United States Patent 10,058,623 (COMPOSITIONS AND METHODS FOR MODULATING UTRN EXPRESSION) - sequence listing, part 9

SEQ ID NO: 295568 - DNA, 15 bp, Homo sapiens
ctggtggaaaccata

SEQ ID NO: 295569 - DNA, 15 bp, Homo sapiens
gctggtggaaaccat

SEQ ID NO: 295570 - DNA, 15 bp, Homo sapiens
tgctggtggaaacca

SEQ ID NO: 295571 - DNA, 15 bp, Homo sapiens
gtgctggtggaaacc

SEQ ID NO: 295572 - DNA, 15 bp, Homo sapiens
tgtgctggtggaaac

SEQ ID NO: 295573 - DNA, 15 bp, Homo sapiens
atgtgctggtggaaa

SEQ ID NO: 295574 - DNA, 15 bp, Homo sapiens
catgtgctggtggaa

SEQ ID NO: 295575 - DNA, 15 bp, Homo sapiens
tcatgtgctggtgga

SEQ ID NO: 295576 - DNA, 15 bp, Homo sapiens
ttcatgtgctggtgg

SEQ ID NO: 295577 - DNA, 15 bp, Homo sapiens
attcatgtgctggtg

SEQ ID NO: 295578 - DNA, 15 bp, Homo sapiens
tattcatgtgctggt

SEQ ID NO: 295579 - DNA, 15 bp, Homo sapiens
atattcatgtgctgg

SEQ ID NO: 295580 - DNA, 15 bp, Homo sapiens
tatattcatgtgctg

SEQ ID NO: 295581 - DNA, 15 bp, Homo sapiens
atatattcatgtgct

SEQ ID NO: 295582 - DNA, 15 bp, Homo sapiens
gatatattcatgtgc

SEQ ID NO: 295583 - DNA, 15 bp, Homo sapiens
agatatattcatgtg

SEQ ID NO: 295584 - DNA, 15 bp, Homo sapiens
tagatatattcatgt

SEQ ID NO: 295585 - DNA, 15 bp, Homo sapiens
atagatatattcatg

SEQ ID NO: 295586 - DNA, 15 bp, Homo sapiens
aatagatatattcat

SEQ ID NO: 295587 - DNA, 15 bp, Homo sapiens
aaatagatatattca

SEQ ID NO: 295588 - DNA, 15 bp, Homo sapiens
caaatagatatattc

SEQ ID NO: 295589 - DNA, 15 bp, Homo sapiens
acaaatagatatatt

SEQ ID NO: 295590 - DNA, 15 bp, Homo sapiens
cacaaatagatatat

SEQ ID NO: 295591 - DNA, 15 bp, Homo sapiens
acacaaatagatata

SEQ ID NO: 295592 - DNA, 15 bp, Homo sapiens
aacacaaatagatat

SEQ ID NO: 295593 - DNA, 15 bp, Homo sapiens
aaacacaaatagata

SEQ ID NO: 295594 - DNA, 15 bp, Homo sapiens
aaaacacaaatagat

SEQ ID NO: 295595 - DNA, 15 bp, Homo sapiens
caaaacacaaataga

SEQ ID NO: 295596 - DNA, 15 bp, Homo sapiens
gcaaaacacaaatag

SEQ ID NO: 295597 - DNA, 15 bp, Homo sapiens
ggcaaaacacaaata

SEQ ID NO: 295598 - DNA, 15 bp, Homo sapiens
tggcaaaacacaaat

SEQ ID NO: 295599 - DNA, 15 bp, Homo sapiens
ctggcaaaacacaaa

SEQ ID NO: 295600 - DNA, 15 bp, Homo sapiens
actggcaaaacacaa

SEQ ID NO: 295601 - DNA, 15 bp, Homo sapiens
cactggcaaaacaca

SEQ ID NO: 295602 - DNA, 15 bp, Homo sapiens
acactggcaaaacac

SEQ ID NO: 295603 - DNA, 15 bp, Homo sapiens
aacactggcaaaaca

SEQ ID NO: 295604 - DNA, 15 bp, Homo sapiens
aaacactggcaaaac

SEQ ID NO: 295605 - DNA, 15 bp, Homo sapiens
gaaacactggcaaaa

SEQ ID NO: 295606 - DNA, 15 bp, Homo sapiens
ggaaacactggcaaa

SEQ ID NO: 295607 - DNA, 15 bp, Homo sapiens
gggaaacactggcaa

SEQ ID NO: 295608 - DNA, 15 bp, Homo sapiens
tgggaaacactggca

SEQ ID NO: 295609 - DNA, 15 bp, Homo sapiens
ctgggaaacactggc

SEQ ID NO: 295610 - DNA, 15 bp, Homo sapiens
cctgggaaacactgg

SEQ ID NO: 295611 - DNA, 15 bp, Homo sapiens
acctgggaaacactg

SEQ ID NO: 295612 - DNA, 15 bp, Homo sapiens
aacctgggaaacact

SEQ ID NO: 295613 - DNA, 15 bp, Homo sapiens
aaacctgggaaacac

SEQ ID NO: 295614 - DNA, 15 bp, Homo sapiens
aaaacctgggaaaca

SEQ ID NO: 295615 - DNA, 15 bp, Homo sapiens
gaaaacctgggaaac

SEQ ID NO: 295616 - DNA, 15 bp, Homo sapiens
tgaaaacctgggaaa

SEQ ID NO: 295617 - DNA, 15 bp, Homo sapiens
atgaaaacctgggaa

SEQ ID NO: 295618 - DNA, 15 bp, Homo sapiens
aatgaaaacctggga

SEQ ID NO: 295619 - DNA, 15 bp, Homo sapiens
aaatgaaaacctggg

SEQ ID NO: 295620 - DNA, 15 bp, Homo sapiens
caaatgaaaacctgg

SEQ ID NO: 295621 - DNA, 15 bp, Homo sapiens
acaaatgaaaacctg

SEQ ID NO: 295622 - DNA, 15 bp, Homo sapiens
tacaaatgaaaacct

SEQ ID NO: 295623 - DNA, 15 bp, Homo sapiens
ctacaaatgaaaacc

SEQ ID NO: 295624 - DNA, 15 bp, Homo sapiens
tctacaaatgaaaac

SEQ ID NO: 295625 - DNA, 15 bp, Homo sapiens
atctacaaatgaaaa

SEQ ID NO: 295626 - DNA, 15 bp, Homo sapiens
gatctacaaatgaaa

SEQ ID NO: 295627 - DNA, 15 bp, Homo sapiens
agatctacaaatgaa

SEQ ID NO: 295628 - DNA, 15 bp, Homo sapiens
tagatctacaaatga

SEQ ID NO: 295629 - DNA, 15 bp, Homo sapiens
gtagatctacaaatg

SEQ ID NO: 295630 - DNA, 15 bp, Homo sapiens
agtagatctacaaat

SEQ ID NO: 295631 - DNA, 15 bp, Homo sapiens
tagtagatctacaaa

SEQ ID NO: 295632 - DNA, 15 bp, Homo sapiens
atagtagatctacaa

SEQ ID NO: 295633 - DNA, 15 bp, Homo sapiens
tatagtagatctaca

SEQ ID NO: 295634 - DNA, 15 bp, Homo sapiens
ttatagtagatctac

SEQ ID NO: 295635 - DNA, 15 bp, Homo sapiens
attatagtagatcta

SEQ ID NO: 295636 - DNA, 15 bp, Homo sapiens
cattatagtagatct

SEQ ID NO: 295637 - DNA, 15 bp, Homo sapiens
gcattatagtagatc

SEQ ID NO: 295638 - DNA, 15 bp, Homo sapiens
agcattatagtagat

SEQ ID NO: 295639 - DNA, 15 bp, Homo sapiens
aagcattatagtaga

SEQ ID NO: 295640 - DNA, 15 bp, Homo sapiens
gaagcattatagtag

SEQ ID NO: 295641 - DNA, 15 bp, Homo sapiens
agaagcattatagta

SEQ ID NO: 295642 - DNA, 15 bp, Homo sapiens
gagaagcattatagt

SEQ ID NO: 295643 - DNA, 15 bp, Homo sapiens
tgagaagcattatag

SEQ ID NO: 295644 - DNA, 15 bp, Homo sapiens
ttgagaagcattata

SEQ ID NO: 295645 - DNA, 15 bp, Homo sapiens
tttgagaagcattat

SEQ ID NO: 295646 - DNA, 15 bp, Homo sapiens
ctttgagaagcatta

SEQ ID NO: 295647 - DNA, 15 bp, Homo sapiens
actttgagaagcatt

SEQ ID NO: 295648 - DNA, 15 bp, Homo sapiens
aactttgagaagcat

SEQ ID NO: 295649 - DNA, 15 bp, Homo sapiens
aaactttgagaagca

SEQ ID NO: 295650 - DNA, 15 bp, Homo sapiens
caaactttgagaagc

SEQ ID NO: 295651 - DNA, 15 bp, Homo sapiens
gcaaactttgagaag

SEQ ID NO: 295652 - DNA, 15 bp, Homo sapiens
tgcaaactttgagaa

SEQ ID NO: 295653 - DNA, 15 bp, Homo sapiens
ctgcaaactttgaga

SEQ ID NO: 295654 - DNA, 15 bp, Homo sapiens
tctgcaaactttgag

SEQ ID NO: 295655 - DNA, 15 bp, Homo sapiens
ttctgcaaactttga

SEQ ID NO: 295656 - DNA, 15 bp, Homo sapiens
attctgcaaactttg

SEQ ID NO: 295657 - DNA, 15 bp, Homo sapiens
gattctgcaaacttt

SEQ ID NO: 295658 - DNA, 15 bp, Homo sapiens
tgattctgcaaactt

SEQ ID NO: 295659 - DNA, 15 bp, Homo sapiens
gtgattctgcaaact

SEQ ID NO: 295660 - DNA, 15 bp, Homo sapiens
tgtgattctgcaaac

SEQ ID NO: 295661 - DNA, 15 bp, Homo sapiens
atgtgattctgcaaa

SEQ ID NO: 295662 - DNA, 15 bp, Homo sapiens
aatgtgattctgcaa

SEQ ID NO: 295663 - DNA, 15 bp, Homo sapiens
aaatgtgattctgca

SEQ ID NO: 295664 - DNA, 15 bp, Homo sapiens
taaatgtgattctgc

SEQ ID NO: 295665 - DNA, 15 bp, Homo sapiens
gtaaatgtgattctg

SEQ ID NO: 295666 - DNA, 15 bp, Homo sapiens
tgtaaatgtgattct

SEQ ID NO: 295667 - DNA, 15 bp, Homo sapiens
gtgtaaatgtgattc

SEQ ID NO: 295668 - DNA, 15 bp, Homo sapiens
agtgtaaatgtgatt

SEQ ID NO: 295669 - DNA, 15 bp, Homo sapiens
tagtgtaaatgtgat

SEQ ID NO: 295670 - DNA, 15 bp, Homo sapiens
gtagtgtaaatgtga

SEQ ID NO: 295671 - DNA, 15 bp, Homo sapiens
tgtagtgtaaatgtg

SEQ ID NO: 295672 - DNA, 15 bp, Homo sapiens
atgtagtgtaaatgt

SEQ ID NO: 295673 - DNA, 15 bp, Homo sapiens
gatgtagtgtaaatg

SEQ ID NO: 295674 - DNA, 15 bp, Homo sapiens
tgatgtagtgtaaat

SEQ ID NO: 295675 - DNA, 15 bp, Homo sapiens
ctgatgtagtgtaaa

SEQ ID NO: 295676 - DNA, 15 bp, Homo sapiens
actgatgtagtgtaa

SEQ ID NO: 295677 - DNA, 15 bp, Homo sapiens
gactgatgtagtgta

SEQ ID NO: 295678 - DNA, 15 bp, Homo sapiens
agactgatgtagtgt

SEQ ID NO: 295679 - DNA, 15 bp, Homo sapiens
gagactgatgtagtg

SEQ ID NO: 295680 - DNA, 15 bp, Homo sapiens
ggagactgatgtagt

SEQ ID NO: 295681 - DNA, 15 bp, Homo sapiens
tggagactgatgtag

SEQ ID NO: 295682 - DNA, 15 bp, Homo sapiens
gtggagactgatgta

SEQ ID NO: 295683 - DNA, 15 bp, Homo sapiens
tgtggagactgatgt

SEQ ID NO: 295684 - DNA, 15 bp, Homo sapiens
gtgtggagactgatg

SEQ ID NO: 295685 - DNA, 15 bp, Homo sapiens
ggtgtggagactgat

SEQ ID NO: 295686 - DNA, 15 bp, Homo sapiens
gggtgtggagactga

SEQ ID NO: 295687 - DNA, 15 bp, Homo sapiens
tgggtgtggagactg

SEQ ID NO: 295688 - DNA, 15 bp, Homo sapiens
gtgggtgtggagact

SEQ ID NO: 295689 - DNA, 15 bp, Homo sapiens
aagaagacatgacta

SEQ ID NO: 295690 - DNA, 15 bp, Homo sapiens
aaagaagacatgact

SEQ ID NO: 295691 - DNA, 15 bp, Homo sapiens
aaaagaagacatgac

SEQ ID NO: 295692 - DNA, 15 bp, Homo sapiens
gaaaagaagacatga

SEQ ID NO: 295693 - DNA, 15 bp, Homo sapiens
tgaaaagaagacatg

SEQ ID NO: 295694 - DNA, 15 bp, Homo sapiens
ttgaaaagaagacat

SEQ ID NO: 295695 - DNA, 15 bp, Homo sapiens
cttgaaaagaagaca

SEQ ID NO: 295696 - DNA, 15 bp, Homo sapiens
tcttgaaaagaagac

SEQ ID NO: 295697 - DNA, 15 bp, Homo sapiens
ttcttgaaaagaaga

SEQ ID NO: 295698 - DNA, 15 bp, Homo sapiens
attcttgaaaagaag

SEQ ID NO: 295699 - DNA, 15 bp, Homo sapiens
aattcttgaaaagaa

SEQ ID NO: 295700 - DNA, 15 bp, Homo sapiens
gaattcttgaaaaga

SEQ ID NO: 295701 - DNA, 15 bp, Homo sapiens
tgaattcttgaaaag

SEQ ID NO: 295702 - DNA, 15 bp, Homo sapiens
ttgaattcttgaaaa

SEQ ID NO: 295703 - DNA, 15 bp, Homo sapiens
cttgaattcttgaaa

SEQ ID NO: 295704 - DNA, 15 bp, Homo sapiens
gcttgaattcttgaa

SEQ ID NO: 295705 - DNA, 15 bp, Homo sapiens
tgcttgaattcttga

SEQ ID NO: 295706 - DNA, 15 bp, Homo sapiens
gtgcttgaattcttg

SEQ ID NO: 295707 - DNA, 15 bp, Homo sapiens
tgtgcttgaattctt

SEQ ID NO: 295708 - DNA, 15 bp, Homo sapiens
atgtgcttgaattct

SEQ ID NO: 295709 - DNA, 15 bp, Homo sapiens
gatgtgcttgaattc

SEQ ID NO: 295710 - DNA, 15 bp, Homo sapiens
ggatgtgcttgaatt

SEQ ID NO: 295711 - DNA, 15 bp, Homo sapiens
tggatgtgcttgaat

SEQ ID NO: 295712 - DNA, 15 bp, Homo sapiens
atggatgtgcttgaa

SEQ ID NO: 295713 - DNA, 15 bp, Homo sapiens
catggatgtgcttga

SEQ ID NO: 295714 - DNA, 15 bp, Homo sapiens
acatggatgtgcttg

SEQ ID NO: 295715 - DNA, 15 bp, Homo sapiens
tacatggatgtgctt

SEQ ID NO: 295716 - DNA, 15 bp, Homo sapiens
atacatggatgtgct

SEQ ID NO: 295717 - DNA, 15 bp, Homo sapiens
catacatggatgtgc

SEQ ID NO: 295718 - DNA, 15 bp, Homo sapiens
tcatacatggatgtg

SEQ ID NO: 295719 - DNA, 15 bp, Homo sapiens
ttcatacatggatgt

SEQ ID NO: 295720 - DNA, 15 bp, Homo sapiens
tttcatacatggatg

SEQ ID NO: 295721 - DNA, 15 bp, Homo sapiens
atttcatacatggat

SEQ ID NO: 295722 - DNA, 15 bp, Homo sapiens
catttcatacatgga

SEQ ID NO: 295723 - DNA, 15 bp, Homo sapiens
tcatttcatacatgg

SEQ ID NO: 295724 - DNA, 15 bp, Homo sapiens
atcatttcatacatg

SEQ ID NO: 295725 - DNA, 15 bp, Homo sapiens
catcatttcatacat

SEQ ID NO: 295726 - DNA, 15 bp, Homo sapiens
tcatcatttcataca

SEQ ID NO: 295727 - DNA, 15 bp, Homo sapiens
ttcatcatttcatac

SEQ ID NO: 295728 - DNA, 15 bp, Homo sapiens
ttttcatcatttcat

SEQ ID NO: 295729 - DNA, 15 bp, Homo sapiens
cttttcatcatttca

SEQ ID NO: 295730 - DNA, 15 bp, Homo sapiens
acttttcatcatttc

SEQ ID NO: 295731 - DNA, 15 bp, Homo sapiens
cacttttcatcattt

SEQ ID NO: 295732 - DNA, 15 bp, Homo sapiens
acacttttcatcatt

SEQ ID NO: 295733 - DNA, 15 bp, Homo sapiens
tacacttttcatcat

SEQ ID NO: 295734 - DNA, 15 bp, Homo sapiens
atacacttttcatca

SEQ ID NO: 295735 - DNA, 15 bp, Homo sapiens
aatacacttttcatc

SEQ ID NO: 295736 - DNA, 15 bp, Homo sapiens
aaatacacttttcat

SEQ ID NO: 295737 - DNA, 15 bp, Homo sapiens
aaaatacacttttca

SEQ ID NO: 295738 - DNA, 15 bp, Homo sapiens
taaaatacacttttc

SEQ ID NO: 295739 - DNA, 15 bp, Homo sapiens
ctaaaatacactttt

SEQ ID NO: 295740 - DNA, 15 bp, Homo sapiens
tctaaaatacacttt

SEQ ID NO: 295741 - DNA, 15 bp, Homo sapiens
ttctaaaatacactt

SEQ ID NO: 295742 - DNA, 15 bp, Homo sapiens
attctaaaatacact

SEQ ID NO: 295743 - DNA, 15 bp, Homo sapiens
gattctaaaatacac

SEQ ID NO: 295744 - DNA, 15 bp, Homo sapiens
ggattctaaaataca

SEQ ID NO: 295745 - DNA, 15 bp, Homo sapiens
aggattctaaaatac

SEQ ID NO: 295746 - DNA, 15 bp, Homo sapiens
aaggattctaaaata

SEQ ID NO: 295747 - DNA, 15 bp, Homo sapiens
aaaggattctaaaat

SEQ ID NO: 295748 - DNA, 15 bp, Homo sapiens
caaaggattctaaaa

SEQ ID NO: 295749 - DNA, 15 bp, Homo sapiens
tcaaaggattctaaa

SEQ ID NO: 295750 - DNA, 15 bp, Homo sapiens
ttcaaaggattctaa

SEQ ID NO: 295751 - DNA, 15 bp, Homo sapiens
tttcaaaggattcta

SEQ ID NO: 295752 - DNA, 15 bp, Homo sapiens
atttcaaaggattct

SEQ ID NO: 295753 - DNA, 15 bp, Homo sapiens
gatttcaaaggattc

SEQ ID NO: 295754 - DNA, 15 bp, Homo sapiens
agatttcaaaggatt

SEQ ID NO: 295755 - DNA, 15 bp, Homo sapiens
gagatttcaaaggat

SEQ ID NO: 295756 - DNA, 15 bp, Homo sapiens
ggagatttcaaagga

SEQ ID NO: 295757 - DNA, 15 bp, Homo sapiens
tggagatttcaaagg

SEQ ID NO: 295758 - DNA, 15 bp, Homo sapiens
atggagatttcaaag

SEQ ID NO: 295759 - DNA, 15 bp, Homo sapiens
catggagatttcaaa

SEQ ID NO: 295760 - DNA, 15 bp, Homo sapiens
acatggagatttcaa

SEQ ID NO: 295761 - DNA, 15 bp, Homo sapiens
aacatggagatttca

SEQ ID NO: 295762 - DNA, 15 bp, Homo sapiens
aaacatggagatttc

SEQ ID NO: 295763 - DNA, 15 bp, Homo sapiens
aaaacatggagattt

SEQ ID NO: 295764 - DNA, 15 bp, Homo sapiens
taaaacatggagatt

SEQ ID NO: 295765 - DNA, 15 bp, Homo sapiens
ttaaaacatggagat

SEQ ID NO: 295766 - DNA, 15 bp, Homo sapiens
attaaaacatggaga

SEQ ID NO: 295767 - DNA, 15 bp, Homo sapiens
aattaaaacatggag

SEQ ID NO: 295768 - DNA, 15 bp, Homo sapiens
aaattaaaacatgga

SEQ ID NO: 295769 - DNA, 15 bp, Homo sapiens
aaaattaaaacatgg

SEQ ID NO: 295770 - DNA, 15 bp, Homo sapiens
aaaaattaaaacatg

SEQ ID NO: 295771 - DNA, 15 bp, Homo sapiens
caaaaattaaaacat

SEQ ID NO: 295772 - DNA, 15 bp, Homo sapiens
ccaaaaattaaaaca

SEQ ID NO: 295773 - DNA, 15 bp, Homo sapiens
gccaaaaattaaaac

SEQ ID NO: 295774 - DNA, 15 bp, Homo sapiens
agccaaaaattaaaa

SEQ ID NO: 295775 - DNA, 15 bp, Homo sapiens
aagccaaaaattaaa

SEQ ID NO: 295776 - DNA, 15 bp, Homo sapiens
gaagccaaaaattaa

SEQ ID NO: 295777 - DNA, 15 bp, Homo sapiens
agaagccaaaaatta

SEQ ID NO: 295778 - DNA, 15 bp, Homo sapiens
cagaagccaaaaatt

SEQ ID NO: 295779 - DNA, 15 bp, Homo sapiens
tcagaagccaaaaat

SEQ ID NO: 295780 - DNA, 15 bp, Homo sapiens
ttcagaagccaaaaa

SEQ ID NO: 295781 - DNA, 15 bp, Homo sapiens
tttcagaagccaaaa

SEQ ID NO: 295782 - DNA, 15 bp, Homo sapiens
ctttcagaagccaaa

SEQ ID NO: 295783 - DNA, 15 bp, Homo sapiens
actttcagaagccaa

SEQ ID NO: 295784 - DNA, 15 bp, Homo sapiens
aactttcagaagcca

SEQ ID NO: 295785 - DNA, 15 bp, Homo sapiens
gaactttcagaagcc

SEQ ID NO: 295786 - DNA, 15 bp, Homo sapiens
agaactttcagaagc

SEQ ID NO: 295787 - DNA, 15 bp, Homo sapiens
cagaactttcagaag

SEQ ID NO: 295788 - DNA, 15 bp, Homo sapiens
gcagaactttcagaa

SEQ ID NO: 295789 - DNA, 15 bp, Homo sapiens
agcagaactttcaga

SEQ ID NO: 295790 - DNA, 15 bp, Homo sapiens
tagcagaactttcag

SEQ ID NO: 295791 - DNA, 15 bp, Homo sapiens
atagcagaactttca

SEQ ID NO: 295792 - DNA, 15 bp, Homo sapiens
aatagcagaactttc

SEQ ID NO: 295793 - DNA, 15 bp, Homo sapiens
gaatagcagaacttt

SEQ ID NO: 295794 - DNA, 15 bp, Homo sapiens
tgaatagcagaactt

SEQ ID NO: 295795 - DNA, 15 bp, Homo sapiens
atgaatagcagaact

SEQ ID NO: 295796 - DNA, 15 bp, Homo sapiens
tatgaatagcagaac

SEQ ID NO: 295797 - DNA, 15 bp, Homo sapiens
atatgaatagcagaa

SEQ ID NO: 295798 - DNA, 15 bp, Homo sapiens
aatatgaatagcaga

SEQ ID NO: 295799 - DNA, 15 bp, Homo sapiens
aaatatgaatagcag

SEQ ID NO: 295800 - DNA, 15 bp, Homo sapiens
aaaatatgaatagca

SEQ ID NO: 295801 - DNA, 15 bp, Homo sapiens
aaaaatatgaatagc

SEQ ID NO: 295802 - DNA, 15 bp, Homo sapiens
aaaaaatatgaatag

SEQ ID NO: 295803 - DNA, 15 bp, Homo sapiens
gaaaaaatatgaata

SEQ ID NO: 295804 - DNA, 15 bp, Homo sapiens
agaaaaaatatgaat

SEQ ID NO: 295805 - DNA, 15 bp, Homo sapiens
gagaaaaaatatgaa

SEQ ID NO: 295806 - DNA, 15 bp, Homo sapiens
agagaaaaaatatga

SEQ ID NO: 295807 - DNA, 15 bp, Homo sapiens
cagagaaaaaatatg

SEQ ID NO: 295808 - DNA, 15 bp, Homo sapiens
ccagagaaaaaatat

SEQ ID NO: 295809 - DNA, 15 bp, Homo sapiens
accagagaaaaaata

SEQ ID NO: 295810 - DNA, 15 bp, Homo sapiens
taccagagaaaaaat

SEQ ID NO: 295811 - DNA, 15 bp, Homo sapiens
ataccagagaaaaaa

SEQ ID NO: 295812 - DNA, 15 bp, Homo sapiens
aataccagagaaaaa

SEQ ID NO: 295813 - DNA, 15 bp, Homo sapiens
taataccagagaaaa

SEQ ID NO: 295814 - DNA, 15 bp, Homo sapiens
ataataccagagaaa

SEQ ID NO: 295815 - DNA, 15 bp, Homo sapiens
tataataccagagaa

SEQ ID NO: 295816 - DNA, 15 bp, Homo sapiens
atataataccagaga

SEQ ID NO: 295817 - DNA, 15 bp, Homo sapiens
tatataataccagag

SEQ ID NO: 295818 - DNA, 15 bp, Homo sapiens
gtatataataccaga

SEQ ID NO: 295819 - DNA, 15 bp, Homo sapiens
tgtatataataccag

SEQ ID NO: 295820 - DNA, 15 bp, Homo sapiens
ttgtatataatacca

SEQ ID NO: 295821 - DNA, 15 bp, Homo sapiens
cttgtatataatacc

SEQ ID NO: 295822 - DNA, 15 bp, Homo sapiens
tcttgtatataatac

SEQ ID NO: 295823 - DNA, 15 bp, Homo sapiens
gtcttgtatataata

SEQ ID NO: 295824 - DNA, 15 bp, Homo sapiens
tgtcttgtatataat

SEQ ID NO: 295825 - DNA, 15 bp, Homo sapiens
ctgtcttgtatataa

SEQ ID NO: 295826 - DNA, 15 bp, Homo sapiens
cctgtcttgtatata

SEQ ID NO: 295827 - DNA, 15 bp, Homo sapiens
ccctgtcttgtatat

SEQ ID NO: 295828 - DNA, 15 bp, Homo sapiens
tccctgtcttgtata

SEQ ID NO: 295829 - DNA, 15 bp, Homo sapiens
gtccctgtcttgtat

SEQ ID NO: 295830 - DNA, 15 bp, Homo sapiens
tgtccctgtcttgta

SEQ ID NO: 295831 - DNA, 15 bp, Homo sapiens
ctgtccctgtcttgt

SEQ ID NO: 295832 - DNA, 15 bp, Homo sapiens
gctgtccctgtcttg

SEQ ID NO: 295833 - DNA, 15 bp, Homo sapiens
agctgtccctgtctt

SEQ ID NO: 295834 - DNA, 15 bp, Homo sapiens
aagctgtccctgtct

SEQ ID NO: 295835 - DNA, 15 bp, Homo sapiens
aaagctgtccctgtc

SEQ ID NO: 295836 - DNA, 15 bp, Homo sapiens
gaaagctgtccctgt

SEQ ID NO: 295837 - DNA, 15 bp, Homo sapiens
ggaaagctgtccctg

SEQ ID NO: 295838 - DNA, 15 bp, Homo sapiens
tggaaagctgtccct

SEQ ID NO: 295839 - DNA, 15 bp, Homo sapiens
atggaaagctgtccc

SEQ ID NO: 295840 - DNA, 15 bp, Homo sapiens
tatggaaagctgtcc

SEQ ID NO: 295841 - DNA, 15 bp, Homo sapiens
ttatggaaagctgtc

SEQ ID NO: 295842 - DNA, 15 bp, Homo sapiens
tttatggaaagctgt

SEQ ID NO: 295843 - DNA, 15 bp, Homo sapiens
ttttatggaaagctg

SEQ ID NO: 295844 - DNA, 15 bp, Homo sapiens
tttttatggaaagct

SEQ ID NO: 295845 - DNA, 15 bp, Homo sapiens
atttttatggaaagc

SEQ ID NO: 295846 - DNA, 15 bp, Homo sapiens
tatttttatggaaag

SEQ ID NO: 295847 - DNA, 15 bp, Homo sapiens
ttatttttatggaaa

SEQ ID NO: 295848 - DNA, 15 bp, Homo sapiens
tttatttttatggaa

SEQ ID NO: 295849 - DNA, 15 bp, Homo sapiens
ttttatttttatgga

SEQ ID NO: 295850 - DNA, 15 bp, Homo sapiens
cttttatttttatgg

SEQ ID NO: 295851 - DNA, 15 bp, Homo sapiens
gcttttatttttatg

SEQ ID NO: 295852 - DNA, 15 bp, Homo sapiens
agcttttatttttat

SEQ ID NO: 295853 - DNA, 15 bp, Homo sapiens
cagcttttattttta

SEQ ID NO: 295854 - DNA, 15 bp, Homo sapiens
acagcttttattttt

SEQ ID NO: 295855 - DNA, 15 bp, Homo sapiens
tacagcttttatttt

SEQ ID NO: 295856 - DNA, 15 bp, Homo sapiens
atacagcttttattt

SEQ ID NO: 295857 - DNA, 15 bp, Homo sapiens
aatacagcttttatt

SEQ ID NO: 295858 - DNA, 15 bp, Homo sapiens
caatacagcttttat

SEQ ID NO: 295859 - DNA, 15 bp, Homo sapiens
tcaatacagctttta

SEQ ID NO: 295860 - DNA, 15 bp, Homo sapiens
gtcaatacagctttt

SEQ ID NO: 295861 - DNA, 15 bp, Homo sapiens
agtcaatacagcttt

SEQ ID NO: 295862 - DNA, 15 bp, Homo sapiens
aagtcaatacagctt

SEQ ID NO: 295863 - DNA, 15 bp, Homo sapiens
taagtcaatacagct

SEQ ID NO: 295864 - DNA, 15 bp, Homo sapiens
ataagtcaatacagc

SEQ ID NO: 295865 - DNA, 15 bp, Homo sapiens
aataagtcaatacag

SEQ ID NO: 295866 - DNA, 15 bp, Homo sapiens
aaataagtcaataca

SEQ ID NO: 295867 - DNA, 15 bp, Homo sapiens
taaataagtcaatac

SEQ ID NO: 295868 - DNA, 15 bp, Homo sapiens
ataaataagtcaata

SEQ ID NO: 295869 - DNA, 15 bp, Homo sapiens
tataaataagtcaat

SEQ ID NO: 295870 - DNA, 15 bp, Homo sapiens
ttataaataagtcaa

SEQ ID NO: 295871 - DNA, 15 bp, Homo sapiens
tttataaataagtca

SEQ ID NO: 295872 - DNA, 15 bp, Homo sapiens
ttttataaataagtc

SEQ ID NO: 295873 - DNA, 15 bp, Homo sapiens
attttataaataagt

SEQ ID NO: 295874 - DNA, 15 bp, Homo sapiens
aattttataaataag

SEQ ID NO: 295875 - DNA, 15 bp, Homo sapiens
caattttataaataa

SEQ ID NO: 295876 - DNA, 15 bp, Homo sapiens
tcaattttataaata

SEQ ID NO: 295877 - DNA, 15 bp, Homo sapiens
atcaattttataaat

SEQ ID NO: 295878 - DNA, 15 bp, Homo sapiens
tatcaattttataaa

SEQ ID NO: 295879 - DNA, 15 bp, Homo sapiens
gtatcaattttataa

SEQ ID NO: 295880 - DNA, 15 bp, Homo sapiens
tgtatcaattttata

SEQ ID NO: 295881 - DNA, 15 bp, Homo sapiens
atgtatcaattttat

SEQ ID NO: 295882 - DNA, 15 bp, Homo sapiens
tatgtatcaatttta

SEQ ID NO: 295883 - DNA, 15 bp, Homo sapiens
atatgtatcaatttt

SEQ ID NO: 295884 - DNA, 15 bp, Homo sapiens
aatatgtatcaattt

SEQ ID NO: 295885 - DNA, 15 bp, Homo sapiens
aaatatgtatcaatt

SEQ ID NO: 295886 - DNA, 15 bp, Homo sapiens
aaaatatgtatcaat

SEQ ID NO: 295887 - DNA, 15 bp, Homo sapiens
gaaaatatgtatcaa

SEQ ID NO: 295888 - DNA, 15 bp, Homo sapiens
tgaaaatatgtatca

SEQ ID NO: 295889 - DNA, 15 bp, Homo sapiens
atgaaaatatgtatc

SEQ ID NO: 295890 - DNA, 15 bp, Homo sapiens
tatgaaaatatgtat

SEQ ID NO: 295891 - DNA, 15 bp, Homo sapiens
atatgaaaatatgta

SEQ ID NO: 295892 - DNA, 15 bp, Homo sapiens
aatatgaaaatatgt

SEQ ID NO: 295893 - DNA, 15 bp, Homo sapiens
gaatatgaaaatatg

SEQ ID NO: 295894 - DNA, 15 bp, Homo sapiens
agaatatgaaaatat

SEQ ID NO: 295895 - DNA, 15 bp, Homo sapiens
cagaatatgaaaata

SEQ ID NO: 295896 - DNA, 15 bp, Homo sapiens
gcagaatatgaaaat

SEQ ID NO: 295897 - DNA, 15 bp, Homo sapiens
ggcagaatatgaaaa

SEQ ID NO: 295898 - DNA, 15 bp, Homo sapiens
aggcagaatatgaaa

SEQ ID NO: 295899 - DNA, 15 bp, Homo sapiens
caggcagaatatgaa

SEQ ID NO: 295900 - DNA, 15 bp, Homo sapiens
acaggcagaatatga

SEQ ID NO: 295901 - DNA, 15 bp, Homo sapiens
tacaggcagaatatg

SEQ ID NO: 295902 - DNA, 15 bp, Homo sapiens
ttacaggcagaatat

SEQ ID NO: 295903 - DNA, 15 bp, Homo sapiens
attacaggcagaata

SEQ ID NO: 295904 - DNA, 15 bp, Homo sapiens
aattacaggcagaat

SEQ ID NO: 295905 - DNA, 15 bp, Homo sapiens
taattacaggcagaa

SEQ ID NO: 295906 - DNA, 15 bp, Homo sapiens
ataattacaggcaga

SEQ ID NO: 295907 - DNA, 15 bp, Homo sapiens
aataattacaggcag

SEQ ID NO: 295908 - DNA, 15 bp, Homo sapiens
taataattacaggca

SEQ ID NO: 295909 - DNA, 15 bp, Homo sapiens
ttaataattacaggc

SEQ ID NO: 295910 - DNA, 15 bp, Homo sapiens
tttaataattacagg

SEQ ID NO: 295911 - DNA, 15 bp, Homo sapiens
gtttaataattacag

SEQ ID NO: 295912 - DNA, 15 bp, Homo sapiens
ggtttaataattaca

SEQ ID NO: 295913 - DNA, 15 bp, Homo sapiens
aggtttaataattac

SEQ ID NO: 295914 - DNA, 15 bp, Homo sapiens
aaggtttaataatta

SEQ ID NO: 295915 - DNA, 15 bp, Homo sapiens
aaaggtttaataatt

SEQ ID NO: 295916 - DNA, 15 bp, Homo sapiens
aaaaggtttaataat

SEQ ID NO: 295917 - DNA, 15 bp, Homo sapiens
taaaaggtttaataa

SEQ ID NO: 295918 - DNA, 15 bp, Homo sapiens
ttaaaaggtttaata

SEQ ID NO: 295919 - DNA, 15 bp, Homo sapiens
tttaaaaggtttaat

SEQ ID NO: 295920 - DNA, 15 bp, Homo sapiens
ttttaaaaggtttaa

SEQ ID NO: 295921 - DNA, 15 bp, Homo sapiens
tttttaaaaggttta

SEQ ID NO: 295922 - DNA, 15 bp, Homo sapiens
atttttaaaaggttt

SEQ ID NO: 295923 - DNA, 15 bp, Homo sapiens
aatttttaaaaggtt

SEQ ID NO: 295924 - DNA, 15 bp, Homo sapiens
caatttttaaaaggt

SEQ ID NO: 295925 - DNA, 15 bp, Homo sapiens
tcaatttttaaaagg

SEQ ID NO: 295926 - DNA, 15 bp, Homo sapiens
atcaatttttaaaag

SEQ ID NO: 295927 - DNA, 15 bp, Homo sapiens
catcaatttttaaaa

SEQ ID NO: 295928 - DNA, 15 bp, Homo sapiens
gcatcaatttttaaa

SEQ ID NO: 295929 - DNA, 15 bp, Homo sapiens
tgcatcaatttttaa

SEQ ID NO: 295930 - DNA, 15 bp, Homo sapiens
ttgcatcaattttta

SEQ ID NO: 295931 - DNA, 15 bp, Homo sapiens
tttgcatcaattttt

SEQ ID NO: 295932 - DNA, 15 bp, Homo sapiens
ttttgcatcaatttt

SEQ ID NO: 295933 - DNA, 15 bp, Homo sapiens
attttgcatcaattt

SEQ ID NO: 295934 - DNA, 15 bp, Homo sapiens
tattttgcatcaatt

SEQ ID NO: 295935 - DNA, 15 bp, Homo sapiens
ctattttgcatcaat

SEQ ID NO: 295936 - DNA, 15 bp, Homo sapiens
tctattttgcatcaa

SEQ ID NO: 295937 - DNA, 15 bp, Homo sapiens
ttctattttgcatca

SEQ ID NO: 295938 - DNA, 15 bp, Homo sapiens
tttctattttgcatc

SEQ ID NO: 295939 - DNA, 15 bp, Homo sapiens
atttctattttgcat

SEQ ID NO: 295940 - DNA, 15 bp, Homo sapiens
gatttctattttgca

SEQ ID NO: 295941 - DNA, 15 bp, Homo sapiens
tgatttctattttgc

SEQ ID NO: 295942 - DNA, 15 bp, Homo sapiens
ctgatttctattttg

SEQ ID NO: 295943 - DNA, 15 bp, Homo sapiens
gctgatttctatttt

SEQ ID NO: 295944 - DNA, 15 bp, Homo sapiens
cgctgatttctattt

SEQ ID NO: 295945 - DNA, 15 bp, Homo sapiens
acgctgatttctatt

SEQ ID NO: 295946 - DNA, 15 bp, Homo sapiens
cacgctgatttctat

SEQ ID NO: 295947 - DNA, 15 bp, Homo sapiens
ccacgctgatttcta

SEQ ID NO: 295948 - DNA, 15 bp, Homo sapiens
cccacgctgatttct

SEQ ID NO: 295949 - DNA, 15 bp, Homo sapiens
tcccacgctgatttc

SEQ ID NO: 295950 - DNA, 15 bp, Homo sapiens
ctcccacgctgattt

SEQ ID NO: 295951 - DNA, 15 bp, Homo sapiens
cctcccacgctgatt

SEQ ID NO: 295952 - DNA, 15 bp, Homo sapiens
acctcccacgctgat

SEQ ID NO: 295953 - DNA, 15 bp, Homo sapiens
tacctcccacgctga

SEQ ID NO: 295954 - DNA, 15 bp, Homo sapiens
ctacctcccacgctg

SEQ ID NO: 295955 - DNA, 15 bp, Homo sapiens
tctacctcccacgct

SEQ ID NO: 295956 - DNA, 15 bp, Homo sapiens
gtctacctcccacgc

SEQ ID NO: 295957 - DNA, 15 bp, Homo sapiens
agtctacctcccacg

SEQ ID NO: 295958 - DNA, 15 bp, Homo sapiens
gagtctacctcccac

SEQ ID NO: 295959 - DNA, 15 bp, Homo sapiens
tgagtctacctccca

SEQ ID NO: 295960 - DNA, 15 bp, Homo sapiens
ctgagtctacctccc

SEQ ID NO: 295961 - DNA, 15 bp, Homo sapiens
actgagtctacctcc

SEQ ID NO: 295962 - DNA, 15 bp, Homo sapiens
cactgagtctacctc

SEQ ID NO: 295963 - DNA, 15 bp, Homo sapiens
gcactgagtctacct

SEQ ID NO: 295964 - DNA, 15 bp, Homo sapiens
ggcactgagtctacc

SEQ ID NO: 295965 - DNA, 15 bp, Homo sapiens
gggcactgagtctac

SEQ ID NO: 295966 - DNA, 15 bp, Homo sapiens
tgggcactgagtcta

SEQ ID NO: 295967 - DNA, 15 bp, Homo sapiens
ctgggcactgagtct

SEQ ID NO: 295968 - DNA, 15 bp, Homo sapiens
actgggcactgagtc

SEQ ID NO: 295969 - DNA, 15 bp, Homo sapiens
cactgggcactgagt

SEQ ID NO: 295970 - DNA, 15 bp, Homo sapiens
gcactgggcactgag

SEQ ID NO: 295971 - DNA, 15 bp, Homo sapiens
tgcactgggcactga

SEQ ID NO: 295972 - DNA, 15 bp, Homo sapiens
atgcactgggcactg

SEQ ID NO: 295973 - DNA, 15 bp, Homo sapiens
catgcactgggcact

SEQ ID NO: 295974 - DNA, 15 bp, Homo sapiens
acatgcactgggcac

SEQ ID NO: 295975 - DNA, 15 bp, Homo sapiens
cacatgcactgggca

SEQ ID NO: 295976 - DNA, 15 bp, Homo sapiens
acacatgcactgggc

SEQ ID NO: 295977 - DNA, 15 bp, Homo sapiens
gacacatgcactggg

SEQ ID NO: 295978 - DNA, 15 bp, Homo sapiens
agacacatgcactgg

SEQ ID NO: 295979 - DNA, 15 bp, Homo sapiens
aagacacatgcactg

SEQ ID NO: 295980 - DNA, 15 bp, Homo sapiens
gaaagacacatgcac

SEQ ID NO: 295981 - DNA, 15 bp, Homo sapiens
agaaagacacatgca

SEQ ID NO: 295982 - DNA, 15 bp, Homo sapiens
gagaaagacacatgc

SEQ ID NO: 295983 - DNA, 15 bp, Homo sapiens
agagaaagacacatg

SEQ ID NO: 295984 - DNA, 15 bp, Homo sapiens
gagagaaagacacat

SEQ ID NO: 295985 - DNA, 15 bp, Homo sapiens
agagagaaagacaca

SEQ ID NO: 295986 - DNA, 15 bp, Homo sapiens
gagagagaaagacac

SEQ ID NO: 295987 - DNA, 15 bp, Homo sapiens
agagagagaaagaca

SEQ ID NO: 295988 - DNA, 15 bp, Homo sapiens
aagagagagaaagac

SEQ ID NO: 295989 - DNA, 15 bp, Homo sapiens
aaagagagagaaaga

SEQ ID NO: 295990 - DNA, 15 bp, Homo sapiens
aaaagagagagaaag

SEQ ID NO: 295991 - DNA, 15 bp, Homo sapiens
aaaaagagagagaaa

SEQ ID NO: 295992 - DNA, 15 bp, Homo sapiens
tctcagaaaaaaaaa

SEQ ID NO: 295993 - DNA, 15 bp, Homo sapiens
gtctcagaaaaaaaa

SEQ ID NO: 295994 - DNA, 15 bp, Homo sapiens
tgtctcagaaaaaaa

SEQ ID NO: 295995 - DNA, 15 bp, Homo sapiens
ctgtctcagaaaaaa

SEQ ID NO: 295996 - DNA, 15 bp, Homo sapiens
tctgtctcagaaaaa

SEQ ID NO: 295997 - DNA, 15 bp, Homo sapiens
ctctgtctcagaaaa

SEQ ID NO: 295998 - DNA, 15 bp, Homo sapiens
tctctgtctcagaaa

SEQ ID NO: 295999 - DNA, 15 bp, Homo sapiens
gtctctgtctcagaa

SEQ ID NO: 296000 - DNA, 15 bp, Homo sapiens
agtctctgtctcaga

SEQ ID NO: 296001 - DNA, 15 bp, Homo sapiens
gagtctctgtctcag

SEQ ID NO: 296002 - DNA, 15 bp, Homo sapiens
tgagtctctgtctca

SEQ ID NO: 296003 - DNA, 15 bp, Homo sapiens
gtgagtctctgtctc

SEQ ID NO: 296004 - DNA, 15 bp, Homo sapiens
agtgagtctctgtct

SEQ ID NO: 296005 - DNA, 15 bp, Homo sapiens
gagtgagtctctgtc

SEQ ID NO: 296006 - DNA, 15 bp, Homo sapiens
agagtgagtctctgt

SEQ ID NO: 296007 - DNA, 15 bp, Homo sapiens
cagagtgagtctctg

SEQ ID NO: 296008 - DNA, 15 bp, Homo sapiens
acagagtgagtctct

SEQ ID NO: 296009 - DNA, 15 bp, Homo sapiens
aacagagtgagtctc

SEQ ID NO: 296010 - DNA, 15 bp, Homo sapiens
caacagagtgagtct

SEQ ID NO: 296011 - DNA, 15 bp, Homo sapiens
gcaacagagtgagtc

SEQ ID NO: 296012 - DNA, 15 bp, Homo sapiens
ggcaacagagtgagt

SEQ ID NO: 296013 - DNA, 15 bp, Homo sapiens
gaactccagcctggg

SEQ ID NO: 296014 - DNA, 15 bp, Homo sapiens
tgaactccagcctgg

SEQ ID NO: 296015 - DNA, 15 bp, Homo sapiens
ttgaactccagcctg

SEQ ID NO: 296016 - DNA, 15 bp, Homo sapiens
attgaactccagcct

SEQ ID NO: 296017 - DNA, 15 bp, Homo sapiens
cattgaactccagcc

SEQ ID NO: 296018 - DNA, 15 bp, Homo sapiens
ccattgaactccagc

SEQ ID NO: 296019 - DNA, 15 bp, Homo sapiens
gccattgaactccag

SEQ ID NO: 296020 - DNA, 15 bp, Homo sapiens
tgccattgaactcca

SEQ ID NO: 296021 - DNA, 15 bp, Homo sapiens
gtgccattgaactcc

SEQ ID NO: 296022 - DNA, 15 bp, Homo sapiens
cgtgccattgaactc

SEQ ID NO: 296023 - DNA, 15 bp, Homo sapiens
tcgtgccattgaact

SEQ ID NO: 296024 - DNA, 15 bp, Homo sapiens
atcgtgccattgaac

SEQ ID NO: 296025 - DNA, 15 bp, Homo sapiens
gatcgtgccattgaa

SEQ ID NO: 296026 - DNA, 15 bp, Homo sapiens
agatcgtgccattga

SEQ ID NO: 296027 - DNA, 15 bp, Homo sapiens
cctgagatcgtgcca

SEQ ID NO: 296028 - DNA, 15 bp, Homo sapiens
acctgagatcgtgcc

SEQ ID NO: 296029 - DNA, 15 bp, Homo sapiens
gacctgagatcgtgc

SEQ ID NO: 296030 - DNA, 15 bp, Homo sapiens
agacctgagatcgtg

SEQ ID NO: 296031 - DNA, 15 bp, Homo sapiens
cagacctgagatcgt

SEQ ID NO: 296032 - DNA, 15 bp, Homo sapiens
acagacctgagatcg

SEQ ID NO: 296033 - DNA, 15 bp, Homo sapiens
tacagacctgagatc

SEQ ID NO: 296034 - DNA, 15 bp, Homo sapiens
atacagacctgagat

SEQ ID NO: 296035 - DNA, 15 bp, Homo sapiens
tatacagacctgaga

SEQ ID NO: 296036 - DNA, 15 bp, Homo sapiens
ttatacagacctgag

SEQ ID NO: 296037 - DNA, 15 bp, Homo sapiens
gttatacagacctga

SEQ ID NO: 296038 - DNA, 15 bp, Homo sapiens
ggttatacagacctg

SEQ ID NO: 296039 - DNA, 15 bp, Homo sapiens
aggttatacagacct

SEQ ID NO: 296040 - DNA, 15 bp, Homo sapiens
gaggttatacagacc

SEQ ID NO: 296041 - DNA, 15 bp, Homo sapiens
ggaggttatacagac

SEQ ID NO: 296042 - DNA, 15 bp, Homo sapiens
tggaggttatacaga

SEQ ID NO: 296043 - DNA, 15 bp, Homo sapiens
gtggaggttatacag

SEQ ID NO: 296044 - DNA, 15 bp, Homo sapiens
ggtggaggttataca

SEQ ID NO: 296045 - DNA, 15 bp, Homo sapiens
aggtggaggttatac

SEQ ID NO: 296046 - DNA, 15 bp, Homo sapiens
gaggtggaggttata

SEQ ID NO: 296047 - DNA, 15 bp, Homo sapiens
ggaggtggaggttat

SEQ ID NO: 296048 - DNA, 15 bp, Homo sapiens
gggaggtggaggtta

SEQ ID NO: 296049 - DNA, 15 bp, Homo sapiens
gcctgggaggtggag

SEQ ID NO: 296050 - DNA, 15 bp, Homo sapiens
tgagcctgggaggtg

SEQ ID NO: 296051 - DNA, 15 bp, Homo sapiens
ttgcttgagcctggg

SEQ ID NO: 296052 - DNA, 15 bp, Homo sapiens
attgcttgagcctgg

SEQ ID NO: 296053 - DNA, 15 bp, Homo sapiens
aattgcttgagcctg

SEQ ID NO: 296054 - DNA, 15 bp, Homo sapiens
gaattgcttgagcct

SEQ ID NO: 296055 - DNA, 15 bp, Homo sapiens
tgagaattgcttgag

SEQ ID NO: 296056 - DNA, 15 bp, Homo sapiens
gtggtggcatgtgcc

SEQ ID NO: 296057 - DNA, 15 bp, Homo sapiens
cgtggtggcatgtgc

SEQ ID NO: 296058 - DNA, 15 bp, Homo sapiens
gcgtggtggcatgtg

SEQ ID NO: 296059 - DNA, 15 bp, Homo sapiens
ggcgtggtggcatgt

SEQ ID NO: 296060 - DNA, 15 bp, Homo sapiens
gggcgtggtggcatg

SEQ ID NO: 296061 - DNA, 15 bp, Homo sapiens
tgggcgtggtggcat

SEQ ID NO: 296062 - DNA, 15 bp, Homo sapiens
ttgggcgtggtggca

SEQ ID NO: 296063 - DNA, 15 bp, Homo sapiens
gttgggcgtggtggc

SEQ ID NO: 296064 - DNA, 15 bp, Homo sapiens
agttgggcgtggtgg

SEQ ID NO: 296065 - DNA, 15 bp, Homo sapiens
tagttgggcgtggtg

SEQ ID NO: 296066 - DNA, 15 bp, Homo sapiens
ttagttgggcgtggt

SEQ ID NO: 296067 - DNA, 15 bp, Homo sapiens
attagttgggcgtgg

SEQ ID NO: 296068 - DNA, 15 bp, Homo sapiens
aattagttgggcgtg

SEQ ID NO: 296069 - DNA, 15 bp, Homo sapiens
aaattagttgggcgt

SEQ ID NO: 296070 - DNA, 15 bp, Homo sapiens
aaaattagttgggcg

SEQ ID NO: 296071 - DNA, 15 bp, Homo sapiens
gatctctactaaaaa

SEQ ID NO: 296072 - DNA, 15 bp, Homo sapiens
cgatctctactaaaa

SEQ ID NO: 296073 - DNA, 15 bp, Homo sapiens
ccgatctctactaaa

SEQ ID NO: 296074 - DNA, 15 bp, Homo sapiens
cccgatctctactaa

SEQ ID NO: 296075 - DNA, 15 bp, Homo sapiens
acccgatctctacta

SEQ ID NO: 296076 - DNA, 15 bp, Homo sapiens
aacccgatctctact

SEQ ID NO: 296077 - DNA, 15 bp, Homo sapiens
aaacccgatctctac

SEQ ID NO: 296078 - DNA, 15 bp, Homo sapiens
gaaacccgatctcta

SEQ ID NO: 296079 - DNA, 15 bp, Homo sapiens
tgaaacccgatctct

SEQ ID NO: 296080 - DNA, 15 bp, Homo sapiens
gtgaaacccgatctc

SEQ ID NO: 296081 - DNA, 15 bp, Homo sapiens
ggtgaaacccgatct

SEQ ID NO: 296082 - DNA, 15 bp, Homo sapiens
tggtgaaacccgatc

SEQ ID NO: 296083 - DNA, 15 bp, Homo sapiens
atggtgaaacccgat

SEQ ID NO: 296084 - DNA, 15 bp, Homo sapiens
catggtgaaacccga

SEQ ID NO: 296085 - DNA, 15 bp, Homo sapiens
acatggtgaaacccg

SEQ ID NO: 296086 - DNA, 15 bp, Homo sapiens
gtcacttgaggccag

SEQ ID NO: 296087 - DNA, 15 bp, Homo sapiens
ggtcacttgaggcca

SEQ ID NO: 296088 - DNA, 15 bp, Homo sapiens
gggtcacttgaggcc

SEQ ID NO: 296089 - DNA, 15 bp, Homo sapiens
tgggtcacttgaggc

SEQ ID NO: 296090 - DNA, 15 bp, Homo sapiens
gtgggtcacttgagg

SEQ ID NO: 296091 - DNA, 15 bp, Homo sapiens
ggtgggtcacttgag

SEQ ID NO: 296092 - DNA, 15 bp, Homo sapiens
gggtgggtcacttga

SEQ ID NO: 296093 - DNA, 15 bp, Homo sapiens
tgggtgggtcacttg

SEQ ID NO: 296094 - DNA, 15 bp, Homo sapiens
gtgggtgggtcactt

SEQ ID NO: 296095 - DNA, 15 bp, Homo sapiens
ggtgggtgggtcact

SEQ ID NO: 296096 - DNA, 15 bp, Homo sapiens
gggtgggtgggtcac

SEQ ID NO: 296097 - DNA, 15 bp, Homo sapiens
agggtgggtgggtca

SEQ ID NO: 296098 - DNA, 15 bp, Homo sapiens
cagggtgggtgggtc

SEQ ID NO: 296099 - DNA, 15 bp, Homo sapiens
ccagggtgggtgggt

SEQ ID NO: 296100 - DNA, 15 bp, Homo sapiens
gccagggtgggtggg

SEQ ID NO: 296101 - DNA, 15 bp, Homo sapiens
ggccagggtgggtgg

SEQ ID NO: 296102 - DNA, 15 bp, Homo sapiens
aggccagggtgggtg

SEQ ID NO: 296103 - DNA, 15 bp, Homo sapiens
gaggccagggtgggt

SEQ ID NO: 296104 - DNA, 15 bp, Homo sapiens
ggaggccagggtggg

SEQ ID NO: 296105 - DNA, 15 bp, Homo sapiens
gggaggccagggtgg

SEQ ID NO: 296106 - DNA, 15 bp, Homo sapiens
tgggaggccagggtg

SEQ ID NO: 296107 - DNA, 15 bp, Homo sapiens
ttgggaggccagggt

SEQ ID NO: 296108 - DNA, 15 bp, Homo sapiens
tttgggaggccaggg

SEQ ID NO: 296109 - DNA, 15 bp, Homo sapiens
gtttgggaggccagg

SEQ ID NO: 296110 - DNA, 15 bp, Homo sapiens
ggtttgggaggccag

SEQ ID NO: 296111 - DNA, 15 bp, Homo sapiens
cggtttgggaggcca

SEQ ID NO: 296112 - DNA, 15 bp, Homo sapiens
gcggtttgggaggcc

SEQ ID NO: 296113 - DNA, 15 bp, Homo sapiens
agcggtttgggaggc

SEQ ID NO: 296114 - DNA, 15 bp, Homo sapiens
cagcggtttgggagg

SEQ ID NO: 296115 - DNA, 15 bp, Homo sapiens
ccagcggtttgggag

SEQ ID NO: 296116 - DNA, 15 bp, Homo sapiens
cccagcggtttggga

SEQ ID NO: 296117 - DNA, 15 bp, Homo sapiens
tcccagcggtttggg

SEQ ID NO: 296118 - DNA, 15 bp, Homo sapiens
atcccagcggtttgg

SEQ ID NO: 296119 - DNA, 15 bp, Homo sapiens
aatcccagcggtttg

SEQ ID NO: 296120 - DNA, 15 bp, Homo sapiens
taatcccagcggttt

SEQ ID NO: 296121 - DNA, 15 bp, Homo sapiens
gtaatcccagcggtt

SEQ ID NO: 296122 - DNA, 15 bp, Homo sapiens
tgtaatcccagcggt

SEQ ID NO: 296123 - DNA, 15 bp, Homo sapiens
gtgtaatcccagcgg

SEQ ID NO: 296124 - DNA, 15 bp, Homo sapiens
cgtgtaatcccagcg

SEQ ID NO: 296125 - DNA, 15 bp, Homo sapiens
gcgtgtaatcccagc

SEQ ID NO: 296126 - DNA, 15 bp, Homo sapiens
cgcgtgtaatcccag

SEQ ID NO: 296127 - DNA, 15 bp, Homo sapiens
acgcgtgtaatccca

SEQ ID NO: 296128 - DNA, 15 bp, Homo sapiens
cacgcgtgtaatccc

SEQ ID NO: 296129 - DNA, 15 bp, Homo sapiens
tcacgcgtgtaatcc

SEQ ID NO: 296130 - DNA, 15 bp, Homo sapiens
ctcacgcgtgtaatc

SEQ ID NO: 296131 - DNA, 15 bp, Homo sapiens
gctcacgcgtgtaat

SEQ ID NO: 296132 - DNA, 15 bp, Homo sapiens
ggctcacgcgtgtaa

SEQ ID NO: 296133 - DNA, 15 bp, Homo sapiens
tggctcacgcgtgta

SEQ ID NO: 296134 - DNA, 15 bp, Homo sapiens
gtggctcacgcgtgt

SEQ ID NO: 296135 - DNA, 15 bp, Homo sapiens
ggtggctcacgcgtg

SEQ ID NO: 296136 - DNA, 15 bp, Homo sapiens
tggtggctcacgcgt

SEQ ID NO: 296137 - DNA, 15 bp, Homo sapiens
gtggtggctcacgcg

SEQ ID NO: 296138 - DNA, 15 bp, Homo sapiens
gggccgggtgtggtg

SEQ ID NO: 296139 - DNA, 15 bp, Homo sapiens
ggggccgggtgtggt

SEQ ID NO: 296140 - DNA, 15 bp, Homo sapiens
tggggccgggtgtgg

SEQ ID NO: 296141 - DNA, 15 bp, Homo sapiens
ttggggccgggtgtg

SEQ ID NO: 296142 - DNA, 15 bp, Homo sapiens
attggggccgggtgt

SEQ ID NO: 296143 - DNA, 15 bp, Homo sapiens
tattggggccgggtg

SEQ ID NO: 296144 - DNA, 15 bp, Homo sapiens
gtattggggccgggt

SEQ ID NO: 296145 - DNA, 15 bp, Homo sapiens
tgtattggggccggg

SEQ ID NO: 296146 - DNA, 15 bp, Homo sapiens
atgtattggggccgg

SEQ ID NO: 296147 - DNA, 15 bp, Homo sapiens
catgtattggggccg

SEQ ID NO: 296148 - DNA, 15 bp, Homo sapiens
acatgtattggggcc

SEQ ID NO: 296149 - DNA, 15 bp, Homo sapiens
aacatgtattggggc

SEQ ID NO: 296150 - DNA, 15 bp, Homo sapiens
aaacatgtattgggg

SEQ ID NO: 296151 - DNA, 15 bp, Homo sapiens
gaaacatgtattggg

SEQ ID NO: 296152 - DNA, 15 bp, Homo sapiens
agaaacatgtattgg

SEQ ID NO: 296153 - DNA, 15 bp, Homo sapiens
cagaaacatgtattg

SEQ ID NO: 296154 - DNA, 15 bp, Homo sapiens
tcagaaacatgtatt

SEQ ID NO: 296155 - DNA, 15 bp, Homo sapiens
gtcagaaacatgtat

SEQ ID NO: 296156 - DNA, 15 bp, Homo sapiens
agtcagaaacatgta

SEQ ID NO: 296157 - DNA, 15 bp, Homo sapiens
aagtcagaaacatgt

SEQ ID NO: 296158 - DNA, 15 bp, Homo sapiens
caagtcagaaacatg

SEQ ID NO: 296159 - DNA, 15 bp, Homo sapiens
tcaagtcagaaacat

SEQ ID NO: 296160 - DNA, 15 bp, Homo sapiens
ctcaagtcagaaaca

SEQ ID NO: 296161 - DNA, 15 bp, Homo sapiens
actcaagtcagaaac

SEQ ID NO: 296162 - DNA, 15 bp, Homo sapiens
cactcaagtcagaaa

SEQ ID NO: 296163 - DNA, 15 bp, Homo sapiens
tcactcaagtcagaa

SEQ ID NO: 296164 - DNA, 15 bp, Homo sapiens
ttcactcaagtcaga

SEQ ID NO: 296165 - DNA, 15 bp, Homo sapiens
attcactcaagtcag

SEQ ID NO: 296166 - DNA, 15 bp, Homo sapiens
cattcactcaagtca

SEQ ID NO: 296167 - DNA, 15 bp, Homo sapiens
tcattcactcaagtc

SEQ ID NO: 296168 - DNA, 15 bp, Homo sapiens
atcattcactcaagt

SEQ ID NO: 296169 - DNA, 15 bp, Homo sapiens
aatcattcactcaag

SEQ ID NO: 296170 - DNA, 15 bp, Homo sapiens
taatcattcactcaa

SEQ ID NO: 296171 - DNA, 15 bp, Homo sapiens
gtaatcattcactca

SEQ ID NO: 296172 - DNA, 15 bp, Homo sapiens
tgtaatcattcactc

SEQ ID NO: 296173 - DNA, 15 bp, Homo sapiens
atgtaatcattcact

SEQ ID NO: 296174 - DNA, 15 bp, Homo sapiens
aatgtaatcattcac

SEQ ID NO: 296175 - DNA, 15 bp, Homo sapiens
aaatgtaatcattca

SEQ ID NO: 296176 - DNA, 15 bp, Homo sapiens
aaaatgtaatcattc

SEQ ID NO: 296177 - DNA, 15 bp, Homo sapiens
gaaaatgtaatcatt

SEQ ID NO: 296178 - DNA, 15 bp, Homo sapiens
agaaaatgtaatcat

SEQ ID NO: 296179 - DNA, 15 bp, Homo sapiens
tagaaaatgtaatca

SEQ ID NO: 296180 - DNA, 15 bp, Homo sapiens
ctagaaaatgtaatc

SEQ ID NO: 296181 - DNA, 15 bp, Homo sapiens
gctagaaaatgtaat

SEQ ID NO: 296182 - DNA, 15 bp, Homo sapiens
agctagaaaatgtaa

SEQ ID NO: 296183 - DNA, 15 bp, Homo sapiens
cagctagaaaatgta

SEQ ID NO: 296184 - DNA, 15 bp, Homo sapiens
ccagctagaaaatgt

SEQ ID NO: 296185 - DNA, 15 bp, Homo sapiens
cccagctagaaaatg

SEQ ID NO: 296186 - DNA, 15 bp, Homo sapiens
tcccagctagaaaat

SEQ ID NO: 296187 - DNA, 15 bp, Homo sapiens
ttcccagctagaaaa

SEQ ID NO: 296188 - DNA, 15 bp, Homo sapiens
cttcccagctagaaa

SEQ ID NO: 296189 - DNA, 15 bp, Homo sapiens
ccttcccagctagaa

SEQ ID NO: 296190 - DNA, 15 bp, Homo sapiens
accttcccagctaga

SEQ ID NO: 296191 - DNA, 15 bp, Homo sapiens
aaccttcccagctag

SEQ ID NO: 296192 - DNA, 15 bp, Homo sapiens
aaaccttcccagcta

SEQ ID NO: 296193 - DNA, 15 bp, Homo sapiens
gaaaccttcccagct

SEQ ID NO: 296194 - DNA, 15 bp, Homo sapiens
ggaaaccttcccagc

SEQ ID NO: 296195 - DNA, 15 bp, Homo sapiens
aggaaaccttcccag

SEQ ID NO: 296196 - DNA, 15 bp, Homo sapiens
aaggaaaccttccca

SEQ ID NO: 296197 - DNA, 15 bp, Homo sapiens
caaggaaaccttccc

SEQ ID NO: 296198 - DNA, 15 bp, Homo sapiens
acaaggaaaccttcc

SEQ ID NO: 296199 - DNA, 15 bp, Homo sapiens
tacaaggaaaccttc

SEQ ID NO: 296200 - DNA, 15 bp, Homo sapiens
ctacaaggaaacctt

SEQ ID NO: 296201 - DNA, 15 bp, Homo sapiens
gctacaaggaaacct

SEQ ID NO: 296202 - DNA, 15 bp, Homo sapiens
tgctacaaggaaacc

SEQ ID NO: 296203 - DNA, 15 bp, Homo sapiens
atgctacaaggaaac

SEQ ID NO: 296204 - DNA, 15 bp, Homo sapiens
aatgctacaaggaaa

SEQ ID NO: 296205 - DNA, 15 bp, Homo sapiens
gaatgctacaaggaa

SEQ ID NO: 296206 - DNA, 15 bp, Homo sapiens
ggaatgctacaagga

SEQ ID NO: 296207 - DNA, 15 bp, Homo sapiens
aggaatgctacaagg

SEQ ID NO: 296208 - DNA, 15 bp, Homo sapiens
taggaatgctacaag

SEQ ID NO: 296209 - DNA, 15 bp, Homo sapiens
ctaggaatgctacaa

SEQ ID NO: 296210 - DNA, 15 bp, Homo sapiens
tctaggaatgctaca

SEQ ID NO: 296211 - DNA, 15 bp, Homo sapiens
atctaggaatgctac

SEQ ID NO: 296212 - DNA, 15 bp, Homo sapiens
tatctaggaatgcta

SEQ ID NO: 296213 - DNA, 15 bp, Homo sapiens
ctatctaggaatgct

SEQ ID NO: 296214 - DNA, 15 bp, Homo sapiens
actatctaggaatgc

SEQ ID NO: 296215 - DNA, 15 bp, Homo sapiens
tactatctaggaatg

SEQ ID NO: 296216 - DNA, 15 bp, Homo sapiens
gtactatctaggaat

SEQ ID NO: 296217 - DNA, 15 bp, Homo sapiens
agtactatctaggaa

SEQ ID NO: 296218 - DNA, 15 bp, Homo sapiens
gagtactatctagga

SEQ ID NO: 296219 - DNA, 15 bp, Homo sapiens
tgagtactatctagg

SEQ ID NO: 296220 - DNA, 15 bp, Homo sapiens
ctgagtactatctag

SEQ ID NO: 296221 - DNA, 15 bp, Homo sapiens
tctgagtactatcta

SEQ ID NO: 296222 - DNA, 15 bp, Homo sapiens
ttctgagtactatct

SEQ ID NO: 296223 - DNA, 15 bp, Homo sapiens
gttctgagtactatc

SEQ ID NO: 296224 - DNA, 15 bp, Homo sapiens
cgttctgagtactat

SEQ ID NO: 296225 - DNA, 15 bp, Homo sapiens
acgttctgagtacta

SEQ ID NO: 296226 - DNA, 15 bp, Homo sapiens
aacgttctgagtact

SEQ ID NO: 296227 - DNA, 15 bp, Homo sapiens
aaacgttctgagtac

SEQ ID NO: 296228 - DNA, 15 bp, Homo sapiens
aaaacgttctgagta

SEQ ID NO: 296229 - DNA, 15 bp, Homo sapiens
caaaacgttctgagt

SEQ ID NO: 296230 - DNA, 15 bp, Homo sapiens
acaaaacgttctgag

SEQ ID NO: 296231 - DNA, 15 bp, Homo sapiens
tacaaaacgttctga

SEQ ID NO: 296232 - DNA, 15 bp, Homo sapiens
ctacaaaacgttctg

SEQ ID NO: 296233 - DNA, 15 bp, Homo sapiens
cctacaaaacgttct

SEQ ID NO: 296234 - DNA, 15 bp, Homo sapiens
tcctacaaaacgttc

SEQ ID NO: 296235 - DNA, 15 bp, Homo sapiens
atcctacaaaacgtt

SEQ ID NO: 296236 - DNA, 15 bp, Homo sapiens
aatcctacaaaacgt

SEQ ID NO: 296237 - DNA, 15 bp, Homo sapiens
gaatcctacaaaacg

SEQ ID NO: 296238 - DNA, 15 bp, Homo sapiens
tgaatcctacaaaac

SEQ ID NO: 296239 - DNA, 15 bp, Homo sapiens
atgaatcctacaaaa

SEQ ID NO: 296240 - DNA, 15 bp, Homo sapiens
aatgaatcctacaaa

SEQ ID NO: 296241 - DNA, 15 bp, Homo sapiens
aaatgaatcctacaa

SEQ ID NO: 296242 - DNA, 15 bp, Homo sapiens
caaatgaatcctaca

SEQ ID NO: 296243 - DNA, 15 bp, Homo sapiens
acaaatgaatcctac

SEQ ID NO: 296244 - DNA, 15 bp, Homo sapiens
aacaaatgaatccta

SEQ ID NO: 296245 - DNA, 15 bp, Homo sapiens
gaacaaatgaatcct

SEQ ID NO: 296246 - DNA, 15 bp, Homo sapiens
agaacaaatgaatcc

SEQ ID NO: 296247 - DNA, 15 bp, Homo sapiens
aagaacaaatgaatc

SEQ ID NO: 296248 - DNA, 15 bp, Homo sapiens
aaagaacaaatgaat

SEQ ID NO: 296249 - DNA, 15 bp, Homo sapiens
aaaagaacaaatgaa

SEQ ID NO: 296250 - DNA, 15 bp, Homo sapiens
caaaagaacaaatga

SEQ ID NO: 296251 - DNA, 15 bp, Homo sapiens
acaaaagaacaaatg

SEQ ID NO: 296252 - DNA, 15 bp, Homo sapiens
gacaaaagaacaaat

SEQ ID NO: 296253 - DNA, 15 bp, Homo sapiens
ggacaaaagaacaaa

SEQ ID NO: 296254 - DNA, 15 bp, Homo sapiens
gggacaaaagaacaa

SEQ ID NO: 296255 - DNA, 15 bp, Homo sapiens
agggacaaaagaaca

SEQ ID NO: 296256 - DNA, 15 bp, Homo sapiens
aagggacaaaagaac

SEQ ID NO: 296257 - DNA, 15 bp, Homo sapiens
aaagggacaaaagaa

SEQ ID NO: 296258 - DNA, 15 bp, Homo sapiens
taaagggacaaaaga

SEQ ID NO: 296259 - DNA, 15 bp, Homo sapiens
ttaaagggacaaaag

SEQ ID NO: 296260 - DNA, 15 bp, Homo sapiens
tttaaagggacaaaa

SEQ ID NO: 296261 - DNA, 15 bp, Homo sapiens
ctttaaagggacaaa

SEQ ID NO: 296262 - DNA, 15 bp, Homo sapiens
actttaaagggacaa

SEQ ID NO: 296263 - DNA, 15 bp, Homo sapiens
aactttaaagggaca

SEQ ID NO: 296264 - DNA, 15 bp, Homo sapiens
caactttaaagggac

SEQ ID NO: 296265 - DNA, 15 bp, Homo sapiens
gcaactttaaaggga

SEQ ID NO: 296266 - DNA, 15 bp, Homo sapiens
agcaactttaaaggg

SEQ ID NO: 296267 - DNA, 15 bp, Homo sapiens
gagcaactttaaagg

SEQ ID NO: 296268 - DNA, 15 bp, Homo sapiens
tgagcaactttaaag

SEQ ID NO: 296269 - DNA, 15 bp, Homo sapiens
ctgagcaactttaaa

SEQ ID NO: 296270 - DNA, 15 bp, Homo sapiens
gctgagcaactttaa

SEQ ID NO: 296271 - DNA, 15 bp, Homo sapiens
ggctgagcaacttta

SEQ ID NO: 296272 - DNA, 15 bp, Homo sapiens
tggctgagcaacttt

SEQ ID NO: 296273 - DNA, 15 bp, Homo sapiens
ctggctgagcaactt

SEQ ID NO: 296274 - DNA, 15 bp, Homo sapiens
gctggctgagcaact

SEQ ID NO: 296275 - DNA, 15 bp, Homo sapiens
tgctggctgagcaac

SEQ ID NO: 296276 - DNA, 15 bp, Homo sapiens
ttgctggctgagcaa

SEQ ID NO: 296277 - DNA, 15 bp, Homo sapiens
tttgctggctgagca

SEQ ID NO: 296278 - DNA, 15 bp, Homo sapiens
atttgctggctgagc

SEQ ID NO: 296279 - DNA, 15 bp, Homo sapiens
tatttgctggctgag

SEQ ID NO: 296280 - DNA, 15 bp, Homo sapiens
atatttgctggctga

SEQ ID NO: 296281 - DNA, 15 bp, Homo sapiens
aatatttgctggctg

SEQ ID NO: 296282 - DNA, 15 bp, Homo sapiens
aaatatttgctggct

SEQ ID NO: 296283 - DNA, 15 bp, Homo sapiens
aaaatatttgctggc

SEQ ID NO: 296284 - DNA, 15 bp, Homo sapiens
taaaatatttgctgg

SEQ ID NO: 296285 - DNA, 15 bp, Homo sapiens
ttaaaatatttgctg

SEQ ID NO: 296286 - DNA, 15 bp, Homo sapiens
attaaaatatttgct

SEQ ID NO: 296287 - DNA, 15 bp, Homo sapiens
tattaaaatatttgc

SEQ ID NO: 296288 - DNA, 15 bp, Homo sapiens
ttattaaaatatttg

SEQ ID NO: 296289 - DNA, 15 bp, Homo sapiens
cttattaaaatattt

SEQ ID NO: 296290 - DNA, 15 bp, Homo sapiens
gcttattaaaatatt

SEQ ID NO: 296291 - DNA, 15 bp, Homo sapiens
ggcttattaaaatat

SEQ ID NO: 296292 - DNA, 15 bp, Homo sapiens
aggcttattaaaata

SEQ ID NO: 296293 - DNA, 15 bp, Homo sapiens
aaggcttattaaaat

SEQ ID NO: 296294 - DNA, 15 bp, Homo sapiens
aaaggcttattaaaa

SEQ ID NO: 296295 - DNA, 15 bp, Homo sapiens
caaaggcttattaaa

SEQ ID NO: 296296 - DNA, 15 bp, Homo sapiens
acaaaggcttattaa

SEQ ID NO: 296297 - DNA, 15 bp, Homo sapiens
cacaaaggcttatta

SEQ ID NO: 296298 - DNA, 15 bp, Homo sapiens
tcacaaaggcttatt

SEQ ID NO: 296299 - DNA, 15 bp, Homo sapiens
atcacaaaggcttat

SEQ ID NO: 296300 - DNA, 15 bp, Homo sapiens
aatcacaaaggctta

SEQ ID NO: 296301 - DNA, 15 bp, Homo sapiens
gaatcacaaaggctt

SEQ ID NO: 296302 - DNA, 15 bp, Homo sapiens
ggaatcacaaaggct

SEQ ID NO: 296303 - DNA, 15 bp, Homo sapiens
gggaatcacaaaggc

SEQ ID NO: 296304 - DNA, 15 bp, Homo sapiens
tgggaatcacaaagg

SEQ ID NO: 296305 - DNA, 15 bp, Homo sapiens
ttgggaatcacaaag

SEQ ID NO: 296306 - DNA, 15 bp, Homo sapiens
tttgggaatcacaaa

SEQ ID NO: 296307 - DNA, 15 bp, Homo sapiens
ctttgggaatcacaa

SEQ ID NO: 296308 - DNA, 15 bp, Homo sapiens
gctttgggaatcaca

SEQ ID NO: 296309 - DNA, 15 bp, Homo sapiens
agctttgggaatcac

SEQ ID NO: 296310 - DNA, 15 bp, Homo sapiens
aagctttgggaatca

SEQ ID NO: 296311 - DNA, 15 bp, Homo sapiens
taagctttgggaatc

SEQ ID NO: 296312 - DNA, 15 bp, Homo sapiens
gtaagctttgggaat

SEQ ID NO: 296313 - DNA, 15 bp, Homo sapiens
ggtaagctttgggaa

SEQ ID NO: 296314 - DNA, 15 bp, Homo sapiens
tggtaagctttggga

SEQ ID NO: 296315 - DNA, 15 bp, Homo sapiens
ttggtaagctttggg

SEQ ID NO: 296316 - DNA, 15 bp, Homo sapiens
gttggtaagctttgg

SEQ ID NO: 296317 - DNA, 15 bp, Homo sapiens
ggttggtaagctttg

SEQ ID NO: 296318 - DNA, 15 bp, Homo sapiens
tggttggtaagcttt

SEQ ID NO: 296319 - DNA, 15 bp, Homo sapiens
gtggttggtaagctt

SEQ ID NO: 296320 - DNA, 15 bp, Homo sapiens
ggtggttggtaagct

SEQ ID NO: 296321 - DNA, 15 bp, Homo sapiens
aggtggttggtaagc

SEQ ID NO: 296322 - DNA, 15 bp, Homo sapiens
aaggtggttggtaag

SEQ ID NO: 296323 - DNA, 15 bp, Homo sapiens
aaaggtggttggtaa

SEQ ID NO: 296324 - DNA, 15 bp, Homo sapiens
caaaggtggttggta

SEQ ID NO: 296325 - DNA, 15 bp, Homo sapiens
ccaaaggtggttggt

SEQ ID NO: 296326 - DNA, 15 bp, Homo sapiens
tccaaaggtggttgg

SEQ ID NO: 296327 - DNA, 15 bp, Homo sapiens
ctccaaaggtggttg

SEQ ID NO: 296328 - DNA, 15 bp, Homo sapiens
tctccaaaggtggtt

SEQ ID NO: 296329 - DNA, 15 bp, Homo sapiens
ttctccaaaggtggt

SEQ ID NO: 296330 - DNA, 15 bp, Homo sapiens
attctccaaaggtgg

SEQ ID NO: 296331 - DNA, 15 bp, Homo sapiens
aattctccaaaggtg

SEQ ID NO: 296332 - DNA, 15 bp, Homo sapiens
aaattctccaaaggt

SEQ ID NO: 296333 - DNA, 15 bp, Homo sapiens
taaattctccaaagg

SEQ ID NO: 296334 - DNA, 15 bp, Homo sapiens
ataaattctccaaag

SEQ ID NO: 296335 - DNA, 15 bp, Homo sapiens
gataaattctccaaa

SEQ ID NO: 296336 - DNA, 15 bp, Homo sapiens
agataaattctccaa

SEQ ID NO: 296337 - DNA, 15 bp, Homo sapiens
tagataaattctcca

SEQ ID NO: 296338 - DNA, 15 bp, Homo sapiens
ttagataaattctcc

SEQ ID NO: 296339 - DNA, 15 bp, Homo sapiens
tttagataaattctc

SEQ ID NO: 296340 - DNA, 15 bp, Homo sapiens
gtttagataaattct

SEQ ID NO: 296341 - DNA, 15 bp, Homo sapiens
tgtttagataaattc

SEQ ID NO: 296342 - DNA, 15 bp, Homo sapiens
ttgtttagataaatt

SEQ ID NO: 296343 - DNA, 15 bp, Homo sapiens
tttgtttagataaat

SEQ ID NO: 296344 - DNA, 15 bp, Homo sapiens
atttgtttagataaa

SEQ ID NO: 296345 - DNA, 15 bp, Homo sapiens
gatttgtttagataa

SEQ ID NO: 296346 - DNA, 15 bp, Homo sapiens
cgatttgtttagata

SEQ ID NO: 296347 - DNA, 15 bp, Homo sapiens
ccgatttgtttagat

SEQ ID NO: 296348 - DNA, 15 bp, Homo sapiens
tccgatttgtttaga

SEQ ID NO: 296349 - DNA, 15 bp, Homo sapiens
atccgatttgtttag

SEQ ID NO: 296350 - DNA, 15 bp, Homo sapiens
aatccgatttgttta

SEQ ID NO: 296351 - DNA, 15 bp, Homo sapiens
caatccgatttgttt

SEQ ID NO: 296352 - DNA, 15 bp, Homo sapiens
ccaatccgatttgtt

SEQ ID NO: 296353 - DNA, 15 bp, Homo sapiens
gccaatccgatttgt

SEQ ID NO: 296354 - DNA, 15 bp, Homo sapiens
tgccaatccgatttg

SEQ ID NO: 296355 - DNA, 15 bp, Homo sapiens
gtgccaatccgattt

SEQ ID NO: 296356 - DNA, 15 bp, Homo sapiens
ggtgccaatccgatt

SEQ ID NO: 296357 - DNA, 15 bp, Homo sapiens
gggtgccaatccgat

SEQ ID NO: 296358 - DNA, 15 bp, Homo sapiens
agggtgccaatccga

SEQ ID NO: 296359 - DNA, 15 bp, Homo sapiens
gagggtgccaatccg

SEQ ID NO: 296360 - DNA, 15 bp, Homo sapiens
ggagggtgccaatcc

SEQ ID NO: 296361 - DNA, 15 bp, Homo sapiens
gggagggtgccaatc

SEQ ID NO: 296362 - DNA, 15 bp, Homo sapiens
tgggagggtgccaat

SEQ ID NO: 296363 - DNA, 15 bp, Homo sapiens
ttgggagggtgccaa

SEQ ID NO: 296364 - DNA, 15 bp, Homo sapiens
attgggagggtgcca

SEQ ID NO: 296365 - DNA, 15 bp, Homo sapiens
cattgggagggtgcc

SEQ ID NO: 296366 - DNA, 15 bp, Homo sapiens
gcattgggagggtgc

SEQ ID NO: 296367 - DNA, 15 bp, Homo sapiens
ggcattgggagggtg

SEQ ID NO: 296368 - DNA, 15 bp, Homo sapiens
tggcattgggagggt

SEQ ID NO: 296369 - DNA, 15 bp, Homo sapiens
ttggcattgggaggg

SEQ ID NO: 296370 - DNA, 15 bp, Homo sapiens
cttggcattgggagg

SEQ ID NO: 296371 - DNA, 15 bp, Homo sapiens
gcttggcattgggag

SEQ ID NO: 296372 - DNA, 15 bp, Homo sapiens
ggcttggcattggga

SEQ ID NO: 296373 - DNA, 15 bp, Homo sapiens
tggcttggcattggg

SEQ ID NO: 296374 - DNA, 15 bp, Homo sapiens
ttggcttggcattgg

SEQ ID NO: 296375 - DNA, 15 bp, Homo sapiens
attggcttggcattg

SEQ ID NO: 296376 - DNA, 15 bp, Homo sapiens
gattggcttggcatt

SEQ ID NO: 296377 - DNA, 15 bp, Homo sapiens
ggattggcttggcat

SEQ ID NO: 296378 - DNA, 15 bp, Homo sapiens
gggattggcttggca

SEQ ID NO: 296379 - DNA, 15 bp, Homo sapiens
agggattggcttggc

SEQ ID NO: 296380 - DNA, 15 bp, Homo sapiens
aagggattggcttgg

SEQ ID NO: 296381 - DNA, 15 bp, Homo sapiens
caagggattggcttg

SEQ ID NO: 296382 - DNA, 15 bp, Homo sapiens
tcaagggattggctt

SEQ ID NO: 296383 - DNA, 15 bp, Homo sapiens
ctcaagggattggct

SEQ ID NO: 296384 - DNA, 15 bp, Homo sapiens
gctcaagggattggc

SEQ ID NO: 296385 - DNA, 15 bp, Homo sapiens
ggctcaagggattgg

SEQ ID NO: 296386 - DNA, 15 bp, Homo sapiens
gggctcaagggattg

SEQ ID NO: 296387 - DNA, 15 bp, Homo sapiens
ggggctcaagggatt

SEQ ID NO: 296388 - DNA, 15 bp, Homo sapiens
aggggctcaagggat

SEQ ID NO: 296389 - DNA, 15 bp, Homo sapiens
caggggctcaaggga

SEQ ID NO: 296390 - DNA, 15 bp, Homo sapiens
acaggggctcaaggg

SEQ ID NO: 296391 - DNA, 15 bp, Homo sapiens
tacaggggctcaagg

SEQ ID NO: 296392 - DNA, 15 bp, Homo sapiens
ttacaggggctcaag

SEQ ID NO: 296393 - DNA, 15 bp, Homo sapiens
gttacaggggctcaa

SEQ ID NO: 296394 - DNA, 15 bp, Homo sapiens
agttacaggggctca

SEQ ID NO: 296395 - DNA, 15 bp, Homo sapiens
tagttacaggggctc

SEQ ID NO: 296396 - DNA, 15 bp, Homo sapiens
ttagttacaggggct

SEQ ID NO: 296397 - DNA, 15 bp, Homo sapiens
attagttacaggggc

SEQ ID NO: 296398 - DNA, 15 bp, Homo sapiens
cattagttacagggg

SEQ ID NO: 296399 - DNA, 15 bp, Homo sapiens
tcattagttacaggg

SEQ ID NO: 296400 - DNA, 15 bp, Homo sapiens
ctcattagttacagg

SEQ ID NO: 296401 - DNA, 15 bp, Homo sapiens
tctcattagttacag

SEQ ID NO: 296402 - DNA, 15 bp, Homo sapiens
ttctcattagttaca

SEQ ID NO: 296403 - DNA, 15 bp, Homo sapiens
gttctcattagttac

SEQ ID NO: 296404 - DNA, 15 bp, Homo sapiens
agttctcattagtta

SEQ ID NO: 296405 - DNA, 15 bp, Homo sapiens
aagttctcattagtt

SEQ ID NO: 296406 - DNA, 15 bp, Homo sapiens
aaagttctcattagt

SEQ ID NO: 296407 - DNA, 15 bp, Homo sapiens
taaagttctcattag

SEQ ID NO: 296408 - DNA, 15 bp, Homo sapiens
ttaaagttctcatta

SEQ ID NO: 296409 - DNA, 15 bp, Homo sapiens
tttaaagttctcatt

SEQ ID NO: 296410 - DNA, 15 bp, Homo sapiens
ttttaaagttctcat

SEQ ID NO: 296411 - DNA, 15 bp, Homo sapiens
tttttaaagttctca

SEQ ID NO: 296412 - DNA, 15 bp, Homo sapiens
atttttaaagttctc

SEQ ID NO: 296413 - DNA, 15 bp, Homo sapiens
catttttaaagttct

SEQ ID NO: 296414 - DNA, 15 bp, Homo sapiens
gcatttttaaagttc

SEQ ID NO: 296415 - DNA, 15 bp, Homo sapiens
agcatttttaaagtt

SEQ ID NO: 296416 - DNA, 15 bp, Homo sapiens
aagcatttttaaagt

SEQ ID NO: 296417 - DNA, 15 bp, Homo sapiens
caagcatttttaaag

SEQ ID NO: 296418 - DNA, 15 bp, Homo sapiens
acaagcatttttaaa

SEQ ID NO: 296419 - DNA, 15 bp, Homo sapiens
gacaagcatttttaa

SEQ ID NO: 296420 - DNA, 15 bp, Homo sapiens
cgacaagcattttta

SEQ ID NO: 296421 - DNA, 15 bp, Homo sapiens
gcgacaagcattttt

SEQ ID NO: 296422 - DNA, 15 bp, Homo sapiens
ggcgacaagcatttt

SEQ ID NO: 296423 - DNA, 15 bp, Homo sapiens
tggcgacaagcattt

SEQ ID NO: 296424 - DNA, 15 bp, Homo sapiens
ctggcgacaagcatt

SEQ ID NO: 296425 - DNA, 15 bp, Homo sapiens
gctggcgacaagcat

SEQ ID NO: 296426 - DNA, 15 bp, Homo sapiens
tgctggcgacaagca

SEQ ID NO: 296427 - DNA, 15 bp, Homo sapiens
atgctggcgacaagc

SEQ ID NO: 296428 - DNA, 15 bp, Homo sapiens
tatgctggcgacaag

SEQ ID NO: 296429 - DNA, 15 bp, Homo sapiens
gtatgctggcgacaa

SEQ ID NO: 296430 - DNA, 15 bp, Homo sapiens
tgtatgctggcgaca

SEQ ID NO: 296431 - DNA, 15 bp, Homo sapiens
ttgtatgctggcgac

SEQ ID NO: 296432 - DNA, 15 bp, Homo sapiens
attgtatgctggcga

SEQ ID NO: 296433 - DNA, 15 bp, Homo sapiens
cattgtatgctggcg

SEQ ID NO: 296434 - DNA, 15 bp, Homo sapiens
tcattgtatgctggc

SEQ ID NO: 296435 - DNA, 15 bp, Homo sapiens
ttcattgtatgctgg

SEQ ID NO: 296436 - DNA, 15 bp, Homo sapiens
attcattgtatgctg

SEQ ID NO: 296437 - DNA, 15 bp, Homo sapiens
aattcattgtatgct

SEQ ID NO: 296438 - DNA, 15 bp, Homo sapiens
caattcattgtatgc

SEQ ID NO: 296439 - DNA, 15 bp, Homo sapiens
tcaattcattgtatg

SEQ ID NO: 296440 - DNA, 15 bp, Homo sapiens
atcaattcattgtat

SEQ ID NO: 296441 - DNA, 15 bp, Homo sapiens
gatcaattcattgta

SEQ ID NO: 296442 - DNA, 15 bp, Homo sapiens
agatcaattcattgt

SEQ ID NO: 296443 - DNA, 15 bp, Homo sapiens
aagatcaattcattg

SEQ ID NO: 296444 - DNA, 15 bp, Homo sapiens
gaagatcaattcatt

SEQ ID NO: 296445 - DNA, 15 bp, Homo sapiens
tgaagatcaattcat

SEQ ID NO: 296446 - DNA, 15 bp, Homo sapiens
atgaagatcaattca

SEQ ID NO: 296447 - DNA, 15 bp, Homo sapiens
catgaagatcaattc

SEQ ID NO: 296448 - DNA, 15 bp, Homo sapiens
acatgaagatcaatt

SEQ ID NO: 296449 - DNA, 15 bp, Homo sapiens
aacatgaagatcaat

SEQ ID NO: 296450 - DNA, 15 bp, Homo sapiens
taacatgaagatcaa

SEQ ID NO: 296451 - DNA, 15 bp, Homo sapiens
ttaacatgaagatca

SEQ ID NO: 296452 - DNA, 15 bp, Homo sapiens
attaacatgaagatc

SEQ ID NO: 296453 - DNA, 15 bp, Homo sapiens
gattaacatgaagat

SEQ ID NO: 296454 - DNA, 15 bp, Homo sapiens
agattaacatgaaga

SEQ ID NO: 296455 - DNA, 15 bp, Homo sapiens
aagattaacatgaag

SEQ ID NO: 296456 - DNA, 15 bp, Homo sapiens
caagattaacatgaa

SEQ ID NO: 296457 - DNA, 15 bp, Homo sapiens
tcaagattaacatga

SEQ ID NO: 296458 - DNA, 15 bp, Homo sapiens
gtcaagattaacatg

SEQ ID NO: 296459 - DNA, 15 bp, Homo sapiens
agtcaagattaacat

SEQ ID NO: 296460 - DNA, 15 bp, Homo sapiens
aagtcaagattaaca

SEQ ID NO: 296461 - DNA, 15 bp, Homo sapiens
aaagtcaagattaac

SEQ ID NO: 296462 - DNA, 15 bp, Homo sapiens
aaaagtcaagattaa

SEQ ID NO: 296463 - DNA, 15 bp, Homo sapiens
caaaagtcaagatta

SEQ ID NO: 296464 - DNA, 15 bp, Homo sapiens
tcaaaagtcaagatt

SEQ ID NO: 296465 - DNA, 15 bp, Homo sapiens
atcaaaagtcaagat

SEQ ID NO: 296466 - DNA, 15 bp, Homo sapiens
gatcaaaagtcaaga

SEQ ID NO: 296467 - DNA, 15 bp, Homo sapiens
ggatcaaaagtcaag

SEQ ID NO: 296468 - DNA, 15 bp, Homo sapiens
aggatcaaaagtcaa

SEQ ID NO: 296469 - DNA, 15 bp, Homo sapiens
aaggatcaaaagtca

SEQ ID NO: 296470 - DNA, 15 bp, Homo sapiens
aaaggatcaaaagtc

SEQ ID NO: 296471 - DNA, 15 bp, Homo sapiens
caaaggatcaaaagt

SEQ ID NO: 296472 - DNA, 15 bp, Homo sapiens
acaaaggatcaaaag

SEQ ID NO: 296473 - DNA, 15 bp, Homo sapiens
cacaaaggatcaaaa

SEQ ID NO: 296474 - DNA, 15 bp, Homo sapiens
ccacaaaggatcaaa

SEQ ID NO: 296475 - DNA, 15 bp, Homo sapiens
tccacaaaggatcaa

SEQ ID NO: 296476 - DNA, 15 bp, Homo sapiens
atccacaaaggatca

SEQ ID NO: 296477 - DNA, 15 bp, Homo sapiens
aatccacaaaggatc

SEQ ID NO: 296478 - DNA, 15 bp, Homo sapiens
taatccacaaaggat

SEQ ID NO: 296479 - DNA, 15 bp, Homo sapiens
ttaatccacaaagga

SEQ ID NO: 296480 - DNA, 15 bp, Homo sapiens
tttaatccacaaagg

SEQ ID NO: 296481 - DNA, 15 bp, Homo sapiens
ttttaatccacaaag

SEQ ID NO: 296482 - DNA, 15 bp, Homo sapiens
tttttaatccacaaa

SEQ ID NO: 296483 - DNA, 15 bp, Homo sapiens
atttttaatccacaa

SEQ ID NO: 296484 - DNA, 15 bp, Homo sapiens
aatttttaatccaca

SEQ ID NO: 296485 - DNA, 15 bp, Homo sapiens
taatttttaatccac

SEQ ID NO: 296486 - DNA, 15 bp, Homo sapiens
ctaatttttaatcca

SEQ ID NO: 296487 - DNA, 15 bp, Homo sapiens
gctaatttttaatcc

SEQ ID NO: 296488 - DNA, 15 bp, Homo sapiens
tgctaatttttaatc

SEQ ID NO: 296489 - DNA, 15 bp, Homo sapiens
atgctaatttttaat

SEQ ID NO: 296490 - DNA, 15 bp, Homo sapiens
catgctaatttttaa

SEQ ID NO: 296491 - DNA, 15 bp, Homo sapiens
ccatgctaattttta

SEQ ID NO: 296492 - DNA, 15 bp, Homo sapiens
gccatgctaattttt

SEQ ID NO: 296493 - DNA, 15 bp, Homo sapiens
ggccatgctaatttt

SEQ ID NO: 296494 - DNA, 15 bp, Homo sapiens
gggccatgctaattt

SEQ ID NO: 296495 - DNA, 15 bp, Homo sapiens
ggggccatgctaatt

SEQ ID NO: 296496 - DNA, 15 bp, Homo sapiens
tggggccatgctaat

SEQ ID NO: 296497 - DNA, 15 bp, Homo sapiens
ttggggccatgctaa

SEQ ID NO: 296498 - DNA, 15 bp, Homo sapiens
tttggggccatgcta

SEQ ID NO: 296499 - DNA, 15 bp, Homo sapiens
atttggggccatgct

SEQ ID NO: 296500 - DNA, 15 bp, Homo sapiens
catttggggccatgc

SEQ ID NO: 296501 - DNA, 15 bp, Homo sapiens
tcatttggggccatg

SEQ ID NO: 296502 - DNA, 15 bp, Homo sapiens
ttcatttggggccat

SEQ ID NO: 296503 - DNA, 15 bp, Homo sapiens
attcatttggggcca

SEQ ID NO: 296504 - DNA, 15 bp, Homo sapiens
aattcatttggggcc

SEQ ID NO: 296505 - DNA, 15 bp, Homo sapiens
aaattcatttggggc

SEQ ID NO: 296506 - DNA, 15 bp, Homo sapiens
gaaattcatttgggg

SEQ ID NO: 296507 - DNA, 15 bp, Homo sapiens
ggaaattcatttggg

SEQ ID NO: 296508 - DNA, 15 bp, Homo sapiens
tggaaattcatttgg

SEQ ID NO: 296509 - DNA, 15 bp, Homo sapiens
gtggaaattcatttg

SEQ ID NO: 296510 - DNA, 15 bp, Homo sapiens
agtggaaattcattt

SEQ ID NO: 296511 - DNA, 15 bp, Homo sapiens
gagtggaaattcatt

SEQ ID NO: 296512 - DNA, 15 bp, Homo sapiens
agagtggaaattcat

SEQ ID NO: 296513 - DNA, 15 bp, Homo sapiens
aagagtggaaattca

SEQ ID NO: 296514 - DNA, 15 bp, Homo sapiens
caagagtggaaattc

SEQ ID NO: 296515 - DNA, 15 bp, Homo sapiens
ccaagagtggaaatt

SEQ ID NO: 296516 - DNA, 15 bp, Homo sapiens
gccaagagtggaaat

SEQ ID NO: 296517 - DNA, 15 bp, Homo sapiens
tgccaagagtggaaa

SEQ ID NO: 296518 - DNA, 15 bp, Homo sapiens
ttgccaagagtggaa

SEQ ID NO: 296519 - DNA, 15 bp, Homo sapiens
attgccaagagtgga

SEQ ID NO: 296520 - DNA, 15 bp, Homo sapiens
gattgccaagagtgg

SEQ ID NO: 296521 - DNA, 15 bp, Homo sapiens
agattgccaagagtg

SEQ ID NO: 296522 - DNA, 15 bp, Homo sapiens
aagattgccaagagt

SEQ ID NO: 296523 - DNA, 15 bp, Homo sapiens
caagattgccaagag

SEQ ID NO: 296524 - DNA, 15 bp, Homo sapiens
ccaagattgccaaga

SEQ ID NO: 296525 - DNA, 15 bp, Homo sapiens
tccaagattgccaag

SEQ ID NO: 296526 - DNA, 15 bp, Homo sapiens
ttccaagattgccaa

SEQ ID NO: 296527 - DNA, 15 bp, Homo sapiens
attccaagattgcca

SEQ ID NO: 296528 - DNA, 15 bp, Homo sapiens
aattccaagattgcc

SEQ ID NO: 296529 - DNA, 15 bp, Homo sapiens
taattccaagattgc

SEQ ID NO: 296530 - DNA, 15 bp, Homo sapiens
ttaattccaagattg

SEQ ID NO: 296531 - DNA, 15 bp, Homo sapiens
tttaattccaagatt

SEQ ID NO: 296532 - DNA, 15 bp, Homo sapiens
ttttaattccaagat

SEQ ID NO: 296533 - DNA, 15 bp, Homo sapiens
attttaattccaaga

SEQ ID NO: 296534 - DNA, 15 bp, Homo sapiens
cattttaattccaag

SEQ ID NO: 296535 - DNA, 15 bp, Homo sapiens
tcattttaattccaa

SEQ ID NO: 296536 - DNA, 15 bp, Homo sapiens
ttcattttaattcca

SEQ ID NO: 296537 - DNA, 15 bp, Homo sapiens
tttcattttaattcc

SEQ ID NO: 296538 - DNA, 15 bp, Homo sapiens
gagtttcattttaat

SEQ ID NO: 296539 - DNA, 15 bp, Homo sapiens
agagtttcattttaa

SEQ ID NO: 296540 - DNA, 15 bp, Homo sapiens
cagagtttcatttta

SEQ ID NO: 296541 - DNA, 15 bp, Homo sapiens
acagagtttcatttt

SEQ ID NO: 296542 - DNA, 15 bp, Homo sapiens
tacagagtttcattt

SEQ ID NO: 296543 - DNA, 15 bp, Homo sapiens
atacagagtttcatt

SEQ ID NO: 296544 - DNA, 15 bp, Homo sapiens
aatacagagtttcat

SEQ ID NO: 296545 - DNA, 15 bp, Homo sapiens
gaatacagagtttca

SEQ ID NO: 296546 - DNA, 15 bp, Homo sapiens
tgaatacagagtttc

SEQ ID NO: 296547 - DNA, 15 bp, Homo sapiens
atgaatacagagttt

SEQ ID NO: 296548 - DNA, 15 bp, Homo sapiens
tatgaatacagagtt

SEQ ID NO: 296549 - DNA, 15 bp, Homo sapiens
ttatgaatacagagt

SEQ ID NO: 296550 - DNA, 15 bp, Homo sapiens
tttatgaatacagag

SEQ ID NO: 296551 - DNA, 15 bp, Homo sapiens
atttatgaatacaga

SEQ ID NO: 296552 - DNA, 15 bp, Homo sapiens
gatttatgaatacag

SEQ ID NO: 296553 - DNA, 15 bp, Homo sapiens
ggatttatgaataca

SEQ ID NO: 296554 - DNA, 15 bp, Homo sapiens
aggatttatgaatac

SEQ ID NO: 296555 - DNA, 15 bp, Homo sapiens
taggatttatgaata

SEQ ID NO: 296556 - DNA, 15 bp, Homo sapiens
ttaggatttatgaat

SEQ ID NO: 296557 - DNA, 15 bp, Homo sapiens
attaggatttatgaa

SEQ ID NO: 296558 - DNA, 15 bp, Homo sapiens
aattaggatttatga

SEQ ID NO: 296559 - DNA, 15 bp, Homo sapiens
caattaggatttatg

SEQ ID NO: 296560 - DNA, 15 bp, Homo sapiens
acaattaggatttat

SEQ ID NO: 296561 - DNA, 15 bp, Homo sapiens
cacaattaggattta

SEQ ID NO: 296562 - DNA, 15 bp, Homo sapiens
acacaattaggattt

SEQ ID NO: 296563 - DNA, 15 bp, Homo sapiens
cacacaattaggatt

SEQ ID NO: 296564 - DNA, 15 bp, Homo sapiens
tcacacaattaggat

SEQ ID NO: 296565 - DNA, 15 bp, Homo sapiens
ttcacacaattagga

SEQ ID NO: 296566 - DNA, 15 bp, Homo sapiens
attcacacaattagg

SEQ ID NO: 296567 - DNA, 15 bp, Homo sapiens
aattcacacaattag

SEQ ID NO: 296568 - DNA, 15 bp, Homo sapiens
caattcacacaatta

SEQ ID NO: 296569 - DNA, 15 bp, Homo sapiens
gcaattcacacaatt

SEQ ID NO: 296570 - DNA, 15 bp, Homo sapiens
ggcaattcacacaat

SEQ ID NO: 296571 - DNA, 15 bp, Homo sapiens
aggcaattcacacaa

SEQ ID NO: 296572 - DNA, 15 bp, Homo sapiens
taggcaattcacaca

SEQ ID NO: 296573 - DNA, 15 bp, Homo sapiens
ataggcaattcacac

SEQ ID NO: 296574 - DNA, 15 bp, Homo sapiens
aataggcaattcaca

SEQ ID NO: 296575 - DNA, 15 bp, Homo sapiens
aaataggcaattcac

SEQ ID NO: 296576 - DNA, 15 bp, Homo sapiens
aaaataggcaattca

SEQ ID NO: 296577 - DNA, 15 bp, Homo sapiens
taaaataggcaattc

SEQ ID NO: 296578 - DNA, 15 bp, Homo sapiens
ttaaaataggcaatt

SEQ ID NO: 296579 - DNA, 15 bp, Homo sapiens
gttaaaataggcaat

SEQ ID NO: 296580 - DNA, 15 bp, Homo sapiens
tgttaaaataggcaa

SEQ ID NO: 296581 - DNA, 15 bp, Homo sapiens
atgttaaaataggca

SEQ ID NO: 296582 - DNA, 15 bp, Homo sapiens
catgttaaaataggc

SEQ ID NO: 296583 - DNA, 15 bp, Homo sapiens
tcatgttaaaatagg

SEQ ID NO: 296584 - DNA, 15 bp, Homo sapiens
gtcatgttaaaatag

SEQ ID NO: 296585 - DNA, 15 bp, Homo sapiens
ggtcatgttaaaata

SEQ ID NO: 296586 - DNA, 15 bp, Homo sapiens
cggtcatgttaaaat

SEQ ID NO: 296587 - DNA, 15 bp, Homo sapiens
acggtcatgttaaaa

SEQ ID NO: 296588 - DNA, 15 bp, Homo sapiens
aacggtcatgttaaa

SEQ ID NO: 296589 - DNA, 15 bp, Homo sapiens
aaacggtcatgttaa

SEQ ID NO: 296590 - DNA, 15 bp, Homo sapiens
aaaacggtcatgtta

SEQ ID NO: 296591 - DNA, 15 bp, Homo sapiens
aaaaacggtcatgtt

SEQ ID NO: 296592 - DNA, 15 bp, Homo sapiens
aaaaaacggtcatgt

SEQ ID NO: 296593 - DNA, 15 bp, Homo sapiens
taaaaaacggtcatg

SEQ ID NO: 296594 - DNA, 15 bp, Homo sapiens
ttaaaaaacggtcat

SEQ ID NO: 296595 - DNA, 15 bp, Homo sapiens
gttaaaaaacggtca

SEQ ID NO: 296596 - DNA, 15 bp, Homo sapiens
agttaaaaaacggtc

SEQ ID NO: 296597 - DNA, 15 bp, Homo sapiens
cagttaaaaaacggt

SEQ ID NO: 296598 - DNA, 15 bp, Homo sapiens
acagttaaaaaacgg

SEQ ID NO: 296599 - DNA, 15 bp, Homo sapiens
cacagttaaaaaacg

SEQ ID NO: 296600 - DNA, 15 bp, Homo sapiens
acacagttaaaaaac

SEQ ID NO: 296601 - DNA, 15 bp, Homo sapiens
gacacagttaaaaaa

SEQ ID NO: 296602 - DNA, 15 bp, Homo sapiens
agacacagttaaaaa

SEQ ID NO: 296603 - DNA, 15 bp, Homo sapiens
tagacacagttaaaa

SEQ ID NO: 296604 - DNA, 15 bp, Homo sapiens
gtagacacagttaaa

SEQ ID NO: 296605 - DNA, 15 bp, Homo sapiens
tgtagacacagttaa

SEQ ID NO: 296606 - DNA, 15 bp, Homo sapiens
gtgtagacacagtta

SEQ ID NO: 296607 - DNA, 15 bp, Homo sapiens
tgtgtagacacagtt

SEQ ID NO: 296608 - DNA, 15 bp, Homo sapiens
atgtgtagacacagt

SEQ ID NO: 296609 - DNA, 15 bp, Homo sapiens
aatgtgtagacacag

SEQ ID NO: 296610 - DNA, 15 bp, Homo sapiens
caatgtgtagacaca

SEQ ID NO: 296611 - DNA, 15 bp, Homo sapiens
acaatgtgtagacac

SEQ ID NO: 296612 - DNA, 15 bp, Homo sapiens
aacaatgtgtagaca

SEQ ID NO: 296613 - DNA, 15 bp, Homo sapiens
caacaatgtgtagac

SEQ ID NO: 296614 - DNA, 15 bp, Homo sapiens
gcaacaatgtgtaga

SEQ ID NO: 296615 - DNA, 15 bp, Homo sapiens
tgcaacaatgtgtag

SEQ ID NO: 296616 - DNA, 15 bp, Homo sapiens
gtgcaacaatgtgta

SEQ ID NO: 296617 - DNA, 15 bp, Homo sapiens
tgtgcaacaatgtgt

SEQ ID NO: 296618 - DNA, 15 bp, Homo sapiens
atgtgcaacaatgtg

SEQ ID NO: 296619 - DNA, 15 bp, Homo sapiens
tatgtgcaacaatgt

SEQ ID NO: 296620 - DNA, 15 bp, Homo sapiens
ttatgtgcaacaatg

SEQ ID NO: 296621 - DNA, 15 bp, Homo sapiens
gttatgtgcaacaat

SEQ ID NO: 296622 - DNA, 15 bp, Homo sapiens
tgttatgtgcaacaa

SEQ ID NO: 296623 - DNA, 15 bp, Homo sapiens
gtgttatgtgcaaca

SEQ ID NO: 296624 - DNA, 15 bp, Homo sapiens
agtgttatgtgcaac

SEQ ID NO: 296625 - DNA, 15 bp, Homo sapiens
aagtgttatgtgcaa

SEQ ID NO: 296626 - DNA, 15 bp, Homo sapiens
aaagtgttatgtgca

SEQ ID NO: 296627 - DNA, 15 bp, Homo sapiens
taaagtgttatgtgc

SEQ ID NO: 296628 - DNA, 15 bp, Homo sapiens
ctaaagtgttatgtg

SEQ ID NO: 296629 - DNA, 15 bp, Homo sapiens
tctaaagtgttatgt

SEQ ID NO: 296630 - DNA, 15 bp, Homo sapiens
ttctaaagtgttatg

SEQ ID NO: 296631 - DNA, 15 bp, Homo sapiens
gttctaaagtgttat

SEQ ID NO: 296632 - DNA, 15 bp, Homo sapiens
agttctaaagtgtta

SEQ ID NO: 296633 - DNA, 15 bp, Homo sapiens
gagttctaaagtgtt

SEQ ID NO: 296634 - DNA, 15 bp, Homo sapiens
ggagttctaaagtgt

SEQ ID NO: 296635 - DNA, 15 bp, Homo sapiens
aggagttctaaagtg

SEQ ID NO: 296636 - DNA, 15 bp, Homo sapiens
aaggagttctaaagt

SEQ ID NO: 296637 - DNA, 15 bp, Homo sapiens
aaaggagttctaaag

SEQ ID NO: 296638 - DNA, 15 bp, Homo sapiens
caaaggagttctaaa

SEQ ID NO: 296639 - DNA, 15 bp, Homo sapiens
acaaaggagttctaa

SEQ ID NO: 296640 - DNA, 15 bp, Homo sapiens
gacaaaggagttcta

SEQ ID NO: 296641 - DNA, 15 bp, Homo sapiens
agacaaaggagttct

SEQ ID NO: 296642 - DNA, 15 bp, Homo sapiens
cagacaaaggagttc

SEQ ID NO: 296643 - DNA, 15 bp, Homo sapiens
tcagacaaaggagtt

SEQ ID NO: 296644 - DNA, 15 bp, Homo sapiens
ttcagacaaaggagt

SEQ ID NO: 296645 - DNA, 15 bp, Homo sapiens
attcagacaaaggag

SEQ ID NO: 296646 - DNA, 15 bp, Homo sapiens
aattcagacaaagga

SEQ ID NO: 296647 - DNA, 15 bp, Homo sapiens
taattcagacaaagg

SEQ ID NO: 296648 - DNA, 15 bp, Homo sapiens
ttaattcagacaaag

SEQ ID NO: 296649 - DNA, 15 bp, Homo sapiens
attaattcagacaaa

SEQ ID NO: 296650 - DNA, 15 bp, Homo sapiens
tattaattcagacaa

SEQ ID NO: 296651 - DNA, 15 bp, Homo sapiens
atattaattcagaca

SEQ ID NO: 296652 - DNA, 15 bp, Homo sapiens
gatattaattcagac

SEQ ID NO: 296653 - DNA, 15 bp, Homo sapiens
ggatattaattcaga

SEQ ID NO: 296654 - DNA, 15 bp, Homo sapiens
gggatattaattcag

SEQ ID NO: 296655 - DNA, 15 bp, Homo sapiens
tgggatattaattca

SEQ ID NO: 296656 - DNA, 15 bp, Homo sapiens
ctgggatattaattc

SEQ ID NO: 296657 - DNA, 15 bp, Homo sapiens
actgggatattaatt

SEQ ID NO: 296658 - DNA, 15 bp, Homo sapiens
aactgggatattaat

SEQ ID NO: 296659 - DNA, 15 bp, Homo sapiens
caactgggatattaa

SEQ ID NO: 296660 - DNA, 15 bp, Homo sapiens
ccaactgggatatta

SEQ ID NO: 296661 - DNA, 15 bp, Homo sapiens
accaactgggatatt

SEQ ID NO: 296662 - DNA, 15 bp, Homo sapiens
gaccaactgggatat

SEQ ID NO: 296663 - DNA, 15 bp, Homo sapiens
ggaccaactgggata

SEQ ID NO: 296664 - DNA, 15 bp, Homo sapiens
aggaccaactgggat

SEQ ID NO: 296665 - DNA, 15 bp, Homo sapiens
caggaccaactggga

SEQ ID NO: 296666 - DNA, 15 bp, Homo sapiens
tcaggaccaactggg

SEQ ID NO: 296667 - DNA, 15 bp, Homo sapiens
atcaggaccaactgg

SEQ ID NO: 296668 - DNA, 15 bp, Homo sapiens
tatcaggaccaactg

SEQ ID NO: 296669 - DNA, 15 bp, Homo sapiens
ctatcaggaccaact

SEQ ID NO: 296670 - DNA, 15 bp, Homo sapiens
gctatcaggaccaac

SEQ ID NO: 296671 - DNA, 15 bp, Homo sapiens
tgctatcaggaccaa

SEQ ID NO: 296672 - DNA, 15 bp, Homo sapiens
atgctatcaggacca

SEQ ID NO: 296673 - DNA, 15 bp, Homo sapiens
gatgctatcaggacc

SEQ ID NO: 296674 - DNA, 15 bp, Homo sapiens
ggatgctatcaggac

SEQ ID NO: 296675 - DNA, 15 bp, Homo sapiens
aggatgctatcagga

SEQ ID NO: 296676 - DNA, 15 bp, Homo sapiens
aaggatgctatcagg

SEQ ID NO: 296677 - DNA, 15 bp, Homo sapiens
caaggatgctatcag

SEQ ID NO: 296678 - DNA, 15 bp, Homo sapiens
tcaaggatgctatca

SEQ ID NO: 296679 - DNA, 15 bp, Homo sapiens
ttcaaggatgctatc

SEQ ID NO: 296680 - DNA, 15 bp, Homo sapiens
attcaaggatgctat

SEQ ID NO: 296681 - DNA, 15 bp, Homo sapiens
aattcaaggatgcta

SEQ ID NO: 296682 - DNA, 15 bp, Homo sapiens
taattcaaggatgct

SEQ ID NO: 296683 - DNA, 15 bp, Homo sapiens
ataattcaaggatgc

SEQ ID NO: 296684 - DNA, 15 bp, Homo sapiens
cataattcaaggatg

SEQ ID NO: 296685 - DNA, 15 bp, Homo sapiens
ccataattcaaggat

SEQ ID NO: 296686 - DNA, 15 bp, Homo sapiens
gccataattcaagga

SEQ ID NO: 296687 - DNA, 15 bp, Homo sapiens
ggccataattcaagg

SEQ ID NO: 296688 - DNA, 15 bp, Homo sapiens
aggccataattcaag

SEQ ID NO: 296689 - DNA, 15 bp, Homo sapiens
aaggccataattcaa

SEQ ID NO: 296690 - DNA, 15 bp, Homo sapiens
aaaggccataattca

SEQ ID NO: 296691 - DNA, 15 bp, Homo sapiens
aaaaggccataattc

SEQ ID NO: 296692 - DNA, 15 bp, Homo sapiens
taaaaggccataatt

SEQ ID NO: 296693 - DNA, 15 bp, Homo sapiens
ttaaaaggccataat

SEQ ID NO: 296694 - DNA, 15 bp, Homo sapiens
tttaaaaggccataa

SEQ ID NO: 296695 - DNA, 15 bp, Homo sapiens
ctttaaaaggccata

SEQ ID NO: 296696 - DNA, 15 bp, Homo sapiens
actttaaaaggccat

SEQ ID NO: 296697 - DNA, 15 bp, Homo sapiens
gactttaaaaggcca

SEQ ID NO: 296698 - DNA, 15 bp, Homo sapiens
agactttaaaaggcc

SEQ ID NO: 296699 - DNA, 15 bp, Homo sapiens
aagactttaaaaggc

SEQ ID NO: 296700 - DNA, 15 bp, Homo sapiens
aaagactttaaaagg

SEQ ID NO: 296701 - DNA, 15 bp, Homo sapiens
aaaagactttaaaag

SEQ ID NO: 296702 - DNA, 15 bp, Homo sapiens
aaaaagactttaaaa

SEQ ID NO: 296703 - DNA, 15 bp, Homo sapiens
taaaaagactttaaa

SEQ ID NO: 296704 - DNA, 15 bp, Homo sapiens
ttaaaaagactttaa

SEQ ID NO: 296705 - DNA, 15 bp, Homo sapiens
tttaaaaagacttta

SEQ ID NO: 296706 - DNA, 15 bp, Homo sapiens
ttttaaaaagacttt

SEQ ID NO: 296707 - DNA, 15 bp, Homo sapiens
attttaaaaagactt

SEQ ID NO: 296708 - DNA, 15 bp, Homo sapiens
aattttaaaaagact

SEQ ID NO: 296709 - DNA, 15 bp, Homo sapiens
taattttaaaaagac

SEQ ID NO: 296710 - DNA, 15 bp, Homo sapiens
ataattttaaaaaga

SEQ ID NO: 296711 - DNA, 15 bp, Homo sapiens
aataattttaaaaag

SEQ ID NO: 296712 - DNA, 15 bp, Homo sapiens
aaataattttaaaaa

SEQ ID NO: 296713 - DNA, 15 bp, Homo sapiens
taaataattttaaaa

SEQ ID NO: 296714 - DNA, 15 bp, Homo sapiens
ataaataattttaaa

SEQ ID NO: 296715 - DNA, 15 bp, Homo sapiens
cataaataattttaa

SEQ ID NO: 296716 - DNA, 15 bp, Homo sapiens
acataaataatttta

SEQ ID NO: 296717 - DNA, 15 bp, Homo sapiens
aacataaataatttt

SEQ ID NO: 296718 - DNA, 15 bp, Homo sapiens
caacataaataattt

SEQ ID NO: 296719 - DNA, 15 bp, Homo sapiens
tcaacataaataatt

SEQ ID NO: 296720 - DNA, 15 bp, Homo sapiens
ctcaacataaataat

SEQ ID NO: 296721 - DNA, 15 bp, Homo sapiens
actcaacataaataa

SEQ ID NO: 296722 - DNA, 15 bp, Homo sapiens
gactcaacataaata

SEQ ID NO: 296723 - DNA, 15 bp, Homo sapiens
agactcaacataaat

SEQ ID NO: 296724 - DNA, 15 bp, Homo sapiens
aagactcaacataaa

SEQ ID NO: 296725 - DNA, 15 bp, Homo sapiens
taagactcaacataa

SEQ ID NO: 296726 - DNA, 15 bp, Homo sapiens
ctaagactcaacata

SEQ ID NO: 296727 - DNA, 15 bp, Homo sapiens
tctaagactcaacat

SEQ ID NO: 296728 - DNA, 15 bp, Homo sapiens
ctctaagactcaaca

SEQ ID NO: 296729 - DNA, 15 bp, Homo sapiens
gctctaagactcaac

SEQ ID NO: 296730 - DNA, 15 bp, Homo sapiens
tgctctaagactcaa

SEQ ID NO: 296731 - DNA, 15 bp, Homo sapiens
ctgctctaagactca

SEQ ID NO: 296732 - DNA, 15 bp, Homo sapiens
tctgctctaagactc

SEQ ID NO: 296733 - DNA, 15 bp, Homo sapiens
ctctgctctaagact

SEQ ID NO: 296734 - DNA, 15 bp, Homo sapiens
tctctgctctaagac

SEQ ID NO: 296735 - DNA, 15 bp, Homo sapiens
ttctctgctctaaga

SEQ ID NO: 296736 - DNA, 15 bp, Homo sapiens
cttctctgctctaag

SEQ ID NO: 296737 - DNA, 15 bp, Homo sapiens
gcttctctgctctaa

SEQ ID NO: 296738 - DNA, 15 bp, Homo sapiens
tgcttctctgctcta

SEQ ID NO: 296739 - DNA, 15 bp, Homo sapiens
ctgcttctctgctct

SEQ ID NO: 296740 - DNA, 15 bp, Homo sapiens
tctgcttctctgctc

SEQ ID NO: 296741 - DNA, 15 bp, Homo sapiens
gtctgcttctctgct

SEQ ID NO: 296742 - DNA, 15 bp, Homo sapiens
tgtctgcttctctgc

SEQ ID NO: 296743 - DNA, 15 bp, Homo sapiens
atgtctgcttctctg

SEQ ID NO: 296744 - DNA, 15 bp, Homo sapiens
aatgtctgcttctct

SEQ ID NO: 296745 - DNA, 15 bp, Homo sapiens
aaatgtctgcttctc

SEQ ID NO: 296746 - DNA, 15 bp, Homo sapiens
gaaatgtctgcttct

SEQ ID NO: 296747 - DNA, 15 bp, Homo sapiens
ggaaatgtctgcttc

SEQ ID NO: 296748 - DNA, 15 bp, Homo sapiens
aggaaatgtctgctt

SEQ ID NO: 296749 - DNA, 15 bp, Homo sapiens
aaggaaatgtctgct

SEQ ID NO: 296750 - DNA, 15 bp, Homo sapiens
gaaggaaatgtctgc

SEQ ID NO: 296751 - DNA, 15 bp, Homo sapiens
tgaaggaaatgtctg

SEQ ID NO: 296752 - DNA, 15 bp, Homo sapiens
gtgaaggaaatgtct

SEQ ID NO: 296753 - DNA, 15 bp, Homo sapiens
agtgaaggaaatgtc

SEQ ID NO: 296754 - DNA, 15 bp, Homo sapiens
aagtgaaggaaatgt

SEQ ID NO: 296755 - DNA, 15 bp, Homo sapiens
gaagtgaaggaaatg

SEQ ID NO: 296756 - DNA, 15 bp, Homo sapiens
ggaagtgaaggaaat

SEQ ID NO: 296757 - DNA, 15 bp, Homo sapiens
aggaagtgaaggaaa

SEQ ID NO: 296758 - DNA, 15 bp, Homo sapiens
caggaagtgaaggaa

SEQ ID NO: 296759 - DNA, 15 bp, Homo sapiens
ccaggaagtgaagga

SEQ ID NO: 296760 - DNA, 15 bp, Homo sapiens
gccaggaagtgaagg

SEQ ID NO: 296761 - DNA, 15 bp, Homo sapiens
tgccaggaagtgaag

SEQ ID NO: 296762 - DNA, 15 bp, Homo sapiens
ttgccaggaagtgaa

SEQ ID NO: 296763 - DNA, 15 bp, Homo sapiens
cttgccaggaagtga

SEQ ID NO: 296764 - DNA, 15 bp, Homo sapiens
ccttgccaggaagtg

SEQ ID NO: 296765 - DNA, 15 bp, Homo sapiens
tccttgccaggaagt

SEQ ID NO: 296766 - DNA, 15 bp, Homo sapiens
ctccttgccaggaag

SEQ ID NO: 296767 - DNA, 15 bp, Homo sapiens
actccttgccaggaa

SEQ ID NO: 296768 - DNA, 15 bp, Homo sapiens
aactccttgccagga

SEQ ID NO: 296769 - DNA, 15 bp, Homo sapiens
taactccttgccagg

SEQ ID NO: 296770 - DNA, 15 bp, Homo sapiens
ttaactccttgccag

SEQ ID NO: 296771 - DNA, 15 bp, Homo sapiens
cttaactccttgcca

SEQ ID NO: 296772 - DNA, 15 bp, Homo sapiens
ccttaactccttgcc

SEQ ID NO: 296773 - DNA, 15 bp, Homo sapiens
tccttaactccttgc

SEQ ID NO: 296774 - DNA, 15 bp, Homo sapiens
ttccttaactccttg

SEQ ID NO: 296775 - DNA, 15 bp, Homo sapiens
tttccttaactcctt

SEQ ID NO: 296776 - DNA, 15 bp, Homo sapiens
ctttccttaactcct

SEQ ID NO: 296777 - DNA, 15 bp, Homo sapiens
cctttccttaactcc

SEQ ID NO: 296778 - DNA, 15 bp, Homo sapiens
ccctttccttaactc

SEQ ID NO: 296779 - DNA, 15 bp, Homo sapiens
cccctttccttaact

SEQ ID NO: 296780 - DNA, 15 bp, Homo sapiens
acccctttccttaac

SEQ ID NO: 296781 - DNA, 15 bp, Homo sapiens
aacccctttccttaa

SEQ ID NO: 296782 - DNA, 15 bp, Homo sapiens
aaacccctttcctta

SEQ ID NO: 296783 - DNA, 15 bp, Homo sapiens
taaacccctttcctt

SEQ ID NO: 296784 - DNA, 15 bp, Homo sapiens
ttaaacccctttcct

SEQ ID NO: 296785 - DNA, 15 bp, Homo sapiens
tttaaacccctttcc

SEQ ID NO: 296786 - DNA, 15 bp, Homo sapiens
atttaaacccctttc

SEQ ID NO: 296787 - DNA, 15 bp, Homo sapiens
catttaaaccccttt

SEQ ID NO: 296788 - DNA, 15 bp, Homo sapiens
acatttaaacccctt

SEQ ID NO: 296789 - DNA, 15 bp, Homo sapiens
tacatttaaacccct

SEQ ID NO: 296790 - DNA, 15 bp, Homo sapiens
gtacatttaaacccc

SEQ ID NO: 296791 - DNA, 15 bp, Homo sapiens
agtacatttaaaccc

SEQ ID NO: 296792 - DNA, 15 bp, Homo sapiens
cagtacatttaaacc

SEQ ID NO: 296793 - DNA, 15 bp, Homo sapiens
gcagtacatttaaac

SEQ ID NO: 296794 - DNA, 15 bp, Homo sapiens
ggcagtacatttaaa

SEQ ID NO: 296795 - DNA, 15 bp, Homo sapiens
tggcagtacatttaa

SEQ ID NO: 296796 - DNA, 15 bp, Homo sapiens
ttggcagtacattta

SEQ ID NO: 296797 - DNA, 15 bp, Homo sapiens
attggcagtacattt

SEQ ID NO: 296798 - DNA, 15 bp, Homo sapiens
aattggcagtacatt

SEQ ID NO: 296799 - DNA, 15 bp, Homo sapiens
taattggcagtacat

SEQ ID NO: 296800 - DNA, 15 bp, Homo sapiens
ttaattggcagtaca

SEQ ID NO: 296801 - DNA, 15 bp, Homo sapiens
gttaattggcagtac

SEQ ID NO: 296802 - DNA, 15 bp, Homo sapiens
tgttaattggcagta

SEQ ID NO: 296803 - DNA, 15 bp, Homo sapiens
ttgttaattggcagt

SEQ ID NO: 296804 - DNA, 15 bp, Homo sapiens
cttgttaattggcag

SEQ ID NO: 296805 - DNA, 15 bp, Homo sapiens
acttgttaattggca

SEQ ID NO: 296806 - DNA, 15 bp, Homo sapiens
cacttgttaattggc

SEQ ID NO: 296807 - DNA, 15 bp, Homo sapiens
acacttgttaattgg

SEQ ID NO: 296808 - DNA, 15 bp, Homo sapiens
tacacttgttaattg

SEQ ID NO: 296809 - DNA, 15 bp, Homo sapiens
gtacacttgttaatt

SEQ ID NO: 296810 - DNA, 15 bp, Homo sapiens
agtacacttgttaat

SEQ ID NO: 296811 - DNA, 15 bp, Homo sapiens
aagtacacttgttaa

SEQ ID NO: 296812 - DNA, 15 bp, Homo sapiens
taagtacacttgtta

SEQ ID NO: 296813 - DNA, 15 bp, Homo sapiens
gtaagtacacttgtt

SEQ ID NO: 296814 - DNA, 15 bp, Homo sapiens
agtaagtacacttgt

SEQ ID NO: 296815 - DNA, 15 bp, Homo sapiens
tagtaagtacacttg

SEQ ID NO: 296816 - DNA, 15 bp, Homo sapiens
ttagtaagtacactt

SEQ ID NO: 296817 - DNA, 15 bp, Homo sapiens
tttagtaagtacact

SEQ ID NO: 296818 - DNA, 15 bp, Homo sapiens
ttttagtaagtacac

SEQ ID NO: 296819 - DNA, 15 bp, Homo sapiens
attttagtaagtaca

SEQ ID NO: 296820 - DNA, 15 bp, Homo sapiens
aattttagtaagtac

SEQ ID NO: 296821 - DNA, 15 bp, Homo sapiens
gaattttagtaagta

SEQ ID NO: 296822 - DNA, 15 bp, Homo sapiens
ggaattttagtaagt

SEQ ID NO: 296823 - DNA, 15 bp, Homo sapiens
gggaattttagtaag

SEQ ID NO: 296824 - DNA, 15 bp, Homo sapiens
tgggaattttagtaa

SEQ ID NO: 296825 - DNA, 15 bp, Homo sapiens
gtgggaattttagta

SEQ ID NO: 296826 - DNA, 15 bp, Homo sapiens
agtgggaattttagt

SEQ ID NO: 296827 - DNA, 15 bp, Homo sapiens
cagtgggaattttag

SEQ ID NO: 296828 - DNA, 15 bp, Homo sapiens
tcagtgggaatttta

SEQ ID NO: 296829 - DNA, 15 bp, Homo sapiens
gtcagtgggaatttt

SEQ ID NO: 296830 - DNA, 15 bp, Homo sapiens
agtcagtgggaattt

SEQ ID NO: 296831 - DNA, 15 bp, Homo sapiens
cagtcagtgggaatt

SEQ ID NO: 296832 - DNA, 15 bp, Homo sapiens
gcagtcagtgggaat

SEQ ID NO: 296833 - DNA, 15 bp, Homo sapiens
tgcagtcagtgggaa

SEQ ID NO: 296834 - DNA, 15 bp, Homo sapiens
ctgcagtcagtggga

SEQ ID NO: 296835 - DNA, 15 bp, Homo sapiens
actgcagtcagtggg

SEQ ID NO: 296836 - DNA, 15 bp, Homo sapiens
tactgcagtcagtgg

SEQ ID NO: 296837 - DNA, 15 bp, Homo sapiens
ttactgcagtcagtg

SEQ ID NO: 296838 - DNA, 15 bp, Homo sapiens
gttactgcagtcagt

SEQ ID NO: 296839 - DNA, 15 bp, Homo sapiens
agttactgcagtcag

SEQ ID NO: 296840 - DNA, 15 bp, Homo sapiens
tagttactgcagtca

SEQ ID NO: 296841 - DNA, 15 bp, Homo sapiens
atagttactgcagtc

SEQ ID NO: 296842 - DNA, 15 bp, Homo sapiens
aatagttactgcagt

SEQ ID NO: 296843 - DNA, 15 bp, Homo sapiens
aaatagttactgcag

SEQ ID NO: 296844 - DNA, 15 bp, Homo sapiens
aaaatagttactgca

SEQ ID NO: 296845 - DNA, 15 bp, Homo sapiens
aaaaatagttactgc

SEQ ID NO: 296846 - DNA, 15 bp, Homo sapiens
taaaaatagttactg

SEQ ID NO: 296847 - DNA, 15 bp, Homo sapiens
ataaaaatagttact

SEQ ID NO: 296848 - DNA, 15 bp, Homo sapiens
aataaaaatagttac

SEQ ID NO: 296849 - DNA, 15 bp, Homo sapiens
aaataaaaatagtta

SEQ ID NO: 296850 - DNA, 15 bp, Homo sapiens
aaaataaaaatagtt

SEQ ID NO: 296851 - DNA, 15 bp, Homo sapiens
aaaaataaaaatagt

SEQ ID NO: 296852 - DNA, 15 bp, Homo sapiens
aaaaaataaaaatag

SEQ ID NO: 296853 - DNA, 15 bp, Homo sapiens
ccaaaaaataaaaat

SEQ ID NO: 296854 - DNA, 15 bp, Homo sapiens
accaaaaaataaaaa

SEQ ID NO: 296855 - DNA, 15 bp, Homo sapiens
ataccaaaaaataaa

SEQ ID NO: 296856 - DNA, 15 bp, Homo sapiens
tataccaaaaaataa

SEQ ID NO: 296857 - DNA, 15 bp, Homo sapiens
ttataccaaaaaata

SEQ ID NO: 296858 - DNA, 15 bp, Homo sapiens
tttataccaaaaaat

SEQ ID NO: 296859 - DNA, 15 bp, Homo sapiens
atttataccaaaaaa

SEQ ID NO: 296860 - DNA, 15 bp, Homo sapiens
aatttataccaaaaa

SEQ ID NO: 296861 - DNA, 15 bp, Homo sapiens
aaatttataccaaaa

SEQ ID NO: 296862 - DNA, 15 bp, Homo sapiens
aaaatttataccaaa

SEQ ID NO: 296863 - DNA, 15 bp, Homo sapiens
aaaaatttataccaa

SEQ ID NO: 296864 - DNA, 15 bp, Homo sapiens
aaaaaatttatacca

SEQ ID NO: 296865 - DNA, 15 bp, Homo sapiens
aaaaaaatttatacc

SEQ ID NO: 296866 - DNA, 15 bp, Homo sapiens
aaaaaaaatttatac

SEQ ID NO: 296867 - DNA, 15 bp, Homo sapiens
caaaaaaaatttata

SEQ ID NO: 296868 - DNA, 15 bp, Homo sapiens
acaaaaaaaatttat

SEQ ID NO: 296869 - DNA, 15 bp, Homo sapiens
gacaaaaaaaattta

SEQ ID NO: 296870 - DNA, 15 bp, Homo sapiens
ggacaaaaaaaattt

SEQ ID NO: 296871 - DNA, 15 bp, Homo sapiens
tggacaaaaaaaatt

SEQ ID NO: 296872 - DNA, 15 bp, Homo sapiens
atggacaaaaaaaat

SEQ ID NO: 296873 - DNA, 15 bp, Homo sapiens
aatggacaaaaaaaa

SEQ ID NO: 296874 - DNA, 15 bp, Homo sapiens
aaatggacaaaaaaa

SEQ ID NO: 296875 - DNA, 15 bp, Homo sapiens
aaaatggacaaaaaa

SEQ ID NO: 296876 - DNA, 15 bp, Homo sapiens
aaaaatggacaaaaa

SEQ ID NO: 296877 - DNA, 15 bp, Homo sapiens
aaaaaatggacaaaa

SEQ ID NO: 296878 - DNA, 15 bp, Homo sapiens
taaaaaatggacaaa

SEQ ID NO: 296879 - DNA, 15 bp, Homo sapiens
gtaaaaaatggacaa

SEQ ID NO: 296880 - DNA, 15 bp, Homo sapiens
agtaaaaaatggaca

SEQ ID NO: 296881 - DNA, 15 bp, Homo sapiens
aagtaaaaaatggac

SEQ ID NO: 296882 - DNA, 15 bp, Homo sapiens
taagtaaaaaatgga

SEQ ID NO: 296883 - DNA, 15 bp, Homo sapiens
ataagtaaaaaatgg

SEQ ID NO: 296884 - DNA, 15 bp, Homo sapiens
cataagtaaaaaatg

SEQ ID NO: 296885 - DNA, 15 bp, Homo sapiens
acataagtaaaaaat

SEQ ID NO: 296886 - DNA, 15 bp, Homo sapiens
gacataagtaaaaaa

SEQ ID NO: 296887 - DNA, 15 bp, Homo sapiens
ggacataagtaaaaa

SEQ ID NO: 296888 - DNA, 15 bp, Homo sapiens
aggacataagtaaaa

SEQ ID NO: 296889 - DNA, 15 bp, Homo sapiens
aaggacataagtaaa

SEQ ID NO: 296890 - DNA, 15 bp, Homo sapiens
gaaggacataagtaa

SEQ ID NO: 296891 - DNA, 15 bp, Homo sapiens
tgaaggacataagta

SEQ ID NO: 296892 - DNA, 15 bp, Homo sapiens
ttgaaggacataagt

SEQ ID NO: 296893 - DNA, 15 bp, Homo sapiens
tttgaaggacataag

SEQ ID NO: 296894 - DNA, 15 bp, Homo sapiens
atttgaaggacataa

SEQ ID NO: 296895 - DNA, 15 bp, Homo sapiens
catttgaaggacata

SEQ ID NO: 296896 - DNA, 15 bp, Homo sapiens
acatttgaaggacat

SEQ ID NO: 296897 - DNA, 15 bp, Homo sapiens
tacatttgaaggaca

SEQ ID NO: 296898 - DNA, 15 bp, Homo sapiens
atacatttgaaggac

SEQ ID NO: 296899 - DNA, 15 bp, Homo sapiens
catacatttgaagga

SEQ ID NO: 296900 - DNA, 15 bp, Homo sapiens
tcatacatttgaagg

SEQ ID NO: 296901 - DNA, 15 bp, Homo sapiens
ttcatacatttgaag

SEQ ID NO: 296902 - DNA, 15 bp, Homo sapiens
tttcatacatttgaa

SEQ ID NO: 296903 - DNA, 15 bp, Homo sapiens
atttcatacatttga

SEQ ID NO: 296904 - DNA, 15 bp, Homo sapiens
tatttcatacatttg

SEQ ID NO: 296905 - DNA, 15 bp, Homo sapiens
gtatttcatacattt

SEQ ID NO: 296906 - DNA, 15 bp, Homo sapiens
agtatttcatacatt

SEQ ID NO: 296907 - DNA, 15 bp, Homo sapiens
cagtatttcatacat

SEQ ID NO: 296908 - DNA, 15 bp, Homo sapiens
ccagtatttcataca

SEQ ID NO: 296909 - DNA, 15 bp, Homo sapiens
gccagtatttcatac

SEQ ID NO: 296910 - DNA, 15 bp, Homo sapiens
tgccagtatttcata

SEQ ID NO: 296911 - DNA, 15 bp, Homo sapiens
ctgccagtatttcat

SEQ ID NO: 296912 - DNA, 15 bp, Homo sapiens
actgccagtatttca

SEQ ID NO: 296913 - DNA, 15 bp, Homo sapiens
tactgccagtatttc

SEQ ID NO: 296914 - DNA, 15 bp, Homo sapiens
ttactgccagtattt

SEQ ID NO: 296915 - DNA, 15 bp, Homo sapiens
cttactgccagtatt

SEQ ID NO: 296916 - DNA, 15 bp, Homo sapiens
gcttactgccagtat

SEQ ID NO: 296917 - DNA, 15 bp, Homo sapiens
ggcttactgccagta

SEQ ID NO: 296918 - DNA, 15 bp, Homo sapiens
tggcttactgccagt

SEQ ID NO: 296919 - DNA, 15 bp, Homo sapiens
ttggcttactgccag

SEQ ID NO: 296920 - DNA, 15 bp, Homo sapiens
gttggcttactgcca

SEQ ID NO: 296921 - DNA, 15 bp, Homo sapiens
agttggcttactgcc

SEQ ID NO: 296922 - DNA, 15 bp, Homo sapiens
tagttggcttactgc

SEQ ID NO: 296923 - DNA, 15 bp, Homo sapiens
ttagttggcttactg

SEQ ID NO: 296924 - DNA, 15 bp, Homo sapiens
attagttggcttact

SEQ ID NO: 296925 - DNA, 15 bp, Homo sapiens
aattagttggcttac

SEQ ID NO: 296926 - DNA, 15 bp, Homo sapiens
aaattagttggctta

SEQ ID NO: 296927 - DNA, 15 bp, Homo sapiens
aaaattagttggctt

SEQ ID NO: 296928 - DNA, 15 bp, Homo sapiens
aaaaattagttggct

SEQ ID NO: 296929 - DNA, 15 bp, Homo sapiens
caaaaattagttggc

SEQ ID NO: 296930 - DNA, 15 bp, Homo sapiens
gcaaaaattagttgg

SEQ ID NO: 296931 - DNA, 15 bp, Homo sapiens
agcaaaaattagttg

SEQ ID NO: 296932 - DNA, 15 bp, Homo sapiens
cagcaaaaattagtt

SEQ ID NO: 296933 - DNA, 15 bp, Homo sapiens
tcagcaaaaattagt

SEQ ID NO: 296934 - DNA, 15 bp, Homo sapiens
atcagcaaaaattag

SEQ ID NO: 296935 - DNA, 15 bp, Homo sapiens
tatcagcaaaaatta

SEQ ID NO: 296936 - DNA, 15 bp, Homo sapiens
ctatcagcaaaaatt

SEQ ID NO: 296937 - DNA, 15 bp, Homo sapiens
tctatcagcaaaaat

SEQ ID NO: 296938 - DNA, 15 bp, Homo sapiens
gtctatcagcaaaaa

SEQ ID NO: 296939 - DNA, 15 bp, Homo sapiens
ggtctatcagcaaaa

SEQ ID NO: 296940 - DNA, 15 bp, Homo sapiens
tggtctatcagcaaa

SEQ ID NO: 296941 - DNA, 15 bp, Homo sapiens
ttggtctatcagcaa

SEQ ID NO: 296942 - DNA, 15 bp, Homo sapiens
cttggtctatcagca

SEQ ID NO: 296943 - DNA, 15 bp, Homo sapiens
tcttggtctatcagc

SEQ ID NO: 296944 - DNA, 15 bp, Homo sapiens
ttcttggtctatcag

SEQ ID NO: 296945 - DNA, 15 bp, Homo sapiens
tttcttggtctatca

SEQ ID NO: 296946 - DNA, 15 bp, Homo sapiens
atttcttggtctatc

SEQ ID NO: 296947 - DNA, 15 bp, Homo sapiens
catttcttggtctat

SEQ ID NO: 296948 - DNA, 15 bp, Homo sapiens
gcatttcttggtcta

SEQ ID NO: 296949 - DNA, 15 bp, Homo sapiens
agcatttcttggtct

SEQ ID NO: 296950 - DNA, 15 bp, Homo sapiens
aagcatttcttggtc

SEQ ID NO: 296951 - DNA, 15 bp, Homo sapiens
aaagcatttcttggt

SEQ ID NO: 296952 - DNA, 15 bp, Homo sapiens
gaaagcatttcttgg

SEQ ID NO: 296953 - DNA, 15 bp, Homo sapiens
tgaaagcatttcttg

SEQ ID NO: 296954 - DNA, 15 bp, Homo sapiens
ttgaaagcatttctt

SEQ ID NO: 296955 - DNA, 15 bp, Homo sapiens
tttgaaagcatttct

SEQ ID NO: 296956 - DNA, 15 bp, Homo sapiens
ttttgaaagcatttc

SEQ ID NO: 296957 - DNA, 15 bp, Homo sapiens
attttgaaagcattt

SEQ ID NO: 296958 - DNA, 15 bp, Homo sapiens
aattttgaaagcatt

SEQ ID NO: 296959 - DNA, 15 bp, Homo sapiens
taattttgaaagcat

SEQ ID NO: 296960 - DNA, 15 bp, Homo sapiens
ataattttgaaagca

SEQ ID NO: 296961 - DNA, 15 bp, Homo sapiens
aataattttgaaagc

SEQ ID NO: 296962 - DNA, 15 bp, Homo sapiens
aaataattttgaaag

SEQ ID NO: 296963 - DNA, 15 bp, Homo sapiens
aaaataattttgaaa

SEQ ID NO: 296964 - DNA, 15 bp, Homo sapiens
aaaaataattttgaa

SEQ ID NO: 296965 - DNA, 15 bp, Homo sapiens
caaaaataattttga

SEQ ID NO: 296966 - DNA, 15 bp, Homo sapiens
tcaaaaataattttg

SEQ ID NO: 296967 - DNA, 15 bp, Homo sapiens
gtcaaaaataatttt

SEQ ID NO: 296968 - DNA, 15 bp, Homo sapiens
ggtcaaaaataattt

SEQ ID NO: 296969 - DNA, 15 bp, Homo sapiens
gggtcaaaaataatt

SEQ ID NO: 296970 - DNA, 15 bp, Homo sapiens
tgggtcaaaaataat

SEQ ID NO: 296971 - DNA, 15 bp, Homo sapiens
gtgggtcaaaaataa

SEQ ID NO: 296972 - DNA, 15 bp, Homo sapiens
tgtgggtcaaaaata

SEQ ID NO: 296973 - DNA, 15 bp, Homo sapiens
ctgtgggtcaaaaat

SEQ ID NO: 296974 - DNA, 15 bp, Homo sapiens
cctgtgggtcaaaaa

SEQ ID NO: 296975 - DNA, 15 bp, Homo sapiens
gcctgtgggtcaaaa

SEQ ID NO: 296976 - DNA, 15 bp, Homo sapiens
tgcctgtgggtcaaa

SEQ ID NO: 296977 - DNA, 15 bp, Homo sapiens
atgcctgtgggtcaa

SEQ ID NO: 296978 - DNA, 15 bp, Homo sapiens
tatgcctgtgggtca

SEQ ID NO: 296979 - DNA, 15 bp, Homo sapiens
atatgcctgtgggtc

SEQ ID NO: 296980 - DNA, 15 bp, Homo sapiens
aatatgcctgtgggt

SEQ ID NO: 296981 - DNA, 15 bp, Homo sapiens
aaatatgcctgtggg

SEQ ID NO: 296982 - DNA, 15 bp, Homo sapiens
aaaatatgcctgtgg

SEQ ID NO: 296983 - DNA, 15 bp, Homo sapiens
aaaaatatgcctgtg

SEQ ID NO: 296984 - DNA, 15 bp, Homo sapiens
taaaaatatgcctgt

SEQ ID NO: 296985 - DNA, 15 bp, Homo sapiens
gtaaaaatatgcctg

SEQ ID NO: 296986 - DNA, 15 bp, Homo sapiens
agtaaaaatatgcct

SEQ ID NO: 296987 - DNA, 15 bp, Homo sapiens
tagtaaaaatatgcc

SEQ ID NO: 296988 - DNA, 15 bp, Homo sapiens
atagtaaaaatatgc

SEQ ID NO: 296989 - DNA, 15 bp, Homo sapiens
catagtaaaaatatg

SEQ ID NO: 296990 - DNA, 15 bp, Homo sapiens
tcatagtaaaaatat

SEQ ID NO: 296991 - DNA, 15 bp, Homo sapiens
ttcatagtaaaaata

SEQ ID NO: 296992 - DNA, 15 bp, Homo sapiens
attcatagtaaaaat

SEQ ID NO: 296993 - DNA, 15 bp, Homo sapiens
aattcatagtaaaaa

SEQ ID NO: 296994 - DNA, 15 bp, Homo sapiens
caattcatagtaaaa

SEQ ID NO: 296995 - DNA, 15 bp, Homo sapiens
gcaattcatagtaaa

SEQ ID NO: 296996 - DNA, 15 bp, Homo sapiens
ggcaattcatagtaa

SEQ ID NO: 296997 - DNA, 15 bp, Homo sapiens
aggcaattcatagta

SEQ ID NO: 296998 - DNA, 15 bp, Homo sapiens
taggcaattcatagt

SEQ ID NO: 296999 - DNA, 15 bp, Homo sapiens
ataggcaattcatag

SEQ ID NO: 297000 - DNA, 15 bp, Homo sapiens
cataggcaattcata

SEQ ID NO: 297001 - DNA, 15 bp, Homo sapiens
acataggcaattcat

SEQ ID NO: 297002 - DNA, 15 bp, Homo sapiens
aacataggcaattca

SEQ ID NO: 297003 - DNA, 15 bp, Homo sapiens
aaacataggcaattc

SEQ ID NO: 297004 - DNA, 15 bp, Homo sapiens
taaacataggcaatt

SEQ ID NO: 297005 - DNA, 15 bp, Homo sapiens
ataaacataggcaat

SEQ ID NO: 297006 - DNA, 15 bp, Homo sapiens
aataaacataggcaa

SEQ ID NO: 297007 - DNA, 15 bp, Homo sapiens
taataaacataggca

SEQ ID NO: 297008 - DNA, 15 bp, Homo sapiens
ttaataaacataggc

SEQ ID NO: 297009 - DNA, 15 bp, Homo sapiens
cttaataaacatagg

SEQ ID NO: 297010 - DNA, 15 bp, Homo sapiens
gcttaataaacatag

SEQ ID NO: 297011 - DNA, 15 bp, Homo sapiens
agcttaataaacata

SEQ ID NO: 297012 - DNA, 15 bp, Homo sapiens
ttcaagcttaataaa

SEQ ID NO: 297013 - DNA, 15 bp, Homo sapiens
attcaagcttaataa

SEQ ID NO: 297014 - DNA, 15 bp, Homo sapiens
cattcaagcttaata

SEQ ID NO: 297015 - DNA, 15 bp, Homo sapiens
ccattcaagcttaat

SEQ ID NO: 297016 - DNA, 15 bp, Homo sapiens
gccattcaagcttaa

SEQ ID NO: 297017 - DNA, 15 bp, Homo sapiens
tgccattcaagctta

SEQ ID NO: 297018 - DNA, 15 bp, Homo sapiens
atgccattcaagctt

SEQ ID NO: 297019 - DNA, 15 bp, Homo sapiens
aatgccattcaagct

SEQ ID NO: 297020 - DNA, 15 bp, Homo sapiens
gaatgccattcaagc

SEQ ID NO: 297021 - DNA, 15 bp, Homo sapiens
tgaatgccattcaag

SEQ ID NO: 297022 - DNA, 15 bp, Homo sapiens
atgaatgccattcaa

SEQ ID NO: 297023 - DNA, 15 bp, Homo sapiens
gatgaatgccattca

SEQ ID NO: 297024 - DNA, 15 bp, Homo sapiens
tgatgaatgccattc

SEQ ID NO: 297025 - DNA, 15 bp, Homo sapiens
ttgatgaatgccatt

SEQ ID NO: 297026 - DNA, 15 bp, Homo sapiens
tttgatgaatgccat

SEQ ID NO: 297027 - DNA, 15 bp, Homo sapiens
ttttgatgaatgcca

SEQ ID NO: 297028 - DNA, 15 bp, Homo sapiens
tttttgatgaatgcc

SEQ ID NO: 297029 - DNA, 15 bp, Homo sapiens
gtttttgatgaatgc

SEQ ID NO: 297030 - DNA, 15 bp, Homo sapiens
ggtttttgatgaatg

SEQ ID NO: 297031 - DNA, 15 bp, Homo sapiens
gggtttttgatgaat

SEQ ID NO: 297032 - DNA, 15 bp, Homo sapiens
tgggtttttgatgaa

SEQ ID NO: 297033 - DNA, 15 bp, Homo sapiens
ttgggtttttgatga

SEQ ID NO: 297034 - DNA, 15 bp, Homo sapiens
tttgggtttttgatg

SEQ ID NO: 297035 - DNA, 15 bp, Homo sapiens
ttttgggtttttgat

SEQ ID NO: 297036 - DNA, 15 bp, Homo sapiens
gttttgggtttttga

SEQ ID NO: 297037 - DNA, 15 bp, Homo sapiens
ggttttgggtttttg

SEQ ID NO: 297038 - DNA, 15 bp, Homo sapiens
gggttttgggttttt

SEQ ID NO: 297039 - DNA, 15 bp, Homo sapiens
tgggttttgggtttt

SEQ ID NO: 297040 - DNA, 15 bp, Homo sapiens
gtgggttttgggttt

SEQ ID NO: 297041 - DNA, 15 bp, Homo sapiens
agtgggttttgggtt

SEQ ID NO: 297042 - DNA, 15 bp, Homo sapiens
cagtgggttttgggt

SEQ ID NO: 297043 - DNA, 15 bp, Homo sapiens
gcagtgggttttggg

SEQ ID NO: 297044 - DNA, 15 bp, Homo sapiens
tgcagtgggttttgg

SEQ ID NO: 297045 - DNA, 15 bp, Homo sapiens
ttgcagtgggttttg

SEQ ID NO: 297046 - DNA, 15 bp, Homo sapiens
attgcagtgggtttt

SEQ ID NO: 297047 - DNA, 15 bp, Homo sapiens
cattgcagtgggttt

SEQ ID NO: 297048 - DNA, 15 bp, Homo sapiens
gcattgcagtgggtt

SEQ ID NO: 297049 - DNA, 15 bp, Homo sapiens
tgcattgcagtgggt

SEQ ID NO: 297050 - DNA, 15 bp, Homo sapiens
ctgcattgcagtggg

SEQ ID NO: 297051 - DNA, 15 bp, Homo sapiens
actgcattgcagtgg

SEQ ID NO: 297052 - DNA, 15 bp, Homo sapiens
cactgcattgcagtg

SEQ ID NO: 297053 - DNA, 15 bp, Homo sapiens
tcactgcattgcagt

SEQ ID NO: 297054 - DNA, 15 bp, Homo sapiens
atcactgcattgcag

SEQ ID NO: 297055 - DNA, 15 bp, Homo sapiens
aatcactgcattgca

SEQ ID NO: 297056 - DNA, 15 bp, Homo sapiens
aaatcactgcattgc

SEQ ID NO: 297057 - DNA, 15 bp, Homo sapiens
gaaatcactgcattg

SEQ ID NO: 297058 - DNA, 15 bp, Homo sapiens
ggaaatcactgcatt

SEQ ID NO: 297059 - DNA, 15 bp, Homo sapiens
aggaaatcactgcat

SEQ ID NO: 297060 - DNA, 15 bp, Homo sapiens
aaggaaatcactgca

SEQ ID NO: 297061 - DNA, 15 bp, Homo sapiens
aaaggaaatcactgc

SEQ ID NO: 297062 - DNA, 15 bp, Homo sapiens
aaaaggaaatcactg

SEQ ID NO: 297063 - DNA, 15 bp, Homo sapiens
aaaaaggaaatcact

SEQ ID NO: 297064 - DNA, 15 bp, Homo sapiens
taaaaaggaaatcac

SEQ ID NO: 297065 - DNA, 15 bp, Homo sapiens
ttaaaaaggaaatca

SEQ ID NO: 297066 - DNA, 15 bp, Homo sapiens
tttaaaaaggaaatc

SEQ ID NO: 297067 - DNA, 15 bp, Homo sapiens
ttttaaaaaggaaat

SEQ ID NO: 297068 - DNA, 15 bp, Homo sapiens
attttaaaaaggaaa

SEQ ID NO: 297069 - DNA, 15 bp, Homo sapiens
tattttaaaaaggaa

SEQ ID NO: 297070 - DNA, 15 bp, Homo sapiens
atattttaaaaagga

SEQ ID NO: 297071 - DNA, 15 bp, Homo sapiens
aatattttaaaaagg

SEQ ID NO: 297072 - DNA, 15 bp, Homo sapiens
aaatattttaaaaag

SEQ ID NO: 297073 - DNA, 15 bp, Homo sapiens
aaaatattttaaaaa

SEQ ID NO: 297074 - DNA, 15 bp, Homo sapiens
aaaaatattttaaaa

SEQ ID NO: 297075 - DNA, 15 bp, Homo sapiens
caaaaatattttaaa

SEQ ID NO: 297076 - DNA, 15 bp, Homo sapiens
acaaaaatattttaa

SEQ ID NO: 297077 - DNA, 15 bp, Homo sapiens
cacaaaaatatttta

SEQ ID NO: 297078 - DNA, 15 bp, Homo sapiens
acacaaaaatatttt

SEQ ID NO: 297079 - DNA, 15 bp, Homo sapiens
cacacaaaaatattt

SEQ ID NO: 297080 - DNA, 15 bp, Homo sapiens
tcacacaaaaatatt

SEQ ID NO: 297081 - DNA, 15 bp, Homo sapiens
atcacacaaaaatat

SEQ ID NO: 297082 - DNA, 15 bp, Homo sapiens
aatcacacaaaaata

SEQ ID NO: 297083 - DNA, 15 bp, Homo sapiens
aaatcacacaaaaat

SEQ ID NO: 297084 - DNA, 15 bp, Homo sapiens
caaatcacacaaaaa

SEQ ID NO: 297085 - DNA, 15 bp, Homo sapiens
acaaatcacacaaaa

SEQ ID NO: 297086 - DNA, 15 bp, Homo sapiens
aacaaatcacacaaa

SEQ ID NO: 297087 - DNA, 15 bp, Homo sapiens
gaacaaatcacacaa

SEQ ID NO: 297088 - DNA, 15 bp, Homo sapiens
tgaacaaatcacaca

SEQ ID NO: 297089 - DNA, 15 bp, Homo sapiens
ctgaacaaatcacac

SEQ ID NO: 297090 - DNA, 15 bp, Homo sapiens
cctgaacaaatcaca

SEQ ID NO: 297091 - DNA, 15 bp, Homo sapiens
gcctgaacaaatcac

SEQ ID NO: 297092 - DNA, 15 bp, Homo sapiens
tgcctgaacaaatca

SEQ ID NO: 297093 - DNA, 15 bp, Homo sapiens
ttgcctgaacaaatc

SEQ ID NO: 297094 - DNA, 15 bp, Homo sapiens
tttgcctgaacaaat

SEQ ID NO: 297095 - DNA, 15 bp, Homo sapiens
atttgcctgaacaaa

SEQ ID NO: 297096 - DNA, 15 bp, Homo sapiens
tatttgcctgaacaa

SEQ ID NO: 297097 - DNA, 15 bp, Homo sapiens
gtatttgcctgaaca

SEQ ID NO: 297098 - DNA, 15 bp, Homo sapiens
ggtatttgcctgaac

SEQ ID NO: 297099 - DNA, 15 bp, Homo sapiens
gggtatttgcctgaa

SEQ ID NO: 297100 - DNA, 15 bp, Homo sapiens
tgggtatttgcctga

SEQ ID NO: 297101 - DNA, 15 bp, Homo sapiens
atgggtatttgcctg

SEQ ID NO: 297102 - DNA, 15 bp, Homo sapiens
tatgggtatttgcct

SEQ ID NO: 297103 - DNA, 15 bp, Homo sapiens
ctatgggtatttgcc

SEQ ID NO: 297104 - DNA, 15 bp, Homo sapiens
gctatgggtatttgc

SEQ ID NO: 297105 - DNA, 15 bp, Homo sapiens
ggctatgggtatttg

SEQ ID NO: 297106 - DNA, 15 bp, Homo sapiens
aggctatgggtattt

SEQ ID NO: 297107 - DNA, 15 bp, Homo sapiens
aaggctatgggtatt

SEQ ID NO: 297108 - DNA, 15 bp, Homo sapiens
aaaggctatgggtat

SEQ ID NO: 297109 - DNA, 15 bp, Homo sapiens
aaaaggctatgggta

SEQ ID NO: 297110 - DNA, 15 bp, Homo sapiens
taaaaggctatgggt

SEQ ID NO: 297111 - DNA, 15 bp, Homo sapiens
ataaaaggctatggg

SEQ ID NO: 297112 - DNA, 15 bp, Homo sapiens
aataaaaggctatgg

SEQ ID NO: 297113 - DNA, 15 bp, Homo sapiens
aaataaaaggctatg

SEQ ID NO: 297114 - DNA, 15 bp, Homo sapiens
caaataaaaggctat

SEQ ID NO: 297115 - DNA, 15 bp, Homo sapiens
tcaaataaaaggcta

SEQ ID NO: 297116 - DNA, 15 bp, Homo sapiens
atcaaataaaaggct

SEQ ID NO: 297117 - DNA, 15 bp, Homo sapiens
tatcaaataaaaggc

SEQ ID NO: 297118 - DNA, 15 bp, Homo sapiens
ttatcaaataaaagg

SEQ ID NO: 297119 - DNA, 15 bp, Homo sapiens
tttatcaaataaaag

SEQ ID NO: 297120 - DNA, 15 bp, Homo sapiens
ttttatcaaataaaa

SEQ ID NO: 297121 - DNA, 15 bp, Homo sapiens
ccttttatcaaataa

SEQ ID NO: 297122 - DNA, 15 bp, Homo sapiens
gccttttatcaaata

SEQ ID NO: 297123 - DNA, 15 bp, Homo sapiens
agccttttatcaaat

SEQ ID NO: 297124 - DNA, 15 bp, Homo sapiens
cagccttttatcaaa

SEQ ID NO: 297125 - DNA, 15 bp, Homo sapiens
acagccttttatcaa

SEQ ID NO: 297126 - DNA, 15 bp, Homo sapiens
tacagccttttatca

SEQ ID NO: 297127 - DNA, 15 bp, Homo sapiens
ttacagccttttatc

SEQ ID NO: 297128 - DNA, 15 bp, Homo sapiens
cttacagccttttat

SEQ ID NO: 297129 - DNA, 15 bp, Homo sapiens
ccttacagcctttta

SEQ ID NO: 297130 - DNA, 15 bp, Homo sapiens
accttacagcctttt

SEQ ID NO: 297131 - DNA, 15 bp, Homo sapiens
aaccttacagccttt

SEQ ID NO: 297132 - DNA, 15 bp, Homo sapiens
taaccttacagcctt

SEQ ID NO: 297133 - DNA, 15 bp, Homo sapiens
ttaaccttacagcct

SEQ ID NO: 297134 - DNA, 15 bp, Homo sapiens
tttaaccttacagcc

SEQ ID NO: 297135 - DNA, 15 bp, Homo sapiens
ttttaaccttacagc

SEQ ID NO: 297136 - DNA, 15 bp, Homo sapiens
cttttaaccttacag

SEQ ID NO: 297137 - DNA, 15 bp, Homo sapiens
acttttaaccttaca

SEQ ID NO: 297138 - DNA, 15 bp, Homo sapiens
tacttttaaccttac

SEQ ID NO: 297139 - DNA, 15 bp, Homo sapiens
atacttttaacctta

SEQ ID NO: 297140 - DNA, 15 bp, Homo sapiens
aatacttttaacctt

SEQ ID NO: 297141 - DNA, 15 bp, Homo sapiens
caatacttttaacct

SEQ ID NO: 297142 - DNA, 15 bp, Homo sapiens
ccaatacttttaacc

SEQ ID NO: 297143 - DNA, 15 bp, Homo sapiens
accaatacttttaac

SEQ ID NO: 297144 - DNA, 15 bp, Homo sapiens
taaaccaatactttt

SEQ ID NO: 297145 - DNA, 15 bp, Homo sapiens
ctaaaccaatacttt

SEQ ID NO: 297146 - DNA, 15 bp, Homo sapiens
tctaaaccaatactt

SEQ ID NO: 297147 - DNA, 15 bp, Homo sapiens
ctctaaaccaatact

SEQ ID NO: 297148 - DNA, 15 bp, Homo sapiens
gctctaaaccaatac

SEQ ID NO: 297149 - DNA, 15 bp, Homo sapiens
tgctctaaaccaata

SEQ ID NO: 297150 - DNA, 15 bp, Homo sapiens
ttgctctaaaccaat

SEQ ID NO: 297151 - DNA, 15 bp, Homo sapiens
tttgctctaaaccaa

SEQ ID NO: 297152 - DNA, 15 bp, Homo sapiens
ttttgctctaaacca

SEQ ID NO: 297153 - DNA, 15 bp, Homo sapiens
attttgctctaaacc

SEQ ID NO: 297154 - DNA, 15 bp, Homo sapiens
cattttgctctaaac

SEQ ID NO: 297155 - DNA, 15 bp, Homo sapiens
ccattttgctctaaa

SEQ ID NO: 297156 - DNA, 15 bp, Homo sapiens
tccattttgctctaa

SEQ ID NO: 297157 - DNA, 15 bp, Homo sapiens
atccattttgctcta

SEQ ID NO: 297158 - DNA, 15 bp, Homo sapiens
aatccattttgctct

SEQ ID NO: 297159 - DNA, 15 bp, Homo sapiens
taatccattttgctc

SEQ ID NO: 297160 - DNA, 15 bp, Homo sapiens
ctaatccattttgct

SEQ ID NO: 297161 - DNA, 15 bp, Homo sapiens
tctaatccattttgc

SEQ ID NO: 297162 - DNA, 15 bp, Homo sapiens
gtctaatccattttg

SEQ ID NO: 297163 - DNA, 15 bp, Homo sapiens
agtctaatccatttt

SEQ ID NO: 297164 - DNA, 15 bp, Homo sapiens
aagtctaatccattt

SEQ ID NO: 297165 - DNA, 15 bp, Homo sapiens
gaagtctaatccatt

SEQ ID NO: 297166 - DNA, 15 bp, Homo sapiens
agaagtctaatccat

SEQ ID NO: 297167 - DNA, 15 bp, Homo sapiens
cagaagtctaatcca

SEQ ID NO: 297168 - DNA, 15 bp, Homo sapiens
acagaagtctaatcc

SEQ ID NO: 297169 - DNA, 15 bp, Homo sapiens
gacagaagtctaatc

SEQ ID NO: 297170 - DNA, 15 bp, Homo sapiens
agacagaagtctaat

SEQ ID NO: 297171 - DNA, 15 bp, Homo sapiens
tagacagaagtctaa

SEQ ID NO: 297172 - DNA, 15 bp, Homo sapiens
ctagacagaagtcta

SEQ ID NO: 297173 - DNA, 15 bp, Homo sapiens
cctagacagaagtct

SEQ ID NO: 297174 - DNA, 15 bp, Homo sapiens
ccctagacagaagtc

SEQ ID NO: 297175 - DNA, 15 bp, Homo sapiens
accctagacagaagt

SEQ ID NO: 297176 - DNA, 15 bp, Homo sapiens
aaccctagacagaag

SEQ ID NO: 297177 - DNA, 15 bp, Homo sapiens
aaaccctagacagaa

SEQ ID NO: 297178 - DNA, 15 bp, Homo sapiens
caaaccctagacaga

SEQ ID NO: 297179 - DNA, 15 bp, Homo sapiens
ccaaaccctagacag

SEQ ID NO: 297180 - DNA, 15 bp, Homo sapiens
gccaaaccctagaca

SEQ ID NO: 297181 - DNA, 15 bp, Homo sapiens
agccaaaccctagac

SEQ ID NO: 297182 - DNA, 15 bp, Homo sapiens
tagccaaaccctaga

SEQ ID NO: 297183 - DNA, 15 bp, Homo sapiens
atagccaaaccctag

SEQ ID NO: 297184 - DNA, 15 bp, Homo sapiens
aatagccaaacccta

SEQ ID NO: 297185 - DNA, 15 bp, Homo sapiens
aaatagccaaaccct

SEQ ID NO: 297186 - DNA, 15 bp, Homo sapiens
caaatagccaaaccc

SEQ ID NO: 297187 - DNA, 15 bp, Homo sapiens
acaaatagccaaacc

SEQ ID NO: 297188 - DNA, 15 bp, Homo sapiens
aacaaatagccaaac

SEQ ID NO: 297189 - DNA, 15 bp, Homo sapiens
taacaaatagccaaa

SEQ ID NO: 297190 - DNA, 15 bp, Homo sapiens
ataacaaatagccaa

SEQ ID NO: 297191 - DNA, 15 bp, Homo sapiens
tataacaaatagcca

SEQ ID NO: 297192 - DNA, 15 bp, Homo sapiens
atataacaaatagcc

SEQ ID NO: 297193 - DNA, 15 bp, Homo sapiens
aatataacaaatagc

SEQ ID NO: 297194 - DNA, 15 bp, Homo sapiens
aaatataacaaatag

SEQ ID NO: 297195 - DNA, 15 bp, Homo sapiens
caaatataacaaata

SEQ ID NO: 297196 - DNA, 15 bp, Homo sapiens
acaaatataacaaat

SEQ ID NO: 297197 - DNA, 15 bp, Homo sapiens
aacaaatataacaaa

SEQ ID NO: 297198 - DNA, 15 bp, Homo sapiens
taacaaatataacaa

SEQ ID NO: 297199 - DNA, 15 bp, Homo sapiens
gtaacaaatataaca

SEQ ID NO: 297200 - DNA, 15 bp, Homo sapiens
agtaacaaatataac

SEQ ID NO: 297201 - DNA, 15 bp, Homo sapiens
aagtaacaaatataa

SEQ ID NO: 297202 - DNA, 15 bp, Homo sapiens
caagtaacaaatata

SEQ ID NO: 297203 - DNA, 15 bp, Homo sapiens
gcaagtaacaaatat

SEQ ID NO: 297204 - DNA, 15 bp, Homo sapiens
tgcaagtaacaaata

SEQ ID NO: 297205 - DNA, 15 bp, Homo sapiens
ttgcaagtaacaaat

SEQ ID NO: 297206 - DNA, 15 bp, Homo sapiens
cttgcaagtaacaaa

SEQ ID NO: 297207 - DNA, 15 bp, Homo sapiens
tcttgcaagtaacaa

SEQ ID NO: 297208 - DNA, 15 bp, Homo sapiens
ctcttgcaagtaaca

SEQ ID NO: 297209 - DNA, 15 bp, Homo sapiens
tctcttgcaagtaac

SEQ ID NO: 297210 - DNA, 15 bp, Homo sapiens
ttctcttgcaagtaa

SEQ ID NO: 297211 - DNA, 15 bp, Homo sapiens
cttctcttgcaagta

SEQ ID NO: 297212 - DNA, 15 bp, Homo sapiens
gcttctcttgcaagt

SEQ ID NO: 297213 - DNA, 15 bp, Homo sapiens
tgcttctcttgcaag

SEQ ID NO: 297214 - DNA, 15 bp, Homo sapiens
atgcttctcttgcaa

SEQ ID NO: 297215 - DNA, 15 bp, Homo sapiens
tatgcttctcttgca

SEQ ID NO: 297216 - DNA, 15 bp, Homo sapiens
ttatgcttctcttgc

SEQ ID NO: 297217 - DNA, 15 bp, Homo sapiens
gttatgcttctcttg

SEQ ID NO: 297218 - DNA, 15 bp, Homo sapiens
agttatgcttctctt

SEQ ID NO: 297219 - DNA, 15 bp, Homo sapiens
gagttatgcttctct

SEQ ID NO: 297220 - DNA, 15 bp, Homo sapiens
agagttatgcttctc

SEQ ID NO: 297221 - DNA, 15 bp, Homo sapiens
cagagttatgcttct

SEQ ID NO: 297222 - DNA, 15 bp, Homo sapiens
acagagttatgcttc

SEQ ID NO: 297223 - DNA, 15 bp, Homo sapiens
gacagagttatgctt

SEQ ID NO: 297224 - DNA, 15 bp, Homo sapiens
agacagagttatgct

SEQ ID NO: 297225 - DNA, 15 bp, Homo sapiens
cagacagagttatgc

SEQ ID NO: 297226 - DNA, 15 bp, Homo sapiens
acagacagagttatg

SEQ ID NO: 297227 - DNA, 15 bp, Homo sapiens
aacagacagagttat

SEQ ID NO: 297228 - DNA, 15 bp, Homo sapiens
aaacagacagagtta

SEQ ID NO: 297229 - DNA, 15 bp, Homo sapiens
aaaacagacagagtt

SEQ ID NO: 297230 - DNA, 15 bp, Homo sapiens
taaaacagacagagt

SEQ ID NO: 297231 - DNA, 15 bp, Homo sapiens
ttaaaacagacagag

SEQ ID NO: 297232 - DNA, 15 bp, Homo sapiens
tttaaaacagacaga

SEQ ID NO: 297233 - DNA, 15 bp, Homo sapiens
ttttaaaacagacag

SEQ ID NO: 297234 - DNA, 15 bp, Homo sapiens
tttttaaaacagaca

SEQ ID NO: 297235 - DNA, 15 bp, Homo sapiens
ctttttaaaacagac

SEQ ID NO: 297236 - DNA, 15 bp, Homo sapiens
tctttttaaaacaga

SEQ ID NO: 297237 - DNA, 15 bp, Homo sapiens
ctctttttaaaacag

SEQ ID NO: 297238 - DNA, 15 bp, Homo sapiens
actctttttaaaaca

SEQ ID NO: 297239 - DNA, 15 bp, Homo sapiens
cactctttttaaaac

SEQ ID NO: 297240 - DNA, 15 bp, Homo sapiens
acactctttttaaaa

SEQ ID NO: 297241 - DNA, 15 bp, Homo sapiens
cacactctttttaaa

SEQ ID NO: 297242 - DNA, 15 bp, Homo sapiens
acacactctttttaa

SEQ ID NO: 297243 - DNA, 15 bp, Homo sapiens
tacacactcttttta

SEQ ID NO: 297244 - DNA, 15 bp, Homo sapiens
ttacacactcttttt

SEQ ID NO: 297245 - DNA, 15 bp, Homo sapiens
tttacacactctttt

SEQ ID NO: 297246 - DNA, 15 bp, Homo sapiens
gtttacacactcttt

SEQ ID NO: 297247 - DNA, 15 bp, Homo sapiens
ggtttacacactctt

SEQ ID NO: 297248 - DNA, 15 bp, Homo sapiens
aggtttacacactct

SEQ ID NO: 297249 - DNA, 15 bp, Homo sapiens
taggtttacacactc

SEQ ID NO: 297250 - DNA, 15 bp, Homo sapiens
ataggtttacacact

SEQ ID NO: 297251 - DNA, 15 bp, Homo sapiens
cataggtttacacac

SEQ ID NO: 297252 - DNA, 15 bp, Homo sapiens
ccataggtttacaca

SEQ ID NO: 297253 - DNA, 15 bp, Homo sapiens
accataggtttacac

SEQ ID NO: 297254 - DNA, 15 bp, Homo sapiens
caccataggtttaca

SEQ ID NO: 297255 - DNA, 15 bp, Homo sapiens
acaccataggtttac

SEQ ID NO: 297256 - DNA, 15 bp, Homo sapiens
tacaccataggttta

SEQ ID NO: 297257 - DNA, 15 bp, Homo sapiens
gtacaccataggttt

SEQ ID NO: 297258 - DNA, 15 bp, Homo sapiens
agtacaccataggtt

SEQ ID NO: 297259 - DNA, 15 bp, Homo sapiens
aagtacaccataggt

SEQ ID NO: 297260 - DNA, 15 bp, Homo sapiens
taagtacaccatagg

SEQ ID NO: 297261 - DNA, 15 bp, Homo sapiens
ttaagtacaccatag

SEQ ID NO: 297262 - DNA, 15 bp, Homo sapiens
attaagtacaccata

SEQ ID NO: 297263 - DNA, 15 bp, Homo sapiens
tattaagtacaccat

SEQ ID NO: 297264 - DNA, 15 bp, Homo sapiens
ttattaagtacacca

SEQ ID NO: 297265 - DNA, 15 bp, Homo sapiens
attattaagtacacc

SEQ ID NO: 297266 - DNA, 15 bp, Homo sapiens
tattattaagtacac

SEQ ID NO: 297267 - DNA, 15 bp, Homo sapiens
ttattattaagtaca

SEQ ID NO: 297268 - DNA, 15 bp, Homo sapiens
attattattaagtac

SEQ ID NO: 297269 - DNA, 15 bp, Homo sapiens
aattattattaagta

SEQ ID NO: 297270 - DNA, 15 bp, Homo sapiens
gaattattattaagt

SEQ ID NO: 297271 - DNA, 15 bp, Homo sapiens
tgaattattattaag

SEQ ID NO: 297272 - DNA, 15 bp, Homo sapiens
ttgaattattattaa

SEQ ID NO: 297273 - DNA, 15 bp, Homo sapiens
gttgaattattatta

SEQ ID NO: 297274 - DNA, 15 bp, Homo sapiens
agttgaattattatt

SEQ ID NO: 297275 - DNA, 15 bp, Homo sapiens
gagttgaattattat

SEQ ID NO: 297276 - DNA, 15 bp, Homo sapiens
tgagttgaattatta

SEQ ID NO: 297277 - DNA, 15 bp, Homo sapiens
ctgagttgaattatt

SEQ ID NO: 297278 - DNA, 15 bp, Homo sapiens
gctgagttgaattat

SEQ ID NO: 297279 - DNA, 15 bp, Homo sapiens
agctgagttgaatta

SEQ ID NO: 297280 - DNA, 15 bp, Homo sapiens
tagctgagttgaatt

SEQ ID NO: 297281 - DNA, 15 bp, Homo sapiens
atagctgagttgaat

SEQ ID NO: 297282 - DNA, 15 bp, Homo sapiens
gatagctgagttgaa

SEQ ID NO: 297283 - DNA, 15 bp, Homo sapiens
ggatagctgagttga

SEQ ID NO: 297284 - DNA, 15 bp, Homo sapiens
gggatagctgagttg

SEQ ID NO: 297285 - DNA, 15 bp, Homo sapiens
agggatagctgagtt

SEQ ID NO: 297286 - DNA, 15 bp, Homo sapiens
aagggatagctgagt

SEQ ID NO: 297287 - DNA, 15 bp, Homo sapiens
caagggatagctgag

SEQ ID NO: 297288 - DNA, 15 bp, Homo sapiens
ccaagggatagctga

SEQ ID NO: 297289 - DNA, 15 bp, Homo sapiens
tccaagggatagctg

SEQ ID NO: 297290 - DNA, 15 bp, Homo sapiens
gtccaagggatagct

SEQ ID NO: 297291 - DNA, 15 bp, Homo sapiens
tgtccaagggatagc

SEQ ID NO: 297292 - DNA, 15 bp, Homo sapiens
gtgtccaagggatag

SEQ ID NO: 297293 - DNA, 15 bp, Homo sapiens
agtgtccaagggata

SEQ ID NO: 297294 - DNA, 15 bp, Homo sapiens
cagtgtccaagggat

SEQ ID NO: 297295 - DNA, 15 bp, Homo sapiens
acagtgtccaaggga

SEQ ID NO: 297296 - DNA, 15 bp, Homo sapiens
cacagtgtccaaggg

SEQ ID NO: 297297 - DNA, 15 bp, Homo sapiens
ccacagtgtccaagg

SEQ ID NO: 297298 - DNA, 15 bp, Homo sapiens
tccacagtgtccaag

SEQ ID NO: 297299 - DNA, 15 bp, Homo sapiens
ctccacagtgtccaa

SEQ ID NO: 297300 - DNA, 15 bp, Homo sapiens
cctccacagtgtcca

SEQ ID NO: 297301 - DNA, 15 bp, Homo sapiens
acctccacagtgtcc

SEQ ID NO: 297302 - DNA, 15 bp, Homo sapiens
gacctccacagtgtc

SEQ ID NO: 297303 - DNA, 15 bp, Homo sapiens
ggacctccacagtgt

SEQ ID NO: 297304 - DNA, 15 bp, Homo sapiens
tggacctccacagtg

SEQ ID NO: 297305 - DNA, 15 bp, Homo sapiens
gtggacctccacagt

SEQ ID NO: 297306 - DNA, 15 bp, Homo sapiens
agtggacctccacag

SEQ ID NO: 297307 - DNA, 15 bp, Homo sapiens
gagtggacctccaca

SEQ ID NO: 297308 - DNA, 15 bp, Homo sapiens
agagtggacctccac

SEQ ID NO: 297309 - DNA, 15 bp, Homo sapiens
aagagtggacctcca

SEQ ID NO: 297310 - DNA, 15 bp, Homo sapiens
aaagagtggacctcc

SEQ ID NO: 297311 - DNA, 15 bp, Homo sapiens
aaaagagtggacctc

SEQ ID NO: 297312 - DNA, 15 bp, Homo sapiens
gaaaagagtggacct

SEQ ID NO: 297313 - DNA, 15 bp, Homo sapiens
agaaaagagtggacc

SEQ ID NO: 297314 - DNA, 15 bp, Homo sapiens
gagaaaagagtggac

SEQ ID NO: 297315 - DNA, 15 bp, Homo sapiens
ggagaaaagagtgga

SEQ ID NO: 297316 - DNA, 15 bp, Homo sapiens
aggagaaaagagtgg

SEQ ID NO: 297317 - DNA, 15 bp, Homo sapiens
caggagaaaagagtg

SEQ ID NO: 297318 - DNA, 15 bp, Homo sapiens
ccaggagaaaagagt

SEQ ID NO: 297319 - DNA, 15 bp, Homo sapiens
tccaggagaaaagag

SEQ ID NO: 297320 - DNA, 15 bp, Homo sapiens
atccaggagaaaaga

SEQ ID NO: 297321 - DNA, 15 bp, Homo sapiens
catccaggagaaaag

SEQ ID NO: 297322 - DNA, 15 bp, Homo sapiens
acatccaggagaaaa

SEQ ID NO: 297323 - DNA, 15 bp, Homo sapiens
tacatccaggagaaa

SEQ ID NO: 297324 - DNA, 15 bp, Homo sapiens
ttacatccaggagaa

SEQ ID NO: 297325 - DNA, 15 bp, Homo sapiens
gttacatccaggaga

SEQ ID NO: 297326 - DNA, 15 bp, Homo sapiens
agttacatccaggag

SEQ ID NO: 297327 - DNA, 15 bp, Homo sapiens
aagttacatccagga

SEQ ID NO: 297328 - DNA, 15 bp, Homo sapiens
taagttacatccagg

SEQ ID NO: 297329 - DNA, 15 bp, Homo sapiens
gtaagttacatccag

SEQ ID NO: 297330 - DNA, 15 bp, Homo sapiens
tgtaagttacatcca

SEQ ID NO: 297331 - DNA, 15 bp, Homo sapiens
ctgtaagttacatcc

SEQ ID NO: 297332 - DNA, 15 bp, Homo sapiens
tctgtaagttacatc

SEQ ID NO: 297333 - DNA, 15 bp, Homo sapiens
atctgtaagttacat

SEQ ID NO: 297334 - DNA, 15 bp, Homo sapiens
gatctgtaagttaca

SEQ ID NO: 297335 - DNA, 15 bp, Homo sapiens
agatctgtaagttac

SEQ ID NO: 297336 - DNA, 15 bp, Homo sapiens
cagatctgtaagtta

SEQ ID NO: 297337 - DNA, 15 bp, Homo sapiens
acagatctgtaagtt

SEQ ID NO: 297338 - DNA, 15 bp, Homo sapiens
aacagatctgtaagt

SEQ ID NO: 297339 - DNA, 15 bp, Homo sapiens
taacagatctgtaag

SEQ ID NO: 297340 - DNA, 15 bp, Homo sapiens
ctaacagatctgtaa

SEQ ID NO: 297341 - DNA, 15 bp, Homo sapiens
tctaacagatctgta

SEQ ID NO: 297342 - DNA, 15 bp, Homo sapiens
ttctaacagatctgt

SEQ ID NO: 297343 - DNA, 15 bp, Homo sapiens
gttctaacagatctg

SEQ ID NO: 297344 - DNA, 15 bp, Homo sapiens
agttctaacagatct

SEQ ID NO: 297345 - DNA, 15 bp, Homo sapiens
tagttctaacagatc

SEQ ID NO: 297346 - DNA, 15 bp, Homo sapiens
ctagttctaacagat

SEQ ID NO: 297347 - DNA, 15 bp, Homo sapiens
cctagttctaacaga

SEQ ID NO: 297348 - DNA, 15 bp, Homo sapiens
gcctagttctaacag

SEQ ID NO: 297349 - DNA, 15 bp, Homo sapiens
agcctagttctaaca

SEQ ID NO: 297350 - DNA, 15 bp, Homo sapiens
aagcctagttctaac

SEQ ID NO: 297351 - DNA, 15 bp, Homo sapiens
gaagcctagttctaa

SEQ ID NO: 297352 - DNA, 15 bp, Homo sapiens
agaagcctagttcta

SEQ ID NO: 297353 - DNA, 15 bp, Homo sapiens
aagaagcctagttct

SEQ ID NO: 297354 - DNA, 15 bp, Homo sapiens
aaagaagcctagttc

SEQ ID NO: 297355 - DNA, 15 bp, Homo sapiens
aaaagaagcctagtt

SEQ ID NO: 297356 - DNA, 15 bp, Homo sapiens
taaaagaagcctagt

SEQ ID NO: 297357 - DNA, 15 bp, Homo sapiens
ctaaaagaagcctag

SEQ ID NO: 297358 - DNA, 15 bp, Homo sapiens
gctaaaagaagccta

SEQ ID NO: 297359 - DNA, 15 bp, Homo sapiens
ggctaaaagaagcct

SEQ ID NO: 297360 - DNA, 15 bp, Homo sapiens
aggctaaaagaagcc

SEQ ID NO: 297361 - DNA, 15 bp, Homo sapiens
caggctaaaagaagc

SEQ ID NO: 297362 - DNA, 15 bp, Homo sapiens
tcaggctaaaagaag

SEQ ID NO: 297363 - DNA, 15 bp, Homo sapiens
atcaggctaaaagaa

SEQ ID NO: 297364 - DNA, 15 bp, Homo sapiens
aatcaggctaaaaga

SEQ ID NO: 297365 - DNA, 15 bp, Homo sapiens
aaatcaggctaaaag

SEQ ID NO: 297366 - DNA, 15 bp, Homo sapiens
gaaatcaggctaaaa

SEQ ID NO: 297367 - DNA, 15 bp, Homo sapiens
agaaatcaggctaaa

SEQ ID NO: 297368 - DNA, 15 bp, Homo sapiens
gagaaatcaggctaa

SEQ ID NO: 297369 - DNA, 15 bp, Homo sapiens
ggagaaatcaggcta

SEQ ID NO: 297370 - DNA, 15 bp, Homo sapiens
gggagaaatcaggct

SEQ ID NO: 297371 - DNA, 15 bp, Homo sapiens
ggggagaaatcaggc

SEQ ID NO: 297372 - DNA, 15 bp, Homo sapiens
gggggagaaatcagg

SEQ ID NO: 297373 - DNA, 15 bp, Homo sapiens
tgggggagaaatcag

SEQ ID NO: 297374 - DNA, 15 bp, Homo sapiens
ttgggggagaaatca

SEQ ID NO: 297375 - DNA, 15 bp, Homo sapiens
tttgggggagaaatc

SEQ ID NO: 297376 - DNA, 15 bp, Homo sapiens
atttgggggagaaat

SEQ ID NO: 297377 - DNA, 15 bp, Homo sapiens
tatttgggggagaaa

SEQ ID NO: 297378 - DNA, 15 bp, Homo sapiens
gtatttgggggagaa

SEQ ID NO: 297379 - DNA, 15 bp, Homo sapiens
ggtatttgggggaga

SEQ ID NO: 297380 - DNA, 15 bp, Homo sapiens
cggtatttgggggag

SEQ ID NO: 297381 - DNA, 15 bp, Homo sapiens
ccggtatttggggga

SEQ ID NO: 297382 - DNA, 15 bp, Homo sapiens
cccggtatttggggg

SEQ ID NO: 297383 - DNA, 15 bp, Homo sapiens
gcccggtatttgggg

SEQ ID NO: 297384 - DNA, 15 bp, Homo sapiens
ggcccggtatttggg

SEQ ID NO: 297385 - DNA, 15 bp, Homo sapiens
aggcccggtatttgg

SEQ ID NO: 297386 - DNA, 15 bp, Homo sapiens
gaggcccggtatttg

SEQ ID NO: 297387 - DNA, 15 bp, Homo sapiens
tgaggcccggtattt

SEQ ID NO: 297388 - DNA, 15 bp, Homo sapiens
gtgaggcccggtatt

SEQ ID NO: 297389 - DNA, 15 bp, Homo sapiens
tgtgaggcccggtat

SEQ ID NO: 297390 - DNA, 15 bp, Homo sapiens
gtgtgaggcccggta

SEQ ID NO: 297391 - DNA, 15 bp, Homo sapiens
agtgtgaggcccggt

SEQ ID NO: 297392 - DNA, 15 bp, Homo sapiens
aagtgtgaggcccgg

SEQ ID NO: 297393 - DNA, 15 bp, Homo sapiens
aaagtgtgaggcccg

SEQ ID NO: 297394 - DNA, 15 bp, Homo sapiens
gaaagtgtgaggccc

SEQ ID NO: 297395 - DNA, 15 bp, Homo sapiens
ggaaagtgtgaggcc

SEQ ID NO: 297396 - DNA, 15 bp, Homo sapiens
gggaaagtgtgaggc

SEQ ID NO: 297397 - DNA, 15 bp, Homo sapiens
agggaaagtgtgagg

SEQ ID NO: 297398 - DNA, 15 bp, Homo sapiens
gagggaaagtgtgag

SEQ ID NO: 297399 - DNA, 15 bp, Homo sapiens
ggagggaaagtgtga

SEQ ID NO: 297400 - DNA, 15 bp, Homo sapiens
tggagggaaagtgtg

SEQ ID NO: 297401 - DNA, 15 bp, Homo sapiens
ctggagggaaagtgt

SEQ ID NO: 297402 - DNA, 15 bp, Homo sapiens
tctggagggaaagtg

SEQ ID NO: 297403 - DNA, 15 bp, Homo sapiens
gtctggagggaaagt

SEQ ID NO: 297404 - DNA, 15 bp, Homo sapiens
cgtctggagggaaag

SEQ ID NO: 297405 - DNA, 15 bp, Homo sapiens
acgtctggagggaaa

SEQ ID NO: 297406 - DNA, 15 bp, Homo sapiens
aacgtctggagggaa

SEQ ID NO: 297407 - DNA, 15 bp, Homo sapiens
taacgtctggaggga

SEQ ID NO: 297408 - DNA, 15 bp, Homo sapiens
ataacgtctggaggg

SEQ ID NO: 297409 - DNA, 15 bp, Homo sapiens
tataacgtctggagg

SEQ ID NO: 297410 - DNA, 15 bp, Homo sapiens
ctataacgtctggag

SEQ ID NO: 297411 - DNA, 15 bp, Homo sapiens
cctataacgtctgga

SEQ ID NO: 297412 - DNA, 15 bp, Homo sapiens
tcctataacgtctgg

SEQ ID NO: 297413 - DNA, 15 bp, Homo sapiens
ttcctataacgtctg

SEQ ID NO: 297414 - DNA, 15 bp, Homo sapiens
cttcctataacgtct

SEQ ID NO: 297415 - DNA, 15 bp, Homo sapiens
ccttcctataacgtc

SEQ ID NO: 297416 - DNA, 15 bp, Homo sapiens
cccttcctataacgt

SEQ ID NO: 297417 - DNA, 15 bp, Homo sapiens
acccttcctataacg

SEQ ID NO: 297418 - DNA, 15 bp, Homo sapiens
tacccttcctataac

SEQ ID NO: 297419 - DNA, 15 bp, Homo sapiens
gtacccttcctataa

SEQ ID NO: 297420 - DNA, 15 bp, Homo sapiens
agtacccttcctata

SEQ ID NO: 297421 - DNA, 15 bp, Homo sapiens
gagtacccttcctat

SEQ ID NO: 297422 - DNA, 15 bp, Homo sapiens
agagtacccttccta

SEQ ID NO: 297423 - DNA, 15 bp, Homo sapiens
aagagtacccttcct

SEQ ID NO: 297424 - DNA, 15 bp, Homo sapiens
gaagagtacccttcc

SEQ ID NO: 297425 - DNA, 15 bp, Homo sapiens
tgaagagtacccttc

SEQ ID NO: 297426 - DNA, 15 bp, Homo sapiens
atgaagagtaccctt

SEQ ID NO: 297427 - DNA, 15 bp, Homo sapiens
catgaagagtaccct

SEQ ID NO: 297428 - DNA, 15 bp, Homo sapiens
gcatgaagagtaccc

SEQ ID NO: 297429 - DNA, 15 bp, Homo sapiens
ggcatgaagagtacc

SEQ ID NO: 297430 - DNA, 15 bp, Homo sapiens
aggcatgaagagtac

SEQ ID NO: 297431 - DNA, 15 bp, Homo sapiens
caggcatgaagagta

SEQ ID NO: 297432 - DNA, 15 bp, Homo sapiens
gcaggcatgaagagt

SEQ ID NO: 297433 - DNA, 15 bp, Homo sapiens
agcaggcatgaagag

SEQ ID NO: 297434 - DNA, 15 bp, Homo sapiens
gagcaggcatgaaga

SEQ ID NO: 297435 - DNA, 15 bp, Homo sapiens
agagcaggcatgaag

SEQ ID NO: 297436 - DNA, 15 bp, Homo sapiens
aagagcaggcatgaa

SEQ ID NO: 297437 - DNA, 15 bp, Homo sapiens
aaagagcaggcatga

SEQ ID NO: 297438 - DNA, 15 bp, Homo sapiens
aaaagagcaggcatg

SEQ ID NO: 297439 - DNA, 15 bp, Homo sapiens
aaaaagagcaggcat

SEQ ID NO: 297440 - DNA, 15 bp, Homo sapiens
aaaaaagagcaggca

SEQ ID NO: 297441 - DNA, 15 bp, Homo sapiens
aaaaaaagagcaggc

SEQ ID NO: 297442 - DNA, 15 bp, Homo sapiens
gaaaaaaagagcagg

SEQ ID NO: 297443 - DNA, 15 bp, Homo sapiens
agaaaaaaagagcag

SEQ ID NO: 297444 - DNA, 15 bp, Homo sapiens
gagaaaaaaagagca

SEQ ID NO: 297445 - DNA, 15 bp, Homo sapiens
tgagaaaaaaagagc

SEQ ID NO: 297446 - DNA, 15 bp, Homo sapiens
gtgagaaaaaaagag

SEQ ID NO: 297447 - DNA, 15 bp, Homo sapiens
tgtgagaaaaaaaga

SEQ ID NO: 297448 - DNA, 15 bp, Homo sapiens
atgtgagaaaaaaag

SEQ ID NO: 297449 - DNA, 15 bp, Homo sapiens
tatgtgagaaaaaaa

SEQ ID NO: 297450 - DNA, 15 bp, Homo sapiens
ctatgtgagaaaaaa

SEQ ID NO: 297451 - DNA, 15 bp, Homo sapiens
gctatgtgagaaaaa

SEQ ID NO: 297452 - DNA, 15 bp, Homo sapiens
agctatgtgagaaaa

SEQ ID NO: 297453 - DNA, 15 bp, Homo sapiens
gagctatgtgagaaa

SEQ ID NO: 297454 - DNA, 15 bp, Homo sapiens
ggagctatgtgagaa

SEQ ID NO: 297455 - DNA, 15 bp, Homo sapiens
gggagctatgtgaga

SEQ ID NO: 297456 - DNA, 15 bp, Homo sapiens
tgggagctatgtgag

SEQ ID NO: 297457 - DNA, 15 bp, Homo sapiens
ctgggagctatgtga

SEQ ID NO: 297458 - DNA, 15 bp, Homo sapiens
gctgggagctatgtg

SEQ ID NO: 297459 - DNA, 15 bp, Homo sapiens
tgctgggagctatgt

SEQ ID NO: 297460 - DNA, 15 bp, Homo sapiens
gtgctgggagctatg

SEQ ID NO: 297461 - DNA, 15 bp, Homo sapiens
tgtgctgggagctat

SEQ ID NO: 297462 - DNA, 15 bp, Homo sapiens
gtgtgctgggagcta

SEQ ID NO: 297463 - DNA, 15 bp, Homo sapiens
tgtgtgctgggagct

SEQ ID NO: 297464 - DNA, 15 bp, Homo sapiens
ctgtgtgctgggagc

SEQ ID NO: 297465 - DNA, 15 bp, Homo sapiens
gctgtgtgctgggag

SEQ ID NO: 297466 - DNA, 15 bp, Homo sapiens
tgctgtgtgctggga

SEQ ID NO: 297467 - DNA, 15 bp, Homo sapiens
gtgctgtgtgctggg

SEQ ID NO: 297468 - DNA, 15 bp, Homo sapiens
tgtgctgtgtgctgg

SEQ ID NO: 297469 - DNA, 15 bp, Homo sapiens
atgtgctgtgtgctg

SEQ ID NO: 297470 - DNA, 15 bp, Homo sapiens
catgtgctgtgtgct

SEQ ID NO: 297471 - DNA, 15 bp, Homo sapiens
ccatgtgctgtgtgc

SEQ ID NO: 297472 - DNA, 15 bp, Homo sapiens
accatgtgctgtgtg

SEQ ID NO: 297473 - DNA, 15 bp, Homo sapiens
gaccatgtgctgtgt

SEQ ID NO: 297474 - DNA, 15 bp, Homo sapiens
tgaccatgtgctgtg

SEQ ID NO: 297475 - DNA, 15 bp, Homo sapiens
gtgaccatgtgctgt

SEQ ID NO: 297476 - DNA, 15 bp, Homo sapiens
agtgaccatgtgctg

SEQ ID NO: 297477 - DNA, 15 bp, Homo sapiens
cagtgaccatgtgct

SEQ ID NO: 297478 - DNA, 15 bp, Homo sapiens
tcagtgaccatgtgc

SEQ ID NO: 297479 - DNA, 15 bp, Homo sapiens
atcagtgaccatgtg

SEQ ID NO: 297480 - DNA, 15 bp, Homo sapiens
catcagtgaccatgt

SEQ ID NO: 297481 - DNA, 15 bp, Homo sapiens
acatcagtgaccatg

SEQ ID NO: 297482 - DNA, 15 bp, Homo sapiens
gacatcagtgaccat

SEQ ID NO: 297483 - DNA, 15 bp, Homo sapiens
ggacatcagtgacca

SEQ ID NO: 297484 - DNA, 15 bp, Homo sapiens
aggacatcagtgacc

SEQ ID NO: 297485 - DNA, 15 bp, Homo sapiens
aaggacatcagtgac

SEQ ID NO: 297486 - DNA, 15 bp, Homo sapiens
aaaggacatcagtga

SEQ ID NO: 297487 - DNA, 15 bp, Homo sapiens
gaaaggacatcagtg

SEQ ID NO: 297488 - DNA, 15 bp, Homo sapiens
agaaaggacatcagt

SEQ ID NO: 297489 - DNA, 15 bp, Homo sapiens
gagaaaggacatcag

SEQ ID NO: 297490 - DNA, 15 bp, Homo sapiens
ggagaaaggacatca

SEQ ID NO: 297491 - DNA, 15 bp, Homo sapiens
gggagaaaggacatc

SEQ ID NO: 297492 - DNA, 15 bp, Homo sapiens
tgggagaaaggacat

SEQ ID NO: 297493 - DNA, 15 bp, Homo sapiens
gtgggagaaaggaca

SEQ ID NO: 297494 - DNA, 15 bp, Homo sapiens
agtgggagaaaggac

SEQ ID NO: 297495 - DNA, 15 bp, Homo sapiens
gagtgggagaaagga

SEQ ID NO: 297496 - DNA, 15 bp, Homo sapiens
tgagtgggagaaagg

SEQ ID NO: 297497 - DNA, 15 bp, Homo sapiens
ctgagtgggagaaag

SEQ ID NO: 297498 - DNA, 15 bp, Homo sapiens
gctgagtgggagaaa

SEQ ID NO: 297499 - DNA, 15 bp, Homo sapiens
tgctgagtgggagaa

SEQ ID NO: 297500 - DNA, 15 bp, Homo sapiens
atgctgagtgggaga

SEQ ID NO: 297501 - DNA, 15 bp, Homo sapiens
tatgctgagtgggag

SEQ ID NO: 297502 - DNA, 15 bp, Homo sapiens
ctatgctgagtggga

SEQ ID NO: 297503 - DNA, 15 bp, Homo sapiens
tctatgctgagtggg

SEQ ID NO: 297504 - DNA, 15 bp, Homo sapiens
ttctatgctgagtgg

SEQ ID NO: 297505 - DNA, 15 bp, Homo sapiens
gttctatgctgagtg

SEQ ID NO: 297506 - DNA, 15 bp, Homo sapiens
tgttctatgctgagt

SEQ ID NO: 297507 - DNA, 15 bp, Homo sapiens
ctgttctatgctgag

SEQ ID NO: 297508 - DNA, 15 bp, Homo sapiens
actgttctatgctga

SEQ ID NO: 297509 - DNA, 15 bp, Homo sapiens
cactgttctatgctg

SEQ ID NO: 297510 - DNA, 15 bp, Homo sapiens
tcactgttctatgct

SEQ ID NO: 297511 - DNA, 15 bp, Homo sapiens
ctcactgttctatgc

SEQ ID NO: 297512 - DNA, 15 bp, Homo sapiens
tctcactgttctatg

SEQ ID NO: 297513 - DNA, 15 bp, Homo sapiens
ctctcactgttctat

SEQ ID NO: 297514 - DNA, 15 bp, Homo sapiens
tctctcactgttcta

SEQ ID NO: 297515 - DNA, 15 bp, Homo sapiens
atctctcactgttct

SEQ ID NO: 297516 - DNA, 15 bp, Homo sapiens
catctctcactgttc

SEQ ID NO: 297517 - DNA, 15 bp, Homo sapiens
ccatctctcactgtt

SEQ ID NO: 297518 - DNA, 15 bp, Homo sapiens
tccatctctcactgt

SEQ ID NO: 297519 - DNA, 15 bp, Homo sapiens
ttccatctctcactg

SEQ ID NO: 297520 - DNA, 15 bp, Homo sapiens
cttccatctctcact

SEQ ID NO: 297521 - DNA, 15 bp, Homo sapiens
ccttccatctctcac

SEQ ID NO: 297522 - DNA, 15 bp, Homo sapiens
tccttccatctctca

SEQ ID NO: 297523 - DNA, 15 bp, Homo sapiens
ctccttccatctctc

SEQ ID NO: 297524 - DNA, 15 bp, Homo sapiens
actccttccatctct

SEQ ID NO: 297525 - DNA, 15 bp, Homo sapiens
cactccttccatctc

SEQ ID NO: 297526 - DNA, 15 bp, Homo sapiens
gcactccttccatct

SEQ ID NO: 297527 - DNA, 15 bp, Homo sapiens
tgcactccttccatc

SEQ ID NO: 297528 - DNA, 15 bp, Homo sapiens
ctgcactccttccat

SEQ ID NO: 297529 - DNA, 15 bp, Homo sapiens
gctgcactccttcca

SEQ ID NO: 297530 - DNA, 15 bp, Homo sapiens
tgctgcactccttcc

SEQ ID NO: 297531 - DNA, 15 bp, Homo sapiens
atgctgcactccttc

SEQ ID NO: 297532 - DNA, 15 bp, Homo sapiens
catgctgcactcctt

SEQ ID NO: 297533 - DNA, 15 bp, Homo sapiens
gcatgctgcactcct

SEQ ID NO: 297534 - DNA, 15 bp, Homo sapiens
agcatgctgcactcc

SEQ ID NO: 297535 - DNA, 15 bp, Homo sapiens
tagcatgctgcactc

SEQ ID NO: 297536 - DNA, 15 bp, Homo sapiens
ctagcatgctgcact

SEQ ID NO: 297537 - DNA, 15 bp, Homo sapiens
tctagcatgctgcac

SEQ ID NO: 297538 - DNA, 15 bp, Homo sapiens
atctagcatgctgca

SEQ ID NO: 297539 - DNA, 15 bp, Homo sapiens
catctagcatgctgc

SEQ ID NO: 297540 - DNA, 15 bp, Homo sapiens
tcatctagcatgctg

SEQ ID NO: 297541 - DNA, 15 bp, Homo sapiens
gtcatctagcatgct

SEQ ID NO: 297542 - DNA, 15 bp, Homo sapiens
agtcatctagcatgc

SEQ ID NO: 297543 - DNA, 15 bp, Homo sapiens
tagtcatctagcatg

SEQ ID NO: 297544 - DNA, 15 bp, Homo sapiens
ctagtcatctagcat

SEQ ID NO: 297545 - DNA, 15 bp, Homo sapiens
cctagtcatctagca

SEQ ID NO: 297546 - DNA, 15 bp, Homo sapiens
ccctagtcatctagc

SEQ ID NO: 297547 - DNA, 15 bp, Homo sapiens
tccctagtcatctag

SEQ ID NO: 297548 - DNA, 15 bp, Homo sapiens
gtccctagtcatcta

SEQ ID NO: 297549 - DNA, 15 bp, Homo sapiens
tgtccctagtcatct

SEQ ID NO: 297550 - DNA, 15 bp, Homo sapiens
ttgtccctagtcatc

SEQ ID NO: 297551 - DNA, 15 bp, Homo sapiens
gttgtccctagtcat

SEQ ID NO: 297552 - DNA, 15 bp, Homo sapiens
agttgtccctagtca

SEQ ID NO: 297553 - DNA, 15 bp, Homo sapiens
aagttgtccctagtc

SEQ ID NO: 297554 - DNA, 15 bp, Homo sapiens
aaagttgtccctagt

SEQ ID NO: 297555 - DNA, 15 bp, Homo sapiens
aaaagttgtccctag

SEQ ID NO: 297556 - DNA, 15 bp, Homo sapiens
taaaagttgtcccta

SEQ ID NO: 297557 - DNA, 15 bp, Homo sapiens
ataaaagttgtccct

SEQ ID NO: 297558 - DNA, 15 bp, Homo sapiens
aataaaagttgtccc

SEQ ID NO: 297559 - DNA, 15 bp, Homo sapiens
aaataaaagttgtcc

SEQ ID NO: 297560 - DNA, 15 bp, Homo sapiens
caaataaaagttgtc

SEQ ID NO: 297561 - DNA, 15 bp, Homo sapiens
tcaaataaaagttgt

SEQ ID NO: 297562 - DNA, 15 bp, Homo sapiens
gtcaaataaaagttg

SEQ ID NO: 297563 - DNA, 15 bp, Homo sapiens
ggtcaaataaaagtt

SEQ ID NO: 297564 - DNA, 15 bp, Homo sapiens
tggtcaaataaaagt

SEQ ID NO: 297565 - DNA, 15 bp, Homo sapiens
ttggtcaaataaaag

SEQ ID NO: 297566 - DNA, 15 bp, Homo sapiens
cttggtcaaataaaa

SEQ ID NO: 297567 - DNA, 15 bp, Homo sapiens
tcttggtcaaataaa

SEQ ID NO: 297568 - DNA, 15 bp, Homo sapiens
ttcttggtcaaataa

SEQ ID NO: 297569 - DNA, 15 bp, Homo sapiens
gttcttggtcaaata

SEQ ID NO: 297570 - DNA, 15 bp, Homo sapiens
tgttcttggtcaaat

SEQ ID NO: 297571 - DNA, 15 bp, Homo sapiens
ctgttcttggtcaaa

SEQ ID NO: 297572 - DNA, 15 bp, Homo sapiens
tctgttcttggtcaa

SEQ ID NO: 297573 - DNA, 15 bp, Homo sapiens
atctgttcttggtca

SEQ ID NO: 297574 - DNA, 15 bp, Homo sapiens
aatctgttcttggtc

SEQ ID NO: 297575 - DNA, 15 bp, Homo sapiens
caatctgttcttggt

SEQ ID NO: 297576 - DNA, 15 bp, Homo sapiens
acaatctgttcttgg

SEQ ID NO: 297577 - DNA, 15 bp, Homo sapiens
aacaatctgttcttg

SEQ ID NO: 297578 - DNA, 15 bp, Homo sapiens
caacaatctgttctt

SEQ ID NO: 297579 - DNA, 15 bp, Homo sapiens
gcaacaatctgttct

SEQ ID NO: 297580 - DNA, 15 bp, Homo sapiens
ggcaacaatctgttc

SEQ ID NO: 297581 - DNA, 15 bp, Homo sapiens
tggcaacaatctgtt

SEQ ID NO: 297582 - DNA, 15 bp, Homo sapiens
atggcaacaatctgt

SEQ ID NO: 297583 - DNA, 15 bp, Homo sapiens
aatggcaacaatctg

SEQ ID NO: 297584 - DNA, 15 bp, Homo sapiens
taatggcaacaatct

SEQ ID NO: 297585 - DNA, 15 bp, Homo sapiens
gtaatggcaacaatc

SEQ ID NO: 297586 - DNA, 15 bp, Homo sapiens
agtaatggcaacaat

SEQ ID NO: 297587 - DNA, 15 bp, Homo sapiens
cagtaatggcaacaa

SEQ ID NO: 297588 - DNA, 15 bp, Homo sapiens
ccagtaatggcaaca

SEQ ID NO: 297589 - DNA, 15 bp, Homo sapiens
cccagtaatggcaac

SEQ ID NO: 297590 - DNA, 15 bp, Homo sapiens
ccccagtaatggcaa

SEQ ID NO: 297591 - DNA, 15 bp, Homo sapiens
cccccagtaatggca

SEQ ID NO: 297592 - DNA, 15 bp, Homo sapiens
tcccccagtaatggc

SEQ ID NO: 297593 - DNA, 15 bp, Homo sapiens
gtcccccagtaatgg

SEQ ID NO: 297594 - DNA, 15 bp, Homo sapiens
tgtcccccagtaatg

SEQ ID NO: 297595 - DNA, 15 bp, Homo sapiens
ctgtcccccagtaat

SEQ ID NO: 297596 - DNA, 15 bp, Homo sapiens
tctgtcccccagtaa

SEQ ID NO: 297597 - DNA, 15 bp, Homo sapiens
atctgtcccccagta

SEQ ID NO: 297598 - DNA, 15 bp, Homo sapiens
gatctgtcccccagt

SEQ ID NO: 297599 - DNA, 15 bp, Homo sapiens
agatctgtcccccag

SEQ ID NO: 297600 - DNA, 15 bp, Homo sapiens
gagatctgtccccca

SEQ ID NO: 297601 - DNA, 15 bp, Homo sapiens
ggagatctgtccccc

SEQ ID NO: 297602 - DNA, 15 bp, Homo sapiens
aggagatctgtcccc

SEQ ID NO: 297603 - DNA, 15 bp, Homo sapiens
gaggagatctgtccc

SEQ ID NO: 297604 - DNA, 15 bp, Homo sapiens
agaggagatctgtcc

SEQ ID NO: 297605 - DNA, 15 bp, Homo sapiens
aagaggagatctgtc

SEQ ID NO: 297606 - DNA, 15 bp, Homo sapiens
aaagaggagatctgt

SEQ ID NO: 297607 - DNA, 15 bp, Homo sapiens
aaaagaggagatctg

SEQ ID NO: 297608 - DNA, 15 bp, Homo sapiens
gaaaagaggagatct

SEQ ID NO: 297609 - DNA, 15 bp, Homo sapiens
ggaaaagaggagatc

SEQ ID NO: 297610 - DNA, 15 bp, Homo sapiens
gggaaaagaggagat

SEQ ID NO: 297611 - DNA, 15 bp, Homo sapiens
ggggaaaagaggaga

SEQ ID NO: 297612 - DNA, 15 bp, Homo sapiens
gggggaaaagaggag

SEQ ID NO: 297613 - DNA, 15 bp, Homo sapiens
ggggggaaaagagga

SEQ ID NO: 297614 - DNA, 15 bp, Homo sapiens
tggggggaaaagagg

SEQ ID NO: 297615 - DNA, 15 bp, Homo sapiens
ctggggggaaaagag

SEQ ID NO: 297616 - DNA, 15 bp, Homo sapiens
gctggggggaaaaga

SEQ ID NO: 297617 - DNA, 15 bp, Homo sapiens
tgctggggggaaaag

SEQ ID NO: 297618 - DNA, 15 bp, Homo sapiens
atgctggggggaaaa

SEQ ID NO: 297619 - DNA, 15 bp, Homo sapiens
aatgctggggggaaa

SEQ ID NO: 297620 - DNA, 15 bp, Homo sapiens
caatgctggggggaa

SEQ ID NO: 297621 - DNA, 15 bp, Homo sapiens
tcaatgctgggggga

SEQ ID NO: 297622 - DNA, 15 bp, Homo sapiens
ctcaatgctgggggg

SEQ ID NO: 297623 - DNA, 15 bp, Homo sapiens
tctcaatgctggggg

SEQ ID NO: 297624 - DNA, 15 bp, Homo sapiens
ttctcaatgctgggg

SEQ ID NO: 297625 - DNA, 15 bp, Homo sapiens
gttctcaatgctggg

SEQ ID NO: 297626 - DNA, 15 bp, Homo sapiens
cgttctcaatgctgg

SEQ ID NO: 297627 - DNA, 15 bp, Homo sapiens
tcgttctcaatgctg

SEQ ID NO: 297628 - DNA, 15 bp, Homo sapiens
ctcgttctcaatgct

SEQ ID NO: 297629 - DNA, 15 bp, Homo sapiens
tctcgttctcaatgc

SEQ ID NO: 297630 - DNA, 15 bp, Homo sapiens
atctcgttctcaatg

SEQ ID NO: 297631 - DNA, 15 bp, Homo sapiens
catctcgttctcaat

SEQ ID NO: 297632 - DNA, 15 bp, Homo sapiens
tcatctcgttctcaa

SEQ ID NO: 297633 - DNA, 15 bp, Homo sapiens
atcatctcgttctca

SEQ ID NO: 297634 - DNA, 15 bp, Homo sapiens
gatcatctcgttctc

SEQ ID NO: 297635 - DNA, 15 bp, Homo sapiens
tgatcatctcgttct

SEQ ID NO: 297636 - DNA, 15 bp, Homo sapiens
atgatcatctcgttc

SEQ ID NO: 297637 - DNA, 15 bp, Homo sapiens
catgatcatctcgtt

SEQ ID NO: 297638 - DNA, 15 bp, Homo sapiens
acatgatcatctcgt

SEQ ID NO: 297639 - DNA, 15 bp, Homo sapiens
tacatgatcatctcg

SEQ ID NO: 297640 - DNA, 15 bp, Homo sapiens
ctacatgatcatctc

SEQ ID NO: 297641 - DNA, 15 bp, Homo sapiens
gctacatgatcatct

SEQ ID NO: 297642 - DNA, 15 bp, Homo sapiens
tgctacatgatcatc

SEQ ID NO: 297643 - DNA, 15 bp, Homo sapiens
ttgctacatgatcat

SEQ ID NO: 297644 - DNA, 15 bp, Homo sapiens
tttgctacatgatca

SEQ ID NO: 297645 - DNA, 15 bp, Homo sapiens
ttttgctacatgatc

SEQ ID NO: 297646 - DNA, 15 bp, Homo sapiens
cttttgctacatgat

SEQ ID NO: 297647 - DNA, 15 bp, Homo sapiens
tcttttgctacatga

SEQ ID NO: 297648 - DNA, 15 bp, Homo sapiens
ctcttttgctacatg

SEQ ID NO: 297649 - DNA, 15 bp, Homo sapiens
cctcttttgctacat

SEQ ID NO: 297650 - DNA, 15 bp, Homo sapiens
ccctcttttgctaca

SEQ ID NO: 297651 - DNA, 15 bp, Homo sapiens
cccctcttttgctac

SEQ ID NO: 297652 - DNA, 15 bp, Homo sapiens
tcccctcttttgcta

SEQ ID NO: 297653 - DNA, 15 bp, Homo sapiens
gtcccctcttttgct

SEQ ID NO: 297654 - DNA, 15 bp, Homo sapiens
cgtcccctcttttgc

SEQ ID NO: 297655 - DNA, 15 bp, Homo sapiens
tcgtcccctcttttg

SEQ ID NO: 297656 - DNA, 15 bp, Homo sapiens
ttcgtcccctctttt

SEQ ID NO: 297657 - DNA, 15 bp, Homo sapiens
tttcgtcccctcttt

SEQ ID NO: 297658 - DNA, 15 bp, Homo sapiens
ttttcgtcccctctt

SEQ ID NO: 297659 - DNA, 15 bp, Homo sapiens
cttttcgtcccctct

SEQ ID NO: 297660 - DNA, 15 bp, Homo sapiens
gcttttcgtcccctc

SEQ ID NO: 297661 - DNA, 15 bp, Homo sapiens
tgcttttcgtcccct

SEQ ID NO: 297662 - DNA, 15 bp, Homo sapiens
ctgcttttcgtcccc

SEQ ID NO: 297663 - DNA, 15 bp, Homo sapiens
tctgcttttcgtccc

SEQ ID NO: 297664 - DNA, 15 bp, Homo sapiens
atctgcttttcgtcc

SEQ ID NO: 297665 - DNA, 15 bp, Homo sapiens
catctgcttttcgtc

SEQ ID NO: 297666 - DNA, 15 bp, Homo sapiens
gcatctgcttttcgt

SEQ ID NO: 297667 - DNA, 15 bp, Homo sapiens
ggcatctgcttttcg

SEQ ID NO: 297668 - DNA, 15 bp, Homo sapiens
aggcatctgcttttc

SEQ ID NO: 297669 - DNA, 15 bp, Homo sapiens
aaggcatctgctttt

SEQ ID NO: 297670 - DNA, 15 bp, Homo sapiens
taaggcatctgcttt

SEQ ID NO: 297671 - DNA, 15 bp, Homo sapiens
ctaaggcatctgctt

SEQ ID NO: 297672 - DNA, 15 bp, Homo sapiens
tctaaggcatctgct

SEQ ID NO: 297673 - DNA, 15 bp, Homo sapiens
ctctaaggcatctgc

SEQ ID NO: 297674 - DNA, 15 bp, Homo sapiens
tctctaaggcatctg

SEQ ID NO: 297675 - DNA, 15 bp, Homo sapiens
ttctctaaggcatct

SEQ ID NO: 297676 - DNA, 15 bp, Homo sapiens
cttctctaaggcatc

SEQ ID NO: 297677 - DNA, 15 bp, Homo sapiens
tcttctctaaggcat

SEQ ID NO: 297678 - DNA, 15 bp, Homo sapiens
ctcttctctaaggca

SEQ ID NO: 297679 - DNA, 15 bp, Homo sapiens
tctcttctctaaggc

SEQ ID NO: 297680 - DNA, 15 bp, Homo sapiens
atctcttctctaagg

SEQ ID NO: 297681 - DNA, 15 bp, Homo sapiens
catctcttctctaag

SEQ ID NO: 297682 - DNA, 15 bp, Homo sapiens
ccatctcttctctaa

SEQ ID NO: 297683 - DNA, 15 bp, Homo sapiens
gccatctcttctcta

SEQ ID NO: 297684 - DNA, 15 bp, Homo sapiens
tgccatctcttctct

SEQ ID NO: 297685 - DNA, 15 bp, Homo sapiens
ctgccatctcttctc

SEQ ID NO: 297686 - DNA, 15 bp, Homo sapiens
actgccatctcttct

SEQ ID NO: 297687 - DNA, 15 bp, Homo sapiens
cactgccatctcttc

SEQ ID NO: 297688 - DNA, 15 bp, Homo sapiens
ccactgccatctctt

SEQ ID NO: 297689 - DNA, 15 bp, Homo sapiens
gccactgccatctct

SEQ ID NO: 297690 - DNA, 15 bp, Homo sapiens
agccactgccatctc

SEQ ID NO: 297691 - DNA, 15 bp, Homo sapiens
cagccactgccatct

SEQ ID NO: 297692 - DNA, 15 bp, Homo sapiens
gcagccactgccatc

SEQ ID NO: 297693 - DNA, 15 bp, Homo sapiens
ggcagccactgccat

SEQ ID NO: 297694 - DNA, 15 bp, Homo sapiens
gggcagccactgcca

SEQ ID NO: 297695 - DNA, 15 bp, Homo sapiens
agggcagccactgcc

SEQ ID NO: 297696 - DNA, 15 bp, Homo sapiens
aagggcagccactgc

SEQ ID NO: 297697 - DNA, 15 bp, Homo sapiens
caagggcagccactg

SEQ ID NO: 297698 - DNA, 15 bp, Homo sapiens
gcaagggcagccact

SEQ ID NO: 297699 - DNA, 15 bp, Homo sapiens
tgcaagggcagccac

SEQ ID NO: 297700 - DNA, 15 bp, Homo sapiens
ttgcaagggcagcca

SEQ ID NO: 297701 - DNA, 15 bp, Homo sapiens
tttgcaagggcagcc

SEQ ID NO: 297702 - DNA, 15 bp, Homo sapiens
ctttgcaagggcagc

SEQ ID NO: 297703 - DNA, 15 bp, Homo sapiens
gctttgcaagggcag

SEQ ID NO: 297704 - DNA, 15 bp, Homo sapiens
ggctttgcaagggca

SEQ ID NO: 297705 - DNA, 15 bp, Homo sapiens
gggctttgcaagggc

SEQ ID NO: 297706 - DNA, 15 bp, Homo sapiens
cgggctttgcaaggg

SEQ ID NO: 297707 - DNA, 15 bp, Homo sapiens
gcgggctttgcaagg

SEQ ID NO: 297708 - DNA, 15 bp, Homo sapiens
ggcgggctttgcaag

SEQ ID NO: 297709 - DNA, 15 bp, Homo sapiens
tggcgggctttgcaa

SEQ ID NO: 297710 - DNA, 15 bp, Homo sapiens
ctggcgggctttgca

SEQ ID NO: 297711 - DNA, 15 bp, Homo sapiens
tctggcgggctttgc

SEQ ID NO: 297712 - DNA, 15 bp, Homo sapiens
atctggcgggctttg

SEQ ID NO: 297713 - DNA, 15 bp, Homo sapiens
gatctggcgggcttt

SEQ ID NO: 297714 - DNA, 15 bp, Homo sapiens
cgatctggcgggctt

SEQ ID NO: 297715 - DNA, 15 bp, Homo sapiens
acgatctggcgggct

SEQ ID NO: 297716 - DNA, 15 bp, Homo sapiens
gacgatctggcgggc

SEQ ID NO: 297717 - DNA, 15 bp, Homo sapiens
agacgatctggcggg

SEQ ID NO: 297718 - DNA, 15 bp, Homo sapiens
aagacgatctggcgg

SEQ ID NO: 297719 - DNA, 15 bp, Homo sapiens
gaagacgatctggcg

SEQ ID NO: 297720 - DNA, 15 bp, Homo sapiens
tgaagacgatctggc

SEQ ID NO: 297721 - DNA, 15 bp, Homo sapiens
gtgaagacgatctgg

SEQ ID NO: 297722 - DNA, 15 bp, Homo sapiens
agtgaagacgatctg

SEQ ID NO: 297723 - DNA, 15 bp, Homo sapiens
cagtgaagacgatct

SEQ ID NO: 297724 - DNA, 15 bp, Homo sapiens
acagtgaagacgatc

SEQ ID NO: 297725 - DNA, 15 bp, Homo sapiens
aacagtgaagacgat

SEQ ID NO: 297726 - DNA, 15 bp, Homo sapiens
taacagtgaagacga

SEQ ID NO: 297727 - DNA, 15 bp, Homo sapiens
ataacagtgaagacg

SEQ ID NO: 297728 - DNA, 15 bp, Homo sapiens
cataacagtgaagac

SEQ ID NO: 297729 - DNA, 15 bp, Homo sapiens
ccataacagtgaaga

SEQ ID NO: 297730 - DNA, 15 bp, Homo sapiens
cccataacagtgaag

SEQ ID NO: 297731 - DNA, 15 bp, Homo sapiens
gcccataacagtgaa

SEQ ID NO: 297732 - DNA, 15 bp, Homo sapiens
agcccataacagtga

SEQ ID NO: 297733 - DNA, 15 bp, Homo sapiens
gagcccataacagtg

SEQ ID NO: 297734 - DNA, 15 bp, Homo sapiens
agagcccataacagt

SEQ ID NO: 297735 - DNA, 15 bp, Homo sapiens
cagagcccataacag

SEQ ID NO: 297736 - DNA, 15 bp, Homo sapiens
ccagagcccataaca

SEQ ID NO: 297737 - DNA, 15 bp, Homo sapiens
tccagagcccataac

SEQ ID NO: 297738 - DNA, 15 bp, Homo sapiens
ttccagagcccataa

SEQ ID NO: 297739 - DNA, 15 bp, Homo sapiens
gttccagagcccata

SEQ ID NO: 297740 - DNA, 15 bp, Homo sapiens
ggttccagagcccat

SEQ ID NO: 297741 - DNA, 15 bp, Homo sapiens
tggttccagagccca

SEQ ID NO: 297742 - DNA, 15 bp, Homo sapiens
ttggttccagagccc

SEQ ID NO: 297743 - DNA, 15 bp, Homo sapiens
tttggttccagagcc

SEQ ID NO: 297744 - DNA, 15 bp, Homo sapiens
ttttggttccagagc

SEQ ID NO: 297745 - DNA, 15 bp, Homo sapiens
tttttggttccagag

SEQ ID NO: 297746 - DNA, 15 bp, Homo sapiens
ctttttggttccaga

SEQ ID NO: 297747 - DNA, 15 bp, Homo sapiens
cctttttggttccag

SEQ ID NO: 297748 - DNA, 15 bp, Homo sapiens
tcctttttggttcca

SEQ ID NO: 297749 - DNA, 15 bp, Homo sapiens
ttcctttttggttcc

SEQ ID NO: 297750 - DNA, 15 bp, Homo sapiens
attcctttttggttc

SEQ ID NO: 297751 - DNA, 15 bp, Homo sapiens
aattcctttttggtt

SEQ ID NO: 297752 - DNA, 15 bp, Homo sapiens
caattcctttttggt

SEQ ID NO: 297753 - DNA, 15 bp, Homo sapiens
tcaattcctttttgg

SEQ ID NO: 297754 - DNA, 15 bp, Homo sapiens
ctcaattcctttttg

SEQ ID NO: 297755 - DNA, 15 bp, Homo sapiens
gctcaattccttttt

SEQ ID NO: 297756 - DNA, 15 bp, Homo sapiens
agctcaattcctttt

SEQ ID NO: 297757 - DNA, 15 bp, Homo sapiens
tagctcaattccttt

SEQ ID NO: 297758 - DNA, 15 bp, Homo sapiens
atagctcaattcctt

SEQ ID NO: 297759 - DNA, 15 bp, Homo sapiens
gatagctcaattcct

SEQ ID NO: 297760 - DNA, 15 bp, Homo sapiens
agatagctcaattcc

SEQ ID NO: 297761 - DNA, 15 bp, Homo sapiens
cagatagctcaattc

SEQ ID NO: 297762 - DNA, 15 bp, Homo sapiens
acagatagctcaatt

SEQ ID NO: 297763 - DNA, 15 bp, Homo sapiens
cacagatagctcaat

SEQ ID NO: 297764 - DNA, 15 bp, Homo sapiens
acacagatagctcaa

SEQ ID NO: 297765 - DNA, 15 bp, Homo sapiens
cacacagatagctca

SEQ ID NO: 297766 - DNA, 15 bp, Homo sapiens
ccacacagatagctc

SEQ ID NO: 297767 - DNA, 15 bp, Homo sapiens
tccacacagatagct

SEQ ID NO: 297768 - DNA, 15 bp, Homo sapiens
ttccacacagatagc

SEQ ID NO: 297769 - DNA, 15 bp, Homo sapiens
tttccacacagatag

SEQ ID NO: 297770 - DNA, 15 bp, Homo sapiens
ctttccacacagata

SEQ ID NO: 297771 - DNA, 15 bp, Homo sapiens
cctttccacacagat

SEQ ID NO: 297772 - DNA, 15 bp, Homo sapiens
tcctttccacacaga

SEQ ID NO: 297773 - DNA, 15 bp, Homo sapiens
ctcctttccacacag

SEQ ID NO: 297774 - DNA, 15 bp, Homo sapiens
tctcctttccacaca

SEQ ID NO: 297775 - DNA, 15 bp, Homo sapiens
ttctcctttccacac

SEQ ID NO: 297776 - DNA, 15 bp, Homo sapiens
attctcctttccaca

SEQ ID NO: 297777 - DNA, 15 bp, Homo sapiens
aattctcctttccac

SEQ ID NO: 297778 - DNA, 15 bp, Homo sapiens
taattctcctttcca

SEQ ID NO: 297779 - DNA, 15 bp, Homo sapiens
ctaattctcctttcc

SEQ ID NO: 297780 - DNA, 15 bp, Homo sapiens
tctaattctcctttc

SEQ ID NO: 297781 - DNA, 15 bp, Homo sapiens
atctaattctccttt

SEQ ID NO: 297782 - DNA, 15 bp, Homo sapiens
catctaattctcctt

SEQ ID NO: 297783 - DNA, 15 bp, Homo sapiens
gcatctaattctcct

SEQ ID NO: 297784 - DNA, 15 bp, Homo sapiens
ggcatctaattctcc

SEQ ID NO: 297785 - DNA, 15 bp, Homo sapiens
tggcatctaattctc

SEQ ID NO: 297786 - DNA, 15 bp, Homo sapiens
atggcatctaattct

SEQ ID NO: 297787 - DNA, 15 bp, Homo sapiens
tatggcatctaattc

SEQ ID NO: 297788 - DNA, 15 bp, Homo sapiens
atatggcatctaatt

SEQ ID NO: 297789 - DNA, 15 bp, Homo sapiens
aatatggcatctaat

SEQ ID NO: 297790 - DNA, 15 bp, Homo sapiens
gaatatggcatctaa

SEQ ID NO: 297791 - DNA, 15 bp, Homo sapiens
agaatatggcatcta

SEQ ID NO: 297792 - DNA, 15 bp, Homo sapiens
tagaatatggcatct

SEQ ID NO: 297793 - DNA, 15 bp, Homo sapiens
ttagaatatggcatc

SEQ ID NO: 297794 - DNA, 15 bp, Homo sapiens
gttagaatatggcat

SEQ ID NO: 297795 - DNA, 15 bp, Homo sapiens
agttagaatatggca

SEQ ID NO: 297796 - DNA, 15 bp, Homo sapiens
aagttagaatatggc

SEQ ID NO: 297797 - DNA, 15 bp, Homo sapiens
gaagttagaatatgg

SEQ ID NO: 297798 - DNA, 15 bp, Homo sapiens
agaagttagaatatg

SEQ ID NO: 297799 - DNA, 15 bp, Homo sapiens
gagaagttagaatat

SEQ ID NO: 297800 - DNA, 15 bp, Homo sapiens
ggagaagttagaata

SEQ ID NO: 297801 - DNA, 15 bp, Homo sapiens
cggagaagttagaat

SEQ ID NO: 297802 - DNA, 15 bp, Homo sapiens
acggagaagttagaa

SEQ ID NO: 297803 - DNA, 15 bp, Homo sapiens
aacggagaagttaga

SEQ ID NO: 297804 - DNA, 15 bp, Homo sapiens
caacggagaagttag

SEQ ID NO: 297805 - DNA, 15 bp, Homo sapiens
acaacggagaagtta

SEQ ID NO: 297806 - DNA, 15 bp, Homo sapiens
aacaacggagaagtt

SEQ ID NO: 297807 - DNA, 15 bp, Homo sapiens
gaacaacggagaagt

SEQ ID NO: 297808 - DNA, 15 bp, Homo sapiens
ggaacaacggagaag

SEQ ID NO: 297809 - DNA, 15 bp, Homo sapiens
aggaacaacggagaa

SEQ ID NO: 297810 - DNA, 15 bp, Homo sapiens
taggaacaacggaga

SEQ ID NO: 297811 - DNA, 15 bp, Homo sapiens
ttaggaacaacggag

SEQ ID NO: 297812 - DNA, 15 bp, Homo sapiens
gttaggaacaacgga

SEQ ID NO: 297813 - DNA, 15 bp, Homo sapiens
agttaggaacaacgg

SEQ ID NO: 297814 - DNA, 15 bp, Homo sapiens
cagttaggaacaacg

SEQ ID NO: 297815 - DNA, 15 bp, Homo sapiens
ccagttaggaacaac

SEQ ID NO: 297816 - DNA, 15 bp, Homo sapiens
cccagttaggaacaa

SEQ ID NO: 297817 - DNA, 15 bp, Homo sapiens
gcccagttaggaaca

SEQ ID NO: 297818 - DNA, 15 bp, Homo sapiens
ggcccagttaggaac

SEQ ID NO: 297819 - DNA, 15 bp, Homo sapiens
gggcccagttaggaa

SEQ ID NO: 297820 - DNA, 15 bp, Homo sapiens
tgggcccagttagga

SEQ ID NO: 297821 - DNA, 15 bp, Homo sapiens
atgggcccagttagg

SEQ ID NO: 297822 - DNA, 15 bp, Homo sapiens
gatgggcccagttag

SEQ ID NO: 297823 - DNA, 15 bp, Homo sapiens
ggatgggcccagtta

SEQ ID NO: 297824 - DNA, 15 bp, Homo sapiens
tggatgggcccagtt

SEQ ID NO: 297825 - DNA, 15 bp, Homo sapiens
ttggatgggcccagt

SEQ ID NO: 297826 - DNA, 15 bp, Homo sapiens
cttggatgggcccag

SEQ ID NO: 297827 - DNA, 15 bp, Homo sapiens
ccttggatgggccca

SEQ ID NO: 297828 - DNA, 15 bp, Homo sapiens
cccttggatgggccc

SEQ ID NO: 297829 - DNA, 15 bp, Homo sapiens
tcccttggatgggcc

SEQ ID NO: 297830 - DNA, 15 bp, Homo sapiens
gtcccttggatgggc

SEQ ID NO: 297831 - DNA, 15 bp, Homo sapiens
agtcccttggatggg

SEQ ID NO: 297832 - DNA, 15 bp, Homo sapiens
tagtcccttggatgg

SEQ ID NO: 297833 - DNA, 15 bp, Homo sapiens
atagtcccttggatg

SEQ ID NO: 297834 - DNA, 15 bp, Homo sapiens
aatagtcccttggat

SEQ ID NO: 297835 - DNA, 15 bp, Homo sapiens
taatagtcccttgga

SEQ ID NO: 297836 - DNA, 15 bp, Homo sapiens
ataatagtcccttgg

SEQ ID NO: 297837 - DNA, 15 bp, Homo sapiens
aataatagtcccttg

SEQ ID NO: 297838 - DNA, 15 bp, Homo sapiens
taataatagtccctt

SEQ ID NO: 297839 - DNA, 15 bp, Homo sapiens
gataataatagtccc

SEQ ID NO: 297840 - DNA, 15 bp, Homo sapiens
ggataataatagtcc

SEQ ID NO: 297841 - DNA, 15 bp, Homo sapiens
gggataataatagtc

SEQ ID NO: 297842 - DNA, 15 bp, Homo sapiens
tgggataataatagt

SEQ ID NO: 297843 - DNA, 15 bp, Homo sapiens
ttgggataataatag

SEQ ID NO: 297844 - DNA, 15 bp, Homo sapiens
cttgggataataata

SEQ ID NO: 297845 - DNA, 15 bp, Homo sapiens
acttgggataataat

SEQ ID NO: 297846 - DNA, 15 bp, Homo sapiens
cacttgggataataa

SEQ ID NO: 297847 - DNA, 15 bp, Homo sapiens
acacttgggataata

SEQ ID NO: 297848 - DNA, 15 bp, Homo sapiens
gacacttgggataat

SEQ ID NO: 297849 - DNA, 15 bp, Homo sapiens
ggacacttgggataa

SEQ ID NO: 297850 - DNA, 15 bp, Homo sapiens
tggacacttgggata

SEQ ID NO: 297851 - DNA, 15 bp, Homo sapiens
ctggacacttgggat

SEQ ID NO: 297852 - DNA, 15 bp, Homo sapiens
tctggacacttggga

SEQ ID NO: 297853 - DNA, 15 bp, Homo sapiens
ttctggacacttggg

SEQ ID NO: 297854 - DNA, 15 bp, Homo sapiens
cttctggacacttgg

SEQ ID NO: 297855 - DNA, 15 bp, Homo sapiens
ccttctggacacttg

SEQ ID NO: 297856 - DNA, 15 bp, Homo sapiens
tccttctggacactt

SEQ ID NO: 297857 - DNA, 15 bp, Homo sapiens
gtccttctggacact

SEQ ID NO: 297858 - DNA, 15 bp, Homo sapiens
tgtccttctggacac

SEQ ID NO: 297859 - DNA, 15 bp, Homo sapiens
gtgtccttctggaca

SEQ ID NO: 297860 - DNA, 15 bp, Homo sapiens
agtgtccttctggac

SEQ ID NO: 297861 - DNA, 15 bp, Homo sapiens
cagtgtccttctgga

SEQ ID NO: 297862 - DNA, 15 bp, Homo sapiens
tcagtgtccttctgg

SEQ ID NO: 297863 - DNA, 15 bp, Homo sapiens
ctcagtgtccttctg

SEQ ID NO: 297864 - DNA, 15 bp, Homo sapiens
cctcagtgtccttct

SEQ ID NO: 297865 - DNA, 15 bp, Homo sapiens
tcctcagtgtccttc

SEQ ID NO: 297866 - DNA, 15 bp, Homo sapiens
atcctcagtgtcctt

SEQ ID NO: 297867 - DNA, 15 bp, Homo sapiens
aatcctcagtgtcct

SEQ ID NO: 297868 - DNA, 15 bp, Homo sapiens
taatcctcagtgtcc

SEQ ID NO: 297869 - DNA, 15 bp, Homo sapiens
ctaatcctcagtgtc

SEQ ID NO: 297870 - DNA, 15 bp, Homo sapiens
cctaatcctcagtgt

SEQ ID NO: 297871 - DNA, 15 bp, Homo sapiens
gcctaatcctcagtg

SEQ ID NO: 297872 - DNA, 15 bp, Homo sapiens
ggcctaatcctcagt

SEQ ID NO: 297873 - DNA, 15 bp, Homo sapiens
tggcctaatcctcag

SEQ ID NO: 297874 - DNA, 15 bp, Homo sapiens
ctggcctaatcctca

SEQ ID NO: 297875 - DNA, 15 bp, Homo sapiens
gctggcctaatcctc

SEQ ID NO: 297876 - DNA, 15 bp, Homo sapiens
tgctggcctaatcct

SEQ ID NO: 297877 - DNA, 15 bp, Homo sapiens
gtgctggcctaatcc

SEQ ID NO: 297878 - DNA, 15 bp, Homo sapiens
agtgctggcctaatc

SEQ ID NO: 297879 - DNA, 15 bp, Homo sapiens
aagtgctggcctaat

SEQ ID NO: 297880 - DNA, 15 bp, Homo sapiens
aaagtgctggcctaa

SEQ ID NO: 297881 - DNA, 15 bp, Homo sapiens
gaaagtgctggccta

SEQ ID NO: 297882 - DNA, 15 bp, Homo sapiens
ggaaagtgctggcct

SEQ ID NO: 297883 - DNA, 15 bp, Homo sapiens
aggaaagtgctggcc

SEQ ID NO: 297884 - DNA, 15 bp, Homo sapiens
aaggaaagtgctggc

SEQ ID NO: 297885 - DNA, 15 bp, Homo sapiens
caaggaaagtgctgg

SEQ ID NO: 297886 - DNA, 15 bp, Homo sapiens
tcaaggaaagtgctg

SEQ ID NO: 297887 - DNA, 15 bp, Homo sapiens
atcaaggaaagtgct

SEQ ID NO: 297888 - DNA, 15 bp, Homo sapiens
catcaaggaaagtgc

SEQ ID NO: 297889 - DNA, 15 bp, Homo sapiens
gcatcaaggaaagtg

SEQ ID NO: 297890 - DNA, 15 bp, Homo sapiens
tgcatcaaggaaagt

SEQ ID NO: 297891 - DNA, 15 bp, Homo sapiens
ttgcatcaaggaaag

SEQ ID NO: 297892 - DNA, 15 bp, Homo sapiens
cttgcatcaaggaaa

SEQ ID NO: 297893 - DNA, 15 bp, Homo sapiens
acttgcatcaaggaa

SEQ ID NO: 297894 - DNA, 15 bp, Homo sapiens
tacttgcatcaagga

SEQ ID NO: 297895 - DNA, 15 bp, Homo sapiens
gtacttgcatcaagg

SEQ ID NO: 297896 - DNA, 15 bp, Homo sapiens
agtacttgcatcaag

SEQ ID NO: 297897 - DNA, 15 bp, Homo sapiens
aagtacttgcatcaa

SEQ ID NO: 297898 - DNA, 15 bp, Homo sapiens
caagtacttgcatca

SEQ ID NO: 297899 - DNA, 15 bp, Homo sapiens
ccaagtacttgcatc

SEQ ID NO: 297900 - DNA, 15 bp, Homo sapiens
gccaagtacttgcat

SEQ ID NO: 297901 - DNA, 15 bp, Homo sapiens
ggccaagtacttgca

SEQ ID NO: 297902 - DNA, 15 bp, Homo sapiens
tggccaagtacttgc

SEQ ID NO: 297903 - DNA, 15 bp, Homo sapiens
gtggccaagtacttg

SEQ ID NO: 297904 - DNA, 15 bp, Homo sapiens
ggtggccaagtactt

SEQ ID NO: 297905 - DNA, 15 bp, Homo sapiens
tggtggccaagtact

SEQ ID NO: 297906 - DNA, 15 bp, Homo sapiens
atggtggccaagtac

SEQ ID NO: 297907 - DNA, 15 bp, Homo sapiens
aatggtggccaagta

SEQ ID NO: 297908 - DNA, 15 bp, Homo sapiens
aaatggtggccaagt

SEQ ID NO: 297909 - DNA, 15 bp, Homo sapiens
aaaatggtggccaag

SEQ ID NO: 297910 - DNA, 15 bp, Homo sapiens
gaaaatggtggccaa

SEQ ID NO: 297911 - DNA, 15 bp, Homo sapiens
ggaaaatggtggcca

SEQ ID NO: 297912 - DNA, 15 bp, Homo sapiens
aggaaaatggtggcc

SEQ ID NO: 297913 - DNA, 15 bp, Homo sapiens
caggaaaatggtggc

SEQ ID NO: 297914 - DNA, 15 bp, Homo sapiens
ccaggaaaatggtgg

SEQ ID NO: 297915 - DNA, 15 bp, Homo sapiens
cccaggaaaatggtg

SEQ ID NO: 297916 - DNA, 15 bp, Homo sapiens
gcccaggaaaatggt

SEQ ID NO: 297917 - DNA, 15 bp, Homo sapiens
cgcccaggaaaatgg

SEQ ID NO: 297918 - DNA, 15 bp, Homo sapiens
acgcccaggaaaatg

SEQ ID NO: 297919 - DNA, 15 bp, Homo sapiens
aacgcccaggaaaat

SEQ ID NO: 297920 - DNA, 15 bp, Homo sapiens
taacgcccaggaaaa

SEQ ID NO: 297921 - DNA, 15 bp, Homo sapiens
ctaacgcccaggaaa

SEQ ID NO: 297922 - DNA, 15 bp, Homo sapiens
cctaacgcccaggaa

SEQ ID NO: 297923 - DNA, 15 bp, Homo sapiens
ccctaacgcccagga

SEQ ID NO: 297924 - DNA, 15 bp, Homo sapiens
accctaacgcccagg

SEQ ID NO: 297925 - DNA, 15 bp, Homo sapiens
gaccctaacgcccag

SEQ ID NO: 297926 - DNA, 15 bp, Homo sapiens
ggaccctaacgccca

SEQ ID NO: 297927 - DNA, 15 bp, Homo sapiens
tggaccctaacgccc

SEQ ID NO: 297928 - DNA, 15 bp, Homo sapiens
ctggaccctaacgcc

SEQ ID NO: 297929 - DNA, 15 bp, Homo sapiens
cctggaccctaacgc

SEQ ID NO: 297930 - DNA, 15 bp, Homo sapiens
ccctggaccctaacg

SEQ ID NO: 297931 - DNA, 15 bp, Homo sapiens
accctggaccctaac

SEQ ID NO: 297932 - DNA, 15 bp, Homo sapiens
caccctggaccctaa

SEQ ID NO: 297933 - DNA, 15 bp, Homo sapiens
acaccctggacccta

SEQ ID NO: 297934 - DNA, 15 bp, Homo sapiens
cacaccctggaccct

SEQ ID NO: 297935 - DNA, 15 bp, Homo sapiens
acacaccctggaccc

SEQ ID NO: 297936 - DNA, 15 bp, Homo sapiens
gacacaccctggacc

SEQ ID NO: 297937 - DNA, 15 bp, Homo sapiens
tgacacaccctggac

SEQ ID NO: 297938 - DNA, 15 bp, Homo sapiens
ttgacacaccctgga

SEQ ID NO: 297939 - DNA, 15 bp, Homo sapiens
cttgacacaccctgg

SEQ ID NO: 297940 - DNA, 15 bp, Homo sapiens
ccttgacacaccctg

SEQ ID NO: 297941 - DNA, 15 bp, Homo sapiens
cccttgacacaccct

SEQ ID NO: 297942 - DNA, 15 bp, Homo sapiens
acccttgacacaccc

SEQ ID NO: 297943 - DNA, 15 bp, Homo sapiens
cacccttgacacacc

SEQ ID NO: 297944 - DNA, 15 bp, Homo sapiens
ccacccttgacacac

SEQ ID NO: 297945 - DNA, 15 bp, Homo sapiens
cccacccttgacaca

SEQ ID NO: 297946 - DNA, 15 bp, Homo sapiens
acccacccttgacac

SEQ ID NO: 297947 - DNA, 15 bp, Homo sapiens
gacccacccttgaca

SEQ ID NO: 297948 - DNA, 15 bp, Homo sapiens
tgacccacccttgac

SEQ ID NO: 297949 - DNA, 15 bp, Homo sapiens
ttgacccacccttga

SEQ ID NO: 297950 - DNA, 15 bp, Homo sapiens
cttgacccacccttg

SEQ ID NO: 297951 - DNA, 15 bp, Homo sapiens
tcttgacccaccctt

SEQ ID NO: 297952 - DNA, 15 bp, Homo sapiens
ctcttgacccaccct

SEQ ID NO: 297953 - DNA, 15 bp, Homo sapiens
tctcttgacccaccc

SEQ ID NO: 297954 - DNA, 15 bp, Homo sapiens
ctctcttgacccacc

SEQ ID NO: 297955 - DNA, 15 bp, Homo sapiens
cctctcttgacccac

SEQ ID NO: 297956 - DNA, 15 bp, Homo sapiens
gcctctcttgaccca

SEQ ID NO: 297957 - DNA, 15 bp, Homo sapiens
tgcctctcttgaccc

SEQ ID NO: 297958 - DNA, 15 bp, Homo sapiens
ctgcctctcttgacc

SEQ ID NO: 297959 - DNA, 15 bp, Homo sapiens
tctgcctctcttgac

SEQ ID NO: 297960 - DNA, 15 bp, Homo sapiens
ttctgcctctcttga

SEQ ID NO: 297961 - DNA, 15 bp, Homo sapiens
tttctgcctctcttg

SEQ ID NO: 297962 - DNA, 15 bp, Homo sapiens
gtttctgcctctctt

SEQ ID NO: 297963 - DNA, 15 bp, Homo sapiens
ggtttctgcctctct

SEQ ID NO: 297964 - DNA, 15 bp, Homo sapiens
tggtttctgcctctc

SEQ ID NO: 297965 - DNA, 15 bp, Homo sapiens
ttggtttctgcctct

SEQ ID NO: 297966 - DNA, 15 bp, Homo sapiens
tttggtttctgcctc

SEQ ID NO: 297967 - DNA, 15 bp, Homo sapiens
ctttggtttctgcct

SEQ ID NO: 297968 - DNA, 15 bp, Homo sapiens
tctttggtttctgcc

SEQ ID NO: 297969 - DNA, 15 bp, Homo sapiens
gtctttggtttctgc

SEQ ID NO: 297970 - DNA, 15 bp, Homo sapiens
agtctttggtttctg

SEQ ID NO: 297971 - DNA, 15 bp, Homo sapiens
aagtctttggtttct

SEQ ID NO: 297972 - DNA, 15 bp, Homo sapiens
taagtctttggtttc

SEQ ID NO: 297973 - DNA, 15 bp, Homo sapiens
ataagtctttggttt

SEQ ID NO: 297974 - DNA, 15 bp, Homo sapiens
cataagtctttggtt

SEQ ID NO: 297975 - DNA, 15 bp, Homo sapiens
gcataagtctttggt

SEQ ID NO: 297976 - DNA, 15 bp, Homo sapiens
ggcataagtctttgg

SEQ ID NO: 297977 - DNA, 15 bp, Homo sapiens
aggcataagtctttg

SEQ ID NO: 297978 - DNA, 15 bp, Homo sapiens
aaggcataagtcttt

SEQ ID NO: 297979 - DNA, 15 bp, Homo sapiens
gaaggcataagtctt

SEQ ID NO: 297980 - DNA, 15 bp, Homo sapiens
tgaaggcataagtct

SEQ ID NO: 297981 - DNA, 15 bp, Homo sapiens
ctgaaggcataagtc

SEQ ID NO: 297982 - DNA, 15 bp, Homo sapiens
actgaaggcataagt

SEQ ID NO: 297983 - DNA, 15 bp, Homo sapiens
cactgaaggcataag

SEQ ID NO: 297984 - DNA, 15 bp, Homo sapiens
ccactgaaggcataa

SEQ ID NO: 297985 - DNA, 15 bp, Homo sapiens
accactgaaggcata

SEQ ID NO: 297986 - DNA, 15 bp, Homo sapiens
gaccactgaaggcat

SEQ ID NO: 297987 - DNA, 15 bp, Homo sapiens
ggaccactgaaggca

SEQ ID NO: 297988 - DNA, 15 bp, Homo sapiens
gggaccactgaaggc

SEQ ID NO: 297989 - DNA, 15 bp, Homo sapiens
agggaccactgaagg

SEQ ID NO: 297990 - DNA, 15 bp, Homo sapiens
aagggaccactgaag

SEQ ID NO: 297991 - DNA, 15 bp, Homo sapiens
caagggaccactgaa

SEQ ID NO: 297992 - DNA, 15 bp, Homo sapiens
ccaagggaccactga

SEQ ID NO: 297993 - DNA, 15 bp, Homo sapiens
accaagggaccactg

SEQ ID NO: 297994 - DNA, 15 bp, Homo sapiens
gaccaagggaccact

SEQ ID NO: 297995 - DNA, 15 bp, Homo sapiens
tgaccaagggaccac

SEQ ID NO: 297996 - DNA, 15 bp, Homo sapiens
ctgaccaagggacca

SEQ ID NO: 297997 - DNA, 15 bp, Homo sapiens
tctgaccaagggacc

SEQ ID NO: 297998 - DNA, 15 bp, Homo sapiens
ttctgaccaagggac

SEQ ID NO: 297999 - DNA, 15 bp, Homo sapiens
attctgaccaaggga

SEQ ID NO: 298000 - DNA, 15 bp, Homo sapiens
aattctgaccaaggg

SEQ ID NO: 298001 - DNA, 15 bp, Homo sapiens
taattctgaccaagg

SEQ ID NO: 298002 - DNA, 15 bp, Homo sapiens
ctaattctgaccaag

SEQ ID NO: 298003 - DNA, 15 bp, Homo sapiens
actaattctgaccaa

SEQ ID NO: 298004 - DNA, 15 bp, Homo sapiens
tactaattctgacca

SEQ ID NO: 298005 - DNA, 15 bp, Homo sapiens
gtactaattctgacc

SEQ ID NO: 298006 - DNA, 15 bp, Homo sapiens
agtactaattctgac

SEQ ID NO: 298007 - DNA, 15 bp, Homo sapiens
gagtactaattctga

SEQ ID NO: 298008 - DNA, 15 bp, Homo sapiens
tgagtactaattctg

SEQ ID NO: 298009 - DNA, 15 bp, Homo sapiens
ctgagtactaattct

SEQ ID NO: 298010 - DNA, 15 bp, Homo sapiens
gctgagtactaattc

SEQ ID NO: 298011 - DNA, 15 bp, Homo sapiens
tgctgagtactaatt

SEQ ID NO: 298012 - DNA, 15 bp, Homo sapiens
ttgctgagtactaat

SEQ ID NO: 298013 - DNA, 15 bp, Homo sapiens
tttgctgagtactaa

SEQ ID NO: 298014 - DNA, 15 bp, Homo sapiens
ctttgctgagtacta

SEQ ID NO: 298015 - DNA, 15 bp, Homo sapiens
actttgctgagtact

SEQ ID NO: 298016 - DNA, 15 bp, Homo sapiens
tactttgctgagtac

SEQ ID NO: 298017 - DNA, 15 bp, Homo sapiens
ttactttgctgagta

SEQ ID NO: 298018 - DNA, 15 bp, Homo sapiens
cttactttgctgagt

SEQ ID NO: 298019 - DNA, 15 bp, Homo sapiens
acttactttgctgag

SEQ ID NO: 298020 - DNA, 15 bp, Homo sapiens
tacttactttgctga

SEQ ID NO: 298021 - DNA, 15 bp, Homo sapiens
ctacttactttgctg

SEQ ID NO: 298022 - DNA, 15 bp, Homo sapiens
tctacttactttgct

SEQ ID NO: 298023 - DNA, 15 bp, Homo sapiens
ttctacttactttgc

SEQ ID NO: 298024 - DNA, 15 bp, Homo sapiens
gttctacttactttg

SEQ ID NO: 298025 - DNA, 15 bp, Homo sapiens
tgttctacttacttt

SEQ ID NO: 298026 - DNA, 15 bp, Homo sapiens
atgttctacttactt

SEQ ID NO: 298027 - DNA, 15 bp, Homo sapiens
catgttctacttact

SEQ ID NO: 298028 - DNA, 15 bp, Homo sapiens
gcatgttctacttac

SEQ ID NO: 298029 - DNA, 15 bp, Homo sapiens
agcatgttctactta

SEQ ID NO: 298030 - DNA, 15 bp, Homo sapiens
gagcatgttctactt

SEQ ID NO: 298031 - DNA, 15 bp, Homo sapiens
agagcatgttctact

SEQ ID NO: 298032 - DNA, 15 bp, Homo sapiens
cagagcatgttctac

SEQ ID NO: 298033 - DNA, 15 bp, Homo sapiens
acagagcatgttcta

SEQ ID NO: 298034 - DNA, 15 bp, Homo sapiens
aacagagcatgttct

SEQ ID NO: 298035 - DNA, 15 bp, Homo sapiens
gaacagagcatgttc

SEQ ID NO: 298036 - DNA, 15 bp, Homo sapiens
agaacagagcatgtt

SEQ ID NO: 298037 - DNA, 15 bp, Homo sapiens
cagaacagagcatgt

SEQ ID NO: 298038 - DNA, 15 bp, Homo sapiens
tcagaacagagcatg

SEQ ID NO: 298039 - DNA, 15 bp, Homo sapiens
atcagaacagagcat

SEQ ID NO: 298040 - DNA, 15 bp, Homo sapiens
tatcagaacagagca

SEQ ID NO: 298041 - DNA, 15 bp, Homo sapiens
gtatcagaacagagc

SEQ ID NO: 298042 - DNA, 15 bp, Homo sapiens
tgtatcagaacagag

SEQ ID NO: 298043 - DNA, 15 bp, Homo sapiens
atgtatcagaacaga

SEQ ID NO: 298044 - DNA, 15 bp, Homo sapiens
tatgtatcagaacag

SEQ ID NO: 298045 - DNA, 15 bp, Homo sapiens
ttatgtatcagaaca

SEQ ID NO: 298046 - DNA, 15 bp, Homo sapiens
tttatgtatcagaac

SEQ ID NO: 298047 - DNA, 15 bp, Homo sapiens
gtttatgtatcagaa

SEQ ID NO: 298048 - DNA, 15 bp, Homo sapiens
ggtttatgtatcaga

SEQ ID NO: 298049 - DNA, 15 bp, Homo sapiens
tggtttatgtatcag

SEQ ID NO: 298050 - DNA, 15 bp, Homo sapiens
ttggtttatgtatca

SEQ ID NO: 298051 - DNA, 15 bp, Homo sapiens
tttggtttatgtatc

SEQ ID NO: 298052 - DNA, 15 bp, Homo sapiens
atttggtttatgtat

SEQ ID NO: 298053 - DNA, 15 bp, Homo sapiens
tatttggtttatgta

SEQ ID NO: 298054 - DNA, 15 bp, Homo sapiens
gtatttggtttatgt

SEQ ID NO: 298055 - DNA, 15 bp, Homo sapiens
tgtatttggtttatg

SEQ ID NO: 298056 - DNA, 15 bp, Homo sapiens
gtgtatttggtttat

SEQ ID NO: 298057 - DNA, 15 bp, Homo sapiens
tgtgtatttggttta

SEQ ID NO: 298058 - DNA, 15 bp, Homo sapiens
ctgtgtatttggttt

SEQ ID NO: 298059 - DNA, 15 bp, Homo sapiens
actgtgtatttggtt

SEQ ID NO: 298060 - DNA, 15 bp, Homo sapiens
tactgtgtatttggt

SEQ ID NO: 298061 - DNA, 15 bp, Homo sapiens
atactgtgtatttgg

SEQ ID NO: 298062 - DNA, 15 bp, Homo sapiens
catactgtgtatttg

SEQ ID NO: 298063 - DNA, 15 bp, Homo sapiens
tcatactgtgtattt

SEQ ID NO: 298064 - DNA, 15 bp, Homo sapiens
atcatactgtgtatt

SEQ ID NO: 298065 - DNA, 15 bp, Homo sapiens
aatcatactgtgtat

SEQ ID NO: 298066 - DNA, 15 bp, Homo sapiens
aaatcatactgtgta

SEQ ID NO: 298067 - DNA, 15 bp, Homo sapiens
taaatcatactgtgt

SEQ ID NO: 298068 - DNA, 15 bp, Homo sapiens
ttaaatcatactgtg

SEQ ID NO: 298069 - DNA, 15 bp, Homo sapiens
tttaaatcatactgt

SEQ ID NO: 298070 - DNA, 15 bp, Homo sapiens
atttaaatcatactg

SEQ ID NO: 298071 - DNA, 15 bp, Homo sapiens
tatttaaatcatact

SEQ ID NO: 298072 - DNA, 15 bp, Homo sapiens
ctatttaaatcatac

SEQ ID NO: 298073 - DNA, 15 bp, Homo sapiens
cctatttaaatcata

SEQ ID NO: 298074 - DNA, 15 bp, Homo sapiens
tcctatttaaatcat

SEQ ID NO: 298075 - DNA, 15 bp, Homo sapiens
ttcctatttaaatca

SEQ ID NO: 298076 - DNA, 15 bp, Homo sapiens
tttcctatttaaatc

SEQ ID NO: 298077 - DNA, 15 bp, Homo sapiens
atttcctatttaaat

SEQ ID NO: 298078 - DNA, 15 bp, Homo sapiens
catttcctatttaaa

SEQ ID NO: 298079 - DNA, 15 bp, Homo sapiens
tcatttcctatttaa

SEQ ID NO: 298080 - DNA, 15 bp, Homo sapiens
ctcatttcctattta

SEQ ID NO: 298081 - DNA, 15 bp, Homo sapiens
tctcatttcctattt

SEQ ID NO: 298082 - DNA, 15 bp, Homo sapiens
atctcatttcctatt

SEQ ID NO: 298083 - DNA, 15 bp, Homo sapiens
aatctcatttcctat

SEQ ID NO: 298084 - DNA, 15 bp, Homo sapiens
aaatctcatttccta

SEQ ID NO: 298085 - DNA, 15 bp, Homo sapiens
aaaatctcatttcct

SEQ ID NO: 298086 - DNA, 15 bp, Homo sapiens
aaaaatctcatttcc

SEQ ID NO: 298087 - DNA, 15 bp, Homo sapiens
aaaaaatctcatttc

SEQ ID NO: 298088 - DNA, 15 bp, Homo sapiens
caaaaaatctcattt

SEQ ID NO: 298089 - DNA, 15 bp, Homo sapiens
gcaaaaaatctcatt

SEQ ID NO: 298090 - DNA, 15 bp, Homo sapiens
tgcaaaaaatctcat

SEQ ID NO: 298091 - DNA, 15 bp, Homo sapiens
ttgcaaaaaatctca

SEQ ID NO: 298092 - DNA, 15 bp, Homo sapiens
cttgcaaaaaatctc

SEQ ID NO: 298093 - DNA, 15 bp, Homo sapiens
tcttgcaaaaaatct

SEQ ID NO: 298094 - DNA, 15 bp, Homo sapiens
gtcttgcaaaaaatc

SEQ ID NO: 298095 - DNA, 15 bp, Homo sapiens
agtcttgcaaaaaat

SEQ ID NO: 298096 - DNA, 15 bp, Homo sapiens
tagtcttgcaaaaaa

SEQ ID NO: 298097 - DNA, 15 bp, Homo sapiens
ttagtcttgcaaaaa

SEQ ID NO: 298098 - DNA, 15 bp, Homo sapiens
cttagtcttgcaaaa

SEQ ID NO: 298099 - DNA, 15 bp, Homo sapiens
acttagtcttgcaaa

SEQ ID NO: 298100 - DNA, 15 bp, Homo sapiens
cacttagtcttgcaa

SEQ ID NO: 298101 - DNA, 15 bp, Homo sapiens
gcacttagtcttgca

SEQ ID NO: 298102 - DNA, 15 bp, Homo sapiens
agcacttagtcttgc

SEQ ID NO: 298103 - DNA, 15 bp, Homo sapiens
gagcacttagtcttg

SEQ ID NO: 298104 - DNA, 15 bp, Homo sapiens
tgagcacttagtctt

SEQ ID NO: 298105 - DNA, 15 bp, Homo sapiens
ctgagcacttagtct

SEQ ID NO: 298106 - DNA, 15 bp, Homo sapiens
actgagcacttagtc

SEQ ID NO: 298107 - DNA, 15 bp, Homo sapiens
cactgagcacttagt

SEQ ID NO: 298108 - DNA, 15 bp, Homo sapiens
tcactgagcacttag

SEQ ID NO: 298109 - DNA, 15 bp, Homo sapiens
ttcactgagcactta

SEQ ID NO: 298110 - DNA, 15 bp, Homo sapiens
attcactgagcactt

SEQ ID NO: 298111 - DNA, 15 bp, Homo sapiens
cattcactgagcact

SEQ ID NO: 298112 - DNA, 15 bp, Homo sapiens
gcattcactgagcac

SEQ ID NO: 298113 - DNA, 15 bp, Homo sapiens
agcattcactgagca

SEQ ID NO: 298114 - DNA, 15 bp, Homo sapiens
aagcattcactgagc

SEQ ID NO: 298115 - DNA, 15 bp, Homo sapiens
aaagcattcactgag

SEQ ID NO: 298116 - DNA, 15 bp, Homo sapiens
taaagcattcactga

SEQ ID NO: 298117 - DNA, 15 bp, Homo sapiens
ctaaagcattcactg

SEQ ID NO: 298118 - DNA, 15 bp, Homo sapiens
actaaagcattcact

SEQ ID NO: 298119 - DNA, 15 bp, Homo sapiens
cactaaagcattcac

SEQ ID NO: 298120 - DNA, 15 bp, Homo sapiens
acactaaagcattca

SEQ ID NO: 298121 - DNA, 15 bp, Homo sapiens
tacactaaagcattc

SEQ ID NO: 298122 - DNA, 15 bp, Homo sapiens
atacactaaagcatt

SEQ ID NO: 298123 - DNA, 15 bp, Homo sapiens
catacactaaagcat

SEQ ID NO: 298124 - DNA, 15 bp, Homo sapiens
gcatacactaaagca

SEQ ID NO: 298125 - DNA, 15 bp, Homo sapiens
tgcatacactaaagc

SEQ ID NO: 298126 - DNA, 15 bp, Homo sapiens
gtgcatacactaaag

SEQ ID NO: 298127 - DNA, 15 bp, Homo sapiens
agtgcatacactaaa

SEQ ID NO: 298128 - DNA, 15 bp, Homo sapiens
tagtgcatacactaa

SEQ ID NO: 298129 - DNA, 15 bp, Homo sapiens
ttagtgcatacacta

SEQ ID NO: 298130 - DNA, 15 bp, Homo sapiens
tttagtgcatacact

SEQ ID NO: 298131 - DNA, 15 bp, Homo sapiens
atttagtgcatacac

SEQ ID NO: 298132 - DNA, 15 bp, Homo sapiens
gatttagtgcataca

SEQ ID NO: 298133 - DNA, 15 bp, Homo sapiens
agatttagtgcatac

SEQ ID NO: 298134 - DNA, 15 bp, Homo sapiens
aagatttagtgcata

SEQ ID NO: 298135 - DNA, 15 bp, Homo sapiens
taagatttagtgcat

SEQ ID NO: 298136 - DNA, 15 bp, Homo sapiens
ttaagatttagtgca

SEQ ID NO: 298137 - DNA, 15 bp, Homo sapiens
tttaagatttagtgc

SEQ ID NO: 298138 - DNA, 15 bp, Homo sapiens
atttaagatttagtg

SEQ ID NO: 298139 - DNA, 15 bp, Homo sapiens
gatttaagatttagt

SEQ ID NO: 298140 - DNA, 15 bp, Homo sapiens
tgatttaagatttag

SEQ ID NO: 298141 - DNA, 15 bp, Homo sapiens
gtgatttaagattta

SEQ ID NO: 298142 - DNA, 15 bp, Homo sapiens
tgtgatttaagattt

SEQ ID NO: 298143 - DNA, 15 bp, Homo sapiens
catgtgatttaagat

SEQ ID NO: 298144 - DNA, 15 bp, Homo sapiens
ccatgtgatttaaga

SEQ ID NO: 298145 - DNA, 15 bp, Homo sapiens
cccatgtgatttaag

SEQ ID NO: 298146 - DNA, 15 bp, Homo sapiens
tcccatgtgatttaa

SEQ ID NO: 298147 - DNA, 15 bp, Homo sapiens
atcccatgtgattta

SEQ ID NO: 298148 - DNA, 15 bp, Homo sapiens
tatcccatgtgattt

SEQ ID NO: 298149 - DNA, 15 bp, Homo sapiens
atatcccatgtgatt

SEQ ID NO: 298150 - DNA, 15 bp, Homo sapiens
catatcccatgtgat

SEQ ID NO: 298151 - DNA, 15 bp, Homo sapiens
tcatatcccatgtga

SEQ ID NO: 298152 - DNA, 15 bp, Homo sapiens
ctcatatcccatgtg

SEQ ID NO: 298153 - DNA, 15 bp, Homo sapiens
tctcatatcccatgt

SEQ ID NO: 298154 - DNA, 15 bp, Homo sapiens
ttctcatatcccatg

SEQ ID NO: 298155 - DNA, 15 bp, Homo sapiens
tttctcatatcccat

SEQ ID NO: 298156 - DNA, 15 bp, Homo sapiens
gtttctcatatccca

SEQ ID NO: 298157 - DNA, 15 bp, Homo sapiens
agtttctcatatccc

SEQ ID NO: 298158 - DNA, 15 bp, Homo sapiens
tagtttctcatatcc

SEQ ID NO: 298159 - DNA, 15 bp, Homo sapiens
ttagtttctcatatc

SEQ ID NO: 298160 - DNA, 15 bp, Homo sapiens
gttagtttctcatat

SEQ ID NO: 298161 - DNA, 15 bp, Homo sapiens
ggttagtttctcata

SEQ ID NO: 298162 - DNA, 15 bp, Homo sapiens
tggttagtttctcat

SEQ ID NO: 298163 - DNA, 15 bp, Homo sapiens
ctggttagtttctca

SEQ ID NO: 298164 - DNA, 15 bp, Homo sapiens
cctggttagtttctc

SEQ ID NO: 298165 - DNA, 15 bp, Homo sapiens
tcctggttagtttct

SEQ ID NO: 298166 - DNA, 15 bp, Homo sapiens
ttcctggttagtttc

SEQ ID NO: 298167 - DNA, 15 bp, Homo sapiens
tttcctggttagttt

SEQ ID NO: 298168 - DNA, 15 bp, Homo sapiens
ttttcctggttagtt

SEQ ID NO: 298169 - DNA, 15 bp, Homo sapiens
gttttcctggttagt

SEQ ID NO: 298170 - DNA, 15 bp, Homo sapiens
agttttcctggttag

SEQ ID NO: 298171 - DNA, 15 bp, Homo sapiens
tagttttcctggtta

SEQ ID NO: 298172 - DNA, 15 bp, Homo sapiens
ctagttttcctggtt

SEQ ID NO: 298173 - DNA, 15 bp, Homo sapiens
gctagttttcctggt

SEQ ID NO: 298174 - DNA, 15 bp, Homo sapiens
ggctagttttcctgg

SEQ ID NO: 298175 - DNA, 15 bp, Homo sapiens
gggctagttttcctg

SEQ ID NO: 298176 - DNA, 15 bp, Homo sapiens
agggctagttttcct

SEQ ID NO: 298177 - DNA, 15 bp, Homo sapiens
gagggctagttttcc

SEQ ID NO: 298178 - DNA, 15 bp, Homo sapiens
tgagggctagttttc

SEQ ID NO: 298179 - DNA, 15 bp, Homo sapiens
atgagggctagtttt

SEQ ID NO: 298180 - DNA, 15 bp, Homo sapiens
aatgagggctagttt

SEQ ID NO: 298181 - DNA, 15 bp, Homo sapiens
caatgagggctagtt

SEQ ID NO: 298182 - DNA, 15 bp, Homo sapiens
tcaatgagggctagt

SEQ ID NO: 298183 - DNA, 15 bp, Homo sapiens
ttcaatgagggctag

SEQ ID NO: 298184 - DNA, 15 bp, Homo sapiens
cttcaatgagggcta

SEQ ID NO: 298185 - DNA, 15 bp, Homo sapiens
gcttcaatgagggct

SEQ ID NO: 298186 - DNA, 15 bp, Homo sapiens
tgcttcaatgagggc

SEQ ID NO: 298187 - DNA, 15 bp, Homo sapiens
atgcttcaatgaggg

SEQ ID NO: 298188 - DNA, 15 bp, Homo sapiens
aatgcttcaatgagg

SEQ ID NO: 298189 - DNA, 15 bp, Homo sapiens
taatgcttcaatgag

SEQ ID NO: 298190 - DNA, 15 bp, Homo sapiens
ttaatgcttcaatga

SEQ ID NO: 298191 - DNA, 15 bp, Homo sapiens
cttaatgcttcaatg

SEQ ID NO: 298192 - DNA, 15 bp, Homo sapiens
gcttaatgcttcaat

SEQ ID NO: 298193 - DNA, 15 bp, Homo sapiens
ggcttaatgcttcaa

SEQ ID NO: 298194 - DNA, 15 bp, Homo sapiens
tggcttaatgcttca

SEQ ID NO: 298195 - DNA, 15 bp, Homo sapiens
ctggcttaatgcttc

SEQ ID NO: 298196 - DNA, 15 bp, Homo sapiens
cctggcttaatgctt

SEQ ID NO: 298197 - DNA, 15 bp, Homo sapiens
tcctggcttaatgct

SEQ ID NO: 298198 - DNA, 15 bp, Homo sapiens
ttcctggcttaatgc

SEQ ID NO: 298199 - DNA, 15 bp, Homo sapiens
tttcctggcttaatg

SEQ ID NO: 298200 - DNA, 15 bp, Homo sapiens
ttttcctggcttaat

SEQ ID NO: 298201 - DNA, 15 bp, Homo sapiens
tttttcctggcttaa

SEQ ID NO: 298202 - DNA, 15 bp, Homo sapiens
ttttttcctggctta

SEQ ID NO: 298203 - DNA, 15 bp, Homo sapiens
tttttttcctggctt

SEQ ID NO: 298204 - DNA, 15 bp, Homo sapiens
ttttttttcctggct

SEQ ID NO: 298205 - DNA, 15 bp, Homo sapiens
tttttttttcctggc

SEQ ID NO: 298206 - DNA, 15 bp, Homo sapiens
ttttttttttcctgg

SEQ ID NO: 298207 - DNA, 15 bp, Homo sapiens
attttttttttcctg

SEQ ID NO: 298208 - DNA, 15 bp, Homo sapiens
cattttttttttcct

SEQ ID NO: 298209 - DNA, 15 bp, Homo sapiens
acattttttttttcc

SEQ ID NO: 298210 - DNA, 15 bp, Homo sapiens
cacattttttttttc

SEQ ID NO: 298211 - DNA, 15 bp, Homo sapiens
acacatttttttttt

SEQ ID NO: 298212 - DNA, 15 bp, Homo sapiens
aacacattttttttt

SEQ ID NO: 298213 - DNA, 15 bp, Homo sapiens
aaacacatttttttt

SEQ ID NO: 298214 - DNA, 15 bp, Homo sapiens
gaaacacattttttt

SEQ ID NO: 298215 - DNA, 15 bp, Homo sapiens
agaaacacatttttt

SEQ ID NO: 298216 - DNA, 15 bp, Homo sapiens
aagaaacacattttt

SEQ ID NO: 298217 - DNA, 15 bp, Homo sapiens
caagaaacacatttt

SEQ ID NO: 298218 - DNA, 15 bp, Homo sapiens
acaagaaacacattt

SEQ ID NO: 298219 - DNA, 15 bp, Homo sapiens
aacaagaaacacatt

SEQ ID NO: 298220 - DNA, 15 bp, Homo sapiens
aaacaagaaacacat

SEQ ID NO: 298221 - DNA, 15 bp, Homo sapiens
aaaacaagaaacaca

SEQ ID NO: 298222 - DNA, 15 bp, Homo sapiens
aaaaacaagaaacac

SEQ ID NO: 298223 - DNA, 15 bp, Homo sapiens
gaaaaacaagaaaca

SEQ ID NO: 298224 - DNA, 15 bp, Homo sapiens
ggaaaaacaagaaac

SEQ ID NO: 298225 - DNA, 15 bp, Homo sapiens
aggaaaaacaagaaa

SEQ ID NO: 298226 - DNA, 15 bp, Homo sapiens
taggaaaaacaagaa

SEQ ID NO: 298227 - DNA, 15 bp, Homo sapiens
ataggaaaaacaaga

SEQ ID NO: 298228 - DNA, 15 bp, Homo sapiens
aataggaaaaacaag

SEQ ID NO: 298229 - DNA, 15 bp, Homo sapiens
taataggaaaaacaa

SEQ ID NO: 298230 - DNA, 15 bp, Homo sapiens
ctaataggaaaaaca

SEQ ID NO: 298231 - DNA, 15 bp, Homo sapiens
gctaataggaaaaac

SEQ ID NO: 298232 - DNA, 15 bp, Homo sapiens
tgctaataggaaaaa

SEQ ID NO: 298233 - DNA, 15 bp, Homo sapiens
atgctaataggaaaa

SEQ ID NO: 298234 - DNA, 15 bp, Homo sapiens
gatgctaataggaaa

SEQ ID NO: 298235 - DNA, 15 bp, Homo sapiens
ggatgctaataggaa

SEQ ID NO: 298236 - DNA, 15 bp, Homo sapiens
tggatgctaatagga

SEQ ID NO: 298237 - DNA, 15 bp, Homo sapiens
atggatgctaatagg

SEQ ID NO: 298238 - DNA, 15 bp, Homo sapiens
aatggatgctaatag

SEQ ID NO: 298239 - DNA, 15 bp, Homo sapiens
aaatggatgctaata

SEQ ID NO: 298240 - DNA, 15 bp, Homo sapiens
taaatggatgctaat

SEQ ID NO: 298241 - DNA, 15 bp, Homo sapiens
ttaaatggatgctaa

SEQ ID NO: 298242 - DNA, 15 bp, Homo sapiens
gttaaatggatgcta

SEQ ID NO: 298243 - DNA, 15 bp, Homo sapiens
tgttaaatggatgct

SEQ ID NO: 298244 - DNA, 15 bp, Homo sapiens
ttgttaaatggatgc

SEQ ID NO: 298245 - DNA, 15 bp, Homo sapiens
gttgttaaatggatg

SEQ ID NO: 298246 - DNA, 15 bp, Homo sapiens
agttgttaaatggat

SEQ ID NO: 298247 - DNA, 15 bp, Homo sapiens
cagttgttaaatgga

SEQ ID NO: 298248 - DNA, 15 bp, Homo sapiens
ccagttgttaaatgg

SEQ ID NO: 298249 - DNA, 15 bp, Homo sapiens
cccagttgttaaatg

SEQ ID NO: 298250 - DNA, 15 bp, Homo sapiens
gcccagttgttaaat

SEQ ID NO: 298251 - DNA, 15 bp, Homo sapiens
agcccagttgttaaa

SEQ ID NO: 298252 - DNA, 15 bp, Homo sapiens
tagcccagttgttaa

SEQ ID NO: 298253 - DNA, 15 bp, Homo sapiens
atagcccagttgtta

SEQ ID NO: 298254 - DNA, 15 bp, Homo sapiens
aatagcccagttgtt

SEQ ID NO: 298255 - DNA, 15 bp, Homo sapiens
taatagcccagttgt

SEQ ID NO: 298256 - DNA, 15 bp, Homo sapiens
ataatagcccagttg

SEQ ID NO: 298257 - DNA, 15 bp, Homo sapiens
aataatagcccagtt

SEQ ID NO: 298258 - DNA, 15 bp, Homo sapiens
taataatagcccagt

SEQ ID NO: 298259 - DNA, 15 bp, Homo sapiens
gtaataatagcccag

SEQ ID NO: 298260 - DNA, 15 bp, Homo sapiens
ggtaataatagccca

SEQ ID NO: 298261 - DNA, 15 bp, Homo sapiens
gggtaataatagccc

SEQ ID NO: 298262 - DNA, 15 bp, Homo sapiens
agggtaataatagcc

SEQ ID NO: 298263 - DNA, 15 bp, Homo sapiens
tagggtaataatagc

SEQ ID NO: 298264 - DNA, 15 bp, Homo sapiens
atagggtaataatag

SEQ ID NO: 298265 - DNA, 15 bp, Homo sapiens
catagggtaataata

SEQ ID NO: 298266 - DNA, 15 bp, Homo sapiens
acatagggtaataat

SEQ ID NO: 298267 - DNA, 15 bp, Homo sapiens
tacatagggtaataa

SEQ ID NO: 298268 - DNA, 15 bp, Homo sapiens
ctacatagggtaata

SEQ ID NO: 298269 - DNA, 15 bp, Homo sapiens
tctacatagggtaat

SEQ ID NO: 298270 - DNA, 15 bp, Homo sapiens
ctctacatagggtaa

SEQ ID NO: 298271 - DNA, 15 bp, Homo sapiens
actctacatagggta

SEQ ID NO: 298272 - DNA, 15 bp, Homo sapiens
cactctacatagggt

SEQ ID NO: 298273 - DNA, 15 bp, Homo sapiens
tcactctacataggg

SEQ ID NO: 298274 - DNA, 15 bp, Homo sapiens
atcactctacatagg

SEQ ID NO: 298275 - DNA, 15 bp, Homo sapiens
tatcactctacatag

SEQ ID NO: 298276 - DNA, 15 bp, Homo sapiens
gtatcactctacata

SEQ ID NO: 298277 - DNA, 15 bp, Homo sapiens
agtatcactctacat

SEQ ID NO: 298278 - DNA, 15 bp, Homo sapiens
aagtatcactctaca

SEQ ID NO: 298279 - DNA, 15 bp, Homo sapiens
aaagtatcactctac

SEQ ID NO: 298280 - DNA, 15 bp, Homo sapiens
gaaagtatcactcta

SEQ ID NO: 298281 - DNA, 15 bp, Homo sapiens
ggaaagtatcactct

SEQ ID NO: 298282 - DNA, 15 bp, Homo sapiens
tggaaagtatcactc

SEQ ID NO: 298283 - DNA, 15 bp, Homo sapiens
gtggaaagtatcact

SEQ ID NO: 298284 - DNA, 15 bp, Homo sapiens
cgtggaaagtatcac

SEQ ID NO: 298285 - DNA, 15 bp, Homo sapiens
gcgtggaaagtatca

SEQ ID NO: 298286 - DNA, 15 bp, Homo sapiens
tgcgtggaaagtatc

SEQ ID NO: 298287 - DNA, 15 bp, Homo sapiens
atgcgtggaaagtat

SEQ ID NO: 298288 - DNA, 15 bp, Homo sapiens
aatgcgtggaaagta

SEQ ID NO: 298289 - DNA, 15 bp, Homo sapiens
aaatgcgtggaaagt

SEQ ID NO: 298290 - DNA, 15 bp, Homo sapiens
caaatgcgtggaaag

SEQ ID NO: 298291 - DNA, 15 bp, Homo sapiens
gcaaatgcgtggaaa

SEQ ID NO: 298292 - DNA, 15 bp, Homo sapiens
tgcaaatgcgtggaa

SEQ ID NO: 298293 - DNA, 15 bp, Homo sapiens
atgcaaatgcgtgga

SEQ ID NO: 298294 - DNA, 15 bp, Homo sapiens
catgcaaatgcgtgg

SEQ ID NO: 298295 - DNA, 15 bp, Homo sapiens
gcatgcaaatgcgtg

SEQ ID NO: 298296 - DNA, 15 bp, Homo sapiens
ggcatgcaaatgcgt

SEQ ID NO: 298297 - DNA, 15 bp, Homo sapiens
aggcatgcaaatgcg

SEQ ID NO: 298298 - DNA, 15 bp, Homo sapiens
caggcatgcaaatgc

SEQ ID NO: 298299 - DNA, 15 bp, Homo sapiens
tcaggcatgcaaatg

SEQ ID NO: 298300 - DNA, 15 bp, Homo sapiens
ctcaggcatgcaaat

SEQ ID NO: 298301 - DNA, 15 bp, Homo sapiens
tctcaggcatgcaaa

SEQ ID NO: 298302 - DNA, 15 bp, Homo sapiens
ctctcaggcatgcaa

SEQ ID NO: 298303 - DNA, 15 bp, Homo sapiens
actctcaggcatgca

SEQ ID NO: 298304 - DNA, 15 bp, Homo sapiens
aactctcaggcatgc

SEQ ID NO: 298305 - DNA, 15 bp, Homo sapiens
caactctcaggcatg

SEQ ID NO: 298306 - DNA, 15 bp, Homo sapiens
ccaactctcaggcat

SEQ ID NO: 298307 - DNA, 15 bp, Homo sapiens
tccaactctcaggca

SEQ ID NO: 298308 - DNA, 15 bp, Homo sapiens
ttccaactctcaggc

SEQ ID NO: 298309 - DNA, 15 bp, Homo sapiens
gttccaactctcagg

SEQ ID NO: 298310 - DNA, 15 bp, Homo sapiens
ggttccaactctcag

SEQ ID NO: 298311 - DNA, 15 bp, Homo sapiens
tggttccaactctca

SEQ ID NO: 298312 - DNA, 15 bp, Homo sapiens
ttggttccaactctc

SEQ ID NO: 298313 - DNA, 15 bp, Homo sapiens
gttggttccaactct

SEQ ID NO: 298314 - DNA, 15 bp, Homo sapiens
tgttggttccaactc

SEQ ID NO: 298315 - DNA, 15 bp, Homo sapiens
ttgttggttccaact

SEQ ID NO: 298316 - DNA, 15 bp, Homo sapiens
tttgttggttccaac

SEQ ID NO: 298317 - DNA, 15 bp, Homo sapiens
ctttgttggttccaa

SEQ ID NO: 298318 - DNA, 15 bp, Homo sapiens
actttgttggttcca

SEQ ID NO: 298319 - DNA, 15 bp, Homo sapiens
tactttgttggttcc

SEQ ID NO: 298320 - DNA, 15 bp, Homo sapiens
ttactttgttggttc

SEQ ID NO: 298321 - DNA, 15 bp, Homo sapiens
gttactttgttggtt

SEQ ID NO: 298322 - DNA, 15 bp, Homo sapiens
tgttactttgttggt

SEQ ID NO: 298323 - DNA, 15 bp, Homo sapiens
ctgttactttgttgg

SEQ ID NO: 298324 - DNA, 15 bp, Homo sapiens
cctgttactttgttg

SEQ ID NO: 298325 - DNA, 15 bp, Homo sapiens
tcctgttactttgtt

SEQ ID NO: 298326 - DNA, 15 bp, Homo sapiens
gtcctgttactttgt

SEQ ID NO: 298327 - DNA, 15 bp, Homo sapiens
agtcctgttactttg

SEQ ID NO: 298328 - DNA, 15 bp, Homo sapiens
cagtcctgttacttt

SEQ ID NO: 298329 - DNA, 15 bp, Homo sapiens
gcagtcctgttactt

SEQ ID NO: 298330 - DNA, 15 bp, Homo sapiens
ggcagtcctgttact

SEQ ID NO: 298331 - DNA, 15 bp, Homo sapiens
tggcagtcctgttac

SEQ ID NO: 298332 - DNA, 15 bp, Homo sapiens
atggcagtcctgtta

SEQ ID NO: 298333 - DNA, 15 bp, Homo sapiens
aatggcagtcctgtt

SEQ ID NO: 298334 - DNA, 15 bp, Homo sapiens
taatggcagtcctgt

SEQ ID NO: 298335 - DNA, 15 bp, Homo sapiens
ttaatggcagtcctg

SEQ ID NO: 298336 - DNA, 15 bp, Homo sapiens
cttaatggcagtcct

SEQ ID NO: 298337 - DNA, 15 bp, Homo sapiens
acttaatggcagtcc

SEQ ID NO: 298338 - DNA, 15 bp, Homo sapiens
cacttaatggcagtc

SEQ ID NO: 298339 - DNA, 15 bp, Homo sapiens
tcacttaatggcagt

SEQ ID NO: 298340 - DNA, 15 bp, Homo sapiens
atcacttaatggcag

SEQ ID NO: 298341 - DNA, 15 bp, Homo sapiens
aatcacttaatggca

SEQ ID NO: 298342 - DNA, 15 bp, Homo sapiens
aaatcacttaatggc

SEQ ID NO: 298343 - DNA, 15 bp, Homo sapiens
gaaatcacttaatgg

SEQ ID NO: 298344 - DNA, 15 bp, Homo sapiens
agaaatcacttaatg

SEQ ID NO: 298345 - DNA, 15 bp, Homo sapiens
aagaaatcacttaat

SEQ ID NO: 298346 - DNA, 15 bp, Homo sapiens
aaagaaatcacttaa

SEQ ID NO: 298347 - DNA, 15 bp, Homo sapiens
aaaagaaatcactta

SEQ ID NO: 298348 - DNA, 15 bp, Homo sapiens
caaaagaaatcactt

SEQ ID NO: 298349 - DNA, 15 bp, Homo sapiens
acaaaagaaatcact

SEQ ID NO: 298350 - DNA, 15 bp, Homo sapiens
aacaaaagaaatcac

SEQ ID NO: 298351 - DNA, 15 bp, Homo sapiens
aaacaaaagaaatca

SEQ ID NO: 298352 - DNA, 15 bp, Homo sapiens
aaaacaaaagaaatc

SEQ ID NO: 298353 - DNA, 15 bp, Homo sapiens
gaaaacaaaagaaat

SEQ ID NO: 298354 - DNA, 15 bp, Homo sapiens
aagagaaaacaaaag

SEQ ID NO: 298355 - DNA, 15 bp, Homo sapiens
aaagagaaaacaaaa

SEQ ID NO: 298356 - DNA, 15 bp, Homo sapiens
gaaagagaaaacaaa

SEQ ID NO: 298357 - DNA, 15 bp, Homo sapiens
tgaaagagaaaacaa

SEQ ID NO: 298358 - DNA, 15 bp, Homo sapiens
ctgaaagagaaaaca

SEQ ID NO: 298359 - DNA, 15 bp, Homo sapiens
gctgaaagagaaaac

SEQ ID NO: 298360 - DNA, 15 bp, Homo sapiens
tgctgaaagagaaaa

SEQ ID NO: 298361 - DNA, 15 bp, Homo sapiens
ttgctgaaagagaaa

SEQ ID NO: 298362 - DNA, 15 bp, Homo sapiens
tttgctgaaagagaa

SEQ ID NO: 298363 - DNA, 15 bp, Homo sapiens
atttgctgaaagaga

SEQ ID NO: 298364 - DNA, 15 bp, Homo sapiens
catttgctgaaagag

SEQ ID NO: 298365 - DNA, 15 bp, Homo sapiens
acatttgctgaaaga

SEQ ID NO: 298366 - DNA, 15 bp, Homo sapiens
aacatttgctgaaag

SEQ ID NO: 298367 - DNA, 15 bp, Homo sapiens
gaacatttgctgaaa

SEQ ID NO: 298368 - DNA, 15 bp, Homo sapiens
ggaacatttgctgaa

SEQ ID NO: 298369 - DNA, 15 bp, Homo sapiens
gggaacatttgctga

SEQ ID NO: 298370 - DNA, 15 bp, Homo sapiens
tgggaacatttgctg

SEQ ID NO: 298371 - DNA, 15 bp, Homo sapiens
ctgggaacatttgct

SEQ ID NO: 298372 - DNA, 15 bp, Homo sapiens
gctgggaacatttgc

SEQ ID NO: 298373 - DNA, 15 bp, Homo sapiens
tgctgggaacatttg

SEQ ID NO: 298374 - DNA, 15 bp, Homo sapiens
ctgctgggaacattt

SEQ ID NO: 298375 - DNA, 15 bp, Homo sapiens
cctgctgggaacatt

SEQ ID NO: 298376 - DNA, 15 bp, Homo sapiens
gcctgctgggaacat

SEQ ID NO: 298377 - DNA, 15 bp, Homo sapiens
ggcctgctgggaaca

SEQ ID NO: 298378 - DNA, 15 bp, Homo sapiens
tggcctgctgggaac

SEQ ID NO: 298379 - DNA, 15 bp, Homo sapiens
gtggcctgctgggaa

SEQ ID NO: 298380 - DNA, 15 bp, Homo sapiens
tgtggcctgctggga

SEQ ID NO: 298381 - DNA, 15 bp, Homo sapiens
ctgtggcctgctggg

SEQ ID NO: 298382 - DNA, 15 bp, Homo sapiens
cctgtggcctgctgg

SEQ ID NO: 298383 - DNA, 15 bp, Homo sapiens
acctgtggcctgctg

SEQ ID NO: 298384 - DNA, 15 bp, Homo sapiens
tacctgtggcctgct

SEQ ID NO: 298385 - DNA, 15 bp, Homo sapiens
ttacctgtggcctgc

SEQ ID NO: 298386 - DNA, 15 bp, Homo sapiens
cttacctgtggcctg

SEQ ID NO: 298387 - DNA, 15 bp, Homo sapiens
tcttacctgtggcct

SEQ ID NO: 298388 - DNA, 15 bp, Homo sapiens
ctcttacctgtggcc

SEQ ID NO: 298389 - DNA, 15 bp, Homo sapiens
actcttacctgtggc

SEQ ID NO: 298390 - DNA, 15 bp, Homo sapiens
aactcttacctgtgg

SEQ ID NO: 298391 - DNA, 15 bp, Homo sapiens
taactcttacctgtg

SEQ ID NO: 298392 - DNA, 15 bp, Homo sapiens
ttaactcttacctgt

SEQ ID NO: 298393 - DNA, 15 bp, Homo sapiens
attaactcttacctg

SEQ ID NO: 298394 - DNA, 15 bp, Homo sapiens
cattaactcttacct

SEQ ID NO: 298395 - DNA, 15 bp, Homo sapiens
ccattaactcttacc

SEQ ID NO: 298396 - DNA, 15 bp, Homo sapiens
gccattaactcttac

SEQ ID NO: 298397 - DNA, 15 bp, Homo sapiens
agccattaactctta

SEQ ID NO: 298398 - DNA, 15 bp, Homo sapiens
aagccattaactctt

SEQ ID NO: 298399 - DNA, 15 bp, Homo sapiens
caagccattaactct

SEQ ID NO: 298400 - DNA, 15 bp, Homo sapiens
ccaagccattaactc

SEQ ID NO: 298401 - DNA, 15 bp, Homo sapiens
accaagccattaact

SEQ ID NO: 298402 - DNA, 15 bp, Homo sapiens
aaccaagccattaac

SEQ ID NO: 298403 - DNA, 15 bp, Homo sapiens
caaccaagccattaa

SEQ ID NO: 298404 - DNA, 15 bp, Homo sapiens
ccaaccaagccatta

SEQ ID NO: 298405 - DNA, 15 bp, Homo sapiens
gccaaccaagccatt

SEQ ID NO: 298406 - DNA, 15 bp, Homo sapiens
agccaaccaagccat

SEQ ID NO: 298407 - DNA, 15 bp, Homo sapiens
gagccaaccaagcca

SEQ ID NO: 298408 - DNA, 15 bp, Homo sapiens
agagccaaccaagcc

SEQ ID NO: 298409 - DNA, 15 bp, Homo sapiens
tagagccaaccaagc

SEQ ID NO: 298410 - DNA, 15 bp, Homo sapiens
atagagccaaccaag

SEQ ID NO: 298411 - DNA, 15 bp, Homo sapiens
catagagccaaccaa

SEQ ID NO: 298412 - DNA, 15 bp, Homo sapiens
acatagagccaacca

SEQ ID NO: 298413 - DNA, 15 bp, Homo sapiens
aacatagagccaacc

SEQ ID NO: 298414 - DNA, 15 bp, Homo sapiens
taacatagagccaac

SEQ ID NO: 298415 - DNA, 15 bp, Homo sapiens
gtaacatagagccaa

SEQ ID NO: 298416 - DNA, 15 bp, Homo sapiens
agtaacatagagcca

SEQ ID NO: 298417 - DNA, 15 bp, Homo sapiens
cagtaacatagagcc

SEQ ID NO: 298418 - DNA, 15 bp, Homo sapiens
tcagtaacatagagc

SEQ ID NO: 298419 - DNA, 15 bp, Homo sapiens
atcagtaacatagag

SEQ ID NO: 298420 - DNA, 15 bp, Homo sapiens
gatcagtaacataga

SEQ ID NO: 298421 - DNA, 15 bp, Homo sapiens
ggatcagtaacatag

SEQ ID NO: 298422 - DNA, 15 bp, Homo sapiens
gggatcagtaacata

SEQ ID NO: 298423 - DNA, 15 bp, Homo sapiens
tgggatcagtaacat

SEQ ID NO: 298424 - DNA, 15 bp, Homo sapiens
ttgggatcagtaaca

SEQ ID NO: 298425 - DNA, 15 bp, Homo sapiens
gttgggatcagtaac

SEQ ID NO: 298426 - DNA, 15 bp, Homo sapiens
ggttgggatcagtaa

SEQ ID NO: 298427 - DNA, 15 bp, Homo sapiens
aggttgggatcagta

SEQ ID NO: 298428 - DNA, 15 bp, Homo sapiens
taggttgggatcagt

SEQ ID NO: 298429 - DNA, 15 bp, Homo sapiens
ctaggttgggatcag

SEQ ID NO: 298430 - DNA, 15 bp, Homo sapiens
tctaggttgggatca

SEQ ID NO: 298431 - DNA, 15 bp, Homo sapiens
ctctaggttgggatc

SEQ ID NO: 298432 - DNA, 15 bp, Homo sapiens
actctaggttgggat

SEQ ID NO: 298433 - DNA, 15 bp, Homo sapiens
tactctaggttggga

SEQ ID NO: 298434 - DNA, 15 bp, Homo sapiens
ttactctaggttggg

SEQ ID NO: 298435 - DNA, 15 bp, Homo sapiens
cttactctaggttgg

SEQ ID NO: 298436 - DNA, 15 bp, Homo sapiens
gcttactctaggttg

SEQ ID NO: 298437 - DNA, 15 bp, Homo sapiens
tgcttactctaggtt

SEQ ID NO: 298438 - DNA, 15 bp, Homo sapiens
ctgcttactctaggt

SEQ ID NO: 298439 - DNA, 15 bp, Homo sapiens
tctgcttactctagg

SEQ ID NO: 298440 - DNA, 15 bp, Homo sapiens
atctgcttactctag

SEQ ID NO: 298441 - DNA, 15 bp, Homo sapiens
aatctgcttactcta

SEQ ID NO: 298442 - DNA, 15 bp, Homo sapiens
taatctgcttactct

SEQ ID NO: 298443 - DNA, 15 bp, Homo sapiens
ataatctgcttactc

SEQ ID NO: 298444 - DNA, 15 bp, Homo sapiens
gataatctgcttact

SEQ ID NO: 298445 - DNA, 15 bp, Homo sapiens
ggataatctgcttac

SEQ ID NO: 298446 - DNA, 15 bp, Homo sapiens
tggataatctgctta

SEQ ID NO: 298447 - DNA, 15 bp, Homo sapiens
gtggataatctgctt

SEQ ID NO: 298448 - DNA, 15 bp, Homo sapiens
cgtggataatctgct

SEQ ID NO: 298449 - DNA, 15 bp, Homo sapiens
tcgtggataatctgc

SEQ ID NO: 298450 - DNA, 15 bp, Homo sapiens
gtcgtggataatctg

SEQ ID NO: 298451 - DNA, 15 bp, Homo sapiens
agtcgtggataatct

SEQ ID NO: 298452 - DNA, 15 bp, Homo sapiens
cagtcgtggataatc

SEQ ID NO: 298453 - DNA, 15 bp, Homo sapiens
tcagtcgtggataat

SEQ ID NO: 298454 - DNA, 15 bp, Homo sapiens
atcagtcgtggataa

SEQ ID NO: 298455 - DNA, 15 bp, Homo sapiens
aatcagtcgtggata

SEQ ID NO: 298456 - DNA, 15 bp, Homo sapiens
aaatcagtcgtggat

SEQ ID NO: 298457 - DNA, 15 bp, Homo sapiens
aaaatcagtcgtgga

SEQ ID NO: 298458 - DNA, 15 bp, Homo sapiens
taaaatcagtcgtgg

SEQ ID NO: 298459 - DNA, 15 bp, Homo sapiens
ataaaatcagtcgtg

SEQ ID NO: 298460 - DNA, 15 bp, Homo sapiens
aataaaatcagtcgt

SEQ ID NO: 298461 - DNA, 15 bp, Homo sapiens
gaataaaatcagtcg

SEQ ID NO: 298462 - DNA, 15 bp, Homo sapiens
ggaataaaatcagtc

SEQ ID NO: 298463 - DNA, 15 bp, Homo sapiens
aggaataaaatcagt

SEQ ID NO: 298464 - DNA, 15 bp, Homo sapiens
taggaataaaatcag

SEQ ID NO: 298465 - DNA, 15 bp, Homo sapiens
gtaggaataaaatca

SEQ ID NO: 298466 - DNA, 15 bp, Homo sapiens
agtaggaataaaatc

SEQ ID NO: 298467 - DNA, 15 bp, Homo sapiens
aagtaggaataaaat

SEQ ID NO: 298468 - DNA, 15 bp, Homo sapiens
aaagtaggaataaaa

SEQ ID NO: 298469 - DNA, 15 bp, Homo sapiens
taaagtaggaataaa

SEQ ID NO: 298470 - DNA, 15 bp, Homo sapiens
ataaagtaggaataa

SEQ ID NO: 298471 - DNA, 15 bp, Homo sapiens
aataaagtaggaata

SEQ ID NO: 298472 - DNA, 15 bp, Homo sapiens
gaataaagtaggaat

SEQ ID NO: 298473 - DNA, 15 bp, Homo sapiens
agaataaagtaggaa

SEQ ID NO: 298474 - DNA, 15 bp, Homo sapiens
gagaataaagtagga

SEQ ID NO: 298475 - DNA, 15 bp, Homo sapiens
ggagaataaagtagg

SEQ ID NO: 298476 - DNA, 15 bp, Homo sapiens
tggagaataaagtag

SEQ ID NO: 298477 - DNA, 15 bp, Homo sapiens
atggagaataaagta

SEQ ID NO: 298478 - DNA, 15 bp, Homo sapiens
catggagaataaagt

SEQ ID NO: 298479 - DNA, 15 bp, Homo sapiens
acatggagaataaag

SEQ ID NO: 298480 - DNA, 15 bp, Homo sapiens
tacatggagaataaa

SEQ ID NO: 298481 - DNA, 15 bp, Homo sapiens
ttacatggagaataa

SEQ ID NO: 298482 - DNA, 15 bp, Homo sapiens
tttacatggagaata

SEQ ID NO: 298483 - DNA, 15 bp, Homo sapiens
atttacatggagaat

SEQ ID NO: 298484 - DNA, 15 bp, Homo sapiens
tatttacatggagaa

SEQ ID NO: 298485 - DNA, 15 bp, Homo sapiens
ttatttacatggaga

SEQ ID NO: 298486 - DNA, 15 bp, Homo sapiens
cttatttacatggag

SEQ ID NO: 298487 - DNA, 15 bp, Homo sapiens
acttatttacatgga

SEQ ID NO: 298488 - DNA, 15 bp, Homo sapiens
tacttatttacatgg

SEQ ID NO: 298489 - DNA, 15 bp, Homo sapiens
ttacttatttacatg

SEQ ID NO: 298490 - DNA, 15 bp, Homo sapiens
tttacttatttacat

SEQ ID NO: 298491 - DNA, 15 bp, Homo sapiens
gtttacttatttaca

SEQ ID NO: 298492 - DNA, 15 bp, Homo sapiens
agtttacttatttac

SEQ ID NO: 298493 - DNA, 15 bp, Homo sapiens
aagtttacttattta

SEQ ID NO: 298494 - DNA, 15 bp, Homo sapiens
taagtttacttattt

SEQ ID NO: 298495 - DNA, 15 bp, Homo sapiens
gtaagtttacttatt

SEQ ID NO: 298496 - DNA, 15 bp, Homo sapiens
agtaagtttacttat

SEQ ID NO: 298497 - DNA, 15 bp, Homo sapiens
aagtaagtttactta

SEQ ID NO: 298498 - DNA, 15 bp, Homo sapiens
caagtaagtttactt

SEQ ID NO: 298499 - DNA, 15 bp, Homo sapiens
tcaagtaagtttact

SEQ ID NO: 298500 - DNA, 15 bp, Homo sapiens
gtcaagtaagtttac

SEQ ID NO: 298501 - DNA, 15 bp, Homo sapiens
tgtcaagtaagttta

SEQ ID NO: 298502 - DNA, 15 bp, Homo sapiens
atgtcaagtaagttt

SEQ ID NO: 298503 - DNA, 15 bp, Homo sapiens
aatgtcaagtaagtt

SEQ ID NO: 298504 - DNA, 15 bp, Homo sapiens
aaatgtcaagtaagt

SEQ ID NO: 298505 - DNA, 15 bp, Homo sapiens
taaatgtcaagtaag

SEQ ID NO: 298506 - DNA, 15 bp, Homo sapiens
ttaaatgtcaagtaa

SEQ ID NO: 298507 - DNA, 15 bp, Homo sapiens
tttaaatgtcaagta

SEQ ID NO: 298508 - DNA, 15 bp, Homo sapiens
atttaaatgtcaagt

SEQ ID NO: 298509 - DNA, 15 bp, Homo sapiens
catttaaatgtcaag

SEQ ID NO: 298510 - DNA, 15 bp, Homo sapiens
acatttaaatgtcaa

SEQ ID NO: 298511 - DNA, 15 bp, Homo sapiens
aacatttaaatgtca

SEQ ID NO: 298512 - DNA, 15 bp, Homo sapiens
taacatttaaatgtc

SEQ ID NO: 298513 - DNA, 15 bp, Homo sapiens
ctaacatttaaatgt

SEQ ID NO: 298514 - DNA, 15 bp, Homo sapiens
actaacatttaaatg

SEQ ID NO: 298515 - DNA, 15 bp, Homo sapiens
aactaacatttaaat

SEQ ID NO: 298516 - DNA, 15 bp, Homo sapiens
caactaacatttaaa

SEQ ID NO: 298517 - DNA, 15 bp, Homo sapiens
tcaactaacatttaa

SEQ ID NO: 298518 - DNA, 15 bp, Homo sapiens
atcaactaacattta

SEQ ID NO: 298519 - DNA, 15 bp, Homo sapiens
aatcaactaacattt

SEQ ID NO: 298520 - DNA, 15 bp, Homo sapiens
gaatcaactaacatt

SEQ ID NO: 298521 - DNA, 15 bp, Homo sapiens
agaatcaactaacat

SEQ ID NO: 298522 - DNA, 15 bp, Homo sapiens
cagaatcaactaaca

SEQ ID NO: 298523 - DNA, 15 bp, Homo sapiens
acagaatcaactaac

SEQ ID NO: 298524 - DNA, 15 bp, Homo sapiens
tacagaatcaactaa

SEQ ID NO: 298525 - DNA, 15 bp, Homo sapiens
gtacagaatcaacta

SEQ ID NO: 298526 - DNA, 15 bp, Homo sapiens
tgtacagaatcaact

SEQ ID NO: 298527 - DNA, 15 bp, Homo sapiens
ttgtacagaatcaac

SEQ ID NO: 298528 - DNA, 15 bp, Homo sapiens
gttgtacagaatcaa

SEQ ID NO: 298529 - DNA, 15 bp, Homo sapiens
tgttgtacagaatca

SEQ ID NO: 298530 - DNA, 15 bp, Homo sapiens
ctgttgtacagaatc

SEQ ID NO: 298531 - DNA, 15 bp, Homo sapiens
actgttgtacagaat

SEQ ID NO: 298532 - DNA, 15 bp, Homo sapiens
aactgttgtacagaa

SEQ ID NO: 298533 - DNA, 15 bp, Homo sapiens
aaactgttgtacaga

SEQ ID NO: 298534 - DNA, 15 bp, Homo sapiens
caaactgttgtacag

SEQ ID NO: 298535 - DNA, 15 bp, Homo sapiens
acaaactgttgtaca

SEQ ID NO: 298536 - DNA, 15 bp, Homo sapiens
gacaaactgttgtac

SEQ ID NO: 298537 - DNA, 15 bp, Homo sapiens
tgacaaactgttgta

SEQ ID NO: 298538 - DNA, 15 bp, Homo sapiens
ctgacaaactgttgt

SEQ ID NO: 298539 - DNA, 15 bp, Homo sapiens
actgacaaactgttg

SEQ ID NO: 298540 - DNA, 15 bp, Homo sapiens
gactgacaaactgtt

SEQ ID NO: 298541 - DNA, 15 bp, Homo sapiens
agactgacaaactgt

SEQ ID NO: 298542 - DNA, 15 bp, Homo sapiens
cagactgacaaactg

SEQ ID NO: 298543 - DNA, 15 bp, Homo sapiens
ccagactgacaaact

SEQ ID NO: 298544 - DNA, 15 bp, Homo sapiens
cccagactgacaaac

SEQ ID NO: 298545 - DNA, 15 bp, Homo sapiens
tcccagactgacaaa

SEQ ID NO: 298546 - DNA, 15 bp, Homo sapiens
ctcccagactgacaa

SEQ ID NO: 298547 - DNA, 15 bp, Homo sapiens
actcccagactgaca

SEQ ID NO: 298548 - DNA, 15 bp, Homo sapiens
cactcccagactgac

SEQ ID NO: 298549 - DNA, 15 bp, Homo sapiens
ccactcccagactga

SEQ ID NO: 298550 - DNA, 15 bp, Homo sapiens
cccactcccagactg

SEQ ID NO: 298551 - DNA, 15 bp, Homo sapiens
ccccactcccagact

SEQ ID NO: 298552 - DNA, 15 bp, Homo sapiens
cccccactcccagac

SEQ ID NO: 298553 - DNA, 15 bp, Homo sapiens
ccccccactcccaga

SEQ ID NO: 298554 - DNA, 15 bp, Homo sapiens
accccccactcccag

SEQ ID NO: 298555 - DNA, 15 bp, Homo sapiens
caccccccactccca

SEQ ID NO: 298556 - DNA, 15 bp, Homo sapiens
ccaccccccactccc

SEQ ID NO: 298557 - DNA, 15 bp, Homo sapiens
gccaccccccactcc

SEQ ID NO: 298558 - DNA, 15 bp, Homo sapiens
agccaccccccactc

SEQ ID NO: 298559 - DNA, 15 bp, Homo sapiens
gagccaccccccact

SEQ ID NO: 298560 - DNA, 15 bp, Homo sapiens
ggagccaccccccac

SEQ ID NO: 298561 - DNA, 15 bp, Homo sapiens
gggagccacccccca

SEQ ID NO: 298562 - DNA, 15 bp, Homo sapiens
tgggagccacccccc

SEQ ID NO: 298563 - DNA, 15 bp, Homo sapiens
ttgggagccaccccc

SEQ ID NO: 298564 - DNA, 15 bp, Homo sapiens
cttgggagccacccc

SEQ ID NO: 298565 - DNA, 15 bp, Homo sapiens
gcttgggagccaccc

SEQ ID NO: 298566 - DNA, 15 bp, Homo sapiens
ggcttgggagccacc

SEQ ID NO: 298567 - DNA, 15 bp, Homo sapiens
tggcttgggagccac

SEQ ID NO: 298568 - DNA, 15 bp, Homo sapiens
gtggcttgggagcca

SEQ ID NO: 298569 - DNA, 15 bp, Homo sapiens
tgtggcttgggagcc

SEQ ID NO: 298570 - DNA, 15 bp, Homo sapiens
ctgtggcttgggagc

SEQ ID NO: 298571 - DNA, 15 bp, Homo sapiens
tctgtggcttgggag

SEQ ID NO: 298572 - DNA, 15 bp, Homo sapiens
atctgtggcttggga

SEQ ID NO: 298573 - DNA, 15 bp, Homo sapiens
tatctgtggcttggg

SEQ ID NO: 298574 - DNA, 15 bp, Homo sapiens
gtatctgtggcttgg

SEQ ID NO: 298575 - DNA, 15 bp, Homo sapiens
ggtatctgtggcttg

SEQ ID NO: 298576 - DNA, 15 bp, Homo sapiens
tggtatctgtggctt

SEQ ID NO: 298577 - DNA, 15 bp, Homo sapiens
ttggtatctgtggct

SEQ ID NO: 298578 - DNA, 15 bp, Homo sapiens
tttggtatctgtggc

SEQ ID NO: 298579 - DNA, 15 bp, Homo sapiens
ttttggtatctgtgg

SEQ ID NO: 298580 - DNA, 15 bp, Homo sapiens
tttttggtatctgtg

SEQ ID NO: 298581 - DNA, 15 bp, Homo sapiens
atttttggtatctgt

SEQ ID NO: 298582 - DNA, 15 bp, Homo sapiens
tatttttggtatctg

SEQ ID NO: 298583 - DNA, 15 bp, Homo sapiens
gtatttttggtatct

SEQ ID NO: 298584 - DNA, 15 bp, Homo sapiens
ggtatttttggtatc

SEQ ID NO: 298585 - DNA, 15 bp, Homo sapiens
tggtatttttggtat

SEQ ID NO: 298586 - DNA, 15 bp, Homo sapiens
atggtatttttggta

SEQ ID NO: 298587 - DNA, 15 bp, Homo sapiens
catggtatttttggt

SEQ ID NO: 298588 - DNA, 15 bp, Homo sapiens
acatggtatttttgg

SEQ ID NO: 298589 - DNA, 15 bp, Homo sapiens
cacatggtatttttg

SEQ ID NO: 298590 - DNA, 15 bp, Homo sapiens
acacatggtattttt

SEQ ID NO: 298591 - DNA, 15 bp, Homo sapiens
aacacatggtatttt

SEQ ID NO: 298592 - DNA, 15 bp, Homo sapiens
aaacacatggtattt

SEQ ID NO: 298593 - DNA, 15 bp, Homo sapiens
caaacacatggtatt

SEQ ID NO: 298594 - DNA, 15 bp, Homo sapiens
tcaaacacatggtat

SEQ ID NO: 298595 - DNA, 15 bp, Homo sapiens
atcaaacacatggta

SEQ ID NO: 298596 - DNA, 15 bp, Homo sapiens
gatcaaacacatggt

SEQ ID NO: 298597 - DNA, 15 bp, Homo sapiens
ggatcaaacacatgg

SEQ ID NO: 298598 - DNA, 15 bp, Homo sapiens
aggatcaaacacatg

SEQ ID NO: 298599 - DNA, 15 bp, Homo sapiens
aaggatcaaacacat

SEQ ID NO: 298600 - DNA, 15 bp, Homo sapiens
aaaggatcaaacaca

SEQ ID NO: 298601 - DNA, 15 bp, Homo sapiens
caaaggatcaaacac

SEQ ID NO: 298602 - DNA, 15 bp, Homo sapiens
acaaaggatcaaaca

SEQ ID NO: 298603 - DNA, 15 bp, Homo sapiens
cacaaaggatcaaac

SEQ ID NO: 298604 - DNA, 15 bp, Homo sapiens
acacaaaggatcaaa

SEQ ID NO: 298605 - DNA, 15 bp, Homo sapiens
aacacaaaggatcaa

SEQ ID NO: 298606 - DNA, 15 bp, Homo sapiens
gaacacaaaggatca

SEQ ID NO: 298607 - DNA, 15 bp, Homo sapiens
agaacacaaaggatc

SEQ ID NO: 298608 - DNA, 15 bp, Homo sapiens
tagaacacaaaggat

SEQ ID NO: 298609 - DNA, 15 bp, Homo sapiens
ttagaacacaaagga

SEQ ID NO: 298610 - DNA, 15 bp, Homo sapiens
gttagaacacaaagg

SEQ ID NO: 298611 - DNA, 15 bp, Homo sapiens
tgttagaacacaaag

SEQ ID NO: 298612 - DNA, 15 bp, Homo sapiens
ctgttagaacacaaa

SEQ ID NO: 298613 - DNA, 15 bp, Homo sapiens
gctgttagaacacaa

SEQ ID NO: 298614 - DNA, 15 bp, Homo sapiens
agctgttagaacaca

SEQ ID NO: 298615 - DNA, 15 bp, Homo sapiens
aagctgttagaacac

SEQ ID NO: 298616 - DNA, 15 bp, Homo sapiens
aaagctgttagaaca

SEQ ID NO: 298617 - DNA, 15 bp, Homo sapiens
aaaagctgttagaac

SEQ ID NO: 298618 - DNA, 15 bp, Homo sapiens
aaaaagctgttagaa

SEQ ID NO: 298619 - DNA, 15 bp, Homo sapiens
taaaaagctgttaga

SEQ ID NO: 298620 - DNA, 15 bp, Homo sapiens
ttaaaaagctgttag

SEQ ID NO: 298621 - DNA, 15 bp, Homo sapiens
attaaaaagctgtta

SEQ ID NO: 298622 - DNA, 15 bp, Homo sapiens
cattaaaaagctgtt

SEQ ID NO: 298623 - DNA, 15 bp, Homo sapiens
ccattaaaaagctgt

SEQ ID NO: 298624 - DNA, 15 bp, Homo sapiens
gccattaaaaagctg

SEQ ID NO: 298625 - DNA, 15 bp, Homo sapiens
tgccattaaaaagct

SEQ ID NO: 298626 - DNA, 15 bp, Homo sapiens
atgccattaaaaagc

SEQ ID NO: 298627 - DNA, 15 bp, Homo sapiens
gatgccattaaaaag

SEQ ID NO: 298628 - DNA, 15 bp, Homo sapiens
agatgccattaaaaa

SEQ ID NO: 298629 - DNA, 15 bp, Homo sapiens
aagatgccattaaaa

SEQ ID NO: 298630 - DNA, 15 bp, Homo sapiens
taagatgccattaaa

SEQ ID NO: 298631 - DNA, 15 bp, Homo sapiens
ataagatgccattaa

SEQ ID NO: 298632 - DNA, 15 bp, Homo sapiens
cataagatgccatta

SEQ ID NO: 298633 - DNA, 15 bp, Homo sapiens
acataagatgccatt

SEQ ID NO: 298634 - DNA, 15 bp, Homo sapiens
cacataagatgccat

SEQ ID NO: 298635 - DNA, 15 bp, Homo sapiens
gcacataagatgcca

SEQ ID NO: 298636 - DNA, 15 bp, Homo sapiens
agcacataagatgcc

SEQ ID NO: 298637 - DNA, 15 bp, Homo sapiens
tagcacataagatgc

SEQ ID NO: 298638 - DNA, 15 bp, Homo sapiens
gtagcacataagatg

SEQ ID NO: 298639 - DNA, 15 bp, Homo sapiens
tgtagcacataagat

SEQ ID NO: 298640 - DNA, 15 bp, Homo sapiens
atgtagcacataaga

SEQ ID NO: 298641 - DNA, 15 bp, Homo sapiens
tatgtagcacataag

SEQ ID NO: 298642 - DNA, 15 bp, Homo sapiens
ttatgtagcacataa

SEQ ID NO: 298643 - DNA, 15 bp, Homo sapiens
tttatgtagcacata

SEQ ID NO: 298644 - DNA, 15 bp, Homo sapiens
ctttatgtagcacat

SEQ ID NO: 298645 - DNA, 15 bp, Homo sapiens
actttatgtagcaca

SEQ ID NO: 298646 - DNA, 15 bp, Homo sapiens
gactttatgtagcac

SEQ ID NO: 298647 - DNA, 15 bp, Homo sapiens
tgactttatgtagca

SEQ ID NO: 298648 - DNA, 15 bp, Homo sapiens
gtgactttatgtagc

SEQ ID NO: 298649 - DNA, 15 bp, Homo sapiens
agtgactttatgtag

SEQ ID NO: 298650 - DNA, 15 bp, Homo sapiens
gagtgactttatgta

SEQ ID NO: 298651 - DNA, 15 bp, Homo sapiens
agagtgactttatgt

SEQ ID NO: 298652 - DNA, 15 bp, Homo sapiens
tagagtgactttatg

SEQ ID NO: 298653 - DNA, 15 bp, Homo sapiens
ctagagtgactttat

SEQ ID NO: 298654 - DNA, 15 bp, Homo sapiens
tctagagtgacttta

SEQ ID NO: 298655 - DNA, 15 bp, Homo sapiens
atctagagtgacttt

SEQ ID NO: 298656 - DNA, 15 bp, Homo sapiens
tatctagagtgactt

SEQ ID NO: 298657 - DNA, 15 bp, Homo sapiens
ctatctagagtgact

SEQ ID NO: 298658 - DNA, 15 bp, Homo sapiens
tctatctagagtgac

SEQ ID NO: 298659 - DNA, 15 bp, Homo sapiens
atctatctagagtga

SEQ ID NO: 298660 - DNA, 15 bp, Homo sapiens
aatctatctagagtg

SEQ ID NO: 298661 - DNA, 15 bp, Homo sapiens
aaatctatctagagt

SEQ ID NO: 298662 - DNA, 15 bp, Homo sapiens
caaatctatctagag

SEQ ID NO: 298663 - DNA, 15 bp, Homo sapiens
tcaaatctatctaga

SEQ ID NO: 298664 - DNA, 15 bp, Homo sapiens
gtcaaatctatctag

SEQ ID NO: 298665 - DNA, 15 bp, Homo sapiens
ggtcaaatctatcta

SEQ ID NO: 298666 - DNA, 15 bp, Homo sapiens
tggtcaaatctatct

SEQ ID NO: 298667 - DNA, 15 bp, Homo sapiens
gtggtcaaatctatc

SEQ ID NO: 298668 - DNA, 15 bp, Homo sapiens
ggtggtcaaatctat

SEQ ID NO: 298669 - DNA, 15 bp, Homo sapiens
tggtggtcaaatcta

SEQ ID NO: 298670 - DNA, 15 bp, Homo sapiens
gtggtggtcaaatct

SEQ ID NO: 298671 - DNA, 15 bp, Homo sapiens
agtggtggtcaaatc

SEQ ID NO: 298672 - DNA, 15 bp, Homo sapiens
cagtggtggtcaaat

SEQ ID NO: 298673 - DNA, 15 bp, Homo sapiens
gcagtggtggtcaaa

SEQ ID NO: 298674 - DNA, 15 bp, Homo sapiens
agcagtggtggtcaa

SEQ ID NO: 298675 - DNA, 15 bp, Homo sapiens
gagcagtggtggtca

SEQ ID NO: 298676 - DNA, 15 bp, Homo sapiens
agagcagtggtggtc

SEQ ID NO: 298677 - DNA, 15 bp, Homo sapiens
gagagcagtggtggt

SEQ ID NO: 298678 - DNA, 15 bp, Homo sapiens
agagagcagtggtgg

SEQ ID NO: 298679 - DNA, 15 bp, Homo sapiens
gagagagcagtggtg

SEQ ID NO: 298680 - DNA, 15 bp, Homo sapiens
tgagagagcagtggt

SEQ ID NO: 298681 - DNA, 15 bp, Homo sapiens
ttgagagagcagtgg

SEQ ID NO: 298682 - DNA, 15 bp, Homo sapiens
tttgagagagcagtg

SEQ ID NO: 298683 - DNA, 15 bp, Homo sapiens
atttgagagagcagt

SEQ ID NO: 298684 - DNA, 15 bp, Homo sapiens
catttgagagagcag

SEQ ID NO: 298685 - DNA, 15 bp, Homo sapiens
acatttgagagagca

SEQ ID NO: 298686 - DNA, 15 bp, Homo sapiens
gacatttgagagagc

SEQ ID NO: 298687 - DNA, 15 bp, Homo sapiens
agacatttgagagag

SEQ ID NO: 298688 - DNA, 15 bp, Homo sapiens
tagacatttgagaga

SEQ ID NO: 298689 - DNA, 15 bp, Homo sapiens
gtagacatttgagag

SEQ ID NO: 298690 - DNA, 15 bp, Homo sapiens
agtagacatttgaga

SEQ ID NO: 298691 - DNA, 15 bp, Homo sapiens
aagtagacatttgag

SEQ ID NO: 298692 - DNA, 15 bp, Homo sapiens
taagtagacatttga

SEQ ID NO: 298693 - DNA, 15 bp, Homo sapiens
ttaagtagacatttg

SEQ ID NO: 298694 - DNA, 15 bp, Homo sapiens
cttaagtagacattt

SEQ ID NO: 298695 - DNA, 15 bp, Homo sapiens
ccttaagtagacatt

SEQ ID NO: 298696 - DNA, 15 bp, Homo sapiens
accttaagtagacat

SEQ ID NO: 298697 - DNA, 15 bp, Homo sapiens
caccttaagtagaca

SEQ ID NO: 298698 - DNA, 15 bp, Homo sapiens
ccaccttaagtagac

SEQ ID NO: 298699 - DNA, 15 bp, Homo sapiens
gccaccttaagtaga

SEQ ID NO: 298700 - DNA, 15 bp, Homo sapiens
agccaccttaagtag

SEQ ID NO: 298701 - DNA, 15 bp, Homo sapiens
tagccaccttaagta

SEQ ID NO: 298702 - DNA, 15 bp, Homo sapiens
atagccaccttaagt

SEQ ID NO: 298703 - DNA, 15 bp, Homo sapiens
gatagccaccttaag

SEQ ID NO: 298704 - DNA, 15 bp, Homo sapiens
tgatagccaccttaa

SEQ ID NO: 298705 - DNA, 15 bp, Homo sapiens
gtgatagccacctta

SEQ ID NO: 298706 - DNA, 15 bp, Homo sapiens
tgtgatagccacctt

SEQ ID NO: 298707 - DNA, 15 bp, Homo sapiens
ctgtgatagccacct

SEQ ID NO: 298708 - DNA, 15 bp, Homo sapiens
tctgtgatagccacc

SEQ ID NO: 298709 - DNA, 15 bp, Homo sapiens
ttctgtgatagccac

SEQ ID NO: 298710 - DNA, 15 bp, Homo sapiens
gttctgtgatagcca

SEQ ID NO: 298711 - DNA, 15 bp, Homo sapiens
tgttctgtgatagcc

SEQ ID NO: 298712 - DNA, 15 bp, Homo sapiens
atgttctgtgatagc

SEQ ID NO: 298713 - DNA, 15 bp, Homo sapiens
aatgttctgtgatag

SEQ ID NO: 298714 - DNA, 15 bp, Homo sapiens
caatgttctgtgata

SEQ ID NO: 298715 - DNA, 15 bp, Homo sapiens
tcaatgttctgtgat

SEQ ID NO: 298716 - DNA, 15 bp, Homo sapiens
gtcaatgttctgtga

SEQ ID NO: 298717 - DNA, 15 bp, Homo sapiens
ggtcaatgttctgtg

SEQ ID NO: 298718 - DNA, 15 bp, Homo sapiens
aggtcaatgttctgt

SEQ ID NO: 298719 - DNA, 15 bp, Homo sapiens
taggtcaatgttctg

SEQ ID NO: 298720 - DNA, 15 bp, Homo sapiens
ttaggtcaatgttct

SEQ ID NO: 298721 - DNA, 15 bp, Homo sapiens
tttaggtcaatgttc

SEQ ID NO: 298722 - DNA, 15 bp, Homo sapiens
ttttaggtcaatgtt

SEQ ID NO: 298723 - DNA, 15 bp, Homo sapiens
tttttaggtcaatgt

SEQ ID NO: 298724 - DNA, 15 bp, Homo sapiens
ttttttaggtcaatg

SEQ ID NO: 298725 - DNA, 15 bp, Homo sapiens
tttttttaggtcaat

SEQ ID NO: 298726 - DNA, 15 bp, Homo sapiens
ttttttttaggtcaa

SEQ ID NO: 298727 - DNA, 15 bp, Homo sapiens
tttttttttaggtca

SEQ ID NO: 298728 - DNA, 15 bp, Homo sapiens
ttttttttttaggtc

SEQ ID NO: 298729 - DNA, 15 bp, Homo sapiens
attttttttttaggt

SEQ ID NO: 298730 - DNA, 15 bp, Homo sapiens
cattttttttttagg

SEQ ID NO: 298731 - DNA, 15 bp, Homo sapiens
tcattttttttttag

SEQ ID NO: 298732 - DNA, 15 bp, Homo sapiens
gtcatttttttttta

SEQ ID NO: 298733 - DNA, 15 bp, Homo sapiens
cagtcattttttttt

SEQ ID NO: 298734 - DNA, 15 bp, Homo sapiens
ccagtcatttttttt

SEQ ID NO: 298735 - DNA, 15 bp, Homo sapiens
accagtcattttttt

SEQ ID NO: 298736 - DNA, 15 bp, Homo sapiens
taccagtcatttttt

SEQ ID NO: 298737 - DNA, 15 bp, Homo sapiens
gtaccagtcattttt

SEQ ID NO: 298738 - DNA, 15 bp, Homo sapiens
ggtaccagtcatttt

SEQ ID NO: 298739 - DNA, 15 bp, Homo sapiens
tggtaccagtcattt

SEQ ID NO: 298740 - DNA, 15 bp, Homo sapiens
gtggtaccagtcatt

SEQ ID NO: 298741 - DNA, 15 bp, Homo sapiens
tgtggtaccagtcat

SEQ ID NO: 298742 - DNA, 15 bp, Homo sapiens
ctgtggtaccagtca

SEQ ID NO: 298743 - DNA, 15 bp, Homo sapiens
tctgtggtaccagtc

SEQ ID NO: 298744 - DNA, 15 bp, Homo sapiens
ctctgtggtaccagt

SEQ ID NO: 298745 - DNA, 15 bp, Homo sapiens
cctctgtggtaccag

SEQ ID NO: 298746 - DNA, 15 bp, Homo sapiens
acctctgtggtacca

SEQ ID NO: 298747 - DNA, 15 bp, Homo sapiens
cacctctgtggtacc

SEQ ID NO: 298748 - DNA, 15 bp, Homo sapiens
ccacctctgtggtac

SEQ ID NO: 298749 - DNA, 15 bp, Homo sapiens
accacctctgtggta

SEQ ID NO: 298750 - DNA, 15 bp, Homo sapiens
aaccacctctgtggt

SEQ ID NO: 298751 - DNA, 15 bp, Homo sapiens
aaaccacctctgtgg

SEQ ID NO: 298752 - DNA, 15 bp, Homo sapiens
aaaaccacctctgtg

SEQ ID NO: 298753 - DNA, 15 bp, Homo sapiens
caaaaccacctctgt

SEQ ID NO: 298754 - DNA, 15 bp, Homo sapiens
acaaaaccacctctg

SEQ ID NO: 298755 - DNA, 15 bp, Homo sapiens
gtaacaaaaccacct

SEQ ID NO: 298756 - DNA, 15 bp, Homo sapiens
agtaacaaaaccacc

SEQ ID NO: 298757 - DNA, 15 bp, Homo sapiens
aagtaacaaaaccac

SEQ ID NO: 298758 - DNA, 15 bp, Homo sapiens
aaagtaacaaaacca

SEQ ID NO: 298759 - DNA, 15 bp, Homo sapiens
caaagtaacaaaacc

SEQ ID NO: 298760 - DNA, 15 bp, Homo sapiens
gcaaagtaacaaaac

SEQ ID NO: 298761 - DNA, 15 bp, Homo sapiens
tgcaaagtaacaaaa

SEQ ID NO: 298762 - DNA, 15 bp, Homo sapiens
ctgcaaagtaacaaa

SEQ ID NO: 298763 - DNA, 15 bp, Homo sapiens
cctgcaaagtaacaa

SEQ ID NO: 298764 - DNA, 15 bp, Homo sapiens
ccctgcaaagtaaca

SEQ ID NO: 298765 - DNA, 15 bp, Homo sapiens
cccctgcaaagtaac

SEQ ID NO: 298766 - DNA, 15 bp, Homo sapiens
tcccctgcaaagtaa

SEQ ID NO: 298767 - DNA, 15 bp, Homo sapiens
ttcccctgcaaagta

SEQ ID NO: 298768 - DNA, 15 bp, Homo sapiens
tttcccctgcaaagt

SEQ ID NO: 298769 - DNA, 15 bp, Homo sapiens
ttttcccctgcaaag

SEQ ID NO: 298770 - DNA, 15 bp, Homo sapiens
attttcccctgcaaa

SEQ ID NO: 298771 - DNA, 15 bp, Homo sapiens
tattttcccctgcaa

SEQ ID NO: 298772 - DNA, 15 bp, Homo sapiens
atattttcccctgca

SEQ ID NO: 298773 - DNA, 15 bp, Homo sapiens
aatattttcccctgc

SEQ ID NO: 298774 - DNA, 15 bp, Homo sapiens
aaatattttcccctg

SEQ ID NO: 298775 - DNA, 15 bp, Homo sapiens
gaaatattttcccct

SEQ ID NO: 298776 - DNA, 15 bp, Homo sapiens
tgaaatattttcccc

SEQ ID NO: 298777 - DNA, 15 bp, Homo sapiens
ttgaaatattttccc

SEQ ID NO: 298778 - DNA, 15 bp, Homo sapiens
attgaaatattttcc

SEQ ID NO: 298779 - DNA, 15 bp, Homo sapiens
aattgaaatattttc

SEQ ID NO: 298780 - DNA, 15 bp, Homo sapiens
aaattgaaatatttt

SEQ ID NO: 298781 - DNA, 15 bp, Homo sapiens
aaaattgaaatattt

SEQ ID NO: 298782 - DNA, 15 bp, Homo sapiens
aaaaattgaaatatt

SEQ ID NO: 298783 - DNA, 15 bp, Homo sapiens
aaaaaattgaaatat

SEQ ID NO: 298784 - DNA, 15 bp, Homo sapiens
taaaaaattgaaata

SEQ ID NO: 298785 - DNA, 15 bp, Homo sapiens
gtaaaaaattgaaat

SEQ ID NO: 298786 - DNA, 15 bp, Homo sapiens
agtaaaaaattgaaa

SEQ ID NO: 298787 - DNA, 15 bp, Homo sapiens
aagtaaaaaattgaa

SEQ ID NO: 298788 - DNA, 15 bp, Homo sapiens
taagtaaaaaattga

SEQ ID NO: 298789 - DNA, 15 bp, Homo sapiens
ttaagtaaaaaattg

SEQ ID NO: 298790 - DNA, 15 bp, Homo sapiens
tttaagtaaaaaatt

SEQ ID NO: 298791 - DNA, 15 bp, Homo sapiens
ttttaagtaaaaaat

SEQ ID NO: 298792 - DNA, 15 bp, Homo sapiens
tttttaagtaaaaaa

SEQ ID NO: 298793 - DNA, 15 bp, Homo sapiens
atttttaagtaaaaa

SEQ ID NO: 298794 - DNA, 15 bp, Homo sapiens
aatttttaagtaaaa

SEQ ID NO: 298795 - DNA, 15 bp, Homo sapiens
aaatttttaagtaaa

SEQ ID NO: 298796 - DNA, 15 bp, Homo sapiens
aaaatttttaagtaa

SEQ ID NO: 298797 - DNA, 15 bp, Homo sapiens
caaaatttttaagta

SEQ ID NO: 298798 - DNA, 15 bp, Homo sapiens
gcaaaatttttaagt

SEQ ID NO: 298799 - DNA, 15 bp, Homo sapiens
agcaaaatttttaag

SEQ ID NO: 298800 - DNA, 15 bp, Homo sapiens
cagcaaaatttttaa

SEQ ID NO: 298801 - DNA, 15 bp, Homo sapiens
tcagcaaaattttta

SEQ ID NO: 298802 - DNA, 15 bp, Homo sapiens
ctcagcaaaattttt

SEQ ID NO: 298803 - DNA, 15 bp, Homo sapiens
tctcagcaaaatttt

SEQ ID NO: 298804 - DNA, 15 bp, Homo sapiens
ttctcagcaaaattt

SEQ ID NO: 298805 - DNA, 15 bp, Homo sapiens
gttctcagcaaaatt

SEQ ID NO: 298806 - DNA, 15 bp, Homo sapiens
agttctcagcaaaat

SEQ ID NO: 298807 - DNA, 15 bp, Homo sapiens
cagttctcagcaaaa

SEQ ID NO: 298808 - DNA, 15 bp, Homo sapiens
acagttctcagcaaa

SEQ ID NO: 298809 - DNA, 15 bp, Homo sapiens
aacagttctcagcaa

SEQ ID NO: 298810 - DNA, 15 bp, Homo sapiens
caacagttctcagca

SEQ ID NO: 298811 - DNA, 15 bp, Homo sapiens
ccaacagttctcagc

SEQ ID NO: 298812 - DNA, 15 bp, Homo sapiens
gccaacagttctcag

SEQ ID NO: 298813 - DNA, 15 bp, Homo sapiens
tgccaacagttctca

SEQ ID NO: 298814 - DNA, 15 bp, Homo sapiens
ctgccaacagttctc

SEQ ID NO: 298815 - DNA, 15 bp, Homo sapiens
gctgccaacagttct

SEQ ID NO: 298816 - DNA, 15 bp, Homo sapiens
agctgccaacagttc

SEQ ID NO: 298817 - DNA, 15 bp, Homo sapiens
cagctgccaacagtt

SEQ ID NO: 298818 - DNA, 15 bp, Homo sapiens
acagctgccaacagt

SEQ ID NO: 298819 - DNA, 15 bp, Homo sapiens
tacagctgccaacag

SEQ ID NO: 298820 - DNA, 15 bp, Homo sapiens
gtacagctgccaaca

SEQ ID NO: 298821 - DNA, 15 bp, Homo sapiens
ggtacagctgccaac

SEQ ID NO: 298822 - DNA, 15 bp, Homo sapiens
gggtacagctgccaa

SEQ ID NO: 298823 - DNA, 15 bp, Homo sapiens
agggtacagctgcca

SEQ ID NO: 298824 - DNA, 15 bp, Homo sapiens
aagggtacagctgcc

SEQ ID NO: 298825 - DNA, 15 bp, Homo sapiens
taagggtacagctgc

SEQ ID NO: 298826 - DNA, 15 bp, Homo sapiens
ataagggtacagctg

SEQ ID NO: 298827 - DNA, 15 bp, Homo sapiens
cataagggtacagct

SEQ ID NO: 298828 - DNA, 15 bp, Homo sapiens
gcataagggtacagc

SEQ ID NO: 298829 - DNA, 15 bp, Homo sapiens
ggcataagggtacag

SEQ ID NO: 298830 - DNA, 15 bp, Homo sapiens
aggcataagggtaca

SEQ ID NO: 298831 - DNA, 15 bp, Homo sapiens
aaggcataagggtac

SEQ ID NO: 298832 - DNA, 15 bp, Homo sapiens
aaaggcataagggta

SEQ ID NO: 298833 - DNA, 15 bp, Homo sapiens
aaaaggcataagggt

SEQ ID NO: 298834 - DNA, 15 bp, Homo sapiens
taaaaggcataaggg

SEQ ID NO: 298835 - DNA, 15 bp, Homo sapiens
ctaaaaggcataagg

SEQ ID NO: 298836 - DNA, 15 bp, Homo sapiens
actaaaaggcataag

SEQ ID NO: 298837 - DNA, 15 bp, Homo sapiens
tactaaaaggcataa

SEQ ID NO: 298838 - DNA, 15 bp, Homo sapiens
atactaaaaggcata

SEQ ID NO: 298839 - DNA, 15 bp, Homo sapiens
aatactaaaaggcat

SEQ ID NO: 298840 - DNA, 15 bp, Homo sapiens
aaatactaaaaggca

SEQ ID NO: 298841 - DNA, 15 bp, Homo sapiens
aaaatactaaaaggc

SEQ ID NO: 298842 - DNA, 15 bp, Homo sapiens
gaaaatactaaaagg

SEQ ID NO: 298843 - DNA, 15 bp, Homo sapiens
agaaaatactaaaag

SEQ ID NO: 298844 - DNA, 15 bp, Homo sapiens
tagaaaatactaaaa

SEQ ID NO: 298845 - DNA, 15 bp, Homo sapiens
atagaaaatactaaa

SEQ ID NO: 298846 - DNA, 15 bp, Homo sapiens
tatagaaaatactaa

SEQ ID NO: 298847 - DNA, 15 bp, Homo sapiens
ttatagaaaatacta

SEQ ID NO: 298848 - DNA, 15 bp, Homo sapiens
tttatagaaaatact

SEQ ID NO: 298849 - DNA, 15 bp, Homo sapiens
gtttatagaaaatac

SEQ ID NO: 298850 - DNA, 15 bp, Homo sapiens
ggtttatagaaaata

SEQ ID NO: 298851 - DNA, 15 bp, Homo sapiens
tggtttatagaaaat

SEQ ID NO: 298852 - DNA, 15 bp, Homo sapiens
ttggtttatagaaaa

SEQ ID NO: 298853 - DNA, 15 bp, Homo sapiens
tttggtttatagaaa

SEQ ID NO: 298854 - DNA, 15 bp, Homo sapiens
ttttggtttatagaa

SEQ ID NO: 298855 - DNA, 15 bp, Homo sapiens
tttttggtttataga

SEQ ID NO: 298856 - DNA, 15 bp, Homo sapiens
ctttttggtttatag

SEQ ID NO: 298857 - DNA, 15 bp, Homo sapiens
actttttggtttata

SEQ ID NO: 298858 - DNA, 15 bp, Homo sapiens
cactttttggtttat

SEQ ID NO: 298859 - DNA, 15 bp, Homo sapiens
acactttttggttta

SEQ ID NO: 298860 - DNA, 15 bp, Homo sapiens
tacactttttggttt

SEQ ID NO: 298861 - DNA, 15 bp, Homo sapiens
atacactttttggtt

SEQ ID NO: 298862 - DNA, 15 bp, Homo sapiens
catacactttttggt

SEQ ID NO: 298863 - DNA, 15 bp, Homo sapiens
tcatacactttttgg

SEQ ID NO: 298864 - DNA, 15 bp, Homo sapiens
ctcatacactttttg

SEQ ID NO: 298865 - DNA, 15 bp, Homo sapiens
tctcatacacttttt

SEQ ID NO: 298866 - DNA, 15 bp, Homo sapiens
gtctcatacactttt

SEQ ID NO: 298867 - DNA, 15 bp, Homo sapiens
tgtctcatacacttt

SEQ ID NO: 298868 - DNA, 15 bp, Homo sapiens
ctgtctcatacactt

SEQ ID NO: 298869 - DNA, 15 bp, Homo sapiens
cctgtctcatacact

SEQ ID NO: 298870 - DNA, 15 bp, Homo sapiens
acctgtctcatacac

SEQ ID NO: 298871 - DNA, 15 bp, Homo sapiens
aacctgtctcataca

SEQ ID NO: 298872 - DNA, 15 bp, Homo sapiens
aaacctgtctcatac

SEQ ID NO: 298873 - DNA, 15 bp, Homo sapiens
taaacctgtctcata

SEQ ID NO: 298874 - DNA, 15 bp, Homo sapiens
gtaaacctgtctcat

SEQ ID NO: 298875 - DNA, 15 bp, Homo sapiens
agtaaacctgtctca

SEQ ID NO: 298876 - DNA, 15 bp, Homo sapiens
aagtaaacctgtctc

SEQ ID NO: 298877 - DNA, 15 bp, Homo sapiens
aaagtaaacctgtct

SEQ ID NO: 298878 - DNA, 15 bp, Homo sapiens
caaagtaaacctgtc

SEQ ID NO: 298879 - DNA, 15 bp, Homo sapiens
gcaaagtaaacctgt

SEQ ID NO: 298880 - DNA, 15 bp, Homo sapiens
ggcaaagtaaacctg

SEQ ID NO: 298881 - DNA, 15 bp, Homo sapiens
tggcaaagtaaacct

SEQ ID NO: 298882 - DNA, 15 bp, Homo sapiens
ttggcaaagtaaacc

SEQ ID NO: 298883 - DNA, 15 bp, Homo sapiens
cttggcaaagtaaac

SEQ ID NO: 298884 - DNA, 15 bp, Homo sapiens
ccttggcaaagtaaa

SEQ ID NO: 298885 - DNA, 15 bp, Homo sapiens
accttggcaaagtaa

SEQ ID NO: 298886 - DNA, 15 bp, Homo sapiens
aaccttggcaaagta

SEQ ID NO: 298887 - DNA, 15 bp, Homo sapiens
caaccttggcaaagt

SEQ ID NO: 298888 - DNA, 15 bp, Homo sapiens
tcaaccttggcaaag

SEQ ID NO: 298889 - DNA, 15 bp, Homo sapiens
ctcaaccttggcaaa

SEQ ID NO: 298890 - DNA, 15 bp, Homo sapiens
cctcaaccttggcaa

SEQ ID NO: 298891 - DNA, 15 bp, Homo sapiens
tcctcaaccttggca

SEQ ID NO: 298892 - DNA, 15 bp, Homo sapiens
gtcctcaaccttggc

SEQ ID NO: 298893 - DNA, 15 bp, Homo sapiens
tgtcctcaaccttgg

SEQ ID NO: 298894 - DNA, 15 bp, Homo sapiens
gtgtcctcaaccttg

SEQ ID NO: 298895 - DNA, 15 bp, Homo sapiens
tgtgtcctcaacctt

SEQ ID NO: 298896 - DNA, 15 bp, Homo sapiens
gtgtgtcctcaacct

SEQ ID NO: 298897 - DNA, 15 bp, Homo sapiens
ggtgtgtcctcaacc

SEQ ID NO: 298898 - DNA, 15 bp, Homo sapiens
aggtgtgtcctcaac

SEQ ID NO: 298899 - DNA, 15 bp, Homo sapiens
caggtgtgtcctcaa

SEQ ID NO: 298900 - DNA, 15 bp, Homo sapiens
ccaggtgtgtcctca

SEQ ID NO: 298901 - DNA, 15 bp, Homo sapiens
cccaggtgtgtcctc

SEQ ID NO: 298902 - DNA, 15 bp, Homo sapiens
tcccaggtgtgtcct

SEQ ID NO: 298903 - DNA, 15 bp, Homo sapiens
ttcccaggtgtgtcc

SEQ ID NO: 298904 - DNA, 15 bp, Homo sapiens
tttcccaggtgtgtc

SEQ ID NO: 298905 - DNA, 15 bp, Homo sapiens
ttttcccaggtgtgt

SEQ ID NO: 298906 - DNA, 15 bp, Homo sapiens
tttttcccaggtgtg

SEQ ID NO: 298907 - DNA, 15 bp, Homo sapiens
ctttttcccaggtgt

SEQ ID NO: 298908 - DNA, 15 bp, Homo sapiens
tctttttcccaggtg

SEQ ID NO: 298909 - DNA, 15 bp, Homo sapiens
ctctttttcccaggt

SEQ ID NO: 298910 - DNA, 15 bp, Homo sapiens
tctctttttcccagg

SEQ ID NO: 298911 - DNA, 15 bp, Homo sapiens
ctctctttttcccag

SEQ ID NO: 298912 - DNA, 15 bp, Homo sapiens
tctctctttttccca

SEQ ID NO: 298913 - DNA, 15 bp, Homo sapiens
atctctctttttccc

SEQ ID NO: 298914 - DNA, 15 bp, Homo sapiens
tatctctctttttcc

SEQ ID NO: 298915 - DNA, 15 bp, Homo sapiens
ttatctctctttttc

SEQ ID NO: 298916 - DNA, 15 bp, Homo sapiens
tttatctctcttttt

SEQ ID NO: 298917 - DNA, 15 bp, Homo sapiens
atttatctctctttt

SEQ ID NO: 298918 - DNA, 15 bp, Homo sapiens
aatttatctctcttt

SEQ ID NO: 298919 - DNA, 15 bp, Homo sapiens
aaatttatctctctt

SEQ ID NO: 298920 - DNA, 15 bp, Homo sapiens
gaaatttatctctct

SEQ ID NO: 298921 - DNA, 15 bp, Homo sapiens
tgaaatttatctctc

SEQ ID NO: 298922 - DNA, 15 bp, Homo sapiens
atgaaatttatctct

SEQ ID NO: 298923 - DNA, 15 bp, Homo sapiens
aatgaaatttatctc

SEQ ID NO: 298924 - DNA, 15 bp, Homo sapiens
taatgaaatttatct

SEQ ID NO: 298925 - DNA, 15 bp, Homo sapiens
ctaatgaaatttatc

SEQ ID NO: 298926 - DNA, 15 bp, Homo sapiens
cctaatgaaatttat

SEQ ID NO: 298927 - DNA, 15 bp, Homo sapiens
tcctaatgaaattta

SEQ ID NO: 298928 - DNA, 15 bp, Homo sapiens
atcctaatgaaattt

SEQ ID NO: 298929 - DNA, 15 bp, Homo sapiens
aatcctaatgaaatt

SEQ ID NO: 298930 - DNA, 15 bp, Homo sapiens
aaatcctaatgaaat

SEQ ID NO: 298931 - DNA, 15 bp, Homo sapiens
caaatcctaatgaaa

SEQ ID NO: 298932 - DNA, 15 bp, Homo sapiens
acaaatcctaatgaa

SEQ ID NO: 298933 - DNA, 15 bp, Homo sapiens
tacaaatcctaatga

SEQ ID NO: 298934 - DNA, 15 bp, Homo sapiens
ctacaaatcctaatg

SEQ ID NO: 298935 - DNA, 15 bp, Homo sapiens
gctacaaatcctaat

SEQ ID NO: 298936 - DNA, 15 bp, Homo sapiens
ggctacaaatcctaa

SEQ ID NO: 298937 - DNA, 15 bp, Homo sapiens
aggctacaaatccta

SEQ ID NO: 298938 - DNA, 15 bp, Homo sapiens
caggctacaaatcct

SEQ ID NO: 298939 - DNA, 15 bp, Homo sapiens
acaggctacaaatcc

SEQ ID NO: 298940 - DNA, 15 bp, Homo sapiens
aacaggctacaaatc

SEQ ID NO: 298941 - DNA, 15 bp, Homo sapiens
aaacaggctacaaat

SEQ ID NO: 298942 - DNA, 15 bp, Homo sapiens
aaaacaggctacaaa

SEQ ID NO: 298943 - DNA, 15 bp, Homo sapiens
caaaacaggctacaa

SEQ ID NO: 298944 - DNA, 15 bp, Homo sapiens
acaaaacaggctaca

SEQ ID NO: 298945 - DNA, 15 bp, Homo sapiens
aacaaaacaggctac

SEQ ID NO: 298946 - DNA, 15 bp, Homo sapiens
aaacaaaacaggcta

SEQ ID NO: 298947 - DNA, 15 bp, Homo sapiens
aaaacaaaacaggct

SEQ ID NO: 298948 - DNA, 15 bp, Homo sapiens
caaaacaaaacaggc

SEQ ID NO: 298949 - DNA, 15 bp, Homo sapiens
acaaaacaaaacagg

SEQ ID NO: 298950 - DNA, 15 bp, Homo sapiens
caaaaaaacaaaaca

SEQ ID NO: 298951 - DNA, 15 bp, Homo sapiens
acaaaaaaacaaaac

SEQ ID NO: 298952 - DNA, 15 bp, Homo sapiens
aacaaaaaaacaaaa

SEQ ID NO: 298953 - DNA, 15 bp, Homo sapiens
caaaacaaaaaaaca

SEQ ID NO: 298954 - DNA, 15 bp, Homo sapiens
acaaaacaaaaaaac

SEQ ID NO: 298955 - DNA, 15 bp, Homo sapiens
aacaaaacaaaaaaa

SEQ ID NO: 298956 - DNA, 15 bp, Homo sapiens
acaaaaaacaaaaca

SEQ ID NO: 298957 - DNA, 15 bp, Homo sapiens
aacaaaaaacaaaac

SEQ ID NO: 298958 - DNA, 15 bp, Homo sapiens
caaaaacaaaaaaca

SEQ ID NO: 298959 - DNA, 15 bp, Homo sapiens
acaaaaacaaaaaac

SEQ ID NO: 298960 - DNA, 15 bp, Homo sapiens
aacaaaaacaaaaaa

SEQ ID NO: 298961 - DNA, 15 bp, Homo sapiens
gaaaaaacaaaaaca

SEQ ID NO: 298962 - DNA, 15 bp, Homo sapiens
ggaaaaaacaaaaac

SEQ ID NO: 298963 - DNA, 15 bp, Homo sapiens
gggaaaaaacaaaaa

SEQ ID NO: 298964 - DNA, 15 bp, Homo sapiens
tgggaaaaaacaaaa

SEQ ID NO: 298965 - DNA, 15 bp, Homo sapiens
ttgggaaaaaacaaa

SEQ ID NO: 298966 - DNA, 15 bp, Homo sapiens
tttgggaaaaaacaa

SEQ ID NO: 298967 - DNA, 15 bp, Homo sapiens
ttttgggaaaaaaca

SEQ ID NO: 298968 - DNA, 15 bp, Homo sapiens
tttttgggaaaaaac

SEQ ID NO: 298969 - DNA, 15 bp, Homo sapiens
ctttttgggaaaaaa

SEQ ID NO: 298970 - DNA, 15 bp, Homo sapiens
cctttttgggaaaaa

SEQ ID NO: 298971 - DNA, 15 bp, Homo sapiens
tcctttttgggaaaa

SEQ ID NO: 298972 - DNA, 15 bp, Homo sapiens
atcctttttgggaaa

SEQ ID NO: 298973 - DNA, 15 bp, Homo sapiens
aatcctttttgggaa

SEQ ID NO: 298974 - DNA, 15 bp, Homo sapiens
aaatcctttttggga

SEQ ID NO: 298975 - DNA, 15 bp, Homo sapiens
aaaatcctttttggg

SEQ ID NO: 298976 - DNA, 15 bp, Homo sapiens
caaaatcctttttgg

SEQ ID NO: 298977 - DNA, 15 bp, Homo sapiens
tcaaaatcctttttg

SEQ ID NO: 298978 - DNA, 15 bp, Homo sapiens
ctcaaaatccttttt

SEQ ID NO: 298979 - DNA, 15 bp, Homo sapiens
cctcaaaatcctttt

SEQ ID NO: 298980 - DNA, 15 bp, Homo sapiens
ccctcaaaatccttt

SEQ ID NO: 298981 - DNA, 15 bp, Homo sapiens
gccctcaaaatcctt

SEQ ID NO: 298982 - DNA, 15 bp, Homo sapiens
agccctcaaaatcct

SEQ ID NO: 298983 - DNA, 15 bp, Homo sapiens
aagccctcaaaatcc

SEQ ID NO: 298984 - DNA, 15 bp, Homo sapiens
gaagccctcaaaatc

SEQ ID NO: 298985 - DNA, 15 bp, Homo sapiens
tgaagccctcaaaat

SEQ ID NO: 298986 - DNA, 15 bp, Homo sapiens
gtgaagccctcaaaa

SEQ ID NO: 298987 - DNA, 15 bp, Homo sapiens
tgtgaagccctcaaa

SEQ ID NO: 298988 - DNA, 15 bp, Homo sapiens
ctgtgaagccctcaa

SEQ ID NO: 298989 - DNA, 15 bp, Homo sapiens
tctgtgaagccctca

SEQ ID NO: 298990 - DNA, 15 bp, Homo sapiens
ttctgtgaagccctc

SEQ ID NO: 298991 - DNA, 15 bp, Homo sapiens
tttctgtgaagccct

SEQ ID NO: 298992 - DNA, 15 bp, Homo sapiens
gtttctgtgaagccc

SEQ ID NO: 298993 - DNA, 15 bp, Homo sapiens
cgtttctgtgaagcc

SEQ ID NO: 298994 - DNA, 15 bp, Homo sapiens
tcgtttctgtgaagc

SEQ ID NO: 298995 - DNA, 15 bp, Homo sapiens
ttcgtttctgtgaag

SEQ ID NO: 298996 - DNA, 15 bp, Homo sapiens
tttcgtttctgtgaa

SEQ ID NO: 298997 - DNA, 15 bp, Homo sapiens
ctttcgtttctgtga

SEQ ID NO: 298998 - DNA, 15 bp, Homo sapiens
tctttcgtttctgtg

SEQ ID NO: 298999 - DNA, 15 bp, Homo sapiens
ctctttcgtttctgt

SEQ ID NO: 299000 - DNA, 15 bp, Homo sapiens
gctctttcgtttctg

SEQ ID NO: 299001 - DNA, 15 bp, Homo sapiens
tgctctttcgtttct

SEQ ID NO: 299002 - DNA, 15 bp, Homo sapiens
ctgctctttcgtttc

SEQ ID NO: 299003 - DNA, 15 bp, Homo sapiens
cctgctctttcgttt

SEQ ID NO: 299004 - DNA, 15 bp, Homo sapiens
gcctgctctttcgtt

SEQ ID NO: 299005 - DNA, 15 bp, Homo sapiens
tgcctgctctttcgt

SEQ ID NO: 299006 - DNA, 15 bp, Homo sapiens
ctgcctgctctttcg

SEQ ID NO: 299007 - DNA, 15 bp, Homo sapiens
cctgcctgctctttc

SEQ ID NO: 299008 - DNA, 15 bp, Homo sapiens
tcctgcctgctcttt

SEQ ID NO: 299009 - DNA, 15 bp, Homo sapiens
ctcctgcctgctctt

SEQ ID NO: 299010 - DNA, 15 bp, Homo sapiens
cctcctgcctgctct

SEQ ID NO: 299011 - DNA, 15 bp, Homo sapiens
ccctcctgcctgctc

SEQ ID NO: 299012 - DNA, 15 bp, Homo sapiens
cccctcctgcctgct

SEQ ID NO: 299013 - DNA, 15 bp, Homo sapiens
ccccctcctgcctgc

SEQ ID NO: 299014 - DNA, 15 bp, Homo sapiens
accccctcctgcctg

SEQ ID NO: 299015 - DNA, 15 bp, Homo sapiens
caccccctcctgcct

SEQ ID NO: 299016 - DNA, 15 bp, Homo sapiens
ccaccccctcctgcc

SEQ ID NO: 299017 - DNA, 15 bp, Homo sapiens
tccaccccctcctgc

SEQ ID NO: 299018 - DNA, 15 bp, Homo sapiens
ctccaccccctcctg

SEQ ID NO: 299019 - DNA, 15 bp, Homo sapiens
cctccaccccctcct

SEQ ID NO: 299020 - DNA, 15 bp, Homo sapiens
tcctccaccccctcc

SEQ ID NO: 299021 - DNA, 15 bp, Homo sapiens
ttcctccaccccctc

SEQ ID NO: 299022 - DNA, 15 bp, Homo sapiens
gttcctccaccccct

SEQ ID NO: 299023 - DNA, 15 bp, Homo sapiens
tgttcctccaccccc

SEQ ID NO: 299024 - DNA, 15 bp, Homo sapiens
ctgttcctccacccc

SEQ ID NO: 299025 - DNA, 15 bp, Homo sapiens
actgttcctccaccc

SEQ ID NO: 299026 - DNA, 15 bp, Homo sapiens
gactgttcctccacc

SEQ ID NO: 299027 - DNA, 15 bp, Homo sapiens
tgactgttcctccac

SEQ ID NO: 299028 - DNA, 15 bp, Homo sapiens
ttgactgttcctcca

SEQ ID NO: 299029 - DNA, 15 bp, Homo sapiens
attgactgttcctcc

SEQ ID NO: 299030 - DNA, 15 bp, Homo sapiens
aattgactgttcctc

SEQ ID NO: 299031 - DNA, 15 bp, Homo sapiens
taattgactgttcct

SEQ ID NO: 299032 - DNA, 15 bp, Homo sapiens
ataattgactgttcc

SEQ ID NO: 299033 - DNA, 15 bp, Homo sapiens
cataattgactgttc

SEQ ID NO: 299034 - DNA, 15 bp, Homo sapiens
gcataattgactgtt

SEQ ID NO: 299035 - DNA, 15 bp, Homo sapiens
tgcataattgactgt

SEQ ID NO: 299036 - DNA, 15 bp, Homo sapiens
atgcataattgactg

SEQ ID NO: 299037 - DNA, 15 bp, Homo sapiens
aatgcataattgact

SEQ ID NO: 299038 - DNA, 15 bp, Homo sapiens
aaatgcataattgac

SEQ ID NO: 299039 - DNA, 15 bp, Homo sapiens
caaatgcataattga

SEQ ID NO: 299040 - DNA, 15 bp, Homo sapiens
acaaatgcataattg

SEQ ID NO: 299041 - DNA, 15 bp, Homo sapiens
gacaaatgcataatt

SEQ ID NO: 299042 - DNA, 15 bp, Homo sapiens
agacaaatgcataat

SEQ ID NO: 299043 - DNA, 15 bp, Homo sapiens
aagacaaatgcataa

SEQ ID NO: 299044 - DNA, 15 bp, Homo sapiens
taagacaaatgcata

SEQ ID NO: 299045 - DNA, 15 bp, Homo sapiens
ataagacaaatgcat

SEQ ID NO: 299046 - DNA, 15 bp, Homo sapiens
cataagacaaatgca

SEQ ID NO: 299047 - DNA, 15 bp, Homo sapiens
gcataagacaaatgc

SEQ ID NO: 299048 - DNA, 15 bp, Homo sapiens
agcataagacaaatg

SEQ ID NO: 299049 - DNA, 15 bp, Homo sapiens
gagcataagacaaat

SEQ ID NO: 299050 - DNA, 15 bp, Homo sapiens
tgagcataagacaaa

SEQ ID NO: 299051 - DNA, 15 bp, Homo sapiens
ctgagcataagacaa

SEQ ID NO: 299052 - DNA, 15 bp, Homo sapiens
actgagcataagaca

SEQ ID NO: 299053 - DNA, 15 bp, Homo sapiens
tactgagcataagac

SEQ ID NO: 299054 - DNA, 15 bp, Homo sapiens
ttactgagcataaga

SEQ ID NO: 299055 - DNA, 15 bp, Homo sapiens
tttactgagcataag

SEQ ID NO: 299056 - DNA, 15 bp, Homo sapiens
atttactgagcataa

SEQ ID NO: 299057 - DNA, 15 bp, Homo sapiens
gatttactgagcata

SEQ ID NO: 299058 - DNA, 15 bp, Homo sapiens
agatttactgagcat

SEQ ID NO: 299059 - DNA, 15 bp, Homo sapiens
cagatttactgagca

SEQ ID NO: 299060 - DNA, 15 bp, Homo sapiens
gcagatttactgagc

SEQ ID NO: 299061 - DNA, 15 bp, Homo sapiens
cgcagatttactgag

SEQ ID NO: 299062 - DNA, 15 bp, Homo sapiens
acgcagatttactga

SEQ ID NO: 299063 - DNA, 15 bp, Homo sapiens
aacgcagatttactg

SEQ ID NO: 299064 - DNA, 15 bp, Homo sapiens
aaacgcagatttact

SEQ ID NO: 299065 - DNA, 15 bp, Homo sapiens
aaaacgcagatttac

SEQ ID NO: 299066 - DNA, 15 bp, Homo sapiens
taaaacgcagattta

SEQ ID NO: 299067 - DNA, 15 bp, Homo sapiens
ataaaacgcagattt

SEQ ID NO: 299068 - DNA, 15 bp, Homo sapiens
tataaaacgcagatt

SEQ ID NO: 299069 - DNA, 15 bp, Homo sapiens
atataaaacgcagat

SEQ ID NO: 299070 - DNA, 15 bp, Homo sapiens
tatataaaacgcaga

SEQ ID NO: 299071 - DNA, 15 bp, Homo sapiens
ttatataaaacgcag

SEQ ID NO: 299072 - DNA, 15 bp, Homo sapiens
attatataaaacgca

SEQ ID NO: 299073 - DNA, 15 bp, Homo sapiens
aattatataaaacgc

SEQ ID NO: 299074 - DNA, 15 bp, Homo sapiens
taattatataaaacg

SEQ ID NO: 299075 - DNA, 15 bp, Homo sapiens
ttaattatataaaac

SEQ ID NO: 299076 - DNA, 15 bp, Homo sapiens
cttaattatataaaa

SEQ ID NO: 299077 - DNA, 15 bp, Homo sapiens
tcttaattatataaa

SEQ ID NO: 299078 - DNA, 15 bp, Homo sapiens
atcttaattatataa

SEQ ID NO: 299079 - DNA, 15 bp, Homo sapiens
tatcttaattatata

SEQ ID NO: 299080 - DNA, 15 bp, Homo sapiens
ttatcttaattatat

SEQ ID NO: 299081 - DNA, 15 bp, Homo sapiens
cttatcttaattata

SEQ ID NO: 299082 - DNA, 15 bp, Homo sapiens
ccttatcttaattat

SEQ ID NO: 299083 - DNA, 15 bp, Homo sapiens
accttatcttaatta

SEQ ID NO: 299084 - DNA, 15 bp, Homo sapiens
taccttatcttaatt

SEQ ID NO: 299085 - DNA, 15 bp, Homo sapiens
ataccttatcttaat

SEQ ID NO: 299086 - DNA, 15 bp, Homo sapiens
cataccttatcttaa

SEQ ID NO: 299087 - DNA, 15 bp, Homo sapiens
gcataccttatctta

SEQ ID NO: 299088 - DNA, 15 bp, Homo sapiens
ggcataccttatctt

SEQ ID NO: 299089 - DNA, 15 bp, Homo sapiens
aggcataccttatct

SEQ ID NO: 299090 - DNA, 15 bp, Homo sapiens
taggcataccttatc

SEQ ID NO: 299091 - DNA, 15 bp, Homo sapiens
ctaggcataccttat

SEQ ID NO: 299092 - DNA, 15 bp, Homo sapiens
tctaggcatacctta

SEQ ID NO: 299093 - DNA, 15 bp, Homo sapiens
ctctaggcatacctt

SEQ ID NO: 299094 - DNA, 15 bp, Homo sapiens
actctaggcatacct

SEQ ID NO: 299095 - DNA, 15 bp, Homo sapiens
tactctaggcatacc

SEQ ID NO: 299096 - DNA, 15 bp, Homo sapiens
ctactctaggcatac

SEQ ID NO: 299097 - DNA, 15 bp, Homo sapiens
tctactctaggcata

SEQ ID NO: 299098 - DNA, 15 bp, Homo sapiens
ttctactctaggcat

SEQ ID NO: 299099 - DNA, 15 bp, Homo sapiens
cttctactctaggca

SEQ ID NO: 299100 - DNA, 15 bp, Homo sapiens
tcttctactctaggc

SEQ ID NO: 299101 - DNA, 15 bp, Homo sapiens
ttcttctactctagg

SEQ ID NO: 299102 - DNA, 15 bp, Homo sapiens
cttcttctactctag

SEQ ID NO: 299103 - DNA, 15 bp, Homo sapiens
gcttcttctactcta

SEQ ID NO: 299104 - DNA, 15 bp, Homo sapiens
tgcttcttctactct

SEQ ID NO: 299105 - DNA, 15 bp, Homo sapiens
ctgcttcttctactc

SEQ ID NO: 299106 - DNA, 15 bp, Homo sapiens
actgcttcttctact

SEQ ID NO: 299107 - DNA, 15 bp, Homo sapiens
gactgcttcttctac

SEQ ID NO: 299108 - DNA, 15 bp, Homo sapiens
tgactgcttcttcta

SEQ ID NO: 299109 - DNA, 15 bp, Homo sapiens
ttgactgcttcttct

SEQ ID NO: 299110 - DNA, 15 bp, Homo sapiens
cttgactgcttcttc

SEQ ID NO: 299111 - DNA, 15 bp, Homo sapiens
acttgactgcttctt

SEQ ID NO: 299112 - DNA, 15 bp, Homo sapiens
tacttgactgcttct

SEQ ID NO: 299113 - DNA, 15 bp, Homo sapiens
gtacttgactgcttc

SEQ ID NO: 299114 - DNA, 15 bp, Homo sapiens
tgtacttgactgctt

SEQ ID NO: 299115 - DNA, 15 bp, Homo sapiens
gtgtacttgactgct

SEQ ID NO: 299116 - DNA, 15 bp, Homo sapiens
tgtgtacttgactgc

SEQ ID NO: 299117 - DNA, 15 bp, Homo sapiens
atgtgtacttgactg

SEQ ID NO: 299118 - DNA, 15 bp, Homo sapiens
aatgtgtacttgact

SEQ ID NO: 299119 - DNA, 15 bp, Homo sapiens
aaatgtgtacttgac

SEQ ID NO: 299120 - DNA, 15 bp, Homo sapiens
aaaatgtgtacttga

SEQ ID NO: 299121 - DNA, 15 bp, Homo sapiens
aaaaatgtgtacttg

SEQ ID NO: 299122 - DNA, 15 bp, Homo sapiens
gaaaaatgtgtactt

SEQ ID NO: 299123 - DNA, 15 bp, Homo sapiens
agaaaaatgtgtact

SEQ ID NO: 299124 - DNA, 15 bp, Homo sapiens
gagaaaaatgtgtac

SEQ ID NO: 299125 - DNA, 15 bp, Homo sapiens
tgagaaaaatgtgta

SEQ ID NO: 299126 - DNA, 15 bp, Homo sapiens
ctgagaaaaatgtgt

SEQ ID NO: 299127 - DNA, 15 bp, Homo sapiens
cctgagaaaaatgtg

SEQ ID NO: 299128 - DNA, 15 bp, Homo sapiens
ccctgagaaaaatgt

SEQ ID NO: 299129 - DNA, 15 bp, Homo sapiens
accctgagaaaaatg

SEQ ID NO: 299130 - DNA, 15 bp, Homo sapiens
caccctgagaaaaat

SEQ ID NO: 299131 - DNA, 15 bp, Homo sapiens
ccaccctgagaaaaa

SEQ ID NO: 299132 - DNA, 15 bp, Homo sapiens
cccaccctgagaaaa

SEQ ID NO: 299133 - DNA, 15 bp, Homo sapiens
tcccaccctgagaaa

SEQ ID NO: 299134 - DNA, 15 bp, Homo sapiens
ctcccaccctgagaa

SEQ ID NO: 299135 - DNA, 15 bp, Homo sapiens
cctcccaccctgaga

SEQ ID NO: 299136 - DNA, 15 bp, Homo sapiens
tcctcccaccctgag

SEQ ID NO: 299137 - DNA, 15 bp, Homo sapiens
ctcctcccaccctga

SEQ ID NO: 299138 - DNA, 15 bp, Homo sapiens
tctcctcccaccctg

SEQ ID NO: 299139 - DNA, 15 bp, Homo sapiens
ctctcctcccaccct

SEQ ID NO: 299140 - DNA, 15 bp, Homo sapiens
tctctcctcccaccc

SEQ ID NO: 299141 - DNA, 15 bp, Homo sapiens
atctctcctcccacc

SEQ ID NO: 299142 - DNA, 15 bp, Homo sapiens
catctctcctcccac

SEQ ID NO: 299143 - DNA, 15 bp, Homo sapiens
tcatctctcctccca

SEQ ID NO: 299144 - DNA, 15 bp, Homo sapiens
gtcatctctcctccc

SEQ ID NO: 299145 - DNA, 15 bp, Homo sapiens
agtcatctctcctcc

SEQ ID NO: 299146 - DNA, 15 bp, Homo sapiens
aagtcatctctcctc

SEQ ID NO: 299147 - DNA, 15 bp, Homo sapiens
gaagtcatctctcct

SEQ ID NO: 299148 - DNA, 15 bp, Homo sapiens
agaagtcatctctcc

SEQ ID NO: 299149 - DNA, 15 bp, Homo sapiens
tagaagtcatctctc

SEQ ID NO: 299150 - DNA, 15 bp, Homo sapiens
ctagaagtcatctct

SEQ ID NO: 299151 - DNA, 15 bp, Homo sapiens
actagaagtcatctc

SEQ ID NO: 299152 - DNA, 15 bp, Homo sapiens
gactagaagtcatct

SEQ ID NO: 299153 - DNA, 15 bp, Homo sapiens
ggactagaagtcatc

SEQ ID NO: 299154 - DNA, 15 bp, Homo sapiens
aggactagaagtcat

SEQ ID NO: 299155 - DNA, 15 bp, Homo sapiens
caggactagaagtca

SEQ ID NO: 299156 - DNA, 15 bp, Homo sapiens
gcaggactagaagtc

SEQ ID NO: 299157 - DNA, 15 bp, Homo sapiens
ggcaggactagaagt

SEQ ID NO: 299158 - DNA, 15 bp, Homo sapiens
aggcaggactagaag

SEQ ID NO: 299159 - DNA, 15 bp, Homo sapiens
aaggcaggactagaa

SEQ ID NO: 299160 - DNA, 15 bp, Homo sapiens
aaaggcaggactaga

SEQ ID NO: 299161 - DNA, 15 bp, Homo sapiens
caaaggcaggactag

SEQ ID NO: 299162 - DNA, 15 bp, Homo sapiens
acaaaggcaggacta

SEQ ID NO: 299163 - DNA, 15 bp, Homo sapiens
gacaaaggcaggact

SEQ ID NO: 299164 - DNA, 15 bp, Homo sapiens
ggacaaaggcaggac

SEQ ID NO: 299165 - DNA, 15 bp, Homo sapiens
aggacaaaggcagga

SEQ ID NO: 299166 - DNA, 15 bp, Homo sapiens
caggacaaaggcagg

SEQ ID NO: 299167 - DNA, 15 bp, Homo sapiens
acaggacaaaggcag

SEQ ID NO: 299168 - DNA, 15 bp, Homo sapiens
tacaggacaaaggca

SEQ ID NO: 299169 - DNA, 15 bp, Homo sapiens
ttacaggacaaaggc

SEQ ID NO: 299170 - DNA, 15 bp, Homo sapiens
tttacaggacaaagg

SEQ ID NO: 299171 - DNA, 15 bp, Homo sapiens
ctttacaggacaaag

SEQ ID NO: 299172 - DNA, 15 bp, Homo sapiens
tctttacaggacaaa

SEQ ID NO: 299173 - DNA, 15 bp, Homo sapiens
atctttacaggacaa

SEQ ID NO: 299174 - DNA, 15 bp, Homo sapiens
tatctttacaggaca

SEQ ID NO: 299175 - DNA, 15 bp, Homo sapiens
ttatctttacaggac

SEQ ID NO: 299176 - DNA, 15 bp, Homo sapiens
cttatctttacagga

SEQ ID NO: 299177 - DNA, 15 bp, Homo sapiens
gcttatctttacagg

SEQ ID NO: 299178 - DNA, 15 bp, Homo sapiens
agcttatctttacag

SEQ ID NO: 299179 - DNA, 15 bp, Homo sapiens
cagcttatctttaca

SEQ ID NO: 299180 - DNA, 15 bp, Homo sapiens
acagcttatctttac

SEQ ID NO: 299181 - DNA, 15 bp, Homo sapiens
aacagcttatcttta

SEQ ID NO: 299182 - DNA, 15 bp, Homo sapiens
taacagcttatcttt

SEQ ID NO: 299183 - DNA, 15 bp, Homo sapiens
ttaacagcttatctt

SEQ ID NO: 299184 - DNA, 15 bp, Homo sapiens
attaacagcttatct

SEQ ID NO: 299185 - DNA, 15 bp, Homo sapiens
aattaacagcttatc

SEQ ID NO: 299186 - DNA, 15 bp, Homo sapiens
gaattaacagcttat

SEQ ID NO: 299187 - DNA, 15 bp, Homo sapiens
tgaattaacagctta

SEQ ID NO: 299188 - DNA, 15 bp, Homo sapiens
gtgaattaacagctt

SEQ ID NO: 299189 - DNA, 15 bp, Homo sapiens
tgtgaattaacagct

SEQ ID NO: 299190 - DNA, 15 bp, Homo sapiens
atgtgaattaacagc

SEQ ID NO: 299191 - DNA, 15 bp, Homo sapiens
aatgtgaattaacag

SEQ ID NO: 299192 - DNA, 15 bp, Homo sapiens
caatgtgaattaaca

SEQ ID NO: 299193 - DNA, 15 bp, Homo sapiens
acaatgtgaattaac

SEQ ID NO: 299194 - DNA, 15 bp, Homo sapiens
gacaatgtgaattaa

SEQ ID NO: 299195 - DNA, 15 bp, Homo sapiens
tgacaatgtgaatta

SEQ ID NO: 299196 - DNA, 15 bp, Homo sapiens
ctgacaatgtgaatt

SEQ ID NO: 299197 - DNA, 15 bp, Homo sapiens
cctgacaatgtgaat

SEQ ID NO: 299198 - DNA, 15 bp, Homo sapiens
ccctgacaatgtgaa

SEQ ID NO: 299199 - DNA, 15 bp, Homo sapiens
accctgacaatgtga

SEQ ID NO: 299200 - DNA, 15 bp, Homo sapiens
caccctgacaatgtg

SEQ ID NO: 299201 - DNA, 15 bp, Homo sapiens
tcaccctgacaatgt

SEQ ID NO: 299202 - DNA, 15 bp, Homo sapiens
ttcaccctgacaatg

SEQ ID NO: 299203 - DNA, 15 bp, Homo sapiens
tttcaccctgacaat

SEQ ID NO: 299204 - DNA, 15 bp, Homo sapiens
atttcaccctgacaa

SEQ ID NO: 299205 - DNA, 15 bp, Homo sapiens
aatttcaccctgaca

SEQ ID NO: 299206 - DNA, 15 bp, Homo sapiens
gaatttcaccctgac

SEQ ID NO: 299207 - DNA, 15 bp, Homo sapiens
tgaatttcaccctga

SEQ ID NO: 299208 - DNA, 15 bp, Homo sapiens
ttgaatttcaccctg

SEQ ID NO: 299209 - DNA, 15 bp, Homo sapiens
gttgaatttcaccct

SEQ ID NO: 299210 - DNA, 15 bp, Homo sapiens
tgttgaatttcaccc

SEQ ID NO: 299211 - DNA, 15 bp, Homo sapiens
ttgttgaatttcacc

SEQ ID NO: 299212 - DNA, 15 bp, Homo sapiens
tttgttgaatttcac

SEQ ID NO: 299213 - DNA, 15 bp, Homo sapiens
ttttgttgaatttca

SEQ ID NO: 299214 - DNA, 15 bp, Homo sapiens
gttttgttgaatttc

SEQ ID NO: 299215 - DNA, 15 bp, Homo sapiens
agttttgttgaattt

SEQ ID NO: 299216 - DNA, 15 bp, Homo sapiens
gagttttgttgaatt

SEQ ID NO: 299217 - DNA, 15 bp, Homo sapiens
agagttttgttgaat

SEQ ID NO: 299218 - DNA, 15 bp, Homo sapiens
cagagttttgttgaa

SEQ ID NO: 299219 - DNA, 15 bp, Homo sapiens
acagagttttgttga

SEQ ID NO: 299220 - DNA, 15 bp, Homo sapiens
aacagagttttgttg

SEQ ID NO: 299221 - DNA, 15 bp, Homo sapiens
aaacagagttttgtt

SEQ ID NO: 299222 - DNA, 15 bp, Homo sapiens
aaaacagagttttgt

SEQ ID NO: 299223 - DNA, 15 bp, Homo sapiens
taaaacagagttttg

SEQ ID NO: 299224 - DNA, 15 bp, Homo sapiens
ctaaaacagagtttt

SEQ ID NO: 299225 - DNA, 15 bp, Homo sapiens
cctaaaacagagttt

SEQ ID NO: 299226 - DNA, 15 bp, Homo sapiens
ccctaaaacagagtt

SEQ ID NO: 299227 - DNA, 15 bp, Homo sapiens
accctaaaacagagt

SEQ ID NO: 299228 - DNA, 15 bp, Homo sapiens
taccctaaaacagag

SEQ ID NO: 299229 - DNA, 15 bp, Homo sapiens
ttaccctaaaacaga

SEQ ID NO: 299230 - DNA, 15 bp, Homo sapiens
tttaccctaaaacag

SEQ ID NO: 299231 - DNA, 15 bp, Homo sapiens
ctttaccctaaaaca

SEQ ID NO: 299232 - DNA, 15 bp, Homo sapiens
tctttaccctaaaac

SEQ ID NO: 299233 - DNA, 15 bp, Homo sapiens
atctttaccctaaaa

SEQ ID NO: 299234 - DNA, 15 bp, Homo sapiens
aatctttaccctaaa

SEQ ID NO: 299235 - DNA, 15 bp, Homo sapiens
aaatctttaccctaa

SEQ ID NO: 299236 - DNA, 15 bp, Homo sapiens
caaatctttacccta

SEQ ID NO: 299237 - DNA, 15 bp, Homo sapiens
ccaaatctttaccct

SEQ ID NO: 299238 - DNA, 15 bp, Homo sapiens
cccaaatctttaccc

SEQ ID NO: 299239 - DNA, 15 bp, Homo sapiens
ccccaaatctttacc

SEQ ID NO: 299240 - DNA, 15 bp, Homo sapiens
tccccaaatctttac

SEQ ID NO: 299241 - DNA, 15 bp, Homo sapiens
gtccccaaatcttta

SEQ ID NO: 299242 - DNA, 15 bp, Homo sapiens
ggtccccaaatcttt

SEQ ID NO: 299243 - DNA, 15 bp, Homo sapiens
gggtccccaaatctt

SEQ ID NO: 299244 - DNA, 15 bp, Homo sapiens
agggtccccaaatct

SEQ ID NO: 299245 - DNA, 15 bp, Homo sapiens
aagggtccccaaatc

SEQ ID NO: 299246 - DNA, 15 bp, Homo sapiens
taagggtccccaaat

SEQ ID NO: 299247 - DNA, 15 bp, Homo sapiens
ctaagggtccccaaa

SEQ ID NO: 299248 - DNA, 15 bp, Homo sapiens
tctaagggtccccaa

SEQ ID NO: 299249 - DNA, 15 bp, Homo sapiens
ttctaagggtcccca

SEQ ID NO: 299250 - DNA, 15 bp, Homo sapiens
tttctaagggtcccc

SEQ ID NO: 299251 - DNA, 15 bp, Homo sapiens
atttctaagggtccc

SEQ ID NO: 299252 - DNA, 15 bp, Homo sapiens
aatttctaagggtcc

SEQ ID NO: 299253 - DNA, 15 bp, Homo sapiens
aaatttctaagggtc

SEQ ID NO: 299254 - DNA, 15 bp, Homo sapiens
gaaatttctaagggt

SEQ ID NO: 299255 - DNA, 15 bp, Homo sapiens
ggaaatttctaaggg

SEQ ID NO: 299256 - DNA, 15 bp, Homo sapiens
aggaaatttctaagg

SEQ ID NO: 299257 - DNA, 15 bp, Homo sapiens
caaggaaatttctaa

SEQ ID NO: 299258 - DNA, 15 bp, Homo sapiens
acaaggaaatttcta

SEQ ID NO: 299259 - DNA, 15 bp, Homo sapiens
cacaaggaaatttct

SEQ ID NO: 299260 - DNA, 15 bp, Homo sapiens
tcacaaggaaatttc

SEQ ID NO: 299261 - DNA, 15 bp, Homo sapiens
ctcacaaggaaattt

SEQ ID NO: 299262 - DNA, 15 bp, Homo sapiens
gctcacaaggaaatt

SEQ ID NO: 299263 - DNA, 15 bp, Homo sapiens
tgctcacaaggaaat

SEQ ID NO: 299264 - DNA, 15 bp, Homo sapiens
ttgctcacaaggaaa

SEQ ID NO: 299265 - DNA, 15 bp, Homo sapiens
attgctcacaaggaa

SEQ ID NO: 299266 - DNA, 15 bp, Homo sapiens
aattgctcacaagga

SEQ ID NO: 299267 - DNA, 15 bp, Homo sapiens
aaattgctcacaagg

SEQ ID NO: 299268 - DNA, 15 bp, Homo sapiens
caaattgctcacaag

SEQ ID NO: 299269 - DNA, 15 bp, Homo sapiens
acaaattgctcacaa

SEQ ID NO: 299270 - DNA, 15 bp, Homo sapiens
cacaaattgctcaca

SEQ ID NO: 299271 - DNA, 15 bp, Homo sapiens
tcacaaattgctcac

SEQ ID NO: 299272 - DNA, 15 bp, Homo sapiens
ctcacaaattgctca

SEQ ID NO: 299273 - DNA, 15 bp, Homo sapiens
cctcacaaattgctc

SEQ ID NO: 299274 - DNA, 15 bp, Homo sapiens
ccctcacaaattgct

SEQ ID NO: 299275 - DNA, 15 bp, Homo sapiens
tccctcacaaattgc

SEQ ID NO: 299276 - DNA, 15 bp, Homo sapiens
ctccctcacaaattg

SEQ ID NO: 299277 - DNA, 15 bp, Homo sapiens
cctccctcacaaatt

SEQ ID NO: 299278 - DNA, 15 bp, Homo sapiens
acctccctcacaaat

SEQ ID NO: 299279 - DNA, 15 bp, Homo sapiens
gacctccctcacaaa

SEQ ID NO: 299280 - DNA, 15 bp, Homo sapiens
tgacctccctcacaa

SEQ ID NO: 299281 - DNA, 15 bp, Homo sapiens
gtgacctccctcaca

SEQ ID NO: 299282 - DNA, 15 bp, Homo sapiens
agtgacctccctcac

SEQ ID NO: 299283 - DNA, 15 bp, Homo sapiens
cagtgacctccctca

SEQ ID NO: 299284 - DNA, 15 bp, Homo sapiens
ccagtgacctccctc

SEQ ID NO: 299285 - DNA, 15 bp, Homo sapiens
gccagtgacctccct

SEQ ID NO: 299286 - DNA, 15 bp, Homo sapiens
ggccagtgacctccc

SEQ ID NO: 299287 - DNA, 15 bp, Homo sapiens
aggccagtgacctcc

SEQ ID NO: 299288 - DNA, 15 bp, Homo sapiens
aaggccagtgacctc

SEQ ID NO: 299289 - DNA, 15 bp, Homo sapiens
gaaggccagtgacct

SEQ ID NO: 299290 - DNA, 15 bp, Homo sapiens
agaaggccagtgacc

SEQ ID NO: 299291 - DNA, 15 bp, Homo sapiens
tagaaggccagtgac

SEQ ID NO: 299292 - DNA, 15 bp, Homo sapiens
atagaaggccagtga

SEQ ID NO: 299293 - DNA, 15 bp, Homo sapiens
gatagaaggccagtg

SEQ ID NO: 299294 - DNA, 15 bp, Homo sapiens
agatagaaggccagt

SEQ ID NO: 299295 - DNA, 15 bp, Homo sapiens
aagatagaaggccag

SEQ ID NO: 299296 - DNA, 15 bp, Homo sapiens
aaagatagaaggcca

SEQ ID NO: 299297 - DNA, 15 bp, Homo sapiens
caaagatagaaggcc

SEQ ID NO: 299298 - DNA, 15 bp, Homo sapiens
gcaaagatagaaggc

SEQ ID NO: 299299 - DNA, 15 bp, Homo sapiens
tgcaaagatagaagg

SEQ ID NO: 299300 - DNA, 15 bp, Homo sapiens
ttgcaaagatagaag

SEQ ID NO: 299301 - DNA, 15 bp, Homo sapiens
cttgcaaagatagaa

SEQ ID NO: 299302 - DNA, 15 bp, Homo sapiens
acttgcaaagataga

SEQ ID NO: 299303 - DNA, 15 bp, Homo sapiens
tacttgcaaagatag

SEQ ID NO: 299304 - DNA, 15 bp, Homo sapiens
ctacttgcaaagata

SEQ ID NO: 299305 - DNA, 15 bp, Homo sapiens
gctacttgcaaagat

SEQ ID NO: 299306 - DNA, 15 bp, Homo sapiens
agctacttgcaaaga

SEQ ID NO: 299307 - DNA, 15 bp, Homo sapiens
cagctacttgcaaag

SEQ ID NO: 299308 - DNA, 15 bp, Homo sapiens
gcagctacttgcaaa

SEQ ID NO: 299309 - DNA, 15 bp, Homo sapiens
agcagctacttgcaa

SEQ ID NO: 299310 - DNA, 15 bp, Homo sapiens
aagcagctacttgca

SEQ ID NO: 299311 - DNA, 15 bp, Homo sapiens
taagcagctacttgc

SEQ ID NO: 299312 - DNA, 15 bp, Homo sapiens
ctaagcagctacttg

SEQ ID NO: 299313 - DNA, 15 bp, Homo sapiens
cctaagcagctactt

SEQ ID NO: 299314 - DNA, 15 bp, Homo sapiens
tcctaagcagctact

SEQ ID NO: 299315 - DNA, 15 bp, Homo sapiens
ttcctaagcagctac

SEQ ID NO: 299316 - DNA, 15 bp, Homo sapiens
cttcctaagcagcta

SEQ ID NO: 299317 - DNA, 15 bp, Homo sapiens
ccttcctaagcagct

SEQ ID NO: 299318 - DNA, 15 bp, Homo sapiens
accttcctaagcagc

SEQ ID NO: 299319 - DNA, 15 bp, Homo sapiens
taccttcctaagcag

SEQ ID NO: 299320 - DNA, 15 bp, Homo sapiens
ctaccttcctaagca

SEQ ID NO: 299321 - DNA, 15 bp, Homo sapiens
actaccttcctaagc

SEQ ID NO: 299322 - DNA, 15 bp, Homo sapiens
aactaccttcctaag

SEQ ID NO: 299323 - DNA, 15 bp, Homo sapiens
aaactaccttcctaa

SEQ ID NO: 299324 - DNA, 15 bp, Homo sapiens
aaaactaccttccta

SEQ ID NO: 299325 - DNA, 15 bp, Homo sapiens
aaaaactaccttcct

SEQ ID NO: 299326 - DNA, 15 bp, Homo sapiens
caaaaactaccttcc

SEQ ID NO: 299327 - DNA, 15 bp, Homo sapiens
acaaaaactaccttc

SEQ ID NO: 299328 - DNA, 15 bp, Homo sapiens
cacaaaaactacctt

SEQ ID NO: 299329 - DNA, 15 bp, Homo sapiens
acacaaaaactacct

SEQ ID NO: 299330 - DNA, 15 bp, Homo sapiens
cacacaaaaactacc

SEQ ID NO: 299331 - DNA, 15 bp, Homo sapiens
tcacacaaaaactac

SEQ ID NO: 299332 - DNA, 15 bp, Homo sapiens
gtcacacaaaaacta

SEQ ID NO: 299333 - DNA, 15 bp, Homo sapiens
agtcacacaaaaact

SEQ ID NO: 299334 - DNA, 15 bp, Homo sapiens
gagtcacacaaaaac

SEQ ID NO: 299335 - DNA, 15 bp, Homo sapiens
tgagtcacacaaaaa

SEQ ID NO: 299336 - DNA, 15 bp, Homo sapiens
ctgagtcacacaaaa

SEQ ID NO: 299337 - DNA, 15 bp, Homo sapiens
actgagtcacacaaa

SEQ ID NO: 299338 - DNA, 15 bp, Homo sapiens
aactgagtcacacaa

SEQ ID NO: 299339 - DNA, 15 bp, Homo sapiens
gaactgagtcacaca

SEQ ID NO: 299340 - DNA, 15 bp, Homo sapiens
ggaactgagtcacac

SEQ ID NO: 299341 - DNA, 15 bp, Homo sapiens
gggaactgagtcaca

SEQ ID NO: 299342 - DNA, 15 bp, Homo sapiens
tgggaactgagtcac

SEQ ID NO: 299343 - DNA, 15 bp, Homo sapiens
gtgggaactgagtca

SEQ ID NO: 299344 - DNA, 15 bp, Homo sapiens
agtgggaactgagtc

SEQ ID NO: 299345 - DNA, 15 bp, Homo sapiens
aagtgggaactgagt

SEQ ID NO: 299346 - DNA, 15 bp, Homo sapiens
aaagtgggaactgag

SEQ ID NO: 299347 - DNA, 15 bp, Homo sapiens
aaaagtgggaactga

SEQ ID NO: 299348 - DNA, 15 bp, Homo sapiens
taaaagtgggaactg

SEQ ID NO: 299349 - DNA, 15 bp, Homo sapiens
ttaaaagtgggaact

SEQ ID NO: 299350 - DNA, 15 bp, Homo sapiens
attaaaagtgggaac

SEQ ID NO: 299351 - DNA, 15 bp, Homo sapiens
aattaaaagtgggaa

SEQ ID NO: 299352 - DNA, 15 bp, Homo sapiens
aaattaaaagtggga

SEQ ID NO: 299353 - DNA, 15 bp, Homo sapiens
aaaattaaaagtggg

SEQ ID NO: 299354 - DNA, 15 bp, Homo sapiens
aaaaattaaaagtgg

SEQ ID NO: 299355 - DNA, 15 bp, Homo sapiens
gaaaaattaaaagtg

SEQ ID NO: 299356 - DNA, 15 bp, Homo sapiens
ggaaaaattaaaagt

SEQ ID NO: 299357 - DNA, 15 bp, Homo sapiens
gggaaaaattaaaag

SEQ ID NO: 299358 - DNA, 15 bp, Homo sapiens
agggaaaaattaaaa

SEQ ID NO: 299359 - DNA, 15 bp, Homo sapiens
aagggaaaaattaaa

SEQ ID NO: 299360 - DNA, 15 bp, Homo sapiens
aaagggaaaaattaa

SEQ ID NO: 299361 - DNA, 15 bp, Homo sapiens
taaagggaaaaatta

SEQ ID NO: 299362 - DNA, 15 bp, Homo sapiens
ctaaagggaaaaatt

SEQ ID NO: 299363 - DNA, 15 bp, Homo sapiens
gctaaagggaaaaat

SEQ ID NO: 299364 - DNA, 15 bp, Homo sapiens
tgctaaagggaaaaa

SEQ ID NO: 299365 - DNA, 15 bp, Homo sapiens
atgctaaagggaaaa

SEQ ID NO: 299366 - DNA, 15 bp, Homo sapiens
tatgctaaagggaaa

SEQ ID NO: 299367 - DNA, 15 bp, Homo sapiens
ctatgctaaagggaa

SEQ ID NO: 299368 - DNA, 15 bp, Homo sapiens
actatgctaaaggga

SEQ ID NO: 299369 - DNA, 15 bp, Homo sapiens
cactatgctaaaggg

SEQ ID NO: 299370 - DNA, 15 bp, Homo sapiens
tcactatgctaaagg

SEQ ID NO: 299371 - DNA, 15 bp, Homo sapiens
ctcactatgctaaag

SEQ ID NO: 299372 - DNA, 15 bp, Homo sapiens
actcactatgctaaa

SEQ ID NO: 299373 - DNA, 15 bp, Homo sapiens
aactcactatgctaa

SEQ ID NO: 299374 - DNA, 15 bp, Homo sapiens
taactcactatgcta

SEQ ID NO: 299375 - DNA, 15 bp, Homo sapiens
ctaactcactatgct

SEQ ID NO: 299376 - DNA, 15 bp, Homo sapiens
cctaactcactatgc

SEQ ID NO: 299377 - DNA, 15 bp, Homo sapiens
ccctaactcactatg

SEQ ID NO: 299378 - DNA, 15 bp, Homo sapiens
tccctaactcactat

SEQ ID NO: 299379 - DNA, 15 bp, Homo sapiens
atccctaactcacta

SEQ ID NO: 299380 - DNA, 15 bp, Homo sapiens
gatccctaactcact

SEQ ID NO: 299381 - DNA, 15 bp, Homo sapiens
ggatccctaactcac

SEQ ID NO: 299382 - DNA, 15 bp, Homo sapiens
aggatccctaactca

SEQ ID NO: 299383 - DNA, 15 bp, Homo sapiens
caggatccctaactc

SEQ ID NO: 299384 - DNA, 15 bp, Homo sapiens
tcaggatccctaact

SEQ ID NO: 299385 - DNA, 15 bp, Homo sapiens
ctcaggatccctaac

SEQ ID NO: 299386 - DNA, 15 bp, Homo sapiens
tctcaggatccctaa

SEQ ID NO: 299387 - DNA, 15 bp, Homo sapiens
atctcaggatcccta

SEQ ID NO: 299388 - DNA, 15 bp, Homo sapiens
aatctcaggatccct

SEQ ID NO: 299389 - DNA, 15 bp, Homo sapiens
aaatctcaggatccc

SEQ ID NO: 299390 - DNA, 15 bp, Homo sapiens
aaaatctcaggatcc

SEQ ID NO: 299391 - DNA, 15 bp, Homo sapiens
caaaatctcaggatc

SEQ ID NO: 299392 - DNA, 15 bp, Homo sapiens
acaaaatctcaggat

SEQ ID NO: 299393 - DNA, 15 bp, Homo sapiens
aacaaaatctcagga

SEQ ID NO: 299394 - DNA, 15 bp, Homo sapiens
aaacaaaatctcagg

SEQ ID NO: 299395 - DNA, 15 bp, Homo sapiens
aaaacaaaatctcag

SEQ ID NO: 299396 - DNA, 15 bp, Homo sapiens
gaaaacaaaatctca

SEQ ID NO: 299397 - DNA, 15 bp, Homo sapiens
ggaaaacaaaatctc

SEQ ID NO: 299398 - DNA, 15 bp, Homo sapiens
tggaaaacaaaatct

SEQ ID NO: 299399 - DNA, 15 bp, Homo sapiens
atggaaaacaaaatc

SEQ ID NO: 299400 - DNA, 15 bp, Homo sapiens
gaatggaaaacaaaa

SEQ ID NO: 299401 - DNA, 15 bp, Homo sapiens
tgaatggaaaacaaa

SEQ ID NO: 299402 - DNA, 15 bp, Homo sapiens
gtgaatggaaaacaa

SEQ ID NO: 299403 - DNA, 15 bp, Homo sapiens
tgtgaatggaaaaca

SEQ ID NO: 299404 - DNA, 15 bp, Homo sapiens
atgtgaatggaaaac

SEQ ID NO: 299405 - DNA, 15 bp, Homo sapiens
aatgtgaatggaaaa

SEQ ID NO: 299406 - DNA, 15 bp, Homo sapiens
aaatgtgaatggaaa

SEQ ID NO: 299407 - DNA, 15 bp, Homo sapiens
aaaatgtgaatggaa

SEQ ID NO: 299408 - DNA, 15 bp, Homo sapiens
gaaaatgtgaatgga

SEQ ID NO: 299409 - DNA, 15 bp, Homo sapiens
agaaaatgtgaatgg

SEQ ID NO: 299410 - DNA, 15 bp, Homo sapiens
aagaaaatgtgaatg

SEQ ID NO: 299411 - DNA, 15 bp, Homo sapiens
taagaaaatgtgaat

SEQ ID NO: 299412 - DNA, 15 bp, Homo sapiens
ataagaaaatgtgaa

SEQ ID NO: 299413 - DNA, 15 bp, Homo sapiens
gataagaaaatgtga

SEQ ID NO: 299414 - DNA, 15 bp, Homo sapiens
tgataagaaaatgtg

SEQ ID NO: 299415 - DNA, 15 bp, Homo sapiens
gtgataagaaaatgt

SEQ ID NO: 299416 - DNA, 15 bp, Homo sapiens
tgtgataagaaaatg

SEQ ID NO: 299417 - DNA, 15 bp, Homo sapiens
atgtgataagaaaat

SEQ ID NO: 299418 - DNA, 15 bp, Homo sapiens
tatgtgataagaaaa

SEQ ID NO: 299419 - DNA, 15 bp, Homo sapiens
gtatgtgataagaaa

SEQ ID NO: 299420 - DNA, 15 bp, Homo sapiens
agtatgtgataagaa

SEQ ID NO: 299421 - DNA, 15 bp, Homo sapiens
aagtatgtgataaga

SEQ ID NO: 299422 - DNA, 15 bp, Homo sapiens
aaagtatgtgataag

SEQ ID NO: 299423 - DNA, 15 bp, Homo sapiens
aaaagtatgtgataa

SEQ ID NO: 299424 - DNA, 15 bp, Homo sapiens
taaaagtatgtgata

SEQ ID NO: 299425 - DNA, 15 bp, Homo sapiens
ctaaaagtatgtgat

SEQ ID NO: 299426 - DNA, 15 bp, Homo sapiens
actaaaagtatgtga

SEQ ID NO: 299427 - DNA, 15 bp, Homo sapiens
tactaaaagtatgtg

SEQ ID NO: 299428 - DNA, 15 bp, Homo sapiens
ttactaaaagtatgt

SEQ ID NO: 299429 - DNA, 15 bp, Homo sapiens
attactaaaagtatg

SEQ ID NO: 299430 - DNA, 15 bp, Homo sapiens
tattactaaaagtat

SEQ ID NO: 299431 - DNA, 15 bp, Homo sapiens
ttattactaaaagta

SEQ ID NO: 299432 - DNA, 15 bp, Homo sapiens
attattactaaaagt

SEQ ID NO: 299433 - DNA, 15 bp, Homo sapiens
cattattactaaaag

SEQ ID NO: 299434 - DNA, 15 bp, Homo sapiens
acattattactaaaa

SEQ ID NO: 299435 - DNA, 15 bp, Homo sapiens
cacattattactaaa

SEQ ID NO: 299436 - DNA, 15 bp, Homo sapiens
gcacattattactaa

SEQ ID NO: 299437 - DNA, 15 bp, Homo sapiens
ggcacattattacta

SEQ ID NO: 299438 - DNA, 15 bp, Homo sapiens
tggcacattattact

SEQ ID NO: 299439 - DNA, 15 bp, Homo sapiens
gtggcacattattac

SEQ ID NO: 299440 - DNA, 15 bp, Homo sapiens
tgtggcacattatta

SEQ ID NO: 299441 - DNA, 15 bp, Homo sapiens
ttgtggcacattatt

SEQ ID NO: 299442 - DNA, 15 bp, Homo sapiens
tttgtggcacattat

SEQ ID NO: 299443 - DNA, 15 bp, Homo sapiens
ctttgtggcacatta

SEQ ID NO: 299444 - DNA, 15 bp, Homo sapiens
gctttgtggcacatt

SEQ ID NO: 299445 - DNA, 15 bp, Homo sapiens
ggctttgtggcacat

SEQ ID NO: 299446 - DNA, 15 bp, Homo sapiens
tggctttgtggcaca

SEQ ID NO: 299447 - DNA, 15 bp, Homo sapiens
gtggctttgtggcac

SEQ ID NO: 299448 - DNA, 15 bp, Homo sapiens
tgtggctttgtggca

SEQ ID NO: 299449 - DNA, 15 bp, Homo sapiens
ctgtggctttgtggc

SEQ ID NO: 299450 - DNA, 15 bp, Homo sapiens
gctgtggctttgtgg

SEQ ID NO: 299451 - DNA, 15 bp, Homo sapiens
tgctgtggctttgtg

SEQ ID NO: 299452 - DNA, 15 bp, Homo sapiens
ctgctgtggctttgt

SEQ ID NO: 299453 - DNA, 15 bp, Homo sapiens
gctgctgtggctttg

SEQ ID NO: 299454 - DNA, 15 bp, Homo sapiens
agctgctgtggcttt

SEQ ID NO: 299455 - DNA, 15 bp, Homo sapiens
aagctgctgtggctt

SEQ ID NO: 299456 - DNA, 15 bp, Homo sapiens
aaagctgctgtggct

SEQ ID NO: 299457 - DNA, 15 bp, Homo sapiens
caaagctgctgtggc

SEQ ID NO: 299458 - DNA, 15 bp, Homo sapiens
ccaaagctgctgtgg

SEQ ID NO: 299459 - DNA, 15 bp, Homo sapiens
tccaaagctgctgtg

SEQ ID NO: 299460 - DNA, 15 bp, Homo sapiens
ctccaaagctgctgt

SEQ ID NO: 299461 - DNA, 15 bp, Homo sapiens
tctccaaagctgctg

SEQ ID NO: 299462 - DNA, 15 bp, Homo sapiens
ttctccaaagctgct

SEQ ID NO: 299463 - DNA, 15 bp, Homo sapiens
gttctccaaagctgc

SEQ ID NO: 299464 - DNA, 15 bp, Homo sapiens
tgttctccaaagctg

SEQ ID NO: 299465 - DNA, 15 bp, Homo sapiens
atgttctccaaagct

SEQ ID NO: 299466 - DNA, 15 bp, Homo sapiens
aatgttctccaaagc

SEQ ID NO: 299467 - DNA, 15 bp, Homo sapiens
aaatgttctccaaag

SEQ ID NO: 299468 - DNA, 15 bp, Homo sapiens
aaaatgttctccaaa

SEQ ID NO: 299469 - DNA, 15 bp, Homo sapiens
gaaaatgttctccaa

SEQ ID NO: 299470 - DNA, 15 bp, Homo sapiens
agaaaatgttctcca

SEQ ID NO: 299471 - DNA, 15 bp, Homo sapiens
aagaaaatgttctcc

SEQ ID NO: 299472 - DNA, 15 bp, Homo sapiens
aaagaaaatgttctc

SEQ ID NO: 299473 - DNA, 15 bp, Homo sapiens
gaaagaaaatgttct

SEQ ID NO: 299474 - DNA, 15 bp, Homo sapiens
tgaaagaaaatgttc

SEQ ID NO: 299475 - DNA, 15 bp, Homo sapiens
atgaaagaaaatgtt

SEQ ID NO: 299476 - DNA, 15 bp, Homo sapiens
catgaaagaaaatgt

SEQ ID NO: 299477 - DNA, 15 bp, Homo sapiens
tcatgaaagaaaatg

SEQ ID NO: 299478 - DNA, 15 bp, Homo sapiens
ttcatgaaagaaaat

SEQ ID NO: 299479 - DNA, 15 bp, Homo sapiens
gttcatgaaagaaaa

SEQ ID NO: 299480 - DNA, 15 bp, Homo sapiens
agttcatgaaagaaa

SEQ ID NO: 299481 - DNA, 15 bp, Homo sapiens
aagttcatgaaagaa

SEQ ID NO: 299482 - DNA, 15 bp, Homo sapiens
caagttcatgaaaga

SEQ ID NO: 299483 - DNA, 15 bp, Homo sapiens
acaagttcatgaaag

SEQ ID NO: 299484 - DNA, 15 bp, Homo sapiens
aacaagttcatgaaa

SEQ ID NO: 299485 - DNA, 15 bp, Homo sapiens
aaacaagttcatgaa

SEQ ID NO: 299486 - DNA, 15 bp, Homo sapiens
taaacaagttcatga

SEQ ID NO: 299487 - DNA, 15 bp, Homo sapiens
gtaaacaagttcatg

SEQ ID NO: 299488 - DNA, 15 bp, Homo sapiens
agtaaacaagttcat

SEQ ID NO: 299489 - DNA, 15 bp, Homo sapiens
tagtaaacaagttca

SEQ ID NO: 299490 - DNA, 15 bp, Homo sapiens
ttagtaaacaagttc

SEQ ID NO: 299491 - DNA, 15 bp, Homo sapiens
attagtaaacaagtt

SEQ ID NO: 299492 - DNA, 15 bp, Homo sapiens
gattagtaaacaagt

SEQ ID NO: 299493 - DNA, 15 bp, Homo sapiens
agattagtaaacaag

SEQ ID NO: 299494 - DNA, 15 bp, Homo sapiens
aagattagtaaacaa

SEQ ID NO: 299495 - DNA, 15 bp, Homo sapiens
aaagattagtaaaca

SEQ ID NO: 299496 - DNA, 15 bp, Homo sapiens
aaaagattagtaaac

SEQ ID NO: 299497 - DNA, 15 bp, Homo sapiens
aaaaagattagtaaa

SEQ ID NO: 299498 - DNA, 15 bp, Homo sapiens
caaaaagattagtaa

SEQ ID NO: 299499 - DNA, 15 bp, Homo sapiens
tcaaaaagattagta

SEQ ID NO: 299500 - DNA, 15 bp, Homo sapiens
ttcaaaaagattagt

SEQ ID NO: 299501 - DNA, 15 bp, Homo sapiens
tttcaaaaagattag

SEQ ID NO: 299502 - DNA, 15 bp, Homo sapiens
gtttcaaaaagatta

SEQ ID NO: 299503 - DNA, 15 bp, Homo sapiens
tgtttcaaaaagatt

SEQ ID NO: 299504 - DNA, 15 bp, Homo sapiens
ttgtttcaaaaagat

SEQ ID NO: 299505 - DNA, 15 bp, Homo sapiens
attgtttcaaaaaga

SEQ ID NO: 299506 - DNA, 15 bp, Homo sapiens
cattgtttcaaaaag

SEQ ID NO: 299507 - DNA, 15 bp, Homo sapiens
tcattgtttcaaaaa

SEQ ID NO: 299508 - DNA, 15 bp, Homo sapiens
ctcattgtttcaaaa

SEQ ID NO: 299509 - DNA, 15 bp, Homo sapiens
gctcattgtttcaaa

SEQ ID NO: 299510 - DNA, 15 bp, Homo sapiens
ggctcattgtttcaa

SEQ ID NO: 299511 - DNA, 15 bp, Homo sapiens
aggctcattgtttca

SEQ ID NO: 299512 - DNA, 15 bp, Homo sapiens
aaggctcattgtttc

SEQ ID NO: 299513 - DNA, 15 bp, Homo sapiens
gaaggctcattgttt

SEQ ID NO: 299514 - DNA, 15 bp, Homo sapiens
agaaggctcattgtt

SEQ ID NO: 299515 - DNA, 15 bp, Homo sapiens
cagaaggctcattgt

SEQ ID NO: 299516 - DNA, 15 bp, Homo sapiens
tcagaaggctcattg

SEQ ID NO: 299517 - DNA, 15 bp, Homo sapiens
ttcagaaggctcatt

SEQ ID NO: 299518 - DNA, 15 bp, Homo sapiens
attcagaaggctcat

SEQ ID NO: 299519 - DNA, 15 bp, Homo sapiens
cattcagaaggctca

SEQ ID NO: 299520 - DNA, 15 bp, Homo sapiens
tcattcagaaggctc

SEQ ID NO: 299521 - DNA, 15 bp, Homo sapiens
atcattcagaaggct

SEQ ID NO: 299522 - DNA, 15 bp, Homo sapiens
aatcattcagaaggc

SEQ ID NO: 299523 - DNA, 15 bp, Homo sapiens
caatcattcagaagg

SEQ ID NO: 299524 - DNA, 15 bp, Homo sapiens
acaatcattcagaag

SEQ ID NO: 299525 - DNA, 15 bp, Homo sapiens
gacaatcattcagaa

SEQ ID NO: 299526 - DNA, 15 bp, Homo sapiens
agacaatcattcaga

SEQ ID NO: 299527 - DNA, 15 bp, Homo sapiens
aagacaatcattcag

SEQ ID NO: 299528 - DNA, 15 bp, Homo sapiens
taagacaatcattca

SEQ ID NO: 299529 - DNA, 15 bp, Homo sapiens
ataagacaatcattc

SEQ ID NO: 299530 - DNA, 15 bp, Homo sapiens
aataagacaatcatt

SEQ ID NO: 299531 - DNA, 15 bp, Homo sapiens
caataagacaatcat

SEQ ID NO: 299532 - DNA, 15 bp, Homo sapiens
ccaataagacaatca

SEQ ID NO: 299533 - DNA, 15 bp, Homo sapiens
gccaataagacaatc

SEQ ID NO: 299534 - DNA, 15 bp, Homo sapiens
tgccaataagacaat

SEQ ID NO: 299535 - DNA, 15 bp, Homo sapiens
ttgccaataagacaa

SEQ ID NO: 299536 - DNA, 15 bp, Homo sapiens
cttgccaataagaca

SEQ ID NO: 299537 - DNA, 15 bp, Homo sapiens
tcttgccaataagac

SEQ ID NO: 299538 - DNA, 15 bp, Homo sapiens
ctcttgccaataaga

SEQ ID NO: 299539 - DNA, 15 bp, Homo sapiens
tctcttgccaataag

SEQ ID NO: 299540 - DNA, 15 bp, Homo sapiens
ctctcttgccaataa

SEQ ID NO: 299541 - DNA, 15 bp, Homo sapiens
cctctcttgccaata

SEQ ID NO: 299542 - DNA, 15 bp, Homo sapiens
gcctctcttgccaat

SEQ ID NO: 299543 - DNA, 15 bp, Homo sapiens
agcctctcttgccaa

SEQ ID NO: 299544 - DNA, 15 bp, Homo sapiens
cagcctctcttgcca

SEQ ID NO: 299545 - DNA, 15 bp, Homo sapiens
ccagcctctcttgcc

SEQ ID NO: 299546 - DNA, 15 bp, Homo sapiens
cccagcctctcttgc

SEQ ID NO: 299547 - DNA, 15 bp, Homo sapiens
tcccagcctctcttg

SEQ ID NO: 299548 - DNA, 15 bp, Homo sapiens
atcccagcctctctt

SEQ ID NO: 299549 - DNA, 15 bp, Homo sapiens
gatcccagcctctct

SEQ ID NO: 299550 - DNA, 15 bp, Homo sapiens
agatcccagcctctc

SEQ ID NO: 299551 - DNA, 15 bp, Homo sapiens
aagatcccagcctct

SEQ ID NO: 299552 - DNA, 15 bp, Homo sapiens
taagatcccagcctc

SEQ ID NO: 299553 - DNA, 15 bp, Homo sapiens
ttaagatcccagcct

SEQ ID NO: 299554 - DNA, 15 bp, Homo sapiens
gttaagatcccagcc

SEQ ID NO: 299555 - DNA, 15 bp, Homo sapiens
agttaagatcccagc

SEQ ID NO: 299556 - DNA, 15 bp, Homo sapiens
tagttaagatcccag

SEQ ID NO: 299557 - DNA, 15 bp, Homo sapiens
ttagttaagatccca

SEQ ID NO: 299558 - DNA, 15 bp, Homo sapiens
tttagttaagatccc

SEQ ID NO: 299559 - DNA, 15 bp, Homo sapiens
ttttagttaagatcc

SEQ ID NO: 299560 - DNA, 15 bp, Homo sapiens
cttttagttaagatc

SEQ ID NO: 299561 - DNA, 15 bp, Homo sapiens
tcttttagttaagat

SEQ ID NO: 299562 - DNA, 15 bp, Homo sapiens
gtcttttagttaaga

SEQ ID NO: 299563 - DNA, 15 bp, Homo sapiens
tgtcttttagttaag

SEQ ID NO: 299564 - DNA, 15 bp, Homo sapiens
ttgtcttttagttaa

SEQ ID NO: 299565 - DNA, 15 bp, Homo sapiens
cttgtcttttagtta

SEQ ID NO: 299566 - DNA, 15 bp, Homo sapiens
ccttgtcttttagtt

SEQ ID NO: 299567 - DNA, 15 bp, Homo sapiens
cccttgtcttttagt

SEQ ID NO: 299568 - DNA, 15 bp, Homo sapiens
acccttgtcttttag

SEQ ID NO: 299569 - DNA, 15 bp, Homo sapiens
tacccttgtctttta

SEQ ID NO: 299570 - DNA, 15 bp, Homo sapiens
atacccttgtctttt

SEQ ID NO: 299571 - DNA, 15 bp, Homo sapiens
catacccttgtcttt

SEQ ID NO: 299572 - DNA, 15 bp, Homo sapiens
acatacccttgtctt

SEQ ID NO: 299573 - DNA, 15 bp, Homo sapiens
cacatacccttgtct

SEQ ID NO: 299574 - DNA, 15 bp, Homo sapiens
tcacatacccttgtc

SEQ ID NO: 299575 - DNA, 15 bp, Homo sapiens
ttcacatacccttgt

SEQ ID NO: 299576 - DNA, 15 bp, Homo sapiens
cttcacatacccttg

SEQ ID NO: 299577 - DNA, 15 bp, Homo sapiens
acttcacataccctt

SEQ ID NO: 299578 - DNA, 15 bp, Homo sapiens
tacttcacataccct

SEQ ID NO: 299579 - DNA, 15 bp, Homo sapiens
ctacttcacataccc

SEQ ID NO: 299580 - DNA, 15 bp, Homo sapiens
cctacttcacatacc

SEQ ID NO: 299581 - DNA, 15 bp, Homo sapiens
gcctacttcacatac

SEQ ID NO: 299582 - DNA, 15 bp, Homo sapiens
agcctacttcacata

SEQ ID NO: 299583 - DNA, 15 bp, Homo sapiens
tagcctacttcacat

SEQ ID NO: 299584 - DNA, 15 bp, Homo sapiens
ctagcctacttcaca

SEQ ID NO: 299585 - DNA, 15 bp, Homo sapiens
cctagcctacttcac

SEQ ID NO: 299586 - DNA, 15 bp, Homo sapiens
ccctagcctacttca

SEQ ID NO: 299587 - DNA, 15 bp, Homo sapiens
cccctagcctacttc

SEQ ID NO: 299588 - DNA, 15 bp, Homo sapiens
acccctagcctactt

SEQ ID NO: 299589 - DNA, 15 bp, Homo sapiens
cacccctagcctact

SEQ ID NO: 299590 - DNA, 15 bp, Homo sapiens
acacccctagcctac

SEQ ID NO: 299591 - DNA, 15 bp, Homo sapiens
cacacccctagccta

SEQ ID NO: 299592 - DNA, 15 bp, Homo sapiens
ccacacccctagcct

SEQ ID NO: 299593 - DNA, 15 bp, Homo sapiens
accacacccctagcc

SEQ ID NO: 299594 - DNA, 15 bp, Homo sapiens
caccacacccctagc

SEQ ID NO: 299595 - DNA, 15 bp, Homo sapiens
tcaccacacccctag

SEQ ID NO: 299596 - DNA, 15 bp, Homo sapiens
ctcaccacaccccta

SEQ ID NO: 299597 - DNA, 15 bp, Homo sapiens
gctcaccacacccct

SEQ ID NO: 299598 - DNA, 15 bp, Homo sapiens
agctcaccacacccc

SEQ ID NO: 299599 - DNA, 15 bp, Homo sapiens
cagctcaccacaccc

SEQ ID NO: 299600 - DNA, 15 bp, Homo sapiens
acagctcaccacacc

SEQ ID NO: 299601 - DNA, 15 bp, Homo sapiens
cacagctcaccacac

SEQ ID NO: 299602 - DNA, 15 bp, Homo sapiens
ccacagctcaccaca

SEQ ID NO: 299603 - DNA, 15 bp, Homo sapiens
cccacagctcaccac

SEQ ID NO: 299604 - DNA, 15 bp, Homo sapiens
acccacagctcacca

SEQ ID NO: 299605 - DNA, 15 bp, Homo sapiens
cacccacagctcacc

SEQ ID NO: 299606 - DNA, 15 bp, Homo sapiens
acacccacagctcac

SEQ ID NO: 299607 - DNA, 15 bp, Homo sapiens
aacacccacagctca

SEQ ID NO: 299608 - DNA, 15 bp, Homo sapiens
gaacacccacagctc

SEQ ID NO: 299609 - DNA, 15 bp, Homo sapiens
agaacacccacagct

SEQ ID NO: 299610 - DNA, 15 bp, Homo sapiens
gagaacacccacagc

SEQ ID NO: 299611 - DNA, 15 bp, Homo sapiens
agagaacacccacag

SEQ ID NO: 299612 - DNA, 15 bp, Homo sapiens
gagagaacacccaca

SEQ ID NO: 299613 - DNA, 15 bp, Homo sapiens
ggagagaacacccac

SEQ ID NO: 299614 - DNA, 15 bp, Homo sapiens
aggagagaacaccca

SEQ ID NO: 299615 - DNA, 15 bp, Homo sapiens
caggagagaacaccc

SEQ ID NO: 299616 - DNA, 15 bp, Homo sapiens
gcaggagagaacacc

SEQ ID NO: 299617 - DNA, 15 bp, Homo sapiens
agcaggagagaacac

SEQ ID NO: 299618 - DNA, 15 bp, Homo sapiens
aagcaggagagaaca

SEQ ID NO: 299619 - DNA, 15 bp, Homo sapiens
caagcaggagagaac

SEQ ID NO: 299620 - DNA, 15 bp, Homo sapiens
gcaagcaggagagaa

SEQ ID NO: 299621 - DNA, 15 bp, Homo sapiens
agcaagcaggagaga

SEQ ID NO: 299622 - DNA, 15 bp, Homo sapiens
aagcaagcaggagag

SEQ ID NO: 299623 - DNA, 15 bp, Homo sapiens
gaagcaagcaggaga

SEQ ID NO: 299624 - DNA, 15 bp, Homo sapiens
agaagcaagcaggag

SEQ ID NO: 299625 - DNA, 15 bp, Homo sapiens
cagaagcaagcagga

SEQ ID NO: 299626 - DNA, 15 bp, Homo sapiens
acagaagcaagcagg

SEQ ID NO: 299627 - DNA, 15 bp, Homo sapiens
aacagaagcaagcag

SEQ ID NO: 299628 - DNA, 15 bp, Homo sapiens
caacagaagcaagca

SEQ ID NO: 299629 - DNA, 15 bp, Homo sapiens
acaacagaagcaagc

SEQ ID NO: 299630 - DNA, 15 bp, Homo sapiens
gacaacagaagcaag

SEQ ID NO: 299631 - DNA, 15 bp, Homo sapiens
agacaacagaagcaa

SEQ ID NO: 299632 - DNA, 15 bp, Homo sapiens
tagacaacagaagca

SEQ ID NO: 299633 - DNA, 15 bp, Homo sapiens
ttagacaacagaagc

SEQ ID NO: 299634 - DNA, 15 bp, Homo sapiens
cttagacaacagaag

SEQ ID NO: 299635 - DNA, 15 bp, Homo sapiens
acttagacaacagaa

SEQ ID NO: 299636 - DNA, 15 bp, Homo sapiens
cacttagacaacaga

SEQ ID NO: 299637 - DNA, 15 bp, Homo sapiens
tcacttagacaacag

SEQ ID NO: 299638 - DNA, 15 bp, Homo sapiens
ttcacttagacaaca

SEQ ID NO: 299639 - DNA, 15 bp, Homo sapiens
attcacttagacaac

SEQ ID NO: 299640 - DNA, 15 bp, Homo sapiens
aattcacttagacaa

SEQ ID NO: 299641 - DNA, 15 bp, Homo sapiens
caattcacttagaca

SEQ ID NO: 299642 - DNA, 15 bp, Homo sapiens
ccaattcacttagac

SEQ ID NO: 299643 - DNA, 15 bp, Homo sapiens
tccaattcacttaga

SEQ ID NO: 299644 - DNA, 15 bp, Homo sapiens
ttccaattcacttag

SEQ ID NO: 299645 - DNA, 15 bp, Homo sapiens
cttccaattcactta

SEQ ID NO: 299646 - DNA, 15 bp, Homo sapiens
gcttccaattcactt

SEQ ID NO: 299647 - DNA, 15 bp, Homo sapiens
ggcttccaattcact

SEQ ID NO: 299648 - DNA, 15 bp, Homo sapiens
cggcttccaattcac

SEQ ID NO: 299649 - DNA, 15 bp, Homo sapiens
ccggcttccaattca

SEQ ID NO: 299650 - DNA, 15 bp, Homo sapiens
cccggcttccaattc

SEQ ID NO: 299651 - DNA, 15 bp, Homo sapiens
tcccggcttccaatt

SEQ ID NO: 299652 - DNA, 15 bp, Homo sapiens
gtcccggcttccaat

SEQ ID NO: 299653 - DNA, 15 bp, Homo sapiens
agtcccggcttccaa

SEQ ID NO: 299654 - DNA, 15 bp, Homo sapiens
aagtcccggcttcca

SEQ ID NO: 299655 - DNA, 15 bp, Homo sapiens
aaagtcccggcttcc

SEQ ID NO: 299656 - DNA, 15 bp, Homo sapiens
taaagtcccggcttc

SEQ ID NO: 299657 - DNA, 15 bp, Homo sapiens
ctaaagtcccggctt

SEQ ID NO: 299658 - DNA, 15 bp, Homo sapiens
gctaaagtcccggct

SEQ ID NO: 299659 - DNA, 15 bp, Homo sapiens
tgctaaagtcccggc

SEQ ID NO: 299660 - DNA, 15 bp, Homo sapiens
ctgctaaagtcccgg

SEQ ID NO: 299661 - DNA, 15 bp, Homo sapiens
cctgctaaagtcccg

SEQ ID NO: 299662 - DNA, 15 bp, Homo sapiens
ccctgctaaagtccc

SEQ ID NO: 299663 - DNA, 15 bp, Homo sapiens
tccctgctaaagtcc

SEQ ID NO: 299664 - DNA, 15 bp, Homo sapiens
ctccctgctaaagtc

SEQ ID NO: 299665 - DNA, 15 bp, Homo sapiens
actccctgctaaagt

SEQ ID NO: 299666 - DNA, 15 bp, Homo sapiens
cactccctgctaaag

SEQ ID NO: 299667 - DNA, 15 bp, Homo sapiens
tcactccctgctaaa

SEQ ID NO: 299668 - DNA, 15 bp, Homo sapiens
ctcactccctgctaa

SEQ ID NO: 299669 - DNA, 15 bp, Homo sapiens
cctcactccctgcta

SEQ ID NO: 299670 - DNA, 15 bp, Homo sapiens
acctcactccctgct

SEQ ID NO: 299671 - DNA, 15 bp, Homo sapiens
aacctcactccctgc

SEQ ID NO: 299672 - DNA, 15 bp, Homo sapiens
caacctcactccctg

SEQ ID NO: 299673 - DNA, 15 bp, Homo sapiens
ccaacctcactccct

SEQ ID NO: 299674 - DNA, 15 bp, Homo sapiens
cccaacctcactccc

SEQ ID NO: 299675 - DNA, 15 bp, Homo sapiens
ccccaacctcactcc

SEQ ID NO: 299676 - DNA, 15 bp, Homo sapiens
tccccaacctcactc

SEQ ID NO: 299677 - DNA, 15 bp, Homo sapiens
ctccccaacctcact

SEQ ID NO: 299678 - DNA, 15 bp, Homo sapiens
cctccccaacctcac

SEQ ID NO: 299679 - DNA, 15 bp, Homo sapiens
tcctccccaacctca

SEQ ID NO: 299680 - DNA, 15 bp, Homo sapiens
ctcctccccaacctc

SEQ ID NO: 299681 - DNA, 15 bp, Homo sapiens
cctcctccccaacct

SEQ ID NO: 299682 - DNA, 15 bp, Homo sapiens
acctcctccccaacc

SEQ ID NO: 299683 - DNA, 15 bp, Homo sapiens
cacctcctccccaac

SEQ ID NO: 299684 - DNA, 15 bp, Homo sapiens
acacctcctccccaa

SEQ ID NO: 299685 - DNA, 15 bp, Homo sapiens
gacacctcctcccca

SEQ ID NO: 299686 - DNA, 15 bp, Homo sapiens
tgacacctcctcccc

SEQ ID NO: 299687 - DNA, 15 bp, Homo sapiens
ctgacacctcctccc

SEQ ID NO: 299688 - DNA, 15 bp, Homo sapiens
tctgacacctcctcc

SEQ ID NO: 299689 - DNA, 15 bp, Homo sapiens
ttctgacacctcctc

SEQ ID NO: 299690 - DNA, 15 bp, Homo sapiens
cttctgacacctcct

SEQ ID NO: 299691 - DNA, 15 bp, Homo sapiens
acttctgacacctcc

SEQ ID NO: 299692 - DNA, 15 bp, Homo sapiens
cacttctgacacctc

SEQ ID NO: 299693 - DNA, 15 bp, Homo sapiens
gcacttctgacacct

SEQ ID NO: 299694 - DNA, 15 bp, Homo sapiens
cgcacttctgacacc

SEQ ID NO: 299695 - DNA, 15 bp, Homo sapiens
tcgcacttctgacac

SEQ ID NO: 299696 - DNA, 15 bp, Homo sapiens
ctcgcacttctgaca

SEQ ID NO: 299697 - DNA, 15 bp, Homo sapiens
cctcgcacttctgac

SEQ ID NO: 299698 - DNA, 15 bp, Homo sapiens
tcctcgcacttctga

SEQ ID NO: 299699 - DNA, 15 bp, Homo sapiens
ctcctcgcacttctg

SEQ ID NO: 299700 - DNA, 15 bp, Homo sapiens
tctcctcgcacttct

SEQ ID NO: 299701 - DNA, 15 bp, Homo sapiens
ctctcctcgcacttc

SEQ ID NO: 299702 - DNA, 15 bp, Homo sapiens
tctctcctcgcactt

SEQ ID NO: 299703 - DNA, 15 bp, Homo sapiens
gtctctcctcgcact

SEQ ID NO: 299704 - DNA, 15 bp, Homo sapiens
agtctctcctcgcac

SEQ ID NO: 299705 - DNA, 15 bp, Homo sapiens
cagtctctcctcgca

SEQ ID NO: 299706 - DNA, 15 bp, Homo sapiens
ccagtctctcctcgc

SEQ ID NO: 299707 - DNA, 15 bp, Homo sapiens
tccagtctctcctcg

SEQ ID NO: 299708 - DNA, 15 bp, Homo sapiens
ctccagtctctcctc

SEQ ID NO: 299709 - DNA, 15 bp, Homo sapiens
cctccagtctctcct

SEQ ID NO: 299710 - DNA, 15 bp, Homo sapiens
tcctccagtctctcc

SEQ ID NO: 299711 - DNA, 15 bp, Homo sapiens
atcctccagtctctc

SEQ ID NO: 299712 - DNA, 15 bp, Homo sapiens
catcctccagtctct

SEQ ID NO: 299713 - DNA, 15 bp, Homo sapiens
acatcctccagtctc

SEQ ID NO: 299714 - DNA, 15 bp, Homo sapiens
cacatcctccagtct

SEQ ID NO: 299715 - DNA, 15 bp, Homo sapiens
acacatcctccagtc

SEQ ID NO: 299716 - DNA, 15 bp, Homo sapiens
cacacatcctccagt

SEQ ID NO: 299717 - DNA, 15 bp, Homo sapiens
tcacacatcctccag

SEQ ID NO: 299718 - DNA, 15 bp, Homo sapiens
atcacacatcctcca

SEQ ID NO: 299719 - DNA, 15 bp, Homo sapiens
tatcacacatcctcc

SEQ ID NO: 299720 - DNA, 15 bp, Homo sapiens
ctatcacacatcctc

SEQ ID NO: 299721 - DNA, 15 bp, Homo sapiens
gctatcacacatcct

SEQ ID NO: 299722 - DNA, 15 bp, Homo sapiens
agctatcacacatcc

SEQ ID NO: 299723 - DNA, 15 bp, Homo sapiens
aagctatcacacatc

SEQ ID NO: 299724 - DNA, 15 bp, Homo sapiens
gaagctatcacacat

SEQ ID NO: 299725 - DNA, 15 bp, Homo sapiens
agaagctatcacaca

SEQ ID NO: 299726 - DNA, 15 bp, Homo sapiens
aagaagctatcacac

SEQ ID NO: 299727 - DNA, 15 bp, Homo sapiens
caagaagctatcaca

SEQ ID NO: 299728 - DNA, 15 bp, Homo sapiens
ccaagaagctatcac

SEQ ID NO: 299729 - DNA, 15 bp, Homo sapiens
tccaagaagctatca

SEQ ID NO: 299730 - DNA, 15 bp, Homo sapiens
ctccaagaagctatc

SEQ ID NO: 299731 - DNA, 15 bp, Homo sapiens
tctccaagaagctat

SEQ ID NO: 299732 - DNA, 15 bp, Homo sapiens
ttctccaagaagcta

SEQ ID NO: 299733 - DNA, 15 bp, Homo sapiens
attctccaagaagct

SEQ ID NO: 299734 - DNA, 15 bp, Homo sapiens
tattctccaagaagc

SEQ ID NO: 299735 - DNA, 15 bp, Homo sapiens
ctattctccaagaag

SEQ ID NO: 299736 - DNA, 15 bp, Homo sapiens
tctattctccaagaa

SEQ ID NO: 299737 - DNA, 15 bp, Homo sapiens
ttctattctccaaga

SEQ ID NO: 299738 - DNA, 15 bp, Homo sapiens
cttctattctccaag

SEQ ID NO: 299739 - DNA, 15 bp, Homo sapiens
tcttctattctccaa

SEQ ID NO: 299740 - DNA, 15 bp, Homo sapiens
ctcttctattctcca

SEQ ID NO: 299741 - DNA, 15 bp, Homo sapiens
gctcttctattctcc

SEQ ID NO: 299742 - DNA, 15 bp, Homo sapiens
tgctcttctattctc

SEQ ID NO: 299743 - DNA, 15 bp, Homo sapiens
ctgctcttctattct

SEQ ID NO: 299744 - DNA, 15 bp, Homo sapiens
tctgctcttctattc

SEQ ID NO: 299745 - DNA, 15 bp, Homo sapiens
atctgctcttctatt

SEQ ID NO: 299746 - DNA, 15 bp, Homo sapiens
catctgctcttctat

SEQ ID NO: 299747 - DNA, 15 bp, Homo sapiens
ccatctgctcttcta

SEQ ID NO: 299748 - DNA, 15 bp, Homo sapiens
gccatctgctcttct

SEQ ID NO: 299749 - DNA, 15 bp, Homo sapiens
ggccatctgctcttc

SEQ ID NO: 299750 - DNA, 15 bp, Homo sapiens
aggccatctgctctt

SEQ ID NO: 299751 - DNA, 15 bp, Homo sapiens
caggccatctgctct

SEQ ID NO: 299752 - DNA, 15 bp, Homo sapiens
ccaggccatctgctc

SEQ ID NO: 299753 - DNA, 15 bp, Homo sapiens
cccaggccatctgct

SEQ ID NO: 299754 - DNA, 15 bp, Homo sapiens
tcccaggccatctgc

SEQ ID NO: 299755 - DNA, 15 bp, Homo sapiens
ttcccaggccatctg

SEQ ID NO: 299756 - DNA, 15 bp, Homo sapiens
tttcccaggccatct

SEQ ID NO: 299757 - DNA, 15 bp, Homo sapiens
atttcccaggccatc

SEQ ID NO: 299758 - DNA, 15 bp, Homo sapiens
tatttcccaggccat

SEQ ID NO: 299759 - DNA, 15 bp, Homo sapiens
ctatttcccaggcca

SEQ ID NO: 299760 - DNA, 15 bp, Homo sapiens
tctatttcccaggcc

SEQ ID NO: 299761 - DNA, 15 bp, Homo sapiens
ctctatttcccaggc

SEQ ID NO: 299762 - DNA, 15 bp, Homo sapiens
actctatttcccagg

SEQ ID NO: 299763 - DNA, 15 bp, Homo sapiens
cactctatttcccag

SEQ ID NO: 299764 - DNA, 15 bp, Homo sapiens
acactctatttccca

SEQ ID NO: 299765 - DNA, 15 bp, Homo sapiens
cacactctatttccc

SEQ ID NO: 299766 - DNA, 15 bp, Homo sapiens
tcacactctatttcc

SEQ ID NO: 299767 - DNA, 15 bp, Homo sapiens
gtcacactctatttc

SEQ ID NO: 299768 - DNA, 15 bp, Homo sapiens
agtcacactctattt

SEQ ID NO: 299769 - DNA, 15 bp, Homo sapiens
tagtcacactctatt

SEQ ID NO: 299770 - DNA, 15 bp, Homo sapiens
atagtcacactctat

SEQ ID NO: 299771 - DNA, 15 bp, Homo sapiens
tatagtcacactcta

SEQ ID NO: 299772 - DNA, 15 bp, Homo sapiens
ttatagtcacactct

SEQ ID NO: 299773 - DNA, 15 bp, Homo sapiens
cttatagtcacactc

SEQ ID NO: 299774 - DNA, 15 bp, Homo sapiens
gcttatagtcacact

SEQ ID NO: 299775 - DNA, 15 bp, Homo sapiens
tgcttatagtcacac

SEQ ID NO: 299776 - DNA, 15 bp, Homo sapiens
ctgcttatagtcaca

SEQ ID NO: 299777 - DNA, 15 bp, Homo sapiens
gctgcttatagtcac

SEQ ID NO: 299778 - DNA, 15 bp, Homo sapiens
tgctgcttatagtca

SEQ ID NO: 299779 - DNA, 15 bp, Homo sapiens
atgctgcttatagtc

SEQ ID NO: 299780 - DNA, 15 bp, Homo sapiens
aatgctgcttatagt

SEQ ID NO: 299781 - DNA, 15 bp, Homo sapiens
taatgctgcttatag

SEQ ID NO: 299782 - DNA, 15 bp, Homo sapiens
ttaatgctgcttata

SEQ ID NO: 299783 - DNA, 15 bp, Homo sapiens
tttaatgctgcttat

SEQ ID NO: 299784 - DNA, 15 bp, Homo sapiens
ctttaatgctgctta

SEQ ID NO: 299785 - DNA, 15 bp, Homo sapiens
cctttaatgctgctt

SEQ ID NO: 299786 - DNA, 15 bp, Homo sapiens
acctttaatgctgct

SEQ ID NO: 299787 - DNA, 15 bp, Homo sapiens
cacctttaatgctgc

SEQ ID NO: 299788 - DNA, 15 bp, Homo sapiens
gcacctttaatgctg

SEQ ID NO: 299789 - DNA, 15 bp, Homo sapiens
ggcacctttaatgct

SEQ ID NO: 299790 - DNA, 15 bp, Homo sapiens
tggcacctttaatgc

SEQ ID NO: 299791 - DNA, 15 bp, Homo sapiens
gtggcacctttaatg

SEQ ID NO: 299792 - DNA, 15 bp, Homo sapiens
agtggcacctttaat

SEQ ID NO: 299793 - DNA, 15 bp, Homo sapiens
gagtggcacctttaa

SEQ ID NO: 299794 - DNA, 15 bp, Homo sapiens
tgagtggcaccttta

SEQ ID NO: 299795 - DNA, 15 bp, Homo sapiens
atgagtggcaccttt

SEQ ID NO: 299796 - DNA, 15 bp, Homo sapiens
catgagtggcacctt

SEQ ID NO: 299797 - DNA, 15 bp, Homo sapiens
tcatgagtggcacct

SEQ ID NO: 299798 - DNA, 15 bp, Homo sapiens
ttcatgagtggcacc

SEQ ID NO: 299799 - DNA, 15 bp, Homo sapiens
attcatgagtggcac

SEQ ID NO: 299800 - DNA, 15 bp, Homo sapiens
aattcatgagtggca

SEQ ID NO: 299801 - DNA, 15 bp, Homo sapiens
aaattcatgagtggc

SEQ ID NO: 299802 - DNA, 15 bp, Homo sapiens
taaattcatgagtgg

SEQ ID NO: 299803 - DNA, 15 bp, Homo sapiens
ttaaattcatgagtg

SEQ ID NO: 299804 - DNA, 15 bp, Homo sapiens
gttaaattcatgagt

SEQ ID NO: 299805 - DNA, 15 bp, Homo sapiens
tgttaaattcatgag

SEQ ID NO: 299806 - DNA, 15 bp, Homo sapiens
atgttaaattcatga

SEQ ID NO: 299807 - DNA, 15 bp, Homo sapiens
catgttaaattcatg

SEQ ID NO: 299808 - DNA, 15 bp, Homo sapiens
tcatgttaaattcat

SEQ ID NO: 299809 - DNA, 15 bp, Homo sapiens
ctcatgttaaattca

SEQ ID NO: 299810 - DNA, 15 bp, Homo sapiens
cctcatgttaaattc

SEQ ID NO: 299811 - DNA, 15 bp, Homo sapiens
gcctcatgttaaatt

SEQ ID NO: 299812 - DNA, 15 bp, Homo sapiens
ggcctcatgttaaat

SEQ ID NO: 299813 - DNA, 15 bp, Homo sapiens
tggcctcatgttaaa

SEQ ID NO: 299814 - DNA, 15 bp, Homo sapiens
atggcctcatgttaa

SEQ ID NO: 299815 - DNA, 15 bp, Homo sapiens
aatggcctcatgtta

SEQ ID NO: 299816 - DNA, 15 bp, Homo sapiens
gaatggcctcatgtt

SEQ ID NO: 299817 - DNA, 15 bp, Homo sapiens
agaatggcctcatgt

SEQ ID NO: 299818 - DNA, 15 bp, Homo sapiens
cagaatggcctcatg

SEQ ID NO: 299819 - DNA, 15 bp, Homo sapiens
gcagaatggcctcat

SEQ ID NO: 299820 - DNA, 15 bp, Homo sapiens
tgcagaatggcctca

SEQ ID NO: 299821 - DNA, 15 bp, Homo sapiens
ctgcagaatggcctc

SEQ ID NO: 299822 - DNA, 15 bp, Homo sapiens
cctgcagaatggcct

SEQ ID NO: 299823 - DNA, 15 bp, Homo sapiens
ccctgcagaatggcc

SEQ ID NO: 299824 - DNA, 15 bp, Homo sapiens
accctgcagaatggc

SEQ ID NO: 299825 - DNA, 15 bp, Homo sapiens
aaccctgcagaatgg

SEQ ID NO: 299826 - DNA, 15 bp, Homo sapiens
caaccctgcagaatg

SEQ ID NO: 299827 - DNA, 15 bp, Homo sapiens
acaaccctgcagaat

SEQ ID NO: 299828 - DNA, 15 bp, Homo sapiens
tacaaccctgcagaa

SEQ ID NO: 299829 - DNA, 15 bp, Homo sapiens
ttacaaccctgcaga

SEQ ID NO: 299830 - DNA, 15 bp, Homo sapiens
cttacaaccctgcag

SEQ ID NO: 299831 - DNA, 15 bp, Homo sapiens
acttacaaccctgca

SEQ ID NO: 299832 - DNA, 15 bp, Homo sapiens
aacttacaaccctgc

SEQ ID NO: 299833 - DNA, 15 bp, Homo sapiens
caacttacaaccctg

SEQ ID NO: 299834 - DNA, 15 bp, Homo sapiens
gcaacttacaaccct

SEQ ID NO: 299835 - DNA, 15 bp, Homo sapiens
ggcaacttacaaccc

SEQ ID NO: 299836 - DNA, 15 bp, Homo sapiens
gggcaacttacaacc

SEQ ID NO: 299837 - DNA, 15 bp, Homo sapiens
agggcaacttacaac

SEQ ID NO: 299838 - DNA, 15 bp, Homo sapiens
gagggcaacttacaa

SEQ ID NO: 299839 - DNA, 15 bp, Homo sapiens
agagggcaacttaca

SEQ ID NO: 299840 - DNA, 15 bp, Homo sapiens
tagagggcaacttac

SEQ ID NO: 299841 - DNA, 15 bp, Homo sapiens
ctagagggcaactta

SEQ ID NO: 299842 - DNA, 15 bp, Homo sapiens
cctagagggcaactt

SEQ ID NO: 299843 - DNA, 15 bp, Homo sapiens
gcctagagggcaact

SEQ ID NO: 299844 - DNA, 15 bp, Homo sapiens
tgcctagagggcaac

SEQ ID NO: 299845 - DNA, 15 bp, Homo sapiens
atgcctagagggcaa

SEQ ID NO: 299846 - DNA, 15 bp, Homo sapiens
tatgcctagagggca

SEQ ID NO: 299847 - DNA, 15 bp, Homo sapiens
atatgcctagagggc

SEQ ID NO: 299848 - DNA, 15 bp, Homo sapiens
aatatgcctagaggg

SEQ ID NO: 299849 - DNA, 15 bp, Homo sapiens
gaatatgcctagagg

SEQ ID NO: 299850 - DNA, 15 bp, Homo sapiens
tgaatatgcctagag

SEQ ID NO: 299851 - DNA, 15 bp, Homo sapiens
gtgaatatgcctaga

SEQ ID NO: 299852 - DNA, 15 bp, Homo sapiens
cgtgaatatgcctag

SEQ ID NO: 299853 - DNA, 15 bp, Homo sapiens
acgtgaatatgccta

SEQ ID NO: 299854 - DNA, 15 bp, Homo sapiens
aacgtgaatatgcct

SEQ ID NO: 299855 - DNA, 15 bp, Homo sapiens
gaacgtgaatatgcc

SEQ ID NO: 299856 - DNA, 15 bp, Homo sapiens
tgaacgtgaatatgc

SEQ ID NO: 299857 - DNA, 15 bp, Homo sapiens
atgaacgtgaatatg

SEQ ID NO: 299858 - DNA, 15 bp, Homo sapiens
catgaacgtgaatat

SEQ ID NO: 299859 - DNA, 15 bp, Homo sapiens
tcatgaacgtgaata

SEQ ID NO: 299860 - DNA, 15 bp, Homo sapiens
ctcatgaacgtgaat

SEQ ID NO: 299861 - DNA, 15 bp, Homo sapiens
gctcatgaacgtgaa

SEQ ID NO: 299862 - DNA, 15 bp, Homo sapiens
tgctcatgaacgtga

SEQ ID NO: 299863 - DNA, 15 bp, Homo sapiens
gtgctcatgaacgtg

SEQ ID NO: 299864 - DNA, 15 bp, Homo sapiens
tgtgctcatgaacgt

SEQ ID NO: 299865 - DNA, 15 bp, Homo sapiens
ctgtgctcatgaacg

SEQ ID NO: 299866 - DNA, 15 bp, Homo sapiens
cctgtgctcatgaac

SEQ ID NO: 299867 - DNA, 15 bp, Homo sapiens
gcctgtgctcatgaa

SEQ ID NO: 299868 - DNA, 15 bp, Homo sapiens
tgcctgtgctcatga

SEQ ID NO: 299869 - DNA, 15 bp, Homo sapiens
gtgcctgtgctcatg

SEQ ID NO: 299870 - DNA, 15 bp, Homo sapiens
ggtgcctgtgctcat

SEQ ID NO: 299871 - DNA, 15 bp, Homo sapiens
tggtgcctgtgctca

SEQ ID NO: 299872 - DNA, 15 bp, Homo sapiens
ctggtgcctgtgctc

SEQ ID NO: 299873 - DNA, 15 bp, Homo sapiens
tctggtgcctgtgct

SEQ ID NO: 299874 - DNA, 15 bp, Homo sapiens
ttctggtgcctgtgc

SEQ ID NO: 299875 - DNA, 15 bp, Homo sapiens
attctggtgcctgtg

SEQ ID NO: 299876 - DNA, 15 bp, Homo sapiens
cattctggtgcctgt

SEQ ID NO: 299877 - DNA, 15 bp, Homo sapiens
ccattctggtgcctg

SEQ ID NO: 299878 - DNA, 15 bp, Homo sapiens
cccattctggtgcct

SEQ ID NO: 299879 - DNA, 15 bp, Homo sapiens
gcccattctggtgcc

SEQ ID NO: 299880 - DNA, 15 bp, Homo sapiens
agcccattctggtgc

SEQ ID NO: 299881 - DNA, 15 bp, Homo sapiens
cagcccattctggtg

SEQ ID NO: 299882 - DNA, 15 bp, Homo sapiens
tcagcccattctggt

SEQ ID NO: 299883 - DNA, 15 bp, Homo sapiens
ctcagcccattctgg

SEQ ID NO: 299884 - DNA, 15 bp, Homo sapiens
actcagcccattctg

SEQ ID NO: 299885 - DNA, 15 bp, Homo sapiens
tactcagcccattct

SEQ ID NO: 299886 - DNA, 15 bp, Homo sapiens
atactcagcccattc

SEQ ID NO: 299887 - DNA, 15 bp, Homo sapiens
aatactcagcccatt

SEQ ID NO: 299888 - DNA, 15 bp, Homo sapiens
caatactcagcccat

SEQ ID NO: 299889 - DNA, 15 bp, Homo sapiens
ccaatactcagccca

SEQ ID NO: 299890 - DNA, 15 bp, Homo sapiens
gccaatactcagccc

SEQ ID NO: 299891 - DNA, 15 bp, Homo sapiens
tgccaatactcagcc

SEQ ID NO: 299892 - DNA, 15 bp, Homo sapiens
atgccaatactcagc

SEQ ID NO: 299893 - DNA, 15 bp, Homo sapiens
aatgccaatactcag

SEQ ID NO: 299894 - DNA, 15 bp, Homo sapiens
aaatgccaatactca

SEQ ID NO: 299895 - DNA, 15 bp, Homo sapiens
taaatgccaatactc

SEQ ID NO: 299896 - DNA, 15 bp, Homo sapiens
ttaaatgccaatact

SEQ ID NO: 299897 - DNA, 15 bp, Homo sapiens
tttaaatgccaatac

SEQ ID NO: 299898 - DNA, 15 bp, Homo sapiens
ttttaaatgccaata

SEQ ID NO: 299899 - DNA, 15 bp, Homo sapiens
tttttaaatgccaat

SEQ ID NO: 299900 - DNA, 15 bp, Homo sapiens
ctttttaaatgccaa

SEQ ID NO: 299901 - DNA, 15 bp, Homo sapiens
actttttaaatgcca

SEQ ID NO: 299902 - DNA, 15 bp, Homo sapiens
aactttttaaatgcc

SEQ ID NO: 299903 - DNA, 15 bp, Homo sapiens
caactttttaaatgc

SEQ ID NO: 299904 - DNA, 15 bp, Homo sapiens
tcaactttttaaatg

SEQ ID NO: 299905 - DNA, 15 bp, Homo sapiens
ttcaactttttaaat

SEQ ID NO: 299906 - DNA, 15 bp, Homo sapiens
cttcaactttttaaa

SEQ ID NO: 299907 - DNA, 15 bp, Homo sapiens
acttcaactttttaa

SEQ ID NO: 299908 - DNA, 15 bp, Homo sapiens
aacttcaacttttta

SEQ ID NO: 299909 - DNA, 15 bp, Homo sapiens
caacttcaacttttt

SEQ ID NO: 299910 - DNA, 15 bp, Homo sapiens
ccaacttcaactttt

SEQ ID NO: 299911 - DNA, 15 bp, Homo sapiens
cccaacttcaacttt

SEQ ID NO: 299912 - DNA, 15 bp, Homo sapiens
ccccaacttcaactt

SEQ ID NO: 299913 - DNA, 15 bp, Homo sapiens
accccaacttcaact

SEQ ID NO: 299914 - DNA, 15 bp, Homo sapiens
aaccccaacttcaac

SEQ ID NO: 299915 - DNA, 15 bp, Homo sapiens
aaaccccaacttcaa

SEQ ID NO: 299916 - DNA, 15 bp, Homo sapiens
caaaccccaacttca

SEQ ID NO: 299917 - DNA, 15 bp, Homo sapiens
tcaaaccccaacttc

SEQ ID NO: 299918 - DNA, 15 bp, Homo sapiens
gtcaaaccccaactt

SEQ ID NO: 299919 - DNA, 15 bp, Homo sapiens
tgtcaaaccccaact

SEQ ID NO: 299920 - DNA, 15 bp, Homo sapiens
ttgtcaaaccccaac

SEQ ID NO: 299921 - DNA, 15 bp, Homo sapiens
tttgtcaaaccccaa

SEQ ID NO: 299922 - DNA, 15 bp, Homo sapiens
ctttgtcaaacccca

SEQ ID NO: 299923 - DNA, 15 bp, Homo sapiens
actttgtcaaacccc

SEQ ID NO: 299924 - DNA, 15 bp, Homo sapiens
cactttgtcaaaccc

SEQ ID NO: 299925 - DNA, 15 bp, Homo sapiens
tcactttgtcaaacc

SEQ ID NO: 299926 - DNA, 15 bp, Homo sapiens
ctcactttgtcaaac

SEQ ID NO: 299927 - DNA, 15 bp, Homo sapiens
actcactttgtcaaa

SEQ ID NO: 299928 - DNA, 15 bp, Homo sapiens
tactcactttgtcaa

SEQ ID NO: 299929 - DNA, 15 bp, Homo sapiens
gtactcactttgtca

SEQ ID NO: 299930 - DNA, 15 bp, Homo sapiens
tgtactcactttgtc

SEQ ID NO: 299931 - DNA, 15 bp, Homo sapiens
ctgtactcactttgt

SEQ ID NO: 299932 - DNA, 15 bp, Homo sapiens
actgtactcactttg

SEQ ID NO: 299933 - DNA, 15 bp, Homo sapiens
cactgtactcacttt

SEQ ID NO: 299934 - DNA, 15 bp, Homo sapiens
tcactgtactcactt

SEQ ID NO: 299935 - DNA, 15 bp, Homo sapiens
atcactgtactcact

SEQ ID NO: 299936 - DNA, 15 bp, Homo sapiens
aatcactgtactcac

SEQ ID NO: 299937 - DNA, 15 bp, Homo sapiens
gaatcactgtactca

SEQ ID NO: 299938 - DNA, 15 bp, Homo sapiens
tgaatcactgtactc

SEQ ID NO: 299939 - DNA, 15 bp, Homo sapiens
ttgaatcactgtact

SEQ ID NO: 299940 - DNA, 15 bp, Homo sapiens
cttgaatcactgtac

SEQ ID NO: 299941 - DNA, 15 bp, Homo sapiens
ccttgaatcactgta

SEQ ID NO: 299942 - DNA, 15 bp, Homo sapiens
cccttgaatcactgt

SEQ ID NO: 299943 - DNA, 15 bp, Homo sapiens
tcccttgaatcactg

SEQ ID NO: 299944 - DNA, 15 bp, Homo sapiens
ttcccttgaatcact

SEQ ID NO: 299945 - DNA, 15 bp, Homo sapiens
cttcccttgaatcac

SEQ ID NO: 299946 - DNA, 15 bp, Homo sapiens
tcttcccttgaatca

SEQ ID NO: 299947 - DNA, 15 bp, Homo sapiens
ctcttcccttgaatc

SEQ ID NO: 299948 - DNA, 15 bp, Homo sapiens
cctcttcccttgaat

SEQ ID NO: 299949 - DNA, 15 bp, Homo sapiens
gcctcttcccttgaa

SEQ ID NO: 299950 - DNA, 15 bp, Homo sapiens
tgcctcttcccttga

SEQ ID NO: 299951 - DNA, 15 bp, Homo sapiens
ttgcctcttcccttg

SEQ ID NO: 299952 - DNA, 15 bp, Homo sapiens
tttgcctcttccctt

SEQ ID NO: 299953 - DNA, 15 bp, Homo sapiens
ctttgcctcttccct

SEQ ID NO: 299954 - DNA, 15 bp, Homo sapiens
tctttgcctcttccc

SEQ ID NO: 299955 - DNA, 15 bp, Homo sapiens
ttctttgcctcttcc

SEQ ID NO: 299956 - DNA, 15 bp, Homo sapiens
cttctttgcctcttc

SEQ ID NO: 299957 - DNA, 15 bp, Homo sapiens
acttctttgcctctt

SEQ ID NO: 299958 - DNA, 15 bp, Homo sapiens
cacttctttgcctct

SEQ ID NO: 299959 - DNA, 15 bp, Homo sapiens
tcacttctttgcctc

SEQ ID NO: 299960 - DNA, 15 bp, Homo sapiens
atcacttctttgcct

SEQ ID NO: 299961 - DNA, 15 bp, Homo sapiens
aatcacttctttgcc

SEQ ID NO: 299962 - DNA, 15 bp, Homo sapiens
taatcacttctttgc

SEQ ID NO: 299963 - DNA, 15 bp, Homo sapiens
ataatcacttctttg

SEQ ID NO: 299964 - DNA, 15 bp, Homo sapiens
tataatcacttcttt

SEQ ID NO: 299965 - DNA, 15 bp, Homo sapiens
ttataatcacttctt

SEQ ID NO: 299966 - DNA, 15 bp, Homo sapiens
attataatcacttct

SEQ ID NO: 299967 - DNA, 15 bp, Homo sapiens
cattataatcacttc

SEQ ID NO: 299968 - DNA, 15 bp, Homo sapiens
tcattataatcactt

SEQ ID NO: 299969 - DNA, 15 bp, Homo sapiens
atcattataatcact

SEQ ID NO: 299970 - DNA, 15 bp, Homo sapiens
aatcattataatcac

SEQ ID NO: 299971 - DNA, 15 bp, Homo sapiens
caatcattataatca

SEQ ID NO: 299972 - DNA, 15 bp, Homo sapiens
tcaatcattataatc

SEQ ID NO: 299973 - DNA, 15 bp, Homo sapiens
ttcaatcattataat

SEQ ID NO: 299974 - DNA, 15 bp, Homo sapiens
gttcaatcattataa

SEQ ID NO: 299975 - DNA, 15 bp, Homo sapiens
ggttcaatcattata

SEQ ID NO: 299976 - DNA, 15 bp, Homo sapiens
tggttcaatcattat

SEQ ID NO: 299977 - DNA, 15 bp, Homo sapiens
ctggttcaatcatta

SEQ ID NO: 299978 - DNA, 15 bp, Homo sapiens
tctggttcaatcatt

SEQ ID NO: 299979 - DNA, 15 bp, Homo sapiens
atctggttcaatcat

SEQ ID NO: 299980 - DNA, 15 bp, Homo sapiens
catctggttcaatca

SEQ ID NO: 299981 - DNA, 15 bp, Homo sapiens
gcatctggttcaatc

SEQ ID NO: 299982 - DNA, 15 bp, Homo sapiens
agcatctggttcaat

SEQ ID NO: 299983 - DNA, 15 bp, Homo sapiens
aagcatctggttcaa

SEQ ID NO: 299984 - DNA, 15 bp, Homo sapiens
taagcatctggttca

SEQ ID NO: 299985 - DNA, 15 bp, Homo sapiens
ttaagcatctggttc

SEQ ID NO: 299986 - DNA, 15 bp, Homo sapiens
cttaagcatctggtt

SEQ ID NO: 299987 - DNA, 15 bp, Homo sapiens
gcttaagcatctggt

SEQ ID NO: 299988 - DNA, 15 bp, Homo sapiens
agcttaagcatctgg

SEQ ID NO: 299989 - DNA, 15 bp, Homo sapiens
gagcttaagcatctg

SEQ ID NO: 299990 - DNA, 15 bp, Homo sapiens
tgagcttaagcatct

SEQ ID NO: 299991 - DNA, 15 bp, Homo sapiens
ctgagcttaagcatc

SEQ ID NO: 299992 - DNA, 15 bp, Homo sapiens
actgagcttaagcat

SEQ ID NO: 299993 - DNA, 15 bp, Homo sapiens
tactgagcttaagca

SEQ ID NO: 299994 - DNA, 15 bp, Homo sapiens
ctactgagcttaagc

SEQ ID NO: 299995 - DNA, 15 bp, Homo sapiens
actactgagcttaag

SEQ ID NO: 299996 - DNA, 15 bp, Homo sapiens
cactactgagcttaa

SEQ ID NO: 299997 - DNA, 15 bp, Homo sapiens
tcactactgagctta

SEQ ID NO: 299998 - DNA, 15 bp, Homo sapiens
ttcactactgagctt

SEQ ID NO: 299999 - DNA, 15 bp, Homo sapiens
tttcactactgagct

SEQ ID NO: 300000 - DNA, 15 bp, Homo sapiens
ctttcactactgagc

SEQ ID NO: 300001 - DNA, 15 bp, Homo sapiens
cctttcactactgag

SEQ ID NO: 300002 - DNA, 15 bp, Homo sapiens
tcctttcactactga

SEQ ID NO: 300003 - DNA, 15 bp, Homo sapiens
ttcctttcactactg

SEQ ID NO: 300004 - DNA, 15 bp, Homo sapiens
attcctttcactact

SEQ ID NO: 300005 - DNA, 15 bp, Homo sapiens
cattcctttcactac

SEQ ID NO: 300006 - DNA, 15 bp, Homo sapiens
tcattcctttcacta

SEQ ID NO: 300007 - DNA, 15 bp, Homo sapiens
ctcattcctttcact

SEQ ID NO: 300008 - DNA, 15 bp, Homo sapiens
cctcattcctttcac

SEQ ID NO: 300009 - DNA, 15 bp, Homo sapiens
tcctcattcctttca

SEQ ID NO: 300010 - DNA, 15 bp, Homo sapiens
ttcctcattcctttc

SEQ ID NO: 300011 - DNA, 15 bp, Homo sapiens
tttcctcattccttt

SEQ ID NO: 300012 - DNA, 15 bp, Homo sapiens
atttcctcattcctt

SEQ ID NO: 300013 - DNA, 15 bp, Homo sapiens
catttcctcattcct

SEQ ID NO: 300014 - DNA, 15 bp, Homo sapiens
acatttcctcattcc

SEQ ID NO: 300015 - DNA, 15 bp, Homo sapiens
gacatttcctcattc

SEQ ID NO: 300016 - DNA, 15 bp, Homo sapiens
ggacatttcctcatt

SEQ ID NO: 300017 - DNA, 15 bp, Homo sapiens
tggacatttcctcat

SEQ ID NO: 300018 - DNA, 15 bp, Homo sapiens
ctggacatttcctca

SEQ ID NO: 300019 - DNA, 15 bp, Homo sapiens
actggacatttcctc

SEQ ID NO: 300020 - DNA, 15 bp, Homo sapiens
cactggacatttcct

SEQ ID NO: 300021 - DNA, 15 bp, Homo sapiens
acactggacatttcc

SEQ ID NO: 300022 - DNA, 15 bp, Homo sapiens
cacactggacatttc

SEQ ID NO: 300023 - DNA, 15 bp, Homo sapiens
ccacactggacattt

SEQ ID NO: 300024 - DNA, 15 bp, Homo sapiens
cccacactggacatt

SEQ ID NO: 300025 - DNA, 15 bp, Homo sapiens
tcccacactggacat

SEQ ID NO: 300026 - DNA, 15 bp, Homo sapiens
ctcccacactggaca

SEQ ID NO: 300027 - DNA, 15 bp, Homo sapiens
tctcccacactggac

SEQ ID NO: 300028 - DNA, 15 bp, Homo sapiens
gtctcccacactgga

SEQ ID NO: 300029 - DNA, 15 bp, Homo sapiens
tgtctcccacactgg

SEQ ID NO: 300030 - DNA, 15 bp, Homo sapiens
ctgtctcccacactg

SEQ ID NO: 300031 - DNA, 15 bp, Homo sapiens
tctgtctcccacact

SEQ ID NO: 300032 - DNA, 15 bp, Homo sapiens
ttctgtctcccacac

SEQ ID NO: 300033 - DNA, 15 bp, Homo sapiens
tttctgtctcccaca

SEQ ID NO: 300034 - DNA, 15 bp, Homo sapiens
atttctgtctcccac

SEQ ID NO: 300035 - DNA, 15 bp, Homo sapiens
tatttctgtctccca

SEQ ID NO: 300036 - DNA, 15 bp, Homo sapiens
ttatttctgtctccc

SEQ ID NO: 300037 - DNA, 15 bp, Homo sapiens
tttatttctgtctcc

SEQ ID NO: 300038 - DNA, 15 bp, Homo sapiens
ctttatttctgtctc

SEQ ID NO: 300039 - DNA, 15 bp, Homo sapiens
tctttatttctgtct

SEQ ID NO: 300040 - DNA, 15 bp, Homo sapiens
atctttatttctgtc

SEQ ID NO: 300041 - DNA, 15 bp, Homo sapiens
catctttatttctgt

SEQ ID NO: 300042 - DNA, 15 bp, Homo sapiens
ccatctttatttctg

SEQ ID NO: 300043 - DNA, 15 bp, Homo sapiens
cccatctttatttct

SEQ ID NO: 300044 - DNA, 15 bp, Homo sapiens
tcccatctttatttc

SEQ ID NO: 300045 - DNA, 15 bp, Homo sapiens
ctcccatctttattt

SEQ ID NO: 300046 - DNA, 15 bp, Homo sapiens
cctcccatctttatt

SEQ ID NO: 300047 - DNA, 15 bp, Homo sapiens
tcctcccatctttat

SEQ ID NO: 300048 - DNA, 15 bp, Homo sapiens
atcctcccatcttta

SEQ ID NO: 300049 - DNA, 15 bp, Homo sapiens
gatcctcccatcttt

SEQ ID NO: 300050 - DNA, 15 bp, Homo sapiens
tgatcctcccatctt

SEQ ID NO: 300051 - DNA, 15 bp, Homo sapiens
ttgatcctcccatct

SEQ ID NO: 300052 - DNA, 15 bp, Homo sapiens
attgatcctcccatc

SEQ ID NO: 300053 - DNA, 15 bp, Homo sapiens
cattgatcctcccat

SEQ ID NO: 300054 - DNA, 15 bp, Homo sapiens
ccattgatcctccca

SEQ ID NO: 300055 - DNA, 15 bp, Homo sapiens
tccattgatcctccc

SEQ ID NO: 300056 - DNA, 15 bp, Homo sapiens
atccattgatcctcc

SEQ ID NO: 300057 - DNA, 15 bp, Homo sapiens
gatccattgatcctc

SEQ ID NO: 300058 - DNA, 15 bp, Homo sapiens
ggatccattgatcct

SEQ ID NO: 300059 - DNA, 15 bp, Homo sapiens
aggatccattgatcc

SEQ ID NO: 300060 - DNA, 15 bp, Homo sapiens
taggatccattgatc

SEQ ID NO: 300061 - DNA, 15 bp, Homo sapiens
ataggatccattgat

SEQ ID NO: 300062 - DNA, 15 bp, Homo sapiens
aataggatccattga

SEQ ID NO: 300063 - DNA, 15 bp, Homo sapiens
caataggatccattg

SEQ ID NO: 300064 - DNA, 15 bp, Homo sapiens
acaataggatccatt

SEQ ID NO: 300065 - DNA, 15 bp, Homo sapiens
gacaataggatccat

SEQ ID NO: 300066 - DNA, 15 bp, Homo sapiens
tgacaataggatcca

SEQ ID NO: 300067 - DNA, 15 bp, Homo sapiens
ttgacaataggatcc

SEQ ID NO: 300068 - DNA, 15 bp, Homo sapiens
tttgacaataggatc

SEQ ID NO: 300069 - DNA, 15 bp, Homo sapiens
ctttgacaataggat

SEQ ID NO: 300070 - DNA, 15 bp, Homo sapiens
cctttgacaatagga

SEQ ID NO: 300071 - DNA, 15 bp, Homo sapiens
tcctttgacaatagg

SEQ ID NO: 300072 - DNA, 15 bp, Homo sapiens
atcctttgacaatag

SEQ ID NO: 300073 - DNA, 15 bp, Homo sapiens
catcctttgacaata

SEQ ID NO: 300074 - DNA, 15 bp, Homo sapiens
ccatcctttgacaat

SEQ ID NO: 300075 - DNA, 15 bp, Homo sapiens
tccatcctttgacaa

SEQ ID NO: 300076 - DNA, 15 bp, Homo sapiens
atccatcctttgaca

SEQ ID NO: 300077 - DNA, 15 bp, Homo sapiens
tatccatcctttgac

SEQ ID NO: 300078 - DNA, 15 bp, Homo sapiens
ttatccatcctttga

SEQ ID NO: 300079 - DNA, 15 bp, Homo sapiens
tttatccatcctttg

SEQ ID NO: 300080 - DNA, 15 bp, Homo sapiens
atttatccatccttt

SEQ ID NO: 300081 - DNA, 15 bp, Homo sapiens
aatttatccatcctt

SEQ ID NO: 300082 - DNA, 15 bp, Homo sapiens
aaatttatccatcct

SEQ ID NO: 300083 - DNA, 15 bp, Homo sapiens
caaatttatccatcc

SEQ ID NO: 300084 - DNA, 15 bp, Homo sapiens
gcaaatttatccatc

SEQ ID NO: 300085 - DNA, 15 bp, Homo sapiens
tgcaaatttatccat

SEQ ID NO: 300086 - DNA, 15 bp, Homo sapiens
ctgcaaatttatcca

SEQ ID NO: 300087 - DNA, 15 bp, Homo sapiens
actgcaaatttatcc

SEQ ID NO: 300088 - DNA, 15 bp, Homo sapiens
aactgcaaatttatc

SEQ ID NO: 300089 - DNA, 15 bp, Homo sapiens
caactgcaaatttat

SEQ ID NO: 300090 - DNA, 15 bp, Homo sapiens
acaactgcaaattta

SEQ ID NO: 300091 - DNA, 15 bp, Homo sapiens
tacaactgcaaattt

SEQ ID NO: 300092 - DNA, 15 bp, Homo sapiens
ctacaactgcaaatt

SEQ ID NO: 300093 - DNA, 15 bp, Homo sapiens
cctacaactgcaaat

SEQ ID NO: 300094 - DNA, 15 bp, Homo sapiens
ccctacaactgcaaa

SEQ ID NO: 300095 - DNA, 15 bp, Homo sapiens
cccctacaactgcaa

SEQ ID NO: 300096 - DNA, 15 bp, Homo sapiens
tcccctacaactgca

SEQ ID NO: 300097 - DNA, 15 bp, Homo sapiens
ttcccctacaactgc

SEQ ID NO: 300098 - DNA, 15 bp, Homo sapiens
cttcccctacaactg

SEQ ID NO: 300099 - DNA, 15 bp, Homo sapiens
acttcccctacaact

SEQ ID NO: 300100 - DNA, 15 bp, Homo sapiens
tacttcccctacaac

SEQ ID NO: 300101 - DNA, 15 bp, Homo sapiens
ttacttcccctacaa

SEQ ID NO: 300102 - DNA, 15 bp, Homo sapiens
cttacttcccctaca

SEQ ID NO: 300103 - DNA, 15 bp, Homo sapiens
gcttacttcccctac

SEQ ID NO: 300104 - DNA, 15 bp, Homo sapiens
agcttacttccccta

SEQ ID NO: 300105 - DNA, 15 bp, Homo sapiens
cagcttacttcccct

SEQ ID NO: 300106 - DNA, 15 bp, Homo sapiens
acagcttacttcccc

SEQ ID NO: 300107 - DNA, 15 bp, Homo sapiens
cacagcttacttccc

SEQ ID NO: 300108 - DNA, 15 bp, Homo sapiens
ccacagcttacttcc

SEQ ID NO: 300109 - DNA, 15 bp, Homo sapiens
tccacagcttacttc

SEQ ID NO: 300110 - DNA, 15 bp, Homo sapiens
ctccacagcttactt

SEQ ID NO: 300111 - DNA, 15 bp, Homo sapiens
cctccacagcttact

SEQ ID NO: 300112 - DNA, 15 bp, Homo sapiens
acctccacagcttac

SEQ ID NO: 300113 - DNA, 15 bp, Homo sapiens
tacctccacagctta

SEQ ID NO: 300114 - DNA, 15 bp, Homo sapiens
ctacctccacagctt

SEQ ID NO: 300115 - DNA, 15 bp, Homo sapiens
tctacctccacagct

SEQ ID NO: 300116 - DNA, 15 bp, Homo sapiens
ctctacctccacagc

SEQ ID NO: 300117 - DNA, 15 bp, Homo sapiens
cctctacctccacag

SEQ ID NO: 300118 - DNA, 15 bp, Homo sapiens
acctctacctccaca

SEQ ID NO: 300119 - DNA, 15 bp, Homo sapiens
cacctctacctccac

SEQ ID NO: 300120 - DNA, 15 bp, Homo sapiens
ccacctctacctcca

SEQ ID NO: 300121 - DNA, 15 bp, Homo sapiens
accacctctacctcc

SEQ ID NO: 300122 - DNA, 15 bp, Homo sapiens
aaccacctctacctc

SEQ ID NO: 300123 - DNA, 15 bp, Homo sapiens
caaccacctctacct

SEQ ID NO: 300124 - DNA, 15 bp, Homo sapiens
acaaccacctctacc

SEQ ID NO: 300125 - DNA, 15 bp, Homo sapiens
gacaaccacctctac

SEQ ID NO: 300126 - DNA, 15 bp, Homo sapiens
tgacaaccacctcta

SEQ ID NO: 300127 - DNA, 15 bp, Homo sapiens
ctgacaaccacctct

SEQ ID NO: 300128 - DNA, 15 bp, Homo sapiens
tctgacaaccacctc

SEQ ID NO: 300129 - DNA, 15 bp, Homo sapiens
ttctgacaaccacct

SEQ ID NO: 300130 - DNA, 15 bp, Homo sapiens
cttctgacaaccacc

SEQ ID NO: 300131 - DNA, 15 bp, Homo sapiens
gcttctgacaaccac

SEQ ID NO: 300132 - DNA, 15 bp, Homo sapiens
agcttctgacaacca

SEQ ID NO: 300133 - DNA, 15 bp, Homo sapiens
tagcttctgacaacc

SEQ ID NO: 300134 - DNA, 15 bp, Homo sapiens
ctagcttctgacaac

SEQ ID NO: 300135 - DNA, 15 bp, Homo sapiens
cctagcttctgacaa

SEQ ID NO: 300136 - DNA, 15 bp, Homo sapiens
acctagcttctgaca

SEQ ID NO: 300137 - DNA, 15 bp, Homo sapiens
aacctagcttctgac

SEQ ID NO: 300138 - DNA, 15 bp, Homo sapiens
caacctagcttctga

SEQ ID NO: 300139 - DNA, 15 bp, Homo sapiens
tcaacctagcttctg

SEQ ID NO: 300140 - DNA, 15 bp, Homo sapiens
ttcaacctagcttct

SEQ ID NO: 300141 - DNA, 15 bp, Homo sapiens
attcaacctagcttc

SEQ ID NO: 300142 - DNA, 15 bp, Homo sapiens
cattcaacctagctt

SEQ ID NO: 300143 - DNA, 15 bp, Homo sapiens
tcattcaacctagct

SEQ ID NO: 300144 - DNA, 15 bp, Homo sapiens
atcattcaacctagc

SEQ ID NO: 300145 - DNA, 15 bp, Homo sapiens
tatcattcaacctag

SEQ ID NO: 300146 - DNA, 15 bp, Homo sapiens
gtatcattcaaccta

SEQ ID NO: 300147 - DNA, 15 bp, Homo sapiens
agtatcattcaacct

SEQ ID NO: 300148 - DNA, 15 bp, Homo sapiens
cagtatcattcaacc

SEQ ID NO: 300149 - DNA, 15 bp, Homo sapiens
tcagtatcattcaac

SEQ ID NO: 300150 - DNA, 15 bp, Homo sapiens
ttcagtatcattcaa

SEQ ID NO: 300151 - DNA, 15 bp, Homo sapiens
tttcagtatcattca

SEQ ID NO: 300152 - DNA, 15 bp, Homo sapiens
atttcagtatcattc

SEQ ID NO: 300153 - DNA, 15 bp, Homo sapiens
aatttcagtatcatt

SEQ ID NO: 300154 - DNA, 15 bp, Homo sapiens
taatttcagtatcat

SEQ ID NO: 300155 - DNA, 15 bp, Homo sapiens
ctaatttcagtatca

SEQ ID NO: 300156 - DNA, 15 bp, Homo sapiens
tctaatttcagtatc

SEQ ID NO: 300157 - DNA, 15 bp, Homo sapiens
ctctaatttcagtat

SEQ ID NO: 300158 - DNA, 15 bp, Homo sapiens
cctctaatttcagta

SEQ ID NO: 300159 - DNA, 15 bp, Homo sapiens
ccctctaatttcagt

SEQ ID NO: 300160 - DNA, 15 bp, Homo sapiens
cccctctaatttcag

SEQ ID NO: 300161 - DNA, 15 bp, Homo sapiens
acccctctaatttca

SEQ ID NO: 300162 - DNA, 15 bp, Homo sapiens
aacccctctaatttc

SEQ ID NO: 300163 - DNA, 15 bp, Homo sapiens
caacccctctaattt

SEQ ID NO: 300164 - DNA, 15 bp, Homo sapiens
gcaacccctctaatt

SEQ ID NO: 300165 - DNA, 15 bp, Homo sapiens
tgcaacccctctaat

SEQ ID NO: 300166 - DNA, 15 bp, Homo sapiens
ttgcaacccctctaa

SEQ ID NO: 300167 - DNA, 15 bp, Homo sapiens
cttgcaacccctcta

SEQ ID NO: 300168 - DNA, 15 bp, Homo sapiens
acttgcaacccctct

SEQ ID NO: 300169 - DNA, 15 bp, Homo sapiens
tacttgcaacccctc

SEQ ID NO: 300170 - DNA, 15 bp, Homo sapiens
atacttgcaacccct

SEQ ID NO: 300171 - DNA, 15 bp, Homo sapiens
aatacttgcaacccc

SEQ ID NO: 300172 - DNA, 15 bp, Homo sapiens
caatacttgcaaccc

SEQ ID NO: 300173 - DNA, 15 bp, Homo sapiens
ccaatacttgcaacc

SEQ ID NO: 300174 - DNA, 15 bp, Homo sapiens
accaatacttgcaac

SEQ ID NO: 300175 - DNA, 15 bp, Homo sapiens
taccaatacttgcaa

SEQ ID NO: 300176 - DNA, 15 bp, Homo sapiens
ttaccaatacttgca

SEQ ID NO: 300177 - DNA, 15 bp, Homo sapiens
attaccaatacttgc

SEQ ID NO: 300178 - DNA, 15 bp, Homo sapiens
cattaccaatacttg

SEQ ID NO: 300179 - DNA, 15 bp, Homo sapiens
ccattaccaatactt

SEQ ID NO: 300180 - DNA, 15 bp, Homo sapiens
accattaccaatact

SEQ ID NO: 300181 - DNA, 15 bp, Homo sapiens
gaccattaccaatac

SEQ ID NO: 300182 - DNA, 15 bp, Homo sapiens
ggaccattaccaata

SEQ ID NO: 300183 - DNA, 15 bp, Homo sapiens
tggaccattaccaat

SEQ ID NO: 300184 - DNA, 15 bp, Homo sapiens
atggaccattaccaa

SEQ ID NO: 300185 - DNA, 15 bp, Homo sapiens
tatggaccattacca

SEQ ID NO: 300186 - DNA, 15 bp, Homo sapiens
atatggaccattacc

SEQ ID NO: 300187 - DNA, 15 bp, Homo sapiens
aatatggaccattac

SEQ ID NO: 300188 - DNA, 15 bp, Homo sapiens
aaatatggaccatta

SEQ ID NO: 300189 - DNA, 15 bp, Homo sapiens
caaatatggaccatt

SEQ ID NO: 300190 - DNA, 15 bp, Homo sapiens
ccaaatatggaccat

SEQ ID NO: 300191 - DNA, 15 bp, Homo sapiens
tccaaatatggacca

SEQ ID NO: 300192 - DNA, 15 bp, Homo sapiens
gtccaaatatggacc

SEQ ID NO: 300193 - DNA, 15 bp, Homo sapiens
ggtccaaatatggac

SEQ ID NO: 300194 - DNA, 15 bp, Homo sapiens
aggtccaaatatgga

SEQ ID NO: 300195 - DNA, 15 bp, Homo sapiens
aaggtccaaatatgg

SEQ ID NO: 300196 - DNA, 15 bp, Homo sapiens
aaaggtccaaatatg

SEQ ID NO: 300197 - DNA, 15 bp, Homo sapiens
caaaggtccaaatat

SEQ ID NO: 300198 - DNA, 15 bp, Homo sapiens
acaaaggtccaaata

SEQ ID NO: 300199 - DNA, 15 bp, Homo sapiens
cacaaaggtccaaat

SEQ ID NO: 300200 - DNA, 15 bp, Homo sapiens
acacaaaggtccaaa

SEQ ID NO: 300201 - DNA, 15 bp, Homo sapiens
cacacaaaggtccaa

SEQ ID NO: 300202 - DNA, 15 bp, Homo sapiens
tcacacaaaggtcca

SEQ ID NO: 300203 - DNA, 15 bp, Homo sapiens
ttcacacaaaggtcc

SEQ ID NO: 300204 - DNA, 15 bp, Homo sapiens
attcacacaaaggtc

SEQ ID NO: 300205 - DNA, 15 bp, Homo sapiens
cattcacacaaaggt

SEQ ID NO: 300206 - DNA, 15 bp, Homo sapiens
ccattcacacaaagg

SEQ ID NO: 300207 - DNA, 15 bp, Homo sapiens
gccattcacacaaag

SEQ ID NO: 300208 - DNA, 15 bp, Homo sapiens
agccattcacacaaa

SEQ ID NO: 300209 - DNA, 15 bp, Homo sapiens
tagccattcacacaa

SEQ ID NO: 300210 - DNA, 15 bp, Homo sapiens
ttagccattcacaca

SEQ ID NO: 300211 - DNA, 15 bp, Homo sapiens
cttagccattcacac

SEQ ID NO: 300212 - DNA, 15 bp, Homo sapiens
tcttagccattcaca

SEQ ID NO: 300213 - DNA, 15 bp, Homo sapiens
ttcttagccattcac

SEQ ID NO: 300214 - DNA, 15 bp, Homo sapiens
cttcttagccattca

SEQ ID NO: 300215 - DNA, 15 bp, Homo sapiens
ccttcttagccattc

SEQ ID NO: 300216 - DNA, 15 bp, Homo sapiens
accttcttagccatt

SEQ ID NO: 300217 - DNA, 15 bp, Homo sapiens
aaccttcttagccat

SEQ ID NO: 300218 - DNA, 15 bp, Homo sapiens
caaccttcttagcca

SEQ ID NO: 300219 - DNA, 15 bp, Homo sapiens
ccaaccttcttagcc

SEQ ID NO: 300220 - DNA, 15 bp, Homo sapiens
tccaaccttcttagc

SEQ ID NO: 300221 - DNA, 15 bp, Homo sapiens
ctccaaccttcttag

SEQ ID NO: 300222 - DNA, 15 bp, Homo sapiens
cctccaaccttctta

SEQ ID NO: 300223 - DNA, 15 bp, Homo sapiens
tcctccaaccttctt

SEQ ID NO: 300224 - DNA, 15 bp, Homo sapiens
gtcctccaaccttct

SEQ ID NO: 300225 - DNA, 15 bp, Homo sapiens
tgtcctccaaccttc

SEQ ID NO: 300226 - DNA, 15 bp, Homo sapiens
ctgtcctccaacctt

SEQ ID NO: 300227 - DNA, 15 bp, Homo sapiens
cctgtcctccaacct

SEQ ID NO: 300228 - DNA, 15 bp, Homo sapiens
tcctgtcctccaacc

SEQ ID NO: 300229 - DNA, 15 bp, Homo sapiens
gtcctgtcctccaac

SEQ ID NO: 300230 - DNA, 15 bp, Homo sapiens
ggtcctgtcctccaa

SEQ ID NO: 300231 - DNA, 15 bp, Homo sapiens
tggtcctgtcctcca

SEQ ID NO: 300232 - DNA, 15 bp, Homo sapiens
atggtcctgtcctcc

SEQ ID NO: 300233 - DNA, 15 bp, Homo sapiens
aatggtcctgtcctc

SEQ ID NO: 300234 - DNA, 15 bp, Homo sapiens
caatggtcctgtcct

SEQ ID NO: 300235 - DNA, 15 bp, Homo sapiens
ccaatggtcctgtcc

SEQ ID NO: 300236 - DNA, 15 bp, Homo sapiens
tccaatggtcctgtc

SEQ ID NO: 300237 - DNA, 15 bp, Homo sapiens
ctccaatggtcctgt

SEQ ID NO: 300238 - DNA, 15 bp, Homo sapiens
cctccaatggtcctg

SEQ ID NO: 300239 - DNA, 15 bp, Homo sapiens
tcctccaatggtcct

SEQ ID NO: 300240 - DNA, 15 bp, Homo sapiens
ttcctccaatggtcc

SEQ ID NO: 300241 - DNA, 15 bp, Homo sapiens
tttcctccaatggtc

SEQ ID NO: 300242 - DNA, 15 bp, Homo sapiens
ttttcctccaatggt

SEQ ID NO: 300243 - DNA, 15 bp, Homo sapiens
cttttcctccaatgg

SEQ ID NO: 300244 - DNA, 15 bp, Homo sapiens
tcttttcctccaatg

SEQ ID NO: 300245 - DNA, 15 bp, Homo sapiens
ctcttttcctccaat

SEQ ID NO: 300246 - DNA, 15 bp, Homo sapiens
gctcttttcctccaa

SEQ ID NO: 300247 - DNA, 15 bp, Homo sapiens
ggctcttttcctcca

SEQ ID NO: 300248 - DNA, 15 bp, Homo sapiens
aggctcttttcctcc

SEQ ID NO: 300249 - DNA, 15 bp, Homo sapiens
taggctcttttcctc

SEQ ID NO: 300250 - DNA, 15 bp, Homo sapiens
ttaggctcttttcct

SEQ ID NO: 300251 - DNA, 15 bp, Homo sapiens
tttaggctcttttcc

SEQ ID NO: 300252 - DNA, 15 bp, Homo sapiens
ctttaggctcttttc

SEQ ID NO: 300253 - DNA, 15 bp, Homo sapiens
tctttaggctctttt

SEQ ID NO: 300254 - DNA, 15 bp, Homo sapiens
ttctttaggctcttt

SEQ ID NO: 300255 - DNA, 15 bp, Homo sapiens
gttctttaggctctt

SEQ ID NO: 300256 - DNA, 15 bp, Homo sapiens
ggttctttaggctct

SEQ ID NO: 300257 - DNA, 15 bp, Homo sapiens
tggttctttaggctc

SEQ ID NO: 300258 - DNA, 15 bp, Homo sapiens
ttggttctttaggct

SEQ ID NO: 300259 - DNA, 15 bp, Homo sapiens
cttggttctttaggc

SEQ ID NO: 300260 - DNA, 15 bp, Homo sapiens
tcttggttctttagg

SEQ ID NO: 300261 - DNA, 15 bp, Homo sapiens
ttcttggttctttag

SEQ ID NO: 300262 - DNA, 15 bp, Homo sapiens
cttcttggttcttta

SEQ ID NO: 300263 - DNA, 15 bp, Homo sapiens
gcttcttggttcttt

SEQ ID NO: 300264 - DNA, 15 bp, Homo sapiens
ggcttcttggttctt

SEQ ID NO: 300265 - DNA, 15 bp, Homo sapiens
tggcttcttggttct

SEQ ID NO: 300266 - DNA, 15 bp, Homo sapiens
ctggcttcttggttc

SEQ ID NO: 300267 - DNA, 15 bp, Homo sapiens
tctggcttcttggtt

SEQ ID NO: 300268 - DNA, 15 bp, Homo sapiens
ctctggcttcttggt

SEQ ID NO: 300269 - DNA, 15 bp, Homo sapiens
actctggcttcttgg

SEQ ID NO: 300270 - DNA, 15 bp, Homo sapiens
cactctggcttcttg

SEQ ID NO: 300271 - DNA, 15 bp, Homo sapiens
gcactctggcttctt

SEQ ID NO: 300272 - DNA, 15 bp, Homo sapiens
agcactctggcttct

SEQ ID NO: 300273 - DNA, 15 bp, Homo sapiens
cagcactctggcttc

SEQ ID NO: 300274 - DNA, 15 bp, Homo sapiens
ccagcactctggctt

SEQ ID NO: 300275 - DNA, 15 bp, Homo sapiens
tccagcactctggct

SEQ ID NO: 300276 - DNA, 15 bp, Homo sapiens
ttccagcactctggc

SEQ ID NO: 300277 - DNA, 15 bp, Homo sapiens
cttccagcactctgg

SEQ ID NO: 300278 - DNA, 15 bp, Homo sapiens
tcttccagcactctg

SEQ ID NO: 300279 - DNA, 15 bp, Homo sapiens
ttcttccagcactct

SEQ ID NO: 300280 - DNA, 15 bp, Homo sapiens
attcttccagcactc

SEQ ID NO: 300281 - DNA, 15 bp, Homo sapiens
gattcttccagcact

SEQ ID NO: 300282 - DNA, 15 bp, Homo sapiens
tgattcttccagcac

SEQ ID NO: 300283 - DNA, 15 bp, Homo sapiens
atgattcttccagca

SEQ ID NO: 300284 - DNA, 15 bp, Homo sapiens
gatgattcttccagc

SEQ ID NO: 300285 - DNA, 15 bp, Homo sapiens
agatgattcttccag

SEQ ID NO: 300286 - DNA, 15 bp, Homo sapiens
gagatgattcttcca

SEQ ID NO: 300287 - DNA, 15 bp, Homo sapiens
ggagatgattcttcc

SEQ ID NO: 300288 - DNA, 15 bp, Homo sapiens
tggagatgattcttc

SEQ ID NO: 300289 - DNA, 15 bp, Homo sapiens
atggagatgattctt

SEQ ID NO: 300290 - DNA, 15 bp, Homo sapiens
catggagatgattct

SEQ ID NO: 300291 - DNA, 15 bp, Homo sapiens
ccatggagatgattc

SEQ ID NO: 300292 - DNA, 15 bp, Homo sapiens
cccatggagatgatt

SEQ ID NO: 300293 - DNA, 15 bp, Homo sapiens
acccatggagatgat

SEQ ID NO: 300294 - DNA, 15 bp, Homo sapiens
cacccatggagatga

SEQ ID NO: 300295 - DNA, 15 bp, Homo sapiens
acacccatggagatg

SEQ ID NO: 300296 - DNA, 15 bp, Homo sapiens
aacacccatggagat

SEQ ID NO: 300297 - DNA, 15 bp, Homo sapiens
caacacccatggaga

SEQ ID NO: 300298 - DNA, 15 bp, Homo sapiens
tcaacacccatggag

SEQ ID NO: 300299 - DNA, 15 bp, Homo sapiens
ttcaacacccatgga

SEQ ID NO: 300300 - DNA, 15 bp, Homo sapiens
tttcaacacccatgg

SEQ ID NO: 300301 - DNA, 15 bp, Homo sapiens
atttcaacacccatg

SEQ ID NO: 300302 - DNA, 15 bp, Homo sapiens
gatttcaacacccat

SEQ ID NO: 300303 - DNA, 15 bp, Homo sapiens
tgatttcaacaccca

SEQ ID NO: 300304 - DNA, 15 bp, Homo sapiens
gtgatttcaacaccc

SEQ ID NO: 300305 - DNA, 15 bp, Homo sapiens
agtgatttcaacacc

SEQ ID NO: 300306 - DNA, 15 bp, Homo sapiens
tagtgatttcaacac

SEQ ID NO: 300307 - DNA, 15 bp, Homo sapiens
ttagtgatttcaaca

SEQ ID NO: 300308 - DNA, 15 bp, Homo sapiens
gttagtgatttcaac

SEQ ID NO: 300309 - DNA, 15 bp, Homo sapiens
tgttagtgatttcaa

SEQ ID NO: 300310 - DNA, 15 bp, Homo sapiens
atgttagtgatttca

SEQ ID NO: 300311 - DNA, 15 bp, Homo sapiens
aatgttagtgatttc

SEQ ID NO: 300312 - DNA, 15 bp, Homo sapiens
aaatgttagtgattt

SEQ ID NO: 300313 - DNA, 15 bp, Homo sapiens
taaatgttagtgatt

SEQ ID NO: 300314 - DNA, 15 bp, Homo sapiens
ttaaatgttagtgat

SEQ ID NO: 300315 - DNA, 15 bp, Homo sapiens
tttaaatgttagtga

SEQ ID NO: 300316 - DNA, 15 bp, Homo sapiens
ttttaaatgttagtg

SEQ ID NO: 300317 - DNA, 15 bp, Homo sapiens
tttttaaatgttagt

SEQ ID NO: 300318 - DNA, 15 bp, Homo sapiens
atttttaaatgttag

SEQ ID NO: 300319 - DNA, 15 bp, Homo sapiens
catttttaaatgtta

SEQ ID NO: 300320 - DNA, 15 bp, Homo sapiens
ccatttttaaatgtt

SEQ ID NO: 300321 - DNA, 15 bp, Homo sapiens
gccatttttaaatgt

SEQ ID NO: 300322 - DNA, 15 bp, Homo sapiens
agccatttttaaatg

SEQ ID NO: 300323 - DNA, 15 bp, Homo sapiens
aagccatttttaaat

SEQ ID NO: 300324 - DNA, 15 bp, Homo sapiens
aaagccatttttaaa

SEQ ID NO: 300325 - DNA, 15 bp, Homo sapiens
taaagccatttttaa

SEQ ID NO: 300326 - DNA, 15 bp, Homo sapiens
ctaaagccattttta

SEQ ID NO: 300327 - DNA, 15 bp, Homo sapiens
tctaaagccattttt

SEQ ID NO: 300328 - DNA, 15 bp, Homo sapiens
ctctaaagccatttt

SEQ ID NO: 300329 - DNA, 15 bp, Homo sapiens
actctaaagccattt

SEQ ID NO: 300330 - DNA, 15 bp, Homo sapiens
tactctaaagccatt

SEQ ID NO: 300331 - DNA, 15 bp, Homo sapiens
ctactctaaagccat

SEQ ID NO: 300332 - DNA, 15 bp, Homo sapiens
cctactctaaagcca

SEQ ID NO: 300333 - DNA, 15 bp, Homo sapiens
ccctactctaaagcc

SEQ ID NO: 300334 - DNA, 15 bp, Homo sapiens
cccctactctaaagc

SEQ ID NO: 300335 - DNA, 15 bp, Homo sapiens
tcccctactctaaag

SEQ ID NO: 300336 - DNA, 15 bp, Homo sapiens
gtcccctactctaaa

SEQ ID NO: 300337 - DNA, 15 bp, Homo sapiens
agtcccctactctaa

SEQ ID NO: 300338 - DNA, 15 bp, Homo sapiens
aagtcccctactcta

SEQ ID NO: 300339 - DNA, 15 bp, Homo sapiens
aaagtcccctactct

SEQ ID NO: 300340 - DNA, 15 bp, Homo sapiens
caaagtcccctactc

SEQ ID NO: 300341 - DNA, 15 bp, Homo sapiens
tcaaagtcccctact

SEQ ID NO: 300342 - DNA, 15 bp, Homo sapiens
ctcaaagtcccctac

SEQ ID NO: 300343 - DNA, 15 bp, Homo sapiens
gctcaaagtccccta

SEQ ID NO: 300344 - DNA, 15 bp, Homo sapiens
ggctcaaagtcccct

SEQ ID NO: 300345 - DNA, 15 bp, Homo sapiens
tggctcaaagtcccc

SEQ ID NO: 300346 - DNA, 15 bp, Homo sapiens
atggctcaaagtccc

SEQ ID NO: 300347 - DNA, 15 bp, Homo sapiens
aatggctcaaagtcc

SEQ ID NO: 300348 - DNA, 15 bp, Homo sapiens
aaatggctcaaagtc

SEQ ID NO: 300349 - DNA, 15 bp, Homo sapiens
aaaatggctcaaagt

SEQ ID NO: 300350 - DNA, 15 bp, Homo sapiens
aaaaatggctcaaag

SEQ ID NO: 300351 - DNA, 15 bp, Homo sapiens
aaaaaatggctcaaa

SEQ ID NO: 300352 - DNA, 15 bp, Homo sapiens
taaaaaatggctcaa

SEQ ID NO: 300353 - DNA, 15 bp, Homo sapiens
gtaaaaaatggctca

SEQ ID NO: 300354 - DNA, 15 bp, Homo sapiens
agtaaaaaatggctc

SEQ ID NO: 300355 - DNA, 15 bp, Homo sapiens
aagtaaaaaatggct

SEQ ID NO: 300356 - DNA, 15 bp, Homo sapiens
gaagtaaaaaatggc

SEQ ID NO: 300357 - DNA, 15 bp, Homo sapiens
tgaagtaaaaaatgg

SEQ ID NO: 300358 - DNA, 15 bp, Homo sapiens
ttgaagtaaaaaatg

SEQ ID NO: 300359 - DNA, 15 bp, Homo sapiens
cttgaagtaaaaaat

SEQ ID NO: 300360 - DNA, 15 bp, Homo sapiens
tcttgaagtaaaaaa

SEQ ID NO: 300361 - DNA, 15 bp, Homo sapiens
ttcttgaagtaaaaa

SEQ ID NO: 300362 - DNA, 15 bp, Homo sapiens
cttcttgaagtaaaa

SEQ ID NO: 300363 - DNA, 15 bp, Homo sapiens
acttcttgaagtaaa

SEQ ID NO: 300364 - DNA, 15 bp, Homo sapiens
cacttcttgaagtaa

SEQ ID NO: 300365 - DNA, 15 bp, Homo sapiens
tcacttcttgaagta

SEQ ID NO: 300366 - DNA, 15 bp, Homo sapiens
ttcacttcttgaagt

SEQ ID NO: 300367 - DNA, 15 bp, Homo sapiens
cttcacttcttgaag

SEQ ID NO: 300368 - DNA, 15 bp, Homo sapiens
ccttcacttcttgaa

SEQ ID NO: 300369 - DNA, 15 bp, Homo sapiens
tccttcacttcttga

SEQ ID NO: 300370 - DNA, 15 bp, Homo sapiens
ttccttcacttcttg

SEQ ID NO: 300371 - DNA, 15 bp, Homo sapiens
gttccttcacttctt

SEQ ID NO: 300372 - DNA, 15 bp, Homo sapiens
tgttccttcacttct

SEQ ID NO: 300373 - DNA, 15 bp, Homo sapiens
atgttccttcacttc

SEQ ID NO: 300374 - DNA, 15 bp, Homo sapiens
tcatgttccttcact

SEQ ID NO: 300375 - DNA, 15 bp, Homo sapiens
gtcatgttccttcac

SEQ ID NO: 300376 - DNA, 15 bp, Homo sapiens
ggtcatgttccttca

SEQ ID NO: 300377 - DNA, 15 bp, Homo sapiens
aggtcatgttccttc

SEQ ID NO: 300378 - DNA, 15 bp, Homo sapiens
taggtcatgttcctt

SEQ ID NO: 300379 - DNA, 15 bp, Homo sapiens
gtaggtcatgttcct

SEQ ID NO: 300380 - DNA, 15 bp, Homo sapiens
cgtaggtcatgttcc

SEQ ID NO: 300381 - DNA, 15 bp, Homo sapiens
ccgtaggtcatgttc

SEQ ID NO: 300382 - DNA, 15 bp, Homo sapiens
tccgtaggtcatgtt

SEQ ID NO: 300383 - DNA, 15 bp, Homo sapiens
ctccgtaggtcatgt

SEQ ID NO: 300384 - DNA, 15 bp, Homo sapiens
actccgtaggtcatg

SEQ ID NO: 300385 - DNA, 15 bp, Homo sapiens
gactccgtaggtcat

SEQ ID NO: 300386 - DNA, 15 bp, Homo sapiens
tgactccgtaggtca

SEQ ID NO: 300387 - DNA, 15 bp, Homo sapiens
ctgactccgtaggtc

SEQ ID NO: 300388 - DNA, 15 bp, Homo sapiens
actgactccgtaggt

SEQ ID NO: 300389 - DNA, 15 bp, Homo sapiens
tactgactccgtagg

SEQ ID NO: 300390 - DNA, 15 bp, Homo sapiens
ctactgactccgtag

SEQ ID NO: 300391 - DNA, 15 bp, Homo sapiens
tctactgactccgta

SEQ ID NO: 300392 - DNA, 15 bp, Homo sapiens
atctactgactccgt

SEQ ID NO: 300393 - DNA, 15 bp, Homo sapiens
catctactgactccg

SEQ ID NO: 300394 - DNA, 15 bp, Homo sapiens
tcatctactgactcc

SEQ ID NO: 300395 - DNA, 15 bp, Homo sapiens
gtcatctactgactc

SEQ ID NO: 300396 - DNA, 15 bp, Homo sapiens
agtcatctactgact

SEQ ID NO: 300397 - DNA, 15 bp, Homo sapiens
cagtcatctactgac

SEQ ID NO: 300398 - DNA, 15 bp, Homo sapiens
gcagtcatctactga

SEQ ID NO: 300399 - DNA, 15 bp, Homo sapiens
tgcagtcatctactg

SEQ ID NO: 300400 - DNA, 15 bp, Homo sapiens
atgcagtcatctact

SEQ ID NO: 300401 - DNA, 15 bp, Homo sapiens
tatgcagtcatctac

SEQ ID NO: 300402 - DNA, 15 bp, Homo sapiens
ttatgcagtcatcta

SEQ ID NO: 300403 - DNA, 15 bp, Homo sapiens
attatgcagtcatct

SEQ ID NO: 300404 - DNA, 15 bp, Homo sapiens
cattatgcagtcatc

SEQ ID NO: 300405 - DNA, 15 bp, Homo sapiens
ccattatgcagtcat

SEQ ID NO: 300406 - DNA, 15 bp, Homo sapiens
tccattatgcagtca

SEQ ID NO: 300407 - DNA, 15 bp, Homo sapiens
ctccattatgcagtc

SEQ ID NO: 300408 - DNA, 15 bp, Homo sapiens
actccattatgcagt

SEQ ID NO: 300409 - DNA, 15 bp, Homo sapiens
gactccattatgcag

SEQ ID NO: 300410 - DNA, 15 bp, Homo sapiens
tgactccattatgca

SEQ ID NO: 300411 - DNA, 15 bp, Homo sapiens
atgactccattatgc

SEQ ID NO: 300412 - DNA, 15 bp, Homo sapiens
tatgactccattatg

SEQ ID NO: 300413 - DNA, 15 bp, Homo sapiens
atatgactccattat

SEQ ID NO: 300414 - DNA, 15 bp, Homo sapiens
tatatgactccatta

SEQ ID NO: 300415 - DNA, 15 bp, Homo sapiens
ctatatgactccatt

SEQ ID NO: 300416 - DNA, 15 bp, Homo sapiens
actatatgactccat

SEQ ID NO: 300417 - DNA, 15 bp, Homo sapiens
gactatatgactcca

SEQ ID NO: 300418 - DNA, 15 bp, Homo sapiens
agactatatgactcc

SEQ ID NO: 300419 - DNA, 15 bp, Homo sapiens
cagactatatgactc

SEQ ID NO: 300420 - DNA, 15 bp, Homo sapiens
tcagactatatgact

SEQ ID NO: 300421 - DNA, 15 bp, Homo sapiens
atcagactatatgac

SEQ ID NO: 300422 - DNA, 15 bp, Homo sapiens
catcagactatatga

SEQ ID NO: 300423 - DNA, 15 bp, Homo sapiens
tcatcagactatatg

SEQ ID NO: 300424 - DNA, 15 bp, Homo sapiens
atcatcagactatat

SEQ ID NO: 300425 - DNA, 15 bp, Homo sapiens
tatcatcagactata

SEQ ID NO: 300426 - DNA, 15 bp, Homo sapiens
atatcatcagactat

SEQ ID NO: 300427 - DNA, 15 bp, Homo sapiens
catatcatcagacta

SEQ ID NO: 300428 - DNA, 15 bp, Homo sapiens
tcatatcatcagact

SEQ ID NO: 300429 - DNA, 15 bp, Homo sapiens
ctcatatcatcagac

SEQ ID NO: 300430 - DNA, 15 bp, Homo sapiens
tctcatatcatcaga

SEQ ID NO: 300431 - DNA, 15 bp, Homo sapiens
atctcatatcatcag

SEQ ID NO: 300432 - DNA, 15 bp, Homo sapiens
aatctcatatcatca

SEQ ID NO: 300433 - DNA, 15 bp, Homo sapiens
gaatctcatatcatc

SEQ ID NO: 300434 - DNA, 15 bp, Homo sapiens
tgaatctcatatcat

SEQ ID NO: 300435 - DNA, 15 bp, Homo sapiens
ttgaatctcatatca

SEQ ID NO: 300436 - DNA, 15 bp, Homo sapiens
tttgaatctcatatc

SEQ ID NO: 300437 - DNA, 15 bp, Homo sapiens
ctttgaatctcatat

SEQ ID NO: 300438 - DNA, 15 bp, Homo sapiens
gctttgaatctcata

SEQ ID NO: 300439 - DNA, 15 bp, Homo sapiens
agctttgaatctcat

SEQ ID NO: 300440 - DNA, 15 bp, Homo sapiens
cagctttgaatctca

SEQ ID NO: 300441 - DNA, 15 bp, Homo sapiens
ccagctttgaatctc

SEQ ID NO: 300442 - DNA, 15 bp, Homo sapiens
cccagctttgaatct

SEQ ID NO: 300443 - DNA, 15 bp, Homo sapiens
acccagctttgaatc

SEQ ID NO: 300444 - DNA, 15 bp, Homo sapiens
cacccagctttgaat

SEQ ID NO: 300445 - DNA, 15 bp, Homo sapiens
acacccagctttgaa

SEQ ID NO: 300446 - DNA, 15 bp, Homo sapiens
aacacccagctttga

SEQ ID NO: 300447 - DNA, 15 bp, Homo sapiens
aaacacccagctttg

SEQ ID NO: 300448 - DNA, 15 bp, Homo sapiens
aaaacacccagcttt

SEQ ID NO: 300449 - DNA, 15 bp, Homo sapiens
aaaaacacccagctt

SEQ ID NO: 300450 - DNA, 15 bp, Homo sapiens
taaaaacacccagct

SEQ ID NO: 300451 - DNA, 15 bp, Homo sapiens
ctaaaaacacccagc

SEQ ID NO: 300452 - DNA, 15 bp, Homo sapiens
cctaaaaacacccag

SEQ ID NO: 300453 - DNA, 15 bp, Homo sapiens
ccctaaaaacaccca

SEQ ID NO: 300454 - DNA, 15 bp, Homo sapiens
tccctaaaaacaccc

SEQ ID NO: 300455 - DNA, 15 bp, Homo sapiens
ctccctaaaaacacc

SEQ ID NO: 300456 - DNA, 15 bp, Homo sapiens
tctccctaaaaacac

SEQ ID NO: 300457 - DNA, 15 bp, Homo sapiens
ctctccctaaaaaca

SEQ ID NO: 300458 - DNA, 15 bp, Homo sapiens
cctctccctaaaaac

SEQ ID NO: 300459 - DNA, 15 bp, Homo sapiens
tcctctccctaaaaa

SEQ ID NO: 300460 - DNA, 15 bp, Homo sapiens
ctcctctccctaaaa

SEQ ID NO: 300461 - DNA, 15 bp, Homo sapiens
tctcctctccctaaa

SEQ ID NO: 300462 - DNA, 15 bp, Homo sapiens
ttctcctctccctaa

SEQ ID NO: 300463 - DNA, 15 bp, Homo sapiens
tttctcctctcccta

SEQ ID NO: 300464 - DNA, 15 bp, Homo sapiens
ctttctcctctccct

SEQ ID NO: 300465 - DNA, 15 bp, Homo sapiens
tctttctcctctccc

SEQ ID NO: 300466 - DNA, 15 bp, Homo sapiens
ttctttctcctctcc

SEQ ID NO: 300467 - DNA, 15 bp, Homo sapiens
cttctttctcctctc

SEQ ID NO: 300468 - DNA, 15 bp, Homo sapiens
tcttctttctcctct

SEQ ID NO: 300469 - DNA, 15 bp, Homo sapiens
atcttctttctcctc

SEQ ID NO: 300470 - DNA, 15 bp, Homo sapiens
tatcttctttctcct

SEQ ID NO: 300471 - DNA, 15 bp, Homo sapiens
gtatcttctttctcc

SEQ ID NO: 300472 - DNA, 15 bp, Homo sapiens
ggtatcttctttctc

SEQ ID NO: 300473 - DNA, 15 bp, Homo sapiens
gggtatcttctttct

SEQ ID NO: 300474 - DNA, 15 bp, Homo sapiens
ggggtatcttctttc

SEQ ID NO: 300475 - DNA, 15 bp, Homo sapiens
tggggtatcttcttt

SEQ ID NO: 300476 - DNA, 15 bp, Homo sapiens
ctggggtatcttctt

SEQ ID NO: 300477 - DNA, 15 bp, Homo sapiens
tctggggtatcttct

SEQ ID NO: 300478 - DNA, 15 bp, Homo sapiens
ctctggggtatcttc

SEQ ID NO: 300479 - DNA, 15 bp, Homo sapiens
cctctggggtatctt

SEQ ID NO: 300480 - DNA, 15 bp, Homo sapiens
gcctctggggtatct

SEQ ID NO: 300481 - DNA, 15 bp, Homo sapiens
ggcctctggggtatc

SEQ ID NO: 300482 - DNA, 15 bp, Homo sapiens
gggcctctggggtat

SEQ ID NO: 300483 - DNA, 15 bp, Homo sapiens
ggggcctctggggta

SEQ ID NO: 300484 - DNA, 15 bp, Homo sapiens
tggggcctctggggt

SEQ ID NO: 300485 - DNA, 15 bp, Homo sapiens
ttggggcctctgggg

SEQ ID NO: 300486 - DNA, 15 bp, Homo sapiens
attggggcctctggg

SEQ ID NO: 300487 - DNA, 15 bp, Homo sapiens
cattggggcctctgg

SEQ ID NO: 300488 - DNA, 15 bp, Homo sapiens
tcattggggcctctg

SEQ ID NO: 300489 - DNA, 15 bp, Homo sapiens
ctcattggggcctct

SEQ ID NO: 300490 - DNA, 15 bp, Homo sapiens
cctcattggggcctc

SEQ ID NO: 300491 - DNA, 15 bp, Homo sapiens
tcctcattggggcct

SEQ ID NO: 300492 - DNA, 15 bp, Homo sapiens
gtcctcattggggcc

SEQ ID NO: 300493 - DNA, 15 bp, Homo sapiens
ggtcctcattggggc

SEQ ID NO: 300494 - DNA, 15 bp, Homo sapiens
tggtcctcattgggg

SEQ ID NO: 300495 - DNA, 15 bp, Homo sapiens
ttggtcctcattggg

SEQ ID NO: 300496 - DNA, 15 bp, Homo sapiens
cttggtcctcattgg

SEQ ID NO: 300497 - DNA, 15 bp, Homo sapiens
ccttggtcctcattg

SEQ ID NO: 300498 - DNA, 15 bp, Homo sapiens
tccttggtcctcatt

SEQ ID NO: 300499 - DNA, 15 bp, Homo sapiens
ttccttggtcctcat

SEQ ID NO: 300500 - DNA, 15 bp, Homo sapiens
cttccttggtcctca

SEQ ID NO: 300501 - DNA, 15 bp, Homo sapiens
tcttccttggtcctc

SEQ ID NO: 300502 - DNA, 15 bp, Homo sapiens
gtcttccttggtcct

SEQ ID NO: 300503 - DNA, 15 bp, Homo sapiens
agtcttccttggtcc

SEQ ID NO: 300504 - DNA, 15 bp, Homo sapiens
gagtcttccttggtc

SEQ ID NO: 300505 - DNA, 15 bp, Homo sapiens
tgagtcttccttggt

SEQ ID NO: 300506 - DNA, 15 bp, Homo sapiens
atgagtcttccttgg

SEQ ID NO: 300507 - DNA, 15 bp, Homo sapiens
catgagtcttccttg

SEQ ID NO: 300508 - DNA, 15 bp, Homo sapiens
gcatgagtcttcctt

SEQ ID NO: 300509 - DNA, 15 bp, Homo sapiens
tgcatgagtcttcct

SEQ ID NO: 300510 - DNA, 15 bp, Homo sapiens
ctgcatgagtcttcc

SEQ ID NO: 300511 - DNA, 15 bp, Homo sapiens
actgcatgagtcttc

SEQ ID NO: 300512 - DNA, 15 bp, Homo sapiens
cactgcatgagtctt

SEQ ID NO: 300513 - DNA, 15 bp, Homo sapiens
acactgcatgagtct

SEQ ID NO: 300514 - DNA, 15 bp, Homo sapiens
tacactgcatgagtc

SEQ ID NO: 300515 - DNA, 15 bp, Homo sapiens
atacactgcatgagt

SEQ ID NO: 300516 - DNA, 15 bp, Homo sapiens
catacactgcatgag

SEQ ID NO: 300517 - DNA, 15 bp, Homo sapiens
tcatacactgcatga

SEQ ID NO: 300518 - DNA, 15 bp, Homo sapiens
ctcatacactgcatg

SEQ ID NO: 300519 - DNA, 15 bp, Homo sapiens
cctcatacactgcat

SEQ ID NO: 300520 - DNA, 15 bp, Homo sapiens
tcctcatacactgca

SEQ ID NO: 300521 - DNA, 15 bp, Homo sapiens
ttcctcatacactgc

SEQ ID NO: 300522 - DNA, 15 bp, Homo sapiens
attcctcatacactg

SEQ ID NO: 300523 - DNA, 15 bp, Homo sapiens
cattcctcatacact

SEQ ID NO: 300524 - DNA, 15 bp, Homo sapiens
ccattcctcatacac

SEQ ID NO: 300525 - DNA, 15 bp, Homo sapiens
cccattcctcataca

SEQ ID NO: 300526 - DNA, 15 bp, Homo sapiens
ccccattcctcatac

SEQ ID NO: 300527 - DNA, 15 bp, Homo sapiens
cccccattcctcata

SEQ ID NO: 300528 - DNA, 15 bp, Homo sapiens
tcccccattcctcat

SEQ ID NO: 300529 - DNA, 15 bp, Homo sapiens
ctcccccattcctca

SEQ ID NO: 300530 - DNA, 15 bp, Homo sapiens
tctcccccattcctc

SEQ ID NO: 300531 - DNA, 15 bp, Homo sapiens
ttctcccccattcct

SEQ ID NO: 300532 - DNA, 15 bp, Homo sapiens
attctcccccattcc

SEQ ID NO: 300533 - DNA, 15 bp, Homo sapiens
cattctcccccattc

SEQ ID NO: 300534 - DNA, 15 bp, Homo sapiens
ccattctcccccatt

SEQ ID NO: 300535 - DNA, 15 bp, Homo sapiens
cccattctcccccat

SEQ ID NO: 300536 - DNA, 15 bp, Homo sapiens
ccccattctccccca

SEQ ID NO: 300537 - DNA, 15 bp, Homo sapiens
tccccattctccccc

SEQ ID NO: 300538 - DNA, 15 bp, Homo sapiens
ctccccattctcccc

SEQ ID NO: 300539 - DNA, 15 bp, Homo sapiens
cctccccattctccc

SEQ ID NO: 300540 - DNA, 15 bp, Homo sapiens
ccctccccattctcc

SEQ ID NO: 300541 - DNA, 15 bp, Homo sapiens
cccctccccattctc

SEQ ID NO: 300542 - DNA, 15 bp, Homo sapiens
tcccctccccattct

SEQ ID NO: 300543 - DNA, 15 bp, Homo sapiens
ttcccctccccattc

SEQ ID NO: 300544 - DNA, 15 bp, Homo sapiens
cttcccctccccatt

SEQ ID NO: 300545 - DNA, 15 bp, Homo sapiens
acttcccctccccat

SEQ ID NO: 300546 - DNA, 15 bp, Homo sapiens
cacttcccctcccca

SEQ ID NO: 300547 - DNA, 15 bp, Homo sapiens
gcacttcccctcccc

SEQ ID NO: 300548 - DNA, 15 bp, Homo sapiens
agcacttcccctccc

SEQ ID NO: 300549 - DNA, 15 bp, Homo sapiens
cagcacttcccctcc

SEQ ID NO: 300550 - DNA, 15 bp, Homo sapiens
acagcacttcccctc

SEQ ID NO: 300551 - DNA, 15 bp, Homo sapiens
cacagcacttcccct

SEQ ID NO: 300552 - DNA, 15 bp, Homo sapiens
acacagcacttcccc

SEQ ID NO: 300553 - DNA, 15 bp, Homo sapiens
cacacagcacttccc

SEQ ID NO: 300554 - DNA, 15 bp, Homo sapiens
tcacacagcacttcc

SEQ ID NO: 300555 - DNA, 15 bp, Homo sapiens
ctcacacagcacttc

SEQ ID NO: 300556 - DNA, 15 bp, Homo sapiens
tctcacacagcactt

SEQ ID NO: 300557 - DNA, 15 bp, Homo sapiens
ctctcacacagcact

SEQ ID NO: 300558 - DNA, 15 bp, Homo sapiens
cctctcacacagcac

SEQ ID NO: 300559 - DNA, 15 bp, Homo sapiens
ccctctcacacagca

SEQ ID NO: 300560 - DNA, 15 bp, Homo sapiens
accctctcacacagc

SEQ ID NO: 300561 - DNA, 15 bp, Homo sapiens
aaccctctcacacag

SEQ ID NO: 300562 - DNA, 15 bp, Homo sapiens
taaccctctcacaca

SEQ ID NO: 300563 - DNA, 15 bp, Homo sapiens
ataaccctctcacac

SEQ ID NO: 300564 - DNA, 15 bp, Homo sapiens
cataaccctctcaca

SEQ ID NO: 300565 - DNA, 15 bp, Homo sapiens
tcataaccctctcac

SEQ ID NO: 300566 - DNA, 15 bp, Homo sapiens
ctcataaccctctca

SEQ ID NO: 300567 - DNA, 15 bp, Homo sapiens
cctcataaccctctc

SEQ ID NO: 300568 - DNA, 15 bp, Homo sapiens
ccctcataaccctct

SEQ ID NO: 300569 - DNA, 15 bp, Homo sapiens
tccctcataaccctc

SEQ ID NO: 300570 - DNA, 15 bp, Homo sapiens
ttccctcataaccct

SEQ ID NO: 300571 - DNA, 15 bp, Homo sapiens
cttccctcataaccc

SEQ ID NO: 300572 - DNA, 15 bp, Homo sapiens
gcttccctcataacc

SEQ ID NO: 300573 - DNA, 15 bp, Homo sapiens
agcttccctcataac

SEQ ID NO: 300574 - DNA, 15 bp, Homo sapiens
cagcttccctcataa

SEQ ID NO: 300575 - DNA, 15 bp, Homo sapiens
acagcttccctcata

SEQ ID NO: 300576 - DNA, 15 bp, Homo sapiens
cacagcttccctcat

SEQ ID NO: 300577 - DNA, 15 bp, Homo sapiens
acacagcttccctca

SEQ ID NO: 300578 - DNA, 15 bp, Homo sapiens
gacacagcttccctc

SEQ ID NO: 300579 - DNA, 15 bp, Homo sapiens
agacacagcttccct

SEQ ID NO: 300580 - DNA, 15 bp, Homo sapiens
aagacacagcttccc

SEQ ID NO: 300581 - DNA, 15 bp, Homo sapiens
gaagacacagcttcc

SEQ ID NO: 300582 - DNA, 15 bp, Homo sapiens
tgaagacacagcttc

SEQ ID NO: 300583 - DNA, 15 bp, Homo sapiens
ctgaagacacagctt

SEQ ID NO: 300584 - DNA, 15 bp, Homo sapiens
cctgaagacacagct

SEQ ID NO: 300585 - DNA, 15 bp, Homo sapiens
acctgaagacacagc

SEQ ID NO: 300586 - DNA, 15 bp, Homo sapiens
tacctgaagacacag

SEQ ID NO: 300587 - DNA, 15 bp, Homo sapiens
ctacctgaagacaca

SEQ ID NO: 300588 - DNA, 15 bp, Homo sapiens
tctacctgaagacac

SEQ ID NO: 300589 - DNA, 15 bp, Homo sapiens
atctacctgaagaca

SEQ ID NO: 300590 - DNA, 15 bp, Homo sapiens
catctacctgaagac

SEQ ID NO: 300591 - DNA, 15 bp, Homo sapiens
gcatctacctgaaga

SEQ ID NO: 300592 - DNA, 15 bp, Homo sapiens
tgcatctacctgaag

SEQ ID NO: 300593 - DNA, 15 bp, Homo sapiens
ctgcatctacctgaa

SEQ ID NO: 300594 - DNA, 15 bp, Homo sapiens
tctgcatctacctga

SEQ ID NO: 300595 - DNA, 15 bp, Homo sapiens
atctgcatctacctg

SEQ ID NO: 300596 - DNA, 15 bp, Homo sapiens
tatctgcatctacct

SEQ ID NO: 300597 - DNA, 15 bp, Homo sapiens
atatctgcatctacc

SEQ ID NO: 300598 - DNA, 15 bp, Homo sapiens
aatatctgcatctac

SEQ ID NO: 300599 - DNA, 15 bp, Homo sapiens
caatatctgcatcta

SEQ ID NO: 300600 - DNA, 15 bp, Homo sapiens
tcaatatctgcatct

SEQ ID NO: 300601 - DNA, 15 bp, Homo sapiens
atcaatatctgcatc

SEQ ID NO: 300602 - DNA, 15 bp, Homo sapiens
aatcaatatctgcat

SEQ ID NO: 300603 - DNA, 15 bp, Homo sapiens
taatcaatatctgca

SEQ ID NO: 300604 - DNA, 15 bp, Homo sapiens
ctaatcaatatctgc

SEQ ID NO: 300605 - DNA, 15 bp, Homo sapiens
tctaatcaatatctg

SEQ ID NO: 300606 - DNA, 15 bp, Homo sapiens
ctctaatcaatatct

SEQ ID NO: 300607 - DNA, 15 bp, Homo sapiens
gctctaatcaatatc

SEQ ID NO: 300608 - DNA, 15 bp, Homo sapiens
tgctctaatcaatat

SEQ ID NO: 300609 - DNA, 15 bp, Homo sapiens
ttgctctaatcaata

SEQ ID NO: 300610 - DNA, 15 bp, Homo sapiens
cttgctctaatcaat

SEQ ID NO: 300611 - DNA, 15 bp, Homo sapiens
acttgctctaatcaa

SEQ ID NO: 300612 - DNA, 15 bp, Homo sapiens
tacttgctctaatca

SEQ ID NO: 300613 - DNA, 15 bp, Homo sapiens
ctacttgctctaatc

SEQ ID NO: 300614 - DNA, 15 bp, Homo sapiens
tctacttgctctaat

SEQ ID NO: 300615 - DNA, 15 bp, Homo sapiens
atctacttgctctaa

SEQ ID NO: 300616 - DNA, 15 bp, Homo sapiens
catctacttgctcta

SEQ ID NO: 300617 - DNA, 15 bp, Homo sapiens
gcatctacttgctct

SEQ ID NO: 300618 - DNA, 15 bp, Homo sapiens
tgcatctacttgctc

SEQ ID NO: 300619 - DNA, 15 bp, Homo sapiens
ctgcatctacttgct

SEQ ID NO: 300620 - DNA, 15 bp, Homo sapiens
cctgcatctacttgc

SEQ ID NO: 300621 - DNA, 15 bp, Homo sapiens
gcctgcatctacttg

SEQ ID NO: 300622 - DNA, 15 bp, Homo sapiens
tgcctgcatctactt

SEQ ID NO: 300623 - DNA, 15 bp, Homo sapiens
ctgcctgcatctact

SEQ ID NO: 300624 - DNA, 15 bp, Homo sapiens
gctgcctgcatctac

SEQ ID NO: 300625 - DNA, 15 bp, Homo sapiens
tgctgcctgcatcta

SEQ ID NO: 300626 - DNA, 15 bp, Homo sapiens
atgctgcctgcatct

SEQ ID NO: 300627 - DNA, 15 bp, Homo sapiens
aatgctgcctgcatc

SEQ ID NO: 300628 - DNA, 15 bp, Homo sapiens
gaatgctgcctgcat

SEQ ID NO: 300629 - DNA, 15 bp, Homo sapiens
tgaatgctgcctgca

SEQ ID NO: 300630 - DNA, 15 bp, Homo sapiens
ctgaatgctgcctgc

SEQ ID NO: 300631 - DNA, 15 bp, Homo sapiens
tctgaatgctgcctg

SEQ ID NO: 300632 - DNA, 15 bp, Homo sapiens
ctctgaatgctgcct

SEQ ID NO: 300633 - DNA, 15 bp, Homo sapiens
tctctgaatgctgcc

SEQ ID NO: 300634 - DNA, 15 bp, Homo sapiens
ttctctgaatgctgc

SEQ ID NO: 300635 - DNA, 15 bp, Homo sapiens
cttctctgaatgctg

SEQ ID NO: 300636 - DNA, 15 bp, Homo sapiens
ccttctctgaatgct

SEQ ID NO: 300637 - DNA, 15 bp, Homo sapiens
cccttctctgaatgc

SEQ ID NO: 300638 - DNA, 15 bp, Homo sapiens
acccttctctgaatg

SEQ ID NO: 300639 - DNA, 15 bp, Homo sapiens
aacccttctctgaat

SEQ ID NO: 300640 - DNA, 15 bp, Homo sapiens
aaacccttctctgaa

SEQ ID NO: 300641 - DNA, 15 bp, Homo sapiens
caaacccttctctga

SEQ ID NO: 300642 - DNA, 15 bp, Homo sapiens
ccaaacccttctctg

SEQ ID NO: 300643 - DNA, 15 bp, Homo sapiens
cccaaacccttctct

SEQ ID NO: 300644 - DNA, 15 bp, Homo sapiens
tcccaaacccttctc

SEQ ID NO: 300645 - DNA, 15 bp, Homo sapiens
ttcccaaacccttct

SEQ ID NO: 300646 - DNA, 15 bp, Homo sapiens
gttcccaaacccttc

SEQ ID NO: 300647 - DNA, 15 bp, Homo sapiens
tgttcccaaaccctt

SEQ ID NO: 300648 - DNA, 15 bp, Homo sapiens
atgttcccaaaccct

SEQ ID NO: 300649 - DNA, 15 bp, Homo sapiens
catgttcccaaaccc

SEQ ID NO: 300650 - DNA, 15 bp, Homo sapiens
ccatgttcccaaacc

SEQ ID NO: 300651 - DNA, 15 bp, Homo sapiens
cccatgttcccaaac

SEQ ID NO: 300652 - DNA, 15 bp, Homo sapiens
acccatgttcccaaa

SEQ ID NO: 300653 - DNA, 15 bp, Homo sapiens
aacccatgttcccaa

SEQ ID NO: 300654 - DNA, 15 bp, Homo sapiens
aaacccatgttccca

SEQ ID NO: 300655 - DNA, 15 bp, Homo sapiens
aaaacccatgttccc

SEQ ID NO: 300656 - DNA, 15 bp, Homo sapiens
caaaacccatgttcc

SEQ ID NO: 300657 - DNA, 15 bp, Homo sapiens
gcaaaacccatgttc

SEQ ID NO: 300658 - DNA, 15 bp, Homo sapiens
cgcaaaacccatgtt

SEQ ID NO: 300659 - DNA, 15 bp, Homo sapiens
ccgcaaaacccatgt

SEQ ID NO: 300660 - DNA, 15 bp, Homo sapiens
tccgcaaaacccatg

SEQ ID NO: 300661 - DNA, 15 bp, Homo sapiens
atccgcaaaacccat

SEQ ID NO: 300662 - DNA, 15 bp, Homo sapiens
gatccgcaaaaccca

SEQ ID NO: 300663 - DNA, 15 bp, Homo sapiens
tgatccgcaaaaccc

SEQ ID NO: 300664 - DNA, 15 bp, Homo sapiens
gtgatccgcaaaacc

SEQ ID NO: 300665 - DNA, 15 bp, Homo sapiens
tgtgatccgcaaaac

SEQ ID NO: 300666 - DNA, 15 bp, Homo sapiens
ctgtgatccgcaaaa

SEQ ID NO: 300667 - DNA, 15 bp, Homo sapiens
cctgtgatccgcaaa

SEQ ID NO: 300668 - DNA, 15 bp, Homo sapiens
gcctgtgatccgcaa

SEQ ID NO: 300669 - DNA, 15 bp, Homo sapiens
ggcctgtgatccgca

SEQ ID NO: 300670 - DNA, 15 bp, Homo sapiens
tggcctgtgatccgc

SEQ ID NO: 300671 - DNA, 15 bp, Homo sapiens
gtggcctgtgatccg

SEQ ID NO: 300672 - DNA, 15 bp, Homo sapiens
tgtggcctgtgatcc

SEQ ID NO: 300673 - DNA, 15 bp, Homo sapiens
atgtggcctgtgatc

SEQ ID NO: 300674 - DNA, 15 bp, Homo sapiens
catgtggcctgtgat

SEQ ID NO: 300675 - DNA, 15 bp, Homo sapiens
tcatgtggcctgtga

SEQ ID NO: 300676 - DNA, 15 bp, Homo sapiens
gtcatgtggcctgtg

SEQ ID NO: 300677 - DNA, 15 bp, Homo sapiens
ggtcatgtggcctgt

SEQ ID NO: 300678 - DNA, 15 bp, Homo sapiens
aggtcatgtggcctg

SEQ ID NO: 300679 - DNA, 15 bp, Homo sapiens
taggtcatgtggcct

SEQ ID NO: 300680 - DNA, 15 bp, Homo sapiens
ataggtcatgtggcc

SEQ ID NO: 300681 - DNA, 15 bp, Homo sapiens
tataggtcatgtggc

SEQ ID NO: 300682 - DNA, 15 bp, Homo sapiens
ctataggtcatgtgg

SEQ ID NO: 300683 - DNA, 15 bp, Homo sapiens
cctataggtcatgtg

SEQ ID NO: 300684 - DNA, 15 bp, Homo sapiens
tcctataggtcatgt

SEQ ID NO: 300685 - DNA, 15 bp, Homo sapiens
gtcctataggtcatg

SEQ ID NO: 300686 - DNA, 15 bp, Homo sapiens
tgtcctataggtcat

SEQ ID NO: 300687 - DNA, 15 bp, Homo sapiens
ctgtcctataggtca

SEQ ID NO: 300688 - DNA, 15 bp, Homo sapiens
cctgtcctataggtc

SEQ ID NO: 300689 - DNA, 15 bp, Homo sapiens
acctgtcctataggt

SEQ ID NO: 300690 - DNA, 15 bp, Homo sapiens
aacctgtcctatagg

SEQ ID NO: 300691 - DNA, 15 bp, Homo sapiens
aaacctgtcctatag

SEQ ID NO: 300692 - DNA, 15 bp, Homo sapiens
gaaacctgtcctata

SEQ ID NO: 300693 - DNA, 15 bp, Homo sapiens
tgaaacctgtcctat

SEQ ID NO: 300694 - DNA, 15 bp, Homo sapiens
ttgaaacctgtccta

SEQ ID NO: 300695 - DNA, 15 bp, Homo sapiens
cttgaaacctgtcct

SEQ ID NO: 300696 - DNA, 15 bp, Homo sapiens
tcttgaaacctgtcc

SEQ ID NO: 300697 - DNA, 15 bp, Homo sapiens
ctcttgaaacctgtc

SEQ ID NO: 300698 - DNA, 15 bp, Homo sapiens
gctcttgaaacctgt

SEQ ID NO: 300699 - DNA, 15 bp, Homo sapiens
agctcttgaaacctg

SEQ ID NO: 300700 - DNA, 15 bp, Homo sapiens
tagctcttgaaacct

SEQ ID NO: 300701 - DNA, 15 bp, Homo sapiens
ctagctcttgaaacc

SEQ ID NO: 300702 - DNA, 15 bp, Homo sapiens
cctagctcttgaaac

SEQ ID NO: 300703 - DNA, 15 bp, Homo sapiens
tcctagctcttgaaa

SEQ ID NO: 300704 - DNA, 15 bp, Homo sapiens
ttcctagctcttgaa

SEQ ID NO: 300705 - DNA, 15 bp, Homo sapiens
cttcctagctcttga

SEQ ID NO: 300706 - DNA, 15 bp, Homo sapiens
tcttcctagctcttg

SEQ ID NO: 300707 - DNA, 15 bp, Homo sapiens
ctcttcctagctctt

SEQ ID NO: 300708 - DNA, 15 bp, Homo sapiens
actcttcctagctct

SEQ ID NO: 300709 - DNA, 15 bp, Homo sapiens
cactcttcctagctc

SEQ ID NO: 300710 - DNA, 15 bp, Homo sapiens
tcactcttcctagct

SEQ ID NO: 300711 - DNA, 15 bp, Homo sapiens
ctcactcttcctagc

SEQ ID NO: 300712 - DNA, 15 bp, Homo sapiens
cctcactcttcctag

SEQ ID NO: 300713 - DNA, 15 bp, Homo sapiens
gcctcactcttccta

SEQ ID NO: 300714 - DNA, 15 bp, Homo sapiens
tgcctcactcttcct

SEQ ID NO: 300715 - DNA, 15 bp, Homo sapiens
atgcctcactcttcc

SEQ ID NO: 300716 - DNA, 15 bp, Homo sapiens
tatgcctcactcttc

SEQ ID NO: 300717 - DNA, 15 bp, Homo sapiens
ctatgcctcactctt

SEQ ID NO: 300718 - DNA, 15 bp, Homo sapiens
cctatgcctcactct

SEQ ID NO: 300719 - DNA, 15 bp, Homo sapiens
ccctatgcctcactc

SEQ ID NO: 300720 - DNA, 15 bp, Homo sapiens
accctatgcctcact

SEQ ID NO: 300721 - DNA, 15 bp, Homo sapiens
gaccctatgcctcac

SEQ ID NO: 300722 - DNA, 15 bp, Homo sapiens
tgaccctatgcctca

SEQ ID NO: 300723 - DNA, 15 bp, Homo sapiens
gtgaccctatgcctc

SEQ ID NO: 300724 - DNA, 15 bp, Homo sapiens
tgtgaccctatgcct

SEQ ID NO: 300725 - DNA, 15 bp, Homo sapiens
ttgtgaccctatgcc

SEQ ID NO: 300726 - DNA, 15 bp, Homo sapiens
tttgtgaccctatgc

SEQ ID NO: 300727 - DNA, 15 bp, Homo sapiens
ttttgtgaccctatg

SEQ ID NO: 300728 - DNA, 15 bp, Homo sapiens
tttttgtgaccctat

SEQ ID NO: 300729 - DNA, 15 bp, Homo sapiens
ctttttgtgacccta

SEQ ID NO: 300730 - DNA, 15 bp, Homo sapiens
cctttttgtgaccct

SEQ ID NO: 300731 - DNA, 15 bp, Homo sapiens
ccctttttgtgaccc

SEQ ID NO: 300732 - DNA, 15 bp, Homo sapiens
cccctttttgtgacc

SEQ ID NO: 300733 - DNA, 15 bp, Homo sapiens
acccctttttgtgac

SEQ ID NO: 300734 - DNA, 15 bp, Homo sapiens
tacccctttttgtga

SEQ ID NO: 300735 - DNA, 15 bp, Homo sapiens
atacccctttttgtg

SEQ ID NO: 300736 - DNA, 15 bp, Homo sapiens
catacccctttttgt

SEQ ID NO: 300737 - DNA, 15 bp, Homo sapiens
gcatacccctttttg

SEQ ID NO: 300738 - DNA, 15 bp, Homo sapiens
tgcataccccttttt

SEQ ID NO: 300739 - DNA, 15 bp, Homo sapiens
ctgcatacccctttt

SEQ ID NO: 300740 - DNA, 15 bp, Homo sapiens
tctgcataccccttt

SEQ ID NO: 300741 - DNA, 15 bp, Homo sapiens
atctgcatacccctt

SEQ ID NO: 300742 - DNA, 15 bp, Homo sapiens
gatctgcatacccct

SEQ ID NO: 300743 - DNA, 15 bp, Homo sapiens
agatctgcatacccc

SEQ ID NO: 300744 - DNA, 15 bp, Homo sapiens
gagatctgcataccc

SEQ ID NO: 300745 - DNA, 15 bp, Homo sapiens
agagatctgcatacc

SEQ ID NO: 300746 - DNA, 15 bp, Homo sapiens
tagagatctgcatac

SEQ ID NO: 300747 - DNA, 15 bp, Homo sapiens
atagagatctgcata

SEQ ID NO: 300748 - DNA, 15 bp, Homo sapiens
tatagagatctgcat

SEQ ID NO: 300749 - DNA, 15 bp, Homo sapiens
atatagagatctgca

SEQ ID NO: 300750 - DNA, 15 bp, Homo sapiens
catatagagatctgc

SEQ ID NO: 300751 - DNA, 15 bp, Homo sapiens
tcatatagagatctg

SEQ ID NO: 300752 - DNA, 15 bp, Homo sapiens
gtcatatagagatct

SEQ ID NO: 300753 - DNA, 15 bp, Homo sapiens
agtcatatagagatc

SEQ ID NO: 300754 - DNA, 15 bp, Homo sapiens
tagtcatatagagat

SEQ ID NO: 300755 - DNA, 15 bp, Homo sapiens
ctagtcatatagaga

SEQ ID NO: 300756 - DNA, 15 bp, Homo sapiens
tctagtcatatagag

SEQ ID NO: 300757 - DNA, 15 bp, Homo sapiens
ttctagtcatataga

SEQ ID NO: 300758 - DNA, 15 bp, Homo sapiens
attctagtcatatag

SEQ ID NO: 300759 - DNA, 15 bp, Homo sapiens
tattctagtcatata

SEQ ID NO: 300760 - DNA, 15 bp, Homo sapiens
gtattctagtcatat

SEQ ID NO: 300761 - DNA, 15 bp, Homo sapiens
tgtattctagtcata

SEQ ID NO: 300762 - DNA, 15 bp, Homo sapiens
ctgtattctagtcat

SEQ ID NO: 300763 - DNA, 15 bp, Homo sapiens
cctgtattctagtca

SEQ ID NO: 300764 - DNA, 15 bp, Homo sapiens
acctgtattctagtc

SEQ ID NO: 300765 - DNA, 15 bp, Homo sapiens
cacctgtattctagt

SEQ ID NO: 300766 - DNA, 15 bp, Homo sapiens
tcacctgtattctag

SEQ ID NO: 300767 - DNA, 15 bp, Homo sapiens
atcacctgtattcta

SEQ ID NO: 300768 - DNA, 15 bp, Homo sapiens
catcacctgtattct

SEQ ID NO: 300769 - DNA, 15 bp, Homo sapiens
ccatcacctgtattc

SEQ ID NO: 300770 - DNA, 15 bp, Homo sapiens
tccatcacctgtatt

SEQ ID NO: 300771 - DNA, 15 bp, Homo sapiens
ttccatcacctgtat

SEQ ID NO: 300772 - DNA, 15 bp, Homo sapiens
cttccatcacctgta

SEQ ID NO: 300773 - DNA, 15 bp, Homo sapiens
ccttccatcacctgt

SEQ ID NO: 300774 - DNA, 15 bp, Homo sapiens
cccttccatcacctg

SEQ ID NO: 300775 - DNA, 15 bp, Homo sapiens
gcccttccatcacct

SEQ ID NO: 300776 - DNA, 15 bp, Homo sapiens
tgcccttccatcacc

SEQ ID NO: 300777 - DNA, 15 bp, Homo sapiens
ttgcccttccatcac

SEQ ID NO: 300778 - DNA, 15 bp, Homo sapiens
gttgcccttccatca

SEQ ID NO: 300779 - DNA, 15 bp, Homo sapiens
ggttgcccttccatc

SEQ ID NO: 300780 - DNA, 15 bp, Homo sapiens
tggttgcccttccat

SEQ ID NO: 300781 - DNA, 15 bp, Homo sapiens
ctggttgcccttcca

SEQ ID NO: 300782 - DNA, 15 bp, Homo sapiens
cctggttgcccttcc

SEQ ID NO: 300783 - DNA, 15 bp, Homo sapiens
tcctggttgcccttc

SEQ ID NO: 300784 - DNA, 15 bp, Homo sapiens
ctcctggttgccctt

SEQ ID NO: 300785 - DNA, 15 bp, Homo sapiens
actcctggttgccct

SEQ ID NO: 300786 - DNA, 15 bp, Homo sapiens
gactcctggttgccc

SEQ ID NO: 300787 - DNA, 15 bp, Homo sapiens
agactcctggttgcc

SEQ ID NO: 300788 - DNA, 15 bp, Homo sapiens
tagactcctggttgc

SEQ ID NO: 300789 - DNA, 15 bp, Homo sapiens
ctagactcctggttg

SEQ ID NO: 300790 - DNA, 15 bp, Homo sapiens
tctagactcctggtt

SEQ ID NO: 300791 - DNA, 15 bp, Homo sapiens
ctctagactcctggt

SEQ ID NO: 300792 - DNA, 15 bp, Homo sapiens
gctctagactcctgg

SEQ ID NO: 300793 - DNA, 15 bp, Homo sapiens
agctctagactcctg

SEQ ID NO: 300794 - DNA, 15 bp, Homo sapiens
aagctctagactcct

SEQ ID NO: 300795 - DNA, 15 bp, Homo sapiens
aaagctctagactcc

SEQ ID NO: 300796 - DNA, 15 bp, Homo sapiens
aaaagctctagactc

SEQ ID NO: 300797 - DNA, 15 bp, Homo sapiens
aaaaagctctagact

SEQ ID NO: 300798 - DNA, 15 bp, Homo sapiens
taaaaagctctagac

SEQ ID NO: 300799 - DNA, 15 bp, Homo sapiens
ctaaaaagctctaga

SEQ ID NO: 300800 - DNA, 15 bp, Homo sapiens
cctaaaaagctctag

SEQ ID NO: 300801 - DNA, 15 bp, Homo sapiens
ccctaaaaagctcta

SEQ ID NO: 300802 - DNA, 15 bp, Homo sapiens
accctaaaaagctct

SEQ ID NO: 300803 - DNA, 15 bp, Homo sapiens
caccctaaaaagctc

SEQ ID NO: 300804 - DNA, 15 bp, Homo sapiens
ccaccctaaaaagct

SEQ ID NO: 300805 - DNA, 15 bp, Homo sapiens
gccaccctaaaaagc

SEQ ID NO: 300806 - DNA, 15 bp, Homo sapiens
ggccaccctaaaaag

SEQ ID NO: 300807 - DNA, 15 bp, Homo sapiens
gggccaccctaaaaa

SEQ ID NO: 300808 - DNA, 15 bp, Homo sapiens
tgggccaccctaaaa

SEQ ID NO: 300809 - DNA, 15 bp, Homo sapiens
atgggccaccctaaa

SEQ ID NO: 300810 - DNA, 15 bp, Homo sapiens
aatgggccaccctaa

SEQ ID NO: 300811 - DNA, 15 bp, Homo sapiens
taatgggccacccta

SEQ ID NO: 300812 - DNA, 15 bp, Homo sapiens
ttaatgggccaccct

SEQ ID NO: 300813 - DNA, 15 bp, Homo sapiens
tttaatgggccaccc

SEQ ID NO: 300814 - DNA, 15 bp, Homo sapiens
ttttaatgggccacc

SEQ ID NO: 300815 - DNA, 15 bp, Homo sapiens
attttaatgggccac

SEQ ID NO: 300816 - DNA, 15 bp, Homo sapiens
aattttaatgggcca

SEQ ID NO: 300817 - DNA, 15 bp, Homo sapiens
taattttaatgggcc

SEQ ID NO: 300818 - DNA, 15 bp, Homo sapiens
ctaattttaatgggc

SEQ ID NO: 300819 - DNA, 15 bp, Homo sapiens
cctaattttaatggg

SEQ ID NO: 300820 - DNA, 15 bp, Homo sapiens
ccctaattttaatgg

SEQ ID NO: 300821 - DNA, 15 bp, Homo sapiens
tccctaattttaatg

SEQ ID NO: 300822 - DNA, 15 bp, Homo sapiens
atccctaattttaat

SEQ ID NO: 300823 - DNA, 15 bp, Homo sapiens
tatccctaattttaa

SEQ ID NO: 300824 - DNA, 15 bp, Homo sapiens
ttatccctaatttta

SEQ ID NO: 300825 - DNA, 15 bp, Homo sapiens
tttatccctaatttt

SEQ ID NO: 300826 - DNA, 15 bp, Homo sapiens
ctttatccctaattt

SEQ ID NO: 300827 - DNA, 15 bp, Homo sapiens
cctttatccctaatt

SEQ ID NO: 300828 - DNA, 15 bp, Homo sapiens
ccctttatccctaat

SEQ ID NO: 300829 - DNA, 15 bp, Homo sapiens
accctttatccctaa

SEQ ID NO: 300830 - DNA, 15 bp, Homo sapiens
taccctttatcccta

SEQ ID NO: 300831 - DNA, 15 bp, Homo sapiens
gtaccctttatccct

SEQ ID NO: 300832 - DNA, 15 bp, Homo sapiens
tgtaccctttatccc

SEQ ID NO: 300833 - DNA, 15 bp, Homo sapiens
ttgtaccctttatcc

SEQ ID NO: 300834 - DNA, 15 bp, Homo sapiens
tttgtaccctttatc

SEQ ID NO: 300835 - DNA, 15 bp, Homo sapiens
ctttgtaccctttat

SEQ ID NO: 300836 - DNA, 15 bp, Homo sapiens
tctttgtacccttta

SEQ ID NO: 300837 - DNA, 15 bp, Homo sapiens
ctctttgtacccttt

SEQ ID NO: 300838 - DNA, 15 bp, Homo sapiens
cctctttgtaccctt

SEQ ID NO: 300839 - DNA, 15 bp, Homo sapiens
acctctttgtaccct

SEQ ID NO: 300840 - DNA, 15 bp, Homo sapiens
aacctctttgtaccc

SEQ ID NO: 300841 - DNA, 15 bp, Homo sapiens
taacctctttgtacc

SEQ ID NO: 300842 - DNA, 15 bp, Homo sapiens
ctaacctctttgtac

SEQ ID NO: 300843 - DNA, 15 bp, Homo sapiens
actaacctctttgta

SEQ ID NO: 300844 - DNA, 15 bp, Homo sapiens
gactaacctctttgt

SEQ ID NO: 300845 - DNA, 15 bp, Homo sapiens
ggactaacctctttg

SEQ ID NO: 300846 - DNA, 15 bp, Homo sapiens
aggactaacctcttt

SEQ ID NO: 300847 - DNA, 15 bp, Homo sapiens
caggactaacctctt

SEQ ID NO: 300848 - DNA, 15 bp, Homo sapiens
tcaggactaacctct

SEQ ID NO: 300849 - DNA, 15 bp, Homo sapiens
atcaggactaacctc

SEQ ID NO: 300850 - DNA, 15 bp, Homo sapiens
catcaggactaacct

SEQ ID NO: 300851 - DNA, 15 bp, Homo sapiens
ccatcaggactaacc

SEQ ID NO: 300852 - DNA, 15 bp, Homo sapiens
accatcaggactaac

SEQ ID NO: 300853 - DNA, 15 bp, Homo sapiens
gaccatcaggactaa

SEQ ID NO: 300854 - DNA, 15 bp, Homo sapiens
ggaccatcaggacta

SEQ ID NO: 300855 - DNA, 15 bp, Homo sapiens
gggaccatcaggact

SEQ ID NO: 300856 - DNA, 15 bp, Homo sapiens
ggggaccatcaggac

SEQ ID NO: 300857 - DNA, 15 bp, Homo sapiens
tggggaccatcagga

SEQ ID NO: 300858 - DNA, 15 bp, Homo sapiens
ctggggaccatcagg

SEQ ID NO: 300859 - DNA, 15 bp, Homo sapiens
cctggggaccatcag

SEQ ID NO: 300860 - DNA, 15 bp, Homo sapiens
acctggggaccatca

SEQ ID NO: 300861 - DNA, 15 bp, Homo sapiens
cacctggggaccatc

SEQ ID NO: 300862 - DNA, 15 bp, Homo sapiens
ccacctggggaccat

SEQ ID NO: 300863 - DNA, 15 bp, Homo sapiens
tccacctggggacca

SEQ ID NO: 300864 - DNA, 15 bp, Homo sapiens
ttccacctggggacc

SEQ ID NO: 300865 - DNA, 15 bp, Homo sapiens
attccacctggggac

SEQ ID NO: 300866 - DNA, 15 bp, Homo sapiens
cattccacctgggga

SEQ ID NO: 300867 - DNA, 15 bp, Homo sapiens
tcattccacctgggg

SEQ ID NO: 300868 - DNA, 15 bp, Homo sapiens
ctcattccacctggg

SEQ ID NO: 300869 - DNA, 15 bp, Homo sapiens
cctcattccacctgg

SEQ ID NO: 300870 - DNA, 15 bp, Homo sapiens
gcctcattccacctg

SEQ ID NO: 300871 - DNA, 15 bp, Homo sapiens
agcctcattccacct

SEQ ID NO: 300872 - DNA, 15 bp, Homo sapiens
cagcctcattccacc

SEQ ID NO: 300873 - DNA, 15 bp, Homo sapiens
acagcctcattccac

SEQ ID NO: 300874 - DNA, 15 bp, Homo sapiens
cacagcctcattcca

SEQ ID NO: 300875 - DNA, 15 bp, Homo sapiens
tcacagcctcattcc

SEQ ID NO: 300876 - DNA, 15 bp, Homo sapiens
ctcacagcctcattc

SEQ ID NO: 300877 - DNA, 15 bp, Homo sapiens
actcacagcctcatt

SEQ ID NO: 300878 - DNA, 15 bp, Homo sapiens
cactcacagcctcat

SEQ ID NO: 300879 - DNA, 15 bp, Homo sapiens
tcactcacagcctca

SEQ ID NO: 300880 - DNA, 15 bp, Homo sapiens
gtcactcacagcctc

SEQ ID NO: 300881 - DNA, 15 bp, Homo sapiens
tgtcactcacagcct

SEQ ID NO: 300882 - DNA, 15 bp, Homo sapiens
ttgtcactcacagcc

SEQ ID NO: 300883 - DNA, 15 bp, Homo sapiens
tttgtcactcacagc

SEQ ID NO: 300884 - DNA, 15 bp, Homo sapiens
ctttgtcactcacag

SEQ ID NO: 300885 - DNA, 15 bp, Homo sapiens
cctttgtcactcaca

SEQ ID NO: 300886 - DNA, 15 bp, Homo sapiens
gcctttgtcactcac

SEQ ID NO: 300887 - DNA, 15 bp, Homo sapiens
tgcctttgtcactca

SEQ ID NO: 300888 - DNA, 15 bp, Homo sapiens
ttgcctttgtcactc

SEQ ID NO: 300889 - DNA, 15 bp, Homo sapiens
cttgcctttgtcact

SEQ ID NO: 300890 - DNA, 15 bp, Homo sapiens
ccttgcctttgtcac

SEQ ID NO: 300891 - DNA, 15 bp, Homo sapiens
tccttgcctttgtca

SEQ ID NO: 300892 - DNA, 15 bp, Homo sapiens
ctccttgcctttgtc

SEQ ID NO: 300893 - DNA, 15 bp, Homo sapiens
cctccttgcctttgt

SEQ ID NO: 300894 - DNA, 15 bp, Homo sapiens
ccctccttgcctttg

SEQ ID NO: 300895 - DNA, 15 bp, Homo sapiens
tccctccttgccttt

SEQ ID NO: 300896 - DNA, 15 bp, Homo sapiens
ttccctccttgcctt

SEQ ID NO: 300897 - DNA, 15 bp, Homo sapiens
cttccctccttgcct

SEQ ID NO: 300898 - DNA, 15 bp, Homo sapiens
tcttccctccttgcc

SEQ ID NO: 300899 - DNA, 15 bp, Homo sapiens
ctcttccctccttgc

SEQ ID NO: 300900 - DNA, 15 bp, Homo sapiens
tctcttccctccttg

SEQ ID NO: 300901 - DNA, 15 bp, Homo sapiens
ctctcttccctcctt

SEQ ID NO: 300902 - DNA, 15 bp, Homo sapiens
tctctcttccctcct

SEQ ID NO: 300903 - DNA, 15 bp, Homo sapiens
ttctctcttccctcc

SEQ ID NO: 300904 - DNA, 15 bp, Homo sapiens
attctctcttccctc

SEQ ID NO: 300905 - DNA, 15 bp, Homo sapiens
gattctctcttccct

SEQ ID NO: 300906 - DNA, 15 bp, Homo sapiens
agattctctcttccc

SEQ ID NO: 300907 - DNA, 15 bp, Homo sapiens
aagattctctcttcc

SEQ ID NO: 300908 - DNA, 15 bp, Homo sapiens
aaagattctctcttc

SEQ ID NO: 300909 - DNA, 15 bp, Homo sapiens
aaaagattctctctt

SEQ ID NO: 300910 - DNA, 15 bp, Homo sapiens
taaaagattctctct

SEQ ID NO: 300911 - DNA, 15 bp, Homo sapiens
ttaaaagattctctc

SEQ ID NO: 300912 - DNA, 15 bp, Homo sapiens
tttaaaagattctct

SEQ ID NO: 300913 - DNA, 15 bp, Homo sapiens
ttttaaaagattctc

SEQ ID NO: 300914 - DNA, 15 bp, Homo sapiens
attttaaaagattct

SEQ ID NO: 300915 - DNA, 15 bp, Homo sapiens
gattttaaaagattc

SEQ ID NO: 300916 - DNA, 15 bp, Homo sapiens
ggattttaaaagatt

SEQ ID NO: 300917 - DNA, 15 bp, Homo sapiens
aggattttaaaagat

SEQ ID NO: 300918 - DNA, 15 bp, Homo sapiens
gaggattttaaaaga

SEQ ID NO: 300919 - DNA, 15 bp, Homo sapiens
tgaggattttaaaag

SEQ ID NO: 300920 - DNA, 15 bp, Homo sapiens
ctgaggattttaaaa

SEQ ID NO: 300921 - DNA, 15 bp, Homo sapiens
tctgaggattttaaa

SEQ ID NO: 300922 - DNA, 15 bp, Homo sapiens
atctgaggattttaa

SEQ ID NO: 300923 - DNA, 15 bp, Homo sapiens
tatctgaggatttta

SEQ ID NO: 300924 - DNA, 15 bp, Homo sapiens
atatctgaggatttt

SEQ ID NO: 300925 - DNA, 15 bp, Homo sapiens
tatatctgaggattt

SEQ ID NO: 300926 - DNA, 15 bp, Homo sapiens
ttatatctgaggatt

SEQ ID NO: 300927 - DNA, 15 bp, Homo sapiens
attatatctgaggat

SEQ ID NO: 300928 - DNA, 15 bp, Homo sapiens
tattatatctgagga

SEQ ID NO: 300929 - DNA, 15 bp, Homo sapiens
gtattatatctgagg

SEQ ID NO: 300930 - DNA, 15 bp, Homo sapiens
tgtattatatctgag

SEQ ID NO: 300931 - DNA, 15 bp, Homo sapiens
ttgtattatatctga

SEQ ID NO: 300932 - DNA, 15 bp, Homo sapiens
cttgtattatatctg

SEQ ID NO: 300933 - DNA, 15 bp, Homo sapiens
acttgtattatatct

SEQ ID NO: 300934 - DNA, 15 bp, Homo sapiens
cacttgtattatatc

SEQ ID NO: 300935 - DNA, 15 bp, Homo sapiens
gcacttgtattatat

SEQ ID NO: 300936 - DNA, 15 bp, Homo sapiens
agcacttgtattata

SEQ ID NO: 300937 - DNA, 15 bp, Homo sapiens
gagcacttgtattat

SEQ ID NO: 300938 - DNA, 15 bp, Homo sapiens
tgagcacttgtatta

SEQ ID NO: 300939 - DNA, 15 bp, Homo sapiens
ctgagcacttgtatt

SEQ ID NO: 300940 - DNA, 15 bp, Homo sapiens
tctgagcacttgtat

SEQ ID NO: 300941 - DNA, 15 bp, Homo sapiens
ttctgagcacttgta

SEQ ID NO: 300942 - DNA, 15 bp, Homo sapiens
attctgagcacttgt

SEQ ID NO: 300943 - DNA, 15 bp, Homo sapiens
aattctgagcacttg

SEQ ID NO: 300944 - DNA, 15 bp, Homo sapiens
aaattctgagcactt

SEQ ID NO: 300945 - DNA, 15 bp, Homo sapiens
taaattctgagcact

SEQ ID NO: 300946 - DNA, 15 bp, Homo sapiens
ttaaattctgagcac

SEQ ID NO: 300947 - DNA, 15 bp, Homo sapiens
tttaaattctgagca

SEQ ID NO: 300948 - DNA, 15 bp, Homo sapiens
ctttaaattctgagc

SEQ ID NO: 300949 - DNA, 15 bp, Homo sapiens
gctttaaattctgag

SEQ ID NO: 300950 - DNA, 15 bp, Homo sapiens
ctgctttaaattctg

SEQ ID NO: 300951 - DNA, 15 bp, Homo sapiens
tctgctttaaattct

SEQ ID NO: 300952 - DNA, 15 bp, Homo sapiens
ttctgctttaaattc

SEQ ID NO: 300953 - DNA, 15 bp, Homo sapiens
tttctgctttaaatt

SEQ ID NO: 300954 - DNA, 15 bp, Homo sapiens
ttttctgctttaaat

SEQ ID NO: 300955 - DNA, 15 bp, Homo sapiens
attttctgctttaaa

SEQ ID NO: 300956 - DNA, 15 bp, Homo sapiens
aattttctgctttaa

SEQ ID NO: 300957 - DNA, 15 bp, Homo sapiens
taattttctgcttta

SEQ ID NO: 300958 - DNA, 15 bp, Homo sapiens
ataattttctgcttt

SEQ ID NO: 300959 - DNA, 15 bp, Homo sapiens
gataattttctgctt

SEQ ID NO: 300960 - DNA, 15 bp, Homo sapiens
agataattttctgct

SEQ ID NO: 300961 - DNA, 15 bp, Homo sapiens
cagataattttctgc

SEQ ID NO: 300962 - DNA, 15 bp, Homo sapiens
tcagataattttctg

SEQ ID NO: 300963 - DNA, 15 bp, Homo sapiens
ctcagataattttct

SEQ ID NO: 300964 - DNA, 15 bp, Homo sapiens
cctcagataattttc

SEQ ID NO: 300965 - DNA, 15 bp, Homo sapiens
tcctcagataatttt

SEQ ID NO: 300966 - DNA, 15 bp, Homo sapiens
ctcctcagataattt

SEQ ID NO: 300967 - DNA, 15 bp, Homo sapiens
cctcctcagataatt

SEQ ID NO: 300968 - DNA, 15 bp, Homo sapiens
gcctcctcagataat

SEQ ID NO: 300969 - DNA, 15 bp, Homo sapiens
ggcctcctcagataa

SEQ ID NO: 300970 - DNA, 15 bp, Homo sapiens
aggcctcctcagata

SEQ ID NO: 300971 - DNA, 15 bp, Homo sapiens
aaggcctcctcagat

SEQ ID NO: 300972 - DNA, 15 bp, Homo sapiens
gaaggcctcctcaga

SEQ ID NO: 300973 - DNA, 15 bp, Homo sapiens
agaaggcctcctcag

SEQ ID NO: 300974 - DNA, 15 bp, Homo sapiens
gagaaggcctcctca

SEQ ID NO: 300975 - DNA, 15 bp, Homo sapiens
ggagaaggcctcctc

SEQ ID NO: 300976 - DNA, 15 bp, Homo sapiens
aggagaaggcctcct

SEQ ID NO: 300977 - DNA, 15 bp, Homo sapiens
gaggagaaggcctcc

SEQ ID NO: 300978 - DNA, 15 bp, Homo sapiens
ggaggagaaggcctc

SEQ ID NO: 300979 - DNA, 15 bp, Homo sapiens
aggaggagaaggcct

SEQ ID NO: 300980 - DNA, 15 bp, Homo sapiens
taggaggagaaggcc

SEQ ID NO: 300981 - DNA, 15 bp, Homo sapiens
gtaggaggagaaggc

SEQ ID NO: 300982 - DNA, 15 bp, Homo sapiens
agtaggaggagaagg

SEQ ID NO: 300983 - DNA, 15 bp, Homo sapiens
gagtaggaggagaag

SEQ ID NO: 300984 - DNA, 15 bp, Homo sapiens
agagtaggaggagaa

SEQ ID NO: 300985 - DNA, 15 bp, Homo sapiens
cagagtaggaggaga

SEQ ID NO: 300986 - DNA, 15 bp, Homo sapiens
acagagtaggaggag

SEQ ID NO: 300987 - DNA, 15 bp, Homo sapiens
aacagagtaggagga

SEQ ID NO: 300988 - DNA, 15 bp, Homo sapiens
aaacagagtaggagg

SEQ ID NO: 300989 - DNA, 15 bp, Homo sapiens
gaaacagagtaggag

SEQ ID NO: 300990 - DNA, 15 bp, Homo sapiens
agaaacagagtagga

SEQ ID NO: 300991 - DNA, 15 bp, Homo sapiens
tagaaacagagtagg

SEQ ID NO: 300992 - DNA, 15 bp, Homo sapiens
ctagaaacagagtag

SEQ ID NO: 300993 - DNA, 15 bp, Homo sapiens
tctagaaacagagta

SEQ ID NO: 300994 - DNA, 15 bp, Homo sapiens
atctagaaacagagt

SEQ ID NO: 300995 - DNA, 15 bp, Homo sapiens
aatctagaaacagag

SEQ ID NO: 300996 - DNA, 15 bp, Homo sapiens
aaatctagaaacaga

SEQ ID NO: 300997 - DNA, 15 bp, Homo sapiens
aaaatctagaaacag

SEQ ID NO: 300998 - DNA, 15 bp, Homo sapiens
taaaatctagaaaca

SEQ ID NO: 300999 - DNA, 15 bp, Homo sapiens
ctaaaatctagaaac

SEQ ID NO: 301000 - DNA, 15 bp, Homo sapiens
tctaaaatctagaaa

SEQ ID NO: 301001 - DNA, 15 bp, Homo sapiens
ttctaaaatctagaa

SEQ ID NO: 301002 - DNA, 15 bp, Homo sapiens
tttctaaaatctaga

SEQ ID NO: 301003 - DNA, 15 bp, Homo sapiens
atttctaaaatctag

SEQ ID NO: 301004 - DNA, 15 bp, Homo sapiens
aatttctaaaatcta

SEQ ID NO: 301005 - DNA, 15 bp, Homo sapiens
caatttctaaaatct

SEQ ID NO: 301006 - DNA, 15 bp, Homo sapiens
tcaatttctaaaatc

SEQ ID NO: 301007 - DNA, 15 bp, Homo sapiens
ctcaatttctaaaat

SEQ ID NO: 301008 - DNA, 15 bp, Homo sapiens
actcaatttctaaaa

SEQ ID NO: 301009 - DNA, 15 bp, Homo sapiens
aactcaatttctaaa

SEQ ID NO: 301010 - DNA, 15 bp, Homo sapiens
aaactcaatttctaa

SEQ ID NO: 301011 - DNA, 15 bp, Homo sapiens
taaactcaatttcta

SEQ ID NO: 301012 - DNA, 15 bp, Homo sapiens
gtaaactcaatttct

SEQ ID NO: 301013 - DNA, 15 bp, Homo sapiens
tgtaaactcaatttc

SEQ ID NO: 301014 - DNA, 15 bp, Homo sapiens
ttgtaaactcaattt

SEQ ID NO: 301015 - DNA, 15 bp, Homo sapiens
tttgtaaactcaatt

SEQ ID NO: 301016 - DNA, 15 bp, Homo sapiens
ctttgtaaactcaat

SEQ ID NO: 301017 - DNA, 15 bp, Homo sapiens
tctttgtaaactcaa

SEQ ID NO: 301018 - DNA, 15 bp, Homo sapiens
ctctttgtaaactca

SEQ ID NO: 301019 - DNA, 15 bp, Homo sapiens
gctctttgtaaactc

SEQ ID NO: 301020 - DNA, 15 bp, Homo sapiens
agctctttgtaaact

SEQ ID NO: 301021 - DNA, 15 bp, Homo sapiens
tagctctttgtaaac

SEQ ID NO: 301022 - DNA, 15 bp, Homo sapiens
ttagctctttgtaaa

SEQ ID NO: 301023 - DNA, 15 bp, Homo sapiens
tttagctctttgtaa

SEQ ID NO: 301024 - DNA, 15 bp, Homo sapiens
atttagctctttgta

SEQ ID NO: 301025 - DNA, 15 bp, Homo sapiens
catttagctctttgt

SEQ ID NO: 301026 - DNA, 15 bp, Homo sapiens
ccatttagctctttg

SEQ ID NO: 301027 - DNA, 15 bp, Homo sapiens
accatttagctcttt

SEQ ID NO: 301028 - DNA, 15 bp, Homo sapiens
aaccatttagctctt

SEQ ID NO: 301029 - DNA, 15 bp, Homo sapiens
gaaccatttagctct

SEQ ID NO: 301030 - DNA, 15 bp, Homo sapiens
ggaaccatttagctc

SEQ ID NO: 301031 - DNA, 15 bp, Homo sapiens
gggaaccatttagct

SEQ ID NO: 301032 - DNA, 15 bp, Homo sapiens
tgggaaccatttagc

SEQ ID NO: 301033 - DNA, 15 bp, Homo sapiens
ctgggaaccatttag

SEQ ID NO: 301034 - DNA, 15 bp, Homo sapiens
actgggaaccattta

SEQ ID NO: 301035 - DNA, 15 bp, Homo sapiens
aactgggaaccattt

SEQ ID NO: 301036 - DNA, 15 bp, Homo sapiens
caactgggaaccatt

SEQ ID NO: 301037 - DNA, 15 bp, Homo sapiens
acaactgggaaccat

SEQ ID NO: 301038 - DNA, 15 bp, Homo sapiens
tacaactgggaacca

SEQ ID NO: 301039 - DNA, 15 bp, Homo sapiens
gtacaactgggaacc

SEQ ID NO: 301040 - DNA, 15 bp, Homo sapiens
tgtacaactgggaac

SEQ ID NO: 301041 - DNA, 15 bp, Homo sapiens
ctgtacaactgggaa

SEQ ID NO: 301042 - DNA, 15 bp, Homo sapiens
gctgtacaactggga

SEQ ID NO: 301043 - DNA, 15 bp, Homo sapiens
tgctgtacaactggg

SEQ ID NO: 301044 - DNA, 15 bp, Homo sapiens
ttgctgtacaactgg

SEQ ID NO: 301045 - DNA, 15 bp, Homo sapiens
gttgctgtacaactg

SEQ ID NO: 301046 - DNA, 15 bp, Homo sapiens
agttgctgtacaact

SEQ ID NO: 301047 - DNA, 15 bp, Homo sapiens
aagttgctgtacaac

SEQ ID NO: 301048 - DNA, 15 bp, Homo sapiens
taagttgctgtacaa

SEQ ID NO: 301049 - DNA, 15 bp, Homo sapiens
ctaagttgctgtaca

SEQ ID NO: 301050 - DNA, 15 bp, Homo sapiens
actaagttgctgtac

SEQ ID NO: 301051 - DNA, 15 bp, Homo sapiens
cactaagttgctgta

SEQ ID NO: 301052 - DNA, 15 bp, Homo sapiens
ccactaagttgctgt

SEQ ID NO: 301053 - DNA, 15 bp, Homo sapiens
tccactaagttgctg

SEQ ID NO: 301054 - DNA, 15 bp, Homo sapiens
atccactaagttgct

SEQ ID NO: 301055 - DNA, 15 bp, Homo sapiens
catccactaagttgc

SEQ ID NO: 301056 - DNA, 15 bp, Homo sapiens
ccatccactaagttg

SEQ ID NO: 301057 - DNA, 15 bp, Homo sapiens
tccatccactaagtt

SEQ ID NO: 301058 - DNA, 15 bp, Homo sapiens
ctccatccactaagt

SEQ ID NO: 301059 - DNA, 15 bp, Homo sapiens
gctccatccactaag

SEQ ID NO: 301060 - DNA, 15 bp, Homo sapiens
tgctccatccactaa

SEQ ID NO: 301061 - DNA, 15 bp, Homo sapiens
ttgctccatccacta

SEQ ID NO: 301062 - DNA, 15 bp, Homo sapiens
tttgctccatccact

SEQ ID NO: 301063 - DNA, 15 bp, Homo sapiens
gtttgctccatccac

SEQ ID NO: 301064 - DNA, 15 bp, Homo sapiens
tgtttgctccatcca

SEQ ID NO: 301065 - DNA, 15 bp, Homo sapiens
atgtttgctccatcc

SEQ ID NO: 301066 - DNA, 15 bp, Homo sapiens
catgtttgctccatc

SEQ ID NO: 301067 - DNA, 15 bp, Homo sapiens
acatgtttgctccat

SEQ ID NO: 301068 - DNA, 15 bp, Homo sapiens
tacatgtttgctcca

SEQ ID NO: 301069 - DNA, 15 bp, Homo sapiens
ttacatgtttgctcc

SEQ ID NO: 301070 - DNA, 15 bp, Homo sapiens
gttacatgtttgctc

SEQ ID NO: 301071 - DNA, 15 bp, Homo sapiens
agttacatgtttgct

SEQ ID NO: 301072 - DNA, 15 bp, Homo sapiens
gagttacatgtttgc

SEQ ID NO: 301073 - DNA, 15 bp, Homo sapiens
tgagttacatgtttg

SEQ ID NO: 301074 - DNA, 15 bp, Homo sapiens
ttgagttacatgttt

SEQ ID NO: 301075 - DNA, 15 bp, Homo sapiens
attgagttacatgtt

SEQ ID NO: 301076 - DNA, 15 bp, Homo sapiens
tattgagttacatgt

SEQ ID NO: 301077 - DNA, 15 bp, Homo sapiens
gtattgagttacatg

SEQ ID NO: 301078 - DNA, 15 bp, Homo sapiens
tgtattgagttacat

SEQ ID NO: 301079 - DNA, 15 bp, Homo sapiens
ttgtattgagttaca

SEQ ID NO: 301080 - DNA, 15 bp, Homo sapiens
cttgtattgagttac

SEQ ID NO: 301081 - DNA, 15 bp, Homo sapiens
tcttgtattgagtta

SEQ ID NO: 301082 - DNA, 15 bp, Homo sapiens
ctcttgtattgagtt

SEQ ID NO: 301083 - DNA, 15 bp, Homo sapiens
cctcttgtattgagt

SEQ ID NO: 301084 - DNA, 15 bp, Homo sapiens
gcctcttgtattgag

SEQ ID NO: 301085 - DNA, 15 bp, Homo sapiens
ggcctcttgtattga

SEQ ID NO: 301086 - DNA, 15 bp, Homo sapiens
gggcctcttgtattg

SEQ ID NO: 301087 - DNA, 15 bp, Homo sapiens
ggggcctcttgtatt

SEQ ID NO: 301088 - DNA, 15 bp, Homo sapiens
aggggcctcttgtat

SEQ ID NO: 301089 - DNA, 15 bp, Homo sapiens
aaggggcctcttgta

SEQ ID NO: 301090 - DNA, 15 bp, Homo sapiens
aaaggggcctcttgt

SEQ ID NO: 301091 - DNA, 15 bp, Homo sapiens
gaaaggggcctcttg

SEQ ID NO: 301092 - DNA, 15 bp, Homo sapiens
ggaaaggggcctctt

SEQ ID NO: 301093 - DNA, 15 bp, Homo sapiens
gggaaaggggcctct

SEQ ID NO: 301094 - DNA, 15 bp, Homo sapiens
tgggaaaggggcctc

SEQ ID NO: 301095 - DNA, 15 bp, Homo sapiens
atgggaaaggggcct

SEQ ID NO: 301096 - DNA, 15 bp, Homo sapiens
aatgggaaaggggcc

SEQ ID NO: 301097 - DNA, 15 bp, Homo sapiens
aaatgggaaaggggc

SEQ ID NO: 301098 - DNA, 15 bp, Homo sapiens
aaaatgggaaagggg

SEQ ID NO: 301099 - DNA, 15 bp, Homo sapiens
gaaaatgggaaaggg

SEQ ID NO: 301100 - DNA, 15 bp, Homo sapiens
agaaaatgggaaagg

SEQ ID NO: 301101 - DNA, 15 bp, Homo sapiens
aagaaaatgggaaag

SEQ ID NO: 301102 - DNA, 15 bp, Homo sapiens
gaagaaaatgggaaa

SEQ ID NO: 301103 - DNA, 15 bp, Homo sapiens
ggaagaaaatgggaa

SEQ ID NO: 301104 - DNA, 15 bp, Homo sapiens
aggaagaaaatggga

SEQ ID NO: 301105 - DNA, 15 bp, Homo sapiens
aaggaagaaaatggg

SEQ ID NO: 301106 - DNA, 15 bp, Homo sapiens
gaaggaagaaaatgg

SEQ ID NO: 301107 - DNA, 15 bp, Homo sapiens
ggaaggaagaaaatg

SEQ ID NO: 301108 - DNA, 15 bp, Homo sapiens
gggaaggaagaaaat

SEQ ID NO: 301109 - DNA, 15 bp, Homo sapiens
agggaaggaagaaaa

SEQ ID NO: 301110 - DNA, 15 bp, Homo sapiens
aagggaaggaagaaa

SEQ ID NO: 301111 - DNA, 15 bp, Homo sapiens
aaagggaaggaagaa

SEQ ID NO: 301112 - DNA, 15 bp, Homo sapiens
gaaagggaaggaaga

SEQ ID NO: 301113 - DNA, 15 bp, Homo sapiens
ggaaagggaaggaag

SEQ ID NO: 301114 - DNA, 15 bp, Homo sapiens
tggaaagggaaggaa

SEQ ID NO: 301115 - DNA, 15 bp, Homo sapiens
atggaaagggaagga

SEQ ID NO: 301116 - DNA, 15 bp, Homo sapiens
catggaaagggaagg

SEQ ID NO: 301117 - DNA, 15 bp, Homo sapiens
acatggaaagggaag

SEQ ID NO: 301118 - DNA, 15 bp, Homo sapiens
cacatggaaagggaa

SEQ ID NO: 301119 - DNA, 15 bp, Homo sapiens
acacatggaaaggga

SEQ ID NO: 301120 - DNA, 15 bp, Homo sapiens
aacacatggaaaggg

SEQ ID NO: 301121 - DNA, 15 bp, Homo sapiens
aaacacatggaaagg

SEQ ID NO: 301122 - DNA, 15 bp, Homo sapiens
aaaacacatggaaag

SEQ ID NO: 301123 - DNA, 15 bp, Homo sapiens
aaaaacacatggaaa

SEQ ID NO: 301124 - DNA, 15 bp, Homo sapiens
aaaaaacacatggaa

SEQ ID NO: 301125 - DNA, 15 bp, Homo sapiens
gaaaaaacacatgga

SEQ ID NO: 301126 - DNA, 15 bp, Homo sapiens
ggaaaaaacacatgg

SEQ ID NO: 301127 - DNA, 15 bp, Homo sapiens
aggaaaaaacacatg

SEQ ID NO: 301128 - DNA, 15 bp, Homo sapiens
caggaaaaaacacat

SEQ ID NO: 301129 - DNA, 15 bp, Homo sapiens
gcaggaaaaaacaca

SEQ ID NO: 301130 - DNA, 15 bp, Homo sapiens
agcaggaaaaaacac

SEQ ID NO: 301131 - DNA, 15 bp, Homo sapiens
gagcaggaaaaaaca

SEQ ID NO: 301132 - DNA, 15 bp, Homo sapiens
agagcaggaaaaaac

SEQ ID NO: 301133 - DNA, 15 bp, Homo sapiens
aagagcaggaaaaaa

SEQ ID NO: 301134 - DNA, 15 bp, Homo sapiens
gaagagcaggaaaaa

SEQ ID NO: 301135 - DNA, 15 bp, Homo sapiens
agaagagcaggaaaa

SEQ ID NO: 301136 - DNA, 15 bp, Homo sapiens
gagaagagcaggaaa

SEQ ID NO: 301137 - DNA, 15 bp, Homo sapiens
agagaagagcaggaa

SEQ ID NO: 301138 - DNA, 15 bp, Homo sapiens
aagagaagagcagga

SEQ ID NO: 301139 - DNA, 15 bp, Homo sapiens
aaagagaagagcagg

SEQ ID NO: 301140 - DNA, 15 bp, Homo sapiens
aaaagagaagagcag

SEQ ID NO: 301141 - DNA, 15 bp, Homo sapiens
gaaaagagaagagca

SEQ ID NO: 301142 - DNA, 15 bp, Homo sapiens
agaaaagagaagagc

SEQ ID NO: 301143 - DNA, 15 bp, Homo sapiens
aagaaaagagaagag

SEQ ID NO: 301144 - DNA, 15 bp, Homo sapiens
gaagaaaagagaaga

SEQ ID NO: 301145 - DNA, 15 bp, Homo sapiens
tgaagaaaagagaag

SEQ ID NO: 301146 - DNA, 15 bp, Homo sapiens
atgaagaaaagagaa

SEQ ID NO: 301147 - DNA, 15 bp, Homo sapiens
aatgaagaaaagaga

SEQ ID NO: 301148 - DNA, 15 bp, Homo sapiens
aaatgaagaaaagag

SEQ ID NO: 301149 - DNA, 15 bp, Homo sapiens
aaaaatgaagaaaag

SEQ ID NO: 301150 - DNA, 15 bp, Homo sapiens
aaaaaatgaagaaaa

SEQ ID NO: 301151 - DNA, 15 bp, Homo sapiens
gaaaaaatgaagaaa

SEQ ID NO: 301152 - DNA, 15 bp, Homo sapiens
tgaaaaaatgaagaa

SEQ ID NO: 301153 - DNA, 15 bp, Homo sapiens
atgaaaaaatgaaga

SEQ ID NO: 301154 - DNA, 15 bp, Homo sapiens
catgaaaaaatgaag

SEQ ID NO: 301155 - DNA, 15 bp, Homo sapiens
acatgaaaaaatgaa

SEQ ID NO: 301156 - DNA, 15 bp, Homo sapiens
gacatgaaaaaatga

SEQ ID NO: 301157 - DNA, 15 bp, Homo sapiens
agacatgaaaaaatg

SEQ ID NO: 301158 - DNA, 15 bp, Homo sapiens
aagacatgaaaaaat

SEQ ID NO: 301159 - DNA, 15 bp, Homo sapiens
caagacatgaaaaaa

SEQ ID NO: 301160 - DNA, 15 bp, Homo sapiens
ccaagacatgaaaaa

SEQ ID NO: 301161 - DNA, 15 bp, Homo sapiens
cccaagacatgaaaa

SEQ ID NO: 301162 - DNA, 15 bp, Homo sapiens
acccaagacatgaaa

SEQ ID NO: 301163 - DNA, 15 bp, Homo sapiens
gacccaagacatgaa

SEQ ID NO: 301164 - DNA, 15 bp, Homo sapiens
cgacccaagacatga

SEQ ID NO: 301165 - DNA, 15 bp, Homo sapiens
tcgacccaagacatg

SEQ ID NO: 301166 - DNA, 15 bp, Homo sapiens
ttcgacccaagacat

SEQ ID NO: 301167 - DNA, 15 bp, Homo sapiens
attcgacccaagaca

SEQ ID NO: 301168 - DNA, 15 bp, Homo sapiens
cattcgacccaagac

SEQ ID NO: 301169 - DNA, 15 bp, Homo sapiens
ccattcgacccaaga

SEQ ID NO: 301170 - DNA, 15 bp, Homo sapiens
tccattcgacccaag

SEQ ID NO: 301171 - DNA, 15 bp, Homo sapiens
ttccattcgacccaa

SEQ ID NO: 301172 - DNA, 15 bp, Homo sapiens
tttccattcgaccca

SEQ ID NO: 301173 - DNA, 15 bp, Homo sapiens
atttccattcgaccc

SEQ ID NO: 301174 - DNA, 15 bp, Homo sapiens
aatttccattcgacc

SEQ ID NO: 301175 - DNA, 15 bp, Homo sapiens
gaatttccattcgac

SEQ ID NO: 301176 - DNA, 15 bp, Homo sapiens
tgaatttccattcga

SEQ ID NO: 301177 - DNA, 15 bp, Homo sapiens
atgaatttccattcg

SEQ ID NO: 301178 - DNA, 15 bp, Homo sapiens
catgaatttccattc

SEQ ID NO: 301179 - DNA, 15 bp, Homo sapiens
tcatgaatttccatt

SEQ ID NO: 301180 - DNA, 15 bp, Homo sapiens
ttcatgaatttccat

SEQ ID NO: 301181 - DNA, 15 bp, Homo sapiens
tttcatgaatttcca

SEQ ID NO: 301182 - DNA, 15 bp, Homo sapiens
ttttcatgaatttcc

SEQ ID NO: 301183 - DNA, 15 bp, Homo sapiens
cttttcatgaatttc

SEQ ID NO: 301184 - DNA, 15 bp, Homo sapiens
acttttcatgaattt

SEQ ID NO: 301185 - DNA, 15 bp, Homo sapiens
tacttttcatgaatt

SEQ ID NO: 301186 - DNA, 15 bp, Homo sapiens
atacttttcatgaat

SEQ ID NO: 301187 - DNA, 15 bp, Homo sapiens
tatacttttcatgaa

SEQ ID NO: 301188 - DNA, 15 bp, Homo sapiens
atatacttttcatga

SEQ ID NO: 301189 - DNA, 15 bp, Homo sapiens
tatatacttttcatg

SEQ ID NO: 301190 - DNA, 15 bp, Homo sapiens
atatatacttttcat

SEQ ID NO: 301191 - DNA, 15 bp, Homo sapiens
aatatatacttttca

SEQ ID NO: 301192 - DNA, 15 bp, Homo sapiens
aaatatatacttttc

SEQ ID NO: 301193 - DNA, 15 bp, Homo sapiens
aaaatatatactttt

SEQ ID NO: 301194 - DNA, 15 bp, Homo sapiens
gaaaatatatacttt

SEQ ID NO: 301195 - DNA, 15 bp, Homo sapiens
tgaaaatatatactt

SEQ ID NO: 301196 - DNA, 15 bp, Homo sapiens
gtgaaaatatatact

SEQ ID NO: 301197 - DNA, 15 bp, Homo sapiens
ggtgaaaatatatac

SEQ ID NO: 301198 - DNA, 15 bp, Homo sapiens
aggtgaaaatatata

SEQ ID NO: 301199 - DNA, 15 bp, Homo sapiens
caggtgaaaatatat

SEQ ID NO: 301200 - DNA, 15 bp, Homo sapiens
ccaggtgaaaatata

SEQ ID NO: 301201 - DNA, 15 bp, Homo sapiens
tccaggtgaaaatat

SEQ ID NO: 301202 - DNA, 15 bp, Homo sapiens
ctccaggtgaaaata

SEQ ID NO: 301203 - DNA, 15 bp, Homo sapiens
cctccaggtgaaaat

SEQ ID NO: 301204 - DNA, 15 bp, Homo sapiens
ccctccaggtgaaaa

SEQ ID NO: 301205 - DNA, 15 bp, Homo sapiens
accctccaggtgaaa

SEQ ID NO: 301206 - DNA, 15 bp, Homo sapiens
aaccctccaggtgaa

SEQ ID NO: 301207 - DNA, 15 bp, Homo sapiens
caaccctccaggtga

SEQ ID NO: 301208 - DNA, 15 bp, Homo sapiens
ccaaccctccaggtg

SEQ ID NO: 301209 - DNA, 15 bp, Homo sapiens
cccaaccctccaggt

SEQ ID NO: 301210 - DNA, 15 bp, Homo sapiens
gcccaaccctccagg

SEQ ID NO: 301211 - DNA, 15 bp, Homo sapiens
agcccaaccctccag

SEQ ID NO: 301212 - DNA, 15 bp, Homo sapiens
tagcccaaccctcca

SEQ ID NO: 301213 - DNA, 15 bp, Homo sapiens
ttagcccaaccctcc

SEQ ID NO: 301214 - DNA, 15 bp, Homo sapiens
attagcccaaccctc

SEQ ID NO: 301215 - DNA, 15 bp, Homo sapiens
tattagcccaaccct

SEQ ID NO: 301216 - DNA, 15 bp, Homo sapiens
atattagcccaaccc

SEQ ID NO: 301217 - DNA, 15 bp, Homo sapiens
aatattagcccaacc

SEQ ID NO: 301218 - DNA, 15 bp, Homo sapiens
aaatattagcccaac

SEQ ID NO: 301219 - DNA, 15 bp, Homo sapiens
taaatattagcccaa

SEQ ID NO: 301220 - DNA, 15 bp, Homo sapiens
gtaaatattagccca

SEQ ID NO: 301221 - DNA, 15 bp, Homo sapiens
tgtaaatattagccc

SEQ ID NO: 301222 - DNA, 15 bp, Homo sapiens
atgtaaatattagcc

SEQ ID NO: 301223 - DNA, 15 bp, Homo sapiens
tatgtaaatattagc

SEQ ID NO: 301224 - DNA, 15 bp, Homo sapiens
ctatgtaaatattag

SEQ ID NO: 301225 - DNA, 15 bp, Homo sapiens
gctatgtaaatatta

SEQ ID NO: 301226 - DNA, 15 bp, Homo sapiens
tgctatgtaaatatt

SEQ ID NO: 301227 - DNA, 15 bp, Homo sapiens
atgctatgtaaatat

SEQ ID NO: 301228 - DNA, 15 bp, Homo sapiens
catgctatgtaaata

SEQ ID NO: 301229 - DNA, 15 bp, Homo sapiens
tcatgctatgtaaat

SEQ ID NO: 301230 - DNA, 15 bp, Homo sapiens
atcatgctatgtaaa

SEQ ID NO: 301231 - DNA, 15 bp, Homo sapiens
gatcatgctatgtaa

SEQ ID NO: 301232 - DNA, 15 bp, Homo sapiens
agatcatgctatgta

SEQ ID NO: 301233 - DNA, 15 bp, Homo sapiens
aagatcatgctatgt

SEQ ID NO: 301234 - DNA, 15 bp, Homo sapiens
taagatcatgctatg

SEQ ID NO: 301235 - DNA, 15 bp, Homo sapiens
ttaagatcatgctat

SEQ ID NO: 301236 - DNA, 15 bp, Homo sapiens
tttaagatcatgcta

SEQ ID NO: 301237 - DNA, 15 bp, Homo sapiens
atttaagatcatgct

SEQ ID NO: 301238 - DNA, 15 bp, Homo sapiens
aatttaagatcatgc

SEQ ID NO: 301239 - DNA, 15 bp, Homo sapiens
aaatttaagatcatg

SEQ ID NO: 301240 - DNA, 15 bp, Homo sapiens
aaaatttaagatcat

SEQ ID NO: 301241 - DNA, 15 bp, Homo sapiens
aaaaatttaagatca

SEQ ID NO: 301242 - DNA, 15 bp, Homo sapiens
taaaaatttaagatc

SEQ ID NO: 301243 - DNA, 15 bp, Homo sapiens
ctaaaaatttaagat

SEQ ID NO: 301244 - DNA, 15 bp, Homo sapiens
tctaaaaatttaaga

SEQ ID NO: 301245 - DNA, 15 bp, Homo sapiens
ttctaaaaatttaag

SEQ ID NO: 301246 - DNA, 15 bp, Homo sapiens
attctaaaaatttaa

SEQ ID NO: 301247 - DNA, 15 bp, Homo sapiens
aattctaaaaattta

SEQ ID NO: 301248 - DNA, 15 bp, Homo sapiens
gaattctaaaaattt

SEQ ID NO: 301249 - DNA, 15 bp, Homo sapiens
agaattctaaaaatt

SEQ ID NO: 301250 - DNA, 15 bp, Homo sapiens
cagaattctaaaaat

SEQ ID NO: 301251 - DNA, 15 bp, Homo sapiens
tcagaattctaaaaa

SEQ ID NO: 301252 - DNA, 15 bp, Homo sapiens
gtcagaattctaaaa

SEQ ID NO: 301253 - DNA, 15 bp, Homo sapiens
tgtcagaattctaaa

SEQ ID NO: 301254 - DNA, 15 bp, Homo sapiens
gtgtcagaattctaa

SEQ ID NO: 301255 - DNA, 15 bp, Homo sapiens
ggtgtcagaattcta

SEQ ID NO: 301256 - DNA, 15 bp, Homo sapiens
aggtgtcagaattct

SEQ ID NO: 301257 - DNA, 15 bp, Homo sapiens
taggtgtcagaattc

SEQ ID NO: 301258 - DNA, 15 bp, Homo sapiens
ttaggtgtcagaatt

SEQ ID NO: 301259 - DNA, 15 bp, Homo sapiens
tttaggtgtcagaat

SEQ ID NO: 301260 - DNA, 15 bp, Homo sapiens
ttttaggtgtcagaa

SEQ ID NO: 301261 - DNA, 15 bp, Homo sapiens
attttaggtgtcaga

SEQ ID NO: 301262 - DNA, 15 bp, Homo sapiens
cattttaggtgtcag

SEQ ID NO: 301263 - DNA, 15 bp, Homo sapiens
tcattttaggtgtca

SEQ ID NO: 301264 - DNA, 15 bp, Homo sapiens
ctcattttaggtgtc

SEQ ID NO: 301265 - DNA, 15 bp, Homo sapiens
gctcattttaggtgt

SEQ ID NO: 301266 - DNA, 15 bp, Homo sapiens
tgctcattttaggtg

SEQ ID NO: 301267 - DNA, 15 bp, Homo sapiens
ctgctcattttaggt

SEQ ID NO: 301268 - DNA, 15 bp, Homo sapiens
actgctcattttagg

SEQ ID NO: 301269 - DNA, 15 bp, Homo sapiens
tactgctcattttag

SEQ ID NO: 301270 - DNA, 15 bp, Homo sapiens
atactgctcatttta

SEQ ID NO: 301271 - DNA, 15 bp, Homo sapiens
aatactgctcatttt

SEQ ID NO: 301272 - DNA, 15 bp, Homo sapiens
caatactgctcattt

SEQ ID NO: 301273 - DNA, 15 bp, Homo sapiens
acaatactgctcatt

SEQ ID NO: 301274 - DNA, 15 bp, Homo sapiens
cacaatactgctcat

SEQ ID NO: 301275 - DNA, 15 bp, Homo sapiens
acacaatactgctca

SEQ ID NO: 301276 - DNA, 15 bp, Homo sapiens
cacacaatactgctc

SEQ ID NO: 301277 - DNA, 15 bp, Homo sapiens
acacacaatactgct

SEQ ID NO: 301278 - DNA, 15 bp, Homo sapiens
gacacacaatactgc

SEQ ID NO: 301279 - DNA, 15 bp, Homo sapiens
ggacacacaatactg

SEQ ID NO: 301280 - DNA, 15 bp, Homo sapiens
tggacacacaatact

SEQ ID NO: 301281 - DNA, 15 bp, Homo sapiens
ttggacacacaatac

SEQ ID NO: 301282 - DNA, 15 bp, Homo sapiens
attggacacacaata

SEQ ID NO: 301283 - DNA, 15 bp, Homo sapiens
aattggacacacaat

SEQ ID NO: 301284 - DNA, 15 bp, Homo sapiens
taattggacacacaa

SEQ ID NO: 301285 - DNA, 15 bp, Homo sapiens
ttaattggacacaca

SEQ ID NO: 301286 - DNA, 15 bp, Homo sapiens
attaattggacacac

SEQ ID NO: 301287 - DNA, 15 bp, Homo sapiens
tattaattggacaca

SEQ ID NO: 301288 - DNA, 15 bp, Homo sapiens
ctattaattggacac

SEQ ID NO: 301289 - DNA, 15 bp, Homo sapiens
tctattaattggaca

SEQ ID NO: 301290 - DNA, 15 bp, Homo sapiens
gtctattaattggac

SEQ ID NO: 301291 - DNA, 15 bp, Homo sapiens
tgtctattaattgga

SEQ ID NO: 301292 - DNA, 15 bp, Homo sapiens
gtgtctattaattgg

SEQ ID NO: 301293 - DNA, 15 bp, Homo sapiens
tgtgtctattaattg

SEQ ID NO: 301294 - DNA, 15 bp, Homo sapiens
atgtgtctattaatt

SEQ ID NO: 301295 - DNA, 15 bp, Homo sapiens
gatgtgtctattaat

SEQ ID NO: 301296 - DNA, 15 bp, Homo sapiens
agatgtgtctattaa

SEQ ID NO: 301297 - DNA, 15 bp, Homo sapiens
gagatgtgtctatta

SEQ ID NO: 301298 - DNA, 15 bp, Homo sapiens
tgagatgtgtctatt

SEQ ID NO: 301299 - DNA, 15 bp, Homo sapiens
atgagatgtgtctat

SEQ ID NO: 301300 - DNA, 15 bp, Homo sapiens
aatgagatgtgtcta

SEQ ID NO: 301301 - DNA, 15 bp, Homo sapiens
gaatgagatgtgtct

SEQ ID NO: 301302 - DNA, 15 bp, Homo sapiens
agaatgagatgtgtc

SEQ ID NO: 301303 - DNA, 15 bp, Homo sapiens
gagaatgagatgtgt

SEQ ID NO: 301304 - DNA, 15 bp, Homo sapiens
tgagaatgagatgtg

SEQ ID NO: 301305 - DNA, 15 bp, Homo sapiens
ttgagaatgagatgt

SEQ ID NO: 301306 - DNA, 15 bp, Homo sapiens
cttgagaatgagatg

SEQ ID NO: 301307 - DNA, 15 bp, Homo sapiens
ccttgagaatgagat

SEQ ID NO: 301308 - DNA, 15 bp, Homo sapiens
tccttgagaatgaga

SEQ ID NO: 301309 - DNA, 15 bp, Homo sapiens
atccttgagaatgag

SEQ ID NO: 301310 - DNA, 15 bp, Homo sapiens
tatccttgagaatga

SEQ ID NO: 301311 - DNA, 15 bp, Homo sapiens
ttatccttgagaatg

SEQ ID NO: 301312 - DNA, 15 bp, Homo sapiens
attatccttgagaat

SEQ ID NO: 301313 - DNA, 15 bp, Homo sapiens
cattatccttgagaa

SEQ ID NO: 301314 - DNA, 15 bp, Homo sapiens
ccattatccttgaga

SEQ ID NO: 301315 - DNA, 15 bp, Homo sapiens
tccattatccttgag

SEQ ID NO: 301316 - DNA, 15 bp, Homo sapiens
ctccattatccttga

SEQ ID NO: 301317 - DNA, 15 bp, Homo sapiens
actccattatccttg

SEQ ID NO: 301318 - DNA, 15 bp, Homo sapiens
tactccattatcctt

SEQ ID NO: 301319 - DNA, 15 bp, Homo sapiens
atactccattatcct

SEQ ID NO: 301320 - DNA, 15 bp, Homo sapiens
tatactccattatcc

SEQ ID NO: 301321 - DNA, 15 bp, Homo sapiens
atatactccattatc

SEQ ID NO: 301322 - DNA, 15 bp, Homo sapiens
tatatactccattat

SEQ ID NO: 301323 - DNA, 15 bp, Homo sapiens
ctatatactccatta

SEQ ID NO: 301324 - DNA, 15 bp, Homo sapiens
cctatatactccatt

SEQ ID NO: 301325 - DNA, 15 bp, Homo sapiens
gcctatatactccat

SEQ ID NO: 301326 - DNA, 15 bp, Homo sapiens
tgcctatatactcca

SEQ ID NO: 301327 - DNA, 15 bp, Homo sapiens
gtgcctatatactcc

SEQ ID NO: 301328 - DNA, 15 bp, Homo sapiens
tgtgcctatatactc

SEQ ID NO: 301329 - DNA, 15 bp, Homo sapiens
ttgtgcctatatact

SEQ ID NO: 301330 - DNA, 15 bp, Homo sapiens
attgtgcctatatac

SEQ ID NO: 301331 - DNA, 15 bp, Homo sapiens
aattgtgcctatata

SEQ ID NO: 301332 - DNA, 15 bp, Homo sapiens
gaattgtgcctatat

SEQ ID NO: 301333 - DNA, 15 bp, Homo sapiens
tgaattgtgcctata

SEQ ID NO: 301334 - DNA, 15 bp, Homo sapiens
ttgaattgtgcctat

SEQ ID NO: 301335 - DNA, 15 bp, Homo sapiens
tttgaattgtgccta

SEQ ID NO: 301336 - DNA, 15 bp, Homo sapiens
ttttgaattgtgcct

SEQ ID NO: 301337 - DNA, 15 bp, Homo sapiens
tttttgaattgtgcc

SEQ ID NO: 301338 - DNA, 15 bp, Homo sapiens
atttttgaattgtgc

SEQ ID NO: 301339 - DNA, 15 bp, Homo sapiens
gatttttgaattgtg

SEQ ID NO: 301340 - DNA, 15 bp, Homo sapiens
ggatttttgaattgt

SEQ ID NO: 301341 - DNA, 15 bp, Homo sapiens
aggatttttgaattg

SEQ ID NO: 301342 - DNA, 15 bp, Homo sapiens
gaggatttttgaatt

SEQ ID NO: 301343 - DNA, 15 bp, Homo sapiens
agaggatttttgaat

SEQ ID NO: 301344 - DNA, 15 bp, Homo sapiens
aagaggatttttgaa

SEQ ID NO: 301345 - DNA, 15 bp, Homo sapiens
caagaggatttttga

SEQ ID NO: 301346 - DNA, 15 bp, Homo sapiens
ccaagaggatttttg

SEQ ID NO: 301347 - DNA, 15 bp, Homo sapiens
gccaagaggattttt

SEQ ID NO: 301348 - DNA, 15 bp, Homo sapiens
agccaagaggatttt

SEQ ID NO: 301349 - DNA, 15 bp, Homo sapiens
aagccaagaggattt

SEQ ID NO: 301350 - DNA, 15 bp, Homo sapiens
aaagccaagaggatt

SEQ ID NO: 301351 - DNA, 15 bp, Homo sapiens
taaagccaagaggat

SEQ ID NO: 301352 - DNA, 15 bp, Homo sapiens
ataaagccaagagga

SEQ ID NO: 301353 - DNA, 15 bp, Homo sapiens
tataaagccaagagg

SEQ ID NO: 301354 - DNA, 15 bp, Homo sapiens
atataaagccaagag

SEQ ID NO: 301355 - DNA, 15 bp, Homo sapiens
aatataaagccaaga

SEQ ID NO: 301356 - DNA, 15 bp, Homo sapiens
aaatataaagccaag

SEQ ID NO: 301357 - DNA, 15 bp, Homo sapiens
taaatataaagccaa

SEQ ID NO: 301358 - DNA, 15 bp, Homo sapiens
ttaaatataaagcca

SEQ ID NO: 301359 - DNA, 15 bp, Homo sapiens
gttaaatataaagcc

SEQ ID NO: 301360 - DNA, 15 bp, Homo sapiens
tgttaaatataaagc

SEQ ID NO: 301361 - DNA, 15 bp, Homo sapiens
atgttaaatataaag

SEQ ID NO: 301362 - DNA, 15 bp, Homo sapiens
catgttaaatataaa

SEQ ID NO: 301363 - DNA, 15 bp, Homo sapiens
tcatgttaaatataa

SEQ ID NO: 301364 - DNA, 15 bp, Homo sapiens
ttcatgttaaatata

SEQ ID NO: 301365 - DNA, 15 bp, Homo sapiens
attcatgttaaatat

SEQ ID NO: 301366 - DNA, 15 bp, Homo sapiens
gattcatgttaaata

SEQ ID NO: 301367 - DNA, 15 bp, Homo sapiens
tgattcatgttaaat

SEQ ID NO: 301368 - DNA, 15 bp, Homo sapiens
ctgattcatgttaaa

SEQ ID NO: 301369 - DNA, 15 bp, Homo sapiens
gctgattcatgttaa

SEQ ID NO: 301370 - DNA, 15 bp, Homo sapiens
cgctgattcatgtta

SEQ ID NO: 301371 - DNA, 15 bp, Homo sapiens
gcgctgattcatgtt

SEQ ID NO: 301372 - DNA, 15 bp, Homo sapiens
ggcgctgattcatgt

SEQ ID NO: 301373 - DNA, 15 bp, Homo sapiens
tggcgctgattcatg

SEQ ID NO: 301374 - DNA, 15 bp, Homo sapiens
ctggcgctgattcat

SEQ ID NO: 301375 - DNA, 15 bp, Homo sapiens
tctggcgctgattca

SEQ ID NO: 301376 - DNA, 15 bp, Homo sapiens
ctctggcgctgattc

SEQ ID NO: 301377 - DNA, 15 bp, Homo sapiens
actctggcgctgatt

SEQ ID NO: 301378 - DNA, 15 bp, Homo sapiens
aactctggcgctgat

SEQ ID NO: 301379 - DNA, 15 bp, Homo sapiens
aaactctggcgctga

SEQ ID NO: 301380 - DNA, 15 bp, Homo sapiens
gaaactctggcgctg

SEQ ID NO: 301381 - DNA, 15 bp, Homo sapiens
tgaaactctggcgct

SEQ ID NO: 301382 - DNA, 15 bp, Homo sapiens
ctgaaactctggcgc

SEQ ID NO: 301383 - DNA, 15 bp, Homo sapiens
actgaaactctggcg

SEQ ID NO: 301384 - DNA, 15 bp, Homo sapiens
aactgaaactctggc

SEQ ID NO: 301385 - DNA, 15 bp, Homo sapiens
taactgaaactctgg

SEQ ID NO: 301386 - DNA, 15 bp, Homo sapiens
ataactgaaactctg

SEQ ID NO: 301387 - DNA, 15 bp, Homo sapiens
gataactgaaactct

SEQ ID NO: 301388 - DNA, 15 bp, Homo sapiens
tgataactgaaactc

SEQ ID NO: 301389 - DNA, 15 bp, Homo sapiens
ttgataactgaaact

SEQ ID NO: 301390 - DNA, 15 bp, Homo sapiens
attgataactgaaac

SEQ ID NO: 301391 - DNA, 15 bp, Homo sapiens
tattgataactgaaa

SEQ ID NO: 301392 - DNA, 15 bp, Homo sapiens
atattgataactgaa

SEQ ID NO: 301393 - DNA, 15 bp, Homo sapiens
aatattgataactga

SEQ ID NO: 301394 - DNA, 15 bp, Homo sapiens
taatattgataactg

SEQ ID NO: 301395 - DNA, 15 bp, Homo sapiens
ttaatattgataact

SEQ ID NO: 301396 - DNA, 15 bp, Homo sapiens
attaatattgataac

SEQ ID NO: 301397 - DNA, 15 bp, Homo sapiens
tattaatattgataa

SEQ ID NO: 301398 - DNA, 15 bp, Homo sapiens
atattaatattgata

SEQ ID NO: 301399 - DNA, 15 bp, Homo sapiens
catattaatattgat

SEQ ID NO: 301400 - DNA, 15 bp, Homo sapiens
acatattaatattga

SEQ ID NO: 301401 - DNA, 15 bp, Homo sapiens
tacatattaatattg

SEQ ID NO: 301402 - DNA, 15 bp, Homo sapiens
ttacatattaatatt

SEQ ID NO: 301403 - DNA, 15 bp, Homo sapiens
gttacatattaatat

SEQ ID NO: 301404 - DNA, 15 bp, Homo sapiens
tgttacatattaata

SEQ ID NO: 301405 - DNA, 15 bp, Homo sapiens
ttgttacatattaat

SEQ ID NO: 301406 - DNA, 15 bp, Homo sapiens
tttgttacatattaa

SEQ ID NO: 301407 - DNA, 15 bp, Homo sapiens
ttttgttacatatta

SEQ ID NO: 301408 - DNA, 15 bp, Homo sapiens
attttgttacatatt

SEQ ID NO: 301409 - DNA, 15 bp, Homo sapiens
cattttgttacatat

SEQ ID NO: 301410 - DNA, 15 bp, Homo sapiens
acattttgttacata

SEQ ID NO: 301411 - DNA, 15 bp, Homo sapiens
aacattttgttacat

SEQ ID NO: 301412 - DNA, 15 bp, Homo sapiens
gaacattttgttaca

SEQ ID NO: 301413 - DNA, 15 bp, Homo sapiens
ggaacattttgttac

SEQ ID NO: 301414 - DNA, 15 bp, Homo sapiens
aggaacattttgtta

SEQ ID NO: 301415 - DNA, 15 bp, Homo sapiens
aaggaacattttgtt

SEQ ID NO: 301416 - DNA, 15 bp, Homo sapiens
aaaggaacattttgt

SEQ ID NO: 301417 - DNA, 15 bp, Homo sapiens
gaaaggaacattttg

SEQ ID NO: 301418 - DNA, 15 bp, Homo sapiens
agaaaggaacatttt

SEQ ID NO: 301419 - DNA, 15 bp, Homo sapiens
gagaaaggaacattt

SEQ ID NO: 301420 - DNA, 15 bp, Homo sapiens
tgagaaaggaacatt

SEQ ID NO: 301421 - DNA, 15 bp, Homo sapiens
atgagaaaggaacat

SEQ ID NO: 301422 - DNA, 15 bp, Homo sapiens
tatgagaaaggaaca

SEQ ID NO: 301423 - DNA, 15 bp, Homo sapiens
atatgagaaaggaac

SEQ ID NO: 301424 - DNA, 15 bp, Homo sapiens
catatgagaaaggaa

SEQ ID NO: 301425 - DNA, 15 bp, Homo sapiens
ccatatgagaaagga

SEQ ID NO: 301426 - DNA, 15 bp, Homo sapiens
cccatatgagaaagg

SEQ ID NO: 301427 - DNA, 15 bp, Homo sapiens
ccccatatgagaaag

SEQ ID NO: 301428 - DNA, 15 bp, Homo sapiens
accccatatgagaaa

SEQ ID NO: 301429 - DNA, 15 bp, Homo sapiens
aaccccatatgagaa

SEQ ID NO: 301430 - DNA, 15 bp, Homo sapiens
taaccccatatgaga

SEQ ID NO: 301431 - DNA, 15 bp, Homo sapiens
ttaaccccatatgag

SEQ ID NO: 301432 - DNA, 15 bp, Homo sapiens
attaaccccatatga

SEQ ID NO: 301433 - DNA, 15 bp, Homo sapiens
gattaaccccatatg

SEQ ID NO: 301434 - DNA, 15 bp, Homo sapiens
agattaaccccatat

SEQ ID NO: 301435 - DNA, 15 bp, Homo sapiens
gagattaaccccata

SEQ ID NO: 301436 - DNA, 15 bp, Homo sapiens
agagattaaccccat

SEQ ID NO: 301437 - DNA, 15 bp, Homo sapiens
gagagattaacccca

SEQ ID NO: 301438 - DNA, 15 bp, Homo sapiens
ggagagattaacccc

SEQ ID NO: 301439 - DNA, 15 bp, Homo sapiens
gggagagattaaccc

SEQ ID NO: 301440 - DNA, 15 bp, Homo sapiens
ggggagagattaacc

SEQ ID NO: 301441 - DNA, 15 bp, Homo sapiens
aggggagagattaac

SEQ ID NO: 301442 - DNA, 15 bp, Homo sapiens
aaggggagagattaa

SEQ ID NO: 301443 - DNA, 15 bp, Homo sapiens
gaaggggagagatta

SEQ ID NO: 301444 - DNA, 15 bp, Homo sapiens
agaaggggagagatt

SEQ ID NO: 301445 - DNA, 15 bp, Homo sapiens
gagaaggggagagat

SEQ ID NO: 301446 - DNA, 15 bp, Homo sapiens
agagaaggggagaga

SEQ ID NO: 301447 - DNA, 15 bp, Homo sapiens
cagagaaggggagag

SEQ ID NO: 301448 - DNA, 15 bp, Homo sapiens
acagagaaggggaga

SEQ ID NO: 301449 - DNA, 15 bp, Homo sapiens
gacagagaaggggag

SEQ ID NO: 301450 - DNA, 15 bp, Homo sapiens
ggacagagaagggga

SEQ ID NO: 301451 - DNA, 15 bp, Homo sapiens
aggacagagaagggg

SEQ ID NO: 301452 - DNA, 15 bp, Homo sapiens
gaggacagagaaggg

SEQ ID NO: 301453 - DNA, 15 bp, Homo sapiens
tgaggacagagaagg

SEQ ID NO: 301454 - DNA, 15 bp, Homo sapiens
ttgaggacagagaag

SEQ ID NO: 301455 - DNA, 15 bp, Homo sapiens
tttgaggacagagaa

SEQ ID NO: 301456 - DNA, 15 bp, Homo sapiens
gtttgaggacagaga

SEQ ID NO: 301457 - DNA, 15 bp, Homo sapiens
ggtttgaggacagag

SEQ ID NO: 301458 - DNA, 15 bp, Homo sapiens
tggtttgaggacaga

SEQ ID NO: 301459 - DNA, 15 bp, Homo sapiens
gtggtttgaggacag

SEQ ID NO: 301460 - DNA, 15 bp, Homo sapiens
agtggtttgaggaca

SEQ ID NO: 301461 - DNA, 15 bp, Homo sapiens
aagtggtttgaggac

SEQ ID NO: 301462 - DNA, 15 bp, Homo sapiens
gaagtggtttgagga

SEQ ID NO: 301463 - DNA, 15 bp, Homo sapiens
agaagtggtttgagg

SEQ ID NO: 301464 - DNA, 15 bp, Homo sapiens
aagaagtggtttgag

SEQ ID NO: 301465 - DNA, 15 bp, Homo sapiens
aaagaagtggtttga

SEQ ID NO: 301466 - DNA, 15 bp, Homo sapiens
caaagaagtggtttg

SEQ ID NO: 301467 - DNA, 15 bp, Homo sapiens
tcaaagaagtggttt

SEQ ID NO: 301468 - DNA, 15 bp, Homo sapiens
ttcaaagaagtggtt

SEQ ID NO: 301469 - DNA, 15 bp, Homo sapiens
attcaaagaagtggt

SEQ ID NO: 301470 - DNA, 15 bp, Homo sapiens
aattcaaagaagtgg

SEQ ID NO: 301471 - DNA, 15 bp, Homo sapiens
aaattcaaagaagtg

SEQ ID NO: 301472 - DNA, 15 bp, Homo sapiens
taaattcaaagaagt

SEQ ID NO: 301473 - DNA, 15 bp, Homo sapiens
gtaaattcaaagaag

SEQ ID NO: 301474 - DNA, 15 bp, Homo sapiens
agtaaattcaaagaa

SEQ ID NO: 301475 - DNA, 15 bp, Homo sapiens
cagtaaattcaaaga

SEQ ID NO: 301476 - DNA, 15 bp, Homo sapiens
acagtaaattcaaag

SEQ ID NO: 301477 - DNA, 15 bp, Homo sapiens
cacagtaaattcaaa

SEQ ID NO: 301478 - DNA, 15 bp, Homo sapiens
ccacagtaaattcaa

SEQ ID NO: 301479 - DNA, 15 bp, Homo sapiens
gccacagtaaattca

SEQ ID NO: 301480 - DNA, 15 bp, Homo sapiens
ggccacagtaaattc

SEQ ID NO: 301481 - DNA, 15 bp, Homo sapiens
cggccacagtaaatt

SEQ ID NO: 301482 - DNA, 15 bp, Homo sapiens
ccggccacagtaaat

SEQ ID NO: 301483 - DNA, 15 bp, Homo sapiens
gccggccacagtaaa

SEQ ID NO: 301484 - DNA, 15 bp, Homo sapiens
tgccggccacagtaa

SEQ ID NO: 301485 - DNA, 15 bp, Homo sapiens
gtgccggccacagta

SEQ ID NO: 301486 - DNA, 15 bp, Homo sapiens
agtgccggccacagt

SEQ ID NO: 301487 - DNA, 15 bp, Homo sapiens
aagtgccggccacag

SEQ ID NO: 301488 - DNA, 15 bp, Homo sapiens
taagtgccggccaca

SEQ ID NO: 301489 - DNA, 15 bp, Homo sapiens
gtaagtgccggccac

SEQ ID NO: 301490 - DNA, 15 bp, Homo sapiens
ggtaagtgccggcca

SEQ ID NO: 301491 - DNA, 15 bp, Homo sapiens
aggtaagtgccggcc

SEQ ID NO: 301492 - DNA, 15 bp, Homo sapiens
gaggtaagtgccggc

SEQ ID NO: 301493 - DNA, 15 bp, Homo sapiens
tgaggtaagtgccgg

SEQ ID NO: 301494 - DNA, 15 bp, Homo sapiens
atgaggtaagtgccg

SEQ ID NO: 301495 - DNA, 15 bp, Homo sapiens
tatgaggtaagtgcc

SEQ ID NO: 301496 - DNA, 15 bp, Homo sapiens
atatgaggtaagtgc

SEQ ID NO: 301497 - DNA, 15 bp, Homo sapiens
aatatgaggtaagtg

SEQ ID NO: 301498 - DNA, 15 bp, Homo sapiens
taatatgaggtaagt

SEQ ID NO: 301499 - DNA, 15 bp, Homo sapiens
gtaatatgaggtaag

SEQ ID NO: 301500 - DNA, 15 bp, Homo sapiens
tgtaatatgaggtaa

SEQ ID NO: 301501 - DNA, 15 bp, Homo sapiens
ttgtaatatgaggta

SEQ ID NO: 301502 - DNA, 15 bp, Homo sapiens
attgtaatatgaggt

SEQ ID NO: 301503 - DNA, 15 bp, Homo sapiens
aattgtaatatgagg

SEQ ID NO: 301504 - DNA, 15 bp, Homo sapiens
caattgtaatatgag

SEQ ID NO: 301505 - DNA, 15 bp, Homo sapiens
tcaattgtaatatga

SEQ ID NO: 301506 - DNA, 15 bp, Homo sapiens
ttcaattgtaatatg

SEQ ID NO: 301507 - DNA, 15 bp, Homo sapiens
attcaattgtaatat

SEQ ID NO: 301508 - DNA, 15 bp, Homo sapiens
cattcaattgtaata

SEQ ID NO: 301509 - DNA, 15 bp, Homo sapiens
tcattcaattgtaat

SEQ ID NO: 301510 - DNA, 15 bp, Homo sapiens
ctcattcaattgtaa

SEQ ID NO: 301511 - DNA, 15 bp, Homo sapiens
cctcattcaattgta

SEQ ID NO: 301512 - DNA, 15 bp, Homo sapiens
gcctcattcaattgt

SEQ ID NO: 301513 - DNA, 15 bp, Homo sapiens
agcctcattcaattg

SEQ ID NO: 301514 - DNA, 15 bp, Homo sapiens
cagcctcattcaatt

SEQ ID NO: 301515 - DNA, 15 bp, Homo sapiens
gcagcctcattcaat

SEQ ID NO: 301516 - DNA, 15 bp, Homo sapiens
ggcagcctcattcaa

SEQ ID NO: 301517 - DNA, 15 bp, Homo sapiens
aggcagcctcattca

SEQ ID NO: 301518 - DNA, 15 bp, Homo sapiens
caggcagcctcattc

SEQ ID NO: 301519 - DNA, 15 bp, Homo sapiens
ccaggcagcctcatt

SEQ ID NO: 301520 - DNA, 15 bp, Homo sapiens
gccaggcagcctcat

SEQ ID NO: 301521 - DNA, 15 bp, Homo sapiens
agccaggcagcctca

SEQ ID NO: 301522 - DNA, 15 bp, Homo sapiens
cagccaggcagcctc

SEQ ID NO: 301523 - DNA, 15 bp, Homo sapiens
tcagccaggcagcct

SEQ ID NO: 301524 - DNA, 15 bp, Homo sapiens
ctcagccaggcagcc

SEQ ID NO: 301525 - DNA, 15 bp, Homo sapiens
tctcagccaggcagc

SEQ ID NO: 301526 - DNA, 15 bp, Homo sapiens
atctcagccaggcag

SEQ ID NO: 301527 - DNA, 15 bp, Homo sapiens
tatctcagccaggca

SEQ ID NO: 301528 - DNA, 15 bp, Homo sapiens
atatctcagccaggc

SEQ ID NO: 301529 - DNA, 15 bp, Homo sapiens
gatatctcagccagg

SEQ ID NO: 301530 - DNA, 15 bp, Homo sapiens
agatatctcagccag

SEQ ID NO: 301531 - DNA, 15 bp, Homo sapiens
aagatatctcagcca

SEQ ID NO: 301532 - DNA, 15 bp, Homo sapiens
gaagatatctcagcc

SEQ ID NO: 301533 - DNA, 15 bp, Homo sapiens
ggaagatatctcagc

SEQ ID NO: 301534 - DNA, 15 bp, Homo sapiens
tggaagatatctcag

SEQ ID NO: 301535 - DNA, 15 bp, Homo sapiens
gtggaagatatctca

SEQ ID NO: 301536 - DNA, 15 bp, Homo sapiens
tgtggaagatatctc

SEQ ID NO: 301537 - DNA, 15 bp, Homo sapiens
gtgtggaagatatct

SEQ ID NO: 301538 - DNA, 15 bp, Homo sapiens
ggtgtggaagatatc

SEQ ID NO: 301539 - DNA, 15 bp, Homo sapiens
aggtgtggaagatat

SEQ ID NO: 301540 - DNA, 15 bp, Homo sapiens
caggtgtggaagata

SEQ ID NO: 301541 - DNA, 15 bp, Homo sapiens
gcaggtgtggaagat

SEQ ID NO: 301542 - DNA, 15 bp, Homo sapiens
agcaggtgtggaaga

SEQ ID NO: 301543 - DNA, 15 bp, Homo sapiens
aagcaggtgtggaag

SEQ ID NO: 301544 - DNA, 15 bp, Homo sapiens
gaagcaggtgtggaa

SEQ ID NO: 301545 - DNA, 15 bp, Homo sapiens
tgaagcaggtgtgga

SEQ ID NO: 301546 - DNA, 15 bp, Homo sapiens
gtgaagcaggtgtgg

SEQ ID NO: 301547 - DNA, 15 bp, Homo sapiens
tgtgaagcaggtgtg

SEQ ID NO: 301548 - DNA, 15 bp, Homo sapiens
ctgtgaagcaggtgt

SEQ ID NO: 301549 - DNA, 15 bp, Homo sapiens
cctgtgaagcaggtg

SEQ ID NO: 301550 - DNA, 15 bp, Homo sapiens
tcctgtgaagcaggt

SEQ ID NO: 301551 - DNA, 15 bp, Homo sapiens
ctcctgtgaagcagg

SEQ ID NO: 301552 - DNA, 15 bp, Homo sapiens
cctcctgtgaagcag

SEQ ID NO: 301553 - DNA, 15 bp, Homo sapiens
ccctcctgtgaagca

SEQ ID NO: 301554 - DNA, 15 bp, Homo sapiens
gccctcctgtgaagc

SEQ ID NO: 301555 - DNA, 15 bp, Homo sapiens
ggccctcctgtgaag

SEQ ID NO: 301556 - DNA, 15 bp, Homo sapiens
aggccctcctgtgaa

SEQ ID NO: 301557 - DNA, 15 bp, Homo sapiens
gaggccctcctgtga

SEQ ID NO: 301558 - DNA, 15 bp, Homo sapiens
ggaggccctcctgtg

SEQ ID NO: 301559 - DNA, 15 bp, Homo sapiens
gggaggccctcctgt

SEQ ID NO: 301560 - DNA, 15 bp, Homo sapiens
ggggaggccctcctg

SEQ ID NO: 301561 - DNA, 15 bp, Homo sapiens
aggggaggccctcct

SEQ ID NO: 301562 - DNA, 15 bp, Homo sapiens
gaggggaggccctcc

SEQ ID NO: 301563 - DNA, 15 bp, Homo sapiens
tgaggggaggccctc

SEQ ID NO: 301564 - DNA, 15 bp, Homo sapiens
ctgaggggaggccct

SEQ ID NO: 301565 - DNA, 15 bp, Homo sapiens
actgaggggaggccc

SEQ ID NO: 301566 - DNA, 15 bp, Homo sapiens
tactgaggggaggcc

SEQ ID NO: 301567 - DNA, 15 bp, Homo sapiens
gtactgaggggaggc

SEQ ID NO: 301568 - DNA, 15 bp, Homo sapiens
tgtactgaggggagg

SEQ ID NO: 301569 - DNA, 15 bp, Homo sapiens
ttgtactgaggggag

SEQ ID NO: 301570 - DNA, 15 bp, Homo sapiens
attgtactgagggga

SEQ ID NO: 301571 - DNA, 15 bp, Homo sapiens
cattgtactgagggg

SEQ ID NO: 301572 - DNA, 15 bp, Homo sapiens
gcattgtactgaggg

SEQ ID NO: 301573 - DNA, 15 bp, Homo sapiens
ggcattgtactgagg

SEQ ID NO: 301574 - DNA, 15 bp, Homo sapiens
aggcattgtactgag

SEQ ID NO: 301575 - DNA, 15 bp, Homo sapiens
caggcattgtactga

SEQ ID NO: 301576 - DNA, 15 bp, Homo sapiens
ccaggcattgtactg

SEQ ID NO: 301577 - DNA, 15 bp, Homo sapiens
tccaggcattgtact

SEQ ID NO: 301578 - DNA, 15 bp, Homo sapiens
ttccaggcattgtac

SEQ ID NO: 301579 - DNA, 15 bp, Homo sapiens
gttccaggcattgta

SEQ ID NO: 301580 - DNA, 15 bp, Homo sapiens
ggttccaggcattgt

SEQ ID NO: 301581 - DNA, 15 bp, Homo sapiens
gggttccaggcattg

SEQ ID NO: 301582 - DNA, 15 bp, Homo sapiens
tgggttccaggcatt

SEQ ID NO: 301583 - DNA, 15 bp, Homo sapiens
atgggttccaggcat

SEQ ID NO: 301584 - DNA, 15 bp, Homo sapiens
gatgggttccaggca

SEQ ID NO: 301585 - DNA, 15 bp, Homo sapiens
tgatgggttccaggc

SEQ ID NO: 301586 - DNA, 15 bp, Homo sapiens
ctgatgggttccagg

SEQ ID NO: 301587 - DNA, 15 bp, Homo sapiens
actgatgggttccag

SEQ ID NO: 301588 - DNA, 15 bp, Homo sapiens
cactgatgggttcca

SEQ ID NO: 301589 - DNA, 15 bp, Homo sapiens
acactgatgggttcc

SEQ ID NO: 301590 - DNA, 15 bp, Homo sapiens
aacactgatgggttc

SEQ ID NO: 301591 - DNA, 15 bp, Homo sapiens
aaacactgatgggtt

SEQ ID NO: 301592 - DNA, 15 bp, Homo sapiens
caaacactgatgggt

SEQ ID NO: 301593 - DNA, 15 bp, Homo sapiens
gcaaacactgatggg

SEQ ID NO: 301594 - DNA, 15 bp, Homo sapiens
agcaaacactgatgg

SEQ ID NO: 301595 - DNA, 15 bp, Homo sapiens
cagcaaacactgatg

SEQ ID NO: 301596 - DNA, 15 bp, Homo sapiens
tcagcaaacactgat

SEQ ID NO: 301597 - DNA, 15 bp, Homo sapiens
ttcagcaaacactga

SEQ ID NO: 301598 - DNA, 15 bp, Homo sapiens
attcagcaaacactg

SEQ ID NO: 301599 - DNA, 15 bp, Homo sapiens
aattcagcaaacact

SEQ ID NO: 301600 - DNA, 15 bp, Homo sapiens
aaattcagcaaacac

SEQ ID NO: 301601 - DNA, 15 bp, Homo sapiens
aaaattcagcaaaca

SEQ ID NO: 301602 - DNA, 15 bp, Homo sapiens
aaaaattcagcaaac

SEQ ID NO: 301603 - DNA, 15 bp, Homo sapiens
caaaaattcagcaaa

SEQ ID NO: 301604 - DNA, 15 bp, Homo sapiens
gcaaaaattcagcaa

SEQ ID NO: 301605 - DNA, 15 bp, Homo sapiens
agcaaaaattcagca

SEQ ID NO: 301606 - DNA, 15 bp, Homo sapiens
gagcaaaaattcagc

SEQ ID NO: 301607 - DNA, 15 bp, Homo sapiens
ggagcaaaaattcag

SEQ ID NO: 301608 - DNA, 15 bp, Homo sapiens
gggagcaaaaattca

SEQ ID NO: 301609 - DNA, 15 bp, Homo sapiens
agggagcaaaaattc

SEQ ID NO: 301610 - DNA, 15 bp, Homo sapiens
gagggagcaaaaatt

SEQ ID NO: 301611 - DNA, 15 bp, Homo sapiens
agagggagcaaaaat

SEQ ID NO: 301612 - DNA, 15 bp, Homo sapiens
tagagggagcaaaaa

SEQ ID NO: 301613 - DNA, 15 bp, Homo sapiens
ttagagggagcaaaa

SEQ ID NO: 301614 - DNA, 15 bp, Homo sapiens
gttagagggagcaaa

SEQ ID NO: 301615 - DNA, 15 bp, Homo sapiens
tgttagagggagcaa

SEQ ID NO: 301616 - DNA, 15 bp, Homo sapiens
atgttagagggagca

SEQ ID NO: 301617 - DNA, 15 bp, Homo sapiens
catgttagagggagc

SEQ ID NO: 301618 - DNA, 15 bp, Homo sapiens
ccatgttagagggag

SEQ ID NO: 301619 - DNA, 15 bp, Homo sapiens
gccatgttagaggga

SEQ ID NO: 301620 - DNA, 15 bp, Homo sapiens
tgccatgttagaggg

SEQ ID NO: 301621 - DNA, 15 bp, Homo sapiens
ttgccatgttagagg

SEQ ID NO: 301622 - DNA, 15 bp, Homo sapiens
attgccatgttagag

SEQ ID NO: 301623 - DNA, 15 bp, Homo sapiens
gattgccatgttaga

SEQ ID NO: 301624 - DNA, 15 bp, Homo sapiens
tgattgccatgttag

SEQ ID NO: 301625 - DNA, 15 bp, Homo sapiens
ttgattgccatgtta

SEQ ID NO: 301626 - DNA, 15 bp, Homo sapiens
tttgattgccatgtt

SEQ ID NO: 301627 - DNA, 15 bp, Homo sapiens
atttgattgccatgt

SEQ ID NO: 301628 - DNA, 15 bp, Homo sapiens
catttgattgccatg

SEQ ID NO: 301629 - DNA, 15 bp, Homo sapiens
acatttgattgccat

SEQ ID NO: 301630 - DNA, 15 bp, Homo sapiens
aacatttgattgcca

SEQ ID NO: 301631 - DNA, 15 bp, Homo sapiens
gaacatttgattgcc

SEQ ID NO: 301632 - DNA, 15 bp, Homo sapiens
tgaacatttgattgc

SEQ ID NO: 301633 - DNA, 15 bp, Homo sapiens
ttgaacatttgattg

SEQ ID NO: 301634 - DNA, 15 bp, Homo sapiens
tttgaacatttgatt

SEQ ID NO: 301635 - DNA, 15 bp, Homo sapiens
ttttgaacatttgat

SEQ ID NO: 301636 - DNA, 15 bp, Homo sapiens
attttgaacatttga

SEQ ID NO: 301637 - DNA, 15 bp, Homo sapiens
cattttgaacatttg

SEQ ID NO: 301638 - DNA, 15 bp, Homo sapiens
ccattttgaacattt

SEQ ID NO: 301639 - DNA, 15 bp, Homo sapiens
tccattttgaacatt

SEQ ID NO: 301640 - DNA, 15 bp, Homo sapiens
ctccattttgaacat

SEQ ID NO: 301641 - DNA, 15 bp, Homo sapiens
tctccattttgaaca

SEQ ID NO: 301642 - DNA, 15 bp, Homo sapiens
ttctccattttgaac

SEQ ID NO: 301643 - DNA, 15 bp, Homo sapiens
cttctccattttgaa

SEQ ID NO: 301644 - DNA, 15 bp, Homo sapiens
gcttctccattttga

SEQ ID NO: 301645 - DNA, 15 bp, Homo sapiens
ttgcttctccatttt

SEQ ID NO: 301646 - DNA, 15 bp, Homo sapiens
cttgcttctccattt

SEQ ID NO: 301647 - DNA, 15 bp, Homo sapiens
acttgcttctccatt

SEQ ID NO: 301648 - DNA, 15 bp, Homo sapiens
cacttgcttctccat

SEQ ID NO: 301649 - DNA, 15 bp, Homo sapiens
acacttgcttctcca

SEQ ID NO: 301650 - DNA, 15 bp, Homo sapiens
gacacttgcttctcc

SEQ ID NO: 301651 - DNA, 15 bp, Homo sapiens
agacacttgcttctc

SEQ ID NO: 301652 - DNA, 15 bp, Homo sapiens
cagacacttgcttct

SEQ ID NO: 301653 - DNA, 15 bp, Homo sapiens
tcagacacttgcttc

SEQ ID NO: 301654 - DNA, 15 bp, Homo sapiens
ttcagacacttgctt

SEQ ID NO: 301655 - DNA, 15 bp, Homo sapiens
cttcagacacttgct

SEQ ID NO: 301656 - DNA, 15 bp, Homo sapiens
tcttcagacacttgc

SEQ ID NO: 301657 - DNA, 15 bp, Homo sapiens
ttcttcagacacttg

SEQ ID NO: 301658 - DNA, 15 bp, Homo sapiens
attcttcagacactt

SEQ ID NO: 301659 - DNA, 15 bp, Homo sapiens
gattcttcagacact

SEQ ID NO: 301660 - DNA, 15 bp, Homo sapiens
ggattcttcagacac

SEQ ID NO: 301661 - DNA, 15 bp, Homo sapiens
tggattcttcagaca

SEQ ID NO: 301662 - DNA, 15 bp, Homo sapiens
ttggattcttcagac

SEQ ID NO: 301663 - DNA, 15 bp, Homo sapiens
tttggattcttcaga

SEQ ID NO: 301664 - DNA, 15 bp, Homo sapiens
atttggattcttcag

SEQ ID NO: 301665 - DNA, 15 bp, Homo sapiens
aatttggattcttca

SEQ ID NO: 301666 - DNA, 15 bp, Homo sapiens
aaatttggattcttc

SEQ ID NO: 301667 - DNA, 15 bp, Homo sapiens
caaatttggattctt

SEQ ID NO: 301668 - DNA, 15 bp, Homo sapiens
tcaaatttggattct

SEQ ID NO: 301669 - DNA, 15 bp, Homo sapiens
ttcaaatttggattc

SEQ ID NO: 301670 - DNA, 15 bp, Homo sapiens
attcaaatttggatt

SEQ ID NO: 301671 - DNA, 15 bp, Homo sapiens
tattcaaatttggat

SEQ ID NO: 301672 - DNA, 15 bp, Homo sapiens
ctattcaaatttgga

SEQ ID NO: 301673 - DNA, 15 bp, Homo sapiens
actattcaaatttgg

SEQ ID NO: 301674 - DNA, 15 bp, Homo sapiens
gactattcaaatttg

SEQ ID NO: 301675 - DNA, 15 bp, Homo sapiens
tgactattcaaattt

SEQ ID NO: 301676 - DNA, 15 bp, Homo sapiens
atgactattcaaatt

SEQ ID NO: 301677 - DNA, 15 bp, Homo sapiens
catgactattcaaat

SEQ ID NO: 301678 - DNA, 15 bp, Homo sapiens
ccatgactattcaaa

SEQ ID NO: 301679 - DNA, 15 bp, Homo sapiens
tccatgactattcaa

SEQ ID NO: 301680 - DNA, 15 bp, Homo sapiens
ctccatgactattca

SEQ ID NO: 301681 - DNA, 15 bp, Homo sapiens
tctccatgactattc

SEQ ID NO: 301682 - DNA, 15 bp, Homo sapiens
ttctccatgactatt

SEQ ID NO: 301683 - DNA, 15 bp, Homo sapiens
attctccatgactat

SEQ ID NO: 301684 - DNA, 15 bp, Homo sapiens
cattctccatgacta

SEQ ID NO: 301685 - DNA, 15 bp, Homo sapiens
ccattctccatgact

SEQ ID NO: 301686 - DNA, 15 bp, Homo sapiens
cccattctccatgac

SEQ ID NO: 301687 - DNA, 15 bp, Homo sapiens
gcccattctccatga

SEQ ID NO: 301688 - DNA, 15 bp, Homo sapiens
agcccattctccatg

SEQ ID NO: 301689 - DNA, 15 bp, Homo sapiens
gagcccattctccat

SEQ ID NO: 301690 - DNA, 15 bp, Homo sapiens
agagcccattctcca

SEQ ID NO: 301691 - DNA, 15 bp, Homo sapiens
tagagcccattctcc

SEQ ID NO: 301692 - DNA, 15 bp, Homo sapiens
ctagagcccattctc

SEQ ID NO: 301693 - DNA, 15 bp, Homo sapiens
cctagagcccattct

SEQ ID NO: 301694 - DNA, 15 bp, Homo sapiens
gcctagagcccattc

SEQ ID NO: 301695 - DNA, 15 bp, Homo sapiens
ggcctagagcccatt

SEQ ID NO: 301696 - DNA, 15 bp, Homo sapiens
tggcctagagcccat

SEQ ID NO: 301697 - DNA, 15 bp, Homo sapiens
ctggcctagagccca

SEQ ID NO: 301698 - DNA, 15 bp, Homo sapiens
tctggcctagagccc

SEQ ID NO: 301699 - DNA, 15 bp, Homo sapiens
ctctggcctagagcc

SEQ ID NO: 301700 - DNA, 15 bp, Homo sapiens
actctggcctagagc

SEQ ID NO: 301701 - DNA, 15 bp, Homo sapiens
gactctggcctagag

SEQ ID NO: 301702 - DNA, 15 bp, Homo sapiens
tgactctggcctaga

SEQ ID NO: 301703 - DNA, 15 bp, Homo sapiens
ttgactctggcctag

SEQ ID NO: 301704 - DNA, 15 bp, Homo sapiens
tttgactctggccta

SEQ ID NO: 301705 - DNA, 15 bp, Homo sapiens
atttgactctggcct

SEQ ID NO: 301706 - DNA, 15 bp, Homo sapiens
catttgactctggcc

SEQ ID NO: 301707 - DNA, 15 bp, Homo sapiens
tcatttgactctggc

SEQ ID NO: 301708 - DNA, 15 bp, Homo sapiens
ctcatttgactctgg

SEQ ID NO: 301709 - DNA, 15 bp, Homo sapiens
actcatttgactctg

SEQ ID NO: 301710 - DNA, 15 bp, Homo sapiens
aactcatttgactct

SEQ ID NO: 301711 - DNA, 15 bp, Homo sapiens
aaactcatttgactc

SEQ ID NO: 301712 - DNA, 15 bp, Homo sapiens
caaactcatttgact

SEQ ID NO: 301713 - DNA, 15 bp, Homo sapiens
gcaaactcatttgac

SEQ ID NO: 301714 - DNA, 15 bp, Homo sapiens
agcaaactcatttga

SEQ ID NO: 301715 - DNA, 15 bp, Homo sapiens
cagcaaactcatttg

SEQ ID NO: 301716 - DNA, 15 bp, Homo sapiens
gcagcaaactcattt

SEQ ID NO: 301717 - DNA, 15 bp, Homo sapiens
agcagcaaactcatt

SEQ ID NO: 301718 - DNA, 15 bp, Homo sapiens
aagcagcaaactcat

SEQ ID NO: 301719 - DNA, 15 bp, Homo sapiens
aaagcagcaaactca

SEQ ID NO: 301720 - DNA, 15 bp, Homo sapiens
gaaagcagcaaactc

SEQ ID NO: 301721 - DNA, 15 bp, Homo sapiens
tgaaagcagcaaact

SEQ ID NO: 301722 - DNA, 15 bp, Homo sapiens
ctgaaagcagcaaac

SEQ ID NO: 301723 - DNA, 15 bp, Homo sapiens
gctgaaagcagcaaa

SEQ ID NO: 301724 - DNA, 15 bp, Homo sapiens
tgctgaaagcagcaa

SEQ ID NO: 301725 - DNA, 15 bp, Homo sapiens
atgctgaaagcagca

SEQ ID NO: 301726 - DNA, 15 bp, Homo sapiens
tatgctgaaagcagc

SEQ ID NO: 301727 - DNA, 15 bp, Homo sapiens
gtatgctgaaagcag

SEQ ID NO: 301728 - DNA, 15 bp, Homo sapiens
ggtatgctgaaagca

SEQ ID NO: 301729 - DNA, 15 bp, Homo sapiens
aggtatgctgaaagc

SEQ ID NO: 301730 - DNA, 15 bp, Homo sapiens
caggtatgctgaaag

SEQ ID NO: 301731 - DNA, 15 bp, Homo sapiens
ccaggtatgctgaaa

SEQ ID NO: 301732 - DNA, 15 bp, Homo sapiens
cccaggtatgctgaa

SEQ ID NO: 301733 - DNA, 15 bp, Homo sapiens
tcccaggtatgctga

SEQ ID NO: 301734 - DNA, 15 bp, Homo sapiens
ttcccaggtatgctg

SEQ ID NO: 301735 - DNA, 15 bp, Homo sapiens
tttcccaggtatgct

SEQ ID NO: 301736 - DNA, 15 bp, Homo sapiens
ttttcccaggtatgc

SEQ ID NO: 301737 - DNA, 15 bp, Homo sapiens
cttttcccaggtatg

SEQ ID NO: 301738 - DNA, 15 bp, Homo sapiens
ccttttcccaggtat

SEQ ID NO: 301739 - DNA, 15 bp, Homo sapiens
tccttttcccaggta

SEQ ID NO: 301740 - DNA, 15 bp, Homo sapiens
ctccttttcccaggt

SEQ ID NO: 301741 - DNA, 15 bp, Homo sapiens
cctccttttcccagg

SEQ ID NO: 301742 - DNA, 15 bp, Homo sapiens
ccctccttttcccag

SEQ ID NO: 301743 - DNA, 15 bp, Homo sapiens
cccctccttttccca

SEQ ID NO: 301744 - DNA, 15 bp, Homo sapiens
gcccctccttttccc

SEQ ID NO: 301745 - DNA, 15 bp, Homo sapiens
agcccctccttttcc

SEQ ID NO: 301746 - DNA, 15 bp, Homo sapiens
gagcccctccttttc

SEQ ID NO: 301747 - DNA, 15 bp, Homo sapiens
ggagcccctcctttt

SEQ ID NO: 301748 - DNA, 15 bp, Homo sapiens
cggagcccctccttt

SEQ ID NO: 301749 - DNA, 15 bp, Homo sapiens
acggagcccctcctt

SEQ ID NO: 301750 - DNA, 15 bp, Homo sapiens
cacggagcccctcct

SEQ ID NO: 301751 - DNA, 15 bp, Homo sapiens
ccacggagcccctcc

SEQ ID NO: 301752 - DNA, 15 bp, Homo sapiens
cccacggagcccctc

SEQ ID NO: 301753 - DNA, 15 bp, Homo sapiens
gcccacggagcccct

SEQ ID NO: 301754 - DNA, 15 bp, Homo sapiens
tgcccacggagcccc

SEQ ID NO: 301755 - DNA, 15 bp, Homo sapiens
ctgcccacggagccc

SEQ ID NO: 301756 - DNA, 15 bp, Homo sapiens
actgcccacggagcc

SEQ ID NO: 301757 - DNA, 15 bp, Homo sapiens
aactgcccacggagc

SEQ ID NO: 301758 - DNA, 15 bp, Homo sapiens
aaactgcccacggag

SEQ ID NO: 301759 - DNA, 15 bp, Homo sapiens
aaaactgcccacgga

SEQ ID NO: 301760 - DNA, 15 bp, Homo sapiens
aaaaactgcccacgg

SEQ ID NO: 301761 - DNA, 15 bp, Homo sapiens
gaaaaactgcccacg

SEQ ID NO: 301762 - DNA, 15 bp, Homo sapiens
ggaaaaactgcccac

SEQ ID NO: 301763 - DNA, 15 bp, Homo sapiens
tggaaaaactgccca

SEQ ID NO: 301764 - DNA, 15 bp, Homo sapiens
ctggaaaaactgccc

SEQ ID NO: 301765 - DNA, 15 bp, Homo sapiens
actggaaaaactgcc

SEQ ID NO: 301766 - DNA, 15 bp, Homo sapiens
cactggaaaaactgc

SEQ ID NO: 301767 - DNA, 15 bp, Homo sapiens
ccactggaaaaactg

SEQ ID NO: 301768 - DNA, 15 bp, Homo sapiens
gccactggaaaaact

SEQ ID NO: 301769 - DNA, 15 bp, Homo sapiens
agccactggaaaaac

SEQ ID NO: 301770 - DNA, 15 bp, Homo sapiens
aagccactggaaaaa

SEQ ID NO: 301771 - DNA, 15 bp, Homo sapiens
gaagccactggaaaa

SEQ ID NO: 301772 - DNA, 15 bp, Homo sapiens
tgaagccactggaaa

SEQ ID NO: 301773 - DNA, 15 bp, Homo sapiens
atgaagccactggaa

SEQ ID NO: 301774 - DNA, 15 bp, Homo sapiens
aatgaagccactgga

SEQ ID NO: 301775 - DNA, 15 bp, Homo sapiens
taatgaagccactgg

SEQ ID NO: 301776 - DNA, 15 bp, Homo sapiens
ctaatgaagccactg

SEQ ID NO: 301777 - DNA, 15 bp, Homo sapiens
cctaatgaagccact

SEQ ID NO: 301778 - DNA, 15 bp, Homo sapiens
tcctaatgaagccac

SEQ ID NO: 301779 - DNA, 15 bp, Homo sapiens
ttcctaatgaagcca

SEQ ID NO: 301780 - DNA, 15 bp, Homo sapiens
gttcctaatgaagcc

SEQ ID NO: 301781 - DNA, 15 bp, Homo sapiens
tgttcctaatgaagc

SEQ ID NO: 301782 - DNA, 15 bp, Homo sapiens
atgttcctaatgaag

SEQ ID NO: 301783 - DNA, 15 bp, Homo sapiens
catgttcctaatgaa

SEQ ID NO: 301784 - DNA, 15 bp, Homo sapiens
gcatgttcctaatga

SEQ ID NO: 301785 - DNA, 15 bp, Homo sapiens
agcatgttcctaatg

SEQ ID NO: 301786 - DNA, 15 bp, Homo sapiens
aagcatgttcctaat

SEQ ID NO: 301787 - DNA, 15 bp, Homo sapiens
gaagcatgttcctaa

SEQ ID NO: 301788 - DNA, 15 bp, Homo sapiens
ggaagcatgttccta

SEQ ID NO: 301789 - DNA, 15 bp, Homo sapiens
tggaagcatgttcct

SEQ ID NO: 301790 - DNA, 15 bp, Homo sapiens
ctggaagcatgttcc

SEQ ID NO: 301791 - DNA, 15 bp, Homo sapiens
cctggaagcatgttc

SEQ ID NO: 301792 - DNA, 15 bp, Homo sapiens
ccctggaagcatgtt

SEQ ID NO: 301793 - DNA, 15 bp, Homo sapiens
tccctggaagcatgt

SEQ ID NO: 301794 - DNA, 15 bp, Homo sapiens
ctccctggaagcatg

SEQ ID NO: 301795 - DNA, 15 bp, Homo sapiens
gctccctggaagcat

SEQ ID NO: 301796 - DNA, 15 bp, Homo sapiens
tgctccctggaagca

SEQ ID NO: 301797 - DNA, 15 bp, Homo sapiens
ctgctccctggaagc

SEQ ID NO: 301798 - DNA, 15 bp, Homo sapiens
cctgctccctggaag

SEQ ID NO: 301799 - DNA, 15 bp, Homo sapiens
tcctgctccctggaa

SEQ ID NO: 301800 - DNA, 15 bp, Homo sapiens
atcctgctccctgga

SEQ ID NO: 301801 - DNA, 15 bp, Homo sapiens
tatcctgctccctgg

SEQ ID NO: 301802 - DNA, 15 bp, Homo sapiens
ttatcctgctccctg

SEQ ID NO: 301803 - DNA, 15 bp, Homo sapiens
tttatcctgctccct

SEQ ID NO: 301804 - DNA, 15 bp, Homo sapiens
ctttatcctgctccc

SEQ ID NO: 301805 - DNA, 15 bp, Homo sapiens
actttatcctgctcc

SEQ ID NO: 301806 - DNA, 15 bp, Homo sapiens
gactttatcctgctc

SEQ ID NO: 301807 - DNA, 15 bp, Homo sapiens
ggactttatcctgct

SEQ ID NO: 301808 - DNA, 15 bp, Homo sapiens
gggactttatcctgc

SEQ ID NO: 301809 - DNA, 15 bp, Homo sapiens
ggggactttatcctg

SEQ ID NO: 301810 - DNA, 15 bp, Homo sapiens
gggggactttatcct

SEQ ID NO: 301811 - DNA, 15 bp, Homo sapiens
tgggggactttatcc

SEQ ID NO: 301812 - DNA, 15 bp, Homo sapiens
atgggggactttatc

SEQ ID NO: 301813 - DNA, 15 bp, Homo sapiens
tatgggggactttat

SEQ ID NO: 301814 - DNA, 15 bp, Homo sapiens
ttatgggggacttta

SEQ ID NO: 301815 - DNA, 15 bp, Homo sapiens
tttatgggggacttt

SEQ ID NO: 301816 - DNA, 15 bp, Homo sapiens
ttttatgggggactt

SEQ ID NO: 301817 - DNA, 15 bp, Homo sapiens
attttatgggggact

SEQ ID NO: 301818 - DNA, 15 bp, Homo sapiens
tattttatgggggac

SEQ ID NO: 301819 - DNA, 15 bp, Homo sapiens
ttattttatggggga

SEQ ID NO: 301820 - DNA, 15 bp, Homo sapiens
cttattttatggggg

SEQ ID NO: 301821 - DNA, 15 bp, Homo sapiens
ccttattttatgggg

SEQ ID NO: 301822 - DNA, 15 bp, Homo sapiens
accttattttatggg

SEQ ID NO: 301823 - DNA, 15 bp, Homo sapiens
caccttattttatgg

SEQ ID NO: 301824 - DNA, 15 bp, Homo sapiens
acaccttattttatg

SEQ ID NO: 301825 - DNA, 15 bp, Homo sapiens
tacaccttattttat

SEQ ID NO: 301826 - DNA, 15 bp, Homo sapiens
ttacaccttatttta

SEQ ID NO: 301827 - DNA, 15 bp, Homo sapiens
tttacaccttatttt

SEQ ID NO: 301828 - DNA, 15 bp, Homo sapiens
ctttacaccttattt

SEQ ID NO: 301829 - DNA, 15 bp, Homo sapiens
tctttacaccttatt

SEQ ID NO: 301830 - DNA, 15 bp, Homo sapiens
gtctttacaccttat

SEQ ID NO: 301831 - DNA, 15 bp, Homo sapiens
tgtctttacacctta

SEQ ID NO: 301832 - DNA, 15 bp, Homo sapiens
ctgtctttacacctt

SEQ ID NO: 301833 - DNA, 15 bp, Homo sapiens
tctgtctttacacct

SEQ ID NO: 301834 - DNA, 15 bp, Homo sapiens
atctgtctttacacc

SEQ ID NO: 301835 - DNA, 15 bp, Homo sapiens
catctgtctttacac

SEQ ID NO: 301836 - DNA, 15 bp, Homo sapiens
ccatctgtctttaca

SEQ ID NO: 301837 - DNA, 15 bp, Homo sapiens
tccatctgtctttac

SEQ ID NO: 301838 - DNA, 15 bp, Homo sapiens
ttccatctgtcttta

SEQ ID NO: 301839 - DNA, 15 bp, Homo sapiens
attccatctgtcttt

SEQ ID NO: 301840 - DNA, 15 bp, Homo sapiens
tattccatctgtctt

SEQ ID NO: 301841 - DNA, 15 bp, Homo sapiens
atattccatctgtct

SEQ ID NO: 301842 - DNA, 15 bp, Homo sapiens
gatattccatctgtc

SEQ ID NO: 301843 - DNA, 15 bp, Homo sapiens
agatattccatctgt

SEQ ID NO: 301844 - DNA, 15 bp, Homo sapiens
aagatattccatctg

SEQ ID NO: 301845 - DNA, 15 bp, Homo sapiens
aaagatattccatct

SEQ ID NO: 301846 - DNA, 15 bp, Homo sapiens
gaaagatattccatc

SEQ ID NO: 301847 - DNA, 15 bp, Homo sapiens
ggaaagatattccat

SEQ ID NO: 301848 - DNA, 15 bp, Homo sapiens
aggaaagatattcca

SEQ ID NO: 301849 - DNA, 15 bp, Homo sapiens
caggaaagatattcc

SEQ ID NO: 301850 - DNA, 15 bp, Homo sapiens
tcaggaaagatattc

SEQ ID NO: 301851 - DNA, 15 bp, Homo sapiens
ctcaggaaagatatt

SEQ ID NO: 301852 - DNA, 15 bp, Homo sapiens
cctcaggaaagatat

SEQ ID NO: 301853 - DNA, 15 bp, Homo sapiens
ccctcaggaaagata

SEQ ID NO: 301854 - DNA, 15 bp, Homo sapiens
accctcaggaaagat

SEQ ID NO: 301855 - DNA, 15 bp, Homo sapiens
gaccctcaggaaaga

SEQ ID NO: 301856 - DNA, 15 bp, Homo sapiens
ggaccctcaggaaag

SEQ ID NO: 301857 - DNA, 15 bp, Homo sapiens
tggaccctcaggaaa

SEQ ID NO: 301858 - DNA, 15 bp, Homo sapiens
ctggaccctcaggaa

SEQ ID NO: 301859 - DNA, 15 bp, Homo sapiens
tctggaccctcagga

SEQ ID NO: 301860 - DNA, 15 bp, Homo sapiens
ttctggaccctcagg

SEQ ID NO: 301861 - DNA, 15 bp, Homo sapiens
tttctggaccctcag

SEQ ID NO: 301862 - DNA, 15 bp, Homo sapiens
ctttctggaccctca

SEQ ID NO: 301863 - DNA, 15 bp, Homo sapiens
cctttctggaccctc

SEQ ID NO: 301864 - DNA, 15 bp, Homo sapiens
gcctttctggaccct

SEQ ID NO: 301865 - DNA, 15 bp, Homo sapiens
ggcctttctggaccc

SEQ ID NO: 301866 - DNA, 15 bp, Homo sapiens
aggcctttctggacc

SEQ ID NO: 301867 - DNA, 15 bp, Homo sapiens
aaggcctttctggac

SEQ ID NO: 301868 - DNA, 15 bp, Homo sapiens
aaaggcctttctgga

SEQ ID NO: 301869 - DNA, 15 bp, Homo sapiens
aaaaggcctttctgg

SEQ ID NO: 301870 - DNA, 15 bp, Homo sapiens
taaaaggcctttctg

SEQ ID NO: 301871 - DNA, 15 bp, Homo sapiens
ataaaaggcctttct

SEQ ID NO: 301872 - DNA, 15 bp, Homo sapiens
cataaaaggcctttc

SEQ ID NO: 301873 - DNA, 15 bp, Homo sapiens
tcataaaaggccttt

SEQ ID NO: 301874 - DNA, 15 bp, Homo sapiens
atcataaaaggcctt

SEQ ID NO: 301875 - DNA, 15 bp, Homo sapiens
aatcataaaaggcct

SEQ ID NO: 301876 - DNA, 15 bp, Homo sapiens
aaatcataaaaggcc

SEQ ID NO: 301877 - DNA, 15 bp, Homo sapiens
taaatcataaaaggc

SEQ ID NO: 301878 - DNA, 15 bp, Homo sapiens
ataaatcataaaagg

SEQ ID NO: 301879 - DNA, 15 bp, Homo sapiens
cataaatcataaaag

SEQ ID NO: 301880 - DNA, 15 bp, Homo sapiens
tcataaatcataaaa

SEQ ID NO: 301881 - DNA, 15 bp, Homo sapiens
ctcataaatcataaa

SEQ ID NO: 301882 - DNA, 15 bp, Homo sapiens
cctcataaatcataa

SEQ ID NO: 301883 - DNA, 15 bp, Homo sapiens
gcctcataaatcata

SEQ ID NO: 301884 - DNA, 15 bp, Homo sapiens
tgcctcataaatcat

SEQ ID NO: 301885 - DNA, 15 bp, Homo sapiens
atgcctcataaatca

SEQ ID NO: 301886 - DNA, 15 bp, Homo sapiens
catgcctcataaatc

SEQ ID NO: 301887 - DNA, 15 bp, Homo sapiens
ccatgcctcataaat

SEQ ID NO: 301888 - DNA, 15 bp, Homo sapiens
tccatgcctcataaa

SEQ ID NO: 301889 - DNA, 15 bp, Homo sapiens
gtccatgcctcataa

SEQ ID NO: 301890 - DNA, 15 bp, Homo sapiens
ggtccatgcctcata

SEQ ID NO: 301891 - DNA, 15 bp, Homo sapiens
tggtccatgcctcat

SEQ ID NO: 301892 - DNA, 15 bp, Homo sapiens
ctggtccatgcctca

SEQ ID NO: 301893 - DNA, 15 bp, Homo sapiens
actggtccatgcctc

SEQ ID NO: 301894 - DNA, 15 bp, Homo sapiens
aactggtccatgcct

SEQ ID NO: 301895 - DNA, 15 bp, Homo sapiens
aaactggtccatgcc

SEQ ID NO: 301896 - DNA, 15 bp, Homo sapiens
caaactggtccatgc

SEQ ID NO: 301897 - DNA, 15 bp, Homo sapiens
ccaaactggtccatg

SEQ ID NO: 301898 - DNA, 15 bp, Homo sapiens
tccaaactggtccat

SEQ ID NO: 301899 - DNA, 15 bp, Homo sapiens
atccaaactggtcca

SEQ ID NO: 301900 - DNA, 15 bp, Homo sapiens
catccaaactggtcc

SEQ ID NO: 301901 - DNA, 15 bp, Homo sapiens
tcatccaaactggtc

SEQ ID NO: 301902 - DNA, 15 bp, Homo sapiens
atcatccaaactggt

SEQ ID NO: 301903 - DNA, 15 bp, Homo sapiens
aatcatccaaactgg

SEQ ID NO: 301904 - DNA, 15 bp, Homo sapiens
aaatcatccaaactg

SEQ ID NO: 301905 - DNA, 15 bp, Homo sapiens
gaaatcatccaaact

SEQ ID NO: 301906 - DNA, 15 bp, Homo sapiens
tgaaatcatccaaac

SEQ ID NO: 301907 - DNA, 15 bp, Homo sapiens
atgaaatcatccaaa

SEQ ID NO: 301908 - DNA, 15 bp, Homo sapiens
aatgaaatcatccaa

SEQ ID NO: 301909 - DNA, 15 bp, Homo sapiens
aaatgaaatcatcca

SEQ ID NO: 301910 - DNA, 15 bp, Homo sapiens
aaaatgaaatcatcc

SEQ ID NO: 301911 - DNA, 15 bp, Homo sapiens
taaaatgaaatcatc

SEQ ID NO: 301912 - DNA, 15 bp, Homo sapiens
ctaaaatgaaatcat

SEQ ID NO: 301913 - DNA, 15 bp, Homo sapiens
gctaaaatgaaatca

SEQ ID NO: 301914 - DNA, 15 bp, Homo sapiens
tgctaaaatgaaatc

SEQ ID NO: 301915 - DNA, 15 bp, Homo sapiens
gtgctaaaatgaaat

SEQ ID NO: 301916 - DNA, 15 bp, Homo sapiens
agtgctaaaatgaaa

SEQ ID NO: 301917 - DNA, 15 bp, Homo sapiens
aagtgctaaaatgaa

SEQ ID NO: 301918 - DNA, 15 bp, Homo sapiens
aaagtgctaaaatga

SEQ ID NO: 301919 - DNA, 15 bp, Homo sapiens
aaaagtgctaaaatg

SEQ ID NO: 301920 - DNA, 15 bp, Homo sapiens
aaaaagtgctaaaat

SEQ ID NO: 301921 - DNA, 15 bp, Homo sapiens
aaaaaagtgctaaaa

SEQ ID NO: 301922 - DNA, 15 bp, Homo sapiens
aaaaaaagtgctaaa

SEQ ID NO: 301923 - DNA, 15 bp, Homo sapiens
aaaaaaaagtgctaa

SEQ ID NO: 301924 - DNA, 15 bp, Homo sapiens
aaaaaaaaagtgcta

SEQ ID NO: 301925 - DNA, 15 bp, Homo sapiens
taaaaaaaaagtgct

SEQ ID NO: 301926 - DNA, 15 bp, Homo sapiens
ataaaaaaaaagtgc

SEQ ID NO: 301927 - DNA, 15 bp, Homo sapiens
aataaaaaaaaagtg

SEQ ID NO: 301928 - DNA, 15 bp, Homo sapiens
aaataaaaaaaaagt

SEQ ID NO: 301929 - DNA, 15 bp, Homo sapiens
aaaataaaaaaaaag

SEQ ID NO: 301930 - DNA, 15 bp, Homo sapiens
tagaaaaaaataaaa

SEQ ID NO: 301931 - DNA, 15 bp, Homo sapiens
ttagaaaaaaataaa

SEQ ID NO: 301932 - DNA, 15 bp, Homo sapiens
attagaaaaaaataa

SEQ ID NO: 301933 - DNA, 15 bp, Homo sapiens
aattagaaaaaaata

SEQ ID NO: 301934 - DNA, 15 bp, Homo sapiens
aaattagaaaaaaat

SEQ ID NO: 301935 - DNA, 15 bp, Homo sapiens
gaaattagaaaaaaa

SEQ ID NO: 301936 - DNA, 15 bp, Homo sapiens
tgaaattagaaaaaa

SEQ ID NO: 301937 - DNA, 15 bp, Homo sapiens
ttgaaattagaaaaa

SEQ ID NO: 301938 - DNA, 15 bp, Homo sapiens
tttgaaattagaaaa

SEQ ID NO: 301939 - DNA, 15 bp, Homo sapiens
ttttgaaattagaaa

SEQ ID NO: 301940 - DNA, 15 bp, Homo sapiens
attttgaaattagaa

SEQ ID NO: 301941 - DNA, 15 bp, Homo sapiens
gattttgaaattaga

SEQ ID NO: 301942 - DNA, 15 bp, Homo sapiens
ggattttgaaattag

SEQ ID NO: 301943 - DNA, 15 bp, Homo sapiens
aggattttgaaatta

SEQ ID NO: 301944 - DNA, 15 bp, Homo sapiens
aaggattttgaaatt

SEQ ID NO: 301945 - DNA, 15 bp, Homo sapiens
aaaggattttgaaat

SEQ ID NO: 301946 - DNA, 15 bp, Homo sapiens
aaaaggattttgaaa

SEQ ID NO: 301947 - DNA, 15 bp, Homo sapiens
taaaaggattttgaa

SEQ ID NO: 301948 - DNA, 15 bp, Homo sapiens
ctaaaaggattttga

SEQ ID NO: 301949 - DNA, 15 bp, Homo sapiens
tctaaaaggattttg

SEQ ID NO: 301950 - DNA, 15 bp, Homo sapiens
ttctaaaaggatttt

SEQ ID NO: 301951 - DNA, 15 bp, Homo sapiens
cttctaaaaggattt

SEQ ID NO: 301952 - DNA, 15 bp, Homo sapiens
tcttctaaaaggatt

SEQ ID NO: 301953 - DNA, 15 bp, Homo sapiens
gtcttctaaaaggat

SEQ ID NO: 301954 - DNA, 15 bp, Homo sapiens
ggtcttctaaaagga

SEQ ID NO: 301955 - DNA, 15 bp, Homo sapiens
tggtcttctaaaagg

SEQ ID NO: 301956 - DNA, 15 bp, Homo sapiens
ttggtcttctaaaag

SEQ ID NO: 301957 - DNA, 15 bp, Homo sapiens
tttggtcttctaaaa

SEQ ID NO: 301958 - DNA, 15 bp, Homo sapiens
atttggtcttctaaa

SEQ ID NO: 301959 - DNA, 15 bp, Homo sapiens
catttggtcttctaa

SEQ ID NO: 301960 - DNA, 15 bp, Homo sapiens
acatttggtcttcta

SEQ ID NO: 301961 - DNA, 15 bp, Homo sapiens
aacatttggtcttct

SEQ ID NO: 301962 - DNA, 15 bp, Homo sapiens
aaacatttggtcttc

SEQ ID NO: 301963 - DNA, 15 bp, Homo sapiens
caaacatttggtctt

SEQ ID NO: 301964 - DNA, 15 bp, Homo sapiens
tcaaacatttggtct

SEQ ID NO: 301965 - DNA, 15 bp, Homo sapiens
gtcaaacatttggtc

SEQ ID NO: 301966 - DNA, 15 bp, Homo sapiens
ggtcaaacatttggt

SEQ ID NO: 301967 - DNA, 15 bp, Homo sapiens
aggtcaaacatttgg

SEQ ID NO: 301968 - DNA, 15 bp, Homo sapiens
aaggtcaaacatttg

SEQ ID NO: 301969 - DNA, 15 bp, Homo sapiens
gaaggtcaaacattt

SEQ ID NO: 301970 - DNA, 15 bp, Homo sapiens
ggaaggtcaaacatt

SEQ ID NO: 301971 - DNA, 15 bp, Homo sapiens
gggaaggtcaaacat

SEQ ID NO: 301972 - DNA, 15 bp, Homo sapiens
agggaaggtcaaaca

SEQ ID NO: 301973 - DNA, 15 bp, Homo sapiens
aagggaaggtcaaac

SEQ ID NO: 301974 - DNA, 15 bp, Homo sapiens
gaagggaaggtcaaa

SEQ ID NO: 301975 - DNA, 15 bp, Homo sapiens
tgaagggaaggtcaa

SEQ ID NO: 301976 - DNA, 15 bp, Homo sapiens
ttgaagggaaggtca

SEQ ID NO: 301977 - DNA, 15 bp, Homo sapiens
tttgaagggaaggtc

SEQ ID NO: 301978 - DNA, 15 bp, Homo sapiens
ttttgaagggaaggt

SEQ ID NO: 301979 - DNA, 15 bp, Homo sapiens
cttttgaagggaagg

SEQ ID NO: 301980 - DNA, 15 bp, Homo sapiens
ccttttgaagggaag

SEQ ID NO: 301981 - DNA, 15 bp, Homo sapiens
accttttgaagggaa

SEQ ID NO: 301982 - DNA, 15 bp, Homo sapiens
aaccttttgaaggga

SEQ ID NO: 301983 - DNA, 15 bp, Homo sapiens
caaccttttgaaggg

SEQ ID NO: 301984 - DNA, 15 bp, Homo sapiens
tcaaccttttgaagg

SEQ ID NO: 301985 - DNA, 15 bp, Homo sapiens
atcaaccttttgaag

SEQ ID NO: 301986 - DNA, 15 bp, Homo sapiens
tatcaaccttttgaa

SEQ ID NO: 301987 - DNA, 15 bp, Homo sapiens
gtatcaaccttttga

SEQ ID NO: 301988 - DNA, 15 bp, Homo sapiens
ggtatcaaccttttg

SEQ ID NO: 301989 - DNA, 15 bp, Homo sapiens
tggtatcaacctttt

SEQ ID NO: 301990 - DNA, 15 bp, Homo sapiens
gtggtatcaaccttt

SEQ ID NO: 301991 - DNA, 15 bp, Homo sapiens
agtggtatcaacctt

SEQ ID NO: 301992 - DNA, 15 bp, Homo sapiens
aagtggtatcaacct

SEQ ID NO: 301993 - DNA, 15 bp, Homo sapiens
gaagtggtatcaacc

SEQ ID NO: 301994 - DNA, 15 bp, Homo sapiens
ggaagtggtatcaac

SEQ ID NO: 301995 - DNA, 15 bp, Homo sapiens
tggaagtggtatcaa

SEQ ID NO: 301996 - DNA, 15 bp, Homo sapiens
atggaagtggtatca

SEQ ID NO: 301997 - DNA, 15 bp, Homo sapiens
catggaagtggtatc

SEQ ID NO: 301998 - DNA, 15 bp, Homo sapiens
tcatggaagtggtat

SEQ ID NO: 301999 - DNA, 15 bp, Homo sapiens
ctcatggaagtggta

SEQ ID NO: 302000 - DNA, 15 bp, Homo sapiens
actcatggaagtggt

SEQ ID NO: 302001 - DNA, 15 bp, Homo sapiens
cactcatggaagtgg

SEQ ID NO: 302002 - DNA, 15 bp, Homo sapiens
acactcatggaagtg

SEQ ID NO: 302003 - DNA, 15 bp, Homo sapiens
cacactcatggaagt

SEQ ID NO: 302004 - DNA, 15 bp, Homo sapiens
ccacactcatggaag

SEQ ID NO: 302005 - DNA, 15 bp, Homo sapiens
gccacactcatggaa

SEQ ID NO: 302006 - DNA, 15 bp, Homo sapiens
ggccacactcatgga

SEQ ID NO: 302007 - DNA, 15 bp, Homo sapiens
aggccacactcatgg

SEQ ID NO: 302008 - DNA, 15 bp, Homo sapiens
caggccacactcatg

SEQ ID NO: 302009 - DNA, 15 bp, Homo sapiens
ccaggccacactcat

SEQ ID NO: 302010 - DNA, 15 bp, Homo sapiens
tccaggccacactca

SEQ ID NO: 302011 - DNA, 15 bp, Homo sapiens
atccaggccacactc

SEQ ID NO: 302012 - DNA, 15 bp, Homo sapiens
aatccaggccacact

SEQ ID NO: 302013 - DNA, 15 bp, Homo sapiens
aaatccaggccacac

SEQ ID NO: 302014 - DNA, 15 bp, Homo sapiens
taaatccaggccaca

SEQ ID NO: 302015 - DNA, 15 bp, Homo sapiens
ataaatccaggccac

SEQ ID NO: 302016 - DNA, 15 bp, Homo sapiens
tataaatccaggcca

SEQ ID NO: 302017 - DNA, 15 bp, Homo sapiens
atataaatccaggcc

SEQ ID NO: 302018 - DNA, 15 bp, Homo sapiens
aatataaatccaggc

SEQ ID NO: 302019 - DNA, 15 bp, Homo sapiens
caatataaatccagg

SEQ ID NO: 302020 - DNA, 15 bp, Homo sapiens
acaatataaatccag

SEQ ID NO: 302021 - DNA, 15 bp, Homo sapiens
gacaatataaatcca

SEQ ID NO: 302022 - DNA, 15 bp, Homo sapiens
agacaatataaatcc

SEQ ID NO: 302023 - DNA, 15 bp, Homo sapiens
gagacaatataaatc

SEQ ID NO: 302024 - DNA, 15 bp, Homo sapiens
agagacaatataaat

SEQ ID NO: 302025 - DNA, 15 bp, Homo sapiens
cagagacaatataaa

SEQ ID NO: 302026 - DNA, 15 bp, Homo sapiens
tcagagacaatataa

SEQ ID NO: 302027 - DNA, 15 bp, Homo sapiens
gtcagagacaatata

SEQ ID NO: 302028 - DNA, 15 bp, Homo sapiens
ggtcagagacaatat

SEQ ID NO: 302029 - DNA, 15 bp, Homo sapiens
aggtcagagacaata

SEQ ID NO: 302030 - DNA, 15 bp, Homo sapiens
caggtcagagacaat

SEQ ID NO: 302031 - DNA, 15 bp, Homo sapiens
ccaggtcagagacaa

SEQ ID NO: 302032 - DNA, 15 bp, Homo sapiens
cccaggtcagagaca

SEQ ID NO: 302033 - DNA, 15 bp, Homo sapiens
tcccaggtcagagac

SEQ ID NO: 302034 - DNA, 15 bp, Homo sapiens
gtcccaggtcagaga

SEQ ID NO: 302035 - DNA, 15 bp, Homo sapiens
tgtcccaggtcagag

SEQ ID NO: 302036 - DNA, 15 bp, Homo sapiens
atgtcccaggtcaga

SEQ ID NO: 302037 - DNA, 15 bp, Homo sapiens
aatgtcccaggtcag

SEQ ID NO: 302038 - DNA, 15 bp, Homo sapiens
aaatgtcccaggtca

SEQ ID NO: 302039 - DNA, 15 bp, Homo sapiens
taaatgtcccaggtc

SEQ ID NO: 302040 - DNA, 15 bp, Homo sapiens
ttaaatgtcccaggt

SEQ ID NO: 302041 - DNA, 15 bp, Homo sapiens
gttaaatgtcccagg

SEQ ID NO: 302042 - DNA, 15 bp, Homo sapiens
agttaaatgtcccag

SEQ ID NO: 302043 - DNA, 15 bp, Homo sapiens
aagttaaatgtccca

SEQ ID NO: 302044 - DNA, 15 bp, Homo sapiens
aaagttaaatgtccc

SEQ ID NO: 302045 - DNA, 15 bp, Homo sapiens
taaagttaaatgtcc

SEQ ID NO: 302046 - DNA, 15 bp, Homo sapiens
ttaaagttaaatgtc

SEQ ID NO: 302047 - DNA, 15 bp, Homo sapiens
gttaaagttaaatgt

SEQ ID NO: 302048 - DNA, 15 bp, Homo sapiens
agttaaagttaaatg

SEQ ID NO: 302049 - DNA, 15 bp, Homo sapiens
cagttaaagttaaat

SEQ ID NO: 302050 - DNA, 15 bp, Homo sapiens
ccagttaaagttaaa

SEQ ID NO: 302051 - DNA, 15 bp, Homo sapiens
gccagttaaagttaa

SEQ ID NO: 302052 - DNA, 15 bp, Homo sapiens
tgccagttaaagtta

SEQ ID NO: 302053 - DNA, 15 bp, Homo sapiens
gtgccagttaaagtt

SEQ ID NO: 302054 - DNA, 15 bp, Homo sapiens
ggtgccagttaaagt

SEQ ID NO: 302055 - DNA, 15 bp, Homo sapiens
tggtgccagttaaag

SEQ ID NO: 302056 - DNA, 15 bp, Homo sapiens
gtggtgccagttaaa

SEQ ID NO: 302057 - DNA, 15 bp, Homo sapiens
agtggtgccagttaa

SEQ ID NO: 302058 - DNA, 15 bp, Homo sapiens
tagtggtgccagtta

SEQ ID NO: 302059 - DNA, 15 bp, Homo sapiens
ttagtggtgccagtt

SEQ ID NO: 302060 - DNA, 15 bp, Homo sapiens
tttagtggtgccagt

SEQ ID NO: 302061 - DNA, 15 bp, Homo sapiens
gtttagtggtgccag

SEQ ID NO: 302062 - DNA, 15 bp, Homo sapiens
tgtttagtggtgcca

SEQ ID NO: 302063 - DNA, 15 bp, Homo sapiens
gtgtttagtggtgcc

SEQ ID NO: 302064 - DNA, 15 bp, Homo sapiens
ggtgtttagtggtgc

SEQ ID NO: 302065 - DNA, 15 bp, Homo sapiens
gggtgtttagtggtg

SEQ ID NO: 302066 - DNA, 15 bp, Homo sapiens
agggtgtttagtggt

SEQ ID NO: 302067 - DNA, 15 bp, Homo sapiens
aagggtgtttagtgg

SEQ ID NO: 302068 - DNA, 15 bp, Homo sapiens
caagggtgtttagtg

SEQ ID NO: 302069 - DNA, 15 bp, Homo sapiens
ccaagggtgtttagt

SEQ ID NO: 302070 - DNA, 15 bp, Homo sapiens
cccaagggtgtttag

SEQ ID NO: 302071 - DNA, 15 bp, Homo sapiens
acccaagggtgttta

SEQ ID NO: 302072 - DNA, 15 bp, Homo sapiens
aacccaagggtgttt

SEQ ID NO: 302073 - DNA, 15 bp, Homo sapiens
taacccaagggtgtt

SEQ ID NO: 302074 - DNA, 15 bp, Homo sapiens
ataacccaagggtgt

SEQ ID NO: 302075 - DNA, 15 bp, Homo sapiens
cataacccaagggtg

SEQ ID NO: 302076 - DNA, 15 bp, Homo sapiens
tcataacccaagggt

SEQ ID NO: 302077 - DNA, 15 bp, Homo sapiens
atcataacccaaggg

SEQ ID NO: 302078 - DNA, 15 bp, Homo sapiens
aatcataacccaagg

SEQ ID NO: 302079 - DNA, 15 bp, Homo sapiens
gaatcataacccaag

SEQ ID NO: 302080 - DNA, 15 bp, Homo sapiens
ggaatcataacccaa

SEQ ID NO: 302081 - DNA, 15 bp, Homo sapiens
aggaatcataaccca

SEQ ID NO: 302082 - DNA, 15 bp, Homo sapiens
caggaatcataaccc

SEQ ID NO: 302083 - DNA, 15 bp, Homo sapiens
gcaggaatcataacc

SEQ ID NO: 302084 - DNA, 15 bp, Homo sapiens
ggcaggaatcataac

SEQ ID NO: 302085 - DNA, 15 bp, Homo sapiens
aggcaggaatcataa

SEQ ID NO: 302086 - DNA, 15 bp, Homo sapiens
aaggcaggaatcata

SEQ ID NO: 302087 - DNA, 15 bp, Homo sapiens
caaggcaggaatcat

SEQ ID NO: 302088 - DNA, 15 bp, Homo sapiens
gcaaggcaggaatca

SEQ ID NO: 302089 - DNA, 15 bp, Homo sapiens
ggcaaggcaggaatc

SEQ ID NO: 302090 - DNA, 15 bp, Homo sapiens
aggcaaggcaggaat

SEQ ID NO: 302091 - DNA, 15 bp, Homo sapiens
aaggcaaggcaggaa

SEQ ID NO: 302092 - DNA, 15 bp, Homo sapiens
gaaggcaaggcagga

SEQ ID NO: 302093 - DNA, 15 bp, Homo sapiens
ggaaggcaaggcagg

SEQ ID NO: 302094 - DNA, 15 bp, Homo sapiens
aggaaggcaaggcag

SEQ ID NO: 302095 - DNA, 15 bp, Homo sapiens
gaggaaggcaaggca

SEQ ID NO: 302096 - DNA, 15 bp, Homo sapiens
agaggaaggcaaggc

SEQ ID NO: 302097 - DNA, 15 bp, Homo sapiens
aagaggaaggcaagg

SEQ ID NO: 302098 - DNA, 15 bp, Homo sapiens
gaagaggaaggcaag

SEQ ID NO: 302099 - DNA, 15 bp, Homo sapiens
agaagaggaaggcaa

SEQ ID NO: 302100 - DNA, 15 bp, Homo sapiens
gagaagaggaaggca

SEQ ID NO: 302101 - DNA, 15 bp, Homo sapiens
agagaagaggaaggc

SEQ ID NO: 302102 - DNA, 15 bp, Homo sapiens
cagagaagaggaagg

SEQ ID NO: 302103 - DNA, 15 bp, Homo sapiens
ccagagaagaggaag

SEQ ID NO: 302104 - DNA, 15 bp, Homo sapiens
tccagagaagaggaa

SEQ ID NO: 302105 - DNA, 15 bp, Homo sapiens
gtccagagaagagga

SEQ ID NO: 302106 - DNA, 15 bp, Homo sapiens
agtccagagaagagg

SEQ ID NO: 302107 - DNA, 15 bp, Homo sapiens
gagtccagagaagag

SEQ ID NO: 302108 - DNA, 15 bp, Homo sapiens
ggagtccagagaaga

SEQ ID NO: 302109 - DNA, 15 bp, Homo sapiens
tggagtccagagaag

SEQ ID NO: 302110 - DNA, 15 bp, Homo sapiens
gctggagtccagaga

SEQ ID NO: 302111 - DNA, 15 bp, Homo sapiens
agctggagtccagag

SEQ ID NO: 302112 - DNA, 15 bp, Homo sapiens
aagctggagtccaga

SEQ ID NO: 302113 - DNA, 15 bp, Homo sapiens
caagctggagtccag

SEQ ID NO: 302114 - DNA, 15 bp, Homo sapiens
ccaagctggagtcca

SEQ ID NO: 302115 - DNA, 15 bp, Homo sapiens
cccaagctggagtcc

SEQ ID NO: 302116 - DNA, 15 bp, Homo sapiens
tcccaagctggagtc

SEQ ID NO: 302117 - DNA, 15 bp, Homo sapiens
atcccaagctggagt

SEQ ID NO: 302118 - DNA, 15 bp, Homo sapiens
gatcccaagctggag

SEQ ID NO: 302119 - DNA, 15 bp, Homo sapiens
tgatcccaagctgga

SEQ ID NO: 302120 - DNA, 15 bp, Homo sapiens
ttgatcccaagctgg

SEQ ID NO: 302121 - DNA, 15 bp, Homo sapiens
cttgatcccaagctg

SEQ ID NO: 302122 - DNA, 15 bp, Homo sapiens
tcttgatcccaagct

SEQ ID NO: 302123 - DNA, 15 bp, Homo sapiens
atcttgatcccaagc

SEQ ID NO: 302124 - DNA, 15 bp, Homo sapiens
catcttgatcccaag

SEQ ID NO: 302125 - DNA, 15 bp, Homo sapiens
ccatcttgatcccaa

SEQ ID NO: 302126 - DNA, 15 bp, Homo sapiens
accatcttgatccca

SEQ ID NO: 302127 - DNA, 15 bp, Homo sapiens
aaccatcttgatccc

SEQ ID NO: 302128 - DNA, 15 bp, Homo sapiens
caaccatcttgatcc

SEQ ID NO: 302129 - DNA, 15 bp, Homo sapiens
ccaaccatcttgatc

SEQ ID NO: 302130 - DNA, 15 bp, Homo sapiens
gccaaccatcttgat

SEQ ID NO: 302131 - DNA, 15 bp, Homo sapiens
tgccaaccatcttga

SEQ ID NO: 302132 - DNA, 15 bp, Homo sapiens
atgccaaccatcttg

SEQ ID NO: 302133 - DNA, 15 bp, Homo sapiens
aatgccaaccatctt

SEQ ID NO: 302134 - DNA, 15 bp, Homo sapiens
caatgccaaccatct

SEQ ID NO: 302135 - DNA, 15 bp, Homo sapiens
acaatgccaaccatc

SEQ ID NO: 302136 - DNA, 15 bp, Homo sapiens
aacaatgccaaccat

SEQ ID NO: 302137 - DNA, 15 bp, Homo sapiens
taacaatgccaacca

SEQ ID NO: 302138 - DNA, 15 bp, Homo sapiens
ctaacaatgccaacc

SEQ ID NO: 302139 - DNA, 15 bp, Homo sapiens
cctaacaatgccaac

SEQ ID NO: 302140 - DNA, 15 bp, Homo sapiens
ccctaacaatgccaa

SEQ ID NO: 302141 - DNA, 15 bp, Homo sapiens
accctaacaatgcca

SEQ ID NO: 302142 - DNA, 15 bp, Homo sapiens
taccctaacaatgcc

SEQ ID NO: 302143 - DNA, 15 bp, Homo sapiens
gtaccctaacaatgc

SEQ ID NO: 302144 - DNA, 15 bp, Homo sapiens
ggtaccctaacaatg

SEQ ID NO: 302145 - DNA, 15 bp, Homo sapiens
gggtaccctaacaat

SEQ ID NO: 302146 - DNA, 15 bp, Homo sapiens
ggggtaccctaacaa

SEQ ID NO: 302147 - DNA, 15 bp, Homo sapiens
gggggtaccctaaca

SEQ ID NO: 302148 - DNA, 15 bp, Homo sapiens
agggggtaccctaac

SEQ ID NO: 302149 - DNA, 15 bp, Homo sapiens
gagggggtaccctaa

SEQ ID NO: 302150 - DNA, 15 bp, Homo sapiens
agagggggtacccta

SEQ ID NO: 302151 - DNA, 15 bp, Homo sapiens
tagagggggtaccct

SEQ ID NO: 302152 - DNA, 15 bp, Homo sapiens
gtagagggggtaccc

SEQ ID NO: 302153 - DNA, 15 bp, Homo sapiens
tgtagagggggtacc

SEQ ID NO: 302154 - DNA, 15 bp, Homo sapiens
ctgtagagggggtac

SEQ ID NO: 302155 - DNA, 15 bp, Homo sapiens
tctgtagagggggta

SEQ ID NO: 302156 - DNA, 15 bp, Homo sapiens
atctgtagagggggt

SEQ ID NO: 302157 - DNA, 15 bp, Homo sapiens
catctgtagaggggg

SEQ ID NO: 302158 - DNA, 15 bp, Homo sapiens
tcatctgtagagggg

SEQ ID NO: 302159 - DNA, 15 bp, Homo sapiens
gtcatctgtagaggg

SEQ ID NO: 302160 - DNA, 15 bp, Homo sapiens
ggtcatctgtagagg

SEQ ID NO: 302161 - DNA, 15 bp, Homo sapiens
aggtcatctgtagag

SEQ ID NO: 302162 - DNA, 15 bp, Homo sapiens
gaggtcatctgtaga

SEQ ID NO: 302163 - DNA, 15 bp, Homo sapiens
ggaggtcatctgtag

SEQ ID NO: 302164 - DNA, 15 bp, Homo sapiens
gggaggtcatctgta

SEQ ID NO: 302165 - DNA, 15 bp, Homo sapiens
tgggaggtcatctgt

SEQ ID NO: 302166 - DNA, 15 bp, Homo sapiens
gtgggaggtcatctg

SEQ ID NO: 302167 - DNA, 15 bp, Homo sapiens
tgtgggaggtcatct

SEQ ID NO: 302168 - DNA, 15 bp, Homo sapiens
ctgtgggaggtcatc

SEQ ID NO: 302169 - DNA, 15 bp, Homo sapiens
actgtgggaggtcat

SEQ ID NO: 302170 - DNA, 15 bp, Homo sapiens
gactgtgggaggtca

SEQ ID NO: 302171 - DNA, 15 bp, Homo sapiens
ggactgtgggaggtc

SEQ ID NO: 302172 - DNA, 15 bp, Homo sapiens
gggactgtgggaggt

SEQ ID NO: 302173 - DNA, 15 bp, Homo sapiens
ggggactgtgggagg

SEQ ID NO: 302174 - DNA, 15 bp, Homo sapiens
gggggactgtgggag

SEQ ID NO: 302175 - DNA, 15 bp, Homo sapiens
tgggggactgtggga

SEQ ID NO: 302176 - DNA, 15 bp, Homo sapiens
ctgggggactgtggg

SEQ ID NO: 302177 - DNA, 15 bp, Homo sapiens
cctgggggactgtgg

SEQ ID NO: 302178 - DNA, 15 bp, Homo sapiens
tcctgggggactgtg

SEQ ID NO: 302179 - DNA, 15 bp, Homo sapiens
ttcctgggggactgt

SEQ ID NO: 302180 - DNA, 15 bp, Homo sapiens
cttcctgggggactg

SEQ ID NO: 302181 - DNA, 15 bp, Homo sapiens
tcttcctgggggact

SEQ ID NO: 302182 - DNA, 15 bp, Homo sapiens
gtcttcctgggggac

SEQ ID NO: 302183 - DNA, 15 bp, Homo sapiens
tgtcttcctggggga

SEQ ID NO: 302184 - DNA, 15 bp, Homo sapiens
atgtcttcctggggg

SEQ ID NO: 302185 - DNA, 15 bp, Homo sapiens
catgtcttcctgggg

SEQ ID NO: 302186 - DNA, 15 bp, Homo sapiens
ccatgtcttcctggg

SEQ ID NO: 302187 - DNA, 15 bp, Homo sapiens
cccatgtcttcctgg

SEQ ID NO: 302188 - DNA, 15 bp, Homo sapiens
tcccatgtcttcctg

SEQ ID NO: 302189 - DNA, 15 bp, Homo sapiens
atcccatgtcttcct

SEQ ID NO: 302190 - DNA, 15 bp, Homo sapiens
tatcccatgtcttcc

SEQ ID NO: 302191 - DNA, 15 bp, Homo sapiens
atatcccatgtcttc

SEQ ID NO: 302192 - DNA, 15 bp, Homo sapiens
aatatcccatgtctt

SEQ ID NO: 302193 - DNA, 15 bp, Homo sapiens
aaatatcccatgtct

SEQ ID NO: 302194 - DNA, 15 bp, Homo sapiens
aaaatatcccatgtc

SEQ ID NO: 302195 - DNA, 15 bp, Homo sapiens
gaaaatatcccatgt

SEQ ID NO: 302196 - DNA, 15 bp, Homo sapiens
tgaaaatatcccatg

SEQ ID NO: 302197 - DNA, 15 bp, Homo sapiens
gtgaaaatatcccat

SEQ ID NO: 302198 - DNA, 15 bp, Homo sapiens
ggtgaaaatatccca

SEQ ID NO: 302199 - DNA, 15 bp, Homo sapiens
tggtgaaaatatccc

SEQ ID NO: 302200 - DNA, 15 bp, Homo sapiens
ctggtgaaaatatcc

SEQ ID NO: 302201 - DNA, 15 bp, Homo sapiens
gctggtgaaaatatc

SEQ ID NO: 302202 - DNA, 15 bp, Homo sapiens
ggctggtgaaaatat

SEQ ID NO: 302203 - DNA, 15 bp, Homo sapiens
aggctggtgaaaata

SEQ ID NO: 302204 - DNA, 15 bp, Homo sapiens
gaggctggtgaaaat

SEQ ID NO: 302205 - DNA, 15 bp, Homo sapiens
tgaggctggtgaaaa

SEQ ID NO: 302206 - DNA, 15 bp, Homo sapiens
atgaggctggtgaaa

SEQ ID NO: 302207 - DNA, 15 bp, Homo sapiens
aatgaggctggtgaa

SEQ ID NO: 302208 - DNA, 15 bp, Homo sapiens
gaatgaggctggtga

SEQ ID NO: 302209 - DNA, 15 bp, Homo sapiens
cgaatgaggctggtg

SEQ ID NO: 302210 - DNA, 15 bp, Homo sapiens
gcgaatgaggctggt

SEQ ID NO: 302211 - DNA, 15 bp, Homo sapiens
agcgaatgaggctgg

SEQ ID NO: 302212 - DNA, 15 bp, Homo sapiens
gagcgaatgaggctg

SEQ ID NO: 302213 - DNA, 15 bp, Homo sapiens
tgagcgaatgaggct

SEQ ID NO: 302214 - DNA, 15 bp, Homo sapiens
gtgagcgaatgaggc

SEQ ID NO: 302215 - DNA, 15 bp, Homo sapiens
ggtgagcgaatgagg

SEQ ID NO: 302216 - DNA, 15 bp, Homo sapiens
tggtgagcgaatgag

SEQ ID NO: 302217 - DNA, 15 bp, Homo sapiens
atggtgagcgaatga

SEQ ID NO: 302218 - DNA, 15 bp, Homo sapiens
aatggtgagcgaatg

SEQ ID NO: 302219 - DNA, 15 bp, Homo sapiens
caatggtgagcgaat

SEQ ID NO: 302220 - DNA, 15 bp, Homo sapiens
ccaatggtgagcgaa

SEQ ID NO: 302221 - DNA, 15 bp, Homo sapiens
accaatggtgagcga

SEQ ID NO: 302222 - DNA, 15 bp, Homo sapiens
taccaatggtgagcg

SEQ ID NO: 302223 - DNA, 15 bp, Homo sapiens
gtaccaatggtgagc

SEQ ID NO: 302224 - DNA, 15 bp, Homo sapiens
ggtaccaatggtgag

SEQ ID NO: 302225 - DNA, 15 bp, Homo sapiens
aggtaccaatggtga

SEQ ID NO: 302226 - DNA, 15 bp, Homo sapiens
aaggtaccaatggtg

SEQ ID NO: 302227 - DNA, 15 bp, Homo sapiens
gaaggtaccaatggt

SEQ ID NO: 302228 - DNA, 15 bp, Homo sapiens
tgaaggtaccaatgg

SEQ ID NO: 302229 - DNA, 15 bp, Homo sapiens
ctgaaggtaccaatg

SEQ ID NO: 302230 - DNA, 15 bp, Homo sapiens
gctgaaggtaccaat

SEQ ID NO: 302231 - DNA, 15 bp, Homo sapiens
tgctgaaggtaccaa

SEQ ID NO: 302232 - DNA, 15 bp, Homo sapiens
ctgctgaaggtacca

SEQ ID NO: 302233 - DNA, 15 bp, Homo sapiens
tctgctgaaggtacc

SEQ ID NO: 302234 - DNA, 15 bp, Homo sapiens
ttctgctgaaggtac

SEQ ID NO: 302235 - DNA, 15 bp, Homo sapiens
tttctgctgaaggta

SEQ ID NO: 302236 - DNA, 15 bp, Homo sapiens
ctttctgctgaaggt

SEQ ID NO: 302237 - DNA, 15 bp, Homo sapiens
tctttctgctgaagg

SEQ ID NO: 302238 - DNA, 15 bp, Homo sapiens
ttctttctgctgaag

SEQ ID NO: 302239 - DNA, 15 bp, Homo sapiens
tttctttctgctgaa

SEQ ID NO: 302240 - DNA, 15 bp, Homo sapiens
atttctttctgctga

SEQ ID NO: 302241 - DNA, 15 bp, Homo sapiens
catttctttctgctg

SEQ ID NO: 302242 - DNA, 15 bp, Homo sapiens
tcatttctttctgct

SEQ ID NO: 302243 - DNA, 15 bp, Homo sapiens
ttcatttctttctgc

SEQ ID NO: 302244 - DNA, 15 bp, Homo sapiens
cttcatttctttctg

SEQ ID NO: 302245 - DNA, 15 bp, Homo sapiens
acttcatttctttct

SEQ ID NO: 302246 - DNA, 15 bp, Homo sapiens
gacttcatttctttc

SEQ ID NO: 302247 - DNA, 15 bp, Homo sapiens
ggacttcatttcttt

SEQ ID NO: 302248 - DNA, 15 bp, Homo sapiens
aggacttcatttctt

SEQ ID NO: 302249 - DNA, 15 bp, Homo sapiens
gaggacttcatttct

SEQ ID NO: 302250 - DNA, 15 bp, Homo sapiens
agaggacttcatttc

SEQ ID NO: 302251 - DNA, 15 bp, Homo sapiens
gagaggacttcattt

SEQ ID NO: 302252 - DNA, 15 bp, Homo sapiens
ggagaggacttcatt

SEQ ID NO: 302253 - DNA, 15 bp, Homo sapiens
tggagaggacttcat

SEQ ID NO: 302254 - DNA, 15 bp, Homo sapiens
atggagaggacttca

SEQ ID NO: 302255 - DNA, 15 bp, Homo sapiens
aatggagaggacttc

SEQ ID NO: 302256 - DNA, 15 bp, Homo sapiens
aaatggagaggactt

SEQ ID NO: 302257 - DNA, 15 bp, Homo sapiens
aaaatggagaggact

SEQ ID NO: 302258 - DNA, 15 bp, Homo sapiens
taaaatggagaggac

SEQ ID NO: 302259 - DNA, 15 bp, Homo sapiens
ttaaaatggagagga

SEQ ID NO: 302260 - DNA, 15 bp, Homo sapiens
gttaaaatggagagg

SEQ ID NO: 302261 - DNA, 15 bp, Homo sapiens
agttaaaatggagag

SEQ ID NO: 302262 - DNA, 15 bp, Homo sapiens
aagttaaaatggaga

SEQ ID NO: 302263 - DNA, 15 bp, Homo sapiens
aaagttaaaatggag

SEQ ID NO: 302264 - DNA, 15 bp, Homo sapiens
caaagttaaaatgga

SEQ ID NO: 302265 - DNA, 15 bp, Homo sapiens
gcaaagttaaaatgg

SEQ ID NO: 302266 - DNA, 15 bp, Homo sapiens
agcaaagttaaaatg

SEQ ID NO: 302267 - DNA, 15 bp, Homo sapiens
aagcaaagttaaaat

SEQ ID NO: 302268 - DNA, 15 bp, Homo sapiens
gaagcaaagttaaaa

SEQ ID NO: 302269 - DNA, 15 bp, Homo sapiens
ggaagcaaagttaaa

SEQ ID NO: 302270 - DNA, 15 bp, Homo sapiens
tggaagcaaagttaa

SEQ ID NO: 302271 - DNA, 15 bp, Homo sapiens
ctggaagcaaagtta

SEQ ID NO: 302272 - DNA, 15 bp, Homo sapiens
gctggaagcaaagtt

SEQ ID NO: 302273 - DNA, 15 bp, Homo sapiens
ggctggaagcaaagt

SEQ ID NO: 302274 - DNA, 15 bp, Homo sapiens
aggctggaagcaaag

SEQ ID NO: 302275 - DNA, 15 bp, Homo sapiens
caggctggaagcaaa

SEQ ID NO: 302276 - DNA, 15 bp, Homo sapiens
ccaggctggaagcaa

SEQ ID NO: 302277 - DNA, 15 bp, Homo sapiens
gccaggctggaagca

SEQ ID NO: 302278 - DNA, 15 bp, Homo sapiens
ggccaggctggaagc

SEQ ID NO: 302279 - DNA, 15 bp, Homo sapiens
tggccaggctggaag

SEQ ID NO: 302280 - DNA, 15 bp, Homo sapiens
ttggccaggctggaa

SEQ ID NO: 302281 - DNA, 15 bp, Homo sapiens
cttggccaggctgga

SEQ ID NO: 302282 - DNA, 15 bp, Homo sapiens
tcttggccaggctgg

SEQ ID NO: 302283 - DNA, 15 bp, Homo sapiens
ctcttggccaggctg

SEQ ID NO: 302284 - DNA, 15 bp, Homo sapiens
tctcttggccaggct

SEQ ID NO: 302285 - DNA, 15 bp, Homo sapiens
ttctcttggccaggc

SEQ ID NO: 302286 - DNA, 15 bp, Homo sapiens
tttctcttggccagg

SEQ ID NO: 302287 - DNA, 15 bp, Homo sapiens
ttttctcttggccag

SEQ ID NO: 302288 - DNA, 15 bp, Homo sapiens
cttttctcttggcca

SEQ ID NO: 302289 - DNA, 15 bp, Homo sapiens
tcttttctcttggcc

SEQ ID NO: 302290 - DNA, 15 bp, Homo sapiens
gtcttttctcttggc

SEQ ID NO: 302291 - DNA, 15 bp, Homo sapiens
agtcttttctcttgg

SEQ ID NO: 302292 - DNA, 15 bp, Homo sapiens
aagtcttttctcttg

SEQ ID NO: 302293 - DNA, 15 bp, Homo sapiens
aaagtcttttctctt

SEQ ID NO: 302294 - DNA, 15 bp, Homo sapiens
gaaagtcttttctct

SEQ ID NO: 302295 - DNA, 15 bp, Homo sapiens
tgaaagtcttttctc

SEQ ID NO: 302296 - DNA, 15 bp, Homo sapiens
ctgaaagtcttttct

SEQ ID NO: 302297 - DNA, 15 bp, Homo sapiens
tctgaaagtcttttc

SEQ ID NO: 302298 - DNA, 15 bp, Homo sapiens
gtctgaaagtctttt

SEQ ID NO: 302299 - DNA, 15 bp, Homo sapiens
agtctgaaagtcttt

SEQ ID NO: 302300 - DNA, 15 bp, Homo sapiens
aagtctgaaagtctt

SEQ ID NO: 302301 - DNA, 15 bp, Homo sapiens
gaagtctgaaagtct

SEQ ID NO: 302302 - DNA, 15 bp, Homo sapiens
ggaagtctgaaagtc

SEQ ID NO: 302303 - DNA, 15 bp, Homo sapiens
gggaagtctgaaagt

SEQ ID NO: 302304 - DNA, 15 bp, Homo sapiens
agggaagtctgaaag

SEQ ID NO: 302305 - DNA, 15 bp, Homo sapiens
gagggaagtctgaaa

SEQ ID NO: 302306 - DNA, 15 bp, Homo sapiens
agagggaagtctgaa

SEQ ID NO: 302307 - DNA, 15 bp, Homo sapiens
tagagggaagtctga

SEQ ID NO: 302308 - DNA, 15 bp, Homo sapiens
ttagagggaagtctg

SEQ ID NO: 302309 - DNA, 15 bp, Homo sapiens
tttagagggaagtct

SEQ ID NO: 302310 - DNA, 15 bp, Homo sapiens
atttagagggaagtc

SEQ ID NO: 302311 - DNA, 15 bp, Homo sapiens
gatttagagggaagt

SEQ ID NO: 302312 - DNA, 15 bp, Homo sapiens
tgatttagagggaag

SEQ ID NO: 302313 - DNA, 15 bp, Homo sapiens
ctgatttagagggaa

SEQ ID NO: 302314 - DNA, 15 bp, Homo sapiens
gctgatttagaggga

SEQ ID NO: 302315 - DNA, 15 bp, Homo sapiens
agctgatttagaggg

SEQ ID NO: 302316 - DNA, 15 bp, Homo sapiens
cagctgatttagagg

SEQ ID NO: 302317 - DNA, 15 bp, Homo sapiens
gcagctgatttagag

SEQ ID NO: 302318 - DNA, 15 bp, Homo sapiens
tgcagctgatttaga

SEQ ID NO: 302319 - DNA, 15 bp, Homo sapiens
ctgcagctgatttag

SEQ ID NO: 302320 - DNA, 15 bp, Homo sapiens
actgcagctgattta

SEQ ID NO: 302321 - DNA, 15 bp, Homo sapiens
cactgcagctgattt

SEQ ID NO: 302322 - DNA, 15 bp, Homo sapiens
tcactgcagctgatt

SEQ ID NO: 302323 - DNA, 15 bp, Homo sapiens
atcactgcagctgat

SEQ ID NO: 302324 - DNA, 15 bp, Homo sapiens
tatcactgcagctga

SEQ ID NO: 302325 - DNA, 15 bp, Homo sapiens
ctatcactgcagctg

SEQ ID NO: 302326 - DNA, 15 bp, Homo sapiens
tctatcactgcagct

SEQ ID NO: 302327 - DNA, 15 bp, Homo sapiens
ttctatcactgcagc

SEQ ID NO: 302328 - DNA, 15 bp, Homo sapiens
tttctatcactgcag

SEQ ID NO: 302329 - DNA, 15 bp, Homo sapiens
ctttctatcactgca

SEQ ID NO: 302330 - DNA, 15 bp, Homo sapiens
gctttctatcactgc

SEQ ID NO: 302331 - DNA, 15 bp, Homo sapiens
tgctttctatcactg

SEQ ID NO: 302332 - DNA, 15 bp, Homo sapiens
ctgctttctatcact

SEQ ID NO: 302333 - DNA, 15 bp, Homo sapiens
tctgctttctatcac

SEQ ID NO: 302334 - DNA, 15 bp, Homo sapiens
gtctgctttctatca

SEQ ID NO: 302335 - DNA, 15 bp, Homo sapiens
agtctgctttctatc

SEQ ID NO: 302336 - DNA, 15 bp, Homo sapiens
tagtctgctttctat

SEQ ID NO: 302337 - DNA, 15 bp, Homo sapiens
ctagtctgctttcta

SEQ ID NO: 302338 - DNA, 15 bp, Homo sapiens
cctagtctgctttct

SEQ ID NO: 302339 - DNA, 15 bp, Homo sapiens
acctagtctgctttc

SEQ ID NO: 302340 - DNA, 15 bp, Homo sapiens
tacctagtctgcttt

SEQ ID NO: 302341 - DNA, 15 bp, Homo sapiens
ttacctagtctgctt

SEQ ID NO: 302342 - DNA, 15 bp, Homo sapiens
gttacctagtctgct

SEQ ID NO: 302343 - DNA, 15 bp, Homo sapiens
agttacctagtctgc

SEQ ID NO: 302344 - DNA, 15 bp, Homo sapiens
aagttacctagtctg

SEQ ID NO: 302345 - DNA, 15 bp, Homo sapiens
gaagttacctagtct

SEQ ID NO: 302346 - DNA, 15 bp, Homo sapiens
tgaagttacctagtc

SEQ ID NO: 302347 - DNA, 15 bp, Homo sapiens
ctgaagttacctagt

SEQ ID NO: 302348 - DNA, 15 bp, Homo sapiens
gctgaagttacctag

SEQ ID NO: 302349 - DNA, 15 bp, Homo sapiens
tgctgaagttaccta

SEQ ID NO: 302350 - DNA, 15 bp, Homo sapiens
atgctgaagttacct

SEQ ID NO: 302351 - DNA, 15 bp, Homo sapiens
catgctgaagttacc

SEQ ID NO: 302352 - DNA, 15 bp, Homo sapiens
tcatgctgaagttac

SEQ ID NO: 302353 - DNA, 15 bp, Homo sapiens
ctcatgctgaagtta

SEQ ID NO: 302354 - DNA, 15 bp, Homo sapiens
tctcatgctgaagtt

SEQ ID NO: 302355 - DNA, 15 bp, Homo sapiens
ctctcatgctgaagt

SEQ ID NO: 302356 - DNA, 15 bp, Homo sapiens
cctctcatgctgaag

SEQ ID NO: 302357 - DNA, 15 bp, Homo sapiens
ccctctcatgctgaa

SEQ ID NO: 302358 - DNA, 15 bp, Homo sapiens
tccctctcatgctga

SEQ ID NO: 302359 - DNA, 15 bp, Homo sapiens
ctccctctcatgctg

SEQ ID NO: 302360 - DNA, 15 bp, Homo sapiens
cctccctctcatgct

SEQ ID NO: 302361 - DNA, 15 bp, Homo sapiens
ccctccctctcatgc

SEQ ID NO: 302362 - DNA, 15 bp, Homo sapiens
tccctccctctcatg

SEQ ID NO: 302363 - DNA, 15 bp, Homo sapiens
gtccctccctctcat

SEQ ID NO: 302364 - DNA, 15 bp, Homo sapiens
ggtccctccctctca

SEQ ID NO: 302365 - DNA, 15 bp, Homo sapiens
aggtccctccctctc

SEQ ID NO: 302366 - DNA, 15 bp, Homo sapiens
gaggtccctccctct

SEQ ID NO: 302367 - DNA, 15 bp, Homo sapiens
tgaggtccctccctc

SEQ ID NO: 302368 - DNA, 15 bp, Homo sapiens
atgaggtccctccct

SEQ ID NO: 302369 - DNA, 15 bp, Homo sapiens
aatgaggtccctccc

SEQ ID NO: 302370 - DNA, 15 bp, Homo sapiens
caatgaggtccctcc

SEQ ID NO: 302371 - DNA, 15 bp, Homo sapiens
gcaatgaggtccctc

SEQ ID NO: 302372 - DNA, 15 bp, Homo sapiens
tgcaatgaggtccct

SEQ ID NO: 302373 - DNA, 15 bp, Homo sapiens
ctgcaatgaggtccc

SEQ ID NO: 302374 - DNA, 15 bp, Homo sapiens
cctgcaatgaggtcc

SEQ ID NO: 302375 - DNA, 15 bp, Homo sapiens
tcctgcaatgaggtc

SEQ ID NO: 302376 - DNA, 15 bp, Homo sapiens
ttcctgcaatgaggt

SEQ ID NO: 302377 - DNA, 15 bp, Homo sapiens
cttcctgcaatgagg

SEQ ID NO: 302378 - DNA, 15 bp, Homo sapiens
gcttcctgcaatgag

SEQ ID NO: 302379 - DNA, 15 bp, Homo sapiens
tgcttcctgcaatga

SEQ ID NO: 302380 - DNA, 15 bp, Homo sapiens
ttgcttcctgcaatg

SEQ ID NO: 302381 - DNA, 15 bp, Homo sapiens
tttgcttcctgcaat

SEQ ID NO: 302382 - DNA, 15 bp, Homo sapiens
ttttgcttcctgcaa

SEQ ID NO: 302383 - DNA, 15 bp, Homo sapiens
cttttgcttcctgca

SEQ ID NO: 302384 - DNA, 15 bp, Homo sapiens
acttttgcttcctgc

SEQ ID NO: 302385 - DNA, 15 bp, Homo sapiens
gacttttgcttcctg

SEQ ID NO: 302386 - DNA, 15 bp, Homo sapiens
tgacttttgcttcct

SEQ ID NO: 302387 - DNA, 15 bp, Homo sapiens
gtgacttttgcttcc

SEQ ID NO: 302388 - DNA, 15 bp, Homo sapiens
tgtgacttttgcttc

SEQ ID NO: 302389 - DNA, 15 bp, Homo sapiens
ctgtgacttttgctt

SEQ ID NO: 302390 - DNA, 15 bp, Homo sapiens
actgtgacttttgct

SEQ ID NO: 302391 - DNA, 15 bp, Homo sapiens
tactgtgacttttgc

SEQ ID NO: 302392 - DNA, 15 bp, Homo sapiens
ctactgtgacttttg

SEQ ID NO: 302393 - DNA, 15 bp, Homo sapiens
tctactgtgactttt

SEQ ID NO: 302394 - DNA, 15 bp, Homo sapiens
ctctactgtgacttt

SEQ ID NO: 302395 - DNA, 15 bp, Homo sapiens
actctactgtgactt

SEQ ID NO: 302396 - DNA, 15 bp, Homo sapiens
aactctactgtgact

SEQ ID NO: 302397 - DNA, 15 bp, Homo sapiens
taactctactgtgac

SEQ ID NO: 302398 - DNA, 15 bp, Homo sapiens
ttaactctactgtga

SEQ ID NO: 302399 - DNA, 15 bp, Homo sapiens
cttaactctactgtg

SEQ ID NO: 302400 - DNA, 15 bp, Homo sapiens
tcttaactctactgt

SEQ ID NO: 302401 - DNA, 15 bp, Homo sapiens
gtcttaactctactg

SEQ ID NO: 302402 - DNA, 15 bp, Homo sapiens
agtcttaactctact

SEQ ID NO: 302403 - DNA, 15 bp, Homo sapiens
gagtcttaactctac

SEQ ID NO: 302404 - DNA, 15 bp, Homo sapiens
agagtcttaactcta

SEQ ID NO: 302405 - DNA, 15 bp, Homo sapiens
aagagtcttaactct

SEQ ID NO: 302406 - DNA, 15 bp, Homo sapiens
caagagtcttaactc

SEQ ID NO: 302407 - DNA, 15 bp, Homo sapiens
tcaagagtcttaact

SEQ ID NO: 302408 - DNA, 15 bp, Homo sapiens
ttcaagagtcttaac

SEQ ID NO: 302409 - DNA, 15 bp, Homo sapiens
tttcaagagtcttaa

SEQ ID NO: 302410 - DNA, 15 bp, Homo sapiens
ctttcaagagtctta

SEQ ID NO: 302411 - DNA, 15 bp, Homo sapiens
tctttcaagagtctt

SEQ ID NO: 302412 - DNA, 15 bp, Homo sapiens
ttctttcaagagtct

SEQ ID NO: 302413 - DNA, 15 bp, Homo sapiens
cttctttcaagagtc

SEQ ID NO: 302414 - DNA, 15 bp, Homo sapiens
gcttctttcaagagt

SEQ ID NO: 302415 - DNA, 15 bp, Homo sapiens
tgcttctttcaagag

SEQ ID NO: 302416 - DNA, 15 bp, Homo sapiens
gtgcttctttcaaga

SEQ ID NO: 302417 - DNA, 15 bp, Homo sapiens
agtgcttctttcaag

SEQ ID NO: 302418 - DNA, 15 bp, Homo sapiens
aagtgcttctttcaa

SEQ ID NO: 302419 - DNA, 15 bp, Homo sapiens
aaagtgcttctttca

SEQ ID NO: 302420 - DNA, 15 bp, Homo sapiens
aaaagtgcttctttc

SEQ ID NO: 302421 - DNA, 15 bp, Homo sapiens
taaaagtgcttcttt

SEQ ID NO: 302422 - DNA, 15 bp, Homo sapiens
ataaaagtgcttctt

SEQ ID NO: 302423 - DNA, 15 bp, Homo sapiens
aataaaagtgcttct

SEQ ID NO: 302424 - DNA, 15 bp, Homo sapiens
aaataaaagtgcttc

SEQ ID NO: 302425 - DNA, 15 bp, Homo sapiens
aaaataaaagtgctt

SEQ ID NO: 302426 - DNA, 15 bp, Homo sapiens
gaaaataaaagtgct

SEQ ID NO: 302427 - DNA, 15 bp, Homo sapiens
agaaaataaaagtgc

SEQ ID NO: 302428 - DNA, 15 bp, Homo sapiens
aagaaaataaaagtg

SEQ ID NO: 302429 - DNA, 15 bp, Homo sapiens
caagaaaataaaagt

SEQ ID NO: 302430 - DNA, 15 bp, Homo sapiens
tcaagaaaataaaag

SEQ ID NO: 302431 - DNA, 15 bp, Homo sapiens
ttcaagaaaataaaa

SEQ ID NO: 302432 - DNA, 15 bp, Homo sapiens
cttcaagaaaataaa

SEQ ID NO: 302433 - DNA, 15 bp, Homo sapiens
tcttcaagaaaataa

SEQ ID NO: 302434 - DNA, 15 bp, Homo sapiens
ttcttcaagaaaata

SEQ ID NO: 302435 - DNA, 15 bp, Homo sapiens
attcttcaagaaaat

SEQ ID NO: 302436 - DNA, 15 bp, Homo sapiens
aattcttcaagaaaa

SEQ ID NO: 302437 - DNA, 15 bp, Homo sapiens
caattcttcaagaaa

SEQ ID NO: 302438 - DNA, 15 bp, Homo sapiens
tcaattcttcaagaa

SEQ ID NO: 302439 - DNA, 15 bp, Homo sapiens
gtcaattcttcaaga

SEQ ID NO: 302440 - DNA, 15 bp, Homo sapiens
tgtcaattcttcaag

SEQ ID NO: 302441 - DNA, 15 bp, Homo sapiens
ctgtcaattcttcaa

SEQ ID NO: 302442 - DNA, 15 bp, Homo sapiens
tctgtcaattcttca

SEQ ID NO: 302443 - DNA, 15 bp, Homo sapiens
atctgtcaattcttc

SEQ ID NO: 302444 - DNA, 15 bp, Homo sapiens
gatctgtcaattctt

SEQ ID NO: 302445 - DNA, 15 bp, Homo sapiens
agatctgtcaattct

SEQ ID NO: 302446 - DNA, 15 bp, Homo sapiens
gagatctgtcaattc

SEQ ID NO: 302447 - DNA, 15 bp, Homo sapiens
agagatctgtcaatt

SEQ ID NO: 302448 - DNA, 15 bp, Homo sapiens
cagagatctgtcaat

SEQ ID NO: 302449 - DNA, 15 bp, Homo sapiens
gcagagatctgtcaa

SEQ ID NO: 302450 - DNA, 15 bp, Homo sapiens
agcagagatctgtca

SEQ ID NO: 302451 - DNA, 15 bp, Homo sapiens
aagcagagatctgtc

SEQ ID NO: 302452 - DNA, 15 bp, Homo sapiens
gaagcagagatctgt

SEQ ID NO: 302453 - DNA, 15 bp, Homo sapiens
ggaagcagagatctg

SEQ ID NO: 302454 - DNA, 15 bp, Homo sapiens
aggaagcagagatct

SEQ ID NO: 302455 - DNA, 15 bp, Homo sapiens
caggaagcagagatc

SEQ ID NO: 302456 - DNA, 15 bp, Homo sapiens
acaggaagcagagat

SEQ ID NO: 302457 - DNA, 15 bp, Homo sapiens
tacaggaagcagaga

SEQ ID NO: 302458 - DNA, 15 bp, Homo sapiens
ttacaggaagcagag

SEQ ID NO: 302459 - DNA, 15 bp, Homo sapiens
attacaggaagcaga

SEQ ID NO: 302460 - DNA, 15 bp, Homo sapiens
cattacaggaagcag

SEQ ID NO: 302461 - DNA, 15 bp, Homo sapiens
acattacaggaagca

SEQ ID NO: 302462 - DNA, 15 bp, Homo sapiens
aacattacaggaagc

SEQ ID NO: 302463 - DNA, 15 bp, Homo sapiens
aaacattacaggaag

SEQ ID NO: 302464 - DNA, 15 bp, Homo sapiens
aaaacattacaggaa

SEQ ID NO: 302465 - DNA, 15 bp, Homo sapiens
caaaacattacagga

SEQ ID NO: 302466 - DNA, 15 bp, Homo sapiens
acaaaacattacagg

SEQ ID NO: 302467 - DNA, 15 bp, Homo sapiens
cacaaaacattacag

SEQ ID NO: 302468 - DNA, 15 bp, Homo sapiens
gcacaaaacattaca

SEQ ID NO: 302469 - DNA, 15 bp, Homo sapiens
tgcacaaaacattac

SEQ ID NO: 302470 - DNA, 15 bp, Homo sapiens
ttgcacaaaacatta

SEQ ID NO: 302471 - DNA, 15 bp, Homo sapiens
tttgcacaaaacatt

SEQ ID NO: 302472 - DNA, 15 bp, Homo sapiens
atttgcacaaaacat

SEQ ID NO: 302473 - DNA, 15 bp, Homo sapiens
aatttgcacaaaaca

SEQ ID NO: 302474 - DNA, 15 bp, Homo sapiens
aaatttgcacaaaac

SEQ ID NO: 302475 - DNA, 15 bp, Homo sapiens
agaaatttgcacaaa

SEQ ID NO: 302476 - DNA, 15 bp, Homo sapiens
cagaaatttgcacaa

SEQ ID NO: 302477 - DNA, 15 bp, Homo sapiens
tcagaaatttgcaca

SEQ ID NO: 302478 - DNA, 15 bp, Homo sapiens
gtcagaaatttgcac

SEQ ID NO: 302479 - DNA, 15 bp, Homo sapiens
tgtcagaaatttgca

SEQ ID NO: 302480 - DNA, 15 bp, Homo sapiens
ctgtcagaaatttgc

SEQ ID NO: 302481 - DNA, 15 bp, Homo sapiens
actgtcagaaatttg

SEQ ID NO: 302482 - DNA, 15 bp, Homo sapiens
cactgtcagaaattt

SEQ ID NO: 302483 - DNA, 15 bp, Homo sapiens
gcactgtcagaaatt

SEQ ID NO: 302484 - DNA, 15 bp, Homo sapiens
agcactgtcagaaat

SEQ ID NO: 302485 - DNA, 15 bp, Homo sapiens
tagcactgtcagaaa

SEQ ID NO: 302486 - DNA, 15 bp, Homo sapiens
atagcactgtcagaa

SEQ ID NO: 302487 - DNA, 15 bp, Homo sapiens
aatagcactgtcaga

SEQ ID NO: 302488 - DNA, 15 bp, Homo sapiens
aaatagcactgtcag

SEQ ID NO: 302489 - DNA, 15 bp, Homo sapiens
aaaatagcactgtca

SEQ ID NO: 302490 - DNA, 15 bp, Homo sapiens
gaaaatagcactgtc

SEQ ID NO: 302491 - DNA, 15 bp, Homo sapiens
ggaaaatagcactgt

SEQ ID NO: 302492 - DNA, 15 bp, Homo sapiens
gggaaaatagcactg

SEQ ID NO: 302493 - DNA, 15 bp, Homo sapiens
agggaaaatagcact

SEQ ID NO: 302494 - DNA, 15 bp, Homo sapiens
aagggaaaatagcac

SEQ ID NO: 302495 - DNA, 15 bp, Homo sapiens
gaagggaaaatagca

SEQ ID NO: 302496 - DNA, 15 bp, Homo sapiens
ggaagggaaaatagc

SEQ ID NO: 302497 - DNA, 15 bp, Homo sapiens
gggaagggaaaatag

SEQ ID NO: 302498 - DNA, 15 bp, Homo sapiens
tgggaagggaaaata

SEQ ID NO: 302499 - DNA, 15 bp, Homo sapiens
atgggaagggaaaat

SEQ ID NO: 302500 - DNA, 15 bp, Homo sapiens
tatgggaagggaaaa

SEQ ID NO: 302501 - DNA, 15 bp, Homo sapiens
ctatgggaagggaaa

SEQ ID NO: 302502 - DNA, 15 bp, Homo sapiens
cctatgggaagggaa

SEQ ID NO: 302503 - DNA, 15 bp, Homo sapiens
gcctatgggaaggga

SEQ ID NO: 302504 - DNA, 15 bp, Homo sapiens
tgcctatgggaaggg

SEQ ID NO: 302505 - DNA, 15 bp, Homo sapiens
ttgcctatgggaagg

SEQ ID NO: 302506 - DNA, 15 bp, Homo sapiens
attgcctatgggaag

SEQ ID NO: 302507 - DNA, 15 bp, Homo sapiens
cattgcctatgggaa

SEQ ID NO: 302508 - DNA, 15 bp, Homo sapiens
acattgcctatggga

SEQ ID NO: 302509 - DNA, 15 bp, Homo sapiens
cacattgcctatggg

SEQ ID NO: 302510 - DNA, 15 bp, Homo sapiens
tcacattgcctatgg

SEQ ID NO: 302511 - DNA, 15 bp, Homo sapiens
ttcacattgcctatg

SEQ ID NO: 302512 - DNA, 15 bp, Homo sapiens
cttcacattgcctat

SEQ ID NO: 302513 - DNA, 15 bp, Homo sapiens
acttcacattgccta

SEQ ID NO: 302514 - DNA, 15 bp, Homo sapiens
tacttcacattgcct

SEQ ID NO: 302515 - DNA, 15 bp, Homo sapiens
atacttcacattgcc

SEQ ID NO: 302516 - DNA, 15 bp, Homo sapiens
aatacttcacattgc

SEQ ID NO: 302517 - DNA, 15 bp, Homo sapiens
gaatacttcacattg

SEQ ID NO: 302518 - DNA, 15 bp, Homo sapiens
tgaatacttcacatt

SEQ ID NO: 302519 - DNA, 15 bp, Homo sapiens
atgaatacttcacat

SEQ ID NO: 302520 - DNA, 15 bp, Homo sapiens
gatgaatacttcaca

SEQ ID NO: 302521 - DNA, 15 bp, Homo sapiens
ggatgaatacttcac

SEQ ID NO: 302522 - DNA, 15 bp, Homo sapiens
cggatgaatacttca

SEQ ID NO: 302523 - DNA, 15 bp, Homo sapiens
ccggatgaatacttc

SEQ ID NO: 302524 - DNA, 15 bp, Homo sapiens
gccggatgaatactt

SEQ ID NO: 302525 - DNA, 15 bp, Homo sapiens
ggccggatgaatact

SEQ ID NO: 302526 - DNA, 15 bp, Homo sapiens
tggccggatgaatac

SEQ ID NO: 302527 - DNA, 15 bp, Homo sapiens
ttggccggatgaata

SEQ ID NO: 302528 - DNA, 15 bp, Homo sapiens
gttggccggatgaat

SEQ ID NO: 302529 - DNA, 15 bp, Homo sapiens
ggttggccggatgaa

SEQ ID NO: 302530 - DNA, 15 bp, Homo sapiens
tggttggccggatga

SEQ ID NO: 302531 - DNA, 15 bp, Homo sapiens
ttggttggccggatg

SEQ ID NO: 302532 - DNA, 15 bp, Homo sapiens
attggttggccggat

SEQ ID NO: 302533 - DNA, 15 bp, Homo sapiens
cattggttggccgga

SEQ ID NO: 302534 - DNA, 15 bp, Homo sapiens
acattggttggccgg

SEQ ID NO: 302535 - DNA, 15 bp, Homo sapiens
aacattggttggccg

SEQ ID NO: 302536 - DNA, 15 bp, Homo sapiens
aaacattggttggcc

SEQ ID NO: 302537 - DNA, 15 bp, Homo sapiens
gaaacattggttggc

SEQ ID NO: 302538 - DNA, 15 bp, Homo sapiens
ggaaacattggttgg

SEQ ID NO: 302539 - DNA, 15 bp, Homo sapiens
aggaaacattggttg

SEQ ID NO: 302540 - DNA, 15 bp, Homo sapiens
caggaaacattggtt

SEQ ID NO: 302541 - DNA, 15 bp, Homo sapiens
tcaggaaacattggt

SEQ ID NO: 302542 - DNA, 15 bp, Homo sapiens
gtcaggaaacattgg

SEQ ID NO: 302543 - DNA, 15 bp, Homo sapiens
cgtcaggaaacattg

SEQ ID NO: 302544 - DNA, 15 bp, Homo sapiens
acgtcaggaaacatt

SEQ ID NO: 302545 - DNA, 15 bp, Homo sapiens
tacgtcaggaaacat

SEQ ID NO: 302546 - DNA, 15 bp, Homo sapiens
gtacgtcaggaaaca

SEQ ID NO: 302547 - DNA, 15 bp, Homo sapiens
tgtacgtcaggaaac

SEQ ID NO: 302548 - DNA, 15 bp, Homo sapiens
ctgtacgtcaggaaa

SEQ ID NO: 302549 - DNA, 15 bp, Homo sapiens
actgtacgtcaggaa

SEQ ID NO: 302550 - DNA, 15 bp, Homo sapiens
cactgtacgtcagga

SEQ ID NO: 302551 - DNA, 15 bp, Homo sapiens
acactgtacgtcagg

SEQ ID NO: 302552 - DNA, 15 bp, Homo sapiens
aacactgtacgtcag

SEQ ID NO: 302553 - DNA, 15 bp, Homo sapiens
caacactgtacgtca

SEQ ID NO: 302554 - DNA, 15 bp, Homo sapiens
gcaacactgtacgtc

SEQ ID NO: 302555 - DNA, 15 bp, Homo sapiens
ggcaacactgtacgt

SEQ ID NO: 302556 - DNA, 15 bp, Homo sapiens
gggcaacactgtacg

SEQ ID NO: 302557 - DNA, 15 bp, Homo sapiens
agggcaacactgtac

SEQ ID NO: 302558 - DNA, 15 bp, Homo sapiens
aagggcaacactgta

SEQ ID NO: 302559 - DNA, 15 bp, Homo sapiens
aaagggcaacactgt

SEQ ID NO: 302560 - DNA, 15 bp, Homo sapiens
aaaagggcaacactg

SEQ ID NO: 302561 - DNA, 15 bp, Homo sapiens
gaaaagggcaacact

SEQ ID NO: 302562 - DNA, 15 bp, Homo sapiens
tgaaaagggcaacac

SEQ ID NO: 302563 - DNA, 15 bp, Homo sapiens
ctgaaaagggcaaca

SEQ ID NO: 302564 - DNA, 15 bp, Homo sapiens
gctgaaaagggcaac

SEQ ID NO: 302565 - DNA, 15 bp, Homo sapiens
tgctgaaaagggcaa

SEQ ID NO: 302566 - DNA, 15 bp, Homo sapiens
ttgctgaaaagggca

SEQ ID NO: 302567 - DNA, 15 bp, Homo sapiens
tttgctgaaaagggc

SEQ ID NO: 302568 - DNA, 15 bp, Homo sapiens
atttgctgaaaaggg

SEQ ID NO: 302569 - DNA, 15 bp, Homo sapiens
catttgctgaaaagg

SEQ ID NO: 302570 - DNA, 15 bp, Homo sapiens
gcatttgctgaaaag

SEQ ID NO: 302571 - DNA, 15 bp, Homo sapiens
ggcatttgctgaaaa

SEQ ID NO: 302572 - DNA, 15 bp, Homo sapiens
tggcatttgctgaaa

SEQ ID NO: 302573 - DNA, 15 bp, Homo sapiens
ttggcatttgctgaa

SEQ ID NO: 302574 - DNA, 15 bp, Homo sapiens
attggcatttgctga

SEQ ID NO: 302575 - DNA, 15 bp, Homo sapiens
aattggcatttgctg

SEQ ID NO: 302576 - DNA, 15 bp, Homo sapiens
gaattggcatttgct

SEQ ID NO: 302577 - DNA, 15 bp, Homo sapiens
ggaattggcatttgc

SEQ ID NO: 302578 - DNA, 15 bp, Homo sapiens
tggaattggcatttg

SEQ ID NO: 302579 - DNA, 15 bp, Homo sapiens
ttggaattggcattt

SEQ ID NO: 302580 - DNA, 15 bp, Homo sapiens
cttggaattggcatt

SEQ ID NO: 302581 - DNA, 15 bp, Homo sapiens
acttggaattggcat

SEQ ID NO: 302582 - DNA, 15 bp, Homo sapiens
aacttggaattggca

SEQ ID NO: 302583 - DNA, 15 bp, Homo sapiens
gaacttggaattggc

SEQ ID NO: 302584 - DNA, 15 bp, Homo sapiens
ggaacttggaattgg

SEQ ID NO: 302585 - DNA, 15 bp, Homo sapiens
tggaacttggaattg

SEQ ID NO: 302586 - DNA, 15 bp, Homo sapiens
atggaacttggaatt

SEQ ID NO: 302587 - DNA, 15 bp, Homo sapiens
aatggaacttggaat

SEQ ID NO: 302588 - DNA, 15 bp, Homo sapiens
taatggaacttggaa

SEQ ID NO: 302589 - DNA, 15 bp, Homo sapiens
ttaatggaacttgga

SEQ ID NO: 302590 - DNA, 15 bp, Homo sapiens
tttaatggaacttgg

SEQ ID NO: 302591 - DNA, 15 bp, Homo sapiens
atttaatggaacttg

SEQ ID NO: 302592 - DNA, 15 bp, Homo sapiens
gatttaatggaactt

SEQ ID NO: 302593 - DNA, 15 bp, Homo sapiens
tgatttaatggaact

SEQ ID NO: 302594 - DNA, 15 bp, Homo sapiens
ctgatttaatggaac

SEQ ID NO: 302595 - DNA, 15 bp, Homo sapiens
tctgatttaatggaa

SEQ ID NO: 302596 - DNA, 15 bp, Homo sapiens
ttctgatttaatgga

SEQ ID NO: 302597 - DNA, 15 bp, Homo sapiens
cttctgatttaatgg

SEQ ID NO: 302598 - DNA, 15 bp, Homo sapiens
gcttctgatttaatg

SEQ ID NO: 302599 - DNA, 15 bp, Homo sapiens
agcttctgatttaat

SEQ ID NO: 302600 - DNA, 15 bp, Homo sapiens
gagcttctgatttaa

SEQ ID NO: 302601 - DNA, 15 bp, Homo sapiens
ggagcttctgattta

SEQ ID NO: 302602 - DNA, 15 bp, Homo sapiens
tggagcttctgattt

SEQ ID NO: 302603 - DNA, 15 bp, Homo sapiens
atggagcttctgatt

SEQ ID NO: 302604 - DNA, 15 bp, Homo sapiens
catggagcttctgat

SEQ ID NO: 302605 - DNA, 15 bp, Homo sapiens
ccatggagcttctga

SEQ ID NO: 302606 - DNA, 15 bp, Homo sapiens
gccatggagcttctg

SEQ ID NO: 302607 - DNA, 15 bp, Homo sapiens
agccatggagcttct

SEQ ID NO: 302608 - DNA, 15 bp, Homo sapiens
gagccatggagcttc

SEQ ID NO: 302609 - DNA, 15 bp, Homo sapiens
ggagccatggagctt

SEQ ID NO: 302610 - DNA, 15 bp, Homo sapiens
aggagccatggagct

SEQ ID NO: 302611 - DNA, 15 bp, Homo sapiens
aaggagccatggagc

SEQ ID NO: 302612 - DNA, 15 bp, Homo sapiens
caaggagccatggag

SEQ ID NO: 302613 - DNA, 15 bp, Homo sapiens
ccaaggagccatgga

SEQ ID NO: 302614 - DNA, 15 bp, Homo sapiens
gccaaggagccatgg

SEQ ID NO: 302615 - DNA, 15 bp, Homo sapiens
ggccaaggagccatg

SEQ ID NO: 302616 - DNA, 15 bp, Homo sapiens
gggccaaggagccat

SEQ ID NO: 302617 - DNA, 15 bp, Homo sapiens
tgggccaaggagcca

SEQ ID NO: 302618 - DNA, 15 bp, Homo sapiens
gtgggccaaggagcc

SEQ ID NO: 302619 - DNA, 15 bp, Homo sapiens
cgtgggccaaggagc

SEQ ID NO: 302620 - DNA, 15 bp, Homo sapiens
tcgtgggccaaggag

SEQ ID NO: 302621 - DNA, 15 bp, Homo sapiens
atcgtgggccaagga

SEQ ID NO: 302622 - DNA, 15 bp, Homo sapiens
catcgtgggccaagg

SEQ ID NO: 302623 - DNA, 15 bp, Homo sapiens
acatcgtgggccaag

SEQ ID NO: 302624 - DNA, 15 bp, Homo sapiens
aacatcgtgggccaa

SEQ ID NO: 302625 - DNA, 15 bp, Homo sapiens
caacatcgtgggcca

SEQ ID NO: 302626 - DNA, 15 bp, Homo sapiens
tcaacatcgtgggcc

SEQ ID NO: 302627 - DNA, 15 bp, Homo sapiens
ctcaacatcgtgggc

SEQ ID NO: 302628 - DNA, 15 bp, Homo sapiens
actcaacatcgtggg

SEQ ID NO: 302629 - DNA, 15 bp, Homo sapiens
cactcaacatcgtgg

SEQ ID NO: 302630 - DNA, 15 bp, Homo sapiens
gcactcaacatcgtg

SEQ ID NO: 302631 - DNA, 15 bp, Homo sapiens
agcactcaacatcgt

SEQ ID NO: 302632 - DNA, 15 bp, Homo sapiens
cagcactcaacatcg

SEQ ID NO: 302633 - DNA, 15 bp, Homo sapiens
tcagcactcaacatc

SEQ ID NO: 302634 - DNA, 15 bp, Homo sapiens
gtcagcactcaacat

SEQ ID NO: 302635 - DNA, 15 bp, Homo sapiens
agtcagcactcaaca

SEQ ID NO: 302636 - DNA, 15 bp, Homo sapiens
cagtcagcactcaac

SEQ ID NO: 302637 - DNA, 15 bp, Homo sapiens
acagtcagcactcaa

SEQ ID NO: 302638 - DNA, 15 bp, Homo sapiens
cacagtcagcactca

SEQ ID NO: 302639 - DNA, 15 bp, Homo sapiens
acacagtcagcactc

SEQ ID NO: 302640 - DNA, 15 bp, Homo sapiens
cacacagtcagcact

SEQ ID NO: 302641 - DNA, 15 bp, Homo sapiens
acacacagtcagcac

SEQ ID NO: 302642 - DNA, 15 bp, Homo sapiens
aacacacagtcagca

SEQ ID NO: 302643 - DNA, 15 bp, Homo sapiens
gaacacacagtcagc

SEQ ID NO: 302644 - DNA, 15 bp, Homo sapiens
agaacacacagtcag

SEQ ID NO: 302645 - DNA, 15 bp, Homo sapiens
tagaacacacagtca

SEQ ID NO: 302646 - DNA, 15 bp, Homo sapiens
gtagaacacacagtc

SEQ ID NO: 302647 - DNA, 15 bp, Homo sapiens
agtagaacacacagt

SEQ ID NO: 302648 - DNA, 15 bp, Homo sapiens
cagtagaacacacag

SEQ ID NO: 302649 - DNA, 15 bp, Homo sapiens
tcagtagaacacaca

SEQ ID NO: 302650 - DNA, 15 bp, Homo sapiens
ttcagtagaacacac

SEQ ID NO: 302651 - DNA, 15 bp, Homo sapiens
tttcagtagaacaca

SEQ ID NO: 302652 - DNA, 15 bp, Homo sapiens
ctttcagtagaacac

SEQ ID NO: 302653 - DNA, 15 bp, Homo sapiens
tctttcagtagaaca

SEQ ID NO: 302654 - DNA, 15 bp, Homo sapiens
ctctttcagtagaac

SEQ ID NO: 302655 - DNA, 15 bp, Homo sapiens
actctttcagtagaa

SEQ ID NO: 302656 - DNA, 15 bp, Homo sapiens
tactctttcagtaga

SEQ ID NO: 302657 - DNA, 15 bp, Homo sapiens
ttactctttcagtag

SEQ ID NO: 302658 - DNA, 15 bp, Homo sapiens
tttactctttcagta

SEQ ID NO: 302659 - DNA, 15 bp, Homo sapiens
ttttactctttcagt

SEQ ID NO: 302660 - DNA, 15 bp, Homo sapiens
gttttactctttcag

SEQ ID NO: 302661 - DNA, 15 bp, Homo sapiens
tgttttactctttca

SEQ ID NO: 302662 - DNA, 15 bp, Homo sapiens
gtgttttactctttc

SEQ ID NO: 302663 - DNA, 15 bp, Homo sapiens
agtgttttactcttt

SEQ ID NO: 302664 - DNA, 15 bp, Homo sapiens
cagtgttttactctt

SEQ ID NO: 302665 - DNA, 15 bp, Homo sapiens
tcagtgttttactct

SEQ ID NO: 302666 - DNA, 15 bp, Homo sapiens
gtcagtgttttactc

SEQ ID NO: 302667 - DNA, 15 bp, Homo sapiens
agtcagtgttttact

SEQ ID NO: 302668 - DNA, 15 bp, Homo sapiens
tagtcagtgttttac

SEQ ID NO: 302669 - DNA, 15 bp, Homo sapiens
atagtcagtgtttta

SEQ ID NO: 302670 - DNA, 15 bp, Homo sapiens
gatagtcagtgtttt

SEQ ID NO: 302671 - DNA, 15 bp, Homo sapiens
ggatagtcagtgttt

SEQ ID NO: 302672 - DNA, 15 bp, Homo sapiens
tggatagtcagtgtt

SEQ ID NO: 302673 - DNA, 15 bp, Homo sapiens
ttggatagtcagtgt

SEQ ID NO: 302674 - DNA, 15 bp, Homo sapiens
tttggatagtcagtg

SEQ ID NO: 302675 - DNA, 15 bp, Homo sapiens
ctttggatagtcagt

SEQ ID NO: 302676 - DNA, 15 bp, Homo sapiens
tctttggatagtcag

SEQ ID NO: 302677 - DNA, 15 bp, Homo sapiens
ctctttggatagtca

SEQ ID NO: 302678 - DNA, 15 bp, Homo sapiens
tctctttggatagtc

SEQ ID NO: 302679 - DNA, 15 bp, Homo sapiens
ttctctttggatagt

SEQ ID NO: 302680 - DNA, 15 bp, Homo sapiens
tttctctttggatag

SEQ ID NO: 302681 - DNA, 15 bp, Homo sapiens
atttctctttggata

SEQ ID NO: 302682 - DNA, 15 bp, Homo sapiens
catttctctttggat

SEQ ID NO: 302683 - DNA, 15 bp, Homo sapiens
ccatttctctttgga

SEQ ID NO: 302684 - DNA, 15 bp, Homo sapiens
tccatttctctttgg

SEQ ID NO: 302685 - DNA, 15 bp, Homo sapiens
atccatttctctttg

SEQ ID NO: 302686 - DNA, 15 bp, Homo sapiens
tatccatttctcttt

SEQ ID NO: 302687 - DNA, 15 bp, Homo sapiens
atatccatttctctt

SEQ ID NO: 302688 - DNA, 15 bp, Homo sapiens
aatatccatttctct

SEQ ID NO: 302689 - DNA, 15 bp, Homo sapiens
aaatatccatttctc

SEQ ID NO: 302690 - DNA, 15 bp, Homo sapiens
aaaatatccatttct

SEQ ID NO: 302691 - DNA, 15 bp, Homo sapiens
caaaatatccatttc

SEQ ID NO: 302692 - DNA, 15 bp, Homo sapiens
acaaaatatccattt

SEQ ID NO: 302693 - DNA, 15 bp, Homo sapiens
aacaaaatatccatt

SEQ ID NO: 302694 - DNA, 15 bp, Homo sapiens
aaacaaaatatccat

SEQ ID NO: 302695 - DNA, 15 bp, Homo sapiens
aaaacaaaatatcca

SEQ ID NO: 302696 - DNA, 15 bp, Homo sapiens
aaaaacaaaatatcc

SEQ ID NO: 302697 - DNA, 15 bp, Homo sapiens
taaaaacaaaatatc

SEQ ID NO: 302698 - DNA, 15 bp, Homo sapiens
ataaaaacaaaatat

SEQ ID NO: 302699 - DNA, 15 bp, Homo sapiens
tataaaaacaaaata

SEQ ID NO: 302700 - DNA, 15 bp, Homo sapiens
ttataaaaacaaaat

SEQ ID NO: 302701 - DNA, 15 bp, Homo sapiens
attataaaaacaaaa

SEQ ID NO: 302702 - DNA, 15 bp, Homo sapiens
tattataaaaacaaa

SEQ ID NO: 302703 - DNA, 15 bp, Homo sapiens
ttattataaaaacaa

SEQ ID NO: 302704 - DNA, 15 bp, Homo sapiens
gttattataaaaaca

SEQ ID NO: 302705 - DNA, 15 bp, Homo sapiens
ggttattataaaaac

SEQ ID NO: 302706 - DNA, 15 bp, Homo sapiens
tggttattataaaaa

SEQ ID NO: 302707 - DNA, 15 bp, Homo sapiens
atggttattataaaa

SEQ ID NO: 302708 - DNA, 15 bp, Homo sapiens
tatggttattataaa

SEQ ID NO: 302709 - DNA, 15 bp, Homo sapiens
atatggttattataa

SEQ ID NO: 302710 - DNA, 15 bp, Homo sapiens
tatatggttattata

SEQ ID NO: 302711 - DNA, 15 bp, Homo sapiens
atatatggttattat

SEQ ID NO: 302712 - DNA, 15 bp, Homo sapiens
aatatatggttatta

SEQ ID NO: 302713 - DNA, 15 bp, Homo sapiens
taatatatggttatt

SEQ ID NO: 302714 - DNA, 15 bp, Homo sapiens
aataatatatggtta

SEQ ID NO: 302715 - DNA, 15 bp, Homo sapiens
caataatatatggtt

SEQ ID NO: 302716 - DNA, 15 bp, Homo sapiens
acaataatatatggt

SEQ ID NO: 302717 - DNA, 15 bp, Homo sapiens
aacaataatatatgg

SEQ ID NO: 302718 - DNA, 15 bp, Homo sapiens
aaacaataatatatg

SEQ ID NO: 302719 - DNA, 15 bp, Homo sapiens
aaaacaataatatat

SEQ ID NO: 302720 - DNA, 15 bp, Homo sapiens
gaaaacaataatata

SEQ ID NO: 302721 - DNA, 15 bp, Homo sapiens
agaaaacaataatat

SEQ ID NO: 302722 - DNA, 15 bp, Homo sapiens
aagaaaacaataata

SEQ ID NO: 302723 - DNA, 15 bp, Homo sapiens
gaagaaaacaataat

SEQ ID NO: 302724 - DNA, 15 bp, Homo sapiens
agaagaaaacaataa

SEQ ID NO: 302725 - DNA, 15 bp, Homo sapiens
aagaagaaaacaata

SEQ ID NO: 302726 - DNA, 15 bp, Homo sapiens
gaagaagaaaacaat

SEQ ID NO: 302727 - DNA, 15 bp, Homo sapiens
ggaagaagaaaacaa

SEQ ID NO: 302728 - DNA, 15 bp, Homo sapiens
gggaagaagaaaaca

SEQ ID NO: 302729 - DNA, 15 bp, Homo sapiens
agggaagaagaaaac

SEQ ID NO: 302730 - DNA, 15 bp, Homo sapiens
aagggaagaagaaaa

SEQ ID NO: 302731 - DNA, 15 bp, Homo sapiens
aaagggaagaagaaa

SEQ ID NO: 302732 - DNA, 15 bp, Homo sapiens
gaaagggaagaagaa

SEQ ID NO: 302733 - DNA, 15 bp, Homo sapiens
agaaagggaagaaga

SEQ ID NO: 302734 - DNA, 15 bp, Homo sapiens
tagaaagggaagaag

SEQ ID NO: 302735 - DNA, 15 bp, Homo sapiens
atagaaagggaagaa

SEQ ID NO: 302736 - DNA, 15 bp, Homo sapiens
catagaaagggaaga

SEQ ID NO: 302737 - DNA, 15 bp, Homo sapiens
gcatagaaagggaag

SEQ ID NO: 302738 - DNA, 15 bp, Homo sapiens
tgcatagaaagggaa

SEQ ID NO: 302739 - DNA, 15 bp, Homo sapiens
ttgcatagaaaggga

SEQ ID NO: 302740 - DNA, 15 bp, Homo sapiens
cttgcatagaaaggg

SEQ ID NO: 302741 - DNA, 15 bp, Homo sapiens
acttgcatagaaagg

SEQ ID NO: 302742 - DNA, 15 bp, Homo sapiens
cacttgcatagaaag

SEQ ID NO: 302743 - DNA, 15 bp, Homo sapiens
acacttgcatagaaa

SEQ ID NO: 302744 - DNA, 15 bp, Homo sapiens
tacacttgcatagaa

SEQ ID NO: 302745 - DNA, 15 bp, Homo sapiens
ttacacttgcataga

SEQ ID NO: 302746 - DNA, 15 bp, Homo sapiens
tttacacttgcatag

SEQ ID NO: 302747 - DNA, 15 bp, Homo sapiens
atttacacttgcata

SEQ ID NO: 302748 - DNA, 15 bp, Homo sapiens
aatttacacttgcat

SEQ ID NO: 302749 - DNA, 15 bp, Homo sapiens
taatttacacttgca

SEQ ID NO: 302750 - DNA, 15 bp, Homo sapiens
ttaatttacacttgc

SEQ ID NO: 302751 - DNA, 15 bp, Homo sapiens
attaatttacacttg

SEQ ID NO: 302752 - DNA, 15 bp, Homo sapiens
cattaatttacactt

SEQ ID NO: 302753 - DNA, 15 bp, Homo sapiens
tcattaatttacact

SEQ ID NO: 302754 - DNA, 15 bp, Homo sapiens
ttcattaatttacac

SEQ ID NO: 302755 - DNA, 15 bp, Homo sapiens
gttcattaatttaca

SEQ ID NO: 302756 - DNA, 15 bp, Homo sapiens
tgttcattaatttac

SEQ ID NO: 302757 - DNA, 15 bp, Homo sapiens
ctgttcattaattta

SEQ ID NO: 302758 - DNA, 15 bp, Homo sapiens
tctgttcattaattt

SEQ ID NO: 302759 - DNA, 15 bp, Homo sapiens
ctctgttcattaatt

SEQ ID NO: 302760 - DNA, 15 bp, Homo sapiens
tctctgttcattaat

SEQ ID NO: 302761 - DNA, 15 bp, Homo sapiens
ctctctgttcattaa

SEQ ID NO: 302762 - DNA, 15 bp, Homo sapiens
cctctctgttcatta

SEQ ID NO: 302763 - DNA, 15 bp, Homo sapiens
acctctctgttcatt

SEQ ID NO: 302764 - DNA, 15 bp, Homo sapiens
tacctctctgttcat

SEQ ID NO: 302765 - DNA, 15 bp, Homo sapiens
atacctctctgttca

SEQ ID NO: 302766 - DNA, 15 bp, Homo sapiens
aatacctctctgttc

SEQ ID NO: 302767 - DNA, 15 bp, Homo sapiens
aaatacctctctgtt

SEQ ID NO: 302768 - DNA, 15 bp, Homo sapiens
caaatacctctctgt

SEQ ID NO: 302769 - DNA, 15 bp, Homo sapiens
ccaaatacctctctg

SEQ ID NO: 302770 - DNA, 15 bp, Homo sapiens
tccaaatacctctct

SEQ ID NO: 302771 - DNA, 15 bp, Homo sapiens
ttccaaatacctctc

SEQ ID NO: 302772 - DNA, 15 bp, Homo sapiens
tttccaaatacctct

SEQ ID NO: 302773 - DNA, 15 bp, Homo sapiens
atttccaaatacctc

SEQ ID NO: 302774 - DNA, 15 bp, Homo sapiens
catttccaaatacct

SEQ ID NO: 302775 - DNA, 15 bp, Homo sapiens
ccatttccaaatacc

SEQ ID NO: 302776 - DNA, 15 bp, Homo sapiens
accatttccaaatac

SEQ ID NO: 302777 - DNA, 15 bp, Homo sapiens
taccatttccaaata

SEQ ID NO: 302778 - DNA, 15 bp, Homo sapiens
ttaccatttccaaat

SEQ ID NO: 302779 - DNA, 15 bp, Homo sapiens
attaccatttccaaa

SEQ ID NO: 302780 - DNA, 15 bp, Homo sapiens
tattaccatttccaa

SEQ ID NO: 302781 - DNA, 15 bp, Homo sapiens
gtattaccatttcca

SEQ ID NO: 302782 - DNA, 15 bp, Homo sapiens
tgtattaccatttcc

SEQ ID NO: 302783 - DNA, 15 bp, Homo sapiens
atgtattaccatttc

SEQ ID NO: 302784 - DNA, 15 bp, Homo sapiens
aatgtattaccattt

SEQ ID NO: 302785 - DNA, 15 bp, Homo sapiens
aaatgtattaccatt

SEQ ID NO: 302786 - DNA, 15 bp, Homo sapiens
caaatgtattaccat

SEQ ID NO: 302787 - DNA, 15 bp, Homo sapiens
acaaatgtattacca

SEQ ID NO: 302788 - DNA, 15 bp, Homo sapiens
gacaaatgtattacc

SEQ ID NO: 302789 - DNA, 15 bp, Homo sapiens
tgacaaatgtattac

SEQ ID NO: 302790 - DNA, 15 bp, Homo sapiens
gtgacaaatgtatta

SEQ ID NO: 302791 - DNA, 15 bp, Homo sapiens
cgtgacaaatgtatt

SEQ ID NO: 302792 - DNA, 15 bp, Homo sapiens
ccgtgacaaatgtat

SEQ ID NO: 302793 - DNA, 15 bp, Homo sapiens
tccgtgacaaatgta

SEQ ID NO: 302794 - DNA, 15 bp, Homo sapiens
atccgtgacaaatgt

SEQ ID NO: 302795 - DNA, 15 bp, Homo sapiens
aatccgtgacaaatg

SEQ ID NO: 302796 - DNA, 15 bp, Homo sapiens
aaatccgtgacaaat

SEQ ID NO: 302797 - DNA, 15 bp, Homo sapiens
caaatccgtgacaaa

SEQ ID NO: 302798 - DNA, 15 bp, Homo sapiens
acaaatccgtgacaa

SEQ ID NO: 302799 - DNA, 15 bp, Homo sapiens
tacaaatccgtgaca

SEQ ID NO: 302800 - DNA, 15 bp, Homo sapiens
atacaaatccgtgac

SEQ ID NO: 302801 - DNA, 15 bp, Homo sapiens
tatacaaatccgtga

SEQ ID NO: 302802 - DNA, 15 bp, Homo sapiens
ttatacaaatccgtg

SEQ ID NO: 302803 - DNA, 15 bp, Homo sapiens
attatacaaatccgt

SEQ ID NO: 302804 - DNA, 15 bp, Homo sapiens
cattatacaaatccg

SEQ ID NO: 302805 - DNA, 15 bp, Homo sapiens
acattatacaaatcc

SEQ ID NO: 302806 - DNA, 15 bp, Homo sapiens
tacattatacaaatc

SEQ ID NO: 302807 - DNA, 15 bp, Homo sapiens
atacattatacaaat

SEQ ID NO: 302808 - DNA, 15 bp, Homo sapiens
tatacattatacaaa

SEQ ID NO: 302809 - DNA, 15 bp, Homo sapiens
gtatacattatacaa

SEQ ID NO: 302810 - DNA, 15 bp, Homo sapiens
tgtatacattataca

SEQ ID NO: 302811 - DNA, 15 bp, Homo sapiens
ctgtatacattatac

SEQ ID NO: 302812 - DNA, 15 bp, Homo sapiens
gctgtatacattata

SEQ ID NO: 302813 - DNA, 15 bp, Homo sapiens
tgctgtatacattat

SEQ ID NO: 302814 - DNA, 15 bp, Homo sapiens
atgctgtatacatta

SEQ ID NO: 302815 - DNA, 15 bp, Homo sapiens
aatgctgtatacatt

SEQ ID NO: 302816 - DNA, 15 bp, Homo sapiens
caatgctgtatacat

SEQ ID NO: 302817 - DNA, 15 bp, Homo sapiens
ccaatgctgtataca

SEQ ID NO: 302818 - DNA, 15 bp, Homo sapiens
cccaatgctgtatac

SEQ ID NO: 302819 - DNA, 15 bp, Homo sapiens
tcccaatgctgtata

SEQ ID NO: 302820 - DNA, 15 bp, Homo sapiens
ttcccaatgctgtat

SEQ ID NO: 302821 - DNA, 15 bp, Homo sapiens
tttcccaatgctgta

SEQ ID NO: 302822 - DNA, 15 bp, Homo sapiens
ctttcccaatgctgt

SEQ ID NO: 302823 - DNA, 15 bp, Homo sapiens
actttcccaatgctg

SEQ ID NO: 302824 - DNA, 15 bp, Homo sapiens
cactttcccaatgct

SEQ ID NO: 302825 - DNA, 15 bp, Homo sapiens
ccactttcccaatgc

SEQ ID NO: 302826 - DNA, 15 bp, Homo sapiens
cccactttcccaatg

SEQ ID NO: 302827 - DNA, 15 bp, Homo sapiens
acccactttcccaat

SEQ ID NO: 302828 - DNA, 15 bp, Homo sapiens
cacccactttcccaa

SEQ ID NO: 302829 - DNA, 15 bp, Homo sapiens
ccacccactttccca

SEQ ID NO: 302830 - DNA, 15 bp, Homo sapiens
cccacccactttccc

SEQ ID NO: 302831 - DNA, 15 bp, Homo sapiens
ccccacccactttcc

SEQ ID NO: 302832 - DNA, 15 bp, Homo sapiens
cccccacccactttc

SEQ ID NO: 302833 - DNA, 15 bp, Homo sapiens
gcccccacccacttt

SEQ ID NO: 302834 - DNA, 15 bp, Homo sapiens
agcccccacccactt

SEQ ID NO: 302835 - DNA, 15 bp, Homo sapiens
aagcccccacccact

SEQ ID NO: 302836 - DNA, 15 bp, Homo sapiens
aaagcccccacccac

SEQ ID NO: 302837 - DNA, 15 bp, Homo sapiens
gaaagcccccaccca

SEQ ID NO: 302838 - DNA, 15 bp, Homo sapiens
agaaagcccccaccc

SEQ ID NO: 302839 - DNA, 15 bp, Homo sapiens
tagaaagcccccacc

SEQ ID NO: 302840 - DNA, 15 bp, Homo sapiens
ttagaaagcccccac

SEQ ID NO: 302841 - DNA, 15 bp, Homo sapiens
attagaaagccccca

SEQ ID NO: 302842 - DNA, 15 bp, Homo sapiens
tattagaaagccccc

SEQ ID NO: 302843 - DNA, 15 bp, Homo sapiens
atattagaaagcccc

SEQ ID NO: 302844 - DNA, 15 bp, Homo sapiens
catattagaaagccc

SEQ ID NO: 302845 - DNA, 15 bp, Homo sapiens
tcatattagaaagcc

SEQ ID NO: 302846 - DNA, 15 bp, Homo sapiens
atcatattagaaagc

SEQ ID NO: 302847 - DNA, 15 bp, Homo sapiens
tatcatattagaaag

SEQ ID NO: 302848 - DNA, 15 bp, Homo sapiens
gtatcatattagaaa

SEQ ID NO: 302849 - DNA, 15 bp, Homo sapiens
ggtatcatattagaa

SEQ ID NO: 302850 - DNA, 15 bp, Homo sapiens
cggtatcatattaga

SEQ ID NO: 302851 - DNA, 15 bp, Homo sapiens
acggtatcatattag

SEQ ID NO: 302852 - DNA, 15 bp, Homo sapiens
gacggtatcatatta

SEQ ID NO: 302853 - DNA, 15 bp, Homo sapiens
agacggtatcatatt

SEQ ID NO: 302854 - DNA, 15 bp, Homo sapiens
aagacggtatcatat

SEQ ID NO: 302855 - DNA, 15 bp, Homo sapiens
aaagacggtatcata

SEQ ID NO: 302856 - DNA, 15 bp, Homo sapiens
aaaagacggtatcat

SEQ ID NO: 302857 - DNA, 15 bp, Homo sapiens
aaaaagacggtatca

SEQ ID NO: 302858 - DNA, 15 bp, Homo sapiens
taaaaagacggtatc

SEQ ID NO: 302859 - DNA, 15 bp, Homo sapiens
ttaaaaagacggtat

SEQ ID NO: 302860 - DNA, 15 bp, Homo sapiens
attaaaaagacggta

SEQ ID NO: 302861 - DNA, 15 bp, Homo sapiens
tattaaaaagacggt

SEQ ID NO: 302862 - DNA, 15 bp, Homo sapiens
ttattaaaaagacgg

SEQ ID NO: 302863 - DNA, 15 bp, Homo sapiens
gttattaaaaagacg

SEQ ID NO: 302864 - DNA, 15 bp, Homo sapiens
agttattaaaaagac

SEQ ID NO: 302865 - DNA, 15 bp, Homo sapiens
tagttattaaaaaga

SEQ ID NO: 302866 - DNA, 15 bp, Homo sapiens
atagttattaaaaag

SEQ ID NO: 302867 - DNA, 15 bp, Homo sapiens
catagttattaaaaa

SEQ ID NO: 302868 - DNA, 15 bp, Homo sapiens
tcatagttattaaaa

SEQ ID NO: 302869 - DNA, 15 bp, Homo sapiens
gtcatagttattaaa

SEQ ID NO: 302870 - DNA, 15 bp, Homo sapiens
tgtcatagttattaa

SEQ ID NO: 302871 - DNA, 15 bp, Homo sapiens
ttgtcatagttatta

SEQ ID NO: 302872 - DNA, 15 bp, Homo sapiens
tttgtcatagttatt

SEQ ID NO: 302873 - DNA, 15 bp, Homo sapiens
ctttgtcatagttat

SEQ ID NO: 302874 - DNA, 15 bp, Homo sapiens
gctttgtcatagtta

SEQ ID NO: 302875 - DNA, 15 bp, Homo sapiens
agctttgtcatagtt

SEQ ID NO: 302876 - DNA, 15 bp, Homo sapiens
aagctttgtcatagt

SEQ ID NO: 302877 - DNA, 15 bp, Homo sapiens
taagctttgtcatag

SEQ ID NO: 302878 - DNA, 15 bp, Homo sapiens
gtaagctttgtcata

SEQ ID NO: 302879 - DNA, 15 bp, Homo sapiens
tgtaagctttgtcat

SEQ ID NO: 302880 - DNA, 15 bp, Homo sapiens
atgtaagctttgtca

SEQ ID NO: 302881 - DNA, 15 bp, Homo sapiens
tatgtaagctttgtc

SEQ ID NO: 302882 - DNA, 15 bp, Homo sapiens
ttatgtaagctttgt

SEQ ID NO: 302883 - DNA, 15 bp, Homo sapiens
cttatgtaagctttg

SEQ ID NO: 302884 - DNA, 15 bp, Homo sapiens
tcttatgtaagcttt

SEQ ID NO: 302885 - DNA, 15 bp, Homo sapiens
ttcttatgtaagctt

SEQ ID NO: 302886 - DNA, 15 bp, Homo sapiens
attcttatgtaagct

SEQ ID NO: 302887 - DNA, 15 bp, Homo sapiens
aattcttatgtaagc

SEQ ID NO: 302888 - DNA, 15 bp, Homo sapiens
taattcttatgtaag

SEQ ID NO: 302889 - DNA, 15 bp, Homo sapiens
ctaattcttatgtaa

SEQ ID NO: 302890 - DNA, 15 bp, Homo sapiens
tctaattcttatgta

SEQ ID NO: 302891 - DNA, 15 bp, Homo sapiens
ttctaattcttatgt

SEQ ID NO: 302892 - DNA, 15 bp, Homo sapiens
cttctaattcttatg

SEQ ID NO: 302893 - DNA, 15 bp, Homo sapiens
tcttctaattcttat

SEQ ID NO: 302894 - DNA, 15 bp, Homo sapiens
gtcttctaattctta

SEQ ID NO: 302895 - DNA, 15 bp, Homo sapiens
ggtcttctaattctt

SEQ ID NO: 302896 - DNA, 15 bp, Homo sapiens
tggtcttctaattct

SEQ ID NO: 302897 - DNA, 15 bp, Homo sapiens
gtggtcttctaattc

SEQ ID NO: 302898 - DNA, 15 bp, Homo sapiens
agtggtcttctaatt

SEQ ID NO: 302899 - DNA, 15 bp, Homo sapiens
aagtggtcttctaat

SEQ ID NO: 302900 - DNA, 15 bp, Homo sapiens
aaagtggtcttctaa

SEQ ID NO: 302901 - DNA, 15 bp, Homo sapiens
taaagtggtcttcta

SEQ ID NO: 302902 - DNA, 15 bp, Homo sapiens
gtaaagtggtcttct

SEQ ID NO: 302903 - DNA, 15 bp, Homo sapiens
tgtaaagtggtcttc

SEQ ID NO: 302904 - DNA, 15 bp, Homo sapiens
atgtaaagtggtctt

SEQ ID NO: 302905 - DNA, 15 bp, Homo sapiens
aatgtaaagtggtct

SEQ ID NO: 302906 - DNA, 15 bp, Homo sapiens
aaatgtaaagtggtc

SEQ ID NO: 302907 - DNA, 15 bp, Homo sapiens
aaaatgtaaagtggt

SEQ ID NO: 302908 - DNA, 15 bp, Homo sapiens
aaaaatgtaaagtgg

SEQ ID NO: 302909 - DNA, 15 bp, Homo sapiens
taaaaatgtaaagtg

SEQ ID NO: 302910 - DNA, 15 bp, Homo sapiens
gtaaaaatgtaaagt

SEQ ID NO: 302911 - DNA, 15 bp, Homo sapiens
tgtaaaaatgtaaag

SEQ ID NO: 302912 - DNA, 15 bp, Homo sapiens
atgtaaaaatgtaaa

SEQ ID NO: 302913 - DNA, 15 bp, Homo sapiens
aatgtaaaaatgtaa

SEQ ID NO: 302914 - DNA, 15 bp, Homo sapiens
gaatgtaaaaatgta

SEQ ID NO: 302915 - DNA, 15 bp, Homo sapiens
ggaatgtaaaaatgt

SEQ ID NO: 302916 - DNA, 15 bp, Homo sapiens
aggaatgtaaaaatg

SEQ ID NO: 302917 - DNA, 15 bp, Homo sapiens
aaggaatgtaaaaat

SEQ ID NO: 302918 - DNA, 15 bp, Homo sapiens
gaaggaatgtaaaaa

SEQ ID NO: 302919 - DNA, 15 bp, Homo sapiens
agaaggaatgtaaaa

SEQ ID NO: 302920 - DNA, 15 bp, Homo sapiens
cagaaggaatgtaaa

SEQ ID NO: 302921 - DNA, 15 bp, Homo sapiens
gcagaaggaatgtaa

SEQ ID NO: 302922 - DNA, 15 bp, Homo sapiens
agcagaaggaatgta

SEQ ID NO: 302923 - DNA, 15 bp, Homo sapiens
cagcagaaggaatgt

SEQ ID NO: 302924 - DNA, 15 bp, Homo sapiens
acagcagaaggaatg

SEQ ID NO: 302925 - DNA, 15 bp, Homo sapiens
aacagcagaaggaat

SEQ ID NO: 302926 - DNA, 15 bp, Homo sapiens
gaacagcagaaggaa

SEQ ID NO: 302927 - DNA, 15 bp, Homo sapiens
tgaacagcagaagga

SEQ ID NO: 302928 - DNA, 15 bp, Homo sapiens
atgaacagcagaagg

SEQ ID NO: 302929 - DNA, 15 bp, Homo sapiens
tatgaacagcagaag

SEQ ID NO: 302930 - DNA, 15 bp, Homo sapiens
atatgaacagcagaa

SEQ ID NO: 302931 - DNA, 15 bp, Homo sapiens
aatatgaacagcaga

SEQ ID NO: 302932 - DNA, 15 bp, Homo sapiens
taatatgaacagcag

SEQ ID NO: 302933 - DNA, 15 bp, Homo sapiens
ttaatatgaacagca

SEQ ID NO: 302934 - DNA, 15 bp, Homo sapiens
gttaatatgaacagc

SEQ ID NO: 302935 - DNA, 15 bp, Homo sapiens
ggttaatatgaacag

SEQ ID NO: 302936 - DNA, 15 bp, Homo sapiens
aggttaatatgaaca

SEQ ID NO: 302937 - DNA, 15 bp, Homo sapiens
aaggttaatatgaac

SEQ ID NO: 302938 - DNA, 15 bp, Homo sapiens
caaggttaatatgaa

SEQ ID NO: 302939 - DNA, 15 bp, Homo sapiens
gcaaggttaatatga

SEQ ID NO: 302940 - DNA, 15 bp, Homo sapiens
tgcaaggttaatatg

SEQ ID NO: 302941 - DNA, 15 bp, Homo sapiens
gtgcaaggttaatat

SEQ ID NO: 302942 - DNA, 15 bp, Homo sapiens
tgtgcaaggttaata

SEQ ID NO: 302943 - DNA, 15 bp, Homo sapiens
ttgtgcaaggttaat

SEQ ID NO: 302944 - DNA, 15 bp, Homo sapiens
attgtgcaaggttaa

SEQ ID NO: 302945 - DNA, 15 bp, Homo sapiens
aattgtgcaaggtta

SEQ ID NO: 302946 - DNA, 15 bp, Homo sapiens
taattgtgcaaggtt

SEQ ID NO: 302947 - DNA, 15 bp, Homo sapiens
gtaattgtgcaaggt

SEQ ID NO: 302948 - DNA, 15 bp, Homo sapiens
agtaattgtgcaagg

SEQ ID NO: 302949 - DNA, 15 bp, Homo sapiens
aagtaattgtgcaag

SEQ ID NO: 302950 - DNA, 15 bp, Homo sapiens
gaagtaattgtgcaa

SEQ ID NO: 302951 - DNA, 15 bp, Homo sapiens
tgaagtaattgtgca

SEQ ID NO: 302952 - DNA, 15 bp, Homo sapiens
atgaagtaattgtgc

SEQ ID NO: 302953 - DNA, 15 bp, Homo sapiens
aatgaagtaattgtg

SEQ ID NO: 302954 - DNA, 15 bp, Homo sapiens
aaatgaagtaattgt

SEQ ID NO: 302955 - DNA, 15 bp, Homo sapiens
aaaatgaagtaattg

SEQ ID NO: 302956 - DNA, 15 bp, Homo sapiens
aaaaatgaagtaatt

SEQ ID NO: 302957 - DNA, 15 bp, Homo sapiens
aaaaaatgaagtaat

SEQ ID NO: 302958 - DNA, 15 bp, Homo sapiens
gaaaaaatgaagtaa

SEQ ID NO: 302959 - DNA, 15 bp, Homo sapiens
agaaaaaatgaagta

SEQ ID NO: 302960 - DNA, 15 bp, Homo sapiens
aagaaaaaatgaagt

SEQ ID NO: 302961 - DNA, 15 bp, Homo sapiens
aaagaaaaaatgaag

SEQ ID NO: 302962 - DNA, 15 bp, Homo sapiens
caaagaaaaaatgaa

SEQ ID NO: 302963 - DNA, 15 bp, Homo sapiens
tcaaagaaaaaatga

SEQ ID NO: 302964 - DNA, 15 bp, Homo sapiens
gtcaaagaaaaaatg

SEQ ID NO: 302965 - DNA, 15 bp, Homo sapiens
agtcaaagaaaaaat

SEQ ID NO: 302966 - DNA, 15 bp, Homo sapiens
gagtcaaagaaaaaa

SEQ ID NO: 302967 - DNA, 15 bp, Homo sapiens
agagtcaaagaaaaa

SEQ ID NO: 302968 - DNA, 15 bp, Homo sapiens
aagagtcaaagaaaa

SEQ ID NO: 302969 - DNA, 15 bp, Homo sapiens
aaagagtcaaagaaa

SEQ ID NO: 302970 - DNA, 15 bp, Homo sapiens
aaaagagtcaaagaa

SEQ ID NO: 302971 - DNA, 15 bp, Homo sapiens
taaaagagtcaaaga

SEQ ID NO: 302972 - DNA, 15 bp, Homo sapiens
gtaaaagagtcaaag

SEQ ID NO: 302973 - DNA, 15 bp, Homo sapiens
ggtaaaagagtcaaa

SEQ ID NO: 302974 - DNA, 15 bp, Homo sapiens
tggtaaaagagtcaa

SEQ ID NO: 302975 - DNA, 15 bp, Homo sapiens
gtggtaaaagagtca

SEQ ID NO: 302976 - DNA, 15 bp, Homo sapiens
tgtggtaaaagagtc

SEQ ID NO: 302977 - DNA, 15 bp, Homo sapiens
ttgtggtaaaagagt

SEQ ID NO: 302978 - DNA, 15 bp, Homo sapiens
attgtggtaaaagag

SEQ ID NO: 302979 - DNA, 15 bp, Homo sapiens
cattgtggtaaaaga

SEQ ID NO: 302980 - DNA, 15 bp, Homo sapiens
acattgtggtaaaag

SEQ ID NO: 302981 - DNA, 15 bp, Homo sapiens
aacattgtggtaaaa

SEQ ID NO: 302982 - DNA, 15 bp, Homo sapiens
aaacattgtggtaaa

SEQ ID NO: 302983 - DNA, 15 bp, Homo sapiens
aaaacattgtggtaa

SEQ ID NO: 302984 - DNA, 15 bp, Homo sapiens
caaaacattgtggta

SEQ ID NO: 302985 - DNA, 15 bp, Homo sapiens
ccaaaacattgtggt

SEQ ID NO: 302986 - DNA, 15 bp, Homo sapiens
accaaaacattgtgg

SEQ ID NO: 302987 - DNA, 15 bp, Homo sapiens
aaccaaaacattgtg

SEQ ID NO: 302988 - DNA, 15 bp, Homo sapiens
taaccaaaacattgt

SEQ ID NO: 302989 - DNA, 15 bp, Homo sapiens
ataaccaaaacattg

SEQ ID NO: 302990 - DNA, 15 bp, Homo sapiens
aataaccaaaacatt

SEQ ID NO: 302991 - DNA, 15 bp, Homo sapiens
ataaataaccaaaac

SEQ ID NO: 302992 - DNA, 15 bp, Homo sapiens
tataaataaccaaaa

SEQ ID NO: 302993 - DNA, 15 bp, Homo sapiens
ttataaataaccaaa

SEQ ID NO: 302994 - DNA, 15 bp, Homo sapiens
attataaataaccaa

SEQ ID NO: 302995 - DNA, 15 bp, Homo sapiens
aattataaataacca

SEQ ID NO: 302996 - DNA, 15 bp, Homo sapiens
aaattataaataacc

SEQ ID NO: 302997 - DNA, 15 bp, Homo sapiens
taaattataaataac

SEQ ID NO: 302998 - DNA, 15 bp, Homo sapiens
gataaattataaata

SEQ ID NO: 302999 - DNA, 15 bp, Homo sapiens
tgataaattataaat

SEQ ID NO: 303000 - DNA, 15 bp, Homo sapiens
ctgataaattataaa

SEQ ID NO: 303001 - DNA, 15 bp, Homo sapiens
gctgataaattataa

SEQ ID NO: 303002 - DNA, 15 bp, Homo sapiens
ggctgataaattata

SEQ ID NO: 303003 - DNA, 15 bp, Homo sapiens
tggctgataaattat

SEQ ID NO: 303004 - DNA, 15 bp, Homo sapiens
atggctgataaatta

SEQ ID NO: 303005 - DNA, 15 bp, Homo sapiens
tatggctgataaatt

SEQ ID NO: 303006 - DNA, 15 bp, Homo sapiens
atatggctgataaat

SEQ ID NO: 303007 - DNA, 15 bp, Homo sapiens
catatggctgataaa

SEQ ID NO: 303008 - DNA, 15 bp, Homo sapiens
acatatggctgataa

SEQ ID NO: 303009 - DNA, 15 bp, Homo sapiens
aacatatggctgata

SEQ ID NO: 303010 - DNA, 15 bp, Homo sapiens
aaacatatggctgat

SEQ ID NO: 303011 - DNA, 15 bp, Homo sapiens
taaacatatggctga

SEQ ID NO: 303012 - DNA, 15 bp, Homo sapiens
ataaacatatggctg

SEQ ID NO: 303013 - DNA, 15 bp, Homo sapiens
gataaacatatggct

SEQ ID NO: 303014 - DNA, 15 bp, Homo sapiens
tgataaacatatggc

SEQ ID NO: 303015 - DNA, 15 bp, Homo sapiens
ctgataaacatatgg

SEQ ID NO: 303016 - DNA, 15 bp, Homo sapiens
gctgataaacatatg

SEQ ID NO: 303017 - DNA, 15 bp, Homo sapiens
ggctgataaacatat

SEQ ID NO: 303018 - DNA, 15 bp, Homo sapiens
tggctgataaacata

SEQ ID NO: 303019 - DNA, 15 bp, Homo sapiens
atggctgataaacat

SEQ ID NO: 303020 - DNA, 15 bp, Homo sapiens
tatggctgataaaca

SEQ ID NO: 303021 - DNA, 15 bp, Homo sapiens
atatggctgataaac

SEQ ID NO: 303022 - DNA, 15 bp, Homo sapiens
tatatggctgataaa

SEQ ID NO: 303023 - DNA, 15 bp, Homo sapiens
ttatatggctgataa

SEQ ID NO: 303024 - DNA, 15 bp, Homo sapiens
gttatatggctgata

SEQ ID NO: 303025 - DNA, 15 bp, Homo sapiens
ggttatatggctgat

SEQ ID NO: 303026 - DNA, 15 bp, Homo sapiens
tggttatatggctga

SEQ ID NO: 303027 - DNA, 15 bp, Homo sapiens
ttggttatatggctg

SEQ ID NO: 303028 - DNA, 15 bp, Homo sapiens
gttggttatatggct

SEQ ID NO: 303029 - DNA, 15 bp, Homo sapiens
agttggttatatggc

SEQ ID NO: 303030 - DNA, 15 bp, Homo sapiens
tagttggttatatgg

SEQ ID NO: 303031 - DNA, 15 bp, Homo sapiens
ctagttggttatatg

SEQ ID NO: 303032 - DNA, 15 bp, Homo sapiens
tctagttggttatat

SEQ ID NO: 303033 - DNA, 15 bp, Homo sapiens
atctagttggttata

SEQ ID NO: 303034 - DNA, 15 bp, Homo sapiens
gatctagttggttat

SEQ ID NO: 303035 - DNA, 15 bp, Homo sapiens
ggatctagttggtta

SEQ ID NO: 303036 - DNA, 15 bp, Homo sapiens
gggatctagttggtt

SEQ ID NO: 303037 - DNA, 15 bp, Homo sapiens
tgggatctagttggt

SEQ ID NO: 303038 - DNA, 15 bp, Homo sapiens
ttgggatctagttgg

SEQ ID NO: 303039 - DNA, 15 bp, Homo sapiens
tttgggatctagttg

SEQ ID NO: 303040 - DNA, 15 bp, Homo sapiens
atttgggatctagtt

SEQ ID NO: 303041 - DNA, 15 bp, Homo sapiens
tatttgggatctagt

SEQ ID NO: 303042 - DNA, 15 bp, Homo sapiens
ctatttgggatctag

SEQ ID NO: 303043 - DNA, 15 bp, Homo sapiens
tctatttgggatcta

SEQ ID NO: 303044 - DNA, 15 bp, Homo sapiens
atctatttgggatct

SEQ ID NO: 303045 - DNA, 15 bp, Homo sapiens
gatctatttgggatc

SEQ ID NO: 303046 - DNA, 15 bp, Homo sapiens
ggatctatttgggat

SEQ ID NO: 303047 - DNA, 15 bp, Homo sapiens
tggatctatttggga

SEQ ID NO: 303048 - DNA, 15 bp, Homo sapiens
atggatctatttggg

SEQ ID NO: 303049 - DNA, 15 bp, Homo sapiens
catggatctatttgg

SEQ ID NO: 303050 - DNA, 15 bp, Homo sapiens
acatggatctatttg

SEQ ID NO: 303051 - DNA, 15 bp, Homo sapiens
tacatggatctattt

SEQ ID NO: 303052 - DNA, 15 bp, Homo sapiens
atacatggatctatt

SEQ ID NO: 303053 - DNA, 15 bp, Homo sapiens
aatacatggatctat

SEQ ID NO: 303054 - DNA, 15 bp, Homo sapiens
aaatacatggatcta

SEQ ID NO: 303055 - DNA, 15 bp, Homo sapiens
caaatacatggatct

SEQ ID NO: 303056 - DNA, 15 bp, Homo sapiens
acaaatacatggatc

SEQ ID NO: 303057 - DNA, 15 bp, Homo sapiens
aacaaatacatggat

SEQ ID NO: 303058 - DNA, 15 bp, Homo sapiens
gaaacaaatacatgg

SEQ ID NO: 303059 - DNA, 15 bp, Homo sapiens
ggaaacaaatacatg

SEQ ID NO: 303060 - DNA, 15 bp, Homo sapiens
cggaaacaaatacat

SEQ ID NO: 303061 - DNA, 15 bp, Homo sapiens
acggaaacaaataca

SEQ ID NO: 303062 - DNA, 15 bp, Homo sapiens
cacggaaacaaatac

SEQ ID NO: 303063 - DNA, 15 bp, Homo sapiens
tcacggaaacaaata

SEQ ID NO: 303064 - DNA, 15 bp, Homo sapiens
atcacggaaacaaat

SEQ ID NO: 303065 - DNA, 15 bp, Homo sapiens
aatcacggaaacaaa

SEQ ID NO: 303066 - DNA, 15 bp, Homo sapiens
aaatcacggaaacaa

SEQ ID NO: 303067 - DNA, 15 bp, Homo sapiens
caaatcacggaaaca

SEQ ID NO: 303068 - DNA, 15 bp, Homo sapiens
ccaaatcacggaaac

SEQ ID NO: 303069 - DNA, 15 bp, Homo sapiens
gccaaatcacggaaa

SEQ ID NO: 303070 - DNA, 15 bp, Homo sapiens
ggccaaatcacggaa

SEQ ID NO: 303071 - DNA, 15 bp, Homo sapiens
tggccaaatcacgga

SEQ ID NO: 303072 - DNA, 15 bp, Homo sapiens
gtggccaaatcacgg

SEQ ID NO: 303073 - DNA, 15 bp, Homo sapiens
tgtggccaaatcacg

SEQ ID NO: 303074 - DNA, 15 bp, Homo sapiens
atgtggccaaatcac

SEQ ID NO: 303075 - DNA, 15 bp, Homo sapiens
aatgtggccaaatca

SEQ ID NO: 303076 - DNA, 15 bp, Homo sapiens
taatgtggccaaatc

SEQ ID NO: 303077 - DNA, 15 bp, Homo sapiens
ttaatgtggccaaat

SEQ ID NO: 303078 - DNA, 15 bp, Homo sapiens
attaatgtggccaaa

SEQ ID NO: 303079 - DNA, 15 bp, Homo sapiens
tattaatgtggccaa

SEQ ID NO: 303080 - DNA, 15 bp, Homo sapiens
ttattaatgtggcca

SEQ ID NO: 303081 - DNA, 15 bp, Homo sapiens
tttattaatgtggcc

SEQ ID NO: 303082 - DNA, 15 bp, Homo sapiens
atttattaatgtggc

SEQ ID NO: 303083 - DNA, 15 bp, Homo sapiens
aatttattaatgtgg

SEQ ID NO: 303084 - DNA, 15 bp, Homo sapiens
gaatttattaatgtg

SEQ ID NO: 303085 - DNA, 15 bp, Homo sapiens
tgaatttattaatgt

SEQ ID NO: 303086 - DNA, 15 bp, Homo sapiens
atgaatttattaatg

SEQ ID NO: 303087 - DNA, 15 bp, Homo sapiens
tatgaatttattaat

SEQ ID NO: 303088 - DNA, 15 bp, Homo sapiens
ttatgaatttattaa

SEQ ID NO: 303089 - DNA, 15 bp, Homo sapiens
tttatgaatttatta

SEQ ID NO: 303090 - DNA, 15 bp, Homo sapiens
atttatgaatttatt

SEQ ID NO: 303091 - DNA, 15 bp, Homo sapiens
aatttatgaatttat

SEQ ID NO: 303092 - DNA, 15 bp, Homo sapiens
aaatttatgaattta

SEQ ID NO: 303093 - DNA, 15 bp, Homo sapiens
gaaatttatgaattt

SEQ ID NO: 303094 - DNA, 15 bp, Homo sapiens
tgaaatttatgaatt

SEQ ID NO: 303095 - DNA, 15 bp, Homo sapiens
ttgaaatttatgaat

SEQ ID NO: 303096 - DNA, 15 bp, Homo sapiens
attgaaatttatgaa

SEQ ID NO: 303097 - DNA, 15 bp, Homo sapiens
gattgaaatttatga

SEQ ID NO: 303098 - DNA, 15 bp, Homo sapiens
tgattgaaatttatg

SEQ ID NO: 303099 - DNA, 15 bp, Homo sapiens
ttgattgaaatttat

SEQ ID NO: 303100 - DNA, 15 bp, Homo sapiens
tttgattgaaattta

SEQ ID NO: 303101 - DNA, 15 bp, Homo sapiens
atttgattgaaattt

SEQ ID NO: 303102 - DNA, 15 bp, Homo sapiens
tatttgattgaaatt

SEQ ID NO: 303103 - DNA, 15 bp, Homo sapiens
atatttgattgaaat

SEQ ID NO: 303104 - DNA, 15 bp, Homo sapiens
gatatttgattgaaa

SEQ ID NO: 303105 - DNA, 15 bp, Homo sapiens
agatatttgattgaa

SEQ ID NO: 303106 - DNA, 15 bp, Homo sapiens
aagatatttgattga

SEQ ID NO: 303107 - DNA, 15 bp, Homo sapiens
taagatatttgattg

SEQ ID NO: 303108 - DNA, 15 bp, Homo sapiens
ataagatatttgatt

SEQ ID NO: 303109 - DNA, 15 bp, Homo sapiens
tataagatatttgat

SEQ ID NO: 303110 - DNA, 15 bp, Homo sapiens
atataagatatttga

SEQ ID NO: 303111 - DNA, 15 bp, Homo sapiens
tatataagatatttg

SEQ ID NO: 303112 - DNA, 15 bp, Homo sapiens
atatataagatattt

SEQ ID NO: 303113 - DNA, 15 bp, Homo sapiens
tatatataagatatt

SEQ ID NO: 303114 - DNA, 15 bp, Homo sapiens
gtatatataagatat

SEQ ID NO: 303115 - DNA, 15 bp, Homo sapiens
tgtatatataagata

SEQ ID NO: 303116 - DNA, 15 bp, Homo sapiens
gtgtatatataagat

SEQ ID NO: 303117 - DNA, 15 bp, Homo sapiens
tgtgtatatataaga

SEQ ID NO: 303118 - DNA, 15 bp, Homo sapiens
gtgtgtatatataag

SEQ ID NO: 303119 - DNA, 15 bp, Homo sapiens
tgtgtgtatatataa

SEQ ID NO: 303120 - DNA, 15 bp, Homo sapiens
catatgtgtgtatat

SEQ ID NO: 303121 - DNA, 15 bp, Homo sapiens
ccatatgtgtgtata

SEQ ID NO: 303122 - DNA, 15 bp, Homo sapiens
accatatgtgtgtat

SEQ ID NO: 303123 - DNA, 15 bp, Homo sapiens
aaccatatgtgtgta

SEQ ID NO: 303124 - DNA, 15 bp, Homo sapiens
aaaccatatgtgtgt

SEQ ID NO: 303125 - DNA, 15 bp, Homo sapiens
taaaccatatgtgtg

SEQ ID NO: 303126 - DNA, 15 bp, Homo sapiens
ttaaaccatatgtgt

SEQ ID NO: 303127 - DNA, 15 bp, Homo sapiens
cttaaaccatatgtg

SEQ ID NO: 303128 - DNA, 15 bp, Homo sapiens
gcttaaaccatatgt

SEQ ID NO: 303129 - DNA, 15 bp, Homo sapiens
agcttaaaccatatg

SEQ ID NO: 303130 - DNA, 15 bp, Homo sapiens
tagcttaaaccatat

SEQ ID NO: 303131 - DNA, 15 bp, Homo sapiens
gtagcttaaaccata

SEQ ID NO: 303132 - DNA, 15 bp, Homo sapiens
tgtagcttaaaccat

SEQ ID NO: 303133 - DNA, 15 bp, Homo sapiens
ctgtagcttaaacca

SEQ ID NO: 303134 - DNA, 15 bp, Homo sapiens
gctgtagcttaaacc

SEQ ID NO: 303135 - DNA, 15 bp, Homo sapiens
ggctgtagcttaaac

SEQ ID NO: 303136 - DNA, 15 bp, Homo sapiens
gggctgtagcttaaa

SEQ ID NO: 303137 - DNA, 15 bp, Homo sapiens
agggctgtagcttaa

SEQ ID NO: 303138 - DNA, 15 bp, Homo sapiens
cagggctgtagctta

SEQ ID NO: 303139 - DNA, 15 bp, Homo sapiens
acagggctgtagctt

SEQ ID NO: 303140 - DNA, 15 bp, Homo sapiens
cacagggctgtagct

SEQ ID NO: 303141 - DNA, 15 bp, Homo sapiens
acacagggctgtagc

SEQ ID NO: 303142 - DNA, 15 bp, Homo sapiens
tacacagggctgtag

SEQ ID NO: 303143 - DNA, 15 bp, Homo sapiens
atacacagggctgta

SEQ ID NO: 303144 - DNA, 15 bp, Homo sapiens
catacacagggctgt

SEQ ID NO: 303145 - DNA, 15 bp, Homo sapiens
gcatacacagggctg

SEQ ID NO: 303146 - DNA, 15 bp, Homo sapiens
ggcatacacagggct

SEQ ID NO: 303147 - DNA, 15 bp, Homo sapiens
cggcatacacagggc

SEQ ID NO: 303148 - DNA, 15 bp, Homo sapiens
acggcatacacaggg

SEQ ID NO: 303149 - DNA, 15 bp, Homo sapiens
aacggcatacacagg

SEQ ID NO: 303150 - DNA, 15 bp, Homo sapiens
aaacggcatacacag

SEQ ID NO: 303151 - DNA, 15 bp, Homo sapiens
taaacggcatacaca

SEQ ID NO: 303152 - DNA, 15 bp, Homo sapiens
ttaaacggcatacac

SEQ ID NO: 303153 - DNA, 15 bp, Homo sapiens
gttaaacggcataca

SEQ ID NO: 303154 - DNA, 15 bp, Homo sapiens
agttaaacggcatac

SEQ ID NO: 303155 - DNA, 15 bp, Homo sapiens
aagttaaacggcata

SEQ ID NO: 303156 - DNA, 15 bp, Homo sapiens
aaagttaaacggcat

SEQ ID NO: 303157 - DNA, 15 bp, Homo sapiens
taaagttaaacggca

SEQ ID NO: 303158 - DNA, 15 bp, Homo sapiens
ataaagttaaacggc

SEQ ID NO: 303159 - DNA, 15 bp, Homo sapiens
aataaagttaaacgg

SEQ ID NO: 303160 - DNA, 15 bp, Homo sapiens
aaataaagttaaacg

SEQ ID NO: 303161 - DNA, 15 bp, Homo sapiens
caaataaagttaaac

SEQ ID NO: 303162 - DNA, 15 bp, Homo sapiens
tcaaataaagttaaa

SEQ ID NO: 303163 - DNA, 15 bp, Homo sapiens
gtcaaataaagttaa

SEQ ID NO: 303164 - DNA, 15 bp, Homo sapiens
cgtcaaataaagtta

SEQ ID NO: 303165 - DNA, 15 bp, Homo sapiens
acgtcaaataaagtt

SEQ ID NO: 303166 - DNA, 15 bp, Homo sapiens
aacgtcaaataaagt

SEQ ID NO: 303167 - DNA, 15 bp, Homo sapiens
caacgtcaaataaag

SEQ ID NO: 303168 - DNA, 15 bp, Homo sapiens
gcaacgtcaaataaa

SEQ ID NO: 303169 - DNA, 15 bp, Homo sapiens
ggcaacgtcaaataa

SEQ ID NO: 303170 - DNA, 15 bp, Homo sapiens
gggcaacgtcaaata

SEQ ID NO: 303171 - DNA, 15 bp, Homo sapiens
tgggcaacgtcaaat

SEQ ID NO: 303172 - DNA, 15 bp, Homo sapiens
gtgggcaacgtcaaa

SEQ ID NO: 303173 - DNA, 15 bp, Homo sapiens
agtgggcaacgtcaa

SEQ ID NO: 303174 - DNA, 15 bp, Homo sapiens
aagtgggcaacgtca

SEQ ID NO: 303175 - DNA, 15 bp, Homo sapiens
taagtgggcaacgtc

SEQ ID NO: 303176 - DNA, 15 bp, Homo sapiens
gtaagtgggcaacgt

SEQ ID NO: 303177 - DNA, 15 bp, Homo sapiens
agtaagtgggcaacg

SEQ ID NO: 303178 - DNA, 15 bp, Homo sapiens
aagtaagtgggcaac

SEQ ID NO: 303179 - DNA, 15 bp, Homo sapiens
gaagtaagtgggcaa

SEQ ID NO: 303180 - DNA, 15 bp, Homo sapiens
agaagtaagtgggca

SEQ ID NO: 303181 - DNA, 15 bp, Homo sapiens
aagaagtaagtgggc

SEQ ID NO: 303182 - DNA, 15 bp, Homo sapiens
aaagaagtaagtggg

SEQ ID NO: 303183 - DNA, 15 bp, Homo sapiens
caaagaagtaagtgg

SEQ ID NO: 303184 - DNA, 15 bp, Homo sapiens
gcaaagaagtaagtg

SEQ ID NO: 303185 - DNA, 15 bp, Homo sapiens
agcaaagaagtaagt

SEQ ID NO: 303186 - DNA, 15 bp, Homo sapiens
cagcaaagaagtaag

SEQ ID NO: 303187 - DNA, 15 bp, Homo sapiens
tcagcaaagaagtaa

SEQ ID NO: 303188 - DNA, 15 bp, Homo sapiens
gtcagcaaagaagta

SEQ ID NO: 303189 - DNA, 15 bp, Homo sapiens
ggtcagcaaagaagt

SEQ ID NO: 303190 - DNA, 15 bp, Homo sapiens
tggtcagcaaagaag

SEQ ID NO: 303191 - DNA, 15 bp, Homo sapiens
gtggtcagcaaagaa

SEQ ID NO: 303192 - DNA, 15 bp, Homo sapiens
agtggtcagcaaaga

SEQ ID NO: 303193 - DNA, 15 bp, Homo sapiens
aagtggtcagcaaag

SEQ ID NO: 303194 - DNA, 15 bp, Homo sapiens
caagtggtcagcaaa

SEQ ID NO: 303195 - DNA, 15 bp, Homo sapiens
ccaagtggtcagcaa

SEQ ID NO: 303196 - DNA, 15 bp, Homo sapiens
tccaagtggtcagca

SEQ ID NO: 303197 - DNA, 15 bp, Homo sapiens
atccaagtggtcagc

SEQ ID NO: 303198 - DNA, 15 bp, Homo sapiens
tatccaagtggtcag

SEQ ID NO: 303199 - DNA, 15 bp, Homo sapiens
ttatccaagtggtca

SEQ ID NO: 303200 - DNA, 15 bp, Homo sapiens
gttatccaagtggtc

SEQ ID NO: 303201 - DNA, 15 bp, Homo sapiens
ggttatccaagtggt

SEQ ID NO: 303202 - DNA, 15 bp, Homo sapiens
cggttatccaagtgg

SEQ ID NO: 303203 - DNA, 15 bp, Homo sapiens
acggttatccaagtg

SEQ ID NO: 303204 - DNA, 15 bp, Homo sapiens
tacggttatccaagt

SEQ ID NO: 303205 - DNA, 15 bp, Homo sapiens
ttacggttatccaag

SEQ ID NO: 303206 - DNA, 15 bp, Homo sapiens
attacggttatccaa

SEQ ID NO: 303207 - DNA, 15 bp, Homo sapiens
tattacggttatcca

SEQ ID NO: 303208 - DNA, 15 bp, Homo sapiens
ttattacggttatcc

SEQ ID NO: 303209 - DNA, 15 bp, Homo sapiens
tttattacggttatc

SEQ ID NO: 303210 - DNA, 15 bp, Homo sapiens
ttttattacggttat

SEQ ID NO: 303211 - DNA, 15 bp, Homo sapiens
tttttattacggtta

SEQ ID NO: 303212 - DNA, 15 bp, Homo sapiens
atttttattacggtt

SEQ ID NO: 303213 - DNA, 15 bp, Homo sapiens
gatttttattacggt

SEQ ID NO: 303214 - DNA, 15 bp, Homo sapiens
ggatttttattacgg

SEQ ID NO: 303215 - DNA, 15 bp, Homo sapiens
aggatttttattacg

SEQ ID NO: 303216 - DNA, 15 bp, Homo sapiens
taggatttttattac

SEQ ID NO: 303217 - DNA, 15 bp, Homo sapiens
ataggatttttatta

SEQ ID NO: 303218 - DNA, 15 bp, Homo sapiens
tataggatttttatt

SEQ ID NO: 303219 - DNA, 15 bp, Homo sapiens
ttataggatttttat

SEQ ID NO: 303220 - DNA, 15 bp, Homo sapiens
cttataggattttta

SEQ ID NO: 303221 - DNA, 15 bp, Homo sapiens
gcttataggattttt

SEQ ID NO: 303222 - DNA, 15 bp, Homo sapiens
ggcttataggatttt

SEQ ID NO: 303223 - DNA, 15 bp, Homo sapiens
aggcttataggattt

SEQ ID NO: 303224 - DNA, 15 bp, Homo sapiens
taggcttataggatt

SEQ ID NO: 303225 - DNA, 15 bp, Homo sapiens
ttaggcttataggat

SEQ ID NO: 303226 - DNA, 15 bp, Homo sapiens
tttaggcttatagga

SEQ ID NO: 303227 - DNA, 15 bp, Homo sapiens
atttaggcttatagg

SEQ ID NO: 303228 - DNA, 15 bp, Homo sapiens
catttaggcttatag

SEQ ID NO: 303229 - DNA, 15 bp, Homo sapiens
ccatttaggcttata

SEQ ID NO: 303230 - DNA, 15 bp, Homo sapiens
gccatttaggcttat

SEQ ID NO: 303231 - DNA, 15 bp, Homo sapiens
tgccatttaggctta

SEQ ID NO: 303232 - DNA, 15 bp, Homo sapiens
atgccatttaggctt

SEQ ID NO: 303233 - DNA, 15 bp, Homo sapiens
aatgccatttaggct

SEQ ID NO: 303234 - DNA, 15 bp, Homo sapiens
aaatgccatttaggc

SEQ ID NO: 303235 - DNA, 15 bp, Homo sapiens
gaaatgccatttagg

SEQ ID NO: 303236 - DNA, 15 bp, Homo sapiens
agaaatgccatttag

SEQ ID NO: 303237 - DNA, 15 bp, Homo sapiens
aagaaatgccattta

SEQ ID NO: 303238 - DNA, 15 bp, Homo sapiens
aaagaaatgccattt

SEQ ID NO: 303239 - DNA, 15 bp, Homo sapiens
aaaagaaatgccatt

SEQ ID NO: 303240 - DNA, 15 bp, Homo sapiens
caaaagaaatgccat

SEQ ID NO: 303241 - DNA, 15 bp, Homo sapiens
ccaaaagaaatgcca

SEQ ID NO: 303242 - DNA, 15 bp, Homo sapiens
cccaaaagaaatgcc

SEQ ID NO: 303243 - DNA, 15 bp, Homo sapiens
tcccaaaagaaatgc

SEQ ID NO: 303244 - DNA, 15 bp, Homo sapiens
atcccaaaagaaatg

SEQ ID NO: 303245 - DNA, 15 bp, Homo sapiens
tatcccaaaagaaat

SEQ ID NO: 303246 - DNA, 15 bp, Homo sapiens
atatcccaaaagaaa

SEQ ID NO: 303247 - DNA, 15 bp, Homo sapiens
aatatcccaaaagaa

SEQ ID NO: 303248 - DNA, 15 bp, Homo sapiens
aaatatcccaaaaga

SEQ ID NO: 303249 - DNA, 15 bp, Homo sapiens
aaaatatcccaaaag

SEQ ID NO: 303250 - DNA, 15 bp, Homo sapiens
aaaaatatcccaaaa

SEQ ID NO: 303251 - DNA, 15 bp, Homo sapiens
gaaaaatatcccaaa

SEQ ID NO: 303252 - DNA, 15 bp, Homo sapiens
ggaaaaatatcccaa

SEQ ID NO: 303253 - DNA, 15 bp, Homo sapiens
aggaaaaatatccca

SEQ ID NO: 303254 - DNA, 15 bp, Homo sapiens
caggaaaaatatccc

SEQ ID NO: 303255 - DNA, 15 bp, Homo sapiens
gcaggaaaaatatcc

SEQ ID NO: 303256 - DNA, 15 bp, Homo sapiens
tgcaggaaaaatatc

SEQ ID NO: 303257 - DNA, 15 bp, Homo sapiens
atgcaggaaaaatat

SEQ ID NO: 303258 - DNA, 15 bp, Homo sapiens
aatgcaggaaaaata

SEQ ID NO: 303259 - DNA, 15 bp, Homo sapiens
aaatgcaggaaaaat

SEQ ID NO: 303260 - DNA, 15 bp, Homo sapiens
aaaatgcaggaaaaa

SEQ ID NO: 303261 - DNA, 15 bp, Homo sapiens
taaaatgcaggaaaa

SEQ ID NO: 303262 - DNA, 15 bp, Homo sapiens
ataaaatgcaggaaa

SEQ ID NO: 303263 - DNA, 15 bp, Homo sapiens
aataaaatgcaggaa

SEQ ID NO: 303264 - DNA, 15 bp, Homo sapiens
gaataaaatgcagga

SEQ ID NO: 303265 - DNA, 15 bp, Homo sapiens
ggaataaaatgcagg

SEQ ID NO: 303266 - DNA, 15 bp, Homo sapiens
gggaataaaatgcag

SEQ ID NO: 303267 - DNA, 15 bp, Homo sapiens
agggaataaaatgca

SEQ ID NO: 303268 - DNA, 15 bp, Homo sapiens
aagggaataaaatgc

SEQ ID NO: 303269 - DNA, 15 bp, Homo sapiens
aaagggaataaaatg

SEQ ID NO: 303270 - DNA, 15 bp, Homo sapiens
aaaagggaataaaat

SEQ ID NO: 303271 - DNA, 15 bp, Homo sapiens
aaaaagggaataaaa

SEQ ID NO: 303272 - DNA, 15 bp, Homo sapiens
taaaaagggaataaa

SEQ ID NO: 303273 - DNA, 15 bp, Homo sapiens
ataaaaagggaataa

SEQ ID NO: 303274 - DNA, 15 bp, Homo sapiens
tataaaaagggaata

SEQ ID NO: 303275 - DNA, 15 bp, Homo sapiens
atataaaaagggaat

SEQ ID NO: 303276 - DNA, 15 bp, Homo sapiens
tatataaaaagggaa

SEQ ID NO: 303277 - DNA, 15 bp, Homo sapiens
ttatataaaaaggga

SEQ ID NO: 303278 - DNA, 15 bp, Homo sapiens
cttatataaaaaggg

SEQ ID NO: 303279 - DNA, 15 bp, Homo sapiens
acttatataaaaagg

SEQ ID NO: 303280 - DNA, 15 bp, Homo sapiens
tacttatataaaaag

SEQ ID NO: 303281 - DNA, 15 bp, Homo sapiens
ctacttatataaaaa

SEQ ID NO: 303282 - DNA, 15 bp, Homo sapiens
cctacttatataaaa

SEQ ID NO: 303283 - DNA, 15 bp, Homo sapiens
tcctacttatataaa

SEQ ID NO: 303284 - DNA, 15 bp, Homo sapiens
ttcctacttatataa

SEQ ID NO: 303285 - DNA, 15 bp, Homo sapiens
attcctacttatata

SEQ ID NO: 303286 - DNA, 15 bp, Homo sapiens
aattcctacttatat

SEQ ID NO: 303287 - DNA, 15 bp, Homo sapiens
taattcctacttata

SEQ ID NO: 303288 - DNA, 15 bp, Homo sapiens
ttaattcctacttat

SEQ ID NO: 303289 - DNA, 15 bp, Homo sapiens
attaattcctactta

SEQ ID NO: 303290 - DNA, 15 bp, Homo sapiens
aattaattcctactt

SEQ ID NO: 303291 - DNA, 15 bp, Homo sapiens
taattaattcctact

SEQ ID NO: 303292 - DNA, 15 bp, Homo sapiens
ataattaattcctac

SEQ ID NO: 303293 - DNA, 15 bp, Homo sapiens
aataattaattccta

SEQ ID NO: 303294 - DNA, 15 bp, Homo sapiens
aaataattaattcct

SEQ ID NO: 303295 - DNA, 15 bp, Homo sapiens
taaataattaattcc

SEQ ID NO: 303296 - DNA, 15 bp, Homo sapiens
ataaataattaattc

SEQ ID NO: 303297 - DNA, 15 bp, Homo sapiens
aataaataattaatt

SEQ ID NO: 303298 - DNA, 15 bp, Homo sapiens
aaataaataattaat

SEQ ID NO: 303299 - DNA, 15 bp, Homo sapiens
aaaataaataattaa

SEQ ID NO: 303300 - DNA, 15 bp, Homo sapiens
taaaataaataatta

SEQ ID NO: 303301 - DNA, 15 bp, Homo sapiens
ataaaataaataatt

SEQ ID NO: 303302 - DNA, 15 bp, Homo sapiens
cataaaataaataat

SEQ ID NO: 303303 - DNA, 15 bp, Homo sapiens
acataaaataaataa

SEQ ID NO: 303304 - DNA, 15 bp, Homo sapiens
gacataaaataaata

SEQ ID NO: 303305 - DNA, 15 bp, Homo sapiens
agacataaaataaat

SEQ ID NO: 303306 - DNA, 15 bp, Homo sapiens
aagacataaaataaa

SEQ ID NO: 303307 - DNA, 15 bp, Homo sapiens
taagacataaaataa

SEQ ID NO: 303308 - DNA, 15 bp, Homo sapiens
ttaagacataaaata

SEQ ID NO: 303309 - DNA, 15 bp, Homo sapiens
attaagacataaaat

SEQ ID NO: 303310 - DNA, 15 bp, Homo sapiens
gattaagacataaaa

SEQ ID NO: 303311 - DNA, 15 bp, Homo sapiens
agattaagacataaa

SEQ ID NO: 303312 - DNA, 15 bp, Homo sapiens
tagattaagacataa

SEQ ID NO: 303313 - DNA, 15 bp, Homo sapiens
atagattaagacata

SEQ ID NO: 303314 - DNA, 15 bp, Homo sapiens
aatagattaagacat

SEQ ID NO: 303315 - DNA, 15 bp, Homo sapiens
aaatagattaagaca

SEQ ID NO: 303316 - DNA, 15 bp, Homo sapiens
caaatagattaagac

SEQ ID NO: 303317 - DNA, 15 bp, Homo sapiens
tcaaatagattaaga

SEQ ID NO: 303318 - DNA, 15 bp, Homo sapiens
atcaaatagattaag

SEQ ID NO: 303319 - DNA, 15 bp, Homo sapiens
tatcaaatagattaa

SEQ ID NO: 303320 - DNA, 15 bp, Homo sapiens
ttatcaaatagatta

SEQ ID NO: 303321 - DNA, 15 bp, Homo sapiens
tttatcaaatagatt

SEQ ID NO: 303322 - DNA, 15 bp, Homo sapiens
ctttatcaaatagat

SEQ ID NO: 303323 - DNA, 15 bp, Homo sapiens
tctttatcaaataga

SEQ ID NO: 303324 - DNA, 15 bp, Homo sapiens
ttctttatcaaatag

SEQ ID NO: 303325 - DNA, 15 bp, Homo sapiens
cttctttatcaaata

SEQ ID NO: 303326 - DNA, 15 bp, Homo sapiens
tcttctttatcaaat

SEQ ID NO: 303327 - DNA, 15 bp, Homo sapiens
gtcttctttatcaaa

SEQ ID NO: 303328 - DNA, 15 bp, Homo sapiens
agtcttctttatcaa

SEQ ID NO: 303329 - DNA, 15 bp, Homo sapiens
tagtcttctttatca

SEQ ID NO: 303330 - DNA, 15 bp, Homo sapiens
gtagtcttctttatc

SEQ ID NO: 303331 - DNA, 15 bp, Homo sapiens
tgtagtcttctttat

SEQ ID NO: 303332 - DNA, 15 bp, Homo sapiens
atgtagtcttcttta

SEQ ID NO: 303333 - DNA, 15 bp, Homo sapiens
aatgtagtcttcttt

SEQ ID NO: 303334 - DNA, 15 bp, Homo sapiens
taatgtagtcttctt

SEQ ID NO: 303335 - DNA, 15 bp, Homo sapiens
ataatgtagtcttct

SEQ ID NO: 303336 - DNA, 15 bp, Homo sapiens
tataatgtagtcttc

SEQ ID NO: 303337 - DNA, 15 bp, Homo sapiens
ttataatgtagtctt

SEQ ID NO: 303338 - DNA, 15 bp, Homo sapiens
attataatgtagtct

SEQ ID NO: 303339 - DNA, 15 bp, Homo sapiens
tattataatgtagtc

SEQ ID NO: 303340 - DNA, 15 bp, Homo sapiens
ttattataatgtagt

SEQ ID NO: 303341 - DNA, 15 bp, Homo sapiens
attattataatgtag

SEQ ID NO: 303342 - DNA, 15 bp, Homo sapiens
gattattataatgta

SEQ ID NO: 303343 - DNA, 15 bp, Homo sapiens
agattattataatgt

SEQ ID NO: 303344 - DNA, 15 bp, Homo sapiens
gagattattataatg

SEQ ID NO: 303345 - DNA, 15 bp, Homo sapiens
tgagattattataat

SEQ ID NO: 303346 - DNA, 15 bp, Homo sapiens
ttgagattattataa

SEQ ID NO: 303347 - DNA, 15 bp, Homo sapiens
tttgagattattata

SEQ ID NO: 303348 - DNA, 15 bp, Homo sapiens
ctttgagattattat

SEQ ID NO: 303349 - DNA, 15 bp, Homo sapiens
tctttgagattatta

SEQ ID NO: 303350 - DNA, 15 bp, Homo sapiens
atctttgagattatt

SEQ ID NO: 303351 - DNA, 15 bp, Homo sapiens
gatctttgagattat

SEQ ID NO: 303352 - DNA, 15 bp, Homo sapiens
tgatctttgagatta

SEQ ID NO: 303353 - DNA, 15 bp, Homo sapiens
atgatctttgagatt

SEQ ID NO: 303354 - DNA, 15 bp, Homo sapiens
tatgatctttgagat

SEQ ID NO: 303355 - DNA, 15 bp, Homo sapiens
atatgatctttgaga

SEQ ID NO: 303356 - DNA, 15 bp, Homo sapiens
aatatgatctttgag

SEQ ID NO: 303357 - DNA, 15 bp, Homo sapiens
taatatgatctttga

SEQ ID NO: 303358 - DNA, 15 bp, Homo sapiens
gtaatatgatctttg

SEQ ID NO: 303359 - DNA, 15 bp, Homo sapiens
ggtaatatgatcttt

SEQ ID NO: 303360 - DNA, 15 bp, Homo sapiens
tggtaatatgatctt

SEQ ID NO: 303361 - DNA, 15 bp, Homo sapiens
ttggtaatatgatct

SEQ ID NO: 303362 - DNA, 15 bp, Homo sapiens
tttggtaatatgatc

SEQ ID NO: 303363 - DNA, 15 bp, Homo sapiens
ctttggtaatatgat

SEQ ID NO: 303364 - DNA, 15 bp, Homo sapiens
cctttggtaatatga

SEQ ID NO: 303365 - DNA, 15 bp, Homo sapiens
acctttggtaatatg

SEQ ID NO: 303366 - DNA, 15 bp, Homo sapiens
aacctttggtaatat

SEQ ID NO: 303367 - DNA, 15 bp, Homo sapiens
caacctttggtaata

SEQ ID NO: 303368 - DNA, 15 bp, Homo sapiens
gcaacctttggtaat

SEQ ID NO: 303369 - DNA, 15 bp, Homo sapiens
ggcaacctttggtaa

SEQ ID NO: 303370 - DNA, 15 bp, Homo sapiens
gggcaacctttggta

SEQ ID NO: 303371 - DNA, 15 bp, Homo sapiens
tgggcaacctttggt

SEQ ID NO: 303372 - DNA, 15 bp, Homo sapiens
gtgggcaacctttgg

SEQ ID NO: 303373 - DNA, 15 bp, Homo sapiens
agtgggcaacctttg

SEQ ID NO: 303374 - DNA, 15 bp, Homo sapiens
aagtgggcaaccttt

SEQ ID NO: 303375 - DNA, 15 bp, Homo sapiens
caagtgggcaacctt

SEQ ID NO: 303376 - DNA, 15 bp, Homo sapiens
tcaagtgggcaacct

SEQ ID NO: 303377 - DNA, 15 bp, Homo sapiens
ctcaagtgggcaacc

SEQ ID NO: 303378 - DNA, 15 bp, Homo sapiens
gctcaagtgggcaac

SEQ ID NO: 303379 - DNA, 15 bp, Homo sapiens
tgctcaagtgggcaa

SEQ ID NO: 303380 - DNA, 15 bp, Homo sapiens
atgctcaagtgggca

SEQ ID NO: 303381 - DNA, 15 bp, Homo sapiens
tatgctcaagtgggc

SEQ ID NO: 303382 - DNA, 15 bp, Homo sapiens
atatgctcaagtggg

SEQ ID NO: 303383 - DNA, 15 bp, Homo sapiens
aatatgctcaagtgg

SEQ ID NO: 303384 - DNA, 15 bp, Homo sapiens
aaatatgctcaagtg

SEQ ID NO: 303385 - DNA, 15 bp, Homo sapiens
aaaatatgctcaagt

SEQ ID NO: 303386 - DNA, 15 bp, Homo sapiens
gaaaatatgctcaag

SEQ ID NO: 303387 - DNA, 15 bp, Homo sapiens
tgaaaatatgctcaa

SEQ ID NO: 303388 - DNA, 15 bp, Homo sapiens
aaaatgaaaatatgc

SEQ ID NO: 303389 - DNA, 15 bp, Homo sapiens
caaaatgaaaatatg

SEQ ID NO: 303390 - DNA, 15 bp, Homo sapiens
tcaaaatgaaaatat

SEQ ID NO: 303391 - DNA, 15 bp, Homo sapiens
gtcaaaatgaaaata

SEQ ID NO: 303392 - DNA, 15 bp, Homo sapiens
tgtcaaaatgaaaat

SEQ ID NO: 303393 - DNA, 15 bp, Homo sapiens
gtgtcaaaatgaaaa

SEQ ID NO: 303394 - DNA, 15 bp, Homo sapiens
tgtgtcaaaatgaaa

SEQ ID NO: 303395 - DNA, 15 bp, Homo sapiens
ctgtgtcaaaatgaa

SEQ ID NO: 303396 - DNA, 15 bp, Homo sapiens
tctgtgtcaaaatga

SEQ ID NO: 303397 - DNA, 15 bp, Homo sapiens
ttctgtgtcaaaatg

SEQ ID NO: 303398 - DNA, 15 bp, Homo sapiens
tttctgtgtcaaaat

SEQ ID NO: 303399 - DNA, 15 bp, Homo sapiens
gtttctgtgtcaaaa

SEQ ID NO: 303400 - DNA, 15 bp, Homo sapiens
tgtttctgtgtcaaa

SEQ ID NO: 303401 - DNA, 15 bp, Homo sapiens
ttgtttctgtgtcaa

SEQ ID NO: 303402 - DNA, 15 bp, Homo sapiens
tttgtttctgtgtca

SEQ ID NO: 303403 - DNA, 15 bp, Homo sapiens
ttttgtttctgtgtc

SEQ ID NO: 303404 - DNA, 15 bp, Homo sapiens
attttgtttctgtgt

SEQ ID NO: 303405 - DNA, 15 bp, Homo sapiens
aattttgtttctgtg

SEQ ID NO: 303406 - DNA, 15 bp, Homo sapiens
aaattttgtttctgt

SEQ ID NO: 303407 - DNA, 15 bp, Homo sapiens
taaattttgtttctg

SEQ ID NO: 303408 - DNA, 15 bp, Homo sapiens
ctaaattttgtttct

SEQ ID NO: 303409 - DNA, 15 bp, Homo sapiens
actaaattttgtttc

SEQ ID NO: 303410 - DNA, 15 bp, Homo sapiens
tactaaattttgttt

SEQ ID NO: 303411 - DNA, 15 bp, Homo sapiens
gtactaaattttgtt

SEQ ID NO: 303412 - DNA, 15 bp, Homo sapiens
tgtactaaattttgt

SEQ ID NO: 303413 - DNA, 15 bp, Homo sapiens
ttgtactaaattttg

SEQ ID NO: 303414 - DNA, 15 bp, Homo sapiens
gttgtactaaatttt

SEQ ID NO: 303415 - DNA, 15 bp, Homo sapiens
ggttgtactaaattt

SEQ ID NO: 303416 - DNA, 15 bp, Homo sapiens
aggttgtactaaatt

SEQ ID NO: 303417 - DNA, 15 bp, Homo sapiens
aaggttgtactaaat

SEQ ID NO: 303418 - DNA, 15 bp, Homo sapiens
aaaggttgtactaaa

SEQ ID NO: 303419 - DNA, 15 bp, Homo sapiens
gaaaggttgtactaa

SEQ ID NO: 303420 - DNA, 15 bp, Homo sapiens
ggaaaggttgtacta

SEQ ID NO: 303421 - DNA, 15 bp, Homo sapiens
aggaaaggttgtact

SEQ ID NO: 303422 - DNA, 15 bp, Homo sapiens
taggaaaggttgtac

SEQ ID NO: 303423 - DNA, 15 bp, Homo sapiens
ctaggaaaggttgta

SEQ ID NO: 303424 - DNA, 15 bp, Homo sapiens
actaggaaaggttgt

SEQ ID NO: 303425 - DNA, 15 bp, Homo sapiens
aactaggaaaggttg

SEQ ID NO: 303426 - DNA, 15 bp, Homo sapiens
gaactaggaaaggtt

SEQ ID NO: 303427 - DNA, 15 bp, Homo sapiens
ggaactaggaaaggt

SEQ ID NO: 303428 - DNA, 15 bp, Homo sapiens
gggaactaggaaagg

SEQ ID NO: 303429 - DNA, 15 bp, Homo sapiens
tgggaactaggaaag

SEQ ID NO: 303430 - DNA, 15 bp, Homo sapiens
atgggaactaggaaa

SEQ ID NO: 303431 - DNA, 15 bp, Homo sapiens
catgggaactaggaa

SEQ ID NO: 303432 - DNA, 15 bp, Homo sapiens
acatgggaactagga

SEQ ID NO: 303433 - DNA, 15 bp, Homo sapiens
gacatgggaactagg

SEQ ID NO: 303434 - DNA, 15 bp, Homo sapiens
agacatgggaactag

SEQ ID NO: 303435 - DNA, 15 bp, Homo sapiens
aagacatgggaacta

SEQ ID NO: 303436 - DNA, 15 bp, Homo sapiens
caagacatgggaact

SEQ ID NO: 303437 - DNA, 15 bp, Homo sapiens
tcaagacatgggaac

SEQ ID NO: 303438 - DNA, 15 bp, Homo sapiens
atcaagacatgggaa

SEQ ID NO: 303439 - DNA, 15 bp, Homo sapiens
aatcaagacatggga

SEQ ID NO: 303440 - DNA, 15 bp, Homo sapiens
aaatcaagacatggg

SEQ ID NO: 303441 - DNA, 15 bp, Homo sapiens
aaaatcaagacatgg

SEQ ID NO: 303442 - DNA, 15 bp, Homo sapiens
gaaaatcaagacatg

SEQ ID NO: 303443 - DNA, 15 bp, Homo sapiens
tgaaaatcaagacat

SEQ ID NO: 303444 - DNA, 15 bp, Homo sapiens
atgaaaatcaagaca

SEQ ID NO: 303445 - DNA, 15 bp, Homo sapiens
gatgaaaatcaagac

SEQ ID NO: 303446 - DNA, 15 bp, Homo sapiens
tgatgaaaatcaaga

SEQ ID NO: 303447 - DNA, 15 bp, Homo sapiens
atgatgaaaatcaag

SEQ ID NO: 303448 - DNA, 15 bp, Homo sapiens
aatgatgaaaatcaa

SEQ ID NO: 303449 - DNA, 15 bp, Homo sapiens
taatgatgaaaatca

SEQ ID NO: 303450 - DNA, 15 bp, Homo sapiens
gtaatgatgaaaatc

SEQ ID NO: 303451 - DNA, 15 bp, Homo sapiens
tgtaatgatgaaaat

SEQ ID NO: 303452 - DNA, 15 bp, Homo sapiens
atgtaatgatgaaaa

SEQ ID NO: 303453 - DNA, 15 bp, Homo sapiens
catgtaatgatgaaa

SEQ ID NO: 303454 - DNA, 15 bp, Homo sapiens
gcatgtaatgatgaa

SEQ ID NO: 303455 - DNA, 15 bp, Homo sapiens
tgcatgtaatgatga

SEQ ID NO: 303456 - DNA, 15 bp, Homo sapiens
gtgcatgtaatgatg

SEQ ID NO: 303457 - DNA, 15 bp, Homo sapiens
tgtgcatgtaatgat

SEQ ID NO: 303458 - DNA, 15 bp, Homo sapiens
ctgtgcatgtaatga

SEQ ID NO: 303459 - DNA, 15 bp, Homo sapiens
gctgtgcatgtaatg

SEQ ID NO: 303460 - DNA, 15 bp, Homo sapiens
tgctgtgcatgtaat

SEQ ID NO: 303461 - DNA, 15 bp, Homo sapiens
ctgctgtgcatgtaa

SEQ ID NO: 303462 - DNA, 15 bp, Homo sapiens
tctgctgtgcatgta

SEQ ID NO: 303463 - DNA, 15 bp, Homo sapiens
gtctgctgtgcatgt

SEQ ID NO: 303464 - DNA, 15 bp, Homo sapiens
ggtctgctgtgcatg

SEQ ID NO: 303465 - DNA, 15 bp, Homo sapiens
aggtctgctgtgcat

SEQ ID NO: 303466 - DNA, 15 bp, Homo sapiens
aaggtctgctgtgca

SEQ ID NO: 303467 - DNA, 15 bp, Homo sapiens
aaaggtctgctgtgc

SEQ ID NO: 303468 - DNA, 15 bp, Homo sapiens
taaaggtctgctgtg

SEQ ID NO: 303469 - DNA, 15 bp, Homo sapiens
gtaaaggtctgctgt

SEQ ID NO: 303470 - DNA, 15 bp, Homo sapiens
ggtaaaggtctgctg

SEQ ID NO: 303471 - DNA, 15 bp, Homo sapiens
aggtaaaggtctgct

SEQ ID NO: 303472 - DNA, 15 bp, Homo sapiens
taggtaaaggtctgc

SEQ ID NO: 303473 - DNA, 15 bp, Homo sapiens
ataggtaaaggtctg

SEQ ID NO: 303474 - DNA, 15 bp, Homo sapiens
aataggtaaaggtct

SEQ ID NO: 303475 - DNA, 15 bp, Homo sapiens
caataggtaaaggtc

SEQ ID NO: 303476 - DNA, 15 bp, Homo sapiens
acaataggtaaaggt

SEQ ID NO: 303477 - DNA, 15 bp, Homo sapiens
cacaataggtaaagg

SEQ ID NO: 303478 - DNA, 15 bp, Homo sapiens
tcacaataggtaaag

SEQ ID NO: 303479 - DNA, 15 bp, Homo sapiens
atcacaataggtaaa

SEQ ID NO: 303480 - DNA, 15 bp, Homo sapiens
tatcacaataggtaa

SEQ ID NO: 303481 - DNA, 15 bp, Homo sapiens
gtatcacaataggta

SEQ ID NO: 303482 - DNA, 15 bp, Homo sapiens
ggtatcacaataggt

SEQ ID NO: 303483 - DNA, 15 bp, Homo sapiens
tggtatcacaatagg

SEQ ID NO: 303484 - DNA, 15 bp, Homo sapiens
ctggtatcacaatag

SEQ ID NO: 303485 - DNA, 15 bp, Homo sapiens
tctggtatcacaata

SEQ ID NO: 303486 - DNA, 15 bp, Homo sapiens
ttctggtatcacaat

SEQ ID NO: 303487 - DNA, 15 bp, Homo sapiens
gttctggtatcacaa

SEQ ID NO: 303488 - DNA, 15 bp, Homo sapiens
tgttctggtatcaca

SEQ ID NO: 303489 - DNA, 15 bp, Homo sapiens
gtgttctggtatcac

SEQ ID NO: 303490 - DNA, 15 bp, Homo sapiens
tgtgttctggtatca

SEQ ID NO: 303491 - DNA, 15 bp, Homo sapiens
atgtgttctggtatc

SEQ ID NO: 303492 - DNA, 15 bp, Homo sapiens
gatgtgttctggtat

SEQ ID NO: 303493 - DNA, 15 bp, Homo sapiens
tgatgtgttctggta

SEQ ID NO: 303494 - DNA, 15 bp, Homo sapiens
atgatgtgttctggt

SEQ ID NO: 303495 - DNA, 15 bp, Homo sapiens
aatgatgtgttctgg

SEQ ID NO: 303496 - DNA, 15 bp, Homo sapiens
caatgatgtgttctg

SEQ ID NO: 303497 - DNA, 15 bp, Homo sapiens
acaatgatgtgttct

SEQ ID NO: 303498 - DNA, 15 bp, Homo sapiens
gacaatgatgtgttc

SEQ ID NO: 303499 - DNA, 15 bp, Homo sapiens
agacaatgatgtgtt

SEQ ID NO: 303500 - DNA, 15 bp, Homo sapiens
aagacaatgatgtgt

SEQ ID NO: 303501 - DNA, 15 bp, Homo sapiens
aaagacaatgatgtg

SEQ ID NO: 303502 - DNA, 15 bp, Homo sapiens
caaagacaatgatgt

SEQ ID NO: 303503 - DNA, 15 bp, Homo sapiens
ccaaagacaatgatg

SEQ ID NO: 303504 - DNA, 15 bp, Homo sapiens
accaaagacaatgat

SEQ ID NO: 303505 - DNA, 15 bp, Homo sapiens
aaccaaagacaatga

SEQ ID NO: 303506 - DNA, 15 bp, Homo sapiens
gaaccaaagacaatg

SEQ ID NO: 303507 - DNA, 15 bp, Homo sapiens
ggaaccaaagacaat

SEQ ID NO: 303508 - DNA, 15 bp, Homo sapiens
gggaaccaaagacaa

SEQ ID NO: 303509 - DNA, 15 bp, Homo sapiens
agggaaccaaagaca

SEQ ID NO: 303510 - DNA, 15 bp, Homo sapiens
aagggaaccaaagac

SEQ ID NO: 303511 - DNA, 15 bp, Homo sapiens
gaagggaaccaaaga

SEQ ID NO: 303512 - DNA, 15 bp, Homo sapiens
tgaagggaaccaaag

SEQ ID NO: 303513 - DNA, 15 bp, Homo sapiens
ttgaagggaaccaaa

SEQ ID NO: 303514 - DNA, 15 bp, Homo sapiens
tttgaagggaaccaa

SEQ ID NO: 303515 - DNA, 15 bp, Homo sapiens
ctttgaagggaacca

SEQ ID NO: 303516 - DNA, 15 bp, Homo sapiens
tctttgaagggaacc

SEQ ID NO: 303517 - DNA, 15 bp, Homo sapiens
ctctttgaagggaac

SEQ ID NO: 303518 - DNA, 15 bp, Homo sapiens
tctctttgaagggaa

SEQ ID NO: 303519 - DNA, 15 bp, Homo sapiens
ttctctttgaaggga

SEQ ID NO: 303520 - DNA, 15 bp, Homo sapiens
attctctttgaaggg

SEQ ID NO: 303521 - DNA, 15 bp, Homo sapiens
aattctctttgaagg

SEQ ID NO: 303522 - DNA, 15 bp, Homo sapiens
aaattctctttgaag

SEQ ID NO: 303523 - DNA, 15 bp, Homo sapiens
aaaattctctttgaa

SEQ ID NO: 303524 - DNA, 15 bp, Homo sapiens
taaaattctctttga

SEQ ID NO: 303525 - DNA, 15 bp, Homo sapiens
ataaaattctctttg

SEQ ID NO: 303526 - DNA, 15 bp, Homo sapiens
aataaaattctcttt

SEQ ID NO: 303527 - DNA, 15 bp, Homo sapiens
caataaaattctctt

SEQ ID NO: 303528 - DNA, 15 bp, Homo sapiens
acaataaaattctct

SEQ ID NO: 303529 - DNA, 15 bp, Homo sapiens
aacaataaaattctc

SEQ ID NO: 303530 - DNA, 15 bp, Homo sapiens
caacaataaaattct

SEQ ID NO: 303531 - DNA, 15 bp, Homo sapiens
acaacaataaaattc

SEQ ID NO: 303532 - DNA, 15 bp, Homo sapiens
aacaacaataaaatt

SEQ ID NO: 303533 - DNA, 15 bp, Homo sapiens
aaacaacaataaaat

SEQ ID NO: 303534 - DNA, 15 bp, Homo sapiens
aaaacaacaataaaa

SEQ ID NO: 303535 - DNA, 15 bp, Homo sapiens
caaaacaacaataaa

SEQ ID NO: 303536 - DNA, 15 bp, Homo sapiens
acaaaacaacaataa

SEQ ID NO: 303537 - DNA, 15 bp, Homo sapiens
tacaaaacaacaata

SEQ ID NO: 303538 - DNA, 15 bp, Homo sapiens
atacaaaacaacaat

SEQ ID NO: 303539 - DNA, 15 bp, Homo sapiens
aatacaaaacaacaa

SEQ ID NO: 303540 - DNA, 15 bp, Homo sapiens
aaatacaaaacaaca

SEQ ID NO: 303541 - DNA, 15 bp, Homo sapiens
aaaatacaaaacaac

SEQ ID NO: 303542 - DNA, 15 bp, Homo sapiens
gaaaatacaaaacaa

SEQ ID NO: 303543 - DNA, 15 bp, Homo sapiens
tgaaaatacaaaaca

SEQ ID NO: 303544 - DNA, 15 bp, Homo sapiens
ttgaaaatacaaaac

SEQ ID NO: 303545 - DNA, 15 bp, Homo sapiens
cttgaaaatacaaaa

SEQ ID NO: 303546 - DNA, 15 bp, Homo sapiens
acttgaaaatacaaa

SEQ ID NO: 303547 - DNA, 15 bp, Homo sapiens
gacttgaaaatacaa

SEQ ID NO: 303548 - DNA, 15 bp, Homo sapiens
ggacttgaaaataca

SEQ ID NO: 303549 - DNA, 15 bp, Homo sapiens
aggacttgaaaatac

SEQ ID NO: 303550 - DNA, 15 bp, Homo sapiens
aaggacttgaaaata

SEQ ID NO: 303551 - DNA, 15 bp, Homo sapiens
taaggacttgaaaat

SEQ ID NO: 303552 - DNA, 15 bp, Homo sapiens
ttaaggacttgaaaa

SEQ ID NO: 303553 - DNA, 15 bp, Homo sapiens
attaaggacttgaaa

SEQ ID NO: 303554 - DNA, 15 bp, Homo sapiens
tattaaggacttgaa

SEQ ID NO: 303555 - DNA, 15 bp, Homo sapiens
ctattaaggacttga

SEQ ID NO: 303556 - DNA, 15 bp, Homo sapiens
actattaaggacttg

SEQ ID NO: 303557 - DNA, 15 bp, Homo sapiens
aactattaaggactt

SEQ ID NO: 303558 - DNA, 15 bp, Homo sapiens
gaactattaaggact

SEQ ID NO: 303559 - DNA, 15 bp, Homo sapiens
agaactattaaggac

SEQ ID NO: 303560 - DNA, 15 bp, Homo sapiens
aagaactattaagga

SEQ ID NO: 303561 - DNA, 15 bp, Homo sapiens
caagaactattaagg

SEQ ID NO: 303562 - DNA, 15 bp, Homo sapiens
tcaagaactattaag

SEQ ID NO: 303563 - DNA, 15 bp, Homo sapiens
ttcaagaactattaa

SEQ ID NO: 303564 - DNA, 15 bp, Homo sapiens
tttcaagaactatta

SEQ ID NO: 303565 - DNA, 15 bp, Homo sapiens
gtttcaagaactatt

SEQ ID NO: 303566 - DNA, 15 bp, Homo sapiens
agtttcaagaactat

SEQ ID NO: 303567 - DNA, 15 bp, Homo sapiens
gagtttcaagaacta

SEQ ID NO: 303568 - DNA, 15 bp, Homo sapiens
ggagtttcaagaact

SEQ ID NO: 303569 - DNA, 15 bp, Homo sapiens
aggagtttcaagaac

SEQ ID NO: 303570 - DNA, 15 bp, Homo sapiens
taggagtttcaagaa

SEQ ID NO: 303571 - DNA, 15 bp, Homo sapiens
ctaggagtttcaaga

SEQ ID NO: 303572 - DNA, 15 bp, Homo sapiens
actaggagtttcaag

SEQ ID NO: 303573 - DNA, 15 bp, Homo sapiens
aactaggagtttcaa

SEQ ID NO: 303574 - DNA, 15 bp, Homo sapiens
caactaggagtttca

SEQ ID NO: 303575 - DNA, 15 bp, Homo sapiens
acaactaggagtttc

SEQ ID NO: 303576 - DNA, 15 bp, Homo sapiens
aacaactaggagttt

SEQ ID NO: 303577 - DNA, 15 bp, Homo sapiens
aaacaactaggagtt

SEQ ID NO: 303578 - DNA, 15 bp, Homo sapiens
aaaacaactaggagt

SEQ ID NO: 303579 - DNA, 15 bp, Homo sapiens
gaaaacaactaggag

SEQ ID NO: 303580 - DNA, 15 bp, Homo sapiens
agaaaacaactagga

SEQ ID NO: 303581 - DNA, 15 bp, Homo sapiens
aagaaaacaactagg

SEQ ID NO: 303582 - DNA, 15 bp, Homo sapiens
caagaaaacaactag

SEQ ID NO: 303583 - DNA, 15 bp, Homo sapiens
acaagaaaacaacta

SEQ ID NO: 303584 - DNA, 15 bp, Homo sapiens
aacaagaaaacaact

SEQ ID NO: 303585 - DNA, 15 bp, Homo sapiens
caacaagaaaacaac

SEQ ID NO: 303586 - DNA, 15 bp, Homo sapiens
tcaacaagaaaacaa

SEQ ID NO: 303587 - DNA, 15 bp, Homo sapiens
ttcaacaagaaaaca

SEQ ID NO: 303588 - DNA, 15 bp, Homo sapiens
tttcaacaagaaaac

SEQ ID NO: 303589 - DNA, 15 bp, Homo sapiens
ctttcaacaagaaaa

SEQ ID NO: 303590 - DNA, 15 bp, Homo sapiens
gctttcaacaagaaa

SEQ ID NO: 303591 - DNA, 15 bp, Homo sapiens
tgctttcaacaagaa

SEQ ID NO: 303592 - DNA, 15 bp, Homo sapiens
ctgctttcaacaaga

SEQ ID NO: 303593 - DNA, 15 bp, Homo sapiens
tctgctttcaacaag

SEQ ID NO: 303594 - DNA, 15 bp, Homo sapiens
gtctgctttcaacaa

SEQ ID NO: 303595 - DNA, 15 bp, Homo sapiens
tgtctgctttcaaca

SEQ ID NO: 303596 - DNA, 15 bp, Homo sapiens
gtgtctgctttcaac

SEQ ID NO: 303597 - DNA, 15 bp, Homo sapiens
tgtgtctgctttcaa

SEQ ID NO: 303598 - DNA, 15 bp, Homo sapiens
gtgtgtctgctttca

SEQ ID NO: 303599 - DNA, 15 bp, Homo sapiens
tgtgtgtctgctttc

SEQ ID NO: 303600 - DNA, 15 bp, Homo sapiens
atgtgtgtctgcttt

SEQ ID NO: 303601 - DNA, 15 bp, Homo sapiens
aatgtgtgtctgctt

SEQ ID NO: 303602 - DNA, 15 bp, Homo sapiens
aaatgtgtgtctgct

SEQ ID NO: 303603 - DNA, 15 bp, Homo sapiens
taaatgtgtgtctgc

SEQ ID NO: 303604 - DNA, 15 bp, Homo sapiens
ctaaatgtgtgtctg

SEQ ID NO: 303605 - DNA, 15 bp, Homo sapiens
actaaatgtgtgtct

SEQ ID NO: 303606 - DNA, 15 bp, Homo sapiens
cactaaatgtgtgtc

SEQ ID NO: 303607 - DNA, 15 bp, Homo sapiens
gcactaaatgtgtgt

SEQ ID NO: 303608 - DNA, 15 bp, Homo sapiens
tgcactaaatgtgtg

SEQ ID NO: 303609 - DNA, 15 bp, Homo sapiens
gtgcactaaatgtgt

SEQ ID NO: 303610 - DNA, 15 bp, Homo sapiens
cgtgcactaaatgtg

SEQ ID NO: 303611 - DNA, 15 bp, Homo sapiens
ccgtgcactaaatgt

SEQ ID NO: 303612 - DNA, 15 bp, Homo sapiens
gccgtgcactaaatg

SEQ ID NO: 303613 - DNA, 15 bp, Homo sapiens
agccgtgcactaaat

SEQ ID NO: 303614 - DNA, 15 bp, Homo sapiens
aagccgtgcactaaa

SEQ ID NO: 303615 - DNA, 15 bp, Homo sapiens
taagccgtgcactaa

SEQ ID NO: 303616 - DNA, 15 bp, Homo sapiens
ataagccgtgcacta

SEQ ID NO: 303617 - DNA, 15 bp, Homo sapiens
aataagccgtgcact

SEQ ID NO: 303618 - DNA, 15 bp, Homo sapiens
aaataagccgtgcac

SEQ ID NO: 303619 - DNA, 15 bp, Homo sapiens
aaaataagccgtgca

SEQ ID NO: 303620 - DNA, 15 bp, Homo sapiens
taaaataagccgtgc

SEQ ID NO: 303621 - DNA, 15 bp, Homo sapiens
gtaaaataagccgtg

SEQ ID NO: 303622 - DNA, 15 bp, Homo sapiens
ggtaaaataagccgt

SEQ ID NO: 303623 - DNA, 15 bp, Homo sapiens
aggtaaaataagccg

SEQ ID NO: 303624 - DNA, 15 bp, Homo sapiens
aaggtaaaataagcc

SEQ ID NO: 303625 - DNA, 15 bp, Homo sapiens
aaaggtaaaataagc

SEQ ID NO: 303626 - DNA, 15 bp, Homo sapiens
gaaaggtaaaataag

SEQ ID NO: 303627 - DNA, 15 bp, Homo sapiens
cgaaaggtaaaataa

SEQ ID NO: 303628 - DNA, 15 bp, Homo sapiens
ccgaaaggtaaaata

SEQ ID NO: 303629 - DNA, 15 bp, Homo sapiens
cccgaaaggtaaaat

SEQ ID NO: 303630 - DNA, 15 bp, Homo sapiens
acccgaaaggtaaaa

SEQ ID NO: 303631 - DNA, 15 bp, Homo sapiens
cacccgaaaggtaaa

SEQ ID NO: 303632 - DNA, 15 bp, Homo sapiens
tcacccgaaaggtaa

SEQ ID NO: 303633 - DNA, 15 bp, Homo sapiens
ttcacccgaaaggta

SEQ ID NO: 303634 - DNA, 15 bp, Homo sapiens
tttcacccgaaaggt

SEQ ID NO: 303635 - DNA, 15 bp, Homo sapiens
ctttcacccgaaagg

SEQ ID NO: 303636 - DNA, 15 bp, Homo sapiens
tctttcacccgaaag

SEQ ID NO: 303637 - DNA, 15 bp, Homo sapiens
atctttcacccgaaa

SEQ ID NO: 303638 - DNA, 15 bp, Homo sapiens
gatctttcacccgaa

SEQ ID NO: 303639 - DNA, 15 bp, Homo sapiens
tgatctttcacccga

SEQ ID NO: 303640 - DNA, 15 bp, Homo sapiens
ctgatctttcacccg

SEQ ID NO: 303641 - DNA, 15 bp, Homo sapiens
tctgatctttcaccc

SEQ ID NO: 303642 - DNA, 15 bp, Homo sapiens
atctgatctttcacc

SEQ ID NO: 303643 - DNA, 15 bp, Homo sapiens
catctgatctttcac

SEQ ID NO: 303644 - DNA, 15 bp, Homo sapiens
acatctgatctttca

SEQ ID NO: 303645 - DNA, 15 bp, Homo sapiens
aacatctgatctttc

SEQ ID NO: 303646 - DNA, 15 bp, Homo sapiens
aaacatctgatcttt

SEQ ID NO: 303647 - DNA, 15 bp, Homo sapiens
aaaacatctgatctt

SEQ ID NO: 303648 - DNA, 15 bp, Homo sapiens
aaaaacatctgatct

SEQ ID NO: 303649 - DNA, 15 bp, Homo sapiens
taaaaacatctgatc

SEQ ID NO: 303650 - DNA, 15 bp, Homo sapiens
ataaaaacatctgat

SEQ ID NO: 303651 - DNA, 15 bp, Homo sapiens
tataaaaacatctga

SEQ ID NO: 303652 - DNA, 15 bp, Homo sapiens
gtataaaaacatctg

SEQ ID NO: 303653 - DNA, 15 bp, Homo sapiens
ggtataaaaacatct

SEQ ID NO: 303654 - DNA, 15 bp, Homo sapiens
gggtataaaaacatc

SEQ ID NO: 303655 - DNA, 15 bp, Homo sapiens
agggtataaaaacat

SEQ ID NO: 303656 - DNA, 15 bp, Homo sapiens
aagggtataaaaaca

SEQ ID NO: 303657 - DNA, 15 bp, Homo sapiens
gaagggtataaaaac

SEQ ID NO: 303658 - DNA, 15 bp, Homo sapiens
tgaagggtataaaaa

SEQ ID NO: 303659 - DNA, 15 bp, Homo sapiens
gtgaagggtataaaa

SEQ ID NO: 303660 - DNA, 15 bp, Homo sapiens
agtgaagggtataaa

SEQ ID NO: 303661 - DNA, 15 bp, Homo sapiens
aagtgaagggtataa

SEQ ID NO: 303662 - DNA, 15 bp, Homo sapiens
caagtgaagggtata

SEQ ID NO: 303663 - DNA, 15 bp, Homo sapiens
tcaagtgaagggtat

SEQ ID NO: 303664 - DNA, 15 bp, Homo sapiens
atcaagtgaagggta

SEQ ID NO: 303665 - DNA, 15 bp, Homo sapiens
gatcaagtgaagggt

SEQ ID NO: 303666 - DNA, 15 bp, Homo sapiens
tgatcaagtgaaggg

SEQ ID NO: 303667 - DNA, 15 bp, Homo sapiens
ttgatcaagtgaagg

SEQ ID NO: 303668 - DNA, 15 bp, Homo sapiens
attgatcaagtgaag

SEQ ID NO: 303669 - DNA, 15 bp, Homo sapiens
tattgatcaagtgaa

SEQ ID NO: 303670 - DNA, 15 bp, Homo sapiens
atattgatcaagtga

SEQ ID NO: 303671 - DNA, 15 bp, Homo sapiens
tatattgatcaagtg

SEQ ID NO: 303672 - DNA, 15 bp, Homo sapiens
atatattgatcaagt

SEQ ID NO: 303673 - DNA, 15 bp, Homo sapiens
aatatattgatcaag

SEQ ID NO: 303674 - DNA, 15 bp, Homo sapiens
aaatatattgatcaa

SEQ ID NO: 303675 - DNA, 15 bp, Homo sapiens
caaatatattgatca

SEQ ID NO: 303676 - DNA, 15 bp, Homo sapiens
ccaaatatattgatc

SEQ ID NO: 303677 - DNA, 15 bp, Homo sapiens
tccaaatatattgat

SEQ ID NO: 303678 - DNA, 15 bp, Homo sapiens
ttccaaatatattga

SEQ ID NO: 303679 - DNA, 15 bp, Homo sapiens
tttccaaatatattg

SEQ ID NO: 303680 - DNA, 15 bp, Homo sapiens
ctttccaaatatatt

SEQ ID NO: 303681 - DNA, 15 bp, Homo sapiens
tctttccaaatatat

SEQ ID NO: 303682 - DNA, 15 bp, Homo sapiens
ttctttccaaatata

SEQ ID NO: 303683 - DNA, 15 bp, Homo sapiens
attctttccaaatat

SEQ ID NO: 303684 - DNA, 15 bp, Homo sapiens
cattctttccaaata

SEQ ID NO: 303685 - DNA, 15 bp, Homo sapiens
acattctttccaaat

SEQ ID NO: 303686 - DNA, 15 bp, Homo sapiens
aacattctttccaaa

SEQ ID NO: 303687 - DNA, 15 bp, Homo sapiens
aaacattctttccaa

SEQ ID NO: 303688 - DNA, 15 bp, Homo sapiens
taaacattctttcca

SEQ ID NO: 303689 - DNA, 15 bp, Homo sapiens
ataaacattctttcc

SEQ ID NO: 303690 - DNA, 15 bp, Homo sapiens
gataaacattctttc

SEQ ID NO: 303691 - DNA, 15 bp, Homo sapiens
tgataaacattcttt

SEQ ID NO: 303692 - DNA, 15 bp, Homo sapiens
ttgataaacattctt

SEQ ID NO: 303693 - DNA, 15 bp, Homo sapiens
tttgataaacattct

SEQ ID NO: 303694 - DNA, 15 bp, Homo sapiens
ttttgataaacattc

SEQ ID NO: 303695 - DNA, 15 bp, Homo sapiens
cttttgataaacatt

SEQ ID NO: 303696 - DNA, 15 bp, Homo sapiens
acttttgataaacat

SEQ ID NO: 303697 - DNA, 15 bp, Homo sapiens
gacttttgataaaca

SEQ ID NO: 303698 - DNA, 15 bp, Homo sapiens
agacttttgataaac

SEQ ID NO: 303699 - DNA, 15 bp, Homo sapiens
tagacttttgataaa

SEQ ID NO: 303700 - DNA, 15 bp, Homo sapiens
atagacttttgataa

SEQ ID NO: 303701 - DNA, 15 bp, Homo sapiens
catagacttttgata

SEQ ID NO: 303702 - DNA, 15 bp, Homo sapiens
acatagacttttgat

SEQ ID NO: 303703 - DNA, 15 bp, Homo sapiens
gacatagacttttga

SEQ ID NO: 303704 - DNA, 15 bp, Homo sapiens
tgacatagacttttg

SEQ ID NO: 303705 - DNA, 15 bp, Homo sapiens
gtgacatagactttt

SEQ ID NO: 303706 - DNA, 15 bp, Homo sapiens
agtgacatagacttt

SEQ ID NO: 303707 - DNA, 15 bp, Homo sapiens
cagtgacatagactt

SEQ ID NO: 303708 - DNA, 15 bp, Homo sapiens
gcagtgacatagact

SEQ ID NO: 303709 - DNA, 15 bp, Homo sapiens
agcagtgacatagac

SEQ ID NO: 303710 - DNA, 15 bp, Homo sapiens
aagcagtgacataga

SEQ ID NO: 303711 - DNA, 15 bp, Homo sapiens
gaagcagtgacatag

SEQ ID NO: 303712 - DNA, 15 bp, Homo sapiens
agaagcagtgacata

SEQ ID NO: 303713 - DNA, 15 bp, Homo sapiens
tagaagcagtgacat

SEQ ID NO: 303714 - DNA, 15 bp, Homo sapiens
gtagaagcagtgaca

SEQ ID NO: 303715 - DNA, 15 bp, Homo sapiens
tgtagaagcagtgac

SEQ ID NO: 303716 - DNA, 15 bp, Homo sapiens
ctgtagaagcagtga

SEQ ID NO: 303717 - DNA, 15 bp, Homo sapiens
tctgtagaagcagtg

SEQ ID NO: 303718 - DNA, 15 bp, Homo sapiens
ttctgtagaagcagt

SEQ ID NO: 303719 - DNA, 15 bp, Homo sapiens
cttctgtagaagcag

SEQ ID NO: 303720 - DNA, 15 bp, Homo sapiens
tcttctgtagaagca

SEQ ID NO: 303721 - DNA, 15 bp, Homo sapiens
ttcttctgtagaagc

SEQ ID NO: 303722 - DNA, 15 bp, Homo sapiens
attcttctgtagaag

SEQ ID NO: 303723 - DNA, 15 bp, Homo sapiens
cattcttctgtagaa

SEQ ID NO: 303724 - DNA, 15 bp, Homo sapiens
tcattcttctgtaga

SEQ ID NO: 303725 - DNA, 15 bp, Homo sapiens
ttcattcttctgtag

SEQ ID NO: 303726 - DNA, 15 bp, Homo sapiens
tttcattcttctgta

SEQ ID NO: 303727 - DNA, 15 bp, Homo sapiens
atttcattcttctgt

SEQ ID NO: 303728 - DNA, 15 bp, Homo sapiens
aatttcattcttctg

SEQ ID NO: 303729 - DNA, 15 bp, Homo sapiens
taatttcattcttct

SEQ ID NO: 303730 - DNA, 15 bp, Homo sapiens
ttaatttcattcttc

SEQ ID NO: 303731 - DNA, 15 bp, Homo sapiens
attaatttcattctt

SEQ ID NO: 303732 - DNA, 15 bp, Homo sapiens
cattaatttcattct

SEQ ID NO: 303733 - DNA, 15 bp, Homo sapiens
gcattaatttcattc

SEQ ID NO: 303734 - DNA, 15 bp, Homo sapiens
agcattaatttcatt

SEQ ID NO: 303735 - DNA, 15 bp, Homo sapiens
aagcattaatttcat

SEQ ID NO: 303736 - DNA, 15 bp, Homo sapiens
taagcattaatttca

SEQ ID NO: 303737 - DNA, 15 bp, Homo sapiens
ctaagcattaatttc

SEQ ID NO: 303738 - DNA, 15 bp, Homo sapiens
cctaagcattaattt

SEQ ID NO: 303739 - DNA, 15 bp, Homo sapiens
acctaagcattaatt

SEQ ID NO: 303740 - DNA, 15 bp, Homo sapiens
cacctaagcattaat

SEQ ID NO: 303741 - DNA, 15 bp, Homo sapiens
tcacctaagcattaa

SEQ ID NO: 303742 - DNA, 15 bp, Homo sapiens
atcacctaagcatta

SEQ ID NO: 303743 - DNA, 15 bp, Homo sapiens
catcacctaagcatt

SEQ ID NO: 303744 - DNA, 15 bp, Homo sapiens
ccatcacctaagcat

SEQ ID NO: 303745 - DNA, 15 bp, Homo sapiens
accatcacctaagca

SEQ ID NO: 303746 - DNA, 15 bp, Homo sapiens
taccatcacctaagc

SEQ ID NO: 303747 - DNA, 15 bp, Homo sapiens
gtaccatcacctaag

SEQ ID NO: 303748 - DNA, 15 bp, Homo sapiens
ggtaccatcacctaa

SEQ ID NO: 303749 - DNA, 15 bp, Homo sapiens
aggtaccatcaccta

SEQ ID NO: 303750 - DNA, 15 bp, Homo sapiens
gaggtaccatcacct

SEQ ID NO: 303751 - DNA, 15 bp, Homo sapiens
ggaggtaccatcacc

SEQ ID NO: 303752 - DNA, 15 bp, Homo sapiens
tggaggtaccatcac

SEQ ID NO: 303753 - DNA, 15 bp, Homo sapiens
gtggaggtaccatca

SEQ ID NO: 303754 - DNA, 15 bp, Homo sapiens
ggtggaggtaccatc

SEQ ID NO: 303755 - DNA, 15 bp, Homo sapiens
aggtggaggtaccat

SEQ ID NO: 303756 - DNA, 15 bp, Homo sapiens
taggtggaggtacca

SEQ ID NO: 303757 - DNA, 15 bp, Homo sapiens
gtaggtggaggtacc

SEQ ID NO: 303758 - DNA, 15 bp, Homo sapiens
tgtaggtggaggtac

SEQ ID NO: 303759 - DNA, 15 bp, Homo sapiens
atgtaggtggaggta

SEQ ID NO: 303760 - DNA, 15 bp, Homo sapiens
gatgtaggtggaggt

SEQ ID NO: 303761 - DNA, 15 bp, Homo sapiens
agatgtaggtggagg

SEQ ID NO: 303762 - DNA, 15 bp, Homo sapiens
aagatgtaggtggag

SEQ ID NO: 303763 - DNA, 15 bp, Homo sapiens
aaagatgtaggtgga

SEQ ID NO: 303764 - DNA, 15 bp, Homo sapiens
aaaagatgtaggtgg

SEQ ID NO: 303765 - DNA, 15 bp, Homo sapiens
aaaaagatgtaggtg

SEQ ID NO: 303766 - DNA, 15 bp, Homo sapiens
caaaaagatgtaggt

SEQ ID NO: 303767 - DNA, 15 bp, Homo sapiens
tcaaaaagatgtagg

SEQ ID NO: 303768 - DNA, 15 bp, Homo sapiens
ctcaaaaagatgtag

SEQ ID NO: 303769 - DNA, 15 bp, Homo sapiens
actcaaaaagatgta

SEQ ID NO: 303770 - DNA, 15 bp, Homo sapiens
cactcaaaaagatgt

SEQ ID NO: 303771 - DNA, 15 bp, Homo sapiens
gcactcaaaaagatg

SEQ ID NO: 303772 - DNA, 15 bp, Homo sapiens
tgcactcaaaaagat

SEQ ID NO: 303773 - DNA, 15 bp, Homo sapiens
atgcactcaaaaaga

SEQ ID NO: 303774 - DNA, 15 bp, Homo sapiens
aatgcactcaaaaag

SEQ ID NO: 303775 - DNA, 15 bp, Homo sapiens
gaatgcactcaaaaa

SEQ ID NO: 303776 - DNA, 15 bp, Homo sapiens
tgaatgcactcaaaa

SEQ ID NO: 303777 - DNA, 15 bp, Homo sapiens
ttgaatgcactcaaa

SEQ ID NO: 303778 - DNA, 15 bp, Homo sapiens
attgaatgcactcaa

SEQ ID NO: 303779 - DNA, 15 bp, Homo sapiens
aattgaatgcactca

SEQ ID NO: 303780 - DNA, 15 bp, Homo sapiens
taattgaatgcactc

SEQ ID NO: 303781 - DNA, 15 bp, Homo sapiens
ataattgaatgcact

SEQ ID NO: 303782 - DNA, 15 bp, Homo sapiens
cataattgaatgcac

SEQ ID NO: 303783 - DNA, 15 bp, Homo sapiens
acataattgaatgca

SEQ ID NO: 303784 - DNA, 15 bp, Homo sapiens
tacataattgaatgc

SEQ ID NO: 303785 - DNA, 15 bp, Homo sapiens
atacataattgaatg

SEQ ID NO: 303786 - DNA, 15 bp, Homo sapiens
aatacataattgaat

SEQ ID NO: 303787 - DNA, 15 bp, Homo sapiens
aaatacataattgaa

SEQ ID NO: 303788 - DNA, 15 bp, Homo sapiens
aaaatacataattga

SEQ ID NO: 303789 - DNA, 15 bp, Homo sapiens
caaaatacataattg

SEQ ID NO: 303790 - DNA, 15 bp, Homo sapiens
ccaaaatacataatt

SEQ ID NO: 303791 - DNA, 15 bp, Homo sapiens
accaaaatacataat

SEQ ID NO: 303792 - DNA, 15 bp, Homo sapiens
aaccaaaatacataa

SEQ ID NO: 303793 - DNA, 15 bp, Homo sapiens
aaaccaaaatacata

SEQ ID NO: 303794 - DNA, 15 bp, Homo sapiens
taaaccaaaatacat

SEQ ID NO: 303795 - DNA, 15 bp, Homo sapiens
ctaaaccaaaataca

SEQ ID NO: 303796 - DNA, 15 bp, Homo sapiens
gctaaaccaaaatac

SEQ ID NO: 303797 - DNA, 15 bp, Homo sapiens
agctaaaccaaaata

SEQ ID NO: 303798 - DNA, 15 bp, Homo sapiens
aagctaaaccaaaat

SEQ ID NO: 303799 - DNA, 15 bp, Homo sapiens
gaagctaaaccaaaa

SEQ ID NO: 303800 - DNA, 15 bp, Homo sapiens
agaagctaaaccaaa

SEQ ID NO: 303801 - DNA, 15 bp, Homo sapiens
cagaagctaaaccaa

SEQ ID NO: 303802 - DNA, 15 bp, Homo sapiens
tcagaagctaaacca

SEQ ID NO: 303803 - DNA, 15 bp, Homo sapiens
atcagaagctaaacc

SEQ ID NO: 303804 - DNA, 15 bp, Homo sapiens
aatcagaagctaaac

SEQ ID NO: 303805 - DNA, 15 bp, Homo sapiens
taaatcagaagctaa

SEQ ID NO: 303806 - DNA, 15 bp, Homo sapiens
ttaaatcagaagcta

SEQ ID NO: 303807 - DNA, 15 bp, Homo sapiens
gttaaatcagaagct

SEQ ID NO: 303808 - DNA, 15 bp, Homo sapiens
tgttaaatcagaagc

SEQ ID NO: 303809 - DNA, 15 bp, Homo sapiens
atgttaaatcagaag

SEQ ID NO: 303810 - DNA, 15 bp, Homo sapiens
aatgttaaatcagaa

SEQ ID NO: 303811 - DNA, 15 bp, Homo sapiens
aaatgttaaatcaga

SEQ ID NO: 303812 - DNA, 15 bp, Homo sapiens
taaatgttaaatcag

SEQ ID NO: 303813 - DNA, 15 bp, Homo sapiens
ttaaatgttaaatca

SEQ ID NO: 303814 - DNA, 15 bp, Homo sapiens
attaaatgttaaatc

SEQ ID NO: 303815 - DNA, 15 bp, Homo sapiens
aattaaatgttaaat

SEQ ID NO: 303816 - DNA, 15 bp, Homo sapiens
caattaaatgttaaa

SEQ ID NO: 303817 - DNA, 15 bp, Homo sapiens
tcaattaaatgttaa

SEQ ID NO: 303818 - DNA, 15 bp, Homo sapiens
atcaattaaatgtta

SEQ ID NO: 303819 - DNA, 15 bp, Homo sapiens
aatcaattaaatgtt

SEQ ID NO: 303820 - DNA, 15 bp, Homo sapiens
gaatcaattaaatgt

SEQ ID NO: 303821 - DNA, 15 bp, Homo sapiens
tgaatcaattaaatg

SEQ ID NO: 303822 - DNA, 15 bp, Homo sapiens
ctgaatcaattaaat

SEQ ID NO: 303823 - DNA, 15 bp, Homo sapiens
actgaatcaattaaa

SEQ ID NO: 303824 - DNA, 15 bp, Homo sapiens
aactgaatcaattaa

SEQ ID NO: 303825 - DNA, 15 bp, Homo sapiens
aaactgaatcaatta

SEQ ID NO: 303826 - DNA, 15 bp, Homo sapiens
taaactgaatcaatt

SEQ ID NO: 303827 - DNA, 15 bp, Homo sapiens
ttaaactgaatcaat

SEQ ID NO: 303828 - DNA, 15 bp, Homo sapiens
tttaaactgaatcaa

SEQ ID NO: 303829 - DNA, 15 bp, Homo sapiens
gtttaaactgaatca

SEQ ID NO: 303830 - DNA, 15 bp, Homo sapiens
tgtttaaactgaatc

SEQ ID NO: 303831 - DNA, 15 bp, Homo sapiens
atgtttaaactgaat

SEQ ID NO: 303832 - DNA, 15 bp, Homo sapiens
catgtttaaactgaa

SEQ ID NO: 303833 - DNA, 15 bp, Homo sapiens
acatgtttaaactga

SEQ ID NO: 303834 - DNA, 15 bp, Homo sapiens
aacatgtttaaactg

SEQ ID NO: 303835 - DNA, 15 bp, Homo sapiens
taacatgtttaaact

SEQ ID NO: 303836 - DNA, 15 bp, Homo sapiens
gtaacatgtttaaac

SEQ ID NO: 303837 - DNA, 15 bp, Homo sapiens
agtaacatgtttaaa

SEQ ID NO: 303838 - DNA, 15 bp, Homo sapiens
aagtaacatgtttaa

SEQ ID NO: 303839 - DNA, 15 bp, Homo sapiens
taagtaacatgttta

SEQ ID NO: 303840 - DNA, 15 bp, Homo sapiens
ttaagtaacatgttt

SEQ ID NO: 303841 - DNA, 15 bp, Homo sapiens
attaagtaacatgtt

SEQ ID NO: 303842 - DNA, 15 bp, Homo sapiens
aattaagtaacatgt

SEQ ID NO: 303843 - DNA, 15 bp, Homo sapiens
taattaagtaacatg

SEQ ID NO: 303844 - DNA, 15 bp, Homo sapiens
ctaattaagtaacat

SEQ ID NO: 303845 - DNA, 15 bp, Homo sapiens
gctaattaagtaaca

SEQ ID NO: 303846 - DNA, 15 bp, Homo sapiens
tgctaattaagtaac

SEQ ID NO: 303847 - DNA, 15 bp, Homo sapiens
ttgctaattaagtaa

SEQ ID NO: 303848 - DNA, 15 bp, Homo sapiens
tttgctaattaagta

SEQ ID NO: 303849 - DNA, 15 bp, Homo sapiens
atttgctaattaagt

SEQ ID NO: 303850 - DNA, 15 bp, Homo sapiens
catttgctaattaag

SEQ ID NO: 303851 - DNA, 15 bp, Homo sapiens
acatttgctaattaa

SEQ ID NO: 303852 - DNA, 15 bp, Homo sapiens
tacatttgctaatta

SEQ ID NO: 303853 - DNA, 15 bp, Homo sapiens
ctacatttgctaatt

SEQ ID NO: 303854 - DNA, 15 bp, Homo sapiens
tctacatttgctaat

SEQ ID NO: 303855 - DNA, 15 bp, Homo sapiens
ctctacatttgctaa

SEQ ID NO: 303856 - DNA, 15 bp, Homo sapiens
cctctacatttgcta

SEQ ID NO: 303857 - DNA, 15 bp, Homo sapiens
tcctctacatttgct

SEQ ID NO: 303858 - DNA, 15 bp, Homo sapiens
ttcctctacatttgc

SEQ ID NO: 303859 - DNA, 15 bp, Homo sapiens
gttcctctacatttg

SEQ ID NO: 303860 - DNA, 15 bp, Homo sapiens
ggttcctctacattt

SEQ ID NO: 303861 - DNA, 15 bp, Homo sapiens
tggttcctctacatt

SEQ ID NO: 303862 - DNA, 15 bp, Homo sapiens
ttggttcctctacat

SEQ ID NO: 303863 - DNA, 15 bp, Homo sapiens
tttggttcctctaca

SEQ ID NO: 303864 - DNA, 15 bp, Homo sapiens
ttttggttcctctac

SEQ ID NO: 303865 - DNA, 15 bp, Homo sapiens
tttttggttcctcta

SEQ ID NO: 303866 - DNA, 15 bp, Homo sapiens
ttttttggttcctct

SEQ ID NO: 303867 - DNA, 15 bp, Homo sapiens
tttttttggttcctc

SEQ ID NO: 303868 - DNA, 15 bp, Homo sapiens
ctttttttggttcct

SEQ ID NO: 303869 - DNA, 15 bp, Homo sapiens
cctttttttggttcc

SEQ ID NO: 303870 - DNA, 15 bp, Homo sapiens
acctttttttggttc

SEQ ID NO: 303871 - DNA, 15 bp, Homo sapiens
cacctttttttggtt

SEQ ID NO: 303872 - DNA, 15 bp, Homo sapiens
tcacctttttttggt

SEQ ID NO: 303873 - DNA, 15 bp, Homo sapiens
ttcacctttttttgg

SEQ ID NO: 303874 - DNA, 15 bp, Homo sapiens
tttcacctttttttg

SEQ ID NO: 303875 - DNA, 15 bp, Homo sapiens
ttttcaccttttttt

SEQ ID NO: 303876 - DNA, 15 bp, Homo sapiens
attttcacctttttt

SEQ ID NO: 303877 - DNA, 15 bp, Homo sapiens
tattttcaccttttt

SEQ ID NO: 303878 - DNA, 15 bp, Homo sapiens
ttattttcacctttt

SEQ ID NO: 303879 - DNA, 15 bp, Homo sapiens
attattttcaccttt

SEQ ID NO: 303880 - DNA, 15 bp, Homo sapiens
tattattttcacctt

SEQ ID NO: 303881 - DNA, 15 bp, Homo sapiens
atattattttcacct

SEQ ID NO: 303882 - DNA, 15 bp, Homo sapiens
catattattttcacc

SEQ ID NO: 303883 - DNA, 15 bp, Homo sapiens
acatattattttcac

SEQ ID NO: 303884 - DNA, 15 bp, Homo sapiens
aacatattattttca

SEQ ID NO: 303885 - DNA, 15 bp, Homo sapiens
aaacatattattttc

SEQ ID NO: 303886 - DNA, 15 bp, Homo sapiens
aaaacatattatttt

SEQ ID NO: 303887 - DNA, 15 bp, Homo sapiens
caaaacatattattt

SEQ ID NO: 303888 - DNA, 15 bp, Homo sapiens
tcaaaacatattatt

SEQ ID NO: 303889 - DNA, 15 bp, Homo sapiens
atcaaaacatattat

SEQ ID NO: 303890 - DNA, 15 bp, Homo sapiens
aatcaaaacatatta

SEQ ID NO: 303891 - DNA, 15 bp, Homo sapiens
gaatcaaaacatatt

SEQ ID NO: 303892 - DNA, 15 bp, Homo sapiens
tgaatcaaaacatat

SEQ ID NO: 303893 - DNA, 15 bp, Homo sapiens
ttgaatcaaaacata

SEQ ID NO: 303894 - DNA, 15 bp, Homo sapiens
tttgaatcaaaacat

SEQ ID NO: 303895 - DNA, 15 bp, Homo sapiens
gtttgaatcaaaaca

SEQ ID NO: 303896 - DNA, 15 bp, Homo sapiens
ggtttgaatcaaaac

SEQ ID NO: 303897 - DNA, 15 bp, Homo sapiens
aggtttgaatcaaaa

SEQ ID NO: 303898 - DNA, 15 bp, Homo sapiens
taggtttgaatcaaa

SEQ ID NO: 303899 - DNA, 15 bp, Homo sapiens
ttaggtttgaatcaa

SEQ ID NO: 303900 - DNA, 15 bp, Homo sapiens
tttaggtttgaatca

SEQ ID NO: 303901 - DNA, 15 bp, Homo sapiens
ctttaggtttgaatc

SEQ ID NO: 303902 - DNA, 15 bp, Homo sapiens
tctttaggtttgaat

SEQ ID NO: 303903 - DNA, 15 bp, Homo sapiens
gtctttaggtttgaa

SEQ ID NO: 303904 - DNA, 15 bp, Homo sapiens
tgtctttaggtttga

SEQ ID NO: 303905 - DNA, 15 bp, Homo sapiens
atgtctttaggtttg

SEQ ID NO: 303906 - DNA, 15 bp, Homo sapiens
tatgtctttaggttt

SEQ ID NO: 303907 - DNA, 15 bp, Homo sapiens
ttatgtctttaggtt

SEQ ID NO: 303908 - DNA, 15 bp, Homo sapiens
tttatgtctttaggt

SEQ ID NO: 303909 - DNA, 15 bp, Homo sapiens
ttttatgtctttagg

SEQ ID NO: 303910 - DNA, 15 bp, Homo sapiens
tttttatgtctttag

SEQ ID NO: 303911 - DNA, 15 bp, Homo sapiens
gtttttatgtcttta

SEQ ID NO: 303912 - DNA, 15 bp, Homo sapiens
tgtttttatgtcttt

SEQ ID NO: 303913 - DNA, 15 bp, Homo sapiens
atgtttttatgtctt

SEQ ID NO: 303914 - DNA, 15 bp, Homo sapiens
tatgtttttatgtct

SEQ ID NO: 303915 - DNA, 15 bp, Homo sapiens
ttatgtttttatgtc

SEQ ID NO: 303916 - DNA, 15 bp, Homo sapiens
tttatgtttttatgt

SEQ ID NO: 303917 - DNA, 15 bp, Homo sapiens
ctttatgtttttatg

SEQ ID NO: 303918 - DNA, 15 bp, Homo sapiens
tctttatgtttttat

SEQ ID NO: 303919 - DNA, 15 bp, Homo sapiens
gtctttatgttttta

SEQ ID NO: 303920 - DNA, 15 bp, Homo sapiens
tgtctttatgttttt

SEQ ID NO: 303921 - DNA, 15 bp, Homo sapiens
atgtctttatgtttt

SEQ ID NO: 303922 - DNA, 15 bp, Homo sapiens
aatgtctttatgttt

SEQ ID NO: 303923 - DNA, 15 bp, Homo sapiens
aaatgtctttatgtt

SEQ ID NO: 303924 - DNA, 15 bp, Homo sapiens
aaaatgtctttatgt

SEQ ID NO: 303925 - DNA, 15 bp, Homo sapiens
taaaatgtctttatg

SEQ ID NO: 303926 - DNA, 15 bp, Homo sapiens
ttaaaatgtctttat

SEQ ID NO: 303927 - DNA, 15 bp, Homo sapiens
gttaaaatgtcttta

SEQ ID NO: 303928 - DNA, 15 bp, Homo sapiens
agttaaaatgtcttt

SEQ ID NO: 303929 - DNA, 15 bp, Homo sapiens
aagttaaaatgtctt

SEQ ID NO: 303930 - DNA, 15 bp, Homo sapiens
aaagttaaaatgtct

SEQ ID NO: 303931 - DNA, 15 bp, Homo sapiens
caaagttaaaatgtc

SEQ ID NO: 303932 - DNA, 15 bp, Homo sapiens
ccaaagttaaaatgt

SEQ ID NO: 303933 - DNA, 15 bp, Homo sapiens
cccaaagttaaaatg

SEQ ID NO: 303934 - DNA, 15 bp, Homo sapiens
acccaaagttaaaat

SEQ ID NO: 303935 - DNA, 15 bp, Homo sapiens
aacccaaagttaaaa

SEQ ID NO: 303936 - DNA, 15 bp, Homo sapiens
gaacccaaagttaaa

SEQ ID NO: 303937 - DNA, 15 bp, Homo sapiens
agaacccaaagttaa

SEQ ID NO: 303938 - DNA, 15 bp, Homo sapiens
gagaacccaaagtta

SEQ ID NO: 303939 - DNA, 15 bp, Homo sapiens
agagaacccaaagtt

SEQ ID NO: 303940 - DNA, 15 bp, Homo sapiens
aagagaacccaaagt

SEQ ID NO: 303941 - DNA, 15 bp, Homo sapiens
aaagagaacccaaag

SEQ ID NO: 303942 - DNA, 15 bp, Homo sapiens
taaagagaacccaaa

SEQ ID NO: 303943 - DNA, 15 bp, Homo sapiens
ctaaagagaacccaa

SEQ ID NO: 303944 - DNA, 15 bp, Homo sapiens
gctaaagagaaccca

SEQ ID NO: 303945 - DNA, 15 bp, Homo sapiens
agctaaagagaaccc

SEQ ID NO: 303946 - DNA, 15 bp, Homo sapiens
cagctaaagagaacc

SEQ ID NO: 303947 - DNA, 15 bp, Homo sapiens
ccagctaaagagaac

SEQ ID NO: 303948 - DNA, 15 bp, Homo sapiens
cccagctaaagagaa

SEQ ID NO: 303949 - DNA, 15 bp, Homo sapiens
tcccagctaaagaga

SEQ ID NO: 303950 - DNA, 15 bp, Homo sapiens
atcccagctaaagag

SEQ ID NO: 303951 - DNA, 15 bp, Homo sapiens
gatcccagctaaaga

SEQ ID NO: 303952 - DNA, 15 bp, Homo sapiens
agatcccagctaaag

SEQ ID NO: 303953 - DNA, 15 bp, Homo sapiens
cagatcccagctaaa

SEQ ID NO: 303954 - DNA, 15 bp, Homo sapiens
ccagatcccagctaa

SEQ ID NO: 303955 - DNA, 15 bp, Homo sapiens
gccagatcccagcta

SEQ ID NO: 303956 - DNA, 15 bp, Homo sapiens
ggccagatcccagct

SEQ ID NO: 303957 - DNA, 15 bp, Homo sapiens
tggccagatcccagc

SEQ ID NO: 303958 - DNA, 15 bp, Homo sapiens
ctggccagatcccag

SEQ ID NO: 303959 - DNA, 15 bp, Homo sapiens
tctggccagatccca

SEQ ID NO: 303960 - DNA, 15 bp, Homo sapiens
ttctggccagatccc

SEQ ID NO: 303961 - DNA, 15 bp, Homo sapiens
cttctggccagatcc

SEQ ID NO: 303962 - DNA, 15 bp, Homo sapiens
ccttctggccagatc

SEQ ID NO: 303963 - DNA, 15 bp, Homo sapiens
tccttctggccagat

SEQ ID NO: 303964 - DNA, 15 bp, Homo sapiens
ctccttctggccaga

SEQ ID NO: 303965 - DNA, 15 bp, Homo sapiens
cctccttctggccag

SEQ ID NO: 303966 - DNA, 15 bp, Homo sapiens
gcctccttctggcca

SEQ ID NO: 303967 - DNA, 15 bp, Homo sapiens
agcctccttctggcc

SEQ ID NO: 303968 - DNA, 15 bp, Homo sapiens
aagcctccttctggc

SEQ ID NO: 303969 - DNA, 15 bp, Homo sapiens
taagcctccttctgg

SEQ ID NO: 303970 - DNA, 15 bp, Homo sapiens
ttaagcctccttctg

SEQ ID NO: 303971 - DNA, 15 bp, Homo sapiens
tttaagcctccttct

SEQ ID NO: 303972 - DNA, 15 bp, Homo sapiens
ctttaagcctccttc

SEQ ID NO: 303973 - DNA, 15 bp, Homo sapiens
actttaagcctcctt

SEQ ID NO: 303974 - DNA, 15 bp, Homo sapiens
aactttaagcctcct

SEQ ID NO: 303975 - DNA, 15 bp, Homo sapiens
taactttaagcctcc

SEQ ID NO: 303976 - DNA, 15 bp, Homo sapiens
ctaactttaagcctc

SEQ ID NO: 303977 - DNA, 15 bp, Homo sapiens
tctaactttaagcct

SEQ ID NO: 303978 - DNA, 15 bp, Homo sapiens
ttctaactttaagcc

SEQ ID NO: 303979 - DNA, 15 bp, Homo sapiens
tttctaactttaagc

SEQ ID NO: 303980 - DNA, 15 bp, Homo sapiens
atttctaactttaag

SEQ ID NO: 303981 - DNA, 15 bp, Homo sapiens
aatttctaactttaa

SEQ ID NO: 303982 - DNA, 15 bp, Homo sapiens
caatttctaacttta

SEQ ID NO: 303983 - DNA, 15 bp, Homo sapiens
gcaatttctaacttt

SEQ ID NO: 303984 - DNA, 15 bp, Homo sapiens
agcaatttctaactt

SEQ ID NO: 303985 - DNA, 15 bp, Homo sapiens
tagcaatttctaact

SEQ ID NO: 303986 - DNA, 15 bp, Homo sapiens
atagcaatttctaac

SEQ ID NO: 303987 - DNA, 15 bp, Homo sapiens
aatagcaatttctaa

SEQ ID NO: 303988 - DNA, 15 bp, Homo sapiens
taatagcaatttcta

SEQ ID NO: 303989 - DNA, 15 bp, Homo sapiens
ataatagcaatttct

SEQ ID NO: 303990 - DNA, 15 bp, Homo sapiens
aataatagcaatttc

SEQ ID NO: 303991 - DNA, 15 bp, Homo sapiens
aaataatagcaattt

SEQ ID NO: 303992 - DNA, 15 bp, Homo sapiens
aaaataatagcaatt

SEQ ID NO: 303993 - DNA, 15 bp, Homo sapiens
taaaataatagcaat

SEQ ID NO: 303994 - DNA, 15 bp, Homo sapiens
ctaaaataatagcaa

SEQ ID NO: 303995 - DNA, 15 bp, Homo sapiens
tctaaaataatagca

SEQ ID NO: 303996 - DNA, 15 bp, Homo sapiens
ttctaaaataatagc

SEQ ID NO: 303997 - DNA, 15 bp, Homo sapiens
attctaaaataatag

SEQ ID NO: 303998 - DNA, 15 bp, Homo sapiens
tattctaaaataata

SEQ ID NO: 303999 - DNA, 15 bp, Homo sapiens
ctattctaaaataat

SEQ ID NO: 304000 - DNA, 15 bp, Homo sapiens
cctattctaaaataa

SEQ ID NO: 304001 - DNA, 15 bp, Homo sapiens
acctattctaaaata

SEQ ID NO: 304002 - DNA, 15 bp, Homo sapiens
aacctattctaaaat

SEQ ID NO: 304003 - DNA, 15 bp, Homo sapiens
caacctattctaaaa

SEQ ID NO: 304004 - DNA, 15 bp, Homo sapiens
ccaacctattctaaa

SEQ ID NO: 304005 - DNA, 15 bp, Homo sapiens
cccaacctattctaa

SEQ ID NO: 304006 - DNA, 15 bp, Homo sapiens
acccaacctattcta

SEQ ID NO: 304007 - DNA, 15 bp, Homo sapiens
cacccaacctattct

SEQ ID NO: 304008 - DNA, 15 bp, Homo sapiens
ccacccaacctattc

SEQ ID NO: 304009 - DNA, 15 bp, Homo sapiens
cccacccaacctatt

SEQ ID NO: 304010 - DNA, 15 bp, Homo sapiens
acccacccaacctat

SEQ ID NO: 304011 - DNA, 15 bp, Homo sapiens
aacccacccaaccta

SEQ ID NO: 304012 - DNA, 15 bp, Homo sapiens
caacccacccaacct

SEQ ID NO: 304013 - DNA, 15 bp, Homo sapiens
ccaacccacccaacc

SEQ ID NO: 304014 - DNA, 15 bp, Homo sapiens
cccaacccacccaac

SEQ ID NO: 304015 - DNA, 15 bp, Homo sapiens
ccccaacccacccaa

SEQ ID NO: 304016 - DNA, 15 bp, Homo sapiens
cccccaacccaccca

SEQ ID NO: 304017 - DNA, 15 bp, Homo sapiens
ccccccaacccaccc

SEQ ID NO: 304018 - DNA, 15 bp, Homo sapiens
gccccccaacccacc

SEQ ID NO: 304019 - DNA, 15 bp, Homo sapiens
tgccccccaacccac

SEQ ID NO: 304020 - DNA, 15 bp, Homo sapiens
ttgccccccaaccca

SEQ ID NO: 304021 - DNA, 15 bp, Homo sapiens
cttgccccccaaccc

SEQ ID NO: 304022 - DNA, 15 bp, Homo sapiens
ccttgccccccaacc

SEQ ID NO: 304023 - DNA, 15 bp, Homo sapiens
cccttgccccccaac

SEQ ID NO: 304024 - DNA, 15 bp, Homo sapiens
acccttgccccccaa

SEQ ID NO: 304025 - DNA, 15 bp, Homo sapiens
cacccttgcccccca

SEQ ID NO: 304026 - DNA, 15 bp, Homo sapiens
acacccttgcccccc

SEQ ID NO: 304027 - DNA, 15 bp, Homo sapiens
gacacccttgccccc

SEQ ID NO: 304028 - DNA, 15 bp, Homo sapiens
agacacccttgcccc

SEQ ID NO: 304029 - DNA, 15 bp, Homo sapiens
tagacacccttgccc

SEQ ID NO: 304030 - DNA, 15 bp, Homo sapiens
atagacacccttgcc

SEQ ID NO: 304031 - DNA, 15 bp, Homo sapiens
aatagacacccttgc

SEQ ID NO: 304032 - DNA, 15 bp, Homo sapiens
aaatagacacccttg

SEQ ID NO: 304033 - DNA, 15 bp, Homo sapiens
caaatagacaccctt

SEQ ID NO: 304034 - DNA, 15 bp, Homo sapiens
gcaaatagacaccct

SEQ ID NO: 304035 - DNA, 15 bp, Homo sapiens
tgcaaatagacaccc

SEQ ID NO: 304036 - DNA, 15 bp, Homo sapiens
ctgcaaatagacacc

SEQ ID NO: 304037 - DNA, 15 bp, Homo sapiens
gctgcaaatagacac

SEQ ID NO: 304038 - DNA, 15 bp, Homo sapiens
tgctgcaaatagaca

SEQ ID NO: 304039 - DNA, 15 bp, Homo sapiens
ctgctgcaaatagac

SEQ ID NO: 304040 - DNA, 15 bp, Homo sapiens
tctgctgcaaataga

SEQ ID NO: 304041 - DNA, 15 bp, Homo sapiens
ctctgctgcaaatag

SEQ ID NO: 304042 - DNA, 15 bp, Homo sapiens
tctctgctgcaaata

SEQ ID NO: 304043 - DNA, 15 bp, Homo sapiens
atctctgctgcaaat

SEQ ID NO: 304044 - DNA, 15 bp, Homo sapiens
tatctctgctgcaaa

SEQ ID NO: 304045 - DNA, 15 bp, Homo sapiens
atatctctgctgcaa

SEQ ID NO: 304046 - DNA, 15 bp, Homo sapiens
aatatctctgctgca

SEQ ID NO: 304047 - DNA, 15 bp, Homo sapiens
aaatatctctgctgc

SEQ ID NO: 304048 - DNA, 15 bp, Homo sapiens
aaaatatctctgctg

SEQ ID NO: 304049 - DNA, 15 bp, Homo sapiens
caaaatatctctgct

SEQ ID NO: 304050 - DNA, 15 bp, Homo sapiens
tcaaaatatctctgc

SEQ ID NO: 304051 - DNA, 15 bp, Homo sapiens
ttcaaaatatctctg

SEQ ID NO: 304052 - DNA, 15 bp, Homo sapiens
tttcaaaatatctct

SEQ ID NO: 304053 - DNA, 15 bp, Homo sapiens
ttttcaaaatatctc

SEQ ID NO: 304054 - DNA, 15 bp, Homo sapiens
cttttcaaaatatct

SEQ ID NO: 304055 - DNA, 15 bp, Homo sapiens
tcttttcaaaatatc

SEQ ID NO: 304056 - DNA, 15 bp, Homo sapiens
ttcttttcaaaatat

SEQ ID NO: 304057 - DNA, 15 bp, Homo sapiens
cttcttttcaaaata

SEQ ID NO: 304058 - DNA, 15 bp, Homo sapiens
tcttcttttcaaaat

SEQ ID NO: 304059 - DNA, 15 bp, Homo sapiens
ttcttcttttcaaaa

SEQ ID NO: 304060 - DNA, 15 bp, Homo sapiens
tttcttcttttcaaa

SEQ ID NO: 304061 - DNA, 15 bp, Homo sapiens
ttttcttcttttcaa

SEQ ID NO: 304062 - DNA, 15 bp, Homo sapiens
attttcttcttttca

SEQ ID NO: 304063 - DNA, 15 bp, Homo sapiens
aattttcttcttttc

SEQ ID NO: 304064 - DNA, 15 bp, Homo sapiens
caattttcttctttt

SEQ ID NO: 304065 - DNA, 15 bp, Homo sapiens
acaattttcttcttt

SEQ ID NO: 304066 - DNA, 15 bp, Homo sapiens
aacaattttcttctt

SEQ ID NO: 304067 - DNA, 15 bp, Homo sapiens
aaacaattttcttct

SEQ ID NO: 304068 - DNA, 15 bp, Homo sapiens
aaaacaattttcttc

SEQ ID NO: 304069 - DNA, 15 bp, Homo sapiens
taaaacaattttctt

SEQ ID NO: 304070 - DNA, 15 bp, Homo sapiens
ataaaacaattttct

SEQ ID NO: 304071 - DNA, 15 bp, Homo sapiens
tataaaacaattttc

SEQ ID NO: 304072 - DNA, 15 bp, Homo sapiens
atataaaacaatttt

SEQ ID NO: 304073 - DNA, 15 bp, Homo sapiens
tatataaaacaattt

SEQ ID NO: 304074 - DNA, 15 bp, Homo sapiens
ttatataaaacaatt

SEQ ID NO: 304075 - DNA, 15 bp, Homo sapiens
tttatataaaacaat

SEQ ID NO: 304076 - DNA, 15 bp, Homo sapiens
ttttatataaaacaa

SEQ ID NO: 304077 - DNA, 15 bp, Homo sapiens
tttttatataaaaca

SEQ ID NO: 304078 - DNA, 15 bp, Homo sapiens
ctttttatataaaac

SEQ ID NO: 304079 - DNA, 15 bp, Homo sapiens
cctttttatataaaa

SEQ ID NO: 304080 - DNA, 15 bp, Homo sapiens
tcctttttatataaa

SEQ ID NO: 304081 - DNA, 15 bp, Homo sapiens
ttcctttttatataa

SEQ ID NO: 304082 - DNA, 15 bp, Homo sapiens
tttcctttttatata

SEQ ID NO: 304083 - DNA, 15 bp, Homo sapiens
ctttcctttttatat

SEQ ID NO: 304084 - DNA, 15 bp, Homo sapiens
gctttcctttttata

SEQ ID NO: 304085 - DNA, 15 bp, Homo sapiens
ggctttcctttttat

SEQ ID NO: 304086 - DNA, 15 bp, Homo sapiens
tggctttccttttta

SEQ ID NO: 304087 - DNA, 15 bp, Homo sapiens
atggctttccttttt

SEQ ID NO: 304088 - DNA, 15 bp, Homo sapiens
catggctttcctttt

SEQ ID NO: 304089 - DNA, 15 bp, Homo sapiens
tcatggctttccttt

SEQ ID NO: 304090 - DNA, 15 bp, Homo sapiens
gtcatggctttcctt

SEQ ID NO: 304091 - DNA, 15 bp, Homo sapiens
ggtcatggctttcct

SEQ ID NO: 304092 - DNA, 15 bp, Homo sapiens
tggtcatggctttcc

SEQ ID NO: 304093 - DNA, 15 bp, Homo sapiens
gtggtcatggctttc

SEQ ID NO: 304094 - DNA, 15 bp, Homo sapiens
ggtggtcatggcttt

SEQ ID NO: 304095 - DNA, 15 bp, Homo sapiens
aggtggtcatggctt

SEQ ID NO: 304096 - DNA, 15 bp, Homo sapiens
aaggtggtcatggct

SEQ ID NO: 304097 - DNA, 15 bp, Homo sapiens
aaaggtggtcatggc

SEQ ID NO: 304098 - DNA, 15 bp, Homo sapiens
gaaaggtggtcatgg

SEQ ID NO: 304099 - DNA, 15 bp, Homo sapiens
agaaaggtggtcatg

SEQ ID NO: 304100 - DNA, 15 bp, Homo sapiens
tagaaaggtggtcat

SEQ ID NO: 304101 - DNA, 15 bp, Homo sapiens
gtagaaaggtggtca

SEQ ID NO: 304102 - DNA, 15 bp, Homo sapiens
ggtagaaaggtggtc

SEQ ID NO: 304103 - DNA, 15 bp, Homo sapiens
aggtagaaaggtggt

SEQ ID NO: 304104 - DNA, 15 bp, Homo sapiens
gaggtagaaaggtgg

SEQ ID NO: 304105 - DNA, 15 bp, Homo sapiens
tgaggtagaaaggtg

SEQ ID NO: 304106 - DNA, 15 bp, Homo sapiens
ctgaggtagaaaggt

SEQ ID NO: 304107 - DNA, 15 bp, Homo sapiens
tctgaggtagaaagg

SEQ ID NO: 304108 - DNA, 15 bp, Homo sapiens
atctgaggtagaaag

SEQ ID NO: 304109 - DNA, 15 bp, Homo sapiens
gatctgaggtagaaa

SEQ ID NO: 304110 - DNA, 15 bp, Homo sapiens
ggatctgaggtagaa

SEQ ID NO: 304111 - DNA, 15 bp, Homo sapiens
tggatctgaggtaga

SEQ ID NO: 304112 - DNA, 15 bp, Homo sapiens
atggatctgaggtag

SEQ ID NO: 304113 - DNA, 15 bp, Homo sapiens
gatggatctgaggta

SEQ ID NO: 304114 - DNA, 15 bp, Homo sapiens
agatggatctgaggt

SEQ ID NO: 304115 - DNA, 15 bp, Homo sapiens
aagatggatctgagg

SEQ ID NO: 304116 - DNA, 15 bp, Homo sapiens
gaagatggatctgag

SEQ ID NO: 304117 - DNA, 15 bp, Homo sapiens
tgaagatggatctga

SEQ ID NO: 304118 - DNA, 15 bp, Homo sapiens
atgaagatggatctg

SEQ ID NO: 304119 - DNA, 15 bp, Homo sapiens
gatgaagatggatct

SEQ ID NO: 304120 - DNA, 15 bp, Homo sapiens
ggatgaagatggatc

SEQ ID NO: 304121 - DNA, 15 bp, Homo sapiens
tggatgaagatggat

SEQ ID NO: 304122 - DNA, 15 bp, Homo sapiens
atggatgaagatgga

SEQ ID NO: 304123 - DNA, 15 bp, Homo sapiens
aatggatgaagatgg

SEQ ID NO: 304124 - DNA, 15 bp, Homo sapiens
caatggatgaagatg

SEQ ID NO: 304125 - DNA, 15 bp, Homo sapiens
gcaatggatgaagat

SEQ ID NO: 304126 - DNA, 15 bp, Homo sapiens
tgcaatggatgaaga

SEQ ID NO: 304127 - DNA, 15 bp, Homo sapiens
atgcaatggatgaag

SEQ ID NO: 304128 - DNA, 15 bp, Homo sapiens
aatgcaatggatgaa

SEQ ID NO: 304129 - DNA, 15 bp, Homo sapiens
caatgcaatggatga

SEQ ID NO: 304130 - DNA, 15 bp, Homo sapiens
ccaatgcaatggatg

SEQ ID NO: 304131 - DNA, 15 bp, Homo sapiens
tccaatgcaatggat

SEQ ID NO: 304132 - DNA, 15 bp, Homo sapiens
ttccaatgcaatgga

SEQ ID NO: 304133 - DNA, 15 bp, Homo sapiens
tttccaatgcaatgg

SEQ ID NO: 304134 - DNA, 15 bp, Homo sapiens
gtttccaatgcaatg

SEQ ID NO: 304135 - DNA, 15 bp, Homo sapiens
agtttccaatgcaat

SEQ ID NO: 304136 - DNA, 15 bp, Homo sapiens
cagtttccaatgcaa

SEQ ID NO: 304137 - DNA, 15 bp, Homo sapiens
gcagtttccaatgca

SEQ ID NO: 304138 - DNA, 15 bp, Homo sapiens
agcagtttccaatgc

SEQ ID NO: 304139 - DNA, 15 bp, Homo sapiens
aagcagtttccaatg

SEQ ID NO: 304140 - DNA, 15 bp, Homo sapiens
aaagcagtttccaat

SEQ ID NO: 304141 - DNA, 15 bp, Homo sapiens
taaagcagtttccaa

SEQ ID NO: 304142 - DNA, 15 bp, Homo sapiens
ataaagcagtttcca

SEQ ID NO: 304143 - DNA, 15 bp, Homo sapiens
cataaagcagtttcc

SEQ ID NO: 304144 - DNA, 15 bp, Homo sapiens
gcataaagcagtttc

SEQ ID NO: 304145 - DNA, 15 bp, Homo sapiens
agcataaagcagttt

SEQ ID NO: 304146 - DNA, 15 bp, Homo sapiens
cagcataaagcagtt

SEQ ID NO: 304147 - DNA, 15 bp, Homo sapiens
gcagcataaagcagt

SEQ ID NO: 304148 - DNA, 15 bp, Homo sapiens
agcagcataaagcag

SEQ ID NO: 304149 - DNA, 15 bp, Homo sapiens
cagcagcataaagca

SEQ ID NO: 304150 - DNA, 15 bp, Homo sapiens
gcagcagcataaagc

SEQ ID NO: 304151 - DNA, 15 bp, Homo sapiens
tgcagcagcataaag

SEQ ID NO: 304152 - DNA, 15 bp, Homo sapiens
ctgcagcagcataaa

SEQ ID NO: 304153 - DNA, 15 bp, Homo sapiens
actgcagcagcataa

SEQ ID NO: 304154 - DNA, 15 bp, Homo sapiens
gactgcagcagcata

SEQ ID NO: 304155 - DNA, 15 bp, Homo sapiens
agactgcagcagcat

SEQ ID NO: 304156 - DNA, 15 bp, Homo sapiens
cagactgcagcagca

SEQ ID NO: 304157 - DNA, 15 bp, Homo sapiens
gcagactgcagcagc

SEQ ID NO: 304158 - DNA, 15 bp, Homo sapiens
tgcagactgcagcag

SEQ ID NO: 304159 - DNA, 15 bp, Homo sapiens
ttgcagactgcagca

SEQ ID NO: 304160 - DNA, 15 bp, Homo sapiens
tttgcagactgcagc

SEQ ID NO: 304161 - DNA, 15 bp, Homo sapiens
ctttgcagactgcag

SEQ ID NO: 304162 - DNA, 15 bp, Homo sapiens
actttgcagactgca

SEQ ID NO: 304163 - DNA, 15 bp, Homo sapiens
gactttgcagactgc

SEQ ID NO: 304164 - DNA, 15 bp, Homo sapiens
agactttgcagactg

SEQ ID NO: 304165 - DNA, 15 bp, Homo sapiens
tagactttgcagact

SEQ ID NO: 304166 - DNA, 15 bp, Homo sapiens
ctagactttgcagac

SEQ ID NO: 304167 - DNA, 15 bp, Homo sapiens
tctagactttgcaga

SEQ ID NO: 304168 - DNA, 15 bp, Homo sapiens
ctctagactttgcag

SEQ ID NO: 304169 - DNA, 15 bp, Homo sapiens
gctctagactttgca

SEQ ID NO: 304170 - DNA, 15 bp, Homo sapiens
agctctagactttgc

SEQ ID NO: 304171 - DNA, 15 bp, Homo sapiens
aagctctagactttg

SEQ ID NO: 304172 - DNA, 15 bp, Homo sapiens
aaagctctagacttt

SEQ ID NO: 304173 - DNA, 15 bp, Homo sapiens
aaaagctctagactt

SEQ ID NO: 304174 - DNA, 15 bp, Homo sapiens
taaaagctctagact

SEQ ID NO: 304175 - DNA, 15 bp, Homo sapiens
ataaaagctctagac

SEQ ID NO: 304176 - DNA, 15 bp, Homo sapiens
gataaaagctctaga

SEQ ID NO: 304177 - DNA, 15 bp, Homo sapiens
tgataaaagctctag

SEQ ID NO: 304178 - DNA, 15 bp, Homo sapiens
ctgataaaagctcta

SEQ ID NO: 304179 - DNA, 15 bp, Homo sapiens
cctgataaaagctct

SEQ ID NO: 304180 - DNA, 15 bp, Homo sapiens
gcctgataaaagctc

SEQ ID NO: 304181 - DNA, 15 bp, Homo sapiens
ggcctgataaaagct

SEQ ID NO: 304182 - DNA, 15 bp, Homo sapiens
tggcctgataaaagc

SEQ ID NO: 304183 - DNA, 15 bp, Homo sapiens
atggcctgataaaag

SEQ ID NO: 304184 - DNA, 15 bp, Homo sapiens
catggcctgataaaa

SEQ ID NO: 304185 - DNA, 15 bp, Homo sapiens
acatggcctgataaa

SEQ ID NO: 304186 - DNA, 15 bp, Homo sapiens
gacatggcctgataa

SEQ ID NO: 304187 - DNA, 15 bp, Homo sapiens
tgacatggcctgata

SEQ ID NO: 304188 - DNA, 15 bp, Homo sapiens
atgacatggcctgat

SEQ ID NO: 304189 - DNA, 15 bp, Homo sapiens
tatgacatggcctga

SEQ ID NO: 304190 - DNA, 15 bp, Homo sapiens
gtatgacatggcctg

SEQ ID NO: 304191 - DNA, 15 bp, Homo sapiens
ggtatgacatggcct

SEQ ID NO: 304192 - DNA, 15 bp, Homo sapiens
gggtatgacatggcc

SEQ ID NO: 304193 - DNA, 15 bp, Homo sapiens
tgggtatgacatggc

SEQ ID NO: 304194 - DNA, 15 bp, Homo sapiens
ttgggtatgacatgg

SEQ ID NO: 304195 - DNA, 15 bp, Homo sapiens
cttgggtatgacatg

SEQ ID NO: 304196 - DNA, 15 bp, Homo sapiens
tcttgggtatgacat

SEQ ID NO: 304197 - DNA, 15 bp, Homo sapiens
ttcttgggtatgaca

SEQ ID NO: 304198 - DNA, 15 bp, Homo sapiens
tttcttgggtatgac

SEQ ID NO: 304199 - DNA, 15 bp, Homo sapiens
ctttcttgggtatga

SEQ ID NO: 304200 - DNA, 15 bp, Homo sapiens
gctttcttgggtatg

SEQ ID NO: 304201 - DNA, 15 bp, Homo sapiens
tgctttcttgggtat

SEQ ID NO: 304202 - DNA, 15 bp, Homo sapiens
gtgctttcttgggta

SEQ ID NO: 304203 - DNA, 15 bp, Homo sapiens
ggtgctttcttgggt

SEQ ID NO: 304204 - DNA, 15 bp, Homo sapiens
aggtgctttcttggg

SEQ ID NO: 304205 - DNA, 15 bp, Homo sapiens
taggtgctttcttgg

SEQ ID NO: 304206 - DNA, 15 bp, Homo sapiens
ataggtgctttcttg

SEQ ID NO: 304207 - DNA, 15 bp, Homo sapiens
aataggtgctttctt

SEQ ID NO: 304208 - DNA, 15 bp, Homo sapiens
aaataggtgctttct

SEQ ID NO: 304209 - DNA, 15 bp, Homo sapiens
taaataggtgctttc

SEQ ID NO: 304210 - DNA, 15 bp, Homo sapiens
ttaaataggtgcttt

SEQ ID NO: 304211 - DNA, 15 bp, Homo sapiens
tttaaataggtgctt

SEQ ID NO: 304212 - DNA, 15 bp, Homo sapiens
ctttaaataggtgct

SEQ ID NO: 304213 - DNA, 15 bp, Homo sapiens
tctttaaataggtgc

SEQ ID NO: 304214 - DNA, 15 bp, Homo sapiens
ttctttaaataggtg

SEQ ID NO: 304215 - DNA, 15 bp, Homo sapiens
tttctttaaataggt

SEQ ID NO: 304216 - DNA, 15 bp, Homo sapiens
ttttctttaaatagg

SEQ ID NO: 304217 - DNA, 15 bp, Homo sapiens
tttttctttaaatag

SEQ ID NO: 304218 - DNA, 15 bp, Homo sapiens
ttttttctttaaata

SEQ ID NO: 304219 - DNA, 15 bp, Homo sapiens
gttttttctttaaat

SEQ ID NO: 304220 - DNA, 15 bp, Homo sapiens
tgttttttctttaaa

SEQ ID NO: 304221 - DNA, 15 bp, Homo sapiens
ttgttttttctttaa

SEQ ID NO: 304222 - DNA, 15 bp, Homo sapiens
attgttttttcttta

SEQ ID NO: 304223 - DNA, 15 bp, Homo sapiens
aattgttttttcttt

SEQ ID NO: 304224 - DNA, 15 bp, Homo sapiens
gaattgttttttctt

SEQ ID NO: 304225 - DNA, 15 bp, Homo sapiens
ggaattgttttttct

SEQ ID NO: 304226 - DNA, 15 bp, Homo sapiens
gggaattgttttttc

SEQ ID NO: 304227 - DNA, 15 bp, Homo sapiens
agggaattgtttttt

SEQ ID NO: 304228 - DNA, 15 bp, Homo sapiens
cagggaattgttttt

SEQ ID NO: 304229 - DNA, 15 bp, Homo sapiens
tcagggaattgtttt

SEQ ID NO: 304230 - DNA, 15 bp, Homo sapiens
ctcagggaattgttt

SEQ ID NO: 304231 - DNA, 15 bp, Homo sapiens
gctcagggaattgtt

SEQ ID NO: 304232 - DNA, 15 bp, Homo sapiens
agctcagggaattgt

SEQ ID NO: 304233 - DNA, 15 bp, Homo sapiens
gagctcagggaattg

SEQ ID NO: 304234 - DNA, 15 bp, Homo sapiens
agagctcagggaatt

SEQ ID NO: 304235 - DNA, 15 bp, Homo sapiens
gagagctcagggaat

SEQ ID NO: 304236 - DNA, 15 bp, Homo sapiens
tgagagctcagggaa

SEQ ID NO: 304237 - DNA, 15 bp, Homo sapiens
ttgagagctcaggga

SEQ ID NO: 304238 - DNA, 15 bp, Homo sapiens
gttgagagctcaggg

SEQ ID NO: 304239 - DNA, 15 bp, Homo sapiens
agttgagagctcagg

SEQ ID NO: 304240 - DNA, 15 bp, Homo sapiens
gagttgagagctcag

SEQ ID NO: 304241 - DNA, 15 bp, Homo sapiens
ggagttgagagctca

SEQ ID NO: 304242 - DNA, 15 bp, Homo sapiens
tggagttgagagctc

SEQ ID NO: 304243 - DNA, 15 bp, Homo sapiens
ttggagttgagagct

SEQ ID NO: 304244 - DNA, 15 bp, Homo sapiens
cttggagttgagagc

SEQ ID NO: 304245 - DNA, 15 bp, Homo sapiens
acttggagttgagag

SEQ ID NO: 304246 - DNA, 15 bp, Homo sapiens
aacttggagttgaga

SEQ ID NO: 304247 - DNA, 15 bp, Homo sapiens
caacttggagttgag

SEQ ID NO: 304248 - DNA, 15 bp, Homo sapiens
acaacttggagttga

SEQ ID NO: 304249 - DNA, 15 bp, Homo sapiens
tacaacttggagttg

SEQ ID NO: 304250 - DNA, 15 bp, Homo sapiens
ctacaacttggagtt

SEQ ID NO: 304251 - DNA, 15 bp, Homo sapiens
tctacaacttggagt

SEQ ID NO: 304252 - DNA, 15 bp, Homo sapiens
atctacaacttggag

SEQ ID NO: 304253 - DNA, 15 bp, Homo sapiens
aatctacaacttgga

SEQ ID NO: 304254 - DNA, 15 bp, Homo sapiens
aaatctacaacttgg

SEQ ID NO: 304255 - DNA, 15 bp, Homo sapiens
caaatctacaacttg

SEQ ID NO: 304256 - DNA, 15 bp, Homo sapiens
ccaaatctacaactt

SEQ ID NO: 304257 - DNA, 15 bp, Homo sapiens
accaaatctacaact

SEQ ID NO: 304258 - DNA, 15 bp, Homo sapiens
caccaaatctacaac

SEQ ID NO: 304259 - DNA, 15 bp, Homo sapiens
acaccaaatctacaa

SEQ ID NO: 304260 - DNA, 15 bp, Homo sapiens
gacaccaaatctaca

SEQ ID NO: 304261 - DNA, 15 bp, Homo sapiens
aagacaccaaatcta

SEQ ID NO: 304262 - DNA, 15 bp, Homo sapiens
gaagacaccaaatct

SEQ ID NO: 304263 - DNA, 15 bp, Homo sapiens
ggaagacaccaaatc

SEQ ID NO: 304264 - DNA, 15 bp, Homo sapiens
aggaagacaccaaat

SEQ ID NO: 304265 - DNA, 15 bp, Homo sapiens
aaggaagacaccaaa

SEQ ID NO: 304266 - DNA, 15 bp, Homo sapiens
caaggaagacaccaa

SEQ ID NO: 304267 - DNA, 15 bp, Homo sapiens
acaaggaagacacca

SEQ ID NO: 304268 - DNA, 15 bp, Homo sapiens
aacaaggaagacacc

SEQ ID NO: 304269 - DNA, 15 bp, Homo sapiens
gaacaaggaagacac

SEQ ID NO: 304270 - DNA, 15 bp, Homo sapiens
agaacaaggaagaca

SEQ ID NO: 304271 - DNA, 15 bp, Homo sapiens
aagaacaaggaagac

SEQ ID NO: 304272 - DNA, 15 bp, Homo sapiens
taagaacaaggaaga

SEQ ID NO: 304273 - DNA, 15 bp, Homo sapiens
gtaagaacaaggaag

SEQ ID NO: 304274 - DNA, 15 bp, Homo sapiens
agtaagaacaaggaa

SEQ ID NO: 304275 - DNA, 15 bp, Homo sapiens
aagtaagaacaagga

SEQ ID NO: 304276 - DNA, 15 bp, Homo sapiens
aaagtaagaacaagg

SEQ ID NO: 304277 - DNA, 15 bp, Homo sapiens
taaagtaagaacaag

SEQ ID NO: 304278 - DNA, 15 bp, Homo sapiens
ttaaagtaagaacaa

SEQ ID NO: 304279 - DNA, 15 bp, Homo sapiens
tttaaagtaagaaca

SEQ ID NO: 304280 - DNA, 15 bp, Homo sapiens
ttttaaagtaagaac

SEQ ID NO: 304281 - DNA, 15 bp, Homo sapiens
tttttaaagtaagaa

SEQ ID NO: 304282 - DNA, 15 bp, Homo sapiens
ctttttaaagtaaga

SEQ ID NO: 304283 - DNA, 15 bp, Homo sapiens
actttttaaagtaag

SEQ ID NO: 304284 - DNA, 15 bp, Homo sapiens
gactttttaaagtaa

SEQ ID NO: 304285 - DNA, 15 bp, Homo sapiens
tgactttttaaagta

SEQ ID NO: 304286 - DNA, 15 bp, Homo sapiens
atgactttttaaagt

SEQ ID NO: 304287 - DNA, 15 bp, Homo sapiens
catgactttttaaag

SEQ ID NO: 304288 - DNA, 15 bp, Homo sapiens
acatgactttttaaa

SEQ ID NO: 304289 - DNA, 15 bp, Homo sapiens
cacatgactttttaa

SEQ ID NO: 304290 - DNA, 15 bp, Homo sapiens
acacatgacttttta

SEQ ID NO: 304291 - DNA, 15 bp, Homo sapiens
aacacatgacttttt

SEQ ID NO: 304292 - DNA, 15 bp, Homo sapiens
taacacatgactttt

SEQ ID NO: 304293 - DNA, 15 bp, Homo sapiens
ttaacacatgacttt

SEQ ID NO: 304294 - DNA, 15 bp, Homo sapiens
attaacacatgactt

SEQ ID NO: 304295 - DNA, 15 bp, Homo sapiens
aattaacacatgact

SEQ ID NO: 304296 - DNA, 15 bp, Homo sapiens
aaattaacacatgac

SEQ ID NO: 304297 - DNA, 15 bp, Homo sapiens
aaaattaacacatga

SEQ ID NO: 304298 - DNA, 15 bp, Homo sapiens
aaaaattaacacatg

SEQ ID NO: 304299 - DNA, 15 bp, Homo sapiens
aaaaaattaacacat

SEQ ID NO: 304300 - DNA, 15 bp, Homo sapiens
aaaaaaattaacaca

SEQ ID NO: 304301 - DNA, 15 bp, Homo sapiens
aaaaaaaattaacac

SEQ ID NO: 304302 - DNA, 15 bp, Homo sapiens
gaaaaaaaattaaca

SEQ ID NO: 304303 - DNA, 15 bp, Homo sapiens
agaaaaaaaattaac

SEQ ID NO: 304304 - DNA, 15 bp, Homo sapiens
gcagaaaaaaaatta

SEQ ID NO: 304305 - DNA, 15 bp, Homo sapiens
ggcagaaaaaaaatt

SEQ ID NO: 304306 - DNA, 15 bp, Homo sapiens
aggcagaaaaaaaat

SEQ ID NO: 304307 - DNA, 15 bp, Homo sapiens
caggcagaaaaaaaa

SEQ ID NO: 304308 - DNA, 15 bp, Homo sapiens
acaggcagaaaaaaa

SEQ ID NO: 304309 - DNA, 15 bp, Homo sapiens
tacaggcagaaaaaa

SEQ ID NO: 304310 - DNA, 15 bp, Homo sapiens
atacaggcagaaaaa

SEQ ID NO: 304311 - DNA, 15 bp, Homo sapiens
aatacaggcagaaaa

SEQ ID NO: 304312 - DNA, 15 bp, Homo sapiens
aaatacaggcagaaa

SEQ ID NO: 304313 - DNA, 15 bp, Homo sapiens
caaatacaggcagaa

SEQ ID NO: 304314 - DNA, 15 bp, Homo sapiens
acaaatacaggcaga

SEQ ID NO: 304315 - DNA, 15 bp, Homo sapiens
tacaaatacaggcag

SEQ ID NO: 304316 - DNA, 15 bp, Homo sapiens
atacaaatacaggca

SEQ ID NO: 304317 - DNA, 15 bp, Homo sapiens
catacaaatacaggc

SEQ ID NO: 304318 - DNA, 15 bp, Homo sapiens
gcatacaaatacagg

SEQ ID NO: 304319 - DNA, 15 bp, Homo sapiens
tgcatacaaatacag

SEQ ID NO: 304320 - DNA, 15 bp, Homo sapiens
ttgcatacaaataca

SEQ ID NO: 304321 - DNA, 15 bp, Homo sapiens
tttgcatacaaatac

SEQ ID NO: 304322 - DNA, 15 bp, Homo sapiens
ttttgcatacaaata

SEQ ID NO: 304323 - DNA, 15 bp, Homo sapiens
attttgcatacaaat

SEQ ID NO: 304324 - DNA, 15 bp, Homo sapiens
cattttgcatacaaa

SEQ ID NO: 304325 - DNA, 15 bp, Homo sapiens
acattttgcatacaa

SEQ ID NO: 304326 - DNA, 15 bp, Homo sapiens
gacattttgcataca

SEQ ID NO: 304327 - DNA, 15 bp, Homo sapiens
ggacattttgcatac

SEQ ID NO: 304328 - DNA, 15 bp, Homo sapiens
aggacattttgcata

SEQ ID NO: 304329 - DNA, 15 bp, Homo sapiens
gaggacattttgcat

SEQ ID NO: 304330 - DNA, 15 bp, Homo sapiens
agaggacattttgca

SEQ ID NO: 304331 - DNA, 15 bp, Homo sapiens
tagaggacattttgc

SEQ ID NO: 304332 - DNA, 15 bp, Homo sapiens
atagaggacattttg

SEQ ID NO: 304333 - DNA, 15 bp, Homo sapiens
gatagaggacatttt

SEQ ID NO: 304334 - DNA, 15 bp, Homo sapiens
agatagaggacattt

SEQ ID NO: 304335 - DNA, 15 bp, Homo sapiens
cagatagaggacatt

SEQ ID NO: 304336 - DNA, 15 bp, Homo sapiens
gcagatagaggacat

SEQ ID NO: 304337 - DNA, 15 bp, Homo sapiens
agcagatagaggaca

SEQ ID NO: 304338 - DNA, 15 bp, Homo sapiens
tagcagatagaggac

SEQ ID NO: 304339 - DNA, 15 bp, Homo sapiens
atagcagatagagga

SEQ ID NO: 304340 - DNA, 15 bp, Homo sapiens
aatagcagatagagg

SEQ ID NO: 304341 - DNA, 15 bp, Homo sapiens
taatagcagatagag

SEQ ID NO: 304342 - DNA, 15 bp, Homo sapiens
ttaatagcagataga

SEQ ID NO: 304343 - DNA, 15 bp, Homo sapiens
tttaatagcagatag

SEQ ID NO: 304344 - DNA, 15 bp, Homo sapiens
ctttaatagcagata

SEQ ID NO: 304345 - DNA, 15 bp, Homo sapiens
tctttaatagcagat

SEQ ID NO: 304346 - DNA, 15 bp, Homo sapiens
ttctttaatagcaga

SEQ ID NO: 304347 - DNA, 15 bp, Homo sapiens
tttctttaatagcag

SEQ ID NO: 304348 - DNA, 15 bp, Homo sapiens
ttttctttaatagca

SEQ ID NO: 304349 - DNA, 15 bp, Homo sapiens
cttttctttaatagc

SEQ ID NO: 304350 - DNA, 15 bp, Homo sapiens
gcttttctttaatag

SEQ ID NO: 304351 - DNA, 15 bp, Homo sapiens
agcttttctttaata

SEQ ID NO: 304352 - DNA, 15 bp, Homo sapiens
tagcttttctttaat

SEQ ID NO: 304353 - DNA, 15 bp, Homo sapiens
gtagcttttctttaa

SEQ ID NO: 304354 - DNA, 15 bp, Homo sapiens
cgtagcttttcttta

SEQ ID NO: 304355 - DNA, 15 bp, Homo sapiens
acgtagcttttcttt

SEQ ID NO: 304356 - DNA, 15 bp, Homo sapiens
tacgtagcttttctt

SEQ ID NO: 304357 - DNA, 15 bp, Homo sapiens
ttacgtagcttttct

SEQ ID NO: 304358 - DNA, 15 bp, Homo sapiens
tttacgtagcttttc

SEQ ID NO: 304359 - DNA, 15 bp, Homo sapiens
ttttacgtagctttt

SEQ ID NO: 304360 - DNA, 15 bp, Homo sapiens
gttttacgtagcttt

SEQ ID NO: 304361 - DNA, 15 bp, Homo sapiens
tgttttacgtagctt

SEQ ID NO: 304362 - DNA, 15 bp, Homo sapiens
gtgttttacgtagct

SEQ ID NO: 304363 - DNA, 15 bp, Homo sapiens
agtgttttacgtagc

SEQ ID NO: 304364 - DNA, 15 bp, Homo sapiens
tagtgttttacgtag

SEQ ID NO: 304365 - DNA, 15 bp, Homo sapiens
gtagtgttttacgta

SEQ ID NO: 304366 - DNA, 15 bp, Homo sapiens
tgtagtgttttacgt

SEQ ID NO: 304367 - DNA, 15 bp, Homo sapiens
atgtagtgttttacg

SEQ ID NO: 304368 - DNA, 15 bp, Homo sapiens
aatgtagtgttttac

SEQ ID NO: 304369 - DNA, 15 bp, Homo sapiens
caatgtagtgtttta

SEQ ID NO: 304370 - DNA, 15 bp, Homo sapiens
acaatgtagtgtttt

SEQ ID NO: 304371 - DNA, 15 bp, Homo sapiens
tacaatgtagtgttt

SEQ ID NO: 304372 - DNA, 15 bp, Homo sapiens
ttacaatgtagtgtt

SEQ ID NO: 304373 - DNA, 15 bp, Homo sapiens
gttacaatgtagtgt

SEQ ID NO: 304374 - DNA, 15 bp, Homo sapiens
ggttacaatgtagtg

SEQ ID NO: 304375 - DNA, 15 bp, Homo sapiens
aggttacaatgtagt

SEQ ID NO: 304376 - DNA, 15 bp, Homo sapiens
aaggttacaatgtag

SEQ ID NO: 304377 - DNA, 15 bp, Homo sapiens
gaaggttacaatgta

SEQ ID NO: 304378 - DNA, 15 bp, Homo sapiens
agaaggttacaatgt

SEQ ID NO: 304379 - DNA, 15 bp, Homo sapiens
tagaaggttacaatg

SEQ ID NO: 304380 - DNA, 15 bp, Homo sapiens
ttagaaggttacaat

SEQ ID NO: 304381 - DNA, 15 bp, Homo sapiens
cttagaaggttacaa

SEQ ID NO: 304382 - DNA, 15 bp, Homo sapiens
acttagaaggttaca

SEQ ID NO: 304383 - DNA, 15 bp, Homo sapiens
tacttagaaggttac

SEQ ID NO: 304384 - DNA, 15 bp, Homo sapiens
ttacttagaaggtta

SEQ ID NO: 304385 - DNA, 15 bp, Homo sapiens
attacttagaaggtt

SEQ ID NO: 304386 - DNA, 15 bp, Homo sapiens
tattacttagaaggt

SEQ ID NO: 304387 - DNA, 15 bp, Homo sapiens
ttattacttagaagg

SEQ ID NO: 304388 - DNA, 15 bp, Homo sapiens
attattacttagaag

SEQ ID NO: 304389 - DNA, 15 bp, Homo sapiens
tattattacttagaa

SEQ ID NO: 304390 - DNA, 15 bp, Homo sapiens
ttattattacttaga

SEQ ID NO: 304391 - DNA, 15 bp, Homo sapiens
tttattattacttag

SEQ ID NO: 304392 - DNA, 15 bp, Homo sapiens
atttattattactta

SEQ ID NO: 304393 - DNA, 15 bp, Homo sapiens
tatttattattactt

SEQ ID NO: 304394 - DNA, 15 bp, Homo sapiens
ttatttattattact

SEQ ID NO: 304395 - DNA, 15 bp, Homo sapiens
tttatttattattac

SEQ ID NO: 304396 - DNA, 15 bp, Homo sapiens
tttttatttattatt

SEQ ID NO: 304397 - DNA, 15 bp, Homo sapiens
ctttttatttattat

SEQ ID NO: 304398 - DNA, 15 bp, Homo sapiens
tctttttatttatta

SEQ ID NO: 304399 - DNA, 15 bp, Homo sapiens
ttctttttatttatt

SEQ ID NO: 304400 - DNA, 15 bp, Homo sapiens
tttctttttatttat

SEQ ID NO: 304401 - DNA, 15 bp, Homo sapiens
atttctttttattta

SEQ ID NO: 304402 - DNA, 15 bp, Homo sapiens
tatttctttttattt

SEQ ID NO: 304403 - DNA, 15 bp, Homo sapiens
atatttctttttatt

SEQ ID NO: 304404 - DNA, 15 bp, Homo sapiens
tatatttctttttat

SEQ ID NO: 304405 - DNA, 15 bp, Homo sapiens
atatatttcttttta

SEQ ID NO: 304406 - DNA, 15 bp, Homo sapiens
aatatatttcttttt

SEQ ID NO: 304407 - DNA, 15 bp, Homo sapiens
caatatatttctttt

SEQ ID NO: 304408 - DNA, 15 bp, Homo sapiens
gcaatatatttcttt

SEQ ID NO: 304409 - DNA, 15 bp, Homo sapiens
tgcaatatatttctt

SEQ ID NO: 304410 - DNA, 15 bp, Homo sapiens
ctgcaatatatttct

SEQ ID NO: 304411 - DNA, 15 bp, Homo sapiens
actgcaatatatttc

SEQ ID NO: 304412 - DNA, 15 bp, Homo sapiens
tactgcaatatattt

SEQ ID NO: 304413 - DNA, 15 bp, Homo sapiens
ttactgcaatatatt

SEQ ID NO: 304414 - DNA, 15 bp, Homo sapiens
gttactgcaatatat

SEQ ID NO: 304415 - DNA, 15 bp, Homo sapiens
tgttactgcaatata

SEQ ID NO: 304416 - DNA, 15 bp, Homo sapiens
ttgttactgcaatat

SEQ ID NO: 304417 - DNA, 15 bp, Homo sapiens
attgttactgcaata

SEQ ID NO: 304418 - DNA, 15 bp, Homo sapiens
cattgttactgcaat

SEQ ID NO: 304419 - DNA, 15 bp, Homo sapiens
ccattgttactgcaa

SEQ ID NO: 304420 - DNA, 15 bp, Homo sapiens
cccattgttactgca

SEQ ID NO: 304421 - DNA, 15 bp, Homo sapiens
tcccattgttactgc

SEQ ID NO: 304422 - DNA, 15 bp, Homo sapiens
ttcccattgttactg

SEQ ID NO: 304423 - DNA, 15 bp, Homo sapiens
cttcccattgttact

SEQ ID NO: 304424 - DNA, 15 bp, Homo sapiens
acttcccattgttac

SEQ ID NO: 304425 - DNA, 15 bp, Homo sapiens
tacttcccattgtta

SEQ ID NO: 304426 - DNA, 15 bp, Homo sapiens
ttacttcccattgtt

SEQ ID NO: 304427 - DNA, 15 bp, Homo sapiens
cttacttcccattgt

SEQ ID NO: 304428 - DNA, 15 bp, Homo sapiens
acttacttcccattg

SEQ ID NO: 304429 - DNA, 15 bp, Homo sapiens
tacttacttcccatt

SEQ ID NO: 304430 - DNA, 15 bp, Homo sapiens
atacttacttcccat

SEQ ID NO: 304431 - DNA, 15 bp, Homo sapiens
catacttacttccca

SEQ ID NO: 304432 - DNA, 15 bp, Homo sapiens
acatacttacttccc

SEQ ID NO: 304433 - DNA, 15 bp, Homo sapiens
tacatacttacttcc

SEQ ID NO: 304434 - DNA, 15 bp, Homo sapiens
ctacatacttacttc

SEQ ID NO: 304435 - DNA, 15 bp, Homo sapiens
actacatacttactt

SEQ ID NO: 304436 - DNA, 15 bp, Homo sapiens
aactacatacttact

SEQ ID NO: 304437 - DNA, 15 bp, Homo sapiens
gaactacatacttac

SEQ ID NO: 304438 - DNA, 15 bp, Homo sapiens
agaactacatactta

SEQ ID NO: 304439 - DNA, 15 bp, Homo sapiens
aagaactacatactt

SEQ ID NO: 304440 - DNA, 15 bp, Homo sapiens
aaagaactacatact

SEQ ID NO: 304441 - DNA, 15 bp, Homo sapiens
aaaagaactacatac

SEQ ID NO: 304442 - DNA, 15 bp, Homo sapiens
caaaagaactacata

SEQ ID NO: 304443 - DNA, 15 bp, Homo sapiens
tcaaaagaactacat

SEQ ID NO: 304444 - DNA, 15 bp, Homo sapiens
ttcaaaagaactaca

SEQ ID NO: 304445 - DNA, 15 bp, Homo sapiens
tttcaaaagaactac

SEQ ID NO: 304446 - DNA, 15 bp, Homo sapiens
atttcaaaagaacta

SEQ ID NO: 304447 - DNA, 15 bp, Homo sapiens
tatttcaaaagaact

SEQ ID NO: 304448 - DNA, 15 bp, Homo sapiens
atatttcaaaagaac

SEQ ID NO: 304449 - DNA, 15 bp, Homo sapiens
catatttcaaaagaa

SEQ ID NO: 304450 - DNA, 15 bp, Homo sapiens
acatatttcaaaaga

SEQ ID NO: 304451 - DNA, 15 bp, Homo sapiens
cacatatttcaaaag

SEQ ID NO: 304452 - DNA, 15 bp, Homo sapiens
ccacatatttcaaaa

SEQ ID NO: 304453 - DNA, 15 bp, Homo sapiens
accacatatttcaaa

SEQ ID NO: 304454 - DNA, 15 bp, Homo sapiens
taccacatatttcaa

SEQ ID NO: 304455 - DNA, 15 bp, Homo sapiens
ttaccacatatttca

SEQ ID NO: 304456 - DNA, 15 bp, Homo sapiens
tttaccacatatttc

SEQ ID NO: 304457 - DNA, 15 bp, Homo sapiens
ctttaccacatattt

SEQ ID NO: 304458 - DNA, 15 bp, Homo sapiens
tctttaccacatatt

SEQ ID NO: 304459 - DNA, 15 bp, Homo sapiens
ttctttaccacatat

SEQ ID NO: 304460 - DNA, 15 bp, Homo sapiens
gttctttaccacata

SEQ ID NO: 304461 - DNA, 15 bp, Homo sapiens
agttctttaccacat

SEQ ID NO: 304462 - DNA, 15 bp, Homo sapiens
tagttctttaccaca

SEQ ID NO: 304463 - DNA, 15 bp, Homo sapiens
ttagttctttaccac

SEQ ID NO: 304464 - DNA, 15 bp, Homo sapiens
attagttctttacca

SEQ ID NO: 304465 - DNA, 15 bp, Homo sapiens
gattagttctttacc

SEQ ID NO: 304466 - DNA, 15 bp, Homo sapiens
tgattagttctttac

SEQ ID NO: 304467 - DNA, 15 bp, Homo sapiens
gtgattagttcttta

SEQ ID NO: 304468 - DNA, 15 bp, Homo sapiens
tgtgattagttcttt

SEQ ID NO: 304469 - DNA, 15 bp, Homo sapiens
ctgtgattagttctt

SEQ ID NO: 304470 - DNA, 15 bp, Homo sapiens
tctgtgattagttct

SEQ ID NO: 304471 - DNA, 15 bp, Homo sapiens
gtctgtgattagttc

SEQ ID NO: 304472 - DNA, 15 bp, Homo sapiens
agtctgtgattagtt

SEQ ID NO: 304473 - DNA, 15 bp, Homo sapiens
tagtctgtgattagt

SEQ ID NO: 304474 - DNA, 15 bp, Homo sapiens
atagtctgtgattag

SEQ ID NO: 304475 - DNA, 15 bp, Homo sapiens
gatagtctgtgatta

SEQ ID NO: 304476 - DNA, 15 bp, Homo sapiens
tgatagtctgtgatt

SEQ ID NO: 304477 - DNA, 15 bp, Homo sapiens
atgatagtctgtgat

SEQ ID NO: 304478 - DNA, 15 bp, Homo sapiens
gatgatagtctgtga

SEQ ID NO: 304479 - DNA, 15 bp, Homo sapiens
agatgatagtctgtg

SEQ ID NO: 304480 - DNA, 15 bp, Homo sapiens
tagatgatagtctgt

SEQ ID NO: 304481 - DNA, 15 bp, Homo sapiens
ttagatgatagtctg

SEQ ID NO: 304482 - DNA, 15 bp, Homo sapiens
attagatgatagtct

SEQ ID NO: 304483 - DNA, 15 bp, Homo sapiens
gattagatgatagtc

SEQ ID NO: 304484 - DNA, 15 bp, Homo sapiens
agattagatgatagt

SEQ ID NO: 304485 - DNA, 15 bp, Homo sapiens
cagattagatgatag

SEQ ID NO: 304486 - DNA, 15 bp, Homo sapiens
ccagattagatgata

SEQ ID NO: 304487 - DNA, 15 bp, Homo sapiens
accagattagatgat

SEQ ID NO: 304488 - DNA, 15 bp, Homo sapiens
aaccagattagatga

SEQ ID NO: 304489 - DNA, 15 bp, Homo sapiens
taaccagattagatg

SEQ ID NO: 304490 - DNA, 15 bp, Homo sapiens
gtaaccagattagat

SEQ ID NO: 304491 - DNA, 15 bp, Homo sapiens
tgtaaccagattaga

SEQ ID NO: 304492 - DNA, 15 bp, Homo sapiens
atgtaaccagattag

SEQ ID NO: 304493 - DNA, 15 bp, Homo sapiens
tatgtaaccagatta

SEQ ID NO: 304494 - DNA, 15 bp, Homo sapiens
atatgtaaccagatt

SEQ ID NO: 304495 - DNA, 15 bp, Homo sapiens
aatatgtaaccagat

SEQ ID NO: 304496 - DNA, 15 bp, Homo sapiens
caatatgtaaccaga

SEQ ID NO: 304497 - DNA, 15 bp, Homo sapiens
acaatatgtaaccag

SEQ ID NO: 304498 - DNA, 15 bp, Homo sapiens
tacaatatgtaacca

SEQ ID NO: 304499 - DNA, 15 bp, Homo sapiens
atacaatatgtaacc

SEQ ID NO: 304500 - DNA, 15 bp, Homo sapiens
aatacaatatgtaac

SEQ ID NO: 304501 - DNA, 15 bp, Homo sapiens
aaatacaatatgtaa

SEQ ID NO: 304502 - DNA, 15 bp, Homo sapiens
aaaatacaatatgta

SEQ ID NO: 304503 - DNA, 15 bp, Homo sapiens
aaaaatacaatatgt

SEQ ID NO: 304504 - DNA, 15 bp, Homo sapiens
gaaaaatacaatatg

SEQ ID NO: 304505 - DNA, 15 bp, Homo sapiens
tgaaaaatacaatat

SEQ ID NO: 304506 - DNA, 15 bp, Homo sapiens
atgaaaaatacaata

SEQ ID NO: 304507 - DNA, 15 bp, Homo sapiens
gatgaaaaatacaat

SEQ ID NO: 304508 - DNA, 15 bp, Homo sapiens
ggatgaaaaatacaa

SEQ ID NO: 304509 - DNA, 15 bp, Homo sapiens
aggatgaaaaataca

SEQ ID NO: 304510 - DNA, 15 bp, Homo sapiens
caggatgaaaaatac

SEQ ID NO: 304511 - DNA, 15 bp, Homo sapiens
tcaggatgaaaaata

SEQ ID NO: 304512 - DNA, 15 bp, Homo sapiens
ttcaggatgaaaaat

SEQ ID NO: 304513 - DNA, 15 bp, Homo sapiens
attcaggatgaaaaa

SEQ ID NO: 304514 - DNA, 15 bp, Homo sapiens
tattcaggatgaaaa

SEQ ID NO: 304515 - DNA, 15 bp, Homo sapiens
ttattcaggatgaaa

SEQ ID NO: 304516 - DNA, 15 bp, Homo sapiens
tttattcaggatgaa

SEQ ID NO: 304517 - DNA, 15 bp, Homo sapiens
ttttattcaggatga

SEQ ID NO: 304518 - DNA, 15 bp, Homo sapiens
cttttattcaggatg

SEQ ID NO: 304519 - DNA, 15 bp, Homo sapiens
acttttattcaggat

SEQ ID NO: 304520 - DNA, 15 bp, Homo sapiens
tacttttattcagga

SEQ ID NO: 304521 - DNA, 15 bp, Homo sapiens
ttacttttattcagg

SEQ ID NO: 304522 - DNA, 15 bp, Homo sapiens
attacttttattcag

SEQ ID NO: 304523 - DNA, 15 bp, Homo sapiens
aattacttttattca

SEQ ID NO: 304524 - DNA, 15 bp, Homo sapiens
aaattacttttattc

SEQ ID NO: 304525 - DNA, 15 bp, Homo sapiens
aaaattacttttatt

SEQ ID NO: 304526 - DNA, 15 bp, Homo sapiens
taaaattacttttat

SEQ ID NO: 304527 - DNA, 15 bp, Homo sapiens
ttaaaattactttta

SEQ ID NO: 304528 - DNA, 15 bp, Homo sapiens
gttaaaattactttt

SEQ ID NO: 304529 - DNA, 15 bp, Homo sapiens
tgttaaaattacttt

SEQ ID NO: 304530 - DNA, 15 bp, Homo sapiens
gtgttaaaattactt

SEQ ID NO: 304531 - DNA, 15 bp, Homo sapiens
tgtgttaaaattact

SEQ ID NO: 304532 - DNA, 15 bp, Homo sapiens
ttgtgttaaaattac

SEQ ID NO: 304533 - DNA, 15 bp, Homo sapiens
cttgtgttaaaatta

SEQ ID NO: 304534 - DNA, 15 bp, Homo sapiens
tcttgtgttaaaatt

SEQ ID NO: 304535 - DNA, 15 bp, Homo sapiens
atcttgtgttaaaat

SEQ ID NO: 304536 - DNA, 15 bp, Homo sapiens
catcttgtgttaaaa

SEQ ID NO: 304537 - DNA, 15 bp, Homo sapiens
tcatcttgtgttaaa

SEQ ID NO: 304538 - DNA, 15 bp, Homo sapiens
gtcatcttgtgttaa

SEQ ID NO: 304539 - DNA, 15 bp, Homo sapiens
agtcatcttgtgtta

SEQ ID NO: 304540 - DNA, 15 bp, Homo sapiens
aagtcatcttgtgtt

SEQ ID NO: 304541 - DNA, 15 bp, Homo sapiens
aaagtcatcttgtgt

SEQ ID NO: 304542 - DNA, 15 bp, Homo sapiens
caaagtcatcttgtg

SEQ ID NO: 304543 - DNA, 15 bp, Homo sapiens
tcaaagtcatcttgt

SEQ ID NO: 304544 - DNA, 15 bp, Homo sapiens
atcaaagtcatcttg

SEQ ID NO: 304545 - DNA, 15 bp, Homo sapiens
tatcaaagtcatctt

SEQ ID NO: 304546 - DNA, 15 bp, Homo sapiens
atatcaaagtcatct

SEQ ID NO: 304547 - DNA, 15 bp, Homo sapiens
aatatcaaagtcatc

SEQ ID NO: 304548 - DNA, 15 bp, Homo sapiens
gaatatcaaagtcat

SEQ ID NO: 304549 - DNA, 15 bp, Homo sapiens
agaatatcaaagtca

SEQ ID NO: 304550 - DNA, 15 bp, Homo sapiens
aagaatatcaaagtc

SEQ ID NO: 304551 - DNA, 15 bp, Homo sapiens
gaagaatatcaaagt

SEQ ID NO: 304552 - DNA, 15 bp, Homo sapiens
tgaagaatatcaaag

SEQ ID NO: 304553 - DNA, 15 bp, Homo sapiens
ctgaagaatatcaaa

SEQ ID NO: 304554 - DNA, 15 bp, Homo sapiens
gctgaagaatatcaa

SEQ ID NO: 304555 - DNA, 15 bp, Homo sapiens
agctgaagaatatca

SEQ ID NO: 304556 - DNA, 15 bp, Homo sapiens
cagctgaagaatatc

SEQ ID NO: 304557 - DNA, 15 bp, Homo sapiens
ccagctgaagaatat

SEQ ID NO: 304558 - DNA, 15 bp, Homo sapiens
tccagctgaagaata

SEQ ID NO: 304559 - DNA, 15 bp, Homo sapiens
atccagctgaagaat

SEQ ID NO: 304560 - DNA, 15 bp, Homo sapiens
aatccagctgaagaa

SEQ ID NO: 304561 - DNA, 15 bp, Homo sapiens
gaatccagctgaaga

SEQ ID NO: 304562 - DNA, 15 bp, Homo sapiens
tgaatccagctgaag

SEQ ID NO: 304563 - DNA, 15 bp, Homo sapiens
gtgaatccagctgaa

SEQ ID NO: 304564 - DNA, 15 bp, Homo sapiens
agtgaatccagctga

SEQ ID NO: 304565 - DNA, 15 bp, Homo sapiens
cagtgaatccagctg

SEQ ID NO: 304566 - DNA, 15 bp, Homo sapiens
tcagtgaatccagct

SEQ ID NO: 304567 - DNA, 15 bp, Homo sapiens
atcagtgaatccagc

SEQ ID NO: 304568 - DNA, 15 bp, Homo sapiens
tatcagtgaatccag

SEQ ID NO: 304569 - DNA, 15 bp, Homo sapiens
ctatcagtgaatcca

SEQ ID NO: 304570 - DNA, 15 bp, Homo sapiens
tctatcagtgaatcc

SEQ ID NO: 304571 - DNA, 15 bp, Homo sapiens
ttctatcagtgaatc

SEQ ID NO: 304572 - DNA, 15 bp, Homo sapiens
attctatcagtgaat

SEQ ID NO: 304573 - DNA, 15 bp, Homo sapiens
cattctatcagtgaa

SEQ ID NO: 304574 - DNA, 15 bp, Homo sapiens
acattctatcagtga

SEQ ID NO: 304575 - DNA, 15 bp, Homo sapiens
cacattctatcagtg

SEQ ID NO: 304576 - DNA, 15 bp, Homo sapiens
tcacattctatcagt

SEQ ID NO: 304577 - DNA, 15 bp, Homo sapiens
ctcacattctatcag

SEQ ID NO: 304578 - DNA, 15 bp, Homo sapiens
actcacattctatca

SEQ ID NO: 304579 - DNA, 15 bp, Homo sapiens
aactcacattctatc

SEQ ID NO: 304580 - DNA, 15 bp, Homo sapiens
aaactcacattctat

SEQ ID NO: 304581 - DNA, 15 bp, Homo sapiens
aaaactcacattcta

SEQ ID NO: 304582 - DNA, 15 bp, Homo sapiens
caaaactcacattct

SEQ ID NO: 304583 - DNA, 15 bp, Homo sapiens
tcaaaactcacattc

SEQ ID NO: 304584 - DNA, 15 bp, Homo sapiens
ttcaaaactcacatt

SEQ ID NO: 304585 - DNA, 15 bp, Homo sapiens
attcaaaactcacat

SEQ ID NO: 304586 - DNA, 15 bp, Homo sapiens
cattcaaaactcaca

SEQ ID NO: 304587 - DNA, 15 bp, Homo sapiens
gcattcaaaactcac

SEQ ID NO: 304588 - DNA, 15 bp, Homo sapiens
tgcattcaaaactca

SEQ ID NO: 304589 - DNA, 15 bp, Homo sapiens
gtgcattcaaaactc

SEQ ID NO: 304590 - DNA, 15 bp, Homo sapiens
tgtgcattcaaaact

SEQ ID NO: 304591 - DNA, 15 bp, Homo sapiens
atgtgcattcaaaac

SEQ ID NO: 304592 - DNA, 15 bp, Homo sapiens
aatgtgcattcaaaa

SEQ ID NO: 304593 - DNA, 15 bp, Homo sapiens
aaatgtgcattcaaa

SEQ ID NO: 304594 - DNA, 15 bp, Homo sapiens
taaatgtgcattcaa

SEQ ID NO: 304595 - DNA, 15 bp, Homo sapiens
ataaatgtgcattca

SEQ ID NO: 304596 - DNA, 15 bp, Homo sapiens
cataaatgtgcattc

SEQ ID NO: 304597 - DNA, 15 bp, Homo sapiens
tcataaatgtgcatt

SEQ ID NO: 304598 - DNA, 15 bp, Homo sapiens
ttcataaatgtgcat

SEQ ID NO: 304599 - DNA, 15 bp, Homo sapiens
tttcataaatgtgca

SEQ ID NO: 304600 - DNA, 15 bp, Homo sapiens
ttttcataaatgtgc

SEQ ID NO: 304601 - DNA, 15 bp, Homo sapiens
gttttcataaatgtg

SEQ ID NO: 304602 - DNA, 15 bp, Homo sapiens
tgttttcataaatgt

SEQ ID NO: 304603 - DNA, 15 bp, Homo sapiens
ttgttttcataaatg

SEQ ID NO: 304604 - DNA, 15 bp, Homo sapiens
cttgttttcataaat

SEQ ID NO: 304605 - DNA, 15 bp, Homo sapiens
tcttgttttcataaa

SEQ ID NO: 304606 - DNA, 15 bp, Homo sapiens
atcttgttttcataa

SEQ ID NO: 304607 - DNA, 15 bp, Homo sapiens
tatcttgttttcata

SEQ ID NO: 304608 - DNA, 15 bp, Homo sapiens
atatcttgttttcat

SEQ ID NO: 304609 - DNA, 15 bp, Homo sapiens
tatatcttgttttca

SEQ ID NO: 304610 - DNA, 15 bp, Homo sapiens
ctatatcttgttttc

SEQ ID NO: 304611 - DNA, 15 bp, Homo sapiens
tctatatcttgtttt

SEQ ID NO: 304612 - DNA, 15 bp, Homo sapiens
ctctatatcttgttt

SEQ ID NO: 304613 - DNA, 15 bp, Homo sapiens
tctctatatcttgtt

SEQ ID NO: 304614 - DNA, 15 bp, Homo sapiens
atctctatatcttgt

SEQ ID NO: 304615 - DNA, 15 bp, Homo sapiens
tatctctatatcttg

SEQ ID NO: 304616 - DNA, 15 bp, Homo sapiens
ctatctctatatctt

SEQ ID NO: 304617 - DNA, 15 bp, Homo sapiens
gctatctctatatct

SEQ ID NO: 304618 - DNA, 15 bp, Homo sapiens
ggctatctctatatc

SEQ ID NO: 304619 - DNA, 15 bp, Homo sapiens
aggctatctctatat

SEQ ID NO: 304620 - DNA, 15 bp, Homo sapiens
caggctatctctata

SEQ ID NO: 304621 - DNA, 15 bp, Homo sapiens
acaggctatctctat

SEQ ID NO: 304622 - DNA, 15 bp, Homo sapiens
cacaggctatctcta

SEQ ID NO: 304623 - DNA, 15 bp, Homo sapiens
acacaggctatctct

SEQ ID NO: 304624 - DNA, 15 bp, Homo sapiens
gacacaggctatctc

SEQ ID NO: 304625 - DNA, 15 bp, Homo sapiens
ggacacaggctatct

SEQ ID NO: 304626 - DNA, 15 bp, Homo sapiens
aggacacaggctatc

SEQ ID NO: 304627 - DNA, 15 bp, Homo sapiens
caggacacaggctat

SEQ ID NO: 304628 - DNA, 15 bp, Homo sapiens
tcaggacacaggcta

SEQ ID NO: 304629 - DNA, 15 bp, Homo sapiens
atcaggacacaggct

SEQ ID NO: 304630 - DNA, 15 bp, Homo sapiens
tatcaggacacaggc

SEQ ID NO: 304631 - DNA, 15 bp, Homo sapiens
gtatcaggacacagg

SEQ ID NO: 304632 - DNA, 15 bp, Homo sapiens
tgtatcaggacacag

SEQ ID NO: 304633 - DNA, 15 bp, Homo sapiens
atgtatcaggacaca

SEQ ID NO: 304634 - DNA, 15 bp, Homo sapiens
gatgtatcaggacac

SEQ ID NO: 304635 - DNA, 15 bp, Homo sapiens
agatgtatcaggaca

SEQ ID NO: 304636 - DNA, 15 bp, Homo sapiens
tagatgtatcaggac

SEQ ID NO: 304637 - DNA, 15 bp, Homo sapiens
gtagatgtatcagga

SEQ ID NO: 304638 - DNA, 15 bp, Homo sapiens
tgtagatgtatcagg

SEQ ID NO: 304639 - DNA, 15 bp, Homo sapiens
atgtagatgtatcag

SEQ ID NO: 304640 - DNA, 15 bp, Homo sapiens
aatgtagatgtatca

SEQ ID NO: 304641 - DNA, 15 bp, Homo sapiens
aaatgtagatgtatc

SEQ ID NO: 304642 - DNA, 15 bp, Homo sapiens
aaaatgtagatgtat

SEQ ID NO: 304643 - DNA, 15 bp, Homo sapiens
aaaaatgtagatgta

SEQ ID NO: 304644 - DNA, 15 bp, Homo sapiens
aaaaaatgtagatgt

SEQ ID NO: 304645 - DNA, 15 bp, Homo sapiens
gaaaaaatgtagatg

SEQ ID NO: 304646 - DNA, 15 bp, Homo sapiens
ggaaaaaatgtagat

SEQ ID NO: 304647 - DNA, 15 bp, Homo sapiens
aggaaaaaatgtaga

SEQ ID NO: 304648 - DNA, 15 bp, Homo sapiens
caggaaaaaatgtag

SEQ ID NO: 304649 - DNA, 15 bp, Homo sapiens
gcaggaaaaaatgta

SEQ ID NO: 304650 - DNA, 15 bp, Homo sapiens
tgcaggaaaaaatgt

SEQ ID NO: 304651 - DNA, 15 bp, Homo sapiens
ctgcaggaaaaaatg

SEQ ID NO: 304652 - DNA, 15 bp, Homo sapiens
actgcaggaaaaaat

SEQ ID NO: 304653 - DNA, 15 bp, Homo sapiens
aactgcaggaaaaaa

SEQ ID NO: 304654 - DNA, 15 bp, Homo sapiens
aaactgcaggaaaaa

SEQ ID NO: 304655 - DNA, 15 bp, Homo sapiens
gaaactgcaggaaaa

SEQ ID NO: 304656 - DNA, 15 bp, Homo sapiens
agaaactgcaggaaa

SEQ ID NO: 304657 - DNA, 15 bp, Homo sapiens
gagaaactgcaggaa

SEQ ID NO: 304658 - DNA, 15 bp, Homo sapiens
agagaaactgcagga

SEQ ID NO: 304659 - DNA, 15 bp, Homo sapiens
gagagaaactgcagg

SEQ ID NO: 304660 - DNA, 15 bp, Homo sapiens
tgagagaaactgcag

SEQ ID NO: 304661 - DNA, 15 bp, Homo sapiens
atgagagaaactgca

SEQ ID NO: 304662 - DNA, 15 bp, Homo sapiens
tatgagagaaactgc

SEQ ID NO: 304663 - DNA, 15 bp, Homo sapiens
gtatgagagaaactg

SEQ ID NO: 304664 - DNA, 15 bp, Homo sapiens
tgtatgagagaaact

SEQ ID NO: 304665 - DNA, 15 bp, Homo sapiens
gtgtatgagagaaac

SEQ ID NO: 304666 - DNA, 15 bp, Homo sapiens
tgtgtatgagagaaa

SEQ ID NO: 304667 - DNA, 15 bp, Homo sapiens
gtgtgtatgagagaa

SEQ ID NO: 304668 - DNA, 15 bp, Homo sapiens
agtgtgtatgagaga

SEQ ID NO: 304669 - DNA, 15 bp, Homo sapiens
tagtgtgtatgagag

SEQ ID NO: 304670 - DNA, 15 bp, Homo sapiens
ttagtgtgtatgaga

SEQ ID NO: 304671 - DNA, 15 bp, Homo sapiens
attagtgtgtatgag

SEQ ID NO: 304672 - DNA, 15 bp, Homo sapiens
tattagtgtgtatga

SEQ ID NO: 304673 - DNA, 15 bp, Homo sapiens
gtattagtgtgtatg

SEQ ID NO: 304674 - DNA, 15 bp, Homo sapiens
tgtattagtgtgtat

SEQ ID NO: 304675 - DNA, 15 bp, Homo sapiens
ctgtattagtgtgta

SEQ ID NO: 304676 - DNA, 15 bp, Homo sapiens
actgtattagtgtgt

SEQ ID NO: 304677 - DNA, 15 bp, Homo sapiens
gactgtattagtgtg

SEQ ID NO: 304678 - DNA, 15 bp, Homo sapiens
agactgtattagtgt

SEQ ID NO: 304679 - DNA, 15 bp, Homo sapiens
gagactgtattagtg

SEQ ID NO: 304680 - DNA, 15 bp, Homo sapiens
ggagactgtattagt

SEQ ID NO: 304681 - DNA, 15 bp, Homo sapiens
aggagactgtattag

SEQ ID NO: 304682 - DNA, 15 bp, Homo sapiens
caggagactgtatta

SEQ ID NO: 304683 - DNA, 15 bp, Homo sapiens
acaggagactgtatt

SEQ ID NO: 304684 - DNA, 15 bp, Homo sapiens
aacaggagactgtat

SEQ ID NO: 304685 - DNA, 15 bp, Homo sapiens
caacaggagactgta

SEQ ID NO: 304686 - DNA, 15 bp, Homo sapiens
gcaacaggagactgt

SEQ ID NO: 304687 - DNA, 15 bp, Homo sapiens
agcaacaggagactg

SEQ ID NO: 304688 - DNA, 15 bp, Homo sapiens
gagcaacaggagact

SEQ ID NO: 304689 - DNA, 15 bp, Homo sapiens
agagcaacaggagac

SEQ ID NO: 304690 - DNA, 15 bp, Homo sapiens
gagagcaacaggaga

SEQ ID NO: 304691 - DNA, 15 bp, Homo sapiens
tgagagcaacaggag

SEQ ID NO: 304692 - DNA, 15 bp, Homo sapiens
atgagagcaacagga

SEQ ID NO: 304693 - DNA, 15 bp, Homo sapiens
aatgagagcaacagg

SEQ ID NO: 304694 - DNA, 15 bp, Homo sapiens
gaatgagagcaacag

SEQ ID NO: 304695 - DNA, 15 bp, Homo sapiens
agaatgagagcaaca

SEQ ID NO: 304696 - DNA, 15 bp, Homo sapiens
gagaatgagagcaac

SEQ ID NO: 304697 - DNA, 15 bp, Homo sapiens
agagaatgagagcaa

SEQ ID NO: 304698 - DNA, 15 bp, Homo sapiens
gagagaatgagagca

SEQ ID NO: 304699 - DNA, 15 bp, Homo sapiens
agagagaatgagagc

SEQ ID NO: 304700 - DNA, 15 bp, Homo sapiens
gagagagagagaatg

SEQ ID NO: 304701 - DNA, 15 bp, Homo sapiens
ggagagagagagaat

SEQ ID NO: 304702 - DNA, 15 bp, Homo sapiens
gggagagagagagaa

SEQ ID NO: 304703 - DNA, 15 bp, Homo sapiens
ggggagagagagaga

SEQ ID NO: 304704 - DNA, 15 bp, Homo sapiens
tggggagagagagag

SEQ ID NO: 304705 - DNA, 15 bp, Homo sapiens
atggggagagagaga

SEQ ID NO: 304706 - DNA, 15 bp, Homo sapiens
gatggggagagagag

SEQ ID NO: 304707 - DNA, 15 bp, Homo sapiens
agatggggagagaga

SEQ ID NO: 304708 - DNA, 15 bp, Homo sapiens
gagatggggagagag

SEQ ID NO: 304709 - DNA, 15 bp, Homo sapiens
agagatggggagaga

SEQ ID NO: 304710 - DNA, 15 bp, Homo sapiens
aagagatggggagag

SEQ ID NO: 304711 - DNA, 15 bp, Homo sapiens
taagagatggggaga

SEQ ID NO: 304712 - DNA, 15 bp, Homo sapiens
gtaagagatggggag

SEQ ID NO: 304713 - DNA, 15 bp, Homo sapiens
tgtaagagatgggga

SEQ ID NO: 304714 - DNA, 15 bp, Homo sapiens
gtgtaagagatgggg

SEQ ID NO: 304715 - DNA, 15 bp, Homo sapiens
tgtgtaagagatggg

SEQ ID NO: 304716 - DNA, 15 bp, Homo sapiens
atgtgtaagagatgg

SEQ ID NO: 304717 - DNA, 15 bp, Homo sapiens
tatgtgtaagagatg

SEQ ID NO: 304718 - DNA, 15 bp, Homo sapiens
gtatgtgtaagagat

SEQ ID NO: 304719 - DNA, 15 bp, Homo sapiens
tgtatgtgtaagaga

SEQ ID NO: 304720 - DNA, 15 bp, Homo sapiens
atgtatgtgtaagag

SEQ ID NO: 304721 - DNA, 15 bp, Homo sapiens
tatgtatgtgtaaga

SEQ ID NO: 304722 - DNA, 15 bp, Homo sapiens
atatgtatgtgtaag

SEQ ID NO: 304723 - DNA, 15 bp, Homo sapiens
tatatgtatgtgtaa

SEQ ID NO: 304724 - DNA, 15 bp, Homo sapiens
ttatatgtatgtgta

SEQ ID NO: 304725 - DNA, 15 bp, Homo sapiens
attatatgtatgtgt

SEQ ID NO: 304726 - DNA, 15 bp, Homo sapiens
aattatatgtatgtg

SEQ ID NO: 304727 - DNA, 15 bp, Homo sapiens
taattatatgtatgt

SEQ ID NO: 304728 - DNA, 15 bp, Homo sapiens
ataattatatgtatg

SEQ ID NO: 304729 - DNA, 15 bp, Homo sapiens
tataattatatgtat

SEQ ID NO: 304730 - DNA, 15 bp, Homo sapiens
atataattatatgta

SEQ ID NO: 304731 - DNA, 15 bp, Homo sapiens
catataattatatgt

SEQ ID NO: 304732 - DNA, 15 bp, Homo sapiens
tcatataattatatg

SEQ ID NO: 304733 - DNA, 15 bp, Homo sapiens
atcatataattatat

SEQ ID NO: 304734 - DNA, 15 bp, Homo sapiens
aatcatataattata

SEQ ID NO: 304735 - DNA, 15 bp, Homo sapiens
gaatcatataattat

SEQ ID NO: 304736 - DNA, 15 bp, Homo sapiens
agaatcatataatta

SEQ ID NO: 304737 - DNA, 15 bp, Homo sapiens
gagaatcatataatt

SEQ ID NO: 304738 - DNA, 15 bp, Homo sapiens
tgagaatcatataat

SEQ ID NO: 304739 - DNA, 15 bp, Homo sapiens
ttgagaatcatataa

SEQ ID NO: 304740 - DNA, 15 bp, Homo sapiens
attgagaatcatata

SEQ ID NO: 304741 - DNA, 15 bp, Homo sapiens
aattgagaatcatat

SEQ ID NO: 304742 - DNA, 15 bp, Homo sapiens
aaattgagaatcata

SEQ ID NO: 304743 - DNA, 15 bp, Homo sapiens
taaattgagaatcat

SEQ ID NO: 304744 - DNA, 15 bp, Homo sapiens
ataaattgagaatca

SEQ ID NO: 304745 - DNA, 15 bp, Homo sapiens
aataaattgagaatc

SEQ ID NO: 304746 - DNA, 15 bp, Homo sapiens
aaataaattgagaat

SEQ ID NO: 304747 - DNA, 15 bp, Homo sapiens
aaaataaattgagaa

SEQ ID NO: 304748 - DNA, 15 bp, Homo sapiens
gaaaataaattgaga

SEQ ID NO: 304749 - DNA, 15 bp, Homo sapiens
ggaaaataaattgag

SEQ ID NO: 304750 - DNA, 15 bp, Homo sapiens
tggaaaataaattga

SEQ ID NO: 304751 - DNA, 15 bp, Homo sapiens
ctggaaaataaattg

SEQ ID NO: 304752 - DNA, 15 bp, Homo sapiens
tctggaaaataaatt

SEQ ID NO: 304753 - DNA, 15 bp, Homo sapiens
atctggaaaataaat

SEQ ID NO: 304754 - DNA, 15 bp, Homo sapiens
tatctggaaaataaa

SEQ ID NO: 304755 - DNA, 15 bp, Homo sapiens
ctatctggaaaataa

SEQ ID NO: 304756 - DNA, 15 bp, Homo sapiens
tctatctggaaaata

SEQ ID NO: 304757 - DNA, 15 bp, Homo sapiens
ttctatctggaaaat

SEQ ID NO: 304758 - DNA, 15 bp, Homo sapiens
cttctatctggaaaa

SEQ ID NO: 304759 - DNA, 15 bp, Homo sapiens
ccttctatctggaaa

SEQ ID NO: 304760 - DNA, 15 bp, Homo sapiens
accttctatctggaa

SEQ ID NO: 304761 - DNA, 15 bp, Homo sapiens
aaccttctatctgga

SEQ ID NO: 304762 - DNA, 15 bp, Homo sapiens
aaaccttctatctgg

SEQ ID NO: 304763 - DNA, 15 bp, Homo sapiens
taaaccttctatctg

SEQ ID NO: 304764 - DNA, 15 bp, Homo sapiens
ataaaccttctatct

SEQ ID NO: 304765 - DNA, 15 bp, Homo sapiens
aataaaccttctatc

SEQ ID NO: 304766 - DNA, 15 bp, Homo sapiens
caataaaccttctat

SEQ ID NO: 304767 - DNA, 15 bp, Homo sapiens
tcaataaaccttcta

SEQ ID NO: 304768 - DNA, 15 bp, Homo sapiens
atcaataaaccttct

SEQ ID NO: 304769 - DNA, 15 bp, Homo sapiens
tatcaataaaccttc

SEQ ID NO: 304770 - DNA, 15 bp, Homo sapiens
ctatcaataaacctt

SEQ ID NO: 304771 - DNA, 15 bp, Homo sapiens
tctatcaataaacct

SEQ ID NO: 304772 - DNA, 15 bp, Homo sapiens
ctctatcaataaacc

SEQ ID NO: 304773 - DNA, 15 bp, Homo sapiens
tctctatcaataaac

SEQ ID NO: 304774 - DNA, 15 bp, Homo sapiens
ttctctatcaataaa

SEQ ID NO: 304775 - DNA, 15 bp, Homo sapiens
tttctctatcaataa

SEQ ID NO: 304776 - DNA, 15 bp, Homo sapiens
ttttctctatcaata

SEQ ID NO: 304777 - DNA, 15 bp, Homo sapiens
cttttctctatcaat

SEQ ID NO: 304778 - DNA, 15 bp, Homo sapiens
acttttctctatcaa

SEQ ID NO: 304779 - DNA, 15 bp, Homo sapiens
tacttttctctatca

SEQ ID NO: 304780 - DNA, 15 bp, Homo sapiens
ttacttttctctatc

SEQ ID NO: 304781 - DNA, 15 bp, Homo sapiens
attacttttctctat

SEQ ID NO: 304782 - DNA, 15 bp, Homo sapiens
tattacttttctcta

SEQ ID NO: 304783 - DNA, 15 bp, Homo sapiens
atattacttttctct

SEQ ID NO: 304784 - DNA, 15 bp, Homo sapiens
aatattacttttctc

SEQ ID NO: 304785 - DNA, 15 bp, Homo sapiens
caatattacttttct

SEQ ID NO: 304786 - DNA, 15 bp, Homo sapiens
ccaatattacttttc

SEQ ID NO: 304787 - DNA, 15 bp, Homo sapiens
tccaatattactttt

SEQ ID NO: 304788 - DNA, 15 bp, Homo sapiens
atccaatattacttt

SEQ ID NO: 304789 - DNA, 15 bp, Homo sapiens
catccaatattactt

SEQ ID NO: 304790 - DNA, 15 bp, Homo sapiens
acatccaatattact

SEQ ID NO: 304791 - DNA, 15 bp, Homo sapiens
tacatccaatattac

SEQ ID NO: 304792 - DNA, 15 bp, Homo sapiens
ttacatccaatatta

SEQ ID NO: 304793 - DNA, 15 bp, Homo sapiens
tttacatccaatatt

SEQ ID NO: 304794 - DNA, 15 bp, Homo sapiens
ttttacatccaatat

SEQ ID NO: 304795 - DNA, 15 bp, Homo sapiens
tttttacatccaata

SEQ ID NO: 304796 - DNA, 15 bp, Homo sapiens
atttttacatccaat

SEQ ID NO: 304797 - DNA, 15 bp, Homo sapiens
catttttacatccaa

SEQ ID NO: 304798 - DNA, 15 bp, Homo sapiens
acatttttacatcca

SEQ ID NO: 304799 - DNA, 15 bp, Homo sapiens
cacatttttacatcc

SEQ ID NO: 304800 - DNA, 15 bp, Homo sapiens
acacatttttacatc

SEQ ID NO: 304801 - DNA, 15 bp, Homo sapiens
tacacatttttacat

SEQ ID NO: 304802 - DNA, 15 bp, Homo sapiens
gtacacatttttaca

SEQ ID NO: 304803 - DNA, 15 bp, Homo sapiens
tgtacacatttttac

SEQ ID NO: 304804 - DNA, 15 bp, Homo sapiens
atgtacacattttta

SEQ ID NO: 304805 - DNA, 15 bp, Homo sapiens
tatgtacacattttt

SEQ ID NO: 304806 - DNA, 15 bp, Homo sapiens
ttatgtacacatttt

SEQ ID NO: 304807 - DNA, 15 bp, Homo sapiens
tttatgtacacattt

SEQ ID NO: 304808 - DNA, 15 bp, Homo sapiens
ttttatgtacacatt

SEQ ID NO: 304809 - DNA, 15 bp, Homo sapiens
gttttatgtacacat

SEQ ID NO: 304810 - DNA, 15 bp, Homo sapiens
ggttttatgtacaca

SEQ ID NO: 304811 - DNA, 15 bp, Homo sapiens
aggttttatgtacac

SEQ ID NO: 304812 - DNA, 15 bp, Homo sapiens
caggttttatgtaca

SEQ ID NO: 304813 - DNA, 15 bp, Homo sapiens
acaggttttatgtac

SEQ ID NO: 304814 - DNA, 15 bp, Homo sapiens
aacaggttttatgta

SEQ ID NO: 304815 - DNA, 15 bp, Homo sapiens
caacaggttttatgt

SEQ ID NO: 304816 - DNA, 15 bp, Homo sapiens
tcaacaggttttatg

SEQ ID NO: 304817 - DNA, 15 bp, Homo sapiens
ctcaacaggttttat

SEQ ID NO: 304818 - DNA, 15 bp, Homo sapiens
actcaacaggtttta

SEQ ID NO: 304819 - DNA, 15 bp, Homo sapiens
cactcaacaggtttt

SEQ ID NO: 304820 - DNA, 15 bp, Homo sapiens
acactcaacaggttt

SEQ ID NO: 304821 - DNA, 15 bp, Homo sapiens
aacactcaacaggtt

SEQ ID NO: 304822 - DNA, 15 bp, Homo sapiens
aaacactcaacaggt

SEQ ID NO: 304823 - DNA, 15 bp, Homo sapiens
aaaacactcaacagg

SEQ ID NO: 304824 - DNA, 15 bp, Homo sapiens
taaaacactcaacag

SEQ ID NO: 304825 - DNA, 15 bp, Homo sapiens
ttaaaacactcaaca

SEQ ID NO: 304826 - DNA, 15 bp, Homo sapiens
attaaaacactcaac

SEQ ID NO: 304827 - DNA, 15 bp, Homo sapiens
tattaaaacactcaa

SEQ ID NO: 304828 - DNA, 15 bp, Homo sapiens
ttattaaaacactca

SEQ ID NO: 304829 - DNA, 15 bp, Homo sapiens
gttattaaaacactc

SEQ ID NO: 304830 - DNA, 15 bp, Homo sapiens
agttattaaaacact

SEQ ID NO: 304831 - DNA, 15 bp, Homo sapiens
tagttattaaaacac

SEQ ID NO: 304832 - DNA, 15 bp, Homo sapiens
ctagttattaaaaca

SEQ ID NO: 304833 - DNA, 15 bp, Homo sapiens
tctagttattaaaac

SEQ ID NO: 304834 - DNA, 15 bp, Homo sapiens
atctagttattaaaa

SEQ ID NO: 304835 - DNA, 15 bp, Homo sapiens
catctagttattaaa

SEQ ID NO: 304836 - DNA, 15 bp, Homo sapiens
gcatctagttattaa

SEQ ID NO: 304837 - DNA, 15 bp, Homo sapiens
agcatctagttatta

SEQ ID NO: 304838 - DNA, 15 bp, Homo sapiens
cagcatctagttatt

SEQ ID NO: 304839 - DNA, 15 bp, Homo sapiens
acagcatctagttat

SEQ ID NO: 304840 - DNA, 15 bp, Homo sapiens
aacagcatctagtta

SEQ ID NO: 304841 - DNA, 15 bp, Homo sapiens
caacagcatctagtt

SEQ ID NO: 304842 - DNA, 15 bp, Homo sapiens
tcaacagcatctagt

SEQ ID NO: 304843 - DNA, 15 bp, Homo sapiens
gtcaacagcatctag

SEQ ID NO: 304844 - DNA, 15 bp, Homo sapiens
tgtcaacagcatcta

SEQ ID NO: 304845 - DNA, 15 bp, Homo sapiens
atgtcaacagcatct

SEQ ID NO: 304846 - DNA, 15 bp, Homo sapiens
aatgtcaacagcatc

SEQ ID NO: 304847 - DNA, 15 bp, Homo sapiens
taatgtcaacagcat

SEQ ID NO: 304848 - DNA, 15 bp, Homo sapiens
ttaatgtcaacagca

SEQ ID NO: 304849 - DNA, 15 bp, Homo sapiens
cttaatgtcaacagc

SEQ ID NO: 304850 - DNA, 15 bp, Homo sapiens
acttaatgtcaacag

SEQ ID NO: 304851 - DNA, 15 bp, Homo sapiens
aacttaatgtcaaca

SEQ ID NO: 304852 - DNA, 15 bp, Homo sapiens
gaacttaatgtcaac

SEQ ID NO: 304853 - DNA, 15 bp, Homo sapiens
ggaacttaatgtcaa

SEQ ID NO: 304854 - DNA, 15 bp, Homo sapiens
aggaacttaatgtca

SEQ ID NO: 304855 - DNA, 15 bp, Homo sapiens
aaggaacttaatgtc

SEQ ID NO: 304856 - DNA, 15 bp, Homo sapiens
aaaggaacttaatgt

SEQ ID NO: 304857 - DNA, 15 bp, Homo sapiens
gaaaggaacttaatg

SEQ ID NO: 304858 - DNA, 15 bp, Homo sapiens
tgaaaggaacttaat

SEQ ID NO: 304859 - DNA, 15 bp, Homo sapiens
ttgaaaggaacttaa

SEQ ID NO: 304860 - DNA, 15 bp, Homo sapiens
tttgaaaggaactta

SEQ ID NO: 304861 - DNA, 15 bp, Homo sapiens
atttgaaaggaactt

SEQ ID NO: 304862 - DNA, 15 bp, Homo sapiens
catttgaaaggaact

SEQ ID NO: 304863 - DNA, 15 bp, Homo sapiens
acatttgaaaggaac

SEQ ID NO: 304864 - DNA, 15 bp, Homo sapiens
tacatttgaaaggaa

SEQ ID NO: 304865 - DNA, 15 bp, Homo sapiens
gtacatttgaaagga

SEQ ID NO: 304866 - DNA, 15 bp, Homo sapiens
agtacatttgaaagg

SEQ ID NO: 304867 - DNA, 15 bp, Homo sapiens
aagtacatttgaaag

SEQ ID NO: 304868 - DNA, 15 bp, Homo sapiens
aaagtacatttgaaa

SEQ ID NO: 304869 - DNA, 15 bp, Homo sapiens
aaaagtacatttgaa

SEQ ID NO: 304870 - DNA, 15 bp, Homo sapiens
taaaagtacatttga

SEQ ID NO: 304871 - DNA, 15 bp, Homo sapiens
ctaaaagtacatttg

SEQ ID NO: 304872 - DNA, 15 bp, Homo sapiens
actaaaagtacattt

SEQ ID NO: 304873 - DNA, 15 bp, Homo sapiens
aactaaaagtacatt

SEQ ID NO: 304874 - DNA, 15 bp, Homo sapiens
aaactaaaagtacat

SEQ ID NO: 304875 - DNA, 15 bp, Homo sapiens
gaaactaaaagtaca

SEQ ID NO: 304876 - DNA, 15 bp, Homo sapiens
tgaaactaaaagtac

SEQ ID NO: 304877 - DNA, 15 bp, Homo sapiens
atgaaactaaaagta

SEQ ID NO: 304878 - DNA, 15 bp, Homo sapiens
catgaaactaaaagt

SEQ ID NO: 304879 - DNA, 15 bp, Homo sapiens
gcatgaaactaaaag

SEQ ID NO: 304880 - DNA, 15 bp, Homo sapiens
agcatgaaactaaaa

SEQ ID NO: 304881 - DNA, 15 bp, Homo sapiens
gagcatgaaactaaa

SEQ ID NO: 304882 - DNA, 15 bp, Homo sapiens
agagcatgaaactaa

SEQ ID NO: 304883 - DNA, 15 bp, Homo sapiens
gagagcatgaaacta

SEQ ID NO: 304884 - DNA, 15 bp, Homo sapiens
tgagagcatgaaact

SEQ ID NO: 304885 - DNA, 15 bp, Homo sapiens
ttgagagcatgaaac

SEQ ID NO: 304886 - DNA, 15 bp, Homo sapiens
tttgagagcatgaaa

SEQ ID NO: 304887 - DNA, 15 bp, Homo sapiens
atttgagagcatgaa

SEQ ID NO: 304888 - DNA, 15 bp, Homo sapiens
tatttgagagcatga

SEQ ID NO: 304889 - DNA, 15 bp, Homo sapiens
gtatttgagagcatg

SEQ ID NO: 304890 - DNA, 15 bp, Homo sapiens
agtatttgagagcat

SEQ ID NO: 304891 - DNA, 15 bp, Homo sapiens
cagtatttgagagca

SEQ ID NO: 304892 - DNA, 15 bp, Homo sapiens
acagtatttgagagc

SEQ ID NO: 304893 - DNA, 15 bp, Homo sapiens
tacagtatttgagag

SEQ ID NO: 304894 - DNA, 15 bp, Homo sapiens
atacagtatttgaga

SEQ ID NO: 304895 - DNA, 15 bp, Homo sapiens
catacagtatttgag

SEQ ID NO: 304896 - DNA, 15 bp, Homo sapiens
gcatacagtatttga

SEQ ID NO: 304897 - DNA, 15 bp, Homo sapiens
agcatacagtatttg

SEQ ID NO: 304898 - DNA, 15 bp, Homo sapiens
aagcatacagtattt

SEQ ID NO: 304899 - DNA, 15 bp, Homo sapiens
aaagcatacagtatt

SEQ ID NO: 304900 - DNA, 15 bp, Homo sapiens
aaaagcatacagtat

SEQ ID NO: 304901 - DNA, 15 bp, Homo sapiens
aaaaagcatacagta

SEQ ID NO: 304902 - DNA, 15 bp, Homo sapiens
taaaaagcatacagt

SEQ ID NO: 304903 - DNA, 15 bp, Homo sapiens
ataaaaagcatacag

SEQ ID NO: 304904 - DNA, 15 bp, Homo sapiens
gataaaaagcataca

SEQ ID NO: 304905 - DNA, 15 bp, Homo sapiens
ggataaaaagcatac

SEQ ID NO: 304906 - DNA, 15 bp, Homo sapiens
cggataaaaagcata

SEQ ID NO: 304907 - DNA, 15 bp, Homo sapiens
acggataaaaagcat

SEQ ID NO: 304908 - DNA, 15 bp, Homo sapiens
tacggataaaaagca

SEQ ID NO: 304909 - DNA, 15 bp, Homo sapiens
gtacggataaaaagc

SEQ ID NO: 304910 - DNA, 15 bp, Homo sapiens
tgtacggataaaaag

SEQ ID NO: 304911 - DNA, 15 bp, Homo sapiens
gtgtacggataaaaa

SEQ ID NO: 304912 - DNA, 15 bp, Homo sapiens
agtgtacggataaaa

SEQ ID NO: 304913 - DNA, 15 bp, Homo sapiens
cagtgtacggataaa

SEQ ID NO: 304914 - DNA, 15 bp, Homo sapiens
ccagtgtacggataa

SEQ ID NO: 304915 - DNA, 15 bp, Homo sapiens
tccagtgtacggata

SEQ ID NO: 304916 - DNA, 15 bp, Homo sapiens
atccagtgtacggat

SEQ ID NO: 304917 - DNA, 15 bp, Homo sapiens
aatccagtgtacgga

SEQ ID NO: 304918 - DNA, 15 bp, Homo sapiens
aaatccagtgtacgg

SEQ ID NO: 304919 - DNA, 15 bp, Homo sapiens
aaaatccagtgtacg

SEQ ID NO: 304920 - DNA, 15 bp, Homo sapiens
taaaatccagtgtac

SEQ ID NO: 304921 - DNA, 15 bp, Homo sapiens
ttaaaatccagtgta

SEQ ID NO: 304922 - DNA, 15 bp, Homo sapiens
gttaaaatccagtgt

SEQ ID NO: 304923 - DNA, 15 bp, Homo sapiens
ggttaaaatccagtg

SEQ ID NO: 304924 - DNA, 15 bp, Homo sapiens
tggttaaaatccagt

SEQ ID NO: 304925 - DNA, 15 bp, Homo sapiens
gtggttaaaatccag

SEQ ID NO: 304926 - DNA, 15 bp, Homo sapiens
agtggttaaaatcca

SEQ ID NO: 304927 - DNA, 15 bp, Homo sapiens
gagtggttaaaatcc

SEQ ID NO: 304928 - DNA, 15 bp, Homo sapiens
agagtggttaaaatc

SEQ ID NO: 304929 - DNA, 15 bp, Homo sapiens
tagagtggttaaaat

SEQ ID NO: 304930 - DNA, 15 bp, Homo sapiens
ctagagtggttaaaa

SEQ ID NO: 304931 - DNA, 15 bp, Homo sapiens
actagagtggttaaa

SEQ ID NO: 304932 - DNA, 15 bp, Homo sapiens
tactagagtggttaa

SEQ ID NO: 304933 - DNA, 15 bp, Homo sapiens
ctactagagtggtta

SEQ ID NO: 304934 - DNA, 15 bp, Homo sapiens
cctactagagtggtt

SEQ ID NO: 304935 - DNA, 15 bp, Homo sapiens
acctactagagtggt

SEQ ID NO: 304936 - DNA, 15 bp, Homo sapiens
aacctactagagtgg

SEQ ID NO: 304937 - DNA, 15 bp, Homo sapiens
aaacctactagagtg

SEQ ID NO: 304938 - DNA, 15 bp, Homo sapiens
taaacctactagagt

SEQ ID NO: 304939 - DNA, 15 bp, Homo sapiens
ttaaacctactagag

SEQ ID NO: 304940 - DNA, 15 bp, Homo sapiens
attaaacctactaga

SEQ ID NO: 304941 - DNA, 15 bp, Homo sapiens
gattaaacctactag

SEQ ID NO: 304942 - DNA, 15 bp, Homo sapiens
tgattaaacctacta

SEQ ID NO: 304943 - DNA, 15 bp, Homo sapiens
ttgattaaacctact

SEQ ID NO: 304944 - DNA, 15 bp, Homo sapiens
attgattaaacctac

SEQ ID NO: 304945 - DNA, 15 bp, Homo sapiens
aattgattaaaccta

SEQ ID NO: 304946 - DNA, 15 bp, Homo sapiens
aaattgattaaacct

SEQ ID NO: 304947 - DNA, 15 bp, Homo sapiens
gaaattgattaaacc

SEQ ID NO: 304948 - DNA, 15 bp, Homo sapiens
agaaattgattaaac

SEQ ID NO: 304949 - DNA, 15 bp, Homo sapiens
cagaaattgattaaa

SEQ ID NO: 304950 - DNA, 15 bp, Homo sapiens
tcagaaattgattaa

SEQ ID NO: 304951 - DNA, 15 bp, Homo sapiens
ttcagaaattgatta

SEQ ID NO: 304952 - DNA, 15 bp, Homo sapiens
cttcagaaattgatt

SEQ ID NO: 304953 - DNA, 15 bp, Homo sapiens
gcttcagaaattgat

SEQ ID NO: 304954 - DNA, 15 bp, Homo sapiens
ggcttcagaaattga

SEQ ID NO: 304955 - DNA, 15 bp, Homo sapiens
tggcttcagaaattg

SEQ ID NO: 304956 - DNA, 15 bp, Homo sapiens
atggcttcagaaatt

SEQ ID NO: 304957 - DNA, 15 bp, Homo sapiens
aatggcttcagaaat

SEQ ID NO: 304958 - DNA, 15 bp, Homo sapiens
gaatggcttcagaaa

SEQ ID NO: 304959 - DNA, 15 bp, Homo sapiens
tgaatggcttcagaa

SEQ ID NO: 304960 - DNA, 15 bp, Homo sapiens
ctgaatggcttcaga

SEQ ID NO: 304961 - DNA, 15 bp, Homo sapiens
actgaatggcttcag

SEQ ID NO: 304962 - DNA, 15 bp, Homo sapiens
cactgaatggcttca

SEQ ID NO: 304963 - DNA, 15 bp, Homo sapiens
ccactgaatggcttc

SEQ ID NO: 304964 - DNA, 15 bp, Homo sapiens
cccactgaatggctt

SEQ ID NO: 304965 - DNA, 15 bp, Homo sapiens
tcccactgaatggct

SEQ ID NO: 304966 - DNA, 15 bp, Homo sapiens
ttcccactgaatggc

SEQ ID NO: 304967 - DNA, 15 bp, Homo sapiens
tttcccactgaatgg

SEQ ID NO: 304968 - DNA, 15 bp, Homo sapiens
gtttcccactgaatg

SEQ ID NO: 304969 - DNA, 15 bp, Homo sapiens
tgtttcccactgaat

SEQ ID NO: 304970 - DNA, 15 bp, Homo sapiens
ttgtttcccactgaa

SEQ ID NO: 304971 - DNA, 15 bp, Homo sapiens
attgtttcccactga

SEQ ID NO: 304972 - DNA, 15 bp, Homo sapiens
cattgtttcccactg

SEQ ID NO: 304973 - DNA, 15 bp, Homo sapiens
acattgtttcccact

SEQ ID NO: 304974 - DNA, 15 bp, Homo sapiens
aacattgtttcccac

SEQ ID NO: 304975 - DNA, 15 bp, Homo sapiens
caacattgtttccca

SEQ ID NO: 304976 - DNA, 15 bp, Homo sapiens
tcaacattgtttccc

SEQ ID NO: 304977 - DNA, 15 bp, Homo sapiens
ctcaacattgtttcc

SEQ ID NO: 304978 - DNA, 15 bp, Homo sapiens
tctcaacattgtttc

SEQ ID NO: 304979 - DNA, 15 bp, Homo sapiens
ttctcaacattgttt

SEQ ID NO: 304980 - DNA, 15 bp, Homo sapiens
attctcaacattgtt

SEQ ID NO: 304981 - DNA, 15 bp, Homo sapiens
gattctcaacattgt

SEQ ID NO: 304982 - DNA, 15 bp, Homo sapiens
tgattctcaacattg

SEQ ID NO: 304983 - DNA, 15 bp, Homo sapiens
atgattctcaacatt

SEQ ID NO: 304984 - DNA, 15 bp, Homo sapiens
catgattctcaacat

SEQ ID NO: 304985 - DNA, 15 bp, Homo sapiens
acatgattctcaaca

SEQ ID NO: 304986 - DNA, 15 bp, Homo sapiens
aacatgattctcaac

SEQ ID NO: 304987 - DNA, 15 bp, Homo sapiens
caacatgattctcaa

SEQ ID NO: 304988 - DNA, 15 bp, Homo sapiens
gcaacatgattctca

SEQ ID NO: 304989 - DNA, 15 bp, Homo sapiens
agcaacatgattctc

SEQ ID NO: 304990 - DNA, 15 bp, Homo sapiens
aagcaacatgattct

SEQ ID NO: 304991 - DNA, 15 bp, Homo sapiens
aaagcaacatgattc

SEQ ID NO: 304992 - DNA, 15 bp, Homo sapiens
taaagcaacatgatt

SEQ ID NO: 304993 - DNA, 15 bp, Homo sapiens
ataaagcaacatgat

SEQ ID NO: 304994 - DNA, 15 bp, Homo sapiens
aataaagcaacatga

SEQ ID NO: 304995 - DNA, 15 bp, Homo sapiens
gaataaagcaacatg

SEQ ID NO: 304996 - DNA, 15 bp, Homo sapiens
agaataaagcaacat

SEQ ID NO: 304997 - DNA, 15 bp, Homo sapiens
tagaataaagcaaca

SEQ ID NO: 304998 - DNA, 15 bp, Homo sapiens
ttagaataaagcaac

SEQ ID NO: 304999 - DNA, 15 bp, Homo sapiens
tttagaataaagcaa

SEQ ID NO: 305000 - DNA, 15 bp, Homo sapiens
ttttagaataaagca

SEQ ID NO: 305001 - DNA, 15 bp, Homo sapiens
attttagaataaagc

SEQ ID NO: 305002 - DNA, 15 bp, Homo sapiens
aattttagaataaag

SEQ ID NO: 305003 - DNA, 15 bp, Homo sapiens
taattttagaataaa

SEQ ID NO: 305004 - DNA, 15 bp, Homo sapiens
ttaattttagaataa

SEQ ID NO: 305005 - DNA, 15 bp, Homo sapiens
tttaattttagaata

SEQ ID NO: 305006 - DNA, 15 bp, Homo sapiens
ttttaattttagaat

SEQ ID NO: 305007 - DNA, 15 bp, Homo sapiens
cttttaattttagaa

SEQ ID NO: 305008 - DNA, 15 bp, Homo sapiens
gcttttaattttaga

SEQ ID NO: 305009 - DNA, 15 bp, Homo sapiens
agcttttaattttag

SEQ ID NO: 305010 - DNA, 15 bp, Homo sapiens
cagcttttaatttta

SEQ ID NO: 305011 - DNA, 15 bp, Homo sapiens
acagcttttaatttt

SEQ ID NO: 305012 - DNA, 15 bp, Homo sapiens
gacagcttttaattt

SEQ ID NO: 305013 - DNA, 15 bp, Homo sapiens
agacagcttttaatt

SEQ ID NO: 305014 - DNA, 15 bp, Homo sapiens
tagacagcttttaat

SEQ ID NO: 305015 - DNA, 15 bp, Homo sapiens
atagacagcttttaa

SEQ ID NO: 305016 - DNA, 15 bp, Homo sapiens
catagacagctttta

SEQ ID NO: 305017 - DNA, 15 bp, Homo sapiens
tcatagacagctttt

SEQ ID NO: 305018 - DNA, 15 bp, Homo sapiens
ttcatagacagcttt

SEQ ID NO: 305019 - DNA, 15 bp, Homo sapiens
gttcatagacagctt

SEQ ID NO: 305020 - DNA, 15 bp, Homo sapiens
agttcatagacagct

SEQ ID NO: 305021 - DNA, 15 bp, Homo sapiens
tagttcatagacagc

SEQ ID NO: 305022 - DNA, 15 bp, Homo sapiens
ctagttcatagacag

SEQ ID NO: 305023 - DNA, 15 bp, Homo sapiens
tctagttcatagaca

SEQ ID NO: 305024 - DNA, 15 bp, Homo sapiens
ttctagttcatagac

SEQ ID NO: 305025 - DNA, 15 bp, Homo sapiens
tttctagttcataga

SEQ ID NO: 305026 - DNA, 15 bp, Homo sapiens
ttttctagttcatag

SEQ ID NO: 305027 - DNA, 15 bp, Homo sapiens
tttttctagttcata

SEQ ID NO: 305028 - DNA, 15 bp, Homo sapiens
atttttctagttcat

SEQ ID NO: 305029 - DNA, 15 bp, Homo sapiens
gatttttctagttca

SEQ ID NO: 305030 - DNA, 15 bp, Homo sapiens
tgatttttctagttc

SEQ ID NO: 305031 - DNA, 15 bp, Homo sapiens
atgatttttctagtt

SEQ ID NO: 305032 - DNA, 15 bp, Homo sapiens
gatgatttttctagt

SEQ ID NO: 305033 - DNA, 15 bp, Homo sapiens
agatgatttttctag

SEQ ID NO: 305034 - DNA, 15 bp, Homo sapiens
tagatgatttttcta

SEQ ID NO: 305035 - DNA, 15 bp, Homo sapiens
ttagatgatttttct

SEQ ID NO: 305036 - DNA, 15 bp, Homo sapiens
tttagatgatttttc

SEQ ID NO: 305037 - DNA, 15 bp, Homo sapiens
ttttagatgattttt

SEQ ID NO: 305038 - DNA, 15 bp, Homo sapiens
attttagatgatttt

SEQ ID NO: 305039 - DNA, 15 bp, Homo sapiens
tattttagatgattt

SEQ ID NO: 305040 - DNA, 15 bp, Homo sapiens
atattttagatgatt

SEQ ID NO: 305041 - DNA, 15 bp, Homo sapiens
tatattttagatgat

SEQ ID NO: 305042 - DNA, 15 bp, Homo sapiens
ttatattttagatga

SEQ ID NO: 305043 - DNA, 15 bp, Homo sapiens
attatattttagatg

SEQ ID NO: 305044 - DNA, 15 bp, Homo sapiens
aattatattttagat

SEQ ID NO: 305045 - DNA, 15 bp, Homo sapiens
aaattatattttaga

SEQ ID NO: 305046 - DNA, 15 bp, Homo sapiens
caaattatattttag

SEQ ID NO: 305047 - DNA, 15 bp, Homo sapiens
acaaattatatttta

SEQ ID NO: 305048 - DNA, 15 bp, Homo sapiens
aacaaattatatttt

SEQ ID NO: 305049 - DNA, 15 bp, Homo sapiens
taacaaattatattt

SEQ ID NO: 305050 - DNA, 15 bp, Homo sapiens
ttaacaaattatatt

SEQ ID NO: 305051 - DNA, 15 bp, Homo sapiens
tttaacaaattatat

SEQ ID NO: 305052 - DNA, 15 bp, Homo sapiens
ttttaacaaattata

SEQ ID NO: 305053 - DNA, 15 bp, Homo sapiens
attttaacaaattat

SEQ ID NO: 305054 - DNA, 15 bp, Homo sapiens
tattttaacaaatta

SEQ ID NO: 305055 - DNA, 15 bp, Homo sapiens
ttattttaacaaatt

SEQ ID NO: 305056 - DNA, 15 bp, Homo sapiens
tttattttaacaaat

SEQ ID NO: 305057 - DNA, 15 bp, Homo sapiens
ctttattttaacaaa

SEQ ID NO: 305058 - DNA, 15 bp, Homo sapiens
tctttattttaacaa

SEQ ID NO: 305059 - DNA, 15 bp, Homo sapiens
ttctttattttaaca

SEQ ID NO: 305060 - DNA, 15 bp, Homo sapiens
tttctttattttaac

SEQ ID NO: 305061 - DNA, 15 bp, Homo sapiens
ttttctttattttaa

SEQ ID NO: 305062 - DNA, 15 bp, Homo sapiens
gttttctttatttta

SEQ ID NO: 305063 - DNA, 15 bp, Homo sapiens
agttttctttatttt

SEQ ID NO: 305064 - DNA, 15 bp, Homo sapiens
cagttttctttattt

SEQ ID NO: 305065 - DNA, 15 bp, Homo sapiens
tcagttttctttatt

SEQ ID NO: 305066 - DNA, 15 bp, Homo sapiens
atcagttttctttat

SEQ ID NO: 305067 - DNA, 15 bp, Homo sapiens
tatcagttttcttta

SEQ ID NO: 305068 - DNA, 15 bp, Homo sapiens
gtatcagttttcttt

SEQ ID NO: 305069 - DNA, 15 bp, Homo sapiens
tgtatcagttttctt

SEQ ID NO: 305070 - DNA, 15 bp, Homo sapiens
atgtatcagttttct

SEQ ID NO: 305071 - DNA, 15 bp, Homo sapiens
aatgtatcagttttc

SEQ ID NO: 305072 - DNA, 15 bp, Homo sapiens
gaatgtatcagtttt

SEQ ID NO: 305073 - DNA, 15 bp, Homo sapiens
agaatgtatcagttt

SEQ ID NO: 305074 - DNA, 15 bp, Homo sapiens
cagaatgtatcagtt

SEQ ID NO: 305075 - DNA, 15 bp, Homo sapiens
tcagaatgtatcagt

SEQ ID NO: 305076 - DNA, 15 bp, Homo sapiens
atcagaatgtatcag

SEQ ID NO: 305077 - DNA, 15 bp, Homo sapiens
catcagaatgtatca

SEQ ID NO: 305078 - DNA, 15 bp, Homo sapiens
tcatcagaatgtatc

SEQ ID NO: 305079 - DNA, 15 bp, Homo sapiens
ttcatcagaatgtat

SEQ ID NO: 305080 - DNA, 15 bp, Homo sapiens
gttcatcagaatgta

SEQ ID NO: 305081 - DNA, 15 bp, Homo sapiens
tgttcatcagaatgt

SEQ ID NO: 305082 - DNA, 15 bp, Homo sapiens
ttgttcatcagaatg

SEQ ID NO: 305083 - DNA, 15 bp, Homo sapiens
tttgttcatcagaat

SEQ ID NO: 305084 - DNA, 15 bp, Homo sapiens
gtttgttcatcagaa

SEQ ID NO: 305085 - DNA, 15 bp, Homo sapiens
tgtttgttcatcaga

SEQ ID NO: 305086 - DNA, 15 bp, Homo sapiens
atgtttgttcatcag

SEQ ID NO: 305087 - DNA, 15 bp, Homo sapiens
aatgtttgttcatca

SEQ ID NO: 305088 - DNA, 15 bp, Homo sapiens
aaatgtttgttcatc

SEQ ID NO: 305089 - DNA, 15 bp, Homo sapiens
aaaatgtttgttcat

SEQ ID NO: 305090 - DNA, 15 bp, Homo sapiens
taaaatgtttgttca

SEQ ID NO: 305091 - DNA, 15 bp, Homo sapiens
ttaaaatgtttgttc

SEQ ID NO: 305092 - DNA, 15 bp, Homo sapiens
tttaaaatgtttgtt

SEQ ID NO: 305093 - DNA, 15 bp, Homo sapiens
gtttaaaatgtttgt

SEQ ID NO: 305094 - DNA, 15 bp, Homo sapiens
tgtttaaaatgtttg

SEQ ID NO: 305095 - DNA, 15 bp, Homo sapiens
atgtttaaaatgttt

SEQ ID NO: 305096 - DNA, 15 bp, Homo sapiens
gatgtttaaaatgtt

SEQ ID NO: 305097 - DNA, 15 bp, Homo sapiens
ggatgtttaaaatgt

SEQ ID NO: 305098 - DNA, 15 bp, Homo sapiens
aggatgtttaaaatg

SEQ ID NO: 305099 - DNA, 15 bp, Homo sapiens
caggatgtttaaaat

SEQ ID NO: 305100 - DNA, 15 bp, Homo sapiens
acaggatgtttaaaa

SEQ ID NO: 305101 - DNA, 15 bp, Homo sapiens
cacaggatgtttaaa

SEQ ID NO: 305102 - DNA, 15 bp, Homo sapiens
acacaggatgtttaa

SEQ ID NO: 305103 - DNA, 15 bp, Homo sapiens
tacacaggatgttta

SEQ ID NO: 305104 - DNA, 15 bp, Homo sapiens
gtacacaggatgttt

SEQ ID NO: 305105 - DNA, 15 bp, Homo sapiens
ggtacacaggatgtt

SEQ ID NO: 305106 - DNA, 15 bp, Homo sapiens
tggtacacaggatgt

SEQ ID NO: 305107 - DNA, 15 bp, Homo sapiens
gtggtacacaggatg

SEQ ID NO: 305108 - DNA, 15 bp, Homo sapiens
agtggtacacaggat

SEQ ID NO: 305109 - DNA, 15 bp, Homo sapiens
tagtggtacacagga

SEQ ID NO: 305110 - DNA, 15 bp, Homo sapiens
ttagtggtacacagg

SEQ ID NO: 305111 - DNA, 15 bp, Homo sapiens
cttagtggtacacag

SEQ ID NO: 305112 - DNA, 15 bp, Homo sapiens
acttagtggtacaca

SEQ ID NO: 305113 - DNA, 15 bp, Homo sapiens
tacttagtggtacac

SEQ ID NO: 305114 - DNA, 15 bp, Homo sapiens
ttacttagtggtaca

SEQ ID NO: 305115 - DNA, 15 bp, Homo sapiens
attacttagtggtac

SEQ ID NO: 305116 - DNA, 15 bp, Homo sapiens
cattacttagtggta

SEQ ID NO: 305117 - DNA, 15 bp, Homo sapiens
gcattacttagtggt

SEQ ID NO: 305118 - DNA, 15 bp, Homo sapiens
agcattacttagtgg

SEQ ID NO: 305119 - DNA, 15 bp, Homo sapiens
cagcattacttagtg

SEQ ID NO: 305120 - DNA, 15 bp, Homo sapiens
tcagcattacttagt

SEQ ID NO: 305121 - DNA, 15 bp, Homo sapiens
gtcagcattacttag

SEQ ID NO: 305122 - DNA, 15 bp, Homo sapiens
tgtcagcattactta

SEQ ID NO: 305123 - DNA, 15 bp, Homo sapiens
atgtcagcattactt

SEQ ID NO: 305124 - DNA, 15 bp, Homo sapiens
aatgtcagcattact

SEQ ID NO: 305125 - DNA, 15 bp, Homo sapiens
taatgtcagcattac

SEQ ID NO: 305126 - DNA, 15 bp, Homo sapiens
ttaatgtcagcatta

SEQ ID NO: 305127 - DNA, 15 bp, Homo sapiens
cttaatgtcagcatt

SEQ ID NO: 305128 - DNA, 15 bp, Homo sapiens
gcttaatgtcagcat

SEQ ID NO: 305129 - DNA, 15 bp, Homo sapiens
tgcttaatgtcagca

SEQ ID NO: 305130 - DNA, 15 bp, Homo sapiens
atgcttaatgtcagc

SEQ ID NO: 305131 - DNA, 15 bp, Homo sapiens
aatgcttaatgtcag

SEQ ID NO: 305132 - DNA, 15 bp, Homo sapiens
gaatgcttaatgtca

SEQ ID NO: 305133 - DNA, 15 bp, Homo sapiens
ggaatgcttaatgtc

SEQ ID NO: 305134 - DNA, 15 bp, Homo sapiens
aggaatgcttaatgt

SEQ ID NO: 305135 - DNA, 15 bp, Homo sapiens
caggaatgcttaatg

SEQ ID NO: 305136 - DNA, 15 bp, Homo sapiens
tcaggaatgcttaat

SEQ ID NO: 305137 - DNA, 15 bp, Homo sapiens
ttcaggaatgcttaa

SEQ ID NO: 305138 - DNA, 15 bp, Homo sapiens
tttcaggaatgctta

SEQ ID NO: 305139 - DNA, 15 bp, Homo sapiens
ttttcaggaatgctt

SEQ ID NO: 305140 - DNA, 15 bp, Homo sapiens
tttttcaggaatgct

SEQ ID NO: 305141 - DNA, 15 bp, Homo sapiens
ttttttcaggaatgc

SEQ ID NO: 305142 - DNA, 15 bp, Homo sapiens
gttttttcaggaatg

SEQ ID NO: 305143 - DNA, 15 bp, Homo sapiens
tgttttttcaggaat

SEQ ID NO: 305144 - DNA, 15 bp, Homo sapiens
gtgttttttcaggaa

SEQ ID NO: 305145 - DNA, 15 bp, Homo sapiens
agtgttttttcagga

SEQ ID NO: 305146 - DNA, 15 bp, Homo sapiens
aagtgttttttcagg

SEQ ID NO: 305147 - DNA, 15 bp, Homo sapiens
caagtgttttttcag

SEQ ID NO: 305148 - DNA, 15 bp, Homo sapiens
tcaagtgttttttca

SEQ ID NO: 305149 - DNA, 15 bp, Homo sapiens
atcaagtgttttttc

SEQ ID NO: 305150 - DNA, 15 bp, Homo sapiens
aatcaagtgtttttt

SEQ ID NO: 305151 - DNA, 15 bp, Homo sapiens
aaatcaagtgttttt

SEQ ID NO: 305152 - DNA, 15 bp, Homo sapiens
gaaatcaagtgtttt

SEQ ID NO: 305153 - DNA, 15 bp, Homo sapiens
ggaaatcaagtgttt

SEQ ID NO: 305154 - DNA, 15 bp, Homo sapiens
tggaaatcaagtgtt

SEQ ID NO: 305155 - DNA, 15 bp, Homo sapiens
ctggaaatcaagtgt

SEQ ID NO: 305156 - DNA, 15 bp, Homo sapiens
gctggaaatcaagtg

SEQ ID NO: 305157 - DNA, 15 bp, Homo sapiens
tgctggaaatcaagt

SEQ ID NO: 305158 - DNA, 15 bp, Homo sapiens
ttgctggaaatcaag

SEQ ID NO: 305159 - DNA, 15 bp, Homo sapiens
gttgctggaaatcaa

SEQ ID NO: 305160 - DNA, 15 bp, Homo sapiens
agttgctggaaatca

SEQ ID NO: 305161 - DNA, 15 bp, Homo sapiens
aagttgctggaaatc

SEQ ID NO: 305162 - DNA, 15 bp, Homo sapiens
caagttgctggaaat

SEQ ID NO: 305163 - DNA, 15 bp, Homo sapiens
acaagttgctggaaa

SEQ ID NO: 305164 - DNA, 15 bp, Homo sapiens
aacaagttgctggaa

SEQ ID NO: 305165 - DNA, 15 bp, Homo sapiens
caacaagttgctgga

SEQ ID NO: 305166 - DNA, 15 bp, Homo sapiens
tcaacaagttgctgg

SEQ ID NO: 305167 - DNA, 15 bp, Homo sapiens
gtcaacaagttgctg

SEQ ID NO: 305168 - DNA, 15 bp, Homo sapiens
agtcaacaagttgct

SEQ ID NO: 305169 - DNA, 15 bp, Homo sapiens
tagtcaacaagttgc

SEQ ID NO: 305170 - DNA, 15 bp, Homo sapiens
ctagtcaacaagttg

SEQ ID NO: 305171 - DNA, 15 bp, Homo sapiens
cctagtcaacaagtt

SEQ ID NO: 305172 - DNA, 15 bp, Homo sapiens
acctagtcaacaagt

SEQ ID NO: 305173 - DNA, 15 bp, Homo sapiens
tacctagtcaacaag

SEQ ID NO: 305174 - DNA, 15 bp, Homo sapiens
ctacctagtcaacaa

SEQ ID NO: 305175 - DNA, 15 bp, Homo sapiens
gctacctagtcaaca

SEQ ID NO: 305176 - DNA, 15 bp, Homo sapiens
agctacctagtcaac

SEQ ID NO: 305177 - DNA, 15 bp, Homo sapiens
cagctacctagtcaa

SEQ ID NO: 305178 - DNA, 15 bp, Homo sapiens
tcagctacctagtca

SEQ ID NO: 305179 - DNA, 15 bp, Homo sapiens
ttcagctacctagtc

SEQ ID NO: 305180 - DNA, 15 bp, Homo sapiens
tttcagctacctagt

SEQ ID NO: 305181 - DNA, 15 bp, Homo sapiens
ttttcagctacctag

SEQ ID NO: 305182 - DNA, 15 bp, Homo sapiens
attttcagctaccta

SEQ ID NO: 305183 - DNA, 15 bp, Homo sapiens
tattttcagctacct

SEQ ID NO: 305184 - DNA, 15 bp, Homo sapiens
ctattttcagctacc

SEQ ID NO: 305185 - DNA, 15 bp, Homo sapiens
tctattttcagctac

SEQ ID NO: 305186 - DNA, 15 bp, Homo sapiens
ttctattttcagcta

SEQ ID NO: 305187 - DNA, 15 bp, Homo sapiens
cttctattttcagct

SEQ ID NO: 305188 - DNA, 15 bp, Homo sapiens
acttctattttcagc

SEQ ID NO: 305189 - DNA, 15 bp, Homo sapiens
cacttctattttcag

SEQ ID NO: 305190 - DNA, 15 bp, Homo sapiens
gcacttctattttca

SEQ ID NO: 305191 - DNA, 15 bp, Homo sapiens
cgcacttctattttc

SEQ ID NO: 305192 - DNA, 15 bp, Homo sapiens
tcgcacttctatttt

SEQ ID NO: 305193 - DNA, 15 bp, Homo sapiens
ttcgcacttctattt

SEQ ID NO: 305194 - DNA, 15 bp, Homo sapiens
gttcgcacttctatt

SEQ ID NO: 305195 - DNA, 15 bp, Homo sapiens
tgttcgcacttctat

SEQ ID NO: 305196 - DNA, 15 bp, Homo sapiens
ttgttcgcacttcta

SEQ ID NO: 305197 - DNA, 15 bp, Homo sapiens
tttgttcgcacttct

SEQ ID NO: 305198 - DNA, 15 bp, Homo sapiens
atttgttcgcacttc

SEQ ID NO: 305199 - DNA, 15 bp, Homo sapiens
catttgttcgcactt

SEQ ID NO: 305200 - DNA, 15 bp, Homo sapiens
tcatttgttcgcact

SEQ ID NO: 305201 - DNA, 15 bp, Homo sapiens
ttcatttgttcgcac

SEQ ID NO: 305202 - DNA, 15 bp, Homo sapiens
gttcatttgttcgca

SEQ ID NO: 305203 - DNA, 15 bp, Homo sapiens
tgttcatttgttcgc

SEQ ID NO: 305204 - DNA, 15 bp, Homo sapiens
ttgttcatttgttcg

SEQ ID NO: 305205 - DNA, 15 bp, Homo sapiens
cttgttcatttgttc

SEQ ID NO: 305206 - DNA, 15 bp, Homo sapiens
acttgttcatttgtt

SEQ ID NO: 305207 - DNA, 15 bp, Homo sapiens
aacttgttcatttgt

SEQ ID NO: 305208 - DNA, 15 bp, Homo sapiens
aaacttgttcatttg

SEQ ID NO: 305209 - DNA, 15 bp, Homo sapiens
aaaacttgttcattt

SEQ ID NO: 305210 - DNA, 15 bp, Homo sapiens
caaaacttgttcatt

SEQ ID NO: 305211 - DNA, 15 bp, Homo sapiens
gcaaaacttgttcat

SEQ ID NO: 305212 - DNA, 15 bp, Homo sapiens
agcaaaacttgttca

SEQ ID NO: 305213 - DNA, 15 bp, Homo sapiens
aagcaaaacttgttc

SEQ ID NO: 305214 - DNA, 15 bp, Homo sapiens
aaagcaaaacttgtt

SEQ ID NO: 305215 - DNA, 15 bp, Homo sapiens
gaaagcaaaacttgt

SEQ ID NO: 305216 - DNA, 15 bp, Homo sapiens
tgaaagcaaaacttg

SEQ ID NO: 305217 - DNA, 15 bp, Homo sapiens
atgaaagcaaaactt

SEQ ID NO: 305218 - DNA, 15 bp, Homo sapiens
tatgaaagcaaaact

SEQ ID NO: 305219 - DNA, 15 bp, Homo sapiens
gtatgaaagcaaaac

SEQ ID NO: 305220 - DNA, 15 bp, Homo sapiens
agtatgaaagcaaaa

SEQ ID NO: 305221 - DNA, 15 bp, Homo sapiens
cagtatgaaagcaaa

SEQ ID NO: 305222 - DNA, 15 bp, Homo sapiens
gcagtatgaaagcaa

SEQ ID NO: 305223 - DNA, 15 bp, Homo sapiens
agcagtatgaaagca

SEQ ID NO: 305224 - DNA, 15 bp, Homo sapiens
cagcagtatgaaagc

SEQ ID NO: 305225 - DNA, 15 bp, Homo sapiens
acagcagtatgaaag

SEQ ID NO: 305226 - DNA, 15 bp, Homo sapiens
cacagcagtatgaaa

SEQ ID NO: 305227 - DNA, 15 bp, Homo sapiens
ccacagcagtatgaa

SEQ ID NO: 305228 - DNA, 15 bp, Homo sapiens
accacagcagtatga

SEQ ID NO: 305229 - DNA, 15 bp, Homo sapiens
aaccacagcagtatg

SEQ ID NO: 305230 - DNA, 15 bp, Homo sapiens
aaaccacagcagtat

SEQ ID NO: 305231 - DNA, 15 bp, Homo sapiens
caaaccacagcagta

SEQ ID NO: 305232 - DNA, 15 bp, Homo sapiens
tcaaaccacagcagt

SEQ ID NO: 305233 - DNA, 15 bp, Homo sapiens
ttcaaaccacagcag

SEQ ID NO: 305234 - DNA, 15 bp, Homo sapiens
attcaaaccacagca

SEQ ID NO: 305235 - DNA, 15 bp, Homo sapiens
cattcaaaccacagc

SEQ ID NO: 305236 - DNA, 15 bp, Homo sapiens
acattcaaaccacag

SEQ ID NO: 305237 - DNA, 15 bp, Homo sapiens
cacattcaaaccaca

SEQ ID NO: 305238 - DNA, 15 bp, Homo sapiens
acacattcaaaccac

SEQ ID NO: 305239 - DNA, 15 bp, Homo sapiens
gacacattcaaacca

SEQ ID NO: 305240 - DNA, 15 bp, Homo sapiens
tgacacattcaaacc

SEQ ID NO: 305241 - DNA, 15 bp, Homo sapiens
gtgacacattcaaac

SEQ ID NO: 305242 - DNA, 15 bp, Homo sapiens
gggtgacacattcaa

SEQ ID NO: 305243 - DNA, 15 bp, Homo sapiens
tgggtgacacattca

SEQ ID NO: 305244 - DNA, 15 bp, Homo sapiens
gtgggtgacacattc

SEQ ID NO: 305245 - DNA, 15 bp, Homo sapiens
tgtgggtgacacatt

SEQ ID NO: 305246 - DNA, 15 bp, Homo sapiens
ctgtgggtgacacat

SEQ ID NO: 305247 - DNA, 15 bp, Homo sapiens
actgtgggtgacaca

SEQ ID NO: 305248 - DNA, 15 bp, Homo sapiens
aactgtgggtgacac

SEQ ID NO: 305249 - DNA, 15 bp, Homo sapiens
gaactgtgggtgaca

SEQ ID NO: 305250 - DNA, 15 bp, Homo sapiens
tgaactgtgggtgac

SEQ ID NO: 305251 - DNA, 15 bp, Homo sapiens
atgaactgtgggtga

SEQ ID NO: 305252 - DNA, 15 bp, Homo sapiens
catgaactgtgggtg

SEQ ID NO: 305253 - DNA, 15 bp, Homo sapiens
acatgaactgtgggt

SEQ ID NO: 305254 - DNA, 15 bp, Homo sapiens
cacatgaactgtggg

SEQ ID NO: 305255 - DNA, 15 bp, Homo sapiens
acacatgaactgtgg

SEQ ID NO: 305256 - DNA, 15 bp, Homo sapiens
aacacatgaactgtg

SEQ ID NO: 305257 - DNA, 15 bp, Homo sapiens
caacacatgaactgt

SEQ ID NO: 305258 - DNA, 15 bp, Homo sapiens
tcaacacatgaactg

SEQ ID NO: 305259 - DNA, 15 bp, Homo sapiens
ttcaacacatgaact

SEQ ID NO: 305260 - DNA, 15 bp, Homo sapiens
tttcaacacatgaac

SEQ ID NO: 305261 - DNA, 15 bp, Homo sapiens
ttttcaacacatgaa

SEQ ID NO: 305262 - DNA, 15 bp, Homo sapiens
attttcaacacatga

SEQ ID NO: 305263 - DNA, 15 bp, Homo sapiens
aattttcaacacatg

SEQ ID NO: 305264 - DNA, 15 bp, Homo sapiens
aaattttcaacacat

SEQ ID NO: 305265 - DNA, 15 bp, Homo sapiens
taaattttcaacaca

SEQ ID NO: 305266 - DNA, 15 bp, Homo sapiens
ttaaattttcaacac

SEQ ID NO: 305267 - DNA, 15 bp, Homo sapiens
attaaattttcaaca

SEQ ID NO: 305268 - DNA, 15 bp, Homo sapiens
gattaaattttcaac

SEQ ID NO: 305269 - DNA, 15 bp, Homo sapiens
ggattaaattttcaa

SEQ ID NO: 305270 - DNA, 15 bp, Homo sapiens
gggattaaattttca

SEQ ID NO: 305271 - DNA, 15 bp, Homo sapiens
ggggattaaattttc

SEQ ID NO: 305272 - DNA, 15 bp, Homo sapiens
cggggattaaatttt

SEQ ID NO: 305273 - DNA, 15 bp, Homo sapiens
tcggggattaaattt

SEQ ID NO: 305274 - DNA, 15 bp, Homo sapiens
atcggggattaaatt

SEQ ID NO: 305275 - DNA, 15 bp, Homo sapiens
aatcggggattaaat

SEQ ID NO: 305276 - DNA, 15 bp, Homo sapiens
gaatcggggattaaa

SEQ ID NO: 305277 - DNA, 15 bp, Homo sapiens
ggaatcggggattaa

SEQ ID NO: 305278 - DNA, 15 bp, Homo sapiens
tggaatcggggatta

SEQ ID NO: 305279 - DNA, 15 bp, Homo sapiens
atggaatcggggatt

SEQ ID NO: 305280 - DNA, 15 bp, Homo sapiens
tatggaatcggggat

SEQ ID NO: 305281 - DNA, 15 bp, Homo sapiens
ctatggaatcgggga

SEQ ID NO: 305282 - DNA, 15 bp, Homo sapiens
actatggaatcgggg

SEQ ID NO: 305283 - DNA, 15 bp, Homo sapiens
cactatggaatcggg

SEQ ID NO: 305284 - DNA, 15 bp, Homo sapiens
acactatggaatcgg

SEQ ID NO: 305285 - DNA, 15 bp, Homo sapiens
aacactatggaatcg

SEQ ID NO: 305286 - DNA, 15 bp, Homo sapiens
caacactatggaatc

SEQ ID NO: 305287 - DNA, 15 bp, Homo sapiens
tcaacactatggaat

SEQ ID NO: 305288 - DNA, 15 bp, Homo sapiens
ctcaacactatggaa

SEQ ID NO: 305289 - DNA, 15 bp, Homo sapiens
cctcaacactatgga

SEQ ID NO: 305290 - DNA, 15 bp, Homo sapiens
ccctcaacactatgg

SEQ ID NO: 305291 - DNA, 15 bp, Homo sapiens
acccctcaacactat

SEQ ID NO: 305292 - DNA, 15 bp, Homo sapiens
aacccctcaacacta

SEQ ID NO: 305293 - DNA, 15 bp, Homo sapiens
caacccctcaacact

SEQ ID NO: 305294 - DNA, 15 bp, Homo sapiens
ccaacccctcaacac

SEQ ID NO: 305295 - DNA, 15 bp, Homo sapiens
tccaacccctcaaca

SEQ ID NO: 305296 - DNA, 15 bp, Homo sapiens
gtccaacccctcaac

SEQ ID NO: 305297 - DNA, 15 bp, Homo sapiens
ggtccaacccctcaa

SEQ ID NO: 305298 - DNA, 15 bp, Homo sapiens
aggtccaacccctca

SEQ ID NO: 305299 - DNA, 15 bp, Homo sapiens
aaggtccaacccctc

SEQ ID NO: 305300 - DNA, 15 bp, Homo sapiens
aaaggtccaacccct

SEQ ID NO: 305301 - DNA, 15 bp, Homo sapiens
taaaggtccaacccc

SEQ ID NO: 305302 - DNA, 15 bp, Homo sapiens
ttaaaggtccaaccc

SEQ ID NO: 305303 - DNA, 15 bp, Homo sapiens
cttaaaggtccaacc

SEQ ID NO: 305304 - DNA, 15 bp, Homo sapiens
tcttaaaggtccaac

SEQ ID NO: 305305 - DNA, 15 bp, Homo sapiens
ttcttaaaggtccaa

SEQ ID NO: 305306 - DNA, 15 bp, Homo sapiens
cttcttaaaggtcca

SEQ ID NO: 305307 - DNA, 15 bp, Homo sapiens
acttcttaaaggtcc

SEQ ID NO: 305308 - DNA, 15 bp, Homo sapiens
cacttcttaaaggtc

SEQ ID NO: 305309 - DNA, 15 bp, Homo sapiens
tcacttcttaaaggt

SEQ ID NO: 305310 - DNA, 15 bp, Homo sapiens
atcacttcttaaagg

SEQ ID NO: 305311 - DNA, 15 bp, Homo sapiens
aatcacttcttaaag

SEQ ID NO: 305312 - DNA, 15 bp, Homo sapiens
caatcacttcttaaa

SEQ ID NO: 305313 - DNA, 15 bp, Homo sapiens
ccaatcacttcttaa

SEQ ID NO: 305314 - DNA, 15 bp, Homo sapiens
tccaatcacttctta

SEQ ID NO: 305315 - DNA, 15 bp, Homo sapiens
atccaatcacttctt

SEQ ID NO: 305316 - DNA, 15 bp, Homo sapiens
gatccaatcacttct

SEQ ID NO: 305317 - DNA, 15 bp, Homo sapiens
tgatccaatcacttc

SEQ ID NO: 305318 - DNA, 15 bp, Homo sapiens
atgatccaatcactt

SEQ ID NO: 305319 - DNA, 15 bp, Homo sapiens
catgatccaatcact

SEQ ID NO: 305320 - DNA, 15 bp, Homo sapiens
tcatgatccaatcac

SEQ ID NO: 305321 - DNA, 15 bp, Homo sapiens
ctcatgatccaatca

SEQ ID NO: 305322 - DNA, 15 bp, Homo sapiens
cctcatgatccaatc

SEQ ID NO: 305323 - DNA, 15 bp, Homo sapiens
acctcatgatccaat

SEQ ID NO: 305324 - DNA, 15 bp, Homo sapiens
gacctcatgatccaa

SEQ ID NO: 305325 - DNA, 15 bp, Homo sapiens
tctgacctcatgatc

SEQ ID NO: 305326 - DNA, 15 bp, Homo sapiens
ctctgacctcatgat

SEQ ID NO: 305327 - DNA, 15 bp, Homo sapiens
cctctgacctcatga

SEQ ID NO: 305328 - DNA, 15 bp, Homo sapiens
acctctgacctcatg

SEQ ID NO: 305329 - DNA, 15 bp, Homo sapiens
gacctctgacctcat

SEQ ID NO: 305330 - DNA, 15 bp, Homo sapiens
tgacctctgacctca

SEQ ID NO: 305331 - DNA, 15 bp, Homo sapiens
atgacctctgacctc

SEQ ID NO: 305332 - DNA, 15 bp, Homo sapiens
catgacctctgacct

SEQ ID NO: 305333 - DNA, 15 bp, Homo sapiens
tcatgacctctgacc

SEQ ID NO: 305334 - DNA, 15 bp, Homo sapiens
ttcatgacctctgac

SEQ ID NO: 305335 - DNA, 15 bp, Homo sapiens
attcatgacctctga

SEQ ID NO: 305336 - DNA, 15 bp, Homo sapiens
cattcatgacctctg

SEQ ID NO: 305337 - DNA, 15 bp, Homo sapiens
ccattcatgacctct

SEQ ID NO: 305338 - DNA, 15 bp, Homo sapiens
tccattcatgacctc

SEQ ID NO: 305339 - DNA, 15 bp, Homo sapiens
atccattcatgacct

SEQ ID NO: 305340 - DNA, 15 bp, Homo sapiens
aatccattcatgacc

SEQ ID NO: 305341 - DNA, 15 bp, Homo sapiens
taatccattcatgac

SEQ ID NO: 305342 - DNA, 15 bp, Homo sapiens
ttaatccattcatga

SEQ ID NO: 305343 - DNA, 15 bp, Homo sapiens
attaatccattcatg

SEQ ID NO: 305344 - DNA, 15 bp, Homo sapiens
cattaatccattcat

SEQ ID NO: 305345 - DNA, 15 bp, Homo sapiens
gatgacattaatcca

SEQ ID NO: 305346 - DNA, 15 bp, Homo sapiens
tgatgacattaatcc

SEQ ID NO: 305347 - DNA, 15 bp, Homo sapiens
gtgatgacattaatc

SEQ ID NO: 305348 - DNA, 15 bp, Homo sapiens
tgtgatgacattaat

SEQ ID NO: 305349 - DNA, 15 bp, Homo sapiens
ctgtgatgacattaa

SEQ ID NO: 305350 - DNA, 15 bp, Homo sapiens
tctgtgatgacatta

SEQ ID NO: 305351 - DNA, 15 bp, Homo sapiens
ttctgtgatgacatt

SEQ ID NO: 305352 - DNA, 15 bp, Homo sapiens
cttctgtgatgacat

SEQ ID NO: 305353 - DNA, 15 bp, Homo sapiens
acttctgtgatgaca

SEQ ID NO: 305354 - DNA, 15 bp, Homo sapiens
cacttctgtgatgac

SEQ ID NO: 305355 - DNA, 15 bp, Homo sapiens
acacttctgtgatga

SEQ ID NO: 305356 - DNA, 15 bp, Homo sapiens
cacacttctgtgatg

SEQ ID NO: 305357 - DNA, 15 bp, Homo sapiens
acacacttctgtgat

SEQ ID NO: 305358 - DNA, 15 bp, Homo sapiens
aacacacttctgtga

SEQ ID NO: 305359 - DNA, 15 bp, Homo sapiens
aaacacacttctgtg

SEQ ID NO: 305360 - DNA, 15 bp, Homo sapiens
caaacacacttctgt

SEQ ID NO: 305361 - DNA, 15 bp, Homo sapiens
gcaaacacacttctg

SEQ ID NO: 305362 - DNA, 15 bp, Homo sapiens
agcaaacacacttct

SEQ ID NO: 305363 - DNA, 15 bp, Homo sapiens
tagcaaacacacttc

SEQ ID NO: 305364 - DNA, 15 bp, Homo sapiens
atagcaaacacactt

SEQ ID NO: 305365 - DNA, 15 bp, Homo sapiens
gatagcaaacacact

SEQ ID NO: 305366 - DNA, 15 bp, Homo sapiens
agatagcaaacacac

SEQ ID NO: 305367 - DNA, 15 bp, Homo sapiens
gagatagcaaacaca

SEQ ID NO: 305368 - DNA, 15 bp, Homo sapiens
tgagatagcaaacac

SEQ ID NO: 305369 - DNA, 15 bp, Homo sapiens
ttgagatagcaaaca

SEQ ID NO: 305370 - DNA, 15 bp, Homo sapiens
cttgagatagcaaac

SEQ ID NO: 305371 - DNA, 15 bp, Homo sapiens
acttgagatagcaaa

SEQ ID NO: 305372 - DNA, 15 bp, Homo sapiens
cacttgagatagcaa

SEQ ID NO: 305373 - DNA, 15 bp, Homo sapiens
ccacttgagatagca

SEQ ID NO: 305374 - DNA, 15 bp, Homo sapiens
cccacttgagatagc

SEQ ID NO: 305375 - DNA, 15 bp, Homo sapiens
acccacttgagatag

SEQ ID NO: 305376 - DNA, 15 bp, Homo sapiens
aacccacttgagata

SEQ ID NO: 305377 - DNA, 15 bp, Homo sapiens
aaacccacttgagat

SEQ ID NO: 305378 - DNA, 15 bp, Homo sapiens
taaacccacttgaga

SEQ ID NO: 305379 - DNA, 15 bp, Homo sapiens
ataaacccacttgag

SEQ ID NO: 305380 - DNA, 15 bp, Homo sapiens
aataaacccacttga

SEQ ID NO: 305381 - DNA, 15 bp, Homo sapiens
taataaacccacttg

SEQ ID NO: 305382 - DNA, 15 bp, Homo sapiens
gtaataaacccactt

SEQ ID NO: 305383 - DNA, 15 bp, Homo sapiens
ggtaataaacccact

SEQ ID NO: 305384 - DNA, 15 bp, Homo sapiens
tggtaataaacccac

SEQ ID NO: 305385 - DNA, 15 bp, Homo sapiens
ttggtaataaaccca

SEQ ID NO: 305386 - DNA, 15 bp, Homo sapiens
tttggtaataaaccc

SEQ ID NO: 305387 - DNA, 15 bp, Homo sapiens
ctttggtaataaacc

SEQ ID NO: 305388 - DNA, 15 bp, Homo sapiens
gctttggtaataaac

SEQ ID NO: 305389 - DNA, 15 bp, Homo sapiens
tgctttggtaataaa

SEQ ID NO: 305390 - DNA, 15 bp, Homo sapiens
gtgctttggtaataa

SEQ ID NO: 305391 - DNA, 15 bp, Homo sapiens
cgtgctttggtaata

SEQ ID NO: 305392 - DNA, 15 bp, Homo sapiens
acgtgctttggtaat

SEQ ID NO: 305393 - DNA, 15 bp, Homo sapiens
aacgtgctttggtaa

SEQ ID NO: 305394 - DNA, 15 bp, Homo sapiens
caacgtgctttggta

SEQ ID NO: 305395 - DNA, 15 bp, Homo sapiens
ccaacgtgctttggt

SEQ ID NO: 305396 - DNA, 15 bp, Homo sapiens
cccaacgtgctttgg

SEQ ID NO: 305397 - DNA, 15 bp, Homo sapiens
acccaacgtgctttg

SEQ ID NO: 305398 - DNA, 15 bp, Homo sapiens
aacccaacgtgcttt

SEQ ID NO: 305399 - DNA, 15 bp, Homo sapiens
gaacccaacgtgctt

SEQ ID NO: 305400 - DNA, 15 bp, Homo sapiens
agaacccaacgtgct

SEQ ID NO: 305401 - DNA, 15 bp, Homo sapiens
gagaacccaacgtgc

SEQ ID NO: 305402 - DNA, 15 bp, Homo sapiens
agagaacccaacgtg

SEQ ID NO: 305403 - DNA, 15 bp, Homo sapiens
gagagaacccaacgt

SEQ ID NO: 305404 - DNA, 15 bp, Homo sapiens
tgagagaacccaacg

SEQ ID NO: 305405 - DNA, 15 bp, Homo sapiens
gtgagagaacccaac

SEQ ID NO: 305406 - DNA, 15 bp, Homo sapiens
agtgagagaacccaa

SEQ ID NO: 305407 - DNA, 15 bp, Homo sapiens
aagtgagagaaccca

SEQ ID NO: 305408 - DNA, 15 bp, Homo sapiens
aaagtgagagaaccc

SEQ ID NO: 305409 - DNA, 15 bp, Homo sapiens
gaaagtgagagaacc

SEQ ID NO: 305410 - DNA, 15 bp, Homo sapiens
agaaagtgagagaac

SEQ ID NO: 305411 - DNA, 15 bp, Homo sapiens
gagaaagtgagagaa

SEQ ID NO: 305412 - DNA, 15 bp, Homo sapiens
agagaaagtgagaga

SEQ ID NO: 305413 - DNA, 15 bp, Homo sapiens
aagagaaagtgagag

SEQ ID NO: 305414 - DNA, 15 bp, Homo sapiens
caagagaaagtgaga

SEQ ID NO: 305415 - DNA, 15 bp, Homo sapiens
gcaagagaaagtgag

SEQ ID NO: 305416 - DNA, 15 bp, Homo sapiens
tgcaagagaaagtga

SEQ ID NO: 305417 - DNA, 15 bp, Homo sapiens
atgcaagagaaagtg

SEQ ID NO: 305418 - DNA, 15 bp, Homo sapiens
catgcaagagaaagt

SEQ ID NO: 305419 - DNA, 15 bp, Homo sapiens
acatgcaagagaaag

SEQ ID NO: 305420 - DNA, 15 bp, Homo sapiens
aacatgcaagagaaa

SEQ ID NO: 305421 - DNA, 15 bp, Homo sapiens
gaacatgcaagagaa

SEQ ID NO: 305422 - DNA, 15 bp, Homo sapiens
agaacatgcaagaga

SEQ ID NO: 305423 - DNA, 15 bp, Homo sapiens
gagaacatgcaagag

SEQ ID NO: 305424 - DNA, 15 bp, Homo sapiens
agagaacatgcaaga

SEQ ID NO: 305425 - DNA, 15 bp, Homo sapiens
cagagaacatgcaag

SEQ ID NO: 305426 - DNA, 15 bp, Homo sapiens
gcagagaacatgcaa

SEQ ID NO: 305427 - DNA, 15 bp, Homo sapiens
ggcagagaacatgca

SEQ ID NO: 305428 - DNA, 15 bp, Homo sapiens
gggcagagaacatgc

SEQ ID NO: 305429 - DNA, 15 bp, Homo sapiens
agggcagagaacatg

SEQ ID NO: 305430 - DNA, 15 bp, Homo sapiens
cagggcagagaacat

SEQ ID NO: 305431 - DNA, 15 bp, Homo sapiens
acagggcagagaaca

SEQ ID NO: 305432 - DNA, 15 bp, Homo sapiens
gacagggcagagaac

SEQ ID NO: 305433 - DNA, 15 bp, Homo sapiens
tgacagggcagagaa

SEQ ID NO: 305434 - DNA, 15 bp, Homo sapiens
gtgacagggcagaga

SEQ ID NO: 305435 - DNA, 15 bp, Homo sapiens
ggtgacagggcagag

SEQ ID NO: 305436 - DNA, 15 bp, Homo sapiens
aggtgacagggcaga

SEQ ID NO: 305437 - DNA, 15 bp, Homo sapiens
aaggtgacagggcag

SEQ ID NO: 305438 - DNA, 15 bp, Homo sapiens
gaaggtgacagggca

SEQ ID NO: 305439 - DNA, 15 bp, Homo sapiens
ggaaggtgacagggc

SEQ ID NO: 305440 - DNA, 15 bp, Homo sapiens
tggaaggtgacaggg

SEQ ID NO: 305441 - DNA, 15 bp, Homo sapiens
gtggaaggtgacagg

SEQ ID NO: 305442 - DNA, 15 bp, Homo sapiens
ggtggaaggtgacag

SEQ ID NO: 305443 - DNA, 15 bp, Homo sapiens
tggtggaaggtgaca

SEQ ID NO: 305444 - DNA, 15 bp, Homo sapiens
atggtggaaggtgac

SEQ ID NO: 305445 - DNA, 15 bp, Homo sapiens
tatggtggaaggtga

SEQ ID NO: 305446 - DNA, 15 bp, Homo sapiens
ctatggtggaaggtg

SEQ ID NO: 305447 - DNA, 15 bp, Homo sapiens
cctatggtggaaggt

SEQ ID NO: 305448 - DNA, 15 bp, Homo sapiens
tcctatggtggaagg

SEQ ID NO: 305449 - DNA, 15 bp, Homo sapiens
atcctatggtggaag

SEQ ID NO: 305450 - DNA, 15 bp, Homo sapiens
catcctatggtggaa

SEQ ID NO: 305451 - DNA, 15 bp, Homo sapiens
tcatcctatggtgga

SEQ ID NO: 305452 - DNA, 15 bp, Homo sapiens
gtcatcctatggtgg

SEQ ID NO: 305453 - DNA, 15 bp, Homo sapiens
cgtcatcctatggtg

SEQ ID NO: 305454 - DNA, 15 bp, Homo sapiens
gcgtcatcctatggt

SEQ ID NO: 305455 - DNA, 15 bp, Homo sapiens
tgcgtcatcctatgg

SEQ ID NO: 305456 - DNA, 15 bp, Homo sapiens
ctgcgtcatcctatg

SEQ ID NO: 305457 - DNA, 15 bp, Homo sapiens
gctgcgtcatcctat

SEQ ID NO: 305458 - DNA, 15 bp, Homo sapiens
tgctgcgtcatccta

SEQ ID NO: 305459 - DNA, 15 bp, Homo sapiens
ttgctgcgtcatcct

SEQ ID NO: 305460 - DNA, 15 bp, Homo sapiens
cttgctgcgtcatcc

SEQ ID NO: 305461 - DNA, 15 bp, Homo sapiens
tcttgctgcgtcatc

SEQ ID NO: 305462 - DNA, 15 bp, Homo sapiens
gtcttgctgcgtcat

SEQ ID NO: 305463 - DNA, 15 bp, Homo sapiens
tgtcttgctgcgtca

SEQ ID NO: 305464 - DNA, 15 bp, Homo sapiens
ctgtcttgctgcgtc

SEQ ID NO: 305465 - DNA, 15 bp, Homo sapiens
cctgtcttgctgcgt

SEQ ID NO: 305466 - DNA, 15 bp, Homo sapiens
gcctgtcttgctgcg

SEQ ID NO: 305467 - DNA, 15 bp, Homo sapiens
ggcctgtcttgctgc

SEQ ID NO: 305468 - DNA, 15 bp, Homo sapiens
aggcctgtcttgctg

SEQ ID NO: 305469 - DNA, 15 bp, Homo sapiens
aaggcctgtcttgct

SEQ ID NO: 305470 - DNA, 15 bp, Homo sapiens
taaggcctgtcttgc

SEQ ID NO: 305471 - DNA, 15 bp, Homo sapiens
gtaaggcctgtcttg

SEQ ID NO: 305472 - DNA, 15 bp, Homo sapiens
ggtaaggcctgtctt

SEQ ID NO: 305473 - DNA, 15 bp, Homo sapiens
tggtaaggcctgtct

SEQ ID NO: 305474 - DNA, 15 bp, Homo sapiens
ctggtaaggcctgtc

SEQ ID NO: 305475 - DNA, 15 bp, Homo sapiens
tctggtaaggcctgt

SEQ ID NO: 305476 - DNA, 15 bp, Homo sapiens
atctggtaaggcctg

SEQ ID NO: 305477 - DNA, 15 bp, Homo sapiens
catctggtaaggcct

SEQ ID NO: 305478 - DNA, 15 bp, Homo sapiens
gcatctggtaaggcc

SEQ ID NO: 305479 - DNA, 15 bp, Homo sapiens
agcatctggtaaggc

SEQ ID NO: 305480 - DNA, 15 bp, Homo sapiens
cagcatctggtaagg

SEQ ID NO: 305481 - DNA, 15 bp, Homo sapiens
ccagcatctggtaag

SEQ ID NO: 305482 - DNA, 15 bp, Homo sapiens
gccagcatctggtaa

SEQ ID NO: 305483 - DNA, 15 bp, Homo sapiens
tgccagcatctggta

SEQ ID NO: 305484 - DNA, 15 bp, Homo sapiens
gtgccagcatctggt

SEQ ID NO: 305485 - DNA, 15 bp, Homo sapiens
ggtgccagcatctgg

SEQ ID NO: 305486 - DNA, 15 bp, Homo sapiens
aggtgccagcatctg

SEQ ID NO: 305487 - DNA, 15 bp, Homo sapiens
aaggtgccagcatct

SEQ ID NO: 305488 - DNA, 15 bp, Homo sapiens
caaggtgccagcatc

SEQ ID NO: 305489 - DNA, 15 bp, Homo sapiens
tcaaggtgccagcat

SEQ ID NO: 305490 - DNA, 15 bp, Homo sapiens
atcaaggtgccagca

SEQ ID NO: 305491 - DNA, 15 bp, Homo sapiens
tatcaaggtgccagc

SEQ ID NO: 305492 - DNA, 15 bp, Homo sapiens
atatcaaggtgccag

SEQ ID NO: 305493 - DNA, 15 bp, Homo sapiens
aatatcaaggtgcca

SEQ ID NO: 305494 - DNA, 15 bp, Homo sapiens
caatatcaaggtgcc

SEQ ID NO: 305495 - DNA, 15 bp, Homo sapiens
ccaatatcaaggtgc

SEQ ID NO: 305496 - DNA, 15 bp, Homo sapiens
tccaatatcaaggtg

SEQ ID NO: 305497 - DNA, 15 bp, Homo sapiens
gtccaatatcaaggt

SEQ ID NO: 305498 - DNA, 15 bp, Homo sapiens
agtccaatatcaagg

SEQ ID NO: 305499 - DNA, 15 bp, Homo sapiens
aagtccaatatcaag

SEQ ID NO: 305500 - DNA, 15 bp, Homo sapiens
gaagtccaatatcaa

SEQ ID NO: 305501 - DNA, 15 bp, Homo sapiens
ggaagtccaatatca

SEQ ID NO: 305502 - DNA, 15 bp, Homo sapiens
gggaagtccaatatc

SEQ ID NO: 305503 - DNA, 15 bp, Homo sapiens
tgggaagtccaatat

SEQ ID NO: 305504 - DNA, 15 bp, Homo sapiens
ttgggaagtccaata

SEQ ID NO: 305505 - DNA, 15 bp, Homo sapiens
gttgggaagtccaat

SEQ ID NO: 305506 - DNA, 15 bp, Homo sapiens
ggttgggaagtccaa

SEQ ID NO: 305507 - DNA, 15 bp, Homo sapiens
aggttgggaagtcca

SEQ ID NO: 305508 - DNA, 15 bp, Homo sapiens
gaggttgggaagtcc

SEQ ID NO: 305509 - DNA, 15 bp, Homo sapiens
ggaggttgggaagtc

SEQ ID NO: 305510 - DNA, 15 bp, Homo sapiens
tggaggttgggaagt

SEQ ID NO: 305511 - DNA, 15 bp, Homo sapiens
ctggaggttgggaag

SEQ ID NO: 305512 - DNA, 15 bp, Homo sapiens
tctggaggttgggaa

SEQ ID NO: 305513 - DNA, 15 bp, Homo sapiens
ttctggaggttggga

SEQ ID NO: 305514 - DNA, 15 bp, Homo sapiens
gttctggaggttggg

SEQ ID NO: 305515 - DNA, 15 bp, Homo sapiens
cgttctggaggttgg

SEQ ID NO: 305516 - DNA, 15 bp, Homo sapiens
gcgttctggaggttg

SEQ ID NO: 305517 - DNA, 15 bp, Homo sapiens
agcgttctggaggtt

SEQ ID NO: 305518 - DNA, 15 bp, Homo sapiens
cagcgttctggaggt

SEQ ID NO: 305519 - DNA, 15 bp, Homo sapiens
tcagcgttctggagg

SEQ ID NO: 305520 - DNA, 15 bp, Homo sapiens
ctcagcgttctggag

SEQ ID NO: 305521 - DNA, 15 bp, Homo sapiens
tctcagcgttctgga

SEQ ID NO: 305522 - DNA, 15 bp, Homo sapiens
ttctcagcgttctgg

SEQ ID NO: 305523 - DNA, 15 bp, Homo sapiens
tttctcagcgttctg

SEQ ID NO: 305524 - DNA, 15 bp, Homo sapiens
atttctcagcgttct

SEQ ID NO: 305525 - DNA, 15 bp, Homo sapiens
tatttctcagcgttc

SEQ ID NO: 305526 - DNA, 15 bp, Homo sapiens
ttatttctcagcgtt

SEQ ID NO: 305527 - DNA, 15 bp, Homo sapiens
tttatttctcagcgt

SEQ ID NO: 305528 - DNA, 15 bp, Homo sapiens
atttatttctcagcg

SEQ ID NO: 305529 - DNA, 15 bp, Homo sapiens
aatttatttctcagc

SEQ ID NO: 305530 - DNA, 15 bp, Homo sapiens
aaatttatttctcag

SEQ ID NO: 305531 - DNA, 15 bp, Homo sapiens
gaaatttatttctca

SEQ ID NO: 305532 - DNA, 15 bp, Homo sapiens
agaaatttatttctc

SEQ ID NO: 305533 - DNA, 15 bp, Homo sapiens
aagaaatttatttct

SEQ ID NO: 305534 - DNA, 15 bp, Homo sapiens
aaagaaatttatttc

SEQ ID NO: 305535 - DNA, 15 bp, Homo sapiens
aaaagaaatttattt

SEQ ID NO: 305536 - DNA, 15 bp, Homo sapiens
gaaaagaaatttatt

SEQ ID NO: 305537 - DNA, 15 bp, Homo sapiens
agaaaagaaatttat

SEQ ID NO: 305538 - DNA, 15 bp, Homo sapiens
aagaaaagaaattta

SEQ ID NO: 305539 - DNA, 15 bp, Homo sapiens
aaagaaaagaaattt

SEQ ID NO: 305540 - DNA, 15 bp, Homo sapiens
caaagaaaagaaatt

SEQ ID NO: 305541 - DNA, 15 bp, Homo sapiens
acaaagaaaagaaat

SEQ ID NO: 305542 - DNA, 15 bp, Homo sapiens
tacaaagaaaagaaa

SEQ ID NO: 305543 - DNA, 15 bp, Homo sapiens
ttacaaagaaaagaa

SEQ ID NO: 305544 - DNA, 15 bp, Homo sapiens
tttacaaagaaaaga

SEQ ID NO: 305545 - DNA, 15 bp, Homo sapiens
atttacaaagaaaag

SEQ ID NO: 305546 - DNA, 15 bp, Homo sapiens
aatttacaaagaaaa

SEQ ID NO: 305547 - DNA, 15 bp, Homo sapiens
taatttacaaagaaa

SEQ ID NO: 305548 - DNA, 15 bp, Homo sapiens
gtaatttacaaagaa

SEQ ID NO: 305549 - DNA, 15 bp, Homo sapiens
ggtaatttacaaaga

SEQ ID NO: 305550 - DNA, 15 bp, Homo sapiens
ttgggtaatttacaa

SEQ ID NO: 305551 - DNA, 15 bp, Homo sapiens
attgggtaatttaca

SEQ ID NO: 305552 - DNA, 15 bp, Homo sapiens
gattgggtaatttac

SEQ ID NO: 305553 - DNA, 15 bp, Homo sapiens
agattgggtaattta

SEQ ID NO: 305554 - DNA, 15 bp, Homo sapiens
cagattgggtaattt

SEQ ID NO: 305555 - DNA, 15 bp, Homo sapiens
acagattgggtaatt

SEQ ID NO: 305556 - DNA, 15 bp, Homo sapiens
cacagattgggtaat

SEQ ID NO: 305557 - DNA, 15 bp, Homo sapiens
ccacagattgggtaa

SEQ ID NO: 305558 - DNA, 15 bp, Homo sapiens
accacagattgggta

SEQ ID NO: 305559 - DNA, 15 bp, Homo sapiens
taccacagattgggt

SEQ ID NO: 305560 - DNA, 15 bp, Homo sapiens
ataccacagattggg

SEQ ID NO: 305561 - DNA, 15 bp, Homo sapiens
aataccacagattgg

SEQ ID NO: 305562 - DNA, 15 bp, Homo sapiens
gaataccacagattg

SEQ ID NO: 305563 - DNA, 15 bp, Homo sapiens
agaataccacagatt

SEQ ID NO: 305564 - DNA, 15 bp, Homo sapiens
cagaataccacagat

SEQ ID NO: 305565 - DNA, 15 bp, Homo sapiens
acagaataccacaga

SEQ ID NO: 305566 - DNA, 15 bp, Homo sapiens
aacagaataccacag

SEQ ID NO: 305567 - DNA, 15 bp, Homo sapiens
taacagaataccaca

SEQ ID NO: 305568 - DNA, 15 bp, Homo sapiens
ataacagaataccac

SEQ ID NO: 305569 - DNA, 15 bp, Homo sapiens
tataacagaatacca

SEQ ID NO: 305570 - DNA, 15 bp, Homo sapiens
ctataacagaatacc

SEQ ID NO: 305571 - DNA, 15 bp, Homo sapiens
ttgctataacagaat

SEQ ID NO: 305572 - DNA, 15 bp, Homo sapiens
gttgctataacagaa

SEQ ID NO: 305573 - DNA, 15 bp, Homo sapiens
tgttgctataacaga

SEQ ID NO: 305574 - DNA, 15 bp, Homo sapiens
gtgttgctataacag

SEQ ID NO: 305575 - DNA, 15 bp, Homo sapiens
tgtgttgctataaca

SEQ ID NO: 305576 - DNA, 15 bp, Homo sapiens
ttgtgttgctataac

SEQ ID NO: 305577 - DNA, 15 bp, Homo sapiens
tttgtgttgctataa

SEQ ID NO: 305578 - DNA, 15 bp, Homo sapiens
ttttgtgttgctata

SEQ ID NO: 305579 - DNA, 15 bp, Homo sapiens
attttgtgttgctat

SEQ ID NO: 305580 - DNA, 15 bp, Homo sapiens
tattttgtgttgcta

SEQ ID NO: 305581 - DNA, 15 bp, Homo sapiens
ctattttgtgttgct

SEQ ID NO: 305582 - DNA, 15 bp, Homo sapiens
tctattttgtgttgc

SEQ ID NO: 305583 - DNA, 15 bp, Homo sapiens
ttctattttgtgttg

SEQ ID NO: 305584 - DNA, 15 bp, Homo sapiens
attctattttgtgtt

SEQ ID NO: 305585 - DNA, 15 bp, Homo sapiens
tattctattttgtgt

SEQ ID NO: 305586 - DNA, 15 bp, Homo sapiens
ttattctattttgtg

SEQ ID NO: 305587 - DNA, 15 bp, Homo sapiens
tttattctattttgt

SEQ ID NO: 305588 - DNA, 15 bp, Homo sapiens
ctttattctattttg

SEQ ID NO: 305589 - DNA, 15 bp, Homo sapiens
tctttattctatttt

SEQ ID NO: 305590 - DNA, 15 bp, Homo sapiens
atctttattctattt

SEQ ID NO: 305591 - DNA, 15 bp, Homo sapiens
catctttattctatt

SEQ ID NO: 305592 - DNA, 15 bp, Homo sapiens
acatctttattctat

SEQ ID NO: 305593 - DNA, 15 bp, Homo sapiens
tacatctttattcta

SEQ ID NO: 305594 - DNA, 15 bp, Homo sapiens
atacatctttattct

SEQ ID NO: 305595 - DNA, 15 bp, Homo sapiens
tatacatctttattc

SEQ ID NO: 305596 - DNA, 15 bp, Homo sapiens
gtatacatctttatt

SEQ ID NO: 305597 - DNA, 15 bp, Homo sapiens
agtatacatctttat

SEQ ID NO: 305598 - DNA, 15 bp, Homo sapiens
cagtatacatcttta

SEQ ID NO: 305599 - DNA, 15 bp, Homo sapiens
acagtatacatcttt

SEQ ID NO: 305600 - DNA, 15 bp, Homo sapiens
cacagtatacatctt

SEQ ID NO: 305601 - DNA, 15 bp, Homo sapiens
gcacagtatacatct

SEQ ID NO: 305602 - DNA, 15 bp, Homo sapiens
ggcacagtatacatc

SEQ ID NO: 305603 - DNA, 15 bp, Homo sapiens
aggcacagtatacat

SEQ ID NO: 305604 - DNA, 15 bp, Homo sapiens
aaggcacagtataca

SEQ ID NO: 305605 - DNA, 15 bp, Homo sapiens
gaaggcacagtatac

SEQ ID NO: 305606 - DNA, 15 bp, Homo sapiens
tgaaggcacagtata

SEQ ID NO: 305607 - DNA, 15 bp, Homo sapiens
ttgaaggcacagtat

SEQ ID NO: 305608 - DNA, 15 bp, Homo sapiens
cttgaaggcacagta

SEQ ID NO: 305609 - DNA, 15 bp, Homo sapiens
acttgaaggcacagt

SEQ ID NO: 305610 - DNA, 15 bp, Homo sapiens
aacttgaaggcacag

SEQ ID NO: 305611 - DNA, 15 bp, Homo sapiens
caacttgaaggcaca

SEQ ID NO: 305612 - DNA, 15 bp, Homo sapiens
acaacttgaaggcac

SEQ ID NO: 305613 - DNA, 15 bp, Homo sapiens
aacaacttgaaggca

SEQ ID NO: 305614 - DNA, 15 bp, Homo sapiens
taacaacttgaaggc

SEQ ID NO: 305615 - DNA, 15 bp, Homo sapiens
ataacaacttgaagg

SEQ ID NO: 305616 - DNA, 15 bp, Homo sapiens
tataacaacttgaag

SEQ ID NO: 305617 - DNA, 15 bp, Homo sapiens
atataacaacttgaa

SEQ ID NO: 305618 - DNA, 15 bp, Homo sapiens
tatataacaacttga

SEQ ID NO: 305619 - DNA, 15 bp, Homo sapiens
atatataacaacttg

SEQ ID NO: 305620 - DNA, 15 bp, Homo sapiens
gatatataacaactt

SEQ ID NO: 305621 - DNA, 15 bp, Homo sapiens
tgatatataacaact

SEQ ID NO: 305622 - DNA, 15 bp, Homo sapiens
gtgatatataacaac

SEQ ID NO: 305623 - DNA, 15 bp, Homo sapiens
tgtgatatataacaa

SEQ ID NO: 305624 - DNA, 15 bp, Homo sapiens
atgtgatatataaca

SEQ ID NO: 305625 - DNA, 15 bp, Homo sapiens
tatgtgatatataac

SEQ ID NO: 305626 - DNA, 15 bp, Homo sapiens
atatgtgatatataa

SEQ ID NO: 305627 - DNA, 15 bp, Homo sapiens
tatatgtgatatata

SEQ ID NO: 305628 - DNA, 15 bp, Homo sapiens
atatatgtgatatat

SEQ ID NO: 305629 - DNA, 15 bp, Homo sapiens
tatatatgtgatata

SEQ ID NO: 305630 - DNA, 15 bp, Homo sapiens
atatatatgtgatat

SEQ ID NO: 305631 - DNA, 15 bp, Homo sapiens
tatatatatgtgata

SEQ ID NO: 305632 - DNA, 15 bp, Homo sapiens
atatatatatgtgat

SEQ ID NO: 305633 - DNA, 15 bp, Homo sapiens
tatatatatatgtga

SEQ ID NO: 305634 - DNA, 15 bp, Homo sapiens
ttatatatatatgtg

SEQ ID NO: 305635 - DNA, 15 bp, Homo sapiens
attatatatatatgt

SEQ ID NO: 305636 - DNA, 15 bp, Homo sapiens
tattatatatatatg

SEQ ID NO: 305637 - DNA, 15 bp, Homo sapiens
catatatattatata

SEQ ID NO: 305638 - DNA, 15 bp, Homo sapiens
acatatatattatat

SEQ ID NO: 305639 - DNA, 15 bp, Homo sapiens
aacatatatattata

SEQ ID NO: 305640 - DNA, 15 bp, Homo sapiens
taacatatatattat

SEQ ID NO: 305641 - DNA, 15 bp, Homo sapiens
gtaacatatatatta

SEQ ID NO: 305642 - DNA, 15 bp, Homo sapiens
tgtaacatatatatt

SEQ ID NO: 305643 - DNA, 15 bp, Homo sapiens
ttgtaacatatatat

SEQ ID NO: 305644 - DNA, 15 bp, Homo sapiens
attgtaacatatata

SEQ ID NO: 305645 - DNA, 15 bp, Homo sapiens
gattgtaacatatat

SEQ ID NO: 305646 - DNA, 15 bp, Homo sapiens
tgattgtaacatata

SEQ ID NO: 305647 - DNA, 15 bp, Homo sapiens
ttgattgtaacatat

SEQ ID NO: 305648 - DNA, 15 bp, Homo sapiens
cttgattgtaacata

SEQ ID NO: 305649 - DNA, 15 bp, Homo sapiens
ccttgattgtaacat

SEQ ID NO: 305650 - DNA, 15 bp, Homo sapiens
gccttgattgtaaca

SEQ ID NO: 305651 - DNA, 15 bp, Homo sapiens
tgccttgattgtaac

SEQ ID NO: 305652 - DNA, 15 bp, Homo sapiens
gtgccttgattgtaa

SEQ ID NO: 305653 - DNA, 15 bp, Homo sapiens
tgtgccttgattgta

SEQ ID NO: 305654 - DNA, 15 bp, Homo sapiens
ctgtgccttgattgt

SEQ ID NO: 305655 - DNA, 15 bp, Homo sapiens
actgtgccttgattg

SEQ ID NO: 305656 - DNA, 15 bp, Homo sapiens
tactgtgccttgatt

SEQ ID NO: 305657 - DNA, 15 bp, Homo sapiens
atactgtgccttgat

SEQ ID NO: 305658 - DNA, 15 bp, Homo sapiens
tatactgtgccttga

SEQ ID NO: 305659 - DNA, 15 bp, Homo sapiens
gtatactgtgccttg

SEQ ID NO: 305660 - DNA, 15 bp, Homo sapiens
agtatactgtgcctt

SEQ ID NO: 305661 - DNA, 15 bp, Homo sapiens
tagtatactgtgcct

SEQ ID NO: 305662 - DNA, 15 bp, Homo sapiens
atagtatactgtgcc

SEQ ID NO: 305663 - DNA, 15 bp, Homo sapiens
tatagtatactgtgc

SEQ ID NO: 305664 - DNA, 15 bp, Homo sapiens
atatagtatactgtg

SEQ ID NO: 305665 - DNA, 15 bp, Homo sapiens
tatatagtatactgt

SEQ ID NO: 305666 - DNA, 15 bp, Homo sapiens
atatatagtatactg

SEQ ID NO: 305667 - DNA, 15 bp, Homo sapiens
tatatatagtatact

SEQ ID NO: 305668 - DNA, 15 bp, Homo sapiens
gtatatatagtatac

SEQ ID NO: 305669 - DNA, 15 bp, Homo sapiens
agtatatatagtata

SEQ ID NO: 305670 - DNA, 15 bp, Homo sapiens
cagtatatatagtat

SEQ ID NO: 305671 - DNA, 15 bp, Homo sapiens
acagtatatatagta

SEQ ID NO: 305672 - DNA, 15 bp, Homo sapiens
cacagtatatatagt

SEQ ID NO: 305673 - DNA, 15 bp, Homo sapiens
tcacagtatatatag

SEQ ID NO: 305674 - DNA, 15 bp, Homo sapiens
ttcacagtatatata

SEQ ID NO: 305675 - DNA, 15 bp, Homo sapiens
cttcacagtatatat

SEQ ID NO: 305676 - DNA, 15 bp, Homo sapiens
ccttcacagtatata

SEQ ID NO: 305677 - DNA, 15 bp, Homo sapiens
gccttcacagtatat

SEQ ID NO: 305678 - DNA, 15 bp, Homo sapiens
tgccttcacagtata

SEQ ID NO: 305679 - DNA, 15 bp, Homo sapiens
atgccttcacagtat

SEQ ID NO: 305680 - DNA, 15 bp, Homo sapiens
tatgccttcacagta

SEQ ID NO: 305681 - DNA, 15 bp, Homo sapiens
ctatgccttcacagt

SEQ ID NO: 305682 - DNA, 15 bp, Homo sapiens
tctatgccttcacag

SEQ ID NO: 305683 - DNA, 15 bp, Homo sapiens
ctctatgccttcaca

SEQ ID NO: 305684 - DNA, 15 bp, Homo sapiens
tctctatgccttcac

SEQ ID NO: 305685 - DNA, 15 bp, Homo sapiens
atctctatgccttca

SEQ ID NO: 305686 - DNA, 15 bp, Homo sapiens
tatctctatgccttc

SEQ ID NO: 305687 - DNA, 15 bp, Homo sapiens
ctatctctatgcctt

SEQ ID NO: 305688 - DNA, 15 bp, Homo sapiens
tctatctctatgcct

SEQ ID NO: 305689 - DNA, 15 bp, Homo sapiens
atctatctctatgcc

SEQ ID NO: 305690 - DNA, 15 bp, Homo sapiens
catctatctctatgc

SEQ ID NO: 305691 - DNA, 15 bp, Homo sapiens
tcatctatctctatg

SEQ ID NO: 305692 - DNA, 15 bp, Homo sapiens
atcatctatctctat

SEQ ID NO: 305693 - DNA, 15 bp, Homo sapiens
tatcatctatctcta

SEQ ID NO: 305694 - DNA, 15 bp, Homo sapiens
ctatcatctatctct

SEQ ID NO: 305695 - DNA, 15 bp, Homo sapiens
tctatcatctatctc

SEQ ID NO: 305696 - DNA, 15 bp, Homo sapiens
atctatcatctatct

SEQ ID NO: 305697 - DNA, 15 bp, Homo sapiens
catctatcatctatc

SEQ ID NO: 305698 - DNA, 15 bp, Homo sapiens
tcatctatcatctat

SEQ ID NO: 305699 - DNA, 15 bp, Homo sapiens
atcatctatcatcta

SEQ ID NO: 305700 - DNA, 15 bp, Homo sapiens
tatcatctatcatct

SEQ ID NO: 305701 - DNA, 15 bp, Homo sapiens
ctatcatctatcatc

SEQ ID NO: 305702 - DNA, 15 bp, Homo sapiens
tctatcatctatcat

SEQ ID NO: 305703 - DNA, 15 bp, Homo sapiens
atctatcatctatca

SEQ ID NO: 305704 - DNA, 15 bp, Homo sapiens
tatctatcatctatc

SEQ ID NO: 305705 - DNA, 15 bp, Homo sapiens
atatctatcatctat

SEQ ID NO: 305706 - DNA, 15 bp, Homo sapiens
tatatctatcatcta

SEQ ID NO: 305707 - DNA, 15 bp, Homo sapiens
ctatatctatcatct

SEQ ID NO: 305708 - DNA, 15 bp, Homo sapiens
tctatatctatcatc

SEQ ID NO: 305709 - DNA, 15 bp, Homo sapiens
atctatatctatcat

SEQ ID NO: 305710 - DNA, 15 bp, Homo sapiens
tatctatatctatca

SEQ ID NO: 305711 - DNA, 15 bp, Homo sapiens
ctatctatatctatc

SEQ ID NO: 305712 - DNA, 15 bp, Homo sapiens
tctatctatatctat

SEQ ID NO: 305713 - DNA, 15 bp, Homo sapiens
atctatctatatcta

SEQ ID NO: 305714 - DNA, 15 bp, Homo sapiens
tatctatctatatct

SEQ ID NO: 305715 - DNA, 15 bp, Homo sapiens
ctatctatctatatc

SEQ ID NO: 305716 - DNA, 15 bp, Homo sapiens
tatctatctatctat

SEQ ID NO: 305717 - DNA, 15 bp, Homo sapiens
ctatctatctatcta

SEQ ID NO: 305718 - DNA, 15 bp, Homo sapiens
tctatctatctatct

SEQ ID NO: 305719 - DNA, 15 bp, Homo sapiens
atctatctatctatc

SEQ ID NO: 305720 - DNA, 15 bp, Homo sapiens
catctatctatctat

SEQ ID NO: 305721 - DNA, 15 bp, Homo sapiens
tcatctatctatcta

SEQ ID NO: 305722 - DNA, 15 bp, Homo sapiens
atcatctatctatct

SEQ ID NO: 305723 - DNA, 15 bp, Homo sapiens
tatcatctatctatc

SEQ ID NO: 305724 - DNA, 15 bp, Homo sapiens
ctatcatctatctat

SEQ ID NO: 305725 - DNA, 15 bp, Homo sapiens
tctatcatctatcta

SEQ ID NO: 305726 - DNA, 15 bp, Homo sapiens
ctatctatcatctat

SEQ ID NO: 305727 - DNA, 15 bp, Homo sapiens
tctatctatcatcta

SEQ ID NO: 305728 - DNA, 15 bp, Homo sapiens
atctatctatcatct

SEQ ID NO: 305729 - DNA, 15 bp, Homo sapiens
catctatctatcatc

SEQ ID NO: 305730 - DNA, 15 bp, Homo sapiens
tcatctatctatcat

SEQ ID NO: 305731 - DNA, 15 bp, Homo sapiens
atcatctatctatca

SEQ ID NO: 305732 - DNA, 15 bp, Homo sapiens
tatctatctatcatc

SEQ ID NO: 305733 - DNA, 15 bp, Homo sapiens
atatctatctatcat

SEQ ID NO: 305734 - DNA, 15 bp, Homo sapiens
tatatctatctatca

SEQ ID NO: 305735 - DNA, 15 bp, Homo sapiens
ctatatctatctatc

SEQ ID NO: 305736 - DNA, 15 bp, Homo sapiens
tctatatctatctat

SEQ ID NO: 305737 - DNA, 15 bp, Homo sapiens
atctatatctatcta

SEQ ID NO: 305738 - DNA, 15 bp, Homo sapiens
tatctatatctatct

SEQ ID NO: 305739 - DNA, 15 bp, Homo sapiens
catctatctatatct

SEQ ID NO: 305740 - DNA, 15 bp, Homo sapiens
tcatctatctatatc

SEQ ID NO: 305741 - DNA, 15 bp, Homo sapiens
atcatctatctatat

SEQ ID NO: 305742 - DNA, 15 bp, Homo sapiens
tatcatctatctata

SEQ ID NO: 305743 - DNA, 15 bp, Homo sapiens
ctatctatctatcat

SEQ ID NO: 305744 - DNA, 15 bp, Homo sapiens
tctatctatctatca

SEQ ID NO: 305745 - DNA, 15 bp, Homo sapiens
ctctatctatctatc

SEQ ID NO: 305746 - DNA, 15 bp, Homo sapiens
tctctatctatctat

SEQ ID NO: 305747 - DNA, 15 bp, Homo sapiens
atctctatctatcta

SEQ ID NO: 305748 - DNA, 15 bp, Homo sapiens
tatctctatctatct

SEQ ID NO: 305749 - DNA, 15 bp, Homo sapiens
ctatctctatctatc

SEQ ID NO: 305750 - DNA, 15 bp, Homo sapiens
tctatctctatctat

SEQ ID NO: 305751 - DNA, 15 bp, Homo sapiens
gtctatctctatcta

SEQ ID NO: 305752 - DNA, 15 bp, Homo sapiens
tgtctatctctatct

SEQ ID NO: 305753 - DNA, 15 bp, Homo sapiens
ctgtctatctctatc

SEQ ID NO: 305754 - DNA, 15 bp, Homo sapiens
tctgtctatctctat

SEQ ID NO: 305755 - DNA, 15 bp, Homo sapiens
gtctgtctatctcta

SEQ ID NO: 305756 - DNA, 15 bp, Homo sapiens
tgtctgtctatctct

SEQ ID NO: 305757 - DNA, 15 bp, Homo sapiens
ctgtctgtctatctc

SEQ ID NO: 305758 - DNA, 15 bp, Homo sapiens
tctgtctgtctatct

SEQ ID NO: 305759 - DNA, 15 bp, Homo sapiens
atctgtctgtctatc

SEQ ID NO: 305760 - DNA, 15 bp, Homo sapiens
tatctgtctgtctat

SEQ ID NO: 305761 - DNA, 15 bp, Homo sapiens
ttatctgtctgtcta

SEQ ID NO: 305762 - DNA, 15 bp, Homo sapiens
attatctgtctgtct

SEQ ID NO: 305763 - DNA, 15 bp, Homo sapiens
gattatctgtctgtc

SEQ ID NO: 305764 - DNA, 15 bp, Homo sapiens
agattatctgtctgt

SEQ ID NO: 305765 - DNA, 15 bp, Homo sapiens
aagattatctgtctg

SEQ ID NO: 305766 - DNA, 15 bp, Homo sapiens
aaagattatctgtct

SEQ ID NO: 305767 - DNA, 15 bp, Homo sapiens
caaagattatctgtc

SEQ ID NO: 305768 - DNA, 15 bp, Homo sapiens
acaaagattatctgt

SEQ ID NO: 305769 - DNA, 15 bp, Homo sapiens
tacaaagattatctg

SEQ ID NO: 305770 - DNA, 15 bp, Homo sapiens
ctacaaagattatct

SEQ ID NO: 305771 - DNA, 15 bp, Homo sapiens
actacaaagattatc

SEQ ID NO: 305772 - DNA, 15 bp, Homo sapiens
aactacaaagattat

SEQ ID NO: 305773 - DNA, 15 bp, Homo sapiens
aaactacaaagatta

SEQ ID NO: 305774 - DNA, 15 bp, Homo sapiens
caaactacaaagatt

SEQ ID NO: 305775 - DNA, 15 bp, Homo sapiens
gcaaactacaaagat

SEQ ID NO: 305776 - DNA, 15 bp, Homo sapiens
agcaaactacaaaga

SEQ ID NO: 305777 - DNA, 15 bp, Homo sapiens
gagcaaactacaaag

SEQ ID NO: 305778 - DNA, 15 bp, Homo sapiens
ggagcaaactacaaa

SEQ ID NO: 305779 - DNA, 15 bp, Homo sapiens
aggagcaaactacaa

SEQ ID NO: 305780 - DNA, 15 bp, Homo sapiens
caggagcaaactaca

SEQ ID NO: 305781 - DNA, 15 bp, Homo sapiens
acaggagcaaactac

SEQ ID NO: 305782 - DNA, 15 bp, Homo sapiens
cacaggagcaaacta

SEQ ID NO: 305783 - DNA, 15 bp, Homo sapiens
acacaggagcaaact

SEQ ID NO: 305784 - DNA, 15 bp, Homo sapiens
tacacaggagcaaac

SEQ ID NO: 305785 - DNA, 15 bp, Homo sapiens
atacacaggagcaaa

SEQ ID NO: 305786 - DNA, 15 bp, Homo sapiens
gatacacaggagcaa

SEQ ID NO: 305787 - DNA, 15 bp, Homo sapiens
agatacacaggagca

SEQ ID NO: 305788 - DNA, 15 bp, Homo sapiens
aagatacacaggagc

SEQ ID NO: 305789 - DNA, 15 bp, Homo sapiens
aaagatacacaggag

SEQ ID NO: 305790 - DNA, 15 bp, Homo sapiens
aaaagatacacagga

SEQ ID NO: 305791 - DNA, 15 bp, Homo sapiens
gaaaagatacacagg

SEQ ID NO: 305792 - DNA, 15 bp, Homo sapiens
agaaaagatacacag

SEQ ID NO: 305793 - DNA, 15 bp, Homo sapiens
gagaaaagatacaca

SEQ ID NO: 305794 - DNA, 15 bp, Homo sapiens
ggagaaaagatacac

SEQ ID NO: 305795 - DNA, 15 bp, Homo sapiens
gggagaaaagataca

SEQ ID NO: 305796 - DNA, 15 bp, Homo sapiens
tgggagaaaagatac

SEQ ID NO: 305797 - DNA, 15 bp, Homo sapiens
gtgggagaaaagata

SEQ ID NO: 305798 - DNA, 15 bp, Homo sapiens
ggtgggagaaaagat

SEQ ID NO: 305799 - DNA, 15 bp, Homo sapiens
gggtgggagaaaaga

SEQ ID NO: 305800 - DNA, 15 bp, Homo sapiens
tgggtgggagaaaag

SEQ ID NO: 305801 - DNA, 15 bp, Homo sapiens
gtgggtgggagaaaa

SEQ ID NO: 305802 - DNA, 15 bp, Homo sapiens
tgtgggtgggagaaa

SEQ ID NO: 305803 - DNA, 15 bp, Homo sapiens
atgtgggtgggagaa

SEQ ID NO: 305804 - DNA, 15 bp, Homo sapiens
aatgtgggtgggaga

SEQ ID NO: 305805 - DNA, 15 bp, Homo sapiens
gaatgtgggtgggag

SEQ ID NO: 305806 - DNA, 15 bp, Homo sapiens
tgaatgtgggtggga

SEQ ID NO: 305807 - DNA, 15 bp, Homo sapiens
gtgaatgtgggtggg

SEQ ID NO: 305808 - DNA, 15 bp, Homo sapiens
agtgaatgtgggtgg

SEQ ID NO: 305809 - DNA, 15 bp, Homo sapiens
cagtgaatgtgggtg

SEQ ID NO: 305810 - DNA, 15 bp, Homo sapiens
acagtgaatgtgggt

SEQ ID NO: 305811 - DNA, 15 bp, Homo sapiens
aacagtgaatgtggg

SEQ ID NO: 305812 - DNA, 15 bp, Homo sapiens
aaacagtgaatgtgg

SEQ ID NO: 305813 - DNA, 15 bp, Homo sapiens
gaaacagtgaatgtg

SEQ ID NO: 305814 - DNA, 15 bp, Homo sapiens
tgaaacagtgaatgt

SEQ ID NO: 305815 - DNA, 15 bp, Homo sapiens
ctgaaacagtgaatg

SEQ ID NO: 305816 - DNA, 15 bp, Homo sapiens
actgaaacagtgaat

SEQ ID NO: 305817 - DNA, 15 bp, Homo sapiens
tactgaaacagtgaa

SEQ ID NO: 305818 - DNA, 15 bp, Homo sapiens
atactgaaacagtga

SEQ ID NO: 305819 - DNA, 15 bp, Homo sapiens
catactgaaacagtg

SEQ ID NO: 305820 - DNA, 15 bp, Homo sapiens
gcatactgaaacagt

SEQ ID NO: 305821 - DNA, 15 bp, Homo sapiens
ggcatactgaaacag

SEQ ID NO: 305822 - DNA, 15 bp, Homo sapiens
tggcatactgaaaca

SEQ ID NO: 305823 - DNA, 15 bp, Homo sapiens
ctggcatactgaaac

SEQ ID NO: 305824 - DNA, 15 bp, Homo sapiens
gctggcatactgaaa

SEQ ID NO: 305825 - DNA, 15 bp, Homo sapiens
agctggcatactgaa

SEQ ID NO: 305826 - DNA, 15 bp, Homo sapiens
aagctggcatactga

SEQ ID NO: 305827 - DNA, 15 bp, Homo sapiens
aaagctggcatactg

SEQ ID NO: 305828 - DNA, 15 bp, Homo sapiens
aaaagctggcatact

SEQ ID NO: 305829 - DNA, 15 bp, Homo sapiens
aaaaagctggcatac

SEQ ID NO: 305830 - DNA, 15 bp, Homo sapiens
gaaaaagctggcata

SEQ ID NO: 305831 - DNA, 15 bp, Homo sapiens
tgaaaaagctggcat

SEQ ID NO: 305832 - DNA, 15 bp, Homo sapiens
ttgaaaaagctggca

SEQ ID NO: 305833 - DNA, 15 bp, Homo sapiens
tttgaaaaagctggc

SEQ ID NO: 305834 - DNA, 15 bp, Homo sapiens
ctttgaaaaagctgg

SEQ ID NO: 305835 - DNA, 15 bp, Homo sapiens
cctttgaaaaagctg

SEQ ID NO: 305836 - DNA, 15 bp, Homo sapiens
gcctttgaaaaagct

SEQ ID NO: 305837 - DNA, 15 bp, Homo sapiens
ggcctttgaaaaagc

SEQ ID NO: 305838 - DNA, 15 bp, Homo sapiens
aggcctttgaaaaag

SEQ ID NO: 305839 - DNA, 15 bp, Homo sapiens
aaggcctttgaaaaa

SEQ ID NO: 305840 - DNA, 15 bp, Homo sapiens
aaaggcctttgaaaa

SEQ ID NO: 305841 - DNA, 15 bp, Homo sapiens
gaaaggcctttgaaa

SEQ ID NO: 305842 - DNA, 15 bp, Homo sapiens
agaaaggcctttgaa

SEQ ID NO: 305843 - DNA, 15 bp, Homo sapiens
tagaaaggcctttga

SEQ ID NO: 305844 - DNA, 15 bp, Homo sapiens
ttagaaaggcctttg

SEQ ID NO: 305845 - DNA, 15 bp, Homo sapiens
tttagaaaggccttt

SEQ ID NO: 305846 - DNA, 15 bp, Homo sapiens
atttagaaaggcctt

SEQ ID NO: 305847 - DNA, 15 bp, Homo sapiens
aatttagaaaggcct

SEQ ID NO: 305848 - DNA, 15 bp, Homo sapiens
gaatttagaaaggcc

SEQ ID NO: 305849 - DNA, 15 bp, Homo sapiens
tgaatttagaaaggc

SEQ ID NO: 305850 - DNA, 15 bp, Homo sapiens
atgaatttagaaagg

SEQ ID NO: 305851 - DNA, 15 bp, Homo sapiens
aatgaatttagaaag

SEQ ID NO: 305852 - DNA, 15 bp, Homo sapiens
taatgaatttagaaa

SEQ ID NO: 305853 - DNA, 15 bp, Homo sapiens
ctaatgaatttagaa

SEQ ID NO: 305854 - DNA, 15 bp, Homo sapiens
actaatgaatttaga

SEQ ID NO: 305855 - DNA, 15 bp, Homo sapiens
cactaatgaatttag

SEQ ID NO: 305856 - DNA, 15 bp, Homo sapiens
ccactaatgaattta

SEQ ID NO: 305857 - DNA, 15 bp, Homo sapiens
tccactaatgaattt

SEQ ID NO: 305858 - DNA, 15 bp, Homo sapiens
ctccactaatgaatt

SEQ ID NO: 305859 - DNA, 15 bp, Homo sapiens
tctccactaatgaat

SEQ ID NO: 305860 - DNA, 15 bp, Homo sapiens
ttctccactaatgaa

SEQ ID NO: 305861 - DNA, 15 bp, Homo sapiens
attctccactaatga

SEQ ID NO: 305862 - DNA, 15 bp, Homo sapiens
aattctccactaatg

SEQ ID NO: 305863 - DNA, 15 bp, Homo sapiens
aaattctccactaat

SEQ ID NO: 305864 - DNA, 15 bp, Homo sapiens
taaattctccactaa

SEQ ID NO: 305865 - DNA, 15 bp, Homo sapiens
ttaaattctccacta

SEQ ID NO: 305866 - DNA, 15 bp, Homo sapiens
attaaattctccact

SEQ ID NO: 305867 - DNA, 15 bp, Homo sapiens
cattaaattctccac

SEQ ID NO: 305868 - DNA, 15 bp, Homo sapiens
tcattaaattctcca

SEQ ID NO: 305869 - DNA, 15 bp, Homo sapiens
atcattaaattctcc

SEQ ID NO: 305870 - DNA, 15 bp, Homo sapiens
tatcattaaattctc

SEQ ID NO: 305871 - DNA, 15 bp, Homo sapiens
ttatcattaaattct

SEQ ID NO: 305872 - DNA, 15 bp, Homo sapiens
attatcattaaattc

SEQ ID NO: 305873 - DNA, 15 bp, Homo sapiens
gtattatcattaaat

SEQ ID NO: 305874 - DNA, 15 bp, Homo sapiens
tgtattatcattaaa

SEQ ID NO: 305875 - DNA, 15 bp, Homo sapiens
ctgtattatcattaa

SEQ ID NO: 305876 - DNA, 15 bp, Homo sapiens
actgtattatcatta

SEQ ID NO: 305877 - DNA, 15 bp, Homo sapiens
tactgtattatcatt

SEQ ID NO: 305878 - DNA, 15 bp, Homo sapiens
ttactgtattatcat

SEQ ID NO: 305879 - DNA, 15 bp, Homo sapiens
tttactgtattatca

SEQ ID NO: 305880 - DNA, 15 bp, Homo sapiens
gtttactgtattatc

SEQ ID NO: 305881 - DNA, 15 bp, Homo sapiens
ggtttactgtattat

SEQ ID NO: 305882 - DNA, 15 bp, Homo sapiens
tggtttactgtatta

SEQ ID NO: 305883 - DNA, 15 bp, Homo sapiens
gtggtttactgtatt

SEQ ID NO: 305884 - DNA, 15 bp, Homo sapiens
ggtggtttactgtat

SEQ ID NO: 305885 - DNA, 15 bp, Homo sapiens
tggtggtttactgta

SEQ ID NO: 305886 - DNA, 15 bp, Homo sapiens
gtggtggtttactgt

SEQ ID NO: 305887 - DNA, 15 bp, Homo sapiens
agtggtggtttactg

SEQ ID NO: 305888 - DNA, 15 bp, Homo sapiens
tagtggtggtttact

SEQ ID NO: 305889 - DNA, 15 bp, Homo sapiens
ttagtggtggtttac

SEQ ID NO: 305890 - DNA, 15 bp, Homo sapiens
gttagtggtggttta

SEQ ID NO: 305891 - DNA, 15 bp, Homo sapiens
cgttagtggtggttt

SEQ ID NO: 305892 - DNA, 15 bp, Homo sapiens
gcgttagtggtggtt

SEQ ID NO: 305893 - DNA, 15 bp, Homo sapiens
agcgttagtggtggt

SEQ ID NO: 305894 - DNA, 15 bp, Homo sapiens
tagcgttagtggtgg

SEQ ID NO: 305895 - DNA, 15 bp, Homo sapiens
gtagcgttagtggtg

SEQ ID NO: 305896 - DNA, 15 bp, Homo sapiens
agtagcgttagtggt

SEQ ID NO: 305897 - DNA, 15 bp, Homo sapiens
tagtagcgttagtgg

SEQ ID NO: 305898 - DNA, 15 bp, Homo sapiens
gtagtagcgttagtg

SEQ ID NO: 305899 - DNA, 15 bp, Homo sapiens
agtagtagcgttagt

SEQ ID NO: 305900 - DNA, 15 bp, Homo sapiens
aagtagtagcgttag

SEQ ID NO: 305901 - DNA, 15 bp, Homo sapiens
taagtagtagcgtta

SEQ ID NO: 305902 - DNA, 15 bp, Homo sapiens
ttaagtagtagcgtt

SEQ ID NO: 305903 - DNA, 15 bp, Homo sapiens
tttaagtagtagcgt

SEQ ID NO: 305904 - DNA, 15 bp, Homo sapiens
gtttaagtagtagcg

SEQ ID NO: 305905 - DNA, 15 bp, Homo sapiens
ggtttaagtagtagc

SEQ ID NO: 305906 - DNA, 15 bp, Homo sapiens
aggtttaagtagtag

SEQ ID NO: 305907 - DNA, 15 bp, Homo sapiens
taggtttaagtagta

SEQ ID NO: 305908 - DNA, 15 bp, Homo sapiens
ataggtttaagtagt

SEQ ID NO: 305909 - DNA, 15 bp, Homo sapiens
cataggtttaagtag

SEQ ID NO: 305910 - DNA, 15 bp, Homo sapiens
tcataggtttaagta

SEQ ID NO: 305911 - DNA, 15 bp, Homo sapiens
ctcataggtttaagt

SEQ ID NO: 305912 - DNA, 15 bp, Homo sapiens
actcataggtttaag

SEQ ID NO: 305913 - DNA, 15 bp, Homo sapiens
tactcataggtttaa

SEQ ID NO: 305914 - DNA, 15 bp, Homo sapiens
ctactcataggttta

SEQ ID NO: 305915 - DNA, 15 bp, Homo sapiens
cctactcataggttt

SEQ ID NO: 305916 - DNA, 15 bp, Homo sapiens
tcctactcataggtt

SEQ ID NO: 305917 - DNA, 15 bp, Homo sapiens
atcctactcataggt

SEQ ID NO: 305918 - DNA, 15 bp, Homo sapiens
gatcctactcatagg

SEQ ID NO: 305919 - DNA, 15 bp, Homo sapiens
ggatcctactcatag

SEQ ID NO: 305920 - DNA, 15 bp, Homo sapiens
tggatcctactcata

SEQ ID NO: 305921 - DNA, 15 bp, Homo sapiens
ttggatcctactcat

SEQ ID NO: 305922 - DNA, 15 bp, Homo sapiens
tttggatcctactca

SEQ ID NO: 305923 - DNA, 15 bp, Homo sapiens
ttttggatcctactc

SEQ ID NO: 305924 - DNA, 15 bp, Homo sapiens
cttttggatcctact

SEQ ID NO: 305925 - DNA, 15 bp, Homo sapiens
gcttttggatcctac

SEQ ID NO: 305926 - DNA, 15 bp, Homo sapiens
agcttttggatccta

SEQ ID NO: 305927 - DNA, 15 bp, Homo sapiens
aagcttttggatcct

SEQ ID NO: 305928 - DNA, 15 bp, Homo sapiens
gaagcttttggatcc

SEQ ID NO: 305929 - DNA, 15 bp, Homo sapiens
tgaagcttttggatc

SEQ ID NO: 305930 - DNA, 15 bp, Homo sapiens
gtgaagcttttggat

SEQ ID NO: 305931 - DNA, 15 bp, Homo sapiens
agtgaagcttttgga

SEQ ID NO: 305932 - DNA, 15 bp, Homo sapiens
cagtgaagcttttgg

SEQ ID NO: 305933 - DNA, 15 bp, Homo sapiens
tcagtgaagcttttg

SEQ ID NO: 305934 - DNA, 15 bp, Homo sapiens
gtcagtgaagctttt

SEQ ID NO: 305935 - DNA, 15 bp, Homo sapiens
tgtcagtgaagcttt

SEQ ID NO: 305936 - DNA, 15 bp, Homo sapiens
atgtcagtgaagctt

SEQ ID NO: 305937 - DNA, 15 bp, Homo sapiens
tatgtcagtgaagct

SEQ ID NO: 305938 - DNA, 15 bp, Homo sapiens
gtatgtcagtgaagc

SEQ ID NO: 305939 - DNA, 15 bp, Homo sapiens
tgtatgtcagtgaag

SEQ ID NO: 305940 - DNA, 15 bp, Homo sapiens
ttgtatgtcagtgaa

SEQ ID NO: 305941 - DNA, 15 bp, Homo sapiens
attgtatgtcagtga

SEQ ID NO: 305942 - DNA, 15 bp, Homo sapiens
cattgtatgtcagtg

SEQ ID NO: 305943 - DNA, 15 bp, Homo sapiens
acattgtatgtcagt

SEQ ID NO: 305944 - DNA, 15 bp, Homo sapiens
gacattgtatgtcag

SEQ ID NO: 305945 - DNA, 15 bp, Homo sapiens
tgacattgtatgtca

SEQ ID NO: 305946 - DNA, 15 bp, Homo sapiens
ctgacattgtatgtc

SEQ ID NO: 305947 - DNA, 15 bp, Homo sapiens
gctgacattgtatgt

SEQ ID NO: 305948 - DNA, 15 bp, Homo sapiens
agctgacattgtatg

SEQ ID NO: 305949 - DNA, 15 bp, Homo sapiens
aagctgacattgtat

SEQ ID NO: 305950 - DNA, 15 bp, Homo sapiens
caagctgacattgta

SEQ ID NO: 305951 - DNA, 15 bp, Homo sapiens
acaagctgacattgt

SEQ ID NO: 305952 - DNA, 15 bp, Homo sapiens
cacaagctgacattg

SEQ ID NO: 305953 - DNA, 15 bp, Homo sapiens
acacaagctgacatt

SEQ ID NO: 305954 - DNA, 15 bp, Homo sapiens
aacacaagctgacat

SEQ ID NO: 305955 - DNA, 15 bp, Homo sapiens
aaacacaagctgaca

SEQ ID NO: 305956 - DNA, 15 bp, Homo sapiens
aaaacacaagctgac

SEQ ID NO: 305957 - DNA, 15 bp, Homo sapiens
aaaaacacaagctga

SEQ ID NO: 305958 - DNA, 15 bp, Homo sapiens
caaaaacacaagctg

SEQ ID NO: 305959 - DNA, 15 bp, Homo sapiens
acaaaaacacaagct

SEQ ID NO: 305960 - DNA, 15 bp, Homo sapiens
cacaaaaacacaagc

SEQ ID NO: 305961 - DNA, 15 bp, Homo sapiens
tcacaaaaacacaag

SEQ ID NO: 305962 - DNA, 15 bp, Homo sapiens
ctcacaaaaacacaa

SEQ ID NO: 305963 - DNA, 15 bp, Homo sapiens
cctcacaaaaacaca

SEQ ID NO: 305964 - DNA, 15 bp, Homo sapiens
acctcacaaaaacac

SEQ ID NO: 305965 - DNA, 15 bp, Homo sapiens
aacctcacaaaaaca

SEQ ID NO: 305966 - DNA, 15 bp, Homo sapiens
taacctcacaaaaac

SEQ ID NO: 305967 - DNA, 15 bp, Homo sapiens
ttaacctcacaaaaa

SEQ ID NO: 305968 - DNA, 15 bp, Homo sapiens
attaacctcacaaaa

SEQ ID NO: 305969 - DNA, 15 bp, Homo sapiens
aattaacctcacaaa

SEQ ID NO: 305970 - DNA, 15 bp, Homo sapiens
taattaacctcacaa

SEQ ID NO: 305971 - DNA, 15 bp, Homo sapiens
ttaattaacctcaca

SEQ ID NO: 305972 - DNA, 15 bp, Homo sapiens
cttaattaacctcac

SEQ ID NO: 305973 - DNA, 15 bp, Homo sapiens
acttaattaacctca

SEQ ID NO: 305974 - DNA, 15 bp, Homo sapiens
tacttaattaacctc

SEQ ID NO: 305975 - DNA, 15 bp, Homo sapiens
ttacttaattaacct

SEQ ID NO: 305976 - DNA, 15 bp, Homo sapiens
gttacttaattaacc

SEQ ID NO: 305977 - DNA, 15 bp, Homo sapiens
ggttacttaattaac

SEQ ID NO: 305978 - DNA, 15 bp, Homo sapiens
tggttacttaattaa

SEQ ID NO: 305979 - DNA, 15 bp, Homo sapiens
ctggttacttaatta

SEQ ID NO: 305980 - DNA, 15 bp, Homo sapiens
tctggttacttaatt

SEQ ID NO: 305981 - DNA, 15 bp, Homo sapiens
ttctggttacttaat

SEQ ID NO: 305982 - DNA, 15 bp, Homo sapiens
attctggttacttaa

SEQ ID NO: 305983 - DNA, 15 bp, Homo sapiens
cattctggttactta

SEQ ID NO: 305984 - DNA, 15 bp, Homo sapiens
tcattctggttactt

SEQ ID NO: 305985 - DNA, 15 bp, Homo sapiens
ctcattctggttact

SEQ ID NO: 305986 - DNA, 15 bp, Homo sapiens
cctcattctggttac

SEQ ID NO: 305987 - DNA, 15 bp, Homo sapiens
gcctcattctggtta

SEQ ID NO: 305988 - DNA, 15 bp, Homo sapiens
agcctcattctggtt

SEQ ID NO: 305989 - DNA, 15 bp, Homo sapiens
cagcctcattctggt

SEQ ID NO: 305990 - DNA, 15 bp, Homo sapiens
gcagcctcattctgg

SEQ ID NO: 305991 - DNA, 15 bp, Homo sapiens
agcagcctcattctg

SEQ ID NO: 305992 - DNA, 15 bp, Homo sapiens
tagcagcctcattct

SEQ ID NO: 305993 - DNA, 15 bp, Homo sapiens
gtagcagcctcattc

SEQ ID NO: 305994 - DNA, 15 bp, Homo sapiens
tgtagcagcctcatt

SEQ ID NO: 305995 - DNA, 15 bp, Homo sapiens
ctgtagcagcctcat

SEQ ID NO: 305996 - DNA, 15 bp, Homo sapiens
tctgtagcagcctca

SEQ ID NO: 305997 - DNA, 15 bp, Homo sapiens
gtctgtagcagcctc

SEQ ID NO: 305998 - DNA, 15 bp, Homo sapiens
tgtctgtagcagcct

SEQ ID NO: 305999 - DNA, 15 bp, Homo sapiens
ctgtctgtagcagcc

SEQ ID NO: 306000 - DNA, 15 bp, Homo sapiens
gctgtctgtagcagc

SEQ ID NO: 306001 - DNA, 15 bp, Homo sapiens
tgctgtctgtagcag

SEQ ID NO: 306002 - DNA, 15 bp, Homo sapiens
ctgctgtctgtagca

SEQ ID NO: 306003 - DNA, 15 bp, Homo sapiens
cctgctgtctgtagc

SEQ ID NO: 306004 - DNA, 15 bp, Homo sapiens
tcctgctgtctgtag

SEQ ID NO: 306005 - DNA, 15 bp, Homo sapiens
ctcctgctgtctgta

SEQ ID NO: 306006 - DNA, 15 bp, Homo sapiens
tctcctgctgtctgt

SEQ ID NO: 306007 - DNA, 15 bp, Homo sapiens
atctcctgctgtctg

SEQ ID NO: 306008 - DNA, 15 bp, Homo sapiens
tatctcctgctgtct

SEQ ID NO: 306009 - DNA, 15 bp, Homo sapiens
ttatctcctgctgtc

SEQ ID NO: 306010 - DNA, 15 bp, Homo sapiens
attatctcctgctgt

SEQ ID NO: 306011 - DNA, 15 bp, Homo sapiens
gattatctcctgctg

SEQ ID NO: 306012 - DNA, 15 bp, Homo sapiens
tgattatctcctgct

SEQ ID NO: 306013 - DNA, 15 bp, Homo sapiens
gtgattatctcctgc

SEQ ID NO: 306014 - DNA, 15 bp, Homo sapiens
tgtgattatctcctg

SEQ ID NO: 306015 - DNA, 15 bp, Homo sapiens
ttgtgattatctcct

SEQ ID NO: 306016 - DNA, 15 bp, Homo sapiens
attgtgattatctcc

SEQ ID NO: 306017 - DNA, 15 bp, Homo sapiens
aattgtgattatctc

SEQ ID NO: 306018 - DNA, 15 bp, Homo sapiens
ggggaggaggaggag

SEQ ID NO: 306019 - DNA, 15 bp, Homo sapiens
gggaggaggaggagg

SEQ ID NO: 306020 - DNA, 15 bp, Homo sapiens
tttctttttttaaaa

SEQ ID NO: 306021 - DNA, 15 bp, Homo sapiens
tttttttttttaaat

SEQ ID NO: 306022 - DNA, 15 bp, Homo sapiens
cctctttcccagcct

SEQ ID NO: 306023 - DNA, 15 bp, Homo sapiens
cccattttcctctgt

SEQ ID NO: 306024 - DNA, 15 bp, Homo sapiens
tataataaaatacac

SEQ ID NO: 306025 - DNA, 15 bp, Homo sapiens
aaaaaagttttttag

SEQ ID NO: 306026 - DNA, 15 bp, Homo sapiens
aaaaagttttttaga

SEQ ID NO: 306027 - DNA, 15 bp, Homo sapiens
ctctctctctctctt

SEQ ID NO: 306028 - DNA, 15 bp, Homo sapiens
tctctctctctcttt

SEQ ID NO: 306029 - DNA, 15 bp, Homo sapiens
ctctctctctctttt

SEQ ID NO: 306030 - DNA, 15 bp, Homo sapiens
ttttttttttgagat

SEQ ID NO: 306031 - DNA, 15 bp, Homo sapiens
tttttttttgagatg

SEQ ID NO: 306032 - DNA, 15 bp, Homo sapiens
ttttttttgagatgg

SEQ ID NO: 306033 - DNA, 15 bp, Homo sapiens
tttttttgagatgga

SEQ ID NO: 306034 - DNA, 15 bp, Homo sapiens
ttttttgagatggag

SEQ ID NO: 306035 - DNA, 15 bp, Homo sapiens
tttttgagatggagt

SEQ ID NO: 306036 - DNA, 15 bp, Homo sapiens
ttttgagatggagtc

SEQ ID NO: 306037 - DNA, 15 bp, Homo sapiens
tttgagatggagtct

SEQ ID NO: 306038 - DNA, 15 bp, Homo sapiens
ttgagatggagtctc

SEQ ID NO: 306039 - DNA, 15 bp, Homo sapiens
tgagatggagtctca

SEQ ID NO: 306040 - DNA, 15 bp, Homo sapiens
gagatggagtctcac

SEQ ID NO: 306041 - DNA, 15 bp, Homo sapiens
caaggctggagtgca

SEQ ID NO: 306042 - DNA, 15 bp, Homo sapiens
aaggctggagtgcag

SEQ ID NO: 306043 - DNA, 15 bp, Homo sapiens
agtagctgggattac

SEQ ID NO: 306044 - DNA, 15 bp, Homo sapiens
gtagctgggattaca

SEQ ID NO: 306045 - DNA, 15 bp, Homo sapiens
tagctgggattacag

SEQ ID NO: 306046 - DNA, 15 bp, Homo sapiens
agctgggattacagg

SEQ ID NO: 306047 - DNA, 15 bp, Homo sapiens
gctgggattacaggt

SEQ ID NO: 306048 - DNA, 15 bp, Homo sapiens
ctgggattacaggtg

SEQ ID NO: 306049 - DNA, 15 bp, Homo sapiens
catgcctggctaatt

SEQ ID NO: 306050 - DNA, 15 bp, Homo sapiens
atgcctggctaattt

SEQ ID NO: 306051 - DNA, 15 bp, Homo sapiens
tgcctggctaatttt

SEQ ID NO: 306052 - DNA, 15 bp, Homo sapiens
taatttttatatttt

SEQ ID NO: 306053 - DNA, 15 bp, Homo sapiens
aatttttatattttt

SEQ ID NO: 306054 - DNA, 15 bp, Homo sapiens
atttttatattttta

SEQ ID NO: 306055 - DNA, 15 bp, Homo sapiens
gggattacaggcacc

SEQ ID NO: 306056 - DNA, 15 bp, Homo sapiens
gatggggtttcacca

SEQ ID NO: 306057 - DNA, 15 bp, Homo sapiens
gccaggctggtctcg

SEQ ID NO: 306058 - DNA, 15 bp, Homo sapiens
ccaggctggtctcga

SEQ ID NO: 306059 - DNA, 15 bp, Homo sapiens
caggctggtctcgaa

SEQ ID NO: 306060 - DNA, 15 bp, Homo sapiens
aggctggtctcgaac

SEQ ID NO: 306061 - DNA, 15 bp, Homo sapiens
ggctggtctcgaact

SEQ ID NO: 306062 - DNA, 15 bp, Homo sapiens
gctggtctcgaactc

SEQ ID NO: 306063 - DNA, 15 bp, Homo sapiens
ctggtctcgaactcc

SEQ ID NO: 306064 - DNA, 15 bp, Homo sapiens
tggtctcgaactcct

SEQ ID NO: 306065 - DNA, 15 bp, Homo sapiens
ggtctcgaactcctg

SEQ ID NO: 306066 - DNA, 15 bp, Homo sapiens
gtctcgaactcctga

SEQ ID NO: 306067 - DNA, 15 bp, Homo sapiens
cttcccaaagtgctg

SEQ ID NO: 306068 - DNA, 15 bp, Homo sapiens
ttcccaaagtgctgg

SEQ ID NO: 306069 - DNA, 15 bp, Homo sapiens
agatggagtctcact

SEQ ID NO: 306070 - DNA, 15 bp, Homo sapiens
gatggagtctcactc

SEQ ID NO: 306071 - DNA, 15 bp, Homo sapiens
atggagtctcactct

SEQ ID NO: 306072 - DNA, 15 bp, Homo sapiens
agtgcagtggcgtga

SEQ ID NO: 306073 - DNA, 15 bp, Homo sapiens
gtgcagtggcgtgat

SEQ ID NO: 306074 - DNA, 15 bp, Homo sapiens
tgcagtggcgtgatc

SEQ ID NO: 306075 - DNA, 15 bp, Homo sapiens
gcagtggcgtgatct

SEQ ID NO: 306076 - DNA, 15 bp, Homo sapiens
cagtggcgtgatctc

SEQ ID NO: 306077 - DNA, 15 bp, Homo sapiens
tccacctcccaggtt

SEQ ID NO: 306078 - DNA, 15 bp, Homo sapiens
ccacctcccaggttc

SEQ ID NO: 306079 - DNA, 15 bp, Homo sapiens
cacctcccaggttca

SEQ ID NO: 306080 - DNA, 15 bp, Homo sapiens
acctcccaggttcaa

SEQ ID NO: 306081 - DNA, 15 bp, Homo sapiens
ttagcctcctgagta

SEQ ID NO: 306082 - DNA, 15 bp, Homo sapiens
tagcctcctgagtag

SEQ ID NO: 306083 - DNA, 15 bp, Homo sapiens
tggctaatttttttt

SEQ ID NO: 306084 - DNA, 15 bp, Homo sapiens
ggctaattttttttt

SEQ ID NO: 306085 - DNA, 15 bp, Homo sapiens
gctaatttttttttt

SEQ ID NO: 306086 - DNA, 15 bp, Homo sapiens
ctaattttttttttt

SEQ ID NO: 306087 - DNA, 15 bp, Homo sapiens
taatttttttttttt

SEQ ID NO: 306088 - DNA, 15 bp, Homo sapiens
tttttttttttttgt

SEQ ID NO: 306089 - DNA, 15 bp, Homo sapiens
ttttttttttttgta

SEQ ID NO: 306090 - DNA, 15 bp, Homo sapiens
tttttttttttgtat

SEQ ID NO: 306091 - DNA, 15 bp, Homo sapiens
ttttttttttgtatt

SEQ ID NO: 306092 - DNA, 15 bp, Homo sapiens
tttttttttgtattt

SEQ ID NO: 306093 - DNA, 15 bp, Homo sapiens
ttttttttgtatttt

SEQ ID NO: 306094 - DNA, 15 bp, Homo sapiens
tttttttgtattttt

SEQ ID NO: 306095 - DNA, 15 bp, Homo sapiens
tgacctcgtgatcca

SEQ ID NO: 306096 - DNA, 15 bp, Homo sapiens
gacctcgtgatccac

SEQ ID NO: 306097 - DNA, 15 bp, Homo sapiens
acctcgtgatccacc

SEQ ID NO: 306098 - DNA, 15 bp, Homo sapiens
gtgatccacctgcct

SEQ ID NO: 306099 - DNA, 15 bp, Homo sapiens
tgatccacctgcctc

SEQ ID NO: 306100 - DNA, 15 bp, Homo sapiens
ctcggcctcccaaag

SEQ ID NO: 306101 - DNA, 15 bp, Homo sapiens
tcggcctcccaaagt

SEQ ID NO: 306102 - DNA, 15 bp, Homo sapiens
cggcctcccaaagtg

SEQ ID NO: 306103 - DNA, 15 bp, Homo sapiens
ctcaataaatatttg

SEQ ID NO: 306104 - DNA, 15 bp, Homo sapiens
ttctgtatttttaaa

SEQ ID NO: 306105 - DNA, 15 bp, Homo sapiens
agtaactttgaaaag

SEQ ID NO: 306106 - DNA, 15 bp, Homo sapiens
atctaatttcagaaa

SEQ ID NO: 306107 - DNA, 15 bp, Homo sapiens
ctgggatggcccttc

SEQ ID NO: 306108 - DNA, 15 bp, Homo sapiens
catgcctggaatccc

SEQ ID NO: 306109 - DNA, 15 bp, Homo sapiens
atgcctggaatccca

SEQ ID NO: 306110 - DNA, 15 bp, Homo sapiens
tgcctggaatcccag

SEQ ID NO: 306111 - DNA, 15 bp, Homo sapiens
gcctggaatcccagc

SEQ ID NO: 306112 - DNA, 15 bp, Homo sapiens
atcccagcactttga

SEQ ID NO: 306113 - DNA, 15 bp, Homo sapiens
ccgaggcgggcggat

SEQ ID NO: 306114 - DNA, 15 bp, Homo sapiens
cgaggcgggcggatc

SEQ ID NO: 306115 - DNA, 15 bp, Homo sapiens
gtcaggagttcaaga

SEQ ID NO: 306116 - DNA, 15 bp, Homo sapiens
aaaaatacaaaaaaa

SEQ ID NO: 306117 - DNA, 15 bp, Homo sapiens
aaaatacaaaaaaaa

SEQ ID NO: 306118 - DNA, 15 bp, Homo sapiens
aaatacaaaaaaaaa

SEQ ID NO: 306119 - DNA, 15 bp, Homo sapiens
aatacaaaaaaaaaa

SEQ ID NO: 306120 - DNA, 15 bp, Homo sapiens
atacaaaaaaaaaaa

SEQ ID NO: 306121 - DNA, 15 bp, Homo sapiens
tacaaaaaaaaaaaa

SEQ ID NO: 306122 - DNA, 15 bp, Homo sapiens
acaaaaaaaaaaaaa

SEQ ID NO: 306123 - DNA, 15 bp, Homo sapiens
aaaaaaaaaaaatta

SEQ ID NO: 306124 - DNA, 15 bp, Homo sapiens
cacctgtagtcccag

SEQ ID NO: 306125 - DNA, 15 bp, Homo sapiens
acctgtagtcccagc

SEQ ID NO: 306126 - DNA, 15 bp, Homo sapiens
agtcccagctactca

SEQ ID NO: 306127 - DNA, 15 bp, Homo sapiens
ctactcaggaggcta

SEQ ID NO: 306128 - DNA, 15 bp, Homo sapiens
tactcaggaggctaa

SEQ ID NO: 306129 - DNA, 15 bp, Homo sapiens
actcaggaggctaag

SEQ ID NO: 306130 - DNA, 15 bp, Homo sapiens
ctcaggaggctaagg

SEQ ID NO: 306131 - DNA, 15 bp, Homo sapiens
tcaggaggctaaggc

SEQ ID NO: 306132 - DNA, 15 bp, Homo sapiens
caggaggctaaggca

SEQ ID NO: 306133 - DNA, 15 bp, Homo sapiens
ttgaacctgggaggt

SEQ ID NO: 306134 - DNA, 15 bp, Homo sapiens
tgaacctgggaggtg

SEQ ID NO: 306135 - DNA, 15 bp, Homo sapiens
gaacctgggaggtgg

SEQ ID NO: 306136 - DNA, 15 bp, Homo sapiens
aacctgggaggtgga

SEQ ID NO: 306137 - DNA, 15 bp, Homo sapiens
cctgggaggtggagg

SEQ ID NO: 306138 - DNA, 15 bp, Homo sapiens
tcactgcactccagc

SEQ ID NO: 306139 - DNA, 15 bp, Homo sapiens
aaaaaaaaaaaaatc

SEQ ID NO: 306140 - DNA, 15 bp, Homo sapiens
aaaaaaaaaaaatca

SEQ ID NO: 306141 - DNA, 15 bp, Homo sapiens
tttctgaaattagat

SEQ ID NO: 306142 - DNA, 15 bp, Homo sapiens
gtgccaccacgcctg

SEQ ID NO: 306143 - DNA, 15 bp, Homo sapiens
tgccaccacgcctgg

SEQ ID NO: 306144 - DNA, 15 bp, Homo sapiens
gccaccacgcctggc

SEQ ID NO: 306145 - DNA, 15 bp, Homo sapiens
ccaccacgcctggct

SEQ ID NO: 306146 - DNA, 15 bp, Homo sapiens
tgcccaggctggtct

SEQ ID NO: 306147 - DNA, 15 bp, Homo sapiens
gcccaggctggtctc

SEQ ID NO: 306148 - DNA, 15 bp, Homo sapiens
cccaggctggtctca

SEQ ID NO: 306149 - DNA, 15 bp, Homo sapiens
gtctcaaactcctgg

SEQ ID NO: 306150 - DNA, 15 bp, Homo sapiens
tctcaaactcctggg

SEQ ID NO: 306151 - DNA, 15 bp, Homo sapiens
ctcaaactcctgggc

SEQ ID NO: 306152 - DNA, 15 bp, Homo sapiens
tcaaactcctgggct

SEQ ID NO: 306153 - DNA, 15 bp, Homo sapiens
caaactcctgggctc

SEQ ID NO: 306154 - DNA, 15 bp, Homo sapiens
aaactcctgggctca

SEQ ID NO: 306155 - DNA, 15 bp, Homo sapiens
aactcctgggctcaa

SEQ ID NO: 306156 - DNA, 15 bp, Homo sapiens
actcctgggctcaag

SEQ ID NO: 306157 - DNA, 15 bp, Homo sapiens
ctcctgggctcaagc

SEQ ID NO: 306158 - DNA, 15 bp, Homo sapiens
tcctgggctcaagca

SEQ ID NO: 306159 - DNA, 15 bp, Homo sapiens
cctgggctcaagcaa

SEQ ID NO: 306160 - DNA, 15 bp, Homo sapiens
ctgggctcaagcaat

SEQ ID NO: 306161 - DNA, 15 bp, Homo sapiens
tgggctcaagcaatc

SEQ ID NO: 306162 - DNA, 15 bp, Homo sapiens
gggctcaagcaatcc

SEQ ID NO: 306163 - DNA, 15 bp, Homo sapiens
aaatcctgcaggatt

SEQ ID NO: 306164 - DNA, 15 bp, Homo sapiens
aatcctgcaggattt

SEQ ID NO: 306165 - DNA, 15 bp, Homo sapiens
cactttgggaggccg

SEQ ID NO: 306166 - DNA, 15 bp, Homo sapiens
actttgggaggccga

SEQ ID NO: 306167 - DNA, 15 bp, Homo sapiens
ctttgggaggccgag

SEQ ID NO: 306168 - DNA, 15 bp, Homo sapiens
tttgggaggccgaga

SEQ ID NO: 306169 - DNA, 15 bp, Homo sapiens
ttgggaggccgagac

SEQ ID NO: 306170 - DNA, 15 bp, Homo sapiens
tgggaggccgagacg

SEQ ID NO: 306171 - DNA, 15 bp, Homo sapiens
gggaggccgagacgg

SEQ ID NO: 306172 - DNA, 15 bp, Homo sapiens
ggaggccgagacggg

SEQ ID NO: 306173 - DNA, 15 bp, Homo sapiens
gaggccgagacgggt

SEQ ID NO: 306174 - DNA, 15 bp, Homo sapiens
aggccgagacgggtg

SEQ ID NO: 306175 - DNA, 15 bp, Homo sapiens
ggccgagacgggtgg

SEQ ID NO: 306176 - DNA, 15 bp, Homo sapiens
gccgagacgggtgga

SEQ ID NO: 306177 - DNA, 15 bp, Homo sapiens
cgggtggatcacgag

SEQ ID NO: 306178 - DNA, 15 bp, Homo sapiens
gggtggatcacgagg

SEQ ID NO: 306179 - DNA, 15 bp, Homo sapiens
ggtggatcacgaggt

SEQ ID NO: 306180 - DNA, 15 bp, Homo sapiens
gtggatcacgaggtc

SEQ ID NO: 306181 - DNA, 15 bp, Homo sapiens
tggatcacgaggtca

SEQ ID NO: 306182 - DNA, 15 bp, Homo sapiens
cacggtgaaaccccg

SEQ ID NO: 306183 - DNA, 15 bp, Homo sapiens
acggtgaaaccccgt

SEQ ID NO: 306184 - DNA, 15 bp, Homo sapiens
cggtgaaaccccgtc

SEQ ID NO: 306185 - DNA, 15 bp, Homo sapiens
ggtgaaaccccgtct

SEQ ID NO: 306186 - DNA, 15 bp, Homo sapiens
gtgaaaccccgtctc

SEQ ID NO: 306187 - DNA, 15 bp, Homo sapiens
tgaaaccccgtctct

SEQ ID NO: 306188 - DNA, 15 bp, Homo sapiens
gacagagcaagactc

SEQ ID NO: 306189 - DNA, 15 bp, Homo sapiens
acagagcaagactcc

SEQ ID NO: 306190 - DNA, 15 bp, Homo sapiens
cagagcaagactcca

SEQ ID NO: 306191 - DNA, 15 bp, Homo sapiens
agactccatctcaaa

SEQ ID NO: 306192 - DNA, 15 bp, Homo sapiens
gactccatctcaaaa

SEQ ID NO: 306193 - DNA, 15 bp, Homo sapiens
actccatctcaaaaa

SEQ ID NO: 306194 - DNA, 15 bp, Homo sapiens
ctccatctcaaaaaa

SEQ ID NO: 306195 - DNA, 15 bp, Homo sapiens
tccatctcaaaaaaa

SEQ ID NO: 306196 - DNA, 15 bp, Homo sapiens
ccatctcaaaaaaaa

SEQ ID NO: 306197 - DNA, 15 bp, Homo sapiens
catctcaaaaaaaaa

SEQ ID NO: 306198 - DNA, 15 bp, Homo sapiens
atctcaaaaaaaaaa

SEQ ID NO: 306199 - DNA, 15 bp, Homo sapiens
cccctcaacactatg

SEQ ID NO: 306200 - DNA, 15 bp, Homo sapiens
gaaaaaaaaaaaaag

SEQ ID NO: 306201 - DNA, 15 bp, Homo sapiens
gaaaaaaaaaatgac

SEQ ID NO: 306202 - DNA, 15 bp, Homo sapiens
aaaaaaaaaatgact

SEQ ID NO: 306203 - DNA, 15 bp, Homo sapiens
cctggccaacatggc

SEQ ID NO: 306204 - DNA, 15 bp, Homo sapiens
tggccaacatggcaa

SEQ ID NO: 306205 - DNA, 15 bp, Homo sapiens
ggccaacatggcaaa

SEQ ID NO: 306206 - DNA, 15 bp, Homo sapiens
gccaacatggcaaaa

SEQ ID NO: 306207 - DNA, 15 bp, Homo sapiens
ccaacatggcaaaac

SEQ ID NO: 306208 - DNA, 15 bp, Homo sapiens
aacatggcaaaaccc

SEQ ID NO: 306209 - DNA, 15 bp, Homo sapiens
acatggcaaaacccc

SEQ ID NO: 306210 - DNA, 15 bp, Homo sapiens
atggcaaaaccccgt

SEQ ID NO: 306211 - DNA, 15 bp, Homo sapiens
tggcaaaaccccgtc

SEQ ID NO: 306212 - DNA, 15 bp, Homo sapiens
ggcaaaaccccgtct

SEQ ID NO: 306213 - DNA, 15 bp, Homo sapiens
gcaaaaccccgtctc

SEQ ID NO: 306214 - DNA, 15 bp, Homo sapiens
caaaaccccgtctct

SEQ ID NO: 306215 - DNA, 15 bp, Homo sapiens
aaaaccccgtctcta

SEQ ID NO: 306216 - DNA, 15 bp, Homo sapiens
ctctactaaaaataa

SEQ ID NO: 306217 - DNA, 15 bp, Homo sapiens
aaaattagctgggca

SEQ ID NO: 306218 - DNA, 15 bp, Homo sapiens
aaattagctgggcat

SEQ ID NO: 306219 - DNA, 15 bp, Homo sapiens
aattagctgggcatg

SEQ ID NO: 306220 - DNA, 15 bp, Homo sapiens
attagctgggcatgg

SEQ ID NO: 306221 - DNA, 15 bp, Homo sapiens
ttagctgggcatggt

SEQ ID NO: 306222 - DNA, 15 bp, Homo sapiens
tagctgggcatggtg

SEQ ID NO: 306223 - DNA, 15 bp, Homo sapiens
agctgggcatggtgg

SEQ ID NO: 306224 - DNA, 15 bp, Homo sapiens
gggagaatcacttga

SEQ ID NO: 306225 - DNA, 15 bp, Homo sapiens
ggagaatcacttgaa

SEQ ID NO: 306226 - DNA, 15 bp, Homo sapiens
gagaatcacttgaac

SEQ ID NO: 306227 - DNA, 15 bp, Homo sapiens
agaatcacttgaacc

SEQ ID NO: 306228 - DNA, 15 bp, Homo sapiens
gaatcacttgaaccc

SEQ ID NO: 306229 - DNA, 15 bp, Homo sapiens
gggaggtggaggttg

SEQ ID NO: 306230 - DNA, 15 bp, Homo sapiens
ggaggtggaggttgc

SEQ ID NO: 306231 - DNA, 15 bp, Homo sapiens
gaggtggaggttgca

SEQ ID NO: 306232 - DNA, 15 bp, Homo sapiens
aggtggaggttgcag

SEQ ID NO: 306233 - DNA, 15 bp, Homo sapiens
ggtggaggttgcagt

SEQ ID NO: 306234 - DNA, 15 bp, Homo sapiens
aggttgcagtgagcc

SEQ ID NO: 306235 - DNA, 15 bp, Homo sapiens
tgagccgagatcaca

SEQ ID NO: 306236 - DNA, 15 bp, Homo sapiens
gagccgagatcacac

SEQ ID NO: 306237 - DNA, 15 bp, Homo sapiens
agccgagatcacacc

SEQ ID NO: 306238 - DNA, 15 bp, Homo sapiens
gccgagatcacacca

SEQ ID NO: 306239 - DNA, 15 bp, Homo sapiens
gagatcacaccattg

SEQ ID NO: 306240 - DNA, 15 bp, Homo sapiens
agatcacaccattgc

SEQ ID NO: 306241 - DNA, 15 bp, Homo sapiens
gatcacaccattgca

SEQ ID NO: 306242 - DNA, 15 bp, Homo sapiens
atcacaccattgcac

SEQ ID NO: 306243 - DNA, 15 bp, Homo sapiens
tcacaccattgcact

SEQ ID NO: 306244 - DNA, 15 bp, Homo sapiens
cacaccattgcactc

SEQ ID NO: 306245 - DNA, 15 bp, Homo sapiens
acaccattgcactcc

SEQ ID NO: 306246 - DNA, 15 bp, Homo sapiens
caccattgcactcca

SEQ ID NO: 306247 - DNA, 15 bp, Homo sapiens
accattgcactccag

SEQ ID NO: 306248 - DNA, 15 bp, Homo sapiens
cagcctgggcaacaa

SEQ ID NO: 306249 - DNA, 15 bp, Homo sapiens
agcctgggcaacaag

SEQ ID NO: 306250 - DNA, 15 bp, Homo sapiens
acaaaacaaaacaaa

SEQ ID NO: 306251 - DNA, 15 bp, Homo sapiens
caaaacaaaacaaaa

SEQ ID NO: 306252 - DNA, 15 bp, Homo sapiens
aaaacaaaacaaaac

SEQ ID NO: 306253 - DNA, 15 bp, Homo sapiens
aaacaaaacaaaaca

SEQ ID NO: 306254 - DNA, 15 bp, Homo sapiens
aacaaaacaaaacaa

SEQ ID NO: 306255 - DNA, 15 bp, Homo sapiens
ttccttttttttttt

SEQ ID NO: 306256 - DNA, 15 bp, Homo sapiens
tcctttttttttttt

SEQ ID NO: 306257 - DNA, 15 bp, Homo sapiens
cctttttttttttta

SEQ ID NO: 306258 - DNA, 15 bp, Homo sapiens
cttttttttttttaa

SEQ ID NO: 306259 - DNA, 15 bp, Homo sapiens
tttttttttttaaac

SEQ ID NO: 306260 - DNA, 15 bp, Homo sapiens
gtttttattctttat

SEQ ID NO: 306261 - DNA, 15 bp, Homo sapiens
gacaaattttttttt

SEQ ID NO: 306262 - DNA, 15 bp, Homo sapiens
agtctcactctgttg

SEQ ID NO: 306263 - DNA, 15 bp, Homo sapiens
gtctcactctgttgc

SEQ ID NO: 306264 - DNA, 15 bp, Homo sapiens
tctcactctgttgcc

SEQ ID NO: 306265 - DNA, 15 bp, Homo sapiens
ctcactctgttgccc

SEQ ID NO: 306266 - DNA, 15 bp, Homo sapiens
tcactctgttgccca

SEQ ID NO: 306267 - DNA, 15 bp, Homo sapiens
cactctgttgcccag

SEQ ID NO: 306268 - DNA, 15 bp, Homo sapiens
gagtgcagtggtgcg

SEQ ID NO: 306269 - DNA, 15 bp, Homo sapiens
agtgcagtggtgcga

SEQ ID NO: 306270 - DNA, 15 bp, Homo sapiens
gtgcagtggtgcgat

SEQ ID NO: 306271 - DNA, 15 bp, Homo sapiens
tgcagtggtgcgatc

SEQ ID NO: 306272 - DNA, 15 bp, Homo sapiens
gcagtggtgcgatct

SEQ ID NO: 306273 - DNA, 15 bp, Homo sapiens
caacctctgcctccc

SEQ ID NO: 306274 - DNA, 15 bp, Homo sapiens
aacctctgcctccca

SEQ ID NO: 306275 - DNA, 15 bp, Homo sapiens
acctctgcctcccag

SEQ ID NO: 306276 - DNA, 15 bp, Homo sapiens
cctctgcctcccagg

SEQ ID NO: 306277 - DNA, 15 bp, Homo sapiens
ctctgcctcccaggt

SEQ ID NO: 306278 - DNA, 15 bp, Homo sapiens
ctgcctcccaggttc

SEQ ID NO: 306279 - DNA, 15 bp, Homo sapiens
tgcctcccaggttca

SEQ ID NO: 306280 - DNA, 15 bp, Homo sapiens
tcctgcctcagtctc

SEQ ID NO: 306281 - DNA, 15 bp, Homo sapiens
cctgcctcagtctcc

SEQ ID NO: 306282 - DNA, 15 bp, Homo sapiens
ctgcctcagtctccc

SEQ ID NO: 306283 - DNA, 15 bp, Homo sapiens
tacccagctaatttt

SEQ ID NO: 306284 - DNA, 15 bp, Homo sapiens
accatgttggccagc

SEQ ID NO: 306285 - DNA, 15 bp, Homo sapiens
ccatgttggccagcc

SEQ ID NO: 306286 - DNA, 15 bp, Homo sapiens
catgttggccagcct

SEQ ID NO: 306287 - DNA, 15 bp, Homo sapiens
aggtgtgagccaccg

SEQ ID NO: 306288 - DNA, 15 bp, Homo sapiens
ggtgtgagccaccgc

SEQ ID NO: 306289 - DNA, 15 bp, Homo sapiens
tgagccaccgcacct

SEQ ID NO: 306290 - DNA, 15 bp, Homo sapiens
gagccaccgcacctg

SEQ ID NO: 306291 - DNA, 15 bp, Homo sapiens
agccaccgcacctgg

SEQ ID NO: 306292 - DNA, 15 bp, Homo sapiens
tggagtctcactctg

SEQ ID NO: 306293 - DNA, 15 bp, Homo sapiens
gatctcttgaccttg

SEQ ID NO: 306294 - DNA, 15 bp, Homo sapiens
atctcttgaccttgt

SEQ ID NO: 306295 - DNA, 15 bp, Homo sapiens
tctcttgaccttgtg

SEQ ID NO: 306296 - DNA, 15 bp, Homo sapiens
ctcttgaccttgtga

SEQ ID NO: 306297 - DNA, 15 bp, Homo sapiens
tcttgaccttgtgat

SEQ ID NO: 306298 - DNA, 15 bp, Homo sapiens
cttgaccttgtgatc

SEQ ID NO: 306299 - DNA, 15 bp, Homo sapiens
ttgaccttgtgatcc

SEQ ID NO: 306300 - DNA, 15 bp, Homo sapiens
tgaccttgtgatccg

SEQ ID NO: 306301 - DNA, 15 bp, Homo sapiens
gaccttgtgatccgc

SEQ ID NO: 306302 - DNA, 15 bp, Homo sapiens
accttgtgatccgcc

SEQ ID NO: 306303 - DNA, 15 bp, Homo sapiens
agtggtcagggaagg

SEQ ID NO: 306304 - DNA, 15 bp, Homo sapiens
gtggtcagggaaggc

SEQ ID NO: 306305 - DNA, 15 bp, Homo sapiens
caagctctcttgcaa

SEQ ID NO: 306306 - DNA, 15 bp, Homo sapiens
aagctctcttgcaag

SEQ ID NO: 306307 - DNA, 15 bp, Homo sapiens
agctctcttgcaaga

SEQ ID NO: 306308 - DNA, 15 bp, Homo sapiens
tgatttattttgctt

SEQ ID NO: 306309 - DNA, 15 bp, Homo sapiens
tactatgtgctaggc

SEQ ID NO: 306310 - DNA, 15 bp, Homo sapiens
cctgtggagagccag

SEQ ID NO: 306311 - DNA, 15 bp, Homo sapiens
gaagggccatcccag

SEQ ID NO: 306312 - DNA, 15 bp, Homo sapiens
cacagacacacacac

SEQ ID NO: 306313 - DNA, 15 bp, Homo sapiens
acagacacacacaca

SEQ ID NO: 306314 - DNA, 15 bp, Homo sapiens
cagacacacacacac

SEQ ID NO: 306315 - DNA, 15 bp, Homo sapiens
agacacacacacaca

SEQ ID NO: 306316 - DNA, 15 bp, Homo sapiens
gacacacacacacac

SEQ ID NO: 306317 - DNA, 15 bp, Homo sapiens
acacacacacacacc

SEQ ID NO: 306318 - DNA, 15 bp, Homo sapiens
cacacacacacacat

SEQ ID NO: 306319 - DNA, 15 bp, Homo sapiens
tggagtcttgctctg

SEQ ID NO: 306320 - DNA, 15 bp, Homo sapiens
ggagtcttgctctgt

SEQ ID NO: 306321 - DNA, 15 bp, Homo sapiens
gagtcttgctctgtc

SEQ ID NO: 306322 - DNA, 15 bp, Homo sapiens
gagatggagtcttac

SEQ ID NO: 306323 - DNA, 15 bp, Homo sapiens
gtgatccacccgcct

SEQ ID NO: 306324 - DNA, 15 bp, Homo sapiens
tgatccacccgcctc

SEQ ID NO: 306325 - DNA, 15 bp, Homo sapiens
atccacccgcctcag

SEQ ID NO: 306326 - DNA, 15 bp, Homo sapiens
tccacccgcctcagc

SEQ ID NO: 306327 - DNA, 15 bp, Homo sapiens
aaattaaaaaatgaa

SEQ ID NO: 306328 - DNA, 15 bp, Homo sapiens
aattaaaaaatgaat

SEQ ID NO: 306329 - DNA, 15 bp, Homo sapiens
tcctgtaatcccagc

SEQ ID NO: 306330 - DNA, 15 bp, Homo sapiens
ttgggaggccaaggc

SEQ ID NO: 306331 - DNA, 15 bp, Homo sapiens
aggccaaggcgggcg

SEQ ID NO: 306332 - DNA, 15 bp, Homo sapiens
ggccaaggcgggcgg

SEQ ID NO: 306333 - DNA, 15 bp, Homo sapiens
gccaaggcgggcgga

SEQ ID NO: 306334 - DNA, 15 bp, Homo sapiens
ccaaggcgggcggat

SEQ ID NO: 306335 - DNA, 15 bp, Homo sapiens
ttgagaccagcctgg

SEQ ID NO: 306336 - DNA, 15 bp, Homo sapiens
tgagaccagcctggc

SEQ ID NO: 306337 - DNA, 15 bp, Homo sapiens
tggtgaaaccccatc

SEQ ID NO: 306338 - DNA, 15 bp, Homo sapiens
caatttttttttttt

SEQ ID NO: 306339 - DNA, 15 bp, Homo sapiens
ttttttttttttagg

SEQ ID NO: 306340 - DNA, 15 bp, Homo sapiens
gatctcggctcattg

SEQ ID NO: 306341 - DNA, 15 bp, Homo sapiens
atctcggctcattgc

SEQ ID NO: 306342 - DNA, 15 bp, Homo sapiens
tctcggctcattgca

SEQ ID NO: 306343 - DNA, 15 bp, Homo sapiens
ctcggctcattgcaa

SEQ ID NO: 306344 - DNA, 15 bp, Homo sapiens
tcggctcattgcaac

SEQ ID NO: 306345 - DNA, 15 bp, Homo sapiens
cggctcattgcaacc

SEQ ID NO: 306346 - DNA, 15 bp, Homo sapiens
ggctcattgcaacct

SEQ ID NO: 306347 - DNA, 15 bp, Homo sapiens
ctcccgggctcaagt

SEQ ID NO: 306348 - DNA, 15 bp, Homo sapiens
tcccgggctcaagtg

SEQ ID NO: 306349 - DNA, 15 bp, Homo sapiens
cccgggctcaagtga

SEQ ID NO: 306350 - DNA, 15 bp, Homo sapiens
ccgggctcaagtgat

SEQ ID NO: 306351 - DNA, 15 bp, Homo sapiens
gagtagctgggactg

SEQ ID NO: 306352 - DNA, 15 bp, Homo sapiens
agtagctgggactgc

SEQ ID NO: 306353 - DNA, 15 bp, Homo sapiens
gtagctgggactgca

SEQ ID NO: 306354 - DNA, 15 bp, Homo sapiens
gtagagatgaggttt

SEQ ID NO: 306355 - DNA, 15 bp, Homo sapiens
agagatgaggtttca

SEQ ID NO: 306356 - DNA, 15 bp, Homo sapiens
gagatgaggtttcac

SEQ ID NO: 306357 - DNA, 15 bp, Homo sapiens
agatgaggtttcacc

SEQ ID NO: 306358 - DNA, 15 bp, Homo sapiens
gatgaggtttcacca

SEQ ID NO: 306359 - DNA, 15 bp, Homo sapiens
atgaggtttcaccat

SEQ ID NO: 306360 - DNA, 15 bp, Homo sapiens
tgaggtttcaccatg

SEQ ID NO: 306361 - DNA, 15 bp, Homo sapiens
tgcgcctgtaatccc

SEQ ID NO: 306362 - DNA, 15 bp, Homo sapiens
gcgcctgtaatccca

SEQ ID NO: 306363 - DNA, 15 bp, Homo sapiens
gtgagctgagattgt

SEQ ID NO: 306364 - DNA, 15 bp, Homo sapiens
tgagctgagattgtg

SEQ ID NO: 306365 - DNA, 15 bp, Homo sapiens
gagctgagattgtgc

SEQ ID NO: 306366 - DNA, 15 bp, Homo sapiens
agctgagattgtgcc

SEQ ID NO: 306367 - DNA, 15 bp, Homo sapiens
agagtgagactccat

SEQ ID NO: 306368 - DNA, 15 bp, Homo sapiens
gagtgagactccatc

SEQ ID NO: 306369 - DNA, 15 bp, Homo sapiens
agtgagactccatct

SEQ ID NO: 306370 - DNA, 15 bp, Homo sapiens
gtgagactccatctc

SEQ ID NO: 306371 - DNA, 15 bp, Homo sapiens
tgagactccatctca

SEQ ID NO: 306372 - DNA, 15 bp, Homo sapiens
gagactccatctcaa

SEQ ID NO: 306373 - DNA, 15 bp, Homo sapiens
aaaaaaaaaaaaagt

SEQ ID NO: 306374 - DNA, 15 bp, Homo sapiens
aaaaaaaaaaaagta

SEQ ID NO: 306375 - DNA, 15 bp, Homo sapiens
aaaaaaaaaaagtaa

SEQ ID NO: 306376 - DNA, 15 bp, Homo sapiens
tattttacgtaaaat

SEQ ID NO: 306377 - DNA, 15 bp, Homo sapiens
attttacgtaaaata

SEQ ID NO: 306378 - DNA, 15 bp, Homo sapiens
tttttcttttctttt

SEQ ID NO: 306379 - DNA, 15 bp, Homo sapiens
ttcttttcttttttt

SEQ ID NO: 306380 - DNA, 15 bp, Homo sapiens
gaggtgggtagatca

SEQ ID NO: 306381 - DNA, 15 bp, Homo sapiens
aggtgggtagatcac

SEQ ID NO: 306382 - DNA, 15 bp, Homo sapiens
cacgaggtcaggagt

SEQ ID NO: 306383 - DNA, 15 bp, Homo sapiens
acgaggtcaggagtt

SEQ ID NO: 306384 - DNA, 15 bp, Homo sapiens
cgaggtcaggagttc

SEQ ID NO: 306385 - DNA, 15 bp, Homo sapiens
gataccagcctggcc

SEQ ID NO: 306386 - DNA, 15 bp, Homo sapiens
ataccagcctggcca

SEQ ID NO: 306387 - DNA, 15 bp, Homo sapiens
taccagcctggccaa

SEQ ID NO: 306388 - DNA, 15 bp, Homo sapiens
ctggccaacatggtg

SEQ ID NO: 306389 - DNA, 15 bp, Homo sapiens
tggccaacatggtga

SEQ ID NO: 306390 - DNA, 15 bp, Homo sapiens
ggccaacatggtgaa

SEQ ID NO: 306391 - DNA, 15 bp, Homo sapiens
gccaacatggtgaaa

SEQ ID NO: 306392 - DNA, 15 bp, Homo sapiens
ccaacatggtgaaac

SEQ ID NO: 306393 - DNA, 15 bp, Homo sapiens
caacatggtgaaacc

SEQ ID NO: 306394 - DNA, 15 bp, Homo sapiens
aacatggtgaaacct

SEQ ID NO: 306395 - DNA, 15 bp, Homo sapiens
gctgggtgtggtggc

SEQ ID NO: 306396 - DNA, 15 bp, Homo sapiens
gtggtggcgtgtgcc

SEQ ID NO: 306397 - DNA, 15 bp, Homo sapiens
tggtggcgtgtgcct

SEQ ID NO: 306398 - DNA, 15 bp, Homo sapiens
ggtggcgtgtgcctg

SEQ ID NO: 306399 - DNA, 15 bp, Homo sapiens
gtggcgtgtgcctgt

SEQ ID NO: 306400 - DNA, 15 bp, Homo sapiens
tggcgtgtgcctgta

SEQ ID NO: 306401 - DNA, 15 bp, Homo sapiens
ggcgtgtgcctgtaa

SEQ ID NO: 306402 - DNA, 15 bp, Homo sapiens
gcgtgtgcctgtaat

SEQ ID NO: 306403 - DNA, 15 bp, Homo sapiens
cgtgtgcctgtaatc

SEQ ID NO: 306404 - DNA, 15 bp, Homo sapiens
gtgtgcctgtaatcc

SEQ ID NO: 306405 - DNA, 15 bp, Homo sapiens
tgtgcctgtaatccc

SEQ ID NO: 306406 - DNA, 15 bp, Homo sapiens
ctgagatcatgccac

SEQ ID NO: 306407 - DNA, 15 bp, Homo sapiens
tgagatcatgccact

SEQ ID NO: 306408 - DNA, 15 bp, Homo sapiens
cactccagcctggtg

SEQ ID NO: 306409 - DNA, 15 bp, Homo sapiens
actccagcctggtga

SEQ ID NO: 306410 - DNA, 15 bp, Homo sapiens
ctccagcctggtgac

SEQ ID NO: 306411 - DNA, 15 bp, Homo sapiens
tccagcctggtgaca

SEQ ID NO: 306412 - DNA, 15 bp, Homo sapiens
ccagcctggtgacag

SEQ ID NO: 306413 - DNA, 15 bp, Homo sapiens
cagcctggtgacaga

SEQ ID NO: 306414 - DNA, 15 bp, Homo sapiens
agcctggtgacagag

SEQ ID NO: 306415 - DNA, 15 bp, Homo sapiens
aaaaaaaaaaaagtt

SEQ ID NO: 306416 - DNA, 15 bp, Homo sapiens
aaaaaaaaaaagttt

SEQ ID NO: 306417 - DNA, 15 bp, Homo sapiens
aaaaaaaagtttttt

SEQ ID NO: 306418 - DNA, 15 bp, Homo sapiens
ttttttgtagagaca

SEQ ID NO: 306419 - DNA, 15 bp, Homo sapiens
gaactcctggactca

SEQ ID NO: 306420 - DNA, 15 bp, Homo sapiens
aactcctggactcaa

SEQ ID NO: 306421 - DNA, 15 bp, Homo sapiens
actcctggactcaag

SEQ ID NO: 306422 - DNA, 15 bp, Homo sapiens
ctcctggactcaagc

SEQ ID NO: 306423 - DNA, 15 bp, Homo sapiens
gctgggattataggt

SEQ ID NO: 306424 - DNA, 15 bp, Homo sapiens
ctgggattataggtg

SEQ ID NO: 306425 - DNA, 15 bp, Homo sapiens
tgggattataggtgt

SEQ ID NO: 306426 - DNA, 15 bp, Homo sapiens
gggattataggtgtg

SEQ ID NO: 306427 - DNA, 15 bp, Homo sapiens
ggattataggtgtga

SEQ ID NO: 306428 - DNA, 15 bp, Homo sapiens
gattataggtgtgag

SEQ ID NO: 306429 - DNA, 15 bp, Homo sapiens
attataggtgtgagc

SEQ ID NO: 306430 - DNA, 15 bp, Homo sapiens
ttttttgtttgtttg

SEQ ID NO: 306431 - DNA, 15 bp, Homo sapiens
tttttgtttgtttgt

SEQ ID NO: 306432 - DNA, 15 bp, Homo sapiens
ttttgtttgtttgtt

SEQ ID NO: 306433 - DNA, 15 bp, Homo sapiens
tttgtttgtttgttt

SEQ ID NO: 306434 - DNA, 15 bp, Homo sapiens
gggacagagtcttgc

SEQ ID NO: 306435 - DNA, 15 bp, Homo sapiens
ggacagagtcttgct

SEQ ID NO: 306436 - DNA, 15 bp, Homo sapiens
gattctcgtgcctca

SEQ ID NO: 306437 - DNA, 15 bp, Homo sapiens
attctcgtgcctcag

SEQ ID NO: 306438 - DNA, 15 bp, Homo sapiens
ttctcgtgcctcagc

SEQ ID NO: 306439 - DNA, 15 bp, Homo sapiens
tctcgtgcctcagcc

SEQ ID NO: 306440 - DNA, 15 bp, Homo sapiens
ctcgtgcctcagcct

SEQ ID NO: 306441 - DNA, 15 bp, Homo sapiens
tcgtgcctcagcctc

SEQ ID NO: 306442 - DNA, 15 bp, Homo sapiens
cgtgcctcagcctcc

SEQ ID NO: 306443 - DNA, 15 bp, Homo sapiens
gtgcctcagcctccc

SEQ ID NO: 306444 - DNA, 15 bp, Homo sapiens
tgcctcagcctcccc

SEQ ID NO: 306445 - DNA, 15 bp, Homo sapiens
gcctcagcctcccca

SEQ ID NO: 306446 - DNA, 15 bp, Homo sapiens
cctcagcctccccag

SEQ ID NO: 306447 - DNA, 15 bp, Homo sapiens
agcctccccagtagc

SEQ ID NO: 306448 - DNA, 15 bp, Homo sapiens
gcctccccagtagct

SEQ ID NO: 306449 - DNA, 15 bp, Homo sapiens
cctccccagtagctg

SEQ ID NO: 306450 - DNA, 15 bp, Homo sapiens
tcctggcctcaagtg

SEQ ID NO: 306451 - DNA, 15 bp, Homo sapiens
cctggcctcaagtga

SEQ ID NO: 306452 - DNA, 15 bp, Homo sapiens
ctggcctcaagtgat

SEQ ID NO: 306453 - DNA, 15 bp, Homo sapiens
tggcctcaagtgatc

SEQ ID NO: 306454 - DNA, 15 bp, Homo sapiens
acctgcctcagcctc

SEQ ID NO: 306455 - DNA, 15 bp, Homo sapiens
ctatatgatctttga

SEQ ID NO: 306456 - DNA, 15 bp, Homo sapiens
atttaaaaaatatga

SEQ ID NO: 306457 - DNA, 15 bp, Homo sapiens
tttaaaaaatatgaa

SEQ ID NO: 306458 - DNA, 15 bp, Homo sapiens
ttaaaaaatatgaaa

SEQ ID NO: 306459 - DNA, 15 bp, Homo sapiens
aaaaaaaaataataa

SEQ ID NO: 306460 - DNA, 15 bp, Homo sapiens
aaaaaaaataataat

SEQ ID NO: 306461 - DNA, 15 bp, Homo sapiens
gattgtaggtttctt

SEQ ID NO: 306462 - DNA, 15 bp, Homo sapiens
attatttatatattt

SEQ ID NO: 306463 - DNA, 15 bp, Homo sapiens
tttttcttatttttt

SEQ ID NO: 306464 - DNA, 15 bp, Homo sapiens
tttttttttttttac

SEQ ID NO: 306465 - DNA, 15 bp, Homo sapiens
ttttttttttttact

SEQ ID NO: 306466 - DNA, 15 bp, Homo sapiens
tttttttttttactt

SEQ ID NO: 306467 - DNA, 15 bp, Homo sapiens
ttttttttttacttt

SEQ ID NO: 306468 - DNA, 15 bp, Homo sapiens
aaaaataaactcaaa

SEQ ID NO: 306469 - DNA, 15 bp, Homo sapiens
aaaataaactcaaaa

SEQ ID NO: 306470 - DNA, 15 bp, Homo sapiens
tatatatatttatat

SEQ ID NO: 306471 - DNA, 15 bp, Homo sapiens
atatatatttatata

SEQ ID NO: 306472 - DNA, 15 bp, Homo sapiens
tatatatttatatat

SEQ ID NO: 306473 - DNA, 15 bp, Homo sapiens
atatatttatatata

SEQ ID NO: 306474 - DNA, 15 bp, Homo sapiens
ataaatatatattta

SEQ ID NO: 306475 - DNA, 15 bp, Homo sapiens
taaatatatatttat

SEQ ID NO: 306476 - DNA, 15 bp, Homo sapiens
tatatttatatataa

SEQ ID NO: 306477 - DNA, 15 bp, Homo sapiens
atatttatatataaa

SEQ ID NO: 306478 - DNA, 15 bp, Homo sapiens
tatttatatataaat

SEQ ID NO: 306479 - DNA, 15 bp, Homo sapiens
atttatatataaata

SEQ ID NO: 306480 - DNA, 15 bp, Homo sapiens
tttatatataaatat

SEQ ID NO: 306481 - DNA, 15 bp, Homo sapiens
ttatatataaatata

SEQ ID NO: 306482 - DNA, 15 bp, Homo sapiens
tatatataaatatat

SEQ ID NO: 306483 - DNA, 15 bp, Homo sapiens
atatataaatatata

SEQ ID NO: 306484 - DNA, 15 bp, Homo sapiens
tatataaatatatat

SEQ ID NO: 306485 - DNA, 15 bp, Homo sapiens
atataaatatatata

SEQ ID NO: 306486 - DNA, 15 bp, Homo sapiens
gtatatatatatatt

SEQ ID NO: 306487 - DNA, 15 bp, Homo sapiens
tatatatatatattt

SEQ ID NO: 306488 - DNA, 15 bp, Homo sapiens
ttttttttttttaac

SEQ ID NO: 306489 - DNA, 15 bp, Homo sapiens
gagtcttactctgtc

SEQ ID NO: 306490 - DNA, 15 bp, Homo sapiens
agtcttactctgtca

SEQ ID NO: 306491 - DNA, 15 bp, Homo sapiens
gtcttactctgtcac

SEQ ID NO: 306492 - DNA, 15 bp, Homo sapiens
tcttactctgtcacc

SEQ ID NO: 306493 - DNA, 15 bp, Homo sapiens
cttactctgtcaccc

SEQ ID NO: 306494 - DNA, 15 bp, Homo sapiens
ttactctgtcaccca

SEQ ID NO: 306495 - DNA, 15 bp, Homo sapiens
tactctgtcacccag

SEQ ID NO: 306496 - DNA, 15 bp, Homo sapiens
gagtgcagtggcaca

SEQ ID NO: 306497 - DNA, 15 bp, Homo sapiens
agtgcagtggcacaa

SEQ ID NO: 306498 - DNA, 15 bp, Homo sapiens
gtgcagtggcacaat

SEQ ID NO: 306499 - DNA, 15 bp, Homo sapiens
tgcagtggcacaatc

SEQ ID NO: 306500 - DNA, 15 bp, Homo sapiens
gcagtggcacaatct

SEQ ID NO: 306501 - DNA, 15 bp, Homo sapiens
cagtggcacaatctt

SEQ ID NO: 306502 - DNA, 15 bp, Homo sapiens
agtggcacaatcttg

SEQ ID NO: 306503 - DNA, 15 bp, Homo sapiens
agagacggggtttca

SEQ ID NO: 306504 - DNA, 15 bp, Homo sapiens
gagacggggtttcac

SEQ ID NO: 306505 - DNA, 15 bp, Homo sapiens
agacggggtttcacc

SEQ ID NO: 306506 - DNA, 15 bp, Homo sapiens
ttgttgtccaggctg

SEQ ID NO: 306507 - DNA, 15 bp, Homo sapiens
tgttgtccaggctgg

SEQ ID NO: 306508 - DNA, 15 bp, Homo sapiens
tcttgaactcctggc

SEQ ID NO: 306509 - DNA, 15 bp, Homo sapiens
cttgaactcctggcc

SEQ ID NO: 306510 - DNA, 15 bp, Homo sapiens
ttgaactcctggcct

SEQ ID NO: 306511 - DNA, 15 bp, Homo sapiens
ttataggtgtgagcc

SEQ ID NO: 306512 - DNA, 15 bp, Homo sapiens
tataggtgtgagcca

SEQ ID NO: 306513 - DNA, 15 bp, Homo sapiens
ataggtgtgagccac

SEQ ID NO: 306514 - DNA, 15 bp, Homo sapiens
taggtgtgagccacc

SEQ ID NO: 306515 - DNA, 15 bp, Homo sapiens
tgtgagccaccacac

SEQ ID NO: 306516 - DNA, 15 bp, Homo sapiens
gtgagccaccacacc

SEQ ID NO: 306517 - DNA, 15 bp, Homo sapiens
tgagccaccacaccc

SEQ ID NO: 306518 - DNA, 15 bp, Homo sapiens
gagccaccacaccca

SEQ ID NO: 306519 - DNA, 15 bp, Homo sapiens
agccaccacacccag

SEQ ID NO: 306520 - DNA, 15 bp, Homo sapiens
atttactttaaaata

SEQ ID NO: 306521 - DNA, 15 bp, Homo sapiens
cacttgggaggccaa

SEQ ID NO: 306522 - DNA, 15 bp, Homo sapiens
tggatcacttgaggc

SEQ ID NO: 306523 - DNA, 15 bp, Homo sapiens
gatcacttgaggcca

SEQ ID NO: 306524 - DNA, 15 bp, Homo sapiens
atcacttgaggccag

SEQ ID NO: 306525 - DNA, 15 bp, Homo sapiens
tcacttgaggccagg

SEQ ID NO: 306526 - DNA, 15 bp, Homo sapiens
cacttgaggccagga

SEQ ID NO: 306527 - DNA, 15 bp, Homo sapiens
tgaggccaggagttt

SEQ ID NO: 306528 - DNA, 15 bp, Homo sapiens
gaggccaggagtttg

SEQ ID NO: 306529 - DNA, 15 bp, Homo sapiens
aggccaggagtttga

SEQ ID NO: 306530 - DNA, 15 bp, Homo sapiens
ggccaggagtttgag

SEQ ID NO: 306531 - DNA, 15 bp, Homo sapiens
ccaggagtttgagac

SEQ ID NO: 306532 - DNA, 15 bp, Homo sapiens
tgagaccagcctggg

SEQ ID NO: 306533 - DNA, 15 bp, Homo sapiens
gagaccagcctgggc

SEQ ID NO: 306534 - DNA, 15 bp, Homo sapiens
ccatgcctgtaatcc

SEQ ID NO: 306535 - DNA, 15 bp, Homo sapiens
agctacttgggaggt

SEQ ID NO: 306536 - DNA, 15 bp, Homo sapiens
gctacttgggaggtt

SEQ ID NO: 306537 - DNA, 15 bp, Homo sapiens
ctacttgggaggttg

SEQ ID NO: 306538 - DNA, 15 bp, Homo sapiens
tacttgggaggttga

SEQ ID NO: 306539 - DNA, 15 bp, Homo sapiens
acttgggaggttgag

SEQ ID NO: 306540 - DNA, 15 bp, Homo sapiens
cttgggaggttgagg

SEQ ID NO: 306541 - DNA, 15 bp, Homo sapiens
gcttgaactcaggag

SEQ ID NO: 306542 - DNA, 15 bp, Homo sapiens
cagagattgcagtga

SEQ ID NO: 306543 - DNA, 15 bp, Homo sapiens
agagattgcagtgag

SEQ ID NO: 306544 - DNA, 15 bp, Homo sapiens
gagattgcagtgagc

SEQ ID NO: 306545 - DNA, 15 bp, Homo sapiens
agcctgggtaacaaa

SEQ ID NO: 306546 - DNA, 15 bp, Homo sapiens
gcctgggtaacaaag

SEQ ID NO: 306547 - DNA, 15 bp, Homo sapiens
cctgggtaacaaagt

SEQ ID NO: 306548 - DNA, 15 bp, Homo sapiens
tcattgccacttcca

SEQ ID NO: 306549 - DNA, 15 bp, Homo sapiens
agaagcaactgcagc

SEQ ID NO: 306550 - DNA, 15 bp, Homo sapiens
aaattttctttcttt

SEQ ID NO: 306551 - DNA, 15 bp, Homo sapiens
cctctgcctcctggg

SEQ ID NO: 306552 - DNA, 15 bp, Homo sapiens
ctctgcctcctgggt

SEQ ID NO: 306553 - DNA, 15 bp, Homo sapiens
tctgcctcctgggtt

SEQ ID NO: 306554 - DNA, 15 bp, Homo sapiens
ctgcctcctgggttc

SEQ ID NO: 306555 - DNA, 15 bp, Homo sapiens
tgcctcctgggttca

SEQ ID NO: 306556 - DNA, 15 bp, Homo sapiens
ccacctcagtctccc

SEQ ID NO: 306557 - DNA, 15 bp, Homo sapiens
cacctcagtctccca

SEQ ID NO: 306558 - DNA, 15 bp, Homo sapiens
acctcagtctcccaa

SEQ ID NO: 306559 - DNA, 15 bp, Homo sapiens
gtgtgccaccacacc

SEQ ID NO: 306560 - DNA, 15 bp, Homo sapiens
tgtgccaccacaccc

SEQ ID NO: 306561 - DNA, 15 bp, Homo sapiens
gaggctgaggcaggt

SEQ ID NO: 306562 - DNA, 15 bp, Homo sapiens
aggctgaggcaggtg

SEQ ID NO: 306563 - DNA, 15 bp, Homo sapiens
ggctgaggcaggtgg

SEQ ID NO: 306564 - DNA, 15 bp, Homo sapiens
gctgaggcaggtgga

SEQ ID NO: 306565 - DNA, 15 bp, Homo sapiens
ctgaggcaggtggat

SEQ ID NO: 306566 - DNA, 15 bp, Homo sapiens
gaggcaggtggatca

SEQ ID NO: 306567 - DNA, 15 bp, Homo sapiens
aggcaggtggatcac

SEQ ID NO: 306568 - DNA, 15 bp, Homo sapiens
caggtggatcacttg

SEQ ID NO: 306569 - DNA, 15 bp, Homo sapiens
aggtggatcacttga

SEQ ID NO: 306570 - DNA, 15 bp, Homo sapiens
gatcacttgaagtca

SEQ ID NO: 306571 - DNA, 15 bp, Homo sapiens
atcacttgaagtcag

SEQ ID NO: 306572 - DNA, 15 bp, Homo sapiens
tcacttgaagtcagg

SEQ ID NO: 306573 - DNA, 15 bp, Homo sapiens
cacttgaagtcagga

SEQ ID NO: 306574 - DNA, 15 bp, Homo sapiens
acttgaagtcaggag

SEQ ID NO: 306575 - DNA, 15 bp, Homo sapiens
cttgaagtcaggagt

SEQ ID NO: 306576 - DNA, 15 bp, Homo sapiens
ttgaagtcaggagtt

SEQ ID NO: 306577 - DNA, 15 bp, Homo sapiens
tgaagtcaggagttc

SEQ ID NO: 306578 - DNA, 15 bp, Homo sapiens
gaagtcaggagttca

SEQ ID NO: 306579 - DNA, 15 bp, Homo sapiens
aagtcaggagttcaa

SEQ ID NO: 306580 - DNA, 15 bp, Homo sapiens
agtcaggagttcaag

SEQ ID NO: 306581 - DNA, 15 bp, Homo sapiens
caggagttcaagact

SEQ ID NO: 306582 - DNA, 15 bp, Homo sapiens
aggagttcaagacta

SEQ ID NO: 306583 - DNA, 15 bp, Homo sapiens
ggagttcaagactag

SEQ ID NO: 306584 - DNA, 15 bp, Homo sapiens
gagttcaagactagc

SEQ ID NO: 306585 - DNA, 15 bp, Homo sapiens
agttcaagactagcc

SEQ ID NO: 306586 - DNA, 15 bp, Homo sapiens
taaaaatataaaaat

SEQ ID NO: 306587 - DNA, 15 bp, Homo sapiens
ggtgcctgtaatccc

SEQ ID NO: 306588 - DNA, 15 bp, Homo sapiens
tgtgccactgcactc

SEQ ID NO: 306589 - DNA, 15 bp, Homo sapiens
agactccctctcaaa

SEQ ID NO: 306590 - DNA, 15 bp, Homo sapiens
gactccctctcaaaa

SEQ ID NO: 306591 - DNA, 15 bp, Homo sapiens
actccctctcaaaaa

SEQ ID NO: 306592 - DNA, 15 bp, Homo sapiens
ctccctctcaaaaaa

SEQ ID NO: 306593 - DNA, 15 bp, Homo sapiens
tccctctcaaaaaaa

SEQ ID NO: 306594 - DNA, 15 bp, Homo sapiens
ccctctcaaaaaaaa

SEQ ID NO: 306595 - DNA, 15 bp, Homo sapiens
cctctcaaaaaaaaa

SEQ ID NO: 306596 - DNA, 15 bp, Homo sapiens
ctctcaaaaaaaaaa

SEQ ID NO: 306597 - DNA, 15 bp, Homo sapiens
cgcttgtaatcccag

SEQ ID NO: 306598 - DNA, 15 bp, Homo sapiens
ggcgggcagatcact

SEQ ID NO: 306599 - DNA, 15 bp, Homo sapiens
gcgggcagatcactt

SEQ ID NO: 306600 - DNA, 15 bp, Homo sapiens
cgggcagatcacttg

SEQ ID NO: 306601 - DNA, 15 bp, Homo sapiens
gggcagatcacttga

SEQ ID NO: 306602 - DNA, 15 bp, Homo sapiens
ggcagatcacttgag

SEQ ID NO: 306603 - DNA, 15 bp, Homo sapiens
gcagatcacttgagg

SEQ ID NO: 306604 - DNA, 15 bp, Homo sapiens
cagatcacttgaggt

SEQ ID NO: 306605 - DNA, 15 bp, Homo sapiens
agatcacttgaggtc

SEQ ID NO: 306606 - DNA, 15 bp, Homo sapiens
tcacttgaggtcaga

SEQ ID NO: 306607 - DNA, 15 bp, Homo sapiens
gcttgaacccaggaa

SEQ ID NO: 306608 - DNA, 15 bp, Homo sapiens
cttgaacccaggaag

SEQ ID NO: 306609 - DNA, 15 bp, Homo sapiens
ttgaacccaggaagc

SEQ ID NO: 306610 - DNA, 15 bp, Homo sapiens
tgaacccaggaagca

SEQ ID NO: 306611 - DNA, 15 bp, Homo sapiens
gaacccaggaagcag

SEQ ID NO: 306612 - DNA, 15 bp, Homo sapiens
aacccaggaagcaga

SEQ ID NO: 306613 - DNA, 15 bp, Homo sapiens
acccaggaagcagag

SEQ ID NO: 306614 - DNA, 15 bp, Homo sapiens
cccaggaagcagagg

SEQ ID NO: 306615 - DNA, 15 bp, Homo sapiens
gagatggcaccactg

SEQ ID NO: 306616 - DNA, 15 bp, Homo sapiens
agatggcaccactgc

SEQ ID NO: 306617 - DNA, 15 bp, Homo sapiens
gatggcaccactgca

SEQ ID NO: 306618 - DNA, 15 bp, Homo sapiens
atggcaccactgcac

SEQ ID NO: 306619 - DNA, 15 bp, Homo sapiens
tggcaccactgcact

SEQ ID NO: 306620 - DNA, 15 bp, Homo sapiens
ggcaccactgcactc

SEQ ID NO: 306621 - DNA, 15 bp, Homo sapiens
gcaccactgcactcc

SEQ ID NO: 306622 - DNA, 15 bp, Homo sapiens
ccactgcactccagt

SEQ ID NO: 306623 - DNA, 15 bp, Homo sapiens
cactgcactccagtc

SEQ ID NO: 306624 - DNA, 15 bp, Homo sapiens
gcactccagtctggg

SEQ ID NO: 306625 - DNA, 15 bp, Homo sapiens
cactccagtctgggt

SEQ ID NO: 306626 - DNA, 15 bp, Homo sapiens
actccagtctgggtg

SEQ ID NO: 306627 - DNA, 15 bp, Homo sapiens
ctccagtctgggtga

SEQ ID NO: 306628 - DNA, 15 bp, Homo sapiens
tccagtctgggtgac

SEQ ID NO: 306629 - DNA, 15 bp, Homo sapiens
ccagtctgggtgaca

SEQ ID NO: 306630 - DNA, 15 bp, Homo sapiens
caaaaaataaaaata

SEQ ID NO: 306631 - DNA, 15 bp, Homo sapiens
aaaaaataaaaataa

SEQ ID NO: 306632 - DNA, 15 bp, Homo sapiens
ttttgtgtgtgtgtg

SEQ ID NO: 306633 - DNA, 15 bp, Homo sapiens
tgtgtgtgtgtgtac

SEQ ID NO: 306634 - DNA, 15 bp, Homo sapiens
aaatgctacattttg

SEQ ID NO: 306635 - DNA, 15 bp, Homo sapiens
tacaaatctgagaag

SEQ ID NO: 306636 - DNA, 15 bp, Homo sapiens
tttgtatgaaataaa

SEQ ID NO: 306637 - DNA, 15 bp, Homo sapiens
tgaatggataaacaa

SEQ ID NO: 306638 - DNA, 15 bp, Homo sapiens
gaatggataaacaaa

SEQ ID NO: 306639 - DNA, 15 bp, Homo sapiens
aatggataaacaaaa

SEQ ID NO: 306640 - DNA, 15 bp, Homo sapiens
atggataaacaaaat

SEQ ID NO: 306641 - DNA, 15 bp, Homo sapiens
tggataaacaaaatg

SEQ ID NO: 306642 - DNA, 15 bp, Homo sapiens
ggataaacaaaatgt

SEQ ID NO: 306643 - DNA, 15 bp, Homo sapiens
gataaacaaaatgtg

SEQ ID NO: 306644 - DNA, 15 bp, Homo sapiens
gacacatgctacaac

SEQ ID NO: 306645 - DNA, 15 bp, Homo sapiens
acacatgctacaaca

SEQ ID NO: 306646 - DNA, 15 bp, Homo sapiens
cacatgctacaacat

SEQ ID NO: 306647 - DNA, 15 bp, Homo sapiens
gaagagatagagaaa

SEQ ID NO: 306648 - DNA, 15 bp, Homo sapiens
tattatgaaaagtca

SEQ ID NO: 306649 - DNA, 15 bp, Homo sapiens
ttttaaagacaatgt

SEQ ID NO: 306650 - DNA, 15 bp, Homo sapiens
ggtgacacattcaaa

SEQ ID NO: 306651 - DNA, 15 bp, Homo sapiens
ttcagtaataaaaat

SEQ ID NO: 306652 - DNA, 15 bp, Homo sapiens
tcagtaataaaaatg

SEQ ID NO: 306653 - DNA, 15 bp, Homo sapiens
attcattttttaatt

SEQ ID NO: 306654 - DNA, 15 bp, Homo sapiens
ttcattttttaattt

SEQ ID NO: 306655 - DNA, 15 bp, Homo sapiens
ttttttcttaggaca

SEQ ID NO: 306656 - DNA, 15 bp, Homo sapiens
ttttaaaatgtcttt

SEQ ID NO: 306657 - DNA, 15 bp, Homo sapiens
ctgcagtcttgacct

SEQ ID NO: 306658 - DNA, 15 bp, Homo sapiens
tgcagtcttgacctc

SEQ ID NO: 306659 - DNA, 15 bp, Homo sapiens
gcagtcttgacctcc

SEQ ID NO: 306660 - DNA, 15 bp, Homo sapiens
ctgggactacaggca

SEQ ID NO: 306661 - DNA, 15 bp, Homo sapiens
tgggactacaggcat

SEQ ID NO: 306662 - DNA, 15 bp, Homo sapiens
gggactacaggcatg

SEQ ID NO: 306663 - DNA, 15 bp, Homo sapiens
gggctcaagtgatct

SEQ ID NO: 306664 - DNA, 15 bp, Homo sapiens
ggctcaagtgatctt

SEQ ID NO: 306665 - DNA, 15 bp, Homo sapiens
aaaataacagatgtt

SEQ ID NO: 306666 - DNA, 15 bp, Homo sapiens
ttccatataatctcc

SEQ ID NO: 306667 - DNA, 15 bp, Homo sapiens
tccatataatctcct

SEQ ID NO: 306668 - DNA, 15 bp, Homo sapiens
ccatataatctcctc

SEQ ID NO: 306669 - DNA, 15 bp, Homo sapiens
gaggagattatatgg

SEQ ID NO: 306670 - DNA, 15 bp, Homo sapiens
aggagattatatgga

SEQ ID NO: 306671 - DNA, 15 bp, Homo sapiens
ggagattatatggaa

SEQ ID NO: 306672 - DNA, 15 bp, Homo sapiens
aagaaatgaagaaaa

SEQ ID NO: 306673 - DNA, 15 bp, Homo sapiens
actaaatatttttaa

SEQ ID NO: 306674 - DNA, 15 bp, Homo sapiens
ctaaatatttttaaa

SEQ ID NO: 306675 - DNA, 15 bp, Homo sapiens
taaatatttttaaat

SEQ ID NO: 306676 - DNA, 15 bp, Homo sapiens
tttgttttgtttttt

SEQ ID NO: 306677 - DNA, 15 bp, Homo sapiens
ttgttttgttttttg

SEQ ID NO: 306678 - DNA, 15 bp, Homo sapiens
tgttttgttttttga

SEQ ID NO: 306679 - DNA, 15 bp, Homo sapiens
taccacattttcttt

SEQ ID NO: 306680 - DNA, 15 bp, Homo sapiens
accacattttcttta

SEQ ID NO: 306681 - DNA, 15 bp, Homo sapiens
tatttaaatatttta

SEQ ID NO: 306682 - DNA, 15 bp, Homo sapiens
actgcaacctctgct

SEQ ID NO: 306683 - DNA, 15 bp, Homo sapiens
ctgcaacctctgctt

SEQ ID NO: 306684 - DNA, 15 bp, Homo sapiens
tgcaacctctgcttc

SEQ ID NO: 306685 - DNA, 15 bp, Homo sapiens
gcaacctctgcttcc

SEQ ID NO: 306686 - DNA, 15 bp, Homo sapiens
tgggactacaggtgc

SEQ ID NO: 306687 - DNA, 15 bp, Homo sapiens
gtcttgatctcttga

SEQ ID NO: 306688 - DNA, 15 bp, Homo sapiens
tcttgatctcttgac

SEQ ID NO: 306689 - DNA, 15 bp, Homo sapiens
cttgatctcttgacc

SEQ ID NO: 306690 - DNA, 15 bp, Homo sapiens
ttgatctcttgacct

SEQ ID NO: 306691 - DNA, 15 bp, Homo sapiens
tgggattacaagcgt

SEQ ID NO: 306692 - DNA, 15 bp, Homo sapiens
gggattacaagcgtg

SEQ ID NO: 306693 - DNA, 15 bp, Homo sapiens
ggattacaagcgtga

SEQ ID NO: 306694 - DNA, 15 bp, Homo sapiens
aaaaaacaaaaaaca

SEQ ID NO: 306695 - DNA, 15 bp, Homo sapiens
aaaaacaaaaaacaa

SEQ ID NO: 306696 - DNA, 15 bp, Homo sapiens
actgcagccttgaac

SEQ ID NO: 306697 - DNA, 15 bp, Homo sapiens
ctgcagccttgaact

SEQ ID NO: 306698 - DNA, 15 bp, Homo sapiens
gggctcaagcagtcc

SEQ ID NO: 306699 - DNA, 15 bp, Homo sapiens
tgtaatcccagtact

SEQ ID NO: 306700 - DNA, 15 bp, Homo sapiens
gtaatcccagtactt

SEQ ID NO: 306701 - DNA, 15 bp, Homo sapiens
taatcccagtacttt

SEQ ID NO: 306702 - DNA, 15 bp, Homo sapiens
aatcccagtactttg

SEQ ID NO: 306703 - DNA, 15 bp, Homo sapiens
atcccagtactttgg

SEQ ID NO: 306704 - DNA, 15 bp, Homo sapiens
tcccagtactttggg

SEQ ID NO: 306705 - DNA, 15 bp, Homo sapiens
cccagtactttggga

SEQ ID NO: 306706 - DNA, 15 bp, Homo sapiens
ccagtactttgggag

SEQ ID NO: 306707 - DNA, 15 bp, Homo sapiens
cagtactttgggagg

SEQ ID NO: 306708 - DNA, 15 bp, Homo sapiens
agtactttgggaggc

SEQ ID NO: 306709 - DNA, 15 bp, Homo sapiens
gaggctgaggtgggt

SEQ ID NO: 306710 - DNA, 15 bp, Homo sapiens
aggctgaggtgggtg

SEQ ID NO: 306711 - DNA, 15 bp, Homo sapiens
ggctgaggtgggtgg

SEQ ID NO: 306712 - DNA, 15 bp, Homo sapiens
gctgaggtgggtgga

SEQ ID NO: 306713 - DNA, 15 bp, Homo sapiens
ctgaggtgggtggat

SEQ ID NO: 306714 - DNA, 15 bp, Homo sapiens
gggtggattgcctga

SEQ ID NO: 306715 - DNA, 15 bp, Homo sapiens
ggtggattgcctgag

SEQ ID NO: 306716 - DNA, 15 bp, Homo sapiens
gtggattgcctgagc

SEQ ID NO: 306717 - DNA, 15 bp, Homo sapiens
tggattgcctgagct

SEQ ID NO: 306718 - DNA, 15 bp, Homo sapiens
ttgcctgagctcagg

SEQ ID NO: 306719 - DNA, 15 bp, Homo sapiens
tgcctgagctcagga

SEQ ID NO: 306720 - DNA, 15 bp, Homo sapiens
gcctgagctcaggag

SEQ ID NO: 306721 - DNA, 15 bp, Homo sapiens
cctgagctcaggagt

SEQ ID NO: 306722 - DNA, 15 bp, Homo sapiens
ctgagctcaggagtt

SEQ ID NO: 306723 - DNA, 15 bp, Homo sapiens
tgagctcaggagttt

SEQ ID NO: 306724 - DNA, 15 bp, Homo sapiens
gaccagcctgggcaa

SEQ ID NO: 306725 - DNA, 15 bp, Homo sapiens
accagcctgggcaac

SEQ ID NO: 306726 - DNA, 15 bp, Homo sapiens
agcctgggcaacatg

SEQ ID NO: 306727 - DNA, 15 bp, Homo sapiens
gcctgggcaacatgg

SEQ ID NO: 306728 - DNA, 15 bp, Homo sapiens
ataaaaaatacaaaa

SEQ ID NO: 306729 - DNA, 15 bp, Homo sapiens
taaaaaatacaaaaa

SEQ ID NO: 306730 - DNA, 15 bp, Homo sapiens
ggcatggtggtgtgc

SEQ ID NO: 306731 - DNA, 15 bp, Homo sapiens
tggtggtgtgcgcct

SEQ ID NO: 306732 - DNA, 15 bp, Homo sapiens
ggaggatggcttgag

SEQ ID NO: 306733 - DNA, 15 bp, Homo sapiens
gaggatggcttgagc

SEQ ID NO: 306734 - DNA, 15 bp, Homo sapiens
aggatggcttgagcc

SEQ ID NO: 306735 - DNA, 15 bp, Homo sapiens
ggatggcttgagccc

SEQ ID NO: 306736 - DNA, 15 bp, Homo sapiens
gatggcttgagccca

SEQ ID NO: 306737 - DNA, 15 bp, Homo sapiens
gcttgagcccagggg

SEQ ID NO: 306738 - DNA, 15 bp, Homo sapiens
ttaaaaaaaaaacaa

SEQ ID NO: 306739 - DNA, 15 bp, Homo sapiens
taaaaaaaaaacaaa

SEQ ID NO: 306740 - DNA, 15 bp, Homo sapiens
tcaagcaatcctcct

SEQ ID NO: 306741 - DNA, 15 bp, Homo sapiens
caagcaatcctcctg

SEQ ID NO: 306742 - DNA, 15 bp, Homo sapiens
aagcaatcctcctgc

SEQ ID NO: 306743 - DNA, 15 bp, Homo sapiens
agcaatcctcctgcc

SEQ ID NO: 306744 - DNA, 15 bp, Homo sapiens
gcaatcctcctgcct

SEQ ID NO: 306745 - DNA, 15 bp, Homo sapiens
gttttgttttgtttg

SEQ ID NO: 306746 - DNA, 15 bp, Homo sapiens
tgatcacagctcact

SEQ ID NO: 306747 - DNA, 15 bp, Homo sapiens
gatcacagctcactg

SEQ ID NO: 306748 - DNA, 15 bp, Homo sapiens
attatttttaaattt

SEQ ID NO: 306749 - DNA, 15 bp, Homo sapiens
tatttttaaattttt

SEQ ID NO: 306750 - DNA, 15 bp, Homo sapiens
ggctggagggcagtg

SEQ ID NO: 306751 - DNA, 15 bp, Homo sapiens
gctggagggcagtgg

SEQ ID NO: 306752 - DNA, 15 bp, Homo sapiens
tgatccacctgcctt

SEQ ID NO: 306753 - DNA, 15 bp, Homo sapiens
gatccacctgccttg

SEQ ID NO: 306754 - DNA, 15 bp, Homo sapiens
atccacctgccttgg

SEQ ID NO: 306755 - DNA, 15 bp, Homo sapiens
tccacctgccttggc

SEQ ID NO: 306756 - DNA, 15 bp, Homo sapiens
ccacctgccttggcc

SEQ ID NO: 306757 - DNA, 15 bp, Homo sapiens
cacctgccttggcct

SEQ ID NO: 306758 - DNA, 15 bp, Homo sapiens
acctgccttggcctc

SEQ ID NO: 306759 - DNA, 15 bp, Homo sapiens
attattttattttat

SEQ ID NO: 306760 - DNA, 15 bp, Homo sapiens
gccaccacacccggc

SEQ ID NO: 306761 - DNA, 15 bp, Homo sapiens
ccaccacacccggct

SEQ ID NO: 306762 - DNA, 15 bp, Homo sapiens
caccacacccggcta

SEQ ID NO: 306763 - DNA, 15 bp, Homo sapiens
tttttatatatatat

SEQ ID NO: 306764 - DNA, 15 bp, Homo sapiens
ttttatatatatata

SEQ ID NO: 306765 - DNA, 15 bp, Homo sapiens
tttatatatatatat

SEQ ID NO: 306766 - DNA, 15 bp, Homo sapiens
atatatatatatatt

SEQ ID NO: 306767 - DNA, 15 bp, Homo sapiens
atatatatatatttt

SEQ ID NO: 306768 - DNA, 15 bp, Homo sapiens
aatctcctgacctca

SEQ ID NO: 306769 - DNA, 15 bp, Homo sapiens
gcctgcttcagcctc

SEQ ID NO: 306770 - DNA, 15 bp, Homo sapiens
cctgcttcagcctcc

SEQ ID NO: 306771 - DNA, 15 bp, Homo sapiens
ctgcttcagcctccc

SEQ ID NO: 306772 - DNA, 15 bp, Homo sapiens
agcacagaggtcctg

SEQ ID NO: 306773 - DNA, 15 bp, Homo sapiens
tcacttgcattttct

SEQ ID NO: 306774 - DNA, 15 bp, Homo sapiens
cacttgcattttctt

SEQ ID NO: 306775 - DNA, 15 bp, Homo sapiens
tgctctcttgtttca

SEQ ID NO: 306776 - DNA, 15 bp, Homo sapiens
gctctcttgtttcat

SEQ ID NO: 306777 - DNA, 15 bp, Homo sapiens
ctctcttgtttcatc

SEQ ID NO: 306778 - DNA, 15 bp, Homo sapiens
tctcttgtttcatca

SEQ ID NO: 306779 - DNA, 15 bp, Homo sapiens
taacaaaaaagaaaa

SEQ ID NO: 306780 - DNA, 15 bp, Homo sapiens
aattattatctttta

SEQ ID NO: 306781 - DNA, 15 bp, Homo sapiens
attattatcttttat

SEQ ID NO: 306782 - DNA, 15 bp, Homo sapiens
ctcctgagttcaagc

SEQ ID NO: 306783 - DNA, 15 bp, Homo sapiens
tgagtagctgggatc

SEQ ID NO: 306784 - DNA, 15 bp, Homo sapiens
gagtagctgggatca

SEQ ID NO: 306785 - DNA, 15 bp, Homo sapiens
agtagctgggatcac

SEQ ID NO: 306786 - DNA, 15 bp, Homo sapiens
gtagctgggatcaca

SEQ ID NO: 306787 - DNA, 15 bp, Homo sapiens
tagctgggatcacag

SEQ ID NO: 306788 - DNA, 15 bp, Homo sapiens
attcatttatttatt

SEQ ID NO: 306789 - DNA, 15 bp, Homo sapiens
gctcactgcagcctt

SEQ ID NO: 306790 - DNA, 15 bp, Homo sapiens
ctcactgcagccttg

SEQ ID NO: 306791 - DNA, 15 bp, Homo sapiens
tcactgcagccttga

SEQ ID NO: 306792 - DNA, 15 bp, Homo sapiens
cactgcagccttgaa

SEQ ID NO: 306793 - DNA, 15 bp, Homo sapiens
tttaagaaattggtc

SEQ ID NO: 306794 - DNA, 15 bp, Homo sapiens
ttaagaaattggtca

SEQ ID NO: 306795 - DNA, 15 bp, Homo sapiens
acttaaacacttagg

SEQ ID NO: 306796 - DNA, 15 bp, Homo sapiens
cttaaacacttaggc

SEQ ID NO: 306797 - DNA, 15 bp, Homo sapiens
ttaaacacttaggca

SEQ ID NO: 306798 - DNA, 15 bp, Homo sapiens
taaacacttaggcat

SEQ ID NO: 306799 - DNA, 15 bp, Homo sapiens
gcattttgggaggct

SEQ ID NO: 306800 - DNA, 15 bp, Homo sapiens
cattttgggaggctg

SEQ ID NO: 306801 - DNA, 15 bp, Homo sapiens
attttgggaggctga

SEQ ID NO: 306802 - DNA, 15 bp, Homo sapiens
ttttgggaggctgag

SEQ ID NO: 306803 - DNA, 15 bp, Homo sapiens
aattgcttgaacctg

SEQ ID NO: 306804 - DNA, 15 bp, Homo sapiens
attgcttgaacctgg

SEQ ID NO: 306805 - DNA, 15 bp, Homo sapiens
ttgcttgaacctggg

SEQ ID NO: 306806 - DNA, 15 bp, Homo sapiens
tgcttgaacctggga

SEQ ID NO: 306807 - DNA, 15 bp, Homo sapiens
caataaataaataaa

SEQ ID NO: 306808 - DNA, 15 bp, Homo sapiens
tacctgagactgggt

SEQ ID NO: 306809 - DNA, 15 bp, Homo sapiens
acctgagactgggta

SEQ ID NO: 306810 - DNA, 15 bp, Homo sapiens
cctgagactgggtaa

SEQ ID NO: 306811 - DNA, 15 bp, Homo sapiens
ctgagactgggtaat

SEQ ID NO: 306812 - DNA, 15 bp, Homo sapiens
tgagactgggtaatt

SEQ ID NO: 306813 - DNA, 15 bp, Homo sapiens
gagactgggtaattt

SEQ ID NO: 306814 - DNA, 15 bp, Homo sapiens
tataaaaccatcaga

SEQ ID NO: 306815 - DNA, 15 bp, Homo sapiens
ataaaaccatcagat

SEQ ID NO: 306816 - DNA, 15 bp, Homo sapiens
acctcccactgggtc

SEQ ID NO: 306817 - DNA, 15 bp, Homo sapiens
cctcccactgggtcc

SEQ ID NO: 306818 - DNA, 15 bp, Homo sapiens
ctcccactgggtccc

SEQ ID NO: 306819 - DNA, 15 bp, Homo sapiens
tcccactgggtccct

SEQ ID NO: 306820 - DNA, 15 bp, Homo sapiens
cccactgggtccctc

SEQ ID NO: 306821 - DNA, 15 bp, Homo sapiens
ccactgggtccctcc

SEQ ID NO: 306822 - DNA, 15 bp, Homo sapiens
cactgggtccctccc

SEQ ID NO: 306823 - DNA, 15 bp, Homo sapiens
aagatgagatttggg

SEQ ID NO: 306824 - DNA, 15 bp, Homo sapiens
agatgagatttgggt

SEQ ID NO: 306825 - DNA, 15 bp, Homo sapiens
gatgagatttgggtg

SEQ ID NO: 306826 - DNA, 15 bp, Homo sapiens
atgagatttgggtgg

SEQ ID NO: 306827 - DNA, 15 bp, Homo sapiens
tgagatttgggtggg

SEQ ID NO: 306828 - DNA, 15 bp, Homo sapiens
gagatttgggtgggg

SEQ ID NO: 306829 - DNA, 15 bp, Homo sapiens
agatttgggtgggga

SEQ ID NO: 306830 - DNA, 15 bp, Homo sapiens
gatttgggtggggac

SEQ ID NO: 306831 - DNA, 15 bp, Homo sapiens
atttgggtggggaca

SEQ ID NO: 306832 - DNA, 15 bp, Homo sapiens
tttgggtggggacac

SEQ ID NO: 306833 - DNA, 15 bp, Homo sapiens
ttttctgttaatttt

SEQ ID NO: 306834 - DNA, 15 bp, Homo sapiens
gaagtattattttag

SEQ ID NO: 306835 - DNA, 15 bp, Homo sapiens
gttttttgagacaga

SEQ ID NO: 306836 - DNA, 15 bp, Homo sapiens
ctaattttcatattt

SEQ ID NO: 306837 - DNA, 15 bp, Homo sapiens
taattttcatatttt

SEQ ID NO: 306838 - DNA, 15 bp, Homo sapiens
aattttcatattttt

SEQ ID NO: 306839 - DNA, 15 bp, Homo sapiens
tttagtagagatggc

SEQ ID NO: 306840 - DNA, 15 bp, Homo sapiens
ttagtagagatggca

SEQ ID NO: 306841 - DNA, 15 bp, Homo sapiens
tagtagagatggcat

SEQ ID NO: 306842 - DNA, 15 bp, Homo sapiens
agtagagatggcatt

SEQ ID NO: 306843 - DNA, 15 bp, Homo sapiens
gtagagatggcattt

SEQ ID NO: 306844 - DNA, 15 bp, Homo sapiens
tagagatggcatttc

SEQ ID NO: 306845 - DNA, 15 bp, Homo sapiens
agagatggcatttca

SEQ ID NO: 306846 - DNA, 15 bp, Homo sapiens
gagatggcatttcac

SEQ ID NO: 306847 - DNA, 15 bp, Homo sapiens
gctcaagcaatcctc

SEQ ID NO: 306848 - DNA, 15 bp, Homo sapiens
accacacccagctga

SEQ ID NO: 306849 - DNA, 15 bp, Homo sapiens
ccacacccagctgat

SEQ ID NO: 306850 - DNA, 15 bp, Homo sapiens
cacacccagctgatt

SEQ ID NO: 306851 - DNA, 15 bp, Homo sapiens
acacccagctgattt

SEQ ID NO: 306852 - DNA, 15 bp, Homo sapiens
cacccagctgatttt

SEQ ID NO: 306853 - DNA, 15 bp, Homo sapiens
acccagctgattttt

SEQ ID NO: 306854 - DNA, 15 bp, Homo sapiens
ctcctgcctcagtct

SEQ ID NO: 306855 - DNA, 15 bp, Homo sapiens
tcaaagtgctgggat

SEQ ID NO: 306856 - DNA, 15 bp, Homo sapiens
ttttttagaaacaaa

SEQ ID NO: 306857 - DNA, 15 bp, Homo sapiens
tttttagaaacaaag

SEQ ID NO: 306858 - DNA, 15 bp, Homo sapiens
tttttaaaaaaagaa

SEQ ID NO: 306859 - DNA, 15 bp, Homo sapiens
ctgggtgtggtggct

SEQ ID NO: 306860 - DNA, 15 bp, Homo sapiens
tgggtgtggtggctc

SEQ ID NO: 306861 - DNA, 15 bp, Homo sapiens
gggtgtggtggctca

SEQ ID NO: 306862 - DNA, 15 bp, Homo sapiens
ggtgtggtggctcac

SEQ ID NO: 306863 - DNA, 15 bp, Homo sapiens
gtgtggtggctcacg

SEQ ID NO: 306864 - DNA, 15 bp, Homo sapiens
tgtggtggctcacgc

SEQ ID NO: 306865 - DNA, 15 bp, Homo sapiens
gaggcgggtggatca

SEQ ID NO: 306866 - DNA, 15 bp, Homo sapiens
aggcgggtggatcac

SEQ ID NO: 306867 - DNA, 15 bp, Homo sapiens
ataaaaatacaaaaa

SEQ ID NO: 306868 - DNA, 15 bp, Homo sapiens
atacaaaaaaaaatt

SEQ ID NO: 306869 - DNA, 15 bp, Homo sapiens
aaaaaaattagctgg

SEQ ID NO: 306870 - DNA, 15 bp, Homo sapiens
gggaggctgaagcag

SEQ ID NO: 306871 - DNA, 15 bp, Homo sapiens
ggaggctgaagcagg

SEQ ID NO: 306872 - DNA, 15 bp, Homo sapiens
ccagcctggctgaca

SEQ ID NO: 306873 - DNA, 15 bp, Homo sapiens
ggtttctaatacagt

SEQ ID NO: 306874 - DNA, 15 bp, Homo sapiens
atgtaactgctttac

SEQ ID NO: 306875 - DNA, 15 bp, Homo sapiens
acctgtaatcccaac

SEQ ID NO: 306876 - DNA, 15 bp, Homo sapiens
cctgtaatcccaaca

SEQ ID NO: 306877 - DNA, 15 bp, Homo sapiens
ctgtaatcccaacac

SEQ ID NO: 306878 - DNA, 15 bp, Homo sapiens
tgtaatcccaacact

SEQ ID NO: 306879 - DNA, 15 bp, Homo sapiens
gtaatcccaacactt

SEQ ID NO: 306880 - DNA, 15 bp, Homo sapiens
taatcccaacacttt

SEQ ID NO: 306881 - DNA, 15 bp, Homo sapiens
aatcccaacactttg

SEQ ID NO: 306882 - DNA, 15 bp, Homo sapiens
cagcctggccaacac

SEQ ID NO: 306883 - DNA, 15 bp, Homo sapiens
gtagtggcacacgcc

SEQ ID NO: 306884 - DNA, 15 bp, Homo sapiens
tagtggcacacgcct

SEQ ID NO: 306885 - DNA, 15 bp, Homo sapiens
agtggcacacgcctg

SEQ ID NO: 306886 - DNA, 15 bp, Homo sapiens
gtggcacacgcctgt

SEQ ID NO: 306887 - DNA, 15 bp, Homo sapiens
tggcacacgcctgta

SEQ ID NO: 306888 - DNA, 15 bp, Homo sapiens
accctgtctcaaaaa

SEQ ID NO: 306889 - DNA, 15 bp, Homo sapiens
ccctgtctcaaaaaa

SEQ ID NO: 306890 - DNA, 15 bp, Homo sapiens
cctgtctcaaaaaaa

SEQ ID NO: 306891 - DNA, 15 bp, Homo sapiens
gatttttttcattaa

SEQ ID NO: 306892 - DNA, 15 bp, Homo sapiens
atagatatctttttt

SEQ ID NO: 306893 - DNA, 15 bp, Homo sapiens
gctatgtgtgataag

SEQ ID NO: 306894 - DNA, 15 bp, Homo sapiens
atgtaaattttaata

SEQ ID NO: 306895 - DNA, 15 bp, Homo sapiens
tgtaaattttaatat

SEQ ID NO: 306896 - DNA, 15 bp, Homo sapiens
gtaaattttaatata

SEQ ID NO: 306897 - DNA, 15 bp, Homo sapiens
taaattttaatataa

SEQ ID NO: 306898 - DNA, 15 bp, Homo sapiens
gagacaaatacttct

SEQ ID NO: 306899 - DNA, 15 bp, Homo sapiens
gaaatttgcacaaaa

SEQ ID NO: 306900 - DNA, 15 bp, Homo sapiens
atttcatataaatgg

SEQ ID NO: 306901 - DNA, 15 bp, Homo sapiens
tttcatataaatgga

SEQ ID NO: 306902 - DNA, 15 bp, Homo sapiens
catccttgccaacac

SEQ ID NO: 306903 - DNA, 15 bp, Homo sapiens
tcaaaagaaaaaaaa

SEQ ID NO: 306904 - DNA, 15 bp, Homo sapiens
caaaagaaaaaaaaa

SEQ ID NO: 306905 - DNA, 15 bp, Homo sapiens
tcttgtattgatttt

SEQ ID NO: 306906 - DNA, 15 bp, Homo sapiens
ggcgggtggatcacc

SEQ ID NO: 306907 - DNA, 15 bp, Homo sapiens
gcgggtggatcacct

SEQ ID NO: 306908 - DNA, 15 bp, Homo sapiens
cgggtggatcacctg

SEQ ID NO: 306909 - DNA, 15 bp, Homo sapiens
ttctactaaaaatac

SEQ ID NO: 306910 - DNA, 15 bp, Homo sapiens
cagctacttgggaag

SEQ ID NO: 306911 - DNA, 15 bp, Homo sapiens
agctacttgggaagc

SEQ ID NO: 306912 - DNA, 15 bp, Homo sapiens
gctacttgggaagct

SEQ ID NO: 306913 - DNA, 15 bp, Homo sapiens
ctacttgggaagctg

SEQ ID NO: 306914 - DNA, 15 bp, Homo sapiens
tacttgggaagctga

SEQ ID NO: 306915 - DNA, 15 bp, Homo sapiens
acttgggaagctgag

SEQ ID NO: 306916 - DNA, 15 bp, Homo sapiens
cttgggaagctgagg

SEQ ID NO: 306917 - DNA, 15 bp, Homo sapiens
ttgggaagctgaggc

SEQ ID NO: 306918 - DNA, 15 bp, Homo sapiens
tgggaagctgaggca

SEQ ID NO: 306919 - DNA, 15 bp, Homo sapiens
gggaagctgaggcag

SEQ ID NO: 306920 - DNA, 15 bp, Homo sapiens
ggaagctgaggcagg

SEQ ID NO: 306921 - DNA, 15 bp, Homo sapiens
gaagctgaggcagga

SEQ ID NO: 306922 - DNA, 15 bp, Homo sapiens
aagctgaggcaggag

SEQ ID NO: 306923 - DNA, 15 bp, Homo sapiens
agctgaggcaggaga

SEQ ID NO: 306924 - DNA, 15 bp, Homo sapiens
ttatctacaaaaaaa

SEQ ID NO: 306925 - DNA, 15 bp, Homo sapiens
tttaaaaaattaaaa

SEQ ID NO: 306926 - DNA, 15 bp, Homo sapiens
gaaaaaaataaaaaa

SEQ ID NO: 306927 - DNA, 15 bp, Homo sapiens
aaaaaaataaaaaat

SEQ ID NO: 306928 - DNA, 15 bp, Homo sapiens
ttacttaaactaaat

SEQ ID NO: 306929 - DNA, 15 bp, Homo sapiens
aaatgcataaatcaa

SEQ ID NO: 306930 - DNA, 15 bp, Homo sapiens
gtactgaaaacacat

SEQ ID NO: 306931 - DNA, 15 bp, Homo sapiens
tactgaaaacacatg

SEQ ID NO: 306932 - DNA, 15 bp, Homo sapiens
actgaaaacacatga

SEQ ID NO: 306933 - DNA, 15 bp, Homo sapiens
gtcatcatcagcagc

SEQ ID NO: 306934 - DNA, 15 bp, Homo sapiens
tcatcatcagcagca

SEQ ID NO: 306935 - DNA, 15 bp, Homo sapiens
gttttttaaaaaaag

SEQ ID NO: 306936 - DNA, 15 bp, Homo sapiens
ttttttaaaaaaagt

SEQ ID NO: 306937 - DNA, 15 bp, Homo sapiens
caaatatttattgag

SEQ ID NO: 306938 - DNA, 15 bp, Homo sapiens
ttcccaggtgcaatt

SEQ ID NO: 306939 - DNA, 15 bp, Homo sapiens
tttaaagaatgatga

SEQ ID NO: 306940 - DNA, 15 bp, Homo sapiens
caatcttgactcact

SEQ ID NO: 306941 - DNA, 15 bp, Homo sapiens
aatcttgactcactg

SEQ ID NO: 306942 - DNA, 15 bp, Homo sapiens
atcttgactcactgc

SEQ ID NO: 306943 - DNA, 15 bp, Homo sapiens
tcttgactcactgca

SEQ ID NO: 306944 - DNA, 15 bp, Homo sapiens
cttgactcactgcaa

SEQ ID NO: 306945 - DNA, 15 bp, Homo sapiens
ttgactcactgcaac

SEQ ID NO: 306946 - DNA, 15 bp, Homo sapiens
tgactcactgcaacc

SEQ ID NO: 306947 - DNA, 15 bp, Homo sapiens
gactcactgcaacct

SEQ ID NO: 306948 - DNA, 15 bp, Homo sapiens
aacctctgcctcctg

SEQ ID NO: 306949 - DNA, 15 bp, Homo sapiens
acctctgcctcctgg

SEQ ID NO: 306950 - DNA, 15 bp, Homo sapiens
gccactgcacccagc

SEQ ID NO: 306951 - DNA, 15 bp, Homo sapiens
ccactgcacccagcc

SEQ ID NO: 306952 - DNA, 15 bp, Homo sapiens
atcccaacactttgg

SEQ ID NO: 306953 - DNA, 15 bp, Homo sapiens
tcccaacactttggg

SEQ ID NO: 306954 - DNA, 15 bp, Homo sapiens
cccaacactttggga

SEQ ID NO: 306955 - DNA, 15 bp, Homo sapiens
ccaacactttgggag

SEQ ID NO: 306956 - DNA, 15 bp, Homo sapiens
caacactttgggagg

SEQ ID NO: 306957 - DNA, 15 bp, Homo sapiens
aacactttgggaggc

SEQ ID NO: 306958 - DNA, 15 bp, Homo sapiens
acactttgggaggcc

SEQ ID NO: 306959 - DNA, 15 bp, Homo sapiens
tagccgggtgtggtg

SEQ ID NO: 306960 - DNA, 15 bp, Homo sapiens
agccgggtgtggtgg

SEQ ID NO: 306961 - DNA, 15 bp, Homo sapiens
gccgggtgtggtggc

SEQ ID NO: 306962 - DNA, 15 bp, Homo sapiens
gggtgtggtggcaca

SEQ ID NO: 306963 - DNA, 15 bp, Homo sapiens
ggtgtggtggcacac

SEQ ID NO: 306964 - DNA, 15 bp, Homo sapiens
tggtggcacacacct

SEQ ID NO: 306965 - DNA, 15 bp, Homo sapiens
aaaaaaaaaagtttc

SEQ ID NO: 306966 - DNA, 15 bp, Homo sapiens
aaaaaaaaagtttcc

SEQ ID NO: 306967 - DNA, 15 bp, Homo sapiens
ggagaaatagaaaga

SEQ ID NO: 306968 - DNA, 15 bp, Homo sapiens
ttgaatatataaaat

SEQ ID NO: 306969 - DNA, 15 bp, Homo sapiens
ttcactgtaattctt

SEQ ID NO: 306970 - DNA, 15 bp, Homo sapiens
tcactgtaattctta

SEQ ID NO: 306971 - DNA, 15 bp, Homo sapiens
atcatggtggaaggc

SEQ ID NO: 306972 - DNA, 15 bp, Homo sapiens
tcatggtggaaggca

SEQ ID NO: 306973 - DNA, 15 bp, Homo sapiens
catggtggaaggcaa

SEQ ID NO: 306974 - DNA, 15 bp, Homo sapiens
ttggcctcccaagtg

SEQ ID NO: 306975 - DNA, 15 bp, Homo sapiens
tgcttttaagattct

SEQ ID NO: 306976 - DNA, 15 bp, Homo sapiens
ttctgtgtgtttgtg

SEQ ID NO: 306977 - DNA, 15 bp, Homo sapiens
gatagcattaggaga

SEQ ID NO: 306978 - DNA, 15 bp, Homo sapiens
acatggcacatgtat

SEQ ID NO: 306979 - DNA, 15 bp, Homo sapiens
catggcacatgtata

SEQ ID NO: 306980 - DNA, 15 bp, Homo sapiens
atggcacatgtatac

SEQ ID NO: 306981 - DNA, 15 bp, Homo sapiens
gtataataataataa

SEQ ID NO: 306982 - DNA, 15 bp, Homo sapiens
tataataataataat

SEQ ID NO: 306983 - DNA, 15 bp, Homo sapiens
attaaaaaaaagaaa

SEQ ID NO: 306984 - DNA, 15 bp, Homo sapiens
ttaaaaaaaagaaaa

SEQ ID NO: 306985 - DNA, 15 bp, Homo sapiens
taaaaaaaagaaaag

SEQ ID NO: 306986 - DNA, 15 bp, Homo sapiens
atgaattatattgca

SEQ ID NO: 306987 - DNA, 15 bp, Homo sapiens
tgaattatattgcaa

SEQ ID NO: 306988 - DNA, 15 bp, Homo sapiens
atacataaaaagaat

SEQ ID NO: 306989 - DNA, 15 bp, Homo sapiens
atacacacacatata

SEQ ID NO: 306990 - DNA, 15 bp, Homo sapiens
tacacacacatatac

SEQ ID NO: 306991 - DNA, 15 bp, Homo sapiens
tatttatttaaaaaa

SEQ ID NO: 306992 - DNA, 15 bp, Homo sapiens
aaaaatattttattt

SEQ ID NO: 306993 - DNA, 15 bp, Homo sapiens
atttttcactccctt

SEQ ID NO: 306994 - DNA, 15 bp, Homo sapiens
tttttcactcccttg

SEQ ID NO: 306995 - DNA, 15 bp, Homo sapiens
attctatttttaaaa

SEQ ID NO: 306996 - DNA, 15 bp, Homo sapiens
caagagtgatgcaat

SEQ ID NO: 306997 - DNA, 15 bp, Homo sapiens
aagagtgatgcaatg

SEQ ID NO: 306998 - DNA, 15 bp, Homo sapiens
tatatttaaaaattt

SEQ ID NO: 306999 - DNA, 15 bp, Homo sapiens
tgtgtatatatatac

SEQ ID NO: 307000 - DNA, 15 bp, Homo sapiens
gtgtatatatataca

SEQ ID NO: 307001 - DNA, 15 bp, Homo sapiens
tgtatatatatacac

SEQ ID NO: 307002 - DNA, 15 bp, Homo sapiens
gtatatatatacaca

SEQ ID NO: 307003 - DNA, 15 bp, Homo sapiens
tagtttcttttgcaa

SEQ ID NO: 307004 - DNA, 15 bp, Homo sapiens
gatttttaaaaatga

SEQ ID NO: 307005 - DNA, 15 bp, Homo sapiens
acatgcacacacaca

SEQ ID NO: 307006 - DNA, 15 bp, Homo sapiens
ttcagaattttaaaa

SEQ ID NO: 307007 - DNA, 15 bp, Homo sapiens
ttttaaaacaatgta

SEQ ID NO: 307008 - DNA, 15 bp, Homo sapiens
tttaaaacaatgtaa

SEQ ID NO: 307009 - DNA, 15 bp, Homo sapiens
tctcctgcctcagtc

SEQ ID NO: 307010 - DNA, 15 bp, Homo sapiens
tttagtagagacgga

SEQ ID NO: 307011 - DNA, 15 bp, Homo sapiens
ttagtagagacggag

SEQ ID NO: 307012 - DNA, 15 bp, Homo sapiens
tagtagagacggagt

SEQ ID NO: 307013 - DNA, 15 bp, Homo sapiens
agtagagacggagtt

SEQ ID NO: 307014 - DNA, 15 bp, Homo sapiens
gtagagacggagttt

SEQ ID NO: 307015 - DNA, 15 bp, Homo sapiens
tagagacggagtttc

SEQ ID NO: 307016 - DNA, 15 bp, Homo sapiens
accatgttggccatg

SEQ ID NO: 307017 - DNA, 15 bp, Homo sapiens
aattaaaaatatttt

SEQ ID NO: 307018 - DNA, 15 bp, Homo sapiens
tttaaaatgtcagag

SEQ ID NO: 307019 - DNA, 15 bp, Homo sapiens
ttaaaatgtcagaga

SEQ ID NO: 307020 - DNA, 15 bp, Homo sapiens
ggagtgacaaaaatg

SEQ ID NO: 307021 - DNA, 15 bp, Homo sapiens
attatttagaataca

SEQ ID NO: 307022 - DNA, 15 bp, Homo sapiens
cctggggcacacagc

SEQ ID NO: 307023 - DNA, 15 bp, Homo sapiens
ttaatcctataggat

SEQ ID NO: 307024 - DNA, 15 bp, Homo sapiens
taatcctataggatt

SEQ ID NO: 307025 - DNA, 15 bp, Homo sapiens
aatcctataggatta

SEQ ID NO: 307026 - DNA, 15 bp, Homo sapiens
atcctataggattaa

SEQ ID NO: 307027 - DNA, 15 bp, Homo sapiens
ttttcaattattctg

SEQ ID NO: 307028 - DNA, 15 bp, Homo sapiens
tttcaattattctgt

SEQ ID NO: 307029 - DNA, 15 bp, Homo sapiens
tgaggtcaggagatt

SEQ ID NO: 307030 - DNA, 15 bp, Homo sapiens
gaggtcaggagattg

SEQ ID NO: 307031 - DNA, 15 bp, Homo sapiens
aggtcaggagattga

SEQ ID NO: 307032 - DNA, 15 bp, Homo sapiens
ggtcaggagattgag

SEQ ID NO: 307033 - DNA, 15 bp, Homo sapiens
gtcaggagattgaga

SEQ ID NO: 307034 - DNA, 15 bp, Homo sapiens
tcaggagattgagac

SEQ ID NO: 307035 - DNA, 15 bp, Homo sapiens
catgcctgtagtccc

SEQ ID NO: 307036 - DNA, 15 bp, Homo sapiens
atgcctgtagtccca

SEQ ID NO: 307037 - DNA, 15 bp, Homo sapiens
tgcctgtagtcccag

SEQ ID NO: 307038 - DNA, 15 bp, Homo sapiens
cagctactggggagg

SEQ ID NO: 307039 - DNA, 15 bp, Homo sapiens
agctactggggaggc

SEQ ID NO: 307040 - DNA, 15 bp, Homo sapiens
gctactggggaggct

SEQ ID NO: 307041 - DNA, 15 bp, Homo sapiens
actgtctcaaaaaaa

SEQ ID NO: 307042 - DNA, 15 bp, Homo sapiens
aaaaaaaaaaaagtg

SEQ ID NO: 307043 - DNA, 15 bp, Homo sapiens
aataaacatttattg

SEQ ID NO: 307044 - DNA, 15 bp, Homo sapiens
tttaaaaattcattt

SEQ ID NO: 307045 - DNA, 15 bp, Homo sapiens
atttattatatttta

SEQ ID NO: 307046 - DNA, 15 bp, Homo sapiens
gaggctgaagcaggc

SEQ ID NO: 307047 - DNA, 15 bp, Homo sapiens
gccaggcgtggtggt

SEQ ID NO: 307048 - DNA, 15 bp, Homo sapiens
ccaggcgtggtggtg

SEQ ID NO: 307049 - DNA, 15 bp, Homo sapiens
ggtgggtgcctgtag

SEQ ID NO: 307050 - DNA, 15 bp, Homo sapiens
gtgggtgcctgtagt

SEQ ID NO: 307051 - DNA, 15 bp, Homo sapiens
tgggtgcctgtagtc

SEQ ID NO: 307052 - DNA, 15 bp, Homo sapiens
ggtgcctgtagtccc

SEQ ID NO: 307053 - DNA, 15 bp, Homo sapiens
gtgcctgtagtccca

SEQ ID NO: 307054 - DNA, 15 bp, Homo sapiens
ggctggggaggcctc

SEQ ID NO: 307055 - DNA, 15 bp, Homo sapiens
gctggggaggcctca

SEQ ID NO: 307056 - DNA, 15 bp, Homo sapiens
ctggggaggcctcac

SEQ ID NO: 307057 - DNA, 15 bp, Homo sapiens
cagcatgggaaaaac

SEQ ID NO: 307058 - DNA, 15 bp, Homo sapiens
agcatgggaaaaacc

SEQ ID NO: 307059 - DNA, 15 bp, Homo sapiens
gcatgggaaaaacct

SEQ ID NO: 307060 - DNA, 15 bp, Homo sapiens
ggggattattacaat

SEQ ID NO: 307061 - DNA, 15 bp, Homo sapiens
gggattattacaatt

SEQ ID NO: 307062 - DNA, 15 bp, Homo sapiens
ggattattacaattc

SEQ ID NO: 307063 - DNA, 15 bp, Homo sapiens
gattattacaattca

SEQ ID NO: 307064 - DNA, 15 bp, Homo sapiens
tggggacacagagcc

SEQ ID NO: 307065 - DNA, 15 bp, Homo sapiens
ggggacacagagcca

SEQ ID NO: 307066 - DNA, 15 bp, Homo sapiens
gggacacagagccaa

SEQ ID NO: 307067 - DNA, 15 bp, Homo sapiens
ggacacagagccaaa

SEQ ID NO: 307068 - DNA, 15 bp, Homo sapiens
gacacagagccaaac

SEQ ID NO: 307069 - DNA, 15 bp, Homo sapiens
acacagagccaaacc

SEQ ID NO: 307070 - DNA, 15 bp, Homo sapiens
cacagagccaaacca

SEQ ID NO: 307071 - DNA, 15 bp, Homo sapiens
acagagccaaaccat

SEQ ID NO: 307072 - DNA, 15 bp, Homo sapiens
cagagccaaaccata

SEQ ID NO: 307073 - DNA, 15 bp, Homo sapiens
agagccaaaccatat

SEQ ID NO: 307074 - DNA, 15 bp, Homo sapiens
gagccaaaccatatc

SEQ ID NO: 307075 - DNA, 15 bp, Homo sapiens
agccaaaccatatca

SEQ ID NO: 307076 - DNA, 15 bp, Homo sapiens
aaaagagagagagag

SEQ ID NO: 307077 - DNA, 15 bp, Homo sapiens
aaagagagagagaga

SEQ ID NO: 307078 - DNA, 15 bp, Homo sapiens
aagagagagagagag

SEQ ID NO: 307079 - DNA, 15 bp, Homo sapiens
ggtgtgtgtgtgtgt

SEQ ID NO: 307080 - DNA, 15 bp, Homo sapiens
tcatcattctttaaa

SEQ ID NO: 307081 - DNA, 15 bp, Homo sapiens
gttctcctctcattt

SEQ ID NO: 307082 - DNA, 15 bp, Homo sapiens
agtaagtaatagaaa

SEQ ID NO: 307083 - DNA, 15 bp, Homo sapiens
tataattattttacc

SEQ ID NO: 307084 - DNA, 15 bp, Homo sapiens
ataattattttacct

SEQ ID NO: 307085 - DNA, 15 bp, Homo sapiens
gggactacaggcacc

SEQ ID NO: 307086 - DNA, 15 bp, Homo sapiens
tgatccgcccgcctt

SEQ ID NO: 307087 - DNA, 15 bp, Homo sapiens
gatccgcccgccttg

SEQ ID NO: 307088 - DNA, 15 bp, Homo sapiens
atccgcccgccttgg

SEQ ID NO: 307089 - DNA, 15 bp, Homo sapiens
tccgcccgccttggc

SEQ ID NO: 307090 - DNA, 15 bp, Homo sapiens
ccgcccgccttggcc

SEQ ID NO: 307091 - DNA, 15 bp, Homo sapiens
cgcccgccttggcct

SEQ ID NO: 307092 - DNA, 15 bp, Homo sapiens
tgcttctccattttg

SEQ ID NO: 307093 - DNA, 15 bp, Homo sapiens
aaaatatttcctcac

SEQ ID NO: 307094 - DNA, 15 bp, Homo sapiens
ctcaagcgatcctcc

SEQ ID NO: 307095 - DNA, 15 bp, Homo sapiens
tcaagcgatcctccc

SEQ ID NO: 307096 - DNA, 15 bp, Homo sapiens
caagcgatcctccca

SEQ ID NO: 307097 - DNA, 15 bp, Homo sapiens
aagcgatcctcccac

SEQ ID NO: 307098 - DNA, 15 bp, Homo sapiens
agcgatcctcccacc

SEQ ID NO: 307099 - DNA, 15 bp, Homo sapiens
gcgatcctcccacct

SEQ ID NO: 307100 - DNA, 15 bp, Homo sapiens
cgatcctcccacctc

SEQ ID NO: 307101 - DNA, 15 bp, Homo sapiens
ctcccacctctgcct

SEQ ID NO: 307102 - DNA, 15 bp, Homo sapiens
cccaccttggcctcc

SEQ ID NO: 307103 - DNA, 15 bp, Homo sapiens
ttttttttttgagag

SEQ ID NO: 307104 - DNA, 15 bp, Homo sapiens
tttttttttgagagg

SEQ ID NO: 307105 - DNA, 15 bp, Homo sapiens
ttttttttgagaggg

SEQ ID NO: 307106 - DNA, 15 bp, Homo sapiens
tttttttgagaggga

SEQ ID NO: 307107 - DNA, 15 bp, Homo sapiens
ttttttgagagggag

SEQ ID NO: 307108 - DNA, 15 bp, Homo sapiens
tttttgagagggagt

SEQ ID NO: 307109 - DNA, 15 bp, Homo sapiens
ttttgagagggagtc

SEQ ID NO: 307110 - DNA, 15 bp, Homo sapiens
tttgagagggagtct

SEQ ID NO: 307111 - DNA, 15 bp, Homo sapiens
actttgttacccagg

SEQ ID NO: 307112 - DNA, 15 bp, Homo sapiens
ctttgttacccaggc

SEQ ID NO: 307113 - DNA, 15 bp, Homo sapiens
tttgttacccaggct

SEQ ID NO: 307114 - DNA, 15 bp, Homo sapiens
ctgggactataggtg

SEQ ID NO: 307115 - DNA, 15 bp, Homo sapiens
aaattattatttttt

SEQ ID NO: 307116 - DNA, 15 bp, Homo sapiens
aattattattttttt

SEQ ID NO: 307117 - DNA, 15 bp, Homo sapiens
ttttttttaaatata

SEQ ID NO: 307118 - DNA, 15 bp, Homo sapiens
tttttttaaatatat

SEQ ID NO: 307119 - DNA, 15 bp, Homo sapiens
tatatgtatgaattt

SEQ ID NO: 307120 - DNA, 15 bp, Homo sapiens
atatgtatgaatttt

SEQ ID NO: 307121 - DNA, 15 bp, Homo sapiens
gtggcacatatacac

SEQ ID NO: 307122 - DNA, 15 bp, Homo sapiens
tggcacatatacacc

SEQ ID NO: 307123 - DNA, 15 bp, Homo sapiens
ggcacatatacacca

SEQ ID NO: 307124 - DNA, 15 bp, Homo sapiens
gcacatatacaccat

SEQ ID NO: 307125 - DNA, 15 bp, Homo sapiens
cacatatacaccatg

SEQ ID NO: 307126 - DNA, 15 bp, Homo sapiens
acatatacaccatgg

SEQ ID NO: 307127 - DNA, 15 bp, Homo sapiens
catatacaccatgga

SEQ ID NO: 307128 - DNA, 15 bp, Homo sapiens
atatacaccatggag

SEQ ID NO: 307129 - DNA, 15 bp, Homo sapiens
tatacaccatggagt

SEQ ID NO: 307130 - DNA, 15 bp, Homo sapiens
atacaccatggagta

SEQ ID NO: 307131 - DNA, 15 bp, Homo sapiens
tacaccatggagtac

SEQ ID NO: 307132 - DNA, 15 bp, Homo sapiens
tactatgcagccata

SEQ ID NO: 307133 - DNA, 15 bp, Homo sapiens
actatgcagccataa

SEQ ID NO: 307134 - DNA, 15 bp, Homo sapiens
ctatgcagccataaa

SEQ ID NO: 307135 - DNA, 15 bp, Homo sapiens
tatgcagccataaaa

SEQ ID NO: 307136 - DNA, 15 bp, Homo sapiens
atgcagccataaaaa

SEQ ID NO: 307137 - DNA, 15 bp, Homo sapiens
cagccataaaaaatg

SEQ ID NO: 307138 - DNA, 15 bp, Homo sapiens
agccataaaaaatga

SEQ ID NO: 307139 - DNA, 15 bp, Homo sapiens
tcagcaaactcacac

SEQ ID NO: 307140 - DNA, 15 bp, Homo sapiens
caggaacagaaaacc

SEQ ID NO: 307141 - DNA, 15 bp, Homo sapiens
aggaacagaaaacca

SEQ ID NO: 307142 - DNA, 15 bp, Homo sapiens
ggaacagaaaaccaa

SEQ ID NO: 307143 - DNA, 15 bp, Homo sapiens
gaacagaaaaccaaa

SEQ ID NO: 307144 - DNA, 15 bp, Homo sapiens
gcatgttctcactca

SEQ ID NO: 307145 - DNA, 15 bp, Homo sapiens
catgttctcactcat

SEQ ID NO: 307146 - DNA, 15 bp, Homo sapiens
atgttctcactcata

SEQ ID NO: 307147 - DNA, 15 bp, Homo sapiens
tgttctcactcataa

SEQ ID NO: 307148 - DNA, 15 bp, Homo sapiens
gttctcactcataag

SEQ ID NO: 307149 - DNA, 15 bp, Homo sapiens
tagatgatgggttga

SEQ ID NO: 307150 - DNA, 15 bp, Homo sapiens
agatgatgggttgat

SEQ ID NO: 307151 - DNA, 15 bp, Homo sapiens
gatgatgggttgata

SEQ ID NO: 307152 - DNA, 15 bp, Homo sapiens
atgatgggttgatag

SEQ ID NO: 307153 - DNA, 15 bp, Homo sapiens
tgatgggttgatagg

SEQ ID NO: 307154 - DNA, 15 bp, Homo sapiens
ataataaaaaaaaaa

SEQ ID NO: 307155 - DNA, 15 bp, Homo sapiens
tttgttttttgagac

SEQ ID NO: 307156 - DNA, 15 bp, Homo sapiens
agtgcagtgatgtga

SEQ ID NO: 307157 - DNA, 15 bp, Homo sapiens
gtgcagtgatgtgat

SEQ ID NO: 307158 - DNA, 15 bp, Homo sapiens
tgccaccacacccgg

SEQ ID NO: 307159 - DNA, 15 bp, Homo sapiens
tttttggtagagaca

SEQ ID NO: 307160 - DNA, 15 bp, Homo sapiens
ttttatgtattttta

SEQ ID NO: 307161 - DNA, 15 bp, Homo sapiens
atttttaaaaaaatc

SEQ ID NO: 307162 - DNA, 15 bp, Homo sapiens
gagcactgttttaaa

SEQ ID NO: 307163 - DNA, 15 bp, Homo sapiens
tttaaaacagtgctc

SEQ ID NO: 307164 - DNA, 15 bp, Homo sapiens
atgtggtgaaattgg

SEQ ID NO: 307165 - DNA, 15 bp, Homo sapiens
gaggtgggaggatcg

SEQ ID NO: 307166 - DNA, 15 bp, Homo sapiens
aggtgggaggatcgc

SEQ ID NO: 307167 - DNA, 15 bp, Homo sapiens
ggtgggaggatcgct

SEQ ID NO: 307168 - DNA, 15 bp, Homo sapiens
gtgggaggatcgctt

SEQ ID NO: 307169 - DNA, 15 bp, Homo sapiens
tgggaggatcgcttg

SEQ ID NO: 307170 - DNA, 15 bp, Homo sapiens
gggaggatcgcttga

SEQ ID NO: 307171 - DNA, 15 bp, Homo sapiens
ggaggatcgcttgag

SEQ ID NO: 307172 - DNA, 15 bp, Homo sapiens
caggaattcaagacc

SEQ ID NO: 307173 - DNA, 15 bp, Homo sapiens
aggaattcaagacca

SEQ ID NO: 307174 - DNA, 15 bp, Homo sapiens
ggaattcaagaccag

SEQ ID NO: 307175 - DNA, 15 bp, Homo sapiens
gaattcaagaccagc

SEQ ID NO: 307176 - DNA, 15 bp, Homo sapiens
atggctcatgcctgt

SEQ ID NO: 307177 - DNA, 15 bp, Homo sapiens
tgcctgtagtcctag

SEQ ID NO: 307178 - DNA, 15 bp, Homo sapiens
gcctgtagtcctagc

SEQ ID NO: 307179 - DNA, 15 bp, Homo sapiens
cctgtagtcctagct

SEQ ID NO: 307180 - DNA, 15 bp, Homo sapiens
ttcaaggctgcagtg

SEQ ID NO: 307181 - DNA, 15 bp, Homo sapiens
tcaaggctgcagtga

SEQ ID NO: 307182 - DNA, 15 bp, Homo sapiens
ctttgtttctaaaaa

SEQ ID NO: 307183 - DNA, 15 bp, Homo sapiens
tttgtttctaaaaaa

SEQ ID NO: 307184 - DNA, 15 bp, Homo sapiens
taaaaaataaaataa

SEQ ID NO: 307185 - DNA, 15 bp, Homo sapiens
ataaaataaaataat

SEQ ID NO: 307186 - DNA, 15 bp, Homo sapiens
gcatcagtgacaaca

SEQ ID NO: 307187 - DNA, 15 bp, Homo sapiens
tttttttctttgttc

SEQ ID NO: 307188 - DNA, 15 bp, Homo sapiens
ttgagagagagagag

SEQ ID NO: 307189 - DNA, 15 bp, Homo sapiens
tgagagagagagaga

SEQ ID NO: 307190 - DNA, 15 bp, Homo sapiens
gagagagagagagat

SEQ ID NO: 307191 - DNA, 15 bp, Homo sapiens
agagagagagagatt

SEQ ID NO: 307192 - DNA, 15 bp, Homo sapiens
gagagagagagattg

SEQ ID NO: 307193 - DNA, 15 bp, Homo sapiens
agagagagagattga

SEQ ID NO: 307194 - DNA, 15 bp, Homo sapiens
gagagagagattgag

SEQ ID NO: 307195 - DNA, 15 bp, Homo sapiens
agagagagattgaga

SEQ ID NO: 307196 - DNA, 15 bp, Homo sapiens
gagagagattgagag

SEQ ID NO: 307197 - DNA, 15 bp, Homo sapiens
agagagattgagaga

SEQ ID NO: 307198 - DNA, 15 bp, Homo sapiens
ttcctttgaaattga

SEQ ID NO: 307199 - DNA, 15 bp, Homo sapiens
tcctttgaaattgag

SEQ ID NO: 307200 - DNA, 15 bp, Homo sapiens
tttctttttcatttt

SEQ ID NO: 307201 - DNA, 15 bp, Homo sapiens
aaaatatattattgg

SEQ ID NO: 307202 - DNA, 15 bp, Homo sapiens
aaatatattattgga

SEQ ID NO: 307203 - DNA, 15 bp, Homo sapiens
agaaagagtcatgga

SEQ ID NO: 307204 - DNA, 15 bp, Homo sapiens
attagccaggcatgg

SEQ ID NO: 307205 - DNA, 15 bp, Homo sapiens
ggcaggcacctgtaa

SEQ ID NO: 307206 - DNA, 15 bp, Homo sapiens
gcaggcacctgtaat

SEQ ID NO: 307207 - DNA, 15 bp, Homo sapiens
caggcacctgtaatc

SEQ ID NO: 307208 - DNA, 15 bp, Homo sapiens
aggcacctgtaatcc

SEQ ID NO: 307209 - DNA, 15 bp, Homo sapiens
atcccagctacttga

SEQ ID NO: 307210 - DNA, 15 bp, Homo sapiens
tcccagctacttgag

SEQ ID NO: 307211 - DNA, 15 bp, Homo sapiens
cccagctacttgaga

SEQ ID NO: 307212 - DNA, 15 bp, Homo sapiens
ccagctacttgagag

SEQ ID NO: 307213 - DNA, 15 bp, Homo sapiens
gtgaaacaccatctc

SEQ ID NO: 307214 - DNA, 15 bp, Homo sapiens
ttttagttacatttt

SEQ ID NO: 307215 - DNA, 15 bp, Homo sapiens
ttttctaaaaagaaa

SEQ ID NO: 307216 - DNA, 15 bp, Homo sapiens
tttctaaaaagaaat

SEQ ID NO: 307217 - DNA, 15 bp, Homo sapiens
tgttctttttctctc

SEQ ID NO: 307218 - DNA, 15 bp, Homo sapiens
gttctttttctctcc

SEQ ID NO: 307219 - DNA, 15 bp, Homo sapiens
tctttttctctccct

SEQ ID NO: 307220 - DNA, 15 bp, Homo sapiens
tatttttttgtgtgt

SEQ ID NO: 307221 - DNA, 15 bp, Homo sapiens
tggcttttttttttt

SEQ ID NO: 307222 - DNA, 15 bp, Homo sapiens
ggagaaaaaaaaaag

SEQ ID NO: 307223 - DNA, 15 bp, Homo sapiens
aagaaaatgaaaata

SEQ ID NO: 307224 - DNA, 15 bp, Homo sapiens
agaaaatgaaaataa

SEQ ID NO: 307225 - DNA, 15 bp, Homo sapiens
gaaaatgaaaataaa

SEQ ID NO: 307226 - DNA, 15 bp, Homo sapiens
aaaatgaaaataaaa

SEQ ID NO: 307227 - DNA, 15 bp, Homo sapiens
aaatgaaaataaaat

SEQ ID NO: 307228 - DNA, 15 bp, Homo sapiens
tttaaagaaaaagaa

SEQ ID NO: 307229 - DNA, 15 bp, Homo sapiens
ttaaagaaaaagaaa

SEQ ID NO: 307230 - DNA, 15 bp, Homo sapiens
taaagaaaaagaaag

SEQ ID NO: 307231 - DNA, 15 bp, Homo sapiens
aaagaaaaagaaagg

SEQ ID NO: 307232 - DNA, 15 bp, Homo sapiens
gctgcagttgcttct

SEQ ID NO: 307233 - DNA, 15 bp, Homo sapiens
tatctactggctttt

SEQ ID NO: 307234 - DNA, 15 bp, Homo sapiens
ttttattattattat

SEQ ID NO: 307235 - DNA, 15 bp, Homo sapiens
attattattattatc

SEQ ID NO: 307236 - DNA, 15 bp, Homo sapiens
ttattattattatct

SEQ ID NO: 307237 - DNA, 15 bp, Homo sapiens
ctgtatttcttttgt

SEQ ID NO: 307238 - DNA, 15 bp, Homo sapiens
tgtatttcttttgtt

SEQ ID NO: 307239 - DNA, 15 bp, Homo sapiens
gtatttcttttgttt

SEQ ID NO: 307240 - DNA, 15 bp, Homo sapiens
attttctttatccat

SEQ ID NO: 307241 - DNA, 15 bp, Homo sapiens
tgcttccaaatcttg

SEQ ID NO: 307242 - DNA, 15 bp, Homo sapiens
atcttggctattgtg

SEQ ID NO: 307243 - DNA, 15 bp, Homo sapiens
tgcttctccatcttt

SEQ ID NO: 307244 - DNA, 15 bp, Homo sapiens
gcttctccatctttc

SEQ ID NO: 307245 - DNA, 15 bp, Homo sapiens
tgctctgtcgcccag

SEQ ID NO: 307246 - DNA, 15 bp, Homo sapiens
ttttagtagagacga

SEQ ID NO: 307247 - DNA, 15 bp, Homo sapiens
tttagtagagacgag

SEQ ID NO: 307248 - DNA, 15 bp, Homo sapiens
ttagtagagacgagg

SEQ ID NO: 307249 - DNA, 15 bp, Homo sapiens
tagtagagacgaggt

SEQ ID NO: 307250 - DNA, 15 bp, Homo sapiens
agtagagacgaggtt

SEQ ID NO: 307251 - DNA, 15 bp, Homo sapiens
gtagagacgaggttt

SEQ ID NO: 307252 - DNA, 15 bp, Homo sapiens
tagagacgaggtttc

SEQ ID NO: 307253 - DNA, 15 bp, Homo sapiens
agagacgaggtttca

SEQ ID NO: 307254 - DNA, 15 bp, Homo sapiens
ttcatttttattttt

SEQ ID NO: 307255 - DNA, 15 bp, Homo sapiens
tcatttttatttttt

SEQ ID NO: 307256 - DNA, 15 bp, Homo sapiens
ttatttattttttaa

SEQ ID NO: 307257 - DNA, 15 bp, Homo sapiens
tttgctgtgcagaag

SEQ ID NO: 307258 - DNA, 15 bp, Homo sapiens
ttgctgtgcagaagc

SEQ ID NO: 307259 - DNA, 15 bp, Homo sapiens
attttgatttttaaa

SEQ ID NO: 307260 - DNA, 15 bp, Homo sapiens
atcagcatatgctga

SEQ ID NO: 307261 - DNA, 15 bp, Homo sapiens
tcagcatatgctgat

SEQ ID NO: 307262 - DNA, 15 bp, Homo sapiens
ggtggctcacacctg

SEQ ID NO: 307263 - DNA, 15 bp, Homo sapiens
ggtggatcatgaggt

SEQ ID NO: 307264 - DNA, 15 bp, Homo sapiens
gtggatcatgaggtc

SEQ ID NO: 307265 - DNA, 15 bp, Homo sapiens
tggatcatgaggtca

SEQ ID NO: 307266 - DNA, 15 bp, Homo sapiens
aaaaaataataataa

SEQ ID NO: 307267 - DNA, 15 bp, Homo sapiens
aaaaataataataat

SEQ ID NO: 307268 - DNA, 15 bp, Homo sapiens
atatatgtgtgtata

SEQ ID NO: 307269 - DNA, 15 bp, Homo sapiens
acatatgtataaata

SEQ ID NO: 307270 - DNA, 15 bp, Homo sapiens
atacatatatatgta

SEQ ID NO: 307271 - DNA, 15 bp, Homo sapiens
tacatatatatgtat

SEQ ID NO: 307272 - DNA, 15 bp, Homo sapiens
atatatatgtatata

SEQ ID NO: 307273 - DNA, 15 bp, Homo sapiens
tatatatgtatatat

SEQ ID NO: 307274 - DNA, 15 bp, Homo sapiens
atatatgtatatata

SEQ ID NO: 307275 - DNA, 15 bp, Homo sapiens
taaatacatatatat

SEQ ID NO: 307276 - DNA, 15 bp, Homo sapiens
aaatacatatatata

SEQ ID NO: 307277 - DNA, 15 bp, Homo sapiens
aatacatatatatat

SEQ ID NO: 307278 - DNA, 15 bp, Homo sapiens
atacatatatatatg

SEQ ID NO: 307279 - DNA, 15 bp, Homo sapiens
tacatatatatatgt

SEQ ID NO: 307280 - DNA, 15 bp, Homo sapiens
acatatatatatgta

SEQ ID NO: 307281 - DNA, 15 bp, Homo sapiens
catatatatatgtat

SEQ ID NO: 307282 - DNA, 15 bp, Homo sapiens
atatatatatgtatt

SEQ ID NO: 307283 - DNA, 15 bp, Homo sapiens
tatatatatgtattt

SEQ ID NO: 307284 - DNA, 15 bp, Homo sapiens
atatatatgtattta

SEQ ID NO: 307285 - DNA, 15 bp, Homo sapiens
tttgttttttgtttg

SEQ ID NO: 307286 - DNA, 15 bp, Homo sapiens
ttgttttttgtttgt

SEQ ID NO: 307287 - DNA, 15 bp, Homo sapiens
cctctgcttcctggg

SEQ ID NO: 307288 - DNA, 15 bp, Homo sapiens
ctctgcttcctgggt

SEQ ID NO: 307289 - DNA, 15 bp, Homo sapiens
tctgcttcctgggtt

SEQ ID NO: 307290 - DNA, 15 bp, Homo sapiens
ctgcttcctgggttc

SEQ ID NO: 307291 - DNA, 15 bp, Homo sapiens
tgcttcctgggttca

SEQ ID NO: 307292 - DNA, 15 bp, Homo sapiens
gcttcctgggttcaa

SEQ ID NO: 307293 - DNA, 15 bp, Homo sapiens
cttcctgggttcaag

SEQ ID NO: 307294 - DNA, 15 bp, Homo sapiens
ttcctgggttcaagc

SEQ ID NO: 307295 - DNA, 15 bp, Homo sapiens
gttttttttttttaa

SEQ ID NO: 307296 - DNA, 15 bp, Homo sapiens
atcacagctcactgc

SEQ ID NO: 307297 - DNA, 15 bp, Homo sapiens
tcacagctcactgca

SEQ ID NO: 307298 - DNA, 15 bp, Homo sapiens
cacagctcactgcaa

SEQ ID NO: 307299 - DNA, 15 bp, Homo sapiens
gcatgccaccatgcc

SEQ ID NO: 307300 - DNA, 15 bp, Homo sapiens
atgccaccatgcccg

SEQ ID NO: 307301 - DNA, 15 bp, Homo sapiens
aaaaaaaaaagtaat

SEQ ID NO: 307302 - DNA, 15 bp, Homo sapiens
tctcctaaaggaaaa

SEQ ID NO: 307303 - DNA, 15 bp, Homo sapiens
agataataataataa

SEQ ID NO: 307304 - DNA, 15 bp, Homo sapiens
gataataataataat

SEQ ID NO: 307305 - DNA, 15 bp, Homo sapiens
tcatgcctgtaatct

SEQ ID NO: 307306 - DNA, 15 bp, Homo sapiens
cattgtactccagcc

SEQ ID NO: 307307 - DNA, 15 bp, Homo sapiens
attgtactccagcct

SEQ ID NO: 307308 - DNA, 15 bp, Homo sapiens
ttgtactccagcctg

SEQ ID NO: 307309 - DNA, 15 bp, Homo sapiens
tgtactccagcctgg

SEQ ID NO: 307310 - DNA, 15 bp, Homo sapiens
gtactccagcctggg

SEQ ID NO: 307311 - DNA, 15 bp, Homo sapiens
tactccagcctgggc

SEQ ID NO: 307312 - DNA, 15 bp, Homo sapiens
aaaaaaataaataaa

SEQ ID NO: 307313 - DNA, 15 bp, Homo sapiens
aaaaaataaataaat

SEQ ID NO: 307314 - DNA, 15 bp, Homo sapiens
aaaaataaataaata

SEQ ID NO: 307315 - DNA, 15 bp, Homo sapiens
tgaggtgggtggatc

SEQ ID NO: 307316 - DNA, 15 bp, Homo sapiens
gtgagccgagatcgc

SEQ ID NO: 307317 - DNA, 15 bp, Homo sapiens
tgagccgagatcgcg

SEQ ID NO: 307318 - DNA, 15 bp, Homo sapiens
gagccgagatcgcgc

SEQ ID NO: 307319 - DNA, 15 bp, Homo sapiens
agccgagatcgcgcc

SEQ ID NO: 307320 - DNA, 15 bp, Homo sapiens
gccgagatcgcgcca

SEQ ID NO: 307321 - DNA, 15 bp, Homo sapiens
ccgagatcgcgccat

SEQ ID NO: 307322 - DNA, 15 bp, Homo sapiens
cgagatcgcgccatt

SEQ ID NO: 307323 - DNA, 15 bp, Homo sapiens
ccagcctgggaaaca

SEQ ID NO: 307324 - DNA, 15 bp, Homo sapiens
caataacttttcaag

SEQ ID NO: 307325 - DNA, 15 bp, Homo sapiens
atttttttctttttc

SEQ ID NO: 307326 - DNA, 15 bp, Homo sapiens
tttttttctttttct

SEQ ID NO: 307327 - DNA, 15 bp, Homo sapiens
tgacctcatgatcca

SEQ ID NO: 307328 - DNA, 15 bp, Homo sapiens
gacctcatgatccac

SEQ ID NO: 307329 - DNA, 15 bp, Homo sapiens
acctcatgatccacc

SEQ ID NO: 307330 - DNA, 15 bp, Homo sapiens
ccacccgcctcagcc

SEQ ID NO: 307331 - DNA, 15 bp, Homo sapiens
ataattaaataattt

SEQ ID NO: 307332 - DNA, 15 bp, Homo sapiens
acctgtaatcccagt

SEQ ID NO: 307333 - DNA, 15 bp, Homo sapiens
cctgtaatcccagta

SEQ ID NO: 307334 - DNA, 15 bp, Homo sapiens
ctgtaatcccagtac

SEQ ID NO: 307335 - DNA, 15 bp, Homo sapiens
aggccaggagttcaa

SEQ ID NO: 307336 - DNA, 15 bp, Homo sapiens
ggccaggagttcaag

SEQ ID NO: 307337 - DNA, 15 bp, Homo sapiens
gccaggagttcaaga

SEQ ID NO: 307338 - DNA, 15 bp, Homo sapiens
caacatagcaagact

SEQ ID NO: 307339 - DNA, 15 bp, Homo sapiens
aacatagcaagactc

SEQ ID NO: 307340 - DNA, 15 bp, Homo sapiens
agcaagactctgtcc

SEQ ID NO: 307341 - DNA, 15 bp, Homo sapiens
gcaagactctgtccc

SEQ ID NO: 307342 - DNA, 15 bp, Homo sapiens
aagatcacttgagcc

SEQ ID NO: 307343 - DNA, 15 bp, Homo sapiens
agatcacttgagccc

SEQ ID NO: 307344 - DNA, 15 bp, Homo sapiens
atcacttgagcccgg

SEQ ID NO: 307345 - DNA, 15 bp, Homo sapiens
caaggctgcagtgag

SEQ ID NO: 307346 - DNA, 15 bp, Homo sapiens
caacagagtgagacc

SEQ ID NO: 307347 - DNA, 15 bp, Homo sapiens
aacagagtgagaccc

SEQ ID NO: 307348 - DNA, 15 bp, Homo sapiens
acagagtgagaccct

SEQ ID NO: 307349 - DNA, 15 bp, Homo sapiens
cagagtgagaccctg

SEQ ID NO: 307350 - DNA, 15 bp, Homo sapiens
agagtgagaccctgt

SEQ ID NO: 307351 - DNA, 15 bp, Homo sapiens
gagtgagaccctgtc

SEQ ID NO: 307352 - DNA, 15 bp, Homo sapiens
tgttttccttccttg

SEQ ID NO: 307353 - DNA, 15 bp, Homo sapiens
tgggaggccgaggaa

SEQ ID NO: 307354 - DNA, 15 bp, Homo sapiens
gggaggccgaggaag

SEQ ID NO: 307355 - DNA, 15 bp, Homo sapiens
ggaggccgaggaagg

SEQ ID NO: 307356 - DNA, 15 bp, Homo sapiens
aggaggctaaggcag

SEQ ID NO: 307357 - DNA, 15 bp, Homo sapiens
agtaagtgcttatta

SEQ ID NO: 307358 - DNA, 15 bp, Homo sapiens
acagctcagccataa

SEQ ID NO: 307359 - DNA, 15 bp, Homo sapiens
aatagcttttatact

SEQ ID NO: 307360 - DNA, 15 bp, Homo sapiens
agaaatgataaaaag

SEQ ID NO: 307361 - DNA, 15 bp, Homo sapiens
acagtaaaagaaaac

SEQ ID NO: 307362 - DNA, 15 bp, Homo sapiens
taaattttcttccaa

SEQ ID NO: 307363 - DNA, 15 bp, Homo sapiens
atttaaatattttat

SEQ ID NO: 307364 - DNA, 15 bp, Homo sapiens
taataattagtattt

SEQ ID NO: 307365 - DNA, 15 bp, Homo sapiens
aataattagtatttg

SEQ ID NO: 307366 - DNA, 15 bp, Homo sapiens
tttattttcattttc

SEQ ID NO: 307367 - DNA, 15 bp, Homo sapiens
ttattttcattttct

SEQ ID NO: 307368 - DNA, 15 bp, Homo sapiens
tattttcattttctt

SEQ ID NO: 307369 - DNA, 15 bp, Homo sapiens
ataatggaatcataa

SEQ ID NO: 307370 - DNA, 15 bp, Homo sapiens
tttttaattttcata

SEQ ID NO: 307371 - DNA, 15 bp, Homo sapiens
gtgtattttattata

SEQ ID NO: 307372 - DNA, 15 bp, Homo sapiens
ttgatttatgcattt

SEQ ID NO: 307373 - DNA, 15 bp, Homo sapiens
aagaaaaaaaaagaa

SEQ ID NO: 307374 - DNA, 15 bp, Homo sapiens
agaaaaaaaaagaat

SEQ ID NO: 307375 - DNA, 15 bp, Homo sapiens
atttttaaaatttaa

SEQ ID NO: 307376 - DNA, 15 bp, Homo sapiens
taaaatttaaaaaat

SEQ ID NO: 307377 - DNA, 15 bp, Homo sapiens
ctgtttcttctttct

SEQ ID NO: 307378 - DNA, 15 bp, Homo sapiens
aatataaaataatat

SEQ ID NO: 307379 - DNA, 15 bp, Homo sapiens
aggtgcggtggctta

SEQ ID NO: 307380 - DNA, 15 bp, Homo sapiens
ggtgcggtggcttat

SEQ ID NO: 307381 - DNA, 15 bp, Homo sapiens
gtgcggtggcttatg

SEQ ID NO: 307382 - DNA, 15 bp, Homo sapiens
tgcggtggcttatgc

SEQ ID NO: 307383 - DNA, 15 bp, Homo sapiens
gcggtggcttatgcc

SEQ ID NO: 307384 - DNA, 15 bp, Homo sapiens
cggtggcttatgcct

SEQ ID NO: 307385 - DNA, 15 bp, Homo sapiens
ggtggcttatgcctg

SEQ ID NO: 307386 - DNA, 15 bp, Homo sapiens
gtggcttatgcctgt

SEQ ID NO: 307387 - DNA, 15 bp, Homo sapiens
tggcttatgcctgta

SEQ ID NO: 307388 - DNA, 15 bp, Homo sapiens
ggcttatgcctgtaa

SEQ ID NO: 307389 - DNA, 15 bp, Homo sapiens
ttgggagactgaggt

SEQ ID NO: 307390 - DNA, 15 bp, Homo sapiens
tgggagactgaggtg

SEQ ID NO: 307391 - DNA, 15 bp, Homo sapiens
gggagactgaggtgg

SEQ ID NO: 307392 - DNA, 15 bp, Homo sapiens
cctaaaaaaaaaaaa

SEQ ID NO: 307393 - DNA, 15 bp, Homo sapiens
ctgtgatcccagcta

SEQ ID NO: 307394 - DNA, 15 bp, Homo sapiens
tgtgatcccagctac

SEQ ID NO: 307395 - DNA, 15 bp, Homo sapiens
aaaaacaaaaaccaa

SEQ ID NO: 307396 - DNA, 15 bp, Homo sapiens
aaaacaaaaaccaaa

SEQ ID NO: 307397 - DNA, 15 bp, Homo sapiens
accttttcaaagttc

SEQ ID NO: 307398 - DNA, 15 bp, Homo sapiens
taattttttgatgta

SEQ ID NO: 307399 - DNA, 15 bp, Homo sapiens
gatgaaagtaagaaa

SEQ ID NO: 307400 - DNA, 15 bp, Homo sapiens
cataacttttaaaaa

SEQ ID NO: 307401 - DNA, 15 bp, Homo sapiens
ataacttttaaaaat

SEQ ID NO: 307402 - DNA, 15 bp, Homo sapiens
ccagcctggacaaca

SEQ ID NO: 307403 - DNA, 15 bp, Homo sapiens
cagcctggacaacaa

SEQ ID NO: 307404 - DNA, 15 bp, Homo sapiens
aaaaaaaaaaaattg

SEQ ID NO: 307405 - DNA, 15 bp, Homo sapiens
cagcttctagaagct

SEQ ID NO: 307406 - DNA, 15 bp, Homo sapiens
agcttctagaagctg

SEQ ID NO: 307407 - DNA, 15 bp, Homo sapiens
gatttttttaaaaat

SEQ ID NO: 307408 - DNA, 15 bp, Homo sapiens
tattttaaagtaaat

SEQ ID NO: 307409 - DNA, 15 bp, Homo sapiens
agactatctctgttt

SEQ ID NO: 307410 - DNA, 15 bp, Homo sapiens
tttctattacttact

SEQ ID NO: 307411 - DNA, 15 bp, Homo sapiens
agaagaaatattttt

SEQ ID NO: 307412 - DNA, 15 bp, Homo sapiens
cttaatattttaata

SEQ ID NO: 307413 - DNA, 15 bp, Homo sapiens
ttttttgttttgttt

SEQ ID NO: 307414 - DNA, 15 bp, Homo sapiens
tgttttgtttttttt

SEQ ID NO: 307415 - DNA, 15 bp, Homo sapiens
ttttttttaatttta

SEQ ID NO: 307416 - DNA, 15 bp, Homo sapiens
agcaagaggtgttca

SEQ ID NO: 307417 - DNA, 15 bp, Homo sapiens
cacacctgtaattcc

SEQ ID NO: 307418 - DNA, 15 bp, Homo sapiens
acacctgtaattcca

SEQ ID NO: 307419 - DNA, 15 bp, Homo sapiens
cacctgtaattccag

SEQ ID NO: 307420 - DNA, 15 bp, Homo sapiens
aattagttttgaaat

SEQ ID NO: 307421 - DNA, 15 bp, Homo sapiens
attagttttgaaatt

SEQ ID NO: 307422 - DNA, 15 bp, Homo sapiens
ttagttttgaaattt

SEQ ID NO: 307423 - DNA, 15 bp, Homo sapiens
cagaaaaagagaaag

SEQ ID NO: 307424 - DNA, 15 bp, Homo sapiens
gcaatccacccgcct

SEQ ID NO: 307425 - DNA, 15 bp, Homo sapiens
caatccacccgcctc

SEQ ID NO: 307426 - DNA, 15 bp, Homo sapiens
gtagttaaatttcta

SEQ ID NO: 307427 - DNA, 15 bp, Homo sapiens
atatatatagatata

SEQ ID NO: 307428 - DNA, 15 bp, Homo sapiens
catttttatataaaa

SEQ ID NO: 307429 - DNA, 15 bp, Homo sapiens
atttttatataaaaa

SEQ ID NO: 307430 - DNA, 15 bp, Homo sapiens
tttttatataaaaat

SEQ ID NO: 307431 - DNA, 15 bp, Homo sapiens
ttttatataaaaatg

SEQ ID NO: 307432 - DNA, 15 bp, Homo sapiens
tcatgtgttttcagt

SEQ ID NO: 307433 - DNA, 15 bp, Homo sapiens
catgtgttttcagta

SEQ ID NO: 307434 - DNA, 15 bp, Homo sapiens
atgtgttttcagtac

SEQ ID NO: 307435 - DNA, 15 bp, Homo sapiens
ccactgccctccagc

SEQ ID NO: 307436 - DNA, 15 bp, Homo sapiens
cactgccctccagcc

SEQ ID NO: 307437 - DNA, 15 bp, Homo sapiens
aggaagaactgatga

SEQ ID NO: 307438 - DNA, 15 bp, Homo sapiens
ataataataataaaa

SEQ ID NO: 307439 - DNA, 15 bp, Homo sapiens
aataataaaataaaa

SEQ ID NO: 307440 - DNA, 15 bp, Homo sapiens
aaaataaaaaaataa

SEQ ID NO: 307441 - DNA, 15 bp, Homo sapiens
aaataaaaaaataaa

SEQ ID NO: 307442 - DNA, 15 bp, Homo sapiens
ttctgtgatttaaat

SEQ ID NO: 307443 - DNA, 15 bp, Homo sapiens
tttattaaacacttt

SEQ ID NO: 307444 - DNA, 15 bp, Homo sapiens
ttattaaacactttc

SEQ ID NO: 307445 - DNA, 15 bp, Homo sapiens
gggcaaagaaatgag

SEQ ID NO: 307446 - DNA, 15 bp, Homo sapiens
taagaattacagtga

SEQ ID NO: 307447 - DNA, 15 bp, Homo sapiens
aagaattacagtgaa

SEQ ID NO: 307448 - DNA, 15 bp, Homo sapiens
aaaggaaaaaaatct

SEQ ID NO: 307449 - DNA, 15 bp, Homo sapiens
aaggaaaaaaatctt

SEQ ID NO: 307450 - DNA, 15 bp, Homo sapiens
aggaaaaaaatcttt

SEQ ID NO: 307451 - DNA, 15 bp, Homo sapiens
tttttcatctgaaaa

SEQ ID NO: 307452 - DNA, 15 bp, Homo sapiens
ttttcatctgaaaaa

SEQ ID NO: 307453 - DNA, 15 bp, Homo sapiens
tttcatctgaaaaat

SEQ ID NO: 307454 - DNA, 15 bp, Homo sapiens
ttcatctgaaaaatt

SEQ ID NO: 307455 - DNA, 15 bp, Homo sapiens
tttgtttgagacaga

SEQ ID NO: 307456 - DNA, 15 bp, Homo sapiens
ttgtttgagacagag

SEQ ID NO: 307457 - DNA, 15 bp, Homo sapiens
tgtttgagacagagt

SEQ ID NO: 307458 - DNA, 15 bp, Homo sapiens
gtttgagacagagtc

SEQ ID NO: 307459 - DNA, 15 bp, Homo sapiens
cagagtctcactctg

SEQ ID NO: 307460 - DNA, 15 bp, Homo sapiens
agagtctcactctgt

SEQ ID NO: 307461 - DNA, 15 bp, Homo sapiens
tgcctcagtctcccg

SEQ ID NO: 307462 - DNA, 15 bp, Homo sapiens
gcctcagtctcccga

SEQ ID NO: 307463 - DNA, 15 bp, Homo sapiens
cctcagtctcccgag

SEQ ID NO: 307464 - DNA, 15 bp, Homo sapiens
ctcagtctcccgagt

SEQ ID NO: 307465 - DNA, 15 bp, Homo sapiens
tcagtctcccgagta

SEQ ID NO: 307466 - DNA, 15 bp, Homo sapiens
cagtctcccgagtag

SEQ ID NO: 307467 - DNA, 15 bp, Homo sapiens
agtctcccgagtagc

SEQ ID NO: 307468 - DNA, 15 bp, Homo sapiens
gtctcccgagtagct

SEQ ID NO: 307469 - DNA, 15 bp, Homo sapiens
tctcccgagtagctg

SEQ ID NO: 307470 - DNA, 15 bp, Homo sapiens
gccaggatggtctca

SEQ ID NO: 307471 - DNA, 15 bp, Homo sapiens
ccaggatggtctcaa

SEQ ID NO: 307472 - DNA, 15 bp, Homo sapiens
caggatggtctcaat

SEQ ID NO: 307473 - DNA, 15 bp, Homo sapiens
attattttgaccatt

SEQ ID NO: 307474 - DNA, 15 bp, Homo sapiens
ttattttgaccattt

SEQ ID NO: 307475 - DNA, 15 bp, Homo sapiens
tattttgaccatttt

SEQ ID NO: 307476 - DNA, 15 bp, Homo sapiens
attttgaccattttt

SEQ ID NO: 307477 - DNA, 15 bp, Homo sapiens
tcaattagtgtaagt

SEQ ID NO: 307478 - DNA, 15 bp, Homo sapiens
tacttgcatttatat

SEQ ID NO: 307479 - DNA, 15 bp, Homo sapiens
acttgcatttatatt

SEQ ID NO: 307480 - DNA, 15 bp, Homo sapiens
cttgcatttatattt

SEQ ID NO: 307481 - DNA, 15 bp, Homo sapiens
ttgcatttatatttt

SEQ ID NO: 307482 - DNA, 15 bp, Homo sapiens
tgcatttatattttt

SEQ ID NO: 307483 - DNA, 15 bp, Homo sapiens
gcatttatatttttc

SEQ ID NO: 307484 - DNA, 15 bp, Homo sapiens
catttatatttttcc

SEQ ID NO: 307485 - DNA, 15 bp, Homo sapiens
atttatatttttcct

SEQ ID NO: 307486 - DNA, 15 bp, Homo sapiens
tttatatttttcctg

SEQ ID NO: 307487 - DNA, 15 bp, Homo sapiens
ttatatttttcctgt

SEQ ID NO: 307488 - DNA, 15 bp, Homo sapiens
tatatttttcctgtt

SEQ ID NO: 307489 - DNA, 15 bp, Homo sapiens
atatttttcctgttt

SEQ ID NO: 307490 - DNA, 15 bp, Homo sapiens
tatttttcctgtttt

SEQ ID NO: 307491 - DNA, 15 bp, Homo sapiens
atttttcctgttttc

SEQ ID NO: 307492 - DNA, 15 bp, Homo sapiens
tttttcctgttttct

SEQ ID NO: 307493 - DNA, 15 bp, Homo sapiens
ttttcctgttttcta

SEQ ID NO: 307494 - DNA, 15 bp, Homo sapiens
tttcctgttttctac

SEQ ID NO: 307495 - DNA, 15 bp, Homo sapiens
ttcctgttttctaca

SEQ ID NO: 307496 - DNA, 15 bp, Homo sapiens
tcctgttttctacat

SEQ ID NO: 307497 - DNA, 15 bp, Homo sapiens
cctgttttctacatt

SEQ ID NO: 307498 - DNA, 15 bp, Homo sapiens
ctgttttctacattg

SEQ ID NO: 307499 - DNA, 15 bp, Homo sapiens
tgttttctacattga

SEQ ID NO: 307500 - DNA, 15 bp, Homo sapiens
gttttctacattgag

SEQ ID NO: 307501 - DNA, 15 bp, Homo sapiens
ttttctacattgaga

SEQ ID NO: 307502 - DNA, 15 bp, Homo sapiens
tttctacattgagaa

SEQ ID NO: 307503 - DNA, 15 bp, Homo sapiens
ttctacattgagaat

SEQ ID NO: 307504 - DNA, 15 bp, Homo sapiens
tctacattgagaata

SEQ ID NO: 307505 - DNA, 15 bp, Homo sapiens
ctacattgagaatat

SEQ ID NO: 307506 - DNA, 15 bp, Homo sapiens
tacattgagaatata

SEQ ID NO: 307507 - DNA, 15 bp, Homo sapiens
acattgagaatatag

SEQ ID NO: 307508 - DNA, 15 bp, Homo sapiens
cattgagaatatagt

SEQ ID NO: 307509 - DNA, 15 bp, Homo sapiens
attgagaatatagta

SEQ ID NO: 307510 - DNA, 15 bp, Homo sapiens
ttgagaatatagtac

SEQ ID NO: 307511 - DNA, 15 bp, Homo sapiens
tgagaatatagtaca

SEQ ID NO: 307512 - DNA, 15 bp, Homo sapiens
gagaatatagtacat

SEQ ID NO: 307513 - DNA, 15 bp, Homo sapiens
agaatatagtacatc

SEQ ID NO: 307514 - DNA, 15 bp, Homo sapiens
gaatatagtacatct

SEQ ID NO: 307515 - DNA, 15 bp, Homo sapiens
aatatagtacatcta

SEQ ID NO: 307516 - DNA, 15 bp, Homo sapiens
atatagtacatctaa

SEQ ID NO: 307517 - DNA, 15 bp, Homo sapiens
tatagtacatctaaa

SEQ ID NO: 307518 - DNA, 15 bp, Homo sapiens
atagtacatctaaaa

SEQ ID NO: 307519 - DNA, 15 bp, Homo sapiens
tagtacatctaaaat

SEQ ID NO: 307520 - DNA, 15 bp, Homo sapiens
agtacatctaaaatt

SEQ ID NO: 307521 - DNA, 15 bp, Homo sapiens
gtacatctaaaattt

SEQ ID NO: 307522 - DNA, 15 bp, Homo sapiens
tacatctaaaatttg

SEQ ID NO: 307523 - DNA, 15 bp, Homo sapiens
acatctaaaatttgt

SEQ ID NO: 307524 - DNA, 15 bp, Homo sapiens
catctaaaatttgta

SEQ ID NO: 307525 - DNA, 15 bp, Homo sapiens
atctaaaatttgtat

SEQ ID NO: 307526 - DNA, 15 bp, Homo sapiens
tctaaaatttgtatt

SEQ ID NO: 307527 - DNA, 15 bp, Homo sapiens
ctaaaatttgtattt

SEQ ID NO: 307528 - DNA, 15 bp, Homo sapiens
taaaatttgtatttc

SEQ ID NO: 307529 - DNA, 15 bp, Homo sapiens
aaaatttgtatttcg

SEQ ID NO: 307530 - DNA, 15 bp, Homo sapiens
aaatttgtatttcga

SEQ ID NO: 307531 - DNA, 15 bp, Homo sapiens
aatttgtatttcgaa

SEQ ID NO: 307532 - DNA, 15 bp, Homo sapiens
atttgtatttcgaat

SEQ ID NO: 307533 - DNA, 15 bp, Homo sapiens
tttgtatttcgaatg

SEQ ID NO: 307534 - DNA, 15 bp, Homo sapiens
ttgtatttcgaatga

SEQ ID NO: 307535 - DNA, 15 bp, Homo sapiens
tgtatttcgaatgag

SEQ ID NO: 307536 - DNA, 15 bp, Homo sapiens
gtatttcgaatgaga

SEQ ID NO: 307537 - DNA, 15 bp, Homo sapiens
tatttcgaatgagag

SEQ ID NO: 307538 - DNA, 15 bp, Homo sapiens
atttcgaatgagaga

SEQ ID NO: 307539 - DNA, 15 bp, Homo sapiens
tttcgaatgagagag

SEQ ID NO: 307540 - DNA, 15 bp, Homo sapiens
ttcgaatgagagaga

SEQ ID NO: 307541 - DNA, 15 bp, Homo sapiens
tcgaatgagagagaa

SEQ ID NO: 307542 - DNA, 15 bp, Homo sapiens
cgaatgagagagaaa

SEQ ID NO: 307543 - DNA, 15 bp, Homo sapiens
gaatgagagagaaat

SEQ ID NO: 307544 - DNA, 15 bp, Homo sapiens
aatgagagagaaata

SEQ ID NO: 307545 - DNA, 15 bp, Homo sapiens
atgagagagaaatat

SEQ ID NO: 307546 - DNA, 15 bp, Homo sapiens
tgagagagaaatatg

SEQ ID NO: 307547 - DNA, 15 bp, Homo sapiens
gagagagaaatatgt

SEQ ID NO: 307548 - DNA, 15 bp, Homo sapiens
agagagaaatatgtc

SEQ ID NO: 307549 - DNA, 15 bp, Homo sapiens
gagagaaatatgtcc

SEQ ID NO: 307550 - DNA, 15 bp, Homo sapiens
agagaaatatgtcca

SEQ ID NO: 307551 - DNA, 15 bp, Homo sapiens
gagaaatatgtccag

SEQ ID NO: 307552 - DNA, 15 bp, Homo sapiens
agaaatatgtccaga

SEQ ID NO: 307553 - DNA, 15 bp, Homo sapiens
gaaatatgtccagac

SEQ ID NO: 307554 - DNA, 15 bp, Homo sapiens
aaatatgtccagact

SEQ ID NO: 307555 - DNA, 15 bp, Homo sapiens
aatatgtccagactt

SEQ ID NO: 307556 - DNA, 15 bp, Homo sapiens
atatgtccagacttg

SEQ ID NO: 307557 - DNA, 15 bp, Homo sapiens
tatgtccagacttga

SEQ ID NO: 307558 - DNA, 15 bp, Homo sapiens
atgtccagacttgat

SEQ ID NO: 307559 - DNA, 15 bp, Homo sapiens
tgtccagacttgata

SEQ ID NO: 307560 - DNA, 15 bp, Homo sapiens
gtccagacttgatac

SEQ ID NO: 307561 - DNA, 15 bp, Homo sapiens
tccagacttgatacc

SEQ ID NO: 307562 - DNA, 15 bp, Homo sapiens
ccagacttgatacct

SEQ ID NO: 307563 - DNA, 15 bp, Homo sapiens
cagacttgatacctg

SEQ ID NO: 307564 - DNA, 15 bp, Homo sapiens
agacttgatacctgg

SEQ ID NO: 307565 - DNA, 15 bp, Homo sapiens
gacttgatacctggt

SEQ ID NO: 307566 - DNA, 15 bp, Homo sapiens
acttgatacctggtt

SEQ ID NO: 307567 - DNA, 15 bp, Homo sapiens
cttgatacctggttt

SEQ ID NO: 307568 - DNA, 15 bp, Homo sapiens
ttgatacctggttta

SEQ ID NO: 307569 - DNA, 15 bp, Homo sapiens
tgatacctggtttag

SEQ ID NO: 307570 - DNA, 15 bp, Homo sapiens
gatacctggtttagg

SEQ ID NO: 307571 - DNA, 15 bp, Homo sapiens
atacctggtttaggc

SEQ ID NO: 307572 - DNA, 15 bp, Homo sapiens
tacctggtttaggca

SEQ ID NO: 307573 - DNA, 15 bp, Homo sapiens
acctggtttaggcac

SEQ ID NO: 307574 - DNA, 15 bp, Homo sapiens
cctggtttaggcaca

SEQ ID NO: 307575 - DNA, 15 bp, Homo sapiens
ctggtttaggcacaa

SEQ ID NO: 307576 - DNA, 15 bp, Homo sapiens
tggtttaggcacaag

SEQ ID NO: 307577 - DNA, 15 bp, Homo sapiens
ggtttaggcacaaga

SEQ ID NO: 307578 - DNA, 15 bp, Homo sapiens
gtttaggcacaagag

SEQ ID NO: 307579 - DNA, 15 bp, Homo sapiens
tttaggcacaagagt

SEQ ID NO: 307580 - DNA, 15 bp, Homo sapiens
ttaggcacaagagtg

SEQ ID NO: 307581 - DNA, 15 bp, Homo sapiens
taggcacaagagtga

SEQ ID NO: 307582 - DNA, 15 bp, Homo sapiens
aggcacaagagtgag

SEQ ID NO: 307583 - DNA, 15 bp, Homo sapiens
ggcacaagagtgagc

SEQ ID NO: 307584 - DNA, 15 bp, Homo sapiens
gcacaagagtgagca

SEQ ID NO: 307585 - DNA, 15 bp, Homo sapiens
cacaagagtgagcaa

SEQ ID NO: 307586 - DNA, 15 bp, Homo sapiens
acaagagtgagcaag

SEQ ID NO: 307587 - DNA, 15 bp, Homo sapiens
caagagtgagcaagc

SEQ ID NO: 307588 - DNA, 15 bp, Homo sapiens
aagagtgagcaagca

SEQ ID NO: 307589 - DNA, 15 bp, Homo sapiens
agagtgagcaagcaa

SEQ ID NO: 307590 - DNA, 15 bp, Homo sapiens
gagtgagcaagcaaa

SEQ ID NO: 307591 - DNA, 15 bp, Homo sapiens
agtgagcaagcaaag

SEQ ID NO: 307592 - DNA, 15 bp, Homo sapiens
gtgagcaagcaaagg

SEQ ID NO: 307593 - DNA, 15 bp, Homo sapiens
tgagcaagcaaaggt

SEQ ID NO: 307594 - DNA, 15 bp, Homo sapiens
gagcaagcaaaggtt

SEQ ID NO: 307595 - DNA, 15 bp, Homo sapiens
agcaagcaaaggttt

SEQ ID NO: 307596 - DNA, 15 bp, Homo sapiens
gcaagcaaaggtttc

SEQ ID NO: 307597 - DNA, 15 bp, Homo sapiens
caagcaaaggtttct

SEQ ID NO: 307598 - DNA, 15 bp, Homo sapiens
aagcaaaggtttctt

SEQ ID NO: 307599 - DNA, 15 bp, Homo sapiens
agcaaaggtttcttc

SEQ ID NO: 307600 - DNA, 15 bp, Homo sapiens
gcaaaggtttcttca

SEQ ID NO: 307601 - DNA, 15 bp, Homo sapiens
caaaggtttcttcaa

SEQ ID NO: 307602 - DNA, 15 bp, Homo sapiens
aaaggtttcttcaag

SEQ ID NO: 307603 - DNA, 15 bp, Homo sapiens
aaggtttcttcaagc

SEQ ID NO: 307604 - DNA, 15 bp, Homo sapiens
aggtttcttcaagct

SEQ ID NO: 307605 - DNA, 15 bp, Homo sapiens
ggtttcttcaagcta

SEQ ID NO: 307606 - DNA, 15 bp, Homo sapiens
gtttcttcaagctaa

SEQ ID NO: 307607 - DNA, 15 bp, Homo sapiens
tttcttcaagctaat

SEQ ID NO: 307608 - DNA, 15 bp, Homo sapiens
ttcttcaagctaatg

SEQ ID NO: 307609 - DNA, 15 bp, Homo sapiens
tcttcaagctaatgg

SEQ ID NO: 307610 - DNA, 15 bp, Homo sapiens
cttcaagctaatggt

SEQ ID NO: 307611 - DNA, 15 bp, Homo sapiens
ttcaagctaatggtg

SEQ ID NO: 307612 - DNA, 15 bp, Homo sapiens
tcaagctaatggtga

SEQ ID NO: 307613 - DNA, 15 bp, Homo sapiens
caagctaatggtgac

SEQ ID NO: 307614 - DNA, 15 bp, Homo sapiens
aagctaatggtgact

SEQ ID NO: 307615 - DNA, 15 bp, Homo sapiens
agctaatggtgactt

SEQ ID NO: 307616 - DNA, 15 bp, Homo sapiens
gctaatggtgactta

SEQ ID NO: 307617 - DNA, 15 bp, Homo sapiens
ctaatggtgacttaa

SEQ ID NO: 307618 - DNA, 15 bp, Homo sapiens
taatggtgacttaat

SEQ ID NO: 307619 - DNA, 15 bp, Homo sapiens
aatggtgacttaatt

SEQ ID NO: 307620 - DNA, 15 bp, Homo sapiens
atggtgacttaatta

SEQ ID NO: 307621 - DNA, 15 bp, Homo sapiens
tggtgacttaattat

SEQ ID NO: 307622 - DNA, 15 bp, Homo sapiens
ggtgacttaattatt

SEQ ID NO: 307623 - DNA, 15 bp, Homo sapiens
gtgacttaattattg

SEQ ID NO: 307624 - DNA, 15 bp, Homo sapiens
tgacttaattattgc

SEQ ID NO: 307625 - DNA, 15 bp, Homo sapiens
gacttaattattgca

SEQ ID NO: 307626 - DNA, 15 bp, Homo sapiens
acttaattattgcac

SEQ ID NO: 307627 - DNA, 15 bp, Homo sapiens
cttaattattgcaca

SEQ ID NO: 307628 - DNA, 15 bp, Homo sapiens
ttaattattgcacaa

SEQ ID NO: 307629 - DNA, 15 bp, Homo sapiens
taattattgcacaaa

SEQ ID NO: 307630 - DNA, 15 bp, Homo sapiens
aattattgcacaaag

SEQ ID NO: 307631 - DNA, 15 bp, Homo sapiens
attattgcacaaaga

SEQ ID NO: 307632 - DNA, 15 bp, Homo sapiens
ttattgcacaaagat

SEQ ID NO: 307633 - DNA, 15 bp, Homo sapiens
tattgcacaaagatt

SEQ ID NO: 307634 - DNA, 15 bp, Homo sapiens
attgcacaaagatta

SEQ ID NO: 307635 - DNA, 15 bp, Homo sapiens
ttgcacaaagattac

SEQ ID NO: 307636 - DNA, 15 bp, Homo sapiens
tgcacaaagattaca

SEQ ID NO: 307637 - DNA, 15 bp, Homo sapiens
gcacaaagattacac

SEQ ID NO: 307638 - DNA, 15 bp, Homo sapiens
cacaaagattacaca

SEQ ID NO: 307639 - DNA, 15 bp, Homo sapiens
acaaagattacacat

SEQ ID NO: 307640 - DNA, 15 bp, Homo sapiens
caaagattacacatg

SEQ ID NO: 307641 - DNA, 15 bp, Homo sapiens
aaagattacacatga

SEQ ID NO: 307642 - DNA, 15 bp, Homo sapiens
aagattacacatgaa

SEQ ID NO: 307643 - DNA, 15 bp, Homo sapiens
agattacacatgaag

SEQ ID NO: 307644 - DNA, 15 bp, Homo sapiens
gattacacatgaagg

SEQ ID NO: 307645 - DNA, 15 bp, Homo sapiens
attacacatgaaggg

SEQ ID NO: 307646 - DNA, 15 bp, Homo sapiens
ttacacatgaaggga

SEQ ID NO: 307647 - DNA, 15 bp, Homo sapiens
tacacatgaagggaa

SEQ ID NO: 307648 - DNA, 15 bp, Homo sapiens
acacatgaagggaat

SEQ ID NO: 307649 - DNA, 15 bp, Homo sapiens
cacatgaagggaatg

SEQ ID NO: 307650 - DNA, 15 bp, Homo sapiens
acatgaagggaatga

SEQ ID NO: 307651 - DNA, 15 bp, Homo sapiens
catgaagggaatgaa

SEQ ID NO: 307652 - DNA, 15 bp, Homo sapiens
atgaagggaatgaat

SEQ ID NO: 307653 - DNA, 15 bp, Homo sapiens
tgaagggaatgaata

SEQ ID NO: 307654 - DNA, 15 bp, Homo sapiens
gaagggaatgaatat

SEQ ID NO: 307655 - DNA, 15 bp, Homo sapiens
aagggaatgaatata

SEQ ID NO: 307656 - DNA, 15 bp, Homo sapiens
agggaatgaatataa

SEQ ID NO: 307657 - DNA, 15 bp, Homo sapiens
gggaatgaatataag

SEQ ID NO: 307658 - DNA, 15 bp, Homo sapiens
ggaatgaatataaga

SEQ ID NO: 307659 - DNA, 15 bp, Homo sapiens
gaatgaatataagaa

SEQ ID NO: 307660 - DNA, 15 bp, Homo sapiens
aatgaatataagaac

SEQ ID NO: 307661 - DNA, 15 bp, Homo sapiens
atgaatataagaaca

SEQ ID NO: 307662 - DNA, 15 bp, Homo sapiens
tgaatataagaacaa

SEQ ID NO: 307663 - DNA, 15 bp, Homo sapiens
gaatataagaacaat

SEQ ID NO: 307664 - DNA, 15 bp, Homo sapiens
aatataagaacaatt

SEQ ID NO: 307665 - DNA, 15 bp, Homo sapiens
atataagaacaattc

SEQ ID NO: 307666 - DNA, 15 bp, Homo sapiens
tataagaacaattcc

SEQ ID NO: 307667 - DNA, 15 bp, Homo sapiens
ataagaacaattcca

SEQ ID NO: 307668 - DNA, 15 bp, Homo sapiens
taagaacaattccaa

SEQ ID NO: 307669 - DNA, 15 bp, Homo sapiens
aagaacaattccaat

SEQ ID NO: 307670 - DNA, 15 bp, Homo sapiens
agaacaattccaata

SEQ ID NO: 307671 - DNA, 15 bp, Homo sapiens
gaacaattccaatag

SEQ ID NO: 307672 - DNA, 15 bp, Homo sapiens
aacaattccaatagt

SEQ ID NO: 307673 - DNA, 15 bp, Homo sapiens
acaattccaatagta

SEQ ID NO: 307674 - DNA, 15 bp, Homo sapiens
caattccaatagtaa

SEQ ID NO: 307675 - DNA, 15 bp, Homo sapiens
aattccaatagtaaa

SEQ ID NO: 307676 - DNA, 15 bp, Homo sapiens
attccaatagtaaaa

SEQ ID NO: 307677 - DNA, 15 bp, Homo sapiens
ttccaatagtaaaat

SEQ ID NO: 307678 - DNA, 15 bp, Homo sapiens
tccaatagtaaaatg

SEQ ID NO: 307679 - DNA, 15 bp, Homo sapiens
ccaatagtaaaatgg

SEQ ID NO: 307680 - DNA, 15 bp, Homo sapiens
caatagtaaaatggg

SEQ ID NO: 307681 - DNA, 15 bp, Homo sapiens
aatagtaaaatgggg

SEQ ID NO: 307682 - DNA, 15 bp, Homo sapiens
atagtaaaatggggt

SEQ ID NO: 307683 - DNA, 15 bp, Homo sapiens
tagtaaaatggggtc

SEQ ID NO: 307684 - DNA, 15 bp, Homo sapiens
agtaaaatggggtcc

SEQ ID NO: 307685 - DNA, 15 bp, Homo sapiens
gtaaaatggggtcca

SEQ ID NO: 307686 - DNA, 15 bp, Homo sapiens
taaaatggggtccag

SEQ ID NO: 307687 - DNA, 15 bp, Homo sapiens
aaaatggggtccagt

SEQ ID NO: 307688 - DNA, 15 bp, Homo sapiens
aaatggggtccagtt

SEQ ID NO: 307689 - DNA, 15 bp, Homo sapiens
aatggggtccagttg

SEQ ID NO: 307690 - DNA, 15 bp, Homo sapiens
atggggtccagttgg

SEQ ID NO: 307691 - DNA, 15 bp, Homo sapiens
tggggtccagttgga

SEQ ID NO: 307692 - DNA, 15 bp, Homo sapiens
ggggtccagttggaa

SEQ ID NO: 307693 - DNA, 15 bp, Homo sapiens
gggtccagttggaat

SEQ ID NO: 307694 - DNA, 15 bp, Homo sapiens
ggtccagttggaata

SEQ ID NO: 307695 - DNA, 15 bp, Homo sapiens
gtccagttggaatag

SEQ ID NO: 307696 - DNA, 15 bp, Homo sapiens
tccagttggaatagg

SEQ ID NO: 307697 - DNA, 15 bp, Homo sapiens
ccagttggaataggt

SEQ ID NO: 307698 - DNA, 15 bp, Homo sapiens
cagttggaataggtc

SEQ ID NO: 307699 - DNA, 15 bp, Homo sapiens
agttggaataggtct

SEQ ID NO: 307700 - DNA, 15 bp, Homo sapiens
gttggaataggtctg

SEQ ID NO: 307701 - DNA, 15 bp, Homo sapiens
ttggaataggtctga

SEQ ID NO: 307702 - DNA, 15 bp, Homo sapiens
tggaataggtctgat

SEQ ID NO: 307703 - DNA, 15 bp, Homo sapiens
ggaataggtctgatt

SEQ ID NO: 307704 - DNA, 15 bp, Homo sapiens
gaataggtctgatta

SEQ ID NO: 307705 - DNA, 15 bp, Homo sapiens
aataggtctgattag

SEQ ID NO: 307706 - DNA, 15 bp, Homo sapiens
ataggtctgattagt

SEQ ID NO: 307707 - DNA, 15 bp, Homo sapiens
taggtctgattagtt

SEQ ID NO: 307708 - DNA, 15 bp, Homo sapiens
aggtctgattagttt

SEQ ID NO: 307709 - DNA, 15 bp, Homo sapiens
ggtctgattagttta

SEQ ID NO: 307710 - DNA, 15 bp, Homo sapiens
gtctgattagtttag

SEQ ID NO: 307711 - DNA, 15 bp, Homo sapiens
tctgattagtttagt

SEQ ID NO: 307712 - DNA, 15 bp, Homo sapiens
ctgattagtttagtt

SEQ ID NO: 307713 - DNA, 15 bp, Homo sapiens
tgattagtttagttg

SEQ ID NO: 307714 - DNA, 15 bp, Homo sapiens
gattagtttagttgt

SEQ ID NO: 307715 - DNA, 15 bp, Homo sapiens
attagtttagttgta

SEQ ID NO: 307716 - DNA, 15 bp, Homo sapiens
ttagtttagttgtaa

SEQ ID NO: 307717 - DNA, 15 bp, Homo sapiens
tagtttagttgtaaa

SEQ ID NO: 307718 - DNA, 15 bp, Homo sapiens
agtttagttgtaaag

SEQ ID NO: 307719 - DNA, 15 bp, Homo sapiens
gtttagttgtaaaga

SEQ ID NO: 307720 - DNA, 15 bp, Homo sapiens
tttagttgtaaagag

SEQ ID NO: 307721 - DNA, 15 bp, Homo sapiens
ttagttgtaaagaga

SEQ ID NO: 307722 - DNA, 15 bp, Homo sapiens
tagttgtaaagagat

SEQ ID NO: 307723 - DNA, 15 bp, Homo sapiens
agttgtaaagagatg

SEQ ID NO: 307724 - DNA, 15 bp, Homo sapiens
gttgtaaagagatgc

SEQ ID NO: 307725 - DNA, 15 bp, Homo sapiens
ttgtaaagagatgca

SEQ ID NO: 307726 - DNA, 15 bp, Homo sapiens
tgtaaagagatgcat

SEQ ID NO: 307727 - DNA, 15 bp, Homo sapiens
gtaaagagatgcatc

SEQ ID NO: 307728 - DNA, 15 bp, Homo sapiens
taaagagatgcatct

SEQ ID NO: 307729 - DNA, 15 bp, Homo sapiens
aaagagatgcatctt

SEQ ID NO: 307730 - DNA, 15 bp, Homo sapiens
aagagatgcatcttt

SEQ ID NO: 307731 - DNA, 15 bp, Homo sapiens
agagatgcatctttc

SEQ ID NO: 307732 - DNA, 15 bp, Homo sapiens
gagatgcatctttct

SEQ ID NO: 307733 - DNA, 15 bp, Homo sapiens
agatgcatctttctc

SEQ ID NO: 307734 - DNA, 15 bp, Homo sapiens
gatgcatctttctct

SEQ ID NO: 307735 - DNA, 15 bp, Homo sapiens
atgcatctttctctg

SEQ ID NO: 307736 - DNA, 15 bp, Homo sapiens
tgcatctttctctgt

SEQ ID NO: 307737 - DNA, 15 bp, Homo sapiens
gcatctttctctgtg

SEQ ID NO: 307738 - DNA, 15 bp, Homo sapiens
catctttctctgtgg

SEQ ID NO: 307739 - DNA, 15 bp, Homo sapiens
atctttctctgtggc

SEQ ID NO: 307740 - DNA, 15 bp, Homo sapiens
tctttctctgtggct

SEQ ID NO: 307741 - DNA, 15 bp, Homo sapiens
ctttctctgtggctt

SEQ ID NO: 307742 - DNA, 15 bp, Homo sapiens
tttctctgtggcttc

SEQ ID NO: 307743 - DNA, 15 bp, Homo sapiens
ttctctgtggcttca

SEQ ID NO: 307744 - DNA, 15 bp, Homo sapiens
tctctgtggcttcag

SEQ ID NO: 307745 - DNA, 15 bp, Homo sapiens
ctctgtggcttcaga

SEQ ID NO: 307746 - DNA, 15 bp, Homo sapiens
tctgtggcttcagag

SEQ ID NO: 307747 - DNA, 15 bp, Homo sapiens
ctgtggcttcagaga

SEQ ID NO: 307748 - DNA, 15 bp, Homo sapiens
tgtggcttcagagaa

SEQ ID NO: 307749 - DNA, 15 bp, Homo sapiens
gtggcttcagagaat

SEQ ID NO: 307750 - DNA, 15 bp, Homo sapiens
tggcttcagagaatg

SEQ ID NO: 307751 - DNA, 15 bp, Homo sapiens
ggcttcagagaatga

SEQ ID NO: 307752 - DNA, 15 bp, Homo sapiens
gcttcagagaatgaa

SEQ ID NO: 307753 - DNA, 15 bp, Homo sapiens
cttcagagaatgaat

SEQ ID NO: 307754 - DNA, 15 bp, Homo sapiens
ttcagagaatgaatg

SEQ ID NO: 307755 - DNA, 15 bp, Homo sapiens
tcagagaatgaatgg

SEQ ID NO: 307756 - DNA, 15 bp, Homo sapiens
cagagaatgaatgga

SEQ ID NO: 307757 - DNA, 15 bp, Homo sapiens
agagaatgaatggaa

SEQ ID NO: 307758 - DNA, 15 bp, Homo sapiens
gagaatgaatggaaa

SEQ ID NO: 307759 - DNA, 15 bp, Homo sapiens
agaatgaatggaaag

SEQ ID NO: 307760 - DNA, 15 bp, Homo sapiens
gaatgaatggaaaga

SEQ ID NO: 307761 - DNA, 15 bp, Homo sapiens
aatgaatggaaagac

SEQ ID NO: 307762 - DNA, 15 bp, Homo sapiens
atgaatggaaagaca

SEQ ID NO: 307763 - DNA, 15 bp, Homo sapiens
cagcagaaaacaaaa

SEQ ID NO: 307764 - DNA, 15 bp, Homo sapiens
tgacagaacagattt

SEQ ID NO: 307765 - DNA, 15 bp, Homo sapiens
ttacacagtatttct

SEQ ID NO: 307766 - DNA, 15 bp, Homo sapiens
atttcttattggtgg

SEQ ID NO: 307767 - DNA, 15 bp, Homo sapiens
aagccaataaatttt

SEQ ID NO: 307768 - DNA, 15 bp, Homo sapiens
attttattatttatt

SEQ ID NO: 307769 - DNA, 15 bp, Homo sapiens
tttaagattctattt

SEQ ID NO: 307770 - DNA, 15 bp, Homo sapiens
agaaagaagaaacag

SEQ ID NO: 307771 - DNA, 15 bp, Homo sapiens
aattactatttttct

SEQ ID NO: 307772 - DNA, 15 bp, Homo sapiens
attactatttttctt

SEQ ID NO: 307773 - DNA, 15 bp, Homo sapiens
aatttttttttgtat

SEQ ID NO: 307774 - DNA, 15 bp, Homo sapiens
tatgttgttagagca

SEQ ID NO: 307775 - DNA, 15 bp, Homo sapiens
gttttgttttttgag

SEQ ID NO: 307776 - DNA, 15 bp, Homo sapiens
ttccatatcttggct

SEQ ID NO: 307777 - DNA, 15 bp, Homo sapiens
tccatatcttggcta

SEQ ID NO: 307778 - DNA, 15 bp, Homo sapiens
ccatatcttggctat

SEQ ID NO: 307779 - DNA, 15 bp, Homo sapiens
catatcttggctatt

SEQ ID NO: 307780 - DNA, 15 bp, Homo sapiens
atatcttggctattg

SEQ ID NO: 307781 - DNA, 15 bp, Homo sapiens
tatcttggctattgt

SEQ ID NO: 307782 - DNA, 15 bp, Homo sapiens
ttgtgaataatgcta

SEQ ID NO: 307783 - DNA, 15 bp, Homo sapiens
tgtgaataatgctac

SEQ ID NO: 307784 - DNA, 15 bp, Homo sapiens
gtgaataatgctaca

SEQ ID NO: 307785 - DNA, 15 bp, Homo sapiens
acccagaagtgggat

SEQ ID NO: 307786 - DNA, 15 bp, Homo sapiens
cccagaagtgggatt

SEQ ID NO: 307787 - DNA, 15 bp, Homo sapiens
ccagaagtgggatta

SEQ ID NO: 307788 - DNA, 15 bp, Homo sapiens
cagaagtgggattac

SEQ ID NO: 307789 - DNA, 15 bp, Homo sapiens
agaagtgggattact

SEQ ID NO: 307790 - DNA, 15 bp, Homo sapiens
ttttaattttttaaa

SEQ ID NO: 307791 - DNA, 15 bp, Homo sapiens
ttttgctttgcattt

SEQ ID NO: 307792 - DNA, 15 bp, Homo sapiens
tttggtttttgtttt

SEQ ID NO: 307793 - DNA, 15 bp, Homo sapiens
ttggtttttgttttt

SEQ ID NO: 307794 - DNA, 15 bp, Homo sapiens
ggaggctgaggcacg

SEQ ID NO: 307795 - DNA, 15 bp, Homo sapiens
gaggctgaggcacga

SEQ ID NO: 307796 - DNA, 15 bp, Homo sapiens
aggctgaggcacgag

SEQ ID NO: 307797 - DNA, 15 bp, Homo sapiens
ggctgaggcacgaga

SEQ ID NO: 307798 - DNA, 15 bp, Homo sapiens
gctgaggcacgagaa

SEQ ID NO: 307799 - DNA, 15 bp, Homo sapiens
ctgaggcacgagaat

SEQ ID NO: 307800 - DNA, 15 bp, Homo sapiens
tgaggcacgagaatc

SEQ ID NO: 307801 - DNA, 15 bp, Homo sapiens
ctgagatcgtgccat

SEQ ID NO: 307802 - DNA, 15 bp, Homo sapiens
tgagatcgtgccatt

SEQ ID NO: 307803 - DNA, 15 bp, Homo sapiens
ctgtctcaaaaaaat

SEQ ID NO: 307804 - DNA, 15 bp, Homo sapiens
tgtctcaaaaaaata

SEQ ID NO: 307805 - DNA, 15 bp, Homo sapiens
gtctcaaaaaaataa

SEQ ID NO: 307806 - DNA, 15 bp, Homo sapiens
tctcaaaaaaataaa

SEQ ID NO: 307807 - DNA, 15 bp, Homo sapiens
ctcaaaaaaataaaa

SEQ ID NO: 307808 - DNA, 15 bp, Homo sapiens
tcaaaaaaataaaaa

SEQ ID NO: 307809 - DNA, 15 bp, Homo sapiens
caaaaaaataaaaaa

SEQ ID NO: 307810 - DNA, 15 bp, Homo sapiens
attaaaaatgtagtt

SEQ ID NO: 307811 - DNA, 15 bp, Homo sapiens
aggtaaaataattat

SEQ ID NO: 307812 - DNA, 15 bp, Homo sapiens
ggtaaaataattata

SEQ ID NO: 307813 - DNA, 15 bp, Homo sapiens
aaatttcaaaactaa

SEQ ID NO: 307814 - DNA, 15 bp, Homo sapiens
aatttcaaaactaat

SEQ ID NO: 307815 - DNA, 15 bp, Homo sapiens
atttcaaaactaatt

SEQ ID NO: 307816 - DNA, 15 bp, Homo sapiens
ttaaattttaaaaat

SEQ ID NO: 307817 - DNA, 15 bp, Homo sapiens
tcttttctttttaaa

SEQ ID NO: 307818 - DNA, 15 bp, Homo sapiens
cttttctttttaaaa

SEQ ID NO: 307819 - DNA, 15 bp, Homo sapiens
gtcaggataaatatt

SEQ ID NO: 307820 - DNA, 15 bp, Homo sapiens
tttggtctgcagacc

SEQ ID NO: 307821 - DNA, 15 bp, Homo sapiens
ttggtctgcagacca

SEQ ID NO: 307822 - DNA, 15 bp, Homo sapiens
tggtctgcagaccaa

SEQ ID NO: 307823 - DNA, 15 bp, Homo sapiens
ggtctgcagaccaaa

SEQ ID NO: 307824 - DNA, 15 bp, Homo sapiens
tatcccatccagtta

SEQ ID NO: 307825 - DNA, 15 bp, Homo sapiens
taattctgaggcaca

SEQ ID NO: 307826 - DNA, 15 bp, Homo sapiens
aattctgaggcacag

SEQ ID NO: 307827 - DNA, 15 bp, Homo sapiens
ttatgattccattat

SEQ ID NO: 307828 - DNA, 15 bp, Homo sapiens
aaaaaaaaaaactat

SEQ ID NO: 307829 - DNA, 15 bp, Homo sapiens
ataaaagataataat

SEQ ID NO: 307830 - DNA, 15 bp, Homo sapiens
taaaagataataatt

SEQ ID NO: 307831 - DNA, 15 bp, Homo sapiens
aataattcagaacaa

SEQ ID NO: 307832 - DNA, 15 bp, Homo sapiens
ataattcagaacaaa

SEQ ID NO: 307833 - DNA, 15 bp, Homo sapiens
taattcagaacaaaa

SEQ ID NO: 307834 - DNA, 15 bp, Homo sapiens
aacattttttaaaaa

SEQ ID NO: 307835 - DNA, 15 bp, Homo sapiens
ttttaaaaagaaaag

SEQ ID NO: 307836 - DNA, 15 bp, Homo sapiens
tttaaaaagaaaaga

SEQ ID NO: 307837 - DNA, 15 bp, Homo sapiens
aaagaaaagaaaaaa

SEQ ID NO: 307838 - DNA, 15 bp, Homo sapiens
gttattaatatatac

SEQ ID NO: 307839 - DNA, 15 bp, Homo sapiens
tatatacatgtatat

SEQ ID NO: 307840 - DNA, 15 bp, Homo sapiens
atatacatgtatata

SEQ ID NO: 307841 - DNA, 15 bp, Homo sapiens
attaaaacaaaaaca

SEQ ID NO: 307842 - DNA, 15 bp, Homo sapiens
atttaaatcacagaa

SEQ ID NO: 307843 - DNA, 15 bp, Homo sapiens
tttgaaaatgaggaa

SEQ ID NO: 307844 - DNA, 15 bp, Homo sapiens
ttgaaaatgaggaat

SEQ ID NO: 307845 - DNA, 15 bp, Homo sapiens
agtgtttactatgtg

SEQ ID NO: 307846 - DNA, 15 bp, Homo sapiens
tttgtttgttttgtt

SEQ ID NO: 307847 - DNA, 15 bp, Homo sapiens
ttgtttgttttgttt

SEQ ID NO: 307848 - DNA, 15 bp, Homo sapiens
tttgttttgtttttg

SEQ ID NO: 307849 - DNA, 15 bp, Homo sapiens
agtggcacaatctca

SEQ ID NO: 307850 - DNA, 15 bp, Homo sapiens
gtggcacaatctcag

SEQ ID NO: 307851 - DNA, 15 bp, Homo sapiens
ggcacaatctcagct

SEQ ID NO: 307852 - DNA, 15 bp, Homo sapiens
gcacaatctcagctc

SEQ ID NO: 307853 - DNA, 15 bp, Homo sapiens
cacaatctcagctca

SEQ ID NO: 307854 - DNA, 15 bp, Homo sapiens
acaatctcagctcac

SEQ ID NO: 307855 - DNA, 15 bp, Homo sapiens
ggattataggtgccc

SEQ ID NO: 307856 - DNA, 15 bp, Homo sapiens
gattataggtgccca

SEQ ID NO: 307857 - DNA, 15 bp, Homo sapiens
attataggtgcccac

SEQ ID NO: 307858 - DNA, 15 bp, Homo sapiens
ttataggtgcccacc

SEQ ID NO: 307859 - DNA, 15 bp, Homo sapiens
tataggtgcccacca

SEQ ID NO: 307860 - DNA, 15 bp, Homo sapiens
ataggtgcccaccac

SEQ ID NO: 307861 - DNA, 15 bp, Homo sapiens
taggtgcccaccacc

SEQ ID NO: 307862 - DNA, 15 bp, Homo sapiens
aaataggaagctaaa

SEQ ID NO: 307863 - DNA, 15 bp, Homo sapiens
gtgatgctgcgtttt

SEQ ID NO: 307864 - DNA, 15 bp, Homo sapiens
tgatgctgcgttttc

SEQ ID NO: 307865 - DNA, 15 bp, Homo sapiens
tatatctatatattt

SEQ ID NO: 307866 - DNA, 15 bp, Homo sapiens
ctcttgttgaaagaa

SEQ ID NO: 307867 - DNA, 15 bp, Homo sapiens
ttatttttgtttttt

SEQ ID NO: 307868 - DNA, 15 bp, Homo sapiens
ttttagaggctatta

SEQ ID NO: 307869 - DNA, 15 bp, Homo sapiens
tttagaggctattaa

SEQ ID NO: 307870 - DNA, 15 bp, Homo sapiens
atggagaatacaaaa

SEQ ID NO: 307871 - DNA, 15 bp, Homo sapiens
actgtattagaaacc

SEQ ID NO: 307872 - DNA, 15 bp, Homo sapiens
ttaacattaaaacaa

SEQ ID NO: 307873 - DNA, 15 bp, Homo sapiens
taaaattctagaatt

SEQ ID NO: 307874 - DNA, 15 bp, Homo sapiens
aaaattctagaattt

SEQ ID NO: 307875 - DNA, 15 bp, Homo sapiens
aaattctagaatttt

SEQ ID NO: 307876 - DNA, 15 bp, Homo sapiens
aattctagaatttta

SEQ ID NO: 307877 - DNA, 15 bp, Homo sapiens
ctgtaatcccagctc

SEQ ID NO: 307878 - DNA, 15 bp, Homo sapiens
tgtaatcccagctct

SEQ ID NO: 307879 - DNA, 15 bp, Homo sapiens
gtaatcccagctctt

SEQ ID NO: 307880 - DNA, 15 bp, Homo sapiens
taatcccagctcttt

SEQ ID NO: 307881 - DNA, 15 bp, Homo sapiens
aatcccagctctttg

SEQ ID NO: 307882 - DNA, 15 bp, Homo sapiens
atcccagctctttgg

SEQ ID NO: 307883 - DNA, 15 bp, Homo sapiens
tcccagctctttggg

SEQ ID NO: 307884 - DNA, 15 bp, Homo sapiens
cccagctctttggga

SEQ ID NO: 307885 - DNA, 15 bp, Homo sapiens
ccagctctttgggag

SEQ ID NO: 307886 - DNA, 15 bp, Homo sapiens
cagctctttgggagg

SEQ ID NO: 307887 - DNA, 15 bp, Homo sapiens
agctctttgggaggc

SEQ ID NO: 307888 - DNA, 15 bp, Homo sapiens
agccgagatcgcacc

SEQ ID NO: 307889 - DNA, 15 bp, Homo sapiens
gccgagatcgcacca

SEQ ID NO: 307890 - DNA, 15 bp, Homo sapiens
aaaaaatatatatat

SEQ ID NO: 307891 - DNA, 15 bp, Homo sapiens
tattaaaatattaag

SEQ ID NO: 307892 - DNA, 15 bp, Homo sapiens
attttcatatttttt

SEQ ID NO: 307893 - DNA, 15 bp, Homo sapiens
ttttcatatttttta

SEQ ID NO: 307894 - DNA, 15 bp, Homo sapiens
tttcatattttttaa

SEQ ID NO: 307895 - DNA, 15 bp, Homo sapiens
ttcatattttttaaa

SEQ ID NO: 307896 - DNA, 15 bp, Homo sapiens
tcatattttttaaat

SEQ ID NO: 307897 - DNA, 15 bp, Homo sapiens
ctttctctttttctg

SEQ ID NO: 307898 - DNA, 15 bp, Homo sapiens
tatatatgtatacat

SEQ ID NO: 307899 - DNA, 15 bp, Homo sapiens
atatatgtatacata

SEQ ID NO: 307900 - DNA, 15 bp, Homo sapiens
tatatgtatacatat

SEQ ID NO: 307901 - DNA, 15 bp, Homo sapiens
atatgtatacatata

SEQ ID NO: 307902 - DNA, 15 bp, Homo sapiens
tatgtatacatatat

SEQ ID NO: 307903 - DNA, 15 bp, Homo sapiens
atgtatacatatata

SEQ ID NO: 307904 - DNA, 15 bp, Homo sapiens
cacacacacatacaa

SEQ ID NO: 307905 - DNA, 15 bp, Homo sapiens
acacacacatacaaa

SEQ ID NO: 307906 - DNA, 15 bp, Homo sapiens
ggtggctcacaccta

SEQ ID NO: 307907 - DNA, 15 bp, Homo sapiens
gtggctcacacctat

SEQ ID NO: 307908 - DNA, 15 bp, Homo sapiens
tggctcacacctata

SEQ ID NO: 307909 - DNA, 15 bp, Homo sapiens
ggctcacacctataa

SEQ ID NO: 307910 - DNA, 15 bp, Homo sapiens
gctcacacctataat

SEQ ID NO: 307911 - DNA, 15 bp, Homo sapiens
ctcacacctataatc

SEQ ID NO: 307912 - DNA, 15 bp, Homo sapiens
tcacacctataatcc

SEQ ID NO: 307913 - DNA, 15 bp, Homo sapiens
cacacctataatccc

SEQ ID NO: 307914 - DNA, 15 bp, Homo sapiens
acacctataatccca

SEQ ID NO: 307915 - DNA, 15 bp, Homo sapiens
cacctataatcccag

SEQ ID NO: 307916 - DNA, 15 bp, Homo sapiens
acctataatcccagc

SEQ ID NO: 307917 - DNA, 15 bp, Homo sapiens
aggcaggtggatcat

SEQ ID NO: 307918 - DNA, 15 bp, Homo sapiens
tcgctactaaaaata

SEQ ID NO: 307919 - DNA, 15 bp, Homo sapiens
cgctactaaaaatac

SEQ ID NO: 307920 - DNA, 15 bp, Homo sapiens
gctactaaaaataca

SEQ ID NO: 307921 - DNA, 15 bp, Homo sapiens
taaaaatacaaaaag

SEQ ID NO: 307922 - DNA, 15 bp, Homo sapiens
aaaaatacaaaaagt

SEQ ID NO: 307923 - DNA, 15 bp, Homo sapiens
aaaatacaaaaagta

SEQ ID NO: 307924 - DNA, 15 bp, Homo sapiens
aaatacaaaaagtag

SEQ ID NO: 307925 - DNA, 15 bp, Homo sapiens
aatacaaaaagtagc

SEQ ID NO: 307926 - DNA, 15 bp, Homo sapiens
atacaaaaagtagcc

SEQ ID NO: 307927 - DNA, 15 bp, Homo sapiens
cgggcatggtggcat

SEQ ID NO: 307928 - DNA, 15 bp, Homo sapiens
ggcatggtggcatgc

SEQ ID NO: 307929 - DNA, 15 bp, Homo sapiens
caggaggttgaggca

SEQ ID NO: 307930 - DNA, 15 bp, Homo sapiens
aggaggttgaggcag

SEQ ID NO: 307931 - DNA, 15 bp, Homo sapiens
aggttgcaatgagcc

SEQ ID NO: 307932 - DNA, 15 bp, Homo sapiens
ggttgcaatgagccg

SEQ ID NO: 307933 - DNA, 15 bp, Homo sapiens
gttgcaatgagccga

SEQ ID NO: 307934 - DNA, 15 bp, Homo sapiens
ttgcaatgagccgag

SEQ ID NO: 307935 - DNA, 15 bp, Homo sapiens
tgcaatgagccgaga

SEQ ID NO: 307936 - DNA, 15 bp, Homo sapiens
gcaatgagccgagat

SEQ ID NO: 307937 - DNA, 15 bp, Homo sapiens
caatgagccgagatc

SEQ ID NO: 307938 - DNA, 15 bp, Homo sapiens
tctccaaaaaaaaaa

SEQ ID NO: 307939 - DNA, 15 bp, Homo sapiens
aaaaaaaaaaagcca

SEQ ID NO: 307940 - DNA, 15 bp, Homo sapiens
ccaggtatggtggca

SEQ ID NO: 307941 - DNA, 15 bp, Homo sapiens
gggaggctgaagttg

SEQ ID NO: 307942 - DNA, 15 bp, Homo sapiens
ggaggctgaagttgc

SEQ ID NO: 307943 - DNA, 15 bp, Homo sapiens
gaggctgaagttgca

SEQ ID NO: 307944 - DNA, 15 bp, Homo sapiens
aggctgaagttgcag

SEQ ID NO: 307945 - DNA, 15 bp, Homo sapiens
ggctgaagttgcagt

SEQ ID NO: 307946 - DNA, 15 bp, Homo sapiens
tctcaaaacaacaac

SEQ ID NO: 307947 - DNA, 15 bp, Homo sapiens
ctcaaaacaacaaca

SEQ ID NO: 307948 - DNA, 15 bp, Homo sapiens
tcaaaacaacaacaa

SEQ ID NO: 307949 - DNA, 15 bp, Homo sapiens
ataaatgaataaata

SEQ ID NO: 307950 - DNA, 15 bp, Homo sapiens
taaatgaataaataa

SEQ ID NO: 307951 - DNA, 15 bp, Homo sapiens
aaatgaataaataaa

SEQ ID NO: 307952 - DNA, 15 bp, Homo sapiens
aatgaataaataaaa

SEQ ID NO: 307953 - DNA, 15 bp, Homo sapiens
aggttttcatttgta

SEQ ID NO: 307954 - DNA, 15 bp, Homo sapiens
attaaaaataaataa

SEQ ID NO: 307955 - DNA, 15 bp, Homo sapiens
ataaataatcataat

SEQ ID NO: 307956 - DNA, 15 bp, Homo sapiens
cccaggctggagttc

SEQ ID NO: 307957 - DNA, 15 bp, Homo sapiens
ccaggctggagttca

SEQ ID NO: 307958 - DNA, 15 bp, Homo sapiens
aatggcacgatctca

SEQ ID NO: 307959 - DNA, 15 bp, Homo sapiens
atggcacgatctcag

SEQ ID NO: 307960 - DNA, 15 bp, Homo sapiens
cctccacctcccagg

SEQ ID NO: 307961 - DNA, 15 bp, Homo sapiens
ctcaaactcctggcc

SEQ ID NO: 307962 - DNA, 15 bp, Homo sapiens
tcaaactcctggcct

SEQ ID NO: 307963 - DNA, 15 bp, Homo sapiens
caaactcctggcctc

SEQ ID NO: 307964 - DNA, 15 bp, Homo sapiens
aaactcctggcctca

SEQ ID NO: 307965 - DNA, 15 bp, Homo sapiens
tatttttattttttg

SEQ ID NO: 307966 - DNA, 15 bp, Homo sapiens
tgctcagtgaatgct

SEQ ID NO: 307967 - DNA, 15 bp, Homo sapiens
gctcagtgaatgctt

SEQ ID NO: 307968 - DNA, 15 bp, Homo sapiens
ctcagtgaatgcttt

SEQ ID NO: 307969 - DNA, 15 bp, Homo sapiens
aggaaaaaaaaaatg

SEQ ID NO: 307970 - DNA, 15 bp, Homo sapiens
ccagcctggccaaga

SEQ ID NO: 307971 - DNA, 15 bp, Homo sapiens
cttctgatttaacat

SEQ ID NO: 307972 - DNA, 15 bp, Homo sapiens
ttctgatttaacatt

SEQ ID NO: 307973 - DNA, 15 bp, Homo sapiens
aaaagaagaaaattg

SEQ ID NO: 307974 - DNA, 15 bp, Homo sapiens
tactttaaaaagtca

SEQ ID NO: 307975 - DNA, 15 bp, Homo sapiens
tttgaatgtgtcacc

SEQ ID NO: 307976 - DNA, 15 bp, Homo sapiens
catagtgttgagggg

SEQ ID NO: 307977 - DNA, 15 bp, Homo sapiens
gatagatagatagag

SEQ ID NO: 307978 - DNA, 15 bp, Homo sapiens
atagatagatagaga

SEQ ID NO: 307979 - DNA, 15 bp, Homo sapiens
tagatagatagagat

SEQ ID NO: 307980 - DNA, 15 bp, Homo sapiens
agatagatagagata

SEQ ID NO: 307981 - DNA, 15 bp, Homo sapiens
ctgggagggcgcgca

SEQ ID NO: 307982 - DNA, 15 bp, Homo sapiens
tgggagggcgcgcag

SEQ ID NO: 307983 - DNA, 15 bp, Homo sapiens
gggagggcgcgcagg

SEQ ID NO: 307984 - DNA, 15 bp, Homo sapiens
ggagggcgcgcaggg

SEQ ID NO: 307985 - DNA, 15 bp, Homo sapiens
gagggcgcgcagggc

SEQ ID NO: 307986 - DNA, 15 bp, Homo sapiens
agggcgcgcagggcc

SEQ ID NO: 307987 - DNA, 15 bp, Homo sapiens
gggcgcgcagggccg

SEQ ID NO: 307988 - DNA, 15 bp, Homo sapiens
ggcgcgcagggccgg

SEQ ID NO: 307989 - DNA, 15 bp, Homo sapiens
gcgcgcagggccggc

SEQ ID NO: 307990 - DNA, 15 bp, Homo sapiens
cgcgcagggccggcg

SEQ ID NO: 307991 - DNA, 15 bp, Homo sapiens
gcgcagggccggcgc

SEQ ID NO: 307992 - DNA, 15 bp, Homo sapiens
cgcagggccggcgct

SEQ ID NO: 307993 - DNA, 15 bp, Homo sapiens
gcagggccggcgctg

SEQ ID NO: 307994 - DNA, 15 bp, Homo sapiens
cagggccggcgctga

SEQ ID NO: 307995 - DNA, 15 bp, Homo sapiens
agggccggcgctgat

SEQ ID NO: 307996 - DNA, 15 bp, Homo sapiens
gggccggcgctgatt

SEQ ID NO: 307997 - DNA, 15 bp, Homo sapiens
ggccggcgctgattg

SEQ ID NO: 307998 - DNA, 15 bp, Homo sapiens
gccggcgctgattga

SEQ ID NO: 307999 - DNA, 15 bp, Homo sapiens
ccggcgctgattgac

SEQ ID NO: 308000 - DNA, 15 bp, Homo sapiens
cggcgctgattgacg

SEQ ID NO: 308001 - DNA, 15 bp, Homo sapiens
ggcgctgattgacgg

SEQ ID NO: 308002 - DNA, 15 bp, Homo sapiens
gcgctgattgacggg

SEQ ID NO: 308003 - DNA, 15 bp, Homo sapiens
cgctgattgacgggg

SEQ ID NO: 308004 - DNA, 15 bp, Homo sapiens
gctgattgacggggc

SEQ ID NO: 308005 - DNA, 15 bp, Homo sapiens
ctgattgacggggcg

SEQ ID NO: 308006 - DNA, 15 bp, Homo sapiens
tgattgacggggcgc

SEQ ID NO: 308007 - DNA, 15 bp, Homo sapiens
gattgacggggcgcg

SEQ ID NO: 308008 - DNA, 15 bp, Homo sapiens
attgacggggcgcgc

SEQ ID NO: 308009 - DNA, 15 bp, Homo sapiens
ttgacggggcgcgca

SEQ ID NO: 308010 - DNA, 15 bp, Homo sapiens
tgacggggcgcgcag

SEQ ID NO: 308011 - DNA, 15 bp, Homo sapiens
gacggggcgcgcagt

SEQ ID NO: 308012 - DNA, 15 bp, Homo sapiens
acggggcgcgcagtc

SEQ ID NO: 308013 - DNA, 15 bp, Homo sapiens
cggggcgcgcagtca

SEQ ID NO: 308014 - DNA, 15 bp, Homo sapiens
ggggcgcgcagtcag

SEQ ID NO: 308015 - DNA, 15 bp, Homo sapiens
gggcgcgcagtcagg

SEQ ID NO: 308016 - DNA, 15 bp, Homo sapiens
ggcgcgcagtcaggt

SEQ ID NO: 308017 - DNA, 15 bp, Homo sapiens
gcgcgcagtcaggtg

SEQ ID NO: 308018 - DNA, 15 bp, Homo sapiens
cgcgcagtcaggtga

SEQ ID NO: 308019 - DNA, 15 bp, Homo sapiens
gcgcagtcaggtgac

SEQ ID NO: 308020 - DNA, 15 bp, Homo sapiens
cgcagtcaggtgact

SEQ ID NO: 308021 - DNA, 15 bp, Homo sapiens
gcagtcaggtgactt

SEQ ID NO: 308022 - DNA, 15 bp, Homo sapiens
cagtcaggtgacttg

SEQ ID NO: 308023 - DNA, 15 bp, Homo sapiens
agtcaggtgacttgg

SEQ ID NO: 308024 - DNA, 15 bp, Homo sapiens
gtcaggtgacttggg

SEQ ID NO: 308025 - DNA, 15 bp, Homo sapiens
tcaggtgacttgggg

SEQ ID NO: 308026 - DNA, 15 bp, Homo sapiens
caggtgacttggggc

SEQ ID NO: 308027 - DNA, 15 bp, Homo sapiens
aggtgacttggggcg

SEQ ID NO: 308028 - DNA, 15 bp, Homo sapiens
ggtgacttggggcgc

SEQ ID NO: 308029 - DNA, 15 bp, Homo sapiens
gtgacttggggcgcc

SEQ ID NO: 308030 - DNA, 15 bp, Homo sapiens
tgacttggggcgcca

SEQ ID NO: 308031 - DNA, 15 bp, Homo sapiens
gacttggggcgccaa

SEQ ID NO: 308032 - DNA, 15 bp, Homo sapiens
acttggggcgccaag

SEQ ID NO: 308033 - DNA, 15 bp, Homo sapiens
cttggggcgccaagt

SEQ ID NO: 308034 - DNA, 15 bp, Homo sapiens
ttggggcgccaagtt

SEQ ID NO: 308035 - DNA, 15 bp, Homo sapiens
tggggcgccaagttc

SEQ ID NO: 308036 - DNA, 15 bp, Homo sapiens
ggggcgccaagttcc

SEQ ID NO: 308037 - DNA, 15 bp, Homo sapiens
gggcgccaagttccc

SEQ ID NO: 308038 - DNA, 15 bp, Homo sapiens
ggcgccaagttcccg

SEQ ID NO: 308039 - DNA, 15 bp, Homo sapiens
gcgccaagttcccga

SEQ ID NO: 308040 - DNA, 15 bp, Homo sapiens
cgccaagttcccgac

SEQ ID NO: 308041 - DNA, 15 bp, Homo sapiens
gccaagttcccgacg

SEQ ID NO: 308042 - DNA, 15 bp, Homo sapiens
ccaagttcccgacgc

SEQ ID NO: 308043 - DNA, 15 bp, Homo sapiens
caagttcccgacgcg

SEQ ID NO: 308044 - DNA, 15 bp, Homo sapiens
aagttcccgacgcgg

SEQ ID NO: 308045 - DNA, 15 bp, Homo sapiens
agttcccgacgcggt

SEQ ID NO: 308046 - DNA, 15 bp, Homo sapiens
gttcccgacgcggtg

SEQ ID NO: 308047 - DNA, 15 bp, Homo sapiens
ttcccgacgcggtgg

SEQ ID NO: 308048 - DNA, 15 bp, Homo sapiens
tcccgacgcggtggc

SEQ ID NO: 308049 - DNA, 15 bp, Homo sapiens
cccgacgcggtggcc

SEQ ID NO: 308050 - DNA, 15 bp, Homo sapiens
ccgacgcggtggccg

SEQ ID NO: 308051 - DNA, 15 bp, Homo sapiens
cgacgcggtggccgc

SEQ ID NO: 308052 - DNA, 15 bp, Homo sapiens
gacgcggtggccgcg

SEQ ID NO: 308053 - DNA, 15 bp, Homo sapiens
acgcggtggccgcgg

SEQ ID NO: 308054 - DNA, 15 bp, Homo sapiens
cgcggtggccgcggt

SEQ ID NO: 308055 - DNA, 15 bp, Homo sapiens
gcggtggccgcggtg

SEQ ID NO: 308056 - DNA, 15 bp, Homo sapiens
cggtggccgcggtga

SEQ ID NO: 308057 - DNA, 15 bp, Homo sapiens
ggtggccgcggtgac

SEQ ID NO: 308058 - DNA, 15 bp, Homo sapiens
gtggccgcggtgacc

SEQ ID NO: 308059 - DNA, 15 bp, Homo sapiens
tggccgcggtgaccg

SEQ ID NO: 308060 - DNA, 15 bp, Homo sapiens
ggccgcggtgaccgc

SEQ ID NO: 308061 - DNA, 15 bp, Homo sapiens
gccgcggtgaccgcc

SEQ ID NO: 308062 - DNA, 15 bp, Homo sapiens
ccgcggtgaccgccg

SEQ ID NO: 308063 - DNA, 15 bp, Homo sapiens
cgcggtgaccgccga

SEQ ID NO: 308064 - DNA, 15 bp, Homo sapiens
gcggtgaccgccgag

SEQ ID NO: 308065 - DNA, 15 bp, Homo sapiens
cggtgaccgccgagg

SEQ ID NO: 308066 - DNA, 15 bp, Homo sapiens
ggtgaccgccgaggc

SEQ ID NO: 308067 - DNA, 15 bp, Homo sapiens
gtgaccgccgaggcc

SEQ ID NO: 308068 - DNA, 15 bp, Homo sapiens
tgaccgccgaggccc

SEQ ID NO: 308069 - DNA, 15 bp, Homo sapiens
gaccgccgaggcccg

SEQ ID NO: 308070 - DNA, 15 bp, Homo sapiens
accgccgaggcccgg

SEQ ID NO: 308071 - DNA, 15 bp, Homo sapiens
ccgccgaggcccggc

SEQ ID NO: 308072 - DNA, 15 bp, Homo sapiens
cgccgaggcccggca

SEQ ID NO: 308073 - DNA, 15 bp, Homo sapiens
gccgaggcccggcag

SEQ ID NO: 308074 - DNA, 15 bp, Homo sapiens
ccgaggcccggcaga

SEQ ID NO: 308075 - DNA, 15 bp, Homo sapiens
cgaggcccggcagac

SEQ ID NO: 308076 - DNA, 15 bp, Homo sapiens
gaggcccggcagacg

SEQ ID NO: 308077 - DNA, 15 bp, Homo sapiens
aggcccggcagacgc

SEQ ID NO: 308078 - DNA, 15 bp, Homo sapiens
ggcccggcagacgct

SEQ ID NO: 308079 - DNA, 15 bp, Homo sapiens
gcccggcagacgctg

SEQ ID NO: 308080 - DNA, 15 bp, Homo sapiens
cccggcagacgctga

SEQ ID NO: 308081 - DNA, 15 bp, Homo sapiens
ccggcagacgctgac

SEQ ID NO: 308082 - DNA, 15 bp, Homo sapiens
cggcagacgctgacc

SEQ ID NO: 308083 - DNA, 15 bp, Homo sapiens
ggcagacgctgaccc

SEQ ID NO: 308084 - DNA, 15 bp, Homo sapiens
gcagacgctgacccg

SEQ ID NO: 308085 - DNA, 15 bp, Homo sapiens
cagacgctgacccgg

SEQ ID NO: 308086 - DNA, 15 bp, Homo sapiens
agacgctgacccggg

SEQ ID NO: 308087 - DNA, 15 bp, Homo sapiens
gacgctgacccggga

SEQ ID NO: 308088 - DNA, 15 bp, Homo sapiens
acgctgacccgggaa

SEQ ID NO: 308089 - DNA, 15 bp, Homo sapiens
cgctgacccgggaac

SEQ ID NO: 308090 - DNA, 15 bp, Homo sapiens
gctgacccgggaacg

SEQ ID NO: 308091 - DNA, 15 bp, Homo sapiens
ctgacccgggaacgt

SEQ ID NO: 308092 - DNA, 15 bp, Homo sapiens
tgacccgggaacgta

SEQ ID NO: 308093 - DNA, 15 bp, Homo sapiens
gacccgggaacgtag

SEQ ID NO: 308094 - DNA, 15 bp, Homo sapiens
acccgggaacgtagt

SEQ ID NO: 308095 - DNA, 15 bp, Homo sapiens
cccgggaacgtagtg

SEQ ID NO: 308096 - DNA, 15 bp, Homo sapiens
ccgggaacgtagtgg

SEQ ID NO: 308097 - DNA, 15 bp, Homo sapiens
cgggaacgtagtggg

SEQ ID NO: 308098 - DNA, 15 bp, Homo sapiens
gggaacgtagtgggg

SEQ ID NO: 308099 - DNA, 15 bp, Homo sapiens
ggaacgtagtggggc

SEQ ID NO: 308100 - DNA, 15 bp, Homo sapiens
gaacgtagtggggct

SEQ ID NO: 308101 - DNA, 15 bp, Homo sapiens
aacgtagtggggctg

SEQ ID NO: 308102 - DNA, 15 bp, Homo sapiens
acgtagtggggctga

SEQ ID NO: 308103 - DNA, 15 bp, Homo sapiens
cgtagtggggctgat

SEQ ID NO: 308104 - DNA, 15 bp, Homo sapiens
gtagtggggctgatc

SEQ ID NO: 308105 - DNA, 15 bp, Homo sapiens
tagtggggctgatct

SEQ ID NO: 308106 - DNA, 15 bp, Homo sapiens
agtggggctgatctt

SEQ ID NO: 308107 - DNA, 15 bp, Homo sapiens
gtggggctgatcttc

SEQ ID NO: 308108 - DNA, 15 bp, Homo sapiens
tggggctgatcttcc

SEQ ID NO: 308109 - DNA, 15 bp, Homo sapiens
ggggctgatcttccg

SEQ ID NO: 308110 - DNA, 15 bp, Homo sapiens
gggctgatcttccgg

SEQ ID NO: 308111 - DNA, 15 bp, Homo sapiens
ggctgatcttccgga

SEQ ID NO: 308112 - DNA, 15 bp, Homo sapiens
gctgatcttccggaa

SEQ ID NO: 308113 - DNA, 15 bp, Homo sapiens
ctgatcttccggaac

SEQ ID NO: 308114 - DNA, 15 bp, Homo sapiens
tgatcttccggaaca

SEQ ID NO: 308115 - DNA, 15 bp, Homo sapiens
gatcttccggaacaa

SEQ ID NO: 308116 - DNA, 15 bp, Homo sapiens
atcttccggaacaaa

SEQ ID NO: 308117 - DNA, 15 bp, Homo sapiens
tcttccggaacaaag

SEQ ID NO: 308118 - DNA, 15 bp, Homo sapiens
cttccggaacaaagt

SEQ ID NO: 308119 - DNA, 15 bp, Homo sapiens
ttccggaacaaagtt

SEQ ID NO: 308120 - DNA, 15 bp, Homo sapiens
tccggaacaaagttg

SEQ ID NO: 308121 - DNA, 15 bp, Homo sapiens
ccggaacaaagttgc

SEQ ID NO: 308122 - DNA, 15 bp, Homo sapiens
cggaacaaagttgct

SEQ ID NO: 308123 - DNA, 15 bp, Homo sapiens
ggaacaaagttgctg

SEQ ID NO: 308124 - DNA, 15 bp, Homo sapiens
gaacaaagttgctgg

SEQ ID NO: 308125 - DNA, 15 bp, Homo sapiens
aacaaagttgctggg

SEQ ID NO: 308126 - DNA, 15 bp, Homo sapiens
acaaagttgctgggc

SEQ ID NO: 308127 - DNA, 15 bp, Homo sapiens
caaagttgctgggcc

SEQ ID NO: 308128 - DNA, 15 bp, Homo sapiens
aaagttgctgggccg

SEQ ID NO: 308129 - DNA, 15 bp, Homo sapiens
aagttgctgggccgg

SEQ ID NO: 308130 - DNA, 15 bp, Homo sapiens
agttgctgggccggc

SEQ ID NO: 308131 - DNA, 15 bp, Homo sapiens
gttgctgggccggcg

SEQ ID NO: 308132 - DNA, 15 bp, Homo sapiens
ttgctgggccggcgg

SEQ ID NO: 308133 - DNA, 15 bp, Homo sapiens
tgctgggccggcggc

SEQ ID NO: 308134 - DNA, 15 bp, Homo sapiens
gctgggccggcggcg

SEQ ID NO: 308135 - DNA, 15 bp, Homo sapiens
ctgggccggcggcgg

SEQ ID NO: 308136 - DNA, 15 bp, Homo sapiens
tgggccggcggcggc

SEQ ID NO: 308137 - DNA, 15 bp, Homo sapiens
gggccggcggcggcg

SEQ ID NO: 308138 - DNA, 15 bp, Homo sapiens
ggccggcggcggcgg

SEQ ID NO: 308139 - DNA, 15 bp, Homo sapiens
gccggcggcggcggg

SEQ ID NO: 308140 - DNA, 15 bp, Homo sapiens
ccggcggcggcgggg

SEQ ID NO: 308141 - DNA, 15 bp, Homo sapiens
cggcggcggcggggc

SEQ ID NO: 308142 - DNA, 15 bp, Homo sapiens
ggcggcggcggggcg

SEQ ID NO: 308143 - DNA, 15 bp, Homo sapiens
gcggcggcggggcga

SEQ ID NO: 308144 - DNA, 15 bp, Homo sapiens
cggcggcggggcgag

SEQ ID NO: 308145 - DNA, 15 bp, Homo sapiens
ggcggcggggcgaga

SEQ ID NO: 308146 - DNA, 15 bp, Homo sapiens
gcggcggggcgagag

SEQ ID NO: 308147 - DNA, 15 bp, Homo sapiens
cggcggggcgagagc

SEQ ID NO: 308148 - DNA, 15 bp, Homo sapiens
ggcggggcgagagcg

SEQ ID NO: 308149 - DNA, 15 bp, Homo sapiens
gcggggcgagagcgc

SEQ ID NO: 308150 - DNA, 15 bp, Homo sapiens
cggggcgagagcgcc

SEQ ID NO: 308151 - DNA, 15 bp, Homo sapiens
ggggcgagagcgccg

SEQ ID NO: 308152 - DNA, 15 bp, Homo sapiens
gggcgagagcgccga

SEQ ID NO: 308153 - DNA, 15 bp, Homo sapiens
ggcgagagcgccgag

SEQ ID NO: 308154 - DNA, 15 bp, Homo sapiens
gcgagagcgccgagg

SEQ ID NO: 308155 - DNA, 15 bp, Homo sapiens
cgagagcgccgaggg

SEQ ID NO: 308156 - DNA, 15 bp, Homo sapiens
gagagcgccgagggg

SEQ ID NO: 308157 - DNA, 15 bp, Homo sapiens
agagcgccgaggggg

SEQ ID NO: 308158 - DNA, 15 bp, Homo sapiens
gagcgccgaggggga

SEQ ID NO: 308159 - DNA, 15 bp, Homo sapiens
agcgccgagggggag

SEQ ID NO: 308160 - DNA, 15 bp, Homo sapiens
gcgccgagggggagc

SEQ ID NO: 308161 - DNA, 15 bp, Homo sapiens
cgccgagggggagcc

SEQ ID NO: 308162 - DNA, 15 bp, Homo sapiens
gccgagggggagccg

SEQ ID NO: 308163 - DNA, 15 bp, Homo sapiens
ccgagggggagccgg

SEQ ID NO: 308164 - DNA, 15 bp, Homo sapiens
cgagggggagccgga

SEQ ID NO: 308165 - DNA, 15 bp, Homo sapiens
gagggggagccggag

SEQ ID NO: 308166 - DNA, 15 bp, Homo sapiens
agggggagccggagc

SEQ ID NO: 308167 - DNA, 15 bp, Homo sapiens
gggggagccggagcg

SEQ ID NO: 308168 - DNA, 15 bp, Homo sapiens
ggggagccggagcgc

SEQ ID NO: 308169 - DNA, 15 bp, Homo sapiens
gggagccggagcgct

SEQ ID NO: 308170 - DNA, 15 bp, Homo sapiens
ggagccggagcgctg

SEQ ID NO: 308171 - DNA, 15 bp, Homo sapiens
gagccggagcgctgc

SEQ ID NO: 308172 - DNA, 15 bp, Homo sapiens
agccggagcgctgca

SEQ ID NO: 308173 - DNA, 15 bp, Homo sapiens
gccggagcgctgcag

SEQ ID NO: 308174 - DNA, 15 bp, Homo sapiens
ccggagcgctgcaga

SEQ ID NO: 308175 - DNA, 15 bp, Homo sapiens
cggagcgctgcagag

SEQ ID NO: 308176 - DNA, 15 bp, Homo sapiens
ggagcgctgcagagg

SEQ ID NO: 308177 - DNA, 15 bp, Homo sapiens
gagcgctgcagaggc

SEQ ID NO: 308178 - DNA, 15 bp, Homo sapiens
agcgctgcagaggcg

SEQ ID NO: 308179 - DNA, 15 bp, Homo sapiens
gcgctgcagaggcgc

SEQ ID NO: 308180 - DNA, 15 bp, Homo sapiens
cgctgcagaggcgcg

SEQ ID NO: 308181 - DNA, 15 bp, Homo sapiens
gctgcagaggcgcgg

SEQ ID NO: 308182 - DNA, 15 bp, Homo sapiens
ctgcagaggcgcggg

SEQ ID NO: 308183 - DNA, 15 bp, Homo sapiens
tgcagaggcgcgggc

SEQ ID NO: 308184 - DNA, 15 bp, Homo sapiens
gcagaggcgcgggcc

SEQ ID NO: 308185 - DNA, 15 bp, Homo sapiens
cagaggcgcgggccg

SEQ ID NO: 308186 - DNA, 15 bp, Homo sapiens
agaggcgcgggccgg

SEQ ID NO: 308187 - DNA, 15 bp, Homo sapiens
gaggcgcgggccgga

SEQ ID NO: 308188 - DNA, 15 bp, Homo sapiens
aggcgcgggccggag

SEQ ID NO: 308189 - DNA, 15 bp, Homo sapiens
ggcgcgggccggagg

SEQ ID NO: 308190 - DNA, 15 bp, Homo sapiens
gcgcgggccggaggg

SEQ ID NO: 308191 - DNA, 15 bp, Homo sapiens
cgcgggccggagggc

SEQ ID NO: 308192 - DNA, 15 bp, Homo sapiens
gcgggccggagggct

SEQ ID NO: 308193 - DNA, 15 bp, Homo sapiens
cgggccggagggctg

SEQ ID NO: 308194 - DNA, 15 bp, Homo sapiens
gggccggagggctgg

SEQ ID NO: 308195 - DNA, 15 bp, Homo sapiens
ggccggagggctggc

SEQ ID NO: 308196 - DNA, 15 bp, Homo sapiens
gccggagggctggcg

SEQ ID NO: 308197 - DNA, 15 bp, Homo sapiens
ccggagggctggcgc

SEQ ID NO: 308198 - DNA, 15 bp, Homo sapiens
cggagggctggcgct

SEQ ID NO: 308199 - DNA, 15 bp, Homo sapiens
ggagggctggcgctg

SEQ ID NO: 308200 - DNA, 15 bp, Homo sapiens
gagggctggcgctga

SEQ ID NO: 308201 - DNA, 15 bp, Homo sapiens
agggctggcgctgat

SEQ ID NO: 308202 - DNA, 15 bp, Homo sapiens
gggctggcgctgatc

SEQ ID NO: 308203 - DNA, 15 bp, Homo sapiens
ggctggcgctgatct

SEQ ID NO: 308204 - DNA, 15 bp, Homo sapiens
gctggcgctgatctg

SEQ ID NO: 308205 - DNA, 15 bp, Homo sapiens
ctggcgctgatctgc

SEQ ID NO: 308206 - DNA, 15 bp, Homo sapiens
tggcgctgatctgca

SEQ ID NO: 308207 - DNA, 15 bp, Homo sapiens
ggcgctgatctgcac

SEQ ID NO: 308208 - DNA, 15 bp, Homo sapiens
gcgctgatctgcacc

SEQ ID NO: 308209 - DNA, 15 bp, Homo sapiens
cgctgatctgcaccc

SEQ ID NO: 308210 - DNA, 15 bp, Homo sapiens
gctgatctgcaccct

SEQ ID NO: 308211 - DNA, 15 bp, Homo sapiens
ctgatctgcaccctt

SEQ ID NO: 308212 - DNA, 15 bp, Homo sapiens
tgatctgcacccttc

SEQ ID NO: 308213 - DNA, 15 bp, Homo sapiens
gatctgcacccttct

SEQ ID NO: 308214 - DNA, 15 bp, Homo sapiens
atctgcacccttctc

SEQ ID NO: 308215 - DNA, 15 bp, Homo sapiens
tctgcacccttctca

SEQ ID NO: 308216 - DNA, 15 bp, Homo sapiens
ctgcacccttctcat

SEQ ID NO: 308217 - DNA, 15 bp, Homo sapiens
tgcacccttctcatc

SEQ ID NO: 308218 - DNA, 15 bp, Homo sapiens
gcacccttctcatct

SEQ ID NO: 308219 - DNA, 15 bp, Homo sapiens
cacccttctcatctg

SEQ ID NO: 308220 - DNA, 15 bp, Homo sapiens
acccttctcatctgg

SEQ ID NO: 308221 - DNA, 15 bp, Homo sapiens
cccttctcatctgga

SEQ ID NO: 308222 - DNA, 15 bp, Homo sapiens
ccttctcatctggag

SEQ ID NO: 308223 - DNA, 15 bp, Homo sapiens
cttctcatctggaga

SEQ ID NO: 308224 - DNA, 15 bp, Homo sapiens
ttctcatctggagag

SEQ ID NO: 308225 - DNA, 15 bp, Homo sapiens
tctcatctggagagc

SEQ ID NO: 308226 - DNA, 15 bp, Homo sapiens
ctcatctggagagcg

SEQ ID NO: 308227 - DNA, 15 bp, Homo sapiens
tcatctggagagcgg

SEQ ID NO: 308228 - DNA, 15 bp, Homo sapiens
catctggagagcgga

SEQ ID NO: 308229 - DNA, 15 bp, Homo sapiens
atctggagagcggac

SEQ ID NO: 308230 - DNA, 15 bp, Homo sapiens
tctggagagcggacc

SEQ ID NO: 308231 - DNA, 15 bp, Homo sapiens
ctggagagcggaccc

SEQ ID NO: 308232 - DNA, 15 bp, Homo sapiens
tggagagcggacccc

SEQ ID NO: 308233 - DNA, 15 bp, Homo sapiens
ggagagcggacccct

SEQ ID NO: 308234 - DNA, 15 bp, Homo sapiens
gagagcggacccctg

SEQ ID NO: 308235 - DNA, 15 bp, Homo sapiens
agagcggacccctgg

SEQ ID NO: 308236 - DNA, 15 bp, Homo sapiens
gagcggacccctggc

SEQ ID NO: 308237 - DNA, 15 bp, Homo sapiens
agcggacccctggct

SEQ ID NO: 308238 - DNA, 15 bp, Homo sapiens
gcggacccctggctg

SEQ ID NO: 308239 - DNA, 15 bp, Homo sapiens
cggacccctggctgc

SEQ ID NO: 308240 - DNA, 15 bp, Homo sapiens
ggacccctggctgcc

SEQ ID NO: 308241 - DNA, 15 bp, Homo sapiens
gacccctggctgccc

SEQ ID NO: 308242 - DNA, 15 bp, Homo sapiens
acccctggctgcccg

SEQ ID NO: 308243 - DNA, 15 bp, Homo sapiens
cccctggctgcccgg

SEQ ID NO: 308244 - DNA, 15 bp, Homo sapiens
ccctggctgcccgga

SEQ ID NO: 308245 - DNA, 15 bp, Homo sapiens
cctggctgcccggag

SEQ ID NO: 308246 - DNA, 15 bp, Homo sapiens
ctggctgcccggagg

SEQ ID NO: 308247 - DNA, 15 bp, Homo sapiens
tggctgcccggaggc

SEQ ID NO: 308248 - DNA, 15 bp, Homo sapiens
ggctgcccggaggcg

SEQ ID NO: 308249 - DNA, 15 bp, Homo sapiens
gctgcccggaggcga

SEQ ID NO: 308250 - DNA, 15 bp, Homo sapiens
ctgcccggaggcgag

SEQ ID NO: 308251 - DNA, 15 bp, Homo sapiens
tgcccggaggcgagc

SEQ ID NO: 308252 - DNA, 15 bp, Homo sapiens
gcccggaggcgagcc

SEQ ID NO: 308253 - DNA, 15 bp, Homo sapiens
cccggaggcgagccc

SEQ ID NO: 308254 - DNA, 15 bp, Homo sapiens
ccggaggcgagcccc

SEQ ID NO: 308255 - DNA, 15 bp, Homo sapiens
cggaggcgagcccct

SEQ ID NO: 308256 - DNA, 15 bp, Homo sapiens
ggaggcgagcccctt

SEQ ID NO: 308257 - DNA, 15 bp, Homo sapiens
gaggcgagccccttc

SEQ ID NO: 308258 - DNA, 15 bp, Homo sapiens
aggcgagccccttcc

SEQ ID NO: 308259 - DNA, 15 bp, Homo sapiens
ggcgagccccttccc

SEQ ID NO: 308260 - DNA, 15 bp, Homo sapiens
gcgagccccttcccg

SEQ ID NO: 308261 - DNA, 15 bp, Homo sapiens
cgagccccttcccgg

SEQ ID NO: 308262 - DNA, 15 bp, Homo sapiens
gagccccttcccggg

SEQ ID NO: 308263 - DNA, 15 bp, Homo sapiens
agccccttcccgggg

SEQ ID NO: 308264 - DNA, 15 bp, Homo sapiens
gccccttcccggggg

SEQ ID NO: 308265 - DNA, 15 bp, Homo sapiens
ccccttcccgggggg

SEQ ID NO: 308266 - DNA, 15 bp, Homo sapiens
cccttcccggggggt

SEQ ID NO: 308267 - DNA, 15 bp, Homo sapiens
ccttcccggggggtg

SEQ ID NO: 308268 - DNA, 15 bp, Homo sapiens
cttcccggggggtgg

SEQ ID NO: 308269 - DNA, 15 bp, Homo sapiens
ttcccggggggtggg

SEQ ID NO: 308270 - DNA, 15 bp, Homo sapiens
tcccggggggtgggg

SEQ ID NO: 308271 - DNA, 15 bp, Homo sapiens
cccggggggtggggg

SEQ ID NO: 308272 - DNA, 15 bp, Homo sapiens
ccggggggtgggggc

SEQ ID NO: 308273 - DNA, 15 bp, Homo sapiens
cggggggtgggggcg

SEQ ID NO: 308274 - DNA, 15 bp, Homo sapiens
ggggggtgggggcgg

SEQ ID NO: 308275 - DNA, 15 bp, Homo sapiens
gggggtgggggcggc

SEQ ID NO: 308276 - DNA, 15 bp, Homo sapiens
ggggtgggggcggca

SEQ ID NO: 308277 - DNA, 15 bp, Homo sapiens
gggtgggggcggcaa

SEQ ID NO: 308278 - DNA, 15 bp, Homo sapiens
ggtgggggcggcaac

SEQ ID NO: 308279 - DNA, 15 bp, Homo sapiens
gtgggggcggcaacg

SEQ ID NO: 308280 - DNA, 15 bp, Homo sapiens
tgggggcggcaacgc

SEQ ID NO: 308281 - DNA, 15 bp, Homo sapiens
gggggcggcaacgcg

SEQ ID NO: 308282 - DNA, 15 bp, Homo sapiens
ggggcggcaacgcgc

SEQ ID NO: 308283 - DNA, 15 bp, Homo sapiens
gggcggcaacgcgcg

SEQ ID NO: 308284 - DNA, 15 bp, Homo sapiens
ggcggcaacgcgcga

SEQ ID NO: 308285 - DNA, 15 bp, Homo sapiens
gcggcaacgcgcgac

SEQ ID NO: 308286 - DNA, 15 bp, Homo sapiens
cggcaacgcgcgacc

SEQ ID NO: 308287 - DNA, 15 bp, Homo sapiens
ggcaacgcgcgaccc

SEQ ID NO: 308288 - DNA, 15 bp, Homo sapiens
gcaacgcgcgaccca

SEQ ID NO: 308289 - DNA, 15 bp, Homo sapiens
caacgcgcgacccag

SEQ ID NO: 308290 - DNA, 15 bp, Homo sapiens
aacgcgcgacccagc

SEQ ID NO: 308291 - DNA, 15 bp, Homo sapiens
acgcgcgacccagcg

SEQ ID NO: 308292 - DNA, 15 bp, Homo sapiens
cgcgcgacccagcgg

SEQ ID NO: 308293 - DNA, 15 bp, Homo sapiens
gcgcgacccagcggt

SEQ ID NO: 308294 - DNA, 15 bp, Homo sapiens
cgcgacccagcggtc

SEQ ID NO: 308295 - DNA, 15 bp, Homo sapiens
gcgacccagcggtcc

SEQ ID NO: 308296 - DNA, 15 bp, Homo sapiens
cgacccagcggtcct

SEQ ID NO: 308297 - DNA, 15 bp, Homo sapiens
gacccagcggtcctg

SEQ ID NO: 308298 - DNA, 15 bp, Homo sapiens
acccagcggtcctgc

SEQ ID NO: 308299 - DNA, 15 bp, Homo sapiens
cccagcggtcctgcg

SEQ ID NO: 308300 - DNA, 15 bp, Homo sapiens
ccagcggtcctgcgc

SEQ ID NO: 308301 - DNA, 15 bp, Homo sapiens
cagcggtcctgcgcc

SEQ ID NO: 308302 - DNA, 15 bp, Homo sapiens
agcggtcctgcgccc

SEQ ID NO: 308303 - DNA, 15 bp, Homo sapiens
gcggtcctgcgcccc

SEQ ID NO: 308304 - DNA, 15 bp, Homo sapiens
cggtcctgcgcccca

SEQ ID NO: 308305 - DNA, 15 bp, Homo sapiens
ggtcctgcgccccac

SEQ ID NO: 308306 - DNA, 15 bp, Homo sapiens
gtcctgcgccccacc

SEQ ID NO: 308307 - DNA, 15 bp, Homo sapiens
tcctgcgccccaccc

SEQ ID NO: 308308 - DNA, 15 bp, Homo sapiens
cctgcgccccaccct

SEQ ID NO: 308309 - DNA, 15 bp, Homo sapiens
ctgcgccccaccctc

SEQ ID NO: 308310 - DNA, 15 bp, Homo sapiens
tgcgccccaccctcc

SEQ ID NO: 308311 - DNA, 15 bp, Homo sapiens
gcgccccaccctccc

SEQ ID NO: 308312 - DNA, 15 bp, Homo sapiens
cgccccaccctccct

SEQ ID NO: 308313 - DNA, 15 bp, Homo sapiens
gccccaccctccctc

SEQ ID NO: 308314 - DNA, 15 bp, Homo sapiens
ccccaccctccctcc

SEQ ID NO: 308315 - DNA, 15 bp, Homo sapiens
cccaccctccctcct

SEQ ID NO: 308316 - DNA, 15 bp, Homo sapiens
ccaccctccctcctc

SEQ ID NO: 308317 - DNA, 15 bp, Homo sapiens
caccctccctcctcc

SEQ ID NO: 308318 - DNA, 15 bp, Homo sapiens
accctccctcctccg

SEQ ID NO: 308319 - DNA, 15 bp, Homo sapiens
ccctccctcctccgc

SEQ ID NO: 308320 - DNA, 15 bp, Homo sapiens
cctccctcctccgcc

SEQ ID NO: 308321 - DNA, 15 bp, Homo sapiens
ctccctcctccgcct

SEQ ID NO: 308322 - DNA, 15 bp, Homo sapiens
tccctcctccgcctc

SEQ ID NO: 308323 - DNA, 15 bp, Homo sapiens
ccctcctccgcctcc

SEQ ID NO: 308324 - DNA, 15 bp, Homo sapiens
cctcctccgcctcca

SEQ ID NO: 308325 - DNA, 15 bp, Homo sapiens
ctcctccgcctccag

SEQ ID NO: 308326 - DNA, 15 bp, Homo sapiens
tcctccgcctccagc

SEQ ID NO: 308327 - DNA, 15 bp, Homo sapiens
cctccgcctccagcg

SEQ ID NO: 308328 - DNA, 15 bp, Homo sapiens
ctccgcctccagcgc

SEQ ID NO: 308329 - DNA, 15 bp, Homo sapiens
tccgcctccagcgct

SEQ ID NO: 308330 - DNA, 15 bp, Homo sapiens
ccgcctccagcgctc

SEQ ID NO: 308331 - DNA, 15 bp, Homo sapiens
cgcctccagcgctcg

SEQ ID NO: 308332 - DNA, 15 bp, Homo sapiens
gcctccagcgctcgg

SEQ ID NO: 308333 - DNA, 15 bp, Homo sapiens
cctccagcgctcggc

SEQ ID NO: 308334 - DNA, 15 bp, Homo sapiens
ctccagcgctcggct

SEQ ID NO: 308335 - DNA, 15 bp, Homo sapiens
tccagcgctcggctc

SEQ ID NO: 308336 - DNA, 15 bp, Homo sapiens
ccagcgctcggctcc

SEQ ID NO: 308337 - DNA, 15 bp, Homo sapiens
cagcgctcggctcca

SEQ ID NO: 308338 - DNA, 15 bp, Homo sapiens
agcgctcggctccaa

SEQ ID NO: 308339 - DNA, 15 bp, Homo sapiens
gcgctcggctccaac

SEQ ID NO: 308340 - DNA, 15 bp, Homo sapiens
cgctcggctccaaca

SEQ ID NO: 308341 - DNA, 15 bp, Homo sapiens
gctcggctccaacaa

SEQ ID NO: 308342 - DNA, 15 bp, Homo sapiens
ctcggctccaacaaa

SEQ ID NO: 308343 - DNA, 15 bp, Homo sapiens
tcggctccaacaaag

SEQ ID NO: 308344 - DNA, 15 bp, Homo sapiens
cggctccaacaaagg

SEQ ID NO: 308345 - DNA, 15 bp, Homo sapiens
ggctccaacaaaggg

SEQ ID NO: 308346 - DNA, 15 bp, Homo sapiens
gctccaacaaagggg

SEQ ID NO: 308347 - DNA, 15 bp, Homo sapiens
ctccaacaaaggggc

SEQ ID NO: 308348 - DNA, 15 bp, Homo sapiens
tccaacaaaggggca

SEQ ID NO: 308349 - DNA, 15 bp, Homo sapiens
ccaacaaaggggcag

SEQ ID NO: 308350 - DNA, 15 bp, Homo sapiens
caacaaaggggcagg

SEQ ID NO: 308351 - DNA, 15 bp, Homo sapiens
aacaaaggggcaggc

SEQ ID NO: 308352 - DNA, 15 bp, Homo sapiens
acaaaggggcaggcc

SEQ ID NO: 308353 - DNA, 15 bp, Homo sapiens
caaaggggcaggccc

SEQ ID NO: 308354 - DNA, 15 bp, Homo sapiens
aaaggggcaggcccg

SEQ ID NO: 308355 - DNA, 15 bp, Homo sapiens
aaggggcaggcccgc

SEQ ID NO: 308356 - DNA, 15 bp, Homo sapiens
aggggcaggcccgca

SEQ ID NO: 308357 - DNA, 15 bp, Homo sapiens
ggggcaggcccgcag

SEQ ID NO: 308358 - DNA, 15 bp, Homo sapiens
gggcaggcccgcagc

SEQ ID NO: 308359 - DNA, 15 bp, Homo sapiens
ggcaggcccgcagcg

SEQ ID NO: 308360 - DNA, 15 bp, Homo sapiens
gcaggcccgcagcgg

SEQ ID NO: 308361 - DNA, 15 bp, Homo sapiens
caggcccgcagcggg

SEQ ID NO: 308362 - DNA, 15 bp, Homo sapiens
aggcccgcagcgggg

SEQ ID NO: 308363 - DNA, 15 bp, Homo sapiens
ggcccgcagcgggga

SEQ ID NO: 308364 - DNA, 15 bp, Homo sapiens
gcccgcagcggggag

SEQ ID NO: 308365 - DNA, 15 bp, Homo sapiens
cccgcagcggggagg

SEQ ID NO: 308366 - DNA, 15 bp, Homo sapiens
ccgcagcggggagga

SEQ ID NO: 308367 - DNA, 15 bp, Homo sapiens
cgcagcggggaggag

SEQ ID NO: 308368 - DNA, 15 bp, Homo sapiens
gcagcggggaggagg

SEQ ID NO: 308369 - DNA, 15 bp, Homo sapiens
cagcggggaggagga

SEQ ID NO: 308370 - DNA, 15 bp, Homo sapiens
agcggggaggaggag

SEQ ID NO: 308371 - DNA, 15 bp, Homo sapiens
gcggggaggaggagg

SEQ ID NO: 308372 - DNA, 15 bp, Homo sapiens
cggggaggaggagga

SEQ ID NO: 308373 - DNA, 15 bp, Homo sapiens
ggaggaggaggagga

SEQ ID NO: 308374 - DNA, 15 bp, Homo sapiens
gaggaggaggaggag

SEQ ID NO: 308375 - DNA, 15 bp, Homo sapiens
aggaggaggaggagc

SEQ ID NO: 308376 - DNA, 15 bp, Homo sapiens
ggaggaggaggagcc

SEQ ID NO: 308377 - DNA, 15 bp, Homo sapiens
gaggaggaggagccg

SEQ ID NO: 308378 - DNA, 15 bp, Homo sapiens
aggaggaggagccgc

SEQ ID NO: 308379 - DNA, 15 bp, Homo sapiens
ggaggaggagccgcc

SEQ ID NO: 308380 - DNA, 15 bp, Homo sapiens
gaggaggagccgccg

SEQ ID NO: 308381 - DNA, 15 bp, Homo sapiens
aggaggagccgccga

SEQ ID NO: 308382 - DNA, 15 bp, Homo sapiens
ggaggagccgccgaa

SEQ ID NO: 308383 - DNA, 15 bp, Homo sapiens
gaggagccgccgaag

SEQ ID NO: 308384 - DNA, 15 bp, Homo sapiens
aggagccgccgaagg

SEQ ID NO: 308385 - DNA, 15 bp, Homo sapiens
ggagccgccgaagga

SEQ ID NO: 308386 - DNA, 15 bp, Homo sapiens
gagccgccgaaggag

SEQ ID NO: 308387 - DNA, 15 bp, Homo sapiens
agccgccgaaggagc

SEQ ID NO: 308388 - DNA, 15 bp, Homo sapiens
gccgccgaaggagcg

SEQ ID NO: 308389 - DNA, 15 bp, Homo sapiens
ccgccgaaggagcga

SEQ ID NO: 308390 - DNA, 15 bp, Homo sapiens
cgccgaaggagcgag

SEQ ID NO: 308391 - DNA, 15 bp, Homo sapiens
gccgaaggagcgagc

SEQ ID NO: 308392 - DNA, 15 bp, Homo sapiens
ccgaaggagcgagcc

SEQ ID NO: 308393 - DNA, 15 bp, Homo sapiens
cgaaggagcgagcct

SEQ ID NO: 308394 - DNA, 15 bp, Homo sapiens
gaaggagcgagcctc

SEQ ID NO: 308395 - DNA, 15 bp, Homo sapiens
aaggagcgagcctct

SEQ ID NO: 308396 - DNA, 15 bp, Homo sapiens
aggagcgagcctctc

SEQ ID NO: 308397 - DNA, 15 bp, Homo sapiens
ggagcgagcctctct

SEQ ID NO: 308398 - DNA, 15 bp, Homo sapiens
gagcgagcctctctc

SEQ ID NO: 308399 - DNA, 15 bp, Homo sapiens
agcgagcctctctcg

SEQ ID NO: 308400 - DNA, 15 bp, Homo sapiens
gcgagcctctctcgc

SEQ ID NO: 308401 - DNA, 15 bp, Homo sapiens
cgagcctctctcgcg

SEQ ID NO: 308402 - DNA, 15 bp, Homo sapiens
gagcctctctcgcgc

SEQ ID NO: 308403 - DNA, 15 bp, Homo sapiens
agcctctctcgcgca

SEQ ID NO: 308404 - DNA, 15 bp, Homo sapiens
gcctctctcgcgcac

SEQ ID NO: 308405 - DNA, 15 bp, Homo sapiens
cctctctcgcgcaca

SEQ ID NO: 308406 - DNA, 15 bp, Homo sapiens
ctctctcgcgcacaa

SEQ ID NO: 308407 - DNA, 15 bp, Homo sapiens
tctctcgcgcacaaa

SEQ ID NO: 308408 - DNA, 15 bp, Homo sapiens
ctctcgcgcacaaag

SEQ ID NO: 308409 - DNA, 15 bp, Homo sapiens
tctcgcgcacaaagt

SEQ ID NO: 308410 - DNA, 15 bp, Homo sapiens
ctcgcgcacaaagtt

SEQ ID NO: 308411 - DNA, 15 bp, Homo sapiens
tcgcgcacaaagttg

SEQ ID NO: 308412 - DNA, 15 bp, Homo sapiens
cgcgcacaaagttgt

SEQ ID NO: 308413 - DNA, 15 bp, Homo sapiens
gcgcacaaagttgtg

SEQ ID NO: 308414 - DNA, 15 bp, Homo sapiens
cgcacaaagttgtgg

SEQ ID NO: 308415 - DNA, 15 bp, Homo sapiens
gcacaaagttgtgga

SEQ ID NO: 308416 - DNA, 15 bp, Homo sapiens
cacaaagttgtggag

SEQ ID NO: 308417 - DNA, 15 bp, Homo sapiens
acaaagttgtggagt

SEQ ID NO: 308418 - DNA, 15 bp, Homo sapiens
caaagttgtggagtc

SEQ ID NO: 308419 - DNA, 15 bp, Homo sapiens
aaagttgtggagtcg

SEQ ID NO: 308420 - DNA, 15 bp, Homo sapiens
aagttgtggagtcgt

SEQ ID NO: 308421 - DNA, 15 bp, Homo sapiens
agttgtggagtcgtt

SEQ ID NO: 308422 - DNA, 15 bp, Homo sapiens
gttgtggagtcgttt

SEQ ID NO: 308423 - DNA, 15 bp, Homo sapiens
ttgtggagtcgtttt

SEQ ID NO: 308424 - DNA, 15 bp, Homo sapiens
tgtggagtcgttttt

SEQ ID NO: 308425 - DNA, 15 bp, Homo sapiens
gtggagtcgtttttc

SEQ ID NO: 308426 - DNA, 15 bp, Homo sapiens
tggagtcgtttttcc

SEQ ID NO: 308427 - DNA, 15 bp, Homo sapiens
ggagtcgtttttcct

SEQ ID NO: 308428 - DNA, 15 bp, Homo sapiens
gagtcgtttttcctc

SEQ ID NO: 308429 - DNA, 15 bp, Homo sapiens
agtcgtttttcctcg

SEQ ID NO: 308430 - DNA, 15 bp, Homo sapiens
gtcgtttttcctcgg

SEQ ID NO: 308431 - DNA, 15 bp, Homo sapiens
tcgtttttcctcgga

SEQ ID NO: 308432 - DNA, 15 bp, Homo sapiens
cgtttttcctcggag

SEQ ID NO: 308433 - DNA, 15 bp, Homo sapiens
gtttttcctcggagc

SEQ ID NO: 308434 - DNA, 15 bp, Homo sapiens
tttttcctcggagca

SEQ ID NO: 308435 - DNA, 15 bp, Homo sapiens
ttttcctcggagcag

SEQ ID NO: 308436 - DNA, 15 bp, Homo sapiens
tttcctcggagcagg

SEQ ID NO: 308437 - DNA, 15 bp, Homo sapiens
ttcctcggagcaggg

SEQ ID NO: 308438 - DNA, 15 bp, Homo sapiens
tcctcggagcaggga

SEQ ID NO: 308439 - DNA, 15 bp, Homo sapiens
cctcggagcagggaa

SEQ ID NO: 308440 - DNA, 15 bp, Homo sapiens
ctcggagcagggaag

SEQ ID NO: 308441 - DNA, 15 bp, Homo sapiens
tcggagcagggaagc

SEQ ID NO: 308442 - DNA, 15 bp, Homo sapiens
cggagcagggaagcg

SEQ ID NO: 308443 - DNA, 15 bp, Homo sapiens
ggagcagggaagcgg

SEQ ID NO: 308444 - DNA, 15 bp, Homo sapiens
gagcagggaagcggg

SEQ ID NO: 308445 - DNA, 15 bp, Homo sapiens
agcagggaagcgggc

SEQ ID NO: 308446 - DNA, 15 bp, Homo sapiens
gcagggaagcgggca

SEQ ID NO: 308447 - DNA, 15 bp, Homo sapiens
cagggaagcgggcag

SEQ ID NO: 308448 - DNA, 15 bp, Homo sapiens
agggaagcgggcagc

SEQ ID NO: 308449 - DNA, 15 bp, Homo sapiens
gggaagcgggcagca

SEQ ID NO: 308450 - DNA, 15 bp, Homo sapiens
ggaagcgggcagcag

SEQ ID NO: 308451 - DNA, 15 bp, Homo sapiens
gaagcgggcagcagc

SEQ ID NO: 308452 - DNA, 15 bp, Homo sapiens
aagcgggcagcagca

SEQ ID NO: 308453 - DNA, 15 bp, Homo sapiens
agcgggcagcagcag

SEQ ID NO: 308454 - DNA, 15 bp, Homo sapiens
gcgggcagcagcagc

SEQ ID NO: 308455 - DNA, 15 bp, Homo sapiens
cgggcagcagcagcc

SEQ ID NO: 308456 - DNA, 15 bp, Homo sapiens
gggcagcagcagccg

SEQ ID NO: 308457 - DNA, 15 bp, Homo sapiens
ggcagcagcagccgg

SEQ ID NO: 308458 - DNA, 15 bp, Homo sapiens
gcagcagcagccggc

SEQ ID NO: 308459 - DNA, 15 bp, Homo sapiens
cagcagcagccggcc

SEQ ID NO: 308460 - DNA, 15 bp, Homo sapiens
agcagcagccggccg

SEQ ID NO: 308461 - DNA, 15 bp, Homo sapiens
gcagcagccggccgc

SEQ ID NO: 308462 - DNA, 15 bp, Homo sapiens
cagcagccggccgcg

SEQ ID NO: 308463 - DNA, 15 bp, Homo sapiens
agcagccggccgcgg

SEQ ID NO: 308464 - DNA, 15 bp, Homo sapiens
gcagccggccgcggg

SEQ ID NO: 308465 - DNA, 15 bp, Homo sapiens
cagccggccgcgggc

SEQ ID NO: 308466 - DNA, 15 bp, Homo sapiens
agccggccgcgggct

SEQ ID NO: 308467 - DNA, 15 bp, Homo sapiens
gccggccgcgggctt

SEQ ID NO: 308468 - DNA, 15 bp, Homo sapiens
ccggccgcgggcttt

SEQ ID NO: 308469 - DNA, 15 bp, Homo sapiens
cggccgcgggctttc

SEQ ID NO: 308470 - DNA, 15 bp, Homo sapiens
ggccgcgggctttct

SEQ ID NO: 308471 - DNA, 15 bp, Homo sapiens
gccgcgggctttctc

SEQ ID NO: 308472 - DNA, 15 bp, Homo sapiens
ccgcgggctttctcc

SEQ ID NO: 308473 - DNA, 15 bp, Homo sapiens
cgcgggctttctccc

SEQ ID NO: 308474 - DNA, 15 bp, Homo sapiens
gcgggctttctcccg

SEQ ID NO: 308475 - DNA, 15 bp, Homo sapiens
cgggctttctcccgc

SEQ ID NO: 308476 - DNA, 15 bp, Homo sapiens
gggctttctcccgcc

SEQ ID NO: 308477 - DNA, 15 bp, Homo sapiens
ggctttctcccgccg

SEQ ID NO: 308478 - DNA, 15 bp, Homo sapiens
gctttctcccgccga

SEQ ID NO: 308479 - DNA, 15 bp, Homo sapiens
ctttctcccgccgag

SEQ ID NO: 308480 - DNA, 15 bp, Homo sapiens
tttctcccgccgagg

SEQ ID NO: 308481 - DNA, 15 bp, Homo sapiens
ttctcccgccgaggg

SEQ ID NO: 308482 - DNA, 15 bp, Homo sapiens
tctcccgccgagggg

SEQ ID NO: 308483 - DNA, 15 bp, Homo sapiens
ctcccgccgaggggc

SEQ ID NO: 308484 - DNA, 15 bp, Homo sapiens
tcccgccgaggggcg

SEQ ID NO: 308485 - DNA, 15 bp, Homo sapiens
cccgccgaggggcga

SEQ ID NO: 308486 - DNA, 15 bp, Homo sapiens
ccgccgaggggcgag

SEQ ID NO: 308487 - DNA, 15 bp, Homo sapiens
cgccgaggggcgagg

SEQ ID NO: 308488 - DNA, 15 bp, Homo sapiens
gccgaggggcgagga

SEQ ID NO: 308489 - DNA, 15 bp, Homo sapiens
ccgaggggcgaggag

SEQ ID NO: 308490 - DNA, 15 bp, Homo sapiens
cgaggggcgaggagg

SEQ ID NO: 308491 - DNA, 15 bp, Homo sapiens
gaggggcgaggagga

SEQ ID NO: 308492 - DNA, 15 bp, Homo sapiens
aggggcgaggaggag

SEQ ID NO: 308493 - DNA, 15 bp, Homo sapiens
ggggcgaggaggagc

SEQ ID NO: 308494 - DNA, 15 bp, Homo sapiens
gggcgaggaggagcc

SEQ ID NO: 308495 - DNA, 15 bp, Homo sapiens
ggcgaggaggagcct

SEQ ID NO: 308496 - DNA, 15 bp, Homo sapiens
gcgaggaggagcctc

SEQ ID NO: 308497 - DNA, 15 bp, Homo sapiens
cgaggaggagcctct

SEQ ID NO: 308498 - DNA, 15 bp, Homo sapiens
gaggaggagcctctg

SEQ ID NO: 308499 - DNA, 15 bp, Homo sapiens
aggaggagcctctgg

SEQ ID NO: 308500 - DNA, 15 bp, Homo sapiens
ggaggagcctctggc

SEQ ID NO: 308501 - DNA, 15 bp, Homo sapiens
gaggagcctctggct

SEQ ID NO: 308502 - DNA, 15 bp, Homo sapiens
aggagcctctggctc

SEQ ID NO: 308503 - DNA, 15 bp, Homo sapiens
ggagcctctggctcc

SEQ ID NO: 308504 - DNA, 15 bp, Homo sapiens
gagcctctggctcca

SEQ ID NO: 308505 - DNA, 15 bp, Homo sapiens
agcctctggctccag

SEQ ID NO: 308506 - DNA, 15 bp, Homo sapiens
gcctctggctccaga

SEQ ID NO: 308507 - DNA, 15 bp, Homo sapiens
cctctggctccagaa

SEQ ID NO: 308508 - DNA, 15 bp, Homo sapiens
ctctggctccagaag

SEQ ID NO: 308509 - DNA, 15 bp, Homo sapiens
tctggctccagaagc

SEQ ID NO: 308510 - DNA, 15 bp, Homo sapiens
ctggctccagaagcc

SEQ ID NO: 308511 - DNA, 15 bp, Homo sapiens
tggctccagaagccg

SEQ ID NO: 308512 - DNA, 15 bp, Homo sapiens
ggctccagaagccga

SEQ ID NO: 308513 - DNA, 15 bp, Homo sapiens
gctccagaagccgat

SEQ ID NO: 308514 - DNA, 15 bp, Homo sapiens
ctccagaagccgatt

SEQ ID NO: 308515 - DNA, 15 bp, Homo sapiens
tccagaagccgattg

SEQ ID NO: 308516 - DNA, 15 bp, Homo sapiens
ccagaagccgattgg

SEQ ID NO: 308517 - DNA, 15 bp, Homo sapiens
cagaagccgattggg

SEQ ID NO: 308518 - DNA, 15 bp, Homo sapiens
agaagccgattgggg

SEQ ID NO: 308519 - DNA, 15 bp, Homo sapiens
gaagccgattgggga

SEQ ID NO: 308520 - DNA, 15 bp, Homo sapiens
aagccgattggggaa

SEQ ID NO: 308521 - DNA, 15 bp, Homo sapiens
agccgattggggaat

SEQ ID NO: 308522 - DNA, 15 bp, Homo sapiens
gccgattggggaatc

SEQ ID NO: 308523 - DNA, 15 bp, Homo sapiens
ccgattggggaatca

SEQ ID NO: 308524 - DNA, 15 bp, Homo sapiens
cgattggggaatcac

SEQ ID NO: 308525 - DNA, 15 bp, Homo sapiens
gattggggaatcacg

SEQ ID NO: 308526 - DNA, 15 bp, Homo sapiens
attggggaatcacgg

SEQ ID NO: 308527 - DNA, 15 bp, Homo sapiens
ttggggaatcacggg

SEQ ID NO: 308528 - DNA, 15 bp, Homo sapiens
tggggaatcacgggg

SEQ ID NO: 308529 - DNA, 15 bp, Homo sapiens
ggggaatcacgggga

SEQ ID NO: 308530 - DNA, 15 bp, Homo sapiens
gggaatcacggggag

SEQ ID NO: 308531 - DNA, 15 bp, Homo sapiens
ggaatcacggggagc

SEQ ID NO: 308532 - DNA, 15 bp, Homo sapiens
gaatcacggggagcg

SEQ ID NO: 308533 - DNA, 15 bp, Homo sapiens
aatcacggggagcgg

SEQ ID NO: 308534 - DNA, 15 bp, Homo sapiens
atcacggggagcggc

SEQ ID NO: 308535 - DNA, 15 bp, Homo sapiens
tcacggggagcggcg

SEQ ID NO: 308536 - DNA, 15 bp, Homo sapiens
cacggggagcggcgc

SEQ ID NO: 308537 - DNA, 15 bp, Homo sapiens
acggggagcggcgcc

SEQ ID NO: 308538 - DNA, 15 bp, Homo sapiens
cggggagcggcgccc

SEQ ID NO: 308539 - DNA, 15 bp, Homo sapiens
ggggagcggcgcccc

SEQ ID NO: 308540 - DNA, 15 bp, Homo sapiens
gggagcggcgccccc

SEQ ID NO: 308541 - DNA, 15 bp, Homo sapiens
ggagcggcgcccccc

SEQ ID NO: 308542 - DNA, 15 bp, Homo sapiens
gagcggcgcccccct

SEQ ID NO: 308543 - DNA, 15 bp, Homo sapiens
agcggcgcccccctt

SEQ ID NO: 308544 - DNA, 15 bp, Homo sapiens
gcggcgccccccttc

SEQ ID NO: 308545 - DNA, 15 bp, Homo sapiens
cggcgccccccttct

SEQ ID NO: 308546 - DNA, 15 bp, Homo sapiens
ggcgccccccttctt

SEQ ID NO: 308547 - DNA, 15 bp, Homo sapiens
gcgccccccttcttt

SEQ ID NO: 308548 - DNA, 15 bp, Homo sapiens
cgccccccttctttt

SEQ ID NO: 308549 - DNA, 15 bp, Homo sapiens
gccccccttcttttg

SEQ ID NO: 308550 - DNA, 15 bp, Homo sapiens
ccccccttcttttgg

SEQ ID NO: 308551 - DNA, 15 bp, Homo sapiens
cccccttcttttggg

SEQ ID NO: 308552 - DNA, 15 bp, Homo sapiens
ccccttcttttgggt

SEQ ID NO: 308553 - DNA, 15 bp, Homo sapiens
cccttcttttgggtc

SEQ ID NO: 308554 - DNA, 15 bp, Homo sapiens
ccttcttttgggtca

SEQ ID NO: 308555 - DNA, 15 bp, Homo sapiens
cttcttttgggtcat

SEQ ID NO: 308556 - DNA, 15 bp, Homo sapiens
ttcttttgggtcatt

SEQ ID NO: 308557 - DNA, 15 bp, Homo sapiens
tcttttgggtcattt

SEQ ID NO: 308558 - DNA, 15 bp, Homo sapiens
cttttgggtcatttc

SEQ ID NO: 308559 - DNA, 15 bp, Homo sapiens
ttttgggtcatttct

SEQ ID NO: 308560 - DNA, 15 bp, Homo sapiens
tttgggtcatttctg

SEQ ID NO: 308561 - DNA, 15 bp, Homo sapiens
ttgggtcatttctgc

SEQ ID NO: 308562 - DNA, 15 bp, Homo sapiens
tgggtcatttctgca

SEQ ID NO: 308563 - DNA, 15 bp, Homo sapiens
gggtcatttctgcaa

SEQ ID NO: 308564 - DNA, 15 bp, Homo sapiens
ggtcatttctgcaaa

SEQ ID NO: 308565 - DNA, 15 bp, Homo sapiens
gtcatttctgcaaac

SEQ ID NO: 308566 - DNA, 15 bp, Homo sapiens
tcatttctgcaaacg

SEQ ID NO: 308567 - DNA, 15 bp, Homo sapiens
catttctgcaaacgg

SEQ ID NO: 308568 - DNA, 15 bp, Homo sapiens
atttctgcaaacgga

SEQ ID NO: 308569 - DNA, 15 bp, Homo sapiens
tttctgcaaacggaa

SEQ ID NO: 308570 - DNA, 15 bp, Homo sapiens
ttctgcaaacggaaa

SEQ ID NO: 308571 - DNA, 15 bp, Homo sapiens
tctgcaaacggaaaa

SEQ ID NO: 308572 - DNA, 15 bp, Homo sapiens
ctgcaaacggaaaac

SEQ ID NO: 308573 - DNA, 15 bp, Homo sapiens
tgcaaacggaaaact

SEQ ID NO: 308574 - DNA, 15 bp, Homo sapiens
gcaaacggaaaactc

SEQ ID NO: 308575 - DNA, 15 bp, Homo sapiens
caaacggaaaactct

SEQ ID NO: 308576 - DNA, 15 bp, Homo sapiens
aaacggaaaactctg

SEQ ID NO: 308577 - DNA, 15 bp, Homo sapiens
aacggaaaactctgt

SEQ ID NO: 308578 - DNA, 15 bp, Homo sapiens
acggaaaactctgta

SEQ ID NO: 308579 - DNA, 15 bp, Homo sapiens
cggaaaactctgtag

SEQ ID NO: 308580 - DNA, 15 bp, Homo sapiens
ggaaaactctgtagc

SEQ ID NO: 308581 - DNA, 15 bp, Homo sapiens
gaaaactctgtagcg

SEQ ID NO: 308582 - DNA, 15 bp, Homo sapiens
aaaactctgtagcgt

SEQ ID NO: 308583 - DNA, 15 bp, Homo sapiens
aaactctgtagcgtt

SEQ ID NO: 308584 - DNA, 15 bp, Homo sapiens
aactctgtagcgttt

SEQ ID NO: 308585 - DNA, 15 bp, Homo sapiens
actctgtagcgtttg

SEQ ID NO: 308586 - DNA, 15 bp, Homo sapiens
ctctgtagcgtttgg

SEQ ID NO: 308587 - DNA, 15 bp, Homo sapiens
tctgtagcgtttggc

SEQ ID NO: 308588 - DNA, 15 bp, Homo sapiens
ctgtagcgtttggca

SEQ ID NO: 308589 - DNA, 15 bp, Homo sapiens
tgtagcgtttggcaa

SEQ ID NO: 308590 - DNA, 15 bp, Homo sapiens
gtagcgtttggcaaa

SEQ ID NO: 308591 - DNA, 15 bp, Homo sapiens
tagcgtttggcaaag

SEQ ID NO: 308592 - DNA, 15 bp, Homo sapiens
agcgtttggcaaagt

SEQ ID NO: 308593 - DNA, 15 bp, Homo sapiens
gcgtttggcaaagtt

SEQ ID NO: 308594 - DNA, 15 bp, Homo sapiens
cgtttggcaaagttg

SEQ ID NO: 308595 - DNA, 15 bp, Homo sapiens
gtttggcaaagttgg

SEQ ID NO: 308596 - DNA, 15 bp, Homo sapiens
tttggcaaagttggt

SEQ ID NO: 308597 - DNA, 15 bp, Homo sapiens
ttggcaaagttggtg

SEQ ID NO: 308598 - DNA, 15 bp, Homo sapiens
tggcaaagttggtgc

SEQ ID NO: 308599 - DNA, 15 bp, Homo sapiens
ggcaaagttggtgcc

SEQ ID NO: 308600 - DNA, 15 bp, Homo sapiens
gcaaagttggtgcct

SEQ ID NO: 308601 - DNA, 15 bp, Homo sapiens
caaagttggtgcctg

SEQ ID NO: 308602 - DNA, 15 bp, Homo sapiens
aaagttggtgcctgc

SEQ ID NO: 308603 - DNA, 15 bp, Homo sapiens
aagttggtgcctgcg

SEQ ID NO: 308604 - DNA, 15 bp, Homo sapiens
agttggtgcctgcgc

SEQ ID NO: 308605 - DNA, 15 bp, Homo sapiens
gttggtgcctgcgcg

SEQ ID NO: 308606 - DNA, 15 bp, Homo sapiens
ttggtgcctgcgcgc

SEQ ID NO: 308607 - DNA, 15 bp, Homo sapiens
tggtgcctgcgcgcc

SEQ ID NO: 308608 - DNA, 15 bp, Homo sapiens
ggtgcctgcgcgccc

SEQ ID NO: 308609 - DNA, 15 bp, Homo sapiens
gtgcctgcgcgcccc

SEQ ID NO: 308610 - DNA, 15 bp, Homo sapiens
tgcctgcgcgcccct

SEQ ID NO: 308611 - DNA, 15 bp, Homo sapiens
gcctgcgcgcccctt

SEQ ID NO: 308612 - DNA, 15 bp, Homo sapiens
cctgcgcgccccttc

SEQ ID NO: 308613 - DNA, 15 bp, Homo sapiens
ctgcgcgccccttcc

SEQ ID NO: 308614 - DNA, 15 bp, Homo sapiens
tgcgcgccccttcca

SEQ ID NO: 308615 - DNA, 15 bp, Homo sapiens
gcgcgccccttccag

SEQ ID NO: 308616 - DNA, 15 bp, Homo sapiens
cgcgccccttccagg

SEQ ID NO: 308617 - DNA, 15 bp, Homo sapiens
gcgccccttccaggt

SEQ ID NO: 308618 - DNA, 15 bp, Homo sapiens
cgccccttccaggtt

SEQ ID NO: 308619 - DNA, 15 bp, Homo sapiens
gccccttccaggttt

SEQ ID NO: 308620 - DNA, 15 bp, Homo sapiens
ccccttccaggtttg

SEQ ID NO: 308621 - DNA, 15 bp, Homo sapiens
cccttccaggtttgc

SEQ ID NO: 308622 - DNA, 15 bp, Homo sapiens
ccttccaggtttgcg

SEQ ID NO: 308623 - DNA, 15 bp, Homo sapiens
cttccaggtttgcgc

SEQ ID NO: 308624 - DNA, 15 bp, Homo sapiens
ttccaggtttgcgct

SEQ ID NO: 308625 - DNA, 15 bp, Homo sapiens
tccaggtttgcgctt

SEQ ID NO: 308626 - DNA, 15 bp, Homo sapiens
ccaggtttgcgcttt

SEQ ID NO: 308627 - DNA, 15 bp, Homo sapiens
caggtttgcgctttg

SEQ ID NO: 308628 - DNA, 15 bp, Homo sapiens
aggtttgcgctttga

SEQ ID NO: 308629 - DNA, 15 bp, Homo sapiens
ggtttgcgctttgac

SEQ ID NO: 308630 - DNA, 15 bp, Homo sapiens
gtttgcgctttgact

SEQ ID NO: 308631 - DNA, 15 bp, Homo sapiens
tttgcgctttgactg

SEQ ID NO: 308632 - DNA, 15 bp, Homo sapiens
ttgcgctttgactgt

SEQ ID NO: 308633 - DNA, 15 bp, Homo sapiens
tgcgctttgactgtt

SEQ ID NO: 308634 - DNA, 15 bp, Homo sapiens
gcgctttgactgttt

SEQ ID NO: 308635 - DNA, 15 bp, Homo sapiens
cgctttgactgtttt

SEQ ID NO: 308636 - DNA, 15 bp, Homo sapiens
gctttgactgttttg

SEQ ID NO: 308637 - DNA, 15 bp, Homo sapiens
ctttgactgttttgt

SEQ ID NO: 308638 - DNA, 15 bp, Homo sapiens
tttgactgttttgtt

SEQ ID NO: 308639 - DNA, 15 bp, Homo sapiens
ttgactgttttgttt

SEQ ID NO: 308640 - DNA, 15 bp, Homo sapiens
tgactgttttgtttt

SEQ ID NO: 308641 - DNA, 15 bp, Homo sapiens
gactgttttgttttt

SEQ ID NO: 308642 - DNA, 15 bp, Homo sapiens
actgttttgtttttg

SEQ ID NO: 308643 - DNA, 15 bp, Homo sapiens
ctgttttgtttttgg

SEQ ID NO: 308644 - DNA, 15 bp, Homo sapiens
tgttttgtttttggc

SEQ ID NO: 308645 - DNA, 15 bp, Homo sapiens
gttttgtttttggcg

SEQ ID NO: 308646 - DNA, 15 bp, Homo sapiens
ttttgtttttggcgg

SEQ ID NO: 308647 - DNA, 15 bp, Homo sapiens
tttgtttttggcgga

SEQ ID NO: 308648 - DNA, 15 bp, Homo sapiens
ttgtttttggcggaa

SEQ ID NO: 308649 - DNA, 15 bp, Homo sapiens
tgtttttggcggaac

SEQ ID NO: 308650 - DNA, 15 bp, Homo sapiens
gtttttggcggaact

SEQ ID NO: 308651 - DNA, 15 bp, Homo sapiens
tttttggcggaacta

SEQ ID NO: 308652 - DNA, 15 bp, Homo sapiens
ttttggcggaactac

SEQ ID NO: 308653 - DNA, 15 bp, Homo sapiens
tttggcggaactacc

SEQ ID NO: 308654 - DNA, 15 bp, Homo sapiens
ttggcggaactacca

SEQ ID NO: 308655 - DNA, 15 bp, Homo sapiens
tggcggaactaccag

SEQ ID NO: 308656 - DNA, 15 bp, Homo sapiens
ggcggaactaccagg

SEQ ID NO: 308657 - DNA, 15 bp, Homo sapiens
gcggaactaccaggc

SEQ ID NO: 308658 - DNA, 15 bp, Homo sapiens
cggaactaccaggca

SEQ ID NO: 308659 - DNA, 15 bp, Homo sapiens
ggaactaccaggcag

SEQ ID NO: 308660 - DNA, 15 bp, Homo sapiens
gaactaccaggcagg

SEQ ID NO: 308661 - DNA, 15 bp, Homo sapiens
aactaccaggcagga

SEQ ID NO: 308662 - DNA, 15 bp, Homo sapiens
actaccaggcaggaa

SEQ ID NO: 308663 - DNA, 15 bp, Homo sapiens
ctaccaggcaggaag

SEQ ID NO: 308664 - DNA, 15 bp, Homo sapiens
taccaggcaggaaga

SEQ ID NO: 308665 - DNA, 15 bp, Homo sapiens
accaggcaggaagat

SEQ ID NO: 308666 - DNA, 15 bp, Homo sapiens
ccaggcaggaagatt

SEQ ID NO: 308667 - DNA, 15 bp, Homo sapiens
caggcaggaagattg

SEQ ID NO: 308668 - DNA, 15 bp, Homo sapiens
aggcaggaagattgc

SEQ ID NO: 308669 - DNA, 15 bp, Homo sapiens
ggcaggaagattgca

SEQ ID NO: 308670 - DNA, 15 bp, Homo sapiens
gcaggaagattgcac

SEQ ID NO: 308671 - DNA, 15 bp, Homo sapiens
caggaagattgcaca

SEQ ID NO: 308672 - DNA, 15 bp, Homo sapiens
aggaagattgcacaa

SEQ ID NO: 308673 - DNA, 15 bp, Homo sapiens
ggaagattgcacaag

SEQ ID NO: 308674 - DNA, 15 bp, Homo sapiens
gaagattgcacaagt

SEQ ID NO: 308675 - DNA, 15 bp, Homo sapiens
aagattgcacaagta

SEQ ID NO: 308676 - DNA, 15 bp, Homo sapiens
agattgcacaagtaa

SEQ ID NO: 308677 - DNA, 15 bp, Homo sapiens
gattgcacaagtaag

SEQ ID NO: 308678 - DNA, 15 bp, Homo sapiens
attgcacaagtaagg

SEQ ID NO: 308679 - DNA, 15 bp, Homo sapiens
ttgcacaagtaaggg

SEQ ID NO: 308680 - DNA, 15 bp, Homo sapiens
tgcacaagtaagggg

SEQ ID NO: 308681 - DNA, 15 bp, Homo sapiens
gcacaagtaaggggc

SEQ ID NO: 308682 - DNA, 15 bp, Homo sapiens
cacaagtaaggggcg

SEQ ID NO: 308683 - DNA, 15 bp, Homo sapiens
acaagtaaggggcgt

SEQ ID NO: 308684 - DNA, 15 bp, Homo sapiens
caagtaaggggcgtt

SEQ ID NO: 308685 - DNA, 15 bp, Homo sapiens
aagtaaggggcgttt

SEQ ID NO: 308686 - DNA, 15 bp, Homo sapiens
agtaaggggcgtttt

SEQ ID NO: 308687 - DNA, 15 bp, Homo sapiens
gtaaggggcgttttc

SEQ ID NO: 308688 - DNA, 15 bp, Homo sapiens
taaggggcgttttca

SEQ ID NO: 308689 - DNA, 15 bp, Homo sapiens
aaggggcgttttcag

SEQ ID NO: 308690 - DNA, 15 bp, Homo sapiens
aggggcgttttcagt

SEQ ID NO: 308691 - DNA, 15 bp, Homo sapiens
ggggcgttttcagtc

SEQ ID NO: 308692 - DNA, 15 bp, Homo sapiens
gggcgttttcagtcg

SEQ ID NO: 308693 - DNA, 15 bp, Homo sapiens
ggcgttttcagtcgg

SEQ ID NO: 308694 - DNA, 15 bp, Homo sapiens
gcgttttcagtcggg

SEQ ID NO: 308695 - DNA, 15 bp, Homo sapiens
cgttttcagtcgggt

SEQ ID NO: 308696 - DNA, 15 bp, Homo sapiens
gttttcagtcgggtg

SEQ ID NO: 308697 - DNA, 15 bp, Homo sapiens
ttttcagtcgggtgt

SEQ ID NO: 308698 - DNA, 15 bp, Homo sapiens
tttcagtcgggtgtc

SEQ ID NO: 308699 - DNA, 15 bp, Homo sapiens
ttcagtcgggtgtca

SEQ ID NO: 308700 - DNA, 15 bp, Homo sapiens
tcagtcgggtgtcaa

SEQ ID NO: 308701 - DNA, 15 bp, Homo sapiens
cagtcgggtgtcaat

SEQ ID NO: 308702 - DNA, 15 bp, Homo sapiens
agtcgggtgtcaatt

SEQ ID NO: 308703 - DNA, 15 bp, Homo sapiens
gtcgggtgtcaattt

SEQ ID NO: 308704 - DNA, 15 bp, Homo sapiens
tcgggtgtcaatttc

SEQ ID NO: 308705 - DNA, 15 bp, Homo sapiens
cgggtgtcaatttct

SEQ ID NO: 308706 - DNA, 15 bp, Homo sapiens
gggtgtcaatttctc

SEQ ID NO: 308707 - DNA, 15 bp, Homo sapiens
ggtgtcaatttctct

SEQ ID NO: 308708 - DNA, 15 bp, Homo sapiens
gtgtcaatttctctt

SEQ ID NO: 308709 - DNA, 15 bp, Homo sapiens
tgtcaatttctcttt

SEQ ID NO: 308710 - DNA, 15 bp, Homo sapiens
gtcaatttctctttc

SEQ ID NO: 308711 - DNA, 15 bp, Homo sapiens
tcaatttctctttct

SEQ ID NO: 308712 - DNA, 15 bp, Homo sapiens
caatttctctttctt

SEQ ID NO: 308713 - DNA, 15 bp, Homo sapiens
aatttctctttcttt

SEQ ID NO: 308714 - DNA, 15 bp, Homo sapiens
atttctctttctttc

SEQ ID NO: 308715 - DNA, 15 bp, Homo sapiens
tttctctttctttct

SEQ ID NO: 308716 - DNA, 15 bp, Homo sapiens
ttctctttctttctt

SEQ ID NO: 308717 - DNA, 15 bp, Homo sapiens
ctttctttctttctt

SEQ ID NO: 308718 - DNA, 15 bp, Homo sapiens
tttctttctttcttt

SEQ ID NO: 308719 - DNA, 15 bp, Homo sapiens
ttctttctttctttt

SEQ ID NO: 308720 - DNA, 15 bp, Homo sapiens
tctttctttcttttt

SEQ ID NO: 308721 - DNA, 15 bp, Homo sapiens
ctttctttctttttt

SEQ ID NO: 308722 - DNA, 15 bp, Homo sapiens
tttctttcttttttt

SEQ ID NO: 308723 - DNA, 15 bp, Homo sapiens
ttctttcttttttta

SEQ ID NO: 308724 - DNA, 15 bp, Homo sapiens
tctttctttttttaa

SEQ ID NO: 308725 - DNA, 15 bp, Homo sapiens
ctttctttttttaaa

SEQ ID NO: 308726 - DNA, 15 bp, Homo sapiens
ttctttttttaaaat

SEQ ID NO: 308727 - DNA, 15 bp, Homo sapiens
tctttttttaaaatt

SEQ ID NO: 308728 - DNA, 15 bp, Homo sapiens
ctttttttaaaattt

SEQ ID NO: 308729 - DNA, 15 bp, Homo sapiens
tttttttaaaatttc

SEQ ID NO: 308730 - DNA, 15 bp, Homo sapiens
ttttttaaaatttcg

SEQ ID NO: 308731 - DNA, 15 bp, Homo sapiens
tttttaaaatttcgg

SEQ ID NO: 308732 - DNA, 15 bp, Homo sapiens
ttttaaaatttcggt

SEQ ID NO: 308733 - DNA, 15 bp, Homo sapiens
tttaaaatttcggtt

SEQ ID NO: 308734 - DNA, 15 bp, Homo sapiens
ttaaaatttcggttc

SEQ ID NO: 308735 - DNA, 15 bp, Homo sapiens
taaaatttcggttcg

SEQ ID NO: 308736 - DNA, 15 bp, Homo sapiens
aaaatttcggttcgt

SEQ ID NO: 308737 - DNA, 15 bp, Homo sapiens
aaatttcggttcgtg

SEQ ID NO: 308738 - DNA, 15 bp, Homo sapiens
aatttcggttcgtgt

SEQ ID NO: 308739 - DNA, 15 bp, Homo sapiens
atttcggttcgtgtc

SEQ ID NO: 308740 - DNA, 15 bp, Homo sapiens
tttcggttcgtgtct

SEQ ID NO: 308741 - DNA, 15 bp, Homo sapiens
ttcggttcgtgtctg

SEQ ID NO: 308742 - DNA, 15 bp, Homo sapiens
tcggttcgtgtctgc

SEQ ID NO: 308743 - DNA, 15 bp, Homo sapiens
cggttcgtgtctgct

SEQ ID NO: 308744 - DNA, 15 bp, Homo sapiens
ggttcgtgtctgctt

SEQ ID NO: 308745 - DNA, 15 bp, Homo sapiens
gttcgtgtctgcttc

SEQ ID NO: 308746 - DNA, 15 bp, Homo sapiens
ttcgtgtctgcttct

SEQ ID NO: 308747 - DNA, 15 bp, Homo sapiens
tcgtgtctgcttctc

SEQ ID NO: 308748 - DNA, 15 bp, Homo sapiens
cgtgtctgcttctcc

SEQ ID NO: 308749 - DNA, 15 bp, Homo sapiens
gtgtctgcttctcca

SEQ ID NO: 308750 - DNA, 15 bp, Homo sapiens
tgtctgcttctccaa

SEQ ID NO: 308751 - DNA, 15 bp, Homo sapiens
gtctgcttctccaag

SEQ ID NO: 308752 - DNA, 15 bp, Homo sapiens
tctgcttctccaagc

SEQ ID NO: 308753 - DNA, 15 bp, Homo sapiens
ctgcttctccaagct

SEQ ID NO: 308754 - DNA, 15 bp, Homo sapiens
tgcttctccaagctt

SEQ ID NO: 308755 - DNA, 15 bp, Homo sapiens
gcttctccaagcttt

SEQ ID NO: 308756 - DNA, 15 bp, Homo sapiens
cttctccaagcttta

SEQ ID NO: 308757 - DNA, 15 bp, Homo sapiens
ttctccaagctttat

SEQ ID NO: 308758 - DNA, 15 bp, Homo sapiens
tctccaagctttatt

SEQ ID NO: 308759 - DNA, 15 bp, Homo sapiens
ctccaagctttattt

SEQ ID NO: 308760 - DNA, 15 bp, Homo sapiens
tccaagctttatttt

SEQ ID NO: 308761 - DNA, 15 bp, Homo sapiens
ccaagctttattttt

SEQ ID NO: 308762 - DNA, 15 bp, Homo sapiens
caagctttatttttt

SEQ ID NO: 308763 - DNA, 15 bp, Homo sapiens
aagctttattttttt

SEQ ID NO: 308764 - DNA, 15 bp, Homo sapiens
agctttatttttttt

SEQ ID NO: 308765 - DNA, 15 bp, Homo sapiens
gctttattttttttt

SEQ ID NO: 308766 - DNA, 15 bp, Homo sapiens
ctttatttttttttt

SEQ ID NO: 308767 - DNA, 15 bp, Homo sapiens
tttattttttttttt

SEQ ID NO: 308768 - DNA, 15 bp, Homo sapiens
ttattttttttttta

SEQ ID NO: 308769 - DNA, 15 bp, Homo sapiens
tatttttttttttaa

SEQ ID NO: 308770 - DNA, 15 bp, Homo sapiens
atttttttttttaaa

SEQ ID NO: 308771 - DNA, 15 bp, Homo sapiens
ttttttttttaaata

SEQ ID NO: 308772 - DNA, 15 bp, Homo sapiens
tttttttttaaatac

SEQ ID NO: 308773 - DNA, 15 bp, Homo sapiens
ttttttttaaataca

SEQ ID NO: 308774 - DNA, 15 bp, Homo sapiens
tttttttaaatacat

SEQ ID NO: 308775 - DNA, 15 bp, Homo sapiens
ttttttaaatacatc

SEQ ID NO: 308776 - DNA, 15 bp, Homo sapiens
tttttaaatacatcg

SEQ ID NO: 308777 - DNA, 15 bp, Homo sapiens
ttttaaatacatcgc

SEQ ID NO: 308778 - DNA, 15 bp, Homo sapiens
tttaaatacatcgca

SEQ ID NO: 308779 - DNA, 15 bp, Homo sapiens
ttaaatacatcgcac

SEQ ID NO: 308780 - DNA, 15 bp, Homo sapiens
taaatacatcgcacc

SEQ ID NO: 308781 - DNA, 15 bp, Homo sapiens
aaatacatcgcacca

SEQ ID NO: 308782 - DNA, 15 bp, Homo sapiens
aatacatcgcaccac

SEQ ID NO: 308783 - DNA, 15 bp, Homo sapiens
atacatcgcaccacc

SEQ ID NO: 308784 - DNA, 15 bp, Homo sapiens
tacatcgcaccacca

SEQ ID NO: 308785 - DNA, 15 bp, Homo sapiens
acatcgcaccaccaa

SEQ ID NO: 308786 - DNA, 15 bp, Homo sapiens
catcgcaccaccaaa

SEQ ID NO: 308787 - DNA, 15 bp, Homo sapiens
atcgcaccaccaaac

SEQ ID NO: 308788 - DNA, 15 bp, Homo sapiens
tcgcaccaccaaact

SEQ ID NO: 308789 - DNA, 15 bp, Homo sapiens
cgcaccaccaaacta

SEQ ID NO: 308790 - DNA, 15 bp, Homo sapiens
gcaccaccaaactaa

SEQ ID NO: 308791 - DNA, 15 bp, Homo sapiens
caccaccaaactaac

SEQ ID NO: 308792 - DNA, 15 bp, Homo sapiens
accaccaaactaaca

SEQ ID NO: 308793 - DNA, 15 bp, Homo sapiens
ccaccaaactaacac

SEQ ID NO: 308794 - DNA, 15 bp, Homo sapiens
caccaaactaacact

SEQ ID NO: 308795 - DNA, 15 bp, Homo sapiens
accaaactaacactc

SEQ ID NO: 308796 - DNA, 15 bp, Homo sapiens
ccaaactaacactcg

SEQ ID NO: 308797 - DNA, 15 bp, Homo sapiens
caaactaacactcgc

SEQ ID NO: 308798 - DNA, 15 bp, Homo sapiens
aaactaacactcgca

SEQ ID NO: 308799 - DNA, 15 bp, Homo sapiens
aactaacactcgcac

SEQ ID NO: 308800 - DNA, 15 bp, Homo sapiens
actaacactcgcaca

SEQ ID NO: 308801 - DNA, 15 bp, Homo sapiens
ctaacactcgcacac

SEQ ID NO: 308802 - DNA, 15 bp, Homo sapiens
taacactcgcacaca

SEQ ID NO: 308803 - DNA, 15 bp, Homo sapiens
aacactcgcacacac

SEQ ID NO: 308804 - DNA, 15 bp, Homo sapiens
acactcgcacacacc

SEQ ID NO: 308805 - DNA, 15 bp, Homo sapiens
cactcgcacacaccc

SEQ ID NO: 308806 - DNA, 15 bp, Homo sapiens
actcgcacacacccc

SEQ ID NO: 308807 - DNA, 15 bp, Homo sapiens
ctcgcacacaccccc

SEQ ID NO: 308808 - DNA, 15 bp, Homo sapiens
tcgcacacacccccg

SEQ ID NO: 308809 - DNA, 15 bp, Homo sapiens
cgcacacacccccgc

SEQ ID NO: 308810 - DNA, 15 bp, Homo sapiens
gcacacacccccgcg

SEQ ID NO: 308811 - DNA, 15 bp, Homo sapiens
cacacacccccgcgg

SEQ ID NO: 308812 - DNA, 15 bp, Homo sapiens
acacacccccgcggt

SEQ ID NO: 308813 - DNA, 15 bp, Homo sapiens
cacacccccgcggtt

SEQ ID NO: 308814 - DNA, 15 bp, Homo sapiens
acacccccgcggtta

SEQ ID NO: 308815 - DNA, 15 bp, Homo sapiens
cacccccgcggttac

SEQ ID NO: 308816 - DNA, 15 bp, Homo sapiens
acccccgcggttact

SEQ ID NO: 308817 - DNA, 15 bp, Homo sapiens
cccccgcggttactc

SEQ ID NO: 308818 - DNA, 15 bp, Homo sapiens
ccccgcggttactcc

SEQ ID NO: 308819 - DNA, 15 bp, Homo sapiens
cccgcggttactccg

SEQ ID NO: 308820 - DNA, 15 bp, Homo sapiens
ccgcggttactccgt

SEQ ID NO: 308821 - DNA, 15 bp, Homo sapiens
cgcggttactccgtg

SEQ ID NO: 308822 - DNA, 15 bp, Homo sapiens
gcggttactccgtgt

SEQ ID NO: 308823 - DNA, 15 bp, Homo sapiens
cggttactccgtgtc

SEQ ID NO: 308824 - DNA, 15 bp, Homo sapiens
ggttactccgtgtca

SEQ ID NO: 308825 - DNA, 15 bp, Homo sapiens
gttactccgtgtcaa

SEQ ID NO: 308826 - DNA, 15 bp, Homo sapiens
ttactccgtgtcaaa

SEQ ID NO: 308827 - DNA, 15 bp, Homo sapiens
tactccgtgtcaaac

SEQ ID NO: 308828 - DNA, 15 bp, Homo sapiens
actccgtgtcaaact

SEQ ID NO: 308829 - DNA, 15 bp, Homo sapiens
ctccgtgtcaaactc

SEQ ID NO: 308830 - DNA, 15 bp, Homo sapiens
tccgtgtcaaactcc

SEQ ID NO: 308831 - DNA, 15 bp, Homo sapiens
ccgtgtcaaactcct

SEQ ID NO: 308832 - DNA, 15 bp, Homo sapiens
cgtgtcaaactccta

SEQ ID NO: 308833 - DNA, 15 bp, Homo sapiens
gtgtcaaactcctag

SEQ ID NO: 308834 - DNA, 15 bp, Homo sapiens
tgtcaaactcctaga

SEQ ID NO: 308835 - DNA, 15 bp, Homo sapiens
gtcaaactcctagag

SEQ ID NO: 308836 - DNA, 15 bp, Homo sapiens
tcaaactcctagagg

SEQ ID NO: 308837 - DNA, 15 bp, Homo sapiens
caaactcctagagga

SEQ ID NO: 308838 - DNA, 15 bp, Homo sapiens
aaactcctagaggag

SEQ ID NO: 308839 - DNA, 15 bp, Homo sapiens
aactcctagaggagc

SEQ ID NO: 308840 - DNA, 15 bp, Homo sapiens
actcctagaggagcc

SEQ ID NO: 308841 - DNA, 15 bp, Homo sapiens
ctcctagaggagccc

SEQ ID NO: 308842 - DNA, 15 bp, Homo sapiens
tcctagaggagccct

SEQ ID NO: 308843 - DNA, 15 bp, Homo sapiens
cctagaggagccctt

SEQ ID NO: 308844 - DNA, 15 bp, Homo sapiens
ctagaggagcccttg

SEQ ID NO: 308845 - DNA, 15 bp, Homo sapiens
tagaggagcccttgg

SEQ ID NO: 308846 - DNA, 15 bp, Homo sapiens
agaggagcccttggc

SEQ ID NO: 308847 - DNA, 15 bp, Homo sapiens
gaggagcccttggcc

SEQ ID NO: 308848 - DNA, 15 bp, Homo sapiens
aggagcccttggcca

SEQ ID NO: 308849 - DNA, 15 bp, Homo sapiens
ggagcccttggccag

SEQ ID NO: 308850 - DNA, 15 bp, Homo sapiens
gagcccttggccagc

SEQ ID NO: 308851 - DNA, 15 bp, Homo sapiens
agcccttggccagct

SEQ ID NO: 308852 - DNA, 15 bp, Homo sapiens
gcccttggccagctc

SEQ ID NO: 308853 - DNA, 15 bp, Homo sapiens
cccttggccagctcg

SEQ ID NO: 308854 - DNA, 15 bp, Homo sapiens
ccttggccagctcgg

SEQ ID NO: 308855 - DNA, 15 bp, Homo sapiens
cttggccagctcggg

SEQ ID NO: 308856 - DNA, 15 bp, Homo sapiens
ttggccagctcgggg

SEQ ID NO: 308857 - DNA, 15 bp, Homo sapiens
tggccagctcggggt

SEQ ID NO: 308858 - DNA, 15 bp, Homo sapiens
ggccagctcggggtg

SEQ ID NO: 308859 - DNA, 15 bp, Homo sapiens
gccagctcggggtgc

SEQ ID NO: 308860 - DNA, 15 bp, Homo sapiens
ccagctcggggtgcg

SEQ ID NO: 308861 - DNA, 15 bp, Homo sapiens
cagctcggggtgcgg

SEQ ID NO: 308862 - DNA, 15 bp, Homo sapiens
agctcggggtgcggc

SEQ ID NO: 308863 - DNA, 15 bp, Homo sapiens
gctcggggtgcggcg

SEQ ID NO: 308864 - DNA, 15 bp, Homo sapiens
ctcggggtgcggcgg

SEQ ID NO: 308865 - DNA, 15 bp, Homo sapiens
tcggggtgcggcggt

SEQ ID NO: 308866 - DNA, 15 bp, Homo sapiens
cggggtgcggcggtg

SEQ ID NO: 308867 - DNA, 15 bp, Homo sapiens
ggggtgcggcggtgg

SEQ ID NO: 308868 - DNA, 15 bp, Homo sapiens
gggtgcggcggtggc

SEQ ID NO: 308869 - DNA, 15 bp, Homo sapiens
ggtgcggcggtggcg

SEQ ID NO: 308870 - DNA, 15 bp, Homo sapiens
gtgcggcggtggcga

SEQ ID NO: 308871 - DNA, 15 bp, Homo sapiens
tgcggcggtggcgac

SEQ ID NO: 308872 - DNA, 15 bp, Homo sapiens
gcggcggtggcgacc

SEQ ID NO: 308873 - DNA, 15 bp, Homo sapiens
cggcggtggcgaccg

SEQ ID NO: 308874 - DNA, 15 bp, Homo sapiens
ggcggtggcgaccgg

SEQ ID NO: 308875 - DNA, 15 bp, Homo sapiens
gcggtggcgaccggc

SEQ ID NO: 308876 - DNA, 15 bp, Homo sapiens
cggtggcgaccggca

SEQ ID NO: 308877 - DNA, 15 bp, Homo sapiens
ggtggcgaccggcag

SEQ ID NO: 308878 - DNA, 15 bp, Homo sapiens
gtggcgaccggcagg

SEQ ID NO: 308879 - DNA, 15 bp, Homo sapiens
tggcgaccggcaggc

SEQ ID NO: 308880 - DNA, 15 bp, Homo sapiens
ggcgaccggcaggcg

SEQ ID NO: 308881 - DNA, 15 bp, Homo sapiens
gcgaccggcaggcga

SEQ ID NO: 308882 - DNA, 15 bp, Homo sapiens
cgaccggcaggcgag

SEQ ID NO: 308883 - DNA, 15 bp, Homo sapiens
gaccggcaggcgagg

SEQ ID NO: 308884 - DNA, 15 bp, Homo sapiens
accggcaggcgagga

SEQ ID NO: 308885 - DNA, 15 bp, Homo sapiens
ccggcaggcgaggag

SEQ ID NO: 308886 - DNA, 15 bp, Homo sapiens
cggcaggcgaggagg

SEQ ID NO: 308887 - DNA, 15 bp, Homo sapiens
ggcaggcgaggaggc

SEQ ID NO: 308888 - DNA, 15 bp, Homo sapiens
gcaggcgaggaggcc

SEQ ID NO: 308889 - DNA, 15 bp, Homo sapiens
caggcgaggaggccc

SEQ ID NO: 308890 - DNA, 15 bp, Homo sapiens
aggcgaggaggcccg

SEQ ID NO: 308891 - DNA, 15 bp, Homo sapiens
ggcgaggaggcccgc

SEQ ID NO: 308892 - DNA, 15 bp, Homo sapiens
gcgaggaggcccgcg

SEQ ID NO: 308893 - DNA, 15 bp, Homo sapiens
cgaggaggcccgcgg

SEQ ID NO: 308894 - DNA, 15 bp, Homo sapiens
gaggaggcccgcggg

SEQ ID NO: 308895 - DNA, 15 bp, Homo sapiens
aggaggcccgcgggc

SEQ ID NO: 308896 - DNA, 15 bp, Homo sapiens
ggaggcccgcgggca

SEQ ID NO: 308897 - DNA, 15 bp, Homo sapiens
gaggcccgcgggcag

SEQ ID NO: 308898 - DNA, 15 bp, Homo sapiens
aggcccgcgggcagc

SEQ ID NO: 308899 - DNA, 15 bp, Homo sapiens
ggcccgcgggcagca

SEQ ID NO: 308900 - DNA, 15 bp, Homo sapiens
gcccgcgggcagcag

SEQ ID NO: 308901 - DNA, 15 bp, Homo sapiens
cccgcgggcagcagg

SEQ ID NO: 308902 - DNA, 15 bp, Homo sapiens
ccgcgggcagcaggt

SEQ ID NO: 308903 - DNA, 15 bp, Homo sapiens
cgcgggcagcaggta

SEQ ID NO: 308904 - DNA, 15 bp, Homo sapiens
gcgggcagcaggtaa

SEQ ID NO: 308905 - DNA, 15 bp, Homo sapiens
cgggcagcaggtaag

SEQ ID NO: 308906 - DNA, 15 bp, Homo sapiens
gggcagcaggtaagc

SEQ ID NO: 308907 - DNA, 15 bp, Homo sapiens
ggcagcaggtaagcc

SEQ ID NO: 308908 - DNA, 15 bp, Homo sapiens
gcagcaggtaagccc

SEQ ID NO: 308909 - DNA, 15 bp, Homo sapiens
cagcaggtaagccca

SEQ ID NO: 308910 - DNA, 15 bp, Homo sapiens
agcaggtaagcccat

SEQ ID NO: 308911 - DNA, 15 bp, Homo sapiens
gcaggtaagcccatg

SEQ ID NO: 308912 - DNA, 15 bp, Homo sapiens
caggtaagcccatgc

SEQ ID NO: 308913 - DNA, 15 bp, Homo sapiens
aggtaagcccatgca

SEQ ID NO: 308914 - DNA, 15 bp, Homo sapiens
ggtaagcccatgcat

SEQ ID NO: 308915 - DNA, 15 bp, Homo sapiens
gtaagcccatgcatt

SEQ ID NO: 308916 - DNA, 15 bp, Homo sapiens
taagcccatgcatta

SEQ ID NO: 308917 - DNA, 15 bp, Homo sapiens
aagcccatgcattat

SEQ ID NO: 308918 - DNA, 15 bp, Homo sapiens
agcccatgcattatt

SEQ ID NO: 308919 - DNA, 15 bp, Homo sapiens
gcccatgcattattg

SEQ ID NO: 308920 - DNA, 15 bp, Homo sapiens
cccatgcattattga

SEQ ID NO: 308921 - DNA, 15 bp, Homo sapiens
ccatgcattattgaa

SEQ ID NO: 308922 - DNA, 15 bp, Homo sapiens
catgcattattgaag

SEQ ID NO: 308923 - DNA, 15 bp, Homo sapiens
atgcattattgaagc

SEQ ID NO: 308924 - DNA, 15 bp, Homo sapiens
tgcattattgaagcc

SEQ ID NO: 308925 - DNA, 15 bp, Homo sapiens
gcattattgaagcct

SEQ ID NO: 308926 - DNA, 15 bp, Homo sapiens
cattattgaagcctc

SEQ ID NO: 308927 - DNA, 15 bp, Homo sapiens
attattgaagcctcg

SEQ ID NO: 308928 - DNA, 15 bp, Homo sapiens
ttattgaagcctcgg

SEQ ID NO: 308929 - DNA, 15 bp, Homo sapiens
tattgaagcctcggg

SEQ ID NO: 308930 - DNA, 15 bp, Homo sapiens
attgaagcctcgggc

SEQ ID NO: 308931 - DNA, 15 bp, Homo sapiens
ttgaagcctcgggct

SEQ ID NO: 308932 - DNA, 15 bp, Homo sapiens
tgaagcctcgggctg

SEQ ID NO: 308933 - DNA, 15 bp, Homo sapiens
gaagcctcgggctgg

SEQ ID NO: 308934 - DNA, 15 bp, Homo sapiens
aagcctcgggctggt

SEQ ID NO: 308935 - DNA, 15 bp, Homo sapiens
agcctcgggctggta

SEQ ID NO: 308936 - DNA, 15 bp, Homo sapiens
gcctcgggctggtaa

SEQ ID NO: 308937 - DNA, 15 bp, Homo sapiens
cctcgggctggtaat

SEQ ID NO: 308938 - DNA, 15 bp, Homo sapiens
ctcgggctggtaatg

SEQ ID NO: 308939 - DNA, 15 bp, Homo sapiens
tcgggctggtaatgt

SEQ ID NO: 308940 - DNA, 15 bp, Homo sapiens
cgggctggtaatgtg

SEQ ID NO: 308941 - DNA, 15 bp, Homo sapiens
gggctggtaatgtga

SEQ ID NO: 308942 - DNA, 15 bp, Homo sapiens
ggctggtaatgtgac

SEQ ID NO: 308943 - DNA, 15 bp, Homo sapiens
gctggtaatgtgact

SEQ ID NO: 308944 - DNA, 15 bp, Homo sapiens
ctggtaatgtgacta

SEQ ID NO: 308945 - DNA, 15 bp, Homo sapiens
tggtaatgtgactac

SEQ ID NO: 308946 - DNA, 15 bp, Homo sapiens
ggtaatgtgactaca

SEQ ID NO: 308947 - DNA, 15 bp, Homo sapiens
gtaatgtgactacag

SEQ ID NO: 308948 - DNA, 15 bp, Homo sapiens
taatgtgactacagc

SEQ ID NO: 308949 - DNA, 15 bp, Homo sapiens
aatgtgactacagcc

SEQ ID NO: 308950 - DNA, 15 bp, Homo sapiens
atgtgactacagccc

SEQ ID NO: 308951 - DNA, 15 bp, Homo sapiens
tgtgactacagcccc

SEQ ID NO: 308952 - DNA, 15 bp, Homo sapiens
gtgactacagccccc

SEQ ID NO: 308953 - DNA, 15 bp, Homo sapiens
tgactacagcccccg

SEQ ID NO: 308954 - DNA, 15 bp, Homo sapiens
gactacagcccccga

SEQ ID NO: 308955 - DNA, 15 bp, Homo sapiens
actacagcccccgag

SEQ ID NO: 308956 - DNA, 15 bp, Homo sapiens
ctacagcccccgagg

SEQ ID NO: 308957 - DNA, 15 bp, Homo sapiens
tacagcccccgaggg

SEQ ID NO: 308958 - DNA, 15 bp, Homo sapiens
acagcccccgaggga

SEQ ID NO: 308959 - DNA, 15 bp, Homo sapiens
cagcccccgagggaa

SEQ ID NO: 308960 - DNA, 15 bp, Homo sapiens
agcccccgagggaat

SEQ ID NO: 308961 - DNA, 15 bp, Homo sapiens
gcccccgagggaatg

SEQ ID NO: 308962 - DNA, 15 bp, Homo sapiens
cccccgagggaatgg

SEQ ID NO: 308963 - DNA, 15 bp, Homo sapiens
ccccgagggaatggg

SEQ ID NO: 308964 - DNA, 15 bp, Homo sapiens
cccgagggaatgggg

SEQ ID NO: 308965 - DNA, 15 bp, Homo sapiens
ccgagggaatggggc

SEQ ID NO: 308966 - DNA, 15 bp, Homo sapiens
cgagggaatggggcg

SEQ ID NO: 308967 - DNA, 15 bp, Homo sapiens
gagggaatggggcgg

SEQ ID NO: 308968 - DNA, 15 bp, Homo sapiens
agggaatggggcggg

SEQ ID NO: 308969 - DNA, 15 bp, Homo sapiens
gggaatggggcgggg

SEQ ID NO: 308970 - DNA, 15 bp, Homo sapiens
ggaatggggcggggg

SEQ ID NO: 308971 - DNA, 15 bp, Homo sapiens
gaatggggcgggggc

SEQ ID NO: 308972 - DNA, 15 bp, Homo sapiens
aatggggcgggggcc

SEQ ID NO: 308973 - DNA, 15 bp, Homo sapiens
atggggcgggggccg

SEQ ID NO: 308974 - DNA, 15 bp, Homo sapiens
tggggcgggggccgg

SEQ ID NO: 308975 - DNA, 15 bp, Homo sapiens
ggggcgggggccggg

SEQ ID NO: 308976 - DNA, 15 bp, Homo sapiens
gggcgggggccggga

SEQ ID NO: 308977 - DNA, 15 bp, Homo sapiens
ggcgggggccgggag

SEQ ID NO: 308978 - DNA, 15 bp, Homo sapiens
gcgggggccgggagg

SEQ ID NO: 308979 - DNA, 15 bp, Homo sapiens
cgggggccgggagga

SEQ ID NO: 308980 - DNA, 15 bp, Homo sapiens
gggggccgggaggag

SEQ ID NO: 308981 - DNA, 15 bp, Homo sapiens
ggggccgggaggagg

SEQ ID NO: 308982 - DNA, 15 bp, Homo sapiens
gggccgggaggagga

SEQ ID NO: 308983 - DNA, 15 bp, Homo sapiens
ggccgggaggaggat

SEQ ID NO: 308984 - DNA, 15 bp, Homo sapiens
gccgggaggaggatg

SEQ ID NO: 308985 - DNA, 15 bp, Homo sapiens
ccgggaggaggatgg

SEQ ID NO: 308986 - DNA, 15 bp, Homo sapiens
cgggaggaggatggc

SEQ ID NO: 308987 - DNA, 15 bp, Homo sapiens
gggaggaggatggct

SEQ ID NO: 308988 - DNA, 15 bp, Homo sapiens
ggaggaggatggctc

SEQ ID NO: 308989 - DNA, 15 bp, Homo sapiens
gaggaggatggctct

SEQ ID NO: 308990 - DNA, 15 bp, Homo sapiens
aggaggatggctctt

SEQ ID NO: 308991 - DNA, 15 bp, Homo sapiens
ggaggatggctcttt

SEQ ID NO: 308992 - DNA, 15 bp, Homo sapiens
gaggatggctctttc

SEQ ID NO: 308993 - DNA, 15 bp, Homo sapiens
aggatggctctttct

SEQ ID NO: 308994 - DNA, 15 bp, Homo sapiens
ggatggctctttctg

SEQ ID NO: 308995 - DNA, 15 bp, Homo sapiens
gatggctctttctgt

SEQ ID NO: 308996 - DNA, 15 bp, Homo sapiens
atggctctttctgtg

SEQ ID NO: 308997 - DNA, 15 bp, Homo sapiens
tggctctttctgtgg

SEQ ID NO: 308998 - DNA, 15 bp, Homo sapiens
ggctctttctgtggt

SEQ ID NO: 308999 - DNA, 15 bp, Homo sapiens
gctctttctgtggtt

SEQ ID NO: 309000 - DNA, 15 bp, Homo sapiens
ctctttctgtggttc

SEQ ID NO: 309001 - DNA, 15 bp, Homo sapiens
tctttctgtggttct

SEQ ID NO: 309002 - DNA, 15 bp, Homo sapiens
ctttctgtggttctt

SEQ ID NO: 309003 - DNA, 15 bp, Homo sapiens
tttctgtggttcttc

SEQ ID NO: 309004 - DNA, 15 bp, Homo sapiens
ttctgtggttcttcc

SEQ ID NO: 309005 - DNA, 15 bp, Homo sapiens
tctgtggttcttccg

SEQ ID NO: 309006 - DNA, 15 bp, Homo sapiens
ctgtggttcttccgc

SEQ ID NO: 309007 - DNA, 15 bp, Homo sapiens
tgtggttcttccgcc

SEQ ID NO: 309008 - DNA, 15 bp, Homo sapiens
gtggttcttccgcct

SEQ ID NO: 309009 - DNA, 15 bp, Homo sapiens
tggttcttccgcctg

SEQ ID NO: 309010 - DNA, 15 bp, Homo sapiens
ggttcttccgcctgg

SEQ ID NO: 309011 - DNA, 15 bp, Homo sapiens
gttcttccgcctggg

SEQ ID NO: 309012 - DNA, 15 bp, Homo sapiens
ttcttccgcctggga

SEQ ID NO: 309013 - DNA, 15 bp, Homo sapiens
tcttccgcctgggat

SEQ ID NO: 309014 - DNA, 15 bp, Homo sapiens
cttccgcctgggatc

SEQ ID NO: 309015 - DNA, 15 bp, Homo sapiens
ttccgcctgggatcg

SEQ ID NO: 309016 - DNA, 15 bp, Homo sapiens
tccgcctgggatcgg

SEQ ID NO: 309017 - DNA, 15 bp, Homo sapiens
ccgcctgggatcggc

SEQ ID NO: 309018 - DNA, 15 bp, Homo sapiens
cgcctgggatcggcg

SEQ ID NO: 309019 - DNA, 15 bp, Homo sapiens
gcctgggatcggcgt

SEQ ID NO: 309020 - DNA, 15 bp, Homo sapiens
cctgggatcggcgtc

SEQ ID NO: 309021 - DNA, 15 bp, Homo sapiens
ctgggatcggcgtcc

SEQ ID NO: 309022 - DNA, 15 bp, Homo sapiens
tgggatcggcgtccc

SEQ ID NO: 309023 - DNA, 15 bp, Homo sapiens
gggatcggcgtcccg

SEQ ID NO: 309024 - DNA, 15 bp, Homo sapiens
ggatcggcgtcccga

SEQ ID NO: 309025 - DNA, 15 bp, Homo sapiens
gatcggcgtcccgag

SEQ ID NO: 309026 - DNA, 15 bp, Homo sapiens
atcggcgtcccgagc

SEQ ID NO: 309027 - DNA, 15 bp, Homo sapiens
tcggcgtcccgagct

SEQ ID NO: 309028 - DNA, 15 bp, Homo sapiens
cggcgtcccgagctg

SEQ ID NO: 309029 - DNA, 15 bp, Homo sapiens
ggcgtcccgagctgc

SEQ ID NO: 309030 - DNA, 15 bp, Homo sapiens
gcgtcccgagctgct

SEQ ID NO: 309031 - DNA, 15 bp, Homo sapiens
cgtcccgagctgctt

SEQ ID NO: 309032 - DNA, 15 bp, Homo sapiens
gtcccgagctgcttc

SEQ ID NO: 309033 - DNA, 15 bp, Homo sapiens
tcccgagctgcttcc

SEQ ID NO: 309034 - DNA, 15 bp, Homo sapiens
cccgagctgcttccc

SEQ ID NO: 309035 - DNA, 15 bp, Homo sapiens
ccgagctgcttccca

SEQ ID NO: 309036 - DNA, 15 bp, Homo sapiens
cgagctgcttcccaa

SEQ ID NO: 309037 - DNA, 15 bp, Homo sapiens
gagctgcttcccaag

SEQ ID NO: 309038 - DNA, 15 bp, Homo sapiens
agctgcttcccaagt

SEQ ID NO: 309039 - DNA, 15 bp, Homo sapiens
gctgcttcccaagtc

SEQ ID NO: 309040 - DNA, 15 bp, Homo sapiens
ctgcttcccaagtcc

SEQ ID NO: 309041 - DNA, 15 bp, Homo sapiens
tgcttcccaagtccc

SEQ ID NO: 309042 - DNA, 15 bp, Homo sapiens
gcttcccaagtccca

SEQ ID NO: 309043 - DNA, 15 bp, Homo sapiens
cttcccaagtcccag

SEQ ID NO: 309044 - DNA, 15 bp, Homo sapiens
ttcccaagtcccaga

SEQ ID NO: 309045 - DNA, 15 bp, Homo sapiens
tcccaagtcccagag

SEQ ID NO: 309046 - DNA, 15 bp, Homo sapiens
cccaagtcccagagt

SEQ ID NO: 309047 - DNA, 15 bp, Homo sapiens
ccaagtcccagagtc

SEQ ID NO: 309048 - DNA, 15 bp, Homo sapiens
caagtcccagagtcg

SEQ ID NO: 309049 - DNA, 15 bp, Homo sapiens
aagtcccagagtcga

SEQ ID NO: 309050 - DNA, 15 bp, Homo sapiens
agtcccagagtcgaa

SEQ ID NO: 309051 - DNA, 15 bp, Homo sapiens
gtcccagagtcgaag

SEQ ID NO: 309052 - DNA, 15 bp, Homo sapiens
tcccagagtcgaaga

SEQ ID NO: 309053 - DNA, 15 bp, Homo sapiens
cccagagtcgaagat

SEQ ID NO: 309054 - DNA, 15 bp, Homo sapiens
ccagagtcgaagatg

SEQ ID NO: 309055 - DNA, 15 bp, Homo sapiens
cagagtcgaagatgg

SEQ ID NO: 309056 - DNA, 15 bp, Homo sapiens
agagtcgaagatggg

SEQ ID NO: 309057 - DNA, 15 bp, Homo sapiens
gagtcgaagatggga

SEQ ID NO: 309058 - DNA, 15 bp, Homo sapiens
agtcgaagatgggag

SEQ ID NO: 309059 - DNA, 15 bp, Homo sapiens
gtcgaagatgggagt

SEQ ID NO: 309060 - DNA, 15 bp, Homo sapiens
tcgaagatgggagta

SEQ ID NO: 309061 - DNA, 15 bp, Homo sapiens
cgaagatgggagtaa

SEQ ID NO: 309062 - DNA, 15 bp, Homo sapiens
gaagatgggagtaac

SEQ ID NO: 309063 - DNA, 15 bp, Homo sapiens
aagatgggagtaact

SEQ ID NO: 309064 - DNA, 15 bp, Homo sapiens
agatgggagtaactt

SEQ ID NO: 309065 - DNA, 15 bp, Homo sapiens
gatgggagtaacttt

SEQ ID NO: 309066 - DNA, 15 bp, Homo sapiens
atgggagtaactttt

SEQ ID NO: 309067 - DNA, 15 bp, Homo sapiens
tgggagtaacttttg

SEQ ID NO: 309068 - DNA, 15 bp, Homo sapiens
gggagtaacttttgc

SEQ ID NO: 309069 - DNA, 15 bp, Homo sapiens
ggagtaacttttgcg

SEQ ID NO: 309070 - DNA, 15 bp, Homo sapiens
gagtaacttttgcgt

SEQ ID NO: 309071 - DNA, 15 bp, Homo sapiens
agtaacttttgcgtg

SEQ ID NO: 309072 - DNA, 15 bp, Homo sapiens
gtaacttttgcgtgc

SEQ ID NO: 309073 - DNA, 15 bp, Homo sapiens
taacttttgcgtgcc

SEQ ID NO: 309074 - DNA, 15 bp, Homo sapiens
aacttttgcgtgccc

SEQ ID NO: 309075 - DNA, 15 bp, Homo sapiens
acttttgcgtgccct

SEQ ID NO: 309076 - DNA, 15 bp, Homo sapiens
cttttgcgtgccctt

SEQ ID NO: 309077 - DNA, 15 bp, Homo sapiens
ttttgcgtgcccttt

SEQ ID NO: 309078 - DNA, 15 bp, Homo sapiens
tttgcgtgccctttc

SEQ ID NO: 309079 - DNA, 15 bp, Homo sapiens
ttgcgtgccctttcc

SEQ ID NO: 309080 - DNA, 15 bp, Homo sapiens
tgcgtgccctttcct

SEQ ID NO: 309081 - DNA, 15 bp, Homo sapiens
gcgtgccctttcctc

SEQ ID NO: 309082 - DNA, 15 bp, Homo sapiens
cgtgccctttcctcg

SEQ ID NO: 309083 - DNA, 15 bp, Homo sapiens
gtgccctttcctcgg

SEQ ID NO: 309084 - DNA, 15 bp, Homo sapiens
tgccctttcctcggg

SEQ ID NO: 309085 - DNA, 15 bp, Homo sapiens
gccctttcctcgggg

SEQ ID NO: 309086 - DNA, 15 bp, Homo sapiens
ccctttcctcggggc

SEQ ID NO: 309087 - DNA, 15 bp, Homo sapiens
cctttcctcggggcc

SEQ ID NO: 309088 - DNA, 15 bp, Homo sapiens
ctttcctcggggcct

SEQ ID NO: 309089 - DNA, 15 bp, Homo sapiens
tttcctcggggcctc

SEQ ID NO: 309090 - DNA, 15 bp, Homo sapiens
ttcctcggggcctca

SEQ ID NO: 309091 - DNA, 15 bp, Homo sapiens
tcctcggggcctcag

SEQ ID NO: 309092 - DNA, 15 bp, Homo sapiens
cctcggggcctcagt

SEQ ID NO: 309093 - DNA, 15 bp, Homo sapiens
ctcggggcctcagtt

SEQ ID NO: 309094 - DNA, 15 bp, Homo sapiens
tcggggcctcagttt

SEQ ID NO: 309095 - DNA, 15 bp, Homo sapiens
cggggcctcagttta

SEQ ID NO: 309096 - DNA, 15 bp, Homo sapiens
ggggcctcagtttag

SEQ ID NO: 309097 - DNA, 15 bp, Homo sapiens
gggcctcagtttagc

SEQ ID NO: 309098 - DNA, 15 bp, Homo sapiens
ggcctcagtttagct

SEQ ID NO: 309099 - DNA, 15 bp, Homo sapiens
gcctcagtttagctc

SEQ ID NO: 309100 - DNA, 15 bp, Homo sapiens
cctcagtttagctcc

SEQ ID NO: 309101 - DNA, 15 bp, Homo sapiens
ctcagtttagctccc

SEQ ID NO: 309102 - DNA, 15 bp, Homo sapiens
tcagtttagctcccc

SEQ ID NO: 309103 - DNA, 15 bp, Homo sapiens
cagtttagctccccg

SEQ ID NO: 309104 - DNA, 15 bp, Homo sapiens
agtttagctccccgc

SEQ ID NO: 309105 - DNA, 15 bp, Homo sapiens
gtttagctccccgcg

SEQ ID NO: 309106 - DNA, 15 bp, Homo sapiens
tttagctccccgcgg

SEQ ID NO: 309107 - DNA, 15 bp, Homo sapiens
ttagctccccgcggt

SEQ ID NO: 309108 - DNA, 15 bp, Homo sapiens
tagctccccgcggtg

SEQ ID NO: 309109 - DNA, 15 bp, Homo sapiens
agctccccgcggtgc

SEQ ID NO: 309110 - DNA, 15 bp, Homo sapiens
gctccccgcggtgcg

SEQ ID NO: 309111 - DNA, 15 bp, Homo sapiens
ctccccgcggtgcga

SEQ ID NO: 309112 - DNA, 15 bp, Homo sapiens
tccccgcggtgcgag

SEQ ID NO: 309113 - DNA, 15 bp, Homo sapiens
ccccgcggtgcgaga

SEQ ID NO: 309114 - DNA, 15 bp, Homo sapiens
cccgcggtgcgagag

SEQ ID NO: 309115 - DNA, 15 bp, Homo sapiens
ccgcggtgcgagaga

SEQ ID NO: 309116 - DNA, 15 bp, Homo sapiens
cgcggtgcgagagag

SEQ ID NO: 309117 - DNA, 15 bp, Homo sapiens
gcggtgcgagagaga

SEQ ID NO: 309118 - DNA, 15 bp, Homo sapiens
cggtgcgagagagaa

SEQ ID NO: 309119 - DNA, 15 bp, Homo sapiens
ggtgcgagagagaat

SEQ ID NO: 309120 - DNA, 15 bp, Homo sapiens
gtgcgagagagaatg

SEQ ID NO: 309121 - DNA, 15 bp, Homo sapiens
tgcgagagagaatgc

SEQ ID NO: 309122 - DNA, 15 bp, Homo sapiens
gcgagagagaatgcc

SEQ ID NO: 309123 - DNA, 15 bp, Homo sapiens
cgagagagaatgccg

SEQ ID NO: 309124 - DNA, 15 bp, Homo sapiens
gagagagaatgccgg

SEQ ID NO: 309125 - DNA, 15 bp, Homo sapiens
agagagaatgccgga

SEQ ID NO: 309126 - DNA, 15 bp, Homo sapiens
gagagaatgccggag

SEQ ID NO: 309127 - DNA, 15 bp, Homo sapiens
agagaatgccggagg

SEQ ID NO: 309128 - DNA, 15 bp, Homo sapiens
gagaatgccggaggc

SEQ ID NO: 309129 - DNA, 15 bp, Homo sapiens
agaatgccggaggcg

SEQ ID NO: 309130 - DNA, 15 bp, Homo sapiens
gaatgccggaggcgt

SEQ ID NO: 309131 - DNA, 15 bp, Homo sapiens
aatgccggaggcgtg

SEQ ID NO: 309132 - DNA, 15 bp, Homo sapiens
atgccggaggcgtgg

SEQ ID NO: 309133 - DNA, 15 bp, Homo sapiens
tgccggaggcgtgga

SEQ ID NO: 309134 - DNA, 15 bp, Homo sapiens
gccggaggcgtggag

SEQ ID NO: 309135 - DNA, 15 bp, Homo sapiens
ccggaggcgtggaga

SEQ ID NO: 309136 - DNA, 15 bp, Homo sapiens
cggaggcgtggagag

SEQ ID NO: 309137 - DNA, 15 bp, Homo sapiens
ggaggcgtggagagc

SEQ ID NO: 309138 - DNA, 15 bp, Homo sapiens
gaggcgtggagagct

SEQ ID NO: 309139 - DNA, 15 bp, Homo sapiens
aggcgtggagagctc

SEQ ID NO: 309140 - DNA, 15 bp, Homo sapiens
ggcgtggagagctcg

SEQ ID NO: 309141 - DNA, 15 bp, Homo sapiens
gcgtggagagctcgg

SEQ ID NO: 309142 - DNA, 15 bp, Homo sapiens
cgtggagagctcggg

SEQ ID NO: 309143 - DNA, 15 bp, Homo sapiens
gtggagagctcgggc

SEQ ID NO: 309144 - DNA, 15 bp, Homo sapiens
tggagagctcgggcg

SEQ ID NO: 309145 - DNA, 15 bp, Homo sapiens
ggagagctcgggcgt

SEQ ID NO: 309146 - DNA, 15 bp, Homo sapiens
gagagctcgggcgtg

SEQ ID NO: 309147 - DNA, 15 bp, Homo sapiens
agagctcgggcgtgg

SEQ ID NO: 309148 - DNA, 15 bp, Homo sapiens
gagctcgggcgtgga

SEQ ID NO: 309149 - DNA, 15 bp, Homo sapiens
agctcgggcgtggag

SEQ ID NO: 309150 - DNA, 15 bp, Homo sapiens
gctcgggcgtggagg

SEQ ID NO: 309151 - DNA, 15 bp, Homo sapiens
ctcgggcgtggaggt

SEQ ID NO: 309152 - DNA, 15 bp, Homo sapiens
tcgggcgtggaggtc

SEQ ID NO: 309153 - DNA, 15 bp, Homo sapiens
cgggcgtggaggtcc

SEQ ID NO: 309154 - DNA, 15 bp, Homo sapiens
gggcgtggaggtcct

SEQ ID NO: 309155 - DNA, 15 bp, Homo sapiens
ggcgtggaggtcctt

SEQ ID NO: 309156 - DNA, 15 bp, Homo sapiens
gcgtggaggtccttg

SEQ ID NO: 309157 - DNA, 15 bp, Homo sapiens
cgtggaggtccttgg

SEQ ID NO: 309158 - DNA, 15 bp, Homo sapiens
gtggaggtccttggg

SEQ ID NO: 309159 - DNA, 15 bp, Homo sapiens
tggaggtccttggga

SEQ ID NO: 309160 - DNA, 15 bp, Homo sapiens
ggaggtccttgggat

SEQ ID NO: 309161 - DNA, 15 bp, Homo sapiens
gaggtccttgggatc

SEQ ID NO: 309162 - DNA, 15 bp, Homo sapiens
aggtccttgggatcc

SEQ ID NO: 309163 - DNA, 15 bp, Homo sapiens
ggtccttgggatccg

SEQ ID NO: 309164 - DNA, 15 bp, Homo sapiens
gtccttgggatccgt

SEQ ID NO: 309165 - DNA, 15 bp, Homo sapiens
tccttgggatccgta

SEQ ID NO: 309166 - DNA, 15 bp, Homo sapiens
ccttgggatccgtac

SEQ ID NO: 309167 - DNA, 15 bp, Homo sapiens
cttgggatccgtact

SEQ ID NO: 309168 - DNA, 15 bp, Homo sapiens
ttgggatccgtacta

SEQ ID NO: 309169 - DNA, 15 bp, Homo sapiens
tgggatccgtactag

SEQ ID NO: 309170 - DNA, 15 bp, Homo sapiens
gggatccgtactagt

SEQ ID NO: 309171 - DNA, 15 bp, Homo sapiens
ggatccgtactagtt

SEQ ID NO: 309172 - DNA, 15 bp, Homo sapiens
gatccgtactagttg

SEQ ID NO: 309173 - DNA, 15 bp, Homo sapiens
atccgtactagttgt

SEQ ID NO: 309174 - DNA, 15 bp, Homo sapiens
tccgtactagttgtg

SEQ ID NO: 309175 - DNA, 15 bp, Homo sapiens
ccgtactagttgtga

SEQ ID NO: 309176 - DNA, 15 bp, Homo sapiens
cgtactagttgtgaa

SEQ ID NO: 309177 - DNA, 15 bp, Homo sapiens
gtactagttgtgaac

SEQ ID NO: 309178 - DNA, 15 bp, Homo sapiens
tactagttgtgaacg

SEQ ID NO: 309179 - DNA, 15 bp, Homo sapiens
actagttgtgaacga

SEQ ID NO: 309180 - DNA, 15 bp, Homo sapiens
ctagttgtgaacgat

SEQ ID NO: 309181 - DNA, 15 bp, Homo sapiens
tagttgtgaacgatc

SEQ ID NO: 309182 - DNA, 15 bp, Homo sapiens
agttgtgaacgatcc

SEQ ID NO: 309183 - DNA, 15 bp, Homo sapiens
gttgtgaacgatcca

SEQ ID NO: 309184 - DNA, 15 bp, Homo sapiens
ttgtgaacgatccaa

SEQ ID NO: 309185 - DNA, 15 bp, Homo sapiens
tgtgaacgatccaaa

SEQ ID NO: 309186 - DNA, 15 bp, Homo sapiens
gtgaacgatccaaac

SEQ ID NO: 309187 - DNA, 15 bp, Homo sapiens
tgaacgatccaaact

SEQ ID NO: 309188 - DNA, 15 bp, Homo sapiens
gaacgatccaaactt

SEQ ID NO: 309189 - DNA, 15 bp, Homo sapiens
aacgatccaaactta

SEQ ID NO: 309190 - DNA, 15 bp, Homo sapiens
acgatccaaacttat

SEQ ID NO: 309191 - DNA, 15 bp, Homo sapiens
cgatccaaacttatc

SEQ ID NO: 309192 - DNA, 15 bp, Homo sapiens
gatccaaacttatct

SEQ ID NO: 309193 - DNA, 15 bp, Homo sapiens
atccaaacttatctg

SEQ ID NO: 309194 - DNA, 15 bp, Homo sapiens
tccaaacttatctga

SEQ ID NO: 309195 - DNA, 15 bp, Homo sapiens
ccaaacttatctgac

SEQ ID NO: 309196 - DNA, 15 bp, Homo sapiens
caaacttatctgacc

SEQ ID NO: 309197 - DNA, 15 bp, Homo sapiens
aaacttatctgacca

SEQ ID NO: 309198 - DNA, 15 bp, Homo sapiens
aacttatctgaccag

SEQ ID NO: 309199 - DNA, 15 bp, Homo sapiens
acttatctgaccagc

SEQ ID NO: 309200 - DNA, 15 bp, Homo sapiens
cttatctgaccagct

SEQ ID NO: 309201 - DNA, 15 bp, Homo sapiens
ttatctgaccagctc

SEQ ID NO: 309202 - DNA, 15 bp, Homo sapiens
tatctgaccagctct

SEQ ID NO: 309203 - DNA, 15 bp, Homo sapiens
atctgaccagctctg

SEQ ID NO: 309204 - DNA, 15 bp, Homo sapiens
tctgaccagctctgt

SEQ ID NO: 309205 - DNA, 15 bp, Homo sapiens
ctgaccagctctgtg

SEQ ID NO: 309206 - DNA, 15 bp, Homo sapiens
tgaccagctctgtgc

SEQ ID NO: 309207 - DNA, 15 bp, Homo sapiens
gaccagctctgtgct

SEQ ID NO: 309208 - DNA, 15 bp, Homo sapiens
accagctctgtgctg

SEQ ID NO: 309209 - DNA, 15 bp, Homo sapiens
ccagctctgtgctgc

SEQ ID NO: 309210 - DNA, 15 bp, Homo sapiens
cagctctgtgctgcc

SEQ ID NO: 309211 - DNA, 15 bp, Homo sapiens
agctctgtgctgcct

SEQ ID NO: 309212 - DNA, 15 bp, Homo sapiens
gctctgtgctgcctc

SEQ ID NO: 309213 - DNA, 15 bp, Homo sapiens
ctctgtgctgcctcc

SEQ ID NO: 309214 - DNA, 15 bp, Homo sapiens
tctgtgctgcctccc

SEQ ID NO: 309215 - DNA, 15 bp, Homo sapiens
ctgtgctgcctccct

SEQ ID NO: 309216 - DNA, 15 bp, Homo sapiens
tgtgctgcctccctg

SEQ ID NO: 309217 - DNA, 15 bp, Homo sapiens
gtgctgcctccctgc

SEQ ID NO: 309218 - DNA, 15 bp, Homo sapiens
tgctgcctccctgct

SEQ ID NO: 309219 - DNA, 15 bp, Homo sapiens
gctgcctccctgctc

SEQ ID NO: 309220 - DNA, 15 bp, Homo sapiens
ctgcctccctgctcc

SEQ ID NO: 309221 - DNA, 15 bp, Homo sapiens
tgcctccctgctccc

SEQ ID NO: 309222 - DNA, 15 bp, Homo sapiens
gcctccctgctcccc

SEQ ID NO: 309223 - DNA, 15 bp, Homo sapiens
cctccctgctcccct

SEQ ID NO: 309224 - DNA, 15 bp, Homo sapiens
ctccctgctccccta

SEQ ID NO: 309225 - DNA, 15 bp, Homo sapiens
tccctgctcccctaa

SEQ ID NO: 309226 - DNA, 15 bp, Homo sapiens
ccctgctcccctaat

SEQ ID NO: 309227 - DNA, 15 bp, Homo sapiens
cctgctcccctaatc

SEQ ID NO: 309228 - DNA, 15 bp, Homo sapiens
ctgctcccctaatct

SEQ ID NO: 309229 - DNA, 15 bp, Homo sapiens
tgctcccctaatctt

SEQ ID NO: 309230 - DNA, 15 bp, Homo sapiens
gctcccctaatcttc

SEQ ID NO: 309231 - DNA, 15 bp, Homo sapiens
ctcccctaatcttcc

SEQ ID NO: 309232 - DNA, 15 bp, Homo sapiens
tcccctaatcttcct

SEQ ID NO: 309233 - DNA, 15 bp, Homo sapiens
cccctaatcttcctc

SEQ ID NO: 309234 - DNA, 15 bp, Homo sapiens
ccctaatcttcctcc

SEQ ID NO: 309235 - DNA, 15 bp, Homo sapiens
cctaatcttcctccc

SEQ ID NO: 309236 - DNA, 15 bp, Homo sapiens
ctaatcttcctcccc

SEQ ID NO: 309237 - DNA, 15 bp, Homo sapiens
taatcttcctccccg

SEQ ID NO: 309238 - DNA, 15 bp, Homo sapiens
aatcttcctccccgc

SEQ ID NO: 309239 - DNA, 15 bp, Homo sapiens
atcttcctccccgcc

SEQ ID NO: 309240 - DNA, 15 bp, Homo sapiens
tcttcctccccgccg

SEQ ID NO: 309241 - DNA, 15 bp, Homo sapiens
cttcctccccgccgg

SEQ ID NO: 309242 - DNA, 15 bp, Homo sapiens
ttcctccccgccggg

SEQ ID NO: 309243 - DNA, 15 bp, Homo sapiens
tcctccccgccgggg

SEQ ID NO: 309244 - DNA, 15 bp, Homo sapiens
cctccccgccggggt

SEQ ID NO: 309245 - DNA, 15 bp, Homo sapiens
ctccccgccggggtg

SEQ ID NO: 309246 - DNA, 15 bp, Homo sapiens
tccccgccggggtga

SEQ ID NO: 309247 - DNA, 15 bp, Homo sapiens
ccccgccggggtgac

SEQ ID NO: 309248 - DNA, 15 bp, Homo sapiens
cccgccggggtgaca

SEQ ID NO: 309249 - DNA, 15 bp, Homo sapiens
ccgccggggtgacag

SEQ ID NO: 309250 - DNA, 15 bp, Homo sapiens
cgccggggtgacaga

SEQ ID NO: 309251 - DNA, 15 bp, Homo sapiens
gccggggtgacagag

SEQ ID NO: 309252 - DNA, 15 bp, Homo sapiens
ccggggtgacagagt

SEQ ID NO: 309253 - DNA, 15 bp, Homo sapiens
cggggtgacagagtc

SEQ ID NO: 309254 - DNA, 15 bp, Homo sapiens
ggggtgacagagtcg

SEQ ID NO: 309255 - DNA, 15 bp, Homo sapiens
gggtgacagagtcgc

SEQ ID NO: 309256 - DNA, 15 bp, Homo sapiens
ggtgacagagtcgcc

SEQ ID NO: 309257 - DNA, 15 bp, Homo sapiens
gtgacagagtcgccc

SEQ ID NO: 309258 - DNA, 15 bp, Homo sapiens
tgacagagtcgccct

SEQ ID NO: 309259 - DNA, 15 bp, Homo sapiens
gacagagtcgccctc

SEQ ID NO: 309260 - DNA, 15 bp, Homo sapiens
acagagtcgccctcc

SEQ ID NO: 309261 - DNA, 15 bp, Homo sapiens
cagagtcgccctccg

SEQ ID NO: 309262 - DNA, 15 bp, Homo sapiens
agagtcgccctccgt

SEQ ID NO: 309263 - DNA, 15 bp, Homo sapiens
gagtcgccctccgtg

SEQ ID NO: 309264 - DNA, 15 bp, Homo sapiens
agtcgccctccgtgc

SEQ ID NO: 309265 - DNA, 15 bp, Homo sapiens
gtcgccctccgtgca

SEQ ID NO: 309266 - DNA, 15 bp, Homo sapiens
tcgccctccgtgcat

SEQ ID NO: 309267 - DNA, 15 bp, Homo sapiens
cgccctccgtgcatc

SEQ ID NO: 309268 - DNA, 15 bp, Homo sapiens
gccctccgtgcatcg

SEQ ID NO: 309269 - DNA, 15 bp, Homo sapiens
ccctccgtgcatcgc

SEQ ID NO: 309270 - DNA, 15 bp, Homo sapiens
cctccgtgcatcgcg

SEQ ID NO: 309271 - DNA, 15 bp, Homo sapiens
ctccgtgcatcgcgc

SEQ ID NO: 309272 - DNA, 15 bp, Homo sapiens
tccgtgcatcgcgcg

SEQ ID NO: 309273 - DNA, 15 bp, Homo sapiens
ccgtgcatcgcgcgg

SEQ ID NO: 309274 - DNA, 15 bp, Homo sapiens
cgtgcatcgcgcggt

SEQ ID NO: 309275 - DNA, 15 bp, Homo sapiens
gtgcatcgcgcggtg

SEQ ID NO: 309276 - DNA, 15 bp, Homo sapiens
tgcatcgcgcggtgc

SEQ ID NO: 309277 - DNA, 15 bp, Homo sapiens
gcatcgcgcggtgca

SEQ ID NO: 309278 - DNA, 15 bp, Homo sapiens
catcgcgcggtgcag

SEQ ID NO: 309279 - DNA, 15 bp, Homo sapiens
atcgcgcggtgcagg

SEQ ID NO: 309280 - DNA, 15 bp, Homo sapiens
tcgcgcggtgcaggg

SEQ ID NO: 309281 - DNA, 15 bp, Homo sapiens
cgcgcggtgcagggc

SEQ ID NO: 309282 - DNA, 15 bp, Homo sapiens
gcgcggtgcagggcg

SEQ ID NO: 309283 - DNA, 15 bp, Homo sapiens
cgcggtgcagggcgc

SEQ ID NO: 309284 - DNA, 15 bp, Homo sapiens
gcggtgcagggcgct

SEQ ID NO: 309285 - DNA, 15 bp, Homo sapiens
cggtgcagggcgctg

SEQ ID NO: 309286 - DNA, 15 bp, Homo sapiens
ggtgcagggcgctgg

SEQ ID NO: 309287 - DNA, 15 bp, Homo sapiens
gtgcagggcgctggg

SEQ ID NO: 309288 - DNA, 15 bp, Homo sapiens
tgcagggcgctgggc

SEQ ID NO: 309289 - DNA, 15 bp, Homo sapiens
gcagggcgctgggcc

SEQ ID NO: 309290 - DNA, 15 bp, Homo sapiens
cagggcgctgggcca

SEQ ID NO: 309291 - DNA, 15 bp, Homo sapiens
agggcgctgggccag

SEQ ID NO: 309292 - DNA, 15 bp, Homo sapiens
gggcgctgggccagt

SEQ ID NO: 309293 - DNA, 15 bp, Homo sapiens
ggcgctgggccagtg

SEQ ID NO: 309294 - DNA, 15 bp, Homo sapiens
gcgctgggccagtga

SEQ ID NO: 309295 - DNA, 15 bp, Homo sapiens
cgctgggccagtgat

SEQ ID NO: 309296 - DNA, 15 bp, Homo sapiens
gctgggccagtgatt

SEQ ID NO: 309297 - DNA, 15 bp, Homo sapiens
ctgggccagtgattt

SEQ ID NO: 309298 - DNA, 15 bp, Homo sapiens
tgggccagtgatttg

SEQ ID NO: 309299 - DNA, 15 bp, Homo sapiens
gggccagtgatttgc

SEQ ID NO: 309300 - DNA, 15 bp, Homo sapiens
ggccagtgatttgca

SEQ ID NO: 309301 - DNA, 15 bp, Homo sapiens
gccagtgatttgcaa

SEQ ID NO: 309302 - DNA, 15 bp, Homo sapiens
ccagtgatttgcaag

SEQ ID NO: 309303 - DNA, 15 bp, Homo sapiens
cagtgatttgcaaga

SEQ ID NO: 309304 - DNA, 15 bp, Homo sapiens
agtgatttgcaagag

SEQ ID NO: 309305 - DNA, 15 bp, Homo sapiens
gtgatttgcaagagg

SEQ ID NO: 309306 - DNA, 15 bp, Homo sapiens
tgatttgcaagaggg

SEQ ID NO: 309307 - DNA, 15 bp, Homo sapiens
gatttgcaagagggg

SEQ ID NO: 309308 - DNA, 15 bp, Homo sapiens
atttgcaagagggga

SEQ ID NO: 309309 - DNA, 15 bp, Homo sapiens
tttgcaagaggggac

SEQ ID NO: 309310 - DNA, 15 bp, Homo sapiens
ttgcaagaggggacg

SEQ ID NO: 309311 - DNA, 15 bp, Homo sapiens
tgcaagaggggacgt

SEQ ID NO: 309312 - DNA, 15 bp, Homo sapiens
gcaagaggggacgtg

SEQ ID NO: 309313 - DNA, 15 bp, Homo sapiens
caagaggggacgtgg

SEQ ID NO: 309314 - DNA, 15 bp, Homo sapiens
aagaggggacgtggc

SEQ ID NO: 309315 - DNA, 15 bp, Homo sapiens
agaggggacgtggcc

SEQ ID NO: 309316 - DNA, 15 bp, Homo sapiens
gaggggacgtggcct

SEQ ID NO: 309317 - DNA, 15 bp, Homo sapiens
aggggacgtggcctc

SEQ ID NO: 309318 - DNA, 15 bp, Homo sapiens
ggggacgtggcctct

SEQ ID NO: 309319 - DNA, 15 bp, Homo sapiens
gggacgtggcctctt

SEQ ID NO: 309320 - DNA, 15 bp, Homo sapiens
ggacgtggcctctta

SEQ ID NO: 309321 - DNA, 15 bp, Homo sapiens
gacgtggcctcttag

SEQ ID NO: 309322 - DNA, 15 bp, Homo sapiens
acgtggcctcttagg

SEQ ID NO: 309323 - DNA, 15 bp, Homo sapiens
cgtggcctcttagga

SEQ ID NO: 309324 - DNA, 15 bp, Homo sapiens
gtggcctcttaggag

SEQ ID NO: 309325 - DNA, 15 bp, Homo sapiens
tggcctcttaggaga

SEQ ID NO: 309326 - DNA, 15 bp, Homo sapiens
ggcctcttaggagag

SEQ ID NO: 309327 - DNA, 15 bp, Homo sapiens
gcctcttaggagagt

SEQ ID NO: 309328 - DNA, 15 bp, Homo sapiens
cctcttaggagagtc

SEQ ID NO: 309329 - DNA, 15 bp, Homo sapiens
ctcttaggagagtct

SEQ ID NO: 309330 - DNA, 15 bp, Homo sapiens
tcttaggagagtctg

SEQ ID NO: 309331 - DNA, 15 bp, Homo sapiens
cttaggagagtctgt

SEQ ID NO: 309332 - DNA, 15 bp, Homo sapiens
ttaggagagtctgtc

SEQ ID NO: 309333 - DNA, 15 bp, Homo sapiens
taggagagtctgtca

SEQ ID NO: 309334 - DNA, 15 bp, Homo sapiens
aggagagtctgtcac

SEQ ID NO: 309335 - DNA, 15 bp, Homo sapiens
ggagagtctgtcaca

SEQ ID NO: 309336 - DNA, 15 bp, Homo sapiens
gagagtctgtcacag

SEQ ID NO: 309337 - DNA, 15 bp, Homo sapiens
agagtctgtcacaga

SEQ ID NO: 309338 - DNA, 15 bp, Homo sapiens
gagtctgtcacagac

SEQ ID NO: 309339 - DNA, 15 bp, Homo sapiens
agtctgtcacagaca

SEQ ID NO: 309340 - DNA, 15 bp, Homo sapiens
gtctgtcacagacac

SEQ ID NO: 309341 - DNA, 15 bp, Homo sapiens
tctgtcacagacacc

SEQ ID NO: 309342 - DNA, 15 bp, Homo sapiens
ctgtcacagacaccc

SEQ ID NO: 309343 - DNA, 15 bp, Homo sapiens
tgtcacagacacccg

SEQ ID NO: 309344 - DNA, 15 bp, Homo sapiens
gtcacagacacccgg

SEQ ID NO: 309345 - DNA, 15 bp, Homo sapiens
tcacagacacccggg

SEQ ID NO: 309346 - DNA, 15 bp, Homo sapiens
cacagacacccgggc

SEQ ID NO: 309347 - DNA, 15 bp, Homo sapiens
acagacacccgggcc

SEQ ID NO: 309348 - DNA, 15 bp, Homo sapiens
cagacacccgggccc

SEQ ID NO: 309349 - DNA, 15 bp, Homo sapiens
agacacccgggcccg

SEQ ID NO: 309350 - DNA, 15 bp, Homo sapiens
gacacccgggcccgg

SEQ ID NO: 309351 - DNA, 15 bp, Homo sapiens
acacccgggcccggg

SEQ ID NO: 309352 - DNA, 15 bp, Homo sapiens
cacccgggcccgggg

SEQ ID NO: 309353 - DNA, 15 bp, Homo sapiens
acccgggcccgggga

SEQ ID NO: 309354 - DNA, 15 bp, Homo sapiens
cccgggcccggggaa

SEQ ID NO: 309355 - DNA, 15 bp, Homo sapiens
ccgggcccggggaag

SEQ ID NO: 309356 - DNA, 15 bp, Homo sapiens
cgggcccggggaagg

SEQ ID NO: 309357 - DNA, 15 bp, Homo sapiens
gggcccggggaaggc

SEQ ID NO: 309358 - DNA, 15 bp, Homo sapiens
ggcccggggaaggcg

SEQ ID NO: 309359 - DNA, 15 bp, Homo sapiens
gcccggggaaggcgg

SEQ ID NO: 309360 - DNA, 15 bp, Homo sapiens
cccggggaaggcggg

SEQ ID NO: 309361 - DNA, 15 bp, Homo sapiens
ccggggaaggcgggg

SEQ ID NO: 309362 - DNA, 15 bp, Homo sapiens
cggggaaggcggggc

SEQ ID NO: 309363 - DNA, 15 bp, Homo sapiens
ggggaaggcggggct

SEQ ID NO: 309364 - DNA, 15 bp, Homo sapiens
gggaaggcggggctc

SEQ ID NO: 309365 - DNA, 15 bp, Homo sapiens
ggaaggcggggctcc

SEQ ID NO: 309366 - DNA, 15 bp, Homo sapiens
gaaggcggggctccg

SEQ ID NO: 309367 - DNA, 15 bp, Homo sapiens
aaggcggggctccgg

SEQ ID NO: 309368 - DNA, 15 bp, Homo sapiens
aggcggggctccggc

SEQ ID NO: 309369 - DNA, 15 bp, Homo sapiens
ggcggggctccggcg

SEQ ID NO: 309370 - DNA, 15 bp, Homo sapiens
gcggggctccggcgg

SEQ ID NO: 309371 - DNA, 15 bp, Homo sapiens
cggggctccggcggt

SEQ ID NO: 309372 - DNA, 15 bp, Homo sapiens
ggggctccggcggtg

SEQ ID NO: 309373 - DNA, 15 bp, Homo sapiens
gggctccggcggtgt

SEQ ID NO: 309374 - DNA, 15 bp, Homo sapiens
ggctccggcggtgtc

SEQ ID NO: 309375 - DNA, 15 bp, Homo sapiens
gctccggcggtgtcc

SEQ ID NO: 309376 - DNA, 15 bp, Homo sapiens
ctccggcggtgtcca

SEQ ID NO: 309377 - DNA, 15 bp, Homo sapiens
tccggcggtgtccac

SEQ ID NO: 309378 - DNA, 15 bp, Homo sapiens
ccggcggtgtccaca

SEQ ID NO: 309379 - DNA, 15 bp, Homo sapiens
cggcggtgtccacag

SEQ ID NO: 309380 - DNA, 15 bp, Homo sapiens
ggcggtgtccacagg

SEQ ID NO: 309381 - DNA, 15 bp, Homo sapiens
gcggtgtccacagga

SEQ ID NO: 309382 - DNA, 15 bp, Homo sapiens
cggtgtccacaggag

SEQ ID NO: 309383 - DNA, 15 bp, Homo sapiens
ggtgtccacaggaga

SEQ ID NO: 309384 - DNA, 15 bp, Homo sapiens
gtgtccacaggagag

SEQ ID NO: 309385 - DNA, 15 bp, Homo sapiens
tgtccacaggagagg

SEQ ID NO: 309386 - DNA, 15 bp, Homo sapiens
gtccacaggagaggg

SEQ ID NO: 309387 - DNA, 15 bp, Homo sapiens
tccacaggagagggt

SEQ ID NO: 309388 - DNA, 15 bp, Homo sapiens
ccacaggagagggtg

SEQ ID NO: 309389 - DNA, 15 bp, Homo sapiens
cacaggagagggtgg

SEQ ID NO: 309390 - DNA, 15 bp, Homo sapiens
acaggagagggtggg

SEQ ID NO: 309391 - DNA, 15 bp, Homo sapiens
caggagagggtgggc

SEQ ID NO: 309392 - DNA, 15 bp, Homo sapiens
aggagagggtgggca

SEQ ID NO: 309393 - DNA, 15 bp, Homo sapiens
ggagagggtgggcag

SEQ ID NO: 309394 - DNA, 15 bp, Homo sapiens
gagagggtgggcaga

SEQ ID NO: 309395 - DNA, 15 bp, Homo sapiens
agagggtgggcagag

SEQ ID NO: 309396 - DNA, 15 bp, Homo sapiens
gagggtgggcagagg

SEQ ID NO: 309397 - DNA, 15 bp, Homo sapiens
agggtgggcagaggg

SEQ ID NO: 309398 - DNA, 15 bp, Homo sapiens
gggtgggcagagggt

SEQ ID NO: 309399 - DNA, 15 bp, Homo sapiens
ggtgggcagagggtg

SEQ ID NO: 309400 - DNA, 15 bp, Homo sapiens
gtgggcagagggtgg

SEQ ID NO: 309401 - DNA, 15 bp, Homo sapiens
tgggcagagggtggc

SEQ ID NO: 309402 - DNA, 15 bp, Homo sapiens
gggcagagggtggct

SEQ ID NO: 309403 - DNA, 15 bp, Homo sapiens
ggcagagggtggctg

SEQ ID NO: 309404 - DNA, 15 bp, Homo sapiens
gcagagggtggctgt

SEQ ID NO: 309405 - DNA, 15 bp, Homo sapiens
cagagggtggctgtg

SEQ ID NO: 309406 - DNA, 15 bp, Homo sapiens
agagggtggctgtgt

SEQ ID NO: 309407 - DNA, 15 bp, Homo sapiens
gagggtggctgtgtg

SEQ ID NO: 309408 - DNA, 15 bp, Homo sapiens
agggtggctgtgtgg

SEQ ID NO: 309409 - DNA, 15 bp, Homo sapiens
gggtggctgtgtggt

SEQ ID NO: 309410 - DNA, 15 bp, Homo sapiens
ggtggctgtgtggtc

SEQ ID NO: 309411 - DNA, 15 bp, Homo sapiens
gtggctgtgtggtcg

SEQ ID NO: 309412 - DNA, 15 bp, Homo sapiens
tggctgtgtggtcgg

SEQ ID NO: 309413 - DNA, 15 bp, Homo sapiens
ggctgtgtggtcggc

SEQ ID NO: 309414 - DNA, 15 bp, Homo sapiens
gctgtgtggtcggcg

SEQ ID NO: 309415 - DNA, 15 bp, Homo sapiens
ctgtgtggtcggcgg

SEQ ID NO: 309416 - DNA, 15 bp, Homo sapiens
tgtgtggtcggcggc

SEQ ID NO: 309417 - DNA, 15 bp, Homo sapiens
gtgtggtcggcggcc

SEQ ID NO: 309418 - DNA, 15 bp, Homo sapiens
tgtggtcggcggcca

SEQ ID NO: 309419 - DNA, 15 bp, Homo sapiens
gtggtcggcggccag

SEQ ID NO: 309420 - DNA, 15 bp, Homo sapiens
tggtcggcggccagc

SEQ ID NO: 309421 - DNA, 15 bp, Homo sapiens
ggtcggcggccagcg

SEQ ID NO: 309422 - DNA, 15 bp, Homo sapiens
gtcggcggccagcgg

SEQ ID NO: 309423 - DNA, 15 bp, Homo sapiens
tcggcggccagcgga

SEQ ID NO: 309424 - DNA, 15 bp, Homo sapiens
cggcggccagcggag

SEQ ID NO: 309425 - DNA, 15 bp, Homo sapiens
ggcggccagcggagc

SEQ ID NO: 309426 - DNA, 15 bp, Homo sapiens
gcggccagcggagcg

SEQ ID NO: 309427 - DNA, 15 bp, Homo sapiens
cggccagcggagcgc

SEQ ID NO: 309428 - DNA, 15 bp, Homo sapiens
ggccagcggagcgct

SEQ ID NO: 309429 - DNA, 15 bp, Homo sapiens
gccagcggagcgctt

SEQ ID NO: 309430 - DNA, 15 bp, Homo sapiens
ccagcggagcgcttc

SEQ ID NO: 309431 - DNA, 15 bp, Homo sapiens
cagcggagcgcttcc

SEQ ID NO: 309432 - DNA, 15 bp, Homo sapiens
agcggagcgcttccc

SEQ ID NO: 309433 - DNA, 15 bp, Homo sapiens
gcggagcgcttccca

SEQ ID NO: 309434 - DNA, 15 bp, Homo sapiens
cggagcgcttcccag

SEQ ID NO: 309435 - DNA, 15 bp, Homo sapiens
ggagcgcttcccagc

SEQ ID NO: 309436 - DNA, 15 bp, Homo sapiens
gagcgcttcccagcc

SEQ ID NO: 309437 - DNA, 15 bp, Homo sapiens
agcgcttcccagcca

SEQ ID NO: 309438 - DNA, 15 bp, Homo sapiens
gcgcttcccagccag

SEQ ID NO: 309439 - DNA, 15 bp, Homo sapiens
cgcttcccagccagc

SEQ ID NO: 309440 - DNA, 15 bp, Homo sapiens
gcttcccagccagcc

SEQ ID NO: 309441 - DNA, 15 bp, Homo sapiens
cttcccagccagccg

SEQ ID NO: 309442 - DNA, 15 bp, Homo sapiens
ttcccagccagccgc

SEQ ID NO: 309443 - DNA, 15 bp, Homo sapiens
tcccagccagccgcc

SEQ ID NO: 309444 - DNA, 15 bp, Homo sapiens
cccagccagccgccc

SEQ ID NO: 309445 - DNA, 15 bp, Homo sapiens
ccagccagccgcccg

SEQ ID NO: 309446 - DNA, 15 bp, Homo sapiens
cagccagccgcccgg

SEQ ID NO: 309447 - DNA, 15 bp, Homo sapiens
agccagccgcccggc

SEQ ID NO: 309448 - DNA, 15 bp, Homo sapiens
gccagccgcccggcg

SEQ ID NO: 309449 - DNA, 15 bp, Homo sapiens
ccagccgcccggcgg

SEQ ID NO: 309450 - DNA, 15 bp, Homo sapiens
cagccgcccggcggg

SEQ ID NO: 309451 - DNA, 15 bp, Homo sapiens
agccgcccggcgggg

SEQ ID NO: 309452 - DNA, 15 bp, Homo sapiens
gccgcccggcgggga

SEQ ID NO: 309453 - DNA, 15 bp, Homo sapiens
ccgcccggcggggaa

SEQ ID NO: 309454 - DNA, 15 bp, Homo sapiens
cgcccggcggggaac

SEQ ID NO: 309455 - DNA, 15 bp, Homo sapiens
gcccggcggggaacg

SEQ ID NO: 309456 - DNA, 15 bp, Homo sapiens
cccggcggggaacgt

SEQ ID NO: 309457 - DNA, 15 bp, Homo sapiens
ccggcggggaacgtg

SEQ ID NO: 309458 - DNA, 15 bp, Homo sapiens
cggcggggaacgtgc

SEQ ID NO: 309459 - DNA, 15 bp, Homo sapiens
ggcggggaacgtgct

SEQ ID NO: 309460 - DNA, 15 bp, Homo sapiens
gcggggaacgtgctt

SEQ ID NO: 309461 - DNA, 15 bp, Homo sapiens
cggggaacgtgcttg

SEQ ID NO: 309462 - DNA, 15 bp, Homo sapiens
ggggaacgtgcttga

SEQ ID NO: 309463 - DNA, 15 bp, Homo sapiens
gggaacgtgcttgac

SEQ ID NO: 309464 - DNA, 15 bp, Homo sapiens
ggaacgtgcttgacc

SEQ ID NO: 309465 - DNA, 15 bp, Homo sapiens
gaacgtgcttgacct

SEQ ID NO: 309466 - DNA, 15 bp, Homo sapiens
aacgtgcttgacctc

SEQ ID NO: 309467 - DNA, 15 bp, Homo sapiens
acgtgcttgacctct

SEQ ID NO: 309468 - DNA, 15 bp, Homo sapiens
cgtgcttgacctctg

SEQ ID NO: 309469 - DNA, 15 bp, Homo sapiens
gtgcttgacctctgg

SEQ ID NO: 309470 - DNA, 15 bp, Homo sapiens
tgcttgacctctggg

SEQ ID NO: 309471 - DNA, 15 bp, Homo sapiens
gcttgacctctgggt

SEQ ID NO: 309472 - DNA, 15 bp, Homo sapiens
cttgacctctgggtg

SEQ ID NO: 309473 - DNA, 15 bp, Homo sapiens
ttgacctctgggtgg

SEQ ID NO: 309474 - DNA, 15 bp, Homo sapiens
tgacctctgggtggt

SEQ ID NO: 309475 - DNA, 15 bp, Homo sapiens
gacctctgggtggtt

SEQ ID NO: 309476 - DNA, 15 bp, Homo sapiens
acctctgggtggttg

SEQ ID NO: 309477 - DNA, 15 bp, Homo sapiens
cctctgggtggttgc

SEQ ID NO: 309478 - DNA, 15 bp, Homo sapiens
ctctgggtggttgct

SEQ ID NO: 309479 - DNA, 15 bp, Homo sapiens
tctgggtggttgctg

SEQ ID NO: 309480 - DNA, 15 bp, Homo sapiens
ctgggtggttgctgc

SEQ ID NO: 309481 - DNA, 15 bp, Homo sapiens
tgggtggttgctgct

SEQ ID NO: 309482 - DNA, 15 bp, Homo sapiens
gggtggttgctgctc

SEQ ID NO: 309483 - DNA, 15 bp, Homo sapiens
ggtggttgctgctcc

SEQ ID NO: 309484 - DNA, 15 bp, Homo sapiens
gtggttgctgctccc

SEQ ID NO: 309485 - DNA, 15 bp, Homo sapiens
tggttgctgctccca

SEQ ID NO: 309486 - DNA, 15 bp, Homo sapiens
ggttgctgctcccaa

SEQ ID NO: 309487 - DNA, 15 bp, Homo sapiens
gttgctgctcccaag

SEQ ID NO: 309488 - DNA, 15 bp, Homo sapiens
ttgctgctcccaagg

SEQ ID NO: 309489 - DNA, 15 bp, Homo sapiens
tgctgctcccaaggg

SEQ ID NO: 309490 - DNA, 15 bp, Homo sapiens
gctgctcccaagggt

SEQ ID NO: 309491 - DNA, 15 bp, Homo sapiens
ctgctcccaagggtg

SEQ ID NO: 309492 - DNA, 15 bp, Homo sapiens
tgctcccaagggtgg

SEQ ID NO: 309493 - DNA, 15 bp, Homo sapiens
gctcccaagggtggg

SEQ ID NO: 309494 - DNA, 15 bp, Homo sapiens
ctcccaagggtgggg

SEQ ID NO: 309495 - DNA, 15 bp, Homo sapiens
tcccaagggtggggc

SEQ ID NO: 309496 - DNA, 15 bp, Homo sapiens
cccaagggtggggct

SEQ ID NO: 309497 - DNA, 15 bp, Homo sapiens
ccaagggtggggctc

SEQ ID NO: 309498 - DNA, 15 bp, Homo sapiens
caagggtggggctcc

SEQ ID NO: 309499 - DNA, 15 bp, Homo sapiens
aagggtggggctccg

SEQ ID NO: 309500 - DNA, 15 bp, Homo sapiens
agggtggggctccgg

SEQ ID NO: 309501 - DNA, 15 bp, Homo sapiens
gggtggggctccgga

SEQ ID NO: 309502 - DNA, 15 bp, Homo sapiens
ggtggggctccggag

SEQ ID NO: 309503 - DNA, 15 bp, Homo sapiens
gtggggctccggaga

SEQ ID NO: 309504 - DNA, 15 bp, Homo sapiens
tggggctccggagag

SEQ ID NO: 309505 - DNA, 15 bp, Homo sapiens
ggggctccggagagt

SEQ ID NO: 309506 - DNA, 15 bp, Homo sapiens
gggctccggagagtg

SEQ ID NO: 309507 - DNA, 15 bp, Homo sapiens
ggctccggagagtgt

SEQ ID NO: 309508 - DNA, 15 bp, Homo sapiens
gctccggagagtgtg

SEQ ID NO: 309509 - DNA, 15 bp, Homo sapiens
ctccggagagtgtgg

SEQ ID NO: 309510 - DNA, 15 bp, Homo sapiens
tccggagagtgtggc

SEQ ID NO: 309511 - DNA, 15 bp, Homo sapiens
ccggagagtgtggcg

SEQ ID NO: 309512 - DNA, 15 bp, Homo sapiens
cggagagtgtggcgc

SEQ ID NO: 309513 - DNA, 15 bp, Homo sapiens
ggagagtgtggcgcg

SEQ ID NO: 309514 - DNA, 15 bp, Homo sapiens
gagagtgtggcgcga

SEQ ID NO: 309515 - DNA, 15 bp, Homo sapiens
agagtgtggcgcgat

SEQ ID NO: 309516 - DNA, 15 bp, Homo sapiens
gagtgtggcgcgatc

SEQ ID NO: 309517 - DNA, 15 bp, Homo sapiens
agtgtggcgcgatcg

SEQ ID NO: 309518 - DNA, 15 bp, Homo sapiens
gtgtggcgcgatcgc

SEQ ID NO: 309519 - DNA, 15 bp, Homo sapiens
tgtggcgcgatcgcc

SEQ ID NO: 309520 - DNA, 15 bp, Homo sapiens
gtggcgcgatcgcca

SEQ ID NO: 309521 - DNA, 15 bp, Homo sapiens
tggcgcgatcgccaa

SEQ ID NO: 309522 - DNA, 15 bp, Homo sapiens
ggcgcgatcgccaag

SEQ ID NO: 309523 - DNA, 15 bp, Homo sapiens
gcgcgatcgccaagc

SEQ ID NO: 309524 - DNA, 15 bp, Homo sapiens
cgcgatcgccaagct

SEQ ID NO: 309525 - DNA, 15 bp, Homo sapiens
gcgatcgccaagctc

SEQ ID NO: 309526 - DNA, 15 bp, Homo sapiens
cgatcgccaagctcc

SEQ ID NO: 309527 - DNA, 15 bp, Homo sapiens
gatcgccaagctccc

SEQ ID NO: 309528 - DNA, 15 bp, Homo sapiens
atcgccaagctccct

SEQ ID NO: 309529 - DNA, 15 bp, Homo sapiens
tcgccaagctccctg

SEQ ID NO: 309530 - DNA, 15 bp, Homo sapiens
cgccaagctccctgg

SEQ ID NO: 309531 - DNA, 15 bp, Homo sapiens
gccaagctccctggc

SEQ ID NO: 309532 - DNA, 15 bp, Homo sapiens
ccaagctccctggca

SEQ ID NO: 309533 - DNA, 15 bp, Homo sapiens
caagctccctggcag

SEQ ID NO: 309534 - DNA, 15 bp, Homo sapiens
aagctccctggcagc

SEQ ID NO: 309535 - DNA, 15 bp, Homo sapiens
agctccctggcagcg

SEQ ID NO: 309536 - DNA, 15 bp, Homo sapiens
gctccctggcagcgg

SEQ ID NO: 309537 - DNA, 15 bp, Homo sapiens
ctccctggcagcggc

SEQ ID NO: 309538 - DNA, 15 bp, Homo sapiens
tccctggcagcggcc

SEQ ID NO: 309539 - DNA, 15 bp, Homo sapiens
ccctggcagcggccc

SEQ ID NO: 309540 - DNA, 15 bp, Homo sapiens
cctggcagcggccct

SEQ ID NO: 309541 - DNA, 15 bp, Homo sapiens
ctggcagcggccctg

SEQ ID NO: 309542 - DNA, 15 bp, Homo sapiens
tggcagcggccctgg

SEQ ID NO: 309543 - DNA, 15 bp, Homo sapiens
ggcagcggccctgga

SEQ ID NO: 309544 - DNA, 15 bp, Homo sapiens
gcagcggccctggag

SEQ ID NO: 309545 - DNA, 15 bp, Homo sapiens
cagcggccctggaga

SEQ ID NO: 309546 - DNA, 15 bp, Homo sapiens
agcggccctggagag

SEQ ID NO: 309547 - DNA, 15 bp, Homo sapiens
gcggccctggagaga

SEQ ID NO: 309548 - DNA, 15 bp, Homo sapiens
cggccctggagagac

SEQ ID NO: 309549 - DNA, 15 bp, Homo sapiens
ggccctggagagact

SEQ ID NO: 309550 - DNA, 15 bp, Homo sapiens
gccctggagagactg

SEQ ID NO: 309551 - DNA, 15 bp, Homo sapiens
ccctggagagactga

SEQ ID NO: 309552 - DNA, 15 bp, Homo sapiens
cctggagagactgag

SEQ ID NO: 309553 - DNA, 15 bp, Homo sapiens
ctggagagactgagg

SEQ ID NO: 309554 - DNA, 15 bp, Homo sapiens
tggagagactgaggg

SEQ ID NO: 309555 - DNA, 15 bp, Homo sapiens
ggagagactgagggg

SEQ ID NO: 309556 - DNA, 15 bp, Homo sapiens
gagagactgagggga

SEQ ID NO: 309557 - DNA, 15 bp, Homo sapiens
agagactgaggggac

SEQ ID NO: 309558 - DNA, 15 bp, Homo sapiens
gagactgaggggaca

SEQ ID NO: 309559 - DNA, 15 bp, Homo sapiens
agactgaggggacag

SEQ ID NO: 309560 - DNA, 15 bp, Homo sapiens
gactgaggggacagg

SEQ ID NO: 309561 - DNA, 15 bp, Homo sapiens
actgaggggacagga

SEQ ID NO: 309562 - DNA, 15 bp, Homo sapiens
ctgaggggacaggag

SEQ ID NO: 309563 - DNA, 15 bp, Homo sapiens
tgaggggacaggagg

SEQ ID NO: 309564 - DNA, 15 bp, Homo sapiens
gaggggacaggagga

SEQ ID NO: 309565 - DNA, 15 bp, Homo sapiens
aggggacaggaggag

SEQ ID NO: 309566 - DNA, 15 bp, Homo sapiens
ggggacaggaggagg

SEQ ID NO: 309567 - DNA, 15 bp, Homo sapiens
gggacaggaggaggg

SEQ ID NO: 309568 - DNA, 15 bp, Homo sapiens
ggacaggaggagggg

SEQ ID NO: 309569 - DNA, 15 bp, Homo sapiens
gacaggaggaggggg

SEQ ID NO: 309570 - DNA, 15 bp, Homo sapiens
acaggaggagggggg

SEQ ID NO: 309571 - DNA, 15 bp, Homo sapiens
caggaggaggggggc

SEQ ID NO: 309572 - DNA, 15 bp, Homo sapiens
aggaggaggggggcg

SEQ ID NO: 309573 - DNA, 15 bp, Homo sapiens
ggaggaggggggcgc

SEQ ID NO: 309574 - DNA, 15 bp, Homo sapiens
gaggaggggggcgcc

SEQ ID NO: 309575 - DNA, 15 bp, Homo sapiens
aggaggggggcgccc

SEQ ID NO: 309576 - DNA, 15 bp, Homo sapiens
ggaggggggcgcccc

SEQ ID NO: 309577 - DNA, 15 bp, Homo sapiens
gaggggggcgcccca

SEQ ID NO: 309578 - DNA, 15 bp, Homo sapiens
aggggggcgccccat

SEQ ID NO: 309579 - DNA, 15 bp, Homo sapiens
ggggggcgccccatt

SEQ ID NO: 309580 - DNA, 15 bp, Homo sapiens
gggggcgccccattg

SEQ ID NO: 309581 - DNA, 15 bp, Homo sapiens
ggggcgccccattgg

SEQ ID NO: 309582 - DNA, 15 bp, Homo sapiens
gggcgccccattggt

SEQ ID NO: 309583 - DNA, 15 bp, Homo sapiens
ggcgccccattggtg

SEQ ID NO: 309584 - DNA, 15 bp, Homo sapiens
gcgccccattggtgt

SEQ ID NO: 309585 - DNA, 15 bp, Homo sapiens
cgccccattggtgtg

SEQ ID NO: 309586 - DNA, 15 bp, Homo sapiens
gccccattggtgtgt

SEQ ID NO: 309587 - DNA, 15 bp, Homo sapiens
ccccattggtgtgta

SEQ ID NO: 309588 - DNA, 15 bp, Homo sapiens
cccattggtgtgtag

SEQ ID NO: 309589 - DNA, 15 bp, Homo sapiens
ccattggtgtgtagt

SEQ ID NO: 309590 - DNA, 15 bp, Homo sapiens
cattggtgtgtagtc

SEQ ID NO: 309591 - DNA, 15 bp, Homo sapiens
attggtgtgtagtcc

SEQ ID NO: 309592 - DNA, 15 bp, Homo sapiens
ttggtgtgtagtccc

SEQ ID NO: 309593 - DNA, 15 bp, Homo sapiens
tggtgtgtagtcccg

SEQ ID NO: 309594 - DNA, 15 bp, Homo sapiens
ggtgtgtagtcccgc

SEQ ID NO: 309595 - DNA, 15 bp, Homo sapiens
gtgtgtagtcccgcg

SEQ ID NO: 309596 - DNA, 15 bp, Homo sapiens
tgtgtagtcccgcgc

SEQ ID NO: 309597 - DNA, 15 bp, Homo sapiens
gtgtagtcccgcgca

SEQ ID NO: 309598 - DNA, 15 bp, Homo sapiens
tgtagtcccgcgcag

SEQ ID NO: 309599 - DNA, 15 bp, Homo sapiens
gtagtcccgcgcagt

SEQ ID NO: 309600 - DNA, 15 bp, Homo sapiens
tagtcccgcgcagtc

SEQ ID NO: 309601 - DNA, 15 bp, Homo sapiens
agtcccgcgcagtcg

SEQ ID NO: 309602 - DNA, 15 bp, Homo sapiens
gtcccgcgcagtcgc

SEQ ID NO: 309603 - DNA, 15 bp, Homo sapiens
tcccgcgcagtcgcc

SEQ ID NO: 309604 - DNA, 15 bp, Homo sapiens
cccgcgcagtcgccg

SEQ ID NO: 309605 - DNA, 15 bp, Homo sapiens
ccgcgcagtcgccgg

SEQ ID NO: 309606 - DNA, 15 bp, Homo sapiens
cgcgcagtcgccggc

SEQ ID NO: 309607 - DNA, 15 bp, Homo sapiens
gcgcagtcgccggct

SEQ ID NO: 309608 - DNA, 15 bp, Homo sapiens
cgcagtcgccggctc

SEQ ID NO: 309609 - DNA, 15 bp, Homo sapiens
gcagtcgccggctct

SEQ ID NO: 309610 - DNA, 15 bp, Homo sapiens
cagtcgccggctctc

SEQ ID NO: 309611 - DNA, 15 bp, Homo sapiens
agtcgccggctctcc

SEQ ID NO: 309612 - DNA, 15 bp, Homo sapiens
gtcgccggctctcct

SEQ ID NO: 309613 - DNA, 15 bp, Homo sapiens
tcgccggctctcctt

SEQ ID NO: 309614 - DNA, 15 bp, Homo sapiens
cgccggctctccttt

SEQ ID NO: 309615 - DNA, 15 bp, Homo sapiens
gccggctctcctttt

SEQ ID NO: 309616 - DNA, 15 bp, Homo sapiens
ccggctctccttttc

SEQ ID NO: 309617 - DNA, 15 bp, Homo sapiens
cggctctccttttcc

SEQ ID NO: 309618 - DNA, 15 bp, Homo sapiens
ggctctccttttccg

SEQ ID NO: 309619 - DNA, 15 bp, Homo sapiens
gctctccttttccgg

SEQ ID NO: 309620 - DNA, 15 bp, Homo sapiens
ctctccttttccgga

SEQ ID NO: 309621 - DNA, 15 bp, Homo sapiens
tctccttttccggac

SEQ ID NO: 309622 - DNA, 15 bp, Homo sapiens
ctccttttccggact

SEQ ID NO: 309623 - DNA, 15 bp, Homo sapiens
tccttttccggactc

SEQ ID NO: 309624 - DNA, 15 bp, Homo sapiens
ccttttccggactct

SEQ ID NO: 309625 - DNA, 15 bp, Homo sapiens
cttttccggactctg

SEQ ID NO: 309626 - DNA, 15 bp, Homo sapiens
ttttccggactctgg

SEQ ID NO: 309627 - DNA, 15 bp, Homo sapiens
tttccggactctggg

SEQ ID NO: 309628 - DNA, 15 bp, Homo sapiens
ttccggactctgggg

SEQ ID NO: 309629 - DNA, 15 bp, Homo sapiens
tccggactctgggga

SEQ ID NO: 309630 - DNA, 15 bp, Homo sapiens
ccggactctggggat

SEQ ID NO: 309631 - DNA, 15 bp, Homo sapiens
cggactctggggatc

SEQ ID NO: 309632 - DNA, 15 bp, Homo sapiens
ggactctggggatct

SEQ ID NO: 309633 - DNA, 15 bp, Homo sapiens
gactctggggatctc

SEQ ID NO: 309634 - DNA, 15 bp, Homo sapiens
actctggggatctct

SEQ ID NO: 309635 - DNA, 15 bp, Homo sapiens
ctctggggatctctt

SEQ ID NO: 309636 - DNA, 15 bp, Homo sapiens
tctggggatctcttg

SEQ ID NO: 309637 - DNA, 15 bp, Homo sapiens
ctggggatctcttgc

SEQ ID NO: 309638 - DNA, 15 bp, Homo sapiens
tggggatctcttgct

SEQ ID NO: 309639 - DNA, 15 bp, Homo sapiens
ggggatctcttgctg

SEQ ID NO: 309640 - DNA, 15 bp, Homo sapiens
gggatctcttgctgc

SEQ ID NO: 309641 - DNA, 15 bp, Homo sapiens
ggatctcttgctgca

SEQ ID NO: 309642 - DNA, 15 bp, Homo sapiens
gatctcttgctgcaa

SEQ ID NO: 309643 - DNA, 15 bp, Homo sapiens
atctcttgctgcaac

SEQ ID NO: 309644 - DNA, 15 bp, Homo sapiens
tctcttgctgcaact

SEQ ID NO: 309645 - DNA, 15 bp, Homo sapiens
ctcttgctgcaactg

SEQ ID NO: 309646 - DNA, 15 bp, Homo sapiens
tcttgctgcaactga

SEQ ID NO: 309647 - DNA, 15 bp, Homo sapiens
cttgctgcaactgac

SEQ ID NO: 309648 - DNA, 15 bp, Homo sapiens
ttgctgcaactgaca

SEQ ID NO: 309649 - DNA, 15 bp, Homo sapiens
tgctgcaactgacaa

SEQ ID NO: 309650 - DNA, 15 bp, Homo sapiens
gctgcaactgacaag

SEQ ID NO: 309651 - DNA, 15 bp, Homo sapiens
ctgcaactgacaagg

SEQ ID NO: 309652 - DNA, 15 bp, Homo sapiens
tgcaactgacaaggt

SEQ ID NO: 309653 - DNA, 15 bp, Homo sapiens
gcaactgacaaggta

SEQ ID NO: 309654 - DNA, 15 bp, Homo sapiens
caactgacaaggtaa

SEQ ID NO: 309655 - DNA, 15 bp, Homo sapiens
aactgacaaggtaat

SEQ ID NO: 309656 - DNA, 15 bp, Homo sapiens
actgacaaggtaatt

SEQ ID NO: 309657 - DNA, 15 bp, Homo sapiens
ctgacaaggtaattc

SEQ ID NO: 309658 - DNA, 15 bp, Homo sapiens
tgacaaggtaattca

SEQ ID NO: 309659 - DNA, 15 bp, Homo sapiens
gacaaggtaattcat

SEQ ID NO: 309660 - DNA, 15 bp, Homo sapiens
acaaggtaattcatg

SEQ ID NO: 309661 - DNA, 15 bp, Homo sapiens
caaggtaattcatgc

SEQ ID NO: 309662 - DNA, 15 bp, Homo sapiens
aaggtaattcatgcc

SEQ ID NO: 309663 - DNA, 15 bp, Homo sapiens
aggtaattcatgccc

SEQ ID NO: 309664 - DNA, 15 bp, Homo sapiens
ggtaattcatgcccc

SEQ ID NO: 309665 - DNA, 15 bp, Homo sapiens
gtaattcatgccccg

SEQ ID NO: 309666 - DNA, 15 bp, Homo sapiens
taattcatgccccgc

SEQ ID NO: 309667 - DNA, 15 bp, Homo sapiens
aattcatgccccgct

SEQ ID NO: 309668 - DNA, 15 bp, Homo sapiens
attcatgccccgctt

SEQ ID NO: 309669 - DNA, 15 bp, Homo sapiens
ttcatgccccgcttt

SEQ ID NO: 309670 - DNA, 15 bp, Homo sapiens
tcatgccccgctttg

SEQ ID NO: 309671 - DNA, 15 bp, Homo sapiens
catgccccgctttgg

SEQ ID NO: 309672 - DNA, 15 bp, Homo sapiens
atgccccgctttggc

SEQ ID NO: 309673 - DNA, 15 bp, Homo sapiens
tgccccgctttggcc

SEQ ID NO: 309674 - DNA, 15 bp, Homo sapiens
gccccgctttggccc

SEQ ID NO: 309675 - DNA, 15 bp, Homo sapiens
ccccgctttggcccg

SEQ ID NO: 309676 - DNA, 15 bp, Homo sapiens
cccgctttggcccgg

SEQ ID NO: 309677 - DNA, 15 bp, Homo sapiens
ccgctttggcccggg

SEQ ID NO: 309678 - DNA, 15 bp, Homo sapiens
cgctttggcccgggg

SEQ ID NO: 309679 - DNA, 15 bp, Homo sapiens
gctttggcccggggt

SEQ ID NO: 309680 - DNA, 15 bp, Homo sapiens
ctttggcccggggtc

SEQ ID NO: 309681 - DNA, 15 bp, Homo sapiens
tttggcccggggtcc

SEQ ID NO: 309682 - DNA, 15 bp, Homo sapiens
ttggcccggggtccg

SEQ ID NO: 309683 - DNA, 15 bp, Homo sapiens
tggcccggggtccga

SEQ ID NO: 309684 - DNA, 15 bp, Homo sapiens
ggcccggggtccgag

SEQ ID NO: 309685 - DNA, 15 bp, Homo sapiens
gcccggggtccgagg

SEQ ID NO: 309686 - DNA, 15 bp, Homo sapiens
cccggggtccgaggc

SEQ ID NO: 309687 - DNA, 15 bp, Homo sapiens
ccggggtccgaggct

SEQ ID NO: 309688 - DNA, 15 bp, Homo sapiens
cggggtccgaggctg

SEQ ID NO: 309689 - DNA, 15 bp, Homo sapiens
ggggtccgaggctgt

SEQ ID NO: 309690 - DNA, 15 bp, Homo sapiens
gggtccgaggctgtg

SEQ ID NO: 309691 - DNA, 15 bp, Homo sapiens
ggtccgaggctgtgg

SEQ ID NO: 309692 - DNA, 15 bp, Homo sapiens
gtccgaggctgtggt

SEQ ID NO: 309693 - DNA, 15 bp, Homo sapiens
tccgaggctgtggtt

SEQ ID NO: 309694 - DNA, 15 bp, Homo sapiens
ccgaggctgtggttg

SEQ ID NO: 309695 - DNA, 15 bp, Homo sapiens
cgaggctgtggttgc

SEQ ID NO: 309696 - DNA, 15 bp, Homo sapiens
gaggctgtggttgct

SEQ ID NO: 309697 - DNA, 15 bp, Homo sapiens
aggctgtggttgctc

SEQ ID NO: 309698 - DNA, 15 bp, Homo sapiens
ggctgtggttgctca

SEQ ID NO: 309699 - DNA, 15 bp, Homo sapiens
gctgtggttgctcaa

SEQ ID NO: 309700 - DNA, 15 bp, Homo sapiens
ctgtggttgctcaag

SEQ ID NO: 309701 - DNA, 15 bp, Homo sapiens
tgtggttgctcaagg

SEQ ID NO: 309702 - DNA, 15 bp, Homo sapiens
gtggttgctcaaggc

SEQ ID NO: 309703 - DNA, 15 bp, Homo sapiens
tggttgctcaaggcc

SEQ ID NO: 309704 - DNA, 15 bp, Homo sapiens
ggttgctcaaggcca

SEQ ID NO: 309705 - DNA, 15 bp, Homo sapiens
gttgctcaaggccac

SEQ ID NO: 309706 - DNA, 15 bp, Homo sapiens
ttgctcaaggccact

SEQ ID NO: 309707 - DNA, 15 bp, Homo sapiens
tgctcaaggccactt

SEQ ID NO: 309708 - DNA, 15 bp, Homo sapiens
gctcaaggccactta

SEQ ID NO: 309709 - DNA, 15 bp, Homo sapiens
ctcaaggccacttaa

SEQ ID NO: 309710 - DNA, 15 bp, Homo sapiens
tcaaggccacttaaa

SEQ ID NO: 309711 - DNA, 15 bp, Homo sapiens
caaggccacttaaaa

SEQ ID NO: 309712 - DNA, 15 bp, Homo sapiens
aaggccacttaaaaa

SEQ ID NO: 309713 - DNA, 15 bp, Homo sapiens
aggccacttaaaaac

SEQ ID NO: 309714 - DNA, 15 bp, Homo sapiens
ggccacttaaaaacc

SEQ ID NO: 309715 - DNA, 15 bp, Homo sapiens
gccacttaaaaacca

SEQ ID NO: 309716 - DNA, 15 bp, Homo sapiens
ccacttaaaaaccaa

SEQ ID NO: 309717 - DNA, 15 bp, Homo sapiens
cacttaaaaaccaac

SEQ ID NO: 309718 - DNA, 15 bp, Homo sapiens
acttaaaaaccaaca

SEQ ID NO: 309719 - DNA, 15 bp, Homo sapiens
cttaaaaaccaacaa

SEQ ID NO: 309720 - DNA, 15 bp, Homo sapiens
ttaaaaaccaacaaa

SEQ ID NO: 309721 - DNA, 15 bp, Homo sapiens
taaaaaccaacaaag

SEQ ID NO: 309722 - DNA, 15 bp, Homo sapiens
aaaaaccaacaaagc

SEQ ID NO: 309723 - DNA, 15 bp, Homo sapiens
aaaaccaacaaagca

SEQ ID NO: 309724 - DNA, 15 bp, Homo sapiens
aaaccaacaaagcac

SEQ ID NO: 309725 - DNA, 15 bp, Homo sapiens
aaccaacaaagcacc

SEQ ID NO: 309726 - DNA, 15 bp, Homo sapiens
accaacaaagcacca

SEQ ID NO: 309727 - DNA, 15 bp, Homo sapiens
ccaacaaagcaccaa

SEQ ID NO: 309728 - DNA, 15 bp, Homo sapiens
caacaaagcaccaat

SEQ ID NO: 309729 - DNA, 15 bp, Homo sapiens
aacaaagcaccaatt

SEQ ID NO: 309730 - DNA, 15 bp, Homo sapiens
acaaagcaccaattg

SEQ ID NO: 309731 - DNA, 15 bp, Homo sapiens
caaagcaccaattga

SEQ ID NO: 309732 - DNA, 15 bp, Homo sapiens
aaagcaccaattgaa

SEQ ID NO: 309733 - DNA, 15 bp, Homo sapiens
aagcaccaattgaag

SEQ ID NO: 309734 - DNA, 15 bp, Homo sapiens
agcaccaattgaagg

SEQ ID NO: 309735 - DNA, 15 bp, Homo sapiens
gcaccaattgaaggc

SEQ ID NO: 309736 - DNA, 15 bp, Homo sapiens
caccaattgaaggct

SEQ ID NO: 309737 - DNA, 15 bp, Homo sapiens
accaattgaaggctg

SEQ ID NO: 309738 - DNA, 15 bp, Homo sapiens
ccaattgaaggctgt

SEQ ID NO: 309739 - DNA, 15 bp, Homo sapiens
caattgaaggctgtg

SEQ ID NO: 309740 - DNA, 15 bp, Homo sapiens
aattgaaggctgtgc

SEQ ID NO: 309741 - DNA, 15 bp, Homo sapiens
attgaaggctgtgca

SEQ ID NO: 309742 - DNA, 15 bp, Homo sapiens
ttgaaggctgtgcaa

SEQ ID NO: 309743 - DNA, 15 bp, Homo sapiens
tgaaggctgtgcaac

SEQ ID NO: 309744 - DNA, 15 bp, Homo sapiens
gaaggctgtgcaact

SEQ ID NO: 309745 - DNA, 15 bp, Homo sapiens
aaggctgtgcaactt

SEQ ID NO: 309746 - DNA, 15 bp, Homo sapiens
aggctgtgcaacttt

SEQ ID NO: 309747 - DNA, 15 bp, Homo sapiens
ggctgtgcaactttc

SEQ ID NO: 309748 - DNA, 15 bp, Homo sapiens
gctgtgcaactttca

SEQ ID NO: 309749 - DNA, 15 bp, Homo sapiens
ctgtgcaactttcag

SEQ ID NO: 309750 - DNA, 15 bp, Homo sapiens
tgtgcaactttcaga

SEQ ID NO: 309751 - DNA, 15 bp, Homo sapiens
gtgcaactttcagat

SEQ ID NO: 309752 - DNA, 15 bp, Homo sapiens
tgcaactttcagatg

SEQ ID NO: 309753 - DNA, 15 bp, Homo sapiens
gcaactttcagatgg

SEQ ID NO: 309754 - DNA, 15 bp, Homo sapiens
caactttcagatggc

SEQ ID NO: 309755 - DNA, 15 bp, Homo sapiens
aactttcagatggca

SEQ ID NO: 309756 - DNA, 15 bp, Homo sapiens
actttcagatggcag

SEQ ID NO: 309757 - DNA, 15 bp, Homo sapiens
ctttcagatggcagg

SEQ ID NO: 309758 - DNA, 15 bp, Homo sapiens
tttcagatggcaggt

SEQ ID NO: 309759 - DNA, 15 bp, Homo sapiens
ttcagatggcaggtt

SEQ ID NO: 309760 - DNA, 15 bp, Homo sapiens
tcagatggcaggttg

SEQ ID NO: 309761 - DNA, 15 bp, Homo sapiens
cagatggcaggttgt

SEQ ID NO: 309762 - DNA, 15 bp, Homo sapiens
agatggcaggttgtt

SEQ ID NO: 309763 - DNA, 15 bp, Homo sapiens
gatggcaggttgttc

SEQ ID NO: 309764 - DNA, 15 bp, Homo sapiens
atggcaggttgttca

SEQ ID NO: 309765 - DNA, 15 bp, Homo sapiens
tggcaggttgttcaa

SEQ ID NO: 309766 - DNA, 15 bp, Homo sapiens
ggcaggttgttcaaa

SEQ ID NO: 309767 - DNA, 15 bp, Homo sapiens
gcaggttgttcaaag

SEQ ID NO: 309768 - DNA, 15 bp, Homo sapiens
caggttgttcaaagg

SEQ ID NO: 309769 - DNA, 15 bp, Homo sapiens
aggttgttcaaagga

SEQ ID NO: 309770 - DNA, 15 bp, Homo sapiens
ggttgttcaaaggat

SEQ ID NO: 309771 - DNA, 15 bp, Homo sapiens
gttgttcaaaggatt

SEQ ID NO: 309772 - DNA, 15 bp, Homo sapiens
ttgttcaaaggattt

SEQ ID NO: 309773 - DNA, 15 bp, Homo sapiens
tgttcaaaggatttt

SEQ ID NO: 309774 - DNA, 15 bp, Homo sapiens
gttcaaaggattttt

SEQ ID NO: 309775 - DNA, 15 bp, Homo sapiens
ttcaaaggatttttt

SEQ ID NO: 309776 - DNA, 15 bp, Homo sapiens
tcaaaggattttttc

SEQ ID NO: 309777 - DNA, 15 bp, Homo sapiens
caaaggattttttcc

SEQ ID NO: 309778 - DNA, 15 bp, Homo sapiens
aaaggattttttcct

SEQ ID NO: 309779 - DNA, 15 bp, Homo sapiens
aaggattttttcctc

SEQ ID NO: 309780 - DNA, 15 bp, Homo sapiens
aggattttttcctcc

SEQ ID NO: 309781 - DNA, 15 bp, Homo sapiens
ggattttttcctcca

SEQ ID NO: 309782 - DNA, 15 bp, Homo sapiens
gattttttcctccaa

SEQ ID NO: 309783 - DNA, 15 bp, Homo sapiens
attttttcctccaag

SEQ ID NO: 309784 - DNA, 15 bp, Homo sapiens
ttttttcctccaagc

SEQ ID NO: 309785 - DNA, 15 bp, Homo sapiens
tttttcctccaagcc

SEQ ID NO: 309786 - DNA, 15 bp, Homo sapiens
ttttcctccaagcct

SEQ ID NO: 309787 - DNA, 15 bp, Homo sapiens
tttcctccaagcctc

SEQ ID NO: 309788 - DNA, 15 bp, Homo sapiens
ttcctccaagcctca

SEQ ID NO: 309789 - DNA, 15 bp, Homo sapiens
tcctccaagcctcag

SEQ ID NO: 309790 - DNA, 15 bp, Homo sapiens
cctccaagcctcaga

SEQ ID NO: 309791 - DNA, 15 bp, Homo sapiens
ctccaagcctcagat

SEQ ID NO: 309792 - DNA, 15 bp, Homo sapiens
tccaagcctcagatt

SEQ ID NO: 309793 - DNA, 15 bp, Homo sapiens
ccaagcctcagatta

SEQ ID NO: 309794 - DNA, 15 bp, Homo sapiens
caagcctcagattat

SEQ ID NO: 309795 - DNA, 15 bp, Homo sapiens
aagcctcagattatg

SEQ ID NO: 309796 - DNA, 15 bp, Homo sapiens
agcctcagattatga

SEQ ID NO: 309797 - DNA, 15 bp, Homo sapiens
gcctcagattatgaa

SEQ ID NO: 309798 - DNA, 15 bp, Homo sapiens
cctcagattatgaaa

SEQ ID NO: 309799 - DNA, 15 bp, Homo sapiens
ctcagattatgaaag

SEQ ID NO: 309800 - DNA, 15 bp, Homo sapiens
tcagattatgaaagg

SEQ ID NO: 309801 - DNA, 15 bp, Homo sapiens
cagattatgaaaggg

SEQ ID NO: 309802 - DNA, 15 bp, Homo sapiens
agattatgaaaggga

SEQ ID NO: 309803 - DNA, 15 bp, Homo sapiens
gattatgaaagggac

SEQ ID NO: 309804 - DNA, 15 bp, Homo sapiens
attatgaaagggact

SEQ ID NO: 309805 - DNA, 15 bp, Homo sapiens
ttatgaaagggactc

SEQ ID NO: 309806 - DNA, 15 bp, Homo sapiens
tatgaaagggactca

SEQ ID NO: 309807 - DNA, 15 bp, Homo sapiens
atgaaagggactcat

SEQ ID NO: 309808 - DNA, 15 bp, Homo sapiens
tgaaagggactcatt

SEQ ID NO: 309809 - DNA, 15 bp, Homo sapiens
gaaagggactcattc

SEQ ID NO: 309810 - DNA, 15 bp, Homo sapiens
aaagggactcattcc

SEQ ID NO: 309811 - DNA, 15 bp, Homo sapiens
aagggactcattcca

SEQ ID NO: 309812 - DNA, 15 bp, Homo sapiens
agggactcattccag

SEQ ID NO: 309813 - DNA, 15 bp, Homo sapiens
gggactcattccagt

SEQ ID NO: 309814 - DNA, 15 bp, Homo sapiens
ggactcattccagtg

SEQ ID NO: 309815 - DNA, 15 bp, Homo sapiens
gactcattccagtgc

SEQ ID NO: 309816 - DNA, 15 bp, Homo sapiens
actcattccagtgcg

SEQ ID NO: 309817 - DNA, 15 bp, Homo sapiens
ctcattccagtgcgt

SEQ ID NO: 309818 - DNA, 15 bp, Homo sapiens
tcattccagtgcgtt

SEQ ID NO: 309819 - DNA, 15 bp, Homo sapiens
cattccagtgcgttt

SEQ ID NO: 309820 - DNA, 15 bp, Homo sapiens
attccagtgcgtttt

SEQ ID NO: 309821 - DNA, 15 bp, Homo sapiens
ttccagtgcgttttt

SEQ ID NO: 309822 - DNA, 15 bp, Homo sapiens
tccagtgcgtttttc

SEQ ID NO: 309823 - DNA, 15 bp, Homo sapiens
ccagtgcgtttttcg

SEQ ID NO: 309824 - DNA, 15 bp, Homo sapiens
cagtgcgtttttcga

SEQ ID NO: 309825 - DNA, 15 bp, Homo sapiens
agtgcgtttttcgag

SEQ ID NO: 309826 - DNA, 15 bp, Homo sapiens
gtgcgtttttcgagg

SEQ ID NO: 309827 - DNA, 15 bp, Homo sapiens
tgcgtttttcgagga

SEQ ID NO: 309828 - DNA, 15 bp, Homo sapiens
gcgtttttcgaggag

SEQ ID NO: 309829 - DNA, 15 bp, Homo sapiens
cgtttttcgaggagg

SEQ ID NO: 309830 - DNA, 15 bp, Homo sapiens
gtttttcgaggagga

SEQ ID NO: 309831 - DNA, 15 bp, Homo sapiens
tttttcgaggaggag

SEQ ID NO: 309832 - DNA, 15 bp, Homo sapiens
ttttcgaggaggagg

SEQ ID NO: 309833 - DNA, 15 bp, Homo sapiens
tttcgaggaggaggg

SEQ ID NO: 309834 - DNA, 15 bp, Homo sapiens
ttcgaggaggaggga

SEQ ID NO: 309835 - DNA, 15 bp, Homo sapiens
tcgaggaggagggag

SEQ ID NO: 309836 - DNA, 15 bp, Homo sapiens
cgaggaggagggaga

SEQ ID NO: 309837 - DNA, 15 bp, Homo sapiens
gaggaggagggagaa

SEQ ID NO: 309838 - DNA, 15 bp, Homo sapiens
aggaggagggagaaa

SEQ ID NO: 309839 - DNA, 15 bp, Homo sapiens
ggaggagggagaaaa

SEQ ID NO: 309840 - DNA, 15 bp, Homo sapiens
gaggagggagaaaac

SEQ ID NO: 309841 - DNA, 15 bp, Homo sapiens
aggagggagaaaacg

SEQ ID NO: 309842 - DNA, 15 bp, Homo sapiens
ggagggagaaaacgt

SEQ ID NO: 309843 - DNA, 15 bp, Homo sapiens
gagggagaaaacgtt

SEQ ID NO: 309844 - DNA, 15 bp, Homo sapiens
agggagaaaacgttg

SEQ ID NO: 309845 - DNA, 15 bp, Homo sapiens
gggagaaaacgttgc

SEQ ID NO: 309846 - DNA, 15 bp, Homo sapiens
ggagaaaacgttgcc

SEQ ID NO: 309847 - DNA, 15 bp, Homo sapiens
gagaaaacgttgccc

SEQ ID NO: 309848 - DNA, 15 bp, Homo sapiens
agaaaacgttgcccg

SEQ ID NO: 309849 - DNA, 15 bp, Homo sapiens
gaaaacgttgcccga

SEQ ID NO: 309850 - DNA, 15 bp, Homo sapiens
aaaacgttgcccgac

SEQ ID NO: 309851 - DNA, 15 bp, Homo sapiens
aaacgttgcccgacc

SEQ ID NO: 309852 - DNA, 15 bp, Homo sapiens
aacgttgcccgacct

SEQ ID NO: 309853 - DNA, 15 bp, Homo sapiens
acgttgcccgacctc

SEQ ID NO: 309854 - DNA, 15 bp, Homo sapiens
cgttgcccgacctcc

SEQ ID NO: 309855 - DNA, 15 bp, Homo sapiens
gttgcccgacctccg

SEQ ID NO: 309856 - DNA, 15 bp, Homo sapiens
ttgcccgacctccga

SEQ ID NO: 309857 - DNA, 15 bp, Homo sapiens
tgcccgacctccgag

SEQ ID NO: 309858 - DNA, 15 bp, Homo sapiens
gcccgacctccgaga

SEQ ID NO: 309859 - DNA, 15 bp, Homo sapiens
cccgacctccgagag

SEQ ID NO: 309860 - DNA, 15 bp, Homo sapiens
ccgacctccgagaga

SEQ ID NO: 309861 - DNA, 15 bp, Homo sapiens
cgacctccgagagag

SEQ ID NO: 309862 - DNA, 15 bp, Homo sapiens
gacctccgagagagc

SEQ ID NO: 309863 - DNA, 15 bp, Homo sapiens
acctccgagagagct

SEQ ID NO: 309864 - DNA, 15 bp, Homo sapiens
cctccgagagagctg

SEQ ID NO: 309865 - DNA, 15 bp, Homo sapiens
ctccgagagagctgt

SEQ ID NO: 309866 - DNA, 15 bp, Homo sapiens
tccgagagagctgtg

SEQ ID NO: 309867 - DNA, 15 bp, Homo sapiens
ccgagagagctgtgg

SEQ ID NO: 309868 - DNA, 15 bp, Homo sapiens
cgagagagctgtggg

SEQ ID NO: 309869 - DNA, 15 bp, Homo sapiens
gagagagctgtggga

SEQ ID NO: 309870 - DNA, 15 bp, Homo sapiens
agagagctgtgggac

SEQ ID NO: 309871 - DNA, 15 bp, Homo sapiens
gagagctgtgggacc

SEQ ID NO: 309872 - DNA, 15 bp, Homo sapiens
agagctgtgggacca

SEQ ID NO: 309873 - DNA, 15 bp, Homo sapiens
gagctgtgggaccag

SEQ ID NO: 309874 - DNA, 15 bp, Homo sapiens
agctgtgggaccagc

SEQ ID NO: 309875 - DNA, 15 bp, Homo sapiens
gctgtgggaccagca

SEQ ID NO: 309876 - DNA, 15 bp, Homo sapiens
ctgtgggaccagcac

SEQ ID NO: 309877 - DNA, 15 bp, Homo sapiens
tgtgggaccagcact

SEQ ID NO: 309878 - DNA, 15 bp, Homo sapiens
gtgggaccagcactt

SEQ ID NO: 309879 - DNA, 15 bp, Homo sapiens
tgggaccagcacttt

SEQ ID NO: 309880 - DNA, 15 bp, Homo sapiens
gggaccagcacttta

SEQ ID NO: 309881 - DNA, 15 bp, Homo sapiens
ggaccagcactttat

SEQ ID NO: 309882 - DNA, 15 bp, Homo sapiens
gaccagcactttatt

SEQ ID NO: 309883 - DNA, 15 bp, Homo sapiens
accagcactttattt

SEQ ID NO: 309884 - DNA, 15 bp, Homo sapiens
ccagcactttatttt

SEQ ID NO: 309885 - DNA, 15 bp, Homo sapiens
cagcactttatttta

SEQ ID NO: 309886 - DNA, 15 bp, Homo sapiens
agcactttattttac

SEQ ID NO: 309887 - DNA, 15 bp, Homo sapiens
gcactttattttaca

SEQ ID NO: 309888 - DNA, 15 bp, Homo sapiens
cactttattttacaa

SEQ ID NO: 309889 - DNA, 15 bp, Homo sapiens
actttattttacaag

SEQ ID NO: 309890 - DNA, 15 bp, Homo sapiens
ctttattttacaagg

SEQ ID NO: 309891 - DNA, 15 bp, Homo sapiens
tttattttacaagga

SEQ ID NO: 309892 - DNA, 15 bp, Homo sapiens
ttattttacaaggaa

SEQ ID NO: 309893 - DNA, 15 bp, Homo sapiens
tattttacaaggaac

SEQ ID NO: 309894 - DNA, 15 bp, Homo sapiens
attttacaaggaact

SEQ ID NO: 309895 - DNA, 15 bp, Homo sapiens
ttttacaaggaactg

SEQ ID NO: 309896 - DNA, 15 bp, Homo sapiens
tttacaaggaactgc

SEQ ID NO: 309897 - DNA, 15 bp, Homo sapiens
ttacaaggaactgca

SEQ ID NO: 309898 - DNA, 15 bp, Homo sapiens
tacaaggaactgcag

SEQ ID NO: 309899 - DNA, 15 bp, Homo sapiens
acaaggaactgcaga

SEQ ID NO: 309900 - DNA, 15 bp, Homo sapiens
caaggaactgcagag

SEQ ID NO: 309901 - DNA, 15 bp, Homo sapiens
aaggaactgcagagc

SEQ ID NO: 309902 - DNA, 15 bp, Homo sapiens
aggaactgcagagct

SEQ ID NO: 309903 - DNA, 15 bp, Homo sapiens
ggaactgcagagctc

SEQ ID NO: 309904 - DNA, 15 bp, Homo sapiens
gaactgcagagctcg

SEQ ID NO: 309905 - DNA, 15 bp, Homo sapiens
aactgcagagctcgg

SEQ ID NO: 309906 - DNA, 15 bp, Homo sapiens
actgcagagctcggg

SEQ ID NO: 309907 - DNA, 15 bp, Homo sapiens
ctgcagagctcgggt

SEQ ID NO: 309908 - DNA, 15 bp, Homo sapiens
tgcagagctcgggtt

SEQ ID NO: 309909 - DNA, 15 bp, Homo sapiens
gcagagctcgggttc

SEQ ID NO: 309910 - DNA, 15 bp, Homo sapiens
cagagctcgggttct

SEQ ID NO: 309911 - DNA, 15 bp, Homo sapiens
agagctcgggttcta

SEQ ID NO: 309912 - DNA, 15 bp, Homo sapiens
gagctcgggttctaa

SEQ ID NO: 309913 - DNA, 15 bp, Homo sapiens
agctcgggttctaac

SEQ ID NO: 309914 - DNA, 15 bp, Homo sapiens
gctcgggttctaact

SEQ ID NO: 309915 - DNA, 15 bp, Homo sapiens
ctcgggttctaactc

SEQ ID NO: 309916 - DNA, 15 bp, Homo sapiens
tcgggttctaactcc

SEQ ID NO: 309917 - DNA, 15 bp, Homo sapiens
cgggttctaactcca

SEQ ID NO: 309918 - DNA, 15 bp, Homo sapiens
gggttctaactccac

SEQ ID NO: 309919 - DNA, 15 bp, Homo sapiens
ggttctaactccacg

SEQ ID NO: 309920 - DNA, 15 bp, Homo sapiens
gttctaactccacgg

SEQ ID NO: 309921 - DNA, 15 bp, Homo sapiens
ttctaactccacggc

SEQ ID NO: 309922 - DNA, 15 bp, Homo sapiens
tctaactccacggcc

SEQ ID NO: 309923 - DNA, 15 bp, Homo sapiens
ctaactccacggccc

SEQ ID NO: 309924 - DNA, 15 bp, Homo sapiens
taactccacggcccc

SEQ ID NO: 309925 - DNA, 15 bp, Homo sapiens
aactccacggccccg

SEQ ID NO: 309926 - DNA, 15 bp, Homo sapiens
actccacggccccgc

SEQ ID NO: 309927 - DNA, 15 bp, Homo sapiens
ctccacggccccgct

SEQ ID NO: 309928 - DNA, 15 bp, Homo sapiens
tccacggccccgctc

SEQ ID NO: 309929 - DNA, 15 bp, Homo sapiens
ccacggccccgctct

SEQ ID NO: 309930 - DNA, 15 bp, Homo sapiens
cacggccccgctctc

SEQ ID NO: 309931 - DNA, 15 bp, Homo sapiens
acggccccgctctct

SEQ ID NO: 309932 - DNA, 15 bp, Homo sapiens
cggccccgctctctg

SEQ ID NO: 309933 - DNA, 15 bp, Homo sapiens
ggccccgctctctga

SEQ ID NO: 309934 - DNA, 15 bp, Homo sapiens
gccccgctctctgag

SEQ ID NO: 309935 - DNA, 15 bp, Homo sapiens
ccccgctctctgagg

SEQ ID NO: 309936 - DNA, 15 bp, Homo sapiens
cccgctctctgaggt

SEQ ID NO: 309937 - DNA, 15 bp, Homo sapiens
ccgctctctgaggtg

SEQ ID NO: 309938 - DNA, 15 bp, Homo sapiens
cgctctctgaggtgt

SEQ ID NO: 309939 - DNA, 15 bp, Homo sapiens
gctctctgaggtgtt

SEQ ID NO: 309940 - DNA, 15 bp, Homo sapiens
ctctctgaggtgttc

SEQ ID NO: 309941 - DNA, 15 bp, Homo sapiens
tctctgaggtgttca

SEQ ID NO: 309942 - DNA, 15 bp, Homo sapiens
ctctgaggtgttcag

SEQ ID NO: 309943 - DNA, 15 bp, Homo sapiens
tctgaggtgttcagg

SEQ ID NO: 309944 - DNA, 15 bp, Homo sapiens
ctgaggtgttcagga

SEQ ID NO: 309945 - DNA, 15 bp, Homo sapiens
tgaggtgttcaggac

SEQ ID NO: 309946 - DNA, 15 bp, Homo sapiens
gaggtgttcaggaca

SEQ ID NO: 309947 - DNA, 15 bp, Homo sapiens
aggtgttcaggacag

SEQ ID NO: 309948 - DNA, 15 bp, Homo sapiens
ggtgttcaggacagg

SEQ ID NO: 309949 - DNA, 15 bp, Homo sapiens
gtgttcaggacaggg

SEQ ID NO: 309950 - DNA, 15 bp, Homo sapiens
tgttcaggacagggc

SEQ ID NO: 309951 - DNA, 15 bp, Homo sapiens
gttcaggacagggcc

SEQ ID NO: 309952 - DNA, 15 bp, Homo sapiens
ttcaggacagggcct

SEQ ID NO: 309953 - DNA, 15 bp, Homo sapiens
tcaggacagggcctc

SEQ ID NO: 309954 - DNA, 15 bp, Homo sapiens
caggacagggcctcc

SEQ ID NO: 309955 - DNA, 15 bp, Homo sapiens
aggacagggcctcct

SEQ ID NO: 309956 - DNA, 15 bp, Homo sapiens
ggacagggcctcctc

SEQ ID NO: 309957 - DNA, 15 bp, Homo sapiens
gacagggcctcctct

SEQ ID NO: 309958 - DNA, 15 bp, Homo sapiens
acagggcctcctctt

SEQ ID NO: 309959 - DNA, 15 bp, Homo sapiens
cagggcctcctcttt

SEQ ID NO: 309960 - DNA, 15 bp, Homo sapiens
agggcctcctctttc

SEQ ID NO: 309961 - DNA, 15 bp, Homo sapiens
gggcctcctctttcc

SEQ ID NO: 309962 - DNA, 15 bp, Homo sapiens
ggcctcctctttccc

SEQ ID NO: 309963 - DNA, 15 bp, Homo sapiens
gcctcctctttccca

SEQ ID NO: 309964 - DNA, 15 bp, Homo sapiens
cctcctctttcccag

SEQ ID NO: 309965 - DNA, 15 bp, Homo sapiens
ctcctctttcccagc

SEQ ID NO: 309966 - DNA, 15 bp, Homo sapiens
tcctctttcccagcc

SEQ ID NO: 309967 - DNA, 15 bp, Homo sapiens
ctctttcccagcctt

SEQ ID NO: 309968 - DNA, 15 bp, Homo sapiens
tctttcccagccttc

SEQ ID NO: 309969 - DNA, 15 bp, Homo sapiens
ctttcccagccttca

SEQ ID NO: 309970 - DNA, 15 bp, Homo sapiens
tttcccagccttcag

SEQ ID NO: 309971 - DNA, 15 bp, Homo sapiens
ttcccagccttcagg

SEQ ID NO: 309972 - DNA, 15 bp, Homo sapiens
tcccagccttcaggt

SEQ ID NO: 309973 - DNA, 15 bp, Homo sapiens
cccagccttcaggtc

SEQ ID NO: 309974 - DNA, 15 bp, Homo sapiens
ccagccttcaggtca

SEQ ID NO: 309975 - DNA, 15 bp, Homo sapiens
cagccttcaggtcag

SEQ ID NO: 309976 - DNA, 15 bp, Homo sapiens
agccttcaggtcagc

SEQ ID NO: 309977 - DNA, 15 bp, Homo sapiens
gccttcaggtcagcc

SEQ ID NO: 309978 - DNA, 15 bp, Homo sapiens
ccttcaggtcagccg

SEQ ID NO: 309979 - DNA, 15 bp, Homo sapiens
cttcaggtcagccgg

SEQ ID NO: 309980 - DNA, 15 bp, Homo sapiens
ttcaggtcagccgga

SEQ ID NO: 309981 - DNA, 15 bp, Homo sapiens
tcaggtcagccggat

SEQ ID NO: 309982 - DNA, 15 bp, Homo sapiens
caggtcagccggatc

SEQ ID NO: 309983 - DNA, 15 bp, Homo sapiens
aggtcagccggatca

SEQ ID NO: 309984 - DNA, 15 bp, Homo sapiens
ggtcagccggatcac

SEQ ID NO: 309985 - DNA, 15 bp, Homo sapiens
gtcagccggatcacc

SEQ ID NO: 309986 - DNA, 15 bp, Homo sapiens
tcagccggatcacca

SEQ ID NO: 309987 - DNA, 15 bp, Homo sapiens
cagccggatcaccag

SEQ ID NO: 309988 - DNA, 15 bp, Homo sapiens
agccggatcaccagg

SEQ ID NO: 309989 - DNA, 15 bp, Homo sapiens
gccggatcaccaggg

SEQ ID NO: 309990 - DNA, 15 bp, Homo sapiens
ccggatcaccagggc

SEQ ID NO: 309991 - DNA, 15 bp, Homo sapiens
cggatcaccagggcc

SEQ ID NO: 309992 - DNA, 15 bp, Homo sapiens
ggatcaccagggcct

SEQ ID NO: 309993 - DNA, 15 bp, Homo sapiens
gatcaccagggcctt

SEQ ID NO: 309994 - DNA, 15 bp, Homo sapiens
atcaccagggccttg

SEQ ID NO: 309995 - DNA, 15 bp, Homo sapiens
tcaccagggccttgc

SEQ ID NO: 309996 - DNA, 15 bp, Homo sapiens
caccagggccttgcg

SEQ ID NO: 309997 - DNA, 15 bp, Homo sapiens
accagggccttgcgg

SEQ ID NO: 309998 - DNA, 15 bp, Homo sapiens
ccagggccttgcggg

SEQ ID NO: 309999 - DNA, 15 bp, Homo sapiens
cagggccttgcgggc

SEQ ID NO: 310000 - DNA, 15 bp, Homo sapiens
agggccttgcgggcc

SEQ ID NO: 310001 - DNA, 15 bp, Homo sapiens
gggccttgcgggcca

SEQ ID NO: 310002 - DNA, 15 bp, Homo sapiens
ggccttgcgggccag

SEQ ID NO: 310003 - DNA, 15 bp, Homo sapiens
gccttgcgggccagt

SEQ ID NO: 310004 - DNA, 15 bp, Homo sapiens
ccttgcgggccagtt

SEQ ID NO: 310005 - DNA, 15 bp, Homo sapiens
cttgcgggccagttc

SEQ ID NO: 310006 - DNA, 15 bp, Homo sapiens
ttgcgggccagttcc

SEQ ID NO: 310007 - DNA, 15 bp, Homo sapiens
tgcgggccagttccc

SEQ ID NO: 310008 - DNA, 15 bp, Homo sapiens
gcgggccagttcccc

SEQ ID NO: 310009 - DNA, 15 bp, Homo sapiens
cgggccagttccccc

SEQ ID NO: 310010 - DNA, 15 bp, Homo sapiens
gggccagttccccct

SEQ ID NO: 310011 - DNA, 15 bp, Homo sapiens
ggccagttccccctg

SEQ ID NO: 310012 - DNA, 15 bp, Homo sapiens
gccagttccccctgc

SEQ ID NO: 310013 - DNA, 15 bp, Homo sapiens
ccagttccccctgcc

SEQ ID NO: 310014 - DNA, 15 bp, Homo sapiens
cagttccccctgccg

SEQ ID NO: 310015 - DNA, 15 bp, Homo sapiens
agttccccctgccgc

SEQ ID NO: 310016 - DNA, 15 bp, Homo sapiens
gttccccctgccgcg

SEQ ID NO: 310017 - DNA, 15 bp, Homo sapiens
ttccccctgccgcgg

SEQ ID NO: 310018 - DNA, 15 bp, Homo sapiens
tccccctgccgcggt

SEQ ID NO: 310019 - DNA, 15 bp, Homo sapiens
ccccctgccgcggtt

SEQ ID NO: 310020 - DNA, 15 bp, Homo sapiens
cccctgccgcggttg

SEQ ID NO: 310021 - DNA, 15 bp, Homo sapiens
ccctgccgcggttgg

SEQ ID NO: 310022 - DNA, 15 bp, Homo sapiens
cctgccgcggttggg

SEQ ID NO: 310023 - DNA, 15 bp, Homo sapiens
ctgccgcggttggga

SEQ ID NO: 310024 - DNA, 15 bp, Homo sapiens
tgccgcggttgggag

SEQ ID NO: 310025 - DNA, 15 bp, Homo sapiens
gccgcggttgggagg

SEQ ID NO: 310026 - DNA, 15 bp, Homo sapiens
ccgcggttgggaggg

SEQ ID NO: 310027 - DNA, 15 bp, Homo sapiens
cgcggttgggagggt

SEQ ID NO: 310028 - DNA, 15 bp, Homo sapiens
gcggttgggagggtc

SEQ ID NO: 310029 - DNA, 15 bp, Homo sapiens
cggttgggagggtca

SEQ ID NO: 310030 - DNA, 15 bp, Homo sapiens
ggttgggagggtcag

SEQ ID NO: 310031 - DNA, 15 bp, Homo sapiens
gttgggagggtcagt

SEQ ID NO: 310032 - DNA, 15 bp, Homo sapiens
ttgggagggtcagtg

SEQ ID NO: 310033 - DNA, 15 bp, Homo sapiens
tgggagggtcagtgc

SEQ ID NO: 310034 - DNA, 15 bp, Homo sapiens
gggagggtcagtgca

SEQ ID NO: 310035 - DNA, 15 bp, Homo sapiens
ggagggtcagtgcag

SEQ ID NO: 310036 - DNA, 15 bp, Homo sapiens
gagggtcagtgcagc

SEQ ID NO: 310037 - DNA, 15 bp, Homo sapiens
agggtcagtgcagcg

SEQ ID NO: 310038 - DNA, 15 bp, Homo sapiens
gggtcagtgcagcgg

SEQ ID NO: 310039 - DNA, 15 bp, Homo sapiens
ggtcagtgcagcggt

SEQ ID NO: 310040 - DNA, 15 bp, Homo sapiens
gtcagtgcagcggtc

SEQ ID NO: 310041 - DNA, 15 bp, Homo sapiens
tcagtgcagcggtcg

SEQ ID NO: 310042 - DNA, 15 bp, Homo sapiens
cagtgcagcggtcgc

SEQ ID NO: 310043 - DNA, 15 bp, Homo sapiens
agtgcagcggtcgcc

SEQ ID NO: 310044 - DNA, 15 bp, Homo sapiens
gtgcagcggtcgccg

SEQ ID NO: 310045 - DNA, 15 bp, Homo sapiens
tgcagcggtcgccgc

SEQ ID NO: 310046 - DNA, 15 bp, Homo sapiens
gcagcggtcgccgcg

SEQ ID NO: 310047 - DNA, 15 bp, Homo sapiens
cagcggtcgccgcgg

SEQ ID NO: 310048 - DNA, 15 bp, Homo sapiens
agcggtcgccgcggc

SEQ ID NO: 310049 - DNA, 15 bp, Homo sapiens
gcggtcgccgcggcc

SEQ ID NO: 310050 - DNA, 15 bp, Homo sapiens
cggtcgccgcggcca

SEQ ID NO: 310051 - DNA, 15 bp, Homo sapiens
ggtcgccgcggccag

SEQ ID NO: 310052 - DNA, 15 bp, Homo sapiens
gtcgccgcggccaga

SEQ ID NO: 310053 - DNA, 15 bp, Homo sapiens
tcgccgcggccagag

SEQ ID NO: 310054 - DNA, 15 bp, Homo sapiens
cgccgcggccagagc

SEQ ID NO: 310055 - DNA, 15 bp, Homo sapiens
gccgcggccagagcg

SEQ ID NO: 310056 - DNA, 15 bp, Homo sapiens
ccgcggccagagcgc

SEQ ID NO: 310057 - DNA, 15 bp, Homo sapiens
cgcggccagagcgcg

SEQ ID NO: 310058 - DNA, 15 bp, Homo sapiens
gcggccagagcgcgc

SEQ ID NO: 310059 - DNA, 15 bp, Homo sapiens
cggccagagcgcgcg

SEQ ID NO: 310060 - DNA, 15 bp, Homo sapiens
ggccagagcgcgcgg

SEQ ID NO: 310061 - DNA, 15 bp, Homo sapiens
gccagagcgcgcgga

SEQ ID NO: 310062 - DNA, 15 bp, Homo sapiens
ccagagcgcgcggag

SEQ ID NO: 310063 - DNA, 15 bp, Homo sapiens
cagagcgcgcggagc

SEQ ID NO: 310064 - DNA, 15 bp, Homo sapiens
agagcgcgcggagct

SEQ ID NO: 310065 - DNA, 15 bp, Homo sapiens
gagcgcgcggagctc

SEQ ID NO: 310066 - DNA, 15 bp, Homo sapiens
agcgcgcggagctcg

SEQ ID NO: 310067 - DNA, 15 bp, Homo sapiens
gcgcgcggagctcgg

SEQ ID NO: 310068 - DNA, 15 bp, Homo sapiens
cgcgcggagctcggg

SEQ ID NO: 310069 - DNA, 15 bp, Homo sapiens
gcgcggagctcgggg

SEQ ID NO: 310070 - DNA, 15 bp, Homo sapiens
cgcggagctcggggg

SEQ ID NO: 310071 - DNA, 15 bp, Homo sapiens
gcggagctcggggga

SEQ ID NO: 310072 - DNA, 15 bp, Homo sapiens
cggagctcgggggag

SEQ ID NO: 310073 - DNA, 15 bp, Homo sapiens
ggagctcgggggagg

SEQ ID NO: 310074 - DNA, 15 bp, Homo sapiens
gagctcgggggaggc

SEQ ID NO: 310075 - DNA, 15 bp, Homo sapiens
agctcgggggaggcc

SEQ ID NO: 310076 - DNA, 15 bp, Homo sapiens
gctcgggggaggccg

SEQ ID NO: 310077 - DNA, 15 bp, Homo sapiens
ctcgggggaggccgg

SEQ ID NO: 310078 - DNA, 15 bp, Homo sapiens
tcgggggaggccgga

SEQ ID NO: 310079 - DNA, 15 bp, Homo sapiens
cgggggaggccggat

SEQ ID NO: 310080 - DNA, 15 bp, Homo sapiens
gggggaggccggatt

SEQ ID NO: 310081 - DNA, 15 bp, Homo sapiens
ggggaggccggattc

SEQ ID NO: 310082 - DNA, 15 bp, Homo sapiens
gggaggccggattcc

SEQ ID NO: 310083 - DNA, 15 bp, Homo sapiens
ggaggccggattccc

SEQ ID NO: 310084 - DNA, 15 bp, Homo sapiens
gaggccggattccct

SEQ ID NO: 310085 - DNA, 15 bp, Homo sapiens
aggccggattcccta

SEQ ID NO: 310086 - DNA, 15 bp, Homo sapiens
ggccggattccctag

SEQ ID NO: 310087 - DNA, 15 bp, Homo sapiens
gccggattccctagg

SEQ ID NO: 310088 - DNA, 15 bp, Homo sapiens
ccggattccctaggt

SEQ ID NO: 310089 - DNA, 15 bp, Homo sapiens
cggattccctaggtc

SEQ ID NO: 310090 - DNA, 15 bp, Homo sapiens
ggattccctaggtct

SEQ ID NO: 310091 - DNA, 15 bp, Homo sapiens
gattccctaggtctg

SEQ ID NO: 310092 - DNA, 15 bp, Homo sapiens
attccctaggtctga

SEQ ID NO: 310093 - DNA, 15 bp, Homo sapiens
ttccctaggtctgag

SEQ ID NO: 310094 - DNA, 15 bp, Homo sapiens
tccctaggtctgagc

SEQ ID NO: 310095 - DNA, 15 bp, Homo sapiens
ccctaggtctgagcc

SEQ ID NO: 310096 - DNA, 15 bp, Homo sapiens
cctaggtctgagccg

SEQ ID NO: 310097 - DNA, 15 bp, Homo sapiens
ctaggtctgagccga

SEQ ID NO: 310098 - DNA, 15 bp, Homo sapiens
taggtctgagccgac

SEQ ID NO: 310099 - DNA, 15 bp, Homo sapiens
aggtctgagccgacc

SEQ ID NO: 310100 - DNA, 15 bp, Homo sapiens
ggtctgagccgaccc

SEQ ID NO: 310101 - DNA, 15 bp, Homo sapiens
gtctgagccgaccct

SEQ ID NO: 310102 - DNA, 15 bp, Homo sapiens
tctgagccgaccctc

SEQ ID NO: 310103 - DNA, 15 bp, Homo sapiens
ctgagccgaccctcc

SEQ ID NO: 310104 - DNA, 15 bp, Homo sapiens
tgagccgaccctccc

SEQ ID NO: 310105 - DNA, 15 bp, Homo sapiens
gagccgaccctcccg

SEQ ID NO: 310106 - DNA, 15 bp, Homo sapiens
agccgaccctcccgg

SEQ ID NO: 310107 - DNA, 15 bp, Homo sapiens
gccgaccctcccggc

SEQ ID NO: 310108 - DNA, 15 bp, Homo sapiens
ccgaccctcccggcc

SEQ ID NO: 310109 - DNA, 15 bp, Homo sapiens
cgaccctcccggccg

SEQ ID NO: 310110 - DNA, 15 bp, Homo sapiens
gaccctcccggccgc

SEQ ID NO: 310111 - DNA, 15 bp, Homo sapiens
accctcccggccgcc

SEQ ID NO: 310112 - DNA, 15 bp, Homo sapiens
ccctcccggccgccc

SEQ ID NO: 310113 - DNA, 15 bp, Homo sapiens
cctcccggccgcccg

SEQ ID NO: 310114 - DNA, 15 bp, Homo sapiens
ctcccggccgcccgg

SEQ ID NO: 310115 - DNA, 15 bp, Homo sapiens
tcccggccgcccggc

SEQ ID NO: 310116 - DNA, 15 bp, Homo sapiens
cccggccgcccggcc

SEQ ID NO: 310117 - DNA, 15 bp, Homo sapiens
ccggccgcccggccg

SEQ ID NO: 310118 - DNA, 15 bp, Homo sapiens
cggccgcccggccgg

SEQ ID NO: 310119 - DNA, 15 bp, Homo sapiens
ggccgcccggccggg

SEQ ID NO: 310120 - DNA, 15 bp, Homo sapiens
gccgcccggccgggc

SEQ ID NO: 310121 - DNA, 15 bp, Homo sapiens
ccgcccggccgggcg

SEQ ID NO: 310122 - DNA, 15 bp, Homo sapiens
cgcccggccgggcgg

SEQ ID NO: 310123 - DNA, 15 bp, Homo sapiens
gcccggccgggcggc

SEQ ID NO: 310124 - DNA, 15 bp, Homo sapiens
cccggccgggcggca

SEQ ID NO: 310125 - DNA, 15 bp, Homo sapiens
ccggccgggcggcag

SEQ ID NO: 310126 - DNA, 15 bp, Homo sapiens
cggccgggcggcagc

SEQ ID NO: 310127 - DNA, 15 bp, Homo sapiens
ggccgggcggcagcg

SEQ ID NO: 310128 - DNA, 15 bp, Homo sapiens
gccgggcggcagcga

SEQ ID NO: 310129 - DNA, 15 bp, Homo sapiens
ccgggcggcagcgac

SEQ ID NO: 310130 - DNA, 15 bp, Homo sapiens
cgggcggcagcgacc

SEQ ID NO: 310131 - DNA, 15 bp, Homo sapiens
gggcggcagcgaccg

SEQ ID NO: 310132 - DNA, 15 bp, Homo sapiens
ggcggcagcgaccgc

SEQ ID NO: 310133 - DNA, 15 bp, Homo sapiens
gcggcagcgaccgca

SEQ ID NO: 310134 - DNA, 15 bp, Homo sapiens
cggcagcgaccgcat

SEQ ID NO: 310135 - DNA, 15 bp, Homo sapiens
ggcagcgaccgcatc

SEQ ID NO: 310136 - DNA, 15 bp, Homo sapiens
gcagcgaccgcatcc

SEQ ID NO: 310137 - DNA, 15 bp, Homo sapiens
cagcgaccgcatcca

SEQ ID NO: 310138 - DNA, 15 bp, Homo sapiens
agcgaccgcatccat

SEQ ID NO: 310139 - DNA, 15 bp, Homo sapiens
gcgaccgcatccatt

SEQ ID NO: 310140 - DNA, 15 bp, Homo sapiens
cgaccgcatccattc

SEQ ID NO: 310141 - DNA, 15 bp, Homo sapiens
gaccgcatccattcc

SEQ ID NO: 310142 - DNA, 15 bp, Homo sapiens
accgcatccattcct

SEQ ID NO: 310143 - DNA, 15 bp, Homo sapiens
ccgcatccattcctt

SEQ ID NO: 310144 - DNA, 15 bp, Homo sapiens
cgcatccattccttt

SEQ ID NO: 310145 - DNA, 15 bp, Homo sapiens
gcatccattcctttg

SEQ ID NO: 310146 - DNA, 15 bp, Homo sapiens
catccattcctttgt

SEQ ID NO: 310147 - DNA, 15 bp, Homo sapiens
atccattcctttgta

SEQ ID NO: 310148 - DNA, 15 bp, Homo sapiens
tccattcctttgtaa

SEQ ID NO: 310149 - DNA, 15 bp, Homo sapiens
ccattcctttgtaag

SEQ ID NO: 310150 - DNA, 15 bp, Homo sapiens
cattcctttgtaagt

SEQ ID NO: 310151 - DNA, 15 bp, Homo sapiens
attcctttgtaagtt

SEQ ID NO: 310152 - DNA, 15 bp, Homo sapiens
ttcctttgtaagttg

SEQ ID NO: 310153 - DNA, 15 bp, Homo sapiens
tcctttgtaagttgc

SEQ ID NO: 310154 - DNA, 15 bp, Homo sapiens
cctttgtaagttgca

SEQ ID NO: 310155 - DNA, 15 bp, Homo sapiens
ctttgtaagttgcac

SEQ ID NO: 310156 - DNA, 15 bp, Homo sapiens
tttgtaagttgcacc

SEQ ID NO: 310157 - DNA, 15 bp, Homo sapiens
ttgtaagttgcaccg

SEQ ID NO: 310158 - DNA, 15 bp, Homo sapiens
tgtaagttgcaccgg

SEQ ID NO: 310159 - DNA, 15 bp, Homo sapiens
gtaagttgcaccggc

SEQ ID NO: 310160 - DNA, 15 bp, Homo sapiens
taagttgcaccggcc

SEQ ID NO: 310161 - DNA, 15 bp, Homo sapiens
aagttgcaccggcct

SEQ ID NO: 310162 - DNA, 15 bp, Homo sapiens
agttgcaccggcctc

SEQ ID NO: 310163 - DNA, 15 bp, Homo sapiens
gttgcaccggcctca

SEQ ID NO: 310164 - DNA, 15 bp, Homo sapiens
ttgcaccggcctcag

SEQ ID NO: 310165 - DNA, 15 bp, Homo sapiens
tgcaccggcctcagg

SEQ ID NO: 310166 - DNA, 15 bp, Homo sapiens
gcaccggcctcagga

SEQ ID NO: 310167 - DNA, 15 bp, Homo sapiens
caccggcctcaggaa

SEQ ID NO: 310168 - DNA, 15 bp, Homo sapiens
accggcctcaggaag

SEQ ID NO: 310169 - DNA, 15 bp, Homo sapiens
ccggcctcaggaagt

SEQ ID NO: 310170 - DNA, 15 bp, Homo sapiens
cggcctcaggaagtc

SEQ ID NO: 310171 - DNA, 15 bp, Homo sapiens
ggcctcaggaagtcg

SEQ ID NO: 310172 - DNA, 15 bp, Homo sapiens
gcctcaggaagtcga

SEQ ID NO: 310173 - DNA, 15 bp, Homo sapiens
cctcaggaagtcgat

SEQ ID NO: 310174 - DNA, 15 bp, Homo sapiens
ctcaggaagtcgatc

SEQ ID NO: 310175 - DNA, 15 bp, Homo sapiens
tcaggaagtcgatct

SEQ ID NO: 310176 - DNA, 15 bp, Homo sapiens
caggaagtcgatctg

SEQ ID NO: 310177 - DNA, 15 bp, Homo sapiens
aggaagtcgatctgg

SEQ ID NO: 310178 - DNA, 15 bp, Homo sapiens
ggaagtcgatctggg

SEQ ID NO: 310179 - DNA, 15 bp, Homo sapiens
gaagtcgatctgggc

SEQ ID NO: 310180 - DNA, 15 bp, Homo sapiens
aagtcgatctgggcc

SEQ ID NO: 310181 - DNA, 15 bp, Homo sapiens
agtcgatctgggccc

SEQ ID NO: 310182 - DNA, 15 bp, Homo sapiens
gtcgatctgggccct

SEQ ID NO: 310183 - DNA, 15 bp, Homo sapiens
tcgatctgggccctc

SEQ ID NO: 310184 - DNA, 15 bp, Homo sapiens
cgatctgggccctcc

SEQ ID NO: 310185 - DNA, 15 bp, Homo sapiens
gatctgggccctccc

SEQ ID NO: 310186 - DNA, 15 bp, Homo sapiens
atctgggccctcccg

SEQ ID NO: 310187 - DNA, 15 bp, Homo sapiens
tctgggccctcccgg

SEQ ID NO: 310188 - DNA, 15 bp, Homo sapiens
ctgggccctcccggt

SEQ ID NO: 310189 - DNA, 15 bp, Homo sapiens
tgggccctcccggtt

SEQ ID NO: 310190 - DNA, 15 bp, Homo sapiens
gggccctcccggttc

SEQ ID NO: 310191 - DNA, 15 bp, Homo sapiens
ggccctcccggttcg

SEQ ID NO: 310192 - DNA, 15 bp, Homo sapiens
gccctcccggttcgt

SEQ ID NO: 310193 - DNA, 15 bp, Homo sapiens
ccctcccggttcgtt

SEQ ID NO: 310194 - DNA, 15 bp, Homo sapiens
cctcccggttcgttg

SEQ ID NO: 310195 - DNA, 15 bp, Homo sapiens
ctcccggttcgttgg

SEQ ID NO: 310196 - DNA, 15 bp, Homo sapiens
tcccggttcgttggc

SEQ ID NO: 310197 - DNA, 15 bp, Homo sapiens
cccggttcgttggcg

SEQ ID NO: 310198 - DNA, 15 bp, Homo sapiens
ccggttcgttggcgg

SEQ ID NO: 310199 - DNA, 15 bp, Homo sapiens
cggttcgttggcggt

SEQ ID NO: 310200 - DNA, 15 bp, Homo sapiens
ggttcgttggcggtg

SEQ ID NO: 310201 - DNA, 15 bp, Homo sapiens
gttcgttggcggtgg

SEQ ID NO: 310202 - DNA, 15 bp, Homo sapiens
ttcgttggcggtggg

SEQ ID NO: 310203 - DNA, 15 bp, Homo sapiens
tcgttggcggtgggc

SEQ ID NO: 310204 - DNA, 15 bp, Homo sapiens
cgttggcggtgggcg

SEQ ID NO: 310205 - DNA, 15 bp, Homo sapiens
gttggcggtgggcgt

SEQ ID NO: 310206 - DNA, 15 bp, Homo sapiens
ttggcggtgggcgtg

SEQ ID NO: 310207 - DNA, 15 bp, Homo sapiens
tggcggtgggcgtgg

SEQ ID NO: 310208 - DNA, 15 bp, Homo sapiens
ggcggtgggcgtggg

SEQ ID NO: 310209 - DNA, 15 bp, Homo sapiens
gcggtgggcgtggga

SEQ ID NO: 310210 - DNA, 15 bp, Homo sapiens
cggtgggcgtgggag

SEQ ID NO: 310211 - DNA, 15 bp, Homo sapiens
ggtgggcgtgggaga

SEQ ID NO: 310212 - DNA, 15 bp, Homo sapiens
gtgggcgtgggagac

SEQ ID NO: 310213 - DNA, 15 bp, Homo sapiens
tgggcgtgggagacg

SEQ ID NO: 310214 - DNA, 15 bp, Homo sapiens
gggcgtgggagacgc

SEQ ID NO: 310215 - DNA, 15 bp, Homo sapiens
ggcgtgggagacgca

SEQ ID NO: 310216 - DNA, 15 bp, Homo sapiens
gcgtgggagacgcag

SEQ ID NO: 310217 - DNA, 15 bp, Homo sapiens
cgtgggagacgcagc

SEQ ID NO: 310218 - DNA, 15 bp, Homo sapiens
gtgggagacgcagcc

SEQ ID NO: 310219 - DNA, 15 bp, Homo sapiens
tgggagacgcagcct

SEQ ID NO: 310220 - DNA, 15 bp, Homo sapiens
gggagacgcagcctg

SEQ ID NO: 310221 - DNA, 15 bp, Homo sapiens
ggagacgcagcctgc

SEQ ID NO: 310222 - DNA, 15 bp, Homo sapiens
gagacgcagcctgcg

SEQ ID NO: 310223 - DNA, 15 bp, Homo sapiens
agacgcagcctgcgg

SEQ ID NO: 310224 - DNA, 15 bp, Homo sapiens
gacgcagcctgcgga

SEQ ID NO: 310225 - DNA, 15 bp, Homo sapiens
acgcagcctgcggat

SEQ ID NO: 310226 - DNA, 15 bp, Homo sapiens
cgcagcctgcggata

SEQ ID NO: 310227 - DNA, 15 bp, Homo sapiens
gcagcctgcggatag

SEQ ID NO: 310228 - DNA, 15 bp, Homo sapiens
cagcctgcggatagc

SEQ ID NO: 310229 - DNA, 15 bp, Homo sapiens
agcctgcggatagct

SEQ ID NO: 310230 - DNA, 15 bp, Homo sapiens
gcctgcggatagctc

SEQ ID NO: 310231 - DNA, 15 bp, Homo sapiens
cctgcggatagctca

SEQ ID NO: 310232 - DNA, 15 bp, Homo sapiens
ctgcggatagctcag

SEQ ID NO: 310233 - DNA, 15 bp, Homo sapiens
tgcggatagctcagg

SEQ ID NO: 310234 - DNA, 15 bp, Homo sapiens
gcggatagctcaggg

SEQ ID NO: 310235 - DNA, 15 bp, Homo sapiens
cggatagctcagggt

SEQ ID NO: 310236 - DNA, 15 bp, Homo sapiens
ggatagctcagggtc

SEQ ID NO: 310237 - DNA, 15 bp, Homo sapiens
gatagctcagggtca

SEQ ID NO: 310238 - DNA, 15 bp, Homo sapiens
atagctcagggtcag

SEQ ID NO: 310239 - DNA, 15 bp, Homo sapiens
tagctcagggtcagg

SEQ ID NO: 310240 - DNA, 15 bp, Homo sapiens
agctcagggtcaggg

SEQ ID NO: 310241 - DNA, 15 bp, Homo sapiens
gctcagggtcagggg

SEQ ID NO: 310242 - DNA, 15 bp, Homo sapiens
ctcagggtcagggga

SEQ ID NO: 310243 - DNA, 15 bp, Homo sapiens
tcagggtcaggggag

SEQ ID NO: 310244 - DNA, 15 bp, Homo sapiens
cagggtcaggggaga

SEQ ID NO: 310245 - DNA, 15 bp, Homo sapiens
agggtcaggggagag

SEQ ID NO: 310246 - DNA, 15 bp, Homo sapiens
gggtcaggggagagg

SEQ ID NO: 310247 - DNA, 15 bp, Homo sapiens
ggtcaggggagaggt

SEQ ID NO: 310248 - DNA, 15 bp, Homo sapiens
gtcaggggagaggtg

SEQ ID NO: 310249 - DNA, 15 bp, Homo sapiens
tcaggggagaggtgg

SEQ ID NO: 310250 - DNA, 15 bp, Homo sapiens
caggggagaggtgga

SEQ ID NO: 310251 - DNA, 15 bp, Homo sapiens
aggggagaggtggag

SEQ ID NO: 310252 - DNA, 15 bp, Homo sapiens
ggggagaggtggagg

SEQ ID NO: 310253 - DNA, 15 bp, Homo sapiens
gggagaggtggagga

SEQ ID NO: 310254 - DNA, 15 bp, Homo sapiens
ggagaggtggaggaa

SEQ ID NO: 310255 - DNA, 15 bp, Homo sapiens
gagaggtggaggaat

SEQ ID NO: 310256 - DNA, 15 bp, Homo sapiens
agaggtggaggaatg

SEQ ID NO: 310257 - DNA, 15 bp, Homo sapiens
gaggtggaggaatgc

SEQ ID NO: 310258 - DNA, 15 bp, Homo sapiens
aggtggaggaatgcg

SEQ ID NO: 310259 - DNA, 15 bp, Homo sapiens
ggtggaggaatgcga

SEQ ID NO: 310260 - DNA, 15 bp, Homo sapiens
gtggaggaatgcgaa

SEQ ID NO: 310261 - DNA, 15 bp, Homo sapiens
tggaggaatgcgaag

SEQ ID NO: 310262 - DNA, 15 bp, Homo sapiens
ggaggaatgcgaagc

SEQ ID NO: 310263 - DNA, 15 bp, Homo sapiens
gaggaatgcgaagct

SEQ ID NO: 310264 - DNA, 15 bp, Homo sapiens
aggaatgcgaagctt

SEQ ID NO: 310265 - DNA, 15 bp, Homo sapiens
ggaatgcgaagcttg

SEQ ID NO: 310266 - DNA, 15 bp, Homo sapiens
gaatgcgaagcttgt

SEQ ID NO: 310267 - DNA, 15 bp, Homo sapiens
aatgcgaagcttgtg

SEQ ID NO: 310268 - DNA, 15 bp, Homo sapiens
atgcgaagcttgtgg

SEQ ID NO: 310269 - DNA, 15 bp, Homo sapiens
tgcgaagcttgtggg

SEQ ID NO: 310270 - DNA, 15 bp, Homo sapiens
gcgaagcttgtgggt

SEQ ID NO: 310271 - DNA, 15 bp, Homo sapiens
cgaagcttgtgggta

SEQ ID NO: 310272 - DNA, 15 bp, Homo sapiens
gaagcttgtgggtag

SEQ ID NO: 310273 - DNA, 15 bp, Homo sapiens
aagcttgtgggtagt

SEQ ID NO: 310274 - DNA, 15 bp, Homo sapiens
agcttgtgggtagtt

SEQ ID NO: 310275 - DNA, 15 bp, Homo sapiens
gcttgtgggtagttc

SEQ ID NO: 310276 - DNA, 15 bp, Homo sapiens
cttgtgggtagttct

SEQ ID NO: 310277 - DNA, 15 bp, Homo sapiens
ttgtgggtagttctg

SEQ ID NO: 310278 - DNA, 15 bp, Homo sapiens
tgtgggtagttctgc

SEQ ID NO: 310279 - DNA, 15 bp, Homo sapiens
gtgggtagttctgcg

SEQ ID NO: 310280 - DNA, 15 bp, Homo sapiens
tgggtagttctgcgg

SEQ ID NO: 310281 - DNA, 15 bp, Homo sapiens
gggtagttctgcggt

SEQ ID NO: 310282 - DNA, 15 bp, Homo sapiens
ggtagttctgcggtg

SEQ ID NO: 310283 - DNA, 15 bp, Homo sapiens
gtagttctgcggtga

SEQ ID NO: 310284 - DNA, 15 bp, Homo sapiens
tagttctgcggtgac

SEQ ID NO: 310285 - DNA, 15 bp, Homo sapiens
agttctgcggtgacg

SEQ ID NO: 310286 - DNA, 15 bp, Homo sapiens
gttctgcggtgacgg

SEQ ID NO: 310287 - DNA, 15 bp, Homo sapiens
ttctgcggtgacgga

SEQ ID NO: 310288 - DNA, 15 bp, Homo sapiens
tctgcggtgacggac

SEQ ID NO: 310289 - DNA, 15 bp, Homo sapiens
ctgcggtgacggaca

SEQ ID NO: 310290 - DNA, 15 bp, Homo sapiens
tgcggtgacggacag

SEQ ID NO: 310291 - DNA, 15 bp, Homo sapiens
gcggtgacggacagg

SEQ ID NO: 310292 - DNA, 15 bp, Homo sapiens
cggtgacggacaggg

SEQ ID NO: 310293 - DNA, 15 bp, Homo sapiens
ggtgacggacagggt

SEQ ID NO: 310294 - DNA, 15 bp, Homo sapiens
gtgacggacagggtt

SEQ ID NO: 310295 - DNA, 15 bp, Homo sapiens
tgacggacagggttg

SEQ ID NO: 310296 - DNA, 15 bp, Homo sapiens
gacggacagggttgg

SEQ ID NO: 310297 - DNA, 15 bp, Homo sapiens
acggacagggttggc

SEQ ID NO: 310298 - DNA, 15 bp, Homo sapiens
cggacagggttggcg

SEQ ID NO: 310299 - DNA, 15 bp, Homo sapiens
ggacagggttggcgt

SEQ ID NO: 310300 - DNA, 15 bp, Homo sapiens
gacagggttggcgtg

SEQ ID NO: 310301 - DNA, 15 bp, Homo sapiens
acagggttggcgtgg

SEQ ID NO: 310302 - DNA, 15 bp, Homo sapiens
cagggttggcgtgga

SEQ ID NO: 310303 - DNA, 15 bp, Homo sapiens
agggttggcgtggaa

SEQ ID NO: 310304 - DNA, 15 bp, Homo sapiens
gggttggcgtggaac

SEQ ID NO: 310305 - DNA, 15 bp, Homo sapiens
ggttggcgtggaacc

SEQ ID NO: 310306 - DNA, 15 bp, Homo sapiens
gttggcgtggaacca

SEQ ID NO: 310307 - DNA, 15 bp, Homo sapiens
ttggcgtggaaccat

SEQ ID NO: 310308 - DNA, 15 bp, Homo sapiens
tggcgtggaaccatt

SEQ ID NO: 310309 - DNA, 15 bp, Homo sapiens
ggcgtggaaccattc

SEQ ID NO: 310310 - DNA, 15 bp, Homo sapiens
gcgtggaaccattcc

SEQ ID NO: 310311 - DNA, 15 bp, Homo sapiens
cgtggaaccattccc

SEQ ID NO: 310312 - DNA, 15 bp, Homo sapiens
gtggaaccattcccc

SEQ ID NO: 310313 - DNA, 15 bp, Homo sapiens
tggaaccattccccg

SEQ ID NO: 310314 - DNA, 15 bp, Homo sapiens
ggaaccattccccgc

SEQ ID NO: 310315 - DNA, 15 bp, Homo sapiens
gaaccattccccgcc

SEQ ID NO: 310316 - DNA, 15 bp, Homo sapiens
aaccattccccgccc

SEQ ID NO: 310317 - DNA, 15 bp, Homo sapiens
accattccccgcccc

SEQ ID NO: 310318 - DNA, 15 bp, Homo sapiens
ccattccccgcccct

SEQ ID NO: 310319 - DNA, 15 bp, Homo sapiens
cattccccgcccctt

SEQ ID NO: 310320 - DNA, 15 bp, Homo sapiens
attccccgccccttt

SEQ ID NO: 310321 - DNA, 15 bp, Homo sapiens
ttccccgcccctttt

SEQ ID NO: 310322 - DNA, 15 bp, Homo sapiens
tccccgcccctttta

SEQ ID NO: 310323 - DNA, 15 bp, Homo sapiens
ccccgccccttttac

SEQ ID NO: 310324 - DNA, 15 bp, Homo sapiens
cccgccccttttacc

SEQ ID NO: 310325 - DNA, 15 bp, Homo sapiens
ccgccccttttacca

SEQ ID NO: 310326 - DNA, 15 bp, Homo sapiens
cgccccttttaccag

SEQ ID NO: 310327 - DNA, 15 bp, Homo sapiens
gccccttttaccagc

SEQ ID NO: 310328 - DNA, 15 bp, Homo sapiens
ccccttttaccagcc

SEQ ID NO: 310329 - DNA, 15 bp, Homo sapiens
cccttttaccagcct

SEQ ID NO: 310330 - DNA, 15 bp, Homo sapiens
ccttttaccagcctt

SEQ ID NO: 310331 - DNA, 15 bp, Homo sapiens
cttttaccagccttt

SEQ ID NO: 310332 - DNA, 15 bp, Homo sapiens
ttttaccagccttta

SEQ ID NO: 310333 - DNA, 15 bp, Homo sapiens
tttaccagcctttat

SEQ ID NO: 310334 - DNA, 15 bp, Homo sapiens
ttaccagcctttatg

SEQ ID NO: 310335 - DNA, 15 bp, Homo sapiens
taccagcctttatgg

SEQ ID NO: 310336 - DNA, 15 bp, Homo sapiens
accagcctttatggg

SEQ ID NO: 310337 - DNA, 15 bp, Homo sapiens
ccagcctttatggga

SEQ ID NO: 310338 - DNA, 15 bp, Homo sapiens
cagcctttatgggac

SEQ ID NO: 310339 - DNA, 15 bp, Homo sapiens
agcctttatgggacc

SEQ ID NO: 310340 - DNA, 15 bp, Homo sapiens
gcctttatgggaccg

SEQ ID NO: 310341 - DNA, 15 bp, Homo sapiens
cctttatgggaccga

SEQ ID NO: 310342 - DNA, 15 bp, Homo sapiens
ctttatgggaccgat

SEQ ID NO: 310343 - DNA, 15 bp, Homo sapiens
tttatgggaccgatg

SEQ ID NO: 310344 - DNA, 15 bp, Homo sapiens
ttatgggaccgatga

SEQ ID NO: 310345 - DNA, 15 bp, Homo sapiens
tatgggaccgatgag

SEQ ID NO: 310346 - DNA, 15 bp, Homo sapiens
atgggaccgatgaga

SEQ ID NO: 310347 - DNA, 15 bp, Homo sapiens
tgggaccgatgagac

SEQ ID NO: 310348 - DNA, 15 bp, Homo sapiens
gggaccgatgagaca

SEQ ID NO: 310349 - DNA, 15 bp, Homo sapiens
ggaccgatgagacaa

SEQ ID NO: 310350 - DNA, 15 bp, Homo sapiens
gaccgatgagacaac

SEQ ID NO: 310351 - DNA, 15 bp, Homo sapiens
accgatgagacaact

SEQ ID NO: 310352 - DNA, 15 bp, Homo sapiens
ccgatgagacaactc

SEQ ID NO: 310353 - DNA, 15 bp, Homo sapiens
cgatgagacaactct

SEQ ID NO: 310354 - DNA, 15 bp, Homo sapiens
gatgagacaactctt

SEQ ID NO: 310355 - DNA, 15 bp, Homo sapiens
atgagacaactcttt

SEQ ID NO: 310356 - DNA, 15 bp, Homo sapiens
tgagacaactcttta

SEQ ID NO: 310357 - DNA, 15 bp, Homo sapiens
gagacaactctttaa

SEQ ID NO: 310358 - DNA, 15 bp, Homo sapiens
agacaactctttaac

SEQ ID NO: 310359 - DNA, 15 bp, Homo sapiens
gacaactctttaact

SEQ ID NO: 310360 - DNA, 15 bp, Homo sapiens
acaactctttaactc

SEQ ID NO: 310361 - DNA, 15 bp, Homo sapiens
caactctttaactct

SEQ ID NO: 310362 - DNA, 15 bp, Homo sapiens
aactctttaactctc

SEQ ID NO: 310363 - DNA, 15 bp, Homo sapiens
actctttaactctcc

SEQ ID NO: 310364 - DNA, 15 bp, Homo sapiens
ctctttaactctcct

SEQ ID NO: 310365 - DNA, 15 bp, Homo sapiens
tctttaactctcctt

SEQ ID NO: 310366 - DNA, 15 bp, Homo sapiens
ctttaactctccttt

SEQ ID NO: 310367 - DNA, 15 bp, Homo sapiens
tttaactctcctttg

SEQ ID NO: 310368 - DNA, 15 bp, Homo sapiens
ttaactctcctttgg

SEQ ID NO: 310369 - DNA, 15 bp, Homo sapiens
taactctcctttggg

SEQ ID NO: 310370 - DNA, 15 bp, Homo sapiens
aactctcctttgggt

SEQ ID NO: 310371 - DNA, 15 bp, Homo sapiens
actctcctttgggtg

SEQ ID NO: 310372 - DNA, 15 bp, Homo sapiens
ctctcctttgggtgt

SEQ ID NO: 310373 - DNA, 15 bp, Homo sapiens
tctcctttgggtgtt

SEQ ID NO: 310374 - DNA, 15 bp, Homo sapiens
ctcctttgggtgttt

SEQ ID NO: 310375 - DNA, 15 bp, Homo sapiens
tcctttgggtgttta

SEQ ID NO: 310376 - DNA, 15 bp, Homo sapiens
cctttgggtgtttac

SEQ ID NO: 310377 - DNA, 15 bp, Homo sapiens
ctttgggtgtttacc

SEQ ID NO: 310378 - DNA, 15 bp, Homo sapiens
tttgggtgtttacct

SEQ ID NO: 310379 - DNA, 15 bp, Homo sapiens
ttgggtgtttaccta

SEQ ID NO: 310380 - DNA, 15 bp, Homo sapiens
tgggtgtttacctaa

SEQ ID NO: 310381 - DNA, 15 bp, Homo sapiens
gggtgtttacctaaa

SEQ ID NO: 310382 - DNA, 15 bp, Homo sapiens
ggtgtttacctaaaa

SEQ ID NO: 310383 - DNA, 15 bp, Homo sapiens
gtgtttacctaaaat

SEQ ID NO: 310384 - DNA, 15 bp, Homo sapiens
tgtttacctaaaatt

SEQ ID NO: 310385 - DNA, 15 bp, Homo sapiens
gtttacctaaaattt

SEQ ID NO: 310386 - DNA, 15 bp, Homo sapiens
tttacctaaaattta

SEQ ID NO: 310387 - DNA, 15 bp, Homo sapiens
ttacctaaaatttat

SEQ ID NO: 310388 - DNA, 15 bp, Homo sapiens
tacctaaaatttatt

SEQ ID NO: 310389 - DNA, 15 bp, Homo sapiens
acctaaaatttattg

SEQ ID NO: 310390 - DNA, 15 bp, Homo sapiens
cctaaaatttattgg

SEQ ID NO: 310391 - DNA, 15 bp, Homo sapiens
ctaaaatttattggc

SEQ ID NO: 310392 - DNA, 15 bp, Homo sapiens
taaaatttattggct

SEQ ID NO: 310393 - DNA, 15 bp, Homo sapiens
aaaatttattggctc

SEQ ID NO: 310394 - DNA, 15 bp, Homo sapiens
aaatttattggctct

SEQ ID NO: 310395 - DNA, 15 bp, Homo sapiens
aatttattggctctg

SEQ ID NO: 310396 - DNA, 15 bp, Homo sapiens
atttattggctctgt

SEQ ID NO: 310397 - DNA, 15 bp, Homo sapiens
tttattggctctgta

SEQ ID NO: 310398 - DNA, 15 bp, Homo sapiens
ttattggctctgtaa

SEQ ID NO: 310399 - DNA, 15 bp, Homo sapiens
tattggctctgtaaa

SEQ ID NO: 310400 - DNA, 15 bp, Homo sapiens
attggctctgtaaac

SEQ ID NO: 310401 - DNA, 15 bp, Homo sapiens
ttggctctgtaaaca

SEQ ID NO: 310402 - DNA, 15 bp, Homo sapiens
tggctctgtaaacag

SEQ ID NO: 310403 - DNA, 15 bp, Homo sapiens
ggctctgtaaacagt

SEQ ID NO: 310404 - DNA, 15 bp, Homo sapiens
gctctgtaaacagta

SEQ ID NO: 310405 - DNA, 15 bp, Homo sapiens
ctctgtaaacagtat

SEQ ID NO: 310406 - DNA, 15 bp, Homo sapiens
tctgtaaacagtatt

SEQ ID NO: 310407 - DNA, 15 bp, Homo sapiens
ctgtaaacagtatta

SEQ ID NO: 310408 - DNA, 15 bp, Homo sapiens
tgtaaacagtattaa

SEQ ID NO: 310409 - DNA, 15 bp, Homo sapiens
gtaaacagtattaat

SEQ ID NO: 310410 - DNA, 15 bp, Homo sapiens
taaacagtattaatc

SEQ ID NO: 310411 - DNA, 15 bp, Homo sapiens
aaacagtattaatca

SEQ ID NO: 310412 - DNA, 15 bp, Homo sapiens
aacagtattaatcac

SEQ ID NO: 310413 - DNA, 15 bp, Homo sapiens
acagtattaatcaca

SEQ ID NO: 310414 - DNA, 15 bp, Homo sapiens
cagtattaatcacag

SEQ ID NO: 310415 - DNA, 15 bp, Homo sapiens
agtattaatcacagt

SEQ ID NO: 310416 - DNA, 15 bp, Homo sapiens
gtattaatcacagta

SEQ ID NO: 310417 - DNA, 15 bp, Homo sapiens
tattaatcacagtag

SEQ ID NO: 310418 - DNA, 15 bp, Homo sapiens
attaatcacagtagt

SEQ ID NO: 310419 - DNA, 15 bp, Homo sapiens
ttaatcacagtagta

SEQ ID NO: 310420 - DNA, 15 bp, Homo sapiens
taatcacagtagtat

SEQ ID NO: 310421 - DNA, 15 bp, Homo sapiens
aatcacagtagtatt

SEQ ID NO: 310422 - DNA, 15 bp, Homo sapiens
atcacagtagtatta

SEQ ID NO: 310423 - DNA, 15 bp, Homo sapiens
tcacagtagtattaa

SEQ ID NO: 310424 - DNA, 15 bp, Homo sapiens
cacagtagtattaac

SEQ ID NO: 310425 - DNA, 15 bp, Homo sapiens
acagtagtattaacc

SEQ ID NO: 310426 - DNA, 15 bp, Homo sapiens
cagtagtattaacct

SEQ ID NO: 310427 - DNA, 15 bp, Homo sapiens
agtagtattaacctt

SEQ ID NO: 310428 - DNA, 15 bp, Homo sapiens
gtagtattaaccttc

SEQ ID NO: 310429 - DNA, 15 bp, Homo sapiens
tagtattaaccttcc

SEQ ID NO: 310430 - DNA, 15 bp, Homo sapiens
agtattaaccttccc

SEQ ID NO: 310431 - DNA, 15 bp, Homo sapiens
gtattaaccttccct

SEQ ID NO: 310432 - DNA, 15 bp, Homo sapiens
tattaaccttccctg

SEQ ID NO: 310433 - DNA, 15 bp, Homo sapiens
attaaccttccctgg

SEQ ID NO: 310434 - DNA, 15 bp, Homo sapiens
ttaaccttccctgga

SEQ ID NO: 310435 - DNA, 15 bp, Homo sapiens
taaccttccctggag

SEQ ID NO: 310436 - DNA, 15 bp, Homo sapiens
aaccttccctggagc

SEQ ID NO: 310437 - DNA, 15 bp, Homo sapiens
accttccctggagcg

SEQ ID NO: 310438 - DNA, 15 bp, Homo sapiens
ccttccctggagcgc

SEQ ID NO: 310439 - DNA, 15 bp, Homo sapiens
cttccctggagcgct

SEQ ID NO: 310440 - DNA, 15 bp, Homo sapiens
ttccctggagcgctt

SEQ ID NO: 310441 - DNA, 15 bp, Homo sapiens
tccctggagcgcttc

SEQ ID NO: 310442 - DNA, 15 bp, Homo sapiens
ccctggagcgcttcc

SEQ ID NO: 310443 - DNA, 15 bp, Homo sapiens
cctggagcgcttccg

SEQ ID NO: 310444 - DNA, 15 bp, Homo sapiens
ctggagcgcttccga

SEQ ID NO: 310445 - DNA, 15 bp, Homo sapiens
tggagcgcttccgag

SEQ ID NO: 310446 - DNA, 15 bp, Homo sapiens
ggagcgcttccgagt

SEQ ID NO: 310447 - DNA, 15 bp, Homo sapiens
gagcgcttccgagtg

SEQ ID NO: 310448 - DNA, 15 bp, Homo sapiens
agcgcttccgagtgt

SEQ ID NO: 310449 - DNA, 15 bp, Homo sapiens
gcgcttccgagtgta

SEQ ID NO: 310450 - DNA, 15 bp, Homo sapiens
cgcttccgagtgtaa

SEQ ID NO: 310451 - DNA, 15 bp, Homo sapiens
gcttccgagtgtaaa

SEQ ID NO: 310452 - DNA, 15 bp, Homo sapiens
cttccgagtgtaaat

SEQ ID NO: 310453 - DNA, 15 bp, Homo sapiens
ttccgagtgtaaatg

SEQ ID NO: 310454 - DNA, 15 bp, Homo sapiens
tccgagtgtaaatgg

SEQ ID NO: 310455 - DNA, 15 bp, Homo sapiens
ccgagtgtaaatggc

SEQ ID NO: 310456 - DNA, 15 bp, Homo sapiens
cgagtgtaaatggca

SEQ ID NO: 310457 - DNA, 15 bp, Homo sapiens
gagtgtaaatggcag

SEQ ID NO: 310458 - DNA, 15 bp, Homo sapiens
agtgtaaatggcagt

SEQ ID NO: 310459 - DNA, 15 bp, Homo sapiens
gtgtaaatggcagtt

SEQ ID NO: 310460 - DNA, 15 bp, Homo sapiens
tgtaaatggcagttc

SEQ ID NO: 310461 - DNA, 15 bp, Homo sapiens
gtaaatggcagttct

SEQ ID NO: 310462 - DNA, 15 bp, Homo sapiens
taaatggcagttctt

SEQ ID NO: 310463 - DNA, 15 bp, Homo sapiens
aaatggcagttcttg

SEQ ID NO: 310464 - DNA, 15 bp, Homo sapiens
aatggcagttcttgg

SEQ ID NO: 310465 - DNA, 15 bp, Homo sapiens
atggcagttcttggc

SEQ ID NO: 310466 - DNA, 15 bp, Homo sapiens
tggcagttcttggca

SEQ ID NO: 310467 - DNA, 15 bp, Homo sapiens
ggcagttcttggcac

SEQ ID NO: 310468 - DNA, 15 bp, Homo sapiens
gcagttcttggcact

SEQ ID NO: 310469 - DNA, 15 bp, Homo sapiens
cagttcttggcactc

SEQ ID NO: 310470 - DNA, 15 bp, Homo sapiens
agttcttggcactca

SEQ ID NO: 310471 - DNA, 15 bp, Homo sapiens
gttcttggcactcac

SEQ ID NO: 310472 - DNA, 15 bp, Homo sapiens
ttcttggcactcacc

SEQ ID NO: 310473 - DNA, 15 bp, Homo sapiens
tcttggcactcaccg

SEQ ID NO: 310474 - DNA, 15 bp, Homo sapiens
cttggcactcaccgt

SEQ ID NO: 310475 - DNA, 15 bp, Homo sapiens
ttggcactcaccgtt

SEQ ID NO: 310476 - DNA, 15 bp, Homo sapiens
tggcactcaccgttt

SEQ ID NO: 310477 - DNA, 15 bp, Homo sapiens
ggcactcaccgtttt

SEQ ID NO: 310478 - DNA, 15 bp, Homo sapiens
gcactcaccgttttc

SEQ ID NO: 310479 - DNA, 15 bp, Homo sapiens
cactcaccgttttct

SEQ ID NO: 310480 - DNA, 15 bp, Homo sapiens
actcaccgttttctt

SEQ ID NO: 310481 - DNA, 15 bp, Homo sapiens
ctcaccgttttcttt

SEQ ID NO: 310482 - DNA, 15 bp, Homo sapiens
tcaccgttttctttt

SEQ ID NO: 310483 - DNA, 15 bp, Homo sapiens
caccgttttctttta

SEQ ID NO: 310484 - DNA, 15 bp, Homo sapiens
accgttttcttttac

SEQ ID NO: 310485 - DNA, 15 bp, Homo sapiens
ccgttttcttttact

SEQ ID NO: 310486 - DNA, 15 bp, Homo sapiens
cgttttcttttactg

SEQ ID NO: 310487 - DNA, 15 bp, Homo sapiens
gttttcttttactgt

SEQ ID NO: 310488 - DNA, 15 bp, Homo sapiens
ttttcttttactgtg

SEQ ID NO: 310489 - DNA, 15 bp, Homo sapiens
tttcttttactgtgt

SEQ ID NO: 310490 - DNA, 15 bp, Homo sapiens
ttcttttactgtgtt

SEQ ID NO: 310491 - DNA, 15 bp, Homo sapiens
tcttttactgtgttt

SEQ ID NO: 310492 - DNA, 15 bp, Homo sapiens
cttttactgtgtttc

SEQ ID NO: 310493 - DNA, 15 bp, Homo sapiens
ttttactgtgtttca

SEQ ID NO: 310494 - DNA, 15 bp, Homo sapiens
tttactgtgtttcaa

SEQ ID NO: 310495 - DNA, 15 bp, Homo sapiens
ttactgtgtttcaag

SEQ ID NO: 310496 - DNA, 15 bp, Homo sapiens
tactgtgtttcaagc

SEQ ID NO: 310497 - DNA, 15 bp, Homo sapiens
actgtgtttcaagca

SEQ ID NO: 310498 - DNA, 15 bp, Homo sapiens
ctgtgtttcaagcag

SEQ ID NO: 310499 - DNA, 15 bp, Homo sapiens
tgtgtttcaagcaga

SEQ ID NO: 310500 - DNA, 15 bp, Homo sapiens
gtgtttcaagcagag

SEQ ID NO: 310501 - DNA, 15 bp, Homo sapiens
tgtttcaagcagagc

SEQ ID NO: 310502 - DNA, 15 bp, Homo sapiens
gtttcaagcagagca

SEQ ID NO: 310503 - DNA, 15 bp, Homo sapiens
tttcaagcagagcag

SEQ ID NO: 310504 - DNA, 15 bp, Homo sapiens
ttcaagcagagcagc

SEQ ID NO: 310505 - DNA, 15 bp, Homo sapiens
tcaagcagagcagca

SEQ ID NO: 310506 - DNA, 15 bp, Homo sapiens
caagcagagcagcaa

SEQ ID NO: 310507 - DNA, 15 bp, Homo sapiens
aagcagagcagcaaa

SEQ ID NO: 310508 - DNA, 15 bp, Homo sapiens
agcagagcagcaaac

SEQ ID NO: 310509 - DNA, 15 bp, Homo sapiens
gcagagcagcaaact

SEQ ID NO: 310510 - DNA, 15 bp, Homo sapiens
cagagcagcaaactc

SEQ ID NO: 310511 - DNA, 15 bp, Homo sapiens
agagcagcaaactct

SEQ ID NO: 310512 - DNA, 15 bp, Homo sapiens
gagcagcaaactctt

SEQ ID NO: 310513 - DNA, 15 bp, Homo sapiens
agcagcaaactcttg

SEQ ID NO: 310514 - DNA, 15 bp, Homo sapiens
gcagcaaactcttgt

SEQ ID NO: 310515 - DNA, 15 bp, Homo sapiens
cagcaaactcttgtc

SEQ ID NO: 310516 - DNA, 15 bp, Homo sapiens
agcaaactcttgtcc

SEQ ID NO: 310517 - DNA, 15 bp, Homo sapiens
gcaaactcttgtccg

SEQ ID NO: 310518 - DNA, 15 bp, Homo sapiens
caaactcttgtccgc

SEQ ID NO: 310519 - DNA, 15 bp, Homo sapiens
aaactcttgtccgct

SEQ ID NO: 310520 - DNA, 15 bp, Homo sapiens
aactcttgtccgctt

SEQ ID NO: 310521 - DNA, 15 bp, Homo sapiens
actcttgtccgcttg

SEQ ID NO: 310522 - DNA, 15 bp, Homo sapiens
ctcttgtccgcttgg

SEQ ID NO: 310523 - DNA, 15 bp, Homo sapiens
tcttgtccgcttggc

SEQ ID NO: 310524 - DNA, 15 bp, Homo sapiens
cttgtccgcttggct

SEQ ID NO: 310525 - DNA, 15 bp, Homo sapiens
ttgtccgcttggctt

SEQ ID NO: 310526 - DNA, 15 bp, Homo sapiens
tgtccgcttggcttc

SEQ ID NO: 310527 - DNA, 15 bp, Homo sapiens
gtccgcttggcttcc

SEQ ID NO: 310528 - DNA, 15 bp, Homo sapiens
tccgcttggcttcct

SEQ ID NO: 310529 - DNA, 15 bp, Homo sapiens
ccgcttggcttcctt

SEQ ID NO: 310530 - DNA, 15 bp, Homo sapiens
cgcttggcttccttt

SEQ ID NO: 310531 - DNA, 15 bp, Homo sapiens
gcttggcttcctttt

SEQ ID NO: 310532 - DNA, 15 bp, Homo sapiens
cttggcttccttttc

SEQ ID NO: 310533 - DNA, 15 bp, Homo sapiens
ttggcttccttttct

SEQ ID NO: 310534 - DNA, 15 bp, Homo sapiens
tggcttccttttcta

SEQ ID NO: 310535 - DNA, 15 bp, Homo sapiens
ggcttccttttctac

SEQ ID NO: 310536 - DNA, 15 bp, Homo sapiens
gcttccttttctact

SEQ ID NO: 310537 - DNA, 15 bp, Homo sapiens
cttccttttctacta

SEQ ID NO: 310538 - DNA, 15 bp, Homo sapiens
ttccttttctactat

SEQ ID NO: 310539 - DNA, 15 bp, Homo sapiens
tccttttctactatc

SEQ ID NO: 310540 - DNA, 15 bp, Homo sapiens
ccttttctactatct

SEQ ID NO: 310541 - DNA, 15 bp, Homo sapiens
cttttctactatctc

SEQ ID NO: 310542 - DNA, 15 bp, Homo sapiens
ttttctactatctca

SEQ ID NO: 310543 - DNA, 15 bp, Homo sapiens
tttctactatctcaa

SEQ ID NO: 310544 - DNA, 15 bp, Homo sapiens
ttctactatctcaat

SEQ ID NO: 310545 - DNA, 15 bp, Homo sapiens
tctactatctcaatc

SEQ ID NO: 310546 - DNA, 15 bp, Homo sapiens
ctactatctcaatcg

SEQ ID NO: 310547 - DNA, 15 bp, Homo sapiens
tactatctcaatcgt

SEQ ID NO: 310548 - DNA, 15 bp, Homo sapiens
actatctcaatcgtt

SEQ ID NO: 310549 - DNA, 15 bp, Homo sapiens
ctatctcaatcgttc

SEQ ID NO: 310550 - DNA, 15 bp, Homo sapiens
tatctcaatcgttcc

SEQ ID NO: 310551 - DNA, 15 bp, Homo sapiens
atctcaatcgttcct

SEQ ID NO: 310552 - DNA, 15 bp, Homo sapiens
tctcaatcgttccta

SEQ ID NO: 310553 - DNA, 15 bp, Homo sapiens
ctcaatcgttcctag

SEQ ID NO: 310554 - DNA, 15 bp, Homo sapiens
tcaatcgttcctagg

SEQ ID NO: 310555 - DNA, 15 bp, Homo sapiens
caatcgttcctaggt

SEQ ID NO: 310556 - DNA, 15 bp, Homo sapiens
aatcgttcctaggtt

SEQ ID NO: 310557 - DNA, 15 bp, Homo sapiens
atcgttcctaggttt

SEQ ID NO: 310558 - DNA, 15 bp, Homo sapiens
tcgttcctaggtttt

SEQ ID NO: 310559 - DNA, 15 bp, Homo sapiens
cgttcctaggttttg

SEQ ID NO: 310560 - DNA, 15 bp, Homo sapiens
gttcctaggttttgg

SEQ ID NO: 310561 - DNA, 15 bp, Homo sapiens
ttcctaggttttggt

SEQ ID NO: 310562 - DNA, 15 bp, Homo sapiens
tcctaggttttggtt

SEQ ID NO: 310563 - DNA, 15 bp, Homo sapiens
cctaggttttggttc

SEQ ID NO: 310564 - DNA, 15 bp, Homo sapiens
ctaggttttggttcc

SEQ ID NO: 310565 - DNA, 15 bp, Homo sapiens
taggttttggttcct

SEQ ID NO: 310566 - DNA, 15 bp, Homo sapiens
aggttttggttccta

SEQ ID NO: 310567 - DNA, 15 bp, Homo sapiens
ggttttggttcctat

SEQ ID NO: 310568 - DNA, 15 bp, Homo sapiens
gttttggttcctata

SEQ ID NO: 310569 - DNA, 15 bp, Homo sapiens
ttttggttcctatag

SEQ ID NO: 310570 - DNA, 15 bp, Homo sapiens
tttggttcctatagt

SEQ ID NO: 310571 - DNA, 15 bp, Homo sapiens
ttggttcctatagta

SEQ ID NO: 310572 - DNA, 15 bp, Homo sapiens
tggttcctatagtaa

SEQ ID NO: 310573 - DNA, 15 bp, Homo sapiens
ggttcctatagtaaa

SEQ ID NO: 310574 - DNA, 15 bp, Homo sapiens
gttcctatagtaaat

SEQ ID NO: 310575 - DNA, 15 bp, Homo sapiens
ttcctatagtaaatt

SEQ ID NO: 310576 - DNA, 15 bp, Homo sapiens
tcctatagtaaatta

SEQ ID NO: 310577 - DNA, 15 bp, Homo sapiens
cctatagtaaattaa

SEQ ID NO: 310578 - DNA, 15 bp, Homo sapiens
ctatagtaaattaat

SEQ ID NO: 310579 - DNA, 15 bp, Homo sapiens
tatagtaaattaatg

SEQ ID NO: 310580 - DNA, 15 bp, Homo sapiens
atagtaaattaatga

SEQ ID NO: 310581 - DNA, 15 bp, Homo sapiens
tagtaaattaatgaa

SEQ ID NO: 310582 - DNA, 15 bp, Homo sapiens
agtaaattaatgaat

SEQ ID NO: 310583 - DNA, 15 bp, Homo sapiens
gtaaattaatgaata

SEQ ID NO: 310584 - DNA, 15 bp, Homo sapiens
taaattaatgaatag

SEQ ID NO: 310585 - DNA, 15 bp, Homo sapiens
aaattaatgaatagt

SEQ ID NO: 310586 - DNA, 15 bp, Homo sapiens
aattaatgaatagtg

SEQ ID NO: 310587 - DNA, 15 bp, Homo sapiens
attaatgaatagtgt

SEQ ID NO: 310588 - DNA, 15 bp, Homo sapiens
ttaatgaatagtgtt

SEQ ID NO: 310589 - DNA, 15 bp, Homo sapiens
taatgaatagtgttt

SEQ ID NO: 310590 - DNA, 15 bp, Homo sapiens
aatgaatagtgtttg

SEQ ID NO: 310591 - DNA, 15 bp, Homo sapiens
atgaatagtgtttgc

SEQ ID NO: 310592 - DNA, 15 bp, Homo sapiens
tgaatagtgtttgca

SEQ ID NO: 310593 - DNA, 15 bp, Homo sapiens
gaatagtgtttgcat

SEQ ID NO: 310594 - DNA, 15 bp, Homo sapiens
aatagtgtttgcatt

SEQ ID NO: 310595 - DNA, 15 bp, Homo sapiens
atagtgtttgcatta

SEQ ID NO: 310596 - DNA, 15 bp, Homo sapiens
tagtgtttgcattac

SEQ ID NO: 310597 - DNA, 15 bp, Homo sapiens
agtgtttgcattaca

SEQ ID NO: 310598 - DNA, 15 bp, Homo sapiens
gtgtttgcattacac

SEQ ID NO: 310599 - DNA, 15 bp, Homo sapiens
tgtttgcattacaca

SEQ ID NO: 310600 - DNA, 15 bp, Homo sapiens
gtttgcattacacag

SEQ ID NO: 310601 - DNA, 15 bp, Homo sapiens
tttgcattacacagc

SEQ ID NO: 310602 - DNA, 15 bp, Homo sapiens
ttgcattacacagca

SEQ ID NO: 310603 - DNA, 15 bp, Homo sapiens
tgcattacacagcat

SEQ ID NO: 310604 - DNA, 15 bp, Homo sapiens
gcattacacagcatt

SEQ ID NO: 310605 - DNA, 15 bp, Homo sapiens
cattacacagcattt

SEQ ID NO: 310606 - DNA, 15 bp, Homo sapiens
attacacagcatttc

SEQ ID NO: 310607 - DNA, 15 bp, Homo sapiens
ttacacagcatttcc

SEQ ID NO: 310608 - DNA, 15 bp, Homo sapiens
tacacagcatttcca

SEQ ID NO: 310609 - DNA, 15 bp, Homo sapiens
acacagcatttccat

SEQ ID NO: 310610 - DNA, 15 bp, Homo sapiens
cacagcatttccatc

SEQ ID NO: 310611 - DNA, 15 bp, Homo sapiens
acagcatttccatca

SEQ ID NO: 310612 - DNA, 15 bp, Homo sapiens
cagcatttccatcat

SEQ ID NO: 310613 - DNA, 15 bp, Homo sapiens
agcatttccatcata

SEQ ID NO: 310614 - DNA, 15 bp, Homo sapiens
gcatttccatcataa

SEQ ID NO: 310615 - DNA, 15 bp, Homo sapiens
catttccatcataat

SEQ ID NO: 310616 - DNA, 15 bp, Homo sapiens
atttccatcataatg

SEQ ID NO: 310617 - DNA, 15 bp, Homo sapiens
tttccatcataatgc

SEQ ID NO: 310618 - DNA, 15 bp, Homo sapiens
ttccatcataatgca

SEQ ID NO: 310619 - DNA, 15 bp, Homo sapiens
tccatcataatgcac

SEQ ID NO: 310620 - DNA, 15 bp, Homo sapiens
ccatcataatgcaca

SEQ ID NO: 310621 - DNA, 15 bp, Homo sapiens
catcataatgcacac

SEQ ID NO: 310622 - DNA, 15 bp, Homo sapiens
atcataatgcacact

SEQ ID NO: 310623 - DNA, 15 bp, Homo sapiens
tcataatgcacactg

SEQ ID NO: 310624 - DNA, 15 bp, Homo sapiens
cataatgcacactgt

SEQ ID NO: 310625 - DNA, 15 bp, Homo sapiens
ataatgcacactgtt

SEQ ID NO: 310626 - DNA, 15 bp, Homo sapiens
taatgcacactgttg

SEQ ID NO: 310627 - DNA, 15 bp, Homo sapiens
aatgcacactgttgg

SEQ ID NO: 310628 - DNA, 15 bp, Homo sapiens
atgcacactgttgga

SEQ ID NO: 310629 - DNA, 15 bp, Homo sapiens
tgcacactgttggat

SEQ ID NO: 310630 - DNA, 15 bp, Homo sapiens
gcacactgttggata

SEQ ID NO: 310631 - DNA, 15 bp, Homo sapiens
cacactgttggatat

SEQ ID NO: 310632 - DNA, 15 bp, Homo sapiens
acactgttggatata

SEQ ID NO: 310633 - DNA, 15 bp, Homo sapiens
cactgttggatatat

SEQ ID NO: 310634 - DNA, 15 bp, Homo sapiens
actgttggatatata

SEQ ID NO: 310635 - DNA, 15 bp, Homo sapiens
ctgttggatatatat

SEQ ID NO: 310636 - DNA, 15 bp, Homo sapiens
tgttggatatatatg

SEQ ID NO: 310637 - DNA, 15 bp, Homo sapiens
gttggatatatatgt

SEQ ID NO: 310638 - DNA, 15 bp, Homo sapiens
ttggatatatatgtg

SEQ ID NO: 310639 - DNA, 15 bp, Homo sapiens
tggatatatatgtgc

SEQ ID NO: 310640 - DNA, 15 bp, Homo sapiens
ggatatatatgtgct

SEQ ID NO: 310641 - DNA, 15 bp, Homo sapiens
gatatatatgtgcta

SEQ ID NO: 310642 - DNA, 15 bp, Homo sapiens
atatatatgtgctat

SEQ ID NO: 310643 - DNA, 15 bp, Homo sapiens
tatatatgtgctata

SEQ ID NO: 310644 - DNA, 15 bp, Homo sapiens
atatatgtgctatat

SEQ ID NO: 310645 - DNA, 15 bp, Homo sapiens
tatatgtgctatata

SEQ ID NO: 310646 - DNA, 15 bp, Homo sapiens
atatgtgctatatac

SEQ ID NO: 310647 - DNA, 15 bp, Homo sapiens
tatgtgctatataca

SEQ ID NO: 310648 - DNA, 15 bp, Homo sapiens
atgtgctatatacat

SEQ ID NO: 310649 - DNA, 15 bp, Homo sapiens
tgtgctatatacata

SEQ ID NO: 310650 - DNA, 15 bp, Homo sapiens
gtgctatatacataa

SEQ ID NO: 310651 - DNA, 15 bp, Homo sapiens
tgctatatacataaa

SEQ ID NO: 310652 - DNA, 15 bp, Homo sapiens
gctatatacataaaa

SEQ ID NO: 310653 - DNA, 15 bp, Homo sapiens
ctatatacataaaat

SEQ ID NO: 310654 - DNA, 15 bp, Homo sapiens
tatatacataaaata

SEQ ID NO: 310655 - DNA, 15 bp, Homo sapiens
atatacataaaatat

SEQ ID NO: 310656 - DNA, 15 bp, Homo sapiens
tatacataaaatata

SEQ ID NO: 310657 - DNA, 15 bp, Homo sapiens
atacataaaatatag

SEQ ID NO: 310658 - DNA, 15 bp, Homo sapiens
tacataaaatatagt

SEQ ID NO: 310659 - DNA, 15 bp, Homo sapiens
acataaaatatagta

SEQ ID NO: 310660 - DNA, 15 bp, Homo sapiens
cataaaatatagtac

SEQ ID NO: 310661 - DNA, 15 bp, Homo sapiens
ataaaatatagtaca

SEQ ID NO: 310662 - DNA, 15 bp, Homo sapiens
taaaatatagtacaa

SEQ ID NO: 310663 - DNA, 15 bp, Homo sapiens
aaaatatagtacaaa

SEQ ID NO: 310664 - DNA, 15 bp, Homo sapiens
aaatatagtacaaaa

SEQ ID NO: 310665 - DNA, 15 bp, Homo sapiens
aatatagtacaaaat

SEQ ID NO: 310666 - DNA, 15 bp, Homo sapiens
atatagtacaaaata

SEQ ID NO: 310667 - DNA, 15 bp, Homo sapiens
tatagtacaaaataa

SEQ ID NO: 310668 - DNA, 15 bp, Homo sapiens
atagtacaaaataaa

SEQ ID NO: 310669 - DNA, 15 bp, Homo sapiens
tagtacaaaataaaa

SEQ ID NO: 310670 - DNA, 15 bp, Homo sapiens
agtacaaaataaaaa

SEQ ID NO: 310671 - DNA, 15 bp, Homo sapiens
gtacaaaataaaaat

SEQ ID NO: 310672 - DNA, 15 bp, Homo sapiens
tacaaaataaaaatt

SEQ ID NO: 310673 - DNA, 15 bp, Homo sapiens
acaaaataaaaatta

SEQ ID NO: 310674 - DNA, 15 bp, Homo sapiens
caaaataaaaattat

SEQ ID NO: 310675 - DNA, 15 bp, Homo sapiens
aaaataaaaattata

SEQ ID NO: 310676 - DNA, 15 bp, Homo sapiens
aaataaaaattatat

SEQ ID NO: 310677 - DNA, 15 bp, Homo sapiens
aataaaaattatata

SEQ ID NO: 310678 - DNA, 15 bp, Homo sapiens
ataaaaattatatac

SEQ ID NO: 310679 - DNA, 15 bp, Homo sapiens
taaaaattatataca

SEQ ID NO: 310680 - DNA, 15 bp, Homo sapiens
aaaaattatatacat

SEQ ID NO: 310681 - DNA, 15 bp, Homo sapiens
aaaattatatacata

SEQ ID NO: 310682 - DNA, 15 bp, Homo sapiens
aaattatatacatat

SEQ ID NO: 310683 - DNA, 15 bp, Homo sapiens
aattatatacatata

SEQ ID NO: 310684 - DNA, 15 bp, Homo sapiens
attatatacatatat

SEQ ID NO: 310685 - DNA, 15 bp, Homo sapiens
ttatatacatatatt

SEQ ID NO: 310686 - DNA, 15 bp, Homo sapiens
tatatacatatattc

SEQ ID NO: 310687 - DNA, 15 bp, Homo sapiens
atatacatatattca

SEQ ID NO: 310688 - DNA, 15 bp, Homo sapiens
tatacatatattcat

SEQ ID NO: 310689 - DNA, 15 bp, Homo sapiens
atacatatattcatt

SEQ ID NO: 310690 - DNA, 15 bp, Homo sapiens
tacatatattcattg

SEQ ID NO: 310691 - DNA, 15 bp, Homo sapiens
acatatattcattgt

SEQ ID NO: 310692 - DNA, 15 bp, Homo sapiens
catatattcattgta

SEQ ID NO: 310693 - DNA, 15 bp, Homo sapiens
atatattcattgtat

SEQ ID NO: 310694 - DNA, 15 bp, Homo sapiens
tatattcattgtata

SEQ ID NO: 310695 - DNA, 15 bp, Homo sapiens
atattcattgtataa

SEQ ID NO: 310696 - DNA, 15 bp, Homo sapiens
tattcattgtataat

SEQ ID NO: 310697 - DNA, 15 bp, Homo sapiens
attcattgtataatt

SEQ ID NO: 310698 - DNA, 15 bp, Homo sapiens
ttcattgtataattc

SEQ ID NO: 310699 - DNA, 15 bp, Homo sapiens
tcattgtataattcc

SEQ ID NO: 310700 - DNA, 15 bp, Homo sapiens
cattgtataattcct

SEQ ID NO: 310701 - DNA, 15 bp, Homo sapiens
attgtataattccta

SEQ ID NO: 310702 - DNA, 15 bp, Homo sapiens
ttgtataattcctaa

SEQ ID NO: 310703 - DNA, 15 bp, Homo sapiens
tgtataattcctaaa

SEQ ID NO: 310704 - DNA, 15 bp, Homo sapiens
gtataattcctaaaa

SEQ ID NO: 310705 - DNA, 15 bp, Homo sapiens
tataattcctaaaat

SEQ ID NO: 310706 - DNA, 15 bp, Homo sapiens
ataattcctaaaatc

SEQ ID NO: 310707 - DNA, 15 bp, Homo sapiens
taattcctaaaatct

SEQ ID NO: 310708 - DNA, 15 bp, Homo sapiens
aattcctaaaatctt

SEQ ID NO: 310709 - DNA, 15 bp, Homo sapiens
attcctaaaatctta

SEQ ID NO: 310710 - DNA, 15 bp, Homo sapiens
ttcctaaaatcttaa

SEQ ID NO: 310711 - DNA, 15 bp, Homo sapiens
tcctaaaatcttaaa

SEQ ID NO: 310712 - DNA, 15 bp, Homo sapiens
cctaaaatcttaaaa

SEQ ID NO: 310713 - DNA, 15 bp, Homo sapiens
ctaaaatcttaaaaa

SEQ ID NO: 310714 - DNA, 15 bp, Homo sapiens
taaaatcttaaaaaa

SEQ ID NO: 310715 - DNA, 15 bp, Homo sapiens
aaaatcttaaaaaat

SEQ ID NO: 310716 - DNA, 15 bp, Homo sapiens
aaatcttaaaaaatt

SEQ ID NO: 310717 - DNA, 15 bp, Homo sapiens
aatcttaaaaaattg

SEQ ID NO: 310718 - DNA, 15 bp, Homo sapiens
atcttaaaaaattga

SEQ ID NO: 310719 - DNA, 15 bp, Homo sapiens
tcttaaaaaattgaa

SEQ ID NO: 310720 - DNA, 15 bp, Homo sapiens
cttaaaaaattgaaa

SEQ ID NO: 310721 - DNA, 15 bp, Homo sapiens
ttaaaaaattgaaac

SEQ ID NO: 310722 - DNA, 15 bp, Homo sapiens
taaaaaattgaaaca

SEQ ID NO: 310723 - DNA, 15 bp, Homo sapiens
aaaaaattgaaacat

SEQ ID NO: 310724 - DNA, 15 bp, Homo sapiens
aaaaattgaaacatt

SEQ ID NO: 310725 - DNA, 15 bp, Homo sapiens
aaaattgaaacatta

SEQ ID NO: 310726 - DNA, 15 bp, Homo sapiens
aaattgaaacattag

SEQ ID NO: 310727 - DNA, 15 bp, Homo sapiens
aattgaaacattagt

SEQ ID NO: 310728 - DNA, 15 bp, Homo sapiens
attgaaacattagtt

SEQ ID NO: 310729 - DNA, 15 bp, Homo sapiens
ttgaaacattagttt

SEQ ID NO: 310730 - DNA, 15 bp, Homo sapiens
tgaaacattagtttt

SEQ ID NO: 310731 - DNA, 15 bp, Homo sapiens
gaaacattagttttg

SEQ ID NO: 310732 - DNA, 15 bp, Homo sapiens
aaacattagttttgt

SEQ ID NO: 310733 - DNA, 15 bp, Homo sapiens
aacattagttttgtc

SEQ ID NO: 310734 - DNA, 15 bp, Homo sapiens
acattagttttgtct

SEQ ID NO: 310735 - DNA, 15 bp, Homo sapiens
cattagttttgtctt

SEQ ID NO: 310736 - DNA, 15 bp, Homo sapiens
attagttttgtcttt

SEQ ID NO: 310737 - DNA, 15 bp, Homo sapiens
ttagttttgtcttta

SEQ ID NO: 310738 - DNA, 15 bp, Homo sapiens
tagttttgtctttaa

SEQ ID NO: 310739 - DNA, 15 bp, Homo sapiens
agttttgtctttaag

SEQ ID NO: 310740 - DNA, 15 bp, Homo sapiens
gttttgtctttaagg

SEQ ID NO: 310741 - DNA, 15 bp, Homo sapiens
ttttgtctttaaggc

SEQ ID NO: 310742 - DNA, 15 bp, Homo sapiens
tttgtctttaaggct

SEQ ID NO: 310743 - DNA, 15 bp, Homo sapiens
ttgtctttaaggctg

SEQ ID NO: 310744 - DNA, 15 bp, Homo sapiens
tgtctttaaggctgt

SEQ ID NO: 310745 - DNA, 15 bp, Homo sapiens
gtctttaaggctgtc

SEQ ID NO: 310746 - DNA, 15 bp, Homo sapiens
tctttaaggctgtca

SEQ ID NO: 310747 - DNA, 15 bp, Homo sapiens
ctttaaggctgtcac

SEQ ID NO: 310748 - DNA, 15 bp, Homo sapiens
tttaaggctgtcacc

SEQ ID NO: 310749 - DNA, 15 bp, Homo sapiens
ttaaggctgtcacct

SEQ ID NO: 310750 - DNA, 15 bp, Homo sapiens
taaggctgtcacctt

SEQ ID NO: 310751 - DNA, 15 bp, Homo sapiens
aaggctgtcacctta

SEQ ID NO: 310752 - DNA, 15 bp, Homo sapiens
aggctgtcaccttat

SEQ ID NO: 310753 - DNA, 15 bp, Homo sapiens
ggctgtcaccttatg

SEQ ID NO: 310754 - DNA, 15 bp, Homo sapiens
gctgtcaccttatgt

SEQ ID NO: 310755 - DNA, 15 bp, Homo sapiens
ctgtcaccttatgtt

SEQ ID NO: 310756 - DNA, 15 bp, Homo sapiens
tgtcaccttatgttt

SEQ ID NO: 310757 - DNA, 15 bp, Homo sapiens
gtcaccttatgttta

SEQ ID NO: 310758 - DNA, 15 bp, Homo sapiens
tcaccttatgtttat

SEQ ID NO: 310759 - DNA, 15 bp, Homo sapiens
caccttatgtttatt

SEQ ID NO: 310760 - DNA, 15 bp, Homo sapiens
accttatgtttattt

SEQ ID NO: 310761 - DNA, 15 bp, Homo sapiens
ccttatgtttatttt

SEQ ID NO: 310762 - DNA, 15 bp, Homo sapiens
cttatgtttattttt

SEQ ID NO: 310763 - DNA, 15 bp, Homo sapiens
ttatgtttatttttt

SEQ ID NO: 310764 - DNA, 15 bp, Homo sapiens
tatgtttatttttta

SEQ ID NO: 310765 - DNA, 15 bp, Homo sapiens
atgtttattttttaa

SEQ ID NO: 310766 - DNA, 15 bp, Homo sapiens
tgtttattttttaaa

SEQ ID NO: 310767 - DNA, 15 bp, Homo sapiens
gtttattttttaaac

SEQ ID NO: 310768 - DNA, 15 bp, Homo sapiens
tttattttttaaaca

SEQ ID NO: 310769 - DNA, 15 bp, Homo sapiens
ttattttttaaacac

SEQ ID NO: 310770 - DNA, 15 bp, Homo sapiens
tattttttaaacacc

SEQ ID NO: 310771 - DNA, 15 bp, Homo sapiens
attttttaaacacct

SEQ ID NO: 310772 - DNA, 15 bp, Homo sapiens
ttttttaaacacctt

SEQ ID NO: 310773 - DNA, 15 bp, Homo sapiens
tttttaaacacctta

SEQ ID NO: 310774 - DNA, 15 bp, Homo sapiens
ttttaaacaccttat

SEQ ID NO: 310775 - DNA, 15 bp, Homo sapiens
tttaaacaccttatg

SEQ ID NO: 310776 - DNA, 15 bp, Homo sapiens
ttaaacaccttatgt

SEQ ID NO: 310777 - DNA, 15 bp, Homo sapiens
taaacaccttatgtt

SEQ ID NO: 310778 - DNA, 15 bp, Homo sapiens
aaacaccttatgttt

SEQ ID NO: 310779 - DNA, 15 bp, Homo sapiens
aacaccttatgttta

SEQ ID NO: 310780 - DNA, 15 bp, Homo sapiens
acaccttatgtttat

SEQ ID NO: 310781 - DNA, 15 bp, Homo sapiens
ccttatgtttatttc

SEQ ID NO: 310782 - DNA, 15 bp, Homo sapiens
cttatgtttatttca

SEQ ID NO: 310783 - DNA, 15 bp, Homo sapiens
ttatgtttatttcat

SEQ ID NO: 310784 - DNA, 15 bp, Homo sapiens
tatgtttatttcata

SEQ ID NO: 310785 - DNA, 15 bp, Homo sapiens
atgtttatttcatac

SEQ ID NO: 310786 - DNA, 15 bp, Homo sapiens
tgtttatttcataca

SEQ ID NO: 310787 - DNA, 15 bp, Homo sapiens
gtttatttcatacac

SEQ ID NO: 310788 - DNA, 15 bp, Homo sapiens
tttatttcatacact

SEQ ID NO: 310789 - DNA, 15 bp, Homo sapiens
ttatttcatacactc

SEQ ID NO: 310790 - DNA, 15 bp, Homo sapiens
tatttcatacactct

SEQ ID NO: 310791 - DNA, 15 bp, Homo sapiens
atttcatacactctt

SEQ ID NO: 310792 - DNA, 15 bp, Homo sapiens
tttcatacactcttg

SEQ ID NO: 310793 - DNA, 15 bp, Homo sapiens
ttcatacactcttgc

SEQ ID NO: 310794 - DNA, 15 bp, Homo sapiens
tcatacactcttgct

SEQ ID NO: 310795 - DNA, 15 bp, Homo sapiens
catacactcttgctt

SEQ ID NO: 310796 - DNA, 15 bp, Homo sapiens
atacactcttgcttg

SEQ ID NO: 310797 - DNA, 15 bp, Homo sapiens
tacactcttgcttgg

SEQ ID NO: 310798 - DNA, 15 bp, Homo sapiens
acactcttgcttggt

SEQ ID NO: 310799 - DNA, 15 bp, Homo sapiens
cactcttgcttggtg

SEQ ID NO: 310800 - DNA, 15 bp, Homo sapiens
actcttgcttggtgg

SEQ ID NO: 310801 - DNA, 15 bp, Homo sapiens
ctcttgcttggtggt

SEQ ID NO: 310802 - DNA, 15 bp, Homo sapiens
tcttgcttggtggtc

SEQ ID NO: 310803 - DNA, 15 bp, Homo sapiens
cttgcttggtggtcc

SEQ ID NO: 310804 - DNA, 15 bp, Homo sapiens
ttgcttggtggtcca

SEQ ID NO: 310805 - DNA, 15 bp, Homo sapiens
tgcttggtggtccat

SEQ ID NO: 310806 - DNA, 15 bp, Homo sapiens
gcttggtggtccata

SEQ ID NO: 310807 - DNA, 15 bp, Homo sapiens
cttggtggtccatat

SEQ ID NO: 310808 - DNA, 15 bp, Homo sapiens
ttggtggtccatatg

SEQ ID NO: 310809 - DNA, 15 bp, Homo sapiens
tggtggtccatatga

SEQ ID NO: 310810 - DNA, 15 bp, Homo sapiens
ggtggtccatatgac

SEQ ID NO: 310811 - DNA, 15 bp, Homo sapiens
gtggtccatatgaca

SEQ ID NO: 310812 - DNA, 15 bp, Homo sapiens
tggtccatatgacag

SEQ ID NO: 310813 - DNA, 15 bp, Homo sapiens
ggtccatatgacagc

SEQ ID NO: 310814 - DNA, 15 bp, Homo sapiens
gtccatatgacagcc

SEQ ID NO: 310815 - DNA, 15 bp, Homo sapiens
tccatatgacagccg

SEQ ID NO: 310816 - DNA, 15 bp, Homo sapiens
ccatatgacagccgg

SEQ ID NO: 310817 - DNA, 15 bp, Homo sapiens
catatgacagccgga

SEQ ID NO: 310818 - DNA, 15 bp, Homo sapiens
atatgacagccggaa

SEQ ID NO: 310819 - DNA, 15 bp, Homo sapiens
tatgacagccggaag

SEQ ID NO: 310820 - DNA, 15 bp, Homo sapiens
atgacagccggaagc

SEQ ID NO: 310821 - DNA, 15 bp, Homo sapiens
tgacagccggaagcg

SEQ ID NO: 310822 - DNA, 15 bp, Homo sapiens
gacagccggaagcgt

SEQ ID NO: 310823 - DNA, 15 bp, Homo sapiens
acagccggaagcgtt

SEQ ID NO: 310824 - DNA, 15 bp, Homo sapiens
cagccggaagcgttc

SEQ ID NO: 310825 - DNA, 15 bp, Homo sapiens
agccggaagcgttct

SEQ ID NO: 310826 - DNA, 15 bp, Homo sapiens
gccggaagcgttctg

SEQ ID NO: 310827 - DNA, 15 bp, Homo sapiens
ccggaagcgttctga

SEQ ID NO: 310828 - DNA, 15 bp, Homo sapiens
cggaagcgttctgaa

SEQ ID NO: 310829 - DNA, 15 bp, Homo sapiens
ggaagcgttctgaag

SEQ ID NO: 310830 - DNA, 15 bp, Homo sapiens
gaagcgttctgaagg

SEQ ID NO: 310831 - DNA, 15 bp, Homo sapiens
aagcgttctgaaggg

SEQ ID NO: 310832 - DNA, 15 bp, Homo sapiens
agcgttctgaaggga

SEQ ID NO: 310833 - DNA, 15 bp, Homo sapiens
gcgttctgaagggag

SEQ ID NO: 310834 - DNA, 15 bp, Homo sapiens
cgttctgaagggaga

SEQ ID NO: 310835 - DNA, 15 bp, Homo sapiens
gttctgaagggagag

SEQ ID NO: 310836 - DNA, 15 bp, Homo sapiens
ttctgaagggagagt

SEQ ID NO: 310837 - DNA, 15 bp, Homo sapiens
tctgaagggagagtt

SEQ ID NO: 310838 - DNA, 15 bp, Homo sapiens
ctgaagggagagtta

SEQ ID NO: 310839 - DNA, 15 bp, Homo sapiens
tgaagggagagttag

SEQ ID NO: 310840 - DNA, 15 bp, Homo sapiens
gaagggagagttagt

SEQ ID NO: 310841 - DNA, 15 bp, Homo sapiens
aagggagagttagtg

SEQ ID NO: 310842 - DNA, 15 bp, Homo sapiens
agggagagttagtga

SEQ ID NO: 310843 - DNA, 15 bp, Homo sapiens
gggagagttagtgaa

SEQ ID NO: 310844 - DNA, 15 bp, Homo sapiens
ggagagttagtgaat

SEQ ID NO: 310845 - DNA, 15 bp, Homo sapiens
gagagttagtgaata

SEQ ID NO: 310846 - DNA, 15 bp, Homo sapiens
agagttagtgaatat

SEQ ID NO: 310847 - DNA, 15 bp, Homo sapiens
gagttagtgaatatc

SEQ ID NO: 310848 - DNA, 15 bp, Homo sapiens
agttagtgaatatcg

SEQ ID NO: 310849 - DNA, 15 bp, Homo sapiens
gttagtgaatatcga

SEQ ID NO: 310850 - DNA, 15 bp, Homo sapiens
ttagtgaatatcgac

SEQ ID NO: 310851 - DNA, 15 bp, Homo sapiens
tagtgaatatcgact

SEQ ID NO: 310852 - DNA, 15 bp, Homo sapiens
agtgaatatcgactt

SEQ ID NO: 310853 - DNA, 15 bp, Homo sapiens
gtgaatatcgacttg

SEQ ID NO: 310854 - DNA, 15 bp, Homo sapiens
tgaatatcgacttga

SEQ ID NO: 310855 - DNA, 15 bp, Homo sapiens
gaatatcgacttgac

SEQ ID NO: 310856 - DNA, 15 bp, Homo sapiens
aatatcgacttgact

SEQ ID NO: 310857 - DNA, 15 bp, Homo sapiens
atatcgacttgactg

SEQ ID NO: 310858 - DNA, 15 bp, Homo sapiens
tatcgacttgactgg

SEQ ID NO: 310859 - DNA, 15 bp, Homo sapiens
atcgacttgactgga

SEQ ID NO: 310860 - DNA, 15 bp, Homo sapiens
tcgacttgactggat

SEQ ID NO: 310861 - DNA, 15 bp, Homo sapiens
cgacttgactggatt

SEQ ID NO: 310862 - DNA, 15 bp, Homo sapiens
gacttgactggattg

SEQ ID NO: 310863 - DNA, 15 bp, Homo sapiens
acttgactggattgg

SEQ ID NO: 310864 - DNA, 15 bp, Homo sapiens
cttgactggattggt

SEQ ID NO: 310865 - DNA, 15 bp, Homo sapiens
ttgactggattggtt

SEQ ID NO: 310866 - DNA, 15 bp, Homo sapiens
tgactggattggttt

SEQ ID NO: 310867 - DNA, 15 bp, Homo sapiens
gactggattggtttc

SEQ ID NO: 310868 - DNA, 15 bp, Homo sapiens
actggattggtttca

SEQ ID NO: 310869 - DNA, 15 bp, Homo sapiens
ctggattggtttcag

SEQ ID NO: 310870 - DNA, 15 bp, Homo sapiens
tggattggtttcagt

SEQ ID NO: 310871 - DNA, 15 bp, Homo sapiens
ggattggtttcagta

SEQ ID NO: 310872 - DNA, 15 bp, Homo sapiens
gattggtttcagtaa

SEQ ID NO: 310873 - DNA, 15 bp, Homo sapiens
attggtttcagtaag

SEQ ID NO: 310874 - DNA, 15 bp, Homo sapiens
ttggtttcagtaaga

SEQ ID NO: 310875 - DNA, 15 bp, Homo sapiens
tggtttcagtaagaa

SEQ ID NO: 310876 - DNA, 15 bp, Homo sapiens
ggtttcagtaagaac

SEQ ID NO: 310877 - DNA, 15 bp, Homo sapiens
gtttcagtaagaaca

SEQ ID NO: 310878 - DNA, 15 bp, Homo sapiens
tttcagtaagaacat

SEQ ID NO: 310879 - DNA, 15 bp, Homo sapiens
ttcagtaagaacatc

SEQ ID NO: 310880 - DNA, 15 bp, Homo sapiens
tcagtaagaacatct

SEQ ID NO: 310881 - DNA, 15 bp, Homo sapiens
cagtaagaacatctg

SEQ ID NO: 310882 - DNA, 15 bp, Homo sapiens
agtaagaacatctgg

SEQ ID NO: 310883 - DNA, 15 bp, Homo sapiens
gtaagaacatctggc

SEQ ID NO: 310884 - DNA, 15 bp, Homo sapiens
taagaacatctggct

SEQ ID NO: 310885 - DNA, 15 bp, Homo sapiens
aagaacatctggctt

SEQ ID NO: 310886 - DNA, 15 bp, Homo sapiens
agaacatctggcttt

SEQ ID NO: 310887 - DNA, 15 bp, Homo sapiens
gaacatctggctttt

SEQ ID NO: 310888 - DNA, 15 bp, Homo sapiens
aacatctggctttta

SEQ ID NO: 310889 - DNA, 15 bp, Homo sapiens
acatctggcttttac

SEQ ID NO: 310890 - DNA, 15 bp, Homo sapiens
catctggcttttaca

SEQ ID NO: 310891 - DNA, 15 bp, Homo sapiens
atctggcttttacag

SEQ ID NO: 310892 - DNA, 15 bp, Homo sapiens
tctggcttttacaga

SEQ ID NO: 310893 - DNA, 15 bp, Homo sapiens
ctggcttttacagaa

SEQ ID NO: 310894 - DNA, 15 bp, Homo sapiens
tggcttttacagaat

SEQ ID NO: 310895 - DNA, 15 bp, Homo sapiens
ggcttttacagaata

SEQ ID NO: 310896 - DNA, 15 bp, Homo sapiens
gcttttacagaatat

SEQ ID NO: 310897 - DNA, 15 bp, Homo sapiens
cttttacagaatatc

SEQ ID NO: 310898 - DNA, 15 bp, Homo sapiens
ttttacagaatatca

SEQ ID NO: 310899 - DNA, 15 bp, Homo sapiens
tttacagaatatcat

SEQ ID NO: 310900 - DNA, 15 bp, Homo sapiens
ttacagaatatcatt

SEQ ID NO: 310901 - DNA, 15 bp, Homo sapiens
tacagaatatcattt

SEQ ID NO: 310902 - DNA, 15 bp, Homo sapiens
acagaatatcatttg

SEQ ID NO: 310903 - DNA, 15 bp, Homo sapiens
cagaatatcatttga

SEQ ID NO: 310904 - DNA, 15 bp, Homo sapiens
agaatatcatttgag

SEQ ID NO: 310905 - DNA, 15 bp, Homo sapiens
gaatatcatttgagg

SEQ ID NO: 310906 - DNA, 15 bp, Homo sapiens
aatatcatttgaggg

SEQ ID NO: 310907 - DNA, 15 bp, Homo sapiens
atatcatttgaggga

SEQ ID NO: 310908 - DNA, 15 bp, Homo sapiens
tatcatttgagggaa

SEQ ID NO: 310909 - DNA, 15 bp, Homo sapiens
atcatttgagggaag

SEQ ID NO: 310910 - DNA, 15 bp, Homo sapiens
tcatttgagggaagg

SEQ ID NO: 310911 - DNA, 15 bp, Homo sapiens
catttgagggaaggg

SEQ ID NO: 310912 - DNA, 15 bp, Homo sapiens
atttgagggaaggga

SEQ ID NO: 310913 - DNA, 15 bp, Homo sapiens
tttgagggaagggaa

SEQ ID NO: 310914 - DNA, 15 bp, Homo sapiens
ttgagggaagggaaa

SEQ ID NO: 310915 - DNA, 15 bp, Homo sapiens
tgagggaagggaaat

SEQ ID NO: 310916 - DNA, 15 bp, Homo sapiens
gagggaagggaaatc

SEQ ID NO: 310917 - DNA, 15 bp, Homo sapiens
agggaagggaaatct

SEQ ID NO: 310918 - DNA, 15 bp, Homo sapiens
gggaagggaaatcta

SEQ ID NO: 310919 - DNA, 15 bp, Homo sapiens
ggaagggaaatctag

SEQ ID NO: 310920 - DNA, 15 bp, Homo sapiens
gaagggaaatctagg

SEQ ID NO: 310921 - DNA, 15 bp, Homo sapiens
aagggaaatctaggg

SEQ ID NO: 310922 - DNA, 15 bp, Homo sapiens
agggaaatctagggc

SEQ ID NO: 310923 - DNA, 15 bp, Homo sapiens
gggaaatctagggca

SEQ ID NO: 310924 - DNA, 15 bp, Homo sapiens
ggaaatctagggcag

SEQ ID NO: 310925 - DNA, 15 bp, Homo sapiens
gaaatctagggcaga

SEQ ID NO: 310926 - DNA, 15 bp, Homo sapiens
aaatctagggcagag

SEQ ID NO: 310927 - DNA, 15 bp, Homo sapiens
aatctagggcagagg

SEQ ID NO: 310928 - DNA, 15 bp, Homo sapiens
atctagggcagaggt

SEQ ID NO: 310929 - DNA, 15 bp, Homo sapiens
tctagggcagaggta

SEQ ID NO: 310930 - DNA, 15 bp, Homo sapiens
ctagggcagaggtaa

SEQ ID NO: 310931 - DNA, 15 bp, Homo sapiens
tagggcagaggtaac

SEQ ID NO: 310932 - DNA, 15 bp, Homo sapiens
agggcagaggtaaca

SEQ ID NO: 310933 - DNA, 15 bp, Homo sapiens
gggcagaggtaacaa

SEQ ID NO: 310934 - DNA, 15 bp, Homo sapiens
ggcagaggtaacaat

SEQ ID NO: 310935 - DNA, 15 bp, Homo sapiens
gcagaggtaacaata

SEQ ID NO: 310936 - DNA, 15 bp, Homo sapiens
cagaggtaacaataa

SEQ ID NO: 310937 - DNA, 15 bp, Homo sapiens
agaggtaacaataaa

SEQ ID NO: 310938 - DNA, 15 bp, Homo sapiens
gaggtaacaataaat

SEQ ID NO: 310939 - DNA, 15 bp, Homo sapiens
aggtaacaataaatt

SEQ ID NO: 310940 - DNA, 15 bp, Homo sapiens
ggtaacaataaattg

SEQ ID NO: 310941 - DNA, 15 bp, Homo sapiens
gtaacaataaattgc

SEQ ID NO: 310942 - DNA, 15 bp, Homo sapiens
taacaataaattgca

SEQ ID NO: 310943 - DNA, 15 bp, Homo sapiens
aacaataaattgcat

SEQ ID NO: 310944 - DNA, 15 bp, Homo sapiens
acaataaattgcatt

SEQ ID NO: 310945 - DNA, 15 bp, Homo sapiens
caataaattgcattt

SEQ ID NO: 310946 - DNA, 15 bp, Homo sapiens
aataaattgcatttg

SEQ ID NO: 310947 - DNA, 15 bp, Homo sapiens
ataaattgcatttgt

SEQ ID NO: 310948 - DNA, 15 bp, Homo sapiens
taaattgcatttgta

SEQ ID NO: 310949 - DNA, 15 bp, Homo sapiens
aaattgcatttgtat

SEQ ID NO: 310950 - DNA, 15 bp, Homo sapiens
aattgcatttgtata

SEQ ID NO: 310951 - DNA, 15 bp, Homo sapiens
attgcatttgtatag

SEQ ID NO: 310952 - DNA, 15 bp, Homo sapiens
ttgcatttgtatagg

SEQ ID NO: 310953 - DNA, 15 bp, Homo sapiens
tgcatttgtataggg

SEQ ID NO: 310954 - DNA, 15 bp, Homo sapiens
gcatttgtatagggc

SEQ ID NO: 310955 - DNA, 15 bp, Homo sapiens
catttgtatagggct

SEQ ID NO: 310956 - DNA, 15 bp, Homo sapiens
atttgtatagggctt

SEQ ID NO: 310957 - DNA, 15 bp, Homo sapiens
tttgtatagggcttg

SEQ ID NO: 310958 - DNA, 15 bp, Homo sapiens
ttgtatagggcttga

SEQ ID NO: 310959 - DNA, 15 bp, Homo sapiens
tgtatagggcttgaa

SEQ ID NO: 310960 - DNA, 15 bp, Homo sapiens
gtatagggcttgaag

SEQ ID NO: 310961 - DNA, 15 bp, Homo sapiens
tatagggcttgaagc

SEQ ID NO: 310962 - DNA, 15 bp, Homo sapiens
atagggcttgaagct

SEQ ID NO: 310963 - DNA, 15 bp, Homo sapiens
tagggcttgaagctt

SEQ ID NO: 310964 - DNA, 15 bp, Homo sapiens
agggcttgaagcttc

SEQ ID NO: 310965 - DNA, 15 bp, Homo sapiens
gggcttgaagcttct

SEQ ID NO: 310966 - DNA, 15 bp, Homo sapiens
ggcttgaagcttcta

SEQ ID NO: 310967 - DNA, 15 bp, Homo sapiens
gcttgaagcttctaa

SEQ ID NO: 310968 - DNA, 15 bp, Homo sapiens
cttgaagcttctaaa

SEQ ID NO: 310969 - DNA, 15 bp, Homo sapiens
ttgaagcttctaaag

SEQ ID NO: 310970 - DNA, 15 bp, Homo sapiens
tgaagcttctaaagc

SEQ ID NO: 310971 - DNA, 15 bp, Homo sapiens
gaagcttctaaagca

SEQ ID NO: 310972 - DNA, 15 bp, Homo sapiens
aagcttctaaagcaa

SEQ ID NO: 310973 - DNA, 15 bp, Homo sapiens
agcttctaaagcaac

SEQ ID NO: 310974 - DNA, 15 bp, Homo sapiens
gcttctaaagcaaca

SEQ ID NO: 310975 - DNA, 15 bp, Homo sapiens
cttctaaagcaacat

SEQ ID NO: 310976 - DNA, 15 bp, Homo sapiens
ttctaaagcaacatc

SEQ ID NO: 310977 - DNA, 15 bp, Homo sapiens
tctaaagcaacatct

SEQ ID NO: 310978 - DNA, 15 bp, Homo sapiens
ctaaagcaacatctc

SEQ ID NO: 310979 - DNA, 15 bp, Homo sapiens
taaagcaacatctca

SEQ ID NO: 310980 - DNA, 15 bp, Homo sapiens
aaagcaacatctcat

SEQ ID NO: 310981 - DNA, 15 bp, Homo sapiens
aagcaacatctcatt

SEQ ID NO: 310982 - DNA, 15 bp, Homo sapiens
agcaacatctcattc

SEQ ID NO: 310983 - DNA, 15 bp, Homo sapiens
gcaacatctcattca

SEQ ID NO: 310984 - DNA, 15 bp, Homo sapiens
caacatctcattcat

SEQ ID NO: 310985 - DNA, 15 bp, Homo sapiens
aacatctcattcatt

SEQ ID NO: 310986 - DNA, 15 bp, Homo sapiens
acatctcattcattg

SEQ ID NO: 310987 - DNA, 15 bp, Homo sapiens
catctcattcattga

SEQ ID NO: 310988 - DNA, 15 bp, Homo sapiens
atctcattcattgat

SEQ ID NO: 310989 - DNA, 15 bp, Homo sapiens
tctcattcattgatt

SEQ ID NO: 310990 - DNA, 15 bp, Homo sapiens
ctcattcattgattc

SEQ ID NO: 310991 - DNA, 15 bp, Homo sapiens
tcattcattgattct

SEQ ID NO: 310992 - DNA, 15 bp, Homo sapiens
cattcattgattctc

SEQ ID NO: 310993 - DNA, 15 bp, Homo sapiens
attcattgattctca

SEQ ID NO: 310994 - DNA, 15 bp, Homo sapiens
ttcattgattctcag

SEQ ID NO: 310995 - DNA, 15 bp, Homo sapiens
tcattgattctcagt

SEQ ID NO: 310996 - DNA, 15 bp, Homo sapiens
cattgattctcagtt

SEQ ID NO: 310997 - DNA, 15 bp, Homo sapiens
attgattctcagttt

SEQ ID NO: 310998 - DNA, 15 bp, Homo sapiens
ttgattctcagtttc

SEQ ID NO: 310999 - DNA, 15 bp, Homo sapiens
tgattctcagtttct

SEQ ID NO: 311000 - DNA, 15 bp, Homo sapiens
gattctcagtttctc

SEQ ID NO: 311001 - DNA, 15 bp, Homo sapiens
attctcagtttctca

SEQ ID NO: 311002 - DNA, 15 bp, Homo sapiens
ttctcagtttctcac

SEQ ID NO: 311003 - DNA, 15 bp, Homo sapiens
tctcagtttctcacc

SEQ ID NO: 311004 - DNA, 15 bp, Homo sapiens
ctcagtttctcacct

SEQ ID NO: 311005 - DNA, 15 bp, Homo sapiens
tcagtttctcaccta

SEQ ID NO: 311006 - DNA, 15 bp, Homo sapiens
cagtttctcacctag

SEQ ID NO: 311007 - DNA, 15 bp, Homo sapiens
agtttctcacctagc

SEQ ID NO: 311008 - DNA, 15 bp, Homo sapiens
gtttctcacctagcc

SEQ ID NO: 311009 - DNA, 15 bp, Homo sapiens
tttctcacctagcct

SEQ ID NO: 311010 - DNA, 15 bp, Homo sapiens
ttctcacctagcctt

SEQ ID NO: 311011 - DNA, 15 bp, Homo sapiens
tctcacctagccttc

SEQ ID NO: 311012 - DNA, 15 bp, Homo sapiens
ctcacctagccttct

SEQ ID NO: 311013 - DNA, 15 bp, Homo sapiens
tcacctagccttctg

SEQ ID NO: 311014 - DNA, 15 bp, Homo sapiens
cacctagccttctgt

SEQ ID NO: 311015 - DNA, 15 bp, Homo sapiens
acctagccttctgtg

SEQ ID NO: 311016 - DNA, 15 bp, Homo sapiens
cctagccttctgtga

SEQ ID NO: 311017 - DNA, 15 bp, Homo sapiens
ctagccttctgtgaa

SEQ ID NO: 311018 - DNA, 15 bp, Homo sapiens
tagccttctgtgaag

SEQ ID NO: 311019 - DNA, 15 bp, Homo sapiens
agccttctgtgaaga

SEQ ID NO: 311020 - DNA, 15 bp, Homo sapiens
gccttctgtgaagat

SEQ ID NO: 311021 - DNA, 15 bp, Homo sapiens
ccttctgtgaagatg

SEQ ID NO: 311022 - DNA, 15 bp, Homo sapiens
cttctgtgaagatgg

SEQ ID NO: 311023 - DNA, 15 bp, Homo sapiens
ttctgtgaagatggt

SEQ ID NO: 311024 - DNA, 15 bp, Homo sapiens
tctgtgaagatggtg

SEQ ID NO: 311025 - DNA, 15 bp, Homo sapiens
ctgtgaagatggtgt

SEQ ID NO: 311026 - DNA, 15 bp, Homo sapiens
tgtgaagatggtgtt

SEQ ID NO: 311027 - DNA, 15 bp, Homo sapiens
gtgaagatggtgttc

SEQ ID NO: 311028 - DNA, 15 bp, Homo sapiens
tgaagatggtgttcc

SEQ ID NO: 311029 - DNA, 15 bp, Homo sapiens
gaagatggtgttccc

SEQ ID NO: 311030 - DNA, 15 bp, Homo sapiens
aagatggtgttccct

SEQ ID NO: 311031 - DNA, 15 bp, Homo sapiens
agatggtgttccctc

SEQ ID NO: 311032 - DNA, 15 bp, Homo sapiens
gatggtgttccctcc

SEQ ID NO: 311033 - DNA, 15 bp, Homo sapiens
atggtgttccctcca

SEQ ID NO: 311034 - DNA, 15 bp, Homo sapiens
tggtgttccctccat

SEQ ID NO: 311035 - DNA, 15 bp, Homo sapiens
ggtgttccctccatt

SEQ ID NO: 311036 - DNA, 15 bp, Homo sapiens
gtgttccctccattt

SEQ ID NO: 311037 - DNA, 15 bp, Homo sapiens
tgttccctccatttt

SEQ ID NO: 311038 - DNA, 15 bp, Homo sapiens
gttccctccatttta

SEQ ID NO: 311039 - DNA, 15 bp, Homo sapiens
ttccctccattttat

SEQ ID NO: 311040 - DNA, 15 bp, Homo sapiens
tccctccattttata

SEQ ID NO: 311041 - DNA, 15 bp, Homo sapiens
ccctccattttatag

SEQ ID NO: 311042 - DNA, 15 bp, Homo sapiens
cctccattttatagg

SEQ ID NO: 311043 - DNA, 15 bp, Homo sapiens
ctccattttataggt

SEQ ID NO: 311044 - DNA, 15 bp, Homo sapiens
tccattttataggtg

SEQ ID NO: 311045 - DNA, 15 bp, Homo sapiens
ccattttataggtgt

SEQ ID NO: 311046 - DNA, 15 bp, Homo sapiens
cattttataggtgtg

SEQ ID NO: 311047 - DNA, 15 bp, Homo sapiens
attttataggtgtgg

SEQ ID NO: 311048 - DNA, 15 bp, Homo sapiens
ttttataggtgtgga

SEQ ID NO: 311049 - DNA, 15 bp, Homo sapiens
tttataggtgtggaa

SEQ ID NO: 311050 - DNA, 15 bp, Homo sapiens
ttataggtgtggaag

SEQ ID NO: 311051 - DNA, 15 bp, Homo sapiens
tataggtgtggaaga

SEQ ID NO: 311052 - DNA, 15 bp, Homo sapiens
ataggtgtggaagac

SEQ ID NO: 311053 - DNA, 15 bp, Homo sapiens
taggtgtggaagacg

SEQ ID NO: 311054 - DNA, 15 bp, Homo sapiens
aggtgtggaagacgg

SEQ ID NO: 311055 - DNA, 15 bp, Homo sapiens
ggtgtggaagacgga

SEQ ID NO: 311056 - DNA, 15 bp, Homo sapiens
gtgtggaagacggag

SEQ ID NO: 311057 - DNA, 15 bp, Homo sapiens
tgtggaagacggagg

SEQ ID NO: 311058 - DNA, 15 bp, Homo sapiens
gtggaagacggaggg

SEQ ID NO: 311059 - DNA, 15 bp, Homo sapiens
tggaagacggagggt

SEQ ID NO: 311060 - DNA, 15 bp, Homo sapiens
ggaagacggagggtc

SEQ ID NO: 311061 - DNA, 15 bp, Homo sapiens
gaagacggagggtca

SEQ ID NO: 311062 - DNA, 15 bp, Homo sapiens
aagacggagggtcac

SEQ ID NO: 311063 - DNA, 15 bp, Homo sapiens
agacggagggtcaca

SEQ ID NO: 311064 - DNA, 15 bp, Homo sapiens
gacggagggtcacac

SEQ ID NO: 311065 - DNA, 15 bp, Homo sapiens
acggagggtcacact

SEQ ID NO: 311066 - DNA, 15 bp, Homo sapiens
cggagggtcacactg

SEQ ID NO: 311067 - DNA, 15 bp, Homo sapiens
ggagggtcacactgg

SEQ ID NO: 311068 - DNA, 15 bp, Homo sapiens
gagggtcacactggg

SEQ ID NO: 311069 - DNA, 15 bp, Homo sapiens
agggtcacactggga

SEQ ID NO: 311070 - DNA, 15 bp, Homo sapiens
gggtcacactgggat

SEQ ID NO: 311071 - DNA, 15 bp, Homo sapiens
ggtcacactgggatg

SEQ ID NO: 311072 - DNA, 15 bp, Homo sapiens
gtcacactgggatgc

SEQ ID NO: 311073 - DNA, 15 bp, Homo sapiens
tcacactgggatgca

SEQ ID NO: 311074 - DNA, 15 bp, Homo sapiens
cacactgggatgcat

SEQ ID NO: 311075 - DNA, 15 bp, Homo sapiens
acactgggatgcatt

SEQ ID NO: 311076 - DNA, 15 bp, Homo sapiens
cactgggatgcattg

SEQ ID NO: 311077 - DNA, 15 bp, Homo sapiens
actgggatgcattgt

SEQ ID NO: 311078 - DNA, 15 bp, Homo sapiens
ctgggatgcattgtt

SEQ ID NO: 311079 - DNA, 15 bp, Homo sapiens
tgggatgcattgttc

SEQ ID NO: 311080 - DNA, 15 bp, Homo sapiens
gggatgcattgttcg

SEQ ID NO: 311081 - DNA, 15 bp, Homo sapiens
ggatgcattgttcgt

SEQ ID NO: 311082 - DNA, 15 bp, Homo sapiens
gatgcattgttcgtg

SEQ ID NO: 311083 - DNA, 15 bp, Homo sapiens
atgcattgttcgtgg

SEQ ID NO: 311084 - DNA, 15 bp, Homo sapiens
tgcattgttcgtggt

SEQ ID NO: 311085 - DNA, 15 bp, Homo sapiens
gcattgttcgtggtg

SEQ ID NO: 311086 - DNA, 15 bp, Homo sapiens
cattgttcgtggtga

SEQ ID NO: 311087 - DNA, 15 bp, Homo sapiens
attgttcgtggtgaa

SEQ ID NO: 311088 - DNA, 15 bp, Homo sapiens
ttgttcgtggtgaaa

SEQ ID NO: 311089 - DNA, 15 bp, Homo sapiens
tgttcgtggtgaaac

SEQ ID NO: 311090 - DNA, 15 bp, Homo sapiens
gttcgtggtgaaact

SEQ ID NO: 311091 - DNA, 15 bp, Homo sapiens
ttcgtggtgaaactt

SEQ ID NO: 311092 - DNA, 15 bp, Homo sapiens
tcgtggtgaaacttt

SEQ ID NO: 311093 - DNA, 15 bp, Homo sapiens
cgtggtgaaactttg

SEQ ID NO: 311094 - DNA, 15 bp, Homo sapiens
gtggtgaaactttga

SEQ ID NO: 311095 - DNA, 15 bp, Homo sapiens
tggtgaaactttgat

SEQ ID NO: 311096 - DNA, 15 bp, Homo sapiens
ggtgaaactttgatt

SEQ ID NO: 311097 - DNA, 15 bp, Homo sapiens
gtgaaactttgattc

SEQ ID NO: 311098 - DNA, 15 bp, Homo sapiens
tgaaactttgattct

SEQ ID NO: 311099 - DNA, 15 bp, Homo sapiens
gaaactttgattctg

SEQ ID NO: 311100 - DNA, 15 bp, Homo sapiens
aaactttgattctgt

SEQ ID NO: 311101 - DNA, 15 bp, Homo sapiens
aactttgattctgtc

SEQ ID NO: 311102 - DNA, 15 bp, Homo sapiens
actttgattctgtct

SEQ ID NO: 311103 - DNA, 15 bp, Homo sapiens
ctttgattctgtctc

SEQ ID NO: 311104 - DNA, 15 bp, Homo sapiens
tttgattctgtctcc

SEQ ID NO: 311105 - DNA, 15 bp, Homo sapiens
ttgattctgtctcct

SEQ ID NO: 311106 - DNA, 15 bp, Homo sapiens
tgattctgtctcctg

SEQ ID NO: 311107 - DNA, 15 bp, Homo sapiens
gattctgtctcctga

SEQ ID NO: 311108 - DNA, 15 bp, Homo sapiens
attctgtctcctgag

SEQ ID NO: 311109 - DNA, 15 bp, Homo sapiens
ttctgtctcctgaga

SEQ ID NO: 311110 - DNA, 15 bp, Homo sapiens
tctgtctcctgagaa

SEQ ID NO: 311111 - DNA, 15 bp, Homo sapiens
ctgtctcctgagaac

SEQ ID NO: 311112 - DNA, 15 bp, Homo sapiens
tgtctcctgagaacc

SEQ ID NO: 311113 - DNA, 15 bp, Homo sapiens
gtctcctgagaacca

SEQ ID NO: 311114 - DNA, 15 bp, Homo sapiens
tctcctgagaaccaa

SEQ ID NO: 311115 - DNA, 15 bp, Homo sapiens
ctcctgagaaccaaa

SEQ ID NO: 311116 - DNA, 15 bp, Homo sapiens
tcctgagaaccaaag

SEQ ID NO: 311117 - DNA, 15 bp, Homo sapiens
cctgagaaccaaaga

SEQ ID NO: 311118 - DNA, 15 bp, Homo sapiens
ctgagaaccaaagat

SEQ ID NO: 311119 - DNA, 15 bp, Homo sapiens
tgagaaccaaagatt

SEQ ID NO: 311120 - DNA, 15 bp, Homo sapiens
gagaaccaaagattc

SEQ ID NO: 311121 - DNA, 15 bp, Homo sapiens
agaaccaaagattct

SEQ ID NO: 311122 - DNA, 15 bp, Homo sapiens
gaaccaaagattctg

SEQ ID NO: 311123 - DNA, 15 bp, Homo sapiens
aaccaaagattctgc

SEQ ID NO: 311124 - DNA, 15 bp, Homo sapiens
accaaagattctgca

SEQ ID NO: 311125 - DNA, 15 bp, Homo sapiens
ccaaagattctgcat

SEQ ID NO: 311126 - DNA, 15 bp, Homo sapiens
caaagattctgcatt

SEQ ID NO: 311127 - DNA, 15 bp, Homo sapiens
aaagattctgcattt

SEQ ID NO: 311128 - DNA, 15 bp, Homo sapiens
aagattctgcatttg

SEQ ID NO: 311129 - DNA, 15 bp, Homo sapiens
agattctgcatttgg

SEQ ID NO: 311130 - DNA, 15 bp, Homo sapiens
gattctgcatttggc

SEQ ID NO: 311131 - DNA, 15 bp, Homo sapiens
attctgcatttggca

SEQ ID NO: 311132 - DNA, 15 bp, Homo sapiens
ttctgcatttggcaa

SEQ ID NO: 311133 - DNA, 15 bp, Homo sapiens
tctgcatttggcaat

SEQ ID NO: 311134 - DNA, 15 bp, Homo sapiens
ctgcatttggcaatt

SEQ ID NO: 311135 - DNA, 15 bp, Homo sapiens
tgcatttggcaatta

SEQ ID NO: 311136 - DNA, 15 bp, Homo sapiens
gcatttggcaattag

SEQ ID NO: 311137 - DNA, 15 bp, Homo sapiens
catttggcaattaga

SEQ ID NO: 311138 - DNA, 15 bp, Homo sapiens
atttggcaattagaa

SEQ ID NO: 311139 - DNA, 15 bp, Homo sapiens
tttggcaattagaag

SEQ ID NO: 311140 - DNA, 15 bp, Homo sapiens
ttggcaattagaagg

SEQ ID NO: 311141 - DNA, 15 bp, Homo sapiens
tggcaattagaagga

SEQ ID NO: 311142 - DNA, 15 bp, Homo sapiens
ggcaattagaaggag

SEQ ID NO: 311143 - DNA, 15 bp, Homo sapiens
gcaattagaaggagt

SEQ ID NO: 311144 - DNA, 15 bp, Homo sapiens
caattagaaggagtc

SEQ ID NO: 311145 - DNA, 15 bp, Homo sapiens
aattagaaggagtca

SEQ ID NO: 311146 - DNA, 15 bp, Homo sapiens
attagaaggagtcat

SEQ ID NO: 311147 - DNA, 15 bp, Homo sapiens
ttagaaggagtcatc

SEQ ID NO: 311148 - DNA, 15 bp, Homo sapiens
tagaaggagtcatcc

SEQ ID NO: 311149 - DNA, 15 bp, Homo sapiens
agaaggagtcatcct

SEQ ID NO: 311150 - DNA, 15 bp, Homo sapiens
gaaggagtcatcctt

SEQ ID NO: 311151 - DNA, 15 bp, Homo sapiens
aaggagtcatccttt

SEQ ID NO: 311152 - DNA, 15 bp, Homo sapiens
aggagtcatcctttg

SEQ ID NO: 311153 - DNA, 15 bp, Homo sapiens
ggagtcatcctttgc

SEQ ID NO: 311154 - DNA, 15 bp, Homo sapiens
gagtcatcctttgcc

SEQ ID NO: 311155 - DNA, 15 bp, Homo sapiens
agtcatcctttgcct

SEQ ID NO: 311156 - DNA, 15 bp, Homo sapiens
gtcatcctttgcctt

SEQ ID NO: 311157 - DNA, 15 bp, Homo sapiens
tcatcctttgcctta

SEQ ID NO: 311158 - DNA, 15 bp, Homo sapiens
catcctttgccttaa

SEQ ID NO: 311159 - DNA, 15 bp, Homo sapiens
atcctttgccttaag

SEQ ID NO: 311160 - DNA, 15 bp, Homo sapiens
tcctttgccttaagt

SEQ ID NO: 311161 - DNA, 15 bp, Homo sapiens
cctttgccttaagtg

SEQ ID NO: 311162 - DNA, 15 bp, Homo sapiens
ctttgccttaagtgt

SEQ ID NO: 311163 - DNA, 15 bp, Homo sapiens
tttgccttaagtgta

SEQ ID NO: 311164 - DNA, 15 bp, Homo sapiens
ttgccttaagtgtac

SEQ ID NO: 311165 - DNA, 15 bp, Homo sapiens
tgccttaagtgtact

SEQ ID NO: 311166 - DNA, 15 bp, Homo sapiens
gccttaagtgtactc

SEQ ID NO: 311167 - DNA, 15 bp, Homo sapiens
ccttaagtgtactca

SEQ ID NO: 311168 - DNA, 15 bp, Homo sapiens
cttaagtgtactcaa

SEQ ID NO: 311169 - DNA, 15 bp, Homo sapiens
ttaagtgtactcaaa

SEQ ID NO: 311170 - DNA, 15 bp, Homo sapiens
taagtgtactcaaat

SEQ ID NO: 311171 - DNA, 15 bp, Homo sapiens
aagtgtactcaaatt

SEQ ID NO: 311172 - DNA, 15 bp, Homo sapiens
agtgtactcaaattc

SEQ ID NO: 311173 - DNA, 15 bp, Homo sapiens
gtgtactcaaattcc

SEQ ID NO: 311174 - DNA, 15 bp, Homo sapiens
tgtactcaaattcct

SEQ ID NO: 311175 - DNA, 15 bp, Homo sapiens
gtactcaaattcctc

SEQ ID NO: 311176 - DNA, 15 bp, Homo sapiens
tactcaaattcctct

SEQ ID NO: 311177 - DNA, 15 bp, Homo sapiens
actcaaattcctctg

SEQ ID NO: 311178 - DNA, 15 bp, Homo sapiens
ctcaaattcctctgg

SEQ ID NO: 311179 - DNA, 15 bp, Homo sapiens
tcaaattcctctggc

SEQ ID NO: 311180 - DNA, 15 bp, Homo sapiens
caaattcctctggcc

SEQ ID NO: 311181 - DNA, 15 bp, Homo sapiens
aaattcctctggcca

SEQ ID NO: 311182 - DNA, 15 bp, Homo sapiens
aattcctctggccat

SEQ ID NO: 311183 - DNA, 15 bp, Homo sapiens
attcctctggccatt

SEQ ID NO: 311184 - DNA, 15 bp, Homo sapiens
ttcctctggccatta

SEQ ID NO: 311185 - DNA, 15 bp, Homo sapiens
tcctctggccattaa

SEQ ID NO: 311186 - DNA, 15 bp, Homo sapiens
cctctggccattaat

SEQ ID NO: 311187 - DNA, 15 bp, Homo sapiens
ctctggccattaatg

SEQ ID NO: 311188 - DNA, 15 bp, Homo sapiens
tctggccattaatgg

SEQ ID NO: 311189 - DNA, 15 bp, Homo sapiens
ctggccattaatggc

SEQ ID NO: 311190 - DNA, 15 bp, Homo sapiens
tggccattaatggca

SEQ ID NO: 311191 - DNA, 15 bp, Homo sapiens
ggccattaatggcaa

SEQ ID NO: 311192 - DNA, 15 bp, Homo sapiens
gccattaatggcaag

SEQ ID NO: 311193 - DNA, 15 bp, Homo sapiens
ccattaatggcaagt

SEQ ID NO: 311194 - DNA, 15 bp, Homo sapiens
cattaatggcaagta

SEQ ID NO: 311195 - DNA, 15 bp, Homo sapiens
attaatggcaagtaa

SEQ ID NO: 311196 - DNA, 15 bp, Homo sapiens
ttaatggcaagtaac

SEQ ID NO: 311197 - DNA, 15 bp, Homo sapiens
taatggcaagtaacc

SEQ ID NO: 311198 - DNA, 15 bp, Homo sapiens
aatggcaagtaacct

SEQ ID NO: 311199 - DNA, 15 bp, Homo sapiens
atggcaagtaacctc

SEQ ID NO: 311200 - DNA, 15 bp, Homo sapiens
tggcaagtaacctca

SEQ ID NO: 311201 - DNA, 15 bp, Homo sapiens
ggcaagtaacctcag

SEQ ID NO: 311202 - DNA, 15 bp, Homo sapiens
gcaagtaacctcagt

SEQ ID NO: 311203 - DNA, 15 bp, Homo sapiens
caagtaacctcagtg

SEQ ID NO: 311204 - DNA, 15 bp, Homo sapiens
aagtaacctcagtgg

SEQ ID NO: 311205 - DNA, 15 bp, Homo sapiens
agtaacctcagtggc

SEQ ID NO: 311206 - DNA, 15 bp, Homo sapiens
gtaacctcagtggct

SEQ ID NO: 311207 - DNA, 15 bp, Homo sapiens
taacctcagtggcta

SEQ ID NO: 311208 - DNA, 15 bp, Homo sapiens
aacctcagtggctat

SEQ ID NO: 311209 - DNA, 15 bp, Homo sapiens
acctcagtggctatc

SEQ ID NO: 311210 - DNA, 15 bp, Homo sapiens
cctcagtggctatca

SEQ ID NO: 311211 - DNA, 15 bp, Homo sapiens
ctcagtggctatcac

SEQ ID NO: 311212 - DNA, 15 bp, Homo sapiens
tcagtggctatcact

SEQ ID NO: 311213 - DNA, 15 bp, Homo sapiens
cagtggctatcacta

SEQ ID NO: 311214 - DNA, 15 bp, Homo sapiens
agtggctatcactat

SEQ ID NO: 311215 - DNA, 15 bp, Homo sapiens
gtggctatcactatt

SEQ ID NO: 311216 - DNA, 15 bp, Homo sapiens
tggctatcactattt

SEQ ID NO: 311217 - DNA, 15 bp, Homo sapiens
ggctatcactattta

SEQ ID NO: 311218 - DNA, 15 bp, Homo sapiens
gctatcactatttaa

SEQ ID NO: 311219 - DNA, 15 bp, Homo sapiens
ctatcactatttaaa

SEQ ID NO: 311220 - DNA, 15 bp, Homo sapiens
tatcactatttaaat

SEQ ID NO: 311221 - DNA, 15 bp, Homo sapiens
atcactatttaaata

SEQ ID NO: 311222 - DNA, 15 bp, Homo sapiens
tcactatttaaatag

SEQ ID NO: 311223 - DNA, 15 bp, Homo sapiens
cactatttaaatagc

SEQ ID NO: 311224 - DNA, 15 bp, Homo sapiens
actatttaaatagcc

SEQ ID NO: 311225 - DNA, 15 bp, Homo sapiens
ctatttaaatagcct

SEQ ID NO: 311226 - DNA, 15 bp, Homo sapiens
tatttaaatagcctt

SEQ ID NO: 311227 - DNA, 15 bp, Homo sapiens
atttaaatagccttc

SEQ ID NO: 311228 - DNA, 15 bp, Homo sapiens
tttaaatagccttct

SEQ ID NO: 311229 - DNA, 15 bp, Homo sapiens
ttaaatagccttctg

SEQ ID NO: 311230 - DNA, 15 bp, Homo sapiens
taaatagccttctgt

SEQ ID NO: 311231 - DNA, 15 bp, Homo sapiens
aaatagccttctgtt

SEQ ID NO: 311232 - DNA, 15 bp, Homo sapiens
aatagccttctgtta

SEQ ID NO: 311233 - DNA, 15 bp, Homo sapiens
atagccttctgttat

SEQ ID NO: 311234 - DNA, 15 bp, Homo sapiens
tagccttctgttatt

SEQ ID NO: 311235 - DNA, 15 bp, Homo sapiens
agccttctgttattc

SEQ ID NO: 311236 - DNA, 15 bp, Homo sapiens
gccttctgttattct

SEQ ID NO: 311237 - DNA, 15 bp, Homo sapiens
ccttctgttattctt

SEQ ID NO: 311238 - DNA, 15 bp, Homo sapiens
cttctgttattcttc

SEQ ID NO: 311239 - DNA, 15 bp, Homo sapiens
ttctgttattcttct

SEQ ID NO: 311240 - DNA, 15 bp, Homo sapiens
tctgttattcttctt

SEQ ID NO: 311241 - DNA, 15 bp, Homo sapiens
ctgttattcttcttt

SEQ ID NO: 311242 - DNA, 15 bp, Homo sapiens
tgttattcttctttc

SEQ ID NO: 311243 - DNA, 15 bp, Homo sapiens
gttattcttctttct

SEQ ID NO: 311244 - DNA, 15 bp, Homo sapiens
ttattcttctttctc

SEQ ID NO: 311245 - DNA, 15 bp, Homo sapiens
tattcttctttctcc

SEQ ID NO: 311246 - DNA, 15 bp, Homo sapiens
attcttctttctccc

SEQ ID NO: 311247 - DNA, 15 bp, Homo sapiens
ttcttctttctcccc

SEQ ID NO: 311248 - DNA, 15 bp, Homo sapiens
tcttctttctcccca

SEQ ID NO: 311249 - DNA, 15 bp, Homo sapiens
cttctttctccccat

SEQ ID NO: 311250 - DNA, 15 bp, Homo sapiens
ttctttctccccatt

SEQ ID NO: 311251 - DNA, 15 bp, Homo sapiens
tctttctccccattt

SEQ ID NO: 311252 - DNA, 15 bp, Homo sapiens
ctttctccccatttt

SEQ ID NO: 311253 - DNA, 15 bp, Homo sapiens
tttctccccattttc

SEQ ID NO: 311254 - DNA, 15 bp, Homo sapiens
ttctccccattttcc

SEQ ID NO: 311255 - DNA, 15 bp, Homo sapiens
tctccccattttcct

SEQ ID NO: 311256 - DNA, 15 bp, Homo sapiens
ctccccattttcctc

SEQ ID NO: 311257 - DNA, 15 bp, Homo sapiens
tccccattttcctct

SEQ ID NO: 311258 - DNA, 15 bp, Homo sapiens
ccccattttcctctg

SEQ ID NO: 311259 - DNA, 15 bp, Homo sapiens
ccattttcctctgta

SEQ ID NO: 311260 - DNA, 15 bp, Homo sapiens
cattttcctctgtac

SEQ ID NO: 311261 - DNA, 15 bp, Homo sapiens
attttcctctgtact

SEQ ID NO: 311262 - DNA, 15 bp, Homo sapiens
ttttcctctgtactc

SEQ ID NO: 311263 - DNA, 15 bp, Homo sapiens
tttcctctgtactct

SEQ ID NO: 311264 - DNA, 15 bp, Homo sapiens
ttcctctgtactctg

SEQ ID NO: 311265 - DNA, 15 bp, Homo sapiens
tcctctgtactctga

SEQ ID NO: 311266 - DNA, 15 bp, Homo sapiens
cctctgtactctgat

SEQ ID NO: 311267 - DNA, 15 bp, Homo sapiens
ctctgtactctgatc

SEQ ID NO: 311268 - DNA, 15 bp, Homo sapiens
tctgtactctgatca

SEQ ID NO: 311269 - DNA, 15 bp, Homo sapiens
ctgtactctgatcac

SEQ ID NO: 311270 - DNA, 15 bp, Homo sapiens
tgtactctgatcacc

SEQ ID NO: 311271 - DNA, 15 bp, Homo sapiens
gtactctgatcacct

SEQ ID NO: 311272 - DNA, 15 bp, Homo sapiens
tactctgatcacctt

SEQ ID NO: 311273 - DNA, 15 bp, Homo sapiens
actctgatcaccttt

SEQ ID NO: 311274 - DNA, 15 bp, Homo sapiens
ctctgatcacctttt

SEQ ID NO: 311275 - DNA, 15 bp, Homo sapiens
tctgatcaccttttc

SEQ ID NO: 311276 - DNA, 15 bp, Homo sapiens
ctgatcaccttttct

SEQ ID NO: 311277 - DNA, 15 bp, Homo sapiens
tgatcaccttttctg

SEQ ID NO: 311278 - DNA, 15 bp, Homo sapiens
gatcaccttttctgc

SEQ ID NO: 311279 - DNA, 15 bp, Homo sapiens
atcaccttttctgct

SEQ ID NO: 311280 - DNA, 15 bp, Homo sapiens
tcaccttttctgctg

SEQ ID NO: 311281 - DNA, 15 bp, Homo sapiens
caccttttctgctgt

SEQ ID NO: 311282 - DNA, 15 bp, Homo sapiens
accttttctgctgta

SEQ ID NO: 311283 - DNA, 15 bp, Homo sapiens
ccttttctgctgtat

SEQ ID NO: 311284 - DNA, 15 bp, Homo sapiens
cttttctgctgtatc

SEQ ID NO: 311285 - DNA, 15 bp, Homo sapiens
ttttctgctgtatct

SEQ ID NO: 311286 - DNA, 15 bp, Homo sapiens
tttctgctgtatctt

SEQ ID NO: 311287 - DNA, 15 bp, Homo sapiens
ttctgctgtatcttt

SEQ ID NO: 311288 - DNA, 15 bp, Homo sapiens
tctgctgtatctttg

SEQ ID NO: 311289 - DNA, 15 bp, Homo sapiens
ctgctgtatctttgc

SEQ ID NO: 311290 - DNA, 15 bp, Homo sapiens
tgctgtatctttgca

SEQ ID NO: 311291 - DNA, 15 bp, Homo sapiens
gctgtatctttgcaa

SEQ ID NO: 311292 - DNA, 15 bp, Homo sapiens
ctgtatctttgcaac

SEQ ID NO: 311293 - DNA, 15 bp, Homo sapiens
tgtatctttgcaacc

SEQ ID NO: 311294 - DNA, 15 bp, Homo sapiens
gtatctttgcaacct

SEQ ID NO: 311295 - DNA, 15 bp, Homo sapiens
tatctttgcaacctg

SEQ ID NO: 311296 - DNA, 15 bp, Homo sapiens
atctttgcaacctgt

SEQ ID NO: 311297 - DNA, 15 bp, Homo sapiens
tctttgcaacctgta

SEQ ID NO: 311298 - DNA, 15 bp, Homo sapiens
ctttgcaacctgtaa

SEQ ID NO: 311299 - DNA, 15 bp, Homo sapiens
tttgcaacctgtaag

SEQ ID NO: 311300 - DNA, 15 bp, Homo sapiens
ttgcaacctgtaagg

SEQ ID NO: 311301 - DNA, 15 bp, Homo sapiens
tgcaacctgtaaggg

SEQ ID NO: 311302 - DNA, 15 bp, Homo sapiens
gcaacctgtaaggga

SEQ ID NO: 311303 - DNA, 15 bp, Homo sapiens
caacctgtaagggat

SEQ ID NO: 311304 - DNA, 15 bp, Homo sapiens
aacctgtaagggatt

SEQ ID NO: 311305 - DNA, 15 bp, Homo sapiens
acctgtaagggattt

SEQ ID NO: 311306 - DNA, 15 bp, Homo sapiens
cctgtaagggatttt

SEQ ID NO: 311307 - DNA, 15 bp, Homo sapiens
ctgtaagggattttc

SEQ ID NO: 311308 - DNA, 15 bp, Homo sapiens
tgtaagggattttca

SEQ ID NO: 311309 - DNA, 15 bp, Homo sapiens
gtaagggattttcat

SEQ ID NO: 311310 - DNA, 15 bp, Homo sapiens
taagggattttcatt

SEQ ID NO: 311311 - DNA, 15 bp, Homo sapiens
aagggattttcatta

SEQ ID NO: 311312 - DNA, 15 bp, Homo sapiens
agggattttcattat

SEQ ID NO: 311313 - DNA, 15 bp, Homo sapiens
gggattttcattatc

SEQ ID NO: 311314 - DNA, 15 bp, Homo sapiens
ggattttcattatca

SEQ ID NO: 311315 - DNA, 15 bp, Homo sapiens
gattttcattatcaa

SEQ ID NO: 311316 - DNA, 15 bp, Homo sapiens
attttcattatcaag

SEQ ID NO: 311317 - DNA, 15 bp, Homo sapiens
ttttcattatcaaga

SEQ ID NO: 311318 - DNA, 15 bp, Homo sapiens
tttcattatcaagaa

SEQ ID NO: 311319 - DNA, 15 bp, Homo sapiens
ttcattatcaagaag

SEQ ID NO: 311320 - DNA, 15 bp, Homo sapiens
tcattatcaagaaga

SEQ ID NO: 311321 - DNA, 15 bp, Homo sapiens
cattatcaagaagag

SEQ ID NO: 311322 - DNA, 15 bp, Homo sapiens
attatcaagaagaga

SEQ ID NO: 311323 - DNA, 15 bp, Homo sapiens
ttatcaagaagagaa

SEQ ID NO: 311324 - DNA, 15 bp, Homo sapiens
tatcaagaagagaaa

SEQ ID NO: 311325 - DNA, 15 bp, Homo sapiens
atcaagaagagaaaa

SEQ ID NO: 311326 - DNA, 15 bp, Homo sapiens
tcaagaagagaaaaa

SEQ ID NO: 311327 - DNA, 15 bp, Homo sapiens
caagaagagaaaaat

SEQ ID NO: 311328 - DNA, 15 bp, Homo sapiens
aagaagagaaaaatt

SEQ ID NO: 311329 - DNA, 15 bp, Homo sapiens
agaagagaaaaattt

SEQ ID NO: 311330 - DNA, 15 bp, Homo sapiens
gaagagaaaaatttg

SEQ ID NO: 311331 - DNA, 15 bp, Homo sapiens
aagagaaaaatttga

SEQ ID NO: 311332 - DNA, 15 bp, Homo sapiens
agagaaaaatttgaa

SEQ ID NO: 311333 - DNA, 15 bp, Homo sapiens
gagaaaaatttgaaa

SEQ ID NO: 311334 - DNA, 15 bp, Homo sapiens
agaaaaatttgaaaa

SEQ ID NO: 311335 - DNA, 15 bp, Homo sapiens
gaaaaatttgaaaaa

SEQ ID NO: 311336 - DNA, 15 bp, Homo sapiens
aaaaatttgaaaaat

SEQ ID NO: 311337 - DNA, 15 bp, Homo sapiens
aaaatttgaaaaatc

SEQ ID NO: 311338 - DNA, 15 bp, Homo sapiens
aaatttgaaaaatca

SEQ ID NO: 311339 - DNA, 15 bp, Homo sapiens
aatttgaaaaatcac

SEQ ID NO: 311340 - DNA, 15 bp, Homo sapiens
atttgaaaaatcacc

SEQ ID NO: 311341 - DNA, 15 bp, Homo sapiens
tttgaaaaatcacct

SEQ ID NO: 311342 - DNA, 15 bp, Homo sapiens
ttgaaaaatcacctt

SEQ ID NO: 311343 - DNA, 15 bp, Homo sapiens
tgaaaaatcaccttg

SEQ ID NO: 311344 - DNA, 15 bp, Homo sapiens
gaaaaatcaccttga

SEQ ID NO: 311345 - DNA, 15 bp, Homo sapiens
aaaaatcaccttgag

SEQ ID NO: 311346 - DNA, 15 bp, Homo sapiens
aaaatcaccttgagg

SEQ ID NO: 311347 - DNA, 15 bp, Homo sapiens
aaatcaccttgagga

SEQ ID NO: 311348 - DNA, 15 bp, Homo sapiens
aatcaccttgaggag

SEQ ID NO: 311349 - DNA, 15 bp, Homo sapiens
atcaccttgaggaga

SEQ ID NO: 311350 - DNA, 15 bp, Homo sapiens
tcaccttgaggagag

SEQ ID NO: 311351 - DNA, 15 bp, Homo sapiens
caccttgaggagagt

SEQ ID NO: 311352 - DNA, 15 bp, Homo sapiens
accttgaggagagtg

SEQ ID NO: 311353 - DNA, 15 bp, Homo sapiens
ccttgaggagagtgg

SEQ ID NO: 311354 - DNA, 15 bp, Homo sapiens
cttgaggagagtggc

SEQ ID NO: 311355 - DNA, 15 bp, Homo sapiens
ttgaggagagtggca

SEQ ID NO: 311356 - DNA, 15 bp, Homo sapiens
tgaggagagtggcaa

SEQ ID NO: 311357 - DNA, 15 bp, Homo sapiens
gaggagagtggcaag

SEQ ID NO: 311358 - DNA, 15 bp, Homo sapiens
aggagagtggcaagt

SEQ ID NO: 311359 - DNA, 15 bp, Homo sapiens
ggagagtggcaagtg

SEQ ID NO: 311360 - DNA, 15 bp, Homo sapiens
gagagtggcaagtga

SEQ ID NO: 311361 - DNA, 15 bp, Homo sapiens
agagtggcaagtgaa

SEQ ID NO: 311362 - DNA, 15 bp, Homo sapiens
gagtggcaagtgaaa

SEQ ID NO: 311363 - DNA, 15 bp, Homo sapiens
agtggcaagtgaaac

SEQ ID NO: 311364 - DNA, 15 bp, Homo sapiens
gtggcaagtgaaaca

SEQ ID NO: 311365 - DNA, 15 bp, Homo sapiens
tggcaagtgaaacat

SEQ ID NO: 311366 - DNA, 15 bp, Homo sapiens
ggcaagtgaaacatt

SEQ ID NO: 311367 - DNA, 15 bp, Homo sapiens
gcaagtgaaacatta

SEQ ID NO: 311368 - DNA, 15 bp, Homo sapiens
caagtgaaacattat

SEQ ID NO: 311369 - DNA, 15 bp, Homo sapiens
aagtgaaacattata

SEQ ID NO: 311370 - DNA, 15 bp, Homo sapiens
agtgaaacattatag

SEQ ID NO: 311371 - DNA, 15 bp, Homo sapiens
gtgaaacattatagt

SEQ ID NO: 311372 - DNA, 15 bp, Homo sapiens
tgaaacattatagtg

SEQ ID NO: 311373 - DNA, 15 bp, Homo sapiens
gaaacattatagtga

SEQ ID NO: 311374 - DNA, 15 bp, Homo sapiens
aaacattatagtgaa

SEQ ID NO: 311375 - DNA, 15 bp, Homo sapiens
aacattatagtgaag

SEQ ID NO: 311376 - DNA, 15 bp, Homo sapiens
acattatagtgaaga

SEQ ID NO: 311377 - DNA, 15 bp, Homo sapiens
cattatagtgaagaa

SEQ ID NO: 311378 - DNA, 15 bp, Homo sapiens
attatagtgaagaag

SEQ ID NO: 311379 - DNA, 15 bp, Homo sapiens
ttatagtgaagaagt

SEQ ID NO: 311380 - DNA, 15 bp, Homo sapiens
tatagtgaagaagtg

SEQ ID NO: 311381 - DNA, 15 bp, Homo sapiens
atagtgaagaagtgt

SEQ ID NO: 311382 - DNA, 15 bp, Homo sapiens
tagtgaagaagtgtt

SEQ ID NO: 311383 - DNA, 15 bp, Homo sapiens
agtgaagaagtgtta

SEQ ID NO: 311384 - DNA, 15 bp, Homo sapiens
gtgaagaagtgttac

SEQ ID NO: 311385 - DNA, 15 bp, Homo sapiens
tgaagaagtgttact

SEQ ID NO: 311386 - DNA, 15 bp, Homo sapiens
gaagaagtgttactg

SEQ ID NO: 311387 - DNA, 15 bp, Homo sapiens
aagaagtgttactga

SEQ ID NO: 311388 - DNA, 15 bp, Homo sapiens
agaagtgttactgat

SEQ ID NO: 311389 - DNA, 15 bp, Homo sapiens
gaagtgttactgata

SEQ ID NO: 311390 - DNA, 15 bp, Homo sapiens
aagtgttactgataa

SEQ ID NO: 311391 - DNA, 15 bp, Homo sapiens
agtgttactgataat

SEQ ID NO: 311392 - DNA, 15 bp, Homo sapiens
gtgttactgataatg

SEQ ID NO: 311393 - DNA, 15 bp, Homo sapiens
tgttactgataatgg

SEQ ID NO: 311394 - DNA, 15 bp, Homo sapiens
gttactgataatggg

SEQ ID NO: 311395 - DNA, 15 bp, Homo sapiens
ttactgataatgggc

SEQ ID NO: 311396 - DNA, 15 bp, Homo sapiens
tactgataatgggca

SEQ ID NO: 311397 - DNA, 15 bp, Homo sapiens
actgataatgggcaa

SEQ ID NO: 311398 - DNA, 15 bp, Homo sapiens
ctgataatgggcaaa

SEQ ID NO: 311399 - DNA, 15 bp, Homo sapiens
tgataatgggcaaat

SEQ ID NO: 311400 - DNA, 15 bp, Homo sapiens
gataatgggcaaatg

SEQ ID NO: 311401 - DNA, 15 bp, Homo sapiens
ataatgggcaaatgg

SEQ ID NO: 311402 - DNA, 15 bp, Homo sapiens
taatgggcaaatgga

SEQ ID NO: 311403 - DNA, 15 bp, Homo sapiens
aatgggcaaatggaa

SEQ ID NO: 311404 - DNA, 15 bp, Homo sapiens
atgggcaaatggaat

SEQ ID NO: 311405 - DNA, 15 bp, Homo sapiens
tgggcaaatggaata

SEQ ID NO: 311406 - DNA, 15 bp, Homo sapiens
gggcaaatggaataa

SEQ ID NO: 311407 - DNA, 15 bp, Homo sapiens
ggcaaatggaataaa

SEQ ID NO: 311408 - DNA, 15 bp, Homo sapiens
gcaaatggaataaag

SEQ ID NO: 311409 - DNA, 15 bp, Homo sapiens
caaatggaataaagt

SEQ ID NO: 311410 - DNA, 15 bp, Homo sapiens
aaatggaataaagta

SEQ ID NO: 311411 - DNA, 15 bp, Homo sapiens
aatggaataaagtag

SEQ ID NO: 311412 - DNA, 15 bp, Homo sapiens
atggaataaagtagt

SEQ ID NO: 311413 - DNA, 15 bp, Homo sapiens
tggaataaagtagtg

SEQ ID NO: 311414 - DNA, 15 bp, Homo sapiens
ggaataaagtagtgt

SEQ ID NO: 311415 - DNA, 15 bp, Homo sapiens
gaataaagtagtgtg

SEQ ID NO: 311416 - DNA, 15 bp, Homo sapiens
aataaagtagtgtgt

SEQ ID NO: 311417 - DNA, 15 bp, Homo sapiens
ataaagtagtgtgta

SEQ ID NO: 311418 - DNA, 15 bp, Homo sapiens
taaagtagtgtgtaa

SEQ ID NO: 311419 - DNA, 15 bp, Homo sapiens
aaagtagtgtgtaaa

SEQ ID NO: 311420 - DNA, 15 bp, Homo sapiens
aagtagtgtgtaaac

SEQ ID NO: 311421 - DNA, 15 bp, Homo sapiens
agtagtgtgtaaaca

SEQ ID NO: 311422 - DNA, 15 bp, Homo sapiens
gtagtgtgtaaacag

SEQ ID NO: 311423 - DNA, 15 bp, Homo sapiens
tagtgtgtaaacagt

SEQ ID NO: 311424 - DNA, 15 bp, Homo sapiens
agtgtgtaaacagtt

SEQ ID NO: 311425 - DNA, 15 bp, Homo sapiens
gtgtgtaaacagttg

SEQ ID NO: 311426 - DNA, 15 bp, Homo sapiens
tgtgtaaacagttga

SEQ ID NO: 311427 - DNA, 15 bp, Homo sapiens
gtgtaaacagttgac

SEQ ID NO: 311428 - DNA, 15 bp, Homo sapiens
tgtaaacagttgact

SEQ ID NO: 311429 - DNA, 15 bp, Homo sapiens
gtaaacagttgactt

SEQ ID NO: 311430 - DNA, 15 bp, Homo sapiens
taaacagttgacttt

SEQ ID NO: 311431 - DNA, 15 bp, Homo sapiens
aaacagttgactttt

SEQ ID NO: 311432 - DNA, 15 bp, Homo sapiens
aacagttgacttttc

SEQ ID NO: 311433 - DNA, 15 bp, Homo sapiens
acagttgacttttct

SEQ ID NO: 311434 - DNA, 15 bp, Homo sapiens
cagttgacttttctc

SEQ ID NO: 311435 - DNA, 15 bp, Homo sapiens
agttgacttttctct

SEQ ID NO: 311436 - DNA, 15 bp, Homo sapiens
gttgacttttctctt

SEQ ID NO: 311437 - DNA, 15 bp, Homo sapiens
ttgacttttctcttt

SEQ ID NO: 311438 - DNA, 15 bp, Homo sapiens
tgacttttctctttt

SEQ ID NO: 311439 - DNA, 15 bp, Homo sapiens
gacttttctctttta

SEQ ID NO: 311440 - DNA, 15 bp, Homo sapiens
acttttctcttttat

SEQ ID NO: 311441 - DNA, 15 bp, Homo sapiens
cttttctcttttatg

SEQ ID NO: 311442 - DNA, 15 bp, Homo sapiens
ttttctcttttatgg

SEQ ID NO: 311443 - DNA, 15 bp, Homo sapiens
tttctcttttatggg

SEQ ID NO: 311444 - DNA, 15 bp, Homo sapiens
ttctcttttatgggt

SEQ ID NO: 311445 - DNA, 15 bp, Homo sapiens
tctcttttatgggtg

SEQ ID NO: 311446 - DNA, 15 bp, Homo sapiens
ctcttttatgggtga

SEQ ID NO: 311447 - DNA, 15 bp, Homo sapiens
tcttttatgggtgaa

SEQ ID NO: 311448 - DNA, 15 bp, Homo sapiens
cttttatgggtgaat

SEQ ID NO: 311449 - DNA, 15 bp, Homo sapiens
ttttatgggtgaata

SEQ ID NO: 311450 - DNA, 15 bp, Homo sapiens
tttatgggtgaataa

SEQ ID NO: 311451 - DNA, 15 bp, Homo sapiens
ttatgggtgaataaa

SEQ ID NO: 311452 - DNA, 15 bp, Homo sapiens
tatgggtgaataaag

SEQ ID NO: 311453 - DNA, 15 bp, Homo sapiens
atgggtgaataaagg

SEQ ID NO: 311454 - DNA, 15 bp, Homo sapiens
tgggtgaataaaggc

SEQ ID NO: 311455 - DNA, 15 bp, Homo sapiens
gggtgaataaaggct

SEQ ID NO: 311456 - DNA, 15 bp, Homo sapiens
ggtgaataaaggctt

SEQ ID NO: 311457 - DNA, 15 bp, Homo sapiens
gtgaataaaggcttt

SEQ ID NO: 311458 - DNA, 15 bp, Homo sapiens
tgaataaaggctttg

SEQ ID NO: 311459 - DNA, 15 bp, Homo sapiens
gaataaaggctttgg

SEQ ID NO: 311460 - DNA, 15 bp, Homo sapiens
aataaaggctttggg

SEQ ID NO: 311461 - DNA, 15 bp, Homo sapiens
ataaaggctttgggt

SEQ ID NO: 311462 - DNA, 15 bp, Homo sapiens
taaaggctttgggta

SEQ ID NO: 311463 - DNA, 15 bp, Homo sapiens
aaaggctttgggtag

SEQ ID NO: 311464 - DNA, 15 bp, Homo sapiens
aaggctttgggtagc

SEQ ID NO: 311465 - DNA, 15 bp, Homo sapiens
aggctttgggtagca

SEQ ID NO: 311466 - DNA, 15 bp, Homo sapiens
ggctttgggtagcat

SEQ ID NO: 311467 - DNA, 15 bp, Homo sapiens
gctttgggtagcata

SEQ ID NO: 311468 - DNA, 15 bp, Homo sapiens
ctttgggtagcatag

SEQ ID NO: 311469 - DNA, 15 bp, Homo sapiens
tttgggtagcataga

SEQ ID NO: 311470 - DNA, 15 bp, Homo sapiens
ttgggtagcatagaa

SEQ ID NO: 311471 - DNA, 15 bp, Homo sapiens
tgggtagcatagaag

SEQ ID NO: 311472 - DNA, 15 bp, Homo sapiens
gggtagcatagaagt

SEQ ID NO: 311473 - DNA, 15 bp, Homo sapiens
ggtagcatagaagtg

SEQ ID NO: 311474 - DNA, 15 bp, Homo sapiens
gtagcatagaagtgg

SEQ ID NO: 311475 - DNA, 15 bp, Homo sapiens
tagcatagaagtgga

SEQ ID NO: 311476 - DNA, 15 bp, Homo sapiens
agcatagaagtggag

SEQ ID NO: 311477 - DNA, 15 bp, Homo sapiens
gcatagaagtggaga

SEQ ID NO: 311478 - DNA, 15 bp, Homo sapiens
catagaagtggagat

SEQ ID NO: 311479 - DNA, 15 bp, Homo sapiens
atagaagtggagatc

SEQ ID NO: 311480 - DNA, 15 bp, Homo sapiens
tagaagtggagatct

SEQ ID NO: 311481 - DNA, 15 bp, Homo sapiens
agaagtggagatctt

SEQ ID NO: 311482 - DNA, 15 bp, Homo sapiens
gaagtggagatcttg

SEQ ID NO: 311483 - DNA, 15 bp, Homo sapiens
aagtggagatcttgg

SEQ ID NO: 311484 - DNA, 15 bp, Homo sapiens
agtggagatcttggc

SEQ ID NO: 311485 - DNA, 15 bp, Homo sapiens
gtggagatcttggct

SEQ ID NO: 311486 - DNA, 15 bp, Homo sapiens
tggagatcttggcta

SEQ ID NO: 311487 - DNA, 15 bp, Homo sapiens
ggagatcttggctaa

SEQ ID NO: 311488 - DNA, 15 bp, Homo sapiens
gagatcttggctaag

SEQ ID NO: 311489 - DNA, 15 bp, Homo sapiens
agatcttggctaaga

SEQ ID NO: 311490 - DNA, 15 bp, Homo sapiens
gatcttggctaagac

SEQ ID NO: 311491 - DNA, 15 bp, Homo sapiens
atcttggctaagacc

SEQ ID NO: 311492 - DNA, 15 bp, Homo sapiens
tcttggctaagacca

SEQ ID NO: 311493 - DNA, 15 bp, Homo sapiens
cttggctaagaccaa

SEQ ID NO: 311494 - DNA, 15 bp, Homo sapiens
ttggctaagaccaat

SEQ ID NO: 311495 - DNA, 15 bp, Homo sapiens
tggctaagaccaata

SEQ ID NO: 311496 - DNA, 15 bp, Homo sapiens
ggctaagaccaatag

SEQ ID NO: 311497 - DNA, 15 bp, Homo sapiens
gctaagaccaatagt

SEQ ID NO: 311498 - DNA, 15 bp, Homo sapiens
ctaagaccaatagtg

SEQ ID NO: 311499 - DNA, 15 bp, Homo sapiens
taagaccaatagtga

SEQ ID NO: 311500 - DNA, 15 bp, Homo sapiens
aagaccaatagtgaa

SEQ ID NO: 311501 - DNA, 15 bp, Homo sapiens
agaccaatagtgaag

SEQ ID NO: 311502 - DNA, 15 bp, Homo sapiens
gaccaatagtgaaga

SEQ ID NO: 311503 - DNA, 15 bp, Homo sapiens
accaatagtgaagaa

SEQ ID NO: 311504 - DNA, 15 bp, Homo sapiens
ccaatagtgaagaaa

SEQ ID NO: 311505 - DNA, 15 bp, Homo sapiens
caatagtgaagaaaa

SEQ ID NO: 311506 - DNA, 15 bp, Homo sapiens
aatagtgaagaaaag

SEQ ID NO: 311507 - DNA, 15 bp, Homo sapiens
atagtgaagaaaagc

SEQ ID NO: 311508 - DNA, 15 bp, Homo sapiens
tagtgaagaaaagca

SEQ ID NO: 311509 - DNA, 15 bp, Homo sapiens
agtgaagaaaagcat

SEQ ID NO: 311510 - DNA, 15 bp, Homo sapiens
gtgaagaaaagcatt

SEQ ID NO: 311511 - DNA, 15 bp, Homo sapiens
tgaagaaaagcatta

SEQ ID NO: 311512 - DNA, 15 bp, Homo sapiens
gaagaaaagcattag

SEQ ID NO: 311513 - DNA, 15 bp, Homo sapiens
aagaaaagcattaga

SEQ ID NO: 311514 - DNA, 15 bp, Homo sapiens
agaaaagcattagac

SEQ ID NO: 311515 - DNA, 15 bp, Homo sapiens
gaaaagcattagact

SEQ ID NO: 311516 - DNA, 15 bp, Homo sapiens
aaaagcattagactt

SEQ ID NO: 311517 - DNA, 15 bp, Homo sapiens
aaagcattagactta

SEQ ID NO: 311518 - DNA, 15 bp, Homo sapiens
aagcattagacttac

SEQ ID NO: 311519 - DNA, 15 bp, Homo sapiens
agcattagacttact

SEQ ID NO: 311520 - DNA, 15 bp, Homo sapiens
gcattagacttactg

SEQ ID NO: 311521 - DNA, 15 bp, Homo sapiens
cattagacttactgc

SEQ ID NO: 311522 - DNA, 15 bp, Homo sapiens
attagacttactgct

SEQ ID NO: 311523 - DNA, 15 bp, Homo sapiens
ttagacttactgctc

SEQ ID NO: 311524 - DNA, 15 bp, Homo sapiens
tagacttactgctcc

SEQ ID NO: 311525 - DNA, 15 bp, Homo sapiens
agacttactgctcca

SEQ ID NO: 311526 - DNA, 15 bp, Homo sapiens
gacttactgctccaa

SEQ ID NO: 311527 - DNA, 15 bp, Homo sapiens
acttactgctccaaa

SEQ ID NO: 311528 - DNA, 15 bp, Homo sapiens
cttactgctccaaag

SEQ ID NO: 311529 - DNA, 15 bp, Homo sapiens
ttactgctccaaagt

SEQ ID NO: 311530 - DNA, 15 bp, Homo sapiens
tactgctccaaagtg

SEQ ID NO: 311531 - DNA, 15 bp, Homo sapiens
actgctccaaagtga

SEQ ID NO: 311532 - DNA, 15 bp, Homo sapiens
ctgctccaaagtgat

SEQ ID NO: 311533 - DNA, 15 bp, Homo sapiens
tgctccaaagtgata

SEQ ID NO: 311534 - DNA, 15 bp, Homo sapiens
gctccaaagtgatac

SEQ ID NO: 311535 - DNA, 15 bp, Homo sapiens
ctccaaagtgataca

SEQ ID NO: 311536 - DNA, 15 bp, Homo sapiens
tccaaagtgatacac

SEQ ID NO: 311537 - DNA, 15 bp, Homo sapiens
ccaaagtgatacact

SEQ ID NO: 311538 - DNA, 15 bp, Homo sapiens
caaagtgatacactg

SEQ ID NO: 311539 - DNA, 15 bp, Homo sapiens
aaagtgatacactgt

SEQ ID NO: 311540 - DNA, 15 bp, Homo sapiens
aagtgatacactgta

SEQ ID NO: 311541 - DNA, 15 bp, Homo sapiens
agtgatacactgtag

SEQ ID NO: 311542 - DNA, 15 bp, Homo sapiens
gtgatacactgtagt

SEQ ID NO: 311543 - DNA, 15 bp, Homo sapiens
tgatacactgtagtt

SEQ ID NO: 311544 - DNA, 15 bp, Homo sapiens
gatacactgtagttc

SEQ ID NO: 311545 - DNA, 15 bp, Homo sapiens
atacactgtagttct

SEQ ID NO: 311546 - DNA, 15 bp, Homo sapiens
tacactgtagttctt

SEQ ID NO: 311547 - DNA, 15 bp, Homo sapiens
acactgtagttcttt

SEQ ID NO: 311548 - DNA, 15 bp, Homo sapiens
cactgtagttctttc

SEQ ID NO: 311549 - DNA, 15 bp, Homo sapiens
actgtagttctttcc

SEQ ID NO: 311550 - DNA, 15 bp, Homo sapiens
ctgtagttctttcca

SEQ ID NO: 311551 - DNA, 15 bp, Homo sapiens
tgtagttctttccag

SEQ ID NO: 311552 - DNA, 15 bp, Homo sapiens
gtagttctttccagg

SEQ ID NO: 311553 - DNA, 15 bp, Homo sapiens
tagttctttccagga

SEQ ID NO: 311554 - DNA, 15 bp, Homo sapiens
agttctttccaggaa

SEQ ID NO: 311555 - DNA, 15 bp, Homo sapiens
gttctttccaggaaa

SEQ ID NO: 311556 - DNA, 15 bp, Homo sapiens
ttctttccaggaaag

SEQ ID NO: 311557 - DNA, 15 bp, Homo sapiens
tctttccaggaaaga

SEQ ID NO: 311558 - DNA, 15 bp, Homo sapiens
ctttccaggaaagag

SEQ ID NO: 311559 - DNA, 15 bp, Homo sapiens
tttccaggaaagaga

SEQ ID NO: 311560 - DNA, 15 bp, Homo sapiens
ttccaggaaagagaa

SEQ ID NO: 311561 - DNA, 15 bp, Homo sapiens
tccaggaaagagaat

SEQ ID NO: 311562 - DNA, 15 bp, Homo sapiens
ccaggaaagagaatt

SEQ ID NO: 311563 - DNA, 15 bp, Homo sapiens
caggaaagagaattt

SEQ ID NO: 311564 - DNA, 15 bp, Homo sapiens
aggaaagagaatttt

SEQ ID NO: 311565 - DNA, 15 bp, Homo sapiens
ggaaagagaattttt

SEQ ID NO: 311566 - DNA, 15 bp, Homo sapiens
gaaagagaatttttc

SEQ ID NO: 311567 - DNA, 15 bp, Homo sapiens
aaagagaatttttcc

SEQ ID NO: 311568 - DNA, 15 bp, Homo sapiens
aagagaatttttccc

SEQ ID NO: 311569 - DNA, 15 bp, Homo sapiens
agagaatttttccct

SEQ ID NO: 311570 - DNA, 15 bp, Homo sapiens
gagaatttttccctg

SEQ ID NO: 311571 - DNA, 15 bp, Homo sapiens
agaatttttccctgg

SEQ ID NO: 311572 - DNA, 15 bp, Homo sapiens
gaatttttccctggg

SEQ ID NO: 311573 - DNA, 15 bp, Homo sapiens
aatttttccctgggc

SEQ ID NO: 311574 - DNA, 15 bp, Homo sapiens
atttttccctgggca

SEQ ID NO: 311575 - DNA, 15 bp, Homo sapiens
tttttccctgggcaa

SEQ ID NO: 311576 - DNA, 15 bp, Homo sapiens
ttttccctgggcaaa

SEQ ID NO: 311577 - DNA, 15 bp, Homo sapiens
tttccctgggcaaac

SEQ ID NO: 311578 - DNA, 15 bp, Homo sapiens
ttccctgggcaaact

SEQ ID NO: 311579 - DNA, 15 bp, Homo sapiens
tccctgggcaaactt

SEQ ID NO: 311580 - DNA, 15 bp, Homo sapiens
ccctgggcaaactta

SEQ ID NO: 311581 - DNA, 15 bp, Homo sapiens
cctgggcaaacttaa

SEQ ID NO: 311582 - DNA, 15 bp, Homo sapiens
ctgggcaaacttaat

SEQ ID NO: 311583 - DNA, 15 bp, Homo sapiens
tgggcaaacttaatt

SEQ ID NO: 311584 - DNA, 15 bp, Homo sapiens
gggcaaacttaattt

SEQ ID NO: 311585 - DNA, 15 bp, Homo sapiens
ggcaaacttaatttt

SEQ ID NO: 311586 - DNA, 15 bp, Homo sapiens
gcaaacttaattttc

SEQ ID NO: 311587 - DNA, 15 bp, Homo sapiens
caaacttaattttcc

SEQ ID NO: 311588 - DNA, 15 bp, Homo sapiens
aaacttaattttcca

SEQ ID NO: 311589 - DNA, 15 bp, Homo sapiens
aacttaattttccat

SEQ ID NO: 311590 - DNA, 15 bp, Homo sapiens
acttaattttccatg

SEQ ID NO: 311591 - DNA, 15 bp, Homo sapiens
cttaattttccatga

SEQ ID NO: 311592 - DNA, 15 bp, Homo sapiens
ttaattttccatgat

SEQ ID NO: 311593 - DNA, 15 bp, Homo sapiens
taattttccatgata

SEQ ID NO: 311594 - DNA, 15 bp, Homo sapiens
aattttccatgataa

SEQ ID NO: 311595 - DNA, 15 bp, Homo sapiens
attttccatgataaa

SEQ ID NO: 311596 - DNA, 15 bp, Homo sapiens
ttttccatgataaac

SEQ ID NO: 311597 - DNA, 15 bp, Homo sapiens
tttccatgataaact

SEQ ID NO: 311598 - DNA, 15 bp, Homo sapiens
ttccatgataaactt

SEQ ID NO: 311599 - DNA, 15 bp, Homo sapiens
tccatgataaacttt

SEQ ID NO: 311600 - DNA, 15 bp, Homo sapiens
ccatgataaactttt

SEQ ID NO: 311601 - DNA, 15 bp, Homo sapiens
catgataaactttta

SEQ ID NO: 311602 - DNA, 15 bp, Homo sapiens
atgataaacttttat

SEQ ID NO: 311603 - DNA, 15 bp, Homo sapiens
tgataaacttttata

SEQ ID NO: 311604 - DNA, 15 bp, Homo sapiens
gataaacttttatag

SEQ ID NO: 311605 - DNA, 15 bp, Homo sapiens
ataaacttttataga

SEQ ID NO: 311606 - DNA, 15 bp, Homo sapiens
taaacttttatagac

SEQ ID NO: 311607 - DNA, 15 bp, Homo sapiens
aaacttttatagaca

SEQ ID NO: 311608 - DNA, 15 bp, Homo sapiens
aacttttatagacat

SEQ ID NO: 311609 - DNA, 15 bp, Homo sapiens
acttttatagacatt

SEQ ID NO: 311610 - DNA, 15 bp, Homo sapiens
cttttatagacattc

SEQ ID NO: 311611 - DNA, 15 bp, Homo sapiens
ttttatagacattct

SEQ ID NO: 311612 - DNA, 15 bp, Homo sapiens
tttatagacattctt

SEQ ID NO: 311613 - DNA, 15 bp, Homo sapiens
ttatagacattcttc

SEQ ID NO: 311614 - DNA, 15 bp, Homo sapiens
tatagacattcttct

SEQ ID NO: 311615 - DNA, 15 bp, Homo sapiens
atagacattcttctg

SEQ ID NO: 311616 - DNA, 15 bp, Homo sapiens
tagacattcttctga

SEQ ID NO: 311617 - DNA, 15 bp, Homo sapiens
agacattcttctgaa

SEQ ID NO: 311618 - DNA, 15 bp, Homo sapiens
gacattcttctgaac

SEQ ID NO: 311619 - DNA, 15 bp, Homo sapiens
acattcttctgaaca

SEQ ID NO: 311620 - DNA, 15 bp, Homo sapiens
cattcttctgaacaa

SEQ ID NO: 311621 - DNA, 15 bp, Homo sapiens
attcttctgaacaaa

SEQ ID NO: 311622 - DNA, 15 bp, Homo sapiens
ttcttctgaacaaag

SEQ ID NO: 311623 - DNA, 15 bp, Homo sapiens
tcttctgaacaaagt

SEQ ID NO: 311624 - DNA, 15 bp, Homo sapiens
cttctgaacaaagtt

SEQ ID NO: 311625 - DNA, 15 bp, Homo sapiens
ttctgaacaaagttt

SEQ ID NO: 311626 - DNA, 15 bp, Homo sapiens
tctgaacaaagtttt

SEQ ID NO: 311627 - DNA, 15 bp, Homo sapiens
ctgaacaaagttttt

SEQ ID NO: 311628 - DNA, 15 bp, Homo sapiens
tgaacaaagtttttg

SEQ ID NO: 311629 - DNA, 15 bp, Homo sapiens
gaacaaagtttttga

SEQ ID NO: 311630 - DNA, 15 bp, Homo sapiens
aacaaagtttttgat

SEQ ID NO: 311631 - DNA, 15 bp, Homo sapiens
acaaagtttttgatt

SEQ ID NO: 311632 - DNA, 15 bp, Homo sapiens
caaagtttttgattc

SEQ ID NO: 311633 - DNA, 15 bp, Homo sapiens
aaagtttttgattct

SEQ ID NO: 311634 - DNA, 15 bp, Homo sapiens
aagtttttgattctt

SEQ ID NO: 311635 - DNA, 15 bp, Homo sapiens
agtttttgattcttg

SEQ ID NO: 311636 - DNA, 15 bp, Homo sapiens
gtttttgattcttga

SEQ ID NO: 311637 - DNA, 15 bp, Homo sapiens
tttttgattcttgaa

SEQ ID NO: 311638 - DNA, 15 bp, Homo sapiens
ttttgattcttgaat

SEQ ID NO: 311639 - DNA, 15 bp, Homo sapiens
tttgattcttgaata

SEQ ID NO: 311640 - DNA, 15 bp, Homo sapiens
ttgattcttgaatat

SEQ ID NO: 311641 - DNA, 15 bp, Homo sapiens
tgattcttgaatata

SEQ ID NO: 311642 - DNA, 15 bp, Homo sapiens
gattcttgaatataa

SEQ ID NO: 311643 - DNA, 15 bp, Homo sapiens
attcttgaatataat

SEQ ID NO: 311644 - DNA, 15 bp, Homo sapiens
ttcttgaatataata

SEQ ID NO: 311645 - DNA, 15 bp, Homo sapiens
tcttgaatataataa

SEQ ID NO: 311646 - DNA, 15 bp, Homo sapiens
cttgaatataataaa

SEQ ID NO: 311647 - DNA, 15 bp, Homo sapiens
ttgaatataataaaa

SEQ ID NO: 311648 - DNA, 15 bp, Homo sapiens
tgaatataataaaat

SEQ ID NO: 311649 - DNA, 15 bp, Homo sapiens
gaatataataaaata

SEQ ID NO: 311650 - DNA, 15 bp, Homo sapiens
aatataataaaatac

SEQ ID NO: 311651 - DNA, 15 bp, Homo sapiens
atataataaaataca

SEQ ID NO: 311652 - DNA, 15 bp, Homo sapiens
ataataaaatacact

SEQ ID NO: 311653 - DNA, 15 bp, Homo sapiens
taataaaatacactt

SEQ ID NO: 311654 - DNA, 15 bp, Homo sapiens
aataaaatacactta

SEQ ID NO: 311655 - DNA, 15 bp, Homo sapiens
ataaaatacacttaa

SEQ ID NO: 311656 - DNA, 15 bp, Homo sapiens
taaaatacacttaag

SEQ ID NO: 311657 - DNA, 15 bp, Homo sapiens
aaaatacacttaaga

SEQ ID NO: 311658 - DNA, 15 bp, Homo sapiens
aaatacacttaagaa

SEQ ID NO: 311659 - DNA, 15 bp, Homo sapiens
aatacacttaagaat

SEQ ID NO: 311660 - DNA, 15 bp, Homo sapiens
atacacttaagaatt

SEQ ID NO: 311661 - DNA, 15 bp, Homo sapiens
tacacttaagaattt

SEQ ID NO: 311662 - DNA, 15 bp, Homo sapiens
acacttaagaattta

SEQ ID NO: 311663 - DNA, 15 bp, Homo sapiens
cacttaagaatttag

SEQ ID NO: 311664 - DNA, 15 bp, Homo sapiens
acttaagaatttagc

SEQ ID NO: 311665 - DNA, 15 bp, Homo sapiens
cttaagaatttagca

SEQ ID NO: 311666 - DNA, 15 bp, Homo sapiens
ttaagaatttagcaa

SEQ ID NO: 311667 - DNA, 15 bp, Homo sapiens
taagaatttagcaaa

SEQ ID NO: 311668 - DNA, 15 bp, Homo sapiens
aagaatttagcaaat

SEQ ID NO: 311669 - DNA, 15 bp, Homo sapiens
agaatttagcaaatc

SEQ ID NO: 311670 - DNA, 15 bp, Homo sapiens
gaatttagcaaatcc

SEQ ID NO: 311671 - DNA, 15 bp, Homo sapiens
aatttagcaaatcct

SEQ ID NO: 311672 - DNA, 15 bp, Homo sapiens
atttagcaaatcctt

SEQ ID NO: 311673 - DNA, 15 bp, Homo sapiens
tttagcaaatccttt

SEQ ID NO: 311674 - DNA, 15 bp, Homo sapiens
ttagcaaatccttta

SEQ ID NO: 311675 - DNA, 15 bp, Homo sapiens
tagcaaatcctttat

SEQ ID NO: 311676 - DNA, 15 bp, Homo sapiens
agcaaatcctttata

SEQ ID NO: 311677 - DNA, 15 bp, Homo sapiens
gcaaatcctttatag

SEQ ID NO: 311678 - DNA, 15 bp, Homo sapiens
caaatcctttatagt

SEQ ID NO: 311679 - DNA, 15 bp, Homo sapiens
aaatcctttatagtt

SEQ ID NO: 311680 - DNA, 15 bp, Homo sapiens
aatcctttatagtta

SEQ ID NO: 311681 - DNA, 15 bp, Homo sapiens
atcctttatagttat

SEQ ID NO: 311682 - DNA, 15 bp, Homo sapiens
tcctttatagttatg

SEQ ID NO: 311683 - DNA, 15 bp, Homo sapiens
cctttatagttatgt

SEQ ID NO: 311684 - DNA, 15 bp, Homo sapiens
ctttatagttatgta

SEQ ID NO: 311685 - DNA, 15 bp, Homo sapiens
tttatagttatgtac

SEQ ID NO: 311686 - DNA, 15 bp, Homo sapiens
ttatagttatgtact

SEQ ID NO: 311687 - DNA, 15 bp, Homo sapiens
tatagttatgtactt

SEQ ID NO: 311688 - DNA, 15 bp, Homo sapiens
atagttatgtacttg

SEQ ID NO: 311689 - DNA, 15 bp, Homo sapiens
tagttatgtacttga

SEQ ID NO: 311690 - DNA, 15 bp, Homo sapiens
agttatgtacttgaa

SEQ ID NO: 311691 - DNA, 15 bp, Homo sapiens
gttatgtacttgaat

SEQ ID NO: 311692 - DNA, 15 bp, Homo sapiens
ttatgtacttgaatg

SEQ ID NO: 311693 - DNA, 15 bp, Homo sapiens
tatgtacttgaatga

SEQ ID NO: 311694 - DNA, 15 bp, Homo sapiens
atgtacttgaatgaa

SEQ ID NO: 311695 - DNA, 15 bp, Homo sapiens
tgtacttgaatgaaa

SEQ ID NO: 311696 - DNA, 15 bp, Homo sapiens
gtacttgaatgaaag

SEQ ID NO: 311697 - DNA, 15 bp, Homo sapiens
tacttgaatgaaaga

SEQ ID NO: 311698 - DNA, 15 bp, Homo sapiens
acttgaatgaaagaa

SEQ ID NO: 311699 - DNA, 15 bp, Homo sapiens
cttgaatgaaagaat

SEQ ID NO: 311700 - DNA, 15 bp, Homo sapiens
ttgaatgaaagaatg

SEQ ID NO: 311701 - DNA, 15 bp, Homo sapiens
tgaatgaaagaatgt

SEQ ID NO: 311702 - DNA, 15 bp, Homo sapiens
gaatgaaagaatgta

SEQ ID NO: 311703 - DNA, 15 bp, Homo sapiens
aatgaaagaatgtaa

SEQ ID NO: 311704 - DNA, 15 bp, Homo sapiens
atgaaagaatgtaat

SEQ ID NO: 311705 - DNA, 15 bp, Homo sapiens
tgaaagaatgtaatc

SEQ ID NO: 311706 - DNA, 15 bp, Homo sapiens
gaaagaatgtaatca

SEQ ID NO: 311707 - DNA, 15 bp, Homo sapiens
aaagaatgtaatcat

SEQ ID NO: 311708 - DNA, 15 bp, Homo sapiens
aagaatgtaatcata

SEQ ID NO: 311709 - DNA, 15 bp, Homo sapiens
agaatgtaatcatat

SEQ ID NO: 311710 - DNA, 15 bp, Homo sapiens
gaatgtaatcatata

SEQ ID NO: 311711 - DNA, 15 bp, Homo sapiens
aatgtaatcatataa

SEQ ID NO: 311712 - DNA, 15 bp, Homo sapiens
atgtaatcatataat

SEQ ID NO: 311713 - DNA, 15 bp, Homo sapiens
tgtaatcatataata

SEQ ID NO: 311714 - DNA, 15 bp, Homo sapiens
gtaatcatataataa

SEQ ID NO: 311715 - DNA, 15 bp, Homo sapiens
taatcatataataat

SEQ ID NO: 311716 - DNA, 15 bp, Homo sapiens
aatcatataataatc

SEQ ID NO: 311717 - DNA, 15 bp, Homo sapiens
atcatataataatcc

SEQ ID NO: 311718 - DNA, 15 bp, Homo sapiens
tcatataataatcca

SEQ ID NO: 311719 - DNA, 15 bp, Homo sapiens
catataataatccat

SEQ ID NO: 311720 - DNA, 15 bp, Homo sapiens
atataataatccata

SEQ ID NO: 311721 - DNA, 15 bp, Homo sapiens
tataataatccataa

SEQ ID NO: 311722 - DNA, 15 bp, Homo sapiens
ataataatccataaa

SEQ ID NO: 311723 - DNA, 15 bp, Homo sapiens
taataatccataaat

SEQ ID NO: 311724 - DNA, 15 bp, Homo sapiens
aataatccataaatt

SEQ ID NO: 311725 - DNA, 15 bp, Homo sapiens
ataatccataaattt

SEQ ID NO: 311726 - DNA, 15 bp, Homo sapiens
taatccataaatttt

SEQ ID NO: 311727 - DNA, 15 bp, Homo sapiens
aatccataaattttt

SEQ ID NO: 311728 - DNA, 15 bp, Homo sapiens
atccataaattttta

SEQ ID NO: 311729 - DNA, 15 bp, Homo sapiens
tccataaatttttag

SEQ ID NO: 311730 - DNA, 15 bp, Homo sapiens
ccataaatttttagc

SEQ ID NO: 311731 - DNA, 15 bp, Homo sapiens
cataaatttttagca

SEQ ID NO: 311732 - DNA, 15 bp, Homo sapiens
ataaatttttagcag

SEQ ID NO: 311733 - DNA, 15 bp, Homo sapiens
taaatttttagcagt

SEQ ID NO: 311734 - DNA, 15 bp, Homo sapiens
aaatttttagcagta

SEQ ID NO: 311735 - DNA, 15 bp, Homo sapiens
aatttttagcagtag

SEQ ID NO: 311736 - DNA, 15 bp, Homo sapiens
atttttagcagtagt

SEQ ID NO: 311737 - DNA, 15 bp, Homo sapiens
tttttagcagtagta

SEQ ID NO: 311738 - DNA, 15 bp, Homo sapiens
ttttagcagtagtag

SEQ ID NO: 311739 - DNA, 15 bp, Homo sapiens
tttagcagtagtaga

SEQ ID NO: 311740 - DNA, 15 bp, Homo sapiens
ttagcagtagtagag

SEQ ID NO: 311741 - DNA, 15 bp, Homo sapiens
tagcagtagtagagc

SEQ ID NO: 311742 - DNA, 15 bp, Homo sapiens
agcagtagtagagcc

SEQ ID NO: 311743 - DNA, 15 bp, Homo sapiens
gcagtagtagagcct

SEQ ID NO: 311744 - DNA, 15 bp, Homo sapiens
cagtagtagagccta

SEQ ID NO: 311745 - DNA, 15 bp, Homo sapiens
agtagtagagcctat

SEQ ID NO: 311746 - DNA, 15 bp, Homo sapiens
gtagtagagcctata

SEQ ID NO: 311747 - DNA, 15 bp, Homo sapiens
tagtagagcctataa

SEQ ID NO: 311748 - DNA, 15 bp, Homo sapiens
agtagagcctataaa

SEQ ID NO: 311749 - DNA, 15 bp, Homo sapiens
gtagagcctataaaa

SEQ ID NO: 311750 - DNA, 15 bp, Homo sapiens
tagagcctataaaaa

SEQ ID NO: 311751 - DNA, 15 bp, Homo sapiens
agagcctataaaaaa

SEQ ID NO: 311752 - DNA, 15 bp, Homo sapiens
gagcctataaaaaat

SEQ ID NO: 311753 - DNA, 15 bp, Homo sapiens
agcctataaaaaatg

SEQ ID NO: 311754 - DNA, 15 bp, Homo sapiens
gcctataaaaaatga

SEQ ID NO: 311755 - DNA, 15 bp, Homo sapiens
cctataaaaaatgaa

SEQ ID NO: 311756 - DNA, 15 bp, Homo sapiens
ctataaaaaatgaaa

SEQ ID NO: 311757 - DNA, 15 bp, Homo sapiens
tataaaaaatgaaaa

SEQ ID NO: 311758 - DNA, 15 bp, Homo sapiens
ataaaaaatgaaaaa

SEQ ID NO: 311759 - DNA, 15 bp, Homo sapiens
taaaaaatgaaaaaa

SEQ ID NO: 311760 - DNA, 15 bp, Homo sapiens
aaaaaatgaaaaaag

SEQ ID NO: 311761 - DNA, 15 bp, Homo sapiens
aaaaatgaaaaaagt

SEQ ID NO: 311762 - DNA, 15 bp, Homo sapiens
aaaatgaaaaaagtt

SEQ ID NO: 311763 - DNA, 15 bp, Homo sapiens
aaatgaaaaaagttt

SEQ ID NO: 311764 - DNA, 15 bp, Homo sapiens
aatgaaaaaagtttt

SEQ ID NO: 311765 - DNA, 15 bp, Homo sapiens
atgaaaaaagttttt

SEQ ID NO: 311766 - DNA, 15 bp, Homo sapiens
tgaaaaaagtttttt

SEQ ID NO: 311767 - DNA, 15 bp, Homo sapiens
gaaaaaagtttttta

SEQ ID NO: 311768 - DNA, 15 bp, Homo sapiens
aaaagttttttagac

SEQ ID NO: 311769 - DNA, 15 bp, Homo sapiens
aaagttttttagact

SEQ ID NO: 311770 - DNA, 15 bp, Homo sapiens
aagttttttagactc

SEQ ID NO: 311771 - DNA, 15 bp, Homo sapiens
agttttttagactct

SEQ ID NO: 311772 - DNA, 15 bp, Homo sapiens
gttttttagactctc

SEQ ID NO: 311773 - DNA, 15 bp, Homo sapiens
ttttttagactctca

SEQ ID NO: 311774 - DNA, 15 bp, Homo sapiens
tttttagactctcat

SEQ ID NO: 311775 - DNA, 15 bp, Homo sapiens
ttttagactctcata

SEQ ID NO: 311776 - DNA, 15 bp, Homo sapiens
tttagactctcataa

SEQ ID NO: 311777 - DNA, 15 bp, Homo sapiens
ttagactctcataaa

SEQ ID NO: 311778 - DNA, 15 bp, Homo sapiens
tagactctcataaaa

SEQ ID NO: 311779 - DNA, 15 bp, Homo sapiens
agactctcataaaat

SEQ ID NO: 311780 - DNA, 15 bp, Homo sapiens
gactctcataaaatc

SEQ ID NO: 311781 - DNA, 15 bp, Homo sapiens
actctcataaaatct

SEQ ID NO: 311782 - DNA, 15 bp, Homo sapiens
ctctcataaaatctg

SEQ ID NO: 311783 - DNA, 15 bp, Homo sapiens
tctcataaaatctgt

SEQ ID NO: 311784 - DNA, 15 bp, Homo sapiens
ctcataaaatctgtc

SEQ ID NO: 311785 - DNA, 15 bp, Homo sapiens
tcataaaatctgtca

SEQ ID NO: 311786 - DNA, 15 bp, Homo sapiens
cataaaatctgtcag

SEQ ID NO: 311787 - DNA, 15 bp, Homo sapiens
ataaaatctgtcaga

SEQ ID NO: 311788 - DNA, 15 bp, Homo sapiens
taaaatctgtcagat

SEQ ID NO: 311789 - DNA, 15 bp, Homo sapiens
aaaatctgtcagatt

SEQ ID NO: 311790 - DNA, 15 bp, Homo sapiens
aaatctgtcagattg

SEQ ID NO: 311791 - DNA, 15 bp, Homo sapiens
aatctgtcagattga

SEQ ID NO: 311792 - DNA, 15 bp, Homo sapiens
atctgtcagattgat

SEQ ID NO: 311793 - DNA, 15 bp, Homo sapiens
tctgtcagattgatg

SEQ ID NO: 311794 - DNA, 15 bp, Homo sapiens
ctgtcagattgatga

SEQ ID NO: 311795 - DNA, 15 bp, Homo sapiens
tgtcagattgatgat

SEQ ID NO: 311796 - DNA, 15 bp, Homo sapiens
gtcagattgatgatc

SEQ ID NO: 311797 - DNA, 15 bp, Homo sapiens
tcagattgatgatcc

SEQ ID NO: 311798 - DNA, 15 bp, Homo sapiens
cagattgatgatcca

SEQ ID NO: 311799 - DNA, 15 bp, Homo sapiens
agattgatgatccaa

SEQ ID NO: 311800 - DNA, 15 bp, Homo sapiens
gattgatgatccaat

SEQ ID NO: 311801 - DNA, 15 bp, Homo sapiens
attgatgatccaatc

SEQ ID NO: 311802 - DNA, 15 bp, Homo sapiens
ttgatgatccaatcc

SEQ ID NO: 311803 - DNA, 15 bp, Homo sapiens
tgatgatccaatcct

SEQ ID NO: 311804 - DNA, 15 bp, Homo sapiens
gatgatccaatcctt

SEQ ID NO: 311805 - DNA, 15 bp, Homo sapiens
atgatccaatccttt

SEQ ID NO: 311806 - DNA, 15 bp, Homo sapiens
tgatccaatccttta

SEQ ID NO: 311807 - DNA, 15 bp, Homo sapiens
gatccaatcctttat

SEQ ID NO: 311808 - DNA, 15 bp, Homo sapiens
atccaatcctttata

SEQ ID NO: 311809 - DNA, 15 bp, Homo sapiens
tccaatcctttatat

SEQ ID NO: 311810 - DNA, 15 bp, Homo sapiens
ccaatcctttatatc

SEQ ID NO: 311811 - DNA, 15 bp, Homo sapiens
caatcctttatatcc

SEQ ID NO: 311812 - DNA, 15 bp, Homo sapiens
aatcctttatatcca

SEQ ID NO: 311813 - DNA, 15 bp, Homo sapiens
atcctttatatccaa

SEQ ID NO: 311814 - DNA, 15 bp, Homo sapiens
tcctttatatccaac

SEQ ID NO: 311815 - DNA, 15 bp, Homo sapiens
cctttatatccaact

SEQ ID NO: 311816 - DNA, 15 bp, Homo sapiens
ctttatatccaactc

SEQ ID NO: 311817 - DNA, 15 bp, Homo sapiens
tttatatccaactct

SEQ ID NO: 311818 - DNA, 15 bp, Homo sapiens
ttatatccaactctc

SEQ ID NO: 311819 - DNA, 15 bp, Homo sapiens
tatatccaactctct

SEQ ID NO: 311820 - DNA, 15 bp, Homo sapiens
atatccaactctctc

SEQ ID NO: 311821 - DNA, 15 bp, Homo sapiens
tatccaactctctct

SEQ ID NO: 311822 - DNA, 15 bp, Homo sapiens
atccaactctctctc

SEQ ID NO: 311823 - DNA, 15 bp, Homo sapiens
tccaactctctctct

SEQ ID NO: 311824 - DNA, 15 bp, Homo sapiens
ccaactctctctctc

SEQ ID NO: 311825 - DNA, 15 bp, Homo sapiens
caactctctctctct

SEQ ID NO: 311826 - DNA, 15 bp, Homo sapiens
aactctctctctctc

SEQ ID NO: 311827 - DNA, 15 bp, Homo sapiens
actctctctctctct

SEQ ID NO: 311828 - DNA, 15 bp, Homo sapiens
ctctctctctctctc

SEQ ID NO: 311829 - DNA, 15 bp, Homo sapiens
tctctctctctctct

SEQ ID NO: 311830 - DNA, 15 bp, Homo sapiens
tctctctctcttttt

SEQ ID NO: 311831 - DNA, 15 bp, Homo sapiens
ctctctctctttttt

SEQ ID NO: 311832 - DNA, 15 bp, Homo sapiens
tctctctcttttttt

SEQ ID NO: 311833 - DNA, 15 bp, Homo sapiens
ctctctctttttttt

SEQ ID NO: 311834 - DNA, 15 bp, Homo sapiens
tctctcttttttttt

SEQ ID NO: 311835 - DNA, 15 bp, Homo sapiens
ctctctttttttttt

SEQ ID NO: 311836 - DNA, 15 bp, Homo sapiens
tctcttttttttttt

SEQ ID NO: 311837 - DNA, 15 bp, Homo sapiens
ctctttttttttttt

SEQ ID NO: 311838 - DNA, 15 bp, Homo sapiens
tcttttttttttttt

SEQ ID NO: 311839 - DNA, 15 bp, Homo sapiens
ctttttttttttttt

SEQ ID NO: 311840 - DNA, 15 bp, Homo sapiens
ttttttttttttttt

SEQ ID NO: 311841 - DNA, 15 bp, Homo sapiens
ttttttttttttttg

SEQ ID NO: 311842 - DNA, 15 bp, Homo sapiens
tttttttttttttga

SEQ ID NO: 311843 - DNA, 15 bp, Homo sapiens
ttttttttttttgag

SEQ ID NO: 311844 - DNA, 15 bp, Homo sapiens
tttttttttttgaga

SEQ ID NO: 311845 - DNA, 15 bp, Homo sapiens
agatggagtctcacc

SEQ ID NO: 311846 - DNA, 15 bp, Homo sapiens
gatggagtctcaccc

SEQ ID NO: 311847 - DNA, 15 bp, Homo sapiens
atggagtctcaccca

SEQ ID NO: 311848 - DNA, 15 bp, Homo sapiens
tggagtctcacccac

SEQ ID NO: 311849 - DNA, 15 bp, Homo sapiens
ggagtctcacccact

SEQ ID NO: 311850 - DNA, 15 bp, Homo sapiens
gagtctcacccactc

SEQ ID NO: 311851 - DNA, 15 bp, Homo sapiens
agtctcacccactcg

SEQ ID NO: 311852 - DNA, 15 bp, Homo sapiens
gtctcacccactcgg

SEQ ID NO: 311853 - DNA, 15 bp, Homo sapiens
tctcacccactcggt

SEQ ID NO: 311854 - DNA, 15 bp, Homo sapiens
ctcacccactcggtc

SEQ ID NO: 311855 - DNA, 15 bp, Homo sapiens
tcacccactcggtcg

SEQ ID NO: 311856 - DNA, 15 bp, Homo sapiens
cacccactcggtcgt

SEQ ID NO: 311857 - DNA, 15 bp, Homo sapiens
acccactcggtcgtc

SEQ ID NO: 311858 - DNA, 15 bp, Homo sapiens
cccactcggtcgtca

SEQ ID NO: 311859 - DNA, 15 bp, Homo sapiens
ccactcggtcgtcaa

SEQ ID NO: 311860 - DNA, 15 bp, Homo sapiens
cactcggtcgtcaag

SEQ ID NO: 311861 - DNA, 15 bp, Homo sapiens
actcggtcgtcaagg

SEQ ID NO: 311862 - DNA, 15 bp, Homo sapiens
ctcggtcgtcaaggc

SEQ ID NO: 311863 - DNA, 15 bp, Homo sapiens
tcggtcgtcaaggct

SEQ ID NO: 311864 - DNA, 15 bp, Homo sapiens
cggtcgtcaaggctg

SEQ ID NO: 311865 - DNA, 15 bp, Homo sapiens
ggtcgtcaaggctgg

SEQ ID NO: 311866 - DNA, 15 bp, Homo sapiens
gtcgtcaaggctgga

SEQ ID NO: 311867 - DNA, 15 bp, Homo sapiens
tcgtcaaggctggag

SEQ ID NO: 311868 - DNA, 15 bp, Homo sapiens
cgtcaaggctggagt

SEQ ID NO: 311869 - DNA, 15 bp, Homo sapiens
gtcaaggctggagtg

SEQ ID NO: 311870 - DNA, 15 bp, Homo sapiens
tcaaggctggagtgc

SEQ ID NO: 311871 - DNA, 15 bp, Homo sapiens
aggctggagtgcagt

SEQ ID NO: 311872 - DNA, 15 bp, Homo sapiens
ggctggagtgcagtg

SEQ ID NO: 311873 - DNA, 15 bp, Homo sapiens
gctggagtgcagtgg

SEQ ID NO: 311874 - DNA, 15 bp, Homo sapiens
ctggagtgcagtggc

SEQ ID NO: 311875 - DNA, 15 bp, Homo sapiens
tggagtgcagtggca

SEQ ID NO: 311876 - DNA, 15 bp, Homo sapiens
ggagtgcagtggcag

SEQ ID NO: 311877 - DNA, 15 bp, Homo sapiens
gagtgcagtggcagc

SEQ ID NO: 311878 - DNA, 15 bp, Homo sapiens
agtgcagtggcagcg

SEQ ID NO: 311879 - DNA, 15 bp, Homo sapiens
gtgcagtggcagcga

SEQ ID NO: 311880 - DNA, 15 bp, Homo sapiens
tgcagtggcagcgat

SEQ ID NO: 311881 - DNA, 15 bp, Homo sapiens
gcagtggcagcgatc

SEQ ID NO: 311882 - DNA, 15 bp, Homo sapiens
cagtggcagcgatct

SEQ ID NO: 311883 - DNA, 15 bp, Homo sapiens
agtggcagcgatctt

SEQ ID NO: 311884 - DNA, 15 bp, Homo sapiens
gtggcagcgatcttg

SEQ ID NO: 311885 - DNA, 15 bp, Homo sapiens
tggcagcgatcttgg

SEQ ID NO: 311886 - DNA, 15 bp, Homo sapiens
ggcagcgatcttggc

SEQ ID NO: 311887 - DNA, 15 bp, Homo sapiens
gcagcgatcttggcc

SEQ ID NO: 311888 - DNA, 15 bp, Homo sapiens
cagcgatcttggccc

SEQ ID NO: 311889 - DNA, 15 bp, Homo sapiens
agcgatcttggccca

SEQ ID NO: 311890 - DNA, 15 bp, Homo sapiens
gcgatcttggcccac

SEQ ID NO: 311891 - DNA, 15 bp, Homo sapiens
cgatcttggcccact

SEQ ID NO: 311892 - DNA, 15 bp, Homo sapiens
gatcttggcccactg

SEQ ID NO: 311893 - DNA, 15 bp, Homo sapiens
atcttggcccactgc

SEQ ID NO: 311894 - DNA, 15 bp, Homo sapiens
tcttggcccactgca

SEQ ID NO: 311895 - DNA, 15 bp, Homo sapiens
cttggcccactgcaa

SEQ ID NO: 311896 - DNA, 15 bp, Homo sapiens
ttggcccactgcaac

SEQ ID NO: 311897 - DNA, 15 bp, Homo sapiens
tggcccactgcaacc

SEQ ID NO: 311898 - DNA, 15 bp, Homo sapiens
ggcccactgcaacct

SEQ ID NO: 311899 - DNA, 15 bp, Homo sapiens
gcccactgcaacctt

SEQ ID NO: 311900 - DNA, 15 bp, Homo sapiens
cccactgcaaccttt

SEQ ID NO: 311901 - DNA, 15 bp, Homo sapiens
ccactgcaaccttta

SEQ ID NO: 311902 - DNA, 15 bp, Homo sapiens
cactgcaacctttac

SEQ ID NO: 311903 - DNA, 15 bp, Homo sapiens
actgcaacctttacc

SEQ ID NO: 311904 - DNA, 15 bp, Homo sapiens
ctgcaacctttacct

SEQ ID NO: 311905 - DNA, 15 bp, Homo sapiens
tgcaacctttacctc

SEQ ID NO: 311906 - DNA, 15 bp, Homo sapiens
gcaacctttacctcc

SEQ ID NO: 311907 - DNA, 15 bp, Homo sapiens
caacctttacctcct

SEQ ID NO: 311908 - DNA, 15 bp, Homo sapiens
aacctttacctcctg

SEQ ID NO: 311909 - DNA, 15 bp, Homo sapiens
acctttacctcctga

SEQ ID NO: 311910 - DNA, 15 bp, Homo sapiens
cctttacctcctgag

SEQ ID NO: 311911 - DNA, 15 bp, Homo sapiens
ctttacctcctgagt

SEQ ID NO: 311912 - DNA, 15 bp, Homo sapiens
tttacctcctgagtt

SEQ ID NO: 311913 - DNA, 15 bp, Homo sapiens
ttacctcctgagttc

SEQ ID NO: 311914 - DNA, 15 bp, Homo sapiens
tacctcctgagttca

SEQ ID NO: 311915 - DNA, 15 bp, Homo sapiens
acctcctgagttcaa

SEQ ID NO: 311916 - DNA, 15 bp, Homo sapiens
cctcctgagttcaat

SEQ ID NO: 311917 - DNA, 15 bp, Homo sapiens
ctcctgagttcaatc

SEQ ID NO: 311918 - DNA, 15 bp, Homo sapiens
tcctgagttcaatca

SEQ ID NO: 311919 - DNA, 15 bp, Homo sapiens
cctgagttcaatcaa

SEQ ID NO: 311920 - DNA, 15 bp, Homo sapiens
ctgagttcaatcaat

SEQ ID NO: 311921 - DNA, 15 bp, Homo sapiens
tgagttcaatcaatt

SEQ ID NO: 311922 - DNA, 15 bp, Homo sapiens
gagttcaatcaattc

SEQ ID NO: 311923 - DNA, 15 bp, Homo sapiens
agttcaatcaattcc

SEQ ID NO: 311924 - DNA, 15 bp, Homo sapiens
gttcaatcaattccc

SEQ ID NO: 311925 - DNA, 15 bp, Homo sapiens
ttcaatcaattcccc

SEQ ID NO: 311926 - DNA, 15 bp, Homo sapiens
tcaatcaattcccct

SEQ ID NO: 311927 - DNA, 15 bp, Homo sapiens
caatcaattcccctg

SEQ ID NO: 311928 - DNA, 15 bp, Homo sapiens
aatcaattcccctgc

SEQ ID NO: 311929 - DNA, 15 bp, Homo sapiens
atcaattcccctgcc

SEQ ID NO: 311930 - DNA, 15 bp, Homo sapiens
tcaattcccctgcct

SEQ ID NO: 311931 - DNA, 15 bp, Homo sapiens
caattcccctgcctc

SEQ ID NO: 311932 - DNA, 15 bp, Homo sapiens
aattcccctgcctca

SEQ ID NO: 311933 - DNA, 15 bp, Homo sapiens
attcccctgcctcag

SEQ ID NO: 311934 - DNA, 15 bp, Homo sapiens
ttcccctgcctcagc

SEQ ID NO: 311935 - DNA, 15 bp, Homo sapiens
tcccctgcctcagcc

SEQ ID NO: 311936 - DNA, 15 bp, Homo sapiens
cccctgcctcagcct

SEQ ID NO: 311937 - DNA, 15 bp, Homo sapiens
ccctgcctcagcctc

SEQ ID NO: 311938 - DNA, 15 bp, Homo sapiens
cctgcctcagcctcc

SEQ ID NO: 311939 - DNA, 15 bp, Homo sapiens
ctgcctcagcctcct

SEQ ID NO: 311940 - DNA, 15 bp, Homo sapiens
tgggattacaggtgt

SEQ ID NO: 311941 - DNA, 15 bp, Homo sapiens
gggattacaggtgtt

SEQ ID NO: 311942 - DNA, 15 bp, Homo sapiens
ggattacaggtgttt

SEQ ID NO: 311943 - DNA, 15 bp, Homo sapiens
gattacaggtgtttg

SEQ ID NO: 311944 - DNA, 15 bp, Homo sapiens
attacaggtgtttgc

SEQ ID NO: 311945 - DNA, 15 bp, Homo sapiens
ttacaggtgtttgcc

SEQ ID NO: 311946 - DNA, 15 bp, Homo sapiens
tacaggtgtttgcca

SEQ ID NO: 311947 - DNA, 15 bp, Homo sapiens
acaggtgtttgccac

SEQ ID NO: 311948 - DNA, 15 bp, Homo sapiens
caggtgtttgccacc

SEQ ID NO: 311949 - DNA, 15 bp, Homo sapiens
aggtgtttgccacca

SEQ ID NO: 311950 - DNA, 15 bp, Homo sapiens
ggtgtttgccaccat

SEQ ID NO: 311951 - DNA, 15 bp, Homo sapiens
gtgtttgccaccatg

SEQ ID NO: 311952 - DNA, 15 bp, Homo sapiens
tgtttgccaccatgc

SEQ ID NO: 311953 - DNA, 15 bp, Homo sapiens
gtttgccaccatgcc

SEQ ID NO: 311954 - DNA, 15 bp, Homo sapiens
tttgccaccatgcct

SEQ ID NO: 311955 - DNA, 15 bp, Homo sapiens
ttgccaccatgcctg

SEQ ID NO: 311956 - DNA, 15 bp, Homo sapiens
tgccaccatgcctgg

SEQ ID NO: 311957 - DNA, 15 bp, Homo sapiens
gccaccatgcctggc

SEQ ID NO: 311958 - DNA, 15 bp, Homo sapiens
ccaccatgcctggct

SEQ ID NO: 311959 - DNA, 15 bp, Homo sapiens
caccatgcctggcta

SEQ ID NO: 311960 - DNA, 15 bp, Homo sapiens
accatgcctggctaa

SEQ ID NO: 311961 - DNA, 15 bp, Homo sapiens
ccatgcctggctaat

SEQ ID NO: 311962 - DNA, 15 bp, Homo sapiens
gcctggctaattttt

SEQ ID NO: 311963 - DNA, 15 bp, Homo sapiens
cctggctaattttta

SEQ ID NO: 311964 - DNA, 15 bp, Homo sapiens
ctggctaatttttat

SEQ ID NO: 311965 - DNA, 15 bp, Homo sapiens
tggctaatttttata

SEQ ID NO: 311966 - DNA, 15 bp, Homo sapiens
ggctaatttttatat

SEQ ID NO: 311967 - DNA, 15 bp, Homo sapiens
gctaatttttatatt

SEQ ID NO: 311968 - DNA, 15 bp, Homo sapiens
ctaatttttatattt

SEQ ID NO: 311969 - DNA, 15 bp, Homo sapiens
tttttatatttttag

SEQ ID NO: 311970 - DNA, 15 bp, Homo sapiens
ttttatatttttagt

SEQ ID NO: 311971 - DNA, 15 bp, Homo sapiens
tttatatttttagta

SEQ ID NO: 311972 - DNA, 15 bp, Homo sapiens
ttatatttttagtag

SEQ ID NO: 311973 - DNA, 15 bp, Homo sapiens
tatatttttagtaga

SEQ ID NO: 311974 - DNA, 15 bp, Homo sapiens
atatttttagtagag

SEQ ID NO: 311975 - DNA, 15 bp, Homo sapiens
tgggattacaggcac

SEQ ID NO: 311976 - DNA, 15 bp, Homo sapiens
ggattacaggcacct

SEQ ID NO: 311977 - DNA, 15 bp, Homo sapiens
gattacaggcacctg

SEQ ID NO: 311978 - DNA, 15 bp, Homo sapiens
attacaggcacctgc

SEQ ID NO: 311979 - DNA, 15 bp, Homo sapiens
ttacaggcacctgcc

SEQ ID NO: 311980 - DNA, 15 bp, Homo sapiens
tacaggcacctgcca

SEQ ID NO: 311981 - DNA, 15 bp, Homo sapiens
acaggcacctgccac

SEQ ID NO: 311982 - DNA, 15 bp, Homo sapiens
caggcacctgccacc

SEQ ID NO: 311983 - DNA, 15 bp, Homo sapiens
aggcacctgccacca

SEQ ID NO: 311984 - DNA, 15 bp, Homo sapiens
ggcacctgccaccac

SEQ ID NO: 311985 - DNA, 15 bp, Homo sapiens
gcacctgccaccaca

SEQ ID NO: 311986 - DNA, 15 bp, Homo sapiens
cacctgccaccacac

SEQ ID NO: 311987 - DNA, 15 bp, Homo sapiens
acctgccaccacacc

SEQ ID NO: 311988 - DNA, 15 bp, Homo sapiens
cctgccaccacaccc

SEQ ID NO: 311989 - DNA, 15 bp, Homo sapiens
ctgccaccacaccca

SEQ ID NO: 311990 - DNA, 15 bp, Homo sapiens
tgccaccacacccag

SEQ ID NO: 311991 - DNA, 15 bp, Homo sapiens
gccaccacacccagc

SEQ ID NO: 311992 - DNA, 15 bp, Homo sapiens
ccaccacacccagct

SEQ ID NO: 311993 - DNA, 15 bp, Homo sapiens
caccacacccagcta

SEQ ID NO: 311994 - DNA, 15 bp, Homo sapiens
accacacccagctaa

SEQ ID NO: 311995 - DNA, 15 bp, Homo sapiens
ccacacccagctaat

SEQ ID NO: 311996 - DNA, 15 bp, Homo sapiens
cacacccagctaatt

SEQ ID NO: 311997 - DNA, 15 bp, Homo sapiens
acacccagctaattt

SEQ ID NO: 311998 - DNA, 15 bp, Homo sapiens
cacccagctaatttt

SEQ ID NO: 311999 - DNA, 15 bp, Homo sapiens
acccagctaattttt

SEQ ID NO: 312000 - DNA, 15 bp, Homo sapiens
atttttgtatttttt

SEQ ID NO: 312001 - DNA, 15 bp, Homo sapiens
tttttgtattttttt

SEQ ID NO: 312002 - DNA, 15 bp, Homo sapiens
ttttgtatttttttt

SEQ ID NO: 312003 - DNA, 15 bp, Homo sapiens
tttgtattttttttt

SEQ ID NO: 312004 - DNA, 15 bp, Homo sapiens
ttgtattttttttta

SEQ ID NO: 312005 - DNA, 15 bp, Homo sapiens
tgtatttttttttaa

SEQ ID NO: 312006 - DNA, 15 bp, Homo sapiens
gtatttttttttaag

SEQ ID NO: 312007 - DNA, 15 bp, Homo sapiens
tatttttttttaagt

SEQ ID NO: 312008 - DNA, 15 bp, Homo sapiens
atttttttttaagta

SEQ ID NO: 312009 - DNA, 15 bp, Homo sapiens
tttttttttaagtag

SEQ ID NO: 312010 - DNA, 15 bp, Homo sapiens
ttttttttaagtaga

SEQ ID NO: 312011 - DNA, 15 bp, Homo sapiens
tttttttaagtagag

SEQ ID NO: 312012 - DNA, 15 bp, Homo sapiens
ttttttaagtagaga

SEQ ID NO: 312013 - DNA, 15 bp, Homo sapiens
tttttaagtagagat

SEQ ID NO: 312014 - DNA, 15 bp, Homo sapiens
ttttaagtagagatg

SEQ ID NO: 312015 - DNA, 15 bp, Homo sapiens
tttaagtagagatgg

SEQ ID NO: 312016 - DNA, 15 bp, Homo sapiens
ttaagtagagatggg

SEQ ID NO: 312017 - DNA, 15 bp, Homo sapiens
taagtagagatgggg

SEQ ID NO: 312018 - DNA, 15 bp, Homo sapiens
aagtagagatggggt

SEQ ID NO: 312019 - DNA, 15 bp, Homo sapiens
agtagagatggggtt

SEQ ID NO: 312020 - DNA, 15 bp, Homo sapiens
gtagagatggggttt

SEQ ID NO: 312021 - DNA, 15 bp, Homo sapiens
tagagatggggtttc

SEQ ID NO: 312022 - DNA, 15 bp, Homo sapiens
agagatggggtttca

SEQ ID NO: 312023 - DNA, 15 bp, Homo sapiens
gagatggggtttcac

SEQ ID NO: 312024 - DNA, 15 bp, Homo sapiens
agatggggtttcacc

SEQ ID NO: 312025 - DNA, 15 bp, Homo sapiens
atggggtttcaccat

SEQ ID NO: 312026 - DNA, 15 bp, Homo sapiens
tggggtttcaccatg

SEQ ID NO: 312027 - DNA, 15 bp, Homo sapiens
ggggtttcaccatgt

SEQ ID NO: 312028 - DNA, 15 bp, Homo sapiens
gggtttcaccatgtt

SEQ ID NO: 312029 - DNA, 15 bp, Homo sapiens
ggtttcaccatgttg

SEQ ID NO: 312030 - DNA, 15 bp, Homo sapiens
gtttcaccatgttgg

SEQ ID NO: 312031 - DNA, 15 bp, Homo sapiens
tttcaccatgttggc

SEQ ID NO: 312032 - DNA, 15 bp, Homo sapiens
ttcaccatgttggcc

SEQ ID NO: 312033 - DNA, 15 bp, Homo sapiens
tcaccatgttggcca

SEQ ID NO: 312034 - DNA, 15 bp, Homo sapiens
caccatgttggccag

SEQ ID NO: 312035 - DNA, 15 bp, Homo sapiens
accatgttggccagg

SEQ ID NO: 312036 - DNA, 15 bp, Homo sapiens
tctcgaactcctgaa

SEQ ID NO: 312037 - DNA, 15 bp, Homo sapiens
ctcgaactcctgaac

SEQ ID NO: 312038 - DNA, 15 bp, Homo sapiens
tcgaactcctgaact

SEQ ID NO: 312039 - DNA, 15 bp, Homo sapiens
cgaactcctgaactc

SEQ ID NO: 312040 - DNA, 15 bp, Homo sapiens
gaactcctgaactca

SEQ ID NO: 312041 - DNA, 15 bp, Homo sapiens
aactcctgaactcag

SEQ ID NO: 312042 - DNA, 15 bp, Homo sapiens
actcctgaactcagg

SEQ ID NO: 312043 - DNA, 15 bp, Homo sapiens
ctcctgaactcaggt

SEQ ID NO: 312044 - DNA, 15 bp, Homo sapiens
tcctgaactcaggtg

SEQ ID NO: 312045 - DNA, 15 bp, Homo sapiens
cctgaactcaggtga

SEQ ID NO: 312046 - DNA, 15 bp, Homo sapiens
ctgaactcaggtgat

SEQ ID NO: 312047 - DNA, 15 bp, Homo sapiens
tgaactcaggtgatg

SEQ ID NO: 312048 - DNA, 15 bp, Homo sapiens
gaactcaggtgatgc

SEQ ID NO: 312049 - DNA, 15 bp, Homo sapiens
aactcaggtgatgca

SEQ ID NO: 312050 - DNA, 15 bp, Homo sapiens
actcaggtgatgcac

SEQ ID NO: 312051 - DNA, 15 bp, Homo sapiens
ctcaggtgatgcacc

SEQ ID NO: 312052 - DNA, 15 bp, Homo sapiens
tcaggtgatgcacct

SEQ ID NO: 312053 - DNA, 15 bp, Homo sapiens
caggtgatgcacctg

SEQ ID NO: 312054 - DNA, 15 bp, Homo sapiens
aggtgatgcacctgc

SEQ ID NO: 312055 - DNA, 15 bp, Homo sapiens
ggtgatgcacctgcc

SEQ ID NO: 312056 - DNA, 15 bp, Homo sapiens
gtgatgcacctgcct

SEQ ID NO: 312057 - DNA, 15 bp, Homo sapiens
tgatgcacctgcctt

SEQ ID NO: 312058 - DNA, 15 bp, Homo sapiens
gatgcacctgccttg

SEQ ID NO: 312059 - DNA, 15 bp, Homo sapiens
atgcacctgccttgg

SEQ ID NO: 312060 - DNA, 15 bp, Homo sapiens
tgcacctgccttggc

SEQ ID NO: 312061 - DNA, 15 bp, Homo sapiens
gcacctgccttggct

SEQ ID NO: 312062 - DNA, 15 bp, Homo sapiens
cacctgccttggctt

SEQ ID NO: 312063 - DNA, 15 bp, Homo sapiens
acctgccttggcttc

SEQ ID NO: 312064 - DNA, 15 bp, Homo sapiens
cctgccttggcttcc

SEQ ID NO: 312065 - DNA, 15 bp, Homo sapiens
ctgccttggcttccc

SEQ ID NO: 312066 - DNA, 15 bp, Homo sapiens
tgccttggcttccca

SEQ ID NO: 312067 - DNA, 15 bp, Homo sapiens
gccttggcttcccaa

SEQ ID NO: 312068 - DNA, 15 bp, Homo sapiens
ccttggcttcccaaa

SEQ ID NO: 312069 - DNA, 15 bp, Homo sapiens
cttggcttcccaaag

SEQ ID NO: 312070 - DNA, 15 bp, Homo sapiens
ttggcttcccaaagt

SEQ ID NO: 312071 - DNA, 15 bp, Homo sapiens
tggcttcccaaagtg

SEQ ID NO: 312072 - DNA, 15 bp, Homo sapiens
ggcttcccaaagtgc

SEQ ID NO: 312073 - DNA, 15 bp, Homo sapiens
gcttcccaaagtgct

SEQ ID NO: 312074 - DNA, 15 bp, Homo sapiens
caaagtgctgggatt

SEQ ID NO: 312075 - DNA, 15 bp, Homo sapiens
aaagtgctgggatta

SEQ ID NO: 312076 - DNA, 15 bp, Homo sapiens
aagtgctgggattac

SEQ ID NO: 312077 - DNA, 15 bp, Homo sapiens
agtgctgggattaca

SEQ ID NO: 312078 - DNA, 15 bp, Homo sapiens
gtgctgggattacag

SEQ ID NO: 312079 - DNA, 15 bp, Homo sapiens
tgctgggattacagg

SEQ ID NO: 312080 - DNA, 15 bp, Homo sapiens
ctgggattacaggcg

SEQ ID NO: 312081 - DNA, 15 bp, Homo sapiens
tgggattacaggcgt

SEQ ID NO: 312082 - DNA, 15 bp, Homo sapiens
gggattacaggcgtg

SEQ ID NO: 312083 - DNA, 15 bp, Homo sapiens
ggattacaggcgtga

SEQ ID NO: 312084 - DNA, 15 bp, Homo sapiens
gattacaggcgtgag

SEQ ID NO: 312085 - DNA, 15 bp, Homo sapiens
attacaggcgtgagc

SEQ ID NO: 312086 - DNA, 15 bp, Homo sapiens
ttacaggcgtgagcc

SEQ ID NO: 312087 - DNA, 15 bp, Homo sapiens
tacaggcgtgagcca

SEQ ID NO: 312088 - DNA, 15 bp, Homo sapiens
acaggcgtgagccac

SEQ ID NO: 312089 - DNA, 15 bp, Homo sapiens
caggcgtgagccacc

SEQ ID NO: 312090 - DNA, 15 bp, Homo sapiens
aggcgtgagccacct

SEQ ID NO: 312091 - DNA, 15 bp, Homo sapiens
ggcgtgagccacctt

SEQ ID NO: 312092 - DNA, 15 bp, Homo sapiens
gcgtgagccaccttg

SEQ ID NO: 312093 - DNA, 15 bp, Homo sapiens
cgtgagccaccttgc

SEQ ID NO: 312094 - DNA, 15 bp, Homo sapiens
gtgagccaccttgcc

SEQ ID NO: 312095 - DNA, 15 bp, Homo sapiens
tgagccaccttgccc

SEQ ID NO: 312096 - DNA, 15 bp, Homo sapiens
gagccaccttgcccg

SEQ ID NO: 312097 - DNA, 15 bp, Homo sapiens
agccaccttgcccgg

SEQ ID NO: 312098 - DNA, 15 bp, Homo sapiens
gccaccttgcccggc

SEQ ID NO: 312099 - DNA, 15 bp, Homo sapiens
ccaccttgcccggcc

SEQ ID NO: 312100 - DNA, 15 bp, Homo sapiens
caccttgcccggcct

SEQ ID NO: 312101 - DNA, 15 bp, Homo sapiens
accttgcccggccta

SEQ ID NO: 312102 - DNA, 15 bp, Homo sapiens
ccttgcccggcctag

SEQ ID NO: 312103 - DNA, 15 bp, Homo sapiens
cttgcccggcctagt

SEQ ID NO: 312104 - DNA, 15 bp, Homo sapiens
ttgcccggcctagtt

SEQ ID NO: 312105 - DNA, 15 bp, Homo sapiens
tgcccggcctagttt

SEQ ID NO: 312106 - DNA, 15 bp, Homo sapiens
gcccggcctagtttt

SEQ ID NO: 312107 - DNA, 15 bp, Homo sapiens
cccggcctagttttc

SEQ ID NO: 312108 - DNA, 15 bp, Homo sapiens
ccggcctagttttcc

SEQ ID NO: 312109 - DNA, 15 bp, Homo sapiens
cggcctagttttccc

SEQ ID NO: 312110 - DNA, 15 bp, Homo sapiens
ggcctagttttccca

SEQ ID NO: 312111 - DNA, 15 bp, Homo sapiens
gcctagttttcccac

SEQ ID NO: 312112 - DNA, 15 bp, Homo sapiens
cctagttttcccact

SEQ ID NO: 312113 - DNA, 15 bp, Homo sapiens
ctagttttcccactt

SEQ ID NO: 312114 - DNA, 15 bp, Homo sapiens
tagttttcccactta

SEQ ID NO: 312115 - DNA, 15 bp, Homo sapiens
agttttcccacttat

SEQ ID NO: 312116 - DNA, 15 bp, Homo sapiens
gttttcccacttatt

SEQ ID NO: 312117 - DNA, 15 bp, Homo sapiens
ttttcccacttattt

SEQ ID NO: 312118 - DNA, 15 bp, Homo sapiens
tttcccacttatttt

SEQ ID NO: 312119 - DNA, 15 bp, Homo sapiens
ttcccacttatttta

SEQ ID NO: 312120 - DNA, 15 bp, Homo sapiens
tcccacttattttac

SEQ ID NO: 312121 - DNA, 15 bp, Homo sapiens
cccacttattttaca

SEQ ID NO: 312122 - DNA, 15 bp, Homo sapiens
ccacttattttacaa

SEQ ID NO: 312123 - DNA, 15 bp, Homo sapiens
cacttattttacaat

SEQ ID NO: 312124 - DNA, 15 bp, Homo sapiens
acttattttacaata

SEQ ID NO: 312125 - DNA, 15 bp, Homo sapiens
cttattttacaatac

SEQ ID NO: 312126 - DNA, 15 bp, Homo sapiens
ttattttacaatact

SEQ ID NO: 312127 - DNA, 15 bp, Homo sapiens
tattttacaatactt

SEQ ID NO: 312128 - DNA, 15 bp, Homo sapiens
attttacaatactta

SEQ ID NO: 312129 - DNA, 15 bp, Homo sapiens
ttttacaatacttac

SEQ ID NO: 312130 - DNA, 15 bp, Homo sapiens
tttacaatacttact

SEQ ID NO: 312131 - DNA, 15 bp, Homo sapiens
ttacaatacttactg

SEQ ID NO: 312132 - DNA, 15 bp, Homo sapiens
tacaatacttactgc

SEQ ID NO: 312133 - DNA, 15 bp, Homo sapiens
acaatacttactgca

SEQ ID NO: 312134 - DNA, 15 bp, Homo sapiens
caatacttactgcat

SEQ ID NO: 312135 - DNA, 15 bp, Homo sapiens
aatacttactgcatt

SEQ ID NO: 312136 - DNA, 15 bp, Homo sapiens
atacttactgcattt

SEQ ID NO: 312137 - DNA, 15 bp, Homo sapiens
tacttactgcatttt

SEQ ID NO: 312138 - DNA, 15 bp, Homo sapiens
acttactgcattttt

SEQ ID NO: 312139 - DNA, 15 bp, Homo sapiens
cttactgcatttttc

SEQ ID NO: 312140 - DNA, 15 bp, Homo sapiens
ttactgcatttttct

SEQ ID NO: 312141 - DNA, 15 bp, Homo sapiens
tactgcatttttctg

SEQ ID NO: 312142 - DNA, 15 bp, Homo sapiens
actgcatttttctgt

SEQ ID NO: 312143 - DNA, 15 bp, Homo sapiens
ctgcatttttctgtc

SEQ ID NO: 312144 - DNA, 15 bp, Homo sapiens
tgcatttttctgtct

SEQ ID NO: 312145 - DNA, 15 bp, Homo sapiens
gcatttttctgtctg

SEQ ID NO: 312146 - DNA, 15 bp, Homo sapiens
catttttctgtctgt

SEQ ID NO: 312147 - DNA, 15 bp, Homo sapiens
atttttctgtctgtc

SEQ ID NO: 312148 - DNA, 15 bp, Homo sapiens
tttttctgtctgtct

SEQ ID NO: 312149 - DNA, 15 bp, Homo sapiens
ttttctgtctgtctg

SEQ ID NO: 312150 - DNA, 15 bp, Homo sapiens
tttctgtctgtctgt

SEQ ID NO: 312151 - DNA, 15 bp, Homo sapiens
ttctgtctgtctgtg

SEQ ID NO: 312152 - DNA, 15 bp, Homo sapiens
tctgtctgtctgtgt

SEQ ID NO: 312153 - DNA, 15 bp, Homo sapiens
ctgtctgtctgtgtg

SEQ ID NO: 312154 - DNA, 15 bp, Homo sapiens
tgtctgtctgtgtgt

SEQ ID NO: 312155 - DNA, 15 bp, Homo sapiens
gtctgtctgtgtgta

SEQ ID NO: 312156 - DNA, 15 bp, Homo sapiens
tctgtctgtgtgtat

SEQ ID NO: 312157 - DNA, 15 bp, Homo sapiens
ctgtctgtgtgtatg

SEQ ID NO: 312158 - DNA, 15 bp, Homo sapiens
tgtctgtgtgtatgc

SEQ ID NO: 312159 - DNA, 15 bp, Homo sapiens
gtctgtgtgtatgca

SEQ ID NO: 312160 - DNA, 15 bp, Homo sapiens
tctgtgtgtatgcat

SEQ ID NO: 312161 - DNA, 15 bp, Homo sapiens
ctgtgtgtatgcata

SEQ ID NO: 312162 - DNA, 15 bp, Homo sapiens
tgtgtgtatgcatat

SEQ ID NO: 312163 - DNA, 15 bp, Homo sapiens
gtgtgtatgcatata

SEQ ID NO: 312164 - DNA, 15 bp, Homo sapiens
tgtgtatgcatatat

SEQ ID NO: 312165 - DNA, 15 bp, Homo sapiens
gtgtatgcatatata

SEQ ID NO: 312166 - DNA, 15 bp, Homo sapiens
tgtatgcatatatac

SEQ ID NO: 312167 - DNA, 15 bp, Homo sapiens
gtatgcatatataca

SEQ ID NO: 312168 - DNA, 15 bp, Homo sapiens
tatgcatatatacat

SEQ ID NO: 312169 - DNA, 15 bp, Homo sapiens
atgcatatatacatc

SEQ ID NO: 312170 - DNA, 15 bp, Homo sapiens
tgcatatatacatct

SEQ ID NO: 312171 - DNA, 15 bp, Homo sapiens
gcatatatacatcta

SEQ ID NO: 312172 - DNA, 15 bp, Homo sapiens
catatatacatctac

SEQ ID NO: 312173 - DNA, 15 bp, Homo sapiens
atatatacatctaca

SEQ ID NO: 312174 - DNA, 15 bp, Homo sapiens
tatatacatctacat

SEQ ID NO: 312175 - DNA, 15 bp, Homo sapiens
atatacatctacata

SEQ ID NO: 312176 - DNA, 15 bp, Homo sapiens
tatacatctacatac

SEQ ID NO: 312177 - DNA, 15 bp, Homo sapiens
atacatctacataca

SEQ ID NO: 312178 - DNA, 15 bp, Homo sapiens
tacatctacatacat

SEQ ID NO: 312179 - DNA, 15 bp, Homo sapiens
acatctacatacata

SEQ ID NO: 312180 - DNA, 15 bp, Homo sapiens
catctacatacatat

SEQ ID NO: 312181 - DNA, 15 bp, Homo sapiens
atctacatacatata

SEQ ID NO: 312182 - DNA, 15 bp, Homo sapiens
tctacatacatatat

SEQ ID NO: 312183 - DNA, 15 bp, Homo sapiens
ctacatacatatatc

SEQ ID NO: 312184 - DNA, 15 bp, Homo sapiens
tacatacatatatca

SEQ ID NO: 312185 - DNA, 15 bp, Homo sapiens
acatacatatatcaa

SEQ ID NO: 312186 - DNA, 15 bp, Homo sapiens
catacatatatcaac

SEQ ID NO: 312187 - DNA, 15 bp, Homo sapiens
atacatatatcaacc

SEQ ID NO: 312188 - DNA, 15 bp, Homo sapiens
tacatatatcaacct

SEQ ID NO: 312189 - DNA, 15 bp, Homo sapiens
acatatatcaaccta

SEQ ID NO: 312190 - DNA, 15 bp, Homo sapiens
catatatcaacctaa

SEQ ID NO: 312191 - DNA, 15 bp, Homo sapiens
atatatcaacctaaa

SEQ ID NO: 312192 - DNA, 15 bp, Homo sapiens
tatatcaacctaaat

SEQ ID NO: 312193 - DNA, 15 bp, Homo sapiens
atatcaacctaaata

SEQ ID NO: 312194 - DNA, 15 bp, Homo sapiens
tatcaacctaaatat

SEQ ID NO: 312195 - DNA, 15 bp, Homo sapiens
atcaacctaaatata

SEQ ID NO: 312196 - DNA, 15 bp, Homo sapiens
tcaacctaaatatac

SEQ ID NO: 312197 - DNA, 15 bp, Homo sapiens
caacctaaatatacc

SEQ ID NO: 312198 - DNA, 15 bp, Homo sapiens
aacctaaatatacct

SEQ ID NO: 312199 - DNA, 15 bp, Homo sapiens
acctaaatataccta

SEQ ID NO: 312200 - DNA, 15 bp, Homo sapiens
cctaaatatacctat

SEQ ID NO: 312201 - DNA, 15 bp, Homo sapiens
ctaaatatacctata

SEQ ID NO: 312202 - DNA, 15 bp, Homo sapiens
taaatatacctatat

SEQ ID NO: 312203 - DNA, 15 bp, Homo sapiens
aaatatacctatatc

SEQ ID NO: 312204 - DNA, 15 bp, Homo sapiens
aatatacctatatca

SEQ ID NO: 312205 - DNA, 15 bp, Homo sapiens
atatacctatatcag

SEQ ID NO: 312206 - DNA, 15 bp, Homo sapiens
tatacctatatcagt

SEQ ID NO: 312207 - DNA, 15 bp, Homo sapiens
atacctatatcagta

SEQ ID NO: 312208 - DNA, 15 bp, Homo sapiens
tacctatatcagtat

SEQ ID NO: 312209 - DNA, 15 bp, Homo sapiens
acctatatcagtata

SEQ ID NO: 312210 - DNA, 15 bp, Homo sapiens
cctatatcagtatag

SEQ ID NO: 312211 - DNA, 15 bp, Homo sapiens
ctatatcagtataga

SEQ ID NO: 312212 - DNA, 15 bp, Homo sapiens
tatatcagtatagac

SEQ ID NO: 312213 - DNA, 15 bp, Homo sapiens
atatcagtatagaca

SEQ ID NO: 312214 - DNA, 15 bp, Homo sapiens
tatcagtatagacag

SEQ ID NO: 312215 - DNA, 15 bp, Homo sapiens
atcagtatagacaga

SEQ ID NO: 312216 - DNA, 15 bp, Homo sapiens
tcagtatagacagat

SEQ ID NO: 312217 - DNA, 15 bp, Homo sapiens
cagtatagacagata

SEQ ID NO: 312218 - DNA, 15 bp, Homo sapiens
agtatagacagatat

SEQ ID NO: 312219 - DNA, 15 bp, Homo sapiens
gtatagacagatata

SEQ ID NO: 312220 - DNA, 15 bp, Homo sapiens
tatagacagatatat

SEQ ID NO: 312221 - DNA, 15 bp, Homo sapiens
atagacagatatatg

SEQ ID NO: 312222 - DNA, 15 bp, Homo sapiens
tagacagatatatgc

SEQ ID NO: 312223 - DNA, 15 bp, Homo sapiens
agacagatatatgct

SEQ ID NO: 312224 - DNA, 15 bp, Homo sapiens
gacagatatatgcta

SEQ ID NO: 312225 - DNA, 15 bp, Homo sapiens
acagatatatgctat

SEQ ID NO: 312226 - DNA, 15 bp, Homo sapiens
cagatatatgctatt

SEQ ID NO: 312227 - DNA, 15 bp, Homo sapiens
agatatatgctattc

SEQ ID NO: 312228 - DNA, 15 bp, Homo sapiens
gatatatgctattct

SEQ ID NO: 312229 - DNA, 15 bp, Homo sapiens
atatatgctattctg

SEQ ID NO: 312230 - DNA, 15 bp, Homo sapiens
tatatgctattctgt

SEQ ID NO: 312231 - DNA, 15 bp, Homo sapiens
atatgctattctgtt

SEQ ID NO: 312232 - DNA, 15 bp, Homo sapiens
tatgctattctgttt

SEQ ID NO: 312233 - DNA, 15 bp, Homo sapiens
atgctattctgtttg

SEQ ID NO: 312234 - DNA, 15 bp, Homo sapiens
tgctattctgtttga

SEQ ID NO: 312235 - DNA, 15 bp, Homo sapiens
gctattctgtttgaa

SEQ ID NO: 312236 - DNA, 15 bp, Homo sapiens
ctattctgtttgaac

SEQ ID NO: 312237 - DNA, 15 bp, Homo sapiens
tattctgtttgaact

SEQ ID NO: 312238 - DNA, 15 bp, Homo sapiens
attctgtttgaactt

SEQ ID NO: 312239 - DNA, 15 bp, Homo sapiens
ttctgtttgaactta

SEQ ID NO: 312240 - DNA, 15 bp, Homo sapiens
tctgtttgaacttaa

SEQ ID NO: 312241 - DNA, 15 bp, Homo sapiens
ctgtttgaacttaag

SEQ ID NO: 312242 - DNA, 15 bp, Homo sapiens
tgtttgaacttaagt

SEQ ID NO: 312243 - DNA, 15 bp, Homo sapiens
gtttgaacttaagtt

SEQ ID NO: 312244 - DNA, 15 bp, Homo sapiens
tttgaacttaagttg

SEQ ID NO: 312245 - DNA, 15 bp, Homo sapiens
ttgaacttaagttga

SEQ ID NO: 312246 - DNA, 15 bp, Homo sapiens
tgaacttaagttgaa

SEQ ID NO: 312247 - DNA, 15 bp, Homo sapiens
gaacttaagttgaag

SEQ ID NO: 312248 - DNA, 15 bp, Homo sapiens
aacttaagttgaaga

SEQ ID NO: 312249 - DNA, 15 bp, Homo sapiens
acttaagttgaagat

SEQ ID NO: 312250 - DNA, 15 bp, Homo sapiens
cttaagttgaagata

SEQ ID NO: 312251 - DNA, 15 bp, Homo sapiens
ttaagttgaagatac

SEQ ID NO: 312252 - DNA, 15 bp, Homo sapiens
taagttgaagatacc

SEQ ID NO: 312253 - DNA, 15 bp, Homo sapiens
aagttgaagatacca

SEQ ID NO: 312254 - DNA, 15 bp, Homo sapiens
agttgaagataccat

SEQ ID NO: 312255 - DNA, 15 bp, Homo sapiens
gttgaagataccatc

SEQ ID NO: 312256 - DNA, 15 bp, Homo sapiens
ttgaagataccatca

SEQ ID NO: 312257 - DNA, 15 bp, Homo sapiens
tgaagataccatcac

SEQ ID NO: 312258 - DNA, 15 bp, Homo sapiens
gaagataccatcaca

SEQ ID NO: 312259 - DNA, 15 bp, Homo sapiens
aagataccatcacac

SEQ ID NO: 312260 - DNA, 15 bp, Homo sapiens
agataccatcacact

SEQ ID NO: 312261 - DNA, 15 bp, Homo sapiens
gataccatcacactt

SEQ ID NO: 312262 - DNA, 15 bp, Homo sapiens
ataccatcacacttc

SEQ ID NO: 312263 - DNA, 15 bp, Homo sapiens
taccatcacacttca

SEQ ID NO: 312264 - DNA, 15 bp, Homo sapiens
accatcacacttcat

SEQ ID NO: 312265 - DNA, 15 bp, Homo sapiens
ccatcacacttcatt

SEQ ID NO: 312266 - DNA, 15 bp, Homo sapiens
catcacacttcattg

SEQ ID NO: 312267 - DNA, 15 bp, Homo sapiens
atcacacttcattgc

SEQ ID NO: 312268 - DNA, 15 bp, Homo sapiens
tcacacttcattgct

SEQ ID NO: 312269 - DNA, 15 bp, Homo sapiens
cacacttcattgcta

SEQ ID NO: 312270 - DNA, 15 bp, Homo sapiens
acacttcattgctaa

SEQ ID NO: 312271 - DNA, 15 bp, Homo sapiens
cacttcattgctaaa

SEQ ID NO: 312272 - DNA, 15 bp, Homo sapiens
acttcattgctaaat

SEQ ID NO: 312273 - DNA, 15 bp, Homo sapiens
cttcattgctaaata

SEQ ID NO: 312274 - DNA, 15 bp, Homo sapiens
ttcattgctaaatat

SEQ ID NO: 312275 - DNA, 15 bp, Homo sapiens
tcattgctaaatatt

SEQ ID NO: 312276 - DNA, 15 bp, Homo sapiens
cattgctaaatattt

SEQ ID NO: 312277 - DNA, 15 bp, Homo sapiens
attgctaaatatttc

SEQ ID NO: 312278 - DNA, 15 bp, Homo sapiens
ttgctaaatatttca

SEQ ID NO: 312279 - DNA, 15 bp, Homo sapiens
tgctaaatatttcac

SEQ ID NO: 312280 - DNA, 15 bp, Homo sapiens
gctaaatatttcacc

SEQ ID NO: 312281 - DNA, 15 bp, Homo sapiens
ctaaatatttcacca

SEQ ID NO: 312282 - DNA, 15 bp, Homo sapiens
taaatatttcaccac

SEQ ID NO: 312283 - DNA, 15 bp, Homo sapiens
aaatatttcaccaca

SEQ ID NO: 312284 - DNA, 15 bp, Homo sapiens
aatatttcaccacat

SEQ ID NO: 312285 - DNA, 15 bp, Homo sapiens
atatttcaccacatg

SEQ ID NO: 312286 - DNA, 15 bp, Homo sapiens
tatttcaccacatgt

SEQ ID NO: 312287 - DNA, 15 bp, Homo sapiens
atttcaccacatgtc

SEQ ID NO: 312288 - DNA, 15 bp, Homo sapiens
tttcaccacatgtct

SEQ ID NO: 312289 - DNA, 15 bp, Homo sapiens
ttcaccacatgtctc

SEQ ID NO: 312290 - DNA, 15 bp, Homo sapiens
tcaccacatgtctct

SEQ ID NO: 312291 - DNA, 15 bp, Homo sapiens
caccacatgtctctt

SEQ ID NO: 312292 - DNA, 15 bp, Homo sapiens
accacatgtctctta

SEQ ID NO: 312293 - DNA, 15 bp, Homo sapiens
ccacatgtctcttac

SEQ ID NO: 312294 - DNA, 15 bp, Homo sapiens
cacatgtctcttaca

SEQ ID NO: 312295 - DNA, 15 bp, Homo sapiens
acatgtctcttacaa

SEQ ID NO: 312296 - DNA, 15 bp, Homo sapiens
catgtctcttacaat

SEQ ID NO: 312297 - DNA, 15 bp, Homo sapiens
atgtctcttacaatc

SEQ ID NO: 312298 - DNA, 15 bp, Homo sapiens
tgtctcttacaatca

SEQ ID NO: 312299 - DNA, 15 bp, Homo sapiens
gtctcttacaatcaa

SEQ ID NO: 312300 - DNA, 15 bp, Homo sapiens
tctcttacaatcaaa

SEQ ID NO: 312301 - DNA, 15 bp, Homo sapiens
ctcttacaatcaaag

SEQ ID NO: 312302 - DNA, 15 bp, Homo sapiens
tcttacaatcaaaga

SEQ ID NO: 312303 - DNA, 15 bp, Homo sapiens
cttacaatcaaagac

SEQ ID NO: 312304 - DNA, 15 bp, Homo sapiens
ttacaatcaaagaca

SEQ ID NO: 312305 - DNA, 15 bp, Homo sapiens
tacaatcaaagacat

SEQ ID NO: 312306 - DNA, 15 bp, Homo sapiens
acaatcaaagacatt

SEQ ID NO: 312307 - DNA, 15 bp, Homo sapiens
caatcaaagacattc

SEQ ID NO: 312308 - DNA, 15 bp, Homo sapiens
aatcaaagacattct

SEQ ID NO: 312309 - DNA, 15 bp, Homo sapiens
atcaaagacattctc

SEQ ID NO: 312310 - DNA, 15 bp, Homo sapiens
tcaaagacattctcc

SEQ ID NO: 312311 - DNA, 15 bp, Homo sapiens
caaagacattctcct

SEQ ID NO: 312312 - DNA, 15 bp, Homo sapiens
aaagacattctcctg

SEQ ID NO: 312313 - DNA, 15 bp, Homo sapiens
aagacattctcctgc

SEQ ID NO: 312314 - DNA, 15 bp, Homo sapiens
agacattctcctgca

SEQ ID NO: 312315 - DNA, 15 bp, Homo sapiens
gacattctcctgcaa

SEQ ID NO: 312316 - DNA, 15 bp, Homo sapiens
acattctcctgcaac

SEQ ID NO: 312317 - DNA, 15 bp, Homo sapiens
cattctcctgcaaca

SEQ ID NO: 312318 - DNA, 15 bp, Homo sapiens
attctcctgcaacaa

SEQ ID NO: 312319 - DNA, 15 bp, Homo sapiens
ttctcctgcaacaat

SEQ ID NO: 312320 - DNA, 15 bp, Homo sapiens
tctcctgcaacaata

SEQ ID NO: 312321 - DNA, 15 bp, Homo sapiens
ctcctgcaacaatac

SEQ ID NO: 312322 - DNA, 15 bp, Homo sapiens
tcctgcaacaatacc

SEQ ID NO: 312323 - DNA, 15 bp, Homo sapiens
cctgcaacaatacca

SEQ ID NO: 312324 - DNA, 15 bp, Homo sapiens
ctgcaacaataccat

SEQ ID NO: 312325 - DNA, 15 bp, Homo sapiens
tgcaacaataccata

SEQ ID NO: 312326 - DNA, 15 bp, Homo sapiens
gcaacaataccataa

SEQ ID NO: 312327 - DNA, 15 bp, Homo sapiens
caacaataccataat

SEQ ID NO: 312328 - DNA, 15 bp, Homo sapiens
aacaataccataatt

SEQ ID NO: 312329 - DNA, 15 bp, Homo sapiens
acaataccataatta

SEQ ID NO: 312330 - DNA, 15 bp, Homo sapiens
caataccataattaa

SEQ ID NO: 312331 - DNA, 15 bp, Homo sapiens
aataccataattaat

SEQ ID NO: 312332 - DNA, 15 bp, Homo sapiens
ataccataattaatg

SEQ ID NO: 312333 - DNA, 15 bp, Homo sapiens
taccataattaatgt

SEQ ID NO: 312334 - DNA, 15 bp, Homo sapiens
accataattaatgtt

SEQ ID NO: 312335 - DNA, 15 bp, Homo sapiens
ccataattaatgtta

SEQ ID NO: 312336 - DNA, 15 bp, Homo sapiens
cataattaatgttaa

SEQ ID NO: 312337 - DNA, 15 bp, Homo sapiens
ataattaatgttaaa

SEQ ID NO: 312338 - DNA, 15 bp, Homo sapiens
taattaatgttaaag

SEQ ID NO: 312339 - DNA, 15 bp, Homo sapiens
aattaatgttaaaga

SEQ ID NO: 312340 - DNA, 15 bp, Homo sapiens
attaatgttaaagaa

SEQ ID NO: 312341 - DNA, 15 bp, Homo sapiens
ttaatgttaaagaaa

SEQ ID NO: 312342 - DNA, 15 bp, Homo sapiens
taatgttaaagaaat

SEQ ID NO: 312343 - DNA, 15 bp, Homo sapiens
aatgttaaagaaatt

SEQ ID NO: 312344 - DNA, 15 bp, Homo sapiens
atgttaaagaaattt

SEQ ID NO: 312345 - DNA, 15 bp, Homo sapiens
tgttaaagaaattta

SEQ ID NO: 312346 - DNA, 15 bp, Homo sapiens
gttaaagaaatttaa

SEQ ID NO: 312347 - DNA, 15 bp, Homo sapiens
ttaaagaaatttaac

SEQ ID NO: 312348 - DNA, 15 bp, Homo sapiens
taaagaaatttaaca

SEQ ID NO: 312349 - DNA, 15 bp, Homo sapiens
aaagaaatttaacat

SEQ ID NO: 312350 - DNA, 15 bp, Homo sapiens
aagaaatttaacatt

SEQ ID NO: 312351 - DNA, 15 bp, Homo sapiens
agaaatttaacattg

SEQ ID NO: 312352 - DNA, 15 bp, Homo sapiens
gaaatttaacattga

SEQ ID NO: 312353 - DNA, 15 bp, Homo sapiens
aaatttaacattgat

SEQ ID NO: 312354 - DNA, 15 bp, Homo sapiens
aatttaacattgata

SEQ ID NO: 312355 - DNA, 15 bp, Homo sapiens
atttaacattgatac

SEQ ID NO: 312356 - DNA, 15 bp, Homo sapiens
tttaacattgataca

SEQ ID NO: 312357 - DNA, 15 bp, Homo sapiens
ttaacattgatacaa

SEQ ID NO: 312358 - DNA, 15 bp, Homo sapiens
taacattgatacaat

SEQ ID NO: 312359 - DNA, 15 bp, Homo sapiens
aacattgatacaata

SEQ ID NO: 312360 - DNA, 15 bp, Homo sapiens
acattgatacaataa

SEQ ID NO: 312361 - DNA, 15 bp, Homo sapiens
cattgatacaataat

SEQ ID NO: 312362 - DNA, 15 bp, Homo sapiens
attgatacaataata

SEQ ID NO: 312363 - DNA, 15 bp, Homo sapiens
ttgatacaataatat

SEQ ID NO: 312364 - DNA, 15 bp, Homo sapiens
tgatacaataatatt

SEQ ID NO: 312365 - DNA, 15 bp, Homo sapiens
gatacaataatattg

SEQ ID NO: 312366 - DNA, 15 bp, Homo sapiens
atacaataatattgt

SEQ ID NO: 312367 - DNA, 15 bp, Homo sapiens
tacaataatattgtc

SEQ ID NO: 312368 - DNA, 15 bp, Homo sapiens
acaataatattgtct

SEQ ID NO: 312369 - DNA, 15 bp, Homo sapiens
caataatattgtcta

SEQ ID NO: 312370 - DNA, 15 bp, Homo sapiens
aataatattgtctaa

SEQ ID NO: 312371 - DNA, 15 bp, Homo sapiens
ataatattgtctaat

SEQ ID NO: 312372 - DNA, 15 bp, Homo sapiens
taatattgtctaata

SEQ ID NO: 312373 - DNA, 15 bp, Homo sapiens
aatattgtctaatac

SEQ ID NO: 312374 - DNA, 15 bp, Homo sapiens
atattgtctaataca

SEQ ID NO: 312375 - DNA, 15 bp, Homo sapiens
tattgtctaatacat

SEQ ID NO: 312376 - DNA, 15 bp, Homo sapiens
attgtctaatacata

SEQ ID NO: 312377 - DNA, 15 bp, Homo sapiens
ttgtctaatacatag

SEQ ID NO: 312378 - DNA, 15 bp, Homo sapiens
tgtctaatacatagt

SEQ ID NO: 312379 - DNA, 15 bp, Homo sapiens
gtctaatacatagtc

SEQ ID NO: 312380 - DNA, 15 bp, Homo sapiens
tctaatacatagtcc

SEQ ID NO: 312381 - DNA, 15 bp, Homo sapiens
ctaatacatagtcca

SEQ ID NO: 312382 - DNA, 15 bp, Homo sapiens
taatacatagtccaa

SEQ ID NO: 312383 - DNA, 15 bp, Homo sapiens
aatacatagtccaaa

SEQ ID NO: 312384 - DNA, 15 bp, Homo sapiens
atacatagtccaaat

SEQ ID NO: 312385 - DNA, 15 bp, Homo sapiens
tacatagtccaaatt

SEQ ID NO: 312386 - DNA, 15 bp, Homo sapiens
acatagtccaaattc

SEQ ID NO: 312387 - DNA, 15 bp, Homo sapiens
catagtccaaattca

SEQ ID NO: 312388 - DNA, 15 bp, Homo sapiens
atagtccaaattcag

SEQ ID NO: 312389 - DNA, 15 bp, Homo sapiens
tagtccaaattcaga

SEQ ID NO: 312390 - DNA, 15 bp, Homo sapiens
agtccaaattcagat

SEQ ID NO: 312391 - DNA, 15 bp, Homo sapiens
gtccaaattcagatt

SEQ ID NO: 312392 - DNA, 15 bp, Homo sapiens
tccaaattcagattt

SEQ ID NO: 312393 - DNA, 15 bp, Homo sapiens
ccaaattcagatttt

SEQ ID NO: 312394 - DNA, 15 bp, Homo sapiens
caaattcagattttt

SEQ ID NO: 312395 - DNA, 15 bp, Homo sapiens
aaattcagatttttc

SEQ ID NO: 312396 - DNA, 15 bp, Homo sapiens
aattcagatttttca

SEQ ID NO: 312397 - DNA, 15 bp, Homo sapiens
attcagatttttcaa

SEQ ID NO: 312398 - DNA, 15 bp, Homo sapiens
ttcagatttttcaaa

SEQ ID NO: 312399 - DNA, 15 bp, Homo sapiens
tcagatttttcaaat

SEQ ID NO: 312400 - DNA, 15 bp, Homo sapiens
cagatttttcaaatg

SEQ ID NO: 312401 - DNA, 15 bp, Homo sapiens
agatttttcaaatga

SEQ ID NO: 312402 - DNA, 15 bp, Homo sapiens
gatttttcaaatgat

SEQ ID NO: 312403 - DNA, 15 bp, Homo sapiens
atttttcaaatgatc

SEQ ID NO: 312404 - DNA, 15 bp, Homo sapiens
tttttcaaatgatcc

SEQ ID NO: 312405 - DNA, 15 bp, Homo sapiens
ttttcaaatgatcct

SEQ ID NO: 312406 - DNA, 15 bp, Homo sapiens
tttcaaatgatcctc

SEQ ID NO: 312407 - DNA, 15 bp, Homo sapiens
ttcaaatgatcctca

SEQ ID NO: 312408 - DNA, 15 bp, Homo sapiens
tcaaatgatcctcaa

SEQ ID NO: 312409 - DNA, 15 bp, Homo sapiens
caaatgatcctcaaa

SEQ ID NO: 312410 - DNA, 15 bp, Homo sapiens
aaatgatcctcaaat

SEQ ID NO: 312411 - DNA, 15 bp, Homo sapiens
aatgatcctcaaatg

SEQ ID NO: 312412 - DNA, 15 bp, Homo sapiens
atgatcctcaaatgt

SEQ ID NO: 312413 - DNA, 15 bp, Homo sapiens
tgatcctcaaatgtt

SEQ ID NO: 312414 - DNA, 15 bp, Homo sapiens
gatcctcaaatgttt

SEQ ID NO: 312415 - DNA, 15 bp, Homo sapiens
atcctcaaatgtttt

SEQ ID NO: 312416 - DNA, 15 bp, Homo sapiens
tcctcaaatgtttta

SEQ ID NO: 312417 - DNA, 15 bp, Homo sapiens
cctcaaatgttttat

SEQ ID NO: 312418 - DNA, 15 bp, Homo sapiens
ctcaaatgttttatt

SEQ ID NO: 312419 - DNA, 15 bp, Homo sapiens
tcaaatgttttattt

SEQ ID NO: 312420 - DNA, 15 bp, Homo sapiens
caaatgttttatttt

SEQ ID NO: 312421 - DNA, 15 bp, Homo sapiens
aaatgttttatttta

SEQ ID NO: 312422 - DNA, 15 bp, Homo sapiens
aatgttttattttaa

SEQ ID NO: 312423 - DNA, 15 bp, Homo sapiens
atgttttattttaaa

SEQ ID NO: 312424 - DNA, 15 bp, Homo sapiens
tgttttattttaaaa

SEQ ID NO: 312425 - DNA, 15 bp, Homo sapiens
gttttattttaaaat

SEQ ID NO: 312426 - DNA, 15 bp, Homo sapiens
ttttattttaaaatt

SEQ ID NO: 312427 - DNA, 15 bp, Homo sapiens
tttattttaaaattc

SEQ ID NO: 312428 - DNA, 15 bp, Homo sapiens
ttattttaaaattct

SEQ ID NO: 312429 - DNA, 15 bp, Homo sapiens
tattttaaaattctg

SEQ ID NO: 312430 - DNA, 15 bp, Homo sapiens
attttaaaattctga

SEQ ID NO: 312431 - DNA, 15 bp, Homo sapiens
ttttaaaattctgaa

SEQ ID NO: 312432 - DNA, 15 bp, Homo sapiens
tttaaaattctgaat

SEQ ID NO: 312433 - DNA, 15 bp, Homo sapiens
ttaaaattctgaatt

SEQ ID NO: 312434 - DNA, 15 bp, Homo sapiens
taaaattctgaattc

SEQ ID NO: 312435 - DNA, 15 bp, Homo sapiens
aaaattctgaattca

SEQ ID NO: 312436 - DNA, 15 bp, Homo sapiens
aaattctgaattcaa

SEQ ID NO: 312437 - DNA, 15 bp, Homo sapiens
aattctgaattcaat

SEQ ID NO: 312438 - DNA, 15 bp, Homo sapiens
attctgaattcaatc

SEQ ID NO: 312439 - DNA, 15 bp, Homo sapiens
ttctgaattcaatca

SEQ ID NO: 312440 - DNA, 15 bp, Homo sapiens
tctgaattcaatcaa

SEQ ID NO: 312441 - DNA, 15 bp, Homo sapiens
ctgaattcaatcaaa

SEQ ID NO: 312442 - DNA, 15 bp, Homo sapiens
tgaattcaatcaaag

SEQ ID NO: 312443 - DNA, 15 bp, Homo sapiens
gaattcaatcaaaga

SEQ ID NO: 312444 - DNA, 15 bp, Homo sapiens
aattcaatcaaagat

SEQ ID NO: 312445 - DNA, 15 bp, Homo sapiens
attcaatcaaagatt

SEQ ID NO: 312446 - DNA, 15 bp, Homo sapiens
ttcaatcaaagatta

SEQ ID NO: 312447 - DNA, 15 bp, Homo sapiens
tcaatcaaagattac

SEQ ID NO: 312448 - DNA, 15 bp, Homo sapiens
caatcaaagattaca

SEQ ID NO: 312449 - DNA, 15 bp, Homo sapiens
aatcaaagattacat

SEQ ID NO: 312450 - DNA, 15 bp, Homo sapiens
atcaaagattacatt

SEQ ID NO: 312451 - DNA, 15 bp, Homo sapiens
tcaaagattacattt

SEQ ID NO: 312452 - DNA, 15 bp, Homo sapiens
caaagattacatttc

SEQ ID NO: 312453 - DNA, 15 bp, Homo sapiens
aaagattacatttca

SEQ ID NO: 312454 - DNA, 15 bp, Homo sapiens
aagattacatttcat

SEQ ID NO: 312455 - DNA, 15 bp, Homo sapiens
agattacatttcatt

SEQ ID NO: 312456 - DNA, 15 bp, Homo sapiens
gattacatttcattg

SEQ ID NO: 312457 - DNA, 15 bp, Homo sapiens
attacatttcattgt

SEQ ID NO: 312458 - DNA, 15 bp, Homo sapiens
ttacatttcattgtc

SEQ ID NO: 312459 - DNA, 15 bp, Homo sapiens
tacatttcattgtca

SEQ ID NO: 312460 - DNA, 15 bp, Homo sapiens
acatttcattgtcat

SEQ ID NO: 312461 - DNA, 15 bp, Homo sapiens
catttcattgtcatg

SEQ ID NO: 312462 - DNA, 15 bp, Homo sapiens
atttcattgtcatgt

SEQ ID NO: 312463 - DNA, 15 bp, Homo sapiens
tttcattgtcatgtc

SEQ ID NO: 312464 - DNA, 15 bp, Homo sapiens
ttcattgtcatgtct

SEQ ID NO: 312465 - DNA, 15 bp, Homo sapiens
tcattgtcatgtcta

SEQ ID NO: 312466 - DNA, 15 bp, Homo sapiens
cattgtcatgtctat

SEQ ID NO: 312467 - DNA, 15 bp, Homo sapiens
attgtcatgtctatt

SEQ ID NO: 312468 - DNA, 15 bp, Homo sapiens
ttgtcatgtctattt

SEQ ID NO: 312469 - DNA, 15 bp, Homo sapiens
tgtcatgtctattta

SEQ ID NO: 312470 - DNA, 15 bp, Homo sapiens
gtcatgtctatttag

SEQ ID NO: 312471 - DNA, 15 bp, Homo sapiens
tcatgtctatttagt

SEQ ID NO: 312472 - DNA, 15 bp, Homo sapiens
catgtctatttagtc

SEQ ID NO: 312473 - DNA, 15 bp, Homo sapiens
atgtctatttagtct

SEQ ID NO: 312474 - DNA, 15 bp, Homo sapiens
tgtctatttagtctc

SEQ ID NO: 312475 - DNA, 15 bp, Homo sapiens
gtctatttagtctcc

SEQ ID NO: 312476 - DNA, 15 bp, Homo sapiens
tctatttagtctcct

SEQ ID NO: 312477 - DNA, 15 bp, Homo sapiens
ctatttagtctcctt

SEQ ID NO: 312478 - DNA, 15 bp, Homo sapiens
tatttagtctccttt

SEQ ID NO: 312479 - DNA, 15 bp, Homo sapiens
atttagtctccttta

SEQ ID NO: 312480 - DNA, 15 bp, Homo sapiens
tttagtctcctttaa

SEQ ID NO: 312481 - DNA, 15 bp, Homo sapiens
ttagtctcctttaat

SEQ ID NO: 312482 - DNA, 15 bp, Homo sapiens
tagtctcctttaatt

SEQ ID NO: 312483 - DNA, 15 bp, Homo sapiens
agtctcctttaattc

SEQ ID NO: 312484 - DNA, 15 bp, Homo sapiens
gtctcctttaattca

SEQ ID NO: 312485 - DNA, 15 bp, Homo sapiens
tctcctttaattcac

SEQ ID NO: 312486 - DNA, 15 bp, Homo sapiens
ctcctttaattcaca

SEQ ID NO: 312487 - DNA, 15 bp, Homo sapiens
tcctttaattcacaa

SEQ ID NO: 312488 - DNA, 15 bp, Homo sapiens
cctttaattcacaaa

SEQ ID NO: 312489 - DNA, 15 bp, Homo sapiens
ctttaattcacaaag

SEQ ID NO: 312490 - DNA, 15 bp, Homo sapiens
tttaattcacaaagc

SEQ ID NO: 312491 - DNA, 15 bp, Homo sapiens
ttaattcacaaagct

SEQ ID NO: 312492 - DNA, 15 bp, Homo sapiens
taattcacaaagctc

SEQ ID NO: 312493 - DNA, 15 bp, Homo sapiens
aattcacaaagctcc

SEQ ID NO: 312494 - DNA, 15 bp, Homo sapiens
attcacaaagctccc

SEQ ID NO: 312495 - DNA, 15 bp, Homo sapiens
ttcacaaagctcccc

SEQ ID NO: 312496 - DNA, 15 bp, Homo sapiens
tcacaaagctccccc

SEQ ID NO: 312497 - DNA, 15 bp, Homo sapiens
cacaaagctccccct

SEQ ID NO: 312498 - DNA, 15 bp, Homo sapiens
acaaagctccccctc

SEQ ID NO: 312499 - DNA, 15 bp, Homo sapiens
caaagctccccctct

SEQ ID NO: 312500 - DNA, 15 bp, Homo sapiens
aaagctccccctctc

SEQ ID NO: 312501 - DNA, 15 bp, Homo sapiens
aagctccccctctcc

SEQ ID NO: 312502 - DNA, 15 bp, Homo sapiens
agctccccctctccc

SEQ ID NO: 312503 - DNA, 15 bp, Homo sapiens
gctccccctctccca

SEQ ID NO: 312504 - DNA, 15 bp, Homo sapiens
ctccccctctcccag

SEQ ID NO: 312505 - DNA, 15 bp, Homo sapiens
tccccctctcccagg

SEQ ID NO: 312506 - DNA, 15 bp, Homo sapiens
ccccctctcccaggt

SEQ ID NO: 312507 - DNA, 15 bp, Homo sapiens
cccctctcccaggta

SEQ ID NO: 312508 - DNA, 15 bp, Homo sapiens
ccctctcccaggtaa

SEQ ID NO: 312509 - DNA, 15 bp, Homo sapiens
cctctcccaggtaat

SEQ ID NO: 312510 - DNA, 15 bp, Homo sapiens
ctctcccaggtaatt

SEQ ID NO: 312511 - DNA, 15 bp, Homo sapiens
tctcccaggtaattt

SEQ ID NO: 312512 - DNA, 15 bp, Homo sapiens
ctcccaggtaatttt

SEQ ID NO: 312513 - DNA, 15 bp, Homo sapiens
tcccaggtaattttg

SEQ ID NO: 312514 - DNA, 15 bp, Homo sapiens
cccaggtaattttgg

SEQ ID NO: 312515 - DNA, 15 bp, Homo sapiens
ccaggtaattttggt

SEQ ID NO: 312516 - DNA, 15 bp, Homo sapiens
caggtaattttggtt

SEQ ID NO: 312517 - DNA, 15 bp, Homo sapiens
aggtaattttggttt

SEQ ID NO: 312518 - DNA, 15 bp, Homo sapiens
ggtaattttggtttt

SEQ ID NO: 312519 - DNA, 15 bp, Homo sapiens
gtaattttggttttc

SEQ ID NO: 312520 - DNA, 15 bp, Homo sapiens
taattttggttttca

SEQ ID NO: 312521 - DNA, 15 bp, Homo sapiens
aattttggttttcaa

SEQ ID NO: 312522 - DNA, 15 bp, Homo sapiens
attttggttttcaag

SEQ ID NO: 312523 - DNA, 15 bp, Homo sapiens
ttttggttttcaaga

SEQ ID NO: 312524 - DNA, 15 bp, Homo sapiens
tttggttttcaagac

SEQ ID NO: 312525 - DNA, 15 bp, Homo sapiens
ttggttttcaagacg

SEQ ID NO: 312526 - DNA, 15 bp, Homo sapiens
tggttttcaagacgc

SEQ ID NO: 312527 - DNA, 15 bp, Homo sapiens
ggttttcaagacgct

SEQ ID NO: 312528 - DNA, 15 bp, Homo sapiens
gttttcaagacgctg

SEQ ID NO: 312529 - DNA, 15 bp, Homo sapiens
ttttcaagacgctga

SEQ ID NO: 312530 - DNA, 15 bp, Homo sapiens
tttcaagacgctgac

SEQ ID NO: 312531 - DNA, 15 bp, Homo sapiens
ttcaagacgctgaca

SEQ ID NO: 312532 - DNA, 15 bp, Homo sapiens
tcaagacgctgacag

SEQ ID NO: 312533 - DNA, 15 bp, Homo sapiens
caagacgctgacagt

SEQ ID NO: 312534 - DNA, 15 bp, Homo sapiens
aagacgctgacagtt

SEQ ID NO: 312535 - DNA, 15 bp, Homo sapiens
agacgctgacagttt

SEQ ID NO: 312536 - DNA, 15 bp, Homo sapiens
gacgctgacagtttt

SEQ ID NO: 312537 - DNA, 15 bp, Homo sapiens
acgctgacagttttg

SEQ ID NO: 312538 - DNA, 15 bp, Homo sapiens
cgctgacagttttga

SEQ ID NO: 312539 - DNA, 15 bp, Homo sapiens
gctgacagttttgaa

SEQ ID NO: 312540 - DNA, 15 bp, Homo sapiens
ctgacagttttgaag

SEQ ID NO: 312541 - DNA, 15 bp, Homo sapiens
tgacagttttgaaga

SEQ ID NO: 312542 - DNA, 15 bp, Homo sapiens
gacagttttgaagaa

SEQ ID NO: 312543 - DNA, 15 bp, Homo sapiens
acagttttgaagaaa

SEQ ID NO: 312544 - DNA, 15 bp, Homo sapiens
cagttttgaagaaac

SEQ ID NO: 312545 - DNA, 15 bp, Homo sapiens
agttttgaagaaacc

SEQ ID NO: 312546 - DNA, 15 bp, Homo sapiens
gttttgaagaaacca

SEQ ID NO: 312547 - DNA, 15 bp, Homo sapiens
ttttgaagaaaccag

SEQ ID NO: 312548 - DNA, 15 bp, Homo sapiens
tttgaagaaaccagg

SEQ ID NO: 312549 - DNA, 15 bp, Homo sapiens
ttgaagaaaccaggc

SEQ ID NO: 312550 - DNA, 15 bp, Homo sapiens
tgaagaaaccaggcc

SEQ ID NO: 312551 - DNA, 15 bp, Homo sapiens
gaagaaaccaggcca

SEQ ID NO: 312552 - DNA, 15 bp, Homo sapiens
aagaaaccaggccat

SEQ ID NO: 312553 - DNA, 15 bp, Homo sapiens
agaaaccaggccatt

SEQ ID NO: 312554 - DNA, 15 bp, Homo sapiens
gaaaccaggccattt

SEQ ID NO: 312555 - DNA, 15 bp, Homo sapiens
aaaccaggccatttc

SEQ ID NO: 312556 - DNA, 15 bp, Homo sapiens
aaccaggccatttct

SEQ ID NO: 312557 - DNA, 15 bp, Homo sapiens
accaggccatttctt

SEQ ID NO: 312558 - DNA, 15 bp, Homo sapiens
ccaggccatttcttt

SEQ ID NO: 312559 - DNA, 15 bp, Homo sapiens
caggccatttctttt

SEQ ID NO: 312560 - DNA, 15 bp, Homo sapiens
aggccatttcttttg

SEQ ID NO: 312561 - DNA, 15 bp, Homo sapiens
ggccatttcttttga

SEQ ID NO: 312562 - DNA, 15 bp, Homo sapiens
gccatttcttttgaa

SEQ ID NO: 312563 - DNA, 15 bp, Homo sapiens
ccatttcttttgaaa

SEQ ID NO: 312564 - DNA, 15 bp, Homo sapiens
catttcttttgaaaa

SEQ ID NO: 312565 - DNA, 15 bp, Homo sapiens
atttcttttgaaaac

SEQ ID NO: 312566 - DNA, 15 bp, Homo sapiens
tttcttttgaaaact

SEQ ID NO: 312567 - DNA, 15 bp, Homo sapiens
ttcttttgaaaacta

SEQ ID NO: 312568 - DNA, 15 bp, Homo sapiens
tcttttgaaaactag

SEQ ID NO: 312569 - DNA, 15 bp, Homo sapiens
cttttgaaaactagc

SEQ ID NO: 312570 - DNA, 15 bp, Homo sapiens
ttttgaaaactagcc

SEQ ID NO: 312571 - DNA, 15 bp, Homo sapiens
tttgaaaactagcca

SEQ ID NO: 312572 - DNA, 15 bp, Homo sapiens
ttgaaaactagccac

SEQ ID NO: 312573 - DNA, 15 bp, Homo sapiens
tgaaaactagccaca

SEQ ID NO: 312574 - DNA, 15 bp, Homo sapiens
gaaaactagccacag

SEQ ID NO: 312575 - DNA, 15 bp, Homo sapiens
aaaactagccacagt

SEQ ID NO: 312576 - DNA, 15 bp, Homo sapiens
aaactagccacagtc

SEQ ID NO: 312577 - DNA, 15 bp, Homo sapiens
aactagccacagtct

SEQ ID NO: 312578 - DNA, 15 bp, Homo sapiens
actagccacagtcta

SEQ ID NO: 312579 - DNA, 15 bp, Homo sapiens
ctagccacagtctag

SEQ ID NO: 312580 - DNA, 15 bp, Homo sapiens
tagccacagtctaga

SEQ ID NO: 312581 - DNA, 15 bp, Homo sapiens
agccacagtctagat

SEQ ID NO: 312582 - DNA, 15 bp, Homo sapiens
gccacagtctagatt

SEQ ID NO: 312583 - DNA, 15 bp, Homo sapiens
ccacagtctagattt

SEQ ID NO: 312584 - DNA, 15 bp, Homo sapiens
cacagtctagatttg

SEQ ID NO: 312585 - DNA, 15 bp, Homo sapiens
acagtctagatttgt

SEQ ID NO: 312586 - DNA, 15 bp, Homo sapiens
cagtctagatttgtc

SEQ ID NO: 312587 - DNA, 15 bp, Homo sapiens
agtctagatttgtct

SEQ ID NO: 312588 - DNA, 15 bp, Homo sapiens
gtctagatttgtctg

SEQ ID NO: 312589 - DNA, 15 bp, Homo sapiens
tctagatttgtctgc

SEQ ID NO: 312590 - DNA, 15 bp, Homo sapiens
ctagatttgtctgct

SEQ ID NO: 312591 - DNA, 15 bp, Homo sapiens
tagatttgtctgctc

SEQ ID NO: 312592 - DNA, 15 bp, Homo sapiens
agatttgtctgctca

SEQ ID NO: 312593 - DNA, 15 bp, Homo sapiens
gatttgtctgctcat

SEQ ID NO: 312594 - DNA, 15 bp, Homo sapiens
atttgtctgctcatg

SEQ ID NO: 312595 - DNA, 15 bp, Homo sapiens
tttgtctgctcatga

SEQ ID NO: 312596 - DNA, 15 bp, Homo sapiens
ttgtctgctcatgag

SEQ ID NO: 312597 - DNA, 15 bp, Homo sapiens
tgtctgctcatgaga

SEQ ID NO: 312598 - DNA, 15 bp, Homo sapiens
gtctgctcatgagaa

SEQ ID NO: 312599 - DNA, 15 bp, Homo sapiens
tctgctcatgagaag

SEQ ID NO: 312600 - DNA, 15 bp, Homo sapiens
ctgctcatgagaaga

SEQ ID NO: 312601 - DNA, 15 bp, Homo sapiens
tgctcatgagaagat

SEQ ID NO: 312602 - DNA, 15 bp, Homo sapiens
gctcatgagaagatt

SEQ ID NO: 312603 - DNA, 15 bp, Homo sapiens
ctcatgagaagattc

SEQ ID NO: 312604 - DNA, 15 bp, Homo sapiens
tcatgagaagattca

SEQ ID NO: 312605 - DNA, 15 bp, Homo sapiens
catgagaagattcac

SEQ ID NO: 312606 - DNA, 15 bp, Homo sapiens
atgagaagattcacg

SEQ ID NO: 312607 - DNA, 15 bp, Homo sapiens
tgagaagattcacgt

SEQ ID NO: 312608 - DNA, 15 bp, Homo sapiens
gagaagattcacgtt

SEQ ID NO: 312609 - DNA, 15 bp, Homo sapiens
agaagattcacgttc

SEQ ID NO: 312610 - DNA, 15 bp, Homo sapiens
gaagattcacgttca

SEQ ID NO: 312611 - DNA, 15 bp, Homo sapiens
aagattcacgttcaa

SEQ ID NO: 312612 - DNA, 15 bp, Homo sapiens
agattcacgttcaac

SEQ ID NO: 312613 - DNA, 15 bp, Homo sapiens
gattcacgttcaaca

SEQ ID NO: 312614 - DNA, 15 bp, Homo sapiens
attcacgttcaacat

SEQ ID NO: 312615 - DNA, 15 bp, Homo sapiens
ttcacgttcaacatc

SEQ ID NO: 312616 - DNA, 15 bp, Homo sapiens
tcacgttcaacatct

SEQ ID NO: 312617 - DNA, 15 bp, Homo sapiens
cacgttcaacatctt

SEQ ID NO: 312618 - DNA, 15 bp, Homo sapiens
acgttcaacatcttg

SEQ ID NO: 312619 - DNA, 15 bp, Homo sapiens
cgttcaacatcttgg

SEQ ID NO: 312620 - DNA, 15 bp, Homo sapiens
gttcaacatcttggc

SEQ ID NO: 312621 - DNA, 15 bp, Homo sapiens
ttcaacatcttggca

SEQ ID NO: 312622 - DNA, 15 bp, Homo sapiens
tcaacatcttggcaa

SEQ ID NO: 312623 - DNA, 15 bp, Homo sapiens
caacatcttggcaag

SEQ ID NO: 312624 - DNA, 15 bp, Homo sapiens
aacatcttggcaagg

SEQ ID NO: 312625 - DNA, 15 bp, Homo sapiens
acatcttggcaagga

SEQ ID NO: 312626 - DNA, 15 bp, Homo sapiens
catcttggcaaggat

SEQ ID NO: 312627 - DNA, 15 bp, Homo sapiens
atcttggcaaggata

SEQ ID NO: 312628 - DNA, 15 bp, Homo sapiens
tcttggcaaggatat

SEQ ID NO: 312629 - DNA, 15 bp, Homo sapiens
cttggcaaggatatt

SEQ ID NO: 312630 - DNA, 15 bp, Homo sapiens
ttggcaaggatattg

SEQ ID NO: 312631 - DNA, 15 bp, Homo sapiens
tggcaaggatattgt

SEQ ID NO: 312632 - DNA, 15 bp, Homo sapiens
ggcaaggatattgtg

SEQ ID NO: 312633 - DNA, 15 bp, Homo sapiens
gcaaggatattgtgt

SEQ ID NO: 312634 - DNA, 15 bp, Homo sapiens
caaggatattgtgta

SEQ ID NO: 312635 - DNA, 15 bp, Homo sapiens
aaggatattgtgtag

SEQ ID NO: 312636 - DNA, 15 bp, Homo sapiens
aggatattgtgtaga

SEQ ID NO: 312637 - DNA, 15 bp, Homo sapiens
ggatattgtgtagat

SEQ ID NO: 312638 - DNA, 15 bp, Homo sapiens
gatattgtgtagatg

SEQ ID NO: 312639 - DNA, 15 bp, Homo sapiens
atattgtgtagatga

SEQ ID NO: 312640 - DNA, 15 bp, Homo sapiens
tattgtgtagatgat

SEQ ID NO: 312641 - DNA, 15 bp, Homo sapiens
attgtgtagatgatg

SEQ ID NO: 312642 - DNA, 15 bp, Homo sapiens
ttgtgtagatgatgt

SEQ ID NO: 312643 - DNA, 15 bp, Homo sapiens
tgtgtagatgatgtg

SEQ ID NO: 312644 - DNA, 15 bp, Homo sapiens
gtgtagatgatgtgg

SEQ ID NO: 312645 - DNA, 15 bp, Homo sapiens
tgtagatgatgtggt

SEQ ID NO: 312646 - DNA, 15 bp, Homo sapiens
gtagatgatgtggtg

SEQ ID NO: 312647 - DNA, 15 bp, Homo sapiens
tagatgatgtggtga

SEQ ID NO: 312648 - DNA, 15 bp, Homo sapiens
agatgatgtggtgat

SEQ ID NO: 312649 - DNA, 15 bp, Homo sapiens
gatgatgtggtgatt

SEQ ID NO: 312650 - DNA, 15 bp, Homo sapiens
atgatgtggtgattt

SEQ ID NO: 312651 - DNA, 15 bp, Homo sapiens
tgatgtggtgatttt

SEQ ID NO: 312652 - DNA, 15 bp, Homo sapiens
gatgtggtgattttc

SEQ ID NO: 312653 - DNA, 15 bp, Homo sapiens
atgtggtgattttcc

SEQ ID NO: 312654 - DNA, 15 bp, Homo sapiens
tgtggtgattttcca

SEQ ID NO: 312655 - DNA, 15 bp, Homo sapiens
gtggtgattttccat

SEQ ID NO: 312656 - DNA, 15 bp, Homo sapiens
tggtgattttccatt

SEQ ID NO: 312657 - DNA, 15 bp, Homo sapiens
ggtgattttccattc

SEQ ID NO: 312658 - DNA, 15 bp, Homo sapiens
gtgattttccattca

SEQ ID NO: 312659 - DNA, 15 bp, Homo sapiens
tgattttccattcaa

SEQ ID NO: 312660 - DNA, 15 bp, Homo sapiens
gattttccattcaat

SEQ ID NO: 312661 - DNA, 15 bp, Homo sapiens
attttccattcaatt

SEQ ID NO: 312662 - DNA, 15 bp, Homo sapiens
ttttccattcaattg

SEQ ID NO: 312663 - DNA, 15 bp, Homo sapiens
tttccattcaattgc

SEQ ID NO: 312664 - DNA, 15 bp, Homo sapiens
ttccattcaattgca

SEQ ID NO: 312665 - DNA, 15 bp, Homo sapiens
tccattcaattgcat

SEQ ID NO: 312666 - DNA, 15 bp, Homo sapiens
ccattcaattgcatg

SEQ ID NO: 312667 - DNA, 15 bp, Homo sapiens
cattcaattgcatga

SEQ ID NO: 312668 - DNA, 15 bp, Homo sapiens
attcaattgcatgat

SEQ ID NO: 312669 - DNA, 15 bp, Homo sapiens
ttcaattgcatgatg

SEQ ID NO: 312670 - DNA, 15 bp, Homo sapiens
tcaattgcatgatgc

SEQ ID NO: 312671 - DNA, 15 bp, Homo sapiens
caattgcatgatgcc

SEQ ID NO: 312672 - DNA, 15 bp, Homo sapiens
aattgcatgatgccc

SEQ ID NO: 312673 - DNA, 15 bp, Homo sapiens
attgcatgatgcccc

SEQ ID NO: 312674 - DNA, 15 bp, Homo sapiens
ttgcatgatgcccca

SEQ ID NO: 312675 - DNA, 15 bp, Homo sapiens
tgcatgatgccccat

SEQ ID NO: 312676 - DNA, 15 bp, Homo sapiens
gcatgatgccccatg

SEQ ID NO: 312677 - DNA, 15 bp, Homo sapiens
catgatgccccatga

SEQ ID NO: 312678 - DNA, 15 bp, Homo sapiens
atgatgccccatgat

SEQ ID NO: 312679 - DNA, 15 bp, Homo sapiens
tgatgccccatgatt

SEQ ID NO: 312680 - DNA, 15 bp, Homo sapiens
gatgccccatgattg

SEQ ID NO: 312681 - DNA, 15 bp, Homo sapiens
atgccccatgattgg

SEQ ID NO: 312682 - DNA, 15 bp, Homo sapiens
tgccccatgattggt

SEQ ID NO: 312683 - DNA, 15 bp, Homo sapiens
gccccatgattggtt

SEQ ID NO: 312684 - DNA, 15 bp, Homo sapiens
ccccatgattggtta

SEQ ID NO: 312685 - DNA, 15 bp, Homo sapiens
cccatgattggttat

SEQ ID NO: 312686 - DNA, 15 bp, Homo sapiens
ccatgattggttatg

SEQ ID NO: 312687 - DNA, 15 bp, Homo sapiens
catgattggttatgt

SEQ ID NO: 312688 - DNA, 15 bp, Homo sapiens
atgattggttatgtg

SEQ ID NO: 312689 - DNA, 15 bp, Homo sapiens
tgattggttatgtga

SEQ ID NO: 312690 - DNA, 15 bp, Homo sapiens
gattggttatgtgaa

SEQ ID NO: 312691 - DNA, 15 bp, Homo sapiens
attggttatgtgaat

SEQ ID NO: 312692 - DNA, 15 bp, Homo sapiens
ttggttatgtgaatt

SEQ ID NO: 312693 - DNA, 15 bp, Homo sapiens
tggttatgtgaattt

SEQ ID NO: 312694 - DNA, 15 bp, Homo sapiens
ggttatgtgaatttt

SEQ ID NO: 312695 - DNA, 15 bp, Homo sapiens
gttatgtgaattttg

SEQ ID NO: 312696 - DNA, 15 bp, Homo sapiens
ttatgtgaattttga

SEQ ID NO: 312697 - DNA, 15 bp, Homo sapiens
tatgtgaattttgat

SEQ ID NO: 312698 - DNA, 15 bp, Homo sapiens
atgtgaattttgatc

SEQ ID NO: 312699 - DNA, 15 bp, Homo sapiens
tgtgaattttgatca

SEQ ID NO: 312700 - DNA, 15 bp, Homo sapiens
gtgaattttgatcac

SEQ ID NO: 312701 - DNA, 15 bp, Homo sapiens
tgaattttgatcact

SEQ ID NO: 312702 - DNA, 15 bp, Homo sapiens
gaattttgatcactt

SEQ ID NO: 312703 - DNA, 15 bp, Homo sapiens
aattttgatcacttg

SEQ ID NO: 312704 - DNA, 15 bp, Homo sapiens
attttgatcacttgg

SEQ ID NO: 312705 - DNA, 15 bp, Homo sapiens
ttttgatcacttggt

SEQ ID NO: 312706 - DNA, 15 bp, Homo sapiens
tttgatcacttggtt

SEQ ID NO: 312707 - DNA, 15 bp, Homo sapiens
ttgatcacttggtta

SEQ ID NO: 312708 - DNA, 15 bp, Homo sapiens
tgatcacttggttaa

SEQ ID NO: 312709 - DNA, 15 bp, Homo sapiens
gatcacttggttaag

SEQ ID NO: 312710 - DNA, 15 bp, Homo sapiens
atcacttggttaaga

SEQ ID NO: 312711 - DNA, 15 bp, Homo sapiens
tcacttggttaagat

SEQ ID NO: 312712 - DNA, 15 bp, Homo sapiens
cacttggttaagatt

SEQ ID NO: 312713 - DNA, 15 bp, Homo sapiens
acttggttaagatta

SEQ ID NO: 312714 - DNA, 15 bp, Homo sapiens
cttggttaagattag

SEQ ID NO: 312715 - DNA, 15 bp, Homo sapiens
ttggttaagattagg

SEQ ID NO: 312716 - DNA, 15 bp, Homo sapiens
tggttaagattagga

SEQ ID NO: 312717 - DNA, 15 bp, Homo sapiens
ggttaagattaggaa

SEQ ID NO: 312718 - DNA, 15 bp, Homo sapiens
gttaagattaggaat

SEQ ID NO: 312719 - DNA, 15 bp, Homo sapiens
ttaagattaggaatt

SEQ ID NO: 312720 - DNA, 15 bp, Homo sapiens
taagattaggaattt

SEQ ID NO: 312721 - DNA, 15 bp, Homo sapiens
aagattaggaatttt

SEQ ID NO: 312722 - DNA, 15 bp, Homo sapiens
agattaggaattttt

SEQ ID NO: 312723 - DNA, 15 bp, Homo sapiens
gattaggaatttttc

SEQ ID NO: 312724 - DNA, 15 bp, Homo sapiens
attaggaatttttcc

SEQ ID NO: 312725 - DNA, 15 bp, Homo sapiens
ttaggaatttttccc

SEQ ID NO: 312726 - DNA, 15 bp, Homo sapiens
taggaatttttcccc

SEQ ID NO: 312727 - DNA, 15 bp, Homo sapiens
aggaatttttcccca

SEQ ID NO: 312728 - DNA, 15 bp, Homo sapiens
ggaatttttccccaa

SEQ ID NO: 312729 - DNA, 15 bp, Homo sapiens
gaatttttccccaac

SEQ ID NO: 312730 - DNA, 15 bp, Homo sapiens
aatttttccccaaca

SEQ ID NO: 312731 - DNA, 15 bp, Homo sapiens
atttttccccaacat

SEQ ID NO: 312732 - DNA, 15 bp, Homo sapiens
tttttccccaacata

SEQ ID NO: 312733 - DNA, 15 bp, Homo sapiens
ttttccccaacatat

SEQ ID NO: 312734 - DNA, 15 bp, Homo sapiens
tttccccaacatatt

SEQ ID NO: 312735 - DNA, 15 bp, Homo sapiens
ttccccaacatatta

SEQ ID NO: 312736 - DNA, 15 bp, Homo sapiens
tccccaacatattac

SEQ ID NO: 312737 - DNA, 15 bp, Homo sapiens
ccccaacatattact

SEQ ID NO: 312738 - DNA, 15 bp, Homo sapiens
cccaacatattacta

SEQ ID NO: 312739 - DNA, 15 bp, Homo sapiens
ccaacatattactat

SEQ ID NO: 312740 - DNA, 15 bp, Homo sapiens
caacatattactatg

SEQ ID NO: 312741 - DNA, 15 bp, Homo sapiens
aacatattactatga

SEQ ID NO: 312742 - DNA, 15 bp, Homo sapiens
acatattactatgaa

SEQ ID NO: 312743 - DNA, 15 bp, Homo sapiens
catattactatgaaa

SEQ ID NO: 312744 - DNA, 15 bp, Homo sapiens
atattactatgaaaa

SEQ ID NO: 312745 - DNA, 15 bp, Homo sapiens
tattactatgaaaaa

SEQ ID NO: 312746 - DNA, 15 bp, Homo sapiens
attactatgaaaaaa

SEQ ID NO: 312747 - DNA, 15 bp, Homo sapiens
ttactatgaaaaaat

SEQ ID NO: 312748 - DNA, 15 bp, Homo sapiens
tactatgaaaaaatt

SEQ ID NO: 312749 - DNA, 15 bp, Homo sapiens
actatgaaaaaattc

SEQ ID NO: 312750 - DNA, 15 bp, Homo sapiens
ctatgaaaaaattct

SEQ ID NO: 312751 - DNA, 15 bp, Homo sapiens
tatgaaaaaattctc

SEQ ID NO: 312752 - DNA, 15 bp, Homo sapiens
atgaaaaaattctca

SEQ ID NO: 312753 - DNA, 15 bp, Homo sapiens
tgaaaaaattctcag

SEQ ID NO: 312754 - DNA, 15 bp, Homo sapiens
gaaaaaattctcaga

SEQ ID NO: 312755 - DNA, 15 bp, Homo sapiens
aaaaaattctcagac

SEQ ID NO: 312756 - DNA, 15 bp, Homo sapiens
aaaaattctcagaca

SEQ ID NO: 312757 - DNA, 15 bp, Homo sapiens
aaaattctcagacat

SEQ ID NO: 312758 - DNA, 15 bp, Homo sapiens
aaattctcagacata

SEQ ID NO: 312759 - DNA, 15 bp, Homo sapiens
aattctcagacatac

SEQ ID NO: 312760 - DNA, 15 bp, Homo sapiens
attctcagacataca

SEQ ID NO: 312761 - DNA, 15 bp, Homo sapiens
ttctcagacatacag

SEQ ID NO: 312762 - DNA, 15 bp, Homo sapiens
tctcagacatacaga

SEQ ID NO: 312763 - DNA, 15 bp, Homo sapiens
ctcagacatacagaa

SEQ ID NO: 312764 - DNA, 15 bp, Homo sapiens
tcagacatacagaag

SEQ ID NO: 312765 - DNA, 15 bp, Homo sapiens
cagacatacagaaga

SEQ ID NO: 312766 - DNA, 15 bp, Homo sapiens
agacatacagaagag

SEQ ID NO: 312767 - DNA, 15 bp, Homo sapiens
gacatacagaagagt

SEQ ID NO: 312768 - DNA, 15 bp, Homo sapiens
acatacagaagagtt

SEQ ID NO: 312769 - DNA, 15 bp, Homo sapiens
catacagaagagttg

SEQ ID NO: 312770 - DNA, 15 bp, Homo sapiens
atacagaagagttgc

SEQ ID NO: 312771 - DNA, 15 bp, Homo sapiens
tacagaagagttgca

SEQ ID NO: 312772 - DNA, 15 bp, Homo sapiens
acagaagagttgcaa

SEQ ID NO: 312773 - DNA, 15 bp, Homo sapiens
cagaagagttgcaag

SEQ ID NO: 312774 - DNA, 15 bp, Homo sapiens
agaagagttgcaaga

SEQ ID NO: 312775 - DNA, 15 bp, Homo sapiens
gaagagttgcaagaa

SEQ ID NO: 312776 - DNA, 15 bp, Homo sapiens
aagagttgcaagaaa

SEQ ID NO: 312777 - DNA, 15 bp, Homo sapiens
agagttgcaagaaat

SEQ ID NO: 312778 - DNA, 15 bp, Homo sapiens
gagttgcaagaaatt

SEQ ID NO: 312779 - DNA, 15 bp, Homo sapiens
agttgcaagaaattt

SEQ ID NO: 312780 - DNA, 15 bp, Homo sapiens
gttgcaagaaatttt

SEQ ID NO: 312781 - DNA, 15 bp, Homo sapiens
ttgcaagaaattttc

SEQ ID NO: 312782 - DNA, 15 bp, Homo sapiens
tgcaagaaattttca

SEQ ID NO: 312783 - DNA, 15 bp, Homo sapiens
gcaagaaattttcat

SEQ ID NO: 312784 - DNA, 15 bp, Homo sapiens
caagaaattttcatt

SEQ ID NO: 312785 - DNA, 15 bp, Homo sapiens
aagaaattttcattc

SEQ ID NO: 312786 - DNA, 15 bp, Homo sapiens
agaaattttcattca

SEQ ID NO: 312787 - DNA, 15 bp, Homo sapiens
gaaattttcattcag

SEQ ID NO: 312788 - DNA, 15 bp, Homo sapiens
aaattttcattcagc

SEQ ID NO: 312789 - DNA, 15 bp, Homo sapiens
aattttcattcagca

SEQ ID NO: 312790 - DNA, 15 bp, Homo sapiens
attttcattcagcat

SEQ ID NO: 312791 - DNA, 15 bp, Homo sapiens
ttttcattcagcatt

SEQ ID NO: 312792 - DNA, 15 bp, Homo sapiens
tttcattcagcattc

SEQ ID NO: 312793 - DNA, 15 bp, Homo sapiens
ttcattcagcattca

SEQ ID NO: 312794 - DNA, 15 bp, Homo sapiens
tcattcagcattcat

SEQ ID NO: 312795 - DNA, 15 bp, Homo sapiens
cattcagcattcata

SEQ ID NO: 312796 - DNA, 15 bp, Homo sapiens
attcagcattcatat

SEQ ID NO: 312797 - DNA, 15 bp, Homo sapiens
ttcagcattcatata

SEQ ID NO: 312798 - DNA, 15 bp, Homo sapiens
tcagcattcatatac

SEQ ID NO: 312799 - DNA, 15 bp, Homo sapiens
cagcattcatatacc

SEQ ID NO: 312800 - DNA, 15 bp, Homo sapiens
agcattcatataccc

SEQ ID NO: 312801 - DNA, 15 bp, Homo sapiens
gcattcatataccca

SEQ ID NO: 312802 - DNA, 15 bp, Homo sapiens
cattcatatacccat

SEQ ID NO: 312803 - DNA, 15 bp, Homo sapiens
attcatatacccatg

SEQ ID NO: 312804 - DNA, 15 bp, Homo sapiens
ttcatatacccatga

SEQ ID NO: 312805 - DNA, 15 bp, Homo sapiens
tcatatacccatgag

SEQ ID NO: 312806 - DNA, 15 bp, Homo sapiens
catatacccatgagc

SEQ ID NO: 312807 - DNA, 15 bp, Homo sapiens
atatacccatgagct

SEQ ID NO: 312808 - DNA, 15 bp, Homo sapiens
tatacccatgagcta

SEQ ID NO: 312809 - DNA, 15 bp, Homo sapiens
atacccatgagctag

SEQ ID NO: 312810 - DNA, 15 bp, Homo sapiens
tacccatgagctagg

SEQ ID NO: 312811 - DNA, 15 bp, Homo sapiens
acccatgagctaggt

SEQ ID NO: 312812 - DNA, 15 bp, Homo sapiens
cccatgagctaggtt

SEQ ID NO: 312813 - DNA, 15 bp, Homo sapiens
ccatgagctaggttc

SEQ ID NO: 312814 - DNA, 15 bp, Homo sapiens
catgagctaggttcc

SEQ ID NO: 312815 - DNA, 15 bp, Homo sapiens
atgagctaggttcct

SEQ ID NO: 312816 - DNA, 15 bp, Homo sapiens
tgagctaggttcctt

SEQ ID NO: 312817 - DNA, 15 bp, Homo sapiens
gagctaggttcctta

SEQ ID NO: 312818 - DNA, 15 bp, Homo sapiens
agctaggttccttaa

SEQ ID NO: 312819 - DNA, 15 bp, Homo sapiens
gctaggttccttaat

SEQ ID NO: 312820 - DNA, 15 bp, Homo sapiens
ctaggttccttaatt

SEQ ID NO: 312821 - DNA, 15 bp, Homo sapiens
taggttccttaattt

SEQ ID NO: 312822 - DNA, 15 bp, Homo sapiens
aggttccttaatttg

SEQ ID NO: 312823 - DNA, 15 bp, Homo sapiens
ggttccttaatttgc

SEQ ID NO: 312824 - DNA, 15 bp, Homo sapiens
gttccttaatttgca

SEQ ID NO: 312825 - DNA, 15 bp, Homo sapiens
ttccttaatttgcat

SEQ ID NO: 312826 - DNA, 15 bp, Homo sapiens
tccttaatttgcatt

SEQ ID NO: 312827 - DNA, 15 bp, Homo sapiens
ccttaatttgcattt

SEQ ID NO: 312828 - DNA, 15 bp, Homo sapiens
cttaatttgcatttt

SEQ ID NO: 312829 - DNA, 15 bp, Homo sapiens
ttaatttgcattttg

SEQ ID NO: 312830 - DNA, 15 bp, Homo sapiens
taatttgcattttgc

SEQ ID NO: 312831 - DNA, 15 bp, Homo sapiens
aatttgcattttgct

SEQ ID NO: 312832 - DNA, 15 bp, Homo sapiens
atttgcattttgcta

SEQ ID NO: 312833 - DNA, 15 bp, Homo sapiens
tttgcattttgctat

SEQ ID NO: 312834 - DNA, 15 bp, Homo sapiens
ttgcattttgctata

SEQ ID NO: 312835 - DNA, 15 bp, Homo sapiens
tgcattttgctatat

SEQ ID NO: 312836 - DNA, 15 bp, Homo sapiens
gcattttgctatatt

SEQ ID NO: 312837 - DNA, 15 bp, Homo sapiens
cattttgctatattc

SEQ ID NO: 312838 - DNA, 15 bp, Homo sapiens
attttgctatattct

SEQ ID NO: 312839 - DNA, 15 bp, Homo sapiens
ttttgctatattctg

SEQ ID NO: 312840 - DNA, 15 bp, Homo sapiens
tttgctatattctgc

SEQ ID NO: 312841 - DNA, 15 bp, Homo sapiens
ttgctatattctgcc

SEQ ID NO: 312842 - DNA, 15 bp, Homo sapiens
tgctatattctgcca

SEQ ID NO: 312843 - DNA, 15 bp, Homo sapiens
gctatattctgccat

SEQ ID NO: 312844 - DNA, 15 bp, Homo sapiens
ctatattctgccata

SEQ ID NO: 312845 - DNA, 15 bp, Homo sapiens
tatattctgccatag

SEQ ID NO: 312846 - DNA, 15 bp, Homo sapiens
atattctgccatagt

SEQ ID NO: 312847 - DNA, 15 bp, Homo sapiens
tattctgccatagtc

SEQ ID NO: 312848 - DNA, 15 bp, Homo sapiens
attctgccatagtct

SEQ ID NO: 312849 - DNA, 15 bp, Homo sapiens
ttctgccatagtctt

SEQ ID NO: 312850 - DNA, 15 bp, Homo sapiens
tctgccatagtcttc

SEQ ID NO: 312851 - DNA, 15 bp, Homo sapiens
ctgccatagtcttca

SEQ ID NO: 312852 - DNA, 15 bp, Homo sapiens
tgccatagtcttcac

SEQ ID NO: 312853 - DNA, 15 bp, Homo sapiens
gccatagtcttcact

SEQ ID NO: 312854 - DNA, 15 bp, Homo sapiens
ccatagtcttcactg

SEQ ID NO: 312855 - DNA, 15 bp, Homo sapiens
catagtcttcactgg

SEQ ID NO: 312856 - DNA, 15 bp, Homo sapiens
atagtcttcactggt

SEQ ID NO: 312857 - DNA, 15 bp, Homo sapiens
tagtcttcactggtt

SEQ ID NO: 312858 - DNA, 15 bp, Homo sapiens
agtcttcactggttc

SEQ ID NO: 312859 - DNA, 15 bp, Homo sapiens
gtcttcactggttcc

SEQ ID NO: 312860 - DNA, 15 bp, Homo sapiens
tcttcactggttccc

SEQ ID NO: 312861 - DNA, 15 bp, Homo sapiens
cttcactggttcccc

SEQ ID NO: 312862 - DNA, 15 bp, Homo sapiens
ttcactggttcccca

SEQ ID NO: 312863 - DNA, 15 bp, Homo sapiens
tcactggttccccac

SEQ ID NO: 312864 - DNA, 15 bp, Homo sapiens
cactggttccccaca

SEQ ID NO: 312865 - DNA, 15 bp, Homo sapiens
actggttccccacat

SEQ ID NO: 312866 - DNA, 15 bp, Homo sapiens
ctggttccccacata

SEQ ID NO: 312867 - DNA, 15 bp, Homo sapiens
tggttccccacatat

SEQ ID NO: 312868 - DNA, 15 bp, Homo sapiens
ggttccccacatatt

SEQ ID NO: 312869 - DNA, 15 bp, Homo sapiens
gttccccacatatta

SEQ ID NO: 312870 - DNA, 15 bp, Homo sapiens
ttccccacatattac

SEQ ID NO: 312871 - DNA, 15 bp, Homo sapiens
tccccacatattact

SEQ ID NO: 312872 - DNA, 15 bp, Homo sapiens
ccccacatattactg

SEQ ID NO: 312873 - DNA, 15 bp, Homo sapiens
cccacatattactgt

SEQ ID NO: 312874 - DNA, 15 bp, Homo sapiens
ccacatattactgtg

SEQ ID NO: 312875 - DNA, 15 bp, Homo sapiens
cacatattactgtgg

SEQ ID NO: 312876 - DNA, 15 bp, Homo sapiens
acatattactgtggt

SEQ ID NO: 312877 - DNA, 15 bp, Homo sapiens
catattactgtggtc

SEQ ID NO: 312878 - DNA, 15 bp, Homo sapiens
atattactgtggtct

SEQ ID NO: 312879 - DNA, 15 bp, Homo sapiens
tattactgtggtcta

SEQ ID NO: 312880 - DNA, 15 bp, Homo sapiens
attactgtggtctac

SEQ ID NO: 312881 - DNA, 15 bp, Homo sapiens
ttactgtggtctacc

SEQ ID NO: 312882 - DNA, 15 bp, Homo sapiens
tactgtggtctacct

SEQ ID NO: 312883 - DNA, 15 bp, Homo sapiens
actgtggtctaccta

SEQ ID NO: 312884 - DNA, 15 bp, Homo sapiens
ctgtggtctacctac

SEQ ID NO: 312885 - DNA, 15 bp, Homo sapiens
tgtggtctacctaca

SEQ ID NO: 312886 - DNA, 15 bp, Homo sapiens
gtggtctacctacaa

SEQ ID NO: 312887 - DNA, 15 bp, Homo sapiens
tggtctacctacaag

SEQ ID NO: 312888 - DNA, 15 bp, Homo sapiens
ggtctacctacaagc

SEQ ID NO: 312889 - DNA, 15 bp, Homo sapiens
gtctacctacaagcc

SEQ ID NO: 312890 - DNA, 15 bp, Homo sapiens
tctacctacaagcca

SEQ ID NO: 312891 - DNA, 15 bp, Homo sapiens
ctacctacaagccac

SEQ ID NO: 312892 - DNA, 15 bp, Homo sapiens
tacctacaagccaca

SEQ ID NO: 312893 - DNA, 15 bp, Homo sapiens
acctacaagccacaa

SEQ ID NO: 312894 - DNA, 15 bp, Homo sapiens
cctacaagccacaat

SEQ ID NO: 312895 - DNA, 15 bp, Homo sapiens
ctacaagccacaatc

SEQ ID NO: 312896 - DNA, 15 bp, Homo sapiens
tacaagccacaatcg

SEQ ID NO: 312897 - DNA, 15 bp, Homo sapiens
acaagccacaatcgt

SEQ ID NO: 312898 - DNA, 15 bp, Homo sapiens
caagccacaatcgtc

SEQ ID NO: 312899 - DNA, 15 bp, Homo sapiens
aagccacaatcgtct

SEQ ID NO: 312900 - DNA, 15 bp, Homo sapiens
agccacaatcgtctt

SEQ ID NO: 312901 - DNA, 15 bp, Homo sapiens
gccacaatcgtcttt

SEQ ID NO: 312902 - DNA, 15 bp, Homo sapiens
ccacaatcgtctttt

SEQ ID NO: 312903 - DNA, 15 bp, Homo sapiens
cacaatcgtcttttt

SEQ ID NO: 312904 - DNA, 15 bp, Homo sapiens
acaatcgtctttttt

SEQ ID NO: 312905 - DNA, 15 bp, Homo sapiens
caatcgtcttttttt

SEQ ID NO: 312906 - DNA, 15 bp, Homo sapiens
aatcgtctttttttt

SEQ ID NO: 312907 - DNA, 15 bp, Homo sapiens
atcgtcttttttttt

SEQ ID NO: 312908 - DNA, 15 bp, Homo sapiens
tcgtctttttttttt

SEQ ID NO: 312909 - DNA, 15 bp, Homo sapiens
cgtcttttttttttt

SEQ ID NO: 312910 - DNA, 15 bp, Homo sapiens
gtctttttttttttt

SEQ ID NO: 312911 - DNA, 15 bp, Homo sapiens
tggagtctcactctc

SEQ ID NO: 312912 - DNA, 15 bp, Homo sapiens
ggagtctcactctcg

SEQ ID NO: 312913 - DNA, 15 bp, Homo sapiens
gagtctcactctcgt

SEQ ID NO: 312914 - DNA, 15 bp, Homo sapiens
agtctcactctcgtt

SEQ ID NO: 312915 - DNA, 15 bp, Homo sapiens
gtctcactctcgttg

SEQ ID NO: 312916 - DNA, 15 bp, Homo sapiens
tctcactctcgttgc

SEQ ID NO: 312917 - DNA, 15 bp, Homo sapiens
ctcactctcgttgcc

SEQ ID NO: 312918 - DNA, 15 bp, Homo sapiens
tcactctcgttgccc

SEQ ID NO: 312919 - DNA, 15 bp, Homo sapiens
cactctcgttgccca

SEQ ID NO: 312920 - DNA, 15 bp, Homo sapiens
actctcgttgcccag

SEQ ID NO: 312921 - DNA, 15 bp, Homo sapiens
ctctcgttgcccagg

SEQ ID NO: 312922 - DNA, 15 bp, Homo sapiens
tctcgttgcccaggg

SEQ ID NO: 312923 - DNA, 15 bp, Homo sapiens
ctcgttgcccagggt

SEQ ID NO: 312924 - DNA, 15 bp, Homo sapiens
tcgttgcccagggtg

SEQ ID NO: 312925 - DNA, 15 bp, Homo sapiens
cgttgcccagggtgg

SEQ ID NO: 312926 - DNA, 15 bp, Homo sapiens
gttgcccagggtgga

SEQ ID NO: 312927 - DNA, 15 bp, Homo sapiens
ttgcccagggtggag

SEQ ID NO: 312928 - DNA, 15 bp, Homo sapiens
tgcccagggtggagt

SEQ ID NO: 312929 - DNA, 15 bp, Homo sapiens
gcccagggtggagtg

SEQ ID NO: 312930 - DNA, 15 bp, Homo sapiens
cccagggtggagtgc

SEQ ID NO: 312931 - DNA, 15 bp, Homo sapiens
ccagggtggagtgca

SEQ ID NO: 312932 - DNA, 15 bp, Homo sapiens
cagggtggagtgcag

SEQ ID NO: 312933 - DNA, 15 bp, Homo sapiens
agggtggagtgcagt

SEQ ID NO: 312934 - DNA, 15 bp, Homo sapiens
gggtggagtgcagtg

SEQ ID NO: 312935 - DNA, 15 bp, Homo sapiens
ggtggagtgcagtgg

SEQ ID NO: 312936 - DNA, 15 bp, Homo sapiens
gtggagtgcagtggc

SEQ ID NO: 312937 - DNA, 15 bp, Homo sapiens
tggagtgcagtggcg

SEQ ID NO: 312938 - DNA, 15 bp, Homo sapiens
ggagtgcagtggcgt

SEQ ID NO: 312939 - DNA, 15 bp, Homo sapiens
gagtgcagtggcgtg

SEQ ID NO: 312940 - DNA, 15 bp, Homo sapiens
agtggcgtgatctca

SEQ ID NO: 312941 - DNA, 15 bp, Homo sapiens
gtggcgtgatctcag

SEQ ID NO: 312942 - DNA, 15 bp, Homo sapiens
tggcgtgatctcagc

SEQ ID NO: 312943 - DNA, 15 bp, Homo sapiens
ggcgtgatctcagct

SEQ ID NO: 312944 - DNA, 15 bp, Homo sapiens
gcgtgatctcagctc

SEQ ID NO: 312945 - DNA, 15 bp, Homo sapiens
cgtgatctcagctca

SEQ ID NO: 312946 - DNA, 15 bp, Homo sapiens
gtgatctcagctcac

SEQ ID NO: 312947 - DNA, 15 bp, Homo sapiens
tgatctcagctcact

SEQ ID NO: 312948 - DNA, 15 bp, Homo sapiens
gatctcagctcactg

SEQ ID NO: 312949 - DNA, 15 bp, Homo sapiens
atctcagctcactgc

SEQ ID NO: 312950 - DNA, 15 bp, Homo sapiens
tctcagctcactgca

SEQ ID NO: 312951 - DNA, 15 bp, Homo sapiens
ctcagctcactgcaa

SEQ ID NO: 312952 - DNA, 15 bp, Homo sapiens
tcagctcactgcaac

SEQ ID NO: 312953 - DNA, 15 bp, Homo sapiens
cagctcactgcaact

SEQ ID NO: 312954 - DNA, 15 bp, Homo sapiens
agctcactgcaactt

SEQ ID NO: 312955 - DNA, 15 bp, Homo sapiens
gctcactgcaacttc

SEQ ID NO: 312956 - DNA, 15 bp, Homo sapiens
ctcactgcaacttcc

SEQ ID NO: 312957 - DNA, 15 bp, Homo sapiens
tcactgcaacttcca

SEQ ID NO: 312958 - DNA, 15 bp, Homo sapiens
cactgcaacttccac

SEQ ID NO: 312959 - DNA, 15 bp, Homo sapiens
actgcaacttccacc

SEQ ID NO: 312960 - DNA, 15 bp, Homo sapiens
ctgcaacttccacct

SEQ ID NO: 312961 - DNA, 15 bp, Homo sapiens
tgcaacttccacctc

SEQ ID NO: 312962 - DNA, 15 bp, Homo sapiens
gcaacttccacctcc

SEQ ID NO: 312963 - DNA, 15 bp, Homo sapiens
caacttccacctccc

SEQ ID NO: 312964 - DNA, 15 bp, Homo sapiens
aacttccacctccca

SEQ ID NO: 312965 - DNA, 15 bp, Homo sapiens
acttccacctcccag

SEQ ID NO: 312966 - DNA, 15 bp, Homo sapiens
cttccacctcccagg

SEQ ID NO: 312967 - DNA, 15 bp, Homo sapiens
ttccacctcccaggt

SEQ ID NO: 312968 - DNA, 15 bp, Homo sapiens
cctcccaggttcaag

SEQ ID NO: 312969 - DNA, 15 bp, Homo sapiens
ctcccaggttcaagc

SEQ ID NO: 312970 - DNA, 15 bp, Homo sapiens
tcccaggttcaagca

SEQ ID NO: 312971 - DNA, 15 bp, Homo sapiens
cccaggttcaagcaa

SEQ ID NO: 312972 - DNA, 15 bp, Homo sapiens
ccaggttcaagcaat

SEQ ID NO: 312973 - DNA, 15 bp, Homo sapiens
caggttcaagcaatt

SEQ ID NO: 312974 - DNA, 15 bp, Homo sapiens
aggttcaagcaattc

SEQ ID NO: 312975 - DNA, 15 bp, Homo sapiens
ggttcaagcaattct

SEQ ID NO: 312976 - DNA, 15 bp, Homo sapiens
gttcaagcaattctc

SEQ ID NO: 312977 - DNA, 15 bp, Homo sapiens
ttcaagcaattctcc

SEQ ID NO: 312978 - DNA, 15 bp, Homo sapiens
tcaagcaattctcct

SEQ ID NO: 312979 - DNA, 15 bp, Homo sapiens
caagcaattctcctg

SEQ ID NO: 312980 - DNA, 15 bp, Homo sapiens
aagcaattctcctgc

SEQ ID NO: 312981 - DNA, 15 bp, Homo sapiens
agcaattctcctgca

SEQ ID NO: 312982 - DNA, 15 bp, Homo sapiens
gcaattctcctgcat

SEQ ID NO: 312983 - DNA, 15 bp, Homo sapiens
caattctcctgcatt

SEQ ID NO: 312984 - DNA, 15 bp, Homo sapiens
aattctcctgcatta

SEQ ID NO: 312985 - DNA, 15 bp, Homo sapiens
attctcctgcattag

SEQ ID NO: 312986 - DNA, 15 bp, Homo sapiens
ttctcctgcattagc

SEQ ID NO: 312987 - DNA, 15 bp, Homo sapiens
tctcctgcattagcc

SEQ ID NO: 312988 - DNA, 15 bp, Homo sapiens
ctcctgcattagcct

SEQ ID NO: 312989 - DNA, 15 bp, Homo sapiens
tcctgcattagcctc

SEQ ID NO: 312990 - DNA, 15 bp, Homo sapiens
cctgcattagcctcc

SEQ ID NO: 312991 - DNA, 15 bp, Homo sapiens
ctgcattagcctcct

SEQ ID NO: 312992 - DNA, 15 bp, Homo sapiens
tgcattagcctcctg

SEQ ID NO: 312993 - DNA, 15 bp, Homo sapiens
gcattagcctcctga

SEQ ID NO: 312994 - DNA, 15 bp, Homo sapiens
cattagcctcctgag

SEQ ID NO: 312995 - DNA, 15 bp, Homo sapiens
attagcctcctgagt

SEQ ID NO: 312996 - DNA, 15 bp, Homo sapiens
tgggattacaggtgc

SEQ ID NO: 312997 - DNA, 15 bp, Homo sapiens
gggattacaggtgca

SEQ ID NO: 312998 - DNA, 15 bp, Homo sapiens
ggattacaggtgcac

SEQ ID NO: 312999 - DNA, 15 bp, Homo sapiens
gattacaggtgcaca

SEQ ID NO: 313000 - DNA, 15 bp, Homo sapiens
attacaggtgcacac

SEQ ID NO: 313001 - DNA, 15 bp, Homo sapiens
ttacaggtgcacacc

SEQ ID NO: 313002 - DNA, 15 bp, Homo sapiens
tacaggtgcacacca

SEQ ID NO: 313003 - DNA, 15 bp, Homo sapiens
acaggtgcacaccac

SEQ ID NO: 313004 - DNA, 15 bp, Homo sapiens
caggtgcacaccacc

SEQ ID NO: 313005 - DNA, 15 bp, Homo sapiens
aggtgcacaccacca

SEQ ID NO: 313006 - DNA, 15 bp, Homo sapiens
ggtgcacaccaccat

SEQ ID NO: 313007 - DNA, 15 bp, Homo sapiens
gtgcacaccaccatg

SEQ ID NO: 313008 - DNA, 15 bp, Homo sapiens
tgcacaccaccatgc

SEQ ID NO: 313009 - DNA, 15 bp, Homo sapiens
gcacaccaccatgcc

SEQ ID NO: 313010 - DNA, 15 bp, Homo sapiens
cacaccaccatgcct

SEQ ID NO: 313011 - DNA, 15 bp, Homo sapiens
acaccaccatgcctg

SEQ ID NO: 313012 - DNA, 15 bp, Homo sapiens
caccaccatgcctgg

SEQ ID NO: 313013 - DNA, 15 bp, Homo sapiens
accaccatgcctggc

SEQ ID NO: 313014 - DNA, 15 bp, Homo sapiens
cctggctaatttttt

SEQ ID NO: 313015 - DNA, 15 bp, Homo sapiens
ctggctaattttttt

SEQ ID NO: 313016 - DNA, 15 bp, Homo sapiens
aattttttttttttt

SEQ ID NO: 313017 - DNA, 15 bp, Homo sapiens
atttttttttttttt

SEQ ID NO: 313018 - DNA, 15 bp, Homo sapiens
ttttttgtattttta

SEQ ID NO: 313019 - DNA, 15 bp, Homo sapiens
agagacagggtttca

SEQ ID NO: 313020 - DNA, 15 bp, Homo sapiens
gagacagggtttcac

SEQ ID NO: 313021 - DNA, 15 bp, Homo sapiens
agacagggtttcact

SEQ ID NO: 313022 - DNA, 15 bp, Homo sapiens
gacagggtttcactg

SEQ ID NO: 313023 - DNA, 15 bp, Homo sapiens
acagggtttcactgt

SEQ ID NO: 313024 - DNA, 15 bp, Homo sapiens
cagggtttcactgtg

SEQ ID NO: 313025 - DNA, 15 bp, Homo sapiens
agggtttcactgtgc

SEQ ID NO: 313026 - DNA, 15 bp, Homo sapiens
gggtttcactgtgct

SEQ ID NO: 313027 - DNA, 15 bp, Homo sapiens
ggtttcactgtgctg

SEQ ID NO: 313028 - DNA, 15 bp, Homo sapiens
gtttcactgtgctgg

SEQ ID NO: 313029 - DNA, 15 bp, Homo sapiens
tttcactgtgctggc

SEQ ID NO: 313030 - DNA, 15 bp, Homo sapiens
ttcactgtgctggcc

SEQ ID NO: 313031 - DNA, 15 bp, Homo sapiens
tcactgtgctggcca

SEQ ID NO: 313032 - DNA, 15 bp, Homo sapiens
cactgtgctggccag

SEQ ID NO: 313033 - DNA, 15 bp, Homo sapiens
actgtgctggccagg

SEQ ID NO: 313034 - DNA, 15 bp, Homo sapiens
ctgtgctggccaggc

SEQ ID NO: 313035 - DNA, 15 bp, Homo sapiens
tgtgctggccaggct

SEQ ID NO: 313036 - DNA, 15 bp, Homo sapiens
gtgctggccaggctg

SEQ ID NO: 313037 - DNA, 15 bp, Homo sapiens
tgctggccaggctgg

SEQ ID NO: 313038 - DNA, 15 bp, Homo sapiens
gctggccaggctggt

SEQ ID NO: 313039 - DNA, 15 bp, Homo sapiens
ctggccaggctggtc

SEQ ID NO: 313040 - DNA, 15 bp, Homo sapiens
gaactcctgacctcg

SEQ ID NO: 313041 - DNA, 15 bp, Homo sapiens
aactcctgacctcgt

SEQ ID NO: 313042 - DNA, 15 bp, Homo sapiens
actcctgacctcgtg

SEQ ID NO: 313043 - DNA, 15 bp, Homo sapiens
ctcctgacctcgtga

SEQ ID NO: 313044 - DNA, 15 bp, Homo sapiens
tcctgacctcgtgat

SEQ ID NO: 313045 - DNA, 15 bp, Homo sapiens
cctgacctcgtgatc

SEQ ID NO: 313046 - DNA, 15 bp, Homo sapiens
ctgacctcgtgatcc

SEQ ID NO: 313047 - DNA, 15 bp, Homo sapiens
cctcgtgatccacct

SEQ ID NO: 313048 - DNA, 15 bp, Homo sapiens
ctcgtgatccacctg

SEQ ID NO: 313049 - DNA, 15 bp, Homo sapiens
tcgtgatccacctgc

SEQ ID NO: 313050 - DNA, 15 bp, Homo sapiens
cgtgatccacctgcc

SEQ ID NO: 313051 - DNA, 15 bp, Homo sapiens
gatccacctgcctcg

SEQ ID NO: 313052 - DNA, 15 bp, Homo sapiens
atccacctgcctcgg

SEQ ID NO: 313053 - DNA, 15 bp, Homo sapiens
tccacctgcctcggc

SEQ ID NO: 313054 - DNA, 15 bp, Homo sapiens
ccacctgcctcggcc

SEQ ID NO: 313055 - DNA, 15 bp, Homo sapiens
cacctgcctcggcct

SEQ ID NO: 313056 - DNA, 15 bp, Homo sapiens
acctgcctcggcctc

SEQ ID NO: 313057 - DNA, 15 bp, Homo sapiens
cctgcctcggcctcc

SEQ ID NO: 313058 - DNA, 15 bp, Homo sapiens
ctgcctcggcctccc

SEQ ID NO: 313059 - DNA, 15 bp, Homo sapiens
tgcctcggcctccca

SEQ ID NO: 313060 - DNA, 15 bp, Homo sapiens
gcctcggcctcccaa

SEQ ID NO: 313061 - DNA, 15 bp, Homo sapiens
cctcggcctcccaaa

SEQ ID NO: 313062 - DNA, 15 bp, Homo sapiens
ggcctcccaaagtgc

SEQ ID NO: 313063 - DNA, 15 bp, Homo sapiens
gcctcccaaagtgct

SEQ ID NO: 313064 - DNA, 15 bp, Homo sapiens
aggcatgagccaccg

SEQ ID NO: 313065 - DNA, 15 bp, Homo sapiens
ggcatgagccaccgt

SEQ ID NO: 313066 - DNA, 15 bp, Homo sapiens
gcatgagccaccgtg

SEQ ID NO: 313067 - DNA, 15 bp, Homo sapiens
catgagccaccgtgc

SEQ ID NO: 313068 - DNA, 15 bp, Homo sapiens
atgagccaccgtgcc

SEQ ID NO: 313069 - DNA, 15 bp, Homo sapiens
tgagccaccgtgccc

SEQ ID NO: 313070 - DNA, 15 bp, Homo sapiens
gagccaccgtgcccg

SEQ ID NO: 313071 - DNA, 15 bp, Homo sapiens
agccaccgtgcccgt

SEQ ID NO: 313072 - DNA, 15 bp, Homo sapiens
gccaccgtgcccgtc

SEQ ID NO: 313073 - DNA, 15 bp, Homo sapiens
ccaccgtgcccgtcc

SEQ ID NO: 313074 - DNA, 15 bp, Homo sapiens
caccgtgcccgtccc

SEQ ID NO: 313075 - DNA, 15 bp, Homo sapiens
accgtgcccgtccct

SEQ ID NO: 313076 - DNA, 15 bp, Homo sapiens
ccgtgcccgtccctt

SEQ ID NO: 313077 - DNA, 15 bp, Homo sapiens
cgtgcccgtcccttg

SEQ ID NO: 313078 - DNA, 15 bp, Homo sapiens
gtgcccgtcccttga

SEQ ID NO: 313079 - DNA, 15 bp, Homo sapiens
tgcccgtcccttgac

SEQ ID NO: 313080 - DNA, 15 bp, Homo sapiens
gcccgtcccttgacg

SEQ ID NO: 313081 - DNA, 15 bp, Homo sapiens
cccgtcccttgacga

SEQ ID NO: 313082 - DNA, 15 bp, Homo sapiens
ccgtcccttgacgat

SEQ ID NO: 313083 - DNA, 15 bp, Homo sapiens
cgtcccttgacgatc

SEQ ID NO: 313084 - DNA, 15 bp, Homo sapiens
gtcccttgacgatct

SEQ ID NO: 313085 - DNA, 15 bp, Homo sapiens
tcccttgacgatctt

SEQ ID NO: 313086 - DNA, 15 bp, Homo sapiens
cccttgacgatcttt

SEQ ID NO: 313087 - DNA, 15 bp, Homo sapiens
ccttgacgatctttt

SEQ ID NO: 313088 - DNA, 15 bp, Homo sapiens
cttgacgatctttta

SEQ ID NO: 313089 - DNA, 15 bp, Homo sapiens
ttgacgatcttttaa

SEQ ID NO: 313090 - DNA, 15 bp, Homo sapiens
tgacgatcttttaaa

SEQ ID NO: 313091 - DNA, 15 bp, Homo sapiens
gacgatcttttaaaa

SEQ ID NO: 313092 - DNA, 15 bp, Homo sapiens
acgatcttttaaaaa

SEQ ID NO: 313093 - DNA, 15 bp, Homo sapiens
cgatcttttaaaaag

SEQ ID NO: 313094 - DNA, 15 bp, Homo sapiens
gatcttttaaaaagg

SEQ ID NO: 313095 - DNA, 15 bp, Homo sapiens
atcttttaaaaaggc

SEQ ID NO: 313096 - DNA, 15 bp, Homo sapiens
tcttttaaaaaggcc

SEQ ID NO: 313097 - DNA, 15 bp, Homo sapiens
cttttaaaaaggcca

SEQ ID NO: 313098 - DNA, 15 bp, Homo sapiens
ttttaaaaaggccaa

SEQ ID NO: 313099 - DNA, 15 bp, Homo sapiens
tttaaaaaggccaat

SEQ ID NO: 313100 - DNA, 15 bp, Homo sapiens
ttaaaaaggccaatt

SEQ ID NO: 313101 - DNA, 15 bp, Homo sapiens
taaaaaggccaattt

SEQ ID NO: 313102 - DNA, 15 bp, Homo sapiens
aaaaaggccaatttg

SEQ ID NO: 313103 - DNA, 15 bp, Homo sapiens
aaaaggccaatttga

SEQ ID NO: 313104 - DNA, 15 bp, Homo sapiens
aaaggccaatttgac

SEQ ID NO: 313105 - DNA, 15 bp, Homo sapiens
aaggccaatttgacc

SEQ ID NO: 313106 - DNA, 15 bp, Homo sapiens
aggccaatttgacca

SEQ ID NO: 313107 - DNA, 15 bp, Homo sapiens
ggccaatttgaccat

SEQ ID NO: 313108 - DNA, 15 bp, Homo sapiens
gccaatttgaccatg

SEQ ID NO: 313109 - DNA, 15 bp, Homo sapiens
ccaatttgaccatgt

SEQ ID NO: 313110 - DNA, 15 bp, Homo sapiens
caatttgaccatgtt

SEQ ID NO: 313111 - DNA, 15 bp, Homo sapiens
aatttgaccatgttg

SEQ ID NO: 313112 - DNA, 15 bp, Homo sapiens
atttgaccatgttgg

SEQ ID NO: 313113 - DNA, 15 bp, Homo sapiens
tttgaccatgttggt

SEQ ID NO: 313114 - DNA, 15 bp, Homo sapiens
ttgaccatgttggtt

SEQ ID NO: 313115 - DNA, 15 bp, Homo sapiens
tgaccatgttggttc

SEQ ID NO: 313116 - DNA, 15 bp, Homo sapiens
gaccatgttggttcc

SEQ ID NO: 313117 - DNA, 15 bp, Homo sapiens
accatgttggttccc

SEQ ID NO: 313118 - DNA, 15 bp, Homo sapiens
ccatgttggttccct

SEQ ID NO: 313119 - DNA, 15 bp, Homo sapiens
catgttggttccctc

SEQ ID NO: 313120 - DNA, 15 bp, Homo sapiens
atgttggttccctcc

SEQ ID NO: 313121 - DNA, 15 bp, Homo sapiens
tgttggttccctcct

SEQ ID NO: 313122 - DNA, 15 bp, Homo sapiens
gttggttccctcctt

SEQ ID NO: 313123 - DNA, 15 bp, Homo sapiens
ttggttccctccttc

SEQ ID NO: 313124 - DNA, 15 bp, Homo sapiens
tggttccctccttcg

SEQ ID NO: 313125 - DNA, 15 bp, Homo sapiens
ggttccctccttcga

SEQ ID NO: 313126 - DNA, 15 bp, Homo sapiens
gttccctccttcgaa

SEQ ID NO: 313127 - DNA, 15 bp, Homo sapiens
ttccctccttcgaac

SEQ ID NO: 313128 - DNA, 15 bp, Homo sapiens
tccctccttcgaacc

SEQ ID NO: 313129 - DNA, 15 bp, Homo sapiens
ccctccttcgaacca

SEQ ID NO: 313130 - DNA, 15 bp, Homo sapiens
cctccttcgaaccat

SEQ ID NO: 313131 - DNA, 15 bp, Homo sapiens
ctccttcgaaccatc

SEQ ID NO: 313132 - DNA, 15 bp, Homo sapiens
tccttcgaaccatct

SEQ ID NO: 313133 - DNA, 15 bp, Homo sapiens
ccttcgaaccatcta

SEQ ID NO: 313134 - DNA, 15 bp, Homo sapiens
cttcgaaccatctac

SEQ ID NO: 313135 - DNA, 15 bp, Homo sapiens
ttcgaaccatctact

SEQ ID NO: 313136 - DNA, 15 bp, Homo sapiens
tcgaaccatctactg

SEQ ID NO: 313137 - DNA, 15 bp, Homo sapiens
cgaaccatctactgg

SEQ ID NO: 313138 - DNA, 15 bp, Homo sapiens
gaaccatctactggc

SEQ ID NO: 313139 - DNA, 15 bp, Homo sapiens
aaccatctactggct

SEQ ID NO: 313140 - DNA, 15 bp, Homo sapiens
accatctactggctc

SEQ ID NO: 313141 - DNA, 15 bp, Homo sapiens
ccatctactggctcc

SEQ ID NO: 313142 - DNA, 15 bp, Homo sapiens
catctactggctccc

SEQ ID NO: 313143 - DNA, 15 bp, Homo sapiens
atctactggctcccc

SEQ ID NO: 313144 - DNA, 15 bp, Homo sapiens
tctactggctcccca

SEQ ID NO: 313145 - DNA, 15 bp, Homo sapiens
ctactggctccccat

SEQ ID NO: 313146 - DNA, 15 bp, Homo sapiens
tactggctccccatt

SEQ ID NO: 313147 - DNA, 15 bp, Homo sapiens
actggctccccattg

SEQ ID NO: 313148 - DNA, 15 bp, Homo sapiens
ctggctccccattgc

SEQ ID NO: 313149 - DNA, 15 bp, Homo sapiens
tggctccccattgct

SEQ ID NO: 313150 - DNA, 15 bp, Homo sapiens
ggctccccattgctc

SEQ ID NO: 313151 - DNA, 15 bp, Homo sapiens
gctccccattgctct

SEQ ID NO: 313152 - DNA, 15 bp, Homo sapiens
ctccccattgctctt

SEQ ID NO: 313153 - DNA, 15 bp, Homo sapiens
tccccattgctcttc

SEQ ID NO: 313154 - DNA, 15 bp, Homo sapiens
ccccattgctcttca

SEQ ID NO: 313155 - DNA, 15 bp, Homo sapiens
cccattgctcttcag

SEQ ID NO: 313156 - DNA, 15 bp, Homo sapiens
ccattgctcttcaga

SEQ ID NO: 313157 - DNA, 15 bp, Homo sapiens
cattgctcttcagat

SEQ ID NO: 313158 - DNA, 15 bp, Homo sapiens
attgctcttcagata

SEQ ID NO: 313159 - DNA, 15 bp, Homo sapiens
ttgctcttcagataa

SEQ ID NO: 313160 - DNA, 15 bp, Homo sapiens
tgctcttcagataaa

SEQ ID NO: 313161 - DNA, 15 bp, Homo sapiens
gctcttcagataaag

SEQ ID NO: 313162 - DNA, 15 bp, Homo sapiens
ctcttcagataaaga

SEQ ID NO: 313163 - DNA, 15 bp, Homo sapiens
tcttcagataaagac

SEQ ID NO: 313164 - DNA, 15 bp, Homo sapiens
cttcagataaagaca

SEQ ID NO: 313165 - DNA, 15 bp, Homo sapiens
ttcagataaagacac

SEQ ID NO: 313166 - DNA, 15 bp, Homo sapiens
tcagataaagacaca

SEQ ID NO: 313167 - DNA, 15 bp, Homo sapiens
cagataaagacacaa

SEQ ID NO: 313168 - DNA, 15 bp, Homo sapiens
agataaagacacaaa

SEQ ID NO: 313169 - DNA, 15 bp, Homo sapiens
gataaagacacaaac

SEQ ID NO: 313170 - DNA, 15 bp, Homo sapiens
ataaagacacaaacc

SEQ ID NO: 313171 - DNA, 15 bp, Homo sapiens
taaagacacaaaccc

SEQ ID NO: 313172 - DNA, 15 bp, Homo sapiens
aaagacacaaaccct

SEQ ID NO: 313173 - DNA, 15 bp, Homo sapiens
aagacacaaaccctt

SEQ ID NO: 313174 - DNA, 15 bp, Homo sapiens
agacacaaacccttg

SEQ ID NO: 313175 - DNA, 15 bp, Homo sapiens
gacacaaacccttga

SEQ ID NO: 313176 - DNA, 15 bp, Homo sapiens
acacaaacccttgac

SEQ ID NO: 313177 - DNA, 15 bp, Homo sapiens
cacaaacccttgacc

SEQ ID NO: 313178 - DNA, 15 bp, Homo sapiens
acaaacccttgacct

SEQ ID NO: 313179 - DNA, 15 bp, Homo sapiens
caaacccttgacctg

SEQ ID NO: 313180 - DNA, 15 bp, Homo sapiens
aaacccttgacctgt

SEQ ID NO: 313181 - DNA, 15 bp, Homo sapiens
aacccttgacctgtt

SEQ ID NO: 313182 - DNA, 15 bp, Homo sapiens
acccttgacctgttc

SEQ ID NO: 313183 - DNA, 15 bp, Homo sapiens
cccttgacctgttct

SEQ ID NO: 313184 - DNA, 15 bp, Homo sapiens
ccttgacctgttctc

SEQ ID NO: 313185 - DNA, 15 bp, Homo sapiens
cttgacctgttctcc

SEQ ID NO: 313186 - DNA, 15 bp, Homo sapiens
ttgacctgttctcca

SEQ ID NO: 313187 - DNA, 15 bp, Homo sapiens
tgacctgttctccat

SEQ ID NO: 313188 - DNA, 15 bp, Homo sapiens
gacctgttctccatg

SEQ ID NO: 313189 - DNA, 15 bp, Homo sapiens
acctgttctccatgg

SEQ ID NO: 313190 - DNA, 15 bp, Homo sapiens
cctgttctccatggt

SEQ ID NO: 313191 - DNA, 15 bp, Homo sapiens
ctgttctccatggtc

SEQ ID NO: 313192 - DNA, 15 bp, Homo sapiens
tgttctccatggtcc

SEQ ID NO: 313193 - DNA, 15 bp, Homo sapiens
gttctccatggtcct

SEQ ID NO: 313194 - DNA, 15 bp, Homo sapiens
ttctccatggtccta

SEQ ID NO: 313195 - DNA, 15 bp, Homo sapiens
tctccatggtcctat

SEQ ID NO: 313196 - DNA, 15 bp, Homo sapiens
ctccatggtcctatc

SEQ ID NO: 313197 - DNA, 15 bp, Homo sapiens
tccatggtcctatcc

SEQ ID NO: 313198 - DNA, 15 bp, Homo sapiens
ccatggtcctatccc

SEQ ID NO: 313199 - DNA, 15 bp, Homo sapiens
catggtcctatccct

SEQ ID NO: 313200 - DNA, 15 bp, Homo sapiens
atggtcctatccctg

SEQ ID NO: 313201 - DNA, 15 bp, Homo sapiens
tggtcctatccctgg

SEQ ID NO: 313202 - DNA, 15 bp, Homo sapiens
ggtcctatccctggt

SEQ ID NO: 313203 - DNA, 15 bp, Homo sapiens
gtcctatccctggtc

SEQ ID NO: 313204 - DNA, 15 bp, Homo sapiens
tcctatccctggtcc

SEQ ID NO: 313205 - DNA, 15 bp, Homo sapiens
cctatccctggtcct

SEQ ID NO: 313206 - DNA, 15 bp, Homo sapiens
ctatccctggtcctg

SEQ ID NO: 313207 - DNA, 15 bp, Homo sapiens
tatccctggtcctgc

SEQ ID NO: 313208 - DNA, 15 bp, Homo sapiens
atccctggtcctgcc

SEQ ID NO: 313209 - DNA, 15 bp, Homo sapiens
tccctggtcctgccc

SEQ ID NO: 313210 - DNA, 15 bp, Homo sapiens
ccctggtcctgccca

SEQ ID NO: 313211 - DNA, 15 bp, Homo sapiens
cctggtcctgcccag

SEQ ID NO: 313212 - DNA, 15 bp, Homo sapiens
ctggtcctgcccagc

SEQ ID NO: 313213 - DNA, 15 bp, Homo sapiens
tggtcctgcccagct

SEQ ID NO: 313214 - DNA, 15 bp, Homo sapiens
ggtcctgcccagctt

SEQ ID NO: 313215 - DNA, 15 bp, Homo sapiens
gtcctgcccagcttc

SEQ ID NO: 313216 - DNA, 15 bp, Homo sapiens
tcctgcccagcttct

SEQ ID NO: 313217 - DNA, 15 bp, Homo sapiens
cctgcccagcttctt

SEQ ID NO: 313218 - DNA, 15 bp, Homo sapiens
ctgcccagcttcttc

SEQ ID NO: 313219 - DNA, 15 bp, Homo sapiens
tgcccagcttcttca

SEQ ID NO: 313220 - DNA, 15 bp, Homo sapiens
gcccagcttcttcac

SEQ ID NO: 313221 - DNA, 15 bp, Homo sapiens
cccagcttcttcacc

SEQ ID NO: 313222 - DNA, 15 bp, Homo sapiens
ccagcttcttcacct

SEQ ID NO: 313223 - DNA, 15 bp, Homo sapiens
cagcttcttcacctg

SEQ ID NO: 313224 - DNA, 15 bp, Homo sapiens
agcttcttcacctgg

SEQ ID NO: 313225 - DNA, 15 bp, Homo sapiens
gcttcttcacctggt

SEQ ID NO: 313226 - DNA, 15 bp, Homo sapiens
cttcttcacctggtt

SEQ ID NO: 313227 - DNA, 15 bp, Homo sapiens
ttcttcacctggttc

SEQ ID NO: 313228 - DNA, 15 bp, Homo sapiens
tcttcacctggttca

SEQ ID NO: 313229 - DNA, 15 bp, Homo sapiens
cttcacctggttcaa

SEQ ID NO: 313230 - DNA, 15 bp, Homo sapiens
ttcacctggttcaac

SEQ ID NO: 313231 - DNA, 15 bp, Homo sapiens
tcacctggttcaaca

SEQ ID NO: 313232 - DNA, 15 bp, Homo sapiens
cacctggttcaacag

SEQ ID NO: 313233 - DNA, 15 bp, Homo sapiens
acctggttcaacagg

SEQ ID NO: 313234 - DNA, 15 bp, Homo sapiens
cctggttcaacaggt

SEQ ID NO: 313235 - DNA, 15 bp, Homo sapiens
ctggttcaacaggta

SEQ ID NO: 313236 - DNA, 15 bp, Homo sapiens
tggttcaacaggtac

SEQ ID NO: 313237 - DNA, 15 bp, Homo sapiens
ggttcaacaggtaca

SEQ ID NO: 313238 - DNA, 15 bp, Homo sapiens
gttcaacaggtacac

SEQ ID NO: 313239 - DNA, 15 bp, Homo sapiens
ttcaacaggtacact

SEQ ID NO: 313240 - DNA, 15 bp, Homo sapiens
tcaacaggtacactt

SEQ ID NO: 313241 - DNA, 15 bp, Homo sapiens
caacaggtacacttg

SEQ ID NO: 313242 - DNA, 15 bp, Homo sapiens
aacaggtacacttgt

SEQ ID NO: 313243 - DNA, 15 bp, Homo sapiens
acaggtacacttgtc

SEQ ID NO: 313244 - DNA, 15 bp, Homo sapiens
caggtacacttgtct

SEQ ID NO: 313245 - DNA, 15 bp, Homo sapiens
aggtacacttgtctc

SEQ ID NO: 313246 - DNA, 15 bp, Homo sapiens
ggtacacttgtctct

SEQ ID NO: 313247 - DNA, 15 bp, Homo sapiens
gtacacttgtctctt

SEQ ID NO: 313248 - DNA, 15 bp, Homo sapiens
tacacttgtctcttg

SEQ ID NO: 313249 - DNA, 15 bp, Homo sapiens
acacttgtctcttgg

SEQ ID NO: 313250 - DNA, 15 bp, Homo sapiens
cacttgtctcttggc

SEQ ID NO: 313251 - DNA, 15 bp, Homo sapiens
acttgtctcttggct

SEQ ID NO: 313252 - DNA, 15 bp, Homo sapiens
cttgtctcttggctg

SEQ ID NO: 313253 - DNA, 15 bp, Homo sapiens
ttgtctcttggctgt

SEQ ID NO: 313254 - DNA, 15 bp, Homo sapiens
tgtctcttggctgtc

SEQ ID NO: 313255 - DNA, 15 bp, Homo sapiens
gtctcttggctgtct

SEQ ID NO: 313256 - DNA, 15 bp, Homo sapiens
tctcttggctgtctt

SEQ ID NO: 313257 - DNA, 15 bp, Homo sapiens
ctcttggctgtcttc

SEQ ID NO: 313258 - DNA, 15 bp, Homo sapiens
tcttggctgtcttct

SEQ ID NO: 313259 - DNA, 15 bp, Homo sapiens
cttggctgtcttctt

SEQ ID NO: 313260 - DNA, 15 bp, Homo sapiens
ttggctgtcttcttt

SEQ ID NO: 313261 - DNA, 15 bp, Homo sapiens
tggctgtcttctttc

SEQ ID NO: 313262 - DNA, 15 bp, Homo sapiens
ggctgtcttctttcc

SEQ ID NO: 313263 - DNA, 15 bp, Homo sapiens
gctgtcttctttcca

SEQ ID NO: 313264 - DNA, 15 bp, Homo sapiens
ctgtcttctttccag

SEQ ID NO: 313265 - DNA, 15 bp, Homo sapiens
tgtcttctttccaga

SEQ ID NO: 313266 - DNA, 15 bp, Homo sapiens
gtcttctttccagaa

SEQ ID NO: 313267 - DNA, 15 bp, Homo sapiens
tcttctttccagaaa

SEQ ID NO: 313268 - DNA, 15 bp, Homo sapiens
cttctttccagaaac

SEQ ID NO: 313269 - DNA, 15 bp, Homo sapiens
ttctttccagaaaca

SEQ ID NO: 313270 - DNA, 15 bp, Homo sapiens
tctttccagaaacac

SEQ ID NO: 313271 - DNA, 15 bp, Homo sapiens
ctttccagaaacact

SEQ ID NO: 313272 - DNA, 15 bp, Homo sapiens
tttccagaaacactg

SEQ ID NO: 313273 - DNA, 15 bp, Homo sapiens
ttccagaaacactgg

SEQ ID NO: 313274 - DNA, 15 bp, Homo sapiens
tccagaaacactggc

SEQ ID NO: 313275 - DNA, 15 bp, Homo sapiens
ccagaaacactggct

SEQ ID NO: 313276 - DNA, 15 bp, Homo sapiens
cagaaacactggctt

SEQ ID NO: 313277 - DNA, 15 bp, Homo sapiens
agaaacactggcttg

SEQ ID NO: 313278 - DNA, 15 bp, Homo sapiens
gaaacactggcttgt

SEQ ID NO: 313279 - DNA, 15 bp, Homo sapiens
aaacactggcttgtg

SEQ ID NO: 313280 - DNA, 15 bp, Homo sapiens
aacactggcttgtgc

SEQ ID NO: 313281 - DNA, 15 bp, Homo sapiens
acactggcttgtgct

SEQ ID NO: 313282 - DNA, 15 bp, Homo sapiens
cactggcttgtgctc

SEQ ID NO: 313283 - DNA, 15 bp, Homo sapiens
actggcttgtgctcc

SEQ ID NO: 313284 - DNA, 15 bp, Homo sapiens
ctggcttgtgctcca

SEQ ID NO: 313285 - DNA, 15 bp, Homo sapiens
tggcttgtgctccat

SEQ ID NO: 313286 - DNA, 15 bp, Homo sapiens
ggcttgtgctccatt

SEQ ID NO: 313287 - DNA, 15 bp, Homo sapiens
gcttgtgctccattc

SEQ ID NO: 313288 - DNA, 15 bp, Homo sapiens
cttgtgctccattct

SEQ ID NO: 313289 - DNA, 15 bp, Homo sapiens
ttgtgctccattctt

SEQ ID NO: 313290 - DNA, 15 bp, Homo sapiens
tgtgctccattcttt

SEQ ID NO: 313291 - DNA, 15 bp, Homo sapiens
gtgctccattctttg

SEQ ID NO: 313292 - DNA, 15 bp, Homo sapiens
tgctccattctttga

SEQ ID NO: 313293 - DNA, 15 bp, Homo sapiens
gctccattctttgac

SEQ ID NO: 313294 - DNA, 15 bp, Homo sapiens
ctccattctttgact

SEQ ID NO: 313295 - DNA, 15 bp, Homo sapiens
tccattctttgactg

SEQ ID NO: 313296 - DNA, 15 bp, Homo sapiens
ccattctttgactgc

SEQ ID NO: 313297 - DNA, 15 bp, Homo sapiens
cattctttgactgct

SEQ ID NO: 313298 - DNA, 15 bp, Homo sapiens
attctttgactgctc

SEQ ID NO: 313299 - DNA, 15 bp, Homo sapiens
ttctttgactgctcc

SEQ ID NO: 313300 - DNA, 15 bp, Homo sapiens
tctttgactgctcca

SEQ ID NO: 313301 - DNA, 15 bp, Homo sapiens
ctttgactgctccat

SEQ ID NO: 313302 - DNA, 15 bp, Homo sapiens
tttgactgctccatg

SEQ ID NO: 313303 - DNA, 15 bp, Homo sapiens
ttgactgctccatga

SEQ ID NO: 313304 - DNA, 15 bp, Homo sapiens
tgactgctccatgat

SEQ ID NO: 313305 - DNA, 15 bp, Homo sapiens
gactgctccatgatt

SEQ ID NO: 313306 - DNA, 15 bp, Homo sapiens
actgctccatgattc

SEQ ID NO: 313307 - DNA, 15 bp, Homo sapiens
ctgctccatgattct

SEQ ID NO: 313308 - DNA, 15 bp, Homo sapiens
tgctccatgattctt

SEQ ID NO: 313309 - DNA, 15 bp, Homo sapiens
gctccatgattcttt

SEQ ID NO: 313310 - DNA, 15 bp, Homo sapiens
ctccatgattctttc

SEQ ID NO: 313311 - DNA, 15 bp, Homo sapiens
tccatgattctttct

SEQ ID NO: 313312 - DNA, 15 bp, Homo sapiens
ccatgattctttctg

SEQ ID NO: 313313 - DNA, 15 bp, Homo sapiens
catgattctttctgc

SEQ ID NO: 313314 - DNA, 15 bp, Homo sapiens
atgattctttctgcc

SEQ ID NO: 313315 - DNA, 15 bp, Homo sapiens
tgattctttctgcca

SEQ ID NO: 313316 - DNA, 15 bp, Homo sapiens
gattctttctgccac

SEQ ID NO: 313317 - DNA, 15 bp, Homo sapiens
attctttctgccact

SEQ ID NO: 313318 - DNA, 15 bp, Homo sapiens
ttctttctgccactt

SEQ ID NO: 313319 - DNA, 15 bp, Homo sapiens
tctttctgccacttc

SEQ ID NO: 313320 - DNA, 15 bp, Homo sapiens
ctttctgccacttca

SEQ ID NO: 313321 - DNA, 15 bp, Homo sapiens
tttctgccacttcac

SEQ ID NO: 313322 - DNA, 15 bp, Homo sapiens
ttctgccacttcaca

SEQ ID NO: 313323 - DNA, 15 bp, Homo sapiens
tctgccacttcacat

SEQ ID NO: 313324 - DNA, 15 bp, Homo sapiens
ctgccacttcacata

SEQ ID NO: 313325 - DNA, 15 bp, Homo sapiens
tgccacttcacatag

SEQ ID NO: 313326 - DNA, 15 bp, Homo sapiens
gccacttcacatagg

SEQ ID NO: 313327 - DNA, 15 bp, Homo sapiens
ccacttcacatagga

SEQ ID NO: 313328 - DNA, 15 bp, Homo sapiens
cacttcacataggaa

SEQ ID NO: 313329 - DNA, 15 bp, Homo sapiens
acttcacataggaag

SEQ ID NO: 313330 - DNA, 15 bp, Homo sapiens
cttcacataggaagc

SEQ ID NO: 313331 - DNA, 15 bp, Homo sapiens
ttcacataggaagct

SEQ ID NO: 313332 - DNA, 15 bp, Homo sapiens
tcacataggaagctc

SEQ ID NO: 313333 - DNA, 15 bp, Homo sapiens
cacataggaagctct

SEQ ID NO: 313334 - DNA, 15 bp, Homo sapiens
acataggaagctctt

SEQ ID NO: 313335 - DNA, 15 bp, Homo sapiens
cataggaagctctta

SEQ ID NO: 313336 - DNA, 15 bp, Homo sapiens
ataggaagctcttac

SEQ ID NO: 313337 - DNA, 15 bp, Homo sapiens
taggaagctcttacc

SEQ ID NO: 313338 - DNA, 15 bp, Homo sapiens
aggaagctcttacct

SEQ ID NO: 313339 - DNA, 15 bp, Homo sapiens
ggaagctcttacctt

SEQ ID NO: 313340 - DNA, 15 bp, Homo sapiens
gaagctcttaccttt

SEQ ID NO: 313341 - DNA, 15 bp, Homo sapiens
aagctcttacctttt

SEQ ID NO: 313342 - DNA, 15 bp, Homo sapiens
agctcttaccttttc

SEQ ID NO: 313343 - DNA, 15 bp, Homo sapiens
gctcttaccttttct

SEQ ID NO: 313344 - DNA, 15 bp, Homo sapiens
ctcttaccttttctc

SEQ ID NO: 313345 - DNA, 15 bp, Homo sapiens
tcttaccttttctct

SEQ ID NO: 313346 - DNA, 15 bp, Homo sapiens
cttaccttttctctt

SEQ ID NO: 313347 - DNA, 15 bp, Homo sapiens
ttaccttttctcttt

SEQ ID NO: 313348 - DNA, 15 bp, Homo sapiens
taccttttctctttc

SEQ ID NO: 313349 - DNA, 15 bp, Homo sapiens
accttttctctttct

SEQ ID NO: 313350 - DNA, 15 bp, Homo sapiens
ccttttctctttctg

SEQ ID NO: 313351 - DNA, 15 bp, Homo sapiens
cttttctctttctgt

SEQ ID NO: 313352 - DNA, 15 bp, Homo sapiens
ttttctctttctgtt

SEQ ID NO: 313353 - DNA, 15 bp, Homo sapiens
tttctctttctgttt

SEQ ID NO: 313354 - DNA, 15 bp, Homo sapiens
ttctctttctgtttc

SEQ ID NO: 313355 - DNA, 15 bp, Homo sapiens
tctctttctgtttcc

SEQ ID NO: 313356 - DNA, 15 bp, Homo sapiens
ctctttctgtttccc

SEQ ID NO: 313357 - DNA, 15 bp, Homo sapiens
tctttctgtttccct

SEQ ID NO: 313358 - DNA, 15 bp, Homo sapiens
ctttctgtttccctt

SEQ ID NO: 313359 - DNA, 15 bp, Homo sapiens
tttctgtttcccttt

SEQ ID NO: 313360 - DNA, 15 bp, Homo sapiens
ttctgtttccctttt

SEQ ID NO: 313361 - DNA, 15 bp, Homo sapiens
tctgtttcccttttt

SEQ ID NO: 313362 - DNA, 15 bp, Homo sapiens
ctgtttccctttttg

SEQ ID NO: 313363 - DNA, 15 bp, Homo sapiens
tgtttccctttttgg

SEQ ID NO: 313364 - DNA, 15 bp, Homo sapiens
gtttccctttttggc

SEQ ID NO: 313365 - DNA, 15 bp, Homo sapiens
tttccctttttggct

SEQ ID NO: 313366 - DNA, 15 bp, Homo sapiens
ttccctttttggcta

SEQ ID NO: 313367 - DNA, 15 bp, Homo sapiens
tccctttttggctaa

SEQ ID NO: 313368 - DNA, 15 bp, Homo sapiens
ccctttttggctaat

SEQ ID NO: 313369 - DNA, 15 bp, Homo sapiens
cctttttggctaatt

SEQ ID NO: 313370 - DNA, 15 bp, Homo sapiens
ctttttggctaatta

SEQ ID NO: 313371 - DNA, 15 bp, Homo sapiens
tttttggctaattaa

SEQ ID NO: 313372 - DNA, 15 bp, Homo sapiens
ttttggctaattaaa

SEQ ID NO: 313373 - DNA, 15 bp, Homo sapiens
tttggctaattaaat

SEQ ID NO: 313374 - DNA, 15 bp, Homo sapiens
ttggctaattaaatt

SEQ ID NO: 313375 - DNA, 15 bp, Homo sapiens
tggctaattaaattc

SEQ ID NO: 313376 - DNA, 15 bp, Homo sapiens
ggctaattaaattct

SEQ ID NO: 313377 - DNA, 15 bp, Homo sapiens
gctaattaaattctt

SEQ ID NO: 313378 - DNA, 15 bp, Homo sapiens
ctaattaaattcttg

SEQ ID NO: 313379 - DNA, 15 bp, Homo sapiens
taattaaattcttgt

SEQ ID NO: 313380 - DNA, 15 bp, Homo sapiens
aattaaattcttgtc

SEQ ID NO: 313381 - DNA, 15 bp, Homo sapiens
attaaattcttgtca

SEQ ID NO: 313382 - DNA, 15 bp, Homo sapiens
ttaaattcttgtcat

SEQ ID NO: 313383 - DNA, 15 bp, Homo sapiens
taaattcttgtcatc

SEQ ID NO: 313384 - DNA, 15 bp, Homo sapiens
aaattcttgtcatct

SEQ ID NO: 313385 - DNA, 15 bp, Homo sapiens
aattcttgtcatctt

SEQ ID NO: 313386 - DNA, 15 bp, Homo sapiens
attcttgtcatcttt

SEQ ID NO: 313387 - DNA, 15 bp, Homo sapiens
ttcttgtcatcttta

SEQ ID NO: 313388 - DNA, 15 bp, Homo sapiens
tcttgtcatctttaa

SEQ ID NO: 313389 - DNA, 15 bp, Homo sapiens
cttgtcatctttaaa

SEQ ID NO: 313390 - DNA, 15 bp, Homo sapiens
ttgtcatctttaaag

SEQ ID NO: 313391 - DNA, 15 bp, Homo sapiens
tgtcatctttaaagg

SEQ ID NO: 313392 - DNA, 15 bp, Homo sapiens
gtcatctttaaaggc

SEQ ID NO: 313393 - DNA, 15 bp, Homo sapiens
tcatctttaaaggct

SEQ ID NO: 313394 - DNA, 15 bp, Homo sapiens
catctttaaaggctt

SEQ ID NO: 313395 - DNA, 15 bp, Homo sapiens
atctttaaaggcttg

SEQ ID NO: 313396 - DNA, 15 bp, Homo sapiens
tctttaaaggcttgg

SEQ ID NO: 313397 - DNA, 15 bp, Homo sapiens
ctttaaaggcttggc

SEQ ID NO: 313398 - DNA, 15 bp, Homo sapiens
tttaaaggcttggct

SEQ ID NO: 313399 - DNA, 15 bp, Homo sapiens
ttaaaggcttggctc

SEQ ID NO: 313400 - DNA, 15 bp, Homo sapiens
taaaggcttggctca

SEQ ID NO: 313401 - DNA, 15 bp, Homo sapiens
aaaggcttggctcaa

SEQ ID NO: 313402 - DNA, 15 bp, Homo sapiens
aaggcttggctcaaa

SEQ ID NO: 313403 - DNA, 15 bp, Homo sapiens
aggcttggctcaaat

SEQ ID NO: 313404 - DNA, 15 bp, Homo sapiens
ggcttggctcaaatg

SEQ ID NO: 313405 - DNA, 15 bp, Homo sapiens
gcttggctcaaatgt

SEQ ID NO: 313406 - DNA, 15 bp, Homo sapiens
cttggctcaaatgtc

SEQ ID NO: 313407 - DNA, 15 bp, Homo sapiens
ttggctcaaatgtct

SEQ ID NO: 313408 - DNA, 15 bp, Homo sapiens
tggctcaaatgtctc

SEQ ID NO: 313409 - DNA, 15 bp, Homo sapiens
ggctcaaatgtctct

SEQ ID NO: 313410 - DNA, 15 bp, Homo sapiens
gctcaaatgtctctt

SEQ ID NO: 313411 - DNA, 15 bp, Homo sapiens
ctcaaatgtctcttc

SEQ ID NO: 313412 - DNA, 15 bp, Homo sapiens
tcaaatgtctcttca

SEQ ID NO: 313413 - DNA, 15 bp, Homo sapiens
caaatgtctcttcaa

SEQ ID NO: 313414 - DNA, 15 bp, Homo sapiens
aaatgtctcttcaag

SEQ ID NO: 313415 - DNA, 15 bp, Homo sapiens
aatgtctcttcaaga

SEQ ID NO: 313416 - DNA, 15 bp, Homo sapiens
atgtctcttcaagaa

SEQ ID NO: 313417 - DNA, 15 bp, Homo sapiens
tgtctcttcaagaaa

SEQ ID NO: 313418 - DNA, 15 bp, Homo sapiens
gtctcttcaagaaag

SEQ ID NO: 313419 - DNA, 15 bp, Homo sapiens
tctcttcaagaaagc

SEQ ID NO: 313420 - DNA, 15 bp, Homo sapiens
ctcttcaagaaagcc

SEQ ID NO: 313421 - DNA, 15 bp, Homo sapiens
tcttcaagaaagcct

SEQ ID NO: 313422 - DNA, 15 bp, Homo sapiens
cttcaagaaagcctt

SEQ ID NO: 313423 - DNA, 15 bp, Homo sapiens
ttcaagaaagccttc

SEQ ID NO: 313424 - DNA, 15 bp, Homo sapiens
tcaagaaagccttct

SEQ ID NO: 313425 - DNA, 15 bp, Homo sapiens
caagaaagccttctc

SEQ ID NO: 313426 - DNA, 15 bp, Homo sapiens
aagaaagccttctct

SEQ ID NO: 313427 - DNA, 15 bp, Homo sapiens
agaaagccttctcta

SEQ ID NO: 313428 - DNA, 15 bp, Homo sapiens
gaaagccttctctaa

SEQ ID NO: 313429 - DNA, 15 bp, Homo sapiens
aaagccttctctaat

SEQ ID NO: 313430 - DNA, 15 bp, Homo sapiens
aagccttctctaatt

SEQ ID NO: 313431 - DNA, 15 bp, Homo sapiens
agccttctctaattg

SEQ ID NO: 313432 - DNA, 15 bp, Homo sapiens
gccttctctaattgc

SEQ ID NO: 313433 - DNA, 15 bp, Homo sapiens
ccttctctaattgcc

SEQ ID NO: 313434 - DNA, 15 bp, Homo sapiens
cttctctaattgccc

SEQ ID NO: 313435 - DNA, 15 bp, Homo sapiens
ttctctaattgccca

SEQ ID NO: 313436 - DNA, 15 bp, Homo sapiens
tctctaattgcccag

SEQ ID NO: 313437 - DNA, 15 bp, Homo sapiens
ctctaattgcccagg

SEQ ID NO: 313438 - DNA, 15 bp, Homo sapiens
tctaattgcccaggg

SEQ ID NO: 313439 - DNA, 15 bp, Homo sapiens
ctaattgcccagggc

SEQ ID NO: 313440 - DNA, 15 bp, Homo sapiens
taattgcccagggca

SEQ ID NO: 313441 - DNA, 15 bp, Homo sapiens
aattgcccagggcag

SEQ ID NO: 313442 - DNA, 15 bp, Homo sapiens
attgcccagggcagg

SEQ ID NO: 313443 - DNA, 15 bp, Homo sapiens
ttgcccagggcaggt

SEQ ID NO: 313444 - DNA, 15 bp, Homo sapiens
tgcccagggcaggtc

SEQ ID NO: 313445 - DNA, 15 bp, Homo sapiens
gcccagggcaggtca

SEQ ID NO: 313446 - DNA, 15 bp, Homo sapiens
cccagggcaggtcag

SEQ ID NO: 313447 - DNA, 15 bp, Homo sapiens
ccagggcaggtcaga

SEQ ID NO: 313448 - DNA, 15 bp, Homo sapiens
cagggcaggtcagac

SEQ ID NO: 313449 - DNA, 15 bp, Homo sapiens
agggcaggtcagact

SEQ ID NO: 313450 - DNA, 15 bp, Homo sapiens
gggcaggtcagactc

SEQ ID NO: 313451 - DNA, 15 bp, Homo sapiens
ggcaggtcagactcc

SEQ ID NO: 313452 - DNA, 15 bp, Homo sapiens
gcaggtcagactcct

SEQ ID NO: 313453 - DNA, 15 bp, Homo sapiens
caggtcagactcctc

SEQ ID NO: 313454 - DNA, 15 bp, Homo sapiens
aggtcagactcctct

SEQ ID NO: 313455 - DNA, 15 bp, Homo sapiens
ggtcagactcctctg

SEQ ID NO: 313456 - DNA, 15 bp, Homo sapiens
gtcagactcctctgc

SEQ ID NO: 313457 - DNA, 15 bp, Homo sapiens
tcagactcctctgct

SEQ ID NO: 313458 - DNA, 15 bp, Homo sapiens
cagactcctctgctg

SEQ ID NO: 313459 - DNA, 15 bp, Homo sapiens
agactcctctgctgt

SEQ ID NO: 313460 - DNA, 15 bp, Homo sapiens
gactcctctgctgtg

SEQ ID NO: 313461 - DNA, 15 bp, Homo sapiens
actcctctgctgtgt

SEQ ID NO: 313462 - DNA, 15 bp, Homo sapiens
ctcctctgctgtgtg

SEQ ID NO: 313463 - DNA, 15 bp, Homo sapiens
tcctctgctgtgtgc

SEQ ID NO: 313464 - DNA, 15 bp, Homo sapiens
cctctgctgtgtgct

SEQ ID NO: 313465 - DNA, 15 bp, Homo sapiens
ctctgctgtgtgctc

SEQ ID NO: 313466 - DNA, 15 bp, Homo sapiens
tctgctgtgtgctct

SEQ ID NO: 313467 - DNA, 15 bp, Homo sapiens
ctgctgtgtgctctt

SEQ ID NO: 313468 - DNA, 15 bp, Homo sapiens
tgctgtgtgctctta

SEQ ID NO: 313469 - DNA, 15 bp, Homo sapiens
gctgtgtgctcttaa

SEQ ID NO: 313470 - DNA, 15 bp, Homo sapiens
ctgtgtgctcttaat

SEQ ID NO: 313471 - DNA, 15 bp, Homo sapiens
tgtgtgctcttaata

SEQ ID NO: 313472 - DNA, 15 bp, Homo sapiens
gtgtgctcttaatac

SEQ ID NO: 313473 - DNA, 15 bp, Homo sapiens
tgtgctcttaatact

SEQ ID NO: 313474 - DNA, 15 bp, Homo sapiens
gtgctcttaatactc

SEQ ID NO: 313475 - DNA, 15 bp, Homo sapiens
tgctcttaatactct

SEQ ID NO: 313476 - DNA, 15 bp, Homo sapiens
gctcttaatactctg

SEQ ID NO: 313477 - DNA, 15 bp, Homo sapiens
ctcttaatactctgt

SEQ ID NO: 313478 - DNA, 15 bp, Homo sapiens
tcttaatactctgtg

SEQ ID NO: 313479 - DNA, 15 bp, Homo sapiens
cttaatactctgtgc

SEQ ID NO: 313480 - DNA, 15 bp, Homo sapiens
ttaatactctgtgct

SEQ ID NO: 313481 - DNA, 15 bp, Homo sapiens
taatactctgtgctt

SEQ ID NO: 313482 - DNA, 15 bp, Homo sapiens
aatactctgtgcttc

SEQ ID NO: 313483 - DNA, 15 bp, Homo sapiens
atactctgtgcttct

SEQ ID NO: 313484 - DNA, 15 bp, Homo sapiens
tactctgtgcttctc

SEQ ID NO: 313485 - DNA, 15 bp, Homo sapiens
actctgtgcttctcc

SEQ ID NO: 313486 - DNA, 15 bp, Homo sapiens
ctctgtgcttctcct

SEQ ID NO: 313487 - DNA, 15 bp, Homo sapiens
tctgtgcttctcctt

SEQ ID NO: 313488 - DNA, 15 bp, Homo sapiens
ctgtgcttctccttt

SEQ ID NO: 313489 - DNA, 15 bp, Homo sapiens
tgtgcttctcctttg

SEQ ID NO: 313490 - DNA, 15 bp, Homo sapiens
gtgcttctcctttgt

SEQ ID NO: 313491 - DNA, 15 bp, Homo sapiens
tgcttctcctttgta

SEQ ID NO: 313492 - DNA, 15 bp, Homo sapiens
gcttctcctttgtat

SEQ ID NO: 313493 - DNA, 15 bp, Homo sapiens
cttctcctttgtatg

SEQ ID NO: 313494 - DNA, 15 bp, Homo sapiens
ttctcctttgtatga

SEQ ID NO: 313495 - DNA, 15 bp, Homo sapiens
tctcctttgtatgat

SEQ ID NO: 313496 - DNA, 15 bp, Homo sapiens
ctcctttgtatgatt

SEQ ID NO: 313497 - DNA, 15 bp, Homo sapiens
tcctttgtatgattt

SEQ ID NO: 313498 - DNA, 15 bp, Homo sapiens
cctttgtatgatttg

SEQ ID NO: 313499 - DNA, 15 bp, Homo sapiens
ctttgtatgatttgt

SEQ ID NO: 313500 - DNA, 15 bp, Homo sapiens
tttgtatgatttgta

SEQ ID NO: 313501 - DNA, 15 bp, Homo sapiens
ttgtatgatttgtag

SEQ ID NO: 313502 - DNA, 15 bp, Homo sapiens
tgtatgatttgtagt

SEQ ID NO: 313503 - DNA, 15 bp, Homo sapiens
gtatgatttgtagtc

SEQ ID NO: 313504 - DNA, 15 bp, Homo sapiens
tatgatttgtagtct

SEQ ID NO: 313505 - DNA, 15 bp, Homo sapiens
atgatttgtagtctg

SEQ ID NO: 313506 - DNA, 15 bp, Homo sapiens
tgatttgtagtctgt

SEQ ID NO: 313507 - DNA, 15 bp, Homo sapiens
gatttgtagtctgtc

SEQ ID NO: 313508 - DNA, 15 bp, Homo sapiens
atttgtagtctgtca

SEQ ID NO: 313509 - DNA, 15 bp, Homo sapiens
tttgtagtctgtcag

SEQ ID NO: 313510 - DNA, 15 bp, Homo sapiens
ttgtagtctgtcagt

SEQ ID NO: 313511 - DNA, 15 bp, Homo sapiens
tgtagtctgtcagta

SEQ ID NO: 313512 - DNA, 15 bp, Homo sapiens
gtagtctgtcagtat

SEQ ID NO: 313513 - DNA, 15 bp, Homo sapiens
tagtctgtcagtatt

SEQ ID NO: 313514 - DNA, 15 bp, Homo sapiens
agtctgtcagtattg

SEQ ID NO: 313515 - DNA, 15 bp, Homo sapiens
gtctgtcagtattgt

SEQ ID NO: 313516 - DNA, 15 bp, Homo sapiens
tctgtcagtattgta

SEQ ID NO: 313517 - DNA, 15 bp, Homo sapiens
ctgtcagtattgtaa

SEQ ID NO: 313518 - DNA, 15 bp, Homo sapiens
tgtcagtattgtaat

SEQ ID NO: 313519 - DNA, 15 bp, Homo sapiens
gtcagtattgtaatg

SEQ ID NO: 313520 - DNA, 15 bp, Homo sapiens
tcagtattgtaatga

SEQ ID NO: 313521 - DNA, 15 bp, Homo sapiens
cagtattgtaatgaa

SEQ ID NO: 313522 - DNA, 15 bp, Homo sapiens
agtattgtaatgaaa

SEQ ID NO: 313523 - DNA, 15 bp, Homo sapiens
gtattgtaatgaaat

SEQ ID NO: 313524 - DNA, 15 bp, Homo sapiens
tattgtaatgaaata

SEQ ID NO: 313525 - DNA, 15 bp, Homo sapiens
attgtaatgaaataa

SEQ ID NO: 313526 - DNA, 15 bp, Homo sapiens
ttgtaatgaaataat

SEQ ID NO: 313527 - DNA, 15 bp, Homo sapiens
tgtaatgaaataatt

SEQ ID NO: 313528 - DNA, 15 bp, Homo sapiens
gtaatgaaataattc

SEQ ID NO: 313529 - DNA, 15 bp, Homo sapiens
taatgaaataattca

SEQ ID NO: 313530 - DNA, 15 bp, Homo sapiens
aatgaaataattcat

SEQ ID NO: 313531 - DNA, 15 bp, Homo sapiens
atgaaataattcatt

SEQ ID NO: 313532 - DNA, 15 bp, Homo sapiens
tgaaataattcatta

SEQ ID NO: 313533 - DNA, 15 bp, Homo sapiens
gaaataattcattat

SEQ ID NO: 313534 - DNA, 15 bp, Homo sapiens
aaataattcattatg

SEQ ID NO: 313535 - DNA, 15 bp, Homo sapiens
aataattcattatgt

SEQ ID NO: 313536 - DNA, 15 bp, Homo sapiens
ataattcattatgta

SEQ ID NO: 313537 - DNA, 15 bp, Homo sapiens
taattcattatgtaa

SEQ ID NO: 313538 - DNA, 15 bp, Homo sapiens
aattcattatgtaat

SEQ ID NO: 313539 - DNA, 15 bp, Homo sapiens
attcattatgtaatt

SEQ ID NO: 313540 - DNA, 15 bp, Homo sapiens
ttcattatgtaatta

SEQ ID NO: 313541 - DNA, 15 bp, Homo sapiens
tcattatgtaattaa

SEQ ID NO: 313542 - DNA, 15 bp, Homo sapiens
cattatgtaattaat

SEQ ID NO: 313543 - DNA, 15 bp, Homo sapiens
attatgtaattaatt

SEQ ID NO: 313544 - DNA, 15 bp, Homo sapiens
ttatgtaattaattg

SEQ ID NO: 313545 - DNA, 15 bp, Homo sapiens
tatgtaattaattgc

SEQ ID NO: 313546 - DNA, 15 bp, Homo sapiens
atgtaattaattgct

SEQ ID NO: 313547 - DNA, 15 bp, Homo sapiens
tgtaattaattgctt

SEQ ID NO: 313548 - DNA, 15 bp, Homo sapiens
gtaattaattgctta

SEQ ID NO: 313549 - DNA, 15 bp, Homo sapiens
taattaattgcttag

SEQ ID NO: 313550 - DNA, 15 bp, Homo sapiens
aattaattgcttagt

SEQ ID NO: 313551 - DNA, 15 bp, Homo sapiens
attaattgcttagtg

SEQ ID NO: 313552 - DNA, 15 bp, Homo sapiens
ttaattgcttagtgt

SEQ ID NO: 313553 - DNA, 15 bp, Homo sapiens
taattgcttagtgtg

SEQ ID NO: 313554 - DNA, 15 bp, Homo sapiens
aattgcttagtgtgc

SEQ ID NO: 313555 - DNA, 15 bp, Homo sapiens
attgcttagtgtgca

SEQ ID NO: 313556 - DNA, 15 bp, Homo sapiens
ttgcttagtgtgcat

SEQ ID NO: 313557 - DNA, 15 bp, Homo sapiens
tgcttagtgtgcata

SEQ ID NO: 313558 - DNA, 15 bp, Homo sapiens
gcttagtgtgcataa

SEQ ID NO: 313559 - DNA, 15 bp, Homo sapiens
cttagtgtgcataag

SEQ ID NO: 313560 - DNA, 15 bp, Homo sapiens
ttagtgtgcataagc

SEQ ID NO: 313561 - DNA, 15 bp, Homo sapiens
tagtgtgcataagcg

SEQ ID NO: 313562 - DNA, 15 bp, Homo sapiens
agtgtgcataagcgc

SEQ ID NO: 313563 - DNA, 15 bp, Homo sapiens
gtgtgcataagcgcc

SEQ ID NO: 313564 - DNA, 15 bp, Homo sapiens
tgtgcataagcgccg

SEQ ID NO: 313565 - DNA, 15 bp, Homo sapiens
gtgcataagcgccgt

SEQ ID NO: 313566 - DNA, 15 bp, Homo sapiens
tgcataagcgccgta

SEQ ID NO: 313567 - DNA, 15 bp, Homo sapiens
gcataagcgccgtaa

SEQ ID NO: 313568 - DNA, 15 bp, Homo sapiens
cataagcgccgtaat

SEQ ID NO: 313569 - DNA, 15 bp, Homo sapiens
ataagcgccgtaatg

SEQ ID NO: 313570 - DNA, 15 bp, Homo sapiens
taagcgccgtaatgg

SEQ ID NO: 313571 - DNA, 15 bp, Homo sapiens
aagcgccgtaatggc

SEQ ID NO: 313572 - DNA, 15 bp, Homo sapiens
agcgccgtaatggca

SEQ ID NO: 313573 - DNA, 15 bp, Homo sapiens
gcgccgtaatggcag

SEQ ID NO: 313574 - DNA, 15 bp, Homo sapiens
cgccgtaatggcaga

SEQ ID NO: 313575 - DNA, 15 bp, Homo sapiens
gccgtaatggcagag

SEQ ID NO: 313576 - DNA, 15 bp, Homo sapiens
ccgtaatggcagagg

SEQ ID NO: 313577 - DNA, 15 bp, Homo sapiens
cgtaatggcagaggc

SEQ ID NO: 313578 - DNA, 15 bp, Homo sapiens
gtaatggcagaggct

SEQ ID NO: 313579 - DNA, 15 bp, Homo sapiens
taatggcagaggcta

SEQ ID NO: 313580 - DNA, 15 bp, Homo sapiens
aatggcagaggctat

SEQ ID NO: 313581 - DNA, 15 bp, Homo sapiens
atggcagaggctatg

SEQ ID NO: 313582 - DNA, 15 bp, Homo sapiens
tggcagaggctatgt

SEQ ID NO: 313583 - DNA, 15 bp, Homo sapiens
ggcagaggctatgtc

SEQ ID NO: 313584 - DNA, 15 bp, Homo sapiens
gcagaggctatgtct

SEQ ID NO: 313585 - DNA, 15 bp, Homo sapiens
cagaggctatgtctc

SEQ ID NO: 313586 - DNA, 15 bp, Homo sapiens
agaggctatgtctct

SEQ ID NO: 313587 - DNA, 15 bp, Homo sapiens
gaggctatgtctctt

SEQ ID NO: 313588 - DNA, 15 bp, Homo sapiens
aggctatgtctcttg

SEQ ID NO: 313589 - DNA, 15 bp, Homo sapiens
ggctatgtctcttgt

SEQ ID NO: 313590 - DNA, 15 bp, Homo sapiens
gctatgtctcttgtt

SEQ ID NO: 313591 - DNA, 15 bp, Homo sapiens
ctatgtctcttgttc

SEQ ID NO: 313592 - DNA, 15 bp, Homo sapiens
tatgtctcttgttca

SEQ ID NO: 313593 - DNA, 15 bp, Homo sapiens
atgtctcttgttcat

SEQ ID NO: 313594 - DNA, 15 bp, Homo sapiens
tgtctcttgttcata

SEQ ID NO: 313595 - DNA, 15 bp, Homo sapiens
gtctcttgttcatag

SEQ ID NO: 313596 - DNA, 15 bp, Homo sapiens
tctcttgttcatagt

SEQ ID NO: 313597 - DNA, 15 bp, Homo sapiens
ctcttgttcatagtc

SEQ ID NO: 313598 - DNA, 15 bp, Homo sapiens
tcttgttcatagtca

SEQ ID NO: 313599 - DNA, 15 bp, Homo sapiens
cttgttcatagtcat

SEQ ID NO: 313600 - DNA, 15 bp, Homo sapiens
ttgttcatagtcata

SEQ ID NO: 313601 - DNA, 15 bp, Homo sapiens
tgttcatagtcataa

SEQ ID NO: 313602 - DNA, 15 bp, Homo sapiens
gttcatagtcataac

SEQ ID NO: 313603 - DNA, 15 bp, Homo sapiens
ttcatagtcataaca

SEQ ID NO: 313604 - DNA, 15 bp, Homo sapiens
tcatagtcataacac

SEQ ID NO: 313605 - DNA, 15 bp, Homo sapiens
catagtcataacacc

SEQ ID NO: 313606 - DNA, 15 bp, Homo sapiens
atagtcataacacca

SEQ ID NO: 313607 - DNA, 15 bp, Homo sapiens
tagtcataacaccat

SEQ ID NO: 313608 - DNA, 15 bp, Homo sapiens
agtcataacaccatt

SEQ ID NO: 313609 - DNA, 15 bp, Homo sapiens
gtcataacaccattg

SEQ ID NO: 313610 - DNA, 15 bp, Homo sapiens
tcataacaccattgc

SEQ ID NO: 313611 - DNA, 15 bp, Homo sapiens
cataacaccattgcc

SEQ ID NO: 313612 - DNA, 15 bp, Homo sapiens
ataacaccattgcct

SEQ ID NO: 313613 - DNA, 15 bp, Homo sapiens
taacaccattgcctg

SEQ ID NO: 313614 - DNA, 15 bp, Homo sapiens
aacaccattgcctgg

SEQ ID NO: 313615 - DNA, 15 bp, Homo sapiens
acaccattgcctggc

SEQ ID NO: 313616 - DNA, 15 bp, Homo sapiens
caccattgcctggct

SEQ ID NO: 313617 - DNA, 15 bp, Homo sapiens
accattgcctggctt

SEQ ID NO: 313618 - DNA, 15 bp, Homo sapiens
ccattgcctggcttg

SEQ ID NO: 313619 - DNA, 15 bp, Homo sapiens
cattgcctggcttgg

SEQ ID NO: 313620 - DNA, 15 bp, Homo sapiens
attgcctggcttggt

SEQ ID NO: 313621 - DNA, 15 bp, Homo sapiens
ttgcctggcttggtg

SEQ ID NO: 313622 - DNA, 15 bp, Homo sapiens
tgcctggcttggtgc

SEQ ID NO: 313623 - DNA, 15 bp, Homo sapiens
gcctggcttggtgct

SEQ ID NO: 313624 - DNA, 15 bp, Homo sapiens
cctggcttggtgctt

SEQ ID NO: 313625 - DNA, 15 bp, Homo sapiens
ctggcttggtgcttt

SEQ ID NO: 313626 - DNA, 15 bp, Homo sapiens
tggcttggtgcttta

SEQ ID NO: 313627 - DNA, 15 bp, Homo sapiens
ggcttggtgctttac

SEQ ID NO: 313628 - DNA, 15 bp, Homo sapiens
gcttggtgctttaca

SEQ ID NO: 313629 - DNA, 15 bp, Homo sapiens
cttggtgctttacac

SEQ ID NO: 313630 - DNA, 15 bp, Homo sapiens
ttggtgctttacacg

SEQ ID NO: 313631 - DNA, 15 bp, Homo sapiens
tggtgctttacacgt

SEQ ID NO: 313632 - DNA, 15 bp, Homo sapiens
ggtgctttacacgtg

SEQ ID NO: 313633 - DNA, 15 bp, Homo sapiens
gtgctttacacgtgg

SEQ ID NO: 313634 - DNA, 15 bp, Homo sapiens
tgctttacacgtggt

SEQ ID NO: 313635 - DNA, 15 bp, Homo sapiens
gctttacacgtggta

SEQ ID NO: 313636 - DNA, 15 bp, Homo sapiens
ctttacacgtggtag

SEQ ID NO: 313637 - DNA, 15 bp, Homo sapiens
tttacacgtggtagg

SEQ ID NO: 313638 - DNA, 15 bp, Homo sapiens
ttacacgtggtaggc

SEQ ID NO: 313639 - DNA, 15 bp, Homo sapiens
tacacgtggtaggca

SEQ ID NO: 313640 - DNA, 15 bp, Homo sapiens
acacgtggtaggcac

SEQ ID NO: 313641 - DNA, 15 bp, Homo sapiens
cacgtggtaggcact

SEQ ID NO: 313642 - DNA, 15 bp, Homo sapiens
acgtggtaggcactc

SEQ ID NO: 313643 - DNA, 15 bp, Homo sapiens
cgtggtaggcactca

SEQ ID NO: 313644 - DNA, 15 bp, Homo sapiens
gtggtaggcactcaa

SEQ ID NO: 313645 - DNA, 15 bp, Homo sapiens
tggtaggcactcaat

SEQ ID NO: 313646 - DNA, 15 bp, Homo sapiens
ggtaggcactcaata

SEQ ID NO: 313647 - DNA, 15 bp, Homo sapiens
gtaggcactcaataa

SEQ ID NO: 313648 - DNA, 15 bp, Homo sapiens
taggcactcaataaa

SEQ ID NO: 313649 - DNA, 15 bp, Homo sapiens
aggcactcaataaat

SEQ ID NO: 313650 - DNA, 15 bp, Homo sapiens
ggcactcaataaata

SEQ ID NO: 313651 - DNA, 15 bp, Homo sapiens
gcactcaataaatat

SEQ ID NO: 313652 - DNA, 15 bp, Homo sapiens
cactcaataaatatt

SEQ ID NO: 313653 - DNA, 15 bp, Homo sapiens
actcaataaatattt

SEQ ID NO: 313654 - DNA, 15 bp, Homo sapiens
tcaataaatatttgg

SEQ ID NO: 313655 - DNA, 15 bp, Homo sapiens
caataaatatttggt

SEQ ID NO: 313656 - DNA, 15 bp, Homo sapiens
aataaatatttggtg

SEQ ID NO: 313657 - DNA, 15 bp, Homo sapiens
ataaatatttggtga

SEQ ID NO: 313658 - DNA, 15 bp, Homo sapiens
taaatatttggtgaa

SEQ ID NO: 313659 - DNA, 15 bp, Homo sapiens
aaatatttggtgaat

SEQ ID NO: 313660 - DNA, 15 bp, Homo sapiens
aatatttggtgaatg

SEQ ID NO: 313661 - DNA, 15 bp, Homo sapiens
atatttggtgaatga

SEQ ID NO: 313662 - DNA, 15 bp, Homo sapiens
tatttggtgaatgaa

SEQ ID NO: 313663 - DNA, 15 bp, Homo sapiens
atttggtgaatgaat

SEQ ID NO: 313664 - DNA, 15 bp, Homo sapiens
tttggtgaatgaata

SEQ ID NO: 313665 - DNA, 15 bp, Homo sapiens
ttggtgaatgaatag

SEQ ID NO: 313666 - DNA, 15 bp, Homo sapiens
tggtgaatgaatagt

SEQ ID NO: 313667 - DNA, 15 bp, Homo sapiens
ggtgaatgaatagtt

SEQ ID NO: 313668 - DNA, 15 bp, Homo sapiens
gtgaatgaatagtta

SEQ ID NO: 313669 - DNA, 15 bp, Homo sapiens
tgaatgaatagttac

SEQ ID NO: 313670 - DNA, 15 bp, Homo sapiens
gaatgaatagttact

SEQ ID NO: 313671 - DNA, 15 bp, Homo sapiens
aatgaatagttacta

SEQ ID NO: 313672 - DNA, 15 bp, Homo sapiens
atgaatagttactac

SEQ ID NO: 313673 - DNA, 15 bp, Homo sapiens
tgaatagttactacg

SEQ ID NO: 313674 - DNA, 15 bp, Homo sapiens
gaatagttactacga

SEQ ID NO: 313675 - DNA, 15 bp, Homo sapiens
aatagttactacgaa

SEQ ID NO: 313676 - DNA, 15 bp, Homo sapiens
atagttactacgaat

SEQ ID NO: 313677 - DNA, 15 bp, Homo sapiens
tagttactacgaata

SEQ ID NO: 313678 - DNA, 15 bp, Homo sapiens
agttactacgaataa

SEQ ID NO: 313679 - DNA, 15 bp, Homo sapiens
gttactacgaataac

SEQ ID NO: 313680 - DNA, 15 bp, Homo sapiens
ttactacgaataact

SEQ ID NO: 313681 - DNA, 15 bp, Homo sapiens
tactacgaataacta

SEQ ID NO: 313682 - DNA, 15 bp, Homo sapiens
actacgaataactat

SEQ ID NO: 313683 - DNA, 15 bp, Homo sapiens
ctacgaataactata

SEQ ID NO: 313684 - DNA, 15 bp, Homo sapiens
tacgaataactatat

SEQ ID NO: 313685 - DNA, 15 bp, Homo sapiens
acgaataactatata

SEQ ID NO: 313686 - DNA, 15 bp, Homo sapiens
cgaataactatataa

SEQ ID NO: 313687 - DNA, 15 bp, Homo sapiens
gaataactatataaa

SEQ ID NO: 313688 - DNA, 15 bp, Homo sapiens
aataactatataaaa

SEQ ID NO: 313689 - DNA, 15 bp, Homo sapiens
ataactatataaaat

SEQ ID NO: 313690 - DNA, 15 bp, Homo sapiens
taactatataaaata

SEQ ID NO: 313691 - DNA, 15 bp, Homo sapiens
aactatataaaatat

SEQ ID NO: 313692 - DNA, 15 bp, Homo sapiens
actatataaaatata

SEQ ID NO: 313693 - DNA, 15 bp, Homo sapiens
ctatataaaatatat

SEQ ID NO: 313694 - DNA, 15 bp, Homo sapiens
tatataaaatatata

SEQ ID NO: 313695 - DNA, 15 bp, Homo sapiens
atataaaatatataa

SEQ ID NO: 313696 - DNA, 15 bp, Homo sapiens
tataaaatatataaa

SEQ ID NO: 313697 - DNA, 15 bp, Homo sapiens
ataaaatatataaat

SEQ ID NO: 313698 - DNA, 15 bp, Homo sapiens
taaaatatataaata

SEQ ID NO: 313699 - DNA, 15 bp, Homo sapiens
aaaatatataaatac

SEQ ID NO: 313700 - DNA, 15 bp, Homo sapiens
aaatatataaataca

SEQ ID NO: 313701 - DNA, 15 bp, Homo sapiens
aatatataaatacat

SEQ ID NO: 313702 - DNA, 15 bp, Homo sapiens
atatataaatacatt

SEQ ID NO: 313703 - DNA, 15 bp, Homo sapiens
tatataaatacattt

SEQ ID NO: 313704 - DNA, 15 bp, Homo sapiens
atataaatacatttt

SEQ ID NO: 313705 - DNA, 15 bp, Homo sapiens
tataaatacattttt

SEQ ID NO: 313706 - DNA, 15 bp, Homo sapiens
ataaatacatttttt

SEQ ID NO: 313707 - DNA, 15 bp, Homo sapiens
taaatacattttttc

SEQ ID NO: 313708 - DNA, 15 bp, Homo sapiens
aaatacattttttca

SEQ ID NO: 313709 - DNA, 15 bp, Homo sapiens
aatacattttttcaa

SEQ ID NO: 313710 - DNA, 15 bp, Homo sapiens
atacattttttcaag

SEQ ID NO: 313711 - DNA, 15 bp, Homo sapiens
tacattttttcaagt

SEQ ID NO: 313712 - DNA, 15 bp, Homo sapiens
acattttttcaagtc

SEQ ID NO: 313713 - DNA, 15 bp, Homo sapiens
cattttttcaagtca

SEQ ID NO: 313714 - DNA, 15 bp, Homo sapiens
attttttcaagtcag

SEQ ID NO: 313715 - DNA, 15 bp, Homo sapiens
ttttttcaagtcagt

SEQ ID NO: 313716 - DNA, 15 bp, Homo sapiens
tttttcaagtcagta

SEQ ID NO: 313717 - DNA, 15 bp, Homo sapiens
ttttcaagtcagtac

SEQ ID NO: 313718 - DNA, 15 bp, Homo sapiens
tttcaagtcagtact

SEQ ID NO: 313719 - DNA, 15 bp, Homo sapiens
ttcaagtcagtactt

SEQ ID NO: 313720 - DNA, 15 bp, Homo sapiens
tcaagtcagtacttt

SEQ ID NO: 313721 - DNA, 15 bp, Homo sapiens
caagtcagtactttc

SEQ ID NO: 313722 - DNA, 15 bp, Homo sapiens
aagtcagtactttcc

SEQ ID NO: 313723 - DNA, 15 bp, Homo sapiens
agtcagtactttccc

SEQ ID NO: 313724 - DNA, 15 bp, Homo sapiens
gtcagtactttccct

SEQ ID NO: 313725 - DNA, 15 bp, Homo sapiens
tcagtactttccctt

SEQ ID NO: 313726 - DNA, 15 bp, Homo sapiens
cagtactttcccttt

SEQ ID NO: 313727 - DNA, 15 bp, Homo sapiens
agtactttccctttt

SEQ ID NO: 313728 - DNA, 15 bp, Homo sapiens
gtactttcccttttc

SEQ ID NO: 313729 - DNA, 15 bp, Homo sapiens
tactttcccttttcc

SEQ ID NO: 313730 - DNA, 15 bp, Homo sapiens
actttcccttttcct

SEQ ID NO: 313731 - DNA, 15 bp, Homo sapiens
ctttcccttttcctt

SEQ ID NO: 313732 - DNA, 15 bp, Homo sapiens
tttcccttttccttt

SEQ ID NO: 313733 - DNA, 15 bp, Homo sapiens
ttcccttttcctttt

SEQ ID NO: 313734 - DNA, 15 bp, Homo sapiens
tcccttttcctttta

SEQ ID NO: 313735 - DNA, 15 bp, Homo sapiens
cccttttccttttag

SEQ ID NO: 313736 - DNA, 15 bp, Homo sapiens
ccttttccttttagg

SEQ ID NO: 313737 - DNA, 15 bp, Homo sapiens
cttttccttttaggt

SEQ ID NO: 313738 - DNA, 15 bp, Homo sapiens
ttttccttttaggta

SEQ ID NO: 313739 - DNA, 15 bp, Homo sapiens
tttccttttaggtat

SEQ ID NO: 313740 - DNA, 15 bp, Homo sapiens
ttccttttaggtatt

SEQ ID NO: 313741 - DNA, 15 bp, Homo sapiens
tccttttaggtattg

SEQ ID NO: 313742 - DNA, 15 bp, Homo sapiens
ccttttaggtattga

SEQ ID NO: 313743 - DNA, 15 bp, Homo sapiens
cttttaggtattgat

SEQ ID NO: 313744 - DNA, 15 bp, Homo sapiens
ttttaggtattgatg

SEQ ID NO: 313745 - DNA, 15 bp, Homo sapiens
tttaggtattgatgt

SEQ ID NO: 313746 - DNA, 15 bp, Homo sapiens
ttaggtattgatgtc

SEQ ID NO: 313747 - DNA, 15 bp, Homo sapiens
taggtattgatgtca

SEQ ID NO: 313748 - DNA, 15 bp, Homo sapiens
aggtattgatgtcaa

SEQ ID NO: 313749 - DNA, 15 bp, Homo sapiens
ggtattgatgtcaag

SEQ ID NO: 313750 - DNA, 15 bp, Homo sapiens
gtattgatgtcaagc

SEQ ID NO: 313751 - DNA, 15 bp, Homo sapiens
tattgatgtcaagct

SEQ ID NO: 313752 - DNA, 15 bp, Homo sapiens
attgatgtcaagctg

SEQ ID NO: 313753 - DNA, 15 bp, Homo sapiens
ttgatgtcaagctga

SEQ ID NO: 313754 - DNA, 15 bp, Homo sapiens
tgatgtcaagctgaa

SEQ ID NO: 313755 - DNA, 15 bp, Homo sapiens
gatgtcaagctgaac

SEQ ID NO: 313756 - DNA, 15 bp, Homo sapiens
atgtcaagctgaacc

SEQ ID NO: 313757 - DNA, 15 bp, Homo sapiens
tgtcaagctgaacca

SEQ ID NO: 313758 - DNA, 15 bp, Homo sapiens
gtcaagctgaaccat

SEQ ID NO: 313759 - DNA, 15 bp, Homo sapiens
tcaagctgaaccatc

SEQ ID NO: 313760 - DNA, 15 bp, Homo sapiens
caagctgaaccatcg

SEQ ID NO: 313761 - DNA, 15 bp, Homo sapiens
aagctgaaccatcgt

SEQ ID NO: 313762 - DNA, 15 bp, Homo sapiens
agctgaaccatcgta

SEQ ID NO: 313763 - DNA, 15 bp, Homo sapiens
gctgaaccatcgtag

SEQ ID NO: 313764 - DNA, 15 bp, Homo sapiens
ctgaaccatcgtagg

SEQ ID NO: 313765 - DNA, 15 bp, Homo sapiens
tgaaccatcgtagga

SEQ ID NO: 313766 - DNA, 15 bp, Homo sapiens
gaaccatcgtaggaa

SEQ ID NO: 313767 - DNA, 15 bp, Homo sapiens
aaccatcgtaggaag

SEQ ID NO: 313768 - DNA, 15 bp, Homo sapiens
accatcgtaggaagt

SEQ ID NO: 313769 - DNA, 15 bp, Homo sapiens
ccatcgtaggaagtt

SEQ ID NO: 313770 - DNA, 15 bp, Homo sapiens
catcgtaggaagttg

SEQ ID NO: 313771 - DNA, 15 bp, Homo sapiens
atcgtaggaagttga

SEQ ID NO: 313772 - DNA, 15 bp, Homo sapiens
tcgtaggaagttgaa

SEQ ID NO: 313773 - DNA, 15 bp, Homo sapiens
cgtaggaagttgaaa

SEQ ID NO: 313774 - DNA, 15 bp, Homo sapiens
gtaggaagttgaaag

SEQ ID NO: 313775 - DNA, 15 bp, Homo sapiens
taggaagttgaaagc

SEQ ID NO: 313776 - DNA, 15 bp, Homo sapiens
aggaagttgaaagcc

SEQ ID NO: 313777 - DNA, 15 bp, Homo sapiens
ggaagttgaaagcct

SEQ ID NO: 313778 - DNA, 15 bp, Homo sapiens
gaagttgaaagcctt

SEQ ID NO: 313779 - DNA, 15 bp, Homo sapiens
aagttgaaagcctta

SEQ ID NO: 313780 - DNA, 15 bp, Homo sapiens
agttgaaagccttag

SEQ ID NO: 313781 - DNA, 15 bp, Homo sapiens
gttgaaagccttaga

SEQ ID NO: 313782 - DNA, 15 bp, Homo sapiens
ttgaaagccttagaa

SEQ ID NO: 313783 - DNA, 15 bp, Homo sapiens
tgaaagccttagaaa

SEQ ID NO: 313784 - DNA, 15 bp, Homo sapiens
gaaagccttagaaag

SEQ ID NO: 313785 - DNA, 15 bp, Homo sapiens
aaagccttagaaaga

SEQ ID NO: 313786 - DNA, 15 bp, Homo sapiens
aagccttagaaagag

SEQ ID NO: 313787 - DNA, 15 bp, Homo sapiens
agccttagaaagagg

SEQ ID NO: 313788 - DNA, 15 bp, Homo sapiens
gccttagaaagagga

SEQ ID NO: 313789 - DNA, 15 bp, Homo sapiens
ccttagaaagaggac

SEQ ID NO: 313790 - DNA, 15 bp, Homo sapiens
cttagaaagaggact

SEQ ID NO: 313791 - DNA, 15 bp, Homo sapiens
ttagaaagaggactt

SEQ ID NO: 313792 - DNA, 15 bp, Homo sapiens
tagaaagaggacttg

SEQ ID NO: 313793 - DNA, 15 bp, Homo sapiens
agaaagaggacttgg

SEQ ID NO: 313794 - DNA, 15 bp, Homo sapiens
gaaagaggacttggt

SEQ ID NO: 313795 - DNA, 15 bp, Homo sapiens
aaagaggacttggta

SEQ ID NO: 313796 - DNA, 15 bp, Homo sapiens
aagaggacttggtaa

SEQ ID NO: 313797 - DNA, 15 bp, Homo sapiens
agaggacttggtaaa

SEQ ID NO: 313798 - DNA, 15 bp, Homo sapiens
gaggacttggtaaag

SEQ ID NO: 313799 - DNA, 15 bp, Homo sapiens
aggacttggtaaagt

SEQ ID NO: 313800 - DNA, 15 bp, Homo sapiens
ggacttggtaaagtt

SEQ ID NO: 313801 - DNA, 15 bp, Homo sapiens
gacttggtaaagttt

SEQ ID NO: 313802 - DNA, 15 bp, Homo sapiens
acttggtaaagtttt

SEQ ID NO: 313803 - DNA, 15 bp, Homo sapiens
cttggtaaagttttt

SEQ ID NO: 313804 - DNA, 15 bp, Homo sapiens
ttggtaaagtttttg

SEQ ID NO: 313805 - DNA, 15 bp, Homo sapiens
tggtaaagtttttgg

SEQ ID NO: 313806 - DNA, 15 bp, Homo sapiens
ggtaaagtttttgga

SEQ ID NO: 313807 - DNA, 15 bp, Homo sapiens
gtaaagtttttggat

SEQ ID NO: 313808 - DNA, 15 bp, Homo sapiens
taaagtttttggatt

SEQ ID NO: 313809 - DNA, 15 bp, Homo sapiens
aaagtttttggatta

SEQ ID NO: 313810 - DNA, 15 bp, Homo sapiens
aagtttttggattat

SEQ ID NO: 313811 - DNA, 15 bp, Homo sapiens
agtttttggattatc

SEQ ID NO: 313812 - DNA, 15 bp, Homo sapiens
gtttttggattatct

SEQ ID NO: 313813 - DNA, 15 bp, Homo sapiens
tttttggattatctt

SEQ ID NO: 313814 - DNA, 15 bp, Homo sapiens
ttttggattatcttg

SEQ ID NO: 313815 - DNA, 15 bp, Homo sapiens
tttggattatcttga

SEQ ID NO: 313816 - DNA, 15 bp, Homo sapiens
ttggattatcttgaa

SEQ ID NO: 313817 - DNA, 15 bp, Homo sapiens
tggattatcttgaaa

SEQ ID NO: 313818 - DNA, 15 bp, Homo sapiens
ggattatcttgaaac

SEQ ID NO: 313819 - DNA, 15 bp, Homo sapiens
gattatcttgaaact

SEQ ID NO: 313820 - DNA, 15 bp, Homo sapiens
attatcttgaaactc

SEQ ID NO: 313821 - DNA, 15 bp, Homo sapiens
ttatcttgaaactct

SEQ ID NO: 313822 - DNA, 15 bp, Homo sapiens
tatcttgaaactctg

SEQ ID NO: 313823 - DNA, 15 bp, Homo sapiens
atcttgaaactctgg

SEQ ID NO: 313824 - DNA, 15 bp, Homo sapiens
tcttgaaactctggc

SEQ ID NO: 313825 - DNA, 15 bp, Homo sapiens
cttgaaactctggca

SEQ ID NO: 313826 - DNA, 15 bp, Homo sapiens
ttgaaactctggcaa

SEQ ID NO: 313827 - DNA, 15 bp, Homo sapiens
tgaaactctggcaag

SEQ ID NO: 313828 - DNA, 15 bp, Homo sapiens
gaaactctggcaaga

SEQ ID NO: 313829 - DNA, 15 bp, Homo sapiens
aaactctggcaagat

SEQ ID NO: 313830 - DNA, 15 bp, Homo sapiens
aactctggcaagatg

SEQ ID NO: 313831 - DNA, 15 bp, Homo sapiens
actctggcaagatgg

SEQ ID NO: 313832 - DNA, 15 bp, Homo sapiens
ctctggcaagatggc

SEQ ID NO: 313833 - DNA, 15 bp, Homo sapiens
tctggcaagatggcc

SEQ ID NO: 313834 - DNA, 15 bp, Homo sapiens
ctggcaagatggcca

SEQ ID NO: 313835 - DNA, 15 bp, Homo sapiens
tggcaagatggccaa

SEQ ID NO: 313836 - DNA, 15 bp, Homo sapiens
ggcaagatggccaag

SEQ ID NO: 313837 - DNA, 15 bp, Homo sapiens
gcaagatggccaagt

SEQ ID NO: 313838 - DNA, 15 bp, Homo sapiens
caagatggccaagta

SEQ ID NO: 313839 - DNA, 15 bp, Homo sapiens
aagatggccaagtat

SEQ ID NO: 313840 - DNA, 15 bp, Homo sapiens
agatggccaagtatg

SEQ ID NO: 313841 - DNA, 15 bp, Homo sapiens
gatggccaagtatgg

SEQ ID NO: 313842 - DNA, 15 bp, Homo sapiens
atggccaagtatgga

SEQ ID NO: 313843 - DNA, 15 bp, Homo sapiens
tggccaagtatggag

SEQ ID NO: 313844 - DNA, 15 bp, Homo sapiens
ggccaagtatggaga

SEQ ID NO: 313845 - DNA, 15 bp, Homo sapiens
gccaagtatggagaa

SEQ ID NO: 313846 - DNA, 15 bp, Homo sapiens
ccaagtatggagaac

SEQ ID NO: 313847 - DNA, 15 bp, Homo sapiens
caagtatggagaaca

SEQ ID NO: 313848 - DNA, 15 bp, Homo sapiens
aagtatggagaacat

SEQ ID NO: 313849 - DNA, 15 bp, Homo sapiens
agtatggagaacatg

SEQ ID NO: 313850 - DNA, 15 bp, Homo sapiens
gtatggagaacatga

SEQ ID NO: 313851 - DNA, 15 bp, Homo sapiens
tatggagaacatgaa

SEQ ID NO: 313852 - DNA, 15 bp, Homo sapiens
atggagaacatgaag

SEQ ID NO: 313853 - DNA, 15 bp, Homo sapiens
tggagaacatgaagc

SEQ ID NO: 313854 - DNA, 15 bp, Homo sapiens
ggagaacatgaagcc

SEQ ID NO: 313855 - DNA, 15 bp, Homo sapiens
gagaacatgaagcca

SEQ ID NO: 313856 - DNA, 15 bp, Homo sapiens
agaacatgaagccag

SEQ ID NO: 313857 - DNA, 15 bp, Homo sapiens
gaacatgaagccagt

SEQ ID NO: 313858 - DNA, 15 bp, Homo sapiens
aacatgaagccagtc

SEQ ID NO: 313859 - DNA, 15 bp, Homo sapiens
acatgaagccagtcc

SEQ ID NO: 313860 - DNA, 15 bp, Homo sapiens
catgaagccagtcct

SEQ ID NO: 313861 - DNA, 15 bp, Homo sapiens
atgaagccagtcctg

SEQ ID NO: 313862 - DNA, 15 bp, Homo sapiens
tgaagccagtcctga

SEQ ID NO: 313863 - DNA, 15 bp, Homo sapiens
gaagccagtcctgac

SEQ ID NO: 313864 - DNA, 15 bp, Homo sapiens
aagccagtcctgaca

SEQ ID NO: 313865 - DNA, 15 bp, Homo sapiens
agccagtcctgacaa

SEQ ID NO: 313866 - DNA, 15 bp, Homo sapiens
gccagtcctgacaat

SEQ ID NO: 313867 - DNA, 15 bp, Homo sapiens
ccagtcctgacaatg

SEQ ID NO: 313868 - DNA, 15 bp, Homo sapiens
cagtcctgacaatgg

SEQ ID NO: 313869 - DNA, 15 bp, Homo sapiens
agtcctgacaatggg

SEQ ID NO: 313870 - DNA, 15 bp, Homo sapiens
gtcctgacaatgggc

SEQ ID NO: 313871 - DNA, 15 bp, Homo sapiens
tcctgacaatgggca

SEQ ID NO: 313872 - DNA, 15 bp, Homo sapiens
cctgacaatgggcag

SEQ ID NO: 313873 - DNA, 15 bp, Homo sapiens
ctgacaatgggcaga

SEQ ID NO: 313874 - DNA, 15 bp, Homo sapiens
tgacaatgggcagaa

SEQ ID NO: 313875 - DNA, 15 bp, Homo sapiens
gacaatgggcagaac

SEQ ID NO: 313876 - DNA, 15 bp, Homo sapiens
acaatgggcagaacg

SEQ ID NO: 313877 - DNA, 15 bp, Homo sapiens
caatgggcagaacga

SEQ ID NO: 313878 - DNA, 15 bp, Homo sapiens
aatgggcagaacgaa

SEQ ID NO: 313879 - DNA, 15 bp, Homo sapiens
atgggcagaacgaat

SEQ ID NO: 313880 - DNA, 15 bp, Homo sapiens
tgggcagaacgaatt

SEQ ID NO: 313881 - DNA, 15 bp, Homo sapiens
gggcagaacgaattc

SEQ ID NO: 313882 - DNA, 15 bp, Homo sapiens
ggcagaacgaattca

SEQ ID NO: 313883 - DNA, 15 bp, Homo sapiens
gcagaacgaattcag

SEQ ID NO: 313884 - DNA, 15 bp, Homo sapiens
cagaacgaattcagt

SEQ ID NO: 313885 - DNA, 15 bp, Homo sapiens
agaacgaattcagtg

SEQ ID NO: 313886 - DNA, 15 bp, Homo sapiens
gaacgaattcagtga

SEQ ID NO: 313887 - DNA, 15 bp, Homo sapiens
aacgaattcagtgat

SEQ ID NO: 313888 - DNA, 15 bp, Homo sapiens
acgaattcagtgata

SEQ ID NO: 313889 - DNA, 15 bp, Homo sapiens
cgaattcagtgatat

SEQ ID NO: 313890 - DNA, 15 bp, Homo sapiens
gaattcagtgatatc

SEQ ID NO: 313891 - DNA, 15 bp, Homo sapiens
aattcagtgatatca

SEQ ID NO: 313892 - DNA, 15 bp, Homo sapiens
attcagtgatatcat

SEQ ID NO: 313893 - DNA, 15 bp, Homo sapiens
ttcagtgatatcatt

SEQ ID NO: 313894 - DNA, 15 bp, Homo sapiens
tcagtgatatcatta

SEQ ID NO: 313895 - DNA, 15 bp, Homo sapiens
cagtgatatcattaa

SEQ ID NO: 313896 - DNA, 15 bp, Homo sapiens
agtgatatcattaag

SEQ ID NO: 313897 - DNA, 15 bp, Homo sapiens
gtgatatcattaagt

SEQ ID NO: 313898 - DNA, 15 bp, Homo sapiens
tgatatcattaagtc

SEQ ID NO: 313899 - DNA, 15 bp, Homo sapiens
gatatcattaagtcc

SEQ ID NO: 313900 - DNA, 15 bp, Homo sapiens
atatcattaagtcca

SEQ ID NO: 313901 - DNA, 15 bp, Homo sapiens
tatcattaagtccag

SEQ ID NO: 313902 - DNA, 15 bp, Homo sapiens
atcattaagtccaga

SEQ ID NO: 313903 - DNA, 15 bp, Homo sapiens
tcattaagtccagat

SEQ ID NO: 313904 - DNA, 15 bp, Homo sapiens
cattaagtccagatc

SEQ ID NO: 313905 - DNA, 15 bp, Homo sapiens
attaagtccagatct

SEQ ID NO: 313906 - DNA, 15 bp, Homo sapiens
ttaagtccagatctg

SEQ ID NO: 313907 - DNA, 15 bp, Homo sapiens
taagtccagatctgg

SEQ ID NO: 313908 - DNA, 15 bp, Homo sapiens
aagtccagatctggt

SEQ ID NO: 313909 - DNA, 15 bp, Homo sapiens
agtccagatctggta

SEQ ID NO: 313910 - DNA, 15 bp, Homo sapiens
gtccagatctggtag

SEQ ID NO: 313911 - DNA, 15 bp, Homo sapiens
tccagatctggtagg

SEQ ID NO: 313912 - DNA, 15 bp, Homo sapiens
ccagatctggtaggt

SEQ ID NO: 313913 - DNA, 15 bp, Homo sapiens
cagatctggtaggta

SEQ ID NO: 313914 - DNA, 15 bp, Homo sapiens
agatctggtaggtaa

SEQ ID NO: 313915 - DNA, 15 bp, Homo sapiens
gatctggtaggtaaa

SEQ ID NO: 313916 - DNA, 15 bp, Homo sapiens
atctggtaggtaaag

SEQ ID NO: 313917 - DNA, 15 bp, Homo sapiens
tctggtaggtaaagg

SEQ ID NO: 313918 - DNA, 15 bp, Homo sapiens
ctggtaggtaaagga

SEQ ID NO: 313919 - DNA, 15 bp, Homo sapiens
tggtaggtaaaggaa

SEQ ID NO: 313920 - DNA, 15 bp, Homo sapiens
ggtaggtaaaggaag

SEQ ID NO: 313921 - DNA, 15 bp, Homo sapiens
gtaggtaaaggaagc

SEQ ID NO: 313922 - DNA, 15 bp, Homo sapiens
taggtaaaggaagct

SEQ ID NO: 313923 - DNA, 15 bp, Homo sapiens
aggtaaaggaagctc

SEQ ID NO: 313924 - DNA, 15 bp, Homo sapiens
ggtaaaggaagctca

SEQ ID NO: 313925 - DNA, 15 bp, Homo sapiens
gtaaaggaagctcaa

SEQ ID NO: 313926 - DNA, 15 bp, Homo sapiens
taaaggaagctcaag

SEQ ID NO: 313927 - DNA, 15 bp, Homo sapiens
aaaggaagctcaaga

SEQ ID NO: 313928 - DNA, 15 bp, Homo sapiens
aaggaagctcaagaa

SEQ ID NO: 313929 - DNA, 15 bp, Homo sapiens
aggaagctcaagaaa

SEQ ID NO: 313930 - DNA, 15 bp, Homo sapiens
ggaagctcaagaaag

SEQ ID NO: 313931 - DNA, 15 bp, Homo sapiens
gaagctcaagaaagc

SEQ ID NO: 313932 - DNA, 15 bp, Homo sapiens
aagctcaagaaagct

SEQ ID NO: 313933 - DNA, 15 bp, Homo sapiens
agctcaagaaagcta

SEQ ID NO: 313934 - DNA, 15 bp, Homo sapiens
gctcaagaaagctat

SEQ ID NO: 313935 - DNA, 15 bp, Homo sapiens
ctcaagaaagctatg

SEQ ID NO: 313936 - DNA, 15 bp, Homo sapiens
tcaagaaagctatgg

SEQ ID NO: 313937 - DNA, 15 bp, Homo sapiens
caagaaagctatgga

SEQ ID NO: 313938 - DNA, 15 bp, Homo sapiens
aagaaagctatggat

SEQ ID NO: 313939 - DNA, 15 bp, Homo sapiens
agaaagctatggatt

SEQ ID NO: 313940 - DNA, 15 bp, Homo sapiens
gaaagctatggattt

SEQ ID NO: 313941 - DNA, 15 bp, Homo sapiens
aaagctatggatttt

SEQ ID NO: 313942 - DNA, 15 bp, Homo sapiens
aagctatggattttt

SEQ ID NO: 313943 - DNA, 15 bp, Homo sapiens
agctatggattttta

SEQ ID NO: 313944 - DNA, 15 bp, Homo sapiens
gctatggatttttat

SEQ ID NO: 313945 - DNA, 15 bp, Homo sapiens
ctatggatttttatg

SEQ ID NO: 313946 - DNA, 15 bp, Homo sapiens
tatggatttttatgt

SEQ ID NO: 313947 - DNA, 15 bp, Homo sapiens
atggatttttatgta

SEQ ID NO: 313948 - DNA, 15 bp, Homo sapiens
tggatttttatgtat

SEQ ID NO: 313949 - DNA, 15 bp, Homo sapiens
ggatttttatgtatt

SEQ ID NO: 313950 - DNA, 15 bp, Homo sapiens
gatttttatgtattt

SEQ ID NO: 313951 - DNA, 15 bp, Homo sapiens
atttttatgtattta

SEQ ID NO: 313952 - DNA, 15 bp, Homo sapiens
tttttatgtatttag

SEQ ID NO: 313953 - DNA, 15 bp, Homo sapiens
ttttatgtatttaga

SEQ ID NO: 313954 - DNA, 15 bp, Homo sapiens
tttatgtatttagaa

SEQ ID NO: 313955 - DNA, 15 bp, Homo sapiens
ttatgtatttagaaa

SEQ ID NO: 313956 - DNA, 15 bp, Homo sapiens
tatgtatttagaaaa

SEQ ID NO: 313957 - DNA, 15 bp, Homo sapiens
atgtatttagaaaac

SEQ ID NO: 313958 - DNA, 15 bp, Homo sapiens
tgtatttagaaaacc

SEQ ID NO: 313959 - DNA, 15 bp, Homo sapiens
gtatttagaaaacct

SEQ ID NO: 313960 - DNA, 15 bp, Homo sapiens
tatttagaaaaccta

SEQ ID NO: 313961 - DNA, 15 bp, Homo sapiens
atttagaaaacctat

SEQ ID NO: 313962 - DNA, 15 bp, Homo sapiens
tttagaaaacctatg

SEQ ID NO: 313963 - DNA, 15 bp, Homo sapiens
ttagaaaacctatgt

SEQ ID NO: 313964 - DNA, 15 bp, Homo sapiens
tagaaaacctatgtt

SEQ ID NO: 313965 - DNA, 15 bp, Homo sapiens
agaaaacctatgttt

SEQ ID NO: 313966 - DNA, 15 bp, Homo sapiens
gaaaacctatgtttc

SEQ ID NO: 313967 - DNA, 15 bp, Homo sapiens
aaaacctatgtttct

SEQ ID NO: 313968 - DNA, 15 bp, Homo sapiens
aaacctatgtttctt

SEQ ID NO: 313969 - DNA, 15 bp, Homo sapiens
aacctatgtttcttg

SEQ ID NO: 313970 - DNA, 15 bp, Homo sapiens
acctatgtttcttgg

SEQ ID NO: 313971 - DNA, 15 bp, Homo sapiens
cctatgtttcttgga

SEQ ID NO: 313972 - DNA, 15 bp, Homo sapiens
ctatgtttcttggat

SEQ ID NO: 313973 - DNA, 15 bp, Homo sapiens
tatgtttcttggatt

SEQ ID NO: 313974 - DNA, 15 bp, Homo sapiens
atgtttcttggattg

SEQ ID NO: 313975 - DNA, 15 bp, Homo sapiens
tgtttcttggattga

SEQ ID NO: 313976 - DNA, 15 bp, Homo sapiens
gtttcttggattgat

SEQ ID NO: 313977 - DNA, 15 bp, Homo sapiens
tttcttggattgatt

SEQ ID NO: 313978 - DNA, 15 bp, Homo sapiens
ttcttggattgattt

SEQ ID NO: 313979 - DNA, 15 bp, Homo sapiens
tcttggattgatttg

SEQ ID NO: 313980 - DNA, 15 bp, Homo sapiens
cttggattgatttgc

SEQ ID NO: 313981 - DNA, 15 bp, Homo sapiens
ttggattgatttgca

SEQ ID NO: 313982 - DNA, 15 bp, Homo sapiens
tggattgatttgcat

SEQ ID NO: 313983 - DNA, 15 bp, Homo sapiens
ggattgatttgcatt

SEQ ID NO: 313984 - DNA, 15 bp, Homo sapiens
gattgatttgcattg

SEQ ID NO: 313985 - DNA, 15 bp, Homo sapiens
attgatttgcattgt

SEQ ID NO: 313986 - DNA, 15 bp, Homo sapiens
ttgatttgcattgtt

SEQ ID NO: 313987 - DNA, 15 bp, Homo sapiens
tgatttgcattgttc

SEQ ID NO: 313988 - DNA, 15 bp, Homo sapiens
gatttgcattgttct

SEQ ID NO: 313989 - DNA, 15 bp, Homo sapiens
atttgcattgttctt

SEQ ID NO: 313990 - DNA, 15 bp, Homo sapiens
tttgcattgttcttg

SEQ ID NO: 313991 - DNA, 15 bp, Homo sapiens
ttgcattgttcttgc

SEQ ID NO: 313992 - DNA, 15 bp, Homo sapiens
tgcattgttcttgca

SEQ ID NO: 313993 - DNA, 15 bp, Homo sapiens
gcattgttcttgcaa

SEQ ID NO: 313994 - DNA, 15 bp, Homo sapiens
cattgttcttgcaag

SEQ ID NO: 313995 - DNA, 15 bp, Homo sapiens
attgttcttgcaaga

SEQ ID NO: 313996 - DNA, 15 bp, Homo sapiens
ttgttcttgcaagaa

SEQ ID NO: 313997 - DNA, 15 bp, Homo sapiens
tgttcttgcaagaac

SEQ ID NO: 313998 - DNA, 15 bp, Homo sapiens
gttcttgcaagaact

SEQ ID NO: 313999 - DNA, 15 bp, Homo sapiens
ttcttgcaagaactt

SEQ ID NO: 314000 - DNA, 15 bp, Homo sapiens
tcttgcaagaacttc

SEQ ID NO: 314001 - DNA, 15 bp, Homo sapiens
cttgcaagaacttct

SEQ ID NO: 314002 - DNA, 15 bp, Homo sapiens
ttgcaagaacttctt

SEQ ID NO: 314003 - DNA, 15 bp, Homo sapiens
tgcaagaacttcttg

SEQ ID NO: 314004 - DNA, 15 bp, Homo sapiens
gcaagaacttcttgg

SEQ ID NO: 314005 - DNA, 15 bp, Homo sapiens
caagaacttcttgga

SEQ ID NO: 314006 - DNA, 15 bp, Homo sapiens
aagaacttcttggag

SEQ ID NO: 314007 - DNA, 15 bp, Homo sapiens
agaacttcttggagg

SEQ ID NO: 314008 - DNA, 15 bp, Homo sapiens
gaacttcttggaggt

SEQ ID NO: 314009 - DNA, 15 bp, Homo sapiens
aacttcttggaggtg

SEQ ID NO: 314010 - DNA, 15 bp, Homo sapiens
acttcttggaggtga

SEQ ID NO: 314011 - DNA, 15 bp, Homo sapiens
cttcttggaggtgaa

SEQ ID NO: 314012 - DNA, 15 bp, Homo sapiens
ttcttggaggtgaag

SEQ ID NO: 314013 - DNA, 15 bp, Homo sapiens
tcttggaggtgaagt

SEQ ID NO: 314014 - DNA, 15 bp, Homo sapiens
cttggaggtgaagtt

SEQ ID NO: 314015 - DNA, 15 bp, Homo sapiens
ttggaggtgaagttc

SEQ ID NO: 314016 - DNA, 15 bp, Homo sapiens
tggaggtgaagttct

SEQ ID NO: 314017 - DNA, 15 bp, Homo sapiens
ggaggtgaagttctt

SEQ ID NO: 314018 - DNA, 15 bp, Homo sapiens
gaggtgaagttcttt

SEQ ID NO: 314019 - DNA, 15 bp, Homo sapiens
aggtgaagttctttt

SEQ ID NO: 314020 - DNA, 15 bp, Homo sapiens
ggtgaagttctttta

SEQ ID NO: 314021 - DNA, 15 bp, Homo sapiens
gtgaagttcttttaa

SEQ ID NO: 314022 - DNA, 15 bp, Homo sapiens
tgaagttcttttaag

SEQ ID NO: 314023 - DNA, 15 bp, Homo sapiens
gaagttcttttaaga

SEQ ID NO: 314024 - DNA, 15 bp, Homo sapiens
aagttcttttaagaa

SEQ ID NO: 314025 - DNA, 15 bp, Homo sapiens
agttcttttaagaaa

SEQ ID NO: 314026 - DNA, 15 bp, Homo sapiens
gttcttttaagaaac

SEQ ID NO: 314027 - DNA, 15 bp, Homo sapiens
ttcttttaagaaact

SEQ ID NO: 314028 - DNA, 15 bp, Homo sapiens
tcttttaagaaactg

SEQ ID NO: 314029 - DNA, 15 bp, Homo sapiens
cttttaagaaactga

SEQ ID NO: 314030 - DNA, 15 bp, Homo sapiens
ttttaagaaactgaa

SEQ ID NO: 314031 - DNA, 15 bp, Homo sapiens
tttaagaaactgaat

SEQ ID NO: 314032 - DNA, 15 bp, Homo sapiens
ttaagaaactgaatt

SEQ ID NO: 314033 - DNA, 15 bp, Homo sapiens
taagaaactgaattc

SEQ ID NO: 314034 - DNA, 15 bp, Homo sapiens
aagaaactgaattct

SEQ ID NO: 314035 - DNA, 15 bp, Homo sapiens
agaaactgaattctg

SEQ ID NO: 314036 - DNA, 15 bp, Homo sapiens
gaaactgaattctga

SEQ ID NO: 314037 - DNA, 15 bp, Homo sapiens
aaactgaattctgac

SEQ ID NO: 314038 - DNA, 15 bp, Homo sapiens
aactgaattctgaca

SEQ ID NO: 314039 - DNA, 15 bp, Homo sapiens
actgaattctgacaa

SEQ ID NO: 314040 - DNA, 15 bp, Homo sapiens
ctgaattctgacaaa

SEQ ID NO: 314041 - DNA, 15 bp, Homo sapiens
tgaattctgacaaat

SEQ ID NO: 314042 - DNA, 15 bp, Homo sapiens
gaattctgacaaatg

SEQ ID NO: 314043 - DNA, 15 bp, Homo sapiens
aattctgacaaatga

SEQ ID NO: 314044 - DNA, 15 bp, Homo sapiens
attctgacaaatgac

SEQ ID NO: 314045 - DNA, 15 bp, Homo sapiens
ttctgacaaatgact

SEQ ID NO: 314046 - DNA, 15 bp, Homo sapiens
tctgacaaatgacta

SEQ ID NO: 314047 - DNA, 15 bp, Homo sapiens
ctgacaaatgactat

SEQ ID NO: 314048 - DNA, 15 bp, Homo sapiens
tgacaaatgactata

SEQ ID NO: 314049 - DNA, 15 bp, Homo sapiens
gacaaatgactataa

SEQ ID NO: 314050 - DNA, 15 bp, Homo sapiens
acaaatgactataat

SEQ ID NO: 314051 - DNA, 15 bp, Homo sapiens
caaatgactataatt

SEQ ID NO: 314052 - DNA, 15 bp, Homo sapiens
aaatgactataattt

SEQ ID NO: 314053 - DNA, 15 bp, Homo sapiens
aatgactataatttt

SEQ ID NO: 314054 - DNA, 15 bp, Homo sapiens
atgactataattttg

SEQ ID NO: 314055 - DNA, 15 bp, Homo sapiens
tgactataattttgt

SEQ ID NO: 314056 - DNA, 15 bp, Homo sapiens
gactataattttgta

SEQ ID NO: 314057 - DNA, 15 bp, Homo sapiens
actataattttgtaa

SEQ ID NO: 314058 - DNA, 15 bp, Homo sapiens
ctataattttgtaaa

SEQ ID NO: 314059 - DNA, 15 bp, Homo sapiens
tataattttgtaaaa

SEQ ID NO: 314060 - DNA, 15 bp, Homo sapiens
ataattttgtaaaag

SEQ ID NO: 314061 - DNA, 15 bp, Homo sapiens
taattttgtaaaagg

SEQ ID NO: 314062 - DNA, 15 bp, Homo sapiens
aattttgtaaaaggt

SEQ ID NO: 314063 - DNA, 15 bp, Homo sapiens
attttgtaaaaggta

SEQ ID NO: 314064 - DNA, 15 bp, Homo sapiens
ttttgtaaaaggtat

SEQ ID NO: 314065 - DNA, 15 bp, Homo sapiens
tttgtaaaaggtata

SEQ ID NO: 314066 - DNA, 15 bp, Homo sapiens
ttgtaaaaggtatat

SEQ ID NO: 314067 - DNA, 15 bp, Homo sapiens
tgtaaaaggtatatg

SEQ ID NO: 314068 - DNA, 15 bp, Homo sapiens
gtaaaaggtatatgt

SEQ ID NO: 314069 - DNA, 15 bp, Homo sapiens
taaaaggtatatgta

SEQ ID NO: 314070 - DNA, 15 bp, Homo sapiens
aaaaggtatatgtaa

SEQ ID NO: 314071 - DNA, 15 bp, Homo sapiens
aaaggtatatgtaaa

SEQ ID NO: 314072 - DNA, 15 bp, Homo sapiens
aaggtatatgtaaaa

SEQ ID NO: 314073 - DNA, 15 bp, Homo sapiens
aggtatatgtaaaag

SEQ ID NO: 314074 - DNA, 15 bp, Homo sapiens
ggtatatgtaaaagg

SEQ ID NO: 314075 - DNA, 15 bp, Homo sapiens
gtatatgtaaaaggt

SEQ ID NO: 314076 - DNA, 15 bp, Homo sapiens
tatatgtaaaaggta

SEQ ID NO: 314077 - DNA, 15 bp, Homo sapiens
atatgtaaaaggtat

SEQ ID NO: 314078 - DNA, 15 bp, Homo sapiens
tatgtaaaaggtata

SEQ ID NO: 314079 - DNA, 15 bp, Homo sapiens
atgtaaaaggtataa

SEQ ID NO: 314080 - DNA, 15 bp, Homo sapiens
tgtaaaaggtataat

SEQ ID NO: 314081 - DNA, 15 bp, Homo sapiens
gtaaaaggtataata

SEQ ID NO: 314082 - DNA, 15 bp, Homo sapiens
taaaaggtataatat

SEQ ID NO: 314083 - DNA, 15 bp, Homo sapiens
aaaaggtataatatc

SEQ ID NO: 314084 - DNA, 15 bp, Homo sapiens
aaaggtataatatct

SEQ ID NO: 314085 - DNA, 15 bp, Homo sapiens
aaggtataatatctc

SEQ ID NO: 314086 - DNA, 15 bp, Homo sapiens
aggtataatatctct

SEQ ID NO: 314087 - DNA, 15 bp, Homo sapiens
ggtataatatctctg

SEQ ID NO: 314088 - DNA, 15 bp, Homo sapiens
gtataatatctctga

SEQ ID NO: 314089 - DNA, 15 bp, Homo sapiens
tataatatctctgag

SEQ ID NO: 314090 - DNA, 15 bp, Homo sapiens
ataatatctctgagt

SEQ ID NO: 314091 - DNA, 15 bp, Homo sapiens
taatatctctgagtg

SEQ ID NO: 314092 - DNA, 15 bp, Homo sapiens
aatatctctgagtgt

SEQ ID NO: 314093 - DNA, 15 bp, Homo sapiens
atatctctgagtgtc

SEQ ID NO: 314094 - DNA, 15 bp, Homo sapiens
tatctctgagtgtcc

SEQ ID NO: 314095 - DNA, 15 bp, Homo sapiens
atctctgagtgtcct

SEQ ID NO: 314096 - DNA, 15 bp, Homo sapiens
tctctgagtgtccta

SEQ ID NO: 314097 - DNA, 15 bp, Homo sapiens
ctctgagtgtcctat

SEQ ID NO: 314098 - DNA, 15 bp, Homo sapiens
tctgagtgtcctatc

SEQ ID NO: 314099 - DNA, 15 bp, Homo sapiens
ctgagtgtcctatcc

SEQ ID NO: 314100 - DNA, 15 bp, Homo sapiens
tgagtgtcctatcct

SEQ ID NO: 314101 - DNA, 15 bp, Homo sapiens
gagtgtcctatcctt

SEQ ID NO: 314102 - DNA, 15 bp, Homo sapiens
agtgtcctatccttt

SEQ ID NO: 314103 - DNA, 15 bp, Homo sapiens
gtgtcctatcctttc

SEQ ID NO: 314104 - DNA, 15 bp, Homo sapiens
tgtcctatcctttct

SEQ ID NO: 314105 - DNA, 15 bp, Homo sapiens
gtcctatcctttctc

SEQ ID NO: 314106 - DNA, 15 bp, Homo sapiens
tcctatcctttctca

SEQ ID NO: 314107 - DNA, 15 bp, Homo sapiens
cctatcctttctcaa

SEQ ID NO: 314108 - DNA, 15 bp, Homo sapiens
ctatcctttctcaac

SEQ ID NO: 314109 - DNA, 15 bp, Homo sapiens
tatcctttctcaacc

SEQ ID NO: 314110 - DNA, 15 bp, Homo sapiens
atcctttctcaaccc

SEQ ID NO: 314111 - DNA, 15 bp, Homo sapiens
tcctttctcaaccca

SEQ ID NO: 314112 - DNA, 15 bp, Homo sapiens
cctttctcaacccaa

SEQ ID NO: 314113 - DNA, 15 bp, Homo sapiens
ctttctcaacccaat

SEQ ID NO: 314114 - DNA, 15 bp, Homo sapiens
tttctcaacccaatt

SEQ ID NO: 314115 - DNA, 15 bp, Homo sapiens
ttctcaacccaattt

SEQ ID NO: 314116 - DNA, 15 bp, Homo sapiens
tctcaacccaatttt

SEQ ID NO: 314117 - DNA, 15 bp, Homo sapiens
ctcaacccaattttg

SEQ ID NO: 314118 - DNA, 15 bp, Homo sapiens
tcaacccaattttgt

SEQ ID NO: 314119 - DNA, 15 bp, Homo sapiens
caacccaattttgtg

SEQ ID NO: 314120 - DNA, 15 bp, Homo sapiens
aacccaattttgtgc

SEQ ID NO: 314121 - DNA, 15 bp, Homo sapiens
acccaattttgtgct

SEQ ID NO: 314122 - DNA, 15 bp, Homo sapiens
cccaattttgtgctt

SEQ ID NO: 314123 - DNA, 15 bp, Homo sapiens
ccaattttgtgctta

SEQ ID NO: 314124 - DNA, 15 bp, Homo sapiens
caattttgtgcttag

SEQ ID NO: 314125 - DNA, 15 bp, Homo sapiens
aattttgtgcttagt

SEQ ID NO: 314126 - DNA, 15 bp, Homo sapiens
attttgtgcttagtg

SEQ ID NO: 314127 - DNA, 15 bp, Homo sapiens
ttttgtgcttagtga

SEQ ID NO: 314128 - DNA, 15 bp, Homo sapiens
tttgtgcttagtgaa

SEQ ID NO: 314129 - DNA, 15 bp, Homo sapiens
ttgtgcttagtgaaa

SEQ ID NO: 314130 - DNA, 15 bp, Homo sapiens
tgtgcttagtgaaac

SEQ ID NO: 314131 - DNA, 15 bp, Homo sapiens
gtgcttagtgaaact

SEQ ID NO: 314132 - DNA, 15 bp, Homo sapiens
tgcttagtgaaactg

SEQ ID NO: 314133 - DNA, 15 bp, Homo sapiens
gcttagtgaaactgc

SEQ ID NO: 314134 - DNA, 15 bp, Homo sapiens
cttagtgaaactgct

SEQ ID NO: 314135 - DNA, 15 bp, Homo sapiens
ttagtgaaactgctg

SEQ ID NO: 314136 - DNA, 15 bp, Homo sapiens
tagtgaaactgctgc

SEQ ID NO: 314137 - DNA, 15 bp, Homo sapiens
agtgaaactgctgct

SEQ ID NO: 314138 - DNA, 15 bp, Homo sapiens
gtgaaactgctgctt

SEQ ID NO: 314139 - DNA, 15 bp, Homo sapiens
tgaaactgctgcttg

SEQ ID NO: 314140 - DNA, 15 bp, Homo sapiens
gaaactgctgcttgt

SEQ ID NO: 314141 - DNA, 15 bp, Homo sapiens
aaactgctgcttgta

SEQ ID NO: 314142 - DNA, 15 bp, Homo sapiens
aactgctgcttgtag

SEQ ID NO: 314143 - DNA, 15 bp, Homo sapiens
actgctgcttgtagc

SEQ ID NO: 314144 - DNA, 15 bp, Homo sapiens
ctgctgcttgtagct

SEQ ID NO: 314145 - DNA, 15 bp, Homo sapiens
tgctgcttgtagcta

SEQ ID NO: 314146 - DNA, 15 bp, Homo sapiens
gctgcttgtagctaa

SEQ ID NO: 314147 - DNA, 15 bp, Homo sapiens
ctgcttgtagctaaa

SEQ ID NO: 314148 - DNA, 15 bp, Homo sapiens
tgcttgtagctaaag

SEQ ID NO: 314149 - DNA, 15 bp, Homo sapiens
gcttgtagctaaagg

SEQ ID NO: 314150 - DNA, 15 bp, Homo sapiens
cttgtagctaaaggt

SEQ ID NO: 314151 - DNA, 15 bp, Homo sapiens
ttgtagctaaaggtt

SEQ ID NO: 314152 - DNA, 15 bp, Homo sapiens
tgtagctaaaggttg

SEQ ID NO: 314153 - DNA, 15 bp, Homo sapiens
gtagctaaaggttgt

SEQ ID NO: 314154 - DNA, 15 bp, Homo sapiens
tagctaaaggttgtt

SEQ ID NO: 314155 - DNA, 15 bp, Homo sapiens
agctaaaggttgttc

SEQ ID NO: 314156 - DNA, 15 bp, Homo sapiens
gctaaaggttgttca

SEQ ID NO: 314157 - DNA, 15 bp, Homo sapiens
ctaaaggttgttcat

SEQ ID NO: 314158 - DNA, 15 bp, Homo sapiens
taaaggttgttcatt

SEQ ID NO: 314159 - DNA, 15 bp, Homo sapiens
aaaggttgttcattt

SEQ ID NO: 314160 - DNA, 15 bp, Homo sapiens
aaggttgttcatttg

SEQ ID NO: 314161 - DNA, 15 bp, Homo sapiens
aggttgttcatttgg

SEQ ID NO: 314162 - DNA, 15 bp, Homo sapiens
ggttgttcatttgga

SEQ ID NO: 314163 - DNA, 15 bp, Homo sapiens
gttgttcatttggaa

SEQ ID NO: 314164 - DNA, 15 bp, Homo sapiens
ttgttcatttggaag

SEQ ID NO: 314165 - DNA, 15 bp, Homo sapiens
tgttcatttggaaga

SEQ ID NO: 314166 - DNA, 15 bp, Homo sapiens
gttcatttggaagac

SEQ ID NO: 314167 - DNA, 15 bp, Homo sapiens
ttcatttggaagact

SEQ ID NO: 314168 - DNA, 15 bp, Homo sapiens
tcatttggaagacta

SEQ ID NO: 314169 - DNA, 15 bp, Homo sapiens
catttggaagactac

SEQ ID NO: 314170 - DNA, 15 bp, Homo sapiens
atttggaagactact

SEQ ID NO: 314171 - DNA, 15 bp, Homo sapiens
tttggaagactactc

SEQ ID NO: 314172 - DNA, 15 bp, Homo sapiens
ttggaagactactcc

SEQ ID NO: 314173 - DNA, 15 bp, Homo sapiens
tggaagactactcca

SEQ ID NO: 314174 - DNA, 15 bp, Homo sapiens
ggaagactactccat

SEQ ID NO: 314175 - DNA, 15 bp, Homo sapiens
gaagactactccatt

SEQ ID NO: 314176 - DNA, 15 bp, Homo sapiens
aagactactccatta

SEQ ID NO: 314177 - DNA, 15 bp, Homo sapiens
agactactccattaa

SEQ ID NO: 314178 - DNA, 15 bp, Homo sapiens
gactactccattaaa

SEQ ID NO: 314179 - DNA, 15 bp, Homo sapiens
actactccattaaaa

SEQ ID NO: 314180 - DNA, 15 bp, Homo sapiens
ctactccattaaaat

SEQ ID NO: 314181 - DNA, 15 bp, Homo sapiens
tactccattaaaata

SEQ ID NO: 314182 - DNA, 15 bp, Homo sapiens
actccattaaaataa

SEQ ID NO: 314183 - DNA, 15 bp, Homo sapiens
ctccattaaaataaa

SEQ ID NO: 314184 - DNA, 15 bp, Homo sapiens
tccattaaaataaaa

SEQ ID NO: 314185 - DNA, 15 bp, Homo sapiens
ccattaaaataaaat

SEQ ID NO: 314186 - DNA, 15 bp, Homo sapiens
cattaaaataaaata

SEQ ID NO: 314187 - DNA, 15 bp, Homo sapiens
attaaaataaaatac

SEQ ID NO: 314188 - DNA, 15 bp, Homo sapiens
ttaaaataaaatacg

SEQ ID NO: 314189 - DNA, 15 bp, Homo sapiens
taaaataaaatacga

SEQ ID NO: 314190 - DNA, 15 bp, Homo sapiens
aaaataaaatacgac

SEQ ID NO: 314191 - DNA, 15 bp, Homo sapiens
aaataaaatacgacc

SEQ ID NO: 314192 - DNA, 15 bp, Homo sapiens
aataaaatacgaccg

SEQ ID NO: 314193 - DNA, 15 bp, Homo sapiens
ataaaatacgaccga

SEQ ID NO: 314194 - DNA, 15 bp, Homo sapiens
taaaatacgaccgaa

SEQ ID NO: 314195 - DNA, 15 bp, Homo sapiens
aaaatacgaccgaac

SEQ ID NO: 314196 - DNA, 15 bp, Homo sapiens
aaatacgaccgaaca

SEQ ID NO: 314197 - DNA, 15 bp, Homo sapiens
aatacgaccgaacat

SEQ ID NO: 314198 - DNA, 15 bp, Homo sapiens
atacgaccgaacatt

SEQ ID NO: 314199 - DNA, 15 bp, Homo sapiens
tacgaccgaacattt

SEQ ID NO: 314200 - DNA, 15 bp, Homo sapiens
acgaccgaacatttc

SEQ ID NO: 314201 - DNA, 15 bp, Homo sapiens
cgaccgaacatttct

SEQ ID NO: 314202 - DNA, 15 bp, Homo sapiens
gaccgaacatttctc

SEQ ID NO: 314203 - DNA, 15 bp, Homo sapiens
accgaacatttctct

SEQ ID NO: 314204 - DNA, 15 bp, Homo sapiens
ccgaacatttctctt

SEQ ID NO: 314205 - DNA, 15 bp, Homo sapiens
cgaacatttctcttt

SEQ ID NO: 314206 - DNA, 15 bp, Homo sapiens
gaacatttctctttc

SEQ ID NO: 314207 - DNA, 15 bp, Homo sapiens
aacatttctctttct

SEQ ID NO: 314208 - DNA, 15 bp, Homo sapiens
acatttctctttcta

SEQ ID NO: 314209 - DNA, 15 bp, Homo sapiens
catttctctttctat

SEQ ID NO: 314210 - DNA, 15 bp, Homo sapiens
atttctctttctatt

SEQ ID NO: 314211 - DNA, 15 bp, Homo sapiens
tttctctttctattt

SEQ ID NO: 314212 - DNA, 15 bp, Homo sapiens
ttctctttctatttt

SEQ ID NO: 314213 - DNA, 15 bp, Homo sapiens
tctctttctattttc

SEQ ID NO: 314214 - DNA, 15 bp, Homo sapiens
ctctttctattttct

SEQ ID NO: 314215 - DNA, 15 bp, Homo sapiens
tctttctattttctg

SEQ ID NO: 314216 - DNA, 15 bp, Homo sapiens
ctttctattttctgg

SEQ ID NO: 314217 - DNA, 15 bp, Homo sapiens
tttctattttctgga

SEQ ID NO: 314218 - DNA, 15 bp, Homo sapiens
ttctattttctggaa

SEQ ID NO: 314219 - DNA, 15 bp, Homo sapiens
tctattttctggaaa

SEQ ID NO: 314220 - DNA, 15 bp, Homo sapiens
ctattttctggaaat

SEQ ID NO: 314221 - DNA, 15 bp, Homo sapiens
tattttctggaaatt

SEQ ID NO: 314222 - DNA, 15 bp, Homo sapiens
attttctggaaattg

SEQ ID NO: 314223 - DNA, 15 bp, Homo sapiens
ttttctggaaattga

SEQ ID NO: 314224 - DNA, 15 bp, Homo sapiens
tttctggaaattgaa

SEQ ID NO: 314225 - DNA, 15 bp, Homo sapiens
ttctggaaattgaag

SEQ ID NO: 314226 - DNA, 15 bp, Homo sapiens
tctggaaattgaagg

SEQ ID NO: 314227 - DNA, 15 bp, Homo sapiens
ctggaaattgaaggg

SEQ ID NO: 314228 - DNA, 15 bp, Homo sapiens
tggaaattgaaggga

SEQ ID NO: 314229 - DNA, 15 bp, Homo sapiens
ggaaattgaagggat

SEQ ID NO: 314230 - DNA, 15 bp, Homo sapiens
gaaattgaagggatt

SEQ ID NO: 314231 - DNA, 15 bp, Homo sapiens
aaattgaagggatta

SEQ ID NO: 314232 - DNA, 15 bp, Homo sapiens
aattgaagggattat

SEQ ID NO: 314233 - DNA, 15 bp, Homo sapiens
attgaagggattata

SEQ ID NO: 314234 - DNA, 15 bp, Homo sapiens
ttgaagggattatat

SEQ ID NO: 314235 - DNA, 15 bp, Homo sapiens
tgaagggattatatg

SEQ ID NO: 314236 - DNA, 15 bp, Homo sapiens
gaagggattatatgc

SEQ ID NO: 314237 - DNA, 15 bp, Homo sapiens
aagggattatatgct

SEQ ID NO: 314238 - DNA, 15 bp, Homo sapiens
agggattatatgctt

SEQ ID NO: 314239 - DNA, 15 bp, Homo sapiens
gggattatatgctta

SEQ ID NO: 314240 - DNA, 15 bp, Homo sapiens
ggattatatgcttaa

SEQ ID NO: 314241 - DNA, 15 bp, Homo sapiens
gattatatgcttaat

SEQ ID NO: 314242 - DNA, 15 bp, Homo sapiens
attatatgcttaatg

SEQ ID NO: 314243 - DNA, 15 bp, Homo sapiens
ttatatgcttaatgt

SEQ ID NO: 314244 - DNA, 15 bp, Homo sapiens
tatatgcttaatgta

SEQ ID NO: 314245 - DNA, 15 bp, Homo sapiens
atatgcttaatgtag

SEQ ID NO: 314246 - DNA, 15 bp, Homo sapiens
tatgcttaatgtagg

SEQ ID NO: 314247 - DNA, 15 bp, Homo sapiens
atgcttaatgtagga

SEQ ID NO: 314248 - DNA, 15 bp, Homo sapiens
tgcttaatgtaggaa

SEQ ID NO: 314249 - DNA, 15 bp, Homo sapiens
gcttaatgtaggaag

SEQ ID NO: 314250 - DNA, 15 bp, Homo sapiens
cttaatgtaggaagt

SEQ ID NO: 314251 - DNA, 15 bp, Homo sapiens
ttaatgtaggaagtg

SEQ ID NO: 314252 - DNA, 15 bp, Homo sapiens
taatgtaggaagtgc

SEQ ID NO: 314253 - DNA, 15 bp, Homo sapiens
aatgtaggaagtgcc

SEQ ID NO: 314254 - DNA, 15 bp, Homo sapiens
atgtaggaagtgcca

SEQ ID NO: 314255 - DNA, 15 bp, Homo sapiens
tgtaggaagtgccac

SEQ ID NO: 314256 - DNA, 15 bp, Homo sapiens
gtaggaagtgccaca

SEQ ID NO: 314257 - DNA, 15 bp, Homo sapiens
taggaagtgccacag

SEQ ID NO: 314258 - DNA, 15 bp, Homo sapiens
aggaagtgccacagt

SEQ ID NO: 314259 - DNA, 15 bp, Homo sapiens
ggaagtgccacagtt

SEQ ID NO: 314260 - DNA, 15 bp, Homo sapiens
gaagtgccacagttt

SEQ ID NO: 314261 - DNA, 15 bp, Homo sapiens
aagtgccacagtttc

SEQ ID NO: 314262 - DNA, 15 bp, Homo sapiens
agtgccacagtttct

SEQ ID NO: 314263 - DNA, 15 bp, Homo sapiens
gtgccacagtttctg

SEQ ID NO: 314264 - DNA, 15 bp, Homo sapiens
tgccacagtttctgg

SEQ ID NO: 314265 - DNA, 15 bp, Homo sapiens
gccacagtttctggc

SEQ ID NO: 314266 - DNA, 15 bp, Homo sapiens
ccacagtttctggca

SEQ ID NO: 314267 - DNA, 15 bp, Homo sapiens
cacagtttctggcag

SEQ ID NO: 314268 - DNA, 15 bp, Homo sapiens
acagtttctggcagg

SEQ ID NO: 314269 - DNA, 15 bp, Homo sapiens
cagtttctggcagga

SEQ ID NO: 314270 - DNA, 15 bp, Homo sapiens
agtttctggcaggaa

SEQ ID NO: 314271 - DNA, 15 bp, Homo sapiens
gtttctggcaggaaa

SEQ ID NO: 314272 - DNA, 15 bp, Homo sapiens
tttctggcaggaaag

SEQ ID NO: 314273 - DNA, 15 bp, Homo sapiens
ttctggcaggaaaga

SEQ ID NO: 314274 - DNA, 15 bp, Homo sapiens
tctggcaggaaagat

SEQ ID NO: 314275 - DNA, 15 bp, Homo sapiens
ctggcaggaaagatc

SEQ ID NO: 314276 - DNA, 15 bp, Homo sapiens
tggcaggaaagatct

SEQ ID NO: 314277 - DNA, 15 bp, Homo sapiens
ggcaggaaagatctt

SEQ ID NO: 314278 - DNA, 15 bp, Homo sapiens
gcaggaaagatcttt

SEQ ID NO: 314279 - DNA, 15 bp, Homo sapiens
caggaaagatctttc

SEQ ID NO: 314280 - DNA, 15 bp, Homo sapiens
aggaaagatctttca

SEQ ID NO: 314281 - DNA, 15 bp, Homo sapiens
ggaaagatctttcac

SEQ ID NO: 314282 - DNA, 15 bp, Homo sapiens
gaaagatctttcaca

SEQ ID NO: 314283 - DNA, 15 bp, Homo sapiens
aaagatctttcacag

SEQ ID NO: 314284 - DNA, 15 bp, Homo sapiens
aagatctttcacagt

SEQ ID NO: 314285 - DNA, 15 bp, Homo sapiens
agatctttcacagtt

SEQ ID NO: 314286 - DNA, 15 bp, Homo sapiens
gatctttcacagttt

SEQ ID NO: 314287 - DNA, 15 bp, Homo sapiens
atctttcacagtttg

SEQ ID NO: 314288 - DNA, 15 bp, Homo sapiens
tctttcacagtttga

SEQ ID NO: 314289 - DNA, 15 bp, Homo sapiens
ctttcacagtttgat

SEQ ID NO: 314290 - DNA, 15 bp, Homo sapiens
tttcacagtttgatt

SEQ ID NO: 314291 - DNA, 15 bp, Homo sapiens
ttcacagtttgattt

SEQ ID NO: 314292 - DNA, 15 bp, Homo sapiens
tcacagtttgatttc

SEQ ID NO: 314293 - DNA, 15 bp, Homo sapiens
cacagtttgatttca

SEQ ID NO: 314294 - DNA, 15 bp, Homo sapiens
acagtttgatttcat

SEQ ID NO: 314295 - DNA, 15 bp, Homo sapiens
cagtttgatttcatt

SEQ ID NO: 314296 - DNA, 15 bp, Homo sapiens
agtttgatttcatta

SEQ ID NO: 314297 - DNA, 15 bp, Homo sapiens
gtttgatttcattac

SEQ ID NO: 314298 - DNA, 15 bp, Homo sapiens
tttgatttcattacc

SEQ ID NO: 314299 - DNA, 15 bp, Homo sapiens
ttgatttcattacca

SEQ ID NO: 314300 - DNA, 15 bp, Homo sapiens
tgatttcattaccat

SEQ ID NO: 314301 - DNA, 15 bp, Homo sapiens
gatttcattaccata

SEQ ID NO: 314302 - DNA, 15 bp, Homo sapiens
atttcattaccatat

SEQ ID NO: 314303 - DNA, 15 bp, Homo sapiens
tttcattaccatata

SEQ ID NO: 314304 - DNA, 15 bp, Homo sapiens
ttcattaccatatat

SEQ ID NO: 314305 - DNA, 15 bp, Homo sapiens
tcattaccatatatc

SEQ ID NO: 314306 - DNA, 15 bp, Homo sapiens
cattaccatatatcc

SEQ ID NO: 314307 - DNA, 15 bp, Homo sapiens
attaccatatatcct

SEQ ID NO: 314308 - DNA, 15 bp, Homo sapiens
ttaccatatatcctc

SEQ ID NO: 314309 - DNA, 15 bp, Homo sapiens
taccatatatcctca

SEQ ID NO: 314310 - DNA, 15 bp, Homo sapiens
accatatatcctcac

SEQ ID NO: 314311 - DNA, 15 bp, Homo sapiens
ccatatatcctcacc

SEQ ID NO: 314312 - DNA, 15 bp, Homo sapiens
catatatcctcaccc

SEQ ID NO: 314313 - DNA, 15 bp, Homo sapiens
atatatcctcacccc

SEQ ID NO: 314314 - DNA, 15 bp, Homo sapiens
tatatcctcaccccc

SEQ ID NO: 314315 - DNA, 15 bp, Homo sapiens
atatcctcaccccca

SEQ ID NO: 314316 - DNA, 15 bp, Homo sapiens
tatcctcacccccat

SEQ ID NO: 314317 - DNA, 15 bp, Homo sapiens
atcctcacccccatc

SEQ ID NO: 314318 - DNA, 15 bp, Homo sapiens
tcctcacccccatcc

SEQ ID NO: 314319 - DNA, 15 bp, Homo sapiens
cctcacccccatccc

SEQ ID NO: 314320 - DNA, 15 bp, Homo sapiens
ctcacccccatccct

SEQ ID NO: 314321 - DNA, 15 bp, Homo sapiens
tcacccccatccctg

SEQ ID NO: 314322 - DNA, 15 bp, Homo sapiens
cacccccatccctgt

SEQ ID NO: 314323 - DNA, 15 bp, Homo sapiens
acccccatccctgtt

SEQ ID NO: 314324 - DNA, 15 bp, Homo sapiens
cccccatccctgttc

SEQ ID NO: 314325 - DNA, 15 bp, Homo sapiens
ccccatccctgttca

SEQ ID NO: 314326 - DNA, 15 bp, Homo sapiens
cccatccctgttcat

SEQ ID NO: 314327 - DNA, 15 bp, Homo sapiens
ccatccctgttcata

SEQ ID NO: 314328 - DNA, 15 bp, Homo sapiens
catccctgttcatag

SEQ ID NO: 314329 - DNA, 15 bp, Homo sapiens
atccctgttcatagc

SEQ ID NO: 314330 - DNA, 15 bp, Homo sapiens
tccctgttcatagcc

SEQ ID NO: 314331 - DNA, 15 bp, Homo sapiens
ccctgttcatagcca

SEQ ID NO: 314332 - DNA, 15 bp, Homo sapiens
cctgttcatagccat

SEQ ID NO: 314333 - DNA, 15 bp, Homo sapiens
ctgttcatagccatt

SEQ ID NO: 314334 - DNA, 15 bp, Homo sapiens
tgttcatagccattg

SEQ ID NO: 314335 - DNA, 15 bp, Homo sapiens
gttcatagccattga

SEQ ID NO: 314336 - DNA, 15 bp, Homo sapiens
ttcatagccattgat

SEQ ID NO: 314337 - DNA, 15 bp, Homo sapiens
tcatagccattgata

SEQ ID NO: 314338 - DNA, 15 bp, Homo sapiens
catagccattgatag

SEQ ID NO: 314339 - DNA, 15 bp, Homo sapiens
atagccattgatagg

SEQ ID NO: 314340 - DNA, 15 bp, Homo sapiens
tagccattgataggc

SEQ ID NO: 314341 - DNA, 15 bp, Homo sapiens
agccattgataggcc

SEQ ID NO: 314342 - DNA, 15 bp, Homo sapiens
gccattgataggcca

SEQ ID NO: 314343 - DNA, 15 bp, Homo sapiens
ccattgataggccaa

SEQ ID NO: 314344 - DNA, 15 bp, Homo sapiens
cattgataggccaac

SEQ ID NO: 314345 - DNA, 15 bp, Homo sapiens
attgataggccaaca

SEQ ID NO: 314346 - DNA, 15 bp, Homo sapiens
ttgataggccaacag

SEQ ID NO: 314347 - DNA, 15 bp, Homo sapiens
tgataggccaacagg

SEQ ID NO: 314348 - DNA, 15 bp, Homo sapiens
gataggccaacaggt

SEQ ID NO: 314349 - DNA, 15 bp, Homo sapiens
ataggccaacaggtg

SEQ ID NO: 314350 - DNA, 15 bp, Homo sapiens
taggccaacaggtgt

SEQ ID NO: 314351 - DNA, 15 bp, Homo sapiens
aggccaacaggtgtc

SEQ ID NO: 314352 - DNA, 15 bp, Homo sapiens
ggccaacaggtgtcc

SEQ ID NO: 314353 - DNA, 15 bp, Homo sapiens
gccaacaggtgtcct

SEQ ID NO: 314354 - DNA, 15 bp, Homo sapiens
ccaacaggtgtccta

SEQ ID NO: 314355 - DNA, 15 bp, Homo sapiens
caacaggtgtcctac

SEQ ID NO: 314356 - DNA, 15 bp, Homo sapiens
aacaggtgtcctacc

SEQ ID NO: 314357 - DNA, 15 bp, Homo sapiens
acaggtgtcctacct

SEQ ID NO: 314358 - DNA, 15 bp, Homo sapiens
caggtgtcctacctt

SEQ ID NO: 314359 - DNA, 15 bp, Homo sapiens
aggtgtcctaccttg

SEQ ID NO: 314360 - DNA, 15 bp, Homo sapiens
ggtgtcctaccttga

SEQ ID NO: 314361 - DNA, 15 bp, Homo sapiens
gtgtcctaccttgaa

SEQ ID NO: 314362 - DNA, 15 bp, Homo sapiens
tgtcctaccttgaaa

SEQ ID NO: 314363 - DNA, 15 bp, Homo sapiens
gtcctaccttgaaat

SEQ ID NO: 314364 - DNA, 15 bp, Homo sapiens
tcctaccttgaaata

SEQ ID NO: 314365 - DNA, 15 bp, Homo sapiens
cctaccttgaaatat

SEQ ID NO: 314366 - DNA, 15 bp, Homo sapiens
ctaccttgaaatatc

SEQ ID NO: 314367 - DNA, 15 bp, Homo sapiens
taccttgaaatatct

SEQ ID NO: 314368 - DNA, 15 bp, Homo sapiens
accttgaaatatctt

SEQ ID NO: 314369 - DNA, 15 bp, Homo sapiens
ccttgaaatatctta

SEQ ID NO: 314370 - DNA, 15 bp, Homo sapiens
cttgaaatatcttat

SEQ ID NO: 314371 - DNA, 15 bp, Homo sapiens
ttgaaatatcttatg

SEQ ID NO: 314372 - DNA, 15 bp, Homo sapiens
tgaaatatcttatga

SEQ ID NO: 314373 - DNA, 15 bp, Homo sapiens
gaaatatcttatgag

SEQ ID NO: 314374 - DNA, 15 bp, Homo sapiens
aaatatcttatgagc

SEQ ID NO: 314375 - DNA, 15 bp, Homo sapiens
aatatcttatgagcc

SEQ ID NO: 314376 - DNA, 15 bp, Homo sapiens
atatcttatgagcct

SEQ ID NO: 314377 - DNA, 15 bp, Homo sapiens
tatcttatgagcctt

SEQ ID NO: 314378 - DNA, 15 bp, Homo sapiens
atcttatgagccttc

SEQ ID NO: 314379 - DNA, 15 bp, Homo sapiens
tcttatgagccttct

SEQ ID NO: 314380 - DNA, 15 bp, Homo sapiens
cttatgagccttctc

SEQ ID NO: 314381 - DNA, 15 bp, Homo sapiens
ttatgagccttctca

SEQ ID NO: 314382 - DNA, 15 bp, Homo sapiens
tatgagccttctcaa

SEQ ID NO: 314383 - DNA, 15 bp, Homo sapiens
atgagccttctcaag

SEQ ID NO: 314384 - DNA, 15 bp, Homo sapiens
tgagccttctcaagg

SEQ ID NO: 314385 - DNA, 15 bp, Homo sapiens
gagccttctcaaggt

SEQ ID NO: 314386 - DNA, 15 bp, Homo sapiens
agccttctcaaggta

SEQ ID NO: 314387 - DNA, 15 bp, Homo sapiens
gccttctcaaggtaa

SEQ ID NO: 314388 - DNA, 15 bp, Homo sapiens
ccttctcaaggtaaa

SEQ ID NO: 314389 - DNA, 15 bp, Homo sapiens
cttctcaaggtaaaa

SEQ ID NO: 314390 - DNA, 15 bp, Homo sapiens
ttctcaaggtaaaat

SEQ ID NO: 314391 - DNA, 15 bp, Homo sapiens
tctcaaggtaaaatt

SEQ ID NO: 314392 - DNA, 15 bp, Homo sapiens
ctcaaggtaaaattt

SEQ ID NO: 314393 - DNA, 15 bp, Homo sapiens
tcaaggtaaaatttt

SEQ ID NO: 314394 - DNA, 15 bp, Homo sapiens
caaggtaaaattttc

SEQ ID NO: 314395 - DNA, 15 bp, Homo sapiens
aaggtaaaattttca

SEQ ID NO: 314396 - DNA, 15 bp, Homo sapiens
aggtaaaattttcac

SEQ ID NO: 314397 - DNA, 15 bp, Homo sapiens
ggtaaaattttcacc

SEQ ID NO: 314398 - DNA, 15 bp, Homo sapiens
gtaaaattttcacct

SEQ ID NO: 314399 - DNA, 15 bp, Homo sapiens
taaaattttcaccta

SEQ ID NO: 314400 - DNA, 15 bp, Homo sapiens
aaaattttcacctag

SEQ ID NO: 314401 - DNA, 15 bp, Homo sapiens
aaattttcacctagg

SEQ ID NO: 314402 - DNA, 15 bp, Homo sapiens
aattttcacctaggt

SEQ ID NO: 314403 - DNA, 15 bp, Homo sapiens
attttcacctaggta

SEQ ID NO: 314404 - DNA, 15 bp, Homo sapiens
ttttcacctaggtaa

SEQ ID NO: 314405 - DNA, 15 bp, Homo sapiens
tttcacctaggtaat

SEQ ID NO: 314406 - DNA, 15 bp, Homo sapiens
ttcacctaggtaatc

SEQ ID NO: 314407 - DNA, 15 bp, Homo sapiens
tcacctaggtaatct

SEQ ID NO: 314408 - DNA, 15 bp, Homo sapiens
cacctaggtaatcta

SEQ ID NO: 314409 - DNA, 15 bp, Homo sapiens
acctaggtaatctaa

SEQ ID NO: 314410 - DNA, 15 bp, Homo sapiens
cctaggtaatctaat

SEQ ID NO: 314411 - DNA, 15 bp, Homo sapiens
ctaggtaatctaata

SEQ ID NO: 314412 - DNA, 15 bp, Homo sapiens
taggtaatctaataa

SEQ ID NO: 314413 - DNA, 15 bp, Homo sapiens
aggtaatctaataaa

SEQ ID NO: 314414 - DNA, 15 bp, Homo sapiens
ggtaatctaataaac

SEQ ID NO: 314415 - DNA, 15 bp, Homo sapiens
gtaatctaataaacc

SEQ ID NO: 314416 - DNA, 15 bp, Homo sapiens
taatctaataaacca

SEQ ID NO: 314417 - DNA, 15 bp, Homo sapiens
aatctaataaaccag

SEQ ID NO: 314418 - DNA, 15 bp, Homo sapiens
atctaataaaccaga

SEQ ID NO: 314419 - DNA, 15 bp, Homo sapiens
tctaataaaccagac

SEQ ID NO: 314420 - DNA, 15 bp, Homo sapiens
ctaataaaccagact

SEQ ID NO: 314421 - DNA, 15 bp, Homo sapiens
taataaaccagactc

SEQ ID NO: 314422 - DNA, 15 bp, Homo sapiens
aataaaccagactca

SEQ ID NO: 314423 - DNA, 15 bp, Homo sapiens
ataaaccagactcag

SEQ ID NO: 314424 - DNA, 15 bp, Homo sapiens
taaaccagactcaga

SEQ ID NO: 314425 - DNA, 15 bp, Homo sapiens
aaaccagactcagac

SEQ ID NO: 314426 - DNA, 15 bp, Homo sapiens
aaccagactcagaca

SEQ ID NO: 314427 - DNA, 15 bp, Homo sapiens
accagactcagacag

SEQ ID NO: 314428 - DNA, 15 bp, Homo sapiens
ccagactcagacaga

SEQ ID NO: 314429 - DNA, 15 bp, Homo sapiens
cagactcagacagat

SEQ ID NO: 314430 - DNA, 15 bp, Homo sapiens
agactcagacagatt

SEQ ID NO: 314431 - DNA, 15 bp, Homo sapiens
gactcagacagattc

SEQ ID NO: 314432 - DNA, 15 bp, Homo sapiens
actcagacagattca

SEQ ID NO: 314433 - DNA, 15 bp, Homo sapiens
ctcagacagattcat

SEQ ID NO: 314434 - DNA, 15 bp, Homo sapiens
tcagacagattcatg

SEQ ID NO: 314435 - DNA, 15 bp, Homo sapiens
cagacagattcatgg

SEQ ID NO: 314436 - DNA, 15 bp, Homo sapiens
agacagattcatggt

SEQ ID NO: 314437 - DNA, 15 bp, Homo sapiens
gacagattcatggtt

SEQ ID NO: 314438 - DNA, 15 bp, Homo sapiens
acagattcatggttt

SEQ ID NO: 314439 - DNA, 15 bp, Homo sapiens
cagattcatggtttt

SEQ ID NO: 314440 - DNA, 15 bp, Homo sapiens
agattcatggttttc

SEQ ID NO: 314441 - DNA, 15 bp, Homo sapiens
gattcatggttttca

SEQ ID NO: 314442 - DNA, 15 bp, Homo sapiens
attcatggttttcac

SEQ ID NO: 314443 - DNA, 15 bp, Homo sapiens
ttcatggttttcaca

SEQ ID NO: 314444 - DNA, 15 bp, Homo sapiens
tcatggttttcacac

SEQ ID NO: 314445 - DNA, 15 bp, Homo sapiens
catggttttcacacg

SEQ ID NO: 314446 - DNA, 15 bp, Homo sapiens
atggttttcacacga

SEQ ID NO: 314447 - DNA, 15 bp, Homo sapiens
tggttttcacacgaa

SEQ ID NO: 314448 - DNA, 15 bp, Homo sapiens
ggttttcacacgaac

SEQ ID NO: 314449 - DNA, 15 bp, Homo sapiens
gttttcacacgaaca

SEQ ID NO: 314450 - DNA, 15 bp, Homo sapiens
ttttcacacgaacag

SEQ ID NO: 314451 - DNA, 15 bp, Homo sapiens
tttcacacgaacagt

SEQ ID NO: 314452 - DNA, 15 bp, Homo sapiens
ttcacacgaacagtt

SEQ ID NO: 314453 - DNA, 15 bp, Homo sapiens
tcacacgaacagtta

SEQ ID NO: 314454 - DNA, 15 bp, Homo sapiens
cacacgaacagttaa

SEQ ID NO: 314455 - DNA, 15 bp, Homo sapiens
acacgaacagttaaa

SEQ ID NO: 314456 - DNA, 15 bp, Homo sapiens
cacgaacagttaaat

SEQ ID NO: 314457 - DNA, 15 bp, Homo sapiens
acgaacagttaaatt

SEQ ID NO: 314458 - DNA, 15 bp, Homo sapiens
cgaacagttaaattg

SEQ ID NO: 314459 - DNA, 15 bp, Homo sapiens
gaacagttaaattgg

SEQ ID NO: 314460 - DNA, 15 bp, Homo sapiens
aacagttaaattggg

SEQ ID NO: 314461 - DNA, 15 bp, Homo sapiens
acagttaaattgggg

SEQ ID NO: 314462 - DNA, 15 bp, Homo sapiens
cagttaaattggggt

SEQ ID NO: 314463 - DNA, 15 bp, Homo sapiens
agttaaattggggtc

SEQ ID NO: 314464 - DNA, 15 bp, Homo sapiens
gttaaattggggtcc

SEQ ID NO: 314465 - DNA, 15 bp, Homo sapiens
ttaaattggggtcct

SEQ ID NO: 314466 - DNA, 15 bp, Homo sapiens
taaattggggtcctc

SEQ ID NO: 314467 - DNA, 15 bp, Homo sapiens
aaattggggtcctca

SEQ ID NO: 314468 - DNA, 15 bp, Homo sapiens
aattggggtcctcag

SEQ ID NO: 314469 - DNA, 15 bp, Homo sapiens
attggggtcctcagg

SEQ ID NO: 314470 - DNA, 15 bp, Homo sapiens
ttggggtcctcagga

SEQ ID NO: 314471 - DNA, 15 bp, Homo sapiens
tggggtcctcaggat

SEQ ID NO: 314472 - DNA, 15 bp, Homo sapiens
ggggtcctcaggata

SEQ ID NO: 314473 - DNA, 15 bp, Homo sapiens
gggtcctcaggatac

SEQ ID NO: 314474 - DNA, 15 bp, Homo sapiens
ggtcctcaggatacc

SEQ ID NO: 314475 - DNA, 15 bp, Homo sapiens
gtcctcaggatacca

SEQ ID NO: 314476 - DNA, 15 bp, Homo sapiens
tcctcaggataccac

SEQ ID NO: 314477 - DNA, 15 bp, Homo sapiens
cctcaggataccacc

SEQ ID NO: 314478 - DNA, 15 bp, Homo sapiens
ctcaggataccaccc

SEQ ID NO: 314479 - DNA, 15 bp, Homo sapiens
tcaggataccacccc

SEQ ID NO: 314480 - DNA, 15 bp, Homo sapiens
caggataccaccccc

SEQ ID NO: 314481 - DNA, 15 bp, Homo sapiens
aggataccaccccct

SEQ ID NO: 314482 - DNA, 15 bp, Homo sapiens
ggataccaccccctc

SEQ ID NO: 314483 - DNA, 15 bp, Homo sapiens
gataccaccccctcc

SEQ ID NO: 314484 - DNA, 15 bp, Homo sapiens
ataccaccccctcct

SEQ ID NO: 314485 - DNA, 15 bp, Homo sapiens
taccaccccctcctc

SEQ ID NO: 314486 - DNA, 15 bp, Homo sapiens
accaccccctcctcc

SEQ ID NO: 314487 - DNA, 15 bp, Homo sapiens
ccaccccctcctcca

SEQ ID NO: 314488 - DNA, 15 bp, Homo sapiens
caccccctcctccaa

SEQ ID NO: 314489 - DNA, 15 bp, Homo sapiens
accccctcctccaat

SEQ ID NO: 314490 - DNA, 15 bp, Homo sapiens
ccccctcctccaatc

SEQ ID NO: 314491 - DNA, 15 bp, Homo sapiens
cccctcctccaatct

SEQ ID NO: 314492 - DNA, 15 bp, Homo sapiens
ccctcctccaatctt

SEQ ID NO: 314493 - DNA, 15 bp, Homo sapiens
cctcctccaatcttt

SEQ ID NO: 314494 - DNA, 15 bp, Homo sapiens
ctcctccaatctttt

SEQ ID NO: 314495 - DNA, 15 bp, Homo sapiens
tcctccaatcttttt

SEQ ID NO: 314496 - DNA, 15 bp, Homo sapiens
cctccaatcttttta

SEQ ID NO: 314497 - DNA, 15 bp, Homo sapiens
ctccaatctttttat

SEQ ID NO: 314498 - DNA, 15 bp, Homo sapiens
tccaatctttttata

SEQ ID NO: 314499 - DNA, 15 bp, Homo sapiens
ccaatctttttatat

SEQ ID NO: 314500 - DNA, 15 bp, Homo sapiens
caatctttttatata

SEQ ID NO: 314501 - DNA, 15 bp, Homo sapiens
aatctttttatataa

SEQ ID NO: 314502 - DNA, 15 bp, Homo sapiens
atctttttatataac

SEQ ID NO: 314503 - DNA, 15 bp, Homo sapiens
tctttttatataacc

SEQ ID NO: 314504 - DNA, 15 bp, Homo sapiens
ctttttatataaccg

SEQ ID NO: 314505 - DNA, 15 bp, Homo sapiens
tttttatataaccga

SEQ ID NO: 314506 - DNA, 15 bp, Homo sapiens
ttttatataaccgag

SEQ ID NO: 314507 - DNA, 15 bp, Homo sapiens
tttatataaccgagt

SEQ ID NO: 314508 - DNA, 15 bp, Homo sapiens
ttatataaccgagtg

SEQ ID NO: 314509 - DNA, 15 bp, Homo sapiens
tatataaccgagtgc

SEQ ID NO: 314510 - DNA, 15 bp, Homo sapiens
atataaccgagtgct

SEQ ID NO: 314511 - DNA, 15 bp, Homo sapiens
tataaccgagtgctt

SEQ ID NO: 314512 - DNA, 15 bp, Homo sapiens
ataaccgagtgcttt

SEQ ID NO: 314513 - DNA, 15 bp, Homo sapiens
taaccgagtgctttt

SEQ ID NO: 314514 - DNA, 15 bp, Homo sapiens
aaccgagtgcttttt

SEQ ID NO: 314515 - DNA, 15 bp, Homo sapiens
accgagtgctttttg

SEQ ID NO: 314516 - DNA, 15 bp, Homo sapiens
ccgagtgctttttga

SEQ ID NO: 314517 - DNA, 15 bp, Homo sapiens
cgagtgctttttgac

SEQ ID NO: 314518 - DNA, 15 bp, Homo sapiens
gagtgctttttgact

SEQ ID NO: 314519 - DNA, 15 bp, Homo sapiens
agtgctttttgactc

SEQ ID NO: 314520 - DNA, 15 bp, Homo sapiens
gtgctttttgactct

SEQ ID NO: 314521 - DNA, 15 bp, Homo sapiens
tgctttttgactctg

SEQ ID NO: 314522 - DNA, 15 bp, Homo sapiens
gctttttgactctgg

SEQ ID NO: 314523 - DNA, 15 bp, Homo sapiens
ctttttgactctggc

SEQ ID NO: 314524 - DNA, 15 bp, Homo sapiens
tttttgactctggct

SEQ ID NO: 314525 - DNA, 15 bp, Homo sapiens
ttttgactctggctg

SEQ ID NO: 314526 - DNA, 15 bp, Homo sapiens
tttgactctggctgt

SEQ ID NO: 314527 - DNA, 15 bp, Homo sapiens
ttgactctggctgta

SEQ ID NO: 314528 - DNA, 15 bp, Homo sapiens
tgactctggctgtac

SEQ ID NO: 314529 - DNA, 15 bp, Homo sapiens
gactctggctgtaca

SEQ ID NO: 314530 - DNA, 15 bp, Homo sapiens
actctggctgtacag

SEQ ID NO: 314531 - DNA, 15 bp, Homo sapiens
ctctggctgtacaga

SEQ ID NO: 314532 - DNA, 15 bp, Homo sapiens
tctggctgtacagat

SEQ ID NO: 314533 - DNA, 15 bp, Homo sapiens
ctggctgtacagatg

SEQ ID NO: 314534 - DNA, 15 bp, Homo sapiens
tggctgtacagatga

SEQ ID NO: 314535 - DNA, 15 bp, Homo sapiens
ggctgtacagatgaa

SEQ ID NO: 314536 - DNA, 15 bp, Homo sapiens
gctgtacagatgaat

SEQ ID NO: 314537 - DNA, 15 bp, Homo sapiens
ctgtacagatgaatc

SEQ ID NO: 314538 - DNA, 15 bp, Homo sapiens
tgtacagatgaatca

SEQ ID NO: 314539 - DNA, 15 bp, Homo sapiens
gtacagatgaatcaa

SEQ ID NO: 314540 - DNA, 15 bp, Homo sapiens
tacagatgaatcaac

SEQ ID NO: 314541 - DNA, 15 bp, Homo sapiens
acagatgaatcaact

SEQ ID NO: 314542 - DNA, 15 bp, Homo sapiens
cagatgaatcaactg

SEQ ID NO: 314543 - DNA, 15 bp, Homo sapiens
agatgaatcaactgg

SEQ ID NO: 314544 - DNA, 15 bp, Homo sapiens
gatgaatcaactggg

SEQ ID NO: 314545 - DNA, 15 bp, Homo sapiens
atgaatcaactgggg

SEQ ID NO: 314546 - DNA, 15 bp, Homo sapiens
tgaatcaactgggga

SEQ ID NO: 314547 - DNA, 15 bp, Homo sapiens
gaatcaactggggag

SEQ ID NO: 314548 - DNA, 15 bp, Homo sapiens
aatcaactggggagt

SEQ ID NO: 314549 - DNA, 15 bp, Homo sapiens
atcaactggggagtt

SEQ ID NO: 314550 - DNA, 15 bp, Homo sapiens
tcaactggggagttt

SEQ ID NO: 314551 - DNA, 15 bp, Homo sapiens
caactggggagtttt

SEQ ID NO: 314552 - DNA, 15 bp, Homo sapiens
aactggggagtttta

SEQ ID NO: 314553 - DNA, 15 bp, Homo sapiens
actggggagttttaa

SEQ ID NO: 314554 - DNA, 15 bp, Homo sapiens
ctggggagttttaaa

SEQ ID NO: 314555 - DNA, 15 bp, Homo sapiens
tggggagttttaaaa

SEQ ID NO: 314556 - DNA, 15 bp, Homo sapiens
ggggagttttaaaaa

SEQ ID NO: 314557 - DNA, 15 bp, Homo sapiens
gggagttttaaaaaa

SEQ ID NO: 314558 - DNA, 15 bp, Homo sapiens
ggagttttaaaaaac

SEQ ID NO: 314559 - DNA, 15 bp, Homo sapiens
gagttttaaaaaacg

SEQ ID NO: 314560 - DNA, 15 bp, Homo sapiens
agttttaaaaaacgc

SEQ ID NO: 314561 - DNA, 15 bp, Homo sapiens
gttttaaaaaacgca

SEQ ID NO: 314562 - DNA, 15 bp, Homo sapiens
ttttaaaaaacgcag

SEQ ID NO: 314563 - DNA, 15 bp, Homo sapiens
tttaaaaaacgcaga

SEQ ID NO: 314564 - DNA, 15 bp, Homo sapiens
ttaaaaaacgcagat

SEQ ID NO: 314565 - DNA, 15 bp, Homo sapiens
taaaaaacgcagatg

SEQ ID NO: 314566 - DNA, 15 bp, Homo sapiens
aaaaaacgcagatgc

SEQ ID NO: 314567 - DNA, 15 bp, Homo sapiens
aaaaacgcagatgca

SEQ ID NO: 314568 - DNA, 15 bp, Homo sapiens
aaaacgcagatgcat

SEQ ID NO: 314569 - DNA, 15 bp, Homo sapiens
aaacgcagatgcatt

SEQ ID NO: 314570 - DNA, 15 bp, Homo sapiens
aacgcagatgcattg

SEQ ID NO: 314571 - DNA, 15 bp, Homo sapiens
acgcagatgcattgg

SEQ ID NO: 314572 - DNA, 15 bp, Homo sapiens
cgcagatgcattggc

SEQ ID NO: 314573 - DNA, 15 bp, Homo sapiens
gcagatgcattggct

SEQ ID NO: 314574 - DNA, 15 bp, Homo sapiens
cagatgcattggctc

SEQ ID NO: 314575 - DNA, 15 bp, Homo sapiens
agatgcattggctcc

SEQ ID NO: 314576 - DNA, 15 bp, Homo sapiens
gatgcattggctcca

SEQ ID NO: 314577 - DNA, 15 bp, Homo sapiens
atgcattggctccat

SEQ ID NO: 314578 - DNA, 15 bp, Homo sapiens
tgcattggctccatt

SEQ ID NO: 314579 - DNA, 15 bp, Homo sapiens
gcattggctccattc

SEQ ID NO: 314580 - DNA, 15 bp, Homo sapiens
cattggctccattcc

SEQ ID NO: 314581 - DNA, 15 bp, Homo sapiens
attggctccattcca

SEQ ID NO: 314582 - DNA, 15 bp, Homo sapiens
ttggctccattccag

SEQ ID NO: 314583 - DNA, 15 bp, Homo sapiens
tggctccattccaga

SEQ ID NO: 314584 - DNA, 15 bp, Homo sapiens
ggctccattccagac

SEQ ID NO: 314585 - DNA, 15 bp, Homo sapiens
gctccattccagacc

SEQ ID NO: 314586 - DNA, 15 bp, Homo sapiens
ctccattccagaccc

SEQ ID NO: 314587 - DNA, 15 bp, Homo sapiens
tccattccagaccca

SEQ ID NO: 314588 - DNA, 15 bp, Homo sapiens
ccattccagacccat

SEQ ID NO: 314589 - DNA, 15 bp, Homo sapiens
cattccagacccatt

SEQ ID NO: 314590 - DNA, 15 bp, Homo sapiens
attccagacccattg

SEQ ID NO: 314591 - DNA, 15 bp, Homo sapiens
ttccagacccattga

SEQ ID NO: 314592 - DNA, 15 bp, Homo sapiens
tccagacccattgaa

SEQ ID NO: 314593 - DNA, 15 bp, Homo sapiens
ccagacccattgaat

SEQ ID NO: 314594 - DNA, 15 bp, Homo sapiens
cagacccattgaata

SEQ ID NO: 314595 - DNA, 15 bp, Homo sapiens
agacccattgaataa

SEQ ID NO: 314596 - DNA, 15 bp, Homo sapiens
gacccattgaataaa

SEQ ID NO: 314597 - DNA, 15 bp, Homo sapiens
acccattgaataaaa

SEQ ID NO: 314598 - DNA, 15 bp, Homo sapiens
cccattgaataaaaa

SEQ ID NO: 314599 - DNA, 15 bp, Homo sapiens
ccattgaataaaaat

SEQ ID NO: 314600 - DNA, 15 bp, Homo sapiens
cattgaataaaaatt

SEQ ID NO: 314601 - DNA, 15 bp, Homo sapiens
attgaataaaaattt

SEQ ID NO: 314602 - DNA, 15 bp, Homo sapiens
ttgaataaaaatttc

SEQ ID NO: 314603 - DNA, 15 bp, Homo sapiens
tgaataaaaatttct

SEQ ID NO: 314604 - DNA, 15 bp, Homo sapiens
gaataaaaatttctg

SEQ ID NO: 314605 - DNA, 15 bp, Homo sapiens
aataaaaatttctgt

SEQ ID NO: 314606 - DNA, 15 bp, Homo sapiens
ataaaaatttctgta

SEQ ID NO: 314607 - DNA, 15 bp, Homo sapiens
taaaaatttctgtat

SEQ ID NO: 314608 - DNA, 15 bp, Homo sapiens
aaaaatttctgtatt

SEQ ID NO: 314609 - DNA, 15 bp, Homo sapiens
aaaatttctgtattt

SEQ ID NO: 314610 - DNA, 15 bp, Homo sapiens
aaatttctgtatttt

SEQ ID NO: 314611 - DNA, 15 bp, Homo sapiens
aatttctgtattttt

SEQ ID NO: 314612 - DNA, 15 bp, Homo sapiens
atttctgtattttta

SEQ ID NO: 314613 - DNA, 15 bp, Homo sapiens
tttctgtatttttaa

SEQ ID NO: 314614 - DNA, 15 bp, Homo sapiens
tctgtatttttaaaa

SEQ ID NO: 314615 - DNA, 15 bp, Homo sapiens
ctgtatttttaaaaa

SEQ ID NO: 314616 - DNA, 15 bp, Homo sapiens
tgtatttttaaaaag

SEQ ID NO: 314617 - DNA, 15 bp, Homo sapiens
gtatttttaaaaagc

SEQ ID NO: 314618 - DNA, 15 bp, Homo sapiens
tatttttaaaaagct

SEQ ID NO: 314619 - DNA, 15 bp, Homo sapiens
atttttaaaaagctt

SEQ ID NO: 314620 - DNA, 15 bp, Homo sapiens
tttttaaaaagcttc

SEQ ID NO: 314621 - DNA, 15 bp, Homo sapiens
ttttaaaaagcttca

SEQ ID NO: 314622 - DNA, 15 bp, Homo sapiens
tttaaaaagcttcaa

SEQ ID NO: 314623 - DNA, 15 bp, Homo sapiens
ttaaaaagcttcaaa

SEQ ID NO: 314624 - DNA, 15 bp, Homo sapiens
taaaaagcttcaaat

SEQ ID NO: 314625 - DNA, 15 bp, Homo sapiens
aaaaagcttcaaata

SEQ ID NO: 314626 - DNA, 15 bp, Homo sapiens
aaaagcttcaaatat

SEQ ID NO: 314627 - DNA, 15 bp, Homo sapiens
aaagcttcaaatatg

SEQ ID NO: 314628 - DNA, 15 bp, Homo sapiens
aagcttcaaatatga

SEQ ID NO: 314629 - DNA, 15 bp, Homo sapiens
agcttcaaatatgat

SEQ ID NO: 314630 - DNA, 15 bp, Homo sapiens
gcttcaaatatgatt

SEQ ID NO: 314631 - DNA, 15 bp, Homo sapiens
cttcaaatatgattc

SEQ ID NO: 314632 - DNA, 15 bp, Homo sapiens
ttcaaatatgattct

SEQ ID NO: 314633 - DNA, 15 bp, Homo sapiens
tcaaatatgattctg

SEQ ID NO: 314634 - DNA, 15 bp, Homo sapiens
caaatatgattctga

SEQ ID NO: 314635 - DNA, 15 bp, Homo sapiens
aaatatgattctgag

SEQ ID NO: 314636 - DNA, 15 bp, Homo sapiens
aatatgattctgaga

SEQ ID NO: 314637 - DNA, 15 bp, Homo sapiens
atatgattctgagac

SEQ ID NO: 314638 - DNA, 15 bp, Homo sapiens
tatgattctgagaca

SEQ ID NO: 314639 - DNA, 15 bp, Homo sapiens
atgattctgagacaa

SEQ ID NO: 314640 - DNA, 15 bp, Homo sapiens
tgattctgagacaaa

SEQ ID NO: 314641 - DNA, 15 bp, Homo sapiens
gattctgagacaaac

SEQ ID NO: 314642 - DNA, 15 bp, Homo sapiens
attctgagacaaact

SEQ ID NO: 314643 - DNA, 15 bp, Homo sapiens
ttctgagacaaactc

SEQ ID NO: 314644 - DNA, 15 bp, Homo sapiens
tctgagacaaactca

SEQ ID NO: 314645 - DNA, 15 bp, Homo sapiens
ctgagacaaactcaa

SEQ ID NO: 314646 - DNA, 15 bp, Homo sapiens
tgagacaaactcaaa

SEQ ID NO: 314647 - DNA, 15 bp, Homo sapiens
gagacaaactcaaag

SEQ ID NO: 314648 - DNA, 15 bp, Homo sapiens
agacaaactcaaagg

SEQ ID NO: 314649 - DNA, 15 bp, Homo sapiens
gacaaactcaaaggg

SEQ ID NO: 314650 - DNA, 15 bp, Homo sapiens
acaaactcaaagggg

SEQ ID NO: 314651 - DNA, 15 bp, Homo sapiens
caaactcaaagggga

SEQ ID NO: 314652 - DNA, 15 bp, Homo sapiens
aaactcaaaggggag

SEQ ID NO: 314653 - DNA, 15 bp, Homo sapiens
aactcaaaggggaga

SEQ ID NO: 314654 - DNA, 15 bp, Homo sapiens
actcaaaggggagat

SEQ ID NO: 314655 - DNA, 15 bp, Homo sapiens
ctcaaaggggagata

SEQ ID NO: 314656 - DNA, 15 bp, Homo sapiens
tcaaaggggagatat

SEQ ID NO: 314657 - DNA, 15 bp, Homo sapiens
caaaggggagatatt

SEQ ID NO: 314658 - DNA, 15 bp, Homo sapiens
aaaggggagatattt

SEQ ID NO: 314659 - DNA, 15 bp, Homo sapiens
aaggggagatatttt

SEQ ID NO: 314660 - DNA, 15 bp, Homo sapiens
aggggagatattttt

SEQ ID NO: 314661 - DNA, 15 bp, Homo sapiens
ggggagatatttttg

SEQ ID NO: 314662 - DNA, 15 bp, Homo sapiens
gggagatatttttga

SEQ ID NO: 314663 - DNA, 15 bp, Homo sapiens
ggagatatttttgaa

SEQ ID NO: 314664 - DNA, 15 bp, Homo sapiens
gagatatttttgaac

SEQ ID NO: 314665 - DNA, 15 bp, Homo sapiens
agatatttttgaaca

SEQ ID NO: 314666 - DNA, 15 bp, Homo sapiens
gatatttttgaacag

SEQ ID NO: 314667 - DNA, 15 bp, Homo sapiens
atatttttgaacagg

SEQ ID NO: 314668 - DNA, 15 bp, Homo sapiens
tatttttgaacaggc

SEQ ID NO: 314669 - DNA, 15 bp, Homo sapiens
atttttgaacaggca

SEQ ID NO: 314670 - DNA, 15 bp, Homo sapiens
tttttgaacaggcag

SEQ ID NO: 314671 - DNA, 15 bp, Homo sapiens
ttttgaacaggcaga

SEQ ID NO: 314672 - DNA, 15 bp, Homo sapiens
tttgaacaggcagaa

SEQ ID NO: 314673 - DNA, 15 bp, Homo sapiens
ttgaacaggcagaac

SEQ ID NO: 314674 - DNA, 15 bp, Homo sapiens
tgaacaggcagaaca

SEQ ID NO: 314675 - DNA, 15 bp, Homo sapiens
gaacaggcagaacac

SEQ ID NO: 314676 - DNA, 15 bp, Homo sapiens
aacaggcagaacact

SEQ ID NO: 314677 - DNA, 15 bp, Homo sapiens
acaggcagaacactt

SEQ ID NO: 314678 - DNA, 15 bp, Homo sapiens
caggcagaacacttc

SEQ ID NO: 314679 - DNA, 15 bp, Homo sapiens
aggcagaacacttct

SEQ ID NO: 314680 - DNA, 15 bp, Homo sapiens
ggcagaacacttctc

SEQ ID NO: 314681 - DNA, 15 bp, Homo sapiens
gcagaacacttctca

SEQ ID NO: 314682 - DNA, 15 bp, Homo sapiens
cagaacacttctcag

SEQ ID NO: 314683 - DNA, 15 bp, Homo sapiens
agaacacttctcagc

SEQ ID NO: 314684 - DNA, 15 bp, Homo sapiens
gaacacttctcagcc

SEQ ID NO: 314685 - DNA, 15 bp, Homo sapiens
aacacttctcagcct

SEQ ID NO: 314686 - DNA, 15 bp, Homo sapiens
acacttctcagcctt

SEQ ID NO: 314687 - DNA, 15 bp, Homo sapiens
cacttctcagccttg

SEQ ID NO: 314688 - DNA, 15 bp, Homo sapiens
acttctcagccttga

SEQ ID NO: 314689 - DNA, 15 bp, Homo sapiens
cttctcagccttgaa

SEQ ID NO: 314690 - DNA, 15 bp, Homo sapiens
ttctcagccttgaaa

SEQ ID NO: 314691 - DNA, 15 bp, Homo sapiens
tctcagccttgaaaa

SEQ ID NO: 314692 - DNA, 15 bp, Homo sapiens
ctcagccttgaaaat

SEQ ID NO: 314693 - DNA, 15 bp, Homo sapiens
tcagccttgaaaatt

SEQ ID NO: 314694 - DNA, 15 bp, Homo sapiens
cagccttgaaaatta

SEQ ID NO: 314695 - DNA, 15 bp, Homo sapiens
agccttgaaaattac

SEQ ID NO: 314696 - DNA, 15 bp, Homo sapiens
gccttgaaaattaca

SEQ ID NO: 314697 - DNA, 15 bp, Homo sapiens
ccttgaaaattacac

SEQ ID NO: 314698 - DNA, 15 bp, Homo sapiens
cttgaaaattacaca

SEQ ID NO: 314699 - DNA, 15 bp, Homo sapiens
ttgaaaattacacag

SEQ ID NO: 314700 - DNA, 15 bp, Homo sapiens
tgaaaattacacaga

SEQ ID NO: 314701 - DNA, 15 bp, Homo sapiens
gaaaattacacagaa

SEQ ID NO: 314702 - DNA, 15 bp, Homo sapiens
aaaattacacagaac

SEQ ID NO: 314703 - DNA, 15 bp, Homo sapiens
aaattacacagaact

SEQ ID NO: 314704 - DNA, 15 bp, Homo sapiens
aattacacagaactc

SEQ ID NO: 314705 - DNA, 15 bp, Homo sapiens
attacacagaactcc

SEQ ID NO: 314706 - DNA, 15 bp, Homo sapiens
ttacacagaactcca

SEQ ID NO: 314707 - DNA, 15 bp, Homo sapiens
tacacagaactccac

SEQ ID NO: 314708 - DNA, 15 bp, Homo sapiens
acacagaactccacc

SEQ ID NO: 314709 - DNA, 15 bp, Homo sapiens
cacagaactccaccc

SEQ ID NO: 314710 - DNA, 15 bp, Homo sapiens
acagaactccaccct

SEQ ID NO: 314711 - DNA, 15 bp, Homo sapiens
cagaactccaccctg

SEQ ID NO: 314712 - DNA, 15 bp, Homo sapiens
agaactccaccctga

SEQ ID NO: 314713 - DNA, 15 bp, Homo sapiens
gaactccaccctgag

SEQ ID NO: 314714 - DNA, 15 bp, Homo sapiens
aactccaccctgagt

SEQ ID NO: 314715 - DNA, 15 bp, Homo sapiens
actccaccctgagtg

SEQ ID NO: 314716 - DNA, 15 bp, Homo sapiens
ctccaccctgagtgt

SEQ ID NO: 314717 - DNA, 15 bp, Homo sapiens
tccaccctgagtgtg

SEQ ID NO: 314718 - DNA, 15 bp, Homo sapiens
ccaccctgagtgtga

SEQ ID NO: 314719 - DNA, 15 bp, Homo sapiens
caccctgagtgtgaa

SEQ ID NO: 314720 - DNA, 15 bp, Homo sapiens
accctgagtgtgaac

SEQ ID NO: 314721 - DNA, 15 bp, Homo sapiens
ccctgagtgtgaaca

SEQ ID NO: 314722 - DNA, 15 bp, Homo sapiens
cctgagtgtgaacac

SEQ ID NO: 314723 - DNA, 15 bp, Homo sapiens
ctgagtgtgaacact

SEQ ID NO: 314724 - DNA, 15 bp, Homo sapiens
tgagtgtgaacacta

SEQ ID NO: 314725 - DNA, 15 bp, Homo sapiens
gagtgtgaacactat

SEQ ID NO: 314726 - DNA, 15 bp, Homo sapiens
agtgtgaacactata

SEQ ID NO: 314727 - DNA, 15 bp, Homo sapiens
gtgtgaacactatac

SEQ ID NO: 314728 - DNA, 15 bp, Homo sapiens
tgtgaacactatact

SEQ ID NO: 314729 - DNA, 15 bp, Homo sapiens
gtgaacactatactt

SEQ ID NO: 314730 - DNA, 15 bp, Homo sapiens
tgaacactatactta

SEQ ID NO: 314731 - DNA, 15 bp, Homo sapiens
gaacactatacttaa

SEQ ID NO: 314732 - DNA, 15 bp, Homo sapiens
aacactatacttaag

SEQ ID NO: 314733 - DNA, 15 bp, Homo sapiens
acactatacttaagt

SEQ ID NO: 314734 - DNA, 15 bp, Homo sapiens
cactatacttaagta

SEQ ID NO: 314735 - DNA, 15 bp, Homo sapiens
actatacttaagtaa

SEQ ID NO: 314736 - DNA, 15 bp, Homo sapiens
ctatacttaagtaac

SEQ ID NO: 314737 - DNA, 15 bp, Homo sapiens
tatacttaagtaact

SEQ ID NO: 314738 - DNA, 15 bp, Homo sapiens
atacttaagtaactt

SEQ ID NO: 314739 - DNA, 15 bp, Homo sapiens
tacttaagtaacttt

SEQ ID NO: 314740 - DNA, 15 bp, Homo sapiens
acttaagtaactttg

SEQ ID NO: 314741 - DNA, 15 bp, Homo sapiens
cttaagtaactttga

SEQ ID NO: 314742 - DNA, 15 bp, Homo sapiens
ttaagtaactttgaa

SEQ ID NO: 314743 - DNA, 15 bp, Homo sapiens
taagtaactttgaaa

SEQ ID NO: 314744 - DNA, 15 bp, Homo sapiens
aagtaactttgaaaa

SEQ ID NO: 314745 - DNA, 15 bp, Homo sapiens
gtaactttgaaaagt

SEQ ID NO: 314746 - DNA, 15 bp, Homo sapiens
taactttgaaaagtt

SEQ ID NO: 314747 - DNA, 15 bp, Homo sapiens
aactttgaaaagtta

SEQ ID NO: 314748 - DNA, 15 bp, Homo sapiens
actttgaaaagttac

SEQ ID NO: 314749 - DNA, 15 bp, Homo sapiens
ctttgaaaagttact

SEQ ID NO: 314750 - DNA, 15 bp, Homo sapiens
tttgaaaagttactt

SEQ ID NO: 314751 - DNA, 15 bp, Homo sapiens
ttgaaaagttacttt

SEQ ID NO: 314752 - DNA, 15 bp, Homo sapiens
tgaaaagttactttg

SEQ ID NO: 314753 - DNA, 15 bp, Homo sapiens
gaaaagttactttga

SEQ ID NO: 314754 - DNA, 15 bp, Homo sapiens
aaaagttactttgag

SEQ ID NO: 314755 - DNA, 15 bp, Homo sapiens
aaagttactttgagg

SEQ ID NO: 314756 - DNA, 15 bp, Homo sapiens
aagttactttgaggt

SEQ ID NO: 314757 - DNA, 15 bp, Homo sapiens
agttactttgaggta

SEQ ID NO: 314758 - DNA, 15 bp, Homo sapiens
gttactttgaggtat

SEQ ID NO: 314759 - DNA, 15 bp, Homo sapiens
ttactttgaggtata

SEQ ID NO: 314760 - DNA, 15 bp, Homo sapiens
tactttgaggtataa

SEQ ID NO: 314761 - DNA, 15 bp, Homo sapiens
actttgaggtataaa

SEQ ID NO: 314762 - DNA, 15 bp, Homo sapiens
ctttgaggtataaaa

SEQ ID NO: 314763 - DNA, 15 bp, Homo sapiens
tttgaggtataaaat

SEQ ID NO: 314764 - DNA, 15 bp, Homo sapiens
ttgaggtataaaatt

SEQ ID NO: 314765 - DNA, 15 bp, Homo sapiens
tgaggtataaaatta

SEQ ID NO: 314766 - DNA, 15 bp, Homo sapiens
gaggtataaaattac

SEQ ID NO: 314767 - DNA, 15 bp, Homo sapiens
aggtataaaattaca

SEQ ID NO: 314768 - DNA, 15 bp, Homo sapiens
ggtataaaattacat

SEQ ID NO: 314769 - DNA, 15 bp, Homo sapiens
gtataaaattacatc

SEQ ID NO: 314770 - DNA, 15 bp, Homo sapiens
tataaaattacatcc

SEQ ID NO: 314771 - DNA, 15 bp, Homo sapiens
ataaaattacatcca

SEQ ID NO: 314772 - DNA, 15 bp, Homo sapiens
taaaattacatccag

SEQ ID NO: 314773 - DNA, 15 bp, Homo sapiens
aaaattacatccagt

SEQ ID NO: 314774 - DNA, 15 bp, Homo sapiens
aaattacatccagtg

SEQ ID NO: 314775 - DNA, 15 bp, Homo sapiens
aattacatccagtgt

SEQ ID NO: 314776 - DNA, 15 bp, Homo sapiens
attacatccagtgtc

SEQ ID NO: 314777 - DNA, 15 bp, Homo sapiens
ttacatccagtgtca

SEQ ID NO: 314778 - DNA, 15 bp, Homo sapiens
tacatccagtgtcac

SEQ ID NO: 314779 - DNA, 15 bp, Homo sapiens
acatccagtgtcact

SEQ ID NO: 314780 - DNA, 15 bp, Homo sapiens
catccagtgtcactt

SEQ ID NO: 314781 - DNA, 15 bp, Homo sapiens
atccagtgtcacttt

SEQ ID NO: 314782 - DNA, 15 bp, Homo sapiens
tccagtgtcacttta

SEQ ID NO: 314783 - DNA, 15 bp, Homo sapiens
ccagtgtcactttaa

SEQ ID NO: 314784 - DNA, 15 bp, Homo sapiens
cagtgtcactttaaa

SEQ ID NO: 314785 - DNA, 15 bp, Homo sapiens
agtgtcactttaaag

SEQ ID NO: 314786 - DNA, 15 bp, Homo sapiens
gtgtcactttaaaga

SEQ ID NO: 314787 - DNA, 15 bp, Homo sapiens
tgtcactttaaagac

SEQ ID NO: 314788 - DNA, 15 bp, Homo sapiens
gtcactttaaagaca

SEQ ID NO: 314789 - DNA, 15 bp, Homo sapiens
tcactttaaagacaa

SEQ ID NO: 314790 - DNA, 15 bp, Homo sapiens
cactttaaagacaaa

SEQ ID NO: 314791 - DNA, 15 bp, Homo sapiens
actttaaagacaaaa

SEQ ID NO: 314792 - DNA, 15 bp, Homo sapiens
ctttaaagacaaaaa

SEQ ID NO: 314793 - DNA, 15 bp, Homo sapiens
tttaaagacaaaaaa

SEQ ID NO: 314794 - DNA, 15 bp, Homo sapiens
ttaaagacaaaaaag

SEQ ID NO: 314795 - DNA, 15 bp, Homo sapiens
taaagacaaaaaagg

SEQ ID NO: 314796 - DNA, 15 bp, Homo sapiens
aaagacaaaaaagga

SEQ ID NO: 314797 - DNA, 15 bp, Homo sapiens
aagacaaaaaaggaa

SEQ ID NO: 314798 - DNA, 15 bp, Homo sapiens
agacaaaaaaggaac

SEQ ID NO: 314799 - DNA, 15 bp, Homo sapiens
gacaaaaaaggaacc

SEQ ID NO: 314800 - DNA, 15 bp, Homo sapiens
acaaaaaaggaaccc

SEQ ID NO: 314801 - DNA, 15 bp, Homo sapiens
caaaaaaggaaccca

SEQ ID NO: 314802 - DNA, 15 bp, Homo sapiens
aaaaaaggaacccaa

SEQ ID NO: 314803 - DNA, 15 bp, Homo sapiens
aaaaaggaacccaaa

SEQ ID NO: 314804 - DNA, 15 bp, Homo sapiens
aaaaggaacccaaag

SEQ ID NO: 314805 - DNA, 15 bp, Homo sapiens
aaaggaacccaaagc

SEQ ID NO: 314806 - DNA, 15 bp, Homo sapiens
aaggaacccaaagcc

SEQ ID NO: 314807 - DNA, 15 bp, Homo sapiens
aggaacccaaagcct

SEQ ID NO: 314808 - DNA, 15 bp, Homo sapiens
ggaacccaaagcctg

SEQ ID NO: 314809 - DNA, 15 bp, Homo sapiens
gaacccaaagcctgt

SEQ ID NO: 314810 - DNA, 15 bp, Homo sapiens
aacccaaagcctgtt

SEQ ID NO: 314811 - DNA, 15 bp, Homo sapiens
acccaaagcctgttt

SEQ ID NO: 314812 - DNA, 15 bp, Homo sapiens
cccaaagcctgtttt

SEQ ID NO: 314813 - DNA, 15 bp, Homo sapiens
ccaaagcctgttttt

SEQ ID NO: 314814 - DNA, 15 bp, Homo sapiens
caaagcctgtttttg

SEQ ID NO: 314815 - DNA, 15 bp, Homo sapiens
aaagcctgtttttgc

SEQ ID NO: 314816 - DNA, 15 bp, Homo sapiens
aagcctgtttttgct

SEQ ID NO: 314817 - DNA, 15 bp, Homo sapiens
agcctgtttttgctg

SEQ ID NO: 314818 - DNA, 15 bp, Homo sapiens
gcctgtttttgctgt

SEQ ID NO: 314819 - DNA, 15 bp, Homo sapiens
cctgtttttgctgtg

SEQ ID NO: 314820 - DNA, 15 bp, Homo sapiens
ctgtttttgctgtgt

SEQ ID NO: 314821 - DNA, 15 bp, Homo sapiens
tgtttttgctgtgtg

SEQ ID NO: 314822 - DNA, 15 bp, Homo sapiens
gtttttgctgtgtga

SEQ ID NO: 314823 - DNA, 15 bp, Homo sapiens
tttttgctgtgtgaa

SEQ ID NO: 314824 - DNA, 15 bp, Homo sapiens
ttttgctgtgtgaac

SEQ ID NO: 314825 - DNA, 15 bp, Homo sapiens
tttgctgtgtgaacc

SEQ ID NO: 314826 - DNA, 15 bp, Homo sapiens
ttgctgtgtgaacca

SEQ ID NO: 314827 - DNA, 15 bp, Homo sapiens
tgctgtgtgaaccat

SEQ ID NO: 314828 - DNA, 15 bp, Homo sapiens
gctgtgtgaaccatc

SEQ ID NO: 314829 - DNA, 15 bp, Homo sapiens
ctgtgtgaaccatct

SEQ ID NO: 314830 - DNA, 15 bp, Homo sapiens
tgtgtgaaccatctt

SEQ ID NO: 314831 - DNA, 15 bp, Homo sapiens
gtgtgaaccatcttt

SEQ ID NO: 314832 - DNA, 15 bp, Homo sapiens
tgtgaaccatcttta

SEQ ID NO: 314833 - DNA, 15 bp, Homo sapiens
gtgaaccatctttat

SEQ ID NO: 314834 - DNA, 15 bp, Homo sapiens
tgaaccatctttatg

SEQ ID NO: 314835 - DNA, 15 bp, Homo sapiens
gaaccatctttatgt

SEQ ID NO: 314836 - DNA, 15 bp, Homo sapiens
aaccatctttatgtt

SEQ ID NO: 314837 - DNA, 15 bp, Homo sapiens
accatctttatgttc

SEQ ID NO: 314838 - DNA, 15 bp, Homo sapiens
ccatctttatgttct

SEQ ID NO: 314839 - DNA, 15 bp, Homo sapiens
catctttatgttctg

SEQ ID NO: 314840 - DNA, 15 bp, Homo sapiens
atctttatgttctgt

SEQ ID NO: 314841 - DNA, 15 bp, Homo sapiens
tctttatgttctgtt

SEQ ID NO: 314842 - DNA, 15 bp, Homo sapiens
ctttatgttctgtta

SEQ ID NO: 314843 - DNA, 15 bp, Homo sapiens
tttatgttctgttag

SEQ ID NO: 314844 - DNA, 15 bp, Homo sapiens
ttatgttctgttagg

SEQ ID NO: 314845 - DNA, 15 bp, Homo sapiens
tatgttctgttagga

SEQ ID NO: 314846 - DNA, 15 bp, Homo sapiens
atgttctgttaggag

SEQ ID NO: 314847 - DNA, 15 bp, Homo sapiens
tgttctgttaggagc

SEQ ID NO: 314848 - DNA, 15 bp, Homo sapiens
gttctgttaggagct

SEQ ID NO: 314849 - DNA, 15 bp, Homo sapiens
ttctgttaggagctt

SEQ ID NO: 314850 - DNA, 15 bp, Homo sapiens
tctgttaggagcttg

SEQ ID NO: 314851 - DNA, 15 bp, Homo sapiens
ctgttaggagcttgt

SEQ ID NO: 314852 - DNA, 15 bp, Homo sapiens
tgttaggagcttgtt

SEQ ID NO: 314853 - DNA, 15 bp, Homo sapiens
gttaggagcttgttt

SEQ ID NO: 314854 - DNA, 15 bp, Homo sapiens
ttaggagcttgtttc

SEQ ID NO: 314855 - DNA, 15 bp, Homo sapiens
taggagcttgtttct

SEQ ID NO: 314856 - DNA, 15 bp, Homo sapiens
aggagcttgtttctt

SEQ ID NO: 314857 - DNA, 15 bp, Homo sapiens
ggagcttgtttctta

SEQ ID NO: 314858 - DNA, 15 bp, Homo sapiens
gagcttgtttcttat

SEQ ID NO: 314859 - DNA, 15 bp, Homo sapiens
agcttgtttcttatt

SEQ ID NO: 314860 - DNA, 15 bp, Homo sapiens
gcttgtttcttatta

SEQ ID NO: 314861 - DNA, 15 bp, Homo sapiens
cttgtttcttattat

SEQ ID NO: 314862 - DNA, 15 bp, Homo sapiens
ttgtttcttattatg

SEQ ID NO: 314863 - DNA, 15 bp, Homo sapiens
tgtttcttattatgt

SEQ ID NO: 314864 - DNA, 15 bp, Homo sapiens
gtttcttattatgtg

SEQ ID NO: 314865 - DNA, 15 bp, Homo sapiens
tttcttattatgtga

SEQ ID NO: 314866 - DNA, 15 bp, Homo sapiens
ttcttattatgtgaa

SEQ ID NO: 314867 - DNA, 15 bp, Homo sapiens
tcttattatgtgaaa

SEQ ID NO: 314868 - DNA, 15 bp, Homo sapiens
cttattatgtgaaac

SEQ ID NO: 314869 - DNA, 15 bp, Homo sapiens
ttattatgtgaaact

SEQ ID NO: 314870 - DNA, 15 bp, Homo sapiens
tattatgtgaaactg

SEQ ID NO: 314871 - DNA, 15 bp, Homo sapiens
attatgtgaaactgt

SEQ ID NO: 314872 - DNA, 15 bp, Homo sapiens
ttatgtgaaactgta

SEQ ID NO: 314873 - DNA, 15 bp, Homo sapiens
tatgtgaaactgtag

SEQ ID NO: 314874 - DNA, 15 bp, Homo sapiens
atgtgaaactgtaga

SEQ ID NO: 314875 - DNA, 15 bp, Homo sapiens
tgtgaaactgtagaa

SEQ ID NO: 314876 - DNA, 15 bp, Homo sapiens
gtgaaactgtagaaa

SEQ ID NO: 314877 - DNA, 15 bp, Homo sapiens
tgaaactgtagaaat

SEQ ID NO: 314878 - DNA, 15 bp, Homo sapiens
gaaactgtagaaata

SEQ ID NO: 314879 - DNA, 15 bp, Homo sapiens
aaactgtagaaatac

SEQ ID NO: 314880 - DNA, 15 bp, Homo sapiens
aactgtagaaataca

SEQ ID NO: 314881 - DNA, 15 bp, Homo sapiens
actgtagaaatacac

SEQ ID NO: 314882 - DNA, 15 bp, Homo sapiens
ctgtagaaatacaca

SEQ ID NO: 314883 - DNA, 15 bp, Homo sapiens
tgtagaaatacacag

SEQ ID NO: 314884 - DNA, 15 bp, Homo sapiens
gtagaaatacacagt

SEQ ID NO: 314885 - DNA, 15 bp, Homo sapiens
tagaaatacacagtg

SEQ ID NO: 314886 - DNA, 15 bp, Homo sapiens
agaaatacacagtga

SEQ ID NO: 314887 - DNA, 15 bp, Homo sapiens
gaaatacacagtgaa

SEQ ID NO: 314888 - DNA, 15 bp, Homo sapiens
aaatacacagtgaaa

SEQ ID NO: 314889 - DNA, 15 bp, Homo sapiens
aatacacagtgaaaa

SEQ ID NO: 314890 - DNA, 15 bp, Homo sapiens
atacacagtgaaaat

SEQ ID NO: 314891 - DNA, 15 bp, Homo sapiens
tacacagtgaaaata

SEQ ID NO: 314892 - DNA, 15 bp, Homo sapiens
acacagtgaaaataa

SEQ ID NO: 314893 - DNA, 15 bp, Homo sapiens
cacagtgaaaataag

SEQ ID NO: 314894 - DNA, 15 bp, Homo sapiens
acagtgaaaataaga

SEQ ID NO: 314895 - DNA, 15 bp, Homo sapiens
cagtgaaaataagat

SEQ ID NO: 314896 - DNA, 15 bp, Homo sapiens
agtgaaaataagatc

SEQ ID NO: 314897 - DNA, 15 bp, Homo sapiens
gtgaaaataagatct

SEQ ID NO: 314898 - DNA, 15 bp, Homo sapiens
tgaaaataagatcta

SEQ ID NO: 314899 - DNA, 15 bp, Homo sapiens
gaaaataagatctaa

SEQ ID NO: 314900 - DNA, 15 bp, Homo sapiens
aaaataagatctaaa

SEQ ID NO: 314901 - DNA, 15 bp, Homo sapiens
aaataagatctaaat

SEQ ID NO: 314902 - DNA, 15 bp, Homo sapiens
aataagatctaaatt

SEQ ID NO: 314903 - DNA, 15 bp, Homo sapiens
ataagatctaaatta

SEQ ID NO: 314904 - DNA, 15 bp, Homo sapiens
taagatctaaattaa

SEQ ID NO: 314905 - DNA, 15 bp, Homo sapiens
aagatctaaattaac

SEQ ID NO: 314906 - DNA, 15 bp, Homo sapiens
agatctaaattaact

SEQ ID NO: 314907 - DNA, 15 bp, Homo sapiens
gatctaaattaactg

SEQ ID NO: 314908 - DNA, 15 bp, Homo sapiens
atctaaattaactgt

SEQ ID NO: 314909 - DNA, 15 bp, Homo sapiens
tctaaattaactgtc

SEQ ID NO: 314910 - DNA, 15 bp, Homo sapiens
ctaaattaactgtct

SEQ ID NO: 314911 - DNA, 15 bp, Homo sapiens
taaattaactgtctt

SEQ ID NO: 314912 - DNA, 15 bp, Homo sapiens
aaattaactgtctta

SEQ ID NO: 314913 - DNA, 15 bp, Homo sapiens
aattaactgtcttaa

SEQ ID NO: 314914 - DNA, 15 bp, Homo sapiens
attaactgtcttaaa

SEQ ID NO: 314915 - DNA, 15 bp, Homo sapiens
ttaactgtcttaaaa

SEQ ID NO: 314916 - DNA, 15 bp, Homo sapiens
taactgtcttaaaat

SEQ ID NO: 314917 - DNA, 15 bp, Homo sapiens
aactgtcttaaaata

SEQ ID NO: 314918 - DNA, 15 bp, Homo sapiens
actgtcttaaaatac

SEQ ID NO: 314919 - DNA, 15 bp, Homo sapiens
ctgtcttaaaataca

SEQ ID NO: 314920 - DNA, 15 bp, Homo sapiens
tgtcttaaaatacac

SEQ ID NO: 314921 - DNA, 15 bp, Homo sapiens
gtcttaaaatacaca

SEQ ID NO: 314922 - DNA, 15 bp, Homo sapiens
tcttaaaatacacat

SEQ ID NO: 314923 - DNA, 15 bp, Homo sapiens
cttaaaatacacatt

SEQ ID NO: 314924 - DNA, 15 bp, Homo sapiens
ttaaaatacacattt

SEQ ID NO: 314925 - DNA, 15 bp, Homo sapiens
taaaatacacatttt

SEQ ID NO: 314926 - DNA, 15 bp, Homo sapiens
aaaatacacattttc

SEQ ID NO: 314927 - DNA, 15 bp, Homo sapiens
aaatacacattttcc

SEQ ID NO: 314928 - DNA, 15 bp, Homo sapiens
aatacacattttcct

SEQ ID NO: 314929 - DNA, 15 bp, Homo sapiens
atacacattttcctc

SEQ ID NO: 314930 - DNA, 15 bp, Homo sapiens
tacacattttcctcc

SEQ ID NO: 314931 - DNA, 15 bp, Homo sapiens
acacattttcctcca

SEQ ID NO: 314932 - DNA, 15 bp, Homo sapiens
cacattttcctccat

SEQ ID NO: 314933 - DNA, 15 bp, Homo sapiens
acattttcctccatg

SEQ ID NO: 314934 - DNA, 15 bp, Homo sapiens
cattttcctccatga

SEQ ID NO: 314935 - DNA, 15 bp, Homo sapiens
attttcctccatgat

SEQ ID NO: 314936 - DNA, 15 bp, Homo sapiens
ttttcctccatgata

SEQ ID NO: 314937 - DNA, 15 bp, Homo sapiens
tttcctccatgatac

SEQ ID NO: 314938 - DNA, 15 bp, Homo sapiens
ttcctccatgatacc

SEQ ID NO: 314939 - DNA, 15 bp, Homo sapiens
tcctccatgataccg

SEQ ID NO: 314940 - DNA, 15 bp, Homo sapiens
cctccatgataccgg

SEQ ID NO: 314941 - DNA, 15 bp, Homo sapiens
ctccatgataccggt

SEQ ID NO: 314942 - DNA, 15 bp, Homo sapiens
tccatgataccggtg

SEQ ID NO: 314943 - DNA, 15 bp, Homo sapiens
ccatgataccggtgt

SEQ ID NO: 314944 - DNA, 15 bp, Homo sapiens
catgataccggtgtt

SEQ ID NO: 314945 - DNA, 15 bp, Homo sapiens
atgataccggtgttg

SEQ ID NO: 314946 - DNA, 15 bp, Homo sapiens
tgataccggtgttgg

SEQ ID NO: 314947 - DNA, 15 bp, Homo sapiens
gataccggtgttggt

SEQ ID NO: 314948 - DNA, 15 bp, Homo sapiens
ataccggtgttggtt

SEQ ID NO: 314949 - DNA, 15 bp, Homo sapiens
taccggtgttggttg

SEQ ID NO: 314950 - DNA, 15 bp, Homo sapiens
accggtgttggttga

SEQ ID NO: 314951 - DNA, 15 bp, Homo sapiens
ccggtgttggttgat

SEQ ID NO: 314952 - DNA, 15 bp, Homo sapiens
cggtgttggttgatt

SEQ ID NO: 314953 - DNA, 15 bp, Homo sapiens
ggtgttggttgattg

SEQ ID NO: 314954 - DNA, 15 bp, Homo sapiens
gtgttggttgattga

SEQ ID NO: 314955 - DNA, 15 bp, Homo sapiens
tgttggttgattgat

SEQ ID NO: 314956 - DNA, 15 bp, Homo sapiens
gttggttgattgata

SEQ ID NO: 314957 - DNA, 15 bp, Homo sapiens
ttggttgattgataa

SEQ ID NO: 314958 - DNA, 15 bp, Homo sapiens
tggttgattgataaa

SEQ ID NO: 314959 - DNA, 15 bp, Homo sapiens
ggttgattgataaag

SEQ ID NO: 314960 - DNA, 15 bp, Homo sapiens
gttgattgataaaga

SEQ ID NO: 314961 - DNA, 15 bp, Homo sapiens
ttgattgataaagat

SEQ ID NO: 314962 - DNA, 15 bp, Homo sapiens
tgattgataaagatt

SEQ ID NO: 314963 - DNA, 15 bp, Homo sapiens
gattgataaagattt

SEQ ID NO: 314964 - DNA, 15 bp, Homo sapiens
attgataaagatttt

SEQ ID NO: 314965 - DNA, 15 bp, Homo sapiens
ttgataaagatttta

SEQ ID NO: 314966 - DNA, 15 bp, Homo sapiens
tgataaagattttag

SEQ ID NO: 314967 - DNA, 15 bp, Homo sapiens
gataaagattttagt

SEQ ID NO: 314968 - DNA, 15 bp, Homo sapiens
ataaagattttagtt

SEQ ID NO: 314969 - DNA, 15 bp, Homo sapiens
taaagattttagtta

SEQ ID NO: 314970 - DNA, 15 bp, Homo sapiens
aaagattttagttat

SEQ ID NO: 314971 - DNA, 15 bp, Homo sapiens
aagattttagttatt

SEQ ID NO: 314972 - DNA, 15 bp, Homo sapiens
agattttagttatta

SEQ ID NO: 314973 - DNA, 15 bp, Homo sapiens
gattttagttattac

SEQ ID NO: 314974 - DNA, 15 bp, Homo sapiens
attttagttattaca

SEQ ID NO: 314975 - DNA, 15 bp, Homo sapiens
ttttagttattacag

SEQ ID NO: 314976 - DNA, 15 bp, Homo sapiens
tttagttattacaga

SEQ ID NO: 314977 - DNA, 15 bp, Homo sapiens
ttagttattacagat

SEQ ID NO: 314978 - DNA, 15 bp, Homo sapiens
tagttattacagatt

SEQ ID NO: 314979 - DNA, 15 bp, Homo sapiens
agttattacagattt

SEQ ID NO: 314980 - DNA, 15 bp, Homo sapiens
gttattacagatttg

SEQ ID NO: 314981 - DNA, 15 bp, Homo sapiens
ttattacagatttgg

SEQ ID NO: 314982 - DNA, 15 bp, Homo sapiens
tattacagatttggc

SEQ ID NO: 314983 - DNA, 15 bp, Homo sapiens
attacagatttggct

SEQ ID NO: 314984 - DNA, 15 bp, Homo sapiens
ttacagatttggctg

SEQ ID NO: 314985 - DNA, 15 bp, Homo sapiens
tacagatttggctgt

SEQ ID NO: 314986 - DNA, 15 bp, Homo sapiens
acagatttggctgta

SEQ ID NO: 314987 - DNA, 15 bp, Homo sapiens
cagatttggctgtaa

SEQ ID NO: 314988 - DNA, 15 bp, Homo sapiens
agatttggctgtaaa

SEQ ID NO: 314989 - DNA, 15 bp, Homo sapiens
gatttggctgtaaat

SEQ ID NO: 314990 - DNA, 15 bp, Homo sapiens
atttggctgtaaata

SEQ ID NO: 314991 - DNA, 15 bp, Homo sapiens
tttggctgtaaatat

SEQ ID NO: 314992 - DNA, 15 bp, Homo sapiens
ttggctgtaaatatg

SEQ ID NO: 314993 - DNA, 15 bp, Homo sapiens
tggctgtaaatatgt

SEQ ID NO: 314994 - DNA, 15 bp, Homo sapiens
ggctgtaaatatgta

SEQ ID NO: 314995 - DNA, 15 bp, Homo sapiens
gctgtaaatatgtag

SEQ ID NO: 314996 - DNA, 15 bp, Homo sapiens
ctgtaaatatgtagc

SEQ ID NO: 314997 - DNA, 15 bp, Homo sapiens
tgtaaatatgtagca

SEQ ID NO: 314998 - DNA, 15 bp, Homo sapiens
gtaaatatgtagcaa

SEQ ID NO: 314999 - DNA, 15 bp, Homo sapiens
taaatatgtagcaac

SEQ ID NO: 315000 - DNA, 15 bp, Homo sapiens
aaatatgtagcaact

SEQ ID NO: 315001 - DNA, 15 bp, Homo sapiens
aatatgtagcaacta

SEQ ID NO: 315002 - DNA, 15 bp, Homo sapiens
atatgtagcaactat

SEQ ID NO: 315003 - DNA, 15 bp, Homo sapiens
tatgtagcaactatt

SEQ ID NO: 315004 - DNA, 15 bp, Homo sapiens
atgtagcaactattg

SEQ ID NO: 315005 - DNA, 15 bp, Homo sapiens
tgtagcaactattgt

SEQ ID NO: 315006 - DNA, 15 bp, Homo sapiens
gtagcaactattgtg

SEQ ID NO: 315007 - DNA, 15 bp, Homo sapiens
tagcaactattgtgt

SEQ ID NO: 315008 - DNA, 15 bp, Homo sapiens
agcaactattgtgta

SEQ ID NO: 315009 - DNA, 15 bp, Homo sapiens
gcaactattgtgtag

SEQ ID NO: 315010 - DNA, 15 bp, Homo sapiens
caactattgtgtagc

SEQ ID NO: 315011 - DNA, 15 bp, Homo sapiens
aactattgtgtagct

SEQ ID NO: 315012 - DNA, 15 bp, Homo sapiens
actattgtgtagctt

SEQ ID NO: 315013 - DNA, 15 bp, Homo sapiens
ctattgtgtagcttg

SEQ ID NO: 315014 - DNA, 15 bp, Homo sapiens
tattgtgtagcttga

SEQ ID NO: 315015 - DNA, 15 bp, Homo sapiens
attgtgtagcttgac

SEQ ID NO: 315016 - DNA, 15 bp, Homo sapiens
ttgtgtagcttgacg

SEQ ID NO: 315017 - DNA, 15 bp, Homo sapiens
tgtgtagcttgacgg

SEQ ID NO: 315018 - DNA, 15 bp, Homo sapiens
gtgtagcttgacggg

SEQ ID NO: 315019 - DNA, 15 bp, Homo sapiens
tgtagcttgacgggt

SEQ ID NO: 315020 - DNA, 15 bp, Homo sapiens
gtagcttgacgggtc

SEQ ID NO: 315021 - DNA, 15 bp, Homo sapiens
tagcttgacgggtct

SEQ ID NO: 315022 - DNA, 15 bp, Homo sapiens
agcttgacgggtctt

SEQ ID NO: 315023 - DNA, 15 bp, Homo sapiens
gcttgacgggtcttt

SEQ ID NO: 315024 - DNA, 15 bp, Homo sapiens
cttgacgggtctttt

SEQ ID NO: 315025 - DNA, 15 bp, Homo sapiens
ttgacgggtcttttg

SEQ ID NO: 315026 - DNA, 15 bp, Homo sapiens
tgacgggtcttttga

SEQ ID NO: 315027 - DNA, 15 bp, Homo sapiens
gacgggtcttttgaa

SEQ ID NO: 315028 - DNA, 15 bp, Homo sapiens
acgggtcttttgaag

SEQ ID NO: 315029 - DNA, 15 bp, Homo sapiens
cgggtcttttgaagg

SEQ ID NO: 315030 - DNA, 15 bp, Homo sapiens
gggtcttttgaaggt

SEQ ID NO: 315031 - DNA, 15 bp, Homo sapiens
ggtcttttgaaggta

SEQ ID NO: 315032 - DNA, 15 bp, Homo sapiens
gtcttttgaaggtat

SEQ ID NO: 315033 - DNA, 15 bp, Homo sapiens
tcttttgaaggtata

SEQ ID NO: 315034 - DNA, 15 bp, Homo sapiens
cttttgaaggtatag

SEQ ID NO: 315035 - DNA, 15 bp, Homo sapiens
ttttgaaggtatagc

SEQ ID NO: 315036 - DNA, 15 bp, Homo sapiens
tttgaaggtatagct

SEQ ID NO: 315037 - DNA, 15 bp, Homo sapiens
ttgaaggtatagctt

SEQ ID NO: 315038 - DNA, 15 bp, Homo sapiens
tgaaggtatagctta

SEQ ID NO: 315039 - DNA, 15 bp, Homo sapiens
gaaggtatagcttaa

SEQ ID NO: 315040 - DNA, 15 bp, Homo sapiens
aaggtatagcttaat

SEQ ID NO: 315041 - DNA, 15 bp, Homo sapiens
aggtatagcttaata

SEQ ID NO: 315042 - DNA, 15 bp, Homo sapiens
ggtatagcttaatat

SEQ ID NO: 315043 - DNA, 15 bp, Homo sapiens
gtatagcttaatatc

SEQ ID NO: 315044 - DNA, 15 bp, Homo sapiens
tatagcttaatatct

SEQ ID NO: 315045 - DNA, 15 bp, Homo sapiens
atagcttaatatctt

SEQ ID NO: 315046 - DNA, 15 bp, Homo sapiens
tagcttaatatcttg

SEQ ID NO: 315047 - DNA, 15 bp, Homo sapiens
agcttaatatcttgt

SEQ ID NO: 315048 - DNA, 15 bp, Homo sapiens
gcttaatatcttgtt

SEQ ID NO: 315049 - DNA, 15 bp, Homo sapiens
cttaatatcttgttt

SEQ ID NO: 315050 - DNA, 15 bp, Homo sapiens
ttaatatcttgtttt

SEQ ID NO: 315051 - DNA, 15 bp, Homo sapiens
taatatcttgtttta

SEQ ID NO: 315052 - DNA, 15 bp, Homo sapiens
aatatcttgttttaa

SEQ ID NO: 315053 - DNA, 15 bp, Homo sapiens
atatcttgttttaaa

SEQ ID NO: 315054 - DNA, 15 bp, Homo sapiens
tatcttgttttaaaa

SEQ ID NO: 315055 - DNA, 15 bp, Homo sapiens
atcttgttttaaaat

SEQ ID NO: 315056 - DNA, 15 bp, Homo sapiens
tcttgttttaaaata

SEQ ID NO: 315057 - DNA, 15 bp, Homo sapiens
cttgttttaaaatat

SEQ ID NO: 315058 - DNA, 15 bp, Homo sapiens
ttgttttaaaatatg

SEQ ID NO: 315059 - DNA, 15 bp, Homo sapiens
tgttttaaaatatgc

SEQ ID NO: 315060 - DNA, 15 bp, Homo sapiens
gttttaaaatatgct

SEQ ID NO: 315061 - DNA, 15 bp, Homo sapiens
ttttaaaatatgctt

SEQ ID NO: 315062 - DNA, 15 bp, Homo sapiens
tttaaaatatgcttt

SEQ ID NO: 315063 - DNA, 15 bp, Homo sapiens
ttaaaatatgctttg

SEQ ID NO: 315064 - DNA, 15 bp, Homo sapiens
taaaatatgctttga

SEQ ID NO: 315065 - DNA, 15 bp, Homo sapiens
aaaatatgctttgag

SEQ ID NO: 315066 - DNA, 15 bp, Homo sapiens
aaatatgctttgagg

SEQ ID NO: 315067 - DNA, 15 bp, Homo sapiens
aatatgctttgagga

SEQ ID NO: 315068 - DNA, 15 bp, Homo sapiens
atatgctttgaggat

SEQ ID NO: 315069 - DNA, 15 bp, Homo sapiens
tatgctttgaggatg

SEQ ID NO: 315070 - DNA, 15 bp, Homo sapiens
atgctttgaggatgt

SEQ ID NO: 315071 - DNA, 15 bp, Homo sapiens
tgctttgaggatgtt

SEQ ID NO: 315072 - DNA, 15 bp, Homo sapiens
gctttgaggatgttc

SEQ ID NO: 315073 - DNA, 15 bp, Homo sapiens
ctttgaggatgttct

SEQ ID NO: 315074 - DNA, 15 bp, Homo sapiens
tttgaggatgttctc

SEQ ID NO: 315075 - DNA, 15 bp, Homo sapiens
ttgaggatgttctct

SEQ ID NO: 315076 - DNA, 15 bp, Homo sapiens
tgaggatgttctctt

SEQ ID NO: 315077 - DNA, 15 bp, Homo sapiens
gaggatgttctcttc

SEQ ID NO: 315078 - DNA, 15 bp, Homo sapiens
aggatgttctcttcc

SEQ ID NO: 315079 - DNA, 15 bp, Homo sapiens
ggatgttctcttcct

SEQ ID NO: 315080 - DNA, 15 bp, Homo sapiens
gatgttctcttcctg

SEQ ID NO: 315081 - DNA, 15 bp, Homo sapiens
atgttctcttcctgt

SEQ ID NO: 315082 - DNA, 15 bp, Homo sapiens
tgttctcttcctgta

SEQ ID NO: 315083 - DNA, 15 bp, Homo sapiens
gttctcttcctgtaa

SEQ ID NO: 315084 - DNA, 15 bp, Homo sapiens
ttctcttcctgtaaa

SEQ ID NO: 315085 - DNA, 15 bp, Homo sapiens
tctcttcctgtaaaa

SEQ ID NO: 315086 - DNA, 15 bp, Homo sapiens
ctcttcctgtaaaat

SEQ ID NO: 315087 - DNA, 15 bp, Homo sapiens
tcttcctgtaaaatt

SEQ ID NO: 315088 - DNA, 15 bp, Homo sapiens
cttcctgtaaaattc

SEQ ID NO: 315089 - DNA, 15 bp, Homo sapiens
ttcctgtaaaattct

SEQ ID NO: 315090 - DNA, 15 bp, Homo sapiens
tcctgtaaaattctt

SEQ ID NO: 315091 - DNA, 15 bp, Homo sapiens
cctgtaaaattcttt

SEQ ID NO: 315092 - DNA, 15 bp, Homo sapiens
ctgtaaaattctttt

SEQ ID NO: 315093 - DNA, 15 bp, Homo sapiens
tgtaaaattcttttt

SEQ ID NO: 315094 - DNA, 15 bp, Homo sapiens
gtaaaattctttttg

SEQ ID NO: 315095 - DNA, 15 bp, Homo sapiens
taaaattctttttgt

SEQ ID NO: 315096 - DNA, 15 bp, Homo sapiens
aaaattctttttgtt

SEQ ID NO: 315097 - DNA, 15 bp, Homo sapiens
aaattctttttgttt

SEQ ID NO: 315098 - DNA, 15 bp, Homo sapiens
aattctttttgtttt

SEQ ID NO: 315099 - DNA, 15 bp, Homo sapiens
attctttttgtttta

SEQ ID NO: 315100 - DNA, 15 bp, Homo sapiens
ttctttttgttttaa

SEQ ID NO: 315101 - DNA, 15 bp, Homo sapiens
tctttttgttttaaa

SEQ ID NO: 315102 - DNA, 15 bp, Homo sapiens
ctttttgttttaaat

SEQ ID NO: 315103 - DNA, 15 bp, Homo sapiens
tttttgttttaaatg

SEQ ID NO: 315104 - DNA, 15 bp, Homo sapiens
ttttgttttaaatgt

SEQ ID NO: 315105 - DNA, 15 bp, Homo sapiens
tttgttttaaatgtt

SEQ ID NO: 315106 - DNA, 15 bp, Homo sapiens
ttgttttaaatgttt

SEQ ID NO: 315107 - DNA, 15 bp, Homo sapiens
tgttttaaatgtttt

SEQ ID NO: 315108 - DNA, 15 bp, Homo sapiens
gttttaaatgtttta

SEQ ID NO: 315109 - DNA, 15 bp, Homo sapiens
ttttaaatgttttag

SEQ ID NO: 315110 - DNA, 15 bp, Homo sapiens
tttaaatgttttagt

SEQ ID NO: 315111 - DNA, 15 bp, Homo sapiens
ttaaatgttttagtg

SEQ ID NO: 315112 - DNA, 15 bp, Homo sapiens
taaatgttttagtgg

SEQ ID NO: 315113 - DNA, 15 bp, Homo sapiens
aaatgttttagtggt

SEQ ID NO: 315114 - DNA, 15 bp, Homo sapiens
aatgttttagtggta

SEQ ID NO: 315115 - DNA, 15 bp, Homo sapiens
atgttttagtggtat

SEQ ID NO: 315116 - DNA, 15 bp, Homo sapiens
tgttttagtggtata

SEQ ID NO: 315117 - DNA, 15 bp, Homo sapiens
gttttagtggtataa

SEQ ID NO: 315118 - DNA, 15 bp, Homo sapiens
ttttagtggtataag

SEQ ID NO: 315119 - DNA, 15 bp, Homo sapiens
tttagtggtataagg

SEQ ID NO: 315120 - DNA, 15 bp, Homo sapiens
ttagtggtataaggt

SEQ ID NO: 315121 - DNA, 15 bp, Homo sapiens
tagtggtataaggta

SEQ ID NO: 315122 - DNA, 15 bp, Homo sapiens
agtggtataaggtac

SEQ ID NO: 315123 - DNA, 15 bp, Homo sapiens
gtggtataaggtact

SEQ ID NO: 315124 - DNA, 15 bp, Homo sapiens
tggtataaggtacta

SEQ ID NO: 315125 - DNA, 15 bp, Homo sapiens
ggtataaggtactac

SEQ ID NO: 315126 - DNA, 15 bp, Homo sapiens
gtataaggtactaca

SEQ ID NO: 315127 - DNA, 15 bp, Homo sapiens
tataaggtactacaa

SEQ ID NO: 315128 - DNA, 15 bp, Homo sapiens
ataaggtactacaaa

SEQ ID NO: 315129 - DNA, 15 bp, Homo sapiens
taaggtactacaaaa

SEQ ID NO: 315130 - DNA, 15 bp, Homo sapiens
aaggtactacaaaaa

SEQ ID NO: 315131 - DNA, 15 bp, Homo sapiens
aggtactacaaaaat

SEQ ID NO: 315132 - DNA, 15 bp, Homo sapiens
ggtactacaaaaatg

SEQ ID NO: 315133 - DNA, 15 bp, Homo sapiens
gtactacaaaaatgt

SEQ ID NO: 315134 - DNA, 15 bp, Homo sapiens
tactacaaaaatgta

SEQ ID NO: 315135 - DNA, 15 bp, Homo sapiens
actacaaaaatgtaa

SEQ ID NO: 315136 - DNA, 15 bp, Homo sapiens
ctacaaaaatgtaag

SEQ ID NO: 315137 - DNA, 15 bp, Homo sapiens
tacaaaaatgtaagg

SEQ ID NO: 315138 - DNA, 15 bp, Homo sapiens
acaaaaatgtaaggg

SEQ ID NO: 315139 - DNA, 15 bp, Homo sapiens
caaaaatgtaaggga

SEQ ID NO: 315140 - DNA, 15 bp, Homo sapiens
aaaaatgtaagggat

SEQ ID NO: 315141 - DNA, 15 bp, Homo sapiens
aaaatgtaagggatt

SEQ ID NO: 315142 - DNA, 15 bp, Homo sapiens
aaatgtaagggatta

SEQ ID NO: 315143 - DNA, 15 bp, Homo sapiens
aatgtaagggattat

SEQ ID NO: 315144 - DNA, 15 bp, Homo sapiens
atgtaagggattatt

SEQ ID NO: 315145 - DNA, 15 bp, Homo sapiens
tgtaagggattatta

SEQ ID NO: 315146 - DNA, 15 bp, Homo sapiens
gtaagggattattaa

SEQ ID NO: 315147 - DNA, 15 bp, Homo sapiens
taagggattattaat

SEQ ID NO: 315148 - DNA, 15 bp, Homo sapiens
aagggattattaata

SEQ ID NO: 315149 - DNA, 15 bp, Homo sapiens
agggattattaatat

SEQ ID NO: 315150 - DNA, 15 bp, Homo sapiens
gggattattaatatc

SEQ ID NO: 315151 - DNA, 15 bp, Homo sapiens
ggattattaatatca

SEQ ID NO: 315152 - DNA, 15 bp, Homo sapiens
gattattaatatcat

SEQ ID NO: 315153 - DNA, 15 bp, Homo sapiens
attattaatatcatc

SEQ ID NO: 315154 - DNA, 15 bp, Homo sapiens
ttattaatatcatct

SEQ ID NO: 315155 - DNA, 15 bp, Homo sapiens
tattaatatcatctt

SEQ ID NO: 315156 - DNA, 15 bp, Homo sapiens
attaatatcatctta

SEQ ID NO: 315157 - DNA, 15 bp, Homo sapiens
ttaatatcatcttag

SEQ ID NO: 315158 - DNA, 15 bp, Homo sapiens
taatatcatcttagg

SEQ ID NO: 315159 - DNA, 15 bp, Homo sapiens
aatatcatcttagga

SEQ ID NO: 315160 - DNA, 15 bp, Homo sapiens
atatcatcttaggag

SEQ ID NO: 315161 - DNA, 15 bp, Homo sapiens
tatcatcttaggagt

SEQ ID NO: 315162 - DNA, 15 bp, Homo sapiens
atcatcttaggagta

SEQ ID NO: 315163 - DNA, 15 bp, Homo sapiens
tcatcttaggagtac

SEQ ID NO: 315164 - DNA, 15 bp, Homo sapiens
catcttaggagtacg

SEQ ID NO: 315165 - DNA, 15 bp, Homo sapiens
atcttaggagtacgg

SEQ ID NO: 315166 - DNA, 15 bp, Homo sapiens
tcttaggagtacgga

SEQ ID NO: 315167 - DNA, 15 bp, Homo sapiens
cttaggagtacggaa

SEQ ID NO: 315168 - DNA, 15 bp, Homo sapiens
ttaggagtacggaat

SEQ ID NO: 315169 - DNA, 15 bp, Homo sapiens
taggagtacggaata

SEQ ID NO: 315170 - DNA, 15 bp, Homo sapiens
aggagtacggaatac

SEQ ID NO: 315171 - DNA, 15 bp, Homo sapiens
ggagtacggaataca

SEQ ID NO: 315172 - DNA, 15 bp, Homo sapiens
gagtacggaatacat

SEQ ID NO: 315173 - DNA, 15 bp, Homo sapiens
agtacggaatacata

SEQ ID NO: 315174 - DNA, 15 bp, Homo sapiens
gtacggaatacatat

SEQ ID NO: 315175 - DNA, 15 bp, Homo sapiens
tacggaatacatatt

SEQ ID NO: 315176 - DNA, 15 bp, Homo sapiens
acggaatacatattc

SEQ ID NO: 315177 - DNA, 15 bp, Homo sapiens
cggaatacatattca

SEQ ID NO: 315178 - DNA, 15 bp, Homo sapiens
ggaatacatattcag

SEQ ID NO: 315179 - DNA, 15 bp, Homo sapiens
gaatacatattcaga

SEQ ID NO: 315180 - DNA, 15 bp, Homo sapiens
aatacatattcagac

SEQ ID NO: 315181 - DNA, 15 bp, Homo sapiens
atacatattcagaca

SEQ ID NO: 315182 - DNA, 15 bp, Homo sapiens
tacatattcagacat

SEQ ID NO: 315183 - DNA, 15 bp, Homo sapiens
acatattcagacata

SEQ ID NO: 315184 - DNA, 15 bp, Homo sapiens
catattcagacatat

SEQ ID NO: 315185 - DNA, 15 bp, Homo sapiens
atattcagacatatg

SEQ ID NO: 315186 - DNA, 15 bp, Homo sapiens
tattcagacatatgt

SEQ ID NO: 315187 - DNA, 15 bp, Homo sapiens
attcagacatatgta

SEQ ID NO: 315188 - DNA, 15 bp, Homo sapiens
ttcagacatatgtaa

SEQ ID NO: 315189 - DNA, 15 bp, Homo sapiens
tcagacatatgtaaa

SEQ ID NO: 315190 - DNA, 15 bp, Homo sapiens
cagacatatgtaaat

SEQ ID NO: 315191 - DNA, 15 bp, Homo sapiens
agacatatgtaaata

SEQ ID NO: 315192 - DNA, 15 bp, Homo sapiens
gacatatgtaaatat

SEQ ID NO: 315193 - DNA, 15 bp, Homo sapiens
acatatgtaaatata

SEQ ID NO: 315194 - DNA, 15 bp, Homo sapiens
catatgtaaatataa

SEQ ID NO: 315195 - DNA, 15 bp, Homo sapiens
atatgtaaatataac

SEQ ID NO: 315196 - DNA, 15 bp, Homo sapiens
tatgtaaatataaca

SEQ ID NO: 315197 - DNA, 15 bp, Homo sapiens
atgtaaatataacag

SEQ ID NO: 315198 - DNA, 15 bp, Homo sapiens
tgtaaatataacaga

SEQ ID NO: 315199 - DNA, 15 bp, Homo sapiens
gtaaatataacagag

SEQ ID NO: 315200 - DNA, 15 bp, Homo sapiens
taaatataacagagg

SEQ ID NO: 315201 - DNA, 15 bp, Homo sapiens
aaatataacagagga

SEQ ID NO: 315202 - DNA, 15 bp, Homo sapiens
aatataacagaggaa

SEQ ID NO: 315203 - DNA, 15 bp, Homo sapiens
atataacagaggaaa

SEQ ID NO: 315204 - DNA, 15 bp, Homo sapiens
tataacagaggaaaa

SEQ ID NO: 315205 - DNA, 15 bp, Homo sapiens
ataacagaggaaaat

SEQ ID NO: 315206 - DNA, 15 bp, Homo sapiens
taacagaggaaaatg

SEQ ID NO: 315207 - DNA, 15 bp, Homo sapiens
aacagaggaaaatgg

SEQ ID NO: 315208 - DNA, 15 bp, Homo sapiens
acagaggaaaatgga

SEQ ID NO: 315209 - DNA, 15 bp, Homo sapiens
cagaggaaaatggaa

SEQ ID NO: 315210 - DNA, 15 bp, Homo sapiens
agaggaaaatggaag

SEQ ID NO: 315211 - DNA, 15 bp, Homo sapiens
gaggaaaatggaaga

SEQ ID NO: 315212 - DNA, 15 bp, Homo sapiens
aggaaaatggaagag

SEQ ID NO: 315213 - DNA, 15 bp, Homo sapiens
ggaaaatggaagaga

SEQ ID NO: 315214 - DNA, 15 bp, Homo sapiens
gaaaatggaagagag

SEQ ID NO: 315215 - DNA, 15 bp, Homo sapiens
aaaatggaagagaga

SEQ ID NO: 315216 - DNA, 15 bp, Homo sapiens
aaatggaagagagac

SEQ ID NO: 315217 - DNA, 15 bp, Homo sapiens
aatggaagagagacg

SEQ ID NO: 315218 - DNA, 15 bp, Homo sapiens
atggaagagagacga

SEQ ID NO: 315219 - DNA, 15 bp, Homo sapiens
tggaagagagacgat

SEQ ID NO: 315220 - DNA, 15 bp, Homo sapiens
ggaagagagacgatt

SEQ ID NO: 315221 - DNA, 15 bp, Homo sapiens
gaagagagacgattt

SEQ ID NO: 315222 - DNA, 15 bp, Homo sapiens
aagagagacgattta

SEQ ID NO: 315223 - DNA, 15 bp, Homo sapiens
agagagacgatttaa

SEQ ID NO: 315224 - DNA, 15 bp, Homo sapiens
gagagacgatttaat

SEQ ID NO: 315225 - DNA, 15 bp, Homo sapiens
agagacgatttaatg

SEQ ID NO: 315226 - DNA, 15 bp, Homo sapiens
gagacgatttaatgt

SEQ ID NO: 315227 - DNA, 15 bp, Homo sapiens
agacgatttaatgtc

SEQ ID NO: 315228 - DNA, 15 bp, Homo sapiens
gacgatttaatgtct

SEQ ID NO: 315229 - DNA, 15 bp, Homo sapiens
acgatttaatgtctc

SEQ ID NO: 315230 - DNA, 15 bp, Homo sapiens
cgatttaatgtctcc

SEQ ID NO: 315231 - DNA, 15 bp, Homo sapiens
gatttaatgtctcca

SEQ ID NO: 315232 - DNA, 15 bp, Homo sapiens
atttaatgtctccat

SEQ ID NO: 315233 - DNA, 15 bp, Homo sapiens
tttaatgtctccata

SEQ ID NO: 315234 - DNA, 15 bp, Homo sapiens
ttaatgtctccatac

SEQ ID NO: 315235 - DNA, 15 bp, Homo sapiens
taatgtctccatact

SEQ ID NO: 315236 - DNA, 15 bp, Homo sapiens
aatgtctccatacta

SEQ ID NO: 315237 - DNA, 15 bp, Homo sapiens
atgtctccatactag

SEQ ID NO: 315238 - DNA, 15 bp, Homo sapiens
tgtctccatactagt

SEQ ID NO: 315239 - DNA, 15 bp, Homo sapiens
gtctccatactagtc

SEQ ID NO: 315240 - DNA, 15 bp, Homo sapiens
tctccatactagtca

SEQ ID NO: 315241 - DNA, 15 bp, Homo sapiens
ctccatactagtcat

SEQ ID NO: 315242 - DNA, 15 bp, Homo sapiens
tccatactagtcatt

SEQ ID NO: 315243 - DNA, 15 bp, Homo sapiens
ccatactagtcattt

SEQ ID NO: 315244 - DNA, 15 bp, Homo sapiens
catactagtcatttt

SEQ ID NO: 315245 - DNA, 15 bp, Homo sapiens
atactagtcattttc

SEQ ID NO: 315246 - DNA, 15 bp, Homo sapiens
tactagtcattttct

SEQ ID NO: 315247 - DNA, 15 bp, Homo sapiens
actagtcattttcta

SEQ ID NO: 315248 - DNA, 15 bp, Homo sapiens
ctagtcattttctat

SEQ ID NO: 315249 - DNA, 15 bp, Homo sapiens
tagtcattttctata

SEQ ID NO: 315250 - DNA, 15 bp, Homo sapiens
agtcattttctataa

SEQ ID NO: 315251 - DNA, 15 bp, Homo sapiens
gtcattttctataaa

SEQ ID NO: 315252 - DNA, 15 bp, Homo sapiens
tcattttctataaat

SEQ ID NO: 315253 - DNA, 15 bp, Homo sapiens
cattttctataaatt

SEQ ID NO: 315254 - DNA, 15 bp, Homo sapiens
attttctataaattg

SEQ ID NO: 315255 - DNA, 15 bp, Homo sapiens
ttttctataaattgt

SEQ ID NO: 315256 - DNA, 15 bp, Homo sapiens
tttctataaattgtg

SEQ ID NO: 315257 - DNA, 15 bp, Homo sapiens
ttctataaattgtga

SEQ ID NO: 315258 - DNA, 15 bp, Homo sapiens
tctataaattgtgag

SEQ ID NO: 315259 - DNA, 15 bp, Homo sapiens
ctataaattgtgagg

SEQ ID NO: 315260 - DNA, 15 bp, Homo sapiens
tataaattgtgagga

SEQ ID NO: 315261 - DNA, 15 bp, Homo sapiens
ataaattgtgaggag

SEQ ID NO: 315262 - DNA, 15 bp, Homo sapiens
taaattgtgaggagg

SEQ ID NO: 315263 - DNA, 15 bp, Homo sapiens
aaattgtgaggaggt

SEQ ID NO: 315264 - DNA, 15 bp, Homo sapiens
aattgtgaggaggta

SEQ ID NO: 315265 - DNA, 15 bp, Homo sapiens
attgtgaggaggtat

SEQ ID NO: 315266 - DNA, 15 bp, Homo sapiens
ttgtgaggaggtata

SEQ ID NO: 315267 - DNA, 15 bp, Homo sapiens
tgtgaggaggtatat

SEQ ID NO: 315268 - DNA, 15 bp, Homo sapiens
gtgaggaggtatatt

SEQ ID NO: 315269 - DNA, 15 bp, Homo sapiens
tgaggaggtatattc

SEQ ID NO: 315270 - DNA, 15 bp, Homo sapiens
gaggaggtatattcc

SEQ ID NO: 315271 - DNA, 15 bp, Homo sapiens
aggaggtatattcct

SEQ ID NO: 315272 - DNA, 15 bp, Homo sapiens
ggaggtatattccta

SEQ ID NO: 315273 - DNA, 15 bp, Homo sapiens
gaggtatattcctaa

SEQ ID NO: 315274 - DNA, 15 bp, Homo sapiens
aggtatattcctaaa

SEQ ID NO: 315275 - DNA, 15 bp, Homo sapiens
ggtatattcctaaat

SEQ ID NO: 315276 - DNA, 15 bp, Homo sapiens
gtatattcctaaata

SEQ ID NO: 315277 - DNA, 15 bp, Homo sapiens
tatattcctaaatag

SEQ ID NO: 315278 - DNA, 15 bp, Homo sapiens
atattcctaaatagt

SEQ ID NO: 315279 - DNA, 15 bp, Homo sapiens
tattcctaaatagtt

SEQ ID NO: 315280 - DNA, 15 bp, Homo sapiens
attcctaaatagttt

SEQ ID NO: 315281 - DNA, 15 bp, Homo sapiens
ttcctaaatagtttt

SEQ ID NO: 315282 - DNA, 15 bp, Homo sapiens
tcctaaatagttttc

SEQ ID NO: 315283 - DNA, 15 bp, Homo sapiens
cctaaatagttttct

SEQ ID NO: 315284 - DNA, 15 bp, Homo sapiens
ctaaatagttttctg

SEQ ID NO: 315285 - DNA, 15 bp, Homo sapiens
taaatagttttctga

SEQ ID NO: 315286 - DNA, 15 bp, Homo sapiens
aaatagttttctgag

SEQ ID NO: 315287 - DNA, 15 bp, Homo sapiens
aatagttttctgagt

SEQ ID NO: 315288 - DNA, 15 bp, Homo sapiens
atagttttctgagtc

SEQ ID NO: 315289 - DNA, 15 bp, Homo sapiens
tagttttctgagtca

SEQ ID NO: 315290 - DNA, 15 bp, Homo sapiens
agttttctgagtcag

SEQ ID NO: 315291 - DNA, 15 bp, Homo sapiens
gttttctgagtcagc

SEQ ID NO: 315292 - DNA, 15 bp, Homo sapiens
ttttctgagtcagcc

SEQ ID NO: 315293 - DNA, 15 bp, Homo sapiens
tttctgagtcagcct

SEQ ID NO: 315294 - DNA, 15 bp, Homo sapiens
ttctgagtcagcctt

SEQ ID NO: 315295 - DNA, 15 bp, Homo sapiens
tctgagtcagccttc

SEQ ID NO: 315296 - DNA, 15 bp, Homo sapiens
ctgagtcagccttca

SEQ ID NO: 315297 - DNA, 15 bp, Homo sapiens
tgagtcagccttcat

SEQ ID NO: 315298 - DNA, 15 bp, Homo sapiens
gagtcagccttcatt

SEQ ID NO: 315299 - DNA, 15 bp, Homo sapiens
agtcagccttcattc

SEQ ID NO: 315300 - DNA, 15 bp, Homo sapiens
gtcagccttcattct

SEQ ID NO: 315301 - DNA, 15 bp, Homo sapiens
tcagccttcattcta

SEQ ID NO: 315302 - DNA, 15 bp, Homo sapiens
cagccttcattctag

SEQ ID NO: 315303 - DNA, 15 bp, Homo sapiens
agccttcattctagt

SEQ ID NO: 315304 - DNA, 15 bp, Homo sapiens
gccttcattctagta

SEQ ID NO: 315305 - DNA, 15 bp, Homo sapiens
ccttcattctagtaa

SEQ ID NO: 315306 - DNA, 15 bp, Homo sapiens
cttcattctagtaag

SEQ ID NO: 315307 - DNA, 15 bp, Homo sapiens
ttcattctagtaaga

SEQ ID NO: 315308 - DNA, 15 bp, Homo sapiens
tcattctagtaagac

SEQ ID NO: 315309 - DNA, 15 bp, Homo sapiens
cattctagtaagacc

SEQ ID NO: 315310 - DNA, 15 bp, Homo sapiens
attctagtaagacct

SEQ ID NO: 315311 - DNA, 15 bp, Homo sapiens
ttctagtaagacctt

SEQ ID NO: 315312 - DNA, 15 bp, Homo sapiens
tctagtaagaccttt

SEQ ID NO: 315313 - DNA, 15 bp, Homo sapiens
ctagtaagacctttg

SEQ ID NO: 315314 - DNA, 15 bp, Homo sapiens
tagtaagacctttga

SEQ ID NO: 315315 - DNA, 15 bp, Homo sapiens
agtaagacctttgat

SEQ ID NO: 315316 - DNA, 15 bp, Homo sapiens
gtaagacctttgata

SEQ ID NO: 315317 - DNA, 15 bp, Homo sapiens
taagacctttgatat

SEQ ID NO: 315318 - DNA, 15 bp, Homo sapiens
aagacctttgatatt

SEQ ID NO: 315319 - DNA, 15 bp, Homo sapiens
agacctttgatattt

SEQ ID NO: 315320 - DNA, 15 bp, Homo sapiens
gacctttgatattta

SEQ ID NO: 315321 - DNA, 15 bp, Homo sapiens
acctttgatatttat

SEQ ID NO: 315322 - DNA, 15 bp, Homo sapiens
cctttgatatttata

SEQ ID NO: 315323 - DNA, 15 bp, Homo sapiens
ctttgatatttataa

SEQ ID NO: 315324 - DNA, 15 bp, Homo sapiens
tttgatatttataac

SEQ ID NO: 315325 - DNA, 15 bp, Homo sapiens
ttgatatttataact

SEQ ID NO: 315326 - DNA, 15 bp, Homo sapiens
tgatatttataactt

SEQ ID NO: 315327 - DNA, 15 bp, Homo sapiens
gatatttataacttg

SEQ ID NO: 315328 - DNA, 15 bp, Homo sapiens
atatttataacttgt

SEQ ID NO: 315329 - DNA, 15 bp, Homo sapiens
tatttataacttgta

SEQ ID NO: 315330 - DNA, 15 bp, Homo sapiens
atttataacttgtac

SEQ ID NO: 315331 - DNA, 15 bp, Homo sapiens
tttataacttgtact

SEQ ID NO: 315332 - DNA, 15 bp, Homo sapiens
ttataacttgtactt

SEQ ID NO: 315333 - DNA, 15 bp, Homo sapiens
tataacttgtacttt

SEQ ID NO: 315334 - DNA, 15 bp, Homo sapiens
ataacttgtacttta

SEQ ID NO: 315335 - DNA, 15 bp, Homo sapiens
taacttgtactttag

SEQ ID NO: 315336 - DNA, 15 bp, Homo sapiens
aacttgtactttagc

SEQ ID NO: 315337 - DNA, 15 bp, Homo sapiens
acttgtactttagcc

SEQ ID NO: 315338 - DNA, 15 bp, Homo sapiens
cttgtactttagccg

SEQ ID NO: 315339 - DNA, 15 bp, Homo sapiens
ttgtactttagccgt

SEQ ID NO: 315340 - DNA, 15 bp, Homo sapiens
tgtactttagccgtg

SEQ ID NO: 315341 - DNA, 15 bp, Homo sapiens
gtactttagccgtgt

SEQ ID NO: 315342 - DNA, 15 bp, Homo sapiens
tactttagccgtgtc

SEQ ID NO: 315343 - DNA, 15 bp, Homo sapiens
actttagccgtgtcc

SEQ ID NO: 315344 - DNA, 15 bp, Homo sapiens
ctttagccgtgtcca

SEQ ID NO: 315345 - DNA, 15 bp, Homo sapiens
tttagccgtgtccat

SEQ ID NO: 315346 - DNA, 15 bp, Homo sapiens
ttagccgtgtccata

SEQ ID NO: 315347 - DNA, 15 bp, Homo sapiens
tagccgtgtccataa

SEQ ID NO: 315348 - DNA, 15 bp, Homo sapiens
agccgtgtccataaa

SEQ ID NO: 315349 - DNA, 15 bp, Homo sapiens
gccgtgtccataaaa

SEQ ID NO: 315350 - DNA, 15 bp, Homo sapiens
ccgtgtccataaaag

SEQ ID NO: 315351 - DNA, 15 bp, Homo sapiens
cgtgtccataaaaga

SEQ ID NO: 315352 - DNA, 15 bp, Homo sapiens
gtgtccataaaagag

SEQ ID NO: 315353 - DNA, 15 bp, Homo sapiens
tgtccataaaagagt

SEQ ID NO: 315354 - DNA, 15 bp, Homo sapiens
gtccataaaagagta

SEQ ID NO: 315355 - DNA, 15 bp, Homo sapiens
tccataaaagagtaa

SEQ ID NO: 315356 - DNA, 15 bp, Homo sapiens
ccataaaagagtaat

SEQ ID NO: 315357 - DNA, 15 bp, Homo sapiens
cataaaagagtaatt

SEQ ID NO: 315358 - DNA, 15 bp, Homo sapiens
ataaaagagtaatta

SEQ ID NO: 315359 - DNA, 15 bp, Homo sapiens
taaaagagtaattat

SEQ ID NO: 315360 - DNA, 15 bp, Homo sapiens
aaaagagtaattatc

SEQ ID NO: 315361 - DNA, 15 bp, Homo sapiens
aaagagtaattatct

SEQ ID NO: 315362 - DNA, 15 bp, Homo sapiens
aagagtaattatcta

SEQ ID NO: 315363 - DNA, 15 bp, Homo sapiens
agagtaattatctaa

SEQ ID NO: 315364 - DNA, 15 bp, Homo sapiens
gagtaattatctaat

SEQ ID NO: 315365 - DNA, 15 bp, Homo sapiens
agtaattatctaatt

SEQ ID NO: 315366 - DNA, 15 bp, Homo sapiens
gtaattatctaattt

SEQ ID NO: 315367 - DNA, 15 bp, Homo sapiens
taattatctaatttc

SEQ ID NO: 315368 - DNA, 15 bp, Homo sapiens
aattatctaatttca

SEQ ID NO: 315369 - DNA, 15 bp, Homo sapiens
attatctaatttcag

SEQ ID NO: 315370 - DNA, 15 bp, Homo sapiens
ttatctaatttcaga

SEQ ID NO: 315371 - DNA, 15 bp, Homo sapiens
tatctaatttcagaa

SEQ ID NO: 315372 - DNA, 15 bp, Homo sapiens
tctaatttcagaaat

SEQ ID NO: 315373 - DNA, 15 bp, Homo sapiens
ctaatttcagaaata

SEQ ID NO: 315374 - DNA, 15 bp, Homo sapiens
taatttcagaaatac

SEQ ID NO: 315375 - DNA, 15 bp, Homo sapiens
aatttcagaaatacc

SEQ ID NO: 315376 - DNA, 15 bp, Homo sapiens
atttcagaaataccg

SEQ ID NO: 315377 - DNA, 15 bp, Homo sapiens
tttcagaaataccgt

SEQ ID NO: 315378 - DNA, 15 bp, Homo sapiens
ttcagaaataccgtg

SEQ ID NO: 315379 - DNA, 15 bp, Homo sapiens
tcagaaataccgtgt

SEQ ID NO: 315380 - DNA, 15 bp, Homo sapiens
cagaaataccgtgta

SEQ ID NO: 315381 - DNA, 15 bp, Homo sapiens
agaaataccgtgtat

SEQ ID NO: 315382 - DNA, 15 bp, Homo sapiens
gaaataccgtgtata

SEQ ID NO: 315383 - DNA, 15 bp, Homo sapiens
aaataccgtgtatat

SEQ ID NO: 315384 - DNA, 15 bp, Homo sapiens
aataccgtgtatata

SEQ ID NO: 315385 - DNA, 15 bp, Homo sapiens
ataccgtgtatatat

SEQ ID NO: 315386 - DNA, 15 bp, Homo sapiens
taccgtgtatatata

SEQ ID NO: 315387 - DNA, 15 bp, Homo sapiens
accgtgtatatataa

SEQ ID NO: 315388 - DNA, 15 bp, Homo sapiens
ccgtgtatatataat

SEQ ID NO: 315389 - DNA, 15 bp, Homo sapiens
cgtgtatatataatg

SEQ ID NO: 315390 - DNA, 15 bp, Homo sapiens
gtgtatatataatga

SEQ ID NO: 315391 - DNA, 15 bp, Homo sapiens
tgtatatataatgaa

SEQ ID NO: 315392 - DNA, 15 bp, Homo sapiens
gtatatataatgaac

SEQ ID NO: 315393 - DNA, 15 bp, Homo sapiens
tatatataatgaaca

SEQ ID NO: 315394 - DNA, 15 bp, Homo sapiens
atatataatgaacat

SEQ ID NO: 315395 - DNA, 15 bp, Homo sapiens
tatataatgaacata

SEQ ID NO: 315396 - DNA, 15 bp, Homo sapiens
atataatgaacatat

SEQ ID NO: 315397 - DNA, 15 bp, Homo sapiens
tataatgaacatata

SEQ ID NO: 315398 - DNA, 15 bp, Homo sapiens
ataatgaacatataa

SEQ ID NO: 315399 - DNA, 15 bp, Homo sapiens
taatgaacatataaa

SEQ ID NO: 315400 - DNA, 15 bp, Homo sapiens
aatgaacatataaac

SEQ ID NO: 315401 - DNA, 15 bp, Homo sapiens
atgaacatataaact

SEQ ID NO: 315402 - DNA, 15 bp, Homo sapiens
tgaacatataaactc

SEQ ID NO: 315403 - DNA, 15 bp, Homo sapiens
gaacatataaactcc

SEQ ID NO: 315404 - DNA, 15 bp, Homo sapiens
aacatataaactccc

SEQ ID NO: 315405 - DNA, 15 bp, Homo sapiens
acatataaactccca

SEQ ID NO: 315406 - DNA, 15 bp, Homo sapiens
catataaactcccaa

SEQ ID NO: 315407 - DNA, 15 bp, Homo sapiens
atataaactcccaaa

SEQ ID NO: 315408 - DNA, 15 bp, Homo sapiens
tataaactcccaaac

SEQ ID NO: 315409 - DNA, 15 bp, Homo sapiens
ataaactcccaaact

SEQ ID NO: 315410 - DNA, 15 bp, Homo sapiens
taaactcccaaacta

SEQ ID NO: 315411 - DNA, 15 bp, Homo sapiens
aaactcccaaactat

SEQ ID NO: 315412 - DNA, 15 bp, Homo sapiens
aactcccaaactatt

SEQ ID NO: 315413 - DNA, 15 bp, Homo sapiens
actcccaaactattt

SEQ ID NO: 315414 - DNA, 15 bp, Homo sapiens
ctcccaaactatttt

SEQ ID NO: 315415 - DNA, 15 bp, Homo sapiens
tcccaaactatttta

SEQ ID NO: 315416 - DNA, 15 bp, Homo sapiens
cccaaactattttaa

SEQ ID NO: 315417 - DNA, 15 bp, Homo sapiens
ccaaactattttaat

SEQ ID NO: 315418 - DNA, 15 bp, Homo sapiens
caaactattttaatt

SEQ ID NO: 315419 - DNA, 15 bp, Homo sapiens
aaactattttaattt

SEQ ID NO: 315420 - DNA, 15 bp, Homo sapiens
aactattttaattta

SEQ ID NO: 315421 - DNA, 15 bp, Homo sapiens
actattttaatttaa

SEQ ID NO: 315422 - DNA, 15 bp, Homo sapiens
ctattttaatttaaa

SEQ ID NO: 315423 - DNA, 15 bp, Homo sapiens
tattttaatttaaaa

SEQ ID NO: 315424 - DNA, 15 bp, Homo sapiens
attttaatttaaaat

SEQ ID NO: 315425 - DNA, 15 bp, Homo sapiens
ttttaatttaaaatt

SEQ ID NO: 315426 - DNA, 15 bp, Homo sapiens
tttaatttaaaatta

SEQ ID NO: 315427 - DNA, 15 bp, Homo sapiens
ttaatttaaaattat

SEQ ID NO: 315428 - DNA, 15 bp, Homo sapiens
taatttaaaattatc

SEQ ID NO: 315429 - DNA, 15 bp, Homo sapiens
aatttaaaattatct

SEQ ID NO: 315430 - DNA, 15 bp, Homo sapiens
atttaaaattatctt

SEQ ID NO: 315431 - DNA, 15 bp, Homo sapiens
tttaaaattatcttt

SEQ ID NO: 315432 - DNA, 15 bp, Homo sapiens
ttaaaattatctttt

SEQ ID NO: 315433 - DNA, 15 bp, Homo sapiens
taaaattatctttta

SEQ ID NO: 315434 - DNA, 15 bp, Homo sapiens
aaaattatcttttaa

SEQ ID NO: 315435 - DNA, 15 bp, Homo sapiens
aaattatcttttaaa

SEQ ID NO: 315436 - DNA, 15 bp, Homo sapiens
aattatcttttaaaa

SEQ ID NO: 315437 - DNA, 15 bp, Homo sapiens
attatcttttaaaaa

SEQ ID NO: 315438 - DNA, 15 bp, Homo sapiens
ttatcttttaaaaag

SEQ ID NO: 315439 - DNA, 15 bp, Homo sapiens
tatcttttaaaaagg

SEQ ID NO: 315440 - DNA, 15 bp, Homo sapiens
tcttttaaaaaggct

SEQ ID NO: 315441 - DNA, 15 bp, Homo sapiens
cttttaaaaaggctg

SEQ ID NO: 315442 - DNA, 15 bp, Homo sapiens
ttttaaaaaggctga

SEQ ID NO: 315443 - DNA, 15 bp, Homo sapiens
tttaaaaaggctgat

SEQ ID NO: 315444 - DNA, 15 bp, Homo sapiens
ttaaaaaggctgatg

SEQ ID NO: 315445 - DNA, 15 bp, Homo sapiens
taaaaaggctgatga

SEQ ID NO: 315446 - DNA, 15 bp, Homo sapiens
aaaaaggctgatgaa

SEQ ID NO: 315447 - DNA, 15 bp, Homo sapiens
aaaaggctgatgaac

SEQ ID NO: 315448 - DNA, 15 bp, Homo sapiens
aaaggctgatgaacc

SEQ ID NO: 315449 - DNA, 15 bp, Homo sapiens
aaggctgatgaacct

SEQ ID NO: 315450 - DNA, 15 bp, Homo sapiens
aggctgatgaaccta

SEQ ID NO: 315451 - DNA, 15 bp, Homo sapiens
ggctgatgaacctaa

SEQ ID NO: 315452 - DNA, 15 bp, Homo sapiens
gctgatgaacctaaa

SEQ ID NO: 315453 - DNA, 15 bp, Homo sapiens
ctgatgaacctaaaa

SEQ ID NO: 315454 - DNA, 15 bp, Homo sapiens
tgatgaacctaaaat

SEQ ID NO: 315455 - DNA, 15 bp, Homo sapiens
gatgaacctaaaata

SEQ ID NO: 315456 - DNA, 15 bp, Homo sapiens
atgaacctaaaatat

SEQ ID NO: 315457 - DNA, 15 bp, Homo sapiens
tgaacctaaaatatt

SEQ ID NO: 315458 - DNA, 15 bp, Homo sapiens
gaacctaaaatattg

SEQ ID NO: 315459 - DNA, 15 bp, Homo sapiens
aacctaaaatattgc

SEQ ID NO: 315460 - DNA, 15 bp, Homo sapiens
acctaaaatattgct

SEQ ID NO: 315461 - DNA, 15 bp, Homo sapiens
cctaaaatattgctg

SEQ ID NO: 315462 - DNA, 15 bp, Homo sapiens
ctaaaatattgctgg

SEQ ID NO: 315463 - DNA, 15 bp, Homo sapiens
taaaatattgctgga

SEQ ID NO: 315464 - DNA, 15 bp, Homo sapiens
aaaatattgctggag

SEQ ID NO: 315465 - DNA, 15 bp, Homo sapiens
aaatattgctggaga

SEQ ID NO: 315466 - DNA, 15 bp, Homo sapiens
aatattgctggagaa

SEQ ID NO: 315467 - DNA, 15 bp, Homo sapiens
atattgctggagaac

SEQ ID NO: 315468 - DNA, 15 bp, Homo sapiens
tattgctggagaaca

SEQ ID NO: 315469 - DNA, 15 bp, Homo sapiens
attgctggagaacaa

SEQ ID NO: 315470 - DNA, 15 bp, Homo sapiens
ttgctggagaacaat

SEQ ID NO: 315471 - DNA, 15 bp, Homo sapiens
tgctggagaacaatt

SEQ ID NO: 315472 - DNA, 15 bp, Homo sapiens
gctggagaacaattt

SEQ ID NO: 315473 - DNA, 15 bp, Homo sapiens
ctggagaacaatttg

SEQ ID NO: 315474 - DNA, 15 bp, Homo sapiens
tggagaacaatttgg

SEQ ID NO: 315475 - DNA, 15 bp, Homo sapiens
ggagaacaatttggc

SEQ ID NO: 315476 - DNA, 15 bp, Homo sapiens
gagaacaatttggca

SEQ ID NO: 315477 - DNA, 15 bp, Homo sapiens
agaacaatttggcaa

SEQ ID NO: 315478 - DNA, 15 bp, Homo sapiens
gaacaatttggcaaa

SEQ ID NO: 315479 - DNA, 15 bp, Homo sapiens
aacaatttggcaaaa

SEQ ID NO: 315480 - DNA, 15 bp, Homo sapiens
acaatttggcaaaaa

SEQ ID NO: 315481 - DNA, 15 bp, Homo sapiens
caatttggcaaaaat

SEQ ID NO: 315482 - DNA, 15 bp, Homo sapiens
aatttggcaaaaatg

SEQ ID NO: 315483 - DNA, 15 bp, Homo sapiens
atttggcaaaaatga

SEQ ID NO: 315484 - DNA, 15 bp, Homo sapiens
tttggcaaaaatgat

SEQ ID NO: 315485 - DNA, 15 bp, Homo sapiens
ttggcaaaaatgata

SEQ ID NO: 315486 - DNA, 15 bp, Homo sapiens
tggcaaaaatgataa

SEQ ID NO: 315487 - DNA, 15 bp, Homo sapiens
ggcaaaaatgataac

SEQ ID NO: 315488 - DNA, 15 bp, Homo sapiens
gcaaaaatgataaca

SEQ ID NO: 315489 - DNA, 15 bp, Homo sapiens
caaaaatgataacat

SEQ ID NO: 315490 - DNA, 15 bp, Homo sapiens
aaaaatgataacatg

SEQ ID NO: 315491 - DNA, 15 bp, Homo sapiens
aaaatgataacatgt

SEQ ID NO: 315492 - DNA, 15 bp, Homo sapiens
aaatgataacatgtt

SEQ ID NO: 315493 - DNA, 15 bp, Homo sapiens
aatgataacatgttt

SEQ ID NO: 315494 - DNA, 15 bp, Homo sapiens
atgataacatgtttt

SEQ ID NO: 315495 - DNA, 15 bp, Homo sapiens
tgataacatgttttt

SEQ ID NO: 315496 - DNA, 15 bp, Homo sapiens
gataacatgttttta

SEQ ID NO: 315497 - DNA, 15 bp, Homo sapiens
ataacatgtttttaa

SEQ ID NO: 315498 - DNA, 15 bp, Homo sapiens
taacatgtttttaac

SEQ ID NO: 315499 - DNA, 15 bp, Homo sapiens
aacatgtttttaaca

SEQ ID NO: 315500 - DNA, 15 bp, Homo sapiens
acatgtttttaacac

SEQ ID NO: 315501 - DNA, 15 bp, Homo sapiens
catgtttttaacaca

SEQ ID NO: 315502 - DNA, 15 bp, Homo sapiens
atgtttttaacacat

SEQ ID NO: 315503 - DNA, 15 bp, Homo sapiens
tgtttttaacacatg

SEQ ID NO: 315504 - DNA, 15 bp, Homo sapiens
gtttttaacacatgc

SEQ ID NO: 315505 - DNA, 15 bp, Homo sapiens
tttttaacacatgca

SEQ ID NO: 315506 - DNA, 15 bp, Homo sapiens
ttttaacacatgcat

SEQ ID NO: 315507 - DNA, 15 bp, Homo sapiens
tttaacacatgcata

SEQ ID NO: 315508 - DNA, 15 bp, Homo sapiens
ttaacacatgcatat

SEQ ID NO: 315509 - DNA, 15 bp, Homo sapiens
taacacatgcatatc

SEQ ID NO: 315510 - DNA, 15 bp, Homo sapiens
aacacatgcatatca

SEQ ID NO: 315511 - DNA, 15 bp, Homo sapiens
acacatgcatatcaa

SEQ ID NO: 315512 - DNA, 15 bp, Homo sapiens
cacatgcatatcaat

SEQ ID NO: 315513 - DNA, 15 bp, Homo sapiens
acatgcatatcaatt

SEQ ID NO: 315514 - DNA, 15 bp, Homo sapiens
catgcatatcaatta

SEQ ID NO: 315515 - DNA, 15 bp, Homo sapiens
atgcatatcaattaa

SEQ ID NO: 315516 - DNA, 15 bp, Homo sapiens
tgcatatcaattaac

SEQ ID NO: 315517 - DNA, 15 bp, Homo sapiens
gcatatcaattaact

SEQ ID NO: 315518 - DNA, 15 bp, Homo sapiens
catatcaattaactg

SEQ ID NO: 315519 - DNA, 15 bp, Homo sapiens
atatcaattaactga

SEQ ID NO: 315520 - DNA, 15 bp, Homo sapiens
tatcaattaactgag

SEQ ID NO: 315521 - DNA, 15 bp, Homo sapiens
atcaattaactgagt

SEQ ID NO: 315522 - DNA, 15 bp, Homo sapiens
tcaattaactgagta

SEQ ID NO: 315523 - DNA, 15 bp, Homo sapiens
caattaactgagtaa

SEQ ID NO: 315524 - DNA, 15 bp, Homo sapiens
aattaactgagtaat

SEQ ID NO: 315525 - DNA, 15 bp, Homo sapiens
attaactgagtaatt

SEQ ID NO: 315526 - DNA, 15 bp, Homo sapiens
ttaactgagtaattc

SEQ ID NO: 315527 - DNA, 15 bp, Homo sapiens
taactgagtaattct

SEQ ID NO: 315528 - DNA, 15 bp, Homo sapiens
aactgagtaattctg

SEQ ID NO: 315529 - DNA, 15 bp, Homo sapiens
actgagtaattctgt

SEQ ID NO: 315530 - DNA, 15 bp, Homo sapiens
ctgagtaattctgtt

SEQ ID NO: 315531 - DNA, 15 bp, Homo sapiens
tgagtaattctgttt

SEQ ID NO: 315532 - DNA, 15 bp, Homo sapiens
gagtaattctgtttc

SEQ ID NO: 315533 - DNA, 15 bp, Homo sapiens
agtaattctgtttct

SEQ ID NO: 315534 - DNA, 15 bp, Homo sapiens
gtaattctgtttcta

SEQ ID NO: 315535 - DNA, 15 bp, Homo sapiens
taattctgtttctag

SEQ ID NO: 315536 - DNA, 15 bp, Homo sapiens
aattctgtttctaga

SEQ ID NO: 315537 - DNA, 15 bp, Homo sapiens
attctgtttctagag

SEQ ID NO: 315538 - DNA, 15 bp, Homo sapiens
ttctgtttctagagt

SEQ ID NO: 315539 - DNA, 15 bp, Homo sapiens
tctgtttctagagtt

SEQ ID NO: 315540 - DNA, 15 bp, Homo sapiens
ctgtttctagagttt

SEQ ID NO: 315541 - DNA, 15 bp, Homo sapiens
tgtttctagagtttt

SEQ ID NO: 315542 - DNA, 15 bp, Homo sapiens
gtttctagagttttt

SEQ ID NO: 315543 - DNA, 15 bp, Homo sapiens
tttctagagtttttc

SEQ ID NO: 315544 - DNA, 15 bp, Homo sapiens
ttctagagtttttcc

SEQ ID NO: 315545 - DNA, 15 bp, Homo sapiens
tctagagtttttccc

SEQ ID NO: 315546 - DNA, 15 bp, Homo sapiens
ctagagtttttccct

SEQ ID NO: 315547 - DNA, 15 bp, Homo sapiens
tagagtttttcccta

SEQ ID NO: 315548 - DNA, 15 bp, Homo sapiens
agagtttttccctag

SEQ ID NO: 315549 - DNA, 15 bp, Homo sapiens
gagtttttccctagg

SEQ ID NO: 315550 - DNA, 15 bp, Homo sapiens
agtttttccctaggc

SEQ ID NO: 315551 - DNA, 15 bp, Homo sapiens
gtttttccctaggca

SEQ ID NO: 315552 - DNA, 15 bp, Homo sapiens
tttttccctaggcaa

SEQ ID NO: 315553 - DNA, 15 bp, Homo sapiens
ttttccctaggcaat

SEQ ID NO: 315554 - DNA, 15 bp, Homo sapiens
tttccctaggcaata

SEQ ID NO: 315555 - DNA, 15 bp, Homo sapiens
ttccctaggcaatac

SEQ ID NO: 315556 - DNA, 15 bp, Homo sapiens
tccctaggcaataca

SEQ ID NO: 315557 - DNA, 15 bp, Homo sapiens
ccctaggcaatacat

SEQ ID NO: 315558 - DNA, 15 bp, Homo sapiens
cctaggcaatacata

SEQ ID NO: 315559 - DNA, 15 bp, Homo sapiens
ctaggcaatacataa

SEQ ID NO: 315560 - DNA, 15 bp, Homo sapiens
taggcaatacataaa

SEQ ID NO: 315561 - DNA, 15 bp, Homo sapiens
aggcaatacataaaa

SEQ ID NO: 315562 - DNA, 15 bp, Homo sapiens
ggcaatacataaaaa

SEQ ID NO: 315563 - DNA, 15 bp, Homo sapiens
gcaatacataaaaag

SEQ ID NO: 315564 - DNA, 15 bp, Homo sapiens
caatacataaaaagg

SEQ ID NO: 315565 - DNA, 15 bp, Homo sapiens
aatacataaaaaggt

SEQ ID NO: 315566 - DNA, 15 bp, Homo sapiens
atacataaaaaggta

SEQ ID NO: 315567 - DNA, 15 bp, Homo sapiens
tacataaaaaggtac

SEQ ID NO: 315568 - DNA, 15 bp, Homo sapiens
acataaaaaggtaca

SEQ ID NO: 315569 - DNA, 15 bp, Homo sapiens
cataaaaaggtacac

SEQ ID NO: 315570 - DNA, 15 bp, Homo sapiens
ataaaaaggtacact

SEQ ID NO: 315571 - DNA, 15 bp, Homo sapiens
taaaaaggtacactc

SEQ ID NO: 315572 - DNA, 15 bp, Homo sapiens
aaaaaggtacactca

SEQ ID NO: 315573 - DNA, 15 bp, Homo sapiens
aaaaggtacactcaa

SEQ ID NO: 315574 - DNA, 15 bp, Homo sapiens
aaaggtacactcaag

SEQ ID NO: 315575 - DNA, 15 bp, Homo sapiens
aaggtacactcaaga

SEQ ID NO: 315576 - DNA, 15 bp, Homo sapiens
aggtacactcaagaa

SEQ ID NO: 315577 - DNA, 15 bp, Homo sapiens
ggtacactcaagaaa

SEQ ID NO: 315578 - DNA, 15 bp, Homo sapiens
gtacactcaagaaat

SEQ ID NO: 315579 - DNA, 15 bp, Homo sapiens
tacactcaagaaatt

SEQ ID NO: 315580 - DNA, 15 bp, Homo sapiens
acactcaagaaattg

SEQ ID NO: 315581 - DNA, 15 bp, Homo sapiens
cactcaagaaattga

SEQ ID NO: 315582 - DNA, 15 bp, Homo sapiens
actcaagaaattgat

SEQ ID NO: 315583 - DNA, 15 bp, Homo sapiens
ctcaagaaattgatc

SEQ ID NO: 315584 - DNA, 15 bp, Homo sapiens
tcaagaaattgatca

SEQ ID NO: 315585 - DNA, 15 bp, Homo sapiens
caagaaattgatcac

SEQ ID NO: 315586 - DNA, 15 bp, Homo sapiens
aagaaattgatcaca

SEQ ID NO: 315587 - DNA, 15 bp, Homo sapiens
agaaattgatcacag

SEQ ID NO: 315588 - DNA, 15 bp, Homo sapiens
gaaattgatcacagt

SEQ ID NO: 315589 - DNA, 15 bp, Homo sapiens
aaattgatcacagta

SEQ ID NO: 315590 - DNA, 15 bp, Homo sapiens
aattgatcacagtat

SEQ ID NO: 315591 - DNA, 15 bp, Homo sapiens
attgatcacagtatc

SEQ ID NO: 315592 - DNA, 15 bp, Homo sapiens
ttgatcacagtatca

SEQ ID NO: 315593 - DNA, 15 bp, Homo sapiens
tgatcacagtatcat

SEQ ID NO: 315594 - DNA, 15 bp, Homo sapiens
gatcacagtatcatt

SEQ ID NO: 315595 - DNA, 15 bp, Homo sapiens
atcacagtatcattt

SEQ ID NO: 315596 - DNA, 15 bp, Homo sapiens
tcacagtatcattta

SEQ ID NO: 315597 - DNA, 15 bp, Homo sapiens
cacagtatcatttat

SEQ ID NO: 315598 - DNA, 15 bp, Homo sapiens
acagtatcatttata

SEQ ID NO: 315599 - DNA, 15 bp, Homo sapiens
cagtatcatttataa

SEQ ID NO: 315600 - DNA, 15 bp, Homo sapiens
agtatcatttataat

SEQ ID NO: 315601 - DNA, 15 bp, Homo sapiens
gtatcatttataata

SEQ ID NO: 315602 - DNA, 15 bp, Homo sapiens
tatcatttataatag

SEQ ID NO: 315603 - DNA, 15 bp, Homo sapiens
atcatttataataga

SEQ ID NO: 315604 - DNA, 15 bp, Homo sapiens
tcatttataatagaa

SEQ ID NO: 315605 - DNA, 15 bp, Homo sapiens
catttataatagaaa

SEQ ID NO: 315606 - DNA, 15 bp, Homo sapiens
atttataatagaaaa

SEQ ID NO: 315607 - DNA, 15 bp, Homo sapiens
tttataatagaaaac

SEQ ID NO: 315608 - DNA, 15 bp, Homo sapiens
ttataatagaaaaca

SEQ ID NO: 315609 - DNA, 15 bp, Homo sapiens
tataatagaaaacat

SEQ ID NO: 315610 - DNA, 15 bp, Homo sapiens
ataatagaaaacatt

SEQ ID NO: 315611 - DNA, 15 bp, Homo sapiens
taatagaaaacattg

SEQ ID NO: 315612 - DNA, 15 bp, Homo sapiens
aatagaaaacattgt

SEQ ID NO: 315613 - DNA, 15 bp, Homo sapiens
atagaaaacattgta

SEQ ID NO: 315614 - DNA, 15 bp, Homo sapiens
tagaaaacattgtaa

SEQ ID NO: 315615 - DNA, 15 bp, Homo sapiens
agaaaacattgtaaa

SEQ ID NO: 315616 - DNA, 15 bp, Homo sapiens
gaaaacattgtaaac

SEQ ID NO: 315617 - DNA, 15 bp, Homo sapiens
aaaacattgtaaaca

SEQ ID NO: 315618 - DNA, 15 bp, Homo sapiens
aaacattgtaaacac

SEQ ID NO: 315619 - DNA, 15 bp, Homo sapiens
aacattgtaaacacc

SEQ ID NO: 315620 - DNA, 15 bp, Homo sapiens
acattgtaaacacca

SEQ ID NO: 315621 - DNA, 15 bp, Homo sapiens
cattgtaaacaccat

SEQ ID NO: 315622 - DNA, 15 bp, Homo sapiens
attgtaaacaccatg

SEQ ID NO: 315623 - DNA, 15 bp, Homo sapiens
ttgtaaacaccatga

SEQ ID NO: 315624 - DNA, 15 bp, Homo sapiens
tgtaaacaccatgaa

SEQ ID NO: 315625 - DNA, 15 bp, Homo sapiens
gtaaacaccatgaaa

SEQ ID NO: 315626 - DNA, 15 bp, Homo sapiens
taaacaccatgaaaa

SEQ ID NO: 315627 - DNA, 15 bp, Homo sapiens
aaacaccatgaaaat

SEQ ID NO: 315628 - DNA, 15 bp, Homo sapiens
aacaccatgaaaatc

SEQ ID NO: 315629 - DNA, 15 bp, Homo sapiens
acaccatgaaaatct

SEQ ID NO: 315630 - DNA, 15 bp, Homo sapiens
caccatgaaaatcta

SEQ ID NO: 315631 - DNA, 15 bp, Homo sapiens
accatgaaaatctaa

SEQ ID NO: 315632 - DNA, 15 bp, Homo sapiens
ccatgaaaatctaat

SEQ ID NO: 315633 - DNA, 15 bp, Homo sapiens
catgaaaatctaata

SEQ ID NO: 315634 - DNA, 15 bp, Homo sapiens
atgaaaatctaatat

SEQ ID NO: 315635 - DNA, 15 bp, Homo sapiens
tgaaaatctaatatt

SEQ ID NO: 315636 - DNA, 15 bp, Homo sapiens
gaaaatctaatatta

SEQ ID NO: 315637 - DNA, 15 bp, Homo sapiens
aaaatctaatattag

SEQ ID NO: 315638 - DNA, 15 bp, Homo sapiens
aaatctaatattagg

SEQ ID NO: 315639 - DNA, 15 bp, Homo sapiens
aatctaatattagga

SEQ ID NO: 315640 - DNA, 15 bp, Homo sapiens
atctaatattaggaa

SEQ ID NO: 315641 - DNA, 15 bp, Homo sapiens
tctaatattaggaat

SEQ ID NO: 315642 - DNA, 15 bp, Homo sapiens
ctaatattaggaatt

SEQ ID NO: 315643 - DNA, 15 bp, Homo sapiens
taatattaggaattg

SEQ ID NO: 315644 - DNA, 15 bp, Homo sapiens
aatattaggaattgg

SEQ ID NO: 315645 - DNA, 15 bp, Homo sapiens
atattaggaattggt

SEQ ID NO: 315646 - DNA, 15 bp, Homo sapiens
tattaggaattggtt

SEQ ID NO: 315647 - DNA, 15 bp, Homo sapiens
attaggaattggtta

SEQ ID NO: 315648 - DNA, 15 bp, Homo sapiens
ttaggaattggttag

SEQ ID NO: 315649 - DNA, 15 bp, Homo sapiens
taggaattggttaga

SEQ ID NO: 315650 - DNA, 15 bp, Homo sapiens
aggaattggttagat

SEQ ID NO: 315651 - DNA, 15 bp, Homo sapiens
ggaattggttagatc

SEQ ID NO: 315652 - DNA, 15 bp, Homo sapiens
gaattggttagatca

SEQ ID NO: 315653 - DNA, 15 bp, Homo sapiens
aattggttagatcat

SEQ ID NO: 315654 - DNA, 15 bp, Homo sapiens
attggttagatcatt

SEQ ID NO: 315655 - DNA, 15 bp, Homo sapiens
ttggttagatcatta

SEQ ID NO: 315656 - DNA, 15 bp, Homo sapiens
tggttagatcattat

SEQ ID NO: 315657 - DNA, 15 bp, Homo sapiens
ggttagatcattatt

SEQ ID NO: 315658 - DNA, 15 bp, Homo sapiens
gttagatcattattt

SEQ ID NO: 315659 - DNA, 15 bp, Homo sapiens
ttagatcattatttc

SEQ ID NO: 315660 - DNA, 15 bp, Homo sapiens
tagatcattatttcc

SEQ ID NO: 315661 - DNA, 15 bp, Homo sapiens
agatcattatttccc

SEQ ID NO: 315662 - DNA, 15 bp, Homo sapiens
gatcattatttccca

SEQ ID NO: 315663 - DNA, 15 bp, Homo sapiens
atcattatttcccaa

SEQ ID NO: 315664 - DNA, 15 bp, Homo sapiens
tcattatttcccaaa

SEQ ID NO: 315665 - DNA, 15 bp, Homo sapiens
cattatttcccaaag

SEQ ID NO: 315666 - DNA, 15 bp, Homo sapiens
attatttcccaaagt

SEQ ID NO: 315667 - DNA, 15 bp, Homo sapiens
ttatttcccaaagta

SEQ ID NO: 315668 - DNA, 15 bp, Homo sapiens
tatttcccaaagtat

SEQ ID NO: 315669 - DNA, 15 bp, Homo sapiens
atttcccaaagtatt

SEQ ID NO: 315670 - DNA, 15 bp, Homo sapiens
tttcccaaagtattt

SEQ ID NO: 315671 - DNA, 15 bp, Homo sapiens
ttcccaaagtatttc

SEQ ID NO: 315672 - DNA, 15 bp, Homo sapiens
tcccaaagtatttcg

SEQ ID NO: 315673 - DNA, 15 bp, Homo sapiens
cccaaagtatttcga

SEQ ID NO: 315674 - DNA, 15 bp, Homo sapiens
ccaaagtatttcgaa

SEQ ID NO: 315675 - DNA, 15 bp, Homo sapiens
caaagtatttcgaaa

SEQ ID NO: 315676 - DNA, 15 bp, Homo sapiens
aaagtatttcgaaaa

SEQ ID NO: 315677 - DNA, 15 bp, Homo sapiens
aagtatttcgaaaag

SEQ ID NO: 315678 - DNA, 15 bp, Homo sapiens
agtatttcgaaaaga

SEQ ID NO: 315679 - DNA, 15 bp, Homo sapiens
gtatttcgaaaagat

SEQ ID NO: 315680 - DNA, 15 bp, Homo sapiens
tatttcgaaaagatc

SEQ ID NO: 315681 - DNA, 15 bp, Homo sapiens
atttcgaaaagatca

SEQ ID NO: 315682 - DNA, 15 bp, Homo sapiens
tttcgaaaagatcaa

SEQ ID NO: 315683 - DNA, 15 bp, Homo sapiens
ttcgaaaagatcaaa

SEQ ID NO: 315684 - DNA, 15 bp, Homo sapiens
tcgaaaagatcaaaa

SEQ ID NO: 315685 - DNA, 15 bp, Homo sapiens
cgaaaagatcaaaag

SEQ ID NO: 315686 - DNA, 15 bp, Homo sapiens
gaaaagatcaaaagt

SEQ ID NO: 315687 - DNA, 15 bp, Homo sapiens
aaaagatcaaaagtt

SEQ ID NO: 315688 - DNA, 15 bp, Homo sapiens
aaagatcaaaagttc

SEQ ID NO: 315689 - DNA, 15 bp, Homo sapiens
aagatcaaaagttct

SEQ ID NO: 315690 - DNA, 15 bp, Homo sapiens
agatcaaaagttcta

SEQ ID NO: 315691 - DNA, 15 bp, Homo sapiens
gatcaaaagttctag

SEQ ID NO: 315692 - DNA, 15 bp, Homo sapiens
atcaaaagttctagg

SEQ ID NO: 315693 - DNA, 15 bp, Homo sapiens
tcaaaagttctagga

SEQ ID NO: 315694 - DNA, 15 bp, Homo sapiens
caaaagttctaggat

SEQ ID NO: 315695 - DNA, 15 bp, Homo sapiens
aaaagttctaggatt

SEQ ID NO: 315696 - DNA, 15 bp, Homo sapiens
aaagttctaggattg

SEQ ID NO: 315697 - DNA, 15 bp, Homo sapiens
aagttctaggattgt

SEQ ID NO: 315698 - DNA, 15 bp, Homo sapiens
agttctaggattgtt

SEQ ID NO: 315699 - DNA, 15 bp, Homo sapiens
gttctaggattgtta

SEQ ID NO: 315700 - DNA, 15 bp, Homo sapiens
ttctaggattgttaa

SEQ ID NO: 315701 - DNA, 15 bp, Homo sapiens
tctaggattgttaat

SEQ ID NO: 315702 - DNA, 15 bp, Homo sapiens
ctaggattgttaatg

SEQ ID NO: 315703 - DNA, 15 bp, Homo sapiens
taggattgttaatgt

SEQ ID NO: 315704 - DNA, 15 bp, Homo sapiens
aggattgttaatgtg

SEQ ID NO: 315705 - DNA, 15 bp, Homo sapiens
ggattgttaatgtgt

SEQ ID NO: 315706 - DNA, 15 bp, Homo sapiens
gattgttaatgtgta

SEQ ID NO: 315707 - DNA, 15 bp, Homo sapiens
attgttaatgtgtaa

SEQ ID NO: 315708 - DNA, 15 bp, Homo sapiens
ttgttaatgtgtaat

SEQ ID NO: 315709 - DNA, 15 bp, Homo sapiens
tgttaatgtgtaatt

SEQ ID NO: 315710 - DNA, 15 bp, Homo sapiens
gttaatgtgtaattc

SEQ ID NO: 315711 - DNA, 15 bp, Homo sapiens
ttaatgtgtaattca

SEQ ID NO: 315712 - DNA, 15 bp, Homo sapiens
taatgtgtaattcac

SEQ ID NO: 315713 - DNA, 15 bp, Homo sapiens
aatgtgtaattcaca

SEQ ID NO: 315714 - DNA, 15 bp, Homo sapiens
atgtgtaattcacaa

SEQ ID NO: 315715 - DNA, 15 bp, Homo sapiens
tgtgtaattcacaaa

SEQ ID NO: 315716 - DNA, 15 bp, Homo sapiens
gtgtaattcacaaaa

SEQ ID NO: 315717 - DNA, 15 bp, Homo sapiens
tgtaattcacaaaag

SEQ ID NO: 315718 - DNA, 15 bp, Homo sapiens
gtaattcacaaaagg

SEQ ID NO: 315719 - DNA, 15 bp, Homo sapiens
taattcacaaaagga

SEQ ID NO: 315720 - DNA, 15 bp, Homo sapiens
aattcacaaaaggat

SEQ ID NO: 315721 - DNA, 15 bp, Homo sapiens
attcacaaaaggatg

SEQ ID NO: 315722 - DNA, 15 bp, Homo sapiens
ttcacaaaaggatgt

SEQ ID NO: 315723 - DNA, 15 bp, Homo sapiens
tcacaaaaggatgtt

SEQ ID NO: 315724 - DNA, 15 bp, Homo sapiens
cacaaaaggatgtta

SEQ ID NO: 315725 - DNA, 15 bp, Homo sapiens
acaaaaggatgttat

SEQ ID NO: 315726 - DNA, 15 bp, Homo sapiens
caaaaggatgttatg

SEQ ID NO: 315727 - DNA, 15 bp, Homo sapiens
aaaaggatgttatgg

SEQ ID NO: 315728 - DNA, 15 bp, Homo sapiens
aaaggatgttatggt

SEQ ID NO: 315729 - DNA, 15 bp, Homo sapiens
aaggatgttatggtc

SEQ ID NO: 315730 - DNA, 15 bp, Homo sapiens
aggatgttatggtca

SEQ ID NO: 315731 - DNA, 15 bp, Homo sapiens
ggatgttatggtcaa

SEQ ID NO: 315732 - DNA, 15 bp, Homo sapiens
gatgttatggtcaaa

SEQ ID NO: 315733 - DNA, 15 bp, Homo sapiens
atgttatggtcaaat

SEQ ID NO: 315734 - DNA, 15 bp, Homo sapiens
tgttatggtcaaata

SEQ ID NO: 315735 - DNA, 15 bp, Homo sapiens
gttatggtcaaatag

SEQ ID NO: 315736 - DNA, 15 bp, Homo sapiens
ttatggtcaaatagc

SEQ ID NO: 315737 - DNA, 15 bp, Homo sapiens
tatggtcaaatagct

SEQ ID NO: 315738 - DNA, 15 bp, Homo sapiens
atggtcaaatagctt

SEQ ID NO: 315739 - DNA, 15 bp, Homo sapiens
tggtcaaatagcttt

SEQ ID NO: 315740 - DNA, 15 bp, Homo sapiens
ggtcaaatagcttta

SEQ ID NO: 315741 - DNA, 15 bp, Homo sapiens
gtcaaatagctttag

SEQ ID NO: 315742 - DNA, 15 bp, Homo sapiens
tcaaatagctttagg

SEQ ID NO: 315743 - DNA, 15 bp, Homo sapiens
caaatagctttagga

SEQ ID NO: 315744 - DNA, 15 bp, Homo sapiens
aaatagctttaggaa

SEQ ID NO: 315745 - DNA, 15 bp, Homo sapiens
aatagctttaggaaa

SEQ ID NO: 315746 - DNA, 15 bp, Homo sapiens
atagctttaggaaat

SEQ ID NO: 315747 - DNA, 15 bp, Homo sapiens
tagctttaggaaata

SEQ ID NO: 315748 - DNA, 15 bp, Homo sapiens
agctttaggaaatag

SEQ ID NO: 315749 - DNA, 15 bp, Homo sapiens
gctttaggaaatagt

SEQ ID NO: 315750 - DNA, 15 bp, Homo sapiens
ctttaggaaatagtt

SEQ ID NO: 315751 - DNA, 15 bp, Homo sapiens
tttaggaaatagttg

SEQ ID NO: 315752 - DNA, 15 bp, Homo sapiens
ttaggaaatagttgt

SEQ ID NO: 315753 - DNA, 15 bp, Homo sapiens
taggaaatagttgtt

SEQ ID NO: 315754 - DNA, 15 bp, Homo sapiens
aggaaatagttgttt

SEQ ID NO: 315755 - DNA, 15 bp, Homo sapiens
ggaaatagttgttta

SEQ ID NO: 315756 - DNA, 15 bp, Homo sapiens
gaaatagttgtttaa

SEQ ID NO: 315757 - DNA, 15 bp, Homo sapiens
aaatagttgtttaaa

SEQ ID NO: 315758 - DNA, 15 bp, Homo sapiens
aatagttgtttaaac

SEQ ID NO: 315759 - DNA, 15 bp, Homo sapiens
atagttgtttaaacc

SEQ ID NO: 315760 - DNA, 15 bp, Homo sapiens
tagttgtttaaacct

SEQ ID NO: 315761 - DNA, 15 bp, Homo sapiens
agttgtttaaaccta

SEQ ID NO: 315762 - DNA, 15 bp, Homo sapiens
gttgtttaaacctat

SEQ ID NO: 315763 - DNA, 15 bp, Homo sapiens
ttgtttaaacctatt

SEQ ID NO: 315764 - DNA, 15 bp, Homo sapiens
tgtttaaacctatta

SEQ ID NO: 315765 - DNA, 15 bp, Homo sapiens
gtttaaacctattat

SEQ ID NO: 315766 - DNA, 15 bp, Homo sapiens
tttaaacctattatt

SEQ ID NO: 315767 - DNA, 15 bp, Homo sapiens
ttaaacctattattc

SEQ ID NO: 315768 - DNA, 15 bp, Homo sapiens
taaacctattattct

SEQ ID NO: 315769 - DNA, 15 bp, Homo sapiens
aaacctattattctg

SEQ ID NO: 315770 - DNA, 15 bp, Homo sapiens
aacctattattctgt

SEQ ID NO: 315771 - DNA, 15 bp, Homo sapiens
acctattattctgtt

SEQ ID NO: 315772 - DNA, 15 bp, Homo sapiens
cctattattctgttt

SEQ ID NO: 315773 - DNA, 15 bp, Homo sapiens
ctattattctgtttc

SEQ ID NO: 315774 - DNA, 15 bp, Homo sapiens
tattattctgtttct

SEQ ID NO: 315775 - DNA, 15 bp, Homo sapiens
attattctgtttctt

SEQ ID NO: 315776 - DNA, 15 bp, Homo sapiens
ttattctgtttcttt

SEQ ID NO: 315777 - DNA, 15 bp, Homo sapiens
tattctgtttcttta

SEQ ID NO: 315778 - DNA, 15 bp, Homo sapiens
attctgtttctttac

SEQ ID NO: 315779 - DNA, 15 bp, Homo sapiens
ttctgtttctttact

SEQ ID NO: 315780 - DNA, 15 bp, Homo sapiens
tctgtttctttactc

SEQ ID NO: 315781 - DNA, 15 bp, Homo sapiens
ctgtttctttactct

SEQ ID NO: 315782 - DNA, 15 bp, Homo sapiens
tgtttctttactcta

SEQ ID NO: 315783 - DNA, 15 bp, Homo sapiens
gtttctttactctag

SEQ ID NO: 315784 - DNA, 15 bp, Homo sapiens
tttctttactctagc

SEQ ID NO: 315785 - DNA, 15 bp, Homo sapiens
ttctttactctagca

SEQ ID NO: 315786 - DNA, 15 bp, Homo sapiens
tctttactctagcac

SEQ ID NO: 315787 - DNA, 15 bp, Homo sapiens
ctttactctagcaca

SEQ ID NO: 315788 - DNA, 15 bp, Homo sapiens
tttactctagcacat

SEQ ID NO: 315789 - DNA, 15 bp, Homo sapiens
ttactctagcacatc

SEQ ID NO: 315790 - DNA, 15 bp, Homo sapiens
tactctagcacatct

SEQ ID NO: 315791 - DNA, 15 bp, Homo sapiens
actctagcacatctg

SEQ ID NO: 315792 - DNA, 15 bp, Homo sapiens
ctctagcacatctga

SEQ ID NO: 315793 - DNA, 15 bp, Homo sapiens
tctagcacatctgaa

SEQ ID NO: 315794 - DNA, 15 bp, Homo sapiens
ctagcacatctgaac

SEQ ID NO: 315795 - DNA, 15 bp, Homo sapiens
tagcacatctgaaca

SEQ ID NO: 315796 - DNA, 15 bp, Homo sapiens
agcacatctgaacag

SEQ ID NO: 315797 - DNA, 15 bp, Homo sapiens
gcacatctgaacaga

SEQ ID NO: 315798 - DNA, 15 bp, Homo sapiens
cacatctgaacagat

SEQ ID NO: 315799 - DNA, 15 bp, Homo sapiens
acatctgaacagatc

SEQ ID NO: 315800 - DNA, 15 bp, Homo sapiens
catctgaacagatca

SEQ ID NO: 315801 - DNA, 15 bp, Homo sapiens
atctgaacagatcat

SEQ ID NO: 315802 - DNA, 15 bp, Homo sapiens
tctgaacagatcata

SEQ ID NO: 315803 - DNA, 15 bp, Homo sapiens
ctgaacagatcatac

SEQ ID NO: 315804 - DNA, 15 bp, Homo sapiens
tgaacagatcataca

SEQ ID NO: 315805 - DNA, 15 bp, Homo sapiens
gaacagatcatacat

SEQ ID NO: 315806 - DNA, 15 bp, Homo sapiens
aacagatcatacatg

SEQ ID NO: 315807 - DNA, 15 bp, Homo sapiens
acagatcatacatga

SEQ ID NO: 315808 - DNA, 15 bp, Homo sapiens
cagatcatacatgat

SEQ ID NO: 315809 - DNA, 15 bp, Homo sapiens
agatcatacatgatc

SEQ ID NO: 315810 - DNA, 15 bp, Homo sapiens
gatcatacatgatct

SEQ ID NO: 315811 - DNA, 15 bp, Homo sapiens
atcatacatgatctc

SEQ ID NO: 315812 - DNA, 15 bp, Homo sapiens
tcatacatgatctca

SEQ ID NO: 315813 - DNA, 15 bp, Homo sapiens
catacatgatctcag

SEQ ID NO: 315814 - DNA, 15 bp, Homo sapiens
atacatgatctcagt

SEQ ID NO: 315815 - DNA, 15 bp, Homo sapiens
tacatgatctcagta

SEQ ID NO: 315816 - DNA, 15 bp, Homo sapiens
acatgatctcagtag

SEQ ID NO: 315817 - DNA, 15 bp, Homo sapiens
catgatctcagtaga

SEQ ID NO: 315818 - DNA, 15 bp, Homo sapiens
atgatctcagtagag

SEQ ID NO: 315819 - DNA, 15 bp, Homo sapiens
tgatctcagtagagg

SEQ ID NO: 315820 - DNA, 15 bp, Homo sapiens
gatctcagtagaggt

SEQ ID NO: 315821 - DNA, 15 bp, Homo sapiens
atctcagtagaggta

SEQ ID NO: 315822 - DNA, 15 bp, Homo sapiens
tctcagtagaggtaa

SEQ ID NO: 315823 - DNA, 15 bp, Homo sapiens
ctcagtagaggtaac

SEQ ID NO: 315824 - DNA, 15 bp, Homo sapiens
tcagtagaggtaact

SEQ ID NO: 315825 - DNA, 15 bp, Homo sapiens
cagtagaggtaacta

SEQ ID NO: 315826 - DNA, 15 bp, Homo sapiens
agtagaggtaactaa

SEQ ID NO: 315827 - DNA, 15 bp, Homo sapiens
gtagaggtaactaaa

SEQ ID NO: 315828 - DNA, 15 bp, Homo sapiens
tagaggtaactaaat

SEQ ID NO: 315829 - DNA, 15 bp, Homo sapiens
agaggtaactaaatt

SEQ ID NO: 315830 - DNA, 15 bp, Homo sapiens
gaggtaactaaatta

SEQ ID NO: 315831 - DNA, 15 bp, Homo sapiens
aggtaactaaattag

SEQ ID NO: 315832 - DNA, 15 bp, Homo sapiens
ggtaactaaattagg

SEQ ID NO: 315833 - DNA, 15 bp, Homo sapiens
gtaactaaattaggg

SEQ ID NO: 315834 - DNA, 15 bp, Homo sapiens
taactaaattagggt

SEQ ID NO: 315835 - DNA, 15 bp, Homo sapiens
aactaaattagggta

SEQ ID NO: 315836 - DNA, 15 bp, Homo sapiens
actaaattagggtat

SEQ ID NO: 315837 - DNA, 15 bp, Homo sapiens
ctaaattagggtata

SEQ ID NO: 315838 - DNA, 15 bp, Homo sapiens
taaattagggtatat

SEQ ID NO: 315839 - DNA, 15 bp, Homo sapiens
aaattagggtatatc

SEQ ID NO: 315840 - DNA, 15 bp, Homo sapiens
aattagggtatatcc

SEQ ID NO: 315841 - DNA, 15 bp, Homo sapiens
attagggtatatcca

SEQ ID NO: 315842 - DNA, 15 bp, Homo sapiens
ttagggtatatccat

SEQ ID NO: 315843 - DNA, 15 bp, Homo sapiens
tagggtatatccata

SEQ ID NO: 315844 - DNA, 15 bp, Homo sapiens
agggtatatccataa

SEQ ID NO: 315845 - DNA, 15 bp, Homo sapiens
gggtatatccataaa

SEQ ID NO: 315846 - DNA, 15 bp, Homo sapiens
gaggaggttcttcag

SEQ ID NO: 315847 - DNA, 15 bp, Homo sapiens
aggaggttcttcagt

SEQ ID NO: 315848 - DNA, 15 bp, Homo sapiens
ggaggttcttcagtt

SEQ ID NO: 315849 - DNA, 15 bp, Homo sapiens
gaggttcttcagttt

SEQ ID NO: 315850 - DNA, 15 bp, Homo sapiens
aggttcttcagtttt

SEQ ID NO: 315851 - DNA, 15 bp, Homo sapiens
ggttcttcagtttta

SEQ ID NO: 315852 - DNA, 15 bp, Homo sapiens
gttcttcagttttat

SEQ ID NO: 315853 - DNA, 15 bp, Homo sapiens
ttcttcagttttatc

SEQ ID NO: 315854 - DNA, 15 bp, Homo sapiens
tcttcagttttatct

SEQ ID NO: 315855 - DNA, 15 bp, Homo sapiens
cttcagttttatcta

SEQ ID NO: 315856 - DNA, 15 bp, Homo sapiens
ttcagttttatctat

SEQ ID NO: 315857 - DNA, 15 bp, Homo sapiens
tcagttttatctata

SEQ ID NO: 315858 - DNA, 15 bp, Homo sapiens
cagttttatctataa

SEQ ID NO: 315859 - DNA, 15 bp, Homo sapiens
agttttatctataat

SEQ ID NO: 315860 - DNA, 15 bp, Homo sapiens
gttttatctataata

SEQ ID NO: 315861 - DNA, 15 bp, Homo sapiens
ttttatctataatat

SEQ ID NO: 315862 - DNA, 15 bp, Homo sapiens
tttatctataatatt

SEQ ID NO: 315863 - DNA, 15 bp, Homo sapiens
ttatctataatattt

SEQ ID NO: 315864 - DNA, 15 bp, Homo sapiens
tatctataatattta

SEQ ID NO: 315865 - DNA, 15 bp, Homo sapiens
atctataatatttaa

SEQ ID NO: 315866 - DNA, 15 bp, Homo sapiens
tctataatatttaat

SEQ ID NO: 315867 - DNA, 15 bp, Homo sapiens
ctataatatttaatt

SEQ ID NO: 315868 - DNA, 15 bp, Homo sapiens
tataatatttaattc

SEQ ID NO: 315869 - DNA, 15 bp, Homo sapiens
ataatatttaattcc

SEQ ID NO: 315870 - DNA, 15 bp, Homo sapiens
taatatttaattcct

SEQ ID NO: 315871 - DNA, 15 bp, Homo sapiens
aatatttaattcctc

SEQ ID NO: 315872 - DNA, 15 bp, Homo sapiens
atatttaattcctca

SEQ ID NO: 315873 - DNA, 15 bp, Homo sapiens
tatttaattcctcaa

SEQ ID NO: 315874 - DNA, 15 bp, Homo sapiens
atttaattcctcaat

SEQ ID NO: 315875 - DNA, 15 bp, Homo sapiens
tttaattcctcaatg

SEQ ID NO: 315876 - DNA, 15 bp, Homo sapiens
ttaattcctcaatga

SEQ ID NO: 315877 - DNA, 15 bp, Homo sapiens
taattcctcaatgaa

SEQ ID NO: 315878 - DNA, 15 bp, Homo sapiens
aattcctcaatgaaa

SEQ ID NO: 315879 - DNA, 15 bp, Homo sapiens
attcctcaatgaaaa

SEQ ID NO: 315880 - DNA, 15 bp, Homo sapiens
ttcctcaatgaaaat

SEQ ID NO: 315881 - DNA, 15 bp, Homo sapiens
tcctcaatgaaaata

SEQ ID NO: 315882 - DNA, 15 bp, Homo sapiens
cctcaatgaaaatag

SEQ ID NO: 315883 - DNA, 15 bp, Homo sapiens
ctcaatgaaaataga

SEQ ID NO: 315884 - DNA, 15 bp, Homo sapiens
tcaatgaaaatagaa

SEQ ID NO: 315885 - DNA, 15 bp, Homo sapiens
caatgaaaatagaaa

SEQ ID NO: 315886 - DNA, 15 bp, Homo sapiens
aatgaaaatagaaat

SEQ ID NO: 315887 - DNA, 15 bp, Homo sapiens
atgaaaatagaaata

SEQ ID NO: 315888 - DNA, 15 bp, Homo sapiens
tgaaaatagaaatag

SEQ ID NO: 315889 - DNA, 15 bp, Homo sapiens
gaaaatagaaataga

SEQ ID NO: 315890 - DNA, 15 bp, Homo sapiens
aaaatagaaatagaa

SEQ ID NO: 315891 - DNA, 15 bp, Homo sapiens
aaatagaaatagaat

SEQ ID NO: 315892 - DNA, 15 bp, Homo sapiens
aatagaaatagaatc

SEQ ID NO: 315893 - DNA, 15 bp, Homo sapiens
atagaaatagaatct

SEQ ID NO: 315894 - DNA, 15 bp, Homo sapiens
tagaaatagaatctt

SEQ ID NO: 315895 - DNA, 15 bp, Homo sapiens
agaaatagaatctta

SEQ ID NO: 315896 - DNA, 15 bp, Homo sapiens
gaaatagaatcttaa

SEQ ID NO: 315897 - DNA, 15 bp, Homo sapiens
aaatagaatcttaaa

SEQ ID NO: 315898 - DNA, 15 bp, Homo sapiens
aatagaatcttaaat

SEQ ID NO: 315899 - DNA, 15 bp, Homo sapiens
atagaatcttaaatt

SEQ ID NO: 315900 - DNA, 15 bp, Homo sapiens
tagaatcttaaatta

SEQ ID NO: 315901 - DNA, 15 bp, Homo sapiens
agaatcttaaattaa

SEQ ID NO: 315902 - DNA, 15 bp, Homo sapiens
gaatcttaaattaat

SEQ ID NO: 315903 - DNA, 15 bp, Homo sapiens
aatcttaaattaata

SEQ ID NO: 315904 - DNA, 15 bp, Homo sapiens
atcttaaattaatat

SEQ ID NO: 315905 - DNA, 15 bp, Homo sapiens
tcttaaattaatatg

SEQ ID NO: 315906 - DNA, 15 bp, Homo sapiens
cttaaattaatatga

SEQ ID NO: 315907 - DNA, 15 bp, Homo sapiens
ttaaattaatatgaa

SEQ ID NO: 315908 - DNA, 15 bp, Homo sapiens
taaattaatatgaaa

SEQ ID NO: 315909 - DNA, 15 bp, Homo sapiens
aaattaatatgaaat

SEQ ID NO: 315910 - DNA, 15 bp, Homo sapiens
aattaatatgaaata

SEQ ID NO: 315911 - DNA, 15 bp, Homo sapiens
attaatatgaaataa

SEQ ID NO: 315912 - DNA, 15 bp, Homo sapiens
ttaatatgaaataat

SEQ ID NO: 315913 - DNA, 15 bp, Homo sapiens
taatatgaaataatg

SEQ ID NO: 315914 - DNA, 15 bp, Homo sapiens
aatatgaaataatgc

SEQ ID NO: 315915 - DNA, 15 bp, Homo sapiens
atatgaaataatgct

SEQ ID NO: 315916 - DNA, 15 bp, Homo sapiens
tatgaaataatgctg

SEQ ID NO: 315917 - DNA, 15 bp, Homo sapiens
atgaaataatgctga

SEQ ID NO: 315918 - DNA, 15 bp, Homo sapiens
tgaaataatgctgat

SEQ ID NO: 315919 - DNA, 15 bp, Homo sapiens
gaaataatgctgatt

SEQ ID NO: 315920 - DNA, 15 bp, Homo sapiens
aaataatgctgattt

SEQ ID NO: 315921 - DNA, 15 bp, Homo sapiens
aataatgctgatttg

SEQ ID NO: 315922 - DNA, 15 bp, Homo sapiens
ataatgctgatttgt

SEQ ID NO: 315923 - DNA, 15 bp, Homo sapiens
taatgctgatttgtg

SEQ ID NO: 315924 - DNA, 15 bp, Homo sapiens
aatgctgatttgtga

SEQ ID NO: 315925 - DNA, 15 bp, Homo sapiens
atgctgatttgtgaa

SEQ ID NO: 315926 - DNA, 15 bp, Homo sapiens
tgctgatttgtgaac

SEQ ID NO: 315927 - DNA, 15 bp, Homo sapiens
gctgatttgtgaact

SEQ ID NO: 315928 - DNA, 15 bp, Homo sapiens
ctgatttgtgaactg

SEQ ID NO: 315929 - DNA, 15 bp, Homo sapiens
tgatttgtgaactga

SEQ ID NO: 315930 - DNA, 15 bp, Homo sapiens
gatttgtgaactgag

SEQ ID NO: 315931 - DNA, 15 bp, Homo sapiens
atttgtgaactgagt

SEQ ID NO: 315932 - DNA, 15 bp, Homo sapiens
tttgtgaactgagtg

SEQ ID NO: 315933 - DNA, 15 bp, Homo sapiens
ttgtgaactgagtga

SEQ ID NO: 315934 - DNA, 15 bp, Homo sapiens
tgtgaactgagtgat

SEQ ID NO: 315935 - DNA, 15 bp, Homo sapiens
gtgaactgagtgatg

SEQ ID NO: 315936 - DNA, 15 bp, Homo sapiens
tgaactgagtgatga

SEQ ID NO: 315937 - DNA, 15 bp, Homo sapiens
gaactgagtgatgac

SEQ ID NO: 315938 - DNA, 15 bp, Homo sapiens
aactgagtgatgact

SEQ ID NO: 315939 - DNA, 15 bp, Homo sapiens
actgagtgatgactg

SEQ ID NO: 315940 - DNA, 15 bp, Homo sapiens
ctgagtgatgactgt

SEQ ID NO: 315941 - DNA, 15 bp, Homo sapiens
tgagtgatgactgtc

SEQ ID NO: 315942 - DNA, 15 bp, Homo sapiens
gagtgatgactgtct

SEQ ID NO: 315943 - DNA, 15 bp, Homo sapiens
agtgatgactgtctt

SEQ ID NO: 315944 - DNA, 15 bp, Homo sapiens
gtgatgactgtctta

SEQ ID NO: 315945 - DNA, 15 bp, Homo sapiens
tgatgactgtcttaa

SEQ ID NO: 315946 - DNA, 15 bp, Homo sapiens
gatgactgtcttaag

SEQ ID NO: 315947 - DNA, 15 bp, Homo sapiens
atgactgtcttaagc

SEQ ID NO: 315948 - DNA, 15 bp, Homo sapiens
tgactgtcttaagcc

SEQ ID NO: 315949 - DNA, 15 bp, Homo sapiens
gactgtcttaagccc

SEQ ID NO: 315950 - DNA, 15 bp, Homo sapiens
actgtcttaagccca

SEQ ID NO: 315951 - DNA, 15 bp, Homo sapiens
ctgtcttaagcccag

SEQ ID NO: 315952 - DNA, 15 bp, Homo sapiens
tgtcttaagcccagt

SEQ ID NO: 315953 - DNA, 15 bp, Homo sapiens
gtcttaagcccagtt

SEQ ID NO: 315954 - DNA, 15 bp, Homo sapiens
tcttaagcccagttc

SEQ ID NO: 315955 - DNA, 15 bp, Homo sapiens
cttaagcccagttcc

SEQ ID NO: 315956 - DNA, 15 bp, Homo sapiens
ttaagcccagttcct

SEQ ID NO: 315957 - DNA, 15 bp, Homo sapiens
taagcccagttcctt

SEQ ID NO: 315958 - DNA, 15 bp, Homo sapiens
aagcccagttccttg

SEQ ID NO: 315959 - DNA, 15 bp, Homo sapiens
agcccagttccttgg

SEQ ID NO: 315960 - DNA, 15 bp, Homo sapiens
gcccagttccttgga

SEQ ID NO: 315961 - DNA, 15 bp, Homo sapiens
cccagttccttggaa

SEQ ID NO: 315962 - DNA, 15 bp, Homo sapiens
ccagttccttggaag

SEQ ID NO: 315963 - DNA, 15 bp, Homo sapiens
cagttccttggaagt

SEQ ID NO: 315964 - DNA, 15 bp, Homo sapiens
agttccttggaagta

SEQ ID NO: 315965 - DNA, 15 bp, Homo sapiens
gttccttggaagtag

SEQ ID NO: 315966 - DNA, 15 bp, Homo sapiens
ttccttggaagtagg

SEQ ID NO: 315967 - DNA, 15 bp, Homo sapiens
tccttggaagtagga

SEQ ID NO: 315968 - DNA, 15 bp, Homo sapiens
ccttggaagtaggat

SEQ ID NO: 315969 - DNA, 15 bp, Homo sapiens
cttggaagtaggatt

SEQ ID NO: 315970 - DNA, 15 bp, Homo sapiens
ttggaagtaggattt

SEQ ID NO: 315971 - DNA, 15 bp, Homo sapiens
tggaagtaggatttg

SEQ ID NO: 315972 - DNA, 15 bp, Homo sapiens
ggaagtaggatttga

SEQ ID NO: 315973 - DNA, 15 bp, Homo sapiens
gaagtaggatttgag

SEQ ID NO: 315974 - DNA, 15 bp, Homo sapiens
aagtaggatttgaga

SEQ ID NO: 315975 - DNA, 15 bp, Homo sapiens
agtaggatttgagac

SEQ ID NO: 315976 - DNA, 15 bp, Homo sapiens
gtaggatttgagaca

SEQ ID NO: 315977 - DNA, 15 bp, Homo sapiens
taggatttgagacag

SEQ ID NO: 315978 - DNA, 15 bp, Homo sapiens
aggatttgagacaga

SEQ ID NO: 315979 - DNA, 15 bp, Homo sapiens
ggatttgagacagag

SEQ ID NO: 315980 - DNA, 15 bp, Homo sapiens
gatttgagacagaga

SEQ ID NO: 315981 - DNA, 15 bp, Homo sapiens
atttgagacagagat

SEQ ID NO: 315982 - DNA, 15 bp, Homo sapiens
tttgagacagagatt

SEQ ID NO: 315983 - DNA, 15 bp, Homo sapiens
ttgagacagagattt

SEQ ID NO: 315984 - DNA, 15 bp, Homo sapiens
tgagacagagatttg

SEQ ID NO: 315985 - DNA, 15 bp, Homo sapiens
gagacagagatttgt

SEQ ID NO: 315986 - DNA, 15 bp, Homo sapiens
agacagagatttgtg

SEQ ID NO: 315987 - DNA, 15 bp, Homo sapiens
gacagagatttgtgt

SEQ ID NO: 315988 - DNA, 15 bp, Homo sapiens
acagagatttgtgtg

SEQ ID NO: 315989 - DNA, 15 bp, Homo sapiens
cagagatttgtgtgc

SEQ ID NO: 315990 - DNA, 15 bp, Homo sapiens
agagatttgtgtgca

SEQ ID NO: 315991 - DNA, 15 bp, Homo sapiens
gagatttgtgtgcac

SEQ ID NO: 315992 - DNA, 15 bp, Homo sapiens
agatttgtgtgcact

SEQ ID NO: 315993 - DNA, 15 bp, Homo sapiens
gatttgtgtgcactt

SEQ ID NO: 315994 - DNA, 15 bp, Homo sapiens
atttgtgtgcacttg

SEQ ID NO: 315995 - DNA, 15 bp, Homo sapiens
tttgtgtgcacttga

SEQ ID NO: 315996 - DNA, 15 bp, Homo sapiens
ttgtgtgcacttgag

SEQ ID NO: 315997 - DNA, 15 bp, Homo sapiens
tgtgtgcacttgaga

SEQ ID NO: 315998 - DNA, 15 bp, Homo sapiens
gtgtgcacttgagaa

SEQ ID NO: 315999 - DNA, 15 bp, Homo sapiens
tgtgcacttgagaac

SEQ ID NO: 316000 - DNA, 15 bp, Homo sapiens
gtgcacttgagaaca

SEQ ID NO: 316001 - DNA, 15 bp, Homo sapiens
tgcacttgagaacaa

SEQ ID NO: 316002 - DNA, 15 bp, Homo sapiens
gcacttgagaacaat

SEQ ID NO: 316003 - DNA, 15 bp, Homo sapiens
cacttgagaacaatt

SEQ ID NO: 316004 - DNA, 15 bp, Homo sapiens
acttgagaacaattc

SEQ ID NO: 316005 - DNA, 15 bp, Homo sapiens
cttgagaacaattcc

SEQ ID NO: 316006 - DNA, 15 bp, Homo sapiens
ttgagaacaattcct

SEQ ID NO: 316007 - DNA, 15 bp, Homo sapiens
tgagaacaattcctg

SEQ ID NO: 316008 - DNA, 15 bp, Homo sapiens
gagaacaattcctgt

SEQ ID NO: 316009 - DNA, 15 bp, Homo sapiens
agaacaattcctgtt

SEQ ID NO: 316010 - DNA, 15 bp, Homo sapiens
gaacaattcctgtta

SEQ ID NO: 316011 - DNA, 15 bp, Homo sapiens
aacaattcctgttaa

SEQ ID NO: 316012 - DNA, 15 bp, Homo sapiens
acaattcctgttaat

SEQ ID NO: 316013 - DNA, 15 bp, Homo sapiens
caattcctgttaatg

SEQ ID NO: 316014 - DNA, 15 bp, Homo sapiens
aattcctgttaatga

SEQ ID NO: 316015 - DNA, 15 bp, Homo sapiens
attcctgttaatgaa

SEQ ID NO: 316016 - DNA, 15 bp, Homo sapiens
ttcctgttaatgaaa

SEQ ID NO: 316017 - DNA, 15 bp, Homo sapiens
tcctgttaatgaaag

SEQ ID NO: 316018 - DNA, 15 bp, Homo sapiens
cctgttaatgaaaga

SEQ ID NO: 316019 - DNA, 15 bp, Homo sapiens
ctgttaatgaaagaa

SEQ ID NO: 316020 - DNA, 15 bp, Homo sapiens
tgttaatgaaagaaa

SEQ ID NO: 316021 - DNA, 15 bp, Homo sapiens
gttaatgaaagaaat

SEQ ID NO: 316022 - DNA, 15 bp, Homo sapiens
ttaatgaaagaaatg

SEQ ID NO: 316023 - DNA, 15 bp, Homo sapiens
taatgaaagaaatga

SEQ ID NO: 316024 - DNA, 15 bp, Homo sapiens
aatgaaagaaatgag

SEQ ID NO: 316025 - DNA, 15 bp, Homo sapiens
atgaaagaaatgagg

SEQ ID NO: 316026 - DNA, 15 bp, Homo sapiens
tgaaagaaatgaggg

SEQ ID NO: 316027 - DNA, 15 bp, Homo sapiens
gaaagaaatgaggga

SEQ ID NO: 316028 - DNA, 15 bp, Homo sapiens
aaagaaatgagggaa

SEQ ID NO: 316029 - DNA, 15 bp, Homo sapiens
aagaaatgagggaag

SEQ ID NO: 316030 - DNA, 15 bp, Homo sapiens
agaaatgagggaaga

SEQ ID NO: 316031 - DNA, 15 bp, Homo sapiens
gaaatgagggaagaa

SEQ ID NO: 316032 - DNA, 15 bp, Homo sapiens
aaatgagggaagaag

SEQ ID NO: 316033 - DNA, 15 bp, Homo sapiens
aatgagggaagaagg

SEQ ID NO: 316034 - DNA, 15 bp, Homo sapiens
atgagggaagaagga

SEQ ID NO: 316035 - DNA, 15 bp, Homo sapiens
tgagggaagaaggac

SEQ ID NO: 316036 - DNA, 15 bp, Homo sapiens
gagggaagaaggact

SEQ ID NO: 316037 - DNA, 15 bp, Homo sapiens
agggaagaaggactg

SEQ ID NO: 316038 - DNA, 15 bp, Homo sapiens
gggaagaaggactgg

SEQ ID NO: 316039 - DNA, 15 bp, Homo sapiens
ggaagaaggactggg

SEQ ID NO: 316040 - DNA, 15 bp, Homo sapiens
gaagaaggactgggc

SEQ ID NO: 316041 - DNA, 15 bp, Homo sapiens
aagaaggactgggcc

SEQ ID NO: 316042 - DNA, 15 bp, Homo sapiens
agaaggactgggcca

SEQ ID NO: 316043 - DNA, 15 bp, Homo sapiens
gaaggactgggccag

SEQ ID NO: 316044 - DNA, 15 bp, Homo sapiens
aaggactgggccagg

SEQ ID NO: 316045 - DNA, 15 bp, Homo sapiens
aggactgggccaggg

SEQ ID NO: 316046 - DNA, 15 bp, Homo sapiens
ggactgggccaggga

SEQ ID NO: 316047 - DNA, 15 bp, Homo sapiens
gactgggccagggaa

SEQ ID NO: 316048 - DNA, 15 bp, Homo sapiens
actgggccagggaaa

SEQ ID NO: 316049 - DNA, 15 bp, Homo sapiens
ctgggccagggaaaa

SEQ ID NO: 316050 - DNA, 15 bp, Homo sapiens
tgggccagggaaaag

SEQ ID NO: 316051 - DNA, 15 bp, Homo sapiens
gggccagggaaaagc

SEQ ID NO: 316052 - DNA, 15 bp, Homo sapiens
ggccagggaaaagct

SEQ ID NO: 316053 - DNA, 15 bp, Homo sapiens
gccagggaaaagctg

SEQ ID NO: 316054 - DNA, 15 bp, Homo sapiens
ccagggaaaagctga

SEQ ID NO: 316055 - DNA, 15 bp, Homo sapiens
cagggaaaagctgaa

SEQ ID NO: 316056 - DNA, 15 bp, Homo sapiens
agggaaaagctgaag

SEQ ID NO: 316057 - DNA, 15 bp, Homo sapiens
gggaaaagctgaagt

SEQ ID NO: 316058 - DNA, 15 bp, Homo sapiens
ggaaaagctgaagtg

SEQ ID NO: 316059 - DNA, 15 bp, Homo sapiens
gaaaagctgaagtgt

SEQ ID NO: 316060 - DNA, 15 bp, Homo sapiens
aaaagctgaagtgta

SEQ ID NO: 316061 - DNA, 15 bp, Homo sapiens
aaagctgaagtgtag

SEQ ID NO: 316062 - DNA, 15 bp, Homo sapiens
aagctgaagtgtagt

SEQ ID NO: 316063 - DNA, 15 bp, Homo sapiens
agctgaagtgtagtt

SEQ ID NO: 316064 - DNA, 15 bp, Homo sapiens
gctgaagtgtagttg

SEQ ID NO: 316065 - DNA, 15 bp, Homo sapiens
ctgaagtgtagttga

SEQ ID NO: 316066 - DNA, 15 bp, Homo sapiens
tgaagtgtagttgag

SEQ ID NO: 316067 - DNA, 15 bp, Homo sapiens
gaagtgtagttgagt

SEQ ID NO: 316068 - DNA, 15 bp, Homo sapiens
aagtgtagttgagtt

SEQ ID NO: 316069 - DNA, 15 bp, Homo sapiens
agtgtagttgagtta

SEQ ID NO: 316070 - DNA, 15 bp, Homo sapiens
gtgtagttgagttac

SEQ ID NO: 316071 - DNA, 15 bp, Homo sapiens
tgtagttgagttaca

SEQ ID NO: 316072 - DNA, 15 bp, Homo sapiens
gtagttgagttacag

SEQ ID NO: 316073 - DNA, 15 bp, Homo sapiens
tagttgagttacagc

SEQ ID NO: 316074 - DNA, 15 bp, Homo sapiens
agttgagttacagca

SEQ ID NO: 316075 - DNA, 15 bp, Homo sapiens
gttgagttacagcag

SEQ ID NO: 316076 - DNA, 15 bp, Homo sapiens
ttgagttacagcagg

SEQ ID NO: 316077 - DNA, 15 bp, Homo sapiens
tgagttacagcaggg

SEQ ID NO: 316078 - DNA, 15 bp, Homo sapiens
gagttacagcagggc

SEQ ID NO: 316079 - DNA, 15 bp, Homo sapiens
agttacagcagggcc

SEQ ID NO: 316080 - DNA, 15 bp, Homo sapiens
gttacagcagggcca

SEQ ID NO: 316081 - DNA, 15 bp, Homo sapiens
ttacagcagggccac

SEQ ID NO: 316082 - DNA, 15 bp, Homo sapiens
tacagcagggccacc

SEQ ID NO: 316083 - DNA, 15 bp, Homo sapiens
acagcagggccacca

SEQ ID NO: 316084 - DNA, 15 bp, Homo sapiens
cagcagggccaccat

SEQ ID NO: 316085 - DNA, 15 bp, Homo sapiens
agcagggccaccatt

SEQ ID NO: 316086 - DNA, 15 bp, Homo sapiens
gcagggccaccattg

SEQ ID NO: 316087 - DNA, 15 bp, Homo sapiens
cagggccaccattgg

SEQ ID NO: 316088 - DNA, 15 bp, Homo sapiens
agggccaccattgga

SEQ ID NO: 316089 - DNA, 15 bp, Homo sapiens
gggccaccattggat

SEQ ID NO: 316090 - DNA, 15 bp, Homo sapiens
ggccaccattggatc

SEQ ID NO: 316091 - DNA, 15 bp, Homo sapiens
gccaccattggatcc

SEQ ID NO: 316092 - DNA, 15 bp, Homo sapiens
ccaccattggatcca

SEQ ID NO: 316093 - DNA, 15 bp, Homo sapiens
caccattggatccat

SEQ ID NO: 316094 - DNA, 15 bp, Homo sapiens
accattggatccata

SEQ ID NO: 316095 - DNA, 15 bp, Homo sapiens
ccattggatccatag

SEQ ID NO: 316096 - DNA, 15 bp, Homo sapiens
cattggatccatagg

SEQ ID NO: 316097 - DNA, 15 bp, Homo sapiens
attggatccataggg

SEQ ID NO: 316098 - DNA, 15 bp, Homo sapiens
ttggatccataggga

SEQ ID NO: 316099 - DNA, 15 bp, Homo sapiens
tggatccatagggaa

SEQ ID NO: 316100 - DNA, 15 bp, Homo sapiens
ggatccatagggaat

SEQ ID NO: 316101 - DNA, 15 bp, Homo sapiens
gatccatagggaatg

SEQ ID NO: 316102 - DNA, 15 bp, Homo sapiens
atccatagggaatgc

SEQ ID NO: 316103 - DNA, 15 bp, Homo sapiens
tccatagggaatgct

SEQ ID NO: 316104 - DNA, 15 bp, Homo sapiens
ccatagggaatgctg

SEQ ID NO: 316105 - DNA, 15 bp, Homo sapiens
catagggaatgctgg

SEQ ID NO: 316106 - DNA, 15 bp, Homo sapiens
atagggaatgctggt

SEQ ID NO: 316107 - DNA, 15 bp, Homo sapiens
tagggaatgctggtg

SEQ ID NO: 316108 - DNA, 15 bp, Homo sapiens
agggaatgctggtgc

SEQ ID NO: 316109 - DNA, 15 bp, Homo sapiens
gggaatgctggtgct

SEQ ID NO: 316110 - DNA, 15 bp, Homo sapiens
ggaatgctggtgctg

SEQ ID NO: 316111 - DNA, 15 bp, Homo sapiens
gaatgctggtgctgg

SEQ ID NO: 316112 - DNA, 15 bp, Homo sapiens
aatgctggtgctggg

SEQ ID NO: 316113 - DNA, 15 bp, Homo sapiens
atgctggtgctggga

SEQ ID NO: 316114 - DNA, 15 bp, Homo sapiens
tgctggtgctgggat

SEQ ID NO: 316115 - DNA, 15 bp, Homo sapiens
gctggtgctgggatg

SEQ ID NO: 316116 - DNA, 15 bp, Homo sapiens
ctggtgctgggatgg

SEQ ID NO: 316117 - DNA, 15 bp, Homo sapiens
tggtgctgggatggc

SEQ ID NO: 316118 - DNA, 15 bp, Homo sapiens
ggtgctgggatggcc

SEQ ID NO: 316119 - DNA, 15 bp, Homo sapiens
gtgctgggatggccc

SEQ ID NO: 316120 - DNA, 15 bp, Homo sapiens
tgctgggatggccct

SEQ ID NO: 316121 - DNA, 15 bp, Homo sapiens
gctgggatggccctt

SEQ ID NO: 316122 - DNA, 15 bp, Homo sapiens
tgggatggcccttca

SEQ ID NO: 316123 - DNA, 15 bp, Homo sapiens
gggatggcccttcag

SEQ ID NO: 316124 - DNA, 15 bp, Homo sapiens
ggatggcccttcaga

SEQ ID NO: 316125 - DNA, 15 bp, Homo sapiens
gatggcccttcagag

SEQ ID NO: 316126 - DNA, 15 bp, Homo sapiens
atggcccttcagaga

SEQ ID NO: 316127 - DNA, 15 bp, Homo sapiens
tggcccttcagagat

SEQ ID NO: 316128 - DNA, 15 bp, Homo sapiens
ggcccttcagagatt

SEQ ID NO: 316129 - DNA, 15 bp, Homo sapiens
gcccttcagagattt

SEQ ID NO: 316130 - DNA, 15 bp, Homo sapiens
cccttcagagatttc

SEQ ID NO: 316131 - DNA, 15 bp, Homo sapiens
ccttcagagatttcc

SEQ ID NO: 316132 - DNA, 15 bp, Homo sapiens
cttcagagatttccc

SEQ ID NO: 316133 - DNA, 15 bp, Homo sapiens
ttcagagatttccca

SEQ ID NO: 316134 - DNA, 15 bp, Homo sapiens
tcagagatttcccaa

SEQ ID NO: 316135 - DNA, 15 bp, Homo sapiens
cagagatttcccaac

SEQ ID NO: 316136 - DNA, 15 bp, Homo sapiens
agagatttcccaact

SEQ ID NO: 316137 - DNA, 15 bp, Homo sapiens
gagatttcccaactt

SEQ ID NO: 316138 - DNA, 15 bp, Homo sapiens
agatttcccaacttg

SEQ ID NO: 316139 - DNA, 15 bp, Homo sapiens
gatttcccaacttga

SEQ ID NO: 316140 - DNA, 15 bp, Homo sapiens
atttcccaacttgag

SEQ ID NO: 316141 - DNA, 15 bp, Homo sapiens
tttcccaacttgagg

SEQ ID NO: 316142 - DNA, 15 bp, Homo sapiens
ttcccaacttgaggc

SEQ ID NO: 316143 - DNA, 15 bp, Homo sapiens
tcccaacttgaggca

SEQ ID NO: 316144 - DNA, 15 bp, Homo sapiens
cccaacttgaggcaa

SEQ ID NO: 316145 - DNA, 15 bp, Homo sapiens
ccaacttgaggcaat

SEQ ID NO: 316146 - DNA, 15 bp, Homo sapiens
caacttgaggcaatg

SEQ ID NO: 316147 - DNA, 15 bp, Homo sapiens
aacttgaggcaatgt

SEQ ID NO: 316148 - DNA, 15 bp, Homo sapiens
acttgaggcaatgtg

SEQ ID NO: 316149 - DNA, 15 bp, Homo sapiens
cttgaggcaatgtgt

SEQ ID NO: 316150 - DNA, 15 bp, Homo sapiens
ttgaggcaatgtgtt

SEQ ID NO: 316151 - DNA, 15 bp, Homo sapiens
tgaggcaatgtgttg

SEQ ID NO: 316152 - DNA, 15 bp, Homo sapiens
gaggcaatgtgttga

SEQ ID NO: 316153 - DNA, 15 bp, Homo sapiens
aggcaatgtgttgag

SEQ ID NO: 316154 - DNA, 15 bp, Homo sapiens
ggcaatgtgttgagc

SEQ ID NO: 316155 - DNA, 15 bp, Homo sapiens
gcaatgtgttgagcc

SEQ ID NO: 316156 - DNA, 15 bp, Homo sapiens
caatgtgttgagcct

SEQ ID NO: 316157 - DNA, 15 bp, Homo sapiens
aatgtgttgagcctg

SEQ ID NO: 316158 - DNA, 15 bp, Homo sapiens
atgtgttgagcctgg

SEQ ID NO: 316159 - DNA, 15 bp, Homo sapiens
tgtgttgagcctggg

SEQ ID NO: 316160 - DNA, 15 bp, Homo sapiens
gtgttgagcctgggg

SEQ ID NO: 316161 - DNA, 15 bp, Homo sapiens
tgttgagcctgggga

SEQ ID NO: 316162 - DNA, 15 bp, Homo sapiens
gttgagcctggggac

SEQ ID NO: 316163 - DNA, 15 bp, Homo sapiens
ttgagcctggggacc

SEQ ID NO: 316164 - DNA, 15 bp, Homo sapiens
tgagcctggggacct

SEQ ID NO: 316165 - DNA, 15 bp, Homo sapiens
gagcctggggacctt

SEQ ID NO: 316166 - DNA, 15 bp, Homo sapiens
agcctggggaccttt

SEQ ID NO: 316167 - DNA, 15 bp, Homo sapiens
gcctggggacctttg

SEQ ID NO: 316168 - DNA, 15 bp, Homo sapiens
cctggggacctttgc

SEQ ID NO: 316169 - DNA, 15 bp, Homo sapiens
ctggggacctttgcc

SEQ ID NO: 316170 - DNA, 15 bp, Homo sapiens
tggggacctttgcct

SEQ ID NO: 316171 - DNA, 15 bp, Homo sapiens
ggggacctttgcctt

SEQ ID NO: 316172 - DNA, 15 bp, Homo sapiens
gggacctttgccttg

SEQ ID NO: 316173 - DNA, 15 bp, Homo sapiens
ggacctttgccttga

SEQ ID NO: 316174 - DNA, 15 bp, Homo sapiens
gacctttgccttgac

SEQ ID NO: 316175 - DNA, 15 bp, Homo sapiens
acctttgccttgacc

SEQ ID NO: 316176 - DNA, 15 bp, Homo sapiens
cctttgccttgacca

SEQ ID NO: 316177 - DNA, 15 bp, Homo sapiens
ctttgccttgaccag

SEQ ID NO: 316178 - DNA, 15 bp, Homo sapiens
tttgccttgaccagt

SEQ ID NO: 316179 - DNA, 15 bp, Homo sapiens
ttgccttgaccagta

SEQ ID NO: 316180 - DNA, 15 bp, Homo sapiens
tgccttgaccagtag

SEQ ID NO: 316181 - DNA, 15 bp, Homo sapiens
gccttgaccagtagg

SEQ ID NO: 316182 - DNA, 15 bp, Homo sapiens
ccttgaccagtaggc

SEQ ID NO: 316183 - DNA, 15 bp, Homo sapiens
cttgaccagtaggct

SEQ ID NO: 316184 - DNA, 15 bp, Homo sapiens
ttgaccagtaggctt

SEQ ID NO: 316185 - DNA, 15 bp, Homo sapiens
tgaccagtaggcttt

SEQ ID NO: 316186 - DNA, 15 bp, Homo sapiens
gaccagtaggctttt

SEQ ID NO: 316187 - DNA, 15 bp, Homo sapiens
accagtaggcttttg

SEQ ID NO: 316188 - DNA, 15 bp, Homo sapiens
ccagtaggcttttgg

SEQ ID NO: 316189 - DNA, 15 bp, Homo sapiens
cagtaggcttttggc

SEQ ID NO: 316190 - DNA, 15 bp, Homo sapiens
agtaggcttttggct

SEQ ID NO: 316191 - DNA, 15 bp, Homo sapiens
gtaggcttttggctg

SEQ ID NO: 316192 - DNA, 15 bp, Homo sapiens
taggcttttggctga

SEQ ID NO: 316193 - DNA, 15 bp, Homo sapiens
aggcttttggctgac

SEQ ID NO: 316194 - DNA, 15 bp, Homo sapiens
ggcttttggctgacc

SEQ ID NO: 316195 - DNA, 15 bp, Homo sapiens
gcttttggctgaccc

SEQ ID NO: 316196 - DNA, 15 bp, Homo sapiens
cttttggctgaccct

SEQ ID NO: 316197 - DNA, 15 bp, Homo sapiens
ttttggctgaccctg

SEQ ID NO: 316198 - DNA, 15 bp, Homo sapiens
tttggctgaccctgg

SEQ ID NO: 316199 - DNA, 15 bp, Homo sapiens
ttggctgaccctggg

SEQ ID NO: 316200 - DNA, 15 bp, Homo sapiens
tggctgaccctggga

SEQ ID NO: 316201 - DNA, 15 bp, Homo sapiens
ggctgaccctgggaa

SEQ ID NO: 316202 - DNA, 15 bp, Homo sapiens
gctgaccctgggaag

SEQ ID NO: 316203 - DNA, 15 bp, Homo sapiens
ctgaccctgggaagg

SEQ ID NO: 316204 - DNA, 15 bp, Homo sapiens
tgaccctgggaagga

SEQ ID NO: 316205 - DNA, 15 bp, Homo sapiens
gaccctgggaaggag

SEQ ID NO: 316206 - DNA, 15 bp, Homo sapiens
accctgggaaggagg

SEQ ID NO: 316207 - DNA, 15 bp, Homo sapiens
ccctgggaaggaggt

SEQ ID NO: 316208 - DNA, 15 bp, Homo sapiens
cctgggaaggaggtg

SEQ ID NO: 316209 - DNA, 15 bp, Homo sapiens
ctgggaaggaggtga

SEQ ID NO: 316210 - DNA, 15 bp, Homo sapiens
tgggaaggaggtgag

SEQ ID NO: 316211 - DNA, 15 bp, Homo sapiens
gggaaggaggtgagg

SEQ ID NO: 316212 - DNA, 15 bp, Homo sapiens
ggaaggaggtgaggt

SEQ ID NO: 316213 - DNA, 15 bp, Homo sapiens
gaaggaggtgaggtg

SEQ ID NO: 316214 - DNA, 15 bp, Homo sapiens
aaggaggtgaggtga

SEQ ID NO: 316215 - DNA, 15 bp, Homo sapiens
aggaggtgaggtgaa

SEQ ID NO: 316216 - DNA, 15 bp, Homo sapiens
ggaggtgaggtgaaa

SEQ ID NO: 316217 - DNA, 15 bp, Homo sapiens
gaggtgaggtgaaaa

SEQ ID NO: 316218 - DNA, 15 bp, Homo sapiens
aggtgaggtgaaaat

SEQ ID NO: 316219 - DNA, 15 bp, Homo sapiens
ggtgaggtgaaaatc

SEQ ID NO: 316220 - DNA, 15 bp, Homo sapiens
gtgaggtgaaaatct

SEQ ID NO: 316221 - DNA, 15 bp, Homo sapiens
tgaggtgaaaatctg

SEQ ID NO: 316222 - DNA, 15 bp, Homo sapiens
gaggtgaaaatctgg

SEQ ID NO: 316223 - DNA, 15 bp, Homo sapiens
aggtgaaaatctggg

SEQ ID NO: 316224 - DNA, 15 bp, Homo sapiens
ggtgaaaatctgggc

SEQ ID NO: 316225 - DNA, 15 bp, Homo sapiens
gtgaaaatctgggca

SEQ ID NO: 316226 - DNA, 15 bp, Homo sapiens
tgaaaatctgggcaa

SEQ ID NO: 316227 - DNA, 15 bp, Homo sapiens
gaaaatctgggcaag

SEQ ID NO: 316228 - DNA, 15 bp, Homo sapiens
aaaatctgggcaagg

SEQ ID NO: 316229 - DNA, 15 bp, Homo sapiens
aaatctgggcaaggt

SEQ ID NO: 316230 - DNA, 15 bp, Homo sapiens
aatctgggcaaggta

SEQ ID NO: 316231 - DNA, 15 bp, Homo sapiens
atctgggcaaggtaa

SEQ ID NO: 316232 - DNA, 15 bp, Homo sapiens
tctgggcaaggtaac

SEQ ID NO: 316233 - DNA, 15 bp, Homo sapiens
ctgggcaaggtaact

SEQ ID NO: 316234 - DNA, 15 bp, Homo sapiens
tgggcaaggtaactt

SEQ ID NO: 316235 - DNA, 15 bp, Homo sapiens
gggcaaggtaacttg

SEQ ID NO: 316236 - DNA, 15 bp, Homo sapiens
ggcaaggtaacttgg

SEQ ID NO: 316237 - DNA, 15 bp, Homo sapiens
gcaaggtaacttggc

SEQ ID NO: 316238 - DNA, 15 bp, Homo sapiens
caaggtaacttggcc

SEQ ID NO: 316239 - DNA, 15 bp, Homo sapiens
aaggtaacttggcca

SEQ ID NO: 316240 - DNA, 15 bp, Homo sapiens
aggtaacttggccaa

SEQ ID NO: 316241 - DNA, 15 bp, Homo sapiens
ggtaacttggccaag

SEQ ID NO: 316242 - DNA, 15 bp, Homo sapiens
gtaacttggccaagg

SEQ ID NO: 316243 - DNA, 15 bp, Homo sapiens
taacttggccaaggg

SEQ ID NO: 316244 - DNA, 15 bp, Homo sapiens
aacttggccaagggc

SEQ ID NO: 316245 - DNA, 15 bp, Homo sapiens
acttggccaagggca

SEQ ID NO: 316246 - DNA, 15 bp, Homo sapiens
cttggccaagggcag

SEQ ID NO: 316247 - DNA, 15 bp, Homo sapiens
ttggccaagggcagt

SEQ ID NO: 316248 - DNA, 15 bp, Homo sapiens
tggccaagggcagtt

SEQ ID NO: 316249 - DNA, 15 bp, Homo sapiens
ggccaagggcagttc

SEQ ID NO: 316250 - DNA, 15 bp, Homo sapiens
gccaagggcagttcc

SEQ ID NO: 316251 - DNA, 15 bp, Homo sapiens
ccaagggcagttcct

SEQ ID NO: 316252 - DNA, 15 bp, Homo sapiens
caagggcagttcctg

SEQ ID NO: 316253 - DNA, 15 bp, Homo sapiens
aagggcagttcctgg

SEQ ID NO: 316254 - DNA, 15 bp, Homo sapiens
agggcagttcctgga

SEQ ID NO: 316255 - DNA, 15 bp, Homo sapiens
gggcagttcctggac

SEQ ID NO: 316256 - DNA, 15 bp, Homo sapiens
ggcagttcctggacg

SEQ ID NO: 316257 - DNA, 15 bp, Homo sapiens
gcagttcctggacgg

SEQ ID NO: 316258 - DNA, 15 bp, Homo sapiens
cagttcctggacgga

SEQ ID NO: 316259 - DNA, 15 bp, Homo sapiens
agttcctggacggat

SEQ ID NO: 316260 - DNA, 15 bp, Homo sapiens
gttcctggacggatg

SEQ ID NO: 316261 - DNA, 15 bp, Homo sapiens
ttcctggacggatgc

SEQ ID NO: 316262 - DNA, 15 bp, Homo sapiens
tcctggacggatgct

SEQ ID NO: 316263 - DNA, 15 bp, Homo sapiens
cctggacggatgctc

SEQ ID NO: 316264 - DNA, 15 bp, Homo sapiens
ctggacggatgctca

SEQ ID NO: 316265 - DNA, 15 bp, Homo sapiens
tggacggatgctcag

SEQ ID NO: 316266 - DNA, 15 bp, Homo sapiens
ggacggatgctcagc

SEQ ID NO: 316267 - DNA, 15 bp, Homo sapiens
gacggatgctcagct

SEQ ID NO: 316268 - DNA, 15 bp, Homo sapiens
acggatgctcagcta

SEQ ID NO: 316269 - DNA, 15 bp, Homo sapiens
cggatgctcagctat

SEQ ID NO: 316270 - DNA, 15 bp, Homo sapiens
ggatgctcagctatg

SEQ ID NO: 316271 - DNA, 15 bp, Homo sapiens
gatgctcagctatga

SEQ ID NO: 316272 - DNA, 15 bp, Homo sapiens
atgctcagctatgag

SEQ ID NO: 316273 - DNA, 15 bp, Homo sapiens
tgctcagctatgagc

SEQ ID NO: 316274 - DNA, 15 bp, Homo sapiens
gctcagctatgagcc

SEQ ID NO: 316275 - DNA, 15 bp, Homo sapiens
ctcagctatgagccc

SEQ ID NO: 316276 - DNA, 15 bp, Homo sapiens
tcagctatgagccct

SEQ ID NO: 316277 - DNA, 15 bp, Homo sapiens
cagctatgagccctc

SEQ ID NO: 316278 - DNA, 15 bp, Homo sapiens
agctatgagccctca

SEQ ID NO: 316279 - DNA, 15 bp, Homo sapiens
gctatgagccctcag

SEQ ID NO: 316280 - DNA, 15 bp, Homo sapiens
ctatgagccctcagc

SEQ ID NO: 316281 - DNA, 15 bp, Homo sapiens
tatgagccctcagct

SEQ ID NO: 316282 - DNA, 15 bp, Homo sapiens
atgagccctcagctg

SEQ ID NO: 316283 - DNA, 15 bp, Homo sapiens
tgagccctcagctgc

SEQ ID NO: 316284 - DNA, 15 bp, Homo sapiens
gagccctcagctgct

SEQ ID NO: 316285 - DNA, 15 bp, Homo sapiens
agccctcagctgctg

SEQ ID NO: 316286 - DNA, 15 bp, Homo sapiens
gccctcagctgctgg

SEQ ID NO: 316287 - DNA, 15 bp, Homo sapiens
ccctcagctgctggg

SEQ ID NO: 316288 - DNA, 15 bp, Homo sapiens
cctcagctgctgggg

SEQ ID NO: 316289 - DNA, 15 bp, Homo sapiens
ctcagctgctggggg

SEQ ID NO: 316290 - DNA, 15 bp, Homo sapiens
tcagctgctggggga

SEQ ID NO: 316291 - DNA, 15 bp, Homo sapiens
cagctgctgggggaa

SEQ ID NO: 316292 - DNA, 15 bp, Homo sapiens
agctgctgggggaat

SEQ ID NO: 316293 - DNA, 15 bp, Homo sapiens
gctgctgggggaatg

SEQ ID NO: 316294 - DNA, 15 bp, Homo sapiens
ctgctgggggaatga

SEQ ID NO: 316295 - DNA, 15 bp, Homo sapiens
tgctgggggaatgaa

SEQ ID NO: 316296 - DNA, 15 bp, Homo sapiens
gctgggggaatgaat

SEQ ID NO: 316297 - DNA, 15 bp, Homo sapiens
ctgggggaatgaatt

SEQ ID NO: 316298 - DNA, 15 bp, Homo sapiens
tgggggaatgaattt

SEQ ID NO: 316299 - DNA, 15 bp, Homo sapiens
gggggaatgaatttg

SEQ ID NO: 316300 - DNA, 15 bp, Homo sapiens
ggggaatgaatttgt

SEQ ID NO: 316301 - DNA, 15 bp, Homo sapiens
gggaatgaatttgtg

SEQ ID NO: 316302 - DNA, 15 bp, Homo sapiens
ggaatgaatttgtgc

SEQ ID NO: 316303 - DNA, 15 bp, Homo sapiens
gaatgaatttgtgca

SEQ ID NO: 316304 - DNA, 15 bp, Homo sapiens
aatgaatttgtgcat

SEQ ID NO: 316305 - DNA, 15 bp, Homo sapiens
atgaatttgtgcatt

SEQ ID NO: 316306 - DNA, 15 bp, Homo sapiens
tgaatttgtgcattg

SEQ ID NO: 316307 - DNA, 15 bp, Homo sapiens
gaatttgtgcattgc

SEQ ID NO: 316308 - DNA, 15 bp, Homo sapiens
aatttgtgcattgcc

SEQ ID NO: 316309 - DNA, 15 bp, Homo sapiens
atttgtgcattgcct

SEQ ID NO: 316310 - DNA, 15 bp, Homo sapiens
tttgtgcattgcctt

SEQ ID NO: 316311 - DNA, 15 bp, Homo sapiens
ttgtgcattgccttg

SEQ ID NO: 316312 - DNA, 15 bp, Homo sapiens
tgtgcattgccttgc

SEQ ID NO: 316313 - DNA, 15 bp, Homo sapiens
gtgcattgccttgcc

SEQ ID NO: 316314 - DNA, 15 bp, Homo sapiens
tgcattgccttgcct

SEQ ID NO: 316315 - DNA, 15 bp, Homo sapiens
gcattgccttgcctg

SEQ ID NO: 316316 - DNA, 15 bp, Homo sapiens
cattgccttgcctga

SEQ ID NO: 316317 - DNA, 15 bp, Homo sapiens
attgccttgcctgaa

SEQ ID NO: 316318 - DNA, 15 bp, Homo sapiens
ttgccttgcctgaaa

SEQ ID NO: 316319 - DNA, 15 bp, Homo sapiens
tgccttgcctgaaag

SEQ ID NO: 316320 - DNA, 15 bp, Homo sapiens
gccttgcctgaaagg

SEQ ID NO: 316321 - DNA, 15 bp, Homo sapiens
ccttgcctgaaaggc

SEQ ID NO: 316322 - DNA, 15 bp, Homo sapiens
cttgcctgaaaggca

SEQ ID NO: 316323 - DNA, 15 bp, Homo sapiens
ttgcctgaaaggcag

SEQ ID NO: 316324 - DNA, 15 bp, Homo sapiens
tgcctgaaaggcaga

SEQ ID NO: 316325 - DNA, 15 bp, Homo sapiens
gcctgaaaggcagat

SEQ ID NO: 316326 - DNA, 15 bp, Homo sapiens
cctgaaaggcagatc

SEQ ID NO: 316327 - DNA, 15 bp, Homo sapiens
ctgaaaggcagatct

SEQ ID NO: 316328 - DNA, 15 bp, Homo sapiens
tgaaaggcagatctg

SEQ ID NO: 316329 - DNA, 15 bp, Homo sapiens
gaaaggcagatctgg

SEQ ID NO: 316330 - DNA, 15 bp, Homo sapiens
aaaggcagatctgga

SEQ ID NO: 316331 - DNA, 15 bp, Homo sapiens
aaggcagatctggat

SEQ ID NO: 316332 - DNA, 15 bp, Homo sapiens
aggcagatctggata

SEQ ID NO: 316333 - DNA, 15 bp, Homo sapiens
ggcagatctggatag

SEQ ID NO: 316334 - DNA, 15 bp, Homo sapiens
gcagatctggatagg

SEQ ID NO: 316335 - DNA, 15 bp, Homo sapiens
cagatctggatagga

SEQ ID NO: 316336 - DNA, 15 bp, Homo sapiens
agatctggataggag

SEQ ID NO: 316337 - DNA, 15 bp, Homo sapiens
gatctggataggaga

SEQ ID NO: 316338 - DNA, 15 bp, Homo sapiens
atctggataggagat

SEQ ID NO: 316339 - DNA, 15 bp, Homo sapiens
tctggataggagatt

SEQ ID NO: 316340 - DNA, 15 bp, Homo sapiens
ctggataggagattc

SEQ ID NO: 316341 - DNA, 15 bp, Homo sapiens
tggataggagattca

SEQ ID NO: 316342 - DNA, 15 bp, Homo sapiens
ggataggagattcac

SEQ ID NO: 316343 - DNA, 15 bp, Homo sapiens
gataggagattcact

SEQ ID NO: 316344 - DNA, 15 bp, Homo sapiens
ataggagattcactg

SEQ ID NO: 316345 - DNA, 15 bp, Homo sapiens
taggagattcactgc

SEQ ID NO: 316346 - DNA, 15 bp, Homo sapiens
aggagattcactgca

SEQ ID NO: 316347 - DNA, 15 bp, Homo sapiens
ggagattcactgcag

SEQ ID NO: 316348 - DNA, 15 bp, Homo sapiens
gagattcactgcagt

SEQ ID NO: 316349 - DNA, 15 bp, Homo sapiens
agattcactgcagtc

SEQ ID NO: 316350 - DNA, 15 bp, Homo sapiens
gattcactgcagtca

SEQ ID NO: 316351 - DNA, 15 bp, Homo sapiens
attcactgcagtcat

SEQ ID NO: 316352 - DNA, 15 bp, Homo sapiens
ttcactgcagtcatg

SEQ ID NO: 316353 - DNA, 15 bp, Homo sapiens
tcactgcagtcatgg

SEQ ID NO: 316354 - DNA, 15 bp, Homo sapiens
cactgcagtcatgga

SEQ ID NO: 316355 - DNA, 15 bp, Homo sapiens
actgcagtcatggac

SEQ ID NO: 316356 - DNA, 15 bp, Homo sapiens
ctgcagtcatggacc

SEQ ID NO: 316357 - DNA, 15 bp, Homo sapiens
tgcagtcatggacct

SEQ ID NO: 316358 - DNA, 15 bp, Homo sapiens
gcagtcatggacctt

SEQ ID NO: 316359 - DNA, 15 bp, Homo sapiens
cagtcatggaccttg

SEQ ID NO: 316360 - DNA, 15 bp, Homo sapiens
agtcatggaccttgt

SEQ ID NO: 316361 - DNA, 15 bp, Homo sapiens
gtcatggaccttgta

SEQ ID NO: 316362 - DNA, 15 bp, Homo sapiens
tcatggaccttgtac

SEQ ID NO: 316363 - DNA, 15 bp, Homo sapiens
catggaccttgtacc

SEQ ID NO: 316364 - DNA, 15 bp, Homo sapiens
atggaccttgtacca

SEQ ID NO: 316365 - DNA, 15 bp, Homo sapiens
tggaccttgtaccat

SEQ ID NO: 316366 - DNA, 15 bp, Homo sapiens
ggaccttgtaccatt

SEQ ID NO: 316367 - DNA, 15 bp, Homo sapiens
gaccttgtaccattt

SEQ ID NO: 316368 - DNA, 15 bp, Homo sapiens
accttgtaccatttt

SEQ ID NO: 316369 - DNA, 15 bp, Homo sapiens
ccttgtaccattttc

SEQ ID NO: 316370 - DNA, 15 bp, Homo sapiens
cttgtaccattttct

SEQ ID NO: 316371 - DNA, 15 bp, Homo sapiens
ttgtaccattttctt

SEQ ID NO: 316372 - DNA, 15 bp, Homo sapiens
tgtaccattttcttt

SEQ ID NO: 316373 - DNA, 15 bp, Homo sapiens
gtaccattttctttt

SEQ ID NO: 316374 - DNA, 15 bp, Homo sapiens
taccattttcttttg

SEQ ID NO: 316375 - DNA, 15 bp, Homo sapiens
accattttcttttgc

SEQ ID NO: 316376 - DNA, 15 bp, Homo sapiens
ccattttcttttgcc

SEQ ID NO: 316377 - DNA, 15 bp, Homo sapiens
cattttcttttgcct

SEQ ID NO: 316378 - DNA, 15 bp, Homo sapiens
attttcttttgccta

SEQ ID NO: 316379 - DNA, 15 bp, Homo sapiens
ttttcttttgcctat

SEQ ID NO: 316380 - DNA, 15 bp, Homo sapiens
tttcttttgcctatt

SEQ ID NO: 316381 - DNA, 15 bp, Homo sapiens
ttcttttgcctatta

SEQ ID NO: 316382 - DNA, 15 bp, Homo sapiens
tcttttgcctattat

SEQ ID NO: 316383 - DNA, 15 bp, Homo sapiens
cttttgcctattatt

SEQ ID NO: 316384 - DNA, 15 bp, Homo sapiens
ttttgcctattattg

SEQ ID NO: 316385 - DNA, 15 bp, Homo sapiens
tttgcctattattgt

SEQ ID NO: 316386 - DNA, 15 bp, Homo sapiens
ttgcctattattgtc

SEQ ID NO: 316387 - DNA, 15 bp, Homo sapiens
tgcctattattgtct

SEQ ID NO: 316388 - DNA, 15 bp, Homo sapiens
gcctattattgtcta

SEQ ID NO: 316389 - DNA, 15 bp, Homo sapiens
cctattattgtctat

SEQ ID NO: 316390 - DNA, 15 bp, Homo sapiens
ctattattgtctatt

SEQ ID NO: 316391 - DNA, 15 bp, Homo sapiens
tattattgtctattt

SEQ ID NO: 316392 - DNA, 15 bp, Homo sapiens
attattgtctatttc

SEQ ID NO: 316393 - DNA, 15 bp, Homo sapiens
ttattgtctatttct

SEQ ID NO: 316394 - DNA, 15 bp, Homo sapiens
tattgtctatttcta

SEQ ID NO: 316395 - DNA, 15 bp, Homo sapiens
attgtctatttctat

SEQ ID NO: 316396 - DNA, 15 bp, Homo sapiens
ttgtctatttctatg

SEQ ID NO: 316397 - DNA, 15 bp, Homo sapiens
tgtctatttctatgt

SEQ ID NO: 316398 - DNA, 15 bp, Homo sapiens
gtctatttctatgtc

SEQ ID NO: 316399 - DNA, 15 bp, Homo sapiens
tctatttctatgtct

SEQ ID NO: 316400 - DNA, 15 bp, Homo sapiens
ctatttctatgtctg

SEQ ID NO: 316401 - DNA, 15 bp, Homo sapiens
tatttctatgtctga

SEQ ID NO: 316402 - DNA, 15 bp, Homo sapiens
atttctatgtctgaa

SEQ ID NO: 316403 - DNA, 15 bp, Homo sapiens
tttctatgtctgaaa

SEQ ID NO: 316404 - DNA, 15 bp, Homo sapiens
ttctatgtctgaaag

SEQ ID NO: 316405 - DNA, 15 bp, Homo sapiens
tctatgtctgaaaga

SEQ ID NO: 316406 - DNA, 15 bp, Homo sapiens
ctatgtctgaaagat

SEQ ID NO: 316407 - DNA, 15 bp, Homo sapiens
tatgtctgaaagata

SEQ ID NO: 316408 - DNA, 15 bp, Homo sapiens
atgtctgaaagatat

SEQ ID NO: 316409 - DNA, 15 bp, Homo sapiens
tgtctgaaagatatg

SEQ ID NO: 316410 - DNA, 15 bp, Homo sapiens
gtctgaaagatatga

SEQ ID NO: 316411 - DNA, 15 bp, Homo sapiens
tctgaaagatatgac

SEQ ID NO: 316412 - DNA, 15 bp, Homo sapiens
ctgaaagatatgaca

SEQ ID NO: 316413 - DNA, 15 bp, Homo sapiens
tgaaagatatgacat

SEQ ID NO: 316414 - DNA, 15 bp, Homo sapiens
gaaagatatgacata

SEQ ID NO: 316415 - DNA, 15 bp, Homo sapiens
aaagatatgacatat

SEQ ID NO: 316416 - DNA, 15 bp, Homo sapiens
aagatatgacatatt

SEQ ID NO: 316417 - DNA, 15 bp, Homo sapiens
agatatgacatatta

SEQ ID NO: 316418 - DNA, 15 bp, Homo sapiens
gatatgacatattaa

SEQ ID NO: 316419 - DNA, 15 bp, Homo sapiens
atatgacatattaaa

SEQ ID NO: 316420 - DNA, 15 bp, Homo sapiens
tatgacatattaaat

SEQ ID NO: 316421 - DNA, 15 bp, Homo sapiens
atgacatattaaata

SEQ ID NO: 316422 - DNA, 15 bp, Homo sapiens
tgacatattaaataa

SEQ ID NO: 316423 - DNA, 15 bp, Homo sapiens
gacatattaaataaa

SEQ ID NO: 316424 - DNA, 15 bp, Homo sapiens
acatattaaataaaa

SEQ ID NO: 316425 - DNA, 15 bp, Homo sapiens
catattaaataaaaa

SEQ ID NO: 316426 - DNA, 15 bp, Homo sapiens
atattaaataaaaaa

SEQ ID NO: 316427 - DNA, 15 bp, Homo sapiens
tattaaataaaaaaa

SEQ ID NO: 316428 - DNA, 15 bp, Homo sapiens
attaaataaaaaaag

SEQ ID NO: 316429 - DNA, 15 bp, Homo sapiens
ttaaataaaaaaagc

SEQ ID NO: 316430 - DNA, 15 bp, Homo sapiens
taaataaaaaaagct

SEQ ID NO: 316431 - DNA, 15 bp, Homo sapiens
aaataaaaaaagctt

SEQ ID NO: 316432 - DNA, 15 bp, Homo sapiens
aataaaaaaagcttc

SEQ ID NO: 316433 - DNA, 15 bp, Homo sapiens
ataaaaaaagcttcc

SEQ ID NO: 316434 - DNA, 15 bp, Homo sapiens
taaaaaaagcttcca

SEQ ID NO: 316435 - DNA, 15 bp, Homo sapiens
aaaaaaagcttccaa

SEQ ID NO: 316436 - DNA, 15 bp, Homo sapiens
aaaaaagcttccaat

SEQ ID NO: 316437 - DNA, 15 bp, Homo sapiens
aaaaagcttccaatt

SEQ ID NO: 316438 - DNA, 15 bp, Homo sapiens
aaaagcttccaattt

SEQ ID NO: 316439 - DNA, 15 bp, Homo sapiens
aaagcttccaatttc

SEQ ID NO: 316440 - DNA, 15 bp, Homo sapiens
aagcttccaatttct

SEQ ID NO: 316441 - DNA, 15 bp, Homo sapiens
agcttccaatttcta

SEQ ID NO: 316442 - DNA, 15 bp, Homo sapiens
gcttccaatttctag

SEQ ID NO: 316443 - DNA, 15 bp, Homo sapiens
cttccaatttctagg

SEQ ID NO: 316444 - DNA, 15 bp, Homo sapiens
ttccaatttctagga

SEQ ID NO: 316445 - DNA, 15 bp, Homo sapiens
tccaatttctaggag

SEQ ID NO: 316446 - DNA, 15 bp, Homo sapiens
ccaatttctaggagc

SEQ ID NO: 316447 - DNA, 15 bp, Homo sapiens
caatttctaggagca

SEQ ID NO: 316448 - DNA, 15 bp, Homo sapiens
aatttctaggagcag

SEQ ID NO: 316449 - DNA, 15 bp, Homo sapiens
atttctaggagcagt

SEQ ID NO: 316450 - DNA, 15 bp, Homo sapiens
tttctaggagcagta

SEQ ID NO: 316451 - DNA, 15 bp, Homo sapiens
ttctaggagcagtat

SEQ ID NO: 316452 - DNA, 15 bp, Homo sapiens
tctaggagcagtatt

SEQ ID NO: 316453 - DNA, 15 bp, Homo sapiens
ctaggagcagtattc

SEQ ID NO: 316454 - DNA, 15 bp, Homo sapiens
taggagcagtattca

SEQ ID NO: 316455 - DNA, 15 bp, Homo sapiens
aggagcagtattcac

SEQ ID NO: 316456 - DNA, 15 bp, Homo sapiens
ggagcagtattcacc

SEQ ID NO: 316457 - DNA, 15 bp, Homo sapiens
gagcagtattcaccg

SEQ ID NO: 316458 - DNA, 15 bp, Homo sapiens
agcagtattcaccga

SEQ ID NO: 316459 - DNA, 15 bp, Homo sapiens
gcagtattcaccgaa

SEQ ID NO: 316460 - DNA, 15 bp, Homo sapiens
cagtattcaccgaac

SEQ ID NO: 316461 - DNA, 15 bp, Homo sapiens
agtattcaccgaact

SEQ ID NO: 316462 - DNA, 15 bp, Homo sapiens
gtattcaccgaacta

SEQ ID NO: 316463 - DNA, 15 bp, Homo sapiens
tattcaccgaactac

SEQ ID NO: 316464 - DNA, 15 bp, Homo sapiens
attcaccgaactact

SEQ ID NO: 316465 - DNA, 15 bp, Homo sapiens
ttcaccgaactactt

SEQ ID NO: 316466 - DNA, 15 bp, Homo sapiens
tcaccgaactacttc

SEQ ID NO: 316467 - DNA, 15 bp, Homo sapiens
caccgaactacttcc

SEQ ID NO: 316468 - DNA, 15 bp, Homo sapiens
accgaactacttccc

SEQ ID NO: 316469 - DNA, 15 bp, Homo sapiens
ccgaactacttccct

SEQ ID NO: 316470 - DNA, 15 bp, Homo sapiens
cgaactacttccctg

SEQ ID NO: 316471 - DNA, 15 bp, Homo sapiens
gaactacttccctga

SEQ ID NO: 316472 - DNA, 15 bp, Homo sapiens
aactacttccctgac

SEQ ID NO: 316473 - DNA, 15 bp, Homo sapiens
actacttccctgaca

SEQ ID NO: 316474 - DNA, 15 bp, Homo sapiens
ctacttccctgacac

SEQ ID NO: 316475 - DNA, 15 bp, Homo sapiens
tacttccctgacaca

SEQ ID NO: 316476 - DNA, 15 bp, Homo sapiens
acttccctgacacat

SEQ ID NO: 316477 - DNA, 15 bp, Homo sapiens
cttccctgacacata

SEQ ID NO: 316478 - DNA, 15 bp, Homo sapiens
ttccctgacacatac

SEQ ID NO: 316479 - DNA, 15 bp, Homo sapiens
tccctgacacataca

SEQ ID NO: 316480 - DNA, 15 bp, Homo sapiens
ccctgacacatacat

SEQ ID NO: 316481 - DNA, 15 bp, Homo sapiens
cctgacacatacata

SEQ ID NO: 316482 - DNA, 15 bp, Homo sapiens
ctgacacatacatac

SEQ ID NO: 316483 - DNA, 15 bp, Homo sapiens
tgacacatacatacc

SEQ ID NO: 316484 - DNA, 15 bp, Homo sapiens
gacacatacatacct

SEQ ID NO: 316485 - DNA, 15 bp, Homo sapiens
acacatacatacctc

SEQ ID NO: 316486 - DNA, 15 bp, Homo sapiens
cacatacatacctca

SEQ ID NO: 316487 - DNA, 15 bp, Homo sapiens
acatacatacctcac

SEQ ID NO: 316488 - DNA, 15 bp, Homo sapiens
catacatacctcaca

SEQ ID NO: 316489 - DNA, 15 bp, Homo sapiens
atacatacctcacac

SEQ ID NO: 316490 - DNA, 15 bp, Homo sapiens
tacatacctcacacc

SEQ ID NO: 316491 - DNA, 15 bp, Homo sapiens
acatacctcacaccc

SEQ ID NO: 316492 - DNA, 15 bp, Homo sapiens
catacctcacaccct

SEQ ID NO: 316493 - DNA, 15 bp, Homo sapiens
atacctcacaccctg

SEQ ID NO: 316494 - DNA, 15 bp, Homo sapiens
tacctcacaccctgc

SEQ ID NO: 316495 - DNA, 15 bp, Homo sapiens
acctcacaccctgca

SEQ ID NO: 316496 - DNA, 15 bp, Homo sapiens
cctcacaccctgcac

SEQ ID NO: 316497 - DNA, 15 bp, Homo sapiens
ctcacaccctgcaca

SEQ ID NO: 316498 - DNA, 15 bp, Homo sapiens
tcacaccctgcacac

SEQ ID NO: 316499 - DNA, 15 bp, Homo sapiens
cacaccctgcacaca

SEQ ID NO: 316500 - DNA, 15 bp, Homo sapiens
acaccctgcacacac

SEQ ID NO: 316501 - DNA, 15 bp, Homo sapiens
caccctgcacacacc

SEQ ID NO: 316502 - DNA, 15 bp, Homo sapiens
accctgcacacacca

SEQ ID NO: 316503 - DNA, 15 bp, Homo sapiens
ccctgcacacaccac

SEQ ID NO: 316504 - DNA, 15 bp, Homo sapiens
cctgcacacaccaca

SEQ ID NO: 316505 - DNA, 15 bp, Homo sapiens
ctgcacacaccacac

SEQ ID NO: 316506 - DNA, 15 bp, Homo sapiens
tgcacacaccacaca

SEQ ID NO: 316507 - DNA, 15 bp, Homo sapiens
gcacacaccacacac

SEQ ID NO: 316508 - DNA, 15 bp, Homo sapiens
cacacaccacacacc

SEQ ID NO: 316509 - DNA, 15 bp, Homo sapiens
acacaccacacacca

SEQ ID NO: 316510 - DNA, 15 bp, Homo sapiens
cacaccacacaccac

SEQ ID NO: 316511 - DNA, 15 bp, Homo sapiens
acaccacacaccaca

SEQ ID NO: 316512 - DNA, 15 bp, Homo sapiens
caccacacaccacaa

SEQ ID NO: 316513 - DNA, 15 bp, Homo sapiens
accacacaccacaaa

SEQ ID NO: 316514 - DNA, 15 bp, Homo sapiens
ccacacaccacaaac

SEQ ID NO: 316515 - DNA, 15 bp, Homo sapiens
cacacaccacaaacc

SEQ ID NO: 316516 - DNA, 15 bp, Homo sapiens
acacaccacaaaccg

SEQ ID NO: 316517 - DNA, 15 bp, Homo sapiens
cacaccacaaaccgt

SEQ ID NO: 316518 - DNA, 15 bp, Homo sapiens
acaccacaaaccgta

SEQ ID NO: 316519 - DNA, 15 bp, Homo sapiens
caccacaaaccgtag

SEQ ID NO: 316520 - DNA, 15 bp, Homo sapiens
accacaaaccgtagc

SEQ ID NO: 316521 - DNA, 15 bp, Homo sapiens
ccacaaaccgtagct

SEQ ID NO: 316522 - DNA, 15 bp, Homo sapiens
cacaaaccgtagctg

SEQ ID NO: 316523 - DNA, 15 bp, Homo sapiens
acaaaccgtagctgt

SEQ ID NO: 316524 - DNA, 15 bp, Homo sapiens
caaaccgtagctgta

SEQ ID NO: 316525 - DNA, 15 bp, Homo sapiens
aaaccgtagctgtaa

SEQ ID NO: 316526 - DNA, 15 bp, Homo sapiens
aaccgtagctgtaat

SEQ ID NO: 316527 - DNA, 15 bp, Homo sapiens
accgtagctgtaata

SEQ ID NO: 316528 - DNA, 15 bp, Homo sapiens
ccgtagctgtaatat

SEQ ID NO: 316529 - DNA, 15 bp, Homo sapiens
cgtagctgtaatatc

SEQ ID NO: 316530 - DNA, 15 bp, Homo sapiens
gtagctgtaatatca

SEQ ID NO: 316531 - DNA, 15 bp, Homo sapiens
tagctgtaatatcag

SEQ ID NO: 316532 - DNA, 15 bp, Homo sapiens
agctgtaatatcagg

SEQ ID NO: 316533 - DNA, 15 bp, Homo sapiens
gctgtaatatcaggt

SEQ ID NO: 316534 - DNA, 15 bp, Homo sapiens
ctgtaatatcaggtt

SEQ ID NO: 316535 - DNA, 15 bp, Homo sapiens
tgtaatatcaggtta

SEQ ID NO: 316536 - DNA, 15 bp, Homo sapiens
gtaatatcaggttac

SEQ ID NO: 316537 - DNA, 15 bp, Homo sapiens
taatatcaggttaca

SEQ ID NO: 316538 - DNA, 15 bp, Homo sapiens
aatatcaggttacat

SEQ ID NO: 316539 - DNA, 15 bp, Homo sapiens
atatcaggttacata

SEQ ID NO: 316540 - DNA, 15 bp, Homo sapiens
tatcaggttacatac

SEQ ID NO: 316541 - DNA, 15 bp, Homo sapiens
atcaggttacatact

SEQ ID NO: 316542 - DNA, 15 bp, Homo sapiens
tcaggttacatactt

SEQ ID NO: 316543 - DNA, 15 bp, Homo sapiens
caggttacatacttt

SEQ ID NO: 316544 - DNA, 15 bp, Homo sapiens
aggttacatactttc

SEQ ID NO: 316545 - DNA, 15 bp, Homo sapiens
ggttacatactttct

SEQ ID NO: 316546 - DNA, 15 bp, Homo sapiens
gttacatactttctg

SEQ ID NO: 316547 - DNA, 15 bp, Homo sapiens
ttacatactttctgt

SEQ ID NO: 316548 - DNA, 15 bp, Homo sapiens
tacatactttctgtt

SEQ ID NO: 316549 - DNA, 15 bp, Homo sapiens
acatactttctgttt

SEQ ID NO: 316550 - DNA, 15 bp, Homo sapiens
catactttctgtttt

SEQ ID NO: 316551 - DNA, 15 bp, Homo sapiens
atactttctgtttta

SEQ ID NO: 316552 - DNA, 15 bp, Homo sapiens
tactttctgttttat

SEQ ID NO: 316553 - DNA, 15 bp, Homo sapiens
actttctgttttatt

SEQ ID NO: 316554 - DNA, 15 bp, Homo sapiens
ctttctgttttattt

SEQ ID NO: 316555 - DNA, 15 bp, Homo sapiens
tttctgttttatttt

SEQ ID NO: 316556 - DNA, 15 bp, Homo sapiens
ttctgttttattttc

SEQ ID NO: 316557 - DNA, 15 bp, Homo sapiens
tctgttttattttcc

SEQ ID NO: 316558 - DNA, 15 bp, Homo sapiens
ctgttttattttccc

SEQ ID NO: 316559 - DNA, 15 bp, Homo sapiens
tgttttattttccct

SEQ ID NO: 316560 - DNA, 15 bp, Homo sapiens
gttttattttccctt

SEQ ID NO: 316561 - DNA, 15 bp, Homo sapiens
ttttattttcccttt

SEQ ID NO: 316562 - DNA, 15 bp, Homo sapiens
tttattttccctttt

SEQ ID NO: 316563 - DNA, 15 bp, Homo sapiens
ttattttcccttttc

SEQ ID NO: 316564 - DNA, 15 bp, Homo sapiens
tattttcccttttct

SEQ ID NO: 316565 - DNA, 15 bp, Homo sapiens
attttcccttttctc

SEQ ID NO: 316566 - DNA, 15 bp, Homo sapiens
ttttcccttttctct

SEQ ID NO: 316567 - DNA, 15 bp, Homo sapiens
tttcccttttctctg

SEQ ID NO: 316568 - DNA, 15 bp, Homo sapiens
ttcccttttctctgt

SEQ ID NO: 316569 - DNA, 15 bp, Homo sapiens
tcccttttctctgtg

SEQ ID NO: 316570 - DNA, 15 bp, Homo sapiens
cccttttctctgtgt

SEQ ID NO: 316571 - DNA, 15 bp, Homo sapiens
ccttttctctgtgtt

SEQ ID NO: 316572 - DNA, 15 bp, Homo sapiens
cttttctctgtgttt

SEQ ID NO: 316573 - DNA, 15 bp, Homo sapiens
ttttctctgtgtttt

SEQ ID NO: 316574 - DNA, 15 bp, Homo sapiens
tttctctgtgttttt

SEQ ID NO: 316575 - DNA, 15 bp, Homo sapiens
ttctctgtgtttttg

SEQ ID NO: 316576 - DNA, 15 bp, Homo sapiens
tctctgtgtttttgg

SEQ ID NO: 316577 - DNA, 15 bp, Homo sapiens
ctctgtgtttttggt

SEQ ID NO: 316578 - DNA, 15 bp, Homo sapiens
tctgtgtttttggtt

SEQ ID NO: 316579 - DNA, 15 bp, Homo sapiens
ctgtgtttttggtta

SEQ ID NO: 316580 - DNA, 15 bp, Homo sapiens
tgtgtttttggttac

SEQ ID NO: 316581 - DNA, 15 bp, Homo sapiens
gtgtttttggttact

SEQ ID NO: 316582 - DNA, 15 bp, Homo sapiens
tgtttttggttactt

SEQ ID NO: 316583 - DNA, 15 bp, Homo sapiens
gtttttggttacttg

SEQ ID NO: 316584 - DNA, 15 bp, Homo sapiens
tttttggttacttga

SEQ ID NO: 316585 - DNA, 15 bp, Homo sapiens
ttttggttacttgag

SEQ ID NO: 316586 - DNA, 15 bp, Homo sapiens
tttggttacttgaga

SEQ ID NO: 316587 - DNA, 15 bp, Homo sapiens
ttggttacttgagat

SEQ ID NO: 316588 - DNA, 15 bp, Homo sapiens
tggttacttgagatg

SEQ ID NO: 316589 - DNA, 15 bp, Homo sapiens
ggttacttgagatgg

SEQ ID NO: 316590 - DNA, 15 bp, Homo sapiens
gttacttgagatggc

SEQ ID NO: 316591 - DNA, 15 bp, Homo sapiens
ttacttgagatggcc

SEQ ID NO: 316592 - DNA, 15 bp, Homo sapiens
tacttgagatggcct

SEQ ID NO: 316593 - DNA, 15 bp, Homo sapiens
acttgagatggcctc

SEQ ID NO: 316594 - DNA, 15 bp, Homo sapiens
cttgagatggcctcc

SEQ ID NO: 316595 - DNA, 15 bp, Homo sapiens
ttgagatggcctcct

SEQ ID NO: 316596 - DNA, 15 bp, Homo sapiens
tgagatggcctcctc

SEQ ID NO: 316597 - DNA, 15 bp, Homo sapiens
gagatggcctcctct

SEQ ID NO: 316598 - DNA, 15 bp, Homo sapiens
agatggcctcctctc

SEQ ID NO: 316599 - DNA, 15 bp, Homo sapiens
gatggcctcctctct

SEQ ID NO: 316600 - DNA, 15 bp, Homo sapiens
atggcctcctctctc

SEQ ID NO: 316601 - DNA, 15 bp, Homo sapiens
tggcctcctctctct

SEQ ID NO: 316602 - DNA, 15 bp, Homo sapiens
ggcctcctctctctc

SEQ ID NO: 316603 - DNA, 15 bp, Homo sapiens
gcctcctctctctca

SEQ ID NO: 316604 - DNA, 15 bp, Homo sapiens
cctcctctctctcac

SEQ ID NO: 316605 - DNA, 15 bp, Homo sapiens
ctcctctctctcact

SEQ ID NO: 316606 - DNA, 15 bp, Homo sapiens
tcctctctctcactc

SEQ ID NO: 316607 - DNA, 15 bp, Homo sapiens
cctctctctcactcc

SEQ ID NO: 316608 - DNA, 15 bp, Homo sapiens
ctctctctcactcct

SEQ ID NO: 316609 - DNA, 15 bp, Homo sapiens
tctctctcactcctg

SEQ ID NO: 316610 - DNA, 15 bp, Homo sapiens
ctctctcactcctgg

SEQ ID NO: 316611 - DNA, 15 bp, Homo sapiens
tctctcactcctggt

SEQ ID NO: 316612 - DNA, 15 bp, Homo sapiens
ctctcactcctggtt

SEQ ID NO: 316613 - DNA, 15 bp, Homo sapiens
tctcactcctggttt

SEQ ID NO: 316614 - DNA, 15 bp, Homo sapiens
ctcactcctggtttg

SEQ ID NO: 316615 - DNA, 15 bp, Homo sapiens
tcactcctggtttgg

SEQ ID NO: 316616 - DNA, 15 bp, Homo sapiens
cactcctggtttggg

SEQ ID NO: 316617 - DNA, 15 bp, Homo sapiens
actcctggtttggga

SEQ ID NO: 316618 - DNA, 15 bp, Homo sapiens
ctcctggtttgggaa

SEQ ID NO: 316619 - DNA, 15 bp, Homo sapiens
tcctggtttgggaag

SEQ ID NO: 316620 - DNA, 15 bp, Homo sapiens
cctggtttgggaagg

SEQ ID NO: 316621 - DNA, 15 bp, Homo sapiens
ctggtttgggaaggc

SEQ ID NO: 316622 - DNA, 15 bp, Homo sapiens
tggtttgggaaggcc

SEQ ID NO: 316623 - DNA, 15 bp, Homo sapiens
ggtttgggaaggcct

SEQ ID NO: 316624 - DNA, 15 bp, Homo sapiens
gtttgggaaggcctt

SEQ ID NO: 316625 - DNA, 15 bp, Homo sapiens
tttgggaaggccttg

SEQ ID NO: 316626 - DNA, 15 bp, Homo sapiens
ttgggaaggccttgc

SEQ ID NO: 316627 - DNA, 15 bp, Homo sapiens
tgggaaggccttgct

SEQ ID NO: 316628 - DNA, 15 bp, Homo sapiens
gggaaggccttgctt

SEQ ID NO: 316629 - DNA, 15 bp, Homo sapiens
ggaaggccttgcttc

SEQ ID NO: 316630 - DNA, 15 bp, Homo sapiens
gaaggccttgcttcc

SEQ ID NO: 316631 - DNA, 15 bp, Homo sapiens
aaggccttgcttcct

SEQ ID NO: 316632 - DNA, 15 bp, Homo sapiens
aggccttgcttcctc

SEQ ID NO: 316633 - DNA, 15 bp, Homo sapiens
ggccttgcttcctct

SEQ ID NO: 316634 - DNA, 15 bp, Homo sapiens
gccttgcttcctctg

SEQ ID NO: 316635 - DNA, 15 bp, Homo sapiens
ccttgcttcctctga

SEQ ID NO: 316636 - DNA, 15 bp, Homo sapiens
cttgcttcctctgaa

SEQ ID NO: 316637 - DNA, 15 bp, Homo sapiens
ttgcttcctctgaaa

SEQ ID NO: 316638 - DNA, 15 bp, Homo sapiens
tgcttcctctgaaag

SEQ ID NO: 316639 - DNA, 15 bp, Homo sapiens
gcttcctctgaaagc

SEQ ID NO: 316640 - DNA, 15 bp, Homo sapiens
cttcctctgaaagct

SEQ ID NO: 316641 - DNA, 15 bp, Homo sapiens
ttcctctgaaagctt

SEQ ID NO: 316642 - DNA, 15 bp, Homo sapiens
tcctctgaaagcttg

SEQ ID NO: 316643 - DNA, 15 bp, Homo sapiens
cctctgaaagcttgt

SEQ ID NO: 316644 - DNA, 15 bp, Homo sapiens
ctctgaaagcttgtg

SEQ ID NO: 316645 - DNA, 15 bp, Homo sapiens
tctgaaagcttgtga

SEQ ID NO: 316646 - DNA, 15 bp, Homo sapiens
ctgaaagcttgtgag

SEQ ID NO: 316647 - DNA, 15 bp, Homo sapiens
tgaaagcttgtgagc

SEQ ID NO: 316648 - DNA, 15 bp, Homo sapiens
gaaagcttgtgagca

SEQ ID NO: 316649 - DNA, 15 bp, Homo sapiens
aaagcttgtgagcag

SEQ ID NO: 316650 - DNA, 15 bp, Homo sapiens
aagcttgtgagcaga

SEQ ID NO: 316651 - DNA, 15 bp, Homo sapiens
agcttgtgagcagag

SEQ ID NO: 316652 - DNA, 15 bp, Homo sapiens
gcttgtgagcagagg

SEQ ID NO: 316653 - DNA, 15 bp, Homo sapiens
cttgtgagcagaggg

SEQ ID NO: 316654 - DNA, 15 bp, Homo sapiens
ttgtgagcagagggc

SEQ ID NO: 316655 - DNA, 15 bp, Homo sapiens
tgtgagcagagggct

SEQ ID NO: 316656 - DNA, 15 bp, Homo sapiens
gtgagcagagggctg

SEQ ID NO: 316657 - DNA, 15 bp, Homo sapiens
tgagcagagggctga

SEQ ID NO: 316658 - DNA, 15 bp, Homo sapiens
gagcagagggctgat

SEQ ID NO: 316659 - DNA, 15 bp, Homo sapiens
agcagagggctgatc

SEQ ID NO: 316660 - DNA, 15 bp, Homo sapiens
gcagagggctgatct

SEQ ID NO: 316661 - DNA, 15 bp, Homo sapiens
cagagggctgatctg

SEQ ID NO: 316662 - DNA, 15 bp, Homo sapiens
agagggctgatctga

SEQ ID NO: 316663 - DNA, 15 bp, Homo sapiens
gagggctgatctgat

SEQ ID NO: 316664 - DNA, 15 bp, Homo sapiens
agggctgatctgatc

SEQ ID NO: 316665 - DNA, 15 bp, Homo sapiens
gggctgatctgatca

SEQ ID NO: 316666 - DNA, 15 bp, Homo sapiens
ggctgatctgatcag

SEQ ID NO: 316667 - DNA, 15 bp, Homo sapiens
gctgatctgatcaga

SEQ ID NO: 316668 - DNA, 15 bp, Homo sapiens
ctgatctgatcagat

SEQ ID NO: 316669 - DNA, 15 bp, Homo sapiens
tgatctgatcagatt

SEQ ID NO: 316670 - DNA, 15 bp, Homo sapiens
gatctgatcagattt

SEQ ID NO: 316671 - DNA, 15 bp, Homo sapiens
atctgatcagatttg

SEQ ID NO: 316672 - DNA, 15 bp, Homo sapiens
tctgatcagatttgc

SEQ ID NO: 316673 - DNA, 15 bp, Homo sapiens
ctgatcagatttgct

SEQ ID NO: 316674 - DNA, 15 bp, Homo sapiens
tgatcagatttgctc

SEQ ID NO: 316675 - DNA, 15 bp, Homo sapiens
gatcagatttgctct

SEQ ID NO: 316676 - DNA, 15 bp, Homo sapiens
atcagatttgctctt

SEQ ID NO: 316677 - DNA, 15 bp, Homo sapiens
tcagatttgctcttc

SEQ ID NO: 316678 - DNA, 15 bp, Homo sapiens
cagatttgctcttct

SEQ ID NO: 316679 - DNA, 15 bp, Homo sapiens
agatttgctcttctg

SEQ ID NO: 316680 - DNA, 15 bp, Homo sapiens
gatttgctcttctga

SEQ ID NO: 316681 - DNA, 15 bp, Homo sapiens
atttgctcttctgag

SEQ ID NO: 316682 - DNA, 15 bp, Homo sapiens
tttgctcttctgagt

SEQ ID NO: 316683 - DNA, 15 bp, Homo sapiens
ttgctcttctgagtg

SEQ ID NO: 316684 - DNA, 15 bp, Homo sapiens
tgctcttctgagtgg

SEQ ID NO: 316685 - DNA, 15 bp, Homo sapiens
gctcttctgagtggt

SEQ ID NO: 316686 - DNA, 15 bp, Homo sapiens
ctcttctgagtggtg

SEQ ID NO: 316687 - DNA, 15 bp, Homo sapiens
tcttctgagtggtgc

SEQ ID NO: 316688 - DNA, 15 bp, Homo sapiens
cttctgagtggtgct

SEQ ID NO: 316689 - DNA, 15 bp, Homo sapiens
ttctgagtggtgctc

SEQ ID NO: 316690 - DNA, 15 bp, Homo sapiens
tctgagtggtgctct

SEQ ID NO: 316691 - DNA, 15 bp, Homo sapiens
ctgagtggtgctcta

SEQ ID NO: 316692 - DNA, 15 bp, Homo sapiens
tgagtggtgctctag

SEQ ID NO: 316693 - DNA, 15 bp, Homo sapiens
gagtggtgctctaga

SEQ ID NO: 316694 - DNA, 15 bp, Homo sapiens
agtggtgctctagaa

SEQ ID NO: 316695 - DNA, 15 bp, Homo sapiens
gtggtgctctagaag

SEQ ID NO: 316696 - DNA, 15 bp, Homo sapiens
tggtgctctagaagc

SEQ ID NO: 316697 - DNA, 15 bp, Homo sapiens
ggtgctctagaagcc

SEQ ID NO: 316698 - DNA, 15 bp, Homo sapiens
gtgctctagaagcca

SEQ ID NO: 316699 - DNA, 15 bp, Homo sapiens
tgctctagaagccac

SEQ ID NO: 316700 - DNA, 15 bp, Homo sapiens
gctctagaagccacg

SEQ ID NO: 316701 - DNA, 15 bp, Homo sapiens
ctctagaagccacgt

SEQ ID NO: 316702 - DNA, 15 bp, Homo sapiens
tctagaagccacgtg

SEQ ID NO: 316703 - DNA, 15 bp, Homo sapiens
ctagaagccacgtgg

SEQ ID NO: 316704 - DNA, 15 bp, Homo sapiens
tagaagccacgtgga

SEQ ID NO: 316705 - DNA, 15 bp, Homo sapiens
agaagccacgtggag

SEQ ID NO: 316706 - DNA, 15 bp, Homo sapiens
gaagccacgtggagc

SEQ ID NO: 316707 - DNA, 15 bp, Homo sapiens
aagccacgtggagca

SEQ ID NO: 316708 - DNA, 15 bp, Homo sapiens
agccacgtggagcat

SEQ ID NO: 316709 - DNA, 15 bp, Homo sapiens
gccacgtggagcatg

SEQ ID NO: 316710 - DNA, 15 bp, Homo sapiens
ccacgtggagcatgg

SEQ ID NO: 316711 - DNA, 15 bp, Homo sapiens
cacgtggagcatgga

SEQ ID NO: 316712 - DNA, 15 bp, Homo sapiens
acgtggagcatggat

SEQ ID NO: 316713 - DNA, 15 bp, Homo sapiens
cgtggagcatggatg

SEQ ID NO: 316714 - DNA, 15 bp, Homo sapiens
gtggagcatggatgg

SEQ ID NO: 316715 - DNA, 15 bp, Homo sapiens
tggagcatggatggt

SEQ ID NO: 316716 - DNA, 15 bp, Homo sapiens
ggagcatggatggtg

SEQ ID NO: 316717 - DNA, 15 bp, Homo sapiens
gagcatggatggtgt

SEQ ID NO: 316718 - DNA, 15 bp, Homo sapiens
agcatggatggtgtg

SEQ ID NO: 316719 - DNA, 15 bp, Homo sapiens
gcatggatggtgtgg

SEQ ID NO: 316720 - DNA, 15 bp, Homo sapiens
catggatggtgtggg

SEQ ID NO: 316721 - DNA, 15 bp, Homo sapiens
atggatggtgtgggg

SEQ ID NO: 316722 - DNA, 15 bp, Homo sapiens
tggatggtgtggggt

SEQ ID NO: 316723 - DNA, 15 bp, Homo sapiens
ggatggtgtggggtg

SEQ ID NO: 316724 - DNA, 15 bp, Homo sapiens
gatggtgtggggtgt

SEQ ID NO: 316725 - DNA, 15 bp, Homo sapiens
atggtgtggggtgtg

SEQ ID NO: 316726 - DNA, 15 bp, Homo sapiens
tggtgtggggtgtgt

SEQ ID NO: 316727 - DNA, 15 bp, Homo sapiens
ggtgtggggtgtgtg

SEQ ID NO: 316728 - DNA, 15 bp, Homo sapiens
gtgtggggtgtgtgc

SEQ ID NO: 316729 - DNA, 15 bp, Homo sapiens
tgtggggtgtgtgct

SEQ ID NO: 316730 - DNA, 15 bp, Homo sapiens
gtggggtgtgtgctg

SEQ ID NO: 316731 - DNA, 15 bp, Homo sapiens
tggggtgtgtgctgg

SEQ ID NO: 316732 - DNA, 15 bp, Homo sapiens
ggggtgtgtgctgga

SEQ ID NO: 316733 - DNA, 15 bp, Homo sapiens
gggtgtgtgctggat

SEQ ID NO: 316734 - DNA, 15 bp, Homo sapiens
ggtgtgtgctggatg

SEQ ID NO: 316735 - DNA, 15 bp, Homo sapiens
gtgtgtgctggatga

SEQ ID NO: 316736 - DNA, 15 bp, Homo sapiens
tgtgtgctggatgag

SEQ ID NO: 316737 - DNA, 15 bp, Homo sapiens
gtgtgctggatgagg

SEQ ID NO: 316738 - DNA, 15 bp, Homo sapiens
tgtgctggatgaggc

SEQ ID NO: 316739 - DNA, 15 bp, Homo sapiens
gtgctggatgaggca

SEQ ID NO: 316740 - DNA, 15 bp, Homo sapiens
tgctggatgaggcaa

SEQ ID NO: 316741 - DNA, 15 bp, Homo sapiens
gctggatgaggcaag

SEQ ID NO: 316742 - DNA, 15 bp, Homo sapiens
ctggatgaggcaagc

SEQ ID NO: 316743 - DNA, 15 bp, Homo sapiens
tggatgaggcaagcc

SEQ ID NO: 316744 - DNA, 15 bp, Homo sapiens
ggatgaggcaagcct

SEQ ID NO: 316745 - DNA, 15 bp, Homo sapiens
gatgaggcaagcctg

SEQ ID NO: 316746 - DNA, 15 bp, Homo sapiens
atgaggcaagcctgg

SEQ ID NO: 316747 - DNA, 15 bp, Homo sapiens
tgaggcaagcctggg

SEQ ID NO: 316748 - DNA, 15 bp, Homo sapiens
gaggcaagcctgggg

SEQ ID NO: 316749 - DNA, 15 bp, Homo sapiens
aggcaagcctggggt

SEQ ID NO: 316750 - DNA, 15 bp, Homo sapiens
ggcaagcctggggtt

SEQ ID NO: 316751 - DNA, 15 bp, Homo sapiens
gcaagcctggggttc

SEQ ID NO: 316752 - DNA, 15 bp, Homo sapiens
caagcctggggttct

SEQ ID NO: 316753 - DNA, 15 bp, Homo sapiens
aagcctggggttctg

SEQ ID NO: 316754 - DNA, 15 bp, Homo sapiens
agcctggggttctgg

SEQ ID NO: 316755 - DNA, 15 bp, Homo sapiens
gcctggggttctgga

SEQ ID NO: 316756 - DNA, 15 bp, Homo sapiens
cctggggttctggag

SEQ ID NO: 316757 - DNA, 15 bp, Homo sapiens
ctggggttctggagg

SEQ ID NO: 316758 - DNA, 15 bp, Homo sapiens
tggggttctggagga

SEQ ID NO: 316759 - DNA, 15 bp, Homo sapiens
ggggttctggaggac

SEQ ID NO: 316760 - DNA, 15 bp, Homo sapiens
gggttctggaggacc

SEQ ID NO: 316761 - DNA, 15 bp, Homo sapiens
ggttctggaggacct

SEQ ID NO: 316762 - DNA, 15 bp, Homo sapiens
gttctggaggacctt

SEQ ID NO: 316763 - DNA, 15 bp, Homo sapiens
ttctggaggaccttt

SEQ ID NO: 316764 - DNA, 15 bp, Homo sapiens
tctggaggacctttg

SEQ ID NO: 316765 - DNA, 15 bp, Homo sapiens
ctggaggacctttgg

SEQ ID NO: 316766 - DNA, 15 bp, Homo sapiens
tggaggacctttggg

SEQ ID NO: 316767 - DNA, 15 bp, Homo sapiens
ggaggacctttgggt

SEQ ID NO: 316768 - DNA, 15 bp, Homo sapiens
gaggacctttgggtg

SEQ ID NO: 316769 - DNA, 15 bp, Homo sapiens
aggacctttgggtgg

SEQ ID NO: 316770 - DNA, 15 bp, Homo sapiens
ggacctttgggtggc

SEQ ID NO: 316771 - DNA, 15 bp, Homo sapiens
gacctttgggtggct

SEQ ID NO: 316772 - DNA, 15 bp, Homo sapiens
acctttgggtggctg

SEQ ID NO: 316773 - DNA, 15 bp, Homo sapiens
cctttgggtggctgt

SEQ ID NO: 316774 - DNA, 15 bp, Homo sapiens
ctttgggtggctgtc

SEQ ID NO: 316775 - DNA, 15 bp, Homo sapiens
tttgggtggctgtca

SEQ ID NO: 316776 - DNA, 15 bp, Homo sapiens
ttgggtggctgtcac

SEQ ID NO: 316777 - DNA, 15 bp, Homo sapiens
tgggtggctgtcaca

SEQ ID NO: 316778 - DNA, 15 bp, Homo sapiens
gggtggctgtcacag

SEQ ID NO: 316779 - DNA, 15 bp, Homo sapiens
ggtggctgtcacagt

SEQ ID NO: 316780 - DNA, 15 bp, Homo sapiens
gtggctgtcacagtt

SEQ ID NO: 316781 - DNA, 15 bp, Homo sapiens
tggctgtcacagtta

SEQ ID NO: 316782 - DNA, 15 bp, Homo sapiens
ggctgtcacagttag

SEQ ID NO: 316783 - DNA, 15 bp, Homo sapiens
gctgtcacagttaga

SEQ ID NO: 316784 - DNA, 15 bp, Homo sapiens
ctgtcacagttagag

SEQ ID NO: 316785 - DNA, 15 bp, Homo sapiens
tgtcacagttagagg

SEQ ID NO: 316786 - DNA, 15 bp, Homo sapiens
gtcacagttagagga

SEQ ID NO: 316787 - DNA, 15 bp, Homo sapiens
tcacagttagaggat

SEQ ID NO: 316788 - DNA, 15 bp, Homo sapiens
cacagttagaggata

SEQ ID NO: 316789 - DNA, 15 bp, Homo sapiens
acagttagaggataa

SEQ ID NO: 316790 - DNA, 15 bp, Homo sapiens
cagttagaggataag

SEQ ID NO: 316791 - DNA, 15 bp, Homo sapiens
agttagaggataaga

SEQ ID NO: 316792 - DNA, 15 bp, Homo sapiens
gttagaggataagag

SEQ ID NO: 316793 - DNA, 15 bp, Homo sapiens
ttagaggataagagg

SEQ ID NO: 316794 - DNA, 15 bp, Homo sapiens
tagaggataagaggt

SEQ ID NO: 316795 - DNA, 15 bp, Homo sapiens
agaggataagaggta

SEQ ID NO: 316796 - DNA, 15 bp, Homo sapiens
gaggataagaggtat

SEQ ID NO: 316797 - DNA, 15 bp, Homo sapiens
aggataagaggtatt

SEQ ID NO: 316798 - DNA, 15 bp, Homo sapiens
ggataagaggtattg

SEQ ID NO: 316799 - DNA, 15 bp, Homo sapiens
gataagaggtattga

SEQ ID NO: 316800 - DNA, 15 bp, Homo sapiens
ataagaggtattgaa

SEQ ID NO: 316801 - DNA, 15 bp, Homo sapiens
taagaggtattgaag

SEQ ID NO: 316802 - DNA, 15 bp, Homo sapiens
aagaggtattgaagc

SEQ ID NO: 316803 - DNA, 15 bp, Homo sapiens
agaggtattgaagcc

SEQ ID NO: 316804 - DNA, 15 bp, Homo sapiens
gaggtattgaagcca

SEQ ID NO: 316805 - DNA, 15 bp, Homo sapiens
aggtattgaagccaa

SEQ ID NO: 316806 - DNA, 15 bp, Homo sapiens
ggtattgaagccaaa

SEQ ID NO: 316807 - DNA, 15 bp, Homo sapiens
gtattgaagccaaaa

SEQ ID NO: 316808 - DNA, 15 bp, Homo sapiens
tattgaagccaaaac

SEQ ID NO: 316809 - DNA, 15 bp, Homo sapiens
attgaagccaaaact

SEQ ID NO: 316810 - DNA, 15 bp, Homo sapiens
ttgaagccaaaactg

SEQ ID NO: 316811 - DNA, 15 bp, Homo sapiens
tgaagccaaaactga

SEQ ID NO: 316812 - DNA, 15 bp, Homo sapiens
gaagccaaaactgag

SEQ ID NO: 316813 - DNA, 15 bp, Homo sapiens
aagccaaaactgaga

SEQ ID NO: 316814 - DNA, 15 bp, Homo sapiens
agccaaaactgagat

SEQ ID NO: 316815 - DNA, 15 bp, Homo sapiens
gccaaaactgagatt

SEQ ID NO: 316816 - DNA, 15 bp, Homo sapiens
ccaaaactgagattg

SEQ ID NO: 316817 - DNA, 15 bp, Homo sapiens
caaaactgagattga

SEQ ID NO: 316818 - DNA, 15 bp, Homo sapiens
aaaactgagattgag

SEQ ID NO: 316819 - DNA, 15 bp, Homo sapiens
aaactgagattgagg

SEQ ID NO: 316820 - DNA, 15 bp, Homo sapiens
aactgagattgaggt

SEQ ID NO: 316821 - DNA, 15 bp, Homo sapiens
actgagattgaggta

SEQ ID NO: 316822 - DNA, 15 bp, Homo sapiens
ctgagattgaggtag

SEQ ID NO: 316823 - DNA, 15 bp, Homo sapiens
tgagattgaggtagc

SEQ ID NO: 316824 - DNA, 15 bp, Homo sapiens
gagattgaggtagct

SEQ ID NO: 316825 - DNA, 15 bp, Homo sapiens
agattgaggtagctg

SEQ ID NO: 316826 - DNA, 15 bp, Homo sapiens
gattgaggtagctgg

SEQ ID NO: 316827 - DNA, 15 bp, Homo sapiens
attgaggtagctggg

SEQ ID NO: 316828 - DNA, 15 bp, Homo sapiens
ttgaggtagctggga

SEQ ID NO: 316829 - DNA, 15 bp, Homo sapiens
tgaggtagctgggaa

SEQ ID NO: 316830 - DNA, 15 bp, Homo sapiens
gaggtagctgggaag

SEQ ID NO: 316831 - DNA, 15 bp, Homo sapiens
aggtagctgggaagg

SEQ ID NO: 316832 - DNA, 15 bp, Homo sapiens
ggtagctgggaagga

SEQ ID NO: 316833 - DNA, 15 bp, Homo sapiens
gtagctgggaaggag

SEQ ID NO: 316834 - DNA, 15 bp, Homo sapiens
tagctgggaaggagg

SEQ ID NO: 316835 - DNA, 15 bp, Homo sapiens
agctgggaaggagga

SEQ ID NO: 316836 - DNA, 15 bp, Homo sapiens
gctgggaaggaggag

SEQ ID NO: 316837 - DNA, 15 bp, Homo sapiens
ctgggaaggaggaga

SEQ ID NO: 316838 - DNA, 15 bp, Homo sapiens
tgggaaggaggagag

SEQ ID NO: 316839 - DNA, 15 bp, Homo sapiens
gggaaggaggagagg

SEQ ID NO: 316840 - DNA, 15 bp, Homo sapiens
ggaaggaggagaggg

SEQ ID NO: 316841 - DNA, 15 bp, Homo sapiens
gaaggaggagagggg

SEQ ID NO: 316842 - DNA, 15 bp, Homo sapiens
aaggaggagagggga

SEQ ID NO: 316843 - DNA, 15 bp, Homo sapiens
aggaggagaggggag

SEQ ID NO: 316844 - DNA, 15 bp, Homo sapiens
ggaggagaggggaga

SEQ ID NO: 316845 - DNA, 15 bp, Homo sapiens
gaggagaggggagag

SEQ ID NO: 316846 - DNA, 15 bp, Homo sapiens
aggagaggggagagt

SEQ ID NO: 316847 - DNA, 15 bp, Homo sapiens
ggagaggggagagtt

SEQ ID NO: 316848 - DNA, 15 bp, Homo sapiens
gagaggggagagttt

SEQ ID NO: 316849 - DNA, 15 bp, Homo sapiens
agaggggagagttta

SEQ ID NO: 316850 - DNA, 15 bp, Homo sapiens
gaggggagagtttag

SEQ ID NO: 316851 - DNA, 15 bp, Homo sapiens
aggggagagtttaga

SEQ ID NO: 316852 - DNA, 15 bp, Homo sapiens
ggggagagtttagaa

SEQ ID NO: 316853 - DNA, 15 bp, Homo sapiens
gggagagtttagaag

SEQ ID NO: 316854 - DNA, 15 bp, Homo sapiens
ggagagtttagaagc

SEQ ID NO: 316855 - DNA, 15 bp, Homo sapiens
gagagtttagaagct

SEQ ID NO: 316856 - DNA, 15 bp, Homo sapiens
agagtttagaagctt

SEQ ID NO: 316857 - DNA, 15 bp, Homo sapiens
gagtttagaagcttt

SEQ ID NO: 316858 - DNA, 15 bp, Homo sapiens
agtttagaagcttta

SEQ ID NO: 316859 - DNA, 15 bp, Homo sapiens
gtttagaagctttag

SEQ ID NO: 316860 - DNA, 15 bp, Homo sapiens
tttagaagctttagg

SEQ ID NO: 316861 - DNA, 15 bp, Homo sapiens
ttagaagctttaggt

SEQ ID NO: 316862 - DNA, 15 bp, Homo sapiens
tagaagctttaggta

SEQ ID NO: 316863 - DNA, 15 bp, Homo sapiens
agaagctttaggtag

SEQ ID NO: 316864 - DNA, 15 bp, Homo sapiens
gaagctttaggtagg

SEQ ID NO: 316865 - DNA, 15 bp, Homo sapiens
aagctttaggtagga

SEQ ID NO: 316866 - DNA, 15 bp, Homo sapiens
agctttaggtaggag

SEQ ID NO: 316867 - DNA, 15 bp, Homo sapiens
gctttaggtaggagg

SEQ ID NO: 316868 - DNA, 15 bp, Homo sapiens
ctttaggtaggaggc

SEQ ID NO: 316869 - DNA, 15 bp, Homo sapiens
tttaggtaggaggca

SEQ ID NO: 316870 - DNA, 15 bp, Homo sapiens
ttaggtaggaggcag

SEQ ID NO: 316871 - DNA, 15 bp, Homo sapiens
taggtaggaggcaga

SEQ ID NO: 316872 - DNA, 15 bp, Homo sapiens
aggtaggaggcagac

SEQ ID NO: 316873 - DNA, 15 bp, Homo sapiens
ggtaggaggcagacc

SEQ ID NO: 316874 - DNA, 15 bp, Homo sapiens
gtaggaggcagacct

SEQ ID NO: 316875 - DNA, 15 bp, Homo sapiens
taggaggcagacctg

SEQ ID NO: 316876 - DNA, 15 bp, Homo sapiens
aggaggcagacctga

SEQ ID NO: 316877 - DNA, 15 bp, Homo sapiens
ggaggcagacctgat

SEQ ID NO: 316878 - DNA, 15 bp, Homo sapiens
gaggcagacctgata

SEQ ID NO: 316879 - DNA, 15 bp, Homo sapiens
aggcagacctgatag

SEQ ID NO: 316880 - DNA, 15 bp, Homo sapiens
ggcagacctgatagg

SEQ ID NO: 316881 - DNA, 15 bp, Homo sapiens
gcagacctgatagga

SEQ ID NO: 316882 - DNA, 15 bp, Homo sapiens
cagacctgataggac

SEQ ID NO: 316883 - DNA, 15 bp, Homo sapiens
agacctgataggaca

SEQ ID NO: 316884 - DNA, 15 bp, Homo sapiens
gacctgataggacat

SEQ ID NO: 316885 - DNA, 15 bp, Homo sapiens
acctgataggacatg

SEQ ID NO: 316886 - DNA, 15 bp, Homo sapiens
cctgataggacatgg

SEQ ID NO: 316887 - DNA, 15 bp, Homo sapiens
ctgataggacatggt

SEQ ID NO: 316888 - DNA, 15 bp, Homo sapiens
tgataggacatggtg

SEQ ID NO: 316889 - DNA, 15 bp, Homo sapiens
gataggacatggtgg

SEQ ID NO: 316890 - DNA, 15 bp, Homo sapiens
ataggacatggtggt

SEQ ID NO: 316891 - DNA, 15 bp, Homo sapiens
taggacatggtggtg

SEQ ID NO: 316892 - DNA, 15 bp, Homo sapiens
aggacatggtggtgg

SEQ ID NO: 316893 - DNA, 15 bp, Homo sapiens
ggacatggtggtggt

SEQ ID NO: 316894 - DNA, 15 bp, Homo sapiens
gacatggtggtggtc

SEQ ID NO: 316895 - DNA, 15 bp, Homo sapiens
acatggtggtggtct

SEQ ID NO: 316896 - DNA, 15 bp, Homo sapiens
catggtggtggtctt

SEQ ID NO: 316897 - DNA, 15 bp, Homo sapiens
atggtggtggtcttc

SEQ ID NO: 316898 - DNA, 15 bp, Homo sapiens
tggtggtggtcttca

SEQ ID NO: 316899 - DNA, 15 bp, Homo sapiens
ggtggtggtcttcag

SEQ ID NO: 316900 - DNA, 15 bp, Homo sapiens
gtggtggtcttcaga

SEQ ID NO: 316901 - DNA, 15 bp, Homo sapiens
tggtggtcttcagat

SEQ ID NO: 316902 - DNA, 15 bp, Homo sapiens
ggtggtcttcagatg

SEQ ID NO: 316903 - DNA, 15 bp, Homo sapiens
gtggtcttcagatga

SEQ ID NO: 316904 - DNA, 15 bp, Homo sapiens
tggtcttcagatgat

SEQ ID NO: 316905 - DNA, 15 bp, Homo sapiens
ggtcttcagatgatg

SEQ ID NO: 316906 - DNA, 15 bp, Homo sapiens
gtcttcagatgatgg

SEQ ID NO: 316907 - DNA, 15 bp, Homo sapiens
tcttcagatgatggg

SEQ ID NO: 316908 - DNA, 15 bp, Homo sapiens
cttcagatgatgggt

SEQ ID NO: 316909 - DNA, 15 bp, Homo sapiens
ttcagatgatgggtg

SEQ ID NO: 316910 - DNA, 15 bp, Homo sapiens
tcagatgatgggtgg

SEQ ID NO: 316911 - DNA, 15 bp, Homo sapiens
cagatgatgggtggt

SEQ ID NO: 316912 - DNA, 15 bp, Homo sapiens
agatgatgggtggtg

SEQ ID NO: 316913 - DNA, 15 bp, Homo sapiens
gatgatgggtggtgg

SEQ ID NO: 316914 - DNA, 15 bp, Homo sapiens
atgatgggtggtgga

SEQ ID NO: 316915 - DNA, 15 bp, Homo sapiens
tgatgggtggtggat

SEQ ID NO: 316916 - DNA, 15 bp, Homo sapiens
gatgggtggtggatg

SEQ ID NO: 316917 - DNA, 15 bp, Homo sapiens
atgggtggtggatgg

SEQ ID NO: 316918 - DNA, 15 bp, Homo sapiens
tgggtggtggatggg

SEQ ID NO: 316919 - DNA, 15 bp, Homo sapiens
gggtggtggatggga

SEQ ID NO: 316920 - DNA, 15 bp, Homo sapiens
ggtggtggatgggat

SEQ ID NO: 316921 - DNA, 15 bp, Homo sapiens
gtggtggatgggatg

SEQ ID NO: 316922 - DNA, 15 bp, Homo sapiens
tggtggatgggatgg

SEQ ID NO: 316923 - DNA, 15 bp, Homo sapiens
ggtggatgggatgga

SEQ ID NO: 316924 - DNA, 15 bp, Homo sapiens
gtggatgggatggag

SEQ ID NO: 316925 - DNA, 15 bp, Homo sapiens
tggatgggatggaga

SEQ ID NO: 316926 - DNA, 15 bp, Homo sapiens
ggatgggatggagag

SEQ ID NO: 316927 - DNA, 15 bp, Homo sapiens
gatgggatggagaga

SEQ ID NO: 316928 - DNA, 15 bp, Homo sapiens
atgggatggagagag

SEQ ID NO: 316929 - DNA, 15 bp, Homo sapiens
tgggatggagagaga

SEQ ID NO: 316930 - DNA, 15 bp, Homo sapiens
gggatggagagagaa

SEQ ID NO: 316931 - DNA, 15 bp, Homo sapiens
ggatggagagagaag

SEQ ID NO: 316932 - DNA, 15 bp, Homo sapiens
gatggagagagaagc

SEQ ID NO: 316933 - DNA, 15 bp, Homo sapiens
atggagagagaagcc

SEQ ID NO: 316934 - DNA, 15 bp, Homo sapiens
tggagagagaagcct

SEQ ID NO: 316935 - DNA, 15 bp, Homo sapiens
ggagagagaagcctg

SEQ ID NO: 316936 - DNA, 15 bp, Homo sapiens
gagagagaagcctgg

SEQ ID NO: 316937 - DNA, 15 bp, Homo sapiens
agagagaagcctggt

SEQ ID NO: 316938 - DNA, 15 bp, Homo sapiens
gagagaagcctggtt

SEQ ID NO: 316939 - DNA, 15 bp, Homo sapiens
agagaagcctggttt

SEQ ID NO: 316940 - DNA, 15 bp, Homo sapiens
gagaagcctggtttt

SEQ ID NO: 316941 - DNA, 15 bp, Homo sapiens
agaagcctggttttt

SEQ ID NO: 316942 - DNA, 15 bp, Homo sapiens
gaagcctggtttttg

SEQ ID NO: 316943 - DNA, 15 bp, Homo sapiens
aagcctggtttttga

SEQ ID NO: 316944 - DNA, 15 bp, Homo sapiens
agcctggtttttgac

SEQ ID NO: 316945 - DNA, 15 bp, Homo sapiens
gcctggtttttgact

SEQ ID NO: 316946 - DNA, 15 bp, Homo sapiens
cctggtttttgactt

SEQ ID NO: 316947 - DNA, 15 bp, Homo sapiens
ctggtttttgacttt

SEQ ID NO: 316948 - DNA, 15 bp, Homo sapiens
tggtttttgacttta

SEQ ID NO: 316949 - DNA, 15 bp, Homo sapiens
ggtttttgactttaa

SEQ ID NO: 316950 - DNA, 15 bp, Homo sapiens
gtttttgactttaac

SEQ ID NO: 316951 - DNA, 15 bp, Homo sapiens
tttttgactttaaca

SEQ ID NO: 316952 - DNA, 15 bp, Homo sapiens
ttttgactttaacac

SEQ ID NO: 316953 - DNA, 15 bp, Homo sapiens
tttgactttaacact

SEQ ID NO: 316954 - DNA, 15 bp, Homo sapiens
ttgactttaacactc

SEQ ID NO: 316955 - DNA, 15 bp, Homo sapiens
tgactttaacactcg

SEQ ID NO: 316956 - DNA, 15 bp, Homo sapiens
gactttaacactcgc

SEQ ID NO: 316957 - DNA, 15 bp, Homo sapiens
actttaacactcgca

SEQ ID NO: 316958 - DNA, 15 bp, Homo sapiens
ctttaacactcgcaa

SEQ ID NO: 316959 - DNA, 15 bp, Homo sapiens
tttaacactcgcaaa

SEQ ID NO: 316960 - DNA, 15 bp, Homo sapiens
ttaacactcgcaaat

SEQ ID NO: 316961 - DNA, 15 bp, Homo sapiens
taacactcgcaaatg

SEQ ID NO: 316962 - DNA, 15 bp, Homo sapiens
aacactcgcaaatga

SEQ ID NO: 316963 - DNA, 15 bp, Homo sapiens
acactcgcaaatgaa

SEQ ID NO: 316964 - DNA, 15 bp, Homo sapiens
cactcgcaaatgaag

SEQ ID NO: 316965 - DNA, 15 bp, Homo sapiens
actcgcaaatgaagc

SEQ ID NO: 316966 - DNA, 15 bp, Homo sapiens
ctcgcaaatgaagcc

SEQ ID NO: 316967 - DNA, 15 bp, Homo sapiens
tcgcaaatgaagcct

SEQ ID NO: 316968 - DNA, 15 bp, Homo sapiens
cgcaaatgaagcctt

SEQ ID NO: 316969 - DNA, 15 bp, Homo sapiens
gcaaatgaagccttt

SEQ ID NO: 316970 - DNA, 15 bp, Homo sapiens
caaatgaagcctttc

SEQ ID NO: 316971 - DNA, 15 bp, Homo sapiens
aaatgaagcctttct

SEQ ID NO: 316972 - DNA, 15 bp, Homo sapiens
aatgaagcctttctt

SEQ ID NO: 316973 - DNA, 15 bp, Homo sapiens
atgaagcctttcttt

SEQ ID NO: 316974 - DNA, 15 bp, Homo sapiens
tgaagcctttctttc

SEQ ID NO: 316975 - DNA, 15 bp, Homo sapiens
gaagcctttctttct

SEQ ID NO: 316976 - DNA, 15 bp, Homo sapiens
aagcctttctttcta

SEQ ID NO: 316977 - DNA, 15 bp, Homo sapiens
agcctttctttctag

SEQ ID NO: 316978 - DNA, 15 bp, Homo sapiens
gcctttctttctagg

SEQ ID NO: 316979 - DNA, 15 bp, Homo sapiens
cctttctttctaggt

SEQ ID NO: 316980 - DNA, 15 bp, Homo sapiens
ctttctttctaggtt

SEQ ID NO: 316981 - DNA, 15 bp, Homo sapiens
tttctttctaggttt

SEQ ID NO: 316982 - DNA, 15 bp, Homo sapiens
ttctttctaggtttt

SEQ ID NO: 316983 - DNA, 15 bp, Homo sapiens
tctttctaggttttg

SEQ ID NO: 316984 - DNA, 15 bp, Homo sapiens
ctttctaggttttgt

SEQ ID NO: 316985 - DNA, 15 bp, Homo sapiens
tttctaggttttgtg

SEQ ID NO: 316986 - DNA, 15 bp, Homo sapiens
ttctaggttttgtgg

SEQ ID NO: 316987 - DNA, 15 bp, Homo sapiens
tctaggttttgtgga

SEQ ID NO: 316988 - DNA, 15 bp, Homo sapiens
ctaggttttgtggag

SEQ ID NO: 316989 - DNA, 15 bp, Homo sapiens
taggttttgtggaga

SEQ ID NO: 316990 - DNA, 15 bp, Homo sapiens
aggttttgtggagag

SEQ ID NO: 316991 - DNA, 15 bp, Homo sapiens
ggttttgtggagagg

SEQ ID NO: 316992 - DNA, 15 bp, Homo sapiens
gttttgtggagaggg

SEQ ID NO: 316993 - DNA, 15 bp, Homo sapiens
ttttgtggagagggc

SEQ ID NO: 316994 - DNA, 15 bp, Homo sapiens
tttgtggagagggca

SEQ ID NO: 316995 - DNA, 15 bp, Homo sapiens
ttgtggagagggcag

SEQ ID NO: 316996 - DNA, 15 bp, Homo sapiens
tgtggagagggcagt

SEQ ID NO: 316997 - DNA, 15 bp, Homo sapiens
gtggagagggcagtg

SEQ ID NO: 316998 - DNA, 15 bp, Homo sapiens
tggagagggcagtgc

SEQ ID NO: 316999 - DNA, 15 bp, Homo sapiens
ggagagggcagtgca

SEQ ID NO: 317000 - DNA, 15 bp, Homo sapiens
gagagggcagtgcat

SEQ ID NO: 317001 - DNA, 15 bp, Homo sapiens
agagggcagtgcata

SEQ ID NO: 317002 - DNA, 15 bp, Homo sapiens
gagggcagtgcataa

SEQ ID NO: 317003 - DNA, 15 bp, Homo sapiens
agggcagtgcataag

SEQ ID NO: 317004 - DNA, 15 bp, Homo sapiens
gggcagtgcataagg

SEQ ID NO: 317005 - DNA, 15 bp, Homo sapiens
ggcagtgcataaggg

SEQ ID NO: 317006 - DNA, 15 bp, Homo sapiens
gcagtgcataagggg

SEQ ID NO: 317007 - DNA, 15 bp, Homo sapiens
cagtgcataagggga

SEQ ID NO: 317008 - DNA, 15 bp, Homo sapiens
agtgcataaggggat

SEQ ID NO: 317009 - DNA, 15 bp, Homo sapiens
gtgcataaggggata

SEQ ID NO: 317010 - DNA, 15 bp, Homo sapiens
tgcataaggggatag

SEQ ID NO: 317011 - DNA, 15 bp, Homo sapiens
gcataaggggatagt

SEQ ID NO: 317012 - DNA, 15 bp, Homo sapiens
cataaggggatagta

SEQ ID NO: 317013 - DNA, 15 bp, Homo sapiens
ataaggggatagtaa

SEQ ID NO: 317014 - DNA, 15 bp, Homo sapiens
taaggggatagtaag

SEQ ID NO: 317015 - DNA, 15 bp, Homo sapiens
aaggggatagtaagt

SEQ ID NO: 317016 - DNA, 15 bp, Homo sapiens
aggggatagtaagtg

SEQ ID NO: 317017 - DNA, 15 bp, Homo sapiens
ggggatagtaagtga

SEQ ID NO: 317018 - DNA, 15 bp, Homo sapiens
gggatagtaagtgaa

SEQ ID NO: 317019 - DNA, 15 bp, Homo sapiens
ggatagtaagtgaag

SEQ ID NO: 317020 - DNA, 15 bp, Homo sapiens
gatagtaagtgaagt

SEQ ID NO: 317021 - DNA, 15 bp, Homo sapiens
atagtaagtgaagtt

SEQ ID NO: 317022 - DNA, 15 bp, Homo sapiens
tagtaagtgaagttc

SEQ ID NO: 317023 - DNA, 15 bp, Homo sapiens
agtaagtgaagttct

SEQ ID NO: 317024 - DNA, 15 bp, Homo sapiens
gtaagtgaagttcta

SEQ ID NO: 317025 - DNA, 15 bp, Homo sapiens
taagtgaagttctag

SEQ ID NO: 317026 - DNA, 15 bp, Homo sapiens
aagtgaagttctaga

SEQ ID NO: 317027 - DNA, 15 bp, Homo sapiens
agtgaagttctagat

SEQ ID NO: 317028 - DNA, 15 bp, Homo sapiens
gtgaagttctagatt

SEQ ID NO: 317029 - DNA, 15 bp, Homo sapiens
tgaagttctagattg

SEQ ID NO: 317030 - DNA, 15 bp, Homo sapiens
gaagttctagattga

SEQ ID NO: 317031 - DNA, 15 bp, Homo sapiens
aagttctagattgag

SEQ ID NO: 317032 - DNA, 15 bp, Homo sapiens
agttctagattgagt

SEQ ID NO: 317033 - DNA, 15 bp, Homo sapiens
gttctagattgagtt

SEQ ID NO: 317034 - DNA, 15 bp, Homo sapiens
ttctagattgagttt

SEQ ID NO: 317035 - DNA, 15 bp, Homo sapiens
tctagattgagtttt

SEQ ID NO: 317036 - DNA, 15 bp, Homo sapiens
ctagattgagttttg

SEQ ID NO: 317037 - DNA, 15 bp, Homo sapiens
tagattgagttttga

SEQ ID NO: 317038 - DNA, 15 bp, Homo sapiens
agattgagttttgag

SEQ ID NO: 317039 - DNA, 15 bp, Homo sapiens
gattgagttttgagg

SEQ ID NO: 317040 - DNA, 15 bp, Homo sapiens
attgagttttgaggt

SEQ ID NO: 317041 - DNA, 15 bp, Homo sapiens
ttgagttttgaggtg

SEQ ID NO: 317042 - DNA, 15 bp, Homo sapiens
tgagttttgaggtgc

SEQ ID NO: 317043 - DNA, 15 bp, Homo sapiens
gagttttgaggtgcc

SEQ ID NO: 317044 - DNA, 15 bp, Homo sapiens
agttttgaggtgcct

SEQ ID NO: 317045 - DNA, 15 bp, Homo sapiens
gttttgaggtgcctg

SEQ ID NO: 317046 - DNA, 15 bp, Homo sapiens
ttttgaggtgcctgg

SEQ ID NO: 317047 - DNA, 15 bp, Homo sapiens
tttgaggtgcctgga

SEQ ID NO: 317048 - DNA, 15 bp, Homo sapiens
ttgaggtgcctggag

SEQ ID NO: 317049 - DNA, 15 bp, Homo sapiens
tgaggtgcctggaga

SEQ ID NO: 317050 - DNA, 15 bp, Homo sapiens
gaggtgcctggagat

SEQ ID NO: 317051 - DNA, 15 bp, Homo sapiens
aggtgcctggagata

SEQ ID NO: 317052 - DNA, 15 bp, Homo sapiens
ggtgcctggagatat

SEQ ID NO: 317053 - DNA, 15 bp, Homo sapiens
gtgcctggagatatc

SEQ ID NO: 317054 - DNA, 15 bp, Homo sapiens
tgcctggagatatct

SEQ ID NO: 317055 - DNA, 15 bp, Homo sapiens
gcctggagatatctg

SEQ ID NO: 317056 - DNA, 15 bp, Homo sapiens
cctggagatatctgg

SEQ ID NO: 317057 - DNA, 15 bp, Homo sapiens
ctggagatatctggg

SEQ ID NO: 317058 - DNA, 15 bp, Homo sapiens
tggagatatctggga

SEQ ID NO: 317059 - DNA, 15 bp, Homo sapiens
ggagatatctgggaa

SEQ ID NO: 317060 - DNA, 15 bp, Homo sapiens
gagatatctgggaaa

SEQ ID NO: 317061 - DNA, 15 bp, Homo sapiens
agatatctgggaaaa

SEQ ID NO: 317062 - DNA, 15 bp, Homo sapiens
gatatctgggaaaaa

SEQ ID NO: 317063 - DNA, 15 bp, Homo sapiens
atatctgggaaaaat

SEQ ID NO: 317064 - DNA, 15 bp, Homo sapiens
tatctgggaaaaata

SEQ ID NO: 317065 - DNA, 15 bp, Homo sapiens
atctgggaaaaatat

SEQ ID NO: 317066 - DNA, 15 bp, Homo sapiens
tctgggaaaaatatg

SEQ ID NO: 317067 - DNA, 15 bp, Homo sapiens
ctgggaaaaatatgt

SEQ ID NO: 317068 - DNA, 15 bp, Homo sapiens
tgggaaaaatatgta

SEQ ID NO: 317069 - DNA, 15 bp, Homo sapiens
gggaaaaatatgtaa

SEQ ID NO: 317070 - DNA, 15 bp, Homo sapiens
ggaaaaatatgtaat

SEQ ID NO: 317071 - DNA, 15 bp, Homo sapiens
gaaaaatatgtaata

SEQ ID NO: 317072 - DNA, 15 bp, Homo sapiens
aaaaatatgtaatat

SEQ ID NO: 317073 - DNA, 15 bp, Homo sapiens
aaaatatgtaatata

SEQ ID NO: 317074 - DNA, 15 bp, Homo sapiens
aaatatgtaatatat

SEQ ID NO: 317075 - DNA, 15 bp, Homo sapiens
aatatgtaatatata

SEQ ID NO: 317076 - DNA, 15 bp, Homo sapiens
atatgtaatatatat

SEQ ID NO: 317077 - DNA, 15 bp, Homo sapiens
tatgtaatatatata

SEQ ID NO: 317078 - DNA, 15 bp, Homo sapiens
atgtaatatatatat

SEQ ID NO: 317079 - DNA, 15 bp, Homo sapiens
tgtaatatatatatt

SEQ ID NO: 317080 - DNA, 15 bp, Homo sapiens
gtaatatatatattt

SEQ ID NO: 317081 - DNA, 15 bp, Homo sapiens
taatatatatatttc

SEQ ID NO: 317082 - DNA, 15 bp, Homo sapiens
aatatatatatttct

SEQ ID NO: 317083 - DNA, 15 bp, Homo sapiens
atatatatatttctc

SEQ ID NO: 317084 - DNA, 15 bp, Homo sapiens
tatatatatttctct

SEQ ID NO: 317085 - DNA, 15 bp, Homo sapiens
atatatatttctctt

SEQ ID NO: 317086 - DNA, 15 bp, Homo sapiens
tatatatttctctta

SEQ ID NO: 317087 - DNA, 15 bp, Homo sapiens
atatatttctcttac

SEQ ID NO: 317088 - DNA, 15 bp, Homo sapiens
tatatttctcttaca

SEQ ID NO: 317089 - DNA, 15 bp, Homo sapiens
atatttctcttacat

SEQ ID NO: 317090 - DNA, 15 bp, Homo sapiens
tatttctcttacatg

SEQ ID NO: 317091 - DNA, 15 bp, Homo sapiens
atttctcttacatgt

SEQ ID NO: 317092 - DNA, 15 bp, Homo sapiens
tttctcttacatgta

SEQ ID NO: 317093 - DNA, 15 bp, Homo sapiens
ttctcttacatgtat

SEQ ID NO: 317094 - DNA, 15 bp, Homo sapiens
tctcttacatgtatg

SEQ ID NO: 317095 - DNA, 15 bp, Homo sapiens
ctcttacatgtatga

SEQ ID NO: 317096 - DNA, 15 bp, Homo sapiens
tcttacatgtatgag

SEQ ID NO: 317097 - DNA, 15 bp, Homo sapiens
cttacatgtatgaga

SEQ ID NO: 317098 - DNA, 15 bp, Homo sapiens
ttacatgtatgagac

SEQ ID NO: 317099 - DNA, 15 bp, Homo sapiens
tacatgtatgagact

SEQ ID NO: 317100 - DNA, 15 bp, Homo sapiens
acatgtatgagactg

SEQ ID NO: 317101 - DNA, 15 bp, Homo sapiens
catgtatgagactgg

SEQ ID NO: 317102 - DNA, 15 bp, Homo sapiens
atgtatgagactggc

SEQ ID NO: 317103 - DNA, 15 bp, Homo sapiens
tgtatgagactggct

SEQ ID NO: 317104 - DNA, 15 bp, Homo sapiens
gtatgagactggctt

SEQ ID NO: 317105 - DNA, 15 bp, Homo sapiens
tatgagactggcttg

SEQ ID NO: 317106 - DNA, 15 bp, Homo sapiens
atgagactggcttgg

SEQ ID NO: 317107 - DNA, 15 bp, Homo sapiens
tgagactggcttggg

SEQ ID NO: 317108 - DNA, 15 bp, Homo sapiens
gagactggcttgggc

SEQ ID NO: 317109 - DNA, 15 bp, Homo sapiens
agactggcttgggct

SEQ ID NO: 317110 - DNA, 15 bp, Homo sapiens
gactggcttgggctg

SEQ ID NO: 317111 - DNA, 15 bp, Homo sapiens
actggcttgggctgg

SEQ ID NO: 317112 - DNA, 15 bp, Homo sapiens
ctggcttgggctggg

SEQ ID NO: 317113 - DNA, 15 bp, Homo sapiens
tggcttgggctgggg

SEQ ID NO: 317114 - DNA, 15 bp, Homo sapiens
ggcttgggctggggt

SEQ ID NO: 317115 - DNA, 15 bp, Homo sapiens
gcttgggctggggtc

SEQ ID NO: 317116 - DNA, 15 bp, Homo sapiens
cttgggctggggtct

SEQ ID NO: 317117 - DNA, 15 bp, Homo sapiens
ttgggctggggtctg

SEQ ID NO: 317118 - DNA, 15 bp, Homo sapiens
tgggctggggtctgc

SEQ ID NO: 317119 - DNA, 15 bp, Homo sapiens
gggctggggtctgcc

SEQ ID NO: 317120 - DNA, 15 bp, Homo sapiens
ggctggggtctgccc

SEQ ID NO: 317121 - DNA, 15 bp, Homo sapiens
gctggggtctgccct

SEQ ID NO: 317122 - DNA, 15 bp, Homo sapiens
ctggggtctgccctt

SEQ ID NO: 317123 - DNA, 15 bp, Homo sapiens
tggggtctgcccttg

SEQ ID NO: 317124 - DNA, 15 bp, Homo sapiens
ggggtctgcccttga

SEQ ID NO: 317125 - DNA, 15 bp, Homo sapiens
gggtctgcccttgaa

SEQ ID NO: 317126 - DNA, 15 bp, Homo sapiens
ggtctgcccttgaaa

SEQ ID NO: 317127 - DNA, 15 bp, Homo sapiens
gtctgcccttgaaaa

SEQ ID NO: 317128 - DNA, 15 bp, Homo sapiens
tctgcccttgaaaac

SEQ ID NO: 317129 - DNA, 15 bp, Homo sapiens
ctgcccttgaaaact

SEQ ID NO: 317130 - DNA, 15 bp, Homo sapiens
tgcccttgaaaactg

SEQ ID NO: 317131 - DNA, 15 bp, Homo sapiens
gcccttgaaaactgg

SEQ ID NO: 317132 - DNA, 15 bp, Homo sapiens
cccttgaaaactggc

SEQ ID NO: 317133 - DNA, 15 bp, Homo sapiens
ccttgaaaactggca

SEQ ID NO: 317134 - DNA, 15 bp, Homo sapiens
cttgaaaactggcag

SEQ ID NO: 317135 - DNA, 15 bp, Homo sapiens
ttgaaaactggcagc

SEQ ID NO: 317136 - DNA, 15 bp, Homo sapiens
tgaaaactggcagct

SEQ ID NO: 317137 - DNA, 15 bp, Homo sapiens
gaaaactggcagctg

SEQ ID NO: 317138 - DNA, 15 bp, Homo sapiens
aaaactggcagctgg

SEQ ID NO: 317139 - DNA, 15 bp, Homo sapiens
aaactggcagctgga

SEQ ID NO: 317140 - DNA, 15 bp, Homo sapiens
aactggcagctggag

SEQ ID NO: 317141 - DNA, 15 bp, Homo sapiens
actggcagctggagt

SEQ ID NO: 317142 - DNA, 15 bp, Homo sapiens
ctggcagctggagtc

SEQ ID NO: 317143 - DNA, 15 bp, Homo sapiens
tggcagctggagtct

SEQ ID NO: 317144 - DNA, 15 bp, Homo sapiens
ggcagctggagtctt

SEQ ID NO: 317145 - DNA, 15 bp, Homo sapiens
gcagctggagtcttg

SEQ ID NO: 317146 - DNA, 15 bp, Homo sapiens
cagctggagtcttga

SEQ ID NO: 317147 - DNA, 15 bp, Homo sapiens
agctggagtcttgag

SEQ ID NO: 317148 - DNA, 15 bp, Homo sapiens
gctggagtcttgagt

SEQ ID NO: 317149 - DNA, 15 bp, Homo sapiens
ctggagtcttgagta

SEQ ID NO: 317150 - DNA, 15 bp, Homo sapiens
tggagtcttgagtac

SEQ ID NO: 317151 - DNA, 15 bp, Homo sapiens
ggagtcttgagtact

SEQ ID NO: 317152 - DNA, 15 bp, Homo sapiens
gagtcttgagtactt

SEQ ID NO: 317153 - DNA, 15 bp, Homo sapiens
agtcttgagtacttt

SEQ ID NO: 317154 - DNA, 15 bp, Homo sapiens
gtcttgagtactttc

SEQ ID NO: 317155 - DNA, 15 bp, Homo sapiens
tcttgagtactttcc

SEQ ID NO: 317156 - DNA, 15 bp, Homo sapiens
cttgagtactttcct

SEQ ID NO: 317157 - DNA, 15 bp, Homo sapiens
ttgagtactttcctg

SEQ ID NO: 317158 - DNA, 15 bp, Homo sapiens
tgagtactttcctga

SEQ ID NO: 317159 - DNA, 15 bp, Homo sapiens
gagtactttcctgag

SEQ ID NO: 317160 - DNA, 15 bp, Homo sapiens
agtactttcctgagt

SEQ ID NO: 317161 - DNA, 15 bp, Homo sapiens
gtactttcctgagtc

SEQ ID NO: 317162 - DNA, 15 bp, Homo sapiens
tactttcctgagtca

SEQ ID NO: 317163 - DNA, 15 bp, Homo sapiens
actttcctgagtcat

SEQ ID NO: 317164 - DNA, 15 bp, Homo sapiens
ctttcctgagtcatt

SEQ ID NO: 317165 - DNA, 15 bp, Homo sapiens
tttcctgagtcattt

SEQ ID NO: 317166 - DNA, 15 bp, Homo sapiens
ttcctgagtcatttt

SEQ ID NO: 317167 - DNA, 15 bp, Homo sapiens
tcctgagtcattttt

SEQ ID NO: 317168 - DNA, 15 bp, Homo sapiens
cctgagtcatttttt

SEQ ID NO: 317169 - DNA, 15 bp, Homo sapiens
ctgagtcattttttg

SEQ ID NO: 317170 - DNA, 15 bp, Homo sapiens
tgagtcattttttga

SEQ ID NO: 317171 - DNA, 15 bp, Homo sapiens
gagtcattttttgag

SEQ ID NO: 317172 - DNA, 15 bp, Homo sapiens
agtcattttttgagc

SEQ ID NO: 317173 - DNA, 15 bp, Homo sapiens
gtcattttttgagct

SEQ ID NO: 317174 - DNA, 15 bp, Homo sapiens
tcattttttgagctc

SEQ ID NO: 317175 - DNA, 15 bp, Homo sapiens
cattttttgagctct

SEQ ID NO: 317176 - DNA, 15 bp, Homo sapiens
attttttgagctctt

SEQ ID NO: 317177 - DNA, 15 bp, Homo sapiens
ttttttgagctcttt

SEQ ID NO: 317178 - DNA, 15 bp, Homo sapiens
tttttgagctctttg

SEQ ID NO: 317179 - DNA, 15 bp, Homo sapiens
ttttgagctctttgc

SEQ ID NO: 317180 - DNA, 15 bp, Homo sapiens
tttgagctctttgca

SEQ ID NO: 317181 - DNA, 15 bp, Homo sapiens
ttgagctctttgcaa

SEQ ID NO: 317182 - DNA, 15 bp, Homo sapiens
tgagctctttgcaag

SEQ ID NO: 317183 - DNA, 15 bp, Homo sapiens
gagctctttgcaaga

SEQ ID NO: 317184 - DNA, 15 bp, Homo sapiens
agctctttgcaagat

SEQ ID NO: 317185 - DNA, 15 bp, Homo sapiens
gctctttgcaagata

SEQ ID NO: 317186 - DNA, 15 bp, Homo sapiens
ctctttgcaagataa

SEQ ID NO: 317187 - DNA, 15 bp, Homo sapiens
tctttgcaagataat

SEQ ID NO: 317188 - DNA, 15 bp, Homo sapiens
ctttgcaagataatg

SEQ ID NO: 317189 - DNA, 15 bp, Homo sapiens
tttgcaagataatgt

SEQ ID NO: 317190 - DNA, 15 bp, Homo sapiens
ttgcaagataatgtt

SEQ ID NO: 317191 - DNA, 15 bp, Homo sapiens
tgcaagataatgtta

SEQ ID NO: 317192 - DNA, 15 bp, Homo sapiens
gcaagataatgttaa

SEQ ID NO: 317193 - DNA, 15 bp, Homo sapiens
caagataatgttaaa

SEQ ID NO: 317194 - DNA, 15 bp, Homo sapiens
aagataatgttaaaa

SEQ ID NO: 317195 - DNA, 15 bp, Homo sapiens
agataatgttaaaaa

SEQ ID NO: 317196 - DNA, 15 bp, Homo sapiens
gataatgttaaaaat

SEQ ID NO: 317197 - DNA, 15 bp, Homo sapiens
ataatgttaaaaatt

SEQ ID NO: 317198 - DNA, 15 bp, Homo sapiens
taatgttaaaaattc

SEQ ID NO: 317199 - DNA, 15 bp, Homo sapiens
aatgttaaaaattca

SEQ ID NO: 317200 - DNA, 15 bp, Homo sapiens
atgttaaaaattcaa

SEQ ID NO: 317201 - DNA, 15 bp, Homo sapiens
tgttaaaaattcaag

SEQ ID NO: 317202 - DNA, 15 bp, Homo sapiens
gttaaaaattcaaga

SEQ ID NO: 317203 - DNA, 15 bp, Homo sapiens
ttaaaaattcaagag

SEQ ID NO: 317204 - DNA, 15 bp, Homo sapiens
taaaaattcaagagg

SEQ ID NO: 317205 - DNA, 15 bp, Homo sapiens
aaaaattcaagaggc

SEQ ID NO: 317206 - DNA, 15 bp, Homo sapiens
aaaattcaagaggcc

SEQ ID NO: 317207 - DNA, 15 bp, Homo sapiens
aaattcaagaggccg

SEQ ID NO: 317208 - DNA, 15 bp, Homo sapiens
aattcaagaggccgg

SEQ ID NO: 317209 - DNA, 15 bp, Homo sapiens
attcaagaggccggg

SEQ ID NO: 317210 - DNA, 15 bp, Homo sapiens
ttcaagaggccgggt

SEQ ID NO: 317211 - DNA, 15 bp, Homo sapiens
tcaagaggccgggtg

SEQ ID NO: 317212 - DNA, 15 bp, Homo sapiens
caagaggccgggtgt

SEQ ID NO: 317213 - DNA, 15 bp, Homo sapiens
aagaggccgggtgtg

SEQ ID NO: 317214 - DNA, 15 bp, Homo sapiens
agaggccgggtgtgg

SEQ ID NO: 317215 - DNA, 15 bp, Homo sapiens
gaggccgggtgtggt

SEQ ID NO: 317216 - DNA, 15 bp, Homo sapiens
aggccgggtgtggtg

SEQ ID NO: 317217 - DNA, 15 bp, Homo sapiens
ggccgggtgtggtgg

SEQ ID NO: 317218 - DNA, 15 bp, Homo sapiens
gccgggtgtggtgga

SEQ ID NO: 317219 - DNA, 15 bp, Homo sapiens
ccgggtgtggtggat

SEQ ID NO: 317220 - DNA, 15 bp, Homo sapiens
cgggtgtggtggatc

SEQ ID NO: 317221 - DNA, 15 bp, Homo sapiens
gggtgtggtggatca

SEQ ID NO: 317222 - DNA, 15 bp, Homo sapiens
ggtgtggtggatcat

SEQ ID NO: 317223 - DNA, 15 bp, Homo sapiens
gtgtggtggatcatg

SEQ ID NO: 317224 - DNA, 15 bp, Homo sapiens
tgtggtggatcatgc

SEQ ID NO: 317225 - DNA, 15 bp, Homo sapiens
gtggtggatcatgcc

SEQ ID NO: 317226 - DNA, 15 bp, Homo sapiens
tggtggatcatgcct

SEQ ID NO: 317227 - DNA, 15 bp, Homo sapiens
ggtggatcatgcctg

SEQ ID NO: 317228 - DNA, 15 bp, Homo sapiens
gtggatcatgcctgg

SEQ ID NO: 317229 - DNA, 15 bp, Homo sapiens
tggatcatgcctgga

SEQ ID NO: 317230 - DNA, 15 bp, Homo sapiens
ggatcatgcctggaa

SEQ ID NO: 317231 - DNA, 15 bp, Homo sapiens
gatcatgcctggaat

SEQ ID NO: 317232 - DNA, 15 bp, Homo sapiens
atcatgcctggaatc

SEQ ID NO: 317233 - DNA, 15 bp, Homo sapiens
tcatgcctggaatcc

SEQ ID NO: 317234 - DNA, 15 bp, Homo sapiens
cctggaatcccagca

SEQ ID NO: 317235 - DNA, 15 bp, Homo sapiens
ctggaatcccagcac

SEQ ID NO: 317236 - DNA, 15 bp, Homo sapiens
tggaatcccagcact

SEQ ID NO: 317237 - DNA, 15 bp, Homo sapiens
ggaatcccagcactt

SEQ ID NO: 317238 - DNA, 15 bp, Homo sapiens
gaatcccagcacttt

SEQ ID NO: 317239 - DNA, 15 bp, Homo sapiens
tcccagcactttgaa

SEQ ID NO: 317240 - DNA, 15 bp, Homo sapiens
cccagcactttgaaa

SEQ ID NO: 317241 - DNA, 15 bp, Homo sapiens
ccagcactttgaaag

SEQ ID NO: 317242 - DNA, 15 bp, Homo sapiens
cagcactttgaaagg

SEQ ID NO: 317243 - DNA, 15 bp, Homo sapiens
agcactttgaaaggc

SEQ ID NO: 317244 - DNA, 15 bp, Homo sapiens
gcactttgaaaggcc

SEQ ID NO: 317245 - DNA, 15 bp, Homo sapiens
cactttgaaaggccg

SEQ ID NO: 317246 - DNA, 15 bp, Homo sapiens
actttgaaaggccga

SEQ ID NO: 317247 - DNA, 15 bp, Homo sapiens
ctttgaaaggccgag

SEQ ID NO: 317248 - DNA, 15 bp, Homo sapiens
tttgaaaggccgagg

SEQ ID NO: 317249 - DNA, 15 bp, Homo sapiens
ttgaaaggccgaggc

SEQ ID NO: 317250 - DNA, 15 bp, Homo sapiens
tgaaaggccgaggcg

SEQ ID NO: 317251 - DNA, 15 bp, Homo sapiens
gaaaggccgaggcgg

SEQ ID NO: 317252 - DNA, 15 bp, Homo sapiens
aaaggccgaggcggg

SEQ ID NO: 317253 - DNA, 15 bp, Homo sapiens
aaggccgaggcgggc

SEQ ID NO: 317254 - DNA, 15 bp, Homo sapiens
aggccgaggcgggcg

SEQ ID NO: 317255 - DNA, 15 bp, Homo sapiens
ggccgaggcgggcgg

SEQ ID NO: 317256 - DNA, 15 bp, Homo sapiens
gccgaggcgggcgga

SEQ ID NO: 317257 - DNA, 15 bp, Homo sapiens
ggcgggcggatcacc

SEQ ID NO: 317258 - DNA, 15 bp, Homo sapiens
gcgggcggatcacct

SEQ ID NO: 317259 - DNA, 15 bp, Homo sapiens
cgggcggatcacctg

SEQ ID NO: 317260 - DNA, 15 bp, Homo sapiens
gggcggatcacctga

SEQ ID NO: 317261 - DNA, 15 bp, Homo sapiens
ggcggatcacctgag

SEQ ID NO: 317262 - DNA, 15 bp, Homo sapiens
gcggatcacctgagg

SEQ ID NO: 317263 - DNA, 15 bp, Homo sapiens
cggatcacctgaggt

SEQ ID NO: 317264 - DNA, 15 bp, Homo sapiens
ggatcacctgaggtc

SEQ ID NO: 317265 - DNA, 15 bp, Homo sapiens
gatcacctgaggtca

SEQ ID NO: 317266 - DNA, 15 bp, Homo sapiens
atcacctgaggtcag

SEQ ID NO: 317267 - DNA, 15 bp, Homo sapiens
tcacctgaggtcagg

SEQ ID NO: 317268 - DNA, 15 bp, Homo sapiens
cacctgaggtcagga

SEQ ID NO: 317269 - DNA, 15 bp, Homo sapiens
acctgaggtcaggag

SEQ ID NO: 317270 - DNA, 15 bp, Homo sapiens
cctgaggtcaggagt

SEQ ID NO: 317271 - DNA, 15 bp, Homo sapiens
gaggtcaggagttca

SEQ ID NO: 317272 - DNA, 15 bp, Homo sapiens
aggtcaggagttcaa

SEQ ID NO: 317273 - DNA, 15 bp, Homo sapiens
ggtcaggagttcaag

SEQ ID NO: 317274 - DNA, 15 bp, Homo sapiens
tcaggagttcaagac

SEQ ID NO: 317275 - DNA, 15 bp, Homo sapiens
caggagttcaagacc

SEQ ID NO: 317276 - DNA, 15 bp, Homo sapiens
aggagttcaagacca

SEQ ID NO: 317277 - DNA, 15 bp, Homo sapiens
ggagttcaagaccag

SEQ ID NO: 317278 - DNA, 15 bp, Homo sapiens
gagttcaagaccagc

SEQ ID NO: 317279 - DNA, 15 bp, Homo sapiens
agttcaagaccagcc

SEQ ID NO: 317280 - DNA, 15 bp, Homo sapiens
gttcaagaccagcct

SEQ ID NO: 317281 - DNA, 15 bp, Homo sapiens
ttcaagaccagcctg

SEQ ID NO: 317282 - DNA, 15 bp, Homo sapiens
tcaagaccagcctgg

SEQ ID NO: 317283 - DNA, 15 bp, Homo sapiens
caagaccagcctggc

SEQ ID NO: 317284 - DNA, 15 bp, Homo sapiens
aagaccagcctggcc

SEQ ID NO: 317285 - DNA, 15 bp, Homo sapiens
agcctggccaacata

SEQ ID NO: 317286 - DNA, 15 bp, Homo sapiens
gcctggccaacatag

SEQ ID NO: 317287 - DNA, 15 bp, Homo sapiens
cctggccaacatagt

SEQ ID NO: 317288 - DNA, 15 bp, Homo sapiens
ctggccaacatagtg

SEQ ID NO: 317289 - DNA, 15 bp, Homo sapiens
tggccaacatagtga

SEQ ID NO: 317290 - DNA, 15 bp, Homo sapiens
ggccaacatagtgaa

SEQ ID NO: 317291 - DNA, 15 bp, Homo sapiens
gccaacatagtgaaa

SEQ ID NO: 317292 - DNA, 15 bp, Homo sapiens
ccaacatagtgaaac

SEQ ID NO: 317293 - DNA, 15 bp, Homo sapiens
caacatagtgaaacc

SEQ ID NO: 317294 - DNA, 15 bp, Homo sapiens
aacatagtgaaaccc

SEQ ID NO: 317295 - DNA, 15 bp, Homo sapiens
acatagtgaaaccct

SEQ ID NO: 317296 - DNA, 15 bp, Homo sapiens
catagtgaaacccta

SEQ ID NO: 317297 - DNA, 15 bp, Homo sapiens
atagtgaaaccctac

SEQ ID NO: 317298 - DNA, 15 bp, Homo sapiens
tagtgaaaccctacc

SEQ ID NO: 317299 - DNA, 15 bp, Homo sapiens
agtgaaaccctacct

SEQ ID NO: 317300 - DNA, 15 bp, Homo sapiens
gtgaaaccctacctc

SEQ ID NO: 317301 - DNA, 15 bp, Homo sapiens
tgaaaccctacctct

SEQ ID NO: 317302 - DNA, 15 bp, Homo sapiens
gaaaccctacctcta

SEQ ID NO: 317303 - DNA, 15 bp, Homo sapiens
aaaccctacctctac

SEQ ID NO: 317304 - DNA, 15 bp, Homo sapiens
aaccctacctctact

SEQ ID NO: 317305 - DNA, 15 bp, Homo sapiens
accctacctctacta

SEQ ID NO: 317306 - DNA, 15 bp, Homo sapiens
ccctacctctactaa

SEQ ID NO: 317307 - DNA, 15 bp, Homo sapiens
cctacctctactaaa

SEQ ID NO: 317308 - DNA, 15 bp, Homo sapiens
ctacctctactaaaa

SEQ ID NO: 317309 - DNA, 15 bp, Homo sapiens
tacctctactaaaaa

SEQ ID NO: 317310 - DNA, 15 bp, Homo sapiens
acctctactaaaaat

SEQ ID NO: 317311 - DNA, 15 bp, Homo sapiens
cctctactaaaaata

SEQ ID NO: 317312 - DNA, 15 bp, Homo sapiens
aaaaaaaaaaattac

SEQ ID NO: 317313 - DNA, 15 bp, Homo sapiens
aaaaaaaaaattacc

SEQ ID NO: 317314 - DNA, 15 bp, Homo sapiens
aaaaaaaaattacct

SEQ ID NO: 317315 - DNA, 15 bp, Homo sapiens
aaaaaaaattacctg

SEQ ID NO: 317316 - DNA, 15 bp, Homo sapiens
aaaaaaattacctgg

SEQ ID NO: 317317 - DNA, 15 bp, Homo sapiens
aaaaaattacctggg

SEQ ID NO: 317318 - DNA, 15 bp, Homo sapiens
aaaaattacctgggc

SEQ ID NO: 317319 - DNA, 15 bp, Homo sapiens
aaaattacctgggca

SEQ ID NO: 317320 - DNA, 15 bp, Homo sapiens
aaattacctgggcat

SEQ ID NO: 317321 - DNA, 15 bp, Homo sapiens
aattacctgggcatg

SEQ ID NO: 317322 - DNA, 15 bp, Homo sapiens
attacctgggcatgg

SEQ ID NO: 317323 - DNA, 15 bp, Homo sapiens
ttacctgggcatggg

SEQ ID NO: 317324 - DNA, 15 bp, Homo sapiens
tacctgggcatgggg

SEQ ID NO: 317325 - DNA, 15 bp, Homo sapiens
acctgggcatggggt

SEQ ID NO: 317326 - DNA, 15 bp, Homo sapiens
cctgggcatggggtc

SEQ ID NO: 317327 - DNA, 15 bp, Homo sapiens
ctgggcatggggtcg

SEQ ID NO: 317328 - DNA, 15 bp, Homo sapiens
tgggcatggggtcgc

SEQ ID NO: 317329 - DNA, 15 bp, Homo sapiens
gggcatggggtcgcg

SEQ ID NO: 317330 - DNA, 15 bp, Homo sapiens
ggcatggggtcgcgc

SEQ ID NO: 317331 - DNA, 15 bp, Homo sapiens
gcatggggtcgcgca

SEQ ID NO: 317332 - DNA, 15 bp, Homo sapiens
catggggtcgcgcac

SEQ ID NO: 317333 - DNA, 15 bp, Homo sapiens
atggggtcgcgcacc

SEQ ID NO: 317334 - DNA, 15 bp, Homo sapiens
tggggtcgcgcacct

SEQ ID NO: 317335 - DNA, 15 bp, Homo sapiens
ggggtcgcgcacctg

SEQ ID NO: 317336 - DNA, 15 bp, Homo sapiens
gggtcgcgcacctgt

SEQ ID NO: 317337 - DNA, 15 bp, Homo sapiens
ggtcgcgcacctgta

SEQ ID NO: 317338 - DNA, 15 bp, Homo sapiens
gtcgcgcacctgtag

SEQ ID NO: 317339 - DNA, 15 bp, Homo sapiens
tcgcgcacctgtagt

SEQ ID NO: 317340 - DNA, 15 bp, Homo sapiens
cgcgcacctgtagtc

SEQ ID NO: 317341 - DNA, 15 bp, Homo sapiens
gcgcacctgtagtcc

SEQ ID NO: 317342 - DNA, 15 bp, Homo sapiens
cgcacctgtagtccc

SEQ ID NO: 317343 - DNA, 15 bp, Homo sapiens
gcacctgtagtccca

SEQ ID NO: 317344 - DNA, 15 bp, Homo sapiens
gtcccagctactcag

SEQ ID NO: 317345 - DNA, 15 bp, Homo sapiens
tcccagctactcagg

SEQ ID NO: 317346 - DNA, 15 bp, Homo sapiens
cccagctactcagga

SEQ ID NO: 317347 - DNA, 15 bp, Homo sapiens
ccagctactcaggag

SEQ ID NO: 317348 - DNA, 15 bp, Homo sapiens
cagctactcaggagg

SEQ ID NO: 317349 - DNA, 15 bp, Homo sapiens
agctactcaggaggc

SEQ ID NO: 317350 - DNA, 15 bp, Homo sapiens
gctactcaggaggct

SEQ ID NO: 317351 - DNA, 15 bp, Homo sapiens
aggaggctaaggcat

SEQ ID NO: 317352 - DNA, 15 bp, Homo sapiens
ggaggctaaggcatg

SEQ ID NO: 317353 - DNA, 15 bp, Homo sapiens
gaggctaaggcatgg

SEQ ID NO: 317354 - DNA, 15 bp, Homo sapiens
aggctaaggcatggg

SEQ ID NO: 317355 - DNA, 15 bp, Homo sapiens
ggctaaggcatggga

SEQ ID NO: 317356 - DNA, 15 bp, Homo sapiens
gctaaggcatgggaa

SEQ ID NO: 317357 - DNA, 15 bp, Homo sapiens
ctaaggcatgggaat

SEQ ID NO: 317358 - DNA, 15 bp, Homo sapiens
taaggcatgggaata

SEQ ID NO: 317359 - DNA, 15 bp, Homo sapiens
aaggcatgggaataa

SEQ ID NO: 317360 - DNA, 15 bp, Homo sapiens
aggcatgggaataat

SEQ ID NO: 317361 - DNA, 15 bp, Homo sapiens
ggcatgggaataatt

SEQ ID NO: 317362 - DNA, 15 bp, Homo sapiens
gcatgggaataattt

SEQ ID NO: 317363 - DNA, 15 bp, Homo sapiens
catgggaataatttg

SEQ ID NO: 317364 - DNA, 15 bp, Homo sapiens
atgggaataatttga

SEQ ID NO: 317365 - DNA, 15 bp, Homo sapiens
tgggaataatttgaa

SEQ ID NO: 317366 - DNA, 15 bp, Homo sapiens
gggaataatttgaac

SEQ ID NO: 317367 - DNA, 15 bp, Homo sapiens
ggaataatttgaacc

SEQ ID NO: 317368 - DNA, 15 bp, Homo sapiens
gaataatttgaacct

SEQ ID NO: 317369 - DNA, 15 bp, Homo sapiens
aataatttgaacctg

SEQ ID NO: 317370 - DNA, 15 bp, Homo sapiens
ataatttgaacctgg

SEQ ID NO: 317371 - DNA, 15 bp, Homo sapiens
taatttgaacctggg

SEQ ID NO: 317372 - DNA, 15 bp, Homo sapiens
aatttgaacctggga

SEQ ID NO: 317373 - DNA, 15 bp, Homo sapiens
atttgaacctgggag

SEQ ID NO: 317374 - DNA, 15 bp, Homo sapiens
tttgaacctgggagg

SEQ ID NO: 317375 - DNA, 15 bp, Homo sapiens
acctgggaggtggag

SEQ ID NO: 317376 - DNA, 15 bp, Homo sapiens
ctgggaggtggaggc

SEQ ID NO: 317377 - DNA, 15 bp, Homo sapiens
tgggaggtggaggct

SEQ ID NO: 317378 - DNA, 15 bp, Homo sapiens
gggaggtggaggctg

SEQ ID NO: 317379 - DNA, 15 bp, Homo sapiens
ggaggtggaggctgc

SEQ ID NO: 317380 - DNA, 15 bp, Homo sapiens
gaggtggaggctgcg

SEQ ID NO: 317381 - DNA, 15 bp, Homo sapiens
aggtggaggctgcgg

SEQ ID NO: 317382 - DNA, 15 bp, Homo sapiens
ggtggaggctgcggt

SEQ ID NO: 317383 - DNA, 15 bp, Homo sapiens
gtggaggctgcggtg

SEQ ID NO: 317384 - DNA, 15 bp, Homo sapiens
tggaggctgcggtga

SEQ ID NO: 317385 - DNA, 15 bp, Homo sapiens
ggaggctgcggtgag

SEQ ID NO: 317386 - DNA, 15 bp, Homo sapiens
gaggctgcggtgagt

SEQ ID NO: 317387 - DNA, 15 bp, Homo sapiens
aggctgcggtgagtc

SEQ ID NO: 317388 - DNA, 15 bp, Homo sapiens
ggctgcggtgagtca

SEQ ID NO: 317389 - DNA, 15 bp, Homo sapiens
gctgcggtgagtcaa

SEQ ID NO: 317390 - DNA, 15 bp, Homo sapiens
ctgcggtgagtcaat

SEQ ID NO: 317391 - DNA, 15 bp, Homo sapiens
tgcggtgagtcaata

SEQ ID NO: 317392 - DNA, 15 bp, Homo sapiens
gcggtgagtcaatat

SEQ ID NO: 317393 - DNA, 15 bp, Homo sapiens
cggtgagtcaatatc

SEQ ID NO: 317394 - DNA, 15 bp, Homo sapiens
ggtgagtcaatatca

SEQ ID NO: 317395 - DNA, 15 bp, Homo sapiens
gtgagtcaatatcac

SEQ ID NO: 317396 - DNA, 15 bp, Homo sapiens
tgagtcaatatcaca

SEQ ID NO: 317397 - DNA, 15 bp, Homo sapiens
gagtcaatatcacat

SEQ ID NO: 317398 - DNA, 15 bp, Homo sapiens
agtcaatatcacatc

SEQ ID NO: 317399 - DNA, 15 bp, Homo sapiens
gtcaatatcacatca

SEQ ID NO: 317400 - DNA, 15 bp, Homo sapiens
tcaatatcacatcac

SEQ ID NO: 317401 - DNA, 15 bp, Homo sapiens
caatatcacatcact

SEQ ID NO: 317402 - DNA, 15 bp, Homo sapiens
aatatcacatcactg

SEQ ID NO: 317403 - DNA, 15 bp, Homo sapiens
atatcacatcactgc

SEQ ID NO: 317404 - DNA, 15 bp, Homo sapiens
tatcacatcactgca

SEQ ID NO: 317405 - DNA, 15 bp, Homo sapiens
atcacatcactgcac

SEQ ID NO: 317406 - DNA, 15 bp, Homo sapiens
tcacatcactgcact

SEQ ID NO: 317407 - DNA, 15 bp, Homo sapiens
cacatcactgcactc

SEQ ID NO: 317408 - DNA, 15 bp, Homo sapiens
acatcactgcactcc

SEQ ID NO: 317409 - DNA, 15 bp, Homo sapiens
catcactgcactcca

SEQ ID NO: 317410 - DNA, 15 bp, Homo sapiens
atcactgcactccag

SEQ ID NO: 317411 - DNA, 15 bp, Homo sapiens
cactccagcctgggt

SEQ ID NO: 317412 - DNA, 15 bp, Homo sapiens
actccagcctgggtg

SEQ ID NO: 317413 - DNA, 15 bp, Homo sapiens
ctccagcctgggtgg

SEQ ID NO: 317414 - DNA, 15 bp, Homo sapiens
tccagcctgggtggc

SEQ ID NO: 317415 - DNA, 15 bp, Homo sapiens
ccagcctgggtggca

SEQ ID NO: 317416 - DNA, 15 bp, Homo sapiens
cagcctgggtggcag

SEQ ID NO: 317417 - DNA, 15 bp, Homo sapiens
agcctgggtggcaga

SEQ ID NO: 317418 - DNA, 15 bp, Homo sapiens
gcctgggtggcagag

SEQ ID NO: 317419 - DNA, 15 bp, Homo sapiens
cctgggtggcagagt

SEQ ID NO: 317420 - DNA, 15 bp, Homo sapiens
ctgggtggcagagtg

SEQ ID NO: 317421 - DNA, 15 bp, Homo sapiens
tgggtggcagagtgt

SEQ ID NO: 317422 - DNA, 15 bp, Homo sapiens
gggtggcagagtgtg

SEQ ID NO: 317423 - DNA, 15 bp, Homo sapiens
ggtggcagagtgtga

SEQ ID NO: 317424 - DNA, 15 bp, Homo sapiens
gtggcagagtgtgac

SEQ ID NO: 317425 - DNA, 15 bp, Homo sapiens
tggcagagtgtgact

SEQ ID NO: 317426 - DNA, 15 bp, Homo sapiens
ggcagagtgtgactc

SEQ ID NO: 317427 - DNA, 15 bp, Homo sapiens
gcagagtgtgactct

SEQ ID NO: 317428 - DNA, 15 bp, Homo sapiens
cagagtgtgactctg

SEQ ID NO: 317429 - DNA, 15 bp, Homo sapiens
agagtgtgactctgt

SEQ ID NO: 317430 - DNA, 15 bp, Homo sapiens
gagtgtgactctgtt

SEQ ID NO: 317431 - DNA, 15 bp, Homo sapiens
agtgtgactctgttg

SEQ ID NO: 317432 - DNA, 15 bp, Homo sapiens
gtgtgactctgttga

SEQ ID NO: 317433 - DNA, 15 bp, Homo sapiens
tgtgactctgttgaa

SEQ ID NO: 317434 - DNA, 15 bp, Homo sapiens
gtgactctgttgaaa

SEQ ID NO: 317435 - DNA, 15 bp, Homo sapiens
tgactctgttgaaaa

SEQ ID NO: 317436 - DNA, 15 bp, Homo sapiens
gactctgttgaaaaa

SEQ ID NO: 317437 - DNA, 15 bp, Homo sapiens
actctgttgaaaaaa

SEQ ID NO: 317438 - DNA, 15 bp, Homo sapiens
ctctgttgaaaaaaa

SEQ ID NO: 317439 - DNA, 15 bp, Homo sapiens
tctgttgaaaaaaaa

SEQ ID NO: 317440 - DNA, 15 bp, Homo sapiens
ctgttgaaaaaaaaa

SEQ ID NO: 317441 - DNA, 15 bp, Homo sapiens
tgttgaaaaaaaaaa

SEQ ID NO: 317442 - DNA, 15 bp, Homo sapiens
gttgaaaaaaaaaaa

SEQ ID NO: 317443 - DNA, 15 bp, Homo sapiens
ttgaaaaaaaaaaaa

SEQ ID NO: 317444 - DNA, 15 bp, Homo sapiens
tgaaaaaaaaaaaaa

SEQ ID NO: 317445 - DNA, 15 bp, Homo sapiens
gaaaaaaaaaaaaat

SEQ ID NO: 317446 - DNA, 15 bp, Homo sapiens
aaaaaaaaaaatcaa

SEQ ID NO: 317447 - DNA, 15 bp, Homo sapiens
aaaaaaaaaatcaag

SEQ ID NO: 317448 - DNA, 15 bp, Homo sapiens
aaaaaaaaatcaaga

SEQ ID NO: 317449 - DNA, 15 bp, Homo sapiens
aaaaaaaatcaagaa

SEQ ID NO: 317450 - DNA, 15 bp, Homo sapiens
aaaaaaatcaagaac

SEQ ID NO: 317451 - DNA, 15 bp, Homo sapiens
aaaaaatcaagaact

SEQ ID NO: 317452 - DNA, 15 bp, Homo sapiens
aaaaatcaagaactg

SEQ ID NO: 317453 - DNA, 15 bp, Homo sapiens
aaaatcaagaactgt

SEQ ID NO: 317454 - DNA, 15 bp, Homo sapiens
aaatcaagaactgtt

SEQ ID NO: 317455 - DNA, 15 bp, Homo sapiens
aatcaagaactgttg

SEQ ID NO: 317456 - DNA, 15 bp, Homo sapiens
atcaagaactgttgc

SEQ ID NO: 317457 - DNA, 15 bp, Homo sapiens
tcaagaactgttgca

SEQ ID NO: 317458 - DNA, 15 bp, Homo sapiens
caagaactgttgcat

SEQ ID NO: 317459 - DNA, 15 bp, Homo sapiens
aagaactgttgcata

SEQ ID NO: 317460 - DNA, 15 bp, Homo sapiens
agaactgttgcatat

SEQ ID NO: 317461 - DNA, 15 bp, Homo sapiens
gaactgttgcatatt

SEQ ID NO: 317462 - DNA, 15 bp, Homo sapiens
aactgttgcatattt

SEQ ID NO: 317463 - DNA, 15 bp, Homo sapiens
actgttgcatatttt

SEQ ID NO: 317464 - DNA, 15 bp, Homo sapiens
ctgttgcatatttta

SEQ ID NO: 317465 - DNA, 15 bp, Homo sapiens
tgttgcatattttat

SEQ ID NO: 317466 - DNA, 15 bp, Homo sapiens
gttgcatattttatt

SEQ ID NO: 317467 - DNA, 15 bp, Homo sapiens
ttgcatattttattt

SEQ ID NO: 317468 - DNA, 15 bp, Homo sapiens
tgcatattttattta

SEQ ID NO: 317469 - DNA, 15 bp, Homo sapiens
gcatattttatttat

SEQ ID NO: 317470 - DNA, 15 bp, Homo sapiens
catattttatttatc

SEQ ID NO: 317471 - DNA, 15 bp, Homo sapiens
atattttatttatct

SEQ ID NO: 317472 - DNA, 15 bp, Homo sapiens
tattttatttatctt

SEQ ID NO: 317473 - DNA, 15 bp, Homo sapiens
attttatttatcttt

SEQ ID NO: 317474 - DNA, 15 bp, Homo sapiens
ttttatttatctttg

SEQ ID NO: 317475 - DNA, 15 bp, Homo sapiens
tttatttatctttgt

SEQ ID NO: 317476 - DNA, 15 bp, Homo sapiens
ttatttatctttgta

SEQ ID NO: 317477 - DNA, 15 bp, Homo sapiens
tatttatctttgtat

SEQ ID NO: 317478 - DNA, 15 bp, Homo sapiens
atttatctttgtatt

SEQ ID NO: 317479 - DNA, 15 bp, Homo sapiens
tttatctttgtattt

SEQ ID NO: 317480 - DNA, 15 bp, Homo sapiens
ttatctttgtatttt

SEQ ID NO: 317481 - DNA, 15 bp, Homo sapiens
tatctttgtattttc

SEQ ID NO: 317482 - DNA, 15 bp, Homo sapiens
atctttgtattttct

SEQ ID NO: 317483 - DNA, 15 bp, Homo sapiens
tctttgtattttctg

SEQ ID NO: 317484 - DNA, 15 bp, Homo sapiens
ctttgtattttctga

SEQ ID NO: 317485 - DNA, 15 bp, Homo sapiens
tttgtattttctgag

SEQ ID NO: 317486 - DNA, 15 bp, Homo sapiens
ttgtattttctgaga

SEQ ID NO: 317487 - DNA, 15 bp, Homo sapiens
tgtattttctgagat

SEQ ID NO: 317488 - DNA, 15 bp, Homo sapiens
gtattttctgagata

SEQ ID NO: 317489 - DNA, 15 bp, Homo sapiens
tattttctgagatat

SEQ ID NO: 317490 - DNA, 15 bp, Homo sapiens
attttctgagatatt

SEQ ID NO: 317491 - DNA, 15 bp, Homo sapiens
ttttctgagatattt

SEQ ID NO: 317492 - DNA, 15 bp, Homo sapiens
tttctgagatatttt

SEQ ID NO: 317493 - DNA, 15 bp, Homo sapiens
ttctgagatattttt

SEQ ID NO: 317494 - DNA, 15 bp, Homo sapiens
tctgagatatttttg

SEQ ID NO: 317495 - DNA, 15 bp, Homo sapiens
ctgagatatttttga

SEQ ID NO: 317496 - DNA, 15 bp, Homo sapiens
tgagatatttttgac

SEQ ID NO: 317497 - DNA, 15 bp, Homo sapiens
gagatatttttgact

SEQ ID NO: 317498 - DNA, 15 bp, Homo sapiens
agatatttttgactg

SEQ ID NO: 317499 - DNA, 15 bp, Homo sapiens
gatatttttgactga

SEQ ID NO: 317500 - DNA, 15 bp, Homo sapiens
atatttttgactgac

SEQ ID NO: 317501 - DNA, 15 bp, Homo sapiens
tatttttgactgacc

SEQ ID NO: 317502 - DNA, 15 bp, Homo sapiens
atttttgactgaccc

SEQ ID NO: 317503 - DNA, 15 bp, Homo sapiens
tttttgactgaccct

SEQ ID NO: 317504 - DNA, 15 bp, Homo sapiens
ttttgactgacccta

SEQ ID NO: 317505 - DNA, 15 bp, Homo sapiens
tttgactgaccctaa

SEQ ID NO: 317506 - DNA, 15 bp, Homo sapiens
ttgactgaccctaaa

SEQ ID NO: 317507 - DNA, 15 bp, Homo sapiens
tgactgaccctaaaa

SEQ ID NO: 317508 - DNA, 15 bp, Homo sapiens
gactgaccctaaaat

SEQ ID NO: 317509 - DNA, 15 bp, Homo sapiens
actgaccctaaaatg

SEQ ID NO: 317510 - DNA, 15 bp, Homo sapiens
ctgaccctaaaatga

SEQ ID NO: 317511 - DNA, 15 bp, Homo sapiens
tgaccctaaaatgag

SEQ ID NO: 317512 - DNA, 15 bp, Homo sapiens
gaccctaaaatgagc

SEQ ID NO: 317513 - DNA, 15 bp, Homo sapiens
accctaaaatgagca

SEQ ID NO: 317514 - DNA, 15 bp, Homo sapiens
ccctaaaatgagcat

SEQ ID NO: 317515 - DNA, 15 bp, Homo sapiens
cctaaaatgagcatc

SEQ ID NO: 317516 - DNA, 15 bp, Homo sapiens
ctaaaatgagcatct

SEQ ID NO: 317517 - DNA, 15 bp, Homo sapiens
taaaatgagcatctg

SEQ ID NO: 317518 - DNA, 15 bp, Homo sapiens
aaaatgagcatctgg

SEQ ID NO: 317519 - DNA, 15 bp, Homo sapiens
aaatgagcatctgga

SEQ ID NO: 317520 - DNA, 15 bp, Homo sapiens
aatgagcatctggat

SEQ ID NO: 317521 - DNA, 15 bp, Homo sapiens
atgagcatctggatg

SEQ ID NO: 317522 - DNA, 15 bp, Homo sapiens
tgagcatctggatgg

SEQ ID NO: 317523 - DNA, 15 bp, Homo sapiens
gagcatctggatggt

SEQ ID NO: 317524 - DNA, 15 bp, Homo sapiens
agcatctggatggta

SEQ ID NO: 317525 - DNA, 15 bp, Homo sapiens
gcatctggatggtag

SEQ ID NO: 317526 - DNA, 15 bp, Homo sapiens
catctggatggtaga

SEQ ID NO: 317527 - DNA, 15 bp, Homo sapiens
atctggatggtagat

SEQ ID NO: 317528 - DNA, 15 bp, Homo sapiens
tctggatggtagatg

SEQ ID NO: 317529 - DNA, 15 bp, Homo sapiens
ctggatggtagatga

SEQ ID NO: 317530 - DNA, 15 bp, Homo sapiens
tggatggtagatgac

SEQ ID NO: 317531 - DNA, 15 bp, Homo sapiens
ggatggtagatgacg

SEQ ID NO: 317532 - DNA, 15 bp, Homo sapiens
gatggtagatgacgg

SEQ ID NO: 317533 - DNA, 15 bp, Homo sapiens
atggtagatgacggc

SEQ ID NO: 317534 - DNA, 15 bp, Homo sapiens
tggtagatgacggca

SEQ ID NO: 317535 - DNA, 15 bp, Homo sapiens
ggtagatgacggcag

SEQ ID NO: 317536 - DNA, 15 bp, Homo sapiens
gtagatgacggcagc

SEQ ID NO: 317537 - DNA, 15 bp, Homo sapiens
tagatgacggcagcg

SEQ ID NO: 317538 - DNA, 15 bp, Homo sapiens
agatgacggcagcgg

SEQ ID NO: 317539 - DNA, 15 bp, Homo sapiens
gatgacggcagcgga

SEQ ID NO: 317540 - DNA, 15 bp, Homo sapiens
atgacggcagcggaa

SEQ ID NO: 317541 - DNA, 15 bp, Homo sapiens
tgacggcagcggaag

SEQ ID NO: 317542 - DNA, 15 bp, Homo sapiens
gacggcagcggaaga

SEQ ID NO: 317543 - DNA, 15 bp, Homo sapiens
acggcagcggaagat

SEQ ID NO: 317544 - DNA, 15 bp, Homo sapiens
cggcagcggaagatg

SEQ ID NO: 317545 - DNA, 15 bp, Homo sapiens
ggcagcggaagatga

SEQ ID NO: 317546 - DNA, 15 bp, Homo sapiens
gcagcggaagatgaa

SEQ ID NO: 317547 - DNA, 15 bp, Homo sapiens
cagcggaagatgaag

SEQ ID NO: 317548 - DNA, 15 bp, Homo sapiens
agcggaagatgaaga

SEQ ID NO: 317549 - DNA, 15 bp, Homo sapiens
gcggaagatgaagaa

SEQ ID NO: 317550 - DNA, 15 bp, Homo sapiens
cggaagatgaagaat

SEQ ID NO: 317551 - DNA, 15 bp, Homo sapiens
ggaagatgaagaatt

SEQ ID NO: 317552 - DNA, 15 bp, Homo sapiens
gaagatgaagaatta

SEQ ID NO: 317553 - DNA, 15 bp, Homo sapiens
aagatgaagaattaa

SEQ ID NO: 317554 - DNA, 15 bp, Homo sapiens
agatgaagaattaag

SEQ ID NO: 317555 - DNA, 15 bp, Homo sapiens
gatgaagaattaaga

SEQ ID NO: 317556 - DNA, 15 bp, Homo sapiens
atgaagaattaagaa

SEQ ID NO: 317557 - DNA, 15 bp, Homo sapiens
tgaagaattaagaag

SEQ ID NO: 317558 - DNA, 15 bp, Homo sapiens
gaagaattaagaagt

SEQ ID NO: 317559 - DNA, 15 bp, Homo sapiens
aagaattaagaagtg

SEQ ID NO: 317560 - DNA, 15 bp, Homo sapiens
agaattaagaagtgg

SEQ ID NO: 317561 - DNA, 15 bp, Homo sapiens
gaattaagaagtggt

SEQ ID NO: 317562 - DNA, 15 bp, Homo sapiens
aattaagaagtggtt

SEQ ID NO: 317563 - DNA, 15 bp, Homo sapiens
attaagaagtggttt

SEQ ID NO: 317564 - DNA, 15 bp, Homo sapiens
ttaagaagtggtttt

SEQ ID NO: 317565 - DNA, 15 bp, Homo sapiens
taagaagtggttttt

SEQ ID NO: 317566 - DNA, 15 bp, Homo sapiens
aagaagtggtttttg

SEQ ID NO: 317567 - DNA, 15 bp, Homo sapiens
agaagtggtttttga

SEQ ID NO: 317568 - DNA, 15 bp, Homo sapiens
gaagtggtttttgat

SEQ ID NO: 317569 - DNA, 15 bp, Homo sapiens
aagtggtttttgatt

SEQ ID NO: 317570 - DNA, 15 bp, Homo sapiens
agtggtttttgattt

SEQ ID NO: 317571 - DNA, 15 bp, Homo sapiens
gtggtttttgatttg

SEQ ID NO: 317572 - DNA, 15 bp, Homo sapiens
tggtttttgatttgt

SEQ ID NO: 317573 - DNA, 15 bp, Homo sapiens
ggtttttgatttgta

SEQ ID NO: 317574 - DNA, 15 bp, Homo sapiens
gtttttgatttgtaa

SEQ ID NO: 317575 - DNA, 15 bp, Homo sapiens
tttttgatttgtaat

SEQ ID NO: 317576 - DNA, 15 bp, Homo sapiens
ttttgatttgtaata

SEQ ID NO: 317577 - DNA, 15 bp, Homo sapiens
tttgatttgtaatat

SEQ ID NO: 317578 - DNA, 15 bp, Homo sapiens
ttgatttgtaatatt

SEQ ID NO: 317579 - DNA, 15 bp, Homo sapiens
tgatttgtaatattt

SEQ ID NO: 317580 - DNA, 15 bp, Homo sapiens
gatttgtaatatttt

SEQ ID NO: 317581 - DNA, 15 bp, Homo sapiens
atttgtaatattttt

SEQ ID NO: 317582 - DNA, 15 bp, Homo sapiens
tttgtaatatttttt

SEQ ID NO: 317583 - DNA, 15 bp, Homo sapiens
ttgtaatatttttta

SEQ ID NO: 317584 - DNA, 15 bp, Homo sapiens
tgtaatattttttag

SEQ ID NO: 317585 - DNA, 15 bp, Homo sapiens
gtaatattttttagt

SEQ ID NO: 317586 - DNA, 15 bp, Homo sapiens
taatattttttagta

SEQ ID NO: 317587 - DNA, 15 bp, Homo sapiens
aatattttttagtag

SEQ ID NO: 317588 - DNA, 15 bp, Homo sapiens
atattttttagtaga

SEQ ID NO: 317589 - DNA, 15 bp, Homo sapiens
tattttttagtagat

SEQ ID NO: 317590 - DNA, 15 bp, Homo sapiens
attttttagtagata

SEQ ID NO: 317591 - DNA, 15 bp, Homo sapiens
ttttttagtagatat

SEQ ID NO: 317592 - DNA, 15 bp, Homo sapiens
tttttagtagatatt

SEQ ID NO: 317593 - DNA, 15 bp, Homo sapiens
ttttagtagatatta

SEQ ID NO: 317594 - DNA, 15 bp, Homo sapiens
tttagtagatattat

SEQ ID NO: 317595 - DNA, 15 bp, Homo sapiens
ttagtagatattatt

SEQ ID NO: 317596 - DNA, 15 bp, Homo sapiens
tagtagatattatta

SEQ ID NO: 317597 - DNA, 15 bp, Homo sapiens
agtagatattattag

SEQ ID NO: 317598 - DNA, 15 bp, Homo sapiens
gtagatattattagt

SEQ ID NO: 317599 - DNA, 15 bp, Homo sapiens
tagatattattagtt

SEQ ID NO: 317600 - DNA, 15 bp, Homo sapiens
agatattattagttg

SEQ ID NO: 317601 - DNA, 15 bp, Homo sapiens
gatattattagttga

SEQ ID NO: 317602 - DNA, 15 bp, Homo sapiens
atattattagttgat

SEQ ID NO: 317603 - DNA, 15 bp, Homo sapiens
tattattagttgatg

SEQ ID NO: 317604 - DNA, 15 bp, Homo sapiens
attattagttgatgc

SEQ ID NO: 317605 - DNA, 15 bp, Homo sapiens
ttattagttgatgcc

SEQ ID NO: 317606 - DNA, 15 bp, Homo sapiens
tattagttgatgccg

SEQ ID NO: 317607 - DNA, 15 bp, Homo sapiens
attagttgatgccgc

SEQ ID NO: 317608 - DNA, 15 bp, Homo sapiens
ttagttgatgccgca

SEQ ID NO: 317609 - DNA, 15 bp, Homo sapiens
tagttgatgccgcag

SEQ ID NO: 317610 - DNA, 15 bp, Homo sapiens
agttgatgccgcagt

SEQ ID NO: 317611 - DNA, 15 bp, Homo sapiens
gttgatgccgcagtt

SEQ ID NO: 317612 - DNA, 15 bp, Homo sapiens
ttgatgccgcagttg

SEQ ID NO: 317613 - DNA, 15 bp, Homo sapiens
tgatgccgcagttgt

SEQ ID NO: 317614 - DNA, 15 bp, Homo sapiens
gatgccgcagttgtt

SEQ ID NO: 317615 - DNA, 15 bp, Homo sapiens
atgccgcagttgttg

SEQ ID NO: 317616 - DNA, 15 bp, Homo sapiens
tgccgcagttgttga

SEQ ID NO: 317617 - DNA, 15 bp, Homo sapiens
gccgcagttgttgac

SEQ ID NO: 317618 - DNA, 15 bp, Homo sapiens
ccgcagttgttgact

SEQ ID NO: 317619 - DNA, 15 bp, Homo sapiens
cgcagttgttgactg

SEQ ID NO: 317620 - DNA, 15 bp, Homo sapiens
gcagttgttgactgt

SEQ ID NO: 317621 - DNA, 15 bp, Homo sapiens
cagttgttgactgta

SEQ ID NO: 317622 - DNA, 15 bp, Homo sapiens
agttgttgactgtat

SEQ ID NO: 317623 - DNA, 15 bp, Homo sapiens
gttgttgactgtatt

SEQ ID NO: 317624 - DNA, 15 bp, Homo sapiens
ttgttgactgtattt

SEQ ID NO: 317625 - DNA, 15 bp, Homo sapiens
tgttgactgtattta

SEQ ID NO: 317626 - DNA, 15 bp, Homo sapiens
gttgactgtatttat

SEQ ID NO: 317627 - DNA, 15 bp, Homo sapiens
ttgactgtatttatc

SEQ ID NO: 317628 - DNA, 15 bp, Homo sapiens
tgactgtatttatct

SEQ ID NO: 317629 - DNA, 15 bp, Homo sapiens
gactgtatttatctc

SEQ ID NO: 317630 - DNA, 15 bp, Homo sapiens
actgtatttatctcc

SEQ ID NO: 317631 - DNA, 15 bp, Homo sapiens
ctgtatttatctccc

SEQ ID NO: 317632 - DNA, 15 bp, Homo sapiens
tgtatttatctccca

SEQ ID NO: 317633 - DNA, 15 bp, Homo sapiens
gtatttatctcccaa

SEQ ID NO: 317634 - DNA, 15 bp, Homo sapiens
tatttatctcccaag

SEQ ID NO: 317635 - DNA, 15 bp, Homo sapiens
atttatctcccaagg

SEQ ID NO: 317636 - DNA, 15 bp, Homo sapiens
tttatctcccaaggg

SEQ ID NO: 317637 - DNA, 15 bp, Homo sapiens
ttatctcccaagggc

SEQ ID NO: 317638 - DNA, 15 bp, Homo sapiens
tatctcccaagggca

SEQ ID NO: 317639 - DNA, 15 bp, Homo sapiens
atctcccaagggcat

SEQ ID NO: 317640 - DNA, 15 bp, Homo sapiens
tctcccaagggcata

SEQ ID NO: 317641 - DNA, 15 bp, Homo sapiens
ctcccaagggcatag

SEQ ID NO: 317642 - DNA, 15 bp, Homo sapiens
tcccaagggcatagg

SEQ ID NO: 317643 - DNA, 15 bp, Homo sapiens
cccaagggcatagga

SEQ ID NO: 317644 - DNA, 15 bp, Homo sapiens
ccaagggcataggaa

SEQ ID NO: 317645 - DNA, 15 bp, Homo sapiens
caagggcataggaag

SEQ ID NO: 317646 - DNA, 15 bp, Homo sapiens
aagggcataggaagc

SEQ ID NO: 317647 - DNA, 15 bp, Homo sapiens
agggcataggaagcc

SEQ ID NO: 317648 - DNA, 15 bp, Homo sapiens
gggcataggaagccc

SEQ ID NO: 317649 - DNA, 15 bp, Homo sapiens
ggcataggaagcccc

SEQ ID NO: 317650 - DNA, 15 bp, Homo sapiens
gcataggaagccccc

SEQ ID NO: 317651 - DNA, 15 bp, Homo sapiens
cataggaagccccct

SEQ ID NO: 317652 - DNA, 15 bp, Homo sapiens
ataggaagccccctt

SEQ ID NO: 317653 - DNA, 15 bp, Homo sapiens
taggaagcccccttg

SEQ ID NO: 317654 - DNA, 15 bp, Homo sapiens
aggaagcccccttgc

SEQ ID NO: 317655 - DNA, 15 bp, Homo sapiens
ggaagcccccttgca

SEQ ID NO: 317656 - DNA, 15 bp, Homo sapiens
gaagcccccttgcag

SEQ ID NO: 317657 - DNA, 15 bp, Homo sapiens
aagcccccttgcaga

SEQ ID NO: 317658 - DNA, 15 bp, Homo sapiens
agcccccttgcagat

SEQ ID NO: 317659 - DNA, 15 bp, Homo sapiens
gcccccttgcagata

SEQ ID NO: 317660 - DNA, 15 bp, Homo sapiens
cccccttgcagatat

SEQ ID NO: 317661 - DNA, 15 bp, Homo sapiens
ccccttgcagatatt

SEQ ID NO: 317662 - DNA, 15 bp, Homo sapiens
cccttgcagatatta

SEQ ID NO: 317663 - DNA, 15 bp, Homo sapiens
ccttgcagatattac

SEQ ID NO: 317664 - DNA, 15 bp, Homo sapiens
cttgcagatattact

SEQ ID NO: 317665 - DNA, 15 bp, Homo sapiens
ttgcagatattactc

SEQ ID NO: 317666 - DNA, 15 bp, Homo sapiens
tgcagatattactct

SEQ ID NO: 317667 - DNA, 15 bp, Homo sapiens
gcagatattactcta

SEQ ID NO: 317668 - DNA, 15 bp, Homo sapiens
cagatattactctac

SEQ ID NO: 317669 - DNA, 15 bp, Homo sapiens
agatattactctacc

SEQ ID NO: 317670 - DNA, 15 bp, Homo sapiens
gatattactctacct

SEQ ID NO: 317671 - DNA, 15 bp, Homo sapiens
atattactctaccta

SEQ ID NO: 317672 - DNA, 15 bp, Homo sapiens
tattactctacctag

SEQ ID NO: 317673 - DNA, 15 bp, Homo sapiens
attactctacctagc

SEQ ID NO: 317674 - DNA, 15 bp, Homo sapiens
ttactctacctagcc

SEQ ID NO: 317675 - DNA, 15 bp, Homo sapiens
tactctacctagcct

SEQ ID NO: 317676 - DNA, 15 bp, Homo sapiens
actctacctagcctg

SEQ ID NO: 317677 - DNA, 15 bp, Homo sapiens
ctctacctagcctga

SEQ ID NO: 317678 - DNA, 15 bp, Homo sapiens
tctacctagcctgac

SEQ ID NO: 317679 - DNA, 15 bp, Homo sapiens
ctacctagcctgact

SEQ ID NO: 317680 - DNA, 15 bp, Homo sapiens
tacctagcctgactg

SEQ ID NO: 317681 - DNA, 15 bp, Homo sapiens
acctagcctgactgg

SEQ ID NO: 317682 - DNA, 15 bp, Homo sapiens
cctagcctgactggg

SEQ ID NO: 317683 - DNA, 15 bp, Homo sapiens
ctagcctgactgggt

SEQ ID NO: 317684 - DNA, 15 bp, Homo sapiens
tagcctgactgggtg

SEQ ID NO: 317685 - DNA, 15 bp, Homo sapiens
agcctgactgggtgt

SEQ ID NO: 317686 - DNA, 15 bp, Homo sapiens
gcctgactgggtgtt

SEQ ID NO: 317687 - DNA, 15 bp, Homo sapiens
cctgactgggtgttt

SEQ ID NO: 317688 - DNA, 15 bp, Homo sapiens
ctgactgggtgtttg

SEQ ID NO: 317689 - DNA, 15 bp, Homo sapiens
tgactgggtgtttgg

SEQ ID NO: 317690 - DNA, 15 bp, Homo sapiens
gactgggtgtttggg

SEQ ID NO: 317691 - DNA, 15 bp, Homo sapiens
actgggtgtttgggg

SEQ ID NO: 317692 - DNA, 15 bp, Homo sapiens
ctgggtgtttgggga

SEQ ID NO: 317693 - DNA, 15 bp, Homo sapiens
tgggtgtttggggag

SEQ ID NO: 317694 - DNA, 15 bp, Homo sapiens
gggtgtttggggagg

SEQ ID NO: 317695 - DNA, 15 bp, Homo sapiens
ggtgtttggggaggg

SEQ ID NO: 317696 - DNA, 15 bp, Homo sapiens
gtgtttggggaggga

SEQ ID NO: 317697 - DNA, 15 bp, Homo sapiens
tgtttggggagggag

SEQ ID NO: 317698 - DNA, 15 bp, Homo sapiens
gtttggggagggaga

SEQ ID NO: 317699 - DNA, 15 bp, Homo sapiens
tttggggagggagag

SEQ ID NO: 317700 - DNA, 15 bp, Homo sapiens
ttggggagggagaga

SEQ ID NO: 317701 - DNA, 15 bp, Homo sapiens
tggggagggagagaa

SEQ ID NO: 317702 - DNA, 15 bp, Homo sapiens
ggggagggagagaag

SEQ ID NO: 317703 - DNA, 15 bp, Homo sapiens
gggagggagagaaga

SEQ ID NO: 317704 - DNA, 15 bp, Homo sapiens
ggagggagagaagag

SEQ ID NO: 317705 - DNA, 15 bp, Homo sapiens
gagggagagaagagg

SEQ ID NO: 317706 - DNA, 15 bp, Homo sapiens
agggagagaagaggt

SEQ ID NO: 317707 - DNA, 15 bp, Homo sapiens
gggagagaagaggtt

SEQ ID NO: 317708 - DNA, 15 bp, Homo sapiens
ggagagaagaggtta

SEQ ID NO: 317709 - DNA, 15 bp, Homo sapiens
gagagaagaggttaa

SEQ ID NO: 317710 - DNA, 15 bp, Homo sapiens
agagaagaggttaac

SEQ ID NO: 317711 - DNA, 15 bp, Homo sapiens
gagaagaggttaaca

SEQ ID NO: 317712 - DNA, 15 bp, Homo sapiens
agaagaggttaacaa

SEQ ID NO: 317713 - DNA, 15 bp, Homo sapiens
gaagaggttaacaat

SEQ ID NO: 317714 - DNA, 15 bp, Homo sapiens
aagaggttaacaata

SEQ ID NO: 317715 - DNA, 15 bp, Homo sapiens
agaggttaacaataa

SEQ ID NO: 317716 - DNA, 15 bp, Homo sapiens
gaggttaacaataaa

SEQ ID NO: 317717 - DNA, 15 bp, Homo sapiens
aggttaacaataaat

SEQ ID NO: 317718 - DNA, 15 bp, Homo sapiens
ggttaacaataaatc

SEQ ID NO: 317719 - DNA, 15 bp, Homo sapiens
gttaacaataaatcc

SEQ ID NO: 317720 - DNA, 15 bp, Homo sapiens
ttaacaataaatcct

SEQ ID NO: 317721 - DNA, 15 bp, Homo sapiens
taacaataaatcctg

SEQ ID NO: 317722 - DNA, 15 bp, Homo sapiens
aacaataaatcctgc

SEQ ID NO: 317723 - DNA, 15 bp, Homo sapiens
acaataaatcctgca

SEQ ID NO: 317724 - DNA, 15 bp, Homo sapiens
caataaatcctgcaa

SEQ ID NO: 317725 - DNA, 15 bp, Homo sapiens
aataaatcctgcaat

SEQ ID NO: 317726 - DNA, 15 bp, Homo sapiens
ataaatcctgcaata

SEQ ID NO: 317727 - DNA, 15 bp, Homo sapiens
taaatcctgcaatat

SEQ ID NO: 317728 - DNA, 15 bp, Homo sapiens
aaatcctgcaatatg

SEQ ID NO: 317729 - DNA, 15 bp, Homo sapiens
aatcctgcaatatgt

SEQ ID NO: 317730 - DNA, 15 bp, Homo sapiens
atcctgcaatatgtg

SEQ ID NO: 317731 - DNA, 15 bp, Homo sapiens
tcctgcaatatgtgc

SEQ ID NO: 317732 - DNA, 15 bp, Homo sapiens
cctgcaatatgtgca

SEQ ID NO: 317733 - DNA, 15 bp, Homo sapiens
ctgcaatatgtgcag

SEQ ID NO: 317734 - DNA, 15 bp, Homo sapiens
tgcaatatgtgcaga

SEQ ID NO: 317735 - DNA, 15 bp, Homo sapiens
gcaatatgtgcagaa

SEQ ID NO: 317736 - DNA, 15 bp, Homo sapiens
caatatgtgcagaag

SEQ ID NO: 317737 - DNA, 15 bp, Homo sapiens
aatatgtgcagaagt

SEQ ID NO: 317738 - DNA, 15 bp, Homo sapiens
atatgtgcagaagtt

SEQ ID NO: 317739 - DNA, 15 bp, Homo sapiens
tatgtgcagaagttt

SEQ ID NO: 317740 - DNA, 15 bp, Homo sapiens
atgtgcagaagtttt

SEQ ID NO: 317741 - DNA, 15 bp, Homo sapiens
tgtgcagaagttttt

SEQ ID NO: 317742 - DNA, 15 bp, Homo sapiens
gtgcagaagttttta

SEQ ID NO: 317743 - DNA, 15 bp, Homo sapiens
tgcagaagtttttac

SEQ ID NO: 317744 - DNA, 15 bp, Homo sapiens
gcagaagtttttaca

SEQ ID NO: 317745 - DNA, 15 bp, Homo sapiens
cagaagtttttacac

SEQ ID NO: 317746 - DNA, 15 bp, Homo sapiens
agaagtttttacact

SEQ ID NO: 317747 - DNA, 15 bp, Homo sapiens
gaagtttttacactt

SEQ ID NO: 317748 - DNA, 15 bp, Homo sapiens
aagtttttacacttg

SEQ ID NO: 317749 - DNA, 15 bp, Homo sapiens
agtttttacacttgt

SEQ ID NO: 317750 - DNA, 15 bp, Homo sapiens
gtttttacacttgtg

SEQ ID NO: 317751 - DNA, 15 bp, Homo sapiens
tttttacacttgtgt

SEQ ID NO: 317752 - DNA, 15 bp, Homo sapiens
ttttacacttgtgtt

SEQ ID NO: 317753 - DNA, 15 bp, Homo sapiens
tttacacttgtgttt

SEQ ID NO: 317754 - DNA, 15 bp, Homo sapiens
ttacacttgtgtttc

SEQ ID NO: 317755 - DNA, 15 bp, Homo sapiens
tacacttgtgtttct

SEQ ID NO: 317756 - DNA, 15 bp, Homo sapiens
acacttgtgtttctg

SEQ ID NO: 317757 - DNA, 15 bp, Homo sapiens
cacttgtgtttctgc

SEQ ID NO: 317758 - DNA, 15 bp, Homo sapiens
acttgtgtttctgca

SEQ ID NO: 317759 - DNA, 15 bp, Homo sapiens
cttgtgtttctgcat

SEQ ID NO: 317760 - DNA, 15 bp, Homo sapiens
ttgtgtttctgcata

SEQ ID NO: 317761 - DNA, 15 bp, Homo sapiens
tgtgtttctgcatat

SEQ ID NO: 317762 - DNA, 15 bp, Homo sapiens
gtgtttctgcatatt

SEQ ID NO: 317763 - DNA, 15 bp, Homo sapiens
tgtttctgcatattt

SEQ ID NO: 317764 - DNA, 15 bp, Homo sapiens
gtttctgcatatttt

SEQ ID NO: 317765 - DNA, 15 bp, Homo sapiens
tttctgcatattttc

SEQ ID NO: 317766 - DNA, 15 bp, Homo sapiens
ttctgcatattttct

SEQ ID NO: 317767 - DNA, 15 bp, Homo sapiens
tctgcatattttctt

SEQ ID NO: 317768 - DNA, 15 bp, Homo sapiens
ctgcatattttctta

SEQ ID NO: 317769 - DNA, 15 bp, Homo sapiens
tgcatattttcttag

SEQ ID NO: 317770 - DNA, 15 bp, Homo sapiens
gcatattttcttaga

SEQ ID NO: 317771 - DNA, 15 bp, Homo sapiens
catattttcttagaa

SEQ ID NO: 317772 - DNA, 15 bp, Homo sapiens
atattttcttagaaa

SEQ ID NO: 317773 - DNA, 15 bp, Homo sapiens
tattttcttagaaaa

SEQ ID NO: 317774 - DNA, 15 bp, Homo sapiens
attttcttagaaaaa

SEQ ID NO: 317775 - DNA, 15 bp, Homo sapiens
ttttcttagaaaaag

SEQ ID NO: 317776 - DNA, 15 bp, Homo sapiens
tttcttagaaaaagg

SEQ ID NO: 317777 - DNA, 15 bp, Homo sapiens
ttcttagaaaaaggg

SEQ ID NO: 317778 - DNA, 15 bp, Homo sapiens
tcttagaaaaagggt

SEQ ID NO: 317779 - DNA, 15 bp, Homo sapiens
cttagaaaaagggtc

SEQ ID NO: 317780 - DNA, 15 bp, Homo sapiens
ttagaaaaagggtcc

SEQ ID NO: 317781 - DNA, 15 bp, Homo sapiens
tagaaaaagggtcca

SEQ ID NO: 317782 - DNA, 15 bp, Homo sapiens
agaaaaagggtccac

SEQ ID NO: 317783 - DNA, 15 bp, Homo sapiens
gaaaaagggtccaca

SEQ ID NO: 317784 - DNA, 15 bp, Homo sapiens
aaaaagggtccacag

SEQ ID NO: 317785 - DNA, 15 bp, Homo sapiens
aaaagggtccacagt

SEQ ID NO: 317786 - DNA, 15 bp, Homo sapiens
aaagggtccacagtt

SEQ ID NO: 317787 - DNA, 15 bp, Homo sapiens
aagggtccacagttt

SEQ ID NO: 317788 - DNA, 15 bp, Homo sapiens
agggtccacagtttt

SEQ ID NO: 317789 - DNA, 15 bp, Homo sapiens
gggtccacagttttc

SEQ ID NO: 317790 - DNA, 15 bp, Homo sapiens
ggtccacagttttca

SEQ ID NO: 317791 - DNA, 15 bp, Homo sapiens
gtccacagttttcat

SEQ ID NO: 317792 - DNA, 15 bp, Homo sapiens
tccacagttttcatt

SEQ ID NO: 317793 - DNA, 15 bp, Homo sapiens
ccacagttttcatta

SEQ ID NO: 317794 - DNA, 15 bp, Homo sapiens
cacagttttcattat

SEQ ID NO: 317795 - DNA, 15 bp, Homo sapiens
acagttttcattata

SEQ ID NO: 317796 - DNA, 15 bp, Homo sapiens
cagttttcattatat

SEQ ID NO: 317797 - DNA, 15 bp, Homo sapiens
agttttcattatatt

SEQ ID NO: 317798 - DNA, 15 bp, Homo sapiens
gttttcattatattc

SEQ ID NO: 317799 - DNA, 15 bp, Homo sapiens
ttttcattatattct

SEQ ID NO: 317800 - DNA, 15 bp, Homo sapiens
tttcattatattctc

SEQ ID NO: 317801 - DNA, 15 bp, Homo sapiens
ttcattatattctca

SEQ ID NO: 317802 - DNA, 15 bp, Homo sapiens
tcattatattctcaa

SEQ ID NO: 317803 - DNA, 15 bp, Homo sapiens
cattatattctcaaa

SEQ ID NO: 317804 - DNA, 15 bp, Homo sapiens
attatattctcaaag

SEQ ID NO: 317805 - DNA, 15 bp, Homo sapiens
ttatattctcaaagg

SEQ ID NO: 317806 - DNA, 15 bp, Homo sapiens
tatattctcaaagga

SEQ ID NO: 317807 - DNA, 15 bp, Homo sapiens
atattctcaaaggag

SEQ ID NO: 317808 - DNA, 15 bp, Homo sapiens
tattctcaaaggaga

SEQ ID NO: 317809 - DNA, 15 bp, Homo sapiens
attctcaaaggagac

SEQ ID NO: 317810 - DNA, 15 bp, Homo sapiens
ttctcaaaggagacc

SEQ ID NO: 317811 - DNA, 15 bp, Homo sapiens
tctcaaaggagacct

SEQ ID NO: 317812 - DNA, 15 bp, Homo sapiens
ctcaaaggagaccta

SEQ ID NO: 317813 - DNA, 15 bp, Homo sapiens
tcaaaggagacctat

SEQ ID NO: 317814 - DNA, 15 bp, Homo sapiens
caaaggagacctatg

SEQ ID NO: 317815 - DNA, 15 bp, Homo sapiens
aaaggagacctatga

SEQ ID NO: 317816 - DNA, 15 bp, Homo sapiens
aaggagacctatgac

SEQ ID NO: 317817 - DNA, 15 bp, Homo sapiens
aggagacctatgact

SEQ ID NO: 317818 - DNA, 15 bp, Homo sapiens
ggagacctatgactt

SEQ ID NO: 317819 - DNA, 15 bp, Homo sapiens
gagacctatgactta

SEQ ID NO: 317820 - DNA, 15 bp, Homo sapiens
agacctatgacttaa

SEQ ID NO: 317821 - DNA, 15 bp, Homo sapiens
gacctatgacttaat

SEQ ID NO: 317822 - DNA, 15 bp, Homo sapiens
acctatgacttaatg

SEQ ID NO: 317823 - DNA, 15 bp, Homo sapiens
cctatgacttaatga

SEQ ID NO: 317824 - DNA, 15 bp, Homo sapiens
ctatgacttaatgaa

SEQ ID NO: 317825 - DNA, 15 bp, Homo sapiens
tatgacttaatgaaa

SEQ ID NO: 317826 - DNA, 15 bp, Homo sapiens
atgacttaatgaaaa

SEQ ID NO: 317827 - DNA, 15 bp, Homo sapiens
tgacttaatgaaaag

SEQ ID NO: 317828 - DNA, 15 bp, Homo sapiens
gacttaatgaaaagt

SEQ ID NO: 317829 - DNA, 15 bp, Homo sapiens
acttaatgaaaagtt

SEQ ID NO: 317830 - DNA, 15 bp, Homo sapiens
cttaatgaaaagtta

SEQ ID NO: 317831 - DNA, 15 bp, Homo sapiens
ttaatgaaaagttaa

SEQ ID NO: 317832 - DNA, 15 bp, Homo sapiens
taatgaaaagttaag

SEQ ID NO: 317833 - DNA, 15 bp, Homo sapiens
aatgaaaagttaagt

SEQ ID NO: 317834 - DNA, 15 bp, Homo sapiens
atgaaaagttaagtc

SEQ ID NO: 317835 - DNA, 15 bp, Homo sapiens
tgaaaagttaagtct

SEQ ID NO: 317836 - DNA, 15 bp, Homo sapiens
gaaaagttaagtctt

SEQ ID NO: 317837 - DNA, 15 bp, Homo sapiens
aaaagttaagtcttg

SEQ ID NO: 317838 - DNA, 15 bp, Homo sapiens
aaagttaagtcttgt

SEQ ID NO: 317839 - DNA, 15 bp, Homo sapiens
aagttaagtcttgtt

SEQ ID NO: 317840 - DNA, 15 bp, Homo sapiens
agttaagtcttgtta

SEQ ID NO: 317841 - DNA, 15 bp, Homo sapiens
gttaagtcttgttag

SEQ ID NO: 317842 - DNA, 15 bp, Homo sapiens
ttaagtcttgttaga

SEQ ID NO: 317843 - DNA, 15 bp, Homo sapiens
taagtcttgttagag

SEQ ID NO: 317844 - DNA, 15 bp, Homo sapiens
aagtcttgttagagg

SEQ ID NO: 317845 - DNA, 15 bp, Homo sapiens
agtcttgttagagga

SEQ ID NO: 317846 - DNA, 15 bp, Homo sapiens
gtcttgttagaggaa

SEQ ID NO: 317847 - DNA, 15 bp, Homo sapiens
tcttgttagaggaag

SEQ ID NO: 317848 - DNA, 15 bp, Homo sapiens
cttgttagaggaaga

SEQ ID NO: 317849 - DNA, 15 bp, Homo sapiens
ttgttagaggaagag

SEQ ID NO: 317850 - DNA, 15 bp, Homo sapiens
tgttagaggaagagt

SEQ ID NO: 317851 - DNA, 15 bp, Homo sapiens
gttagaggaagagtg

SEQ ID NO: 317852 - DNA, 15 bp, Homo sapiens
ttagaggaagagtga

SEQ ID NO: 317853 - DNA, 15 bp, Homo sapiens
tagaggaagagtgac

SEQ ID NO: 317854 - DNA, 15 bp, Homo sapiens
agaggaagagtgaca

SEQ ID NO: 317855 - DNA, 15 bp, Homo sapiens
gaggaagagtgacat

SEQ ID NO: 317856 - DNA, 15 bp, Homo sapiens
aggaagagtgacata

SEQ ID NO: 317857 - DNA, 15 bp, Homo sapiens
ggaagagtgacatat

SEQ ID NO: 317858 - DNA, 15 bp, Homo sapiens
gaagagtgacatatt

SEQ ID NO: 317859 - DNA, 15 bp, Homo sapiens
aagagtgacatatta

SEQ ID NO: 317860 - DNA, 15 bp, Homo sapiens
agagtgacatattat

SEQ ID NO: 317861 - DNA, 15 bp, Homo sapiens
gagtgacatattata

SEQ ID NO: 317862 - DNA, 15 bp, Homo sapiens
agtgacatattatag

SEQ ID NO: 317863 - DNA, 15 bp, Homo sapiens
gtgacatattatagg

SEQ ID NO: 317864 - DNA, 15 bp, Homo sapiens
tgacatattataggg

SEQ ID NO: 317865 - DNA, 15 bp, Homo sapiens
gacatattatagggt

SEQ ID NO: 317866 - DNA, 15 bp, Homo sapiens
acatattatagggtt

SEQ ID NO: 317867 - DNA, 15 bp, Homo sapiens
catattatagggtta

SEQ ID NO: 317868 - DNA, 15 bp, Homo sapiens
atattatagggttat

SEQ ID NO: 317869 - DNA, 15 bp, Homo sapiens
tattatagggttatg

SEQ ID NO: 317870 - DNA, 15 bp, Homo sapiens
attatagggttatgt

SEQ ID NO: 317871 - DNA, 15 bp, Homo sapiens
ttatagggttatgtc

SEQ ID NO: 317872 - DNA, 15 bp, Homo sapiens
tatagggttatgtct

SEQ ID NO: 317873 - DNA, 15 bp, Homo sapiens
atagggttatgtctt

SEQ ID NO: 317874 - DNA, 15 bp, Homo sapiens
tagggttatgtcttc

SEQ ID NO: 317875 - DNA, 15 bp, Homo sapiens
agggttatgtcttca

SEQ ID NO: 317876 - DNA, 15 bp, Homo sapiens
gggttatgtcttcat

SEQ ID NO: 317877 - DNA, 15 bp, Homo sapiens
ggttatgtcttcata

SEQ ID NO: 317878 - DNA, 15 bp, Homo sapiens
gttatgtcttcataa

SEQ ID NO: 317879 - DNA, 15 bp, Homo sapiens
ttatgtcttcataat

SEQ ID NO: 317880 - DNA, 15 bp, Homo sapiens
tatgtcttcataatg

SEQ ID NO: 317881 - DNA, 15 bp, Homo sapiens
atgtcttcataatgt

SEQ ID NO: 317882 - DNA, 15 bp, Homo sapiens
tgtcttcataatgtt

SEQ ID NO: 317883 - DNA, 15 bp, Homo sapiens
gtcttcataatgttt

SEQ ID NO: 317884 - DNA, 15 bp, Homo sapiens
tcttcataatgtttc

SEQ ID NO: 317885 - DNA, 15 bp, Homo sapiens
cttcataatgtttct

SEQ ID NO: 317886 - DNA, 15 bp, Homo sapiens
ttcataatgtttctt

SEQ ID NO: 317887 - DNA, 15 bp, Homo sapiens
tcataatgtttcttt

SEQ ID NO: 317888 - DNA, 15 bp, Homo sapiens
cataatgtttctttt

SEQ ID NO: 317889 - DNA, 15 bp, Homo sapiens
ataatgtttcttttt

SEQ ID NO: 317890 - DNA, 15 bp, Homo sapiens
taatgtttctttttt

SEQ ID NO: 317891 - DNA, 15 bp, Homo sapiens
aatgtttcttttttt

SEQ ID NO: 317892 - DNA, 15 bp, Homo sapiens
atgtttctttttttc

SEQ ID NO: 317893 - DNA, 15 bp, Homo sapiens
tgtttctttttttct

SEQ ID NO: 317894 - DNA, 15 bp, Homo sapiens
gtttctttttttctg

SEQ ID NO: 317895 - DNA, 15 bp, Homo sapiens
tttctttttttctga

SEQ ID NO: 317896 - DNA, 15 bp, Homo sapiens
ttctttttttctgaa

SEQ ID NO: 317897 - DNA, 15 bp, Homo sapiens
tctttttttctgaaa

SEQ ID NO: 317898 - DNA, 15 bp, Homo sapiens
ctttttttctgaaat

SEQ ID NO: 317899 - DNA, 15 bp, Homo sapiens
tttttttctgaaatt

SEQ ID NO: 317900 - DNA, 15 bp, Homo sapiens
ttttttctgaaatta

SEQ ID NO: 317901 - DNA, 15 bp, Homo sapiens
tttttctgaaattag

SEQ ID NO: 317902 - DNA, 15 bp, Homo sapiens
ttttctgaaattaga

SEQ ID NO: 317903 - DNA, 15 bp, Homo sapiens
ttctgaaattagatt

SEQ ID NO: 317904 - DNA, 15 bp, Homo sapiens
tctgaaattagattg

SEQ ID NO: 317905 - DNA, 15 bp, Homo sapiens
ctgaaattagattgg

SEQ ID NO: 317906 - DNA, 15 bp, Homo sapiens
tgaaattagattggc

SEQ ID NO: 317907 - DNA, 15 bp, Homo sapiens
gaaattagattggca

SEQ ID NO: 317908 - DNA, 15 bp, Homo sapiens
aaattagattggcag

SEQ ID NO: 317909 - DNA, 15 bp, Homo sapiens
aattagattggcagt

SEQ ID NO: 317910 - DNA, 15 bp, Homo sapiens
attagattggcagtc

SEQ ID NO: 317911 - DNA, 15 bp, Homo sapiens
ttagattggcagtcc

SEQ ID NO: 317912 - DNA, 15 bp, Homo sapiens
tagattggcagtcca

SEQ ID NO: 317913 - DNA, 15 bp, Homo sapiens
agattggcagtccaa

SEQ ID NO: 317914 - DNA, 15 bp, Homo sapiens
gattggcagtccaat

SEQ ID NO: 317915 - DNA, 15 bp, Homo sapiens
attggcagtccaata

SEQ ID NO: 317916 - DNA, 15 bp, Homo sapiens
ttggcagtccaatac

SEQ ID NO: 317917 - DNA, 15 bp, Homo sapiens
tggcagtccaatacg

SEQ ID NO: 317918 - DNA, 15 bp, Homo sapiens
ggcagtccaatacgc

SEQ ID NO: 317919 - DNA, 15 bp, Homo sapiens
gcagtccaatacgct

SEQ ID NO: 317920 - DNA, 15 bp, Homo sapiens
cagtccaatacgctg

SEQ ID NO: 317921 - DNA, 15 bp, Homo sapiens
agtccaatacgctgg

SEQ ID NO: 317922 - DNA, 15 bp, Homo sapiens
gtccaatacgctggc

SEQ ID NO: 317923 - DNA, 15 bp, Homo sapiens
tccaatacgctggca

SEQ ID NO: 317924 - DNA, 15 bp, Homo sapiens
ccaatacgctggcac

SEQ ID NO: 317925 - DNA, 15 bp, Homo sapiens
caatacgctggcacg

SEQ ID NO: 317926 - DNA, 15 bp, Homo sapiens
aatacgctggcacga

SEQ ID NO: 317927 - DNA, 15 bp, Homo sapiens
atacgctggcacgaa

SEQ ID NO: 317928 - DNA, 15 bp, Homo sapiens
tacgctggcacgaac

SEQ ID NO: 317929 - DNA, 15 bp, Homo sapiens
acgctggcacgaact

SEQ ID NO: 317930 - DNA, 15 bp, Homo sapiens
cgctggcacgaactg

SEQ ID NO: 317931 - DNA, 15 bp, Homo sapiens
gctggcacgaactga

SEQ ID NO: 317932 - DNA, 15 bp, Homo sapiens
ctggcacgaactgag

SEQ ID NO: 317933 - DNA, 15 bp, Homo sapiens
tggcacgaactgagg

SEQ ID NO: 317934 - DNA, 15 bp, Homo sapiens
ggcacgaactgaggg

SEQ ID NO: 317935 - DNA, 15 bp, Homo sapiens
gcacgaactgagggt

SEQ ID NO: 317936 - DNA, 15 bp, Homo sapiens
cacgaactgagggtc

SEQ ID NO: 317937 - DNA, 15 bp, Homo sapiens
acgaactgagggtct

SEQ ID NO: 317938 - DNA, 15 bp, Homo sapiens
cgaactgagggtctc

SEQ ID NO: 317939 - DNA, 15 bp, Homo sapiens
gaactgagggtctca

SEQ ID NO: 317940 - DNA, 15 bp, Homo sapiens
aactgagggtctcac

SEQ ID NO: 317941 - DNA, 15 bp, Homo sapiens
actgagggtctcaca

SEQ ID NO: 317942 - DNA, 15 bp, Homo sapiens
ctgagggtctcacac

SEQ ID NO: 317943 - DNA, 15 bp, Homo sapiens
tgagggtctcacact

SEQ ID NO: 317944 - DNA, 15 bp, Homo sapiens
gagggtctcacactt

SEQ ID NO: 317945 - DNA, 15 bp, Homo sapiens
agggtctcacacttt

SEQ ID NO: 317946 - DNA, 15 bp, Homo sapiens
gggtctcacactttt

SEQ ID NO: 317947 - DNA, 15 bp, Homo sapiens
ggtctcacacttttg

SEQ ID NO: 317948 - DNA, 15 bp, Homo sapiens
gtctcacacttttgc

SEQ ID NO: 317949 - DNA, 15 bp, Homo sapiens
tctcacacttttgct

SEQ ID NO: 317950 - DNA, 15 bp, Homo sapiens
ctcacacttttgctg

SEQ ID NO: 317951 - DNA, 15 bp, Homo sapiens
tcacacttttgctgt

SEQ ID NO: 317952 - DNA, 15 bp, Homo sapiens
cacacttttgctgta

SEQ ID NO: 317953 - DNA, 15 bp, Homo sapiens
acacttttgctgtaa

SEQ ID NO: 317954 - DNA, 15 bp, Homo sapiens
cacttttgctgtaac

SEQ ID NO: 317955 - DNA, 15 bp, Homo sapiens
acttttgctgtaact

SEQ ID NO: 317956 - DNA, 15 bp, Homo sapiens
cttttgctgtaactc

SEQ ID NO: 317957 - DNA, 15 bp, Homo sapiens
ttttgctgtaactca

SEQ ID NO: 317958 - DNA, 15 bp, Homo sapiens
tttgctgtaactcaa

SEQ ID NO: 317959 - DNA, 15 bp, Homo sapiens
ttgctgtaactcaaa

SEQ ID NO: 317960 - DNA, 15 bp, Homo sapiens
tgctgtaactcaaat

SEQ ID NO: 317961 - DNA, 15 bp, Homo sapiens
gctgtaactcaaatt

SEQ ID NO: 317962 - DNA, 15 bp, Homo sapiens
ctgtaactcaaattc

SEQ ID NO: 317963 - DNA, 15 bp, Homo sapiens
tgtaactcaaattct

SEQ ID NO: 317964 - DNA, 15 bp, Homo sapiens
gtaactcaaattctg

SEQ ID NO: 317965 - DNA, 15 bp, Homo sapiens
taactcaaattctgg

SEQ ID NO: 317966 - DNA, 15 bp, Homo sapiens
aactcaaattctggt

SEQ ID NO: 317967 - DNA, 15 bp, Homo sapiens
actcaaattctggtc

SEQ ID NO: 317968 - DNA, 15 bp, Homo sapiens
ctcaaattctggtcc

SEQ ID NO: 317969 - DNA, 15 bp, Homo sapiens
tcaaattctggtcct

SEQ ID NO: 317970 - DNA, 15 bp, Homo sapiens
caaattctggtcctt

SEQ ID NO: 317971 - DNA, 15 bp, Homo sapiens
aaattctggtcctta

SEQ ID NO: 317972 - DNA, 15 bp, Homo sapiens
aattctggtccttac

SEQ ID NO: 317973 - DNA, 15 bp, Homo sapiens
attctggtccttact

SEQ ID NO: 317974 - DNA, 15 bp, Homo sapiens
ttctggtccttactt

SEQ ID NO: 317975 - DNA, 15 bp, Homo sapiens
tctggtccttacttt

SEQ ID NO: 317976 - DNA, 15 bp, Homo sapiens
ctggtccttacttta

SEQ ID NO: 317977 - DNA, 15 bp, Homo sapiens
tggtccttactttac

SEQ ID NO: 317978 - DNA, 15 bp, Homo sapiens
ggtccttactttact

SEQ ID NO: 317979 - DNA, 15 bp, Homo sapiens
gtccttactttactt

SEQ ID NO: 317980 - DNA, 15 bp, Homo sapiens
tccttactttacttc

SEQ ID NO: 317981 - DNA, 15 bp, Homo sapiens
ccttactttacttct

SEQ ID NO: 317982 - DNA, 15 bp, Homo sapiens
cttactttacttcta

SEQ ID NO: 317983 - DNA, 15 bp, Homo sapiens
ttactttacttctac

SEQ ID NO: 317984 - DNA, 15 bp, Homo sapiens
tactttacttctact

SEQ ID NO: 317985 - DNA, 15 bp, Homo sapiens
actttacttctactg

SEQ ID NO: 317986 - DNA, 15 bp, Homo sapiens
ctttacttctactgc

SEQ ID NO: 317987 - DNA, 15 bp, Homo sapiens
tttacttctactgcc

SEQ ID NO: 317988 - DNA, 15 bp, Homo sapiens
ttacttctactgcct

SEQ ID NO: 317989 - DNA, 15 bp, Homo sapiens
tacttctactgcctt

SEQ ID NO: 317990 - DNA, 15 bp, Homo sapiens
acttctactgcctta

SEQ ID NO: 317991 - DNA, 15 bp, Homo sapiens
cttctactgccttaa

SEQ ID NO: 317992 - DNA, 15 bp, Homo sapiens
ttctactgccttaaa

SEQ ID NO: 317993 - DNA, 15 bp, Homo sapiens
tctactgccttaaag

SEQ ID NO: 317994 - DNA, 15 bp, Homo sapiens
ctactgccttaaagc

SEQ ID NO: 317995 - DNA, 15 bp, Homo sapiens
tactgccttaaagcc

SEQ ID NO: 317996 - DNA, 15 bp, Homo sapiens
actgccttaaagcca

SEQ ID NO: 317997 - DNA, 15 bp, Homo sapiens
ctgccttaaagccac

SEQ ID NO: 317998 - DNA, 15 bp, Homo sapiens
tgccttaaagccact

SEQ ID NO: 317999 - DNA, 15 bp, Homo sapiens
gccttaaagccactc

SEQ ID NO: 318000 - DNA, 15 bp, Homo sapiens
ccttaaagccactca

SEQ ID NO: 318001 - DNA, 15 bp, Homo sapiens
cttaaagccactcaa

SEQ ID NO: 318002 - DNA, 15 bp, Homo sapiens
ttaaagccactcaaa

SEQ ID NO: 318003 - DNA, 15 bp, Homo sapiens
taaagccactcaaac

SEQ ID NO: 318004 - DNA, 15 bp, Homo sapiens
aaagccactcaaaca

SEQ ID NO: 318005 - DNA, 15 bp, Homo sapiens
aagccactcaaacaa

SEQ ID NO: 318006 - DNA, 15 bp, Homo sapiens
agccactcaaacaaa

SEQ ID NO: 318007 - DNA, 15 bp, Homo sapiens
gccactcaaacaaaa

SEQ ID NO: 318008 - DNA, 15 bp, Homo sapiens
ccactcaaacaaaag

SEQ ID NO: 318009 - DNA, 15 bp, Homo sapiens
cactcaaacaaaaga

SEQ ID NO: 318010 - DNA, 15 bp, Homo sapiens
actcaaacaaaagac

SEQ ID NO: 318011 - DNA, 15 bp, Homo sapiens
ctcaaacaaaagacc

SEQ ID NO: 318012 - DNA, 15 bp, Homo sapiens
tcaaacaaaagacct

SEQ ID NO: 318013 - DNA, 15 bp, Homo sapiens
caaacaaaagacctg

SEQ ID NO: 318014 - DNA, 15 bp, Homo sapiens
aaacaaaagacctga

SEQ ID NO: 318015 - DNA, 15 bp, Homo sapiens
aacaaaagacctgat

SEQ ID NO: 318016 - DNA, 15 bp, Homo sapiens
acaaaagacctgatt

SEQ ID NO: 318017 - DNA, 15 bp, Homo sapiens
caaaagacctgattg

SEQ ID NO: 318018 - DNA, 15 bp, Homo sapiens
aaaagacctgattgc

SEQ ID NO: 318019 - DNA, 15 bp, Homo sapiens
aaagacctgattgct

SEQ ID NO: 318020 - DNA, 15 bp, Homo sapiens
aagacctgattgcta

SEQ ID NO: 318021 - DNA, 15 bp, Homo sapiens
agacctgattgctag

SEQ ID NO: 318022 - DNA, 15 bp, Homo sapiens
gacctgattgctaga

SEQ ID NO: 318023 - DNA, 15 bp, Homo sapiens
acctgattgctagaa

SEQ ID NO: 318024 - DNA, 15 bp, Homo sapiens
cctgattgctagaat

SEQ ID NO: 318025 - DNA, 15 bp, Homo sapiens
ctgattgctagaatt

SEQ ID NO: 318026 - DNA, 15 bp, Homo sapiens
tgattgctagaatta

SEQ ID NO: 318027 - DNA, 15 bp, Homo sapiens
gattgctagaattag

SEQ ID NO: 318028 - DNA, 15 bp, Homo sapiens
attgctagaattagg

SEQ ID NO: 318029 - DNA, 15 bp, Homo sapiens
ttgctagaattaggt

SEQ ID NO: 318030 - DNA, 15 bp, Homo sapiens
tgctagaattaggtt

SEQ ID NO: 318031 - DNA, 15 bp, Homo sapiens
gctagaattaggttg

SEQ ID NO: 318032 - DNA, 15 bp, Homo sapiens
ctagaattaggttga

SEQ ID NO: 318033 - DNA, 15 bp, Homo sapiens
tagaattaggttgag

SEQ ID NO: 318034 - DNA, 15 bp, Homo sapiens
agaattaggttgaga

SEQ ID NO: 318035 - DNA, 15 bp, Homo sapiens
gaattaggttgagaa

SEQ ID NO: 318036 - DNA, 15 bp, Homo sapiens
aattaggttgagaag

SEQ ID NO: 318037 - DNA, 15 bp, Homo sapiens
attaggttgagaaga

SEQ ID NO: 318038 - DNA, 15 bp, Homo sapiens
ttaggttgagaagac

SEQ ID NO: 318039 - DNA, 15 bp, Homo sapiens
taggttgagaagaca

SEQ ID NO: 318040 - DNA, 15 bp, Homo sapiens
aggttgagaagacac

SEQ ID NO: 318041 - DNA, 15 bp, Homo sapiens
ggttgagaagacaca

SEQ ID NO: 318042 - DNA, 15 bp, Homo sapiens
gttgagaagacacaa

SEQ ID NO: 318043 - DNA, 15 bp, Homo sapiens
ttgagaagacacaaa

SEQ ID NO: 318044 - DNA, 15 bp, Homo sapiens
tgagaagacacaaag

SEQ ID NO: 318045 - DNA, 15 bp, Homo sapiens
gagaagacacaaagt

SEQ ID NO: 318046 - DNA, 15 bp, Homo sapiens
agaagacacaaagtt

SEQ ID NO: 318047 - DNA, 15 bp, Homo sapiens
gaagacacaaagttt

SEQ ID NO: 318048 - DNA, 15 bp, Homo sapiens
aagacacaaagtttg

SEQ ID NO: 318049 - DNA, 15 bp, Homo sapiens
agacacaaagtttga

SEQ ID NO: 318050 - DNA, 15 bp, Homo sapiens
gacacaaagtttgaa

SEQ ID NO: 318051 - DNA, 15 bp, Homo sapiens
acacaaagtttgaag

SEQ ID NO: 318052 - DNA, 15 bp, Homo sapiens
cacaaagtttgaagg

SEQ ID NO: 318053 - DNA, 15 bp, Homo sapiens
acaaagtttgaaggg

SEQ ID NO: 318054 - DNA, 15 bp, Homo sapiens
caaagtttgaagggc

SEQ ID NO: 318055 - DNA, 15 bp, Homo sapiens
aaagtttgaagggca

SEQ ID NO: 318056 - DNA, 15 bp, Homo sapiens
aagtttgaagggcaa

SEQ ID NO: 318057 - DNA, 15 bp, Homo sapiens
agtttgaagggcaaa

SEQ ID NO: 318058 - DNA, 15 bp, Homo sapiens
gtttgaagggcaaaa

SEQ ID NO: 318059 - DNA, 15 bp, Homo sapiens
tttgaagggcaaaat

SEQ ID NO: 318060 - DNA, 15 bp, Homo sapiens
ttgaagggcaaaatt

SEQ ID NO: 318061 - DNA, 15 bp, Homo sapiens
tgaagggcaaaattt

SEQ ID NO: 318062 - DNA, 15 bp, Homo sapiens
gaagggcaaaatttc

SEQ ID NO: 318063 - DNA, 15 bp, Homo sapiens
aagggcaaaatttct

SEQ ID NO: 318064 - DNA, 15 bp, Homo sapiens
agggcaaaatttctg

SEQ ID NO: 318065 - DNA, 15 bp, Homo sapiens
gggcaaaatttctga

SEQ ID NO: 318066 - DNA, 15 bp, Homo sapiens
ggcaaaatttctgat

SEQ ID NO: 318067 - DNA, 15 bp, Homo sapiens
gcaaaatttctgata

SEQ ID NO: 318068 - DNA, 15 bp, Homo sapiens
caaaatttctgataa

SEQ ID NO: 318069 - DNA, 15 bp, Homo sapiens
aaaatttctgataat

SEQ ID NO: 318070 - DNA, 15 bp, Homo sapiens
aaatttctgataatg

SEQ ID NO: 318071 - DNA, 15 bp, Homo sapiens
aatttctgataatgt

SEQ ID NO: 318072 - DNA, 15 bp, Homo sapiens
atttctgataatgtt

SEQ ID NO: 318073 - DNA, 15 bp, Homo sapiens
tttctgataatgttt

SEQ ID NO: 318074 - DNA, 15 bp, Homo sapiens
ttctgataatgtttg

SEQ ID NO: 318075 - DNA, 15 bp, Homo sapiens
tctgataatgtttga

SEQ ID NO: 318076 - DNA, 15 bp, Homo sapiens
ctgataatgtttgac

SEQ ID NO: 318077 - DNA, 15 bp, Homo sapiens
tgataatgtttgacc

SEQ ID NO: 318078 - DNA, 15 bp, Homo sapiens
gataatgtttgaccc

SEQ ID NO: 318079 - DNA, 15 bp, Homo sapiens
ataatgtttgaccca

SEQ ID NO: 318080 - DNA, 15 bp, Homo sapiens
taatgtttgacccag

SEQ ID NO: 318081 - DNA, 15 bp, Homo sapiens
aatgtttgacccagt

SEQ ID NO: 318082 - DNA, 15 bp, Homo sapiens
atgtttgacccagtt

SEQ ID NO: 318083 - DNA, 15 bp, Homo sapiens
tgtttgacccagttt

SEQ ID NO: 318084 - DNA, 15 bp, Homo sapiens
gtttgacccagtttt

SEQ ID NO: 318085 - DNA, 15 bp, Homo sapiens
tttgacccagttttg

SEQ ID NO: 318086 - DNA, 15 bp, Homo sapiens
ttgacccagttttgc

SEQ ID NO: 318087 - DNA, 15 bp, Homo sapiens
tgacccagttttgca

SEQ ID NO: 318088 - DNA, 15 bp, Homo sapiens
gacccagttttgcat

SEQ ID NO: 318089 - DNA, 15 bp, Homo sapiens
acccagttttgcata

SEQ ID NO: 318090 - DNA, 15 bp, Homo sapiens
cccagttttgcatat

SEQ ID NO: 318091 - DNA, 15 bp, Homo sapiens
ccagttttgcatata

SEQ ID NO: 318092 - DNA, 15 bp, Homo sapiens
cagttttgcatataa

SEQ ID NO: 318093 - DNA, 15 bp, Homo sapiens
agttttgcatataat

SEQ ID NO: 318094 - DNA, 15 bp, Homo sapiens
gttttgcatataatg

SEQ ID NO: 318095 - DNA, 15 bp, Homo sapiens
ttttgcatataatgt

SEQ ID NO: 318096 - DNA, 15 bp, Homo sapiens
tttgcatataatgta

SEQ ID NO: 318097 - DNA, 15 bp, Homo sapiens
ttgcatataatgtat

SEQ ID NO: 318098 - DNA, 15 bp, Homo sapiens
tgcatataatgtatt

SEQ ID NO: 318099 - DNA, 15 bp, Homo sapiens
gcatataatgtattt

SEQ ID NO: 318100 - DNA, 15 bp, Homo sapiens
catataatgtatttt

SEQ ID NO: 318101 - DNA, 15 bp, Homo sapiens
atataatgtattttt

SEQ ID NO: 318102 - DNA, 15 bp, Homo sapiens
tataatgtattttta

SEQ ID NO: 318103 - DNA, 15 bp, Homo sapiens
ataatgtatttttat

SEQ ID NO: 318104 - DNA, 15 bp, Homo sapiens
taatgtatttttatt

SEQ ID NO: 318105 - DNA, 15 bp, Homo sapiens
aatgtatttttattt

SEQ ID NO: 318106 - DNA, 15 bp, Homo sapiens
atgtatttttatttg

SEQ ID NO: 318107 - DNA, 15 bp, Homo sapiens
tgtatttttatttgt

SEQ ID NO: 318108 - DNA, 15 bp, Homo sapiens
gtatttttatttgtt

SEQ ID NO: 318109 - DNA, 15 bp, Homo sapiens
tatttttatttgttg

SEQ ID NO: 318110 - DNA, 15 bp, Homo sapiens
atttttatttgttga

SEQ ID NO: 318111 - DNA, 15 bp, Homo sapiens
tttttatttgttgat

SEQ ID NO: 318112 - DNA, 15 bp, Homo sapiens
ttttatttgttgatg

SEQ ID NO: 318113 - DNA, 15 bp, Homo sapiens
tttatttgttgatga

SEQ ID NO: 318114 - DNA, 15 bp, Homo sapiens
ttatttgttgatgaa

SEQ ID NO: 318115 - DNA, 15 bp, Homo sapiens
tatttgttgatgaat

SEQ ID NO: 318116 - DNA, 15 bp, Homo sapiens
atttgttgatgaata

SEQ ID NO: 318117 - DNA, 15 bp, Homo sapiens
tttgttgatgaatat

SEQ ID NO: 318118 - DNA, 15 bp, Homo sapiens
ttgttgatgaatatt

SEQ ID NO: 318119 - DNA, 15 bp, Homo sapiens
tgttgatgaatattt

SEQ ID NO: 318120 - DNA, 15 bp, Homo sapiens
gttgatgaatatttc

SEQ ID NO: 318121 - DNA, 15 bp, Homo sapiens
ttgatgaatatttcc

SEQ ID NO: 318122 - DNA, 15 bp, Homo sapiens
tgatgaatatttccc

SEQ ID NO: 318123 - DNA, 15 bp, Homo sapiens
gatgaatatttccct

SEQ ID NO: 318124 - DNA, 15 bp, Homo sapiens
atgaatatttccctt

SEQ ID NO: 318125 - DNA, 15 bp, Homo sapiens
tgaatatttcccttt

SEQ ID NO: 318126 - DNA, 15 bp, Homo sapiens
gaatatttccctttt

SEQ ID NO: 318127 - DNA, 15 bp, Homo sapiens
aatatttcccttttg

SEQ ID NO: 318128 - DNA, 15 bp, Homo sapiens
atatttcccttttgt

SEQ ID NO: 318129 - DNA, 15 bp, Homo sapiens
tatttcccttttgtt

SEQ ID NO: 318130 - DNA, 15 bp, Homo sapiens
atttcccttttgttg

SEQ ID NO: 318131 - DNA, 15 bp, Homo sapiens
tttcccttttgttgc

SEQ ID NO: 318132 - DNA, 15 bp, Homo sapiens
ttcccttttgttgct

SEQ ID NO: 318133 - DNA, 15 bp, Homo sapiens
tcccttttgttgcta

SEQ ID NO: 318134 - DNA, 15 bp, Homo sapiens
cccttttgttgctaa

SEQ ID NO: 318135 - DNA, 15 bp, Homo sapiens
ccttttgttgctaaa

SEQ ID NO: 318136 - DNA, 15 bp, Homo sapiens
cttttgttgctaaaa

SEQ ID NO: 318137 - DNA, 15 bp, Homo sapiens
ttttgttgctaaaag

SEQ ID NO: 318138 - DNA, 15 bp, Homo sapiens
tttgttgctaaaagt

SEQ ID NO: 318139 - DNA, 15 bp, Homo sapiens
ttgttgctaaaagtg

SEQ ID NO: 318140 - DNA, 15 bp, Homo sapiens
tgttgctaaaagtgg

SEQ ID NO: 318141 - DNA, 15 bp, Homo sapiens
gttgctaaaagtggc

SEQ ID NO: 318142 - DNA, 15 bp, Homo sapiens
ttgctaaaagtggca

SEQ ID NO: 318143 - DNA, 15 bp, Homo sapiens
tgctaaaagtggcaa

SEQ ID NO: 318144 - DNA, 15 bp, Homo sapiens
gctaaaagtggcaaa

SEQ ID NO: 318145 - DNA, 15 bp, Homo sapiens
ctaaaagtggcaaat

SEQ ID NO: 318146 - DNA, 15 bp, Homo sapiens
taaaagtggcaaata

SEQ ID NO: 318147 - DNA, 15 bp, Homo sapiens
aaaagtggcaaataa

SEQ ID NO: 318148 - DNA, 15 bp, Homo sapiens
aaagtggcaaataat

SEQ ID NO: 318149 - DNA, 15 bp, Homo sapiens
aagtggcaaataatc

SEQ ID NO: 318150 - DNA, 15 bp, Homo sapiens
agtggcaaataatca

SEQ ID NO: 318151 - DNA, 15 bp, Homo sapiens
gtggcaaataatcag

SEQ ID NO: 318152 - DNA, 15 bp, Homo sapiens
tggcaaataatcaga

SEQ ID NO: 318153 - DNA, 15 bp, Homo sapiens
ggcaaataatcagac

SEQ ID NO: 318154 - DNA, 15 bp, Homo sapiens
gcaaataatcagaca

SEQ ID NO: 318155 - DNA, 15 bp, Homo sapiens
caaataatcagacat

SEQ ID NO: 318156 - DNA, 15 bp, Homo sapiens
aaataatcagacata

SEQ ID NO: 318157 - DNA, 15 bp, Homo sapiens
aataatcagacatag

SEQ ID NO: 318158 - DNA, 15 bp, Homo sapiens
ataatcagacataga

SEQ ID NO: 318159 - DNA, 15 bp, Homo sapiens
taatcagacatagat

SEQ ID NO: 318160 - DNA, 15 bp, Homo sapiens
aatcagacatagatt

SEQ ID NO: 318161 - DNA, 15 bp, Homo sapiens
atcagacatagatta

SEQ ID NO: 318162 - DNA, 15 bp, Homo sapiens
tcagacatagattac

SEQ ID NO: 318163 - DNA, 15 bp, Homo sapiens
cagacatagattact

SEQ ID NO: 318164 - DNA, 15 bp, Homo sapiens
agacatagattacta

SEQ ID NO: 318165 - DNA, 15 bp, Homo sapiens
gacatagattactaa

SEQ ID NO: 318166 - DNA, 15 bp, Homo sapiens
acatagattactaat

SEQ ID NO: 318167 - DNA, 15 bp, Homo sapiens
catagattactaatt

SEQ ID NO: 318168 - DNA, 15 bp, Homo sapiens
atagattactaatta

SEQ ID NO: 318169 - DNA, 15 bp, Homo sapiens
tagattactaattaa

SEQ ID NO: 318170 - DNA, 15 bp, Homo sapiens
agattactaattaac

SEQ ID NO: 318171 - DNA, 15 bp, Homo sapiens
gattactaattaaca

SEQ ID NO: 318172 - DNA, 15 bp, Homo sapiens
attactaattaacag

SEQ ID NO: 318173 - DNA, 15 bp, Homo sapiens
ttactaattaacagt

SEQ ID NO: 318174 - DNA, 15 bp, Homo sapiens
tactaattaacagtc

SEQ ID NO: 318175 - DNA, 15 bp, Homo sapiens
actaattaacagtct

SEQ ID NO: 318176 - DNA, 15 bp, Homo sapiens
ctaattaacagtctg

SEQ ID NO: 318177 - DNA, 15 bp, Homo sapiens
taattaacagtctgc

SEQ ID NO: 318178 - DNA, 15 bp, Homo sapiens
aattaacagtctgcc

SEQ ID NO: 318179 - DNA, 15 bp, Homo sapiens
attaacagtctgcct

SEQ ID NO: 318180 - DNA, 15 bp, Homo sapiens
ttaacagtctgcctc

SEQ ID NO: 318181 - DNA, 15 bp, Homo sapiens
taacagtctgcctca

SEQ ID NO: 318182 - DNA, 15 bp, Homo sapiens
aacagtctgcctcag

SEQ ID NO: 318183 - DNA, 15 bp, Homo sapiens
acagtctgcctcagt

SEQ ID NO: 318184 - DNA, 15 bp, Homo sapiens
cagtctgcctcagtt

SEQ ID NO: 318185 - DNA, 15 bp, Homo sapiens
agtctgcctcagttt

SEQ ID NO: 318186 - DNA, 15 bp, Homo sapiens
gtctgcctcagtttt

SEQ ID NO: 318187 - DNA, 15 bp, Homo sapiens
tctgcctcagttttt

SEQ ID NO: 318188 - DNA, 15 bp, Homo sapiens
ctgcctcagtttttt

SEQ ID NO: 318189 - DNA, 15 bp, Homo sapiens
tgcctcagttttttt

SEQ ID NO: 318190 - DNA, 15 bp, Homo sapiens
gcctcagtttttttt

SEQ ID NO: 318191 - DNA, 15 bp, Homo sapiens
cctcagttttttttt

SEQ ID NO: 318192 - DNA, 15 bp, Homo sapiens
ctcagtttttttttt

SEQ ID NO: 318193 - DNA, 15 bp, Homo sapiens
tcagttttttttttt

SEQ ID NO: 318194 - DNA, 15 bp, Homo sapiens
cagtttttttttttt

SEQ ID NO: 318195 - DNA, 15 bp, Homo sapiens
agttttttttttttt

SEQ ID NO: 318196 - DNA, 15 bp, Homo sapiens
gtttttttttttttt

SEQ ID NO: 318197 - DNA, 15 bp, Homo sapiens
tttttttttttttta

SEQ ID NO: 318198 - DNA, 15 bp, Homo sapiens
tttttttttttttaa

SEQ ID NO: 318199 - DNA, 15 bp, Homo sapiens
ttttttttttttaat

SEQ ID NO: 318200 - DNA, 15 bp, Homo sapiens
tttttttttttaatt

SEQ ID NO: 318201 - DNA, 15 bp, Homo sapiens
ttttttttttaatta

SEQ ID NO: 318202 - DNA, 15 bp, Homo sapiens
tttttttttaattaa

SEQ ID NO: 318203 - DNA, 15 bp, Homo sapiens
ttttttttaattaat

SEQ ID NO: 318204 - DNA, 15 bp, Homo sapiens
tttttttaattaatg

SEQ ID NO: 318205 - DNA, 15 bp, Homo sapiens
ttttttaattaatga

SEQ ID NO: 318206 - DNA, 15 bp, Homo sapiens
tttttaattaatgaa

SEQ ID NO: 318207 - DNA, 15 bp, Homo sapiens
ttttaattaatgaaa

SEQ ID NO: 318208 - DNA, 15 bp, Homo sapiens
tttaattaatgaaac

SEQ ID NO: 318209 - DNA, 15 bp, Homo sapiens
ttaattaatgaaact

SEQ ID NO: 318210 - DNA, 15 bp, Homo sapiens
taattaatgaaactt

SEQ ID NO: 318211 - DNA, 15 bp, Homo sapiens
aattaatgaaacttg

SEQ ID NO: 318212 - DNA, 15 bp, Homo sapiens
attaatgaaacttgg

SEQ ID NO: 318213 - DNA, 15 bp, Homo sapiens
ttaatgaaacttggg

SEQ ID NO: 318214 - DNA, 15 bp, Homo sapiens
taatgaaacttgggc

SEQ ID NO: 318215 - DNA, 15 bp, Homo sapiens
aatgaaacttgggct

SEQ ID NO: 318216 - DNA, 15 bp, Homo sapiens
atgaaacttgggctt

SEQ ID NO: 318217 - DNA, 15 bp, Homo sapiens
tgaaacttgggcttc

SEQ ID NO: 318218 - DNA, 15 bp, Homo sapiens
gaaacttgggcttca

SEQ ID NO: 318219 - DNA, 15 bp, Homo sapiens
aaacttgggcttcat

SEQ ID NO: 318220 - DNA, 15 bp, Homo sapiens
aacttgggcttcatc

SEQ ID NO: 318221 - DNA, 15 bp, Homo sapiens
acttgggcttcatca

SEQ ID NO: 318222 - DNA, 15 bp, Homo sapiens
cttgggcttcatcaa

SEQ ID NO: 318223 - DNA, 15 bp, Homo sapiens
ttgggcttcatcaag

SEQ ID NO: 318224 - DNA, 15 bp, Homo sapiens
tgggcttcatcaagc

SEQ ID NO: 318225 - DNA, 15 bp, Homo sapiens
gggcttcatcaagct

SEQ ID NO: 318226 - DNA, 15 bp, Homo sapiens
ggcttcatcaagctc

SEQ ID NO: 318227 - DNA, 15 bp, Homo sapiens
gcttcatcaagctca

SEQ ID NO: 318228 - DNA, 15 bp, Homo sapiens
cttcatcaagctcag

SEQ ID NO: 318229 - DNA, 15 bp, Homo sapiens
ttcatcaagctcagg

SEQ ID NO: 318230 - DNA, 15 bp, Homo sapiens
tcatcaagctcaggt

SEQ ID NO: 318231 - DNA, 15 bp, Homo sapiens
catcaagctcaggtg

SEQ ID NO: 318232 - DNA, 15 bp, Homo sapiens
atcaagctcaggtgg

SEQ ID NO: 318233 - DNA, 15 bp, Homo sapiens
tcaagctcaggtgga

SEQ ID NO: 318234 - DNA, 15 bp, Homo sapiens
caagctcaggtggaa

SEQ ID NO: 318235 - DNA, 15 bp, Homo sapiens
aagctcaggtggaat

SEQ ID NO: 318236 - DNA, 15 bp, Homo sapiens
agctcaggtggaatg

SEQ ID NO: 318237 - DNA, 15 bp, Homo sapiens
gctcaggtggaatgg

SEQ ID NO: 318238 - DNA, 15 bp, Homo sapiens
ctcaggtggaatgga

SEQ ID NO: 318239 - DNA, 15 bp, Homo sapiens
tcaggtggaatggat

SEQ ID NO: 318240 - DNA, 15 bp, Homo sapiens
caggtggaatggata

SEQ ID NO: 318241 - DNA, 15 bp, Homo sapiens
aggtggaatggatat

SEQ ID NO: 318242 - DNA, 15 bp, Homo sapiens
ggtggaatggatatc

SEQ ID NO: 318243 - DNA, 15 bp, Homo sapiens
gtggaatggatatca

SEQ ID NO: 318244 - DNA, 15 bp, Homo sapiens
tggaatggatatcac

SEQ ID NO: 318245 - DNA, 15 bp, Homo sapiens
ggaatggatatcaca

SEQ ID NO: 318246 - DNA, 15 bp, Homo sapiens
gaatggatatcacag

SEQ ID NO: 318247 - DNA, 15 bp, Homo sapiens
aatggatatcacagt

SEQ ID NO: 318248 - DNA, 15 bp, Homo sapiens
atggatatcacagtg

SEQ ID NO: 318249 - DNA, 15 bp, Homo sapiens
tggatatcacagtgc

SEQ ID NO: 318250 - DNA, 15 bp, Homo sapiens
ggatatcacagtgct

SEQ ID NO: 318251 - DNA, 15 bp, Homo sapiens
gatatcacagtgctt

SEQ ID NO: 318252 - DNA, 15 bp, Homo sapiens
atatcacagtgcttt

SEQ ID NO: 318253 - DNA, 15 bp, Homo sapiens
tatcacagtgcttta

SEQ ID NO: 318254 - DNA, 15 bp, Homo sapiens
atcacagtgctttat

SEQ ID NO: 318255 - DNA, 15 bp, Homo sapiens
tcacagtgctttatt

SEQ ID NO: 318256 - DNA, 15 bp, Homo sapiens
cacagtgctttattt

SEQ ID NO: 318257 - DNA, 15 bp, Homo sapiens
acagtgctttatttt

SEQ ID NO: 318258 - DNA, 15 bp, Homo sapiens
cagtgctttattttt

SEQ ID NO: 318259 - DNA, 15 bp, Homo sapiens
agtgctttatttttt

SEQ ID NO: 318260 - DNA, 15 bp, Homo sapiens
gtgctttattttttc

SEQ ID NO: 318261 - DNA, 15 bp, Homo sapiens
tgctttattttttct

SEQ ID NO: 318262 - DNA, 15 bp, Homo sapiens
gctttattttttctg

SEQ ID NO: 318263 - DNA, 15 bp, Homo sapiens
ctttattttttctga

SEQ ID NO: 318264 - DNA, 15 bp, Homo sapiens
tttattttttctgac

SEQ ID NO: 318265 - DNA, 15 bp, Homo sapiens
ttattttttctgaca

SEQ ID NO: 318266 - DNA, 15 bp, Homo sapiens
tattttttctgacat

SEQ ID NO: 318267 - DNA, 15 bp, Homo sapiens
attttttctgacatc

SEQ ID NO: 318268 - DNA, 15 bp, Homo sapiens
ttttttctgacatca

SEQ ID NO: 318269 - DNA, 15 bp, Homo sapiens
tttttctgacatcaa

SEQ ID NO: 318270 - DNA, 15 bp, Homo sapiens
ttttctgacatcaaa

SEQ ID NO: 318271 - DNA, 15 bp, Homo sapiens
tttctgacatcaaaa

SEQ ID NO: 318272 - DNA, 15 bp, Homo sapiens
ttctgacatcaaaag

SEQ ID NO: 318273 - DNA, 15 bp, Homo sapiens
tctgacatcaaaaga

SEQ ID NO: 318274 - DNA, 15 bp, Homo sapiens
ctgacatcaaaagaa

SEQ ID NO: 318275 - DNA, 15 bp, Homo sapiens
tgacatcaaaagaaa

SEQ ID NO: 318276 - DNA, 15 bp, Homo sapiens
gacatcaaaagaaat

SEQ ID NO: 318277 - DNA, 15 bp, Homo sapiens
acatcaaaagaaatt

SEQ ID NO: 318278 - DNA, 15 bp, Homo sapiens
catcaaaagaaattt

SEQ ID NO: 318279 - DNA, 15 bp, Homo sapiens
atcaaaagaaatttc

SEQ ID NO: 318280 - DNA, 15 bp, Homo sapiens
tcaaaagaaatttct

SEQ ID NO: 318281 - DNA, 15 bp, Homo sapiens
caaaagaaatttctt

SEQ ID NO: 318282 - DNA, 15 bp, Homo sapiens
aaaagaaatttcttt

SEQ ID NO: 318283 - DNA, 15 bp, Homo sapiens
aaagaaatttctttg

SEQ ID NO: 318284 - DNA, 15 bp, Homo sapiens
aagaaatttctttgt

SEQ ID NO: 318285 - DNA, 15 bp, Homo sapiens
agaaatttctttgtc

SEQ ID NO: 318286 - DNA, 15 bp, Homo sapiens
gaaatttctttgtca

SEQ ID NO: 318287 - DNA, 15 bp, Homo sapiens
aaatttctttgtcaa

SEQ ID NO: 318288 - DNA, 15 bp, Homo sapiens
aatttctttgtcaaa

SEQ ID NO: 318289 - DNA, 15 bp, Homo sapiens
atttctttgtcaaag

SEQ ID NO: 318290 - DNA, 15 bp, Homo sapiens
tttctttgtcaaagt

SEQ ID NO: 318291 - DNA, 15 bp, Homo sapiens
ttctttgtcaaagtg

SEQ ID NO: 318292 - DNA, 15 bp, Homo sapiens
tctttgtcaaagtgt

SEQ ID NO: 318293 - DNA, 15 bp, Homo sapiens
ctttgtcaaagtgta

SEQ ID NO: 318294 - DNA, 15 bp, Homo sapiens
tttgtcaaagtgtag

SEQ ID NO: 318295 - DNA, 15 bp, Homo sapiens
ttgtcaaagtgtaga

SEQ ID NO: 318296 - DNA, 15 bp, Homo sapiens
tgtcaaagtgtagac

SEQ ID NO: 318297 - DNA, 15 bp, Homo sapiens
gtcaaagtgtagaca

SEQ ID NO: 318298 - DNA, 15 bp, Homo sapiens
tcaaagtgtagacat

SEQ ID NO: 318299 - DNA, 15 bp, Homo sapiens
caaagtgtagacatg

SEQ ID NO: 318300 - DNA, 15 bp, Homo sapiens
aaagtgtagacatgt

SEQ ID NO: 318301 - DNA, 15 bp, Homo sapiens
aagtgtagacatgtt

SEQ ID NO: 318302 - DNA, 15 bp, Homo sapiens
agtgtagacatgttt

SEQ ID NO: 318303 - DNA, 15 bp, Homo sapiens
gtgtagacatgtttg

SEQ ID NO: 318304 - DNA, 15 bp, Homo sapiens
tgtagacatgtttgt

SEQ ID NO: 318305 - DNA, 15 bp, Homo sapiens
gtagacatgtttgtt

SEQ ID NO: 318306 - DNA, 15 bp, Homo sapiens
tagacatgtttgttg

SEQ ID NO: 318307 - DNA, 15 bp, Homo sapiens
agacatgtttgttgt

SEQ ID NO: 318308 - DNA, 15 bp, Homo sapiens
gacatgtttgttgtg

SEQ ID NO: 318309 - DNA, 15 bp, Homo sapiens
acatgtttgttgtga

SEQ ID NO: 318310 - DNA, 15 bp, Homo sapiens
catgtttgttgtgac

SEQ ID NO: 318311 - DNA, 15 bp, Homo sapiens
atgtttgttgtgact

SEQ ID NO: 318312 - DNA, 15 bp, Homo sapiens
tgtttgttgtgactg

SEQ ID NO: 318313 - DNA, 15 bp, Homo sapiens
gtttgttgtgactgc

SEQ ID NO: 318314 - DNA, 15 bp, Homo sapiens
tttgttgtgactgcc

SEQ ID NO: 318315 - DNA, 15 bp, Homo sapiens
ttgttgtgactgcct

SEQ ID NO: 318316 - DNA, 15 bp, Homo sapiens
tgttgtgactgcctt

SEQ ID NO: 318317 - DNA, 15 bp, Homo sapiens
gttgtgactgccttt

SEQ ID NO: 318318 - DNA, 15 bp, Homo sapiens
ttgtgactgcctttt

SEQ ID NO: 318319 - DNA, 15 bp, Homo sapiens
tgtgactgccttttg

SEQ ID NO: 318320 - DNA, 15 bp, Homo sapiens
gtgactgccttttgt

SEQ ID NO: 318321 - DNA, 15 bp, Homo sapiens
tgactgccttttgtg

SEQ ID NO: 318322 - DNA, 15 bp, Homo sapiens
gactgccttttgtgt

SEQ ID NO: 318323 - DNA, 15 bp, Homo sapiens
actgccttttgtgtg

SEQ ID NO: 318324 - DNA, 15 bp, Homo sapiens
ctgccttttgtgtgg

SEQ ID NO: 318325 - DNA, 15 bp, Homo sapiens
tgccttttgtgtggg

SEQ ID NO: 318326 - DNA, 15 bp, Homo sapiens
gccttttgtgtgggt

SEQ ID NO: 318327 - DNA, 15 bp, Homo sapiens
ccttttgtgtgggtt

SEQ ID NO: 318328 - DNA, 15 bp, Homo sapiens
cttttgtgtgggttc

SEQ ID NO: 318329 - DNA, 15 bp, Homo sapiens
ttttgtgtgggttct

SEQ ID NO: 318330 - DNA, 15 bp, Homo sapiens
tttgtgtgggttctt

SEQ ID NO: 318331 - DNA, 15 bp, Homo sapiens
ttgtgtgggttcttt

SEQ ID NO: 318332 - DNA, 15 bp, Homo sapiens
tgtgtgggttctttt

SEQ ID NO: 318333 - DNA, 15 bp, Homo sapiens
gtgtgggttcttttc

SEQ ID NO: 318334 - DNA, 15 bp, Homo sapiens
tgtgggttcttttct

SEQ ID NO: 318335 - DNA, 15 bp, Homo sapiens
gtgggttcttttctc

SEQ ID NO: 318336 - DNA, 15 bp, Homo sapiens
tgggttcttttctcc

SEQ ID NO: 318337 - DNA, 15 bp, Homo sapiens
gggttcttttctccc

SEQ ID NO: 318338 - DNA, 15 bp, Homo sapiens
ggttcttttctccca

SEQ ID NO: 318339 - DNA, 15 bp, Homo sapiens
gttcttttctcccag

SEQ ID NO: 318340 - DNA, 15 bp, Homo sapiens
ttcttttctcccagc

SEQ ID NO: 318341 - DNA, 15 bp, Homo sapiens
tcttttctcccagcc

SEQ ID NO: 318342 - DNA, 15 bp, Homo sapiens
cttttctcccagccc

SEQ ID NO: 318343 - DNA, 15 bp, Homo sapiens
ttttctcccagccct

SEQ ID NO: 318344 - DNA, 15 bp, Homo sapiens
tttctcccagccctc

SEQ ID NO: 318345 - DNA, 15 bp, Homo sapiens
ttctcccagccctct

SEQ ID NO: 318346 - DNA, 15 bp, Homo sapiens
tctcccagccctctc

SEQ ID NO: 318347 - DNA, 15 bp, Homo sapiens
ctcccagccctctcc

SEQ ID NO: 318348 - DNA, 15 bp, Homo sapiens
tcccagccctctcct

SEQ ID NO: 318349 - DNA, 15 bp, Homo sapiens
cccagccctctccta

SEQ ID NO: 318350 - DNA, 15 bp, Homo sapiens
ccagccctctcctac

SEQ ID NO: 318351 - DNA, 15 bp, Homo sapiens
cagccctctcctact

SEQ ID NO: 318352 - DNA, 15 bp, Homo sapiens
agccctctcctacta

SEQ ID NO: 318353 - DNA, 15 bp, Homo sapiens
gccctctcctactac

SEQ ID NO: 318354 - DNA, 15 bp, Homo sapiens
ccctctcctactaca

SEQ ID NO: 318355 - DNA, 15 bp, Homo sapiens
cctctcctactacag

SEQ ID NO: 318356 - DNA, 15 bp, Homo sapiens
ctctcctactacagg

SEQ ID NO: 318357 - DNA, 15 bp, Homo sapiens
tctcctactacagga

SEQ ID NO: 318358 - DNA, 15 bp, Homo sapiens
ctcctactacaggag

SEQ ID NO: 318359 - DNA, 15 bp, Homo sapiens
tcctactacaggaga

SEQ ID NO: 318360 - DNA, 15 bp, Homo sapiens
cctactacaggagag

SEQ ID NO: 318361 - DNA, 15 bp, Homo sapiens
ctactacaggagaga

SEQ ID NO: 318362 - DNA, 15 bp, Homo sapiens
tactacaggagagag

SEQ ID NO: 318363 - DNA, 15 bp, Homo sapiens
actacaggagagaga

SEQ ID NO: 318364 - DNA, 15 bp, Homo sapiens
ctacaggagagagag

SEQ ID NO: 318365 - DNA, 15 bp, Homo sapiens
tacaggagagagaga

SEQ ID NO: 318366 - DNA, 15 bp, Homo sapiens
acaggagagagagat

SEQ ID NO: 318367 - DNA, 15 bp, Homo sapiens
caggagagagagata

SEQ ID NO: 318368 - DNA, 15 bp, Homo sapiens
aggagagagagataa

SEQ ID NO: 318369 - DNA, 15 bp, Homo sapiens
ggagagagagataat

SEQ ID NO: 318370 - DNA, 15 bp, Homo sapiens
gagagagagataatg

SEQ ID NO: 318371 - DNA, 15 bp, Homo sapiens
agagagagataatgg

SEQ ID NO: 318372 - DNA, 15 bp, Homo sapiens
gagagagataatggc

SEQ ID NO: 318373 - DNA, 15 bp, Homo sapiens
agagagataatggcc

SEQ ID NO: 318374 - DNA, 15 bp, Homo sapiens
gagagataatggccc

SEQ ID NO: 318375 - DNA, 15 bp, Homo sapiens
agagataatggccct

SEQ ID NO: 318376 - DNA, 15 bp, Homo sapiens
gagataatggccctt

SEQ ID NO: 318377 - DNA, 15 bp, Homo sapiens
agataatggcccttt

SEQ ID NO: 318378 - DNA, 15 bp, Homo sapiens
gataatggccctttg

SEQ ID NO: 318379 - DNA, 15 bp, Homo sapiens
ataatggccctttgc

SEQ ID NO: 318380 - DNA, 15 bp, Homo sapiens
taatggccctttgct

SEQ ID NO: 318381 - DNA, 15 bp, Homo sapiens
aatggccctttgctc

SEQ ID NO: 318382 - DNA, 15 bp, Homo sapiens
atggccctttgctcc

SEQ ID NO: 318383 - DNA, 15 bp, Homo sapiens
tggccctttgctcct

SEQ ID NO: 318384 - DNA, 15 bp, Homo sapiens
ggccctttgctcctc

SEQ ID NO: 318385 - DNA, 15 bp, Homo sapiens
gccctttgctcctca

SEQ ID NO: 318386 - DNA, 15 bp, Homo sapiens
ccctttgctcctcat

SEQ ID NO: 318387 - DNA, 15 bp, Homo sapiens
cctttgctcctcatt

SEQ ID NO: 318388 - DNA, 15 bp, Homo sapiens
ctttgctcctcattc

SEQ ID NO: 318389 - DNA, 15 bp, Homo sapiens
tttgctcctcattcc

SEQ ID NO: 318390 - DNA, 15 bp, Homo sapiens
ttgctcctcattccg

SEQ ID NO: 318391 - DNA, 15 bp, Homo sapiens
tgctcctcattccgc

SEQ ID NO: 318392 - DNA, 15 bp, Homo sapiens
gctcctcattccgca

SEQ ID NO: 318393 - DNA, 15 bp, Homo sapiens
ctcctcattccgcat

SEQ ID NO: 318394 - DNA, 15 bp, Homo sapiens
tcctcattccgcatt

SEQ ID NO: 318395 - DNA, 15 bp, Homo sapiens
cctcattccgcattc

SEQ ID NO: 318396 - DNA, 15 bp, Homo sapiens
ctcattccgcattca

SEQ ID NO: 318397 - DNA, 15 bp, Homo sapiens
tcattccgcattcag

SEQ ID NO: 318398 - DNA, 15 bp, Homo sapiens
cattccgcattcaga

SEQ ID NO: 318399 - DNA, 15 bp, Homo sapiens
attccgcattcagac

SEQ ID NO: 318400 - DNA, 15 bp, Homo sapiens
ttccgcattcagacc

SEQ ID NO: 318401 - DNA, 15 bp, Homo sapiens
tccgcattcagacca

SEQ ID NO: 318402 - DNA, 15 bp, Homo sapiens
ccgcattcagaccag

SEQ ID NO: 318403 - DNA, 15 bp, Homo sapiens
cgcattcagaccaga

SEQ ID NO: 318404 - DNA, 15 bp, Homo sapiens
gcattcagaccagat

SEQ ID NO: 318405 - DNA, 15 bp, Homo sapiens
cattcagaccagatt

SEQ ID NO: 318406 - DNA, 15 bp, Homo sapiens
attcagaccagattc

SEQ ID NO: 318407 - DNA, 15 bp, Homo sapiens
ttcagaccagattcc

SEQ ID NO: 318408 - DNA, 15 bp, Homo sapiens
tcagaccagattccc

SEQ ID NO: 318409 - DNA, 15 bp, Homo sapiens
cagaccagattcccc

SEQ ID NO: 318410 - DNA, 15 bp, Homo sapiens
agaccagattcccca

SEQ ID NO: 318411 - DNA, 15 bp, Homo sapiens
gaccagattccccag

SEQ ID NO: 318412 - DNA, 15 bp, Homo sapiens
accagattccccagc

SEQ ID NO: 318413 - DNA, 15 bp, Homo sapiens
ccagattccccagct

SEQ ID NO: 318414 - DNA, 15 bp, Homo sapiens
cagattccccagctg

SEQ ID NO: 318415 - DNA, 15 bp, Homo sapiens
agattccccagctgc

SEQ ID NO: 318416 - DNA, 15 bp, Homo sapiens
gattccccagctgca

SEQ ID NO: 318417 - DNA, 15 bp, Homo sapiens
attccccagctgcaa

SEQ ID NO: 318418 - DNA, 15 bp, Homo sapiens
ttccccagctgcaat

SEQ ID NO: 318419 - DNA, 15 bp, Homo sapiens
tccccagctgcaatc

SEQ ID NO: 318420 - DNA, 15 bp, Homo sapiens
ccccagctgcaatct

SEQ ID NO: 318421 - DNA, 15 bp, Homo sapiens
cccagctgcaatctc

SEQ ID NO: 318422 - DNA, 15 bp, Homo sapiens
ccagctgcaatctcc

SEQ ID NO: 318423 - DNA, 15 bp, Homo sapiens
cagctgcaatctcct

SEQ ID NO: 318424 - DNA, 15 bp, Homo sapiens
agctgcaatctcctg

SEQ ID NO: 318425 - DNA, 15 bp, Homo sapiens
gctgcaatctcctgc

SEQ ID NO: 318426 - DNA, 15 bp, Homo sapiens
ctgcaatctcctgcc

SEQ ID NO: 318427 - DNA, 15 bp, Homo sapiens
tgcaatctcctgcca

SEQ ID NO: 318428 - DNA, 15 bp, Homo sapiens
gcaatctcctgccat

SEQ ID NO: 318429 - DNA, 15 bp, Homo sapiens
caatctcctgccatc

SEQ ID NO: 318430 - DNA, 15 bp, Homo sapiens
aatctcctgccatcg

SEQ ID NO: 318431 - DNA, 15 bp, Homo sapiens
atctcctgccatcgg

SEQ ID NO: 318432 - DNA, 15 bp, Homo sapiens
tctcctgccatcgga

SEQ ID NO: 318433 - DNA, 15 bp, Homo sapiens
ctcctgccatcggat

SEQ ID NO: 318434 - DNA, 15 bp, Homo sapiens
tcctgccatcggatt

SEQ ID NO: 318435 - DNA, 15 bp, Homo sapiens
cctgccatcggattg

SEQ ID NO: 318436 - DNA, 15 bp, Homo sapiens
ctgccatcggattgc

SEQ ID NO: 318437 - DNA, 15 bp, Homo sapiens
tgccatcggattgca

SEQ ID NO: 318438 - DNA, 15 bp, Homo sapiens
gccatcggattgcat

SEQ ID NO: 318439 - DNA, 15 bp, Homo sapiens
ccatcggattgcatc

SEQ ID NO: 318440 - DNA, 15 bp, Homo sapiens
catcggattgcatca

SEQ ID NO: 318441 - DNA, 15 bp, Homo sapiens
atcggattgcatcac

SEQ ID NO: 318442 - DNA, 15 bp, Homo sapiens
tcggattgcatcacc

SEQ ID NO: 318443 - DNA, 15 bp, Homo sapiens
cggattgcatcacca

SEQ ID NO: 318444 - DNA, 15 bp, Homo sapiens
ggattgcatcaccaa

SEQ ID NO: 318445 - DNA, 15 bp, Homo sapiens
gattgcatcaccaac

SEQ ID NO: 318446 - DNA, 15 bp, Homo sapiens
attgcatcaccaact

SEQ ID NO: 318447 - DNA, 15 bp, Homo sapiens
ttgcatcaccaactc

SEQ ID NO: 318448 - DNA, 15 bp, Homo sapiens
tgcatcaccaactca

SEQ ID NO: 318449 - DNA, 15 bp, Homo sapiens
gcatcaccaactcaa

SEQ ID NO: 318450 - DNA, 15 bp, Homo sapiens
catcaccaactcaac

SEQ ID NO: 318451 - DNA, 15 bp, Homo sapiens
atcaccaactcaacc

SEQ ID NO: 318452 - DNA, 15 bp, Homo sapiens
tcaccaactcaacct

SEQ ID NO: 318453 - DNA, 15 bp, Homo sapiens
caccaactcaaccta

SEQ ID NO: 318454 - DNA, 15 bp, Homo sapiens
accaactcaacctaa

SEQ ID NO: 318455 - DNA, 15 bp, Homo sapiens
ccaactcaacctaat

SEQ ID NO: 318456 - DNA, 15 bp, Homo sapiens
caactcaacctaatt

SEQ ID NO: 318457 - DNA, 15 bp, Homo sapiens
aactcaacctaattg

SEQ ID NO: 318458 - DNA, 15 bp, Homo sapiens
actcaacctaattgg

SEQ ID NO: 318459 - DNA, 15 bp, Homo sapiens
ctcaacctaattggt

SEQ ID NO: 318460 - DNA, 15 bp, Homo sapiens
tcaacctaattggtg

SEQ ID NO: 318461 - DNA, 15 bp, Homo sapiens
caacctaattggtga

SEQ ID NO: 318462 - DNA, 15 bp, Homo sapiens
aacctaattggtgag

SEQ ID NO: 318463 - DNA, 15 bp, Homo sapiens
acctaattggtgaga

SEQ ID NO: 318464 - DNA, 15 bp, Homo sapiens
cctaattggtgagat

SEQ ID NO: 318465 - DNA, 15 bp, Homo sapiens
ctaattggtgagatg

SEQ ID NO: 318466 - DNA, 15 bp, Homo sapiens
taattggtgagatgt

SEQ ID NO: 318467 - DNA, 15 bp, Homo sapiens
aattggtgagatgtc

SEQ ID NO: 318468 - DNA, 15 bp, Homo sapiens
attggtgagatgtca

SEQ ID NO: 318469 - DNA, 15 bp, Homo sapiens
ttggtgagatgtcac

SEQ ID NO: 318470 - DNA, 15 bp, Homo sapiens
tggtgagatgtcact

SEQ ID NO: 318471 - DNA, 15 bp, Homo sapiens
ggtgagatgtcactc

SEQ ID NO: 318472 - DNA, 15 bp, Homo sapiens
gtgagatgtcactcc

SEQ ID NO: 318473 - DNA, 15 bp, Homo sapiens
tgagatgtcactccc

SEQ ID NO: 318474 - DNA, 15 bp, Homo sapiens
gagatgtcactccct

SEQ ID NO: 318475 - DNA, 15 bp, Homo sapiens
agatgtcactccctc

SEQ ID NO: 318476 - DNA, 15 bp, Homo sapiens
gatgtcactccctcc

SEQ ID NO: 318477 - DNA, 15 bp, Homo sapiens
atgtcactccctccc

SEQ ID NO: 318478 - DNA, 15 bp, Homo sapiens
tgtcactccctccct

SEQ ID NO: 318479 - DNA, 15 bp, Homo sapiens
gtcactccctccctc

SEQ ID NO: 318480 - DNA, 15 bp, Homo sapiens
tcactccctccctcc

SEQ ID NO: 318481 - DNA, 15 bp, Homo sapiens
cactccctccctcca

SEQ ID NO: 318482 - DNA, 15 bp, Homo sapiens
actccctccctccac

SEQ ID NO: 318483 - DNA, 15 bp, Homo sapiens
ctccctccctccacc

SEQ ID NO: 318484 - DNA, 15 bp, Homo sapiens
tccctccctccaccg

SEQ ID NO: 318485 - DNA, 15 bp, Homo sapiens
ccctccctccaccgc

SEQ ID NO: 318486 - DNA, 15 bp, Homo sapiens
cctccctccaccgct

SEQ ID NO: 318487 - DNA, 15 bp, Homo sapiens
ctccctccaccgctc

SEQ ID NO: 318488 - DNA, 15 bp, Homo sapiens
tccctccaccgctca

SEQ ID NO: 318489 - DNA, 15 bp, Homo sapiens
ccctccaccgctcac

SEQ ID NO: 318490 - DNA, 15 bp, Homo sapiens
cctccaccgctcact

SEQ ID NO: 318491 - DNA, 15 bp, Homo sapiens
ctccaccgctcactc

SEQ ID NO: 318492 - DNA, 15 bp, Homo sapiens
tccaccgctcactct

SEQ ID NO: 318493 - DNA, 15 bp, Homo sapiens
ccaccgctcactctc

SEQ ID NO: 318494 - DNA, 15 bp, Homo sapiens
caccgctcactctca

SEQ ID NO: 318495 - DNA, 15 bp, Homo sapiens
accgctcactctcat

SEQ ID NO: 318496 - DNA, 15 bp, Homo sapiens
ccgctcactctcatt

SEQ ID NO: 318497 - DNA, 15 bp, Homo sapiens
cgctcactctcattt

SEQ ID NO: 318498 - DNA, 15 bp, Homo sapiens
gctcactctcatttc

SEQ ID NO: 318499 - DNA, 15 bp, Homo sapiens
ctcactctcatttct

SEQ ID NO: 318500 - DNA, 15 bp, Homo sapiens
tcactctcatttctc

SEQ ID NO: 318501 - DNA, 15 bp, Homo sapiens
cactctcatttctca

SEQ ID NO: 318502 - DNA, 15 bp, Homo sapiens
actctcatttctcag

SEQ ID NO: 318503 - DNA, 15 bp, Homo sapiens
ctctcatttctcagt

SEQ ID NO: 318504 - DNA, 15 bp, Homo sapiens
tctcatttctcagtg

SEQ ID NO: 318505 - DNA, 15 bp, Homo sapiens
ctcatttctcagtga

SEQ ID NO: 318506 - DNA, 15 bp, Homo sapiens
tcatttctcagtgag

SEQ ID NO: 318507 - DNA, 15 bp, Homo sapiens
catttctcagtgagt

SEQ ID NO: 318508 - DNA, 15 bp, Homo sapiens
atttctcagtgagtt

SEQ ID NO: 318509 - DNA, 15 bp, Homo sapiens
tttctcagtgagttt

SEQ ID NO: 318510 - DNA, 15 bp, Homo sapiens
ttctcagtgagttta

SEQ ID NO: 318511 - DNA, 15 bp, Homo sapiens
tctcagtgagtttag

SEQ ID NO: 318512 - DNA, 15 bp, Homo sapiens
ctcagtgagtttagc

SEQ ID NO: 318513 - DNA, 15 bp, Homo sapiens
tcagtgagtttagct

SEQ ID NO: 318514 - DNA, 15 bp, Homo sapiens
cagtgagtttagctc

SEQ ID NO: 318515 - DNA, 15 bp, Homo sapiens
agtgagtttagctct

SEQ ID NO: 318516 - DNA, 15 bp, Homo sapiens
gtgagtttagctctg

SEQ ID NO: 318517 - DNA, 15 bp, Homo sapiens
tgagtttagctctgt

SEQ ID NO: 318518 - DNA, 15 bp, Homo sapiens
gagtttagctctgtc

SEQ ID NO: 318519 - DNA, 15 bp, Homo sapiens
agtttagctctgtca

SEQ ID NO: 318520 - DNA, 15 bp, Homo sapiens
gtttagctctgtcac

SEQ ID NO: 318521 - DNA, 15 bp, Homo sapiens
tttagctctgtcact

SEQ ID NO: 318522 - DNA, 15 bp, Homo sapiens
ttagctctgtcactc

SEQ ID NO: 318523 - DNA, 15 bp, Homo sapiens
tagctctgtcactct

SEQ ID NO: 318524 - DNA, 15 bp, Homo sapiens
agctctgtcactctc

SEQ ID NO: 318525 - DNA, 15 bp, Homo sapiens
gctctgtcactctct

SEQ ID NO: 318526 - DNA, 15 bp, Homo sapiens
ctctgtcactctctc

SEQ ID NO: 318527 - DNA, 15 bp, Homo sapiens
tctgtcactctctct

SEQ ID NO: 318528 - DNA, 15 bp, Homo sapiens
ctgtcactctctcta

SEQ ID NO: 318529 - DNA, 15 bp, Homo sapiens
tgtcactctctctaa

SEQ ID NO: 318530 - DNA, 15 bp, Homo sapiens
gtcactctctctaaa

SEQ ID NO: 318531 - DNA, 15 bp, Homo sapiens
tcactctctctaaaa

SEQ ID NO: 318532 - DNA, 15 bp, Homo sapiens
cactctctctaaaag

SEQ ID NO: 318533 - DNA, 15 bp, Homo sapiens
actctctctaaaagt

SEQ ID NO: 318534 - DNA, 15 bp, Homo sapiens
ctctctctaaaagtt

SEQ ID NO: 318535 - DNA, 15 bp, Homo sapiens
tctctctaaaagtta

SEQ ID NO: 318536 - DNA, 15 bp, Homo sapiens
ctctctaaaagttac

SEQ ID NO: 318537 - DNA, 15 bp, Homo sapiens
tctctaaaagttact

SEQ ID NO: 318538 - DNA, 15 bp, Homo sapiens
ctctaaaagttactc

SEQ ID NO: 318539 - DNA, 15 bp, Homo sapiens
tctaaaagttactct

SEQ ID NO: 318540 - DNA, 15 bp, Homo sapiens
ctaaaagttactctt

SEQ ID NO: 318541 - DNA, 15 bp, Homo sapiens
taaaagttactcttg

SEQ ID NO: 318542 - DNA, 15 bp, Homo sapiens
aaaagttactcttgt

SEQ ID NO: 318543 - DNA, 15 bp, Homo sapiens
aaagttactcttgtt

SEQ ID NO: 318544 - DNA, 15 bp, Homo sapiens
aagttactcttgttt

SEQ ID NO: 318545 - DNA, 15 bp, Homo sapiens
agttactcttgtttt

SEQ ID NO: 318546 - DNA, 15 bp, Homo sapiens
gttactcttgtttta

SEQ ID NO: 318547 - DNA, 15 bp, Homo sapiens
ttactcttgttttag

SEQ ID NO: 318548 - DNA, 15 bp, Homo sapiens
tactcttgttttagt

SEQ ID NO: 318549 - DNA, 15 bp, Homo sapiens
actcttgttttagtg

SEQ ID NO: 318550 - DNA, 15 bp, Homo sapiens
ctcttgttttagtga

SEQ ID NO: 318551 - DNA, 15 bp, Homo sapiens
tcttgttttagtgat

SEQ ID NO: 318552 - DNA, 15 bp, Homo sapiens
cttgttttagtgatt

SEQ ID NO: 318553 - DNA, 15 bp, Homo sapiens
ttgttttagtgattt

SEQ ID NO: 318554 - DNA, 15 bp, Homo sapiens
tgttttagtgatttg

SEQ ID NO: 318555 - DNA, 15 bp, Homo sapiens
gttttagtgatttgg

SEQ ID NO: 318556 - DNA, 15 bp, Homo sapiens
ttttagtgatttggg

SEQ ID NO: 318557 - DNA, 15 bp, Homo sapiens
tttagtgatttgggt

SEQ ID NO: 318558 - DNA, 15 bp, Homo sapiens
ttagtgatttgggtg

SEQ ID NO: 318559 - DNA, 15 bp, Homo sapiens
tagtgatttgggtgt

SEQ ID NO: 318560 - DNA, 15 bp, Homo sapiens
agtgatttgggtgta

SEQ ID NO: 318561 - DNA, 15 bp, Homo sapiens
gtgatttgggtgtaa

SEQ ID NO: 318562 - DNA, 15 bp, Homo sapiens
tgatttgggtgtaaa

SEQ ID NO: 318563 - DNA, 15 bp, Homo sapiens
gatttgggtgtaaac

SEQ ID NO: 318564 - DNA, 15 bp, Homo sapiens
atttgggtgtaaaca

SEQ ID NO: 318565 - DNA, 15 bp, Homo sapiens
tttgggtgtaaacat

SEQ ID NO: 318566 - DNA, 15 bp, Homo sapiens
ttgggtgtaaacatt

SEQ ID NO: 318567 - DNA, 15 bp, Homo sapiens
tgggtgtaaacattg

SEQ ID NO: 318568 - DNA, 15 bp, Homo sapiens
gggtgtaaacattga

SEQ ID NO: 318569 - DNA, 15 bp, Homo sapiens
ggtgtaaacattgat

SEQ ID NO: 318570 - DNA, 15 bp, Homo sapiens
gtgtaaacattgatg

SEQ ID NO: 318571 - DNA, 15 bp, Homo sapiens
tgtaaacattgatga

SEQ ID NO: 318572 - DNA, 15 bp, Homo sapiens
gtaaacattgatgat

SEQ ID NO: 318573 - DNA, 15 bp, Homo sapiens
taaacattgatgatc

SEQ ID NO: 318574 - DNA, 15 bp, Homo sapiens
aaacattgatgatcc

SEQ ID NO: 318575 - DNA, 15 bp, Homo sapiens
aacattgatgatcct

SEQ ID NO: 318576 - DNA, 15 bp, Homo sapiens
acattgatgatcctt

SEQ ID NO: 318577 - DNA, 15 bp, Homo sapiens
cattgatgatccttc

SEQ ID NO: 318578 - DNA, 15 bp, Homo sapiens
attgatgatccttct

SEQ ID NO: 318579 - DNA, 15 bp, Homo sapiens
ttgatgatccttcta

SEQ ID NO: 318580 - DNA, 15 bp, Homo sapiens
tgatgatccttctaa

SEQ ID NO: 318581 - DNA, 15 bp, Homo sapiens
gatgatccttctaat

SEQ ID NO: 318582 - DNA, 15 bp, Homo sapiens
atgatccttctaata

SEQ ID NO: 318583 - DNA, 15 bp, Homo sapiens
tgatccttctaatac

SEQ ID NO: 318584 - DNA, 15 bp, Homo sapiens
gatccttctaatact

SEQ ID NO: 318585 - DNA, 15 bp, Homo sapiens
atccttctaatactc

SEQ ID NO: 318586 - DNA, 15 bp, Homo sapiens
tccttctaatactct

SEQ ID NO: 318587 - DNA, 15 bp, Homo sapiens
ccttctaatactctg

SEQ ID NO: 318588 - DNA, 15 bp, Homo sapiens
cttctaatactctgt

SEQ ID NO: 318589 - DNA, 15 bp, Homo sapiens
ttctaatactctgtc

SEQ ID NO: 318590 - DNA, 15 bp, Homo sapiens
tctaatactctgtcc

SEQ ID NO: 318591 - DNA, 15 bp, Homo sapiens
ctaatactctgtcct

SEQ ID NO: 318592 - DNA, 15 bp, Homo sapiens
taatactctgtcctc

SEQ ID NO: 318593 - DNA, 15 bp, Homo sapiens
aatactctgtcctct

SEQ ID NO: 318594 - DNA, 15 bp, Homo sapiens
atactctgtcctctt

SEQ ID NO: 318595 - DNA, 15 bp, Homo sapiens
tactctgtcctctta

SEQ ID NO: 318596 - DNA, 15 bp, Homo sapiens
actctgtcctcttaa

SEQ ID NO: 318597 - DNA, 15 bp, Homo sapiens
ctctgtcctcttaat

SEQ ID NO: 318598 - DNA, 15 bp, Homo sapiens
tctgtcctcttaatt

SEQ ID NO: 318599 - DNA, 15 bp, Homo sapiens
ctgtcctcttaattt

SEQ ID NO: 318600 - DNA, 15 bp, Homo sapiens
tgtcctcttaatttc

SEQ ID NO: 318601 - DNA, 15 bp, Homo sapiens
gtcctcttaatttct

SEQ ID NO: 318602 - DNA, 15 bp, Homo sapiens
tcctcttaatttctc

SEQ ID NO: 318603 - DNA, 15 bp, Homo sapiens
cctcttaatttctct

SEQ ID NO: 318604 - DNA, 15 bp, Homo sapiens
ctcttaatttctcta

SEQ ID NO: 318605 - DNA, 15 bp, Homo sapiens
tcttaatttctctaa

SEQ ID NO: 318606 - DNA, 15 bp, Homo sapiens
cttaatttctctaag

SEQ ID NO: 318607 - DNA, 15 bp, Homo sapiens
ttaatttctctaagt

SEQ ID NO: 318608 - DNA, 15 bp, Homo sapiens
taatttctctaagtt

SEQ ID NO: 318609 - DNA, 15 bp, Homo sapiens
aatttctctaagttc

SEQ ID NO: 318610 - DNA, 15 bp, Homo sapiens
atttctctaagttct

SEQ ID NO: 318611 - DNA, 15 bp, Homo sapiens
tttctctaagttctc

SEQ ID NO: 318612 - DNA, 15 bp, Homo sapiens
ttctctaagttctct

SEQ ID NO: 318613 - DNA, 15 bp, Homo sapiens
tctctaagttctctt

SEQ ID NO: 318614 - DNA, 15 bp, Homo sapiens
ctctaagttctcttt

SEQ ID NO: 318615 - DNA, 15 bp, Homo sapiens
tctaagttctctttc

SEQ ID NO: 318616 - DNA, 15 bp, Homo sapiens
ctaagttctctttct

SEQ ID NO: 318617 - DNA, 15 bp, Homo sapiens
taagttctctttcta

SEQ ID NO: 318618 - DNA, 15 bp, Homo sapiens
aagttctctttctag

SEQ ID NO: 318619 - DNA, 15 bp, Homo sapiens
agttctctttctagt

SEQ ID NO: 318620 - DNA, 15 bp, Homo sapiens
gttctctttctagtg

SEQ ID NO: 318621 - DNA, 15 bp, Homo sapiens
ttctctttctagtga

SEQ ID NO: 318622 - DNA, 15 bp, Homo sapiens
tctctttctagtgat

SEQ ID NO: 318623 - DNA, 15 bp, Homo sapiens
ctctttctagtgatc

SEQ ID NO: 318624 - DNA, 15 bp, Homo sapiens
tctttctagtgatct

SEQ ID NO: 318625 - DNA, 15 bp, Homo sapiens
ctttctagtgatctt

SEQ ID NO: 318626 - DNA, 15 bp, Homo sapiens
tttctagtgatcttg

SEQ ID NO: 318627 - DNA, 15 bp, Homo sapiens
ttctagtgatcttgt

SEQ ID NO: 318628 - DNA, 15 bp, Homo sapiens
tctagtgatcttgtc

SEQ ID NO: 318629 - DNA, 15 bp, Homo sapiens
ctagtgatcttgtct

SEQ ID NO: 318630 - DNA, 15 bp, Homo sapiens
tagtgatcttgtctc

SEQ ID NO: 318631 - DNA, 15 bp, Homo sapiens
agtgatcttgtctcc

SEQ ID NO: 318632 - DNA, 15 bp, Homo sapiens
gtgatcttgtctccc

SEQ ID NO: 318633 - DNA, 15 bp, Homo sapiens
tgatcttgtctccca

SEQ ID NO: 318634 - DNA, 15 bp, Homo sapiens
gatcttgtctcccag

SEQ ID NO: 318635 - DNA, 15 bp, Homo sapiens
atcttgtctcccagt

SEQ ID NO: 318636 - DNA, 15 bp, Homo sapiens
tcttgtctcccagtg

SEQ ID NO: 318637 - DNA, 15 bp, Homo sapiens
cttgtctcccagtgt

SEQ ID NO: 318638 - DNA, 15 bp, Homo sapiens
ttgtctcccagtgtg

SEQ ID NO: 318639 - DNA, 15 bp, Homo sapiens
tgtctcccagtgtgg

SEQ ID NO: 318640 - DNA, 15 bp, Homo sapiens
gtctcccagtgtggt

SEQ ID NO: 318641 - DNA, 15 bp, Homo sapiens
tctcccagtgtggtg

SEQ ID NO: 318642 - DNA, 15 bp, Homo sapiens
ctcccagtgtggtgg

SEQ ID NO: 318643 - DNA, 15 bp, Homo sapiens
tcccagtgtggtggg

SEQ ID NO: 318644 - DNA, 15 bp, Homo sapiens
cccagtgtggtgggt

SEQ ID NO: 318645 - DNA, 15 bp, Homo sapiens
ccagtgtggtgggta

SEQ ID NO: 318646 - DNA, 15 bp, Homo sapiens
cagtgtggtgggtat

SEQ ID NO: 318647 - DNA, 15 bp, Homo sapiens
agtgtggtgggtata

SEQ ID NO: 318648 - DNA, 15 bp, Homo sapiens
gtgtggtgggtatat

SEQ ID NO: 318649 - DNA, 15 bp, Homo sapiens
tgtggtgggtatatt

SEQ ID NO: 318650 - DNA, 15 bp, Homo sapiens
gtggtgggtatattc

SEQ ID NO: 318651 - DNA, 15 bp, Homo sapiens
tggtgggtatattct

SEQ ID NO: 318652 - DNA, 15 bp, Homo sapiens
ggtgggtatattctg

SEQ ID NO: 318653 - DNA, 15 bp, Homo sapiens
gtgggtatattctgg

SEQ ID NO: 318654 - DNA, 15 bp, Homo sapiens
tgggtatattctggc

SEQ ID NO: 318655 - DNA, 15 bp, Homo sapiens
gggtatattctggct

SEQ ID NO: 318656 - DNA, 15 bp, Homo sapiens
ggtatattctggcta

SEQ ID NO: 318657 - DNA, 15 bp, Homo sapiens
gtatattctggctag

SEQ ID NO: 318658 - DNA, 15 bp, Homo sapiens
tatattctggctaga

SEQ ID NO: 318659 - DNA, 15 bp, Homo sapiens
atattctggctagac

SEQ ID NO: 318660 - DNA, 15 bp, Homo sapiens
tattctggctagacc

SEQ ID NO: 318661 - DNA, 15 bp, Homo sapiens
attctggctagacca

SEQ ID NO: 318662 - DNA, 15 bp, Homo sapiens
ttctggctagaccag

SEQ ID NO: 318663 - DNA, 15 bp, Homo sapiens
tctggctagaccagg

SEQ ID NO: 318664 - DNA, 15 bp, Homo sapiens
ctggctagaccaggt

SEQ ID NO: 318665 - DNA, 15 bp, Homo sapiens
tggctagaccaggtc

SEQ ID NO: 318666 - DNA, 15 bp, Homo sapiens
ggctagaccaggtca

SEQ ID NO: 318667 - DNA, 15 bp, Homo sapiens
gctagaccaggtcat

SEQ ID NO: 318668 - DNA, 15 bp, Homo sapiens
ctagaccaggtcatt

SEQ ID NO: 318669 - DNA, 15 bp, Homo sapiens
tagaccaggtcattg

SEQ ID NO: 318670 - DNA, 15 bp, Homo sapiens
agaccaggtcattgt

SEQ ID NO: 318671 - DNA, 15 bp, Homo sapiens
gaccaggtcattgtt

SEQ ID NO: 318672 - DNA, 15 bp, Homo sapiens
accaggtcattgttt

SEQ ID NO: 318673 - DNA, 15 bp, Homo sapiens
ccaggtcattgttta

SEQ ID NO: 318674 - DNA, 15 bp, Homo sapiens
caggtcattgtttat

SEQ ID NO: 318675 - DNA, 15 bp, Homo sapiens
aggtcattgtttatg

SEQ ID NO: 318676 - DNA, 15 bp, Homo sapiens
ggtcattgtttatgg

SEQ ID NO: 318677 - DNA, 15 bp, Homo sapiens
gtcattgtttatggt

SEQ ID NO: 318678 - DNA, 15 bp, Homo sapiens
tcattgtttatggtg

SEQ ID NO: 318679 - DNA, 15 bp, Homo sapiens
cattgtttatggtgg

SEQ ID NO: 318680 - DNA, 15 bp, Homo sapiens
attgtttatggtggc

SEQ ID NO: 318681 - DNA, 15 bp, Homo sapiens
ttgtttatggtggca

SEQ ID NO: 318682 - DNA, 15 bp, Homo sapiens
tgtttatggtggcag

SEQ ID NO: 318683 - DNA, 15 bp, Homo sapiens
gtttatggtggcagc

SEQ ID NO: 318684 - DNA, 15 bp, Homo sapiens
tttatggtggcagcc

SEQ ID NO: 318685 - DNA, 15 bp, Homo sapiens
ttatggtggcagccc

SEQ ID NO: 318686 - DNA, 15 bp, Homo sapiens
tatggtggcagcccc

SEQ ID NO: 318687 - DNA, 15 bp, Homo sapiens
atggtggcagcccct

SEQ ID NO: 318688 - DNA, 15 bp, Homo sapiens
tggtggcagcccctc

SEQ ID NO: 318689 - DNA, 15 bp, Homo sapiens
ggtggcagcccctct

SEQ ID NO: 318690 - DNA, 15 bp, Homo sapiens
gtggcagcccctctg

SEQ ID NO: 318691 - DNA, 15 bp, Homo sapiens
tggcagcccctctgt

SEQ ID NO: 318692 - DNA, 15 bp, Homo sapiens
ggcagcccctctgtc

SEQ ID NO: 318693 - DNA, 15 bp, Homo sapiens
gcagcccctctgtca

SEQ ID NO: 318694 - DNA, 15 bp, Homo sapiens
cagcccctctgtcat

SEQ ID NO: 318695 - DNA, 15 bp, Homo sapiens
agcccctctgtcatc

SEQ ID NO: 318696 - DNA, 15 bp, Homo sapiens
gcccctctgtcatct

SEQ ID NO: 318697 - DNA, 15 bp, Homo sapiens
cccctctgtcatctg

SEQ ID NO: 318698 - DNA, 15 bp, Homo sapiens
ccctctgtcatctga

SEQ ID NO: 318699 - DNA, 15 bp, Homo sapiens
cctctgtcatctgaa

SEQ ID NO: 318700 - DNA, 15 bp, Homo sapiens
ctctgtcatctgaat

SEQ ID NO: 318701 - DNA, 15 bp, Homo sapiens
tctgtcatctgaatt

SEQ ID NO: 318702 - DNA, 15 bp, Homo sapiens
ctgtcatctgaattt

SEQ ID NO: 318703 - DNA, 15 bp, Homo sapiens
tgtcatctgaattta

SEQ ID NO: 318704 - DNA, 15 bp, Homo sapiens
gtcatctgaatttaa

SEQ ID NO: 318705 - DNA, 15 bp, Homo sapiens
tcatctgaatttaag

SEQ ID NO: 318706 - DNA, 15 bp, Homo sapiens
catctgaatttaagc

SEQ ID NO: 318707 - DNA, 15 bp, Homo sapiens
atctgaatttaagcg

SEQ ID NO: 318708 - DNA, 15 bp, Homo sapiens
tctgaatttaagcgt

SEQ ID NO: 318709 - DNA, 15 bp, Homo sapiens
ctgaatttaagcgtc

SEQ ID NO: 318710 - DNA, 15 bp, Homo sapiens
tgaatttaagcgtcc

SEQ ID NO: 318711 - DNA, 15 bp, Homo sapiens
gaatttaagcgtccc

SEQ ID NO: 318712 - DNA, 15 bp, Homo sapiens
aatttaagcgtccca

SEQ ID NO: 318713 - DNA, 15 bp, Homo sapiens
atttaagcgtcccat

SEQ ID NO: 318714 - DNA, 15 bp, Homo sapiens
tttaagcgtcccatt

SEQ ID NO: 318715 - DNA, 15 bp, Homo sapiens
ttaagcgtcccattt

SEQ ID NO: 318716 - DNA, 15 bp, Homo sapiens
taagcgtcccatttt

SEQ ID NO: 318717 - DNA, 15 bp, Homo sapiens
aagcgtcccattttt

SEQ ID NO: 318718 - DNA, 15 bp, Homo sapiens
agcgtcccatttttt

SEQ ID NO: 318719 - DNA, 15 bp, Homo sapiens
gcgtcccattttttc

SEQ ID NO: 318720 - DNA, 15 bp, Homo sapiens
cgtcccattttttcg

SEQ ID NO: 318721 - DNA, 15 bp, Homo sapiens
gtcccattttttcgg

SEQ ID NO: 318722 - DNA, 15 bp, Homo sapiens
tcccattttttcggt

SEQ ID NO: 318723 - DNA, 15 bp, Homo sapiens
cccattttttcggta

SEQ ID NO: 318724 - DNA, 15 bp, Homo sapiens
ccattttttcggtac

SEQ ID NO: 318725 - DNA, 15 bp, Homo sapiens
cattttttcggtact

SEQ ID NO: 318726 - DNA, 15 bp, Homo sapiens
attttttcggtacta

SEQ ID NO: 318727 - DNA, 15 bp, Homo sapiens
ttttttcggtactag

SEQ ID NO: 318728 - DNA, 15 bp, Homo sapiens
tttttcggtactagc

SEQ ID NO: 318729 - DNA, 15 bp, Homo sapiens
ttttcggtactagca

SEQ ID NO: 318730 - DNA, 15 bp, Homo sapiens
tttcggtactagcat

SEQ ID NO: 318731 - DNA, 15 bp, Homo sapiens
ttcggtactagcatg

SEQ ID NO: 318732 - DNA, 15 bp, Homo sapiens
tcggtactagcatgg

SEQ ID NO: 318733 - DNA, 15 bp, Homo sapiens
cggtactagcatggc

SEQ ID NO: 318734 - DNA, 15 bp, Homo sapiens
ggtactagcatggct

SEQ ID NO: 318735 - DNA, 15 bp, Homo sapiens
gtactagcatggctc

SEQ ID NO: 318736 - DNA, 15 bp, Homo sapiens
tactagcatggctca

SEQ ID NO: 318737 - DNA, 15 bp, Homo sapiens
actagcatggctcac

SEQ ID NO: 318738 - DNA, 15 bp, Homo sapiens
ctagcatggctcact

SEQ ID NO: 318739 - DNA, 15 bp, Homo sapiens
tagcatggctcactg

SEQ ID NO: 318740 - DNA, 15 bp, Homo sapiens
agcatggctcactgc

SEQ ID NO: 318741 - DNA, 15 bp, Homo sapiens
gcatggctcactgca

SEQ ID NO: 318742 - DNA, 15 bp, Homo sapiens
catggctcactgcaa

SEQ ID NO: 318743 - DNA, 15 bp, Homo sapiens
atggctcactgcaac

SEQ ID NO: 318744 - DNA, 15 bp, Homo sapiens
tggctcactgcaacc

SEQ ID NO: 318745 - DNA, 15 bp, Homo sapiens
ggctcactgcaacct

SEQ ID NO: 318746 - DNA, 15 bp, Homo sapiens
ctcactgcaacctcc

SEQ ID NO: 318747 - DNA, 15 bp, Homo sapiens
tcactgcaacctccg

SEQ ID NO: 318748 - DNA, 15 bp, Homo sapiens
cactgcaacctccgc

SEQ ID NO: 318749 - DNA, 15 bp, Homo sapiens
actgcaacctccgcc

SEQ ID NO: 318750 - DNA, 15 bp, Homo sapiens
ctgcaacctccgcct

SEQ ID NO: 318751 - DNA, 15 bp, Homo sapiens
tgcaacctccgcctc

SEQ ID NO: 318752 - DNA, 15 bp, Homo sapiens
gcaacctccgcctcc

SEQ ID NO: 318753 - DNA, 15 bp, Homo sapiens
caacctccgcctcct

SEQ ID NO: 318754 - DNA, 15 bp, Homo sapiens
aacctccgcctcctg

SEQ ID NO: 318755 - DNA, 15 bp, Homo sapiens
acctccgcctcctgg

SEQ ID NO: 318756 - DNA, 15 bp, Homo sapiens
cctccgcctcctggg

SEQ ID NO: 318757 - DNA, 15 bp, Homo sapiens
ctccgcctcctgggc

SEQ ID NO: 318758 - DNA, 15 bp, Homo sapiens
tccgcctcctgggct

SEQ ID NO: 318759 - DNA, 15 bp, Homo sapiens
ccgcctcctgggctc

SEQ ID NO: 318760 - DNA, 15 bp, Homo sapiens
cgcctcctgggctcc

SEQ ID NO: 318761 - DNA, 15 bp, Homo sapiens
gcctcctgggctcca

SEQ ID NO: 318762 - DNA, 15 bp, Homo sapiens
cctcctgggctccag

SEQ ID NO: 318763 - DNA, 15 bp, Homo sapiens
ctcctgggctccagc

SEQ ID NO: 318764 - DNA, 15 bp, Homo sapiens
tcctgggctccagca

SEQ ID NO: 318765 - DNA, 15 bp, Homo sapiens
cctgggctccagcaa

SEQ ID NO: 318766 - DNA, 15 bp, Homo sapiens
ctgggctccagcaat

SEQ ID NO: 318767 - DNA, 15 bp, Homo sapiens
tgggctccagcaatc

SEQ ID NO: 318768 - DNA, 15 bp, Homo sapiens
gggctccagcaatcc

SEQ ID NO: 318769 - DNA, 15 bp, Homo sapiens
ggctccagcaatcct

SEQ ID NO: 318770 - DNA, 15 bp, Homo sapiens
gctccagcaatcctc

SEQ ID NO: 318771 - DNA, 15 bp, Homo sapiens
ctccagcaatcctcc

SEQ ID NO: 318772 - DNA, 15 bp, Homo sapiens
tccagcaatcctccc

SEQ ID NO: 318773 - DNA, 15 bp, Homo sapiens
ccagcaatcctccca

SEQ ID NO: 318774 - DNA, 15 bp, Homo sapiens
cagcaatcctcccac

SEQ ID NO: 318775 - DNA, 15 bp, Homo sapiens
agcaatcctcccacc

SEQ ID NO: 318776 - DNA, 15 bp, Homo sapiens
gcaatcctcccaccc

SEQ ID NO: 318777 - DNA, 15 bp, Homo sapiens
caatcctcccaccct

SEQ ID NO: 318778 - DNA, 15 bp, Homo sapiens
aatcctcccaccctc

SEQ ID NO: 318779 - DNA, 15 bp, Homo sapiens
atcctcccaccctcg

SEQ ID NO: 318780 - DNA, 15 bp, Homo sapiens
tcctcccaccctcgg

SEQ ID NO: 318781 - DNA, 15 bp, Homo sapiens
cctcccaccctcggg

SEQ ID NO: 318782 - DNA, 15 bp, Homo sapiens
ctcccaccctcgggt

SEQ ID NO: 318783 - DNA, 15 bp, Homo sapiens
tcccaccctcgggta

SEQ ID NO: 318784 - DNA, 15 bp, Homo sapiens
cccaccctcgggtag

SEQ ID NO: 318785 - DNA, 15 bp, Homo sapiens
ccaccctcgggtagc

SEQ ID NO: 318786 - DNA, 15 bp, Homo sapiens
caccctcgggtagct

SEQ ID NO: 318787 - DNA, 15 bp, Homo sapiens
accctcgggtagctg

SEQ ID NO: 318788 - DNA, 15 bp, Homo sapiens
ccctcgggtagctgg

SEQ ID NO: 318789 - DNA, 15 bp, Homo sapiens
cctcgggtagctggg

SEQ ID NO: 318790 - DNA, 15 bp, Homo sapiens
ctcgggtagctgggg

SEQ ID NO: 318791 - DNA, 15 bp, Homo sapiens
tcgggtagctggggc

SEQ ID NO: 318792 - DNA, 15 bp, Homo sapiens
cgggtagctggggct

SEQ ID NO: 318793 - DNA, 15 bp, Homo sapiens
gggtagctggggcta

SEQ ID NO: 318794 - DNA, 15 bp, Homo sapiens
ggtagctggggctat

SEQ ID NO: 318795 - DNA, 15 bp, Homo sapiens
gtagctggggctata

SEQ ID NO: 318796 - DNA, 15 bp, Homo sapiens
tagctggggctatag

SEQ ID NO: 318797 - DNA, 15 bp, Homo sapiens
agctggggctatagg

SEQ ID NO: 318798 - DNA, 15 bp, Homo sapiens
gctggggctataggc

SEQ ID NO: 318799 - DNA, 15 bp, Homo sapiens
ctggggctataggca

SEQ ID NO: 318800 - DNA, 15 bp, Homo sapiens
tggggctataggcat

SEQ ID NO: 318801 - DNA, 15 bp, Homo sapiens
ggggctataggcatg

SEQ ID NO: 318802 - DNA, 15 bp, Homo sapiens
gggctataggcatgt

SEQ ID NO: 318803 - DNA, 15 bp, Homo sapiens
ggctataggcatgtg

SEQ ID NO: 318804 - DNA, 15 bp, Homo sapiens
gctataggcatgtgc

SEQ ID NO: 318805 - DNA, 15 bp, Homo sapiens
ctataggcatgtgcc

SEQ ID NO: 318806 - DNA, 15 bp, Homo sapiens
tgtgccaccacgcct

SEQ ID NO: 318807 - DNA, 15 bp, Homo sapiens
caccacgcctggcta

SEQ ID NO: 318808 - DNA, 15 bp, Homo sapiens
accacgcctggctaa

SEQ ID NO: 318809 - DNA, 15 bp, Homo sapiens
ccacgcctggctaat

SEQ ID NO: 318810 - DNA, 15 bp, Homo sapiens
cacgcctggctaatt

SEQ ID NO: 318811 - DNA, 15 bp, Homo sapiens
acgcctggctaattt

SEQ ID NO: 318812 - DNA, 15 bp, Homo sapiens
cgcctggctaatttt

SEQ ID NO: 318813 - DNA, 15 bp, Homo sapiens
ttgtatttttttttg

SEQ ID NO: 318814 - DNA, 15 bp, Homo sapiens
tgtatttttttttgt

SEQ ID NO: 318815 - DNA, 15 bp, Homo sapiens
gtatttttttttgta

SEQ ID NO: 318816 - DNA, 15 bp, Homo sapiens
tatttttttttgtag

SEQ ID NO: 318817 - DNA, 15 bp, Homo sapiens
atttttttttgtaga

SEQ ID NO: 318818 - DNA, 15 bp, Homo sapiens
tttttttttgtagat

SEQ ID NO: 318819 - DNA, 15 bp, Homo sapiens
ttttttttgtagata

SEQ ID NO: 318820 - DNA, 15 bp, Homo sapiens
tttttttgtagataa

SEQ ID NO: 318821 - DNA, 15 bp, Homo sapiens
ttttttgtagataag

SEQ ID NO: 318822 - DNA, 15 bp, Homo sapiens
tttttgtagataaga

SEQ ID NO: 318823 - DNA, 15 bp, Homo sapiens
ttttgtagataagag

SEQ ID NO: 318824 - DNA, 15 bp, Homo sapiens
tttgtagataagagg

SEQ ID NO: 318825 - DNA, 15 bp, Homo sapiens
ttgtagataagaggt

SEQ ID NO: 318826 - DNA, 15 bp, Homo sapiens
tgtagataagaggtt

SEQ ID NO: 318827 - DNA, 15 bp, Homo sapiens
gtagataagaggttt

SEQ ID NO: 318828 - DNA, 15 bp, Homo sapiens
tagataagaggtttc

SEQ ID NO: 318829 - DNA, 15 bp, Homo sapiens
agataagaggtttca

SEQ ID NO: 318830 - DNA, 15 bp, Homo sapiens
gataagaggtttcac

SEQ ID NO: 318831 - DNA, 15 bp, Homo sapiens
ataagaggtttcacc

SEQ ID NO: 318832 - DNA, 15 bp, Homo sapiens
taagaggtttcacca

SEQ ID NO: 318833 - DNA, 15 bp, Homo sapiens
aagaggtttcaccat

SEQ ID NO: 318834 - DNA, 15 bp, Homo sapiens
agaggtttcaccatg

SEQ ID NO: 318835 - DNA, 15 bp, Homo sapiens
gaggtttcaccatgt

SEQ ID NO: 318836 - DNA, 15 bp, Homo sapiens
aggtttcaccatgtt

SEQ ID NO: 318837 - DNA, 15 bp, Homo sapiens
gtttcaccatgttgc

SEQ ID NO: 318838 - DNA, 15 bp, Homo sapiens
tttcaccatgttgcc

SEQ ID NO: 318839 - DNA, 15 bp, Homo sapiens
ttcaccatgttgccc

SEQ ID NO: 318840 - DNA, 15 bp, Homo sapiens
tcaccatgttgccca

SEQ ID NO: 318841 - DNA, 15 bp, Homo sapiens
caccatgttgcccag

SEQ ID NO: 318842 - DNA, 15 bp, Homo sapiens
accatgttgcccagg

SEQ ID NO: 318843 - DNA, 15 bp, Homo sapiens
ccatgttgcccaggc

SEQ ID NO: 318844 - DNA, 15 bp, Homo sapiens
catgttgcccaggct

SEQ ID NO: 318845 - DNA, 15 bp, Homo sapiens
atgttgcccaggctg

SEQ ID NO: 318846 - DNA, 15 bp, Homo sapiens
gttgcccaggctggt

SEQ ID NO: 318847 - DNA, 15 bp, Homo sapiens
ttgcccaggctggtc

SEQ ID NO: 318848 - DNA, 15 bp, Homo sapiens
ctggtctcaaactcc

SEQ ID NO: 318849 - DNA, 15 bp, Homo sapiens
tggtctcaaactcct

SEQ ID NO: 318850 - DNA, 15 bp, Homo sapiens
ggtctcaaactcctg

SEQ ID NO: 318851 - DNA, 15 bp, Homo sapiens
ggctcaagcaatcca

SEQ ID NO: 318852 - DNA, 15 bp, Homo sapiens
gctcaagcaatccat

SEQ ID NO: 318853 - DNA, 15 bp, Homo sapiens
ctcaagcaatccatc

SEQ ID NO: 318854 - DNA, 15 bp, Homo sapiens
tcaagcaatccatcc

SEQ ID NO: 318855 - DNA, 15 bp, Homo sapiens
caagcaatccatcca

SEQ ID NO: 318856 - DNA, 15 bp, Homo sapiens
aagcaatccatccac

SEQ ID NO: 318857 - DNA, 15 bp, Homo sapiens
agcaatccatccacc

SEQ ID NO: 318858 - DNA, 15 bp, Homo sapiens
gcaatccatccacct

SEQ ID NO: 318859 - DNA, 15 bp, Homo sapiens
caatccatccacctc

SEQ ID NO: 318860 - DNA, 15 bp, Homo sapiens
aatccatccacctca

SEQ ID NO: 318861 - DNA, 15 bp, Homo sapiens
atccatccacctcag

SEQ ID NO: 318862 - DNA, 15 bp, Homo sapiens
tccatccacctcagc

SEQ ID NO: 318863 - DNA, 15 bp, Homo sapiens
ccatccacctcagcc

SEQ ID NO: 318864 - DNA, 15 bp, Homo sapiens
catccacctcagcct

SEQ ID NO: 318865 - DNA, 15 bp, Homo sapiens
atccacctcagcctc

SEQ ID NO: 318866 - DNA, 15 bp, Homo sapiens
tccacctcagcctcc

SEQ ID NO: 318867 - DNA, 15 bp, Homo sapiens
ccacctcagcctccc

SEQ ID NO: 318868 - DNA, 15 bp, Homo sapiens
cacctcagcctcccg

SEQ ID NO: 318869 - DNA, 15 bp, Homo sapiens
acctcagcctcccga

SEQ ID NO: 318870 - DNA, 15 bp, Homo sapiens
cctcagcctcccgaa

SEQ ID NO: 318871 - DNA, 15 bp, Homo sapiens
ctcagcctcccgaag

SEQ ID NO: 318872 - DNA, 15 bp, Homo sapiens
tcagcctcccgaagt

SEQ ID NO: 318873 - DNA, 15 bp, Homo sapiens
cagcctcccgaagtg

SEQ ID NO: 318874 - DNA, 15 bp, Homo sapiens
agcctcccgaagtgt

SEQ ID NO: 318875 - DNA, 15 bp, Homo sapiens
gcctcccgaagtgtt

SEQ ID NO: 318876 - DNA, 15 bp, Homo sapiens
cctcccgaagtgttg

SEQ ID NO: 318877 - DNA, 15 bp, Homo sapiens
ctcccgaagtgttgg

SEQ ID NO: 318878 - DNA, 15 bp, Homo sapiens
tcccgaagtgttggg

SEQ ID NO: 318879 - DNA, 15 bp, Homo sapiens
cccgaagtgttggga

SEQ ID NO: 318880 - DNA, 15 bp, Homo sapiens
ccgaagtgttgggat

SEQ ID NO: 318881 - DNA, 15 bp, Homo sapiens
cgaagtgttgggatt

SEQ ID NO: 318882 - DNA, 15 bp, Homo sapiens
gaagtgttgggatta

SEQ ID NO: 318883 - DNA, 15 bp, Homo sapiens
aagtgttgggattac

SEQ ID NO: 318884 - DNA, 15 bp, Homo sapiens
agtgttgggattaca

SEQ ID NO: 318885 - DNA, 15 bp, Homo sapiens
gtgttgggattacag

SEQ ID NO: 318886 - DNA, 15 bp, Homo sapiens
tgttgggattacagg

SEQ ID NO: 318887 - DNA, 15 bp, Homo sapiens
gttgggattacaggt

SEQ ID NO: 318888 - DNA, 15 bp, Homo sapiens
ttgggattacaggtg

SEQ ID NO: 318889 - DNA, 15 bp, Homo sapiens
aggtgtgagccacca

SEQ ID NO: 318890 - DNA, 15 bp, Homo sapiens
ggtgtgagccaccat

SEQ ID NO: 318891 - DNA, 15 bp, Homo sapiens
gtgtgagccaccatg

SEQ ID NO: 318892 - DNA, 15 bp, Homo sapiens
tgtgagccaccatgc

SEQ ID NO: 318893 - DNA, 15 bp, Homo sapiens
gtgagccaccatgcc

SEQ ID NO: 318894 - DNA, 15 bp, Homo sapiens
tgagccaccatgccc

SEQ ID NO: 318895 - DNA, 15 bp, Homo sapiens
gagccaccatgcccg

SEQ ID NO: 318896 - DNA, 15 bp, Homo sapiens
agccaccatgcccgg

SEQ ID NO: 318897 - DNA, 15 bp, Homo sapiens
gccaccatgcccggc

SEQ ID NO: 318898 - DNA, 15 bp, Homo sapiens
ccaccatgcccggct

SEQ ID NO: 318899 - DNA, 15 bp, Homo sapiens
caccatgcccggctg

SEQ ID NO: 318900 - DNA, 15 bp, Homo sapiens
accatgcccggctga

SEQ ID NO: 318901 - DNA, 15 bp, Homo sapiens
ccatgcccggctgac

SEQ ID NO: 318902 - DNA, 15 bp, Homo sapiens
catgcccggctgact

SEQ ID NO: 318903 - DNA, 15 bp, Homo sapiens
atgcccggctgactt

SEQ ID NO: 318904 - DNA, 15 bp, Homo sapiens
tgcccggctgacttt

SEQ ID NO: 318905 - DNA, 15 bp, Homo sapiens
gcccggctgactttg

SEQ ID NO: 318906 - DNA, 15 bp, Homo sapiens
cccggctgactttgc

SEQ ID NO: 318907 - DNA, 15 bp, Homo sapiens
ccggctgactttgcc

SEQ ID NO: 318908 - DNA, 15 bp, Homo sapiens
cggctgactttgcct

SEQ ID NO: 318909 - DNA, 15 bp, Homo sapiens
ggctgactttgccta

SEQ ID NO: 318910 - DNA, 15 bp, Homo sapiens
gctgactttgcctac

SEQ ID NO: 318911 - DNA, 15 bp, Homo sapiens
ctgactttgcctact

SEQ ID NO: 318912 - DNA, 15 bp, Homo sapiens
tgactttgcctactc

SEQ ID NO: 318913 - DNA, 15 bp, Homo sapiens
gactttgcctactct

SEQ ID NO: 318914 - DNA, 15 bp, Homo sapiens
actttgcctactctt

SEQ ID NO: 318915 - DNA, 15 bp, Homo sapiens
ctttgcctactcttg

SEQ ID NO: 318916 - DNA, 15 bp, Homo sapiens
tttgcctactcttgc

SEQ ID NO: 318917 - DNA, 15 bp, Homo sapiens
ttgcctactcttgcc

SEQ ID NO: 318918 - DNA, 15 bp, Homo sapiens
tgcctactcttgccc

SEQ ID NO: 318919 - DNA, 15 bp, Homo sapiens
gcctactcttgccct

SEQ ID NO: 318920 - DNA, 15 bp, Homo sapiens
cctactcttgcccta

SEQ ID NO: 318921 - DNA, 15 bp, Homo sapiens
ctactcttgccctaa

SEQ ID NO: 318922 - DNA, 15 bp, Homo sapiens
tactcttgccctaag

SEQ ID NO: 318923 - DNA, 15 bp, Homo sapiens
actcttgccctaaga

SEQ ID NO: 318924 - DNA, 15 bp, Homo sapiens
ctcttgccctaagaa

SEQ ID NO: 318925 - DNA, 15 bp, Homo sapiens
tcttgccctaagaaa

SEQ ID NO: 318926 - DNA, 15 bp, Homo sapiens
cttgccctaagaaaa

SEQ ID NO: 318927 - DNA, 15 bp, Homo sapiens
ttgccctaagaaaat

SEQ ID NO: 318928 - DNA, 15 bp, Homo sapiens
tgccctaagaaaatt

SEQ ID NO: 318929 - DNA, 15 bp, Homo sapiens
gccctaagaaaattg

SEQ ID NO: 318930 - DNA, 15 bp, Homo sapiens
ccctaagaaaattga

SEQ ID NO: 318931 - DNA, 15 bp, Homo sapiens
cctaagaaaattgaa

SEQ ID NO: 318932 - DNA, 15 bp, Homo sapiens
ctaagaaaattgaag

SEQ ID NO: 318933 - DNA, 15 bp, Homo sapiens
taagaaaattgaagc

SEQ ID NO: 318934 - DNA, 15 bp, Homo sapiens
aagaaaattgaagca

SEQ ID NO: 318935 - DNA, 15 bp, Homo sapiens
agaaaattgaagcaa

SEQ ID NO: 318936 - DNA, 15 bp, Homo sapiens
gaaaattgaagcaaa

SEQ ID NO: 318937 - DNA, 15 bp, Homo sapiens
aaaattgaagcaaac

SEQ ID NO: 318938 - DNA, 15 bp, Homo sapiens
aaattgaagcaaacc

SEQ ID NO: 318939 - DNA, 15 bp, Homo sapiens
aattgaagcaaacca

SEQ ID NO: 318940 - DNA, 15 bp, Homo sapiens
attgaagcaaaccaa

SEQ ID NO: 318941 - DNA, 15 bp, Homo sapiens
ttgaagcaaaccaaa

SEQ ID NO: 318942 - DNA, 15 bp, Homo sapiens
tgaagcaaaccaaag

SEQ ID NO: 318943 - DNA, 15 bp, Homo sapiens
gaagcaaaccaaaga

SEQ ID NO: 318944 - DNA, 15 bp, Homo sapiens
aagcaaaccaaagag

SEQ ID NO: 318945 - DNA, 15 bp, Homo sapiens
agcaaaccaaagagg

SEQ ID NO: 318946 - DNA, 15 bp, Homo sapiens
gcaaaccaaagagga

SEQ ID NO: 318947 - DNA, 15 bp, Homo sapiens
caaaccaaagaggaa

SEQ ID NO: 318948 - DNA, 15 bp, Homo sapiens
aaaccaaagaggaat

SEQ ID NO: 318949 - DNA, 15 bp, Homo sapiens
aaccaaagaggaatc

SEQ ID NO: 318950 - DNA, 15 bp, Homo sapiens
accaaagaggaatcc

SEQ ID NO: 318951 - DNA, 15 bp, Homo sapiens
ccaaagaggaatcca

SEQ ID NO: 318952 - DNA, 15 bp, Homo sapiens
caaagaggaatccag

SEQ ID NO: 318953 - DNA, 15 bp, Homo sapiens
aaagaggaatccaga

SEQ ID NO: 318954 - DNA, 15 bp, Homo sapiens
aagaggaatccagaa

SEQ ID NO: 318955 - DNA, 15 bp, Homo sapiens
agaggaatccagaaa

SEQ ID NO: 318956 - DNA, 15 bp, Homo sapiens
gaggaatccagaaac

SEQ ID NO: 318957 - DNA, 15 bp, Homo sapiens
aggaatccagaaact

SEQ ID NO: 318958 - DNA, 15 bp, Homo sapiens
ggaatccagaaactt

SEQ ID NO: 318959 - DNA, 15 bp, Homo sapiens
gaatccagaaacttc

SEQ ID NO: 318960 - DNA, 15 bp, Homo sapiens
aatccagaaacttca

SEQ ID NO: 318961 - DNA, 15 bp, Homo sapiens
atccagaaacttcaa

SEQ ID NO: 318962 - DNA, 15 bp, Homo sapiens
tccagaaacttcaat

SEQ ID NO: 318963 - DNA, 15 bp, Homo sapiens
ccagaaacttcaata

SEQ ID NO: 318964 - DNA, 15 bp, Homo sapiens
cagaaacttcaatac

SEQ ID NO: 318965 - DNA, 15 bp, Homo sapiens
agaaacttcaatacc

SEQ ID NO: 318966 - DNA, 15 bp, Homo sapiens
gaaacttcaatacca

SEQ ID NO: 318967 - DNA, 15 bp, Homo sapiens
aaacttcaataccac

SEQ ID NO: 318968 - DNA, 15 bp, Homo sapiens
aacttcaataccaca

SEQ ID NO: 318969 - DNA, 15 bp, Homo sapiens
acttcaataccacat

SEQ ID NO: 318970 - DNA, 15 bp, Homo sapiens
cttcaataccacatc

SEQ ID NO: 318971 - DNA, 15 bp, Homo sapiens
ttcaataccacatct

SEQ ID NO: 318972 - DNA, 15 bp, Homo sapiens
tcaataccacatcta

SEQ ID NO: 318973 - DNA, 15 bp, Homo sapiens
caataccacatctat

SEQ ID NO: 318974 - DNA, 15 bp, Homo sapiens
aataccacatctatc

SEQ ID NO: 318975 - DNA, 15 bp, Homo sapiens
ataccacatctatcc

SEQ ID NO: 318976 - DNA, 15 bp, Homo sapiens
taccacatctatcct

SEQ ID NO: 318977 - DNA, 15 bp, Homo sapiens
accacatctatcctc

SEQ ID NO: 318978 - DNA, 15 bp, Homo sapiens
ccacatctatcctca

SEQ ID NO: 318979 - DNA, 15 bp, Homo sapiens
cacatctatcctcaa

SEQ ID NO: 318980 - DNA, 15 bp, Homo sapiens
acatctatcctcaac

SEQ ID NO: 318981 - DNA, 15 bp, Homo sapiens
catctatcctcaacc

SEQ ID NO: 318982 - DNA, 15 bp, Homo sapiens
atctatcctcaacca

SEQ ID NO: 318983 - DNA, 15 bp, Homo sapiens
tctatcctcaaccag

SEQ ID NO: 318984 - DNA, 15 bp, Homo sapiens
ctatcctcaaccaga

SEQ ID NO: 318985 - DNA, 15 bp, Homo sapiens
tatcctcaaccagaa

SEQ ID NO: 318986 - DNA, 15 bp, Homo sapiens
atcctcaaccagaac

SEQ ID NO: 318987 - DNA, 15 bp, Homo sapiens
tcctcaaccagaacc

SEQ ID NO: 318988 - DNA, 15 bp, Homo sapiens
cctcaaccagaaccc

SEQ ID NO: 318989 - DNA, 15 bp, Homo sapiens
ctcaaccagaaccca

SEQ ID NO: 318990 - DNA, 15 bp, Homo sapiens
tcaaccagaacccac

SEQ ID NO: 318991 - DNA, 15 bp, Homo sapiens
caaccagaacccacc

SEQ ID NO: 318992 - DNA, 15 bp, Homo sapiens
aaccagaacccaccc

SEQ ID NO: 318993 - DNA, 15 bp, Homo sapiens
accagaacccaccca

SEQ ID NO: 318994 - DNA, 15 bp, Homo sapiens
ccagaacccacccaa

SEQ ID NO: 318995 - DNA, 15 bp, Homo sapiens
cagaacccacccaag

SEQ ID NO: 318996 - DNA, 15 bp, Homo sapiens
agaacccacccaagg

SEQ ID NO: 318997 - DNA, 15 bp, Homo sapiens
gaacccacccaaggc

SEQ ID NO: 318998 - DNA, 15 bp, Homo sapiens
aacccacccaaggcc

SEQ ID NO: 318999 - DNA, 15 bp, Homo sapiens
acccacccaaggcca

SEQ ID NO: 319000 - DNA, 15 bp, Homo sapiens
cccacccaaggccac

SEQ ID NO: 319001 - DNA, 15 bp, Homo sapiens
ccacccaaggccacc

SEQ ID NO: 319002 - DNA, 15 bp, Homo sapiens
cacccaaggccaccc

SEQ ID NO: 319003 - DNA, 15 bp, Homo sapiens
acccaaggccaccct

SEQ ID NO: 319004 - DNA, 15 bp, Homo sapiens
cccaaggccacccta

SEQ ID NO: 319005 - DNA, 15 bp, Homo sapiens
ccaaggccaccctaa

SEQ ID NO: 319006 - DNA, 15 bp, Homo sapiens
caaggccaccctaac

SEQ ID NO: 319007 - DNA, 15 bp, Homo sapiens
aaggccaccctaacc

SEQ ID NO: 319008 - DNA, 15 bp, Homo sapiens
aggccaccctaaccg

SEQ ID NO: 319009 - DNA, 15 bp, Homo sapiens
ggccaccctaaccgt

SEQ ID NO: 319010 - DNA, 15 bp, Homo sapiens
gccaccctaaccgtg

SEQ ID NO: 319011 - DNA, 15 bp, Homo sapiens
ccaccctaaccgtgt

SEQ ID NO: 319012 - DNA, 15 bp, Homo sapiens
caccctaaccgtgta

SEQ ID NO: 319013 - DNA, 15 bp, Homo sapiens
accctaaccgtgtac

SEQ ID NO: 319014 - DNA, 15 bp, Homo sapiens
ccctaaccgtgtaca

SEQ ID NO: 319015 - DNA, 15 bp, Homo sapiens
cctaaccgtgtacat

SEQ ID NO: 319016 - DNA, 15 bp, Homo sapiens
ctaaccgtgtacatt

SEQ ID NO: 319017 - DNA, 15 bp, Homo sapiens
taaccgtgtacattg

SEQ ID NO: 319018 - DNA, 15 bp, Homo sapiens
aaccgtgtacattgt

SEQ ID NO: 319019 - DNA, 15 bp, Homo sapiens
accgtgtacattgta

SEQ ID NO: 319020 - DNA, 15 bp, Homo sapiens
ccgtgtacattgtac

SEQ ID NO: 319021 - DNA, 15 bp, Homo sapiens
cgtgtacattgtacc

SEQ ID NO: 319022 - DNA, 15 bp, Homo sapiens
gtgtacattgtaccc

SEQ ID NO: 319023 - DNA, 15 bp, Homo sapiens
tgtacattgtaccca

SEQ ID NO: 319024 - DNA, 15 bp, Homo sapiens
gtacattgtacccat

SEQ ID NO: 319025 - DNA, 15 bp, Homo sapiens
tacattgtacccatc

SEQ ID NO: 319026 - DNA, 15 bp, Homo sapiens
acattgtacccatcc

SEQ ID NO: 319027 - DNA, 15 bp, Homo sapiens
cattgtacccatcct

SEQ ID NO: 319028 - DNA, 15 bp, Homo sapiens
attgtacccatcctc

SEQ ID NO: 319029 - DNA, 15 bp, Homo sapiens
ttgtacccatcctcc

SEQ ID NO: 319030 - DNA, 15 bp, Homo sapiens
tgtacccatcctcct

SEQ ID NO: 319031 - DNA, 15 bp, Homo sapiens
gtacccatcctcctt

SEQ ID NO: 319032 - DNA, 15 bp, Homo sapiens
tacccatcctccttt

SEQ ID NO: 319033 - DNA, 15 bp, Homo sapiens
acccatcctccttta

SEQ ID NO: 319034 - DNA, 15 bp, Homo sapiens
cccatcctcctttac

SEQ ID NO: 319035 - DNA, 15 bp, Homo sapiens
ccatcctcctttact

SEQ ID NO: 319036 - DNA, 15 bp, Homo sapiens
catcctcctttactt

SEQ ID NO: 319037 - DNA, 15 bp, Homo sapiens
atcctcctttactta

SEQ ID NO: 319038 - DNA, 15 bp, Homo sapiens
tcctcctttacttac

SEQ ID NO: 319039 - DNA, 15 bp, Homo sapiens
cctcctttacttact

SEQ ID NO: 319040 - DNA, 15 bp, Homo sapiens
ctcctttacttactc

SEQ ID NO: 319041 - DNA, 15 bp, Homo sapiens
tcctttacttactca

SEQ ID NO: 319042 - DNA, 15 bp, Homo sapiens
cctttacttactcaa

SEQ ID NO: 319043 - DNA, 15 bp, Homo sapiens
ctttacttactcaaa

SEQ ID NO: 319044 - DNA, 15 bp, Homo sapiens
tttacttactcaaag

SEQ ID NO: 319045 - DNA, 15 bp, Homo sapiens
ttacttactcaaagt

SEQ ID NO: 319046 - DNA, 15 bp, Homo sapiens
tacttactcaaagtc

SEQ ID NO: 319047 - DNA, 15 bp, Homo sapiens
acttactcaaagtca

SEQ ID NO: 319048 - DNA, 15 bp, Homo sapiens
cttactcaaagtcac

SEQ ID NO: 319049 - DNA, 15 bp, Homo sapiens
ttactcaaagtcacc

SEQ ID NO: 319050 - DNA, 15 bp, Homo sapiens
tactcaaagtcacct

SEQ ID NO: 319051 - DNA, 15 bp, Homo sapiens
actcaaagtcacctc

SEQ ID NO: 319052 - DNA, 15 bp, Homo sapiens
ctcaaagtcacctcc

SEQ ID NO: 319053 - DNA, 15 bp, Homo sapiens
tcaaagtcacctccc

SEQ ID NO: 319054 - DNA, 15 bp, Homo sapiens
caaagtcacctccct

SEQ ID NO: 319055 - DNA, 15 bp, Homo sapiens
aaagtcacctccctt

SEQ ID NO: 319056 - DNA, 15 bp, Homo sapiens
aagtcacctcccttc

SEQ ID NO: 319057 - DNA, 15 bp, Homo sapiens
agtcacctcccttct

SEQ ID NO: 319058 - DNA, 15 bp, Homo sapiens
gtcacctcccttctc

SEQ ID NO: 319059 - DNA, 15 bp, Homo sapiens
tcacctcccttctct

SEQ ID NO: 319060 - DNA, 15 bp, Homo sapiens
cacctcccttctctc

SEQ ID NO: 319061 - DNA, 15 bp, Homo sapiens
acctcccttctctct

SEQ ID NO: 319062 - DNA, 15 bp, Homo sapiens
cctcccttctctctt

SEQ ID NO: 319063 - DNA, 15 bp, Homo sapiens
ctcccttctctcttc

SEQ ID NO: 319064 - DNA, 15 bp, Homo sapiens
tcccttctctcttct

SEQ ID NO: 319065 - DNA, 15 bp, Homo sapiens
cccttctctcttctg

SEQ ID NO: 319066 - DNA, 15 bp, Homo sapiens
ccttctctcttctgc

SEQ ID NO: 319067 - DNA, 15 bp, Homo sapiens
cttctctcttctgca

SEQ ID NO: 319068 - DNA, 15 bp, Homo sapiens
ttctctcttctgcat

SEQ ID NO: 319069 - DNA, 15 bp, Homo sapiens
tctctcttctgcatc

SEQ ID NO: 319070 - DNA, 15 bp, Homo sapiens
ctctcttctgcatcc

SEQ ID NO: 319071 - DNA, 15 bp, Homo sapiens
tctcttctgcatccc

SEQ ID NO: 319072 - DNA, 15 bp, Homo sapiens
ctcttctgcatccct

SEQ ID NO: 319073 - DNA, 15 bp, Homo sapiens
tcttctgcatcccta

SEQ ID NO: 319074 - DNA, 15 bp, Homo sapiens
cttctgcatccctat

SEQ ID NO: 319075 - DNA, 15 bp, Homo sapiens
ttctgcatccctatg

SEQ ID NO: 319076 - DNA, 15 bp, Homo sapiens
tctgcatccctatga

SEQ ID NO: 319077 - DNA, 15 bp, Homo sapiens
ctgcatccctatgat

SEQ ID NO: 319078 - DNA, 15 bp, Homo sapiens
tgcatccctatgatt

SEQ ID NO: 319079 - DNA, 15 bp, Homo sapiens
gcatccctatgattt

SEQ ID NO: 319080 - DNA, 15 bp, Homo sapiens
catccctatgatttc

SEQ ID NO: 319081 - DNA, 15 bp, Homo sapiens
atccctatgatttcc

SEQ ID NO: 319082 - DNA, 15 bp, Homo sapiens
tccctatgatttccc

SEQ ID NO: 319083 - DNA, 15 bp, Homo sapiens
ccctatgatttcccc

SEQ ID NO: 319084 - DNA, 15 bp, Homo sapiens
cctatgatttcccct

SEQ ID NO: 319085 - DNA, 15 bp, Homo sapiens
ctatgatttcccctt

SEQ ID NO: 319086 - DNA, 15 bp, Homo sapiens
tatgatttccccttt

SEQ ID NO: 319087 - DNA, 15 bp, Homo sapiens
atgatttccccttta

SEQ ID NO: 319088 - DNA, 15 bp, Homo sapiens
tgatttcccctttag

SEQ ID NO: 319089 - DNA, 15 bp, Homo sapiens
gatttcccctttagt

SEQ ID NO: 319090 - DNA, 15 bp, Homo sapiens
atttcccctttagtg

SEQ ID NO: 319091 - DNA, 15 bp, Homo sapiens
tttcccctttagtgg

SEQ ID NO: 319092 - DNA, 15 bp, Homo sapiens
ttcccctttagtgga

SEQ ID NO: 319093 - DNA, 15 bp, Homo sapiens
tcccctttagtggat

SEQ ID NO: 319094 - DNA, 15 bp, Homo sapiens
cccctttagtggatc

SEQ ID NO: 319095 - DNA, 15 bp, Homo sapiens
ccctttagtggatcc

SEQ ID NO: 319096 - DNA, 15 bp, Homo sapiens
cctttagtggatccg

SEQ ID NO: 319097 - DNA, 15 bp, Homo sapiens
ctttagtggatccgc

SEQ ID NO: 319098 - DNA, 15 bp, Homo sapiens
tttagtggatccgct

SEQ ID NO: 319099 - DNA, 15 bp, Homo sapiens
ttagtggatccgctt

SEQ ID NO: 319100 - DNA, 15 bp, Homo sapiens
tagtggatccgctta

SEQ ID NO: 319101 - DNA, 15 bp, Homo sapiens
agtggatccgcttac

SEQ ID NO: 319102 - DNA, 15 bp, Homo sapiens
gtggatccgcttaca

SEQ ID NO: 319103 - DNA, 15 bp, Homo sapiens
tggatccgcttacaa

SEQ ID NO: 319104 - DNA, 15 bp, Homo sapiens
ggatccgcttacaaa

SEQ ID NO: 319105 - DNA, 15 bp, Homo sapiens
gatccgcttacaaac

SEQ ID NO: 319106 - DNA, 15 bp, Homo sapiens
atccgcttacaaaca

SEQ ID NO: 319107 - DNA, 15 bp, Homo sapiens
tccgcttacaaacat

SEQ ID NO: 319108 - DNA, 15 bp, Homo sapiens
ccgcttacaaacatg

SEQ ID NO: 319109 - DNA, 15 bp, Homo sapiens
cgcttacaaacatgc

SEQ ID NO: 319110 - DNA, 15 bp, Homo sapiens
gcttacaaacatgct

SEQ ID NO: 319111 - DNA, 15 bp, Homo sapiens
cttacaaacatgcta

SEQ ID NO: 319112 - DNA, 15 bp, Homo sapiens
ttacaaacatgctat

SEQ ID NO: 319113 - DNA, 15 bp, Homo sapiens
tacaaacatgctatt

SEQ ID NO: 319114 - DNA, 15 bp, Homo sapiens
acaaacatgctattg

SEQ ID NO: 319115 - DNA, 15 bp, Homo sapiens
caaacatgctattgt

SEQ ID NO: 319116 - DNA, 15 bp, Homo sapiens
aaacatgctattgtt

SEQ ID NO: 319117 - DNA, 15 bp, Homo sapiens
aacatgctattgttt

SEQ ID NO: 319118 - DNA, 15 bp, Homo sapiens
acatgctattgtttt

SEQ ID NO: 319119 - DNA, 15 bp, Homo sapiens
catgctattgttttt

SEQ ID NO: 319120 - DNA, 15 bp, Homo sapiens
atgctattgtttttc

SEQ ID NO: 319121 - DNA, 15 bp, Homo sapiens
tgctattgtttttct

SEQ ID NO: 319122 - DNA, 15 bp, Homo sapiens
gctattgtttttctt

SEQ ID NO: 319123 - DNA, 15 bp, Homo sapiens
ctattgtttttcttc

SEQ ID NO: 319124 - DNA, 15 bp, Homo sapiens
tattgtttttcttct

SEQ ID NO: 319125 - DNA, 15 bp, Homo sapiens
attgtttttcttcta

SEQ ID NO: 319126 - DNA, 15 bp, Homo sapiens
ttgtttttcttctag

SEQ ID NO: 319127 - DNA, 15 bp, Homo sapiens
tgtttttcttctagc

SEQ ID NO: 319128 - DNA, 15 bp, Homo sapiens
gtttttcttctagca

SEQ ID NO: 319129 - DNA, 15 bp, Homo sapiens
tttttcttctagcaa

SEQ ID NO: 319130 - DNA, 15 bp, Homo sapiens
ttttcttctagcaaa

SEQ ID NO: 319131 - DNA, 15 bp, Homo sapiens
tttcttctagcaaaa

SEQ ID NO: 319132 - DNA, 15 bp, Homo sapiens
ttcttctagcaaaac

SEQ ID NO: 319133 - DNA, 15 bp, Homo sapiens
tcttctagcaaaact

SEQ ID NO: 319134 - DNA, 15 bp, Homo sapiens
cttctagcaaaactt

SEQ ID NO: 319135 - DNA, 15 bp, Homo sapiens
ttctagcaaaacttt

SEQ ID NO: 319136 - DNA, 15 bp, Homo sapiens
tctagcaaaacttta

SEQ ID NO: 319137 - DNA, 15 bp, Homo sapiens
ctagcaaaactttac

SEQ ID NO: 319138 - DNA, 15 bp, Homo sapiens
tagcaaaactttact

SEQ ID NO: 319139 - DNA, 15 bp, Homo sapiens
agcaaaactttactt

SEQ ID NO: 319140 - DNA, 15 bp, Homo sapiens
gcaaaactttacttt

SEQ ID NO: 319141 - DNA, 15 bp, Homo sapiens
caaaactttactttg

SEQ ID NO: 319142 - DNA, 15 bp, Homo sapiens
aaaactttactttga

SEQ ID NO: 319143 - DNA, 15 bp, Homo sapiens
aaactttactttgat

SEQ ID NO: 319144 - DNA, 15 bp, Homo sapiens
aactttactttgatc

SEQ ID NO: 319145 - DNA, 15 bp, Homo sapiens
actttactttgatcc

SEQ ID NO: 319146 - DNA, 15 bp, Homo sapiens
ctttactttgatccc

SEQ ID NO: 319147 - DNA, 15 bp, Homo sapiens
tttactttgatccca

SEQ ID NO: 319148 - DNA, 15 bp, Homo sapiens
ttactttgatcccac

SEQ ID NO: 319149 - DNA, 15 bp, Homo sapiens
tactttgatcccacc

SEQ ID NO: 319150 - DNA, 15 bp, Homo sapiens
actttgatcccacct

SEQ ID NO: 319151 - DNA, 15 bp, Homo sapiens
ctttgatcccacctg

SEQ ID NO: 319152 - DNA, 15 bp, Homo sapiens
tttgatcccacctgt

SEQ ID NO: 319153 - DNA, 15 bp, Homo sapiens
ttgatcccacctgtc

SEQ ID NO: 319154 - DNA, 15 bp, Homo sapiens
tgatcccacctgtct

SEQ ID NO: 319155 - DNA, 15 bp, Homo sapiens
gatcccacctgtctc

SEQ ID NO: 319156 - DNA, 15 bp, Homo sapiens
atcccacctgtctct

SEQ ID NO: 319157 - DNA, 15 bp, Homo sapiens
tcccacctgtctctg

SEQ ID NO: 319158 - DNA, 15 bp, Homo sapiens
cccacctgtctctgt

SEQ ID NO: 319159 - DNA, 15 bp, Homo sapiens
ccacctgtctctgta

SEQ ID NO: 319160 - DNA, 15 bp, Homo sapiens
cacctgtctctgtag

SEQ ID NO: 319161 - DNA, 15 bp, Homo sapiens
acctgtctctgtagc

SEQ ID NO: 319162 - DNA, 15 bp, Homo sapiens
cctgtctctgtagct

SEQ ID NO: 319163 - DNA, 15 bp, Homo sapiens
ctgtctctgtagcta

SEQ ID NO: 319164 - DNA, 15 bp, Homo sapiens
tgtctctgtagctac

SEQ ID NO: 319165 - DNA, 15 bp, Homo sapiens
gtctctgtagctacc

SEQ ID NO: 319166 - DNA, 15 bp, Homo sapiens
tctctgtagctacca

SEQ ID NO: 319167 - DNA, 15 bp, Homo sapiens
ctctgtagctaccac

SEQ ID NO: 319168 - DNA, 15 bp, Homo sapiens
tctgtagctaccacg

SEQ ID NO: 319169 - DNA, 15 bp, Homo sapiens
ctgtagctaccacgc

SEQ ID NO: 319170 - DNA, 15 bp, Homo sapiens
tgtagctaccacgcc

SEQ ID NO: 319171 - DNA, 15 bp, Homo sapiens
gtagctaccacgcca

SEQ ID NO: 319172 - DNA, 15 bp, Homo sapiens
tagctaccacgccat

SEQ ID NO: 319173 - DNA, 15 bp, Homo sapiens
agctaccacgccatt

SEQ ID NO: 319174 - DNA, 15 bp, Homo sapiens
gctaccacgccattc

SEQ ID NO: 319175 - DNA, 15 bp, Homo sapiens
ctaccacgccattcc

SEQ ID NO: 319176 - DNA, 15 bp, Homo sapiens
taccacgccattcct

SEQ ID NO: 319177 - DNA, 15 bp, Homo sapiens
accacgccattcctc

SEQ ID NO: 319178 - DNA, 15 bp, Homo sapiens
ccacgccattcctct

SEQ ID NO: 319179 - DNA, 15 bp, Homo sapiens
cacgccattcctctg

SEQ ID NO: 319180 - DNA, 15 bp, Homo sapiens
acgccattcctctgg

SEQ ID NO: 319181 - DNA, 15 bp, Homo sapiens
cgccattcctctggt

SEQ ID NO: 319182 - DNA, 15 bp, Homo sapiens
gccattcctctggtc

SEQ ID NO: 319183 - DNA, 15 bp, Homo sapiens
ccattcctctggtcc

SEQ ID NO: 319184 - DNA, 15 bp, Homo sapiens
cattcctctggtccc

SEQ ID NO: 319185 - DNA, 15 bp, Homo sapiens
attcctctggtcccc

SEQ ID NO: 319186 - DNA, 15 bp, Homo sapiens
ttcctctggtcccct

SEQ ID NO: 319187 - DNA, 15 bp, Homo sapiens
tcctctggtcccctt

SEQ ID NO: 319188 - DNA, 15 bp, Homo sapiens
cctctggtccccttt

SEQ ID NO: 319189 - DNA, 15 bp, Homo sapiens
ctctggtccccttta

SEQ ID NO: 319190 - DNA, 15 bp, Homo sapiens
tctggtcccctttat

SEQ ID NO: 319191 - DNA, 15 bp, Homo sapiens
ctggtcccctttatg

SEQ ID NO: 319192 - DNA, 15 bp, Homo sapiens
tggtcccctttatga

SEQ ID NO: 319193 - DNA, 15 bp, Homo sapiens
ggtcccctttatgaa

SEQ ID NO: 319194 - DNA, 15 bp, Homo sapiens
gtcccctttatgaaa

SEQ ID NO: 319195 - DNA, 15 bp, Homo sapiens
tcccctttatgaaag

SEQ ID NO: 319196 - DNA, 15 bp, Homo sapiens
cccctttatgaaaga

SEQ ID NO: 319197 - DNA, 15 bp, Homo sapiens
ccctttatgaaagag

SEQ ID NO: 319198 - DNA, 15 bp, Homo sapiens
cctttatgaaagagc

SEQ ID NO: 319199 - DNA, 15 bp, Homo sapiens
ctttatgaaagagct

SEQ ID NO: 319200 - DNA, 15 bp, Homo sapiens
tttatgaaagagctc

SEQ ID NO: 319201 - DNA, 15 bp, Homo sapiens
ttatgaaagagctcc

SEQ ID NO: 319202 - DNA, 15 bp, Homo sapiens
tatgaaagagctcct

SEQ ID NO: 319203 - DNA, 15 bp, Homo sapiens
atgaaagagctcctc

SEQ ID NO: 319204 - DNA, 15 bp, Homo sapiens
tgaaagagctcctca

SEQ ID NO: 319205 - DNA, 15 bp, Homo sapiens
gaaagagctcctcaa

SEQ ID NO: 319206 - DNA, 15 bp, Homo sapiens
aaagagctcctcaaa

SEQ ID NO: 319207 - DNA, 15 bp, Homo sapiens
aagagctcctcaaag

SEQ ID NO: 319208 - DNA, 15 bp, Homo sapiens
agagctcctcaaaga

SEQ ID NO: 319209 - DNA, 15 bp, Homo sapiens
gagctcctcaaagat

SEQ ID NO: 319210 - DNA, 15 bp, Homo sapiens
agctcctcaaagatt

SEQ ID NO: 319211 - DNA, 15 bp, Homo sapiens
gctcctcaaagattg

SEQ ID NO: 319212 - DNA, 15 bp, Homo sapiens
ctcctcaaagattgt

SEQ ID NO: 319213 - DNA, 15 bp, Homo sapiens
tcctcaaagattgta

SEQ ID NO: 319214 - DNA, 15 bp, Homo sapiens
cctcaaagattgtat

SEQ ID NO: 319215 - DNA, 15 bp, Homo sapiens
ctcaaagattgtatg

SEQ ID NO: 319216 - DNA, 15 bp, Homo sapiens
tcaaagattgtatgt

SEQ ID NO: 319217 - DNA, 15 bp, Homo sapiens
caaagattgtatgta

SEQ ID NO: 319218 - DNA, 15 bp, Homo sapiens
aaagattgtatgtac

SEQ ID NO: 319219 - DNA, 15 bp, Homo sapiens
aagattgtatgtacc

SEQ ID NO: 319220 - DNA, 15 bp, Homo sapiens
agattgtatgtacca

SEQ ID NO: 319221 - DNA, 15 bp, Homo sapiens
gattgtatgtaccaa

SEQ ID NO: 319222 - DNA, 15 bp, Homo sapiens
attgtatgtaccaac

SEQ ID NO: 319223 - DNA, 15 bp, Homo sapiens
ttgtatgtaccaaca

SEQ ID NO: 319224 - DNA, 15 bp, Homo sapiens
tgtatgtaccaacat

SEQ ID NO: 319225 - DNA, 15 bp, Homo sapiens
gtatgtaccaacatt

SEQ ID NO: 319226 - DNA, 15 bp, Homo sapiens
tatgtaccaacattt

SEQ ID NO: 319227 - DNA, 15 bp, Homo sapiens
atgtaccaacatttg

SEQ ID NO: 319228 - DNA, 15 bp, Homo sapiens
tgtaccaacatttgc

SEQ ID NO: 319229 - DNA, 15 bp, Homo sapiens
gtaccaacatttgca

SEQ ID NO: 319230 - DNA, 15 bp, Homo sapiens
taccaacatttgcag

SEQ ID NO: 319231 - DNA, 15 bp, Homo sapiens
accaacatttgcagt

SEQ ID NO: 319232 - DNA, 15 bp, Homo sapiens
ccaacatttgcagtt

SEQ ID NO: 319233 - DNA, 15 bp, Homo sapiens
caacatttgcagttc

SEQ ID NO: 319234 - DNA, 15 bp, Homo sapiens
aacatttgcagttcg

SEQ ID NO: 319235 - DNA, 15 bp, Homo sapiens
acatttgcagttcgt

SEQ ID NO: 319236 - DNA, 15 bp, Homo sapiens
catttgcagttcgtc

SEQ ID NO: 319237 - DNA, 15 bp, Homo sapiens
atttgcagttcgtct

SEQ ID NO: 319238 - DNA, 15 bp, Homo sapiens
tttgcagttcgtctc

SEQ ID NO: 319239 - DNA, 15 bp, Homo sapiens
ttgcagttcgtctcc

SEQ ID NO: 319240 - DNA, 15 bp, Homo sapiens
tgcagttcgtctcct

SEQ ID NO: 319241 - DNA, 15 bp, Homo sapiens
gcagttcgtctcctt

SEQ ID NO: 319242 - DNA, 15 bp, Homo sapiens
cagttcgtctccttt

SEQ ID NO: 319243 - DNA, 15 bp, Homo sapiens
agttcgtctcctttc

SEQ ID NO: 319244 - DNA, 15 bp, Homo sapiens
gttcgtctcctttca

SEQ ID NO: 319245 - DNA, 15 bp, Homo sapiens
ttcgtctcctttcat

SEQ ID NO: 319246 - DNA, 15 bp, Homo sapiens
tcgtctcctttcatt

SEQ ID NO: 319247 - DNA, 15 bp, Homo sapiens
cgtctcctttcattc

SEQ ID NO: 319248 - DNA, 15 bp, Homo sapiens
gtctcctttcattcc

SEQ ID NO: 319249 - DNA, 15 bp, Homo sapiens
tctcctttcattccc

SEQ ID NO: 319250 - DNA, 15 bp, Homo sapiens
ctcctttcattccct

SEQ ID NO: 319251 - DNA, 15 bp, Homo sapiens
tcctttcattccctc

SEQ ID NO: 319252 - DNA, 15 bp, Homo sapiens
cctttcattccctct

SEQ ID NO: 319253 - DNA, 15 bp, Homo sapiens
ctttcattccctctt

SEQ ID NO: 319254 - DNA, 15 bp, Homo sapiens
tttcattccctctta

SEQ ID NO: 319255 - DNA, 15 bp, Homo sapiens
ttcattccctcttaa

SEQ ID NO: 319256 - DNA, 15 bp, Homo sapiens
tcattccctcttaag

SEQ ID NO: 319257 - DNA, 15 bp, Homo sapiens
cattccctcttaaga

SEQ ID NO: 319258 - DNA, 15 bp, Homo sapiens
attccctcttaagac

SEQ ID NO: 319259 - DNA, 15 bp, Homo sapiens
ttccctcttaagacc

SEQ ID NO: 319260 - DNA, 15 bp, Homo sapiens
tccctcttaagacca

SEQ ID NO: 319261 - DNA, 15 bp, Homo sapiens
ccctcttaagaccac

SEQ ID NO: 319262 - DNA, 15 bp, Homo sapiens
cctcttaagaccact

SEQ ID NO: 319263 - DNA, 15 bp, Homo sapiens
ctcttaagaccactc

SEQ ID NO: 319264 - DNA, 15 bp, Homo sapiens
tcttaagaccactca

SEQ ID NO: 319265 - DNA, 15 bp, Homo sapiens
cttaagaccactcaa

SEQ ID NO: 319266 - DNA, 15 bp, Homo sapiens
ttaagaccactcaaa

SEQ ID NO: 319267 - DNA, 15 bp, Homo sapiens
taagaccactcaaat

SEQ ID NO: 319268 - DNA, 15 bp, Homo sapiens
aagaccactcaaatc

SEQ ID NO: 319269 - DNA, 15 bp, Homo sapiens
agaccactcaaatca

SEQ ID NO: 319270 - DNA, 15 bp, Homo sapiens
gaccactcaaatcag

SEQ ID NO: 319271 - DNA, 15 bp, Homo sapiens
accactcaaatcagg

SEQ ID NO: 319272 - DNA, 15 bp, Homo sapiens
ccactcaaatcaggc

SEQ ID NO: 319273 - DNA, 15 bp, Homo sapiens
cactcaaatcaggca

SEQ ID NO: 319274 - DNA, 15 bp, Homo sapiens
actcaaatcaggcag

SEQ ID NO: 319275 - DNA, 15 bp, Homo sapiens
ctcaaatcaggcaga

SEQ ID NO: 319276 - DNA, 15 bp, Homo sapiens
tcaaatcaggcagac

SEQ ID NO: 319277 - DNA, 15 bp, Homo sapiens
caaatcaggcagacc

SEQ ID NO: 319278 - DNA, 15 bp, Homo sapiens
aaatcaggcagaccc

SEQ ID NO: 319279 - DNA, 15 bp, Homo sapiens
aatcaggcagacccc

SEQ ID NO: 319280 - DNA, 15 bp, Homo sapiens
atcaggcagaccccc

SEQ ID NO: 319281 - DNA, 15 bp, Homo sapiens
tcaggcagaccccct

SEQ ID NO: 319282 - DNA, 15 bp, Homo sapiens
caggcagacccccta

SEQ ID NO: 319283 - DNA, 15 bp, Homo sapiens
aggcagaccccctac

SEQ ID NO: 319284 - DNA, 15 bp, Homo sapiens
ggcagaccccctacc

SEQ ID NO: 319285 - DNA, 15 bp, Homo sapiens
gcagaccccctacca

SEQ ID NO: 319286 - DNA, 15 bp, Homo sapiens
cagaccccctaccag

SEQ ID NO: 319287 - DNA, 15 bp, Homo sapiens
agaccccctaccagt

SEQ ID NO: 319288 - DNA, 15 bp, Homo sapiens
gaccccctaccagtc

SEQ ID NO: 319289 - DNA, 15 bp, Homo sapiens
accccctaccagtcc

SEQ ID NO: 319290 - DNA, 15 bp, Homo sapiens
ccccctaccagtcca

SEQ ID NO: 319291 - DNA, 15 bp, Homo sapiens
cccctaccagtccag

SEQ ID NO: 319292 - DNA, 15 bp, Homo sapiens
ccctaccagtccagt

SEQ ID NO: 319293 - DNA, 15 bp, Homo sapiens
cctaccagtccagta

SEQ ID NO: 319294 - DNA, 15 bp, Homo sapiens
ctaccagtccagtaa

SEQ ID NO: 319295 - DNA, 15 bp, Homo sapiens
taccagtccagtaaa

SEQ ID NO: 319296 - DNA, 15 bp, Homo sapiens
accagtccagtaaaa

SEQ ID NO: 319297 - DNA, 15 bp, Homo sapiens
ccagtccagtaaaac

SEQ ID NO: 319298 - DNA, 15 bp, Homo sapiens
cagtccagtaaaact

SEQ ID NO: 319299 - DNA, 15 bp, Homo sapiens
agtccagtaaaactg

SEQ ID NO: 319300 - DNA, 15 bp, Homo sapiens
gtccagtaaaactgc

SEQ ID NO: 319301 - DNA, 15 bp, Homo sapiens
tccagtaaaactgct

SEQ ID NO: 319302 - DNA, 15 bp, Homo sapiens
ccagtaaaactgctc

SEQ ID NO: 319303 - DNA, 15 bp, Homo sapiens
cagtaaaactgctct

SEQ ID NO: 319304 - DNA, 15 bp, Homo sapiens
agtaaaactgctctt

SEQ ID NO: 319305 - DNA, 15 bp, Homo sapiens
gtaaaactgctcttg

SEQ ID NO: 319306 - DNA, 15 bp, Homo sapiens
taaaactgctcttgt

SEQ ID NO: 319307 - DNA, 15 bp, Homo sapiens
aaaactgctcttgtc

SEQ ID NO: 319308 - DNA, 15 bp, Homo sapiens
aaactgctcttgtca

SEQ ID NO: 319309 - DNA, 15 bp, Homo sapiens
aactgctcttgtcaa

SEQ ID NO: 319310 - DNA, 15 bp, Homo sapiens
actgctcttgtcaaa

SEQ ID NO: 319311 - DNA, 15 bp, Homo sapiens
ctgctcttgtcaaag

SEQ ID NO: 319312 - DNA, 15 bp, Homo sapiens
tgctcttgtcaaagt

SEQ ID NO: 319313 - DNA, 15 bp, Homo sapiens
gctcttgtcaaagtt

SEQ ID NO: 319314 - DNA, 15 bp, Homo sapiens
ctcttgtcaaagtta

SEQ ID NO: 319315 - DNA, 15 bp, Homo sapiens
tcttgtcaaagttat

SEQ ID NO: 319316 - DNA, 15 bp, Homo sapiens
cttgtcaaagttatt

SEQ ID NO: 319317 - DNA, 15 bp, Homo sapiens
ttgtcaaagttatta

SEQ ID NO: 319318 - DNA, 15 bp, Homo sapiens
tgtcaaagttattag

SEQ ID NO: 319319 - DNA, 15 bp, Homo sapiens
gtcaaagttattagg

SEQ ID NO: 319320 - DNA, 15 bp, Homo sapiens
tcaaagttattaggg

SEQ ID NO: 319321 - DNA, 15 bp, Homo sapiens
caaagttattaggga

SEQ ID NO: 319322 - DNA, 15 bp, Homo sapiens
aaagttattagggac

SEQ ID NO: 319323 - DNA, 15 bp, Homo sapiens
aagttattagggacc

SEQ ID NO: 319324 - DNA, 15 bp, Homo sapiens
agttattagggacct

SEQ ID NO: 319325 - DNA, 15 bp, Homo sapiens
gttattagggacctc

SEQ ID NO: 319326 - DNA, 15 bp, Homo sapiens
ttattagggacctcc

SEQ ID NO: 319327 - DNA, 15 bp, Homo sapiens
tattagggacctcct

SEQ ID NO: 319328 - DNA, 15 bp, Homo sapiens
attagggacctcctt

SEQ ID NO: 319329 - DNA, 15 bp, Homo sapiens
ttagggacctccttg

SEQ ID NO: 319330 - DNA, 15 bp, Homo sapiens
tagggacctccttgt

SEQ ID NO: 319331 - DNA, 15 bp, Homo sapiens
agggacctccttgtt

SEQ ID NO: 319332 - DNA, 15 bp, Homo sapiens
gggacctccttgttg

SEQ ID NO: 319333 - DNA, 15 bp, Homo sapiens
ggacctccttgttgc

SEQ ID NO: 319334 - DNA, 15 bp, Homo sapiens
gacctccttgttgct

SEQ ID NO: 319335 - DNA, 15 bp, Homo sapiens
acctccttgttgcta

SEQ ID NO: 319336 - DNA, 15 bp, Homo sapiens
cctccttgttgctaa

SEQ ID NO: 319337 - DNA, 15 bp, Homo sapiens
ctccttgttgctaaa

SEQ ID NO: 319338 - DNA, 15 bp, Homo sapiens
tccttgttgctaaat

SEQ ID NO: 319339 - DNA, 15 bp, Homo sapiens
ccttgttgctaaatc

SEQ ID NO: 319340 - DNA, 15 bp, Homo sapiens
cttgttgctaaatcc

SEQ ID NO: 319341 - DNA, 15 bp, Homo sapiens
ttgttgctaaatcca

SEQ ID NO: 319342 - DNA, 15 bp, Homo sapiens
tgttgctaaatccag

SEQ ID NO: 319343 - DNA, 15 bp, Homo sapiens
gttgctaaatccagt

SEQ ID NO: 319344 - DNA, 15 bp, Homo sapiens
ttgctaaatccagta

SEQ ID NO: 319345 - DNA, 15 bp, Homo sapiens
tgctaaatccagtag

SEQ ID NO: 319346 - DNA, 15 bp, Homo sapiens
gctaaatccagtagc

SEQ ID NO: 319347 - DNA, 15 bp, Homo sapiens
ctaaatccagtagcc

SEQ ID NO: 319348 - DNA, 15 bp, Homo sapiens
taaatccagtagcct

SEQ ID NO: 319349 - DNA, 15 bp, Homo sapiens
aaatccagtagcctg

SEQ ID NO: 319350 - DNA, 15 bp, Homo sapiens
aatccagtagcctgt

SEQ ID NO: 319351 - DNA, 15 bp, Homo sapiens
atccagtagcctgtt

SEQ ID NO: 319352 - DNA, 15 bp, Homo sapiens
tccagtagcctgttc

SEQ ID NO: 319353 - DNA, 15 bp, Homo sapiens
ccagtagcctgttct

SEQ ID NO: 319354 - DNA, 15 bp, Homo sapiens
cagtagcctgttctc

SEQ ID NO: 319355 - DNA, 15 bp, Homo sapiens
agtagcctgttctca

SEQ ID NO: 319356 - DNA, 15 bp, Homo sapiens
gtagcctgttctcag

SEQ ID NO: 319357 - DNA, 15 bp, Homo sapiens
tagcctgttctcagt

SEQ ID NO: 319358 - DNA, 15 bp, Homo sapiens
agcctgttctcagtc

SEQ ID NO: 319359 - DNA, 15 bp, Homo sapiens
gcctgttctcagtcc

SEQ ID NO: 319360 - DNA, 15 bp, Homo sapiens
cctgttctcagtcct

SEQ ID NO: 319361 - DNA, 15 bp, Homo sapiens
ctgttctcagtcctt

SEQ ID NO: 319362 - DNA, 15 bp, Homo sapiens
tgttctcagtcctta

SEQ ID NO: 319363 - DNA, 15 bp, Homo sapiens
gttctcagtccttac

SEQ ID NO: 319364 - DNA, 15 bp, Homo sapiens
ttctcagtccttacc

SEQ ID NO: 319365 - DNA, 15 bp, Homo sapiens
tctcagtccttacct

SEQ ID NO: 319366 - DNA, 15 bp, Homo sapiens
ctcagtccttacctt

SEQ ID NO: 319367 - DNA, 15 bp, Homo sapiens
tcagtccttacctta

SEQ ID NO: 319368 - DNA, 15 bp, Homo sapiens
cagtccttaccttat

SEQ ID NO: 319369 - DNA, 15 bp, Homo sapiens
agtccttaccttatt

SEQ ID NO: 319370 - DNA, 15 bp, Homo sapiens
gtccttaccttattc

SEQ ID NO: 319371 - DNA, 15 bp, Homo sapiens
tccttaccttattcc

SEQ ID NO: 319372 - DNA, 15 bp, Homo sapiens
ccttaccttattcca

SEQ ID NO: 319373 - DNA, 15 bp, Homo sapiens
cttaccttattccac

SEQ ID NO: 319374 - DNA, 15 bp, Homo sapiens
ttaccttattccacc

SEQ ID NO: 319375 - DNA, 15 bp, Homo sapiens
taccttattccacct

SEQ ID NO: 319376 - DNA, 15 bp, Homo sapiens
accttattccacctc

SEQ ID NO: 319377 - DNA, 15 bp, Homo sapiens
ccttattccacctct

SEQ ID NO: 319378 - DNA, 15 bp, Homo sapiens
cttattccacctctc

SEQ ID NO: 319379 - DNA, 15 bp, Homo sapiens
ttattccacctctca

SEQ ID NO: 319380 - DNA, 15 bp, Homo sapiens
tattccacctctcaa

SEQ ID NO: 319381 - DNA, 15 bp, Homo sapiens
attccacctctcaat

SEQ ID NO: 319382 - DNA, 15 bp, Homo sapiens
ttccacctctcaata

SEQ ID NO: 319383 - DNA, 15 bp, Homo sapiens
tccacctctcaatag

SEQ ID NO: 319384 - DNA, 15 bp, Homo sapiens
ccacctctcaatagc

SEQ ID NO: 319385 - DNA, 15 bp, Homo sapiens
cacctctcaatagca

SEQ ID NO: 319386 - DNA, 15 bp, Homo sapiens
acctctcaatagcat

SEQ ID NO: 319387 - DNA, 15 bp, Homo sapiens
cctctcaatagcatc

SEQ ID NO: 319388 - DNA, 15 bp, Homo sapiens
ctctcaatagcatca

SEQ ID NO: 319389 - DNA, 15 bp, Homo sapiens
tctcaatagcatcaa

SEQ ID NO: 319390 - DNA, 15 bp, Homo sapiens
ctcaatagcatcaac

SEQ ID NO: 319391 - DNA, 15 bp, Homo sapiens
tcaatagcatcaaca

SEQ ID NO: 319392 - DNA, 15 bp, Homo sapiens
caatagcatcaacac

SEQ ID NO: 319393 - DNA, 15 bp, Homo sapiens
aatagcatcaacact

SEQ ID NO: 319394 - DNA, 15 bp, Homo sapiens
atagcatcaacactg

SEQ ID NO: 319395 - DNA, 15 bp, Homo sapiens
tagcatcaacactgc

SEQ ID NO: 319396 - DNA, 15 bp, Homo sapiens
agcatcaacactgct

SEQ ID NO: 319397 - DNA, 15 bp, Homo sapiens
gcatcaacactgctg

SEQ ID NO: 319398 - DNA, 15 bp, Homo sapiens
catcaacactgctga

SEQ ID NO: 319399 - DNA, 15 bp, Homo sapiens
atcaacactgctgat

SEQ ID NO: 319400 - DNA, 15 bp, Homo sapiens
tcaacactgctgatc

SEQ ID NO: 319401 - DNA, 15 bp, Homo sapiens
caacactgctgatca

SEQ ID NO: 319402 - DNA, 15 bp, Homo sapiens
aacactgctgatcac

SEQ ID NO: 319403 - DNA, 15 bp, Homo sapiens
acactgctgatcact

SEQ ID NO: 319404 - DNA, 15 bp, Homo sapiens
cactgctgatcactc

SEQ ID NO: 319405 - DNA, 15 bp, Homo sapiens
actgctgatcactcc

SEQ ID NO: 319406 - DNA, 15 bp, Homo sapiens
ctgctgatcactccc

SEQ ID NO: 319407 - DNA, 15 bp, Homo sapiens
tgctgatcactccct

SEQ ID NO: 319408 - DNA, 15 bp, Homo sapiens
gctgatcactccctc

SEQ ID NO: 319409 - DNA, 15 bp, Homo sapiens
ctgatcactccctcc

SEQ ID NO: 319410 - DNA, 15 bp, Homo sapiens
tgatcactccctcct

SEQ ID NO: 319411 - DNA, 15 bp, Homo sapiens
gatcactccctcctc

SEQ ID NO: 319412 - DNA, 15 bp, Homo sapiens
atcactccctcctcc

SEQ ID NO: 319413 - DNA, 15 bp, Homo sapiens
tcactccctcctcca

SEQ ID NO: 319414 - DNA, 15 bp, Homo sapiens
cactccctcctccat

SEQ ID NO: 319415 - DNA, 15 bp, Homo sapiens
actccctcctccatg

SEQ ID NO: 319416 - DNA, 15 bp, Homo sapiens
ctccctcctccatga

SEQ ID NO: 319417 - DNA, 15 bp, Homo sapiens
tccctcctccatgac

SEQ ID NO: 319418 - DNA, 15 bp, Homo sapiens
ccctcctccatgact

SEQ ID NO: 319419 - DNA, 15 bp, Homo sapiens
cctcctccatgactc

SEQ ID NO: 319420 - DNA, 15 bp, Homo sapiens
ctcctccatgactct

SEQ ID NO: 319421 - DNA, 15 bp, Homo sapiens
tcctccatgactctt

SEQ ID NO: 319422 - DNA, 15 bp, Homo sapiens
cctccatgactcttt

SEQ ID NO: 319423 - DNA, 15 bp, Homo sapiens
ctccatgactctttc

SEQ ID NO: 319424 - DNA, 15 bp, Homo sapiens
tccatgactctttct

SEQ ID NO: 319425 - DNA, 15 bp, Homo sapiens
ccatgactctttctt

SEQ ID NO: 319426 - DNA, 15 bp, Homo sapiens
catgactctttcttc

SEQ ID NO: 319427 - DNA, 15 bp, Homo sapiens
atgactctttcttca

SEQ ID NO: 319428 - DNA, 15 bp, Homo sapiens
tgactctttcttcat

SEQ ID NO: 319429 - DNA, 15 bp, Homo sapiens
gactctttcttcatt

SEQ ID NO: 319430 - DNA, 15 bp, Homo sapiens
actctttcttcattt

SEQ ID NO: 319431 - DNA, 15 bp, Homo sapiens
ctctttcttcatttg

SEQ ID NO: 319432 - DNA, 15 bp, Homo sapiens
tctttcttcatttgg

SEQ ID NO: 319433 - DNA, 15 bp, Homo sapiens
ctttcttcatttggc

SEQ ID NO: 319434 - DNA, 15 bp, Homo sapiens
tttcttcatttggct

SEQ ID NO: 319435 - DNA, 15 bp, Homo sapiens
ttcttcatttggctt

SEQ ID NO: 319436 - DNA, 15 bp, Homo sapiens
tcttcatttggcttc

SEQ ID NO: 319437 - DNA, 15 bp, Homo sapiens
cttcatttggcttct

SEQ ID NO: 319438 - DNA, 15 bp, Homo sapiens
ttcatttggcttcta

SEQ ID NO: 319439 - DNA, 15 bp, Homo sapiens
tcatttggcttctag

SEQ ID NO: 319440 - DNA, 15 bp, Homo sapiens
catttggcttctagg

SEQ ID NO: 319441 - DNA, 15 bp, Homo sapiens
atttggcttctagga

SEQ ID NO: 319442 - DNA, 15 bp, Homo sapiens
tttggcttctaggac

SEQ ID NO: 319443 - DNA, 15 bp, Homo sapiens
ttggcttctaggaca

SEQ ID NO: 319444 - DNA, 15 bp, Homo sapiens
tggcttctaggacac

SEQ ID NO: 319445 - DNA, 15 bp, Homo sapiens
ggcttctaggacacc

SEQ ID NO: 319446 - DNA, 15 bp, Homo sapiens
gcttctaggacaccc

SEQ ID NO: 319447 - DNA, 15 bp, Homo sapiens
cttctaggacacccc

SEQ ID NO: 319448 - DNA, 15 bp, Homo sapiens
ttctaggacacccca

SEQ ID NO: 319449 - DNA, 15 bp, Homo sapiens
tctaggacaccccac

SEQ ID NO: 319450 - DNA, 15 bp, Homo sapiens
ctaggacaccccaca

SEQ ID NO: 319451 - DNA, 15 bp, Homo sapiens
taggacaccccacac

SEQ ID NO: 319452 - DNA, 15 bp, Homo sapiens
aggacaccccacacg

SEQ ID NO: 319453 - DNA, 15 bp, Homo sapiens
ggacaccccacacgc

SEQ ID NO: 319454 - DNA, 15 bp, Homo sapiens
gacaccccacacgct

SEQ ID NO: 319455 - DNA, 15 bp, Homo sapiens
acaccccacacgctc

SEQ ID NO: 319456 - DNA, 15 bp, Homo sapiens
caccccacacgctcc

SEQ ID NO: 319457 - DNA, 15 bp, Homo sapiens
accccacacgctcct

SEQ ID NO: 319458 - DNA, 15 bp, Homo sapiens
ccccacacgctcctg

SEQ ID NO: 319459 - DNA, 15 bp, Homo sapiens
cccacacgctcctgg

SEQ ID NO: 319460 - DNA, 15 bp, Homo sapiens
ccacacgctcctggt

SEQ ID NO: 319461 - DNA, 15 bp, Homo sapiens
cacacgctcctggtt

SEQ ID NO: 319462 - DNA, 15 bp, Homo sapiens
acacgctcctggttt

SEQ ID NO: 319463 - DNA, 15 bp, Homo sapiens
cacgctcctggtttc

SEQ ID NO: 319464 - DNA, 15 bp, Homo sapiens
acgctcctggtttcc

SEQ ID NO: 319465 - DNA, 15 bp, Homo sapiens
cgctcctggtttccc

SEQ ID NO: 319466 - DNA, 15 bp, Homo sapiens
gctcctggtttccca

SEQ ID NO: 319467 - DNA, 15 bp, Homo sapiens
ctcctggtttcccac

SEQ ID NO: 319468 - DNA, 15 bp, Homo sapiens
tcctggtttcccacc

SEQ ID NO: 319469 - DNA, 15 bp, Homo sapiens
cctggtttcccaccc

SEQ ID NO: 319470 - DNA, 15 bp, Homo sapiens
ctggtttcccaccca

SEQ ID NO: 319471 - DNA, 15 bp, Homo sapiens
tggtttcccacccat

SEQ ID NO: 319472 - DNA, 15 bp, Homo sapiens
ggtttcccacccatt

SEQ ID NO: 319473 - DNA, 15 bp, Homo sapiens
gtttcccacccatta

SEQ ID NO: 319474 - DNA, 15 bp, Homo sapiens
tttcccacccattat

SEQ ID NO: 319475 - DNA, 15 bp, Homo sapiens
ttcccacccattatc

SEQ ID NO: 319476 - DNA, 15 bp, Homo sapiens
tcccacccattatct

SEQ ID NO: 319477 - DNA, 15 bp, Homo sapiens
cccacccattatctt

SEQ ID NO: 319478 - DNA, 15 bp, Homo sapiens
ccacccattatcttt

SEQ ID NO: 319479 - DNA, 15 bp, Homo sapiens
cacccattatctttt

SEQ ID NO: 319480 - DNA, 15 bp, Homo sapiens
acccattatcttttg

SEQ ID NO: 319481 - DNA, 15 bp, Homo sapiens
cccattatcttttgc

SEQ ID NO: 319482 - DNA, 15 bp, Homo sapiens
ccattatcttttgct

SEQ ID NO: 319483 - DNA, 15 bp, Homo sapiens
cattatcttttgctg

SEQ ID NO: 319484 - DNA, 15 bp, Homo sapiens
attatcttttgctga

SEQ ID NO: 319485 - DNA, 15 bp, Homo sapiens
ttatcttttgctgat

SEQ ID NO: 319486 - DNA, 15 bp, Homo sapiens
tatcttttgctgatt

SEQ ID NO: 319487 - DNA, 15 bp, Homo sapiens
atcttttgctgattc

SEQ ID NO: 319488 - DNA, 15 bp, Homo sapiens
tcttttgctgattct

SEQ ID NO: 319489 - DNA, 15 bp, Homo sapiens
cttttgctgattctt

SEQ ID NO: 319490 - DNA, 15 bp, Homo sapiens
ttttgctgattcttc

SEQ ID NO: 319491 - DNA, 15 bp, Homo sapiens
tttgctgattcttcc

SEQ ID NO: 319492 - DNA, 15 bp, Homo sapiens
ttgctgattcttcct

SEQ ID NO: 319493 - DNA, 15 bp, Homo sapiens
tgctgattcttcctc

SEQ ID NO: 319494 - DNA, 15 bp, Homo sapiens
gctgattcttcctct

SEQ ID NO: 319495 - DNA, 15 bp, Homo sapiens
ctgattcttcctctt

SEQ ID NO: 319496 - DNA, 15 bp, Homo sapiens
tgattcttcctctta

SEQ ID NO: 319497 - DNA, 15 bp, Homo sapiens
gattcttcctcttaa

SEQ ID NO: 319498 - DNA, 15 bp, Homo sapiens
attcttcctcttaac

SEQ ID NO: 319499 - DNA, 15 bp, Homo sapiens
ttcttcctcttaacg

SEQ ID NO: 319500 - DNA, 15 bp, Homo sapiens
tcttcctcttaacgt

SEQ ID NO: 319501 - DNA, 15 bp, Homo sapiens
cttcctcttaacgtt

SEQ ID NO: 319502 - DNA, 15 bp, Homo sapiens
ttcctcttaacgttg

SEQ ID NO: 319503 - DNA, 15 bp, Homo sapiens
tcctcttaacgttgg

SEQ ID NO: 319504 - DNA, 15 bp, Homo sapiens
cctcttaacgttgga

SEQ ID NO: 319505 - DNA, 15 bp, Homo sapiens
ctcttaacgttggag

SEQ ID NO: 319506 - DNA, 15 bp, Homo sapiens
tcttaacgttggagg

SEQ ID NO: 319507 - DNA, 15 bp, Homo sapiens
cttaacgttggaggg

SEQ ID NO: 319508 - DNA, 15 bp, Homo sapiens
ttaacgttggagggc

SEQ ID NO: 319509 - DNA, 15 bp, Homo sapiens
taacgttggagggcc

SEQ ID NO: 319510 - DNA, 15 bp, Homo sapiens
aacgttggagggccc

SEQ ID NO: 319511 - DNA, 15 bp, Homo sapiens
acgttggagggccca

SEQ ID NO: 319512 - DNA, 15 bp, Homo sapiens
cgttggagggcccag

SEQ ID NO: 319513 - DNA, 15 bp, Homo sapiens
gttggagggcccagg

SEQ ID NO: 319514 - DNA, 15 bp, Homo sapiens
ttggagggcccagga

SEQ ID NO: 319515 - DNA, 15 bp, Homo sapiens
tggagggcccaggac

SEQ ID NO: 319516 - DNA, 15 bp, Homo sapiens
ggagggcccaggacc

SEQ ID NO: 319517 - DNA, 15 bp, Homo sapiens
gagggcccaggaccc

SEQ ID NO: 319518 - DNA, 15 bp, Homo sapiens
agggcccaggaccca

SEQ ID NO: 319519 - DNA, 15 bp, Homo sapiens
gggcccaggacccag

SEQ ID NO: 319520 - DNA, 15 bp, Homo sapiens
ggcccaggacccagt

SEQ ID NO: 319521 - DNA, 15 bp, Homo sapiens
gcccaggacccagtc

SEQ ID NO: 319522 - DNA, 15 bp, Homo sapiens
cccaggacccagtcc

SEQ ID NO: 319523 - DNA, 15 bp, Homo sapiens
ccaggacccagtcct

SEQ ID NO: 319524 - DNA, 15 bp, Homo sapiens
caggacccagtcctt

SEQ ID NO: 319525 - DNA, 15 bp, Homo sapiens
aggacccagtccttg

SEQ ID NO: 319526 - DNA, 15 bp, Homo sapiens
ggacccagtccttgg

SEQ ID NO: 319527 - DNA, 15 bp, Homo sapiens
gacccagtccttgga

SEQ ID NO: 319528 - DNA, 15 bp, Homo sapiens
acccagtccttggac

SEQ ID NO: 319529 - DNA, 15 bp, Homo sapiens
cccagtccttggacc

SEQ ID NO: 319530 - DNA, 15 bp, Homo sapiens
ccagtccttggacct

SEQ ID NO: 319531 - DNA, 15 bp, Homo sapiens
cagtccttggacctc

SEQ ID NO: 319532 - DNA, 15 bp, Homo sapiens
agtccttggacctcc

SEQ ID NO: 319533 - DNA, 15 bp, Homo sapiens
gtccttggacctcct

SEQ ID NO: 319534 - DNA, 15 bp, Homo sapiens
tccttggacctcctc

SEQ ID NO: 319535 - DNA, 15 bp, Homo sapiens
ccttggacctcctct

SEQ ID NO: 319536 - DNA, 15 bp, Homo sapiens
cttggacctcctctc

SEQ ID NO: 319537 - DNA, 15 bp, Homo sapiens
ttggacctcctctct

SEQ ID NO: 319538 - DNA, 15 bp, Homo sapiens
tggacctcctctctg

SEQ ID NO: 319539 - DNA, 15 bp, Homo sapiens
ggacctcctctctgt

SEQ ID NO: 319540 - DNA, 15 bp, Homo sapiens
gacctcctctctgtc

SEQ ID NO: 319541 - DNA, 15 bp, Homo sapiens
acctcctctctgtcc

SEQ ID NO: 319542 - DNA, 15 bp, Homo sapiens
cctcctctctgtccc

SEQ ID NO: 319543 - DNA, 15 bp, Homo sapiens
ctcctctctgtcccc

SEQ ID NO: 319544 - DNA, 15 bp, Homo sapiens
tcctctctgtcccca

SEQ ID NO: 319545 - DNA, 15 bp, Homo sapiens
cctctctgtccccac

SEQ ID NO: 319546 - DNA, 15 bp, Homo sapiens
ctctctgtccccact

SEQ ID NO: 319547 - DNA, 15 bp, Homo sapiens
tctctgtccccactg

SEQ ID NO: 319548 - DNA, 15 bp, Homo sapiens
ctctgtccccactgt

SEQ ID NO: 319549 - DNA, 15 bp, Homo sapiens
tctgtccccactgtt

SEQ ID NO: 319550 - DNA, 15 bp, Homo sapiens
ctgtccccactgttg

SEQ ID NO: 319551 - DNA, 15 bp, Homo sapiens
tgtccccactgttgc

SEQ ID NO: 319552 - DNA, 15 bp, Homo sapiens
gtccccactgttgcc

SEQ ID NO: 319553 - DNA, 15 bp, Homo sapiens
tccccactgttgccg

SEQ ID NO: 319554 - DNA, 15 bp, Homo sapiens
ccccactgttgccgt

SEQ ID NO: 319555 - DNA, 15 bp, Homo sapiens
cccactgttgccgtt

SEQ ID NO: 319556 - DNA, 15 bp, Homo sapiens
ccactgttgccgttt

SEQ ID NO: 319557 - DNA, 15 bp, Homo sapiens
cactgttgccgtttg

SEQ ID NO: 319558 - DNA, 15 bp, Homo sapiens
actgttgccgtttgt

SEQ ID NO: 319559 - DNA, 15 bp, Homo sapiens
ctgttgccgtttgtc

SEQ ID NO: 319560 - DNA, 15 bp, Homo sapiens
tgttgccgtttgtca

SEQ ID NO: 319561 - DNA, 15 bp, Homo sapiens
gttgccgtttgtcat

SEQ ID NO: 319562 - DNA, 15 bp, Homo sapiens
ttgccgtttgtcatc

SEQ ID NO: 319563 - DNA, 15 bp, Homo sapiens
tgccgtttgtcatct

SEQ ID NO: 319564 - DNA, 15 bp, Homo sapiens
gccgtttgtcatctc

SEQ ID NO: 319565 - DNA, 15 bp, Homo sapiens
ccgtttgtcatctca

SEQ ID NO: 319566 - DNA, 15 bp, Homo sapiens
cgtttgtcatctcac

SEQ ID NO: 319567 - DNA, 15 bp, Homo sapiens
gtttgtcatctcacc

SEQ ID NO: 319568 - DNA, 15 bp, Homo sapiens
tttgtcatctcacca

SEQ ID NO: 319569 - DNA, 15 bp, Homo sapiens
ttgtcatctcaccag

SEQ ID NO: 319570 - DNA, 15 bp, Homo sapiens
tgtcatctcaccagt

SEQ ID NO: 319571 - DNA, 15 bp, Homo sapiens
gtcatctcaccagta

SEQ ID NO: 319572 - DNA, 15 bp, Homo sapiens
tcatctcaccagtat

SEQ ID NO: 319573 - DNA, 15 bp, Homo sapiens
catctcaccagtatc

SEQ ID NO: 319574 - DNA, 15 bp, Homo sapiens
atctcaccagtatcc

SEQ ID NO: 319575 - DNA, 15 bp, Homo sapiens
tctcaccagtatcct

SEQ ID NO: 319576 - DNA, 15 bp, Homo sapiens
ctcaccagtatcctg

SEQ ID NO: 319577 - DNA, 15 bp, Homo sapiens
tcaccagtatcctgg

SEQ ID NO: 319578 - DNA, 15 bp, Homo sapiens
caccagtatcctggt

SEQ ID NO: 319579 - DNA, 15 bp, Homo sapiens
accagtatcctggtt

SEQ ID NO: 319580 - DNA, 15 bp, Homo sapiens
ccagtatcctggttt

SEQ ID NO: 319581 - DNA, 15 bp, Homo sapiens
cagtatcctggttta

SEQ ID NO: 319582 - DNA, 15 bp, Homo sapiens
agtatcctggtttaa

SEQ ID NO: 319583 - DNA, 15 bp, Homo sapiens
gtatcctggtttaaa

SEQ ID NO: 319584 - DNA, 15 bp, Homo sapiens
tatcctggtttaaat

SEQ ID NO: 319585 - DNA, 15 bp, Homo sapiens
atcctggtttaaata

SEQ ID NO: 319586 - DNA, 15 bp, Homo sapiens
tcctggtttaaatac

SEQ ID NO: 319587 - DNA, 15 bp, Homo sapiens
cctggtttaaatact

SEQ ID NO: 319588 - DNA, 15 bp, Homo sapiens
ctggtttaaatacta

SEQ ID NO: 319589 - DNA, 15 bp, Homo sapiens
tggtttaaatactat

SEQ ID NO: 319590 - DNA, 15 bp, Homo sapiens
ggtttaaatactatc

SEQ ID NO: 319591 - DNA, 15 bp, Homo sapiens
gtttaaatactatct

SEQ ID NO: 319592 - DNA, 15 bp, Homo sapiens
tttaaatactatctg

SEQ ID NO: 319593 - DNA, 15 bp, Homo sapiens
ttaaatactatctga

SEQ ID NO: 319594 - DNA, 15 bp, Homo sapiens
taaatactatctgaa

SEQ ID NO: 319595 - DNA, 15 bp, Homo sapiens
aaatactatctgaat

SEQ ID NO: 319596 - DNA, 15 bp, Homo sapiens
aatactatctgaatg

SEQ ID NO: 319597 - DNA, 15 bp, Homo sapiens
atactatctgaatgc

SEQ ID NO: 319598 - DNA, 15 bp, Homo sapiens
tactatctgaatgct

SEQ ID NO: 319599 - DNA, 15 bp, Homo sapiens
actatctgaatgctg

SEQ ID NO: 319600 - DNA, 15 bp, Homo sapiens
ctatctgaatgctgg

SEQ ID NO: 319601 - DNA, 15 bp, Homo sapiens
tatctgaatgctggc

SEQ ID NO: 319602 - DNA, 15 bp, Homo sapiens
atctgaatgctggct

SEQ ID NO: 319603 - DNA, 15 bp, Homo sapiens
tctgaatgctggctc

SEQ ID NO: 319604 - DNA, 15 bp, Homo sapiens
ctgaatgctggctca

SEQ ID NO: 319605 - DNA, 15 bp, Homo sapiens
tgaatgctggctcaa

SEQ ID NO: 319606 - DNA, 15 bp, Homo sapiens
gaatgctggctcaaa

SEQ ID NO: 319607 - DNA, 15 bp, Homo sapiens
aatgctggctcaaat

SEQ ID NO: 319608 - DNA, 15 bp, Homo sapiens
atgctggctcaaatt

SEQ ID NO: 319609 - DNA, 15 bp, Homo sapiens
tgctggctcaaattt

SEQ ID NO: 319610 - DNA, 15 bp, Homo sapiens
gctggctcaaatttc

SEQ ID NO: 319611 - DNA, 15 bp, Homo sapiens
ctggctcaaatttct

SEQ ID NO: 319612 - DNA, 15 bp, Homo sapiens
tggctcaaatttcta

SEQ ID NO: 319613 - DNA, 15 bp, Homo sapiens
ggctcaaatttctat

SEQ ID NO: 319614 - DNA, 15 bp, Homo sapiens
gctcaaatttctatc

SEQ ID NO: 319615 - DNA, 15 bp, Homo sapiens
ctcaaatttctatct

SEQ ID NO: 319616 - DNA, 15 bp, Homo sapiens
tcaaatttctatctc

SEQ ID NO: 319617 - DNA, 15 bp, Homo sapiens
caaatttctatctct

SEQ ID NO: 319618 - DNA, 15 bp, Homo sapiens
aaatttctatctcta

SEQ ID NO: 319619 - DNA, 15 bp, Homo sapiens
aatttctatctctag

SEQ ID NO: 319620 - DNA, 15 bp, Homo sapiens
atttctatctctagc

SEQ ID NO: 319621 - DNA, 15 bp, Homo sapiens
tttctatctctagcc

SEQ ID NO: 319622 - DNA, 15 bp, Homo sapiens
ttctatctctagccc

SEQ ID NO: 319623 - DNA, 15 bp, Homo sapiens
tctatctctagccca

SEQ ID NO: 319624 - DNA, 15 bp, Homo sapiens
ctatctctagcccag

SEQ ID NO: 319625 - DNA, 15 bp, Homo sapiens
tatctctagcccaga

SEQ ID NO: 319626 - DNA, 15 bp, Homo sapiens
atctctagcccagac

SEQ ID NO: 319627 - DNA, 15 bp, Homo sapiens
tctctagcccagacc

SEQ ID NO: 319628 - DNA, 15 bp, Homo sapiens
ctctagcccagacct

SEQ ID NO: 319629 - DNA, 15 bp, Homo sapiens
tctagcccagacctc

SEQ ID NO: 319630 - DNA, 15 bp, Homo sapiens
ctagcccagacctct

SEQ ID NO: 319631 - DNA, 15 bp, Homo sapiens
tagcccagacctctt

SEQ ID NO: 319632 - DNA, 15 bp, Homo sapiens
agcccagacctcttc

SEQ ID NO: 319633 - DNA, 15 bp, Homo sapiens
gcccagacctcttcc

SEQ ID NO: 319634 - DNA, 15 bp, Homo sapiens
cccagacctcttcct

SEQ ID NO: 319635 - DNA, 15 bp, Homo sapiens
ccagacctcttcctc

SEQ ID NO: 319636 - DNA, 15 bp, Homo sapiens
cagacctcttcctct

SEQ ID NO: 319637 - DNA, 15 bp, Homo sapiens
agacctcttcctctg

SEQ ID NO: 319638 - DNA, 15 bp, Homo sapiens
gacctcttcctctga

SEQ ID NO: 319639 - DNA, 15 bp, Homo sapiens
acctcttcctctgaa

SEQ ID NO: 319640 - DNA, 15 bp, Homo sapiens
cctcttcctctgaac

SEQ ID NO: 319641 - DNA, 15 bp, Homo sapiens
ctcttcctctgaact

SEQ ID NO: 319642 - DNA, 15 bp, Homo sapiens
tcttcctctgaactg

SEQ ID NO: 319643 - DNA, 15 bp, Homo sapiens
cttcctctgaactgc

SEQ ID NO: 319644 - DNA, 15 bp, Homo sapiens
ttcctctgaactgca

SEQ ID NO: 319645 - DNA, 15 bp, Homo sapiens
tcctctgaactgcat

SEQ ID NO: 319646 - DNA, 15 bp, Homo sapiens
cctctgaactgcata

SEQ ID NO: 319647 - DNA, 15 bp, Homo sapiens
ctctgaactgcatac

SEQ ID NO: 319648 - DNA, 15 bp, Homo sapiens
tctgaactgcatact

SEQ ID NO: 319649 - DNA, 15 bp, Homo sapiens
ctgaactgcatactt

SEQ ID NO: 319650 - DNA, 15 bp, Homo sapiens
tgaactgcatacttg

SEQ ID NO: 319651 - DNA, 15 bp, Homo sapiens
gaactgcatacttgc

SEQ ID NO: 319652 - DNA, 15 bp, Homo sapiens
aactgcatacttgca

SEQ ID NO: 319653 - DNA, 15 bp, Homo sapiens
actgcatacttgcat

SEQ ID NO: 319654 - DNA, 15 bp, Homo sapiens
ctgcatacttgcatt

SEQ ID NO: 319655 - DNA, 15 bp, Homo sapiens
tgcatacttgcattt

SEQ ID NO: 319656 - DNA, 15 bp, Homo sapiens
gcatacttgcatttc

SEQ ID NO: 319657 - DNA, 15 bp, Homo sapiens
catacttgcatttcc

SEQ ID NO: 319658 - DNA, 15 bp, Homo sapiens
atacttgcatttcca

SEQ ID NO: 319659 - DNA, 15 bp, Homo sapiens
tacttgcatttccag

SEQ ID NO: 319660 - DNA, 15 bp, Homo sapiens
acttgcatttccagt

SEQ ID NO: 319661 - DNA, 15 bp, Homo sapiens
cttgcatttccagtt

SEQ ID NO: 319662 - DNA, 15 bp, Homo sapiens
ttgcatttccagttg

SEQ ID NO: 319663 - DNA, 15 bp, Homo sapiens
tgcatttccagttgt

SEQ ID NO: 319664 - DNA, 15 bp, Homo sapiens
gcatttccagttgtt

SEQ ID NO: 319665 - DNA, 15 bp, Homo sapiens
catttccagttgttt

SEQ ID NO: 319666 - DNA, 15 bp, Homo sapiens
atttccagttgttta

SEQ ID NO: 319667 - DNA, 15 bp, Homo sapiens
tttccagttgtttac

SEQ ID NO: 319668 - DNA, 15 bp, Homo sapiens
ttccagttgtttact

SEQ ID NO: 319669 - DNA, 15 bp, Homo sapiens
tccagttgtttactt

SEQ ID NO: 319670 - DNA, 15 bp, Homo sapiens
ccagttgtttacttc

SEQ ID NO: 319671 - DNA, 15 bp, Homo sapiens
cagttgtttacttca

SEQ ID NO: 319672 - DNA, 15 bp, Homo sapiens
agttgtttacttcac

SEQ ID NO: 319673 - DNA, 15 bp, Homo sapiens
gttgtttacttcaca

SEQ ID NO: 319674 - DNA, 15 bp, Homo sapiens
ttgtttacttcacat

SEQ ID NO: 319675 - DNA, 15 bp, Homo sapiens
tgtttacttcacatc

SEQ ID NO: 319676 - DNA, 15 bp, Homo sapiens
gtttacttcacatct

SEQ ID NO: 319677 - DNA, 15 bp, Homo sapiens
tttacttcacatctt

SEQ ID NO: 319678 - DNA, 15 bp, Homo sapiens
ttacttcacatcttc

SEQ ID NO: 319679 - DNA, 15 bp, Homo sapiens
tacttcacatcttct

SEQ ID NO: 319680 - DNA, 15 bp, Homo sapiens
acttcacatcttcta

SEQ ID NO: 319681 - DNA, 15 bp, Homo sapiens
cttcacatcttctat

SEQ ID NO: 319682 - DNA, 15 bp, Homo sapiens
ttcacatcttctatg

SEQ ID NO: 319683 - DNA, 15 bp, Homo sapiens
tcacatcttctatgt

SEQ ID NO: 319684 - DNA, 15 bp, Homo sapiens
cacatcttctatgtt

SEQ ID NO: 319685 - DNA, 15 bp, Homo sapiens
acatcttctatgttc

SEQ ID NO: 319686 - DNA, 15 bp, Homo sapiens
catcttctatgttca

SEQ ID NO: 319687 - DNA, 15 bp, Homo sapiens
atcttctatgttcag

SEQ ID NO: 319688 - DNA, 15 bp, Homo sapiens
tcttctatgttcaga

SEQ ID NO: 319689 - DNA, 15 bp, Homo sapiens
cttctatgttcagat

SEQ ID NO: 319690 - DNA, 15 bp, Homo sapiens
ttctatgttcagatc

SEQ ID NO: 319691 - DNA, 15 bp, Homo sapiens
tctatgttcagatct

SEQ ID NO: 319692 - DNA, 15 bp, Homo sapiens
ctatgttcagatctg

SEQ ID NO: 319693 - DNA, 15 bp, Homo sapiens
tatgttcagatctga

SEQ ID NO: 319694 - DNA, 15 bp, Homo sapiens
atgttcagatctgaa

SEQ ID NO: 319695 - DNA, 15 bp, Homo sapiens
tgttcagatctgaaa

SEQ ID NO: 319696 - DNA, 15 bp, Homo sapiens
gttcagatctgaaaa

SEQ ID NO: 319697 - DNA, 15 bp, Homo sapiens
ttcagatctgaaaat

SEQ ID NO: 319698 - DNA, 15 bp, Homo sapiens
tcagatctgaaaatc

SEQ ID NO: 319699 - DNA, 15 bp, Homo sapiens
cagatctgaaaatct

SEQ ID NO: 319700 - DNA, 15 bp, Homo sapiens
agatctgaaaatctg

SEQ ID NO: 319701 - DNA, 15 bp, Homo sapiens
gatctgaaaatctga

SEQ ID NO: 319702 - DNA, 15 bp, Homo sapiens
atctgaaaatctgaa

SEQ ID NO: 319703 - DNA, 15 bp, Homo sapiens
tctgaaaatctgaac

SEQ ID NO: 319704 - DNA, 15 bp, Homo sapiens
ctgaaaatctgaact

SEQ ID NO: 319705 - DNA, 15 bp, Homo sapiens
tgaaaatctgaactc

SEQ ID NO: 319706 - DNA, 15 bp, Homo sapiens
gaaaatctgaactcc

SEQ ID NO: 319707 - DNA, 15 bp, Homo sapiens
aaaatctgaactcct

SEQ ID NO: 319708 - DNA, 15 bp, Homo sapiens
aaatctgaactcctg

SEQ ID NO: 319709 - DNA, 15 bp, Homo sapiens
aatctgaactcctga

SEQ ID NO: 319710 - DNA, 15 bp, Homo sapiens
atctgaactcctgat

SEQ ID NO: 319711 - DNA, 15 bp, Homo sapiens
tctgaactcctgatc

SEQ ID NO: 319712 - DNA, 15 bp, Homo sapiens
ctgaactcctgatct

SEQ ID NO: 319713 - DNA, 15 bp, Homo sapiens
tgaactcctgatctc

SEQ ID NO: 319714 - DNA, 15 bp, Homo sapiens
gaactcctgatctcc

SEQ ID NO: 319715 - DNA, 15 bp, Homo sapiens
aactcctgatctccc

SEQ ID NO: 319716 - DNA, 15 bp, Homo sapiens
actcctgatctcccg

SEQ ID NO: 319717 - DNA, 15 bp, Homo sapiens
ctcctgatctcccgt

SEQ ID NO: 319718 - DNA, 15 bp, Homo sapiens
tcctgatctcccgta

SEQ ID NO: 319719 - DNA, 15 bp, Homo sapiens
cctgatctcccgtaa

SEQ ID NO: 319720 - DNA, 15 bp, Homo sapiens
ctgatctcccgtaaa

SEQ ID NO: 319721 - DNA, 15 bp, Homo sapiens
tgatctcccgtaaac

SEQ ID NO: 319722 - DNA, 15 bp, Homo sapiens
gatctcccgtaaacc

SEQ ID NO: 319723 - DNA, 15 bp, Homo sapiens
atctcccgtaaaccc

SEQ ID NO: 319724 - DNA, 15 bp, Homo sapiens
tctcccgtaaacccc

SEQ ID NO: 319725 - DNA, 15 bp, Homo sapiens
ctcccgtaaacccca

SEQ ID NO: 319726 - DNA, 15 bp, Homo sapiens
tcccgtaaaccccaa

SEQ ID NO: 319727 - DNA, 15 bp, Homo sapiens
cccgtaaaccccaaa

SEQ ID NO: 319728 - DNA, 15 bp, Homo sapiens
ccgtaaaccccaaag

SEQ ID NO: 319729 - DNA, 15 bp, Homo sapiens
cgtaaaccccaaagc

SEQ ID NO: 319730 - DNA, 15 bp, Homo sapiens
gtaaaccccaaagct

SEQ ID NO: 319731 - DNA, 15 bp, Homo sapiens
taaaccccaaagctg

SEQ ID NO: 319732 - DNA, 15 bp, Homo sapiens
aaaccccaaagctga

SEQ ID NO: 319733 - DNA, 15 bp, Homo sapiens
aaccccaaagctgat

SEQ ID NO: 319734 - DNA, 15 bp, Homo sapiens
accccaaagctgatc

SEQ ID NO: 319735 - DNA, 15 bp, Homo sapiens
ccccaaagctgatcc

SEQ ID NO: 319736 - DNA, 15 bp, Homo sapiens
cccaaagctgatccc

SEQ ID NO: 319737 - DNA, 15 bp, Homo sapiens
ccaaagctgatccca

SEQ ID NO: 319738 - DNA, 15 bp, Homo sapiens
caaagctgatcccac

SEQ ID NO: 319739 - DNA, 15 bp, Homo sapiens
aaagctgatcccaca

SEQ ID NO: 319740 - DNA, 15 bp, Homo sapiens
aagctgatcccacag

SEQ ID NO: 319741 - DNA, 15 bp, Homo sapiens
agctgatcccacagt

SEQ ID NO: 319742 - DNA, 15 bp, Homo sapiens
gctgatcccacagtc

SEQ ID NO: 319743 - DNA, 15 bp, Homo sapiens
ctgatcccacagtct

SEQ ID NO: 319744 - DNA, 15 bp, Homo sapiens
tgatcccacagtctt

SEQ ID NO: 319745 - DNA, 15 bp, Homo sapiens
gatcccacagtcttg

SEQ ID NO: 319746 - DNA, 15 bp, Homo sapiens
atcccacagtcttgc

SEQ ID NO: 319747 - DNA, 15 bp, Homo sapiens
tcccacagtcttgct

SEQ ID NO: 319748 - DNA, 15 bp, Homo sapiens
cccacagtcttgctt

SEQ ID NO: 319749 - DNA, 15 bp, Homo sapiens
ccacagtcttgcttg

SEQ ID NO: 319750 - DNA, 15 bp, Homo sapiens
cacagtcttgcttgt

SEQ ID NO: 319751 - DNA, 15 bp, Homo sapiens
acagtcttgcttgtc

SEQ ID NO: 319752 - DNA, 15 bp, Homo sapiens
cagtcttgcttgtct

SEQ ID NO: 319753 - DNA, 15 bp, Homo sapiens
agtcttgcttgtctc

SEQ ID NO: 319754 - DNA, 15 bp, Homo sapiens
gtcttgcttgtctca

SEQ ID NO: 319755 - DNA, 15 bp, Homo sapiens
tcttgcttgtctcag

SEQ ID NO: 319756 - DNA, 15 bp, Homo sapiens
cttgcttgtctcaga

SEQ ID NO: 319757 - DNA, 15 bp, Homo sapiens
ttgcttgtctcagat

SEQ ID NO: 319758 - DNA, 15 bp, Homo sapiens
tgcttgtctcagata

SEQ ID NO: 319759 - DNA, 15 bp, Homo sapiens
gcttgtctcagataa

SEQ ID NO: 319760 - DNA, 15 bp, Homo sapiens
cttgtctcagataaa

SEQ ID NO: 319761 - DNA, 15 bp, Homo sapiens
ttgtctcagataaag

SEQ ID NO: 319762 - DNA, 15 bp, Homo sapiens
tgtctcagataaagg

SEQ ID NO: 319763 - DNA, 15 bp, Homo sapiens
gtctcagataaaggc

SEQ ID NO: 319764 - DNA, 15 bp, Homo sapiens
tctcagataaaggca

SEQ ID NO: 319765 - DNA, 15 bp, Homo sapiens
ctcagataaaggcaa

SEQ ID NO: 319766 - DNA, 15 bp, Homo sapiens
tcagataaaggcaat

SEQ ID NO: 319767 - DNA, 15 bp, Homo sapiens
cagataaaggcaatg

SEQ ID NO: 319768 - DNA, 15 bp, Homo sapiens
agataaaggcaatgt

SEQ ID NO: 319769 - DNA, 15 bp, Homo sapiens
gataaaggcaatgtg

SEQ ID NO: 319770 - DNA, 15 bp, Homo sapiens
ataaaggcaatgtga

SEQ ID NO: 319771 - DNA, 15 bp, Homo sapiens
taaaggcaatgtgat

SEQ ID NO: 319772 - DNA, 15 bp, Homo sapiens
aaaggcaatgtgatt

SEQ ID NO: 319773 - DNA, 15 bp, Homo sapiens
aaggcaatgtgattc

SEQ ID NO: 319774 - DNA, 15 bp, Homo sapiens
aggcaatgtgattct

SEQ ID NO: 319775 - DNA, 15 bp, Homo sapiens
ggcaatgtgattctt

SEQ ID NO: 319776 - DNA, 15 bp, Homo sapiens
gcaatgtgattcttc

SEQ ID NO: 319777 - DNA, 15 bp, Homo sapiens
caatgtgattcttcc

SEQ ID NO: 319778 - DNA, 15 bp, Homo sapiens
aatgtgattcttcca

SEQ ID NO: 319779 - DNA, 15 bp, Homo sapiens
atgtgattcttccaa

SEQ ID NO: 319780 - DNA, 15 bp, Homo sapiens
aaaaaacaaacaagt

SEQ ID NO: 319781 - DNA, 15 bp, Homo sapiens
aaaaacaaacaagtg

SEQ ID NO: 319782 - DNA, 15 bp, Homo sapiens
aaaacaaacaagtgt

SEQ ID NO: 319783 - DNA, 15 bp, Homo sapiens
aaacaaacaagtgtg

SEQ ID NO: 319784 - DNA, 15 bp, Homo sapiens
aacaaacaagtgtgc

SEQ ID NO: 319785 - DNA, 15 bp, Homo sapiens
acaaacaagtgtgca

SEQ ID NO: 319786 - DNA, 15 bp, Homo sapiens
caaacaagtgtgcaa

SEQ ID NO: 319787 - DNA, 15 bp, Homo sapiens
aaacaagtgtgcaat

SEQ ID NO: 319788 - DNA, 15 bp, Homo sapiens
aacaagtgtgcaatc

SEQ ID NO: 319789 - DNA, 15 bp, Homo sapiens
acaagtgtgcaatcc

SEQ ID NO: 319790 - DNA, 15 bp, Homo sapiens
caagtgtgcaatccc

SEQ ID NO: 319791 - DNA, 15 bp, Homo sapiens
aagtgtgcaatccct

SEQ ID NO: 319792 - DNA, 15 bp, Homo sapiens
agtgtgcaatccctg

SEQ ID NO: 319793 - DNA, 15 bp, Homo sapiens
gtgtgcaatccctga

SEQ ID NO: 319794 - DNA, 15 bp, Homo sapiens
tgtgcaatccctgag

SEQ ID NO: 319795 - DNA, 15 bp, Homo sapiens
gtgcaatccctgaga

SEQ ID NO: 319796 - DNA, 15 bp, Homo sapiens
tgcaatccctgagaa

SEQ ID NO: 319797 - DNA, 15 bp, Homo sapiens
gcaatccctgagaaa

SEQ ID NO: 319798 - DNA, 15 bp, Homo sapiens
caatccctgagaaaa

SEQ ID NO: 319799 - DNA, 15 bp, Homo sapiens
aatccctgagaaaaa

SEQ ID NO: 319800 - DNA, 15 bp, Homo sapiens
atccctgagaaaaat

SEQ ID NO: 319801 - DNA, 15 bp, Homo sapiens
tccctgagaaaaata

SEQ ID NO: 319802 - DNA, 15 bp, Homo sapiens
ccctgagaaaaatat

SEQ ID NO: 319803 - DNA, 15 bp, Homo sapiens
cctgagaaaaatatc

SEQ ID NO: 319804 - DNA, 15 bp, Homo sapiens
ctgagaaaaatatca

SEQ ID NO: 319805 - DNA, 15 bp, Homo sapiens
tgagaaaaatatcag

SEQ ID NO: 319806 - DNA, 15 bp, Homo sapiens
gagaaaaatatcagt

SEQ ID NO: 319807 - DNA, 15 bp, Homo sapiens
agaaaaatatcagtt

SEQ ID NO: 319808 - DNA, 15 bp, Homo sapiens
gaaaaatatcagttc

SEQ ID NO: 319809 - DNA, 15 bp, Homo sapiens
aaaaatatcagttca

SEQ ID NO: 319810 - DNA, 15 bp, Homo sapiens
aaaatatcagttcaa

SEQ ID NO: 319811 - DNA, 15 bp, Homo sapiens
aaatatcagttcaat

SEQ ID NO: 319812 - DNA, 15 bp, Homo sapiens
aatatcagttcaatc

SEQ ID NO: 319813 - DNA, 15 bp, Homo sapiens
atatcagttcaatct

SEQ ID NO: 319814 - DNA, 15 bp, Homo sapiens
tatcagttcaatctt

SEQ ID NO: 319815 - DNA, 15 bp, Homo sapiens
atcagttcaatcttt

SEQ ID NO: 319816 - DNA, 15 bp, Homo sapiens
tcagttcaatctttg

SEQ ID NO: 319817 - DNA, 15 bp, Homo sapiens
cagttcaatctttgt

SEQ ID NO: 319818 - DNA, 15 bp, Homo sapiens
agttcaatctttgtt

SEQ ID NO: 319819 - DNA, 15 bp, Homo sapiens
gttcaatctttgttg

SEQ ID NO: 319820 - DNA, 15 bp, Homo sapiens
ttcaatctttgttga

SEQ ID NO: 319821 - DNA, 15 bp, Homo sapiens
tcaatctttgttgat

SEQ ID NO: 319822 - DNA, 15 bp, Homo sapiens
caatctttgttgatc

SEQ ID NO: 319823 - DNA, 15 bp, Homo sapiens
aatctttgttgatct

SEQ ID NO: 319824 - DNA, 15 bp, Homo sapiens
atctttgttgatctt

SEQ ID NO: 319825 - DNA, 15 bp, Homo sapiens
tctttgttgatcttt

SEQ ID NO: 319826 - DNA, 15 bp, Homo sapiens
ctttgttgatcttta

SEQ ID NO: 319827 - DNA, 15 bp, Homo sapiens
tttgttgatctttat

SEQ ID NO: 319828 - DNA, 15 bp, Homo sapiens
ttgttgatctttatt

SEQ ID NO: 319829 - DNA, 15 bp, Homo sapiens
tgttgatctttattg

SEQ ID NO: 319830 - DNA, 15 bp, Homo sapiens
gttgatctttattgt

SEQ ID NO: 319831 - DNA, 15 bp, Homo sapiens
ttgatctttattgtc

SEQ ID NO: 319832 - DNA, 15 bp, Homo sapiens
tgatctttattgtcc

SEQ ID NO: 319833 - DNA, 15 bp, Homo sapiens
gatctttattgtccc

SEQ ID NO: 319834 - DNA, 15 bp, Homo sapiens
atctttattgtcccg

SEQ ID NO: 319835 - DNA, 15 bp, Homo sapiens
tctttattgtcccga

SEQ ID NO: 319836 - DNA, 15 bp, Homo sapiens
ctttattgtcccgat

SEQ ID NO: 319837 - DNA, 15 bp, Homo sapiens
tttattgtcccgatt

SEQ ID NO: 319838 - DNA, 15 bp, Homo sapiens
ttattgtcccgattg

SEQ ID NO: 319839 - DNA, 15 bp, Homo sapiens
tattgtcccgattga

SEQ ID NO: 319840 - DNA, 15 bp, Homo sapiens
attgtcccgattgat

SEQ ID NO: 319841 - DNA, 15 bp, Homo sapiens
ttgtcccgattgatt

SEQ ID NO: 319842 - DNA, 15 bp, Homo sapiens
tgtcccgattgatta

SEQ ID NO: 319843 - DNA, 15 bp, Homo sapiens
gtcccgattgattag

SEQ ID NO: 319844 - DNA, 15 bp, Homo sapiens
tcccgattgattagc

SEQ ID NO: 319845 - DNA, 15 bp, Homo sapiens
cccgattgattagct

SEQ ID NO: 319846 - DNA, 15 bp, Homo sapiens
ccgattgattagctg

SEQ ID NO: 319847 - DNA, 15 bp, Homo sapiens
cgattgattagctgc

SEQ ID NO: 319848 - DNA, 15 bp, Homo sapiens
gattgattagctgca

SEQ ID NO: 319849 - DNA, 15 bp, Homo sapiens
attgattagctgcat

SEQ ID NO: 319850 - DNA, 15 bp, Homo sapiens
ttgattagctgcatg

SEQ ID NO: 319851 - DNA, 15 bp, Homo sapiens
tgattagctgcatgt

SEQ ID NO: 319852 - DNA, 15 bp, Homo sapiens
gattagctgcatgtc

SEQ ID NO: 319853 - DNA, 15 bp, Homo sapiens
attagctgcatgtca

SEQ ID NO: 319854 - DNA, 15 bp, Homo sapiens
ttagctgcatgtcag

SEQ ID NO: 319855 - DNA, 15 bp, Homo sapiens
tagctgcatgtcagc

SEQ ID NO: 319856 - DNA, 15 bp, Homo sapiens
agctgcatgtcagcc

SEQ ID NO: 319857 - DNA, 15 bp, Homo sapiens
gctgcatgtcagcct

SEQ ID NO: 319858 - DNA, 15 bp, Homo sapiens
ctgcatgtcagcctt

SEQ ID NO: 319859 - DNA, 15 bp, Homo sapiens
tgcatgtcagccttt

SEQ ID NO: 319860 - DNA, 15 bp, Homo sapiens
gcatgtcagcctttg

SEQ ID NO: 319861 - DNA, 15 bp, Homo sapiens
catgtcagcctttga

SEQ ID NO: 319862 - DNA, 15 bp, Homo sapiens
atgtcagcctttgac

SEQ ID NO: 319863 - DNA, 15 bp, Homo sapiens
tgtcagcctttgact

SEQ ID NO: 319864 - DNA, 15 bp, Homo sapiens
gtcagcctttgactg

SEQ ID NO: 319865 - DNA, 15 bp, Homo sapiens
tcagcctttgactgt

SEQ ID NO: 319866 - DNA, 15 bp, Homo sapiens
cagcctttgactgtg

SEQ ID NO: 319867 - DNA, 15 bp, Homo sapiens
agcctttgactgtgt

SEQ ID NO: 319868 - DNA, 15 bp, Homo sapiens
gcctttgactgtgtt

SEQ ID NO: 319869 - DNA, 15 bp, Homo sapiens
cctttgactgtgttt

SEQ ID NO: 319870 - DNA, 15 bp, Homo sapiens
ctttgactgtgtttc

SEQ ID NO: 319871 - DNA, 15 bp, Homo sapiens
tttgactgtgtttcc

SEQ ID NO: 319872 - DNA, 15 bp, Homo sapiens
ttgactgtgtttccc

SEQ ID NO: 319873 - DNA, 15 bp, Homo sapiens
tgactgtgtttccca

SEQ ID NO: 319874 - DNA, 15 bp, Homo sapiens
gactgtgtttcccag

SEQ ID NO: 319875 - DNA, 15 bp, Homo sapiens
actgtgtttcccaga

SEQ ID NO: 319876 - DNA, 15 bp, Homo sapiens
ctgtgtttcccagat

SEQ ID NO: 319877 - DNA, 15 bp, Homo sapiens
tgtgtttcccagatg

SEQ ID NO: 319878 - DNA, 15 bp, Homo sapiens
gtgtttcccagatgc

SEQ ID NO: 319879 - DNA, 15 bp, Homo sapiens
tgtttcccagatgct

SEQ ID NO: 319880 - DNA, 15 bp, Homo sapiens
gtttcccagatgctc

SEQ ID NO: 319881 - DNA, 15 bp, Homo sapiens
tttcccagatgctca

SEQ ID NO: 319882 - DNA, 15 bp, Homo sapiens
ttcccagatgctcac

SEQ ID NO: 319883 - DNA, 15 bp, Homo sapiens
tcccagatgctcacg

SEQ ID NO: 319884 - DNA, 15 bp, Homo sapiens
cccagatgctcacga

SEQ ID NO: 319885 - DNA, 15 bp, Homo sapiens
ccagatgctcacgac

SEQ ID NO: 319886 - DNA, 15 bp, Homo sapiens
cagatgctcacgaca

SEQ ID NO: 319887 - DNA, 15 bp, Homo sapiens
agatgctcacgacag

SEQ ID NO: 319888 - DNA, 15 bp, Homo sapiens
gatgctcacgacaga

SEQ ID NO: 319889 - DNA, 15 bp, Homo sapiens
atgctcacgacagat

SEQ ID NO: 319890 - DNA, 15 bp, Homo sapiens
tgctcacgacagatc

SEQ ID NO: 319891 - DNA, 15 bp, Homo sapiens
gctcacgacagatcg

SEQ ID NO: 319892 - DNA, 15 bp, Homo sapiens
ctcacgacagatcga

SEQ ID NO: 319893 - DNA, 15 bp, Homo sapiens
tcacgacagatcgat

SEQ ID NO: 319894 - DNA, 15 bp, Homo sapiens
cacgacagatcgatc

SEQ ID NO: 319895 - DNA, 15 bp, Homo sapiens
acgacagatcgatca

SEQ ID NO: 319896 - DNA, 15 bp, Homo sapiens
cgacagatcgatcac

SEQ ID NO: 319897 - DNA, 15 bp, Homo sapiens
gacagatcgatcact

SEQ ID NO: 319898 - DNA, 15 bp, Homo sapiens
acagatcgatcactt

SEQ ID NO: 319899 - DNA, 15 bp, Homo sapiens
cagatcgatcacttg

SEQ ID NO: 319900 - DNA, 15 bp, Homo sapiens
agatcgatcacttga

SEQ ID NO: 319901 - DNA, 15 bp, Homo sapiens
gatcgatcacttgat

SEQ ID NO: 319902 - DNA, 15 bp, Homo sapiens
atcgatcacttgatg

SEQ ID NO: 319903 - DNA, 15 bp, Homo sapiens
tcgatcacttgatgt

SEQ ID NO: 319904 - DNA, 15 bp, Homo sapiens
cgatcacttgatgtt

SEQ ID NO: 319905 - DNA, 15 bp, Homo sapiens
gatcacttgatgttg

SEQ ID NO: 319906 - DNA, 15 bp, Homo sapiens
atcacttgatgttgt

SEQ ID NO: 319907 - DNA, 15 bp, Homo sapiens
tcacttgatgttgtt

SEQ ID NO: 319908 - DNA, 15 bp, Homo sapiens
cacttgatgttgttt

SEQ ID NO: 319909 - DNA, 15 bp, Homo sapiens
acttgatgttgtttt

SEQ ID NO: 319910 - DNA, 15 bp, Homo sapiens
cttgatgttgttttc

SEQ ID NO: 319911 - DNA, 15 bp, Homo sapiens
ttgatgttgttttca

SEQ ID NO: 319912 - DNA, 15 bp, Homo sapiens
tgatgttgttttcaa

SEQ ID NO: 319913 - DNA, 15 bp, Homo sapiens
gatgttgttttcaac

SEQ ID NO: 319914 - DNA, 15 bp, Homo sapiens
atgttgttttcaaca

SEQ ID NO: 319915 - DNA, 15 bp, Homo sapiens
tgttgttttcaacag

SEQ ID NO: 319916 - DNA, 15 bp, Homo sapiens
gttgttttcaacagg

SEQ ID NO: 319917 - DNA, 15 bp, Homo sapiens
ttgttttcaacaggc

SEQ ID NO: 319918 - DNA, 15 bp, Homo sapiens
tgttttcaacaggca

SEQ ID NO: 319919 - DNA, 15 bp, Homo sapiens
gttttcaacaggcag

SEQ ID NO: 319920 - DNA, 15 bp, Homo sapiens
ttttcaacaggcagt

SEQ ID NO: 319921 - DNA, 15 bp, Homo sapiens
tttcaacaggcagtc

SEQ ID NO: 319922 - DNA, 15 bp, Homo sapiens
ttcaacaggcagtca

SEQ ID NO: 319923 - DNA, 15 bp, Homo sapiens
tcaacaggcagtcat

SEQ ID NO: 319924 - DNA, 15 bp, Homo sapiens
caacaggcagtcatg

SEQ ID NO: 319925 - DNA, 15 bp, Homo sapiens
aacaggcagtcatga

SEQ ID NO: 319926 - DNA, 15 bp, Homo sapiens
acaggcagtcatgaa

SEQ ID NO: 319927 - DNA, 15 bp, Homo sapiens
caggcagtcatgaaa

SEQ ID NO: 319928 - DNA, 15 bp, Homo sapiens
aggcagtcatgaaat

SEQ ID NO: 319929 - DNA, 15 bp, Homo sapiens
ggcagtcatgaaatg

SEQ ID NO: 319930 - DNA, 15 bp, Homo sapiens
gcagtcatgaaatga

SEQ ID NO: 319931 - DNA, 15 bp, Homo sapiens
cagtcatgaaatgag

SEQ ID NO: 319932 - DNA, 15 bp, Homo sapiens
agtcatgaaatgagc

SEQ ID NO: 319933 - DNA, 15 bp, Homo sapiens
gtcatgaaatgagca

SEQ ID NO: 319934 - DNA, 15 bp, Homo sapiens
tcatgaaatgagcag

SEQ ID NO: 319935 - DNA, 15 bp, Homo sapiens
catgaaatgagcaga

SEQ ID NO: 319936 - DNA, 15 bp, Homo sapiens
atgaaatgagcagac

SEQ ID NO: 319937 - DNA, 15 bp, Homo sapiens
tgaaatgagcagact

SEQ ID NO: 319938 - DNA, 15 bp, Homo sapiens
gaaatgagcagactg

SEQ ID NO: 319939 - DNA, 15 bp, Homo sapiens
aaatgagcagactga

SEQ ID NO: 319940 - DNA, 15 bp, Homo sapiens
aatgagcagactgag

SEQ ID NO: 319941 - DNA, 15 bp, Homo sapiens
atgagcagactgagg

SEQ ID NO: 319942 - DNA, 15 bp, Homo sapiens
tgagcagactgaggt

SEQ ID NO: 319943 - DNA, 15 bp, Homo sapiens
gagcagactgaggtc

SEQ ID NO: 319944 - DNA, 15 bp, Homo sapiens
agcagactgaggtca

SEQ ID NO: 319945 - DNA, 15 bp, Homo sapiens
gcagactgaggtcag

SEQ ID NO: 319946 - DNA, 15 bp, Homo sapiens
cagactgaggtcagt

SEQ ID NO: 319947 - DNA, 15 bp, Homo sapiens
agactgaggtcagtg

SEQ ID NO: 319948 - DNA, 15 bp, Homo sapiens
gactgaggtcagtgt

SEQ ID NO: 319949 - DNA, 15 bp, Homo sapiens
actgaggtcagtgta

SEQ ID NO: 319950 - DNA, 15 bp, Homo sapiens
ctgaggtcagtgtag

SEQ ID NO: 319951 - DNA, 15 bp, Homo sapiens
tgaggtcagtgtagt

SEQ ID NO: 319952 - DNA, 15 bp, Homo sapiens
gaggtcagtgtagta

SEQ ID NO: 319953 - DNA, 15 bp, Homo sapiens
aggtcagtgtagtat

SEQ ID NO: 319954 - DNA, 15 bp, Homo sapiens
ggtcagtgtagtata

SEQ ID NO: 319955 - DNA, 15 bp, Homo sapiens
gtcagtgtagtatag

SEQ ID NO: 319956 - DNA, 15 bp, Homo sapiens
tcagtgtagtataga

SEQ ID NO: 319957 - DNA, 15 bp, Homo sapiens
cagtgtagtatagat

SEQ ID NO: 319958 - DNA, 15 bp, Homo sapiens
agtgtagtatagata

SEQ ID NO: 319959 - DNA, 15 bp, Homo sapiens
gtgtagtatagatat

SEQ ID NO: 319960 - DNA, 15 bp, Homo sapiens
tgtagtatagatatt

SEQ ID NO: 319961 - DNA, 15 bp, Homo sapiens
gtagtatagatattt

SEQ ID NO: 319962 - DNA, 15 bp, Homo sapiens
tagtatagatatttg

SEQ ID NO: 319963 - DNA, 15 bp, Homo sapiens
agtatagatatttgt

SEQ ID NO: 319964 - DNA, 15 bp, Homo sapiens
gtatagatatttgtc

SEQ ID NO: 319965 - DNA, 15 bp, Homo sapiens
tatagatatttgtca

SEQ ID NO: 319966 - DNA, 15 bp, Homo sapiens
atagatatttgtcag

SEQ ID NO: 319967 - DNA, 15 bp, Homo sapiens
tagatatttgtcagc

SEQ ID NO: 319968 - DNA, 15 bp, Homo sapiens
agatatttgtcagcg

SEQ ID NO: 319969 - DNA, 15 bp, Homo sapiens
gatatttgtcagcgt

SEQ ID NO: 319970 - DNA, 15 bp, Homo sapiens
atatttgtcagcgtg

SEQ ID NO: 319971 - DNA, 15 bp, Homo sapiens
tatttgtcagcgtgg

SEQ ID NO: 319972 - DNA, 15 bp, Homo sapiens
atttgtcagcgtggt

SEQ ID NO: 319973 - DNA, 15 bp, Homo sapiens
tttgtcagcgtggtt

SEQ ID NO: 319974 - DNA, 15 bp, Homo sapiens
ttgtcagcgtggttg

SEQ ID NO: 319975 - DNA, 15 bp, Homo sapiens
tgtcagcgtggttgc

SEQ ID NO: 319976 - DNA, 15 bp, Homo sapiens
gtcagcgtggttgcc

SEQ ID NO: 319977 - DNA, 15 bp, Homo sapiens
tcagcgtggttgcca

SEQ ID NO: 319978 - DNA, 15 bp, Homo sapiens
cagcgtggttgccaa

SEQ ID NO: 319979 - DNA, 15 bp, Homo sapiens
agcgtggttgccaac

SEQ ID NO: 319980 - DNA, 15 bp, Homo sapiens
gcgtggttgccaact

SEQ ID NO: 319981 - DNA, 15 bp, Homo sapiens
cgtggttgccaactg

SEQ ID NO: 319982 - DNA, 15 bp, Homo sapiens
gtggttgccaactgc

SEQ ID NO: 319983 - DNA, 15 bp, Homo sapiens
tggttgccaactgcc

SEQ ID NO: 319984 - DNA, 15 bp, Homo sapiens
ggttgccaactgcct

SEQ ID NO: 319985 - DNA, 15 bp, Homo sapiens
gttgccaactgcctt

SEQ ID NO: 319986 - DNA, 15 bp, Homo sapiens
ttgccaactgccttt

SEQ ID NO: 319987 - DNA, 15 bp, Homo sapiens
tgccaactgcctttc

SEQ ID NO: 319988 - DNA, 15 bp, Homo sapiens
gccaactgcctttcc

SEQ ID NO: 319989 - DNA, 15 bp, Homo sapiens
ccaactgcctttcct

SEQ ID NO: 319990 - DNA, 15 bp, Homo sapiens
caactgcctttcctc

SEQ ID NO: 319991 - DNA, 15 bp, Homo sapiens
aactgcctttcctct

SEQ ID NO: 319992 - DNA, 15 bp, Homo sapiens
actgcctttcctctt

SEQ ID NO: 319993 - DNA, 15 bp, Homo sapiens
ctgcctttcctcttc

SEQ ID NO: 319994 - DNA, 15 bp, Homo sapiens
tgcctttcctcttct

SEQ ID NO: 319995 - DNA, 15 bp, Homo sapiens
gcctttcctcttcta

SEQ ID NO: 319996 - DNA, 15 bp, Homo sapiens
cctttcctcttctaa

SEQ ID NO: 319997 - DNA, 15 bp, Homo sapiens
ctttcctcttctaag

SEQ ID NO: 319998 - DNA, 15 bp, Homo sapiens
tttcctcttctaaga

SEQ ID NO: 319999 - DNA, 15 bp, Homo sapiens
ttcctcttctaagat

SEQ ID NO: 320000 - DNA, 15 bp, Homo sapiens
tcctcttctaagatt

SEQ ID NO: 320001 - DNA, 15 bp, Homo sapiens
cctcttctaagattg

SEQ ID NO: 320002 - DNA, 15 bp, Homo sapiens
ctcttctaagattgc

SEQ ID NO: 320003 - DNA, 15 bp, Homo sapiens
tcttctaagattgcc

SEQ ID NO: 320004 - DNA, 15 bp, Homo sapiens
cttctaagattgccc

SEQ ID NO: 320005 - DNA, 15 bp, Homo sapiens
ttctaagattgccct

SEQ ID NO: 320006 - DNA, 15 bp, Homo sapiens
tctaagattgccctt

SEQ ID NO: 320007 - DNA, 15 bp, Homo sapiens
ctaagattgcccttt

SEQ ID NO: 320008 - DNA, 15 bp, Homo sapiens
taagattgcccttta

SEQ ID NO: 320009 - DNA, 15 bp, Homo sapiens
aagattgccctttat

SEQ ID NO: 320010 - DNA, 15 bp, Homo sapiens
agattgccctttatt

SEQ ID NO: 320011 - DNA, 15 bp, Homo sapiens
gattgccctttattg

SEQ ID NO: 320012 - DNA, 15 bp, Homo sapiens
attgccctttattgt

SEQ ID NO: 320013 - DNA, 15 bp, Homo sapiens
ttgccctttattgtg

SEQ ID NO: 320014 - DNA, 15 bp, Homo sapiens
tgccctttattgtgt

SEQ ID NO: 320015 - DNA, 15 bp, Homo sapiens
gccctttattgtgtg

SEQ ID NO: 320016 - DNA, 15 bp, Homo sapiens
ccctttattgtgtga

SEQ ID NO: 320017 - DNA, 15 bp, Homo sapiens
cctttattgtgtgat

SEQ ID NO: 320018 - DNA, 15 bp, Homo sapiens
ctttattgtgtgatt

SEQ ID NO: 320019 - DNA, 15 bp, Homo sapiens
tttattgtgtgatta

SEQ ID NO: 320020 - DNA, 15 bp, Homo sapiens
ttattgtgtgattat

SEQ ID NO: 320021 - DNA, 15 bp, Homo sapiens
tattgtgtgattata

SEQ ID NO: 320022 - DNA, 15 bp, Homo sapiens
attgtgtgattatat

SEQ ID NO: 320023 - DNA, 15 bp, Homo sapiens
ttgtgtgattatatt

SEQ ID NO: 320024 - DNA, 15 bp, Homo sapiens
tgtgtgattatatta

SEQ ID NO: 320025 - DNA, 15 bp, Homo sapiens
gtgtgattatattac

SEQ ID NO: 320026 - DNA, 15 bp, Homo sapiens
tgtgattatattaca

SEQ ID NO: 320027 - DNA, 15 bp, Homo sapiens
gtgattatattacat

SEQ ID NO: 320028 - DNA, 15 bp, Homo sapiens
tgattatattacatt

SEQ ID NO: 320029 - DNA, 15 bp, Homo sapiens
gattatattacattt

SEQ ID NO: 320030 - DNA, 15 bp, Homo sapiens
attatattacatttt

SEQ ID NO: 320031 - DNA, 15 bp, Homo sapiens
ttatattacattttt

SEQ ID NO: 320032 - DNA, 15 bp, Homo sapiens
tatattacattttta

SEQ ID NO: 320033 - DNA, 15 bp, Homo sapiens
atattacatttttag

SEQ ID NO: 320034 - DNA, 15 bp, Homo sapiens
tattacatttttagt

SEQ ID NO: 320035 - DNA, 15 bp, Homo sapiens
attacatttttagtt

SEQ ID NO: 320036 - DNA, 15 bp, Homo sapiens
ttacatttttagttg

SEQ ID NO: 320037 - DNA, 15 bp, Homo sapiens
tacatttttagttgg

SEQ ID NO: 320038 - DNA, 15 bp, Homo sapiens
acatttttagttggc

SEQ ID NO: 320039 - DNA, 15 bp, Homo sapiens
catttttagttggca

SEQ ID NO: 320040 - DNA, 15 bp, Homo sapiens
atttttagttggcat

SEQ ID NO: 320041 - DNA, 15 bp, Homo sapiens
tttttagttggcatg

SEQ ID NO: 320042 - DNA, 15 bp, Homo sapiens
ttttagttggcatga

SEQ ID NO: 320043 - DNA, 15 bp, Homo sapiens
tttagttggcatgaa

SEQ ID NO: 320044 - DNA, 15 bp, Homo sapiens
ttagttggcatgaaa

SEQ ID NO: 320045 - DNA, 15 bp, Homo sapiens
tagttggcatgaaaa

SEQ ID NO: 320046 - DNA, 15 bp, Homo sapiens
agttggcatgaaaat

SEQ ID NO: 320047 - DNA, 15 bp, Homo sapiens
gttggcatgaaaatg

SEQ ID NO: 320048 - DNA, 15 bp, Homo sapiens
ttggcatgaaaatgc

SEQ ID NO: 320049 - DNA, 15 bp, Homo sapiens
tggcatgaaaatgcc

SEQ ID NO: 320050 - DNA, 15 bp, Homo sapiens
ggcatgaaaatgccc

SEQ ID NO: 320051 - DNA, 15 bp, Homo sapiens
gcatgaaaatgccca

SEQ ID NO: 320052 - DNA, 15 bp, Homo sapiens
catgaaaatgcccat

SEQ ID NO: 320053 - DNA, 15 bp, Homo sapiens
atgaaaatgcccatt

SEQ ID NO: 320054 - DNA, 15 bp, Homo sapiens
tgaaaatgcccattt

SEQ ID NO: 320055 - DNA, 15 bp, Homo sapiens
gaaaatgcccattta

SEQ ID NO: 320056 - DNA, 15 bp, Homo sapiens
aaaatgcccatttag

SEQ ID NO: 320057 - DNA, 15 bp, Homo sapiens
aaatgcccatttagt

SEQ ID NO: 320058 - DNA, 15 bp, Homo sapiens
aatgcccatttagtg

SEQ ID NO: 320059 - DNA, 15 bp, Homo sapiens
atgcccatttagtga

SEQ ID NO: 320060 - DNA, 15 bp, Homo sapiens
tgcccatttagtgaa

SEQ ID NO: 320061 - DNA, 15 bp, Homo sapiens
gcccatttagtgaaa

SEQ ID NO: 320062 - DNA, 15 bp, Homo sapiens
cccatttagtgaaat

SEQ ID NO: 320063 - DNA, 15 bp, Homo sapiens
ccatttagtgaaatg

SEQ ID NO: 320064 - DNA, 15 bp, Homo sapiens
catttagtgaaatga

SEQ ID NO: 320065 - DNA, 15 bp, Homo sapiens
atttagtgaaatgat

SEQ ID NO: 320066 - DNA, 15 bp, Homo sapiens
tttagtgaaatgatg

SEQ ID NO: 320067 - DNA, 15 bp, Homo sapiens
ttagtgaaatgatga

SEQ ID NO: 320068 - DNA, 15 bp, Homo sapiens
tagtgaaatgatgag

SEQ ID NO: 320069 - DNA, 15 bp, Homo sapiens
agtgaaatgatgagg

SEQ ID NO: 320070 - DNA, 15 bp, Homo sapiens
gtgaaatgatgagga

SEQ ID NO: 320071 - DNA, 15 bp, Homo sapiens
tgaaatgatgaggat

SEQ ID NO: 320072 - DNA, 15 bp, Homo sapiens
gaaatgatgaggatc

SEQ ID NO: 320073 - DNA, 15 bp, Homo sapiens
aaatgatgaggatct

SEQ ID NO: 320074 - DNA, 15 bp, Homo sapiens
aatgatgaggatctt

SEQ ID NO: 320075 - DNA, 15 bp, Homo sapiens
atgatgaggatcttc

SEQ ID NO: 320076 - DNA, 15 bp, Homo sapiens
tgatgaggatcttcc

SEQ ID NO: 320077 - DNA, 15 bp, Homo sapiens
gatgaggatcttcct

SEQ ID NO: 320078 - DNA, 15 bp, Homo sapiens
atgaggatcttcctg

SEQ ID NO: 320079 - DNA, 15 bp, Homo sapiens
tgaggatcttcctgg

SEQ ID NO: 320080 - DNA, 15 bp, Homo sapiens
gaggatcttcctggg

SEQ ID NO: 320081 - DNA, 15 bp, Homo sapiens
aggatcttcctgggg

SEQ ID NO: 320082 - DNA, 15 bp, Homo sapiens
ggatcttcctggggg

SEQ ID NO: 320083 - DNA, 15 bp, Homo sapiens
gatcttcctggggga

SEQ ID NO: 320084 - DNA, 15 bp, Homo sapiens
atcttcctgggggaa

SEQ ID NO: 320085 - DNA, 15 bp, Homo sapiens
tcttcctgggggaag

SEQ ID NO: 320086 - DNA, 15 bp, Homo sapiens
cttcctgggggaaga

SEQ ID NO: 320087 - DNA, 15 bp, Homo sapiens
ttcctgggggaagaa

SEQ ID NO: 320088 - DNA, 15 bp, Homo sapiens
tcctgggggaagaat

SEQ ID NO: 320089 - DNA, 15 bp, Homo sapiens
cctgggggaagaatt

SEQ ID NO: 320090 - DNA, 15 bp, Homo sapiens
ctgggggaagaattc

SEQ ID NO: 320091 - DNA, 15 bp, Homo sapiens
tgggggaagaattct

SEQ ID NO: 320092 - DNA, 15 bp, Homo sapiens
gggggaagaattctg

SEQ ID NO: 320093 - DNA, 15 bp, Homo sapiens
ggggaagaattctgg

SEQ ID NO: 320094 - DNA, 15 bp, Homo sapiens
gggaagaattctggc

SEQ ID NO: 320095 - DNA, 15 bp, Homo sapiens
ggaagaattctggcg

SEQ ID NO: 320096 - DNA, 15 bp, Homo sapiens
gaagaattctggcgt

SEQ ID NO: 320097 - DNA, 15 bp, Homo sapiens
aagaattctggcgta

SEQ ID NO: 320098 - DNA, 15 bp, Homo sapiens
agaattctggcgtaa

SEQ ID NO: 320099 - DNA, 15 bp, Homo sapiens
gaattctggcgtaag

SEQ ID NO: 320100 - DNA, 15 bp, Homo sapiens
aattctggcgtaaga

SEQ ID NO: 320101 - DNA, 15 bp, Homo sapiens
attctggcgtaagaa

SEQ ID NO: 320102 - DNA, 15 bp, Homo sapiens
ttctggcgtaagaag

SEQ ID NO: 320103 - DNA, 15 bp, Homo sapiens
tctggcgtaagaagc

SEQ ID NO: 320104 - DNA, 15 bp, Homo sapiens
ctggcgtaagaagct

SEQ ID NO: 320105 - DNA, 15 bp, Homo sapiens
tggcgtaagaagctt

SEQ ID NO: 320106 - DNA, 15 bp, Homo sapiens
ggcgtaagaagcttt

SEQ ID NO: 320107 - DNA, 15 bp, Homo sapiens
gcgtaagaagctttc

SEQ ID NO: 320108 - DNA, 15 bp, Homo sapiens
cgtaagaagctttct

SEQ ID NO: 320109 - DNA, 15 bp, Homo sapiens
gtaagaagctttctt

SEQ ID NO: 320110 - DNA, 15 bp, Homo sapiens
taagaagctttcttc

SEQ ID NO: 320111 - DNA, 15 bp, Homo sapiens
aagaagctttcttca

SEQ ID NO: 320112 - DNA, 15 bp, Homo sapiens
agaagctttcttcag

SEQ ID NO: 320113 - DNA, 15 bp, Homo sapiens
gaagctttcttcaga

SEQ ID NO: 320114 - DNA, 15 bp, Homo sapiens
aagctttcttcagat

SEQ ID NO: 320115 - DNA, 15 bp, Homo sapiens
agctttcttcagatt

SEQ ID NO: 320116 - DNA, 15 bp, Homo sapiens
gctttcttcagatta

SEQ ID NO: 320117 - DNA, 15 bp, Homo sapiens
ctttcttcagattac

SEQ ID NO: 320118 - DNA, 15 bp, Homo sapiens
tttcttcagattact

SEQ ID NO: 320119 - DNA, 15 bp, Homo sapiens
ttcttcagattacta

SEQ ID NO: 320120 - DNA, 15 bp, Homo sapiens
tcttcagattactaa

SEQ ID NO: 320121 - DNA, 15 bp, Homo sapiens
cttcagattactaag

SEQ ID NO: 320122 - DNA, 15 bp, Homo sapiens
ttcagattactaagc

SEQ ID NO: 320123 - DNA, 15 bp, Homo sapiens
tcagattactaagca

SEQ ID NO: 320124 - DNA, 15 bp, Homo sapiens
cagattactaagcac

SEQ ID NO: 320125 - DNA, 15 bp, Homo sapiens
agattactaagcact

SEQ ID NO: 320126 - DNA, 15 bp, Homo sapiens
gattactaagcactc

SEQ ID NO: 320127 - DNA, 15 bp, Homo sapiens
attactaagcactct

SEQ ID NO: 320128 - DNA, 15 bp, Homo sapiens
ttactaagcactcta

SEQ ID NO: 320129 - DNA, 15 bp, Homo sapiens
tactaagcactctaa

SEQ ID NO: 320130 - DNA, 15 bp, Homo sapiens
actaagcactctaaa

SEQ ID NO: 320131 - DNA, 15 bp, Homo sapiens
ctaagcactctaaaa

SEQ ID NO: 320132 - DNA, 15 bp, Homo sapiens
taagcactctaaaag

SEQ ID NO: 320133 - DNA, 15 bp, Homo sapiens
aagcactctaaaagg

SEQ ID NO: 320134 - DNA, 15 bp, Homo sapiens
agcactctaaaaggt

SEQ ID NO: 320135 - DNA, 15 bp, Homo sapiens
gcactctaaaaggtc

SEQ ID NO: 320136 - DNA, 15 bp, Homo sapiens
cactctaaaaggtcc

SEQ ID NO: 320137 - DNA, 15 bp, Homo sapiens
actctaaaaggtccc

SEQ ID NO: 320138 - DNA, 15 bp, Homo sapiens
ctctaaaaggtccca

SEQ ID NO: 320139 - DNA, 15 bp, Homo sapiens
tctaaaaggtcccag

SEQ ID NO: 320140 - DNA, 15 bp, Homo sapiens
ctaaaaggtcccagg

SEQ ID NO: 320141 - DNA, 15 bp, Homo sapiens
taaaaggtcccaggt

SEQ ID NO: 320142 - DNA, 15 bp, Homo sapiens
aaaaggtcccaggtt

SEQ ID NO: 320143 - DNA, 15 bp, Homo sapiens
aaaggtcccaggtta

SEQ ID NO: 320144 - DNA, 15 bp, Homo sapiens
aaggtcccaggttat

SEQ ID NO: 320145 - DNA, 15 bp, Homo sapiens
aggtcccaggttatg

SEQ ID NO: 320146 - DNA, 15 bp, Homo sapiens
ggtcccaggttatgg

SEQ ID NO: 320147 - DNA, 15 bp, Homo sapiens
gtcccaggttatggg

SEQ ID NO: 320148 - DNA, 15 bp, Homo sapiens
tcccaggttatgggg

SEQ ID NO: 320149 - DNA, 15 bp, Homo sapiens
cccaggttatggggc

SEQ ID NO: 320150 - DNA, 15 bp, Homo sapiens
ccaggttatggggct

SEQ ID NO: 320151 - DNA, 15 bp, Homo sapiens
caggttatggggctc

SEQ ID NO: 320152 - DNA, 15 bp, Homo sapiens
aggttatggggctct

SEQ ID NO: 320153 - DNA, 15 bp, Homo sapiens
ggttatggggctctg

SEQ ID NO: 320154 - DNA, 15 bp, Homo sapiens
gttatggggctctgg

SEQ ID NO: 320155 - DNA, 15 bp, Homo sapiens
ttatggggctctgga

SEQ ID NO: 320156 - DNA, 15 bp, Homo sapiens
tatggggctctggaa

SEQ ID NO: 320157 - DNA, 15 bp, Homo sapiens
atggggctctggaaa

SEQ ID NO: 320158 - DNA, 15 bp, Homo sapiens
tggggctctggaaag

SEQ ID NO: 320159 - DNA, 15 bp, Homo sapiens
ggggctctggaaagt

SEQ ID NO: 320160 - DNA, 15 bp, Homo sapiens
gggctctggaaagta

SEQ ID NO: 320161 - DNA, 15 bp, Homo sapiens
ggctctggaaagtaa

SEQ ID NO: 320162 - DNA, 15 bp, Homo sapiens
gctctggaaagtaac

SEQ ID NO: 320163 - DNA, 15 bp, Homo sapiens
ctctggaaagtaacg

SEQ ID NO: 320164 - DNA, 15 bp, Homo sapiens
tctggaaagtaacga

SEQ ID NO: 320165 - DNA, 15 bp, Homo sapiens
ctggaaagtaacgat

SEQ ID NO: 320166 - DNA, 15 bp, Homo sapiens
tggaaagtaacgatg

SEQ ID NO: 320167 - DNA, 15 bp, Homo sapiens
ggaaagtaacgatgc

SEQ ID NO: 320168 - DNA, 15 bp, Homo sapiens
gaaagtaacgatgcg

SEQ ID NO: 320169 - DNA, 15 bp, Homo sapiens
aaagtaacgatgcga

SEQ ID NO: 320170 - DNA, 15 bp, Homo sapiens
aagtaacgatgcgaa

SEQ ID NO: 320171 - DNA, 15 bp, Homo sapiens
agtaacgatgcgaat

SEQ ID NO: 320172 - DNA, 15 bp, Homo sapiens
gtaacgatgcgaata

SEQ ID NO: 320173 - DNA, 15 bp, Homo sapiens
taacgatgcgaatac

SEQ ID NO: 320174 - DNA, 15 bp, Homo sapiens
aacgatgcgaatact

SEQ ID NO: 320175 - DNA, 15 bp, Homo sapiens
acgatgcgaatactt

SEQ ID NO: 320176 - DNA, 15 bp, Homo sapiens
cgatgcgaatacttc

SEQ ID NO: 320177 - DNA, 15 bp, Homo sapiens
gatgcgaatacttca

SEQ ID NO: 320178 - DNA, 15 bp, Homo sapiens
atgcgaatacttcac

SEQ ID NO: 320179 - DNA, 15 bp, Homo sapiens
tgcgaatacttcact

SEQ ID NO: 320180 - DNA, 15 bp, Homo sapiens
gcgaatacttcactt

SEQ ID NO: 320181 - DNA, 15 bp, Homo sapiens
cgaatacttcacttg

SEQ ID NO: 320182 - DNA, 15 bp, Homo sapiens
gaatacttcacttgg

SEQ ID NO: 320183 - DNA, 15 bp, Homo sapiens
aatacttcacttggt

SEQ ID NO: 320184 - DNA, 15 bp, Homo sapiens
atacttcacttggtt

SEQ ID NO: 320185 - DNA, 15 bp, Homo sapiens
tacttcacttggtta

SEQ ID NO: 320186 - DNA, 15 bp, Homo sapiens
acttcacttggttat

SEQ ID NO: 320187 - DNA, 15 bp, Homo sapiens
cttcacttggttatg

SEQ ID NO: 320188 - DNA, 15 bp, Homo sapiens
ttcacttggttatgt

SEQ ID NO: 320189 - DNA, 15 bp, Homo sapiens
tcacttggttatgtg

SEQ ID NO: 320190 - DNA, 15 bp, Homo sapiens
cacttggttatgtga

SEQ ID NO: 320191 - DNA, 15 bp, Homo sapiens
acttggttatgtgat

SEQ ID NO: 320192 - DNA, 15 bp, Homo sapiens
cttggttatgtgatt

SEQ ID NO: 320193 - DNA, 15 bp, Homo sapiens
ttggttatgtgattt

SEQ ID NO: 320194 - DNA, 15 bp, Homo sapiens
tggttatgtgatttt

SEQ ID NO: 320195 - DNA, 15 bp, Homo sapiens
ggttatgtgattttt

SEQ ID NO: 320196 - DNA, 15 bp, Homo sapiens
gttatgtgattttta

SEQ ID NO: 320197 - DNA, 15 bp, Homo sapiens
ttatgtgatttttat

SEQ ID NO: 320198 - DNA, 15 bp, Homo sapiens
tatgtgatttttatt

SEQ ID NO: 320199 - DNA, 15 bp, Homo sapiens
atgtgatttttattt

SEQ ID NO: 320200 - DNA, 15 bp, Homo sapiens
tgtgatttttatttt

SEQ ID NO: 320201 - DNA, 15 bp, Homo sapiens
gtgatttttattttt

SEQ ID NO: 320202 - DNA, 15 bp, Homo sapiens
tgatttttatttttg

SEQ ID NO: 320203 - DNA, 15 bp, Homo sapiens
gatttttatttttgc

SEQ ID NO: 320204 - DNA, 15 bp, Homo sapiens
atttttatttttgcc

SEQ ID NO: 320205 - DNA, 15 bp, Homo sapiens
tttttatttttgcct

SEQ ID NO: 320206 - DNA, 15 bp, Homo sapiens
ttttatttttgcctt

SEQ ID NO: 320207 - DNA, 15 bp, Homo sapiens
tttatttttgccttg

SEQ ID NO: 320208 - DNA, 15 bp, Homo sapiens
ttatttttgccttgg

SEQ ID NO: 320209 - DNA, 15 bp, Homo sapiens
tatttttgccttgga

SEQ ID NO: 320210 - DNA, 15 bp, Homo sapiens
atttttgccttggaa

SEQ ID NO: 320211 - DNA, 15 bp, Homo sapiens
tttttgccttggaag

SEQ ID NO: 320212 - DNA, 15 bp, Homo sapiens
ttttgccttggaagt

SEQ ID NO: 320213 - DNA, 15 bp, Homo sapiens
tttgccttggaagtc

SEQ ID NO: 320214 - DNA, 15 bp, Homo sapiens
ttgccttggaagtct

SEQ ID NO: 320215 - DNA, 15 bp, Homo sapiens
tgccttggaagtctt

SEQ ID NO: 320216 - DNA, 15 bp, Homo sapiens
gccttggaagtcttt

SEQ ID NO: 320217 - DNA, 15 bp, Homo sapiens
ccttggaagtctttc

SEQ ID NO: 320218 - DNA, 15 bp, Homo sapiens
cttggaagtctttct

SEQ ID NO: 320219 - DNA, 15 bp, Homo sapiens
ttggaagtctttctg

SEQ ID NO: 320220 - DNA, 15 bp, Homo sapiens
tggaagtctttctgc

SEQ ID NO: 320221 - DNA, 15 bp, Homo sapiens
ggaagtctttctgca

SEQ ID NO: 320222 - DNA, 15 bp, Homo sapiens
gaagtctttctgcaa

SEQ ID NO: 320223 - DNA, 15 bp, Homo sapiens
aagtctttctgcaaa

SEQ ID NO: 320224 - DNA, 15 bp, Homo sapiens
agtctttctgcaaac

SEQ ID NO: 320225 - DNA, 15 bp, Homo sapiens
gtctttctgcaaaca

SEQ ID NO: 320226 - DNA, 15 bp, Homo sapiens
tctttctgcaaacaa

SEQ ID NO: 320227 - DNA, 15 bp, Homo sapiens
ctttctgcaaacaag

SEQ ID NO: 320228 - DNA, 15 bp, Homo sapiens
tttctgcaaacaagt

SEQ ID NO: 320229 - DNA, 15 bp, Homo sapiens
ttctgcaaacaagtc

SEQ ID NO: 320230 - DNA, 15 bp, Homo sapiens
tctgcaaacaagtct

SEQ ID NO: 320231 - DNA, 15 bp, Homo sapiens
ctgcaaacaagtctt

SEQ ID NO: 320232 - DNA, 15 bp, Homo sapiens
tgcaaacaagtcttc

SEQ ID NO: 320233 - DNA, 15 bp, Homo sapiens
gcaaacaagtcttcc

SEQ ID NO: 320234 - DNA, 15 bp, Homo sapiens
caaacaagtcttcca

SEQ ID NO: 320235 - DNA, 15 bp, Homo sapiens
aaacaagtcttccag

SEQ ID NO: 320236 - DNA, 15 bp, Homo sapiens
aacaagtcttccagt

SEQ ID NO: 320237 - DNA, 15 bp, Homo sapiens
acaagtcttccagtg

SEQ ID NO: 320238 - DNA, 15 bp, Homo sapiens
caagtcttccagtgg

SEQ ID NO: 320239 - DNA, 15 bp, Homo sapiens
aagtcttccagtgga

SEQ ID NO: 320240 - DNA, 15 bp, Homo sapiens
agtcttccagtggag

SEQ ID NO: 320241 - DNA, 15 bp, Homo sapiens
gtcttccagtggagg

SEQ ID NO: 320242 - DNA, 15 bp, Homo sapiens
tcttccagtggaggc

SEQ ID NO: 320243 - DNA, 15 bp, Homo sapiens
cttccagtggaggct

SEQ ID NO: 320244 - DNA, 15 bp, Homo sapiens
ttccagtggaggctc

SEQ ID NO: 320245 - DNA, 15 bp, Homo sapiens
tccagtggaggctca

SEQ ID NO: 320246 - DNA, 15 bp, Homo sapiens
ccagtggaggctcat

SEQ ID NO: 320247 - DNA, 15 bp, Homo sapiens
cagtggaggctcatt

SEQ ID NO: 320248 - DNA, 15 bp, Homo sapiens
agtggaggctcattt

SEQ ID NO: 320249 - DNA, 15 bp, Homo sapiens
gtggaggctcatttt

SEQ ID NO: 320250 - DNA, 15 bp, Homo sapiens
tggaggctcatttta

SEQ ID NO: 320251 - DNA, 15 bp, Homo sapiens
ggaggctcattttag

SEQ ID NO: 320252 - DNA, 15 bp, Homo sapiens
gaggctcattttagg

SEQ ID NO: 320253 - DNA, 15 bp, Homo sapiens
aggctcattttagga

SEQ ID NO: 320254 - DNA, 15 bp, Homo sapiens
ggctcattttaggaa

SEQ ID NO: 320255 - DNA, 15 bp, Homo sapiens
gctcattttaggaat

SEQ ID NO: 320256 - DNA, 15 bp, Homo sapiens
ctcattttaggaatg

SEQ ID NO: 320257 - DNA, 15 bp, Homo sapiens
tcattttaggaatgt

SEQ ID NO: 320258 - DNA, 15 bp, Homo sapiens
cattttaggaatgtg

SEQ ID NO: 320259 - DNA, 15 bp, Homo sapiens
attttaggaatgtga

SEQ ID NO: 320260 - DNA, 15 bp, Homo sapiens
ttttaggaatgtgac

SEQ ID NO: 320261 - DNA, 15 bp, Homo sapiens
tttaggaatgtgacg

SEQ ID NO: 320262 - DNA, 15 bp, Homo sapiens
ttaggaatgtgacga

SEQ ID NO: 320263 - DNA, 15 bp, Homo sapiens
taggaatgtgacgat

SEQ ID NO: 320264 - DNA, 15 bp, Homo sapiens
aggaatgtgacgatg

SEQ ID NO: 320265 - DNA, 15 bp, Homo sapiens
ggaatgtgacgatgc

SEQ ID NO: 320266 - DNA, 15 bp, Homo sapiens
gaatgtgacgatgca

SEQ ID NO: 320267 - DNA, 15 bp, Homo sapiens
aatgtgacgatgcat

SEQ ID NO: 320268 - DNA, 15 bp, Homo sapiens
atgtgacgatgcatt

SEQ ID NO: 320269 - DNA, 15 bp, Homo sapiens
tgtgacgatgcattg

SEQ ID NO: 320270 - DNA, 15 bp, Homo sapiens
gtgacgatgcattgc

SEQ ID NO: 320271 - DNA, 15 bp, Homo sapiens
tgacgatgcattgct

SEQ ID NO: 320272 - DNA, 15 bp, Homo sapiens
gacgatgcattgctg

SEQ ID NO: 320273 - DNA, 15 bp, Homo sapiens
acgatgcattgctga

SEQ ID NO: 320274 - DNA, 15 bp, Homo sapiens
cgatgcattgctgat

SEQ ID NO: 320275 - DNA, 15 bp, Homo sapiens
gatgcattgctgata

SEQ ID NO: 320276 - DNA, 15 bp, Homo sapiens
atgcattgctgatag

SEQ ID NO: 320277 - DNA, 15 bp, Homo sapiens
tgcattgctgatagg

SEQ ID NO: 320278 - DNA, 15 bp, Homo sapiens
gcattgctgataggt

SEQ ID NO: 320279 - DNA, 15 bp, Homo sapiens
cattgctgataggta

SEQ ID NO: 320280 - DNA, 15 bp, Homo sapiens
attgctgataggtag

SEQ ID NO: 320281 - DNA, 15 bp, Homo sapiens
ttgctgataggtagg

SEQ ID NO: 320282 - DNA, 15 bp, Homo sapiens
tgctgataggtagga

SEQ ID NO: 320283 - DNA, 15 bp, Homo sapiens
gctgataggtaggat

SEQ ID NO: 320284 - DNA, 15 bp, Homo sapiens
ctgataggtaggatg

SEQ ID NO: 320285 - DNA, 15 bp, Homo sapiens
tgataggtaggatgt

SEQ ID NO: 320286 - DNA, 15 bp, Homo sapiens
gataggtaggatgtg

SEQ ID NO: 320287 - DNA, 15 bp, Homo sapiens
ataggtaggatgtgg

SEQ ID NO: 320288 - DNA, 15 bp, Homo sapiens
taggtaggatgtggc

SEQ ID NO: 320289 - DNA, 15 bp, Homo sapiens
aggtaggatgtggct

SEQ ID NO: 320290 - DNA, 15 bp, Homo sapiens
ggtaggatgtggctt

SEQ ID NO: 320291 - DNA, 15 bp, Homo sapiens
gtaggatgtggcttt

SEQ ID NO: 320292 - DNA, 15 bp, Homo sapiens
taggatgtggctttc

SEQ ID NO: 320293 - DNA, 15 bp, Homo sapiens
aggatgtggctttct

SEQ ID NO: 320294 - DNA, 15 bp, Homo sapiens
ggatgtggctttcta

SEQ ID NO: 320295 - DNA, 15 bp, Homo sapiens
gatgtggctttctat

SEQ ID NO: 320296 - DNA, 15 bp, Homo sapiens
atgtggctttctata

SEQ ID NO: 320297 - DNA, 15 bp, Homo sapiens
tgtggctttctatac

SEQ ID NO: 320298 - DNA, 15 bp, Homo sapiens
gtggctttctataca

SEQ ID NO: 320299 - DNA, 15 bp, Homo sapiens
tggctttctatacag

SEQ ID NO: 320300 - DNA, 15 bp, Homo sapiens
ggctttctatacagc

SEQ ID NO: 320301 - DNA, 15 bp, Homo sapiens
gctttctatacagca

SEQ ID NO: 320302 - DNA, 15 bp, Homo sapiens
ctttctatacagcag

SEQ ID NO: 320303 - DNA, 15 bp, Homo sapiens
tttctatacagcaga

SEQ ID NO: 320304 - DNA, 15 bp, Homo sapiens
ttctatacagcagag

SEQ ID NO: 320305 - DNA, 15 bp, Homo sapiens
tctatacagcagagt

SEQ ID NO: 320306 - DNA, 15 bp, Homo sapiens
ctatacagcagagtt

SEQ ID NO: 320307 - DNA, 15 bp, Homo sapiens
tatacagcagagttt

SEQ ID NO: 320308 - DNA, 15 bp, Homo sapiens
atacagcagagtttg

SEQ ID NO: 320309 - DNA, 15 bp, Homo sapiens
tacagcagagtttgg

SEQ ID NO: 320310 - DNA, 15 bp, Homo sapiens
acagcagagtttggg

SEQ ID NO: 320311 - DNA, 15 bp, Homo sapiens
cagcagagtttgggg

SEQ ID NO: 320312 - DNA, 15 bp, Homo sapiens
agcagagtttggggg

SEQ ID NO: 320313 - DNA, 15 bp, Homo sapiens
gcagagtttgggggg

SEQ ID NO: 320314 - DNA, 15 bp, Homo sapiens
cagagtttggggggt

SEQ ID NO: 320315 - DNA, 15 bp, Homo sapiens
agagtttggggggtg

SEQ ID NO: 320316 - DNA, 15 bp, Homo sapiens
gagtttggggggtgg

SEQ ID NO: 320317 - DNA, 15 bp, Homo sapiens
agtttggggggtggg

SEQ ID NO: 320318 - DNA, 15 bp, Homo sapiens
gtttggggggtggga

SEQ ID NO: 320319 - DNA, 15 bp, Homo sapiens
tttggggggtgggac

SEQ ID NO: 320320 - DNA, 15 bp, Homo sapiens
ttggggggtgggact

SEQ ID NO: 320321 - DNA, 15 bp, Homo sapiens
tggggggtgggactg

SEQ ID NO: 320322 - DNA, 15 bp, Homo sapiens
ggggggtgggactgg

SEQ ID NO: 320323 - DNA, 15 bp, Homo sapiens
gggggtgggactggc

SEQ ID NO: 320324 - DNA, 15 bp, Homo sapiens
ggggtgggactggca

SEQ ID NO: 320325 - DNA, 15 bp, Homo sapiens
gggtgggactggcag

SEQ ID NO: 320326 - DNA, 15 bp, Homo sapiens
ggtgggactggcagg

SEQ ID NO: 320327 - DNA, 15 bp, Homo sapiens
gtgggactggcaggt

SEQ ID NO: 320328 - DNA, 15 bp, Homo sapiens
tgggactggcaggtg

SEQ ID NO: 320329 - DNA, 15 bp, Homo sapiens
gggactggcaggtga

SEQ ID NO: 320330 - DNA, 15 bp, Homo sapiens
ggactggcaggtgag

SEQ ID NO: 320331 - DNA, 15 bp, Homo sapiens
gactggcaggtgagt

SEQ ID NO: 320332 - DNA, 15 bp, Homo sapiens
actggcaggtgagta

SEQ ID NO: 320333 - DNA, 15 bp, Homo sapiens
ctggcaggtgagtag

SEQ ID NO: 320334 - DNA, 15 bp, Homo sapiens
tggcaggtgagtagc

SEQ ID NO: 320335 - DNA, 15 bp, Homo sapiens
ggcaggtgagtagct

SEQ ID NO: 320336 - DNA, 15 bp, Homo sapiens
gcaggtgagtagctc

SEQ ID NO: 320337 - DNA, 15 bp, Homo sapiens
caggtgagtagctca

SEQ ID NO: 320338 - DNA, 15 bp, Homo sapiens
aggtgagtagctcaa

SEQ ID NO: 320339 - DNA, 15 bp, Homo sapiens
ggtgagtagctcaac

SEQ ID NO: 320340 - DNA, 15 bp, Homo sapiens
gtgagtagctcaacc

SEQ ID NO: 320341 - DNA, 15 bp, Homo sapiens
tgagtagctcaaccc

SEQ ID NO: 320342 - DNA, 15 bp, Homo sapiens
gagtagctcaaccca

SEQ ID NO: 320343 - DNA, 15 bp, Homo sapiens
agtagctcaacccag

SEQ ID NO: 320344 - DNA, 15 bp, Homo sapiens
gtagctcaacccagg

SEQ ID NO: 320345 - DNA, 15 bp, Homo sapiens
tagctcaacccaggc

SEQ ID NO: 320346 - DNA, 15 bp, Homo sapiens
agctcaacccaggct

SEQ ID NO: 320347 - DNA, 15 bp, Homo sapiens
gctcaacccaggctt

SEQ ID NO: 320348 - DNA, 15 bp, Homo sapiens
ctcaacccaggcttc

SEQ ID NO: 320349 - DNA, 15 bp, Homo sapiens
tcaacccaggcttct

SEQ ID NO: 320350 - DNA, 15 bp, Homo sapiens
caacccaggcttctg

SEQ ID NO: 320351 - DNA, 15 bp, Homo sapiens
aacccaggcttctga

SEQ ID NO: 320352 - DNA, 15 bp, Homo sapiens
acccaggcttctgag

SEQ ID NO: 320353 - DNA, 15 bp, Homo sapiens
cccaggcttctgagg

SEQ ID NO: 320354 - DNA, 15 bp, Homo sapiens
ccaggcttctgaggg

SEQ ID NO: 320355 - DNA, 15 bp, Homo sapiens
caggcttctgagggt

SEQ ID NO: 320356 - DNA, 15 bp, Homo sapiens
aggcttctgagggtc

SEQ ID NO: 320357 - DNA, 15 bp, Homo sapiens
ggcttctgagggtcc

SEQ ID NO: 320358 - DNA, 15 bp, Homo sapiens
gcttctgagggtcct

SEQ ID NO: 320359 - DNA, 15 bp, Homo sapiens
cttctgagggtcctt

SEQ ID NO: 320360 - DNA, 15 bp, Homo sapiens
ttctgagggtccttc

SEQ ID NO: 320361 - DNA, 15 bp, Homo sapiens
tctgagggtccttca

SEQ ID NO: 320362 - DNA, 15 bp, Homo sapiens
ctgagggtccttcat

SEQ ID NO: 320363 - DNA, 15 bp, Homo sapiens
tgagggtccttcatg

SEQ ID NO: 320364 - DNA, 15 bp, Homo sapiens
gagggtccttcatgt

SEQ ID NO: 320365 - DNA, 15 bp, Homo sapiens
agggtccttcatgtc

SEQ ID NO: 320366 - DNA, 15 bp, Homo sapiens
gggtccttcatgtct

SEQ ID NO: 320367 - DNA, 15 bp, Homo sapiens
ggtccttcatgtctt

SEQ ID NO: 320368 - DNA, 15 bp, Homo sapiens
gtccttcatgtcttt

SEQ ID NO: 320369 - DNA, 15 bp, Homo sapiens
tccttcatgtctttt

SEQ ID NO: 320370 - DNA, 15 bp, Homo sapiens
ccttcatgtcttttg

SEQ ID NO: 320371 - DNA, 15 bp, Homo sapiens
cttcatgtcttttgg

SEQ ID NO: 320372 - DNA, 15 bp, Homo sapiens
ttcatgtcttttgga

SEQ ID NO: 320373 - DNA, 15 bp, Homo sapiens
tcatgtcttttggaa

SEQ ID NO: 320374 - DNA, 15 bp, Homo sapiens
catgtcttttggaac

SEQ ID NO: 320375 - DNA, 15 bp, Homo sapiens
atgtcttttggaaca

SEQ ID NO: 320376 - DNA, 15 bp, Homo sapiens
tgtcttttggaacac

SEQ ID NO: 320377 - DNA, 15 bp, Homo sapiens
gtcttttggaacaca

SEQ ID NO: 320378 - DNA, 15 bp, Homo sapiens
tcttttggaacacaa

SEQ ID NO: 320379 - DNA, 15 bp, Homo sapiens
cttttggaacacaat

SEQ ID NO: 320380 - DNA, 15 bp, Homo sapiens
ttttggaacacaatt

SEQ ID NO: 320381 - DNA, 15 bp, Homo sapiens
tttggaacacaattt

SEQ ID NO: 320382 - DNA, 15 bp, Homo sapiens
ttggaacacaatttg

SEQ ID NO: 320383 - DNA, 15 bp, Homo sapiens
tggaacacaatttga

SEQ ID NO: 320384 - DNA, 15 bp, Homo sapiens
ggaacacaatttgaa

SEQ ID NO: 320385 - DNA, 15 bp, Homo sapiens
gaacacaatttgaaa

SEQ ID NO: 320386 - DNA, 15 bp, Homo sapiens
aacacaatttgaaaa

SEQ ID NO: 320387 - DNA, 15 bp, Homo sapiens
acacaatttgaaaat

SEQ ID NO: 320388 - DNA, 15 bp, Homo sapiens
cacaatttgaaaatc

SEQ ID NO: 320389 - DNA, 15 bp, Homo sapiens
acaatttgaaaatca

SEQ ID NO: 320390 - DNA, 15 bp, Homo sapiens
caatttgaaaatcac

SEQ ID NO: 320391 - DNA, 15 bp, Homo sapiens
aatttgaaaatcact

SEQ ID NO: 320392 - DNA, 15 bp, Homo sapiens
atttgaaaatcactg

SEQ ID NO: 320393 - DNA, 15 bp, Homo sapiens
tttgaaaatcactgc

SEQ ID NO: 320394 - DNA, 15 bp, Homo sapiens
ttgaaaatcactgct

SEQ ID NO: 320395 - DNA, 15 bp, Homo sapiens
tgaaaatcactgctt

SEQ ID NO: 320396 - DNA, 15 bp, Homo sapiens
gaaaatcactgcttt

SEQ ID NO: 320397 - DNA, 15 bp, Homo sapiens
aaaatcactgcttta

SEQ ID NO: 320398 - DNA, 15 bp, Homo sapiens
aaatcactgctttaa

SEQ ID NO: 320399 - DNA, 15 bp, Homo sapiens
aatcactgctttaat

SEQ ID NO: 320400 - DNA, 15 bp, Homo sapiens
atcactgctttaatt

SEQ ID NO: 320401 - DNA, 15 bp, Homo sapiens
tcactgctttaattg

SEQ ID NO: 320402 - DNA, 15 bp, Homo sapiens
cactgctttaattgc

SEQ ID NO: 320403 - DNA, 15 bp, Homo sapiens
actgctttaattgct

SEQ ID NO: 320404 - DNA, 15 bp, Homo sapiens
ctgctttaattgcta

SEQ ID NO: 320405 - DNA, 15 bp, Homo sapiens
tgctttaattgctaa

SEQ ID NO: 320406 - DNA, 15 bp, Homo sapiens
gctttaattgctaaa

SEQ ID NO: 320407 - DNA, 15 bp, Homo sapiens
ctttaattgctaaat

SEQ ID NO: 320408 - DNA, 15 bp, Homo sapiens
tttaattgctaaatt

SEQ ID NO: 320409 - DNA, 15 bp, Homo sapiens
ttaattgctaaattc

SEQ ID NO: 320410 - DNA, 15 bp, Homo sapiens
taattgctaaattct

SEQ ID NO: 320411 - DNA, 15 bp, Homo sapiens
aattgctaaattcta

SEQ ID NO: 320412 - DNA, 15 bp, Homo sapiens
attgctaaattctag

SEQ ID NO: 320413 - DNA, 15 bp, Homo sapiens
ttgctaaattctaga

SEQ ID NO: 320414 - DNA, 15 bp, Homo sapiens
tgctaaattctagaa

SEQ ID NO: 320415 - DNA, 15 bp, Homo sapiens
gctaaattctagaaa

SEQ ID NO: 320416 - DNA, 15 bp, Homo sapiens
ctaaattctagaaaa

SEQ ID NO: 320417 - DNA, 15 bp, Homo sapiens
taaattctagaaaac

SEQ ID NO: 320418 - DNA, 15 bp, Homo sapiens
aaattctagaaaacc

SEQ ID NO: 320419 - DNA, 15 bp, Homo sapiens
aattctagaaaacct

SEQ ID NO: 320420 - DNA, 15 bp, Homo sapiens
attctagaaaacctg

SEQ ID NO: 320421 - DNA, 15 bp, Homo sapiens
ttctagaaaacctgg

SEQ ID NO: 320422 - DNA, 15 bp, Homo sapiens
tctagaaaacctgga

SEQ ID NO: 320423 - DNA, 15 bp, Homo sapiens
ctagaaaacctggat

SEQ ID NO: 320424 - DNA, 15 bp, Homo sapiens
tagaaaacctggatg

SEQ ID NO: 320425 - DNA, 15 bp, Homo sapiens
agaaaacctggatgc

SEQ ID NO: 320426 - DNA, 15 bp, Homo sapiens
gaaaacctggatgcc

SEQ ID NO: 320427 - DNA, 15 bp, Homo sapiens
aaaacctggatgccc

SEQ ID NO: 320428 - DNA, 15 bp, Homo sapiens
aaacctggatgccct

SEQ ID NO: 320429 - DNA, 15 bp, Homo sapiens
aacctggatgcccta

SEQ ID NO: 320430 - DNA, 15 bp, Homo sapiens
acctggatgccctat

SEQ ID NO: 320431 - DNA, 15 bp, Homo sapiens
cctggatgccctatt

SEQ ID NO: 320432 - DNA, 15 bp, Homo sapiens
ctggatgccctattt

SEQ ID NO: 320433 - DNA, 15 bp, Homo sapiens
tggatgccctattta

SEQ ID NO: 320434 - DNA, 15 bp, Homo sapiens
ggatgccctatttaa

SEQ ID NO: 320435 - DNA, 15 bp, Homo sapiens
gatgccctatttaaa

SEQ ID NO: 320436 - DNA, 15 bp, Homo sapiens
atgccctatttaaaa

SEQ ID NO: 320437 - DNA, 15 bp, Homo sapiens
tgccctatttaaaaa

SEQ ID NO: 320438 - DNA, 15 bp, Homo sapiens
gccctatttaaaaaa

SEQ ID NO: 320439 - DNA, 15 bp, Homo sapiens
ccctatttaaaaaaa

SEQ ID NO: 320440 - DNA, 15 bp, Homo sapiens
cctatttaaaaaaag

SEQ ID NO: 320441 - DNA, 15 bp, Homo sapiens
ctatttaaaaaaaga

SEQ ID NO: 320442 - DNA, 15 bp, Homo sapiens
tatttaaaaaaagag

SEQ ID NO: 320443 - DNA, 15 bp, Homo sapiens
atttaaaaaaagagc

SEQ ID NO: 320444 - DNA, 15 bp, Homo sapiens
tttaaaaaaagagct

SEQ ID NO: 320445 - DNA, 15 bp, Homo sapiens
ttaaaaaaagagctt

SEQ ID NO: 320446 - DNA, 15 bp, Homo sapiens
taaaaaaagagctta

SEQ ID NO: 320447 - DNA, 15 bp, Homo sapiens
aaaaaaagagcttag

SEQ ID NO: 320448 - DNA, 15 bp, Homo sapiens
aaaaaagagcttagc

SEQ ID NO: 320449 - DNA, 15 bp, Homo sapiens
aaaaagagcttagct

SEQ ID NO: 320450 - DNA, 15 bp, Homo sapiens
aaaagagcttagctt

SEQ ID NO: 320451 - DNA, 15 bp, Homo sapiens
aaagagcttagctta

SEQ ID NO: 320452 - DNA, 15 bp, Homo sapiens
aagagcttagcttag

SEQ ID NO: 320453 - DNA, 15 bp, Homo sapiens
agagcttagcttagt

SEQ ID NO: 320454 - DNA, 15 bp, Homo sapiens
gagcttagcttagtg

SEQ ID NO: 320455 - DNA, 15 bp, Homo sapiens
agcttagcttagtgt

SEQ ID NO: 320456 - DNA, 15 bp, Homo sapiens
gcttagcttagtgtc

SEQ ID NO: 320457 - DNA, 15 bp, Homo sapiens
cttagcttagtgtca

SEQ ID NO: 320458 - DNA, 15 bp, Homo sapiens
ttagcttagtgtcaa

SEQ ID NO: 320459 - DNA, 15 bp, Homo sapiens
tagcttagtgtcaaa

SEQ ID NO: 320460 - DNA, 15 bp, Homo sapiens
agcttagtgtcaaag

SEQ ID NO: 320461 - DNA, 15 bp, Homo sapiens
gcttagtgtcaaaga

SEQ ID NO: 320462 - DNA, 15 bp, Homo sapiens
cttagtgtcaaagag

SEQ ID NO: 320463 - DNA, 15 bp, Homo sapiens
ttagtgtcaaagagg

SEQ ID NO: 320464 - DNA, 15 bp, Homo sapiens
tagtgtcaaagagga

SEQ ID NO: 320465 - DNA, 15 bp, Homo sapiens
agtgtcaaagaggaa

SEQ ID NO: 320466 - DNA, 15 bp, Homo sapiens
gtgtcaaagaggaac

SEQ ID NO: 320467 - DNA, 15 bp, Homo sapiens
tgtcaaagaggaact

SEQ ID NO: 320468 - DNA, 15 bp, Homo sapiens
gtcaaagaggaacta

SEQ ID NO: 320469 - DNA, 15 bp, Homo sapiens
tcaaagaggaactag

SEQ ID NO: 320470 - DNA, 15 bp, Homo sapiens
caaagaggaactagg

SEQ ID NO: 320471 - DNA, 15 bp, Homo sapiens
aaagaggaactaggt

SEQ ID NO: 320472 - DNA, 15 bp, Homo sapiens
aagaggaactaggtt

SEQ ID NO: 320473 - DNA, 15 bp, Homo sapiens
agaggaactaggttc

SEQ ID NO: 320474 - DNA, 15 bp, Homo sapiens
gaggaactaggttcc

SEQ ID NO: 320475 - DNA, 15 bp, Homo sapiens
aggaactaggttcca

SEQ ID NO: 320476 - DNA, 15 bp, Homo sapiens
ggaactaggttccag

SEQ ID NO: 320477 - DNA, 15 bp, Homo sapiens
gaactaggttccagt

SEQ ID NO: 320478 - DNA, 15 bp, Homo sapiens
aactaggttccagtt

SEQ ID NO: 320479 - DNA, 15 bp, Homo sapiens
actaggttccagttt

SEQ ID NO: 320480 - DNA, 15 bp, Homo sapiens
ctaggttccagtttt

SEQ ID NO: 320481 - DNA, 15 bp, Homo sapiens
taggttccagtttta

SEQ ID NO: 320482 - DNA, 15 bp, Homo sapiens
aggttccagttttag

SEQ ID NO: 320483 - DNA, 15 bp, Homo sapiens
ggttccagttttagc

SEQ ID NO: 320484 - DNA, 15 bp, Homo sapiens
gttccagttttagct

SEQ ID NO: 320485 - DNA, 15 bp, Homo sapiens
ttccagttttagctc

SEQ ID NO: 320486 - DNA, 15 bp, Homo sapiens
tccagttttagctct

SEQ ID NO: 320487 - DNA, 15 bp, Homo sapiens
ccagttttagctctg

SEQ ID NO: 320488 - DNA, 15 bp, Homo sapiens
cagttttagctctgc

SEQ ID NO: 320489 - DNA, 15 bp, Homo sapiens
agttttagctctgca

SEQ ID NO: 320490 - DNA, 15 bp, Homo sapiens
gttttagctctgcag

SEQ ID NO: 320491 - DNA, 15 bp, Homo sapiens
ttttagctctgcaga

SEQ ID NO: 320492 - DNA, 15 bp, Homo sapiens
tttagctctgcagat

SEQ ID NO: 320493 - DNA, 15 bp, Homo sapiens
ttagctctgcagatc

SEQ ID NO: 320494 - DNA, 15 bp, Homo sapiens
tagctctgcagatca

SEQ ID NO: 320495 - DNA, 15 bp, Homo sapiens
agctctgcagatcac

SEQ ID NO: 320496 - DNA, 15 bp, Homo sapiens
gctctgcagatcacc

SEQ ID NO: 320497 - DNA, 15 bp, Homo sapiens
ctctgcagatcacca

SEQ ID NO: 320498 - DNA, 15 bp, Homo sapiens
tctgcagatcaccag

SEQ ID NO: 320499 - DNA, 15 bp, Homo sapiens
ctgcagatcaccagc

SEQ ID NO: 320500 - DNA, 15 bp, Homo sapiens
tgcagatcaccagct

SEQ ID NO: 320501 - DNA, 15 bp, Homo sapiens
gcagatcaccagctg

SEQ ID NO: 320502 - DNA, 15 bp, Homo sapiens
cagatcaccagctgt

SEQ ID NO: 320503 - DNA, 15 bp, Homo sapiens
agatcaccagctgtg

SEQ ID NO: 320504 - DNA, 15 bp, Homo sapiens
gatcaccagctgtgt

SEQ ID NO: 320505 - DNA, 15 bp, Homo sapiens
atcaccagctgtgtg

SEQ ID NO: 320506 - DNA, 15 bp, Homo sapiens
tcaccagctgtgtga

SEQ ID NO: 320507 - DNA, 15 bp, Homo sapiens
caccagctgtgtgac

SEQ ID NO: 320508 - DNA, 15 bp, Homo sapiens
accagctgtgtgacc

SEQ ID NO: 320509 - DNA, 15 bp, Homo sapiens
ccagctgtgtgacct

SEQ ID NO: 320510 - DNA, 15 bp, Homo sapiens
cagctgtgtgacctt

SEQ ID NO: 320511 - DNA, 15 bp, Homo sapiens
agctgtgtgaccttg

SEQ ID NO: 320512 - DNA, 15 bp, Homo sapiens
gctgtgtgaccttga

SEQ ID NO: 320513 - DNA, 15 bp, Homo sapiens
ctgtgtgaccttgaa

SEQ ID NO: 320514 - DNA, 15 bp, Homo sapiens
tgtgtgaccttgaat

SEQ ID NO: 320515 - DNA, 15 bp, Homo sapiens
gtgtgaccttgaata

SEQ ID NO: 320516 - DNA, 15 bp, Homo sapiens
tgtgaccttgaatat

SEQ ID NO: 320517 - DNA, 15 bp, Homo sapiens
gtgaccttgaatatg

SEQ ID NO: 320518 - DNA, 15 bp, Homo sapiens
tgaccttgaatatgt

SEQ ID NO: 320519 - DNA, 15 bp, Homo sapiens
gaccttgaatatgtc

SEQ ID NO: 320520 - DNA, 15 bp, Homo sapiens
accttgaatatgtca

SEQ ID NO: 320521 - DNA, 15 bp, Homo sapiens
ccttgaatatgtcac

SEQ ID NO: 320522 - DNA, 15 bp, Homo sapiens
cttgaatatgtcact

SEQ ID NO: 320523 - DNA, 15 bp, Homo sapiens
ttgaatatgtcactc

SEQ ID NO: 320524 - DNA, 15 bp, Homo sapiens
tgaatatgtcactca

SEQ ID NO: 320525 - DNA, 15 bp, Homo sapiens
gaatatgtcactcaa

SEQ ID NO: 320526 - DNA, 15 bp, Homo sapiens
aatatgtcactcaag

SEQ ID NO: 320527 - DNA, 15 bp, Homo sapiens
atatgtcactcaagc

SEQ ID NO: 320528 - DNA, 15 bp, Homo sapiens
tatgtcactcaagct

SEQ ID NO: 320529 - DNA, 15 bp, Homo sapiens
atgtcactcaagctg

SEQ ID NO: 320530 - DNA, 15 bp, Homo sapiens
tgtcactcaagctgt

SEQ ID NO: 320531 - DNA, 15 bp, Homo sapiens
gtcactcaagctgtc

SEQ ID NO: 320532 - DNA, 15 bp, Homo sapiens
tcactcaagctgtct

SEQ ID NO: 320533 - DNA, 15 bp, Homo sapiens
cactcaagctgtctg

SEQ ID NO: 320534 - DNA, 15 bp, Homo sapiens
actcaagctgtctgc

SEQ ID NO: 320535 - DNA, 15 bp, Homo sapiens
ctcaagctgtctgca

SEQ ID NO: 320536 - DNA, 15 bp, Homo sapiens
tcaagctgtctgcac

SEQ ID NO: 320537 - DNA, 15 bp, Homo sapiens
caagctgtctgcaca

SEQ ID NO: 320538 - DNA, 15 bp, Homo sapiens
aagctgtctgcacaa

SEQ ID NO: 320539 - DNA, 15 bp, Homo sapiens
agctgtctgcacaat

SEQ ID NO: 320540 - DNA, 15 bp, Homo sapiens
gctgtctgcacaatt

SEQ ID NO: 320541 - DNA, 15 bp, Homo sapiens
ctgtctgcacaatta

SEQ ID NO: 320542 - DNA, 15 bp, Homo sapiens
tgtctgcacaattaa

SEQ ID NO: 320543 - DNA, 15 bp, Homo sapiens
gtctgcacaattaat

SEQ ID NO: 320544 - DNA, 15 bp, Homo sapiens
tctgcacaattaatt

SEQ ID NO: 320545 - DNA, 15 bp, Homo sapiens
ctgcacaattaattg

SEQ ID NO: 320546 - DNA, 15 bp, Homo sapiens
tgcacaattaattga

SEQ ID NO: 320547 - DNA, 15 bp, Homo sapiens
gcacaattaattgat

SEQ ID NO: 320548 - DNA, 15 bp, Homo sapiens
cacaattaattgatt

SEQ ID NO: 320549 - DNA, 15 bp, Homo sapiens
acaattaattgattt

SEQ ID NO: 320550 - DNA, 15 bp, Homo sapiens
caattaattgatttg

SEQ ID NO: 320551 - DNA, 15 bp, Homo sapiens
aattaattgatttgt

SEQ ID NO: 320552 - DNA, 15 bp, Homo sapiens
attaattgatttgtt

SEQ ID NO: 320553 - DNA, 15 bp, Homo sapiens
ttaattgatttgttt

SEQ ID NO: 320554 - DNA, 15 bp, Homo sapiens
taattgatttgtttg

SEQ ID NO: 320555 - DNA, 15 bp, Homo sapiens
aattgatttgtttgt

SEQ ID NO: 320556 - DNA, 15 bp, Homo sapiens
attgatttgtttgta

SEQ ID NO: 320557 - DNA, 15 bp, Homo sapiens
ttgatttgtttgtaa

SEQ ID NO: 320558 - DNA, 15 bp, Homo sapiens
tgatttgtttgtaag

SEQ ID NO: 320559 - DNA, 15 bp, Homo sapiens
gatttgtttgtaagg

SEQ ID NO: 320560 - DNA, 15 bp, Homo sapiens
atttgtttgtaaggt

SEQ ID NO: 320561 - DNA, 15 bp, Homo sapiens
tttgtttgtaaggta

SEQ ID NO: 320562 - DNA, 15 bp, Homo sapiens
ttgtttgtaaggtaa

SEQ ID NO: 320563 - DNA, 15 bp, Homo sapiens
tgtttgtaaggtaag

SEQ ID NO: 320564 - DNA, 15 bp, Homo sapiens
gtttgtaaggtaagg

SEQ ID NO: 320565 - DNA, 15 bp, Homo sapiens
tttgtaaggtaagga

SEQ ID NO: 320566 - DNA, 15 bp, Homo sapiens
ttgtaaggtaaggag

SEQ ID NO: 320567 - DNA, 15 bp, Homo sapiens
tgtaaggtaaggagt

SEQ ID NO: 320568 - DNA, 15 bp, Homo sapiens
gtaaggtaaggagta

SEQ ID NO: 320569 - DNA, 15 bp, Homo sapiens
taaggtaaggagtat

SEQ ID NO: 320570 - DNA, 15 bp, Homo sapiens
aaggtaaggagtatg

SEQ ID NO: 320571 - DNA, 15 bp, Homo sapiens
aggtaaggagtatgg

SEQ ID NO: 320572 - DNA, 15 bp, Homo sapiens
ggtaaggagtatgga

SEQ ID NO: 320573 - DNA, 15 bp, Homo sapiens
gtaaggagtatggac

SEQ ID NO: 320574 - DNA, 15 bp, Homo sapiens
taaggagtatggact

SEQ ID NO: 320575 - DNA, 15 bp, Homo sapiens
aaggagtatggacta

SEQ ID NO: 320576 - DNA, 15 bp, Homo sapiens
aggagtatggactag

SEQ ID NO: 320577 - DNA, 15 bp, Homo sapiens
ggagtatggactaga

SEQ ID NO: 320578 - DNA, 15 bp, Homo sapiens
gagtatggactagat

SEQ ID NO: 320579 - DNA, 15 bp, Homo sapiens
agtatggactagatg

SEQ ID NO: 320580 - DNA, 15 bp, Homo sapiens
gtatggactagatga

SEQ ID NO: 320581 - DNA, 15 bp, Homo sapiens
tatggactagatgac

SEQ ID NO: 320582 - DNA, 15 bp, Homo sapiens
atggactagatgacc

SEQ ID NO: 320583 - DNA, 15 bp, Homo sapiens
tggactagatgacct

SEQ ID NO: 320584 - DNA, 15 bp, Homo sapiens
ggactagatgacctc

SEQ ID NO: 320585 - DNA, 15 bp, Homo sapiens
gactagatgacctca

SEQ ID NO: 320586 - DNA, 15 bp, Homo sapiens
actagatgacctcac

SEQ ID NO: 320587 - DNA, 15 bp, Homo sapiens
ctagatgacctcaca

SEQ ID NO: 320588 - DNA, 15 bp, Homo sapiens
tagatgacctcacac

SEQ ID NO: 320589 - DNA, 15 bp, Homo sapiens
agatgacctcacact

SEQ ID NO: 320590 - DNA, 15 bp, Homo sapiens
gatgacctcacactg

SEQ ID NO: 320591 - DNA, 15 bp, Homo sapiens
atgacctcacactga

SEQ ID NO: 320592 - DNA, 15 bp, Homo sapiens
tgacctcacactgat

SEQ ID NO: 320593 - DNA, 15 bp, Homo sapiens
gacctcacactgatc

SEQ ID NO: 320594 - DNA, 15 bp, Homo sapiens
acctcacactgatca

SEQ ID NO: 320595 - DNA, 15 bp, Homo sapiens
cctcacactgatcac

SEQ ID NO: 320596 - DNA, 15 bp, Homo sapiens
ctcacactgatcact

SEQ ID NO: 320597 - DNA, 15 bp, Homo sapiens
tcacactgatcactt

SEQ ID NO: 320598 - DNA, 15 bp, Homo sapiens
cacactgatcacttt

SEQ ID NO: 320599 - DNA, 15 bp, Homo sapiens
acactgatcactttc

SEQ ID NO: 320600 - DNA, 15 bp, Homo sapiens
cactgatcactttct

SEQ ID NO: 320601 - DNA, 15 bp, Homo sapiens
actgatcactttcta

SEQ ID NO: 320602 - DNA, 15 bp, Homo sapiens
ctgatcactttctaa

SEQ ID NO: 320603 - DNA, 15 bp, Homo sapiens
tgatcactttctaag

SEQ ID NO: 320604 - DNA, 15 bp, Homo sapiens
gatcactttctaagc

SEQ ID NO: 320605 - DNA, 15 bp, Homo sapiens
atcactttctaagct

SEQ ID NO: 320606 - DNA, 15 bp, Homo sapiens
tcactttctaagctc

SEQ ID NO: 320607 - DNA, 15 bp, Homo sapiens
cactttctaagctcc

SEQ ID NO: 320608 - DNA, 15 bp, Homo sapiens
actttctaagctcca

SEQ ID NO: 320609 - DNA, 15 bp, Homo sapiens
ctttctaagctccag

SEQ ID NO: 320610 - DNA, 15 bp, Homo sapiens
tttctaagctccaga

SEQ ID NO: 320611 - DNA, 15 bp, Homo sapiens
ttctaagctccagaa

SEQ ID NO: 320612 - DNA, 15 bp, Homo sapiens
tctaagctccagaaa

SEQ ID NO: 320613 - DNA, 15 bp, Homo sapiens
ctaagctccagaaaa

SEQ ID NO: 320614 - DNA, 15 bp, Homo sapiens
taagctccagaaaac

SEQ ID NO: 320615 - DNA, 15 bp, Homo sapiens
aagctccagaaaacc

SEQ ID NO: 320616 - DNA, 15 bp, Homo sapiens
agctccagaaaacct

SEQ ID NO: 320617 - DNA, 15 bp, Homo sapiens
gctccagaaaaccta

SEQ ID NO: 320618 - DNA, 15 bp, Homo sapiens
ctccagaaaacctaa

SEQ ID NO: 320619 - DNA, 15 bp, Homo sapiens
tccagaaaacctaat

SEQ ID NO: 320620 - DNA, 15 bp, Homo sapiens
ccagaaaacctaatt

SEQ ID NO: 320621 - DNA, 15 bp, Homo sapiens
cagaaaacctaattg

SEQ ID NO: 320622 - DNA, 15 bp, Homo sapiens
agaaaacctaattgt

SEQ ID NO: 320623 - DNA, 15 bp, Homo sapiens
gaaaacctaattgtt

SEQ ID NO: 320624 - DNA, 15 bp, Homo sapiens
aaaacctaattgtta

SEQ ID NO: 320625 - DNA, 15 bp, Homo sapiens
aaacctaattgttaa

SEQ ID NO: 320626 - DNA, 15 bp, Homo sapiens
aacctaattgttaat

SEQ ID NO: 320627 - DNA, 15 bp, Homo sapiens
acctaattgttaatg

SEQ ID NO: 320628 - DNA, 15 bp, Homo sapiens
cctaattgttaatgc

SEQ ID NO: 320629 - DNA, 15 bp, Homo sapiens
ctaattgttaatgct

SEQ ID NO: 320630 - DNA, 15 bp, Homo sapiens
taattgttaatgctt

SEQ ID NO: 320631 - DNA, 15 bp, Homo sapiens
aattgttaatgctta

SEQ ID NO: 320632 - DNA, 15 bp, Homo sapiens
attgttaatgcttaa

SEQ ID NO: 320633 - DNA, 15 bp, Homo sapiens
ttgttaatgcttaat

SEQ ID NO: 320634 - DNA, 15 bp, Homo sapiens
tgttaatgcttaatt

SEQ ID NO: 320635 - DNA, 15 bp, Homo sapiens
gttaatgcttaattg

SEQ ID NO: 320636 - DNA, 15 bp, Homo sapiens
ttaatgcttaattgt

SEQ ID NO: 320637 - DNA, 15 bp, Homo sapiens
taatgcttaattgtg

SEQ ID NO: 320638 - DNA, 15 bp, Homo sapiens
aatgcttaattgtgc

SEQ ID NO: 320639 - DNA, 15 bp, Homo sapiens
atgcttaattgtgcg

SEQ ID NO: 320640 - DNA, 15 bp, Homo sapiens
tgcttaattgtgcga

SEQ ID NO: 320641 - DNA, 15 bp, Homo sapiens
gcttaattgtgcgag

SEQ ID NO: 320642 - DNA, 15 bp, Homo sapiens
cttaattgtgcgagc

SEQ ID NO: 320643 - DNA, 15 bp, Homo sapiens
ttaattgtgcgagct

SEQ ID NO: 320644 - DNA, 15 bp, Homo sapiens
taattgtgcgagctg

SEQ ID NO: 320645 - DNA, 15 bp, Homo sapiens
aattgtgcgagctgt

SEQ ID NO: 320646 - DNA, 15 bp, Homo sapiens
attgtgcgagctgtg

SEQ ID NO: 320647 - DNA, 15 bp, Homo sapiens
ttgtgcgagctgtgc

SEQ ID NO: 320648 - DNA, 15 bp, Homo sapiens
tgtgcgagctgtgct

SEQ ID NO: 320649 - DNA, 15 bp, Homo sapiens
gtgcgagctgtgctc

SEQ ID NO: 320650 - DNA, 15 bp, Homo sapiens
tgcgagctgtgctcg

SEQ ID NO: 320651 - DNA, 15 bp, Homo sapiens
gcgagctgtgctcgg

SEQ ID NO: 320652 - DNA, 15 bp, Homo sapiens
cgagctgtgctcggg

SEQ ID NO: 320653 - DNA, 15 bp, Homo sapiens
gagctgtgctcggga

SEQ ID NO: 320654 - DNA, 15 bp, Homo sapiens
agctgtgctcgggaa

SEQ ID NO: 320655 - DNA, 15 bp, Homo sapiens
gctgtgctcgggaag

SEQ ID NO: 320656 - DNA, 15 bp, Homo sapiens
ctgtgctcgggaagg

SEQ ID NO: 320657 - DNA, 15 bp, Homo sapiens
tgtgctcgggaaggg

SEQ ID NO: 320658 - DNA, 15 bp, Homo sapiens
gtgctcgggaagggc

SEQ ID NO: 320659 - DNA, 15 bp, Homo sapiens
tgctcgggaagggct

SEQ ID NO: 320660 - DNA, 15 bp, Homo sapiens
gctcgggaagggctg

SEQ ID NO: 320661 - DNA, 15 bp, Homo sapiens
ctcgggaagggctgt

SEQ ID NO: 320662 - DNA, 15 bp, Homo sapiens
tcgggaagggctgtg

SEQ ID NO: 320663 - DNA, 15 bp, Homo sapiens
cgggaagggctgtgt

SEQ ID NO: 320664 - DNA, 15 bp, Homo sapiens
gggaagggctgtgtt

SEQ ID NO: 320665 - DNA, 15 bp, Homo sapiens
ggaagggctgtgttc

SEQ ID NO: 320666 - DNA, 15 bp, Homo sapiens
gaagggctgtgttct

SEQ ID NO: 320667 - DNA, 15 bp, Homo sapiens
aagggctgtgttcta

SEQ ID NO: 320668 - DNA, 15 bp, Homo sapiens
agggctgtgttctag

SEQ ID NO: 320669 - DNA, 15 bp, Homo sapiens
gggctgtgttctagt

SEQ ID NO: 320670 - DNA, 15 bp, Homo sapiens
ggctgtgttctagta

SEQ ID NO: 320671 - DNA, 15 bp, Homo sapiens
gctgtgttctagtac

SEQ ID NO: 320672 - DNA, 15 bp, Homo sapiens
ctgtgttctagtacc

SEQ ID NO: 320673 - DNA, 15 bp, Homo sapiens
tgtgttctagtacct

SEQ ID NO: 320674 - DNA, 15 bp, Homo sapiens
gtgttctagtacctt

SEQ ID NO: 320675 - DNA, 15 bp, Homo sapiens
tgttctagtaccttc

SEQ ID NO: 320676 - DNA, 15 bp, Homo sapiens
gttctagtaccttct

SEQ ID NO: 320677 - DNA, 15 bp, Homo sapiens
ttctagtaccttctt

SEQ ID NO: 320678 - DNA, 15 bp, Homo sapiens
tctagtaccttcttc

SEQ ID NO: 320679 - DNA, 15 bp, Homo sapiens
ctagtaccttcttcc

SEQ ID NO: 320680 - DNA, 15 bp, Homo sapiens
tagtaccttcttcct

SEQ ID NO: 320681 - DNA, 15 bp, Homo sapiens
agtaccttcttcctc

SEQ ID NO: 320682 - DNA, 15 bp, Homo sapiens
gtaccttcttcctca

SEQ ID NO: 320683 - DNA, 15 bp, Homo sapiens
taccttcttcctcat

SEQ ID NO: 320684 - DNA, 15 bp, Homo sapiens
accttcttcctcatc

SEQ ID NO: 320685 - DNA, 15 bp, Homo sapiens
ccttcttcctcatca

SEQ ID NO: 320686 - DNA, 15 bp, Homo sapiens
cttcttcctcatcac

SEQ ID NO: 320687 - DNA, 15 bp, Homo sapiens
ttcttcctcatcact

SEQ ID NO: 320688 - DNA, 15 bp, Homo sapiens
tcttcctcatcactg

SEQ ID NO: 320689 - DNA, 15 bp, Homo sapiens
cttcctcatcactgt

SEQ ID NO: 320690 - DNA, 15 bp, Homo sapiens
ttcctcatcactgtc

SEQ ID NO: 320691 - DNA, 15 bp, Homo sapiens
tcctcatcactgtca

SEQ ID NO: 320692 - DNA, 15 bp, Homo sapiens
cctcatcactgtcat

SEQ ID NO: 320693 - DNA, 15 bp, Homo sapiens
ctcatcactgtcatt

SEQ ID NO: 320694 - DNA, 15 bp, Homo sapiens
tcatcactgtcattt

SEQ ID NO: 320695 - DNA, 15 bp, Homo sapiens
catcactgtcatttc

SEQ ID NO: 320696 - DNA, 15 bp, Homo sapiens
atcactgtcatttca

SEQ ID NO: 320697 - DNA, 15 bp, Homo sapiens
tcactgtcatttcag

SEQ ID NO: 320698 - DNA, 15 bp, Homo sapiens
cactgtcatttcagt

SEQ ID NO: 320699 - DNA, 15 bp, Homo sapiens
actgtcatttcagta

SEQ ID NO: 320700 - DNA, 15 bp, Homo sapiens
ctgtcatttcagtat

SEQ ID NO: 320701 - DNA, 15 bp, Homo sapiens
tgtcatttcagtatt

SEQ ID NO: 320702 - DNA, 15 bp, Homo sapiens
gtcatttcagtatta

SEQ ID NO: 320703 - DNA, 15 bp, Homo sapiens
tcatttcagtattat

SEQ ID NO: 320704 - DNA, 15 bp, Homo sapiens
catttcagtattatc

SEQ ID NO: 320705 - DNA, 15 bp, Homo sapiens
atttcagtattatct

SEQ ID NO: 320706 - DNA, 15 bp, Homo sapiens
tttcagtattatcta

SEQ ID NO: 320707 - DNA, 15 bp, Homo sapiens
ttcagtattatctac

SEQ ID NO: 320708 - DNA, 15 bp, Homo sapiens
tcagtattatctaca

SEQ ID NO: 320709 - DNA, 15 bp, Homo sapiens
cagtattatctacac

SEQ ID NO: 320710 - DNA, 15 bp, Homo sapiens
agtattatctacact

SEQ ID NO: 320711 - DNA, 15 bp, Homo sapiens
gtattatctacactg

SEQ ID NO: 320712 - DNA, 15 bp, Homo sapiens
tattatctacactga

SEQ ID NO: 320713 - DNA, 15 bp, Homo sapiens
attatctacactgat

SEQ ID NO: 320714 - DNA, 15 bp, Homo sapiens
ttatctacactgatc

SEQ ID NO: 320715 - DNA, 15 bp, Homo sapiens
tatctacactgatct

SEQ ID NO: 320716 - DNA, 15 bp, Homo sapiens
atctacactgatctt

SEQ ID NO: 320717 - DNA, 15 bp, Homo sapiens
tctacactgatcttc

SEQ ID NO: 320718 - DNA, 15 bp, Homo sapiens
ctacactgatcttca

SEQ ID NO: 320719 - DNA, 15 bp, Homo sapiens
tacactgatcttcac

SEQ ID NO: 320720 - DNA, 15 bp, Homo sapiens
acactgatcttcaca

SEQ ID NO: 320721 - DNA, 15 bp, Homo sapiens
cactgatcttcacaa

SEQ ID NO: 320722 - DNA, 15 bp, Homo sapiens
actgatcttcacaaa

SEQ ID NO: 320723 - DNA, 15 bp, Homo sapiens
ctgatcttcacaaat

SEQ ID NO: 320724 - DNA, 15 bp, Homo sapiens
tgatcttcacaaata

SEQ ID NO: 320725 - DNA, 15 bp, Homo sapiens
gatcttcacaaatat

SEQ ID NO: 320726 - DNA, 15 bp, Homo sapiens
atcttcacaaatatt

SEQ ID NO: 320727 - DNA, 15 bp, Homo sapiens
tcttcacaaatattc

SEQ ID NO: 320728 - DNA, 15 bp, Homo sapiens
cttcacaaatattct

SEQ ID NO: 320729 - DNA, 15 bp, Homo sapiens
ttcacaaatattctg

SEQ ID NO: 320730 - DNA, 15 bp, Homo sapiens
tcacaaatattctgc

SEQ ID NO: 320731 - DNA, 15 bp, Homo sapiens
cacaaatattctgca

SEQ ID NO: 320732 - DNA, 15 bp, Homo sapiens
acaaatattctgcac

SEQ ID NO: 320733 - DNA, 15 bp, Homo sapiens
caaatattctgcaca

SEQ ID NO: 320734 - DNA, 15 bp, Homo sapiens
aaatattctgcacac

SEQ ID NO: 320735 - DNA, 15 bp, Homo sapiens
aatattctgcacact

SEQ ID NO: 320736 - DNA, 15 bp, Homo sapiens
atattctgcacactt

SEQ ID NO: 320737 - DNA, 15 bp, Homo sapiens
tattctgcacacttg

SEQ ID NO: 320738 - DNA, 15 bp, Homo sapiens
attctgcacacttgg

SEQ ID NO: 320739 - DNA, 15 bp, Homo sapiens
ttctgcacacttgga

SEQ ID NO: 320740 - DNA, 15 bp, Homo sapiens
tctgcacacttggat

SEQ ID NO: 320741 - DNA, 15 bp, Homo sapiens
ctgcacacttggatt

SEQ ID NO: 320742 - DNA, 15 bp, Homo sapiens
tgcacacttggattc

SEQ ID NO: 320743 - DNA, 15 bp, Homo sapiens
gcacacttggattct

SEQ ID NO: 320744 - DNA, 15 bp, Homo sapiens
cacacttggattcta

SEQ ID NO: 320745 - DNA, 15 bp, Homo sapiens
acacttggattctaa

SEQ ID NO: 320746 - DNA, 15 bp, Homo sapiens
cacttggattctaac

SEQ ID NO: 320747 - DNA, 15 bp, Homo sapiens
acttggattctaacc

SEQ ID NO: 320748 - DNA, 15 bp, Homo sapiens
cttggattctaacct

SEQ ID NO: 320749 - DNA, 15 bp, Homo sapiens
ttggattctaacctg

SEQ ID NO: 320750 - DNA, 15 bp, Homo sapiens
tggattctaacctgc

SEQ ID NO: 320751 - DNA, 15 bp, Homo sapiens
ggattctaacctgca

SEQ ID NO: 320752 - DNA, 15 bp, Homo sapiens
gattctaacctgcaa

SEQ ID NO: 320753 - DNA, 15 bp, Homo sapiens
attctaacctgcaat

SEQ ID NO: 320754 - DNA, 15 bp, Homo sapiens
ttctaacctgcaata

SEQ ID NO: 320755 - DNA, 15 bp, Homo sapiens
tctaacctgcaatat

SEQ ID NO: 320756 - DNA, 15 bp, Homo sapiens
ctaacctgcaatatt

SEQ ID NO: 320757 - DNA, 15 bp, Homo sapiens
taacctgcaatattg

SEQ ID NO: 320758 - DNA, 15 bp, Homo sapiens
aacctgcaatattgc

SEQ ID NO: 320759 - DNA, 15 bp, Homo sapiens
acctgcaatattgct

SEQ ID NO: 320760 - DNA, 15 bp, Homo sapiens
cctgcaatattgctg

SEQ ID NO: 320761 - DNA, 15 bp, Homo sapiens
ctgcaatattgctgt

SEQ ID NO: 320762 - DNA, 15 bp, Homo sapiens
tgcaatattgctgtt

SEQ ID NO: 320763 - DNA, 15 bp, Homo sapiens
gcaatattgctgttg

SEQ ID NO: 320764 - DNA, 15 bp, Homo sapiens
caatattgctgttgg

SEQ ID NO: 320765 - DNA, 15 bp, Homo sapiens
aatattgctgttggg

SEQ ID NO: 320766 - DNA, 15 bp, Homo sapiens
atattgctgttgggg

SEQ ID NO: 320767 - DNA, 15 bp, Homo sapiens
tattgctgttggggt

SEQ ID NO: 320768 - DNA, 15 bp, Homo sapiens
attgctgttggggtt

SEQ ID NO: 320769 - DNA, 15 bp, Homo sapiens
ttgctgttggggtta

SEQ ID NO: 320770 - DNA, 15 bp, Homo sapiens
tgctgttggggttat

SEQ ID NO: 320771 - DNA, 15 bp, Homo sapiens
gctgttggggttata

SEQ ID NO: 320772 - DNA, 15 bp, Homo sapiens
ctgttggggttatag

SEQ ID NO: 320773 - DNA, 15 bp, Homo sapiens
tgttggggttataga

SEQ ID NO: 320774 - DNA, 15 bp, Homo sapiens
gttggggttatagaa

SEQ ID NO: 320775 - DNA, 15 bp, Homo sapiens
ttggggttatagaaa

SEQ ID NO: 320776 - DNA, 15 bp, Homo sapiens
tggggttatagaaat

SEQ ID NO: 320777 - DNA, 15 bp, Homo sapiens
ggggttatagaaata

SEQ ID NO: 320778 - DNA, 15 bp, Homo sapiens
gggttatagaaatat

SEQ ID NO: 320779 - DNA, 15 bp, Homo sapiens
ggttatagaaatata

SEQ ID NO: 320780 - DNA, 15 bp, Homo sapiens
gttatagaaatatag

SEQ ID NO: 320781 - DNA, 15 bp, Homo sapiens
ttatagaaatataga

SEQ ID NO: 320782 - DNA, 15 bp, Homo sapiens
tatagaaatatagat

SEQ ID NO: 320783 - DNA, 15 bp, Homo sapiens
atagaaatatagatt

SEQ ID NO: 320784 - DNA, 15 bp, Homo sapiens
tagaaatatagatta

SEQ ID NO: 320785 - DNA, 15 bp, Homo sapiens
agaaatatagattat

SEQ ID NO: 320786 - DNA, 15 bp, Homo sapiens
gaaatatagattata

SEQ ID NO: 320787 - DNA, 15 bp, Homo sapiens
aaatatagattatat

SEQ ID NO: 320788 - DNA, 15 bp, Homo sapiens
aatatagattatatg

SEQ ID NO: 320789 - DNA, 15 bp, Homo sapiens
atatagattatatga

SEQ ID NO: 320790 - DNA, 15 bp, Homo sapiens
tatagattatatgat

SEQ ID NO: 320791 - DNA, 15 bp, Homo sapiens
atagattatatgatg

SEQ ID NO: 320792 - DNA, 15 bp, Homo sapiens
tagattatatgatgg

SEQ ID NO: 320793 - DNA, 15 bp, Homo sapiens
agattatatgatggt

SEQ ID NO: 320794 - DNA, 15 bp, Homo sapiens
gattatatgatggta

SEQ ID NO: 320795 - DNA, 15 bp, Homo sapiens
attatatgatggtat

SEQ ID NO: 320796 - DNA, 15 bp, Homo sapiens
ttatatgatggtatt

SEQ ID NO: 320797 - DNA, 15 bp, Homo sapiens
tatatgatggtattt

SEQ ID NO: 320798 - DNA, 15 bp, Homo sapiens
atatgatggtattta

SEQ ID NO: 320799 - DNA, 15 bp, Homo sapiens
tatgatggtatttag

SEQ ID NO: 320800 - DNA, 15 bp, Homo sapiens
atgatggtatttagg

SEQ ID NO: 320801 - DNA, 15 bp, Homo sapiens
tgatggtatttaggg

SEQ ID NO: 320802 - DNA, 15 bp, Homo sapiens
gatggtatttagggt

SEQ ID NO: 320803 - DNA, 15 bp, Homo sapiens
atggtatttagggta

SEQ ID NO: 320804 - DNA, 15 bp, Homo sapiens
tggtatttagggtaa

SEQ ID NO: 320805 - DNA, 15 bp, Homo sapiens
ggtatttagggtaag

SEQ ID NO: 320806 - DNA, 15 bp, Homo sapiens
gtatttagggtaagc

SEQ ID NO: 320807 - DNA, 15 bp, Homo sapiens
tatttagggtaagca

SEQ ID NO: 320808 - DNA, 15 bp, Homo sapiens
atttagggtaagcat

SEQ ID NO: 320809 - DNA, 15 bp, Homo sapiens
tttagggtaagcatt

SEQ ID NO: 320810 - DNA, 15 bp, Homo sapiens
ttagggtaagcattt

SEQ ID NO: 320811 - DNA, 15 bp, Homo sapiens
tagggtaagcatttt

SEQ ID NO: 320812 - DNA, 15 bp, Homo sapiens
agggtaagcattttt

SEQ ID NO: 320813 - DNA, 15 bp, Homo sapiens
gggtaagcattttta

SEQ ID NO: 320814 - DNA, 15 bp, Homo sapiens
ggtaagcatttttat

SEQ ID NO: 320815 - DNA, 15 bp, Homo sapiens
gtaagcatttttatc

SEQ ID NO: 320816 - DNA, 15 bp, Homo sapiens
taagcatttttatct

SEQ ID NO: 320817 - DNA, 15 bp, Homo sapiens
aagcatttttatctc

SEQ ID NO: 320818 - DNA, 15 bp, Homo sapiens
agcatttttatctct

SEQ ID NO: 320819 - DNA, 15 bp, Homo sapiens
gcatttttatctcta

SEQ ID NO: 320820 - DNA, 15 bp, Homo sapiens
catttttatctctaa

SEQ ID NO: 320821 - DNA, 15 bp, Homo sapiens
atttttatctctaaa

SEQ ID NO: 320822 - DNA, 15 bp, Homo sapiens
tttttatctctaaaa

SEQ ID NO: 320823 - DNA, 15 bp, Homo sapiens
ttttatctctaaaat

SEQ ID NO: 320824 - DNA, 15 bp, Homo sapiens
tttatctctaaaatg

SEQ ID NO: 320825 - DNA, 15 bp, Homo sapiens
ttatctctaaaatga

SEQ ID NO: 320826 - DNA, 15 bp, Homo sapiens
tatctctaaaatgag

SEQ ID NO: 320827 - DNA, 15 bp, Homo sapiens
atctctaaaatgagt

SEQ ID NO: 320828 - DNA, 15 bp, Homo sapiens
tctctaaaatgagtt

SEQ ID NO: 320829 - DNA, 15 bp, Homo sapiens
ctctaaaatgagtta

SEQ ID NO: 320830 - DNA, 15 bp, Homo sapiens
tctaaaatgagttag

SEQ ID NO: 320831 - DNA, 15 bp, Homo sapiens
ctaaaatgagttaga

SEQ ID NO: 320832 - DNA, 15 bp, Homo sapiens
taaaatgagttagat

SEQ ID NO: 320833 - DNA, 15 bp, Homo sapiens
aaaatgagttagata

SEQ ID NO: 320834 - DNA, 15 bp, Homo sapiens
aaatgagttagatat

SEQ ID NO: 320835 - DNA, 15 bp, Homo sapiens
aatgagttagatatc

SEQ ID NO: 320836 - DNA, 15 bp, Homo sapiens
atgagttagatatca

SEQ ID NO: 320837 - DNA, 15 bp, Homo sapiens
tgagttagatatcaa

SEQ ID NO: 320838 - DNA, 15 bp, Homo sapiens
gagttagatatcaag

SEQ ID NO: 320839 - DNA, 15 bp, Homo sapiens
agttagatatcaagg

SEQ ID NO: 320840 - DNA, 15 bp, Homo sapiens
gttagatatcaagga

SEQ ID NO: 320841 - DNA, 15 bp, Homo sapiens
ttagatatcaaggat

SEQ ID NO: 320842 - DNA, 15 bp, Homo sapiens
tagatatcaaggatg

SEQ ID NO: 320843 - DNA, 15 bp, Homo sapiens
agatatcaaggatgg

SEQ ID NO: 320844 - DNA, 15 bp, Homo sapiens
gatatcaaggatggc

SEQ ID NO: 320845 - DNA, 15 bp, Homo sapiens
atatcaaggatggca

SEQ ID NO: 320846 - DNA, 15 bp, Homo sapiens
tatcaaggatggcat

SEQ ID NO: 320847 - DNA, 15 bp, Homo sapiens
atcaaggatggcatg

SEQ ID NO: 320848 - DNA, 15 bp, Homo sapiens
tcaaggatggcatgg

SEQ ID NO: 320849 - DNA, 15 bp, Homo sapiens
caaggatggcatggt

SEQ ID NO: 320850 - DNA, 15 bp, Homo sapiens
aaggatggcatggta

SEQ ID NO: 320851 - DNA, 15 bp, Homo sapiens
aggatggcatggtat

SEQ ID NO: 320852 - DNA, 15 bp, Homo sapiens
ggatggcatggtatt

SEQ ID NO: 320853 - DNA, 15 bp, Homo sapiens
gatggcatggtatta

SEQ ID NO: 320854 - DNA, 15 bp, Homo sapiens
atggcatggtattag

SEQ ID NO: 320855 - DNA, 15 bp, Homo sapiens
tggcatggtattaga

SEQ ID NO: 320856 - DNA, 15 bp, Homo sapiens
ggcatggtattagat

SEQ ID NO: 320857 - DNA, 15 bp, Homo sapiens
gcatggtattagatt

SEQ ID NO: 320858 - DNA, 15 bp, Homo sapiens
catggtattagatta

SEQ ID NO: 320859 - DNA, 15 bp, Homo sapiens
atggtattagattac

SEQ ID NO: 320860 - DNA, 15 bp, Homo sapiens
tggtattagattaca

SEQ ID NO: 320861 - DNA, 15 bp, Homo sapiens
ggtattagattacac

SEQ ID NO: 320862 - DNA, 15 bp, Homo sapiens
gtattagattacaca

SEQ ID NO: 320863 - DNA, 15 bp, Homo sapiens
tattagattacacaa

SEQ ID NO: 320864 - DNA, 15 bp, Homo sapiens
attagattacacaat

SEQ ID NO: 320865 - DNA, 15 bp, Homo sapiens
ttagattacacaata

SEQ ID NO: 320866 - DNA, 15 bp, Homo sapiens
tagattacacaatat

SEQ ID NO: 320867 - DNA, 15 bp, Homo sapiens
agattacacaatatt

SEQ ID NO: 320868 - DNA, 15 bp, Homo sapiens
gattacacaatattt

SEQ ID NO: 320869 - DNA, 15 bp, Homo sapiens
attacacaatatttg

SEQ ID NO: 320870 - DNA, 15 bp, Homo sapiens
ttacacaatatttga

SEQ ID NO: 320871 - DNA, 15 bp, Homo sapiens
tacacaatatttgaa

SEQ ID NO: 320872 - DNA, 15 bp, Homo sapiens
acacaatatttgaaa

SEQ ID NO: 320873 - DNA, 15 bp, Homo sapiens
cacaatatttgaaaa

SEQ ID NO: 320874 - DNA, 15 bp, Homo sapiens
acaatatttgaaaag

SEQ ID NO: 320875 - DNA, 15 bp, Homo sapiens
caatatttgaaaaga

SEQ ID NO: 320876 - DNA, 15 bp, Homo sapiens
aatatttgaaaagaa

SEQ ID NO: 320877 - DNA, 15 bp, Homo sapiens
atatttgaaaagaat

SEQ ID NO: 320878 - DNA, 15 bp, Homo sapiens
tatttgaaaagaata

SEQ ID NO: 320879 - DNA, 15 bp, Homo sapiens
atttgaaaagaataa

SEQ ID NO: 320880 - DNA, 15 bp, Homo sapiens
tttgaaaagaataat

SEQ ID NO: 320881 - DNA, 15 bp, Homo sapiens
ttgaaaagaataata

SEQ ID NO: 320882 - DNA, 15 bp, Homo sapiens
tgaaaagaataataa

SEQ ID NO: 320883 - DNA, 15 bp, Homo sapiens
gaaaagaataataag

SEQ ID NO: 320884 - DNA, 15 bp, Homo sapiens
aaaagaataataaga

SEQ ID NO: 320885 - DNA, 15 bp, Homo sapiens
aaagaataataagaa

SEQ ID NO: 320886 - DNA, 15 bp, Homo sapiens
aagaataataagaaa

SEQ ID NO: 320887 - DNA, 15 bp, Homo sapiens
agaataataagaaaa

SEQ ID NO: 320888 - DNA, 15 bp, Homo sapiens
gaataataagaaaaa

SEQ ID NO: 320889 - DNA, 15 bp, Homo sapiens
aataataagaaaaat

SEQ ID NO: 320890 - DNA, 15 bp, Homo sapiens
ataataagaaaaatc

SEQ ID NO: 320891 - DNA, 15 bp, Homo sapiens
taataagaaaaatcc

SEQ ID NO: 320892 - DNA, 15 bp, Homo sapiens
aataagaaaaatcct

SEQ ID NO: 320893 - DNA, 15 bp, Homo sapiens
ataagaaaaatcctg

SEQ ID NO: 320894 - DNA, 15 bp, Homo sapiens
taagaaaaatcctgc

SEQ ID NO: 320895 - DNA, 15 bp, Homo sapiens
aagaaaaatcctgca

SEQ ID NO: 320896 - DNA, 15 bp, Homo sapiens
agaaaaatcctgcag

SEQ ID NO: 320897 - DNA, 15 bp, Homo sapiens
gaaaaatcctgcagg

SEQ ID NO: 320898 - DNA, 15 bp, Homo sapiens
aaaaatcctgcagga

SEQ ID NO: 320899 - DNA, 15 bp, Homo sapiens
aaaatcctgcaggat

SEQ ID NO: 320900 - DNA, 15 bp, Homo sapiens
atcctgcaggattta

SEQ ID NO: 320901 - DNA, 15 bp, Homo sapiens
tcctgcaggatttaa

SEQ ID NO: 320902 - DNA, 15 bp, Homo sapiens
cctgcaggatttaaa

SEQ ID NO: 320903 - DNA, 15 bp, Homo sapiens
ctgcaggatttaaaa

SEQ ID NO: 320904 - DNA, 15 bp, Homo sapiens
tgcaggatttaaaaa

SEQ ID NO: 320905 - DNA, 15 bp, Homo sapiens
gcaggatttaaaaat

SEQ ID NO: 320906 - DNA, 15 bp, Homo sapiens
caggatttaaaaatc

SEQ ID NO: 320907 - DNA, 15 bp, Homo sapiens
aggatttaaaaatct

SEQ ID NO: 320908 - DNA, 15 bp, Homo sapiens
ggatttaaaaatctt

SEQ ID NO: 320909 - DNA, 15 bp, Homo sapiens
gatttaaaaatctta

SEQ ID NO: 320910 - DNA, 15 bp, Homo sapiens
atttaaaaatcttat

SEQ ID NO: 320911 - DNA, 15 bp, Homo sapiens
tttaaaaatcttatt

SEQ ID NO: 320912 - DNA, 15 bp, Homo sapiens
ttaaaaatcttatta

SEQ ID NO: 320913 - DNA, 15 bp, Homo sapiens
taaaaatcttattag

SEQ ID NO: 320914 - DNA, 15 bp, Homo sapiens
aaaaatcttattagt

SEQ ID NO: 320915 - DNA, 15 bp, Homo sapiens
aaaatcttattagta

SEQ ID NO: 320916 - DNA, 15 bp, Homo sapiens
aaatcttattagtac

SEQ ID NO: 320917 - DNA, 15 bp, Homo sapiens
aatcttattagtact

SEQ ID NO: 320918 - DNA, 15 bp, Homo sapiens
atcttattagtactc

SEQ ID NO: 320919 - DNA, 15 bp, Homo sapiens
tcttattagtactct

SEQ ID NO: 320920 - DNA, 15 bp, Homo sapiens
cttattagtactctt

SEQ ID NO: 320921 - DNA, 15 bp, Homo sapiens
ttattagtactcttc

SEQ ID NO: 320922 - DNA, 15 bp, Homo sapiens
tattagtactcttct

SEQ ID NO: 320923 - DNA, 15 bp, Homo sapiens
attagtactcttctg

SEQ ID NO: 320924 - DNA, 15 bp, Homo sapiens
ttagtactcttctgt

SEQ ID NO: 320925 - DNA, 15 bp, Homo sapiens
tagtactcttctgta

SEQ ID NO: 320926 - DNA, 15 bp, Homo sapiens
agtactcttctgtag

SEQ ID NO: 320927 - DNA, 15 bp, Homo sapiens
gtactcttctgtaga

SEQ ID NO: 320928 - DNA, 15 bp, Homo sapiens
tactcttctgtagaa

SEQ ID NO: 320929 - DNA, 15 bp, Homo sapiens
actcttctgtagaaa

SEQ ID NO: 320930 - DNA, 15 bp, Homo sapiens
ctcttctgtagaaat

SEQ ID NO: 320931 - DNA, 15 bp, Homo sapiens
tcttctgtagaaata

SEQ ID NO: 320932 - DNA, 15 bp, Homo sapiens
cttctgtagaaatac

SEQ ID NO: 320933 - DNA, 15 bp, Homo sapiens
ttctgtagaaatact

SEQ ID NO: 320934 - DNA, 15 bp, Homo sapiens
tctgtagaaatactt

SEQ ID NO: 320935 - DNA, 15 bp, Homo sapiens
ctgtagaaatacttt

SEQ ID NO: 320936 - DNA, 15 bp, Homo sapiens
tgtagaaatacttta

SEQ ID NO: 320937 - DNA, 15 bp, Homo sapiens
gtagaaatactttag

SEQ ID NO: 320938 - DNA, 15 bp, Homo sapiens
tagaaatactttagg

SEQ ID NO: 320939 - DNA, 15 bp, Homo sapiens
agaaatactttaggg

SEQ ID NO: 320940 - DNA, 15 bp, Homo sapiens
gaaatactttaggga

SEQ ID NO: 320941 - DNA, 15 bp, Homo sapiens
aaatactttagggaa

SEQ ID NO: 320942 - DNA, 15 bp, Homo sapiens
aatactttagggaat

SEQ ID NO: 320943 - DNA, 15 bp, Homo sapiens
atactttagggaatg

SEQ ID NO: 320944 - DNA, 15 bp, Homo sapiens
tactttagggaatgg

SEQ ID NO: 320945 - DNA, 15 bp, Homo sapiens
actttagggaatggt

SEQ ID NO: 320946 - DNA, 15 bp, Homo sapiens
ctttagggaatggtt

SEQ ID NO: 320947 - DNA, 15 bp, Homo sapiens
tttagggaatggttc

SEQ ID NO: 320948 - DNA, 15 bp, Homo sapiens
ttagggaatggttca

SEQ ID NO: 320949 - DNA, 15 bp, Homo sapiens
tagggaatggttcag

SEQ ID NO: 320950 - DNA, 15 bp, Homo sapiens
agggaatggttcaga

SEQ ID NO: 320951 - DNA, 15 bp, Homo sapiens
gggaatggttcagac

SEQ ID NO: 320952 - DNA, 15 bp, Homo sapiens
ggaatggttcagaca

SEQ ID NO: 320953 - DNA, 15 bp, Homo sapiens
gaatggttcagacag

SEQ ID NO: 320954 - DNA, 15 bp, Homo sapiens
aatggttcagacagt

SEQ ID NO: 320955 - DNA, 15 bp, Homo sapiens
atggttcagacagta

SEQ ID NO: 320956 - DNA, 15 bp, Homo sapiens
tggttcagacagtat

SEQ ID NO: 320957 - DNA, 15 bp, Homo sapiens
ggttcagacagtatc

SEQ ID NO: 320958 - DNA, 15 bp, Homo sapiens
gttcagacagtatca

SEQ ID NO: 320959 - DNA, 15 bp, Homo sapiens
ttcagacagtatcag

SEQ ID NO: 320960 - DNA, 15 bp, Homo sapiens
tcagacagtatcagg

SEQ ID NO: 320961 - DNA, 15 bp, Homo sapiens
cagacagtatcaggt

SEQ ID NO: 320962 - DNA, 15 bp, Homo sapiens
agacagtatcaggtg

SEQ ID NO: 320963 - DNA, 15 bp, Homo sapiens
gacagtatcaggtgc

SEQ ID NO: 320964 - DNA, 15 bp, Homo sapiens
acagtatcaggtgct

SEQ ID NO: 320965 - DNA, 15 bp, Homo sapiens
cagtatcaggtgctg

SEQ ID NO: 320966 - DNA, 15 bp, Homo sapiens
agtatcaggtgctgt

SEQ ID NO: 320967 - DNA, 15 bp, Homo sapiens
gtatcaggtgctgtg

SEQ ID NO: 320968 - DNA, 15 bp, Homo sapiens
tatcaggtgctgtgg

SEQ ID NO: 320969 - DNA, 15 bp, Homo sapiens
atcaggtgctgtggg

SEQ ID NO: 320970 - DNA, 15 bp, Homo sapiens
tcaggtgctgtgggt

SEQ ID NO: 320971 - DNA, 15 bp, Homo sapiens
caggtgctgtgggtg

SEQ ID NO: 320972 - DNA, 15 bp, Homo sapiens
aggtgctgtgggtgt

SEQ ID NO: 320973 - DNA, 15 bp, Homo sapiens
ggtgctgtgggtgta

SEQ ID NO: 320974 - DNA, 15 bp, Homo sapiens
gtgctgtgggtgtaa

SEQ ID NO: 320975 - DNA, 15 bp, Homo sapiens
tgctgtgggtgtaag

SEQ ID NO: 320976 - DNA, 15 bp, Homo sapiens
gctgtgggtgtaagc

SEQ ID NO: 320977 - DNA, 15 bp, Homo sapiens
ctgtgggtgtaagca

SEQ ID NO: 320978 - DNA, 15 bp, Homo sapiens
tgtgggtgtaagcat

SEQ ID NO: 320979 - DNA, 15 bp, Homo sapiens
gtgggtgtaagcatg

SEQ ID NO: 320980 - DNA, 15 bp, Homo sapiens
tgggtgtaagcatgg

SEQ ID NO: 320981 - DNA, 15 bp, Homo sapiens
gggtgtaagcatggc

SEQ ID NO: 320982 - DNA, 15 bp, Homo sapiens
ggtgtaagcatggcc

SEQ ID NO: 320983 - DNA, 15 bp, Homo sapiens
gtgtaagcatggcca

SEQ ID NO: 320984 - DNA, 15 bp, Homo sapiens
tgtaagcatggccac

SEQ ID NO: 320985 - DNA, 15 bp, Homo sapiens
gtaagcatggccacc

SEQ ID NO: 320986 - DNA, 15 bp, Homo sapiens
taagcatggccacct

SEQ ID NO: 320987 - DNA, 15 bp, Homo sapiens
aagcatggccacctg

SEQ ID NO: 320988 - DNA, 15 bp, Homo sapiens
agcatggccacctgc

SEQ ID NO: 320989 - DNA, 15 bp, Homo sapiens
gcatggccacctgct

SEQ ID NO: 320990 - DNA, 15 bp, Homo sapiens
catggccacctgcta

SEQ ID NO: 320991 - DNA, 15 bp, Homo sapiens
atggccacctgctag

SEQ ID NO: 320992 - DNA, 15 bp, Homo sapiens
tggccacctgctagc

SEQ ID NO: 320993 - DNA, 15 bp, Homo sapiens
ggccacctgctagct

SEQ ID NO: 320994 - DNA, 15 bp, Homo sapiens
gccacctgctagctc

SEQ ID NO: 320995 - DNA, 15 bp, Homo sapiens
ccacctgctagctct

SEQ ID NO: 320996 - DNA, 15 bp, Homo sapiens
cacctgctagctctg

SEQ ID NO: 320997 - DNA, 15 bp, Homo sapiens
acctgctagctctgt

SEQ ID NO: 320998 - DNA, 15 bp, Homo sapiens
cctgctagctctgtg

SEQ ID NO: 320999 - DNA, 15 bp, Homo sapiens
ctgctagctctgtga

SEQ ID NO: 321000 - DNA, 15 bp, Homo sapiens
tgctagctctgtgaa

SEQ ID NO: 321001 - DNA, 15 bp, Homo sapiens
gctagctctgtgaac

SEQ ID NO: 321002 - DNA, 15 bp, Homo sapiens
ctagctctgtgaacc

SEQ ID NO: 321003 - DNA, 15 bp, Homo sapiens
tagctctgtgaacct

SEQ ID NO: 321004 - DNA, 15 bp, Homo sapiens
agctctgtgaacctg

SEQ ID NO: 321005 - DNA, 15 bp, Homo sapiens
gctctgtgaacctgg

SEQ ID NO: 321006 - DNA, 15 bp, Homo sapiens
ctctgtgaacctgga

SEQ ID NO: 321007 - DNA, 15 bp, Homo sapiens
tctgtgaacctggac

SEQ ID NO: 321008 - DNA, 15 bp, Homo sapiens
ctgtgaacctggaca

SEQ ID NO: 321009 - DNA, 15 bp, Homo sapiens
tgtgaacctggacaa

SEQ ID NO: 321010 - DNA, 15 bp, Homo sapiens
gtgaacctggacaaa

SEQ ID NO: 321011 - DNA, 15 bp, Homo sapiens
tgaacctggacaaat

SEQ ID NO: 321012 - DNA, 15 bp, Homo sapiens
gaacctggacaaatg

SEQ ID NO: 321013 - DNA, 15 bp, Homo sapiens
aacctggacaaatgg

SEQ ID NO: 321014 - DNA, 15 bp, Homo sapiens
acctggacaaatggc

SEQ ID NO: 321015 - DNA, 15 bp, Homo sapiens
cctggacaaatggct

SEQ ID NO: 321016 - DNA, 15 bp, Homo sapiens
ctggacaaatggctt

SEQ ID NO: 321017 - DNA, 15 bp, Homo sapiens
tggacaaatggctta

SEQ ID NO: 321018 - DNA, 15 bp, Homo sapiens
ggacaaatggcttag

SEQ ID NO: 321019 - DNA, 15 bp, Homo sapiens
gacaaatggcttagc

SEQ ID NO: 321020 - DNA, 15 bp, Homo sapiens
acaaatggcttagct

SEQ ID NO: 321021 - DNA, 15 bp, Homo sapiens
caaatggcttagctg

SEQ ID NO: 321022 - DNA, 15 bp, Homo sapiens
aaatggcttagctgc

SEQ ID NO: 321023 - DNA, 15 bp, Homo sapiens
aatggcttagctgct

SEQ ID NO: 321024 - DNA, 15 bp, Homo sapiens
atggcttagctgctc

SEQ ID NO: 321025 - DNA, 15 bp, Homo sapiens
tggcttagctgctct

SEQ ID NO: 321026 - DNA, 15 bp, Homo sapiens
ggcttagctgctctg

SEQ ID NO: 321027 - DNA, 15 bp, Homo sapiens
gcttagctgctctgt

SEQ ID NO: 321028 - DNA, 15 bp, Homo sapiens
cttagctgctctgtg

SEQ ID NO: 321029 - DNA, 15 bp, Homo sapiens
ttagctgctctgtgc

SEQ ID NO: 321030 - DNA, 15 bp, Homo sapiens
tagctgctctgtgcc

SEQ ID NO: 321031 - DNA, 15 bp, Homo sapiens
agctgctctgtgcct

SEQ ID NO: 321032 - DNA, 15 bp, Homo sapiens
gctgctctgtgcctg

SEQ ID NO: 321033 - DNA, 15 bp, Homo sapiens
ctgctctgtgcctga

SEQ ID NO: 321034 - DNA, 15 bp, Homo sapiens
tgctctgtgcctgag

SEQ ID NO: 321035 - DNA, 15 bp, Homo sapiens
gctctgtgcctgagt

SEQ ID NO: 321036 - DNA, 15 bp, Homo sapiens
ctctgtgcctgagta

SEQ ID NO: 321037 - DNA, 15 bp, Homo sapiens
tctgtgcctgagtaa

SEQ ID NO: 321038 - DNA, 15 bp, Homo sapiens
ctgtgcctgagtaaa

SEQ ID NO: 321039 - DNA, 15 bp, Homo sapiens
tgtgcctgagtaaag

SEQ ID NO: 321040 - DNA, 15 bp, Homo sapiens
gtgcctgagtaaagt

SEQ ID NO: 321041 - DNA, 15 bp, Homo sapiens
tgcctgagtaaagta

SEQ ID NO: 321042 - DNA, 15 bp, Homo sapiens
gcctgagtaaagtag

SEQ ID NO: 321043 - DNA, 15 bp, Homo sapiens
cctgagtaaagtaga

SEQ ID NO: 321044 - DNA, 15 bp, Homo sapiens
ctgagtaaagtagag

SEQ ID NO: 321045 - DNA, 15 bp, Homo sapiens
tgagtaaagtagaga

SEQ ID NO: 321046 - DNA, 15 bp, Homo sapiens
gagtaaagtagagat

SEQ ID NO: 321047 - DNA, 15 bp, Homo sapiens
agtaaagtagagata

SEQ ID NO: 321048 - DNA, 15 bp, Homo sapiens
gtaaagtagagatag

SEQ ID NO: 321049 - DNA, 15 bp, Homo sapiens
taaagtagagatagt

SEQ ID NO: 321050 - DNA, 15 bp, Homo sapiens
aaagtagagatagta

SEQ ID NO: 321051 - DNA, 15 bp, Homo sapiens
aagtagagatagtaa

SEQ ID NO: 321052 - DNA, 15 bp, Homo sapiens
agtagagatagtaat

SEQ ID NO: 321053 - DNA, 15 bp, Homo sapiens
gtagagatagtaata

SEQ ID NO: 321054 - DNA, 15 bp, Homo sapiens
tagagatagtaatag

SEQ ID NO: 321055 - DNA, 15 bp, Homo sapiens
agagatagtaatagc

SEQ ID NO: 321056 - DNA, 15 bp, Homo sapiens
gagatagtaatagca

SEQ ID NO: 321057 - DNA, 15 bp, Homo sapiens
agatagtaatagcat

SEQ ID NO: 321058 - DNA, 15 bp, Homo sapiens
gatagtaatagcatc

SEQ ID NO: 321059 - DNA, 15 bp, Homo sapiens
atagtaatagcatca

SEQ ID NO: 321060 - DNA, 15 bp, Homo sapiens
tagtaatagcatcaa

SEQ ID NO: 321061 - DNA, 15 bp, Homo sapiens
agtaatagcatcaac

SEQ ID NO: 321062 - DNA, 15 bp, Homo sapiens
gtaatagcatcaacc

SEQ ID NO: 321063 - DNA, 15 bp, Homo sapiens
taatagcatcaacct

SEQ ID NO: 321064 - DNA, 15 bp, Homo sapiens
aatagcatcaacctc

SEQ ID NO: 321065 - DNA, 15 bp, Homo sapiens
atagcatcaacctcc

SEQ ID NO: 321066 - DNA, 15 bp, Homo sapiens
tagcatcaacctcct

SEQ ID NO: 321067 - DNA, 15 bp, Homo sapiens
agcatcaacctcctc

SEQ ID NO: 321068 - DNA, 15 bp, Homo sapiens
gcatcaacctcctcg

SEQ ID NO: 321069 - DNA, 15 bp, Homo sapiens
catcaacctcctcgt

SEQ ID NO: 321070 - DNA, 15 bp, Homo sapiens
atcaacctcctcgtg

SEQ ID NO: 321071 - DNA, 15 bp, Homo sapiens
tcaacctcctcgtgt

SEQ ID NO: 321072 - DNA, 15 bp, Homo sapiens
caacctcctcgtgtt

SEQ ID NO: 321073 - DNA, 15 bp, Homo sapiens
aacctcctcgtgttg

SEQ ID NO: 321074 - DNA, 15 bp, Homo sapiens
acctcctcgtgttgt

SEQ ID NO: 321075 - DNA, 15 bp, Homo sapiens
cctcctcgtgttgta

SEQ ID NO: 321076 - DNA, 15 bp, Homo sapiens
ctcctcgtgttgtaa

SEQ ID NO: 321077 - DNA, 15 bp, Homo sapiens
tcctcgtgttgtaaa

SEQ ID NO: 321078 - DNA, 15 bp, Homo sapiens
cctcgtgttgtaaaa

SEQ ID NO: 321079 - DNA, 15 bp, Homo sapiens
ctcgtgttgtaaaaa

SEQ ID NO: 321080 - DNA, 15 bp, Homo sapiens
tcgtgttgtaaaaag

SEQ ID NO: 321081 - DNA, 15 bp, Homo sapiens
cgtgttgtaaaaagt

SEQ ID NO: 321082 - DNA, 15 bp, Homo sapiens
gtgttgtaaaaagta

SEQ ID NO: 321083 - DNA, 15 bp, Homo sapiens
tgttgtaaaaagtaa

SEQ ID NO: 321084 - DNA, 15 bp, Homo sapiens
gttgtaaaaagtaag

SEQ ID NO: 321085 - DNA, 15 bp, Homo sapiens
ttgtaaaaagtaagt

SEQ ID NO: 321086 - DNA, 15 bp, Homo sapiens
tgtaaaaagtaagtg

SEQ ID NO: 321087 - DNA, 15 bp, Homo sapiens
gtaaaaagtaagtga

SEQ ID NO: 321088 - DNA, 15 bp, Homo sapiens
taaaaagtaagtgaa

SEQ ID NO: 321089 - DNA, 15 bp, Homo sapiens
aaaaagtaagtgaat

SEQ ID NO: 321090 - DNA, 15 bp, Homo sapiens
aaaagtaagtgaatt

SEQ ID NO: 321091 - DNA, 15 bp, Homo sapiens
aaagtaagtgaatta

SEQ ID NO: 321092 - DNA, 15 bp, Homo sapiens
aagtaagtgaattaa

SEQ ID NO: 321093 - DNA, 15 bp, Homo sapiens
agtaagtgaattaac

SEQ ID NO: 321094 - DNA, 15 bp, Homo sapiens
gtaagtgaattaaca

SEQ ID NO: 321095 - DNA, 15 bp, Homo sapiens
taagtgaattaacat

SEQ ID NO: 321096 - DNA, 15 bp, Homo sapiens
aagtgaattaacata

SEQ ID NO: 321097 - DNA, 15 bp, Homo sapiens
agtgaattaacatat

SEQ ID NO: 321098 - DNA, 15 bp, Homo sapiens
gtgaattaacatata

SEQ ID NO: 321099 - DNA, 15 bp, Homo sapiens
tgaattaacatatat

SEQ ID NO: 321100 - DNA, 15 bp, Homo sapiens
gaattaacatatata

SEQ ID NO: 321101 - DNA, 15 bp, Homo sapiens
aattaacatatataa

SEQ ID NO: 321102 - DNA, 15 bp, Homo sapiens
attaacatatataaa

SEQ ID NO: 321103 - DNA, 15 bp, Homo sapiens
ttaacatatataaag

SEQ ID NO: 321104 - DNA, 15 bp, Homo sapiens
taacatatataaagc

SEQ ID NO: 321105 - DNA, 15 bp, Homo sapiens
aacatatataaagca

SEQ ID NO: 321106 - DNA, 15 bp, Homo sapiens
acatatataaagcaa

SEQ ID NO: 321107 - DNA, 15 bp, Homo sapiens
catatataaagcaat

SEQ ID NO: 321108 - DNA, 15 bp, Homo sapiens
atatataaagcaatt

SEQ ID NO: 321109 - DNA, 15 bp, Homo sapiens
tatataaagcaattt

SEQ ID NO: 321110 - DNA, 15 bp, Homo sapiens
atataaagcaatttg

SEQ ID NO: 321111 - DNA, 15 bp, Homo sapiens
tataaagcaatttgg

SEQ ID NO: 321112 - DNA, 15 bp, Homo sapiens
ataaagcaatttggg

SEQ ID NO: 321113 - DNA, 15 bp, Homo sapiens
taaagcaatttgggg

SEQ ID NO: 321114 - DNA, 15 bp, Homo sapiens
aaagcaatttggggc

SEQ ID NO: 321115 - DNA, 15 bp, Homo sapiens
aagcaatttggggcc

SEQ ID NO: 321116 - DNA, 15 bp, Homo sapiens
agcaatttggggcca

SEQ ID NO: 321117 - DNA, 15 bp, Homo sapiens
gcaatttggggccag

SEQ ID NO: 321118 - DNA, 15 bp, Homo sapiens
caatttggggccagg

SEQ ID NO: 321119 - DNA, 15 bp, Homo sapiens
aatttggggccaggc

SEQ ID NO: 321120 - DNA, 15 bp, Homo sapiens
atttggggccaggcg

SEQ ID NO: 321121 - DNA, 15 bp, Homo sapiens
tttggggccaggcgc

SEQ ID NO: 321122 - DNA, 15 bp, Homo sapiens
ttggggccaggcgcg

SEQ ID NO: 321123 - DNA, 15 bp, Homo sapiens
tggggccaggcgcgg

SEQ ID NO: 321124 - DNA, 15 bp, Homo sapiens
ggggccaggcgcggt

SEQ ID NO: 321125 - DNA, 15 bp, Homo sapiens
gggccaggcgcggtg

SEQ ID NO: 321126 - DNA, 15 bp, Homo sapiens
ggccaggcgcggtgg

SEQ ID NO: 321127 - DNA, 15 bp, Homo sapiens
gccaggcgcggtggc

SEQ ID NO: 321128 - DNA, 15 bp, Homo sapiens
ccaggcgcggtggct

SEQ ID NO: 321129 - DNA, 15 bp, Homo sapiens
caggcgcggtggctc

SEQ ID NO: 321130 - DNA, 15 bp, Homo sapiens
aggcgcggtggctca

SEQ ID NO: 321131 - DNA, 15 bp, Homo sapiens
ggcgcggtggctcat

SEQ ID NO: 321132 - DNA, 15 bp, Homo sapiens
gcgcggtggctcatg

SEQ ID NO: 321133 - DNA, 15 bp, Homo sapiens
cgcggtggctcatgc

SEQ ID NO: 321134 - DNA, 15 bp, Homo sapiens
gcggtggctcatgcc

SEQ ID NO: 321135 - DNA, 15 bp, Homo sapiens
ccgagacgggtggat

SEQ ID NO: 321136 - DNA, 15 bp, Homo sapiens
cgagacgggtggatc

SEQ ID NO: 321137 - DNA, 15 bp, Homo sapiens
gagacgggtggatca

SEQ ID NO: 321138 - DNA, 15 bp, Homo sapiens
agacgggtggatcac

SEQ ID NO: 321139 - DNA, 15 bp, Homo sapiens
gacgggtggatcacg

SEQ ID NO: 321140 - DNA, 15 bp, Homo sapiens
acgggtggatcacga

SEQ ID NO: 321141 - DNA, 15 bp, Homo sapiens
catcctggctaacac

SEQ ID NO: 321142 - DNA, 15 bp, Homo sapiens
atcctggctaacacg

SEQ ID NO: 321143 - DNA, 15 bp, Homo sapiens
tcctggctaacacgg

SEQ ID NO: 321144 - DNA, 15 bp, Homo sapiens
cctggctaacacggt

SEQ ID NO: 321145 - DNA, 15 bp, Homo sapiens
ctggctaacacggtg

SEQ ID NO: 321146 - DNA, 15 bp, Homo sapiens
tggctaacacggtga

SEQ ID NO: 321147 - DNA, 15 bp, Homo sapiens
ggctaacacggtgaa

SEQ ID NO: 321148 - DNA, 15 bp, Homo sapiens
gctaacacggtgaaa

SEQ ID NO: 321149 - DNA, 15 bp, Homo sapiens
ctaacacggtgaaac

SEQ ID NO: 321150 - DNA, 15 bp, Homo sapiens
taacacggtgaaacc

SEQ ID NO: 321151 - DNA, 15 bp, Homo sapiens
aacacggtgaaaccc

SEQ ID NO: 321152 - DNA, 15 bp, Homo sapiens
acacggtgaaacccc

SEQ ID NO: 321153 - DNA, 15 bp, Homo sapiens
gaaaccccgtctcta

SEQ ID NO: 321154 - DNA, 15 bp, Homo sapiens
aaaccccgtctctac

SEQ ID NO: 321155 - DNA, 15 bp, Homo sapiens
aaccccgtctctact

SEQ ID NO: 321156 - DNA, 15 bp, Homo sapiens
accccgtctctacta

SEQ ID NO: 321157 - DNA, 15 bp, Homo sapiens
aaaaaattagccggc

SEQ ID NO: 321158 - DNA, 15 bp, Homo sapiens
aaaaattagccggcc

SEQ ID NO: 321159 - DNA, 15 bp, Homo sapiens
aaaattagccggcct

SEQ ID NO: 321160 - DNA, 15 bp, Homo sapiens
aaattagccggcctg

SEQ ID NO: 321161 - DNA, 15 bp, Homo sapiens
aattagccggcctga

SEQ ID NO: 321162 - DNA, 15 bp, Homo sapiens
attagccggcctgat

SEQ ID NO: 321163 - DNA, 15 bp, Homo sapiens
ttagccggcctgatg

SEQ ID NO: 321164 - DNA, 15 bp, Homo sapiens
tagccggcctgatgg

SEQ ID NO: 321165 - DNA, 15 bp, Homo sapiens
agccggcctgatggc

SEQ ID NO: 321166 - DNA, 15 bp, Homo sapiens
gccggcctgatggca

SEQ ID NO: 321167 - DNA, 15 bp, Homo sapiens
ccggcctgatggcag

SEQ ID NO: 321168 - DNA, 15 bp, Homo sapiens
cggcctgatggcagg

SEQ ID NO: 321169 - DNA, 15 bp, Homo sapiens
ggcctgatggcaggc

SEQ ID NO: 321170 - DNA, 15 bp, Homo sapiens
gcctgatggcaggcg

SEQ ID NO: 321171 - DNA, 15 bp, Homo sapiens
cctgatggcaggcgc

SEQ ID NO: 321172 - DNA, 15 bp, Homo sapiens
ctgatggcaggcgcc

SEQ ID NO: 321173 - DNA, 15 bp, Homo sapiens
tgatggcaggcgcct

SEQ ID NO: 321174 - DNA, 15 bp, Homo sapiens
gatggcaggcgcctg

SEQ ID NO: 321175 - DNA, 15 bp, Homo sapiens
atggcaggcgcctgt

SEQ ID NO: 321176 - DNA, 15 bp, Homo sapiens
tggcaggcgcctgta

SEQ ID NO: 321177 - DNA, 15 bp, Homo sapiens
ggcaggcgcctgtag

SEQ ID NO: 321178 - DNA, 15 bp, Homo sapiens
gcaggcgcctgtagt

SEQ ID NO: 321179 - DNA, 15 bp, Homo sapiens
caggcgcctgtagtc

SEQ ID NO: 321180 - DNA, 15 bp, Homo sapiens
aggcgcctgtagtcc

SEQ ID NO: 321181 - DNA, 15 bp, Homo sapiens
tcccagctactcgga

SEQ ID NO: 321182 - DNA, 15 bp, Homo sapiens
cccagctactcggaa

SEQ ID NO: 321183 - DNA, 15 bp, Homo sapiens
ccagctactcggaag

SEQ ID NO: 321184 - DNA, 15 bp, Homo sapiens
cagctactcggaagg

SEQ ID NO: 321185 - DNA, 15 bp, Homo sapiens
agctactcggaaggc

SEQ ID NO: 321186 - DNA, 15 bp, Homo sapiens
gctactcggaaggct

SEQ ID NO: 321187 - DNA, 15 bp, Homo sapiens
ctactcggaaggctg

SEQ ID NO: 321188 - DNA, 15 bp, Homo sapiens
tactcggaaggctga

SEQ ID NO: 321189 - DNA, 15 bp, Homo sapiens
actcggaaggctgag

SEQ ID NO: 321190 - DNA, 15 bp, Homo sapiens
ctcggaaggctgagg

SEQ ID NO: 321191 - DNA, 15 bp, Homo sapiens
tcggaaggctgaggc

SEQ ID NO: 321192 - DNA, 15 bp, Homo sapiens
cggaaggctgaggca

SEQ ID NO: 321193 - DNA, 15 bp, Homo sapiens
ggaaggctgaggcag

SEQ ID NO: 321194 - DNA, 15 bp, Homo sapiens
gaaggctgaggcagg

SEQ ID NO: 321195 - DNA, 15 bp, Homo sapiens
aaggctgaggcagga

SEQ ID NO: 321196 - DNA, 15 bp, Homo sapiens
aatggtgtgaaccca

SEQ ID NO: 321197 - DNA, 15 bp, Homo sapiens
atggtgtgaacccag

SEQ ID NO: 321198 - DNA, 15 bp, Homo sapiens
tggtgtgaacccagg

SEQ ID NO: 321199 - DNA, 15 bp, Homo sapiens
ggtgtgaacccagga

SEQ ID NO: 321200 - DNA, 15 bp, Homo sapiens
gtgtgaacccaggag

SEQ ID NO: 321201 - DNA, 15 bp, Homo sapiens
tgtgaacccaggagg

SEQ ID NO: 321202 - DNA, 15 bp, Homo sapiens
agcttgcagtgagcc

SEQ ID NO: 321203 - DNA, 15 bp, Homo sapiens
gcttgcagtgagccg

SEQ ID NO: 321204 - DNA, 15 bp, Homo sapiens
cttgcagtgagccga

SEQ ID NO: 321205 - DNA, 15 bp, Homo sapiens
ttgcagtgagccgag

SEQ ID NO: 321206 - DNA, 15 bp, Homo sapiens
tgcagtgagccgaga

SEQ ID NO: 321207 - DNA, 15 bp, Homo sapiens
gcagtgagccgagat

SEQ ID NO: 321208 - DNA, 15 bp, Homo sapiens
cagtgagccgagatt

SEQ ID NO: 321209 - DNA, 15 bp, Homo sapiens
agtgagccgagattg

SEQ ID NO: 321210 - DNA, 15 bp, Homo sapiens
gtgagccgagattgc

SEQ ID NO: 321211 - DNA, 15 bp, Homo sapiens
tgagccgagattgcg

SEQ ID NO: 321212 - DNA, 15 bp, Homo sapiens
gagccgagattgcgc

SEQ ID NO: 321213 - DNA, 15 bp, Homo sapiens
agccgagattgcgcc

SEQ ID NO: 321214 - DNA, 15 bp, Homo sapiens
gccgagattgcgcca

SEQ ID NO: 321215 - DNA, 15 bp, Homo sapiens
ccgagattgcgccac

SEQ ID NO: 321216 - DNA, 15 bp, Homo sapiens
cgagattgcgccact

SEQ ID NO: 321217 - DNA, 15 bp, Homo sapiens
gagattgcgccactg

SEQ ID NO: 321218 - DNA, 15 bp, Homo sapiens
agattgcgccactgc

SEQ ID NO: 321219 - DNA, 15 bp, Homo sapiens
gattgcgccactgca

SEQ ID NO: 321220 - DNA, 15 bp, Homo sapiens
attgcgccactgcac

SEQ ID NO: 321221 - DNA, 15 bp, Homo sapiens
ttgcgccactgcact

SEQ ID NO: 321222 - DNA, 15 bp, Homo sapiens
tgcgccactgcactc

SEQ ID NO: 321223 - DNA, 15 bp, Homo sapiens
gcgccactgcactcc

SEQ ID NO: 321224 - DNA, 15 bp, Homo sapiens
ctccagcctgggtga

SEQ ID NO: 321225 - DNA, 15 bp, Homo sapiens
tccagcctgggtgac

SEQ ID NO: 321226 - DNA, 15 bp, Homo sapiens
ccagcctgggtgaca

SEQ ID NO: 321227 - DNA, 15 bp, Homo sapiens
cagcctgggtgacag

SEQ ID NO: 321228 - DNA, 15 bp, Homo sapiens
agcctgggtgacaga

SEQ ID NO: 321229 - DNA, 15 bp, Homo sapiens
gcctgggtgacagag

SEQ ID NO: 321230 - DNA, 15 bp, Homo sapiens
cctgggtgacagagc

SEQ ID NO: 321231 - DNA, 15 bp, Homo sapiens
ctgggtgacagagca

SEQ ID NO: 321232 - DNA, 15 bp, Homo sapiens
tgggtgacagagcaa

SEQ ID NO: 321233 - DNA, 15 bp, Homo sapiens
gggtgacagagcaag

SEQ ID NO: 321234 - DNA, 15 bp, Homo sapiens
ggtgacagagcaaga

SEQ ID NO: 321235 - DNA, 15 bp, Homo sapiens
gtgacagagcaagac

SEQ ID NO: 321236 - DNA, 15 bp, Homo sapiens
tgacagagcaagact

SEQ ID NO: 321237 - DNA, 15 bp, Homo sapiens
agagcaagactccat

SEQ ID NO: 321238 - DNA, 15 bp, Homo sapiens
gagcaagactccatc

SEQ ID NO: 321239 - DNA, 15 bp, Homo sapiens
agcaagactccatct

SEQ ID NO: 321240 - DNA, 15 bp, Homo sapiens
gcaagactccatctc

SEQ ID NO: 321241 - DNA, 15 bp, Homo sapiens
caagactccatctca

SEQ ID NO: 321242 - DNA, 15 bp, Homo sapiens
aagactccatctcaa

SEQ ID NO: 321243 - DNA, 15 bp, Homo sapiens
aaaaaaaaaaaaagc

SEQ ID NO: 321244 - DNA, 15 bp, Homo sapiens
aaaaaaaaaaaagca

SEQ ID NO: 321245 - DNA, 15 bp, Homo sapiens
aaaaaaaaaaagcaa

SEQ ID NO: 321246 - DNA, 15 bp, Homo sapiens
aaaaaaaaaagcaat

SEQ ID NO: 321247 - DNA, 15 bp, Homo sapiens
aaaaaaaaagcaatt

SEQ ID NO: 321248 - DNA, 15 bp, Homo sapiens
aaaaaaaagcaattt

SEQ ID NO: 321249 - DNA, 15 bp, Homo sapiens
aaaaaaagcaatttg

SEQ ID NO: 321250 - DNA, 15 bp, Homo sapiens
aaaaaagcaatttgg

SEQ ID NO: 321251 - DNA, 15 bp, Homo sapiens
aaaaagcaatttgga

SEQ ID NO: 321252 - DNA, 15 bp, Homo sapiens
aaaagcaatttggaa

SEQ ID NO: 321253 - DNA, 15 bp, Homo sapiens
aaagcaatttggaac

SEQ ID NO: 321254 - DNA, 15 bp, Homo sapiens
aagcaatttggaaca

SEQ ID NO: 321255 - DNA, 15 bp, Homo sapiens
agcaatttggaacat

SEQ ID NO: 321256 - DNA, 15 bp, Homo sapiens
gcaatttggaacata

SEQ ID NO: 321257 - DNA, 15 bp, Homo sapiens
caatttggaacatag

SEQ ID NO: 321258 - DNA, 15 bp, Homo sapiens
aatttggaacataga

SEQ ID NO: 321259 - DNA, 15 bp, Homo sapiens
atttggaacatagaa

SEQ ID NO: 321260 - DNA, 15 bp, Homo sapiens
tttggaacatagaag

SEQ ID NO: 321261 - DNA, 15 bp, Homo sapiens
ttggaacatagaagc

SEQ ID NO: 321262 - DNA, 15 bp, Homo sapiens
tggaacatagaagca

SEQ ID NO: 321263 - DNA, 15 bp, Homo sapiens
ggaacatagaagcac

SEQ ID NO: 321264 - DNA, 15 bp, Homo sapiens
gaacatagaagcact

SEQ ID NO: 321265 - DNA, 15 bp, Homo sapiens
aacatagaagcactc

SEQ ID NO: 321266 - DNA, 15 bp, Homo sapiens
acatagaagcactca

SEQ ID NO: 321267 - DNA, 15 bp, Homo sapiens
catagaagcactcaa

SEQ ID NO: 321268 - DNA, 15 bp, Homo sapiens
atagaagcactcaag

SEQ ID NO: 321269 - DNA, 15 bp, Homo sapiens
tagaagcactcaaga

SEQ ID NO: 321270 - DNA, 15 bp, Homo sapiens
agaagcactcaagaa

SEQ ID NO: 321271 - DNA, 15 bp, Homo sapiens
gaagcactcaagaaa

SEQ ID NO: 321272 - DNA, 15 bp, Homo sapiens
aagcactcaagaaat

SEQ ID NO: 321273 - DNA, 15 bp, Homo sapiens
agcactcaagaaatg

SEQ ID NO: 321274 - DNA, 15 bp, Homo sapiens
gcactcaagaaatgt

SEQ ID NO: 321275 - DNA, 15 bp, Homo sapiens
cactcaagaaatgta

SEQ ID NO: 321276 - DNA, 15 bp, Homo sapiens
actcaagaaatgtaa

SEQ ID NO: 321277 - DNA, 15 bp, Homo sapiens
ctcaagaaatgtaag

SEQ ID NO: 321278 - DNA, 15 bp, Homo sapiens
tcaagaaatgtaagc

SEQ ID NO: 321279 - DNA, 15 bp, Homo sapiens
caagaaatgtaagcc

SEQ ID NO: 321280 - DNA, 15 bp, Homo sapiens
aagaaatgtaagccg

SEQ ID NO: 321281 - DNA, 15 bp, Homo sapiens
agaaatgtaagccgt

SEQ ID NO: 321282 - DNA, 15 bp, Homo sapiens
gaaatgtaagccgtt

SEQ ID NO: 321283 - DNA, 15 bp, Homo sapiens
aaatgtaagccgtta

SEQ ID NO: 321284 - DNA, 15 bp, Homo sapiens
aatgtaagccgttac

SEQ ID NO: 321285 - DNA, 15 bp, Homo sapiens
atgtaagccgttacc

SEQ ID NO: 321286 - DNA, 15 bp, Homo sapiens
tgtaagccgttacct

SEQ ID NO: 321287 - DNA, 15 bp, Homo sapiens
gtaagccgttacctc

SEQ ID NO: 321288 - DNA, 15 bp, Homo sapiens
taagccgttacctcc

SEQ ID NO: 321289 - DNA, 15 bp, Homo sapiens
aagccgttacctcca

SEQ ID NO: 321290 - DNA, 15 bp, Homo sapiens
agccgttacctccat

SEQ ID NO: 321291 - DNA, 15 bp, Homo sapiens
gccgttacctccata

SEQ ID NO: 321292 - DNA, 15 bp, Homo sapiens
ccgttacctccatac

SEQ ID NO: 321293 - DNA, 15 bp, Homo sapiens
cgttacctccataca

SEQ ID NO: 321294 - DNA, 15 bp, Homo sapiens
gttacctccatacaa

SEQ ID NO: 321295 - DNA, 15 bp, Homo sapiens
ttacctccatacaaa

SEQ ID NO: 321296 - DNA, 15 bp, Homo sapiens
tacctccatacaaat

SEQ ID NO: 321297 - DNA, 15 bp, Homo sapiens
acctccatacaaata

SEQ ID NO: 321298 - DNA, 15 bp, Homo sapiens
cctccatacaaataa

SEQ ID NO: 321299 - DNA, 15 bp, Homo sapiens
ctccatacaaataat

SEQ ID NO: 321300 - DNA, 15 bp, Homo sapiens
tccatacaaataatt

SEQ ID NO: 321301 - DNA, 15 bp, Homo sapiens
ccatacaaataatta

SEQ ID NO: 321302 - DNA, 15 bp, Homo sapiens
catacaaataattat

SEQ ID NO: 321303 - DNA, 15 bp, Homo sapiens
atacaaataattatt

SEQ ID NO: 321304 - DNA, 15 bp, Homo sapiens
tacaaataattatta

SEQ ID NO: 321305 - DNA, 15 bp, Homo sapiens
acaaataattattat

SEQ ID NO: 321306 - DNA, 15 bp, Homo sapiens
caaataattattata

SEQ ID NO: 321307 - DNA, 15 bp, Homo sapiens
aaataattattataa

SEQ ID NO: 321308 - DNA, 15 bp, Homo sapiens
aataattattataat

SEQ ID NO: 321309 - DNA, 15 bp, Homo sapiens
ataattattataatg

SEQ ID NO: 321310 - DNA, 15 bp, Homo sapiens
taattattataatgt

SEQ ID NO: 321311 - DNA, 15 bp, Homo sapiens
aattattataatgtg

SEQ ID NO: 321312 - DNA, 15 bp, Homo sapiens
attattataatgtgg

SEQ ID NO: 321313 - DNA, 15 bp, Homo sapiens
ttattataatgtggg

SEQ ID NO: 321314 - DNA, 15 bp, Homo sapiens
tattataatgtgggt

SEQ ID NO: 321315 - DNA, 15 bp, Homo sapiens
attataatgtgggtt

SEQ ID NO: 321316 - DNA, 15 bp, Homo sapiens
ttataatgtgggttt

SEQ ID NO: 321317 - DNA, 15 bp, Homo sapiens
tataatgtgggttta

SEQ ID NO: 321318 - DNA, 15 bp, Homo sapiens
ataatgtgggtttat

SEQ ID NO: 321319 - DNA, 15 bp, Homo sapiens
taatgtgggtttatt

SEQ ID NO: 321320 - DNA, 15 bp, Homo sapiens
aatgtgggtttattt

SEQ ID NO: 321321 - DNA, 15 bp, Homo sapiens
atgtgggtttatttc

SEQ ID NO: 321322 - DNA, 15 bp, Homo sapiens
tgtgggtttatttct

SEQ ID NO: 321323 - DNA, 15 bp, Homo sapiens
gtgggtttatttctt

SEQ ID NO: 321324 - DNA, 15 bp, Homo sapiens
tgggtttatttcttt

SEQ ID NO: 321325 - DNA, 15 bp, Homo sapiens
gggtttatttctttc

SEQ ID NO: 321326 - DNA, 15 bp, Homo sapiens
ggtttatttctttcc

SEQ ID NO: 321327 - DNA, 15 bp, Homo sapiens
gtttatttctttcca

SEQ ID NO: 321328 - DNA, 15 bp, Homo sapiens
tttatttctttccag

SEQ ID NO: 321329 - DNA, 15 bp, Homo sapiens
ttatttctttccagt

SEQ ID NO: 321330 - DNA, 15 bp, Homo sapiens
tatttctttccagtc

SEQ ID NO: 321331 - DNA, 15 bp, Homo sapiens
atttctttccagtct

SEQ ID NO: 321332 - DNA, 15 bp, Homo sapiens
tttctttccagtctt

SEQ ID NO: 321333 - DNA, 15 bp, Homo sapiens
ttctttccagtcttt

SEQ ID NO: 321334 - DNA, 15 bp, Homo sapiens
tctttccagtctttt

SEQ ID NO: 321335 - DNA, 15 bp, Homo sapiens
ctttccagtctttta

SEQ ID NO: 321336 - DNA, 15 bp, Homo sapiens
tttccagtcttttaa

SEQ ID NO: 321337 - DNA, 15 bp, Homo sapiens
ttccagtcttttaaa

SEQ ID NO: 321338 - DNA, 15 bp, Homo sapiens
tccagtcttttaaaa

SEQ ID NO: 321339 - DNA, 15 bp, Homo sapiens
ccagtcttttaaaat

SEQ ID NO: 321340 - DNA, 15 bp, Homo sapiens
cagtcttttaaaata

SEQ ID NO: 321341 - DNA, 15 bp, Homo sapiens
agtcttttaaaataa

SEQ ID NO: 321342 - DNA, 15 bp, Homo sapiens
gtcttttaaaataag

SEQ ID NO: 321343 - DNA, 15 bp, Homo sapiens
tcttttaaaataagc

SEQ ID NO: 321344 - DNA, 15 bp, Homo sapiens
cttttaaaataagca

SEQ ID NO: 321345 - DNA, 15 bp, Homo sapiens
ttttaaaataagcat

SEQ ID NO: 321346 - DNA, 15 bp, Homo sapiens
tttaaaataagcatg

SEQ ID NO: 321347 - DNA, 15 bp, Homo sapiens
ttaaaataagcatgt

SEQ ID NO: 321348 - DNA, 15 bp, Homo sapiens
taaaataagcatgta

SEQ ID NO: 321349 - DNA, 15 bp, Homo sapiens
aaaataagcatgtaa

SEQ ID NO: 321350 - DNA, 15 bp, Homo sapiens
aaataagcatgtaaa

SEQ ID NO: 321351 - DNA, 15 bp, Homo sapiens
aataagcatgtaaaa

SEQ ID NO: 321352 - DNA, 15 bp, Homo sapiens
ataagcatgtaaaaa

SEQ ID NO: 321353 - DNA, 15 bp, Homo sapiens
taagcatgtaaaaat

SEQ ID NO: 321354 - DNA, 15 bp, Homo sapiens
aagcatgtaaaaata

SEQ ID NO: 321355 - DNA, 15 bp, Homo sapiens
agcatgtaaaaatag

SEQ ID NO: 321356 - DNA, 15 bp, Homo sapiens
gcatgtaaaaatagt

SEQ ID NO: 321357 - DNA, 15 bp, Homo sapiens
catgtaaaaatagtt

SEQ ID NO: 321358 - DNA, 15 bp, Homo sapiens
atgtaaaaatagttt

SEQ ID NO: 321359 - DNA, 15 bp, Homo sapiens
tgtaaaaatagtttt

SEQ ID NO: 321360 - DNA, 15 bp, Homo sapiens
gtaaaaatagtttta

SEQ ID NO: 321361 - DNA, 15 bp, Homo sapiens
taaaaatagttttaa

SEQ ID NO: 321362 - DNA, 15 bp, Homo sapiens
aaaaatagttttaat

SEQ ID NO: 321363 - DNA, 15 bp, Homo sapiens
aaaatagttttaatc

SEQ ID NO: 321364 - DNA, 15 bp, Homo sapiens
aaatagttttaatca

SEQ ID NO: 321365 - DNA, 15 bp, Homo sapiens
aatagttttaatcat

SEQ ID NO: 321366 - DNA, 15 bp, Homo sapiens
atagttttaatcata

SEQ ID NO: 321367 - DNA, 15 bp, Homo sapiens
tagttttaatcatat

SEQ ID NO: 321368 - DNA, 15 bp, Homo sapiens
agttttaatcatatt

SEQ ID NO: 321369 - DNA, 15 bp, Homo sapiens
gttttaatcatattg

SEQ ID NO: 321370 - DNA, 15 bp, Homo sapiens
ttttaatcatattgc

SEQ ID NO: 321371 - DNA, 15 bp, Homo sapiens
tttaatcatattgca

SEQ ID NO: 321372 - DNA, 15 bp, Homo sapiens
ttaatcatattgcac

SEQ ID NO: 321373 - DNA, 15 bp, Homo sapiens
taatcatattgcact

SEQ ID NO: 321374 - DNA, 15 bp, Homo sapiens
aatcatattgcacta

SEQ ID NO: 321375 - DNA, 15 bp, Homo sapiens
atcatattgcactag

SEQ ID NO: 321376 - DNA, 15 bp, Homo sapiens
tcatattgcactagg

SEQ ID NO: 321377 - DNA, 15 bp, Homo sapiens
catattgcactagga

SEQ ID NO: 321378 - DNA, 15 bp, Homo sapiens
atattgcactaggaa

SEQ ID NO: 321379 - DNA, 15 bp, Homo sapiens
tattgcactaggaag

SEQ ID NO: 321380 - DNA, 15 bp, Homo sapiens
attgcactaggaaga

SEQ ID NO: 321381 - DNA, 15 bp, Homo sapiens
ttgcactaggaagat

SEQ ID NO: 321382 - DNA, 15 bp, Homo sapiens
tgcactaggaagatt

SEQ ID NO: 321383 - DNA, 15 bp, Homo sapiens
gcactaggaagattt

SEQ ID NO: 321384 - DNA, 15 bp, Homo sapiens
cactaggaagatttg

SEQ ID NO: 321385 - DNA, 15 bp, Homo sapiens
actaggaagatttgt

SEQ ID NO: 321386 - DNA, 15 bp, Homo sapiens
ctaggaagatttgtt

SEQ ID NO: 321387 - DNA, 15 bp, Homo sapiens
taggaagatttgttt

SEQ ID NO: 321388 - DNA, 15 bp, Homo sapiens
aggaagatttgtttt

SEQ ID NO: 321389 - DNA, 15 bp, Homo sapiens
ggaagatttgttttt

SEQ ID NO: 321390 - DNA, 15 bp, Homo sapiens
gaagatttgtttttg

SEQ ID NO: 321391 - DNA, 15 bp, Homo sapiens
aagatttgtttttgt

SEQ ID NO: 321392 - DNA, 15 bp, Homo sapiens
agatttgtttttgtt

SEQ ID NO: 321393 - DNA, 15 bp, Homo sapiens
gatttgtttttgttt

SEQ ID NO: 321394 - DNA, 15 bp, Homo sapiens
atttgtttttgtttc

SEQ ID NO: 321395 - DNA, 15 bp, Homo sapiens
tttgtttttgtttct

SEQ ID NO: 321396 - DNA, 15 bp, Homo sapiens
ttgtttttgtttctt

SEQ ID NO: 321397 - DNA, 15 bp, Homo sapiens
tgtttttgtttctta

SEQ ID NO: 321398 - DNA, 15 bp, Homo sapiens
gtttttgtttcttaa

SEQ ID NO: 321399 - DNA, 15 bp, Homo sapiens
tttttgtttcttaaa

SEQ ID NO: 321400 - DNA, 15 bp, Homo sapiens
ttttgtttcttaaat

SEQ ID NO: 321401 - DNA, 15 bp, Homo sapiens
tttgtttcttaaata

SEQ ID NO: 321402 - DNA, 15 bp, Homo sapiens
ttgtttcttaaatat

SEQ ID NO: 321403 - DNA, 15 bp, Homo sapiens
tgtttcttaaatata

SEQ ID NO: 321404 - DNA, 15 bp, Homo sapiens
gtttcttaaatatat

SEQ ID NO: 321405 - DNA, 15 bp, Homo sapiens
tttcttaaatatata

SEQ ID NO: 321406 - DNA, 15 bp, Homo sapiens
ttcttaaatatatac

SEQ ID NO: 321407 - DNA, 15 bp, Homo sapiens
tcttaaatatataca

SEQ ID NO: 321408 - DNA, 15 bp, Homo sapiens
cttaaatatatacag

SEQ ID NO: 321409 - DNA, 15 bp, Homo sapiens
ttaaatatatacaga

SEQ ID NO: 321410 - DNA, 15 bp, Homo sapiens
taaatatatacagaa

SEQ ID NO: 321411 - DNA, 15 bp, Homo sapiens
aaatatatacagaat

SEQ ID NO: 321412 - DNA, 15 bp, Homo sapiens
aatatatacagaatt

SEQ ID NO: 321413 - DNA, 15 bp, Homo sapiens
atatatacagaattt

SEQ ID NO: 321414 - DNA, 15 bp, Homo sapiens
tatatacagaatttc

SEQ ID NO: 321415 - DNA, 15 bp, Homo sapiens
atatacagaatttcc

SEQ ID NO: 321416 - DNA, 15 bp, Homo sapiens
tatacagaatttccc

SEQ ID NO: 321417 - DNA, 15 bp, Homo sapiens
atacagaatttccct

SEQ ID NO: 321418 - DNA, 15 bp, Homo sapiens
tacagaatttccctt

SEQ ID NO: 321419 - DNA, 15 bp, Homo sapiens
acagaatttcccttt

SEQ ID NO: 321420 - DNA, 15 bp, Homo sapiens
cagaatttccctttt

SEQ ID NO: 321421 - DNA, 15 bp, Homo sapiens
agaatttcccttttt

SEQ ID NO: 321422 - DNA, 15 bp, Homo sapiens
gaatttccctttttc

SEQ ID NO: 321423 - DNA, 15 bp, Homo sapiens
aatttccctttttct

SEQ ID NO: 321424 - DNA, 15 bp, Homo sapiens
atttccctttttctg

SEQ ID NO: 321425 - DNA, 15 bp, Homo sapiens
tttccctttttctgc

SEQ ID NO: 321426 - DNA, 15 bp, Homo sapiens
ttccctttttctgct

SEQ ID NO: 321427 - DNA, 15 bp, Homo sapiens
tccctttttctgctt

SEQ ID NO: 321428 - DNA, 15 bp, Homo sapiens
ccctttttctgcttc

SEQ ID NO: 321429 - DNA, 15 bp, Homo sapiens
cctttttctgcttct

SEQ ID NO: 321430 - DNA, 15 bp, Homo sapiens
ctttttctgcttctt

SEQ ID NO: 321431 - DNA, 15 bp, Homo sapiens
tttttctgcttcttt

SEQ ID NO: 321432 - DNA, 15 bp, Homo sapiens
ttttctgcttcttta

SEQ ID NO: 321433 - DNA, 15 bp, Homo sapiens
tttctgcttctttat

SEQ ID NO: 321434 - DNA, 15 bp, Homo sapiens
ttctgcttctttata

SEQ ID NO: 321435 - DNA, 15 bp, Homo sapiens
tctgcttctttatat

SEQ ID NO: 321436 - DNA, 15 bp, Homo sapiens
ctgcttctttatatt

SEQ ID NO: 321437 - DNA, 15 bp, Homo sapiens
tgcttctttatattt

SEQ ID NO: 321438 - DNA, 15 bp, Homo sapiens
gcttctttatattta

SEQ ID NO: 321439 - DNA, 15 bp, Homo sapiens
cttctttatatttaa

SEQ ID NO: 321440 - DNA, 15 bp, Homo sapiens
ttctttatatttaat

SEQ ID NO: 321441 - DNA, 15 bp, Homo sapiens
tctttatatttaata

SEQ ID NO: 321442 - DNA, 15 bp, Homo sapiens
ctttatatttaataa

SEQ ID NO: 321443 - DNA, 15 bp, Homo sapiens
tttatatttaataac

SEQ ID NO: 321444 - DNA, 15 bp, Homo sapiens
ttatatttaataaca

SEQ ID NO: 321445 - DNA, 15 bp, Homo sapiens
tatatttaataacaa

SEQ ID NO: 321446 - DNA, 15 bp, Homo sapiens
atatttaataacaag

SEQ ID NO: 321447 - DNA, 15 bp, Homo sapiens
tatttaataacaaga

SEQ ID NO: 321448 - DNA, 15 bp, Homo sapiens
atttaataacaagac

SEQ ID NO: 321449 - DNA, 15 bp, Homo sapiens
tttaataacaagaca

SEQ ID NO: 321450 - DNA, 15 bp, Homo sapiens
ttaataacaagacat

SEQ ID NO: 321451 - DNA, 15 bp, Homo sapiens
taataacaagacatt

SEQ ID NO: 321452 - DNA, 15 bp, Homo sapiens
aataacaagacattc

SEQ ID NO: 321453 - DNA, 15 bp, Homo sapiens
ataacaagacattct

SEQ ID NO: 321454 - DNA, 15 bp, Homo sapiens
taacaagacattcta

SEQ ID NO: 321455 - DNA, 15 bp, Homo sapiens
aacaagacattctag

SEQ ID NO: 321456 - DNA, 15 bp, Homo sapiens
acaagacattctagg

SEQ ID NO: 321457 - DNA, 15 bp, Homo sapiens
caagacattctagga

SEQ ID NO: 321458 - DNA, 15 bp, Homo sapiens
aagacattctaggat

SEQ ID NO: 321459 - DNA, 15 bp, Homo sapiens
agacattctaggata

SEQ ID NO: 321460 - DNA, 15 bp, Homo sapiens
gacattctaggatag

SEQ ID NO: 321461 - DNA, 15 bp, Homo sapiens
acattctaggataga

SEQ ID NO: 321462 - DNA, 15 bp, Homo sapiens
cattctaggatagac

SEQ ID NO: 321463 - DNA, 15 bp, Homo sapiens
attctaggatagact

SEQ ID NO: 321464 - DNA, 15 bp, Homo sapiens
ttctaggatagacta

SEQ ID NO: 321465 - DNA, 15 bp, Homo sapiens
tctaggatagactaa

SEQ ID NO: 321466 - DNA, 15 bp, Homo sapiens
ctaggatagactaag

SEQ ID NO: 321467 - DNA, 15 bp, Homo sapiens
taggatagactaagc

SEQ ID NO: 321468 - DNA, 15 bp, Homo sapiens
aggatagactaagcc

SEQ ID NO: 321469 - DNA, 15 bp, Homo sapiens
ggatagactaagcct

SEQ ID NO: 321470 - DNA, 15 bp, Homo sapiens
gatagactaagcctt

SEQ ID NO: 321471 - DNA, 15 bp, Homo sapiens
atagactaagccttt

SEQ ID NO: 321472 - DNA, 15 bp, Homo sapiens
tagactaagcctttt

SEQ ID NO: 321473 - DNA, 15 bp, Homo sapiens
agactaagccttttc

SEQ ID NO: 321474 - DNA, 15 bp, Homo sapiens
gactaagccttttca

SEQ ID NO: 321475 - DNA, 15 bp, Homo sapiens
actaagccttttcat

SEQ ID NO: 321476 - DNA, 15 bp, Homo sapiens
ctaagccttttcatg

SEQ ID NO: 321477 - DNA, 15 bp, Homo sapiens
taagccttttcatgg

SEQ ID NO: 321478 - DNA, 15 bp, Homo sapiens
aagccttttcatggc

SEQ ID NO: 321479 - DNA, 15 bp, Homo sapiens
agccttttcatggct

SEQ ID NO: 321480 - DNA, 15 bp, Homo sapiens
gccttttcatggcta

SEQ ID NO: 321481 - DNA, 15 bp, Homo sapiens
ccttttcatggctaa

SEQ ID NO: 321482 - DNA, 15 bp, Homo sapiens
cttttcatggctaat

SEQ ID NO: 321483 - DNA, 15 bp, Homo sapiens
ttttcatggctaatt

SEQ ID NO: 321484 - DNA, 15 bp, Homo sapiens
tttcatggctaattg

SEQ ID NO: 321485 - DNA, 15 bp, Homo sapiens
ttcatggctaattgt

SEQ ID NO: 321486 - DNA, 15 bp, Homo sapiens
tcatggctaattgtc

SEQ ID NO: 321487 - DNA, 15 bp, Homo sapiens
catggctaattgtcc

SEQ ID NO: 321488 - DNA, 15 bp, Homo sapiens
atggctaattgtcct

SEQ ID NO: 321489 - DNA, 15 bp, Homo sapiens
tggctaattgtcctg

SEQ ID NO: 321490 - DNA, 15 bp, Homo sapiens
ggctaattgtcctgt

SEQ ID NO: 321491 - DNA, 15 bp, Homo sapiens
gctaattgtcctgtg

SEQ ID NO: 321492 - DNA, 15 bp, Homo sapiens
ctaattgtcctgtgg

SEQ ID NO: 321493 - DNA, 15 bp, Homo sapiens
taattgtcctgtgga

SEQ ID NO: 321494 - DNA, 15 bp, Homo sapiens
aattgtcctgtggaa

SEQ ID NO: 321495 - DNA, 15 bp, Homo sapiens
attgtcctgtggaat

SEQ ID NO: 321496 - DNA, 15 bp, Homo sapiens
ttgtcctgtggaatt

SEQ ID NO: 321497 - DNA, 15 bp, Homo sapiens
tgtcctgtggaattc

SEQ ID NO: 321498 - DNA, 15 bp, Homo sapiens
gtcctgtggaattct

SEQ ID NO: 321499 - DNA, 15 bp, Homo sapiens
tcctgtggaattctt

SEQ ID NO: 321500 - DNA, 15 bp, Homo sapiens
cctgtggaattcttt

SEQ ID NO: 321501 - DNA, 15 bp, Homo sapiens
ctgtggaattctttt

SEQ ID NO: 321502 - DNA, 15 bp, Homo sapiens
tgtggaattctttta

SEQ ID NO: 321503 - DNA, 15 bp, Homo sapiens
gtggaattcttttag

SEQ ID NO: 321504 - DNA, 15 bp, Homo sapiens
tggaattcttttagt

SEQ ID NO: 321505 - DNA, 15 bp, Homo sapiens
ggaattcttttagtt

SEQ ID NO: 321506 - DNA, 15 bp, Homo sapiens
gaattcttttagttt

SEQ ID NO: 321507 - DNA, 15 bp, Homo sapiens
aattcttttagtttt

SEQ ID NO: 321508 - DNA, 15 bp, Homo sapiens
attcttttagttttt

SEQ ID NO: 321509 - DNA, 15 bp, Homo sapiens
ttcttttagtttttc

SEQ ID NO: 321510 - DNA, 15 bp, Homo sapiens
tcttttagtttttct

SEQ ID NO: 321511 - DNA, 15 bp, Homo sapiens
cttttagtttttctc

SEQ ID NO: 321512 - DNA, 15 bp, Homo sapiens
ttttagtttttctct

SEQ ID NO: 321513 - DNA, 15 bp, Homo sapiens
tttagtttttctctt

SEQ ID NO: 321514 - DNA, 15 bp, Homo sapiens
ttagtttttctcttc

SEQ ID NO: 321515 - DNA, 15 bp, Homo sapiens
tagtttttctcttcc

SEQ ID NO: 321516 - DNA, 15 bp, Homo sapiens
agtttttctcttcca

SEQ ID NO: 321517 - DNA, 15 bp, Homo sapiens
gtttttctcttccat

SEQ ID NO: 321518 - DNA, 15 bp, Homo sapiens
tttttctcttccatg

SEQ ID NO: 321519 - DNA, 15 bp, Homo sapiens
ttttctcttccatgt

SEQ ID NO: 321520 - DNA, 15 bp, Homo sapiens
tttctcttccatgtt

SEQ ID NO: 321521 - DNA, 15 bp, Homo sapiens
ttctcttccatgttt

SEQ ID NO: 321522 - DNA, 15 bp, Homo sapiens
tctcttccatgttta

SEQ ID NO: 321523 - DNA, 15 bp, Homo sapiens
ctcttccatgtttat

SEQ ID NO: 321524 - DNA, 15 bp, Homo sapiens
tcttccatgtttata

SEQ ID NO: 321525 - DNA, 15 bp, Homo sapiens
cttccatgtttatat

SEQ ID NO: 321526 - DNA, 15 bp, Homo sapiens
ttccatgtttatata

SEQ ID NO: 321527 - DNA, 15 bp, Homo sapiens
tccatgtttatatat

SEQ ID NO: 321528 - DNA, 15 bp, Homo sapiens
ccatgtttatatatt

SEQ ID NO: 321529 - DNA, 15 bp, Homo sapiens
catgtttatatattt

SEQ ID NO: 321530 - DNA, 15 bp, Homo sapiens
atgtttatatatttg

SEQ ID NO: 321531 - DNA, 15 bp, Homo sapiens
tgtttatatatttga

SEQ ID NO: 321532 - DNA, 15 bp, Homo sapiens
gtttatatatttgat

SEQ ID NO: 321533 - DNA, 15 bp, Homo sapiens
tttatatatttgata

SEQ ID NO: 321534 - DNA, 15 bp, Homo sapiens
ttatatatttgatat

SEQ ID NO: 321535 - DNA, 15 bp, Homo sapiens
tatatatttgatatg

SEQ ID NO: 321536 - DNA, 15 bp, Homo sapiens
atatatttgatatga

SEQ ID NO: 321537 - DNA, 15 bp, Homo sapiens
tatatttgatatgat

SEQ ID NO: 321538 - DNA, 15 bp, Homo sapiens
atatttgatatgatt

SEQ ID NO: 321539 - DNA, 15 bp, Homo sapiens
tatttgatatgattt

SEQ ID NO: 321540 - DNA, 15 bp, Homo sapiens
atttgatatgatttt

SEQ ID NO: 321541 - DNA, 15 bp, Homo sapiens
tttgatatgattttc

SEQ ID NO: 321542 - DNA, 15 bp, Homo sapiens
ttgatatgattttct

SEQ ID NO: 321543 - DNA, 15 bp, Homo sapiens
tgatatgattttctg

SEQ ID NO: 321544 - DNA, 15 bp, Homo sapiens
gatatgattttctgg

SEQ ID NO: 321545 - DNA, 15 bp, Homo sapiens
atatgattttctggt

SEQ ID NO: 321546 - DNA, 15 bp, Homo sapiens
tatgattttctggta

SEQ ID NO: 321547 - DNA, 15 bp, Homo sapiens
atgattttctggtag

SEQ ID NO: 321548 - DNA, 15 bp, Homo sapiens
tgattttctggtaga

SEQ ID NO: 321549 - DNA, 15 bp, Homo sapiens
gattttctggtagaa

SEQ ID NO: 321550 - DNA, 15 bp, Homo sapiens
attttctggtagaat

SEQ ID NO: 321551 - DNA, 15 bp, Homo sapiens
ttttctggtagaatt

SEQ ID NO: 321552 - DNA, 15 bp, Homo sapiens
tttctggtagaattc

SEQ ID NO: 321553 - DNA, 15 bp, Homo sapiens
ttctggtagaattct

SEQ ID NO: 321554 - DNA, 15 bp, Homo sapiens
tctggtagaattctt

SEQ ID NO: 321555 - DNA, 15 bp, Homo sapiens
ctggtagaattcttg

SEQ ID NO: 321556 - DNA, 15 bp, Homo sapiens
tggtagaattcttga

SEQ ID NO: 321557 - DNA, 15 bp, Homo sapiens
ggtagaattcttgaa

SEQ ID NO: 321558 - DNA, 15 bp, Homo sapiens
gtagaattcttgaaa

SEQ ID NO: 321559 - DNA, 15 bp, Homo sapiens
tagaattcttgaaaa

SEQ ID NO: 321560 - DNA, 15 bp, Homo sapiens
agaattcttgaaaaa

SEQ ID NO: 321561 - DNA, 15 bp, Homo sapiens
gaattcttgaaaaaa

SEQ ID NO: 321562 - DNA, 15 bp, Homo sapiens
aattcttgaaaaaat

SEQ ID NO: 321563 - DNA, 15 bp, Homo sapiens
attcttgaaaaaata

SEQ ID NO: 321564 - DNA, 15 bp, Homo sapiens
ttcttgaaaaaataa

SEQ ID NO: 321565 - DNA, 15 bp, Homo sapiens
tcttgaaaaaataac

SEQ ID NO: 321566 - DNA, 15 bp, Homo sapiens
cttgaaaaaataact

SEQ ID NO: 321567 - DNA, 15 bp, Homo sapiens
ttgaaaaaataactg

SEQ ID NO: 321568 - DNA, 15 bp, Homo sapiens
tgaaaaaataactgc

SEQ ID NO: 321569 - DNA, 15 bp, Homo sapiens
gaaaaaataactgca

SEQ ID NO: 321570 - DNA, 15 bp, Homo sapiens
aaaaaataactgcat

SEQ ID NO: 321571 - DNA, 15 bp, Homo sapiens
aaaaataactgcatc

SEQ ID NO: 321572 - DNA, 15 bp, Homo sapiens
aaaataactgcatca

SEQ ID NO: 321573 - DNA, 15 bp, Homo sapiens
aaataactgcatcac

SEQ ID NO: 321574 - DNA, 15 bp, Homo sapiens
aataactgcatcaca

SEQ ID NO: 321575 - DNA, 15 bp, Homo sapiens
ataactgcatcacac

SEQ ID NO: 321576 - DNA, 15 bp, Homo sapiens
taactgcatcacaca

SEQ ID NO: 321577 - DNA, 15 bp, Homo sapiens
aactgcatcacacag

SEQ ID NO: 321578 - DNA, 15 bp, Homo sapiens
actgcatcacacagt

SEQ ID NO: 321579 - DNA, 15 bp, Homo sapiens
ctgcatcacacagta

SEQ ID NO: 321580 - DNA, 15 bp, Homo sapiens
tgcatcacacagtag

SEQ ID NO: 321581 - DNA, 15 bp, Homo sapiens
gcatcacacagtagc

SEQ ID NO: 321582 - DNA, 15 bp, Homo sapiens
catcacacagtagct

SEQ ID NO: 321583 - DNA, 15 bp, Homo sapiens
atcacacagtagctc

SEQ ID NO: 321584 - DNA, 15 bp, Homo sapiens
tcacacagtagctct

SEQ ID NO: 321585 - DNA, 15 bp, Homo sapiens
cacacagtagctctc

SEQ ID NO: 321586 - DNA, 15 bp, Homo sapiens
acacagtagctctcc

SEQ ID NO: 321587 - DNA, 15 bp, Homo sapiens
cacagtagctctcct

SEQ ID NO: 321588 - DNA, 15 bp, Homo sapiens
acagtagctctcctc

SEQ ID NO: 321589 - DNA, 15 bp, Homo sapiens
cagtagctctcctct

SEQ ID NO: 321590 - DNA, 15 bp, Homo sapiens
agtagctctcctctc

SEQ ID NO: 321591 - DNA, 15 bp, Homo sapiens
gtagctctcctctcc

SEQ ID NO: 321592 - DNA, 15 bp, Homo sapiens
tagctctcctctccc

SEQ ID NO: 321593 - DNA, 15 bp, Homo sapiens
agctctcctctccca

SEQ ID NO: 321594 - DNA, 15 bp, Homo sapiens
gctctcctctcccat

SEQ ID NO: 321595 - DNA, 15 bp, Homo sapiens
ctctcctctcccatt

SEQ ID NO: 321596 - DNA, 15 bp, Homo sapiens
tctcctctcccattt

SEQ ID NO: 321597 - DNA, 15 bp, Homo sapiens
ctcctctcccatttt

SEQ ID NO: 321598 - DNA, 15 bp, Homo sapiens
tcctctcccatttta

SEQ ID NO: 321599 - DNA, 15 bp, Homo sapiens
cctctcccattttat

SEQ ID NO: 321600 - DNA, 15 bp, Homo sapiens
ctctcccattttatt

SEQ ID NO: 321601 - DNA, 15 bp, Homo sapiens
tctcccattttattt

SEQ ID NO: 321602 - DNA, 15 bp, Homo sapiens
ctcccattttatttt

SEQ ID NO: 321603 - DNA, 15 bp, Homo sapiens
tcccattttatttta

SEQ ID NO: 321604 - DNA, 15 bp, Homo sapiens
cccattttattttat

SEQ ID NO: 321605 - DNA, 15 bp, Homo sapiens
ccattttattttatt

SEQ ID NO: 321606 - DNA, 15 bp, Homo sapiens
cattttattttattt

SEQ ID NO: 321607 - DNA, 15 bp, Homo sapiens
tttattttattttac

SEQ ID NO: 321608 - DNA, 15 bp, Homo sapiens
ttattttattttact

SEQ ID NO: 321609 - DNA, 15 bp, Homo sapiens
tattttattttactt

SEQ ID NO: 321610 - DNA, 15 bp, Homo sapiens
attttattttacttg

SEQ ID NO: 321611 - DNA, 15 bp, Homo sapiens
ttttattttacttgc

SEQ ID NO: 321612 - DNA, 15 bp, Homo sapiens
tttattttacttgct

SEQ ID NO: 321613 - DNA, 15 bp, Homo sapiens
ttattttacttgctg

SEQ ID NO: 321614 - DNA, 15 bp, Homo sapiens
tattttacttgctga

SEQ ID NO: 321615 - DNA, 15 bp, Homo sapiens
attttacttgctgag

SEQ ID NO: 321616 - DNA, 15 bp, Homo sapiens
ttttacttgctgagg

SEQ ID NO: 321617 - DNA, 15 bp, Homo sapiens
tttacttgctgaggc

SEQ ID NO: 321618 - DNA, 15 bp, Homo sapiens
ttacttgctgaggct

SEQ ID NO: 321619 - DNA, 15 bp, Homo sapiens
tacttgctgaggctg

SEQ ID NO: 321620 - DNA, 15 bp, Homo sapiens
acttgctgaggctgg

SEQ ID NO: 321621 - DNA, 15 bp, Homo sapiens
cttgctgaggctgga

SEQ ID NO: 321622 - DNA, 15 bp, Homo sapiens
ttgctgaggctggat

SEQ ID NO: 321623 - DNA, 15 bp, Homo sapiens
tgctgaggctggata

SEQ ID NO: 321624 - DNA, 15 bp, Homo sapiens
gctgaggctggatat

SEQ ID NO: 321625 - DNA, 15 bp, Homo sapiens
ctgaggctggatatt

SEQ ID NO: 321626 - DNA, 15 bp, Homo sapiens
tgaggctggatatta

SEQ ID NO: 321627 - DNA, 15 bp, Homo sapiens
gaggctggatattat

SEQ ID NO: 321628 - DNA, 15 bp, Homo sapiens
aggctggatattata

SEQ ID NO: 321629 - DNA, 15 bp, Homo sapiens
ggctggatattatat

SEQ ID NO: 321630 - DNA, 15 bp, Homo sapiens
gctggatattatatt

SEQ ID NO: 321631 - DNA, 15 bp, Homo sapiens
ctggatattatattc

SEQ ID NO: 321632 - DNA, 15 bp, Homo sapiens
tggatattatattct

SEQ ID NO: 321633 - DNA, 15 bp, Homo sapiens
ggatattatattctt

SEQ ID NO: 321634 - DNA, 15 bp, Homo sapiens
gatattatattcttt

SEQ ID NO: 321635 - DNA, 15 bp, Homo sapiens
atattatattctttt

SEQ ID NO: 321636 - DNA, 15 bp, Homo sapiens
tattatattcttttg

SEQ ID NO: 321637 - DNA, 15 bp, Homo sapiens
attatattcttttgg

SEQ ID NO: 321638 - DNA, 15 bp, Homo sapiens
ttatattcttttggc

SEQ ID NO: 321639 - DNA, 15 bp, Homo sapiens
tatattcttttggct

SEQ ID NO: 321640 - DNA, 15 bp, Homo sapiens
atattcttttggctg

SEQ ID NO: 321641 - DNA, 15 bp, Homo sapiens
tattcttttggctga

SEQ ID NO: 321642 - DNA, 15 bp, Homo sapiens
ttcttttggctgaag

SEQ ID NO: 321643 - DNA, 15 bp, Homo sapiens
tcttttggctgaagt

SEQ ID NO: 321644 - DNA, 15 bp, Homo sapiens
cttttggctgaagtc

SEQ ID NO: 321645 - DNA, 15 bp, Homo sapiens
ttttggctgaagtca

SEQ ID NO: 321646 - DNA, 15 bp, Homo sapiens
tttggctgaagtcac

SEQ ID NO: 321647 - DNA, 15 bp, Homo sapiens
ttggctgaagtcacc

SEQ ID NO: 321648 - DNA, 15 bp, Homo sapiens
tggctgaagtcacca

SEQ ID NO: 321649 - DNA, 15 bp, Homo sapiens
ggctgaagtcaccat

SEQ ID NO: 321650 - DNA, 15 bp, Homo sapiens
gctgaagtcaccata

SEQ ID NO: 321651 - DNA, 15 bp, Homo sapiens
ctgaagtcaccatag

SEQ ID NO: 321652 - DNA, 15 bp, Homo sapiens
tgaagtcaccatagt

SEQ ID NO: 321653 - DNA, 15 bp, Homo sapiens
gaagtcaccatagtg

SEQ ID NO: 321654 - DNA, 15 bp, Homo sapiens
aagtcaccatagtgg

SEQ ID NO: 321655 - DNA, 15 bp, Homo sapiens
agtcaccatagtgga

SEQ ID NO: 321656 - DNA, 15 bp, Homo sapiens
gtcaccatagtggat

SEQ ID NO: 321657 - DNA, 15 bp, Homo sapiens
tcaccatagtggatt

SEQ ID NO: 321658 - DNA, 15 bp, Homo sapiens
caccatagtggattc

SEQ ID NO: 321659 - DNA, 15 bp, Homo sapiens
accatagtggattca

SEQ ID NO: 321660 - DNA, 15 bp, Homo sapiens
ccatagtggattcat

SEQ ID NO: 321661 - DNA, 15 bp, Homo sapiens
catagtggattcata

SEQ ID NO: 321662 - DNA, 15 bp, Homo sapiens
atagtggattcatac

SEQ ID NO: 321663 - DNA, 15 bp, Homo sapiens
tagtggattcataca

SEQ ID NO: 321664 - DNA, 15 bp, Homo sapiens
agtggattcatacaa

SEQ ID NO: 321665 - DNA, 15 bp, Homo sapiens
gtggattcatacaac

SEQ ID NO: 321666 - DNA, 15 bp, Homo sapiens
tggattcatacaact

SEQ ID NO: 321667 - DNA, 15 bp, Homo sapiens
ggattcatacaacta

SEQ ID NO: 321668 - DNA, 15 bp, Homo sapiens
gattcatacaactaa

SEQ ID NO: 321669 - DNA, 15 bp, Homo sapiens
attcatacaactaat

SEQ ID NO: 321670 - DNA, 15 bp, Homo sapiens
ttcatacaactaatt

SEQ ID NO: 321671 - DNA, 15 bp, Homo sapiens
tcatacaactaattt

SEQ ID NO: 321672 - DNA, 15 bp, Homo sapiens
catacaactaatttc

SEQ ID NO: 321673 - DNA, 15 bp, Homo sapiens
atacaactaatttcc

SEQ ID NO: 321674 - DNA, 15 bp, Homo sapiens
tacaactaatttcca

SEQ ID NO: 321675 - DNA, 15 bp, Homo sapiens
acaactaatttccag

SEQ ID NO: 321676 - DNA, 15 bp, Homo sapiens
caactaatttccagc

SEQ ID NO: 321677 - DNA, 15 bp, Homo sapiens
aactaatttccagcc

SEQ ID NO: 321678 - DNA, 15 bp, Homo sapiens
actaatttccagcca

SEQ ID NO: 321679 - DNA, 15 bp, Homo sapiens
ctaatttccagccag

SEQ ID NO: 321680 - DNA, 15 bp, Homo sapiens
taatttccagccagt

SEQ ID NO: 321681 - DNA, 15 bp, Homo sapiens
aatttccagccagtt

SEQ ID NO: 321682 - DNA, 15 bp, Homo sapiens
atttccagccagttt

SEQ ID NO: 321683 - DNA, 15 bp, Homo sapiens
tttccagccagttta

SEQ ID NO: 321684 - DNA, 15 bp, Homo sapiens
ttccagccagtttat

SEQ ID NO: 321685 - DNA, 15 bp, Homo sapiens
tccagccagtttatg

SEQ ID NO: 321686 - DNA, 15 bp, Homo sapiens
ccagccagtttatgt

SEQ ID NO: 321687 - DNA, 15 bp, Homo sapiens
cagccagtttatgta

SEQ ID NO: 321688 - DNA, 15 bp, Homo sapiens
agccagtttatgtag

SEQ ID NO: 321689 - DNA, 15 bp, Homo sapiens
gccagtttatgtaga

SEQ ID NO: 321690 - DNA, 15 bp, Homo sapiens
ccagtttatgtagat

SEQ ID NO: 321691 - DNA, 15 bp, Homo sapiens
cagtttatgtagatc

SEQ ID NO: 321692 - DNA, 15 bp, Homo sapiens
agtttatgtagatca

SEQ ID NO: 321693 - DNA, 15 bp, Homo sapiens
gtttatgtagatcat

SEQ ID NO: 321694 - DNA, 15 bp, Homo sapiens
tttatgtagatcatt

SEQ ID NO: 321695 - DNA, 15 bp, Homo sapiens
ttatgtagatcattt

SEQ ID NO: 321696 - DNA, 15 bp, Homo sapiens
tatgtagatcatttg

SEQ ID NO: 321697 - DNA, 15 bp, Homo sapiens
atgtagatcatttgc

SEQ ID NO: 321698 - DNA, 15 bp, Homo sapiens
tgtagatcatttgca

SEQ ID NO: 321699 - DNA, 15 bp, Homo sapiens
gtagatcatttgcaa

SEQ ID NO: 321700 - DNA, 15 bp, Homo sapiens
tagatcatttgcaaa

SEQ ID NO: 321701 - DNA, 15 bp, Homo sapiens
agatcatttgcaaat

SEQ ID NO: 321702 - DNA, 15 bp, Homo sapiens
gatcatttgcaaatg

SEQ ID NO: 321703 - DNA, 15 bp, Homo sapiens
atcatttgcaaatgt

SEQ ID NO: 321704 - DNA, 15 bp, Homo sapiens
tcatttgcaaatgta

SEQ ID NO: 321705 - DNA, 15 bp, Homo sapiens
catttgcaaatgtat

SEQ ID NO: 321706 - DNA, 15 bp, Homo sapiens
atttgcaaatgtatt

SEQ ID NO: 321707 - DNA, 15 bp, Homo sapiens
tttgcaaatgtatta

SEQ ID NO: 321708 - DNA, 15 bp, Homo sapiens
ttgcaaatgtattag

SEQ ID NO: 321709 - DNA, 15 bp, Homo sapiens
tgcaaatgtattagt

SEQ ID NO: 321710 - DNA, 15 bp, Homo sapiens
gcaaatgtattagtt

SEQ ID NO: 321711 - DNA, 15 bp, Homo sapiens
caaatgtattagtta

SEQ ID NO: 321712 - DNA, 15 bp, Homo sapiens
aaatgtattagttac

SEQ ID NO: 321713 - DNA, 15 bp, Homo sapiens
aatgtattagttaca

SEQ ID NO: 321714 - DNA, 15 bp, Homo sapiens
atgtattagttacag

SEQ ID NO: 321715 - DNA, 15 bp, Homo sapiens
tgtattagttacaga

SEQ ID NO: 321716 - DNA, 15 bp, Homo sapiens
gtattagttacagag

SEQ ID NO: 321717 - DNA, 15 bp, Homo sapiens
tattagttacagaga

SEQ ID NO: 321718 - DNA, 15 bp, Homo sapiens
attagttacagagag

SEQ ID NO: 321719 - DNA, 15 bp, Homo sapiens
ttagttacagagagg

SEQ ID NO: 321720 - DNA, 15 bp, Homo sapiens
tagttacagagaggc

SEQ ID NO: 321721 - DNA, 15 bp, Homo sapiens
agttacagagaggct

SEQ ID NO: 321722 - DNA, 15 bp, Homo sapiens
gttacagagaggctc

SEQ ID NO: 321723 - DNA, 15 bp, Homo sapiens
ttacagagaggctcc

SEQ ID NO: 321724 - DNA, 15 bp, Homo sapiens
tacagagaggctcca

SEQ ID NO: 321725 - DNA, 15 bp, Homo sapiens
acagagaggctccag

SEQ ID NO: 321726 - DNA, 15 bp, Homo sapiens
cagagaggctccagg

SEQ ID NO: 321727 - DNA, 15 bp, Homo sapiens
agagaggctccaggg

SEQ ID NO: 321728 - DNA, 15 bp, Homo sapiens
gagaggctccagggg

SEQ ID NO: 321729 - DNA, 15 bp, Homo sapiens
agaggctccaggggt

SEQ ID NO: 321730 - DNA, 15 bp, Homo sapiens
gaggctccaggggtg

SEQ ID NO: 321731 - DNA, 15 bp, Homo sapiens
aggctccaggggtgt

SEQ ID NO: 321732 - DNA, 15 bp, Homo sapiens
ggctccaggggtgta

SEQ ID NO: 321733 - DNA, 15 bp, Homo sapiens
gctccaggggtgtac

SEQ ID NO: 321734 - DNA, 15 bp, Homo sapiens
ctccaggggtgtacc

SEQ ID NO: 321735 - DNA, 15 bp, Homo sapiens
tccaggggtgtacca

SEQ ID NO: 321736 - DNA, 15 bp, Homo sapiens
ccaggggtgtaccaa

SEQ ID NO: 321737 - DNA, 15 bp, Homo sapiens
caggggtgtaccaaa

SEQ ID NO: 321738 - DNA, 15 bp, Homo sapiens
aggggtgtaccaaag

SEQ ID NO: 321739 - DNA, 15 bp, Homo sapiens
ggggtgtaccaaaga

SEQ ID NO: 321740 - DNA, 15 bp, Homo sapiens
gggtgtaccaaagaa

SEQ ID NO: 321741 - DNA, 15 bp, Homo sapiens
ggtgtaccaaagaaa

SEQ ID NO: 321742 - DNA, 15 bp, Homo sapiens
gtgtaccaaagaaac

SEQ ID NO: 321743 - DNA, 15 bp, Homo sapiens
tgtaccaaagaaacc

SEQ ID NO: 321744 - DNA, 15 bp, Homo sapiens
gtaccaaagaaacct

SEQ ID NO: 321745 - DNA, 15 bp, Homo sapiens
taccaaagaaacctc

SEQ ID NO: 321746 - DNA, 15 bp, Homo sapiens
accaaagaaacctca

SEQ ID NO: 321747 - DNA, 15 bp, Homo sapiens
ccaaagaaacctcaa

SEQ ID NO: 321748 - DNA, 15 bp, Homo sapiens
caaagaaacctcaaa

SEQ ID NO: 321749 - DNA, 15 bp, Homo sapiens
aaagaaacctcaaaa

SEQ ID NO: 321750 - DNA, 15 bp, Homo sapiens
aagaaacctcaaaat

SEQ ID NO: 321751 - DNA, 15 bp, Homo sapiens
agaaacctcaaaata

SEQ ID NO: 321752 - DNA, 15 bp, Homo sapiens
gaaacctcaaaatac

SEQ ID NO: 321753 - DNA, 15 bp, Homo sapiens
aaacctcaaaataca

SEQ ID NO: 321754 - DNA, 15 bp, Homo sapiens
aacctcaaaatacag

SEQ ID NO: 321755 - DNA, 15 bp, Homo sapiens
acctcaaaatacagt

SEQ ID NO: 321756 - DNA, 15 bp, Homo sapiens
cctcaaaatacagtg

SEQ ID NO: 321757 - DNA, 15 bp, Homo sapiens
ctcaaaatacagtgg

SEQ ID NO: 321758 - DNA, 15 bp, Homo sapiens
tcaaaatacagtggc

SEQ ID NO: 321759 - DNA, 15 bp, Homo sapiens
caaaatacagtggct

SEQ ID NO: 321760 - DNA, 15 bp, Homo sapiens
aaaatacagtggctc

SEQ ID NO: 321761 - DNA, 15 bp, Homo sapiens
aaatacagtggctca

SEQ ID NO: 321762 - DNA, 15 bp, Homo sapiens
aatacagtggctcaa

SEQ ID NO: 321763 - DNA, 15 bp, Homo sapiens
atacagtggctcaaa

SEQ ID NO: 321764 - DNA, 15 bp, Homo sapiens
tacagtggctcaaat

SEQ ID NO: 321765 - DNA, 15 bp, Homo sapiens
acagtggctcaaata

SEQ ID NO: 321766 - DNA, 15 bp, Homo sapiens
cagtggctcaaataa

SEQ ID NO: 321767 - DNA, 15 bp, Homo sapiens
agtggctcaaataaa

SEQ ID NO: 321768 - DNA, 15 bp, Homo sapiens
gtggctcaaataaaa

SEQ ID NO: 321769 - DNA, 15 bp, Homo sapiens
tggctcaaataaaat

SEQ ID NO: 321770 - DNA, 15 bp, Homo sapiens
ggctcaaataaaatc

SEQ ID NO: 321771 - DNA, 15 bp, Homo sapiens
gctcaaataaaatca

SEQ ID NO: 321772 - DNA, 15 bp, Homo sapiens
ctcaaataaaatcag

SEQ ID NO: 321773 - DNA, 15 bp, Homo sapiens
tcaaataaaatcaga

SEQ ID NO: 321774 - DNA, 15 bp, Homo sapiens
caaataaaatcagag

SEQ ID NO: 321775 - DNA, 15 bp, Homo sapiens
aaataaaatcagagt

SEQ ID NO: 321776 - DNA, 15 bp, Homo sapiens
aataaaatcagagtt

SEQ ID NO: 321777 - DNA, 15 bp, Homo sapiens
ataaaatcagagttt

SEQ ID NO: 321778 - DNA, 15 bp, Homo sapiens
taaaatcagagttta

SEQ ID NO: 321779 - DNA, 15 bp, Homo sapiens
aaaatcagagtttat

SEQ ID NO: 321780 - DNA, 15 bp, Homo sapiens
aaatcagagtttatt

SEQ ID NO: 321781 - DNA, 15 bp, Homo sapiens
aatcagagtttattt

SEQ ID NO: 321782 - DNA, 15 bp, Homo sapiens
atcagagtttatttc

SEQ ID NO: 321783 - DNA, 15 bp, Homo sapiens
tcagagtttatttct

SEQ ID NO: 321784 - DNA, 15 bp, Homo sapiens
cagagtttatttctt

SEQ ID NO: 321785 - DNA, 15 bp, Homo sapiens
agagtttatttcttt

SEQ ID NO: 321786 - DNA, 15 bp, Homo sapiens
gagtttatttctttc

SEQ ID NO: 321787 - DNA, 15 bp, Homo sapiens
agtttatttctttct

SEQ ID NO: 321788 - DNA, 15 bp, Homo sapiens
gtttatttctttctc

SEQ ID NO: 321789 - DNA, 15 bp, Homo sapiens
tttatttctttctct

SEQ ID NO: 321790 - DNA, 15 bp, Homo sapiens
ttatttctttctctc

SEQ ID NO: 321791 - DNA, 15 bp, Homo sapiens
tatttctttctctcc

SEQ ID NO: 321792 - DNA, 15 bp, Homo sapiens
atttctttctctcct

SEQ ID NO: 321793 - DNA, 15 bp, Homo sapiens
tttctttctctcctt

SEQ ID NO: 321794 - DNA, 15 bp, Homo sapiens
ttctttctctcctta

SEQ ID NO: 321795 - DNA, 15 bp, Homo sapiens
tctttctctccttac

SEQ ID NO: 321796 - DNA, 15 bp, Homo sapiens
ctttctctccttaca

SEQ ID NO: 321797 - DNA, 15 bp, Homo sapiens
tttctctccttacag

SEQ ID NO: 321798 - DNA, 15 bp, Homo sapiens
ttctctccttacagt

SEQ ID NO: 321799 - DNA, 15 bp, Homo sapiens
tctctccttacagtt

SEQ ID NO: 321800 - DNA, 15 bp, Homo sapiens
ctctccttacagttc

SEQ ID NO: 321801 - DNA, 15 bp, Homo sapiens
tctccttacagttca

SEQ ID NO: 321802 - DNA, 15 bp, Homo sapiens
ctccttacagttcag

SEQ ID NO: 321803 - DNA, 15 bp, Homo sapiens
tccttacagttcaga

SEQ ID NO: 321804 - DNA, 15 bp, Homo sapiens
ccttacagttcagag

SEQ ID NO: 321805 - DNA, 15 bp, Homo sapiens
cttacagttcagagt

SEQ ID NO: 321806 - DNA, 15 bp, Homo sapiens
ttacagttcagagtt

SEQ ID NO: 321807 - DNA, 15 bp, Homo sapiens
tacagttcagagttg

SEQ ID NO: 321808 - DNA, 15 bp, Homo sapiens
acagttcagagttgg

SEQ ID NO: 321809 - DNA, 15 bp, Homo sapiens
cagttcagagttggt

SEQ ID NO: 321810 - DNA, 15 bp, Homo sapiens
agttcagagttggtg

SEQ ID NO: 321811 - DNA, 15 bp, Homo sapiens
gttcagagttggtgg

SEQ ID NO: 321812 - DNA, 15 bp, Homo sapiens
ttcagagttggtggg

SEQ ID NO: 321813 - DNA, 15 bp, Homo sapiens
tcagagttggtgggt

SEQ ID NO: 321814 - DNA, 15 bp, Homo sapiens
cagagttggtgggtg

SEQ ID NO: 321815 - DNA, 15 bp, Homo sapiens
agagttggtgggtga

SEQ ID NO: 321816 - DNA, 15 bp, Homo sapiens
gagttggtgggtgat

SEQ ID NO: 321817 - DNA, 15 bp, Homo sapiens
agttggtgggtgatg

SEQ ID NO: 321818 - DNA, 15 bp, Homo sapiens
gttggtgggtgatgg

SEQ ID NO: 321819 - DNA, 15 bp, Homo sapiens
ttggtgggtgatgga

SEQ ID NO: 321820 - DNA, 15 bp, Homo sapiens
tggtgggtgatggag

SEQ ID NO: 321821 - DNA, 15 bp, Homo sapiens
ggtgggtgatggagg

SEQ ID NO: 321822 - DNA, 15 bp, Homo sapiens
gtgggtgatggaggg

SEQ ID NO: 321823 - DNA, 15 bp, Homo sapiens
tgggtgatggagggt

SEQ ID NO: 321824 - DNA, 15 bp, Homo sapiens
gggtgatggagggtg

SEQ ID NO: 321825 - DNA, 15 bp, Homo sapiens
ggtgatggagggtgg

SEQ ID NO: 321826 - DNA, 15 bp, Homo sapiens
gtgatggagggtggg

SEQ ID NO: 321827 - DNA, 15 bp, Homo sapiens
tgatggagggtggga

SEQ ID NO: 321828 - DNA, 15 bp, Homo sapiens
gatggagggtgggaa

SEQ ID NO: 321829 - DNA, 15 bp, Homo sapiens
atggagggtgggaag

SEQ ID NO: 321830 - DNA, 15 bp, Homo sapiens
tggagggtgggaagg

SEQ ID NO: 321831 - DNA, 15 bp, Homo sapiens
ggagggtgggaaggt

SEQ ID NO: 321832 - DNA, 15 bp, Homo sapiens
gagggtgggaaggtg

SEQ ID NO: 321833 - DNA, 15 bp, Homo sapiens
agggtgggaaggtgg

SEQ ID NO: 321834 - DNA, 15 bp, Homo sapiens
gggtgggaaggtggc

SEQ ID NO: 321835 - DNA, 15 bp, Homo sapiens
ggtgggaaggtggct

SEQ ID NO: 321836 - DNA, 15 bp, Homo sapiens
gtgggaaggtggctc

SEQ ID NO: 321837 - DNA, 15 bp, Homo sapiens
tgggaaggtggctcc

SEQ ID NO: 321838 - DNA, 15 bp, Homo sapiens
gggaaggtggctccg

SEQ ID NO: 321839 - DNA, 15 bp, Homo sapiens
ggaaggtggctccgc

SEQ ID NO: 321840 - DNA, 15 bp, Homo sapiens
gaaggtggctccgct

SEQ ID NO: 321841 - DNA, 15 bp, Homo sapiens
aaggtggctccgctt

SEQ ID NO: 321842 - DNA, 15 bp, Homo sapiens
aggtggctccgcttc

SEQ ID NO: 321843 - DNA, 15 bp, Homo sapiens
ggtggctccgcttca

SEQ ID NO: 321844 - DNA, 15 bp, Homo sapiens
gtggctccgcttcat

SEQ ID NO: 321845 - DNA, 15 bp, Homo sapiens
tggctccgcttcata

SEQ ID NO: 321846 - DNA, 15 bp, Homo sapiens
ggctccgcttcatat

SEQ ID NO: 321847 - DNA, 15 bp, Homo sapiens
gctccgcttcatatg

SEQ ID NO: 321848 - DNA, 15 bp, Homo sapiens
ctccgcttcatatgg

SEQ ID NO: 321849 - DNA, 15 bp, Homo sapiens
tccgcttcatatggt

SEQ ID NO: 321850 - DNA, 15 bp, Homo sapiens
ccgcttcatatggtc

SEQ ID NO: 321851 - DNA, 15 bp, Homo sapiens
cgcttcatatggtct

SEQ ID NO: 321852 - DNA, 15 bp, Homo sapiens
gcttcatatggtctc

SEQ ID NO: 321853 - DNA, 15 bp, Homo sapiens
cttcatatggtctct

SEQ ID NO: 321854 - DNA, 15 bp, Homo sapiens
ttcatatggtctctc

SEQ ID NO: 321855 - DNA, 15 bp, Homo sapiens
tcatatggtctctca

SEQ ID NO: 321856 - DNA, 15 bp, Homo sapiens
catatggtctctcag

SEQ ID NO: 321857 - DNA, 15 bp, Homo sapiens
atatggtctctcagg

SEQ ID NO: 321858 - DNA, 15 bp, Homo sapiens
tatggtctctcaggg

SEQ ID NO: 321859 - DNA, 15 bp, Homo sapiens
atggtctctcaggga

SEQ ID NO: 321860 - DNA, 15 bp, Homo sapiens
tggtctctcagggat

SEQ ID NO: 321861 - DNA, 15 bp, Homo sapiens
ggtctctcagggatc

SEQ ID NO: 321862 - DNA, 15 bp, Homo sapiens
gtctctcagggatcc

SEQ ID NO: 321863 - DNA, 15 bp, Homo sapiens
tctctcagggatcct

SEQ ID NO: 321864 - DNA, 15 bp, Homo sapiens
ctctcagggatcctg

SEQ ID NO: 321865 - DNA, 15 bp, Homo sapiens
tctcagggatcctgg

SEQ ID NO: 321866 - DNA, 15 bp, Homo sapiens
ctcagggatcctggt

SEQ ID NO: 321867 - DNA, 15 bp, Homo sapiens
tcagggatcctggtt

SEQ ID NO: 321868 - DNA, 15 bp, Homo sapiens
cagggatcctggttc

SEQ ID NO: 321869 - DNA, 15 bp, Homo sapiens
agggatcctggttcc

SEQ ID NO: 321870 - DNA, 15 bp, Homo sapiens
gggatcctggttcct

SEQ ID NO: 321871 - DNA, 15 bp, Homo sapiens
ggatcctggttcctt

SEQ ID NO: 321872 - DNA, 15 bp, Homo sapiens
gatcctggttccttc

SEQ ID NO: 321873 - DNA, 15 bp, Homo sapiens
atcctggttccttct

SEQ ID NO: 321874 - DNA, 15 bp, Homo sapiens
tcctggttccttctc

SEQ ID NO: 321875 - DNA, 15 bp, Homo sapiens
cctggttccttctct

SEQ ID NO: 321876 - DNA, 15 bp, Homo sapiens
ctggttccttctctc

SEQ ID NO: 321877 - DNA, 15 bp, Homo sapiens
tggttccttctctct

SEQ ID NO: 321878 - DNA, 15 bp, Homo sapiens
ggttccttctctctt

SEQ ID NO: 321879 - DNA, 15 bp, Homo sapiens
gttccttctctcttg

SEQ ID NO: 321880 - DNA, 15 bp, Homo sapiens
ttccttctctcttgt

SEQ ID NO: 321881 - DNA, 15 bp, Homo sapiens
tccttctctcttgtt

SEQ ID NO: 321882 - DNA, 15 bp, Homo sapiens
ccttctctcttgttc

SEQ ID NO: 321883 - DNA, 15 bp, Homo sapiens
cttctctcttgttct

SEQ ID NO: 321884 - DNA, 15 bp, Homo sapiens
ttctctcttgttctg

SEQ ID NO: 321885 - DNA, 15 bp, Homo sapiens
tctctcttgttctgc

SEQ ID NO: 321886 - DNA, 15 bp, Homo sapiens
ctctcttgttctgcc

SEQ ID NO: 321887 - DNA, 15 bp, Homo sapiens
tctcttgttctgcct

SEQ ID NO: 321888 - DNA, 15 bp, Homo sapiens
ctcttgttctgcctt

SEQ ID NO: 321889 - DNA, 15 bp, Homo sapiens
tcttgttctgccttt

SEQ ID NO: 321890 - DNA, 15 bp, Homo sapiens
cttgttctgcctttc

SEQ ID NO: 321891 - DNA, 15 bp, Homo sapiens
ttgttctgcctttcc

SEQ ID NO: 321892 - DNA, 15 bp, Homo sapiens
tgttctgcctttcca

SEQ ID NO: 321893 - DNA, 15 bp, Homo sapiens
gttctgcctttccaa

SEQ ID NO: 321894 - DNA, 15 bp, Homo sapiens
ttctgcctttccaaa

SEQ ID NO: 321895 - DNA, 15 bp, Homo sapiens
tctgcctttccaaag

SEQ ID NO: 321896 - DNA, 15 bp, Homo sapiens
ctgcctttccaaagt

SEQ ID NO: 321897 - DNA, 15 bp, Homo sapiens
tgcctttccaaagtg

SEQ ID NO: 321898 - DNA, 15 bp, Homo sapiens
gcctttccaaagtgt

SEQ ID NO: 321899 - DNA, 15 bp, Homo sapiens
cctttccaaagtgtt

SEQ ID NO: 321900 - DNA, 15 bp, Homo sapiens
ctttccaaagtgttg

SEQ ID NO: 321901 - DNA, 15 bp, Homo sapiens
tttccaaagtgttgt

SEQ ID NO: 321902 - DNA, 15 bp, Homo sapiens
ttccaaagtgttgtt

SEQ ID NO: 321903 - DNA, 15 bp, Homo sapiens
tccaaagtgttgttc

SEQ ID NO: 321904 - DNA, 15 bp, Homo sapiens
ccaaagtgttgttcc

SEQ ID NO: 321905 - DNA, 15 bp, Homo sapiens
caaagtgttgttcca

SEQ ID NO: 321906 - DNA, 15 bp, Homo sapiens
aaagtgttgttccat

SEQ ID NO: 321907 - DNA, 15 bp, Homo sapiens
aagtgttgttccatt

SEQ ID NO: 321908 - DNA, 15 bp, Homo sapiens
agtgttgttccattt

SEQ ID NO: 321909 - DNA, 15 bp, Homo sapiens
gtgttgttccatttt

SEQ ID NO: 321910 - DNA, 15 bp, Homo sapiens
tgttgttccattttc

SEQ ID NO: 321911 - DNA, 15 bp, Homo sapiens
gttgttccattttct

SEQ ID NO: 321912 - DNA, 15 bp, Homo sapiens
ttgttccattttctt

SEQ ID NO: 321913 - DNA, 15 bp, Homo sapiens
tgttccattttcttg

SEQ ID NO: 321914 - DNA, 15 bp, Homo sapiens
gttccattttcttga

SEQ ID NO: 321915 - DNA, 15 bp, Homo sapiens
ttccattttcttgat

SEQ ID NO: 321916 - DNA, 15 bp, Homo sapiens
tccattttcttgatg

SEQ ID NO: 321917 - DNA, 15 bp, Homo sapiens
ccattttcttgatga

SEQ ID NO: 321918 - DNA, 15 bp, Homo sapiens
cattttcttgatgag

SEQ ID NO: 321919 - DNA, 15 bp, Homo sapiens
attttcttgatgagg

SEQ ID NO: 321920 - DNA, 15 bp, Homo sapiens
ttttcttgatgaggc

SEQ ID NO: 321921 - DNA, 15 bp, Homo sapiens
tttcttgatgaggct

SEQ ID NO: 321922 - DNA, 15 bp, Homo sapiens
ttcttgatgaggctt

SEQ ID NO: 321923 - DNA, 15 bp, Homo sapiens
tcttgatgaggcttg

SEQ ID NO: 321924 - DNA, 15 bp, Homo sapiens
cttgatgaggcttgc

SEQ ID NO: 321925 - DNA, 15 bp, Homo sapiens
ttgatgaggcttgcc

SEQ ID NO: 321926 - DNA, 15 bp, Homo sapiens
tgatgaggcttgccc

SEQ ID NO: 321927 - DNA, 15 bp, Homo sapiens
gatgaggcttgcccc

SEQ ID NO: 321928 - DNA, 15 bp, Homo sapiens
atgaggcttgcccct

SEQ ID NO: 321929 - DNA, 15 bp, Homo sapiens
tgaggcttgcccctc

SEQ ID NO: 321930 - DNA, 15 bp, Homo sapiens
gaggcttgcccctca

SEQ ID NO: 321931 - DNA, 15 bp, Homo sapiens
aggcttgcccctcaa

SEQ ID NO: 321932 - DNA, 15 bp, Homo sapiens
ggcttgcccctcaac

SEQ ID NO: 321933 - DNA, 15 bp, Homo sapiens
gcttgcccctcaaca

SEQ ID NO: 321934 - DNA, 15 bp, Homo sapiens
cttgcccctcaacac

SEQ ID NO: 321935 - DNA, 15 bp, Homo sapiens
ttgcccctcaacact

SEQ ID NO: 321936 - DNA, 15 bp, Homo sapiens
tgcccctcaacacta

SEQ ID NO: 321937 - DNA, 15 bp, Homo sapiens
gcccctcaacactat

SEQ ID NO: 321938 - DNA, 15 bp, Homo sapiens
ccctcaacactatgt

SEQ ID NO: 321939 - DNA, 15 bp, Homo sapiens
cctcaacactatgtc

SEQ ID NO: 321940 - DNA, 15 bp, Homo sapiens
ctcaacactatgtca

SEQ ID NO: 321941 - DNA, 15 bp, Homo sapiens
tcaacactatgtcaa

SEQ ID NO: 321942 - DNA, 15 bp, Homo sapiens
caacactatgtcaag

SEQ ID NO: 321943 - DNA, 15 bp, Homo sapiens
aacactatgtcaagt

SEQ ID NO: 321944 - DNA, 15 bp, Homo sapiens
acactatgtcaagtt

SEQ ID NO: 321945 - DNA, 15 bp, Homo sapiens
cactatgtcaagttc

SEQ ID NO: 321946 - DNA, 15 bp, Homo sapiens
actatgtcaagttct

SEQ ID NO: 321947 - DNA, 15 bp, Homo sapiens
ctatgtcaagttcta

SEQ ID NO: 321948 - DNA, 15 bp, Homo sapiens
tatgtcaagttctag

SEQ ID NO: 321949 - DNA, 15 bp, Homo sapiens
atgtcaagttctagt

SEQ ID NO: 321950 - DNA, 15 bp, Homo sapiens
tgtcaagttctagtc

SEQ ID NO: 321951 - DNA, 15 bp, Homo sapiens
gtcaagttctagtcc

SEQ ID NO: 321952 - DNA, 15 bp, Homo sapiens
tcaagttctagtcca

SEQ ID NO: 321953 - DNA, 15 bp, Homo sapiens
caagttctagtccaa

SEQ ID NO: 321954 - DNA, 15 bp, Homo sapiens
aagttctagtccaag

SEQ ID NO: 321955 - DNA, 15 bp, Homo sapiens
agttctagtccaagg

SEQ ID NO: 321956 - DNA, 15 bp, Homo sapiens
gttctagtccaagga

SEQ ID NO: 321957 - DNA, 15 bp, Homo sapiens
ttctagtccaaggaa

SEQ ID NO: 321958 - DNA, 15 bp, Homo sapiens
tctagtccaaggaaa

SEQ ID NO: 321959 - DNA, 15 bp, Homo sapiens
ctagtccaaggaaag

SEQ ID NO: 321960 - DNA, 15 bp, Homo sapiens
tagtccaaggaaaga

SEQ ID NO: 321961 - DNA, 15 bp, Homo sapiens
agtccaaggaaagag

SEQ ID NO: 321962 - DNA, 15 bp, Homo sapiens
gtccaaggaaagaga

SEQ ID NO: 321963 - DNA, 15 bp, Homo sapiens
tccaaggaaagagaa

SEQ ID NO: 321964 - DNA, 15 bp, Homo sapiens
ccaaggaaagagaaa

SEQ ID NO: 321965 - DNA, 15 bp, Homo sapiens
caaggaaagagaaaa

SEQ ID NO: 321966 - DNA, 15 bp, Homo sapiens
aaggaaagagaaaag

SEQ ID NO: 321967 - DNA, 15 bp, Homo sapiens
aggaaagagaaaaga

SEQ ID NO: 321968 - DNA, 15 bp, Homo sapiens
ggaaagagaaaagag

SEQ ID NO: 321969 - DNA, 15 bp, Homo sapiens
gaaagagaaaagaga

SEQ ID NO: 321970 - DNA, 15 bp, Homo sapiens
aaagagaaaagagaa

SEQ ID NO: 321971 - DNA, 15 bp, Homo sapiens
aagagaaaagagaag

SEQ ID NO: 321972 - DNA, 15 bp, Homo sapiens
agagaaaagagaagt

SEQ ID NO: 321973 - DNA, 15 bp, Homo sapiens
gagaaaagagaagta

SEQ ID NO: 321974 - DNA, 15 bp, Homo sapiens
agaaaagagaagtaa

SEQ ID NO: 321975 - DNA, 15 bp, Homo sapiens
gaaaagagaagtaaa

SEQ ID NO: 321976 - DNA, 15 bp, Homo sapiens
aaaagagaagtaaaa

SEQ ID NO: 321977 - DNA, 15 bp, Homo sapiens
aaagagaagtaaaaa

SEQ ID NO: 321978 - DNA, 15 bp, Homo sapiens
aagagaagtaaaaaa

SEQ ID NO: 321979 - DNA, 15 bp, Homo sapiens
agagaagtaaaaaat

SEQ ID NO: 321980 - DNA, 15 bp, Homo sapiens
gagaagtaaaaaata

SEQ ID NO: 321981 - DNA, 15 bp, Homo sapiens
agaagtaaaaaataa

SEQ ID NO: 321982 - DNA, 15 bp, Homo sapiens
gaagtaaaaaataag

SEQ ID NO: 321983 - DNA, 15 bp, Homo sapiens
aagtaaaaaataagc

SEQ ID NO: 321984 - DNA, 15 bp, Homo sapiens
agtaaaaaataagca

SEQ ID NO: 321985 - DNA, 15 bp, Homo sapiens
gtaaaaaataagcaa

SEQ ID NO: 321986 - DNA, 15 bp, Homo sapiens
taaaaaataagcaat

SEQ ID NO: 321987 - DNA, 15 bp, Homo sapiens
aaaaaataagcaatt

SEQ ID NO: 321988 - DNA, 15 bp, Homo sapiens
aaaaataagcaattt

SEQ ID NO: 321989 - DNA, 15 bp, Homo sapiens
aaaataagcaatttt

SEQ ID NO: 321990 - DNA, 15 bp, Homo sapiens
aaataagcaattttt

SEQ ID NO: 321991 - DNA, 15 bp, Homo sapiens
aataagcaatttttt

SEQ ID NO: 321992 - DNA, 15 bp, Homo sapiens
ataagcaatttttta

SEQ ID NO: 321993 - DNA, 15 bp, Homo sapiens
taagcaattttttaa

SEQ ID NO: 321994 - DNA, 15 bp, Homo sapiens
aagcaattttttaaa

SEQ ID NO: 321995 - DNA, 15 bp, Homo sapiens
agcaattttttaaaa

SEQ ID NO: 321996 - DNA, 15 bp, Homo sapiens
gcaattttttaaaac

SEQ ID NO: 321997 - DNA, 15 bp, Homo sapiens
caattttttaaaacg

SEQ ID NO: 321998 - DNA, 15 bp, Homo sapiens
aattttttaaaacgt

SEQ ID NO: 321999 - DNA, 15 bp, Homo sapiens
attttttaaaacgtg

SEQ ID NO: 322000 - DNA, 15 bp, Homo sapiens
ttttttaaaacgtgc

SEQ ID NO: 322001 - DNA, 15 bp, Homo sapiens
tttttaaaacgtgca

SEQ ID NO: 322002 - DNA, 15 bp, Homo sapiens
ttttaaaacgtgcat

SEQ ID NO: 322003 - DNA, 15 bp, Homo sapiens
tttaaaacgtgcatg

SEQ ID NO: 322004 - DNA, 15 bp, Homo sapiens
ttaaaacgtgcatgg

SEQ ID NO: 322005 - DNA, 15 bp, Homo sapiens
taaaacgtgcatggc

SEQ ID NO: 322006 - DNA, 15 bp, Homo sapiens
aaaacgtgcatggcc

SEQ ID NO: 322007 - DNA, 15 bp, Homo sapiens
aaacgtgcatggccc

SEQ ID NO: 322008 - DNA, 15 bp, Homo sapiens
aacgtgcatggccct

SEQ ID NO: 322009 - DNA, 15 bp, Homo sapiens
acgtgcatggccctc

SEQ ID NO: 322010 - DNA, 15 bp, Homo sapiens
cgtgcatggccctca

SEQ ID NO: 322011 - DNA, 15 bp, Homo sapiens
gtgcatggccctcag

SEQ ID NO: 322012 - DNA, 15 bp, Homo sapiens
tgcatggccctcagg

SEQ ID NO: 322013 - DNA, 15 bp, Homo sapiens
gcatggccctcaggt

SEQ ID NO: 322014 - DNA, 15 bp, Homo sapiens
catggccctcaggtt

SEQ ID NO: 322015 - DNA, 15 bp, Homo sapiens
atggccctcaggttg

SEQ ID NO: 322016 - DNA, 15 bp, Homo sapiens
tggccctcaggttgc

SEQ ID NO: 322017 - DNA, 15 bp, Homo sapiens
ggccctcaggttgca

SEQ ID NO: 322018 - DNA, 15 bp, Homo sapiens
gccctcaggttgcat

SEQ ID NO: 322019 - DNA, 15 bp, Homo sapiens
ccctcaggttgcatt

SEQ ID NO: 322020 - DNA, 15 bp, Homo sapiens
cctcaggttgcattc

SEQ ID NO: 322021 - DNA, 15 bp, Homo sapiens
ctcaggttgcattcc

SEQ ID NO: 322022 - DNA, 15 bp, Homo sapiens
tcaggttgcattcct

SEQ ID NO: 322023 - DNA, 15 bp, Homo sapiens
caggttgcattcctg

SEQ ID NO: 322024 - DNA, 15 bp, Homo sapiens
aggttgcattcctga

SEQ ID NO: 322025 - DNA, 15 bp, Homo sapiens
ggttgcattcctgat

SEQ ID NO: 322026 - DNA, 15 bp, Homo sapiens
gttgcattcctgatt

SEQ ID NO: 322027 - DNA, 15 bp, Homo sapiens
ttgcattcctgattt

SEQ ID NO: 322028 - DNA, 15 bp, Homo sapiens
tgcattcctgatttc

SEQ ID NO: 322029 - DNA, 15 bp, Homo sapiens
gcattcctgatttct

SEQ ID NO: 322030 - DNA, 15 bp, Homo sapiens
cattcctgatttctt

SEQ ID NO: 322031 - DNA, 15 bp, Homo sapiens
attcctgatttcttt

SEQ ID NO: 322032 - DNA, 15 bp, Homo sapiens
ttcctgatttctttt

SEQ ID NO: 322033 - DNA, 15 bp, Homo sapiens
tcctgatttcttttc

SEQ ID NO: 322034 - DNA, 15 bp, Homo sapiens
cctgatttcttttca

SEQ ID NO: 322035 - DNA, 15 bp, Homo sapiens
ctgatttcttttcac

SEQ ID NO: 322036 - DNA, 15 bp, Homo sapiens
tgatttcttttcaca

SEQ ID NO: 322037 - DNA, 15 bp, Homo sapiens
gatttcttttcacat

SEQ ID NO: 322038 - DNA, 15 bp, Homo sapiens
atttcttttcacatc

SEQ ID NO: 322039 - DNA, 15 bp, Homo sapiens
tttcttttcacatcc

SEQ ID NO: 322040 - DNA, 15 bp, Homo sapiens
ttcttttcacatccc

SEQ ID NO: 322041 - DNA, 15 bp, Homo sapiens
tcttttcacatccca

SEQ ID NO: 322042 - DNA, 15 bp, Homo sapiens
cttttcacatcccac

SEQ ID NO: 322043 - DNA, 15 bp, Homo sapiens
ttttcacatcccact

SEQ ID NO: 322044 - DNA, 15 bp, Homo sapiens
tttcacatcccactg

SEQ ID NO: 322045 - DNA, 15 bp, Homo sapiens
ttcacatcccactgg

SEQ ID NO: 322046 - DNA, 15 bp, Homo sapiens
tcacatcccactggc

SEQ ID NO: 322047 - DNA, 15 bp, Homo sapiens
cacatcccactggct

SEQ ID NO: 322048 - DNA, 15 bp, Homo sapiens
acatcccactggctg

SEQ ID NO: 322049 - DNA, 15 bp, Homo sapiens
catcccactggctgc

SEQ ID NO: 322050 - DNA, 15 bp, Homo sapiens
atcccactggctgct

SEQ ID NO: 322051 - DNA, 15 bp, Homo sapiens
tcccactggctgctg

SEQ ID NO: 322052 - DNA, 15 bp, Homo sapiens
cccactggctgctgc

SEQ ID NO: 322053 - DNA, 15 bp, Homo sapiens
ccactggctgctgct

SEQ ID NO: 322054 - DNA, 15 bp, Homo sapiens
cactggctgctgctt

SEQ ID NO: 322055 - DNA, 15 bp, Homo sapiens
actggctgctgctta

SEQ ID NO: 322056 - DNA, 15 bp, Homo sapiens
ctggctgctgcttag

SEQ ID NO: 322057 - DNA, 15 bp, Homo sapiens
tggctgctgcttagc

SEQ ID NO: 322058 - DNA, 15 bp, Homo sapiens
ggctgctgcttagcc

SEQ ID NO: 322059 - DNA, 15 bp, Homo sapiens
gctgctgcttagcca

SEQ ID NO: 322060 - DNA, 15 bp, Homo sapiens
ctgctgcttagccac

SEQ ID NO: 322061 - DNA, 15 bp, Homo sapiens
tgctgcttagccacg

SEQ ID NO: 322062 - DNA, 15 bp, Homo sapiens
gctgcttagccacgt

SEQ ID NO: 322063 - DNA, 15 bp, Homo sapiens
ctgcttagccacgtg

SEQ ID NO: 322064 - DNA, 15 bp, Homo sapiens
tgcttagccacgtgg

SEQ ID NO: 322065 - DNA, 15 bp, Homo sapiens
gcttagccacgtgga

SEQ ID NO: 322066 - DNA, 15 bp, Homo sapiens
cttagccacgtggac

SEQ ID NO: 322067 - DNA, 15 bp, Homo sapiens
ttagccacgtggact

SEQ ID NO: 322068 - DNA, 15 bp, Homo sapiens
tagccacgtggactc

SEQ ID NO: 322069 - DNA, 15 bp, Homo sapiens
agccacgtggactca

SEQ ID NO: 322070 - DNA, 15 bp, Homo sapiens
gccacgtggactcat

SEQ ID NO: 322071 - DNA, 15 bp, Homo sapiens
ccacgtggactcatc

SEQ ID NO: 322072 - DNA, 15 bp, Homo sapiens
cacgtggactcatct

SEQ ID NO: 322073 - DNA, 15 bp, Homo sapiens
acgtggactcatctt

SEQ ID NO: 322074 - DNA, 15 bp, Homo sapiens
cgtggactcatcttg

SEQ ID NO: 322075 - DNA, 15 bp, Homo sapiens
gtggactcatcttgc

SEQ ID NO: 322076 - DNA, 15 bp, Homo sapiens
tggactcatcttgct

SEQ ID NO: 322077 - DNA, 15 bp, Homo sapiens
ggactcatcttgctg

SEQ ID NO: 322078 - DNA, 15 bp, Homo sapiens
gactcatcttgctgc

SEQ ID NO: 322079 - DNA, 15 bp, Homo sapiens
actcatcttgctgca

SEQ ID NO: 322080 - DNA, 15 bp, Homo sapiens
ctcatcttgctgcaa

SEQ ID NO: 322081 - DNA, 15 bp, Homo sapiens
tcatcttgctgcaag

SEQ ID NO: 322082 - DNA, 15 bp, Homo sapiens
catcttgctgcaagg

SEQ ID NO: 322083 - DNA, 15 bp, Homo sapiens
atcttgctgcaaggg

SEQ ID NO: 322084 - DNA, 15 bp, Homo sapiens
tcttgctgcaaggga

SEQ ID NO: 322085 - DNA, 15 bp, Homo sapiens
cttgctgcaagggag

SEQ ID NO: 322086 - DNA, 15 bp, Homo sapiens
ttgctgcaagggagg

SEQ ID NO: 322087 - DNA, 15 bp, Homo sapiens
tgctgcaagggaggt

SEQ ID NO: 322088 - DNA, 15 bp, Homo sapiens
gctgcaagggaggtt

SEQ ID NO: 322089 - DNA, 15 bp, Homo sapiens
ctgcaagggaggttg

SEQ ID NO: 322090 - DNA, 15 bp, Homo sapiens
tgcaagggaggttga

SEQ ID NO: 322091 - DNA, 15 bp, Homo sapiens
gcaagggaggttgag

SEQ ID NO: 322092 - DNA, 15 bp, Homo sapiens
caagggaggttgaga

SEQ ID NO: 322093 - DNA, 15 bp, Homo sapiens
aagggaggttgagaa

SEQ ID NO: 322094 - DNA, 15 bp, Homo sapiens
agggaggttgagaaa

SEQ ID NO: 322095 - DNA, 15 bp, Homo sapiens
gggaggttgagaaat

SEQ ID NO: 322096 - DNA, 15 bp, Homo sapiens
ggaggttgagaaata

SEQ ID NO: 322097 - DNA, 15 bp, Homo sapiens
gaggttgagaaatat

SEQ ID NO: 322098 - DNA, 15 bp, Homo sapiens
aggttgagaaatatg

SEQ ID NO: 322099 - DNA, 15 bp, Homo sapiens
ggttgagaaatatgg

SEQ ID NO: 322100 - DNA, 15 bp, Homo sapiens
gttgagaaatatggc

SEQ ID NO: 322101 - DNA, 15 bp, Homo sapiens
ttgagaaatatggct

SEQ ID NO: 322102 - DNA, 15 bp, Homo sapiens
tgagaaatatggctt

SEQ ID NO: 322103 - DNA, 15 bp, Homo sapiens
gagaaatatggcttg

SEQ ID NO: 322104 - DNA, 15 bp, Homo sapiens
agaaatatggcttgt

SEQ ID NO: 322105 - DNA, 15 bp, Homo sapiens
gaaatatggcttgtg

SEQ ID NO: 322106 - DNA, 15 bp, Homo sapiens
aaatatggcttgtgc

SEQ ID NO: 322107 - DNA, 15 bp, Homo sapiens
aatatggcttgtgct

SEQ ID NO: 322108 - DNA, 15 bp, Homo sapiens
atatggcttgtgctg

SEQ ID NO: 322109 - DNA, 15 bp, Homo sapiens
tatggcttgtgctga

SEQ ID NO: 322110 - DNA, 15 bp, Homo sapiens
atggcttgtgctgag

SEQ ID NO: 322111 - DNA, 15 bp, Homo sapiens
tggcttgtgctgagc

SEQ ID NO: 322112 - DNA, 15 bp, Homo sapiens
ggcttgtgctgagct

SEQ ID NO: 322113 - DNA, 15 bp, Homo sapiens
gcttgtgctgagcta

SEQ ID NO: 322114 - DNA, 15 bp, Homo sapiens
cttgtgctgagctag

SEQ ID NO: 322115 - DNA, 15 bp, Homo sapiens
ttgtgctgagctaga

SEQ ID NO: 322116 - DNA, 15 bp, Homo sapiens
tgtgctgagctagaa

SEQ ID NO: 322117 - DNA, 15 bp, Homo sapiens
gtgctgagctagaac

SEQ ID NO: 322118 - DNA, 15 bp, Homo sapiens
tgctgagctagaact

SEQ ID NO: 322119 - DNA, 15 bp, Homo sapiens
gctgagctagaactg

SEQ ID NO: 322120 - DNA, 15 bp, Homo sapiens
ctgagctagaactgt

SEQ ID NO: 322121 - DNA, 15 bp, Homo sapiens
tgagctagaactgtg

SEQ ID NO: 322122 - DNA, 15 bp, Homo sapiens
gagctagaactgtgg

SEQ ID NO: 322123 - DNA, 15 bp, Homo sapiens
agctagaactgtggg

SEQ ID NO: 322124 - DNA, 15 bp, Homo sapiens
gctagaactgtgggg

SEQ ID NO: 322125 - DNA, 15 bp, Homo sapiens
ctagaactgtgggga

SEQ ID NO: 322126 - DNA, 15 bp, Homo sapiens
tagaactgtggggat

SEQ ID NO: 322127 - DNA, 15 bp, Homo sapiens
agaactgtggggatg

SEQ ID NO: 322128 - DNA, 15 bp, Homo sapiens
gaactgtggggatgg

SEQ ID NO: 322129 - DNA, 15 bp, Homo sapiens
aactgtggggatgga

SEQ ID NO: 322130 - DNA, 15 bp, Homo sapiens
actgtggggatggag

SEQ ID NO: 322131 - DNA, 15 bp, Homo sapiens
ctgtggggatggagg

SEQ ID NO: 322132 - DNA, 15 bp, Homo sapiens
tgtggggatggagga

SEQ ID NO: 322133 - DNA, 15 bp, Homo sapiens
gtggggatggaggag

SEQ ID NO: 322134 - DNA, 15 bp, Homo sapiens
tggggatggaggaga

SEQ ID NO: 322135 - DNA, 15 bp, Homo sapiens
ggggatggaggagaa

SEQ ID NO: 322136 - DNA, 15 bp, Homo sapiens
gggatggaggagaag

SEQ ID NO: 322137 - DNA, 15 bp, Homo sapiens
ggatggaggagaaga

SEQ ID NO: 322138 - DNA, 15 bp, Homo sapiens
gatggaggagaagag

SEQ ID NO: 322139 - DNA, 15 bp, Homo sapiens
atggaggagaagagc

SEQ ID NO: 322140 - DNA, 15 bp, Homo sapiens
tggaggagaagagca

SEQ ID NO: 322141 - DNA, 15 bp, Homo sapiens
ggaggagaagagcag

SEQ ID NO: 322142 - DNA, 15 bp, Homo sapiens
gaggagaagagcagg

SEQ ID NO: 322143 - DNA, 15 bp, Homo sapiens
aggagaagagcaggt

SEQ ID NO: 322144 - DNA, 15 bp, Homo sapiens
ggagaagagcaggtt

SEQ ID NO: 322145 - DNA, 15 bp, Homo sapiens
gagaagagcaggttt

SEQ ID NO: 322146 - DNA, 15 bp, Homo sapiens
agaagagcaggtttc

SEQ ID NO: 322147 - DNA, 15 bp, Homo sapiens
gaagagcaggtttct

SEQ ID NO: 322148 - DNA, 15 bp, Homo sapiens
aagagcaggtttctg

SEQ ID NO: 322149 - DNA, 15 bp, Homo sapiens
agagcaggtttctga

SEQ ID NO: 322150 - DNA, 15 bp, Homo sapiens
gagcaggtttctgat

SEQ ID NO: 322151 - DNA, 15 bp, Homo sapiens
agcaggtttctgata

SEQ ID NO: 322152 - DNA, 15 bp, Homo sapiens
gcaggtttctgatac

SEQ ID NO: 322153 - DNA, 15 bp, Homo sapiens
caggtttctgatact

SEQ ID NO: 322154 - DNA, 15 bp, Homo sapiens
aggtttctgatactg

SEQ ID NO: 322155 - DNA, 15 bp, Homo sapiens
ggtttctgatactga

SEQ ID NO: 322156 - DNA, 15 bp, Homo sapiens
gtttctgatactgaa

SEQ ID NO: 322157 - DNA, 15 bp, Homo sapiens
tttctgatactgaaa

SEQ ID NO: 322158 - DNA, 15 bp, Homo sapiens
ttctgatactgaaaa

SEQ ID NO: 322159 - DNA, 15 bp, Homo sapiens
tctgatactgaaaaa

SEQ ID NO: 322160 - DNA, 15 bp, Homo sapiens
ctgatactgaaaaaa

SEQ ID NO: 322161 - DNA, 15 bp, Homo sapiens
tgatactgaaaaaaa

SEQ ID NO: 322162 - DNA, 15 bp, Homo sapiens
gatactgaaaaaaaa

SEQ ID NO: 322163 - DNA, 15 bp, Homo sapiens
atactgaaaaaaaaa

SEQ ID NO: 322164 - DNA, 15 bp, Homo sapiens
tactgaaaaaaaaaa

SEQ ID NO: 322165 - DNA, 15 bp, Homo sapiens
actgaaaaaaaaaaa

SEQ ID NO: 322166 - DNA, 15 bp, Homo sapiens
ctgaaaaaaaaaaaa

SEQ ID NO: 322167 - DNA, 15 bp, Homo sapiens
aaaaaaaaaagaaaa

SEQ ID NO: 322168 - DNA, 15 bp, Homo sapiens
aaaaaaaaagaaaag

SEQ ID NO: 322169 - DNA, 15 bp, Homo sapiens
aaaaaaaagaaaaga

SEQ ID NO: 322170 - DNA, 15 bp, Homo sapiens
aaaaaaagaaaagaa

SEQ ID NO: 322171 - DNA, 15 bp, Homo sapiens
aaaaaagaaaagaaa

SEQ ID NO: 322172 - DNA, 15 bp, Homo sapiens
aaaaagaaaagaaaa

SEQ ID NO: 322173 - DNA, 15 bp, Homo sapiens
aaaagaaaagaaaat

SEQ ID NO: 322174 - DNA, 15 bp, Homo sapiens
aaagaaaagaaaata

SEQ ID NO: 322175 - DNA, 15 bp, Homo sapiens
aagaaaagaaaatag

SEQ ID NO: 322176 - DNA, 15 bp, Homo sapiens
agaaaagaaaataga

SEQ ID NO: 322177 - DNA, 15 bp, Homo sapiens
gaaaagaaaatagaa

SEQ ID NO: 322178 - DNA, 15 bp, Homo sapiens
aaaagaaaatagaaa

SEQ ID NO: 322179 - DNA, 15 bp, Homo sapiens
aaagaaaatagaaag

SEQ ID NO: 322180 - DNA, 15 bp, Homo sapiens
aagaaaatagaaagg

SEQ ID NO: 322181 - DNA, 15 bp, Homo sapiens
agaaaatagaaagga

SEQ ID NO: 322182 - DNA, 15 bp, Homo sapiens
gaaaatagaaaggag

SEQ ID NO: 322183 - DNA, 15 bp, Homo sapiens
aaaatagaaaggaga

SEQ ID NO: 322184 - DNA, 15 bp, Homo sapiens
aaatagaaaggagaa

SEQ ID NO: 322185 - DNA, 15 bp, Homo sapiens
aatagaaaggagaat

SEQ ID NO: 322186 - DNA, 15 bp, Homo sapiens
atagaaaggagaatg

SEQ ID NO: 322187 - DNA, 15 bp, Homo sapiens
tagaaaggagaatgg

SEQ ID NO: 322188 - DNA, 15 bp, Homo sapiens
agaaaggagaatgga

SEQ ID NO: 322189 - DNA, 15 bp, Homo sapiens
gaaaggagaatggat

SEQ ID NO: 322190 - DNA, 15 bp, Homo sapiens
aaaggagaatggata

SEQ ID NO: 322191 - DNA, 15 bp, Homo sapiens
aaggagaatggataa

SEQ ID NO: 322192 - DNA, 15 bp, Homo sapiens
aggagaatggataat

SEQ ID NO: 322193 - DNA, 15 bp, Homo sapiens
ggagaatggataata

SEQ ID NO: 322194 - DNA, 15 bp, Homo sapiens
gagaatggataataa

SEQ ID NO: 322195 - DNA, 15 bp, Homo sapiens
agaatggataataat

SEQ ID NO: 322196 - DNA, 15 bp, Homo sapiens
gaatggataataata

SEQ ID NO: 322197 - DNA, 15 bp, Homo sapiens
aatggataataataa

SEQ ID NO: 322198 - DNA, 15 bp, Homo sapiens
atggataataataaa

SEQ ID NO: 322199 - DNA, 15 bp, Homo sapiens
tggataataataaat

SEQ ID NO: 322200 - DNA, 15 bp, Homo sapiens
ggataataataaata

SEQ ID NO: 322201 - DNA, 15 bp, Homo sapiens
gataataataaatat

SEQ ID NO: 322202 - DNA, 15 bp, Homo sapiens
ataataataaatata

SEQ ID NO: 322203 - DNA, 15 bp, Homo sapiens
taataataaatatac

SEQ ID NO: 322204 - DNA, 15 bp, Homo sapiens
aataataaatataca

SEQ ID NO: 322205 - DNA, 15 bp, Homo sapiens
ataataaatatacat

SEQ ID NO: 322206 - DNA, 15 bp, Homo sapiens
taataaatatacata

SEQ ID NO: 322207 - DNA, 15 bp, Homo sapiens
aataaatatacatat

SEQ ID NO: 322208 - DNA, 15 bp, Homo sapiens
ataaatatacatatg

SEQ ID NO: 322209 - DNA, 15 bp, Homo sapiens
taaatatacatatgc

SEQ ID NO: 322210 - DNA, 15 bp, Homo sapiens
aaatatacatatgct

SEQ ID NO: 322211 - DNA, 15 bp, Homo sapiens
aatatacatatgctt

SEQ ID NO: 322212 - DNA, 15 bp, Homo sapiens
atatacatatgcttt

SEQ ID NO: 322213 - DNA, 15 bp, Homo sapiens
tatacatatgctttg

SEQ ID NO: 322214 - DNA, 15 bp, Homo sapiens
atacatatgctttga

SEQ ID NO: 322215 - DNA, 15 bp, Homo sapiens
tacatatgctttgat

SEQ ID NO: 322216 - DNA, 15 bp, Homo sapiens
acatatgctttgatc

SEQ ID NO: 322217 - DNA, 15 bp, Homo sapiens
catatgctttgatca

SEQ ID NO: 322218 - DNA, 15 bp, Homo sapiens
atatgctttgatcac

SEQ ID NO: 322219 - DNA, 15 bp, Homo sapiens
tatgctttgatcaca

SEQ ID NO: 322220 - DNA, 15 bp, Homo sapiens
atgctttgatcacaa

SEQ ID NO: 322221 - DNA, 15 bp, Homo sapiens
tgctttgatcacaat

SEQ ID NO: 322222 - DNA, 15 bp, Homo sapiens
gctttgatcacaatt

SEQ ID NO: 322223 - DNA, 15 bp, Homo sapiens
ctttgatcacaattt

SEQ ID NO: 322224 - DNA, 15 bp, Homo sapiens
tttgatcacaatttc

SEQ ID NO: 322225 - DNA, 15 bp, Homo sapiens
ttgatcacaatttca

SEQ ID NO: 322226 - DNA, 15 bp, Homo sapiens
tgatcacaatttcat

SEQ ID NO: 322227 - DNA, 15 bp, Homo sapiens
gatcacaatttcatg

SEQ ID NO: 322228 - DNA, 15 bp, Homo sapiens
atcacaatttcatgg

SEQ ID NO: 322229 - DNA, 15 bp, Homo sapiens
tcacaatttcatggg

SEQ ID NO: 322230 - DNA, 15 bp, Homo sapiens
cacaatttcatgggc

SEQ ID NO: 322231 - DNA, 15 bp, Homo sapiens
acaatttcatgggcc

SEQ ID NO: 322232 - DNA, 15 bp, Homo sapiens
caatttcatgggcca

SEQ ID NO: 322233 - DNA, 15 bp, Homo sapiens
aatttcatgggccaa

SEQ ID NO: 322234 - DNA, 15 bp, Homo sapiens
atttcatgggccaag

SEQ ID NO: 322235 - DNA, 15 bp, Homo sapiens
tttcatgggccaagt

SEQ ID NO: 322236 - DNA, 15 bp, Homo sapiens
ttcatgggccaagtt

SEQ ID NO: 322237 - DNA, 15 bp, Homo sapiens
tcatgggccaagttt

SEQ ID NO: 322238 - DNA, 15 bp, Homo sapiens
catgggccaagtttg

SEQ ID NO: 322239 - DNA, 15 bp, Homo sapiens
atgggccaagtttga

SEQ ID NO: 322240 - DNA, 15 bp, Homo sapiens
tgggccaagtttgag

SEQ ID NO: 322241 - DNA, 15 bp, Homo sapiens
gggccaagtttgagt

SEQ ID NO: 322242 - DNA, 15 bp, Homo sapiens
ggccaagtttgagtt

SEQ ID NO: 322243 - DNA, 15 bp, Homo sapiens
gccaagtttgagttt

SEQ ID NO: 322244 - DNA, 15 bp, Homo sapiens
ccaagtttgagtttg

SEQ ID NO: 322245 - DNA, 15 bp, Homo sapiens
caagtttgagtttgg

SEQ ID NO: 322246 - DNA, 15 bp, Homo sapiens
aagtttgagtttgga

SEQ ID NO: 322247 - DNA, 15 bp, Homo sapiens
agtttgagtttggaa

SEQ ID NO: 322248 - DNA, 15 bp, Homo sapiens
gtttgagtttggaat

SEQ ID NO: 322249 - DNA, 15 bp, Homo sapiens
tttgagtttggaatt

SEQ ID NO: 322250 - DNA, 15 bp, Homo sapiens
ttgagtttggaattt

SEQ ID NO: 322251 - DNA, 15 bp, Homo sapiens
tgagtttggaatttt

SEQ ID NO: 322252 - DNA, 15 bp, Homo sapiens
gagtttggaattttc

SEQ ID NO: 322253 - DNA, 15 bp, Homo sapiens
agtttggaattttcc

SEQ ID NO: 322254 - DNA, 15 bp, Homo sapiens
gtttggaattttcca

SEQ ID NO: 322255 - DNA, 15 bp, Homo sapiens
tttggaattttccaa

SEQ ID NO: 322256 - DNA, 15 bp, Homo sapiens
ttggaattttccaag

SEQ ID NO: 322257 - DNA, 15 bp, Homo sapiens
tggaattttccaagt

SEQ ID NO: 322258 - DNA, 15 bp, Homo sapiens
ggaattttccaagtc

SEQ ID NO: 322259 - DNA, 15 bp, Homo sapiens
gaattttccaagtcc

SEQ ID NO: 322260 - DNA, 15 bp, Homo sapiens
aattttccaagtcct

SEQ ID NO: 322261 - DNA, 15 bp, Homo sapiens
attttccaagtcctc

SEQ ID NO: 322262 - DNA, 15 bp, Homo sapiens
ttttccaagtcctca

SEQ ID NO: 322263 - DNA, 15 bp, Homo sapiens
tttccaagtcctcag

SEQ ID NO: 322264 - DNA, 15 bp, Homo sapiens
ttccaagtcctcaga

SEQ ID NO: 322265 - DNA, 15 bp, Homo sapiens
tccaagtcctcagat

SEQ ID NO: 322266 - DNA, 15 bp, Homo sapiens
ccaagtcctcagatt

SEQ ID NO: 322267 - DNA, 15 bp, Homo sapiens
caagtcctcagattc

SEQ ID NO: 322268 - DNA, 15 bp, Homo sapiens
aagtcctcagattct

SEQ ID NO: 322269 - DNA, 15 bp, Homo sapiens
agtcctcagattcta

SEQ ID NO: 322270 - DNA, 15 bp, Homo sapiens
gtcctcagattctat

SEQ ID NO: 322271 - DNA, 15 bp, Homo sapiens
tcctcagattctatg

SEQ ID NO: 322272 - DNA, 15 bp, Homo sapiens
cctcagattctatga

SEQ ID NO: 322273 - DNA, 15 bp, Homo sapiens
ctcagattctatgac

SEQ ID NO: 322274 - DNA, 15 bp, Homo sapiens
tcagattctatgaca

SEQ ID NO: 322275 - DNA, 15 bp, Homo sapiens
cagattctatgacag

SEQ ID NO: 322276 - DNA, 15 bp, Homo sapiens
agattctatgacaga

SEQ ID NO: 322277 - DNA, 15 bp, Homo sapiens
gattctatgacagaa

SEQ ID NO: 322278 - DNA, 15 bp, Homo sapiens
attctatgacagaac

SEQ ID NO: 322279 - DNA, 15 bp, Homo sapiens
ttctatgacagaaca

SEQ ID NO: 322280 - DNA, 15 bp, Homo sapiens
tctatgacagaacat

SEQ ID NO: 322281 - DNA, 15 bp, Homo sapiens
ctatgacagaacatg

SEQ ID NO: 322282 - DNA, 15 bp, Homo sapiens
tatgacagaacatgg

SEQ ID NO: 322283 - DNA, 15 bp, Homo sapiens
atgacagaacatggt

SEQ ID NO: 322284 - DNA, 15 bp, Homo sapiens
tgacagaacatggtg

SEQ ID NO: 322285 - DNA, 15 bp, Homo sapiens
gacagaacatggtgg

SEQ ID NO: 322286 - DNA, 15 bp, Homo sapiens
acagaacatggtggt

SEQ ID NO: 322287 - DNA, 15 bp, Homo sapiens
cagaacatggtggtg

SEQ ID NO: 322288 - DNA, 15 bp, Homo sapiens
agaacatggtggtgg

SEQ ID NO: 322289 - DNA, 15 bp, Homo sapiens
gaacatggtggtgga

SEQ ID NO: 322290 - DNA, 15 bp, Homo sapiens
aacatggtggtggag

SEQ ID NO: 322291 - DNA, 15 bp, Homo sapiens
acatggtggtggaga

SEQ ID NO: 322292 - DNA, 15 bp, Homo sapiens
catggtggtggagag

SEQ ID NO: 322293 - DNA, 15 bp, Homo sapiens
atggtggtggagaga

SEQ ID NO: 322294 - DNA, 15 bp, Homo sapiens
tggtggtggagagag

SEQ ID NO: 322295 - DNA, 15 bp, Homo sapiens
ggtggtggagagagc

SEQ ID NO: 322296 - DNA, 15 bp, Homo sapiens
gtggtggagagagct

SEQ ID NO: 322297 - DNA, 15 bp, Homo sapiens
tggtggagagagctg

SEQ ID NO: 322298 - DNA, 15 bp, Homo sapiens
ggtggagagagctgc

SEQ ID NO: 322299 - DNA, 15 bp, Homo sapiens
gtggagagagctgcc

SEQ ID NO: 322300 - DNA, 15 bp, Homo sapiens
tggagagagctgccc

SEQ ID NO: 322301 - DNA, 15 bp, Homo sapiens
ggagagagctgcccc

SEQ ID NO: 322302 - DNA, 15 bp, Homo sapiens
gagagagctgccccc

SEQ ID NO: 322303 - DNA, 15 bp, Homo sapiens
agagagctgccccct

SEQ ID NO: 322304 - DNA, 15 bp, Homo sapiens
gagagctgccccctg

SEQ ID NO: 322305 - DNA, 15 bp, Homo sapiens
agagctgccccctgg

SEQ ID NO: 322306 - DNA, 15 bp, Homo sapiens
gagctgccccctggc

SEQ ID NO: 322307 - DNA, 15 bp, Homo sapiens
agctgccccctggct

SEQ ID NO: 322308 - DNA, 15 bp, Homo sapiens
gctgccccctggctc

SEQ ID NO: 322309 - DNA, 15 bp, Homo sapiens
ctgccccctggctcc

SEQ ID NO: 322310 - DNA, 15 bp, Homo sapiens
tgccccctggctcca

SEQ ID NO: 322311 - DNA, 15 bp, Homo sapiens
gccccctggctccag

SEQ ID NO: 322312 - DNA, 15 bp, Homo sapiens
ccccctggctccagt

SEQ ID NO: 322313 - DNA, 15 bp, Homo sapiens
cccctggctccagtt

SEQ ID NO: 322314 - DNA, 15 bp, Homo sapiens
ccctggctccagttt

SEQ ID NO: 322315 - DNA, 15 bp, Homo sapiens
cctggctccagtttg

SEQ ID NO: 322316 - DNA, 15 bp, Homo sapiens
ctggctccagtttgc

SEQ ID NO: 322317 - DNA, 15 bp, Homo sapiens
tggctccagtttgca

SEQ ID NO: 322318 - DNA, 15 bp, Homo sapiens
ggctccagtttgcag

SEQ ID NO: 322319 - DNA, 15 bp, Homo sapiens
gctccagtttgcaga

SEQ ID NO: 322320 - DNA, 15 bp, Homo sapiens
ctccagtttgcagac

SEQ ID NO: 322321 - DNA, 15 bp, Homo sapiens
tccagtttgcagact

SEQ ID NO: 322322 - DNA, 15 bp, Homo sapiens
ccagtttgcagactt

SEQ ID NO: 322323 - DNA, 15 bp, Homo sapiens
cagtttgcagacttt

SEQ ID NO: 322324 - DNA, 15 bp, Homo sapiens
agtttgcagactttc

SEQ ID NO: 322325 - DNA, 15 bp, Homo sapiens
gtttgcagactttcc

SEQ ID NO: 322326 - DNA, 15 bp, Homo sapiens
tttgcagactttccc

SEQ ID NO: 322327 - DNA, 15 bp, Homo sapiens
ttgcagactttcccc

SEQ ID NO: 322328 - DNA, 15 bp, Homo sapiens
tgcagactttcccct

SEQ ID NO: 322329 - DNA, 15 bp, Homo sapiens
gcagactttcccctt

SEQ ID NO: 322330 - DNA, 15 bp, Homo sapiens
cagactttccccttt

SEQ ID NO: 322331 - DNA, 15 bp, Homo sapiens
agactttcccctttg

SEQ ID NO: 322332 - DNA, 15 bp, Homo sapiens
gactttcccctttgt

SEQ ID NO: 322333 - DNA, 15 bp, Homo sapiens
actttcccctttgtc

SEQ ID NO: 322334 - DNA, 15 bp, Homo sapiens
ctttcccctttgtct

SEQ ID NO: 322335 - DNA, 15 bp, Homo sapiens
tttcccctttgtctg

SEQ ID NO: 322336 - DNA, 15 bp, Homo sapiens
ttcccctttgtctgc

SEQ ID NO: 322337 - DNA, 15 bp, Homo sapiens
tcccctttgtctgcc

SEQ ID NO: 322338 - DNA, 15 bp, Homo sapiens
cccctttgtctgccc

SEQ ID NO: 322339 - DNA, 15 bp, Homo sapiens
ccctttgtctgccca

SEQ ID NO: 322340 - DNA, 15 bp, Homo sapiens
cctttgtctgcccat

SEQ ID NO: 322341 - DNA, 15 bp, Homo sapiens
ctttgtctgcccatg

SEQ ID NO: 322342 - DNA, 15 bp, Homo sapiens
tttgtctgcccatgc

SEQ ID NO: 322343 - DNA, 15 bp, Homo sapiens
ttgtctgcccatgct

SEQ ID NO: 322344 - DNA, 15 bp, Homo sapiens
tgtctgcccatgctg

SEQ ID NO: 322345 - DNA, 15 bp, Homo sapiens
gtctgcccatgctgg

SEQ ID NO: 322346 - DNA, 15 bp, Homo sapiens
tctgcccatgctggc

SEQ ID NO: 322347 - DNA, 15 bp, Homo sapiens
ctgcccatgctggct

SEQ ID NO: 322348 - DNA, 15 bp, Homo sapiens
tgcccatgctggctc

SEQ ID NO: 322349 - DNA, 15 bp, Homo sapiens
gcccatgctggctcc

SEQ ID NO: 322350 - DNA, 15 bp, Homo sapiens
cccatgctggctcca

SEQ ID NO: 322351 - DNA, 15 bp, Homo sapiens
ccatgctggctccat

SEQ ID NO: 322352 - DNA, 15 bp, Homo sapiens
catgctggctccatt

SEQ ID NO: 322353 - DNA, 15 bp, Homo sapiens
atgctggctccattt

SEQ ID NO: 322354 - DNA, 15 bp, Homo sapiens
tgctggctccatttg

SEQ ID NO: 322355 - DNA, 15 bp, Homo sapiens
gctggctccatttgg

SEQ ID NO: 322356 - DNA, 15 bp, Homo sapiens
ctggctccatttggc

SEQ ID NO: 322357 - DNA, 15 bp, Homo sapiens
tggctccatttggca

SEQ ID NO: 322358 - DNA, 15 bp, Homo sapiens
ggctccatttggcac

SEQ ID NO: 322359 - DNA, 15 bp, Homo sapiens
gctccatttggcact

SEQ ID NO: 322360 - DNA, 15 bp, Homo sapiens
ctccatttggcactg

SEQ ID NO: 322361 - DNA, 15 bp, Homo sapiens
tccatttggcactgg

SEQ ID NO: 322362 - DNA, 15 bp, Homo sapiens
ccatttggcactggg

SEQ ID NO: 322363 - DNA, 15 bp, Homo sapiens
catttggcactggga

SEQ ID NO: 322364 - DNA, 15 bp, Homo sapiens
atttggcactgggaa

SEQ ID NO: 322365 - DNA, 15 bp, Homo sapiens
tttggcactgggaag

SEQ ID NO: 322366 - DNA, 15 bp, Homo sapiens
ttggcactgggaagg

SEQ ID NO: 322367 - DNA, 15 bp, Homo sapiens
tggcactgggaaggg

SEQ ID NO: 322368 - DNA, 15 bp, Homo sapiens
ggcactgggaagggc

SEQ ID NO: 322369 - DNA, 15 bp, Homo sapiens
gcactgggaagggct

SEQ ID NO: 322370 - DNA, 15 bp, Homo sapiens
cactgggaagggctt

SEQ ID NO: 322371 - DNA, 15 bp, Homo sapiens
actgggaagggcttt

SEQ ID NO: 322372 - DNA, 15 bp, Homo sapiens
ctgggaagggctttg

SEQ ID NO: 322373 - DNA, 15 bp, Homo sapiens
tgggaagggctttgc

SEQ ID NO: 322374 - DNA, 15 bp, Homo sapiens
gggaagggctttgca

SEQ ID NO: 322375 - DNA, 15 bp, Homo sapiens
ggaagggctttgcac

SEQ ID NO: 322376 - DNA, 15 bp, Homo sapiens
gaagggctttgcacc

SEQ ID NO: 322377 - DNA, 15 bp, Homo sapiens
aagggctttgcaccc

SEQ ID NO: 322378 - DNA, 15 bp, Homo sapiens
agggctttgcaccca

SEQ ID NO: 322379 - DNA, 15 bp, Homo sapiens
gggctttgcacccaa

SEQ ID NO: 322380 - DNA, 15 bp, Homo sapiens
ggctttgcacccaag

SEQ ID NO: 322381 - DNA, 15 bp, Homo sapiens
gctttgcacccaagt

SEQ ID NO: 322382 - DNA, 15 bp, Homo sapiens
ctttgcacccaagtt

SEQ ID NO: 322383 - DNA, 15 bp, Homo sapiens
tttgcacccaagttt

SEQ ID NO: 322384 - DNA, 15 bp, Homo sapiens
ttgcacccaagtttg

SEQ ID NO: 322385 - DNA, 15 bp, Homo sapiens
tgcacccaagtttgt

SEQ ID NO: 322386 - DNA, 15 bp, Homo sapiens
gcacccaagtttgtg

SEQ ID NO: 322387 - DNA, 15 bp, Homo sapiens
cacccaagtttgtgg

SEQ ID NO: 322388 - DNA, 15 bp, Homo sapiens
acccaagtttgtggt

SEQ ID NO: 322389 - DNA, 15 bp, Homo sapiens
cccaagtttgtggtc

SEQ ID NO: 322390 - DNA, 15 bp, Homo sapiens
ccaagtttgtggtca

SEQ ID NO: 322391 - DNA, 15 bp, Homo sapiens
caagtttgtggtcag

SEQ ID NO: 322392 - DNA, 15 bp, Homo sapiens
aagtttgtggtcagt

SEQ ID NO: 322393 - DNA, 15 bp, Homo sapiens
agtttgtggtcagtt

SEQ ID NO: 322394 - DNA, 15 bp, Homo sapiens
gtttgtggtcagttg

SEQ ID NO: 322395 - DNA, 15 bp, Homo sapiens
tttgtggtcagttgg

SEQ ID NO: 322396 - DNA, 15 bp, Homo sapiens
ttgtggtcagttggc

SEQ ID NO: 322397 - DNA, 15 bp, Homo sapiens
tgtggtcagttggcc

SEQ ID NO: 322398 - DNA, 15 bp, Homo sapiens
gtggtcagttggcca

SEQ ID NO: 322399 - DNA, 15 bp, Homo sapiens
tggtcagttggccaa

SEQ ID NO: 322400 - DNA, 15 bp, Homo sapiens
ggtcagttggccaag

SEQ ID NO: 322401 - DNA, 15 bp, Homo sapiens
gtcagttggccaagc

SEQ ID NO: 322402 - DNA, 15 bp, Homo sapiens
tcagttggccaagca

SEQ ID NO: 322403 - DNA, 15 bp, Homo sapiens
cagttggccaagcac

SEQ ID NO: 322404 - DNA, 15 bp, Homo sapiens
agttggccaagcacc

SEQ ID NO: 322405 - DNA, 15 bp, Homo sapiens
gttggccaagcaccc

SEQ ID NO: 322406 - DNA, 15 bp, Homo sapiens
ttggccaagcaccca

SEQ ID NO: 322407 - DNA, 15 bp, Homo sapiens
tggccaagcacccat

SEQ ID NO: 322408 - DNA, 15 bp, Homo sapiens
ggccaagcacccatg

SEQ ID NO: 322409 - DNA, 15 bp, Homo sapiens
gccaagcacccatgg

SEQ ID NO: 322410 - DNA, 15 bp, Homo sapiens
ccaagcacccatggt

SEQ ID NO: 322411 - DNA, 15 bp, Homo sapiens
caagcacccatggtc

SEQ ID NO: 322412 - DNA, 15 bp, Homo sapiens
aagcacccatggtct

SEQ ID NO: 322413 - DNA, 15 bp, Homo sapiens
agcacccatggtctc

SEQ ID NO: 322414 - DNA, 15 bp, Homo sapiens
gcacccatggtctcc

SEQ ID NO: 322415 - DNA, 15 bp, Homo sapiens
cacccatggtctccc

SEQ ID NO: 322416 - DNA, 15 bp, Homo sapiens
acccatggtctccca

SEQ ID NO: 322417 - DNA, 15 bp, Homo sapiens
cccatggtctcccac

SEQ ID NO: 322418 - DNA, 15 bp, Homo sapiens
ccatggtctcccact

SEQ ID NO: 322419 - DNA, 15 bp, Homo sapiens
catggtctcccactc

SEQ ID NO: 322420 - DNA, 15 bp, Homo sapiens
atggtctcccactct

SEQ ID NO: 322421 - DNA, 15 bp, Homo sapiens
tggtctcccactctt

SEQ ID NO: 322422 - DNA, 15 bp, Homo sapiens
ggtctcccactcttc

SEQ ID NO: 322423 - DNA, 15 bp, Homo sapiens
gtctcccactcttcc

SEQ ID NO: 322424 - DNA, 15 bp, Homo sapiens
tctcccactcttccc

SEQ ID NO: 322425 - DNA, 15 bp, Homo sapiens
ctcccactcttcccc

SEQ ID NO: 322426 - DNA, 15 bp, Homo sapiens
tcccactcttcccca

SEQ ID NO: 322427 - DNA, 15 bp, Homo sapiens
cccactcttccccac

SEQ ID NO: 322428 - DNA, 15 bp, Homo sapiens
ccactcttccccact

SEQ ID NO: 322429 - DNA, 15 bp, Homo sapiens
cactcttccccactt

SEQ ID NO: 322430 - DNA, 15 bp, Homo sapiens
actcttccccacttg

SEQ ID NO: 322431 - DNA, 15 bp, Homo sapiens
ctcttccccacttgc

SEQ ID NO: 322432 - DNA, 15 bp, Homo sapiens
tcttccccacttgca

SEQ ID NO: 322433 - DNA, 15 bp, Homo sapiens
cttccccacttgcaa

SEQ ID NO: 322434 - DNA, 15 bp, Homo sapiens
ttccccacttgcaaa

SEQ ID NO: 322435 - DNA, 15 bp, Homo sapiens
tccccacttgcaaac

SEQ ID NO: 322436 - DNA, 15 bp, Homo sapiens
ccccacttgcaaaca

SEQ ID NO: 322437 - DNA, 15 bp, Homo sapiens
cccacttgcaaacag

SEQ ID NO: 322438 - DNA, 15 bp, Homo sapiens
ccacttgcaaacagt

SEQ ID NO: 322439 - DNA, 15 bp, Homo sapiens
cacttgcaaacagta

SEQ ID NO: 322440 - DNA, 15 bp, Homo sapiens
acttgcaaacagtag

SEQ ID NO: 322441 - DNA, 15 bp, Homo sapiens
cttgcaaacagtagt

SEQ ID NO: 322442 - DNA, 15 bp, Homo sapiens
ttgcaaacagtagtg

SEQ ID NO: 322443 - DNA, 15 bp, Homo sapiens
tgcaaacagtagtgt

SEQ ID NO: 322444 - DNA, 15 bp, Homo sapiens
gcaaacagtagtgtg

SEQ ID NO: 322445 - DNA, 15 bp, Homo sapiens
caaacagtagtgtgg

SEQ ID NO: 322446 - DNA, 15 bp, Homo sapiens
aaacagtagtgtggt

SEQ ID NO: 322447 - DNA, 15 bp, Homo sapiens
aacagtagtgtggtc

SEQ ID NO: 322448 - DNA, 15 bp, Homo sapiens
acagtagtgtggtcc

SEQ ID NO: 322449 - DNA, 15 bp, Homo sapiens
cagtagtgtggtcca

SEQ ID NO: 322450 - DNA, 15 bp, Homo sapiens
agtagtgtggtccac

SEQ ID NO: 322451 - DNA, 15 bp, Homo sapiens
gtagtgtggtccacc

SEQ ID NO: 322452 - DNA, 15 bp, Homo sapiens
tagtgtggtccaccc

SEQ ID NO: 322453 - DNA, 15 bp, Homo sapiens
agtgtggtccaccct

SEQ ID NO: 322454 - DNA, 15 bp, Homo sapiens
gtgtggtccaccctt

SEQ ID NO: 322455 - DNA, 15 bp, Homo sapiens
tgtggtccacccttg

SEQ ID NO: 322456 - DNA, 15 bp, Homo sapiens
gtggtccacccttgc

SEQ ID NO: 322457 - DNA, 15 bp, Homo sapiens
tggtccacccttgct

SEQ ID NO: 322458 - DNA, 15 bp, Homo sapiens
ggtccacccttgctt

SEQ ID NO: 322459 - DNA, 15 bp, Homo sapiens
gtccacccttgcttg

SEQ ID NO: 322460 - DNA, 15 bp, Homo sapiens
tccacccttgcttgg

SEQ ID NO: 322461 - DNA, 15 bp, Homo sapiens
ccacccttgcttggg

SEQ ID NO: 322462 - DNA, 15 bp, Homo sapiens
cacccttgcttggga

SEQ ID NO: 322463 - DNA, 15 bp, Homo sapiens
acccttgcttgggaa

SEQ ID NO: 322464 - DNA, 15 bp, Homo sapiens
cccttgcttgggaaa

SEQ ID NO: 322465 - DNA, 15 bp, Homo sapiens
ccttgcttgggaaag

SEQ ID NO: 322466 - DNA, 15 bp, Homo sapiens
cttgcttgggaaaga

SEQ ID NO: 322467 - DNA, 15 bp, Homo sapiens
ttgcttgggaaagag

SEQ ID NO: 322468 - DNA, 15 bp, Homo sapiens
tgcttgggaaagagc

SEQ ID NO: 322469 - DNA, 15 bp, Homo sapiens
gcttgggaaagagcc

SEQ ID NO: 322470 - DNA, 15 bp, Homo sapiens
cttgggaaagagccc

SEQ ID NO: 322471 - DNA, 15 bp, Homo sapiens
ttgggaaagagccca

SEQ ID NO: 322472 - DNA, 15 bp, Homo sapiens
tgggaaagagcccag

SEQ ID NO: 322473 - DNA, 15 bp, Homo sapiens
gggaaagagcccagt

SEQ ID NO: 322474 - DNA, 15 bp, Homo sapiens
ggaaagagcccagtg

SEQ ID NO: 322475 - DNA, 15 bp, Homo sapiens
gaaagagcccagtgc

SEQ ID NO: 322476 - DNA, 15 bp, Homo sapiens
aaagagcccagtgct

SEQ ID NO: 322477 - DNA, 15 bp, Homo sapiens
aagagcccagtgctc

SEQ ID NO: 322478 - DNA, 15 bp, Homo sapiens
agagcccagtgctca

SEQ ID NO: 322479 - DNA, 15 bp, Homo sapiens
gagcccagtgctcat

SEQ ID NO: 322480 - DNA, 15 bp, Homo sapiens
agcccagtgctcatt

SEQ ID NO: 322481 - DNA, 15 bp, Homo sapiens
gcccagtgctcattt

SEQ ID NO: 322482 - DNA, 15 bp, Homo sapiens
cccagtgctcatttg

SEQ ID NO: 322483 - DNA, 15 bp, Homo sapiens
ccagtgctcatttga

SEQ ID NO: 322484 - DNA, 15 bp, Homo sapiens
cagtgctcatttgag

SEQ ID NO: 322485 - DNA, 15 bp, Homo sapiens
agtgctcatttgagc

SEQ ID NO: 322486 - DNA, 15 bp, Homo sapiens
gtgctcatttgagca

SEQ ID NO: 322487 - DNA, 15 bp, Homo sapiens
tgctcatttgagcag

SEQ ID NO: 322488 - DNA, 15 bp, Homo sapiens
gctcatttgagcagt

SEQ ID NO: 322489 - DNA, 15 bp, Homo sapiens
ctcatttgagcagtg

SEQ ID NO: 322490 - DNA, 15 bp, Homo sapiens
tcatttgagcagtga

SEQ ID NO: 322491 - DNA, 15 bp, Homo sapiens
catttgagcagtgag

SEQ ID NO: 322492 - DNA, 15 bp, Homo sapiens
atttgagcagtgagt

SEQ ID NO: 322493 - DNA, 15 bp, Homo sapiens
tttgagcagtgagta

SEQ ID NO: 322494 - DNA, 15 bp, Homo sapiens
ttgagcagtgagtac

SEQ ID NO: 322495 - DNA, 15 bp, Homo sapiens
tgagcagtgagtact

SEQ ID NO: 322496 - DNA, 15 bp, Homo sapiens
gagcagtgagtacta

SEQ ID NO: 322497 - DNA, 15 bp, Homo sapiens
agcagtgagtactag

SEQ ID NO: 322498 - DNA, 15 bp, Homo sapiens
gcagtgagtactagg

SEQ ID NO: 322499 - DNA, 15 bp, Homo sapiens
cagtgagtactagga

SEQ ID NO: 322500 - DNA, 15 bp, Homo sapiens
agtgagtactaggac

SEQ ID NO: 322501 - DNA, 15 bp, Homo sapiens
gtgagtactaggacc

SEQ ID NO: 322502 - DNA, 15 bp, Homo sapiens
tgagtactaggaccc

SEQ ID NO: 322503 - DNA, 15 bp, Homo sapiens
gagtactaggaccct

SEQ ID NO: 322504 - DNA, 15 bp, Homo sapiens
agtactaggaccctg

SEQ ID NO: 322505 - DNA, 15 bp, Homo sapiens
gtactaggaccctgt

SEQ ID NO: 322506 - DNA, 15 bp, Homo sapiens
tactaggaccctgtg

SEQ ID NO: 322507 - DNA, 15 bp, Homo sapiens
actaggaccctgtgc

SEQ ID NO: 322508 - DNA, 15 bp, Homo sapiens
ctaggaccctgtgcc

SEQ ID NO: 322509 - DNA, 15 bp, Homo sapiens
taggaccctgtgcct

SEQ ID NO: 322510 - DNA, 15 bp, Homo sapiens
aggaccctgtgcctc

SEQ ID NO: 322511 - DNA, 15 bp, Homo sapiens
ggaccctgtgcctct

SEQ ID NO: 322512 - DNA, 15 bp, Homo sapiens
gaccctgtgcctcta

SEQ ID NO: 322513 - DNA, 15 bp, Homo sapiens
accctgtgcctctag

SEQ ID NO: 322514 - DNA, 15 bp, Homo sapiens
ccctgtgcctctaga

SEQ ID NO: 322515 - DNA, 15 bp, Homo sapiens
cctgtgcctctagac

SEQ ID NO: 322516 - DNA, 15 bp, Homo sapiens
ctgtgcctctagacc

SEQ ID NO: 322517 - DNA, 15 bp, Homo sapiens
tgtgcctctagaccg

SEQ ID NO: 322518 - DNA, 15 bp, Homo sapiens
gtgcctctagaccgt

SEQ ID NO: 322519 - DNA, 15 bp, Homo sapiens
tgcctctagaccgtg

SEQ ID NO: 322520 - DNA, 15 bp, Homo sapiens
gcctctagaccgtgc

SEQ ID NO: 322521 - DNA, 15 bp, Homo sapiens
cctctagaccgtgct

SEQ ID NO: 322522 - DNA, 15 bp, Homo sapiens
ctctagaccgtgctt

SEQ ID NO: 322523 - DNA, 15 bp, Homo sapiens
tctagaccgtgcttt

SEQ ID NO: 322524 - DNA, 15 bp, Homo sapiens
ctagaccgtgcttta

SEQ ID NO: 322525 - DNA, 15 bp, Homo sapiens
tagaccgtgctttag

SEQ ID NO: 322526 - DNA, 15 bp, Homo sapiens
agaccgtgctttagg

SEQ ID NO: 322527 - DNA, 15 bp, Homo sapiens
gaccgtgctttagga

SEQ ID NO: 322528 - DNA, 15 bp, Homo sapiens
accgtgctttaggac

SEQ ID NO: 322529 - DNA, 15 bp, Homo sapiens
ccgtgctttaggact

SEQ ID NO: 322530 - DNA, 15 bp, Homo sapiens
cgtgctttaggactt

SEQ ID NO: 322531 - DNA, 15 bp, Homo sapiens
gtgctttaggacttg

SEQ ID NO: 322532 - DNA, 15 bp, Homo sapiens
tgctttaggacttgc

SEQ ID NO: 322533 - DNA, 15 bp, Homo sapiens
gctttaggacttgca

SEQ ID NO: 322534 - DNA, 15 bp, Homo sapiens
ctttaggacttgcat

SEQ ID NO: 322535 - DNA, 15 bp, Homo sapiens
tttaggacttgcata

SEQ ID NO: 322536 - DNA, 15 bp, Homo sapiens
ttaggacttgcatat

SEQ ID NO: 322537 - DNA, 15 bp, Homo sapiens
taggacttgcatatc

SEQ ID NO: 322538 - DNA, 15 bp, Homo sapiens
aggacttgcatatcc

SEQ ID NO: 322539 - DNA, 15 bp, Homo sapiens
ggacttgcatatccc

SEQ ID NO: 322540 - DNA, 15 bp, Homo sapiens
gacttgcatatcccc

SEQ ID NO: 322541 - DNA, 15 bp, Homo sapiens
acttgcatatcccct

SEQ ID NO: 322542 - DNA, 15 bp, Homo sapiens
cttgcatatcccctt

SEQ ID NO: 322543 - DNA, 15 bp, Homo sapiens
ttgcatatccccttg

SEQ ID NO: 322544 - DNA, 15 bp, Homo sapiens
tgcatatccccttgg

SEQ ID NO: 322545 - DNA, 15 bp, Homo sapiens
gcatatccccttggt

SEQ ID NO: 322546 - DNA, 15 bp, Homo sapiens
catatccccttggtc

SEQ ID NO: 322547 - DNA, 15 bp, Homo sapiens
atatccccttggtcc

SEQ ID NO: 322548 - DNA, 15 bp, Homo sapiens
tatccccttggtcct

SEQ ID NO: 322549 - DNA, 15 bp, Homo sapiens
atccccttggtcctc

SEQ ID NO: 322550 - DNA, 15 bp, Homo sapiens
tccccttggtcctct

SEQ ID NO: 322551 - DNA, 15 bp, Homo sapiens
ccccttggtcctctg

SEQ ID NO: 322552 - DNA, 15 bp, Homo sapiens
cccttggtcctctga

SEQ ID NO: 322553 - DNA, 15 bp, Homo sapiens
ccttggtcctctgat

SEQ ID NO: 322554 - DNA, 15 bp, Homo sapiens
cttggtcctctgatt

SEQ ID NO: 322555 - DNA, 15 bp, Homo sapiens
ttggtcctctgattt

SEQ ID NO: 322556 - DNA, 15 bp, Homo sapiens
tggtcctctgatttc

SEQ ID NO: 322557 - DNA, 15 bp, Homo sapiens
ggtcctctgatttct

SEQ ID NO: 322558 - DNA, 15 bp, Homo sapiens
gtcctctgatttctc

SEQ ID NO: 322559 - DNA, 15 bp, Homo sapiens
tcctctgatttctct

SEQ ID NO: 322560 - DNA, 15 bp, Homo sapiens
cctctgatttctcta

SEQ ID NO: 322561 - DNA, 15 bp, Homo sapiens
ctctgatttctctat

SEQ ID NO: 322562 - DNA, 15 bp, Homo sapiens
tctgatttctctatt

SEQ ID NO: 322563 - DNA, 15 bp, Homo sapiens
ctgatttctctattt

SEQ ID NO: 322564 - DNA, 15 bp, Homo sapiens
tgatttctctatttc

SEQ ID NO: 322565 - DNA, 15 bp, Homo sapiens
gatttctctatttct

SEQ ID NO: 322566 - DNA, 15 bp, Homo sapiens
atttctctatttctg

SEQ ID NO: 322567 - DNA, 15 bp, Homo sapiens
tttctctatttctgg

SEQ ID NO: 322568 - DNA, 15 bp, Homo sapiens
ttctctatttctggg

SEQ ID NO: 322569 - DNA, 15 bp, Homo sapiens
tctctatttctgggg

SEQ ID NO: 322570 - DNA, 15 bp, Homo sapiens
ctctatttctggggg

SEQ ID NO: 322571 - DNA, 15 bp, Homo sapiens
tctatttctggggga

SEQ ID NO: 322572 - DNA, 15 bp, Homo sapiens
ctatttctgggggag

SEQ ID NO: 322573 - DNA, 15 bp, Homo sapiens
tatttctgggggaga

SEQ ID NO: 322574 - DNA, 15 bp, Homo sapiens
atttctgggggagag

SEQ ID NO: 322575 - DNA, 15 bp, Homo sapiens
tttctgggggagaga

SEQ ID NO: 322576 - DNA, 15 bp, Homo sapiens
ttctgggggagagat

SEQ ID NO: 322577 - DNA, 15 bp, Homo sapiens
tctgggggagagatg

SEQ ID NO: 322578 - DNA, 15 bp, Homo sapiens
ctgggggagagatgg

SEQ ID NO: 322579 - DNA, 15 bp, Homo sapiens
tgggggagagatggg

SEQ ID NO: 322580 - DNA, 15 bp, Homo sapiens
gggggagagatgggg

SEQ ID NO: 322581 - DNA, 15 bp, Homo sapiens
ggggagagatgggga

SEQ ID NO: 322582 - DNA, 15 bp, Homo sapiens
gggagagatggggat

SEQ ID NO: 322583 - DNA, 15 bp, Homo sapiens
ggagagatggggatg

SEQ ID NO: 322584 - DNA, 15 bp, Homo sapiens
gagagatggggatgg

SEQ ID NO: 322585 - DNA, 15 bp, Homo sapiens
agagatggggatgga

SEQ ID NO: 322586 - DNA, 15 bp, Homo sapiens
gagatggggatggaa

SEQ ID NO: 322587 - DNA, 15 bp, Homo sapiens
agatggggatggaag

SEQ ID NO: 322588 - DNA, 15 bp, Homo sapiens
gatggggatggaaga

SEQ ID NO: 322589 - DNA, 15 bp, Homo sapiens
atggggatggaagag

SEQ ID NO: 322590 - DNA, 15 bp, Homo sapiens
tggggatggaagagg

SEQ ID NO: 322591 - DNA, 15 bp, Homo sapiens
ggggatggaagaggg

SEQ ID NO: 322592 - DNA, 15 bp, Homo sapiens
gggatggaagagggt

SEQ ID NO: 322593 - DNA, 15 bp, Homo sapiens
ggatggaagagggta

SEQ ID NO: 322594 - DNA, 15 bp, Homo sapiens
gatggaagagggtag

SEQ ID NO: 322595 - DNA, 15 bp, Homo sapiens
atggaagagggtaga

SEQ ID NO: 322596 - DNA, 15 bp, Homo sapiens
tggaagagggtagag

SEQ ID NO: 322597 - DNA, 15 bp, Homo sapiens
ggaagagggtagagt

SEQ ID NO: 322598 - DNA, 15 bp, Homo sapiens
gaagagggtagagtg

SEQ ID NO: 322599 - DNA, 15 bp, Homo sapiens
aagagggtagagtga

SEQ ID NO: 322600 - DNA, 15 bp, Homo sapiens
agagggtagagtgag

SEQ ID NO: 322601 - DNA, 15 bp, Homo sapiens
gagggtagagtgagg

SEQ ID NO: 322602 - DNA, 15 bp, Homo sapiens
agggtagagtgaggc

SEQ ID NO: 322603 - DNA, 15 bp, Homo sapiens
gggtagagtgaggcc

SEQ ID NO: 322604 - DNA, 15 bp, Homo sapiens
ggtagagtgaggccc

SEQ ID NO: 322605 - DNA, 15 bp, Homo sapiens
gtagagtgaggccct

SEQ ID NO: 322606 - DNA, 15 bp, Homo sapiens
tagagtgaggccctc

SEQ ID NO: 322607 - DNA, 15 bp, Homo sapiens
agagtgaggccctct

SEQ ID NO: 322608 - DNA, 15 bp, Homo sapiens
gagtgaggccctcta

SEQ ID NO: 322609 - DNA, 15 bp, Homo sapiens
agtgaggccctctaa

SEQ ID NO: 322610 - DNA, 15 bp, Homo sapiens
gtgaggccctctaaa

SEQ ID NO: 322611 - DNA, 15 bp, Homo sapiens
tgaggccctctaaaa

SEQ ID NO: 322612 - DNA, 15 bp, Homo sapiens
gaggccctctaaaag

SEQ ID NO: 322613 - DNA, 15 bp, Homo sapiens
aggccctctaaaagt

SEQ ID NO: 322614 - DNA, 15 bp, Homo sapiens
ggccctctaaaagtc

SEQ ID NO: 322615 - DNA, 15 bp, Homo sapiens
gccctctaaaagtca

SEQ ID NO: 322616 - DNA, 15 bp, Homo sapiens
ccctctaaaagtcag

SEQ ID NO: 322617 - DNA, 15 bp, Homo sapiens
cctctaaaagtcagg

SEQ ID NO: 322618 - DNA, 15 bp, Homo sapiens
ctctaaaagtcagga

SEQ ID NO: 322619 - DNA, 15 bp, Homo sapiens
tctaaaagtcaggat

SEQ ID NO: 322620 - DNA, 15 bp, Homo sapiens
ctaaaagtcaggatt

SEQ ID NO: 322621 - DNA, 15 bp, Homo sapiens
taaaagtcaggattt

SEQ ID NO: 322622 - DNA, 15 bp, Homo sapiens
aaaagtcaggattta

SEQ ID NO: 322623 - DNA, 15 bp, Homo sapiens
aaagtcaggatttaa

SEQ ID NO: 322624 - DNA, 15 bp, Homo sapiens
aagtcaggatttaag

SEQ ID NO: 322625 - DNA, 15 bp, Homo sapiens
agtcaggatttaagg

SEQ ID NO: 322626 - DNA, 15 bp, Homo sapiens
gtcaggatttaaggc

SEQ ID NO: 322627 - DNA, 15 bp, Homo sapiens
tcaggatttaaggca

SEQ ID NO: 322628 - DNA, 15 bp, Homo sapiens
caggatttaaggcaa

SEQ ID NO: 322629 - DNA, 15 bp, Homo sapiens
aggatttaaggcaag

SEQ ID NO: 322630 - DNA, 15 bp, Homo sapiens
ggatttaaggcaagg

SEQ ID NO: 322631 - DNA, 15 bp, Homo sapiens
gatttaaggcaaggt

SEQ ID NO: 322632 - DNA, 15 bp, Homo sapiens
atttaaggcaaggtc

SEQ ID NO: 322633 - DNA, 15 bp, Homo sapiens
tttaaggcaaggtcc

SEQ ID NO: 322634 - DNA, 15 bp, Homo sapiens
ttaaggcaaggtcct

SEQ ID NO: 322635 - DNA, 15 bp, Homo sapiens
taaggcaaggtcctt

SEQ ID NO: 322636 - DNA, 15 bp, Homo sapiens
aaggcaaggtccttg

SEQ ID NO: 322637 - DNA, 15 bp, Homo sapiens
aggcaaggtccttgc

SEQ ID NO: 322638 - DNA, 15 bp, Homo sapiens
ggcaaggtccttgct

SEQ ID NO: 322639 - DNA, 15 bp, Homo sapiens
gcaaggtccttgctt

SEQ ID NO: 322640 - DNA, 15 bp, Homo sapiens
caaggtccttgcttg

SEQ ID NO: 322641 - DNA, 15 bp, Homo sapiens
aaggtccttgcttgt

SEQ ID NO: 322642 - DNA, 15 bp, Homo sapiens
aggtccttgcttgtc

SEQ ID NO: 322643 - DNA, 15 bp, Homo sapiens
ggtccttgcttgtct

SEQ ID NO: 322644 - DNA, 15 bp, Homo sapiens
gtccttgcttgtcta

SEQ ID NO: 322645 - DNA, 15 bp, Homo sapiens
tccttgcttgtctag

SEQ ID NO: 322646 - DNA, 15 bp, Homo sapiens
ccttgcttgtctagg

SEQ ID NO: 322647 - DNA, 15 bp, Homo sapiens
cttgcttgtctaggt

SEQ ID NO: 322648 - DNA, 15 bp, Homo sapiens
ttgcttgtctaggtc

SEQ ID NO: 322649 - DNA, 15 bp, Homo sapiens
tgcttgtctaggtct

SEQ ID NO: 322650 - DNA, 15 bp, Homo sapiens
gcttgtctaggtcta

SEQ ID NO: 322651 - DNA, 15 bp, Homo sapiens
cttgtctaggtctac

SEQ ID NO: 322652 - DNA, 15 bp, Homo sapiens
ttgtctaggtctaca

SEQ ID NO: 322653 - DNA, 15 bp, Homo sapiens
tgtctaggtctacag

SEQ ID NO: 322654 - DNA, 15 bp, Homo sapiens
gtctaggtctacagg

SEQ ID NO: 322655 - DNA, 15 bp, Homo sapiens
tctaggtctacaggt

SEQ ID NO: 322656 - DNA, 15 bp, Homo sapiens
ctaggtctacaggtg

SEQ ID NO: 322657 - DNA, 15 bp, Homo sapiens
taggtctacaggtga

SEQ ID NO: 322658 - DNA, 15 bp, Homo sapiens
aggtctacaggtgat

SEQ ID NO: 322659 - DNA, 15 bp, Homo sapiens
ggtctacaggtgatg

SEQ ID NO: 322660 - DNA, 15 bp, Homo sapiens
gtctacaggtgatgc

SEQ ID NO: 322661 - DNA, 15 bp, Homo sapiens
tctacaggtgatgct

SEQ ID NO: 322662 - DNA, 15 bp, Homo sapiens
ctacaggtgatgcta

SEQ ID NO: 322663 - DNA, 15 bp, Homo sapiens
tacaggtgatgctac

SEQ ID NO: 322664 - DNA, 15 bp, Homo sapiens
acaggtgatgctaca

SEQ ID NO: 322665 - DNA, 15 bp, Homo sapiens
caggtgatgctacaa

SEQ ID NO: 322666 - DNA, 15 bp, Homo sapiens
aggtgatgctacaaa

SEQ ID NO: 322667 - DNA, 15 bp, Homo sapiens
ggtgatgctacaaag

SEQ ID NO: 322668 - DNA, 15 bp, Homo sapiens
gtgatgctacaaaga

SEQ ID NO: 322669 - DNA, 15 bp, Homo sapiens
tgatgctacaaagag

SEQ ID NO: 322670 - DNA, 15 bp, Homo sapiens
gatgctacaaagaga

SEQ ID NO: 322671 - DNA, 15 bp, Homo sapiens
atgctacaaagagaa

SEQ ID NO: 322672 - DNA, 15 bp, Homo sapiens
tgctacaaagagaat

SEQ ID NO: 322673 - DNA, 15 bp, Homo sapiens
gctacaaagagaatg

SEQ ID NO: 322674 - DNA, 15 bp, Homo sapiens
ctacaaagagaatgt

SEQ ID NO: 322675 - DNA, 15 bp, Homo sapiens
tacaaagagaatgtt

SEQ ID NO: 322676 - DNA, 15 bp, Homo sapiens
acaaagagaatgtta

SEQ ID NO: 322677 - DNA, 15 bp, Homo sapiens
caaagagaatgttac

SEQ ID NO: 322678 - DNA, 15 bp, Homo sapiens
aaagagaatgttaca

SEQ ID NO: 322679 - DNA, 15 bp, Homo sapiens
aagagaatgttacat

SEQ ID NO: 322680 - DNA, 15 bp, Homo sapiens
agagaatgttacatt

SEQ ID NO: 322681 - DNA, 15 bp, Homo sapiens
gagaatgttacattg

SEQ ID NO: 322682 - DNA, 15 bp, Homo sapiens
agaatgttacattga

SEQ ID NO: 322683 - DNA, 15 bp, Homo sapiens
gaatgttacattgat

SEQ ID NO: 322684 - DNA, 15 bp, Homo sapiens
aatgttacattgatt

SEQ ID NO: 322685 - DNA, 15 bp, Homo sapiens
atgttacattgattc

SEQ ID NO: 322686 - DNA, 15 bp, Homo sapiens
tgttacattgattca

SEQ ID NO: 322687 - DNA, 15 bp, Homo sapiens
gttacattgattcag

SEQ ID NO: 322688 - DNA, 15 bp, Homo sapiens
ttacattgattcagt

SEQ ID NO: 322689 - DNA, 15 bp, Homo sapiens
tacattgattcagtt

SEQ ID NO: 322690 - DNA, 15 bp, Homo sapiens
acattgattcagttc

SEQ ID NO: 322691 - DNA, 15 bp, Homo sapiens
cattgattcagttct

SEQ ID NO: 322692 - DNA, 15 bp, Homo sapiens
attgattcagttctt

SEQ ID NO: 322693 - DNA, 15 bp, Homo sapiens
ttgattcagttctta

SEQ ID NO: 322694 - DNA, 15 bp, Homo sapiens
tgattcagttcttaa

SEQ ID NO: 322695 - DNA, 15 bp, Homo sapiens
gattcagttcttaaa

SEQ ID NO: 322696 - DNA, 15 bp, Homo sapiens
attcagttcttaaaa

SEQ ID NO: 322697 - DNA, 15 bp, Homo sapiens
ttcagttcttaaaat

SEQ ID NO: 322698 - DNA, 15 bp, Homo sapiens
tcagttcttaaaatt

SEQ ID NO: 322699 - DNA, 15 bp, Homo sapiens
cagttcttaaaattt

SEQ ID NO: 322700 - DNA, 15 bp, Homo sapiens
agttcttaaaatttt

SEQ ID NO: 322701 - DNA, 15 bp, Homo sapiens
gttcttaaaattttc

SEQ ID NO: 322702 - DNA, 15 bp, Homo sapiens
ttcttaaaattttcc

SEQ ID NO: 322703 - DNA, 15 bp, Homo sapiens
tcttaaaattttccc

SEQ ID NO: 322704 - DNA, 15 bp, Homo sapiens
cttaaaattttccct

SEQ ID NO: 322705 - DNA, 15 bp, Homo sapiens
ttaaaattttccctt

SEQ ID NO: 322706 - DNA, 15 bp, Homo sapiens
taaaattttcccttt

SEQ ID NO: 322707 - DNA, 15 bp, Homo sapiens
aaaattttccctttt

SEQ ID NO: 322708 - DNA, 15 bp, Homo sapiens
aaattttcccttttc

SEQ ID NO: 322709 - DNA, 15 bp, Homo sapiens
aattttcccttttcc

SEQ ID NO: 322710 - DNA, 15 bp, Homo sapiens
attttcccttttcct

SEQ ID NO: 322711 - DNA, 15 bp, Homo sapiens
ttttcccttttcctc

SEQ ID NO: 322712 - DNA, 15 bp, Homo sapiens
tttcccttttcctca

SEQ ID NO: 322713 - DNA, 15 bp, Homo sapiens
ttcccttttcctcat

SEQ ID NO: 322714 - DNA, 15 bp, Homo sapiens
tcccttttcctcatg

SEQ ID NO: 322715 - DNA, 15 bp, Homo sapiens
cccttttcctcatgc

SEQ ID NO: 322716 - DNA, 15 bp, Homo sapiens
ccttttcctcatgct

SEQ ID NO: 322717 - DNA, 15 bp, Homo sapiens
cttttcctcatgctt

SEQ ID NO: 322718 - DNA, 15 bp, Homo sapiens
ttttcctcatgcttc

SEQ ID NO: 322719 - DNA, 15 bp, Homo sapiens
tttcctcatgcttct

SEQ ID NO: 322720 - DNA, 15 bp, Homo sapiens
ttcctcatgcttctg

SEQ ID NO: 322721 - DNA, 15 bp, Homo sapiens
tcctcatgcttctgt

SEQ ID NO: 322722 - DNA, 15 bp, Homo sapiens
cctcatgcttctgtt

SEQ ID NO: 322723 - DNA, 15 bp, Homo sapiens
ctcatgcttctgttt

SEQ ID NO: 322724 - DNA, 15 bp, Homo sapiens
tcatgcttctgtttc

SEQ ID NO: 322725 - DNA, 15 bp, Homo sapiens
catgcttctgtttca

SEQ ID NO: 322726 - DNA, 15 bp, Homo sapiens
atgcttctgtttcat

SEQ ID NO: 322727 - DNA, 15 bp, Homo sapiens
tgcttctgtttcatt

SEQ ID NO: 322728 - DNA, 15 bp, Homo sapiens
gcttctgtttcatta

SEQ ID NO: 322729 - DNA, 15 bp, Homo sapiens
cttctgtttcattaa

SEQ ID NO: 322730 - DNA, 15 bp, Homo sapiens
ttctgtttcattaat

SEQ ID NO: 322731 - DNA, 15 bp, Homo sapiens
tctgtttcattaata

SEQ ID NO: 322732 - DNA, 15 bp, Homo sapiens
ctgtttcattaatat

SEQ ID NO: 322733 - DNA, 15 bp, Homo sapiens
tgtttcattaatatt

SEQ ID NO: 322734 - DNA, 15 bp, Homo sapiens
gtttcattaatattc

SEQ ID NO: 322735 - DNA, 15 bp, Homo sapiens
tttcattaatattca

SEQ ID NO: 322736 - DNA, 15 bp, Homo sapiens
ttcattaatattcat

SEQ ID NO: 322737 - DNA, 15 bp, Homo sapiens
tcattaatattcata

SEQ ID NO: 322738 - DNA, 15 bp, Homo sapiens
cattaatattcatat

SEQ ID NO: 322739 - DNA, 15 bp, Homo sapiens
attaatattcatatt

SEQ ID NO: 322740 - DNA, 15 bp, Homo sapiens
ttaatattcatattt

SEQ ID NO: 322741 - DNA, 15 bp, Homo sapiens
taatattcatattta

SEQ ID NO: 322742 - DNA, 15 bp, Homo sapiens
aatattcatatttac

SEQ ID NO: 322743 - DNA, 15 bp, Homo sapiens
atattcatatttact

SEQ ID NO: 322744 - DNA, 15 bp, Homo sapiens
tattcatatttactt

SEQ ID NO: 322745 - DNA, 15 bp, Homo sapiens
attcatatttacttt

SEQ ID NO: 322746 - DNA, 15 bp, Homo sapiens
ttcatatttactttt

SEQ ID NO: 322747 - DNA, 15 bp, Homo sapiens
tcatatttacttttt

SEQ ID NO: 322748 - DNA, 15 bp, Homo sapiens
catatttacttttta

SEQ ID NO: 322749 - DNA, 15 bp, Homo sapiens
atatttactttttat

SEQ ID NO: 322750 - DNA, 15 bp, Homo sapiens
tatttactttttata

SEQ ID NO: 322751 - DNA, 15 bp, Homo sapiens
atttactttttataa

SEQ ID NO: 322752 - DNA, 15 bp, Homo sapiens
tttactttttataat

SEQ ID NO: 322753 - DNA, 15 bp, Homo sapiens
ttactttttataata

SEQ ID NO: 322754 - DNA, 15 bp, Homo sapiens
tactttttataatat

SEQ ID NO: 322755 - DNA, 15 bp, Homo sapiens
actttttataatata

SEQ ID NO: 322756 - DNA, 15 bp, Homo sapiens
ctttttataatatac

SEQ ID NO: 322757 - DNA, 15 bp, Homo sapiens
tttttataatataca

SEQ ID NO: 322758 - DNA, 15 bp, Homo sapiens
ttttataatatacat

SEQ ID NO: 322759 - DNA, 15 bp, Homo sapiens
tttataatatacatg

SEQ ID NO: 322760 - DNA, 15 bp, Homo sapiens
ttataatatacatgt

SEQ ID NO: 322761 - DNA, 15 bp, Homo sapiens
tataatatacatgtt

SEQ ID NO: 322762 - DNA, 15 bp, Homo sapiens
ataatatacatgtta

SEQ ID NO: 322763 - DNA, 15 bp, Homo sapiens
taatatacatgttat

SEQ ID NO: 322764 - DNA, 15 bp, Homo sapiens
aatatacatgttatg

SEQ ID NO: 322765 - DNA, 15 bp, Homo sapiens
atatacatgttatgt

SEQ ID NO: 322766 - DNA, 15 bp, Homo sapiens
tatacatgttatgtc

SEQ ID NO: 322767 - DNA, 15 bp, Homo sapiens
atacatgttatgtct

SEQ ID NO: 322768 - DNA, 15 bp, Homo sapiens
tacatgttatgtctt

SEQ ID NO: 322769 - DNA, 15 bp, Homo sapiens
acatgttatgtcttt

SEQ ID NO: 322770 - DNA, 15 bp, Homo sapiens
catgttatgtcttta

SEQ ID NO: 322771 - DNA, 15 bp, Homo sapiens
atgttatgtctttaa

SEQ ID NO: 322772 - DNA, 15 bp, Homo sapiens
tgttatgtctttaat

SEQ ID NO: 322773 - DNA, 15 bp, Homo sapiens
gttatgtctttaata

SEQ ID NO: 322774 - DNA, 15 bp, Homo sapiens
ttatgtctttaatac

SEQ ID NO: 322775 - DNA, 15 bp, Homo sapiens
tatgtctttaataca

SEQ ID NO: 322776 - DNA, 15 bp, Homo sapiens
atgtctttaatacac

SEQ ID NO: 322777 - DNA, 15 bp, Homo sapiens
tgtctttaatacact

SEQ ID NO: 322778 - DNA, 15 bp, Homo sapiens
gtctttaatacacta

SEQ ID NO: 322779 - DNA, 15 bp, Homo sapiens
tctttaatacactag

SEQ ID NO: 322780 - DNA, 15 bp, Homo sapiens
ctttaatacactagg

SEQ ID NO: 322781 - DNA, 15 bp, Homo sapiens
tttaatacactagga

SEQ ID NO: 322782 - DNA, 15 bp, Homo sapiens
ttaatacactaggag

SEQ ID NO: 322783 - DNA, 15 bp, Homo sapiens
taatacactaggagt

SEQ ID NO: 322784 - DNA, 15 bp, Homo sapiens
aatacactaggagta

SEQ ID NO: 322785 - DNA, 15 bp, Homo sapiens
atacactaggagtag

SEQ ID NO: 322786 - DNA, 15 bp, Homo sapiens
tacactaggagtaga

SEQ ID NO: 322787 - DNA, 15 bp, Homo sapiens
acactaggagtagaa

SEQ ID NO: 322788 - DNA, 15 bp, Homo sapiens
cactaggagtagaat

SEQ ID NO: 322789 - DNA, 15 bp, Homo sapiens
actaggagtagaata

SEQ ID NO: 322790 - DNA, 15 bp, Homo sapiens
ctaggagtagaatat

SEQ ID NO: 322791 - DNA, 15 bp, Homo sapiens
taggagtagaatatt

SEQ ID NO: 322792 - DNA, 15 bp, Homo sapiens
aggagtagaatattt

SEQ ID NO: 322793 - DNA, 15 bp, Homo sapiens
ggagtagaatatttg

SEQ ID NO: 322794 - DNA, 15 bp, Homo sapiens
gagtagaatatttgt

SEQ ID NO: 322795 - DNA, 15 bp, Homo sapiens
agtagaatatttgta

SEQ ID NO: 322796 - DNA, 15 bp, Homo sapiens
gtagaatatttgtaa

SEQ ID NO: 322797 - DNA, 15 bp, Homo sapiens
tagaatatttgtaat

SEQ ID NO: 322798 - DNA, 15 bp, Homo sapiens
agaatatttgtaatg

SEQ ID NO: 322799 - DNA, 15 bp, Homo sapiens
gaatatttgtaatga

SEQ ID NO: 322800 - DNA, 15 bp, Homo sapiens
aatatttgtaatgaa

SEQ ID NO: 322801 - DNA, 15 bp, Homo sapiens
atatttgtaatgaaa

SEQ ID NO: 322802 - DNA, 15 bp, Homo sapiens
tatttgtaatgaaat

SEQ ID NO: 322803 - DNA, 15 bp, Homo sapiens
atttgtaatgaaatg

SEQ ID NO: 322804 - DNA, 15 bp, Homo sapiens
tttgtaatgaaatgg

SEQ ID NO: 322805 - DNA, 15 bp, Homo sapiens
ttgtaatgaaatgga

SEQ ID NO: 322806 - DNA, 15 bp, Homo sapiens
tgtaatgaaatggag

SEQ ID NO: 322807 - DNA, 15 bp, Homo sapiens
gtaatgaaatggagt

SEQ ID NO: 322808 - DNA, 15 bp, Homo sapiens
taatgaaatggagtg

SEQ ID NO: 322809 - DNA, 15 bp, Homo sapiens
aatgaaatggagtgc

SEQ ID NO: 322810 - DNA, 15 bp, Homo sapiens
atgaaatggagtgct

SEQ ID NO: 322811 - DNA, 15 bp, Homo sapiens
tgaaatggagtgctg

SEQ ID NO: 322812 - DNA, 15 bp, Homo sapiens
gaaatggagtgctgt

SEQ ID NO: 322813 - DNA, 15 bp, Homo sapiens
aaatggagtgctgtt

SEQ ID NO: 322814 - DNA, 15 bp, Homo sapiens
aatggagtgctgttt

SEQ ID NO: 322815 - DNA, 15 bp, Homo sapiens
atggagtgctgtttt

SEQ ID NO: 322816 - DNA, 15 bp, Homo sapiens
tggagtgctgtttta

SEQ ID NO: 322817 - DNA, 15 bp, Homo sapiens
ggagtgctgttttaa

SEQ ID NO: 322818 - DNA, 15 bp, Homo sapiens
gagtgctgttttaat

SEQ ID NO: 322819 - DNA, 15 bp, Homo sapiens
agtgctgttttaatg

SEQ ID NO: 322820 - DNA, 15 bp, Homo sapiens
gtgctgttttaatgg

SEQ ID NO: 322821 - DNA, 15 bp, Homo sapiens
tgctgttttaatgga

SEQ ID NO: 322822 - DNA, 15 bp, Homo sapiens
gctgttttaatggat

SEQ ID NO: 322823 - DNA, 15 bp, Homo sapiens
ctgttttaatggatg

SEQ ID NO: 322824 - DNA, 15 bp, Homo sapiens
tgttttaatggatga

SEQ ID NO: 322825 - DNA, 15 bp, Homo sapiens
gttttaatggatgag

SEQ ID NO: 322826 - DNA, 15 bp, Homo sapiens
ttttaatggatgaga

SEQ ID NO: 322827 - DNA, 15 bp, Homo sapiens
tttaatggatgagaa

SEQ ID NO: 322828 - DNA, 15 bp, Homo sapiens
ttaatggatgagaaa

SEQ ID NO: 322829 - DNA, 15 bp, Homo sapiens
taatggatgagaaag

SEQ ID NO: 322830 - DNA, 15 bp, Homo sapiens
aatggatgagaaagg

SEQ ID NO: 322831 - DNA, 15 bp, Homo sapiens
atggatgagaaaggt

SEQ ID NO: 322832 - DNA, 15 bp, Homo sapiens
tggatgagaaaggta

SEQ ID NO: 322833 - DNA, 15 bp, Homo sapiens
ggatgagaaaggtag

SEQ ID NO: 322834 - DNA, 15 bp, Homo sapiens
gatgagaaaggtagg

SEQ ID NO: 322835 - DNA, 15 bp, Homo sapiens
atgagaaaggtaggg

SEQ ID NO: 322836 - DNA, 15 bp, Homo sapiens
tgagaaaggtaggga

SEQ ID NO: 322837 - DNA, 15 bp, Homo sapiens
gagaaaggtagggag

SEQ ID NO: 322838 - DNA, 15 bp, Homo sapiens
agaaaggtagggagg

SEQ ID NO: 322839 - DNA, 15 bp, Homo sapiens
gaaaggtagggaggg

SEQ ID NO: 322840 - DNA, 15 bp, Homo sapiens
aaaggtagggagggg

SEQ ID NO: 322841 - DNA, 15 bp, Homo sapiens
aaggtagggaggggc

SEQ ID NO: 322842 - DNA, 15 bp, Homo sapiens
aggtagggaggggct

SEQ ID NO: 322843 - DNA, 15 bp, Homo sapiens
ggtagggaggggctc

SEQ ID NO: 322844 - DNA, 15 bp, Homo sapiens
gtagggaggggctca

SEQ ID NO: 322845 - DNA, 15 bp, Homo sapiens
tagggaggggctcag

SEQ ID NO: 322846 - DNA, 15 bp, Homo sapiens
agggaggggctcaga

SEQ ID NO: 322847 - DNA, 15 bp, Homo sapiens
gggaggggctcagag

SEQ ID NO: 322848 - DNA, 15 bp, Homo sapiens
ggaggggctcagaga

SEQ ID NO: 322849 - DNA, 15 bp, Homo sapiens
gaggggctcagagag

SEQ ID NO: 322850 - DNA, 15 bp, Homo sapiens
aggggctcagagagg

SEQ ID NO: 322851 - DNA, 15 bp, Homo sapiens
ggggctcagagaggg

SEQ ID NO: 322852 - DNA, 15 bp, Homo sapiens
gggctcagagaggga

SEQ ID NO: 322853 - DNA, 15 bp, Homo sapiens
ggctcagagagggag

SEQ ID NO: 322854 - DNA, 15 bp, Homo sapiens
gctcagagagggagg

SEQ ID NO: 322855 - DNA, 15 bp, Homo sapiens
ctcagagagggaggc

SEQ ID NO: 322856 - DNA, 15 bp, Homo sapiens
tcagagagggaggct

SEQ ID NO: 322857 - DNA, 15 bp, Homo sapiens
cagagagggaggctg

SEQ ID NO: 322858 - DNA, 15 bp, Homo sapiens
agagagggaggctgg

SEQ ID NO: 322859 - DNA, 15 bp, Homo sapiens
gagagggaggctgga

SEQ ID NO: 322860 - DNA, 15 bp, Homo sapiens
agagggaggctggag

SEQ ID NO: 322861 - DNA, 15 bp, Homo sapiens
gagggaggctggaga

SEQ ID NO: 322862 - DNA, 15 bp, Homo sapiens
agggaggctggagaa

SEQ ID NO: 322863 - DNA, 15 bp, Homo sapiens
gggaggctggagaat

SEQ ID NO: 322864 - DNA, 15 bp, Homo sapiens
ggaggctggagaata

SEQ ID NO: 322865 - DNA, 15 bp, Homo sapiens
gaggctggagaatat

SEQ ID NO: 322866 - DNA, 15 bp, Homo sapiens
aggctggagaatatt

SEQ ID NO: 322867 - DNA, 15 bp, Homo sapiens
ggctggagaatattc

SEQ ID NO: 322868 - DNA, 15 bp, Homo sapiens
gctggagaatattca

SEQ ID NO: 322869 - DNA, 15 bp, Homo sapiens
ctggagaatattcac

SEQ ID NO: 322870 - DNA, 15 bp, Homo sapiens
tggagaatattcact

SEQ ID NO: 322871 - DNA, 15 bp, Homo sapiens
ggagaatattcactt

SEQ ID NO: 322872 - DNA, 15 bp, Homo sapiens
gagaatattcactta

SEQ ID NO: 322873 - DNA, 15 bp, Homo sapiens
agaatattcacttat

SEQ ID NO: 322874 - DNA, 15 bp, Homo sapiens
gaatattcacttatt

SEQ ID NO: 322875 - DNA, 15 bp, Homo sapiens
aatattcacttattt

SEQ ID NO: 322876 - DNA, 15 bp, Homo sapiens
atattcacttattta

SEQ ID NO: 322877 - DNA, 15 bp, Homo sapiens
tattcacttatttag

SEQ ID NO: 322878 - DNA, 15 bp, Homo sapiens
attcacttatttagc

SEQ ID NO: 322879 - DNA, 15 bp, Homo sapiens
ttcacttatttagct

SEQ ID NO: 322880 - DNA, 15 bp, Homo sapiens
tcacttatttagctt

SEQ ID NO: 322881 - DNA, 15 bp, Homo sapiens
cacttatttagctta

SEQ ID NO: 322882 - DNA, 15 bp, Homo sapiens
acttatttagcttaa

SEQ ID NO: 322883 - DNA, 15 bp, Homo sapiens
cttatttagcttaat

SEQ ID NO: 322884 - DNA, 15 bp, Homo sapiens
ttatttagcttaatg

SEQ ID NO: 322885 - DNA, 15 bp, Homo sapiens
tatttagcttaatgt

SEQ ID NO: 322886 - DNA, 15 bp, Homo sapiens
atttagcttaatgtt

SEQ ID NO: 322887 - DNA, 15 bp, Homo sapiens
tttagcttaatgttt

SEQ ID NO: 322888 - DNA, 15 bp, Homo sapiens
ttagcttaatgtttt

SEQ ID NO: 322889 - DNA, 15 bp, Homo sapiens
tagcttaatgttttc

SEQ ID NO: 322890 - DNA, 15 bp, Homo sapiens
agcttaatgttttca

SEQ ID NO: 322891 - DNA, 15 bp, Homo sapiens
gcttaatgttttcaa

SEQ ID NO: 322892 - DNA, 15 bp, Homo sapiens
cttaatgttttcaac

SEQ ID NO: 322893 - DNA, 15 bp, Homo sapiens
ttaatgttttcaaca

SEQ ID NO: 322894 - DNA, 15 bp, Homo sapiens
taatgttttcaacag

SEQ ID NO: 322895 - DNA, 15 bp, Homo sapiens
aatgttttcaacagc

SEQ ID NO: 322896 - DNA, 15 bp, Homo sapiens
atgttttcaacagct

SEQ ID NO: 322897 - DNA, 15 bp, Homo sapiens
tgttttcaacagctt

SEQ ID NO: 322898 - DNA, 15 bp, Homo sapiens
gttttcaacagctta

SEQ ID NO: 322899 - DNA, 15 bp, Homo sapiens
ttttcaacagcttaa

SEQ ID NO: 322900 - DNA, 15 bp, Homo sapiens
tttcaacagcttaaa

SEQ ID NO: 322901 - DNA, 15 bp, Homo sapiens
ttcaacagcttaaaa

SEQ ID NO: 322902 - DNA, 15 bp, Homo sapiens
tcaacagcttaaaaa

SEQ ID NO: 322903 - DNA, 15 bp, Homo sapiens
caacagcttaaaaaa

SEQ ID NO: 322904 - DNA, 15 bp, Homo sapiens
aacagcttaaaaaaa

SEQ ID NO: 322905 - DNA, 15 bp, Homo sapiens
acagcttaaaaaaag

SEQ ID NO: 322906 - DNA, 15 bp, Homo sapiens
cagcttaaaaaaaga

SEQ ID NO: 322907 - DNA, 15 bp, Homo sapiens
agcttaaaaaaagag

SEQ ID NO: 322908 - DNA, 15 bp, Homo sapiens
gcttaaaaaaagaga

SEQ ID NO: 322909 - DNA, 15 bp, Homo sapiens
cttaaaaaaagagaa

SEQ ID NO: 322910 - DNA, 15 bp, Homo sapiens
ttaaaaaaagagaaa

SEQ ID NO: 322911 - DNA, 15 bp, Homo sapiens
taaaaaaagagaaaa

SEQ ID NO: 322912 - DNA, 15 bp, Homo sapiens
aaaaaaagagaaaaa

SEQ ID NO: 322913 - DNA, 15 bp, Homo sapiens
aaaaaagagaaaaaa

SEQ ID NO: 322914 - DNA, 15 bp, Homo sapiens
aaaaagagaaaaaac

SEQ ID NO: 322915 - DNA, 15 bp, Homo sapiens
aaaagagaaaaaaca

SEQ ID NO: 322916 - DNA, 15 bp, Homo sapiens
aaagagaaaaaacaa

SEQ ID NO: 322917 - DNA, 15 bp, Homo sapiens
aagagaaaaaacaac

SEQ ID NO: 322918 - DNA, 15 bp, Homo sapiens
agagaaaaaacaacc

SEQ ID NO: 322919 - DNA, 15 bp, Homo sapiens
gagaaaaaacaacct

SEQ ID NO: 322920 - DNA, 15 bp, Homo sapiens
agaaaaaacaacctt

SEQ ID NO: 322921 - DNA, 15 bp, Homo sapiens
gaaaaaacaaccttt

SEQ ID NO: 322922 - DNA, 15 bp, Homo sapiens
aaaaaacaacctttg

SEQ ID NO: 322923 - DNA, 15 bp, Homo sapiens
aaaaacaacctttga

SEQ ID NO: 322924 - DNA, 15 bp, Homo sapiens
aaaacaacctttgag

SEQ ID NO: 322925 - DNA, 15 bp, Homo sapiens
aaacaacctttgagt

SEQ ID NO: 322926 - DNA, 15 bp, Homo sapiens
aacaacctttgagtg

SEQ ID NO: 322927 - DNA, 15 bp, Homo sapiens
acaacctttgagtgg

SEQ ID NO: 322928 - DNA, 15 bp, Homo sapiens
caacctttgagtggc

SEQ ID NO: 322929 - DNA, 15 bp, Homo sapiens
aacctttgagtggcc

SEQ ID NO: 322930 - DNA, 15 bp, Homo sapiens
acctttgagtggccc

SEQ ID NO: 322931 - DNA, 15 bp, Homo sapiens
cctttgagtggccct

SEQ ID NO: 322932 - DNA, 15 bp, Homo sapiens
ctttgagtggccctt

SEQ ID NO: 322933 - DNA, 15 bp, Homo sapiens
tttgagtggcccttg

SEQ ID NO: 322934 - DNA, 15 bp, Homo sapiens
ttgagtggcccttgt

SEQ ID NO: 322935 - DNA, 15 bp, Homo sapiens
tgagtggcccttgtg

SEQ ID NO: 322936 - DNA, 15 bp, Homo sapiens
gagtggcccttgtga

SEQ ID NO: 322937 - DNA, 15 bp, Homo sapiens
agtggcccttgtgat

SEQ ID NO: 322938 - DNA, 15 bp, Homo sapiens
gtggcccttgtgatt

SEQ ID NO: 322939 - DNA, 15 bp, Homo sapiens
tggcccttgtgatta

SEQ ID NO: 322940 - DNA, 15 bp, Homo sapiens
ggcccttgtgattaa

SEQ ID NO: 322941 - DNA, 15 bp, Homo sapiens
gcccttgtgattaaa

SEQ ID NO: 322942 - DNA, 15 bp, Homo sapiens
cccttgtgattaaat

SEQ ID NO: 322943 - DNA, 15 bp, Homo sapiens
ccttgtgattaaatg

SEQ ID NO: 322944 - DNA, 15 bp, Homo sapiens
cttgtgattaaatgg

SEQ ID NO: 322945 - DNA, 15 bp, Homo sapiens
ttgtgattaaatggc

SEQ ID NO: 322946 - DNA, 15 bp, Homo sapiens
tgtgattaaatggca

SEQ ID NO: 322947 - DNA, 15 bp, Homo sapiens
gtgattaaatggcag

SEQ ID NO: 322948 - DNA, 15 bp, Homo sapiens
tgattaaatggcagt

SEQ ID NO: 322949 - DNA, 15 bp, Homo sapiens
gattaaatggcagtt

SEQ ID NO: 322950 - DNA, 15 bp, Homo sapiens
attaaatggcagttt

SEQ ID NO: 322951 - DNA, 15 bp, Homo sapiens
ttaaatggcagtttg

SEQ ID NO: 322952 - DNA, 15 bp, Homo sapiens
taaatggcagtttgc

SEQ ID NO: 322953 - DNA, 15 bp, Homo sapiens
aaatggcagtttgcc

SEQ ID NO: 322954 - DNA, 15 bp, Homo sapiens
aatggcagtttgccc

SEQ ID NO: 322955 - DNA, 15 bp, Homo sapiens
atggcagtttgccca

SEQ ID NO: 322956 - DNA, 15 bp, Homo sapiens
tggcagtttgcccag

SEQ ID NO: 322957 - DNA, 15 bp, Homo sapiens
ggcagtttgcccaga

SEQ ID NO: 322958 - DNA, 15 bp, Homo sapiens
gcagtttgcccagac

SEQ ID NO: 322959 - DNA, 15 bp, Homo sapiens
cagtttgcccagact

SEQ ID NO: 322960 - DNA, 15 bp, Homo sapiens
agtttgcccagacta

SEQ ID NO: 322961 - DNA, 15 bp, Homo sapiens
gtttgcccagactag

SEQ ID NO: 322962 - DNA, 15 bp, Homo sapiens
tttgcccagactaga

SEQ ID NO: 322963 - DNA, 15 bp, Homo sapiens
ttgcccagactagag

SEQ ID NO: 322964 - DNA, 15 bp, Homo sapiens
tgcccagactagagg

SEQ ID NO: 322965 - DNA, 15 bp, Homo sapiens
gcccagactagaggg

SEQ ID NO: 322966 - DNA, 15 bp, Homo sapiens
cccagactagaggga

SEQ ID NO: 322967 - DNA, 15 bp, Homo sapiens
ccagactagagggag

SEQ ID NO: 322968 - DNA, 15 bp, Homo sapiens
cagactagagggagc

SEQ ID NO: 322969 - DNA, 15 bp, Homo sapiens
agactagagggagcc

SEQ ID NO: 322970 - DNA, 15 bp, Homo sapiens
gactagagggagcca

SEQ ID NO: 322971 - DNA, 15 bp, Homo sapiens
actagagggagccag

SEQ ID NO: 322972 - DNA, 15 bp, Homo sapiens
ctagagggagccagc

SEQ ID NO: 322973 - DNA, 15 bp, Homo sapiens
tagagggagccagcg

SEQ ID NO: 322974 - DNA, 15 bp, Homo sapiens
agagggagccagcgt

SEQ ID NO: 322975 - DNA, 15 bp, Homo sapiens
gagggagccagcgtt

SEQ ID NO: 322976 - DNA, 15 bp, Homo sapiens
agggagccagcgttg

SEQ ID NO: 322977 - DNA, 15 bp, Homo sapiens
gggagccagcgttgg

SEQ ID NO: 322978 - DNA, 15 bp, Homo sapiens
ggagccagcgttggg

SEQ ID NO: 322979 - DNA, 15 bp, Homo sapiens
gagccagcgttggga

SEQ ID NO: 322980 - DNA, 15 bp, Homo sapiens
agccagcgttgggaa

SEQ ID NO: 322981 - DNA, 15 bp, Homo sapiens
gccagcgttgggaat

SEQ ID NO: 322982 - DNA, 15 bp, Homo sapiens
ccagcgttgggaata

SEQ ID NO: 322983 - DNA, 15 bp, Homo sapiens
cagcgttgggaataa

SEQ ID NO: 322984 - DNA, 15 bp, Homo sapiens
agcgttgggaataaa

SEQ ID NO: 322985 - DNA, 15 bp, Homo sapiens
gcgttgggaataaaa

SEQ ID NO: 322986 - DNA, 15 bp, Homo sapiens
cgttgggaataaaaa

SEQ ID NO: 322987 - DNA, 15 bp, Homo sapiens
gttgggaataaaaac

SEQ ID NO: 322988 - DNA, 15 bp, Homo sapiens
ttgggaataaaaact

SEQ ID NO: 322989 - DNA, 15 bp, Homo sapiens
tgggaataaaaacta

SEQ ID NO: 322990 - DNA, 15 bp, Homo sapiens
gggaataaaaactaa

SEQ ID NO: 322991 - DNA, 15 bp, Homo sapiens
ggaataaaaactaag

SEQ ID NO: 322992 - DNA, 15 bp, Homo sapiens
gaataaaaactaaga

SEQ ID NO: 322993 - DNA, 15 bp, Homo sapiens
aataaaaactaagat

SEQ ID NO: 322994 - DNA, 15 bp, Homo sapiens
ataaaaactaagatt

SEQ ID NO: 322995 - DNA, 15 bp, Homo sapiens
taaaaactaagattc

SEQ ID NO: 322996 - DNA, 15 bp, Homo sapiens
aaaaactaagattca

SEQ ID NO: 322997 - DNA, 15 bp, Homo sapiens
aaaactaagattcac

SEQ ID NO: 322998 - DNA, 15 bp, Homo sapiens
aaactaagattcact

SEQ ID NO: 322999 - DNA, 15 bp, Homo sapiens
aactaagattcactt

SEQ ID NO: 323000 - DNA, 15 bp, Homo sapiens
actaagattcacttt

SEQ ID NO: 323001 - DNA, 15 bp, Homo sapiens
ctaagattcactttg

SEQ ID NO: 323002 - DNA, 15 bp, Homo sapiens
taagattcactttga

SEQ ID NO: 323003 - DNA, 15 bp, Homo sapiens
aagattcactttgaa

SEQ ID NO: 323004 - DNA, 15 bp, Homo sapiens
agattcactttgaaa

SEQ ID NO: 323005 - DNA, 15 bp, Homo sapiens
gattcactttgaaaa

SEQ ID NO: 323006 - DNA, 15 bp, Homo sapiens
attcactttgaaaat

SEQ ID NO: 323007 - DNA, 15 bp, Homo sapiens
ttcactttgaaaatc

SEQ ID NO: 323008 - DNA, 15 bp, Homo sapiens
tcactttgaaaatct

SEQ ID NO: 323009 - DNA, 15 bp, Homo sapiens
cactttgaaaatcta

SEQ ID NO: 323010 - DNA, 15 bp, Homo sapiens
actttgaaaatctag

SEQ ID NO: 323011 - DNA, 15 bp, Homo sapiens
ctttgaaaatctaga

SEQ ID NO: 323012 - DNA, 15 bp, Homo sapiens
tttgaaaatctagaa

SEQ ID NO: 323013 - DNA, 15 bp, Homo sapiens
ttgaaaatctagaaa

SEQ ID NO: 323014 - DNA, 15 bp, Homo sapiens
tgaaaatctagaaaa

SEQ ID NO: 323015 - DNA, 15 bp, Homo sapiens
gaaaatctagaaaaa

SEQ ID NO: 323016 - DNA, 15 bp, Homo sapiens
aaaatctagaaaaaa

SEQ ID NO: 323017 - DNA, 15 bp, Homo sapiens
aaatctagaaaaaaa

SEQ ID NO: 323018 - DNA, 15 bp, Homo sapiens
aatctagaaaaaaaa

SEQ ID NO: 323019 - DNA, 15 bp, Homo sapiens
atctagaaaaaaaaa

SEQ ID NO: 323020 - DNA, 15 bp, Homo sapiens
tctagaaaaaaaaaa

SEQ ID NO: 323021 - DNA, 15 bp, Homo sapiens
ctagaaaaaaaaaat

SEQ ID NO: 323022 - DNA, 15 bp, Homo sapiens
tagaaaaaaaaaatg

SEQ ID NO: 323023 - DNA, 15 bp, Homo sapiens
agaaaaaaaaaatga

SEQ ID NO: 323024 - DNA, 15 bp, Homo sapiens
aaaaaaaaatgacta

SEQ ID NO: 323025 - DNA, 15 bp, Homo sapiens
aaaaaaaatgactac

SEQ ID NO: 323026 - DNA, 15 bp, Homo sapiens
aaaaaaatgactaca

SEQ ID NO: 323027 - DNA, 15 bp, Homo sapiens
aaaaaatgactacac

SEQ ID NO: 323028 - DNA, 15 bp, Homo sapiens
aaaaatgactacaca

SEQ ID NO: 323029 - DNA, 15 bp, Homo sapiens
aaaatgactacacaa

SEQ ID NO: 323030 - DNA, 15 bp, Homo sapiens
aaatgactacacaag

SEQ ID NO: 323031 - DNA, 15 bp, Homo sapiens
aatgactacacaagt

SEQ ID NO: 323032 - DNA, 15 bp, Homo sapiens
atgactacacaagtc

SEQ ID NO: 323033 - DNA, 15 bp, Homo sapiens
tgactacacaagtca

SEQ ID NO: 323034 - DNA, 15 bp, Homo sapiens
gactacacaagtcat

SEQ ID NO: 323035 - DNA, 15 bp, Homo sapiens
actacacaagtcata

SEQ ID NO: 323036 - DNA, 15 bp, Homo sapiens
ctacacaagtcataa

SEQ ID NO: 323037 - DNA, 15 bp, Homo sapiens
tacacaagtcataag

SEQ ID NO: 323038 - DNA, 15 bp, Homo sapiens
acacaagtcataaga

SEQ ID NO: 323039 - DNA, 15 bp, Homo sapiens
cacaagtcataagaa

SEQ ID NO: 323040 - DNA, 15 bp, Homo sapiens
acaagtcataagaat

SEQ ID NO: 323041 - DNA, 15 bp, Homo sapiens
caagtcataagaatg

SEQ ID NO: 323042 - DNA, 15 bp, Homo sapiens
aagtcataagaatgt

SEQ ID NO: 323043 - DNA, 15 bp, Homo sapiens
agtcataagaatgtg

SEQ ID NO: 323044 - DNA, 15 bp, Homo sapiens
gtcataagaatgtgc

SEQ ID NO: 323045 - DNA, 15 bp, Homo sapiens
tcataagaatgtgct

SEQ ID NO: 323046 - DNA, 15 bp, Homo sapiens
cataagaatgtgctt

SEQ ID NO: 323047 - DNA, 15 bp, Homo sapiens
ataagaatgtgcttg

SEQ ID NO: 323048 - DNA, 15 bp, Homo sapiens
taagaatgtgcttga

SEQ ID NO: 323049 - DNA, 15 bp, Homo sapiens
aagaatgtgcttgat

SEQ ID NO: 323050 - DNA, 15 bp, Homo sapiens
agaatgtgcttgatg

SEQ ID NO: 323051 - DNA, 15 bp, Homo sapiens
gaatgtgcttgatgg

SEQ ID NO: 323052 - DNA, 15 bp, Homo sapiens
aatgtgcttgatggc

SEQ ID NO: 323053 - DNA, 15 bp, Homo sapiens
atgtgcttgatggct

SEQ ID NO: 323054 - DNA, 15 bp, Homo sapiens
tgtgcttgatggctt

SEQ ID NO: 323055 - DNA, 15 bp, Homo sapiens
gtgcttgatggcttg

SEQ ID NO: 323056 - DNA, 15 bp, Homo sapiens
tgcttgatggcttgg

SEQ ID NO: 323057 - DNA, 15 bp, Homo sapiens
gcttgatggcttggg

SEQ ID NO: 323058 - DNA, 15 bp, Homo sapiens
cttgatggcttgggt

SEQ ID NO: 323059 - DNA, 15 bp, Homo sapiens
ttgatggcttgggtt

SEQ ID NO: 323060 - DNA, 15 bp, Homo sapiens
tgatggcttgggttg

SEQ ID NO: 323061 - DNA, 15 bp, Homo sapiens
gatggcttgggttgt

SEQ ID NO: 323062 - DNA, 15 bp, Homo sapiens
atggcttgggttgtc

SEQ ID NO: 323063 - DNA, 15 bp, Homo sapiens
tggcttgggttgtct

SEQ ID NO: 323064 - DNA, 15 bp, Homo sapiens
ggcttgggttgtctg

SEQ ID NO: 323065 - DNA, 15 bp, Homo sapiens
gcttgggttgtctga

SEQ ID NO: 323066 - DNA, 15 bp, Homo sapiens
cttgggttgtctgag

SEQ ID NO: 323067 - DNA, 15 bp, Homo sapiens
ttgggttgtctgagt

SEQ ID NO: 323068 - DNA, 15 bp, Homo sapiens
tgggttgtctgagtg

SEQ ID NO: 323069 - DNA, 15 bp, Homo sapiens
gggttgtctgagtgc

SEQ ID NO: 323070 - DNA, 15 bp, Homo sapiens
ggttgtctgagtgca

SEQ ID NO: 323071 - DNA, 15 bp, Homo sapiens
gttgtctgagtgcaa

SEQ ID NO: 323072 - DNA, 15 bp, Homo sapiens
ttgtctgagtgcaag

SEQ ID NO: 323073 - DNA, 15 bp, Homo sapiens
tgtctgagtgcaagt

SEQ ID NO: 323074 - DNA, 15 bp, Homo sapiens
gtctgagtgcaagtg

SEQ ID NO: 323075 - DNA, 15 bp, Homo sapiens
tctgagtgcaagtga

SEQ ID NO: 323076 - DNA, 15 bp, Homo sapiens
ctgagtgcaagtgaa

SEQ ID NO: 323077 - DNA, 15 bp, Homo sapiens
tgagtgcaagtgaag

SEQ ID NO: 323078 - DNA, 15 bp, Homo sapiens
gagtgcaagtgaagt

SEQ ID NO: 323079 - DNA, 15 bp, Homo sapiens
agtgcaagtgaagta

SEQ ID NO: 323080 - DNA, 15 bp, Homo sapiens
gtgcaagtgaagtag

SEQ ID NO: 323081 - DNA, 15 bp, Homo sapiens
tgcaagtgaagtagg

SEQ ID NO: 323082 - DNA, 15 bp, Homo sapiens
gcaagtgaagtaggg

SEQ ID NO: 323083 - DNA, 15 bp, Homo sapiens
caagtgaagtagggc

SEQ ID NO: 323084 - DNA, 15 bp, Homo sapiens
aagtgaagtagggcg

SEQ ID NO: 323085 - DNA, 15 bp, Homo sapiens
agtgaagtagggcgc

SEQ ID NO: 323086 - DNA, 15 bp, Homo sapiens
gtgaagtagggcgca

SEQ ID NO: 323087 - DNA, 15 bp, Homo sapiens
tgaagtagggcgcag

SEQ ID NO: 323088 - DNA, 15 bp, Homo sapiens
gaagtagggcgcagg

SEQ ID NO: 323089 - DNA, 15 bp, Homo sapiens
aagtagggcgcaggc

SEQ ID NO: 323090 - DNA, 15 bp, Homo sapiens
agtagggcgcaggcc

SEQ ID NO: 323091 - DNA, 15 bp, Homo sapiens
gtagggcgcaggcct

SEQ ID NO: 323092 - DNA, 15 bp, Homo sapiens
tagggcgcaggcctg

SEQ ID NO: 323093 - DNA, 15 bp, Homo sapiens
agggcgcaggcctgg

SEQ ID NO: 323094 - DNA, 15 bp, Homo sapiens
gggcgcaggcctggt

SEQ ID NO: 323095 - DNA, 15 bp, Homo sapiens
ggcgcaggcctggtt

SEQ ID NO: 323096 - DNA, 15 bp, Homo sapiens
gcgcaggcctggttt

SEQ ID NO: 323097 - DNA, 15 bp, Homo sapiens
cgcaggcctggtttc

SEQ ID NO: 323098 - DNA, 15 bp, Homo sapiens
gcaggcctggtttcc

SEQ ID NO: 323099 - DNA, 15 bp, Homo sapiens
caggcctggtttccg

SEQ ID NO: 323100 - DNA, 15 bp, Homo sapiens
aggcctggtttccgc

SEQ ID NO: 323101 - DNA, 15 bp, Homo sapiens
ggcctggtttccgca

SEQ ID NO: 323102 - DNA, 15 bp, Homo sapiens
gcctggtttccgcat

SEQ ID NO: 323103 - DNA, 15 bp, Homo sapiens
cctggtttccgcatt

SEQ ID NO: 323104 - DNA, 15 bp, Homo sapiens
ctggtttccgcattc

SEQ ID NO: 323105 - DNA, 15 bp, Homo sapiens
tggtttccgcattcc

SEQ ID NO: 323106 - DNA, 15 bp, Homo sapiens
ggtttccgcattccc

SEQ ID NO: 323107 - DNA, 15 bp, Homo sapiens
gtttccgcattccct

SEQ ID NO: 323108 - DNA, 15 bp, Homo sapiens
tttccgcattccctg

SEQ ID NO: 323109 - DNA, 15 bp, Homo sapiens
ttccgcattccctgt

SEQ ID NO: 323110 - DNA, 15 bp, Homo sapiens
tccgcattccctgtc

SEQ ID NO: 323111 - DNA, 15 bp, Homo sapiens
ccgcattccctgtct

SEQ ID NO: 323112 - DNA, 15 bp, Homo sapiens
cgcattccctgtctg

SEQ ID NO: 323113 - DNA, 15 bp, Homo sapiens
gcattccctgtctgc

SEQ ID NO: 323114 - DNA, 15 bp, Homo sapiens
cattccctgtctgct

SEQ ID NO: 323115 - DNA, 15 bp, Homo sapiens
attccctgtctgctc

SEQ ID NO: 323116 - DNA, 15 bp, Homo sapiens
ttccctgtctgctca

SEQ ID NO: 323117 - DNA, 15 bp, Homo sapiens
tccctgtctgctcag

SEQ ID NO: 323118 - DNA, 15 bp, Homo sapiens
ccctgtctgctcagc

SEQ ID NO: 323119 - DNA, 15 bp, Homo sapiens
cctgtctgctcagcc

SEQ ID NO: 323120 - DNA, 15 bp, Homo sapiens
ctgtctgctcagcct

SEQ ID NO: 323121 - DNA, 15 bp, Homo sapiens
tgtctgctcagcctt

SEQ ID NO: 323122 - DNA, 15 bp, Homo sapiens
gtctgctcagccttt

SEQ ID NO: 323123 - DNA, 15 bp, Homo sapiens
tctgctcagcctttt

SEQ ID NO: 323124 - DNA, 15 bp, Homo sapiens
ctgctcagcctttta

SEQ ID NO: 323125 - DNA, 15 bp, Homo sapiens
tgctcagccttttag

SEQ ID NO: 323126 - DNA, 15 bp, Homo sapiens
gctcagccttttagc

SEQ ID NO: 323127 - DNA, 15 bp, Homo sapiens
ctcagccttttagct

SEQ ID NO: 323128 - DNA, 15 bp, Homo sapiens
tcagccttttagctc

SEQ ID NO: 323129 - DNA, 15 bp, Homo sapiens
cagccttttagctcc

SEQ ID NO: 323130 - DNA, 15 bp, Homo sapiens
agccttttagctcct

SEQ ID NO: 323131 - DNA, 15 bp, Homo sapiens
gccttttagctccta

SEQ ID NO: 323132 - DNA, 15 bp, Homo sapiens
ccttttagctcctaa

SEQ ID NO: 323133 - DNA, 15 bp, Homo sapiens
cttttagctcctaac

SEQ ID NO: 323134 - DNA, 15 bp, Homo sapiens
ttttagctcctaacc

SEQ ID NO: 323135 - DNA, 15 bp, Homo sapiens
tttagctcctaaccc

SEQ ID NO: 323136 - DNA, 15 bp, Homo sapiens
ttagctcctaacccc

SEQ ID NO: 323137 - DNA, 15 bp, Homo sapiens
tagctcctaacccca

SEQ ID NO: 323138 - DNA, 15 bp, Homo sapiens
agctcctaaccccat

SEQ ID NO: 323139 - DNA, 15 bp, Homo sapiens
gctcctaaccccatc

SEQ ID NO: 323140 - DNA, 15 bp, Homo sapiens
ctcctaaccccatcc

SEQ ID NO: 323141 - DNA, 15 bp, Homo sapiens
tcctaaccccatcca

SEQ ID NO: 323142 - DNA, 15 bp, Homo sapiens
cctaaccccatccac

SEQ ID NO: 323143 - DNA, 15 bp, Homo sapiens
ctaaccccatccact

SEQ ID NO: 323144 - DNA, 15 bp, Homo sapiens
taaccccatccactc

SEQ ID NO: 323145 - DNA, 15 bp, Homo sapiens
aaccccatccactcc

SEQ ID NO: 323146 - DNA, 15 bp, Homo sapiens
accccatccactccc

SEQ ID NO: 323147 - DNA, 15 bp, Homo sapiens
ccccatccactccct

SEQ ID NO: 323148 - DNA, 15 bp, Homo sapiens
cccatccactcccta

SEQ ID NO: 323149 - DNA, 15 bp, Homo sapiens
ccatccactccctag

SEQ ID NO: 323150 - DNA, 15 bp, Homo sapiens
catccactccctaga

SEQ ID NO: 323151 - DNA, 15 bp, Homo sapiens
atccactccctagag

SEQ ID NO: 323152 - DNA, 15 bp, Homo sapiens
tccactccctagagc

SEQ ID NO: 323153 - DNA, 15 bp, Homo sapiens
ccactccctagagct

SEQ ID NO: 323154 - DNA, 15 bp, Homo sapiens
cactccctagagctg

SEQ ID NO: 323155 - DNA, 15 bp, Homo sapiens
actccctagagctgg

SEQ ID NO: 323156 - DNA, 15 bp, Homo sapiens
ctccctagagctggc

SEQ ID NO: 323157 - DNA, 15 bp, Homo sapiens
tccctagagctggcc

SEQ ID NO: 323158 - DNA, 15 bp, Homo sapiens
ccctagagctggcca

SEQ ID NO: 323159 - DNA, 15 bp, Homo sapiens
cctagagctggccag

SEQ ID NO: 323160 - DNA, 15 bp, Homo sapiens
ctagagctggccagc

SEQ ID NO: 323161 - DNA, 15 bp, Homo sapiens
tagagctggccagcc

SEQ ID NO: 323162 - DNA, 15 bp, Homo sapiens
agagctggccagccc

SEQ ID NO: 323163 - DNA, 15 bp, Homo sapiens
gagctggccagccca

SEQ ID NO: 323164 - DNA, 15 bp, Homo sapiens
agctggccagcccag

SEQ ID NO: 323165 - DNA, 15 bp, Homo sapiens
gctggccagcccaga

SEQ ID NO: 323166 - DNA, 15 bp, Homo sapiens
ctggccagcccagac

SEQ ID NO: 323167 - DNA, 15 bp, Homo sapiens
tggccagcccagacc

SEQ ID NO: 323168 - DNA, 15 bp, Homo sapiens
ggccagcccagaccc

SEQ ID NO: 323169 - DNA, 15 bp, Homo sapiens
gccagcccagaccca

SEQ ID NO: 323170 - DNA, 15 bp, Homo sapiens
ccagcccagacccag

SEQ ID NO: 323171 - DNA, 15 bp, Homo sapiens
cagcccagacccagg

SEQ ID NO: 323172 - DNA, 15 bp, Homo sapiens
agcccagacccagga

SEQ ID NO: 323173 - DNA, 15 bp, Homo sapiens
gcccagacccaggac

SEQ ID NO: 323174 - DNA, 15 bp, Homo sapiens
cccagacccaggacc

SEQ ID NO: 323175 - DNA, 15 bp, Homo sapiens
ccagacccaggacct

SEQ ID NO: 323176 - DNA, 15 bp, Homo sapiens
cagacccaggacctg

SEQ ID NO: 323177 - DNA, 15 bp, Homo sapiens
agacccaggacctgg

SEQ ID NO: 323178 - DNA, 15 bp, Homo sapiens
gacccaggacctgga

SEQ ID NO: 323179 - DNA, 15 bp, Homo sapiens
acccaggacctggat

SEQ ID NO: 323180 - DNA, 15 bp, Homo sapiens
cccaggacctggatg

SEQ ID NO: 323181 - DNA, 15 bp, Homo sapiens
ccaggacctggatgc

SEQ ID NO: 323182 - DNA, 15 bp, Homo sapiens
caggacctggatgct

SEQ ID NO: 323183 - DNA, 15 bp, Homo sapiens
aggacctggatgctg

SEQ ID NO: 323184 - DNA, 15 bp, Homo sapiens
ggacctggatgctga

SEQ ID NO: 323185 - DNA, 15 bp, Homo sapiens
gacctggatgctgac

SEQ ID NO: 323186 - DNA, 15 bp, Homo sapiens
acctggatgctgacc

SEQ ID NO: 323187 - DNA, 15 bp, Homo sapiens
cctggatgctgacct

SEQ ID NO: 323188 - DNA, 15 bp, Homo sapiens
ctggatgctgacctc

SEQ ID NO: 323189 - DNA, 15 bp, Homo sapiens
tggatgctgacctct

SEQ ID NO: 323190 - DNA, 15 bp, Homo sapiens
ggatgctgacctctt

SEQ ID NO: 323191 - DNA, 15 bp, Homo sapiens
gatgctgacctcttc

SEQ ID NO: 323192 - DNA, 15 bp, Homo sapiens
atgctgacctcttca

SEQ ID NO: 323193 - DNA, 15 bp, Homo sapiens
tgctgacctcttcag

SEQ ID NO: 323194 - DNA, 15 bp, Homo sapiens
gctgacctcttcagg

SEQ ID NO: 323195 - DNA, 15 bp, Homo sapiens
ctgacctcttcaggg

SEQ ID NO: 323196 - DNA, 15 bp, Homo sapiens
tgacctcttcagggc

SEQ ID NO: 323197 - DNA, 15 bp, Homo sapiens
gacctcttcagggcg

SEQ ID NO: 323198 - DNA, 15 bp, Homo sapiens
acctcttcagggcgg

SEQ ID NO: 323199 - DNA, 15 bp, Homo sapiens
cctcttcagggcgga

SEQ ID NO: 323200 - DNA, 15 bp, Homo sapiens
ctcttcagggcggag

SEQ ID NO: 323201 - DNA, 15 bp, Homo sapiens
tcttcagggcggagc

SEQ ID NO: 323202 - DNA, 15 bp, Homo sapiens
cttcagggcggagct

SEQ ID NO: 323203 - DNA, 15 bp, Homo sapiens
ttcagggcggagctg

SEQ ID NO: 323204 - DNA, 15 bp, Homo sapiens
tcagggcggagctgt

SEQ ID NO: 323205 - DNA, 15 bp, Homo sapiens
cagggcggagctgtt

SEQ ID NO: 323206 - DNA, 15 bp, Homo sapiens
agggcggagctgttg

SEQ ID NO: 323207 - DNA, 15 bp, Homo sapiens
gggcggagctgttgc

SEQ ID NO: 323208 - DNA, 15 bp, Homo sapiens
ggcggagctgttgct

SEQ ID NO: 323209 - DNA, 15 bp, Homo sapiens
gcggagctgttgctg

SEQ ID NO: 323210 - DNA, 15 bp, Homo sapiens
cggagctgttgctgt

SEQ ID NO: 323211 - DNA, 15 bp, Homo sapiens
ggagctgttgctgtg

SEQ ID NO: 323212 - DNA, 15 bp, Homo sapiens
gagctgttgctgtgc

SEQ ID NO: 323213 - DNA, 15 bp, Homo sapiens
agctgttgctgtgct

SEQ ID NO: 323214 - DNA, 15 bp, Homo sapiens
gctgttgctgtgctc

SEQ ID NO: 323215 - DNA, 15 bp, Homo sapiens
ctgttgctgtgctca

SEQ ID NO: 323216 - DNA, 15 bp, Homo sapiens
tgttgctgtgctcag

SEQ ID NO: 323217 - DNA, 15 bp, Homo sapiens
gttgctgtgctcaga

SEQ ID NO: 323218 - DNA, 15 bp, Homo sapiens
ttgctgtgctcagac

SEQ ID NO: 323219 - DNA, 15 bp, Homo sapiens
tgctgtgctcagaca

SEQ ID NO: 323220 - DNA, 15 bp, Homo sapiens
gctgtgctcagacat

SEQ ID NO: 323221 - DNA, 15 bp, Homo sapiens
ctgtgctcagacatc

SEQ ID NO: 323222 - DNA, 15 bp, Homo sapiens
tgtgctcagacatcg

SEQ ID NO: 323223 - DNA, 15 bp, Homo sapiens
gtgctcagacatcgt

SEQ ID NO: 323224 - DNA, 15 bp, Homo sapiens
tgctcagacatcgtg

SEQ ID NO: 323225 - DNA, 15 bp, Homo sapiens
gctcagacatcgtga

SEQ ID NO: 323226 - DNA, 15 bp, Homo sapiens
ctcagacatcgtgac

SEQ ID NO: 323227 - DNA, 15 bp, Homo sapiens
tcagacatcgtgaca

SEQ ID NO: 323228 - DNA, 15 bp, Homo sapiens
cagacatcgtgacaa

SEQ ID NO: 323229 - DNA, 15 bp, Homo sapiens
agacatcgtgacaac

SEQ ID NO: 323230 - DNA, 15 bp, Homo sapiens
gacatcgtgacaact

SEQ ID NO: 323231 - DNA, 15 bp, Homo sapiens
acatcgtgacaactt

SEQ ID NO: 323232 - DNA, 15 bp, Homo sapiens
catcgtgacaacttg

SEQ ID NO: 323233 - DNA, 15 bp, Homo sapiens
atcgtgacaacttgt

SEQ ID NO: 323234 - DNA, 15 bp, Homo sapiens
tcgtgacaacttgtt

SEQ ID NO: 323235 - DNA, 15 bp, Homo sapiens
cgtgacaacttgttg

SEQ ID NO: 323236 - DNA, 15 bp, Homo sapiens
gtgacaacttgttga

SEQ ID NO: 323237 - DNA, 15 bp, Homo sapiens
tgacaacttgttgat

SEQ ID NO: 323238 - DNA, 15 bp, Homo sapiens
gacaacttgttgatg

SEQ ID NO: 323239 - DNA, 15 bp, Homo sapiens
acaacttgttgatgg

SEQ ID NO: 323240 - DNA, 15 bp, Homo sapiens
caacttgttgatggg

SEQ ID NO: 323241 - DNA, 15 bp, Homo sapiens
aacttgttgatggga

SEQ ID NO: 323242 - DNA, 15 bp, Homo sapiens
acttgttgatgggaa

SEQ ID NO: 323243 - DNA, 15 bp, Homo sapiens
cttgttgatgggaaa

SEQ ID NO: 323244 - DNA, 15 bp, Homo sapiens
ttgttgatgggaaat

SEQ ID NO: 323245 - DNA, 15 bp, Homo sapiens
tgttgatgggaaatg

SEQ ID NO: 323246 - DNA, 15 bp, Homo sapiens
gttgatgggaaatgt

SEQ ID NO: 323247 - DNA, 15 bp, Homo sapiens
ttgatgggaaatgta

SEQ ID NO: 323248 - DNA, 15 bp, Homo sapiens
tgatgggaaatgtag

SEQ ID NO: 323249 - DNA, 15 bp, Homo sapiens
gatgggaaatgtagc

SEQ ID NO: 323250 - DNA, 15 bp, Homo sapiens
atgggaaatgtagct

SEQ ID NO: 323251 - DNA, 15 bp, Homo sapiens
tgggaaatgtagctg

SEQ ID NO: 323252 - DNA, 15 bp, Homo sapiens
gggaaatgtagctga

SEQ ID NO: 323253 - DNA, 15 bp, Homo sapiens
ggaaatgtagctgaa

SEQ ID NO: 323254 - DNA, 15 bp, Homo sapiens
gaaatgtagctgaaa

SEQ ID NO: 323255 - DNA, 15 bp, Homo sapiens
aaatgtagctgaaag

SEQ ID NO: 323256 - DNA, 15 bp, Homo sapiens
aatgtagctgaaagt

SEQ ID NO: 323257 - DNA, 15 bp, Homo sapiens
atgtagctgaaagtc

SEQ ID NO: 323258 - DNA, 15 bp, Homo sapiens
tgtagctgaaagtct

SEQ ID NO: 323259 - DNA, 15 bp, Homo sapiens
gtagctgaaagtcta

SEQ ID NO: 323260 - DNA, 15 bp, Homo sapiens
tagctgaaagtctag

SEQ ID NO: 323261 - DNA, 15 bp, Homo sapiens
agctgaaagtctagc

SEQ ID NO: 323262 - DNA, 15 bp, Homo sapiens
gctgaaagtctagca

SEQ ID NO: 323263 - DNA, 15 bp, Homo sapiens
ctgaaagtctagcac

SEQ ID NO: 323264 - DNA, 15 bp, Homo sapiens
tgaaagtctagcaca

SEQ ID NO: 323265 - DNA, 15 bp, Homo sapiens
gaaagtctagcacaa

SEQ ID NO: 323266 - DNA, 15 bp, Homo sapiens
aaagtctagcacaaa

SEQ ID NO: 323267 - DNA, 15 bp, Homo sapiens
aagtctagcacaaaa

SEQ ID NO: 323268 - DNA, 15 bp, Homo sapiens
agtctagcacaaaaa

SEQ ID NO: 323269 - DNA, 15 bp, Homo sapiens
gtctagcacaaaaag

SEQ ID NO: 323270 - DNA, 15 bp, Homo sapiens
tctagcacaaaaagc

SEQ ID NO: 323271 - DNA, 15 bp, Homo sapiens
ctagcacaaaaagct

SEQ ID NO: 323272 - DNA, 15 bp, Homo sapiens
tagcacaaaaagctg

SEQ ID NO: 323273 - DNA, 15 bp, Homo sapiens
agcacaaaaagctgc

SEQ ID NO: 323274 - DNA, 15 bp, Homo sapiens
gcacaaaaagctgct

SEQ ID NO: 323275 - DNA, 15 bp, Homo sapiens
cacaaaaagctgctc

SEQ ID NO: 323276 - DNA, 15 bp, Homo sapiens
acaaaaagctgctct

SEQ ID NO: 323277 - DNA, 15 bp, Homo sapiens
caaaaagctgctctt

SEQ ID NO: 323278 - DNA, 15 bp, Homo sapiens
aaaaagctgctcttg

SEQ ID NO: 323279 - DNA, 15 bp, Homo sapiens
aaaagctgctcttgg

SEQ ID NO: 323280 - DNA, 15 bp, Homo sapiens
aaagctgctcttggg

SEQ ID NO: 323281 - DNA, 15 bp, Homo sapiens
aagctgctcttgggt

SEQ ID NO: 323282 - DNA, 15 bp, Homo sapiens
agctgctcttgggtt

SEQ ID NO: 323283 - DNA, 15 bp, Homo sapiens
gctgctcttgggttg

SEQ ID NO: 323284 - DNA, 15 bp, Homo sapiens
ctgctcttgggttgg

SEQ ID NO: 323285 - DNA, 15 bp, Homo sapiens
tgctcttgggttggc

SEQ ID NO: 323286 - DNA, 15 bp, Homo sapiens
gctcttgggttggcc

SEQ ID NO: 323287 - DNA, 15 bp, Homo sapiens
ctcttgggttggcca

SEQ ID NO: 323288 - DNA, 15 bp, Homo sapiens
tcttgggttggccag

SEQ ID NO: 323289 - DNA, 15 bp, Homo sapiens
cttgggttggccagc

SEQ ID NO: 323290 - DNA, 15 bp, Homo sapiens
ttgggttggccagcg

SEQ ID NO: 323291 - DNA, 15 bp, Homo sapiens
tgggttggccagcga

SEQ ID NO: 323292 - DNA, 15 bp, Homo sapiens
gggttggccagcgaa

SEQ ID NO: 323293 - DNA, 15 bp, Homo sapiens
ggttggccagcgaac

SEQ ID NO: 323294 - DNA, 15 bp, Homo sapiens
gttggccagcgaacc

SEQ ID NO: 323295 - DNA, 15 bp, Homo sapiens
ttggccagcgaacct

SEQ ID NO: 323296 - DNA, 15 bp, Homo sapiens
tggccagcgaacctc

SEQ ID NO: 323297 - DNA, 15 bp, Homo sapiens
ggccagcgaacctcc

SEQ ID NO: 323298 - DNA, 15 bp, Homo sapiens
gccagcgaacctcct

SEQ ID NO: 323299 - DNA, 15 bp, Homo sapiens
ccagcgaacctcctt

SEQ ID NO: 323300 - DNA, 15 bp, Homo sapiens
cagcgaacctccttc

SEQ ID NO: 323301 - DNA, 15 bp, Homo sapiens
agcgaacctccttca

SEQ ID NO: 323302 - DNA, 15 bp, Homo sapiens
gcgaacctccttcat

SEQ ID NO: 323303 - DNA, 15 bp, Homo sapiens
cgaacctccttcatg

SEQ ID NO: 323304 - DNA, 15 bp, Homo sapiens
gaacctccttcatgg

SEQ ID NO: 323305 - DNA, 15 bp, Homo sapiens
aacctccttcatggt

SEQ ID NO: 323306 - DNA, 15 bp, Homo sapiens
acctccttcatggta

SEQ ID NO: 323307 - DNA, 15 bp, Homo sapiens
cctccttcatggtaa

SEQ ID NO: 323308 - DNA, 15 bp, Homo sapiens
ctccttcatggtaaa

SEQ ID NO: 323309 - DNA, 15 bp, Homo sapiens
tccttcatggtaaaa

SEQ ID NO: 323310 - DNA, 15 bp, Homo sapiens
ccttcatggtaaaac

SEQ ID NO: 323311 - DNA, 15 bp, Homo sapiens
cttcatggtaaaact

SEQ ID NO: 323312 - DNA, 15 bp, Homo sapiens
ttcatggtaaaactc

SEQ ID NO: 323313 - DNA, 15 bp, Homo sapiens
tcatggtaaaactcc

SEQ ID NO: 323314 - DNA, 15 bp, Homo sapiens
catggtaaaactccc

SEQ ID NO: 323315 - DNA, 15 bp, Homo sapiens
atggtaaaactcccc

SEQ ID NO: 323316 - DNA, 15 bp, Homo sapiens
tggtaaaactcccca

SEQ ID NO: 323317 - DNA, 15 bp, Homo sapiens
ggtaaaactccccat

SEQ ID NO: 323318 - DNA, 15 bp, Homo sapiens
gtaaaactccccatc

SEQ ID NO: 323319 - DNA, 15 bp, Homo sapiens
taaaactccccatcc

SEQ ID NO: 323320 - DNA, 15 bp, Homo sapiens
aaaactccccatccc

SEQ ID NO: 323321 - DNA, 15 bp, Homo sapiens
aaactccccatccct

SEQ ID NO: 323322 - DNA, 15 bp, Homo sapiens
aactccccatccctt

SEQ ID NO: 323323 - DNA, 15 bp, Homo sapiens
actccccatccctta

SEQ ID NO: 323324 - DNA, 15 bp, Homo sapiens
ctccccatcccttat

SEQ ID NO: 323325 - DNA, 15 bp, Homo sapiens
tccccatcccttatc

SEQ ID NO: 323326 - DNA, 15 bp, Homo sapiens
ccccatcccttatcc

SEQ ID NO: 323327 - DNA, 15 bp, Homo sapiens
cccatcccttatcca

SEQ ID NO: 323328 - DNA, 15 bp, Homo sapiens
ccatcccttatccaa

SEQ ID NO: 323329 - DNA, 15 bp, Homo sapiens
catcccttatccaaa

SEQ ID NO: 323330 - DNA, 15 bp, Homo sapiens
atcccttatccaaat

SEQ ID NO: 323331 - DNA, 15 bp, Homo sapiens
tcccttatccaaatc

SEQ ID NO: 323332 - DNA, 15 bp, Homo sapiens
cccttatccaaatcc

SEQ ID NO: 323333 - DNA, 15 bp, Homo sapiens
ccttatccaaatcct

SEQ ID NO: 323334 - DNA, 15 bp, Homo sapiens
cttatccaaatcctt

SEQ ID NO: 323335 - DNA, 15 bp, Homo sapiens
ttatccaaatccttg

SEQ ID NO: 323336 - DNA, 15 bp, Homo sapiens
tatccaaatccttgg

SEQ ID NO: 323337 - DNA, 15 bp, Homo sapiens
atccaaatccttggg

SEQ ID NO: 323338 - DNA, 15 bp, Homo sapiens
tccaaatccttggga

SEQ ID NO: 323339 - DNA, 15 bp, Homo sapiens
ccaaatccttgggac

SEQ ID NO: 323340 - DNA, 15 bp, Homo sapiens
caaatccttgggacc

SEQ ID NO: 323341 - DNA, 15 bp, Homo sapiens
aaatccttgggacca

SEQ ID NO: 323342 - DNA, 15 bp, Homo sapiens
aatccttgggaccag

SEQ ID NO: 323343 - DNA, 15 bp, Homo sapiens
atccttgggaccaga

SEQ ID NO: 323344 - DNA, 15 bp, Homo sapiens
tccttgggaccagat

SEQ ID NO: 323345 - DNA, 15 bp, Homo sapiens
ccttgggaccagata

SEQ ID NO: 323346 - DNA, 15 bp, Homo sapiens
cttgggaccagatat

SEQ ID NO: 323347 - DNA, 15 bp, Homo sapiens
ttgggaccagatatg

SEQ ID NO: 323348 - DNA, 15 bp, Homo sapiens
tgggaccagatatgc

SEQ ID NO: 323349 - DNA, 15 bp, Homo sapiens
gggaccagatatgct

SEQ ID NO: 323350 - DNA, 15 bp, Homo sapiens
ggaccagatatgctt

SEQ ID NO: 323351 - DNA, 15 bp, Homo sapiens
gaccagatatgcttc

SEQ ID NO: 323352 - DNA, 15 bp, Homo sapiens
accagatatgcttca

SEQ ID NO: 323353 - DNA, 15 bp, Homo sapiens
ccagatatgcttcag

SEQ ID NO: 323354 - DNA, 15 bp, Homo sapiens
cagatatgcttcaga

SEQ ID NO: 323355 - DNA, 15 bp, Homo sapiens
agatatgcttcagaa

SEQ ID NO: 323356 - DNA, 15 bp, Homo sapiens
gatatgcttcagaat

SEQ ID NO: 323357 - DNA, 15 bp, Homo sapiens
atatgcttcagaatt

SEQ ID NO: 323358 - DNA, 15 bp, Homo sapiens
tatgcttcagaattt

SEQ ID NO: 323359 - DNA, 15 bp, Homo sapiens
atgcttcagaattta

SEQ ID NO: 323360 - DNA, 15 bp, Homo sapiens
tgcttcagaatttat

SEQ ID NO: 323361 - DNA, 15 bp, Homo sapiens
gcttcagaatttatg

SEQ ID NO: 323362 - DNA, 15 bp, Homo sapiens
cttcagaatttatga

SEQ ID NO: 323363 - DNA, 15 bp, Homo sapiens
ttcagaatttatgat

SEQ ID NO: 323364 - DNA, 15 bp, Homo sapiens
tcagaatttatgatt

SEQ ID NO: 323365 - DNA, 15 bp, Homo sapiens
cagaatttatgattt

SEQ ID NO: 323366 - DNA, 15 bp, Homo sapiens
agaatttatgatttt

SEQ ID NO: 323367 - DNA, 15 bp, Homo sapiens
gaatttatgattttt

SEQ ID NO: 323368 - DNA, 15 bp, Homo sapiens
aatttatgatttttc

SEQ ID NO: 323369 - DNA, 15 bp, Homo sapiens
atttatgatttttct

SEQ ID NO: 323370 - DNA, 15 bp, Homo sapiens
tttatgatttttctt

SEQ ID NO: 323371 - DNA, 15 bp, Homo sapiens
ttatgatttttcttt

SEQ ID NO: 323372 - DNA, 15 bp, Homo sapiens
tatgatttttctttt

SEQ ID NO: 323373 - DNA, 15 bp, Homo sapiens
atgatttttcttttt

SEQ ID NO: 323374 - DNA, 15 bp, Homo sapiens
tgatttttctttttc

SEQ ID NO: 323375 - DNA, 15 bp, Homo sapiens
gatttttctttttcc

SEQ ID NO: 323376 - DNA, 15 bp, Homo sapiens
atttttctttttccc

SEQ ID NO: 323377 - DNA, 15 bp, Homo sapiens
tttttctttttccca

SEQ ID NO: 323378 - DNA, 15 bp, Homo sapiens
ttttctttttcccat

SEQ ID NO: 323379 - DNA, 15 bp, Homo sapiens
tttctttttcccatt

SEQ ID NO: 323380 - DNA, 15 bp, Homo sapiens
ttctttttcccattt

SEQ ID NO: 323381 - DNA, 15 bp, Homo sapiens
tctttttcccatttc

SEQ ID NO: 323382 - DNA, 15 bp, Homo sapiens
ctttttcccatttca

SEQ ID NO: 323383 - DNA, 15 bp, Homo sapiens
tttttcccatttcag

SEQ ID NO: 323384 - DNA, 15 bp, Homo sapiens
ttttcccatttcaga

SEQ ID NO: 323385 - DNA, 15 bp, Homo sapiens
tttcccatttcagaa

SEQ ID NO: 323386 - DNA, 15 bp, Homo sapiens
ttcccatttcagaaa

SEQ ID NO: 323387 - DNA, 15 bp, Homo sapiens
tcccatttcagaaag

SEQ ID NO: 323388 - DNA, 15 bp, Homo sapiens
cccatttcagaaagg

SEQ ID NO: 323389 - DNA, 15 bp, Homo sapiens
ccatttcagaaaggc

SEQ ID NO: 323390 - DNA, 15 bp, Homo sapiens
catttcagaaaggct

SEQ ID NO: 323391 - DNA, 15 bp, Homo sapiens
atttcagaaaggcta

SEQ ID NO: 323392 - DNA, 15 bp, Homo sapiens
tttcagaaaggctat

SEQ ID NO: 323393 - DNA, 15 bp, Homo sapiens
ttcagaaaggctatg

SEQ ID NO: 323394 - DNA, 15 bp, Homo sapiens
tcagaaaggctatgg

SEQ ID NO: 323395 - DNA, 15 bp, Homo sapiens
cagaaaggctatggc

SEQ ID NO: 323396 - DNA, 15 bp, Homo sapiens
agaaaggctatggcc

SEQ ID NO: 323397 - DNA, 15 bp, Homo sapiens
gaaaggctatggccc

SEQ ID NO: 323398 - DNA, 15 bp, Homo sapiens
aaaggctatggccca

SEQ ID NO: 323399 - DNA, 15 bp, Homo sapiens
aaggctatggcccat

SEQ ID NO: 323400 - DNA, 15 bp, Homo sapiens
aggctatggcccata

SEQ ID NO: 323401 - DNA, 15 bp, Homo sapiens
ggctatggcccatat

SEQ ID NO: 323402 - DNA, 15 bp, Homo sapiens
gctatggcccatatg

SEQ ID NO: 323403 - DNA, 15 bp, Homo sapiens
ctatggcccatatgc

SEQ ID NO: 323404 - DNA, 15 bp, Homo sapiens
tatggcccatatgcc

SEQ ID NO: 323405 - DNA, 15 bp, Homo sapiens
atggcccatatgccc

SEQ ID NO: 323406 - DNA, 15 bp, Homo sapiens
tggcccatatgccct

SEQ ID NO: 323407 - DNA, 15 bp, Homo sapiens
ggcccatatgcccta

SEQ ID NO: 323408 - DNA, 15 bp, Homo sapiens
gcccatatgccctat

SEQ ID NO: 323409 - DNA, 15 bp, Homo sapiens
cccatatgccctatg

SEQ ID NO: 323410 - DNA, 15 bp, Homo sapiens
ccatatgccctatgt

SEQ ID NO: 323411 - DNA, 15 bp, Homo sapiens
catatgccctatgtt

SEQ ID NO: 323412 - DNA, 15 bp, Homo sapiens
atatgccctatgtta

SEQ ID NO: 323413 - DNA, 15 bp, Homo sapiens
tatgccctatgttac

SEQ ID NO: 323414 - DNA, 15 bp, Homo sapiens
atgccctatgttaca

SEQ ID NO: 323415 - DNA, 15 bp, Homo sapiens
tgccctatgttacat

SEQ ID NO: 323416 - DNA, 15 bp, Homo sapiens
gccctatgttacata

SEQ ID NO: 323417 - DNA, 15 bp, Homo sapiens
ccctatgttacataa

SEQ ID NO: 323418 - DNA, 15 bp, Homo sapiens
cctatgttacataaa

SEQ ID NO: 323419 - DNA, 15 bp, Homo sapiens
ctatgttacataaag

SEQ ID NO: 323420 - DNA, 15 bp, Homo sapiens
tatgttacataaagc

SEQ ID NO: 323421 - DNA, 15 bp, Homo sapiens
atgttacataaagcc

SEQ ID NO: 323422 - DNA, 15 bp, Homo sapiens
tgttacataaagcct

SEQ ID NO: 323423 - DNA, 15 bp, Homo sapiens
gttacataaagcctc

SEQ ID NO: 323424 - DNA, 15 bp, Homo sapiens
ttacataaagcctcc

SEQ ID NO: 323425 - DNA, 15 bp, Homo sapiens
tacataaagcctcca

SEQ ID NO: 323426 - DNA, 15 bp, Homo sapiens
acataaagcctccag

SEQ ID NO: 323427 - DNA, 15 bp, Homo sapiens
cataaagcctccaga

SEQ ID NO: 323428 - DNA, 15 bp, Homo sapiens
ataaagcctccagag

SEQ ID NO: 323429 - DNA, 15 bp, Homo sapiens
taaagcctccagagg

SEQ ID NO: 323430 - DNA, 15 bp, Homo sapiens
aaagcctccagagga

SEQ ID NO: 323431 - DNA, 15 bp, Homo sapiens
aagcctccagaggag

SEQ ID NO: 323432 - DNA, 15 bp, Homo sapiens
agcctccagaggagt

SEQ ID NO: 323433 - DNA, 15 bp, Homo sapiens
gcctccagaggagtt

SEQ ID NO: 323434 - DNA, 15 bp, Homo sapiens
cctccagaggagttt

SEQ ID NO: 323435 - DNA, 15 bp, Homo sapiens
ctccagaggagtttg

SEQ ID NO: 323436 - DNA, 15 bp, Homo sapiens
tccagaggagtttgg

SEQ ID NO: 323437 - DNA, 15 bp, Homo sapiens
ccagaggagtttggg

SEQ ID NO: 323438 - DNA, 15 bp, Homo sapiens
cagaggagtttggga

SEQ ID NO: 323439 - DNA, 15 bp, Homo sapiens
agaggagtttgggac

SEQ ID NO: 323440 - DNA, 15 bp, Homo sapiens
gaggagtttgggaca

SEQ ID NO: 323441 - DNA, 15 bp, Homo sapiens
aggagtttgggacag

SEQ ID NO: 323442 - DNA, 15 bp, Homo sapiens
ggagtttgggacagt

SEQ ID NO: 323443 - DNA, 15 bp, Homo sapiens
gagtttgggacagta

SEQ ID NO: 323444 - DNA, 15 bp, Homo sapiens
agtttgggacagtac

SEQ ID NO: 323445 - DNA, 15 bp, Homo sapiens
gtttgggacagtacc

SEQ ID NO: 323446 - DNA, 15 bp, Homo sapiens
tttgggacagtaccc

SEQ ID NO: 323447 - DNA, 15 bp, Homo sapiens
ttgggacagtaccct

SEQ ID NO: 323448 - DNA, 15 bp, Homo sapiens
tgggacagtacccta

SEQ ID NO: 323449 - DNA, 15 bp, Homo sapiens
gggacagtaccctat

SEQ ID NO: 323450 - DNA, 15 bp, Homo sapiens
ggacagtaccctatc

SEQ ID NO: 323451 - DNA, 15 bp, Homo sapiens
gacagtaccctatca

SEQ ID NO: 323452 - DNA, 15 bp, Homo sapiens
acagtaccctatcat

SEQ ID NO: 323453 - DNA, 15 bp, Homo sapiens
cagtaccctatcatc

SEQ ID NO: 323454 - DNA, 15 bp, Homo sapiens
agtaccctatcatcc

SEQ ID NO: 323455 - DNA, 15 bp, Homo sapiens
gtaccctatcatcca

SEQ ID NO: 323456 - DNA, 15 bp, Homo sapiens
taccctatcatccaa

SEQ ID NO: 323457 - DNA, 15 bp, Homo sapiens
accctatcatccaat

SEQ ID NO: 323458 - DNA, 15 bp, Homo sapiens
ccctatcatccaata

SEQ ID NO: 323459 - DNA, 15 bp, Homo sapiens
cctatcatccaatat

SEQ ID NO: 323460 - DNA, 15 bp, Homo sapiens
ctatcatccaatatc

SEQ ID NO: 323461 - DNA, 15 bp, Homo sapiens
tatcatccaatatct

SEQ ID NO: 323462 - DNA, 15 bp, Homo sapiens
atcatccaatatctt

SEQ ID NO: 323463 - DNA, 15 bp, Homo sapiens
tcatccaatatcttc

SEQ ID NO: 323464 - DNA, 15 bp, Homo sapiens
catccaatatcttca

SEQ ID NO: 323465 - DNA, 15 bp, Homo sapiens
atccaatatcttcat

SEQ ID NO: 323466 - DNA, 15 bp, Homo sapiens
tccaatatcttcatc

SEQ ID NO: 323467 - DNA, 15 bp, Homo sapiens
ccaatatcttcatca

SEQ ID NO: 323468 - DNA, 15 bp, Homo sapiens
caatatcttcatcat

SEQ ID NO: 323469 - DNA, 15 bp, Homo sapiens
aatatcttcatcatt

SEQ ID NO: 323470 - DNA, 15 bp, Homo sapiens
atatcttcatcattc

SEQ ID NO: 323471 - DNA, 15 bp, Homo sapiens
tatcttcatcattct

SEQ ID NO: 323472 - DNA, 15 bp, Homo sapiens
atcttcatcattctg

SEQ ID NO: 323473 - DNA, 15 bp, Homo sapiens
tcttcatcattctgc

SEQ ID NO: 323474 - DNA, 15 bp, Homo sapiens
cttcatcattctgca

SEQ ID NO: 323475 - DNA, 15 bp, Homo sapiens
ttcatcattctgcag

SEQ ID NO: 323476 - DNA, 15 bp, Homo sapiens
tcatcattctgcaga

SEQ ID NO: 323477 - DNA, 15 bp, Homo sapiens
catcattctgcagaa

SEQ ID NO: 323478 - DNA, 15 bp, Homo sapiens
atcattctgcagaaa

SEQ ID NO: 323479 - DNA, 15 bp, Homo sapiens
tcattctgcagaaaa

SEQ ID NO: 323480 - DNA, 15 bp, Homo sapiens
cattctgcagaaaat

SEQ ID NO: 323481 - DNA, 15 bp, Homo sapiens
attctgcagaaaatg

SEQ ID NO: 323482 - DNA, 15 bp, Homo sapiens
ttctgcagaaaatgt

SEQ ID NO: 323483 - DNA, 15 bp, Homo sapiens
tctgcagaaaatgta

SEQ ID NO: 323484 - DNA, 15 bp, Homo sapiens
ctgcagaaaatgtat

SEQ ID NO: 323485 - DNA, 15 bp, Homo sapiens
tgcagaaaatgtatg

SEQ ID NO: 323486 - DNA, 15 bp, Homo sapiens
gcagaaaatgtatga

SEQ ID NO: 323487 - DNA, 15 bp, Homo sapiens
cagaaaatgtatgaa

SEQ ID NO: 323488 - DNA, 15 bp, Homo sapiens
agaaaatgtatgaat

SEQ ID NO: 323489 - DNA, 15 bp, Homo sapiens
gaaaatgtatgaata

SEQ ID NO: 323490 - DNA, 15 bp, Homo sapiens
aaaatgtatgaatat

SEQ ID NO: 323491 - DNA, 15 bp, Homo sapiens
aaatgtatgaatatt

SEQ ID NO: 323492 - DNA, 15 bp, Homo sapiens
aatgtatgaatattt

SEQ ID NO: 323493 - DNA, 15 bp, Homo sapiens
atgtatgaatattta

SEQ ID NO: 323494 - DNA, 15 bp, Homo sapiens
tgtatgaatatttac

SEQ ID NO: 323495 - DNA, 15 bp, Homo sapiens
gtatgaatatttaca

SEQ ID NO: 323496 - DNA, 15 bp, Homo sapiens
tatgaatatttacac

SEQ ID NO: 323497 - DNA, 15 bp, Homo sapiens
atgaatatttacact

SEQ ID NO: 323498 - DNA, 15 bp, Homo sapiens
tgaatatttacacta

SEQ ID NO: 323499 - DNA, 15 bp, Homo sapiens
gaatatttacactaa

SEQ ID NO: 323500 - DNA, 15 bp, Homo sapiens
aatatttacactaag

SEQ ID NO: 323501 - DNA, 15 bp, Homo sapiens
atatttacactaagt

SEQ ID NO: 323502 - DNA, 15 bp, Homo sapiens
tatttacactaagtg

SEQ ID NO: 323503 - DNA, 15 bp, Homo sapiens
atttacactaagtgg

SEQ ID NO: 323504 - DNA, 15 bp, Homo sapiens
tttacactaagtgga

SEQ ID NO: 323505 - DNA, 15 bp, Homo sapiens
ttacactaagtggaa

SEQ ID NO: 323506 - DNA, 15 bp, Homo sapiens
tacactaagtggaac

SEQ ID NO: 323507 - DNA, 15 bp, Homo sapiens
acactaagtggaaca

SEQ ID NO: 323508 - DNA, 15 bp, Homo sapiens
cactaagtggaacac

SEQ ID NO: 323509 - DNA, 15 bp, Homo sapiens
actaagtggaacaca

SEQ ID NO: 323510 - DNA, 15 bp, Homo sapiens
ctaagtggaacacaa

SEQ ID NO: 323511 - DNA, 15 bp, Homo sapiens
taagtggaacacaaa

SEQ ID NO: 323512 - DNA, 15 bp, Homo sapiens
aagtggaacacaaac

SEQ ID NO: 323513 - DNA, 15 bp, Homo sapiens
agtggaacacaaaca

SEQ ID NO: 323514 - DNA, 15 bp, Homo sapiens
gtggaacacaaacag

SEQ ID NO: 323515 - DNA, 15 bp, Homo sapiens
tggaacacaaacagg

SEQ ID NO: 323516 - DNA, 15 bp, Homo sapiens
ggaacacaaacaggg

SEQ ID NO: 323517 - DNA, 15 bp, Homo sapiens
gaacacaaacagggt

SEQ ID NO: 323518 - DNA, 15 bp, Homo sapiens
aacacaaacagggtt

SEQ ID NO: 323519 - DNA, 15 bp, Homo sapiens
acacaaacagggtta

SEQ ID NO: 323520 - DNA, 15 bp, Homo sapiens
cacaaacagggttat

SEQ ID NO: 323521 - DNA, 15 bp, Homo sapiens
acaaacagggttata

SEQ ID NO: 323522 - DNA, 15 bp, Homo sapiens
caaacagggttataa

SEQ ID NO: 323523 - DNA, 15 bp, Homo sapiens
aaacagggttataaa

SEQ ID NO: 323524 - DNA, 15 bp, Homo sapiens
aacagggttataaat

SEQ ID NO: 323525 - DNA, 15 bp, Homo sapiens
acagggttataaata

SEQ ID NO: 323526 - DNA, 15 bp, Homo sapiens
cagggttataaatag

SEQ ID NO: 323527 - DNA, 15 bp, Homo sapiens
agggttataaatagc

SEQ ID NO: 323528 - DNA, 15 bp, Homo sapiens
gggttataaatagcc

SEQ ID NO: 323529 - DNA, 15 bp, Homo sapiens
ggttataaatagcct

SEQ ID NO: 323530 - DNA, 15 bp, Homo sapiens
gttataaatagcctc

SEQ ID NO: 323531 - DNA, 15 bp, Homo sapiens
ttataaatagcctca

SEQ ID NO: 323532 - DNA, 15 bp, Homo sapiens
tataaatagcctcag

SEQ ID NO: 323533 - DNA, 15 bp, Homo sapiens
ataaatagcctcagg

SEQ ID NO: 323534 - DNA, 15 bp, Homo sapiens
taaatagcctcaggt

SEQ ID NO: 323535 - DNA, 15 bp, Homo sapiens
aaatagcctcaggtc

SEQ ID NO: 323536 - DNA, 15 bp, Homo sapiens
aatagcctcaggtca

SEQ ID NO: 323537 - DNA, 15 bp, Homo sapiens
atagcctcaggtcag

SEQ ID NO: 323538 - DNA, 15 bp, Homo sapiens
tagcctcaggtcagt

SEQ ID NO: 323539 - DNA, 15 bp, Homo sapiens
agcctcaggtcagtt

SEQ ID NO: 323540 - DNA, 15 bp, Homo sapiens
gcctcaggtcagttc

SEQ ID NO: 323541 - DNA, 15 bp, Homo sapiens
cctcaggtcagttca

SEQ ID NO: 323542 - DNA, 15 bp, Homo sapiens
ctcaggtcagttcag

SEQ ID NO: 323543 - DNA, 15 bp, Homo sapiens
tcaggtcagttcagg

SEQ ID NO: 323544 - DNA, 15 bp, Homo sapiens
caggtcagttcaggt

SEQ ID NO: 323545 - DNA, 15 bp, Homo sapiens
aggtcagttcaggtc

SEQ ID NO: 323546 - DNA, 15 bp, Homo sapiens
ggtcagttcaggtca

SEQ ID NO: 323547 - DNA, 15 bp, Homo sapiens
gtcagttcaggtcac

SEQ ID NO: 323548 - DNA, 15 bp, Homo sapiens
tcagttcaggtcacg

SEQ ID NO: 323549 - DNA, 15 bp, Homo sapiens
cagttcaggtcacgt

SEQ ID NO: 323550 - DNA, 15 bp, Homo sapiens
agttcaggtcacgtt

SEQ ID NO: 323551 - DNA, 15 bp, Homo sapiens
gttcaggtcacgttt

SEQ ID NO: 323552 - DNA, 15 bp, Homo sapiens
ttcaggtcacgtttt

SEQ ID NO: 323553 - DNA, 15 bp, Homo sapiens
tcaggtcacgttttg

SEQ ID NO: 323554 - DNA, 15 bp, Homo sapiens
caggtcacgttttgc

SEQ ID NO: 323555 - DNA, 15 bp, Homo sapiens
aggtcacgttttgct

SEQ ID NO: 323556 - DNA, 15 bp, Homo sapiens
ggtcacgttttgctg

SEQ ID NO: 323557 - DNA, 15 bp, Homo sapiens
gtcacgttttgctgc

SEQ ID NO: 323558 - DNA, 15 bp, Homo sapiens
tcacgttttgctgcc

SEQ ID NO: 323559 - DNA, 15 bp, Homo sapiens
cacgttttgctgcca

SEQ ID NO: 323560 - DNA, 15 bp, Homo sapiens
acgttttgctgccaa

SEQ ID NO: 323561 - DNA, 15 bp, Homo sapiens
cgttttgctgccaaa

SEQ ID NO: 323562 - DNA, 15 bp, Homo sapiens
gttttgctgccaaat

SEQ ID NO: 323563 - DNA, 15 bp, Homo sapiens
ttttgctgccaaatg

SEQ ID NO: 323564 - DNA, 15 bp, Homo sapiens
tttgctgccaaatgg

SEQ ID NO: 323565 - DNA, 15 bp, Homo sapiens
ttgctgccaaatggg

SEQ ID NO: 323566 - DNA, 15 bp, Homo sapiens
tgctgccaaatgggt

SEQ ID NO: 323567 - DNA, 15 bp, Homo sapiens
gctgccaaatgggtt

SEQ ID NO: 323568 - DNA, 15 bp, Homo sapiens
ctgccaaatgggtta

SEQ ID NO: 323569 - DNA, 15 bp, Homo sapiens
tgccaaatgggttat

SEQ ID NO: 323570 - DNA, 15 bp, Homo sapiens
gccaaatgggttatg

SEQ ID NO: 323571 - DNA, 15 bp, Homo sapiens
ccaaatgggttatgg

SEQ ID NO: 323572 - DNA, 15 bp, Homo sapiens
caaatgggttatgga

SEQ ID NO: 323573 - DNA, 15 bp, Homo sapiens
aaatgggttatggaa

SEQ ID NO: 323574 - DNA, 15 bp, Homo sapiens
aatgggttatggaaa

SEQ ID NO: 323575 - DNA, 15 bp, Homo sapiens
atgggttatggaaaa

SEQ ID NO: 323576 - DNA, 15 bp, Homo sapiens
tgggttatggaaaaa

SEQ ID NO: 323577 - DNA, 15 bp, Homo sapiens
gggttatggaaaaag

SEQ ID NO: 323578 - DNA, 15 bp, Homo sapiens
ggttatggaaaaagc

SEQ ID NO: 323579 - DNA, 15 bp, Homo sapiens
gttatggaaaaagcc

SEQ ID NO: 323580 - DNA, 15 bp, Homo sapiens
ttatggaaaaagcct

SEQ ID NO: 323581 - DNA, 15 bp, Homo sapiens
tatggaaaaagcctt

SEQ ID NO: 323582 - DNA, 15 bp, Homo sapiens
atggaaaaagccttt

SEQ ID NO: 323583 - DNA, 15 bp, Homo sapiens
tggaaaaagcctttg

SEQ ID NO: 323584 - DNA, 15 bp, Homo sapiens
ggaaaaagcctttgg

SEQ ID NO: 323585 - DNA, 15 bp, Homo sapiens
gaaaaagcctttggt

SEQ ID NO: 323586 - DNA, 15 bp, Homo sapiens
aaaaagcctttggtt

SEQ ID NO: 323587 - DNA, 15 bp, Homo sapiens
aaaagcctttggttt

SEQ ID NO: 323588 - DNA, 15 bp, Homo sapiens
aaagcctttggtttc

SEQ ID NO: 323589 - DNA, 15 bp, Homo sapiens
aagcctttggtttcc

SEQ ID NO: 323590 - DNA, 15 bp, Homo sapiens
agcctttggtttcca

SEQ ID NO: 323591 - DNA, 15 bp, Homo sapiens
gcctttggtttccag

SEQ ID NO: 323592 - DNA, 15 bp, Homo sapiens
cctttggtttccaga

SEQ ID NO: 323593 - DNA, 15 bp, Homo sapiens
ctttggtttccagag

SEQ ID NO: 323594 - DNA, 15 bp, Homo sapiens
tttggtttccagagc

SEQ ID NO: 323595 - DNA, 15 bp, Homo sapiens
ttggtttccagagct

SEQ ID NO: 323596 - DNA, 15 bp, Homo sapiens
tggtttccagagctt

SEQ ID NO: 323597 - DNA, 15 bp, Homo sapiens
ggtttccagagcttt

SEQ ID NO: 323598 - DNA, 15 bp, Homo sapiens
gtttccagagctttt

SEQ ID NO: 323599 - DNA, 15 bp, Homo sapiens
tttccagagcttttc

SEQ ID NO: 323600 - DNA, 15 bp, Homo sapiens
ttccagagcttttca

SEQ ID NO: 323601 - DNA, 15 bp, Homo sapiens
tccagagcttttcag

SEQ ID NO: 323602 - DNA, 15 bp, Homo sapiens
ccagagcttttcaga

SEQ ID NO: 323603 - DNA, 15 bp, Homo sapiens
cagagcttttcagat

SEQ ID NO: 323604 - DNA, 15 bp, Homo sapiens
agagcttttcagatc

SEQ ID NO: 323605 - DNA, 15 bp, Homo sapiens
gagcttttcagatcc

SEQ ID NO: 323606 - DNA, 15 bp, Homo sapiens
agcttttcagatcct

SEQ ID NO: 323607 - DNA, 15 bp, Homo sapiens
gcttttcagatcctg

SEQ ID NO: 323608 - DNA, 15 bp, Homo sapiens
cttttcagatcctgg

SEQ ID NO: 323609 - DNA, 15 bp, Homo sapiens
ttttcagatcctggc

SEQ ID NO: 323610 - DNA, 15 bp, Homo sapiens
tttcagatcctggca

SEQ ID NO: 323611 - DNA, 15 bp, Homo sapiens
ttcagatcctggcat

SEQ ID NO: 323612 - DNA, 15 bp, Homo sapiens
tcagatcctggcatt

SEQ ID NO: 323613 - DNA, 15 bp, Homo sapiens
cagatcctggcattg

SEQ ID NO: 323614 - DNA, 15 bp, Homo sapiens
agatcctggcattgt

SEQ ID NO: 323615 - DNA, 15 bp, Homo sapiens
gatcctggcattgtg

SEQ ID NO: 323616 - DNA, 15 bp, Homo sapiens
atcctggcattgtgg

SEQ ID NO: 323617 - DNA, 15 bp, Homo sapiens
tcctggcattgtgga

SEQ ID NO: 323618 - DNA, 15 bp, Homo sapiens
cctggcattgtggat

SEQ ID NO: 323619 - DNA, 15 bp, Homo sapiens
ctggcattgtggata

SEQ ID NO: 323620 - DNA, 15 bp, Homo sapiens
tggcattgtggataa

SEQ ID NO: 323621 - DNA, 15 bp, Homo sapiens
ggcattgtggataag

SEQ ID NO: 323622 - DNA, 15 bp, Homo sapiens
gcattgtggataagg

SEQ ID NO: 323623 - DNA, 15 bp, Homo sapiens
cattgtggataaggg

SEQ ID NO: 323624 - DNA, 15 bp, Homo sapiens
attgtggataaggga

SEQ ID NO: 323625 - DNA, 15 bp, Homo sapiens
ttgtggataagggat

SEQ ID NO: 323626 - DNA, 15 bp, Homo sapiens
tgtggataagggatt

SEQ ID NO: 323627 - DNA, 15 bp, Homo sapiens
gtggataagggattg

SEQ ID NO: 323628 - DNA, 15 bp, Homo sapiens
tggataagggattgt

SEQ ID NO: 323629 - DNA, 15 bp, Homo sapiens
ggataagggattgtg

SEQ ID NO: 323630 - DNA, 15 bp, Homo sapiens
gataagggattgtgc

SEQ ID NO: 323631 - DNA, 15 bp, Homo sapiens
ataagggattgtgca

SEQ ID NO: 323632 - DNA, 15 bp, Homo sapiens
taagggattgtgcac

SEQ ID NO: 323633 - DNA, 15 bp, Homo sapiens
aagggattgtgcacc

SEQ ID NO: 323634 - DNA, 15 bp, Homo sapiens
agggattgtgcacct

SEQ ID NO: 323635 - DNA, 15 bp, Homo sapiens
gggattgtgcacctg

SEQ ID NO: 323636 - DNA, 15 bp, Homo sapiens
ggattgtgcacctgg

SEQ ID NO: 323637 - DNA, 15 bp, Homo sapiens
gattgtgcacctggt

SEQ ID NO: 323638 - DNA, 15 bp, Homo sapiens
attgtgcacctggta

SEQ ID NO: 323639 - DNA, 15 bp, Homo sapiens
ttgtgcacctggtat

SEQ ID NO: 323640 - DNA, 15 bp, Homo sapiens
tgtgcacctggtatg

SEQ ID NO: 323641 - DNA, 15 bp, Homo sapiens
aggtgttaattataa

SEQ ID NO: 323642 - DNA, 15 bp, Homo sapiens
ggtgttaattataac

SEQ ID NO: 323643 - DNA, 15 bp, Homo sapiens
gtgttaattataact

SEQ ID NO: 323644 - DNA, 15 bp, Homo sapiens
tgttaattataactc

SEQ ID NO: 323645 - DNA, 15 bp, Homo sapiens
gttaattataactct

SEQ ID NO: 323646 - DNA, 15 bp, Homo sapiens
ttaattataactctt

SEQ ID NO: 323647 - DNA, 15 bp, Homo sapiens
taattataactcttt

SEQ ID NO: 323648 - DNA, 15 bp, Homo sapiens
aattataactctttc

SEQ ID NO: 323649 - DNA, 15 bp, Homo sapiens
attataactctttcc

SEQ ID NO: 323650 - DNA, 15 bp, Homo sapiens
ttataactctttccg

SEQ ID NO: 323651 - DNA, 15 bp, Homo sapiens
tataactctttccgg

SEQ ID NO: 323652 - DNA, 15 bp, Homo sapiens
ataactctttccggt

SEQ ID NO: 323653 - DNA, 15 bp, Homo sapiens
taactctttccggtg

SEQ ID NO: 323654 - DNA, 15 bp, Homo sapiens
aactctttccggtgg

SEQ ID NO: 323655 - DNA, 15 bp, Homo sapiens
actctttccggtggt

SEQ ID NO: 323656 - DNA, 15 bp, Homo sapiens
ctctttccggtggtt

SEQ ID NO: 323657 - DNA, 15 bp, Homo sapiens
tctttccggtggtta

SEQ ID NO: 323658 - DNA, 15 bp, Homo sapiens
ctttccggtggttat

SEQ ID NO: 323659 - DNA, 15 bp, Homo sapiens
tttccggtggttatg

SEQ ID NO: 323660 - DNA, 15 bp, Homo sapiens
ttccggtggttatgt

SEQ ID NO: 323661 - DNA, 15 bp, Homo sapiens
tccggtggttatgtg

SEQ ID NO: 323662 - DNA, 15 bp, Homo sapiens
ccggtggttatgtgc

SEQ ID NO: 323663 - DNA, 15 bp, Homo sapiens
cggtggttatgtgca

SEQ ID NO: 323664 - DNA, 15 bp, Homo sapiens
ggtggttatgtgcat

SEQ ID NO: 323665 - DNA, 15 bp, Homo sapiens
gtggttatgtgcata

SEQ ID NO: 323666 - DNA, 15 bp, Homo sapiens
tggttatgtgcatat

SEQ ID NO: 323667 - DNA, 15 bp, Homo sapiens
ggttatgtgcatata

SEQ ID NO: 323668 - DNA, 15 bp, Homo sapiens
gttatgtgcatatat

SEQ ID NO: 323669 - DNA, 15 bp, Homo sapiens
ttatgtgcatatatt

SEQ ID NO: 323670 - DNA, 15 bp, Homo sapiens
tatgtgcatatattc

SEQ ID NO: 323671 - DNA, 15 bp, Homo sapiens
atgtgcatatattca

SEQ ID NO: 323672 - DNA, 15 bp, Homo sapiens
tgtgcatatattcac

SEQ ID NO: 323673 - DNA, 15 bp, Homo sapiens
gtgcatatattcaca

SEQ ID NO: 323674 - DNA, 15 bp, Homo sapiens
tgcatatattcacag

SEQ ID NO: 323675 - DNA, 15 bp, Homo sapiens
gcatatattcacaga

SEQ ID NO: 323676 - DNA, 15 bp, Homo sapiens
catatattcacagag

SEQ ID NO: 323677 - DNA, 15 bp, Homo sapiens
atatattcacagagt

SEQ ID NO: 323678 - DNA, 15 bp, Homo sapiens
tatattcacagagtt

SEQ ID NO: 323679 - DNA, 15 bp, Homo sapiens
atattcacagagttg

SEQ ID NO: 323680 - DNA, 15 bp, Homo sapiens
tattcacagagttgt

SEQ ID NO: 323681 - DNA, 15 bp, Homo sapiens
attcacagagttgtt

SEQ ID NO: 323682 - DNA, 15 bp, Homo sapiens
ttcacagagttgtta

SEQ ID NO: 323683 - DNA, 15 bp, Homo sapiens
tcacagagttgttac

SEQ ID NO: 323684 - DNA, 15 bp, Homo sapiens
cacagagttgttaca

SEQ ID NO: 323685 - DNA, 15 bp, Homo sapiens
acagagttgttacag

SEQ ID NO: 323686 - DNA, 15 bp, Homo sapiens
cagagttgttacaga

SEQ ID NO: 323687 - DNA, 15 bp, Homo sapiens
agagttgttacagaa

SEQ ID NO: 323688 - DNA, 15 bp, Homo sapiens
gagttgttacagaag

SEQ ID NO: 323689 - DNA, 15 bp, Homo sapiens
agttgttacagaagt

SEQ ID NO: 323690 - DNA, 15 bp, Homo sapiens
gttgttacagaagta

SEQ ID NO: 323691 - DNA, 15 bp, Homo sapiens
ttgttacagaagtaa

SEQ ID NO: 323692 - DNA, 15 bp, Homo sapiens
tgttacagaagtaag

SEQ ID NO: 323693 - DNA, 15 bp, Homo sapiens
gttacagaagtaagg

SEQ ID NO: 323694 - DNA, 15 bp, Homo sapiens
ttacagaagtaaggg

SEQ ID NO: 323695 - DNA, 15 bp, Homo sapiens
tacagaagtaagggg

SEQ ID NO: 323696 - DNA, 15 bp, Homo sapiens
acagaagtaagggga

SEQ ID NO: 323697 - DNA, 15 bp, Homo sapiens
cagaagtaaggggac

SEQ ID NO: 323698 - DNA, 15 bp, Homo sapiens
agaagtaaggggact

SEQ ID NO: 323699 - DNA, 15 bp, Homo sapiens
gaagtaaggggactg

SEQ ID NO: 323700 - DNA, 15 bp, Homo sapiens
aagtaaggggactgg

SEQ ID NO: 323701 - DNA, 15 bp, Homo sapiens
agtaaggggactggg

SEQ ID NO: 323702 - DNA, 15 bp, Homo sapiens
gtaaggggactgggc

SEQ ID NO: 323703 - DNA, 15 bp, Homo sapiens
taaggggactgggct

SEQ ID NO: 323704 - DNA, 15 bp, Homo sapiens
aaggggactgggctg

SEQ ID NO: 323705 - DNA, 15 bp, Homo sapiens
aggggactgggctgc

SEQ ID NO: 323706 - DNA, 15 bp, Homo sapiens
ggggactgggctgct

SEQ ID NO: 323707 - DNA, 15 bp, Homo sapiens
gggactgggctgctc

SEQ ID NO: 323708 - DNA, 15 bp, Homo sapiens
ggactgggctgctca

SEQ ID NO: 323709 - DNA, 15 bp, Homo sapiens
gactgggctgctcat

SEQ ID NO: 323710 - DNA, 15 bp, Homo sapiens
actgggctgctcatg

SEQ ID NO: 323711 - DNA, 15 bp, Homo sapiens
ctgggctgctcatgg

SEQ ID NO: 323712 - DNA, 15 bp, Homo sapiens
tgggctgctcatggt

SEQ ID NO: 323713 - DNA, 15 bp, Homo sapiens
gggctgctcatggtg

SEQ ID NO: 323714 - DNA, 15 bp, Homo sapiens
ggctgctcatggtgg

SEQ ID NO: 323715 - DNA, 15 bp, Homo sapiens
gctgctcatggtggc

SEQ ID NO: 323716 - DNA, 15 bp, Homo sapiens
ctgctcatggtggct

SEQ ID NO: 323717 - DNA, 15 bp, Homo sapiens
tgctcatggtggctc

SEQ ID NO: 323718 - DNA, 15 bp, Homo sapiens
gctcatggtggctca

SEQ ID NO: 323719 - DNA, 15 bp, Homo sapiens
ctcatggtggctcat

SEQ ID NO: 323720 - DNA, 15 bp, Homo sapiens
tcatggtggctcatg

SEQ ID NO: 323721 - DNA, 15 bp, Homo sapiens
cctgtaatcccagcg

SEQ ID NO: 323722 - DNA, 15 bp, Homo sapiens
ctgtaatcccagcgc

SEQ ID NO: 323723 - DNA, 15 bp, Homo sapiens
tgtaatcccagcgct

SEQ ID NO: 323724 - DNA, 15 bp, Homo sapiens
gtaatcccagcgctt

SEQ ID NO: 323725 - DNA, 15 bp, Homo sapiens
taatcccagcgcttt

SEQ ID NO: 323726 - DNA, 15 bp, Homo sapiens
aatcccagcgctttg

SEQ ID NO: 323727 - DNA, 15 bp, Homo sapiens
atcccagcgctttgg

SEQ ID NO: 323728 - DNA, 15 bp, Homo sapiens
tcccagcgctttggg

SEQ ID NO: 323729 - DNA, 15 bp, Homo sapiens
cccagcgctttggga

SEQ ID NO: 323730 - DNA, 15 bp, Homo sapiens
ccagcgctttgggag

SEQ ID NO: 323731 - DNA, 15 bp, Homo sapiens
cagcgctttgggagg

SEQ ID NO: 323732 - DNA, 15 bp, Homo sapiens
agcgctttgggaggc

SEQ ID NO: 323733 - DNA, 15 bp, Homo sapiens
gcgctttgggaggcc

SEQ ID NO: 323734 - DNA, 15 bp, Homo sapiens
cgctttgggaggccg

SEQ ID NO: 323735 - DNA, 15 bp, Homo sapiens
gctttgggaggccga

SEQ ID NO: 323736 - DNA, 15 bp, Homo sapiens
tttgggaggccgagt

SEQ ID NO: 323737 - DNA, 15 bp, Homo sapiens
ttgggaggccgagtg

SEQ ID NO: 323738 - DNA, 15 bp, Homo sapiens
tgggaggccgagtgg

SEQ ID NO: 323739 - DNA, 15 bp, Homo sapiens
gggaggccgagtggg

SEQ ID NO: 323740 - DNA, 15 bp, Homo sapiens
ggaggccgagtgggt

SEQ ID NO: 323741 - DNA, 15 bp, Homo sapiens
gaggccgagtgggtg

SEQ ID NO: 323742 - DNA, 15 bp, Homo sapiens
aggccgagtgggtgg

SEQ ID NO: 323743 - DNA, 15 bp, Homo sapiens
ggccgagtgggtgga

SEQ ID NO: 323744 - DNA, 15 bp, Homo sapiens
gccgagtgggtggat

SEQ ID NO: 323745 - DNA, 15 bp, Homo sapiens
ccgagtgggtggatc

SEQ ID NO: 323746 - DNA, 15 bp, Homo sapiens
cgagtgggtggatct

SEQ ID NO: 323747 - DNA, 15 bp, Homo sapiens
gagtgggtggatctc

SEQ ID NO: 323748 - DNA, 15 bp, Homo sapiens
agtgggtggatctcc

SEQ ID NO: 323749 - DNA, 15 bp, Homo sapiens
gtgggtggatctcct

SEQ ID NO: 323750 - DNA, 15 bp, Homo sapiens
tgggtggatctcctg

SEQ ID NO: 323751 - DNA, 15 bp, Homo sapiens
gggtggatctcctga

SEQ ID NO: 323752 - DNA, 15 bp, Homo sapiens
ggtggatctcctgag

SEQ ID NO: 323753 - DNA, 15 bp, Homo sapiens
gtggatctcctgagg

SEQ ID NO: 323754 - DNA, 15 bp, Homo sapiens
tggatctcctgaggt

SEQ ID NO: 323755 - DNA, 15 bp, Homo sapiens
ggatctcctgaggtc

SEQ ID NO: 323756 - DNA, 15 bp, Homo sapiens
gatctcctgaggtca

SEQ ID NO: 323757 - DNA, 15 bp, Homo sapiens
atctcctgaggtcag

SEQ ID NO: 323758 - DNA, 15 bp, Homo sapiens
tctcctgaggtcagg

SEQ ID NO: 323759 - DNA, 15 bp, Homo sapiens
ctcctgaggtcagga

SEQ ID NO: 323760 - DNA, 15 bp, Homo sapiens
tcctgaggtcaggag

SEQ ID NO: 323761 - DNA, 15 bp, Homo sapiens
ctggccaacatggca

SEQ ID NO: 323762 - DNA, 15 bp, Homo sapiens
caacatggcaaaacc

SEQ ID NO: 323763 - DNA, 15 bp, Homo sapiens
catggcaaaaccccg

SEQ ID NO: 323764 - DNA, 15 bp, Homo sapiens
tctactaaaaataac

SEQ ID NO: 323765 - DNA, 15 bp, Homo sapiens
ctactaaaaataaca

SEQ ID NO: 323766 - DNA, 15 bp, Homo sapiens
tactaaaaataacaa

SEQ ID NO: 323767 - DNA, 15 bp, Homo sapiens
actaaaaataacaaa

SEQ ID NO: 323768 - DNA, 15 bp, Homo sapiens
ctaaaaataacaaaa

SEQ ID NO: 323769 - DNA, 15 bp, Homo sapiens
taaaaataacaaaaa

SEQ ID NO: 323770 - DNA, 15 bp, Homo sapiens
aaaaataacaaaaat

SEQ ID NO: 323771 - DNA, 15 bp, Homo sapiens
aaaataacaaaaatt

SEQ ID NO: 323772 - DNA, 15 bp, Homo sapiens
aaataacaaaaatta

SEQ ID NO: 323773 - DNA, 15 bp, Homo sapiens
aataacaaaaattag

SEQ ID NO: 323774 - DNA, 15 bp, Homo sapiens
ataacaaaaattagc

SEQ ID NO: 323775 - DNA, 15 bp, Homo sapiens
taacaaaaattagct

SEQ ID NO: 323776 - DNA, 15 bp, Homo sapiens
aacaaaaattagctg

SEQ ID NO: 323777 - DNA, 15 bp, Homo sapiens
aaaaattagctgggc

SEQ ID NO: 323778 - DNA, 15 bp, Homo sapiens
gctgggcatggtggc

SEQ ID NO: 323779 - DNA, 15 bp, Homo sapiens
ctgggcatggtggcg

SEQ ID NO: 323780 - DNA, 15 bp, Homo sapiens
tgggcatggtggcgg

SEQ ID NO: 323781 - DNA, 15 bp, Homo sapiens
gggcatggtggcggg

SEQ ID NO: 323782 - DNA, 15 bp, Homo sapiens
ggcatggtggcgggt

SEQ ID NO: 323783 - DNA, 15 bp, Homo sapiens
gcatggtggcgggta

SEQ ID NO: 323784 - DNA, 15 bp, Homo sapiens
catggtggcgggtac

SEQ ID NO: 323785 - DNA, 15 bp, Homo sapiens
atggtggcgggtacc

SEQ ID NO: 323786 - DNA, 15 bp, Homo sapiens
tggtggcgggtacct

SEQ ID NO: 323787 - DNA, 15 bp, Homo sapiens
ggtggcgggtacctg

SEQ ID NO: 323788 - DNA, 15 bp, Homo sapiens
gtggcgggtacctgg

SEQ ID NO: 323789 - DNA, 15 bp, Homo sapiens
tggcgggtacctgga

SEQ ID NO: 323790 - DNA, 15 bp, Homo sapiens
ggcgggtacctggaa

SEQ ID NO: 323791 - DNA, 15 bp, Homo sapiens
gcgggtacctggaat

SEQ ID NO: 323792 - DNA, 15 bp, Homo sapiens
cgggtacctggaatc

SEQ ID NO: 323793 - DNA, 15 bp, Homo sapiens
gggtacctggaatcc

SEQ ID NO: 323794 - DNA, 15 bp, Homo sapiens
ggtacctggaatcct

SEQ ID NO: 323795 - DNA, 15 bp, Homo sapiens
gtacctggaatccta

SEQ ID NO: 323796 - DNA, 15 bp, Homo sapiens
tacctggaatcctag

SEQ ID NO: 323797 - DNA, 15 bp, Homo sapiens
acctggaatcctagc

SEQ ID NO: 323798 - DNA, 15 bp, Homo sapiens
cctggaatcctagca

SEQ ID NO: 323799 - DNA, 15 bp, Homo sapiens
ctggaatcctagcaa

SEQ ID NO: 323800 - DNA, 15 bp, Homo sapiens
tggaatcctagcaac

SEQ ID NO: 323801 - DNA, 15 bp, Homo sapiens
ggaatcctagcaact

SEQ ID NO: 323802 - DNA, 15 bp, Homo sapiens
gaatcctagcaactc

SEQ ID NO: 323803 - DNA, 15 bp, Homo sapiens
aatcctagcaactcg

SEQ ID NO: 323804 - DNA, 15 bp, Homo sapiens
atcctagcaactcgt

SEQ ID NO: 323805 - DNA, 15 bp, Homo sapiens
tcctagcaactcgtg

SEQ ID NO: 323806 - DNA, 15 bp, Homo sapiens
cctagcaactcgtga

SEQ ID NO: 323807 - DNA, 15 bp, Homo sapiens
ctagcaactcgtgag

SEQ ID NO: 323808 - DNA, 15 bp, Homo sapiens
tagcaactcgtgagg

SEQ ID NO: 323809 - DNA, 15 bp, Homo sapiens
agcaactcgtgaggc

SEQ ID NO: 323810 - DNA, 15 bp, Homo sapiens
gcaactcgtgaggct

SEQ ID NO: 323811 - DNA, 15 bp, Homo sapiens
caactcgtgaggctg

SEQ ID NO: 323812 - DNA, 15 bp, Homo sapiens
aactcgtgaggctga

SEQ ID NO: 323813 - DNA, 15 bp, Homo sapiens
actcgtgaggctgag

SEQ ID NO: 323814 - DNA, 15 bp, Homo sapiens
ctcgtgaggctgagg

SEQ ID NO: 323815 - DNA, 15 bp, Homo sapiens
tcgtgaggctgaggc

SEQ ID NO: 323816 - DNA, 15 bp, Homo sapiens
cgtgaggctgaggcg

SEQ ID NO: 323817 - DNA, 15 bp, Homo sapiens
gtgaggctgaggcgg

SEQ ID NO: 323818 - DNA, 15 bp, Homo sapiens
tgaggctgaggcggg

SEQ ID NO: 323819 - DNA, 15 bp, Homo sapiens
gaggctgaggcggga

SEQ ID NO: 323820 - DNA, 15 bp, Homo sapiens
aggctgaggcgggag

SEQ ID NO: 323821 - DNA, 15 bp, Homo sapiens
ggctgaggcgggaga

SEQ ID NO: 323822 - DNA, 15 bp, Homo sapiens
gctgaggcgggagaa

SEQ ID NO: 323823 - DNA, 15 bp, Homo sapiens
ctgaggcgggagaat

SEQ ID NO: 323824 - DNA, 15 bp, Homo sapiens
tgaggcgggagaatc

SEQ ID NO: 323825 - DNA, 15 bp, Homo sapiens
gaggcgggagaatca

SEQ ID NO: 323826 - DNA, 15 bp, Homo sapiens
aggcgggagaatcac

SEQ ID NO: 323827 - DNA, 15 bp, Homo sapiens
ggcgggagaatcact

SEQ ID NO: 323828 - DNA, 15 bp, Homo sapiens
gcgggagaatcactt

SEQ ID NO: 323829 - DNA, 15 bp, Homo sapiens
cgggagaatcacttg

SEQ ID NO: 323830 - DNA, 15 bp, Homo sapiens
aatcacttgaacccg

SEQ ID NO: 323831 - DNA, 15 bp, Homo sapiens
atcacttgaacccgg

SEQ ID NO: 323832 - DNA, 15 bp, Homo sapiens
tcacttgaacccggg

SEQ ID NO: 323833 - DNA, 15 bp, Homo sapiens
cacttgaacccggga

SEQ ID NO: 323834 - DNA, 15 bp, Homo sapiens
acttgaacccgggag

SEQ ID NO: 323835 - DNA, 15 bp, Homo sapiens
cttgaacccgggagg

SEQ ID NO: 323836 - DNA, 15 bp, Homo sapiens
ttgaacccgggaggt

SEQ ID NO: 323837 - DNA, 15 bp, Homo sapiens
tgaacccgggaggtg

SEQ ID NO: 323838 - DNA, 15 bp, Homo sapiens
gaacccgggaggtgg

SEQ ID NO: 323839 - DNA, 15 bp, Homo sapiens
aacccgggaggtgga

SEQ ID NO: 323840 - DNA, 15 bp, Homo sapiens
acccgggaggtggag

SEQ ID NO: 323841 - DNA, 15 bp, Homo sapiens
cccgggaggtggagg

SEQ ID NO: 323842 - DNA, 15 bp, Homo sapiens
ccgggaggtggaggt

SEQ ID NO: 323843 - DNA, 15 bp, Homo sapiens
cgggaggtggaggtt

SEQ ID NO: 323844 - DNA, 15 bp, Homo sapiens
gtggaggttgcagtg

SEQ ID NO: 323845 - DNA, 15 bp, Homo sapiens
tggaggttgcagtga

SEQ ID NO: 323846 - DNA, 15 bp, Homo sapiens
ggttgcagtgagccg

SEQ ID NO: 323847 - DNA, 15 bp, Homo sapiens
gttgcagtgagccga

SEQ ID NO: 323848 - DNA, 15 bp, Homo sapiens
cagtgagccgagatc

SEQ ID NO: 323849 - DNA, 15 bp, Homo sapiens
agtgagccgagatca

SEQ ID NO: 323850 - DNA, 15 bp, Homo sapiens
gtgagccgagatcac

SEQ ID NO: 323851 - DNA, 15 bp, Homo sapiens
ccgagatcacaccat

SEQ ID NO: 323852 - DNA, 15 bp, Homo sapiens
cgagatcacaccatt

SEQ ID NO: 323853 - DNA, 15 bp, Homo sapiens
gcctgggcaacaagg

SEQ ID NO: 323854 - DNA, 15 bp, Homo sapiens
cctgggcaacaaggg

SEQ ID NO: 323855 - DNA, 15 bp, Homo sapiens
ctgggcaacaagggc

SEQ ID NO: 323856 - DNA, 15 bp, Homo sapiens
tgggcaacaagggcg

SEQ ID NO: 323857 - DNA, 15 bp, Homo sapiens
gggcaacaagggcga

SEQ ID NO: 323858 - DNA, 15 bp, Homo sapiens
ggcaacaagggcgaa

SEQ ID NO: 323859 - DNA, 15 bp, Homo sapiens
gcaacaagggcgaaa

SEQ ID NO: 323860 - DNA, 15 bp, Homo sapiens
caacaagggcgaaac

SEQ ID NO: 323861 - DNA, 15 bp, Homo sapiens
aacaagggcgaaact

SEQ ID NO: 323862 - DNA, 15 bp, Homo sapiens
acaagggcgaaactc

SEQ ID NO: 323863 - DNA, 15 bp, Homo sapiens
caagggcgaaactcc

SEQ ID NO: 323864 - DNA, 15 bp, Homo sapiens
aagggcgaaactccg

SEQ ID NO: 323865 - DNA, 15 bp, Homo sapiens
agggcgaaactccgt

SEQ ID NO: 323866 - DNA, 15 bp, Homo sapiens
gggcgaaactccgtc

SEQ ID NO: 323867 - DNA, 15 bp, Homo sapiens
ggcgaaactccgtct

SEQ ID NO: 323868 - DNA, 15 bp, Homo sapiens
gcgaaactccgtctc

SEQ ID NO: 323869 - DNA, 15 bp, Homo sapiens
cgaaactccgtctca

SEQ ID NO: 323870 - DNA, 15 bp, Homo sapiens
actccgtctcaaaac

SEQ ID NO: 323871 - DNA, 15 bp, Homo sapiens
ctccgtctcaaaaca

SEQ ID NO: 323872 - DNA, 15 bp, Homo sapiens
tccgtctcaaaacac

SEQ ID NO: 323873 - DNA, 15 bp, Homo sapiens
ccgtctcaaaacaca

SEQ ID NO: 323874 - DNA, 15 bp, Homo sapiens
cgtctcaaaacacaa

SEQ ID NO: 323875 - DNA, 15 bp, Homo sapiens
gtctcaaaacacaaa

SEQ ID NO: 323876 - DNA, 15 bp, Homo sapiens
tctcaaaacacaaaa

SEQ ID NO: 323877 - DNA, 15 bp, Homo sapiens
ctcaaaacacaaaac

SEQ ID NO: 323878 - DNA, 15 bp, Homo sapiens
tcaaaacacaaaaca

SEQ ID NO: 323879 - DNA, 15 bp, Homo sapiens
caaaacacaaaacaa

SEQ ID NO: 323880 - DNA, 15 bp, Homo sapiens
aaaacacaaaacaaa

SEQ ID NO: 323881 - DNA, 15 bp, Homo sapiens
aaacacaaaacaaaa

SEQ ID NO: 323882 - DNA, 15 bp, Homo sapiens
aacacaaaacaaaac

SEQ ID NO: 323883 - DNA, 15 bp, Homo sapiens
acacaaaacaaaaca

SEQ ID NO: 323884 - DNA, 15 bp, Homo sapiens
cacaaaacaaaacaa

SEQ ID NO: 323885 - DNA, 15 bp, Homo sapiens
caaaacaaaacaaag

SEQ ID NO: 323886 - DNA, 15 bp, Homo sapiens
aaaacaaaacaaagc

SEQ ID NO: 323887 - DNA, 15 bp, Homo sapiens
aaacaaaacaaagca

SEQ ID NO: 323888 - DNA, 15 bp, Homo sapiens
aacaaaacaaagcaa

SEQ ID NO: 323889 - DNA, 15 bp, Homo sapiens
acaaaacaaagcaaa

SEQ ID NO: 323890 - DNA, 15 bp, Homo sapiens
caaaacaaagcaaaa

SEQ ID NO: 323891 - DNA, 15 bp, Homo sapiens
aaaacaaagcaaaac

SEQ ID NO: 323892 - DNA, 15 bp, Homo sapiens
aaacaaagcaaaacg

SEQ ID NO: 323893 - DNA, 15 bp, Homo sapiens
aacaaagcaaaacga

SEQ ID NO: 323894 - DNA, 15 bp, Homo sapiens
acaaagcaaaacgaa

SEQ ID NO: 323895 - DNA, 15 bp, Homo sapiens
caaagcaaaacgaaa

SEQ ID NO: 323896 - DNA, 15 bp, Homo sapiens
aaagcaaaacgaaac

SEQ ID NO: 323897 - DNA, 15 bp, Homo sapiens
aagcaaaacgaaaca

SEQ ID NO: 323898 - DNA, 15 bp, Homo sapiens
agcaaaacgaaacaa

SEQ ID NO: 323899 - DNA, 15 bp, Homo sapiens
gcaaaacgaaacaaa

SEQ ID NO: 323900 - DNA, 15 bp, Homo sapiens
caaaacgaaacaaaa

SEQ ID NO: 323901 - DNA, 15 bp, Homo sapiens
aaaacgaaacaaaaa

SEQ ID NO: 323902 - DNA, 15 bp, Homo sapiens
aaacgaaacaaaaaa

SEQ ID NO: 323903 - DNA, 15 bp, Homo sapiens
aacgaaacaaaaaac

SEQ ID NO: 323904 - DNA, 15 bp, Homo sapiens
acgaaacaaaaaaca

SEQ ID NO: 323905 - DNA, 15 bp, Homo sapiens
cgaaacaaaaaacaa

SEQ ID NO: 323906 - DNA, 15 bp, Homo sapiens
gaaacaaaaaacaac

SEQ ID NO: 323907 - DNA, 15 bp, Homo sapiens
aaacaaaaaacaacg

SEQ ID NO: 323908 - DNA, 15 bp, Homo sapiens
aacaaaaaacaacgg

SEQ ID NO: 323909 - DNA, 15 bp, Homo sapiens
acaaaaaacaacgga

SEQ ID NO: 323910 - DNA, 15 bp, Homo sapiens
caaaaaacaacggaa

SEQ ID NO: 323911 - DNA, 15 bp, Homo sapiens
aaaaaacaacggaag

SEQ ID NO: 323912 - DNA, 15 bp, Homo sapiens
aaaaacaacggaagt

SEQ ID NO: 323913 - DNA, 15 bp, Homo sapiens
aaaacaacggaagtt

SEQ ID NO: 323914 - DNA, 15 bp, Homo sapiens
aaacaacggaagtta

SEQ ID NO: 323915 - DNA, 15 bp, Homo sapiens
aacaacggaagttag

SEQ ID NO: 323916 - DNA, 15 bp, Homo sapiens
acaacggaagttaga

SEQ ID NO: 323917 - DNA, 15 bp, Homo sapiens
caacggaagttagat

SEQ ID NO: 323918 - DNA, 15 bp, Homo sapiens
aacggaagttagatg

SEQ ID NO: 323919 - DNA, 15 bp, Homo sapiens
acggaagttagatgg

SEQ ID NO: 323920 - DNA, 15 bp, Homo sapiens
cggaagttagatggg

SEQ ID NO: 323921 - DNA, 15 bp, Homo sapiens
ggaagttagatgggg

SEQ ID NO: 323922 - DNA, 15 bp, Homo sapiens
gaagttagatggggc

SEQ ID NO: 323923 - DNA, 15 bp, Homo sapiens
aagttagatggggct

SEQ ID NO: 323924 - DNA, 15 bp, Homo sapiens
agttagatggggctg

SEQ ID NO: 323925 - DNA, 15 bp, Homo sapiens
gttagatggggctga

SEQ ID NO: 323926 - DNA, 15 bp, Homo sapiens
ttagatggggctgaa

SEQ ID NO: 323927 - DNA, 15 bp, Homo sapiens
tagatggggctgaat

SEQ ID NO: 323928 - DNA, 15 bp, Homo sapiens
agatggggctgaatt

SEQ ID NO: 323929 - DNA, 15 bp, Homo sapiens
gatggggctgaattt

SEQ ID NO: 323930 - DNA, 15 bp, Homo sapiens
atggggctgaatttc

SEQ ID NO: 323931 - DNA, 15 bp, Homo sapiens
tggggctgaatttcc

SEQ ID NO: 323932 - DNA, 15 bp, Homo sapiens
ggggctgaatttcca

SEQ ID NO: 323933 - DNA, 15 bp, Homo sapiens
gggctgaatttccaa

SEQ ID NO: 323934 - DNA, 15 bp, Homo sapiens
ggctgaatttccaac

SEQ ID NO: 323935 - DNA, 15 bp, Homo sapiens
gctgaatttccaact

SEQ ID NO: 323936 - DNA, 15 bp, Homo sapiens
ctgaatttccaactg

SEQ ID NO: 323937 - DNA, 15 bp, Homo sapiens
tgaatttccaactgc

SEQ ID NO: 323938 - DNA, 15 bp, Homo sapiens
gaatttccaactgct

SEQ ID NO: 323939 - DNA, 15 bp, Homo sapiens
aatttccaactgcta

SEQ ID NO: 323940 - DNA, 15 bp, Homo sapiens
atttccaactgctag

SEQ ID NO: 323941 - DNA, 15 bp, Homo sapiens
tttccaactgctagg

SEQ ID NO: 323942 - DNA, 15 bp, Homo sapiens
ttccaactgctaggc

SEQ ID NO: 323943 - DNA, 15 bp, Homo sapiens
tccaactgctaggct

SEQ ID NO: 323944 - DNA, 15 bp, Homo sapiens
ccaactgctaggcta

SEQ ID NO: 323945 - DNA, 15 bp, Homo sapiens
caactgctaggctag

SEQ ID NO: 323946 - DNA, 15 bp, Homo sapiens
aactgctaggctaga

SEQ ID NO: 323947 - DNA, 15 bp, Homo sapiens
actgctaggctagaa

SEQ ID NO: 323948 - DNA, 15 bp, Homo sapiens
ctgctaggctagaac

SEQ ID NO: 323949 - DNA, 15 bp, Homo sapiens
tgctaggctagaact

SEQ ID NO: 323950 - DNA, 15 bp, Homo sapiens
gctaggctagaacta

SEQ ID NO: 323951 - DNA, 15 bp, Homo sapiens
ctaggctagaactag

SEQ ID NO: 323952 - DNA, 15 bp, Homo sapiens
taggctagaactagg

SEQ ID NO: 323953 - DNA, 15 bp, Homo sapiens
aggctagaactagga

SEQ ID NO: 323954 - DNA, 15 bp, Homo sapiens
ggctagaactaggac

SEQ ID NO: 323955 - DNA, 15 bp, Homo sapiens
gctagaactaggaca

SEQ ID NO: 323956 - DNA, 15 bp, Homo sapiens
ctagaactaggacaa

SEQ ID NO: 323957 - DNA, 15 bp, Homo sapiens
tagaactaggacaac

SEQ ID NO: 323958 - DNA, 15 bp, Homo sapiens
agaactaggacaaca

SEQ ID NO: 323959 - DNA, 15 bp, Homo sapiens
gaactaggacaacac

SEQ ID NO: 323960 - DNA, 15 bp, Homo sapiens
aactaggacaacact

SEQ ID NO: 323961 - DNA, 15 bp, Homo sapiens
actaggacaacactg

SEQ ID NO: 323962 - DNA, 15 bp, Homo sapiens
ctaggacaacactgt

SEQ ID NO: 323963 - DNA, 15 bp, Homo sapiens
taggacaacactgtg

SEQ ID NO: 323964 - DNA, 15 bp, Homo sapiens
aggacaacactgtga

SEQ ID NO: 323965 - DNA, 15 bp, Homo sapiens
ggacaacactgtgag

SEQ ID NO: 323966 - DNA, 15 bp, Homo sapiens
gacaacactgtgagg

SEQ ID NO: 323967 - DNA, 15 bp, Homo sapiens
acaacactgtgaggg

SEQ ID NO: 323968 - DNA, 15 bp, Homo sapiens
caacactgtgaggga

SEQ ID NO: 323969 - DNA, 15 bp, Homo sapiens
aacactgtgagggaa

SEQ ID NO: 323970 - DNA, 15 bp, Homo sapiens
acactgtgagggaaa

SEQ ID NO: 323971 - DNA, 15 bp, Homo sapiens
cactgtgagggaaat

SEQ ID NO: 323972 - DNA, 15 bp, Homo sapiens
actgtgagggaaatc

SEQ ID NO: 323973 - DNA, 15 bp, Homo sapiens
ctgtgagggaaatcg

SEQ ID NO: 323974 - DNA, 15 bp, Homo sapiens
tgtgagggaaatcgg

SEQ ID NO: 323975 - DNA, 15 bp, Homo sapiens
gtgagggaaatcgga

SEQ ID NO: 323976 - DNA, 15 bp, Homo sapiens
tgagggaaatcggag

SEQ ID NO: 323977 - DNA, 15 bp, Homo sapiens
gagggaaatcggagt

SEQ ID NO: 323978 - DNA, 15 bp, Homo sapiens
agggaaatcggagtg

SEQ ID NO: 323979 - DNA, 15 bp, Homo sapiens
gggaaatcggagtgt

SEQ ID NO: 323980 - DNA, 15 bp, Homo sapiens
ggaaatcggagtgta

SEQ ID NO: 323981 - DNA, 15 bp, Homo sapiens
gaaatcggagtgtaa

SEQ ID NO: 323982 - DNA, 15 bp, Homo sapiens
aaatcggagtgtaat

SEQ ID NO: 323983 - DNA, 15 bp, Homo sapiens
aatcggagtgtaata

SEQ ID NO: 323984 - DNA, 15 bp, Homo sapiens
atcggagtgtaatac

SEQ ID NO: 323985 - DNA, 15 bp, Homo sapiens
tcggagtgtaataca

SEQ ID NO: 323986 - DNA, 15 bp, Homo sapiens
cggagtgtaatacat

SEQ ID NO: 323987 - DNA, 15 bp, Homo sapiens
ggagtgtaatacatt

SEQ ID NO: 323988 - DNA, 15 bp, Homo sapiens
gagtgtaatacattc

SEQ ID NO: 323989 - DNA, 15 bp, Homo sapiens
agtgtaatacattcc

SEQ ID NO: 323990 - DNA, 15 bp, Homo sapiens
gtgtaatacattccg

SEQ ID NO: 323991 - DNA, 15 bp, Homo sapiens
tgtaatacattccgc

SEQ ID NO: 323992 - DNA, 15 bp, Homo sapiens
gtaatacattccgca

SEQ ID NO: 323993 - DNA, 15 bp, Homo sapiens
taatacattccgcaa

SEQ ID NO: 323994 - DNA, 15 bp, Homo sapiens
aatacattccgcaac

SEQ ID NO: 323995 - DNA, 15 bp, Homo sapiens
atacattccgcaacc

SEQ ID NO: 323996 - DNA, 15 bp, Homo sapiens
tacattccgcaaccc

SEQ ID NO: 323997 - DNA, 15 bp, Homo sapiens
acattccgcaacccc

SEQ ID NO: 323998 - DNA, 15 bp, Homo sapiens
cattccgcaacccca

SEQ ID NO: 323999 - DNA, 15 bp, Homo sapiens
attccgcaaccccac

SEQ ID NO: 324000 - DNA, 15 bp, Homo sapiens
ttccgcaaccccacc

SEQ ID NO: 324001 - DNA, 15 bp, Homo sapiens
tccgcaaccccacct

SEQ ID NO: 324002 - DNA, 15 bp, Homo sapiens
ccgcaaccccacctg

SEQ ID NO: 324003 - DNA, 15 bp, Homo sapiens
cgcaaccccacctgt

SEQ ID NO: 324004 - DNA, 15 bp, Homo sapiens
gcaaccccacctgtc

SEQ ID NO: 324005 - DNA, 15 bp, Homo sapiens
caaccccacctgtct

SEQ ID NO: 324006 - DNA, 15 bp, Homo sapiens
aaccccacctgtcta

SEQ ID NO: 324007 - DNA, 15 bp, Homo sapiens
accccacctgtctac

SEQ ID NO: 324008 - DNA, 15 bp, Homo sapiens
ccccacctgtctact

SEQ ID NO: 324009 - DNA, 15 bp, Homo sapiens
cccacctgtctacta

SEQ ID NO: 324010 - DNA, 15 bp, Homo sapiens
ccacctgtctactat

SEQ ID NO: 324011 - DNA, 15 bp, Homo sapiens
cacctgtctactatc

SEQ ID NO: 324012 - DNA, 15 bp, Homo sapiens
acctgtctactatcg

SEQ ID NO: 324013 - DNA, 15 bp, Homo sapiens
cctgtctactatcgc

SEQ ID NO: 324014 - DNA, 15 bp, Homo sapiens
ctgtctactatcgca

SEQ ID NO: 324015 - DNA, 15 bp, Homo sapiens
tgtctactatcgcaa

SEQ ID NO: 324016 - DNA, 15 bp, Homo sapiens
gtctactatcgcaac

SEQ ID NO: 324017 - DNA, 15 bp, Homo sapiens
tctactatcgcaacc

SEQ ID NO: 324018 - DNA, 15 bp, Homo sapiens
ctactatcgcaaccc

SEQ ID NO: 324019 - DNA, 15 bp, Homo sapiens
tactatcgcaacccc

SEQ ID NO: 324020 - DNA, 15 bp, Homo sapiens
actatcgcaacccca

SEQ ID NO: 324021 - DNA, 15 bp, Homo sapiens
ctatcgcaaccccac

SEQ ID NO: 324022 - DNA, 15 bp, Homo sapiens
tatcgcaaccccacc

SEQ ID NO: 324023 - DNA, 15 bp, Homo sapiens
atcgcaaccccacct

SEQ ID NO: 324024 - DNA, 15 bp, Homo sapiens
tcgcaaccccacctg

SEQ ID NO: 324025 - DNA, 15 bp, Homo sapiens
aaccccacctgtctg

SEQ ID NO: 324026 - DNA, 15 bp, Homo sapiens
accccacctgtctgc

SEQ ID NO: 324027 - DNA, 15 bp, Homo sapiens
ccccacctgtctgct

SEQ ID NO: 324028 - DNA, 15 bp, Homo sapiens
cccacctgtctgcta

SEQ ID NO: 324029 - DNA, 15 bp, Homo sapiens
ccacctgtctgctat

SEQ ID NO: 324030 - DNA, 15 bp, Homo sapiens
cacctgtctgctatc

SEQ ID NO: 324031 - DNA, 15 bp, Homo sapiens
acctgtctgctatcc

SEQ ID NO: 324032 - DNA, 15 bp, Homo sapiens
cctgtctgctatcct

SEQ ID NO: 324033 - DNA, 15 bp, Homo sapiens
ctgtctgctatcctc

SEQ ID NO: 324034 - DNA, 15 bp, Homo sapiens
tgtctgctatcctcc

SEQ ID NO: 324035 - DNA, 15 bp, Homo sapiens
gtctgctatcctccc

SEQ ID NO: 324036 - DNA, 15 bp, Homo sapiens
tctgctatcctccct

SEQ ID NO: 324037 - DNA, 15 bp, Homo sapiens
ctgctatcctccctt

SEQ ID NO: 324038 - DNA, 15 bp, Homo sapiens
tgctatcctcccttt

SEQ ID NO: 324039 - DNA, 15 bp, Homo sapiens
gctatcctccctttg

SEQ ID NO: 324040 - DNA, 15 bp, Homo sapiens
ctatcctccctttgc

SEQ ID NO: 324041 - DNA, 15 bp, Homo sapiens
tatcctccctttgca

SEQ ID NO: 324042 - DNA, 15 bp, Homo sapiens
atcctccctttgcaa

SEQ ID NO: 324043 - DNA, 15 bp, Homo sapiens
tcctccctttgcaag

SEQ ID NO: 324044 - DNA, 15 bp, Homo sapiens
cctccctttgcaagc

SEQ ID NO: 324045 - DNA, 15 bp, Homo sapiens
ctccctttgcaagcc

SEQ ID NO: 324046 - DNA, 15 bp, Homo sapiens
tccctttgcaagccc

SEQ ID NO: 324047 - DNA, 15 bp, Homo sapiens
ccctttgcaagccca

SEQ ID NO: 324048 - DNA, 15 bp, Homo sapiens
cctttgcaagcccag

SEQ ID NO: 324049 - DNA, 15 bp, Homo sapiens
ctttgcaagcccagg

SEQ ID NO: 324050 - DNA, 15 bp, Homo sapiens
tttgcaagcccaggg

SEQ ID NO: 324051 - DNA, 15 bp, Homo sapiens
ttgcaagcccagggc

SEQ ID NO: 324052 - DNA, 15 bp, Homo sapiens
tgcaagcccagggcc

SEQ ID NO: 324053 - DNA, 15 bp, Homo sapiens
gcaagcccagggcct

SEQ ID NO: 324054 - DNA, 15 bp, Homo sapiens
caagcccagggcctt

SEQ ID NO: 324055 - DNA, 15 bp, Homo sapiens
aagcccagggccttg

SEQ ID NO: 324056 - DNA, 15 bp, Homo sapiens
agcccagggccttga

SEQ ID NO: 324057 - DNA, 15 bp, Homo sapiens
gcccagggccttgat

SEQ ID NO: 324058 - DNA, 15 bp, Homo sapiens
cccagggccttgatg

SEQ ID NO: 324059 - DNA, 15 bp, Homo sapiens
ccagggccttgatgg

SEQ ID NO: 324060 - DNA, 15 bp, Homo sapiens
cagggccttgatggt

SEQ ID NO: 324061 - DNA, 15 bp, Homo sapiens
agggccttgatggtt

SEQ ID NO: 324062 - DNA, 15 bp, Homo sapiens
gggccttgatggttc

SEQ ID NO: 324063 - DNA, 15 bp, Homo sapiens
ggccttgatggttca

SEQ ID NO: 324064 - DNA, 15 bp, Homo sapiens
gccttgatggttcaa

SEQ ID NO: 324065 - DNA, 15 bp, Homo sapiens
ccttgatggttcaag

SEQ ID NO: 324066 - DNA, 15 bp, Homo sapiens
cttgatggttcaagg

SEQ ID NO: 324067 - DNA, 15 bp, Homo sapiens
ttgatggttcaagga

SEQ ID NO: 324068 - DNA, 15 bp, Homo sapiens
tgatggttcaaggat

SEQ ID NO: 324069 - DNA, 15 bp, Homo sapiens
gatggttcaaggatg

SEQ ID NO: 324070 - DNA, 15 bp, Homo sapiens
atggttcaaggatga

SEQ ID NO: 324071 - DNA, 15 bp, Homo sapiens
tggttcaaggatgag

SEQ ID NO: 324072 - DNA, 15 bp, Homo sapiens
ggttcaaggatgagt

SEQ ID NO: 324073 - DNA, 15 bp, Homo sapiens
gttcaaggatgagtc

SEQ ID NO: 324074 - DNA, 15 bp, Homo sapiens
ttcaaggatgagtct

SEQ ID NO: 324075 - DNA, 15 bp, Homo sapiens
tcaaggatgagtctt

SEQ ID NO: 324076 - DNA, 15 bp, Homo sapiens
caaggatgagtcttt

SEQ ID NO: 324077 - DNA, 15 bp, Homo sapiens
aaggatgagtctttc

SEQ ID NO: 324078 - DNA, 15 bp, Homo sapiens
aggatgagtctttct

SEQ ID NO: 324079 - DNA, 15 bp, Homo sapiens
ggatgagtctttcta

SEQ ID NO: 324080 - DNA, 15 bp, Homo sapiens
gatgagtctttctag

SEQ ID NO: 324081 - DNA, 15 bp, Homo sapiens
atgagtctttctaga

SEQ ID NO: 324082 - DNA, 15 bp, Homo sapiens
tgagtctttctagaa

SEQ ID NO: 324083 - DNA, 15 bp, Homo sapiens
gagtctttctagaaa

SEQ ID NO: 324084 - DNA, 15 bp, Homo sapiens
agtctttctagaaaa

SEQ ID NO: 324085 - DNA, 15 bp, Homo sapiens
gtctttctagaaaaa

SEQ ID NO: 324086 - DNA, 15 bp, Homo sapiens
tctttctagaaaaaa

SEQ ID NO: 324087 - DNA, 15 bp, Homo sapiens
ctttctagaaaaaag

SEQ ID NO: 324088 - DNA, 15 bp, Homo sapiens
tttctagaaaaaagg

SEQ ID NO: 324089 - DNA, 15 bp, Homo sapiens
ttctagaaaaaaggg

SEQ ID NO: 324090 - DNA, 15 bp, Homo sapiens
tctagaaaaaaggga

SEQ ID NO: 324091 - DNA, 15 bp, Homo sapiens
ctagaaaaaagggag

SEQ ID NO: 324092 - DNA, 15 bp, Homo sapiens
tagaaaaaagggaga

SEQ ID NO: 324093 - DNA, 15 bp, Homo sapiens
agaaaaaagggagag

SEQ ID NO: 324094 - DNA, 15 bp, Homo sapiens
gaaaaaagggagaga

SEQ ID NO: 324095 - DNA, 15 bp, Homo sapiens
aaaaaagggagagaa

SEQ ID NO: 324096 - DNA, 15 bp, Homo sapiens
aaaaagggagagaag

SEQ ID NO: 324097 - DNA, 15 bp, Homo sapiens
aaaagggagagaagt

SEQ ID NO: 324098 - DNA, 15 bp, Homo sapiens
aaagggagagaagtt

SEQ ID NO: 324099 - DNA, 15 bp, Homo sapiens
aagggagagaagttt

SEQ ID NO: 324100 - DNA, 15 bp, Homo sapiens
agggagagaagtttc

SEQ ID NO: 324101 - DNA, 15 bp, Homo sapiens
gggagagaagtttct

SEQ ID NO: 324102 - DNA, 15 bp, Homo sapiens
ggagagaagtttctt

SEQ ID NO: 324103 - DNA, 15 bp, Homo sapiens
gagagaagtttcttt

SEQ ID NO: 324104 - DNA, 15 bp, Homo sapiens
agagaagtttctttc

SEQ ID NO: 324105 - DNA, 15 bp, Homo sapiens
gagaagtttctttcc

SEQ ID NO: 324106 - DNA, 15 bp, Homo sapiens
agaagtttctttcct

SEQ ID NO: 324107 - DNA, 15 bp, Homo sapiens
gaagtttctttcctt

SEQ ID NO: 324108 - DNA, 15 bp, Homo sapiens
aagtttctttccttt

SEQ ID NO: 324109 - DNA, 15 bp, Homo sapiens
agtttctttcctttt

SEQ ID NO: 324110 - DNA, 15 bp, Homo sapiens
gtttctttccttttt

SEQ ID NO: 324111 - DNA, 15 bp, Homo sapiens
tttctttcctttttt

SEQ ID NO: 324112 - DNA, 15 bp, Homo sapiens
ttctttccttttttt

SEQ ID NO: 324113 - DNA, 15 bp, Homo sapiens
tctttcctttttttt

SEQ ID NO: 324114 - DNA, 15 bp, Homo sapiens
ctttccttttttttt

SEQ ID NO: 324115 - DNA, 15 bp, Homo sapiens
tttcctttttttttt

SEQ ID NO: 324116 - DNA, 15 bp, Homo sapiens
ttttttttttttaaa

SEQ ID NO: 324117 - DNA, 15 bp, Homo sapiens
ttttttttttaaaca

SEQ ID NO: 324118 - DNA, 15 bp, Homo sapiens
tttttttttaaacaa

SEQ ID NO: 324119 - DNA, 15 bp, Homo sapiens
ttttttttaaacaaa

SEQ ID NO: 324120 - DNA, 15 bp, Homo sapiens
tttttttaaacaaaa

SEQ ID NO: 324121 - DNA, 15 bp, Homo sapiens
ttttttaaacaaaag

SEQ ID NO: 324122 - DNA, 15 bp, Homo sapiens
tttttaaacaaaaga

SEQ ID NO: 324123 - DNA, 15 bp, Homo sapiens
ttttaaacaaaagaa

SEQ ID NO: 324124 - DNA, 15 bp, Homo sapiens
tttaaacaaaagaaa

SEQ ID NO: 324125 - DNA, 15 bp, Homo sapiens
ttaaacaaaagaaaa

SEQ ID NO: 324126 - DNA, 15 bp, Homo sapiens
taaacaaaagaaaaa

SEQ ID NO: 324127 - DNA, 15 bp, Homo sapiens
aaacaaaagaaaaac

SEQ ID NO: 324128 - DNA, 15 bp, Homo sapiens
aacaaaagaaaaaca

SEQ ID NO: 324129 - DNA, 15 bp, Homo sapiens
acaaaagaaaaacaa

SEQ ID NO: 324130 - DNA, 15 bp, Homo sapiens
caaaagaaaaacaaa

SEQ ID NO: 324131 - DNA, 15 bp, Homo sapiens
aaaagaaaaacaaac

SEQ ID NO: 324132 - DNA, 15 bp, Homo sapiens
aaagaaaaacaaaca

SEQ ID NO: 324133 - DNA, 15 bp, Homo sapiens
aagaaaaacaaacat

SEQ ID NO: 324134 - DNA, 15 bp, Homo sapiens
agaaaaacaaacatg

SEQ ID NO: 324135 - DNA, 15 bp, Homo sapiens
gaaaaacaaacatgt

SEQ ID NO: 324136 - DNA, 15 bp, Homo sapiens
aaaaacaaacatgtt

SEQ ID NO: 324137 - DNA, 15 bp, Homo sapiens
aaaacaaacatgttt

SEQ ID NO: 324138 - DNA, 15 bp, Homo sapiens
aaacaaacatgttta

SEQ ID NO: 324139 - DNA, 15 bp, Homo sapiens
aacaaacatgtttat

SEQ ID NO: 324140 - DNA, 15 bp, Homo sapiens
acaaacatgtttatt

SEQ ID NO: 324141 - DNA, 15 bp, Homo sapiens
caaacatgtttatta

SEQ ID NO: 324142 - DNA, 15 bp, Homo sapiens
aaacatgtttattaa

SEQ ID NO: 324143 - DNA, 15 bp, Homo sapiens
aacatgtttattaag

SEQ ID NO: 324144 - DNA, 15 bp, Homo sapiens
acatgtttattaaga

SEQ ID NO: 324145 - DNA, 15 bp, Homo sapiens
catgtttattaagat

SEQ ID NO: 324146 - DNA, 15 bp, Homo sapiens
atgtttattaagata

SEQ ID NO: 324147 - DNA, 15 bp, Homo sapiens
tgtttattaagatat

SEQ ID NO: 324148 - DNA, 15 bp, Homo sapiens
gtttattaagatatg

SEQ ID NO: 324149 - DNA, 15 bp, Homo sapiens
tttattaagatatgc

SEQ ID NO: 324150 - DNA, 15 bp, Homo sapiens
ttattaagatatgcg

SEQ ID NO: 324151 - DNA, 15 bp, Homo sapiens
tattaagatatgcgt

SEQ ID NO: 324152 - DNA, 15 bp, Homo sapiens
attaagatatgcgta

SEQ ID NO: 324153 - DNA, 15 bp, Homo sapiens
ttaagatatgcgtag

SEQ ID NO: 324154 - DNA, 15 bp, Homo sapiens
taagatatgcgtagt

SEQ ID NO: 324155 - DNA, 15 bp, Homo sapiens
aagatatgcgtagtg

SEQ ID NO: 324156 - DNA, 15 bp, Homo sapiens
agatatgcgtagtgc

SEQ ID NO: 324157 - DNA, 15 bp, Homo sapiens
gatatgcgtagtgca

SEQ ID NO: 324158 - DNA, 15 bp, Homo sapiens
atatgcgtagtgcat

SEQ ID NO: 324159 - DNA, 15 bp, Homo sapiens
tatgcgtagtgcata

SEQ ID NO: 324160 - DNA, 15 bp, Homo sapiens
atgcgtagtgcatac

SEQ ID NO: 324161 - DNA, 15 bp, Homo sapiens
tgcgtagtgcataca

SEQ ID NO: 324162 - DNA, 15 bp, Homo sapiens
gcgtagtgcatacac

SEQ ID NO: 324163 - DNA, 15 bp, Homo sapiens
cgtagtgcatacaca

SEQ ID NO: 324164 - DNA, 15 bp, Homo sapiens
gtagtgcatacacat

SEQ ID NO: 324165 - DNA, 15 bp, Homo sapiens
tagtgcatacacatg

SEQ ID NO: 324166 - DNA, 15 bp, Homo sapiens
agtgcatacacatgg

SEQ ID NO: 324167 - DNA, 15 bp, Homo sapiens
gtgcatacacatggg

SEQ ID NO: 324168 - DNA, 15 bp, Homo sapiens
tgcatacacatggga

SEQ ID NO: 324169 - DNA, 15 bp, Homo sapiens
gcatacacatgggag

SEQ ID NO: 324170 - DNA, 15 bp, Homo sapiens
catacacatgggagt

SEQ ID NO: 324171 - DNA, 15 bp, Homo sapiens
atacacatgggagta

SEQ ID NO: 324172 - DNA, 15 bp, Homo sapiens
tacacatgggagtac

SEQ ID NO: 324173 - DNA, 15 bp, Homo sapiens
acacatgggagtacc

SEQ ID NO: 324174 - DNA, 15 bp, Homo sapiens
cacatgggagtaccc

SEQ ID NO: 324175 - DNA, 15 bp, Homo sapiens
acatgggagtaccca

SEQ ID NO: 324176 - DNA, 15 bp, Homo sapiens
catgggagtacccag

SEQ ID NO: 324177 - DNA, 15 bp, Homo sapiens
atgggagtacccaga

SEQ ID NO: 324178 - DNA, 15 bp, Homo sapiens
tgggagtacccagac

SEQ ID NO: 324179 - DNA, 15 bp, Homo sapiens
gggagtacccagaca

SEQ ID NO: 324180 - DNA, 15 bp, Homo sapiens
ggagtacccagacat

SEQ ID NO: 324181 - DNA, 15 bp, Homo sapiens
gagtacccagacatg

SEQ ID NO: 324182 - DNA, 15 bp, Homo sapiens
agtacccagacatga

SEQ ID NO: 324183 - DNA, 15 bp, Homo sapiens
gtacccagacatgag

SEQ ID NO: 324184 - DNA, 15 bp, Homo sapiens
tacccagacatgagt

SEQ ID NO: 324185 - DNA, 15 bp, Homo sapiens
acccagacatgagta

SEQ ID NO: 324186 - DNA, 15 bp, Homo sapiens
cccagacatgagtaa

SEQ ID NO: 324187 - DNA, 15 bp, Homo sapiens
ccagacatgagtaat

SEQ ID NO: 324188 - DNA, 15 bp, Homo sapiens
cagacatgagtaatt

SEQ ID NO: 324189 - DNA, 15 bp, Homo sapiens
agacatgagtaattc

SEQ ID NO: 324190 - DNA, 15 bp, Homo sapiens
gacatgagtaattca

SEQ ID NO: 324191 - DNA, 15 bp, Homo sapiens
acatgagtaattcaa

SEQ ID NO: 324192 - DNA, 15 bp, Homo sapiens
catgagtaattcaaa

SEQ ID NO: 324193 - DNA, 15 bp, Homo sapiens
atgagtaattcaaag

SEQ ID NO: 324194 - DNA, 15 bp, Homo sapiens
tgagtaattcaaagg

SEQ ID NO: 324195 - DNA, 15 bp, Homo sapiens
gagtaattcaaaggg

SEQ ID NO: 324196 - DNA, 15 bp, Homo sapiens
agtaattcaaagggt

SEQ ID NO: 324197 - DNA, 15 bp, Homo sapiens
gtaattcaaagggtt

SEQ ID NO: 324198 - DNA, 15 bp, Homo sapiens
taattcaaagggttg

SEQ ID NO: 324199 - DNA, 15 bp, Homo sapiens
aattcaaagggttgg

SEQ ID NO: 324200 - DNA, 15 bp, Homo sapiens
attcaaagggttggt

SEQ ID NO: 324201 - DNA, 15 bp, Homo sapiens
ttcaaagggttggtt

SEQ ID NO: 324202 - DNA, 15 bp, Homo sapiens
tcaaagggttggtta

SEQ ID NO: 324203 - DNA, 15 bp, Homo sapiens
caaagggttggttag

SEQ ID NO: 324204 - DNA, 15 bp, Homo sapiens
aaagggttggttaga

SEQ ID NO: 324205 - DNA, 15 bp, Homo sapiens
aagggttggttagaa

SEQ ID NO: 324206 - DNA, 15 bp, Homo sapiens
agggttggttagaac

SEQ ID NO: 324207 - DNA, 15 bp, Homo sapiens
gggttggttagaact

SEQ ID NO: 324208 - DNA, 15 bp, Homo sapiens
ggttggttagaactg

SEQ ID NO: 324209 - DNA, 15 bp, Homo sapiens
gttggttagaactgg

SEQ ID NO: 324210 - DNA, 15 bp, Homo sapiens
ttggttagaactggg

SEQ ID NO: 324211 - DNA, 15 bp, Homo sapiens
tggttagaactgggc

SEQ ID NO: 324212 - DNA, 15 bp, Homo sapiens
ggttagaactgggct

SEQ ID NO: 324213 - DNA, 15 bp, Homo sapiens
gttagaactgggctt

SEQ ID NO: 324214 - DNA, 15 bp, Homo sapiens
ttagaactgggctta

SEQ ID NO: 324215 - DNA, 15 bp, Homo sapiens
tagaactgggcttat

SEQ ID NO: 324216 - DNA, 15 bp, Homo sapiens
agaactgggcttatc

SEQ ID NO: 324217 - DNA, 15 bp, Homo sapiens
gaactgggcttatct

SEQ ID NO: 324218 - DNA, 15 bp, Homo sapiens
aactgggcttatcta

SEQ ID NO: 324219 - DNA, 15 bp, Homo sapiens
actgggcttatctag

SEQ ID NO: 324220 - DNA, 15 bp, Homo sapiens
ctgggcttatctagc

SEQ ID NO: 324221 - DNA, 15 bp, Homo sapiens
tgggcttatctagca

SEQ ID NO: 324222 - DNA, 15 bp, Homo sapiens
gggcttatctagcat

SEQ ID NO: 324223 - DNA, 15 bp, Homo sapiens
ggcttatctagcatc

SEQ ID NO: 324224 - DNA, 15 bp, Homo sapiens
gcttatctagcatct

SEQ ID NO: 324225 - DNA, 15 bp, Homo sapiens
cttatctagcatctt

SEQ ID NO: 324226 - DNA, 15 bp, Homo sapiens
ttatctagcatctta

SEQ ID NO: 324227 - DNA, 15 bp, Homo sapiens
tatctagcatcttaa

SEQ ID NO: 324228 - DNA, 15 bp, Homo sapiens
atctagcatcttaac

SEQ ID NO: 324229 - DNA, 15 bp, Homo sapiens
tctagcatcttaaca

SEQ ID NO: 324230 - DNA, 15 bp, Homo sapiens
ctagcatcttaacaa

SEQ ID NO: 324231 - DNA, 15 bp, Homo sapiens
tagcatcttaacaaa

SEQ ID NO: 324232 - DNA, 15 bp, Homo sapiens
agcatcttaacaaag

SEQ ID NO: 324233 - DNA, 15 bp, Homo sapiens
gcatcttaacaaagg

SEQ ID NO: 324234 - DNA, 15 bp, Homo sapiens
catcttaacaaagga

SEQ ID NO: 324235 - DNA, 15 bp, Homo sapiens
atcttaacaaaggaa

SEQ ID NO: 324236 - DNA, 15 bp, Homo sapiens
tcttaacaaaggaac

SEQ ID NO: 324237 - DNA, 15 bp, Homo sapiens
cttaacaaaggaacg

SEQ ID NO: 324238 - DNA, 15 bp, Homo sapiens
ttaacaaaggaacga

SEQ ID NO: 324239 - DNA, 15 bp, Homo sapiens
taacaaaggaacgat

SEQ ID NO: 324240 - DNA, 15 bp, Homo sapiens
aacaaaggaacgata

SEQ ID NO: 324241 - DNA, 15 bp, Homo sapiens
acaaaggaacgataa

SEQ ID NO: 324242 - DNA, 15 bp, Homo sapiens
caaaggaacgataac

SEQ ID NO: 324243 - DNA, 15 bp, Homo sapiens
aaaggaacgataact

SEQ ID NO: 324244 - DNA, 15 bp, Homo sapiens
aaggaacgataactt

SEQ ID NO: 324245 - DNA, 15 bp, Homo sapiens
aggaacgataacttt

SEQ ID NO: 324246 - DNA, 15 bp, Homo sapiens
ggaacgataactttt

SEQ ID NO: 324247 - DNA, 15 bp, Homo sapiens
gaacgataacttttt

SEQ ID NO: 324248 - DNA, 15 bp, Homo sapiens
aacgataacttttta

SEQ ID NO: 324249 - DNA, 15 bp, Homo sapiens
acgataactttttag

SEQ ID NO: 324250 - DNA, 15 bp, Homo sapiens
cgataactttttaga

SEQ ID NO: 324251 - DNA, 15 bp, Homo sapiens
gataactttttagag

SEQ ID NO: 324252 - DNA, 15 bp, Homo sapiens
ataactttttagaga

SEQ ID NO: 324253 - DNA, 15 bp, Homo sapiens
taactttttagagag

SEQ ID NO: 324254 - DNA, 15 bp, Homo sapiens
aactttttagagagg

SEQ ID NO: 324255 - DNA, 15 bp, Homo sapiens
actttttagagaggt

SEQ ID NO: 324256 - DNA, 15 bp, Homo sapiens
ctttttagagaggtg

SEQ ID NO: 324257 - DNA, 15 bp, Homo sapiens
tttttagagaggtga

SEQ ID NO: 324258 - DNA, 15 bp, Homo sapiens
ttttagagaggtgat

SEQ ID NO: 324259 - DNA, 15 bp, Homo sapiens
tttagagaggtgatg

SEQ ID NO: 324260 - DNA, 15 bp, Homo sapiens
ttagagaggtgatga

SEQ ID NO: 324261 - DNA, 15 bp, Homo sapiens
tagagaggtgatgaa

SEQ ID NO: 324262 - DNA, 15 bp, Homo sapiens
agagaggtgatgaaa

SEQ ID NO: 324263 - DNA, 15 bp, Homo sapiens
gagaggtgatgaaac

SEQ ID NO: 324264 - DNA, 15 bp, Homo sapiens
agaggtgatgaaaca

SEQ ID NO: 324265 - DNA, 15 bp, Homo sapiens
gaggtgatgaaacaa

SEQ ID NO: 324266 - DNA, 15 bp, Homo sapiens
aggtgatgaaacaaa

SEQ ID NO: 324267 - DNA, 15 bp, Homo sapiens
ggtgatgaaacaaag

SEQ ID NO: 324268 - DNA, 15 bp, Homo sapiens
gtgatgaaacaaagg

SEQ ID NO: 324269 - DNA, 15 bp, Homo sapiens
tgatgaaacaaagga

SEQ ID NO: 324270 - DNA, 15 bp, Homo sapiens
gatgaaacaaaggaa

SEQ ID NO: 324271 - DNA, 15 bp, Homo sapiens
atgaaacaaaggaaa

SEQ ID NO: 324272 - DNA, 15 bp, Homo sapiens
tgaaacaaaggaaaa

SEQ ID NO: 324273 - DNA, 15 bp, Homo sapiens
gaaacaaaggaaaat

SEQ ID NO: 324274 - DNA, 15 bp, Homo sapiens
aaacaaaggaaaatg

SEQ ID NO: 324275 - DNA, 15 bp, Homo sapiens
aacaaaggaaaatga

SEQ ID NO: 324276 - DNA, 15 bp, Homo sapiens
acaaaggaaaatgac

SEQ ID NO: 324277 - DNA, 15 bp, Homo sapiens
caaaggaaaatgact

SEQ ID NO: 324278 - DNA, 15 bp, Homo sapiens
aaaggaaaatgactt

SEQ ID NO: 324279 - DNA, 15 bp, Homo sapiens
aaggaaaatgacttt

SEQ ID NO: 324280 - DNA, 15 bp, Homo sapiens
aggaaaatgacttta

SEQ ID NO: 324281 - DNA, 15 bp, Homo sapiens
ggaaaatgactttaa

SEQ ID NO: 324282 - DNA, 15 bp, Homo sapiens
gaaaatgactttaag

SEQ ID NO: 324283 - DNA, 15 bp, Homo sapiens
aaaatgactttaagc

SEQ ID NO: 324284 - DNA, 15 bp, Homo sapiens
aaatgactttaagct

SEQ ID NO: 324285 - DNA, 15 bp, Homo sapiens
aatgactttaagctt

SEQ ID NO: 324286 - DNA, 15 bp, Homo sapiens
atgactttaagcttc

SEQ ID NO: 324287 - DNA, 15 bp, Homo sapiens
tgactttaagcttcc

SEQ ID NO: 324288 - DNA, 15 bp, Homo sapiens
gactttaagcttcca

SEQ ID NO: 324289 - DNA, 15 bp, Homo sapiens
actttaagcttccag

SEQ ID NO: 324290 - DNA, 15 bp, Homo sapiens
ctttaagcttccagg

SEQ ID NO: 324291 - DNA, 15 bp, Homo sapiens
tttaagcttccaggt

SEQ ID NO: 324292 - DNA, 15 bp, Homo sapiens
ttaagcttccaggtg

SEQ ID NO: 324293 - DNA, 15 bp, Homo sapiens
taagcttccaggtgt

SEQ ID NO: 324294 - DNA, 15 bp, Homo sapiens
aagcttccaggtgtt

SEQ ID NO: 324295 - DNA, 15 bp, Homo sapiens
agcttccaggtgtta

SEQ ID NO: 324296 - DNA, 15 bp, Homo sapiens
gcttccaggtgttac

SEQ ID NO: 324297 - DNA, 15 bp, Homo sapiens
cttccaggtgttacc

SEQ ID NO: 324298 - DNA, 15 bp, Homo sapiens
ttccaggtgttacca

SEQ ID NO: 324299 - DNA, 15 bp, Homo sapiens
tccaggtgttaccag

SEQ ID NO: 324300 - DNA, 15 bp, Homo sapiens
ccaggtgttaccaga

SEQ ID NO: 324301 - DNA, 15 bp, Homo sapiens
caggtgttaccagaa

SEQ ID NO: 324302 - DNA, 15 bp, Homo sapiens
aggtgttaccagaag

SEQ ID NO: 324303 - DNA, 15 bp, Homo sapiens
ggtgttaccagaagt

SEQ ID NO: 324304 - DNA, 15 bp, Homo sapiens
gtgttaccagaagtt

SEQ ID NO: 324305 - DNA, 15 bp, Homo sapiens
tgttaccagaagttt

SEQ ID NO: 324306 - DNA, 15 bp, Homo sapiens
gttaccagaagtttc

SEQ ID NO: 324307 - DNA, 15 bp, Homo sapiens
ttaccagaagtttca

SEQ ID NO: 324308 - DNA, 15 bp, Homo sapiens
taccagaagtttcat

SEQ ID NO: 324309 - DNA, 15 bp, Homo sapiens
accagaagtttcatc

SEQ ID NO: 324310 - DNA, 15 bp, Homo sapiens
ccagaagtttcatca

SEQ ID NO: 324311 - DNA, 15 bp, Homo sapiens
cagaagtttcatcaa

SEQ ID NO: 324312 - DNA, 15 bp, Homo sapiens
agaagtttcatcaaa

SEQ ID NO: 324313 - DNA, 15 bp, Homo sapiens
gaagtttcatcaaat

SEQ ID NO: 324314 - DNA, 15 bp, Homo sapiens
aagtttcatcaaatc

SEQ ID NO: 324315 - DNA, 15 bp, Homo sapiens
agtttcatcaaatca

SEQ ID NO: 324316 - DNA, 15 bp, Homo sapiens
gtttcatcaaatcaa

SEQ ID NO: 324317 - DNA, 15 bp, Homo sapiens
tttcatcaaatcaag

SEQ ID NO: 324318 - DNA, 15 bp, Homo sapiens
ttcatcaaatcaaga

SEQ ID NO: 324319 - DNA, 15 bp, Homo sapiens
tcatcaaatcaagaa

SEQ ID NO: 324320 - DNA, 15 bp, Homo sapiens
catcaaatcaagaat

SEQ ID NO: 324321 - DNA, 15 bp, Homo sapiens
atcaaatcaagaata

SEQ ID NO: 324322 - DNA, 15 bp, Homo sapiens
tcaaatcaagaatat

SEQ ID NO: 324323 - DNA, 15 bp, Homo sapiens
caaatcaagaatatt

SEQ ID NO: 324324 - DNA, 15 bp, Homo sapiens
aaatcaagaatattc

SEQ ID NO: 324325 - DNA, 15 bp, Homo sapiens
aatcaagaatattct

SEQ ID NO: 324326 - DNA, 15 bp, Homo sapiens
atcaagaatattctt

SEQ ID NO: 324327 - DNA, 15 bp, Homo sapiens
tcaagaatattctta

SEQ ID NO: 324328 - DNA, 15 bp, Homo sapiens
caagaatattcttag

SEQ ID NO: 324329 - DNA, 15 bp, Homo sapiens
aagaatattcttagg

SEQ ID NO: 324330 - DNA, 15 bp, Homo sapiens
agaatattcttagga

SEQ ID NO: 324331 - DNA, 15 bp, Homo sapiens
gaatattcttaggag

SEQ ID NO: 324332 - DNA, 15 bp, Homo sapiens
aatattcttaggagt

SEQ ID NO: 324333 - DNA, 15 bp, Homo sapiens
atattcttaggagtg

SEQ ID NO: 324334 - DNA, 15 bp, Homo sapiens
tattcttaggagtgt

SEQ ID NO: 324335 - DNA, 15 bp, Homo sapiens
attcttaggagtgtc

SEQ ID NO: 324336 - DNA, 15 bp, Homo sapiens
ttcttaggagtgtca

SEQ ID NO: 324337 - DNA, 15 bp, Homo sapiens
tcttaggagtgtcag

SEQ ID NO: 324338 - DNA, 15 bp, Homo sapiens
cttaggagtgtcagg

SEQ ID NO: 324339 - DNA, 15 bp, Homo sapiens
ttaggagtgtcaggg

SEQ ID NO: 324340 - DNA, 15 bp, Homo sapiens
taggagtgtcagggg

SEQ ID NO: 324341 - DNA, 15 bp, Homo sapiens
aggagtgtcaggggt

SEQ ID NO: 324342 - DNA, 15 bp, Homo sapiens
ggagtgtcaggggtg

SEQ ID NO: 324343 - DNA, 15 bp, Homo sapiens
gagtgtcaggggtgt

SEQ ID NO: 324344 - DNA, 15 bp, Homo sapiens
agtgtcaggggtgtc

SEQ ID NO: 324345 - DNA, 15 bp, Homo sapiens
gtgtcaggggtgtct

SEQ ID NO: 324346 - DNA, 15 bp, Homo sapiens
tgtcaggggtgtcta

SEQ ID NO: 324347 - DNA, 15 bp, Homo sapiens
gtcaggggtgtctaa

SEQ ID NO: 324348 - DNA, 15 bp, Homo sapiens
tcaggggtgtctaat

SEQ ID NO: 324349 - DNA, 15 bp, Homo sapiens
caggggtgtctaata

SEQ ID NO: 324350 - DNA, 15 bp, Homo sapiens
aggggtgtctaatag

SEQ ID NO: 324351 - DNA, 15 bp, Homo sapiens
ggggtgtctaatagt

SEQ ID NO: 324352 - DNA, 15 bp, Homo sapiens
gggtgtctaatagtt

SEQ ID NO: 324353 - DNA, 15 bp, Homo sapiens
ggtgtctaatagttg

SEQ ID NO: 324354 - DNA, 15 bp, Homo sapiens
gtgtctaatagttga

SEQ ID NO: 324355 - DNA, 15 bp, Homo sapiens
tgtctaatagttgag

SEQ ID NO: 324356 - DNA, 15 bp, Homo sapiens
gtctaatagttgagc

SEQ ID NO: 324357 - DNA, 15 bp, Homo sapiens
tctaatagttgagct

SEQ ID NO: 324358 - DNA, 15 bp, Homo sapiens
ctaatagttgagctg

SEQ ID NO: 324359 - DNA, 15 bp, Homo sapiens
taatagttgagctgt

SEQ ID NO: 324360 - DNA, 15 bp, Homo sapiens
aatagttgagctgtt

SEQ ID NO: 324361 - DNA, 15 bp, Homo sapiens
atagttgagctgtta

SEQ ID NO: 324362 - DNA, 15 bp, Homo sapiens
tagttgagctgttaa

SEQ ID NO: 324363 - DNA, 15 bp, Homo sapiens
agttgagctgttaag

SEQ ID NO: 324364 - DNA, 15 bp, Homo sapiens
gttgagctgttaagt

SEQ ID NO: 324365 - DNA, 15 bp, Homo sapiens
ttgagctgttaagta

SEQ ID NO: 324366 - DNA, 15 bp, Homo sapiens
tgagctgttaagtaa

SEQ ID NO: 324367 - DNA, 15 bp, Homo sapiens
gagctgttaagtaac

SEQ ID NO: 324368 - DNA, 15 bp, Homo sapiens
agctgttaagtaact

SEQ ID NO: 324369 - DNA, 15 bp, Homo sapiens
gctgttaagtaactc

SEQ ID NO: 324370 - DNA, 15 bp, Homo sapiens
ctgttaagtaactct

SEQ ID NO: 324371 - DNA, 15 bp, Homo sapiens
tgttaagtaactctt

SEQ ID NO: 324372 - DNA, 15 bp, Homo sapiens
gttaagtaactctta

SEQ ID NO: 324373 - DNA, 15 bp, Homo sapiens
ttaagtaactcttaa

SEQ ID NO: 324374 - DNA, 15 bp, Homo sapiens
taagtaactcttaaa

SEQ ID NO: 324375 - DNA, 15 bp, Homo sapiens
aagtaactcttaaac

SEQ ID NO: 324376 - DNA, 15 bp, Homo sapiens
agtaactcttaaact

SEQ ID NO: 324377 - DNA, 15 bp, Homo sapiens
gtaactcttaaactt

SEQ ID NO: 324378 - DNA, 15 bp, Homo sapiens
taactcttaaacttg

SEQ ID NO: 324379 - DNA, 15 bp, Homo sapiens
aactcttaaacttgt

SEQ ID NO: 324380 - DNA, 15 bp, Homo sapiens
actcttaaacttgtt

SEQ ID NO: 324381 - DNA, 15 bp, Homo sapiens
ctcttaaacttgtta

SEQ ID NO: 324382 - DNA, 15 bp, Homo sapiens
tcttaaacttgttaa

SEQ ID NO: 324383 - DNA, 15 bp, Homo sapiens
cttaaacttgttaat

SEQ ID NO: 324384 - DNA, 15 bp, Homo sapiens
ttaaacttgttaatg

SEQ ID NO: 324385 - DNA, 15 bp, Homo sapiens
taaacttgttaatgt

SEQ ID NO: 324386 - DNA, 15 bp, Homo sapiens
aaacttgttaatgtc

SEQ ID NO: 324387 - DNA, 15 bp, Homo sapiens
aacttgttaatgtct

SEQ ID NO: 324388 - DNA, 15 bp, Homo sapiens
acttgttaatgtctc

SEQ ID NO: 324389 - DNA, 15 bp, Homo sapiens
cttgttaatgtctct

SEQ ID NO: 324390 - DNA, 15 bp, Homo sapiens
ttgttaatgtctctt

SEQ ID NO: 324391 - DNA, 15 bp, Homo sapiens
tgttaatgtctcttg

SEQ ID NO: 324392 - DNA, 15 bp, Homo sapiens
gttaatgtctcttgg

SEQ ID NO: 324393 - DNA, 15 bp, Homo sapiens
ttaatgtctcttggg

SEQ ID NO: 324394 - DNA, 15 bp, Homo sapiens
taatgtctcttggga

SEQ ID NO: 324395 - DNA, 15 bp, Homo sapiens
aatgtctcttgggaa

SEQ ID NO: 324396 - DNA, 15 bp, Homo sapiens
atgtctcttgggaat

SEQ ID NO: 324397 - DNA, 15 bp, Homo sapiens
tgtctcttgggaatt

SEQ ID NO: 324398 - DNA, 15 bp, Homo sapiens
gtctcttgggaattt

SEQ ID NO: 324399 - DNA, 15 bp, Homo sapiens
tctcttgggaatttc

SEQ ID NO: 324400 - DNA, 15 bp, Homo sapiens
ctcttgggaatttct

SEQ ID NO: 324401 - DNA, 15 bp, Homo sapiens
tcttgggaatttctt

SEQ ID NO: 324402 - DNA, 15 bp, Homo sapiens
cttgggaatttcttc

SEQ ID NO: 324403 - DNA, 15 bp, Homo sapiens
ttgggaatttcttct

SEQ ID NO: 324404 - DNA, 15 bp, Homo sapiens
tgggaatttcttctt

SEQ ID NO: 324405 - DNA, 15 bp, Homo sapiens
gggaatttcttcttt

SEQ ID NO: 324406 - DNA, 15 bp, Homo sapiens
ggaatttcttctttt

SEQ ID NO: 324407 - DNA, 15 bp, Homo sapiens
gaatttcttctttta

SEQ ID NO: 324408 - DNA, 15 bp, Homo sapiens
aatttcttcttttag

SEQ ID NO: 324409 - DNA, 15 bp, Homo sapiens
atttcttcttttaga

SEQ ID NO: 324410 - DNA, 15 bp, Homo sapiens
tttcttcttttagag

SEQ ID NO: 324411 - DNA, 15 bp, Homo sapiens
ttcttcttttagagt

SEQ ID NO: 324412 - DNA, 15 bp, Homo sapiens
tcttcttttagagtt

SEQ ID NO: 324413 - DNA, 15 bp, Homo sapiens
cttcttttagagttg

SEQ ID NO: 324414 - DNA, 15 bp, Homo sapiens
ttcttttagagttgt

SEQ ID NO: 324415 - DNA, 15 bp, Homo sapiens
tcttttagagttgtt

SEQ ID NO: 324416 - DNA, 15 bp, Homo sapiens
cttttagagttgttt

SEQ ID NO: 324417 - DNA, 15 bp, Homo sapiens
ttttagagttgtttt

SEQ ID NO: 324418 - DNA, 15 bp, Homo sapiens
tttagagttgttttg

SEQ ID NO: 324419 - DNA, 15 bp, Homo sapiens
ttagagttgttttgt

SEQ ID NO: 324420 - DNA, 15 bp, Homo sapiens
tagagttgttttgta

SEQ ID NO: 324421 - DNA, 15 bp, Homo sapiens
agagttgttttgtat

SEQ ID NO: 324422 - DNA, 15 bp, Homo sapiens
gagttgttttgtatt

SEQ ID NO: 324423 - DNA, 15 bp, Homo sapiens
agttgttttgtatta

SEQ ID NO: 324424 - DNA, 15 bp, Homo sapiens
gttgttttgtattaa

SEQ ID NO: 324425 - DNA, 15 bp, Homo sapiens
ttgttttgtattaaa

SEQ ID NO: 324426 - DNA, 15 bp, Homo sapiens
tgttttgtattaaaa

SEQ ID NO: 324427 - DNA, 15 bp, Homo sapiens
gttttgtattaaaac

SEQ ID NO: 324428 - DNA, 15 bp, Homo sapiens
ttttgtattaaaacc

SEQ ID NO: 324429 - DNA, 15 bp, Homo sapiens
tttgtattaaaacca

SEQ ID NO: 324430 - DNA, 15 bp, Homo sapiens
ttgtattaaaaccaa

SEQ ID NO: 324431 - DNA, 15 bp, Homo sapiens
tgtattaaaaccaag

SEQ ID NO: 324432 - DNA, 15 bp, Homo sapiens
gtattaaaaccaagg

SEQ ID NO: 324433 - DNA, 15 bp, Homo sapiens
tattaaaaccaagga

SEQ ID NO: 324434 - DNA, 15 bp, Homo sapiens
attaaaaccaaggaa

SEQ ID NO: 324435 - DNA, 15 bp, Homo sapiens
ttaaaaccaaggaaa

SEQ ID NO: 324436 - DNA, 15 bp, Homo sapiens
taaaaccaaggaaat

SEQ ID NO: 324437 - DNA, 15 bp, Homo sapiens
aaaaccaaggaaata

SEQ ID NO: 324438 - DNA, 15 bp, Homo sapiens
aaaccaaggaaataa

SEQ ID NO: 324439 - DNA, 15 bp, Homo sapiens
aaccaaggaaataaa

SEQ ID NO: 324440 - DNA, 15 bp, Homo sapiens
accaaggaaataaat

SEQ ID NO: 324441 - DNA, 15 bp, Homo sapiens
ccaaggaaataaata

SEQ ID NO: 324442 - DNA, 15 bp, Homo sapiens
caaggaaataaatat

SEQ ID NO: 324443 - DNA, 15 bp, Homo sapiens
aaggaaataaatatc

SEQ ID NO: 324444 - DNA, 15 bp, Homo sapiens
aggaaataaatatct

SEQ ID NO: 324445 - DNA, 15 bp, Homo sapiens
ggaaataaatatctt

SEQ ID NO: 324446 - DNA, 15 bp, Homo sapiens
gaaataaatatcttt

SEQ ID NO: 324447 - DNA, 15 bp, Homo sapiens
aaataaatatcttta

SEQ ID NO: 324448 - DNA, 15 bp, Homo sapiens
aataaatatctttat

SEQ ID NO: 324449 - DNA, 15 bp, Homo sapiens
ataaatatctttatt

SEQ ID NO: 324450 - DNA, 15 bp, Homo sapiens
taaatatctttattt

SEQ ID NO: 324451 - DNA, 15 bp, Homo sapiens
aaatatctttatttg

SEQ ID NO: 324452 - DNA, 15 bp, Homo sapiens
aatatctttatttgt

SEQ ID NO: 324453 - DNA, 15 bp, Homo sapiens
atatctttatttgtt

SEQ ID NO: 324454 - DNA, 15 bp, Homo sapiens
tatctttatttgttt

SEQ ID NO: 324455 - DNA, 15 bp, Homo sapiens
atctttatttgtttt

SEQ ID NO: 324456 - DNA, 15 bp, Homo sapiens
tctttatttgtttta

SEQ ID NO: 324457 - DNA, 15 bp, Homo sapiens
ctttatttgttttaa

SEQ ID NO: 324458 - DNA, 15 bp, Homo sapiens
tttatttgttttaaa

SEQ ID NO: 324459 - DNA, 15 bp, Homo sapiens
ttatttgttttaaaa

SEQ ID NO: 324460 - DNA, 15 bp, Homo sapiens
tatttgttttaaaaa

SEQ ID NO: 324461 - DNA, 15 bp, Homo sapiens
atttgttttaaaaat

SEQ ID NO: 324462 - DNA, 15 bp, Homo sapiens
tttgttttaaaaata

SEQ ID NO: 324463 - DNA, 15 bp, Homo sapiens
ttgttttaaaaatag

SEQ ID NO: 324464 - DNA, 15 bp, Homo sapiens
tgttttaaaaatagt

SEQ ID NO: 324465 - DNA, 15 bp, Homo sapiens
gttttaaaaatagta

SEQ ID NO: 324466 - DNA, 15 bp, Homo sapiens
ttttaaaaatagtat

SEQ ID NO: 324467 - DNA, 15 bp, Homo sapiens
tttaaaaatagtatc

SEQ ID NO: 324468 - DNA, 15 bp, Homo sapiens
ttaaaaatagtatct

SEQ ID NO: 324469 - DNA, 15 bp, Homo sapiens
taaaaatagtatctt

SEQ ID NO: 324470 - DNA, 15 bp, Homo sapiens
aaaaatagtatctta

SEQ ID NO: 324471 - DNA, 15 bp, Homo sapiens
aaaatagtatcttaa

SEQ ID NO: 324472 - DNA, 15 bp, Homo sapiens
aaatagtatcttaat

SEQ ID NO: 324473 - DNA, 15 bp, Homo sapiens
aatagtatcttaatt

SEQ ID NO: 324474 - DNA, 15 bp, Homo sapiens
atagtatcttaattt

SEQ ID NO: 324475 - DNA, 15 bp, Homo sapiens
tagtatcttaattta

SEQ ID NO: 324476 - DNA, 15 bp, Homo sapiens
agtatcttaatttat

SEQ ID NO: 324477 - DNA, 15 bp, Homo sapiens
gtatcttaatttatt

SEQ ID NO: 324478 - DNA, 15 bp, Homo sapiens
tatcttaatttatta

SEQ ID NO: 324479 - DNA, 15 bp, Homo sapiens
atcttaatttattaa

SEQ ID NO: 324480 - DNA, 15 bp, Homo sapiens
tcttaatttattaat

SEQ ID NO: 324481 - DNA, 15 bp, Homo sapiens
cttaatttattaatt

SEQ ID NO: 324482 - DNA, 15 bp, Homo sapiens
ttaatttattaattt

SEQ ID NO: 324483 - DNA, 15 bp, Homo sapiens
taatttattaatttt

SEQ ID NO: 324484 - DNA, 15 bp, Homo sapiens
aatttattaattttg

SEQ ID NO: 324485 - DNA, 15 bp, Homo sapiens
atttattaattttgt

SEQ ID NO: 324486 - DNA, 15 bp, Homo sapiens
tttattaattttgtt

SEQ ID NO: 324487 - DNA, 15 bp, Homo sapiens
ttattaattttgttt

SEQ ID NO: 324488 - DNA, 15 bp, Homo sapiens
tattaattttgttta

SEQ ID NO: 324489 - DNA, 15 bp, Homo sapiens
attaattttgtttat

SEQ ID NO: 324490 - DNA, 15 bp, Homo sapiens
ttaattttgtttatt

SEQ ID NO: 324491 - DNA, 15 bp, Homo sapiens
taattttgtttattt

SEQ ID NO: 324492 - DNA, 15 bp, Homo sapiens
aattttgtttatttt

SEQ ID NO: 324493 - DNA, 15 bp, Homo sapiens
attttgtttattttg

SEQ ID NO: 324494 - DNA, 15 bp, Homo sapiens
ttttgtttattttgc

SEQ ID NO: 324495 - DNA, 15 bp, Homo sapiens
tttgtttattttgca

SEQ ID NO: 324496 - DNA, 15 bp, Homo sapiens
ttgtttattttgcaa

SEQ ID NO: 324497 - DNA, 15 bp, Homo sapiens
tgtttattttgcaaa

SEQ ID NO: 324498 - DNA, 15 bp, Homo sapiens
gtttattttgcaaag

SEQ ID NO: 324499 - DNA, 15 bp, Homo sapiens
tttattttgcaaagt

SEQ ID NO: 324500 - DNA, 15 bp, Homo sapiens
ttattttgcaaagtc

SEQ ID NO: 324501 - DNA, 15 bp, Homo sapiens
tattttgcaaagtct

SEQ ID NO: 324502 - DNA, 15 bp, Homo sapiens
attttgcaaagtctt

SEQ ID NO: 324503 - DNA, 15 bp, Homo sapiens
ttttgcaaagtcttt

SEQ ID NO: 324504 - DNA, 15 bp, Homo sapiens
tttgcaaagtctttt

SEQ ID NO: 324505 - DNA, 15 bp, Homo sapiens
ttgcaaagtcttttt

SEQ ID NO: 324506 - DNA, 15 bp, Homo sapiens
tgcaaagtcttttta

SEQ ID NO: 324507 - DNA, 15 bp, Homo sapiens
gcaaagtctttttaa

SEQ ID NO: 324508 - DNA, 15 bp, Homo sapiens
caaagtctttttaag

SEQ ID NO: 324509 - DNA, 15 bp, Homo sapiens
aaagtctttttaagg

SEQ ID NO: 324510 - DNA, 15 bp, Homo sapiens
aagtctttttaagga

SEQ ID NO: 324511 - DNA, 15 bp, Homo sapiens
agtctttttaaggaa

SEQ ID NO: 324512 - DNA, 15 bp, Homo sapiens
gtctttttaaggaaa

SEQ ID NO: 324513 - DNA, 15 bp, Homo sapiens
tctttttaaggaaat

SEQ ID NO: 324514 - DNA, 15 bp, Homo sapiens
ctttttaaggaaata

SEQ ID NO: 324515 - DNA, 15 bp, Homo sapiens
tttttaaggaaatat

SEQ ID NO: 324516 - DNA, 15 bp, Homo sapiens
ttttaaggaaatatt

SEQ ID NO: 324517 - DNA, 15 bp, Homo sapiens
tttaaggaaatatta

SEQ ID NO: 324518 - DNA, 15 bp, Homo sapiens
ttaaggaaatattat

SEQ ID NO: 324519 - DNA, 15 bp, Homo sapiens
taaggaaatattatt

SEQ ID NO: 324520 - DNA, 15 bp, Homo sapiens
aaggaaatattattt

SEQ ID NO: 324521 - DNA, 15 bp, Homo sapiens
aggaaatattatttc

SEQ ID NO: 324522 - DNA, 15 bp, Homo sapiens
ggaaatattatttcc

SEQ ID NO: 324523 - DNA, 15 bp, Homo sapiens
gaaatattatttcct

SEQ ID NO: 324524 - DNA, 15 bp, Homo sapiens
aaatattatttcctt

SEQ ID NO: 324525 - DNA, 15 bp, Homo sapiens
aatattatttccttt

SEQ ID NO: 324526 - DNA, 15 bp, Homo sapiens
atattatttcctttt

SEQ ID NO: 324527 - DNA, 15 bp, Homo sapiens
tattatttcctttta

SEQ ID NO: 324528 - DNA, 15 bp, Homo sapiens
attatttccttttac

SEQ ID NO: 324529 - DNA, 15 bp, Homo sapiens
ttatttccttttaca

SEQ ID NO: 324530 - DNA, 15 bp, Homo sapiens
tatttccttttacaa

SEQ ID NO: 324531 - DNA, 15 bp, Homo sapiens
atttccttttacaat

SEQ ID NO: 324532 - DNA, 15 bp, Homo sapiens
tttccttttacaatg

SEQ ID NO: 324533 - DNA, 15 bp, Homo sapiens
ttccttttacaatga

SEQ ID NO: 324534 - DNA, 15 bp, Homo sapiens
tccttttacaatgag

SEQ ID NO: 324535 - DNA, 15 bp, Homo sapiens
ccttttacaatgagt

SEQ ID NO: 324536 - DNA, 15 bp, Homo sapiens
cttttacaatgagta

SEQ ID NO: 324537 - DNA, 15 bp, Homo sapiens
ttttacaatgagtaa

SEQ ID NO: 324538 - DNA, 15 bp, Homo sapiens
tttacaatgagtaaa

SEQ ID NO: 324539 - DNA, 15 bp, Homo sapiens
ttacaatgagtaaaa

SEQ ID NO: 324540 - DNA, 15 bp, Homo sapiens
tacaatgagtaaaaa

SEQ ID NO: 324541 - DNA, 15 bp, Homo sapiens
acaatgagtaaaaat

SEQ ID NO: 324542 - DNA, 15 bp, Homo sapiens
caatgagtaaaaata

SEQ ID NO: 324543 - DNA, 15 bp, Homo sapiens
aatgagtaaaaatac

SEQ ID NO: 324544 - DNA, 15 bp, Homo sapiens
atgagtaaaaataca

SEQ ID NO: 324545 - DNA, 15 bp, Homo sapiens
tgagtaaaaatacat

SEQ ID NO: 324546 - DNA, 15 bp, Homo sapiens
gagtaaaaatacatt

SEQ ID NO: 324547 - DNA, 15 bp, Homo sapiens
agtaaaaatacattc

SEQ ID NO: 324548 - DNA, 15 bp, Homo sapiens
gtaaaaatacattca

SEQ ID NO: 324549 - DNA, 15 bp, Homo sapiens
taaaaatacattcat

SEQ ID NO: 324550 - DNA, 15 bp, Homo sapiens
aaaaatacattcatt

SEQ ID NO: 324551 - DNA, 15 bp, Homo sapiens
aaaatacattcattc

SEQ ID NO: 324552 - DNA, 15 bp, Homo sapiens
aaatacattcattca

SEQ ID NO: 324553 - DNA, 15 bp, Homo sapiens
aatacattcattcag

SEQ ID NO: 324554 - DNA, 15 bp, Homo sapiens
atacattcattcaga

SEQ ID NO: 324555 - DNA, 15 bp, Homo sapiens
tacattcattcagaa

SEQ ID NO: 324556 - DNA, 15 bp, Homo sapiens
acattcattcagaac

SEQ ID NO: 324557 - DNA, 15 bp, Homo sapiens
cattcattcagaaca

SEQ ID NO: 324558 - DNA, 15 bp, Homo sapiens
attcattcagaacaa

SEQ ID NO: 324559 - DNA, 15 bp, Homo sapiens
ttcattcagaacaaa

SEQ ID NO: 324560 - DNA, 15 bp, Homo sapiens
tcattcagaacaaaa

SEQ ID NO: 324561 - DNA, 15 bp, Homo sapiens
cattcagaacaaaat

SEQ ID NO: 324562 - DNA, 15 bp, Homo sapiens
attcagaacaaaata

SEQ ID NO: 324563 - DNA, 15 bp, Homo sapiens
ttcagaacaaaatat

SEQ ID NO: 324564 - DNA, 15 bp, Homo sapiens
tcagaacaaaatata

SEQ ID NO: 324565 - DNA, 15 bp, Homo sapiens
cagaacaaaatataa

SEQ ID NO: 324566 - DNA, 15 bp, Homo sapiens
agaacaaaatataat

SEQ ID NO: 324567 - DNA, 15 bp, Homo sapiens
gaacaaaatataatt

SEQ ID NO: 324568 - DNA, 15 bp, Homo sapiens
aacaaaatataattg

SEQ ID NO: 324569 - DNA, 15 bp, Homo sapiens
acaaaatataattgt

SEQ ID NO: 324570 - DNA, 15 bp, Homo sapiens
caaaatataattgtt

SEQ ID NO: 324571 - DNA, 15 bp, Homo sapiens
aaaatataattgttt

SEQ ID NO: 324572 - DNA, 15 bp, Homo sapiens
aaatataattgtttc

SEQ ID NO: 324573 - DNA, 15 bp, Homo sapiens
aatataattgtttct

SEQ ID NO: 324574 - DNA, 15 bp, Homo sapiens
atataattgtttctt

SEQ ID NO: 324575 - DNA, 15 bp, Homo sapiens
tataattgtttcttg

SEQ ID NO: 324576 - DNA, 15 bp, Homo sapiens
ataattgtttcttgg

SEQ ID NO: 324577 - DNA, 15 bp, Homo sapiens
taattgtttcttggt

SEQ ID NO: 324578 - DNA, 15 bp, Homo sapiens
aattgtttcttggtg

SEQ ID NO: 324579 - DNA, 15 bp, Homo sapiens
attgtttcttggtgc

SEQ ID NO: 324580 - DNA, 15 bp, Homo sapiens
ttgtttcttggtgca

SEQ ID NO: 324581 - DNA, 15 bp, Homo sapiens
tgtttcttggtgcat

SEQ ID NO: 324582 - DNA, 15 bp, Homo sapiens
gtttcttggtgcatc

SEQ ID NO: 324583 - DNA, 15 bp, Homo sapiens
tttcttggtgcatca

SEQ ID NO: 324584 - DNA, 15 bp, Homo sapiens
ttcttggtgcatcag

SEQ ID NO: 324585 - DNA, 15 bp, Homo sapiens
tcttggtgcatcaga

SEQ ID NO: 324586 - DNA, 15 bp, Homo sapiens
cttggtgcatcagat

SEQ ID NO: 324587 - DNA, 15 bp, Homo sapiens
ttggtgcatcagatg

SEQ ID NO: 324588 - DNA, 15 bp, Homo sapiens
tggtgcatcagatgt

SEQ ID NO: 324589 - DNA, 15 bp, Homo sapiens
ggtgcatcagatgtt

SEQ ID NO: 324590 - DNA, 15 bp, Homo sapiens
gtgcatcagatgttt

SEQ ID NO: 324591 - DNA, 15 bp, Homo sapiens
tgcatcagatgttta

SEQ ID NO: 324592 - DNA, 15 bp, Homo sapiens
gcatcagatgtttat

SEQ ID NO: 324593 - DNA, 15 bp, Homo sapiens
catcagatgtttata

SEQ ID NO: 324594 - DNA, 15 bp, Homo sapiens
atcagatgtttatat

SEQ ID NO: 324595 - DNA, 15 bp, Homo sapiens
tcagatgtttatatc

SEQ ID NO: 324596 - DNA, 15 bp, Homo sapiens
cagatgtttatatct

SEQ ID NO: 324597 - DNA, 15 bp, Homo sapiens
agatgtttatatctc

SEQ ID NO: 324598 - DNA, 15 bp, Homo sapiens
gatgtttatatctca

SEQ ID NO: 324599 - DNA, 15 bp, Homo sapiens
atgtttatatctcat

SEQ ID NO: 324600 - DNA, 15 bp, Homo sapiens
tgtttatatctcatg

SEQ ID NO: 324601 - DNA, 15 bp, Homo sapiens
gtttatatctcatga

SEQ ID NO: 324602 - DNA, 15 bp, Homo sapiens
tttatatctcatgat

SEQ ID NO: 324603 - DNA, 15 bp, Homo sapiens
ttatatctcatgata

SEQ ID NO: 324604 - DNA, 15 bp, Homo sapiens
tatatctcatgatag

SEQ ID NO: 324605 - DNA, 15 bp, Homo sapiens
atatctcatgatagt

SEQ ID NO: 324606 - DNA, 15 bp, Homo sapiens
tatctcatgatagtg

SEQ ID NO: 324607 - DNA, 15 bp, Homo sapiens
atctcatgatagtga

SEQ ID NO: 324608 - DNA, 15 bp, Homo sapiens
tctcatgatagtgat

SEQ ID NO: 324609 - DNA, 15 bp, Homo sapiens
ctcatgatagtgatc

SEQ ID NO: 324610 - DNA, 15 bp, Homo sapiens
tcatgatagtgatct

SEQ ID NO: 324611 - DNA, 15 bp, Homo sapiens
catgatagtgatctg

SEQ ID NO: 324612 - DNA, 15 bp, Homo sapiens
atgatagtgatctgt

SEQ ID NO: 324613 - DNA, 15 bp, Homo sapiens
tgatagtgatctgtt

SEQ ID NO: 324614 - DNA, 15 bp, Homo sapiens
gatagtgatctgtta

SEQ ID NO: 324615 - DNA, 15 bp, Homo sapiens
atagtgatctgttaa

SEQ ID NO: 324616 - DNA, 15 bp, Homo sapiens
tagtgatctgttaat

SEQ ID NO: 324617 - DNA, 15 bp, Homo sapiens
agtgatctgttaata

SEQ ID NO: 324618 - DNA, 15 bp, Homo sapiens
gtgatctgttaatag

SEQ ID NO: 324619 - DNA, 15 bp, Homo sapiens
tgatctgttaataga

SEQ ID NO: 324620 - DNA, 15 bp, Homo sapiens
gatctgttaatagat

SEQ ID NO: 324621 - DNA, 15 bp, Homo sapiens
atctgttaatagatc

SEQ ID NO: 324622 - DNA, 15 bp, Homo sapiens
tctgttaatagatca

SEQ ID NO: 324623 - DNA, 15 bp, Homo sapiens
ctgttaatagatcag

SEQ ID NO: 324624 - DNA, 15 bp, Homo sapiens
tgttaatagatcagg

SEQ ID NO: 324625 - DNA, 15 bp, Homo sapiens
gttaatagatcaggg

SEQ ID NO: 324626 - DNA, 15 bp, Homo sapiens
ttaatagatcagggt

SEQ ID NO: 324627 - DNA, 15 bp, Homo sapiens
taatagatcagggtt

SEQ ID NO: 324628 - DNA, 15 bp, Homo sapiens
aatagatcagggttt

SEQ ID NO: 324629 - DNA, 15 bp, Homo sapiens
atagatcagggtttt

SEQ ID NO: 324630 - DNA, 15 bp, Homo sapiens
tagatcagggttttt

SEQ ID NO: 324631 - DNA, 15 bp, Homo sapiens
agatcagggttttta

SEQ ID NO: 324632 - DNA, 15 bp, Homo sapiens
gatcagggtttttat

SEQ ID NO: 324633 - DNA, 15 bp, Homo sapiens
atcagggtttttatt

SEQ ID NO: 324634 - DNA, 15 bp, Homo sapiens
tcagggtttttattc

SEQ ID NO: 324635 - DNA, 15 bp, Homo sapiens
cagggtttttattct

SEQ ID NO: 324636 - DNA, 15 bp, Homo sapiens
agggtttttattctt

SEQ ID NO: 324637 - DNA, 15 bp, Homo sapiens
gggtttttattcttt

SEQ ID NO: 324638 - DNA, 15 bp, Homo sapiens
ggtttttattcttta

SEQ ID NO: 324639 - DNA, 15 bp, Homo sapiens
tttttattctttatc

SEQ ID NO: 324640 - DNA, 15 bp, Homo sapiens
ttttattctttatct

SEQ ID NO: 324641 - DNA, 15 bp, Homo sapiens
tttattctttatctt

SEQ ID NO: 324642 - DNA, 15 bp, Homo sapiens
ttattctttatcttc

SEQ ID NO: 324643 - DNA, 15 bp, Homo sapiens
tattctttatcttca

SEQ ID NO: 324644 - DNA, 15 bp, Homo sapiens
attctttatcttcat

SEQ ID NO: 324645 - DNA, 15 bp, Homo sapiens
ttctttatcttcatc

SEQ ID NO: 324646 - DNA, 15 bp, Homo sapiens
tctttatcttcatcc

SEQ ID NO: 324647 - DNA, 15 bp, Homo sapiens
ctttatcttcatccc

SEQ ID NO: 324648 - DNA, 15 bp, Homo sapiens
tttatcttcatcccc

SEQ ID NO: 324649 - DNA, 15 bp, Homo sapiens
ttatcttcatccccc

SEQ ID NO: 324650 - DNA, 15 bp, Homo sapiens
tatcttcatcccccc

SEQ ID NO: 324651 - DNA, 15 bp, Homo sapiens
atcttcatcccccct

SEQ ID NO: 324652 - DNA, 15 bp, Homo sapiens
tcttcatcccccctt

SEQ ID NO: 324653 - DNA, 15 bp, Homo sapiens
cttcatccccccttc

SEQ ID NO: 324654 - DNA, 15 bp, Homo sapiens
ttcatccccccttca

SEQ ID NO: 324655 - DNA, 15 bp, Homo sapiens
tcatccccccttcat

SEQ ID NO: 324656 - DNA, 15 bp, Homo sapiens
catccccccttcatt

SEQ ID NO: 324657 - DNA, 15 bp, Homo sapiens
atccccccttcattg

SEQ ID NO: 324658 - DNA, 15 bp, Homo sapiens
tccccccttcattgc

SEQ ID NO: 324659 - DNA, 15 bp, Homo sapiens
ccccccttcattgcc

SEQ ID NO: 324660 - DNA, 15 bp, Homo sapiens
cccccttcattgccc

SEQ ID NO: 324661 - DNA, 15 bp, Homo sapiens
ccccttcattgcccc

SEQ ID NO: 324662 - DNA, 15 bp, Homo sapiens
cccttcattgccccc

SEQ ID NO: 324663 - DNA, 15 bp, Homo sapiens
ccttcattgccccca

SEQ ID NO: 324664 - DNA, 15 bp, Homo sapiens
cttcattgcccccat

SEQ ID NO: 324665 - DNA, 15 bp, Homo sapiens
ttcattgcccccata

SEQ ID NO: 324666 - DNA, 15 bp, Homo sapiens
tcattgcccccatag

SEQ ID NO: 324667 - DNA, 15 bp, Homo sapiens
cattgcccccataga

SEQ ID NO: 324668 - DNA, 15 bp, Homo sapiens
attgcccccatagac

SEQ ID NO: 324669 - DNA, 15 bp, Homo sapiens
ttgcccccatagact

SEQ ID NO: 324670 - DNA, 15 bp, Homo sapiens
tgcccccatagactc

SEQ ID NO: 324671 - DNA, 15 bp, Homo sapiens
gcccccatagactcc

SEQ ID NO: 324672 - DNA, 15 bp, Homo sapiens
cccccatagactcct

SEQ ID NO: 324673 - DNA, 15 bp, Homo sapiens
ccccatagactcctt

SEQ ID NO: 324674 - DNA, 15 bp, Homo sapiens
cccatagactccttt

SEQ ID NO: 324675 - DNA, 15 bp, Homo sapiens
ccatagactcctttg

SEQ ID NO: 324676 - DNA, 15 bp, Homo sapiens
catagactcctttgg

SEQ ID NO: 324677 - DNA, 15 bp, Homo sapiens
atagactcctttggc

SEQ ID NO: 324678 - DNA, 15 bp, Homo sapiens
tagactcctttggca

SEQ ID NO: 324679 - DNA, 15 bp, Homo sapiens
agactcctttggcag

SEQ ID NO: 324680 - DNA, 15 bp, Homo sapiens
gactcctttggcagt

SEQ ID NO: 324681 - DNA, 15 bp, Homo sapiens
actcctttggcagtt

SEQ ID NO: 324682 - DNA, 15 bp, Homo sapiens
ctcctttggcagttt

SEQ ID NO: 324683 - DNA, 15 bp, Homo sapiens
tcctttggcagttta

SEQ ID NO: 324684 - DNA, 15 bp, Homo sapiens
cctttggcagtttag

SEQ ID NO: 324685 - DNA, 15 bp, Homo sapiens
ctttggcagtttagt

SEQ ID NO: 324686 - DNA, 15 bp, Homo sapiens
tttggcagtttagtg

SEQ ID NO: 324687 - DNA, 15 bp, Homo sapiens
ttggcagtttagtga

SEQ ID NO: 324688 - DNA, 15 bp, Homo sapiens
tggcagtttagtgaa

SEQ ID NO: 324689 - DNA, 15 bp, Homo sapiens
ggcagtttagtgaag

SEQ ID NO: 324690 - DNA, 15 bp, Homo sapiens
gcagtttagtgaagc

SEQ ID NO: 324691 - DNA, 15 bp, Homo sapiens
cagtttagtgaagcc

SEQ ID NO: 324692 - DNA, 15 bp, Homo sapiens
agtttagtgaagcca

SEQ ID NO: 324693 - DNA, 15 bp, Homo sapiens
gtttagtgaagccag

SEQ ID NO: 324694 - DNA, 15 bp, Homo sapiens
tttagtgaagccaga

SEQ ID NO: 324695 - DNA, 15 bp, Homo sapiens
ttagtgaagccagac

SEQ ID NO: 324696 - DNA, 15 bp, Homo sapiens
tagtgaagccagaca

SEQ ID NO: 324697 - DNA, 15 bp, Homo sapiens
agtgaagccagacaa

SEQ ID NO: 324698 - DNA, 15 bp, Homo sapiens
gtgaagccagacaaa

SEQ ID NO: 324699 - DNA, 15 bp, Homo sapiens
tgaagccagacaaat

SEQ ID NO: 324700 - DNA, 15 bp, Homo sapiens
gaagccagacaaatt

SEQ ID NO: 324701 - DNA, 15 bp, Homo sapiens
aagccagacaaattt

SEQ ID NO: 324702 - DNA, 15 bp, Homo sapiens
agccagacaaatttt

SEQ ID NO: 324703 - DNA, 15 bp, Homo sapiens
gccagacaaattttt

SEQ ID NO: 324704 - DNA, 15 bp, Homo sapiens
ccagacaaatttttt

SEQ ID NO: 324705 - DNA, 15 bp, Homo sapiens
cagacaaattttttt

SEQ ID NO: 324706 - DNA, 15 bp, Homo sapiens
agacaaatttttttt

SEQ ID NO: 324707 - DNA, 15 bp, Homo sapiens
acaaatttttttttg

SEQ ID NO: 324708 - DNA, 15 bp, Homo sapiens
caaatttttttttga

SEQ ID NO: 324709 - DNA, 15 bp, Homo sapiens
aaatttttttttgag

SEQ ID NO: 324710 - DNA, 15 bp, Homo sapiens
aatttttttttgaga

SEQ ID NO: 324711 - DNA, 15 bp, Homo sapiens
atttttttttgagac

SEQ ID NO: 324712 - DNA, 15 bp, Homo sapiens
ttttttttgagacaa

SEQ ID NO: 324713 - DNA, 15 bp, Homo sapiens
tttttttgagacaaa

SEQ ID NO: 324714 - DNA, 15 bp, Homo sapiens
ttttttgagacaaag

SEQ ID NO: 324715 - DNA, 15 bp, Homo sapiens
tttttgagacaaagt

SEQ ID NO: 324716 - DNA, 15 bp, Homo sapiens
ttttgagacaaagtc

SEQ ID NO: 324717 - DNA, 15 bp, Homo sapiens
tttgagacaaagtct

SEQ ID NO: 324718 - DNA, 15 bp, Homo sapiens
ttgagacaaagtctc

SEQ ID NO: 324719 - DNA, 15 bp, Homo sapiens
tgagacaaagtctca

SEQ ID NO: 324720 - DNA, 15 bp, Homo sapiens
gagacaaagtctcac

SEQ ID NO: 324721 - DNA, 15 bp, Homo sapiens
agacaaagtctcact

SEQ ID NO: 324722 - DNA, 15 bp, Homo sapiens
gacaaagtctcactc

SEQ ID NO: 324723 - DNA, 15 bp, Homo sapiens
acaaagtctcactct

SEQ ID NO: 324724 - DNA, 15 bp, Homo sapiens
caaagtctcactctg

SEQ ID NO: 324725 - DNA, 15 bp, Homo sapiens
aaagtctcactctgt

SEQ ID NO: 324726 - DNA, 15 bp, Homo sapiens
aagtctcactctgtt

SEQ ID NO: 324727 - DNA, 15 bp, Homo sapiens
actctgttgcccagc

SEQ ID NO: 324728 - DNA, 15 bp, Homo sapiens
ctctgttgcccagcc

SEQ ID NO: 324729 - DNA, 15 bp, Homo sapiens
tctgttgcccagcct

SEQ ID NO: 324730 - DNA, 15 bp, Homo sapiens
ctgttgcccagcctg

SEQ ID NO: 324731 - DNA, 15 bp, Homo sapiens
tgttgcccagcctgg

SEQ ID NO: 324732 - DNA, 15 bp, Homo sapiens
gttgcccagcctgga

SEQ ID NO: 324733 - DNA, 15 bp, Homo sapiens
ttgcccagcctggag

SEQ ID NO: 324734 - DNA, 15 bp, Homo sapiens
tgcccagcctggagt

SEQ ID NO: 324735 - DNA, 15 bp, Homo sapiens
gcccagcctggagtg

SEQ ID NO: 324736 - DNA, 15 bp, Homo sapiens
cccagcctggagtgc

SEQ ID NO: 324737 - DNA, 15 bp, Homo sapiens
ccagcctggagtgca

SEQ ID NO: 324738 - DNA, 15 bp, Homo sapiens
cagcctggagtgcag

SEQ ID NO: 324739 - DNA, 15 bp, Homo sapiens
agcctggagtgcagt

SEQ ID NO: 324740 - DNA, 15 bp, Homo sapiens
gcctggagtgcagtg

SEQ ID NO: 324741 - DNA, 15 bp, Homo sapiens
cctggagtgcagtgg

SEQ ID NO: 324742 - DNA, 15 bp, Homo sapiens
cagtggtgcgatctt

SEQ ID NO: 324743 - DNA, 15 bp, Homo sapiens
agtggtgcgatcttg

SEQ ID NO: 324744 - DNA, 15 bp, Homo sapiens
gtggtgcgatcttgg

SEQ ID NO: 324745 - DNA, 15 bp, Homo sapiens
tggtgcgatcttggc

SEQ ID NO: 324746 - DNA, 15 bp, Homo sapiens
ggtgcgatcttggct

SEQ ID NO: 324747 - DNA, 15 bp, Homo sapiens
gtgcgatcttggctc

SEQ ID NO: 324748 - DNA, 15 bp, Homo sapiens
tgcgatcttggctcc

SEQ ID NO: 324749 - DNA, 15 bp, Homo sapiens
gcgatcttggctccc

SEQ ID NO: 324750 - DNA, 15 bp, Homo sapiens
cgatcttggctccct

SEQ ID NO: 324751 - DNA, 15 bp, Homo sapiens
gatcttggctccctg

SEQ ID NO: 324752 - DNA, 15 bp, Homo sapiens
atcttggctccctgc

SEQ ID NO: 324753 - DNA, 15 bp, Homo sapiens
tcttggctccctgca

SEQ ID NO: 324754 - DNA, 15 bp, Homo sapiens
cttggctccctgcaa

SEQ ID NO: 324755 - DNA, 15 bp, Homo sapiens
ttggctccctgcaac

SEQ ID NO: 324756 - DNA, 15 bp, Homo sapiens
tggctccctgcaacc

SEQ ID NO: 324757 - DNA, 15 bp, Homo sapiens
ggctccctgcaacct

SEQ ID NO: 324758 - DNA, 15 bp, Homo sapiens
gctccctgcaacctc

SEQ ID NO: 324759 - DNA, 15 bp, Homo sapiens
ctccctgcaacctct

SEQ ID NO: 324760 - DNA, 15 bp, Homo sapiens
tccctgcaacctctg

SEQ ID NO: 324761 - DNA, 15 bp, Homo sapiens
ccctgcaacctctgc

SEQ ID NO: 324762 - DNA, 15 bp, Homo sapiens
cctgcaacctctgcc

SEQ ID NO: 324763 - DNA, 15 bp, Homo sapiens
tctgcctcccaggtt

SEQ ID NO: 324764 - DNA, 15 bp, Homo sapiens
tcccaggttcaagcg

SEQ ID NO: 324765 - DNA, 15 bp, Homo sapiens
cccaggttcaagcga

SEQ ID NO: 324766 - DNA, 15 bp, Homo sapiens
ccaggttcaagcgat

SEQ ID NO: 324767 - DNA, 15 bp, Homo sapiens
caggttcaagcgatt

SEQ ID NO: 324768 - DNA, 15 bp, Homo sapiens
aggttcaagcgattt

SEQ ID NO: 324769 - DNA, 15 bp, Homo sapiens
ggttcaagcgatttt

SEQ ID NO: 324770 - DNA, 15 bp, Homo sapiens
gttcaagcgattttc

SEQ ID NO: 324771 - DNA, 15 bp, Homo sapiens
ttcaagcgattttcc

SEQ ID NO: 324772 - DNA, 15 bp, Homo sapiens
tcaagcgattttcct

SEQ ID NO: 324773 - DNA, 15 bp, Homo sapiens
caagcgattttcctg

SEQ ID NO: 324774 - DNA, 15 bp, Homo sapiens
aagcgattttcctgc

SEQ ID NO: 324775 - DNA, 15 bp, Homo sapiens
agcgattttcctgcc

SEQ ID NO: 324776 - DNA, 15 bp, Homo sapiens
gcgattttcctgcct

SEQ ID NO: 324777 - DNA, 15 bp, Homo sapiens
cgattttcctgcctc

SEQ ID NO: 324778 - DNA, 15 bp, Homo sapiens
gattttcctgcctca

SEQ ID NO: 324779 - DNA, 15 bp, Homo sapiens
attttcctgcctcag

SEQ ID NO: 324780 - DNA, 15 bp, Homo sapiens
ttttcctgcctcagt

SEQ ID NO: 324781 - DNA, 15 bp, Homo sapiens
tttcctgcctcagtc

SEQ ID NO: 324782 - DNA, 15 bp, Homo sapiens
ttcctgcctcagtct

SEQ ID NO: 324783 - DNA, 15 bp, Homo sapiens
tgcctcagtctccca

SEQ ID NO: 324784 - DNA, 15 bp, Homo sapiens
gcctcagtctcccaa

SEQ ID NO: 324785 - DNA, 15 bp, Homo sapiens
cctcagtctcccaag

SEQ ID NO: 324786 - DNA, 15 bp, Homo sapiens
ctcagtctcccaagt

SEQ ID NO: 324787 - DNA, 15 bp, Homo sapiens
tcagtctcccaagta

SEQ ID NO: 324788 - DNA, 15 bp, Homo sapiens
cagtctcccaagtag

SEQ ID NO: 324789 - DNA, 15 bp, Homo sapiens
agtctcccaagtagc

SEQ ID NO: 324790 - DNA, 15 bp, Homo sapiens
gtctcccaagtagct

SEQ ID NO: 324791 - DNA, 15 bp, Homo sapiens
tctcccaagtagctg

SEQ ID NO: 324792 - DNA, 15 bp, Homo sapiens
agctgggattacagt

SEQ ID NO: 324793 - DNA, 15 bp, Homo sapiens
gctgggattacagtt

SEQ ID NO: 324794 - DNA, 15 bp, Homo sapiens
ctgggattacagttg

SEQ ID NO: 324795 - DNA, 15 bp, Homo sapiens
tgggattacagttgc

SEQ ID NO: 324796 - DNA, 15 bp, Homo sapiens
gggattacagttgca

SEQ ID NO: 324797 - DNA, 15 bp, Homo sapiens
ggattacagttgcaa

SEQ ID NO: 324798 - DNA, 15 bp, Homo sapiens
gattacagttgcaag

SEQ ID NO: 324799 - DNA, 15 bp, Homo sapiens
attacagttgcaagc

SEQ ID NO: 324800 - DNA, 15 bp, Homo sapiens
ttacagttgcaagcc

SEQ ID NO: 324801 - DNA, 15 bp, Homo sapiens
tacagttgcaagcca

SEQ ID NO: 324802 - DNA, 15 bp, Homo sapiens
acagttgcaagccac

SEQ ID NO: 324803 - DNA, 15 bp, Homo sapiens
cagttgcaagccact

SEQ ID NO: 324804 - DNA, 15 bp, Homo sapiens
agttgcaagccactg

SEQ ID NO: 324805 - DNA, 15 bp, Homo sapiens
gttgcaagccactgt

SEQ ID NO: 324806 - DNA, 15 bp, Homo sapiens
ttgcaagccactgta

SEQ ID NO: 324807 - DNA, 15 bp, Homo sapiens
tgcaagccactgtac

SEQ ID NO: 324808 - DNA, 15 bp, Homo sapiens
gcaagccactgtacc

SEQ ID NO: 324809 - DNA, 15 bp, Homo sapiens
caagccactgtaccc

SEQ ID NO: 324810 - DNA, 15 bp, Homo sapiens
aagccactgtaccca

SEQ ID NO: 324811 - DNA, 15 bp, Homo sapiens
agccactgtacccag

SEQ ID NO: 324812 - DNA, 15 bp, Homo sapiens
gccactgtacccagc

SEQ ID NO: 324813 - DNA, 15 bp, Homo sapiens
ccactgtacccagct

SEQ ID NO: 324814 - DNA, 15 bp, Homo sapiens
cactgtacccagcta

SEQ ID NO: 324815 - DNA, 15 bp, Homo sapiens
actgtacccagctaa

SEQ ID NO: 324816 - DNA, 15 bp, Homo sapiens
ctgtacccagctaat

SEQ ID NO: 324817 - DNA, 15 bp, Homo sapiens
tgtacccagctaatt

SEQ ID NO: 324818 - DNA, 15 bp, Homo sapiens
gtacccagctaattt

SEQ ID NO: 324819 - DNA, 15 bp, Homo sapiens
ccagctaattttttg

SEQ ID NO: 324820 - DNA, 15 bp, Homo sapiens
cagctaattttttgt

SEQ ID NO: 324821 - DNA, 15 bp, Homo sapiens
agctaattttttgta

SEQ ID NO: 324822 - DNA, 15 bp, Homo sapiens
gctaattttttgtat

SEQ ID NO: 324823 - DNA, 15 bp, Homo sapiens
ctaattttttgtatt

SEQ ID NO: 324824 - DNA, 15 bp, Homo sapiens
taattttttgtattt

SEQ ID NO: 324825 - DNA, 15 bp, Homo sapiens
aattttttgtatttt

SEQ ID NO: 324826 - DNA, 15 bp, Homo sapiens
attttttgtattttt

SEQ ID NO: 324827 - DNA, 15 bp, Homo sapiens
ttttttgtatttttg

SEQ ID NO: 324828 - DNA, 15 bp, Homo sapiens
tttggtagagacgga

SEQ ID NO: 324829 - DNA, 15 bp, Homo sapiens
ttggtagagacggag

SEQ ID NO: 324830 - DNA, 15 bp, Homo sapiens
tggtagagacggagt

SEQ ID NO: 324831 - DNA, 15 bp, Homo sapiens
ggtagagacggagtt

SEQ ID NO: 324832 - DNA, 15 bp, Homo sapiens
gtagagacggagtta

SEQ ID NO: 324833 - DNA, 15 bp, Homo sapiens
tagagacggagttac

SEQ ID NO: 324834 - DNA, 15 bp, Homo sapiens
agagacggagttaca

SEQ ID NO: 324835 - DNA, 15 bp, Homo sapiens
gagacggagttacac

SEQ ID NO: 324836 - DNA, 15 bp, Homo sapiens
agacggagttacacc

SEQ ID NO: 324837 - DNA, 15 bp, Homo sapiens
gacggagttacacca

SEQ ID NO: 324838 - DNA, 15 bp, Homo sapiens
acggagttacaccat

SEQ ID NO: 324839 - DNA, 15 bp, Homo sapiens
cggagttacaccatg

SEQ ID NO: 324840 - DNA, 15 bp, Homo sapiens
ggagttacaccatgt

SEQ ID NO: 324841 - DNA, 15 bp, Homo sapiens
gagttacaccatgtt

SEQ ID NO: 324842 - DNA, 15 bp, Homo sapiens
agttacaccatgttg

SEQ ID NO: 324843 - DNA, 15 bp, Homo sapiens
gttacaccatgttgg

SEQ ID NO: 324844 - DNA, 15 bp, Homo sapiens
ttacaccatgttggc

SEQ ID NO: 324845 - DNA, 15 bp, Homo sapiens
tacaccatgttggcc

SEQ ID NO: 324846 - DNA, 15 bp, Homo sapiens
acaccatgttggcca

SEQ ID NO: 324847 - DNA, 15 bp, Homo sapiens
atgttggccagcctg

SEQ ID NO: 324848 - DNA, 15 bp, Homo sapiens
tgttggccagcctga

SEQ ID NO: 324849 - DNA, 15 bp, Homo sapiens
gttggccagcctgat

SEQ ID NO: 324850 - DNA, 15 bp, Homo sapiens
ttggccagcctgatc

SEQ ID NO: 324851 - DNA, 15 bp, Homo sapiens
tggccagcctgatct

SEQ ID NO: 324852 - DNA, 15 bp, Homo sapiens
ggccagcctgatctt

SEQ ID NO: 324853 - DNA, 15 bp, Homo sapiens
gccagcctgatcttg

SEQ ID NO: 324854 - DNA, 15 bp, Homo sapiens
ccagcctgatcttga

SEQ ID NO: 324855 - DNA, 15 bp, Homo sapiens
cagcctgatcttgaa

SEQ ID NO: 324856 - DNA, 15 bp, Homo sapiens
agcctgatcttgaag

SEQ ID NO: 324857 - DNA, 15 bp, Homo sapiens
gcctgatcttgaagt

SEQ ID NO: 324858 - DNA, 15 bp, Homo sapiens
cctgatcttgaagtc

SEQ ID NO: 324859 - DNA, 15 bp, Homo sapiens
ctgatcttgaagtcc

SEQ ID NO: 324860 - DNA, 15 bp, Homo sapiens
tgatcttgaagtcct

SEQ ID NO: 324861 - DNA, 15 bp, Homo sapiens
gatcttgaagtcctg

SEQ ID NO: 324862 - DNA, 15 bp, Homo sapiens
atcttgaagtcctga

SEQ ID NO: 324863 - DNA, 15 bp, Homo sapiens
tcttgaagtcctgac

SEQ ID NO: 324864 - DNA, 15 bp, Homo sapiens
cttgaagtcctgacc

SEQ ID NO: 324865 - DNA, 15 bp, Homo sapiens
ttgaagtcctgacct

SEQ ID NO: 324866 - DNA, 15 bp, Homo sapiens
tgaagtcctgacctc

SEQ ID NO: 324867 - DNA, 15 bp, Homo sapiens
gaagtcctgacctca

SEQ ID NO: 324868 - DNA, 15 bp, Homo sapiens
aagtcctgacctcag

SEQ ID NO: 324869 - DNA, 15 bp, Homo sapiens
agtcctgacctcagg

SEQ ID NO: 324870 - DNA, 15 bp, Homo sapiens
gtcctgacctcaggt

SEQ ID NO: 324871 - DNA, 15 bp, Homo sapiens
tcctgacctcaggta

SEQ ID NO: 324872 - DNA, 15 bp, Homo sapiens
cctgacctcaggtaa

SEQ ID NO: 324873 - DNA, 15 bp, Homo sapiens
ctgacctcaggtaat

SEQ ID NO: 324874 - DNA, 15 bp, Homo sapiens
tgacctcaggtaatc

SEQ ID NO: 324875 - DNA, 15 bp, Homo sapiens
gacctcaggtaatcc

SEQ ID NO: 324876 - DNA, 15 bp, Homo sapiens
acctcaggtaatccc

SEQ ID NO: 324877 - DNA, 15 bp, Homo sapiens
cctcaggtaatcccc

SEQ ID NO: 324878 - DNA, 15 bp, Homo sapiens
ctcaggtaatccccc

SEQ ID NO: 324879 - DNA, 15 bp, Homo sapiens
tcaggtaatccccct

SEQ ID NO: 324880 - DNA, 15 bp, Homo sapiens
caggtaatccccctg

SEQ ID NO: 324881 - DNA, 15 bp, Homo sapiens
aggtaatccccctgc

SEQ ID NO: 324882 - DNA, 15 bp, Homo sapiens
ggtaatccccctgcc

SEQ ID NO: 324883 - DNA, 15 bp, Homo sapiens
gtaatccccctgcct

SEQ ID NO: 324884 - DNA, 15 bp, Homo sapiens
taatccccctgcctc

SEQ ID NO: 324885 - DNA, 15 bp, Homo sapiens
aatccccctgcctcg

SEQ ID NO: 324886 - DNA, 15 bp, Homo sapiens
atccccctgcctcgg

SEQ ID NO: 324887 - DNA, 15 bp, Homo sapiens
tccccctgcctcggc

SEQ ID NO: 324888 - DNA, 15 bp, Homo sapiens
ccccctgcctcggcc

SEQ ID NO: 324889 - DNA, 15 bp, Homo sapiens
cccctgcctcggcct

SEQ ID NO: 324890 - DNA, 15 bp, Homo sapiens
ccctgcctcggcctg

SEQ ID NO: 324891 - DNA, 15 bp, Homo sapiens
cctgcctcggcctgc

SEQ ID NO: 324892 - DNA, 15 bp, Homo sapiens
ctgcctcggcctgca

SEQ ID NO: 324893 - DNA, 15 bp, Homo sapiens
tgcctcggcctgcaa

SEQ ID NO: 324894 - DNA, 15 bp, Homo sapiens
gcctcggcctgcaaa

SEQ ID NO: 324895 - DNA, 15 bp, Homo sapiens
cctcggcctgcaaaa

SEQ ID NO: 324896 - DNA, 15 bp, Homo sapiens
ctcggcctgcaaaag

SEQ ID NO: 324897 - DNA, 15 bp, Homo sapiens
tcggcctgcaaaagt

SEQ ID NO: 324898 - DNA, 15 bp, Homo sapiens
cggcctgcaaaagtg

SEQ ID NO: 324899 - DNA, 15 bp, Homo sapiens
ggcctgcaaaagtgc

SEQ ID NO: 324900 - DNA, 15 bp, Homo sapiens
gcctgcaaaagtgct

SEQ ID NO: 324901 - DNA, 15 bp, Homo sapiens
cctgcaaaagtgcta

SEQ ID NO: 324902 - DNA, 15 bp, Homo sapiens
ctgcaaaagtgctag

SEQ ID NO: 324903 - DNA, 15 bp, Homo sapiens
tgcaaaagtgctagg

SEQ ID NO: 324904 - DNA, 15 bp, Homo sapiens
gcaaaagtgctagga

SEQ ID NO: 324905 - DNA, 15 bp, Homo sapiens
caaaagtgctaggat

SEQ ID NO: 324906 - DNA, 15 bp, Homo sapiens
aaaagtgctaggatt

SEQ ID NO: 324907 - DNA, 15 bp, Homo sapiens
gctaggattacaggt

SEQ ID NO: 324908 - DNA, 15 bp, Homo sapiens
ctaggattacaggtg

SEQ ID NO: 324909 - DNA, 15 bp, Homo sapiens
taggattacaggtgt

SEQ ID NO: 324910 - DNA, 15 bp, Homo sapiens
aggattacaggtgtg

SEQ ID NO: 324911 - DNA, 15 bp, Homo sapiens
gtgtgagccaccgca

SEQ ID NO: 324912 - DNA, 15 bp, Homo sapiens
tgtgagccaccgcac

SEQ ID NO: 324913 - DNA, 15 bp, Homo sapiens
gtgagccaccgcacc

SEQ ID NO: 324914 - DNA, 15 bp, Homo sapiens
gccaccgcacctggc

SEQ ID NO: 324915 - DNA, 15 bp, Homo sapiens
ccaccgcacctggcc

SEQ ID NO: 324916 - DNA, 15 bp, Homo sapiens
caccgcacctggcct

SEQ ID NO: 324917 - DNA, 15 bp, Homo sapiens
accgcacctggcctt

SEQ ID NO: 324918 - DNA, 15 bp, Homo sapiens
ccgcacctggccttt

SEQ ID NO: 324919 - DNA, 15 bp, Homo sapiens
cgcacctggcctttt

SEQ ID NO: 324920 - DNA, 15 bp, Homo sapiens
gcacctggccttttt

SEQ ID NO: 324921 - DNA, 15 bp, Homo sapiens
cacctggcctttttt

SEQ ID NO: 324922 - DNA, 15 bp, Homo sapiens
acctggccttttttt

SEQ ID NO: 324923 - DNA, 15 bp, Homo sapiens
ggagtctcactctgt

SEQ ID NO: 324924 - DNA, 15 bp, Homo sapiens
gagtctcactctgtc

SEQ ID NO: 324925 - DNA, 15 bp, Homo sapiens
agtctcactctgtca

SEQ ID NO: 324926 - DNA, 15 bp, Homo sapiens
gtctcactctgtcac

SEQ ID NO: 324927 - DNA, 15 bp, Homo sapiens
tctcactctgtcacc

SEQ ID NO: 324928 - DNA, 15 bp, Homo sapiens
ctcactctgtcaccc

SEQ ID NO: 324929 - DNA, 15 bp, Homo sapiens
tcactctgtcaccca

SEQ ID NO: 324930 - DNA, 15 bp, Homo sapiens
cactctgtcacccag

SEQ ID NO: 324931 - DNA, 15 bp, Homo sapiens
actctgtcacccagg

SEQ ID NO: 324932 - DNA, 15 bp, Homo sapiens
aggctggagtgtagg

SEQ ID NO: 324933 - DNA, 15 bp, Homo sapiens
ggctggagtgtaggg

SEQ ID NO: 324934 - DNA, 15 bp, Homo sapiens
gctggagtgtagggg

SEQ ID NO: 324935 - DNA, 15 bp, Homo sapiens
ctggagtgtaggggg

SEQ ID NO: 324936 - DNA, 15 bp, Homo sapiens
tggagtgtagggggg

SEQ ID NO: 324937 - DNA, 15 bp, Homo sapiens
ggagtgtaggggggc

SEQ ID NO: 324938 - DNA, 15 bp, Homo sapiens
gagtgtaggggggcg

SEQ ID NO: 324939 - DNA, 15 bp, Homo sapiens
agtgtaggggggcga

SEQ ID NO: 324940 - DNA, 15 bp, Homo sapiens
gtgtaggggggcgat

SEQ ID NO: 324941 - DNA, 15 bp, Homo sapiens
tgtaggggggcgatc

SEQ ID NO: 324942 - DNA, 15 bp, Homo sapiens
gtaggggggcgatct

SEQ ID NO: 324943 - DNA, 15 bp, Homo sapiens
taggggggcgatctc

SEQ ID NO: 324944 - DNA, 15 bp, Homo sapiens
aggggggcgatctcg

SEQ ID NO: 324945 - DNA, 15 bp, Homo sapiens
ggggggcgatctcgg

SEQ ID NO: 324946 - DNA, 15 bp, Homo sapiens
gggggcgatctcggc

SEQ ID NO: 324947 - DNA, 15 bp, Homo sapiens
ggggcgatctcggct

SEQ ID NO: 324948 - DNA, 15 bp, Homo sapiens
gggcgatctcggctc

SEQ ID NO: 324949 - DNA, 15 bp, Homo sapiens
ggcgatctcggctca

SEQ ID NO: 324950 - DNA, 15 bp, Homo sapiens
cggctcactgcaact

SEQ ID NO: 324951 - DNA, 15 bp, Homo sapiens
ggctcactgcaactt

SEQ ID NO: 324952 - DNA, 15 bp, Homo sapiens
ctcactgcaacttct

SEQ ID NO: 324953 - DNA, 15 bp, Homo sapiens
tcactgcaacttcta

SEQ ID NO: 324954 - DNA, 15 bp, Homo sapiens
cactgcaacttctac

SEQ ID NO: 324955 - DNA, 15 bp, Homo sapiens
actgcaacttctacc

SEQ ID NO: 324956 - DNA, 15 bp, Homo sapiens
ctgcaacttctacct

SEQ ID NO: 324957 - DNA, 15 bp, Homo sapiens
tgcaacttctacctc

SEQ ID NO: 324958 - DNA, 15 bp, Homo sapiens
gcaacttctacctct

SEQ ID NO: 324959 - DNA, 15 bp, Homo sapiens
caacttctacctctc

SEQ ID NO: 324960 - DNA, 15 bp, Homo sapiens
aacttctacctctcg

SEQ ID NO: 324961 - DNA, 15 bp, Homo sapiens
acttctacctctcgg

SEQ ID NO: 324962 - DNA, 15 bp, Homo sapiens
cttctacctctcggg

SEQ ID NO: 324963 - DNA, 15 bp, Homo sapiens
ttctacctctcgggt

SEQ ID NO: 324964 - DNA, 15 bp, Homo sapiens
tctacctctcgggtt

SEQ ID NO: 324965 - DNA, 15 bp, Homo sapiens
ctacctctcgggttc

SEQ ID NO: 324966 - DNA, 15 bp, Homo sapiens
tacctctcgggttca

SEQ ID NO: 324967 - DNA, 15 bp, Homo sapiens
acctctcgggttcaa

SEQ ID NO: 324968 - DNA, 15 bp, Homo sapiens
tctcgggttcaagcg

SEQ ID NO: 324969 - DNA, 15 bp, Homo sapiens
tcgggttcaagcgat

SEQ ID NO: 324970 - DNA, 15 bp, Homo sapiens
ttctcctgcctcaga

SEQ ID NO: 324971 - DNA, 15 bp, Homo sapiens
tctcctgcctcagac

SEQ ID NO: 324972 - DNA, 15 bp, Homo sapiens
ctcctgcctcagact

SEQ ID NO: 324973 - DNA, 15 bp, Homo sapiens
tcctgcctcagactc

SEQ ID NO: 324974 - DNA, 15 bp, Homo sapiens
cctgcctcagactcc

SEQ ID NO: 324975 - DNA, 15 bp, Homo sapiens
ctgcctcagactccc

SEQ ID NO: 324976 - DNA, 15 bp, Homo sapiens
tgcctcagactcccg

SEQ ID NO: 324977 - DNA, 15 bp, Homo sapiens
gcctcagactcccga

SEQ ID NO: 324978 - DNA, 15 bp, Homo sapiens
cctcagactcccgag

SEQ ID NO: 324979 - DNA, 15 bp, Homo sapiens
ctcagactcccgagt

SEQ ID NO: 324980 - DNA, 15 bp, Homo sapiens
tcagactcccgagta

SEQ ID NO: 324981 - DNA, 15 bp, Homo sapiens
cagactcccgagtag

SEQ ID NO: 324982 - DNA, 15 bp, Homo sapiens
agactcccgagtagc

SEQ ID NO: 324983 - DNA, 15 bp, Homo sapiens
gactcccgagtagct

SEQ ID NO: 324984 - DNA, 15 bp, Homo sapiens
actcccgagtagctg

SEQ ID NO: 324985 - DNA, 15 bp, Homo sapiens
ccgagtagctgggac

SEQ ID NO: 324986 - DNA, 15 bp, Homo sapiens
cgagtagctgggact

SEQ ID NO: 324987 - DNA, 15 bp, Homo sapiens
gctgggactacaggc

SEQ ID NO: 324988 - DNA, 15 bp, Homo sapiens
ctgggactacaggcg

SEQ ID NO: 324989 - DNA, 15 bp, Homo sapiens
tgggactacaggcgc

SEQ ID NO: 324990 - DNA, 15 bp, Homo sapiens
gggactacaggcgca

SEQ ID NO: 324991 - DNA, 15 bp, Homo sapiens
ggactacaggcgcac

SEQ ID NO: 324992 - DNA, 15 bp, Homo sapiens
gactacaggcgcacg

SEQ ID NO: 324993 - DNA, 15 bp, Homo sapiens
actacaggcgcacgc

SEQ ID NO: 324994 - DNA, 15 bp, Homo sapiens
ctacaggcgcacgcc

SEQ ID NO: 324995 - DNA, 15 bp, Homo sapiens
tacaggcgcacgcca

SEQ ID NO: 324996 - DNA, 15 bp, Homo sapiens
acaggcgcacgccat

SEQ ID NO: 324997 - DNA, 15 bp, Homo sapiens
caggcgcacgccatc

SEQ ID NO: 324998 - DNA, 15 bp, Homo sapiens
aggcgcacgccatca

SEQ ID NO: 324999 - DNA, 15 bp, Homo sapiens
ggcgcacgccatcat

SEQ ID NO: 325000 - DNA, 15 bp, Homo sapiens
gcgcacgccatcatg

SEQ ID NO: 325001 - DNA, 15 bp, Homo sapiens
cgcacgccatcatgc

SEQ ID NO: 325002 - DNA, 15 bp, Homo sapiens
gcacgccatcatgcc

SEQ ID NO: 325003 - DNA, 15 bp, Homo sapiens
cacgccatcatgccc

SEQ ID NO: 325004 - DNA, 15 bp, Homo sapiens
acgccatcatgccca

SEQ ID NO: 325005 - DNA, 15 bp, Homo sapiens
cgccatcatgcccag

SEQ ID NO: 325006 - DNA, 15 bp, Homo sapiens
gccatcatgcccagc

SEQ ID NO: 325007 - DNA, 15 bp, Homo sapiens
ttgtatttttagtaa

SEQ ID NO: 325008 - DNA, 15 bp, Homo sapiens
tgtatttttagtaaa

SEQ ID NO: 325009 - DNA, 15 bp, Homo sapiens
gtatttttagtaaag

SEQ ID NO: 325010 - DNA, 15 bp, Homo sapiens
tatttttagtaaaga

SEQ ID NO: 325011 - DNA, 15 bp, Homo sapiens
atttttagtaaagac

SEQ ID NO: 325012 - DNA, 15 bp, Homo sapiens
tttttagtaaagaca

SEQ ID NO: 325013 - DNA, 15 bp, Homo sapiens
ttttagtaaagacaa

SEQ ID NO: 325014 - DNA, 15 bp, Homo sapiens
tttagtaaagacaag

SEQ ID NO: 325015 - DNA, 15 bp, Homo sapiens
ttagtaaagacaaga

SEQ ID NO: 325016 - DNA, 15 bp, Homo sapiens
tagtaaagacaagat

SEQ ID NO: 325017 - DNA, 15 bp, Homo sapiens
agtaaagacaagatt

SEQ ID NO: 325018 - DNA, 15 bp, Homo sapiens
gtaaagacaagattt

SEQ ID NO: 325019 - DNA, 15 bp, Homo sapiens
taaagacaagatttc

SEQ ID NO: 325020 - DNA, 15 bp, Homo sapiens
aaagacaagatttca

SEQ ID NO: 325021 - DNA, 15 bp, Homo sapiens
aagacaagatttcac

SEQ ID NO: 325022 - DNA, 15 bp, Homo sapiens
agacaagatttcacc

SEQ ID NO: 325023 - DNA, 15 bp, Homo sapiens
gacaagatttcacca

SEQ ID NO: 325024 - DNA, 15 bp, Homo sapiens
acaagatttcaccat

SEQ ID NO: 325025 - DNA, 15 bp, Homo sapiens
caagatttcaccatg

SEQ ID NO: 325026 - DNA, 15 bp, Homo sapiens
aagatttcaccatgt

SEQ ID NO: 325027 - DNA, 15 bp, Homo sapiens
agatttcaccatgtt

SEQ ID NO: 325028 - DNA, 15 bp, Homo sapiens
gatttcaccatgttg

SEQ ID NO: 325029 - DNA, 15 bp, Homo sapiens
atttcaccatgttgg

SEQ ID NO: 325030 - DNA, 15 bp, Homo sapiens
ccatgttggccagga

SEQ ID NO: 325031 - DNA, 15 bp, Homo sapiens
catgttggccaggat

SEQ ID NO: 325032 - DNA, 15 bp, Homo sapiens
atgttggccaggatg

SEQ ID NO: 325033 - DNA, 15 bp, Homo sapiens
tgttggccaggatgg

SEQ ID NO: 325034 - DNA, 15 bp, Homo sapiens
gttggccaggatggt

SEQ ID NO: 325035 - DNA, 15 bp, Homo sapiens
ttggccaggatggtc

SEQ ID NO: 325036 - DNA, 15 bp, Homo sapiens
tggccaggatggtct

SEQ ID NO: 325037 - DNA, 15 bp, Homo sapiens
ggccaggatggtctc

SEQ ID NO: 325038 - DNA, 15 bp, Homo sapiens
gccaggatggtctcg

SEQ ID NO: 325039 - DNA, 15 bp, Homo sapiens
ccaggatggtctcga

SEQ ID NO: 325040 - DNA, 15 bp, Homo sapiens
caggatggtctcgat

SEQ ID NO: 325041 - DNA, 15 bp, Homo sapiens
aggatggtctcgatc

SEQ ID NO: 325042 - DNA, 15 bp, Homo sapiens
ggatggtctcgatct

SEQ ID NO: 325043 - DNA, 15 bp, Homo sapiens
gatggtctcgatctc

SEQ ID NO: 325044 - DNA, 15 bp, Homo sapiens
atggtctcgatctct

SEQ ID NO: 325045 - DNA, 15 bp, Homo sapiens
tggtctcgatctctt

SEQ ID NO: 325046 - DNA, 15 bp, Homo sapiens
ggtctcgatctcttg

SEQ ID NO: 325047 - DNA, 15 bp, Homo sapiens
gtctcgatctcttga

SEQ ID NO: 325048 - DNA, 15 bp, Homo sapiens
tctcgatctcttgac

SEQ ID NO: 325049 - DNA, 15 bp, Homo sapiens
ctcgatctcttgacc

SEQ ID NO: 325050 - DNA, 15 bp, Homo sapiens
tcgatctcttgacct

SEQ ID NO: 325051 - DNA, 15 bp, Homo sapiens
cgatctcttgacctt

SEQ ID NO: 325052 - DNA, 15 bp, Homo sapiens
ccttgtgatccgcct

SEQ ID NO: 325053 - DNA, 15 bp, Homo sapiens
cttgtgatccgcctg

SEQ ID NO: 325054 - DNA, 15 bp, Homo sapiens
ttgtgatccgcctgc

SEQ ID NO: 325055 - DNA, 15 bp, Homo sapiens
tgtgatccgcctgcc

SEQ ID NO: 325056 - DNA, 15 bp, Homo sapiens
gtgatccgcctgcct

SEQ ID NO: 325057 - DNA, 15 bp, Homo sapiens
tgatccgcctgcctc

SEQ ID NO: 325058 - DNA, 15 bp, Homo sapiens
gatccgcctgcctcg

SEQ ID NO: 325059 - DNA, 15 bp, Homo sapiens
atccgcctgcctcgg

SEQ ID NO: 325060 - DNA, 15 bp, Homo sapiens
tccgcctgcctcggc

SEQ ID NO: 325061 - DNA, 15 bp, Homo sapiens
ccgcctgcctcggcc

SEQ ID NO: 325062 - DNA, 15 bp, Homo sapiens
cgcctgcctcggcct

SEQ ID NO: 325063 - DNA, 15 bp, Homo sapiens
gcctgcctcggcctc

SEQ ID NO: 325064 - DNA, 15 bp, Homo sapiens
tgctgggattacaga

SEQ ID NO: 325065 - DNA, 15 bp, Homo sapiens
gctgggattacagat

SEQ ID NO: 325066 - DNA, 15 bp, Homo sapiens
ctgggattacagata

SEQ ID NO: 325067 - DNA, 15 bp, Homo sapiens
tgggattacagatat

SEQ ID NO: 325068 - DNA, 15 bp, Homo sapiens
gggattacagatatg

SEQ ID NO: 325069 - DNA, 15 bp, Homo sapiens
ggattacagatatga

SEQ ID NO: 325070 - DNA, 15 bp, Homo sapiens
gattacagatatgag

SEQ ID NO: 325071 - DNA, 15 bp, Homo sapiens
attacagatatgagg

SEQ ID NO: 325072 - DNA, 15 bp, Homo sapiens
ttacagatatgaggc

SEQ ID NO: 325073 - DNA, 15 bp, Homo sapiens
tacagatatgaggca

SEQ ID NO: 325074 - DNA, 15 bp, Homo sapiens
acagatatgaggcac

SEQ ID NO: 325075 - DNA, 15 bp, Homo sapiens
cagatatgaggcacc

SEQ ID NO: 325076 - DNA, 15 bp, Homo sapiens
agatatgaggcaccg

SEQ ID NO: 325077 - DNA, 15 bp, Homo sapiens
gatatgaggcaccgc

SEQ ID NO: 325078 - DNA, 15 bp, Homo sapiens
atatgaggcaccgca

SEQ ID NO: 325079 - DNA, 15 bp, Homo sapiens
tatgaggcaccgcac

SEQ ID NO: 325080 - DNA, 15 bp, Homo sapiens
atgaggcaccgcacc

SEQ ID NO: 325081 - DNA, 15 bp, Homo sapiens
tgaggcaccgcaccc

SEQ ID NO: 325082 - DNA, 15 bp, Homo sapiens
gaggcaccgcaccca

SEQ ID NO: 325083 - DNA, 15 bp, Homo sapiens
aggcaccgcacccag

SEQ ID NO: 325084 - DNA, 15 bp, Homo sapiens
ggcaccgcacccagc

SEQ ID NO: 325085 - DNA, 15 bp, Homo sapiens
gcaccgcacccagcc

SEQ ID NO: 325086 - DNA, 15 bp, Homo sapiens
caccgcacccagcct

SEQ ID NO: 325087 - DNA, 15 bp, Homo sapiens
accgcacccagcctg

SEQ ID NO: 325088 - DNA, 15 bp, Homo sapiens
ccgcacccagcctga

SEQ ID NO: 325089 - DNA, 15 bp, Homo sapiens
cgcacccagcctgac

SEQ ID NO: 325090 - DNA, 15 bp, Homo sapiens
gcacccagcctgaca

SEQ ID NO: 325091 - DNA, 15 bp, Homo sapiens
cacccagcctgacaa

SEQ ID NO: 325092 - DNA, 15 bp, Homo sapiens
acccagcctgacaaa

SEQ ID NO: 325093 - DNA, 15 bp, Homo sapiens
cccagcctgacaaat

SEQ ID NO: 325094 - DNA, 15 bp, Homo sapiens
ccagcctgacaaata

SEQ ID NO: 325095 - DNA, 15 bp, Homo sapiens
cagcctgacaaatat

SEQ ID NO: 325096 - DNA, 15 bp, Homo sapiens
agcctgacaaatatt

SEQ ID NO: 325097 - DNA, 15 bp, Homo sapiens
gcctgacaaatattt

SEQ ID NO: 325098 - DNA, 15 bp, Homo sapiens
cctgacaaatatttt

SEQ ID NO: 325099 - DNA, 15 bp, Homo sapiens
ctgacaaatattttt

SEQ ID NO: 325100 - DNA, 15 bp, Homo sapiens
tgacaaatattttta

SEQ ID NO: 325101 - DNA, 15 bp, Homo sapiens
gacaaatatttttaa

SEQ ID NO: 325102 - DNA, 15 bp, Homo sapiens
acaaatatttttaaa

SEQ ID NO: 325103 - DNA, 15 bp, Homo sapiens
caaatatttttaaat

SEQ ID NO: 325104 - DNA, 15 bp, Homo sapiens
aaatatttttaaatg

SEQ ID NO: 325105 - DNA, 15 bp, Homo sapiens
aatatttttaaatgc

SEQ ID NO: 325106 - DNA, 15 bp, Homo sapiens
atatttttaaatgca

SEQ ID NO: 325107 - DNA, 15 bp, Homo sapiens
tatttttaaatgcat

SEQ ID NO: 325108 - DNA, 15 bp, Homo sapiens
atttttaaatgcata

SEQ ID NO: 325109 - DNA, 15 bp, Homo sapiens
tttttaaatgcataa

SEQ ID NO: 325110 - DNA, 15 bp, Homo sapiens
ttttaaatgcataaa

SEQ ID NO: 325111 - DNA, 15 bp, Homo sapiens
tttaaatgcataaaa

SEQ ID NO: 325112 - DNA, 15 bp, Homo sapiens
ttaaatgcataaaat

SEQ ID NO: 325113 - DNA, 15 bp, Homo sapiens
taaatgcataaaata

SEQ ID NO: 325114 - DNA, 15 bp, Homo sapiens
aaatgcataaaatag

SEQ ID NO: 325115 - DNA, 15 bp, Homo sapiens
aatgcataaaataga

SEQ ID NO: 325116 - DNA, 15 bp, Homo sapiens
atgcataaaatagag

SEQ ID NO: 325117 - DNA, 15 bp, Homo sapiens
tgcataaaatagagt

SEQ ID NO: 325118 - DNA, 15 bp, Homo sapiens
gcataaaatagagta

SEQ ID NO: 325119 - DNA, 15 bp, Homo sapiens
cataaaatagagtac

SEQ ID NO: 325120 - DNA, 15 bp, Homo sapiens
ataaaatagagtaca

SEQ ID NO: 325121 - DNA, 15 bp, Homo sapiens
taaaatagagtacat

SEQ ID NO: 325122 - DNA, 15 bp, Homo sapiens
aaaatagagtacatg

SEQ ID NO: 325123 - DNA, 15 bp, Homo sapiens
aaatagagtacatgg

SEQ ID NO: 325124 - DNA, 15 bp, Homo sapiens
aatagagtacatggt

SEQ ID NO: 325125 - DNA, 15 bp, Homo sapiens
atagagtacatggta

SEQ ID NO: 325126 - DNA, 15 bp, Homo sapiens
tagagtacatggtat

SEQ ID NO: 325127 - DNA, 15 bp, Homo sapiens
agagtacatggtatt

SEQ ID NO: 325128 - DNA, 15 bp, Homo sapiens
gagtacatggtattc

SEQ ID NO: 325129 - DNA, 15 bp, Homo sapiens
agtacatggtattcc

SEQ ID NO: 325130 - DNA, 15 bp, Homo sapiens
gtacatggtattcca

SEQ ID NO: 325131 - DNA, 15 bp, Homo sapiens
tacatggtattccat

SEQ ID NO: 325132 - DNA, 15 bp, Homo sapiens
acatggtattccatg

SEQ ID NO: 325133 - DNA, 15 bp, Homo sapiens
catggtattccatgc

SEQ ID NO: 325134 - DNA, 15 bp, Homo sapiens
atggtattccatgca

SEQ ID NO: 325135 - DNA, 15 bp, Homo sapiens
tggtattccatgcat

SEQ ID NO: 325136 - DNA, 15 bp, Homo sapiens
ggtattccatgcata

SEQ ID NO: 325137 - DNA, 15 bp, Homo sapiens
gtattccatgcatac

SEQ ID NO: 325138 - DNA, 15 bp, Homo sapiens
tattccatgcataca

SEQ ID NO: 325139 - DNA, 15 bp, Homo sapiens
attccatgcatacag

SEQ ID NO: 325140 - DNA, 15 bp, Homo sapiens
ttccatgcatacagt

SEQ ID NO: 325141 - DNA, 15 bp, Homo sapiens
tccatgcatacagtt

SEQ ID NO: 325142 - DNA, 15 bp, Homo sapiens
ccatgcatacagtta

SEQ ID NO: 325143 - DNA, 15 bp, Homo sapiens
catgcatacagttac

SEQ ID NO: 325144 - DNA, 15 bp, Homo sapiens
atgcatacagttacc

SEQ ID NO: 325145 - DNA, 15 bp, Homo sapiens
tgcatacagttacca

SEQ ID NO: 325146 - DNA, 15 bp, Homo sapiens
gcatacagttaccaa

SEQ ID NO: 325147 - DNA, 15 bp, Homo sapiens
catacagttaccaaa

SEQ ID NO: 325148 - DNA, 15 bp, Homo sapiens
atacagttaccaaaa

SEQ ID NO: 325149 - DNA, 15 bp, Homo sapiens
tacagttaccaaaat

SEQ ID NO: 325150 - DNA, 15 bp, Homo sapiens
acagttaccaaaata

SEQ ID NO: 325151 - DNA, 15 bp, Homo sapiens
cagttaccaaaatac

SEQ ID NO: 325152 - DNA, 15 bp, Homo sapiens
agttaccaaaatact

SEQ ID NO: 325153 - DNA, 15 bp, Homo sapiens
gttaccaaaatactg

SEQ ID NO: 325154 - DNA, 15 bp, Homo sapiens
ttaccaaaatactga

SEQ ID NO: 325155 - DNA, 15 bp, Homo sapiens
taccaaaatactgaa

SEQ ID NO: 325156 - DNA, 15 bp, Homo sapiens
accaaaatactgaaa

SEQ ID NO: 325157 - DNA, 15 bp, Homo sapiens
ccaaaatactgaaaa

SEQ ID NO: 325158 - DNA, 15 bp, Homo sapiens
caaaatactgaaaaa

SEQ ID NO: 325159 - DNA, 15 bp, Homo sapiens
aaaatactgaaaaag

SEQ ID NO: 325160 - DNA, 15 bp, Homo sapiens
aaatactgaaaaagt

SEQ ID NO: 325161 - DNA, 15 bp, Homo sapiens
aatactgaaaaagtc

SEQ ID NO: 325162 - DNA, 15 bp, Homo sapiens
atactgaaaaagtct

SEQ ID NO: 325163 - DNA, 15 bp, Homo sapiens
tactgaaaaagtctg

SEQ ID NO: 325164 - DNA, 15 bp, Homo sapiens
actgaaaaagtctgt

SEQ ID NO: 325165 - DNA, 15 bp, Homo sapiens
ctgaaaaagtctgtg

SEQ ID NO: 325166 - DNA, 15 bp, Homo sapiens
tgaaaaagtctgtga

SEQ ID NO: 325167 - DNA, 15 bp, Homo sapiens
gaaaaagtctgtgag

SEQ ID NO: 325168 - DNA, 15 bp, Homo sapiens
aaaaagtctgtgaga

SEQ ID NO: 325169 - DNA, 15 bp, Homo sapiens
aaaagtctgtgagag

SEQ ID NO: 325170 - DNA, 15 bp, Homo sapiens
aaagtctgtgagaga

SEQ ID NO: 325171 - DNA, 15 bp, Homo sapiens
aagtctgtgagagag

SEQ ID NO: 325172 - DNA, 15 bp, Homo sapiens
agtctgtgagagagt

SEQ ID NO: 325173 - DNA, 15 bp, Homo sapiens
gtctgtgagagagta

SEQ ID NO: 325174 - DNA, 15 bp, Homo sapiens
tctgtgagagagtag

SEQ ID NO: 325175 - DNA, 15 bp, Homo sapiens
ctgtgagagagtagt

SEQ ID NO: 325176 - DNA, 15 bp, Homo sapiens
tgtgagagagtagta

SEQ ID NO: 325177 - DNA, 15 bp, Homo sapiens
gtgagagagtagtat

SEQ ID NO: 325178 - DNA, 15 bp, Homo sapiens
tgagagagtagtatt

SEQ ID NO: 325179 - DNA, 15 bp, Homo sapiens
gagagagtagtattt

SEQ ID NO: 325180 - DNA, 15 bp, Homo sapiens
agagagtagtatttg

SEQ ID NO: 325181 - DNA, 15 bp, Homo sapiens
gagagtagtatttgc

SEQ ID NO: 325182 - DNA, 15 bp, Homo sapiens
agagtagtatttgct

SEQ ID NO: 325183 - DNA, 15 bp, Homo sapiens
gagtagtatttgctg

SEQ ID NO: 325184 - DNA, 15 bp, Homo sapiens
agtagtatttgctgt

SEQ ID NO: 325185 - DNA, 15 bp, Homo sapiens
gtagtatttgctgtt

SEQ ID NO: 325186 - DNA, 15 bp, Homo sapiens
tagtatttgctgttt

SEQ ID NO: 325187 - DNA, 15 bp, Homo sapiens
agtatttgctgtttc

SEQ ID NO: 325188 - DNA, 15 bp, Homo sapiens
gtatttgctgtttca

SEQ ID NO: 325189 - DNA, 15 bp, Homo sapiens
tatttgctgtttcat

SEQ ID NO: 325190 - DNA, 15 bp, Homo sapiens
atttgctgtttcatt

SEQ ID NO: 325191 - DNA, 15 bp, Homo sapiens
tttgctgtttcatta

SEQ ID NO: 325192 - DNA, 15 bp, Homo sapiens
ttgctgtttcattag

SEQ ID NO: 325193 - DNA, 15 bp, Homo sapiens
tgctgtttcattagt

SEQ ID NO: 325194 - DNA, 15 bp, Homo sapiens
gctgtttcattagtg

SEQ ID NO: 325195 - DNA, 15 bp, Homo sapiens
ctgtttcattagtgt

SEQ ID NO: 325196 - DNA, 15 bp, Homo sapiens
tgtttcattagtgtg

SEQ ID NO: 325197 - DNA, 15 bp, Homo sapiens
gtttcattagtgtgt

SEQ ID NO: 325198 - DNA, 15 bp, Homo sapiens
tttcattagtgtgtt

SEQ ID NO: 325199 - DNA, 15 bp, Homo sapiens
ttcattagtgtgttc

SEQ ID NO: 325200 - DNA, 15 bp, Homo sapiens
tcattagtgtgttca

SEQ ID NO: 325201 - DNA, 15 bp, Homo sapiens
cattagtgtgttcag

SEQ ID NO: 325202 - DNA, 15 bp, Homo sapiens
attagtgtgttcagt

SEQ ID NO: 325203 - DNA, 15 bp, Homo sapiens
ttagtgtgttcagta

SEQ ID NO: 325204 - DNA, 15 bp, Homo sapiens
tagtgtgttcagtaa

SEQ ID NO: 325205 - DNA, 15 bp, Homo sapiens
agtgtgttcagtaag

SEQ ID NO: 325206 - DNA, 15 bp, Homo sapiens
gtgtgttcagtaaga

SEQ ID NO: 325207 - DNA, 15 bp, Homo sapiens
tgtgttcagtaagaa

SEQ ID NO: 325208 - DNA, 15 bp, Homo sapiens
gtgttcagtaagaac

SEQ ID NO: 325209 - DNA, 15 bp, Homo sapiens
tgttcagtaagaact

SEQ ID NO: 325210 - DNA, 15 bp, Homo sapiens
gttcagtaagaactt

SEQ ID NO: 325211 - DNA, 15 bp, Homo sapiens
ttcagtaagaacttc

SEQ ID NO: 325212 - DNA, 15 bp, Homo sapiens
tcagtaagaacttct

SEQ ID NO: 325213 - DNA, 15 bp, Homo sapiens
cagtaagaacttcta

SEQ ID NO: 325214 - DNA, 15 bp, Homo sapiens
agtaagaacttctag

SEQ ID NO: 325215 - DNA, 15 bp, Homo sapiens
gtaagaacttctagc

SEQ ID NO: 325216 - DNA, 15 bp, Homo sapiens
taagaacttctagca

SEQ ID NO: 325217 - DNA, 15 bp, Homo sapiens
aagaacttctagcat

SEQ ID NO: 325218 - DNA, 15 bp, Homo sapiens
agaacttctagcatc

SEQ ID NO: 325219 - DNA, 15 bp, Homo sapiens
gaacttctagcatct

SEQ ID NO: 325220 - DNA, 15 bp, Homo sapiens
aacttctagcatctc

SEQ ID NO: 325221 - DNA, 15 bp, Homo sapiens
acttctagcatctct

SEQ ID NO: 325222 - DNA, 15 bp, Homo sapiens
cttctagcatctcta

SEQ ID NO: 325223 - DNA, 15 bp, Homo sapiens
ttctagcatctctaa

SEQ ID NO: 325224 - DNA, 15 bp, Homo sapiens
tctagcatctctaac

SEQ ID NO: 325225 - DNA, 15 bp, Homo sapiens
ctagcatctctaacc

SEQ ID NO: 325226 - DNA, 15 bp, Homo sapiens
tagcatctctaacct

SEQ ID NO: 325227 - DNA, 15 bp, Homo sapiens
agcatctctaacctc

SEQ ID NO: 325228 - DNA, 15 bp, Homo sapiens
gcatctctaacctct

SEQ ID NO: 325229 - DNA, 15 bp, Homo sapiens
catctctaacctctc

SEQ ID NO: 325230 - DNA, 15 bp, Homo sapiens
atctctaacctctct

SEQ ID NO: 325231 - DNA, 15 bp, Homo sapiens
tctctaacctctcta

SEQ ID NO: 325232 - DNA, 15 bp, Homo sapiens
ctctaacctctctac

SEQ ID NO: 325233 - DNA, 15 bp, Homo sapiens
tctaacctctctact

SEQ ID NO: 325234 - DNA, 15 bp, Homo sapiens
ctaacctctctactc

SEQ ID NO: 325235 - DNA, 15 bp, Homo sapiens
taacctctctactct

SEQ ID NO: 325236 - DNA, 15 bp, Homo sapiens
aacctctctactctt

SEQ ID NO: 325237 - DNA, 15 bp, Homo sapiens
acctctctactcttc

SEQ ID NO: 325238 - DNA, 15 bp, Homo sapiens
cctctctactcttct

SEQ ID NO: 325239 - DNA, 15 bp, Homo sapiens
ctctctactcttctg

SEQ ID NO: 325240 - DNA, 15 bp, Homo sapiens
tctctactcttctga

SEQ ID NO: 325241 - DNA, 15 bp, Homo sapiens
ctctactcttctgaa

SEQ ID NO: 325242 - DNA, 15 bp, Homo sapiens
tctactcttctgaaa

SEQ ID NO: 325243 - DNA, 15 bp, Homo sapiens
ctactcttctgaaat

SEQ ID NO: 325244 - DNA, 15 bp, Homo sapiens
tactcttctgaaata

SEQ ID NO: 325245 - DNA, 15 bp, Homo sapiens
actcttctgaaataa

SEQ ID NO: 325246 - DNA, 15 bp, Homo sapiens
ctcttctgaaataac

SEQ ID NO: 325247 - DNA, 15 bp, Homo sapiens
tcttctgaaataaca

SEQ ID NO: 325248 - DNA, 15 bp, Homo sapiens
cttctgaaataacaa

SEQ ID NO: 325249 - DNA, 15 bp, Homo sapiens
ttctgaaataacaac

SEQ ID NO: 325250 - DNA, 15 bp, Homo sapiens
tctgaaataacaacg

SEQ ID NO: 325251 - DNA, 15 bp, Homo sapiens
ctgaaataacaacga

SEQ ID NO: 325252 - DNA, 15 bp, Homo sapiens
tgaaataacaacgag

SEQ ID NO: 325253 - DNA, 15 bp, Homo sapiens
gaaataacaacgagc

SEQ ID NO: 325254 - DNA, 15 bp, Homo sapiens
aaataacaacgagcc

SEQ ID NO: 325255 - DNA, 15 bp, Homo sapiens
aataacaacgagcca

SEQ ID NO: 325256 - DNA, 15 bp, Homo sapiens
ataacaacgagccaa

SEQ ID NO: 325257 - DNA, 15 bp, Homo sapiens
taacaacgagccaaa

SEQ ID NO: 325258 - DNA, 15 bp, Homo sapiens
aacaacgagccaaat

SEQ ID NO: 325259 - DNA, 15 bp, Homo sapiens
acaacgagccaaatg

SEQ ID NO: 325260 - DNA, 15 bp, Homo sapiens
caacgagccaaatgg

SEQ ID NO: 325261 - DNA, 15 bp, Homo sapiens
aacgagccaaatggt

SEQ ID NO: 325262 - DNA, 15 bp, Homo sapiens
acgagccaaatggta

SEQ ID NO: 325263 - DNA, 15 bp, Homo sapiens
cgagccaaatggtat

SEQ ID NO: 325264 - DNA, 15 bp, Homo sapiens
gagccaaatggtatt

SEQ ID NO: 325265 - DNA, 15 bp, Homo sapiens
agccaaatggtattt

SEQ ID NO: 325266 - DNA, 15 bp, Homo sapiens
gccaaatggtatttt

SEQ ID NO: 325267 - DNA, 15 bp, Homo sapiens
ccaaatggtattttc

SEQ ID NO: 325268 - DNA, 15 bp, Homo sapiens
caaatggtattttca

SEQ ID NO: 325269 - DNA, 15 bp, Homo sapiens
aaatggtattttcaa

SEQ ID NO: 325270 - DNA, 15 bp, Homo sapiens
aatggtattttcaag

SEQ ID NO: 325271 - DNA, 15 bp, Homo sapiens
atggtattttcaaga

SEQ ID NO: 325272 - DNA, 15 bp, Homo sapiens
tggtattttcaagat

SEQ ID NO: 325273 - DNA, 15 bp, Homo sapiens
ggtattttcaagata

SEQ ID NO: 325274 - DNA, 15 bp, Homo sapiens
gtattttcaagatac

SEQ ID NO: 325275 - DNA, 15 bp, Homo sapiens
tattttcaagatacc

SEQ ID NO: 325276 - DNA, 15 bp, Homo sapiens
attttcaagatacct

SEQ ID NO: 325277 - DNA, 15 bp, Homo sapiens
ttttcaagatacctg

SEQ ID NO: 325278 - DNA, 15 bp, Homo sapiens
tttcaagatacctgc

SEQ ID NO: 325279 - DNA, 15 bp, Homo sapiens
ttcaagatacctgct

SEQ ID NO: 325280 - DNA, 15 bp, Homo sapiens
tcaagatacctgcta

SEQ ID NO: 325281 - DNA, 15 bp, Homo sapiens
caagatacctgctag

SEQ ID NO: 325282 - DNA, 15 bp, Homo sapiens
aagatacctgctaga

SEQ ID NO: 325283 - DNA, 15 bp, Homo sapiens
agatacctgctagag

SEQ ID NO: 325284 - DNA, 15 bp, Homo sapiens
gatacctgctagagt

SEQ ID NO: 325285 - DNA, 15 bp, Homo sapiens
atacctgctagagtt

SEQ ID NO: 325286 - DNA, 15 bp, Homo sapiens
tacctgctagagttg

SEQ ID NO: 325287 - DNA, 15 bp, Homo sapiens
acctgctagagttgt

SEQ ID NO: 325288 - DNA, 15 bp, Homo sapiens
cctgctagagttgta

SEQ ID NO: 325289 - DNA, 15 bp, Homo sapiens
ctgctagagttgtaa

SEQ ID NO: 325290 - DNA, 15 bp, Homo sapiens
tgctagagttgtaag

SEQ ID NO: 325291 - DNA, 15 bp, Homo sapiens
gctagagttgtaagg

SEQ ID NO: 325292 - DNA, 15 bp, Homo sapiens
ctagagttgtaaggt

SEQ ID NO: 325293 - DNA, 15 bp, Homo sapiens
tagagttgtaaggtg

SEQ ID NO: 325294 - DNA, 15 bp, Homo sapiens
agagttgtaaggtga

SEQ ID NO: 325295 - DNA, 15 bp, Homo sapiens
gagttgtaaggtgat

SEQ ID NO: 325296 - DNA, 15 bp, Homo sapiens
agttgtaaggtgatg

SEQ ID NO: 325297 - DNA, 15 bp, Homo sapiens
gttgtaaggtgatgt

SEQ ID NO: 325298 - DNA, 15 bp, Homo sapiens
ttgtaaggtgatgtg

SEQ ID NO: 325299 - DNA, 15 bp, Homo sapiens
tgtaaggtgatgtga

SEQ ID NO: 325300 - DNA, 15 bp, Homo sapiens
gtaaggtgatgtgaa

SEQ ID NO: 325301 - DNA, 15 bp, Homo sapiens
taaggtgatgtgaaa

SEQ ID NO: 325302 - DNA, 15 bp, Homo sapiens
aaggtgatgtgaaaa

SEQ ID NO: 325303 - DNA, 15 bp, Homo sapiens
aggtgatgtgaaaat

SEQ ID NO: 325304 - DNA, 15 bp, Homo sapiens
ggtgatgtgaaaatg

SEQ ID NO: 325305 - DNA, 15 bp, Homo sapiens
gtgatgtgaaaatgg

SEQ ID NO: 325306 - DNA, 15 bp, Homo sapiens
tgatgtgaaaatggt

SEQ ID NO: 325307 - DNA, 15 bp, Homo sapiens
gatgtgaaaatggtt

SEQ ID NO: 325308 - DNA, 15 bp, Homo sapiens
atgtgaaaatggtta

SEQ ID NO: 325309 - DNA, 15 bp, Homo sapiens
tgtgaaaatggttat

SEQ ID NO: 325310 - DNA, 15 bp, Homo sapiens
gtgaaaatggttatg

SEQ ID NO: 325311 - DNA, 15 bp, Homo sapiens
tgaaaatggttatga

SEQ ID NO: 325312 - DNA, 15 bp, Homo sapiens
gaaaatggttatgat

SEQ ID NO: 325313 - DNA, 15 bp, Homo sapiens
aaaatggttatgatt

SEQ ID NO: 325314 - DNA, 15 bp, Homo sapiens
aaatggttatgattt

SEQ ID NO: 325315 - DNA, 15 bp, Homo sapiens
aatggttatgatttt

SEQ ID NO: 325316 - DNA, 15 bp, Homo sapiens
atggttatgattttt

SEQ ID NO: 325317 - DNA, 15 bp, Homo sapiens
tggttatgatttttg

SEQ ID NO: 325318 - DNA, 15 bp, Homo sapiens
ggttatgatttttgc

SEQ ID NO: 325319 - DNA, 15 bp, Homo sapiens
gttatgatttttgct

SEQ ID NO: 325320 - DNA, 15 bp, Homo sapiens
ttatgatttttgctg

SEQ ID NO: 325321 - DNA, 15 bp, Homo sapiens
tatgatttttgctgg

SEQ ID NO: 325322 - DNA, 15 bp, Homo sapiens
atgatttttgctggt

SEQ ID NO: 325323 - DNA, 15 bp, Homo sapiens
tgatttttgctggtg

SEQ ID NO: 325324 - DNA, 15 bp, Homo sapiens
gatttttgctggtga

SEQ ID NO: 325325 - DNA, 15 bp, Homo sapiens
atttttgctggtgac

SEQ ID NO: 325326 - DNA, 15 bp, Homo sapiens
tttttgctggtgaca

SEQ ID NO: 325327 - DNA, 15 bp, Homo sapiens
ttttgctggtgacac

SEQ ID NO: 325328 - DNA, 15 bp, Homo sapiens
tttgctggtgacaca

SEQ ID NO: 325329 - DNA, 15 bp, Homo sapiens
ttgctggtgacacag

SEQ ID NO: 325330 - DNA, 15 bp, Homo sapiens
tgctggtgacacagt

SEQ ID NO: 325331 - DNA, 15 bp, Homo sapiens
gctggtgacacagtc

SEQ ID NO: 325332 - DNA, 15 bp, Homo sapiens
ctggtgacacagtca

SEQ ID NO: 325333 - DNA, 15 bp, Homo sapiens
tggtgacacagtcaa

SEQ ID NO: 325334 - DNA, 15 bp, Homo sapiens
ggtgacacagtcaaa

SEQ ID NO: 325335 - DNA, 15 bp, Homo sapiens
gtgacacagtcaaag

SEQ ID NO: 325336 - DNA, 15 bp, Homo sapiens
tgacacagtcaaagc

SEQ ID NO: 325337 - DNA, 15 bp, Homo sapiens
gacacagtcaaagct

SEQ ID NO: 325338 - DNA, 15 bp, Homo sapiens
acacagtcaaagcta

SEQ ID NO: 325339 - DNA, 15 bp, Homo sapiens
cacagtcaaagctac

SEQ ID NO: 325340 - DNA, 15 bp, Homo sapiens
acagtcaaagctacc

SEQ ID NO: 325341 - DNA, 15 bp, Homo sapiens
cagtcaaagctacca

SEQ ID NO: 325342 - DNA, 15 bp, Homo sapiens
agtcaaagctaccac

SEQ ID NO: 325343 - DNA, 15 bp, Homo sapiens
gtcaaagctaccact

SEQ ID NO: 325344 - DNA, 15 bp, Homo sapiens
tcaaagctaccacta

SEQ ID NO: 325345 - DNA, 15 bp, Homo sapiens
caaagctaccactaa

SEQ ID NO: 325346 - DNA, 15 bp, Homo sapiens
aaagctaccactaat

SEQ ID NO: 325347 - DNA, 15 bp, Homo sapiens
aagctaccactaata

SEQ ID NO: 325348 - DNA, 15 bp, Homo sapiens
agctaccactaataa

SEQ ID NO: 325349 - DNA, 15 bp, Homo sapiens
gctaccactaataat

SEQ ID NO: 325350 - DNA, 15 bp, Homo sapiens
ctaccactaataatg

SEQ ID NO: 325351 - DNA, 15 bp, Homo sapiens
taccactaataatgt

SEQ ID NO: 325352 - DNA, 15 bp, Homo sapiens
accactaataatgtg

SEQ ID NO: 325353 - DNA, 15 bp, Homo sapiens
ccactaataatgtgt

SEQ ID NO: 325354 - DNA, 15 bp, Homo sapiens
cactaataatgtgtt

SEQ ID NO: 325355 - DNA, 15 bp, Homo sapiens
actaataatgtgttt

SEQ ID NO: 325356 - DNA, 15 bp, Homo sapiens
ctaataatgtgtttt

SEQ ID NO: 325357 - DNA, 15 bp, Homo sapiens
taataatgtgttttg

SEQ ID NO: 325358 - DNA, 15 bp, Homo sapiens
aataatgtgttttgt

SEQ ID NO: 325359 - DNA, 15 bp, Homo sapiens
ataatgtgttttgtg

SEQ ID NO: 325360 - DNA, 15 bp, Homo sapiens
taatgtgttttgtga

SEQ ID NO: 325361 - DNA, 15 bp, Homo sapiens
aatgtgttttgtgat

SEQ ID NO: 325362 - DNA, 15 bp, Homo sapiens
atgtgttttgtgatc

SEQ ID NO: 325363 - DNA, 15 bp, Homo sapiens
tgtgttttgtgatct

SEQ ID NO: 325364 - DNA, 15 bp, Homo sapiens
gtgttttgtgatctg

SEQ ID NO: 325365 - DNA, 15 bp, Homo sapiens
tgttttgtgatctgc

SEQ ID NO: 325366 - DNA, 15 bp, Homo sapiens
gttttgtgatctgcc

SEQ ID NO: 325367 - DNA, 15 bp, Homo sapiens
ttttgtgatctgcca

SEQ ID NO: 325368 - DNA, 15 bp, Homo sapiens
tttgtgatctgccat

SEQ ID NO: 325369 - DNA, 15 bp, Homo sapiens
ttgtgatctgccatc

SEQ ID NO: 325370 - DNA, 15 bp, Homo sapiens
tgtgatctgccatca

SEQ ID NO: 325371 - DNA, 15 bp, Homo sapiens
gtgatctgccatcac

SEQ ID NO: 325372 - DNA, 15 bp, Homo sapiens
tgatctgccatcaca

SEQ ID NO: 325373 - DNA, 15 bp, Homo sapiens
gatctgccatcacaa

SEQ ID NO: 325374 - DNA, 15 bp, Homo sapiens
atctgccatcacaat

SEQ ID NO: 325375 - DNA, 15 bp, Homo sapiens
tctgccatcacaatg

SEQ ID NO: 325376 - DNA, 15 bp, Homo sapiens
ctgccatcacaatgg

SEQ ID NO: 325377 - DNA, 15 bp, Homo sapiens
tgccatcacaatgga

SEQ ID NO: 325378 - DNA, 15 bp, Homo sapiens
gccatcacaatggaa

SEQ ID NO: 325379 - DNA, 15 bp, Homo sapiens
ccatcacaatggaag

SEQ ID NO: 325380 - DNA, 15 bp, Homo sapiens
catcacaatggaagg

SEQ ID NO: 325381 - DNA, 15 bp, Homo sapiens
atcacaatggaagga

SEQ ID NO: 325382 - DNA, 15 bp, Homo sapiens
tcacaatggaaggaa

SEQ ID NO: 325383 - DNA, 15 bp, Homo sapiens
cacaatggaaggaaa

SEQ ID NO: 325384 - DNA, 15 bp, Homo sapiens
acaatggaaggaaat

SEQ ID NO: 325385 - DNA, 15 bp, Homo sapiens
caatggaaggaaatg

SEQ ID NO: 325386 - DNA, 15 bp, Homo sapiens
aatggaaggaaatgc

SEQ ID NO: 325387 - DNA, 15 bp, Homo sapiens
atggaaggaaatgca

SEQ ID NO: 325388 - DNA, 15 bp, Homo sapiens
tggaaggaaatgcaa

SEQ ID NO: 325389 - DNA, 15 bp, Homo sapiens
ggaaggaaatgcaaa

SEQ ID NO: 325390 - DNA, 15 bp, Homo sapiens
gaaggaaatgcaaat

SEQ ID NO: 325391 - DNA, 15 bp, Homo sapiens
aaggaaatgcaaatt

SEQ ID NO: 325392 - DNA, 15 bp, Homo sapiens
aggaaatgcaaattt

SEQ ID NO: 325393 - DNA, 15 bp, Homo sapiens
ggaaatgcaaatttc

SEQ ID NO: 325394 - DNA, 15 bp, Homo sapiens
gaaatgcaaatttct

SEQ ID NO: 325395 - DNA, 15 bp, Homo sapiens
aaatgcaaatttctg

SEQ ID NO: 325396 - DNA, 15 bp, Homo sapiens
aatgcaaatttctgt

SEQ ID NO: 325397 - DNA, 15 bp, Homo sapiens
atgcaaatttctgtt

SEQ ID NO: 325398 - DNA, 15 bp, Homo sapiens
tgcaaatttctgtta

SEQ ID NO: 325399 - DNA, 15 bp, Homo sapiens
gcaaatttctgttag

SEQ ID NO: 325400 - DNA, 15 bp, Homo sapiens
caaatttctgttaga

SEQ ID NO: 325401 - DNA, 15 bp, Homo sapiens
aaatttctgttagag

SEQ ID NO: 325402 - DNA, 15 bp, Homo sapiens
aatttctgttagagg

SEQ ID NO: 325403 - DNA, 15 bp, Homo sapiens
atttctgttagaggt

SEQ ID NO: 325404 - DNA, 15 bp, Homo sapiens
tttctgttagaggtc

SEQ ID NO: 325405 - DNA, 15 bp, Homo sapiens
ttctgttagaggtca

SEQ ID NO: 325406 - DNA, 15 bp, Homo sapiens
tctgttagaggtcag

SEQ ID NO: 325407 - DNA, 15 bp, Homo sapiens
ctgttagaggtcagt

SEQ ID NO: 325408 - DNA, 15 bp, Homo sapiens
tgttagaggtcagtg

SEQ ID NO: 325409 - DNA, 15 bp, Homo sapiens
gttagaggtcagtga

SEQ ID NO: 325410 - DNA, 15 bp, Homo sapiens
ttagaggtcagtgaa

SEQ ID NO: 325411 - DNA, 15 bp, Homo sapiens
tagaggtcagtgaaa

SEQ ID NO: 325412 - DNA, 15 bp, Homo sapiens
agaggtcagtgaaaa

SEQ ID NO: 325413 - DNA, 15 bp, Homo sapiens
gaggtcagtgaaaag

SEQ ID NO: 325414 - DNA, 15 bp, Homo sapiens
aggtcagtgaaaaga

SEQ ID NO: 325415 - DNA, 15 bp, Homo sapiens
ggtcagtgaaaagat

SEQ ID NO: 325416 - DNA, 15 bp, Homo sapiens
gtcagtgaaaagatc

SEQ ID NO: 325417 - DNA, 15 bp, Homo sapiens
tcagtgaaaagatct

SEQ ID NO: 325418 - DNA, 15 bp, Homo sapiens
cagtgaaaagatcta

SEQ ID NO: 325419 - DNA, 15 bp, Homo sapiens
agtgaaaagatctaa

SEQ ID NO: 325420 - DNA, 15 bp, Homo sapiens
gtgaaaagatctaat

SEQ ID NO: 325421 - DNA, 15 bp, Homo sapiens
tgaaaagatctaatt

SEQ ID NO: 325422 - DNA, 15 bp, Homo sapiens
gaaaagatctaattg

SEQ ID NO: 325423 - DNA, 15 bp, Homo sapiens
aaaagatctaattgc

SEQ ID NO: 325424 - DNA, 15 bp, Homo sapiens
aaagatctaattgct

SEQ ID NO: 325425 - DNA, 15 bp, Homo sapiens
aagatctaattgctt

SEQ ID NO: 325426 - DNA, 15 bp, Homo sapiens
agatctaattgcttt

SEQ ID NO: 325427 - DNA, 15 bp, Homo sapiens
gatctaattgctttt

SEQ ID NO: 325428 - DNA, 15 bp, Homo sapiens
atctaattgcttttc

SEQ ID NO: 325429 - DNA, 15 bp, Homo sapiens
tctaattgcttttcc

SEQ ID NO: 325430 - DNA, 15 bp, Homo sapiens
ctaattgcttttcct

SEQ ID NO: 325431 - DNA, 15 bp, Homo sapiens
taattgcttttcctg

SEQ ID NO: 325432 - DNA, 15 bp, Homo sapiens
aattgcttttcctgt

SEQ ID NO: 325433 - DNA, 15 bp, Homo sapiens
attgcttttcctgtc

SEQ ID NO: 325434 - DNA, 15 bp, Homo sapiens
ttgcttttcctgtcc

SEQ ID NO: 325435 - DNA, 15 bp, Homo sapiens
tgcttttcctgtcca

SEQ ID NO: 325436 - DNA, 15 bp, Homo sapiens
gcttttcctgtccaa

SEQ ID NO: 325437 - DNA, 15 bp, Homo sapiens
cttttcctgtccaag

SEQ ID NO: 325438 - DNA, 15 bp, Homo sapiens
ttttcctgtccaagt

SEQ ID NO: 325439 - DNA, 15 bp, Homo sapiens
tttcctgtccaagtt

SEQ ID NO: 325440 - DNA, 15 bp, Homo sapiens
ttcctgtccaagttc

SEQ ID NO: 325441 - DNA, 15 bp, Homo sapiens
tcctgtccaagttca

SEQ ID NO: 325442 - DNA, 15 bp, Homo sapiens
cctgtccaagttcat

SEQ ID NO: 325443 - DNA, 15 bp, Homo sapiens
ctgtccaagttcatg

SEQ ID NO: 325444 - DNA, 15 bp, Homo sapiens
tgtccaagttcatgg

SEQ ID NO: 325445 - DNA, 15 bp, Homo sapiens
gtccaagttcatgga

SEQ ID NO: 325446 - DNA, 15 bp, Homo sapiens
tccaagttcatggac

SEQ ID NO: 325447 - DNA, 15 bp, Homo sapiens
ccaagttcatggacc

SEQ ID NO: 325448 - DNA, 15 bp, Homo sapiens
caagttcatggaccc

SEQ ID NO: 325449 - DNA, 15 bp, Homo sapiens
aagttcatggacccc

SEQ ID NO: 325450 - DNA, 15 bp, Homo sapiens
agttcatggaccccc

SEQ ID NO: 325451 - DNA, 15 bp, Homo sapiens
gttcatggaccccct

SEQ ID NO: 325452 - DNA, 15 bp, Homo sapiens
ttcatggaccccctg

SEQ ID NO: 325453 - DNA, 15 bp, Homo sapiens
tcatggaccccctgc

SEQ ID NO: 325454 - DNA, 15 bp, Homo sapiens
catggaccccctgcc

SEQ ID NO: 325455 - DNA, 15 bp, Homo sapiens
atggaccccctgcct

SEQ ID NO: 325456 - DNA, 15 bp, Homo sapiens
tggaccccctgcctg

SEQ ID NO: 325457 - DNA, 15 bp, Homo sapiens
ggaccccctgcctgg

SEQ ID NO: 325458 - DNA, 15 bp, Homo sapiens
gaccccctgcctggt

SEQ ID NO: 325459 - DNA, 15 bp, Homo sapiens
accccctgcctggta

SEQ ID NO: 325460 - DNA, 15 bp, Homo sapiens
ccccctgcctggtaa

SEQ ID NO: 325461 - DNA, 15 bp, Homo sapiens
cccctgcctggtaat

SEQ ID NO: 325462 - DNA, 15 bp, Homo sapiens
ccctgcctggtaata

SEQ ID NO: 325463 - DNA, 15 bp, Homo sapiens
cctgcctggtaataa

SEQ ID NO: 325464 - DNA, 15 bp, Homo sapiens
ctgcctggtaataac

SEQ ID NO: 325465 - DNA, 15 bp, Homo sapiens
tgcctggtaataacc

SEQ ID NO: 325466 - DNA, 15 bp, Homo sapiens
gcctggtaataaccc

SEQ ID NO: 325467 - DNA, 15 bp, Homo sapiens
cctggtaataacccc

SEQ ID NO: 325468 - DNA, 15 bp, Homo sapiens
ctggtaataacccct

SEQ ID NO: 325469 - DNA, 15 bp, Homo sapiens
tggtaataacccctg

SEQ ID NO: 325470 - DNA, 15 bp, Homo sapiens
ggtaataacccctga

SEQ ID NO: 325471 - DNA, 15 bp, Homo sapiens
gtaataacccctgat

SEQ ID NO: 325472 - DNA, 15 bp, Homo sapiens
taataacccctgata

SEQ ID NO: 325473 - DNA, 15 bp, Homo sapiens
aataacccctgataa

SEQ ID NO: 325474 - DNA, 15 bp, Homo sapiens
ataacccctgataaa

SEQ ID NO: 325475 - DNA, 15 bp, Homo sapiens
taacccctgataaag

SEQ ID NO: 325476 - DNA, 15 bp, Homo sapiens
aacccctgataaaga

SEQ ID NO: 325477 - DNA, 15 bp, Homo sapiens
acccctgataaagat

SEQ ID NO: 325478 - DNA, 15 bp, Homo sapiens
cccctgataaagatg

SEQ ID NO: 325479 - DNA, 15 bp, Homo sapiens
ccctgataaagatga

SEQ ID NO: 325480 - DNA, 15 bp, Homo sapiens
cctgataaagatgat

SEQ ID NO: 325481 - DNA, 15 bp, Homo sapiens
ctgataaagatgatg

SEQ ID NO: 325482 - DNA, 15 bp, Homo sapiens
tgataaagatgatgg

SEQ ID NO: 325483 - DNA, 15 bp, Homo sapiens
gataaagatgatggc

SEQ ID NO: 325484 - DNA, 15 bp, Homo sapiens
ataaagatgatggct

SEQ ID NO: 325485 - DNA, 15 bp, Homo sapiens
taaagatgatggctt

SEQ ID NO: 325486 - DNA, 15 bp, Homo sapiens
aaagatgatggctta

SEQ ID NO: 325487 - DNA, 15 bp, Homo sapiens
aagatgatggcttaa

SEQ ID NO: 325488 - DNA, 15 bp, Homo sapiens
agatgatggcttaaa

SEQ ID NO: 325489 - DNA, 15 bp, Homo sapiens
gatgatggcttaaaa

SEQ ID NO: 325490 - DNA, 15 bp, Homo sapiens
atgatggcttaaaat

SEQ ID NO: 325491 - DNA, 15 bp, Homo sapiens
tgatggcttaaaatg

SEQ ID NO: 325492 - DNA, 15 bp, Homo sapiens
gatggcttaaaatga

SEQ ID NO: 325493 - DNA, 15 bp, Homo sapiens
atggcttaaaatgag

SEQ ID NO: 325494 - DNA, 15 bp, Homo sapiens
tggcttaaaatgagt

SEQ ID NO: 325495 - DNA, 15 bp, Homo sapiens
ggcttaaaatgagta

SEQ ID NO: 325496 - DNA, 15 bp, Homo sapiens
gcttaaaatgagtat

SEQ ID NO: 325497 - DNA, 15 bp, Homo sapiens
cttaaaatgagtatt

SEQ ID NO: 325498 - DNA, 15 bp, Homo sapiens
ttaaaatgagtattt

SEQ ID NO: 325499 - DNA, 15 bp, Homo sapiens
taaaatgagtatttg

SEQ ID NO: 325500 - DNA, 15 bp, Homo sapiens
aaaatgagtatttgt

SEQ ID NO: 325501 - DNA, 15 bp, Homo sapiens
aaatgagtatttgtt

SEQ ID NO: 325502 - DNA, 15 bp, Homo sapiens
aatgagtatttgttt

SEQ ID NO: 325503 - DNA, 15 bp, Homo sapiens
atgagtatttgtttc

SEQ ID NO: 325504 - DNA, 15 bp, Homo sapiens
tgagtatttgtttcc

SEQ ID NO: 325505 - DNA, 15 bp, Homo sapiens
gagtatttgtttcct

SEQ ID NO: 325506 - DNA, 15 bp, Homo sapiens
agtatttgtttcctt

SEQ ID NO: 325507 - DNA, 15 bp, Homo sapiens
gtatttgtttcctta

SEQ ID NO: 325508 - DNA, 15 bp, Homo sapiens
tatttgtttccttaa

SEQ ID NO: 325509 - DNA, 15 bp, Homo sapiens
atttgtttccttaaa

SEQ ID NO: 325510 - DNA, 15 bp, Homo sapiens
tttgtttccttaaac

SEQ ID NO: 325511 - DNA, 15 bp, Homo sapiens
ttgtttccttaaacc

SEQ ID NO: 325512 - DNA, 15 bp, Homo sapiens
tgtttccttaaacct

SEQ ID NO: 325513 - DNA, 15 bp, Homo sapiens
gtttccttaaacctc

SEQ ID NO: 325514 - DNA, 15 bp, Homo sapiens
tttccttaaacctca

SEQ ID NO: 325515 - DNA, 15 bp, Homo sapiens
ttccttaaacctcag

SEQ ID NO: 325516 - DNA, 15 bp, Homo sapiens
tccttaaacctcagc

SEQ ID NO: 325517 - DNA, 15 bp, Homo sapiens
ccttaaacctcagca

SEQ ID NO: 325518 - DNA, 15 bp, Homo sapiens
cttaaacctcagcag

SEQ ID NO: 325519 - DNA, 15 bp, Homo sapiens
ttaaacctcagcagt

SEQ ID NO: 325520 - DNA, 15 bp, Homo sapiens
taaacctcagcagtg

SEQ ID NO: 325521 - DNA, 15 bp, Homo sapiens
aaacctcagcagtgg

SEQ ID NO: 325522 - DNA, 15 bp, Homo sapiens
aacctcagcagtggc

SEQ ID NO: 325523 - DNA, 15 bp, Homo sapiens
acctcagcagtggca

SEQ ID NO: 325524 - DNA, 15 bp, Homo sapiens
cctcagcagtggcag

SEQ ID NO: 325525 - DNA, 15 bp, Homo sapiens
ctcagcagtggcagc

SEQ ID NO: 325526 - DNA, 15 bp, Homo sapiens
tcagcagtggcagca

SEQ ID NO: 325527 - DNA, 15 bp, Homo sapiens
cagcagtggcagcag

SEQ ID NO: 325528 - DNA, 15 bp, Homo sapiens
agcagtggcagcagt

SEQ ID NO: 325529 - DNA, 15 bp, Homo sapiens
gcagtggcagcagtg

SEQ ID NO: 325530 - DNA, 15 bp, Homo sapiens
cagtggcagcagtgt

SEQ ID NO: 325531 - DNA, 15 bp, Homo sapiens
agtggcagcagtgtg

SEQ ID NO: 325532 - DNA, 15 bp, Homo sapiens
gtggcagcagtgtgc

SEQ ID NO: 325533 - DNA, 15 bp, Homo sapiens
tggcagcagtgtgcc

SEQ ID NO: 325534 - DNA, 15 bp, Homo sapiens
ggcagcagtgtgcca

SEQ ID NO: 325535 - DNA, 15 bp, Homo sapiens
gcagcagtgtgccac

SEQ ID NO: 325536 - DNA, 15 bp, Homo sapiens
cagcagtgtgccaca

SEQ ID NO: 325537 - DNA, 15 bp, Homo sapiens
agcagtgtgccacag

SEQ ID NO: 325538 - DNA, 15 bp, Homo sapiens
gcagtgtgccacaga

SEQ ID NO: 325539 - DNA, 15 bp, Homo sapiens
cagtgtgccacagag

SEQ ID NO: 325540 - DNA, 15 bp, Homo sapiens
agtgtgccacagagt

SEQ ID NO: 325541 - DNA, 15 bp, Homo sapiens
gtgtgccacagagtg

SEQ ID NO: 325542 - DNA, 15 bp, Homo sapiens
tgtgccacagagtgt

SEQ ID NO: 325543 - DNA, 15 bp, Homo sapiens
gtgccacagagtgtt

SEQ ID NO: 325544 - DNA, 15 bp, Homo sapiens
tgccacagagtgttt

SEQ ID NO: 325545 - DNA, 15 bp, Homo sapiens
gccacagagtgtttc

SEQ ID NO: 325546 - DNA, 15 bp, Homo sapiens
ccacagagtgtttca

SEQ ID NO: 325547 - DNA, 15 bp, Homo sapiens
cacagagtgtttcaa

SEQ ID NO: 325548 - DNA, 15 bp, Homo sapiens
acagagtgtttcaaa

SEQ ID NO: 325549 - DNA, 15 bp, Homo sapiens
cagagtgtttcaaaa

SEQ ID NO: 325550 - DNA, 15 bp, Homo sapiens
agagtgtttcaaaag

SEQ ID NO: 325551 - DNA, 15 bp, Homo sapiens
gagtgtttcaaaaga

SEQ ID NO: 325552 - DNA, 15 bp, Homo sapiens
agtgtttcaaaagag

SEQ ID NO: 325553 - DNA, 15 bp, Homo sapiens
gtgtttcaaaagaga

SEQ ID NO: 325554 - DNA, 15 bp, Homo sapiens
tgtttcaaaagagac

SEQ ID NO: 325555 - DNA, 15 bp, Homo sapiens
gtttcaaaagagaca

SEQ ID NO: 325556 - DNA, 15 bp, Homo sapiens
tttcaaaagagacaa

SEQ ID NO: 325557 - DNA, 15 bp, Homo sapiens
ttcaaaagagacaac

SEQ ID NO: 325558 - DNA, 15 bp, Homo sapiens
tcaaaagagacaaca

SEQ ID NO: 325559 - DNA, 15 bp, Homo sapiens
caaaagagacaacaa

SEQ ID NO: 325560 - DNA, 15 bp, Homo sapiens
aaaagagacaacaat

SEQ ID NO: 325561 - DNA, 15 bp, Homo sapiens
aaagagacaacaatt

SEQ ID NO: 325562 - DNA, 15 bp, Homo sapiens
aagagacaacaattt

SEQ ID NO: 325563 - DNA, 15 bp, Homo sapiens
agagacaacaatttt

SEQ ID NO: 325564 - DNA, 15 bp, Homo sapiens
gagacaacaatttta

SEQ ID NO: 325565 - DNA, 15 bp, Homo sapiens
agacaacaattttaa

SEQ ID NO: 325566 - DNA, 15 bp, Homo sapiens
gacaacaattttaaa

SEQ ID NO: 325567 - DNA, 15 bp, Homo sapiens
acaacaattttaaat

SEQ ID NO: 325568 - DNA, 15 bp, Homo sapiens
caacaattttaaatg

SEQ ID NO: 325569 - DNA, 15 bp, Homo sapiens
aacaattttaaatgg

SEQ ID NO: 325570 - DNA, 15 bp, Homo sapiens
acaattttaaatgga

SEQ ID NO: 325571 - DNA, 15 bp, Homo sapiens
caattttaaatggaa

SEQ ID NO: 325572 - DNA, 15 bp, Homo sapiens
aattttaaatggaaa

SEQ ID NO: 325573 - DNA, 15 bp, Homo sapiens
attttaaatggaaag

SEQ ID NO: 325574 - DNA, 15 bp, Homo sapiens
ttttaaatggaaagt

SEQ ID NO: 325575 - DNA, 15 bp, Homo sapiens
tttaaatggaaagta

SEQ ID NO: 325576 - DNA, 15 bp, Homo sapiens
ttaaatggaaagtag

SEQ ID NO: 325577 - DNA, 15 bp, Homo sapiens
taaatggaaagtagt

SEQ ID NO: 325578 - DNA, 15 bp, Homo sapiens
aaatggaaagtagtc

SEQ ID NO: 325579 - DNA, 15 bp, Homo sapiens
aatggaaagtagtct

SEQ ID NO: 325580 - DNA, 15 bp, Homo sapiens
atggaaagtagtctt

SEQ ID NO: 325581 - DNA, 15 bp, Homo sapiens
tggaaagtagtcttg

SEQ ID NO: 325582 - DNA, 15 bp, Homo sapiens
ggaaagtagtcttgg

SEQ ID NO: 325583 - DNA, 15 bp, Homo sapiens
gaaagtagtcttggg

SEQ ID NO: 325584 - DNA, 15 bp, Homo sapiens
aaagtagtcttgggt

SEQ ID NO: 325585 - DNA, 15 bp, Homo sapiens
aagtagtcttgggtg

SEQ ID NO: 325586 - DNA, 15 bp, Homo sapiens
agtagtcttgggtga

SEQ ID NO: 325587 - DNA, 15 bp, Homo sapiens
gtagtcttgggtgaa

SEQ ID NO: 325588 - DNA, 15 bp, Homo sapiens
tagtcttgggtgaat

SEQ ID NO: 325589 - DNA, 15 bp, Homo sapiens
agtcttgggtgaatg

SEQ ID NO: 325590 - DNA, 15 bp, Homo sapiens
gtcttgggtgaatgc

SEQ ID NO: 325591 - DNA, 15 bp, Homo sapiens
tcttgggtgaatgcc

SEQ ID NO: 325592 - DNA, 15 bp, Homo sapiens
cttgggtgaatgccc

SEQ ID NO: 325593 - DNA, 15 bp, Homo sapiens
ttgggtgaatgcccc

SEQ ID NO: 325594 - DNA, 15 bp, Homo sapiens
tgggtgaatgcccca

SEQ ID NO: 325595 - DNA, 15 bp, Homo sapiens
gggtgaatgccccat

SEQ ID NO: 325596 - DNA, 15 bp, Homo sapiens
ggtgaatgccccata

SEQ ID NO: 325597 - DNA, 15 bp, Homo sapiens
gtgaatgccccatat

SEQ ID NO: 325598 - DNA, 15 bp, Homo sapiens
tgaatgccccatatg

SEQ ID NO: 325599 - DNA, 15 bp, Homo sapiens
gaatgccccatatgg

SEQ ID NO: 325600 - DNA, 15 bp, Homo sapiens
aatgccccatatggc

SEQ ID NO: 325601 - DNA, 15 bp, Homo sapiens
atgccccatatggca

SEQ ID NO: 325602 - DNA, 15 bp, Homo sapiens
tgccccatatggcag

SEQ ID NO: 325603 - DNA, 15 bp, Homo sapiens
gccccatatggcagg

SEQ ID NO: 325604 - DNA, 15 bp, Homo sapiens
ccccatatggcaggc

SEQ ID NO: 325605 - DNA, 15 bp, Homo sapiens
cccatatggcaggca

SEQ ID NO: 325606 - DNA, 15 bp, Homo sapiens
ccatatggcaggcac

SEQ ID NO: 325607 - DNA, 15 bp, Homo sapiens
catatggcaggcact

SEQ ID NO: 325608 - DNA, 15 bp, Homo sapiens
atatggcaggcactg

SEQ ID NO: 325609 - DNA, 15 bp, Homo sapiens
tatggcaggcactgc

SEQ ID NO: 325610 - DNA, 15 bp, Homo sapiens
atggcaggcactgca

SEQ ID NO: 325611 - DNA, 15 bp, Homo sapiens
tggcaggcactgcac

SEQ ID NO: 325612 - DNA, 15 bp, Homo sapiens
ggcaggcactgcact

SEQ ID NO: 325613 - DNA, 15 bp, Homo sapiens
gcaggcactgcactg

SEQ ID NO: 325614 - DNA, 15 bp, Homo sapiens
caggcactgcactgg

SEQ ID NO: 325615 - DNA, 15 bp, Homo sapiens
aggcactgcactggg

SEQ ID NO: 325616 - DNA, 15 bp, Homo sapiens
ggcactgcactgggt

SEQ ID NO: 325617 - DNA, 15 bp, Homo sapiens
gcactgcactgggtg

SEQ ID NO: 325618 - DNA, 15 bp, Homo sapiens
cactgcactgggtgt

SEQ ID NO: 325619 - DNA, 15 bp, Homo sapiens
actgcactgggtgta

SEQ ID NO: 325620 - DNA, 15 bp, Homo sapiens
ctgcactgggtgtag

SEQ ID NO: 325621 - DNA, 15 bp, Homo sapiens
tgcactgggtgtagt

SEQ ID NO: 325622 - DNA, 15 bp, Homo sapiens
gcactgggtgtagtt

SEQ ID NO: 325623 - DNA, 15 bp, Homo sapiens
cactgggtgtagttg

SEQ ID NO: 325624 - DNA, 15 bp, Homo sapiens
actgggtgtagttga

SEQ ID NO: 325625 - DNA, 15 bp, Homo sapiens
ctgggtgtagttgac

SEQ ID NO: 325626 - DNA, 15 bp, Homo sapiens
tgggtgtagttgaca

SEQ ID NO: 325627 - DNA, 15 bp, Homo sapiens
gggtgtagttgacaa

SEQ ID NO: 325628 - DNA, 15 bp, Homo sapiens
ggtgtagttgacaaa

SEQ ID NO: 325629 - DNA, 15 bp, Homo sapiens
gtgtagttgacaaaa

SEQ ID NO: 325630 - DNA, 15 bp, Homo sapiens
tgtagttgacaaaac

SEQ ID NO: 325631 - DNA, 15 bp, Homo sapiens
gtagttgacaaaact

SEQ ID NO: 325632 - DNA, 15 bp, Homo sapiens
tagttgacaaaactg

SEQ ID NO: 325633 - DNA, 15 bp, Homo sapiens
agttgacaaaactga

SEQ ID NO: 325634 - DNA, 15 bp, Homo sapiens
gttgacaaaactgat

SEQ ID NO: 325635 - DNA, 15 bp, Homo sapiens
ttgacaaaactgatg

SEQ ID NO: 325636 - DNA, 15 bp, Homo sapiens
tgacaaaactgatga

SEQ ID NO: 325637 - DNA, 15 bp, Homo sapiens
gacaaaactgatgag

SEQ ID NO: 325638 - DNA, 15 bp, Homo sapiens
acaaaactgatgagc

SEQ ID NO: 325639 - DNA, 15 bp, Homo sapiens
caaaactgatgagct

SEQ ID NO: 325640 - DNA, 15 bp, Homo sapiens
aaaactgatgagctc

SEQ ID NO: 325641 - DNA, 15 bp, Homo sapiens
aaactgatgagctct

SEQ ID NO: 325642 - DNA, 15 bp, Homo sapiens
aactgatgagctcta

SEQ ID NO: 325643 - DNA, 15 bp, Homo sapiens
actgatgagctctat

SEQ ID NO: 325644 - DNA, 15 bp, Homo sapiens
ctgatgagctctatg

SEQ ID NO: 325645 - DNA, 15 bp, Homo sapiens
tgatgagctctatga

SEQ ID NO: 325646 - DNA, 15 bp, Homo sapiens
gatgagctctatgat

SEQ ID NO: 325647 - DNA, 15 bp, Homo sapiens
atgagctctatgatg

SEQ ID NO: 325648 - DNA, 15 bp, Homo sapiens
tgagctctatgatgg

SEQ ID NO: 325649 - DNA, 15 bp, Homo sapiens
gagctctatgatggc

SEQ ID NO: 325650 - DNA, 15 bp, Homo sapiens
agctctatgatggca

SEQ ID NO: 325651 - DNA, 15 bp, Homo sapiens
gctctatgatggcat

SEQ ID NO: 325652 - DNA, 15 bp, Homo sapiens
ctctatgatggcatc

SEQ ID NO: 325653 - DNA, 15 bp, Homo sapiens
tctatgatggcatct

SEQ ID NO: 325654 - DNA, 15 bp, Homo sapiens
ctatgatggcatctg

SEQ ID NO: 325655 - DNA, 15 bp, Homo sapiens
tatgatggcatctgg

SEQ ID NO: 325656 - DNA, 15 bp, Homo sapiens
atgatggcatctggc

SEQ ID NO: 325657 - DNA, 15 bp, Homo sapiens
tgatggcatctggcc

SEQ ID NO: 325658 - DNA, 15 bp, Homo sapiens
gatggcatctggcct

SEQ ID NO: 325659 - DNA, 15 bp, Homo sapiens
atggcatctggcctc

SEQ ID NO: 325660 - DNA, 15 bp, Homo sapiens
tggcatctggcctct

SEQ ID NO: 325661 - DNA, 15 bp, Homo sapiens
ggcatctggcctctt

SEQ ID NO: 325662 - DNA, 15 bp, Homo sapiens
gcatctggcctcttg

SEQ ID NO: 325663 - DNA, 15 bp, Homo sapiens
catctggcctcttga

SEQ ID NO: 325664 - DNA, 15 bp, Homo sapiens
atctggcctcttgag

SEQ ID NO: 325665 - DNA, 15 bp, Homo sapiens
tctggcctcttgagt

SEQ ID NO: 325666 - DNA, 15 bp, Homo sapiens
ctggcctcttgagtg

SEQ ID NO: 325667 - DNA, 15 bp, Homo sapiens
tggcctcttgagtgt

SEQ ID NO: 325668 - DNA, 15 bp, Homo sapiens
ggcctcttgagtgtg

SEQ ID NO: 325669 - DNA, 15 bp, Homo sapiens
gcctcttgagtgtgt

SEQ ID NO: 325670 - DNA, 15 bp, Homo sapiens
cctcttgagtgtgta

SEQ ID NO: 325671 - DNA, 15 bp, Homo sapiens
ctcttgagtgtgtag

SEQ ID NO: 325672 - DNA, 15 bp, Homo sapiens
tcttgagtgtgtaga

SEQ ID NO: 325673 - DNA, 15 bp, Homo sapiens
cttgagtgtgtagac

SEQ ID NO: 325674 - DNA, 15 bp, Homo sapiens
ttgagtgtgtagact

SEQ ID NO: 325675 - DNA, 15 bp, Homo sapiens
tgagtgtgtagacta

SEQ ID NO: 325676 - DNA, 15 bp, Homo sapiens
gagtgtgtagactag

SEQ ID NO: 325677 - DNA, 15 bp, Homo sapiens
agtgtgtagactagt

SEQ ID NO: 325678 - DNA, 15 bp, Homo sapiens
gtgtgtagactagta

SEQ ID NO: 325679 - DNA, 15 bp, Homo sapiens
tgtgtagactagtac

SEQ ID NO: 325680 - DNA, 15 bp, Homo sapiens
gtgtagactagtacg

SEQ ID NO: 325681 - DNA, 15 bp, Homo sapiens
tgtagactagtacga

SEQ ID NO: 325682 - DNA, 15 bp, Homo sapiens
gtagactagtacgag

SEQ ID NO: 325683 - DNA, 15 bp, Homo sapiens
tagactagtacgaga

SEQ ID NO: 325684 - DNA, 15 bp, Homo sapiens
agactagtacgagaa

SEQ ID NO: 325685 - DNA, 15 bp, Homo sapiens
gactagtacgagaac

SEQ ID NO: 325686 - DNA, 15 bp, Homo sapiens
actagtacgagaacc

SEQ ID NO: 325687 - DNA, 15 bp, Homo sapiens
ctagtacgagaacca

SEQ ID NO: 325688 - DNA, 15 bp, Homo sapiens
tagtacgagaaccag

SEQ ID NO: 325689 - DNA, 15 bp, Homo sapiens
agtacgagaaccaga

SEQ ID NO: 325690 - DNA, 15 bp, Homo sapiens
gtacgagaaccagac

SEQ ID NO: 325691 - DNA, 15 bp, Homo sapiens
tacgagaaccagaca

SEQ ID NO: 325692 - DNA, 15 bp, Homo sapiens
acgagaaccagacat

SEQ ID NO: 325693 - DNA, 15 bp, Homo sapiens
cgagaaccagacatc

SEQ ID NO: 325694 - DNA, 15 bp, Homo sapiens
gagaaccagacatca

SEQ ID NO: 325695 - DNA, 15 bp, Homo sapiens
agaaccagacatcaa

SEQ ID NO: 325696 - DNA, 15 bp, Homo sapiens
gaaccagacatcaaa

SEQ ID NO: 325697 - DNA, 15 bp, Homo sapiens
aaccagacatcaaat

SEQ ID NO: 325698 - DNA, 15 bp, Homo sapiens
accagacatcaaatt

SEQ ID NO: 325699 - DNA, 15 bp, Homo sapiens
ccagacatcaaattg

SEQ ID NO: 325700 - DNA, 15 bp, Homo sapiens
cagacatcaaattgc

SEQ ID NO: 325701 - DNA, 15 bp, Homo sapiens
agacatcaaattgca

SEQ ID NO: 325702 - DNA, 15 bp, Homo sapiens
gacatcaaattgcag

SEQ ID NO: 325703 - DNA, 15 bp, Homo sapiens
acatcaaattgcaga

SEQ ID NO: 325704 - DNA, 15 bp, Homo sapiens
catcaaattgcagag

SEQ ID NO: 325705 - DNA, 15 bp, Homo sapiens
atcaaattgcagagc

SEQ ID NO: 325706 - DNA, 15 bp, Homo sapiens
tcaaattgcagagca

SEQ ID NO: 325707 - DNA, 15 bp, Homo sapiens
caaattgcagagcat

SEQ ID NO: 325708 - DNA, 15 bp, Homo sapiens
aaattgcagagcata

SEQ ID NO: 325709 - DNA, 15 bp, Homo sapiens
aattgcagagcatac

SEQ ID NO: 325710 - DNA, 15 bp, Homo sapiens
attgcagagcataca

SEQ ID NO: 325711 - DNA, 15 bp, Homo sapiens
ttgcagagcatacaa

SEQ ID NO: 325712 - DNA, 15 bp, Homo sapiens
tgcagagcatacaaa

SEQ ID NO: 325713 - DNA, 15 bp, Homo sapiens
gcagagcatacaaat

SEQ ID NO: 325714 - DNA, 15 bp, Homo sapiens
cagagcatacaaata

SEQ ID NO: 325715 - DNA, 15 bp, Homo sapiens
agagcatacaaatag

SEQ ID NO: 325716 - DNA, 15 bp, Homo sapiens
gagcatacaaatagt

SEQ ID NO: 325717 - DNA, 15 bp, Homo sapiens
agcatacaaatagtt

SEQ ID NO: 325718 - DNA, 15 bp, Homo sapiens
gcatacaaatagttg

SEQ ID NO: 325719 - DNA, 15 bp, Homo sapiens
catacaaatagttgt

SEQ ID NO: 325720 - DNA, 15 bp, Homo sapiens
atacaaatagttgtt

SEQ ID NO: 325721 - DNA, 15 bp, Homo sapiens
tacaaatagttgttt

SEQ ID NO: 325722 - DNA, 15 bp, Homo sapiens
acaaatagttgttta

SEQ ID NO: 325723 - DNA, 15 bp, Homo sapiens
caaatagttgtttaa

SEQ ID NO: 325724 - DNA, 15 bp, Homo sapiens
aaatagttgtttaac

SEQ ID NO: 325725 - DNA, 15 bp, Homo sapiens
aatagttgtttaact

SEQ ID NO: 325726 - DNA, 15 bp, Homo sapiens
atagttgtttaactg

SEQ ID NO: 325727 - DNA, 15 bp, Homo sapiens
tagttgtttaactgc

SEQ ID NO: 325728 - DNA, 15 bp, Homo sapiens
agttgtttaactgct

SEQ ID NO: 325729 - DNA, 15 bp, Homo sapiens
gttgtttaactgctt

SEQ ID NO: 325730 - DNA, 15 bp, Homo sapiens
ttgtttaactgctta

SEQ ID NO: 325731 - DNA, 15 bp, Homo sapiens
tgtttaactgcttag

SEQ ID NO: 325732 - DNA, 15 bp, Homo sapiens
gtttaactgcttaga

SEQ ID NO: 325733 - DNA, 15 bp, Homo sapiens
tttaactgcttagag

SEQ ID NO: 325734 - DNA, 15 bp, Homo sapiens
ttaactgcttagagg

SEQ ID NO: 325735 - DNA, 15 bp, Homo sapiens
taactgcttagaggg

SEQ ID NO: 325736 - DNA, 15 bp, Homo sapiens
aactgcttagagggt

SEQ ID NO: 325737 - DNA, 15 bp, Homo sapiens
actgcttagagggta

SEQ ID NO: 325738 - DNA, 15 bp, Homo sapiens
ctgcttagagggtag

SEQ ID NO: 325739 - DNA, 15 bp, Homo sapiens
tgcttagagggtaga

SEQ ID NO: 325740 - DNA, 15 bp, Homo sapiens
gcttagagggtagac

SEQ ID NO: 325741 - DNA, 15 bp, Homo sapiens
cttagagggtagaca

SEQ ID NO: 325742 - DNA, 15 bp, Homo sapiens
ttagagggtagacat

SEQ ID NO: 325743 - DNA, 15 bp, Homo sapiens
tagagggtagacatt

SEQ ID NO: 325744 - DNA, 15 bp, Homo sapiens
agagggtagacattc

SEQ ID NO: 325745 - DNA, 15 bp, Homo sapiens
gagggtagacattct

SEQ ID NO: 325746 - DNA, 15 bp, Homo sapiens
agggtagacattctg

SEQ ID NO: 325747 - DNA, 15 bp, Homo sapiens
gggtagacattctgc

SEQ ID NO: 325748 - DNA, 15 bp, Homo sapiens
ggtagacattctgca

SEQ ID NO: 325749 - DNA, 15 bp, Homo sapiens
gtagacattctgcag

SEQ ID NO: 325750 - DNA, 15 bp, Homo sapiens
tagacattctgcagt

SEQ ID NO: 325751 - DNA, 15 bp, Homo sapiens
agacattctgcagtg

SEQ ID NO: 325752 - DNA, 15 bp, Homo sapiens
gacattctgcagtgc

SEQ ID NO: 325753 - DNA, 15 bp, Homo sapiens
acattctgcagtgct

SEQ ID NO: 325754 - DNA, 15 bp, Homo sapiens
cattctgcagtgctg

SEQ ID NO: 325755 - DNA, 15 bp, Homo sapiens
attctgcagtgctgt

SEQ ID NO: 325756 - DNA, 15 bp, Homo sapiens
ttctgcagtgctgtc

SEQ ID NO: 325757 - DNA, 15 bp, Homo sapiens
tctgcagtgctgtca

SEQ ID NO: 325758 - DNA, 15 bp, Homo sapiens
ctgcagtgctgtcat

SEQ ID NO: 325759 - DNA, 15 bp, Homo sapiens
tgcagtgctgtcatg

SEQ ID NO: 325760 - DNA, 15 bp, Homo sapiens
gcagtgctgtcatgg

SEQ ID NO: 325761 - DNA, 15 bp, Homo sapiens
cagtgctgtcatggc

SEQ ID NO: 325762 - DNA, 15 bp, Homo sapiens
agtgctgtcatggca

SEQ ID NO: 325763 - DNA, 15 bp, Homo sapiens
gtgctgtcatggcaa

SEQ ID NO: 325764 - DNA, 15 bp, Homo sapiens
tgctgtcatggcaaa

SEQ ID NO: 325765 - DNA, 15 bp, Homo sapiens
gctgtcatggcaaat

SEQ ID NO: 325766 - DNA, 15 bp, Homo sapiens
ctgtcatggcaaatc

SEQ ID NO: 325767 - DNA, 15 bp, Homo sapiens
tgtcatggcaaatca

SEQ ID NO: 325768 - DNA, 15 bp, Homo sapiens
gtcatggcaaatcac

SEQ ID NO: 325769 - DNA, 15 bp, Homo sapiens
tcatggcaaatcact

SEQ ID NO: 325770 - DNA, 15 bp, Homo sapiens
catggcaaatcactc

SEQ ID NO: 325771 - DNA, 15 bp, Homo sapiens
atggcaaatcactcg

SEQ ID NO: 325772 - DNA, 15 bp, Homo sapiens
tggcaaatcactcgg

SEQ ID NO: 325773 - DNA, 15 bp, Homo sapiens
ggcaaatcactcggg

SEQ ID NO: 325774 - DNA, 15 bp, Homo sapiens
gcaaatcactcgggg

SEQ ID NO: 325775 - DNA, 15 bp, Homo sapiens
caaatcactcgggga

SEQ ID NO: 325776 - DNA, 15 bp, Homo sapiens
aaatcactcggggac

SEQ ID NO: 325777 - DNA, 15 bp, Homo sapiens
aatcactcggggact

SEQ ID NO: 325778 - DNA, 15 bp, Homo sapiens
atcactcggggactt

SEQ ID NO: 325779 - DNA, 15 bp, Homo sapiens
tcactcggggacttc

SEQ ID NO: 325780 - DNA, 15 bp, Homo sapiens
cactcggggacttca

SEQ ID NO: 325781 - DNA, 15 bp, Homo sapiens
actcggggacttcat

SEQ ID NO: 325782 - DNA, 15 bp, Homo sapiens
ctcggggacttcata

SEQ ID NO: 325783 - DNA, 15 bp, Homo sapiens
tcggggacttcatag

SEQ ID NO: 325784 - DNA, 15 bp, Homo sapiens
cggggacttcatagg

SEQ ID NO: 325785 - DNA, 15 bp, Homo sapiens
ggggacttcataggg

SEQ ID NO: 325786 - DNA, 15 bp, Homo sapiens
gggacttcataggga

SEQ ID NO: 325787 - DNA, 15 bp, Homo sapiens
ggacttcatagggac

SEQ ID NO: 325788 - DNA, 15 bp, Homo sapiens
gacttcatagggacc

SEQ ID NO: 325789 - DNA, 15 bp, Homo sapiens
acttcatagggacct

SEQ ID NO: 325790 - DNA, 15 bp, Homo sapiens
cttcatagggacctg

SEQ ID NO: 325791 - DNA, 15 bp, Homo sapiens
ttcatagggacctgg

SEQ ID NO: 325792 - DNA, 15 bp, Homo sapiens
tcatagggacctgga

SEQ ID NO: 325793 - DNA, 15 bp, Homo sapiens
catagggacctggaa

SEQ ID NO: 325794 - DNA, 15 bp, Homo sapiens
atagggacctggaat

SEQ ID NO: 325795 - DNA, 15 bp, Homo sapiens
tagggacctggaatg

SEQ ID NO: 325796 - DNA, 15 bp, Homo sapiens
agggacctggaatga

SEQ ID NO: 325797 - DNA, 15 bp, Homo sapiens
gggacctggaatgag

SEQ ID NO: 325798 - DNA, 15 bp, Homo sapiens
ggacctggaatgagt

SEQ ID NO: 325799 - DNA, 15 bp, Homo sapiens
gacctggaatgagtg

SEQ ID NO: 325800 - DNA, 15 bp, Homo sapiens
acctggaatgagtga

SEQ ID NO: 325801 - DNA, 15 bp, Homo sapiens
cctggaatgagtgat

SEQ ID NO: 325802 - DNA, 15 bp, Homo sapiens
ctggaatgagtgata

SEQ ID NO: 325803 - DNA, 15 bp, Homo sapiens
tggaatgagtgatag

SEQ ID NO: 325804 - DNA, 15 bp, Homo sapiens
ggaatgagtgatagt

SEQ ID NO: 325805 - DNA, 15 bp, Homo sapiens
gaatgagtgatagtt

SEQ ID NO: 325806 - DNA, 15 bp, Homo sapiens
aatgagtgatagttt

SEQ ID NO: 325807 - DNA, 15 bp, Homo sapiens
atgagtgatagtttg

SEQ ID NO: 325808 - DNA, 15 bp, Homo sapiens
tgagtgatagtttga

SEQ ID NO: 325809 - DNA, 15 bp, Homo sapiens
gagtgatagtttgag

SEQ ID NO: 325810 - DNA, 15 bp, Homo sapiens
agtgatagtttgagt

SEQ ID NO: 325811 - DNA, 15 bp, Homo sapiens
gtgatagtttgagtg

SEQ ID NO: 325812 - DNA, 15 bp, Homo sapiens
tgatagtttgagtgg

SEQ ID NO: 325813 - DNA, 15 bp, Homo sapiens
gatagtttgagtggt

SEQ ID NO: 325814 - DNA, 15 bp, Homo sapiens
atagtttgagtggtc

SEQ ID NO: 325815 - DNA, 15 bp, Homo sapiens
tagtttgagtggtca

SEQ ID NO: 325816 - DNA, 15 bp, Homo sapiens
agtttgagtggtcag

SEQ ID NO: 325817 - DNA, 15 bp, Homo sapiens
gtttgagtggtcagg

SEQ ID NO: 325818 - DNA, 15 bp, Homo sapiens
tttgagtggtcaggg

SEQ ID NO: 325819 - DNA, 15 bp, Homo sapiens
ttgagtggtcaggga

SEQ ID NO: 325820 - DNA, 15 bp, Homo sapiens
tgagtggtcagggaa

SEQ ID NO: 325821 - DNA, 15 bp, Homo sapiens
gagtggtcagggaag

SEQ ID NO: 325822 - DNA, 15 bp, Homo sapiens
tggtcagggaaggcc

SEQ ID NO: 325823 - DNA, 15 bp, Homo sapiens
ggtcagggaaggcct

SEQ ID NO: 325824 - DNA, 15 bp, Homo sapiens
gtcagggaaggcctt

SEQ ID NO: 325825 - DNA, 15 bp, Homo sapiens
tcagggaaggccttc

SEQ ID NO: 325826 - DNA, 15 bp, Homo sapiens
cagggaaggccttct

SEQ ID NO: 325827 - DNA, 15 bp, Homo sapiens
agggaaggccttctt

SEQ ID NO: 325828 - DNA, 15 bp, Homo sapiens
gggaaggccttcttg

SEQ ID NO: 325829 - DNA, 15 bp, Homo sapiens
ggaaggccttcttga

SEQ ID NO: 325830 - DNA, 15 bp, Homo sapiens
gaaggccttcttgag

SEQ ID NO: 325831 - DNA, 15 bp, Homo sapiens
aaggccttcttgagg

SEQ ID NO: 325832 - DNA, 15 bp, Homo sapiens
aggccttcttgagga

SEQ ID NO: 325833 - DNA, 15 bp, Homo sapiens
ggccttcttgaggaa

SEQ ID NO: 325834 - DNA, 15 bp, Homo sapiens
gccttcttgaggaat

SEQ ID NO: 325835 - DNA, 15 bp, Homo sapiens
ccttcttgaggaatc

SEQ ID NO: 325836 - DNA, 15 bp, Homo sapiens
cttcttgaggaatct

SEQ ID NO: 325837 - DNA, 15 bp, Homo sapiens
ttcttgaggaatcta

SEQ ID NO: 325838 - DNA, 15 bp, Homo sapiens
tcttgaggaatctat

SEQ ID NO: 325839 - DNA, 15 bp, Homo sapiens
cttgaggaatctatt

SEQ ID NO: 325840 - DNA, 15 bp, Homo sapiens
ttgaggaatctattc

SEQ ID NO: 325841 - DNA, 15 bp, Homo sapiens
tgaggaatctattca

SEQ ID NO: 325842 - DNA, 15 bp, Homo sapiens
gaggaatctattcaa

SEQ ID NO: 325843 - DNA, 15 bp, Homo sapiens
aggaatctattcaag

SEQ ID NO: 325844 - DNA, 15 bp, Homo sapiens
ggaatctattcaagt

SEQ ID NO: 325845 - DNA, 15 bp, Homo sapiens
gaatctattcaagtc

SEQ ID NO: 325846 - DNA, 15 bp, Homo sapiens
aatctattcaagtcc

SEQ ID NO: 325847 - DNA, 15 bp, Homo sapiens
atctattcaagtcca

SEQ ID NO: 325848 - DNA, 15 bp, Homo sapiens
tctattcaagtccat

SEQ ID NO: 325849 - DNA, 15 bp, Homo sapiens
ctattcaagtccata

SEQ ID NO: 325850 - DNA, 15 bp, Homo sapiens
tattcaagtccatag

SEQ ID NO: 325851 - DNA, 15 bp, Homo sapiens
attcaagtccatagt

SEQ ID NO: 325852 - DNA, 15 bp, Homo sapiens
ttcaagtccatagtt

SEQ ID NO: 325853 - DNA, 15 bp, Homo sapiens
tcaagtccatagttc

SEQ ID NO: 325854 - DNA, 15 bp, Homo sapiens
caagtccatagttca

SEQ ID NO: 325855 - DNA, 15 bp, Homo sapiens
aagtccatagttcaa

SEQ ID NO: 325856 - DNA, 15 bp, Homo sapiens
agtccatagttcaag

SEQ ID NO: 325857 - DNA, 15 bp, Homo sapiens
gtccatagttcaagg

SEQ ID NO: 325858 - DNA, 15 bp, Homo sapiens
tccatagttcaaggt

SEQ ID NO: 325859 - DNA, 15 bp, Homo sapiens
ccatagttcaaggtg

SEQ ID NO: 325860 - DNA, 15 bp, Homo sapiens
catagttcaaggtgg

SEQ ID NO: 325861 - DNA, 15 bp, Homo sapiens
atagttcaaggtggt

SEQ ID NO: 325862 - DNA, 15 bp, Homo sapiens
tagttcaaggtggtg

SEQ ID NO: 325863 - DNA, 15 bp, Homo sapiens
agttcaaggtggtgg

SEQ ID NO: 325864 - DNA, 15 bp, Homo sapiens
gttcaaggtggtgga

SEQ ID NO: 325865 - DNA, 15 bp, Homo sapiens
ttcaaggtggtggag

SEQ ID NO: 325866 - DNA, 15 bp, Homo sapiens
tcaaggtggtggagg

SEQ ID NO: 325867 - DNA, 15 bp, Homo sapiens
caaggtggtggaggg

SEQ ID NO: 325868 - DNA, 15 bp, Homo sapiens
aaggtggtggagggc

SEQ ID NO: 325869 - DNA, 15 bp, Homo sapiens
aggtggtggagggca

SEQ ID NO: 325870 - DNA, 15 bp, Homo sapiens
ggtggtggagggcac

SEQ ID NO: 325871 - DNA, 15 bp, Homo sapiens
gtggtggagggcact

SEQ ID NO: 325872 - DNA, 15 bp, Homo sapiens
tggtggagggcactg

SEQ ID NO: 325873 - DNA, 15 bp, Homo sapiens
ggtggagggcactgg

SEQ ID NO: 325874 - DNA, 15 bp, Homo sapiens
gtggagggcactggc

SEQ ID NO: 325875 - DNA, 15 bp, Homo sapiens
tggagggcactggct

SEQ ID NO: 325876 - DNA, 15 bp, Homo sapiens
ggagggcactggctg

SEQ ID NO: 325877 - DNA, 15 bp, Homo sapiens
gagggcactggctga

SEQ ID NO: 325878 - DNA, 15 bp, Homo sapiens
agggcactggctgaa

SEQ ID NO: 325879 - DNA, 15 bp, Homo sapiens
gggcactggctgaag

SEQ ID NO: 325880 - DNA, 15 bp, Homo sapiens
ggcactggctgaagg

SEQ ID NO: 325881 - DNA, 15 bp, Homo sapiens
gcactggctgaaggc

SEQ ID NO: 325882 - DNA, 15 bp, Homo sapiens
cactggctgaaggca

SEQ ID NO: 325883 - DNA, 15 bp, Homo sapiens
actggctgaaggcag

SEQ ID NO: 325884 - DNA, 15 bp, Homo sapiens
ctggctgaaggcaga

SEQ ID NO: 325885 - DNA, 15 bp, Homo sapiens
tggctgaaggcagag

SEQ ID NO: 325886 - DNA, 15 bp, Homo sapiens
ggctgaaggcagagc

SEQ ID NO: 325887 - DNA, 15 bp, Homo sapiens
gctgaaggcagagct

SEQ ID NO: 325888 - DNA, 15 bp, Homo sapiens
ctgaaggcagagctg

SEQ ID NO: 325889 - DNA, 15 bp, Homo sapiens
tgaaggcagagctgt

SEQ ID NO: 325890 - DNA, 15 bp, Homo sapiens
gaaggcagagctgtg

SEQ ID NO: 325891 - DNA, 15 bp, Homo sapiens
aaggcagagctgtgt

SEQ ID NO: 325892 - DNA, 15 bp, Homo sapiens
aggcagagctgtgtg

SEQ ID NO: 325893 - DNA, 15 bp, Homo sapiens
ggcagagctgtgtgc

SEQ ID NO: 325894 - DNA, 15 bp, Homo sapiens
gcagagctgtgtgca

SEQ ID NO: 325895 - DNA, 15 bp, Homo sapiens
cagagctgtgtgcag

SEQ ID NO: 325896 - DNA, 15 bp, Homo sapiens
agagctgtgtgcagg

SEQ ID NO: 325897 - DNA, 15 bp, Homo sapiens
gagctgtgtgcaggc

SEQ ID NO: 325898 - DNA, 15 bp, Homo sapiens
agctgtgtgcaggct

SEQ ID NO: 325899 - DNA, 15 bp, Homo sapiens
gctgtgtgcaggctc

SEQ ID NO: 325900 - DNA, 15 bp, Homo sapiens
ctgtgtgcaggctct

SEQ ID NO: 325901 - DNA, 15 bp, Homo sapiens
tgtgtgcaggctcta

SEQ ID NO: 325902 - DNA, 15 bp, Homo sapiens
gtgtgcaggctctaa

SEQ ID NO: 325903 - DNA, 15 bp, Homo sapiens
tgtgcaggctctaag

SEQ ID NO: 325904 - DNA, 15 bp, Homo sapiens
gtgcaggctctaagc

SEQ ID NO: 325905 - DNA, 15 bp, Homo sapiens
tgcaggctctaagct

SEQ ID NO: 325906 - DNA, 15 bp, Homo sapiens
gcaggctctaagctg

SEQ ID NO: 325907 - DNA, 15 bp, Homo sapiens
caggctctaagctgg

SEQ ID NO: 325908 - DNA, 15 bp, Homo sapiens
aggctctaagctggc

SEQ ID NO: 325909 - DNA, 15 bp, Homo sapiens
ggctctaagctggca

SEQ ID NO: 325910 - DNA, 15 bp, Homo sapiens
gctctaagctggcag

SEQ ID NO: 325911 - DNA, 15 bp, Homo sapiens
ctctaagctggcaga

SEQ ID NO: 325912 - DNA, 15 bp, Homo sapiens
tctaagctggcagaa

SEQ ID NO: 325913 - DNA, 15 bp, Homo sapiens
ctaagctggcagaac

SEQ ID NO: 325914 - DNA, 15 bp, Homo sapiens
taagctggcagaact

SEQ ID NO: 325915 - DNA, 15 bp, Homo sapiens
aagctggcagaactt

SEQ ID NO: 325916 - DNA, 15 bp, Homo sapiens
agctggcagaacttg

SEQ ID NO: 325917 - DNA, 15 bp, Homo sapiens
gctggcagaacttgg

SEQ ID NO: 325918 - DNA, 15 bp, Homo sapiens
ctggcagaacttggc

SEQ ID NO: 325919 - DNA, 15 bp, Homo sapiens
tggcagaacttggcc

SEQ ID NO: 325920 - DNA, 15 bp, Homo sapiens
ggcagaacttggccc

SEQ ID NO: 325921 - DNA, 15 bp, Homo sapiens
gcagaacttggccca

SEQ ID NO: 325922 - DNA, 15 bp, Homo sapiens
cagaacttggcccac

SEQ ID NO: 325923 - DNA, 15 bp, Homo sapiens
agaacttggcccaca

SEQ ID NO: 325924 - DNA, 15 bp, Homo sapiens
gaacttggcccacag

SEQ ID NO: 325925 - DNA, 15 bp, Homo sapiens
aacttggcccacaga

SEQ ID NO: 325926 - DNA, 15 bp, Homo sapiens
acttggcccacagaa

SEQ ID NO: 325927 - DNA, 15 bp, Homo sapiens
cttggcccacagaaa

SEQ ID NO: 325928 - DNA, 15 bp, Homo sapiens
ttggcccacagaaag

SEQ ID NO: 325929 - DNA, 15 bp, Homo sapiens
tggcccacagaaagc

SEQ ID NO: 325930 - DNA, 15 bp, Homo sapiens
ggcccacagaaagcc

SEQ ID NO: 325931 - DNA, 15 bp, Homo sapiens
gcccacagaaagcct

SEQ ID NO: 325932 - DNA, 15 bp, Homo sapiens
cccacagaaagcctg

SEQ ID NO: 325933 - DNA, 15 bp, Homo sapiens
ccacagaaagcctga

SEQ ID NO: 325934 - DNA, 15 bp, Homo sapiens
cacagaaagcctgat

SEQ ID NO: 325935 - DNA, 15 bp, Homo sapiens
acagaaagcctgatt

SEQ ID NO: 325936 - DNA, 15 bp, Homo sapiens
cagaaagcctgattg

SEQ ID NO: 325937 - DNA, 15 bp, Homo sapiens
agaaagcctgattga

SEQ ID NO: 325938 - DNA, 15 bp, Homo sapiens
gaaagcctgattgag

SEQ ID NO: 325939 - DNA, 15 bp, Homo sapiens
aaagcctgattgagg

SEQ ID NO: 325940 - DNA, 15 bp, Homo sapiens
aagcctgattgaggc

SEQ ID NO: 325941 - DNA, 15 bp, Homo sapiens
agcctgattgaggcc

SEQ ID NO: 325942 - DNA, 15 bp, Homo sapiens
gcctgattgaggccg

SEQ ID NO: 325943 - DNA, 15 bp, Homo sapiens
cctgattgaggccgg

SEQ ID NO: 325944 - DNA, 15 bp, Homo sapiens
ctgattgaggccggt

SEQ ID NO: 325945 - DNA, 15 bp, Homo sapiens
tgattgaggccggtg

SEQ ID NO: 325946 - DNA, 15 bp, Homo sapiens
gattgaggccggtga

SEQ ID NO: 325947 - DNA, 15 bp, Homo sapiens
attgaggccggtgat

SEQ ID NO: 325948 - DNA, 15 bp, Homo sapiens
ttgaggccggtgatt

SEQ ID NO: 325949 - DNA, 15 bp, Homo sapiens
tgaggccggtgattg

SEQ ID NO: 325950 - DNA, 15 bp, Homo sapiens
gaggccggtgattgg

SEQ ID NO: 325951 - DNA, 15 bp, Homo sapiens
aggccggtgattggg

SEQ ID NO: 325952 - DNA, 15 bp, Homo sapiens
ggccggtgattggga

SEQ ID NO: 325953 - DNA, 15 bp, Homo sapiens
gccggtgattgggag

SEQ ID NO: 325954 - DNA, 15 bp, Homo sapiens
ccggtgattgggagt

SEQ ID NO: 325955 - DNA, 15 bp, Homo sapiens
cggtgattgggagtg

SEQ ID NO: 325956 - DNA, 15 bp, Homo sapiens
ggtgattgggagtga

SEQ ID NO: 325957 - DNA, 15 bp, Homo sapiens
gtgattgggagtgaa

SEQ ID NO: 325958 - DNA, 15 bp, Homo sapiens
tgattgggagtgaag

SEQ ID NO: 325959 - DNA, 15 bp, Homo sapiens
gattgggagtgaagt

SEQ ID NO: 325960 - DNA, 15 bp, Homo sapiens
attgggagtgaagtg

SEQ ID NO: 325961 - DNA, 15 bp, Homo sapiens
ttgggagtgaagtga

SEQ ID NO: 325962 - DNA, 15 bp, Homo sapiens
tgggagtgaagtgag

SEQ ID NO: 325963 - DNA, 15 bp, Homo sapiens
gggagtgaagtgagc

SEQ ID NO: 325964 - DNA, 15 bp, Homo sapiens
ggagtgaagtgagca

SEQ ID NO: 325965 - DNA, 15 bp, Homo sapiens
gagtgaagtgagcag

SEQ ID NO: 325966 - DNA, 15 bp, Homo sapiens
agtgaagtgagcaga

SEQ ID NO: 325967 - DNA, 15 bp, Homo sapiens
gtgaagtgagcagag

SEQ ID NO: 325968 - DNA, 15 bp, Homo sapiens
tgaagtgagcagagg

SEQ ID NO: 325969 - DNA, 15 bp, Homo sapiens
gaagtgagcagaggg

SEQ ID NO: 325970 - DNA, 15 bp, Homo sapiens
aagtgagcagagggc

SEQ ID NO: 325971 - DNA, 15 bp, Homo sapiens
agtgagcagagggct

SEQ ID NO: 325972 - DNA, 15 bp, Homo sapiens
tgagcagagggctgt

SEQ ID NO: 325973 - DNA, 15 bp, Homo sapiens
gagcagagggctgtg

SEQ ID NO: 325974 - DNA, 15 bp, Homo sapiens
agcagagggctgtgg

SEQ ID NO: 325975 - DNA, 15 bp, Homo sapiens
gcagagggctgtgga

SEQ ID NO: 325976 - DNA, 15 bp, Homo sapiens
cagagggctgtggat

SEQ ID NO: 325977 - DNA, 15 bp, Homo sapiens
agagggctgtggatt

SEQ ID NO: 325978 - DNA, 15 bp, Homo sapiens
gagggctgtggatta

SEQ ID NO: 325979 - DNA, 15 bp, Homo sapiens
agggctgtggattaa

SEQ ID NO: 325980 - DNA, 15 bp, Homo sapiens
gggctgtggattaaa

SEQ ID NO: 325981 - DNA, 15 bp, Homo sapiens
ggctgtggattaaaa

SEQ ID NO: 325982 - DNA, 15 bp, Homo sapiens
gctgtggattaaaat

SEQ ID NO: 325983 - DNA, 15 bp, Homo sapiens
ctgtggattaaaatt

SEQ ID NO: 325984 - DNA, 15 bp, Homo sapiens
tgtggattaaaattg

SEQ ID NO: 325985 - DNA, 15 bp, Homo sapiens
gtggattaaaattgg

SEQ ID NO: 325986 - DNA, 15 bp, Homo sapiens
tggattaaaattggc

SEQ ID NO: 325987 - DNA, 15 bp, Homo sapiens
ggattaaaattggca

SEQ ID NO: 325988 - DNA, 15 bp, Homo sapiens
gattaaaattggcag

SEQ ID NO: 325989 - DNA, 15 bp, Homo sapiens
attaaaattggcaga

SEQ ID NO: 325990 - DNA, 15 bp, Homo sapiens
ttaaaattggcagaa

SEQ ID NO: 325991 - DNA, 15 bp, Homo sapiens
taaaattggcagaaa

SEQ ID NO: 325992 - DNA, 15 bp, Homo sapiens
aaaattggcagaaag

SEQ ID NO: 325993 - DNA, 15 bp, Homo sapiens
aaattggcagaaaga

SEQ ID NO: 325994 - DNA, 15 bp, Homo sapiens
aattggcagaaagat

SEQ ID NO: 325995 - DNA, 15 bp, Homo sapiens
attggcagaaagatg

SEQ ID NO: 325996 - DNA, 15 bp, Homo sapiens
ttggcagaaagatgc

SEQ ID NO: 325997 - DNA, 15 bp, Homo sapiens
tggcagaaagatgca

SEQ ID NO: 325998 - DNA, 15 bp, Homo sapiens
ggcagaaagatgcag

SEQ ID NO: 325999 - DNA, 15 bp, Homo sapiens
gcagaaagatgcagt

SEQ ID NO: 326000 - DNA, 15 bp, Homo sapiens
cagaaagatgcagtc

SEQ ID NO: 326001 - DNA, 15 bp, Homo sapiens
agaaagatgcagtct

SEQ ID NO: 326002 - DNA, 15 bp, Homo sapiens
gaaagatgcagtctg

SEQ ID NO: 326003 - DNA, 15 bp, Homo sapiens
aaagatgcagtctgc

SEQ ID NO: 326004 - DNA, 15 bp, Homo sapiens
aagatgcagtctgca

SEQ ID NO: 326005 - DNA, 15 bp, Homo sapiens
agatgcagtctgcat

SEQ ID NO: 326006 - DNA, 15 bp, Homo sapiens
gatgcagtctgcatt

SEQ ID NO: 326007 - DNA, 15 bp, Homo sapiens
atgcagtctgcattt

SEQ ID NO: 326008 - DNA, 15 bp, Homo sapiens
tgcagtctgcatttc

SEQ ID NO: 326009 - DNA, 15 bp, Homo sapiens
gcagtctgcatttca

SEQ ID NO: 326010 - DNA, 15 bp, Homo sapiens
cagtctgcatttcac

SEQ ID NO: 326011 - DNA, 15 bp, Homo sapiens
agtctgcatttcact

SEQ ID NO: 326012 - DNA, 15 bp, Homo sapiens
gtctgcatttcactc

SEQ ID NO: 326013 - DNA, 15 bp, Homo sapiens
tctgcatttcactca

SEQ ID NO: 326014 - DNA, 15 bp, Homo sapiens
ctgcatttcactcag

SEQ ID NO: 326015 - DNA, 15 bp, Homo sapiens
tgcatttcactcagt

SEQ ID NO: 326016 - DNA, 15 bp, Homo sapiens
gcatttcactcagta

SEQ ID NO: 326017 - DNA, 15 bp, Homo sapiens
catttcactcagtag

SEQ ID NO: 326018 - DNA, 15 bp, Homo sapiens
atttcactcagtagt

SEQ ID NO: 326019 - DNA, 15 bp, Homo sapiens
tttcactcagtagta

SEQ ID NO: 326020 - DNA, 15 bp, Homo sapiens
ttcactcagtagtat

SEQ ID NO: 326021 - DNA, 15 bp, Homo sapiens
tcactcagtagtatt

SEQ ID NO: 326022 - DNA, 15 bp, Homo sapiens
cactcagtagtattt

SEQ ID NO: 326023 - DNA, 15 bp, Homo sapiens
actcagtagtatttc

SEQ ID NO: 326024 - DNA, 15 bp, Homo sapiens
ctcagtagtatttct

SEQ ID NO: 326025 - DNA, 15 bp, Homo sapiens
tcagtagtatttctt

SEQ ID NO: 326026 - DNA, 15 bp, Homo sapiens
cagtagtatttctta

SEQ ID NO: 326027 - DNA, 15 bp, Homo sapiens
agtagtatttcttat

SEQ ID NO: 326028 - DNA, 15 bp, Homo sapiens
gtagtatttcttatc

SEQ ID NO: 326029 - DNA, 15 bp, Homo sapiens
tagtatttcttatcc

SEQ ID NO: 326030 - DNA, 15 bp, Homo sapiens
agtatttcttatcct

SEQ ID NO: 326031 - DNA, 15 bp, Homo sapiens
gtatttcttatcctg

SEQ ID NO: 326032 - DNA, 15 bp, Homo sapiens
tatttcttatcctga

SEQ ID NO: 326033 - DNA, 15 bp, Homo sapiens
atttcttatcctgat

SEQ ID NO: 326034 - DNA, 15 bp, Homo sapiens
tttcttatcctgatt

SEQ ID NO: 326035 - DNA, 15 bp, Homo sapiens
ttcttatcctgattg

SEQ ID NO: 326036 - DNA, 15 bp, Homo sapiens
tcttatcctgattga

SEQ ID NO: 326037 - DNA, 15 bp, Homo sapiens
cttatcctgattgaa

SEQ ID NO: 326038 - DNA, 15 bp, Homo sapiens
ttatcctgattgaag

SEQ ID NO: 326039 - DNA, 15 bp, Homo sapiens
tatcctgattgaagg

SEQ ID NO: 326040 - DNA, 15 bp, Homo sapiens
atcctgattgaaggg

SEQ ID NO: 326041 - DNA, 15 bp, Homo sapiens
tcctgattgaagggg

SEQ ID NO: 326042 - DNA, 15 bp, Homo sapiens
cctgattgaaggggc

SEQ ID NO: 326043 - DNA, 15 bp, Homo sapiens
ctgattgaaggggca

SEQ ID NO: 326044 - DNA, 15 bp, Homo sapiens
tgattgaaggggcat

SEQ ID NO: 326045 - DNA, 15 bp, Homo sapiens
gattgaaggggcatg

SEQ ID NO: 326046 - DNA, 15 bp, Homo sapiens
attgaaggggcatgg

SEQ ID NO: 326047 - DNA, 15 bp, Homo sapiens
ttgaaggggcatggt

SEQ ID NO: 326048 - DNA, 15 bp, Homo sapiens
tgaaggggcatggtt

SEQ ID NO: 326049 - DNA, 15 bp, Homo sapiens
gaaggggcatggttt

SEQ ID NO: 326050 - DNA, 15 bp, Homo sapiens
aaggggcatggttta

SEQ ID NO: 326051 - DNA, 15 bp, Homo sapiens
aggggcatggtttac

SEQ ID NO: 326052 - DNA, 15 bp, Homo sapiens
ggggcatggtttacc

SEQ ID NO: 326053 - DNA, 15 bp, Homo sapiens
gggcatggtttacct

SEQ ID NO: 326054 - DNA, 15 bp, Homo sapiens
ggcatggtttacctc

SEQ ID NO: 326055 - DNA, 15 bp, Homo sapiens
gcatggtttacctct

SEQ ID NO: 326056 - DNA, 15 bp, Homo sapiens
catggtttacctctt

SEQ ID NO: 326057 - DNA, 15 bp, Homo sapiens
atggtttacctctta

SEQ ID NO: 326058 - DNA, 15 bp, Homo sapiens
tggtttacctcttag

SEQ ID NO: 326059 - DNA, 15 bp, Homo sapiens
ggtttacctcttagt

SEQ ID NO: 326060 - DNA, 15 bp, Homo sapiens
gtttacctcttagtt

SEQ ID NO: 326061 - DNA, 15 bp, Homo sapiens
tttacctcttagttt

SEQ ID NO: 326062 - DNA, 15 bp, Homo sapiens
ttacctcttagtttg

SEQ ID NO: 326063 - DNA, 15 bp, Homo sapiens
tacctcttagtttga

SEQ ID NO: 326064 - DNA, 15 bp, Homo sapiens
acctcttagtttgag

SEQ ID NO: 326065 - DNA, 15 bp, Homo sapiens
cctcttagtttgagg

SEQ ID NO: 326066 - DNA, 15 bp, Homo sapiens
ctcttagtttgaggg

SEQ ID NO: 326067 - DNA, 15 bp, Homo sapiens
tcttagtttgagggc

SEQ ID NO: 326068 - DNA, 15 bp, Homo sapiens
cttagtttgagggca

SEQ ID NO: 326069 - DNA, 15 bp, Homo sapiens
ttagtttgagggcat

SEQ ID NO: 326070 - DNA, 15 bp, Homo sapiens
tagtttgagggcatg

SEQ ID NO: 326071 - DNA, 15 bp, Homo sapiens
agtttgagggcatgt

SEQ ID NO: 326072 - DNA, 15 bp, Homo sapiens
gtttgagggcatgta

SEQ ID NO: 326073 - DNA, 15 bp, Homo sapiens
tttgagggcatgtat

SEQ ID NO: 326074 - DNA, 15 bp, Homo sapiens
ttgagggcatgtatt

SEQ ID NO: 326075 - DNA, 15 bp, Homo sapiens
tgagggcatgtatta

SEQ ID NO: 326076 - DNA, 15 bp, Homo sapiens
gagggcatgtattat

SEQ ID NO: 326077 - DNA, 15 bp, Homo sapiens
agggcatgtattatt

SEQ ID NO: 326078 - DNA, 15 bp, Homo sapiens
gggcatgtattattt

SEQ ID NO: 326079 - DNA, 15 bp, Homo sapiens
ggcatgtattattta

SEQ ID NO: 326080 - DNA, 15 bp, Homo sapiens
gcatgtattatttag

SEQ ID NO: 326081 - DNA, 15 bp, Homo sapiens
catgtattatttagt

SEQ ID NO: 326082 - DNA, 15 bp, Homo sapiens
atgtattatttagtg

SEQ ID NO: 326083 - DNA, 15 bp, Homo sapiens
tgtattatttagtgc

SEQ ID NO: 326084 - DNA, 15 bp, Homo sapiens
gtattatttagtgca

SEQ ID NO: 326085 - DNA, 15 bp, Homo sapiens
tattatttagtgcat

SEQ ID NO: 326086 - DNA, 15 bp, Homo sapiens
attatttagtgcatt

SEQ ID NO: 326087 - DNA, 15 bp, Homo sapiens
ttatttagtgcatta

SEQ ID NO: 326088 - DNA, 15 bp, Homo sapiens
tatttagtgcattaa

SEQ ID NO: 326089 - DNA, 15 bp, Homo sapiens
atttagtgcattaat

SEQ ID NO: 326090 - DNA, 15 bp, Homo sapiens
tttagtgcattaatg

SEQ ID NO: 326091 - DNA, 15 bp, Homo sapiens
ttagtgcattaatgg

SEQ ID NO: 326092 - DNA, 15 bp, Homo sapiens
tagtgcattaatgga

SEQ ID NO: 326093 - DNA, 15 bp, Homo sapiens
agtgcattaatggat

SEQ ID NO: 326094 - DNA, 15 bp, Homo sapiens
gtgcattaatggatg

SEQ ID NO: 326095 - DNA, 15 bp, Homo sapiens
tgcattaatggatgg

SEQ ID NO: 326096 - DNA, 15 bp, Homo sapiens
gcattaatggatgga

SEQ ID NO: 326097 - DNA, 15 bp, Homo sapiens
cattaatggatggat

SEQ ID NO: 326098 - DNA, 15 bp, Homo sapiens
attaatggatggatc

SEQ ID NO: 326099 - DNA, 15 bp, Homo sapiens
ttaatggatggatcc

SEQ ID NO: 326100 - DNA, 15 bp, Homo sapiens
taatggatggatccc

SEQ ID NO: 326101 - DNA, 15 bp, Homo sapiens
aatggatggatccct

SEQ ID NO: 326102 - DNA, 15 bp, Homo sapiens
atggatggatcccta

SEQ ID NO: 326103 - DNA, 15 bp, Homo sapiens
tggatggatccctaa

SEQ ID NO: 326104 - DNA, 15 bp, Homo sapiens
ggatggatccctaaa

SEQ ID NO: 326105 - DNA, 15 bp, Homo sapiens
gatggatccctaaaa

SEQ ID NO: 326106 - DNA, 15 bp, Homo sapiens
atggatccctaaaag

SEQ ID NO: 326107 - DNA, 15 bp, Homo sapiens
tggatccctaaaagc

SEQ ID NO: 326108 - DNA, 15 bp, Homo sapiens
ggatccctaaaagca

SEQ ID NO: 326109 - DNA, 15 bp, Homo sapiens
gatccctaaaagcat

SEQ ID NO: 326110 - DNA, 15 bp, Homo sapiens
atccctaaaagcatt

SEQ ID NO: 326111 - DNA, 15 bp, Homo sapiens
tccctaaaagcatta

SEQ ID NO: 326112 - DNA, 15 bp, Homo sapiens
ccctaaaagcattag

SEQ ID NO: 326113 - DNA, 15 bp, Homo sapiens
cctaaaagcattagg

SEQ ID NO: 326114 - DNA, 15 bp, Homo sapiens
ctaaaagcattagga

SEQ ID NO: 326115 - DNA, 15 bp, Homo sapiens
taaaagcattaggaa

SEQ ID NO: 326116 - DNA, 15 bp, Homo sapiens
aaaagcattaggaat

SEQ ID NO: 326117 - DNA, 15 bp, Homo sapiens
aaagcattaggaatt

SEQ ID NO: 326118 - DNA, 15 bp, Homo sapiens
aagcattaggaatta

SEQ ID NO: 326119 - DNA, 15 bp, Homo sapiens
agcattaggaattag

SEQ ID NO: 326120 - DNA, 15 bp, Homo sapiens
gcattaggaattagt

SEQ ID NO: 326121 - DNA, 15 bp, Homo sapiens
cattaggaattagtc

SEQ ID NO: 326122 - DNA, 15 bp, Homo sapiens
attaggaattagtct

SEQ ID NO: 326123 - DNA, 15 bp, Homo sapiens
ttaggaattagtctg

SEQ ID NO: 326124 - DNA, 15 bp, Homo sapiens
taggaattagtctgg

SEQ ID NO: 326125 - DNA, 15 bp, Homo sapiens
aggaattagtctgga

SEQ ID NO: 326126 - DNA, 15 bp, Homo sapiens
ggaattagtctggag

SEQ ID NO: 326127 - DNA, 15 bp, Homo sapiens
gaattagtctggagt

SEQ ID NO: 326128 - DNA, 15 bp, Homo sapiens
aattagtctggagta

SEQ ID NO: 326129 - DNA, 15 bp, Homo sapiens
attagtctggagtat

SEQ ID NO: 326130 - DNA, 15 bp, Homo sapiens
ttagtctggagtatg

SEQ ID NO: 326131 - DNA, 15 bp, Homo sapiens
tagtctggagtatgt

SEQ ID NO: 326132 - DNA, 15 bp, Homo sapiens
agtctggagtatgta

SEQ ID NO: 326133 - DNA, 15 bp, Homo sapiens
gtctggagtatgtag

SEQ ID NO: 326134 - DNA, 15 bp, Homo sapiens
tctggagtatgtagg

SEQ ID NO: 326135 - DNA, 15 bp, Homo sapiens
ctggagtatgtaggt

SEQ ID NO: 326136 - DNA, 15 bp, Homo sapiens
tggagtatgtaggtt

SEQ ID NO: 326137 - DNA, 15 bp, Homo sapiens
ggagtatgtaggttg

SEQ ID NO: 326138 - DNA, 15 bp, Homo sapiens
gagtatgtaggttga

SEQ ID NO: 326139 - DNA, 15 bp, Homo sapiens
agtatgtaggttgaa

SEQ ID NO: 326140 - DNA, 15 bp, Homo sapiens
gtatgtaggttgaaa

SEQ ID NO: 326141 - DNA, 15 bp, Homo sapiens
tatgtaggttgaaaa

SEQ ID NO: 326142 - DNA, 15 bp, Homo sapiens
atgtaggttgaaaaa

SEQ ID NO: 326143 - DNA, 15 bp, Homo sapiens
tgtaggttgaaaaat

SEQ ID NO: 326144 - DNA, 15 bp, Homo sapiens
gtaggttgaaaaata

SEQ ID NO: 326145 - DNA, 15 bp, Homo sapiens
taggttgaaaaatag

SEQ ID NO: 326146 - DNA, 15 bp, Homo sapiens
aggttgaaaaatagg

SEQ ID NO: 326147 - DNA, 15 bp, Homo sapiens
ggttgaaaaataggt

SEQ ID NO: 326148 - DNA, 15 bp, Homo sapiens
gttgaaaaataggtt

SEQ ID NO: 326149 - DNA, 15 bp, Homo sapiens
ttgaaaaataggtta

SEQ ID NO: 326150 - DNA, 15 bp, Homo sapiens
tgaaaaataggttat

SEQ ID NO: 326151 - DNA, 15 bp, Homo sapiens
gaaaaataggttata

SEQ ID NO: 326152 - DNA, 15 bp, Homo sapiens
aaaaataggttataa

SEQ ID NO: 326153 - DNA, 15 bp, Homo sapiens
aaaataggttataaa

SEQ ID NO: 326154 - DNA, 15 bp, Homo sapiens
aaataggttataaaa

SEQ ID NO: 326155 - DNA, 15 bp, Homo sapiens
aataggttataaaat

SEQ ID NO: 326156 - DNA, 15 bp, Homo sapiens
ataggttataaaatt

SEQ ID NO: 326157 - DNA, 15 bp, Homo sapiens
taggttataaaattg

SEQ ID NO: 326158 - DNA, 15 bp, Homo sapiens
aggttataaaattga

SEQ ID NO: 326159 - DNA, 15 bp, Homo sapiens
ggttataaaattgat

SEQ ID NO: 326160 - DNA, 15 bp, Homo sapiens
gttataaaattgatg

SEQ ID NO: 326161 - DNA, 15 bp, Homo sapiens
ttataaaattgatga

SEQ ID NO: 326162 - DNA, 15 bp, Homo sapiens
tataaaattgatgag

SEQ ID NO: 326163 - DNA, 15 bp, Homo sapiens
ataaaattgatgaga

SEQ ID NO: 326164 - DNA, 15 bp, Homo sapiens
taaaattgatgagaa

SEQ ID NO: 326165 - DNA, 15 bp, Homo sapiens
aaaattgatgagaac

SEQ ID NO: 326166 - DNA, 15 bp, Homo sapiens
aaattgatgagaaca

SEQ ID NO: 326167 - DNA, 15 bp, Homo sapiens
aattgatgagaacaa

SEQ ID NO: 326168 - DNA, 15 bp, Homo sapiens
attgatgagaacaag

SEQ ID NO: 326169 - DNA, 15 bp, Homo sapiens
ttgatgagaacaagc

SEQ ID NO: 326170 - DNA, 15 bp, Homo sapiens
tgatgagaacaagct

SEQ ID NO: 326171 - DNA, 15 bp, Homo sapiens
gatgagaacaagctc

SEQ ID NO: 326172 - DNA, 15 bp, Homo sapiens
atgagaacaagctct

SEQ ID NO: 326173 - DNA, 15 bp, Homo sapiens
tgagaacaagctctc

SEQ ID NO: 326174 - DNA, 15 bp, Homo sapiens
gagaacaagctctct

SEQ ID NO: 326175 - DNA, 15 bp, Homo sapiens
agaacaagctctctt

SEQ ID NO: 326176 - DNA, 15 bp, Homo sapiens
gaacaagctctcttg

SEQ ID NO: 326177 - DNA, 15 bp, Homo sapiens
aacaagctctcttgc

SEQ ID NO: 326178 - DNA, 15 bp, Homo sapiens
acaagctctcttgca

SEQ ID NO: 326179 - DNA, 15 bp, Homo sapiens
gctctcttgcaagag

SEQ ID NO: 326180 - DNA, 15 bp, Homo sapiens
ctctcttgcaagagt

SEQ ID NO: 326181 - DNA, 15 bp, Homo sapiens
tctcttgcaagagtt

SEQ ID NO: 326182 - DNA, 15 bp, Homo sapiens
ctcttgcaagagtta

SEQ ID NO: 326183 - DNA, 15 bp, Homo sapiens
tcttgcaagagttag

SEQ ID NO: 326184 - DNA, 15 bp, Homo sapiens
cttgcaagagttaga

SEQ ID NO: 326185 - DNA, 15 bp, Homo sapiens
ttgcaagagttagaa

SEQ ID NO: 326186 - DNA, 15 bp, Homo sapiens
tgcaagagttagaaa

SEQ ID NO: 326187 - DNA, 15 bp, Homo sapiens
gcaagagttagaaac

SEQ ID NO: 326188 - DNA, 15 bp, Homo sapiens
caagagttagaaaca

SEQ ID NO: 326189 - DNA, 15 bp, Homo sapiens
aagagttagaaacat

SEQ ID NO: 326190 - DNA, 15 bp, Homo sapiens
agagttagaaacata

SEQ ID NO: 326191 - DNA, 15 bp, Homo sapiens
gagttagaaacataa

SEQ ID NO: 326192 - DNA, 15 bp, Homo sapiens
agttagaaacataaa

SEQ ID NO: 326193 - DNA, 15 bp, Homo sapiens
gttagaaacataaaa

SEQ ID NO: 326194 - DNA, 15 bp, Homo sapiens
ttagaaacataaaaa

SEQ ID NO: 326195 - DNA, 15 bp, Homo sapiens
tagaaacataaaaac

SEQ ID NO: 326196 - DNA, 15 bp, Homo sapiens
agaaacataaaaaca

SEQ ID NO: 326197 - DNA, 15 bp, Homo sapiens
gaaacataaaaacaa

SEQ ID NO: 326198 - DNA, 15 bp, Homo sapiens
aaacataaaaacaaa

SEQ ID NO: 326199 - DNA, 15 bp, Homo sapiens
aacataaaaacaaat

SEQ ID NO: 326200 - DNA, 15 bp, Homo sapiens
acataaaaacaaatt

SEQ ID NO: 326201 - DNA, 15 bp, Homo sapiens
cataaaaacaaattt

SEQ ID NO: 326202 - DNA, 15 bp, Homo sapiens
ataaaaacaaatttt

SEQ ID NO: 326203 - DNA, 15 bp, Homo sapiens
taaaaacaaattttt

SEQ ID NO: 326204 - DNA, 15 bp, Homo sapiens
aaaaacaaatttttc

SEQ ID NO: 326205 - DNA, 15 bp, Homo sapiens
aaaacaaatttttct

SEQ ID NO: 326206 - DNA, 15 bp, Homo sapiens
aaacaaatttttcta

SEQ ID NO: 326207 - DNA, 15 bp, Homo sapiens
aacaaatttttctaa

SEQ ID NO: 326208 - DNA, 15 bp, Homo sapiens
acaaatttttctaaa

SEQ ID NO: 326209 - DNA, 15 bp, Homo sapiens
caaatttttctaaag

SEQ ID NO: 326210 - DNA, 15 bp, Homo sapiens
aaatttttctaaagc

SEQ ID NO: 326211 - DNA, 15 bp, Homo sapiens
aatttttctaaagct

SEQ ID NO: 326212 - DNA, 15 bp, Homo sapiens
atttttctaaagcta

SEQ ID NO: 326213 - DNA, 15 bp, Homo sapiens
tttttctaaagctaa

SEQ ID NO: 326214 - DNA, 15 bp, Homo sapiens
ttttctaaagctaaa

SEQ ID NO: 326215 - DNA, 15 bp, Homo sapiens
tttctaaagctaaat

SEQ ID NO: 326216 - DNA, 15 bp, Homo sapiens
ttctaaagctaaatt

SEQ ID NO: 326217 - DNA, 15 bp, Homo sapiens
tctaaagctaaattc

SEQ ID NO: 326218 - DNA, 15 bp, Homo sapiens
ctaaagctaaattcc

SEQ ID NO: 326219 - DNA, 15 bp, Homo sapiens
taaagctaaattcct

SEQ ID NO: 326220 - DNA, 15 bp, Homo sapiens
aaagctaaattcctt

SEQ ID NO: 326221 - DNA, 15 bp, Homo sapiens
aagctaaattcctta

SEQ ID NO: 326222 - DNA, 15 bp, Homo sapiens
agctaaattccttaa

SEQ ID NO: 326223 - DNA, 15 bp, Homo sapiens
gctaaattccttaac

SEQ ID NO: 326224 - DNA, 15 bp, Homo sapiens
ctaaattccttaaca

SEQ ID NO: 326225 - DNA, 15 bp, Homo sapiens
taaattccttaacat

SEQ ID NO: 326226 - DNA, 15 bp, Homo sapiens
aaattccttaacatt

SEQ ID NO: 326227 - DNA, 15 bp, Homo sapiens
aattccttaacattt

SEQ ID NO: 326228 - DNA, 15 bp, Homo sapiens
attccttaacatttt

SEQ ID NO: 326229 - DNA, 15 bp, Homo sapiens
ttccttaacattttt

SEQ ID NO: 326230 - DNA, 15 bp, Homo sapiens
tccttaacatttttc

SEQ ID NO: 326231 - DNA, 15 bp, Homo sapiens
ccttaacatttttcc

SEQ ID NO: 326232 - DNA, 15 bp, Homo sapiens
cttaacatttttcct

SEQ ID NO: 326233 - DNA, 15 bp, Homo sapiens
ttaacatttttcctc

SEQ ID NO: 326234 - DNA, 15 bp, Homo sapiens
taacatttttcctca

SEQ ID NO: 326235 - DNA, 15 bp, Homo sapiens
aacatttttcctcac

SEQ ID NO: 326236 - DNA, 15 bp, Homo sapiens
acatttttcctcact

SEQ ID NO: 326237 - DNA, 15 bp, Homo sapiens
catttttcctcactc

SEQ ID NO: 326238 - DNA, 15 bp, Homo sapiens
atttttcctcactca

SEQ ID NO: 326239 - DNA, 15 bp, Homo sapiens
tttttcctcactcag

SEQ ID NO: 326240 - DNA, 15 bp, Homo sapiens
ttttcctcactcaga

SEQ ID NO: 326241 - DNA, 15 bp, Homo sapiens
tttcctcactcagat

SEQ ID NO: 326242 - DNA, 15 bp, Homo sapiens
ttcctcactcagatt

SEQ ID NO: 326243 - DNA, 15 bp, Homo sapiens
tcctcactcagattt

SEQ ID NO: 326244 - DNA, 15 bp, Homo sapiens
cctcactcagatttc

SEQ ID NO: 326245 - DNA, 15 bp, Homo sapiens
ctcactcagatttct

SEQ ID NO: 326246 - DNA, 15 bp, Homo sapiens
tcactcagatttcta

SEQ ID NO: 326247 - DNA, 15 bp, Homo sapiens
cactcagatttctat

SEQ ID NO: 326248 - DNA, 15 bp, Homo sapiens
actcagatttctatt

SEQ ID NO: 326249 - DNA, 15 bp, Homo sapiens
ctcagatttctattt

SEQ ID NO: 326250 - DNA, 15 bp, Homo sapiens
tcagatttctatttg

SEQ ID NO: 326251 - DNA, 15 bp, Homo sapiens
cagatttctatttgg

SEQ ID NO: 326252 - DNA, 15 bp, Homo sapiens
agatttctatttggc

SEQ ID NO: 326253 - DNA, 15 bp, Homo sapiens
gatttctatttggct

SEQ ID NO: 326254 - DNA, 15 bp, Homo sapiens
atttctatttggctt

SEQ ID NO: 326255 - DNA, 15 bp, Homo sapiens
tttctatttggcttg

SEQ ID NO: 326256 - DNA, 15 bp, Homo sapiens
ttctatttggcttga

SEQ ID NO: 326257 - DNA, 15 bp, Homo sapiens
tctatttggcttgaa

SEQ ID NO: 326258 - DNA, 15 bp, Homo sapiens
ctatttggcttgaat

SEQ ID NO: 326259 - DNA, 15 bp, Homo sapiens
tatttggcttgaatc

SEQ ID NO: 326260 - DNA, 15 bp, Homo sapiens
atttggcttgaatct

SEQ ID NO: 326261 - DNA, 15 bp, Homo sapiens
tttggcttgaatcta

SEQ ID NO: 326262 - DNA, 15 bp, Homo sapiens
ttggcttgaatctaa

SEQ ID NO: 326263 - DNA, 15 bp, Homo sapiens
tggcttgaatctaag

SEQ ID NO: 326264 - DNA, 15 bp, Homo sapiens
ggcttgaatctaagg

SEQ ID NO: 326265 - DNA, 15 bp, Homo sapiens
gcttgaatctaagga

SEQ ID NO: 326266 - DNA, 15 bp, Homo sapiens
cttgaatctaaggaa

SEQ ID NO: 326267 - DNA, 15 bp, Homo sapiens
ttgaatctaaggaaa

SEQ ID NO: 326268 - DNA, 15 bp, Homo sapiens
tgaatctaaggaaaa

SEQ ID NO: 326269 - DNA, 15 bp, Homo sapiens
gaatctaaggaaaac

SEQ ID NO: 326270 - DNA, 15 bp, Homo sapiens
aatctaaggaaaacc

SEQ ID NO: 326271 - DNA, 15 bp, Homo sapiens
atctaaggaaaacct

SEQ ID NO: 326272 - DNA, 15 bp, Homo sapiens
tctaaggaaaacctg

SEQ ID NO: 326273 - DNA, 15 bp, Homo sapiens
ctaaggaaaacctga

SEQ ID NO: 326274 - DNA, 15 bp, Homo sapiens
taaggaaaacctgag

SEQ ID NO: 326275 - DNA, 15 bp, Homo sapiens
aaggaaaacctgaga

SEQ ID NO: 326276 - DNA, 15 bp, Homo sapiens
aggaaaacctgagaa

SEQ ID NO: 326277 - DNA, 15 bp, Homo sapiens
ggaaaacctgagaag

SEQ ID NO: 326278 - DNA, 15 bp, Homo sapiens
gaaaacctgagaaga

SEQ ID NO: 326279 - DNA, 15 bp, Homo sapiens
aaaacctgagaagag

SEQ ID NO: 326280 - DNA, 15 bp, Homo sapiens
aaacctgagaagaga

SEQ ID NO: 326281 - DNA, 15 bp, Homo sapiens
aacctgagaagagag

SEQ ID NO: 326282 - DNA, 15 bp, Homo sapiens
acctgagaagagagg

SEQ ID NO: 326283 - DNA, 15 bp, Homo sapiens
cctgagaagagagga

SEQ ID NO: 326284 - DNA, 15 bp, Homo sapiens
ctgagaagagaggaa

SEQ ID NO: 326285 - DNA, 15 bp, Homo sapiens
tgagaagagaggaag

SEQ ID NO: 326286 - DNA, 15 bp, Homo sapiens
gagaagagaggaagt

SEQ ID NO: 326287 - DNA, 15 bp, Homo sapiens
agaagagaggaagtg

SEQ ID NO: 326288 - DNA, 15 bp, Homo sapiens
gaagagaggaagtgc

SEQ ID NO: 326289 - DNA, 15 bp, Homo sapiens
aagagaggaagtgct

SEQ ID NO: 326290 - DNA, 15 bp, Homo sapiens
agagaggaagtgctt

SEQ ID NO: 326291 - DNA, 15 bp, Homo sapiens
gagaggaagtgcttg

SEQ ID NO: 326292 - DNA, 15 bp, Homo sapiens
agaggaagtgcttgg

SEQ ID NO: 326293 - DNA, 15 bp, Homo sapiens
gaggaagtgcttggc

SEQ ID NO: 326294 - DNA, 15 bp, Homo sapiens
aggaagtgcttggct

SEQ ID NO: 326295 - DNA, 15 bp, Homo sapiens
ggaagtgcttggctt

SEQ ID NO: 326296 - DNA, 15 bp, Homo sapiens
gaagtgcttggcttc

SEQ ID NO: 326297 - DNA, 15 bp, Homo sapiens
aagtgcttggcttct

SEQ ID NO: 326298 - DNA, 15 bp, Homo sapiens
agtgcttggcttctc

SEQ ID NO: 326299 - DNA, 15 bp, Homo sapiens
gtgcttggcttctct

SEQ ID NO: 326300 - DNA, 15 bp, Homo sapiens
tgcttggcttctctg

SEQ ID NO: 326301 - DNA, 15 bp, Homo sapiens
gcttggcttctctgt

SEQ ID NO: 326302 - DNA, 15 bp, Homo sapiens
cttggcttctctgta

SEQ ID NO: 326303 - DNA, 15 bp, Homo sapiens
ttggcttctctgtat

SEQ ID NO: 326304 - DNA, 15 bp, Homo sapiens
tggcttctctgtata

SEQ ID NO: 326305 - DNA, 15 bp, Homo sapiens
ggcttctctgtatac

SEQ ID NO: 326306 - DNA, 15 bp, Homo sapiens
gcttctctgtatacc

SEQ ID NO: 326307 - DNA, 15 bp, Homo sapiens
cttctctgtatacca

SEQ ID NO: 326308 - DNA, 15 bp, Homo sapiens
ttctctgtataccaa

SEQ ID NO: 326309 - DNA, 15 bp, Homo sapiens
tctctgtataccaag

SEQ ID NO: 326310 - DNA, 15 bp, Homo sapiens
ctctgtataccaagc

SEQ ID NO: 326311 - DNA, 15 bp, Homo sapiens
tctgtataccaagca

SEQ ID NO: 326312 - DNA, 15 bp, Homo sapiens
ctgtataccaagcag

SEQ ID NO: 326313 - DNA, 15 bp, Homo sapiens
tgtataccaagcagt

SEQ ID NO: 326314 - DNA, 15 bp, Homo sapiens
gtataccaagcagtt

SEQ ID NO: 326315 - DNA, 15 bp, Homo sapiens
tataccaagcagttt

SEQ ID NO: 326316 - DNA, 15 bp, Homo sapiens
ataccaagcagtttc

SEQ ID NO: 326317 - DNA, 15 bp, Homo sapiens
taccaagcagtttca

SEQ ID NO: 326318 - DNA, 15 bp, Homo sapiens
accaagcagtttcaa

SEQ ID NO: 326319 - DNA, 15 bp, Homo sapiens
ccaagcagtttcaac

SEQ ID NO: 326320 - DNA, 15 bp, Homo sapiens
caagcagtttcaaca

SEQ ID NO: 326321 - DNA, 15 bp, Homo sapiens
aagcagtttcaacag

SEQ ID NO: 326322 - DNA, 15 bp, Homo sapiens
agcagtttcaacagt

SEQ ID NO: 326323 - DNA, 15 bp, Homo sapiens
gcagtttcaacagtg

SEQ ID NO: 326324 - DNA, 15 bp, Homo sapiens
cagtttcaacagtgg

SEQ ID NO: 326325 - DNA, 15 bp, Homo sapiens
agtttcaacagtggt

SEQ ID NO: 326326 - DNA, 15 bp, Homo sapiens
gtttcaacagtggtg

SEQ ID NO: 326327 - DNA, 15 bp, Homo sapiens
tttcaacagtggtgt

SEQ ID NO: 326328 - DNA, 15 bp, Homo sapiens
ttcaacagtggtgtt

SEQ ID NO: 326329 - DNA, 15 bp, Homo sapiens
tcaacagtggtgttt

SEQ ID NO: 326330 - DNA, 15 bp, Homo sapiens
caacagtggtgtttg

SEQ ID NO: 326331 - DNA, 15 bp, Homo sapiens
aacagtggtgtttgt

SEQ ID NO: 326332 - DNA, 15 bp, Homo sapiens
acagtggtgtttgta

SEQ ID NO: 326333 - DNA, 15 bp, Homo sapiens
cagtggtgtttgtag

SEQ ID NO: 326334 - DNA, 15 bp, Homo sapiens
agtggtgtttgtaga

SEQ ID NO: 326335 - DNA, 15 bp, Homo sapiens
gtggtgtttgtagaa

SEQ ID NO: 326336 - DNA, 15 bp, Homo sapiens
tggtgtttgtagaaa

SEQ ID NO: 326337 - DNA, 15 bp, Homo sapiens
ggtgtttgtagaaat

SEQ ID NO: 326338 - DNA, 15 bp, Homo sapiens
gtgtttgtagaaatg

SEQ ID NO: 326339 - DNA, 15 bp, Homo sapiens
tgtttgtagaaatgc

SEQ ID NO: 326340 - DNA, 15 bp, Homo sapiens
gtttgtagaaatgca

SEQ ID NO: 326341 - DNA, 15 bp, Homo sapiens
tttgtagaaatgcat

SEQ ID NO: 326342 - DNA, 15 bp, Homo sapiens
ttgtagaaatgcata

SEQ ID NO: 326343 - DNA, 15 bp, Homo sapiens
tgtagaaatgcatac

SEQ ID NO: 326344 - DNA, 15 bp, Homo sapiens
gtagaaatgcatacc

SEQ ID NO: 326345 - DNA, 15 bp, Homo sapiens
tagaaatgcatacct

SEQ ID NO: 326346 - DNA, 15 bp, Homo sapiens
agaaatgcatacctt

SEQ ID NO: 326347 - DNA, 15 bp, Homo sapiens
gaaatgcataccttg

SEQ ID NO: 326348 - DNA, 15 bp, Homo sapiens
aaatgcataccttgc

SEQ ID NO: 326349 - DNA, 15 bp, Homo sapiens
aatgcataccttgct

SEQ ID NO: 326350 - DNA, 15 bp, Homo sapiens
atgcataccttgctg

SEQ ID NO: 326351 - DNA, 15 bp, Homo sapiens
tgcataccttgctgt

SEQ ID NO: 326352 - DNA, 15 bp, Homo sapiens
gcataccttgctgtt

SEQ ID NO: 326353 - DNA, 15 bp, Homo sapiens
cataccttgctgttc

SEQ ID NO: 326354 - DNA, 15 bp, Homo sapiens
ataccttgctgttcc

SEQ ID NO: 326355 - DNA, 15 bp, Homo sapiens
taccttgctgttcct

SEQ ID NO: 326356 - DNA, 15 bp, Homo sapiens
accttgctgttccta

SEQ ID NO: 326357 - DNA, 15 bp, Homo sapiens
ccttgctgttcctag

SEQ ID NO: 326358 - DNA, 15 bp, Homo sapiens
cttgctgttcctagg

SEQ ID NO: 326359 - DNA, 15 bp, Homo sapiens
ttgctgttcctaggc

SEQ ID NO: 326360 - DNA, 15 bp, Homo sapiens
tgctgttcctaggca

SEQ ID NO: 326361 - DNA, 15 bp, Homo sapiens
gctgttcctaggcag

SEQ ID NO: 326362 - DNA, 15 bp, Homo sapiens
ctgttcctaggcaga

SEQ ID NO: 326363 - DNA, 15 bp, Homo sapiens
tgttcctaggcagat

SEQ ID NO: 326364 - DNA, 15 bp, Homo sapiens
gttcctaggcagata

SEQ ID NO: 326365 - DNA, 15 bp, Homo sapiens
ttcctaggcagataa

SEQ ID NO: 326366 - DNA, 15 bp, Homo sapiens
tcctaggcagataag

SEQ ID NO: 326367 - DNA, 15 bp, Homo sapiens
cctaggcagataagt

SEQ ID NO: 326368 - DNA, 15 bp, Homo sapiens
ctaggcagataagtg

SEQ ID NO: 326369 - DNA, 15 bp, Homo sapiens
taggcagataagtgt

SEQ ID NO: 326370 - DNA, 15 bp, Homo sapiens
aggcagataagtgtt

SEQ ID NO: 326371 - DNA, 15 bp, Homo sapiens
ggcagataagtgttg

SEQ ID NO: 326372 - DNA, 15 bp, Homo sapiens
gcagataagtgttgt

SEQ ID NO: 326373 - DNA, 15 bp, Homo sapiens
cagataagtgttgtc

SEQ ID NO: 326374 - DNA, 15 bp, Homo sapiens
agataagtgttgtca

SEQ ID NO: 326375 - DNA, 15 bp, Homo sapiens
gataagtgttgtcac

SEQ ID NO: 326376 - DNA, 15 bp, Homo sapiens
ataagtgttgtcaca

SEQ ID NO: 326377 - DNA, 15 bp, Homo sapiens
taagtgttgtcacac

SEQ ID NO: 326378 - DNA, 15 bp, Homo sapiens
aagtgttgtcacacg

SEQ ID NO: 326379 - DNA, 15 bp, Homo sapiens
agtgttgtcacacgt

SEQ ID NO: 326380 - DNA, 15 bp, Homo sapiens
gtgttgtcacacgtc

SEQ ID NO: 326381 - DNA, 15 bp, Homo sapiens
tgttgtcacacgtct

SEQ ID NO: 326382 - DNA, 15 bp, Homo sapiens
gttgtcacacgtctt

SEQ ID NO: 326383 - DNA, 15 bp, Homo sapiens
ttgtcacacgtcttc

SEQ ID NO: 326384 - DNA, 15 bp, Homo sapiens
tgtcacacgtcttca

SEQ ID NO: 326385 - DNA, 15 bp, Homo sapiens
gtcacacgtcttcag

SEQ ID NO: 326386 - DNA, 15 bp, Homo sapiens
tcacacgtcttcaga

SEQ ID NO: 326387 - DNA, 15 bp, Homo sapiens
cacacgtcttcagat

SEQ ID NO: 326388 - DNA, 15 bp, Homo sapiens
acacgtcttcagatt

SEQ ID NO: 326389 - DNA, 15 bp, Homo sapiens
cacgtcttcagattt

SEQ ID NO: 326390 - DNA, 15 bp, Homo sapiens
acgtcttcagatttt

SEQ ID NO: 326391 - DNA, 15 bp, Homo sapiens
cgtcttcagatttta

SEQ ID NO: 326392 - DNA, 15 bp, Homo sapiens
gtcttcagattttaa

SEQ ID NO: 326393 - DNA, 15 bp, Homo sapiens
tcttcagattttaag

SEQ ID NO: 326394 - DNA, 15 bp, Homo sapiens
cttcagattttaagg

SEQ ID NO: 326395 - DNA, 15 bp, Homo sapiens
ttcagattttaaggc

SEQ ID NO: 326396 - DNA, 15 bp, Homo sapiens
tcagattttaaggcg

SEQ ID NO: 326397 - DNA, 15 bp, Homo sapiens
cagattttaaggcga

SEQ ID NO: 326398 - DNA, 15 bp, Homo sapiens
agattttaaggcgac

SEQ ID NO: 326399 - DNA, 15 bp, Homo sapiens
gattttaaggcgaca

SEQ ID NO: 326400 - DNA, 15 bp, Homo sapiens
attttaaggcgacag

SEQ ID NO: 326401 - DNA, 15 bp, Homo sapiens
ttttaaggcgacagg

SEQ ID NO: 326402 - DNA, 15 bp, Homo sapiens
tttaaggcgacaggc

SEQ ID NO: 326403 - DNA, 15 bp, Homo sapiens
ttaaggcgacaggct

SEQ ID NO: 326404 - DNA, 15 bp, Homo sapiens
taaggcgacaggctc

SEQ ID NO: 326405 - DNA, 15 bp, Homo sapiens
aaggcgacaggctcc

SEQ ID NO: 326406 - DNA, 15 bp, Homo sapiens
aggcgacaggctcca

SEQ ID NO: 326407 - DNA, 15 bp, Homo sapiens
ggcgacaggctccac

SEQ ID NO: 326408 - DNA, 15 bp, Homo sapiens
gcgacaggctccaca

SEQ ID NO: 326409 - DNA, 15 bp, Homo sapiens
cgacaggctccacac

SEQ ID NO: 326410 - DNA, 15 bp, Homo sapiens
gacaggctccacacc

SEQ ID NO: 326411 - DNA, 15 bp, Homo sapiens
acaggctccacacct

SEQ ID NO: 326412 - DNA, 15 bp, Homo sapiens
caggctccacacctg

SEQ ID NO: 326413 - DNA, 15 bp, Homo sapiens
aggctccacacctgg

SEQ ID NO: 326414 - DNA, 15 bp, Homo sapiens
ggctccacacctggc

SEQ ID NO: 326415 - DNA, 15 bp, Homo sapiens
gctccacacctggca

SEQ ID NO: 326416 - DNA, 15 bp, Homo sapiens
ctccacacctggcag

SEQ ID NO: 326417 - DNA, 15 bp, Homo sapiens
tccacacctggcaga

SEQ ID NO: 326418 - DNA, 15 bp, Homo sapiens
ccacacctggcagag

SEQ ID NO: 326419 - DNA, 15 bp, Homo sapiens
cacacctggcagagg

SEQ ID NO: 326420 - DNA, 15 bp, Homo sapiens
acacctggcagaggc

SEQ ID NO: 326421 - DNA, 15 bp, Homo sapiens
cacctggcagaggct

SEQ ID NO: 326422 - DNA, 15 bp, Homo sapiens
acctggcagaggctc

SEQ ID NO: 326423 - DNA, 15 bp, Homo sapiens
cctggcagaggctca

SEQ ID NO: 326424 - DNA, 15 bp, Homo sapiens
ctggcagaggctcag

SEQ ID NO: 326425 - DNA, 15 bp, Homo sapiens
tggcagaggctcaga

SEQ ID NO: 326426 - DNA, 15 bp, Homo sapiens
ggcagaggctcagac

SEQ ID NO: 326427 - DNA, 15 bp, Homo sapiens
gcagaggctcagaca

SEQ ID NO: 326428 - DNA, 15 bp, Homo sapiens
cagaggctcagacag

SEQ ID NO: 326429 - DNA, 15 bp, Homo sapiens
agaggctcagacaga

SEQ ID NO: 326430 - DNA, 15 bp, Homo sapiens
gaggctcagacagag

SEQ ID NO: 326431 - DNA, 15 bp, Homo sapiens
aggctcagacagagc

SEQ ID NO: 326432 - DNA, 15 bp, Homo sapiens
ggctcagacagagca

SEQ ID NO: 326433 - DNA, 15 bp, Homo sapiens
gctcagacagagcag

SEQ ID NO: 326434 - DNA, 15 bp, Homo sapiens
ctcagacagagcaga

SEQ ID NO: 326435 - DNA, 15 bp, Homo sapiens
tcagacagagcagac

SEQ ID NO: 326436 - DNA, 15 bp, Homo sapiens
cagacagagcagacc

SEQ ID NO: 326437 - DNA, 15 bp, Homo sapiens
agacagagcagacca

SEQ ID NO: 326438 - DNA, 15 bp, Homo sapiens
gacagagcagaccag

SEQ ID NO: 326439 - DNA, 15 bp, Homo sapiens
acagagcagaccagg

SEQ ID NO: 326440 - DNA, 15 bp, Homo sapiens
cagagcagaccagga

SEQ ID NO: 326441 - DNA, 15 bp, Homo sapiens
agagcagaccaggat

SEQ ID NO: 326442 - DNA, 15 bp, Homo sapiens
gagcagaccaggatt

SEQ ID NO: 326443 - DNA, 15 bp, Homo sapiens
agcagaccaggattg

SEQ ID NO: 326444 - DNA, 15 bp, Homo sapiens
gcagaccaggattgg

SEQ ID NO: 326445 - DNA, 15 bp, Homo sapiens
cagaccaggattggg

SEQ ID NO: 326446 - DNA, 15 bp, Homo sapiens
agaccaggattgggc

SEQ ID NO: 326447 - DNA, 15 bp, Homo sapiens
gaccaggattgggct

SEQ ID NO: 326448 - DNA, 15 bp, Homo sapiens
accaggattgggcta

SEQ ID NO: 326449 - DNA, 15 bp, Homo sapiens
ccaggattgggctat

SEQ ID NO: 326450 - DNA, 15 bp, Homo sapiens
caggattgggctatt

SEQ ID NO: 326451 - DNA, 15 bp, Homo sapiens
aggattgggctattc

SEQ ID NO: 326452 - DNA, 15 bp, Homo sapiens
ggattgggctattca

SEQ ID NO: 326453 - DNA, 15 bp, Homo sapiens
gattgggctattcac

SEQ ID NO: 326454 - DNA, 15 bp, Homo sapiens
attgggctattcaca

SEQ ID NO: 326455 - DNA, 15 bp, Homo sapiens
ttgggctattcacag

SEQ ID NO: 326456 - DNA, 15 bp, Homo sapiens
tgggctattcacaga

SEQ ID NO: 326457 - DNA, 15 bp, Homo sapiens
gggctattcacagag

SEQ ID NO: 326458 - DNA, 15 bp, Homo sapiens
ggctattcacagagg

SEQ ID NO: 326459 - DNA, 15 bp, Homo sapiens
gctattcacagaggc

SEQ ID NO: 326460 - DNA, 15 bp, Homo sapiens
ctattcacagaggca

SEQ ID NO: 326461 - DNA, 15 bp, Homo sapiens
tattcacagaggcag

SEQ ID NO: 326462 - DNA, 15 bp, Homo sapiens
attcacagaggcagg

SEQ ID NO: 326463 - DNA, 15 bp, Homo sapiens
ttcacagaggcagga

SEQ ID NO: 326464 - DNA, 15 bp, Homo sapiens
tcacagaggcaggaa

SEQ ID NO: 326465 - DNA, 15 bp, Homo sapiens
cacagaggcaggaat

SEQ ID NO: 326466 - DNA, 15 bp, Homo sapiens
acagaggcaggaatg

SEQ ID NO: 326467 - DNA, 15 bp, Homo sapiens
cagaggcaggaatgt

SEQ ID NO: 326468 - DNA, 15 bp, Homo sapiens
agaggcaggaatgtg

SEQ ID NO: 326469 - DNA, 15 bp, Homo sapiens
gaggcaggaatgtga

SEQ ID NO: 326470 - DNA, 15 bp, Homo sapiens
aggcaggaatgtgac

SEQ ID NO: 326471 - DNA, 15 bp, Homo sapiens
ggcaggaatgtgacc

SEQ ID NO: 326472 - DNA, 15 bp, Homo sapiens
gcaggaatgtgacca

SEQ ID NO: 326473 - DNA, 15 bp, Homo sapiens
caggaatgtgaccat

SEQ ID NO: 326474 - DNA, 15 bp, Homo sapiens
aggaatgtgaccatt

SEQ ID NO: 326475 - DNA, 15 bp, Homo sapiens
ggaatgtgaccattc

SEQ ID NO: 326476 - DNA, 15 bp, Homo sapiens
gaatgtgaccattct

SEQ ID NO: 326477 - DNA, 15 bp, Homo sapiens
aatgtgaccattctg

SEQ ID NO: 326478 - DNA, 15 bp, Homo sapiens
atgtgaccattctgg

SEQ ID NO: 326479 - DNA, 15 bp, Homo sapiens
tgtgaccattctggt

SEQ ID NO: 326480 - DNA, 15 bp, Homo sapiens
gtgaccattctggtc

SEQ ID NO: 326481 - DNA, 15 bp, Homo sapiens
tgaccattctggtcc

SEQ ID NO: 326482 - DNA, 15 bp, Homo sapiens
gaccattctggtccg

SEQ ID NO: 326483 - DNA, 15 bp, Homo sapiens
accattctggtccgg

SEQ ID NO: 326484 - DNA, 15 bp, Homo sapiens
ccattctggtccggg

SEQ ID NO: 326485 - DNA, 15 bp, Homo sapiens
cattctggtccgggc

SEQ ID NO: 326486 - DNA, 15 bp, Homo sapiens
attctggtccgggca

SEQ ID NO: 326487 - DNA, 15 bp, Homo sapiens
ttctggtccgggcag

SEQ ID NO: 326488 - DNA, 15 bp, Homo sapiens
tctggtccgggcagt

SEQ ID NO: 326489 - DNA, 15 bp, Homo sapiens
ctggtccgggcagtt

SEQ ID NO: 326490 - DNA, 15 bp, Homo sapiens
tggtccgggcagttg

SEQ ID NO: 326491 - DNA, 15 bp, Homo sapiens
ggtccgggcagttgg

SEQ ID NO: 326492 - DNA, 15 bp, Homo sapiens
gtccgggcagttggg

SEQ ID NO: 326493 - DNA, 15 bp, Homo sapiens
tccgggcagttgggg

SEQ ID NO: 326494 - DNA, 15 bp, Homo sapiens
ccgggcagttgggga

SEQ ID NO: 326495 - DNA, 15 bp, Homo sapiens
cgggcagttggggag

SEQ ID NO: 326496 - DNA, 15 bp, Homo sapiens
gggcagttggggagg

SEQ ID NO: 326497 - DNA, 15 bp, Homo sapiens
ggcagttggggagga

SEQ ID NO: 326498 - DNA, 15 bp, Homo sapiens
gcagttggggaggaa

SEQ ID NO: 326499 - DNA, 15 bp, Homo sapiens
cagttggggaggaac

SEQ ID NO: 326500 - DNA, 15 bp, Homo sapiens
agttggggaggaact

SEQ ID NO: 326501 - DNA, 15 bp, Homo sapiens
gttggggaggaactc

SEQ ID NO: 326502 - DNA, 15 bp, Homo sapiens
ttggggaggaactca

SEQ ID NO: 326503 - DNA, 15 bp, Homo sapiens
tggggaggaactcat

SEQ ID NO: 326504 - DNA, 15 bp, Homo sapiens
ggggaggaactcatc

SEQ ID NO: 326505 - DNA, 15 bp, Homo sapiens
gggaggaactcatct

SEQ ID NO: 326506 - DNA, 15 bp, Homo sapiens
ggaggaactcatcta

SEQ ID NO: 326507 - DNA, 15 bp, Homo sapiens
gaggaactcatctat

SEQ ID NO: 326508 - DNA, 15 bp, Homo sapiens
aggaactcatctatc

SEQ ID NO: 326509 - DNA, 15 bp, Homo sapiens
ggaactcatctatcc

SEQ ID NO: 326510 - DNA, 15 bp, Homo sapiens
gaactcatctatcca

SEQ ID NO: 326511 - DNA, 15 bp, Homo sapiens
aactcatctatccac

SEQ ID NO: 326512 - DNA, 15 bp, Homo sapiens
actcatctatccacg

SEQ ID NO: 326513 - DNA, 15 bp, Homo sapiens
ctcatctatccacgg

SEQ ID NO: 326514 - DNA, 15 bp, Homo sapiens
tcatctatccacggt

SEQ ID NO: 326515 - DNA, 15 bp, Homo sapiens
catctatccacggtt

SEQ ID NO: 326516 - DNA, 15 bp, Homo sapiens
atctatccacggttc

SEQ ID NO: 326517 - DNA, 15 bp, Homo sapiens
tctatccacggttcc

SEQ ID NO: 326518 - DNA, 15 bp, Homo sapiens
ctatccacggttccc

SEQ ID NO: 326519 - DNA, 15 bp, Homo sapiens
tatccacggttccca

SEQ ID NO: 326520 - DNA, 15 bp, Homo sapiens
atccacggttcccat

SEQ ID NO: 326521 - DNA, 15 bp, Homo sapiens
tccacggttcccata

SEQ ID NO: 326522 - DNA, 15 bp, Homo sapiens
ccacggttcccatac

SEQ ID NO: 326523 - DNA, 15 bp, Homo sapiens
cacggttcccatact

SEQ ID NO: 326524 - DNA, 15 bp, Homo sapiens
acggttcccatactg

SEQ ID NO: 326525 - DNA, 15 bp, Homo sapiens
cggttcccatactgt

SEQ ID NO: 326526 - DNA, 15 bp, Homo sapiens
ggttcccatactgtt

SEQ ID NO: 326527 - DNA, 15 bp, Homo sapiens
gttcccatactgttt

SEQ ID NO: 326528 - DNA, 15 bp, Homo sapiens
ttcccatactgtttg

SEQ ID NO: 326529 - DNA, 15 bp, Homo sapiens
tcccatactgtttgg

SEQ ID NO: 326530 - DNA, 15 bp, Homo sapiens
cccatactgtttggc

SEQ ID NO: 326531 - DNA, 15 bp, Homo sapiens
ccatactgtttggcc

SEQ ID NO: 326532 - DNA, 15 bp, Homo sapiens
catactgtttggccc

SEQ ID NO: 326533 - DNA, 15 bp, Homo sapiens
atactgtttggccct

SEQ ID NO: 326534 - DNA, 15 bp, Homo sapiens
tactgtttggccctg

SEQ ID NO: 326535 - DNA, 15 bp, Homo sapiens
actgtttggccctgt

SEQ ID NO: 326536 - DNA, 15 bp, Homo sapiens
ctgtttggccctgtt

SEQ ID NO: 326537 - DNA, 15 bp, Homo sapiens
tgtttggccctgttt

SEQ ID NO: 326538 - DNA, 15 bp, Homo sapiens
gtttggccctgtttt

SEQ ID NO: 326539 - DNA, 15 bp, Homo sapiens
tttggccctgttttt

SEQ ID NO: 326540 - DNA, 15 bp, Homo sapiens
ttggccctgtttttc

SEQ ID NO: 326541 - DNA, 15 bp, Homo sapiens
tggccctgtttttca

SEQ ID NO: 326542 - DNA, 15 bp, Homo sapiens
ggccctgtttttcaa

SEQ ID NO: 326543 - DNA, 15 bp, Homo sapiens
gccctgtttttcaat

SEQ ID NO: 326544 - DNA, 15 bp, Homo sapiens
ccctgtttttcaatt

SEQ ID NO: 326545 - DNA, 15 bp, Homo sapiens
cctgtttttcaattt

SEQ ID NO: 326546 - DNA, 15 bp, Homo sapiens
ctgtttttcaatttg

SEQ ID NO: 326547 - DNA, 15 bp, Homo sapiens
tgtttttcaatttga

SEQ ID NO: 326548 - DNA, 15 bp, Homo sapiens
gtttttcaatttgac

SEQ ID NO: 326549 - DNA, 15 bp, Homo sapiens
tttttcaatttgact

SEQ ID NO: 326550 - DNA, 15 bp, Homo sapiens
ttttcaatttgactc

SEQ ID NO: 326551 - DNA, 15 bp, Homo sapiens
tttcaatttgactcc

SEQ ID NO: 326552 - DNA, 15 bp, Homo sapiens
ttcaatttgactcca

SEQ ID NO: 326553 - DNA, 15 bp, Homo sapiens
tcaatttgactccat

SEQ ID NO: 326554 - DNA, 15 bp, Homo sapiens
caatttgactccatc

SEQ ID NO: 326555 - DNA, 15 bp, Homo sapiens
aatttgactccatca

SEQ ID NO: 326556 - DNA, 15 bp, Homo sapiens
atttgactccatcaa

SEQ ID NO: 326557 - DNA, 15 bp, Homo sapiens
tttgactccatcaaa

SEQ ID NO: 326558 - DNA, 15 bp, Homo sapiens
ttgactccatcaaag

SEQ ID NO: 326559 - DNA, 15 bp, Homo sapiens
tgactccatcaaagc

SEQ ID NO: 326560 - DNA, 15 bp, Homo sapiens
gactccatcaaagca

SEQ ID NO: 326561 - DNA, 15 bp, Homo sapiens
actccatcaaagcac

SEQ ID NO: 326562 - DNA, 15 bp, Homo sapiens
ctccatcaaagcaca

SEQ ID NO: 326563 - DNA, 15 bp, Homo sapiens
tccatcaaagcacat

SEQ ID NO: 326564 - DNA, 15 bp, Homo sapiens
ccatcaaagcacatt

SEQ ID NO: 326565 - DNA, 15 bp, Homo sapiens
catcaaagcacattc

SEQ ID NO: 326566 - DNA, 15 bp, Homo sapiens
atcaaagcacattct

SEQ ID NO: 326567 - DNA, 15 bp, Homo sapiens
tcaaagcacattctc

SEQ ID NO: 326568 - DNA, 15 bp, Homo sapiens
caaagcacattctcc

SEQ ID NO: 326569 - DNA, 15 bp, Homo sapiens
aaagcacattctcca

SEQ ID NO: 326570 - DNA, 15 bp, Homo sapiens
aagcacattctccag

SEQ ID NO: 326571 - DNA, 15 bp, Homo sapiens
agcacattctccagc

SEQ ID NO: 326572 - DNA, 15 bp, Homo sapiens
gcacattctccagcc

SEQ ID NO: 326573 - DNA, 15 bp, Homo sapiens
cacattctccagccg

SEQ ID NO: 326574 - DNA, 15 bp, Homo sapiens
acattctccagccga

SEQ ID NO: 326575 - DNA, 15 bp, Homo sapiens
cattctccagccgag

SEQ ID NO: 326576 - DNA, 15 bp, Homo sapiens
attctccagccgagg

SEQ ID NO: 326577 - DNA, 15 bp, Homo sapiens
ttctccagccgaggg

SEQ ID NO: 326578 - DNA, 15 bp, Homo sapiens
tctccagccgagggg

SEQ ID NO: 326579 - DNA, 15 bp, Homo sapiens
ctccagccgaggggt

SEQ ID NO: 326580 - DNA, 15 bp, Homo sapiens
tccagccgaggggta

SEQ ID NO: 326581 - DNA, 15 bp, Homo sapiens
ccagccgaggggtac

SEQ ID NO: 326582 - DNA, 15 bp, Homo sapiens
cagccgaggggtaca

SEQ ID NO: 326583 - DNA, 15 bp, Homo sapiens
agccgaggggtacac

SEQ ID NO: 326584 - DNA, 15 bp, Homo sapiens
gccgaggggtacaca

SEQ ID NO: 326585 - DNA, 15 bp, Homo sapiens
ccgaggggtacacat

SEQ ID NO: 326586 - DNA, 15 bp, Homo sapiens
cgaggggtacacatc

SEQ ID NO: 326587 - DNA, 15 bp, Homo sapiens
gaggggtacacatcc

SEQ ID NO: 326588 - DNA, 15 bp, Homo sapiens
aggggtacacatccc

SEQ ID NO: 326589 - DNA, 15 bp, Homo sapiens
ggggtacacatccct

SEQ ID NO: 326590 - DNA, 15 bp, Homo sapiens
gggtacacatccctt

SEQ ID NO: 326591 - DNA, 15 bp, Homo sapiens
ggtacacatcccttt

SEQ ID NO: 326592 - DNA, 15 bp, Homo sapiens
gtacacatccctttg

SEQ ID NO: 326593 - DNA, 15 bp, Homo sapiens
tacacatccctttgt

SEQ ID NO: 326594 - DNA, 15 bp, Homo sapiens
acacatccctttgtg

SEQ ID NO: 326595 - DNA, 15 bp, Homo sapiens
cacatccctttgtga

SEQ ID NO: 326596 - DNA, 15 bp, Homo sapiens
acatccctttgtgac

SEQ ID NO: 326597 - DNA, 15 bp, Homo sapiens
catccctttgtgact

SEQ ID NO: 326598 - DNA, 15 bp, Homo sapiens
atccctttgtgactt

SEQ ID NO: 326599 - DNA, 15 bp, Homo sapiens
tccctttgtgacttc

SEQ ID NO: 326600 - DNA, 15 bp, Homo sapiens
ccctttgtgacttca

SEQ ID NO: 326601 - DNA, 15 bp, Homo sapiens
cctttgtgacttcag

SEQ ID NO: 326602 - DNA, 15 bp, Homo sapiens
ctttgtgacttcaga

SEQ ID NO: 326603 - DNA, 15 bp, Homo sapiens
tttgtgacttcagaa

SEQ ID NO: 326604 - DNA, 15 bp, Homo sapiens
ttgtgacttcagaaa

SEQ ID NO: 326605 - DNA, 15 bp, Homo sapiens
tgtgacttcagaaat

SEQ ID NO: 326606 - DNA, 15 bp, Homo sapiens
gtgacttcagaaatc

SEQ ID NO: 326607 - DNA, 15 bp, Homo sapiens
tgacttcagaaatca

SEQ ID NO: 326608 - DNA, 15 bp, Homo sapiens
gacttcagaaatcat

SEQ ID NO: 326609 - DNA, 15 bp, Homo sapiens
acttcagaaatcatg

SEQ ID NO: 326610 - DNA, 15 bp, Homo sapiens
cttcagaaatcatgc

SEQ ID NO: 326611 - DNA, 15 bp, Homo sapiens
ttcagaaatcatgca

SEQ ID NO: 326612 - DNA, 15 bp, Homo sapiens
tcagaaatcatgcac

SEQ ID NO: 326613 - DNA, 15 bp, Homo sapiens
cagaaatcatgcact

SEQ ID NO: 326614 - DNA, 15 bp, Homo sapiens
agaaatcatgcactg

SEQ ID NO: 326615 - DNA, 15 bp, Homo sapiens
gaaatcatgcactgt

SEQ ID NO: 326616 - DNA, 15 bp, Homo sapiens
aaatcatgcactgtt

SEQ ID NO: 326617 - DNA, 15 bp, Homo sapiens
aatcatgcactgttg

SEQ ID NO: 326618 - DNA, 15 bp, Homo sapiens
atcatgcactgttgg

SEQ ID NO: 326619 - DNA, 15 bp, Homo sapiens
tcatgcactgttggt

SEQ ID NO: 326620 - DNA, 15 bp, Homo sapiens
catgcactgttggtt

SEQ ID NO: 326621 - DNA, 15 bp, Homo sapiens
atgcactgttggttt

SEQ ID NO: 326622 - DNA, 15 bp, Homo sapiens
tgcactgttggtttg

SEQ ID NO: 326623 - DNA, 15 bp, Homo sapiens
gcactgttggtttgg

SEQ ID NO: 326624 - DNA, 15 bp, Homo sapiens
cactgttggtttggg

SEQ ID NO: 326625 - DNA, 15 bp, Homo sapiens
actgttggtttggga

SEQ ID NO: 326626 - DNA, 15 bp, Homo sapiens
ctgttggtttgggag

SEQ ID NO: 326627 - DNA, 15 bp, Homo sapiens
tgttggtttgggagt

SEQ ID NO: 326628 - DNA, 15 bp, Homo sapiens
gttggtttgggagtc

SEQ ID NO: 326629 - DNA, 15 bp, Homo sapiens
ttggtttgggagtct

SEQ ID NO: 326630 - DNA, 15 bp, Homo sapiens
tggtttgggagtctt

SEQ ID NO: 326631 - DNA, 15 bp, Homo sapiens
ggtttgggagtctta

SEQ ID NO: 326632 - DNA, 15 bp, Homo sapiens
gtttgggagtcttaa

SEQ ID NO: 326633 - DNA, 15 bp, Homo sapiens
tttgggagtcttaac

SEQ ID NO: 326634 - DNA, 15 bp, Homo sapiens
ttgggagtcttaact

SEQ ID NO: 326635 - DNA, 15 bp, Homo sapiens
tgggagtcttaacta

SEQ ID NO: 326636 - DNA, 15 bp, Homo sapiens
gggagtcttaactac

SEQ ID NO: 326637 - DNA, 15 bp, Homo sapiens
ggagtcttaactaca

SEQ ID NO: 326638 - DNA, 15 bp, Homo sapiens
gagtcttaactacat

SEQ ID NO: 326639 - DNA, 15 bp, Homo sapiens
agtcttaactacatt

SEQ ID NO: 326640 - DNA, 15 bp, Homo sapiens
gtcttaactacattt

SEQ ID NO: 326641 - DNA, 15 bp, Homo sapiens
tcttaactacatttg

SEQ ID NO: 326642 - DNA, 15 bp, Homo sapiens
cttaactacatttgg

SEQ ID NO: 326643 - DNA, 15 bp, Homo sapiens
ttaactacatttgga

SEQ ID NO: 326644 - DNA, 15 bp, Homo sapiens
taactacatttggag

SEQ ID NO: 326645 - DNA, 15 bp, Homo sapiens
aactacatttggagg

SEQ ID NO: 326646 - DNA, 15 bp, Homo sapiens
actacatttggagga

SEQ ID NO: 326647 - DNA, 15 bp, Homo sapiens
ctacatttggaggac

SEQ ID NO: 326648 - DNA, 15 bp, Homo sapiens
tacatttggaggaca

SEQ ID NO: 326649 - DNA, 15 bp, Homo sapiens
acatttggaggacac

SEQ ID NO: 326650 - DNA, 15 bp, Homo sapiens
catttggaggacacg

SEQ ID NO: 326651 - DNA, 15 bp, Homo sapiens
atttggaggacacgc

SEQ ID NO: 326652 - DNA, 15 bp, Homo sapiens
tttggaggacacgct

SEQ ID NO: 326653 - DNA, 15 bp, Homo sapiens
ttggaggacacgctg

SEQ ID NO: 326654 - DNA, 15 bp, Homo sapiens
tggaggacacgctga

SEQ ID NO: 326655 - DNA, 15 bp, Homo sapiens
ggaggacacgctgag

SEQ ID NO: 326656 - DNA, 15 bp, Homo sapiens
gaggacacgctgagc

SEQ ID NO: 326657 - DNA, 15 bp, Homo sapiens
aggacacgctgagcc

SEQ ID NO: 326658 - DNA, 15 bp, Homo sapiens
ggacacgctgagccg

SEQ ID NO: 326659 - DNA, 15 bp, Homo sapiens
gacacgctgagccga

SEQ ID NO: 326660 - DNA, 15 bp, Homo sapiens
acacgctgagccgac

SEQ ID NO: 326661 - DNA, 15 bp, Homo sapiens
cacgctgagccgacg

SEQ ID NO: 326662 - DNA, 15 bp, Homo sapiens
acgctgagccgacga

SEQ ID NO: 326663 - DNA, 15 bp, Homo sapiens
cgctgagccgacgag

SEQ ID NO: 326664 - DNA, 15 bp, Homo sapiens
gctgagccgacgaga

SEQ ID NO: 326665 - DNA, 15 bp, Homo sapiens
ctgagccgacgagaa

SEQ ID NO: 326666 - DNA, 15 bp, Homo sapiens
tgagccgacgagaaa

SEQ ID NO: 326667 - DNA, 15 bp, Homo sapiens
gagccgacgagaaat

SEQ ID NO: 326668 - DNA, 15 bp, Homo sapiens
agccgacgagaaatg

SEQ ID NO: 326669 - DNA, 15 bp, Homo sapiens
gccgacgagaaatgg

SEQ ID NO: 326670 - DNA, 15 bp, Homo sapiens
ccgacgagaaatgga

SEQ ID NO: 326671 - DNA, 15 bp, Homo sapiens
cgacgagaaatggaa

SEQ ID NO: 326672 - DNA, 15 bp, Homo sapiens
gacgagaaatggaag

SEQ ID NO: 326673 - DNA, 15 bp, Homo sapiens
acgagaaatggaagt

SEQ ID NO: 326674 - DNA, 15 bp, Homo sapiens
cgagaaatggaagtg

SEQ ID NO: 326675 - DNA, 15 bp, Homo sapiens
gagaaatggaagtga

SEQ ID NO: 326676 - DNA, 15 bp, Homo sapiens
agaaatggaagtgag

SEQ ID NO: 326677 - DNA, 15 bp, Homo sapiens
gaaatggaagtgaga

SEQ ID NO: 326678 - DNA, 15 bp, Homo sapiens
aaatggaagtgagat

SEQ ID NO: 326679 - DNA, 15 bp, Homo sapiens
aatggaagtgagatc

SEQ ID NO: 326680 - DNA, 15 bp, Homo sapiens
atggaagtgagatct

SEQ ID NO: 326681 - DNA, 15 bp, Homo sapiens
tggaagtgagatctg

SEQ ID NO: 326682 - DNA, 15 bp, Homo sapiens
ggaagtgagatctga

SEQ ID NO: 326683 - DNA, 15 bp, Homo sapiens
gaagtgagatctgaa

SEQ ID NO: 326684 - DNA, 15 bp, Homo sapiens
aagtgagatctgaat

SEQ ID NO: 326685 - DNA, 15 bp, Homo sapiens
agtgagatctgaatc

SEQ ID NO: 326686 - DNA, 15 bp, Homo sapiens
gtgagatctgaatcc

SEQ ID NO: 326687 - DNA, 15 bp, Homo sapiens
tgagatctgaatcca

SEQ ID NO: 326688 - DNA, 15 bp, Homo sapiens
gagatctgaatccac

SEQ ID NO: 326689 - DNA, 15 bp, Homo sapiens
agatctgaatccaca

SEQ ID NO: 326690 - DNA, 15 bp, Homo sapiens
gatctgaatccacaa

SEQ ID NO: 326691 - DNA, 15 bp, Homo sapiens
atctgaatccacaaa

SEQ ID NO: 326692 - DNA, 15 bp, Homo sapiens
tctgaatccacaaac

SEQ ID NO: 326693 - DNA, 15 bp, Homo sapiens
ctgaatccacaaacg

SEQ ID NO: 326694 - DNA, 15 bp, Homo sapiens
tgaatccacaaacgg

SEQ ID NO: 326695 - DNA, 15 bp, Homo sapiens
gaatccacaaacgga

SEQ ID NO: 326696 - DNA, 15 bp, Homo sapiens
aatccacaaacggag

SEQ ID NO: 326697 - DNA, 15 bp, Homo sapiens
atccacaaacggaga

SEQ ID NO: 326698 - DNA, 15 bp, Homo sapiens
tccacaaacggagac

SEQ ID NO: 326699 - DNA, 15 bp, Homo sapiens
ccacaaacggagacg

SEQ ID NO: 326700 - DNA, 15 bp, Homo sapiens
cacaaacggagacgg

SEQ ID NO: 326701 - DNA, 15 bp, Homo sapiens
acaaacggagacggc

SEQ ID NO: 326702 - DNA, 15 bp, Homo sapiens
caaacggagacggca

SEQ ID NO: 326703 - DNA, 15 bp, Homo sapiens
aaacggagacggcag

SEQ ID NO: 326704 - DNA, 15 bp, Homo sapiens
aacggagacggcaga

SEQ ID NO: 326705 - DNA, 15 bp, Homo sapiens
acggagacggcagac

SEQ ID NO: 326706 - DNA, 15 bp, Homo sapiens
cggagacggcagaca

SEQ ID NO: 326707 - DNA, 15 bp, Homo sapiens
ggagacggcagacag

SEQ ID NO: 326708 - DNA, 15 bp, Homo sapiens
gagacggcagacagt

SEQ ID NO: 326709 - DNA, 15 bp, Homo sapiens
agacggcagacagtc

SEQ ID NO: 326710 - DNA, 15 bp, Homo sapiens
gacggcagacagtca

SEQ ID NO: 326711 - DNA, 15 bp, Homo sapiens
acggcagacagtcac

SEQ ID NO: 326712 - DNA, 15 bp, Homo sapiens
cggcagacagtcaca

SEQ ID NO: 326713 - DNA, 15 bp, Homo sapiens
ggcagacagtcacag

SEQ ID NO: 326714 - DNA, 15 bp, Homo sapiens
gcagacagtcacagg

SEQ ID NO: 326715 - DNA, 15 bp, Homo sapiens
cagacagtcacaggc

SEQ ID NO: 326716 - DNA, 15 bp, Homo sapiens
agacagtcacaggca

SEQ ID NO: 326717 - DNA, 15 bp, Homo sapiens
gacagtcacaggcag

SEQ ID NO: 326718 - DNA, 15 bp, Homo sapiens
acagtcacaggcagg

SEQ ID NO: 326719 - DNA, 15 bp, Homo sapiens
cagtcacaggcaggt

SEQ ID NO: 326720 - DNA, 15 bp, Homo sapiens
agtcacaggcaggta

SEQ ID NO: 326721 - DNA, 15 bp, Homo sapiens
gtcacaggcaggtaa

SEQ ID NO: 326722 - DNA, 15 bp, Homo sapiens
tcacaggcaggtaaa

SEQ ID NO: 326723 - DNA, 15 bp, Homo sapiens
cacaggcaggtaaag

SEQ ID NO: 326724 - DNA, 15 bp, Homo sapiens
acaggcaggtaaaga

SEQ ID NO: 326725 - DNA, 15 bp, Homo sapiens
caggcaggtaaagac

SEQ ID NO: 326726 - DNA, 15 bp, Homo sapiens
aggcaggtaaagact

SEQ ID NO: 326727 - DNA, 15 bp, Homo sapiens
ggcaggtaaagactc

SEQ ID NO: 326728 - DNA, 15 bp, Homo sapiens
gcaggtaaagactca

SEQ ID NO: 326729 - DNA, 15 bp, Homo sapiens
caggtaaagactcat

SEQ ID NO: 326730 - DNA, 15 bp, Homo sapiens
aggtaaagactcatt

SEQ ID NO: 326731 - DNA, 15 bp, Homo sapiens
ggtaaagactcattg

SEQ ID NO: 326732 - DNA, 15 bp, Homo sapiens
gtaaagactcattga

SEQ ID NO: 326733 - DNA, 15 bp, Homo sapiens
taaagactcattgag

SEQ ID NO: 326734 - DNA, 15 bp, Homo sapiens
aaagactcattgaga

SEQ ID NO: 326735 - DNA, 15 bp, Homo sapiens
aagactcattgagaa

SEQ ID NO: 326736 - DNA, 15 bp, Homo sapiens
agactcattgagaat

SEQ ID NO: 326737 - DNA, 15 bp, Homo sapiens
gactcattgagaatg

SEQ ID NO: 326738 - DNA, 15 bp, Homo sapiens
actcattgagaatgt

SEQ ID NO: 326739 - DNA, 15 bp, Homo sapiens
ctcattgagaatgtg

SEQ ID NO: 326740 - DNA, 15 bp, Homo sapiens
tcattgagaatgtgg

SEQ ID NO: 326741 - DNA, 15 bp, Homo sapiens
cattgagaatgtggc

SEQ ID NO: 326742 - DNA, 15 bp, Homo sapiens
attgagaatgtggct

SEQ ID NO: 326743 - DNA, 15 bp, Homo sapiens
ttgagaatgtggcta

SEQ ID NO: 326744 - DNA, 15 bp, Homo sapiens
tgagaatgtggctac

SEQ ID NO: 326745 - DNA, 15 bp, Homo sapiens
gagaatgtggctact

SEQ ID NO: 326746 - DNA, 15 bp, Homo sapiens
agaatgtggctactt

SEQ ID NO: 326747 - DNA, 15 bp, Homo sapiens
gaatgtggctactta

SEQ ID NO: 326748 - DNA, 15 bp, Homo sapiens
aatgtggctacttaa

SEQ ID NO: 326749 - DNA, 15 bp, Homo sapiens
atgtggctacttaaa

SEQ ID NO: 326750 - DNA, 15 bp, Homo sapiens
tgtggctacttaaat

SEQ ID NO: 326751 - DNA, 15 bp, Homo sapiens
gtggctacttaaatt

SEQ ID NO: 326752 - DNA, 15 bp, Homo sapiens
tggctacttaaattt

SEQ ID NO: 326753 - DNA, 15 bp, Homo sapiens
ggctacttaaatttt

SEQ ID NO: 326754 - DNA, 15 bp, Homo sapiens
gctacttaaattttg

SEQ ID NO: 326755 - DNA, 15 bp, Homo sapiens
ctacttaaattttgt

SEQ ID NO: 326756 - DNA, 15 bp, Homo sapiens
tacttaaattttgtc

SEQ ID NO: 326757 - DNA, 15 bp, Homo sapiens
acttaaattttgtcc

SEQ ID NO: 326758 - DNA, 15 bp, Homo sapiens
cttaaattttgtcca

SEQ ID NO: 326759 - DNA, 15 bp, Homo sapiens
ttaaattttgtccac

SEQ ID NO: 326760 - DNA, 15 bp, Homo sapiens
taaattttgtccacc

SEQ ID NO: 326761 - DNA, 15 bp, Homo sapiens
aaattttgtccacct

SEQ ID NO: 326762 - DNA, 15 bp, Homo sapiens
aattttgtccacctg

SEQ ID NO: 326763 - DNA, 15 bp, Homo sapiens
attttgtccacctgt

SEQ ID NO: 326764 - DNA, 15 bp, Homo sapiens
ttttgtccacctgtt

SEQ ID NO: 326765 - DNA, 15 bp, Homo sapiens
tttgtccacctgttc

SEQ ID NO: 326766 - DNA, 15 bp, Homo sapiens
ttgtccacctgttca

SEQ ID NO: 326767 - DNA, 15 bp, Homo sapiens
tgtccacctgttcat

SEQ ID NO: 326768 - DNA, 15 bp, Homo sapiens
gtccacctgttcatt

SEQ ID NO: 326769 - DNA, 15 bp, Homo sapiens
tccacctgttcattg

SEQ ID NO: 326770 - DNA, 15 bp, Homo sapiens
ccacctgttcattga

SEQ ID NO: 326771 - DNA, 15 bp, Homo sapiens
cacctgttcattgaa

SEQ ID NO: 326772 - DNA, 15 bp, Homo sapiens
acctgttcattgaaa

SEQ ID NO: 326773 - DNA, 15 bp, Homo sapiens
cctgttcattgaaag

SEQ ID NO: 326774 - DNA, 15 bp, Homo sapiens
ctgttcattgaaagg

SEQ ID NO: 326775 - DNA, 15 bp, Homo sapiens
tgttcattgaaagga

SEQ ID NO: 326776 - DNA, 15 bp, Homo sapiens
gttcattgaaaggaa

SEQ ID NO: 326777 - DNA, 15 bp, Homo sapiens
ttcattgaaaggaag

SEQ ID NO: 326778 - DNA, 15 bp, Homo sapiens
tcattgaaaggaagc

SEQ ID NO: 326779 - DNA, 15 bp, Homo sapiens
cattgaaaggaagcc

SEQ ID NO: 326780 - DNA, 15 bp, Homo sapiens
attgaaaggaagccg

SEQ ID NO: 326781 - DNA, 15 bp, Homo sapiens
ttgaaaggaagccga

SEQ ID NO: 326782 - DNA, 15 bp, Homo sapiens
tgaaaggaagccgag

SEQ ID NO: 326783 - DNA, 15 bp, Homo sapiens
gaaaggaagccgagg

SEQ ID NO: 326784 - DNA, 15 bp, Homo sapiens
aaaggaagccgaggc

SEQ ID NO: 326785 - DNA, 15 bp, Homo sapiens
aaggaagccgaggca

SEQ ID NO: 326786 - DNA, 15 bp, Homo sapiens
aggaagccgaggcat

SEQ ID NO: 326787 - DNA, 15 bp, Homo sapiens
ggaagccgaggcatg

SEQ ID NO: 326788 - DNA, 15 bp, Homo sapiens
gaagccgaggcatga

SEQ ID NO: 326789 - DNA, 15 bp, Homo sapiens
aagccgaggcatgac

SEQ ID NO: 326790 - DNA, 15 bp, Homo sapiens
agccgaggcatgact

SEQ ID NO: 326791 - DNA, 15 bp, Homo sapiens
gccgaggcatgactc

SEQ ID NO: 326792 - DNA, 15 bp, Homo sapiens
ccgaggcatgactct

SEQ ID NO: 326793 - DNA, 15 bp, Homo sapiens
cgaggcatgactctc

SEQ ID NO: 326794 - DNA, 15 bp, Homo sapiens
gaggcatgactctcc

SEQ ID NO: 326795 - DNA, 15 bp, Homo sapiens
aggcatgactctccg

SEQ ID NO: 326796 - DNA, 15 bp, Homo sapiens
ggcatgactctccgc

SEQ ID NO: 326797 - DNA, 15 bp, Homo sapiens
gcatgactctccgcc

SEQ ID NO: 326798 - DNA, 15 bp, Homo sapiens
catgactctccgcca

SEQ ID NO: 326799 - DNA, 15 bp, Homo sapiens
atgactctccgccaa

SEQ ID NO: 326800 - DNA, 15 bp, Homo sapiens
tgactctccgccaat

SEQ ID NO: 326801 - DNA, 15 bp, Homo sapiens
gactctccgccaata

SEQ ID NO: 326802 - DNA, 15 bp, Homo sapiens
actctccgccaataa

SEQ ID NO: 326803 - DNA, 15 bp, Homo sapiens
ctctccgccaataat

SEQ ID NO: 326804 - DNA, 15 bp, Homo sapiens
tctccgccaataatt

SEQ ID NO: 326805 - DNA, 15 bp, Homo sapiens
ctccgccaataatta

SEQ ID NO: 326806 - DNA, 15 bp, Homo sapiens
tccgccaataattag

SEQ ID NO: 326807 - DNA, 15 bp, Homo sapiens
ccgccaataattagt

SEQ ID NO: 326808 - DNA, 15 bp, Homo sapiens
cgccaataattagtg

SEQ ID NO: 326809 - DNA, 15 bp, Homo sapiens
gccaataattagtgt

SEQ ID NO: 326810 - DNA, 15 bp, Homo sapiens
ccaataattagtgtg

SEQ ID NO: 326811 - DNA, 15 bp, Homo sapiens
caataattagtgtga

SEQ ID NO: 326812 - DNA, 15 bp, Homo sapiens
aataattagtgtgaa

SEQ ID NO: 326813 - DNA, 15 bp, Homo sapiens
ataattagtgtgaaa

SEQ ID NO: 326814 - DNA, 15 bp, Homo sapiens
taattagtgtgaaaa

SEQ ID NO: 326815 - DNA, 15 bp, Homo sapiens
aattagtgtgaaaat

SEQ ID NO: 326816 - DNA, 15 bp, Homo sapiens
attagtgtgaaaatt

SEQ ID NO: 326817 - DNA, 15 bp, Homo sapiens
ttagtgtgaaaatta

SEQ ID NO: 326818 - DNA, 15 bp, Homo sapiens
tagtgtgaaaattac

SEQ ID NO: 326819 - DNA, 15 bp, Homo sapiens
agtgtgaaaattact

SEQ ID NO: 326820 - DNA, 15 bp, Homo sapiens
gtgtgaaaattactg

SEQ ID NO: 326821 - DNA, 15 bp, Homo sapiens
tgtgaaaattactga

SEQ ID NO: 326822 - DNA, 15 bp, Homo sapiens
gtgaaaattactgag

SEQ ID NO: 326823 - DNA, 15 bp, Homo sapiens
tgaaaattactgagt

SEQ ID NO: 326824 - DNA, 15 bp, Homo sapiens
gaaaattactgagtt

SEQ ID NO: 326825 - DNA, 15 bp, Homo sapiens
aaaattactgagtta

SEQ ID NO: 326826 - DNA, 15 bp, Homo sapiens
aaattactgagttaa

SEQ ID NO: 326827 - DNA, 15 bp, Homo sapiens
aattactgagttaac

SEQ ID NO: 326828 - DNA, 15 bp, Homo sapiens
attactgagttaaca

SEQ ID NO: 326829 - DNA, 15 bp, Homo sapiens
ttactgagttaacag

SEQ ID NO: 326830 - DNA, 15 bp, Homo sapiens
tactgagttaacaga

SEQ ID NO: 326831 - DNA, 15 bp, Homo sapiens
actgagttaacagat

SEQ ID NO: 326832 - DNA, 15 bp, Homo sapiens
ctgagttaacagatt

SEQ ID NO: 326833 - DNA, 15 bp, Homo sapiens
tgagttaacagattc

SEQ ID NO: 326834 - DNA, 15 bp, Homo sapiens
gagttaacagattct

SEQ ID NO: 326835 - DNA, 15 bp, Homo sapiens
agttaacagattcta

SEQ ID NO: 326836 - DNA, 15 bp, Homo sapiens
gttaacagattctaa

SEQ ID NO: 326837 - DNA, 15 bp, Homo sapiens
ttaacagattctaaa

SEQ ID NO: 326838 - DNA, 15 bp, Homo sapiens
taacagattctaaat

SEQ ID NO: 326839 - DNA, 15 bp, Homo sapiens
aacagattctaaatt

SEQ ID NO: 326840 - DNA, 15 bp, Homo sapiens
acagattctaaatta

SEQ ID NO: 326841 - DNA, 15 bp, Homo sapiens
cagattctaaattat

SEQ ID NO: 326842 - DNA, 15 bp, Homo sapiens
agattctaaattatt

SEQ ID NO: 326843 - DNA, 15 bp, Homo sapiens
gattctaaattattt

SEQ ID NO: 326844 - DNA, 15 bp, Homo sapiens
attctaaattatttt

SEQ ID NO: 326845 - DNA, 15 bp, Homo sapiens
ttctaaattattttg

SEQ ID NO: 326846 - DNA, 15 bp, Homo sapiens
tctaaattattttgt

SEQ ID NO: 326847 - DNA, 15 bp, Homo sapiens
ctaaattattttgtc

SEQ ID NO: 326848 - DNA, 15 bp, Homo sapiens
taaattattttgtcc

SEQ ID NO: 326849 - DNA, 15 bp, Homo sapiens
aaattattttgtcct

SEQ ID NO: 326850 - DNA, 15 bp, Homo sapiens
aattattttgtcctc

SEQ ID NO: 326851 - DNA, 15 bp, Homo sapiens
attattttgtcctct

SEQ ID NO: 326852 - DNA, 15 bp, Homo sapiens
ttattttgtcctctg

SEQ ID NO: 326853 - DNA, 15 bp, Homo sapiens
tattttgtcctctgg

SEQ ID NO: 326854 - DNA, 15 bp, Homo sapiens
attttgtcctctggg

SEQ ID NO: 326855 - DNA, 15 bp, Homo sapiens
ttttgtcctctgggt

SEQ ID NO: 326856 - DNA, 15 bp, Homo sapiens
tttgtcctctgggtg

SEQ ID NO: 326857 - DNA, 15 bp, Homo sapiens
ttgtcctctgggtga

SEQ ID NO: 326858 - DNA, 15 bp, Homo sapiens
tgtcctctgggtgac

SEQ ID NO: 326859 - DNA, 15 bp, Homo sapiens
gtcctctgggtgacc

SEQ ID NO: 326860 - DNA, 15 bp, Homo sapiens
tcctctgggtgacct

SEQ ID NO: 326861 - DNA, 15 bp, Homo sapiens
cctctgggtgaccta

SEQ ID NO: 326862 - DNA, 15 bp, Homo sapiens
ctctgggtgacctag

SEQ ID NO: 326863 - DNA, 15 bp, Homo sapiens
tctgggtgacctagg

SEQ ID NO: 326864 - DNA, 15 bp, Homo sapiens
ctgggtgacctagga

SEQ ID NO: 326865 - DNA, 15 bp, Homo sapiens
tgggtgacctaggaa

SEQ ID NO: 326866 - DNA, 15 bp, Homo sapiens
gggtgacctaggaag

SEQ ID NO: 326867 - DNA, 15 bp, Homo sapiens
ggtgacctaggaagt

SEQ ID NO: 326868 - DNA, 15 bp, Homo sapiens
gtgacctaggaagtt

SEQ ID NO: 326869 - DNA, 15 bp, Homo sapiens
tgacctaggaagttt

SEQ ID NO: 326870 - DNA, 15 bp, Homo sapiens
gacctaggaagtttt

SEQ ID NO: 326871 - DNA, 15 bp, Homo sapiens
acctaggaagttttt

SEQ ID NO: 326872 - DNA, 15 bp, Homo sapiens
cctaggaagttttta

SEQ ID NO: 326873 - DNA, 15 bp, Homo sapiens
ctaggaagtttttaa

SEQ ID NO: 326874 - DNA, 15 bp, Homo sapiens
taggaagtttttaaa

SEQ ID NO: 326875 - DNA, 15 bp, Homo sapiens
aggaagtttttaaaa

SEQ ID NO: 326876 - DNA, 15 bp, Homo sapiens
ggaagtttttaaaag

SEQ ID NO: 326877 - DNA, 15 bp, Homo sapiens
gaagtttttaaaaga

SEQ ID NO: 326878 - DNA, 15 bp, Homo sapiens
aagtttttaaaagac

SEQ ID NO: 326879 - DNA, 15 bp, Homo sapiens
agtttttaaaagacg

SEQ ID NO: 326880 - DNA, 15 bp, Homo sapiens
gtttttaaaagacgt

SEQ ID NO: 326881 - DNA, 15 bp, Homo sapiens
tttttaaaagacgtt

SEQ ID NO: 326882 - DNA, 15 bp, Homo sapiens
ttttaaaagacgttt

SEQ ID NO: 326883 - DNA, 15 bp, Homo sapiens
tttaaaagacgtttt

SEQ ID NO: 326884 - DNA, 15 bp, Homo sapiens
ttaaaagacgttttt

SEQ ID NO: 326885 - DNA, 15 bp, Homo sapiens
taaaagacgtttttt

SEQ ID NO: 326886 - DNA, 15 bp, Homo sapiens
aaaagacgttttttc

SEQ ID NO: 326887 - DNA, 15 bp, Homo sapiens
aaagacgttttttct

SEQ ID NO: 326888 - DNA, 15 bp, Homo sapiens
aagacgttttttcta

SEQ ID NO: 326889 - DNA, 15 bp, Homo sapiens
agacgttttttctaa

SEQ ID NO: 326890 - DNA, 15 bp, Homo sapiens
gacgttttttctaaa

SEQ ID NO: 326891 - DNA, 15 bp, Homo sapiens
acgttttttctaaat

SEQ ID NO: 326892 - DNA, 15 bp, Homo sapiens
cgttttttctaaata

SEQ ID NO: 326893 - DNA, 15 bp, Homo sapiens
gttttttctaaataa

SEQ ID NO: 326894 - DNA, 15 bp, Homo sapiens
ttttttctaaataat

SEQ ID NO: 326895 - DNA, 15 bp, Homo sapiens
tttttctaaataatg

SEQ ID NO: 326896 - DNA, 15 bp, Homo sapiens
ttttctaaataatgt

SEQ ID NO: 326897 - DNA, 15 bp, Homo sapiens
tttctaaataatgtc

SEQ ID NO: 326898 - DNA, 15 bp, Homo sapiens
ttctaaataatgtca

SEQ ID NO: 326899 - DNA, 15 bp, Homo sapiens
tctaaataatgtcat

SEQ ID NO: 326900 - DNA, 15 bp, Homo sapiens
ctaaataatgtcatg

SEQ ID NO: 326901 - DNA, 15 bp, Homo sapiens
taaataatgtcatga

SEQ ID NO: 326902 - DNA, 15 bp, Homo sapiens
aaataatgtcatgaa

SEQ ID NO: 326903 - DNA, 15 bp, Homo sapiens
aataatgtcatgaaa

SEQ ID NO: 326904 - DNA, 15 bp, Homo sapiens
ataatgtcatgaaat

SEQ ID NO: 326905 - DNA, 15 bp, Homo sapiens
taatgtcatgaaata

SEQ ID NO: 326906 - DNA, 15 bp, Homo sapiens
aatgtcatgaaataa

SEQ ID NO: 326907 - DNA, 15 bp, Homo sapiens
atgtcatgaaataag

SEQ ID NO: 326908 - DNA, 15 bp, Homo sapiens
tgtcatgaaataaga

SEQ ID NO: 326909 - DNA, 15 bp, Homo sapiens
gtcatgaaataagat

SEQ ID NO: 326910 - DNA, 15 bp, Homo sapiens
tcatgaaataagata

SEQ ID NO: 326911 - DNA, 15 bp, Homo sapiens
catgaaataagatag

SEQ ID NO: 326912 - DNA, 15 bp, Homo sapiens
atgaaataagatagt

SEQ ID NO: 326913 - DNA, 15 bp, Homo sapiens
tgaaataagatagtt

SEQ ID NO: 326914 - DNA, 15 bp, Homo sapiens
gaaataagatagtta

SEQ ID NO: 326915 - DNA, 15 bp, Homo sapiens
aaataagatagttac

SEQ ID NO: 326916 - DNA, 15 bp, Homo sapiens
aataagatagttaca

SEQ ID NO: 326917 - DNA, 15 bp, Homo sapiens
ataagatagttacat

SEQ ID NO: 326918 - DNA, 15 bp, Homo sapiens
taagatagttacatg

SEQ ID NO: 326919 - DNA, 15 bp, Homo sapiens
aagatagttacatgt

SEQ ID NO: 326920 - DNA, 15 bp, Homo sapiens
agatagttacatgta

SEQ ID NO: 326921 - DNA, 15 bp, Homo sapiens
gatagttacatgtaa

SEQ ID NO: 326922 - DNA, 15 bp, Homo sapiens
atagttacatgtaaa

SEQ ID NO: 326923 - DNA, 15 bp, Homo sapiens
tagttacatgtaaag

SEQ ID NO: 326924 - DNA, 15 bp, Homo sapiens
agttacatgtaaaga

SEQ ID NO: 326925 - DNA, 15 bp, Homo sapiens
gttacatgtaaagaa

SEQ ID NO: 326926 - DNA, 15 bp, Homo sapiens
ttacatgtaaagaat

SEQ ID NO: 326927 - DNA, 15 bp, Homo sapiens
tacatgtaaagaatc

SEQ ID NO: 326928 - DNA, 15 bp, Homo sapiens
acatgtaaagaatct

SEQ ID NO: 326929 - DNA, 15 bp, Homo sapiens
catgtaaagaatcta

SEQ ID NO: 326930 - DNA, 15 bp, Homo sapiens
atgtaaagaatctaa

SEQ ID NO: 326931 - DNA, 15 bp, Homo sapiens
tgtaaagaatctaac

SEQ ID NO: 326932 - DNA, 15 bp, Homo sapiens
gtaaagaatctaaca

SEQ ID NO: 326933 - DNA, 15 bp, Homo sapiens
taaagaatctaacaa

SEQ ID NO: 326934 - DNA, 15 bp, Homo sapiens
aaagaatctaacaag

SEQ ID NO: 326935 - DNA, 15 bp, Homo sapiens
aagaatctaacaagg

SEQ ID NO: 326936 - DNA, 15 bp, Homo sapiens
agaatctaacaaggt

SEQ ID NO: 326937 - DNA, 15 bp, Homo sapiens
gaatctaacaaggtc

SEQ ID NO: 326938 - DNA, 15 bp, Homo sapiens
aatctaacaaggtca

SEQ ID NO: 326939 - DNA, 15 bp, Homo sapiens
atctaacaaggtcag

SEQ ID NO: 326940 - DNA, 15 bp, Homo sapiens
tctaacaaggtcagt

SEQ ID NO: 326941 - DNA, 15 bp, Homo sapiens
ctaacaaggtcagtc

SEQ ID NO: 326942 - DNA, 15 bp, Homo sapiens
taacaaggtcagtca

SEQ ID NO: 326943 - DNA, 15 bp, Homo sapiens
aacaaggtcagtcat

SEQ ID NO: 326944 - DNA, 15 bp, Homo sapiens
acaaggtcagtcatt

SEQ ID NO: 326945 - DNA, 15 bp, Homo sapiens
caaggtcagtcatta

SEQ ID NO: 326946 - DNA, 15 bp, Homo sapiens
aaggtcagtcattaa

SEQ ID NO: 326947 - DNA, 15 bp, Homo sapiens
aggtcagtcattaaa

SEQ ID NO: 326948 - DNA, 15 bp, Homo sapiens
ggtcagtcattaaaa

SEQ ID NO: 326949 - DNA, 15 bp, Homo sapiens
gtcagtcattaaaaa

SEQ ID NO: 326950 - DNA, 15 bp, Homo sapiens
tcagtcattaaaaac

SEQ ID NO: 326951 - DNA, 15 bp, Homo sapiens
cagtcattaaaaaca

SEQ ID NO: 326952 - DNA, 15 bp, Homo sapiens
agtcattaaaaacat

SEQ ID NO: 326953 - DNA, 15 bp, Homo sapiens
gtcattaaaaacatt

SEQ ID NO: 326954 - DNA, 15 bp, Homo sapiens
tcattaaaaacattt

SEQ ID NO: 326955 - DNA, 15 bp, Homo sapiens
cattaaaaacatttt

SEQ ID NO: 326956 - DNA, 15 bp, Homo sapiens
attaaaaacattttc

SEQ ID NO: 326957 - DNA, 15 bp, Homo sapiens
ttaaaaacattttct

SEQ ID NO: 326958 - DNA, 15 bp, Homo sapiens
taaaaacattttcta

SEQ ID NO: 326959 - DNA, 15 bp, Homo sapiens
aaaaacattttctaa

SEQ ID NO: 326960 - DNA, 15 bp, Homo sapiens
aaaacattttctaaa

SEQ ID NO: 326961 - DNA, 15 bp, Homo sapiens
aaacattttctaaat

SEQ ID NO: 326962 - DNA, 15 bp, Homo sapiens
aacattttctaaata

SEQ ID NO: 326963 - DNA, 15 bp, Homo sapiens
acattttctaaatat

SEQ ID NO: 326964 - DNA, 15 bp, Homo sapiens
cattttctaaatatg

SEQ ID NO: 326965 - DNA, 15 bp, Homo sapiens
attttctaaatatga

SEQ ID NO: 326966 - DNA, 15 bp, Homo sapiens
ttttctaaatatgat

SEQ ID NO: 326967 - DNA, 15 bp, Homo sapiens
tttctaaatatgatt

SEQ ID NO: 326968 - DNA, 15 bp, Homo sapiens
ttctaaatatgattt

SEQ ID NO: 326969 - DNA, 15 bp, Homo sapiens
tctaaatatgattta

SEQ ID NO: 326970 - DNA, 15 bp, Homo sapiens
ctaaatatgatttat

SEQ ID NO: 326971 - DNA, 15 bp, Homo sapiens
taaatatgatttatt

SEQ ID NO: 326972 - DNA, 15 bp, Homo sapiens
aaatatgatttattt

SEQ ID NO: 326973 - DNA, 15 bp, Homo sapiens
aatatgatttatttt

SEQ ID NO: 326974 - DNA, 15 bp, Homo sapiens
atatgatttattttg

SEQ ID NO: 326975 - DNA, 15 bp, Homo sapiens
tatgatttattttgc

SEQ ID NO: 326976 - DNA, 15 bp, Homo sapiens
atgatttattttgct

SEQ ID NO: 326977 - DNA, 15 bp, Homo sapiens
gatttattttgctta

SEQ ID NO: 326978 - DNA, 15 bp, Homo sapiens
atttattttgcttac

SEQ ID NO: 326979 - DNA, 15 bp, Homo sapiens
tttattttgcttact

SEQ ID NO: 326980 - DNA, 15 bp, Homo sapiens
ttattttgcttacta

SEQ ID NO: 326981 - DNA, 15 bp, Homo sapiens
tattttgcttactaa

SEQ ID NO: 326982 - DNA, 15 bp, Homo sapiens
attttgcttactaac

SEQ ID NO: 326983 - DNA, 15 bp, Homo sapiens
ttttgcttactaacc

SEQ ID NO: 326984 - DNA, 15 bp, Homo sapiens
tttgcttactaacct

SEQ ID NO: 326985 - DNA, 15 bp, Homo sapiens
ttgcttactaacctt

SEQ ID NO: 326986 - DNA, 15 bp, Homo sapiens
tgcttactaaccttg

SEQ ID NO: 326987 - DNA, 15 bp, Homo sapiens
gcttactaaccttgt

SEQ ID NO: 326988 - DNA, 15 bp, Homo sapiens
cttactaaccttgta

SEQ ID NO: 326989 - DNA, 15 bp, Homo sapiens
ttactaaccttgtaa

SEQ ID NO: 326990 - DNA, 15 bp, Homo sapiens
tactaaccttgtaaa

SEQ ID NO: 326991 - DNA, 15 bp, Homo sapiens
actaaccttgtaaat

SEQ ID NO: 326992 - DNA, 15 bp, Homo sapiens
ctaaccttgtaaatc

SEQ ID NO: 326993 - DNA, 15 bp, Homo sapiens
taaccttgtaaatca

SEQ ID NO: 326994 - DNA, 15 bp, Homo sapiens
aaccttgtaaatcat

SEQ ID NO: 326995 - DNA, 15 bp, Homo sapiens
accttgtaaatcatc

SEQ ID NO: 326996 - DNA, 15 bp, Homo sapiens
ccttgtaaatcatct

SEQ ID NO: 326997 - DNA, 15 bp, Homo sapiens
cttgtaaatcatcta

SEQ ID NO: 326998 - DNA, 15 bp, Homo sapiens
ttgtaaatcatctag

SEQ ID NO: 326999 - DNA, 15 bp, Homo sapiens
tgtaaatcatctagg

SEQ ID NO: 327000 - DNA, 15 bp, Homo sapiens
gtaaatcatctagga

SEQ ID NO: 327001 - DNA, 15 bp, Homo sapiens
taaatcatctaggat

SEQ ID NO: 327002 - DNA, 15 bp, Homo sapiens
aaatcatctaggata

SEQ ID NO: 327003 - DNA, 15 bp, Homo sapiens
aatcatctaggatag

SEQ ID NO: 327004 - DNA, 15 bp, Homo sapiens
atcatctaggatagg

SEQ ID NO: 327005 - DNA, 15 bp, Homo sapiens
tcatctaggatagga

SEQ ID NO: 327006 - DNA, 15 bp, Homo sapiens
catctaggataggac

SEQ ID NO: 327007 - DNA, 15 bp, Homo sapiens
atctaggataggacc

SEQ ID NO: 327008 - DNA, 15 bp, Homo sapiens
tctaggataggacca

SEQ ID NO: 327009 - DNA, 15 bp, Homo sapiens
ctaggataggaccac

SEQ ID NO: 327010 - DNA, 15 bp, Homo sapiens
taggataggaccact

SEQ ID NO: 327011 - DNA, 15 bp, Homo sapiens
aggataggaccactg

SEQ ID NO: 327012 - DNA, 15 bp, Homo sapiens
ggataggaccactgt

SEQ ID NO: 327013 - DNA, 15 bp, Homo sapiens
gataggaccactgtc

SEQ ID NO: 327014 - DNA, 15 bp, Homo sapiens
ataggaccactgtca

SEQ ID NO: 327015 - DNA, 15 bp, Homo sapiens
taggaccactgtcag

SEQ ID NO: 327016 - DNA, 15 bp, Homo sapiens
aggaccactgtcagc

SEQ ID NO: 327017 - DNA, 15 bp, Homo sapiens
ggaccactgtcagcc

SEQ ID NO: 327018 - DNA, 15 bp, Homo sapiens
gaccactgtcagcct

SEQ ID NO: 327019 - DNA, 15 bp, Homo sapiens
accactgtcagcctc

SEQ ID NO: 327020 - DNA, 15 bp, Homo sapiens
ccactgtcagcctca

SEQ ID NO: 327021 - DNA, 15 bp, Homo sapiens
cactgtcagcctcag

SEQ ID NO: 327022 - DNA, 15 bp, Homo sapiens
actgtcagcctcaga

SEQ ID NO: 327023 - DNA, 15 bp, Homo sapiens
ctgtcagcctcagag

SEQ ID NO: 327024 - DNA, 15 bp, Homo sapiens
tgtcagcctcagagc

SEQ ID NO: 327025 - DNA, 15 bp, Homo sapiens
gtcagcctcagagcc

SEQ ID NO: 327026 - DNA, 15 bp, Homo sapiens
tcagcctcagagcct

SEQ ID NO: 327027 - DNA, 15 bp, Homo sapiens
cagcctcagagcctg

SEQ ID NO: 327028 - DNA, 15 bp, Homo sapiens
agcctcagagcctgg

SEQ ID NO: 327029 - DNA, 15 bp, Homo sapiens
gcctcagagcctggc

SEQ ID NO: 327030 - DNA, 15 bp, Homo sapiens
cctcagagcctggca

SEQ ID NO: 327031 - DNA, 15 bp, Homo sapiens
ctcagagcctggcac

SEQ ID NO: 327032 - DNA, 15 bp, Homo sapiens
tcagagcctggcaca

SEQ ID NO: 327033 - DNA, 15 bp, Homo sapiens
cagagcctggcacag

SEQ ID NO: 327034 - DNA, 15 bp, Homo sapiens
agagcctggcacaga

SEQ ID NO: 327035 - DNA, 15 bp, Homo sapiens
gagcctggcacagaa

SEQ ID NO: 327036 - DNA, 15 bp, Homo sapiens
agcctggcacagaac

SEQ ID NO: 327037 - DNA, 15 bp, Homo sapiens
gcctggcacagaact

SEQ ID NO: 327038 - DNA, 15 bp, Homo sapiens
cctggcacagaactt

SEQ ID NO: 327039 - DNA, 15 bp, Homo sapiens
ctggcacagaacttg

SEQ ID NO: 327040 - DNA, 15 bp, Homo sapiens
tggcacagaacttgg

SEQ ID NO: 327041 - DNA, 15 bp, Homo sapiens
ggcacagaacttggc

SEQ ID NO: 327042 - DNA, 15 bp, Homo sapiens
gcacagaacttggca

SEQ ID NO: 327043 - DNA, 15 bp, Homo sapiens
cacagaacttggcac

SEQ ID NO: 327044 - DNA, 15 bp, Homo sapiens
acagaacttggcact

SEQ ID NO: 327045 - DNA, 15 bp, Homo sapiens
cagaacttggcactt

SEQ ID NO: 327046 - DNA, 15 bp, Homo sapiens
agaacttggcactta

SEQ ID NO: 327047 - DNA, 15 bp, Homo sapiens
gaacttggcacttaa

SEQ ID NO: 327048 - DNA, 15 bp, Homo sapiens
aacttggcacttaat

SEQ ID NO: 327049 - DNA, 15 bp, Homo sapiens
acttggcacttaatg

SEQ ID NO: 327050 - DNA, 15 bp, Homo sapiens
cttggcacttaatgc

SEQ ID NO: 327051 - DNA, 15 bp, Homo sapiens
ttggcacttaatgcg

SEQ ID NO: 327052 - DNA, 15 bp, Homo sapiens
tggcacttaatgcgt

SEQ ID NO: 327053 - DNA, 15 bp, Homo sapiens
ggcacttaatgcgtg

SEQ ID NO: 327054 - DNA, 15 bp, Homo sapiens
gcacttaatgcgtgt

SEQ ID NO: 327055 - DNA, 15 bp, Homo sapiens
cacttaatgcgtgtt

SEQ ID NO: 327056 - DNA, 15 bp, Homo sapiens
acttaatgcgtgttt

SEQ ID NO: 327057 - DNA, 15 bp, Homo sapiens
cttaatgcgtgtttg

SEQ ID NO: 327058 - DNA, 15 bp, Homo sapiens
ttaatgcgtgtttgt

SEQ ID NO: 327059 - DNA, 15 bp, Homo sapiens
taatgcgtgtttgtt

SEQ ID NO: 327060 - DNA, 15 bp, Homo sapiens
aatgcgtgtttgttg

SEQ ID NO: 327061 - DNA, 15 bp, Homo sapiens
atgcgtgtttgttga

SEQ ID NO: 327062 - DNA, 15 bp, Homo sapiens
tgcgtgtttgttgaa

SEQ ID NO: 327063 - DNA, 15 bp, Homo sapiens
gcgtgtttgttgaat

SEQ ID NO: 327064 - DNA, 15 bp, Homo sapiens
cgtgtttgttgaata

SEQ ID NO: 327065 - DNA, 15 bp, Homo sapiens
gtgtttgttgaatat

SEQ ID NO: 327066 - DNA, 15 bp, Homo sapiens
tgtttgttgaatatg

SEQ ID NO: 327067 - DNA, 15 bp, Homo sapiens
gtttgttgaatatga

SEQ ID NO: 327068 - DNA, 15 bp, Homo sapiens
tttgttgaatatgaa

SEQ ID NO: 327069 - DNA, 15 bp, Homo sapiens
ttgttgaatatgaat

SEQ ID NO: 327070 - DNA, 15 bp, Homo sapiens
tgttgaatatgaatg

SEQ ID NO: 327071 - DNA, 15 bp, Homo sapiens
gttgaatatgaatgg

SEQ ID NO: 327072 - DNA, 15 bp, Homo sapiens
ttgaatatgaatgga

SEQ ID NO: 327073 - DNA, 15 bp, Homo sapiens
tgaatatgaatggat

SEQ ID NO: 327074 - DNA, 15 bp, Homo sapiens
gaatatgaatggatt

SEQ ID NO: 327075 - DNA, 15 bp, Homo sapiens
aatatgaatggattg

SEQ ID NO: 327076 - DNA, 15 bp, Homo sapiens
atatgaatggattgg

SEQ ID NO: 327077 - DNA, 15 bp, Homo sapiens
tatgaatggattggg

SEQ ID NO: 327078 - DNA, 15 bp, Homo sapiens
atgaatggattgggt

SEQ ID NO: 327079 - DNA, 15 bp, Homo sapiens
tgaatggattgggtc

SEQ ID NO: 327080 - DNA, 15 bp, Homo sapiens
gaatggattgggtcc

SEQ ID NO: 327081 - DNA, 15 bp, Homo sapiens
aatggattgggtcca

SEQ ID NO: 327082 - DNA, 15 bp, Homo sapiens
atggattgggtccag

SEQ ID NO: 327083 - DNA, 15 bp, Homo sapiens
tggattgggtccagt

SEQ ID NO: 327084 - DNA, 15 bp, Homo sapiens
ggattgggtccagtg

SEQ ID NO: 327085 - DNA, 15 bp, Homo sapiens
gattgggtccagtgt

SEQ ID NO: 327086 - DNA, 15 bp, Homo sapiens
attgggtccagtgtc

SEQ ID NO: 327087 - DNA, 15 bp, Homo sapiens
ttgggtccagtgtct

SEQ ID NO: 327088 - DNA, 15 bp, Homo sapiens
tgggtccagtgtcta

SEQ ID NO: 327089 - DNA, 15 bp, Homo sapiens
gggtccagtgtctaa

SEQ ID NO: 327090 - DNA, 15 bp, Homo sapiens
ggtccagtgtctaat

SEQ ID NO: 327091 - DNA, 15 bp, Homo sapiens
gtccagtgtctaatg

SEQ ID NO: 327092 - DNA, 15 bp, Homo sapiens
tccagtgtctaatga

SEQ ID NO: 327093 - DNA, 15 bp, Homo sapiens
ccagtgtctaatgat

SEQ ID NO: 327094 - DNA, 15 bp, Homo sapiens
cagtgtctaatgata

SEQ ID NO: 327095 - DNA, 15 bp, Homo sapiens
agtgtctaatgatac

SEQ ID NO: 327096 - DNA, 15 bp, Homo sapiens
gtgtctaatgatacg

SEQ ID NO: 327097 - DNA, 15 bp, Homo sapiens
tgtctaatgatacgc

SEQ ID NO: 327098 - DNA, 15 bp, Homo sapiens
gtctaatgatacgct

SEQ ID NO: 327099 - DNA, 15 bp, Homo sapiens
tctaatgatacgcta

SEQ ID NO: 327100 - DNA, 15 bp, Homo sapiens
ctaatgatacgctat

SEQ ID NO: 327101 - DNA, 15 bp, Homo sapiens
taatgatacgctatg

SEQ ID NO: 327102 - DNA, 15 bp, Homo sapiens
aatgatacgctatga

SEQ ID NO: 327103 - DNA, 15 bp, Homo sapiens
atgatacgctatgaa

SEQ ID NO: 327104 - DNA, 15 bp, Homo sapiens
tgatacgctatgaaa

SEQ ID NO: 327105 - DNA, 15 bp, Homo sapiens
gatacgctatgaaag

SEQ ID NO: 327106 - DNA, 15 bp, Homo sapiens
atacgctatgaaagt

SEQ ID NO: 327107 - DNA, 15 bp, Homo sapiens
tacgctatgaaagtt

SEQ ID NO: 327108 - DNA, 15 bp, Homo sapiens
acgctatgaaagtta

SEQ ID NO: 327109 - DNA, 15 bp, Homo sapiens
cgctatgaaagttat

SEQ ID NO: 327110 - DNA, 15 bp, Homo sapiens
gctatgaaagttatt

SEQ ID NO: 327111 - DNA, 15 bp, Homo sapiens
ctatgaaagttattc

SEQ ID NO: 327112 - DNA, 15 bp, Homo sapiens
tatgaaagttattcc

SEQ ID NO: 327113 - DNA, 15 bp, Homo sapiens
atgaaagttattcca

SEQ ID NO: 327114 - DNA, 15 bp, Homo sapiens
tgaaagttattccat

SEQ ID NO: 327115 - DNA, 15 bp, Homo sapiens
gaaagttattccatc

SEQ ID NO: 327116 - DNA, 15 bp, Homo sapiens
aaagttattccatca

SEQ ID NO: 327117 - DNA, 15 bp, Homo sapiens
aagttattccatcac

SEQ ID NO: 327118 - DNA, 15 bp, Homo sapiens
agttattccatcact

SEQ ID NO: 327119 - DNA, 15 bp, Homo sapiens
gttattccatcactt

SEQ ID NO: 327120 - DNA, 15 bp, Homo sapiens
ttattccatcacttc

SEQ ID NO: 327121 - DNA, 15 bp, Homo sapiens
tattccatcacttct

SEQ ID NO: 327122 - DNA, 15 bp, Homo sapiens
attccatcacttctc

SEQ ID NO: 327123 - DNA, 15 bp, Homo sapiens
ttccatcacttctcc

SEQ ID NO: 327124 - DNA, 15 bp, Homo sapiens
tccatcacttctccg

SEQ ID NO: 327125 - DNA, 15 bp, Homo sapiens
ccatcacttctccgt

SEQ ID NO: 327126 - DNA, 15 bp, Homo sapiens
catcacttctccgtg

SEQ ID NO: 327127 - DNA, 15 bp, Homo sapiens
atcacttctccgtga

SEQ ID NO: 327128 - DNA, 15 bp, Homo sapiens
tcacttctccgtgat

SEQ ID NO: 327129 - DNA, 15 bp, Homo sapiens
cacttctccgtgatg

SEQ ID NO: 327130 - DNA, 15 bp, Homo sapiens
acttctccgtgatgg

SEQ ID NO: 327131 - DNA, 15 bp, Homo sapiens
cttctccgtgatgga

SEQ ID NO: 327132 - DNA, 15 bp, Homo sapiens
ttctccgtgatggaa

SEQ ID NO: 327133 - DNA, 15 bp, Homo sapiens
tctccgtgatggaaa

SEQ ID NO: 327134 - DNA, 15 bp, Homo sapiens
ctccgtgatggaaaa

SEQ ID NO: 327135 - DNA, 15 bp, Homo sapiens
tccgtgatggaaaaa

SEQ ID NO: 327136 - DNA, 15 bp, Homo sapiens
ccgtgatggaaaaag

SEQ ID NO: 327137 - DNA, 15 bp, Homo sapiens
cgtgatggaaaaaga

SEQ ID NO: 327138 - DNA, 15 bp, Homo sapiens
gtgatggaaaaagat

SEQ ID NO: 327139 - DNA, 15 bp, Homo sapiens
tgatggaaaaagatt

SEQ ID NO: 327140 - DNA, 15 bp, Homo sapiens
gatggaaaaagattt

SEQ ID NO: 327141 - DNA, 15 bp, Homo sapiens
atggaaaaagattta

SEQ ID NO: 327142 - DNA, 15 bp, Homo sapiens
tggaaaaagatttac

SEQ ID NO: 327143 - DNA, 15 bp, Homo sapiens
ggaaaaagatttacc

SEQ ID NO: 327144 - DNA, 15 bp, Homo sapiens
gaaaaagatttaccg

SEQ ID NO: 327145 - DNA, 15 bp, Homo sapiens
aaaaagatttaccga

SEQ ID NO: 327146 - DNA, 15 bp, Homo sapiens
aaaagatttaccgaa

SEQ ID NO: 327147 - DNA, 15 bp, Homo sapiens
aaagatttaccgaaa

SEQ ID NO: 327148 - DNA, 15 bp, Homo sapiens
aagatttaccgaaaa

SEQ ID NO: 327149 - DNA, 15 bp, Homo sapiens
agatttaccgaaaag

SEQ ID NO: 327150 - DNA, 15 bp, Homo sapiens
gatttaccgaaaagt

SEQ ID NO: 327151 - DNA, 15 bp, Homo sapiens
atttaccgaaaagtg

SEQ ID NO: 327152 - DNA, 15 bp, Homo sapiens
tttaccgaaaagtgt

SEQ ID NO: 327153 - DNA, 15 bp, Homo sapiens
ttaccgaaaagtgtc

SEQ ID NO: 327154 - DNA, 15 bp, Homo sapiens
taccgaaaagtgtct

SEQ ID NO: 327155 - DNA, 15 bp, Homo sapiens
accgaaaagtgtctg

SEQ ID NO: 327156 - DNA, 15 bp, Homo sapiens
ccgaaaagtgtctgt

SEQ ID NO: 327157 - DNA, 15 bp, Homo sapiens
cgaaaagtgtctgtt

SEQ ID NO: 327158 - DNA, 15 bp, Homo sapiens
gaaaagtgtctgttg

SEQ ID NO: 327159 - DNA, 15 bp, Homo sapiens
aaaagtgtctgttgt

SEQ ID NO: 327160 - DNA, 15 bp, Homo sapiens
aaagtgtctgttgta

SEQ ID NO: 327161 - DNA, 15 bp, Homo sapiens
aagtgtctgttgtat

SEQ ID NO: 327162 - DNA, 15 bp, Homo sapiens
agtgtctgttgtatg

SEQ ID NO: 327163 - DNA, 15 bp, Homo sapiens
gtgtctgttgtatga

SEQ ID NO: 327164 - DNA, 15 bp, Homo sapiens
tgtctgttgtatgaa

SEQ ID NO: 327165 - DNA, 15 bp, Homo sapiens
gtctgttgtatgaaa

SEQ ID NO: 327166 - DNA, 15 bp, Homo sapiens
tctgttgtatgaaag

SEQ ID NO: 327167 - DNA, 15 bp, Homo sapiens
ctgttgtatgaaagt

SEQ ID NO: 327168 - DNA, 15 bp, Homo sapiens
tgttgtatgaaagtc

SEQ ID NO: 327169 - DNA, 15 bp, Homo sapiens
gttgtatgaaagtca

SEQ ID NO: 327170 - DNA, 15 bp, Homo sapiens
ttgtatgaaagtcat

SEQ ID NO: 327171 - DNA, 15 bp, Homo sapiens
tgtatgaaagtcata

SEQ ID NO: 327172 - DNA, 15 bp, Homo sapiens
gtatgaaagtcatat

SEQ ID NO: 327173 - DNA, 15 bp, Homo sapiens
tatgaaagtcatatg

SEQ ID NO: 327174 - DNA, 15 bp, Homo sapiens
atgaaagtcatatgg

SEQ ID NO: 327175 - DNA, 15 bp, Homo sapiens
tgaaagtcatatggg

SEQ ID NO: 327176 - DNA, 15 bp, Homo sapiens
gaaagtcatatgggg

SEQ ID NO: 327177 - DNA, 15 bp, Homo sapiens
aaagtcatatggggt

SEQ ID NO: 327178 - DNA, 15 bp, Homo sapiens
aagtcatatggggta

SEQ ID NO: 327179 - DNA, 15 bp, Homo sapiens
agtcatatggggtag

SEQ ID NO: 327180 - DNA, 15 bp, Homo sapiens
gtcatatggggtaga

SEQ ID NO: 327181 - DNA, 15 bp, Homo sapiens
tcatatggggtagaa

SEQ ID NO: 327182 - DNA, 15 bp, Homo sapiens
catatggggtagaaa

SEQ ID NO: 327183 - DNA, 15 bp, Homo sapiens
atatggggtagaaat

SEQ ID NO: 327184 - DNA, 15 bp, Homo sapiens
tatggggtagaaatt

SEQ ID NO: 327185 - DNA, 15 bp, Homo sapiens
atggggtagaaatta

SEQ ID NO: 327186 - DNA, 15 bp, Homo sapiens
tggggtagaaattaa

SEQ ID NO: 327187 - DNA, 15 bp, Homo sapiens
ggggtagaaattaaa

SEQ ID NO: 327188 - DNA, 15 bp, Homo sapiens
gggtagaaattaaac

SEQ ID NO: 327189 - DNA, 15 bp, Homo sapiens
ggtagaaattaaact

SEQ ID NO: 327190 - DNA, 15 bp, Homo sapiens
gtagaaattaaactg

SEQ ID NO: 327191 - DNA, 15 bp, Homo sapiens
tagaaattaaactgt

SEQ ID NO: 327192 - DNA, 15 bp, Homo sapiens
agaaattaaactgta

SEQ ID NO: 327193 - DNA, 15 bp, Homo sapiens
gaaattaaactgtaa

SEQ ID NO: 327194 - DNA, 15 bp, Homo sapiens
aaattaaactgtaaa

SEQ ID NO: 327195 - DNA, 15 bp, Homo sapiens
aattaaactgtaaat

SEQ ID NO: 327196 - DNA, 15 bp, Homo sapiens
attaaactgtaaatg

SEQ ID NO: 327197 - DNA, 15 bp, Homo sapiens
ttaaactgtaaatga

SEQ ID NO: 327198 - DNA, 15 bp, Homo sapiens
taaactgtaaatgag

SEQ ID NO: 327199 - DNA, 15 bp, Homo sapiens
aaactgtaaatgagt

SEQ ID NO: 327200 - DNA, 15 bp, Homo sapiens
aactgtaaatgagtt

SEQ ID NO: 327201 - DNA, 15 bp, Homo sapiens
actgtaaatgagtta

SEQ ID NO: 327202 - DNA, 15 bp, Homo sapiens
ctgtaaatgagttaa

SEQ ID NO: 327203 - DNA, 15 bp, Homo sapiens
tgtaaatgagttaag

SEQ ID NO: 327204 - DNA, 15 bp, Homo sapiens
gtaaatgagttaagg

SEQ ID NO: 327205 - DNA, 15 bp, Homo sapiens
taaatgagttaagga

SEQ ID NO: 327206 - DNA, 15 bp, Homo sapiens
aaatgagttaaggag

SEQ ID NO: 327207 - DNA, 15 bp, Homo sapiens
aatgagttaaggagc

SEQ ID NO: 327208 - DNA, 15 bp, Homo sapiens
atgagttaaggagct

SEQ ID NO: 327209 - DNA, 15 bp, Homo sapiens
tgagttaaggagctg

SEQ ID NO: 327210 - DNA, 15 bp, Homo sapiens
gagttaaggagctgt

SEQ ID NO: 327211 - DNA, 15 bp, Homo sapiens
agttaaggagctgta

SEQ ID NO: 327212 - DNA, 15 bp, Homo sapiens
gttaaggagctgtaa

SEQ ID NO: 327213 - DNA, 15 bp, Homo sapiens
ttaaggagctgtaac

SEQ ID NO: 327214 - DNA, 15 bp, Homo sapiens
taaggagctgtaacc

SEQ ID NO: 327215 - DNA, 15 bp, Homo sapiens
aaggagctgtaacct

SEQ ID NO: 327216 - DNA, 15 bp, Homo sapiens
aggagctgtaacctt

SEQ ID NO: 327217 - DNA, 15 bp, Homo sapiens
ggagctgtaaccttg

SEQ ID NO: 327218 - DNA, 15 bp, Homo sapiens
gagctgtaaccttgg

SEQ ID NO: 327219 - DNA, 15 bp, Homo sapiens
agctgtaaccttggc

SEQ ID NO: 327220 - DNA, 15 bp, Homo sapiens
gctgtaaccttggcg

SEQ ID NO: 327221 - DNA, 15 bp, Homo sapiens
ctgtaaccttggcgc

SEQ ID NO: 327222 - DNA, 15 bp, Homo sapiens
tgtaaccttggcgct

SEQ ID NO: 327223 - DNA, 15 bp, Homo sapiens
gtaaccttggcgcta

SEQ ID NO: 327224 - DNA, 15 bp, Homo sapiens
taaccttggcgctat

SEQ ID NO: 327225 - DNA, 15 bp, Homo sapiens
aaccttggcgctatt

SEQ ID NO: 327226 - DNA, 15 bp, Homo sapiens
accttggcgctattc

SEQ ID NO: 327227 - DNA, 15 bp, Homo sapiens
ccttggcgctattcc

SEQ ID NO: 327228 - DNA, 15 bp, Homo sapiens
cttggcgctattcca

SEQ ID NO: 327229 - DNA, 15 bp, Homo sapiens
ttggcgctattccaa

SEQ ID NO: 327230 - DNA, 15 bp, Homo sapiens
tggcgctattccaaa

SEQ ID NO: 327231 - DNA, 15 bp, Homo sapiens
ggcgctattccaaat

SEQ ID NO: 327232 - DNA, 15 bp, Homo sapiens
gcgctattccaaatc

SEQ ID NO: 327233 - DNA, 15 bp, Homo sapiens
cgctattccaaatct

SEQ ID NO: 327234 - DNA, 15 bp, Homo sapiens
gctattccaaatctc

SEQ ID NO: 327235 - DNA, 15 bp, Homo sapiens
ctattccaaatctcc

SEQ ID NO: 327236 - DNA, 15 bp, Homo sapiens
tattccaaatctcca

SEQ ID NO: 327237 - DNA, 15 bp, Homo sapiens
attccaaatctccaa

SEQ ID NO: 327238 - DNA, 15 bp, Homo sapiens
ttccaaatctccaac

SEQ ID NO: 327239 - DNA, 15 bp, Homo sapiens
tccaaatctccaaca

SEQ ID NO: 327240 - DNA, 15 bp, Homo sapiens
ccaaatctccaacaa

SEQ ID NO: 327241 - DNA, 15 bp, Homo sapiens
caaatctccaacaat

SEQ ID NO: 327242 - DNA, 15 bp, Homo sapiens
aaatctccaacaatt

SEQ ID NO: 327243 - DNA, 15 bp, Homo sapiens
aatctccaacaattg

SEQ ID NO: 327244 - DNA, 15 bp, Homo sapiens
atctccaacaattga

SEQ ID NO: 327245 - DNA, 15 bp, Homo sapiens
tctccaacaattgag

SEQ ID NO: 327246 - DNA, 15 bp, Homo sapiens
ctccaacaattgagt

SEQ ID NO: 327247 - DNA, 15 bp, Homo sapiens
tccaacaattgagta

SEQ ID NO: 327248 - DNA, 15 bp, Homo sapiens
ccaacaattgagtag

SEQ ID NO: 327249 - DNA, 15 bp, Homo sapiens
caacaattgagtagt

SEQ ID NO: 327250 - DNA, 15 bp, Homo sapiens
aacaattgagtagtt

SEQ ID NO: 327251 - DNA, 15 bp, Homo sapiens
acaattgagtagtta

SEQ ID NO: 327252 - DNA, 15 bp, Homo sapiens
caattgagtagttaa

SEQ ID NO: 327253 - DNA, 15 bp, Homo sapiens
aattgagtagttaat

SEQ ID NO: 327254 - DNA, 15 bp, Homo sapiens
attgagtagttaatt

SEQ ID NO: 327255 - DNA, 15 bp, Homo sapiens
ttgagtagttaatta

SEQ ID NO: 327256 - DNA, 15 bp, Homo sapiens
tgagtagttaattag

SEQ ID NO: 327257 - DNA, 15 bp, Homo sapiens
gagtagttaattagt

SEQ ID NO: 327258 - DNA, 15 bp, Homo sapiens
agtagttaattagtg

SEQ ID NO: 327259 - DNA, 15 bp, Homo sapiens
gtagttaattagtgc

SEQ ID NO: 327260 - DNA, 15 bp, Homo sapiens
tagttaattagtgcc

SEQ ID NO: 327261 - DNA, 15 bp, Homo sapiens
agttaattagtgccc

SEQ ID NO: 327262 - DNA, 15 bp, Homo sapiens
gttaattagtgcccc

SEQ ID NO: 327263 - DNA, 15 bp, Homo sapiens
ttaattagtgcccct

SEQ ID NO: 327264 - DNA, 15 bp, Homo sapiens
taattagtgcccctg

SEQ ID NO: 327265 - DNA, 15 bp, Homo sapiens
aattagtgcccctgc

SEQ ID NO: 327266 - DNA, 15 bp, Homo sapiens
attagtgcccctgca

SEQ ID NO: 327267 - DNA, 15 bp, Homo sapiens
ttagtgcccctgcat

SEQ ID NO: 327268 - DNA, 15 bp, Homo sapiens
tagtgcccctgcatc

SEQ ID NO: 327269 - DNA, 15 bp, Homo sapiens
agtgcccctgcatcc

SEQ ID NO: 327270 - DNA, 15 bp, Homo sapiens
gtgcccctgcatcca

SEQ ID NO: 327271 - DNA, 15 bp, Homo sapiens
tgcccctgcatccat

SEQ ID NO: 327272 - DNA, 15 bp, Homo sapiens
gcccctgcatccatt

SEQ ID NO: 327273 - DNA, 15 bp, Homo sapiens
cccctgcatccattt

SEQ ID NO: 327274 - DNA, 15 bp, Homo sapiens
ccctgcatccattta

SEQ ID NO: 327275 - DNA, 15 bp, Homo sapiens
cctgcatccatttaa

SEQ ID NO: 327276 - DNA, 15 bp, Homo sapiens
ctgcatccatttaat

SEQ ID NO: 327277 - DNA, 15 bp, Homo sapiens
tgcatccatttaatt

SEQ ID NO: 327278 - DNA, 15 bp, Homo sapiens
gcatccatttaattt

SEQ ID NO: 327279 - DNA, 15 bp, Homo sapiens
catccatttaatttg

SEQ ID NO: 327280 - DNA, 15 bp, Homo sapiens
atccatttaatttgt

SEQ ID NO: 327281 - DNA, 15 bp, Homo sapiens
tccatttaatttgtc

SEQ ID NO: 327282 - DNA, 15 bp, Homo sapiens
ccatttaatttgtcc

SEQ ID NO: 327283 - DNA, 15 bp, Homo sapiens
catttaatttgtcca

SEQ ID NO: 327284 - DNA, 15 bp, Homo sapiens
atttaatttgtccat

SEQ ID NO: 327285 - DNA, 15 bp, Homo sapiens
tttaatttgtccatt

SEQ ID NO: 327286 - DNA, 15 bp, Homo sapiens
ttaatttgtccattt

SEQ ID NO: 327287 - DNA, 15 bp, Homo sapiens
taatttgtccattta

SEQ ID NO: 327288 - DNA, 15 bp, Homo sapiens
aatttgtccatttat

SEQ ID NO: 327289 - DNA, 15 bp, Homo sapiens
atttgtccatttatc

SEQ ID NO: 327290 - DNA, 15 bp, Homo sapiens
tttgtccatttatct

SEQ ID NO: 327291 - DNA, 15 bp, Homo sapiens
ttgtccatttatctc

SEQ ID NO: 327292 - DNA, 15 bp, Homo sapiens
tgtccatttatctct

SEQ ID NO: 327293 - DNA, 15 bp, Homo sapiens
gtccatttatctctt

SEQ ID NO: 327294 - DNA, 15 bp, Homo sapiens
tccatttatctcttg

SEQ ID NO: 327295 - DNA, 15 bp, Homo sapiens
ccatttatctcttgg

SEQ ID NO: 327296 - DNA, 15 bp, Homo sapiens
catttatctcttggt

SEQ ID NO: 327297 - DNA, 15 bp, Homo sapiens
atttatctcttggtt

SEQ ID NO: 327298 - DNA, 15 bp, Homo sapiens
tttatctcttggttc

SEQ ID NO: 327299 - DNA, 15 bp, Homo sapiens
ttatctcttggttcg

SEQ ID NO: 327300 - DNA, 15 bp, Homo sapiens
tatctcttggttcgt

SEQ ID NO: 327301 - DNA, 15 bp, Homo sapiens
atctcttggttcgtt

SEQ ID NO: 327302 - DNA, 15 bp, Homo sapiens
tctcttggttcgttc

SEQ ID NO: 327303 - DNA, 15 bp, Homo sapiens
ctcttggttcgttca

SEQ ID NO: 327304 - DNA, 15 bp, Homo sapiens
tcttggttcgttcac

SEQ ID NO: 327305 - DNA, 15 bp, Homo sapiens
cttggttcgttcact

SEQ ID NO: 327306 - DNA, 15 bp, Homo sapiens
ttggttcgttcactg

SEQ ID NO: 327307 - DNA, 15 bp, Homo sapiens
tggttcgttcactgt

SEQ ID NO: 327308 - DNA, 15 bp, Homo sapiens
ggttcgttcactgtc

SEQ ID NO: 327309 - DNA, 15 bp, Homo sapiens
gttcgttcactgtca

SEQ ID NO: 327310 - DNA, 15 bp, Homo sapiens
ttcgttcactgtcat

SEQ ID NO: 327311 - DNA, 15 bp, Homo sapiens
tcgttcactgtcatt

SEQ ID NO: 327312 - DNA, 15 bp, Homo sapiens
cgttcactgtcattt

SEQ ID NO: 327313 - DNA, 15 bp, Homo sapiens
gttcactgtcattta

SEQ ID NO: 327314 - DNA, 15 bp, Homo sapiens
ttcactgtcatttat

SEQ ID NO: 327315 - DNA, 15 bp, Homo sapiens
tcactgtcatttatt

SEQ ID NO: 327316 - DNA, 15 bp, Homo sapiens
cactgtcatttattt

SEQ ID NO: 327317 - DNA, 15 bp, Homo sapiens
actgtcatttatttc

SEQ ID NO: 327318 - DNA, 15 bp, Homo sapiens
ctgtcatttatttct

SEQ ID NO: 327319 - DNA, 15 bp, Homo sapiens
tgtcatttatttctc

SEQ ID NO: 327320 - DNA, 15 bp, Homo sapiens
gtcatttatttctct

SEQ ID NO: 327321 - DNA, 15 bp, Homo sapiens
tcatttatttctctc

SEQ ID NO: 327322 - DNA, 15 bp, Homo sapiens
catttatttctctct

SEQ ID NO: 327323 - DNA, 15 bp, Homo sapiens
atttatttctctctg

SEQ ID NO: 327324 - DNA, 15 bp, Homo sapiens
tttatttctctctgc

SEQ ID NO: 327325 - DNA, 15 bp, Homo sapiens
ttatttctctctgct

SEQ ID NO: 327326 - DNA, 15 bp, Homo sapiens
tatttctctctgctg

SEQ ID NO: 327327 - DNA, 15 bp, Homo sapiens
atttctctctgctgg

SEQ ID NO: 327328 - DNA, 15 bp, Homo sapiens
tttctctctgctggt

SEQ ID NO: 327329 - DNA, 15 bp, Homo sapiens
ttctctctgctggtg

SEQ ID NO: 327330 - DNA, 15 bp, Homo sapiens
tctctctgctggtgc

SEQ ID NO: 327331 - DNA, 15 bp, Homo sapiens
ctctctgctggtgcc

SEQ ID NO: 327332 - DNA, 15 bp, Homo sapiens
tctctgctggtgcca

SEQ ID NO: 327333 - DNA, 15 bp, Homo sapiens
ctctgctggtgccaa

SEQ ID NO: 327334 - DNA, 15 bp, Homo sapiens
tctgctggtgccaag

SEQ ID NO: 327335 - DNA, 15 bp, Homo sapiens
ctgctggtgccaagt

SEQ ID NO: 327336 - DNA, 15 bp, Homo sapiens
tgctggtgccaagtt

SEQ ID NO: 327337 - DNA, 15 bp, Homo sapiens
gctggtgccaagtta

SEQ ID NO: 327338 - DNA, 15 bp, Homo sapiens
ctggtgccaagttac

SEQ ID NO: 327339 - DNA, 15 bp, Homo sapiens
tggtgccaagttacg

SEQ ID NO: 327340 - DNA, 15 bp, Homo sapiens
ggtgccaagttacgt

SEQ ID NO: 327341 - DNA, 15 bp, Homo sapiens
gtgccaagttacgtg

SEQ ID NO: 327342 - DNA, 15 bp, Homo sapiens
tgccaagttacgtga

SEQ ID NO: 327343 - DNA, 15 bp, Homo sapiens
gccaagttacgtgat

SEQ ID NO: 327344 - DNA, 15 bp, Homo sapiens
ccaagttacgtgata

SEQ ID NO: 327345 - DNA, 15 bp, Homo sapiens
caagttacgtgatag

SEQ ID NO: 327346 - DNA, 15 bp, Homo sapiens
aagttacgtgatagg

SEQ ID NO: 327347 - DNA, 15 bp, Homo sapiens
agttacgtgataggc

SEQ ID NO: 327348 - DNA, 15 bp, Homo sapiens
gttacgtgataggct

SEQ ID NO: 327349 - DNA, 15 bp, Homo sapiens
ttacgtgataggctg

SEQ ID NO: 327350 - DNA, 15 bp, Homo sapiens
tacgtgataggctgc

SEQ ID NO: 327351 - DNA, 15 bp, Homo sapiens
acgtgataggctgct

SEQ ID NO: 327352 - DNA, 15 bp, Homo sapiens
cgtgataggctgctg

SEQ ID NO: 327353 - DNA, 15 bp, Homo sapiens
gtgataggctgctgg

SEQ ID NO: 327354 - DNA, 15 bp, Homo sapiens
tgataggctgctggg

SEQ ID NO: 327355 - DNA, 15 bp, Homo sapiens
gataggctgctggga

SEQ ID NO: 327356 - DNA, 15 bp, Homo sapiens
ataggctgctgggag

SEQ ID NO: 327357 - DNA, 15 bp, Homo sapiens
taggctgctgggagg

SEQ ID NO: 327358 - DNA, 15 bp, Homo sapiens
aggctgctgggaggc

SEQ ID NO: 327359 - DNA, 15 bp, Homo sapiens
ggctgctgggaggca

SEQ ID NO: 327360 - DNA, 15 bp, Homo sapiens
gctgctgggaggcag

SEQ ID NO: 327361 - DNA, 15 bp, Homo sapiens
ctgctgggaggcaga

SEQ ID NO: 327362 - DNA, 15 bp, Homo sapiens
tgctgggaggcagac

SEQ ID NO: 327363 - DNA, 15 bp, Homo sapiens
gctgggaggcagaca

SEQ ID NO: 327364 - DNA, 15 bp, Homo sapiens
ctgggaggcagacaa

SEQ ID NO: 327365 - DNA, 15 bp, Homo sapiens
tgggaggcagacaag

SEQ ID NO: 327366 - DNA, 15 bp, Homo sapiens
gggaggcagacaagc

SEQ ID NO: 327367 - DNA, 15 bp, Homo sapiens
ggaggcagacaagca

SEQ ID NO: 327368 - DNA, 15 bp, Homo sapiens
gaggcagacaagcaa

SEQ ID NO: 327369 - DNA, 15 bp, Homo sapiens
aggcagacaagcaag

SEQ ID NO: 327370 - DNA, 15 bp, Homo sapiens
ggcagacaagcaaga

SEQ ID NO: 327371 - DNA, 15 bp, Homo sapiens
gcagacaagcaagat

SEQ ID NO: 327372 - DNA, 15 bp, Homo sapiens
cagacaagcaagatc

SEQ ID NO: 327373 - DNA, 15 bp, Homo sapiens
agacaagcaagatct

SEQ ID NO: 327374 - DNA, 15 bp, Homo sapiens
gacaagcaagatctc

SEQ ID NO: 327375 - DNA, 15 bp, Homo sapiens
acaagcaagatctct

SEQ ID NO: 327376 - DNA, 15 bp, Homo sapiens
caagcaagatctctg

SEQ ID NO: 327377 - DNA, 15 bp, Homo sapiens
aagcaagatctctgc

SEQ ID NO: 327378 - DNA, 15 bp, Homo sapiens
agcaagatctctgct

SEQ ID NO: 327379 - DNA, 15 bp, Homo sapiens
gcaagatctctgctt

SEQ ID NO: 327380 - DNA, 15 bp, Homo sapiens
caagatctctgcttg

SEQ ID NO: 327381 - DNA, 15 bp, Homo sapiens
cgttcagtaaatatt

SEQ ID NO: 327382 - DNA, 15 bp, Homo sapiens
gttcagtaaatattt

SEQ ID NO: 327383 - DNA, 15 bp, Homo sapiens
ttcagtaaatattta

SEQ ID NO: 327384 - DNA, 15 bp, Homo sapiens
tcagtaaatatttat

SEQ ID NO: 327385 - DNA, 15 bp, Homo sapiens
cagtaaatatttatc

SEQ ID NO: 327386 - DNA, 15 bp, Homo sapiens
agtaaatatttatcc

SEQ ID NO: 327387 - DNA, 15 bp, Homo sapiens
gtaaatatttatcca

SEQ ID NO: 327388 - DNA, 15 bp, Homo sapiens
taaatatttatccac

SEQ ID NO: 327389 - DNA, 15 bp, Homo sapiens
aaatatttatccacc

SEQ ID NO: 327390 - DNA, 15 bp, Homo sapiens
aatatttatccaccc

SEQ ID NO: 327391 - DNA, 15 bp, Homo sapiens
atatttatccaccca

SEQ ID NO: 327392 - DNA, 15 bp, Homo sapiens
tatttatccacccac

SEQ ID NO: 327393 - DNA, 15 bp, Homo sapiens
atttatccacccacc

SEQ ID NO: 327394 - DNA, 15 bp, Homo sapiens
tttatccacccacct

SEQ ID NO: 327395 - DNA, 15 bp, Homo sapiens
ttatccacccaccta

SEQ ID NO: 327396 - DNA, 15 bp, Homo sapiens
tatccacccacctac

SEQ ID NO: 327397 - DNA, 15 bp, Homo sapiens
atccacccacctact

SEQ ID NO: 327398 - DNA, 15 bp, Homo sapiens
tccacccacctacta

SEQ ID NO: 327399 - DNA, 15 bp, Homo sapiens
ccacccacctactat

SEQ ID NO: 327400 - DNA, 15 bp, Homo sapiens
cacccacctactatg

SEQ ID NO: 327401 - DNA, 15 bp, Homo sapiens
acccacctactatgt

SEQ ID NO: 327402 - DNA, 15 bp, Homo sapiens
cccacctactatgtg

SEQ ID NO: 327403 - DNA, 15 bp, Homo sapiens
ccacctactatgtgc

SEQ ID NO: 327404 - DNA, 15 bp, Homo sapiens
cacctactatgtgct

SEQ ID NO: 327405 - DNA, 15 bp, Homo sapiens
acctactatgtgcta

SEQ ID NO: 327406 - DNA, 15 bp, Homo sapiens
cctactatgtgctag

SEQ ID NO: 327407 - DNA, 15 bp, Homo sapiens
ctactatgtgctagg

SEQ ID NO: 327408 - DNA, 15 bp, Homo sapiens
actatgtgctaggca

SEQ ID NO: 327409 - DNA, 15 bp, Homo sapiens
ctatgtgctaggcac

SEQ ID NO: 327410 - DNA, 15 bp, Homo sapiens
tatgtgctaggcact

SEQ ID NO: 327411 - DNA, 15 bp, Homo sapiens
atgtgctaggcactg

SEQ ID NO: 327412 - DNA, 15 bp, Homo sapiens
tgtgctaggcactgt

SEQ ID NO: 327413 - DNA, 15 bp, Homo sapiens
gtgctaggcactgtg

SEQ ID NO: 327414 - DNA, 15 bp, Homo sapiens
tgctaggcactgtga

SEQ ID NO: 327415 - DNA, 15 bp, Homo sapiens
gctaggcactgtgat

SEQ ID NO: 327416 - DNA, 15 bp, Homo sapiens
ctaggcactgtgata

SEQ ID NO: 327417 - DNA, 15 bp, Homo sapiens
taggcactgtgatag

SEQ ID NO: 327418 - DNA, 15 bp, Homo sapiens
aggcactgtgatagt

SEQ ID NO: 327419 - DNA, 15 bp, Homo sapiens
ggcactgtgatagtc

SEQ ID NO: 327420 - DNA, 15 bp, Homo sapiens
gcactgtgatagtca

SEQ ID NO: 327421 - DNA, 15 bp, Homo sapiens
cactgtgatagtcac

SEQ ID NO: 327422 - DNA, 15 bp, Homo sapiens
actgtgatagtcact

SEQ ID NO: 327423 - DNA, 15 bp, Homo sapiens
ctgtgatagtcacta

SEQ ID NO: 327424 - DNA, 15 bp, Homo sapiens
tgtgatagtcactag

SEQ ID NO: 327425 - DNA, 15 bp, Homo sapiens
gtgatagtcactagg

SEQ ID NO: 327426 - DNA, 15 bp, Homo sapiens
tgatagtcactaggt

SEQ ID NO: 327427 - DNA, 15 bp, Homo sapiens
gatagtcactaggta

SEQ ID NO: 327428 - DNA, 15 bp, Homo sapiens
atagtcactaggtat

SEQ ID NO: 327429 - DNA, 15 bp, Homo sapiens
tagtcactaggtatt

SEQ ID NO: 327430 - DNA, 15 bp, Homo sapiens
agtcactaggtatta

SEQ ID NO: 327431 - DNA, 15 bp, Homo sapiens
gtcactaggtattaa

SEQ ID NO: 327432 - DNA, 15 bp, Homo sapiens
tcactaggtattaaa

SEQ ID NO: 327433 - DNA, 15 bp, Homo sapiens
cactaggtattaaaa

SEQ ID NO: 327434 - DNA, 15 bp, Homo sapiens
actaggtattaaaaa

SEQ ID NO: 327435 - DNA, 15 bp, Homo sapiens
ctaggtattaaaaaa

SEQ ID NO: 327436 - DNA, 15 bp, Homo sapiens
taggtattaaaaaag

SEQ ID NO: 327437 - DNA, 15 bp, Homo sapiens
aggtattaaaaaagt

SEQ ID NO: 327438 - DNA, 15 bp, Homo sapiens
ggtattaaaaaagta

SEQ ID NO: 327439 - DNA, 15 bp, Homo sapiens
gtattaaaaaagtac

SEQ ID NO: 327440 - DNA, 15 bp, Homo sapiens
tattaaaaaagtaca

SEQ ID NO: 327441 - DNA, 15 bp, Homo sapiens
attaaaaaagtacat

SEQ ID NO: 327442 - DNA, 15 bp, Homo sapiens
ttaaaaaagtacatt

SEQ ID NO: 327443 - DNA, 15 bp, Homo sapiens
taaaaaagtacattg

SEQ ID NO: 327444 - DNA, 15 bp, Homo sapiens
aaaaaagtacattga

SEQ ID NO: 327445 - DNA, 15 bp, Homo sapiens
aaaaagtacattgat

SEQ ID NO: 327446 - DNA, 15 bp, Homo sapiens
aaaagtacattgatg

SEQ ID NO: 327447 - DNA, 15 bp, Homo sapiens
aaagtacattgatga

SEQ ID NO: 327448 - DNA, 15 bp, Homo sapiens
aagtacattgatgat

SEQ ID NO: 327449 - DNA, 15 bp, Homo sapiens
agtacattgatgatc

SEQ ID NO: 327450 - DNA, 15 bp, Homo sapiens
gtacattgatgatcg

SEQ ID NO: 327451 - DNA, 15 bp, Homo sapiens
tacattgatgatcga

SEQ ID NO: 327452 - DNA, 15 bp, Homo sapiens
acattgatgatcgat

SEQ ID NO: 327453 - DNA, 15 bp, Homo sapiens
cattgatgatcgatg

SEQ ID NO: 327454 - DNA, 15 bp, Homo sapiens
attgatgatcgatgc

SEQ ID NO: 327455 - DNA, 15 bp, Homo sapiens
ttgatgatcgatgct

SEQ ID NO: 327456 - DNA, 15 bp, Homo sapiens
tgatgatcgatgcta

SEQ ID NO: 327457 - DNA, 15 bp, Homo sapiens
gatgatcgatgctaa

SEQ ID NO: 327458 - DNA, 15 bp, Homo sapiens
atgatcgatgctaag

SEQ ID NO: 327459 - DNA, 15 bp, Homo sapiens
tgatcgatgctaaga

SEQ ID NO: 327460 - DNA, 15 bp, Homo sapiens
gatcgatgctaagat

SEQ ID NO: 327461 - DNA, 15 bp, Homo sapiens
atcgatgctaagatt

SEQ ID NO: 327462 - DNA, 15 bp, Homo sapiens
tcgatgctaagatta

SEQ ID NO: 327463 - DNA, 15 bp, Homo sapiens
cgatgctaagattat

SEQ ID NO: 327464 - DNA, 15 bp, Homo sapiens
gatgctaagattatt

SEQ ID NO: 327465 - DNA, 15 bp, Homo sapiens
atgctaagattattt

SEQ ID NO: 327466 - DNA, 15 bp, Homo sapiens
tgctaagattatttt

SEQ ID NO: 327467 - DNA, 15 bp, Homo sapiens
gctaagattattttc

SEQ ID NO: 327468 - DNA, 15 bp, Homo sapiens
ctaagattattttca

SEQ ID NO: 327469 - DNA, 15 bp, Homo sapiens
taagattattttcaa

SEQ ID NO: 327470 - DNA, 15 bp, Homo sapiens
aagattattttcaaa

SEQ ID NO: 327471 - DNA, 15 bp, Homo sapiens
agattattttcaaac

SEQ ID NO: 327472 - DNA, 15 bp, Homo sapiens
gattattttcaaact

SEQ ID NO: 327473 - DNA, 15 bp, Homo sapiens
attattttcaaacta

SEQ ID NO: 327474 - DNA, 15 bp, Homo sapiens
ttattttcaaactat

SEQ ID NO: 327475 - DNA, 15 bp, Homo sapiens
tattttcaaactatt

SEQ ID NO: 327476 - DNA, 15 bp, Homo sapiens
attttcaaactattt

SEQ ID NO: 327477 - DNA, 15 bp, Homo sapiens
ttttcaaactatttt

SEQ ID NO: 327478 - DNA, 15 bp, Homo sapiens
tttcaaactatttta

SEQ ID NO: 327479 - DNA, 15 bp, Homo sapiens
ttcaaactattttaa

SEQ ID NO: 327480 - DNA, 15 bp, Homo sapiens
tcaaactattttaag

SEQ ID NO: 327481 - DNA, 15 bp, Homo sapiens
caaactattttaaga

SEQ ID NO: 327482 - DNA, 15 bp, Homo sapiens
aaactattttaagag

SEQ ID NO: 327483 - DNA, 15 bp, Homo sapiens
aactattttaagaga

SEQ ID NO: 327484 - DNA, 15 bp, Homo sapiens
actattttaagagag

SEQ ID NO: 327485 - DNA, 15 bp, Homo sapiens
ctattttaagagagg

SEQ ID NO: 327486 - DNA, 15 bp, Homo sapiens
tattttaagagagga

SEQ ID NO: 327487 - DNA, 15 bp, Homo sapiens
attttaagagaggac

SEQ ID NO: 327488 - DNA, 15 bp, Homo sapiens
ttttaagagaggact

SEQ ID NO: 327489 - DNA, 15 bp, Homo sapiens
tttaagagaggactc

SEQ ID NO: 327490 - DNA, 15 bp, Homo sapiens
ttaagagaggactcc

SEQ ID NO: 327491 - DNA, 15 bp, Homo sapiens
taagagaggactcct

SEQ ID NO: 327492 - DNA, 15 bp, Homo sapiens
aagagaggactccta

SEQ ID NO: 327493 - DNA, 15 bp, Homo sapiens
agagaggactcctaa

SEQ ID NO: 327494 - DNA, 15 bp, Homo sapiens
gagaggactcctaaa

SEQ ID NO: 327495 - DNA, 15 bp, Homo sapiens
agaggactcctaaat

SEQ ID NO: 327496 - DNA, 15 bp, Homo sapiens
gaggactcctaaatt

SEQ ID NO: 327497 - DNA, 15 bp, Homo sapiens
aggactcctaaatta

SEQ ID NO: 327498 - DNA, 15 bp, Homo sapiens
ggactcctaaattaa

SEQ ID NO: 327499 - DNA, 15 bp, Homo sapiens
gactcctaaattaaa

SEQ ID NO: 327500 - DNA, 15 bp, Homo sapiens
actcctaaattaaaa

SEQ ID NO: 327501 - DNA, 15 bp, Homo sapiens
ctcctaaattaaaag

SEQ ID NO: 327502 - DNA, 15 bp, Homo sapiens
tcctaaattaaaaga

SEQ ID NO: 327503 - DNA, 15 bp, Homo sapiens
cctaaattaaaagaa

SEQ ID NO: 327504 - DNA, 15 bp, Homo sapiens
ctaaattaaaagaaa

SEQ ID NO: 327505 - DNA, 15 bp, Homo sapiens
taaattaaaagaaat

SEQ ID NO: 327506 - DNA, 15 bp, Homo sapiens
aaattaaaagaaatt

SEQ ID NO: 327507 - DNA, 15 bp, Homo sapiens
aattaaaagaaatta

SEQ ID NO: 327508 - DNA, 15 bp, Homo sapiens
attaaaagaaattat

SEQ ID NO: 327509 - DNA, 15 bp, Homo sapiens
ttaaaagaaattatg

SEQ ID NO: 327510 - DNA, 15 bp, Homo sapiens
taaaagaaattatgt

SEQ ID NO: 327511 - DNA, 15 bp, Homo sapiens
aaaagaaattatgta

SEQ ID NO: 327512 - DNA, 15 bp, Homo sapiens
aaagaaattatgtat

SEQ ID NO: 327513 - DNA, 15 bp, Homo sapiens
aagaaattatgtatc

SEQ ID NO: 327514 - DNA, 15 bp, Homo sapiens
agaaattatgtatca

SEQ ID NO: 327515 - DNA, 15 bp, Homo sapiens
gaaattatgtatcaa

SEQ ID NO: 327516 - DNA, 15 bp, Homo sapiens
aaattatgtatcaac

SEQ ID NO: 327517 - DNA, 15 bp, Homo sapiens
aattatgtatcaaca

SEQ ID NO: 327518 - DNA, 15 bp, Homo sapiens
attatgtatcaacag

SEQ ID NO: 327519 - DNA, 15 bp, Homo sapiens
ttatgtatcaacaga

SEQ ID NO: 327520 - DNA, 15 bp, Homo sapiens
tatgtatcaacagac

SEQ ID NO: 327521 - DNA, 15 bp, Homo sapiens
atgtatcaacagaca

SEQ ID NO: 327522 - DNA, 15 bp, Homo sapiens
tgtatcaacagacaa

SEQ ID NO: 327523 - DNA, 15 bp, Homo sapiens
gtatcaacagacaaa

SEQ ID NO: 327524 - DNA, 15 bp, Homo sapiens
tatcaacagacaaat

SEQ ID NO: 327525 - DNA, 15 bp, Homo sapiens
atcaacagacaaatg

SEQ ID NO: 327526 - DNA, 15 bp, Homo sapiens
tcaacagacaaatgc

SEQ ID NO: 327527 - DNA, 15 bp, Homo sapiens
caacagacaaatgcc

SEQ ID NO: 327528 - DNA, 15 bp, Homo sapiens
aacagacaaatgccc

SEQ ID NO: 327529 - DNA, 15 bp, Homo sapiens
acagacaaatgccct

SEQ ID NO: 327530 - DNA, 15 bp, Homo sapiens
cagacaaatgccctt

SEQ ID NO: 327531 - DNA, 15 bp, Homo sapiens
agacaaatgcccttt

SEQ ID NO: 327532 - DNA, 15 bp, Homo sapiens
gacaaatgccctttt

SEQ ID NO: 327533 - DNA, 15 bp, Homo sapiens
acaaatgccctttta

SEQ ID NO: 327534 - DNA, 15 bp, Homo sapiens
caaatgcccttttat

SEQ ID NO: 327535 - DNA, 15 bp, Homo sapiens
aaatgcccttttatt

SEQ ID NO: 327536 - DNA, 15 bp, Homo sapiens
aatgcccttttattt

SEQ ID NO: 327537 - DNA, 15 bp, Homo sapiens
atgcccttttatttt

SEQ ID NO: 327538 - DNA, 15 bp, Homo sapiens
tgcccttttattttt

SEQ ID NO: 327539 - DNA, 15 bp, Homo sapiens
gcccttttatttttt

SEQ ID NO: 327540 - DNA, 15 bp, Homo sapiens
cccttttattttttt

SEQ ID NO: 327541 - DNA, 15 bp, Homo sapiens
ccttttatttttttc

SEQ ID NO: 327542 - DNA, 15 bp, Homo sapiens
cttttatttttttcc

SEQ ID NO: 327543 - DNA, 15 bp, Homo sapiens
ttttatttttttccc

SEQ ID NO: 327544 - DNA, 15 bp, Homo sapiens
tttatttttttccct

SEQ ID NO: 327545 - DNA, 15 bp, Homo sapiens
ttatttttttcccta

SEQ ID NO: 327546 - DNA, 15 bp, Homo sapiens
tatttttttccctac

SEQ ID NO: 327547 - DNA, 15 bp, Homo sapiens
atttttttccctaca

SEQ ID NO: 327548 - DNA, 15 bp, Homo sapiens
tttttttccctacaa

SEQ ID NO: 327549 - DNA, 15 bp, Homo sapiens
ttttttccctacaaa

SEQ ID NO: 327550 - DNA, 15 bp, Homo sapiens
tttttccctacaaaa

SEQ ID NO: 327551 - DNA, 15 bp, Homo sapiens
ttttccctacaaaat

SEQ ID NO: 327552 - DNA, 15 bp, Homo sapiens
tttccctacaaaatt

SEQ ID NO: 327553 - DNA, 15 bp, Homo sapiens
ttccctacaaaattg

SEQ ID NO: 327554 - DNA, 15 bp, Homo sapiens
tccctacaaaattgc

SEQ ID NO: 327555 - DNA, 15 bp, Homo sapiens
ccctacaaaattgct

SEQ ID NO: 327556 - DNA, 15 bp, Homo sapiens
cctacaaaattgctg

SEQ ID NO: 327557 - DNA, 15 bp, Homo sapiens
ctacaaaattgctgc

SEQ ID NO: 327558 - DNA, 15 bp, Homo sapiens
tacaaaattgctgct

SEQ ID NO: 327559 - DNA, 15 bp, Homo sapiens
acaaaattgctgctg

SEQ ID NO: 327560 - DNA, 15 bp, Homo sapiens
caaaattgctgctgg

SEQ ID NO: 327561 - DNA, 15 bp, Homo sapiens
aaaattgctgctggc

SEQ ID NO: 327562 - DNA, 15 bp, Homo sapiens
aaattgctgctggct

SEQ ID NO: 327563 - DNA, 15 bp, Homo sapiens
aattgctgctggcta

SEQ ID NO: 327564 - DNA, 15 bp, Homo sapiens
attgctgctggctag

SEQ ID NO: 327565 - DNA, 15 bp, Homo sapiens
ttgctgctggctaga

SEQ ID NO: 327566 - DNA, 15 bp, Homo sapiens
tgctgctggctagag

SEQ ID NO: 327567 - DNA, 15 bp, Homo sapiens
gctgctggctagaga

SEQ ID NO: 327568 - DNA, 15 bp, Homo sapiens
ctgctggctagagaa

SEQ ID NO: 327569 - DNA, 15 bp, Homo sapiens
tgctggctagagaat

SEQ ID NO: 327570 - DNA, 15 bp, Homo sapiens
gctggctagagaatg

SEQ ID NO: 327571 - DNA, 15 bp, Homo sapiens
ctggctagagaatga

SEQ ID NO: 327572 - DNA, 15 bp, Homo sapiens
tggctagagaatgat

SEQ ID NO: 327573 - DNA, 15 bp, Homo sapiens
ggctagagaatgatg

SEQ ID NO: 327574 - DNA, 15 bp, Homo sapiens
gctagagaatgatga

SEQ ID NO: 327575 - DNA, 15 bp, Homo sapiens
ctagagaatgatgat

SEQ ID NO: 327576 - DNA, 15 bp, Homo sapiens
tagagaatgatgatg

SEQ ID NO: 327577 - DNA, 15 bp, Homo sapiens
agagaatgatgatga

SEQ ID NO: 327578 - DNA, 15 bp, Homo sapiens
gagaatgatgatgat

SEQ ID NO: 327579 - DNA, 15 bp, Homo sapiens
agaatgatgatgatt

SEQ ID NO: 327580 - DNA, 15 bp, Homo sapiens
gaatgatgatgattt

SEQ ID NO: 327581 - DNA, 15 bp, Homo sapiens
aatgatgatgatttg

SEQ ID NO: 327582 - DNA, 15 bp, Homo sapiens
atgatgatgatttgc

SEQ ID NO: 327583 - DNA, 15 bp, Homo sapiens
tgatgatgatttgca

SEQ ID NO: 327584 - DNA, 15 bp, Homo sapiens
gatgatgatttgcac

SEQ ID NO: 327585 - DNA, 15 bp, Homo sapiens
atgatgatttgcact

SEQ ID NO: 327586 - DNA, 15 bp, Homo sapiens
tgatgatttgcactt

SEQ ID NO: 327587 - DNA, 15 bp, Homo sapiens
gatgatttgcacttc

SEQ ID NO: 327588 - DNA, 15 bp, Homo sapiens
atgatttgcacttct

SEQ ID NO: 327589 - DNA, 15 bp, Homo sapiens
tgatttgcacttctg

SEQ ID NO: 327590 - DNA, 15 bp, Homo sapiens
gatttgcacttctga

SEQ ID NO: 327591 - DNA, 15 bp, Homo sapiens
atttgcacttctgac

SEQ ID NO: 327592 - DNA, 15 bp, Homo sapiens
tttgcacttctgaca

SEQ ID NO: 327593 - DNA, 15 bp, Homo sapiens
ttgcacttctgacat

SEQ ID NO: 327594 - DNA, 15 bp, Homo sapiens
tgcacttctgacatc

SEQ ID NO: 327595 - DNA, 15 bp, Homo sapiens
gcacttctgacatca

SEQ ID NO: 327596 - DNA, 15 bp, Homo sapiens
cacttctgacatcat

SEQ ID NO: 327597 - DNA, 15 bp, Homo sapiens
acttctgacatcatt

SEQ ID NO: 327598 - DNA, 15 bp, Homo sapiens
cttctgacatcattg

SEQ ID NO: 327599 - DNA, 15 bp, Homo sapiens
ttctgacatcattgc

SEQ ID NO: 327600 - DNA, 15 bp, Homo sapiens
tctgacatcattgcc

SEQ ID NO: 327601 - DNA, 15 bp, Homo sapiens
ctgacatcattgcct

SEQ ID NO: 327602 - DNA, 15 bp, Homo sapiens
tgacatcattgccta

SEQ ID NO: 327603 - DNA, 15 bp, Homo sapiens
gacatcattgcctaa

SEQ ID NO: 327604 - DNA, 15 bp, Homo sapiens
acatcattgcctaat

SEQ ID NO: 327605 - DNA, 15 bp, Homo sapiens
catcattgcctaatg

SEQ ID NO: 327606 - DNA, 15 bp, Homo sapiens
atcattgcctaatgt

SEQ ID NO: 327607 - DNA, 15 bp, Homo sapiens
tcattgcctaatgtt

SEQ ID NO: 327608 - DNA, 15 bp, Homo sapiens
cattgcctaatgttg

SEQ ID NO: 327609 - DNA, 15 bp, Homo sapiens
attgcctaatgttgg

SEQ ID NO: 327610 - DNA, 15 bp, Homo sapiens
ttgcctaatgttggg

SEQ ID NO: 327611 - DNA, 15 bp, Homo sapiens
tgcctaatgttgggt

SEQ ID NO: 327612 - DNA, 15 bp, Homo sapiens
gcctaatgttgggtt

SEQ ID NO: 327613 - DNA, 15 bp, Homo sapiens
cctaatgttgggttt

SEQ ID NO: 327614 - DNA, 15 bp, Homo sapiens
ctaatgttgggtttc

SEQ ID NO: 327615 - DNA, 15 bp, Homo sapiens
taatgttgggtttct

SEQ ID NO: 327616 - DNA, 15 bp, Homo sapiens
aatgttgggtttctg

SEQ ID NO: 327617 - DNA, 15 bp, Homo sapiens
atgttgggtttctgt

SEQ ID NO: 327618 - DNA, 15 bp, Homo sapiens
tgttgggtttctgtg

SEQ ID NO: 327619 - DNA, 15 bp, Homo sapiens
gttgggtttctgtgc

SEQ ID NO: 327620 - DNA, 15 bp, Homo sapiens
ttgggtttctgtgcc

SEQ ID NO: 327621 - DNA, 15 bp, Homo sapiens
tgggtttctgtgcct

SEQ ID NO: 327622 - DNA, 15 bp, Homo sapiens
gggtttctgtgcctg

SEQ ID NO: 327623 - DNA, 15 bp, Homo sapiens
ggtttctgtgcctgg

SEQ ID NO: 327624 - DNA, 15 bp, Homo sapiens
gtttctgtgcctggg

SEQ ID NO: 327625 - DNA, 15 bp, Homo sapiens
tttctgtgcctgggc

SEQ ID NO: 327626 - DNA, 15 bp, Homo sapiens
ttctgtgcctgggct

SEQ ID NO: 327627 - DNA, 15 bp, Homo sapiens
tctgtgcctgggctc

SEQ ID NO: 327628 - DNA, 15 bp, Homo sapiens
ctgtgcctgggctct

SEQ ID NO: 327629 - DNA, 15 bp, Homo sapiens
tgtgcctgggctctt

SEQ ID NO: 327630 - DNA, 15 bp, Homo sapiens
gtgcctgggctcttt

SEQ ID NO: 327631 - DNA, 15 bp, Homo sapiens
tgcctgggctcttta

SEQ ID NO: 327632 - DNA, 15 bp, Homo sapiens
gcctgggctctttat

SEQ ID NO: 327633 - DNA, 15 bp, Homo sapiens
cctgggctctttatg

SEQ ID NO: 327634 - DNA, 15 bp, Homo sapiens
ctgggctctttatgc

SEQ ID NO: 327635 - DNA, 15 bp, Homo sapiens
tgggctctttatgct

SEQ ID NO: 327636 - DNA, 15 bp, Homo sapiens
gggctctttatgctg

SEQ ID NO: 327637 - DNA, 15 bp, Homo sapiens
ggctctttatgctgt

SEQ ID NO: 327638 - DNA, 15 bp, Homo sapiens
gctctttatgctgtg

SEQ ID NO: 327639 - DNA, 15 bp, Homo sapiens
ctctttatgctgtgg

SEQ ID NO: 327640 - DNA, 15 bp, Homo sapiens
tctttatgctgtgga

SEQ ID NO: 327641 - DNA, 15 bp, Homo sapiens
ctttatgctgtggag

SEQ ID NO: 327642 - DNA, 15 bp, Homo sapiens
tttatgctgtggagg

SEQ ID NO: 327643 - DNA, 15 bp, Homo sapiens
ttatgctgtggaggc

SEQ ID NO: 327644 - DNA, 15 bp, Homo sapiens
tatgctgtggaggca

SEQ ID NO: 327645 - DNA, 15 bp, Homo sapiens
atgctgtggaggcaa

SEQ ID NO: 327646 - DNA, 15 bp, Homo sapiens
tgctgtggaggcaaa

SEQ ID NO: 327647 - DNA, 15 bp, Homo sapiens
gctgtggaggcaaat

SEQ ID NO: 327648 - DNA, 15 bp, Homo sapiens
ctgtggaggcaaatg

SEQ ID NO: 327649 - DNA, 15 bp, Homo sapiens
tgtggaggcaaatgg

SEQ ID NO: 327650 - DNA, 15 bp, Homo sapiens
gtggaggcaaatggt

SEQ ID NO: 327651 - DNA, 15 bp, Homo sapiens
tggaggcaaatggtg

SEQ ID NO: 327652 - DNA, 15 bp, Homo sapiens
ggaggcaaatggtgc

SEQ ID NO: 327653 - DNA, 15 bp, Homo sapiens
gaggcaaatggtgct

SEQ ID NO: 327654 - DNA, 15 bp, Homo sapiens
aggcaaatggtgctt

SEQ ID NO: 327655 - DNA, 15 bp, Homo sapiens
ggcaaatggtgcttt

SEQ ID NO: 327656 - DNA, 15 bp, Homo sapiens
gcaaatggtgctttg

SEQ ID NO: 327657 - DNA, 15 bp, Homo sapiens
caaatggtgctttga

SEQ ID NO: 327658 - DNA, 15 bp, Homo sapiens
aaatggtgctttgag

SEQ ID NO: 327659 - DNA, 15 bp, Homo sapiens
aatggtgctttgagt

SEQ ID NO: 327660 - DNA, 15 bp, Homo sapiens
atggtgctttgagtg

SEQ ID NO: 327661 - DNA, 15 bp, Homo sapiens
tggtgctttgagtgt

SEQ ID NO: 327662 - DNA, 15 bp, Homo sapiens
ggtgctttgagtgtc

SEQ ID NO: 327663 - DNA, 15 bp, Homo sapiens
gtgctttgagtgtct

SEQ ID NO: 327664 - DNA, 15 bp, Homo sapiens
tgctttgagtgtctt

SEQ ID NO: 327665 - DNA, 15 bp, Homo sapiens
gctttgagtgtctta

SEQ ID NO: 327666 - DNA, 15 bp, Homo sapiens
ctttgagtgtcttaa

SEQ ID NO: 327667 - DNA, 15 bp, Homo sapiens
tttgagtgtcttaat

SEQ ID NO: 327668 - DNA, 15 bp, Homo sapiens
ttgagtgtcttaatt

SEQ ID NO: 327669 - DNA, 15 bp, Homo sapiens
tgagtgtcttaattt

SEQ ID NO: 327670 - DNA, 15 bp, Homo sapiens
gagtgtcttaatttc

SEQ ID NO: 327671 - DNA, 15 bp, Homo sapiens
agtgtcttaatttca

SEQ ID NO: 327672 - DNA, 15 bp, Homo sapiens
gtgtcttaatttcac

SEQ ID NO: 327673 - DNA, 15 bp, Homo sapiens
tgtcttaatttcacc

SEQ ID NO: 327674 - DNA, 15 bp, Homo sapiens
gtcttaatttcaccg

SEQ ID NO: 327675 - DNA, 15 bp, Homo sapiens
tcttaatttcaccgg

SEQ ID NO: 327676 - DNA, 15 bp, Homo sapiens
cttaatttcaccgga

SEQ ID NO: 327677 - DNA, 15 bp, Homo sapiens
ttaatttcaccggaa

SEQ ID NO: 327678 - DNA, 15 bp, Homo sapiens
taatttcaccggaat

SEQ ID NO: 327679 - DNA, 15 bp, Homo sapiens
aatttcaccggaatg

SEQ ID NO: 327680 - DNA, 15 bp, Homo sapiens
atttcaccggaatgc

SEQ ID NO: 327681 - DNA, 15 bp, Homo sapiens
tttcaccggaatgct

SEQ ID NO: 327682 - DNA, 15 bp, Homo sapiens
ttcaccggaatgctg

SEQ ID NO: 327683 - DNA, 15 bp, Homo sapiens
tcaccggaatgctgc

SEQ ID NO: 327684 - DNA, 15 bp, Homo sapiens
caccggaatgctgca

SEQ ID NO: 327685 - DNA, 15 bp, Homo sapiens
accggaatgctgcac

SEQ ID NO: 327686 - DNA, 15 bp, Homo sapiens
ccggaatgctgcacc

SEQ ID NO: 327687 - DNA, 15 bp, Homo sapiens
cggaatgctgcacct

SEQ ID NO: 327688 - DNA, 15 bp, Homo sapiens
ggaatgctgcacctg

SEQ ID NO: 327689 - DNA, 15 bp, Homo sapiens
gaatgctgcacctgt

SEQ ID NO: 327690 - DNA, 15 bp, Homo sapiens
aatgctgcacctgtt

SEQ ID NO: 327691 - DNA, 15 bp, Homo sapiens
atgctgcacctgttg

SEQ ID NO: 327692 - DNA, 15 bp, Homo sapiens
tgctgcacctgttgc

SEQ ID NO: 327693 - DNA, 15 bp, Homo sapiens
gctgcacctgttgct

SEQ ID NO: 327694 - DNA, 15 bp, Homo sapiens
ctgcacctgttgctg

SEQ ID NO: 327695 - DNA, 15 bp, Homo sapiens
tgcacctgttgctgg

SEQ ID NO: 327696 - DNA, 15 bp, Homo sapiens
gcacctgttgctggc

SEQ ID NO: 327697 - DNA, 15 bp, Homo sapiens
cacctgttgctggct

SEQ ID NO: 327698 - DNA, 15 bp, Homo sapiens
acctgttgctggcta

SEQ ID NO: 327699 - DNA, 15 bp, Homo sapiens
cctgttgctggctat

SEQ ID NO: 327700 - DNA, 15 bp, Homo sapiens
ctgttgctggctatt

SEQ ID NO: 327701 - DNA, 15 bp, Homo sapiens
tgttgctggctattc

SEQ ID NO: 327702 - DNA, 15 bp, Homo sapiens
gttgctggctattct

SEQ ID NO: 327703 - DNA, 15 bp, Homo sapiens
ttgctggctattctt

SEQ ID NO: 327704 - DNA, 15 bp, Homo sapiens
tgctggctattcttg

SEQ ID NO: 327705 - DNA, 15 bp, Homo sapiens
gctggctattcttgc

SEQ ID NO: 327706 - DNA, 15 bp, Homo sapiens
ctggctattcttgca

SEQ ID NO: 327707 - DNA, 15 bp, Homo sapiens
tggctattcttgcat

SEQ ID NO: 327708 - DNA, 15 bp, Homo sapiens
ggctattcttgcata

SEQ ID NO: 327709 - DNA, 15 bp, Homo sapiens
gctattcttgcatat

SEQ ID NO: 327710 - DNA, 15 bp, Homo sapiens
ctattcttgcatatg

SEQ ID NO: 327711 - DNA, 15 bp, Homo sapiens
tattcttgcatatga

SEQ ID NO: 327712 - DNA, 15 bp, Homo sapiens
attcttgcatatgaa

SEQ ID NO: 327713 - DNA, 15 bp, Homo sapiens
ttcttgcatatgaaa

SEQ ID NO: 327714 - DNA, 15 bp, Homo sapiens
tcttgcatatgaaat

SEQ ID NO: 327715 - DNA, 15 bp, Homo sapiens
cttgcatatgaaatc

SEQ ID NO: 327716 - DNA, 15 bp, Homo sapiens
ttgcatatgaaatcc

SEQ ID NO: 327717 - DNA, 15 bp, Homo sapiens
tgcatatgaaatcca

SEQ ID NO: 327718 - DNA, 15 bp, Homo sapiens
gcatatgaaatccag

SEQ ID NO: 327719 - DNA, 15 bp, Homo sapiens
catatgaaatccaga

SEQ ID NO: 327720 - DNA, 15 bp, Homo sapiens
atatgaaatccagac

SEQ ID NO: 327721 - DNA, 15 bp, Homo sapiens
tatgaaatccagacc

SEQ ID NO: 327722 - DNA, 15 bp, Homo sapiens
atgaaatccagaccc

SEQ ID NO: 327723 - DNA, 15 bp, Homo sapiens
tgaaatccagaccct

SEQ ID NO: 327724 - DNA, 15 bp, Homo sapiens
gaaatccagacccta

SEQ ID NO: 327725 - DNA, 15 bp, Homo sapiens
aaatccagaccctag

SEQ ID NO: 327726 - DNA, 15 bp, Homo sapiens
aatccagaccctaga

SEQ ID NO: 327727 - DNA, 15 bp, Homo sapiens
atccagaccctagag

SEQ ID NO: 327728 - DNA, 15 bp, Homo sapiens
tccagaccctagagt

SEQ ID NO: 327729 - DNA, 15 bp, Homo sapiens
ccagaccctagagtc

SEQ ID NO: 327730 - DNA, 15 bp, Homo sapiens
cagaccctagagtca

SEQ ID NO: 327731 - DNA, 15 bp, Homo sapiens
agaccctagagtcac

SEQ ID NO: 327732 - DNA, 15 bp, Homo sapiens
gaccctagagtcact

SEQ ID NO: 327733 - DNA, 15 bp, Homo sapiens
accctagagtcactt

SEQ ID NO: 327734 - DNA, 15 bp, Homo sapiens
ccctagagtcacttg

SEQ ID NO: 327735 - DNA, 15 bp, Homo sapiens
cctagagtcacttgc

SEQ ID NO: 327736 - DNA, 15 bp, Homo sapiens
ctagagtcacttgct

SEQ ID NO: 327737 - DNA, 15 bp, Homo sapiens
tagagtcacttgctt

SEQ ID NO: 327738 - DNA, 15 bp, Homo sapiens
agagtcacttgcttt

SEQ ID NO: 327739 - DNA, 15 bp, Homo sapiens
gagtcacttgctttc

SEQ ID NO: 327740 - DNA, 15 bp, Homo sapiens
agtcacttgctttca

SEQ ID NO: 327741 - DNA, 15 bp, Homo sapiens
gtcacttgctttcat

SEQ ID NO: 327742 - DNA, 15 bp, Homo sapiens
tcacttgctttcatt

SEQ ID NO: 327743 - DNA, 15 bp, Homo sapiens
cacttgctttcattt

SEQ ID NO: 327744 - DNA, 15 bp, Homo sapiens
acttgctttcatttc

SEQ ID NO: 327745 - DNA, 15 bp, Homo sapiens
cttgctttcatttcc

SEQ ID NO: 327746 - DNA, 15 bp, Homo sapiens
ttgctttcatttcct

SEQ ID NO: 327747 - DNA, 15 bp, Homo sapiens
tgctttcatttcctt

SEQ ID NO: 327748 - DNA, 15 bp, Homo sapiens
gctttcatttccttt

SEQ ID NO: 327749 - DNA, 15 bp, Homo sapiens
ctttcatttcctttt

SEQ ID NO: 327750 - DNA, 15 bp, Homo sapiens
tttcatttccttttc

SEQ ID NO: 327751 - DNA, 15 bp, Homo sapiens
ttcatttccttttcc

SEQ ID NO: 327752 - DNA, 15 bp, Homo sapiens
tcatttccttttcct

SEQ ID NO: 327753 - DNA, 15 bp, Homo sapiens
catttccttttcctc

SEQ ID NO: 327754 - DNA, 15 bp, Homo sapiens
atttccttttcctcc

SEQ ID NO: 327755 - DNA, 15 bp, Homo sapiens
tttccttttcctcct

SEQ ID NO: 327756 - DNA, 15 bp, Homo sapiens
ttccttttcctcctc

SEQ ID NO: 327757 - DNA, 15 bp, Homo sapiens
tccttttcctcctcc

SEQ ID NO: 327758 - DNA, 15 bp, Homo sapiens
ccttttcctcctccc

SEQ ID NO: 327759 - DNA, 15 bp, Homo sapiens
cttttcctcctccct

SEQ ID NO: 327760 - DNA, 15 bp, Homo sapiens
ttttcctcctccctc

SEQ ID NO: 327761 - DNA, 15 bp, Homo sapiens
tttcctcctccctct

SEQ ID NO: 327762 - DNA, 15 bp, Homo sapiens
ttcctcctccctctt

SEQ ID NO: 327763 - DNA, 15 bp, Homo sapiens
tcctcctccctcttt

SEQ ID NO: 327764 - DNA, 15 bp, Homo sapiens
cctcctccctctttc

SEQ ID NO: 327765 - DNA, 15 bp, Homo sapiens
ctcctccctctttcc

SEQ ID NO: 327766 - DNA, 15 bp, Homo sapiens
tcctccctctttccg

SEQ ID NO: 327767 - DNA, 15 bp, Homo sapiens
cctccctctttccgg

SEQ ID NO: 327768 - DNA, 15 bp, Homo sapiens
ctccctctttccggt

SEQ ID NO: 327769 - DNA, 15 bp, Homo sapiens
tccctctttccggtg

SEQ ID NO: 327770 - DNA, 15 bp, Homo sapiens
ccctctttccggtgt

SEQ ID NO: 327771 - DNA, 15 bp, Homo sapiens
cctctttccggtgtg

SEQ ID NO: 327772 - DNA, 15 bp, Homo sapiens
ctctttccggtgtgt

SEQ ID NO: 327773 - DNA, 15 bp, Homo sapiens
tctttccggtgtgtg

SEQ ID NO: 327774 - DNA, 15 bp, Homo sapiens
ctttccggtgtgtgt

SEQ ID NO: 327775 - DNA, 15 bp, Homo sapiens
tttccggtgtgtgtt

SEQ ID NO: 327776 - DNA, 15 bp, Homo sapiens
ttccggtgtgtgttt

SEQ ID NO: 327777 - DNA, 15 bp, Homo sapiens
tccggtgtgtgtttg

SEQ ID NO: 327778 - DNA, 15 bp, Homo sapiens
ccggtgtgtgtttgg

SEQ ID NO: 327779 - DNA, 15 bp, Homo sapiens
cggtgtgtgtttggg

SEQ ID NO: 327780 - DNA, 15 bp, Homo sapiens
ggtgtgtgtttgggg

SEQ ID NO: 327781 - DNA, 15 bp, Homo sapiens
gtgtgtgtttggggg

SEQ ID NO: 327782 - DNA, 15 bp, Homo sapiens
tgtgtgtttgggggg

SEQ ID NO: 327783 - DNA, 15 bp, Homo sapiens
gtgtgtttggggggg

SEQ ID NO: 327784 - DNA, 15 bp, Homo sapiens
tgtgtttgggggggg

SEQ ID NO: 327785 - DNA, 15 bp, Homo sapiens
gtgtttggggggggt

SEQ ID NO: 327786 - DNA, 15 bp, Homo sapiens
tgtttggggggggtg

SEQ ID NO: 327787 - DNA, 15 bp, Homo sapiens
gtttggggggggtgg

SEQ ID NO: 327788 - DNA, 15 bp, Homo sapiens
tttggggggggtggg

SEQ ID NO: 327789 - DNA, 15 bp, Homo sapiens
ttggggggggtgggg

SEQ ID NO: 327790 - DNA, 15 bp, Homo sapiens
tggggggggtggggg

SEQ ID NO: 327791 - DNA, 15 bp, Homo sapiens
ggggggggtgggggt

SEQ ID NO: 327792 - DNA, 15 bp, Homo sapiens
gggggggtgggggtg

SEQ ID NO: 327793 - DNA, 15 bp, Homo sapiens
ggggggtgggggtgg

SEQ ID NO: 327794 - DNA, 15 bp, Homo sapiens
gggggtgggggtggt

SEQ ID NO: 327795 - DNA, 15 bp, Homo sapiens
ggggtgggggtggtg

SEQ ID NO: 327796 - DNA, 15 bp, Homo sapiens
gggtgggggtggtga

SEQ ID NO: 327797 - DNA, 15 bp, Homo sapiens
ggtgggggtggtgag

SEQ ID NO: 327798 - DNA, 15 bp, Homo sapiens
gtgggggtggtgagg

SEQ ID NO: 327799 - DNA, 15 bp, Homo sapiens
tgggggtggtgaggc

SEQ ID NO: 327800 - DNA, 15 bp, Homo sapiens
gggggtggtgaggca

SEQ ID NO: 327801 - DNA, 15 bp, Homo sapiens
ggggtggtgaggcag

SEQ ID NO: 327802 - DNA, 15 bp, Homo sapiens
gggtggtgaggcagg

SEQ ID NO: 327803 - DNA, 15 bp, Homo sapiens
ggtggtgaggcaggg

SEQ ID NO: 327804 - DNA, 15 bp, Homo sapiens
gtggtgaggcagggt

SEQ ID NO: 327805 - DNA, 15 bp, Homo sapiens
tggtgaggcagggtg

SEQ ID NO: 327806 - DNA, 15 bp, Homo sapiens
ggtgaggcagggtgg

SEQ ID NO: 327807 - DNA, 15 bp, Homo sapiens
gtgaggcagggtggg

SEQ ID NO: 327808 - DNA, 15 bp, Homo sapiens
tgaggcagggtgggg

SEQ ID NO: 327809 - DNA, 15 bp, Homo sapiens
gaggcagggtggggg

SEQ ID NO: 327810 - DNA, 15 bp, Homo sapiens
aggcagggtgggggc

SEQ ID NO: 327811 - DNA, 15 bp, Homo sapiens
ggcagggtgggggca

SEQ ID NO: 327812 - DNA, 15 bp, Homo sapiens
gcagggtgggggcag

SEQ ID NO: 327813 - DNA, 15 bp, Homo sapiens
cagggtgggggcagc

SEQ ID NO: 327814 - DNA, 15 bp, Homo sapiens
agggtgggggcagca

SEQ ID NO: 327815 - DNA, 15 bp, Homo sapiens
gggtgggggcagcag

SEQ ID NO: 327816 - DNA, 15 bp, Homo sapiens
ggtgggggcagcaga

SEQ ID NO: 327817 - DNA, 15 bp, Homo sapiens
gtgggggcagcagat

SEQ ID NO: 327818 - DNA, 15 bp, Homo sapiens
tgggggcagcagatt

SEQ ID NO: 327819 - DNA, 15 bp, Homo sapiens
gggggcagcagatta

SEQ ID NO: 327820 - DNA, 15 bp, Homo sapiens
ggggcagcagattag

SEQ ID NO: 327821 - DNA, 15 bp, Homo sapiens
gggcagcagattagt

SEQ ID NO: 327822 - DNA, 15 bp, Homo sapiens
ggcagcagattagta

SEQ ID NO: 327823 - DNA, 15 bp, Homo sapiens
gcagcagattagtag

SEQ ID NO: 327824 - DNA, 15 bp, Homo sapiens
cagcagattagtagc

SEQ ID NO: 327825 - DNA, 15 bp, Homo sapiens
agcagattagtagct

SEQ ID NO: 327826 - DNA, 15 bp, Homo sapiens
gcagattagtagctt

SEQ ID NO: 327827 - DNA, 15 bp, Homo sapiens
cagattagtagcttc

SEQ ID NO: 327828 - DNA, 15 bp, Homo sapiens
agattagtagcttct

SEQ ID NO: 327829 - DNA, 15 bp, Homo sapiens
gattagtagcttctg

SEQ ID NO: 327830 - DNA, 15 bp, Homo sapiens
attagtagcttctgt

SEQ ID NO: 327831 - DNA, 15 bp, Homo sapiens
ttagtagcttctgtg

SEQ ID NO: 327832 - DNA, 15 bp, Homo sapiens
tagtagcttctgtga

SEQ ID NO: 327833 - DNA, 15 bp, Homo sapiens
agtagcttctgtgaa

SEQ ID NO: 327834 - DNA, 15 bp, Homo sapiens
gtagcttctgtgaag

SEQ ID NO: 327835 - DNA, 15 bp, Homo sapiens
tagcttctgtgaaga

SEQ ID NO: 327836 - DNA, 15 bp, Homo sapiens
agcttctgtgaagag

SEQ ID NO: 327837 - DNA, 15 bp, Homo sapiens
gcttctgtgaagagt

SEQ ID NO: 327838 - DNA, 15 bp, Homo sapiens
cttctgtgaagagta

SEQ ID NO: 327839 - DNA, 15 bp, Homo sapiens
ttctgtgaagagtaa

SEQ ID NO: 327840 - DNA, 15 bp, Homo sapiens
tctgtgaagagtaac

SEQ ID NO: 327841 - DNA, 15 bp, Homo sapiens
ctgtgaagagtaacc

SEQ ID NO: 327842 - DNA, 15 bp, Homo sapiens
tgtgaagagtaacca

SEQ ID NO: 327843 - DNA, 15 bp, Homo sapiens
gtgaagagtaaccac

SEQ ID NO: 327844 - DNA, 15 bp, Homo sapiens
tgaagagtaaccacc

SEQ ID NO: 327845 - DNA, 15 bp, Homo sapiens
gaagagtaaccacct

SEQ ID NO: 327846 - DNA, 15 bp, Homo sapiens
aagagtaaccacctt

SEQ ID NO: 327847 - DNA, 15 bp, Homo sapiens
agagtaaccaccttc

SEQ ID NO: 327848 - DNA, 15 bp, Homo sapiens
gagtaaccaccttcc

SEQ ID NO: 327849 - DNA, 15 bp, Homo sapiens
agtaaccaccttcct

SEQ ID NO: 327850 - DNA, 15 bp, Homo sapiens
gtaaccaccttcctg

SEQ ID NO: 327851 - DNA, 15 bp, Homo sapiens
taaccaccttcctgt

SEQ ID NO: 327852 - DNA, 15 bp, Homo sapiens
aaccaccttcctgtt

SEQ ID NO: 327853 - DNA, 15 bp, Homo sapiens
accaccttcctgttc

SEQ ID NO: 327854 - DNA, 15 bp, Homo sapiens
ccaccttcctgttcc

SEQ ID NO: 327855 - DNA, 15 bp, Homo sapiens
caccttcctgttccg

SEQ ID NO: 327856 - DNA, 15 bp, Homo sapiens
accttcctgttccgt

SEQ ID NO: 327857 - DNA, 15 bp, Homo sapiens
ccttcctgttccgtc

SEQ ID NO: 327858 - DNA, 15 bp, Homo sapiens
cttcctgttccgtca

SEQ ID NO: 327859 - DNA, 15 bp, Homo sapiens
ttcctgttccgtcaa

SEQ ID NO: 327860 - DNA, 15 bp, Homo sapiens
tcctgttccgtcaag

SEQ ID NO: 327861 - DNA, 15 bp, Homo sapiens
cctgttccgtcaagg

SEQ ID NO: 327862 - DNA, 15 bp, Homo sapiens
ctgttccgtcaaggc

SEQ ID NO: 327863 - DNA, 15 bp, Homo sapiens
tgttccgtcaaggct

SEQ ID NO: 327864 - DNA, 15 bp, Homo sapiens
gttccgtcaaggcta

SEQ ID NO: 327865 - DNA, 15 bp, Homo sapiens
ttccgtcaaggctat

SEQ ID NO: 327866 - DNA, 15 bp, Homo sapiens
tccgtcaaggctatg

SEQ ID NO: 327867 - DNA, 15 bp, Homo sapiens
ccgtcaaggctatga

SEQ ID NO: 327868 - DNA, 15 bp, Homo sapiens
cgtcaaggctatgat

SEQ ID NO: 327869 - DNA, 15 bp, Homo sapiens
gtcaaggctatgatt

SEQ ID NO: 327870 - DNA, 15 bp, Homo sapiens
tcaaggctatgattt

SEQ ID NO: 327871 - DNA, 15 bp, Homo sapiens
caaggctatgatttt

SEQ ID NO: 327872 - DNA, 15 bp, Homo sapiens
aaggctatgatttta

SEQ ID NO: 327873 - DNA, 15 bp, Homo sapiens
aggctatgattttag

SEQ ID NO: 327874 - DNA, 15 bp, Homo sapiens
ggctatgattttagc

SEQ ID NO: 327875 - DNA, 15 bp, Homo sapiens
gctatgattttagcg

SEQ ID NO: 327876 - DNA, 15 bp, Homo sapiens
ctatgattttagcgc

SEQ ID NO: 327877 - DNA, 15 bp, Homo sapiens
tatgattttagcgcc

SEQ ID NO: 327878 - DNA, 15 bp, Homo sapiens
atgattttagcgccc

SEQ ID NO: 327879 - DNA, 15 bp, Homo sapiens
tgattttagcgcccc

SEQ ID NO: 327880 - DNA, 15 bp, Homo sapiens
gattttagcgccccc

SEQ ID NO: 327881 - DNA, 15 bp, Homo sapiens
attttagcgcccccg

SEQ ID NO: 327882 - DNA, 15 bp, Homo sapiens
ttttagcgcccccgg

SEQ ID NO: 327883 - DNA, 15 bp, Homo sapiens
tttagcgcccccggg

SEQ ID NO: 327884 - DNA, 15 bp, Homo sapiens
ttagcgcccccggga

SEQ ID NO: 327885 - DNA, 15 bp, Homo sapiens
tagcgcccccgggag

SEQ ID NO: 327886 - DNA, 15 bp, Homo sapiens
agcgcccccgggagt

SEQ ID NO: 327887 - DNA, 15 bp, Homo sapiens
gcgcccccgggagtg

SEQ ID NO: 327888 - DNA, 15 bp, Homo sapiens
cgcccccgggagtgg

SEQ ID NO: 327889 - DNA, 15 bp, Homo sapiens
gcccccgggagtggt

SEQ ID NO: 327890 - DNA, 15 bp, Homo sapiens
cccccgggagtggta

SEQ ID NO: 327891 - DNA, 15 bp, Homo sapiens
ccccgggagtggtag

SEQ ID NO: 327892 - DNA, 15 bp, Homo sapiens
cccgggagtggtagt

SEQ ID NO: 327893 - DNA, 15 bp, Homo sapiens
ccgggagtggtagtg

SEQ ID NO: 327894 - DNA, 15 bp, Homo sapiens
cgggagtggtagtgt

SEQ ID NO: 327895 - DNA, 15 bp, Homo sapiens
gggagtggtagtgtt

SEQ ID NO: 327896 - DNA, 15 bp, Homo sapiens
ggagtggtagtgttg

SEQ ID NO: 327897 - DNA, 15 bp, Homo sapiens
gagtggtagtgttgc

SEQ ID NO: 327898 - DNA, 15 bp, Homo sapiens
agtggtagtgttgcg

SEQ ID NO: 327899 - DNA, 15 bp, Homo sapiens
gtggtagtgttgcgt

SEQ ID NO: 327900 - DNA, 15 bp, Homo sapiens
tggtagtgttgcgtc

SEQ ID NO: 327901 - DNA, 15 bp, Homo sapiens
ggtagtgttgcgtca

SEQ ID NO: 327902 - DNA, 15 bp, Homo sapiens
gtagtgttgcgtcac

SEQ ID NO: 327903 - DNA, 15 bp, Homo sapiens
tagtgttgcgtcact

SEQ ID NO: 327904 - DNA, 15 bp, Homo sapiens
agtgttgcgtcactc

SEQ ID NO: 327905 - DNA, 15 bp, Homo sapiens
gtgttgcgtcactct

SEQ ID NO: 327906 - DNA, 15 bp, Homo sapiens
tgttgcgtcactctg

SEQ ID NO: 327907 - DNA, 15 bp, Homo sapiens
gttgcgtcactctgt

SEQ ID NO: 327908 - DNA, 15 bp, Homo sapiens
ttgcgtcactctgtc

SEQ ID NO: 327909 - DNA, 15 bp, Homo sapiens
tgcgtcactctgtca

SEQ ID NO: 327910 - DNA, 15 bp, Homo sapiens
gcgtcactctgtcat

SEQ ID NO: 327911 - DNA, 15 bp, Homo sapiens
cgtcactctgtcatc

SEQ ID NO: 327912 - DNA, 15 bp, Homo sapiens
gtcactctgtcatct

SEQ ID NO: 327913 - DNA, 15 bp, Homo sapiens
tcactctgtcatctg

SEQ ID NO: 327914 - DNA, 15 bp, Homo sapiens
cactctgtcatctgt

SEQ ID NO: 327915 - DNA, 15 bp, Homo sapiens
actctgtcatctgtc

SEQ ID NO: 327916 - DNA, 15 bp, Homo sapiens
ctctgtcatctgtcg

SEQ ID NO: 327917 - DNA, 15 bp, Homo sapiens
tctgtcatctgtcgc

SEQ ID NO: 327918 - DNA, 15 bp, Homo sapiens
ctgtcatctgtcgcc

SEQ ID NO: 327919 - DNA, 15 bp, Homo sapiens
tgtcatctgtcgccg

SEQ ID NO: 327920 - DNA, 15 bp, Homo sapiens
gtcatctgtcgccga

SEQ ID NO: 327921 - DNA, 15 bp, Homo sapiens
tcatctgtcgccgaa

SEQ ID NO: 327922 - DNA, 15 bp, Homo sapiens
catctgtcgccgaaa

SEQ ID NO: 327923 - DNA, 15 bp, Homo sapiens
atctgtcgccgaaag

SEQ ID NO: 327924 - DNA, 15 bp, Homo sapiens
tctgtcgccgaaaga

SEQ ID NO: 327925 - DNA, 15 bp, Homo sapiens
ctgtcgccgaaagac

SEQ ID NO: 327926 - DNA, 15 bp, Homo sapiens
tgtcgccgaaagact

SEQ ID NO: 327927 - DNA, 15 bp, Homo sapiens
gtcgccgaaagactc

SEQ ID NO: 327928 - DNA, 15 bp, Homo sapiens
tcgccgaaagactca

SEQ ID NO: 327929 - DNA, 15 bp, Homo sapiens
cgccgaaagactcat

SEQ ID NO: 327930 - DNA, 15 bp, Homo sapiens
gccgaaagactcata

SEQ ID NO: 327931 - DNA, 15 bp, Homo sapiens
ccgaaagactcataa

SEQ ID NO: 327932 - DNA, 15 bp, Homo sapiens
cgaaagactcataat

SEQ ID NO: 327933 - DNA, 15 bp, Homo sapiens
gaaagactcataatc

SEQ ID NO: 327934 - DNA, 15 bp, Homo sapiens
aaagactcataatcc

SEQ ID NO: 327935 - DNA, 15 bp, Homo sapiens
aagactcataatccg

SEQ ID NO: 327936 - DNA, 15 bp, Homo sapiens
agactcataatccgg

SEQ ID NO: 327937 - DNA, 15 bp, Homo sapiens
gactcataatccggg

SEQ ID NO: 327938 - DNA, 15 bp, Homo sapiens
actcataatccgggc

SEQ ID NO: 327939 - DNA, 15 bp, Homo sapiens
ctcataatccgggca

SEQ ID NO: 327940 - DNA, 15 bp, Homo sapiens
tcataatccgggcag

SEQ ID NO: 327941 - DNA, 15 bp, Homo sapiens
cataatccgggcagc

SEQ ID NO: 327942 - DNA, 15 bp, Homo sapiens
ataatccgggcagcc

SEQ ID NO: 327943 - DNA, 15 bp, Homo sapiens
taatccgggcagcct

SEQ ID NO: 327944 - DNA, 15 bp, Homo sapiens
aatccgggcagcctc

SEQ ID NO: 327945 - DNA, 15 bp, Homo sapiens
atccgggcagcctca

SEQ ID NO: 327946 - DNA, 15 bp, Homo sapiens
tccgggcagcctcaa

SEQ ID NO: 327947 - DNA, 15 bp, Homo sapiens
ccgggcagcctcaag

SEQ ID NO: 327948 - DNA, 15 bp, Homo sapiens
cgggcagcctcaaga

SEQ ID NO: 327949 - DNA, 15 bp, Homo sapiens
gggcagcctcaagag

SEQ ID NO: 327950 - DNA, 15 bp, Homo sapiens
ggcagcctcaagagt

SEQ ID NO: 327951 - DNA, 15 bp, Homo sapiens
gcagcctcaagagtt

SEQ ID NO: 327952 - DNA, 15 bp, Homo sapiens
cagcctcaagagttt

SEQ ID NO: 327953 - DNA, 15 bp, Homo sapiens
agcctcaagagtttg

SEQ ID NO: 327954 - DNA, 15 bp, Homo sapiens
gcctcaagagtttga

SEQ ID NO: 327955 - DNA, 15 bp, Homo sapiens
cctcaagagtttgag

SEQ ID NO: 327956 - DNA, 15 bp, Homo sapiens
ctcaagagtttgagg

SEQ ID NO: 327957 - DNA, 15 bp, Homo sapiens
tcaagagtttgaggc

SEQ ID NO: 327958 - DNA, 15 bp, Homo sapiens
caagagtttgaggcg

SEQ ID NO: 327959 - DNA, 15 bp, Homo sapiens
aagagtttgaggcgt

SEQ ID NO: 327960 - DNA, 15 bp, Homo sapiens
agagtttgaggcgtg

SEQ ID NO: 327961 - DNA, 15 bp, Homo sapiens
gagtttgaggcgtgg

SEQ ID NO: 327962 - DNA, 15 bp, Homo sapiens
agtttgaggcgtggg

SEQ ID NO: 327963 - DNA, 15 bp, Homo sapiens
gtttgaggcgtgggt

SEQ ID NO: 327964 - DNA, 15 bp, Homo sapiens
tttgaggcgtgggtt

SEQ ID NO: 327965 - DNA, 15 bp, Homo sapiens
ttgaggcgtgggttt

SEQ ID NO: 327966 - DNA, 15 bp, Homo sapiens
tgaggcgtgggtttg

SEQ ID NO: 327967 - DNA, 15 bp, Homo sapiens
gaggcgtgggtttgt

SEQ ID NO: 327968 - DNA, 15 bp, Homo sapiens
aggcgtgggtttgtg

SEQ ID NO: 327969 - DNA, 15 bp, Homo sapiens
ggcgtgggtttgtgc

SEQ ID NO: 327970 - DNA, 15 bp, Homo sapiens
gcgtgggtttgtgcc

SEQ ID NO: 327971 - DNA, 15 bp, Homo sapiens
cgtgggtttgtgccc

SEQ ID NO: 327972 - DNA, 15 bp, Homo sapiens
gtgggtttgtgcccg

SEQ ID NO: 327973 - DNA, 15 bp, Homo sapiens
tgggtttgtgcccga

SEQ ID NO: 327974 - DNA, 15 bp, Homo sapiens
gggtttgtgcccgag

SEQ ID NO: 327975 - DNA, 15 bp, Homo sapiens
ggtttgtgcccgagt

SEQ ID NO: 327976 - DNA, 15 bp, Homo sapiens
gtttgtgcccgagtt

SEQ ID NO: 327977 - DNA, 15 bp, Homo sapiens
tttgtgcccgagttt

SEQ ID NO: 327978 - DNA, 15 bp, Homo sapiens
ttgtgcccgagtttg

SEQ ID NO: 327979 - DNA, 15 bp, Homo sapiens
tgtgcccgagtttgg

SEQ ID NO: 327980 - DNA, 15 bp, Homo sapiens
gtgcccgagtttggg

SEQ ID NO: 327981 - DNA, 15 bp, Homo sapiens
tgcccgagtttgggg

SEQ ID NO: 327982 - DNA, 15 bp, Homo sapiens
gcccgagtttggggt

SEQ ID NO: 327983 - DNA, 15 bp, Homo sapiens
cccgagtttggggtt

SEQ ID NO: 327984 - DNA, 15 bp, Homo sapiens
ccgagtttggggttc

SEQ ID NO: 327985 - DNA, 15 bp, Homo sapiens
cgagtttggggttct

SEQ ID NO: 327986 - DNA, 15 bp, Homo sapiens
gagtttggggttcta

SEQ ID NO: 327987 - DNA, 15 bp, Homo sapiens
agtttggggttctag

SEQ ID NO: 327988 - DNA, 15 bp, Homo sapiens
gtttggggttctagg

SEQ ID NO: 327989 - DNA, 15 bp, Homo sapiens
tttggggttctaggg

SEQ ID NO: 327990 - DNA, 15 bp, Homo sapiens
ttggggttctagggg

SEQ ID NO: 327991 - DNA, 15 bp, Homo sapiens
tggggttctagggga

SEQ ID NO: 327992 - DNA, 15 bp, Homo sapiens
ggggttctaggggag

SEQ ID NO: 327993 - DNA, 15 bp, Homo sapiens
gggttctaggggagg

SEQ ID NO: 327994 - DNA, 15 bp, Homo sapiens
ggttctaggggaggg

SEQ ID NO: 327995 - DNA, 15 bp, Homo sapiens
gttctaggggagggg

SEQ ID NO: 327996 - DNA, 15 bp, Homo sapiens
ttctaggggaggggt

SEQ ID NO: 327997 - DNA, 15 bp, Homo sapiens
tctaggggaggggtg

SEQ ID NO: 327998 - DNA, 15 bp, Homo sapiens
ctaggggaggggtga

SEQ ID NO: 327999 - DNA, 15 bp, Homo sapiens
taggggaggggtgaa

SEQ ID NO: 328000 - DNA, 15 bp, Homo sapiens
aggggaggggtgaag

SEQ ID NO: 328001 - DNA, 15 bp, Homo sapiens
ggggaggggtgaagt

SEQ ID NO: 328002 - DNA, 15 bp, Homo sapiens
gggaggggtgaagtg

SEQ ID NO: 328003 - DNA, 15 bp, Homo sapiens
ggaggggtgaagtgg

SEQ ID NO: 328004 - DNA, 15 bp, Homo sapiens
gaggggtgaagtgga

SEQ ID NO: 328005 - DNA, 15 bp, Homo sapiens
aggggtgaagtggaa

SEQ ID NO: 328006 - DNA, 15 bp, Homo sapiens
ggggtgaagtggaac

SEQ ID NO: 328007 - DNA, 15 bp, Homo sapiens
gggtgaagtggaaca

SEQ ID NO: 328008 - DNA, 15 bp, Homo sapiens
ggtgaagtggaacag

SEQ ID NO: 328009 - DNA, 15 bp, Homo sapiens
gtgaagtggaacagg

SEQ ID NO: 328010 - DNA, 15 bp, Homo sapiens
tgaagtggaacaggc

SEQ ID NO: 328011 - DNA, 15 bp, Homo sapiens
gaagtggaacaggct

SEQ ID NO: 328012 - DNA, 15 bp, Homo sapiens
aagtggaacaggctt

SEQ ID NO: 328013 - DNA, 15 bp, Homo sapiens
agtggaacaggcttt

SEQ ID NO: 328014 - DNA, 15 bp, Homo sapiens
gtggaacaggctttc

SEQ ID NO: 328015 - DNA, 15 bp, Homo sapiens
tggaacaggctttca

SEQ ID NO: 328016 - DNA, 15 bp, Homo sapiens
ggaacaggctttcag

SEQ ID NO: 328017 - DNA, 15 bp, Homo sapiens
gaacaggctttcagc

SEQ ID NO: 328018 - DNA, 15 bp, Homo sapiens
aacaggctttcagca

SEQ ID NO: 328019 - DNA, 15 bp, Homo sapiens
acaggctttcagcag

SEQ ID NO: 328020 - DNA, 15 bp, Homo sapiens
caggctttcagcagc

SEQ ID NO: 328021 - DNA, 15 bp, Homo sapiens
aggctttcagcagct

SEQ ID NO: 328022 - DNA, 15 bp, Homo sapiens
ggctttcagcagctg

SEQ ID NO: 328023 - DNA, 15 bp, Homo sapiens
gctttcagcagctgc

SEQ ID NO: 328024 - DNA, 15 bp, Homo sapiens
ctttcagcagctgct

SEQ ID NO: 328025 - DNA, 15 bp, Homo sapiens
tttcagcagctgctg

SEQ ID NO: 328026 - DNA, 15 bp, Homo sapiens
ttcagcagctgctgc

SEQ ID NO: 328027 - DNA, 15 bp, Homo sapiens
tcagcagctgctgcc

SEQ ID NO: 328028 - DNA, 15 bp, Homo sapiens
cagcagctgctgccg

SEQ ID NO: 328029 - DNA, 15 bp, Homo sapiens
agcagctgctgccgc

SEQ ID NO: 328030 - DNA, 15 bp, Homo sapiens
gcagctgctgccgcc

SEQ ID NO: 328031 - DNA, 15 bp, Homo sapiens
cagctgctgccgcca

SEQ ID NO: 328032 - DNA, 15 bp, Homo sapiens
agctgctgccgccac

SEQ ID NO: 328033 - DNA, 15 bp, Homo sapiens
gctgctgccgccacc

SEQ ID NO: 328034 - DNA, 15 bp, Homo sapiens
ctgctgccgccacct

SEQ ID NO: 328035 - DNA, 15 bp, Homo sapiens
tgctgccgccacctg

SEQ ID NO: 328036 - DNA, 15 bp, Homo sapiens
gctgccgccacctga

SEQ ID NO: 328037 - DNA, 15 bp, Homo sapiens
ctgccgccacctgat

SEQ ID NO: 328038 - DNA, 15 bp, Homo sapiens
tgccgccacctgata

SEQ ID NO: 328039 - DNA, 15 bp, Homo sapiens
gccgccacctgatac

SEQ ID NO: 328040 - DNA, 15 bp, Homo sapiens
ccgccacctgatacc

SEQ ID NO: 328041 - DNA, 15 bp, Homo sapiens
cgccacctgatacct

SEQ ID NO: 328042 - DNA, 15 bp, Homo sapiens
gccacctgatacctg

SEQ ID NO: 328043 - DNA, 15 bp, Homo sapiens
ccacctgatacctgg

SEQ ID NO: 328044 - DNA, 15 bp, Homo sapiens
cacctgatacctgga

SEQ ID NO: 328045 - DNA, 15 bp, Homo sapiens
acctgatacctggaa

SEQ ID NO: 328046 - DNA, 15 bp, Homo sapiens
cctgatacctggaac

SEQ ID NO: 328047 - DNA, 15 bp, Homo sapiens
ctgatacctggaacc

SEQ ID NO: 328048 - DNA, 15 bp, Homo sapiens
tgatacctggaacct

SEQ ID NO: 328049 - DNA, 15 bp, Homo sapiens
gatacctggaacctt

SEQ ID NO: 328050 - DNA, 15 bp, Homo sapiens
atacctggaacctta

SEQ ID NO: 328051 - DNA, 15 bp, Homo sapiens
tacctggaaccttac

SEQ ID NO: 328052 - DNA, 15 bp, Homo sapiens
acctggaaccttact

SEQ ID NO: 328053 - DNA, 15 bp, Homo sapiens
cctggaaccttactg

SEQ ID NO: 328054 - DNA, 15 bp, Homo sapiens
ctggaaccttactgc

SEQ ID NO: 328055 - DNA, 15 bp, Homo sapiens
tggaaccttactgct

SEQ ID NO: 328056 - DNA, 15 bp, Homo sapiens
ggaaccttactgcta

SEQ ID NO: 328057 - DNA, 15 bp, Homo sapiens
gaaccttactgctat

SEQ ID NO: 328058 - DNA, 15 bp, Homo sapiens
aaccttactgctatt

SEQ ID NO: 328059 - DNA, 15 bp, Homo sapiens
accttactgctattg

SEQ ID NO: 328060 - DNA, 15 bp, Homo sapiens
ccttactgctattga

SEQ ID NO: 328061 - DNA, 15 bp, Homo sapiens
cttactgctattgag

SEQ ID NO: 328062 - DNA, 15 bp, Homo sapiens
ttactgctattgagg

SEQ ID NO: 328063 - DNA, 15 bp, Homo sapiens
tactgctattgagga

SEQ ID NO: 328064 - DNA, 15 bp, Homo sapiens
actgctattgaggaa

SEQ ID NO: 328065 - DNA, 15 bp, Homo sapiens
ctgctattgaggaac

SEQ ID NO: 328066 - DNA, 15 bp, Homo sapiens
tgctattgaggaaca

SEQ ID NO: 328067 - DNA, 15 bp, Homo sapiens
gctattgaggaacat

SEQ ID NO: 328068 - DNA, 15 bp, Homo sapiens
ctattgaggaacatg

SEQ ID NO: 328069 - DNA, 15 bp, Homo sapiens
tattgaggaacatgt

SEQ ID NO: 328070 - DNA, 15 bp, Homo sapiens
attgaggaacatgta

SEQ ID NO: 328071 - DNA, 15 bp, Homo sapiens
ttgaggaacatgtat

SEQ ID NO: 328072 - DNA, 15 bp, Homo sapiens
tgaggaacatgtatt

SEQ ID NO: 328073 - DNA, 15 bp, Homo sapiens
gaggaacatgtattt

SEQ ID NO: 328074 - DNA, 15 bp, Homo sapiens
aggaacatgtatttc

SEQ ID NO: 328075 - DNA, 15 bp, Homo sapiens
ggaacatgtatttcc

SEQ ID NO: 328076 - DNA, 15 bp, Homo sapiens
gaacatgtatttcct

SEQ ID NO: 328077 - DNA, 15 bp, Homo sapiens
aacatgtatttcctc

SEQ ID NO: 328078 - DNA, 15 bp, Homo sapiens
acatgtatttcctct

SEQ ID NO: 328079 - DNA, 15 bp, Homo sapiens
catgtatttcctctt

SEQ ID NO: 328080 - DNA, 15 bp, Homo sapiens
atgtatttcctcttg

SEQ ID NO: 328081 - DNA, 15 bp, Homo sapiens
tgtatttcctcttgg

SEQ ID NO: 328082 - DNA, 15 bp, Homo sapiens
gtatttcctcttggc

SEQ ID NO: 328083 - DNA, 15 bp, Homo sapiens
tatttcctcttggct

SEQ ID NO: 328084 - DNA, 15 bp, Homo sapiens
atttcctcttggctt

SEQ ID NO: 328085 - DNA, 15 bp, Homo sapiens
tttcctcttggcttc

SEQ ID NO: 328086 - DNA, 15 bp, Homo sapiens
ttcctcttggcttca

SEQ ID NO: 328087 - DNA, 15 bp, Homo sapiens
tcctcttggcttcat

SEQ ID NO: 328088 - DNA, 15 bp, Homo sapiens
cctcttggcttcatt

SEQ ID NO: 328089 - DNA, 15 bp, Homo sapiens
ctcttggcttcattt

SEQ ID NO: 328090 - DNA, 15 bp, Homo sapiens
tcttggcttcatttg

SEQ ID NO: 328091 - DNA, 15 bp, Homo sapiens
cttggcttcatttgc

SEQ ID NO: 328092 - DNA, 15 bp, Homo sapiens
ttggcttcatttgct

SEQ ID NO: 328093 - DNA, 15 bp, Homo sapiens
tggcttcatttgctg

SEQ ID NO: 328094 - DNA, 15 bp, Homo sapiens
ggcttcatttgctgt

SEQ ID NO: 328095 - DNA, 15 bp, Homo sapiens
gcttcatttgctgtt

SEQ ID NO: 328096 - DNA, 15 bp, Homo sapiens
cttcatttgctgttt

SEQ ID NO: 328097 - DNA, 15 bp, Homo sapiens
ttcatttgctgtttg

SEQ ID NO: 328098 - DNA, 15 bp, Homo sapiens
tcatttgctgtttgg

SEQ ID NO: 328099 - DNA, 15 bp, Homo sapiens
catttgctgtttggc

SEQ ID NO: 328100 - DNA, 15 bp, Homo sapiens
atttgctgtttggct

SEQ ID NO: 328101 - DNA, 15 bp, Homo sapiens
tttgctgtttggcta

SEQ ID NO: 328102 - DNA, 15 bp, Homo sapiens
ttgctgtttggctat

SEQ ID NO: 328103 - DNA, 15 bp, Homo sapiens
tgctgtttggctatg

SEQ ID NO: 328104 - DNA, 15 bp, Homo sapiens
gctgtttggctatga

SEQ ID NO: 328105 - DNA, 15 bp, Homo sapiens
ctgtttggctatgac

SEQ ID NO: 328106 - DNA, 15 bp, Homo sapiens
tgtttggctatgact

SEQ ID NO: 328107 - DNA, 15 bp, Homo sapiens
gtttggctatgactg

SEQ ID NO: 328108 - DNA, 15 bp, Homo sapiens
tttggctatgactga

SEQ ID NO: 328109 - DNA, 15 bp, Homo sapiens
ttggctatgactgag

SEQ ID NO: 328110 - DNA, 15 bp, Homo sapiens
tggctatgactgagg

SEQ ID NO: 328111 - DNA, 15 bp, Homo sapiens
ggctatgactgagga

SEQ ID NO: 328112 - DNA, 15 bp, Homo sapiens
gctatgactgaggaa

SEQ ID NO: 328113 - DNA, 15 bp, Homo sapiens
ctatgactgaggaag

SEQ ID NO: 328114 - DNA, 15 bp, Homo sapiens
tatgactgaggaaga

SEQ ID NO: 328115 - DNA, 15 bp, Homo sapiens
atgactgaggaagac

SEQ ID NO: 328116 - DNA, 15 bp, Homo sapiens
tgactgaggaagaca

SEQ ID NO: 328117 - DNA, 15 bp, Homo sapiens
gactgaggaagacag

SEQ ID NO: 328118 - DNA, 15 bp, Homo sapiens
actgaggaagacagg

SEQ ID NO: 328119 - DNA, 15 bp, Homo sapiens
ctgaggaagacagga

SEQ ID NO: 328120 - DNA, 15 bp, Homo sapiens
tgaggaagacaggag

SEQ ID NO: 328121 - DNA, 15 bp, Homo sapiens
gaggaagacaggagg

SEQ ID NO: 328122 - DNA, 15 bp, Homo sapiens
aggaagacaggaggt

SEQ ID NO: 328123 - DNA, 15 bp, Homo sapiens
ggaagacaggaggta

SEQ ID NO: 328124 - DNA, 15 bp, Homo sapiens
gaagacaggaggtat

SEQ ID NO: 328125 - DNA, 15 bp, Homo sapiens
aagacaggaggtatt

SEQ ID NO: 328126 - DNA, 15 bp, Homo sapiens
agacaggaggtattg

SEQ ID NO: 328127 - DNA, 15 bp, Homo sapiens
gacaggaggtattgc

SEQ ID NO: 328128 - DNA, 15 bp, Homo sapiens
acaggaggtattgca

SEQ ID NO: 328129 - DNA, 15 bp, Homo sapiens
caggaggtattgcat

SEQ ID NO: 328130 - DNA, 15 bp, Homo sapiens
aggaggtattgcata

SEQ ID NO: 328131 - DNA, 15 bp, Homo sapiens
ggaggtattgcatag

SEQ ID NO: 328132 - DNA, 15 bp, Homo sapiens
gaggtattgcatagt

SEQ ID NO: 328133 - DNA, 15 bp, Homo sapiens
aggtattgcatagta

SEQ ID NO: 328134 - DNA, 15 bp, Homo sapiens
ggtattgcatagtat

SEQ ID NO: 328135 - DNA, 15 bp, Homo sapiens
gtattgcatagtatc

SEQ ID NO: 328136 - DNA, 15 bp, Homo sapiens
tattgcatagtatca

SEQ ID NO: 328137 - DNA, 15 bp, Homo sapiens
attgcatagtatcat

SEQ ID NO: 328138 - DNA, 15 bp, Homo sapiens
ttgcatagtatcatt

SEQ ID NO: 328139 - DNA, 15 bp, Homo sapiens
tgcatagtatcattt

SEQ ID NO: 328140 - DNA, 15 bp, Homo sapiens
gcatagtatcattta

SEQ ID NO: 328141 - DNA, 15 bp, Homo sapiens
catagtatcatttac

SEQ ID NO: 328142 - DNA, 15 bp, Homo sapiens
atagtatcatttact

SEQ ID NO: 328143 - DNA, 15 bp, Homo sapiens
tagtatcatttactt

SEQ ID NO: 328144 - DNA, 15 bp, Homo sapiens
agtatcatttacttt

SEQ ID NO: 328145 - DNA, 15 bp, Homo sapiens
gtatcatttactttc

SEQ ID NO: 328146 - DNA, 15 bp, Homo sapiens
tatcatttactttca

SEQ ID NO: 328147 - DNA, 15 bp, Homo sapiens
atcatttactttcat

SEQ ID NO: 328148 - DNA, 15 bp, Homo sapiens
tcatttactttcata

SEQ ID NO: 328149 - DNA, 15 bp, Homo sapiens
catttactttcataa

SEQ ID NO: 328150 - DNA, 15 bp, Homo sapiens
atttactttcataaa

SEQ ID NO: 328151 - DNA, 15 bp, Homo sapiens
tttactttcataaac

SEQ ID NO: 328152 - DNA, 15 bp, Homo sapiens
ttactttcataaaca

SEQ ID NO: 328153 - DNA, 15 bp, Homo sapiens
tactttcataaacat

SEQ ID NO: 328154 - DNA, 15 bp, Homo sapiens
actttcataaacata

SEQ ID NO: 328155 - DNA, 15 bp, Homo sapiens
ctttcataaacataa

SEQ ID NO: 328156 - DNA, 15 bp, Homo sapiens
tttcataaacataac

SEQ ID NO: 328157 - DNA, 15 bp, Homo sapiens
ttcataaacataact

SEQ ID NO: 328158 - DNA, 15 bp, Homo sapiens
tcataaacataactt

SEQ ID NO: 328159 - DNA, 15 bp, Homo sapiens
cataaacataacttt

SEQ ID NO: 328160 - DNA, 15 bp, Homo sapiens
ataaacataactttg

SEQ ID NO: 328161 - DNA, 15 bp, Homo sapiens
taaacataactttga

SEQ ID NO: 328162 - DNA, 15 bp, Homo sapiens
aaacataactttgac

SEQ ID NO: 328163 - DNA, 15 bp, Homo sapiens
aacataactttgaca

SEQ ID NO: 328164 - DNA, 15 bp, Homo sapiens
acataactttgacat

SEQ ID NO: 328165 - DNA, 15 bp, Homo sapiens
cataactttgacatc

SEQ ID NO: 328166 - DNA, 15 bp, Homo sapiens
ataactttgacatct

SEQ ID NO: 328167 - DNA, 15 bp, Homo sapiens
taactttgacatctc

SEQ ID NO: 328168 - DNA, 15 bp, Homo sapiens
aactttgacatctct

SEQ ID NO: 328169 - DNA, 15 bp, Homo sapiens
actttgacatctcta

SEQ ID NO: 328170 - DNA, 15 bp, Homo sapiens
ctttgacatctctag

SEQ ID NO: 328171 - DNA, 15 bp, Homo sapiens
tttgacatctctagg

SEQ ID NO: 328172 - DNA, 15 bp, Homo sapiens
ttgacatctctaggc

SEQ ID NO: 328173 - DNA, 15 bp, Homo sapiens
tgacatctctaggct

SEQ ID NO: 328174 - DNA, 15 bp, Homo sapiens
gacatctctaggctt

SEQ ID NO: 328175 - DNA, 15 bp, Homo sapiens
acatctctaggcttc

SEQ ID NO: 328176 - DNA, 15 bp, Homo sapiens
catctctaggcttca

SEQ ID NO: 328177 - DNA, 15 bp, Homo sapiens
atctctaggcttcat

SEQ ID NO: 328178 - DNA, 15 bp, Homo sapiens
tctctaggcttcatg

SEQ ID NO: 328179 - DNA, 15 bp, Homo sapiens
ctctaggcttcatgt

SEQ ID NO: 328180 - DNA, 15 bp, Homo sapiens
tctaggcttcatgtt

SEQ ID NO: 328181 - DNA, 15 bp, Homo sapiens
ctaggcttcatgttg

SEQ ID NO: 328182 - DNA, 15 bp, Homo sapiens
taggcttcatgttgg

SEQ ID NO: 328183 - DNA, 15 bp, Homo sapiens
aggcttcatgttggt

SEQ ID NO: 328184 - DNA, 15 bp, Homo sapiens
ggcttcatgttggtt

SEQ ID NO: 328185 - DNA, 15 bp, Homo sapiens
gcttcatgttggttc

SEQ ID NO: 328186 - DNA, 15 bp, Homo sapiens
cttcatgttggttca

SEQ ID NO: 328187 - DNA, 15 bp, Homo sapiens
ttcatgttggttcag

SEQ ID NO: 328188 - DNA, 15 bp, Homo sapiens
tcatgttggttcagg

SEQ ID NO: 328189 - DNA, 15 bp, Homo sapiens
catgttggttcaggc

SEQ ID NO: 328190 - DNA, 15 bp, Homo sapiens
atgttggttcaggca

SEQ ID NO: 328191 - DNA, 15 bp, Homo sapiens
tgttggttcaggcaa

SEQ ID NO: 328192 - DNA, 15 bp, Homo sapiens
gttggttcaggcaat

SEQ ID NO: 328193 - DNA, 15 bp, Homo sapiens
ttggttcaggcaatg

SEQ ID NO: 328194 - DNA, 15 bp, Homo sapiens
tggttcaggcaatgc

SEQ ID NO: 328195 - DNA, 15 bp, Homo sapiens
ggttcaggcaatgct

SEQ ID NO: 328196 - DNA, 15 bp, Homo sapiens
gttcaggcaatgctc

SEQ ID NO: 328197 - DNA, 15 bp, Homo sapiens
ttcaggcaatgctct

SEQ ID NO: 328198 - DNA, 15 bp, Homo sapiens
tcaggcaatgctctc

SEQ ID NO: 328199 - DNA, 15 bp, Homo sapiens
caggcaatgctctcg

SEQ ID NO: 328200 - DNA, 15 bp, Homo sapiens
aggcaatgctctcga

SEQ ID NO: 328201 - DNA, 15 bp, Homo sapiens
ggcaatgctctcgaa

SEQ ID NO: 328202 - DNA, 15 bp, Homo sapiens
gcaatgctctcgaaa

SEQ ID NO: 328203 - DNA, 15 bp, Homo sapiens
caatgctctcgaaag

SEQ ID NO: 328204 - DNA, 15 bp, Homo sapiens
aatgctctcgaaagc

SEQ ID NO: 328205 - DNA, 15 bp, Homo sapiens
atgctctcgaaagcc

SEQ ID NO: 328206 - DNA, 15 bp, Homo sapiens
tgctctcgaaagcca

SEQ ID NO: 328207 - DNA, 15 bp, Homo sapiens
gctctcgaaagccag

SEQ ID NO: 328208 - DNA, 15 bp, Homo sapiens
ctctcgaaagccagg

SEQ ID NO: 328209 - DNA, 15 bp, Homo sapiens
tctcgaaagccaggg

SEQ ID NO: 328210 - DNA, 15 bp, Homo sapiens
ctcgaaagccaggga

SEQ ID NO: 328211 - DNA, 15 bp, Homo sapiens
tcgaaagccagggag

SEQ ID NO: 328212 - DNA, 15 bp, Homo sapiens
cgaaagccagggagc

SEQ ID NO: 328213 - DNA, 15 bp, Homo sapiens
gaaagccagggagct

SEQ ID NO: 328214 - DNA, 15 bp, Homo sapiens
aaagccagggagctg

SEQ ID NO: 328215 - DNA, 15 bp, Homo sapiens
aagccagggagctgc

SEQ ID NO: 328216 - DNA, 15 bp, Homo sapiens
agccagggagctgct

SEQ ID NO: 328217 - DNA, 15 bp, Homo sapiens
gccagggagctgctt

SEQ ID NO: 328218 - DNA, 15 bp, Homo sapiens
ccagggagctgcttt

SEQ ID NO: 328219 - DNA, 15 bp, Homo sapiens
cagggagctgctttg

SEQ ID NO: 328220 - DNA, 15 bp, Homo sapiens
agggagctgctttgc

SEQ ID NO: 328221 - DNA, 15 bp, Homo sapiens
gggagctgctttgca

SEQ ID NO: 328222 - DNA, 15 bp, Homo sapiens
ggagctgctttgcaa

SEQ ID NO: 328223 - DNA, 15 bp, Homo sapiens
gagctgctttgcaag

SEQ ID NO: 328224 - DNA, 15 bp, Homo sapiens
agctgctttgcaaga

SEQ ID NO: 328225 - DNA, 15 bp, Homo sapiens
gctgctttgcaagat

SEQ ID NO: 328226 - DNA, 15 bp, Homo sapiens
ctgctttgcaagatg

SEQ ID NO: 328227 - DNA, 15 bp, Homo sapiens
tgctttgcaagatgc

SEQ ID NO: 328228 - DNA, 15 bp, Homo sapiens
gctttgcaagatgca

SEQ ID NO: 328229 - DNA, 15 bp, Homo sapiens
ctttgcaagatgcat

SEQ ID NO: 328230 - DNA, 15 bp, Homo sapiens
tttgcaagatgcatg

SEQ ID NO: 328231 - DNA, 15 bp, Homo sapiens
ttgcaagatgcatgc

SEQ ID NO: 328232 - DNA, 15 bp, Homo sapiens
tgcaagatgcatgct

SEQ ID NO: 328233 - DNA, 15 bp, Homo sapiens
gcaagatgcatgcta

SEQ ID NO: 328234 - DNA, 15 bp, Homo sapiens
caagatgcatgctat

SEQ ID NO: 328235 - DNA, 15 bp, Homo sapiens
aagatgcatgctatg

SEQ ID NO: 328236 - DNA, 15 bp, Homo sapiens
agatgcatgctatgg

SEQ ID NO: 328237 - DNA, 15 bp, Homo sapiens
gatgcatgctatggc

SEQ ID NO: 328238 - DNA, 15 bp, Homo sapiens
atgcatgctatggct

SEQ ID NO: 328239 - DNA, 15 bp, Homo sapiens
tgcatgctatggctg

SEQ ID NO: 328240 - DNA, 15 bp, Homo sapiens
gcatgctatggctga

SEQ ID NO: 328241 - DNA, 15 bp, Homo sapiens
catgctatggctgaa

SEQ ID NO: 328242 - DNA, 15 bp, Homo sapiens
atgctatggctgaag

SEQ ID NO: 328243 - DNA, 15 bp, Homo sapiens
tgctatggctgaagg

SEQ ID NO: 328244 - DNA, 15 bp, Homo sapiens
gctatggctgaagga

SEQ ID NO: 328245 - DNA, 15 bp, Homo sapiens
ctatggctgaaggaa

SEQ ID NO: 328246 - DNA, 15 bp, Homo sapiens
tatggctgaaggaac

SEQ ID NO: 328247 - DNA, 15 bp, Homo sapiens
atggctgaaggaacg

SEQ ID NO: 328248 - DNA, 15 bp, Homo sapiens
tggctgaaggaacgg

SEQ ID NO: 328249 - DNA, 15 bp, Homo sapiens
ggctgaaggaacggc

SEQ ID NO: 328250 - DNA, 15 bp, Homo sapiens
gctgaaggaacggct

SEQ ID NO: 328251 - DNA, 15 bp, Homo sapiens
ctgaaggaacggctc

SEQ ID NO: 328252 - DNA, 15 bp, Homo sapiens
tgaaggaacggctca

SEQ ID NO: 328253 - DNA, 15 bp, Homo sapiens
gaaggaacggctcaa

SEQ ID NO: 328254 - DNA, 15 bp, Homo sapiens
aaggaacggctcaat

SEQ ID NO: 328255 - DNA, 15 bp, Homo sapiens
aggaacggctcaata

SEQ ID NO: 328256 - DNA, 15 bp, Homo sapiens
ggaacggctcaatag

SEQ ID NO: 328257 - DNA, 15 bp, Homo sapiens
gaacggctcaatagc

SEQ ID NO: 328258 - DNA, 15 bp, Homo sapiens
aacggctcaatagct

SEQ ID NO: 328259 - DNA, 15 bp, Homo sapiens
acggctcaatagctg

SEQ ID NO: 328260 - DNA, 15 bp, Homo sapiens
cggctcaatagctgg

SEQ ID NO: 328261 - DNA, 15 bp, Homo sapiens
ggctcaatagctggg

SEQ ID NO: 328262 - DNA, 15 bp, Homo sapiens
gctcaatagctggga

SEQ ID NO: 328263 - DNA, 15 bp, Homo sapiens
ctcaatagctgggag

SEQ ID NO: 328264 - DNA, 15 bp, Homo sapiens
tcaatagctgggagc

SEQ ID NO: 328265 - DNA, 15 bp, Homo sapiens
caatagctgggagct

SEQ ID NO: 328266 - DNA, 15 bp, Homo sapiens
aatagctgggagctg

SEQ ID NO: 328267 - DNA, 15 bp, Homo sapiens
atagctgggagctgg

SEQ ID NO: 328268 - DNA, 15 bp, Homo sapiens
tagctgggagctggc

SEQ ID NO: 328269 - DNA, 15 bp, Homo sapiens
agctgggagctggcc

SEQ ID NO: 328270 - DNA, 15 bp, Homo sapiens
gctgggagctggccc

SEQ ID NO: 328271 - DNA, 15 bp, Homo sapiens
ctgggagctggccct

SEQ ID NO: 328272 - DNA, 15 bp, Homo sapiens
tgggagctggccctg

SEQ ID NO: 328273 - DNA, 15 bp, Homo sapiens
gggagctggccctga

SEQ ID NO: 328274 - DNA, 15 bp, Homo sapiens
ggagctggccctgag

SEQ ID NO: 328275 - DNA, 15 bp, Homo sapiens
gagctggccctgagg

SEQ ID NO: 328276 - DNA, 15 bp, Homo sapiens
agctggccctgaggt

SEQ ID NO: 328277 - DNA, 15 bp, Homo sapiens
gctggccctgaggtt

SEQ ID NO: 328278 - DNA, 15 bp, Homo sapiens
ctggccctgaggttt

SEQ ID NO: 328279 - DNA, 15 bp, Homo sapiens
tggccctgaggttta

SEQ ID NO: 328280 - DNA, 15 bp, Homo sapiens
ggccctgaggtttaa

SEQ ID NO: 328281 - DNA, 15 bp, Homo sapiens
gccctgaggtttaaa

SEQ ID NO: 328282 - DNA, 15 bp, Homo sapiens
ccctgaggtttaaat

SEQ ID NO: 328283 - DNA, 15 bp, Homo sapiens
cctgaggtttaaatc

SEQ ID NO: 328284 - DNA, 15 bp, Homo sapiens
ctgaggtttaaatcc

SEQ ID NO: 328285 - DNA, 15 bp, Homo sapiens
tgaggtttaaatcca

SEQ ID NO: 328286 - DNA, 15 bp, Homo sapiens
gaggtttaaatccac

SEQ ID NO: 328287 - DNA, 15 bp, Homo sapiens
aggtttaaatccact

SEQ ID NO: 328288 - DNA, 15 bp, Homo sapiens
ggtttaaatccactc

SEQ ID NO: 328289 - DNA, 15 bp, Homo sapiens
gtttaaatccactca

SEQ ID NO: 328290 - DNA, 15 bp, Homo sapiens
tttaaatccactcac

SEQ ID NO: 328291 - DNA, 15 bp, Homo sapiens
ttaaatccactcaca

SEQ ID NO: 328292 - DNA, 15 bp, Homo sapiens
taaatccactcacag

SEQ ID NO: 328293 - DNA, 15 bp, Homo sapiens
aaatccactcacagc

SEQ ID NO: 328294 - DNA, 15 bp, Homo sapiens
aatccactcacagca

SEQ ID NO: 328295 - DNA, 15 bp, Homo sapiens
atccactcacagcac

SEQ ID NO: 328296 - DNA, 15 bp, Homo sapiens
tccactcacagcacg

SEQ ID NO: 328297 - DNA, 15 bp, Homo sapiens
ccactcacagcacga

SEQ ID NO: 328298 - DNA, 15 bp, Homo sapiens
cactcacagcacgaa

SEQ ID NO: 328299 - DNA, 15 bp, Homo sapiens
actcacagcacgaat

SEQ ID NO: 328300 - DNA, 15 bp, Homo sapiens
ctcacagcacgaatt

SEQ ID NO: 328301 - DNA, 15 bp, Homo sapiens
tcacagcacgaattt

SEQ ID NO: 328302 - DNA, 15 bp, Homo sapiens
cacagcacgaatttg

SEQ ID NO: 328303 - DNA, 15 bp, Homo sapiens
acagcacgaatttgg

SEQ ID NO: 328304 - DNA, 15 bp, Homo sapiens
cagcacgaatttggt

SEQ ID NO: 328305 - DNA, 15 bp, Homo sapiens
agcacgaatttggtg

SEQ ID NO: 328306 - DNA, 15 bp, Homo sapiens
gcacgaatttggtgt

SEQ ID NO: 328307 - DNA, 15 bp, Homo sapiens
cacgaatttggtgtt

SEQ ID NO: 328308 - DNA, 15 bp, Homo sapiens
acgaatttggtgttt

SEQ ID NO: 328309 - DNA, 15 bp, Homo sapiens
cgaatttggtgtttt

SEQ ID NO: 328310 - DNA, 15 bp, Homo sapiens
gaatttggtgtttta

SEQ ID NO: 328311 - DNA, 15 bp, Homo sapiens
aatttggtgttttac

SEQ ID NO: 328312 - DNA, 15 bp, Homo sapiens
atttggtgttttact

SEQ ID NO: 328313 - DNA, 15 bp, Homo sapiens
tttggtgttttactt

SEQ ID NO: 328314 - DNA, 15 bp, Homo sapiens
ttggtgttttacttt

SEQ ID NO: 328315 - DNA, 15 bp, Homo sapiens
tggtgttttactttg

SEQ ID NO: 328316 - DNA, 15 bp, Homo sapiens
ggtgttttactttgt

SEQ ID NO: 328317 - DNA, 15 bp, Homo sapiens
gtgttttactttgtg

SEQ ID NO: 328318 - DNA, 15 bp, Homo sapiens
tgttttactttgtgt

SEQ ID NO: 328319 - DNA, 15 bp, Homo sapiens
gttttactttgtgtc

SEQ ID NO: 328320 - DNA, 15 bp, Homo sapiens
ttttactttgtgtcc

SEQ ID NO: 328321 - DNA, 15 bp, Homo sapiens
tttactttgtgtcct

SEQ ID NO: 328322 - DNA, 15 bp, Homo sapiens
ttactttgtgtcctg

SEQ ID NO: 328323 - DNA, 15 bp, Homo sapiens
tactttgtgtcctga

SEQ ID NO: 328324 - DNA, 15 bp, Homo sapiens
actttgtgtcctgaa

SEQ ID NO: 328325 - DNA, 15 bp, Homo sapiens
ctttgtgtcctgaaa

SEQ ID NO: 328326 - DNA, 15 bp, Homo sapiens
tttgtgtcctgaaac

SEQ ID NO: 328327 - DNA, 15 bp, Homo sapiens
ttgtgtcctgaaacc

SEQ ID NO: 328328 - DNA, 15 bp, Homo sapiens
tgtgtcctgaaacct

SEQ ID NO: 328329 - DNA, 15 bp, Homo sapiens
gtgtcctgaaacctc

SEQ ID NO: 328330 - DNA, 15 bp, Homo sapiens
tgtcctgaaacctca

SEQ ID NO: 328331 - DNA, 15 bp, Homo sapiens
gtcctgaaacctcaa

SEQ ID NO: 328332 - DNA, 15 bp, Homo sapiens
tcctgaaacctcaat

SEQ ID NO: 328333 - DNA, 15 bp, Homo sapiens
cctgaaacctcaata

SEQ ID NO: 328334 - DNA, 15 bp, Homo sapiens
ctgaaacctcaataa

SEQ ID NO: 328335 - DNA, 15 bp, Homo sapiens
tgaaacctcaataac

SEQ ID NO: 328336 - DNA, 15 bp, Homo sapiens
gaaacctcaataacc

SEQ ID NO: 328337 - DNA, 15 bp, Homo sapiens
aaacctcaataacct

SEQ ID NO: 328338 - DNA, 15 bp, Homo sapiens
aacctcaataacctc

SEQ ID NO: 328339 - DNA, 15 bp, Homo sapiens
acctcaataacctca

SEQ ID NO: 328340 - DNA, 15 bp, Homo sapiens
cctcaataacctcat

SEQ ID NO: 328341 - DNA, 15 bp, Homo sapiens
ctcaataacctcatt

SEQ ID NO: 328342 - DNA, 15 bp, Homo sapiens
tcaataacctcattt

SEQ ID NO: 328343 - DNA, 15 bp, Homo sapiens
caataacctcatttt

SEQ ID NO: 328344 - DNA, 15 bp, Homo sapiens
aataacctcattttt

SEQ ID NO: 328345 - DNA, 15 bp, Homo sapiens
ataacctcatttttc

SEQ ID NO: 328346 - DNA, 15 bp, Homo sapiens
taacctcatttttca

SEQ ID NO: 328347 - DNA, 15 bp, Homo sapiens
aacctcatttttcaa

SEQ ID NO: 328348 - DNA, 15 bp, Homo sapiens
acctcatttttcaag

SEQ ID NO: 328349 - DNA, 15 bp, Homo sapiens
cctcatttttcaagt

SEQ ID NO: 328350 - DNA, 15 bp, Homo sapiens
ctcatttttcaagtg

SEQ ID NO: 328351 - DNA, 15 bp, Homo sapiens
tcatttttcaagtga

SEQ ID NO: 328352 - DNA, 15 bp, Homo sapiens
catttttcaagtgag

SEQ ID NO: 328353 - DNA, 15 bp, Homo sapiens
atttttcaagtgaga

SEQ ID NO: 328354 - DNA, 15 bp, Homo sapiens
tttttcaagtgagag

SEQ ID NO: 328355 - DNA, 15 bp, Homo sapiens
ttttcaagtgagagt

SEQ ID NO: 328356 - DNA, 15 bp, Homo sapiens
tttcaagtgagagtt

SEQ ID NO: 328357 - DNA, 15 bp, Homo sapiens
ttcaagtgagagttg

SEQ ID NO: 328358 - DNA, 15 bp, Homo sapiens
tcaagtgagagttga

SEQ ID NO: 328359 - DNA, 15 bp, Homo sapiens
caagtgagagttgaa

SEQ ID NO: 328360 - DNA, 15 bp, Homo sapiens
aagtgagagttgaaa

SEQ ID NO: 328361 - DNA, 15 bp, Homo sapiens
agtgagagttgaaat

SEQ ID NO: 328362 - DNA, 15 bp, Homo sapiens
gtgagagttgaaata

SEQ ID NO: 328363 - DNA, 15 bp, Homo sapiens
tgagagttgaaatat

SEQ ID NO: 328364 - DNA, 15 bp, Homo sapiens
gagagttgaaatatt

SEQ ID NO: 328365 - DNA, 15 bp, Homo sapiens
agagttgaaatattg

SEQ ID NO: 328366 - DNA, 15 bp, Homo sapiens
gagttgaaatattga

SEQ ID NO: 328367 - DNA, 15 bp, Homo sapiens
agttgaaatattgac

SEQ ID NO: 328368 - DNA, 15 bp, Homo sapiens
gttgaaatattgaca

SEQ ID NO: 328369 - DNA, 15 bp, Homo sapiens
ttgaaatattgacac

SEQ ID NO: 328370 - DNA, 15 bp, Homo sapiens
tgaaatattgacaca

SEQ ID NO: 328371 - DNA, 15 bp, Homo sapiens
gaaatattgacacaa

SEQ ID NO: 328372 - DNA, 15 bp, Homo sapiens
aaatattgacacaac

SEQ ID NO: 328373 - DNA, 15 bp, Homo sapiens
aatattgacacaact

SEQ ID NO: 328374 - DNA, 15 bp, Homo sapiens
atattgacacaactt

SEQ ID NO: 328375 - DNA, 15 bp, Homo sapiens
tattgacacaactta

SEQ ID NO: 328376 - DNA, 15 bp, Homo sapiens
attgacacaacttaa

SEQ ID NO: 328377 - DNA, 15 bp, Homo sapiens
ttgacacaacttaac

SEQ ID NO: 328378 - DNA, 15 bp, Homo sapiens
tgacacaacttaact

SEQ ID NO: 328379 - DNA, 15 bp, Homo sapiens
gacacaacttaactt

SEQ ID NO: 328380 - DNA, 15 bp, Homo sapiens
acacaacttaacttt

SEQ ID NO: 328381 - DNA, 15 bp, Homo sapiens
cacaacttaactttt

SEQ ID NO: 328382 - DNA, 15 bp, Homo sapiens
acaacttaactttta

SEQ ID NO: 328383 - DNA, 15 bp, Homo sapiens
caacttaacttttaa

SEQ ID NO: 328384 - DNA, 15 bp, Homo sapiens
aacttaacttttaag

SEQ ID NO: 328385 - DNA, 15 bp, Homo sapiens
acttaacttttaaga

SEQ ID NO: 328386 - DNA, 15 bp, Homo sapiens
cttaacttttaagaa

SEQ ID NO: 328387 - DNA, 15 bp, Homo sapiens
ttaacttttaagaat

SEQ ID NO: 328388 - DNA, 15 bp, Homo sapiens
taacttttaagaatt

SEQ ID NO: 328389 - DNA, 15 bp, Homo sapiens
aacttttaagaattt

SEQ ID NO: 328390 - DNA, 15 bp, Homo sapiens
acttttaagaatttt

SEQ ID NO: 328391 - DNA, 15 bp, Homo sapiens
cttttaagaattttg

SEQ ID NO: 328392 - DNA, 15 bp, Homo sapiens
ttttaagaattttga

SEQ ID NO: 328393 - DNA, 15 bp, Homo sapiens
tttaagaattttgaa

SEQ ID NO: 328394 - DNA, 15 bp, Homo sapiens
ttaagaattttgaag

SEQ ID NO: 328395 - DNA, 15 bp, Homo sapiens
taagaattttgaagg

SEQ ID NO: 328396 - DNA, 15 bp, Homo sapiens
aagaattttgaaggc

SEQ ID NO: 328397 - DNA, 15 bp, Homo sapiens
agaattttgaaggca

SEQ ID NO: 328398 - DNA, 15 bp, Homo sapiens
gaattttgaaggcat

SEQ ID NO: 328399 - DNA, 15 bp, Homo sapiens
aattttgaaggcatc

SEQ ID NO: 328400 - DNA, 15 bp, Homo sapiens
attttgaaggcatca

SEQ ID NO: 328401 - DNA, 15 bp, Homo sapiens
ttttgaaggcatcag

SEQ ID NO: 328402 - DNA, 15 bp, Homo sapiens
tttgaaggcatcagt

SEQ ID NO: 328403 - DNA, 15 bp, Homo sapiens
ttgaaggcatcagtg

SEQ ID NO: 328404 - DNA, 15 bp, Homo sapiens
tgaaggcatcagtga

SEQ ID NO: 328405 - DNA, 15 bp, Homo sapiens
gaaggcatcagtgaa

SEQ ID NO: 328406 - DNA, 15 bp, Homo sapiens
aaggcatcagtgaaa

SEQ ID NO: 328407 - DNA, 15 bp, Homo sapiens
aggcatcagtgaaaa

SEQ ID NO: 328408 - DNA, 15 bp, Homo sapiens
ggcatcagtgaaaat

SEQ ID NO: 328409 - DNA, 15 bp, Homo sapiens
gcatcagtgaaaata

SEQ ID NO: 328410 - DNA, 15 bp, Homo sapiens
catcagtgaaaataa

SEQ ID NO: 328411 - DNA, 15 bp, Homo sapiens
atcagtgaaaataaa

SEQ ID NO: 328412 - DNA, 15 bp, Homo sapiens
tcagtgaaaataaat

SEQ ID NO: 328413 - DNA, 15 bp, Homo sapiens
cagtgaaaataaatt

SEQ ID NO: 328414 - DNA, 15 bp, Homo sapiens
agtgaaaataaattg

SEQ ID NO: 328415 - DNA, 15 bp, Homo sapiens
gtgaaaataaattga

SEQ ID NO: 328416 - DNA, 15 bp, Homo sapiens
tgaaaataaattgaa

SEQ ID NO: 328417 - DNA, 15 bp, Homo sapiens
gaaaataaattgaac

SEQ ID NO: 328418 - DNA, 15 bp, Homo sapiens
aaaataaattgaacg

SEQ ID NO: 328419 - DNA, 15 bp, Homo sapiens
aaataaattgaacga

SEQ ID NO: 328420 - DNA, 15 bp, Homo sapiens
aataaattgaacgaa

SEQ ID NO: 328421 - DNA, 15 bp, Homo sapiens
ataaattgaacgaac

SEQ ID NO: 328422 - DNA, 15 bp, Homo sapiens
taaattgaacgaact

SEQ ID NO: 328423 - DNA, 15 bp, Homo sapiens
aaattgaacgaactt

SEQ ID NO: 328424 - DNA, 15 bp, Homo sapiens
aattgaacgaacttt

SEQ ID NO: 328425 - DNA, 15 bp, Homo sapiens
attgaacgaactttg

SEQ ID NO: 328426 - DNA, 15 bp, Homo sapiens
ttgaacgaactttga

SEQ ID NO: 328427 - DNA, 15 bp, Homo sapiens
tgaacgaactttgaa

SEQ ID NO: 328428 - DNA, 15 bp, Homo sapiens
gaacgaactttgaag

SEQ ID NO: 328429 - DNA, 15 bp, Homo sapiens
aacgaactttgaagt

SEQ ID NO: 328430 - DNA, 15 bp, Homo sapiens
acgaactttgaagtt

SEQ ID NO: 328431 - DNA, 15 bp, Homo sapiens
cgaactttgaagttc

SEQ ID NO: 328432 - DNA, 15 bp, Homo sapiens
gaactttgaagttca

SEQ ID NO: 328433 - DNA, 15 bp, Homo sapiens
aactttgaagttcag

SEQ ID NO: 328434 - DNA, 15 bp, Homo sapiens
actttgaagttcaga

SEQ ID NO: 328435 - DNA, 15 bp, Homo sapiens
ctttgaagttcagag

SEQ ID NO: 328436 - DNA, 15 bp, Homo sapiens
tttgaagttcagaga

SEQ ID NO: 328437 - DNA, 15 bp, Homo sapiens
ttgaagttcagagat

SEQ ID NO: 328438 - DNA, 15 bp, Homo sapiens
tgaagttcagagatc

SEQ ID NO: 328439 - DNA, 15 bp, Homo sapiens
gaagttcagagatct

SEQ ID NO: 328440 - DNA, 15 bp, Homo sapiens
aagttcagagatctc

SEQ ID NO: 328441 - DNA, 15 bp, Homo sapiens
agttcagagatctct

SEQ ID NO: 328442 - DNA, 15 bp, Homo sapiens
gttcagagatctcta

SEQ ID NO: 328443 - DNA, 15 bp, Homo sapiens
ttcagagatctctaa

SEQ ID NO: 328444 - DNA, 15 bp, Homo sapiens
tcagagatctctaaa

SEQ ID NO: 328445 - DNA, 15 bp, Homo sapiens
cagagatctctaaaa

SEQ ID NO: 328446 - DNA, 15 bp, Homo sapiens
agagatctctaaaag

SEQ ID NO: 328447 - DNA, 15 bp, Homo sapiens
gagatctctaaaagt

SEQ ID NO: 328448 - DNA, 15 bp, Homo sapiens
agatctctaaaagtg

SEQ ID NO: 328449 - DNA, 15 bp, Homo sapiens
gatctctaaaagtga

SEQ ID NO: 328450 - DNA, 15 bp, Homo sapiens
atctctaaaagtgaa

SEQ ID NO: 328451 - DNA, 15 bp, Homo sapiens
tctctaaaagtgaat

SEQ ID NO: 328452 - DNA, 15 bp, Homo sapiens
ctctaaaagtgaata

SEQ ID NO: 328453 - DNA, 15 bp, Homo sapiens
tctaaaagtgaatac

SEQ ID NO: 328454 - DNA, 15 bp, Homo sapiens
ctaaaagtgaataca

SEQ ID NO: 328455 - DNA, 15 bp, Homo sapiens
taaaagtgaatacag

SEQ ID NO: 328456 - DNA, 15 bp, Homo sapiens
aaaagtgaatacaga

SEQ ID NO: 328457 - DNA, 15 bp, Homo sapiens
aaagtgaatacagac

SEQ ID NO: 328458 - DNA, 15 bp, Homo sapiens
aagtgaatacagacc

SEQ ID NO: 328459 - DNA, 15 bp, Homo sapiens
agtgaatacagacca

SEQ ID NO: 328460 - DNA, 15 bp, Homo sapiens
gtgaatacagaccaa

SEQ ID NO: 328461 - DNA, 15 bp, Homo sapiens
tgaatacagaccaaa

SEQ ID NO: 328462 - DNA, 15 bp, Homo sapiens
gaatacagaccaaat

SEQ ID NO: 328463 - DNA, 15 bp, Homo sapiens
aatacagaccaaatt

SEQ ID NO: 328464 - DNA, 15 bp, Homo sapiens
atacagaccaaatta

SEQ ID NO: 328465 - DNA, 15 bp, Homo sapiens
tacagaccaaattat

SEQ ID NO: 328466 - DNA, 15 bp, Homo sapiens
acagaccaaattata

SEQ ID NO: 328467 - DNA, 15 bp, Homo sapiens
cagaccaaattatat

SEQ ID NO: 328468 - DNA, 15 bp, Homo sapiens
agaccaaattatatc

SEQ ID NO: 328469 - DNA, 15 bp, Homo sapiens
gaccaaattatatcc

SEQ ID NO: 328470 - DNA, 15 bp, Homo sapiens
accaaattatatcct

SEQ ID NO: 328471 - DNA, 15 bp, Homo sapiens
ccaaattatatcctg

SEQ ID NO: 328472 - DNA, 15 bp, Homo sapiens
caaattatatcctga

SEQ ID NO: 328473 - DNA, 15 bp, Homo sapiens
aaattatatcctgat

SEQ ID NO: 328474 - DNA, 15 bp, Homo sapiens
aattatatcctgatg

SEQ ID NO: 328475 - DNA, 15 bp, Homo sapiens
attatatcctgatga

SEQ ID NO: 328476 - DNA, 15 bp, Homo sapiens
ttatatcctgatgat

SEQ ID NO: 328477 - DNA, 15 bp, Homo sapiens
tatatcctgatgatc

SEQ ID NO: 328478 - DNA, 15 bp, Homo sapiens
atatcctgatgatca

SEQ ID NO: 328479 - DNA, 15 bp, Homo sapiens
tatcctgatgatcaa

SEQ ID NO: 328480 - DNA, 15 bp, Homo sapiens
atcctgatgatcaag

SEQ ID NO: 328481 - DNA, 15 bp, Homo sapiens
tcctgatgatcaagt

SEQ ID NO: 328482 - DNA, 15 bp, Homo sapiens
cctgatgatcaagta

SEQ ID NO: 328483 - DNA, 15 bp, Homo sapiens
ctgatgatcaagtag

SEQ ID NO: 328484 - DNA, 15 bp, Homo sapiens
tgatgatcaagtagg

SEQ ID NO: 328485 - DNA, 15 bp, Homo sapiens
gatgatcaagtagga

SEQ ID NO: 328486 - DNA, 15 bp, Homo sapiens
atgatcaagtaggaa

SEQ ID NO: 328487 - DNA, 15 bp, Homo sapiens
tgatcaagtaggaac

SEQ ID NO: 328488 - DNA, 15 bp, Homo sapiens
gatcaagtaggaaca

SEQ ID NO: 328489 - DNA, 15 bp, Homo sapiens
atcaagtaggaacat

SEQ ID NO: 328490 - DNA, 15 bp, Homo sapiens
tcaagtaggaacatc

SEQ ID NO: 328491 - DNA, 15 bp, Homo sapiens
caagtaggaacatcc

SEQ ID NO: 328492 - DNA, 15 bp, Homo sapiens
aagtaggaacatccg

SEQ ID NO: 328493 - DNA, 15 bp, Homo sapiens
agtaggaacatccgt

SEQ ID NO: 328494 - DNA, 15 bp, Homo sapiens
gtaggaacatccgta

SEQ ID NO: 328495 - DNA, 15 bp, Homo sapiens
taggaacatccgtag

SEQ ID NO: 328496 - DNA, 15 bp, Homo sapiens
aggaacatccgtagt

SEQ ID NO: 328497 - DNA, 15 bp, Homo sapiens
ggaacatccgtagtt

SEQ ID NO: 328498 - DNA, 15 bp, Homo sapiens
gaacatccgtagttc

SEQ ID NO: 328499 - DNA, 15 bp, Homo sapiens
aacatccgtagttcc

SEQ ID NO: 328500 - DNA, 15 bp, Homo sapiens
acatccgtagttcca

SEQ ID NO: 328501 - DNA, 15 bp, Homo sapiens
catccgtagttccag

SEQ ID NO: 328502 - DNA, 15 bp, Homo sapiens
atccgtagttccagt

SEQ ID NO: 328503 - DNA, 15 bp, Homo sapiens
tccgtagttccagta

SEQ ID NO: 328504 - DNA, 15 bp, Homo sapiens
ccgtagttccagtac

SEQ ID NO: 328505 - DNA, 15 bp, Homo sapiens
cgtagttccagtact

SEQ ID NO: 328506 - DNA, 15 bp, Homo sapiens
gtagttccagtacta

SEQ ID NO: 328507 - DNA, 15 bp, Homo sapiens
tagttccagtactat

SEQ ID NO: 328508 - DNA, 15 bp, Homo sapiens
agttccagtactata

SEQ ID NO: 328509 - DNA, 15 bp, Homo sapiens
gttccagtactatag

SEQ ID NO: 328510 - DNA, 15 bp, Homo sapiens
ttccagtactatagt

SEQ ID NO: 328511 - DNA, 15 bp, Homo sapiens
tccagtactatagtt

SEQ ID NO: 328512 - DNA, 15 bp, Homo sapiens
ccagtactatagttc

SEQ ID NO: 328513 - DNA, 15 bp, Homo sapiens
cagtactatagttca

SEQ ID NO: 328514 - DNA, 15 bp, Homo sapiens
agtactatagttcat

SEQ ID NO: 328515 - DNA, 15 bp, Homo sapiens
gtactatagttcatt

SEQ ID NO: 328516 - DNA, 15 bp, Homo sapiens
tactatagttcattg

SEQ ID NO: 328517 - DNA, 15 bp, Homo sapiens
actatagttcattga

SEQ ID NO: 328518 - DNA, 15 bp, Homo sapiens
ctatagttcattgac

SEQ ID NO: 328519 - DNA, 15 bp, Homo sapiens
tatagttcattgaca

SEQ ID NO: 328520 - DNA, 15 bp, Homo sapiens
atagttcattgacaa

SEQ ID NO: 328521 - DNA, 15 bp, Homo sapiens
tagttcattgacaac

SEQ ID NO: 328522 - DNA, 15 bp, Homo sapiens
agttcattgacaacc

SEQ ID NO: 328523 - DNA, 15 bp, Homo sapiens
gttcattgacaacct

SEQ ID NO: 328524 - DNA, 15 bp, Homo sapiens
ttcattgacaacctc

SEQ ID NO: 328525 - DNA, 15 bp, Homo sapiens
tcattgacaacctcc

SEQ ID NO: 328526 - DNA, 15 bp, Homo sapiens
cattgacaacctcca

SEQ ID NO: 328527 - DNA, 15 bp, Homo sapiens
attgacaacctccag

SEQ ID NO: 328528 - DNA, 15 bp, Homo sapiens
ttgacaacctccaga

SEQ ID NO: 328529 - DNA, 15 bp, Homo sapiens
tgacaacctccagaa

SEQ ID NO: 328530 - DNA, 15 bp, Homo sapiens
gacaacctccagaaa

SEQ ID NO: 328531 - DNA, 15 bp, Homo sapiens
acaacctccagaaag

SEQ ID NO: 328532 - DNA, 15 bp, Homo sapiens
caacctccagaaagt

SEQ ID NO: 328533 - DNA, 15 bp, Homo sapiens
aacctccagaaagtt

SEQ ID NO: 328534 - DNA, 15 bp, Homo sapiens
acctccagaaagtta

SEQ ID NO: 328535 - DNA, 15 bp, Homo sapiens
cctccagaaagttac

SEQ ID NO: 328536 - DNA, 15 bp, Homo sapiens
ctccagaaagttacg

SEQ ID NO: 328537 - DNA, 15 bp, Homo sapiens
tccagaaagttacgg

SEQ ID NO: 328538 - DNA, 15 bp, Homo sapiens
ccagaaagttacggt

SEQ ID NO: 328539 - DNA, 15 bp, Homo sapiens
cagaaagttacggta

SEQ ID NO: 328540 - DNA, 15 bp, Homo sapiens
agaaagttacggtag

SEQ ID NO: 328541 - DNA, 15 bp, Homo sapiens
gaaagttacggtagt

SEQ ID NO: 328542 - DNA, 15 bp, Homo sapiens
aaagttacggtagtc

SEQ ID NO: 328543 - DNA, 15 bp, Homo sapiens
aagttacggtagtct

SEQ ID NO: 328544 - DNA, 15 bp, Homo sapiens
agttacggtagtcta

SEQ ID NO: 328545 - DNA, 15 bp, Homo sapiens
gttacggtagtctaa

SEQ ID NO: 328546 - DNA, 15 bp, Homo sapiens
ttacggtagtctaac

SEQ ID NO: 328547 - DNA, 15 bp, Homo sapiens
tacggtagtctaaca

SEQ ID NO: 328548 - DNA, 15 bp, Homo sapiens
acggtagtctaacat

SEQ ID NO: 328549 - DNA, 15 bp, Homo sapiens
cggtagtctaacatt

SEQ ID NO: 328550 - DNA, 15 bp, Homo sapiens
ggtagtctaacattc

SEQ ID NO: 328551 - DNA, 15 bp, Homo sapiens
gtagtctaacattcc

SEQ ID NO: 328552 - DNA, 15 bp, Homo sapiens
tagtctaacattcct

SEQ ID NO: 328553 - DNA, 15 bp, Homo sapiens
agtctaacattcctt

SEQ ID NO: 328554 - DNA, 15 bp, Homo sapiens
gtctaacattcctta

SEQ ID NO: 328555 - DNA, 15 bp, Homo sapiens
tctaacattccttat

SEQ ID NO: 328556 - DNA, 15 bp, Homo sapiens
ctaacattccttatt

SEQ ID NO: 328557 - DNA, 15 bp, Homo sapiens
taacattccttattt

SEQ ID NO: 328558 - DNA, 15 bp, Homo sapiens
aacattccttattta

SEQ ID NO: 328559 - DNA, 15 bp, Homo sapiens
acattccttatttaa

SEQ ID NO: 328560 - DNA, 15 bp, Homo sapiens
cattccttatttaaa

SEQ ID NO: 328561 - DNA, 15 bp, Homo sapiens
attccttatttaaaa

SEQ ID NO: 328562 - DNA, 15 bp, Homo sapiens
ttccttatttaaaac

SEQ ID NO: 328563 - DNA, 15 bp, Homo sapiens
tccttatttaaaacc

SEQ ID NO: 328564 - DNA, 15 bp, Homo sapiens
ccttatttaaaacca

SEQ ID NO: 328565 - DNA, 15 bp, Homo sapiens
cttatttaaaaccaa

SEQ ID NO: 328566 - DNA, 15 bp, Homo sapiens
ttatttaaaaccaac

SEQ ID NO: 328567 - DNA, 15 bp, Homo sapiens
tatttaaaaccaact

SEQ ID NO: 328568 - DNA, 15 bp, Homo sapiens
atttaaaaccaactt

SEQ ID NO: 328569 - DNA, 15 bp, Homo sapiens
tttaaaaccaacttt

SEQ ID NO: 328570 - DNA, 15 bp, Homo sapiens
ttaaaaccaactttg

SEQ ID NO: 328571 - DNA, 15 bp, Homo sapiens
taaaaccaactttgc

SEQ ID NO: 328572 - DNA, 15 bp, Homo sapiens
aaaaccaactttgcc

SEQ ID NO: 328573 - DNA, 15 bp, Homo sapiens
aaaccaactttgcca

SEQ ID NO: 328574 - DNA, 15 bp, Homo sapiens
aaccaactttgccat

SEQ ID NO: 328575 - DNA, 15 bp, Homo sapiens
accaactttgccatg

SEQ ID NO: 328576 - DNA, 15 bp, Homo sapiens
ccaactttgccatgt

SEQ ID NO: 328577 - DNA, 15 bp, Homo sapiens
caactttgccatgtt

SEQ ID NO: 328578 - DNA, 15 bp, Homo sapiens
aactttgccatgttt

SEQ ID NO: 328579 - DNA, 15 bp, Homo sapiens
actttgccatgttta

SEQ ID NO: 328580 - DNA, 15 bp, Homo sapiens
ctttgccatgtttaa

SEQ ID NO: 328581 - DNA, 15 bp, Homo sapiens
tttgccatgtttaat

SEQ ID NO: 328582 - DNA, 15 bp, Homo sapiens
ttgccatgtttaatt

SEQ ID NO: 328583 - DNA, 15 bp, Homo sapiens
tgccatgtttaattt

SEQ ID NO: 328584 - DNA, 15 bp, Homo sapiens
gccatgtttaattta

SEQ ID NO: 328585 - DNA, 15 bp, Homo sapiens
ccatgtttaatttat

SEQ ID NO: 328586 - DNA, 15 bp, Homo sapiens
catgtttaatttatt

SEQ ID NO: 328587 - DNA, 15 bp, Homo sapiens
atgtttaatttattt

SEQ ID NO: 328588 - DNA, 15 bp, Homo sapiens
tgtttaatttattta

SEQ ID NO: 328589 - DNA, 15 bp, Homo sapiens
gtttaatttatttat

SEQ ID NO: 328590 - DNA, 15 bp, Homo sapiens
tttaatttatttata

SEQ ID NO: 328591 - DNA, 15 bp, Homo sapiens
ttaatttatttatac

SEQ ID NO: 328592 - DNA, 15 bp, Homo sapiens
taatttatttatact

SEQ ID NO: 328593 - DNA, 15 bp, Homo sapiens
aatttatttatactt

SEQ ID NO: 328594 - DNA, 15 bp, Homo sapiens
atttatttatacttt

SEQ ID NO: 328595 - DNA, 15 bp, Homo sapiens
tttatttatactttt

SEQ ID NO: 328596 - DNA, 15 bp, Homo sapiens
ttatttatactttta

SEQ ID NO: 328597 - DNA, 15 bp, Homo sapiens
tatttatacttttat

SEQ ID NO: 328598 - DNA, 15 bp, Homo sapiens
atttatacttttata

SEQ ID NO: 328599 - DNA, 15 bp, Homo sapiens
tttatacttttatag

SEQ ID NO: 328600 - DNA, 15 bp, Homo sapiens
ttatacttttataga

SEQ ID NO: 328601 - DNA, 15 bp, Homo sapiens
tatacttttatagat

SEQ ID NO: 328602 - DNA, 15 bp, Homo sapiens
atacttttatagata

SEQ ID NO: 328603 - DNA, 15 bp, Homo sapiens
tacttttatagatag

SEQ ID NO: 328604 - DNA, 15 bp, Homo sapiens
acttttatagataga

SEQ ID NO: 328605 - DNA, 15 bp, Homo sapiens
cttttatagatagac

SEQ ID NO: 328606 - DNA, 15 bp, Homo sapiens
ttttatagatagaca

SEQ ID NO: 328607 - DNA, 15 bp, Homo sapiens
tttatagatagacag

SEQ ID NO: 328608 - DNA, 15 bp, Homo sapiens
ttatagatagacaga

SEQ ID NO: 328609 - DNA, 15 bp, Homo sapiens
tatagatagacagat

SEQ ID NO: 328610 - DNA, 15 bp, Homo sapiens
atagatagacagatt

SEQ ID NO: 328611 - DNA, 15 bp, Homo sapiens
tagatagacagattt

SEQ ID NO: 328612 - DNA, 15 bp, Homo sapiens
agatagacagattta

SEQ ID NO: 328613 - DNA, 15 bp, Homo sapiens
gatagacagatttac

SEQ ID NO: 328614 - DNA, 15 bp, Homo sapiens
atagacagatttact

SEQ ID NO: 328615 - DNA, 15 bp, Homo sapiens
tagacagatttacta

SEQ ID NO: 328616 - DNA, 15 bp, Homo sapiens
agacagatttactac

SEQ ID NO: 328617 - DNA, 15 bp, Homo sapiens
gacagatttactact

SEQ ID NO: 328618 - DNA, 15 bp, Homo sapiens
acagatttactactg

SEQ ID NO: 328619 - DNA, 15 bp, Homo sapiens
cagatttactactgg

SEQ ID NO: 328620 - DNA, 15 bp, Homo sapiens
agatttactactgga

SEQ ID NO: 328621 - DNA, 15 bp, Homo sapiens
gatttactactggac

SEQ ID NO: 328622 - DNA, 15 bp, Homo sapiens
atttactactggaca

SEQ ID NO: 328623 - DNA, 15 bp, Homo sapiens
tttactactggacat

SEQ ID NO: 328624 - DNA, 15 bp, Homo sapiens
ttactactggacatt

SEQ ID NO: 328625 - DNA, 15 bp, Homo sapiens
tactactggacattc

SEQ ID NO: 328626 - DNA, 15 bp, Homo sapiens
actactggacattct

SEQ ID NO: 328627 - DNA, 15 bp, Homo sapiens
ctactggacattctc

SEQ ID NO: 328628 - DNA, 15 bp, Homo sapiens
tactggacattctct

SEQ ID NO: 328629 - DNA, 15 bp, Homo sapiens
actggacattctctg

SEQ ID NO: 328630 - DNA, 15 bp, Homo sapiens
ctggacattctctgg

SEQ ID NO: 328631 - DNA, 15 bp, Homo sapiens
tggacattctctggc

SEQ ID NO: 328632 - DNA, 15 bp, Homo sapiens
ggacattctctggca

SEQ ID NO: 328633 - DNA, 15 bp, Homo sapiens
gacattctctggcag

SEQ ID NO: 328634 - DNA, 15 bp, Homo sapiens
acattctctggcaga

SEQ ID NO: 328635 - DNA, 15 bp, Homo sapiens
cattctctggcagag

SEQ ID NO: 328636 - DNA, 15 bp, Homo sapiens
attctctggcagaga

SEQ ID NO: 328637 - DNA, 15 bp, Homo sapiens
ttctctggcagagaa

SEQ ID NO: 328638 - DNA, 15 bp, Homo sapiens
tctctggcagagaaa

SEQ ID NO: 328639 - DNA, 15 bp, Homo sapiens
ctctggcagagaaaa

SEQ ID NO: 328640 - DNA, 15 bp, Homo sapiens
tctggcagagaaaaa

SEQ ID NO: 328641 - DNA, 15 bp, Homo sapiens
ctggcagagaaaaat

SEQ ID NO: 328642 - DNA, 15 bp, Homo sapiens
tggcagagaaaaatt

SEQ ID NO: 328643 - DNA, 15 bp, Homo sapiens
ggcagagaaaaattt

SEQ ID NO: 328644 - DNA, 15 bp, Homo sapiens
gcagagaaaaatttc

SEQ ID NO: 328645 - DNA, 15 bp, Homo sapiens
cagagaaaaatttca

SEQ ID NO: 328646 - DNA, 15 bp, Homo sapiens
agagaaaaatttcat

SEQ ID NO: 328647 - DNA, 15 bp, Homo sapiens
gagaaaaatttcatg

SEQ ID NO: 328648 - DNA, 15 bp, Homo sapiens
agaaaaatttcatgg

SEQ ID NO: 328649 - DNA, 15 bp, Homo sapiens
gaaaaatttcatgga

SEQ ID NO: 328650 - DNA, 15 bp, Homo sapiens
aaaaatttcatggaa

SEQ ID NO: 328651 - DNA, 15 bp, Homo sapiens
aaaatttcatggaaa

SEQ ID NO: 328652 - DNA, 15 bp, Homo sapiens
aaatttcatggaaag

SEQ ID NO: 328653 - DNA, 15 bp, Homo sapiens
aatttcatggaaagt

SEQ ID NO: 328654 - DNA, 15 bp, Homo sapiens
atttcatggaaagtg

SEQ ID NO: 328655 - DNA, 15 bp, Homo sapiens
tttcatggaaagtga

SEQ ID NO: 328656 - DNA, 15 bp, Homo sapiens
ttcatggaaagtgaa

SEQ ID NO: 328657 - DNA, 15 bp, Homo sapiens
tcatggaaagtgaag

SEQ ID NO: 328658 - DNA, 15 bp, Homo sapiens
catggaaagtgaagt

SEQ ID NO: 328659 - DNA, 15 bp, Homo sapiens
atggaaagtgaagtt

SEQ ID NO: 328660 - DNA, 15 bp, Homo sapiens
tggaaagtgaagttt

SEQ ID NO: 328661 - DNA, 15 bp, Homo sapiens
ggaaagtgaagttta

SEQ ID NO: 328662 - DNA, 15 bp, Homo sapiens
gaaagtgaagtttaa

SEQ ID NO: 328663 - DNA, 15 bp, Homo sapiens
aaagtgaagtttaat

SEQ ID NO: 328664 - DNA, 15 bp, Homo sapiens
aagtgaagtttaatg

SEQ ID NO: 328665 - DNA, 15 bp, Homo sapiens
agtgaagtttaatgt

SEQ ID NO: 328666 - DNA, 15 bp, Homo sapiens
gtgaagtttaatgtg

SEQ ID NO: 328667 - DNA, 15 bp, Homo sapiens
tgaagtttaatgtga

SEQ ID NO: 328668 - DNA, 15 bp, Homo sapiens
gaagtttaatgtgaa

SEQ ID NO: 328669 - DNA, 15 bp, Homo sapiens
aagtttaatgtgaaa

SEQ ID NO: 328670 - DNA, 15 bp, Homo sapiens
agtttaatgtgaaat

SEQ ID NO: 328671 - DNA, 15 bp, Homo sapiens
gtttaatgtgaaatg

SEQ ID NO: 328672 - DNA, 15 bp, Homo sapiens
tttaatgtgaaatgg

SEQ ID NO: 328673 - DNA, 15 bp, Homo sapiens
ttaatgtgaaatggc

SEQ ID NO: 328674 - DNA, 15 bp, Homo sapiens
taatgtgaaatggca

SEQ ID NO: 328675 - DNA, 15 bp, Homo sapiens
aatgtgaaatggcac

SEQ ID NO: 328676 - DNA, 15 bp, Homo sapiens
gtgaaatggcacata

SEQ ID NO: 328677 - DNA, 15 bp, Homo sapiens
tgaaatggcacataa

SEQ ID NO: 328678 - DNA, 15 bp, Homo sapiens
gaaatggcacataag

SEQ ID NO: 328679 - DNA, 15 bp, Homo sapiens
aaatggcacataagt

SEQ ID NO: 328680 - DNA, 15 bp, Homo sapiens
aatggcacataagtg

SEQ ID NO: 328681 - DNA, 15 bp, Homo sapiens
atggcacataagtgg

SEQ ID NO: 328682 - DNA, 15 bp, Homo sapiens
tggcacataagtggt

SEQ ID NO: 328683 - DNA, 15 bp, Homo sapiens
ggcacataagtggtc

SEQ ID NO: 328684 - DNA, 15 bp, Homo sapiens
gcacataagtggtcc

SEQ ID NO: 328685 - DNA, 15 bp, Homo sapiens
cacataagtggtcct

SEQ ID NO: 328686 - DNA, 15 bp, Homo sapiens
acataagtggtcctg

SEQ ID NO: 328687 - DNA, 15 bp, Homo sapiens
cataagtggtcctga

SEQ ID NO: 328688 - DNA, 15 bp, Homo sapiens
ataagtggtcctgac

SEQ ID NO: 328689 - DNA, 15 bp, Homo sapiens
taagtggtcctgact

SEQ ID NO: 328690 - DNA, 15 bp, Homo sapiens
aagtggtcctgactt

SEQ ID NO: 328691 - DNA, 15 bp, Homo sapiens
agtggtcctgacttg

SEQ ID NO: 328692 - DNA, 15 bp, Homo sapiens
gtggtcctgacttgc

SEQ ID NO: 328693 - DNA, 15 bp, Homo sapiens
tggtcctgacttgca

SEQ ID NO: 328694 - DNA, 15 bp, Homo sapiens
ggtcctgacttgcaa

SEQ ID NO: 328695 - DNA, 15 bp, Homo sapiens
gtcctgacttgcaaa

SEQ ID NO: 328696 - DNA, 15 bp, Homo sapiens
tcctgacttgcaaac

SEQ ID NO: 328697 - DNA, 15 bp, Homo sapiens
cctgacttgcaaact

SEQ ID NO: 328698 - DNA, 15 bp, Homo sapiens
ctgacttgcaaactc

SEQ ID NO: 328699 - DNA, 15 bp, Homo sapiens
tgacttgcaaactca

SEQ ID NO: 328700 - DNA, 15 bp, Homo sapiens
gacttgcaaactcag

SEQ ID NO: 328701 - DNA, 15 bp, Homo sapiens
acttgcaaactcagg

SEQ ID NO: 328702 - DNA, 15 bp, Homo sapiens
cttgcaaactcagga

SEQ ID NO: 328703 - DNA, 15 bp, Homo sapiens
ttgcaaactcaggaa

SEQ ID NO: 328704 - DNA, 15 bp, Homo sapiens
tgcaaactcaggaat

SEQ ID NO: 328705 - DNA, 15 bp, Homo sapiens
gcaaactcaggaatg

SEQ ID NO: 328706 - DNA, 15 bp, Homo sapiens
caaactcaggaatgg

SEQ ID NO: 328707 - DNA, 15 bp, Homo sapiens
aaactcaggaatggc

SEQ ID NO: 328708 - DNA, 15 bp, Homo sapiens
aactcaggaatggct

SEQ ID NO: 328709 - DNA, 15 bp, Homo sapiens
actcaggaatggctt

SEQ ID NO: 328710 - DNA, 15 bp, Homo sapiens
ctcaggaatggcttg

SEQ ID NO: 328711 - DNA, 15 bp, Homo sapiens
tcaggaatggcttgt

SEQ ID NO: 328712 - DNA, 15 bp, Homo sapiens
caggaatggcttgtt

SEQ ID NO: 328713 - DNA, 15 bp, Homo sapiens
aggaatggcttgttg

SEQ ID NO: 328714 - DNA, 15 bp, Homo sapiens
ggaatggcttgttga

SEQ ID NO: 328715 - DNA, 15 bp, Homo sapiens
gaatggcttgttgac

SEQ ID NO: 328716 - DNA, 15 bp, Homo sapiens
aatggcttgttgacc

SEQ ID NO: 328717 - DNA, 15 bp, Homo sapiens
atggcttgttgacca

SEQ ID NO: 328718 - DNA, 15 bp, Homo sapiens
tggcttgttgaccac

SEQ ID NO: 328719 - DNA, 15 bp, Homo sapiens
ggcttgttgaccact

SEQ ID NO: 328720 - DNA, 15 bp, Homo sapiens
gcttgttgaccactg

SEQ ID NO: 328721 - DNA, 15 bp, Homo sapiens
cttgttgaccactgt

SEQ ID NO: 328722 - DNA, 15 bp, Homo sapiens
ttgttgaccactgtc

SEQ ID NO: 328723 - DNA, 15 bp, Homo sapiens
tgttgaccactgtcc

SEQ ID NO: 328724 - DNA, 15 bp, Homo sapiens
gttgaccactgtcct

SEQ ID NO: 328725 - DNA, 15 bp, Homo sapiens
ttgaccactgtcctg

SEQ ID NO: 328726 - DNA, 15 bp, Homo sapiens
tgaccactgtcctgg

SEQ ID NO: 328727 - DNA, 15 bp, Homo sapiens
gaccactgtcctgga

SEQ ID NO: 328728 - DNA, 15 bp, Homo sapiens
accactgtcctggaa

SEQ ID NO: 328729 - DNA, 15 bp, Homo sapiens
ccactgtcctggaat

SEQ ID NO: 328730 - DNA, 15 bp, Homo sapiens
cactgtcctggaata

SEQ ID NO: 328731 - DNA, 15 bp, Homo sapiens
actgtcctggaataa

SEQ ID NO: 328732 - DNA, 15 bp, Homo sapiens
ctgtcctggaataag

SEQ ID NO: 328733 - DNA, 15 bp, Homo sapiens
tgtcctggaataaga

SEQ ID NO: 328734 - DNA, 15 bp, Homo sapiens
gtcctggaataagag

SEQ ID NO: 328735 - DNA, 15 bp, Homo sapiens
tcctggaataagaga

SEQ ID NO: 328736 - DNA, 15 bp, Homo sapiens
cctggaataagagag

SEQ ID NO: 328737 - DNA, 15 bp, Homo sapiens
ctggaataagagagc

SEQ ID NO: 328738 - DNA, 15 bp, Homo sapiens
tggaataagagagcc

SEQ ID NO: 328739 - DNA, 15 bp, Homo sapiens
ggaataagagagccc

SEQ ID NO: 328740 - DNA, 15 bp, Homo sapiens
gaataagagagccca

SEQ ID NO: 328741 - DNA, 15 bp, Homo sapiens
aataagagagcccag

SEQ ID NO: 328742 - DNA, 15 bp, Homo sapiens
ataagagagcccagc

SEQ ID NO: 328743 - DNA, 15 bp, Homo sapiens
taagagagcccagct

SEQ ID NO: 328744 - DNA, 15 bp, Homo sapiens
aagagagcccagctt

SEQ ID NO: 328745 - DNA, 15 bp, Homo sapiens
agagagcccagcttt

SEQ ID NO: 328746 - DNA, 15 bp, Homo sapiens
gagagcccagctttg

SEQ ID NO: 328747 - DNA, 15 bp, Homo sapiens
agagcccagctttgt

SEQ ID NO: 328748 - DNA, 15 bp, Homo sapiens
gagcccagctttgtt

SEQ ID NO: 328749 - DNA, 15 bp, Homo sapiens
agcccagctttgttc

SEQ ID NO: 328750 - DNA, 15 bp, Homo sapiens
gcccagctttgttct

SEQ ID NO: 328751 - DNA, 15 bp, Homo sapiens
cccagctttgttctt

SEQ ID NO: 328752 - DNA, 15 bp, Homo sapiens
ccagctttgttcttg

SEQ ID NO: 328753 - DNA, 15 bp, Homo sapiens
cagctttgttcttgt

SEQ ID NO: 328754 - DNA, 15 bp, Homo sapiens
agctttgttcttgtc

SEQ ID NO: 328755 - DNA, 15 bp, Homo sapiens
gctttgttcttgtct

SEQ ID NO: 328756 - DNA, 15 bp, Homo sapiens
ctttgttcttgtctt

SEQ ID NO: 328757 - DNA, 15 bp, Homo sapiens
tttgttcttgtctta

SEQ ID NO: 328758 - DNA, 15 bp, Homo sapiens
ttgttcttgtcttat

SEQ ID NO: 328759 - DNA, 15 bp, Homo sapiens
tgttcttgtcttatt

SEQ ID NO: 328760 - DNA, 15 bp, Homo sapiens
gttcttgtcttattt

SEQ ID NO: 328761 - DNA, 15 bp, Homo sapiens
ttcttgtcttatttc

SEQ ID NO: 328762 - DNA, 15 bp, Homo sapiens
tcttgtcttatttct

SEQ ID NO: 328763 - DNA, 15 bp, Homo sapiens
cttgtcttatttctg

SEQ ID NO: 328764 - DNA, 15 bp, Homo sapiens
ttgtcttatttctgg

SEQ ID NO: 328765 - DNA, 15 bp, Homo sapiens
tgtcttatttctgga

SEQ ID NO: 328766 - DNA, 15 bp, Homo sapiens
gtcttatttctggat

SEQ ID NO: 328767 - DNA, 15 bp, Homo sapiens
tcttatttctggatc

SEQ ID NO: 328768 - DNA, 15 bp, Homo sapiens
cttatttctggatcg

SEQ ID NO: 328769 - DNA, 15 bp, Homo sapiens
ttatttctggatcgc

SEQ ID NO: 328770 - DNA, 15 bp, Homo sapiens
tatttctggatcgcc

SEQ ID NO: 328771 - DNA, 15 bp, Homo sapiens
atttctggatcgccc

SEQ ID NO: 328772 - DNA, 15 bp, Homo sapiens
tttctggatcgccct

SEQ ID NO: 328773 - DNA, 15 bp, Homo sapiens
ttctggatcgccctt

SEQ ID NO: 328774 - DNA, 15 bp, Homo sapiens
tctggatcgcccttt

SEQ ID NO: 328775 - DNA, 15 bp, Homo sapiens
ctggatcgccctttc

SEQ ID NO: 328776 - DNA, 15 bp, Homo sapiens
tggatcgccctttct

SEQ ID NO: 328777 - DNA, 15 bp, Homo sapiens
ggatcgccctttctc

SEQ ID NO: 328778 - DNA, 15 bp, Homo sapiens
gatcgccctttctcc

SEQ ID NO: 328779 - DNA, 15 bp, Homo sapiens
atcgccctttctcct

SEQ ID NO: 328780 - DNA, 15 bp, Homo sapiens
tcgccctttctcctt

SEQ ID NO: 328781 - DNA, 15 bp, Homo sapiens
cgccctttctccttt

SEQ ID NO: 328782 - DNA, 15 bp, Homo sapiens
gccctttctcctttg

SEQ ID NO: 328783 - DNA, 15 bp, Homo sapiens
ccctttctcctttgt

SEQ ID NO: 328784 - DNA, 15 bp, Homo sapiens
cctttctcctttgta

SEQ ID NO: 328785 - DNA, 15 bp, Homo sapiens
ctttctcctttgtac

SEQ ID NO: 328786 - DNA, 15 bp, Homo sapiens
tttctcctttgtacc

SEQ ID NO: 328787 - DNA, 15 bp, Homo sapiens
ttctcctttgtacct

SEQ ID NO: 328788 - DNA, 15 bp, Homo sapiens
tctcctttgtacctt

SEQ ID NO: 328789 - DNA, 15 bp, Homo sapiens
ctcctttgtaccttc

SEQ ID NO: 328790 - DNA, 15 bp, Homo sapiens
tcctttgtaccttct

SEQ ID NO: 328791 - DNA, 15 bp, Homo sapiens
cctttgtaccttctg

SEQ ID NO: 328792 - DNA, 15 bp, Homo sapiens
ctttgtaccttctga

SEQ ID NO: 328793 - DNA, 15 bp, Homo sapiens
tttgtaccttctgac

SEQ ID NO: 328794 - DNA, 15 bp, Homo sapiens
ttgtaccttctgaca

SEQ ID NO: 328795 - DNA, 15 bp, Homo sapiens
tgtaccttctgacat

SEQ ID NO: 328796 - DNA, 15 bp, Homo sapiens
gtaccttctgacatt

SEQ ID NO: 328797 - DNA, 15 bp, Homo sapiens
taccttctgacattg

SEQ ID NO: 328798 - DNA, 15 bp, Homo sapiens
accttctgacattgt

SEQ ID NO: 328799 - DNA, 15 bp, Homo sapiens
ccttctgacattgtt

SEQ ID NO: 328800 - DNA, 15 bp, Homo sapiens
cttctgacattgttt

SEQ ID NO: 328801 - DNA, 15 bp, Homo sapiens
ttctgacattgtttc

SEQ ID NO: 328802 - DNA, 15 bp, Homo sapiens
tctgacattgtttct

SEQ ID NO: 328803 - DNA, 15 bp, Homo sapiens
ctgacattgtttctg

SEQ ID NO: 328804 - DNA, 15 bp, Homo sapiens
tgacattgtttctga

SEQ ID NO: 328805 - DNA, 15 bp, Homo sapiens
gacattgtttctgag

SEQ ID NO: 328806 - DNA, 15 bp, Homo sapiens
acattgtttctgagt

SEQ ID NO: 328807 - DNA, 15 bp, Homo sapiens
cattgtttctgagtt

SEQ ID NO: 328808 - DNA, 15 bp, Homo sapiens
attgtttctgagttc

SEQ ID NO: 328809 - DNA, 15 bp, Homo sapiens
ttgtttctgagttcc

SEQ ID NO: 328810 - DNA, 15 bp, Homo sapiens
tgtttctgagttccc

SEQ ID NO: 328811 - DNA, 15 bp, Homo sapiens
gtttctgagttccct

SEQ ID NO: 328812 - DNA, 15 bp, Homo sapiens
tttctgagttccctc

SEQ ID NO: 328813 - DNA, 15 bp, Homo sapiens
ttctgagttccctcc

SEQ ID NO: 328814 - DNA, 15 bp, Homo sapiens
tctgagttccctcct

SEQ ID NO: 328815 - DNA, 15 bp, Homo sapiens
ctgagttccctcctc

SEQ ID NO: 328816 - DNA, 15 bp, Homo sapiens
tgagttccctcctcc

SEQ ID NO: 328817 - DNA, 15 bp, Homo sapiens
gagttccctcctccc

SEQ ID NO: 328818 - DNA, 15 bp, Homo sapiens
agttccctcctccca

SEQ ID NO: 328819 - DNA, 15 bp, Homo sapiens
gttccctcctcccat

SEQ ID NO: 328820 - DNA, 15 bp, Homo sapiens
ttccctcctcccatc

SEQ ID NO: 328821 - DNA, 15 bp, Homo sapiens
tccctcctcccatct

SEQ ID NO: 328822 - DNA, 15 bp, Homo sapiens
ccctcctcccatctg

SEQ ID NO: 328823 - DNA, 15 bp, Homo sapiens
cctcctcccatctgc

SEQ ID NO: 328824 - DNA, 15 bp, Homo sapiens
ctcctcccatctgcc

SEQ ID NO: 328825 - DNA, 15 bp, Homo sapiens
tcctcccatctgcca

SEQ ID NO: 328826 - DNA, 15 bp, Homo sapiens
cctcccatctgccac

SEQ ID NO: 328827 - DNA, 15 bp, Homo sapiens
ctcccatctgccacc

SEQ ID NO: 328828 - DNA, 15 bp, Homo sapiens
tcccatctgccaccc

SEQ ID NO: 328829 - DNA, 15 bp, Homo sapiens
cccatctgccacccg

SEQ ID NO: 328830 - DNA, 15 bp, Homo sapiens
ccatctgccacccgc

SEQ ID NO: 328831 - DNA, 15 bp, Homo sapiens
catctgccacccgct

SEQ ID NO: 328832 - DNA, 15 bp, Homo sapiens
atctgccacccgctc

SEQ ID NO: 328833 - DNA, 15 bp, Homo sapiens
tctgccacccgctcc

SEQ ID NO: 328834 - DNA, 15 bp, Homo sapiens
ctgccacccgctcct

SEQ ID NO: 328835 - DNA, 15 bp, Homo sapiens
tgccacccgctcctt

SEQ ID NO: 328836 - DNA, 15 bp, Homo sapiens
gccacccgctccttt

SEQ ID NO: 328837 - DNA, 15 bp, Homo sapiens
ccacccgctcctttg

SEQ ID NO: 328838 - DNA, 15 bp, Homo sapiens
cacccgctcctttgc

SEQ ID NO: 328839 - DNA, 15 bp, Homo sapiens
acccgctcctttgca

SEQ ID NO: 328840 - DNA, 15 bp, Homo sapiens
cccgctcctttgcaa

SEQ ID NO: 328841 - DNA, 15 bp, Homo sapiens
ccgctcctttgcaac

SEQ ID NO: 328842 - DNA, 15 bp, Homo sapiens
cgctcctttgcaact

SEQ ID NO: 328843 - DNA, 15 bp, Homo sapiens
gctcctttgcaactc

SEQ ID NO: 328844 - DNA, 15 bp, Homo sapiens
ctcctttgcaactct

SEQ ID NO: 328845 - DNA, 15 bp, Homo sapiens
tcctttgcaactctg

SEQ ID NO: 328846 - DNA, 15 bp, Homo sapiens
cctttgcaactctgt

SEQ ID NO: 328847 - DNA, 15 bp, Homo sapiens
ctttgcaactctgta

SEQ ID NO: 328848 - DNA, 15 bp, Homo sapiens
tttgcaactctgtag

SEQ ID NO: 328849 - DNA, 15 bp, Homo sapiens
ttgcaactctgtaga

SEQ ID NO: 328850 - DNA, 15 bp, Homo sapiens
tgcaactctgtagag

SEQ ID NO: 328851 - DNA, 15 bp, Homo sapiens
gcaactctgtagagc

SEQ ID NO: 328852 - DNA, 15 bp, Homo sapiens
caactctgtagagca

SEQ ID NO: 328853 - DNA, 15 bp, Homo sapiens
aactctgtagagcat

SEQ ID NO: 328854 - DNA, 15 bp, Homo sapiens
actctgtagagcatt

SEQ ID NO: 328855 - DNA, 15 bp, Homo sapiens
ctctgtagagcattt

SEQ ID NO: 328856 - DNA, 15 bp, Homo sapiens
tctgtagagcatttt

SEQ ID NO: 328857 - DNA, 15 bp, Homo sapiens
ctgtagagcatttta

SEQ ID NO: 328858 - DNA, 15 bp, Homo sapiens
tgtagagcattttaa

SEQ ID NO: 328859 - DNA, 15 bp, Homo sapiens
gtagagcattttaat

SEQ ID NO: 328860 - DNA, 15 bp, Homo sapiens
tagagcattttaata

SEQ ID NO: 328861 - DNA, 15 bp, Homo sapiens
agagcattttaataa

SEQ ID NO: 328862 - DNA, 15 bp, Homo sapiens
gagcattttaataac

SEQ ID NO: 328863 - DNA, 15 bp, Homo sapiens
agcattttaataaca

SEQ ID NO: 328864 - DNA, 15 bp, Homo sapiens
gcattttaataacag

SEQ ID NO: 328865 - DNA, 15 bp, Homo sapiens
cattttaataacagg

SEQ ID NO: 328866 - DNA, 15 bp, Homo sapiens
attttaataacaggt

SEQ ID NO: 328867 - DNA, 15 bp, Homo sapiens
ttttaataacaggtt

SEQ ID NO: 328868 - DNA, 15 bp, Homo sapiens
tttaataacaggttg

SEQ ID NO: 328869 - DNA, 15 bp, Homo sapiens
ttaataacaggttgt

SEQ ID NO: 328870 - DNA, 15 bp, Homo sapiens
taataacaggttgtt

SEQ ID NO: 328871 - DNA, 15 bp, Homo sapiens
aataacaggttgttt

SEQ ID NO: 328872 - DNA, 15 bp, Homo sapiens
ataacaggttgtttg

SEQ ID NO: 328873 - DNA, 15 bp, Homo sapiens
taacaggttgtttgt

SEQ ID NO: 328874 - DNA, 15 bp, Homo sapiens
aacaggttgtttgtg

SEQ ID NO: 328875 - DNA, 15 bp, Homo sapiens
acaggttgtttgtgc

SEQ ID NO: 328876 - DNA, 15 bp, Homo sapiens
caggttgtttgtgcc

SEQ ID NO: 328877 - DNA, 15 bp, Homo sapiens
aggttgtttgtgcct

SEQ ID NO: 328878 - DNA, 15 bp, Homo sapiens
ggttgtttgtgcctg

SEQ ID NO: 328879 - DNA, 15 bp, Homo sapiens
gttgtttgtgcctgt

SEQ ID NO: 328880 - DNA, 15 bp, Homo sapiens
ttgtttgtgcctgtc

SEQ ID NO: 328881 - DNA, 15 bp, Homo sapiens
tgtttgtgcctgtct

SEQ ID NO: 328882 - DNA, 15 bp, Homo sapiens
gtttgtgcctgtctt

SEQ ID NO: 328883 - DNA, 15 bp, Homo sapiens
tttgtgcctgtcttg

SEQ ID NO: 328884 - DNA, 15 bp, Homo sapiens
ttgtgcctgtcttgc

SEQ ID NO: 328885 - DNA, 15 bp, Homo sapiens
tgtgcctgtcttgcc

SEQ ID NO: 328886 - DNA, 15 bp, Homo sapiens
gtgcctgtcttgcct

SEQ ID NO: 328887 - DNA, 15 bp, Homo sapiens
tgcctgtcttgcctc

SEQ ID NO: 328888 - DNA, 15 bp, Homo sapiens
gcctgtcttgcctct

SEQ ID NO: 328889 - DNA, 15 bp, Homo sapiens
cctgtcttgcctctg

SEQ ID NO: 328890 - DNA, 15 bp, Homo sapiens
ctgtcttgcctctgc

SEQ ID NO: 328891 - DNA, 15 bp, Homo sapiens
tgtcttgcctctgca

SEQ ID NO: 328892 - DNA, 15 bp, Homo sapiens
gtcttgcctctgcag

SEQ ID NO: 328893 - DNA, 15 bp, Homo sapiens
tcttgcctctgcagc

SEQ ID NO: 328894 - DNA, 15 bp, Homo sapiens
cttgcctctgcagca

SEQ ID NO: 328895 - DNA, 15 bp, Homo sapiens
ttgcctctgcagcac

SEQ ID NO: 328896 - DNA, 15 bp, Homo sapiens
tgcctctgcagcact

SEQ ID NO: 328897 - DNA, 15 bp, Homo sapiens
gcctctgcagcactc

SEQ ID NO: 328898 - DNA, 15 bp, Homo sapiens
cctctgcagcactca

SEQ ID NO: 328899 - DNA, 15 bp, Homo sapiens
ctctgcagcactcac

SEQ ID NO: 328900 - DNA, 15 bp, Homo sapiens
tctgcagcactcact

SEQ ID NO: 328901 - DNA, 15 bp, Homo sapiens
ctgcagcactcactc

SEQ ID NO: 328902 - DNA, 15 bp, Homo sapiens
tgcagcactcactcc

SEQ ID NO: 328903 - DNA, 15 bp, Homo sapiens
gcagcactcactccc

SEQ ID NO: 328904 - DNA, 15 bp, Homo sapiens
cagcactcactccca

SEQ ID NO: 328905 - DNA, 15 bp, Homo sapiens
agcactcactcccac

SEQ ID NO: 328906 - DNA, 15 bp, Homo sapiens
gcactcactcccacc

SEQ ID NO: 328907 - DNA, 15 bp, Homo sapiens
cactcactcccacct

SEQ ID NO: 328908 - DNA, 15 bp, Homo sapiens
actcactcccacctg

SEQ ID NO: 328909 - DNA, 15 bp, Homo sapiens
ctcactcccacctgt

SEQ ID NO: 328910 - DNA, 15 bp, Homo sapiens
tcactcccacctgtt

SEQ ID NO: 328911 - DNA, 15 bp, Homo sapiens
cactcccacctgttt

SEQ ID NO: 328912 - DNA, 15 bp, Homo sapiens
actcccacctgtttc

SEQ ID NO: 328913 - DNA, 15 bp, Homo sapiens
ctcccacctgtttcc

SEQ ID NO: 328914 - DNA, 15 bp, Homo sapiens
tcccacctgtttcct

SEQ ID NO: 328915 - DNA, 15 bp, Homo sapiens
cccacctgtttcctc

SEQ ID NO: 328916 - DNA, 15 bp, Homo sapiens
ccacctgtttcctca

SEQ ID NO: 328917 - DNA, 15 bp, Homo sapiens
cacctgtttcctcag

SEQ ID NO: 328918 - DNA, 15 bp, Homo sapiens
acctgtttcctcagc

SEQ ID NO: 328919 - DNA, 15 bp, Homo sapiens
cctgtttcctcagcc

SEQ ID NO: 328920 - DNA, 15 bp, Homo sapiens
ctgtttcctcagcct

SEQ ID NO: 328921 - DNA, 15 bp, Homo sapiens
tgtttcctcagcctc

SEQ ID NO: 328922 - DNA, 15 bp, Homo sapiens
gtttcctcagcctct

SEQ ID NO: 328923 - DNA, 15 bp, Homo sapiens
tttcctcagcctctg

SEQ ID NO: 328924 - DNA, 15 bp, Homo sapiens
ttcctcagcctctga

SEQ ID NO: 328925 - DNA, 15 bp, Homo sapiens
tcctcagcctctgac

SEQ ID NO: 328926 - DNA, 15 bp, Homo sapiens
cctcagcctctgact

SEQ ID NO: 328927 - DNA, 15 bp, Homo sapiens
ctcagcctctgactt

SEQ ID NO: 328928 - DNA, 15 bp, Homo sapiens
tcagcctctgacttc

SEQ ID NO: 328929 - DNA, 15 bp, Homo sapiens
cagcctctgacttct

SEQ ID NO: 328930 - DNA, 15 bp, Homo sapiens
agcctctgacttctc

SEQ ID NO: 328931 - DNA, 15 bp, Homo sapiens
gcctctgacttctcc

SEQ ID NO: 328932 - DNA, 15 bp, Homo sapiens
cctctgacttctcct

SEQ ID NO: 328933 - DNA, 15 bp, Homo sapiens
ctctgacttctcctt

SEQ ID NO: 328934 - DNA, 15 bp, Homo sapiens
tctgacttctccttt

SEQ ID NO: 328935 - DNA, 15 bp, Homo sapiens
ctgacttctcctttc

SEQ ID NO: 328936 - DNA, 15 bp, Homo sapiens
tgacttctcctttcc

SEQ ID NO: 328937 - DNA, 15 bp, Homo sapiens
gacttctcctttccc

SEQ ID NO: 328938 - DNA, 15 bp, Homo sapiens
acttctcctttcccc

SEQ ID NO: 328939 - DNA, 15 bp, Homo sapiens
cttctcctttcccct

SEQ ID NO: 328940 - DNA, 15 bp, Homo sapiens
ttctcctttcccctt

SEQ ID NO: 328941 - DNA, 15 bp, Homo sapiens
tctcctttccccttt

SEQ ID NO: 328942 - DNA, 15 bp, Homo sapiens
ctcctttcccctttt

SEQ ID NO: 328943 - DNA, 15 bp, Homo sapiens
tcctttccccttttt

SEQ ID NO: 328944 - DNA, 15 bp, Homo sapiens
cctttcccctttttg

SEQ ID NO: 328945 - DNA, 15 bp, Homo sapiens
ctttcccctttttgg

SEQ ID NO: 328946 - DNA, 15 bp, Homo sapiens
tttcccctttttggc

SEQ ID NO: 328947 - DNA, 15 bp, Homo sapiens
ttcccctttttggca

SEQ ID NO: 328948 - DNA, 15 bp, Homo sapiens
tcccctttttggcat

SEQ ID NO: 328949 - DNA, 15 bp, Homo sapiens
cccctttttggcatg

SEQ ID NO: 328950 - DNA, 15 bp, Homo sapiens
ccctttttggcatgc

SEQ ID NO: 328951 - DNA, 15 bp, Homo sapiens
cctttttggcatgct

SEQ ID NO: 328952 - DNA, 15 bp, Homo sapiens
ctttttggcatgctc

SEQ ID NO: 328953 - DNA, 15 bp, Homo sapiens
tttttggcatgctct

SEQ ID NO: 328954 - DNA, 15 bp, Homo sapiens
ttttggcatgctctg

SEQ ID NO: 328955 - DNA, 15 bp, Homo sapiens
tttggcatgctctga

SEQ ID NO: 328956 - DNA, 15 bp, Homo sapiens
ttggcatgctctgac

SEQ ID NO: 328957 - DNA, 15 bp, Homo sapiens
tggcatgctctgacc

SEQ ID NO: 328958 - DNA, 15 bp, Homo sapiens
ggcatgctctgacct

SEQ ID NO: 328959 - DNA, 15 bp, Homo sapiens
gcatgctctgacctg

SEQ ID NO: 328960 - DNA, 15 bp, Homo sapiens
catgctctgacctgc

SEQ ID NO: 328961 - DNA, 15 bp, Homo sapiens
atgctctgacctgcc

SEQ ID NO: 328962 - DNA, 15 bp, Homo sapiens
tgctctgacctgcct

SEQ ID NO: 328963 - DNA, 15 bp, Homo sapiens
gctctgacctgcctc

SEQ ID NO: 328964 - DNA, 15 bp, Homo sapiens
ctctgacctgcctcc

SEQ ID NO: 328965 - DNA, 15 bp, Homo sapiens
tctgacctgcctccg

SEQ ID NO: 328966 - DNA, 15 bp, Homo sapiens
ctgacctgcctccgt

SEQ ID NO: 328967 - DNA, 15 bp, Homo sapiens
tgacctgcctccgta

SEQ ID NO: 328968 - DNA, 15 bp, Homo sapiens
gacctgcctccgtag

SEQ ID NO: 328969 - DNA, 15 bp, Homo sapiens
acctgcctccgtagt

SEQ ID NO: 328970 - DNA, 15 bp, Homo sapiens
cctgcctccgtagtt

SEQ ID NO: 328971 - DNA, 15 bp, Homo sapiens
ctgcctccgtagttg

SEQ ID NO: 328972 - DNA, 15 bp, Homo sapiens
tgcctccgtagttga

SEQ ID NO: 328973 - DNA, 15 bp, Homo sapiens
gcctccgtagttgaa

SEQ ID NO: 328974 - DNA, 15 bp, Homo sapiens
cctccgtagttgaac

SEQ ID NO: 328975 - DNA, 15 bp, Homo sapiens
ctccgtagttgaacc

SEQ ID NO: 328976 - DNA, 15 bp, Homo sapiens
tccgtagttgaaccc

SEQ ID NO: 328977 - DNA, 15 bp, Homo sapiens
ccgtagttgaacccg

SEQ ID NO: 328978 - DNA, 15 bp, Homo sapiens
cgtagttgaacccga

SEQ ID NO: 328979 - DNA, 15 bp, Homo sapiens
gtagttgaacccgat

SEQ ID NO: 328980 - DNA, 15 bp, Homo sapiens
tagttgaacccgatt

SEQ ID NO: 328981 - DNA, 15 bp, Homo sapiens
agttgaacccgattc

SEQ ID NO: 328982 - DNA, 15 bp, Homo sapiens
gttgaacccgattcc

SEQ ID NO: 328983 - DNA, 15 bp, Homo sapiens
ttgaacccgattcct

SEQ ID NO: 328984 - DNA, 15 bp, Homo sapiens
tgaacccgattcctg

SEQ ID NO: 328985 - DNA, 15 bp, Homo sapiens
gaacccgattcctga

SEQ ID NO: 328986 - DNA, 15 bp, Homo sapiens
aacccgattcctgag

SEQ ID NO: 328987 - DNA, 15 bp, Homo sapiens
acccgattcctgagg

SEQ ID NO: 328988 - DNA, 15 bp, Homo sapiens
cccgattcctgaggc

SEQ ID NO: 328989 - DNA, 15 bp, Homo sapiens
ccgattcctgaggca

SEQ ID NO: 328990 - DNA, 15 bp, Homo sapiens
cgattcctgaggcaa

SEQ ID NO: 328991 - DNA, 15 bp, Homo sapiens
gattcctgaggcaat

SEQ ID NO: 328992 - DNA, 15 bp, Homo sapiens
attcctgaggcaatg

SEQ ID NO: 328993 - DNA, 15 bp, Homo sapiens
ttcctgaggcaatga

SEQ ID NO: 328994 - DNA, 15 bp, Homo sapiens
tcctgaggcaatgat

SEQ ID NO: 328995 - DNA, 15 bp, Homo sapiens
cctgaggcaatgata

SEQ ID NO: 328996 - DNA, 15 bp, Homo sapiens
ctgaggcaatgatat

SEQ ID NO: 328997 - DNA, 15 bp, Homo sapiens
tgaggcaatgatatg

SEQ ID NO: 328998 - DNA, 15 bp, Homo sapiens
gaggcaatgatatgg

SEQ ID NO: 328999 - DNA, 15 bp, Homo sapiens
aggcaatgatatggc

SEQ ID NO: 329000 - DNA, 15 bp, Homo sapiens
ggcaatgatatggca

SEQ ID NO: 329001 - DNA, 15 bp, Homo sapiens
gcaatgatatggcag

SEQ ID NO: 329002 - DNA, 15 bp, Homo sapiens
caatgatatggcagg

SEQ ID NO: 329003 - DNA, 15 bp, Homo sapiens
aatgatatggcaggt

SEQ ID NO: 329004 - DNA, 15 bp, Homo sapiens
atgatatggcaggtc

SEQ ID NO: 329005 - DNA, 15 bp, Homo sapiens
tgatatggcaggtcc

SEQ ID NO: 329006 - DNA, 15 bp, Homo sapiens
gatatggcaggtccc

SEQ ID NO: 329007 - DNA, 15 bp, Homo sapiens
atatggcaggtccct

SEQ ID NO: 329008 - DNA, 15 bp, Homo sapiens
tatggcaggtccctc

SEQ ID NO: 329009 - DNA, 15 bp, Homo sapiens
atggcaggtccctca

SEQ ID NO: 329010 - DNA, 15 bp, Homo sapiens
tggcaggtccctcaa

SEQ ID NO: 329011 - DNA, 15 bp, Homo sapiens
ggcaggtccctcaac

SEQ ID NO: 329012 - DNA, 15 bp, Homo sapiens
gcaggtccctcaact

SEQ ID NO: 329013 - DNA, 15 bp, Homo sapiens
caggtccctcaactc

SEQ ID NO: 329014 - DNA, 15 bp, Homo sapiens
aggtccctcaactct

SEQ ID NO: 329015 - DNA, 15 bp, Homo sapiens
ggtccctcaactctc

SEQ ID NO: 329016 - DNA, 15 bp, Homo sapiens
gtccctcaactctcc

SEQ ID NO: 329017 - DNA, 15 bp, Homo sapiens
tccctcaactctcca

SEQ ID NO: 329018 - DNA, 15 bp, Homo sapiens
ccctcaactctccat

SEQ ID NO: 329019 - DNA, 15 bp, Homo sapiens
cctcaactctccatc

SEQ ID NO: 329020 - DNA, 15 bp, Homo sapiens
ctcaactctccatct

SEQ ID NO: 329021 - DNA, 15 bp, Homo sapiens
tcaactctccatcta

SEQ ID NO: 329022 - DNA, 15 bp, Homo sapiens
caactctccatctat

SEQ ID NO: 329023 - DNA, 15 bp, Homo sapiens
aactctccatctata

SEQ ID NO: 329024 - DNA, 15 bp, Homo sapiens
actctccatctatag

SEQ ID NO: 329025 - DNA, 15 bp, Homo sapiens
ctctccatctatagc

SEQ ID NO: 329026 - DNA, 15 bp, Homo sapiens
tctccatctatagca

SEQ ID NO: 329027 - DNA, 15 bp, Homo sapiens
ctccatctatagcac

SEQ ID NO: 329028 - DNA, 15 bp, Homo sapiens
tccatctatagcact

SEQ ID NO: 329029 - DNA, 15 bp, Homo sapiens
ccatctatagcactt

SEQ ID NO: 329030 - DNA, 15 bp, Homo sapiens
catctatagcacttg

SEQ ID NO: 329031 - DNA, 15 bp, Homo sapiens
atctatagcacttgc

SEQ ID NO: 329032 - DNA, 15 bp, Homo sapiens
tctatagcacttgcc

SEQ ID NO: 329033 - DNA, 15 bp, Homo sapiens
ctatagcacttgcct

SEQ ID NO: 329034 - DNA, 15 bp, Homo sapiens
tatagcacttgcctt

SEQ ID NO: 329035 - DNA, 15 bp, Homo sapiens
atagcacttgccttg

SEQ ID NO: 329036 - DNA, 15 bp, Homo sapiens
tagcacttgccttgc

SEQ ID NO: 329037 - DNA, 15 bp, Homo sapiens
agcacttgccttgcc

SEQ ID NO: 329038 - DNA, 15 bp, Homo sapiens
gcacttgccttgcct

SEQ ID NO: 329039 - DNA, 15 bp, Homo sapiens
cacttgccttgcctg

SEQ ID NO: 329040 - DNA, 15 bp, Homo sapiens
acttgccttgcctgg

SEQ ID NO: 329041 - DNA, 15 bp, Homo sapiens
cttgccttgcctggc

SEQ ID NO: 329042 - DNA, 15 bp, Homo sapiens
ttgccttgcctggcc

SEQ ID NO: 329043 - DNA, 15 bp, Homo sapiens
tgccttgcctggcct

SEQ ID NO: 329044 - DNA, 15 bp, Homo sapiens
gccttgcctggcctg

SEQ ID NO: 329045 - DNA, 15 bp, Homo sapiens
ccttgcctggcctgg

SEQ ID NO: 329046 - DNA, 15 bp, Homo sapiens
cttgcctggcctggg

SEQ ID NO: 329047 - DNA, 15 bp, Homo sapiens
ttgcctggcctggga

SEQ ID NO: 329048 - DNA, 15 bp, Homo sapiens
tgcctggcctgggaa

SEQ ID NO: 329049 - DNA, 15 bp, Homo sapiens
gcctggcctgggaac

SEQ ID NO: 329050 - DNA, 15 bp, Homo sapiens
cctggcctgggaacc

SEQ ID NO: 329051 - DNA, 15 bp, Homo sapiens
ctggcctgggaaccg

SEQ ID NO: 329052 - DNA, 15 bp, Homo sapiens
tggcctgggaaccgg

SEQ ID NO: 329053 - DNA, 15 bp, Homo sapiens
ggcctgggaaccggc

SEQ ID NO: 329054 - DNA, 15 bp, Homo sapiens
gcctgggaaccggct

SEQ ID NO: 329055 - DNA, 15 bp, Homo sapiens
cctgggaaccggctc

SEQ ID NO: 329056 - DNA, 15 bp, Homo sapiens
ctgggaaccggctct

SEQ ID NO: 329057 - DNA, 15 bp, Homo sapiens
tgggaaccggctctt

SEQ ID NO: 329058 - DNA, 15 bp, Homo sapiens
gggaaccggctcttt

SEQ ID NO: 329059 - DNA, 15 bp, Homo sapiens
ggaaccggctctttc

SEQ ID NO: 329060 - DNA, 15 bp, Homo sapiens
gaaccggctctttca

SEQ ID NO: 329061 - DNA, 15 bp, Homo sapiens
aaccggctctttcac

SEQ ID NO: 329062 - DNA, 15 bp, Homo sapiens
accggctctttcact

SEQ ID NO: 329063 - DNA, 15 bp, Homo sapiens
ccggctctttcactg

SEQ ID NO: 329064 - DNA, 15 bp, Homo sapiens
cggctctttcactgc

SEQ ID NO: 329065 - DNA, 15 bp, Homo sapiens
ggctctttcactgct

SEQ ID NO: 329066 - DNA, 15 bp, Homo sapiens
gctctttcactgctg

SEQ ID NO: 329067 - DNA, 15 bp, Homo sapiens
ctctttcactgctgt

SEQ ID NO: 329068 - DNA, 15 bp, Homo sapiens
tctttcactgctgta

SEQ ID NO: 329069 - DNA, 15 bp, Homo sapiens
ctttcactgctgtac

SEQ ID NO: 329070 - DNA, 15 bp, Homo sapiens
tttcactgctgtact

SEQ ID NO: 329071 - DNA, 15 bp, Homo sapiens
ttcactgctgtactg

SEQ ID NO: 329072 - DNA, 15 bp, Homo sapiens
tcactgctgtactgc

SEQ ID NO: 329073 - DNA, 15 bp, Homo sapiens
cactgctgtactgca

SEQ ID NO: 329074 - DNA, 15 bp, Homo sapiens
actgctgtactgcat

SEQ ID NO: 329075 - DNA, 15 bp, Homo sapiens
ctgctgtactgcatg

SEQ ID NO: 329076 - DNA, 15 bp, Homo sapiens
tgctgtactgcatgg

SEQ ID NO: 329077 - DNA, 15 bp, Homo sapiens
gctgtactgcatgga

SEQ ID NO: 329078 - DNA, 15 bp, Homo sapiens
ctgtactgcatggaa

SEQ ID NO: 329079 - DNA, 15 bp, Homo sapiens
tgtactgcatggaac

SEQ ID NO: 329080 - DNA, 15 bp, Homo sapiens
gtactgcatggaaca

SEQ ID NO: 329081 - DNA, 15 bp, Homo sapiens
tactgcatggaacag

SEQ ID NO: 329082 - DNA, 15 bp, Homo sapiens
actgcatggaacaga

SEQ ID NO: 329083 - DNA, 15 bp, Homo sapiens
ctgcatggaacagag

SEQ ID NO: 329084 - DNA, 15 bp, Homo sapiens
tgcatggaacagagt

SEQ ID NO: 329085 - DNA, 15 bp, Homo sapiens
gcatggaacagagta

SEQ ID NO: 329086 - DNA, 15 bp, Homo sapiens
catggaacagagtag

SEQ ID NO: 329087 - DNA, 15 bp, Homo sapiens
atggaacagagtagg

SEQ ID NO: 329088 - DNA, 15 bp, Homo sapiens
tggaacagagtaggc

SEQ ID NO: 329089 - DNA, 15 bp, Homo sapiens
ggaacagagtaggca

SEQ ID NO: 329090 - DNA, 15 bp, Homo sapiens
gaacagagtaggcac

SEQ ID NO: 329091 - DNA, 15 bp, Homo sapiens
aacagagtaggcact

SEQ ID NO: 329092 - DNA, 15 bp, Homo sapiens
acagagtaggcactg

SEQ ID NO: 329093 - DNA, 15 bp, Homo sapiens
cagagtaggcactgc

SEQ ID NO: 329094 - DNA, 15 bp, Homo sapiens
agagtaggcactgct

SEQ ID NO: 329095 - DNA, 15 bp, Homo sapiens
gagtaggcactgctt

SEQ ID NO: 329096 - DNA, 15 bp, Homo sapiens
agtaggcactgctta

SEQ ID NO: 329097 - DNA, 15 bp, Homo sapiens
gtaggcactgcttaa

SEQ ID NO: 329098 - DNA, 15 bp, Homo sapiens
taggcactgcttaaa

SEQ ID NO: 329099 - DNA, 15 bp, Homo sapiens
aggcactgcttaaac

SEQ ID NO: 329100 - DNA, 15 bp, Homo sapiens
ggcactgcttaaacc

SEQ ID NO: 329101 - DNA, 15 bp, Homo sapiens
gcactgcttaaacct

SEQ ID NO: 329102 - DNA, 15 bp, Homo sapiens
cactgcttaaaccta

SEQ ID NO: 329103 - DNA, 15 bp, Homo sapiens
actgcttaaacctat

SEQ ID NO: 329104 - DNA, 15 bp, Homo sapiens
ctgcttaaacctatc

SEQ ID NO: 329105 - DNA, 15 bp, Homo sapiens
tgcttaaacctatca

SEQ ID NO: 329106 - DNA, 15 bp, Homo sapiens
gcttaaacctatcag

SEQ ID NO: 329107 - DNA, 15 bp, Homo sapiens
cttaaacctatcagc

SEQ ID NO: 329108 - DNA, 15 bp, Homo sapiens
ttaaacctatcagct

SEQ ID NO: 329109 - DNA, 15 bp, Homo sapiens
taaacctatcagctg

SEQ ID NO: 329110 - DNA, 15 bp, Homo sapiens
aaacctatcagctgc

SEQ ID NO: 329111 - DNA, 15 bp, Homo sapiens
aacctatcagctgcc

SEQ ID NO: 329112 - DNA, 15 bp, Homo sapiens
acctatcagctgcct

SEQ ID NO: 329113 - DNA, 15 bp, Homo sapiens
cctatcagctgcctg

SEQ ID NO: 329114 - DNA, 15 bp, Homo sapiens
ctatcagctgcctgg

SEQ ID NO: 329115 - DNA, 15 bp, Homo sapiens
tatcagctgcctggc

SEQ ID NO: 329116 - DNA, 15 bp, Homo sapiens
atcagctgcctggct

SEQ ID NO: 329117 - DNA, 15 bp, Homo sapiens
tcagctgcctggctc

SEQ ID NO: 329118 - DNA, 15 bp, Homo sapiens
cagctgcctggctct

SEQ ID NO: 329119 - DNA, 15 bp, Homo sapiens
agctgcctggctctc

SEQ ID NO: 329120 - DNA, 15 bp, Homo sapiens
gctgcctggctctct

SEQ ID NO: 329121 - DNA, 15 bp, Homo sapiens
ctgcctggctctctc

SEQ ID NO: 329122 - DNA, 15 bp, Homo sapiens
tgcctggctctctca

SEQ ID NO: 329123 - DNA, 15 bp, Homo sapiens
gcctggctctctcaa

SEQ ID NO: 329124 - DNA, 15 bp, Homo sapiens
cctggctctctcaaa

SEQ ID NO: 329125 - DNA, 15 bp, Homo sapiens
ctggctctctcaaat

SEQ ID NO: 329126 - DNA, 15 bp, Homo sapiens
tggctctctcaaatg

SEQ ID NO: 329127 - DNA, 15 bp, Homo sapiens
ggctctctcaaatgc

SEQ ID NO: 329128 - DNA, 15 bp, Homo sapiens
gctctctcaaatgct

SEQ ID NO: 329129 - DNA, 15 bp, Homo sapiens
ctctctcaaatgctc

SEQ ID NO: 329130 - DNA, 15 bp, Homo sapiens
tctctcaaatgctct

SEQ ID NO: 329131 - DNA, 15 bp, Homo sapiens
ctctcaaatgctctt

SEQ ID NO: 329132 - DNA, 15 bp, Homo sapiens
tctcaaatgctcttt

SEQ ID NO: 329133 - DNA, 15 bp, Homo sapiens
ctcaaatgctctttc

SEQ ID NO: 329134 - DNA, 15 bp, Homo sapiens
tcaaatgctctttcc

SEQ ID NO: 329135 - DNA, 15 bp, Homo sapiens
caaatgctctttcca

SEQ ID NO: 329136 - DNA, 15 bp, Homo sapiens
aaatgctctttccag

SEQ ID NO: 329137 - DNA, 15 bp, Homo sapiens
aatgctctttccagg

SEQ ID NO: 329138 - DNA, 15 bp, Homo sapiens
atgctctttccagga

SEQ ID NO: 329139 - DNA, 15 bp, Homo sapiens
tgctctttccaggaa

SEQ ID NO: 329140 - DNA, 15 bp, Homo sapiens
gctctttccaggaac

SEQ ID NO: 329141 - DNA, 15 bp, Homo sapiens
ctctttccaggaact

SEQ ID NO: 329142 - DNA, 15 bp, Homo sapiens
tctttccaggaactc

SEQ ID NO: 329143 - DNA, 15 bp, Homo sapiens
ctttccaggaactct

SEQ ID NO: 329144 - DNA, 15 bp, Homo sapiens
tttccaggaactctg

SEQ ID NO: 329145 - DNA, 15 bp, Homo sapiens
ttccaggaactctgg

SEQ ID NO: 329146 - DNA, 15 bp, Homo sapiens
tccaggaactctggc

SEQ ID NO: 329147 - DNA, 15 bp, Homo sapiens
ccaggaactctggca

SEQ ID NO: 329148 - DNA, 15 bp, Homo sapiens
caggaactctggcac

SEQ ID NO: 329149 - DNA, 15 bp, Homo sapiens
aggaactctggcact

SEQ ID NO: 329150 - DNA, 15 bp, Homo sapiens
ggaactctggcactg

SEQ ID NO: 329151 - DNA, 15 bp, Homo sapiens
gaactctggcactgt

SEQ ID NO: 329152 - DNA, 15 bp, Homo sapiens
aactctggcactgtg

SEQ ID NO: 329153 - DNA, 15 bp, Homo sapiens
actctggcactgtga

SEQ ID NO: 329154 - DNA, 15 bp, Homo sapiens
ctctggcactgtgaa

SEQ ID NO: 329155 - DNA, 15 bp, Homo sapiens
tctggcactgtgaac

SEQ ID NO: 329156 - DNA, 15 bp, Homo sapiens
ctggcactgtgaacc

SEQ ID NO: 329157 - DNA, 15 bp, Homo sapiens
tggcactgtgaaccc

SEQ ID NO: 329158 - DNA, 15 bp, Homo sapiens
ggcactgtgaaccca

SEQ ID NO: 329159 - DNA, 15 bp, Homo sapiens
gcactgtgaacccac

SEQ ID NO: 329160 - DNA, 15 bp, Homo sapiens
cactgtgaacccact

SEQ ID NO: 329161 - DNA, 15 bp, Homo sapiens
actgtgaacccactg

SEQ ID NO: 329162 - DNA, 15 bp, Homo sapiens
ctgtgaacccactgc

SEQ ID NO: 329163 - DNA, 15 bp, Homo sapiens
tgtgaacccactgct

SEQ ID NO: 329164 - DNA, 15 bp, Homo sapiens
gtgaacccactgctg

SEQ ID NO: 329165 - DNA, 15 bp, Homo sapiens
tgaacccactgctga

SEQ ID NO: 329166 - DNA, 15 bp, Homo sapiens
gaacccactgctgaa

SEQ ID NO: 329167 - DNA, 15 bp, Homo sapiens
aacccactgctgaat

SEQ ID NO: 329168 - DNA, 15 bp, Homo sapiens
acccactgctgaatc

SEQ ID NO: 329169 - DNA, 15 bp, Homo sapiens
cccactgctgaatct

SEQ ID NO: 329170 - DNA, 15 bp, Homo sapiens
ccactgctgaatctc

SEQ ID NO: 329171 - DNA, 15 bp, Homo sapiens
cactgctgaatctcg

SEQ ID NO: 329172 - DNA, 15 bp, Homo sapiens
actgctgaatctcgt

SEQ ID NO: 329173 - DNA, 15 bp, Homo sapiens
ctgctgaatctcgtg

SEQ ID NO: 329174 - DNA, 15 bp, Homo sapiens
tgctgaatctcgtgg

SEQ ID NO: 329175 - DNA, 15 bp, Homo sapiens
gctgaatctcgtggc

SEQ ID NO: 329176 - DNA, 15 bp, Homo sapiens
ctgaatctcgtggct

SEQ ID NO: 329177 - DNA, 15 bp, Homo sapiens
tgaatctcgtggctc

SEQ ID NO: 329178 - DNA, 15 bp, Homo sapiens
gaatctcgtggctca

SEQ ID NO: 329179 - DNA, 15 bp, Homo sapiens
aatctcgtggctcat

SEQ ID NO: 329180 - DNA, 15 bp, Homo sapiens
atctcgtggctcata

SEQ ID NO: 329181 - DNA, 15 bp, Homo sapiens
tctcgtggctcataa

SEQ ID NO: 329182 - DNA, 15 bp, Homo sapiens
ctcgtggctcataaa

SEQ ID NO: 329183 - DNA, 15 bp, Homo sapiens
tcgtggctcataaat

SEQ ID NO: 329184 - DNA, 15 bp, Homo sapiens
cgtggctcataaata

SEQ ID NO: 329185 - DNA, 15 bp, Homo sapiens
gtggctcataaataa

SEQ ID NO: 329186 - DNA, 15 bp, Homo sapiens
tggctcataaataaa

SEQ ID NO: 329187 - DNA, 15 bp, Homo sapiens
ggctcataaataaac

SEQ ID NO: 329188 - DNA, 15 bp, Homo sapiens
gctcataaataaact

SEQ ID NO: 329189 - DNA, 15 bp, Homo sapiens
ctcataaataaactc

SEQ ID NO: 329190 - DNA, 15 bp, Homo sapiens
tcataaataaactct

SEQ ID NO: 329191 - DNA, 15 bp, Homo sapiens
cataaataaactctc

SEQ ID NO: 329192 - DNA, 15 bp, Homo sapiens
ataaataaactctca

SEQ ID NO: 329193 - DNA, 15 bp, Homo sapiens
taaataaactctcaa

SEQ ID NO: 329194 - DNA, 15 bp, Homo sapiens
aaataaactctcaag

SEQ ID NO: 329195 - DNA, 15 bp, Homo sapiens
aataaactctcaagt

SEQ ID NO: 329196 - DNA, 15 bp, Homo sapiens
ataaactctcaagtg

SEQ ID NO: 329197 - DNA, 15 bp, Homo sapiens
taaactctcaagtga

SEQ ID NO: 329198 - DNA, 15 bp, Homo sapiens
aaactctcaagtgat

SEQ ID NO: 329199 - DNA, 15 bp, Homo sapiens
aactctcaagtgata

SEQ ID NO: 329200 - DNA, 15 bp, Homo sapiens
actctcaagtgataa

SEQ ID NO: 329201 - DNA, 15 bp, Homo sapiens
ctctcaagtgataat

SEQ ID NO: 329202 - DNA, 15 bp, Homo sapiens
tctcaagtgataatt

SEQ ID NO: 329203 - DNA, 15 bp, Homo sapiens
ctcaagtgataattg

SEQ ID NO: 329204 - DNA, 15 bp, Homo sapiens
tcaagtgataattgt

SEQ ID NO: 329205 - DNA, 15 bp, Homo sapiens
caagtgataattgtg

SEQ ID NO: 329206 - DNA, 15 bp, Homo sapiens
aagtgataattgtga

SEQ ID NO: 329207 - DNA, 15 bp, Homo sapiens
agtgataattgtgac

SEQ ID NO: 329208 - DNA, 15 bp, Homo sapiens
gtgataattgtgact

SEQ ID NO: 329209 - DNA, 15 bp, Homo sapiens
tgataattgtgactt

SEQ ID NO: 329210 - DNA, 15 bp, Homo sapiens
gataattgtgacttg

SEQ ID NO: 329211 - DNA, 15 bp, Homo sapiens
ataattgtgacttga

SEQ ID NO: 329212 - DNA, 15 bp, Homo sapiens
taattgtgacttgaa

SEQ ID NO: 329213 - DNA, 15 bp, Homo sapiens
aattgtgacttgaat

SEQ ID NO: 329214 - DNA, 15 bp, Homo sapiens
attgtgacttgaatt

SEQ ID NO: 329215 - DNA, 15 bp, Homo sapiens
ttgtgacttgaattc

SEQ ID NO: 329216 - DNA, 15 bp, Homo sapiens
tgtgacttgaattct

SEQ ID NO: 329217 - DNA, 15 bp, Homo sapiens
gtgacttgaattctc

SEQ ID NO: 329218 - DNA, 15 bp, Homo sapiens
tgacttgaattctct

SEQ ID NO: 329219 - DNA, 15 bp, Homo sapiens
gacttgaattctcta

SEQ ID NO: 329220 - DNA, 15 bp, Homo sapiens
acttgaattctctag

SEQ ID NO: 329221 - DNA, 15 bp, Homo sapiens
cttgaattctctagt

SEQ ID NO: 329222 - DNA, 15 bp, Homo sapiens
ttgaattctctagtt

SEQ ID NO: 329223 - DNA, 15 bp, Homo sapiens
tgaattctctagttc

SEQ ID NO: 329224 - DNA, 15 bp, Homo sapiens
gaattctctagttct

SEQ ID NO: 329225 - DNA, 15 bp, Homo sapiens
aattctctagttctt

SEQ ID NO: 329226 - DNA, 15 bp, Homo sapiens
attctctagttctta

SEQ ID NO: 329227 - DNA, 15 bp, Homo sapiens
ttctctagttcttac

SEQ ID NO: 329228 - DNA, 15 bp, Homo sapiens
tctctagttcttacc

SEQ ID NO: 329229 - DNA, 15 bp, Homo sapiens
ctctagttcttacct

SEQ ID NO: 329230 - DNA, 15 bp, Homo sapiens
tctagttcttacctg

SEQ ID NO: 329231 - DNA, 15 bp, Homo sapiens
ctagttcttacctga

SEQ ID NO: 329232 - DNA, 15 bp, Homo sapiens
tagttcttacctgac

SEQ ID NO: 329233 - DNA, 15 bp, Homo sapiens
agttcttacctgacc

SEQ ID NO: 329234 - DNA, 15 bp, Homo sapiens
gttcttacctgacca

SEQ ID NO: 329235 - DNA, 15 bp, Homo sapiens
ttcttacctgaccac

SEQ ID NO: 329236 - DNA, 15 bp, Homo sapiens
tcttacctgaccacc

SEQ ID NO: 329237 - DNA, 15 bp, Homo sapiens
cttacctgaccacct

SEQ ID NO: 329238 - DNA, 15 bp, Homo sapiens
ttacctgaccacctc

SEQ ID NO: 329239 - DNA, 15 bp, Homo sapiens
tacctgaccacctct

SEQ ID NO: 329240 - DNA, 15 bp, Homo sapiens
acctgaccacctctt

SEQ ID NO: 329241 - DNA, 15 bp, Homo sapiens
cctgaccacctctta

SEQ ID NO: 329242 - DNA, 15 bp, Homo sapiens
ctgaccacctcttaa

SEQ ID NO: 329243 - DNA, 15 bp, Homo sapiens
tgaccacctcttaat

SEQ ID NO: 329244 - DNA, 15 bp, Homo sapiens
gaccacctcttaata

SEQ ID NO: 329245 - DNA, 15 bp, Homo sapiens
accacctcttaatat

SEQ ID NO: 329246 - DNA, 15 bp, Homo sapiens
ccacctcttaatatc

SEQ ID NO: 329247 - DNA, 15 bp, Homo sapiens
cacctcttaatatca

SEQ ID NO: 329248 - DNA, 15 bp, Homo sapiens
acctcttaatatcat

SEQ ID NO: 329249 - DNA, 15 bp, Homo sapiens
cctcttaatatcatc

SEQ ID NO: 329250 - DNA, 15 bp, Homo sapiens
ctcttaatatcatcc

SEQ ID NO: 329251 - DNA, 15 bp, Homo sapiens
tcttaatatcatcct

SEQ ID NO: 329252 - DNA, 15 bp, Homo sapiens
cttaatatcatcctg

SEQ ID NO: 329253 - DNA, 15 bp, Homo sapiens
ttaatatcatcctgg

SEQ ID NO: 329254 - DNA, 15 bp, Homo sapiens
taatatcatcctgga

SEQ ID NO: 329255 - DNA, 15 bp, Homo sapiens
aatatcatcctggaa

SEQ ID NO: 329256 - DNA, 15 bp, Homo sapiens
atatcatcctggaac

SEQ ID NO: 329257 - DNA, 15 bp, Homo sapiens
tatcatcctggaact

SEQ ID NO: 329258 - DNA, 15 bp, Homo sapiens
atcatcctggaactg

SEQ ID NO: 329259 - DNA, 15 bp, Homo sapiens
tcatcctggaactgt

SEQ ID NO: 329260 - DNA, 15 bp, Homo sapiens
catcctggaactgtc

SEQ ID NO: 329261 - DNA, 15 bp, Homo sapiens
atcctggaactgtct

SEQ ID NO: 329262 - DNA, 15 bp, Homo sapiens
tcctggaactgtctt

SEQ ID NO: 329263 - DNA, 15 bp, Homo sapiens
cctggaactgtcttt

SEQ ID NO: 329264 - DNA, 15 bp, Homo sapiens
ctggaactgtcttta

SEQ ID NO: 329265 - DNA, 15 bp, Homo sapiens
tggaactgtctttat

SEQ ID NO: 329266 - DNA, 15 bp, Homo sapiens
ggaactgtctttata

SEQ ID NO: 329267 - DNA, 15 bp, Homo sapiens
gaactgtctttatat

SEQ ID NO: 329268 - DNA, 15 bp, Homo sapiens
aactgtctttatatc

SEQ ID NO: 329269 - DNA, 15 bp, Homo sapiens
actgtctttatatca

SEQ ID NO: 329270 - DNA, 15 bp, Homo sapiens
ctgtctttatatcat

SEQ ID NO: 329271 - DNA, 15 bp, Homo sapiens
tgtctttatatcatc

SEQ ID NO: 329272 - DNA, 15 bp, Homo sapiens
gtctttatatcatct

SEQ ID NO: 329273 - DNA, 15 bp, Homo sapiens
tctttatatcatctt

SEQ ID NO: 329274 - DNA, 15 bp, Homo sapiens
ctttatatcatcttg

SEQ ID NO: 329275 - DNA, 15 bp, Homo sapiens
tttatatcatcttgg

SEQ ID NO: 329276 - DNA, 15 bp, Homo sapiens
ttatatcatcttgga

SEQ ID NO: 329277 - DNA, 15 bp, Homo sapiens
tatatcatcttggaa

SEQ ID NO: 329278 - DNA, 15 bp, Homo sapiens
atatcatcttggaaa

SEQ ID NO: 329279 - DNA, 15 bp, Homo sapiens
tatcatcttggaaac

SEQ ID NO: 329280 - DNA, 15 bp, Homo sapiens
atcatcttggaaacc

SEQ ID NO: 329281 - DNA, 15 bp, Homo sapiens
tcatcttggaaaccc

SEQ ID NO: 329282 - DNA, 15 bp, Homo sapiens
catcttggaaaccct

SEQ ID NO: 329283 - DNA, 15 bp, Homo sapiens
atcttggaaaccctg

SEQ ID NO: 329284 - DNA, 15 bp, Homo sapiens
tcttggaaaccctgg

SEQ ID NO: 329285 - DNA, 15 bp, Homo sapiens
cttggaaaccctgga

SEQ ID NO: 329286 - DNA, 15 bp, Homo sapiens
ttggaaaccctggag

SEQ ID NO: 329287 - DNA, 15 bp, Homo sapiens
tggaaaccctggagc

SEQ ID NO: 329288 - DNA, 15 bp, Homo sapiens
ggaaaccctggagct

SEQ ID NO: 329289 - DNA, 15 bp, Homo sapiens
gaaaccctggagctg

SEQ ID NO: 329290 - DNA, 15 bp, Homo sapiens
aaaccctggagctga

SEQ ID NO: 329291 - DNA, 15 bp, Homo sapiens
aaccctggagctgat

SEQ ID NO: 329292 - DNA, 15 bp, Homo sapiens
accctggagctgatt

SEQ ID NO: 329293 - DNA, 15 bp, Homo sapiens
ccctggagctgattt

SEQ ID NO: 329294 - DNA, 15 bp, Homo sapiens
cctggagctgatttg

SEQ ID NO: 329295 - DNA, 15 bp, Homo sapiens
ctggagctgatttga

SEQ ID NO: 329296 - DNA, 15 bp, Homo sapiens
tggagctgatttgaa

SEQ ID NO: 329297 - DNA, 15 bp, Homo sapiens
ggagctgatttgaaa

SEQ ID NO: 329298 - DNA, 15 bp, Homo sapiens
gagctgatttgaaat

SEQ ID NO: 329299 - DNA, 15 bp, Homo sapiens
agctgatttgaaata

SEQ ID NO: 329300 - DNA, 15 bp, Homo sapiens
gctgatttgaaatac

SEQ ID NO: 329301 - DNA, 15 bp, Homo sapiens
ctgatttgaaatacc

SEQ ID NO: 329302 - DNA, 15 bp, Homo sapiens
tgatttgaaatacct

SEQ ID NO: 329303 - DNA, 15 bp, Homo sapiens
gatttgaaatacctc

SEQ ID NO: 329304 - DNA, 15 bp, Homo sapiens
atttgaaatacctct

SEQ ID NO: 329305 - DNA, 15 bp, Homo sapiens
tttgaaatacctctg

SEQ ID NO: 329306 - DNA, 15 bp, Homo sapiens
ttgaaatacctctgg

SEQ ID NO: 329307 - DNA, 15 bp, Homo sapiens
tgaaatacctctggt

SEQ ID NO: 329308 - DNA, 15 bp, Homo sapiens
gaaatacctctggtc

SEQ ID NO: 329309 - DNA, 15 bp, Homo sapiens
aaatacctctggtca

SEQ ID NO: 329310 - DNA, 15 bp, Homo sapiens
aatacctctggtcag

SEQ ID NO: 329311 - DNA, 15 bp, Homo sapiens
atacctctggtcagt

SEQ ID NO: 329312 - DNA, 15 bp, Homo sapiens
tacctctggtcagtt

SEQ ID NO: 329313 - DNA, 15 bp, Homo sapiens
acctctggtcagttc

SEQ ID NO: 329314 - DNA, 15 bp, Homo sapiens
cctctggtcagttcc

SEQ ID NO: 329315 - DNA, 15 bp, Homo sapiens
ctctggtcagttcct

SEQ ID NO: 329316 - DNA, 15 bp, Homo sapiens
tctggtcagttcctc

SEQ ID NO: 329317 - DNA, 15 bp, Homo sapiens
ctggtcagttcctca

SEQ ID NO: 329318 - DNA, 15 bp, Homo sapiens
tggtcagttcctcag

SEQ ID NO: 329319 - DNA, 15 bp, Homo sapiens
ggtcagttcctcagc

SEQ ID NO: 329320 - DNA, 15 bp, Homo sapiens
gtcagttcctcagca

SEQ ID NO: 329321 - DNA, 15 bp, Homo sapiens
tcagttcctcagcat

SEQ ID NO: 329322 - DNA, 15 bp, Homo sapiens
cagttcctcagcatc

SEQ ID NO: 329323 - DNA, 15 bp, Homo sapiens
agttcctcagcatca

SEQ ID NO: 329324 - DNA, 15 bp, Homo sapiens
gttcctcagcatcag

SEQ ID NO: 329325 - DNA, 15 bp, Homo sapiens
ttcctcagcatcagt

SEQ ID NO: 329326 - DNA, 15 bp, Homo sapiens
tcctcagcatcagtt

SEQ ID NO: 329327 - DNA, 15 bp, Homo sapiens
cctcagcatcagttc

SEQ ID NO: 329328 - DNA, 15 bp, Homo sapiens
ctcagcatcagttct

SEQ ID NO: 329329 - DNA, 15 bp, Homo sapiens
tcagcatcagttctg

SEQ ID NO: 329330 - DNA, 15 bp, Homo sapiens
cagcatcagttctgt

SEQ ID NO: 329331 - DNA, 15 bp, Homo sapiens
agcatcagttctgtc

SEQ ID NO: 329332 - DNA, 15 bp, Homo sapiens
gcatcagttctgtct

SEQ ID NO: 329333 - DNA, 15 bp, Homo sapiens
catcagttctgtcta

SEQ ID NO: 329334 - DNA, 15 bp, Homo sapiens
atcagttctgtctaa

SEQ ID NO: 329335 - DNA, 15 bp, Homo sapiens
tcagttctgtctaat

SEQ ID NO: 329336 - DNA, 15 bp, Homo sapiens
cagttctgtctaatg

SEQ ID NO: 329337 - DNA, 15 bp, Homo sapiens
agttctgtctaatga

SEQ ID NO: 329338 - DNA, 15 bp, Homo sapiens
gttctgtctaatgaa

SEQ ID NO: 329339 - DNA, 15 bp, Homo sapiens
ttctgtctaatgaac

SEQ ID NO: 329340 - DNA, 15 bp, Homo sapiens
tctgtctaatgaaca

SEQ ID NO: 329341 - DNA, 15 bp, Homo sapiens
ctgtctaatgaacac

SEQ ID NO: 329342 - DNA, 15 bp, Homo sapiens
tgtctaatgaacacc

SEQ ID NO: 329343 - DNA, 15 bp, Homo sapiens
gtctaatgaacacct

SEQ ID NO: 329344 - DNA, 15 bp, Homo sapiens
tctaatgaacaccta

SEQ ID NO: 329345 - DNA, 15 bp, Homo sapiens
ctaatgaacacctat

SEQ ID NO: 329346 - DNA, 15 bp, Homo sapiens
taatgaacacctata

SEQ ID NO: 329347 - DNA, 15 bp, Homo sapiens
aatgaacacctatat

SEQ ID NO: 329348 - DNA, 15 bp, Homo sapiens
atgaacacctatatt

SEQ ID NO: 329349 - DNA, 15 bp, Homo sapiens
tgaacacctatattc

SEQ ID NO: 329350 - DNA, 15 bp, Homo sapiens
gaacacctatattct

SEQ ID NO: 329351 - DNA, 15 bp, Homo sapiens
aacacctatattctt

SEQ ID NO: 329352 - DNA, 15 bp, Homo sapiens
acacctatattcttc

SEQ ID NO: 329353 - DNA, 15 bp, Homo sapiens
cacctatattcttca

SEQ ID NO: 329354 - DNA, 15 bp, Homo sapiens
acctatattcttcat

SEQ ID NO: 329355 - DNA, 15 bp, Homo sapiens
cctatattcttcatt

SEQ ID NO: 329356 - DNA, 15 bp, Homo sapiens
ctatattcttcattg

SEQ ID NO: 329357 - DNA, 15 bp, Homo sapiens
tatattcttcattgt

SEQ ID NO: 329358 - DNA, 15 bp, Homo sapiens
atattcttcattgtc

SEQ ID NO: 329359 - DNA, 15 bp, Homo sapiens
tattcttcattgtct

SEQ ID NO: 329360 - DNA, 15 bp, Homo sapiens
attcttcattgtctc

SEQ ID NO: 329361 - DNA, 15 bp, Homo sapiens
ttcttcattgtctcc

SEQ ID NO: 329362 - DNA, 15 bp, Homo sapiens
tcttcattgtctcct

SEQ ID NO: 329363 - DNA, 15 bp, Homo sapiens
cttcattgtctcctc

SEQ ID NO: 329364 - DNA, 15 bp, Homo sapiens
ttcattgtctcctca

SEQ ID NO: 329365 - DNA, 15 bp, Homo sapiens
tcattgtctcctcac

SEQ ID NO: 329366 - DNA, 15 bp, Homo sapiens
cattgtctcctcact

SEQ ID NO: 329367 - DNA, 15 bp, Homo sapiens
attgtctcctcactc

SEQ ID NO: 329368 - DNA, 15 bp, Homo sapiens
ttgtctcctcactct

SEQ ID NO: 329369 - DNA, 15 bp, Homo sapiens
tgtctcctcactctt

SEQ ID NO: 329370 - DNA, 15 bp, Homo sapiens
gtctcctcactcttg

SEQ ID NO: 329371 - DNA, 15 bp, Homo sapiens
tctcctcactcttgg

SEQ ID NO: 329372 - DNA, 15 bp, Homo sapiens
ctcctcactcttggc

SEQ ID NO: 329373 - DNA, 15 bp, Homo sapiens
tcctcactcttggct

SEQ ID NO: 329374 - DNA, 15 bp, Homo sapiens
cctcactcttggctc

SEQ ID NO: 329375 - DNA, 15 bp, Homo sapiens
ctcactcttggctct

SEQ ID NO: 329376 - DNA, 15 bp, Homo sapiens
tcactcttggctcta

SEQ ID NO: 329377 - DNA, 15 bp, Homo sapiens
cactcttggctctaa

SEQ ID NO: 329378 - DNA, 15 bp, Homo sapiens
actcttggctctaag

SEQ ID NO: 329379 - DNA, 15 bp, Homo sapiens
ctcttggctctaagt

SEQ ID NO: 329380 - DNA, 15 bp, Homo sapiens
tcttggctctaagtt

SEQ ID NO: 329381 - DNA, 15 bp, Homo sapiens
cttggctctaagttg

SEQ ID NO: 329382 - DNA, 15 bp, Homo sapiens
ttggctctaagttgt

SEQ ID NO: 329383 - DNA, 15 bp, Homo sapiens
tggctctaagttgtc

SEQ ID NO: 329384 - DNA, 15 bp, Homo sapiens
ggctctaagttgtca

SEQ ID NO: 329385 - DNA, 15 bp, Homo sapiens
gctctaagttgtcac

SEQ ID NO: 329386 - DNA, 15 bp, Homo sapiens
ctctaagttgtcaca

SEQ ID NO: 329387 - DNA, 15 bp, Homo sapiens
tctaagttgtcacaa

SEQ ID NO: 329388 - DNA, 15 bp, Homo sapiens
ctaagttgtcacaag

SEQ ID NO: 329389 - DNA, 15 bp, Homo sapiens
taagttgtcacaagt

SEQ ID NO: 329390 - DNA, 15 bp, Homo sapiens
aagttgtcacaagta

SEQ ID NO: 329391 - DNA, 15 bp, Homo sapiens
agttgtcacaagtag

SEQ ID NO: 329392 - DNA, 15 bp, Homo sapiens
gttgtcacaagtaga

SEQ ID NO: 329393 - DNA, 15 bp, Homo sapiens
ttgtcacaagtagat

SEQ ID NO: 329394 - DNA, 15 bp, Homo sapiens
tgtcacaagtagatg

SEQ ID NO: 329395 - DNA, 15 bp, Homo sapiens
gtcacaagtagatga

SEQ ID NO: 329396 - DNA, 15 bp, Homo sapiens
tcacaagtagatgat

SEQ ID NO: 329397 - DNA, 15 bp, Homo sapiens
cacaagtagatgatt

SEQ ID NO: 329398 - DNA, 15 bp, Homo sapiens
acaagtagatgatta

SEQ ID NO: 329399 - DNA, 15 bp, Homo sapiens
caagtagatgattat

SEQ ID NO: 329400 - DNA, 15 bp, Homo sapiens
aagtagatgattatg

SEQ ID NO: 329401 - DNA, 15 bp, Homo sapiens
agtagatgattatgt

SEQ ID NO: 329402 - DNA, 15 bp, Homo sapiens
gtagatgattatgtc

SEQ ID NO: 329403 - DNA, 15 bp, Homo sapiens
tagatgattatgtct

SEQ ID NO: 329404 - DNA, 15 bp, Homo sapiens
agatgattatgtctc

SEQ ID NO: 329405 - DNA, 15 bp, Homo sapiens
gatgattatgtctca

SEQ ID NO: 329406 - DNA, 15 bp, Homo sapiens
atgattatgtctcat

SEQ ID NO: 329407 - DNA, 15 bp, Homo sapiens
tgattatgtctcatt

SEQ ID NO: 329408 - DNA, 15 bp, Homo sapiens
gattatgtctcattc

SEQ ID NO: 329409 - DNA, 15 bp, Homo sapiens
attatgtctcattcc

SEQ ID NO: 329410 - DNA, 15 bp, Homo sapiens
ttatgtctcattccc

SEQ ID NO: 329411 - DNA, 15 bp, Homo sapiens
tatgtctcattccca

SEQ ID NO: 329412 - DNA, 15 bp, Homo sapiens
atgtctcattcccaa

SEQ ID NO: 329413 - DNA, 15 bp, Homo sapiens
tgtctcattcccaag

SEQ ID NO: 329414 - DNA, 15 bp, Homo sapiens
gtctcattcccaagt

SEQ ID NO: 329415 - DNA, 15 bp, Homo sapiens
tctcattcccaagta

SEQ ID NO: 329416 - DNA, 15 bp, Homo sapiens
ctcattcccaagtag

SEQ ID NO: 329417 - DNA, 15 bp, Homo sapiens
tcattcccaagtaga

SEQ ID NO: 329418 - DNA, 15 bp, Homo sapiens
cattcccaagtagag

SEQ ID NO: 329419 - DNA, 15 bp, Homo sapiens
attcccaagtagaga

SEQ ID NO: 329420 - DNA, 15 bp, Homo sapiens
ttcccaagtagagat

SEQ ID NO: 329421 - DNA, 15 bp, Homo sapiens
tcccaagtagagata

SEQ ID NO: 329422 - DNA, 15 bp, Homo sapiens
cccaagtagagatag

SEQ ID NO: 329423 - DNA, 15 bp, Homo sapiens
ccaagtagagatagg

SEQ ID NO: 329424 - DNA, 15 bp, Homo sapiens
caagtagagatagga

SEQ ID NO: 329425 - DNA, 15 bp, Homo sapiens
aagtagagataggac

SEQ ID NO: 329426 - DNA, 15 bp, Homo sapiens
agtagagataggaca

SEQ ID NO: 329427 - DNA, 15 bp, Homo sapiens
gtagagataggacac

SEQ ID NO: 329428 - DNA, 15 bp, Homo sapiens
tagagataggacaca

SEQ ID NO: 329429 - DNA, 15 bp, Homo sapiens
agagataggacacat

SEQ ID NO: 329430 - DNA, 15 bp, Homo sapiens
gagataggacacatg

SEQ ID NO: 329431 - DNA, 15 bp, Homo sapiens
agataggacacatga

SEQ ID NO: 329432 - DNA, 15 bp, Homo sapiens
gataggacacatgag

SEQ ID NO: 329433 - DNA, 15 bp, Homo sapiens
ataggacacatgaga

SEQ ID NO: 329434 - DNA, 15 bp, Homo sapiens
taggacacatgagag

SEQ ID NO: 329435 - DNA, 15 bp, Homo sapiens
aggacacatgagagt

SEQ ID NO: 329436 - DNA, 15 bp, Homo sapiens
ggacacatgagagtg

SEQ ID NO: 329437 - DNA, 15 bp, Homo sapiens
gacacatgagagtgg

SEQ ID NO: 329438 - DNA, 15 bp, Homo sapiens
acacatgagagtggg

SEQ ID NO: 329439 - DNA, 15 bp, Homo sapiens
cacatgagagtgggt

SEQ ID NO: 329440 - DNA, 15 bp, Homo sapiens
acatgagagtgggtg

SEQ ID NO: 329441 - DNA, 15 bp, Homo sapiens
catgagagtgggtgg

SEQ ID NO: 329442 - DNA, 15 bp, Homo sapiens
atgagagtgggtggg

SEQ ID NO: 329443 - DNA, 15 bp, Homo sapiens
tgagagtgggtgggt

SEQ ID NO: 329444 - DNA, 15 bp, Homo sapiens
gagagtgggtgggtg

SEQ ID NO: 329445 - DNA, 15 bp, Homo sapiens
agagtgggtgggtgt

SEQ ID NO: 329446 - DNA, 15 bp, Homo sapiens
gagtgggtgggtgtg

SEQ ID NO: 329447 - DNA, 15 bp, Homo sapiens
agtgggtgggtgtgc

SEQ ID NO: 329448 - DNA, 15 bp, Homo sapiens
gtgggtgggtgtgcc

SEQ ID NO: 329449 - DNA, 15 bp, Homo sapiens
tgggtgggtgtgccc

SEQ ID NO: 329450 - DNA, 15 bp, Homo sapiens
gggtgggtgtgccca

SEQ ID NO: 329451 - DNA, 15 bp, Homo sapiens
ggtgggtgtgcccat

SEQ ID NO: 329452 - DNA, 15 bp, Homo sapiens
gtgggtgtgcccata

SEQ ID NO: 329453 - DNA, 15 bp, Homo sapiens
tgggtgtgcccatag

SEQ ID NO: 329454 - DNA, 15 bp, Homo sapiens
gggtgtgcccatagt

SEQ ID NO: 329455 - DNA, 15 bp, Homo sapiens
ggtgtgcccatagtt

SEQ ID NO: 329456 - DNA, 15 bp, Homo sapiens
gtgtgcccatagttt

SEQ ID NO: 329457 - DNA, 15 bp, Homo sapiens
tgtgcccatagttta

SEQ ID NO: 329458 - DNA, 15 bp, Homo sapiens
gtgcccatagtttag

SEQ ID NO: 329459 - DNA, 15 bp, Homo sapiens
tgcccatagtttaga

SEQ ID NO: 329460 - DNA, 15 bp, Homo sapiens
gcccatagtttagac

SEQ ID NO: 329461 - DNA, 15 bp, Homo sapiens
cccatagtttagaca

SEQ ID NO: 329462 - DNA, 15 bp, Homo sapiens
ccatagtttagacag

SEQ ID NO: 329463 - DNA, 15 bp, Homo sapiens
catagtttagacagg

SEQ ID NO: 329464 - DNA, 15 bp, Homo sapiens
atagtttagacagga

SEQ ID NO: 329465 - DNA, 15 bp, Homo sapiens
tagtttagacaggac

SEQ ID NO: 329466 - DNA, 15 bp, Homo sapiens
agtttagacaggact

SEQ ID NO: 329467 - DNA, 15 bp, Homo sapiens
gtttagacaggacta

SEQ ID NO: 329468 - DNA, 15 bp, Homo sapiens
tttagacaggactat

SEQ ID NO: 329469 - DNA, 15 bp, Homo sapiens
ttagacaggactatc

SEQ ID NO: 329470 - DNA, 15 bp, Homo sapiens
tagacaggactatct

SEQ ID NO: 329471 - DNA, 15 bp, Homo sapiens
agacaggactatctt

SEQ ID NO: 329472 - DNA, 15 bp, Homo sapiens
gacaggactatcttt

SEQ ID NO: 329473 - DNA, 15 bp, Homo sapiens
acaggactatctttg

SEQ ID NO: 329474 - DNA, 15 bp, Homo sapiens
caggactatctttgt

SEQ ID NO: 329475 - DNA, 15 bp, Homo sapiens
aggactatctttgtg

SEQ ID NO: 329476 - DNA, 15 bp, Homo sapiens
ggactatctttgtgt

SEQ ID NO: 329477 - DNA, 15 bp, Homo sapiens
gactatctttgtgtg

SEQ ID NO: 329478 - DNA, 15 bp, Homo sapiens
actatctttgtgtgg

SEQ ID NO: 329479 - DNA, 15 bp, Homo sapiens
ctatctttgtgtggt

SEQ ID NO: 329480 - DNA, 15 bp, Homo sapiens
tatctttgtgtggta

SEQ ID NO: 329481 - DNA, 15 bp, Homo sapiens
atctttgtgtggtac

SEQ ID NO: 329482 - DNA, 15 bp, Homo sapiens
tctttgtgtggtacc

SEQ ID NO: 329483 - DNA, 15 bp, Homo sapiens
ctttgtgtggtacca

SEQ ID NO: 329484 - DNA, 15 bp, Homo sapiens
tttgtgtggtaccag

SEQ ID NO: 329485 - DNA, 15 bp, Homo sapiens
ttgtgtggtaccagc

SEQ ID NO: 329486 - DNA, 15 bp, Homo sapiens
tgtgtggtaccagct

SEQ ID NO: 329487 - DNA, 15 bp, Homo sapiens
gtgtggtaccagctg

SEQ ID NO: 329488 - DNA, 15 bp, Homo sapiens
tgtggtaccagctgc

SEQ ID NO: 329489 - DNA, 15 bp, Homo sapiens
gtggtaccagctgcg

SEQ ID NO: 329490 - DNA, 15 bp, Homo sapiens
tggtaccagctgcgg

SEQ ID NO: 329491 - DNA, 15 bp, Homo sapiens
ggtaccagctgcggc

SEQ ID NO: 329492 - DNA, 15 bp, Homo sapiens
gtaccagctgcggca

SEQ ID NO: 329493 - DNA, 15 bp, Homo sapiens
taccagctgcggcag

SEQ ID NO: 329494 - DNA, 15 bp, Homo sapiens
accagctgcggcagg

SEQ ID NO: 329495 - DNA, 15 bp, Homo sapiens
ccagctgcggcagga

SEQ ID NO: 329496 - DNA, 15 bp, Homo sapiens
cagctgcggcaggat

SEQ ID NO: 329497 - DNA, 15 bp, Homo sapiens
agctgcggcaggatc

SEQ ID NO: 329498 - DNA, 15 bp, Homo sapiens
gctgcggcaggatct

SEQ ID NO: 329499 - DNA, 15 bp, Homo sapiens
ctgcggcaggatcta

SEQ ID NO: 329500 - DNA, 15 bp, Homo sapiens
tgcggcaggatctac

SEQ ID NO: 329501 - DNA, 15 bp, Homo sapiens
gcggcaggatctaca

SEQ ID NO: 329502 - DNA, 15 bp, Homo sapiens
cggcaggatctacag

SEQ ID NO: 329503 - DNA, 15 bp, Homo sapiens
ggcaggatctacaga

SEQ ID NO: 329504 - DNA, 15 bp, Homo sapiens
gcaggatctacagat

SEQ ID NO: 329505 - DNA, 15 bp, Homo sapiens
caggatctacagatg

SEQ ID NO: 329506 - DNA, 15 bp, Homo sapiens
aggatctacagatga

SEQ ID NO: 329507 - DNA, 15 bp, Homo sapiens
ggatctacagatgac

SEQ ID NO: 329508 - DNA, 15 bp, Homo sapiens
gatctacagatgact

SEQ ID NO: 329509 - DNA, 15 bp, Homo sapiens
atctacagatgactc

SEQ ID NO: 329510 - DNA, 15 bp, Homo sapiens
tctacagatgactca

SEQ ID NO: 329511 - DNA, 15 bp, Homo sapiens
ctacagatgactcac

SEQ ID NO: 329512 - DNA, 15 bp, Homo sapiens
tacagatgactcaca

SEQ ID NO: 329513 - DNA, 15 bp, Homo sapiens
acagatgactcacac

SEQ ID NO: 329514 - DNA, 15 bp, Homo sapiens
cagatgactcacaca

SEQ ID NO: 329515 - DNA, 15 bp, Homo sapiens
agatgactcacacat

SEQ ID NO: 329516 - DNA, 15 bp, Homo sapiens
gatgactcacacatg

SEQ ID NO: 329517 - DNA, 15 bp, Homo sapiens
atgactcacacatgt

SEQ ID NO: 329518 - DNA, 15 bp, Homo sapiens
tgactcacacatgtt

SEQ ID NO: 329519 - DNA, 15 bp, Homo sapiens
gactcacacatgtta

SEQ ID NO: 329520 - DNA, 15 bp, Homo sapiens
actcacacatgttaa

SEQ ID NO: 329521 - DNA, 15 bp, Homo sapiens
ctcacacatgttaat

SEQ ID NO: 329522 - DNA, 15 bp, Homo sapiens
tcacacatgttaata

SEQ ID NO: 329523 - DNA, 15 bp, Homo sapiens
cacacatgttaatac

SEQ ID NO: 329524 - DNA, 15 bp, Homo sapiens
acacatgttaatacc

SEQ ID NO: 329525 - DNA, 15 bp, Homo sapiens
cacatgttaataccc

SEQ ID NO: 329526 - DNA, 15 bp, Homo sapiens
acatgttaataccca

SEQ ID NO: 329527 - DNA, 15 bp, Homo sapiens
catgttaatacccac

SEQ ID NO: 329528 - DNA, 15 bp, Homo sapiens
atgttaatacccaca

SEQ ID NO: 329529 - DNA, 15 bp, Homo sapiens
tgttaatacccacat

SEQ ID NO: 329530 - DNA, 15 bp, Homo sapiens
gttaatacccacatc

SEQ ID NO: 329531 - DNA, 15 bp, Homo sapiens
ttaatacccacatct

SEQ ID NO: 329532 - DNA, 15 bp, Homo sapiens
taatacccacatctt

SEQ ID NO: 329533 - DNA, 15 bp, Homo sapiens
aatacccacatcttc

SEQ ID NO: 329534 - DNA, 15 bp, Homo sapiens
atacccacatcttct

SEQ ID NO: 329535 - DNA, 15 bp, Homo sapiens
tacccacatcttctg

SEQ ID NO: 329536 - DNA, 15 bp, Homo sapiens
acccacatcttctga

SEQ ID NO: 329537 - DNA, 15 bp, Homo sapiens
cccacatcttctgag

SEQ ID NO: 329538 - DNA, 15 bp, Homo sapiens
ccacatcttctgagt

SEQ ID NO: 329539 - DNA, 15 bp, Homo sapiens
cacatcttctgagtg

SEQ ID NO: 329540 - DNA, 15 bp, Homo sapiens
acatcttctgagtgg

SEQ ID NO: 329541 - DNA, 15 bp, Homo sapiens
catcttctgagtggc

SEQ ID NO: 329542 - DNA, 15 bp, Homo sapiens
atcttctgagtggcc

SEQ ID NO: 329543 - DNA, 15 bp, Homo sapiens
tcttctgagtggcca

SEQ ID NO: 329544 - DNA, 15 bp, Homo sapiens
cttctgagtggccaa

SEQ ID NO: 329545 - DNA, 15 bp, Homo sapiens
ttctgagtggccaac

SEQ ID NO: 329546 - DNA, 15 bp, Homo sapiens
tctgagtggccaaca

SEQ ID NO: 329547 - DNA, 15 bp, Homo sapiens
ctgagtggccaacat

SEQ ID NO: 329548 - DNA, 15 bp, Homo sapiens
tgagtggccaacatc

SEQ ID NO: 329549 - DNA, 15 bp, Homo sapiens
gagtggccaacatcc

SEQ ID NO: 329550 - DNA, 15 bp, Homo sapiens
agtggccaacatcct

SEQ ID NO: 329551 - DNA, 15 bp, Homo sapiens
gtggccaacatcctc

SEQ ID NO: 329552 - DNA, 15 bp, Homo sapiens
tggccaacatcctca

SEQ ID NO: 329553 - DNA, 15 bp, Homo sapiens
ggccaacatcctcag

SEQ ID NO: 329554 - DNA, 15 bp, Homo sapiens
gccaacatcctcaga

SEQ ID NO: 329555 - DNA, 15 bp, Homo sapiens
ccaacatcctcagat

SEQ ID NO: 329556 - DNA, 15 bp, Homo sapiens
caacatcctcagatt

SEQ ID NO: 329557 - DNA, 15 bp, Homo sapiens
aacatcctcagattt

SEQ ID NO: 329558 - DNA, 15 bp, Homo sapiens
acatcctcagatttg

SEQ ID NO: 329559 - DNA, 15 bp, Homo sapiens
catcctcagatttgc

SEQ ID NO: 329560 - DNA, 15 bp, Homo sapiens
atcctcagatttgca

SEQ ID NO: 329561 - DNA, 15 bp, Homo sapiens
tcctcagatttgcat

SEQ ID NO: 329562 - DNA, 15 bp, Homo sapiens
cctcagatttgcatg

SEQ ID NO: 329563 - DNA, 15 bp, Homo sapiens
ctcagatttgcatgt

SEQ ID NO: 329564 - DNA, 15 bp, Homo sapiens
tcagatttgcatgtg

SEQ ID NO: 329565 - DNA, 15 bp, Homo sapiens
cagatttgcatgtgg

SEQ ID NO: 329566 - DNA, 15 bp, Homo sapiens
agatttgcatgtggg

SEQ ID NO: 329567 - DNA, 15 bp, Homo sapiens
gatttgcatgtgggc

SEQ ID NO: 329568 - DNA, 15 bp, Homo sapiens
atttgcatgtgggca

SEQ ID NO: 329569 - DNA, 15 bp, Homo sapiens
tttgcatgtgggcat

SEQ ID NO: 329570 - DNA, 15 bp, Homo sapiens
ttgcatgtgggcatt

SEQ ID NO: 329571 - DNA, 15 bp, Homo sapiens
tgcatgtgggcattt

SEQ ID NO: 329572 - DNA, 15 bp, Homo sapiens
gcatgtgggcatttg

SEQ ID NO: 329573 - DNA, 15 bp, Homo sapiens
catgtgggcatttgc

SEQ ID NO: 329574 - DNA, 15 bp, Homo sapiens
atgtgggcatttgca

SEQ ID NO: 329575 - DNA, 15 bp, Homo sapiens
tgtgggcatttgcaa

SEQ ID NO: 329576 - DNA, 15 bp, Homo sapiens
gtgggcatttgcaag

SEQ ID NO: 329577 - DNA, 15 bp, Homo sapiens
tgggcatttgcaaga

SEQ ID NO: 329578 - DNA, 15 bp, Homo sapiens
gggcatttgcaagag

SEQ ID NO: 329579 - DNA, 15 bp, Homo sapiens
ggcatttgcaagagg

SEQ ID NO: 329580 - DNA, 15 bp, Homo sapiens
gcatttgcaagagga

SEQ ID NO: 329581 - DNA, 15 bp, Homo sapiens
catttgcaagaggaa

SEQ ID NO: 329582 - DNA, 15 bp, Homo sapiens
atttgcaagaggaag

SEQ ID NO: 329583 - DNA, 15 bp, Homo sapiens
tttgcaagaggaagc

SEQ ID NO: 329584 - DNA, 15 bp, Homo sapiens
ttgcaagaggaagca

SEQ ID NO: 329585 - DNA, 15 bp, Homo sapiens
tgcaagaggaagcac

SEQ ID NO: 329586 - DNA, 15 bp, Homo sapiens
gcaagaggaagcaca

SEQ ID NO: 329587 - DNA, 15 bp, Homo sapiens
caagaggaagcacac

SEQ ID NO: 329588 - DNA, 15 bp, Homo sapiens
aagaggaagcacaca

SEQ ID NO: 329589 - DNA, 15 bp, Homo sapiens
agaggaagcacacag

SEQ ID NO: 329590 - DNA, 15 bp, Homo sapiens
gaggaagcacacaga

SEQ ID NO: 329591 - DNA, 15 bp, Homo sapiens
aggaagcacacagat

SEQ ID NO: 329592 - DNA, 15 bp, Homo sapiens
ggaagcacacagatg

SEQ ID NO: 329593 - DNA, 15 bp, Homo sapiens
gaagcacacagatgc

SEQ ID NO: 329594 - DNA, 15 bp, Homo sapiens
aagcacacagatgct

SEQ ID NO: 329595 - DNA, 15 bp, Homo sapiens
agcacacagatgctg

SEQ ID NO: 329596 - DNA, 15 bp, Homo sapiens
gcacacagatgctgt

SEQ ID NO: 329597 - DNA, 15 bp, Homo sapiens
cacacagatgctgtg

SEQ ID NO: 329598 - DNA, 15 bp, Homo sapiens
acacagatgctgtga

SEQ ID NO: 329599 - DNA, 15 bp, Homo sapiens
cacagatgctgtgat

SEQ ID NO: 329600 - DNA, 15 bp, Homo sapiens
acagatgctgtgatc

SEQ ID NO: 329601 - DNA, 15 bp, Homo sapiens
cagatgctgtgatca

SEQ ID NO: 329602 - DNA, 15 bp, Homo sapiens
agatgctgtgatcag

SEQ ID NO: 329603 - DNA, 15 bp, Homo sapiens
gatgctgtgatcagg

SEQ ID NO: 329604 - DNA, 15 bp, Homo sapiens
atgctgtgatcaggg

SEQ ID NO: 329605 - DNA, 15 bp, Homo sapiens
tgctgtgatcagggc

SEQ ID NO: 329606 - DNA, 15 bp, Homo sapiens
gctgtgatcagggct

SEQ ID NO: 329607 - DNA, 15 bp, Homo sapiens
ctgtgatcagggctg

SEQ ID NO: 329608 - DNA, 15 bp, Homo sapiens
tgtgatcagggctga

SEQ ID NO: 329609 - DNA, 15 bp, Homo sapiens
gtgatcagggctgag

SEQ ID NO: 329610 - DNA, 15 bp, Homo sapiens
tgatcagggctgaga

SEQ ID NO: 329611 - DNA, 15 bp, Homo sapiens
gatcagggctgagat

SEQ ID NO: 329612 - DNA, 15 bp, Homo sapiens
atcagggctgagatg

SEQ ID NO: 329613 - DNA, 15 bp, Homo sapiens
tcagggctgagatgc

SEQ ID NO: 329614 - DNA, 15 bp, Homo sapiens
cagggctgagatgcc

SEQ ID NO: 329615 - DNA, 15 bp, Homo sapiens
agggctgagatgcct

SEQ ID NO: 329616 - DNA, 15 bp, Homo sapiens
gggctgagatgccta

SEQ ID NO: 329617 - DNA, 15 bp, Homo sapiens
ggctgagatgcctac

SEQ ID NO: 329618 - DNA, 15 bp, Homo sapiens
gctgagatgcctaca

SEQ ID NO: 329619 - DNA, 15 bp, Homo sapiens
ctgagatgcctacag

SEQ ID NO: 329620 - DNA, 15 bp, Homo sapiens
tgagatgcctacagg

SEQ ID NO: 329621 - DNA, 15 bp, Homo sapiens
gagatgcctacaggt

SEQ ID NO: 329622 - DNA, 15 bp, Homo sapiens
agatgcctacaggtg

SEQ ID NO: 329623 - DNA, 15 bp, Homo sapiens
gatgcctacaggtgt

SEQ ID NO: 329624 - DNA, 15 bp, Homo sapiens
atgcctacaggtgtg

SEQ ID NO: 329625 - DNA, 15 bp, Homo sapiens
tgcctacaggtgtgt

SEQ ID NO: 329626 - DNA, 15 bp, Homo sapiens
gcctacaggtgtgtc

SEQ ID NO: 329627 - DNA, 15 bp, Homo sapiens
cctacaggtgtgtct

SEQ ID NO: 329628 - DNA, 15 bp, Homo sapiens
ctacaggtgtgtctg

SEQ ID NO: 329629 - DNA, 15 bp, Homo sapiens
tacaggtgtgtctgc

SEQ ID NO: 329630 - DNA, 15 bp, Homo sapiens
acaggtgtgtctgct

SEQ ID NO: 329631 - DNA, 15 bp, Homo sapiens
caggtgtgtctgctg

SEQ ID NO: 329632 - DNA, 15 bp, Homo sapiens
aggtgtgtctgctgg

SEQ ID NO: 329633 - DNA, 15 bp, Homo sapiens
ggtgtgtctgctggg

SEQ ID NO: 329634 - DNA, 15 bp, Homo sapiens
gtgtgtctgctgggc

SEQ ID NO: 329635 - DNA, 15 bp, Homo sapiens
tgtgtctgctgggct

SEQ ID NO: 329636 - DNA, 15 bp, Homo sapiens
gtgtctgctgggctg

SEQ ID NO: 329637 - DNA, 15 bp, Homo sapiens
tgtctgctgggctgc

SEQ ID NO: 329638 - DNA, 15 bp, Homo sapiens
gtctgctgggctgcg

SEQ ID NO: 329639 - DNA, 15 bp, Homo sapiens
tctgctgggctgcgg

SEQ ID NO: 329640 - DNA, 15 bp, Homo sapiens
ctgctgggctgcggc

SEQ ID NO: 329641 - DNA, 15 bp, Homo sapiens
tgctgggctgcggca

SEQ ID NO: 329642 - DNA, 15 bp, Homo sapiens
gctgggctgcggcag

SEQ ID NO: 329643 - DNA, 15 bp, Homo sapiens
ctgggctgcggcagg

SEQ ID NO: 329644 - DNA, 15 bp, Homo sapiens
tgggctgcggcaggt

SEQ ID NO: 329645 - DNA, 15 bp, Homo sapiens
gggctgcggcaggtg

SEQ ID NO: 329646 - DNA, 15 bp, Homo sapiens
ggctgcggcaggtgg

SEQ ID NO: 329647 - DNA, 15 bp, Homo sapiens
gctgcggcaggtggt

SEQ ID NO: 329648 - DNA, 15 bp, Homo sapiens
ctgcggcaggtggtg

SEQ ID NO: 329649 - DNA, 15 bp, Homo sapiens
tgcggcaggtggtgg

SEQ ID NO: 329650 - DNA, 15 bp, Homo sapiens
gcggcaggtggtggc

SEQ ID NO: 329651 - DNA, 15 bp, Homo sapiens
cggcaggtggtggcc

SEQ ID NO: 329652 - DNA, 15 bp, Homo sapiens
ggcaggtggtggcca

SEQ ID NO: 329653 - DNA, 15 bp, Homo sapiens
gcaggtggtggccag

SEQ ID NO: 329654 - DNA, 15 bp, Homo sapiens
caggtggtggccagt

SEQ ID NO: 329655 - DNA, 15 bp, Homo sapiens
aggtggtggccagtg

SEQ ID NO: 329656 - DNA, 15 bp, Homo sapiens
ggtggtggccagtgg

SEQ ID NO: 329657 - DNA, 15 bp, Homo sapiens
gtggtggccagtgga

SEQ ID NO: 329658 - DNA, 15 bp, Homo sapiens
tggtggccagtggaa

SEQ ID NO: 329659 - DNA, 15 bp, Homo sapiens
ggtggccagtggaag

SEQ ID NO: 329660 - DNA, 15 bp, Homo sapiens
gtggccagtggaaga

SEQ ID NO: 329661 - DNA, 15 bp, Homo sapiens
tggccagtggaagac

SEQ ID NO: 329662 - DNA, 15 bp, Homo sapiens
ggccagtggaagaca

SEQ ID NO: 329663 - DNA, 15 bp, Homo sapiens
gccagtggaagacag

SEQ ID NO: 329664 - DNA, 15 bp, Homo sapiens
ccagtggaagacagg

SEQ ID NO: 329665 - DNA, 15 bp, Homo sapiens
cagtggaagacaggt

SEQ ID NO: 329666 - DNA, 15 bp, Homo sapiens
agtggaagacaggtt

SEQ ID NO: 329667 - DNA, 15 bp, Homo sapiens
gtggaagacaggttg

SEQ ID NO: 329668 - DNA, 15 bp, Homo sapiens
tggaagacaggttgt

SEQ ID NO: 329669 - DNA, 15 bp, Homo sapiens
ggaagacaggttgta

SEQ ID NO: 329670 - DNA, 15 bp, Homo sapiens
gaagacaggttgtag

SEQ ID NO: 329671 - DNA, 15 bp, Homo sapiens
aagacaggttgtagg

SEQ ID NO: 329672 - DNA, 15 bp, Homo sapiens
agacaggttgtaggt

SEQ ID NO: 329673 - DNA, 15 bp, Homo sapiens
gacaggttgtaggta

SEQ ID NO: 329674 - DNA, 15 bp, Homo sapiens
acaggttgtaggtag

SEQ ID NO: 329675 - DNA, 15 bp, Homo sapiens
caggttgtaggtagg

SEQ ID NO: 329676 - DNA, 15 bp, Homo sapiens
aggttgtaggtaggg

SEQ ID NO: 329677 - DNA, 15 bp, Homo sapiens
ggttgtaggtaggga

SEQ ID NO: 329678 - DNA, 15 bp, Homo sapiens
gttgtaggtagggaa

SEQ ID NO: 329679 - DNA, 15 bp, Homo sapiens
ttgtaggtagggaaa

SEQ ID NO: 329680 - DNA, 15 bp, Homo sapiens
tgtaggtagggaaag

SEQ ID NO: 329681 - DNA, 15 bp, Homo sapiens
gtaggtagggaaagt

SEQ ID NO: 329682 - DNA, 15 bp, Homo sapiens
taggtagggaaagtg

SEQ ID NO: 329683 - DNA, 15 bp, Homo sapiens
aggtagggaaagtgt

SEQ ID NO: 329684 - DNA, 15 bp, Homo sapiens
ggtagggaaagtgtt

SEQ ID NO: 329685 - DNA, 15 bp, Homo sapiens
gtagggaaagtgttg

SEQ ID NO: 329686 - DNA, 15 bp, Homo sapiens
tagggaaagtgttgc

SEQ ID NO: 329687 - DNA, 15 bp, Homo sapiens
agggaaagtgttgcc

SEQ ID NO: 329688 - DNA, 15 bp, Homo sapiens
gggaaagtgttgcct

SEQ ID NO: 329689 - DNA, 15 bp, Homo sapiens
ggaaagtgttgcctc

SEQ ID NO: 329690 - DNA, 15 bp, Homo sapiens
gaaagtgttgcctca

SEQ ID NO: 329691 - DNA, 15 bp, Homo sapiens
aaagtgttgcctcat

SEQ ID NO: 329692 - DNA, 15 bp, Homo sapiens
aagtgttgcctcatg

SEQ ID NO: 329693 - DNA, 15 bp, Homo sapiens
agtgttgcctcatgg

SEQ ID NO: 329694 - DNA, 15 bp, Homo sapiens
gtgttgcctcatgga

SEQ ID NO: 329695 - DNA, 15 bp, Homo sapiens
tgttgcctcatggag

SEQ ID NO: 329696 - DNA, 15 bp, Homo sapiens
gttgcctcatggagg

SEQ ID NO: 329697 - DNA, 15 bp, Homo sapiens
ttgcctcatggaggg

SEQ ID NO: 329698 - DNA, 15 bp, Homo sapiens
tgcctcatggagggt

SEQ ID NO: 329699 - DNA, 15 bp, Homo sapiens
gcctcatggagggtg

SEQ ID NO: 329700 - DNA, 15 bp, Homo sapiens
cctcatggagggtga

SEQ ID NO: 329701 - DNA, 15 bp, Homo sapiens
ctcatggagggtgat

SEQ ID NO: 329702 - DNA, 15 bp, Homo sapiens
tcatggagggtgatc

SEQ ID NO: 329703 - DNA, 15 bp, Homo sapiens
catggagggtgatcc

SEQ ID NO: 329704 - DNA, 15 bp, Homo sapiens
atggagggtgatcct

SEQ ID NO: 329705 - DNA, 15 bp, Homo sapiens
tggagggtgatcctg

SEQ ID NO: 329706 - DNA, 15 bp, Homo sapiens
ggagggtgatcctga

SEQ ID NO: 329707 - DNA, 15 bp, Homo sapiens
gagggtgatcctgat

SEQ ID NO: 329708 - DNA, 15 bp, Homo sapiens
agggtgatcctgata

SEQ ID NO: 329709 - DNA, 15 bp, Homo sapiens
gggtgatcctgatat

SEQ ID NO: 329710 - DNA, 15 bp, Homo sapiens
ggtgatcctgatatg

SEQ ID NO: 329711 - DNA, 15 bp, Homo sapiens
gtgatcctgatatgg

SEQ ID NO: 329712 - DNA, 15 bp, Homo sapiens
tgatcctgatatggt

SEQ ID NO: 329713 - DNA, 15 bp, Homo sapiens
gatcctgatatggtg

SEQ ID NO: 329714 - DNA, 15 bp, Homo sapiens
atcctgatatggtgg

SEQ ID NO: 329715 - DNA, 15 bp, Homo sapiens
tcctgatatggtggg

SEQ ID NO: 329716 - DNA, 15 bp, Homo sapiens
cctgatatggtggga

SEQ ID NO: 329717 - DNA, 15 bp, Homo sapiens
ctgatatggtgggaa

SEQ ID NO: 329718 - DNA, 15 bp, Homo sapiens
tgatatggtgggaac

SEQ ID NO: 329719 - DNA, 15 bp, Homo sapiens
gatatggtgggaact

SEQ ID NO: 329720 - DNA, 15 bp, Homo sapiens
atatggtgggaactt

SEQ ID NO: 329721 - DNA, 15 bp, Homo sapiens
tatggtgggaacttc

SEQ ID NO: 329722 - DNA, 15 bp, Homo sapiens
atggtgggaacttca

SEQ ID NO: 329723 - DNA, 15 bp, Homo sapiens
tggtgggaacttcaa

SEQ ID NO: 329724 - DNA, 15 bp, Homo sapiens
ggtgggaacttcaat

SEQ ID NO: 329725 - DNA, 15 bp, Homo sapiens
gtgggaacttcaatc

SEQ ID NO: 329726 - DNA, 15 bp, Homo sapiens
tgggaacttcaatcc

SEQ ID NO: 329727 - DNA, 15 bp, Homo sapiens
gggaacttcaatcca

SEQ ID NO: 329728 - DNA, 15 bp, Homo sapiens
ggaacttcaatccag

SEQ ID NO: 329729 - DNA, 15 bp, Homo sapiens
gaacttcaatccaga

SEQ ID NO: 329730 - DNA, 15 bp, Homo sapiens
aacttcaatccagac

SEQ ID NO: 329731 - DNA, 15 bp, Homo sapiens
acttcaatccagact

SEQ ID NO: 329732 - DNA, 15 bp, Homo sapiens
cttcaatccagactc

SEQ ID NO: 329733 - DNA, 15 bp, Homo sapiens
ttcaatccagactcc

SEQ ID NO: 329734 - DNA, 15 bp, Homo sapiens
tcaatccagactccg

SEQ ID NO: 329735 - DNA, 15 bp, Homo sapiens
caatccagactccga

SEQ ID NO: 329736 - DNA, 15 bp, Homo sapiens
aatccagactccgac

SEQ ID NO: 329737 - DNA, 15 bp, Homo sapiens
atccagactccgaca

SEQ ID NO: 329738 - DNA, 15 bp, Homo sapiens
tccagactccgacat

SEQ ID NO: 329739 - DNA, 15 bp, Homo sapiens
ccagactccgacatc

SEQ ID NO: 329740 - DNA, 15 bp, Homo sapiens
cagactccgacatcg

SEQ ID NO: 329741 - DNA, 15 bp, Homo sapiens
agactccgacatcgc

SEQ ID NO: 329742 - DNA, 15 bp, Homo sapiens
gactccgacatcgcc

SEQ ID NO: 329743 - DNA, 15 bp, Homo sapiens
actccgacatcgcca

SEQ ID NO: 329744 - DNA, 15 bp, Homo sapiens
ctccgacatcgccac

SEQ ID NO: 329745 - DNA, 15 bp, Homo sapiens
tccgacatcgccacg

SEQ ID NO: 329746 - DNA, 15 bp, Homo sapiens
ccgacatcgccacgg

SEQ ID NO: 329747 - DNA, 15 bp, Homo sapiens
cgacatcgccacggg

SEQ ID NO: 329748 - DNA, 15 bp, Homo sapiens
gacatcgccacgggc

SEQ ID NO: 329749 - DNA, 15 bp, Homo sapiens
acatcgccacgggca

SEQ ID NO: 329750 - DNA, 15 bp, Homo sapiens
catcgccacgggcaa

SEQ ID NO: 329751 - DNA, 15 bp, Homo sapiens
atcgccacgggcaag

SEQ ID NO: 329752 - DNA, 15 bp, Homo sapiens
tcgccacgggcaagc

SEQ ID NO: 329753 - DNA, 15 bp, Homo sapiens
cgccacgggcaagct

SEQ ID NO: 329754 - DNA, 15 bp, Homo sapiens
gccacgggcaagctg

SEQ ID NO: 329755 - DNA, 15 bp, Homo sapiens
ccacgggcaagctga

SEQ ID NO: 329756 - DNA, 15 bp, Homo sapiens
cacgggcaagctgaa

SEQ ID NO: 329757 - DNA, 15 bp, Homo sapiens
acgggcaagctgaat

SEQ ID NO: 329758 - DNA, 15 bp, Homo sapiens
cgggcaagctgaatg

SEQ ID NO: 329759 - DNA, 15 bp, Homo sapiens
gggcaagctgaatga

SEQ ID NO: 329760 - DNA, 15 bp, Homo sapiens
ggcaagctgaatgac

SEQ ID NO: 329761 - DNA, 15 bp, Homo sapiens
gcaagctgaatgaca

SEQ ID NO: 329762 - DNA, 15 bp, Homo sapiens
caagctgaatgacag

SEQ ID NO: 329763 - DNA, 15 bp, Homo sapiens
aagctgaatgacagt

SEQ ID NO: 329764 - DNA, 15 bp, Homo sapiens
agctgaatgacagta

SEQ ID NO: 329765 - DNA, 15 bp, Homo sapiens
gctgaatgacagtaa

SEQ ID NO: 329766 - DNA, 15 bp, Homo sapiens
ctgaatgacagtaaa

SEQ ID NO: 329767 - DNA, 15 bp, Homo sapiens
tgaatgacagtaaac

SEQ ID NO: 329768 - DNA, 15 bp, Homo sapiens
gaatgacagtaaaca

SEQ ID NO: 329769 - DNA, 15 bp, Homo sapiens
aatgacagtaaacaa

SEQ ID NO: 329770 - DNA, 15 bp, Homo sapiens
atgacagtaaacaac

SEQ ID NO: 329771 - DNA, 15 bp, Homo sapiens
tgacagtaaacaacc

SEQ ID NO: 329772 - DNA, 15 bp, Homo sapiens
gacagtaaacaacct

SEQ ID NO: 329773 - DNA, 15 bp, Homo sapiens
acagtaaacaacctt

SEQ ID NO: 329774 - DNA, 15 bp, Homo sapiens
cagtaaacaaccttc

SEQ ID NO: 329775 - DNA, 15 bp, Homo sapiens
agtaaacaaccttca

SEQ ID NO: 329776 - DNA, 15 bp, Homo sapiens
gtaaacaaccttcag

SEQ ID NO: 329777 - DNA, 15 bp, Homo sapiens
taaacaaccttcagg

SEQ ID NO: 329778 - DNA, 15 bp, Homo sapiens
aaacaaccttcaggg

SEQ ID NO: 329779 - DNA, 15 bp, Homo sapiens
aacaaccttcagggc

SEQ ID NO: 329780 - DNA, 15 bp, Homo sapiens
acaaccttcagggct

SEQ ID NO: 329781 - DNA, 15 bp, Homo sapiens
caaccttcagggctt

SEQ ID NO: 329782 - DNA, 15 bp, Homo sapiens
aaccttcagggcttg

SEQ ID NO: 329783 - DNA, 15 bp, Homo sapiens
accttcagggcttgg

SEQ ID NO: 329784 - DNA, 15 bp, Homo sapiens
ccttcagggcttggg

SEQ ID NO: 329785 - DNA, 15 bp, Homo sapiens
cttcagggcttgggg

SEQ ID NO: 329786 - DNA, 15 bp, Homo sapiens
ttcagggcttgggga

SEQ ID NO: 329787 - DNA, 15 bp, Homo sapiens
tcagggcttggggac

SEQ ID NO: 329788 - DNA, 15 bp, Homo sapiens
cagggcttggggacg

SEQ ID NO: 329789 - DNA, 15 bp, Homo sapiens
agggcttggggacgt

SEQ ID NO: 329790 - DNA, 15 bp, Homo sapiens
gggcttggggacgtc

SEQ ID NO: 329791 - DNA, 15 bp, Homo sapiens
ggcttggggacgtca

SEQ ID NO: 329792 - DNA, 15 bp, Homo sapiens
gcttggggacgtcag

SEQ ID NO: 329793 - DNA, 15 bp, Homo sapiens
cttggggacgtcagc

SEQ ID NO: 329794 - DNA, 15 bp, Homo sapiens
ttggggacgtcagca

SEQ ID NO: 329795 - DNA, 15 bp, Homo sapiens
tggggacgtcagcac

SEQ ID NO: 329796 - DNA, 15 bp, Homo sapiens
ggggacgtcagcaca

SEQ ID NO: 329797 - DNA, 15 bp, Homo sapiens
gggacgtcagcacac

SEQ ID NO: 329798 - DNA, 15 bp, Homo sapiens
ggacgtcagcacact

SEQ ID NO: 329799 - DNA, 15 bp, Homo sapiens
gacgtcagcacactc

SEQ ID NO: 329800 - DNA, 15 bp, Homo sapiens
acgtcagcacactca

SEQ ID NO: 329801 - DNA, 15 bp, Homo sapiens
cgtcagcacactcac

SEQ ID NO: 329802 - DNA, 15 bp, Homo sapiens
gtcagcacactcacc

SEQ ID NO: 329803 - DNA, 15 bp, Homo sapiens
tcagcacactcacct

SEQ ID NO: 329804 - DNA, 15 bp, Homo sapiens
cagcacactcacctg

SEQ ID NO: 329805 - DNA, 15 bp, Homo sapiens
agcacactcacctgt

SEQ ID NO: 329806 - DNA, 15 bp, Homo sapiens
gcacactcacctgtg

SEQ ID NO: 329807 - DNA, 15 bp, Homo sapiens
cacactcacctgtgg

SEQ ID NO: 329808 - DNA, 15 bp, Homo sapiens
acactcacctgtgga

SEQ ID NO: 329809 - DNA, 15 bp, Homo sapiens
cactcacctgtggag

SEQ ID NO: 329810 - DNA, 15 bp, Homo sapiens
actcacctgtggaga

SEQ ID NO: 329811 - DNA, 15 bp, Homo sapiens
ctcacctgtggagag

SEQ ID NO: 329812 - DNA, 15 bp, Homo sapiens
tcacctgtggagagc

SEQ ID NO: 329813 - DNA, 15 bp, Homo sapiens
cacctgtggagagcc

SEQ ID NO: 329814 - DNA, 15 bp, Homo sapiens
acctgtggagagcca

SEQ ID NO: 329815 - DNA, 15 bp, Homo sapiens
ctgtggagagccagc

SEQ ID NO: 329816 - DNA, 15 bp, Homo sapiens
tgtggagagccagcc

SEQ ID NO: 329817 - DNA, 15 bp, Homo sapiens
gtggagagccagcca

SEQ ID NO: 329818 - DNA, 15 bp, Homo sapiens
tggagagccagccag

SEQ ID NO: 329819 - DNA, 15 bp, Homo sapiens
ggagagccagccaga

SEQ ID NO: 329820 - DNA, 15 bp, Homo sapiens
gagagccagccagaa

SEQ ID NO: 329821 - DNA, 15 bp, Homo sapiens
agagccagccagaag

SEQ ID NO: 329822 - DNA, 15 bp, Homo sapiens
gagccagccagaaga

SEQ ID NO: 329823 - DNA, 15 bp, Homo sapiens
agccagccagaagac

SEQ ID NO: 329824 - DNA, 15 bp, Homo sapiens
gccagccagaagaca

SEQ ID NO: 329825 - DNA, 15 bp, Homo sapiens
ccagccagaagacag

SEQ ID NO: 329826 - DNA, 15 bp, Homo sapiens
cagccagaagacagg

SEQ ID NO: 329827 - DNA, 15 bp, Homo sapiens
agccagaagacaggc

SEQ ID NO: 329828 - DNA, 15 bp, Homo sapiens
gccagaagacaggca

SEQ ID NO: 329829 - DNA, 15 bp, Homo sapiens
ccagaagacaggcag

SEQ ID NO: 329830 - DNA, 15 bp, Homo sapiens
cagaagacaggcagt

SEQ ID NO: 329831 - DNA, 15 bp, Homo sapiens
agaagacaggcagtg

SEQ ID NO: 329832 - DNA, 15 bp, Homo sapiens
gaagacaggcagtgg

SEQ ID NO: 329833 - DNA, 15 bp, Homo sapiens
aagacaggcagtggc

SEQ ID NO: 329834 - DNA, 15 bp, Homo sapiens
agacaggcagtggca

SEQ ID NO: 329835 - DNA, 15 bp, Homo sapiens
gacaggcagtggcac

SEQ ID NO: 329836 - DNA, 15 bp, Homo sapiens
acaggcagtggcaca

SEQ ID NO: 329837 - DNA, 15 bp, Homo sapiens
caggcagtggcacaa

SEQ ID NO: 329838 - DNA, 15 bp, Homo sapiens
aggcagtggcacaag

SEQ ID NO: 329839 - DNA, 15 bp, Homo sapiens
ggcagtggcacaagt

SEQ ID NO: 329840 - DNA, 15 bp, Homo sapiens
gcagtggcacaagtt

SEQ ID NO: 329841 - DNA, 15 bp, Homo sapiens
cagtggcacaagttt

SEQ ID NO: 329842 - DNA, 15 bp, Homo sapiens
agtggcacaagtttt

SEQ ID NO: 329843 - DNA, 15 bp, Homo sapiens
gtggcacaagttttc

SEQ ID NO: 329844 - DNA, 15 bp, Homo sapiens
tggcacaagttttct

SEQ ID NO: 329845 - DNA, 15 bp, Homo sapiens
ggcacaagttttctg

SEQ ID NO: 329846 - DNA, 15 bp, Homo sapiens
gcacaagttttctga

SEQ ID NO: 329847 - DNA, 15 bp, Homo sapiens
cacaagttttctgag

SEQ ID NO: 329848 - DNA, 15 bp, Homo sapiens
acaagttttctgagg

SEQ ID NO: 329849 - DNA, 15 bp, Homo sapiens
caagttttctgaggt

SEQ ID NO: 329850 - DNA, 15 bp, Homo sapiens
aagttttctgaggta

SEQ ID NO: 329851 - DNA, 15 bp, Homo sapiens
agttttctgaggtag

SEQ ID NO: 329852 - DNA, 15 bp, Homo sapiens
gttttctgaggtaga

SEQ ID NO: 329853 - DNA, 15 bp, Homo sapiens
ttttctgaggtagag

SEQ ID NO: 329854 - DNA, 15 bp, Homo sapiens
tttctgaggtagaga

SEQ ID NO: 329855 - DNA, 15 bp, Homo sapiens
ttctgaggtagagat

SEQ ID NO: 329856 - DNA, 15 bp, Homo sapiens
tctgaggtagagatt

SEQ ID NO: 329857 - DNA, 15 bp, Homo sapiens
ctgaggtagagattg

SEQ ID NO: 329858 - DNA, 15 bp, Homo sapiens
tgaggtagagattgt

SEQ ID NO: 329859 - DNA, 15 bp, Homo sapiens
gaggtagagattgtg

SEQ ID NO: 329860 - DNA, 15 bp, Homo sapiens
aggtagagattgtga

SEQ ID NO: 329861 - DNA, 15 bp, Homo sapiens
ggtagagattgtgac

SEQ ID NO: 329862 - DNA, 15 bp, Homo sapiens
gtagagattgtgact

SEQ ID NO: 329863 - DNA, 15 bp, Homo sapiens
tagagattgtgactg

SEQ ID NO: 329864 - DNA, 15 bp, Homo sapiens
agagattgtgactgt

SEQ ID NO: 329865 - DNA, 15 bp, Homo sapiens
gagattgtgactgta

SEQ ID NO: 329866 - DNA, 15 bp, Homo sapiens
agattgtgactgtag

SEQ ID NO: 329867 - DNA, 15 bp, Homo sapiens
gattgtgactgtagg

SEQ ID NO: 329868 - DNA, 15 bp, Homo sapiens
attgtgactgtaggt

SEQ ID NO: 329869 - DNA, 15 bp, Homo sapiens
ttgtgactgtaggtg

SEQ ID NO: 329870 - DNA, 15 bp, Homo sapiens
tgtgactgtaggtga

SEQ ID NO: 329871 - DNA, 15 bp, Homo sapiens
gtgactgtaggtgac

SEQ ID NO: 329872 - DNA, 15 bp, Homo sapiens
tgactgtaggtgacc

SEQ ID NO: 329873 - DNA, 15 bp, Homo sapiens
gactgtaggtgacca

SEQ ID NO: 329874 - DNA, 15 bp, Homo sapiens
actgtaggtgaccaa

SEQ ID NO: 329875 - DNA, 15 bp, Homo sapiens
ctgtaggtgaccaag

SEQ ID NO: 329876 - DNA, 15 bp, Homo sapiens
tgtaggtgaccaagg

SEQ ID NO: 329877 - DNA, 15 bp, Homo sapiens
gtaggtgaccaagga

SEQ ID NO: 329878 - DNA, 15 bp, Homo sapiens
taggtgaccaaggaa

SEQ ID NO: 329879 - DNA, 15 bp, Homo sapiens
aggtgaccaaggaac

SEQ ID NO: 329880 - DNA, 15 bp, Homo sapiens
ggtgaccaaggaaca

SEQ ID NO: 329881 - DNA, 15 bp, Homo sapiens
gtgaccaaggaacaa

SEQ ID NO: 329882 - DNA, 15 bp, Homo sapiens
tgaccaaggaacaaa

SEQ ID NO: 329883 - DNA, 15 bp, Homo sapiens
gaccaaggaacaaaa

SEQ ID NO: 329884 - DNA, 15 bp, Homo sapiens
accaaggaacaaaat

SEQ ID NO: 329885 - DNA, 15 bp, Homo sapiens
ccaaggaacaaaata

SEQ ID NO: 329886 - DNA, 15 bp, Homo sapiens
caaggaacaaaatat

SEQ ID NO: 329887 - DNA, 15 bp, Homo sapiens
aaggaacaaaatatt

SEQ ID NO: 329888 - DNA, 15 bp, Homo sapiens
aggaacaaaatatta

SEQ ID NO: 329889 - DNA, 15 bp, Homo sapiens
ggaacaaaatattat

SEQ ID NO: 329890 - DNA, 15 bp, Homo sapiens
gaacaaaatattatg

SEQ ID NO: 329891 - DNA, 15 bp, Homo sapiens
aacaaaatattatga

SEQ ID NO: 329892 - DNA, 15 bp, Homo sapiens
acaaaatattatgaa

SEQ ID NO: 329893 - DNA, 15 bp, Homo sapiens
caaaatattatgaag

SEQ ID NO: 329894 - DNA, 15 bp, Homo sapiens
aaaatattatgaaga

SEQ ID NO: 329895 - DNA, 15 bp, Homo sapiens
aaatattatgaagac

SEQ ID NO: 329896 - DNA, 15 bp, Homo sapiens
aatattatgaagacc

SEQ ID NO: 329897 - DNA, 15 bp, Homo sapiens
atattatgaagacca

SEQ ID NO: 329898 - DNA, 15 bp, Homo sapiens
tattatgaagaccac

SEQ ID NO: 329899 - DNA, 15 bp, Homo sapiens
attatgaagaccaca

SEQ ID NO: 329900 - DNA, 15 bp, Homo sapiens
ttatgaagaccacat

SEQ ID NO: 329901 - DNA, 15 bp, Homo sapiens
tatgaagaccacatt

SEQ ID NO: 329902 - DNA, 15 bp, Homo sapiens
atgaagaccacattg

SEQ ID NO: 329903 - DNA, 15 bp, Homo sapiens
tgaagaccacattgg

SEQ ID NO: 329904 - DNA, 15 bp, Homo sapiens
gaagaccacattggg

SEQ ID NO: 329905 - DNA, 15 bp, Homo sapiens
aagaccacattgggg

SEQ ID NO: 329906 - DNA, 15 bp, Homo sapiens
agaccacattggggt

SEQ ID NO: 329907 - DNA, 15 bp, Homo sapiens
gaccacattggggtt

SEQ ID NO: 329908 - DNA, 15 bp, Homo sapiens
accacattggggttc

SEQ ID NO: 329909 - DNA, 15 bp, Homo sapiens
ccacattggggttca

SEQ ID NO: 329910 - DNA, 15 bp, Homo sapiens
cacattggggttcat

SEQ ID NO: 329911 - DNA, 15 bp, Homo sapiens
acattggggttcata

SEQ ID NO: 329912 - DNA, 15 bp, Homo sapiens
cattggggttcatag

SEQ ID NO: 329913 - DNA, 15 bp, Homo sapiens
attggggttcatagg

SEQ ID NO: 329914 - DNA, 15 bp, Homo sapiens
ttggggttcataggc

SEQ ID NO: 329915 - DNA, 15 bp, Homo sapiens
tggggttcataggct

SEQ ID NO: 329916 - DNA, 15 bp, Homo sapiens
ggggttcataggctg

SEQ ID NO: 329917 - DNA, 15 bp, Homo sapiens
gggttcataggctgg

SEQ ID NO: 329918 - DNA, 15 bp, Homo sapiens
ggttcataggctggt

SEQ ID NO: 329919 - DNA, 15 bp, Homo sapiens
gttcataggctggtg

SEQ ID NO: 329920 - DNA, 15 bp, Homo sapiens
ttcataggctggtgg

SEQ ID NO: 329921 - DNA, 15 bp, Homo sapiens
tcataggctggtggc

SEQ ID NO: 329922 - DNA, 15 bp, Homo sapiens
cataggctggtggcc

SEQ ID NO: 329923 - DNA, 15 bp, Homo sapiens
ataggctggtggccc

SEQ ID NO: 329924 - DNA, 15 bp, Homo sapiens
taggctggtggccct

SEQ ID NO: 329925 - DNA, 15 bp, Homo sapiens
aggctggtggccctg

SEQ ID NO: 329926 - DNA, 15 bp, Homo sapiens
ggctggtggccctgt

SEQ ID NO: 329927 - DNA, 15 bp, Homo sapiens
gctggtggccctgta

SEQ ID NO: 329928 - DNA, 15 bp, Homo sapiens
ctggtggccctgtag

SEQ ID NO: 329929 - DNA, 15 bp, Homo sapiens
tggtggccctgtagg

SEQ ID NO: 329930 - DNA, 15 bp, Homo sapiens
ggtggccctgtagga

SEQ ID NO: 329931 - DNA, 15 bp, Homo sapiens
gtggccctgtaggac

SEQ ID NO: 329932 - DNA, 15 bp, Homo sapiens
tggccctgtaggaca

SEQ ID NO: 329933 - DNA, 15 bp, Homo sapiens
ggccctgtaggacac

SEQ ID NO: 329934 - DNA, 15 bp, Homo sapiens
gccctgtaggacact

SEQ ID NO: 329935 - DNA, 15 bp, Homo sapiens
ccctgtaggacactt

SEQ ID NO: 329936 - DNA, 15 bp, Homo sapiens
cctgtaggacacttg

SEQ ID NO: 329937 - DNA, 15 bp, Homo sapiens
ctgtaggacacttgg

SEQ ID NO: 329938 - DNA, 15 bp, Homo sapiens
tgtaggacacttgga

SEQ ID NO: 329939 - DNA, 15 bp, Homo sapiens
gtaggacacttggac

SEQ ID NO: 329940 - DNA, 15 bp, Homo sapiens
taggacacttggaca

SEQ ID NO: 329941 - DNA, 15 bp, Homo sapiens
aggacacttggacac

SEQ ID NO: 329942 - DNA, 15 bp, Homo sapiens
ggacacttggacaca

SEQ ID NO: 329943 - DNA, 15 bp, Homo sapiens
gacacttggacacat

SEQ ID NO: 329944 - DNA, 15 bp, Homo sapiens
acacttggacacatt

SEQ ID NO: 329945 - DNA, 15 bp, Homo sapiens
cacttggacacattt

SEQ ID NO: 329946 - DNA, 15 bp, Homo sapiens
acttggacacatttt

SEQ ID NO: 329947 - DNA, 15 bp, Homo sapiens
cttggacacattttt

SEQ ID NO: 329948 - DNA, 15 bp, Homo sapiens
ttggacacatttttt

SEQ ID NO: 329949 - DNA, 15 bp, Homo sapiens
tggacacattttttt

SEQ ID NO: 329950 - DNA, 15 bp, Homo sapiens
ggacacatttttttt

SEQ ID NO: 329951 - DNA, 15 bp, Homo sapiens
gacacattttttttc

SEQ ID NO: 329952 - DNA, 15 bp, Homo sapiens
acacattttttttcc

SEQ ID NO: 329953 - DNA, 15 bp, Homo sapiens
cacattttttttcct

SEQ ID NO: 329954 - DNA, 15 bp, Homo sapiens
acattttttttcctg

SEQ ID NO: 329955 - DNA, 15 bp, Homo sapiens
cattttttttcctgc

SEQ ID NO: 329956 - DNA, 15 bp, Homo sapiens
attttttttcctgcc

SEQ ID NO: 329957 - DNA, 15 bp, Homo sapiens
ttttttttcctgcca

SEQ ID NO: 329958 - DNA, 15 bp, Homo sapiens
tttttttcctgccaa

SEQ ID NO: 329959 - DNA, 15 bp, Homo sapiens
ttttttcctgccaac

SEQ ID NO: 329960 - DNA, 15 bp, Homo sapiens
tttttcctgccaaca

SEQ ID NO: 329961 - DNA, 15 bp, Homo sapiens
ttttcctgccaacac

SEQ ID NO: 329962 - DNA, 15 bp, Homo sapiens
tttcctgccaacacc

SEQ ID NO: 329963 - DNA, 15 bp, Homo sapiens
ttcctgccaacacca

SEQ ID NO: 329964 - DNA, 15 bp, Homo sapiens
tcctgccaacaccaa

SEQ ID NO: 329965 - DNA, 15 bp, Homo sapiens
cctgccaacaccaaa

SEQ ID NO: 329966 - DNA, 15 bp, Homo sapiens
ctgccaacaccaaag

SEQ ID NO: 329967 - DNA, 15 bp, Homo sapiens
tgccaacaccaaaga

SEQ ID NO: 329968 - DNA, 15 bp, Homo sapiens
gccaacaccaaagaa

SEQ ID NO: 329969 - DNA, 15 bp, Homo sapiens
ccaacaccaaagaat

SEQ ID NO: 329970 - DNA, 15 bp, Homo sapiens
caacaccaaagaata

SEQ ID NO: 329971 - DNA, 15 bp, Homo sapiens
aacaccaaagaataa

SEQ ID NO: 329972 - DNA, 15 bp, Homo sapiens
acaccaaagaataat

SEQ ID NO: 329973 - DNA, 15 bp, Homo sapiens
caccaaagaataatt

SEQ ID NO: 329974 - DNA, 15 bp, Homo sapiens
accaaagaataattt

SEQ ID NO: 329975 - DNA, 15 bp, Homo sapiens
ccaaagaataatttc

SEQ ID NO: 329976 - DNA, 15 bp, Homo sapiens
caaagaataatttct

SEQ ID NO: 329977 - DNA, 15 bp, Homo sapiens
aaagaataatttcta

SEQ ID NO: 329978 - DNA, 15 bp, Homo sapiens
aagaataatttctag

SEQ ID NO: 329979 - DNA, 15 bp, Homo sapiens
agaataatttctagg

SEQ ID NO: 329980 - DNA, 15 bp, Homo sapiens
gaataatttctaggt

SEQ ID NO: 329981 - DNA, 15 bp, Homo sapiens
aataatttctaggtg

SEQ ID NO: 329982 - DNA, 15 bp, Homo sapiens
ataatttctaggtgt

SEQ ID NO: 329983 - DNA, 15 bp, Homo sapiens
taatttctaggtgtc

SEQ ID NO: 329984 - DNA, 15 bp, Homo sapiens
aatttctaggtgtct

SEQ ID NO: 329985 - DNA, 15 bp, Homo sapiens
atttctaggtgtctc

SEQ ID NO: 329986 - DNA, 15 bp, Homo sapiens
tttctaggtgtctct

SEQ ID NO: 329987 - DNA, 15 bp, Homo sapiens
ttctaggtgtctctt

SEQ ID NO: 329988 - DNA, 15 bp, Homo sapiens
tctaggtgtctcttc

SEQ ID NO: 329989 - DNA, 15 bp, Homo sapiens
ctaggtgtctcttct

SEQ ID NO: 329990 - DNA, 15 bp, Homo sapiens
taggtgtctcttctt

SEQ ID NO: 329991 - DNA, 15 bp, Homo sapiens
aggtgtctcttcttc

SEQ ID NO: 329992 - DNA, 15 bp, Homo sapiens
ggtgtctcttcttca

SEQ ID NO: 329993 - DNA, 15 bp, Homo sapiens
gtgtctcttcttcac

SEQ ID NO: 329994 - DNA, 15 bp, Homo sapiens
tgtctcttcttcaca

SEQ ID NO: 329995 - DNA, 15 bp, Homo sapiens
gtctcttcttcacac

SEQ ID NO: 329996 - DNA, 15 bp, Homo sapiens
tctcttcttcacacc

SEQ ID NO: 329997 - DNA, 15 bp, Homo sapiens
ctcttcttcacacct

SEQ ID NO: 329998 - DNA, 15 bp, Homo sapiens
tcttcttcacacctt

SEQ ID NO: 329999 - DNA, 15 bp, Homo sapiens
cttcttcacaccttc

SEQ ID NO: 330000 - DNA, 15 bp, Homo sapiens
ttcttcacaccttcc

SEQ ID NO: 330001 - DNA, 15 bp, Homo sapiens
tcttcacaccttccc

SEQ ID NO: 330002 - DNA, 15 bp, Homo sapiens
cttcacaccttccca

SEQ ID NO: 330003 - DNA, 15 bp, Homo sapiens
ttcacaccttcccat

SEQ ID NO: 330004 - DNA, 15 bp, Homo sapiens
tcacaccttcccatg

SEQ ID NO: 330005 - DNA, 15 bp, Homo sapiens
cacaccttcccatga

SEQ ID NO: 330006 - DNA, 15 bp, Homo sapiens
acaccttcccatgaa

SEQ ID NO: 330007 - DNA, 15 bp, Homo sapiens
caccttcccatgaag

SEQ ID NO: 330008 - DNA, 15 bp, Homo sapiens
accttcccatgaagc

SEQ ID NO: 330009 - DNA, 15 bp, Homo sapiens
ccttcccatgaagct

SEQ ID NO: 330010 - DNA, 15 bp, Homo sapiens
cttcccatgaagctt

SEQ ID NO: 330011 - DNA, 15 bp, Homo sapiens
ttcccatgaagcttg

SEQ ID NO: 330012 - DNA, 15 bp, Homo sapiens
tcccatgaagcttga

SEQ ID NO: 330013 - DNA, 15 bp, Homo sapiens
cccatgaagcttgaa

SEQ ID NO: 330014 - DNA, 15 bp, Homo sapiens
ccatgaagcttgaaa

SEQ ID NO: 330015 - DNA, 15 bp, Homo sapiens
catgaagcttgaaag

SEQ ID NO: 330016 - DNA, 15 bp, Homo sapiens
atgaagcttgaaagt

SEQ ID NO: 330017 - DNA, 15 bp, Homo sapiens
tgaagcttgaaagtt

SEQ ID NO: 330018 - DNA, 15 bp, Homo sapiens
gaagcttgaaagttc

SEQ ID NO: 330019 - DNA, 15 bp, Homo sapiens
aagcttgaaagttct

SEQ ID NO: 330020 - DNA, 15 bp, Homo sapiens
agcttgaaagttcta

SEQ ID NO: 330021 - DNA, 15 bp, Homo sapiens
gcttgaaagttctag

SEQ ID NO: 330022 - DNA, 15 bp, Homo sapiens
cttgaaagttctaga

SEQ ID NO: 330023 - DNA, 15 bp, Homo sapiens
ttgaaagttctagag

SEQ ID NO: 330024 - DNA, 15 bp, Homo sapiens
tgaaagttctagagc

SEQ ID NO: 330025 - DNA, 15 bp, Homo sapiens
gaaagttctagagct

SEQ ID NO: 330026 - DNA, 15 bp, Homo sapiens
aaagttctagagctc

SEQ ID NO: 330027 - DNA, 15 bp, Homo sapiens
aagttctagagctca

SEQ ID NO: 330028 - DNA, 15 bp, Homo sapiens
agttctagagctcac

SEQ ID NO: 330029 - DNA, 15 bp, Homo sapiens
gttctagagctcact

SEQ ID NO: 330030 - DNA, 15 bp, Homo sapiens
ttctagagctcacta

SEQ ID NO: 330031 - DNA, 15 bp, Homo sapiens
tctagagctcactag

SEQ ID NO: 330032 - DNA, 15 bp, Homo sapiens
ctagagctcactaga

SEQ ID NO: 330033 - DNA, 15 bp, Homo sapiens
tagagctcactagaa

SEQ ID NO: 330034 - DNA, 15 bp, Homo sapiens
agagctcactagaaa

SEQ ID NO: 330035 - DNA, 15 bp, Homo sapiens
gagctcactagaaac

SEQ ID NO: 330036 - DNA, 15 bp, Homo sapiens
agctcactagaaact

SEQ ID NO: 330037 - DNA, 15 bp, Homo sapiens
gctcactagaaacta

SEQ ID NO: 330038 - DNA, 15 bp, Homo sapiens
ctcactagaaactag

SEQ ID NO: 330039 - DNA, 15 bp, Homo sapiens
tcactagaaactaga

SEQ ID NO: 330040 - DNA, 15 bp, Homo sapiens
cactagaaactagaa

SEQ ID NO: 330041 - DNA, 15 bp, Homo sapiens
actagaaactagaaa

SEQ ID NO: 330042 - DNA, 15 bp, Homo sapiens
ctagaaactagaaaa

SEQ ID NO: 330043 - DNA, 15 bp, Homo sapiens
tagaaactagaaaaa

SEQ ID NO: 330044 - DNA, 15 bp, Homo sapiens
agaaactagaaaaat

SEQ ID NO: 330045 - DNA, 15 bp, Homo sapiens
gaaactagaaaaatt

SEQ ID NO: 330046 - DNA, 15 bp, Homo sapiens
aaactagaaaaattt

SEQ ID NO: 330047 - DNA, 15 bp, Homo sapiens
aactagaaaaatttt

SEQ ID NO: 330048 - DNA, 15 bp, Homo sapiens
actagaaaaattttc

SEQ ID NO: 330049 - DNA, 15 bp, Homo sapiens
ctagaaaaattttcc

SEQ ID NO: 330050 - DNA, 15 bp, Homo sapiens
tagaaaaattttcct

SEQ ID NO: 330051 - DNA, 15 bp, Homo sapiens
agaaaaattttcctt

SEQ ID NO: 330052 - DNA, 15 bp, Homo sapiens
gaaaaattttcctta

SEQ ID NO: 330053 - DNA, 15 bp, Homo sapiens
aaaaattttccttac

SEQ ID NO: 330054 - DNA, 15 bp, Homo sapiens
aaaattttccttact

SEQ ID NO: 330055 - DNA, 15 bp, Homo sapiens
aaattttccttacta

SEQ ID NO: 330056 - DNA, 15 bp, Homo sapiens
aattttccttactat

SEQ ID NO: 330057 - DNA, 15 bp, Homo sapiens
attttccttactatg

SEQ ID NO: 330058 - DNA, 15 bp, Homo sapiens
ttttccttactatga

SEQ ID NO: 330059 - DNA, 15 bp, Homo sapiens
tttccttactatgac

SEQ ID NO: 330060 - DNA, 15 bp, Homo sapiens
ttccttactatgaca

SEQ ID NO: 330061 - DNA, 15 bp, Homo sapiens
tccttactatgacag

SEQ ID NO: 330062 - DNA, 15 bp, Homo sapiens
ccttactatgacagc

SEQ ID NO: 330063 - DNA, 15 bp, Homo sapiens
cttactatgacagca

SEQ ID NO: 330064 - DNA, 15 bp, Homo sapiens
ttactatgacagcaa

SEQ ID NO: 330065 - DNA, 15 bp, Homo sapiens
tactatgacagcaag

SEQ ID NO: 330066 - DNA, 15 bp, Homo sapiens
actatgacagcaagt

SEQ ID NO: 330067 - DNA, 15 bp, Homo sapiens
ctatgacagcaagtg

SEQ ID NO: 330068 - DNA, 15 bp, Homo sapiens
tatgacagcaagtgt

SEQ ID NO: 330069 - DNA, 15 bp, Homo sapiens
atgacagcaagtgtg

SEQ ID NO: 330070 - DNA, 15 bp, Homo sapiens
tgacagcaagtgtgc

SEQ ID NO: 330071 - DNA, 15 bp, Homo sapiens
gacagcaagtgtgct

SEQ ID NO: 330072 - DNA, 15 bp, Homo sapiens
acagcaagtgtgctt

SEQ ID NO: 330073 - DNA, 15 bp, Homo sapiens
cagcaagtgtgcttc

SEQ ID NO: 330074 - DNA, 15 bp, Homo sapiens
agcaagtgtgcttcg

SEQ ID NO: 330075 - DNA, 15 bp, Homo sapiens
gcaagtgtgcttcga

SEQ ID NO: 330076 - DNA, 15 bp, Homo sapiens
caagtgtgcttcgag

SEQ ID NO: 330077 - DNA, 15 bp, Homo sapiens
aagtgtgcttcgaga

SEQ ID NO: 330078 - DNA, 15 bp, Homo sapiens
agtgtgcttcgagaa

SEQ ID NO: 330079 - DNA, 15 bp, Homo sapiens
gtgtgcttcgagaaa

SEQ ID NO: 330080 - DNA, 15 bp, Homo sapiens
tgtgcttcgagaaaa

SEQ ID NO: 330081 - DNA, 15 bp, Homo sapiens
gtgcttcgagaaaac

SEQ ID NO: 330082 - DNA, 15 bp, Homo sapiens
tgcttcgagaaaact

SEQ ID NO: 330083 - DNA, 15 bp, Homo sapiens
gcttcgagaaaactc

SEQ ID NO: 330084 - DNA, 15 bp, Homo sapiens
cttcgagaaaactca

SEQ ID NO: 330085 - DNA, 15 bp, Homo sapiens
ttcgagaaaactcac

SEQ ID NO: 330086 - DNA, 15 bp, Homo sapiens
tcgagaaaactcact

SEQ ID NO: 330087 - DNA, 15 bp, Homo sapiens
cgagaaaactcactt

SEQ ID NO: 330088 - DNA, 15 bp, Homo sapiens
gagaaaactcacttg

SEQ ID NO: 330089 - DNA, 15 bp, Homo sapiens
agaaaactcacttgc

SEQ ID NO: 330090 - DNA, 15 bp, Homo sapiens
gaaaactcacttgct

SEQ ID NO: 330091 - DNA, 15 bp, Homo sapiens
aaaactcacttgctg

SEQ ID NO: 330092 - DNA, 15 bp, Homo sapiens
aaactcacttgctga

SEQ ID NO: 330093 - DNA, 15 bp, Homo sapiens
aactcacttgctgac

SEQ ID NO: 330094 - DNA, 15 bp, Homo sapiens
actcacttgctgacc

SEQ ID NO: 330095 - DNA, 15 bp, Homo sapiens
ctcacttgctgacct

SEQ ID NO: 330096 - DNA, 15 bp, Homo sapiens
tcacttgctgacctt

SEQ ID NO: 330097 - DNA, 15 bp, Homo sapiens
cacttgctgaccttt

SEQ ID NO: 330098 - DNA, 15 bp, Homo sapiens
acttgctgacctttg

SEQ ID NO: 330099 - DNA, 15 bp, Homo sapiens
cttgctgacctttgt

SEQ ID NO: 330100 - DNA, 15 bp, Homo sapiens
ttgctgacctttgtt

SEQ ID NO: 330101 - DNA, 15 bp, Homo sapiens
tgctgacctttgttc

SEQ ID NO: 330102 - DNA, 15 bp, Homo sapiens
gctgacctttgttcc

SEQ ID NO: 330103 - DNA, 15 bp, Homo sapiens
ctgacctttgttcca

SEQ ID NO: 330104 - DNA, 15 bp, Homo sapiens
tgacctttgttccac

SEQ ID NO: 330105 - DNA, 15 bp, Homo sapiens
gacctttgttccaca

SEQ ID NO: 330106 - DNA, 15 bp, Homo sapiens
acctttgttccacag

SEQ ID NO: 330107 - DNA, 15 bp, Homo sapiens
cctttgttccacagc

SEQ ID NO: 330108 - DNA, 15 bp, Homo sapiens
ctttgttccacagcc

SEQ ID NO: 330109 - DNA, 15 bp, Homo sapiens
tttgttccacagccc

SEQ ID NO: 330110 - DNA, 15 bp, Homo sapiens
ttgttccacagccca

SEQ ID NO: 330111 - DNA, 15 bp, Homo sapiens
tgttccacagcccag

SEQ ID NO: 330112 - DNA, 15 bp, Homo sapiens
gttccacagcccagc

SEQ ID NO: 330113 - DNA, 15 bp, Homo sapiens
ttccacagcccagca

SEQ ID NO: 330114 - DNA, 15 bp, Homo sapiens
tccacagcccagcag

SEQ ID NO: 330115 - DNA, 15 bp, Homo sapiens
ccacagcccagcagg

SEQ ID NO: 330116 - DNA, 15 bp, Homo sapiens
cacagcccagcaggt

SEQ ID NO: 330117 - DNA, 15 bp, Homo sapiens
acagcccagcaggtt

SEQ ID NO: 330118 - DNA, 15 bp, Homo sapiens
cagcccagcaggttg

SEQ ID NO: 330119 - DNA, 15 bp, Homo sapiens
agcccagcaggttgc

SEQ ID NO: 330120 - DNA, 15 bp, Homo sapiens
gcccagcaggttgcc

SEQ ID NO: 330121 - DNA, 15 bp, Homo sapiens
cccagcaggttgcca

SEQ ID NO: 330122 - DNA, 15 bp, Homo sapiens
ccagcaggttgccac

SEQ ID NO: 330123 - DNA, 15 bp, Homo sapiens
cagcaggttgccacc

SEQ ID NO: 330124 - DNA, 15 bp, Homo sapiens
agcaggttgccacct

SEQ ID NO: 330125 - DNA, 15 bp, Homo sapiens
gcaggttgccacctg

SEQ ID NO: 330126 - DNA, 15 bp, Homo sapiens
caggttgccacctga

SEQ ID NO: 330127 - DNA, 15 bp, Homo sapiens
aggttgccacctgat

SEQ ID NO: 330128 - DNA, 15 bp, Homo sapiens
ggttgccacctgatt

SEQ ID NO: 330129 - DNA, 15 bp, Homo sapiens
gttgccacctgattt

SEQ ID NO: 330130 - DNA, 15 bp, Homo sapiens
ttgccacctgattta

SEQ ID NO: 330131 - DNA, 15 bp, Homo sapiens
tgccacctgatttat

SEQ ID NO: 330132 - DNA, 15 bp, Homo sapiens
gccacctgatttata

SEQ ID NO: 330133 - DNA, 15 bp, Homo sapiens
ccacctgatttataa

SEQ ID NO: 330134 - DNA, 15 bp, Homo sapiens
cacctgatttataaa

SEQ ID NO: 330135 - DNA, 15 bp, Homo sapiens
acctgatttataaaa

SEQ ID NO: 330136 - DNA, 15 bp, Homo sapiens
cctgatttataaaaa

SEQ ID NO: 330137 - DNA, 15 bp, Homo sapiens
ctgatttataaaaac

SEQ ID NO: 330138 - DNA, 15 bp, Homo sapiens
tgatttataaaaaca

SEQ ID NO: 330139 - DNA, 15 bp, Homo sapiens
gatttataaaaacag

SEQ ID NO: 330140 - DNA, 15 bp, Homo sapiens
atttataaaaacaga

SEQ ID NO: 330141 - DNA, 15 bp, Homo sapiens
tttataaaaacagat

SEQ ID NO: 330142 - DNA, 15 bp, Homo sapiens
ttataaaaacagatt

SEQ ID NO: 330143 - DNA, 15 bp, Homo sapiens
tataaaaacagatta

SEQ ID NO: 330144 - DNA, 15 bp, Homo sapiens
ataaaaacagattat

SEQ ID NO: 330145 - DNA, 15 bp, Homo sapiens
taaaaacagattatg

SEQ ID NO: 330146 - DNA, 15 bp, Homo sapiens
aaaaacagattatgg

SEQ ID NO: 330147 - DNA, 15 bp, Homo sapiens
aaaacagattatgga

SEQ ID NO: 330148 - DNA, 15 bp, Homo sapiens
aaacagattatggag

SEQ ID NO: 330149 - DNA, 15 bp, Homo sapiens
aacagattatggaga

SEQ ID NO: 330150 - DNA, 15 bp, Homo sapiens
acagattatggagac

SEQ ID NO: 330151 - DNA, 15 bp, Homo sapiens
cagattatggagaca

SEQ ID NO: 330152 - DNA, 15 bp, Homo sapiens
agattatggagacag

SEQ ID NO: 330153 - DNA, 15 bp, Homo sapiens
gattatggagacagt

SEQ ID NO: 330154 - DNA, 15 bp, Homo sapiens
attatggagacagtc

SEQ ID NO: 330155 - DNA, 15 bp, Homo sapiens
ttatggagacagtcc

SEQ ID NO: 330156 - DNA, 15 bp, Homo sapiens
tatggagacagtcca

SEQ ID NO: 330157 - DNA, 15 bp, Homo sapiens
atggagacagtccag

SEQ ID NO: 330158 - DNA, 15 bp, Homo sapiens
tggagacagtccaga

SEQ ID NO: 330159 - DNA, 15 bp, Homo sapiens
ggagacagtccagaa

SEQ ID NO: 330160 - DNA, 15 bp, Homo sapiens
gagacagtccagaaa

SEQ ID NO: 330161 - DNA, 15 bp, Homo sapiens
agacagtccagaaaa

SEQ ID NO: 330162 - DNA, 15 bp, Homo sapiens
gacagtccagaaaaa

SEQ ID NO: 330163 - DNA, 15 bp, Homo sapiens
acagtccagaaaaat

SEQ ID NO: 330164 - DNA, 15 bp, Homo sapiens
cagtccagaaaaatt

SEQ ID NO: 330165 - DNA, 15 bp, Homo sapiens
agtccagaaaaatta

SEQ ID NO: 330166 - DNA, 15 bp, Homo sapiens
gtccagaaaaattac

SEQ ID NO: 330167 - DNA, 15 bp, Homo sapiens
tccagaaaaattact

SEQ ID NO: 330168 - DNA, 15 bp, Homo sapiens
ccagaaaaattactc

SEQ ID NO: 330169 - DNA, 15 bp, Homo sapiens
cagaaaaattactcc

SEQ ID NO: 330170 - DNA, 15 bp, Homo sapiens
agaaaaattactccc

SEQ ID NO: 330171 - DNA, 15 bp, Homo sapiens
gaaaaattactccct

SEQ ID NO: 330172 - DNA, 15 bp, Homo sapiens
aaaaattactccctc

SEQ ID NO: 330173 - DNA, 15 bp, Homo sapiens
aaaattactccctct

SEQ ID NO: 330174 - DNA, 15 bp, Homo sapiens
aaattactccctctt

SEQ ID NO: 330175 - DNA, 15 bp, Homo sapiens
aattactccctcttt

SEQ ID NO: 330176 - DNA, 15 bp, Homo sapiens
attactccctctttc

SEQ ID NO: 330177 - DNA, 15 bp, Homo sapiens
ttactccctctttct

SEQ ID NO: 330178 - DNA, 15 bp, Homo sapiens
tactccctctttctt

SEQ ID NO: 330179 - DNA, 15 bp, Homo sapiens
actccctctttcttt

SEQ ID NO: 330180 - DNA, 15 bp, Homo sapiens
ctccctctttctttt

SEQ ID NO: 330181 - DNA, 15 bp, Homo sapiens
tccctctttcttttt

SEQ ID NO: 330182 - DNA, 15 bp, Homo sapiens
ccctctttctttttt

SEQ ID NO: 330183 - DNA, 15 bp, Homo sapiens
cctctttcttttttt

SEQ ID NO: 330184 - DNA, 15 bp, Homo sapiens
ctctttctttttttt

SEQ ID NO: 330185 - DNA, 15 bp, Homo sapiens
tttctttttttttta

SEQ ID NO: 330186 - DNA, 15 bp, Homo sapiens
ttcttttttttttaa

SEQ ID NO: 330187 - DNA, 15 bp, Homo sapiens
tcttttttttttaaa

SEQ ID NO: 330188 - DNA, 15 bp, Homo sapiens
cttttttttttaaag

SEQ ID NO: 330189 - DNA, 15 bp, Homo sapiens
ttttttttttaaagt

SEQ ID NO: 330190 - DNA, 15 bp, Homo sapiens
tttttttttaaagta

SEQ ID NO: 330191 - DNA, 15 bp, Homo sapiens
ttttttttaaagtaa

SEQ ID NO: 330192 - DNA, 15 bp, Homo sapiens
tttttttaaagtaat

SEQ ID NO: 330193 - DNA, 15 bp, Homo sapiens
ttttttaaagtaata

SEQ ID NO: 330194 - DNA, 15 bp, Homo sapiens
tttttaaagtaatat

SEQ ID NO: 330195 - DNA, 15 bp, Homo sapiens
ttttaaagtaatatt

SEQ ID NO: 330196 - DNA, 15 bp, Homo sapiens
tttaaagtaatattt

SEQ ID NO: 330197 - DNA, 15 bp, Homo sapiens
ttaaagtaatatttt

SEQ ID NO: 330198 - DNA, 15 bp, Homo sapiens
taaagtaatatttta

SEQ ID NO: 330199 - DNA, 15 bp, Homo sapiens
aaagtaatattttaa

SEQ ID NO: 330200 - DNA, 15 bp, Homo sapiens
aagtaatattttaaa

SEQ ID NO: 330201 - DNA, 15 bp, Homo sapiens
agtaatattttaaaa

SEQ ID NO: 330202 - DNA, 15 bp, Homo sapiens
gtaatattttaaaat

SEQ ID NO: 330203 - DNA, 15 bp, Homo sapiens
taatattttaaaatt

SEQ ID NO: 330204 - DNA, 15 bp, Homo sapiens
aatattttaaaattc

SEQ ID NO: 330205 - DNA, 15 bp, Homo sapiens
atattttaaaattcc

SEQ ID NO: 330206 - DNA, 15 bp, Homo sapiens
tattttaaaattcct

SEQ ID NO: 330207 - DNA, 15 bp, Homo sapiens
attttaaaattcctt

SEQ ID NO: 330208 - DNA, 15 bp, Homo sapiens
ttttaaaattccttt

SEQ ID NO: 330209 - DNA, 15 bp, Homo sapiens
tttaaaattcctttc

SEQ ID NO: 330210 - DNA, 15 bp, Homo sapiens
ttaaaattcctttct

SEQ ID NO: 330211 - DNA, 15 bp, Homo sapiens
taaaattcctttctt

SEQ ID NO: 330212 - DNA, 15 bp, Homo sapiens
aaaattcctttcttt

SEQ ID NO: 330213 - DNA, 15 bp, Homo sapiens
aaattcctttctttt

SEQ ID NO: 330214 - DNA, 15 bp, Homo sapiens
aattcctttcttttt

SEQ ID NO: 330215 - DNA, 15 bp, Homo sapiens
attcctttctttttg

SEQ ID NO: 330216 - DNA, 15 bp, Homo sapiens
ttcctttctttttga

SEQ ID NO: 330217 - DNA, 15 bp, Homo sapiens
tcctttctttttgaa

SEQ ID NO: 330218 - DNA, 15 bp, Homo sapiens
cctttctttttgaag

SEQ ID NO: 330219 - DNA, 15 bp, Homo sapiens
ctttctttttgaagt

SEQ ID NO: 330220 - DNA, 15 bp, Homo sapiens
tttctttttgaagta

SEQ ID NO: 330221 - DNA, 15 bp, Homo sapiens
ttctttttgaagtat

SEQ ID NO: 330222 - DNA, 15 bp, Homo sapiens
tctttttgaagtatt

SEQ ID NO: 330223 - DNA, 15 bp, Homo sapiens
ctttttgaagtattt

SEQ ID NO: 330224 - DNA, 15 bp, Homo sapiens
tttttgaagtatttg

SEQ ID NO: 330225 - DNA, 15 bp, Homo sapiens
ttttgaagtatttgg

SEQ ID NO: 330226 - DNA, 15 bp, Homo sapiens
tttgaagtatttggg

SEQ ID NO: 330227 - DNA, 15 bp, Homo sapiens
ttgaagtatttgggt

SEQ ID NO: 330228 - DNA, 15 bp, Homo sapiens
tgaagtatttgggtt

SEQ ID NO: 330229 - DNA, 15 bp, Homo sapiens
gaagtatttgggttg

SEQ ID NO: 330230 - DNA, 15 bp, Homo sapiens
aagtatttgggttgt

SEQ ID NO: 330231 - DNA, 15 bp, Homo sapiens
agtatttgggttgtt

SEQ ID NO: 330232 - DNA, 15 bp, Homo sapiens
gtatttgggttgttt

SEQ ID NO: 330233 - DNA, 15 bp, Homo sapiens
tatttgggttgtttt

SEQ ID NO: 330234 - DNA, 15 bp, Homo sapiens
atttgggttgttttt

SEQ ID NO: 330235 - DNA, 15 bp, Homo sapiens
tttgggttgttttta

SEQ ID NO: 330236 - DNA, 15 bp, Homo sapiens
ttgggttgtttttat

SEQ ID NO: 330237 - DNA, 15 bp, Homo sapiens
tgggttgtttttatc

SEQ ID NO: 330238 - DNA, 15 bp, Homo sapiens
gggttgtttttatca

SEQ ID NO: 330239 - DNA, 15 bp, Homo sapiens
ggttgtttttatcaa

SEQ ID NO: 330240 - DNA, 15 bp, Homo sapiens
gttgtttttatcaat

SEQ ID NO: 330241 - DNA, 15 bp, Homo sapiens
ttgtttttatcaatt

SEQ ID NO: 330242 - DNA, 15 bp, Homo sapiens
tgtttttatcaattt

SEQ ID NO: 330243 - DNA, 15 bp, Homo sapiens
gtttttatcaatttc

SEQ ID NO: 330244 - DNA, 15 bp, Homo sapiens
tttttatcaatttcg

SEQ ID NO: 330245 - DNA, 15 bp, Homo sapiens
ttttatcaatttcgt

SEQ ID NO: 330246 - DNA, 15 bp, Homo sapiens
tttatcaatttcgtt

SEQ ID NO: 330247 - DNA, 15 bp, Homo sapiens
ttatcaatttcgttc

SEQ ID NO: 330248 - DNA, 15 bp, Homo sapiens
tatcaatttcgttca

SEQ ID NO: 330249 - DNA, 15 bp, Homo sapiens
atcaatttcgttcac

SEQ ID NO: 330250 - DNA, 15 bp, Homo sapiens
tcaatttcgttcact

SEQ ID NO: 330251 - DNA, 15 bp, Homo sapiens
caatttcgttcactg

SEQ ID NO: 330252 - DNA, 15 bp, Homo sapiens
aatttcgttcactgt

SEQ ID NO: 330253 - DNA, 15 bp, Homo sapiens
atttcgttcactgtt

SEQ ID NO: 330254 - DNA, 15 bp, Homo sapiens
tttcgttcactgttg

SEQ ID NO: 330255 - DNA, 15 bp, Homo sapiens
ttcgttcactgttgc

SEQ ID NO: 330256 - DNA, 15 bp, Homo sapiens
tcgttcactgttgcc

SEQ ID NO: 330257 - DNA, 15 bp, Homo sapiens
cgttcactgttgcct

SEQ ID NO: 330258 - DNA, 15 bp, Homo sapiens
gttcactgttgcctt

SEQ ID NO: 330259 - DNA, 15 bp, Homo sapiens
ttcactgttgcctta

SEQ ID NO: 330260 - DNA, 15 bp, Homo sapiens
tcactgttgccttaa

SEQ ID NO: 330261 - DNA, 15 bp, Homo sapiens
cactgttgccttaaa

SEQ ID NO: 330262 - DNA, 15 bp, Homo sapiens
actgttgccttaaat

SEQ ID NO: 330263 - DNA, 15 bp, Homo sapiens
ctgttgccttaaatg

SEQ ID NO: 330264 - DNA, 15 bp, Homo sapiens
tgttgccttaaatga

SEQ ID NO: 330265 - DNA, 15 bp, Homo sapiens
gttgccttaaatgac

SEQ ID NO: 330266 - DNA, 15 bp, Homo sapiens
ttgccttaaatgaca

SEQ ID NO: 330267 - DNA, 15 bp, Homo sapiens
tgccttaaatgacaa

SEQ ID NO: 330268 - DNA, 15 bp, Homo sapiens
gccttaaatgacaat

SEQ ID NO: 330269 - DNA, 15 bp, Homo sapiens
ccttaaatgacaatt

SEQ ID NO: 330270 - DNA, 15 bp, Homo sapiens
cttaaatgacaattc

SEQ ID NO: 330271 - DNA, 15 bp, Homo sapiens
ttaaatgacaattct

SEQ ID NO: 330272 - DNA, 15 bp, Homo sapiens
taaatgacaattctt

SEQ ID NO: 330273 - DNA, 15 bp, Homo sapiens
aaatgacaattcttg

SEQ ID NO: 330274 - DNA, 15 bp, Homo sapiens
aatgacaattcttgc

SEQ ID NO: 330275 - DNA, 15 bp, Homo sapiens
atgacaattcttgcc

SEQ ID NO: 330276 - DNA, 15 bp, Homo sapiens
tgacaattcttgcct

SEQ ID NO: 330277 - DNA, 15 bp, Homo sapiens
gacaattcttgcctc

SEQ ID NO: 330278 - DNA, 15 bp, Homo sapiens
acaattcttgcctcc

SEQ ID NO: 330279 - DNA, 15 bp, Homo sapiens
caattcttgcctccc

SEQ ID NO: 330280 - DNA, 15 bp, Homo sapiens
aattcttgcctccct

SEQ ID NO: 330281 - DNA, 15 bp, Homo sapiens
attcttgcctccctg

SEQ ID NO: 330282 - DNA, 15 bp, Homo sapiens
ttcttgcctccctga

SEQ ID NO: 330283 - DNA, 15 bp, Homo sapiens
tcttgcctccctgaa

SEQ ID NO: 330284 - DNA, 15 bp, Homo sapiens
cttgcctccctgaag

SEQ ID NO: 330285 - DNA, 15 bp, Homo sapiens
ttgcctccctgaaga

SEQ ID NO: 330286 - DNA, 15 bp, Homo sapiens
tgcctccctgaagaa

SEQ ID NO: 330287 - DNA, 15 bp, Homo sapiens
gcctccctgaagaac

SEQ ID NO: 330288 - DNA, 15 bp, Homo sapiens
cctccctgaagaact

SEQ ID NO: 330289 - DNA, 15 bp, Homo sapiens
ctccctgaagaactc

SEQ ID NO: 330290 - DNA, 15 bp, Homo sapiens
tccctgaagaactct

SEQ ID NO: 330291 - DNA, 15 bp, Homo sapiens
ccctgaagaactctt

SEQ ID NO: 330292 - DNA, 15 bp, Homo sapiens
cctgaagaactcttg

SEQ ID NO: 330293 - DNA, 15 bp, Homo sapiens
ctgaagaactcttgg

SEQ ID NO: 330294 - DNA, 15 bp, Homo sapiens
tgaagaactcttggc

SEQ ID NO: 330295 - DNA, 15 bp, Homo sapiens
gaagaactcttggcc

SEQ ID NO: 330296 - DNA, 15 bp, Homo sapiens
aagaactcttggcct

SEQ ID NO: 330297 - DNA, 15 bp, Homo sapiens
agaactcttggcctt

SEQ ID NO: 330298 - DNA, 15 bp, Homo sapiens
gaactcttggccttc

SEQ ID NO: 330299 - DNA, 15 bp, Homo sapiens
aactcttggccttca

SEQ ID NO: 330300 - DNA, 15 bp, Homo sapiens
actcttggccttcat

SEQ ID NO: 330301 - DNA, 15 bp, Homo sapiens
ctcttggccttcatt

SEQ ID NO: 330302 - DNA, 15 bp, Homo sapiens
tcttggccttcattc

SEQ ID NO: 330303 - DNA, 15 bp, Homo sapiens
cttggccttcattcc

SEQ ID NO: 330304 - DNA, 15 bp, Homo sapiens
ttggccttcattcct

SEQ ID NO: 330305 - DNA, 15 bp, Homo sapiens
tggccttcattcctg

SEQ ID NO: 330306 - DNA, 15 bp, Homo sapiens
ggccttcattcctgc

SEQ ID NO: 330307 - DNA, 15 bp, Homo sapiens
gccttcattcctgcc

SEQ ID NO: 330308 - DNA, 15 bp, Homo sapiens
ccttcattcctgcca

SEQ ID NO: 330309 - DNA, 15 bp, Homo sapiens
cttcattcctgccac

SEQ ID NO: 330310 - DNA, 15 bp, Homo sapiens
ttcattcctgccact

SEQ ID NO: 330311 - DNA, 15 bp, Homo sapiens
tcattcctgccacta

SEQ ID NO: 330312 - DNA, 15 bp, Homo sapiens
cattcctgccactac

SEQ ID NO: 330313 - DNA, 15 bp, Homo sapiens
attcctgccactaca

SEQ ID NO: 330314 - DNA, 15 bp, Homo sapiens
ttcctgccactacag

SEQ ID NO: 330315 - DNA, 15 bp, Homo sapiens
tcctgccactacagt

SEQ ID NO: 330316 - DNA, 15 bp, Homo sapiens
cctgccactacagtg

SEQ ID NO: 330317 - DNA, 15 bp, Homo sapiens
ctgccactacagtga

SEQ ID NO: 330318 - DNA, 15 bp, Homo sapiens
tgccactacagtgag

SEQ ID NO: 330319 - DNA, 15 bp, Homo sapiens
gccactacagtgaga

SEQ ID NO: 330320 - DNA, 15 bp, Homo sapiens
ccactacagtgagaa

SEQ ID NO: 330321 - DNA, 15 bp, Homo sapiens
cactacagtgagaag

SEQ ID NO: 330322 - DNA, 15 bp, Homo sapiens
actacagtgagaagt

SEQ ID NO: 330323 - DNA, 15 bp, Homo sapiens
ctacagtgagaagtt

SEQ ID NO: 330324 - DNA, 15 bp, Homo sapiens
tacagtgagaagttc

SEQ ID NO: 330325 - DNA, 15 bp, Homo sapiens
acagtgagaagttct

SEQ ID NO: 330326 - DNA, 15 bp, Homo sapiens
cagtgagaagttcta

SEQ ID NO: 330327 - DNA, 15 bp, Homo sapiens
agtgagaagttctaa

SEQ ID NO: 330328 - DNA, 15 bp, Homo sapiens
gtgagaagttctaag

SEQ ID NO: 330329 - DNA, 15 bp, Homo sapiens
tgagaagttctaagc

SEQ ID NO: 330330 - DNA, 15 bp, Homo sapiens
gagaagttctaagct

SEQ ID NO: 330331 - DNA, 15 bp, Homo sapiens
agaagttctaagctg

SEQ ID NO: 330332 - DNA, 15 bp, Homo sapiens
gaagttctaagctgg

SEQ ID NO: 330333 - DNA, 15 bp, Homo sapiens
aagttctaagctgga

SEQ ID NO: 330334 - DNA, 15 bp, Homo sapiens
agttctaagctggaa

SEQ ID NO: 330335 - DNA, 15 bp, Homo sapiens
gttctaagctggaag

SEQ ID NO: 330336 - DNA, 15 bp, Homo sapiens
ttctaagctggaagg

SEQ ID NO: 330337 - DNA, 15 bp, Homo sapiens
tctaagctggaaggg

SEQ ID NO: 330338 - DNA, 15 bp, Homo sapiens
ctaagctggaagggc

SEQ ID NO: 330339 - DNA, 15 bp, Homo sapiens
taagctggaagggcc

SEQ ID NO: 330340 - DNA, 15 bp, Homo sapiens
aagctggaagggcca

SEQ ID NO: 330341 - DNA, 15 bp, Homo sapiens
agctggaagggccat

SEQ ID NO: 330342 - DNA, 15 bp, Homo sapiens
gctggaagggccatc

SEQ ID NO: 330343 - DNA, 15 bp, Homo sapiens
ctggaagggccatcc

SEQ ID NO: 330344 - DNA, 15 bp, Homo sapiens
tggaagggccatccc

SEQ ID NO: 330345 - DNA, 15 bp, Homo sapiens
ggaagggccatccca

SEQ ID NO: 330346 - DNA, 15 bp, Homo sapiens
aagggccatcccagg

SEQ ID NO: 330347 - DNA, 15 bp, Homo sapiens
agggccatcccaggg

SEQ ID NO: 330348 - DNA, 15 bp, Homo sapiens
gggccatcccaggga

SEQ ID NO: 330349 - DNA, 15 bp, Homo sapiens
ggccatcccagggat

SEQ ID NO: 330350 - DNA, 15 bp, Homo sapiens
gccatcccagggatg

SEQ ID NO: 330351 - DNA, 15 bp, Homo sapiens
ccatcccagggatga

SEQ ID NO: 330352 - DNA, 15 bp, Homo sapiens
catcccagggatgac

SEQ ID NO: 330353 - DNA, 15 bp, Homo sapiens
atcccagggatgact

SEQ ID NO: 330354 - DNA, 15 bp, Homo sapiens
tcccagggatgactg

SEQ ID NO: 330355 - DNA, 15 bp, Homo sapiens
cccagggatgactgc

SEQ ID NO: 330356 - DNA, 15 bp, Homo sapiens
ccagggatgactgct

SEQ ID NO: 330357 - DNA, 15 bp, Homo sapiens
cagggatgactgctt

SEQ ID NO: 330358 - DNA, 15 bp, Homo sapiens
agggatgactgcttt

SEQ ID NO: 330359 - DNA, 15 bp, Homo sapiens
gggatgactgcttta

SEQ ID NO: 330360 - DNA, 15 bp, Homo sapiens
ggatgactgctttaa

SEQ ID NO: 330361 - DNA, 15 bp, Homo sapiens
gatgactgctttaag

SEQ ID NO: 330362 - DNA, 15 bp, Homo sapiens
atgactgctttaagc

SEQ ID NO: 330363 - DNA, 15 bp, Homo sapiens
tgactgctttaagca

SEQ ID NO: 330364 - DNA, 15 bp, Homo sapiens
gactgctttaagcag

SEQ ID NO: 330365 - DNA, 15 bp, Homo sapiens
actgctttaagcagc

SEQ ID NO: 330366 - DNA, 15 bp, Homo sapiens
ctgctttaagcagcc

SEQ ID NO: 330367 - DNA, 15 bp, Homo sapiens
tgctttaagcagcca

SEQ ID NO: 330368 - DNA, 15 bp, Homo sapiens
gctttaagcagccag

SEQ ID NO: 330369 - DNA, 15 bp, Homo sapiens
ctttaagcagccagt

SEQ ID NO: 330370 - DNA, 15 bp, Homo sapiens
tttaagcagccagtc

SEQ ID NO: 330371 - DNA, 15 bp, Homo sapiens
ttaagcagccagtca

SEQ ID NO: 330372 - DNA, 15 bp, Homo sapiens
taagcagccagtcat

SEQ ID NO: 330373 - DNA, 15 bp, Homo sapiens
aagcagccagtcatg

SEQ ID NO: 330374 - DNA, 15 bp, Homo sapiens
agcagccagtcatgt

SEQ ID NO: 330375 - DNA, 15 bp, Homo sapiens
gcagccagtcatgta

SEQ ID NO: 330376 - DNA, 15 bp, Homo sapiens
cagccagtcatgtag

SEQ ID NO: 330377 - DNA, 15 bp, Homo sapiens
agccagtcatgtagg

SEQ ID NO: 330378 - DNA, 15 bp, Homo sapiens
gccagtcatgtaggg

SEQ ID NO: 330379 - DNA, 15 bp, Homo sapiens
ccagtcatgtagggt

SEQ ID NO: 330380 - DNA, 15 bp, Homo sapiens
cagtcatgtagggtt

SEQ ID NO: 330381 - DNA, 15 bp, Homo sapiens
agtcatgtagggttg

SEQ ID NO: 330382 - DNA, 15 bp, Homo sapiens
gtcatgtagggttgc

SEQ ID NO: 330383 - DNA, 15 bp, Homo sapiens
tcatgtagggttgcg

SEQ ID NO: 330384 - DNA, 15 bp, Homo sapiens
catgtagggttgcgc

SEQ ID NO: 330385 - DNA, 15 bp, Homo sapiens
atgtagggttgcgcc

SEQ ID NO: 330386 - DNA, 15 bp, Homo sapiens
tgtagggttgcgcct

SEQ ID NO: 330387 - DNA, 15 bp, Homo sapiens
gtagggttgcgcctg

SEQ ID NO: 330388 - DNA, 15 bp, Homo sapiens
tagggttgcgcctgt

SEQ ID NO: 330389 - DNA, 15 bp, Homo sapiens
agggttgcgcctgtg

SEQ ID NO: 330390 - DNA, 15 bp, Homo sapiens
gggttgcgcctgtgg

SEQ ID NO: 330391 - DNA, 15 bp, Homo sapiens
ggttgcgcctgtggc

SEQ ID NO: 330392 - DNA, 15 bp, Homo sapiens
gttgcgcctgtggcc

SEQ ID NO: 330393 - DNA, 15 bp, Homo sapiens
ttgcgcctgtggccc

SEQ ID NO: 330394 - DNA, 15 bp, Homo sapiens
tgcgcctgtggccct

SEQ ID NO: 330395 - DNA, 15 bp, Homo sapiens
gcgcctgtggccctg

SEQ ID NO: 330396 - DNA, 15 bp, Homo sapiens
cgcctgtggccctgg

SEQ ID NO: 330397 - DNA, 15 bp, Homo sapiens
gcctgtggccctggc

SEQ ID NO: 330398 - DNA, 15 bp, Homo sapiens
cctgtggccctggca

SEQ ID NO: 330399 - DNA, 15 bp, Homo sapiens
ctgtggccctggcag

SEQ ID NO: 330400 - DNA, 15 bp, Homo sapiens
tgtggccctggcaga

SEQ ID NO: 330401 - DNA, 15 bp, Homo sapiens
gtggccctggcagat

SEQ ID NO: 330402 - DNA, 15 bp, Homo sapiens
tggccctggcagatt

SEQ ID NO: 330403 - DNA, 15 bp, Homo sapiens
ggccctggcagattg

SEQ ID NO: 330404 - DNA, 15 bp, Homo sapiens
gccctggcagattgg

SEQ ID NO: 330405 - DNA, 15 bp, Homo sapiens
ccctggcagattgga

SEQ ID NO: 330406 - DNA, 15 bp, Homo sapiens
cctggcagattggac

SEQ ID NO: 330407 - DNA, 15 bp, Homo sapiens
ctggcagattggacc

SEQ ID NO: 330408 - DNA, 15 bp, Homo sapiens
tggcagattggaccc

SEQ ID NO: 330409 - DNA, 15 bp, Homo sapiens
ggcagattggaccct

SEQ ID NO: 330410 - DNA, 15 bp, Homo sapiens
gcagattggaccctg

SEQ ID NO: 330411 - DNA, 15 bp, Homo sapiens
cagattggaccctgt

SEQ ID NO: 330412 - DNA, 15 bp, Homo sapiens
agattggaccctgtt

SEQ ID NO: 330413 - DNA, 15 bp, Homo sapiens
gattggaccctgttt

SEQ ID NO: 330414 - DNA, 15 bp, Homo sapiens
attggaccctgtttc

SEQ ID NO: 330415 - DNA, 15 bp, Homo sapiens
ttggaccctgtttct

SEQ ID NO: 330416 - DNA, 15 bp, Homo sapiens
tggaccctgtttcta

SEQ ID NO: 330417 - DNA, 15 bp, Homo sapiens
ggaccctgtttctac

SEQ ID NO: 330418 - DNA, 15 bp, Homo sapiens
gaccctgtttctacc

SEQ ID NO: 330419 - DNA, 15 bp, Homo sapiens
accctgtttctacca

SEQ ID NO: 330420 - DNA, 15 bp, Homo sapiens
ccctgtttctaccaa

SEQ ID NO: 330421 - DNA, 15 bp, Homo sapiens
cctgtttctaccaag

SEQ ID NO: 330422 - DNA, 15 bp, Homo sapiens
ctgtttctaccaagt

SEQ ID NO: 330423 - DNA, 15 bp, Homo sapiens
tgtttctaccaagtg

SEQ ID NO: 330424 - DNA, 15 bp, Homo sapiens
gtttctaccaagtgg

SEQ ID NO: 330425 - DNA, 15 bp, Homo sapiens
tttctaccaagtggt

SEQ ID NO: 330426 - DNA, 15 bp, Homo sapiens
ttctaccaagtggtg

SEQ ID NO: 330427 - DNA, 15 bp, Homo sapiens
tctaccaagtggtgg

SEQ ID NO: 330428 - DNA, 15 bp, Homo sapiens
ctaccaagtggtggc

SEQ ID NO: 330429 - DNA, 15 bp, Homo sapiens
taccaagtggtggca

SEQ ID NO: 330430 - DNA, 15 bp, Homo sapiens
accaagtggtggcat

SEQ ID NO: 330431 - DNA, 15 bp, Homo sapiens
ccaagtggtggcatc

SEQ ID NO: 330432 - DNA, 15 bp, Homo sapiens
caagtggtggcatca

SEQ ID NO: 330433 - DNA, 15 bp, Homo sapiens
aagtggtggcatcac

SEQ ID NO: 330434 - DNA, 15 bp, Homo sapiens
agtggtggcatcact

SEQ ID NO: 330435 - DNA, 15 bp, Homo sapiens
gtggtggcatcactt

SEQ ID NO: 330436 - DNA, 15 bp, Homo sapiens
tggtggcatcacttg

SEQ ID NO: 330437 - DNA, 15 bp, Homo sapiens
ggtggcatcacttgg

SEQ ID NO: 330438 - DNA, 15 bp, Homo sapiens
gtggcatcacttggc

SEQ ID NO: 330439 - DNA, 15 bp, Homo sapiens
tggcatcacttggct

SEQ ID NO: 330440 - DNA, 15 bp, Homo sapiens
ggcatcacttggctt

SEQ ID NO: 330441 - DNA, 15 bp, Homo sapiens
gcatcacttggcttc

SEQ ID NO: 330442 - DNA, 15 bp, Homo sapiens
catcacttggcttcc

SEQ ID NO: 330443 - DNA, 15 bp, Homo sapiens
atcacttggcttcca

SEQ ID NO: 330444 - DNA, 15 bp, Homo sapiens
tcacttggcttccat

SEQ ID NO: 330445 - DNA, 15 bp, Homo sapiens
cacttggcttccatg

SEQ ID NO: 330446 - DNA, 15 bp, Homo sapiens
acttggcttccatgt

SEQ ID NO: 330447 - DNA, 15 bp, Homo sapiens
cttggcttccatgta

SEQ ID NO: 330448 - DNA, 15 bp, Homo sapiens
ttggcttccatgtag

SEQ ID NO: 330449 - DNA, 15 bp, Homo sapiens
tggcttccatgtagt

SEQ ID NO: 330450 - DNA, 15 bp, Homo sapiens
ggcttccatgtagtg

SEQ ID NO: 330451 - DNA, 15 bp, Homo sapiens
gcttccatgtagtgt

SEQ ID NO: 330452 - DNA, 15 bp, Homo sapiens
cttccatgtagtgtt

SEQ ID NO: 330453 - DNA, 15 bp, Homo sapiens
ttccatgtagtgttt

SEQ ID NO: 330454 - DNA, 15 bp, Homo sapiens
tccatgtagtgtttt

SEQ ID NO: 330455 - DNA, 15 bp, Homo sapiens
ccatgtagtgttttt

SEQ ID NO: 330456 - DNA, 15 bp, Homo sapiens
catgtagtgtttttc

SEQ ID NO: 330457 - DNA, 15 bp, Homo sapiens
atgtagtgtttttct

SEQ ID NO: 330458 - DNA, 15 bp, Homo sapiens
tgtagtgtttttctg

SEQ ID NO: 330459 - DNA, 15 bp, Homo sapiens
gtagtgtttttctgt

SEQ ID NO: 330460 - DNA, 15 bp, Homo sapiens
tagtgtttttctgtt

SEQ ID NO: 330461 - DNA, 15 bp, Homo sapiens
agtgtttttctgttc

SEQ ID NO: 330462 - DNA, 15 bp, Homo sapiens
gtgtttttctgttct

SEQ ID NO: 330463 - DNA, 15 bp, Homo sapiens
tgtttttctgttctc

SEQ ID NO: 330464 - DNA, 15 bp, Homo sapiens
gtttttctgttctcc

SEQ ID NO: 330465 - DNA, 15 bp, Homo sapiens
tttttctgttctcct

SEQ ID NO: 330466 - DNA, 15 bp, Homo sapiens
ttttctgttctcctg

SEQ ID NO: 330467 - DNA, 15 bp, Homo sapiens
tttctgttctcctgc

SEQ ID NO: 330468 - DNA, 15 bp, Homo sapiens
ttctgttctcctgca

SEQ ID NO: 330469 - DNA, 15 bp, Homo sapiens
tctgttctcctgcag

SEQ ID NO: 330470 - DNA, 15 bp, Homo sapiens
ctgttctcctgcaga

SEQ ID NO: 330471 - DNA, 15 bp, Homo sapiens
tgttctcctgcagat

SEQ ID NO: 330472 - DNA, 15 bp, Homo sapiens
gttctcctgcagatc

SEQ ID NO: 330473 - DNA, 15 bp, Homo sapiens
ttctcctgcagatcg

SEQ ID NO: 330474 - DNA, 15 bp, Homo sapiens
tctcctgcagatcgc

SEQ ID NO: 330475 - DNA, 15 bp, Homo sapiens
ctcctgcagatcgct

SEQ ID NO: 330476 - DNA, 15 bp, Homo sapiens
tcctgcagatcgctg

SEQ ID NO: 330477 - DNA, 15 bp, Homo sapiens
cctgcagatcgctgt

SEQ ID NO: 330478 - DNA, 15 bp, Homo sapiens
ctgcagatcgctgtc

SEQ ID NO: 330479 - DNA, 15 bp, Homo sapiens
tgcagatcgctgtca

SEQ ID NO: 330480 - DNA, 15 bp, Homo sapiens
gcagatcgctgtcag

SEQ ID NO: 330481 - DNA, 15 bp, Homo sapiens
cagatcgctgtcagc

SEQ ID NO: 330482 - DNA, 15 bp, Homo sapiens
agatcgctgtcagcc

SEQ ID NO: 330483 - DNA, 15 bp, Homo sapiens
gatcgctgtcagcca

SEQ ID NO: 330484 - DNA, 15 bp, Homo sapiens
atcgctgtcagccac

SEQ ID NO: 330485 - DNA, 15 bp, Homo sapiens
tcgctgtcagccact

SEQ ID NO: 330486 - DNA, 15 bp, Homo sapiens
cgctgtcagccactg

SEQ ID NO: 330487 - DNA, 15 bp, Homo sapiens
gctgtcagccactgg

SEQ ID NO: 330488 - DNA, 15 bp, Homo sapiens
ctgtcagccactgga

SEQ ID NO: 330489 - DNA, 15 bp, Homo sapiens
tgtcagccactggag

SEQ ID NO: 330490 - DNA, 15 bp, Homo sapiens
gtcagccactggagg

SEQ ID NO: 330491 - DNA, 15 bp, Homo sapiens
tcagccactggaggc

SEQ ID NO: 330492 - DNA, 15 bp, Homo sapiens
cagccactggaggcc

SEQ ID NO: 330493 - DNA, 15 bp, Homo sapiens
agccactggaggcct

SEQ ID NO: 330494 - DNA, 15 bp, Homo sapiens
gccactggaggcctc

SEQ ID NO: 330495 - DNA, 15 bp, Homo sapiens
ccactggaggcctca

SEQ ID NO: 330496 - DNA, 15 bp, Homo sapiens
cactggaggcctcac

SEQ ID NO: 330497 - DNA, 15 bp, Homo sapiens
actggaggcctcacc

SEQ ID NO: 330498 - DNA, 15 bp, Homo sapiens
ctggaggcctcaccc

SEQ ID NO: 330499 - DNA, 15 bp, Homo sapiens
tggaggcctcaccca

SEQ ID NO: 330500 - DNA, 15 bp, Homo sapiens
ggaggcctcacccac

SEQ ID NO: 330501 - DNA, 15 bp, Homo sapiens
gaggcctcacccact

SEQ ID NO: 330502 - DNA, 15 bp, Homo sapiens
aggcctcacccactg

SEQ ID NO: 330503 - DNA, 15 bp, Homo sapiens
ggcctcacccactgg

SEQ ID NO: 330504 - DNA, 15 bp, Homo sapiens
gcctcacccactggg

SEQ ID NO: 330505 - DNA, 15 bp, Homo sapiens
cctcacccactgggt

SEQ ID NO: 330506 - DNA, 15 bp, Homo sapiens
ctcacccactgggtt

SEQ ID NO: 330507 - DNA, 15 bp, Homo sapiens
tcacccactgggttc

SEQ ID NO: 330508 - DNA, 15 bp, Homo sapiens
cacccactgggttcc

SEQ ID NO: 330509 - DNA, 15 bp, Homo sapiens
acccactgggttcca

SEQ ID NO: 330510 - DNA, 15 bp, Homo sapiens
cccactgggttccag

SEQ ID NO: 330511 - DNA, 15 bp, Homo sapiens
ccactgggttccaga

SEQ ID NO: 330512 - DNA, 15 bp, Homo sapiens
cactgggttccagac

SEQ ID NO: 330513 - DNA, 15 bp, Homo sapiens
actgggttccagaca

SEQ ID NO: 330514 - DNA, 15 bp, Homo sapiens
ctgggttccagacag

SEQ ID NO: 330515 - DNA, 15 bp, Homo sapiens
tgggttccagacagc

SEQ ID NO: 330516 - DNA, 15 bp, Homo sapiens
gggttccagacagct

SEQ ID NO: 330517 - DNA, 15 bp, Homo sapiens
ggttccagacagctg

SEQ ID NO: 330518 - DNA, 15 bp, Homo sapiens
gttccagacagctgc

SEQ ID NO: 330519 - DNA, 15 bp, Homo sapiens
ttccagacagctgcc

SEQ ID NO: 330520 - DNA, 15 bp, Homo sapiens
tccagacagctgcca

SEQ ID NO: 330521 - DNA, 15 bp, Homo sapiens
ccagacagctgccac

SEQ ID NO: 330522 - DNA, 15 bp, Homo sapiens
cagacagctgccact

SEQ ID NO: 330523 - DNA, 15 bp, Homo sapiens
agacagctgccactt

SEQ ID NO: 330524 - DNA, 15 bp, Homo sapiens
gacagctgccacttc

SEQ ID NO: 330525 - DNA, 15 bp, Homo sapiens
acagctgccacttct

SEQ ID NO: 330526 - DNA, 15 bp, Homo sapiens
cagctgccacttctg

SEQ ID NO: 330527 - DNA, 15 bp, Homo sapiens
agctgccacttctgt

SEQ ID NO: 330528 - DNA, 15 bp, Homo sapiens
gctgccacttctgtt

SEQ ID NO: 330529 - DNA, 15 bp, Homo sapiens
ctgccacttctgttt

SEQ ID NO: 330530 - DNA, 15 bp, Homo sapiens
tgccacttctgttta

SEQ ID NO: 330531 - DNA, 15 bp, Homo sapiens
gccacttctgtttag

SEQ ID NO: 330532 - DNA, 15 bp, Homo sapiens
ccacttctgtttaga

SEQ ID NO: 330533 - DNA, 15 bp, Homo sapiens
cacttctgtttagaa

SEQ ID NO: 330534 - DNA, 15 bp, Homo sapiens
acttctgtttagaag

SEQ ID NO: 330535 - DNA, 15 bp, Homo sapiens
cttctgtttagaagc

SEQ ID NO: 330536 - DNA, 15 bp, Homo sapiens
ttctgtttagaagca

SEQ ID NO: 330537 - DNA, 15 bp, Homo sapiens
tctgtttagaagcaa

SEQ ID NO: 330538 - DNA, 15 bp, Homo sapiens
ctgtttagaagcaac

SEQ ID NO: 330539 - DNA, 15 bp, Homo sapiens
tgtttagaagcaaca

SEQ ID NO: 330540 - DNA, 15 bp, Homo sapiens
gtttagaagcaacac

SEQ ID NO: 330541 - DNA, 15 bp, Homo sapiens
tttagaagcaacact

SEQ ID NO: 330542 - DNA, 15 bp, Homo sapiens
ttagaagcaacactg

SEQ ID NO: 330543 - DNA, 15 bp, Homo sapiens
tagaagcaacactgc

SEQ ID NO: 330544 - DNA, 15 bp, Homo sapiens
agaagcaacactgcc

SEQ ID NO: 330545 - DNA, 15 bp, Homo sapiens
gaagcaacactgcca

SEQ ID NO: 330546 - DNA, 15 bp, Homo sapiens
aagcaacactgccag

SEQ ID NO: 330547 - DNA, 15 bp, Homo sapiens
agcaacactgccagt

SEQ ID NO: 330548 - DNA, 15 bp, Homo sapiens
gcaacactgccagtg

SEQ ID NO: 330549 - DNA, 15 bp, Homo sapiens
caacactgccagtga

SEQ ID NO: 330550 - DNA, 15 bp, Homo sapiens
aacactgccagtgag

SEQ ID NO: 330551 - DNA, 15 bp, Homo sapiens
acactgccagtgaga

SEQ ID NO: 330552 - DNA, 15 bp, Homo sapiens
cactgccagtgagaa

SEQ ID NO: 330553 - DNA, 15 bp, Homo sapiens
actgccagtgagaaa

SEQ ID NO: 330554 - DNA, 15 bp, Homo sapiens
ctgccagtgagaaac

SEQ ID NO: 330555 - DNA, 15 bp, Homo sapiens
tgccagtgagaaacc

SEQ ID NO: 330556 - DNA, 15 bp, Homo sapiens
gccagtgagaaaccc

SEQ ID NO: 330557 - DNA, 15 bp, Homo sapiens
ccagtgagaaaccct

SEQ ID NO: 330558 - DNA, 15 bp, Homo sapiens
cagtgagaaaccctg

SEQ ID NO: 330559 - DNA, 15 bp, Homo sapiens
agtgagaaaccctgc

SEQ ID NO: 330560 - DNA, 15 bp, Homo sapiens
gtgagaaaccctgcc

SEQ ID NO: 330561 - DNA, 15 bp, Homo sapiens
tgagaaaccctgcca

SEQ ID NO: 330562 - DNA, 15 bp, Homo sapiens
gagaaaccctgccac

SEQ ID NO: 330563 - DNA, 15 bp, Homo sapiens
agaaaccctgccaca

SEQ ID NO: 330564 - DNA, 15 bp, Homo sapiens
gaaaccctgccacac

SEQ ID NO: 330565 - DNA, 15 bp, Homo sapiens
aaaccctgccacaca

SEQ ID NO: 330566 - DNA, 15 bp, Homo sapiens
aaccctgccacacac

SEQ ID NO: 330567 - DNA, 15 bp, Homo sapiens
accctgccacacaca

SEQ ID NO: 330568 - DNA, 15 bp, Homo sapiens
ccctgccacacacaa

SEQ ID NO: 330569 - DNA, 15 bp, Homo sapiens
cctgccacacacaac

SEQ ID NO: 330570 - DNA, 15 bp, Homo sapiens
ctgccacacacaaca

SEQ ID NO: 330571 - DNA, 15 bp, Homo sapiens
tgccacacacaacac

SEQ ID NO: 330572 - DNA, 15 bp, Homo sapiens
gccacacacaacaca

SEQ ID NO: 330573 - DNA, 15 bp, Homo sapiens
ccacacacaacacac

SEQ ID NO: 330574 - DNA, 15 bp, Homo sapiens
cacacacaacacaca

SEQ ID NO: 330575 - DNA, 15 bp, Homo sapiens
acacacaacacacac

SEQ ID NO: 330576 - DNA, 15 bp, Homo sapiens
cacacaacacacaca

SEQ ID NO: 330577 - DNA, 15 bp, Homo sapiens
acacaacacacacag

SEQ ID NO: 330578 - DNA, 15 bp, Homo sapiens
cacaacacacacaga

SEQ ID NO: 330579 - DNA, 15 bp, Homo sapiens
acaacacacacagac

SEQ ID NO: 330580 - DNA, 15 bp, Homo sapiens
caacacacacagaca

SEQ ID NO: 330581 - DNA, 15 bp, Homo sapiens
aacacacacagacac

SEQ ID NO: 330582 - DNA, 15 bp, Homo sapiens
acacacacagacaca

SEQ ID NO: 330583 - DNA, 15 bp, Homo sapiens
cacacacagacacac

SEQ ID NO: 330584 - DNA, 15 bp, Homo sapiens
acacacagacacaca

SEQ ID NO: 330585 - DNA, 15 bp, Homo sapiens
cacacagacacacac

SEQ ID NO: 330586 - DNA, 15 bp, Homo sapiens
acacagacacacaca

SEQ ID NO: 330587 - DNA, 15 bp, Homo sapiens
gacacacacacacag

SEQ ID NO: 330588 - DNA, 15 bp, Homo sapiens
acacacacacacaga

SEQ ID NO: 330589 - DNA, 15 bp, Homo sapiens
cacacacacacagac

SEQ ID NO: 330590 - DNA, 15 bp, Homo sapiens
acacacacacagact

SEQ ID NO: 330591 - DNA, 15 bp, Homo sapiens
cacacacacagactc

SEQ ID NO: 330592 - DNA, 15 bp, Homo sapiens
acacacacagactca

SEQ ID NO: 330593 - DNA, 15 bp, Homo sapiens
cacacacagactcac

SEQ ID NO: 330594 - DNA, 15 bp, Homo sapiens
acacacagactcaca

SEQ ID NO: 330595 - DNA, 15 bp, Homo sapiens
cacacagactcacac

SEQ ID NO: 330596 - DNA, 15 bp, Homo sapiens
acacagactcacaca

SEQ ID NO: 330597 - DNA, 15 bp, Homo sapiens
cacagactcacacac

SEQ ID NO: 330598 - DNA, 15 bp, Homo sapiens
acagactcacacaca

SEQ ID NO: 330599 - DNA, 15 bp, Homo sapiens
cagactcacacacag

SEQ ID NO: 330600 - DNA, 15 bp, Homo sapiens
agactcacacacaga

SEQ ID NO: 330601 - DNA, 15 bp, Homo sapiens
gactcacacacagag

SEQ ID NO: 330602 - DNA, 15 bp, Homo sapiens
actcacacacagaga

SEQ ID NO: 330603 - DNA, 15 bp, Homo sapiens
ctcacacacagagac

SEQ ID NO: 330604 - DNA, 15 bp, Homo sapiens
tcacacacagagaca

SEQ ID NO: 330605 - DNA, 15 bp, Homo sapiens
cacacacagagacac

SEQ ID NO: 330606 - DNA, 15 bp, Homo sapiens
acacacagagacaca

SEQ ID NO: 330607 - DNA, 15 bp, Homo sapiens
cacacagagacacac

SEQ ID NO: 330608 - DNA, 15 bp, Homo sapiens
acacagagacacaca

SEQ ID NO: 330609 - DNA, 15 bp, Homo sapiens
cacagagacacacac

SEQ ID NO: 330610 - DNA, 15 bp, Homo sapiens
acagagacacacaca

SEQ ID NO: 330611 - DNA, 15 bp, Homo sapiens
cagagacacacacac

SEQ ID NO: 330612 - DNA, 15 bp, Homo sapiens
agagacacacacaca

SEQ ID NO: 330613 - DNA, 15 bp, Homo sapiens
gagacacacacacac

SEQ ID NO: 330614 - DNA, 15 bp, Homo sapiens
acacacacacagaca

SEQ ID NO: 330615 - DNA, 15 bp, Homo sapiens
cacacacacagacac

SEQ ID NO: 330616 - DNA, 15 bp, Homo sapiens
cacacacacacacca

SEQ ID NO: 330617 - DNA, 15 bp, Homo sapiens
acacacacacaccac

SEQ ID NO: 330618 - DNA, 15 bp, Homo sapiens
cacacacacaccaca

SEQ ID NO: 330619 - DNA, 15 bp, Homo sapiens
acacacacaccacac

SEQ ID NO: 330620 - DNA, 15 bp, Homo sapiens
cacacacaccacaca

SEQ ID NO: 330621 - DNA, 15 bp, Homo sapiens
acacacaccacacac

SEQ ID NO: 330622 - DNA, 15 bp, Homo sapiens
cacacaccacacaca

SEQ ID NO: 330623 - DNA, 15 bp, Homo sapiens
acacaccacacacac

SEQ ID NO: 330624 - DNA, 15 bp, Homo sapiens
cacaccacacacaca

SEQ ID NO: 330625 - DNA, 15 bp, Homo sapiens
acaccacacacacac

SEQ ID NO: 330626 - DNA, 15 bp, Homo sapiens
caccacacacacaca

SEQ ID NO: 330627 - DNA, 15 bp, Homo sapiens
accacacacacacac

SEQ ID NO: 330628 - DNA, 15 bp, Homo sapiens
ccacacacacacaca

SEQ ID NO: 330629 - DNA, 15 bp, Homo sapiens
acacacacacacatg

SEQ ID NO: 330630 - DNA, 15 bp, Homo sapiens
cacacacacacatgt

SEQ ID NO: 330631 - DNA, 15 bp, Homo sapiens
acacacacacatgtg

SEQ ID NO: 330632 - DNA, 15 bp, Homo sapiens
cacacacacatgtga

SEQ ID NO: 330633 - DNA, 15 bp, Homo sapiens
acacacacatgtgag

SEQ ID NO: 330634 - DNA, 15 bp, Homo sapiens
cacacacatgtgaga

SEQ ID NO: 330635 - DNA, 15 bp, Homo sapiens
acacacatgtgagag

SEQ ID NO: 330636 - DNA, 15 bp, Homo sapiens
cacacatgtgagagg

SEQ ID NO: 330637 - DNA, 15 bp, Homo sapiens
acacatgtgagagga

SEQ ID NO: 330638 - DNA, 15 bp, Homo sapiens
cacatgtgagaggag

SEQ ID NO: 330639 - DNA, 15 bp, Homo sapiens
acatgtgagaggagg

SEQ ID NO: 330640 - DNA, 15 bp, Homo sapiens
catgtgagaggaggg

SEQ ID NO: 330641 - DNA, 15 bp, Homo sapiens
atgtgagaggagggc

SEQ ID NO: 330642 - DNA, 15 bp, Homo sapiens
tgtgagaggagggcc

SEQ ID NO: 330643 - DNA, 15 bp, Homo sapiens
gtgagaggagggcca

SEQ ID NO: 330644 - DNA, 15 bp, Homo sapiens
tgagaggagggccac

SEQ ID NO: 330645 - DNA, 15 bp, Homo sapiens
gagaggagggccacc

SEQ ID NO: 330646 - DNA, 15 bp, Homo sapiens
agaggagggccaccc

SEQ ID NO: 330647 - DNA, 15 bp, Homo sapiens
gaggagggccaccct

SEQ ID NO: 330648 - DNA, 15 bp, Homo sapiens
aggagggccaccctg

SEQ ID NO: 330649 - DNA, 15 bp, Homo sapiens
ggagggccaccctgg

SEQ ID NO: 330650 - DNA, 15 bp, Homo sapiens
gagggccaccctggg

SEQ ID NO: 330651 - DNA, 15 bp, Homo sapiens
agggccaccctggga

SEQ ID NO: 330652 - DNA, 15 bp, Homo sapiens
gggccaccctgggag

SEQ ID NO: 330653 - DNA, 15 bp, Homo sapiens
ggccaccctgggagg

SEQ ID NO: 330654 - DNA, 15 bp, Homo sapiens
gccaccctgggagga

SEQ ID NO: 330655 - DNA, 15 bp, Homo sapiens
ccaccctgggaggaa

SEQ ID NO: 330656 - DNA, 15 bp, Homo sapiens
caccctgggaggaaa

SEQ ID NO: 330657 - DNA, 15 bp, Homo sapiens
accctgggaggaaac

SEQ ID NO: 330658 - DNA, 15 bp, Homo sapiens
ccctgggaggaaacc

SEQ ID NO: 330659 - DNA, 15 bp, Homo sapiens
cctgggaggaaaccc

SEQ ID NO: 330660 - DNA, 15 bp, Homo sapiens
ctgggaggaaaccct

SEQ ID NO: 330661 - DNA, 15 bp, Homo sapiens
tgggaggaaaccctg

SEQ ID NO: 330662 - DNA, 15 bp, Homo sapiens
gggaggaaaccctga

SEQ ID NO: 330663 - DNA, 15 bp, Homo sapiens
ggaggaaaccctgaa

SEQ ID NO: 330664 - DNA, 15 bp, Homo sapiens
gaggaaaccctgaat

SEQ ID NO: 330665 - DNA, 15 bp, Homo sapiens
aggaaaccctgaatt

SEQ ID NO: 330666 - DNA, 15 bp, Homo sapiens
ggaaaccctgaattc

SEQ ID NO: 330667 - DNA, 15 bp, Homo sapiens
gaaaccctgaattct

SEQ ID NO: 330668 - DNA, 15 bp, Homo sapiens
aaaccctgaattctc

SEQ ID NO: 330669 - DNA, 15 bp, Homo sapiens
aaccctgaattctcc

SEQ ID NO: 330670 - DNA, 15 bp, Homo sapiens
accctgaattctccc

SEQ ID NO: 330671 - DNA, 15 bp, Homo sapiens
ccctgaattctcccc

SEQ ID NO: 330672 - DNA, 15 bp, Homo sapiens
cctgaattctcccct

SEQ ID NO: 330673 - DNA, 15 bp, Homo sapiens
ctgaattctcccctc

SEQ ID NO: 330674 - DNA, 15 bp, Homo sapiens
tgaattctcccctct

SEQ ID NO: 330675 - DNA, 15 bp, Homo sapiens
gaattctcccctctt

SEQ ID NO: 330676 - DNA, 15 bp, Homo sapiens
aattctcccctctta

SEQ ID NO: 330677 - DNA, 15 bp, Homo sapiens
attctcccctcttag

SEQ ID NO: 330678 - DNA, 15 bp, Homo sapiens
ttctcccctcttagc

SEQ ID NO: 330679 - DNA, 15 bp, Homo sapiens
tctcccctcttagca

SEQ ID NO: 330680 - DNA, 15 bp, Homo sapiens
ctcccctcttagcac

SEQ ID NO: 330681 - DNA, 15 bp, Homo sapiens
tcccctcttagcaca

SEQ ID NO: 330682 - DNA, 15 bp, Homo sapiens
cccctcttagcacac

SEQ ID NO: 330683 - DNA, 15 bp, Homo sapiens
ccctcttagcacact

SEQ ID NO: 330684 - DNA, 15 bp, Homo sapiens
cctcttagcacactc

SEQ ID NO: 330685 - DNA, 15 bp, Homo sapiens
ctcttagcacactcc

SEQ ID NO: 330686 - DNA, 15 bp, Homo sapiens
tcttagcacactcct

SEQ ID NO: 330687 - DNA, 15 bp, Homo sapiens
cttagcacactcctt

SEQ ID NO: 330688 - DNA, 15 bp, Homo sapiens
ttagcacactccttc

SEQ ID NO: 330689 - DNA, 15 bp, Homo sapiens
tagcacactccttct

SEQ ID NO: 330690 - DNA, 15 bp, Homo sapiens
agcacactccttcta

SEQ ID NO: 330691 - DNA, 15 bp, Homo sapiens
gcacactccttctat

SEQ ID NO: 330692 - DNA, 15 bp, Homo sapiens
cacactccttctatc

SEQ ID NO: 330693 - DNA, 15 bp, Homo sapiens
acactccttctatct

SEQ ID NO: 330694 - DNA, 15 bp, Homo sapiens
cactccttctatcta

SEQ ID NO: 330695 - DNA, 15 bp, Homo sapiens
actccttctatctac

SEQ ID NO: 330696 - DNA, 15 bp, Homo sapiens
ctccttctatctact

SEQ ID NO: 330697 - DNA, 15 bp, Homo sapiens
tccttctatctactc

SEQ ID NO: 330698 - DNA, 15 bp, Homo sapiens
ccttctatctactcc

SEQ ID NO: 330699 - DNA, 15 bp, Homo sapiens
cttctatctactcct

SEQ ID NO: 330700 - DNA, 15 bp, Homo sapiens
ttctatctactcctt

SEQ ID NO: 330701 - DNA, 15 bp, Homo sapiens
tctatctactccttc

SEQ ID NO: 330702 - DNA, 15 bp, Homo sapiens
ctatctactccttct

SEQ ID NO: 330703 - DNA, 15 bp, Homo sapiens
tatctactccttcta

SEQ ID NO: 330704 - DNA, 15 bp, Homo sapiens
atctactccttctat

SEQ ID NO: 330705 - DNA, 15 bp, Homo sapiens
tctactccttctatc

SEQ ID NO: 330706 - DNA, 15 bp, Homo sapiens
ctactccttctatct

SEQ ID NO: 330707 - DNA, 15 bp, Homo sapiens
tactccttctatctc

SEQ ID NO: 330708 - DNA, 15 bp, Homo sapiens
actccttctatctcc

SEQ ID NO: 330709 - DNA, 15 bp, Homo sapiens
ctccttctatctcct

SEQ ID NO: 330710 - DNA, 15 bp, Homo sapiens
tccttctatctcctg

SEQ ID NO: 330711 - DNA, 15 bp, Homo sapiens
ccttctatctcctgg

SEQ ID NO: 330712 - DNA, 15 bp, Homo sapiens
cttctatctcctggt

SEQ ID NO: 330713 - DNA, 15 bp, Homo sapiens
ttctatctcctggta

SEQ ID NO: 330714 - DNA, 15 bp, Homo sapiens
tctatctcctggtag

SEQ ID NO: 330715 - DNA, 15 bp, Homo sapiens
ctatctcctggtaga

SEQ ID NO: 330716 - DNA, 15 bp, Homo sapiens
tatctcctggtagag

SEQ ID NO: 330717 - DNA, 15 bp, Homo sapiens
atctcctggtagagg

SEQ ID NO: 330718 - DNA, 15 bp, Homo sapiens
tctcctggtagaggg

SEQ ID NO: 330719 - DNA, 15 bp, Homo sapiens
ctcctggtagaggga

SEQ ID NO: 330720 - DNA, 15 bp, Homo sapiens
tcctggtagagggag

SEQ ID NO: 330721 - DNA, 15 bp, Homo sapiens
cctggtagagggaga

SEQ ID NO: 330722 - DNA, 15 bp, Homo sapiens
ctggtagagggagaa

SEQ ID NO: 330723 - DNA, 15 bp, Homo sapiens
tggtagagggagaag

SEQ ID NO: 330724 - DNA, 15 bp, Homo sapiens
ggtagagggagaagc

SEQ ID NO: 330725 - DNA, 15 bp, Homo sapiens
gtagagggagaagct

SEQ ID NO: 330726 - DNA, 15 bp, Homo sapiens
tagagggagaagctg

SEQ ID NO: 330727 - DNA, 15 bp, Homo sapiens
agagggagaagctgt

SEQ ID NO: 330728 - DNA, 15 bp, Homo sapiens
gagggagaagctgtg

SEQ ID NO: 330729 - DNA, 15 bp, Homo sapiens
agggagaagctgtgt

SEQ ID NO: 330730 - DNA, 15 bp, Homo sapiens
gggagaagctgtgtg

SEQ ID NO: 330731 - DNA, 15 bp, Homo sapiens
ggagaagctgtgtgc

SEQ ID NO: 330732 - DNA, 15 bp, Homo sapiens
gagaagctgtgtgcc

SEQ ID NO: 330733 - DNA, 15 bp, Homo sapiens
agaagctgtgtgccc

SEQ ID NO: 330734 - DNA, 15 bp, Homo sapiens
gaagctgtgtgcccc

SEQ ID NO: 330735 - DNA, 15 bp, Homo sapiens
aagctgtgtgcccct

SEQ ID NO: 330736 - DNA, 15 bp, Homo sapiens
agctgtgtgccccta

SEQ ID NO: 330737 - DNA, 15 bp, Homo sapiens
gctgtgtgcccctat

SEQ ID NO: 330738 - DNA, 15 bp, Homo sapiens
ctgtgtgcccctatt

SEQ ID NO: 330739 - DNA, 15 bp, Homo sapiens
tgtgtgcccctatta

SEQ ID NO: 330740 - DNA, 15 bp, Homo sapiens
gtgtgcccctattac

SEQ ID NO: 330741 - DNA, 15 bp, Homo sapiens
tgtgcccctattact

SEQ ID NO: 330742 - DNA, 15 bp, Homo sapiens
gtgcccctattacta

SEQ ID NO: 330743 - DNA, 15 bp, Homo sapiens
tgcccctattactac

SEQ ID NO: 330744 - DNA, 15 bp, Homo sapiens
gcccctattactacc

SEQ ID NO: 330745 - DNA, 15 bp, Homo sapiens
cccctattactacct

SEQ ID NO: 330746 - DNA, 15 bp, Homo sapiens
ccctattactacctc

SEQ ID NO: 330747 - DNA, 15 bp, Homo sapiens
cctattactacctct

SEQ ID NO: 330748 - DNA, 15 bp, Homo sapiens
ctattactacctctc

SEQ ID NO: 330749 - DNA, 15 bp, Homo sapiens
tattactacctctct

SEQ ID NO: 330750 - DNA, 15 bp, Homo sapiens
attactacctctctt

SEQ ID NO: 330751 - DNA, 15 bp, Homo sapiens
ttactacctctcttt

SEQ ID NO: 330752 - DNA, 15 bp, Homo sapiens
tactacctctcttta

SEQ ID NO: 330753 - DNA, 15 bp, Homo sapiens
actacctctctttac

SEQ ID NO: 330754 - DNA, 15 bp, Homo sapiens
ctacctctctttacc

SEQ ID NO: 330755 - DNA, 15 bp, Homo sapiens
tacctctctttacct

SEQ ID NO: 330756 - DNA, 15 bp, Homo sapiens
acctctctttacctc

SEQ ID NO: 330757 - DNA, 15 bp, Homo sapiens
cctctctttacctcc

SEQ ID NO: 330758 - DNA, 15 bp, Homo sapiens
ctctctttacctcct

SEQ ID NO: 330759 - DNA, 15 bp, Homo sapiens
tctctttacctcctc

SEQ ID NO: 330760 - DNA, 15 bp, Homo sapiens
ctctttacctcctca

SEQ ID NO: 330761 - DNA, 15 bp, Homo sapiens
tctttacctcctcat

SEQ ID NO: 330762 - DNA, 15 bp, Homo sapiens
ctttacctcctcatt

SEQ ID NO: 330763 - DNA, 15 bp, Homo sapiens
tttacctcctcatta

SEQ ID NO: 330764 - DNA, 15 bp, Homo sapiens
ttacctcctcattaa

SEQ ID NO: 330765 - DNA, 15 bp, Homo sapiens
tacctcctcattaag

SEQ ID NO: 330766 - DNA, 15 bp, Homo sapiens
acctcctcattaagg

SEQ ID NO: 330767 - DNA, 15 bp, Homo sapiens
cctcctcattaaggg

SEQ ID NO: 330768 - DNA, 15 bp, Homo sapiens
ctcctcattaagggc

SEQ ID NO: 330769 - DNA, 15 bp, Homo sapiens
tcctcattaagggct

SEQ ID NO: 330770 - DNA, 15 bp, Homo sapiens
cctcattaagggctt

SEQ ID NO: 330771 - DNA, 15 bp, Homo sapiens
ctcattaagggcttt

SEQ ID NO: 330772 - DNA, 15 bp, Homo sapiens
tcattaagggctttg

SEQ ID NO: 330773 - DNA, 15 bp, Homo sapiens
cattaagggctttgg

SEQ ID NO: 330774 - DNA, 15 bp, Homo sapiens
attaagggctttggt

SEQ ID NO: 330775 - DNA, 15 bp, Homo sapiens
ttaagggctttggtg

SEQ ID NO: 330776 - DNA, 15 bp, Homo sapiens
taagggctttggtgc

SEQ ID NO: 330777 - DNA, 15 bp, Homo sapiens
aagggctttggtgcg

SEQ ID NO: 330778 - DNA, 15 bp, Homo sapiens
agggctttggtgcga

SEQ ID NO: 330779 - DNA, 15 bp, Homo sapiens
gggctttggtgcgat

SEQ ID NO: 330780 - DNA, 15 bp, Homo sapiens
ggctttggtgcgatt

SEQ ID NO: 330781 - DNA, 15 bp, Homo sapiens
gctttggtgcgatta

SEQ ID NO: 330782 - DNA, 15 bp, Homo sapiens
ctttggtgcgattat

SEQ ID NO: 330783 - DNA, 15 bp, Homo sapiens
tttggtgcgattatt

SEQ ID NO: 330784 - DNA, 15 bp, Homo sapiens
ttggtgcgattattg

SEQ ID NO: 330785 - DNA, 15 bp, Homo sapiens
tggtgcgattattgt

SEQ ID NO: 330786 - DNA, 15 bp, Homo sapiens
ggtgcgattattgtc

SEQ ID NO: 330787 - DNA, 15 bp, Homo sapiens
gtgcgattattgtct

SEQ ID NO: 330788 - DNA, 15 bp, Homo sapiens
tgcgattattgtctc

SEQ ID NO: 330789 - DNA, 15 bp, Homo sapiens
gcgattattgtctcc

SEQ ID NO: 330790 - DNA, 15 bp, Homo sapiens
cgattattgtctccc

SEQ ID NO: 330791 - DNA, 15 bp, Homo sapiens
gattattgtctccct

SEQ ID NO: 330792 - DNA, 15 bp, Homo sapiens
attattgtctccctt

SEQ ID NO: 330793 - DNA, 15 bp, Homo sapiens
ttattgtctcccttt

SEQ ID NO: 330794 - DNA, 15 bp, Homo sapiens
tattgtctccctttt

SEQ ID NO: 330795 - DNA, 15 bp, Homo sapiens
attgtctccctttta

SEQ ID NO: 330796 - DNA, 15 bp, Homo sapiens
ttgtctcccttttaa

SEQ ID NO: 330797 - DNA, 15 bp, Homo sapiens
tgtctcccttttaat

SEQ ID NO: 330798 - DNA, 15 bp, Homo sapiens
gtctcccttttaatc

SEQ ID NO: 330799 - DNA, 15 bp, Homo sapiens
tctcccttttaatct

SEQ ID NO: 330800 - DNA, 15 bp, Homo sapiens
ctcccttttaatctc

SEQ ID NO: 330801 - DNA, 15 bp, Homo sapiens
tcccttttaatctca

SEQ ID NO: 330802 - DNA, 15 bp, Homo sapiens
cccttttaatctcac

SEQ ID NO: 330803 - DNA, 15 bp, Homo sapiens
ccttttaatctcact

SEQ ID NO: 330804 - DNA, 15 bp, Homo sapiens
cttttaatctcacta

SEQ ID NO: 330805 - DNA, 15 bp, Homo sapiens
ttttaatctcactac

SEQ ID NO: 330806 - DNA, 15 bp, Homo sapiens
tttaatctcactact

SEQ ID NO: 330807 - DNA, 15 bp, Homo sapiens
ttaatctcactactt

SEQ ID NO: 330808 - DNA, 15 bp, Homo sapiens
taatctcactacttg

SEQ ID NO: 330809 - DNA, 15 bp, Homo sapiens
aatctcactacttgc

SEQ ID NO: 330810 - DNA, 15 bp, Homo sapiens
atctcactacttgca

SEQ ID NO: 330811 - DNA, 15 bp, Homo sapiens
tctcactacttgcat

SEQ ID NO: 330812 - DNA, 15 bp, Homo sapiens
ctcactacttgcatg

SEQ ID NO: 330813 - DNA, 15 bp, Homo sapiens
tcactacttgcatgc

SEQ ID NO: 330814 - DNA, 15 bp, Homo sapiens
cactacttgcatgca

SEQ ID NO: 330815 - DNA, 15 bp, Homo sapiens
actacttgcatgcag

SEQ ID NO: 330816 - DNA, 15 bp, Homo sapiens
ctacttgcatgcagc

SEQ ID NO: 330817 - DNA, 15 bp, Homo sapiens
tacttgcatgcagct

SEQ ID NO: 330818 - DNA, 15 bp, Homo sapiens
acttgcatgcagctt

SEQ ID NO: 330819 - DNA, 15 bp, Homo sapiens
cttgcatgcagcttt

SEQ ID NO: 330820 - DNA, 15 bp, Homo sapiens
ttgcatgcagctttc

SEQ ID NO: 330821 - DNA, 15 bp, Homo sapiens
tgcatgcagctttct

SEQ ID NO: 330822 - DNA, 15 bp, Homo sapiens
gcatgcagctttctt

SEQ ID NO: 330823 - DNA, 15 bp, Homo sapiens
catgcagctttcttg

SEQ ID NO: 330824 - DNA, 15 bp, Homo sapiens
atgcagctttcttga

SEQ ID NO: 330825 - DNA, 15 bp, Homo sapiens
tgcagctttcttgag

SEQ ID NO: 330826 - DNA, 15 bp, Homo sapiens
gcagctttcttgaga

SEQ ID NO: 330827 - DNA, 15 bp, Homo sapiens
cagctttcttgagaa

SEQ ID NO: 330828 - DNA, 15 bp, Homo sapiens
agctttcttgagaaa

SEQ ID NO: 330829 - DNA, 15 bp, Homo sapiens
gctttcttgagaaag

SEQ ID NO: 330830 - DNA, 15 bp, Homo sapiens
ctttcttgagaaagg

SEQ ID NO: 330831 - DNA, 15 bp, Homo sapiens
tttcttgagaaaggt

SEQ ID NO: 330832 - DNA, 15 bp, Homo sapiens
ttcttgagaaaggtt

SEQ ID NO: 330833 - DNA, 15 bp, Homo sapiens
tcttgagaaaggtta

SEQ ID NO: 330834 - DNA, 15 bp, Homo sapiens
cttgagaaaggttat

SEQ ID NO: 330835 - DNA, 15 bp, Homo sapiens
ttgagaaaggttata

SEQ ID NO: 330836 - DNA, 15 bp, Homo sapiens
tgagaaaggttataa

SEQ ID NO: 330837 - DNA, 15 bp, Homo sapiens
gagaaaggttataat

SEQ ID NO: 330838 - DNA, 15 bp, Homo sapiens
agaaaggttataatt

SEQ ID NO: 330839 - DNA, 15 bp, Homo sapiens
gaaaggttataattt

SEQ ID NO: 330840 - DNA, 15 bp, Homo sapiens
aaaggttataattta

SEQ ID NO: 330841 - DNA, 15 bp, Homo sapiens
aaggttataatttaa

SEQ ID NO: 330842 - DNA, 15 bp, Homo sapiens
aggttataatttaat

SEQ ID NO: 330843 - DNA, 15 bp, Homo sapiens
ggttataatttaatc

SEQ ID NO: 330844 - DNA, 15 bp, Homo sapiens
gttataatttaatcc

SEQ ID NO: 330845 - DNA, 15 bp, Homo sapiens
ttataatttaatcct

SEQ ID NO: 330846 - DNA, 15 bp, Homo sapiens
tataatttaatcctg

SEQ ID NO: 330847 - DNA, 15 bp, Homo sapiens
ataatttaatcctga

SEQ ID NO: 330848 - DNA, 15 bp, Homo sapiens
taatttaatcctgaa

SEQ ID NO: 330849 - DNA, 15 bp, Homo sapiens
aatttaatcctgaaa

SEQ ID NO: 330850 - DNA, 15 bp, Homo sapiens
atttaatcctgaaat

SEQ ID NO: 330851 - DNA, 15 bp, Homo sapiens
tttaatcctgaaata

SEQ ID NO: 330852 - DNA, 15 bp, Homo sapiens
ttaatcctgaaatac

SEQ ID NO: 330853 - DNA, 15 bp, Homo sapiens
taatcctgaaataca

SEQ ID NO: 330854 - DNA, 15 bp, Homo sapiens
aatcctgaaatacaa

SEQ ID NO: 330855 - DNA, 15 bp, Homo sapiens
atcctgaaatacaac

SEQ ID NO: 330856 - DNA, 15 bp, Homo sapiens
tcctgaaatacaact

SEQ ID NO: 330857 - DNA, 15 bp, Homo sapiens
cctgaaatacaactt

SEQ ID NO: 330858 - DNA, 15 bp, Homo sapiens
ctgaaatacaacttc

SEQ ID NO: 330859 - DNA, 15 bp, Homo sapiens
tgaaatacaacttct

SEQ ID NO: 330860 - DNA, 15 bp, Homo sapiens
gaaatacaacttcta

SEQ ID NO: 330861 - DNA, 15 bp, Homo sapiens
aaatacaacttctag

SEQ ID NO: 330862 - DNA, 15 bp, Homo sapiens
aatacaacttctagg

SEQ ID NO: 330863 - DNA, 15 bp, Homo sapiens
atacaacttctagga

SEQ ID NO: 330864 - DNA, 15 bp, Homo sapiens
tacaacttctaggag

SEQ ID NO: 330865 - DNA, 15 bp, Homo sapiens
acaacttctaggagt

SEQ ID NO: 330866 - DNA, 15 bp, Homo sapiens
caacttctaggagtt

SEQ ID NO: 330867 - DNA, 15 bp, Homo sapiens
aacttctaggagttt

SEQ ID NO: 330868 - DNA, 15 bp, Homo sapiens
acttctaggagtttt

SEQ ID NO: 330869 - DNA, 15 bp, Homo sapiens
cttctaggagttttc

SEQ ID NO: 330870 - DNA, 15 bp, Homo sapiens
ttctaggagttttct

SEQ ID NO: 330871 - DNA, 15 bp, Homo sapiens
tctaggagttttctt

SEQ ID NO: 330872 - DNA, 15 bp, Homo sapiens
ctaggagttttcttt

SEQ ID NO: 330873 - DNA, 15 bp, Homo sapiens
taggagttttctttt

SEQ ID NO: 330874 - DNA, 15 bp, Homo sapiens
aggagttttcttttt

SEQ ID NO: 330875 - DNA, 15 bp, Homo sapiens
ggagttttcttttta

SEQ ID NO: 330876 - DNA, 15 bp, Homo sapiens
gagttttctttttaa

SEQ ID NO: 330877 - DNA, 15 bp, Homo sapiens
agttttctttttaat

SEQ ID NO: 330878 - DNA, 15 bp, Homo sapiens
gttttctttttaatt

SEQ ID NO: 330879 - DNA, 15 bp, Homo sapiens
ttttctttttaattc

SEQ ID NO: 330880 - DNA, 15 bp, Homo sapiens
tttctttttaattca

SEQ ID NO: 330881 - DNA, 15 bp, Homo sapiens
ttctttttaattcat

SEQ ID NO: 330882 - DNA, 15 bp, Homo sapiens
tctttttaattcatc

SEQ ID NO: 330883 - DNA, 15 bp, Homo sapiens
ctttttaattcatca

SEQ ID NO: 330884 - DNA, 15 bp, Homo sapiens
tttttaattcatcat

SEQ ID NO: 330885 - DNA, 15 bp, Homo sapiens
ttttaattcatcatt

SEQ ID NO: 330886 - DNA, 15 bp, Homo sapiens
tttaattcatcattc

SEQ ID NO: 330887 - DNA, 15 bp, Homo sapiens
ttaattcatcattcc

SEQ ID NO: 330888 - DNA, 15 bp, Homo sapiens
taattcatcattcca

SEQ ID NO: 330889 - DNA, 15 bp, Homo sapiens
aattcatcattccaa

SEQ ID NO: 330890 - DNA, 15 bp, Homo sapiens
attcatcattccaag

SEQ ID NO: 330891 - DNA, 15 bp, Homo sapiens
ttcatcattccaagt

SEQ ID NO: 330892 - DNA, 15 bp, Homo sapiens
tcatcattccaagta

SEQ ID NO: 330893 - DNA, 15 bp, Homo sapiens
catcattccaagtag

SEQ ID NO: 330894 - DNA, 15 bp, Homo sapiens
atcattccaagtagg

SEQ ID NO: 330895 - DNA, 15 bp, Homo sapiens
tcattccaagtaggt

SEQ ID NO: 330896 - DNA, 15 bp, Homo sapiens
cattccaagtaggtg

SEQ ID NO: 330897 - DNA, 15 bp, Homo sapiens
attccaagtaggtgt

SEQ ID NO: 330898 - DNA, 15 bp, Homo sapiens
ttccaagtaggtgtc

SEQ ID NO: 330899 - DNA, 15 bp, Homo sapiens
tccaagtaggtgtct

SEQ ID NO: 330900 - DNA, 15 bp, Homo sapiens
ccaagtaggtgtctt

SEQ ID NO: 330901 - DNA, 15 bp, Homo sapiens
caagtaggtgtcttt

SEQ ID NO: 330902 - DNA, 15 bp, Homo sapiens
aagtaggtgtctttg

SEQ ID NO: 330903 - DNA, 15 bp, Homo sapiens
agtaggtgtctttgt

SEQ ID NO: 330904 - DNA, 15 bp, Homo sapiens
gtaggtgtctttgtc

SEQ ID NO: 330905 - DNA, 15 bp, Homo sapiens
taggtgtctttgtct

SEQ ID NO: 330906 - DNA, 15 bp, Homo sapiens
aggtgtctttgtctg

SEQ ID NO: 330907 - DNA, 15 bp, Homo sapiens
ggtgtctttgtctgt

SEQ ID NO: 330908 - DNA, 15 bp, Homo sapiens
gtgtctttgtctgtt

SEQ ID NO: 330909 - DNA, 15 bp, Homo sapiens
tgtctttgtctgttt

SEQ ID NO: 330910 - DNA, 15 bp, Homo sapiens
gtctttgtctgtttc

SEQ ID NO: 330911 - DNA, 15 bp, Homo sapiens
tctttgtctgtttcc

SEQ ID NO: 330912 - DNA, 15 bp, Homo sapiens
ctttgtctgtttcca

SEQ ID NO: 330913 - DNA, 15 bp, Homo sapiens
tttgtctgtttccac

SEQ ID NO: 330914 - DNA, 15 bp, Homo sapiens
ttgtctgtttccaca

SEQ ID NO: 330915 - DNA, 15 bp, Homo sapiens
tgtctgtttccacat

SEQ ID NO: 330916 - DNA, 15 bp, Homo sapiens
gtctgtttccacatt

SEQ ID NO: 330917 - DNA, 15 bp, Homo sapiens
tctgtttccacatta

SEQ ID NO: 330918 - DNA, 15 bp, Homo sapiens
ctgtttccacattag

SEQ ID NO: 330919 - DNA, 15 bp, Homo sapiens
tgtttccacattaga

SEQ ID NO: 330920 - DNA, 15 bp, Homo sapiens
gtttccacattagaa

SEQ ID NO: 330921 - DNA, 15 bp, Homo sapiens
tttccacattagaaa

SEQ ID NO: 330922 - DNA, 15 bp, Homo sapiens
ttccacattagaaaa

SEQ ID NO: 330923 - DNA, 15 bp, Homo sapiens
tccacattagaaaat

SEQ ID NO: 330924 - DNA, 15 bp, Homo sapiens
ccacattagaaaatg

SEQ ID NO: 330925 - DNA, 15 bp, Homo sapiens
cacattagaaaatga

SEQ ID NO: 330926 - DNA, 15 bp, Homo sapiens
acattagaaaatgaa

SEQ ID NO: 330927 - DNA, 15 bp, Homo sapiens
cattagaaaatgaaa

SEQ ID NO: 330928 - DNA, 15 bp, Homo sapiens
attagaaaatgaaac

SEQ ID NO: 330929 - DNA, 15 bp, Homo sapiens
ttagaaaatgaaacc

SEQ ID NO: 330930 - DNA, 15 bp, Homo sapiens
tagaaaatgaaacca

SEQ ID NO: 330931 - DNA, 15 bp, Homo sapiens
agaaaatgaaaccaa

SEQ ID NO: 330932 - DNA, 15 bp, Homo sapiens
gaaaatgaaaccaat

SEQ ID NO: 330933 - DNA, 15 bp, Homo sapiens
aaaatgaaaccaata

SEQ ID NO: 330934 - DNA, 15 bp, Homo sapiens
aaatgaaaccaatac

SEQ ID NO: 330935 - DNA, 15 bp, Homo sapiens
aatgaaaccaatact

SEQ ID NO: 330936 - DNA, 15 bp, Homo sapiens
atgaaaccaatactt

SEQ ID NO: 330937 - DNA, 15 bp, Homo sapiens
tgaaaccaatactta

SEQ ID NO: 330938 - DNA, 15 bp, Homo sapiens
gaaaccaatacttaa

SEQ ID NO: 330939 - DNA, 15 bp, Homo sapiens
aaaccaatacttaaa

SEQ ID NO: 330940 - DNA, 15 bp, Homo sapiens
aaccaatacttaaat

SEQ ID NO: 330941 - DNA, 15 bp, Homo sapiens
accaatacttaaata

SEQ ID NO: 330942 - DNA, 15 bp, Homo sapiens
ccaatacttaaatat

SEQ ID NO: 330943 - DNA, 15 bp, Homo sapiens
caatacttaaatatg

SEQ ID NO: 330944 - DNA, 15 bp, Homo sapiens
aatacttaaatatga

SEQ ID NO: 330945 - DNA, 15 bp, Homo sapiens
atacttaaatatgat

SEQ ID NO: 330946 - DNA, 15 bp, Homo sapiens
tacttaaatatgatt

SEQ ID NO: 330947 - DNA, 15 bp, Homo sapiens
acttaaatatgattt

SEQ ID NO: 330948 - DNA, 15 bp, Homo sapiens
cttaaatatgatttc

SEQ ID NO: 330949 - DNA, 15 bp, Homo sapiens
ttaaatatgatttcc

SEQ ID NO: 330950 - DNA, 15 bp, Homo sapiens
taaatatgatttccc

SEQ ID NO: 330951 - DNA, 15 bp, Homo sapiens
aaatatgatttccct

SEQ ID NO: 330952 - DNA, 15 bp, Homo sapiens
aatatgatttccctg

SEQ ID NO: 330953 - DNA, 15 bp, Homo sapiens
atatgatttccctgc

SEQ ID NO: 330954 - DNA, 15 bp, Homo sapiens
tatgatttccctgct

SEQ ID NO: 330955 - DNA, 15 bp, Homo sapiens
atgatttccctgctt

SEQ ID NO: 330956 - DNA, 15 bp, Homo sapiens
tgatttccctgcttt

SEQ ID NO: 330957 - DNA, 15 bp, Homo sapiens
gatttccctgctttt

SEQ ID NO: 330958 - DNA, 15 bp, Homo sapiens
atttccctgctttta

SEQ ID NO: 330959 - DNA, 15 bp, Homo sapiens
tttccctgcttttat

SEQ ID NO: 330960 - DNA, 15 bp, Homo sapiens
ttccctgcttttatt

SEQ ID NO: 330961 - DNA, 15 bp, Homo sapiens
tccctgcttttattg

SEQ ID NO: 330962 - DNA, 15 bp, Homo sapiens
ccctgcttttattgg

SEQ ID NO: 330963 - DNA, 15 bp, Homo sapiens
cctgcttttattggc

SEQ ID NO: 330964 - DNA, 15 bp, Homo sapiens
ctgcttttattggca

SEQ ID NO: 330965 - DNA, 15 bp, Homo sapiens
tgcttttattggcag

SEQ ID NO: 330966 - DNA, 15 bp, Homo sapiens
gcttttattggcagc

SEQ ID NO: 330967 - DNA, 15 bp, Homo sapiens
cttttattggcagct

SEQ ID NO: 330968 - DNA, 15 bp, Homo sapiens
ttttattggcagcta

SEQ ID NO: 330969 - DNA, 15 bp, Homo sapiens
tttattggcagctat

SEQ ID NO: 330970 - DNA, 15 bp, Homo sapiens
ttattggcagctatt

SEQ ID NO: 330971 - DNA, 15 bp, Homo sapiens
tattggcagctattt

SEQ ID NO: 330972 - DNA, 15 bp, Homo sapiens
attggcagctattta

SEQ ID NO: 330973 - DNA, 15 bp, Homo sapiens
ttggcagctatttaa

SEQ ID NO: 330974 - DNA, 15 bp, Homo sapiens
tggcagctatttaag

SEQ ID NO: 330975 - DNA, 15 bp, Homo sapiens
ggcagctatttaaga

SEQ ID NO: 330976 - DNA, 15 bp, Homo sapiens
gcagctatttaagat

SEQ ID NO: 330977 - DNA, 15 bp, Homo sapiens
cagctatttaagatc

SEQ ID NO: 330978 - DNA, 15 bp, Homo sapiens
agctatttaagatct

SEQ ID NO: 330979 - DNA, 15 bp, Homo sapiens
gctatttaagatcta

SEQ ID NO: 330980 - DNA, 15 bp, Homo sapiens
ctatttaagatctat

SEQ ID NO: 330981 - DNA, 15 bp, Homo sapiens
tatttaagatctatg

SEQ ID NO: 330982 - DNA, 15 bp, Homo sapiens
atttaagatctatgt

SEQ ID NO: 330983 - DNA, 15 bp, Homo sapiens
tttaagatctatgtc

SEQ ID NO: 330984 - DNA, 15 bp, Homo sapiens
ttaagatctatgtct

SEQ ID NO: 330985 - DNA, 15 bp, Homo sapiens
taagatctatgtctg

SEQ ID NO: 330986 - DNA, 15 bp, Homo sapiens
aagatctatgtctga

SEQ ID NO: 330987 - DNA, 15 bp, Homo sapiens
agatctatgtctgag

SEQ ID NO: 330988 - DNA, 15 bp, Homo sapiens
gatctatgtctgagg

SEQ ID NO: 330989 - DNA, 15 bp, Homo sapiens
atctatgtctgaggt

SEQ ID NO: 330990 - DNA, 15 bp, Homo sapiens
tctatgtctgaggtc

SEQ ID NO: 330991 - DNA, 15 bp, Homo sapiens
ctatgtctgaggtct

SEQ ID NO: 330992 - DNA, 15 bp, Homo sapiens
tatgtctgaggtctg

SEQ ID NO: 330993 - DNA, 15 bp, Homo sapiens
atgtctgaggtctgg

SEQ ID NO: 330994 - DNA, 15 bp, Homo sapiens
tgtctgaggtctggc

SEQ ID NO: 330995 - DNA, 15 bp, Homo sapiens
gtctgaggtctggct

SEQ ID NO: 330996 - DNA, 15 bp, Homo sapiens
tctgaggtctggctc

SEQ ID NO: 330997 - DNA, 15 bp, Homo sapiens
ctgaggtctggctcc

SEQ ID NO: 330998 - DNA, 15 bp, Homo sapiens
tgaggtctggctccg

SEQ ID NO: 330999 - DNA, 15 bp, Homo sapiens
gaggtctggctccgt

SEQ ID NO: 331000 - DNA, 15 bp, Homo sapiens
aggtctggctccgtg

SEQ ID NO: 331001 - DNA, 15 bp, Homo sapiens
ggtctggctccgtgt

SEQ ID NO: 331002 - DNA, 15 bp, Homo sapiens
gtctggctccgtgtg

SEQ ID NO: 331003 - DNA, 15 bp, Homo sapiens
tctggctccgtgtgg

SEQ ID NO: 331004 - DNA, 15 bp, Homo sapiens
ctggctccgtgtggt

SEQ ID NO: 331005 - DNA, 15 bp, Homo sapiens
tggctccgtgtggtt

SEQ ID NO: 331006 - DNA, 15 bp, Homo sapiens
ggctccgtgtggttt

SEQ ID NO: 331007 - DNA, 15 bp, Homo sapiens
gctccgtgtggtttg

SEQ ID NO: 331008 - DNA, 15 bp, Homo sapiens
ctccgtgtggtttgg

SEQ ID NO: 331009 - DNA, 15 bp, Homo sapiens
tccgtgtggtttgga

SEQ ID NO: 331010 - DNA, 15 bp, Homo sapiens
ccgtgtggtttggaa

SEQ ID NO: 331011 - DNA, 15 bp, Homo sapiens
cgtgtggtttggaat

SEQ ID NO: 331012 - DNA, 15 bp, Homo sapiens
gtgtggtttggaata

SEQ ID NO: 331013 - DNA, 15 bp, Homo sapiens
tgtggtttggaatac

SEQ ID NO: 331014 - DNA, 15 bp, Homo sapiens
gtggtttggaatact

SEQ ID NO: 331015 - DNA, 15 bp, Homo sapiens
tggtttggaatactt

SEQ ID NO: 331016 - DNA, 15 bp, Homo sapiens
ggtttggaatacttt

SEQ ID NO: 331017 - DNA, 15 bp, Homo sapiens
gtttggaatacttta

SEQ ID NO: 331018 - DNA, 15 bp, Homo sapiens
tttggaatactttat

SEQ ID NO: 331019 - DNA, 15 bp, Homo sapiens
ttggaatactttatt

SEQ ID NO: 331020 - DNA, 15 bp, Homo sapiens
tggaatactttattg

SEQ ID NO: 331021 - DNA, 15 bp, Homo sapiens
ggaatactttattgt

SEQ ID NO: 331022 - DNA, 15 bp, Homo sapiens
gaatactttattgtt

SEQ ID NO: 331023 - DNA, 15 bp, Homo sapiens
aatactttattgtta

SEQ ID NO: 331024 - DNA, 15 bp, Homo sapiens
atactttattgttat

SEQ ID NO: 331025 - DNA, 15 bp, Homo sapiens
tactttattgttatt

SEQ ID NO: 331026 - DNA, 15 bp, Homo sapiens
actttattgttatta

SEQ ID NO: 331027 - DNA, 15 bp, Homo sapiens
ctttattgttattat

SEQ ID NO: 331028 - DNA, 15 bp, Homo sapiens
tttattgttattatt

SEQ ID NO: 331029 - DNA, 15 bp, Homo sapiens
ttattgttattatta

SEQ ID NO: 331030 - DNA, 15 bp, Homo sapiens
tattgttattattat

SEQ ID NO: 331031 - DNA, 15 bp, Homo sapiens
attgttattattatt

SEQ ID NO: 331032 - DNA, 15 bp, Homo sapiens
tgttattattattat

SEQ ID NO: 331033 - DNA, 15 bp, Homo sapiens
gttattattattatt

SEQ ID NO: 331034 - DNA, 15 bp, Homo sapiens
ttattattattatta

SEQ ID NO: 331035 - DNA, 15 bp, Homo sapiens
tattattattattat

SEQ ID NO: 331036 - DNA, 15 bp, Homo sapiens
attattattattatt

SEQ ID NO: 331037 - DNA, 15 bp, Homo sapiens
ttattattattattt

SEQ ID NO: 331038 - DNA, 15 bp, Homo sapiens
tattattattatttt

SEQ ID NO: 331039 - DNA, 15 bp, Homo sapiens
attattattattttg

SEQ ID NO: 331040 - DNA, 15 bp, Homo sapiens
ttattattattttga

SEQ ID NO: 331041 - DNA, 15 bp, Homo sapiens
tattattattttgag

SEQ ID NO: 331042 - DNA, 15 bp, Homo sapiens
attattattttgaga

SEQ ID NO: 331043 - DNA, 15 bp, Homo sapiens
ttattattttgagat

SEQ ID NO: 331044 - DNA, 15 bp, Homo sapiens
tattattttgagatg

SEQ ID NO: 331045 - DNA, 15 bp, Homo sapiens
attattttgagatgg

SEQ ID NO: 331046 - DNA, 15 bp, Homo sapiens
ttattttgagatgga

SEQ ID NO: 331047 - DNA, 15 bp, Homo sapiens
tattttgagatggag

SEQ ID NO: 331048 - DNA, 15 bp, Homo sapiens
attttgagatggagt

SEQ ID NO: 331049 - DNA, 15 bp, Homo sapiens
agtcttgctctgtct

SEQ ID NO: 331050 - DNA, 15 bp, Homo sapiens
gtcttgctctgtctc

SEQ ID NO: 331051 - DNA, 15 bp, Homo sapiens
tcttgctctgtctcc

SEQ ID NO: 331052 - DNA, 15 bp, Homo sapiens
cttgctctgtctccc

SEQ ID NO: 331053 - DNA, 15 bp, Homo sapiens
ttgctctgtctccca

SEQ ID NO: 331054 - DNA, 15 bp, Homo sapiens
tgctctgtctcccag

SEQ ID NO: 331055 - DNA, 15 bp, Homo sapiens
gctctgtctcccagg

SEQ ID NO: 331056 - DNA, 15 bp, Homo sapiens
ctctgtctcccaggc

SEQ ID NO: 331057 - DNA, 15 bp, Homo sapiens
tctgtctcccaggct

SEQ ID NO: 331058 - DNA, 15 bp, Homo sapiens
ctgtctcccaggcta

SEQ ID NO: 331059 - DNA, 15 bp, Homo sapiens
tgtctcccaggctag

SEQ ID NO: 331060 - DNA, 15 bp, Homo sapiens
gtctcccaggctaga

SEQ ID NO: 331061 - DNA, 15 bp, Homo sapiens
tctcccaggctagag

SEQ ID NO: 331062 - DNA, 15 bp, Homo sapiens
ctcccaggctagagt

SEQ ID NO: 331063 - DNA, 15 bp, Homo sapiens
tcccaggctagagtg

SEQ ID NO: 331064 - DNA, 15 bp, Homo sapiens
cccaggctagagtgc

SEQ ID NO: 331065 - DNA, 15 bp, Homo sapiens
ccaggctagagtgca

SEQ ID NO: 331066 - DNA, 15 bp, Homo sapiens
caggctagagtgcag

SEQ ID NO: 331067 - DNA, 15 bp, Homo sapiens
aggctagagtgcagt

SEQ ID NO: 331068 - DNA, 15 bp, Homo sapiens
ggctagagtgcagtg

SEQ ID NO: 331069 - DNA, 15 bp, Homo sapiens
gctagagtgcagtgg

SEQ ID NO: 331070 - DNA, 15 bp, Homo sapiens
ctagagtgcagtggt

SEQ ID NO: 331071 - DNA, 15 bp, Homo sapiens
tagagtgcagtggtg

SEQ ID NO: 331072 - DNA, 15 bp, Homo sapiens
agagtgcagtggtgt

SEQ ID NO: 331073 - DNA, 15 bp, Homo sapiens
gagtgcagtggtgtg

SEQ ID NO: 331074 - DNA, 15 bp, Homo sapiens
agtgcagtggtgtga

SEQ ID NO: 331075 - DNA, 15 bp, Homo sapiens
gtgcagtggtgtgat

SEQ ID NO: 331076 - DNA, 15 bp, Homo sapiens
tgcagtggtgtgatc

SEQ ID NO: 331077 - DNA, 15 bp, Homo sapiens
gcagtggtgtgatct

SEQ ID NO: 331078 - DNA, 15 bp, Homo sapiens
cagtggtgtgatctc

SEQ ID NO: 331079 - DNA, 15 bp, Homo sapiens
agtggtgtgatctca

SEQ ID NO: 331080 - DNA, 15 bp, Homo sapiens
gtggtgtgatctcag

SEQ ID NO: 331081 - DNA, 15 bp, Homo sapiens
tggtgtgatctcagc

SEQ ID NO: 331082 - DNA, 15 bp, Homo sapiens
ggtgtgatctcagcc

SEQ ID NO: 331083 - DNA, 15 bp, Homo sapiens
gtgtgatctcagccc

SEQ ID NO: 331084 - DNA, 15 bp, Homo sapiens
tgtgatctcagccca

SEQ ID NO: 331085 - DNA, 15 bp, Homo sapiens
gtgatctcagcccac

SEQ ID NO: 331086 - DNA, 15 bp, Homo sapiens
tgatctcagcccact

SEQ ID NO: 331087 - DNA, 15 bp, Homo sapiens
gatctcagcccactg

SEQ ID NO: 331088 - DNA, 15 bp, Homo sapiens
atctcagcccactgc

SEQ ID NO: 331089 - DNA, 15 bp, Homo sapiens
tctcagcccactgca

SEQ ID NO: 331090 - DNA, 15 bp, Homo sapiens
ctcagcccactgcaa

SEQ ID NO: 331091 - DNA, 15 bp, Homo sapiens
tcagcccactgcaac

SEQ ID NO: 331092 - DNA, 15 bp, Homo sapiens
cagcccactgcaacc

SEQ ID NO: 331093 - DNA, 15 bp, Homo sapiens
agcccactgcaacct

SEQ ID NO: 331094 - DNA, 15 bp, Homo sapiens
gcccactgcaacctc

SEQ ID NO: 331095 - DNA, 15 bp, Homo sapiens
cccactgcaacctct

SEQ ID NO: 331096 - DNA, 15 bp, Homo sapiens
ccactgcaacctctg

SEQ ID NO: 331097 - DNA, 15 bp, Homo sapiens
aacctctgcctccct

SEQ ID NO: 331098 - DNA, 15 bp, Homo sapiens
acctctgcctccctg

SEQ ID NO: 331099 - DNA, 15 bp, Homo sapiens
cctctgcctccctgg

SEQ ID NO: 331100 - DNA, 15 bp, Homo sapiens
ctctgcctccctggt

SEQ ID NO: 331101 - DNA, 15 bp, Homo sapiens
tctgcctccctggtt

SEQ ID NO: 331102 - DNA, 15 bp, Homo sapiens
ctgcctccctggttc

SEQ ID NO: 331103 - DNA, 15 bp, Homo sapiens
tgcctccctggttca

SEQ ID NO: 331104 - DNA, 15 bp, Homo sapiens
gcctccctggttcaa

SEQ ID NO: 331105 - DNA, 15 bp, Homo sapiens
cctccctggttcaag

SEQ ID NO: 331106 - DNA, 15 bp, Homo sapiens
ctccctggttcaagt

SEQ ID NO: 331107 - DNA, 15 bp, Homo sapiens
tccctggttcaagtg

SEQ ID NO: 331108 - DNA, 15 bp, Homo sapiens
ccctggttcaagtga

SEQ ID NO: 331109 - DNA, 15 bp, Homo sapiens
cctggttcaagtgat

SEQ ID NO: 331110 - DNA, 15 bp, Homo sapiens
ctggttcaagtgatt

SEQ ID NO: 331111 - DNA, 15 bp, Homo sapiens
tggttcaagtgattc

SEQ ID NO: 331112 - DNA, 15 bp, Homo sapiens
ggttcaagtgattcc

SEQ ID NO: 331113 - DNA, 15 bp, Homo sapiens
gttcaagtgattccc

SEQ ID NO: 331114 - DNA, 15 bp, Homo sapiens
ttcaagtgattccca

SEQ ID NO: 331115 - DNA, 15 bp, Homo sapiens
tcaagtgattcccat

SEQ ID NO: 331116 - DNA, 15 bp, Homo sapiens
caagtgattcccatg

SEQ ID NO: 331117 - DNA, 15 bp, Homo sapiens
aagtgattcccatgc

SEQ ID NO: 331118 - DNA, 15 bp, Homo sapiens
agtgattcccatgcc

SEQ ID NO: 331119 - DNA, 15 bp, Homo sapiens
gtgattcccatgcct

SEQ ID NO: 331120 - DNA, 15 bp, Homo sapiens
tgattcccatgcctc

SEQ ID NO: 331121 - DNA, 15 bp, Homo sapiens
gattcccatgcctca

SEQ ID NO: 331122 - DNA, 15 bp, Homo sapiens
attcccatgcctcac

SEQ ID NO: 331123 - DNA, 15 bp, Homo sapiens
ttcccatgcctcacc

SEQ ID NO: 331124 - DNA, 15 bp, Homo sapiens
tcccatgcctcaccc

SEQ ID NO: 331125 - DNA, 15 bp, Homo sapiens
cccatgcctcaccct

SEQ ID NO: 331126 - DNA, 15 bp, Homo sapiens
ccatgcctcaccctc

SEQ ID NO: 331127 - DNA, 15 bp, Homo sapiens
catgcctcaccctcc

SEQ ID NO: 331128 - DNA, 15 bp, Homo sapiens
atgcctcaccctcct

SEQ ID NO: 331129 - DNA, 15 bp, Homo sapiens
tgcctcaccctcctg

SEQ ID NO: 331130 - DNA, 15 bp, Homo sapiens
gcctcaccctcctga

SEQ ID NO: 331131 - DNA, 15 bp, Homo sapiens
cctcaccctcctgaa

SEQ ID NO: 331132 - DNA, 15 bp, Homo sapiens
ctcaccctcctgaat

SEQ ID NO: 331133 - DNA, 15 bp, Homo sapiens
tcaccctcctgaata

SEQ ID NO: 331134 - DNA, 15 bp, Homo sapiens
caccctcctgaatag

SEQ ID NO: 331135 - DNA, 15 bp, Homo sapiens
accctcctgaatagc

SEQ ID NO: 331136 - DNA, 15 bp, Homo sapiens
ccctcctgaatagct

SEQ ID NO: 331137 - DNA, 15 bp, Homo sapiens
cctcctgaatagctg

SEQ ID NO: 331138 - DNA, 15 bp, Homo sapiens
ctcctgaatagctgg

SEQ ID NO: 331139 - DNA, 15 bp, Homo sapiens
tcctgaatagctggg

SEQ ID NO: 331140 - DNA, 15 bp, Homo sapiens
cctgaatagctggga

SEQ ID NO: 331141 - DNA, 15 bp, Homo sapiens
ctgaatagctgggat

SEQ ID NO: 331142 - DNA, 15 bp, Homo sapiens
tgaatagctgggatt

SEQ ID NO: 331143 - DNA, 15 bp, Homo sapiens
gaatagctgggatta

SEQ ID NO: 331144 - DNA, 15 bp, Homo sapiens
gggattacaggcaca

SEQ ID NO: 331145 - DNA, 15 bp, Homo sapiens
ggattacaggcacac

SEQ ID NO: 331146 - DNA, 15 bp, Homo sapiens
gattacaggcacacg

SEQ ID NO: 331147 - DNA, 15 bp, Homo sapiens
attacaggcacacgc

SEQ ID NO: 331148 - DNA, 15 bp, Homo sapiens
ttacaggcacacgcc

SEQ ID NO: 331149 - DNA, 15 bp, Homo sapiens
tacaggcacacgcca

SEQ ID NO: 331150 - DNA, 15 bp, Homo sapiens
acaggcacacgccac

SEQ ID NO: 331151 - DNA, 15 bp, Homo sapiens
caggcacacgccacc

SEQ ID NO: 331152 - DNA, 15 bp, Homo sapiens
aggcacacgccacca

SEQ ID NO: 331153 - DNA, 15 bp, Homo sapiens
ggcacacgccaccac

SEQ ID NO: 331154 - DNA, 15 bp, Homo sapiens
gcacacgccaccacg

SEQ ID NO: 331155 - DNA, 15 bp, Homo sapiens
cacacgccaccacgc

SEQ ID NO: 331156 - DNA, 15 bp, Homo sapiens
acacgccaccacgcc

SEQ ID NO: 331157 - DNA, 15 bp, Homo sapiens
cacgccaccacgcct

SEQ ID NO: 331158 - DNA, 15 bp, Homo sapiens
acgccaccacgcctg

SEQ ID NO: 331159 - DNA, 15 bp, Homo sapiens
cgccaccacgcctgg

SEQ ID NO: 331160 - DNA, 15 bp, Homo sapiens
ggctaatttttgtag

SEQ ID NO: 331161 - DNA, 15 bp, Homo sapiens
gctaatttttgtagt

SEQ ID NO: 331162 - DNA, 15 bp, Homo sapiens
ctaatttttgtagtt

SEQ ID NO: 331163 - DNA, 15 bp, Homo sapiens
taatttttgtagttt

SEQ ID NO: 331164 - DNA, 15 bp, Homo sapiens
aatttttgtagtttt

SEQ ID NO: 331165 - DNA, 15 bp, Homo sapiens
atttttgtagtttta

SEQ ID NO: 331166 - DNA, 15 bp, Homo sapiens
tttttgtagttttag

SEQ ID NO: 331167 - DNA, 15 bp, Homo sapiens
ttttgtagttttagt

SEQ ID NO: 331168 - DNA, 15 bp, Homo sapiens
tttgtagttttagta

SEQ ID NO: 331169 - DNA, 15 bp, Homo sapiens
ttgtagttttagtag

SEQ ID NO: 331170 - DNA, 15 bp, Homo sapiens
tgtagttttagtaga

SEQ ID NO: 331171 - DNA, 15 bp, Homo sapiens
gtagttttagtagag

SEQ ID NO: 331172 - DNA, 15 bp, Homo sapiens
tagttttagtagaga

SEQ ID NO: 331173 - DNA, 15 bp, Homo sapiens
agttttagtagagat

SEQ ID NO: 331174 - DNA, 15 bp, Homo sapiens
gttttagtagagatg

SEQ ID NO: 331175 - DNA, 15 bp, Homo sapiens
tttagtagagatgga

SEQ ID NO: 331176 - DNA, 15 bp, Homo sapiens
ttagtagagatggag

SEQ ID NO: 331177 - DNA, 15 bp, Homo sapiens
tagtagagatggagt

SEQ ID NO: 331178 - DNA, 15 bp, Homo sapiens
agtagagatggagtc

SEQ ID NO: 331179 - DNA, 15 bp, Homo sapiens
gtagagatggagtct

SEQ ID NO: 331180 - DNA, 15 bp, Homo sapiens
tagagatggagtctt

SEQ ID NO: 331181 - DNA, 15 bp, Homo sapiens
agagatggagtctta

SEQ ID NO: 331182 - DNA, 15 bp, Homo sapiens
agatggagtcttacc

SEQ ID NO: 331183 - DNA, 15 bp, Homo sapiens
gatggagtcttacca

SEQ ID NO: 331184 - DNA, 15 bp, Homo sapiens
atggagtcttaccat

SEQ ID NO: 331185 - DNA, 15 bp, Homo sapiens
tggagtcttaccatg

SEQ ID NO: 331186 - DNA, 15 bp, Homo sapiens
ggagtcttaccatgt

SEQ ID NO: 331187 - DNA, 15 bp, Homo sapiens
gagtcttaccatgtt

SEQ ID NO: 331188 - DNA, 15 bp, Homo sapiens
agtcttaccatgttg

SEQ ID NO: 331189 - DNA, 15 bp, Homo sapiens
gtcttaccatgttgg

SEQ ID NO: 331190 - DNA, 15 bp, Homo sapiens
tcttaccatgttggc

SEQ ID NO: 331191 - DNA, 15 bp, Homo sapiens
cttaccatgttggcc

SEQ ID NO: 331192 - DNA, 15 bp, Homo sapiens
caggtgatccacccg

SEQ ID NO: 331193 - DNA, 15 bp, Homo sapiens
aggtgatccacccgc

SEQ ID NO: 331194 - DNA, 15 bp, Homo sapiens
ggtgatccacccgcc

SEQ ID NO: 331195 - DNA, 15 bp, Homo sapiens
gatccacccgcctca

SEQ ID NO: 331196 - DNA, 15 bp, Homo sapiens
ccacccgcctcagct

SEQ ID NO: 331197 - DNA, 15 bp, Homo sapiens
cacccgcctcagctt

SEQ ID NO: 331198 - DNA, 15 bp, Homo sapiens
acccgcctcagcttc

SEQ ID NO: 331199 - DNA, 15 bp, Homo sapiens
cccgcctcagcttcc

SEQ ID NO: 331200 - DNA, 15 bp, Homo sapiens
ccgcctcagcttcct

SEQ ID NO: 331201 - DNA, 15 bp, Homo sapiens
cgcctcagcttccta

SEQ ID NO: 331202 - DNA, 15 bp, Homo sapiens
gcctcagcttcctaa

SEQ ID NO: 331203 - DNA, 15 bp, Homo sapiens
cctcagcttcctaaa

SEQ ID NO: 331204 - DNA, 15 bp, Homo sapiens
ctcagcttcctaaag

SEQ ID NO: 331205 - DNA, 15 bp, Homo sapiens
tcagcttcctaaagt

SEQ ID NO: 331206 - DNA, 15 bp, Homo sapiens
cagcttcctaaagtg

SEQ ID NO: 331207 - DNA, 15 bp, Homo sapiens
agcttcctaaagtgc

SEQ ID NO: 331208 - DNA, 15 bp, Homo sapiens
gcttcctaaagtgct

SEQ ID NO: 331209 - DNA, 15 bp, Homo sapiens
cttcctaaagtgctg

SEQ ID NO: 331210 - DNA, 15 bp, Homo sapiens
ttcctaaagtgctgg

SEQ ID NO: 331211 - DNA, 15 bp, Homo sapiens
tcctaaagtgctggg

SEQ ID NO: 331212 - DNA, 15 bp, Homo sapiens
cctaaagtgctggga

SEQ ID NO: 331213 - DNA, 15 bp, Homo sapiens
ctaaagtgctgggat

SEQ ID NO: 331214 - DNA, 15 bp, Homo sapiens
taaagtgctgggatt

SEQ ID NO: 331215 - DNA, 15 bp, Homo sapiens
ggattataggcatga

SEQ ID NO: 331216 - DNA, 15 bp, Homo sapiens
gattataggcatgag

SEQ ID NO: 331217 - DNA, 15 bp, Homo sapiens
attataggcatgagc

SEQ ID NO: 331218 - DNA, 15 bp, Homo sapiens
ttataggcatgagcc

SEQ ID NO: 331219 - DNA, 15 bp, Homo sapiens
tataggcatgagcca

SEQ ID NO: 331220 - DNA, 15 bp, Homo sapiens
ataggcatgagccat

SEQ ID NO: 331221 - DNA, 15 bp, Homo sapiens
taggcatgagccatt

SEQ ID NO: 331222 - DNA, 15 bp, Homo sapiens
aggcatgagccattg

SEQ ID NO: 331223 - DNA, 15 bp, Homo sapiens
ggcatgagccattgc

SEQ ID NO: 331224 - DNA, 15 bp, Homo sapiens
gcatgagccattgcg

SEQ ID NO: 331225 - DNA, 15 bp, Homo sapiens
catgagccattgcgc

SEQ ID NO: 331226 - DNA, 15 bp, Homo sapiens
atgagccattgcgcc

SEQ ID NO: 331227 - DNA, 15 bp, Homo sapiens
tgagccattgcgccc

SEQ ID NO: 331228 - DNA, 15 bp, Homo sapiens
gagccattgcgccca

SEQ ID NO: 331229 - DNA, 15 bp, Homo sapiens
agccattgcgcccag

SEQ ID NO: 331230 - DNA, 15 bp, Homo sapiens
gccattgcgcccagc

SEQ ID NO: 331231 - DNA, 15 bp, Homo sapiens
ccattgcgcccagcc

SEQ ID NO: 331232 - DNA, 15 bp, Homo sapiens
cattgcgcccagcct

SEQ ID NO: 331233 - DNA, 15 bp, Homo sapiens
attgcgcccagcctg

SEQ ID NO: 331234 - DNA, 15 bp, Homo sapiens
ttgcgcccagcctgg

SEQ ID NO: 331235 - DNA, 15 bp, Homo sapiens
tgcgcccagcctgga

SEQ ID NO: 331236 - DNA, 15 bp, Homo sapiens
gcgcccagcctggaa

SEQ ID NO: 331237 - DNA, 15 bp, Homo sapiens
cgcccagcctggaat

SEQ ID NO: 331238 - DNA, 15 bp, Homo sapiens
gcccagcctggaata

SEQ ID NO: 331239 - DNA, 15 bp, Homo sapiens
cccagcctggaatat

SEQ ID NO: 331240 - DNA, 15 bp, Homo sapiens
ccagcctggaatatt

SEQ ID NO: 331241 - DNA, 15 bp, Homo sapiens
cagcctggaatattt

SEQ ID NO: 331242 - DNA, 15 bp, Homo sapiens
agcctggaatatttt

SEQ ID NO: 331243 - DNA, 15 bp, Homo sapiens
gcctggaatattttc

SEQ ID NO: 331244 - DNA, 15 bp, Homo sapiens
cctggaatattttct

SEQ ID NO: 331245 - DNA, 15 bp, Homo sapiens
ctggaatattttcta

SEQ ID NO: 331246 - DNA, 15 bp, Homo sapiens
tggaatattttctaa

SEQ ID NO: 331247 - DNA, 15 bp, Homo sapiens
ggaatattttctaag

SEQ ID NO: 331248 - DNA, 15 bp, Homo sapiens
gaatattttctaagc

SEQ ID NO: 331249 - DNA, 15 bp, Homo sapiens
aatattttctaagct

SEQ ID NO: 331250 - DNA, 15 bp, Homo sapiens
atattttctaagctc

SEQ ID NO: 331251 - DNA, 15 bp, Homo sapiens
tattttctaagctct

SEQ ID NO: 331252 - DNA, 15 bp, Homo sapiens
attttctaagctctt

SEQ ID NO: 331253 - DNA, 15 bp, Homo sapiens
ttttctaagctcttt

SEQ ID NO: 331254 - DNA, 15 bp, Homo sapiens
tttctaagctctttg

SEQ ID NO: 331255 - DNA, 15 bp, Homo sapiens
ttctaagctctttga

SEQ ID NO: 331256 - DNA, 15 bp, Homo sapiens
tctaagctctttgat

SEQ ID NO: 331257 - DNA, 15 bp, Homo sapiens
ctaagctctttgatg

SEQ ID NO: 331258 - DNA, 15 bp, Homo sapiens
taagctctttgatga

SEQ ID NO: 331259 - DNA, 15 bp, Homo sapiens
aagctctttgatgat

SEQ ID NO: 331260 - DNA, 15 bp, Homo sapiens
agctctttgatgatg

SEQ ID NO: 331261 - DNA, 15 bp, Homo sapiens
gctctttgatgatgg

SEQ ID NO: 331262 - DNA, 15 bp, Homo sapiens
ctctttgatgatggc

SEQ ID NO: 331263 - DNA, 15 bp, Homo sapiens
tctttgatgatggcg

SEQ ID NO: 331264 - DNA, 15 bp, Homo sapiens
ctttgatgatggcgg

SEQ ID NO: 331265 - DNA, 15 bp, Homo sapiens
tttgatgatggcggc

SEQ ID NO: 331266 - DNA, 15 bp, Homo sapiens
ttgatgatggcggct

SEQ ID NO: 331267 - DNA, 15 bp, Homo sapiens
tgatgatggcggctt

SEQ ID NO: 331268 - DNA, 15 bp, Homo sapiens
gatgatggcggcttc

SEQ ID NO: 331269 - DNA, 15 bp, Homo sapiens
atgatggcggcttcg

SEQ ID NO: 331270 - DNA, 15 bp, Homo sapiens
tgatggcggcttcga

SEQ ID NO: 331271 - DNA, 15 bp, Homo sapiens
gatggcggcttcgat

SEQ ID NO: 331272 - DNA, 15 bp, Homo sapiens
atggcggcttcgatt

SEQ ID NO: 331273 - DNA, 15 bp, Homo sapiens
tggcggcttcgattt

SEQ ID NO: 331274 - DNA, 15 bp, Homo sapiens
ggcggcttcgattta

SEQ ID NO: 331275 - DNA, 15 bp, Homo sapiens
gcggcttcgatttaa

SEQ ID NO: 331276 - DNA, 15 bp, Homo sapiens
cggcttcgatttaac

SEQ ID NO: 331277 - DNA, 15 bp, Homo sapiens
ggcttcgatttaact

SEQ ID NO: 331278 - DNA, 15 bp, Homo sapiens
gcttcgatttaactc

SEQ ID NO: 331279 - DNA, 15 bp, Homo sapiens
cttcgatttaactct

SEQ ID NO: 331280 - DNA, 15 bp, Homo sapiens
ttcgatttaactctc

SEQ ID NO: 331281 - DNA, 15 bp, Homo sapiens
tcgatttaactctct

SEQ ID NO: 331282 - DNA, 15 bp, Homo sapiens
cgatttaactctctc

SEQ ID NO: 331283 - DNA, 15 bp, Homo sapiens
gatttaactctctct

SEQ ID NO: 331284 - DNA, 15 bp, Homo sapiens
atttaactctctctg

SEQ ID NO: 331285 - DNA, 15 bp, Homo sapiens
tttaactctctctga

SEQ ID NO: 331286 - DNA, 15 bp, Homo sapiens
ttaactctctctgac

SEQ ID NO: 331287 - DNA, 15 bp, Homo sapiens
taactctctctgact

SEQ ID NO: 331288 - DNA, 15 bp, Homo sapiens
aactctctctgactt

SEQ ID NO: 331289 - DNA, 15 bp, Homo sapiens
tatattatttctagt

SEQ ID NO: 331290 - DNA, 15 bp, Homo sapiens
atattatttctagtt

SEQ ID NO: 331291 - DNA, 15 bp, Homo sapiens
tattatttctagttc

SEQ ID NO: 331292 - DNA, 15 bp, Homo sapiens
attatttctagttct

SEQ ID NO: 331293 - DNA, 15 bp, Homo sapiens
ttatttctagttctt

SEQ ID NO: 331294 - DNA, 15 bp, Homo sapiens
tatttctagttcttt

SEQ ID NO: 331295 - DNA, 15 bp, Homo sapiens
atttctagttctttt

SEQ ID NO: 331296 - DNA, 15 bp, Homo sapiens
tttctagttcttttc

SEQ ID NO: 331297 - DNA, 15 bp, Homo sapiens
ttctagttcttttct

SEQ ID NO: 331298 - DNA, 15 bp, Homo sapiens
tctagttcttttctt

SEQ ID NO: 331299 - DNA, 15 bp, Homo sapiens
ctagttcttttcttc

SEQ ID NO: 331300 - DNA, 15 bp, Homo sapiens
tagttcttttcttca

SEQ ID NO: 331301 - DNA, 15 bp, Homo sapiens
agttcttttcttcaa

SEQ ID NO: 331302 - DNA, 15 bp, Homo sapiens
gttcttttcttcaaa

SEQ ID NO: 331303 - DNA, 15 bp, Homo sapiens
ttcttttcttcaaat

SEQ ID NO: 331304 - DNA, 15 bp, Homo sapiens
tcttttcttcaaatt

SEQ ID NO: 331305 - DNA, 15 bp, Homo sapiens
cttttcttcaaatta

SEQ ID NO: 331306 - DNA, 15 bp, Homo sapiens
ttttcttcaaattac

SEQ ID NO: 331307 - DNA, 15 bp, Homo sapiens
tttcttcaaattaca

SEQ ID NO: 331308 - DNA, 15 bp, Homo sapiens
ttcttcaaattacac

SEQ ID NO: 331309 - DNA, 15 bp, Homo sapiens
tcttcaaattacaca

SEQ ID NO: 331310 - DNA, 15 bp, Homo sapiens
cttcaaattacacaa

SEQ ID NO: 331311 - DNA, 15 bp, Homo sapiens
ttcaaattacacaaa

SEQ ID NO: 331312 - DNA, 15 bp, Homo sapiens
tcaaattacacaaat

SEQ ID NO: 331313 - DNA, 15 bp, Homo sapiens
caaattacacaaata

SEQ ID NO: 331314 - DNA, 15 bp, Homo sapiens
aaattacacaaatat

SEQ ID NO: 331315 - DNA, 15 bp, Homo sapiens
aattacacaaatatt

SEQ ID NO: 331316 - DNA, 15 bp, Homo sapiens
attacacaaatatta

SEQ ID NO: 331317 - DNA, 15 bp, Homo sapiens
ttacacaaatattag

SEQ ID NO: 331318 - DNA, 15 bp, Homo sapiens
tacacaaatattagc

SEQ ID NO: 331319 - DNA, 15 bp, Homo sapiens
acacaaatattagcc

SEQ ID NO: 331320 - DNA, 15 bp, Homo sapiens
cacaaatattagcca

SEQ ID NO: 331321 - DNA, 15 bp, Homo sapiens
acaaatattagccac

SEQ ID NO: 331322 - DNA, 15 bp, Homo sapiens
caaatattagccact

SEQ ID NO: 331323 - DNA, 15 bp, Homo sapiens
aaatattagccactc

SEQ ID NO: 331324 - DNA, 15 bp, Homo sapiens
aatattagccactca

SEQ ID NO: 331325 - DNA, 15 bp, Homo sapiens
atattagccactcag

SEQ ID NO: 331326 - DNA, 15 bp, Homo sapiens
tattagccactcagt

SEQ ID NO: 331327 - DNA, 15 bp, Homo sapiens
attagccactcagtg

SEQ ID NO: 331328 - DNA, 15 bp, Homo sapiens
ttagccactcagtgc

SEQ ID NO: 331329 - DNA, 15 bp, Homo sapiens
tagccactcagtgct

SEQ ID NO: 331330 - DNA, 15 bp, Homo sapiens
agccactcagtgctt

SEQ ID NO: 331331 - DNA, 15 bp, Homo sapiens
gccactcagtgcttg

SEQ ID NO: 331332 - DNA, 15 bp, Homo sapiens
ccactcagtgcttgc

SEQ ID NO: 331333 - DNA, 15 bp, Homo sapiens
cactcagtgcttgca

SEQ ID NO: 331334 - DNA, 15 bp, Homo sapiens
actcagtgcttgcag

SEQ ID NO: 331335 - DNA, 15 bp, Homo sapiens
ctcagtgcttgcaga

SEQ ID NO: 331336 - DNA, 15 bp, Homo sapiens
tcagtgcttgcagaa

SEQ ID NO: 331337 - DNA, 15 bp, Homo sapiens
cagtgcttgcagaat

SEQ ID NO: 331338 - DNA, 15 bp, Homo sapiens
agtgcttgcagaata

SEQ ID NO: 331339 - DNA, 15 bp, Homo sapiens
gtgcttgcagaatat

SEQ ID NO: 331340 - DNA, 15 bp, Homo sapiens
tgcttgcagaatatt

SEQ ID NO: 331341 - DNA, 15 bp, Homo sapiens
gcttgcagaatattt

SEQ ID NO: 331342 - DNA, 15 bp, Homo sapiens
cttgcagaatatttt

SEQ ID NO: 331343 - DNA, 15 bp, Homo sapiens
ttgcagaatattttc

SEQ ID NO: 331344 - DNA, 15 bp, Homo sapiens
tgcagaatattttca

SEQ ID NO: 331345 - DNA, 15 bp, Homo sapiens
gcagaatattttcaa

SEQ ID NO: 331346 - DNA, 15 bp, Homo sapiens
cagaatattttcaaa

SEQ ID NO: 331347 - DNA, 15 bp, Homo sapiens
agaatattttcaaag

SEQ ID NO: 331348 - DNA, 15 bp, Homo sapiens
gaatattttcaaagg

SEQ ID NO: 331349 - DNA, 15 bp, Homo sapiens
aatattttcaaaggt

SEQ ID NO: 331350 - DNA, 15 bp, Homo sapiens
atattttcaaaggtc

SEQ ID NO: 331351 - DNA, 15 bp, Homo sapiens
tattttcaaaggtct

SEQ ID NO: 331352 - DNA, 15 bp, Homo sapiens
attttcaaaggtctg

SEQ ID NO: 331353 - DNA, 15 bp, Homo sapiens
ttttcaaaggtctgc

SEQ ID NO: 331354 - DNA, 15 bp, Homo sapiens
tttcaaaggtctgca

SEQ ID NO: 331355 - DNA, 15 bp, Homo sapiens
ttcaaaggtctgcat

SEQ ID NO: 331356 - DNA, 15 bp, Homo sapiens
tcaaaggtctgcatt

SEQ ID NO: 331357 - DNA, 15 bp, Homo sapiens
caaaggtctgcattt

SEQ ID NO: 331358 - DNA, 15 bp, Homo sapiens
aaaggtctgcatttg

SEQ ID NO: 331359 - DNA, 15 bp, Homo sapiens
aaggtctgcatttgt

SEQ ID NO: 331360 - DNA, 15 bp, Homo sapiens
aggtctgcatttgtg

SEQ ID NO: 331361 - DNA, 15 bp, Homo sapiens
ggtctgcatttgtga

SEQ ID NO: 331362 - DNA, 15 bp, Homo sapiens
gtctgcatttgtgaa

SEQ ID NO: 331363 - DNA, 15 bp, Homo sapiens
tctgcatttgtgaac

SEQ ID NO: 331364 - DNA, 15 bp, Homo sapiens
ctgcatttgtgaaca

SEQ ID NO: 331365 - DNA, 15 bp, Homo sapiens
tgcatttgtgaacag

SEQ ID NO: 331366 - DNA, 15 bp, Homo sapiens
gcatttgtgaacagg

SEQ ID NO: 331367 - DNA, 15 bp, Homo sapiens
catttgtgaacaggt

SEQ ID NO: 331368 - DNA, 15 bp, Homo sapiens
atttgtgaacaggtc

SEQ ID NO: 331369 - DNA, 15 bp, Homo sapiens
tttgtgaacaggtcc

SEQ ID NO: 331370 - DNA, 15 bp, Homo sapiens
ttgtgaacaggtcct

SEQ ID NO: 331371 - DNA, 15 bp, Homo sapiens
tgtgaacaggtcctg

SEQ ID NO: 331372 - DNA, 15 bp, Homo sapiens
gtgaacaggtcctgg

SEQ ID NO: 331373 - DNA, 15 bp, Homo sapiens
tgaacaggtcctggg

SEQ ID NO: 331374 - DNA, 15 bp, Homo sapiens
gaacaggtcctggga

SEQ ID NO: 331375 - DNA, 15 bp, Homo sapiens
aacaggtcctgggat

SEQ ID NO: 331376 - DNA, 15 bp, Homo sapiens
acaggtcctgggatg

SEQ ID NO: 331377 - DNA, 15 bp, Homo sapiens
caggtcctgggatgg

SEQ ID NO: 331378 - DNA, 15 bp, Homo sapiens
aggtcctgggatgga

SEQ ID NO: 331379 - DNA, 15 bp, Homo sapiens
ggtcctgggatggag

SEQ ID NO: 331380 - DNA, 15 bp, Homo sapiens
gtcctgggatggaga

SEQ ID NO: 331381 - DNA, 15 bp, Homo sapiens
tcctgggatggagag

SEQ ID NO: 331382 - DNA, 15 bp, Homo sapiens
cctgggatggagagc

SEQ ID NO: 331383 - DNA, 15 bp, Homo sapiens
ctgggatggagagcc

SEQ ID NO: 331384 - DNA, 15 bp, Homo sapiens
tgggatggagagcct

SEQ ID NO: 331385 - DNA, 15 bp, Homo sapiens
gggatggagagcctt

SEQ ID NO: 331386 - DNA, 15 bp, Homo sapiens
ggatggagagccttt

SEQ ID NO: 331387 - DNA, 15 bp, Homo sapiens
gatggagagcctttg

SEQ ID NO: 331388 - DNA, 15 bp, Homo sapiens
atggagagcctttga

SEQ ID NO: 331389 - DNA, 15 bp, Homo sapiens
tggagagcctttgaa

SEQ ID NO: 331390 - DNA, 15 bp, Homo sapiens
ggagagcctttgaat

SEQ ID NO: 331391 - DNA, 15 bp, Homo sapiens
gagagcctttgaatt

SEQ ID NO: 331392 - DNA, 15 bp, Homo sapiens
agagcctttgaatta

SEQ ID NO: 331393 - DNA, 15 bp, Homo sapiens
gagcctttgaattac

SEQ ID NO: 331394 - DNA, 15 bp, Homo sapiens
agcctttgaattacc

SEQ ID NO: 331395 - DNA, 15 bp, Homo sapiens
gcctttgaattaccg

SEQ ID NO: 331396 - DNA, 15 bp, Homo sapiens
cctttgaattaccgt

SEQ ID NO: 331397 - DNA, 15 bp, Homo sapiens
ctttgaattaccgtg

SEQ ID NO: 331398 - DNA, 15 bp, Homo sapiens
tttgaattaccgtgg

SEQ ID NO: 331399 - DNA, 15 bp, Homo sapiens
ttgaattaccgtggg

SEQ ID NO: 331400 - DNA, 15 bp, Homo sapiens
tgaattaccgtgggt

SEQ ID NO: 331401 - DNA, 15 bp, Homo sapiens
gaattaccgtgggtg

SEQ ID NO: 331402 - DNA, 15 bp, Homo sapiens
aattaccgtgggtgt

SEQ ID NO: 331403 - DNA, 15 bp, Homo sapiens
attaccgtgggtgta

SEQ ID NO: 331404 - DNA, 15 bp, Homo sapiens
ttaccgtgggtgtat

SEQ ID NO: 331405 - DNA, 15 bp, Homo sapiens
taccgtgggtgtatg

SEQ ID NO: 331406 - DNA, 15 bp, Homo sapiens
accgtgggtgtatgt

SEQ ID NO: 331407 - DNA, 15 bp, Homo sapiens
ccgtgggtgtatgtg

SEQ ID NO: 331408 - DNA, 15 bp, Homo sapiens
cgtgggtgtatgtgt

SEQ ID NO: 331409 - DNA, 15 bp, Homo sapiens
gtgggtgtatgtgtt

SEQ ID NO: 331410 - DNA, 15 bp, Homo sapiens
tgggtgtatgtgtta

SEQ ID NO: 331411 - DNA, 15 bp, Homo sapiens
gggtgtatgtgttat

SEQ ID NO: 331412 - DNA, 15 bp, Homo sapiens
ggtgtatgtgttatc

SEQ ID NO: 331413 - DNA, 15 bp, Homo sapiens
gtgtatgtgttatcc

SEQ ID NO: 331414 - DNA, 15 bp, Homo sapiens
tgtatgtgttatcca

SEQ ID NO: 331415 - DNA, 15 bp, Homo sapiens
gtatgtgttatccat

SEQ ID NO: 331416 - DNA, 15 bp, Homo sapiens
tatgtgttatccatt

SEQ ID NO: 331417 - DNA, 15 bp, Homo sapiens
atgtgttatccattt

SEQ ID NO: 331418 - DNA, 15 bp, Homo sapiens
tgtgttatccatttg

SEQ ID NO: 331419 - DNA, 15 bp, Homo sapiens
gtgttatccatttgc

SEQ ID NO: 331420 - DNA, 15 bp, Homo sapiens
tgttatccatttgct

SEQ ID NO: 331421 - DNA, 15 bp, Homo sapiens
gttatccatttgctt

SEQ ID NO: 331422 - DNA, 15 bp, Homo sapiens
ttatccatttgctta

SEQ ID NO: 331423 - DNA, 15 bp, Homo sapiens
tatccatttgcttac

SEQ ID NO: 331424 - DNA, 15 bp, Homo sapiens
atccatttgcttaca

SEQ ID NO: 331425 - DNA, 15 bp, Homo sapiens
tccatttgcttacac

SEQ ID NO: 331426 - DNA, 15 bp, Homo sapiens
ccatttgcttacact

SEQ ID NO: 331427 - DNA, 15 bp, Homo sapiens
catttgcttacactg

SEQ ID NO: 331428 - DNA, 15 bp, Homo sapiens
atttgcttacactgc

SEQ ID NO: 331429 - DNA, 15 bp, Homo sapiens
tttgcttacactgca

SEQ ID NO: 331430 - DNA, 15 bp, Homo sapiens
ttgcttacactgcat

SEQ ID NO: 331431 - DNA, 15 bp, Homo sapiens
tgcttacactgcatc

SEQ ID NO: 331432 - DNA, 15 bp, Homo sapiens
gcttacactgcatct

SEQ ID NO: 331433 - DNA, 15 bp, Homo sapiens
cttacactgcatctt

SEQ ID NO: 331434 - DNA, 15 bp, Homo sapiens
ttacactgcatcttc

SEQ ID NO: 331435 - DNA, 15 bp, Homo sapiens
tacactgcatcttct

SEQ ID NO: 331436 - DNA, 15 bp, Homo sapiens
acactgcatcttctt

SEQ ID NO: 331437 - DNA, 15 bp, Homo sapiens
cactgcatcttctta

SEQ ID NO: 331438 - DNA, 15 bp, Homo sapiens
actgcatcttcttac

SEQ ID NO: 331439 - DNA, 15 bp, Homo sapiens
ctgcatcttcttact

SEQ ID NO: 331440 - DNA, 15 bp, Homo sapiens
tgcatcttcttacta

SEQ ID NO: 331441 - DNA, 15 bp, Homo sapiens
gcatcttcttactat

SEQ ID NO: 331442 - DNA, 15 bp, Homo sapiens
catcttcttactata

SEQ ID NO: 331443 - DNA, 15 bp, Homo sapiens
atcttcttactataa

SEQ ID NO: 331444 - DNA, 15 bp, Homo sapiens
tcttcttactataaa

SEQ ID NO: 331445 - DNA, 15 bp, Homo sapiens
cttcttactataaaa

SEQ ID NO: 331446 - DNA, 15 bp, Homo sapiens
ttcttactataaaat

SEQ ID NO: 331447 - DNA, 15 bp, Homo sapiens
tcttactataaaata

SEQ ID NO: 331448 - DNA, 15 bp, Homo sapiens
cttactataaaataa

SEQ ID NO: 331449 - DNA, 15 bp, Homo sapiens
ttactataaaataaa

SEQ ID NO: 331450 - DNA, 15 bp, Homo sapiens
tactataaaataaag

SEQ ID NO: 331451 - DNA, 15 bp, Homo sapiens
actataaaataaagt

SEQ ID NO: 331452 - DNA, 15 bp, Homo sapiens
ctataaaataaagta

SEQ ID NO: 331453 - DNA, 15 bp, Homo sapiens
tataaaataaagtac

SEQ ID NO: 331454 - DNA, 15 bp, Homo sapiens
ataaaataaagtact

SEQ ID NO: 331455 - DNA, 15 bp, Homo sapiens
taaaataaagtactt

SEQ ID NO: 331456 - DNA, 15 bp, Homo sapiens
aaaataaagtacttc

SEQ ID NO: 331457 - DNA, 15 bp, Homo sapiens
aaataaagtacttct

SEQ ID NO: 331458 - DNA, 15 bp, Homo sapiens
aataaagtacttctt

SEQ ID NO: 331459 - DNA, 15 bp, Homo sapiens
ataaagtacttcttg

SEQ ID NO: 331460 - DNA, 15 bp, Homo sapiens
taaagtacttcttgg

SEQ ID NO: 331461 - DNA, 15 bp, Homo sapiens
aaagtacttcttggc

SEQ ID NO: 331462 - DNA, 15 bp, Homo sapiens
aagtacttcttggca

SEQ ID NO: 331463 - DNA, 15 bp, Homo sapiens
agtacttcttggcag

SEQ ID NO: 331464 - DNA, 15 bp, Homo sapiens
gtacttcttggcaga

SEQ ID NO: 331465 - DNA, 15 bp, Homo sapiens
tacttcttggcagat

SEQ ID NO: 331466 - DNA, 15 bp, Homo sapiens
acttcttggcagatc

SEQ ID NO: 331467 - DNA, 15 bp, Homo sapiens
cttcttggcagatca

SEQ ID NO: 331468 - DNA, 15 bp, Homo sapiens
ttcttggcagatcat

SEQ ID NO: 331469 - DNA, 15 bp, Homo sapiens
tcttggcagatcata

SEQ ID NO: 331470 - DNA, 15 bp, Homo sapiens
cttggcagatcatat

SEQ ID NO: 331471 - DNA, 15 bp, Homo sapiens
ttggcagatcatatg

SEQ ID NO: 331472 - DNA, 15 bp, Homo sapiens
tggcagatcatatgg

SEQ ID NO: 331473 - DNA, 15 bp, Homo sapiens
ggcagatcatatggc

SEQ ID NO: 331474 - DNA, 15 bp, Homo sapiens
gcagatcatatggca

SEQ ID NO: 331475 - DNA, 15 bp, Homo sapiens
cagatcatatggcat

SEQ ID NO: 331476 - DNA, 15 bp, Homo sapiens
agatcatatggcatt

SEQ ID NO: 331477 - DNA, 15 bp, Homo sapiens
gatcatatggcattt

SEQ ID NO: 331478 - DNA, 15 bp, Homo sapiens
atcatatggcattta

SEQ ID NO: 331479 - DNA, 15 bp, Homo sapiens
tcatatggcatttat

SEQ ID NO: 331480 - DNA, 15 bp, Homo sapiens
catatggcatttata

SEQ ID NO: 331481 - DNA, 15 bp, Homo sapiens
atatggcatttatag

SEQ ID NO: 331482 - DNA, 15 bp, Homo sapiens
tatggcatttataga

SEQ ID NO: 331483 - DNA, 15 bp, Homo sapiens
atggcatttatagat

SEQ ID NO: 331484 - DNA, 15 bp, Homo sapiens
tggcatttatagatt

SEQ ID NO: 331485 - DNA, 15 bp, Homo sapiens
ggcatttatagattt

SEQ ID NO: 331486 - DNA, 15 bp, Homo sapiens
gcatttatagatttt

SEQ ID NO: 331487 - DNA, 15 bp, Homo sapiens
catttatagattttt

SEQ ID NO: 331488 - DNA, 15 bp, Homo sapiens
atttatagatttttc

SEQ ID NO: 331489 - DNA, 15 bp, Homo sapiens
tttatagatttttct

SEQ ID NO: 331490 - DNA, 15 bp, Homo sapiens
ttatagatttttctt

SEQ ID NO: 331491 - DNA, 15 bp, Homo sapiens
tatagatttttcttc

SEQ ID NO: 331492 - DNA, 15 bp, Homo sapiens
atagatttttcttct

SEQ ID NO: 331493 - DNA, 15 bp, Homo sapiens
tagatttttcttctt

SEQ ID NO: 331494 - DNA, 15 bp, Homo sapiens
agatttttcttctta

SEQ ID NO: 331495 - DNA, 15 bp, Homo sapiens
gatttttcttcttac

SEQ ID NO: 331496 - DNA, 15 bp, Homo sapiens
atttttcttcttact

SEQ ID NO: 331497 - DNA, 15 bp, Homo sapiens
tttttcttcttactt

SEQ ID NO: 331498 - DNA, 15 bp, Homo sapiens
ttttcttcttacttt

SEQ ID NO: 331499 - DNA, 15 bp, Homo sapiens
tttcttcttactttc

SEQ ID NO: 331500 - DNA, 15 bp, Homo sapiens
ttcttcttactttct

SEQ ID NO: 331501 - DNA, 15 bp, Homo sapiens
tcttcttactttctt

SEQ ID NO: 331502 - DNA, 15 bp, Homo sapiens
cttcttactttcttt

SEQ ID NO: 331503 - DNA, 15 bp, Homo sapiens
ttcttactttctttt

SEQ ID NO: 331504 - DNA, 15 bp, Homo sapiens
tcttactttctttta

SEQ ID NO: 331505 - DNA, 15 bp, Homo sapiens
cttactttcttttat

SEQ ID NO: 331506 - DNA, 15 bp, Homo sapiens
ttactttcttttatt

SEQ ID NO: 331507 - DNA, 15 bp, Homo sapiens
tactttcttttattt

SEQ ID NO: 331508 - DNA, 15 bp, Homo sapiens
actttcttttatttg

SEQ ID NO: 331509 - DNA, 15 bp, Homo sapiens
ctttcttttatttga

SEQ ID NO: 331510 - DNA, 15 bp, Homo sapiens
tttcttttatttgat

SEQ ID NO: 331511 - DNA, 15 bp, Homo sapiens
ttcttttatttgatt

SEQ ID NO: 331512 - DNA, 15 bp, Homo sapiens
tcttttatttgattt

SEQ ID NO: 331513 - DNA, 15 bp, Homo sapiens
cttttatttgattta

SEQ ID NO: 331514 - DNA, 15 bp, Homo sapiens
ttttatttgatttat

SEQ ID NO: 331515 - DNA, 15 bp, Homo sapiens
tttatttgatttata

SEQ ID NO: 331516 - DNA, 15 bp, Homo sapiens
ttatttgatttatat

SEQ ID NO: 331517 - DNA, 15 bp, Homo sapiens
tatttgatttatata

SEQ ID NO: 331518 - DNA, 15 bp, Homo sapiens
atttgatttatataa

SEQ ID NO: 331519 - DNA, 15 bp, Homo sapiens
tttgatttatataat

SEQ ID NO: 331520 - DNA, 15 bp, Homo sapiens
ttgatttatataatt

SEQ ID NO: 331521 - DNA, 15 bp, Homo sapiens
tgatttatataattg

SEQ ID NO: 331522 - DNA, 15 bp, Homo sapiens
gatttatataattgg

SEQ ID NO: 331523 - DNA, 15 bp, Homo sapiens
atttatataattggg

SEQ ID NO: 331524 - DNA, 15 bp, Homo sapiens
tttatataattgggt

SEQ ID NO: 331525 - DNA, 15 bp, Homo sapiens
ttatataattgggta

SEQ ID NO: 331526 - DNA, 15 bp, Homo sapiens
tatataattgggtac

SEQ ID NO: 331527 - DNA, 15 bp, Homo sapiens
atataattgggtact

SEQ ID NO: 331528 - DNA, 15 bp, Homo sapiens
tataattgggtactc

SEQ ID NO: 331529 - DNA, 15 bp, Homo sapiens
ataattgggtactct

SEQ ID NO: 331530 - DNA, 15 bp, Homo sapiens
taattgggtactctc

SEQ ID NO: 331531 - DNA, 15 bp, Homo sapiens
aattgggtactctca

SEQ ID NO: 331532 - DNA, 15 bp, Homo sapiens
attgggtactctcaa

SEQ ID NO: 331533 - DNA, 15 bp, Homo sapiens
ttgggtactctcaac

SEQ ID NO: 331534 - DNA, 15 bp, Homo sapiens
tgggtactctcaact

SEQ ID NO: 331535 - DNA, 15 bp, Homo sapiens
gggtactctcaactc

SEQ ID NO: 331536 - DNA, 15 bp, Homo sapiens
ggtactctcaactcc

SEQ ID NO: 331537 - DNA, 15 bp, Homo sapiens
gtactctcaactccc

SEQ ID NO: 331538 - DNA, 15 bp, Homo sapiens
tactctcaactcccg

SEQ ID NO: 331539 - DNA, 15 bp, Homo sapiens
actctcaactcccgt

SEQ ID NO: 331540 - DNA, 15 bp, Homo sapiens
ctctcaactcccgtg

SEQ ID NO: 331541 - DNA, 15 bp, Homo sapiens
tctcaactcccgtga

SEQ ID NO: 331542 - DNA, 15 bp, Homo sapiens
ctcaactcccgtgat

SEQ ID NO: 331543 - DNA, 15 bp, Homo sapiens
tcaactcccgtgatg

SEQ ID NO: 331544 - DNA, 15 bp, Homo sapiens
caactcccgtgatgg

SEQ ID NO: 331545 - DNA, 15 bp, Homo sapiens
aactcccgtgatgga

SEQ ID NO: 331546 - DNA, 15 bp, Homo sapiens
actcccgtgatggag

SEQ ID NO: 331547 - DNA, 15 bp, Homo sapiens
ctcccgtgatggaga

SEQ ID NO: 331548 - DNA, 15 bp, Homo sapiens
tcccgtgatggagag

SEQ ID NO: 331549 - DNA, 15 bp, Homo sapiens
cccgtgatggagaga

SEQ ID NO: 331550 - DNA, 15 bp, Homo sapiens
ccgtgatggagagaa

SEQ ID NO: 331551 - DNA, 15 bp, Homo sapiens
cgtgatggagagaaa

SEQ ID NO: 331552 - DNA, 15 bp, Homo sapiens
gtgatggagagaaag

SEQ ID NO: 331553 - DNA, 15 bp, Homo sapiens
tgatggagagaaagc

SEQ ID NO: 331554 - DNA, 15 bp, Homo sapiens
gatggagagaaagca

SEQ ID NO: 331555 - DNA, 15 bp, Homo sapiens
atggagagaaagcaa

SEQ ID NO: 331556 - DNA, 15 bp, Homo sapiens
tggagagaaagcaaa

SEQ ID NO: 331557 - DNA, 15 bp, Homo sapiens
ggagagaaagcaaag

SEQ ID NO: 331558 - DNA, 15 bp, Homo sapiens
gagagaaagcaaaga

SEQ ID NO: 331559 - DNA, 15 bp, Homo sapiens
agagaaagcaaagaa

SEQ ID NO: 331560 - DNA, 15 bp, Homo sapiens
gagaaagcaaagaaa

SEQ ID NO: 331561 - DNA, 15 bp, Homo sapiens
agaaagcaaagaaac

SEQ ID NO: 331562 - DNA, 15 bp, Homo sapiens
gaaagcaaagaaacc

SEQ ID NO: 331563 - DNA, 15 bp, Homo sapiens
aaagcaaagaaacca

SEQ ID NO: 331564 - DNA, 15 bp, Homo sapiens
aagcaaagaaaccaa

SEQ ID NO: 331565 - DNA, 15 bp, Homo sapiens
agcaaagaaaccaag

SEQ ID NO: 331566 - DNA, 15 bp, Homo sapiens
gcaaagaaaccaaga

SEQ ID NO: 331567 - DNA, 15 bp, Homo sapiens
caaagaaaccaagaa

SEQ ID NO: 331568 - DNA, 15 bp, Homo sapiens
aaagaaaccaagaat

SEQ ID NO: 331569 - DNA, 15 bp, Homo sapiens
aagaaaccaagaata

SEQ ID NO: 331570 - DNA, 15 bp, Homo sapiens
agaaaccaagaatag

SEQ ID NO: 331571 - DNA, 15 bp, Homo sapiens
gaaaccaagaatagg

SEQ ID NO: 331572 - DNA, 15 bp, Homo sapiens
aaaccaagaatagga

SEQ ID NO: 331573 - DNA, 15 bp, Homo sapiens
aaccaagaataggat

SEQ ID NO: 331574 - DNA, 15 bp, Homo sapiens
accaagaataggata

SEQ ID NO: 331575 - DNA, 15 bp, Homo sapiens
ccaagaataggataa

SEQ ID NO: 331576 - DNA, 15 bp, Homo sapiens
caagaataggataac

SEQ ID NO: 331577 - DNA, 15 bp, Homo sapiens
aagaataggataacg

SEQ ID NO: 331578 - DNA, 15 bp, Homo sapiens
agaataggataacgc

SEQ ID NO: 331579 - DNA, 15 bp, Homo sapiens
gaataggataacgct

SEQ ID NO: 331580 - DNA, 15 bp, Homo sapiens
aataggataacgcta

SEQ ID NO: 331581 - DNA, 15 bp, Homo sapiens
ataggataacgctat

SEQ ID NO: 331582 - DNA, 15 bp, Homo sapiens
taggataacgctatg

SEQ ID NO: 331583 - DNA, 15 bp, Homo sapiens
aggataacgctatgg

SEQ ID NO: 331584 - DNA, 15 bp, Homo sapiens
ggataacgctatgga

SEQ ID NO: 331585 - DNA, 15 bp, Homo sapiens
gataacgctatggaa

SEQ ID NO: 331586 - DNA, 15 bp, Homo sapiens
ataacgctatggaat

SEQ ID NO: 331587 - DNA, 15 bp, Homo sapiens
taacgctatggaatg

SEQ ID NO: 331588 - DNA, 15 bp, Homo sapiens
aacgctatggaatgc

SEQ ID NO: 331589 - DNA, 15 bp, Homo sapiens
acgctatggaatgcc

SEQ ID NO: 331590 - DNA, 15 bp, Homo sapiens
cgctatggaatgcct

SEQ ID NO: 331591 - DNA, 15 bp, Homo sapiens
gctatggaatgcctc

SEQ ID NO: 331592 - DNA, 15 bp, Homo sapiens
ctatggaatgcctca

SEQ ID NO: 331593 - DNA, 15 bp, Homo sapiens
tatggaatgcctcaa

SEQ ID NO: 331594 - DNA, 15 bp, Homo sapiens
atggaatgcctcaat

SEQ ID NO: 331595 - DNA, 15 bp, Homo sapiens
tggaatgcctcaatc

SEQ ID NO: 331596 - DNA, 15 bp, Homo sapiens
ggaatgcctcaatct

SEQ ID NO: 331597 - DNA, 15 bp, Homo sapiens
gaatgcctcaatctt

SEQ ID NO: 331598 - DNA, 15 bp, Homo sapiens
aatgcctcaatcttc

SEQ ID NO: 331599 - DNA, 15 bp, Homo sapiens
atgcctcaatcttct

SEQ ID NO: 331600 - DNA, 15 bp, Homo sapiens
tgcctcaatcttctt

SEQ ID NO: 331601 - DNA, 15 bp, Homo sapiens
gcctcaatcttcttt

SEQ ID NO: 331602 - DNA, 15 bp, Homo sapiens
cctcaatcttctttt

SEQ ID NO: 331603 - DNA, 15 bp, Homo sapiens
ctcaatcttctttta

SEQ ID NO: 331604 - DNA, 15 bp, Homo sapiens
tcaatcttcttttag

SEQ ID NO: 331605 - DNA, 15 bp, Homo sapiens
caatcttcttttagt

SEQ ID NO: 331606 - DNA, 15 bp, Homo sapiens
aatcttcttttagtt

SEQ ID NO: 331607 - DNA, 15 bp, Homo sapiens
atcttcttttagttt

SEQ ID NO: 331608 - DNA, 15 bp, Homo sapiens
tcttcttttagtttt

SEQ ID NO: 331609 - DNA, 15 bp, Homo sapiens
cttcttttagttttt

SEQ ID NO: 331610 - DNA, 15 bp, Homo sapiens
ttcttttagtttttt

SEQ ID NO: 331611 - DNA, 15 bp, Homo sapiens
tcttttagtttttta

SEQ ID NO: 331612 - DNA, 15 bp, Homo sapiens
cttttagttttttat

SEQ ID NO: 331613 - DNA, 15 bp, Homo sapiens
ttttagttttttatt

SEQ ID NO: 331614 - DNA, 15 bp, Homo sapiens
tttagttttttattt

SEQ ID NO: 331615 - DNA, 15 bp, Homo sapiens
ttagttttttatttt

SEQ ID NO: 331616 - DNA, 15 bp, Homo sapiens
tagttttttattttt

SEQ ID NO: 331617 - DNA, 15 bp, Homo sapiens
agttttttatttttg

SEQ ID NO: 331618 - DNA, 15 bp, Homo sapiens
gttttttatttttgg

SEQ ID NO: 331619 - DNA, 15 bp, Homo sapiens
ttttttatttttggt

SEQ ID NO: 331620 - DNA, 15 bp, Homo sapiens
tttttatttttggtt

SEQ ID NO: 331621 - DNA, 15 bp, Homo sapiens
ttttatttttggttg

SEQ ID NO: 331622 - DNA, 15 bp, Homo sapiens
tttatttttggttga

SEQ ID NO: 331623 - DNA, 15 bp, Homo sapiens
ttatttttggttgaa

SEQ ID NO: 331624 - DNA, 15 bp, Homo sapiens
tatttttggttgaat

SEQ ID NO: 331625 - DNA, 15 bp, Homo sapiens
atttttggttgaata

SEQ ID NO: 331626 - DNA, 15 bp, Homo sapiens
tttttggttgaataa

SEQ ID NO: 331627 - DNA, 15 bp, Homo sapiens
ttttggttgaataat

SEQ ID NO: 331628 - DNA, 15 bp, Homo sapiens
tttggttgaataatt

SEQ ID NO: 331629 - DNA, 15 bp, Homo sapiens
ttggttgaataattt

SEQ ID NO: 331630 - DNA, 15 bp, Homo sapiens
tggttgaataatttt

SEQ ID NO: 331631 - DNA, 15 bp, Homo sapiens
ggttgaataatttta

SEQ ID NO: 331632 - DNA, 15 bp, Homo sapiens
gttgaataattttag

SEQ ID NO: 331633 - DNA, 15 bp, Homo sapiens
ttgaataattttagt

SEQ ID NO: 331634 - DNA, 15 bp, Homo sapiens
tgaataattttagtt

SEQ ID NO: 331635 - DNA, 15 bp, Homo sapiens
gaataattttagttt

SEQ ID NO: 331636 - DNA, 15 bp, Homo sapiens
aataattttagttta

SEQ ID NO: 331637 - DNA, 15 bp, Homo sapiens
ataattttagtttag

SEQ ID NO: 331638 - DNA, 15 bp, Homo sapiens
taattttagtttagt

SEQ ID NO: 331639 - DNA, 15 bp, Homo sapiens
aattttagtttagtt

SEQ ID NO: 331640 - DNA, 15 bp, Homo sapiens
attttagtttagttc

SEQ ID NO: 331641 - DNA, 15 bp, Homo sapiens
ttttagtttagttca

SEQ ID NO: 331642 - DNA, 15 bp, Homo sapiens
tttagtttagttcat

SEQ ID NO: 331643 - DNA, 15 bp, Homo sapiens
ttagtttagttcatg

SEQ ID NO: 331644 - DNA, 15 bp, Homo sapiens
tagtttagttcatgg

SEQ ID NO: 331645 - DNA, 15 bp, Homo sapiens
agtttagttcatgga

SEQ ID NO: 331646 - DNA, 15 bp, Homo sapiens
gtttagttcatggaa

SEQ ID NO: 331647 - DNA, 15 bp, Homo sapiens
tttagttcatggaat

SEQ ID NO: 331648 - DNA, 15 bp, Homo sapiens
ttagttcatggaata

SEQ ID NO: 331649 - DNA, 15 bp, Homo sapiens
tagttcatggaataa

SEQ ID NO: 331650 - DNA, 15 bp, Homo sapiens
agttcatggaataag

SEQ ID NO: 331651 - DNA, 15 bp, Homo sapiens
gttcatggaataagg

SEQ ID NO: 331652 - DNA, 15 bp, Homo sapiens
ttcatggaataaggt

SEQ ID NO: 331653 - DNA, 15 bp, Homo sapiens
tcatggaataaggta

SEQ ID NO: 331654 - DNA, 15 bp, Homo sapiens
catggaataaggtaa

SEQ ID NO: 331655 - DNA, 15 bp, Homo sapiens
atggaataaggtaaa

SEQ ID NO: 331656 - DNA, 15 bp, Homo sapiens
tggaataaggtaaat

SEQ ID NO: 331657 - DNA, 15 bp, Homo sapiens
ggaataaggtaaata

SEQ ID NO: 331658 - DNA, 15 bp, Homo sapiens
gaataaggtaaatat

SEQ ID NO: 331659 - DNA, 15 bp, Homo sapiens
aataaggtaaatatt

SEQ ID NO: 331660 - DNA, 15 bp, Homo sapiens
ataaggtaaatattt

SEQ ID NO: 331661 - DNA, 15 bp, Homo sapiens
taaggtaaatatttt

SEQ ID NO: 331662 - DNA, 15 bp, Homo sapiens
aaggtaaatatttta

SEQ ID NO: 331663 - DNA, 15 bp, Homo sapiens
aggtaaatattttac

SEQ ID NO: 331664 - DNA, 15 bp, Homo sapiens
ggtaaatattttaca

SEQ ID NO: 331665 - DNA, 15 bp, Homo sapiens
gtaaatattttacat

SEQ ID NO: 331666 - DNA, 15 bp, Homo sapiens
taaatattttacatt

SEQ ID NO: 331667 - DNA, 15 bp, Homo sapiens
aaatattttacattt

SEQ ID NO: 331668 - DNA, 15 bp, Homo sapiens
aatattttacatttg

SEQ ID NO: 331669 - DNA, 15 bp, Homo sapiens
atattttacatttgt

SEQ ID NO: 331670 - DNA, 15 bp, Homo sapiens
tattttacatttgtt

SEQ ID NO: 331671 - DNA, 15 bp, Homo sapiens
attttacatttgtta

SEQ ID NO: 331672 - DNA, 15 bp, Homo sapiens
ttttacatttgttaa

SEQ ID NO: 331673 - DNA, 15 bp, Homo sapiens
tttacatttgttaat

SEQ ID NO: 331674 - DNA, 15 bp, Homo sapiens
ttacatttgttaata

SEQ ID NO: 331675 - DNA, 15 bp, Homo sapiens
tacatttgttaataa

SEQ ID NO: 331676 - DNA, 15 bp, Homo sapiens
acatttgttaataac

SEQ ID NO: 331677 - DNA, 15 bp, Homo sapiens
catttgttaataact

SEQ ID NO: 331678 - DNA, 15 bp, Homo sapiens
atttgttaataactc

SEQ ID NO: 331679 - DNA, 15 bp, Homo sapiens
tttgttaataactcc

SEQ ID NO: 331680 - DNA, 15 bp, Homo sapiens
ttgttaataactcca

SEQ ID NO: 331681 - DNA, 15 bp, Homo sapiens
tgttaataactccat

SEQ ID NO: 331682 - DNA, 15 bp, Homo sapiens
gttaataactccata

SEQ ID NO: 331683 - DNA, 15 bp, Homo sapiens
ttaataactccatac

SEQ ID NO: 331684 - DNA, 15 bp, Homo sapiens
taataactccatact

SEQ ID NO: 331685 - DNA, 15 bp, Homo sapiens
aataactccatactt

SEQ ID NO: 331686 - DNA, 15 bp, Homo sapiens
ataactccatacttt

SEQ ID NO: 331687 - DNA, 15 bp, Homo sapiens
taactccatactttg

SEQ ID NO: 331688 - DNA, 15 bp, Homo sapiens
aactccatactttgt

SEQ ID NO: 331689 - DNA, 15 bp, Homo sapiens
actccatactttgtt

SEQ ID NO: 331690 - DNA, 15 bp, Homo sapiens
ctccatactttgttc

SEQ ID NO: 331691 - DNA, 15 bp, Homo sapiens
tccatactttgttct

SEQ ID NO: 331692 - DNA, 15 bp, Homo sapiens
ccatactttgttcta

SEQ ID NO: 331693 - DNA, 15 bp, Homo sapiens
catactttgttctag

SEQ ID NO: 331694 - DNA, 15 bp, Homo sapiens
atactttgttctagg

SEQ ID NO: 331695 - DNA, 15 bp, Homo sapiens
tactttgttctaggt

SEQ ID NO: 331696 - DNA, 15 bp, Homo sapiens
actttgttctaggtt

SEQ ID NO: 331697 - DNA, 15 bp, Homo sapiens
ctttgttctaggttc

SEQ ID NO: 331698 - DNA, 15 bp, Homo sapiens
tttgttctaggttca

SEQ ID NO: 331699 - DNA, 15 bp, Homo sapiens
ttgttctaggttcag

SEQ ID NO: 331700 - DNA, 15 bp, Homo sapiens
tgttctaggttcagt

SEQ ID NO: 331701 - DNA, 15 bp, Homo sapiens
gttctaggttcagtg

SEQ ID NO: 331702 - DNA, 15 bp, Homo sapiens
ttctaggttcagtgg

SEQ ID NO: 331703 - DNA, 15 bp, Homo sapiens
tctaggttcagtggc

SEQ ID NO: 331704 - DNA, 15 bp, Homo sapiens
ctaggttcagtggct

SEQ ID NO: 331705 - DNA, 15 bp, Homo sapiens
taggttcagtggctt

SEQ ID NO: 331706 - DNA, 15 bp, Homo sapiens
aggttcagtggctta

SEQ ID NO: 331707 - DNA, 15 bp, Homo sapiens
ggttcagtggcttac

SEQ ID NO: 331708 - DNA, 15 bp, Homo sapiens
gttcagtggcttaca

SEQ ID NO: 331709 - DNA, 15 bp, Homo sapiens
ttcagtggcttacaa

SEQ ID NO: 331710 - DNA, 15 bp, Homo sapiens
tcagtggcttacaaa

SEQ ID NO: 331711 - DNA, 15 bp, Homo sapiens
cagtggcttacaaaa

SEQ ID NO: 331712 - DNA, 15 bp, Homo sapiens
agtggcttacaaaaa

SEQ ID NO: 331713 - DNA, 15 bp, Homo sapiens
gtggcttacaaaaat

SEQ ID NO: 331714 - DNA, 15 bp, Homo sapiens
tggcttacaaaaata

SEQ ID NO: 331715 - DNA, 15 bp, Homo sapiens
ggcttacaaaaatat

SEQ ID NO: 331716 - DNA, 15 bp, Homo sapiens
gcttacaaaaatatg

SEQ ID NO: 331717 - DNA, 15 bp, Homo sapiens
cttacaaaaatatgt

SEQ ID NO: 331718 - DNA, 15 bp, Homo sapiens
ttacaaaaatatgta

SEQ ID NO: 331719 - DNA, 15 bp, Homo sapiens
tacaaaaatatgtat

SEQ ID NO: 331720 - DNA, 15 bp, Homo sapiens
acaaaaatatgtata

SEQ ID NO: 331721 - DNA, 15 bp, Homo sapiens
caaaaatatgtataa

SEQ ID NO: 331722 - DNA, 15 bp, Homo sapiens
aaaaatatgtataac

SEQ ID NO: 331723 - DNA, 15 bp, Homo sapiens
aaaatatgtataaca

SEQ ID NO: 331724 - DNA, 15 bp, Homo sapiens
aaatatgtataacaa

SEQ ID NO: 331725 - DNA, 15 bp, Homo sapiens
aatatgtataacaaa

SEQ ID NO: 331726 - DNA, 15 bp, Homo sapiens
atatgtataacaaaa

SEQ ID NO: 331727 - DNA, 15 bp, Homo sapiens
tatgtataacaaaac

SEQ ID NO: 331728 - DNA, 15 bp, Homo sapiens
atgtataacaaaaca

SEQ ID NO: 331729 - DNA, 15 bp, Homo sapiens
tgtataacaaaacaa

SEQ ID NO: 331730 - DNA, 15 bp, Homo sapiens
gtataacaaaacaaa

SEQ ID NO: 331731 - DNA, 15 bp, Homo sapiens
tataacaaaacaaaa

SEQ ID NO: 331732 - DNA, 15 bp, Homo sapiens
ataacaaaacaaaat

SEQ ID NO: 331733 - DNA, 15 bp, Homo sapiens
taacaaaacaaaatt

SEQ ID NO: 331734 - DNA, 15 bp, Homo sapiens
aacaaaacaaaatta

SEQ ID NO: 331735 - DNA, 15 bp, Homo sapiens
acaaaacaaaattaa

SEQ ID NO: 331736 - DNA, 15 bp, Homo sapiens
caaaacaaaattaaa

SEQ ID NO: 331737 - DNA, 15 bp, Homo sapiens
aaaacaaaattaaaa

SEQ ID NO: 331738 - DNA, 15 bp, Homo sapiens
aaacaaaattaaaaa

SEQ ID NO: 331739 - DNA, 15 bp, Homo sapiens
aacaaaattaaaaaa

SEQ ID NO: 331740 - DNA, 15 bp, Homo sapiens
acaaaattaaaaaat

SEQ ID NO: 331741 - DNA, 15 bp, Homo sapiens
caaaattaaaaaatg

SEQ ID NO: 331742 - DNA, 15 bp, Homo sapiens
aaaattaaaaaatga

SEQ ID NO: 331743 - DNA, 15 bp, Homo sapiens
attaaaaaatgaatc

SEQ ID NO: 331744 - DNA, 15 bp, Homo sapiens
ttaaaaaatgaatca

SEQ ID NO: 331745 - DNA, 15 bp, Homo sapiens
taaaaaatgaatcag

SEQ ID NO: 331746 - DNA, 15 bp, Homo sapiens
aaaaaatgaatcagt

SEQ ID NO: 331747 - DNA, 15 bp, Homo sapiens
aaaaatgaatcagta

SEQ ID NO: 331748 - DNA, 15 bp, Homo sapiens
aaaatgaatcagtag

SEQ ID NO: 331749 - DNA, 15 bp, Homo sapiens
aaatgaatcagtaga

SEQ ID NO: 331750 - DNA, 15 bp, Homo sapiens
aatgaatcagtagag

SEQ ID NO: 331751 - DNA, 15 bp, Homo sapiens
atgaatcagtagaga

SEQ ID NO: 331752 - DNA, 15 bp, Homo sapiens
tgaatcagtagagac

SEQ ID NO: 331753 - DNA, 15 bp, Homo sapiens
gaatcagtagagaca

SEQ ID NO: 331754 - DNA, 15 bp, Homo sapiens
aatcagtagagacaa

SEQ ID NO: 331755 - DNA, 15 bp, Homo sapiens
atcagtagagacaaa

SEQ ID NO: 331756 - DNA, 15 bp, Homo sapiens
tcagtagagacaaaa

SEQ ID NO: 331757 - DNA, 15 bp, Homo sapiens
cagtagagacaaaaa

SEQ ID NO: 331758 - DNA, 15 bp, Homo sapiens
agtagagacaaaaag

SEQ ID NO: 331759 - DNA, 15 bp, Homo sapiens
gtagagacaaaaaga

SEQ ID NO: 331760 - DNA, 15 bp, Homo sapiens
tagagacaaaaagag

SEQ ID NO: 331761 - DNA, 15 bp, Homo sapiens
agagacaaaaagagc

SEQ ID NO: 331762 - DNA, 15 bp, Homo sapiens
gagacaaaaagagca

SEQ ID NO: 331763 - DNA, 15 bp, Homo sapiens
agacaaaaagagcat

SEQ ID NO: 331764 - DNA, 15 bp, Homo sapiens
gacaaaaagagcatg

SEQ ID NO: 331765 - DNA, 15 bp, Homo sapiens
acaaaaagagcatgg

SEQ ID NO: 331766 - DNA, 15 bp, Homo sapiens
caaaaagagcatgga

SEQ ID NO: 331767 - DNA, 15 bp, Homo sapiens
aaaaagagcatggat

SEQ ID NO: 331768 - DNA, 15 bp, Homo sapiens
aaaagagcatggatg

SEQ ID NO: 331769 - DNA, 15 bp, Homo sapiens
aaagagcatggatgt

SEQ ID NO: 331770 - DNA, 15 bp, Homo sapiens
aagagcatggatgtt

SEQ ID NO: 331771 - DNA, 15 bp, Homo sapiens
agagcatggatgtta

SEQ ID NO: 331772 - DNA, 15 bp, Homo sapiens
gagcatggatgttaa

SEQ ID NO: 331773 - DNA, 15 bp, Homo sapiens
agcatggatgttaaa

SEQ ID NO: 331774 - DNA, 15 bp, Homo sapiens
gcatggatgttaaaa

SEQ ID NO: 331775 - DNA, 15 bp, Homo sapiens
catggatgttaaaat

SEQ ID NO: 331776 - DNA, 15 bp, Homo sapiens
atggatgttaaaatg

SEQ ID NO: 331777 - DNA, 15 bp, Homo sapiens
tggatgttaaaatgt

SEQ ID NO: 331778 - DNA, 15 bp, Homo sapiens
ggatgttaaaatgta

SEQ ID NO: 331779 - DNA, 15 bp, Homo sapiens
gatgttaaaatgtaa

SEQ ID NO: 331780 - DNA, 15 bp, Homo sapiens
atgttaaaatgtaac

SEQ ID NO: 331781 - DNA, 15 bp, Homo sapiens
tgttaaaatgtaact

SEQ ID NO: 331782 - DNA, 15 bp, Homo sapiens
gttaaaatgtaacta

SEQ ID NO: 331783 - DNA, 15 bp, Homo sapiens
ttaaaatgtaactaa

SEQ ID NO: 331784 - DNA, 15 bp, Homo sapiens
taaaatgtaactaaa

SEQ ID NO: 331785 - DNA, 15 bp, Homo sapiens
aaaatgtaactaaaa

SEQ ID NO: 331786 - DNA, 15 bp, Homo sapiens
aaatgtaactaaaag

SEQ ID NO: 331787 - DNA, 15 bp, Homo sapiens
aatgtaactaaaaga

SEQ ID NO: 331788 - DNA, 15 bp, Homo sapiens
atgtaactaaaagat

SEQ ID NO: 331789 - DNA, 15 bp, Homo sapiens
tgtaactaaaagatg

SEQ ID NO: 331790 - DNA, 15 bp, Homo sapiens
gtaactaaaagatgc

SEQ ID NO: 331791 - DNA, 15 bp, Homo sapiens
taactaaaagatgcc

SEQ ID NO: 331792 - DNA, 15 bp, Homo sapiens
aactaaaagatgccc

SEQ ID NO: 331793 - DNA, 15 bp, Homo sapiens
actaaaagatgccct

SEQ ID NO: 331794 - DNA, 15 bp, Homo sapiens
ctaaaagatgccctg

SEQ ID NO: 331795 - DNA, 15 bp, Homo sapiens
taaaagatgccctgc

SEQ ID NO: 331796 - DNA, 15 bp, Homo sapiens
aaaagatgccctgca

SEQ ID NO: 331797 - DNA, 15 bp, Homo sapiens
aaagatgccctgcac

SEQ ID NO: 331798 - DNA, 15 bp, Homo sapiens
aagatgccctgcacg

SEQ ID NO: 331799 - DNA, 15 bp, Homo sapiens
agatgccctgcacgg

SEQ ID NO: 331800 - DNA, 15 bp, Homo sapiens
gatgccctgcacggt

SEQ ID NO: 331801 - DNA, 15 bp, Homo sapiens
atgccctgcacggtg

SEQ ID NO: 331802 - DNA, 15 bp, Homo sapiens
tgccctgcacggtgg

SEQ ID NO: 331803 - DNA, 15 bp, Homo sapiens
gccctgcacggtggc

SEQ ID NO: 331804 - DNA, 15 bp, Homo sapiens
ccctgcacggtggct

SEQ ID NO: 331805 - DNA, 15 bp, Homo sapiens
cctgcacggtggctc

SEQ ID NO: 331806 - DNA, 15 bp, Homo sapiens
ctgcacggtggctca

SEQ ID NO: 331807 - DNA, 15 bp, Homo sapiens
tgcacggtggctcac

SEQ ID NO: 331808 - DNA, 15 bp, Homo sapiens
gcacggtggctcact

SEQ ID NO: 331809 - DNA, 15 bp, Homo sapiens
cacggtggctcactc

SEQ ID NO: 331810 - DNA, 15 bp, Homo sapiens
acggtggctcactcc

SEQ ID NO: 331811 - DNA, 15 bp, Homo sapiens
cggtggctcactcct

SEQ ID NO: 331812 - DNA, 15 bp, Homo sapiens
ggtggctcactcctg

SEQ ID NO: 331813 - DNA, 15 bp, Homo sapiens
gtggctcactcctgt

SEQ ID NO: 331814 - DNA, 15 bp, Homo sapiens
tggctcactcctgta

SEQ ID NO: 331815 - DNA, 15 bp, Homo sapiens
ggctcactcctgtaa

SEQ ID NO: 331816 - DNA, 15 bp, Homo sapiens
gctcactcctgtaat

SEQ ID NO: 331817 - DNA, 15 bp, Homo sapiens
ctcactcctgtaatc

SEQ ID NO: 331818 - DNA, 15 bp, Homo sapiens
tcactcctgtaatcc

SEQ ID NO: 331819 - DNA, 15 bp, Homo sapiens
cactcctgtaatccc

SEQ ID NO: 331820 - DNA, 15 bp, Homo sapiens
actcctgtaatccca

SEQ ID NO: 331821 - DNA, 15 bp, Homo sapiens
ctcctgtaatcccag

SEQ ID NO: 331822 - DNA, 15 bp, Homo sapiens
cactttgggaggcca

SEQ ID NO: 331823 - DNA, 15 bp, Homo sapiens
tgggaggccaaggcg

SEQ ID NO: 331824 - DNA, 15 bp, Homo sapiens
gggaggccaaggcgg

SEQ ID NO: 331825 - DNA, 15 bp, Homo sapiens
ggaggccaaggcggg

SEQ ID NO: 331826 - DNA, 15 bp, Homo sapiens
gaggccaaggcgggc

SEQ ID NO: 331827 - DNA, 15 bp, Homo sapiens
caaggcgggcggata

SEQ ID NO: 331828 - DNA, 15 bp, Homo sapiens
aaggcgggcggataa

SEQ ID NO: 331829 - DNA, 15 bp, Homo sapiens
aggcgggcggataac

SEQ ID NO: 331830 - DNA, 15 bp, Homo sapiens
ggcgggcggataact

SEQ ID NO: 331831 - DNA, 15 bp, Homo sapiens
gcgggcggataactt

SEQ ID NO: 331832 - DNA, 15 bp, Homo sapiens
cgggcggataacttg

SEQ ID NO: 331833 - DNA, 15 bp, Homo sapiens
gggcggataacttga

SEQ ID NO: 331834 - DNA, 15 bp, Homo sapiens
ggcggataacttgag

SEQ ID NO: 331835 - DNA, 15 bp, Homo sapiens
gcggataacttgagg

SEQ ID NO: 331836 - DNA, 15 bp, Homo sapiens
cggataacttgaggt

SEQ ID NO: 331837 - DNA, 15 bp, Homo sapiens
ggataacttgaggtc

SEQ ID NO: 331838 - DNA, 15 bp, Homo sapiens
gataacttgaggtca

SEQ ID NO: 331839 - DNA, 15 bp, Homo sapiens
ataacttgaggtcag

SEQ ID NO: 331840 - DNA, 15 bp, Homo sapiens
taacttgaggtcagg

SEQ ID NO: 331841 - DNA, 15 bp, Homo sapiens
aacttgaggtcagga

SEQ ID NO: 331842 - DNA, 15 bp, Homo sapiens
accagcctggccaat

SEQ ID NO: 331843 - DNA, 15 bp, Homo sapiens
ccagcctggccaata

SEQ ID NO: 331844 - DNA, 15 bp, Homo sapiens
cagcctggccaatat

SEQ ID NO: 331845 - DNA, 15 bp, Homo sapiens
agcctggccaatatg

SEQ ID NO: 331846 - DNA, 15 bp, Homo sapiens
gcctggccaatatgg

SEQ ID NO: 331847 - DNA, 15 bp, Homo sapiens
cctggccaatatggt

SEQ ID NO: 331848 - DNA, 15 bp, Homo sapiens
ctggccaatatggtg

SEQ ID NO: 331849 - DNA, 15 bp, Homo sapiens
tggccaatatggtga

SEQ ID NO: 331850 - DNA, 15 bp, Homo sapiens
ggccaatatggtgaa

SEQ ID NO: 331851 - DNA, 15 bp, Homo sapiens
gccaatatggtgaaa

SEQ ID NO: 331852 - DNA, 15 bp, Homo sapiens
ccaatatggtgaaac

SEQ ID NO: 331853 - DNA, 15 bp, Homo sapiens
caatatggtgaaacc

SEQ ID NO: 331854 - DNA, 15 bp, Homo sapiens
aatatggtgaaaccc

SEQ ID NO: 331855 - DNA, 15 bp, Homo sapiens
atatggtgaaacccc

SEQ ID NO: 331856 - DNA, 15 bp, Homo sapiens
tatggtgaaacccca

SEQ ID NO: 331857 - DNA, 15 bp, Homo sapiens
accccatctctacta

SEQ ID NO: 331858 - DNA, 15 bp, Homo sapiens
ccccatctctactaa

SEQ ID NO: 331859 - DNA, 15 bp, Homo sapiens
cccatctctactaaa

SEQ ID NO: 331860 - DNA, 15 bp, Homo sapiens
ccatctctactaaaa

SEQ ID NO: 331861 - DNA, 15 bp, Homo sapiens
catctctactaaaaa

SEQ ID NO: 331862 - DNA, 15 bp, Homo sapiens
atctctactaaaaac

SEQ ID NO: 331863 - DNA, 15 bp, Homo sapiens
tctctactaaaaaca

SEQ ID NO: 331864 - DNA, 15 bp, Homo sapiens
ctctactaaaaacac

SEQ ID NO: 331865 - DNA, 15 bp, Homo sapiens
tctactaaaaacaca

SEQ ID NO: 331866 - DNA, 15 bp, Homo sapiens
ctactaaaaacacaa

SEQ ID NO: 331867 - DNA, 15 bp, Homo sapiens
tactaaaaacacaat

SEQ ID NO: 331868 - DNA, 15 bp, Homo sapiens
actaaaaacacaatt

SEQ ID NO: 331869 - DNA, 15 bp, Homo sapiens
ctaaaaacacaattt

SEQ ID NO: 331870 - DNA, 15 bp, Homo sapiens
taaaaacacaatttt

SEQ ID NO: 331871 - DNA, 15 bp, Homo sapiens
aaaaacacaattttt

SEQ ID NO: 331872 - DNA, 15 bp, Homo sapiens
aaaacacaatttttt

SEQ ID NO: 331873 - DNA, 15 bp, Homo sapiens
aaacacaattttttt

SEQ ID NO: 331874 - DNA, 15 bp, Homo sapiens
aacacaatttttttt

SEQ ID NO: 331875 - DNA, 15 bp, Homo sapiens
acacaattttttttt

SEQ ID NO: 331876 - DNA, 15 bp, Homo sapiens
cacaatttttttttt

SEQ ID NO: 331877 - DNA, 15 bp, Homo sapiens
acaattttttttttt

SEQ ID NO: 331878 - DNA, 15 bp, Homo sapiens
tttttttttttttag

SEQ ID NO: 331879 - DNA, 15 bp, Homo sapiens
tttttttttttaggt

SEQ ID NO: 331880 - DNA, 15 bp, Homo sapiens
ttttttttttaggtg

SEQ ID NO: 331881 - DNA, 15 bp, Homo sapiens
tttttttttaggtgg

SEQ ID NO: 331882 - DNA, 15 bp, Homo sapiens
ttttttttaggtgga

SEQ ID NO: 331883 - DNA, 15 bp, Homo sapiens
tttttttaggtggag

SEQ ID NO: 331884 - DNA, 15 bp, Homo sapiens
ttttttaggtggagt

SEQ ID NO: 331885 - DNA, 15 bp, Homo sapiens
tttttaggtggagtc

SEQ ID NO: 331886 - DNA, 15 bp, Homo sapiens
ttttaggtggagtct

SEQ ID NO: 331887 - DNA, 15 bp, Homo sapiens
tttaggtggagtctc

SEQ ID NO: 331888 - DNA, 15 bp, Homo sapiens
ttaggtggagtctca

SEQ ID NO: 331889 - DNA, 15 bp, Homo sapiens
taggtggagtctcac

SEQ ID NO: 331890 - DNA, 15 bp, Homo sapiens
aggtggagtctcact

SEQ ID NO: 331891 - DNA, 15 bp, Homo sapiens
ggtggagtctcactc

SEQ ID NO: 331892 - DNA, 15 bp, Homo sapiens
gtggagtctcactct

SEQ ID NO: 331893 - DNA, 15 bp, Homo sapiens
ctcactctgtcacca

SEQ ID NO: 331894 - DNA, 15 bp, Homo sapiens
tcactctgtcaccag

SEQ ID NO: 331895 - DNA, 15 bp, Homo sapiens
cactctgtcaccagg

SEQ ID NO: 331896 - DNA, 15 bp, Homo sapiens
actctgtcaccaggc

SEQ ID NO: 331897 - DNA, 15 bp, Homo sapiens
ctctgtcaccaggct

SEQ ID NO: 331898 - DNA, 15 bp, Homo sapiens
tctgtcaccaggctg

SEQ ID NO: 331899 - DNA, 15 bp, Homo sapiens
ctgtcaccaggctgg

SEQ ID NO: 331900 - DNA, 15 bp, Homo sapiens
tgtcaccaggctgga

SEQ ID NO: 331901 - DNA, 15 bp, Homo sapiens
gtcaccaggctggag

SEQ ID NO: 331902 - DNA, 15 bp, Homo sapiens
tcaccaggctggagt

SEQ ID NO: 331903 - DNA, 15 bp, Homo sapiens
caccaggctggagtg

SEQ ID NO: 331904 - DNA, 15 bp, Homo sapiens
accaggctggagtgc

SEQ ID NO: 331905 - DNA, 15 bp, Homo sapiens
gtgatctcggctcat

SEQ ID NO: 331906 - DNA, 15 bp, Homo sapiens
tgatctcggctcatt

SEQ ID NO: 331907 - DNA, 15 bp, Homo sapiens
gctcattgcaacctc

SEQ ID NO: 331908 - DNA, 15 bp, Homo sapiens
aacctccgcctcccg

SEQ ID NO: 331909 - DNA, 15 bp, Homo sapiens
acctccgcctcccgg

SEQ ID NO: 331910 - DNA, 15 bp, Homo sapiens
cctccgcctcccggg

SEQ ID NO: 331911 - DNA, 15 bp, Homo sapiens
ctccgcctcccgggc

SEQ ID NO: 331912 - DNA, 15 bp, Homo sapiens
tccgcctcccgggct

SEQ ID NO: 331913 - DNA, 15 bp, Homo sapiens
ccgcctcccgggctc

SEQ ID NO: 331914 - DNA, 15 bp, Homo sapiens
cgcctcccgggctca

SEQ ID NO: 331915 - DNA, 15 bp, Homo sapiens
gcctcccgggctcaa

SEQ ID NO: 331916 - DNA, 15 bp, Homo sapiens
cctcccgggctcaag

SEQ ID NO: 331917 - DNA, 15 bp, Homo sapiens
cgggctcaagtgatt

SEQ ID NO: 331918 - DNA, 15 bp, Homo sapiens
gggctcaagtgattc

SEQ ID NO: 331919 - DNA, 15 bp, Homo sapiens
ggctcaagtgattct

SEQ ID NO: 331920 - DNA, 15 bp, Homo sapiens
gctcaagtgattctc

SEQ ID NO: 331921 - DNA, 15 bp, Homo sapiens
ctcaagtgattctct

SEQ ID NO: 331922 - DNA, 15 bp, Homo sapiens
tcaagtgattctctt

SEQ ID NO: 331923 - DNA, 15 bp, Homo sapiens
caagtgattctcttg

SEQ ID NO: 331924 - DNA, 15 bp, Homo sapiens
aagtgattctcttgc

SEQ ID NO: 331925 - DNA, 15 bp, Homo sapiens
agtgattctcttgcc

SEQ ID NO: 331926 - DNA, 15 bp, Homo sapiens
gtgattctcttgcct

SEQ ID NO: 331927 - DNA, 15 bp, Homo sapiens
tgattctcttgcctc

SEQ ID NO: 331928 - DNA, 15 bp, Homo sapiens
gattctcttgcctca

SEQ ID NO: 331929 - DNA, 15 bp, Homo sapiens
attctcttgcctcag

SEQ ID NO: 331930 - DNA, 15 bp, Homo sapiens
ttctcttgcctcagc

SEQ ID NO: 331931 - DNA, 15 bp, Homo sapiens
tctcttgcctcagct

SEQ ID NO: 331932 - DNA, 15 bp, Homo sapiens
ctcttgcctcagctc

SEQ ID NO: 331933 - DNA, 15 bp, Homo sapiens
tcttgcctcagctcc

SEQ ID NO: 331934 - DNA, 15 bp, Homo sapiens
cttgcctcagctccc

SEQ ID NO: 331935 - DNA, 15 bp, Homo sapiens
ttgcctcagctccca

SEQ ID NO: 331936 - DNA, 15 bp, Homo sapiens
tgcctcagctcccag

SEQ ID NO: 331937 - DNA, 15 bp, Homo sapiens
gcctcagctcccaga

SEQ ID NO: 331938 - DNA, 15 bp, Homo sapiens
cctcagctcccagag

SEQ ID NO: 331939 - DNA, 15 bp, Homo sapiens
ctcagctcccagagt

SEQ ID NO: 331940 - DNA, 15 bp, Homo sapiens
tcagctcccagagta

SEQ ID NO: 331941 - DNA, 15 bp, Homo sapiens
cagctcccagagtag

SEQ ID NO: 331942 - DNA, 15 bp, Homo sapiens
agctcccagagtagc

SEQ ID NO: 331943 - DNA, 15 bp, Homo sapiens
gctcccagagtagct

SEQ ID NO: 331944 - DNA, 15 bp, Homo sapiens
ctcccagagtagctg

SEQ ID NO: 331945 - DNA, 15 bp, Homo sapiens
tcccagagtagctgg

SEQ ID NO: 331946 - DNA, 15 bp, Homo sapiens
cccagagtagctggg

SEQ ID NO: 331947 - DNA, 15 bp, Homo sapiens
tgggactgcaggcac

SEQ ID NO: 331948 - DNA, 15 bp, Homo sapiens
gggactgcaggcacg

SEQ ID NO: 331949 - DNA, 15 bp, Homo sapiens
ggactgcaggcacgt

SEQ ID NO: 331950 - DNA, 15 bp, Homo sapiens
gactgcaggcacgtg

SEQ ID NO: 331951 - DNA, 15 bp, Homo sapiens
actgcaggcacgtgc

SEQ ID NO: 331952 - DNA, 15 bp, Homo sapiens
ctgcaggcacgtgcc

SEQ ID NO: 331953 - DNA, 15 bp, Homo sapiens
tgcaggcacgtgcca

SEQ ID NO: 331954 - DNA, 15 bp, Homo sapiens
gcaggcacgtgccac

SEQ ID NO: 331955 - DNA, 15 bp, Homo sapiens
gcacgtgccaccaca

SEQ ID NO: 331956 - DNA, 15 bp, Homo sapiens
cacgtgccaccacac

SEQ ID NO: 331957 - DNA, 15 bp, Homo sapiens
acgtgccaccacacc

SEQ ID NO: 331958 - DNA, 15 bp, Homo sapiens
cgtgccaccacaccc

SEQ ID NO: 331959 - DNA, 15 bp, Homo sapiens
gtgccaccacaccca

SEQ ID NO: 331960 - DNA, 15 bp, Homo sapiens
ttttagtagagatga

SEQ ID NO: 331961 - DNA, 15 bp, Homo sapiens
tttagtagagatgag

SEQ ID NO: 331962 - DNA, 15 bp, Homo sapiens
ttagtagagatgagg

SEQ ID NO: 331963 - DNA, 15 bp, Homo sapiens
tagtagagatgaggt

SEQ ID NO: 331964 - DNA, 15 bp, Homo sapiens
agtagagatgaggtt

SEQ ID NO: 331965 - DNA, 15 bp, Homo sapiens
tagagatgaggtttc

SEQ ID NO: 331966 - DNA, 15 bp, Homo sapiens
ttggtcaggctggtc

SEQ ID NO: 331967 - DNA, 15 bp, Homo sapiens
tggtcaggctggtct

SEQ ID NO: 331968 - DNA, 15 bp, Homo sapiens
ggtcaggctggtctt

SEQ ID NO: 331969 - DNA, 15 bp, Homo sapiens
gtcaggctggtctta

SEQ ID NO: 331970 - DNA, 15 bp, Homo sapiens
tcaggctggtcttaa

SEQ ID NO: 331971 - DNA, 15 bp, Homo sapiens
caggctggtcttaat

SEQ ID NO: 331972 - DNA, 15 bp, Homo sapiens
aggctggtcttaatc

SEQ ID NO: 331973 - DNA, 15 bp, Homo sapiens
ggctggtcttaatct

SEQ ID NO: 331974 - DNA, 15 bp, Homo sapiens
gctggtcttaatctc

SEQ ID NO: 331975 - DNA, 15 bp, Homo sapiens
ctggtcttaatctcc

SEQ ID NO: 331976 - DNA, 15 bp, Homo sapiens
tggtcttaatctcct

SEQ ID NO: 331977 - DNA, 15 bp, Homo sapiens
ggtcttaatctcctg

SEQ ID NO: 331978 - DNA, 15 bp, Homo sapiens
gtcttaatctcctga

SEQ ID NO: 331979 - DNA, 15 bp, Homo sapiens
tcttaatctcctgac

SEQ ID NO: 331980 - DNA, 15 bp, Homo sapiens
cttaatctcctgacc

SEQ ID NO: 331981 - DNA, 15 bp, Homo sapiens
ttaatctcctgacct

SEQ ID NO: 331982 - DNA, 15 bp, Homo sapiens
taatctcctgacctc

SEQ ID NO: 331983 - DNA, 15 bp, Homo sapiens
aatctcctgacctcg

SEQ ID NO: 331984 - DNA, 15 bp, Homo sapiens
atctcctgacctcgg

SEQ ID NO: 331985 - DNA, 15 bp, Homo sapiens
tctcctgacctcggg

SEQ ID NO: 331986 - DNA, 15 bp, Homo sapiens
ctcctgacctcggga

SEQ ID NO: 331987 - DNA, 15 bp, Homo sapiens
tcctgacctcgggat

SEQ ID NO: 331988 - DNA, 15 bp, Homo sapiens
cctgacctcgggatc

SEQ ID NO: 331989 - DNA, 15 bp, Homo sapiens
ctgacctcgggatcc

SEQ ID NO: 331990 - DNA, 15 bp, Homo sapiens
tgacctcgggatccg

SEQ ID NO: 331991 - DNA, 15 bp, Homo sapiens
gacctcgggatccgc

SEQ ID NO: 331992 - DNA, 15 bp, Homo sapiens
acctcgggatccgcc

SEQ ID NO: 331993 - DNA, 15 bp, Homo sapiens
cctcgggatccgccc

SEQ ID NO: 331994 - DNA, 15 bp, Homo sapiens
ctcgggatccgcccg

SEQ ID NO: 331995 - DNA, 15 bp, Homo sapiens
tcgggatccgcccgc

SEQ ID NO: 331996 - DNA, 15 bp, Homo sapiens
cgggatccgcccgcc

SEQ ID NO: 331997 - DNA, 15 bp, Homo sapiens
gggatccgcccgccc

SEQ ID NO: 331998 - DNA, 15 bp, Homo sapiens
ggatccgcccgcccc

SEQ ID NO: 331999 - DNA, 15 bp, Homo sapiens
gatccgcccgcccct

SEQ ID NO: 332000 - DNA, 15 bp, Homo sapiens
atccgcccgcccctg

SEQ ID NO: 332001 - DNA, 15 bp, Homo sapiens
tccgcccgcccctgc

SEQ ID NO: 332002 - DNA, 15 bp, Homo sapiens
ccgcccgcccctgcc

SEQ ID NO: 332003 - DNA, 15 bp, Homo sapiens
cgcccgcccctgcct

SEQ ID NO: 332004 - DNA, 15 bp, Homo sapiens
gcccgcccctgcctc

SEQ ID NO: 332005 - DNA, 15 bp, Homo sapiens
cccgcccctgcctcc

SEQ ID NO: 332006 - DNA, 15 bp, Homo sapiens
ccgcccctgcctccc

SEQ ID NO: 332007 - DNA, 15 bp, Homo sapiens
cgcccctgcctccca

SEQ ID NO: 332008 - DNA, 15 bp, Homo sapiens
gcccctgcctcccaa

SEQ ID NO: 332009 - DNA, 15 bp, Homo sapiens
cccctgcctcccaaa

SEQ ID NO: 332010 - DNA, 15 bp, Homo sapiens
ccctgcctcccaaag

SEQ ID NO: 332011 - DNA, 15 bp, Homo sapiens
cctgcctcccaaagt

SEQ ID NO: 332012 - DNA, 15 bp, Homo sapiens
tgctgggattacagt

SEQ ID NO: 332013 - DNA, 15 bp, Homo sapiens
tgggattacagttgt

SEQ ID NO: 332014 - DNA, 15 bp, Homo sapiens
gggattacagttgtg

SEQ ID NO: 332015 - DNA, 15 bp, Homo sapiens
ggattacagttgtga

SEQ ID NO: 332016 - DNA, 15 bp, Homo sapiens
gattacagttgtgag

SEQ ID NO: 332017 - DNA, 15 bp, Homo sapiens
attacagttgtgagc

SEQ ID NO: 332018 - DNA, 15 bp, Homo sapiens
ttacagttgtgagct

SEQ ID NO: 332019 - DNA, 15 bp, Homo sapiens
tacagttgtgagcta

SEQ ID NO: 332020 - DNA, 15 bp, Homo sapiens
acagttgtgagctac

SEQ ID NO: 332021 - DNA, 15 bp, Homo sapiens
cagttgtgagctacc

SEQ ID NO: 332022 - DNA, 15 bp, Homo sapiens
agttgtgagctaccg

SEQ ID NO: 332023 - DNA, 15 bp, Homo sapiens
gttgtgagctaccgc

SEQ ID NO: 332024 - DNA, 15 bp, Homo sapiens
ttgtgagctaccgcg

SEQ ID NO: 332025 - DNA, 15 bp, Homo sapiens
tgtgagctaccgcgc

SEQ ID NO: 332026 - DNA, 15 bp, Homo sapiens
gtgagctaccgcgcc

SEQ ID NO: 332027 - DNA, 15 bp, Homo sapiens
tgagctaccgcgccc

SEQ ID NO: 332028 - DNA, 15 bp, Homo sapiens
gagctaccgcgccca

SEQ ID NO: 332029 - DNA, 15 bp, Homo sapiens
agctaccgcgcccag

SEQ ID NO: 332030 - DNA, 15 bp, Homo sapiens
gctaccgcgcccagc

SEQ ID NO: 332031 - DNA, 15 bp, Homo sapiens
ctaccgcgcccagcc

SEQ ID NO: 332032 - DNA, 15 bp, Homo sapiens
taccgcgcccagcct

SEQ ID NO: 332033 - DNA, 15 bp, Homo sapiens
accgcgcccagcctt

SEQ ID NO: 332034 - DNA, 15 bp, Homo sapiens
ccgcgcccagcctta

SEQ ID NO: 332035 - DNA, 15 bp, Homo sapiens
cgcgcccagccttaa

SEQ ID NO: 332036 - DNA, 15 bp, Homo sapiens
gcgcccagccttaaa

SEQ ID NO: 332037 - DNA, 15 bp, Homo sapiens
cgcccagccttaaaa

SEQ ID NO: 332038 - DNA, 15 bp, Homo sapiens
gcccagccttaaaaa

SEQ ID NO: 332039 - DNA, 15 bp, Homo sapiens
cccagccttaaaaat

SEQ ID NO: 332040 - DNA, 15 bp, Homo sapiens
ccagccttaaaaata

SEQ ID NO: 332041 - DNA, 15 bp, Homo sapiens
cagccttaaaaatac

SEQ ID NO: 332042 - DNA, 15 bp, Homo sapiens
agccttaaaaataca

SEQ ID NO: 332043 - DNA, 15 bp, Homo sapiens
gccttaaaaatacaa

SEQ ID NO: 332044 - DNA, 15 bp, Homo sapiens
ccttaaaaatacaaa

SEQ ID NO: 332045 - DNA, 15 bp, Homo sapiens
cttaaaaatacaaaa

SEQ ID NO: 332046 - DNA, 15 bp, Homo sapiens
aaatacaaaaattaa

SEQ ID NO: 332047 - DNA, 15 bp, Homo sapiens
aatacaaaaattaac

SEQ ID NO: 332048 - DNA, 15 bp, Homo sapiens
atacaaaaattaact

SEQ ID NO: 332049 - DNA, 15 bp, Homo sapiens
tacaaaaattaactg

SEQ ID NO: 332050 - DNA, 15 bp, Homo sapiens
acaaaaattaactgg

SEQ ID NO: 332051 - DNA, 15 bp, Homo sapiens
caaaaattaactggg

SEQ ID NO: 332052 - DNA, 15 bp, Homo sapiens
aaaaattaactgggt

SEQ ID NO: 332053 - DNA, 15 bp, Homo sapiens
aaaattaactgggtg

SEQ ID NO: 332054 - DNA, 15 bp, Homo sapiens
aaattaactgggtgt

SEQ ID NO: 332055 - DNA, 15 bp, Homo sapiens
aattaactgggtgtg

SEQ ID NO: 332056 - DNA, 15 bp, Homo sapiens
attaactgggtgtgg

SEQ ID NO: 332057 - DNA, 15 bp, Homo sapiens
ttaactgggtgtggt

SEQ ID NO: 332058 - DNA, 15 bp, Homo sapiens
taactgggtgtggtg

SEQ ID NO: 332059 - DNA, 15 bp, Homo sapiens
aactgggtgtggtgg

SEQ ID NO: 332060 - DNA, 15 bp, Homo sapiens
actgggtgtggtggc

SEQ ID NO: 332061 - DNA, 15 bp, Homo sapiens
ctgggtgtggtggcc

SEQ ID NO: 332062 - DNA, 15 bp, Homo sapiens
tgggtgtggtggcct

SEQ ID NO: 332063 - DNA, 15 bp, Homo sapiens
gggtgtggtggcctg

SEQ ID NO: 332064 - DNA, 15 bp, Homo sapiens
ggtgtggtggcctgc

SEQ ID NO: 332065 - DNA, 15 bp, Homo sapiens
gtgtggtggcctgcg

SEQ ID NO: 332066 - DNA, 15 bp, Homo sapiens
tgtggtggcctgcgc

SEQ ID NO: 332067 - DNA, 15 bp, Homo sapiens
gtggtggcctgcgcc

SEQ ID NO: 332068 - DNA, 15 bp, Homo sapiens
tggtggcctgcgcct

SEQ ID NO: 332069 - DNA, 15 bp, Homo sapiens
ggtggcctgcgcctg

SEQ ID NO: 332070 - DNA, 15 bp, Homo sapiens
gtggcctgcgcctgt

SEQ ID NO: 332071 - DNA, 15 bp, Homo sapiens
tggcctgcgcctgta

SEQ ID NO: 332072 - DNA, 15 bp, Homo sapiens
ggcctgcgcctgtaa

SEQ ID NO: 332073 - DNA, 15 bp, Homo sapiens
gcctgcgcctgtaat

SEQ ID NO: 332074 - DNA, 15 bp, Homo sapiens
cctgcgcctgtaatc

SEQ ID NO: 332075 - DNA, 15 bp, Homo sapiens
ctgcgcctgtaatcc

SEQ ID NO: 332076 - DNA, 15 bp, Homo sapiens
gcctgtaatcccagg

SEQ ID NO: 332077 - DNA, 15 bp, Homo sapiens
cctgtaatcccaggt

SEQ ID NO: 332078 - DNA, 15 bp, Homo sapiens
ctgtaatcccaggta

SEQ ID NO: 332079 - DNA, 15 bp, Homo sapiens
tgtaatcccaggtac

SEQ ID NO: 332080 - DNA, 15 bp, Homo sapiens
gtaatcccaggtact

SEQ ID NO: 332081 - DNA, 15 bp, Homo sapiens
taatcccaggtactt

SEQ ID NO: 332082 - DNA, 15 bp, Homo sapiens
aatcccaggtacttg

SEQ ID NO: 332083 - DNA, 15 bp, Homo sapiens
atcccaggtacttgg

SEQ ID NO: 332084 - DNA, 15 bp, Homo sapiens
tcccaggtacttggg

SEQ ID NO: 332085 - DNA, 15 bp, Homo sapiens
cccaggtacttgggt

SEQ ID NO: 332086 - DNA, 15 bp, Homo sapiens
ccaggtacttgggtg

SEQ ID NO: 332087 - DNA, 15 bp, Homo sapiens
caggtacttgggtga

SEQ ID NO: 332088 - DNA, 15 bp, Homo sapiens
aggtacttgggtgac

SEQ ID NO: 332089 - DNA, 15 bp, Homo sapiens
ggtacttgggtgact

SEQ ID NO: 332090 - DNA, 15 bp, Homo sapiens
gtacttgggtgactg

SEQ ID NO: 332091 - DNA, 15 bp, Homo sapiens
tacttgggtgactga

SEQ ID NO: 332092 - DNA, 15 bp, Homo sapiens
acttgggtgactgag

SEQ ID NO: 332093 - DNA, 15 bp, Homo sapiens
cttgggtgactgagg

SEQ ID NO: 332094 - DNA, 15 bp, Homo sapiens
ttgggtgactgaggc

SEQ ID NO: 332095 - DNA, 15 bp, Homo sapiens
tgggtgactgaggca

SEQ ID NO: 332096 - DNA, 15 bp, Homo sapiens
gggtgactgaggcag

SEQ ID NO: 332097 - DNA, 15 bp, Homo sapiens
ggtgactgaggcagg

SEQ ID NO: 332098 - DNA, 15 bp, Homo sapiens
gtgactgaggcagga

SEQ ID NO: 332099 - DNA, 15 bp, Homo sapiens
tgactgaggcaggag

SEQ ID NO: 332100 - DNA, 15 bp, Homo sapiens
gactgaggcaggaga

SEQ ID NO: 332101 - DNA, 15 bp, Homo sapiens
actgaggcaggagaa

SEQ ID NO: 332102 - DNA, 15 bp, Homo sapiens
gctgagattgtgcct

SEQ ID NO: 332103 - DNA, 15 bp, Homo sapiens
ctgagattgtgcctc

SEQ ID NO: 332104 - DNA, 15 bp, Homo sapiens
tgagattgtgcctct

SEQ ID NO: 332105 - DNA, 15 bp, Homo sapiens
gagattgtgcctctg

SEQ ID NO: 332106 - DNA, 15 bp, Homo sapiens
agattgtgcctctgc

SEQ ID NO: 332107 - DNA, 15 bp, Homo sapiens
gattgtgcctctgca

SEQ ID NO: 332108 - DNA, 15 bp, Homo sapiens
attgtgcctctgcac

SEQ ID NO: 332109 - DNA, 15 bp, Homo sapiens
ttgtgcctctgcact

SEQ ID NO: 332110 - DNA, 15 bp, Homo sapiens
tgtgcctctgcactc

SEQ ID NO: 332111 - DNA, 15 bp, Homo sapiens
gtgcctctgcactcc

SEQ ID NO: 332112 - DNA, 15 bp, Homo sapiens
tgcctctgcactcca

SEQ ID NO: 332113 - DNA, 15 bp, Homo sapiens
gcctctgcactccag

SEQ ID NO: 332114 - DNA, 15 bp, Homo sapiens
cctctgcactccagc

SEQ ID NO: 332115 - DNA, 15 bp, Homo sapiens
ctctgcactccagcc

SEQ ID NO: 332116 - DNA, 15 bp, Homo sapiens
tctgcactccagcct

SEQ ID NO: 332117 - DNA, 15 bp, Homo sapiens
cagagtgagactcca

SEQ ID NO: 332118 - DNA, 15 bp, Homo sapiens
aaaaaaaaaagtaac

SEQ ID NO: 332119 - DNA, 15 bp, Homo sapiens
aaaaaaaaagtaact

SEQ ID NO: 332120 - DNA, 15 bp, Homo sapiens
aaaaaaaagtaacta

SEQ ID NO: 332121 - DNA, 15 bp, Homo sapiens
aaaaaaagtaactaa

SEQ ID NO: 332122 - DNA, 15 bp, Homo sapiens
aaaaaagtaactaaa

SEQ ID NO: 332123 - DNA, 15 bp, Homo sapiens
aaaaagtaactaaaa

SEQ ID NO: 332124 - DNA, 15 bp, Homo sapiens
aaaagtaactaaaag

SEQ ID NO: 332125 - DNA, 15 bp, Homo sapiens
aaagtaactaaaagg

SEQ ID NO: 332126 - DNA, 15 bp, Homo sapiens
aagtaactaaaagga

SEQ ID NO: 332127 - DNA, 15 bp, Homo sapiens
agtaactaaaaggaa

SEQ ID NO: 332128 - DNA, 15 bp, Homo sapiens
gtaactaaaaggaaa

SEQ ID NO: 332129 - DNA, 15 bp, Homo sapiens
taactaaaaggaaat

SEQ ID NO: 332130 - DNA, 15 bp, Homo sapiens
aactaaaaggaaata

SEQ ID NO: 332131 - DNA, 15 bp, Homo sapiens
actaaaaggaaatac

SEQ ID NO: 332132 - DNA, 15 bp, Homo sapiens
ctaaaaggaaatact

SEQ ID NO: 332133 - DNA, 15 bp, Homo sapiens
taaaaggaaatactt

SEQ ID NO: 332134 - DNA, 15 bp, Homo sapiens
aaaaggaaatactta

SEQ ID NO: 332135 - DNA, 15 bp, Homo sapiens
aaaggaaatacttaa

SEQ ID NO: 332136 - DNA, 15 bp, Homo sapiens
aaggaaatacttaaa

SEQ ID NO: 332137 - DNA, 15 bp, Homo sapiens
aggaaatacttaaaa

SEQ ID NO: 332138 - DNA, 15 bp, Homo sapiens
ggaaatacttaaaaa

SEQ ID NO: 332139 - DNA, 15 bp, Homo sapiens
gaaatacttaaaaaa

SEQ ID NO: 332140 - DNA, 15 bp, Homo sapiens
aaatacttaaaaaat

SEQ ID NO: 332141 - DNA, 15 bp, Homo sapiens
aatacttaaaaaata

SEQ ID NO: 332142 - DNA, 15 bp, Homo sapiens
atacttaaaaaatac

SEQ ID NO: 332143 - DNA, 15 bp, Homo sapiens
tacttaaaaaatact

SEQ ID NO: 332144 - DNA, 15 bp, Homo sapiens
acttaaaaaatactg

SEQ ID NO: 332145 - DNA, 15 bp, Homo sapiens
cttaaaaaatactgg

SEQ ID NO: 332146 - DNA, 15 bp, Homo sapiens
ttaaaaaatactgga

SEQ ID NO: 332147 - DNA, 15 bp, Homo sapiens
taaaaaatactggaa

SEQ ID NO: 332148 - DNA, 15 bp, Homo sapiens
aaaaaatactggaat

SEQ ID NO: 332149 - DNA, 15 bp, Homo sapiens
aaaaatactggaatt

SEQ ID NO: 332150 - DNA, 15 bp, Homo sapiens
aaaatactggaattc

SEQ ID NO: 332151 - DNA, 15 bp, Homo sapiens
aaatactggaattcc

SEQ ID NO: 332152 - DNA, 15 bp, Homo sapiens
aatactggaattcct

SEQ ID NO: 332153 - DNA, 15 bp, Homo sapiens
atactggaattcctc

SEQ ID NO: 332154 - DNA, 15 bp, Homo sapiens
tactggaattcctca

SEQ ID NO: 332155 - DNA, 15 bp, Homo sapiens
actggaattcctcaa

SEQ ID NO: 332156 - DNA, 15 bp, Homo sapiens
ctggaattcctcaat

SEQ ID NO: 332157 - DNA, 15 bp, Homo sapiens
tggaattcctcaatc

SEQ ID NO: 332158 - DNA, 15 bp, Homo sapiens
ggaattcctcaatct

SEQ ID NO: 332159 - DNA, 15 bp, Homo sapiens
gaattcctcaatctt

SEQ ID NO: 332160 - DNA, 15 bp, Homo sapiens
aattcctcaatcttg

SEQ ID NO: 332161 - DNA, 15 bp, Homo sapiens
attcctcaatcttga

SEQ ID NO: 332162 - DNA, 15 bp, Homo sapiens
ttcctcaatcttgat

SEQ ID NO: 332163 - DNA, 15 bp, Homo sapiens
tcctcaatcttgatg

SEQ ID NO: 332164 - DNA, 15 bp, Homo sapiens
cctcaatcttgatga

SEQ ID NO: 332165 - DNA, 15 bp, Homo sapiens
ctcaatcttgatgaa

SEQ ID NO: 332166 - DNA, 15 bp, Homo sapiens
tcaatcttgatgaac

SEQ ID NO: 332167 - DNA, 15 bp, Homo sapiens
caatcttgatgaact

SEQ ID NO: 332168 - DNA, 15 bp, Homo sapiens
aatcttgatgaacta

SEQ ID NO: 332169 - DNA, 15 bp, Homo sapiens
atcttgatgaactat

SEQ ID NO: 332170 - DNA, 15 bp, Homo sapiens
tcttgatgaactatc

SEQ ID NO: 332171 - DNA, 15 bp, Homo sapiens
cttgatgaactatcc

SEQ ID NO: 332172 - DNA, 15 bp, Homo sapiens
ttgatgaactatcct

SEQ ID NO: 332173 - DNA, 15 bp, Homo sapiens
tgatgaactatcctt

SEQ ID NO: 332174 - DNA, 15 bp, Homo sapiens
gatgaactatccttt

SEQ ID NO: 332175 - DNA, 15 bp, Homo sapiens
atgaactatcctttc

SEQ ID NO: 332176 - DNA, 15 bp, Homo sapiens
tgaactatcctttcc

SEQ ID NO: 332177 - DNA, 15 bp, Homo sapiens
gaactatcctttcca

SEQ ID NO: 332178 - DNA, 15 bp, Homo sapiens
aactatcctttccat

SEQ ID NO: 332179 - DNA, 15 bp, Homo sapiens
actatcctttccatg

SEQ ID NO: 332180 - DNA, 15 bp, Homo sapiens
ctatcctttccatgt

SEQ ID NO: 332181 - DNA, 15 bp, Homo sapiens
tatcctttccatgtt

SEQ ID NO: 332182 - DNA, 15 bp, Homo sapiens
atcctttccatgttt

SEQ ID NO: 332183 - DNA, 15 bp, Homo sapiens
tcctttccatgtttt

SEQ ID NO: 332184 - DNA, 15 bp, Homo sapiens
cctttccatgttttc

SEQ ID NO: 332185 - DNA, 15 bp, Homo sapiens
ctttccatgttttct

SEQ ID NO: 332186 - DNA, 15 bp, Homo sapiens
tttccatgttttctc

SEQ ID NO: 332187 - DNA, 15 bp, Homo sapiens
ttccatgttttctcc

SEQ ID NO: 332188 - DNA, 15 bp, Homo sapiens
tccatgttttctccc

SEQ ID NO: 332189 - DNA, 15 bp, Homo sapiens
ccatgttttctccca

SEQ ID NO: 332190 - DNA, 15 bp, Homo sapiens
catgttttctcccat

SEQ ID NO: 332191 - DNA, 15 bp, Homo sapiens
atgttttctcccata

SEQ ID NO: 332192 - DNA, 15 bp, Homo sapiens
tgttttctcccatag

SEQ ID NO: 332193 - DNA, 15 bp, Homo sapiens
gttttctcccatagt

SEQ ID NO: 332194 - DNA, 15 bp, Homo sapiens
ttttctcccatagtt

SEQ ID NO: 332195 - DNA, 15 bp, Homo sapiens
tttctcccatagtta

SEQ ID NO: 332196 - DNA, 15 bp, Homo sapiens
ttctcccatagttaa

SEQ ID NO: 332197 - DNA, 15 bp, Homo sapiens
tctcccatagttaaa

SEQ ID NO: 332198 - DNA, 15 bp, Homo sapiens
ctcccatagttaaac

SEQ ID NO: 332199 - DNA, 15 bp, Homo sapiens
tcccatagttaaaca

SEQ ID NO: 332200 - DNA, 15 bp, Homo sapiens
cccatagttaaacaa

SEQ ID NO: 332201 - DNA, 15 bp, Homo sapiens
ccatagttaaacaag

SEQ ID NO: 332202 - DNA, 15 bp, Homo sapiens
catagttaaacaagg

SEQ ID NO: 332203 - DNA, 15 bp, Homo sapiens
atagttaaacaagga

SEQ ID NO: 332204 - DNA, 15 bp, Homo sapiens
tagttaaacaaggag

SEQ ID NO: 332205 - DNA, 15 bp, Homo sapiens
agttaaacaaggagt

SEQ ID NO: 332206 - DNA, 15 bp, Homo sapiens
gttaaacaaggagtt

SEQ ID NO: 332207 - DNA, 15 bp, Homo sapiens
ttaaacaaggagttt

SEQ ID NO: 332208 - DNA, 15 bp, Homo sapiens
taaacaaggagtttt

SEQ ID NO: 332209 - DNA, 15 bp, Homo sapiens
aaacaaggagttttt

SEQ ID NO: 332210 - DNA, 15 bp, Homo sapiens
aacaaggagttttta

SEQ ID NO: 332211 - DNA, 15 bp, Homo sapiens
acaaggagtttttac

SEQ ID NO: 332212 - DNA, 15 bp, Homo sapiens
caaggagtttttact

SEQ ID NO: 332213 - DNA, 15 bp, Homo sapiens
aaggagtttttactt

SEQ ID NO: 332214 - DNA, 15 bp, Homo sapiens
aggagtttttacttc

SEQ ID NO: 332215 - DNA, 15 bp, Homo sapiens
ggagtttttacttct

SEQ ID NO: 332216 - DNA, 15 bp, Homo sapiens
gagtttttacttctt

SEQ ID NO: 332217 - DNA, 15 bp, Homo sapiens
agtttttacttcttt

SEQ ID NO: 332218 - DNA, 15 bp, Homo sapiens
gtttttacttctttt

SEQ ID NO: 332219 - DNA, 15 bp, Homo sapiens
tttttacttcttttg

SEQ ID NO: 332220 - DNA, 15 bp, Homo sapiens
ttttacttcttttgg

SEQ ID NO: 332221 - DNA, 15 bp, Homo sapiens
tttacttcttttggg

SEQ ID NO: 332222 - DNA, 15 bp, Homo sapiens
ttacttcttttgggc

SEQ ID NO: 332223 - DNA, 15 bp, Homo sapiens
tacttcttttgggca

SEQ ID NO: 332224 - DNA, 15 bp, Homo sapiens
acttcttttgggcag

SEQ ID NO: 332225 - DNA, 15 bp, Homo sapiens
cttcttttgggcagt

SEQ ID NO: 332226 - DNA, 15 bp, Homo sapiens
ttcttttgggcagta

SEQ ID NO: 332227 - DNA, 15 bp, Homo sapiens
tcttttgggcagtag

SEQ ID NO: 332228 - DNA, 15 bp, Homo sapiens
cttttgggcagtagc

SEQ ID NO: 332229 - DNA, 15 bp, Homo sapiens
ttttgggcagtagct

SEQ ID NO: 332230 - DNA, 15 bp, Homo sapiens
tttgggcagtagcta

SEQ ID NO: 332231 - DNA, 15 bp, Homo sapiens
ttgggcagtagctac

SEQ ID NO: 332232 - DNA, 15 bp, Homo sapiens
tgggcagtagctaca

SEQ ID NO: 332233 - DNA, 15 bp, Homo sapiens
gggcagtagctacat

SEQ ID NO: 332234 - DNA, 15 bp, Homo sapiens
ggcagtagctacata

SEQ ID NO: 332235 - DNA, 15 bp, Homo sapiens
gcagtagctacatag

SEQ ID NO: 332236 - DNA, 15 bp, Homo sapiens
cagtagctacatagt

SEQ ID NO: 332237 - DNA, 15 bp, Homo sapiens
agtagctacatagta

SEQ ID NO: 332238 - DNA, 15 bp, Homo sapiens
gtagctacatagtat

SEQ ID NO: 332239 - DNA, 15 bp, Homo sapiens
tagctacatagtatg

SEQ ID NO: 332240 - DNA, 15 bp, Homo sapiens
agctacatagtatga

SEQ ID NO: 332241 - DNA, 15 bp, Homo sapiens
gctacatagtatgag

SEQ ID NO: 332242 - DNA, 15 bp, Homo sapiens
ctacatagtatgaga

SEQ ID NO: 332243 - DNA, 15 bp, Homo sapiens
tacatagtatgagac

SEQ ID NO: 332244 - DNA, 15 bp, Homo sapiens
acatagtatgagact

SEQ ID NO: 332245 - DNA, 15 bp, Homo sapiens
catagtatgagactt

SEQ ID NO: 332246 - DNA, 15 bp, Homo sapiens
atagtatgagacttc

SEQ ID NO: 332247 - DNA, 15 bp, Homo sapiens
tagtatgagacttct

SEQ ID NO: 332248 - DNA, 15 bp, Homo sapiens
agtatgagacttcta

SEQ ID NO: 332249 - DNA, 15 bp, Homo sapiens
gtatgagacttctag

SEQ ID NO: 332250 - DNA, 15 bp, Homo sapiens
tatgagacttctagt

SEQ ID NO: 332251 - DNA, 15 bp, Homo sapiens
atgagacttctagta

SEQ ID NO: 332252 - DNA, 15 bp, Homo sapiens
tgagacttctagtag

SEQ ID NO: 332253 - DNA, 15 bp, Homo sapiens
gagacttctagtagt

SEQ ID NO: 332254 - DNA, 15 bp, Homo sapiens
agacttctagtagtg

SEQ ID NO: 332255 - DNA, 15 bp, Homo sapiens
gacttctagtagtgc

SEQ ID NO: 332256 - DNA, 15 bp, Homo sapiens
acttctagtagtgca

SEQ ID NO: 332257 - DNA, 15 bp, Homo sapiens
cttctagtagtgcac

SEQ ID NO: 332258 - DNA, 15 bp, Homo sapiens
ttctagtagtgcact

SEQ ID NO: 332259 - DNA, 15 bp, Homo sapiens
tctagtagtgcacta

SEQ ID NO: 332260 - DNA, 15 bp, Homo sapiens
ctagtagtgcactat

SEQ ID NO: 332261 - DNA, 15 bp, Homo sapiens
tagtagtgcactatg

SEQ ID NO: 332262 - DNA, 15 bp, Homo sapiens
agtagtgcactatgc

SEQ ID NO: 332263 - DNA, 15 bp, Homo sapiens
gtagtgcactatgct

SEQ ID NO: 332264 - DNA, 15 bp, Homo sapiens
tagtgcactatgcta

SEQ ID NO: 332265 - DNA, 15 bp, Homo sapiens
agtgcactatgctaa

SEQ ID NO: 332266 - DNA, 15 bp, Homo sapiens
gtgcactatgctaac

SEQ ID NO: 332267 - DNA, 15 bp, Homo sapiens
tgcactatgctaaca

SEQ ID NO: 332268 - DNA, 15 bp, Homo sapiens
gcactatgctaacat

SEQ ID NO: 332269 - DNA, 15 bp, Homo sapiens
cactatgctaacatc

SEQ ID NO: 332270 - DNA, 15 bp, Homo sapiens
actatgctaacatca

SEQ ID NO: 332271 - DNA, 15 bp, Homo sapiens
ctatgctaacatcat

SEQ ID NO: 332272 - DNA, 15 bp, Homo sapiens
tatgctaacatcatc

SEQ ID NO: 332273 - DNA, 15 bp, Homo sapiens
atgctaacatcatca

SEQ ID NO: 332274 - DNA, 15 bp, Homo sapiens
tgctaacatcatcac

SEQ ID NO: 332275 - DNA, 15 bp, Homo sapiens
gctaacatcatcaca

SEQ ID NO: 332276 - DNA, 15 bp, Homo sapiens
ctaacatcatcacac

SEQ ID NO: 332277 - DNA, 15 bp, Homo sapiens
taacatcatcacact

SEQ ID NO: 332278 - DNA, 15 bp, Homo sapiens
aacatcatcacactt

SEQ ID NO: 332279 - DNA, 15 bp, Homo sapiens
acatcatcacacttg

SEQ ID NO: 332280 - DNA, 15 bp, Homo sapiens
catcatcacacttga

SEQ ID NO: 332281 - DNA, 15 bp, Homo sapiens
atcatcacacttgaa

SEQ ID NO: 332282 - DNA, 15 bp, Homo sapiens
tcatcacacttgaat

SEQ ID NO: 332283 - DNA, 15 bp, Homo sapiens
catcacacttgaatg

SEQ ID NO: 332284 - DNA, 15 bp, Homo sapiens
atcacacttgaatgt

SEQ ID NO: 332285 - DNA, 15 bp, Homo sapiens
tcacacttgaatgtt

SEQ ID NO: 332286 - DNA, 15 bp, Homo sapiens
cacacttgaatgttt

SEQ ID NO: 332287 - DNA, 15 bp, Homo sapiens
acacttgaatgtttt

SEQ ID NO: 332288 - DNA, 15 bp, Homo sapiens
cacttgaatgttttt

SEQ ID NO: 332289 - DNA, 15 bp, Homo sapiens
acttgaatgtttttt

SEQ ID NO: 332290 - DNA, 15 bp, Homo sapiens
cttgaatgttttttg

SEQ ID NO: 332291 - DNA, 15 bp, Homo sapiens
ttgaatgttttttga

SEQ ID NO: 332292 - DNA, 15 bp, Homo sapiens
tgaatgttttttgaa

SEQ ID NO: 332293 - DNA, 15 bp, Homo sapiens
gaatgttttttgaaa

SEQ ID NO: 332294 - DNA, 15 bp, Homo sapiens
aatgttttttgaaaa

SEQ ID NO: 332295 - DNA, 15 bp, Homo sapiens
atgttttttgaaaat

SEQ ID NO: 332296 - DNA, 15 bp, Homo sapiens
tgttttttgaaaata

SEQ ID NO: 332297 - DNA, 15 bp, Homo sapiens
gttttttgaaaatat

SEQ ID NO: 332298 - DNA, 15 bp, Homo sapiens
ttttttgaaaatatt

SEQ ID NO: 332299 - DNA, 15 bp, Homo sapiens
tttttgaaaatattt

SEQ ID NO: 332300 - DNA, 15 bp, Homo sapiens
ttttgaaaatatttt

SEQ ID NO: 332301 - DNA, 15 bp, Homo sapiens
tttgaaaatatttta

SEQ ID NO: 332302 - DNA, 15 bp, Homo sapiens
ttgaaaatattttac

SEQ ID NO: 332303 - DNA, 15 bp, Homo sapiens
tgaaaatattttacg

SEQ ID NO: 332304 - DNA, 15 bp, Homo sapiens
gaaaatattttacgt

SEQ ID NO: 332305 - DNA, 15 bp, Homo sapiens
aaaatattttacgta

SEQ ID NO: 332306 - DNA, 15 bp, Homo sapiens
aaatattttacgtaa

SEQ ID NO: 332307 - DNA, 15 bp, Homo sapiens
aatattttacgtaaa

SEQ ID NO: 332308 - DNA, 15 bp, Homo sapiens
atattttacgtaaaa

SEQ ID NO: 332309 - DNA, 15 bp, Homo sapiens
ttttacgtaaaatac

SEQ ID NO: 332310 - DNA, 15 bp, Homo sapiens
tttacgtaaaataca

SEQ ID NO: 332311 - DNA, 15 bp, Homo sapiens
ttacgtaaaatacat

SEQ ID NO: 332312 - DNA, 15 bp, Homo sapiens
tacgtaaaatacatg

SEQ ID NO: 332313 - DNA, 15 bp, Homo sapiens
acgtaaaatacatgt

SEQ ID NO: 332314 - DNA, 15 bp, Homo sapiens
cgtaaaatacatgtc

SEQ ID NO: 332315 - DNA, 15 bp, Homo sapiens
gtaaaatacatgtcc

SEQ ID NO: 332316 - DNA, 15 bp, Homo sapiens
taaaatacatgtccc

SEQ ID NO: 332317 - DNA, 15 bp, Homo sapiens
aaaatacatgtccca

SEQ ID NO: 332318 - DNA, 15 bp, Homo sapiens
aaatacatgtcccag

SEQ ID NO: 332319 - DNA, 15 bp, Homo sapiens
aatacatgtcccaga

SEQ ID NO: 332320 - DNA, 15 bp, Homo sapiens
atacatgtcccagat

SEQ ID NO: 332321 - DNA, 15 bp, Homo sapiens
tacatgtcccagatg

SEQ ID NO: 332322 - DNA, 15 bp, Homo sapiens
acatgtcccagatgg

SEQ ID NO: 332323 - DNA, 15 bp, Homo sapiens
catgtcccagatgga

SEQ ID NO: 332324 - DNA, 15 bp, Homo sapiens
atgtcccagatggac

SEQ ID NO: 332325 - DNA, 15 bp, Homo sapiens
tgtcccagatggact

SEQ ID NO: 332326 - DNA, 15 bp, Homo sapiens
gtcccagatggactc

SEQ ID NO: 332327 - DNA, 15 bp, Homo sapiens
tcccagatggactct

SEQ ID NO: 332328 - DNA, 15 bp, Homo sapiens
cccagatggactcta

SEQ ID NO: 332329 - DNA, 15 bp, Homo sapiens
ccagatggactctat

SEQ ID NO: 332330 - DNA, 15 bp, Homo sapiens
cagatggactctatt

SEQ ID NO: 332331 - DNA, 15 bp, Homo sapiens
agatggactctattc

SEQ ID NO: 332332 - DNA, 15 bp, Homo sapiens
gatggactctattct

SEQ ID NO: 332333 - DNA, 15 bp, Homo sapiens
atggactctattctt

SEQ ID NO: 332334 - DNA, 15 bp, Homo sapiens
tggactctattcttt

SEQ ID NO: 332335 - DNA, 15 bp, Homo sapiens
ggactctattcttta

SEQ ID NO: 332336 - DNA, 15 bp, Homo sapiens
gactctattctttag

SEQ ID NO: 332337 - DNA, 15 bp, Homo sapiens
actctattctttagt

SEQ ID NO: 332338 - DNA, 15 bp, Homo sapiens
ctctattctttagtt

SEQ ID NO: 332339 - DNA, 15 bp, Homo sapiens
tctattctttagttg

SEQ ID NO: 332340 - DNA, 15 bp, Homo sapiens
ctattctttagttgg

SEQ ID NO: 332341 - DNA, 15 bp, Homo sapiens
tattctttagttggt

SEQ ID NO: 332342 - DNA, 15 bp, Homo sapiens
attctttagttggtt

SEQ ID NO: 332343 - DNA, 15 bp, Homo sapiens
ttctttagttggtta

SEQ ID NO: 332344 - DNA, 15 bp, Homo sapiens
tctttagttggttat

SEQ ID NO: 332345 - DNA, 15 bp, Homo sapiens
ctttagttggttatc

SEQ ID NO: 332346 - DNA, 15 bp, Homo sapiens
tttagttggttatct

SEQ ID NO: 332347 - DNA, 15 bp, Homo sapiens
ttagttggttatcta

SEQ ID NO: 332348 - DNA, 15 bp, Homo sapiens
tagttggttatctag

SEQ ID NO: 332349 - DNA, 15 bp, Homo sapiens
agttggttatctaga

SEQ ID NO: 332350 - DNA, 15 bp, Homo sapiens
gttggttatctagaa

SEQ ID NO: 332351 - DNA, 15 bp, Homo sapiens
ttggttatctagaat

SEQ ID NO: 332352 - DNA, 15 bp, Homo sapiens
tggttatctagaatt

SEQ ID NO: 332353 - DNA, 15 bp, Homo sapiens
ggttatctagaatta

SEQ ID NO: 332354 - DNA, 15 bp, Homo sapiens
gttatctagaattaa

SEQ ID NO: 332355 - DNA, 15 bp, Homo sapiens
ttatctagaattaac

SEQ ID NO: 332356 - DNA, 15 bp, Homo sapiens
tatctagaattaaca

SEQ ID NO: 332357 - DNA, 15 bp, Homo sapiens
atctagaattaacat

SEQ ID NO: 332358 - DNA, 15 bp, Homo sapiens
tctagaattaacatt

SEQ ID NO: 332359 - DNA, 15 bp, Homo sapiens
ctagaattaacattt

SEQ ID NO: 332360 - DNA, 15 bp, Homo sapiens
tagaattaacatttg

SEQ ID NO: 332361 - DNA, 15 bp, Homo sapiens
agaattaacatttgg

SEQ ID NO: 332362 - DNA, 15 bp, Homo sapiens
gaattaacatttgga

SEQ ID NO: 332363 - DNA, 15 bp, Homo sapiens
aattaacatttggat

SEQ ID NO: 332364 - DNA, 15 bp, Homo sapiens
attaacatttggatt

SEQ ID NO: 332365 - DNA, 15 bp, Homo sapiens
ttaacatttggatta

SEQ ID NO: 332366 - DNA, 15 bp, Homo sapiens
taacatttggattat

SEQ ID NO: 332367 - DNA, 15 bp, Homo sapiens
aacatttggattatg

SEQ ID NO: 332368 - DNA, 15 bp, Homo sapiens
acatttggattatgt

SEQ ID NO: 332369 - DNA, 15 bp, Homo sapiens
catttggattatgtt

SEQ ID NO: 332370 - DNA, 15 bp, Homo sapiens
atttggattatgttt

SEQ ID NO: 332371 - DNA, 15 bp, Homo sapiens
tttggattatgtttg

SEQ ID NO: 332372 - DNA, 15 bp, Homo sapiens
ttggattatgtttgc

SEQ ID NO: 332373 - DNA, 15 bp, Homo sapiens
tggattatgtttgct

SEQ ID NO: 332374 - DNA, 15 bp, Homo sapiens
ggattatgtttgcta

SEQ ID NO: 332375 - DNA, 15 bp, Homo sapiens
gattatgtttgctaa

SEQ ID NO: 332376 - DNA, 15 bp, Homo sapiens
attatgtttgctaaa

SEQ ID NO: 332377 - DNA, 15 bp, Homo sapiens
ttatgtttgctaaat

SEQ ID NO: 332378 - DNA, 15 bp, Homo sapiens
tatgtttgctaaatg

SEQ ID NO: 332379 - DNA, 15 bp, Homo sapiens
atgtttgctaaatgc

SEQ ID NO: 332380 - DNA, 15 bp, Homo sapiens
tgtttgctaaatgcg

SEQ ID NO: 332381 - DNA, 15 bp, Homo sapiens
gtttgctaaatgcgt

SEQ ID NO: 332382 - DNA, 15 bp, Homo sapiens
tttgctaaatgcgtc

SEQ ID NO: 332383 - DNA, 15 bp, Homo sapiens
ttgctaaatgcgtca

SEQ ID NO: 332384 - DNA, 15 bp, Homo sapiens
tgctaaatgcgtcag

SEQ ID NO: 332385 - DNA, 15 bp, Homo sapiens
gctaaatgcgtcagc

SEQ ID NO: 332386 - DNA, 15 bp, Homo sapiens
ctaaatgcgtcagcc

SEQ ID NO: 332387 - DNA, 15 bp, Homo sapiens
taaatgcgtcagcca

SEQ ID NO: 332388 - DNA, 15 bp, Homo sapiens
aaatgcgtcagccat

SEQ ID NO: 332389 - DNA, 15 bp, Homo sapiens
aatgcgtcagccata

SEQ ID NO: 332390 - DNA, 15 bp, Homo sapiens
atgcgtcagccatat

SEQ ID NO: 332391 - DNA, 15 bp, Homo sapiens
tgcgtcagccatatc

SEQ ID NO: 332392 - DNA, 15 bp, Homo sapiens
gcgtcagccatatcc

SEQ ID NO: 332393 - DNA, 15 bp, Homo sapiens
cgtcagccatatcct

SEQ ID NO: 332394 - DNA, 15 bp, Homo sapiens
gtcagccatatccta

SEQ ID NO: 332395 - DNA, 15 bp, Homo sapiens
tcagccatatcctaa

SEQ ID NO: 332396 - DNA, 15 bp, Homo sapiens
cagccatatcctaag

SEQ ID NO: 332397 - DNA, 15 bp, Homo sapiens
agccatatcctaagc

SEQ ID NO: 332398 - DNA, 15 bp, Homo sapiens
gccatatcctaagcg

SEQ ID NO: 332399 - DNA, 15 bp, Homo sapiens
ccatatcctaagcgc

SEQ ID NO: 332400 - DNA, 15 bp, Homo sapiens
catatcctaagcgct

SEQ ID NO: 332401 - DNA, 15 bp, Homo sapiens
atatcctaagcgctg

SEQ ID NO: 332402 - DNA, 15 bp, Homo sapiens
tatcctaagcgctgt

SEQ ID NO: 332403 - DNA, 15 bp, Homo sapiens
atcctaagcgctgtg

SEQ ID NO: 332404 - DNA, 15 bp, Homo sapiens
tcctaagcgctgtga

SEQ ID NO: 332405 - DNA, 15 bp, Homo sapiens
cctaagcgctgtgat

SEQ ID NO: 332406 - DNA, 15 bp, Homo sapiens
ctaagcgctgtgatc

SEQ ID NO: 332407 - DNA, 15 bp, Homo sapiens
taagcgctgtgatcc

SEQ ID NO: 332408 - DNA, 15 bp, Homo sapiens
aagcgctgtgatcct

SEQ ID NO: 332409 - DNA, 15 bp, Homo sapiens
agcgctgtgatcctt

SEQ ID NO: 332410 - DNA, 15 bp, Homo sapiens
gcgctgtgatccttt

SEQ ID NO: 332411 - DNA, 15 bp, Homo sapiens
cgctgtgatcctttt

SEQ ID NO: 332412 - DNA, 15 bp, Homo sapiens
gctgtgatcctttta

SEQ ID NO: 332413 - DNA, 15 bp, Homo sapiens
ctgtgatccttttag

SEQ ID NO: 332414 - DNA, 15 bp, Homo sapiens
tgtgatccttttaga

SEQ ID NO: 332415 - DNA, 15 bp, Homo sapiens
gtgatccttttagaa

SEQ ID NO: 332416 - DNA, 15 bp, Homo sapiens
tgatccttttagaac

SEQ ID NO: 332417 - DNA, 15 bp, Homo sapiens
gatccttttagaact

SEQ ID NO: 332418 - DNA, 15 bp, Homo sapiens
atccttttagaacta

SEQ ID NO: 332419 - DNA, 15 bp, Homo sapiens
tccttttagaactat

SEQ ID NO: 332420 - DNA, 15 bp, Homo sapiens
ccttttagaactatt

SEQ ID NO: 332421 - DNA, 15 bp, Homo sapiens
cttttagaactatta

SEQ ID NO: 332422 - DNA, 15 bp, Homo sapiens
ttttagaactattaa

SEQ ID NO: 332423 - DNA, 15 bp, Homo sapiens
tttagaactattaac

SEQ ID NO: 332424 - DNA, 15 bp, Homo sapiens
ttagaactattaaca

SEQ ID NO: 332425 - DNA, 15 bp, Homo sapiens
tagaactattaacag

SEQ ID NO: 332426 - DNA, 15 bp, Homo sapiens
agaactattaacaga

SEQ ID NO: 332427 - DNA, 15 bp, Homo sapiens
gaactattaacagat

SEQ ID NO: 332428 - DNA, 15 bp, Homo sapiens
aactattaacagatg

SEQ ID NO: 332429 - DNA, 15 bp, Homo sapiens
actattaacagatga

SEQ ID NO: 332430 - DNA, 15 bp, Homo sapiens
ctattaacagatgag

SEQ ID NO: 332431 - DNA, 15 bp, Homo sapiens
tattaacagatgaga

SEQ ID NO: 332432 - DNA, 15 bp, Homo sapiens
attaacagatgagac

SEQ ID NO: 332433 - DNA, 15 bp, Homo sapiens
ttaacagatgagact

SEQ ID NO: 332434 - DNA, 15 bp, Homo sapiens
taacagatgagactg

SEQ ID NO: 332435 - DNA, 15 bp, Homo sapiens
aacagatgagactgg

SEQ ID NO: 332436 - DNA, 15 bp, Homo sapiens
acagatgagactggg

SEQ ID NO: 332437 - DNA, 15 bp, Homo sapiens
cagatgagactgggg

SEQ ID NO: 332438 - DNA, 15 bp, Homo sapiens
agatgagactggggg

SEQ ID NO: 332439 - DNA, 15 bp, Homo sapiens
gatgagactgggggg

SEQ ID NO: 332440 - DNA, 15 bp, Homo sapiens
atgagactggggggc

SEQ ID NO: 332441 - DNA, 15 bp, Homo sapiens
tgagactggggggca

SEQ ID NO: 332442 - DNA, 15 bp, Homo sapiens
gagactggggggcat

SEQ ID NO: 332443 - DNA, 15 bp, Homo sapiens
agactggggggcatt

SEQ ID NO: 332444 - DNA, 15 bp, Homo sapiens
gactggggggcattt

SEQ ID NO: 332445 - DNA, 15 bp, Homo sapiens
actggggggcatttt

SEQ ID NO: 332446 - DNA, 15 bp, Homo sapiens
ctggggggcatttta

SEQ ID NO: 332447 - DNA, 15 bp, Homo sapiens
tggggggcattttat

SEQ ID NO: 332448 - DNA, 15 bp, Homo sapiens
ggggggcattttatg

SEQ ID NO: 332449 - DNA, 15 bp, Homo sapiens
gggggcattttatgg

SEQ ID NO: 332450 - DNA, 15 bp, Homo sapiens
ggggcattttatggt

SEQ ID NO: 332451 - DNA, 15 bp, Homo sapiens
gggcattttatggtt

SEQ ID NO: 332452 - DNA, 15 bp, Homo sapiens
ggcattttatggtta

SEQ ID NO: 332453 - DNA, 15 bp, Homo sapiens
gcattttatggttat

SEQ ID NO: 332454 - DNA, 15 bp, Homo sapiens
cattttatggttata

SEQ ID NO: 332455 - DNA, 15 bp, Homo sapiens
attttatggttataa

SEQ ID NO: 332456 - DNA, 15 bp, Homo sapiens
ttttatggttataag

SEQ ID NO: 332457 - DNA, 15 bp, Homo sapiens
tttatggttataaga

SEQ ID NO: 332458 - DNA, 15 bp, Homo sapiens
ttatggttataagag

SEQ ID NO: 332459 - DNA, 15 bp, Homo sapiens
tatggttataagagc

SEQ ID NO: 332460 - DNA, 15 bp, Homo sapiens
atggttataagagct

SEQ ID NO: 332461 - DNA, 15 bp, Homo sapiens
tggttataagagcta

SEQ ID NO: 332462 - DNA, 15 bp, Homo sapiens
ggttataagagctaa

SEQ ID NO: 332463 - DNA, 15 bp, Homo sapiens
gttataagagctaaa

SEQ ID NO: 332464 - DNA, 15 bp, Homo sapiens
ttataagagctaaat

SEQ ID NO: 332465 - DNA, 15 bp, Homo sapiens
tataagagctaaatg

SEQ ID NO: 332466 - DNA, 15 bp, Homo sapiens
ataagagctaaatga

SEQ ID NO: 332467 - DNA, 15 bp, Homo sapiens
taagagctaaatgat

SEQ ID NO: 332468 - DNA, 15 bp, Homo sapiens
aagagctaaatgata

SEQ ID NO: 332469 - DNA, 15 bp, Homo sapiens
agagctaaatgatat

SEQ ID NO: 332470 - DNA, 15 bp, Homo sapiens
gagctaaatgatatt

SEQ ID NO: 332471 - DNA, 15 bp, Homo sapiens
agctaaatgatattt

SEQ ID NO: 332472 - DNA, 15 bp, Homo sapiens
gctaaatgatattta

SEQ ID NO: 332473 - DNA, 15 bp, Homo sapiens
ctaaatgatatttat

SEQ ID NO: 332474 - DNA, 15 bp, Homo sapiens
taaatgatatttatg

SEQ ID NO: 332475 - DNA, 15 bp, Homo sapiens
aaatgatatttatgc

SEQ ID NO: 332476 - DNA, 15 bp, Homo sapiens
aatgatatttatgca

SEQ ID NO: 332477 - DNA, 15 bp, Homo sapiens
atgatatttatgcaa

SEQ ID NO: 332478 - DNA, 15 bp, Homo sapiens
tgatatttatgcaag

SEQ ID NO: 332479 - DNA, 15 bp, Homo sapiens
gatatttatgcaagt

SEQ ID NO: 332480 - DNA, 15 bp, Homo sapiens
atatttatgcaagtg

SEQ ID NO: 332481 - DNA, 15 bp, Homo sapiens
tatttatgcaagtgt

SEQ ID NO: 332482 - DNA, 15 bp, Homo sapiens
atttatgcaagtgtg

SEQ ID NO: 332483 - DNA, 15 bp, Homo sapiens
tttatgcaagtgtgt

SEQ ID NO: 332484 - DNA, 15 bp, Homo sapiens
ttatgcaagtgtgta

SEQ ID NO: 332485 - DNA, 15 bp, Homo sapiens
tatgcaagtgtgtaa

SEQ ID NO: 332486 - DNA, 15 bp, Homo sapiens
atgcaagtgtgtaaa

SEQ ID NO: 332487 - DNA, 15 bp, Homo sapiens
tgcaagtgtgtaaac

SEQ ID NO: 332488 - DNA, 15 bp, Homo sapiens
gcaagtgtgtaaaca

SEQ ID NO: 332489 - DNA, 15 bp, Homo sapiens
caagtgtgtaaacat

SEQ ID NO: 332490 - DNA, 15 bp, Homo sapiens
aagtgtgtaaacatt

SEQ ID NO: 332491 - DNA, 15 bp, Homo sapiens
agtgtgtaaacatta

SEQ ID NO: 332492 - DNA, 15 bp, Homo sapiens
gtgtgtaaacattaa

SEQ ID NO: 332493 - DNA, 15 bp, Homo sapiens
tgtgtaaacattaat

SEQ ID NO: 332494 - DNA, 15 bp, Homo sapiens
gtgtaaacattaata

SEQ ID NO: 332495 - DNA, 15 bp, Homo sapiens
tgtaaacattaataa

SEQ ID NO: 332496 - DNA, 15 bp, Homo sapiens
gtaaacattaataac

SEQ ID NO: 332497 - DNA, 15 bp, Homo sapiens
taaacattaataact

SEQ ID NO: 332498 - DNA, 15 bp, Homo sapiens
aaacattaataactc

SEQ ID NO: 332499 - DNA, 15 bp, Homo sapiens
aacattaataactca

SEQ ID NO: 332500 - DNA, 15 bp, Homo sapiens
acattaataactcag

SEQ ID NO: 332501 - DNA, 15 bp, Homo sapiens
cattaataactcagc

SEQ ID NO: 332502 - DNA, 15 bp, Homo sapiens
attaataactcagcg

SEQ ID NO: 332503 - DNA, 15 bp, Homo sapiens
ttaataactcagcgt

SEQ ID NO: 332504 - DNA, 15 bp, Homo sapiens
taataactcagcgtt

SEQ ID NO: 332505 - DNA, 15 bp, Homo sapiens
aataactcagcgttt

SEQ ID NO: 332506 - DNA, 15 bp, Homo sapiens
ataactcagcgttta

SEQ ID NO: 332507 - DNA, 15 bp, Homo sapiens
taactcagcgtttat

SEQ ID NO: 332508 - DNA, 15 bp, Homo sapiens
aactcagcgtttata

SEQ ID NO: 332509 - DNA, 15 bp, Homo sapiens
actcagcgtttataa

SEQ ID NO: 332510 - DNA, 15 bp, Homo sapiens
ctcagcgtttataag

SEQ ID NO: 332511 - DNA, 15 bp, Homo sapiens
tcagcgtttataagc

SEQ ID NO: 332512 - DNA, 15 bp, Homo sapiens
cagcgtttataagca

SEQ ID NO: 332513 - DNA, 15 bp, Homo sapiens
agcgtttataagcat

SEQ ID NO: 332514 - DNA, 15 bp, Homo sapiens
gcgtttataagcatg

SEQ ID NO: 332515 - DNA, 15 bp, Homo sapiens
cgtttataagcatgt

SEQ ID NO: 332516 - DNA, 15 bp, Homo sapiens
gtttataagcatgtt

SEQ ID NO: 332517 - DNA, 15 bp, Homo sapiens
tttataagcatgtta

SEQ ID NO: 332518 - DNA, 15 bp, Homo sapiens
ttataagcatgttag

SEQ ID NO: 332519 - DNA, 15 bp, Homo sapiens
tataagcatgttaga

SEQ ID NO: 332520 - DNA, 15 bp, Homo sapiens
ataagcatgttagaa

SEQ ID NO: 332521 - DNA, 15 bp, Homo sapiens
taagcatgttagaat

SEQ ID NO: 332522 - DNA, 15 bp, Homo sapiens
aagcatgttagaata

SEQ ID NO: 332523 - DNA, 15 bp, Homo sapiens
agcatgttagaatat

SEQ ID NO: 332524 - DNA, 15 bp, Homo sapiens
gcatgttagaatatt

SEQ ID NO: 332525 - DNA, 15 bp, Homo sapiens
catgttagaatattt

SEQ ID NO: 332526 - DNA, 15 bp, Homo sapiens
atgttagaatatttg

SEQ ID NO: 332527 - DNA, 15 bp, Homo sapiens
tgttagaatatttga

SEQ ID NO: 332528 - DNA, 15 bp, Homo sapiens
gttagaatatttgat

SEQ ID NO: 332529 - DNA, 15 bp, Homo sapiens
ttagaatatttgatt

SEQ ID NO: 332530 - DNA, 15 bp, Homo sapiens
tagaatatttgatta

SEQ ID NO: 332531 - DNA, 15 bp, Homo sapiens
agaatatttgattat

SEQ ID NO: 332532 - DNA, 15 bp, Homo sapiens
gaatatttgattatg

SEQ ID NO: 332533 - DNA, 15 bp, Homo sapiens
aatatttgattatgg

SEQ ID NO: 332534 - DNA, 15 bp, Homo sapiens
atatttgattatggc

SEQ ID NO: 332535 - DNA, 15 bp, Homo sapiens
tatttgattatggct

SEQ ID NO: 332536 - DNA, 15 bp, Homo sapiens
atttgattatggcta

SEQ ID NO: 332537 - DNA, 15 bp, Homo sapiens
tttgattatggctag

SEQ ID NO: 332538 - DNA, 15 bp, Homo sapiens
ttgattatggctagg

SEQ ID NO: 332539 - DNA, 15 bp, Homo sapiens
tgattatggctaggg

SEQ ID NO: 332540 - DNA, 15 bp, Homo sapiens
gattatggctaggga

SEQ ID NO: 332541 - DNA, 15 bp, Homo sapiens
attatggctagggaa

SEQ ID NO: 332542 - DNA, 15 bp, Homo sapiens
ttatggctagggaaa

SEQ ID NO: 332543 - DNA, 15 bp, Homo sapiens
tatggctagggaaat

SEQ ID NO: 332544 - DNA, 15 bp, Homo sapiens
atggctagggaaatg

SEQ ID NO: 332545 - DNA, 15 bp, Homo sapiens
tggctagggaaatgc

SEQ ID NO: 332546 - DNA, 15 bp, Homo sapiens
ggctagggaaatgca

SEQ ID NO: 332547 - DNA, 15 bp, Homo sapiens
gctagggaaatgcat

SEQ ID NO: 332548 - DNA, 15 bp, Homo sapiens
ctagggaaatgcata

SEQ ID NO: 332549 - DNA, 15 bp, Homo sapiens
tagggaaatgcatat

SEQ ID NO: 332550 - DNA, 15 bp, Homo sapiens
agggaaatgcatatt

SEQ ID NO: 332551 - DNA, 15 bp, Homo sapiens
gggaaatgcatatta

SEQ ID NO: 332552 - DNA, 15 bp, Homo sapiens
ggaaatgcatattag

SEQ ID NO: 332553 - DNA, 15 bp, Homo sapiens
gaaatgcatattagc

SEQ ID NO: 332554 - DNA, 15 bp, Homo sapiens
aaatgcatattagct

SEQ ID NO: 332555 - DNA, 15 bp, Homo sapiens
aatgcatattagcta

SEQ ID NO: 332556 - DNA, 15 bp, Homo sapiens
atgcatattagctat

SEQ ID NO: 332557 - DNA, 15 bp, Homo sapiens
tgcatattagctatc

SEQ ID NO: 332558 - DNA, 15 bp, Homo sapiens
gcatattagctatct

SEQ ID NO: 332559 - DNA, 15 bp, Homo sapiens
catattagctatcta

SEQ ID NO: 332560 - DNA, 15 bp, Homo sapiens
atattagctatctag

SEQ ID NO: 332561 - DNA, 15 bp, Homo sapiens
tattagctatctagc

SEQ ID NO: 332562 - DNA, 15 bp, Homo sapiens
attagctatctagca

SEQ ID NO: 332563 - DNA, 15 bp, Homo sapiens
ttagctatctagcac

SEQ ID NO: 332564 - DNA, 15 bp, Homo sapiens
tagctatctagcaca

SEQ ID NO: 332565 - DNA, 15 bp, Homo sapiens
agctatctagcacag

SEQ ID NO: 332566 - DNA, 15 bp, Homo sapiens
gctatctagcacaga

SEQ ID NO: 332567 - DNA, 15 bp, Homo sapiens
ctatctagcacagat

SEQ ID NO: 332568 - DNA, 15 bp, Homo sapiens
tatctagcacagatc

SEQ ID NO: 332569 - DNA, 15 bp, Homo sapiens
atctagcacagatct

SEQ ID NO: 332570 - DNA, 15 bp, Homo sapiens
tctagcacagatcta

SEQ ID NO: 332571 - DNA, 15 bp, Homo sapiens
ctagcacagatctaa

SEQ ID NO: 332572 - DNA, 15 bp, Homo sapiens
tagcacagatctaaa

SEQ ID NO: 332573 - DNA, 15 bp, Homo sapiens
agcacagatctaaaa

SEQ ID NO: 332574 - DNA, 15 bp, Homo sapiens
gcacagatctaaaag

SEQ ID NO: 332575 - DNA, 15 bp, Homo sapiens
cacagatctaaaagt

SEQ ID NO: 332576 - DNA, 15 bp, Homo sapiens
acagatctaaaagtg

SEQ ID NO: 332577 - DNA, 15 bp, Homo sapiens
cagatctaaaagtga

SEQ ID NO: 332578 - DNA, 15 bp, Homo sapiens
agatctaaaagtgat

SEQ ID NO: 332579 - DNA, 15 bp, Homo sapiens
gatctaaaagtgatc

SEQ ID NO: 332580 - DNA, 15 bp, Homo sapiens
atctaaaagtgatct

SEQ ID NO: 332581 - DNA, 15 bp, Homo sapiens
tctaaaagtgatctg

SEQ ID NO: 332582 - DNA, 15 bp, Homo sapiens
ctaaaagtgatctgg

SEQ ID NO: 332583 - DNA, 15 bp, Homo sapiens
taaaagtgatctggg

SEQ ID NO: 332584 - DNA, 15 bp, Homo sapiens
aaaagtgatctgggc

SEQ ID NO: 332585 - DNA, 15 bp, Homo sapiens
aaagtgatctgggct

SEQ ID NO: 332586 - DNA, 15 bp, Homo sapiens
aagtgatctgggcta

SEQ ID NO: 332587 - DNA, 15 bp, Homo sapiens
agtgatctgggctat

SEQ ID NO: 332588 - DNA, 15 bp, Homo sapiens
gtgatctgggctata

SEQ ID NO: 332589 - DNA, 15 bp, Homo sapiens
tgatctgggctatac

SEQ ID NO: 332590 - DNA, 15 bp, Homo sapiens
gatctgggctatacc

SEQ ID NO: 332591 - DNA, 15 bp, Homo sapiens
atctgggctatacct

SEQ ID NO: 332592 - DNA, 15 bp, Homo sapiens
tctgggctatacctt

SEQ ID NO: 332593 - DNA, 15 bp, Homo sapiens
ctgggctataccttt

SEQ ID NO: 332594 - DNA, 15 bp, Homo sapiens
tgggctatacctttc

SEQ ID NO: 332595 - DNA, 15 bp, Homo sapiens
gggctatacctttca

SEQ ID NO: 332596 - DNA, 15 bp, Homo sapiens
ggctatacctttcat

SEQ ID NO: 332597 - DNA, 15 bp, Homo sapiens
gctatacctttcatt

SEQ ID NO: 332598 - DNA, 15 bp, Homo sapiens
ctatacctttcattt

SEQ ID NO: 332599 - DNA, 15 bp, Homo sapiens
tatacctttcatttc

SEQ ID NO: 332600 - DNA, 15 bp, Homo sapiens
atacctttcatttct

SEQ ID NO: 332601 - DNA, 15 bp, Homo sapiens
tacctttcatttctg

SEQ ID NO: 332602 - DNA, 15 bp, Homo sapiens
acctttcatttctgg

SEQ ID NO: 332603 - DNA, 15 bp, Homo sapiens
cctttcatttctgga

SEQ ID NO: 332604 - DNA, 15 bp, Homo sapiens
ctttcatttctggat

SEQ ID NO: 332605 - DNA, 15 bp, Homo sapiens
tttcatttctggatt

SEQ ID NO: 332606 - DNA, 15 bp, Homo sapiens
ttcatttctggattt

SEQ ID NO: 332607 - DNA, 15 bp, Homo sapiens
tcatttctggatttc

SEQ ID NO: 332608 - DNA, 15 bp, Homo sapiens
catttctggatttct

SEQ ID NO: 332609 - DNA, 15 bp, Homo sapiens
atttctggatttctt

SEQ ID NO: 332610 - DNA, 15 bp, Homo sapiens
tttctggatttcttt

SEQ ID NO: 332611 - DNA, 15 bp, Homo sapiens
ttctggatttctttc

SEQ ID NO: 332612 - DNA, 15 bp, Homo sapiens
tctggatttctttcc

SEQ ID NO: 332613 - DNA, 15 bp, Homo sapiens
ctggatttctttcct

SEQ ID NO: 332614 - DNA, 15 bp, Homo sapiens
tggatttctttcctt

SEQ ID NO: 332615 - DNA, 15 bp, Homo sapiens
ggatttctttcctta

SEQ ID NO: 332616 - DNA, 15 bp, Homo sapiens
gatttctttccttaa

SEQ ID NO: 332617 - DNA, 15 bp, Homo sapiens
atttctttccttaag

SEQ ID NO: 332618 - DNA, 15 bp, Homo sapiens
tttctttccttaagc

SEQ ID NO: 332619 - DNA, 15 bp, Homo sapiens
ttctttccttaagct

SEQ ID NO: 332620 - DNA, 15 bp, Homo sapiens
tctttccttaagctt

SEQ ID NO: 332621 - DNA, 15 bp, Homo sapiens
ctttccttaagctta

SEQ ID NO: 332622 - DNA, 15 bp, Homo sapiens
tttccttaagcttaa

SEQ ID NO: 332623 - DNA, 15 bp, Homo sapiens
ttccttaagcttaaa

SEQ ID NO: 332624 - DNA, 15 bp, Homo sapiens
tccttaagcttaaag

SEQ ID NO: 332625 - DNA, 15 bp, Homo sapiens
ccttaagcttaaagg

SEQ ID NO: 332626 - DNA, 15 bp, Homo sapiens
cttaagcttaaaggg

SEQ ID NO: 332627 - DNA, 15 bp, Homo sapiens
ttaagcttaaagggt

SEQ ID NO: 332628 - DNA, 15 bp, Homo sapiens
taagcttaaagggtg

SEQ ID NO: 332629 - DNA, 15 bp, Homo sapiens
aagcttaaagggtgt

SEQ ID NO: 332630 - DNA, 15 bp, Homo sapiens
agcttaaagggtgtt

SEQ ID NO: 332631 - DNA, 15 bp, Homo sapiens
gcttaaagggtgttc

SEQ ID NO: 332632 - DNA, 15 bp, Homo sapiens
cttaaagggtgttct

SEQ ID NO: 332633 - DNA, 15 bp, Homo sapiens
ttaaagggtgttcta

SEQ ID NO: 332634 - DNA, 15 bp, Homo sapiens
taaagggtgttctaa

SEQ ID NO: 332635 - DNA, 15 bp, Homo sapiens
aaagggtgttctaat

SEQ ID NO: 332636 - DNA, 15 bp, Homo sapiens
aagggtgttctaatt

SEQ ID NO: 332637 - DNA, 15 bp, Homo sapiens
agggtgttctaattt

SEQ ID NO: 332638 - DNA, 15 bp, Homo sapiens
gggtgttctaatttc

SEQ ID NO: 332639 - DNA, 15 bp, Homo sapiens
ggtgttctaatttca

SEQ ID NO: 332640 - DNA, 15 bp, Homo sapiens
gtgttctaatttcat

SEQ ID NO: 332641 - DNA, 15 bp, Homo sapiens
tgttctaatttcatt

SEQ ID NO: 332642 - DNA, 15 bp, Homo sapiens
gttctaatttcatta

SEQ ID NO: 332643 - DNA, 15 bp, Homo sapiens
ttctaatttcattat

SEQ ID NO: 332644 - DNA, 15 bp, Homo sapiens
tctaatttcattatt

SEQ ID NO: 332645 - DNA, 15 bp, Homo sapiens
ctaatttcattatta

SEQ ID NO: 332646 - DNA, 15 bp, Homo sapiens
taatttcattattat

SEQ ID NO: 332647 - DNA, 15 bp, Homo sapiens
aatttcattattatc

SEQ ID NO: 332648 - DNA, 15 bp, Homo sapiens
atttcattattatca

SEQ ID NO: 332649 - DNA, 15 bp, Homo sapiens
tttcattattatcaa

SEQ ID NO: 332650 - DNA, 15 bp, Homo sapiens
ttcattattatcaat

SEQ ID NO: 332651 - DNA, 15 bp, Homo sapiens
tcattattatcaatc

SEQ ID NO: 332652 - DNA, 15 bp, Homo sapiens
cattattatcaatct

SEQ ID NO: 332653 - DNA, 15 bp, Homo sapiens
attattatcaatctc

SEQ ID NO: 332654 - DNA, 15 bp, Homo sapiens
ttattatcaatctca

SEQ ID NO: 332655 - DNA, 15 bp, Homo sapiens
tattatcaatctcaa

SEQ ID NO: 332656 - DNA, 15 bp, Homo sapiens
attatcaatctcaag

SEQ ID NO: 332657 - DNA, 15 bp, Homo sapiens
ttatcaatctcaaga

SEQ ID NO: 332658 - DNA, 15 bp, Homo sapiens
tatcaatctcaagat

SEQ ID NO: 332659 - DNA, 15 bp, Homo sapiens
atcaatctcaagatc

SEQ ID NO: 332660 - DNA, 15 bp, Homo sapiens
tcaatctcaagatca

SEQ ID NO: 332661 - DNA, 15 bp, Homo sapiens
caatctcaagatcat

SEQ ID NO: 332662 - DNA, 15 bp, Homo sapiens
aatctcaagatcatt

SEQ ID NO: 332663 - DNA, 15 bp, Homo sapiens
atctcaagatcattt

SEQ ID NO: 332664 - DNA, 15 bp, Homo sapiens
tctcaagatcatttc

SEQ ID NO: 332665 - DNA, 15 bp, Homo sapiens
ctcaagatcatttca

SEQ ID NO: 332666 - DNA, 15 bp, Homo sapiens
tcaagatcatttcac

SEQ ID NO: 332667 - DNA, 15 bp, Homo sapiens
caagatcatttcaca

SEQ ID NO: 332668 - DNA, 15 bp, Homo sapiens
aagatcatttcacag

SEQ ID NO: 332669 - DNA, 15 bp, Homo sapiens
agatcatttcacagt

SEQ ID NO: 332670 - DNA, 15 bp, Homo sapiens
gatcatttcacagtt

SEQ ID NO: 332671 - DNA, 15 bp, Homo sapiens
atcatttcacagttt

SEQ ID NO: 332672 - DNA, 15 bp, Homo sapiens
tcatttcacagtttc

SEQ ID NO: 332673 - DNA, 15 bp, Homo sapiens
catttcacagtttcc

SEQ ID NO: 332674 - DNA, 15 bp, Homo sapiens
atttcacagtttcct

SEQ ID NO: 332675 - DNA, 15 bp, Homo sapiens
tttcacagtttcctg

SEQ ID NO: 332676 - DNA, 15 bp, Homo sapiens
ttcacagtttcctgg

SEQ ID NO: 332677 - DNA, 15 bp, Homo sapiens
tcacagtttcctggt

SEQ ID NO: 332678 - DNA, 15 bp, Homo sapiens
cacagtttcctggtg

SEQ ID NO: 332679 - DNA, 15 bp, Homo sapiens
acagtttcctggtgg

SEQ ID NO: 332680 - DNA, 15 bp, Homo sapiens
cagtttcctggtggt

SEQ ID NO: 332681 - DNA, 15 bp, Homo sapiens
agtttcctggtggtt

SEQ ID NO: 332682 - DNA, 15 bp, Homo sapiens
gtttcctggtggttg

SEQ ID NO: 332683 - DNA, 15 bp, Homo sapiens
tttcctggtggttgg

SEQ ID NO: 332684 - DNA, 15 bp, Homo sapiens
ttcctggtggttggg

SEQ ID NO: 332685 - DNA, 15 bp, Homo sapiens
tcctggtggttgggt

SEQ ID NO: 332686 - DNA, 15 bp, Homo sapiens
cctggtggttgggtg

SEQ ID NO: 332687 - DNA, 15 bp, Homo sapiens
ctggtggttgggtgt

SEQ ID NO: 332688 - DNA, 15 bp, Homo sapiens
tggtggttgggtgtc

SEQ ID NO: 332689 - DNA, 15 bp, Homo sapiens
ggtggttgggtgtca

SEQ ID NO: 332690 - DNA, 15 bp, Homo sapiens
gtggttgggtgtcat

SEQ ID NO: 332691 - DNA, 15 bp, Homo sapiens
tggttgggtgtcatg

SEQ ID NO: 332692 - DNA, 15 bp, Homo sapiens
ggttgggtgtcatgg

SEQ ID NO: 332693 - DNA, 15 bp, Homo sapiens
gttgggtgtcatggt

SEQ ID NO: 332694 - DNA, 15 bp, Homo sapiens
ttgggtgtcatggtg

SEQ ID NO: 332695 - DNA, 15 bp, Homo sapiens
tgggtgtcatggtga

SEQ ID NO: 332696 - DNA, 15 bp, Homo sapiens
gggtgtcatggtgac

SEQ ID NO: 332697 - DNA, 15 bp, Homo sapiens
ggtgtcatggtgact

SEQ ID NO: 332698 - DNA, 15 bp, Homo sapiens
gtgtcatggtgactt

SEQ ID NO: 332699 - DNA, 15 bp, Homo sapiens
tgtcatggtgacttt

SEQ ID NO: 332700 - DNA, 15 bp, Homo sapiens
gtcatggtgactttt

SEQ ID NO: 332701 - DNA, 15 bp, Homo sapiens
tcatggtgacttttt

SEQ ID NO: 332702 - DNA, 15 bp, Homo sapiens
catggtgactttttg

SEQ ID NO: 332703 - DNA, 15 bp, Homo sapiens
atggtgactttttgt

SEQ ID NO: 332704 - DNA, 15 bp, Homo sapiens
tggtgactttttgtt

SEQ ID NO: 332705 - DNA, 15 bp, Homo sapiens
ggtgactttttgttt

SEQ ID NO: 332706 - DNA, 15 bp, Homo sapiens
gtgactttttgtttt

SEQ ID NO: 332707 - DNA, 15 bp, Homo sapiens
tgactttttgttttc

SEQ ID NO: 332708 - DNA, 15 bp, Homo sapiens
gactttttgttttcc

SEQ ID NO: 332709 - DNA, 15 bp, Homo sapiens
actttttgttttcca

SEQ ID NO: 332710 - DNA, 15 bp, Homo sapiens
ctttttgttttccag

SEQ ID NO: 332711 - DNA, 15 bp, Homo sapiens
tttttgttttccagg

SEQ ID NO: 332712 - DNA, 15 bp, Homo sapiens
ttttgttttccaggc

SEQ ID NO: 332713 - DNA, 15 bp, Homo sapiens
tttgttttccaggct

SEQ ID NO: 332714 - DNA, 15 bp, Homo sapiens
ttgttttccaggctc

SEQ ID NO: 332715 - DNA, 15 bp, Homo sapiens
tgttttccaggctct

SEQ ID NO: 332716 - DNA, 15 bp, Homo sapiens
gttttccaggctctt

SEQ ID NO: 332717 - DNA, 15 bp, Homo sapiens
ttttccaggctcttt

SEQ ID NO: 332718 - DNA, 15 bp, Homo sapiens
tttccaggctctttg

SEQ ID NO: 332719 - DNA, 15 bp, Homo sapiens
ttccaggctctttgt

SEQ ID NO: 332720 - DNA, 15 bp, Homo sapiens
tccaggctctttgtt

SEQ ID NO: 332721 - DNA, 15 bp, Homo sapiens
ccaggctctttgttt

SEQ ID NO: 332722 - DNA, 15 bp, Homo sapiens
caggctctttgtttg

SEQ ID NO: 332723 - DNA, 15 bp, Homo sapiens
aggctctttgtttgg

SEQ ID NO: 332724 - DNA, 15 bp, Homo sapiens
ggctctttgtttgga

SEQ ID NO: 332725 - DNA, 15 bp, Homo sapiens
gctctttgtttggat

SEQ ID NO: 332726 - DNA, 15 bp, Homo sapiens
ctctttgtttggata

SEQ ID NO: 332727 - DNA, 15 bp, Homo sapiens
tctttgtttggatat

SEQ ID NO: 332728 - DNA, 15 bp, Homo sapiens
ctttgtttggatatg

SEQ ID NO: 332729 - DNA, 15 bp, Homo sapiens
tttgtttggatatgt

SEQ ID NO: 332730 - DNA, 15 bp, Homo sapiens
ttgtttggatatgtg

SEQ ID NO: 332731 - DNA, 15 bp, Homo sapiens
tgtttggatatgtgg

SEQ ID NO: 332732 - DNA, 15 bp, Homo sapiens
gtttggatatgtggc

SEQ ID NO: 332733 - DNA, 15 bp, Homo sapiens
tttggatatgtggcc

SEQ ID NO: 332734 - DNA, 15 bp, Homo sapiens
ttggatatgtggcct

SEQ ID NO: 332735 - DNA, 15 bp, Homo sapiens
tggatatgtggcctt

SEQ ID NO: 332736 - DNA, 15 bp, Homo sapiens
ggatatgtggccttg

SEQ ID NO: 332737 - DNA, 15 bp, Homo sapiens
gatatgtggccttgt

SEQ ID NO: 332738 - DNA, 15 bp, Homo sapiens
atatgtggccttgtt

SEQ ID NO: 332739 - DNA, 15 bp, Homo sapiens
tatgtggccttgttt

SEQ ID NO: 332740 - DNA, 15 bp, Homo sapiens
atgtggccttgtttg

SEQ ID NO: 332741 - DNA, 15 bp, Homo sapiens
tgtggccttgtttga

SEQ ID NO: 332742 - DNA, 15 bp, Homo sapiens
gtggccttgtttgag

SEQ ID NO: 332743 - DNA, 15 bp, Homo sapiens
tggccttgtttgagt

SEQ ID NO: 332744 - DNA, 15 bp, Homo sapiens
ggccttgtttgagtt

SEQ ID NO: 332745 - DNA, 15 bp, Homo sapiens
gccttgtttgagttg

SEQ ID NO: 332746 - DNA, 15 bp, Homo sapiens
ccttgtttgagttgt

SEQ ID NO: 332747 - DNA, 15 bp, Homo sapiens
cttgtttgagttgtc

SEQ ID NO: 332748 - DNA, 15 bp, Homo sapiens
ttgtttgagttgtct

SEQ ID NO: 332749 - DNA, 15 bp, Homo sapiens
tgtttgagttgtctt

SEQ ID NO: 332750 - DNA, 15 bp, Homo sapiens
gtttgagttgtcttt

SEQ ID NO: 332751 - DNA, 15 bp, Homo sapiens
tttgagttgtctttg

SEQ ID NO: 332752 - DNA, 15 bp, Homo sapiens
ttgagttgtctttga

SEQ ID NO: 332753 - DNA, 15 bp, Homo sapiens
tgagttgtctttgat

SEQ ID NO: 332754 - DNA, 15 bp, Homo sapiens
gagttgtctttgatt

SEQ ID NO: 332755 - DNA, 15 bp, Homo sapiens
agttgtctttgattg

SEQ ID NO: 332756 - DNA, 15 bp, Homo sapiens
gttgtctttgattgc

SEQ ID NO: 332757 - DNA, 15 bp, Homo sapiens
ttgtctttgattgct

SEQ ID NO: 332758 - DNA, 15 bp, Homo sapiens
tgtctttgattgcta

SEQ ID NO: 332759 - DNA, 15 bp, Homo sapiens
gtctttgattgctat

SEQ ID NO: 332760 - DNA, 15 bp, Homo sapiens
tctttgattgctata

SEQ ID NO: 332761 - DNA, 15 bp, Homo sapiens
ctttgattgctatat

SEQ ID NO: 332762 - DNA, 15 bp, Homo sapiens
tttgattgctatata

SEQ ID NO: 332763 - DNA, 15 bp, Homo sapiens
ttgattgctatatat

SEQ ID NO: 332764 - DNA, 15 bp, Homo sapiens
tgattgctatatatc

SEQ ID NO: 332765 - DNA, 15 bp, Homo sapiens
gattgctatatatct

SEQ ID NO: 332766 - DNA, 15 bp, Homo sapiens
attgctatatatctg

SEQ ID NO: 332767 - DNA, 15 bp, Homo sapiens
ttgctatatatctgt

SEQ ID NO: 332768 - DNA, 15 bp, Homo sapiens
tgctatatatctgta

SEQ ID NO: 332769 - DNA, 15 bp, Homo sapiens
gctatatatctgtac

SEQ ID NO: 332770 - DNA, 15 bp, Homo sapiens
ctatatatctgtacc

SEQ ID NO: 332771 - DNA, 15 bp, Homo sapiens
tatatatctgtaccc

SEQ ID NO: 332772 - DNA, 15 bp, Homo sapiens
atatatctgtaccct

SEQ ID NO: 332773 - DNA, 15 bp, Homo sapiens
tatatctgtaccctt

SEQ ID NO: 332774 - DNA, 15 bp, Homo sapiens
atatctgtacccttg

SEQ ID NO: 332775 - DNA, 15 bp, Homo sapiens
tatctgtacccttgt

SEQ ID NO: 332776 - DNA, 15 bp, Homo sapiens
atctgtacccttgtt

SEQ ID NO: 332777 - DNA, 15 bp, Homo sapiens
tctgtacccttgttt

SEQ ID NO: 332778 - DNA, 15 bp, Homo sapiens
ctgtacccttgtttg

SEQ ID NO: 332779 - DNA, 15 bp, Homo sapiens
tgtacccttgtttgc

SEQ ID NO: 332780 - DNA, 15 bp, Homo sapiens
gtacccttgtttgct

SEQ ID NO: 332781 - DNA, 15 bp, Homo sapiens
tacccttgtttgctt

SEQ ID NO: 332782 - DNA, 15 bp, Homo sapiens
acccttgtttgcttt

SEQ ID NO: 332783 - DNA, 15 bp, Homo sapiens
cccttgtttgctttt

SEQ ID NO: 332784 - DNA, 15 bp, Homo sapiens
ccttgtttgcttttg

SEQ ID NO: 332785 - DNA, 15 bp, Homo sapiens
cttgtttgcttttgc

SEQ ID NO: 332786 - DNA, 15 bp, Homo sapiens
ttgtttgcttttgcc

SEQ ID NO: 332787 - DNA, 15 bp, Homo sapiens
tgtttgcttttgcct

SEQ ID NO: 332788 - DNA, 15 bp, Homo sapiens
gtttgcttttgcctg

SEQ ID NO: 332789 - DNA, 15 bp, Homo sapiens
tttgcttttgcctgg

SEQ ID NO: 332790 - DNA, 15 bp, Homo sapiens
ttgcttttgcctggc

SEQ ID NO: 332791 - DNA, 15 bp, Homo sapiens
tgcttttgcctggct

SEQ ID NO: 332792 - DNA, 15 bp, Homo sapiens
gcttttgcctggcta

SEQ ID NO: 332793 - DNA, 15 bp, Homo sapiens
cttttgcctggctac

SEQ ID NO: 332794 - DNA, 15 bp, Homo sapiens
ttttgcctggctact

SEQ ID NO: 332795 - DNA, 15 bp, Homo sapiens
tttgcctggctactg

SEQ ID NO: 332796 - DNA, 15 bp, Homo sapiens
ttgcctggctactga

SEQ ID NO: 332797 - DNA, 15 bp, Homo sapiens
tgcctggctactgat

SEQ ID NO: 332798 - DNA, 15 bp, Homo sapiens
gcctggctactgatt

SEQ ID NO: 332799 - DNA, 15 bp, Homo sapiens
cctggctactgattc

SEQ ID NO: 332800 - DNA, 15 bp, Homo sapiens
ctggctactgattct

SEQ ID NO: 332801 - DNA, 15 bp, Homo sapiens
tggctactgattctc

SEQ ID NO: 332802 - DNA, 15 bp, Homo sapiens
ggctactgattctca

SEQ ID NO: 332803 - DNA, 15 bp, Homo sapiens
gctactgattctcag

SEQ ID NO: 332804 - DNA, 15 bp, Homo sapiens
ctactgattctcagt

SEQ ID NO: 332805 - DNA, 15 bp, Homo sapiens
tactgattctcagtg

SEQ ID NO: 332806 - DNA, 15 bp, Homo sapiens
actgattctcagtgt

SEQ ID NO: 332807 - DNA, 15 bp, Homo sapiens
ctgattctcagtgtt

SEQ ID NO: 332808 - DNA, 15 bp, Homo sapiens
tgattctcagtgttt

SEQ ID NO: 332809 - DNA, 15 bp, Homo sapiens
gattctcagtgtttc

SEQ ID NO: 332810 - DNA, 15 bp, Homo sapiens
attctcagtgtttca

SEQ ID NO: 332811 - DNA, 15 bp, Homo sapiens
ttctcagtgtttcac

SEQ ID NO: 332812 - DNA, 15 bp, Homo sapiens
tctcagtgtttcact

SEQ ID NO: 332813 - DNA, 15 bp, Homo sapiens
ctcagtgtttcactt

SEQ ID NO: 332814 - DNA, 15 bp, Homo sapiens
tcagtgtttcacttt

SEQ ID NO: 332815 - DNA, 15 bp, Homo sapiens
cagtgtttcactttg

SEQ ID NO: 332816 - DNA, 15 bp, Homo sapiens
agtgtttcactttga

SEQ ID NO: 332817 - DNA, 15 bp, Homo sapiens
gtgtttcactttgac

SEQ ID NO: 332818 - DNA, 15 bp, Homo sapiens
tgtttcactttgacc

SEQ ID NO: 332819 - DNA, 15 bp, Homo sapiens
gtttcactttgacct

SEQ ID NO: 332820 - DNA, 15 bp, Homo sapiens
tttcactttgacctt

SEQ ID NO: 332821 - DNA, 15 bp, Homo sapiens
ttcactttgaccttt

SEQ ID NO: 332822 - DNA, 15 bp, Homo sapiens
tcactttgacctttg

SEQ ID NO: 332823 - DNA, 15 bp, Homo sapiens
cactttgacctttga

SEQ ID NO: 332824 - DNA, 15 bp, Homo sapiens
actttgacctttgat

SEQ ID NO: 332825 - DNA, 15 bp, Homo sapiens
ctttgacctttgata

SEQ ID NO: 332826 - DNA, 15 bp, Homo sapiens
tttgacctttgataa

SEQ ID NO: 332827 - DNA, 15 bp, Homo sapiens
ttgacctttgataaa

SEQ ID NO: 332828 - DNA, 15 bp, Homo sapiens
tgacctttgataaag

SEQ ID NO: 332829 - DNA, 15 bp, Homo sapiens
gacctttgataaagc

SEQ ID NO: 332830 - DNA, 15 bp, Homo sapiens
acctttgataaagct

SEQ ID NO: 332831 - DNA, 15 bp, Homo sapiens
cctttgataaagctg

SEQ ID NO: 332832 - DNA, 15 bp, Homo sapiens
ctttgataaagctgt

SEQ ID NO: 332833 - DNA, 15 bp, Homo sapiens
tttgataaagctgtg

SEQ ID NO: 332834 - DNA, 15 bp, Homo sapiens
ttgataaagctgtga

SEQ ID NO: 332835 - DNA, 15 bp, Homo sapiens
tgataaagctgtgac

SEQ ID NO: 332836 - DNA, 15 bp, Homo sapiens
gataaagctgtgact

SEQ ID NO: 332837 - DNA, 15 bp, Homo sapiens
ataaagctgtgactc

SEQ ID NO: 332838 - DNA, 15 bp, Homo sapiens
taaagctgtgactct

SEQ ID NO: 332839 - DNA, 15 bp, Homo sapiens
aaagctgtgactctg

SEQ ID NO: 332840 - DNA, 15 bp, Homo sapiens
aagctgtgactctga

SEQ ID NO: 332841 - DNA, 15 bp, Homo sapiens
agctgtgactctgat

SEQ ID NO: 332842 - DNA, 15 bp, Homo sapiens
gctgtgactctgatt

SEQ ID NO: 332843 - DNA, 15 bp, Homo sapiens
ctgtgactctgattc

SEQ ID NO: 332844 - DNA, 15 bp, Homo sapiens
tgtgactctgattca

SEQ ID NO: 332845 - DNA, 15 bp, Homo sapiens
gtgactctgattcat

SEQ ID NO: 332846 - DNA, 15 bp, Homo sapiens
tgactctgattcatt

SEQ ID NO: 332847 - DNA, 15 bp, Homo sapiens
gactctgattcattt

SEQ ID NO: 332848 - DNA, 15 bp, Homo sapiens
actctgattcatttt

SEQ ID NO: 332849 - DNA, 15 bp, Homo sapiens
ctctgattcattttt

SEQ ID NO: 332850 - DNA, 15 bp, Homo sapiens
tctgattcattttta

SEQ ID NO: 332851 - DNA, 15 bp, Homo sapiens
ctgattcatttttag

SEQ ID NO: 332852 - DNA, 15 bp, Homo sapiens
tgattcatttttagg

SEQ ID NO: 332853 - DNA, 15 bp, Homo sapiens
gattcatttttaggg

SEQ ID NO: 332854 - DNA, 15 bp, Homo sapiens
attcatttttagggg

SEQ ID NO: 332855 - DNA, 15 bp, Homo sapiens
ttcatttttaggggg

SEQ ID NO: 332856 - DNA, 15 bp, Homo sapiens
tcatttttagggggg

SEQ ID NO: 332857 - DNA, 15 bp, Homo sapiens
catttttagggggga

SEQ ID NO: 332858 - DNA, 15 bp, Homo sapiens
atttttaggggggat

SEQ ID NO: 332859 - DNA, 15 bp, Homo sapiens
tttttaggggggatt

SEQ ID NO: 332860 - DNA, 15 bp, Homo sapiens
ttttaggggggattc

SEQ ID NO: 332861 - DNA, 15 bp, Homo sapiens
tttaggggggattca

SEQ ID NO: 332862 - DNA, 15 bp, Homo sapiens
ttaggggggattcac

SEQ ID NO: 332863 - DNA, 15 bp, Homo sapiens
taggggggattcacc

SEQ ID NO: 332864 - DNA, 15 bp, Homo sapiens
aggggggattcacct

SEQ ID NO: 332865 - DNA, 15 bp, Homo sapiens
ggggggattcacctc

SEQ ID NO: 332866 - DNA, 15 bp, Homo sapiens
gggggattcacctcg

SEQ ID NO: 332867 - DNA, 15 bp, Homo sapiens
ggggattcacctcgt

SEQ ID NO: 332868 - DNA, 15 bp, Homo sapiens
gggattcacctcgtt

SEQ ID NO: 332869 - DNA, 15 bp, Homo sapiens
ggattcacctcgttg

SEQ ID NO: 332870 - DNA, 15 bp, Homo sapiens
gattcacctcgttgg

SEQ ID NO: 332871 - DNA, 15 bp, Homo sapiens
attcacctcgttggt

SEQ ID NO: 332872 - DNA, 15 bp, Homo sapiens
ttcacctcgttggtg

SEQ ID NO: 332873 - DNA, 15 bp, Homo sapiens
tcacctcgttggtgg

SEQ ID NO: 332874 - DNA, 15 bp, Homo sapiens
cacctcgttggtgga

SEQ ID NO: 332875 - DNA, 15 bp, Homo sapiens
acctcgttggtggaa

SEQ ID NO: 332876 - DNA, 15 bp, Homo sapiens
cctcgttggtggaat

SEQ ID NO: 332877 - DNA, 15 bp, Homo sapiens
ctcgttggtggaatc

SEQ ID NO: 332878 - DNA, 15 bp, Homo sapiens
tcgttggtggaatct

SEQ ID NO: 332879 - DNA, 15 bp, Homo sapiens
cgttggtggaatcta

SEQ ID NO: 332880 - DNA, 15 bp, Homo sapiens
gttggtggaatctag

SEQ ID NO: 332881 - DNA, 15 bp, Homo sapiens
ttggtggaatctagc

SEQ ID NO: 332882 - DNA, 15 bp, Homo sapiens
tggtggaatctagcc

SEQ ID NO: 332883 - DNA, 15 bp, Homo sapiens
ggtggaatctagcct

SEQ ID NO: 332884 - DNA, 15 bp, Homo sapiens
gtggaatctagcctt

SEQ ID NO: 332885 - DNA, 15 bp, Homo sapiens
tggaatctagccttg

SEQ ID NO: 332886 - DNA, 15 bp, Homo sapiens
ggaatctagccttgc

SEQ ID NO: 332887 - DNA, 15 bp, Homo sapiens
gaatctagccttgcc

SEQ ID NO: 332888 - DNA, 15 bp, Homo sapiens
aatctagccttgccc

SEQ ID NO: 332889 - DNA, 15 bp, Homo sapiens
atctagccttgccct

SEQ ID NO: 332890 - DNA, 15 bp, Homo sapiens
tctagccttgccctg

SEQ ID NO: 332891 - DNA, 15 bp, Homo sapiens
ctagccttgccctgc

SEQ ID NO: 332892 - DNA, 15 bp, Homo sapiens
tagccttgccctgcc

SEQ ID NO: 332893 - DNA, 15 bp, Homo sapiens
agccttgccctgcca

SEQ ID NO: 332894 - DNA, 15 bp, Homo sapiens
gccttgccctgccag

SEQ ID NO: 332895 - DNA, 15 bp, Homo sapiens
ccttgccctgccagg

SEQ ID NO: 332896 - DNA, 15 bp, Homo sapiens
cttgccctgccaggc

SEQ ID NO: 332897 - DNA, 15 bp, Homo sapiens
ttgccctgccaggcg

SEQ ID NO: 332898 - DNA, 15 bp, Homo sapiens
tgccctgccaggcgg

SEQ ID NO: 332899 - DNA, 15 bp, Homo sapiens
gccctgccaggcggc

SEQ ID NO: 332900 - DNA, 15 bp, Homo sapiens
ccctgccaggcggct

SEQ ID NO: 332901 - DNA, 15 bp, Homo sapiens
cctgccaggcggctg

SEQ ID NO: 332902 - DNA, 15 bp, Homo sapiens
ctgccaggcggctgc

SEQ ID NO: 332903 - DNA, 15 bp, Homo sapiens
tgccaggcggctgcc

SEQ ID NO: 332904 - DNA, 15 bp, Homo sapiens
gccaggcggctgcct

SEQ ID NO: 332905 - DNA, 15 bp, Homo sapiens
ccaggcggctgcctg

SEQ ID NO: 332906 - DNA, 15 bp, Homo sapiens
caggcggctgcctgg

SEQ ID NO: 332907 - DNA, 15 bp, Homo sapiens
aggcggctgcctggg

SEQ ID NO: 332908 - DNA, 15 bp, Homo sapiens
ggcggctgcctgggt

SEQ ID NO: 332909 - DNA, 15 bp, Homo sapiens
gcggctgcctgggtg

SEQ ID NO: 332910 - DNA, 15 bp, Homo sapiens
cggctgcctgggtgt

SEQ ID NO: 332911 - DNA, 15 bp, Homo sapiens
ggctgcctgggtgtt

SEQ ID NO: 332912 - DNA, 15 bp, Homo sapiens
gctgcctgggtgttg

SEQ ID NO: 332913 - DNA, 15 bp, Homo sapiens
ctgcctgggtgttgc

SEQ ID NO: 332914 - DNA, 15 bp, Homo sapiens
tgcctgggtgttgct

SEQ ID NO: 332915 - DNA, 15 bp, Homo sapiens
gcctgggtgttgctt

SEQ ID NO: 332916 - DNA, 15 bp, Homo sapiens
cctgggtgttgcttg

SEQ ID NO: 332917 - DNA, 15 bp, Homo sapiens
ctgggtgttgcttgc

SEQ ID NO: 332918 - DNA, 15 bp, Homo sapiens
tgggtgttgcttgct

SEQ ID NO: 332919 - DNA, 15 bp, Homo sapiens
gggtgttgcttgctg

SEQ ID NO: 332920 - DNA, 15 bp, Homo sapiens
ggtgttgcttgctgg

SEQ ID NO: 332921 - DNA, 15 bp, Homo sapiens
gtgttgcttgctggt

SEQ ID NO: 332922 - DNA, 15 bp, Homo sapiens
tgttgcttgctggtt

SEQ ID NO: 332923 - DNA, 15 bp, Homo sapiens
gttgcttgctggttg

SEQ ID NO: 332924 - DNA, 15 bp, Homo sapiens
ttgcttgctggttgg

SEQ ID NO: 332925 - DNA, 15 bp, Homo sapiens
tgcttgctggttgga

SEQ ID NO: 332926 - DNA, 15 bp, Homo sapiens
gcttgctggttggaa

SEQ ID NO: 332927 - DNA, 15 bp, Homo sapiens
cttgctggttggaat

SEQ ID NO: 332928 - DNA, 15 bp, Homo sapiens
ttgctggttggaatg

SEQ ID NO: 332929 - DNA, 15 bp, Homo sapiens
tgctggttggaatgt

SEQ ID NO: 332930 - DNA, 15 bp, Homo sapiens
gctggttggaatgta

SEQ ID NO: 332931 - DNA, 15 bp, Homo sapiens
ctggttggaatgtat

SEQ ID NO: 332932 - DNA, 15 bp, Homo sapiens
tggttggaatgtatc

SEQ ID NO: 332933 - DNA, 15 bp, Homo sapiens
ggttggaatgtatcc

SEQ ID NO: 332934 - DNA, 15 bp, Homo sapiens
gttggaatgtatcca

SEQ ID NO: 332935 - DNA, 15 bp, Homo sapiens
ttggaatgtatccat

SEQ ID NO: 332936 - DNA, 15 bp, Homo sapiens
tggaatgtatccatt

SEQ ID NO: 332937 - DNA, 15 bp, Homo sapiens
ggaatgtatccattg

SEQ ID NO: 332938 - DNA, 15 bp, Homo sapiens
gaatgtatccattga

SEQ ID NO: 332939 - DNA, 15 bp, Homo sapiens
aatgtatccattgaa

SEQ ID NO: 332940 - DNA, 15 bp, Homo sapiens
atgtatccattgaag

SEQ ID NO: 332941 - DNA, 15 bp, Homo sapiens
tgtatccattgaagg

SEQ ID NO: 332942 - DNA, 15 bp, Homo sapiens
gtatccattgaaggc

SEQ ID NO: 332943 - DNA, 15 bp, Homo sapiens
tatccattgaaggcc

SEQ ID NO: 332944 - DNA, 15 bp, Homo sapiens
atccattgaaggcct

SEQ ID NO: 332945 - DNA, 15 bp, Homo sapiens
tccattgaaggcctt

SEQ ID NO: 332946 - DNA, 15 bp, Homo sapiens
ccattgaaggcctta

SEQ ID NO: 332947 - DNA, 15 bp, Homo sapiens
cattgaaggccttag

SEQ ID NO: 332948 - DNA, 15 bp, Homo sapiens
attgaaggccttaga

SEQ ID NO: 332949 - DNA, 15 bp, Homo sapiens
ttgaaggccttagat

SEQ ID NO: 332950 - DNA, 15 bp, Homo sapiens
tgaaggccttagatg

SEQ ID NO: 332951 - DNA, 15 bp, Homo sapiens
gaaggccttagatgt

SEQ ID NO: 332952 - DNA, 15 bp, Homo sapiens
aaggccttagatgtt

SEQ ID NO: 332953 - DNA, 15 bp, Homo sapiens
aggccttagatgttg

SEQ ID NO: 332954 - DNA, 15 bp, Homo sapiens
ggccttagatgttgg

SEQ ID NO: 332955 - DNA, 15 bp, Homo sapiens
gccttagatgttgga

SEQ ID NO: 332956 - DNA, 15 bp, Homo sapiens
ccttagatgttggag

SEQ ID NO: 332957 - DNA, 15 bp, Homo sapiens
cttagatgttggagt

SEQ ID NO: 332958 - DNA, 15 bp, Homo sapiens
ttagatgttggagtc

SEQ ID NO: 332959 - DNA, 15 bp, Homo sapiens
tagatgttggagtcc

SEQ ID NO: 332960 - DNA, 15 bp, Homo sapiens
agatgttggagtcct

SEQ ID NO: 332961 - DNA, 15 bp, Homo sapiens
gatgttggagtcctt

SEQ ID NO: 332962 - DNA, 15 bp, Homo sapiens
atgttggagtccttg

SEQ ID NO: 332963 - DNA, 15 bp, Homo sapiens
tgttggagtccttgc

SEQ ID NO: 332964 - DNA, 15 bp, Homo sapiens
gttggagtccttgct

SEQ ID NO: 332965 - DNA, 15 bp, Homo sapiens
ttggagtccttgctt

SEQ ID NO: 332966 - DNA, 15 bp, Homo sapiens
tggagtccttgcttc

SEQ ID NO: 332967 - DNA, 15 bp, Homo sapiens
ggagtccttgcttcc

SEQ ID NO: 332968 - DNA, 15 bp, Homo sapiens
gagtccttgcttcct

SEQ ID NO: 332969 - DNA, 15 bp, Homo sapiens
agtccttgcttccta

SEQ ID NO: 332970 - DNA, 15 bp, Homo sapiens
gtccttgcttcctag

SEQ ID NO: 332971 - DNA, 15 bp, Homo sapiens
tccttgcttcctagc

SEQ ID NO: 332972 - DNA, 15 bp, Homo sapiens
ccttgcttcctagct

SEQ ID NO: 332973 - DNA, 15 bp, Homo sapiens
cttgcttcctagctc

SEQ ID NO: 332974 - DNA, 15 bp, Homo sapiens
ttgcttcctagctcc

SEQ ID NO: 332975 - DNA, 15 bp, Homo sapiens
tgcttcctagctcca

SEQ ID NO: 332976 - DNA, 15 bp, Homo sapiens
gcttcctagctccac

SEQ ID NO: 332977 - DNA, 15 bp, Homo sapiens
cttcctagctccacc

SEQ ID NO: 332978 - DNA, 15 bp, Homo sapiens
ttcctagctccacct

SEQ ID NO: 332979 - DNA, 15 bp, Homo sapiens
tcctagctccacctc

SEQ ID NO: 332980 - DNA, 15 bp, Homo sapiens
cctagctccacctct

SEQ ID NO: 332981 - DNA, 15 bp, Homo sapiens
ctagctccacctctt

SEQ ID NO: 332982 - DNA, 15 bp, Homo sapiens
tagctccacctcttt

SEQ ID NO: 332983 - DNA, 15 bp, Homo sapiens
agctccacctctttg

SEQ ID NO: 332984 - DNA, 15 bp, Homo sapiens
gctccacctctttgt

SEQ ID NO: 332985 - DNA, 15 bp, Homo sapiens
ctccacctctttgtt

SEQ ID NO: 332986 - DNA, 15 bp, Homo sapiens
tccacctctttgttt

SEQ ID NO: 332987 - DNA, 15 bp, Homo sapiens
ccacctctttgtttc

SEQ ID NO: 332988 - DNA, 15 bp, Homo sapiens
cacctctttgtttca

SEQ ID NO: 332989 - DNA, 15 bp, Homo sapiens
acctctttgtttcag

SEQ ID NO: 332990 - DNA, 15 bp, Homo sapiens
cctctttgtttcagg

SEQ ID NO: 332991 - DNA, 15 bp, Homo sapiens
ctctttgtttcaggg

SEQ ID NO: 332992 - DNA, 15 bp, Homo sapiens
tctttgtttcagggc

SEQ ID NO: 332993 - DNA, 15 bp, Homo sapiens
ctttgtttcagggca

SEQ ID NO: 332994 - DNA, 15 bp, Homo sapiens
tttgtttcagggcac

SEQ ID NO: 332995 - DNA, 15 bp, Homo sapiens
ttgtttcagggcacc

SEQ ID NO: 332996 - DNA, 15 bp, Homo sapiens
tgtttcagggcacca

SEQ ID NO: 332997 - DNA, 15 bp, Homo sapiens
gtttcagggcaccac

SEQ ID NO: 332998 - DNA, 15 bp, Homo sapiens
tttcagggcaccact

SEQ ID NO: 332999 - DNA, 15 bp, Homo sapiens
ttcagggcaccactc

SEQ ID NO: 333000 - DNA, 15 bp, Homo sapiens
tcagggcaccactct

SEQ ID NO: 333001 - DNA, 15 bp, Homo sapiens
cagggcaccactctt

SEQ ID NO: 333002 - DNA, 15 bp, Homo sapiens
agggcaccactcttc

SEQ ID NO: 333003 - DNA, 15 bp, Homo sapiens
gggcaccactcttct

SEQ ID NO: 333004 - DNA, 15 bp, Homo sapiens
ggcaccactcttctg

SEQ ID NO: 333005 - DNA, 15 bp, Homo sapiens
gcaccactcttctgg

SEQ ID NO: 333006 - DNA, 15 bp, Homo sapiens
caccactcttctggt

SEQ ID NO: 333007 - DNA, 15 bp, Homo sapiens
accactcttctggtc

SEQ ID NO: 333008 - DNA, 15 bp, Homo sapiens
ccactcttctggtct

SEQ ID NO: 333009 - DNA, 15 bp, Homo sapiens
cactcttctggtcta

SEQ ID NO: 333010 - DNA, 15 bp, Homo sapiens
actcttctggtctag

SEQ ID NO: 333011 - DNA, 15 bp, Homo sapiens
ctcttctggtctagt

SEQ ID NO: 333012 - DNA, 15 bp, Homo sapiens
tcttctggtctagtg

SEQ ID NO: 333013 - DNA, 15 bp, Homo sapiens
cttctggtctagtgc

SEQ ID NO: 333014 - DNA, 15 bp, Homo sapiens
ttctggtctagtgca

SEQ ID NO: 333015 - DNA, 15 bp, Homo sapiens
tctggtctagtgcac

SEQ ID NO: 333016 - DNA, 15 bp, Homo sapiens
ctggtctagtgcaca

SEQ ID NO: 333017 - DNA, 15 bp, Homo sapiens
tggtctagtgcacag

SEQ ID NO: 333018 - DNA, 15 bp, Homo sapiens
ggtctagtgcacagc

SEQ ID NO: 333019 - DNA, 15 bp, Homo sapiens
gtctagtgcacagcc

SEQ ID NO: 333020 - DNA, 15 bp, Homo sapiens
tctagtgcacagcct

SEQ ID NO: 333021 - DNA, 15 bp, Homo sapiens
ctagtgcacagcctg

SEQ ID NO: 333022 - DNA, 15 bp, Homo sapiens
tagtgcacagcctgg

SEQ ID NO: 333023 - DNA, 15 bp, Homo sapiens
agtgcacagcctggt

SEQ ID NO: 333024 - DNA, 15 bp, Homo sapiens
gtgcacagcctggtc

SEQ ID NO: 333025 - DNA, 15 bp, Homo sapiens
tgcacagcctggtct

SEQ ID NO: 333026 - DNA, 15 bp, Homo sapiens
gcacagcctggtctc

SEQ ID NO: 333027 - DNA, 15 bp, Homo sapiens
cacagcctggtctct

SEQ ID NO: 333028 - DNA, 15 bp, Homo sapiens
acagcctggtctctg

SEQ ID NO: 333029 - DNA, 15 bp, Homo sapiens
cagcctggtctctgt

SEQ ID NO: 333030 - DNA, 15 bp, Homo sapiens
agcctggtctctgtc

SEQ ID NO: 333031 - DNA, 15 bp, Homo sapiens
gcctggtctctgtca

SEQ ID NO: 333032 - DNA, 15 bp, Homo sapiens
cctggtctctgtcaa

SEQ ID NO: 333033 - DNA, 15 bp, Homo sapiens
ctggtctctgtcaat

SEQ ID NO: 333034 - DNA, 15 bp, Homo sapiens
tggtctctgtcaatc

SEQ ID NO: 333035 - DNA, 15 bp, Homo sapiens
ggtctctgtcaatca

SEQ ID NO: 333036 - DNA, 15 bp, Homo sapiens
gtctctgtcaatcag

SEQ ID NO: 333037 - DNA, 15 bp, Homo sapiens
tctctgtcaatcagc

SEQ ID NO: 333038 - DNA, 15 bp, Homo sapiens
ctctgtcaatcagca

SEQ ID NO: 333039 - DNA, 15 bp, Homo sapiens
tctgtcaatcagcac

SEQ ID NO: 333040 - DNA, 15 bp, Homo sapiens
ctgtcaatcagcacg

SEQ ID NO: 333041 - DNA, 15 bp, Homo sapiens
tgtcaatcagcacgt

SEQ ID NO: 333042 - DNA, 15 bp, Homo sapiens
gtcaatcagcacgtt

SEQ ID NO: 333043 - DNA, 15 bp, Homo sapiens
tcaatcagcacgttc

SEQ ID NO: 333044 - DNA, 15 bp, Homo sapiens
caatcagcacgttct

SEQ ID NO: 333045 - DNA, 15 bp, Homo sapiens
aatcagcacgttctg

SEQ ID NO: 333046 - DNA, 15 bp, Homo sapiens
atcagcacgttctgc

SEQ ID NO: 333047 - DNA, 15 bp, Homo sapiens
tcagcacgttctgcc

SEQ ID NO: 333048 - DNA, 15 bp, Homo sapiens
cagcacgttctgcct

SEQ ID NO: 333049 - DNA, 15 bp, Homo sapiens
agcacgttctgcctg

SEQ ID NO: 333050 - DNA, 15 bp, Homo sapiens
gcacgttctgcctgg

SEQ ID NO: 333051 - DNA, 15 bp, Homo sapiens
cacgttctgcctggc

SEQ ID NO: 333052 - DNA, 15 bp, Homo sapiens
acgttctgcctggcg

SEQ ID NO: 333053 - DNA, 15 bp, Homo sapiens
cgttctgcctggcgt

SEQ ID NO: 333054 - DNA, 15 bp, Homo sapiens
gttctgcctggcgtt

SEQ ID NO: 333055 - DNA, 15 bp, Homo sapiens
ttctgcctggcgttt

SEQ ID NO: 333056 - DNA, 15 bp, Homo sapiens
tctgcctggcgtttt

SEQ ID NO: 333057 - DNA, 15 bp, Homo sapiens
ctgcctggcgtttta

SEQ ID NO: 333058 - DNA, 15 bp, Homo sapiens
tgcctggcgttttat

SEQ ID NO: 333059 - DNA, 15 bp, Homo sapiens
gcctggcgttttatg

SEQ ID NO: 333060 - DNA, 15 bp, Homo sapiens
cctggcgttttatgg

SEQ ID NO: 333061 - DNA, 15 bp, Homo sapiens
ctggcgttttatggc

SEQ ID NO: 333062 - DNA, 15 bp, Homo sapiens
tggcgttttatggca

SEQ ID NO: 333063 - DNA, 15 bp, Homo sapiens
ggcgttttatggcat

SEQ ID NO: 333064 - DNA, 15 bp, Homo sapiens
gcgttttatggcatg

SEQ ID NO: 333065 - DNA, 15 bp, Homo sapiens
cgttttatggcatgt

SEQ ID NO: 333066 - DNA, 15 bp, Homo sapiens
gttttatggcatgtt

SEQ ID NO: 333067 - DNA, 15 bp, Homo sapiens
ttttatggcatgttt

SEQ ID NO: 333068 - DNA, 15 bp, Homo sapiens
tttatggcatgtttt

SEQ ID NO: 333069 - DNA, 15 bp, Homo sapiens
ttatggcatgttttc

SEQ ID NO: 333070 - DNA, 15 bp, Homo sapiens
tatggcatgttttct

SEQ ID NO: 333071 - DNA, 15 bp, Homo sapiens
atggcatgttttctt

SEQ ID NO: 333072 - DNA, 15 bp, Homo sapiens
tggcatgttttcttc

SEQ ID NO: 333073 - DNA, 15 bp, Homo sapiens
ggcatgttttcttcc

SEQ ID NO: 333074 - DNA, 15 bp, Homo sapiens
gcatgttttcttccc

SEQ ID NO: 333075 - DNA, 15 bp, Homo sapiens
catgttttcttcccc

SEQ ID NO: 333076 - DNA, 15 bp, Homo sapiens
atgttttcttccccc

SEQ ID NO: 333077 - DNA, 15 bp, Homo sapiens
tgttttcttcccccc

SEQ ID NO: 333078 - DNA, 15 bp, Homo sapiens
gttttcttccccccc

SEQ ID NO: 333079 - DNA, 15 bp, Homo sapiens
ttttcttccccccca

SEQ ID NO: 333080 - DNA, 15 bp, Homo sapiens
tttcttcccccccac

SEQ ID NO: 333081 - DNA, 15 bp, Homo sapiens
ttcttcccccccaca

SEQ ID NO: 333082 - DNA, 15 bp, Homo sapiens
tcttcccccccacat

SEQ ID NO: 333083 - DNA, 15 bp, Homo sapiens
cttcccccccacata

SEQ ID NO: 333084 - DNA, 15 bp, Homo sapiens
ttcccccccacatag

SEQ ID NO: 333085 - DNA, 15 bp, Homo sapiens
tcccccccacatagg

SEQ ID NO: 333086 - DNA, 15 bp, Homo sapiens
cccccccacataggg

SEQ ID NO: 333087 - DNA, 15 bp, Homo sapiens
ccccccacatagggt

SEQ ID NO: 333088 - DNA, 15 bp, Homo sapiens
cccccacatagggta

SEQ ID NO: 333089 - DNA, 15 bp, Homo sapiens
ccccacatagggtag

SEQ ID NO: 333090 - DNA, 15 bp, Homo sapiens
cccacatagggtagc

SEQ ID NO: 333091 - DNA, 15 bp, Homo sapiens
ccacatagggtagca

SEQ ID NO: 333092 - DNA, 15 bp, Homo sapiens
cacatagggtagcag

SEQ ID NO: 333093 - DNA, 15 bp, Homo sapiens
acatagggtagcagc

SEQ ID NO: 333094 - DNA, 15 bp, Homo sapiens
catagggtagcagcc

SEQ ID NO: 333095 - DNA, 15 bp, Homo sapiens
atagggtagcagcct

SEQ ID NO: 333096 - DNA, 15 bp, Homo sapiens
tagggtagcagcctt

SEQ ID NO: 333097 - DNA, 15 bp, Homo sapiens
agggtagcagccttt

SEQ ID NO: 333098 - DNA, 15 bp, Homo sapiens
gggtagcagcctttt

SEQ ID NO: 333099 - DNA, 15 bp, Homo sapiens
ggtagcagccttttt

SEQ ID NO: 333100 - DNA, 15 bp, Homo sapiens
gtagcagccttttta

SEQ ID NO: 333101 - DNA, 15 bp, Homo sapiens
tagcagcctttttat

SEQ ID NO: 333102 - DNA, 15 bp, Homo sapiens
agcagcctttttata

SEQ ID NO: 333103 - DNA, 15 bp, Homo sapiens
gcagcctttttataa

SEQ ID NO: 333104 - DNA, 15 bp, Homo sapiens
cagcctttttataag

SEQ ID NO: 333105 - DNA, 15 bp, Homo sapiens
agcctttttataagt

SEQ ID NO: 333106 - DNA, 15 bp, Homo sapiens
gcctttttataagtt

SEQ ID NO: 333107 - DNA, 15 bp, Homo sapiens
cctttttataagttg

SEQ ID NO: 333108 - DNA, 15 bp, Homo sapiens
ctttttataagttgt

SEQ ID NO: 333109 - DNA, 15 bp, Homo sapiens
tttttataagttgta

SEQ ID NO: 333110 - DNA, 15 bp, Homo sapiens
ttttataagttgtaa

SEQ ID NO: 333111 - DNA, 15 bp, Homo sapiens
tttataagttgtaat

SEQ ID NO: 333112 - DNA, 15 bp, Homo sapiens
ttataagttgtaatg

SEQ ID NO: 333113 - DNA, 15 bp, Homo sapiens
tataagttgtaatgg

SEQ ID NO: 333114 - DNA, 15 bp, Homo sapiens
ataagttgtaatggg

SEQ ID NO: 333115 - DNA, 15 bp, Homo sapiens
taagttgtaatgggt

SEQ ID NO: 333116 - DNA, 15 bp, Homo sapiens
aagttgtaatgggtt

SEQ ID NO: 333117 - DNA, 15 bp, Homo sapiens
agttgtaatgggttt

SEQ ID NO: 333118 - DNA, 15 bp, Homo sapiens
gttgtaatgggtttt

SEQ ID NO: 333119 - DNA, 15 bp, Homo sapiens
ttgtaatgggttttt

SEQ ID NO: 333120 - DNA, 15 bp, Homo sapiens
tgtaatgggtttttg

SEQ ID NO: 333121 - DNA, 15 bp, Homo sapiens
gtaatgggtttttga

SEQ ID NO: 333122 - DNA, 15 bp, Homo sapiens
taatgggtttttgat

SEQ ID NO: 333123 - DNA, 15 bp, Homo sapiens
aatgggtttttgata

SEQ ID NO: 333124 - DNA, 15 bp, Homo sapiens
atgggtttttgatac

SEQ ID NO: 333125 - DNA, 15 bp, Homo sapiens
tgggtttttgatacc

SEQ ID NO: 333126 - DNA, 15 bp, Homo sapiens
gggtttttgataccc

SEQ ID NO: 333127 - DNA, 15 bp, Homo sapiens
ggtttttgataccca

SEQ ID NO: 333128 - DNA, 15 bp, Homo sapiens
gtttttgatacccac

SEQ ID NO: 333129 - DNA, 15 bp, Homo sapiens
tttttgatacccact

SEQ ID NO: 333130 - DNA, 15 bp, Homo sapiens
ttttgatacccactg

SEQ ID NO: 333131 - DNA, 15 bp, Homo sapiens
tttgatacccactgt

SEQ ID NO: 333132 - DNA, 15 bp, Homo sapiens
ttgatacccactgtc

SEQ ID NO: 333133 - DNA, 15 bp, Homo sapiens
tgatacccactgtca

SEQ ID NO: 333134 - DNA, 15 bp, Homo sapiens
gatacccactgtcat

SEQ ID NO: 333135 - DNA, 15 bp, Homo sapiens
atacccactgtcatt

SEQ ID NO: 333136 - DNA, 15 bp, Homo sapiens
tacccactgtcattt

SEQ ID NO: 333137 - DNA, 15 bp, Homo sapiens
acccactgtcatttt

SEQ ID NO: 333138 - DNA, 15 bp, Homo sapiens
cccactgtcattttt

SEQ ID NO: 333139 - DNA, 15 bp, Homo sapiens
ccactgtcatttttc

SEQ ID NO: 333140 - DNA, 15 bp, Homo sapiens
cactgtcatttttct

SEQ ID NO: 333141 - DNA, 15 bp, Homo sapiens
actgtcatttttctt

SEQ ID NO: 333142 - DNA, 15 bp, Homo sapiens
ctgtcatttttcttt

SEQ ID NO: 333143 - DNA, 15 bp, Homo sapiens
tgtcatttttctttt

SEQ ID NO: 333144 - DNA, 15 bp, Homo sapiens
gtcatttttcttttc

SEQ ID NO: 333145 - DNA, 15 bp, Homo sapiens
tcatttttcttttct

SEQ ID NO: 333146 - DNA, 15 bp, Homo sapiens
catttttcttttctt

SEQ ID NO: 333147 - DNA, 15 bp, Homo sapiens
atttttcttttcttt

SEQ ID NO: 333148 - DNA, 15 bp, Homo sapiens
cttttcttttttttg

SEQ ID NO: 333149 - DNA, 15 bp, Homo sapiens
ttttcttttttttga

SEQ ID NO: 333150 - DNA, 15 bp, Homo sapiens
ttttgagacagggtt

SEQ ID NO: 333151 - DNA, 15 bp, Homo sapiens
tttgagacagggttt

SEQ ID NO: 333152 - DNA, 15 bp, Homo sapiens
ttgagacagggtttc

SEQ ID NO: 333153 - DNA, 15 bp, Homo sapiens
tgagacagggtttca

SEQ ID NO: 333154 - DNA, 15 bp, Homo sapiens
gacagggtttcactc

SEQ ID NO: 333155 - DNA, 15 bp, Homo sapiens
acagggtttcactct

SEQ ID NO: 333156 - DNA, 15 bp, Homo sapiens
cagggtttcactctg

SEQ ID NO: 333157 - DNA, 15 bp, Homo sapiens
agggtttcactctgt

SEQ ID NO: 333158 - DNA, 15 bp, Homo sapiens
gggtttcactctgtc

SEQ ID NO: 333159 - DNA, 15 bp, Homo sapiens
ggtttcactctgtca

SEQ ID NO: 333160 - DNA, 15 bp, Homo sapiens
gtttcactctgtcac

SEQ ID NO: 333161 - DNA, 15 bp, Homo sapiens
tttcactctgtcacc

SEQ ID NO: 333162 - DNA, 15 bp, Homo sapiens
ttcactctgtcaccc

SEQ ID NO: 333163 - DNA, 15 bp, Homo sapiens
tgtcacccaggctga

SEQ ID NO: 333164 - DNA, 15 bp, Homo sapiens
gtcacccaggctgaa

SEQ ID NO: 333165 - DNA, 15 bp, Homo sapiens
tcacccaggctgaat

SEQ ID NO: 333166 - DNA, 15 bp, Homo sapiens
cacccaggctgaatg

SEQ ID NO: 333167 - DNA, 15 bp, Homo sapiens
acccaggctgaatgc

SEQ ID NO: 333168 - DNA, 15 bp, Homo sapiens
cccaggctgaatgca

SEQ ID NO: 333169 - DNA, 15 bp, Homo sapiens
ccaggctgaatgcag

SEQ ID NO: 333170 - DNA, 15 bp, Homo sapiens
caggctgaatgcagt

SEQ ID NO: 333171 - DNA, 15 bp, Homo sapiens
aggctgaatgcagtg

SEQ ID NO: 333172 - DNA, 15 bp, Homo sapiens
ggctgaatgcagtgg

SEQ ID NO: 333173 - DNA, 15 bp, Homo sapiens
gctgaatgcagtggc

SEQ ID NO: 333174 - DNA, 15 bp, Homo sapiens
ctgaatgcagtggca

SEQ ID NO: 333175 - DNA, 15 bp, Homo sapiens
tgaatgcagtggcac

SEQ ID NO: 333176 - DNA, 15 bp, Homo sapiens
gaatgcagtggcacg

SEQ ID NO: 333177 - DNA, 15 bp, Homo sapiens
aatgcagtggcacga

SEQ ID NO: 333178 - DNA, 15 bp, Homo sapiens
atgcagtggcacgat

SEQ ID NO: 333179 - DNA, 15 bp, Homo sapiens
tgcagtggcacgatc

SEQ ID NO: 333180 - DNA, 15 bp, Homo sapiens
gcagtggcacgatca

SEQ ID NO: 333181 - DNA, 15 bp, Homo sapiens
cagtggcacgatcac

SEQ ID NO: 333182 - DNA, 15 bp, Homo sapiens
agtggcacgatcaca

SEQ ID NO: 333183 - DNA, 15 bp, Homo sapiens
gtggcacgatcacag

SEQ ID NO: 333184 - DNA, 15 bp, Homo sapiens
tggcacgatcacagc

SEQ ID NO: 333185 - DNA, 15 bp, Homo sapiens
ggcacgatcacagct

SEQ ID NO: 333186 - DNA, 15 bp, Homo sapiens
gcacgatcacagctt

SEQ ID NO: 333187 - DNA, 15 bp, Homo sapiens
cacgatcacagcttc

SEQ ID NO: 333188 - DNA, 15 bp, Homo sapiens
acgatcacagcttcc

SEQ ID NO: 333189 - DNA, 15 bp, Homo sapiens
cgatcacagcttcct

SEQ ID NO: 333190 - DNA, 15 bp, Homo sapiens
gatcacagcttcctg

SEQ ID NO: 333191 - DNA, 15 bp, Homo sapiens
atcacagcttcctgc

SEQ ID NO: 333192 - DNA, 15 bp, Homo sapiens
tcacagcttcctgca

SEQ ID NO: 333193 - DNA, 15 bp, Homo sapiens
cacagcttcctgcag

SEQ ID NO: 333194 - DNA, 15 bp, Homo sapiens
acagcttcctgcagt

SEQ ID NO: 333195 - DNA, 15 bp, Homo sapiens
cagcttcctgcagtc

SEQ ID NO: 333196 - DNA, 15 bp, Homo sapiens
agcttcctgcagtct

SEQ ID NO: 333197 - DNA, 15 bp, Homo sapiens
gcttcctgcagtctt

SEQ ID NO: 333198 - DNA, 15 bp, Homo sapiens
cttcctgcagtcttg

SEQ ID NO: 333199 - DNA, 15 bp, Homo sapiens
ttcctgcagtcttga

SEQ ID NO: 333200 - DNA, 15 bp, Homo sapiens
tcctgcagtcttgaa

SEQ ID NO: 333201 - DNA, 15 bp, Homo sapiens
cctgcagtcttgaac

SEQ ID NO: 333202 - DNA, 15 bp, Homo sapiens
ctgcagtcttgaact

SEQ ID NO: 333203 - DNA, 15 bp, Homo sapiens
tgcagtcttgaactc

SEQ ID NO: 333204 - DNA, 15 bp, Homo sapiens
gcagtcttgaactct

SEQ ID NO: 333205 - DNA, 15 bp, Homo sapiens
cagtcttgaactctg

SEQ ID NO: 333206 - DNA, 15 bp, Homo sapiens
agtcttgaactctgg

SEQ ID NO: 333207 - DNA, 15 bp, Homo sapiens
gtcttgaactctggg

SEQ ID NO: 333208 - DNA, 15 bp, Homo sapiens
tcttgaactctggga

SEQ ID NO: 333209 - DNA, 15 bp, Homo sapiens
cttgaactctgggac

SEQ ID NO: 333210 - DNA, 15 bp, Homo sapiens
ttgaactctgggact

SEQ ID NO: 333211 - DNA, 15 bp, Homo sapiens
tgaactctgggactc

SEQ ID NO: 333212 - DNA, 15 bp, Homo sapiens
gaactctgggactca

SEQ ID NO: 333213 - DNA, 15 bp, Homo sapiens
aactctgggactcag

SEQ ID NO: 333214 - DNA, 15 bp, Homo sapiens
actctgggactcagg

SEQ ID NO: 333215 - DNA, 15 bp, Homo sapiens
ctctgggactcaggc

SEQ ID NO: 333216 - DNA, 15 bp, Homo sapiens
tctgggactcaggca

SEQ ID NO: 333217 - DNA, 15 bp, Homo sapiens
ctgggactcaggcag

SEQ ID NO: 333218 - DNA, 15 bp, Homo sapiens
tgggactcaggcagt

SEQ ID NO: 333219 - DNA, 15 bp, Homo sapiens
gggactcaggcagtc

SEQ ID NO: 333220 - DNA, 15 bp, Homo sapiens
ggactcaggcagtcc

SEQ ID NO: 333221 - DNA, 15 bp, Homo sapiens
gactcaggcagtcct

SEQ ID NO: 333222 - DNA, 15 bp, Homo sapiens
actcaggcagtcctc

SEQ ID NO: 333223 - DNA, 15 bp, Homo sapiens
ctcaggcagtcctcc

SEQ ID NO: 333224 - DNA, 15 bp, Homo sapiens
tcaggcagtcctccc

SEQ ID NO: 333225 - DNA, 15 bp, Homo sapiens
caggcagtcctccca

SEQ ID NO: 333226 - DNA, 15 bp, Homo sapiens
aggcagtcctcccac

SEQ ID NO: 333227 - DNA, 15 bp, Homo sapiens
ggcagtcctcccacc

SEQ ID NO: 333228 - DNA, 15 bp, Homo sapiens
gtcctcccacctcat

SEQ ID NO: 333229 - DNA, 15 bp, Homo sapiens
tcctcccacctcatc

SEQ ID NO: 333230 - DNA, 15 bp, Homo sapiens
cctcccacctcatcc

SEQ ID NO: 333231 - DNA, 15 bp, Homo sapiens
ctcccacctcatcct

SEQ ID NO: 333232 - DNA, 15 bp, Homo sapiens
tcccacctcatcctc

SEQ ID NO: 333233 - DNA, 15 bp, Homo sapiens
cccacctcatcctcc

SEQ ID NO: 333234 - DNA, 15 bp, Homo sapiens
ccacctcatcctccc

SEQ ID NO: 333235 - DNA, 15 bp, Homo sapiens
cacctcatcctccca

SEQ ID NO: 333236 - DNA, 15 bp, Homo sapiens
acctcatcctcccaa

SEQ ID NO: 333237 - DNA, 15 bp, Homo sapiens
cctcatcctcccaag

SEQ ID NO: 333238 - DNA, 15 bp, Homo sapiens
ctcatcctcccaagt

SEQ ID NO: 333239 - DNA, 15 bp, Homo sapiens
tcatcctcccaagta

SEQ ID NO: 333240 - DNA, 15 bp, Homo sapiens
catcctcccaagtag

SEQ ID NO: 333241 - DNA, 15 bp, Homo sapiens
atcctcccaagtagc

SEQ ID NO: 333242 - DNA, 15 bp, Homo sapiens
tcctcccaagtagct

SEQ ID NO: 333243 - DNA, 15 bp, Homo sapiens
caagtagctgggact

SEQ ID NO: 333244 - DNA, 15 bp, Homo sapiens
aagtagctgggacta

SEQ ID NO: 333245 - DNA, 15 bp, Homo sapiens
ggactacaggtgtgc

SEQ ID NO: 333246 - DNA, 15 bp, Homo sapiens
gactacaggtgtgca

SEQ ID NO: 333247 - DNA, 15 bp, Homo sapiens
actacaggtgtgcac

SEQ ID NO: 333248 - DNA, 15 bp, Homo sapiens
ctacaggtgtgcacc

SEQ ID NO: 333249 - DNA, 15 bp, Homo sapiens
tacaggtgtgcacca

SEQ ID NO: 333250 - DNA, 15 bp, Homo sapiens
acaggtgtgcaccac

SEQ ID NO: 333251 - DNA, 15 bp, Homo sapiens
caggtgtgcaccact

SEQ ID NO: 333252 - DNA, 15 bp, Homo sapiens
aggtgtgcaccacta

SEQ ID NO: 333253 - DNA, 15 bp, Homo sapiens
ggtgtgcaccactat

SEQ ID NO: 333254 - DNA, 15 bp, Homo sapiens
gtgtgcaccactatt

SEQ ID NO: 333255 - DNA, 15 bp, Homo sapiens
tgtgcaccactattc

SEQ ID NO: 333256 - DNA, 15 bp, Homo sapiens
gtgcaccactattcc

SEQ ID NO: 333257 - DNA, 15 bp, Homo sapiens
tgcaccactattccc

SEQ ID NO: 333258 - DNA, 15 bp, Homo sapiens
gcaccactattccca

SEQ ID NO: 333259 - DNA, 15 bp, Homo sapiens
caccactattcccag

SEQ ID NO: 333260 - DNA, 15 bp, Homo sapiens
accactattcccagt

SEQ ID NO: 333261 - DNA, 15 bp, Homo sapiens
ccactattcccagtt

SEQ ID NO: 333262 - DNA, 15 bp, Homo sapiens
cactattcccagttg

SEQ ID NO: 333263 - DNA, 15 bp, Homo sapiens
actattcccagttgc

SEQ ID NO: 333264 - DNA, 15 bp, Homo sapiens
ctattcccagttgct

SEQ ID NO: 333265 - DNA, 15 bp, Homo sapiens
tattcccagttgctt

SEQ ID NO: 333266 - DNA, 15 bp, Homo sapiens
attcccagttgcttt

SEQ ID NO: 333267 - DNA, 15 bp, Homo sapiens
ttcccagttgctttt

SEQ ID NO: 333268 - DNA, 15 bp, Homo sapiens
tcccagttgcttttt

SEQ ID NO: 333269 - DNA, 15 bp, Homo sapiens
cccagttgctttttt

SEQ ID NO: 333270 - DNA, 15 bp, Homo sapiens
ccagttgcttttttt

SEQ ID NO: 333271 - DNA, 15 bp, Homo sapiens
cagttgcttttttta

SEQ ID NO: 333272 - DNA, 15 bp, Homo sapiens
agttgctttttttaa

SEQ ID NO: 333273 - DNA, 15 bp, Homo sapiens
gttgctttttttaaa

SEQ ID NO: 333274 - DNA, 15 bp, Homo sapiens
ttgctttttttaaaa

SEQ ID NO: 333275 - DNA, 15 bp, Homo sapiens
tgctttttttaaaaa

SEQ ID NO: 333276 - DNA, 15 bp, Homo sapiens
gctttttttaaaaaa

SEQ ID NO: 333277 - DNA, 15 bp, Homo sapiens
ctttttttaaaaaag

SEQ ID NO: 333278 - DNA, 15 bp, Homo sapiens
tttttttaaaaaagt

SEQ ID NO: 333279 - DNA, 15 bp, Homo sapiens
ttttttaaaaaagtt

SEQ ID NO: 333280 - DNA, 15 bp, Homo sapiens
tttttaaaaaagttt

SEQ ID NO: 333281 - DNA, 15 bp, Homo sapiens
ttttaaaaaagtttt

SEQ ID NO: 333282 - DNA, 15 bp, Homo sapiens
tttaaaaaagttttt

SEQ ID NO: 333283 - DNA, 15 bp, Homo sapiens
ttaaaaaagtttttt

SEQ ID NO: 333284 - DNA, 15 bp, Homo sapiens
taaaaaagttttttg

SEQ ID NO: 333285 - DNA, 15 bp, Homo sapiens
aaaaaagttttttgg

SEQ ID NO: 333286 - DNA, 15 bp, Homo sapiens
aaaaagttttttggg

SEQ ID NO: 333287 - DNA, 15 bp, Homo sapiens
aaaagttttttgggt

SEQ ID NO: 333288 - DNA, 15 bp, Homo sapiens
aaagttttttgggtc

SEQ ID NO: 333289 - DNA, 15 bp, Homo sapiens
aagttttttgggtcg

SEQ ID NO: 333290 - DNA, 15 bp, Homo sapiens
agttttttgggtcgg

SEQ ID NO: 333291 - DNA, 15 bp, Homo sapiens
gttttttgggtcggg

SEQ ID NO: 333292 - DNA, 15 bp, Homo sapiens
ttttttgggtcgggc

SEQ ID NO: 333293 - DNA, 15 bp, Homo sapiens
tttttgggtcgggcc

SEQ ID NO: 333294 - DNA, 15 bp, Homo sapiens
ttttgggtcgggccg

SEQ ID NO: 333295 - DNA, 15 bp, Homo sapiens
tttgggtcgggccgg

SEQ ID NO: 333296 - DNA, 15 bp, Homo sapiens
ttgggtcgggccggg

SEQ ID NO: 333297 - DNA, 15 bp, Homo sapiens
tgggtcgggccgggt

SEQ ID NO: 333298 - DNA, 15 bp, Homo sapiens
gggtcgggccgggtg

SEQ ID NO: 333299 - DNA, 15 bp, Homo sapiens
ggtcgggccgggtgg

SEQ ID NO: 333300 - DNA, 15 bp, Homo sapiens
gtcgggccgggtggc

SEQ ID NO: 333301 - DNA, 15 bp, Homo sapiens
tcgggccgggtggct

SEQ ID NO: 333302 - DNA, 15 bp, Homo sapiens
cgggccgggtggctc

SEQ ID NO: 333303 - DNA, 15 bp, Homo sapiens
gggccgggtggctca

SEQ ID NO: 333304 - DNA, 15 bp, Homo sapiens
ggccgggtggctcac

SEQ ID NO: 333305 - DNA, 15 bp, Homo sapiens
gccgggtggctcacg

SEQ ID NO: 333306 - DNA, 15 bp, Homo sapiens
ccgggtggctcacgc

SEQ ID NO: 333307 - DNA, 15 bp, Homo sapiens
cgggtggctcacgcc

SEQ ID NO: 333308 - DNA, 15 bp, Homo sapiens
gggtggctcacgcct

SEQ ID NO: 333309 - DNA, 15 bp, Homo sapiens
gaggccgaggtgggt

SEQ ID NO: 333310 - DNA, 15 bp, Homo sapiens
aggccgaggtgggta

SEQ ID NO: 333311 - DNA, 15 bp, Homo sapiens
ggccgaggtgggtag

SEQ ID NO: 333312 - DNA, 15 bp, Homo sapiens
gccgaggtgggtaga

SEQ ID NO: 333313 - DNA, 15 bp, Homo sapiens
ccgaggtgggtagat

SEQ ID NO: 333314 - DNA, 15 bp, Homo sapiens
cgaggtgggtagatc

SEQ ID NO: 333315 - DNA, 15 bp, Homo sapiens
ggtgggtagatcacg

SEQ ID NO: 333316 - DNA, 15 bp, Homo sapiens
gtgggtagatcacga

SEQ ID NO: 333317 - DNA, 15 bp, Homo sapiens
tgggtagatcacgag

SEQ ID NO: 333318 - DNA, 15 bp, Homo sapiens
gggtagatcacgagg

SEQ ID NO: 333319 - DNA, 15 bp, Homo sapiens
ggtagatcacgaggt

SEQ ID NO: 333320 - DNA, 15 bp, Homo sapiens
gtagatcacgaggtc

SEQ ID NO: 333321 - DNA, 15 bp, Homo sapiens
tagatcacgaggtca

SEQ ID NO: 333322 - DNA, 15 bp, Homo sapiens
agatcacgaggtcag

SEQ ID NO: 333323 - DNA, 15 bp, Homo sapiens
ggtcaggagttcgat

SEQ ID NO: 333324 - DNA, 15 bp, Homo sapiens
gtcaggagttcgata

SEQ ID NO: 333325 - DNA, 15 bp, Homo sapiens
tcaggagttcgatac

SEQ ID NO: 333326 - DNA, 15 bp, Homo sapiens
caggagttcgatacc

SEQ ID NO: 333327 - DNA, 15 bp, Homo sapiens
aggagttcgatacca

SEQ ID NO: 333328 - DNA, 15 bp, Homo sapiens
ggagttcgataccag

SEQ ID NO: 333329 - DNA, 15 bp, Homo sapiens
gagttcgataccagc

SEQ ID NO: 333330 - DNA, 15 bp, Homo sapiens
agttcgataccagcc

SEQ ID NO: 333331 - DNA, 15 bp, Homo sapiens
gttcgataccagcct

SEQ ID NO: 333332 - DNA, 15 bp, Homo sapiens
ttcgataccagcctg

SEQ ID NO: 333333 - DNA, 15 bp, Homo sapiens
tcgataccagcctgg

SEQ ID NO: 333334 - DNA, 15 bp, Homo sapiens
cgataccagcctggc

SEQ ID NO: 333335 - DNA, 15 bp, Homo sapiens
acatggtgaaacctg

SEQ ID NO: 333336 - DNA, 15 bp, Homo sapiens
catggtgaaacctgg

SEQ ID NO: 333337 - DNA, 15 bp, Homo sapiens
atggtgaaacctggt

SEQ ID NO: 333338 - DNA, 15 bp, Homo sapiens
tggtgaaacctggtg

SEQ ID NO: 333339 - DNA, 15 bp, Homo sapiens
ggtgaaacctggtgt

SEQ ID NO: 333340 - DNA, 15 bp, Homo sapiens
gtgaaacctggtgtc

SEQ ID NO: 333341 - DNA, 15 bp, Homo sapiens
tgaaacctggtgtct

SEQ ID NO: 333342 - DNA, 15 bp, Homo sapiens
gaaacctggtgtcta

SEQ ID NO: 333343 - DNA, 15 bp, Homo sapiens
aaacctggtgtctac

SEQ ID NO: 333344 - DNA, 15 bp, Homo sapiens
aacctggtgtctact

SEQ ID NO: 333345 - DNA, 15 bp, Homo sapiens
acctggtgtctacta

SEQ ID NO: 333346 - DNA, 15 bp, Homo sapiens
cctggtgtctactaa

SEQ ID NO: 333347 - DNA, 15 bp, Homo sapiens
ctggtgtctactaaa

SEQ ID NO: 333348 - DNA, 15 bp, Homo sapiens
tggtgtctactaaaa

SEQ ID NO: 333349 - DNA, 15 bp, Homo sapiens
ggtgtctactaaaaa

SEQ ID NO: 333350 - DNA, 15 bp, Homo sapiens
gtgtctactaaaaat

SEQ ID NO: 333351 - DNA, 15 bp, Homo sapiens
tgtctactaaaaata

SEQ ID NO: 333352 - DNA, 15 bp, Homo sapiens
gtctactaaaaatat

SEQ ID NO: 333353 - DNA, 15 bp, Homo sapiens
tactaaaaatataac

SEQ ID NO: 333354 - DNA, 15 bp, Homo sapiens
actaaaaatataaca

SEQ ID NO: 333355 - DNA, 15 bp, Homo sapiens
ctaaaaatataacaa

SEQ ID NO: 333356 - DNA, 15 bp, Homo sapiens
taaaaatataacaat

SEQ ID NO: 333357 - DNA, 15 bp, Homo sapiens
aaaaatataacaatt

SEQ ID NO: 333358 - DNA, 15 bp, Homo sapiens
aaaatataacaatta

SEQ ID NO: 333359 - DNA, 15 bp, Homo sapiens
aaatataacaattag

SEQ ID NO: 333360 - DNA, 15 bp, Homo sapiens
aatataacaattagc

SEQ ID NO: 333361 - DNA, 15 bp, Homo sapiens
atataacaattagct

SEQ ID NO: 333362 - DNA, 15 bp, Homo sapiens
tataacaattagctg

SEQ ID NO: 333363 - DNA, 15 bp, Homo sapiens
ataacaattagctgg

SEQ ID NO: 333364 - DNA, 15 bp, Homo sapiens
taacaattagctggg

SEQ ID NO: 333365 - DNA, 15 bp, Homo sapiens
aacaattagctgggt

SEQ ID NO: 333366 - DNA, 15 bp, Homo sapiens
acaattagctgggtg

SEQ ID NO: 333367 - DNA, 15 bp, Homo sapiens
caattagctgggtgt

SEQ ID NO: 333368 - DNA, 15 bp, Homo sapiens
ctgggtgtggtggcg

SEQ ID NO: 333369 - DNA, 15 bp, Homo sapiens
tgggtgtggtggcgt

SEQ ID NO: 333370 - DNA, 15 bp, Homo sapiens
gggtgtggtggcgtg

SEQ ID NO: 333371 - DNA, 15 bp, Homo sapiens
ggtgtggtggcgtgt

SEQ ID NO: 333372 - DNA, 15 bp, Homo sapiens
gtgtggtggcgtgtg

SEQ ID NO: 333373 - DNA, 15 bp, Homo sapiens
tgtggtggcgtgtgc

SEQ ID NO: 333374 - DNA, 15 bp, Homo sapiens
gaatcgcttgaactc

SEQ ID NO: 333375 - DNA, 15 bp, Homo sapiens
aatcgcttgaactcg

SEQ ID NO: 333376 - DNA, 15 bp, Homo sapiens
atcgcttgaactcgg

SEQ ID NO: 333377 - DNA, 15 bp, Homo sapiens
tcgcttgaactcggg

SEQ ID NO: 333378 - DNA, 15 bp, Homo sapiens
cgcttgaactcggga

SEQ ID NO: 333379 - DNA, 15 bp, Homo sapiens
gcttgaactcgggag

SEQ ID NO: 333380 - DNA, 15 bp, Homo sapiens
cttgaactcgggagg

SEQ ID NO: 333381 - DNA, 15 bp, Homo sapiens
ttgaactcgggaggc

SEQ ID NO: 333382 - DNA, 15 bp, Homo sapiens
tgaactcgggaggcg

SEQ ID NO: 333383 - DNA, 15 bp, Homo sapiens
gaactcgggaggcgt

SEQ ID NO: 333384 - DNA, 15 bp, Homo sapiens
aactcgggaggcgtg

SEQ ID NO: 333385 - DNA, 15 bp, Homo sapiens
actcgggaggcgtga

SEQ ID NO: 333386 - DNA, 15 bp, Homo sapiens
ctcgggaggcgtgag

SEQ ID NO: 333387 - DNA, 15 bp, Homo sapiens
tcgggaggcgtgagt

SEQ ID NO: 333388 - DNA, 15 bp, Homo sapiens
cgggaggcgtgagtt

SEQ ID NO: 333389 - DNA, 15 bp, Homo sapiens
gggaggcgtgagttg

SEQ ID NO: 333390 - DNA, 15 bp, Homo sapiens
ggaggcgtgagttgc

SEQ ID NO: 333391 - DNA, 15 bp, Homo sapiens
gaggcgtgagttgca

SEQ ID NO: 333392 - DNA, 15 bp, Homo sapiens
aggcgtgagttgcag

SEQ ID NO: 333393 - DNA, 15 bp, Homo sapiens
ggcgtgagttgcagt

SEQ ID NO: 333394 - DNA, 15 bp, Homo sapiens
gcgtgagttgcagtg

SEQ ID NO: 333395 - DNA, 15 bp, Homo sapiens
cgtgagttgcagtga

SEQ ID NO: 333396 - DNA, 15 bp, Homo sapiens
gtgagttgcagtgaa

SEQ ID NO: 333397 - DNA, 15 bp, Homo sapiens
tgagttgcagtgaac

SEQ ID NO: 333398 - DNA, 15 bp, Homo sapiens
gagttgcagtgaact

SEQ ID NO: 333399 - DNA, 15 bp, Homo sapiens
agttgcagtgaactg

SEQ ID NO: 333400 - DNA, 15 bp, Homo sapiens
gttgcagtgaactga

SEQ ID NO: 333401 - DNA, 15 bp, Homo sapiens
ttgcagtgaactgag

SEQ ID NO: 333402 - DNA, 15 bp, Homo sapiens
tgcagtgaactgaga

SEQ ID NO: 333403 - DNA, 15 bp, Homo sapiens
gcagtgaactgagat

SEQ ID NO: 333404 - DNA, 15 bp, Homo sapiens
cagtgaactgagatc

SEQ ID NO: 333405 - DNA, 15 bp, Homo sapiens
agtgaactgagatca

SEQ ID NO: 333406 - DNA, 15 bp, Homo sapiens
gtgaactgagatcat

SEQ ID NO: 333407 - DNA, 15 bp, Homo sapiens
tgaactgagatcatg

SEQ ID NO: 333408 - DNA, 15 bp, Homo sapiens
gaactgagatcatgc

SEQ ID NO: 333409 - DNA, 15 bp, Homo sapiens
aactgagatcatgcc

SEQ ID NO: 333410 - DNA, 15 bp, Homo sapiens
actgagatcatgcca

SEQ ID NO: 333411 - DNA, 15 bp, Homo sapiens
gagatcatgccactg

SEQ ID NO: 333412 - DNA, 15 bp, Homo sapiens
agatcatgccactgc

SEQ ID NO: 333413 - DNA, 15 bp, Homo sapiens
gatcatgccactgca

SEQ ID NO: 333414 - DNA, 15 bp, Homo sapiens
atcatgccactgcac

SEQ ID NO: 333415 - DNA, 15 bp, Homo sapiens
tcatgccactgcact

SEQ ID NO: 333416 - DNA, 15 bp, Homo sapiens
catgccactgcactc

SEQ ID NO: 333417 - DNA, 15 bp, Homo sapiens
atgccactgcactcc

SEQ ID NO: 333418 - DNA, 15 bp, Homo sapiens
gcctggtgacagagc

SEQ ID NO: 333419 - DNA, 15 bp, Homo sapiens
cctggtgacagagcg

SEQ ID NO: 333420 - DNA, 15 bp, Homo sapiens
ctggtgacagagcga

SEQ ID NO: 333421 - DNA, 15 bp, Homo sapiens
tggtgacagagcgac

SEQ ID NO: 333422 - DNA, 15 bp, Homo sapiens
ggtgacagagcgaca

SEQ ID NO: 333423 - DNA, 15 bp, Homo sapiens
gtgacagagcgacac

SEQ ID NO: 333424 - DNA, 15 bp, Homo sapiens
tgacagagcgacact

SEQ ID NO: 333425 - DNA, 15 bp, Homo sapiens
gacagagcgacactc

SEQ ID NO: 333426 - DNA, 15 bp, Homo sapiens
acagagcgacactct

SEQ ID NO: 333427 - DNA, 15 bp, Homo sapiens
cagagcgacactctg

SEQ ID NO: 333428 - DNA, 15 bp, Homo sapiens
agagcgacactctgt

SEQ ID NO: 333429 - DNA, 15 bp, Homo sapiens
gagcgacactctgtc

SEQ ID NO: 333430 - DNA, 15 bp, Homo sapiens
agcgacactctgtct

SEQ ID NO: 333431 - DNA, 15 bp, Homo sapiens
gcgacactctgtctc

SEQ ID NO: 333432 - DNA, 15 bp, Homo sapiens
cgacactctgtctca

SEQ ID NO: 333433 - DNA, 15 bp, Homo sapiens
gacactctgtctcaa

SEQ ID NO: 333434 - DNA, 15 bp, Homo sapiens
acactctgtctcaaa

SEQ ID NO: 333435 - DNA, 15 bp, Homo sapiens
cactctgtctcaaaa

SEQ ID NO: 333436 - DNA, 15 bp, Homo sapiens
aaaaaaaaaagtttt

SEQ ID NO: 333437 - DNA, 15 bp, Homo sapiens
aaaaaaaaagttttt

SEQ ID NO: 333438 - DNA, 15 bp, Homo sapiens
aaaaaaagttttttg

SEQ ID NO: 333439 - DNA, 15 bp, Homo sapiens
aaaaaagttttttgt

SEQ ID NO: 333440 - DNA, 15 bp, Homo sapiens
aaaaagttttttgta

SEQ ID NO: 333441 - DNA, 15 bp, Homo sapiens
aaaagttttttgtag

SEQ ID NO: 333442 - DNA, 15 bp, Homo sapiens
aaagttttttgtaga

SEQ ID NO: 333443 - DNA, 15 bp, Homo sapiens
aagttttttgtagag

SEQ ID NO: 333444 - DNA, 15 bp, Homo sapiens
agttttttgtagaga

SEQ ID NO: 333445 - DNA, 15 bp, Homo sapiens
gttttttgtagagac

SEQ ID NO: 333446 - DNA, 15 bp, Homo sapiens
tttttgtagagacag

SEQ ID NO: 333447 - DNA, 15 bp, Homo sapiens
ttttgtagagacaga

SEQ ID NO: 333448 - DNA, 15 bp, Homo sapiens
tttgtagagacagag

SEQ ID NO: 333449 - DNA, 15 bp, Homo sapiens
ttgtagagacagagg

SEQ ID NO: 333450 - DNA, 15 bp, Homo sapiens
tgtagagacagaggc

SEQ ID NO: 333451 - DNA, 15 bp, Homo sapiens
gtagagacagaggcc

SEQ ID NO: 333452 - DNA, 15 bp, Homo sapiens
tagagacagaggcct

SEQ ID NO: 333453 - DNA, 15 bp, Homo sapiens
agagacagaggcctc

SEQ ID NO: 333454 - DNA, 15 bp, Homo sapiens
gagacagaggcctca

SEQ ID NO: 333455 - DNA, 15 bp, Homo sapiens
agacagaggcctcac

SEQ ID NO: 333456 - DNA, 15 bp, Homo sapiens
gacagaggcctcact

SEQ ID NO: 333457 - DNA, 15 bp, Homo sapiens
acagaggcctcacta

SEQ ID NO: 333458 - DNA, 15 bp, Homo sapiens
cagaggcctcactat

SEQ ID NO: 333459 - DNA, 15 bp, Homo sapiens
agaggcctcactatg

SEQ ID NO: 333460 - DNA, 15 bp, Homo sapiens
gaggcctcactatgt

SEQ ID NO: 333461 - DNA, 15 bp, Homo sapiens
aggcctcactatgtt

SEQ ID NO: 333462 - DNA, 15 bp, Homo sapiens
ggcctcactatgttg

SEQ ID NO: 333463 - DNA, 15 bp, Homo sapiens
gcctcactatgttgc

SEQ ID NO: 333464 - DNA, 15 bp, Homo sapiens
cctcactatgttgcc

SEQ ID NO: 333465 - DNA, 15 bp, Homo sapiens
tgttgcccaggctga

SEQ ID NO: 333466 - DNA, 15 bp, Homo sapiens
gttgcccaggctgat

SEQ ID NO: 333467 - DNA, 15 bp, Homo sapiens
ttgcccaggctgatc

SEQ ID NO: 333468 - DNA, 15 bp, Homo sapiens
tgcccaggctgatct

SEQ ID NO: 333469 - DNA, 15 bp, Homo sapiens
gcccaggctgatctt

SEQ ID NO: 333470 - DNA, 15 bp, Homo sapiens
cccaggctgatcttg

SEQ ID NO: 333471 - DNA, 15 bp, Homo sapiens
ccaggctgatcttga

SEQ ID NO: 333472 - DNA, 15 bp, Homo sapiens
caggctgatcttgaa

SEQ ID NO: 333473 - DNA, 15 bp, Homo sapiens
aggctgatcttgaac

SEQ ID NO: 333474 - DNA, 15 bp, Homo sapiens
ggctgatcttgaact

SEQ ID NO: 333475 - DNA, 15 bp, Homo sapiens
gctgatcttgaactc

SEQ ID NO: 333476 - DNA, 15 bp, Homo sapiens
ctgatcttgaactcc

SEQ ID NO: 333477 - DNA, 15 bp, Homo sapiens
tgatcttgaactcct

SEQ ID NO: 333478 - DNA, 15 bp, Homo sapiens
gatcttgaactcctg

SEQ ID NO: 333479 - DNA, 15 bp, Homo sapiens
atcttgaactcctgg

SEQ ID NO: 333480 - DNA, 15 bp, Homo sapiens
tcttgaactcctgga

SEQ ID NO: 333481 - DNA, 15 bp, Homo sapiens
cttgaactcctggac

SEQ ID NO: 333482 - DNA, 15 bp, Homo sapiens
ttgaactcctggact

SEQ ID NO: 333483 - DNA, 15 bp, Homo sapiens
tgaactcctggactc

SEQ ID NO: 333484 - DNA, 15 bp, Homo sapiens
tcctggactcaagca

SEQ ID NO: 333485 - DNA, 15 bp, Homo sapiens
cctggactcaagcaa

SEQ ID NO: 333486 - DNA, 15 bp, Homo sapiens
ctggactcaagcaat

SEQ ID NO: 333487 - DNA, 15 bp, Homo sapiens
tggactcaagcaatc

SEQ ID NO: 333488 - DNA, 15 bp, Homo sapiens
ggactcaagcaatcc

SEQ ID NO: 333489 - DNA, 15 bp, Homo sapiens
gactcaagcaatccg

SEQ ID NO: 333490 - DNA, 15 bp, Homo sapiens
actcaagcaatccgc

SEQ ID NO: 333491 - DNA, 15 bp, Homo sapiens
ctcaagcaatccgcc

SEQ ID NO: 333492 - DNA, 15 bp, Homo sapiens
tcaagcaatccgccc

SEQ ID NO: 333493 - DNA, 15 bp, Homo sapiens
caagcaatccgccct

SEQ ID NO: 333494 - DNA, 15 bp, Homo sapiens
aagcaatccgccctc

SEQ ID NO: 333495 - DNA, 15 bp, Homo sapiens
agcaatccgccctcc

SEQ ID NO: 333496 - DNA, 15 bp, Homo sapiens
gcaatccgccctcct

SEQ ID NO: 333497 - DNA, 15 bp, Homo sapiens
caatccgccctcctc

SEQ ID NO: 333498 - DNA, 15 bp, Homo sapiens
aatccgccctcctcg

SEQ ID NO: 333499 - DNA, 15 bp, Homo sapiens
atccgccctcctcgg

SEQ ID NO: 333500 - DNA, 15 bp, Homo sapiens
tccgccctcctcggc

SEQ ID NO: 333501 - DNA, 15 bp, Homo sapiens
ccgccctcctcggcc

SEQ ID NO: 333502 - DNA, 15 bp, Homo sapiens
cgccctcctcggcct

SEQ ID NO: 333503 - DNA, 15 bp, Homo sapiens
gccctcctcggcctc

SEQ ID NO: 333504 - DNA, 15 bp, Homo sapiens
ccctcctcggcctcc

SEQ ID NO: 333505 - DNA, 15 bp, Homo sapiens
cctcctcggcctccc

SEQ ID NO: 333506 - DNA, 15 bp, Homo sapiens
ctcctcggcctccca

SEQ ID NO: 333507 - DNA, 15 bp, Homo sapiens
ttataggtgtgagct

SEQ ID NO: 333508 - DNA, 15 bp, Homo sapiens
tataggtgtgagcta

SEQ ID NO: 333509 - DNA, 15 bp, Homo sapiens
ataggtgtgagctac

SEQ ID NO: 333510 - DNA, 15 bp, Homo sapiens
taggtgtgagctacc

SEQ ID NO: 333511 - DNA, 15 bp, Homo sapiens
aggtgtgagctacca

SEQ ID NO: 333512 - DNA, 15 bp, Homo sapiens
ggtgtgagctaccat

SEQ ID NO: 333513 - DNA, 15 bp, Homo sapiens
gtgtgagctaccatg

SEQ ID NO: 333514 - DNA, 15 bp, Homo sapiens
tgtgagctaccatgc

SEQ ID NO: 333515 - DNA, 15 bp, Homo sapiens
gtgagctaccatgcc

SEQ ID NO: 333516 - DNA, 15 bp, Homo sapiens
tgagctaccatgccc

SEQ ID NO: 333517 - DNA, 15 bp, Homo sapiens
gagctaccatgccca

SEQ ID NO: 333518 - DNA, 15 bp, Homo sapiens
agctaccatgcccag

SEQ ID NO: 333519 - DNA, 15 bp, Homo sapiens
gctaccatgcccagg

SEQ ID NO: 333520 - DNA, 15 bp, Homo sapiens
ctaccatgcccaggc

SEQ ID NO: 333521 - DNA, 15 bp, Homo sapiens
taccatgcccaggct

SEQ ID NO: 333522 - DNA, 15 bp, Homo sapiens
accatgcccaggctt

SEQ ID NO: 333523 - DNA, 15 bp, Homo sapiens
ccatgcccaggcttc

SEQ ID NO: 333524 - DNA, 15 bp, Homo sapiens
catgcccaggcttcc

SEQ ID NO: 333525 - DNA, 15 bp, Homo sapiens
atgcccaggcttccc

SEQ ID NO: 333526 - DNA, 15 bp, Homo sapiens
tgcccaggcttccca

SEQ ID NO: 333527 - DNA, 15 bp, Homo sapiens
gcccaggcttcccag

SEQ ID NO: 333528 - DNA, 15 bp, Homo sapiens
cccaggcttcccagt

SEQ ID NO: 333529 - DNA, 15 bp, Homo sapiens
ccaggcttcccagtg

SEQ ID NO: 333530 - DNA, 15 bp, Homo sapiens
caggcttcccagtgt

SEQ ID NO: 333531 - DNA, 15 bp, Homo sapiens
aggcttcccagtgtc

SEQ ID NO: 333532 - DNA, 15 bp, Homo sapiens
ggcttcccagtgtca

SEQ ID NO: 333533 - DNA, 15 bp, Homo sapiens
gcttcccagtgtcat

SEQ ID NO: 333534 - DNA, 15 bp, Homo sapiens
cttcccagtgtcatt

SEQ ID NO: 333535 - DNA, 15 bp, Homo sapiens
ttcccagtgtcattc

SEQ ID NO: 333536 - DNA, 15 bp, Homo sapiens
tcccagtgtcattct

SEQ ID NO: 333537 - DNA, 15 bp, Homo sapiens
cccagtgtcattctg

SEQ ID NO: 333538 - DNA, 15 bp, Homo sapiens
ccagtgtcattctga

SEQ ID NO: 333539 - DNA, 15 bp, Homo sapiens
cagtgtcattctgat

SEQ ID NO: 333540 - DNA, 15 bp, Homo sapiens
agtgtcattctgatt

SEQ ID NO: 333541 - DNA, 15 bp, Homo sapiens
gtgtcattctgattt

SEQ ID NO: 333542 - DNA, 15 bp, Homo sapiens
tgtcattctgatttg

SEQ ID NO: 333543 - DNA, 15 bp, Homo sapiens
gtcattctgatttga

SEQ ID NO: 333544 - DNA, 15 bp, Homo sapiens
tcattctgatttgaa

SEQ ID NO: 333545 - DNA, 15 bp, Homo sapiens
cattctgatttgaat

SEQ ID NO: 333546 - DNA, 15 bp, Homo sapiens
attctgatttgaatt

SEQ ID NO: 333547 - DNA, 15 bp, Homo sapiens
ttctgatttgaattt

SEQ ID NO: 333548 - DNA, 15 bp, Homo sapiens
tctgatttgaatttt

SEQ ID NO: 333549 - DNA, 15 bp, Homo sapiens
ctgatttgaattttt

SEQ ID NO: 333550 - DNA, 15 bp, Homo sapiens
tgatttgaatttttc

SEQ ID NO: 333551 - DNA, 15 bp, Homo sapiens
gatttgaatttttct

SEQ ID NO: 333552 - DNA, 15 bp, Homo sapiens
atttgaatttttcta

SEQ ID NO: 333553 - DNA, 15 bp, Homo sapiens
tttgaatttttctag

SEQ ID NO: 333554 - DNA, 15 bp, Homo sapiens
ttgaatttttctaga

SEQ ID NO: 333555 - DNA, 15 bp, Homo sapiens
tgaatttttctagaa

SEQ ID NO: 333556 - DNA, 15 bp, Homo sapiens
gaatttttctagaaa

SEQ ID NO: 333557 - DNA, 15 bp, Homo sapiens
aatttttctagaaag

SEQ ID NO: 333558 - DNA, 15 bp, Homo sapiens
atttttctagaaaga

SEQ ID NO: 333559 - DNA, 15 bp, Homo sapiens
tttttctagaaagat

SEQ ID NO: 333560 - DNA, 15 bp, Homo sapiens
ttttctagaaagatt

SEQ ID NO: 333561 - DNA, 15 bp, Homo sapiens
tttctagaaagattt

SEQ ID NO: 333562 - DNA, 15 bp, Homo sapiens
ttctagaaagatttc

SEQ ID NO: 333563 - DNA, 15 bp, Homo sapiens
tctagaaagatttct

SEQ ID NO: 333564 - DNA, 15 bp, Homo sapiens
ctagaaagatttcta

SEQ ID NO: 333565 - DNA, 15 bp, Homo sapiens
tagaaagatttctag

SEQ ID NO: 333566 - DNA, 15 bp, Homo sapiens
agaaagatttctaga

SEQ ID NO: 333567 - DNA, 15 bp, Homo sapiens
gaaagatttctagaa

SEQ ID NO: 333568 - DNA, 15 bp, Homo sapiens
aaagatttctagaat

SEQ ID NO: 333569 - DNA, 15 bp, Homo sapiens
aagatttctagaatt

SEQ ID NO: 333570 - DNA, 15 bp, Homo sapiens
agatttctagaattt

SEQ ID NO: 333571 - DNA, 15 bp, Homo sapiens
gatttctagaatttt

SEQ ID NO: 333572 - DNA, 15 bp, Homo sapiens
atttctagaattttt

SEQ ID NO: 333573 - DNA, 15 bp, Homo sapiens
tttctagaatttttc

SEQ ID NO: 333574 - DNA, 15 bp, Homo sapiens
ttctagaatttttct

SEQ ID NO: 333575 - DNA, 15 bp, Homo sapiens
tctagaatttttcta

SEQ ID NO: 333576 - DNA, 15 bp, Homo sapiens
ctagaatttttctag

SEQ ID NO: 333577 - DNA, 15 bp, Homo sapiens
tagaatttttctaga

SEQ ID NO: 333578 - DNA, 15 bp, Homo sapiens
agaatttttctagaa

SEQ ID NO: 333579 - DNA, 15 bp, Homo sapiens
gaatttttctagaat

SEQ ID NO: 333580 - DNA, 15 bp, Homo sapiens
aatttttctagaatg

SEQ ID NO: 333581 - DNA, 15 bp, Homo sapiens
atttttctagaatga

SEQ ID NO: 333582 - DNA, 15 bp, Homo sapiens
tttttctagaatgat

SEQ ID NO: 333583 - DNA, 15 bp, Homo sapiens
ttttctagaatgatt

SEQ ID NO: 333584 - DNA, 15 bp, Homo sapiens
tttctagaatgatta

SEQ ID NO: 333585 - DNA, 15 bp, Homo sapiens
ttctagaatgattat

SEQ ID NO: 333586 - DNA, 15 bp, Homo sapiens
tctagaatgattatt

SEQ ID NO: 333587 - DNA, 15 bp, Homo sapiens
ctagaatgattattg

SEQ ID NO: 333588 - DNA, 15 bp, Homo sapiens
tagaatgattattgt

SEQ ID NO: 333589 - DNA, 15 bp, Homo sapiens
agaatgattattgta

SEQ ID NO: 333590 - DNA, 15 bp, Homo sapiens
gaatgattattgtat

SEQ ID NO: 333591 - DNA, 15 bp, Homo sapiens
aatgattattgtatc

SEQ ID NO: 333592 - DNA, 15 bp, Homo sapiens
atgattattgtatcc

SEQ ID NO: 333593 - DNA, 15 bp, Homo sapiens
tgattattgtatcct

SEQ ID NO: 333594 - DNA, 15 bp, Homo sapiens
gattattgtatccta

SEQ ID NO: 333595 - DNA, 15 bp, Homo sapiens
attattgtatcctaa

SEQ ID NO: 333596 - DNA, 15 bp, Homo sapiens
ttattgtatcctaaa

SEQ ID NO: 333597 - DNA, 15 bp, Homo sapiens
tattgtatcctaaac

SEQ ID NO: 333598 - DNA, 15 bp, Homo sapiens
attgtatcctaaaca

SEQ ID NO: 333599 - DNA, 15 bp, Homo sapiens
ttgtatcctaaacat

SEQ ID NO: 333600 - DNA, 15 bp, Homo sapiens
tgtatcctaaacatt

SEQ ID NO: 333601 - DNA, 15 bp, Homo sapiens
gtatcctaaacattt

SEQ ID NO: 333602 - DNA, 15 bp, Homo sapiens
tatcctaaacattta

SEQ ID NO: 333603 - DNA, 15 bp, Homo sapiens
atcctaaacatttat

SEQ ID NO: 333604 - DNA, 15 bp, Homo sapiens
tcctaaacatttata

SEQ ID NO: 333605 - DNA, 15 bp, Homo sapiens
cctaaacatttatag

SEQ ID NO: 333606 - DNA, 15 bp, Homo sapiens
ctaaacatttatagc

SEQ ID NO: 333607 - DNA, 15 bp, Homo sapiens
taaacatttatagca

SEQ ID NO: 333608 - DNA, 15 bp, Homo sapiens
aaacatttatagcat

SEQ ID NO: 333609 - DNA, 15 bp, Homo sapiens
aacatttatagcatt

SEQ ID NO: 333610 - DNA, 15 bp, Homo sapiens
acatttatagcatta

SEQ ID NO: 333611 - DNA, 15 bp, Homo sapiens
catttatagcattat

SEQ ID NO: 333612 - DNA, 15 bp, Homo sapiens
atttatagcattatg

SEQ ID NO: 333613 - DNA, 15 bp, Homo sapiens
tttatagcattatgt

SEQ ID NO: 333614 - DNA, 15 bp, Homo sapiens
ttatagcattatgtt

SEQ ID NO: 333615 - DNA, 15 bp, Homo sapiens
tatagcattatgttc

SEQ ID NO: 333616 - DNA, 15 bp, Homo sapiens
atagcattatgttct

SEQ ID NO: 333617 - DNA, 15 bp, Homo sapiens
tagcattatgttctt

SEQ ID NO: 333618 - DNA, 15 bp, Homo sapiens
agcattatgttcttt

SEQ ID NO: 333619 - DNA, 15 bp, Homo sapiens
gcattatgttcttta

SEQ ID NO: 333620 - DNA, 15 bp, Homo sapiens
cattatgttctttac

SEQ ID NO: 333621 - DNA, 15 bp, Homo sapiens
attatgttctttact

SEQ ID NO: 333622 - DNA, 15 bp, Homo sapiens
ttatgttctttactt

SEQ ID NO: 333623 - DNA, 15 bp, Homo sapiens
tatgttctttacttt

SEQ ID NO: 333624 - DNA, 15 bp, Homo sapiens
atgttctttactttt

SEQ ID NO: 333625 - DNA, 15 bp, Homo sapiens
tgttctttacttttt

SEQ ID NO: 333626 - DNA, 15 bp, Homo sapiens
gttctttacttttta

SEQ ID NO: 333627 - DNA, 15 bp, Homo sapiens
ttctttactttttat

SEQ ID NO: 333628 - DNA, 15 bp, Homo sapiens
tctttactttttatt

SEQ ID NO: 333629 - DNA, 15 bp, Homo sapiens
ctttactttttattg

SEQ ID NO: 333630 - DNA, 15 bp, Homo sapiens
tttactttttattgc

SEQ ID NO: 333631 - DNA, 15 bp, Homo sapiens
ttactttttattgct

SEQ ID NO: 333632 - DNA, 15 bp, Homo sapiens
tactttttattgctt

SEQ ID NO: 333633 - DNA, 15 bp, Homo sapiens
actttttattgctta

SEQ ID NO: 333634 - DNA, 15 bp, Homo sapiens
ctttttattgcttag

SEQ ID NO: 333635 - DNA, 15 bp, Homo sapiens
tttttattgcttaga

SEQ ID NO: 333636 - DNA, 15 bp, Homo sapiens
ttttattgcttagaa

SEQ ID NO: 333637 - DNA, 15 bp, Homo sapiens
tttattgcttagaaa

SEQ ID NO: 333638 - DNA, 15 bp, Homo sapiens
ttattgcttagaaaa

SEQ ID NO: 333639 - DNA, 15 bp, Homo sapiens
tattgcttagaaaaa

SEQ ID NO: 333640 - DNA, 15 bp, Homo sapiens
attgcttagaaaaaa

SEQ ID NO: 333641 - DNA, 15 bp, Homo sapiens
ttgcttagaaaaaaa

SEQ ID NO: 333642 - DNA, 15 bp, Homo sapiens
tgcttagaaaaaaat

SEQ ID NO: 333643 - DNA, 15 bp, Homo sapiens
gcttagaaaaaaata

SEQ ID NO: 333644 - DNA, 15 bp, Homo sapiens
cttagaaaaaaatag

SEQ ID NO: 333645 - DNA, 15 bp, Homo sapiens
ttagaaaaaaatagt

SEQ ID NO: 333646 - DNA, 15 bp, Homo sapiens
tagaaaaaaatagtt

SEQ ID NO: 333647 - DNA, 15 bp, Homo sapiens
agaaaaaaatagttt

SEQ ID NO: 333648 - DNA, 15 bp, Homo sapiens
gaaaaaaatagttta

SEQ ID NO: 333649 - DNA, 15 bp, Homo sapiens
aaaaaaatagtttag

SEQ ID NO: 333650 - DNA, 15 bp, Homo sapiens
aaaaaatagtttagt

SEQ ID NO: 333651 - DNA, 15 bp, Homo sapiens
aaaaatagtttagtt

SEQ ID NO: 333652 - DNA, 15 bp, Homo sapiens
aaaatagtttagtta

SEQ ID NO: 333653 - DNA, 15 bp, Homo sapiens
aaatagtttagttac

SEQ ID NO: 333654 - DNA, 15 bp, Homo sapiens
aatagtttagttact

SEQ ID NO: 333655 - DNA, 15 bp, Homo sapiens
atagtttagttacta

SEQ ID NO: 333656 - DNA, 15 bp, Homo sapiens
tagtttagttactac

SEQ ID NO: 333657 - DNA, 15 bp, Homo sapiens
agtttagttactact

SEQ ID NO: 333658 - DNA, 15 bp, Homo sapiens
gtttagttactactg

SEQ ID NO: 333659 - DNA, 15 bp, Homo sapiens
tttagttactactgg

SEQ ID NO: 333660 - DNA, 15 bp, Homo sapiens
ttagttactactggt

SEQ ID NO: 333661 - DNA, 15 bp, Homo sapiens
tagttactactggta

SEQ ID NO: 333662 - DNA, 15 bp, Homo sapiens
agttactactggtaa

SEQ ID NO: 333663 - DNA, 15 bp, Homo sapiens
gttactactggtaat

SEQ ID NO: 333664 - DNA, 15 bp, Homo sapiens
ttactactggtaatt

SEQ ID NO: 333665 - DNA, 15 bp, Homo sapiens
tactactggtaattt

SEQ ID NO: 333666 - DNA, 15 bp, Homo sapiens
actactggtaatttg

SEQ ID NO: 333667 - DNA, 15 bp, Homo sapiens
ctactggtaatttgc

SEQ ID NO: 333668 - DNA, 15 bp, Homo sapiens
tactggtaatttgca

SEQ ID NO: 333669 - DNA, 15 bp, Homo sapiens
actggtaatttgcaa

SEQ ID NO: 333670 - DNA, 15 bp, Homo sapiens
ctggtaatttgcaaa

SEQ ID NO: 333671 - DNA, 15 bp, Homo sapiens
tggtaatttgcaaat

SEQ ID NO: 333672 - DNA, 15 bp, Homo sapiens
ggtaatttgcaaatt

SEQ ID NO: 333673 - DNA, 15 bp, Homo sapiens
gtaatttgcaaatta

SEQ ID NO: 333674 - DNA, 15 bp, Homo sapiens
taatttgcaaattaa

SEQ ID NO: 333675 - DNA, 15 bp, Homo sapiens
aatttgcaaattaaa

SEQ ID NO: 333676 - DNA, 15 bp, Homo sapiens
atttgcaaattaaag

SEQ ID NO: 333677 - DNA, 15 bp, Homo sapiens
tttgcaaattaaaga

SEQ ID NO: 333678 - DNA, 15 bp, Homo sapiens
ttgcaaattaaagaa

SEQ ID NO: 333679 - DNA, 15 bp, Homo sapiens
tgcaaattaaagaat

SEQ ID NO: 333680 - DNA, 15 bp, Homo sapiens
gcaaattaaagaatt

SEQ ID NO: 333681 - DNA, 15 bp, Homo sapiens
caaattaaagaatta

SEQ ID NO: 333682 - DNA, 15 bp, Homo sapiens
aaattaaagaattat

SEQ ID NO: 333683 - DNA, 15 bp, Homo sapiens
aattaaagaattatg

SEQ ID NO: 333684 - DNA, 15 bp, Homo sapiens
attaaagaattatgt

SEQ ID NO: 333685 - DNA, 15 bp, Homo sapiens
ttaaagaattatgta

SEQ ID NO: 333686 - DNA, 15 bp, Homo sapiens
taaagaattatgtat

SEQ ID NO: 333687 - DNA, 15 bp, Homo sapiens
aaagaattatgtata

SEQ ID NO: 333688 - DNA, 15 bp, Homo sapiens
aagaattatgtataa

SEQ ID NO: 333689 - DNA, 15 bp, Homo sapiens
agaattatgtataaa

SEQ ID NO: 333690 - DNA, 15 bp, Homo sapiens
gaattatgtataaaa

SEQ ID NO: 333691 - DNA, 15 bp, Homo sapiens
aattatgtataaaat

SEQ ID NO: 333692 - DNA, 15 bp, Homo sapiens
attatgtataaaatt

SEQ ID NO: 333693 - DNA, 15 bp, Homo sapiens
ttatgtataaaattg

SEQ ID NO: 333694 - DNA, 15 bp, Homo sapiens
tatgtataaaattgc

SEQ ID NO: 333695 - DNA, 15 bp, Homo sapiens
atgtataaaattgct

SEQ ID NO: 333696 - DNA, 15 bp, Homo sapiens
tgtataaaattgcta

SEQ ID NO: 333697 - DNA, 15 bp, Homo sapiens
gtataaaattgctat

SEQ ID NO: 333698 - DNA, 15 bp, Homo sapiens
tataaaattgctata

SEQ ID NO: 333699 - DNA, 15 bp, Homo sapiens
ataaaattgctatag

SEQ ID NO: 333700 - DNA, 15 bp, Homo sapiens
taaaattgctatagg

SEQ ID NO: 333701 - DNA, 15 bp, Homo sapiens
aaaattgctataggt

SEQ ID NO: 333702 - DNA, 15 bp, Homo sapiens
aaattgctataggtg

SEQ ID NO: 333703 - DNA, 15 bp, Homo sapiens
aattgctataggtgc

SEQ ID NO: 333704 - DNA, 15 bp, Homo sapiens
attgctataggtgcc

SEQ ID NO: 333705 - DNA, 15 bp, Homo sapiens
ttgctataggtgcct

SEQ ID NO: 333706 - DNA, 15 bp, Homo sapiens
tgctataggtgcctg

SEQ ID NO: 333707 - DNA, 15 bp, Homo sapiens
gctataggtgcctgt

SEQ ID NO: 333708 - DNA, 15 bp, Homo sapiens
ctataggtgcctgtg

SEQ ID NO: 333709 - DNA, 15 bp, Homo sapiens
tataggtgcctgtgg

SEQ ID NO: 333710 - DNA, 15 bp, Homo sapiens
ataggtgcctgtggt

SEQ ID NO: 333711 - DNA, 15 bp, Homo sapiens
taggtgcctgtggtt

SEQ ID NO: 333712 - DNA, 15 bp, Homo sapiens
aggtgcctgtggtta

SEQ ID NO: 333713 - DNA, 15 bp, Homo sapiens
ggtgcctgtggttaa

SEQ ID NO: 333714 - DNA, 15 bp, Homo sapiens
gtgcctgtggttaaa

SEQ ID NO: 333715 - DNA, 15 bp, Homo sapiens
tgcctgtggttaaat

SEQ ID NO: 333716 - DNA, 15 bp, Homo sapiens
gcctgtggttaaatt

SEQ ID NO: 333717 - DNA, 15 bp, Homo sapiens
cctgtggttaaattc

SEQ ID NO: 333718 - DNA, 15 bp, Homo sapiens
ctgtggttaaattct

SEQ ID NO: 333719 - DNA, 15 bp, Homo sapiens
tgtggttaaattctt

SEQ ID NO: 333720 - DNA, 15 bp, Homo sapiens
gtggttaaattcttt

SEQ ID NO: 333721 - DNA, 15 bp, Homo sapiens
tggttaaattctttt

SEQ ID NO: 333722 - DNA, 15 bp, Homo sapiens
ggttaaattctttta

SEQ ID NO: 333723 - DNA, 15 bp, Homo sapiens
gttaaattcttttac

SEQ ID NO: 333724 - DNA, 15 bp, Homo sapiens
ttaaattcttttacc

SEQ ID NO: 333725 - DNA, 15 bp, Homo sapiens
taaattcttttacca

SEQ ID NO: 333726 - DNA, 15 bp, Homo sapiens
aaattcttttaccaa

SEQ ID NO: 333727 - DNA, 15 bp, Homo sapiens
aattcttttaccaag

SEQ ID NO: 333728 - DNA, 15 bp, Homo sapiens
attcttttaccaaga

SEQ ID NO: 333729 - DNA, 15 bp, Homo sapiens
ttcttttaccaagat

SEQ ID NO: 333730 - DNA, 15 bp, Homo sapiens
tcttttaccaagatt

SEQ ID NO: 333731 - DNA, 15 bp, Homo sapiens
cttttaccaagattt

SEQ ID NO: 333732 - DNA, 15 bp, Homo sapiens
ttttaccaagatttc

SEQ ID NO: 333733 - DNA, 15 bp, Homo sapiens
tttaccaagatttca

SEQ ID NO: 333734 - DNA, 15 bp, Homo sapiens
ttaccaagatttcac

SEQ ID NO: 333735 - DNA, 15 bp, Homo sapiens
taccaagatttcact

SEQ ID NO: 333736 - DNA, 15 bp, Homo sapiens
accaagatttcactt

SEQ ID NO: 333737 - DNA, 15 bp, Homo sapiens
ccaagatttcacttc

SEQ ID NO: 333738 - DNA, 15 bp, Homo sapiens
caagatttcacttct

SEQ ID NO: 333739 - DNA, 15 bp, Homo sapiens
aagatttcacttcta

SEQ ID NO: 333740 - DNA, 15 bp, Homo sapiens
agatttcacttctag

SEQ ID NO: 333741 - DNA, 15 bp, Homo sapiens
gatttcacttctaga

SEQ ID NO: 333742 - DNA, 15 bp, Homo sapiens
atttcacttctagag

SEQ ID NO: 333743 - DNA, 15 bp, Homo sapiens
tttcacttctagaga

SEQ ID NO: 333744 - DNA, 15 bp, Homo sapiens
ttcacttctagagaa

SEQ ID NO: 333745 - DNA, 15 bp, Homo sapiens
tcacttctagagaac

SEQ ID NO: 333746 - DNA, 15 bp, Homo sapiens
cacttctagagaact

SEQ ID NO: 333747 - DNA, 15 bp, Homo sapiens
acttctagagaactg

SEQ ID NO: 333748 - DNA, 15 bp, Homo sapiens
cttctagagaactga

SEQ ID NO: 333749 - DNA, 15 bp, Homo sapiens
ttctagagaactgaa

SEQ ID NO: 333750 - DNA, 15 bp, Homo sapiens
tctagagaactgaag

SEQ ID NO: 333751 - DNA, 15 bp, Homo sapiens
ctagagaactgaaga

SEQ ID NO: 333752 - DNA, 15 bp, Homo sapiens
tagagaactgaagaa

SEQ ID NO: 333753 - DNA, 15 bp, Homo sapiens
agagaactgaagaat

SEQ ID NO: 333754 - DNA, 15 bp, Homo sapiens
gagaactgaagaatt

SEQ ID NO: 333755 - DNA, 15 bp, Homo sapiens
agaactgaagaattt

SEQ ID NO: 333756 - DNA, 15 bp, Homo sapiens
gaactgaagaattta

SEQ ID NO: 333757 - DNA, 15 bp, Homo sapiens
aactgaagaatttac

SEQ ID NO: 333758 - DNA, 15 bp, Homo sapiens
gaagaatttaccaaa

SEQ ID NO: 333759 - DNA, 15 bp, Homo sapiens
aagaatttaccaaag

SEQ ID NO: 333760 - DNA, 15 bp, Homo sapiens
agaatttaccaaagt

SEQ ID NO: 333761 - DNA, 15 bp, Homo sapiens
gaatttaccaaagta

SEQ ID NO: 333762 - DNA, 15 bp, Homo sapiens
aatttaccaaagtaa

SEQ ID NO: 333763 - DNA, 15 bp, Homo sapiens
atttaccaaagtaaa

SEQ ID NO: 333764 - DNA, 15 bp, Homo sapiens
tttaccaaagtaaaa

SEQ ID NO: 333765 - DNA, 15 bp, Homo sapiens
ttaccaaagtaaaaa

SEQ ID NO: 333766 - DNA, 15 bp, Homo sapiens
taccaaagtaaaaat

SEQ ID NO: 333767 - DNA, 15 bp, Homo sapiens
accaaagtaaaaatg

SEQ ID NO: 333768 - DNA, 15 bp, Homo sapiens
ccaaagtaaaaatgg

SEQ ID NO: 333769 - DNA, 15 bp, Homo sapiens
caaagtaaaaatggt

SEQ ID NO: 333770 - DNA, 15 bp, Homo sapiens
aaagtaaaaatggtc

SEQ ID NO: 333771 - DNA, 15 bp, Homo sapiens
aagtaaaaatggtct

SEQ ID NO: 333772 - DNA, 15 bp, Homo sapiens
agtaaaaatggtcta

SEQ ID NO: 333773 - DNA, 15 bp, Homo sapiens
gtaaaaatggtctaa

SEQ ID NO: 333774 - DNA, 15 bp, Homo sapiens
taaaaatggtctaac

SEQ ID NO: 333775 - DNA, 15 bp, Homo sapiens
aaaaatggtctaact

SEQ ID NO: 333776 - DNA, 15 bp, Homo sapiens
aaaatggtctaactt

SEQ ID NO: 333777 - DNA, 15 bp, Homo sapiens
aaatggtctaacttt

SEQ ID NO: 333778 - DNA, 15 bp, Homo sapiens
aatggtctaacttta

SEQ ID NO: 333779 - DNA, 15 bp, Homo sapiens
atggtctaactttat

SEQ ID NO: 333780 - DNA, 15 bp, Homo sapiens
tggtctaactttatt

SEQ ID NO: 333781 - DNA, 15 bp, Homo sapiens
ggtctaactttatta

SEQ ID NO: 333782 - DNA, 15 bp, Homo sapiens
gtctaactttattac

SEQ ID NO: 333783 - DNA, 15 bp, Homo sapiens
tctaactttattact

SEQ ID NO: 333784 - DNA, 15 bp, Homo sapiens
ctaactttattactt

SEQ ID NO: 333785 - DNA, 15 bp, Homo sapiens
taactttattacttg

SEQ ID NO: 333786 - DNA, 15 bp, Homo sapiens
aactttattacttgg

SEQ ID NO: 333787 - DNA, 15 bp, Homo sapiens
actttattacttggt

SEQ ID NO: 333788 - DNA, 15 bp, Homo sapiens
ctttattacttggtt

SEQ ID NO: 333789 - DNA, 15 bp, Homo sapiens
tttattacttggttt

SEQ ID NO: 333790 - DNA, 15 bp, Homo sapiens
ttattacttggttta

SEQ ID NO: 333791 - DNA, 15 bp, Homo sapiens
tattacttggtttat

SEQ ID NO: 333792 - DNA, 15 bp, Homo sapiens
attacttggtttata

SEQ ID NO: 333793 - DNA, 15 bp, Homo sapiens
ttacttggtttatag

SEQ ID NO: 333794 - DNA, 15 bp, Homo sapiens
tacttggtttataga

SEQ ID NO: 333795 - DNA, 15 bp, Homo sapiens
acttggtttatagaa

SEQ ID NO: 333796 - DNA, 15 bp, Homo sapiens
cttggtttatagaaa

SEQ ID NO: 333797 - DNA, 15 bp, Homo sapiens
ttggtttatagaaat

SEQ ID NO: 333798 - DNA, 15 bp, Homo sapiens
tggtttatagaaatg

SEQ ID NO: 333799 - DNA, 15 bp, Homo sapiens
ggtttatagaaatga

SEQ ID NO: 333800 - DNA, 15 bp, Homo sapiens
gtttatagaaatgaa

SEQ ID NO: 333801 - DNA, 15 bp, Homo sapiens
tttatagaaatgaat

SEQ ID NO: 333802 - DNA, 15 bp, Homo sapiens
ttatagaaatgaata

SEQ ID NO: 333803 - DNA, 15 bp, Homo sapiens
tatagaaatgaataa

SEQ ID NO: 333804 - DNA, 15 bp, Homo sapiens
atagaaatgaataaa

SEQ ID NO: 333805 - DNA, 15 bp, Homo sapiens
tagaaatgaataaat

SEQ ID NO: 333806 - DNA, 15 bp, Homo sapiens
agaaatgaataaatc

SEQ ID NO: 333807 - DNA, 15 bp, Homo sapiens
gaaatgaataaatca

SEQ ID NO: 333808 - DNA, 15 bp, Homo sapiens
aaatgaataaatcat

SEQ ID NO: 333809 - DNA, 15 bp, Homo sapiens
aatgaataaatcata

SEQ ID NO: 333810 - DNA, 15 bp, Homo sapiens
atgaataaatcatag

SEQ ID NO: 333811 - DNA, 15 bp, Homo sapiens
tgaataaatcatagt

SEQ ID NO: 333812 - DNA, 15 bp, Homo sapiens
gaataaatcatagtt

SEQ ID NO: 333813 - DNA, 15 bp, Homo sapiens
aataaatcatagtta

SEQ ID NO: 333814 - DNA, 15 bp, Homo sapiens
ataaatcatagttaa

SEQ ID NO: 333815 - DNA, 15 bp, Homo sapiens
taaatcatagttaat

SEQ ID NO: 333816 - DNA, 15 bp, Homo sapiens
aaatcatagttaata

SEQ ID NO: 333817 - DNA, 15 bp, Homo sapiens
aatcatagttaatag

SEQ ID NO: 333818 - DNA, 15 bp, Homo sapiens
atcatagttaatagt

SEQ ID NO: 333819 - DNA, 15 bp, Homo sapiens
tcatagttaatagta

SEQ ID NO: 333820 - DNA, 15 bp, Homo sapiens
catagttaatagtac

SEQ ID NO: 333821 - DNA, 15 bp, Homo sapiens
atagttaatagtaca

SEQ ID NO: 333822 - DNA, 15 bp, Homo sapiens
tagttaatagtacag

SEQ ID NO: 333823 - DNA, 15 bp, Homo sapiens
agttaatagtacagt

SEQ ID NO: 333824 - DNA, 15 bp, Homo sapiens
gttaatagtacagta

SEQ ID NO: 333825 - DNA, 15 bp, Homo sapiens
ttaatagtacagtat

SEQ ID NO: 333826 - DNA, 15 bp, Homo sapiens
taatagtacagtata

SEQ ID NO: 333827 - DNA, 15 bp, Homo sapiens
aatagtacagtatat

SEQ ID NO: 333828 - DNA, 15 bp, Homo sapiens
atagtacagtatatt

SEQ ID NO: 333829 - DNA, 15 bp, Homo sapiens
tagtacagtatatta

SEQ ID NO: 333830 - DNA, 15 bp, Homo sapiens
agtacagtatattaa

SEQ ID NO: 333831 - DNA, 15 bp, Homo sapiens
gtacagtatattaat

SEQ ID NO: 333832 - DNA, 15 bp, Homo sapiens
tacagtatattaata

SEQ ID NO: 333833 - DNA, 15 bp, Homo sapiens
acagtatattaataa

SEQ ID NO: 333834 - DNA, 15 bp, Homo sapiens
cagtatattaataat

SEQ ID NO: 333835 - DNA, 15 bp, Homo sapiens
agtatattaataata

SEQ ID NO: 333836 - DNA, 15 bp, Homo sapiens
gtatattaataatac

SEQ ID NO: 333837 - DNA, 15 bp, Homo sapiens
tatattaataatact

SEQ ID NO: 333838 - DNA, 15 bp, Homo sapiens
atattaataatactg

SEQ ID NO: 333839 - DNA, 15 bp, Homo sapiens
tattaataatactgt

SEQ ID NO: 333840 - DNA, 15 bp, Homo sapiens
attaataatactgtg

SEQ ID NO: 333841 - DNA, 15 bp, Homo sapiens
ttaataatactgtgc

SEQ ID NO: 333842 - DNA, 15 bp, Homo sapiens
taataatactgtgct

SEQ ID NO: 333843 - DNA, 15 bp, Homo sapiens
aataatactgtgctc

SEQ ID NO: 333844 - DNA, 15 bp, Homo sapiens
ataatactgtgctct

SEQ ID NO: 333845 - DNA, 15 bp, Homo sapiens
taatactgtgctcta

SEQ ID NO: 333846 - DNA, 15 bp, Homo sapiens
aatactgtgctctaa

SEQ ID NO: 333847 - DNA, 15 bp, Homo sapiens
atactgtgctctaag

SEQ ID NO: 333848 - DNA, 15 bp, Homo sapiens
tactgtgctctaagc

SEQ ID NO: 333849 - DNA, 15 bp, Homo sapiens
actgtgctctaagct

SEQ ID NO: 333850 - DNA, 15 bp, Homo sapiens
ctgtgctctaagcta

SEQ ID NO: 333851 - DNA, 15 bp, Homo sapiens
tgtgctctaagctac

SEQ ID NO: 333852 - DNA, 15 bp, Homo sapiens
gtgctctaagctaca

SEQ ID NO: 333853 - DNA, 15 bp, Homo sapiens
tgctctaagctacag

SEQ ID NO: 333854 - DNA, 15 bp, Homo sapiens
gctctaagctacaga

SEQ ID NO: 333855 - DNA, 15 bp, Homo sapiens
ctctaagctacagat

SEQ ID NO: 333856 - DNA, 15 bp, Homo sapiens
tctaagctacagatt

SEQ ID NO: 333857 - DNA, 15 bp, Homo sapiens
ctaagctacagatta

SEQ ID NO: 333858 - DNA, 15 bp, Homo sapiens
taagctacagattag

SEQ ID NO: 333859 - DNA, 15 bp, Homo sapiens
aagctacagattaga

SEQ ID NO: 333860 - DNA, 15 bp, Homo sapiens
agctacagattagaa

SEQ ID NO: 333861 - DNA, 15 bp, Homo sapiens
gctacagattagaaa

SEQ ID NO: 333862 - DNA, 15 bp, Homo sapiens
ctacagattagaaaa

SEQ ID NO: 333863 - DNA, 15 bp, Homo sapiens
tacagattagaaaaa

SEQ ID NO: 333864 - DNA, 15 bp, Homo sapiens
acagattagaaaaat

SEQ ID NO: 333865 - DNA, 15 bp, Homo sapiens
cagattagaaaaata

SEQ ID NO: 333866 - DNA, 15 bp, Homo sapiens
agattagaaaaatat

SEQ ID NO: 333867 - DNA, 15 bp, Homo sapiens
gattagaaaaatatg

SEQ ID NO: 333868 - DNA, 15 bp, Homo sapiens
attagaaaaatatgc

SEQ ID NO: 333869 - DNA, 15 bp, Homo sapiens
ttagaaaaatatgca

SEQ ID NO: 333870 - DNA, 15 bp, Homo sapiens
tagaaaaatatgcac

SEQ ID NO: 333871 - DNA, 15 bp, Homo sapiens
agaaaaatatgcacc

SEQ ID NO: 333872 - DNA, 15 bp, Homo sapiens
gaaaaatatgcaccc

SEQ ID NO: 333873 - DNA, 15 bp, Homo sapiens
aaaaatatgcaccct

SEQ ID NO: 333874 - DNA, 15 bp, Homo sapiens
aaaatatgcaccctg

SEQ ID NO: 333875 - DNA, 15 bp, Homo sapiens
aaatatgcaccctgt

SEQ ID NO: 333876 - DNA, 15 bp, Homo sapiens
aatatgcaccctgtt

SEQ ID NO: 333877 - DNA, 15 bp, Homo sapiens
atatgcaccctgttt

SEQ ID NO: 333878 - DNA, 15 bp, Homo sapiens
tatgcaccctgtttg

SEQ ID NO: 333879 - DNA, 15 bp, Homo sapiens
atgcaccctgtttgt

SEQ ID NO: 333880 - DNA, 15 bp, Homo sapiens
tgcaccctgtttgtc

SEQ ID NO: 333881 - DNA, 15 bp, Homo sapiens
gcaccctgtttgtca

SEQ ID NO: 333882 - DNA, 15 bp, Homo sapiens
caccctgtttgtcac

SEQ ID NO: 333883 - DNA, 15 bp, Homo sapiens
accctgtttgtcaca

SEQ ID NO: 333884 - DNA, 15 bp, Homo sapiens
ccctgtttgtcacaa

SEQ ID NO: 333885 - DNA, 15 bp, Homo sapiens
cctgtttgtcacaat

SEQ ID NO: 333886 - DNA, 15 bp, Homo sapiens
ctgtttgtcacaata

SEQ ID NO: 333887 - DNA, 15 bp, Homo sapiens
tgtttgtcacaataa

SEQ ID NO: 333888 - DNA, 15 bp, Homo sapiens
gtttgtcacaataaa

SEQ ID NO: 333889 - DNA, 15 bp, Homo sapiens
tttgtcacaataaat

SEQ ID NO: 333890 - DNA, 15 bp, Homo sapiens
ttgtcacaataaatg

SEQ ID NO: 333891 - DNA, 15 bp, Homo sapiens
tgtcacaataaatgg

SEQ ID NO: 333892 - DNA, 15 bp, Homo sapiens
gtcacaataaatgga

SEQ ID NO: 333893 - DNA, 15 bp, Homo sapiens
tcacaataaatggag

SEQ ID NO: 333894 - DNA, 15 bp, Homo sapiens
cacaataaatggagt

SEQ ID NO: 333895 - DNA, 15 bp, Homo sapiens
acaataaatggagtg

SEQ ID NO: 333896 - DNA, 15 bp, Homo sapiens
caataaatggagtga

SEQ ID NO: 333897 - DNA, 15 bp, Homo sapiens
aataaatggagtgac

SEQ ID NO: 333898 - DNA, 15 bp, Homo sapiens
ataaatggagtgacc

SEQ ID NO: 333899 - DNA, 15 bp, Homo sapiens
taaatggagtgacca

SEQ ID NO: 333900 - DNA, 15 bp, Homo sapiens
aaatggagtgaccaa

SEQ ID NO: 333901 - DNA, 15 bp, Homo sapiens
aatggagtgaccaaa

SEQ ID NO: 333902 - DNA, 15 bp, Homo sapiens
atggagtgaccaaag

SEQ ID NO: 333903 - DNA, 15 bp, Homo sapiens
tggagtgaccaaagc

SEQ ID NO: 333904 - DNA, 15 bp, Homo sapiens
ggagtgaccaaagct

SEQ ID NO: 333905 - DNA, 15 bp, Homo sapiens
gagtgaccaaagcta

SEQ ID NO: 333906 - DNA, 15 bp, Homo sapiens
agtgaccaaagctat

SEQ ID NO: 333907 - DNA, 15 bp, Homo sapiens
gtgaccaaagctata

SEQ ID NO: 333908 - DNA, 15 bp, Homo sapiens
tgaccaaagctatag

SEQ ID NO: 333909 - DNA, 15 bp, Homo sapiens
gaccaaagctatagt

SEQ ID NO: 333910 - DNA, 15 bp, Homo sapiens
accaaagctatagta

SEQ ID NO: 333911 - DNA, 15 bp, Homo sapiens
ccaaagctatagtat

SEQ ID NO: 333912 - DNA, 15 bp, Homo sapiens
caaagctatagtatt

SEQ ID NO: 333913 - DNA, 15 bp, Homo sapiens
aaagctatagtattt

SEQ ID NO: 333914 - DNA, 15 bp, Homo sapiens
aagctatagtatttc

SEQ ID NO: 333915 - DNA, 15 bp, Homo sapiens
agctatagtatttca

SEQ ID NO: 333916 - DNA, 15 bp, Homo sapiens
gctatagtatttcaa

SEQ ID NO: 333917 - DNA, 15 bp, Homo sapiens
ctatagtatttcaaa

SEQ ID NO: 333918 - DNA, 15 bp, Homo sapiens
tatagtatttcaaat

SEQ ID NO: 333919 - DNA, 15 bp, Homo sapiens
atagtatttcaaatc

SEQ ID NO: 333920 - DNA, 15 bp, Homo sapiens
tagtatttcaaatct

SEQ ID NO: 333921 - DNA, 15 bp, Homo sapiens
agtatttcaaatctg

SEQ ID NO: 333922 - DNA, 15 bp, Homo sapiens
gtatttcaaatctgt

SEQ ID NO: 333923 - DNA, 15 bp, Homo sapiens
tatttcaaatctgtg

SEQ ID NO: 333924 - DNA, 15 bp, Homo sapiens
atttcaaatctgtga

SEQ ID NO: 333925 - DNA, 15 bp, Homo sapiens
tttcaaatctgtgac

SEQ ID NO: 333926 - DNA, 15 bp, Homo sapiens
ttcaaatctgtgact

SEQ ID NO: 333927 - DNA, 15 bp, Homo sapiens
tcaaatctgtgacta

SEQ ID NO: 333928 - DNA, 15 bp, Homo sapiens
caaatctgtgactat

SEQ ID NO: 333929 - DNA, 15 bp, Homo sapiens
aaatctgtgactatt

SEQ ID NO: 333930 - DNA, 15 bp, Homo sapiens
aatctgtgactatta

SEQ ID NO: 333931 - DNA, 15 bp, Homo sapiens
atctgtgactattat

SEQ ID NO: 333932 - DNA, 15 bp, Homo sapiens
tctgtgactattata

SEQ ID NO: 333933 - DNA, 15 bp, Homo sapiens
ctgtgactattatat

SEQ ID NO: 333934 - DNA, 15 bp, Homo sapiens
tgtgactattatata

SEQ ID NO: 333935 - DNA, 15 bp, Homo sapiens
gtgactattatatat

SEQ ID NO: 333936 - DNA, 15 bp, Homo sapiens
tgactattatatatt

SEQ ID NO: 333937 - DNA, 15 bp, Homo sapiens
gactattatatattt

SEQ ID NO: 333938 - DNA, 15 bp, Homo sapiens
actattatatatttt

SEQ ID NO: 333939 - DNA, 15 bp, Homo sapiens
ctattatatattttt

SEQ ID NO: 333940 - DNA, 15 bp, Homo sapiens
tattatatatttttc

SEQ ID NO: 333941 - DNA, 15 bp, Homo sapiens
attatatatttttct

SEQ ID NO: 333942 - DNA, 15 bp, Homo sapiens
ttatatatttttcta

SEQ ID NO: 333943 - DNA, 15 bp, Homo sapiens
tatatatttttctat

SEQ ID NO: 333944 - DNA, 15 bp, Homo sapiens
atatatttttctata

SEQ ID NO: 333945 - DNA, 15 bp, Homo sapiens
tatatttttctatac

SEQ ID NO: 333946 - DNA, 15 bp, Homo sapiens
atatttttctatacc

SEQ ID NO: 333947 - DNA, 15 bp, Homo sapiens
tatttttctatacca

SEQ ID NO: 333948 - DNA, 15 bp, Homo sapiens
atttttctataccaa

SEQ ID NO: 333949 - DNA, 15 bp, Homo sapiens
tttttctataccaag

SEQ ID NO: 333950 - DNA, 15 bp, Homo sapiens
ttttctataccaagt

SEQ ID NO: 333951 - DNA, 15 bp, Homo sapiens
tttctataccaagtc

SEQ ID NO: 333952 - DNA, 15 bp, Homo sapiens
ttctataccaagtca

SEQ ID NO: 333953 - DNA, 15 bp, Homo sapiens
tctataccaagtcac

SEQ ID NO: 333954 - DNA, 15 bp, Homo sapiens
ctataccaagtcact

SEQ ID NO: 333955 - DNA, 15 bp, Homo sapiens
tataccaagtcactt

SEQ ID NO: 333956 - DNA, 15 bp, Homo sapiens
ataccaagtcacttc

SEQ ID NO: 333957 - DNA, 15 bp, Homo sapiens
taccaagtcacttct

SEQ ID NO: 333958 - DNA, 15 bp, Homo sapiens
accaagtcacttctt

SEQ ID NO: 333959 - DNA, 15 bp, Homo sapiens
ccaagtcacttcttt

SEQ ID NO: 333960 - DNA, 15 bp, Homo sapiens
caagtcacttctttt

SEQ ID NO: 333961 - DNA, 15 bp, Homo sapiens
aagtcacttcttttt

SEQ ID NO: 333962 - DNA, 15 bp, Homo sapiens
agtcacttctttttt

SEQ ID NO: 333963 - DNA, 15 bp, Homo sapiens
gtcacttcttttttt

SEQ ID NO: 333964 - DNA, 15 bp, Homo sapiens
tcacttctttttttg

SEQ ID NO: 333965 - DNA, 15 bp, Homo sapiens
cacttctttttttgt

SEQ ID NO: 333966 - DNA, 15 bp, Homo sapiens
acttctttttttgtt

SEQ ID NO: 333967 - DNA, 15 bp, Homo sapiens
cttctttttttgttt

SEQ ID NO: 333968 - DNA, 15 bp, Homo sapiens
ttctttttttgtttg

SEQ ID NO: 333969 - DNA, 15 bp, Homo sapiens
tctttttttgtttgt

SEQ ID NO: 333970 - DNA, 15 bp, Homo sapiens
ctttttttgtttgtt

SEQ ID NO: 333971 - DNA, 15 bp, Homo sapiens
tttttttgtttgttt

SEQ ID NO: 333972 - DNA, 15 bp, Homo sapiens
ttgtttgtttgtttt

SEQ ID NO: 333973 - DNA, 15 bp, Homo sapiens
tgtttgtttgttttt

SEQ ID NO: 333974 - DNA, 15 bp, Homo sapiens
gtttgtttgtttttg

SEQ ID NO: 333975 - DNA, 15 bp, Homo sapiens
tttgtttgtttttgg

SEQ ID NO: 333976 - DNA, 15 bp, Homo sapiens
ttgtttgtttttggg

SEQ ID NO: 333977 - DNA, 15 bp, Homo sapiens
tgtttgtttttggga

SEQ ID NO: 333978 - DNA, 15 bp, Homo sapiens
gtttgtttttgggac

SEQ ID NO: 333979 - DNA, 15 bp, Homo sapiens
tttgtttttgggaca

SEQ ID NO: 333980 - DNA, 15 bp, Homo sapiens
ttgtttttgggacag

SEQ ID NO: 333981 - DNA, 15 bp, Homo sapiens
tgtttttgggacaga

SEQ ID NO: 333982 - DNA, 15 bp, Homo sapiens
gtttttgggacagag

SEQ ID NO: 333983 - DNA, 15 bp, Homo sapiens
tttttgggacagagt

SEQ ID NO: 333984 - DNA, 15 bp, Homo sapiens
ttttgggacagagtc

SEQ ID NO: 333985 - DNA, 15 bp, Homo sapiens
tttgggacagagtct

SEQ ID NO: 333986 - DNA, 15 bp, Homo sapiens
ttgggacagagtctt

SEQ ID NO: 333987 - DNA, 15 bp, Homo sapiens
tgggacagagtcttg

SEQ ID NO: 333988 - DNA, 15 bp, Homo sapiens
gacagagtcttgctc

SEQ ID NO: 333989 - DNA, 15 bp, Homo sapiens
acagagtcttgctct

SEQ ID NO: 333990 - DNA, 15 bp, Homo sapiens
cagagtcttgctctg

SEQ ID NO: 333991 - DNA, 15 bp, Homo sapiens
agagtcttgctctgt

SEQ ID NO: 333992 - DNA, 15 bp, Homo sapiens
ctggagtgcaatggt

SEQ ID NO: 333993 - DNA, 15 bp, Homo sapiens
tggagtgcaatggtg

SEQ ID NO: 333994 - DNA, 15 bp, Homo sapiens
ggagtgcaatggtgt

SEQ ID NO: 333995 - DNA, 15 bp, Homo sapiens
gagtgcaatggtgtg

SEQ ID NO: 333996 - DNA, 15 bp, Homo sapiens
agtgcaatggtgtga

SEQ ID NO: 333997 - DNA, 15 bp, Homo sapiens
gtgcaatggtgtgat

SEQ ID NO: 333998 - DNA, 15 bp, Homo sapiens
tgcaatggtgtgatc

SEQ ID NO: 333999 - DNA, 15 bp, Homo sapiens
gcaatggtgtgatct

SEQ ID NO: 334000 - DNA, 15 bp, Homo sapiens
caatggtgtgatctc

SEQ ID NO: 334001 - DNA, 15 bp, Homo sapiens
aatggtgtgatctca

SEQ ID NO: 334002 - DNA, 15 bp, Homo sapiens
atggtgtgatctcag

SEQ ID NO: 334003 - DNA, 15 bp, Homo sapiens
ggtgtgatctcagct

SEQ ID NO: 334004 - DNA, 15 bp, Homo sapiens
gtgtgatctcagctc

SEQ ID NO: 334005 - DNA, 15 bp, Homo sapiens
tgtgatctcagctca

SEQ ID NO: 334006 - DNA, 15 bp, Homo sapiens
tgcaacctctacctt

SEQ ID NO: 334007 - DNA, 15 bp, Homo sapiens
gcaacctctaccttc

SEQ ID NO: 334008 - DNA, 15 bp, Homo sapiens
caacctctaccttct

SEQ ID NO: 334009 - DNA, 15 bp, Homo sapiens
aacctctaccttctg

SEQ ID NO: 334010 - DNA, 15 bp, Homo sapiens
acctctaccttctgg

SEQ ID NO: 334011 - DNA, 15 bp, Homo sapiens
cctctaccttctggg

SEQ ID NO: 334012 - DNA, 15 bp, Homo sapiens
ctctaccttctgggt

SEQ ID NO: 334013 - DNA, 15 bp, Homo sapiens
tctaccttctgggtt

SEQ ID NO: 334014 - DNA, 15 bp, Homo sapiens
ctaccttctgggttc

SEQ ID NO: 334015 - DNA, 15 bp, Homo sapiens
taccttctgggttca

SEQ ID NO: 334016 - DNA, 15 bp, Homo sapiens
ttcaagtgattctcg

SEQ ID NO: 334017 - DNA, 15 bp, Homo sapiens
tcaagtgattctcgt

SEQ ID NO: 334018 - DNA, 15 bp, Homo sapiens
caagtgattctcgtg

SEQ ID NO: 334019 - DNA, 15 bp, Homo sapiens
aagtgattctcgtgc

SEQ ID NO: 334020 - DNA, 15 bp, Homo sapiens
agtgattctcgtgcc

SEQ ID NO: 334021 - DNA, 15 bp, Homo sapiens
gtgattctcgtgcct

SEQ ID NO: 334022 - DNA, 15 bp, Homo sapiens
tgattctcgtgcctc

SEQ ID NO: 334023 - DNA, 15 bp, Homo sapiens
ctcagcctccccagt

SEQ ID NO: 334024 - DNA, 15 bp, Homo sapiens
tcagcctccccagta

SEQ ID NO: 334025 - DNA, 15 bp, Homo sapiens
cagcctccccagtag

SEQ ID NO: 334026 - DNA, 15 bp, Homo sapiens
ctccccagtagctga

SEQ ID NO: 334027 - DNA, 15 bp, Homo sapiens
tccccagtagctgag

SEQ ID NO: 334028 - DNA, 15 bp, Homo sapiens
ccccagtagctgaga

SEQ ID NO: 334029 - DNA, 15 bp, Homo sapiens
cccagtagctgagat

SEQ ID NO: 334030 - DNA, 15 bp, Homo sapiens
ccagtagctgagatt

SEQ ID NO: 334031 - DNA, 15 bp, Homo sapiens
cagtagctgagatta

SEQ ID NO: 334032 - DNA, 15 bp, Homo sapiens
tagctgagattacaa

SEQ ID NO: 334033 - DNA, 15 bp, Homo sapiens
agctgagattacaag

SEQ ID NO: 334034 - DNA, 15 bp, Homo sapiens
gctgagattacaagc

SEQ ID NO: 334035 - DNA, 15 bp, Homo sapiens
ctgagattacaagcg

SEQ ID NO: 334036 - DNA, 15 bp, Homo sapiens
tgagattacaagcgt

SEQ ID NO: 334037 - DNA, 15 bp, Homo sapiens
gagattacaagcgtg

SEQ ID NO: 334038 - DNA, 15 bp, Homo sapiens
agattacaagcgtgc

SEQ ID NO: 334039 - DNA, 15 bp, Homo sapiens
gattacaagcgtgca

SEQ ID NO: 334040 - DNA, 15 bp, Homo sapiens
attacaagcgtgcac

SEQ ID NO: 334041 - DNA, 15 bp, Homo sapiens
ttacaagcgtgcacc

SEQ ID NO: 334042 - DNA, 15 bp, Homo sapiens
tacaagcgtgcacca

SEQ ID NO: 334043 - DNA, 15 bp, Homo sapiens
acaagcgtgcaccac

SEQ ID NO: 334044 - DNA, 15 bp, Homo sapiens
caagcgtgcaccacc

SEQ ID NO: 334045 - DNA, 15 bp, Homo sapiens
aagcgtgcaccacca

SEQ ID NO: 334046 - DNA, 15 bp, Homo sapiens
agcgtgcaccaccac

SEQ ID NO: 334047 - DNA, 15 bp, Homo sapiens
gcgtgcaccaccaca

SEQ ID NO: 334048 - DNA, 15 bp, Homo sapiens
cgtgcaccaccacac

SEQ ID NO: 334049 - DNA, 15 bp, Homo sapiens
gtgcaccaccacacc

SEQ ID NO: 334050 - DNA, 15 bp, Homo sapiens
tgcaccaccacacct

SEQ ID NO: 334051 - DNA, 15 bp, Homo sapiens
taatttttgtatttc

SEQ ID NO: 334052 - DNA, 15 bp, Homo sapiens
aatttttgtatttca

SEQ ID NO: 334053 - DNA, 15 bp, Homo sapiens
atttttgtatttcaa

SEQ ID NO: 334054 - DNA, 15 bp, Homo sapiens
tttttgtatttcaat

SEQ ID NO: 334055 - DNA, 15 bp, Homo sapiens
ttttgtatttcaata

SEQ ID NO: 334056 - DNA, 15 bp, Homo sapiens
tttgtatttcaatag

SEQ ID NO: 334057 - DNA, 15 bp, Homo sapiens
ttgtatttcaataga

SEQ ID NO: 334058 - DNA, 15 bp, Homo sapiens
tgtatttcaatagag

SEQ ID NO: 334059 - DNA, 15 bp, Homo sapiens
gtatttcaatagaga

SEQ ID NO: 334060 - DNA, 15 bp, Homo sapiens
tatttcaatagagaa

SEQ ID NO: 334061 - DNA, 15 bp, Homo sapiens
atttcaatagagaaa

SEQ ID NO: 334062 - DNA, 15 bp, Homo sapiens
tttcaatagagaaag

SEQ ID NO: 334063 - DNA, 15 bp, Homo sapiens
ttcaatagagaaagg

SEQ ID NO: 334064 - DNA, 15 bp, Homo sapiens
tcaatagagaaaggg

SEQ ID NO: 334065 - DNA, 15 bp, Homo sapiens
caatagagaaagggt

SEQ ID NO: 334066 - DNA, 15 bp, Homo sapiens
aatagagaaagggtt

SEQ ID NO: 334067 - DNA, 15 bp, Homo sapiens
atagagaaagggttt

SEQ ID NO: 334068 - DNA, 15 bp, Homo sapiens
tagagaaagggtttc

SEQ ID NO: 334069 - DNA, 15 bp, Homo sapiens
agagaaagggtttca

SEQ ID NO: 334070 - DNA, 15 bp, Homo sapiens
gagaaagggtttcat

SEQ ID NO: 334071 - DNA, 15 bp, Homo sapiens
agaaagggtttcatc

SEQ ID NO: 334072 - DNA, 15 bp, Homo sapiens
gaaagggtttcatca

SEQ ID NO: 334073 - DNA, 15 bp, Homo sapiens
aaagggtttcatcat

SEQ ID NO: 334074 - DNA, 15 bp, Homo sapiens
aagggtttcatcatg

SEQ ID NO: 334075 - DNA, 15 bp, Homo sapiens
agggtttcatcatgt

SEQ ID NO: 334076 - DNA, 15 bp, Homo sapiens
caggctggtcttgac

SEQ ID NO: 334077 - DNA, 15 bp, Homo sapiens
aggctggtcttgacc

SEQ ID NO: 334078 - DNA, 15 bp, Homo sapiens
ggctggtcttgacct

SEQ ID NO: 334079 - DNA, 15 bp, Homo sapiens
gctggtcttgacctc

SEQ ID NO: 334080 - DNA, 15 bp, Homo sapiens
ctggtcttgacctcc

SEQ ID NO: 334081 - DNA, 15 bp, Homo sapiens
tggtcttgacctcct

SEQ ID NO: 334082 - DNA, 15 bp, Homo sapiens
ggtcttgacctcctg

SEQ ID NO: 334083 - DNA, 15 bp, Homo sapiens
gtcttgacctcctgg

SEQ ID NO: 334084 - DNA, 15 bp, Homo sapiens
tcttgacctcctggc

SEQ ID NO: 334085 - DNA, 15 bp, Homo sapiens
cttgacctcctggcc

SEQ ID NO: 334086 - DNA, 15 bp, Homo sapiens
ttgacctcctggcct

SEQ ID NO: 334087 - DNA, 15 bp, Homo sapiens
tgacctcctggcctc

SEQ ID NO: 334088 - DNA, 15 bp, Homo sapiens
gacctcctggcctca

SEQ ID NO: 334089 - DNA, 15 bp, Homo sapiens
acctcctggcctcaa

SEQ ID NO: 334090 - DNA, 15 bp, Homo sapiens
cctcctggcctcaag

SEQ ID NO: 334091 - DNA, 15 bp, Homo sapiens
ctcctggcctcaagt

SEQ ID NO: 334092 - DNA, 15 bp, Homo sapiens
ggcctcaagtgatct

SEQ ID NO: 334093 - DNA, 15 bp, Homo sapiens
gcctcaagtgatcta

SEQ ID NO: 334094 - DNA, 15 bp, Homo sapiens
tcaagtgatctacct

SEQ ID NO: 334095 - DNA, 15 bp, Homo sapiens
caagtgatctacctg

SEQ ID NO: 334096 - DNA, 15 bp, Homo sapiens
aagtgatctacctgc

SEQ ID NO: 334097 - DNA, 15 bp, Homo sapiens
agtgatctacctgcc

SEQ ID NO: 334098 - DNA, 15 bp, Homo sapiens
gtgatctacctgcct

SEQ ID NO: 334099 - DNA, 15 bp, Homo sapiens
tgatctacctgcctc

SEQ ID NO: 334100 - DNA, 15 bp, Homo sapiens
gatctacctgcctca

SEQ ID NO: 334101 - DNA, 15 bp, Homo sapiens
atctacctgcctcag

SEQ ID NO: 334102 - DNA, 15 bp, Homo sapiens
tctacctgcctcagc

SEQ ID NO: 334103 - DNA, 15 bp, Homo sapiens
ctacctgcctcagcc

SEQ ID NO: 334104 - DNA, 15 bp, Homo sapiens
tacctgcctcagcct

SEQ ID NO: 334105 - DNA, 15 bp, Homo sapiens
caggtgtgagccacg

SEQ ID NO: 334106 - DNA, 15 bp, Homo sapiens
aggtgtgagccacgg

SEQ ID NO: 334107 - DNA, 15 bp, Homo sapiens
ggtgtgagccacggt

SEQ ID NO: 334108 - DNA, 15 bp, Homo sapiens
gtgtgagccacggtg

SEQ ID NO: 334109 - DNA, 15 bp, Homo sapiens
tgtgagccacggtgc

SEQ ID NO: 334110 - DNA, 15 bp, Homo sapiens
gtgagccacggtgcc

SEQ ID NO: 334111 - DNA, 15 bp, Homo sapiens
tgagccacggtgccc

SEQ ID NO: 334112 - DNA, 15 bp, Homo sapiens
gagccacggtgcccg

SEQ ID NO: 334113 - DNA, 15 bp, Homo sapiens
agccacggtgcccgg

SEQ ID NO: 334114 - DNA, 15 bp, Homo sapiens
gccacggtgcccggc

SEQ ID NO: 334115 - DNA, 15 bp, Homo sapiens
ccacggtgcccggcc

SEQ ID NO: 334116 - DNA, 15 bp, Homo sapiens
cacggtgcccggcct

SEQ ID NO: 334117 - DNA, 15 bp, Homo sapiens
acggtgcccggcctg

SEQ ID NO: 334118 - DNA, 15 bp, Homo sapiens
cggtgcccggcctgt

SEQ ID NO: 334119 - DNA, 15 bp, Homo sapiens
ggtgcccggcctgta

SEQ ID NO: 334120 - DNA, 15 bp, Homo sapiens
gtgcccggcctgtac

SEQ ID NO: 334121 - DNA, 15 bp, Homo sapiens
tgcccggcctgtacc

SEQ ID NO: 334122 - DNA, 15 bp, Homo sapiens
gcccggcctgtacca

SEQ ID NO: 334123 - DNA, 15 bp, Homo sapiens
cccggcctgtaccaa

SEQ ID NO: 334124 - DNA, 15 bp, Homo sapiens
ccggcctgtaccaag

SEQ ID NO: 334125 - DNA, 15 bp, Homo sapiens
cggcctgtaccaagt

SEQ ID NO: 334126 - DNA, 15 bp, Homo sapiens
ggcctgtaccaagta

SEQ ID NO: 334127 - DNA, 15 bp, Homo sapiens
gcctgtaccaagtaa

SEQ ID NO: 334128 - DNA, 15 bp, Homo sapiens
cctgtaccaagtaac

SEQ ID NO: 334129 - DNA, 15 bp, Homo sapiens
ctgtaccaagtaaca

SEQ ID NO: 334130 - DNA, 15 bp, Homo sapiens
tgtaccaagtaacat

SEQ ID NO: 334131 - DNA, 15 bp, Homo sapiens
gtaccaagtaacatt

SEQ ID NO: 334132 - DNA, 15 bp, Homo sapiens
taccaagtaacattt

SEQ ID NO: 334133 - DNA, 15 bp, Homo sapiens
accaagtaacatttc

SEQ ID NO: 334134 - DNA, 15 bp, Homo sapiens
ccaagtaacatttct

SEQ ID NO: 334135 - DNA, 15 bp, Homo sapiens
caagtaacatttctt

SEQ ID NO: 334136 - DNA, 15 bp, Homo sapiens
aagtaacatttcttt

SEQ ID NO: 334137 - DNA, 15 bp, Homo sapiens
agtaacatttctttc

SEQ ID NO: 334138 - DNA, 15 bp, Homo sapiens
gtaacatttctttct

SEQ ID NO: 334139 - DNA, 15 bp, Homo sapiens
taacatttctttctg

SEQ ID NO: 334140 - DNA, 15 bp, Homo sapiens
aacatttctttctgt

SEQ ID NO: 334141 - DNA, 15 bp, Homo sapiens
acatttctttctgtg

SEQ ID NO: 334142 - DNA, 15 bp, Homo sapiens
catttctttctgtgt

SEQ ID NO: 334143 - DNA, 15 bp, Homo sapiens
atttctttctgtgtg

SEQ ID NO: 334144 - DNA, 15 bp, Homo sapiens
tttctttctgtgtgc

SEQ ID NO: 334145 - DNA, 15 bp, Homo sapiens
ttctttctgtgtgca

SEQ ID NO: 334146 - DNA, 15 bp, Homo sapiens
tctttctgtgtgcag

SEQ ID NO: 334147 - DNA, 15 bp, Homo sapiens
ctttctgtgtgcagg

SEQ ID NO: 334148 - DNA, 15 bp, Homo sapiens
tttctgtgtgcagga

SEQ ID NO: 334149 - DNA, 15 bp, Homo sapiens
ttctgtgtgcaggaa

SEQ ID NO: 334150 - DNA, 15 bp, Homo sapiens
tctgtgtgcaggaat

SEQ ID NO: 334151 - DNA, 15 bp, Homo sapiens
ctgtgtgcaggaata

SEQ ID NO: 334152 - DNA, 15 bp, Homo sapiens
tgtgtgcaggaatat

SEQ ID NO: 334153 - DNA, 15 bp, Homo sapiens
gtgtgcaggaatata

SEQ ID NO: 334154 - DNA, 15 bp, Homo sapiens
tgtgcaggaatatac

SEQ ID NO: 334155 - DNA, 15 bp, Homo sapiens
gtgcaggaatataca

SEQ ID NO: 334156 - DNA, 15 bp, Homo sapiens
tgcaggaatatacat

SEQ ID NO: 334157 - DNA, 15 bp, Homo sapiens
gcaggaatatacatg

SEQ ID NO: 334158 - DNA, 15 bp, Homo sapiens
caggaatatacatgt

SEQ ID NO: 334159 - DNA, 15 bp, Homo sapiens
aggaatatacatgtg

SEQ ID NO: 334160 - DNA, 15 bp, Homo sapiens
ggaatatacatgtgc

SEQ ID NO: 334161 - DNA, 15 bp, Homo sapiens
gaatatacatgtgct

SEQ ID NO: 334162 - DNA, 15 bp, Homo sapiens
aatatacatgtgctt

SEQ ID NO: 334163 - DNA, 15 bp, Homo sapiens
atatacatgtgcttg

SEQ ID NO: 334164 - DNA, 15 bp, Homo sapiens
tatacatgtgcttgt

SEQ ID NO: 334165 - DNA, 15 bp, Homo sapiens
atacatgtgcttgtt

SEQ ID NO: 334166 - DNA, 15 bp, Homo sapiens
tacatgtgcttgtta

SEQ ID NO: 334167 - DNA, 15 bp, Homo sapiens
acatgtgcttgttac

SEQ ID NO: 334168 - DNA, 15 bp, Homo sapiens
catgtgcttgttaca

SEQ ID NO: 334169 - DNA, 15 bp, Homo sapiens
atgtgcttgttacag

SEQ ID NO: 334170 - DNA, 15 bp, Homo sapiens
tgtgcttgttacaga

SEQ ID NO: 334171 - DNA, 15 bp, Homo sapiens
gtgcttgttacagag

SEQ ID NO: 334172 - DNA, 15 bp, Homo sapiens
tgcttgttacagagt

SEQ ID NO: 334173 - DNA, 15 bp, Homo sapiens
gcttgttacagagtt

SEQ ID NO: 334174 - DNA, 15 bp, Homo sapiens
cttgttacagagttg

SEQ ID NO: 334175 - DNA, 15 bp, Homo sapiens
ttgttacagagttga

SEQ ID NO: 334176 - DNA, 15 bp, Homo sapiens
tgttacagagttgag

SEQ ID NO: 334177 - DNA, 15 bp, Homo sapiens
gttacagagttgagt

SEQ ID NO: 334178 - DNA, 15 bp, Homo sapiens
ttacagagttgagtt

SEQ ID NO: 334179 - DNA, 15 bp, Homo sapiens
tacagagttgagttt

SEQ ID NO: 334180 - DNA, 15 bp, Homo sapiens
acagagttgagttta

SEQ ID NO: 334181 - DNA, 15 bp, Homo sapiens
cagagttgagtttat

SEQ ID NO: 334182 - DNA, 15 bp, Homo sapiens
agagttgagtttatc

SEQ ID NO: 334183 - DNA, 15 bp, Homo sapiens
gagttgagtttatca

SEQ ID NO: 334184 - DNA, 15 bp, Homo sapiens
agttgagtttatcat

SEQ ID NO: 334185 - DNA, 15 bp, Homo sapiens
gttgagtttatcata

SEQ ID NO: 334186 - DNA, 15 bp, Homo sapiens
ttgagtttatcatat

SEQ ID NO: 334187 - DNA, 15 bp, Homo sapiens
tgagtttatcatatt

SEQ ID NO: 334188 - DNA, 15 bp, Homo sapiens
gagtttatcatattc

SEQ ID NO: 334189 - DNA, 15 bp, Homo sapiens
agtttatcatattct

SEQ ID NO: 334190 - DNA, 15 bp, Homo sapiens
gtttatcatattcta

SEQ ID NO: 334191 - DNA, 15 bp, Homo sapiens
tttatcatattctat

SEQ ID NO: 334192 - DNA, 15 bp, Homo sapiens
ttatcatattctatc

SEQ ID NO: 334193 - DNA, 15 bp, Homo sapiens
tatcatattctatca

SEQ ID NO: 334194 - DNA, 15 bp, Homo sapiens
atcatattctatcac

SEQ ID NO: 334195 - DNA, 15 bp, Homo sapiens
tcatattctatcacc

SEQ ID NO: 334196 - DNA, 15 bp, Homo sapiens
catattctatcacca

SEQ ID NO: 334197 - DNA, 15 bp, Homo sapiens
atattctatcaccat

SEQ ID NO: 334198 - DNA, 15 bp, Homo sapiens
tattctatcaccatg

SEQ ID NO: 334199 - DNA, 15 bp, Homo sapiens
attctatcaccatgt

SEQ ID NO: 334200 - DNA, 15 bp, Homo sapiens
ttctatcaccatgta

SEQ ID NO: 334201 - DNA, 15 bp, Homo sapiens
tctatcaccatgtat

SEQ ID NO: 334202 - DNA, 15 bp, Homo sapiens
ctatcaccatgtatt

SEQ ID NO: 334203 - DNA, 15 bp, Homo sapiens
tatcaccatgtattt

SEQ ID NO: 334204 - DNA, 15 bp, Homo sapiens
atcaccatgtatttc

SEQ ID NO: 334205 - DNA, 15 bp, Homo sapiens
tcaccatgtatttcc

SEQ ID NO: 334206 - DNA, 15 bp, Homo sapiens
caccatgtatttccc

SEQ ID NO: 334207 - DNA, 15 bp, Homo sapiens
accatgtatttccca

SEQ ID NO: 334208 - DNA, 15 bp, Homo sapiens
ccatgtatttcccat

SEQ ID NO: 334209 - DNA, 15 bp, Homo sapiens
catgtatttcccata

SEQ ID NO: 334210 - DNA, 15 bp, Homo sapiens
atgtatttcccataa

SEQ ID NO: 334211 - DNA, 15 bp, Homo sapiens
tgtatttcccataaa

SEQ ID NO: 334212 - DNA, 15 bp, Homo sapiens
gtatttcccataaat

SEQ ID NO: 334213 - DNA, 15 bp, Homo sapiens
tatttcccataaatc

SEQ ID NO: 334214 - DNA, 15 bp, Homo sapiens
atttcccataaatct

SEQ ID NO: 334215 - DNA, 15 bp, Homo sapiens
tttcccataaatcta

SEQ ID NO: 334216 - DNA, 15 bp, Homo sapiens
ttcccataaatctat

SEQ ID NO: 334217 - DNA, 15 bp, Homo sapiens
tcccataaatctatt

SEQ ID NO: 334218 - DNA, 15 bp, Homo sapiens
cccataaatctatta

SEQ ID NO: 334219 - DNA, 15 bp, Homo sapiens
ccataaatctattaa

SEQ ID NO: 334220 - DNA, 15 bp, Homo sapiens
cataaatctattaag

SEQ ID NO: 334221 - DNA, 15 bp, Homo sapiens
ataaatctattaagt

SEQ ID NO: 334222 - DNA, 15 bp, Homo sapiens
taaatctattaagtt

SEQ ID NO: 334223 - DNA, 15 bp, Homo sapiens
aaatctattaagtta

SEQ ID NO: 334224 - DNA, 15 bp, Homo sapiens
aatctattaagttaa

SEQ ID NO: 334225 - DNA, 15 bp, Homo sapiens
atctattaagttaaa

SEQ ID NO: 334226 - DNA, 15 bp, Homo sapiens
tctattaagttaaaa

SEQ ID NO: 334227 - DNA, 15 bp, Homo sapiens
ctattaagttaaaat

SEQ ID NO: 334228 - DNA, 15 bp, Homo sapiens
tattaagttaaaatc

SEQ ID NO: 334229 - DNA, 15 bp, Homo sapiens
attaagttaaaatct

SEQ ID NO: 334230 - DNA, 15 bp, Homo sapiens
ttaagttaaaatctg

SEQ ID NO: 334231 - DNA, 15 bp, Homo sapiens
taagttaaaatctgt

SEQ ID NO: 334232 - DNA, 15 bp, Homo sapiens
aagttaaaatctgtg

SEQ ID NO: 334233 - DNA, 15 bp, Homo sapiens
agttaaaatctgtgc

SEQ ID NO: 334234 - DNA, 15 bp, Homo sapiens
gttaaaatctgtgcc

SEQ ID NO: 334235 - DNA, 15 bp, Homo sapiens
ttaaaatctgtgcca

SEQ ID NO: 334236 - DNA, 15 bp, Homo sapiens
taaaatctgtgccac

SEQ ID NO: 334237 - DNA, 15 bp, Homo sapiens
aaaatctgtgccact

SEQ ID NO: 334238 - DNA, 15 bp, Homo sapiens
aaatctgtgccactt

SEQ ID NO: 334239 - DNA, 15 bp, Homo sapiens
aatctgtgccactta

SEQ ID NO: 334240 - DNA, 15 bp, Homo sapiens
atctgtgccacttat

SEQ ID NO: 334241 - DNA, 15 bp, Homo sapiens
tctgtgccacttatc

SEQ ID NO: 334242 - DNA, 15 bp, Homo sapiens
ctgtgccacttatca

SEQ ID NO: 334243 - DNA, 15 bp, Homo sapiens
tgtgccacttatcaa

SEQ ID NO: 334244 - DNA, 15 bp, Homo sapiens
gtgccacttatcaaa

SEQ ID NO: 334245 - DNA, 15 bp, Homo sapiens
tgccacttatcaaag

SEQ ID NO: 334246 - DNA, 15 bp, Homo sapiens
gccacttatcaaagt

SEQ ID NO: 334247 - DNA, 15 bp, Homo sapiens
ccacttatcaaagtt

SEQ ID NO: 334248 - DNA, 15 bp, Homo sapiens
cacttatcaaagttt

SEQ ID NO: 334249 - DNA, 15 bp, Homo sapiens
acttatcaaagtttg

SEQ ID NO: 334250 - DNA, 15 bp, Homo sapiens
cttatcaaagtttgg

SEQ ID NO: 334251 - DNA, 15 bp, Homo sapiens
ttatcaaagtttgga

SEQ ID NO: 334252 - DNA, 15 bp, Homo sapiens
tatcaaagtttggag

SEQ ID NO: 334253 - DNA, 15 bp, Homo sapiens
atcaaagtttggagt

SEQ ID NO: 334254 - DNA, 15 bp, Homo sapiens
tcaaagtttggagtg

SEQ ID NO: 334255 - DNA, 15 bp, Homo sapiens
caaagtttggagtga

SEQ ID NO: 334256 - DNA, 15 bp, Homo sapiens
aaagtttggagtgat

SEQ ID NO: 334257 - DNA, 15 bp, Homo sapiens
aagtttggagtgatt

SEQ ID NO: 334258 - DNA, 15 bp, Homo sapiens
agtttggagtgatta

SEQ ID NO: 334259 - DNA, 15 bp, Homo sapiens
gtttggagtgattac

SEQ ID NO: 334260 - DNA, 15 bp, Homo sapiens
tttggagtgattaca

SEQ ID NO: 334261 - DNA, 15 bp, Homo sapiens
ttggagtgattacat

SEQ ID NO: 334262 - DNA, 15 bp, Homo sapiens
tggagtgattacata

SEQ ID NO: 334263 - DNA, 15 bp, Homo sapiens
ggagtgattacatat

SEQ ID NO: 334264 - DNA, 15 bp, Homo sapiens
gagtgattacatata

SEQ ID NO: 334265 - DNA, 15 bp, Homo sapiens
agtgattacatatat

SEQ ID NO: 334266 - DNA, 15 bp, Homo sapiens
gtgattacatatata

SEQ ID NO: 334267 - DNA, 15 bp, Homo sapiens
tgattacatatatat

SEQ ID NO: 334268 - DNA, 15 bp, Homo sapiens
gattacatatatata

SEQ ID NO: 334269 - DNA, 15 bp, Homo sapiens
attacatatatatac

SEQ ID NO: 334270 - DNA, 15 bp, Homo sapiens
ttacatatatataca

SEQ ID NO: 334271 - DNA, 15 bp, Homo sapiens
tacatatatatacat

SEQ ID NO: 334272 - DNA, 15 bp, Homo sapiens
acatatatatacata

SEQ ID NO: 334273 - DNA, 15 bp, Homo sapiens
catatatatacataa

SEQ ID NO: 334274 - DNA, 15 bp, Homo sapiens
atatatatacataac

SEQ ID NO: 334275 - DNA, 15 bp, Homo sapiens
tatatatacataacc

SEQ ID NO: 334276 - DNA, 15 bp, Homo sapiens
atatatacataaccc

SEQ ID NO: 334277 - DNA, 15 bp, Homo sapiens
tatatacataaccct

SEQ ID NO: 334278 - DNA, 15 bp, Homo sapiens
atatacataacccta

SEQ ID NO: 334279 - DNA, 15 bp, Homo sapiens
tatacataaccctat

SEQ ID NO: 334280 - DNA, 15 bp, Homo sapiens
atacataaccctata

SEQ ID NO: 334281 - DNA, 15 bp, Homo sapiens
tacataaccctatat

SEQ ID NO: 334282 - DNA, 15 bp, Homo sapiens
acataaccctatatg

SEQ ID NO: 334283 - DNA, 15 bp, Homo sapiens
cataaccctatatga

SEQ ID NO: 334284 - DNA, 15 bp, Homo sapiens
ataaccctatatgat

SEQ ID NO: 334285 - DNA, 15 bp, Homo sapiens
taaccctatatgatc

SEQ ID NO: 334286 - DNA, 15 bp, Homo sapiens
aaccctatatgatct

SEQ ID NO: 334287 - DNA, 15 bp, Homo sapiens
accctatatgatctt

SEQ ID NO: 334288 - DNA, 15 bp, Homo sapiens
ccctatatgatcttt

SEQ ID NO: 334289 - DNA, 15 bp, Homo sapiens
cctatatgatctttg

SEQ ID NO: 334290 - DNA, 15 bp, Homo sapiens
tatatgatctttgaa

SEQ ID NO: 334291 - DNA, 15 bp, Homo sapiens
atatgatctttgaat

SEQ ID NO: 334292 - DNA, 15 bp, Homo sapiens
tatgatctttgaatt

SEQ ID NO: 334293 - DNA, 15 bp, Homo sapiens
atgatctttgaattc

SEQ ID NO: 334294 - DNA, 15 bp, Homo sapiens
tgatctttgaattca

SEQ ID NO: 334295 - DNA, 15 bp, Homo sapiens
gatctttgaattcag

SEQ ID NO: 334296 - DNA, 15 bp, Homo sapiens
atctttgaattcaga

SEQ ID NO: 334297 - DNA, 15 bp, Homo sapiens
tctttgaattcagag

SEQ ID NO: 334298 - DNA, 15 bp, Homo sapiens
ctttgaattcagagc

SEQ ID NO: 334299 - DNA, 15 bp, Homo sapiens
tttgaattcagagcc

SEQ ID NO: 334300 - DNA, 15 bp, Homo sapiens
ttgaattcagagcct

SEQ ID NO: 334301 - DNA, 15 bp, Homo sapiens
tgaattcagagcctt

SEQ ID NO: 334302 - DNA, 15 bp, Homo sapiens
gaattcagagccttg

SEQ ID NO: 334303 - DNA, 15 bp, Homo sapiens
aattcagagccttga

SEQ ID NO: 334304 - DNA, 15 bp, Homo sapiens
attcagagccttgat

SEQ ID NO: 334305 - DNA, 15 bp, Homo sapiens
ttcagagccttgatg

SEQ ID NO: 334306 - DNA, 15 bp, Homo sapiens
tcagagccttgatgc

SEQ ID NO: 334307 - DNA, 15 bp, Homo sapiens
cagagccttgatgct

SEQ ID NO: 334308 - DNA, 15 bp, Homo sapiens
agagccttgatgcta

SEQ ID NO: 334309 - DNA, 15 bp, Homo sapiens
gagccttgatgctag

SEQ ID NO: 334310 - DNA, 15 bp, Homo sapiens
agccttgatgctagc

SEQ ID NO: 334311 - DNA, 15 bp, Homo sapiens
gccttgatgctagcc

SEQ ID NO: 334312 - DNA, 15 bp, Homo sapiens
ccttgatgctagcct

SEQ ID NO: 334313 - DNA, 15 bp, Homo sapiens
cttgatgctagcctg

SEQ ID NO: 334314 - DNA, 15 bp, Homo sapiens
ttgatgctagcctga

SEQ ID NO: 334315 - DNA, 15 bp, Homo sapiens
tgatgctagcctgag

SEQ ID NO: 334316 - DNA, 15 bp, Homo sapiens
gatgctagcctgaga

SEQ ID NO: 334317 - DNA, 15 bp, Homo sapiens
atgctagcctgagag

SEQ ID NO: 334318 - DNA, 15 bp, Homo sapiens
tgctagcctgagagt

SEQ ID NO: 334319 - DNA, 15 bp, Homo sapiens
gctagcctgagagtc

SEQ ID NO: 334320 - DNA, 15 bp, Homo sapiens
ctagcctgagagtct

SEQ ID NO: 334321 - DNA, 15 bp, Homo sapiens
tagcctgagagtctg

SEQ ID NO: 334322 - DNA, 15 bp, Homo sapiens
agcctgagagtctgt

SEQ ID NO: 334323 - DNA, 15 bp, Homo sapiens
gcctgagagtctgtg

SEQ ID NO: 334324 - DNA, 15 bp, Homo sapiens
cctgagagtctgtgt

SEQ ID NO: 334325 - DNA, 15 bp, Homo sapiens
ctgagagtctgtgtg

SEQ ID NO: 334326 - DNA, 15 bp, Homo sapiens
tgagagtctgtgtgt

SEQ ID NO: 334327 - DNA, 15 bp, Homo sapiens
gagagtctgtgtgta

SEQ ID NO: 334328 - DNA, 15 bp, Homo sapiens
agagtctgtgtgtat

SEQ ID NO: 334329 - DNA, 15 bp, Homo sapiens
gagtctgtgtgtatg

SEQ ID NO: 334330 - DNA, 15 bp, Homo sapiens
agtctgtgtgtatga

SEQ ID NO: 334331 - DNA, 15 bp, Homo sapiens
gtctgtgtgtatgaa

SEQ ID NO: 334332 - DNA, 15 bp, Homo sapiens
tctgtgtgtatgaat

SEQ ID NO: 334333 - DNA, 15 bp, Homo sapiens
ctgtgtgtatgaatg

SEQ ID NO: 334334 - DNA, 15 bp, Homo sapiens
tgtgtgtatgaatgc

SEQ ID NO: 334335 - DNA, 15 bp, Homo sapiens
gtgtgtatgaatgca

SEQ ID NO: 334336 - DNA, 15 bp, Homo sapiens
tgtgtatgaatgcag

SEQ ID NO: 334337 - DNA, 15 bp, Homo sapiens
gtgtatgaatgcagg

SEQ ID NO: 334338 - DNA, 15 bp, Homo sapiens
tgtatgaatgcaggt

SEQ ID NO: 334339 - DNA, 15 bp, Homo sapiens
gtatgaatgcaggtg

SEQ ID NO: 334340 - DNA, 15 bp, Homo sapiens
tatgaatgcaggtgg

SEQ ID NO: 334341 - DNA, 15 bp, Homo sapiens
atgaatgcaggtggc

SEQ ID NO: 334342 - DNA, 15 bp, Homo sapiens
tgaatgcaggtggca

SEQ ID NO: 334343 - DNA, 15 bp, Homo sapiens
gaatgcaggtggcaa

SEQ ID NO: 334344 - DNA, 15 bp, Homo sapiens
aatgcaggtggcaag

SEQ ID NO: 334345 - DNA, 15 bp, Homo sapiens
atgcaggtggcaaga

SEQ ID NO: 334346 - DNA, 15 bp, Homo sapiens
tgcaggtggcaagag

SEQ ID NO: 334347 - DNA, 15 bp, Homo sapiens
gcaggtggcaagagt

SEQ ID NO: 334348 - DNA, 15 bp, Homo sapiens
caggtggcaagagtg

SEQ ID NO: 334349 - DNA, 15 bp, Homo sapiens
aggtggcaagagtga

SEQ ID NO: 334350 - DNA, 15 bp, Homo sapiens
ggtggcaagagtgag

SEQ ID NO: 334351 - DNA, 15 bp, Homo sapiens
gtggcaagagtgagg

SEQ ID NO: 334352 - DNA, 15 bp, Homo sapiens
tggcaagagtgaggc

SEQ ID NO: 334353 - DNA, 15 bp, Homo sapiens
ggcaagagtgaggca

SEQ ID NO: 334354 - DNA, 15 bp, Homo sapiens
gcaagagtgaggcat

SEQ ID NO: 334355 - DNA, 15 bp, Homo sapiens
caagagtgaggcatg

SEQ ID NO: 334356 - DNA, 15 bp, Homo sapiens
aagagtgaggcatgg

SEQ ID NO: 334357 - DNA, 15 bp, Homo sapiens
agagtgaggcatgga

SEQ ID NO: 334358 - DNA, 15 bp, Homo sapiens
gagtgaggcatggat

SEQ ID NO: 334359 - DNA, 15 bp, Homo sapiens
agtgaggcatggatt

SEQ ID NO: 334360 - DNA, 15 bp, Homo sapiens
gtgaggcatggattg

SEQ ID NO: 334361 - DNA, 15 bp, Homo sapiens
tgaggcatggattgt

SEQ ID NO: 334362 - DNA, 15 bp, Homo sapiens
gaggcatggattgtt

SEQ ID NO: 334363 - DNA, 15 bp, Homo sapiens
aggcatggattgttg

SEQ ID NO: 334364 - DNA, 15 bp, Homo sapiens
ggcatggattgttgc

SEQ ID NO: 334365 - DNA, 15 bp, Homo sapiens
gcatggattgttgct

SEQ ID NO: 334366 - DNA, 15 bp, Homo sapiens
catggattgttgcta

SEQ ID NO: 334367 - DNA, 15 bp, Homo sapiens
atggattgttgctat

SEQ ID NO: 334368 - DNA, 15 bp, Homo sapiens
tggattgttgctatt

SEQ ID NO: 334369 - DNA, 15 bp, Homo sapiens
ggattgttgctattt

SEQ ID NO: 334370 - DNA, 15 bp, Homo sapiens
gattgttgctatttt

SEQ ID NO: 334371 - DNA, 15 bp, Homo sapiens
attgttgctattttt

SEQ ID NO: 334372 - DNA, 15 bp, Homo sapiens
ttgttgctatttttt

SEQ ID NO: 334373 - DNA, 15 bp, Homo sapiens
tgttgctattttttc

SEQ ID NO: 334374 - DNA, 15 bp, Homo sapiens
gttgctattttttct

SEQ ID NO: 334375 - DNA, 15 bp, Homo sapiens
ttgctattttttcta

SEQ ID NO: 334376 - DNA, 15 bp, Homo sapiens
tgctattttttctac

SEQ ID NO: 334377 - DNA, 15 bp, Homo sapiens
gctattttttctacc

SEQ ID NO: 334378 - DNA, 15 bp, Homo sapiens
ctattttttctaccg

SEQ ID NO: 334379 - DNA, 15 bp, Homo sapiens
tattttttctaccgg

SEQ ID NO: 334380 - DNA, 15 bp, Homo sapiens
attttttctaccgga

SEQ ID NO: 334381 - DNA, 15 bp, Homo sapiens
ttttttctaccggag

SEQ ID NO: 334382 - DNA, 15 bp, Homo sapiens
tttttctaccggagt

SEQ ID NO: 334383 - DNA, 15 bp, Homo sapiens
ttttctaccggagtg

SEQ ID NO: 334384 - DNA, 15 bp, Homo sapiens
tttctaccggagtgc

SEQ ID NO: 334385 - DNA, 15 bp, Homo sapiens
ttctaccggagtgcc

SEQ ID NO: 334386 - DNA, 15 bp, Homo sapiens
tctaccggagtgcca

SEQ ID NO: 334387 - DNA, 15 bp, Homo sapiens
ctaccggagtgccat

SEQ ID NO: 334388 - DNA, 15 bp, Homo sapiens
taccggagtgccatt

SEQ ID NO: 334389 - DNA, 15 bp, Homo sapiens
accggagtgccatta

SEQ ID NO: 334390 - DNA, 15 bp, Homo sapiens
ccggagtgccattat

SEQ ID NO: 334391 - DNA, 15 bp, Homo sapiens
cggagtgccattatt

SEQ ID NO: 334392 - DNA, 15 bp, Homo sapiens
ggagtgccattatta

SEQ ID NO: 334393 - DNA, 15 bp, Homo sapiens
gagtgccattattaa

SEQ ID NO: 334394 - DNA, 15 bp, Homo sapiens
agtgccattattaac

SEQ ID NO: 334395 - DNA, 15 bp, Homo sapiens
gtgccattattaaca

SEQ ID NO: 334396 - DNA, 15 bp, Homo sapiens
tgccattattaacag

SEQ ID NO: 334397 - DNA, 15 bp, Homo sapiens
gccattattaacagt

SEQ ID NO: 334398 - DNA, 15 bp, Homo sapiens
ccattattaacagtt

SEQ ID NO: 334399 - DNA, 15 bp, Homo sapiens
cattattaacagttt

SEQ ID NO: 334400 - DNA, 15 bp, Homo sapiens
attattaacagtttc

SEQ ID NO: 334401 - DNA, 15 bp, Homo sapiens
ttattaacagtttct

SEQ ID NO: 334402 - DNA, 15 bp, Homo sapiens
tattaacagtttctt

SEQ ID NO: 334403 - DNA, 15 bp, Homo sapiens
attaacagtttcttt

SEQ ID NO: 334404 - DNA, 15 bp, Homo sapiens
ttaacagtttctttt

SEQ ID NO: 334405 - DNA, 15 bp, Homo sapiens
taacagtttcttttc

SEQ ID NO: 334406 - DNA, 15 bp, Homo sapiens
aacagtttcttttct

SEQ ID NO: 334407 - DNA, 15 bp, Homo sapiens
acagtttcttttctg

SEQ ID NO: 334408 - DNA, 15 bp, Homo sapiens
cagtttcttttctgt

SEQ ID NO: 334409 - DNA, 15 bp, Homo sapiens
agtttcttttctgta

SEQ ID NO: 334410 - DNA, 15 bp, Homo sapiens
gtttcttttctgtat

SEQ ID NO: 334411 - DNA, 15 bp, Homo sapiens
tttcttttctgtata

SEQ ID NO: 334412 - DNA, 15 bp, Homo sapiens
ttcttttctgtatag

SEQ ID NO: 334413 - DNA, 15 bp, Homo sapiens
tcttttctgtatagt

SEQ ID NO: 334414 - DNA, 15 bp, Homo sapiens
cttttctgtatagtc

SEQ ID NO: 334415 - DNA, 15 bp, Homo sapiens
ttttctgtatagtca

SEQ ID NO: 334416 - DNA, 15 bp, Homo sapiens
tttctgtatagtcac

SEQ ID NO: 334417 - DNA, 15 bp, Homo sapiens
ttctgtatagtcact

SEQ ID NO: 334418 - DNA, 15 bp, Homo sapiens
tctgtatagtcactg

SEQ ID NO: 334419 - DNA, 15 bp, Homo sapiens
ctgtatagtcactgt

SEQ ID NO: 334420 - DNA, 15 bp, Homo sapiens
tgtatagtcactgtg

SEQ ID NO: 334421 - DNA, 15 bp, Homo sapiens
gtatagtcactgtga

SEQ ID NO: 334422 - DNA, 15 bp, Homo sapiens
tatagtcactgtgaa

SEQ ID NO: 334423 - DNA, 15 bp, Homo sapiens
atagtcactgtgaac

SEQ ID NO: 334424 - DNA, 15 bp, Homo sapiens
tagtcactgtgaaca

SEQ ID NO: 334425 - DNA, 15 bp, Homo sapiens
agtcactgtgaacac

SEQ ID NO: 334426 - DNA, 15 bp, Homo sapiens
gtcactgtgaacact

SEQ ID NO: 334427 - DNA, 15 bp, Homo sapiens
tcactgtgaacactg

SEQ ID NO: 334428 - DNA, 15 bp, Homo sapiens
cactgtgaacactgt

SEQ ID NO: 334429 - DNA, 15 bp, Homo sapiens
actgtgaacactgtt

SEQ ID NO: 334430 - DNA, 15 bp, Homo sapiens
ctgtgaacactgttg

SEQ ID NO: 334431 - DNA, 15 bp, Homo sapiens
tgtgaacactgttgt

SEQ ID NO: 334432 - DNA, 15 bp, Homo sapiens
gtgaacactgttgtg

SEQ ID NO: 334433 - DNA, 15 bp, Homo sapiens
tgaacactgttgtgg

SEQ ID NO: 334434 - DNA, 15 bp, Homo sapiens
gaacactgttgtggg

SEQ ID NO: 334435 - DNA, 15 bp, Homo sapiens
aacactgttgtgggg

SEQ ID NO: 334436 - DNA, 15 bp, Homo sapiens
acactgttgtggggc

SEQ ID NO: 334437 - DNA, 15 bp, Homo sapiens
cactgttgtggggct

SEQ ID NO: 334438 - DNA, 15 bp, Homo sapiens
actgttgtggggctg

SEQ ID NO: 334439 - DNA, 15 bp, Homo sapiens
ctgttgtggggctgc

SEQ ID NO: 334440 - DNA, 15 bp, Homo sapiens
tgttgtggggctgct

SEQ ID NO: 334441 - DNA, 15 bp, Homo sapiens
gttgtggggctgctc

SEQ ID NO: 334442 - DNA, 15 bp, Homo sapiens
ttgtggggctgctcc

SEQ ID NO: 334443 - DNA, 15 bp, Homo sapiens
tgtggggctgctccc

SEQ ID NO: 334444 - DNA, 15 bp, Homo sapiens
gtggggctgctccct

SEQ ID NO: 334445 - DNA, 15 bp, Homo sapiens
tggggctgctccctg

SEQ ID NO: 334446 - DNA, 15 bp, Homo sapiens
ggggctgctccctgt

SEQ ID NO: 334447 - DNA, 15 bp, Homo sapiens
gggctgctccctgtg

SEQ ID NO: 334448 - DNA, 15 bp, Homo sapiens
ggctgctccctgtgt

SEQ ID NO: 334449 - DNA, 15 bp, Homo sapiens
gctgctccctgtgtg

SEQ ID NO: 334450 - DNA, 15 bp, Homo sapiens
ctgctccctgtgtgt

SEQ ID NO: 334451 - DNA, 15 bp, Homo sapiens
tgctccctgtgtgtg

SEQ ID NO: 334452 - DNA, 15 bp, Homo sapiens
gctccctgtgtgtgg

SEQ ID NO: 334453 - DNA, 15 bp, Homo sapiens
ctccctgtgtgtggc

SEQ ID NO: 334454 - DNA, 15 bp, Homo sapiens
tccctgtgtgtggct

SEQ ID NO: 334455 - DNA, 15 bp, Homo sapiens
ccctgtgtgtggctc

SEQ ID NO: 334456 - DNA, 15 bp, Homo sapiens
cctgtgtgtggctct

SEQ ID NO: 334457 - DNA, 15 bp, Homo sapiens
ctgtgtgtggctctg

SEQ ID NO: 334458 - DNA, 15 bp, Homo sapiens
tgtgtgtggctctgc

SEQ ID NO: 334459 - DNA, 15 bp, Homo sapiens
gtgtgtggctctgcc

SEQ ID NO: 334460 - DNA, 15 bp, Homo sapiens
tgtgtggctctgcct

SEQ ID NO: 334461 - DNA, 15 bp, Homo sapiens
gtgtggctctgcctc

SEQ ID NO: 334462 - DNA, 15 bp, Homo sapiens
tgtggctctgcctca

SEQ ID NO: 334463 - DNA, 15 bp, Homo sapiens
gtggctctgcctcag

SEQ ID NO: 334464 - DNA, 15 bp, Homo sapiens
tggctctgcctcaga

SEQ ID NO: 334465 - DNA, 15 bp, Homo sapiens
ggctctgcctcagaa

SEQ ID NO: 334466 - DNA, 15 bp, Homo sapiens
gctctgcctcagaac

SEQ ID NO: 334467 - DNA, 15 bp, Homo sapiens
ctctgcctcagaacc

SEQ ID NO: 334468 - DNA, 15 bp, Homo sapiens
tctgcctcagaaccc

SEQ ID NO: 334469 - DNA, 15 bp, Homo sapiens
ctgcctcagaaccca

SEQ ID NO: 334470 - DNA, 15 bp, Homo sapiens
tgcctcagaacccac

SEQ ID NO: 334471 - DNA, 15 bp, Homo sapiens
gcctcagaacccaca

SEQ ID NO: 334472 - DNA, 15 bp, Homo sapiens
cctcagaacccacag

SEQ ID NO: 334473 - DNA, 15 bp, Homo sapiens
ctcagaacccacaga

SEQ ID NO: 334474 - DNA, 15 bp, Homo sapiens
tcagaacccacagag

SEQ ID NO: 334475 - DNA, 15 bp, Homo sapiens
cagaacccacagagt

SEQ ID NO: 334476 - DNA, 15 bp, Homo sapiens
agaacccacagagtc

SEQ ID NO: 334477 - DNA, 15 bp, Homo sapiens
gaacccacagagtcg

SEQ ID NO: 334478 - DNA, 15 bp, Homo sapiens
aacccacagagtcgg

SEQ ID NO: 334479 - DNA, 15 bp, Homo sapiens
acccacagagtcggc

SEQ ID NO: 334480 - DNA, 15 bp, Homo sapiens
cccacagagtcggct

SEQ ID NO: 334481 - DNA, 15 bp, Homo sapiens
ccacagagtcggctg

SEQ ID NO: 334482 - DNA, 15 bp, Homo sapiens
cacagagtcggctgg

SEQ ID NO: 334483 - DNA, 15 bp, Homo sapiens
acagagtcggctggc

SEQ ID NO: 334484 - DNA, 15 bp, Homo sapiens
cagagtcggctggct

SEQ ID NO: 334485 - DNA, 15 bp, Homo sapiens
agagtcggctggctc

SEQ ID NO: 334486 - DNA, 15 bp, Homo sapiens
gagtcggctggctcc

SEQ ID NO: 334487 - DNA, 15 bp, Homo sapiens
agtcggctggctccc

SEQ ID NO: 334488 - DNA, 15 bp, Homo sapiens
gtcggctggctccca

SEQ ID NO: 334489 - DNA, 15 bp, Homo sapiens
tcggctggctcccag

SEQ ID NO: 334490 - DNA, 15 bp, Homo sapiens
cggctggctcccaga

SEQ ID NO: 334491 - DNA, 15 bp, Homo sapiens
ggctggctcccagac

SEQ ID NO: 334492 - DNA, 15 bp, Homo sapiens
gctggctcccagacc

SEQ ID NO: 334493 - DNA, 15 bp, Homo sapiens
ctggctcccagacct

SEQ ID NO: 334494 - DNA, 15 bp, Homo sapiens
tggctcccagaccta

SEQ ID NO: 334495 - DNA, 15 bp, Homo sapiens
ggctcccagacctac

SEQ ID NO: 334496 - DNA, 15 bp, Homo sapiens
gctcccagacctact

SEQ ID NO: 334497 - DNA, 15 bp, Homo sapiens
ctcccagacctactc

SEQ ID NO: 334498 - DNA, 15 bp, Homo sapiens
tcccagacctactct

SEQ ID NO: 334499 - DNA, 15 bp, Homo sapiens
cccagacctactctg

SEQ ID NO: 334500 - DNA, 15 bp, Homo sapiens
ccagacctactctgt

SEQ ID NO: 334501 - DNA, 15 bp, Homo sapiens
cagacctactctgtc

SEQ ID NO: 334502 - DNA, 15 bp, Homo sapiens
agacctactctgtct

SEQ ID NO: 334503 - DNA, 15 bp, Homo sapiens
gacctactctgtctc

SEQ ID NO: 334504 - DNA, 15 bp, Homo sapiens
acctactctgtctct

SEQ ID NO: 334505 - DNA, 15 bp, Homo sapiens
cctactctgtctctg

SEQ ID NO: 334506 - DNA, 15 bp, Homo sapiens
ctactctgtctctgg

SEQ ID NO: 334507 - DNA, 15 bp, Homo sapiens
tactctgtctctggt

SEQ ID NO: 334508 - DNA, 15 bp, Homo sapiens
actctgtctctggtt

SEQ ID NO: 334509 - DNA, 15 bp, Homo sapiens
ctctgtctctggtta

SEQ ID NO: 334510 - DNA, 15 bp, Homo sapiens
tctgtctctggttac

SEQ ID NO: 334511 - DNA, 15 bp, Homo sapiens
ctgtctctggttaca

SEQ ID NO: 334512 - DNA, 15 bp, Homo sapiens
tgtctctggttacaa

SEQ ID NO: 334513 - DNA, 15 bp, Homo sapiens
gtctctggttacaag

SEQ ID NO: 334514 - DNA, 15 bp, Homo sapiens
tctctggttacaagt

SEQ ID NO: 334515 - DNA, 15 bp, Homo sapiens
ctctggttacaagtc

SEQ ID NO: 334516 - DNA, 15 bp, Homo sapiens
tctggttacaagtca

SEQ ID NO: 334517 - DNA, 15 bp, Homo sapiens
ctggttacaagtcag

SEQ ID NO: 334518 - DNA, 15 bp, Homo sapiens
tggttacaagtcagt

SEQ ID NO: 334519 - DNA, 15 bp, Homo sapiens
ggttacaagtcagtg

SEQ ID NO: 334520 - DNA, 15 bp, Homo sapiens
gttacaagtcagtgt

SEQ ID NO: 334521 - DNA, 15 bp, Homo sapiens
ttacaagtcagtgtc

SEQ ID NO: 334522 - DNA, 15 bp, Homo sapiens
tacaagtcagtgtct

SEQ ID NO: 334523 - DNA, 15 bp, Homo sapiens
acaagtcagtgtctt

SEQ ID NO: 334524 - DNA, 15 bp, Homo sapiens
caagtcagtgtctta

SEQ ID NO: 334525 - DNA, 15 bp, Homo sapiens
aagtcagtgtcttat

SEQ ID NO: 334526 - DNA, 15 bp, Homo sapiens
agtcagtgtcttatt

SEQ ID NO: 334527 - DNA, 15 bp, Homo sapiens
gtcagtgtcttattt

SEQ ID NO: 334528 - DNA, 15 bp, Homo sapiens
tcagtgtcttattta

SEQ ID NO: 334529 - DNA, 15 bp, Homo sapiens
cagtgtcttatttac

SEQ ID NO: 334530 - DNA, 15 bp, Homo sapiens
agtgtcttatttact

SEQ ID NO: 334531 - DNA, 15 bp, Homo sapiens
gtgtcttatttactg

SEQ ID NO: 334532 - DNA, 15 bp, Homo sapiens
tgtcttatttactgg

SEQ ID NO: 334533 - DNA, 15 bp, Homo sapiens
gtcttatttactgga

SEQ ID NO: 334534 - DNA, 15 bp, Homo sapiens
tcttatttactggaa

SEQ ID NO: 334535 - DNA, 15 bp, Homo sapiens
cttatttactggaag

SEQ ID NO: 334536 - DNA, 15 bp, Homo sapiens
ttatttactggaagt

SEQ ID NO: 334537 - DNA, 15 bp, Homo sapiens
tatttactggaagtt

SEQ ID NO: 334538 - DNA, 15 bp, Homo sapiens
atttactggaagtta

SEQ ID NO: 334539 - DNA, 15 bp, Homo sapiens
tttactggaagttaa

SEQ ID NO: 334540 - DNA, 15 bp, Homo sapiens
ttactggaagttaaa

SEQ ID NO: 334541 - DNA, 15 bp, Homo sapiens
tactggaagttaaaa

SEQ ID NO: 334542 - DNA, 15 bp, Homo sapiens
actggaagttaaaag

SEQ ID NO: 334543 - DNA, 15 bp, Homo sapiens
ctggaagttaaaaga

SEQ ID NO: 334544 - DNA, 15 bp, Homo sapiens
tggaagttaaaagac

SEQ ID NO: 334545 - DNA, 15 bp, Homo sapiens
ggaagttaaaagaca

SEQ ID NO: 334546 - DNA, 15 bp, Homo sapiens
gaagttaaaagacag

SEQ ID NO: 334547 - DNA, 15 bp, Homo sapiens
aagttaaaagacagg

SEQ ID NO: 334548 - DNA, 15 bp, Homo sapiens
agttaaaagacaggg

SEQ ID NO: 334549 - DNA, 15 bp, Homo sapiens
gttaaaagacagggc

SEQ ID NO: 334550 - DNA, 15 bp, Homo sapiens
ttaaaagacagggca

SEQ ID NO: 334551 - DNA, 15 bp, Homo sapiens
taaaagacagggcac

SEQ ID NO: 334552 - DNA, 15 bp, Homo sapiens
aaaagacagggcact

SEQ ID NO: 334553 - DNA, 15 bp, Homo sapiens
aaagacagggcactg

SEQ ID NO: 334554 - DNA, 15 bp, Homo sapiens
aagacagggcactgt

SEQ ID NO: 334555 - DNA, 15 bp, Homo sapiens
agacagggcactgtt

SEQ ID NO: 334556 - DNA, 15 bp, Homo sapiens
gacagggcactgttg

SEQ ID NO: 334557 - DNA, 15 bp, Homo sapiens
acagggcactgttga

SEQ ID NO: 334558 - DNA, 15 bp, Homo sapiens
cagggcactgttgat

SEQ ID NO: 334559 - DNA, 15 bp, Homo sapiens
agggcactgttgatt

SEQ ID NO: 334560 - DNA, 15 bp, Homo sapiens
gggcactgttgattt

SEQ ID NO: 334561 - DNA, 15 bp, Homo sapiens
ggcactgttgattta

SEQ ID NO: 334562 - DNA, 15 bp, Homo sapiens
gcactgttgatttac

SEQ ID NO: 334563 - DNA, 15 bp, Homo sapiens
cactgttgatttaca

SEQ ID NO: 334564 - DNA, 15 bp, Homo sapiens
actgttgatttacac

SEQ ID NO: 334565 - DNA, 15 bp, Homo sapiens
ctgttgatttacact

SEQ ID NO: 334566 - DNA, 15 bp, Homo sapiens
tgttgatttacactg

SEQ ID NO: 334567 - DNA, 15 bp, Homo sapiens
gttgatttacactgt

SEQ ID NO: 334568 - DNA, 15 bp, Homo sapiens
ttgatttacactgtg

SEQ ID NO: 334569 - DNA, 15 bp, Homo sapiens
tgatttacactgtgc

SEQ ID NO: 334570 - DNA, 15 bp, Homo sapiens
gatttacactgtgct

SEQ ID NO: 334571 - DNA, 15 bp, Homo sapiens
atttacactgtgctt

SEQ ID NO: 334572 - DNA, 15 bp, Homo sapiens
tttacactgtgcttc

SEQ ID NO: 334573 - DNA, 15 bp, Homo sapiens
ttacactgtgcttca

SEQ ID NO: 334574 - DNA, 15 bp, Homo sapiens
tacactgtgcttcag

SEQ ID NO: 334575 - DNA, 15 bp, Homo sapiens
acactgtgcttcagc

SEQ ID NO: 334576 - DNA, 15 bp, Homo sapiens
cactgtgcttcagca

SEQ ID NO: 334577 - DNA, 15 bp, Homo sapiens
actgtgcttcagcat

SEQ ID NO: 334578 - DNA, 15 bp, Homo sapiens
ctgtgcttcagcatg

SEQ ID NO: 334579 - DNA, 15 bp, Homo sapiens
tgtgcttcagcatgc

SEQ ID NO: 334580 - DNA, 15 bp, Homo sapiens
gtgcttcagcatgcc

SEQ ID NO: 334581 - DNA, 15 bp, Homo sapiens
tgcttcagcatgccc

SEQ ID NO: 334582 - DNA, 15 bp, Homo sapiens
gcttcagcatgccct

SEQ ID NO: 334583 - DNA, 15 bp, Homo sapiens
cttcagcatgccctt

SEQ ID NO: 334584 - DNA, 15 bp, Homo sapiens
ttcagcatgccctta

SEQ ID NO: 334585 - DNA, 15 bp, Homo sapiens
tcagcatgcccttat

SEQ ID NO: 334586 - DNA, 15 bp, Homo sapiens
cagcatgcccttatt

SEQ ID NO: 334587 - DNA, 15 bp, Homo sapiens
agcatgcccttatta

SEQ ID NO: 334588 - DNA, 15 bp, Homo sapiens
gcatgcccttattag

SEQ ID NO: 334589 - DNA, 15 bp, Homo sapiens
catgcccttattagt

SEQ ID NO: 334590 - DNA, 15 bp, Homo sapiens
atgcccttattagta

SEQ ID NO: 334591 - DNA, 15 bp, Homo sapiens
tgcccttattagtat

SEQ ID NO: 334592 - DNA, 15 bp, Homo sapiens
gcccttattagtatt

SEQ ID NO: 334593 - DNA, 15 bp, Homo sapiens
cccttattagtattt

SEQ ID NO: 334594 - DNA, 15 bp, Homo sapiens
ccttattagtatttc

SEQ ID NO: 334595 - DNA, 15 bp, Homo sapiens
cttattagtatttct

SEQ ID NO: 334596 - DNA, 15 bp, Homo sapiens
ttattagtatttctt

SEQ ID NO: 334597 - DNA, 15 bp, Homo sapiens
tattagtatttcttg

SEQ ID NO: 334598 - DNA, 15 bp, Homo sapiens
attagtatttcttgg

SEQ ID NO: 334599 - DNA, 15 bp, Homo sapiens
ttagtatttcttggt

SEQ ID NO: 334600 - DNA, 15 bp, Homo sapiens
tagtatttcttggtt

SEQ ID NO: 334601 - DNA, 15 bp, Homo sapiens
agtatttcttggttc

SEQ ID NO: 334602 - DNA, 15 bp, Homo sapiens
gtatttcttggttct

SEQ ID NO: 334603 - DNA, 15 bp, Homo sapiens
tatttcttggttctt

SEQ ID NO: 334604 - DNA, 15 bp, Homo sapiens
atttcttggttcttc

SEQ ID NO: 334605 - DNA, 15 bp, Homo sapiens
tttcttggttcttcc

SEQ ID NO: 334606 - DNA, 15 bp, Homo sapiens
ttcttggttcttcca

SEQ ID NO: 334607 - DNA, 15 bp, Homo sapiens
tcttggttcttccat

SEQ ID NO: 334608 - DNA, 15 bp, Homo sapiens
cttggttcttccatc

SEQ ID NO: 334609 - DNA, 15 bp, Homo sapiens
ttggttcttccatca

SEQ ID NO: 334610 - DNA, 15 bp, Homo sapiens
tggttcttccatcag

SEQ ID NO: 334611 - DNA, 15 bp, Homo sapiens
ggttcttccatcagt

SEQ ID NO: 334612 - DNA, 15 bp, Homo sapiens
gttcttccatcagtg

SEQ ID NO: 334613 - DNA, 15 bp, Homo sapiens
ttcttccatcagtga

SEQ ID NO: 334614 - DNA, 15 bp, Homo sapiens
tcttccatcagtgag

SEQ ID NO: 334615 - DNA, 15 bp, Homo sapiens
cttccatcagtgagt

SEQ ID NO: 334616 - DNA, 15 bp, Homo sapiens
ttccatcagtgagtc

SEQ ID NO: 334617 - DNA, 15 bp, Homo sapiens
tccatcagtgagtct

SEQ ID NO: 334618 - DNA, 15 bp, Homo sapiens
ccatcagtgagtctc

SEQ ID NO: 334619 - DNA, 15 bp, Homo sapiens
catcagtgagtctct

SEQ ID NO: 334620 - DNA, 15 bp, Homo sapiens
atcagtgagtctctg

SEQ ID NO: 334621 - DNA, 15 bp, Homo sapiens
tcagtgagtctctga

SEQ ID NO: 334622 - DNA, 15 bp, Homo sapiens
cagtgagtctctgat

SEQ ID NO: 334623 - DNA, 15 bp, Homo sapiens
agtgagtctctgatt

SEQ ID NO: 334624 - DNA, 15 bp, Homo sapiens
gtgagtctctgattt

SEQ ID NO: 334625 - DNA, 15 bp, Homo sapiens
tgagtctctgatttc

SEQ ID NO: 334626 - DNA, 15 bp, Homo sapiens
gagtctctgatttct

SEQ ID NO: 334627 - DNA, 15 bp, Homo sapiens
agtctctgatttctt

SEQ ID NO: 334628 - DNA, 15 bp, Homo sapiens
gtctctgatttcttc

SEQ ID NO: 334629 - DNA, 15 bp, Homo sapiens
tctctgatttcttca

SEQ ID NO: 334630 - DNA, 15 bp, Homo sapiens
ctctgatttcttcac

SEQ ID NO: 334631 - DNA, 15 bp, Homo sapiens
tctgatttcttcacc

SEQ ID NO: 334632 - DNA, 15 bp, Homo sapiens
ctgatttcttcacca

SEQ ID NO: 334633 - DNA, 15 bp, Homo sapiens
tgatttcttcaccaa

SEQ ID NO: 334634 - DNA, 15 bp, Homo sapiens
gatttcttcaccaaa

SEQ ID NO: 334635 - DNA, 15 bp, Homo sapiens
atttcttcaccaaaa

SEQ ID NO: 334636 - DNA, 15 bp, Homo sapiens
tttcttcaccaaaaa

SEQ ID NO: 334637 - DNA, 15 bp, Homo sapiens
ttcttcaccaaaaaa

SEQ ID NO: 334638 - DNA, 15 bp, Homo sapiens
tcttcaccaaaaaat

SEQ ID NO: 334639 - DNA, 15 bp, Homo sapiens
cttcaccaaaaaata

SEQ ID NO: 334640 - DNA, 15 bp, Homo sapiens
ttcaccaaaaaataa

SEQ ID NO: 334641 - DNA, 15 bp, Homo sapiens
tcaccaaaaaataat

SEQ ID NO: 334642 - DNA, 15 bp, Homo sapiens
caccaaaaaataatc

SEQ ID NO: 334643 - DNA, 15 bp, Homo sapiens
accaaaaaataatct

SEQ ID NO: 334644 - DNA, 15 bp, Homo sapiens
ccaaaaaataatctt

SEQ ID NO: 334645 - DNA, 15 bp, Homo sapiens
caaaaaataatcttg

SEQ ID NO: 334646 - DNA, 15 bp, Homo sapiens
aaaaaataatcttgc

SEQ ID NO: 334647 - DNA, 15 bp, Homo sapiens
aaaaataatcttgca

SEQ ID NO: 334648 - DNA, 15 bp, Homo sapiens
aaaataatcttgcag

SEQ ID NO: 334649 - DNA, 15 bp, Homo sapiens
aaataatcttgcaga

SEQ ID NO: 334650 - DNA, 15 bp, Homo sapiens
aataatcttgcagag

SEQ ID NO: 334651 - DNA, 15 bp, Homo sapiens
ataatcttgcagaga

SEQ ID NO: 334652 - DNA, 15 bp, Homo sapiens
taatcttgcagagag

SEQ ID NO: 334653 - DNA, 15 bp, Homo sapiens
aatcttgcagagagt

SEQ ID NO: 334654 - DNA, 15 bp, Homo sapiens
atcttgcagagagtc

SEQ ID NO: 334655 - DNA, 15 bp, Homo sapiens
tcttgcagagagtca

SEQ ID NO: 334656 - DNA, 15 bp, Homo sapiens
cttgcagagagtcat

SEQ ID NO: 334657 - DNA, 15 bp, Homo sapiens
ttgcagagagtcatg

SEQ ID NO: 334658 - DNA, 15 bp, Homo sapiens
tgcagagagtcatga

SEQ ID NO: 334659 - DNA, 15 bp, Homo sapiens
gcagagagtcatgat

SEQ ID NO: 334660 - DNA, 15 bp, Homo sapiens
cagagagtcatgatc

SEQ ID NO: 334661 - DNA, 15 bp, Homo sapiens
agagagtcatgatca

SEQ ID NO: 334662 - DNA, 15 bp, Homo sapiens
gagagtcatgatcaa

SEQ ID NO: 334663 - DNA, 15 bp, Homo sapiens
agagtcatgatcaac

SEQ ID NO: 334664 - DNA, 15 bp, Homo sapiens
gagtcatgatcaacc

SEQ ID NO: 334665 - DNA, 15 bp, Homo sapiens
agtcatgatcaaccc

SEQ ID NO: 334666 - DNA, 15 bp, Homo sapiens
gtcatgatcaaccct

SEQ ID NO: 334667 - DNA, 15 bp, Homo sapiens
tcatgatcaaccctg

SEQ ID NO: 334668 - DNA, 15 bp, Homo sapiens
catgatcaaccctgt

SEQ ID NO: 334669 - DNA, 15 bp, Homo sapiens
atgatcaaccctgtt

SEQ ID NO: 334670 - DNA, 15 bp, Homo sapiens
tgatcaaccctgttt

SEQ ID NO: 334671 - DNA, 15 bp, Homo sapiens
gatcaaccctgtttt

SEQ ID NO: 334672 - DNA, 15 bp, Homo sapiens
atcaaccctgttttt

SEQ ID NO: 334673 - DNA, 15 bp, Homo sapiens
tcaaccctgttttta

SEQ ID NO: 334674 - DNA, 15 bp, Homo sapiens
caaccctgtttttat

SEQ ID NO: 334675 - DNA, 15 bp, Homo sapiens
aaccctgtttttata

SEQ ID NO: 334676 - DNA, 15 bp, Homo sapiens
accctgtttttataa

SEQ ID NO: 334677 - DNA, 15 bp, Homo sapiens
ccctgtttttataaa

SEQ ID NO: 334678 - DNA, 15 bp, Homo sapiens
cctgtttttataaaa

SEQ ID NO: 334679 - DNA, 15 bp, Homo sapiens
ctgtttttataaaac

SEQ ID NO: 334680 - DNA, 15 bp, Homo sapiens
tgtttttataaaaca

SEQ ID NO: 334681 - DNA, 15 bp, Homo sapiens
gtttttataaaacac

SEQ ID NO: 334682 - DNA, 15 bp, Homo sapiens
tttttataaaacact

SEQ ID NO: 334683 - DNA, 15 bp, Homo sapiens
ttttataaaacactg

SEQ ID NO: 334684 - DNA, 15 bp, Homo sapiens
tttataaaacactga

SEQ ID NO: 334685 - DNA, 15 bp, Homo sapiens
ttataaaacactgag

SEQ ID NO: 334686 - DNA, 15 bp, Homo sapiens
tataaaacactgagc

SEQ ID NO: 334687 - DNA, 15 bp, Homo sapiens
ataaaacactgagct

SEQ ID NO: 334688 - DNA, 15 bp, Homo sapiens
taaaacactgagctt

SEQ ID NO: 334689 - DNA, 15 bp, Homo sapiens
aaaacactgagcttt

SEQ ID NO: 334690 - DNA, 15 bp, Homo sapiens
aaacactgagctttg

SEQ ID NO: 334691 - DNA, 15 bp, Homo sapiens
aacactgagctttgg

SEQ ID NO: 334692 - DNA, 15 bp, Homo sapiens
acactgagctttgga

SEQ ID NO: 334693 - DNA, 15 bp, Homo sapiens
cactgagctttggaa

SEQ ID NO: 334694 - DNA, 15 bp, Homo sapiens
actgagctttggaaa

SEQ ID NO: 334695 - DNA, 15 bp, Homo sapiens
ctgagctttggaaag

SEQ ID NO: 334696 - DNA, 15 bp, Homo sapiens
tgagctttggaaagg

SEQ ID NO: 334697 - DNA, 15 bp, Homo sapiens
gagctttggaaaggg

SEQ ID NO: 334698 - DNA, 15 bp, Homo sapiens
cctcattctaactag

SEQ ID NO: 334699 - DNA, 15 bp, Homo sapiens
ctcattctaactagt

SEQ ID NO: 334700 - DNA, 15 bp, Homo sapiens
tcattctaactagtg

SEQ ID NO: 334701 - DNA, 15 bp, Homo sapiens
cattctaactagtga

SEQ ID NO: 334702 - DNA, 15 bp, Homo sapiens
attctaactagtgac

SEQ ID NO: 334703 - DNA, 15 bp, Homo sapiens
ttctaactagtgaca

SEQ ID NO: 334704 - DNA, 15 bp, Homo sapiens
tctaactagtgacat

SEQ ID NO: 334705 - DNA, 15 bp, Homo sapiens
ctaactagtgacatc

SEQ ID NO: 334706 - DNA, 15 bp, Homo sapiens
taactagtgacatct

SEQ ID NO: 334707 - DNA, 15 bp, Homo sapiens
aactagtgacatctg

SEQ ID NO: 334708 - DNA, 15 bp, Homo sapiens
actagtgacatctgc

SEQ ID NO: 334709 - DNA, 15 bp, Homo sapiens
ctagtgacatctgca

SEQ ID NO: 334710 - DNA, 15 bp, Homo sapiens
tagtgacatctgcaa

SEQ ID NO: 334711 - DNA, 15 bp, Homo sapiens
agtgacatctgcaat

SEQ ID NO: 334712 - DNA, 15 bp, Homo sapiens
gtgacatctgcaatg

SEQ ID NO: 334713 - DNA, 15 bp, Homo sapiens
tgacatctgcaatga

SEQ ID NO: 334714 - DNA, 15 bp, Homo sapiens
gacatctgcaatgac

SEQ ID NO: 334715 - DNA, 15 bp, Homo sapiens
acatctgcaatgacc

SEQ ID NO: 334716 - DNA, 15 bp, Homo sapiens
catctgcaatgacct

SEQ ID NO: 334717 - DNA, 15 bp, Homo sapiens
atctgcaatgacctt

SEQ ID NO: 334718 - DNA, 15 bp, Homo sapiens
tctgcaatgacctta

SEQ ID NO: 334719 - DNA, 15 bp, Homo sapiens
ctgcaatgaccttat

SEQ ID NO: 334720 - DNA, 15 bp, Homo sapiens
tgcaatgaccttatt

SEQ ID NO: 334721 - DNA, 15 bp, Homo sapiens
gcaatgaccttattt

SEQ ID NO: 334722 - DNA, 15 bp, Homo sapiens
caatgaccttatttc

SEQ ID NO: 334723 - DNA, 15 bp, Homo sapiens
aatgaccttatttcc

SEQ ID NO: 334724 - DNA, 15 bp, Homo sapiens
atgaccttatttcca

SEQ ID NO: 334725 - DNA, 15 bp, Homo sapiens
tgaccttatttccaa

SEQ ID NO: 334726 - DNA, 15 bp, Homo sapiens
gaccttatttccaaa

SEQ ID NO: 334727 - DNA, 15 bp, Homo sapiens
accttatttccaaat

SEQ ID NO: 334728 - DNA, 15 bp, Homo sapiens
ccttatttccaaata

SEQ ID NO: 334729 - DNA, 15 bp, Homo sapiens
cttatttccaaatag

SEQ ID NO: 334730 - DNA, 15 bp, Homo sapiens
ttatttccaaataga

SEQ ID NO: 334731 - DNA, 15 bp, Homo sapiens
tatttccaaatagag

SEQ ID NO: 334732 - DNA, 15 bp, Homo sapiens
atttccaaatagagc

SEQ ID NO: 334733 - DNA, 15 bp, Homo sapiens
tttccaaatagagcc

SEQ ID NO: 334734 - DNA, 15 bp, Homo sapiens
ttccaaatagagccc

SEQ ID NO: 334735 - DNA, 15 bp, Homo sapiens
tccaaatagagcccc

SEQ ID NO: 334736 - DNA, 15 bp, Homo sapiens
ccaaatagagcccct

SEQ ID NO: 334737 - DNA, 15 bp, Homo sapiens
caaatagagcccctc

SEQ ID NO: 334738 - DNA, 15 bp, Homo sapiens
aaatagagcccctct

SEQ ID NO: 334739 - DNA, 15 bp, Homo sapiens
aatagagcccctctc

SEQ ID NO: 334740 - DNA, 15 bp, Homo sapiens
atagagcccctctct

SEQ ID NO: 334741 - DNA, 15 bp, Homo sapiens
tagagcccctctctg

SEQ ID NO: 334742 - DNA, 15 bp, Homo sapiens
agagcccctctctga

SEQ ID NO: 334743 - DNA, 15 bp, Homo sapiens
gagcccctctctgaa

SEQ ID NO: 334744 - DNA, 15 bp, Homo sapiens
agcccctctctgaag

SEQ ID NO: 334745 - DNA, 15 bp, Homo sapiens
gcccctctctgaagt

SEQ ID NO: 334746 - DNA, 15 bp, Homo sapiens
cccctctctgaagta

SEQ ID NO: 334747 - DNA, 15 bp, Homo sapiens
ccctctctgaagtac

SEQ ID NO: 334748 - DNA, 15 bp, Homo sapiens
cctctctgaagtact

SEQ ID NO: 334749 - DNA, 15 bp, Homo sapiens
ctctctgaagtactg

SEQ ID NO: 334750 - DNA, 15 bp, Homo sapiens
tctctgaagtactga

SEQ ID NO: 334751 - DNA, 15 bp, Homo sapiens
ctctgaagtactgag

SEQ ID NO: 334752 - DNA, 15 bp, Homo sapiens
tctgaagtactgagg

SEQ ID NO: 334753 - DNA, 15 bp, Homo sapiens
ctgaagtactgaggg

SEQ ID NO: 334754 - DNA, 15 bp, Homo sapiens
tgaagtactgagggt

SEQ ID NO: 334755 - DNA, 15 bp, Homo sapiens
gaagtactgagggtt

SEQ ID NO: 334756 - DNA, 15 bp, Homo sapiens
aagtactgagggtta

SEQ ID NO: 334757 - DNA, 15 bp, Homo sapiens
agtactgagggttag

SEQ ID NO: 334758 - DNA, 15 bp, Homo sapiens
gtactgagggttagg

SEQ ID NO: 334759 - DNA, 15 bp, Homo sapiens
tactgagggttagga

SEQ ID NO: 334760 - DNA, 15 bp, Homo sapiens
actgagggttaggac

SEQ ID NO: 334761 - DNA, 15 bp, Homo sapiens
ctgagggttaggact

SEQ ID NO: 334762 - DNA, 15 bp, Homo sapiens
tgagggttaggactt

SEQ ID NO: 334763 - DNA, 15 bp, Homo sapiens
gagggttaggacttc

SEQ ID NO: 334764 - DNA, 15 bp, Homo sapiens
agggttaggacttca

SEQ ID NO: 334765 - DNA, 15 bp, Homo sapiens
gggttaggacttcaa

SEQ ID NO: 334766 - DNA, 15 bp, Homo sapiens
ggttaggacttcaac

SEQ ID NO: 334767 - DNA, 15 bp, Homo sapiens
gttaggacttcaaca

SEQ ID NO: 334768 - DNA, 15 bp, Homo sapiens
ttaggacttcaacat

SEQ ID NO: 334769 - DNA, 15 bp, Homo sapiens
taggacttcaacata

SEQ ID NO: 334770 - DNA, 15 bp, Homo sapiens
aggacttcaacatat

SEQ ID NO: 334771 - DNA, 15 bp, Homo sapiens
ggacttcaacatatt

SEQ ID NO: 334772 - DNA, 15 bp, Homo sapiens
gacttcaacatatta

SEQ ID NO: 334773 - DNA, 15 bp, Homo sapiens
acttcaacatattaa

SEQ ID NO: 334774 - DNA, 15 bp, Homo sapiens
cttcaacatattaat

SEQ ID NO: 334775 - DNA, 15 bp, Homo sapiens
ttcaacatattaatt

SEQ ID NO: 334776 - DNA, 15 bp, Homo sapiens
tcaacatattaattt

SEQ ID NO: 334777 - DNA, 15 bp, Homo sapiens
caacatattaatttt

SEQ ID NO: 334778 - DNA, 15 bp, Homo sapiens
aacatattaatttta

SEQ ID NO: 334779 - DNA, 15 bp, Homo sapiens
acatattaattttag

SEQ ID NO: 334780 - DNA, 15 bp, Homo sapiens
catattaattttaga

SEQ ID NO: 334781 - DNA, 15 bp, Homo sapiens
atattaattttagag

SEQ ID NO: 334782 - DNA, 15 bp, Homo sapiens
tattaattttagaga

SEQ ID NO: 334783 - DNA, 15 bp, Homo sapiens
attaattttagagaa

SEQ ID NO: 334784 - DNA, 15 bp, Homo sapiens
ttaattttagagaac

SEQ ID NO: 334785 - DNA, 15 bp, Homo sapiens
taattttagagaaca

SEQ ID NO: 334786 - DNA, 15 bp, Homo sapiens
aattttagagaacat

SEQ ID NO: 334787 - DNA, 15 bp, Homo sapiens
attttagagaacata

SEQ ID NO: 334788 - DNA, 15 bp, Homo sapiens
ttttagagaacataa

SEQ ID NO: 334789 - DNA, 15 bp, Homo sapiens
tttagagaacataat

SEQ ID NO: 334790 - DNA, 15 bp, Homo sapiens
ttagagaacataatt

SEQ ID NO: 334791 - DNA, 15 bp, Homo sapiens
tagagaacataattc

SEQ ID NO: 334792 - DNA, 15 bp, Homo sapiens
agagaacataattca

SEQ ID NO: 334793 - DNA, 15 bp, Homo sapiens
gagaacataattcaa

SEQ ID NO: 334794 - DNA, 15 bp, Homo sapiens
agaacataattcaac

SEQ ID NO: 334795 - DNA, 15 bp, Homo sapiens
gaacataattcaact

SEQ ID NO: 334796 - DNA, 15 bp, Homo sapiens
aacataattcaactc

SEQ ID NO: 334797 - DNA, 15 bp, Homo sapiens
acataattcaactca

SEQ ID NO: 334798 - DNA, 15 bp, Homo sapiens
cataattcaactcat

SEQ ID NO: 334799 - DNA, 15 bp, Homo sapiens
ataattcaactcata

SEQ ID NO: 334800 - DNA, 15 bp, Homo sapiens
taattcaactcataa

SEQ ID NO: 334801 - DNA, 15 bp, Homo sapiens
aattcaactcataac

SEQ ID NO: 334802 - DNA, 15 bp, Homo sapiens
attcaactcataaca

SEQ ID NO: 334803 - DNA, 15 bp, Homo sapiens
ttcaactcataacaa

SEQ ID NO: 334804 - DNA, 15 bp, Homo sapiens
tcaactcataacaat

SEQ ID NO: 334805 - DNA, 15 bp, Homo sapiens
caactcataacaatt

SEQ ID NO: 334806 - DNA, 15 bp, Homo sapiens
aactcataacaattt

SEQ ID NO: 334807 - DNA, 15 bp, Homo sapiens
actcataacaatttt

SEQ ID NO: 334808 - DNA, 15 bp, Homo sapiens
ctcataacaattttc

SEQ ID NO: 334809 - DNA, 15 bp, Homo sapiens
tcataacaattttca

SEQ ID NO: 334810 - DNA, 15 bp, Homo sapiens
cataacaattttcaa

SEQ ID NO: 334811 - DNA, 15 bp, Homo sapiens
ataacaattttcaat

SEQ ID NO: 334812 - DNA, 15 bp, Homo sapiens
taacaattttcaatg

SEQ ID NO: 334813 - DNA, 15 bp, Homo sapiens
aacaattttcaatgg

SEQ ID NO: 334814 - DNA, 15 bp, Homo sapiens
acaattttcaatgga

SEQ ID NO: 334815 - DNA, 15 bp, Homo sapiens
caattttcaatggaa

SEQ ID NO: 334816 - DNA, 15 bp, Homo sapiens
aattttcaatggaag

SEQ ID NO: 334817 - DNA, 15 bp, Homo sapiens
attttcaatggaaga

SEQ ID NO: 334818 - DNA, 15 bp, Homo sapiens
ttttcaatggaagag

SEQ ID NO: 334819 - DNA, 15 bp, Homo sapiens
tttcaatggaagagg

SEQ ID NO: 334820 - DNA, 15 bp, Homo sapiens
ttcaatggaagaggc

SEQ ID NO: 334821 - DNA, 15 bp, Homo sapiens
tcaatggaagaggct

SEQ ID NO: 334822 - DNA, 15 bp, Homo sapiens
caatggaagaggctg

SEQ ID NO: 334823 - DNA, 15 bp, Homo sapiens
aatggaagaggctga

SEQ ID NO: 334824 - DNA, 15 bp, Homo sapiens
atggaagaggctgac

SEQ ID NO: 334825 - DNA, 15 bp, Homo sapiens
tggaagaggctgaca

SEQ ID NO: 334826 - DNA, 15 bp, Homo sapiens
ggaagaggctgacaa

SEQ ID NO: 334827 - DNA, 15 bp, Homo sapiens
gaagaggctgacaaa

SEQ ID NO: 334828 - DNA, 15 bp, Homo sapiens
aagaggctgacaaaa

SEQ ID NO: 334829 - DNA, 15 bp, Homo sapiens
agaggctgacaaaat

SEQ ID NO: 334830 - DNA, 15 bp, Homo sapiens
gaggctgacaaaatg

SEQ ID NO: 334831 - DNA, 15 bp, Homo sapiens
aggctgacaaaatgc

SEQ ID NO: 334832 - DNA, 15 bp, Homo sapiens
ggctgacaaaatgcc

SEQ ID NO: 334833 - DNA, 15 bp, Homo sapiens
gctgacaaaatgccc

SEQ ID NO: 334834 - DNA, 15 bp, Homo sapiens
ctgacaaaatgccct

SEQ ID NO: 334835 - DNA, 15 bp, Homo sapiens
tgacaaaatgcccta

SEQ ID NO: 334836 - DNA, 15 bp, Homo sapiens
gacaaaatgccctat

SEQ ID NO: 334837 - DNA, 15 bp, Homo sapiens
acaaaatgccctatt

SEQ ID NO: 334838 - DNA, 15 bp, Homo sapiens
caaaatgccctattt

SEQ ID NO: 334839 - DNA, 15 bp, Homo sapiens
aaaatgccctatttt

SEQ ID NO: 334840 - DNA, 15 bp, Homo sapiens
aaatgccctattttc

SEQ ID NO: 334841 - DNA, 15 bp, Homo sapiens
aatgccctattttcc

SEQ ID NO: 334842 - DNA, 15 bp, Homo sapiens
atgccctattttcct

SEQ ID NO: 334843 - DNA, 15 bp, Homo sapiens
tgccctattttcctg

SEQ ID NO: 334844 - DNA, 15 bp, Homo sapiens
gccctattttcctgg

SEQ ID NO: 334845 - DNA, 15 bp, Homo sapiens
ccctattttcctggc

SEQ ID NO: 334846 - DNA, 15 bp, Homo sapiens
cctattttcctggca

SEQ ID NO: 334847 - DNA, 15 bp, Homo sapiens
ctattttcctggcat

SEQ ID NO: 334848 - DNA, 15 bp, Homo sapiens
tattttcctggcata

SEQ ID NO: 334849 - DNA, 15 bp, Homo sapiens
attttcctggcatag

SEQ ID NO: 334850 - DNA, 15 bp, Homo sapiens
ttttcctggcatagg

SEQ ID NO: 334851 - DNA, 15 bp, Homo sapiens
tttcctggcataggg

SEQ ID NO: 334852 - DNA, 15 bp, Homo sapiens
ttcctggcataggga

SEQ ID NO: 334853 - DNA, 15 bp, Homo sapiens
tcctggcatagggaa

SEQ ID NO: 334854 - DNA, 15 bp, Homo sapiens
cctggcatagggaaa

SEQ ID NO: 334855 - DNA, 15 bp, Homo sapiens
ctggcatagggaaaa

SEQ ID NO: 334856 - DNA, 15 bp, Homo sapiens
tggcatagggaaaaa

SEQ ID NO: 334857 - DNA, 15 bp, Homo sapiens
ggcatagggaaaaaa

SEQ ID NO: 334858 - DNA, 15 bp, Homo sapiens
gcatagggaaaaaag

SEQ ID NO: 334859 - DNA, 15 bp, Homo sapiens
catagggaaaaaagt

SEQ ID NO: 334860 - DNA, 15 bp, Homo sapiens
atagggaaaaaagta

SEQ ID NO: 334861 - DNA, 15 bp, Homo sapiens
tagggaaaaaagtac

SEQ ID NO: 334862 - DNA, 15 bp, Homo sapiens
agggaaaaaagtacc

SEQ ID NO: 334863 - DNA, 15 bp, Homo sapiens
gggaaaaaagtacct

SEQ ID NO: 334864 - DNA, 15 bp, Homo sapiens
ggaaaaaagtaccta

SEQ ID NO: 334865 - DNA, 15 bp, Homo sapiens
gaaaaaagtacctac

SEQ ID NO: 334866 - DNA, 15 bp, Homo sapiens
aaaaaagtacctacc

SEQ ID NO: 334867 - DNA, 15 bp, Homo sapiens
aaaaagtacctacct

SEQ ID NO: 334868 - DNA, 15 bp, Homo sapiens
aaaagtacctacctt

SEQ ID NO: 334869 - DNA, 15 bp, Homo sapiens
aaagtacctaccttt

SEQ ID NO: 334870 - DNA, 15 bp, Homo sapiens
aagtacctacctttc

SEQ ID NO: 334871 - DNA, 15 bp, Homo sapiens
agtacctacctttct

SEQ ID NO: 334872 - DNA, 15 bp, Homo sapiens
gtacctacctttctt

SEQ ID NO: 334873 - DNA, 15 bp, Homo sapiens
tacctacctttctta

SEQ ID NO: 334874 - DNA, 15 bp, Homo sapiens
acctacctttcttat

SEQ ID NO: 334875 - DNA, 15 bp, Homo sapiens
cctacctttcttatg

SEQ ID NO: 334876 - DNA, 15 bp, Homo sapiens
ctacctttcttatgt

SEQ ID NO: 334877 - DNA, 15 bp, Homo sapiens
tacctttcttatgtt

SEQ ID NO: 334878 - DNA, 15 bp, Homo sapiens
acctttcttatgtta

SEQ ID NO: 334879 - DNA, 15 bp, Homo sapiens
cctttcttatgttaa

SEQ ID NO: 334880 - DNA, 15 bp, Homo sapiens
ctttcttatgttaaa

SEQ ID NO: 334881 - DNA, 15 bp, Homo sapiens
tttcttatgttaaat

SEQ ID NO: 334882 - DNA, 15 bp, Homo sapiens
ttcttatgttaaatt

SEQ ID NO: 334883 - DNA, 15 bp, Homo sapiens
tcttatgttaaattt

SEQ ID NO: 334884 - DNA, 15 bp, Homo sapiens
cttatgttaaatttt

SEQ ID NO: 334885 - DNA, 15 bp, Homo sapiens
ttatgttaaatttta

SEQ ID NO: 334886 - DNA, 15 bp, Homo sapiens
tatgttaaattttaa

SEQ ID NO: 334887 - DNA, 15 bp, Homo sapiens
atgttaaattttaaa

SEQ ID NO: 334888 - DNA, 15 bp, Homo sapiens
tgttaaattttaaaa

SEQ ID NO: 334889 - DNA, 15 bp, Homo sapiens
gttaaattttaaaaa

SEQ ID NO: 334890 - DNA, 15 bp, Homo sapiens
ttaaattttaaaaag

SEQ ID NO: 334891 - DNA, 15 bp, Homo sapiens
taaattttaaaaagg

SEQ ID NO: 334892 - DNA, 15 bp, Homo sapiens
aaattttaaaaaggg

SEQ ID NO: 334893 - DNA, 15 bp, Homo sapiens
aattttaaaaaggga

SEQ ID NO: 334894 - DNA, 15 bp, Homo sapiens
attttaaaaagggac

SEQ ID NO: 334895 - DNA, 15 bp, Homo sapiens
ttttaaaaagggaca

SEQ ID NO: 334896 - DNA, 15 bp, Homo sapiens
tttaaaaagggacat

SEQ ID NO: 334897 - DNA, 15 bp, Homo sapiens
ttaaaaagggacata

SEQ ID NO: 334898 - DNA, 15 bp, Homo sapiens
taaaaagggacataa

SEQ ID NO: 334899 - DNA, 15 bp, Homo sapiens
aaaaagggacataat

SEQ ID NO: 334900 - DNA, 15 bp, Homo sapiens
aaaagggacataatt

SEQ ID NO: 334901 - DNA, 15 bp, Homo sapiens
aaagggacataattt

SEQ ID NO: 334902 - DNA, 15 bp, Homo sapiens
aagggacataatttc

SEQ ID NO: 334903 - DNA, 15 bp, Homo sapiens
agggacataatttca

SEQ ID NO: 334904 - DNA, 15 bp, Homo sapiens
gggacataatttcac

SEQ ID NO: 334905 - DNA, 15 bp, Homo sapiens
ggacataatttcaca

SEQ ID NO: 334906 - DNA, 15 bp, Homo sapiens
gacataatttcacat

SEQ ID NO: 334907 - DNA, 15 bp, Homo sapiens
acataatttcacatc

SEQ ID NO: 334908 - DNA, 15 bp, Homo sapiens
cataatttcacatct

SEQ ID NO: 334909 - DNA, 15 bp, Homo sapiens
ataatttcacatcta

SEQ ID NO: 334910 - DNA, 15 bp, Homo sapiens
taatttcacatctag

SEQ ID NO: 334911 - DNA, 15 bp, Homo sapiens
aatttcacatctaga

SEQ ID NO: 334912 - DNA, 15 bp, Homo sapiens
atttcacatctagaa

SEQ ID NO: 334913 - DNA, 15 bp, Homo sapiens
tttcacatctagaaa

SEQ ID NO: 334914 - DNA, 15 bp, Homo sapiens
ttcacatctagaaaa

SEQ ID NO: 334915 - DNA, 15 bp, Homo sapiens
tcacatctagaaaag

SEQ ID NO: 334916 - DNA, 15 bp, Homo sapiens
cacatctagaaaagt

SEQ ID NO: 334917 - DNA, 15 bp, Homo sapiens
acatctagaaaagtt

SEQ ID NO: 334918 - DNA, 15 bp, Homo sapiens
catctagaaaagttg

SEQ ID NO: 334919 - DNA, 15 bp, Homo sapiens
atctagaaaagttgc

SEQ ID NO: 334920 - DNA, 15 bp, Homo sapiens
tctagaaaagttgca

SEQ ID NO: 334921 - DNA, 15 bp, Homo sapiens
ctagaaaagttgcag

SEQ ID NO: 334922 - DNA, 15 bp, Homo sapiens
tagaaaagttgcagg

SEQ ID NO: 334923 - DNA, 15 bp, Homo sapiens
agaaaagttgcagga

SEQ ID NO: 334924 - DNA, 15 bp, Homo sapiens
gaaaagttgcaggaa

SEQ ID NO: 334925 - DNA, 15 bp, Homo sapiens
aaaagttgcaggaat

SEQ ID NO: 334926 - DNA, 15 bp, Homo sapiens
aaagttgcaggaata

SEQ ID NO: 334927 - DNA, 15 bp, Homo sapiens
aagttgcaggaatag

SEQ ID NO: 334928 - DNA, 15 bp, Homo sapiens
agttgcaggaatagt

SEQ ID NO: 334929 - DNA, 15 bp, Homo sapiens
gttgcaggaatagtt

SEQ ID NO: 334930 - DNA, 15 bp, Homo sapiens
ttgcaggaatagttc

SEQ ID NO: 334931 - DNA, 15 bp, Homo sapiens
tgcaggaatagttca

SEQ ID NO: 334932 - DNA, 15 bp, Homo sapiens
gcaggaatagttcaa

SEQ ID NO: 334933 - DNA, 15 bp, Homo sapiens
caggaatagttcaaa

SEQ ID NO: 334934 - DNA, 15 bp, Homo sapiens
aggaatagttcaaag

SEQ ID NO: 334935 - DNA, 15 bp, Homo sapiens
ggaatagttcaaaga

SEQ ID NO: 334936 - DNA, 15 bp, Homo sapiens
gaatagttcaaagaa

SEQ ID NO: 334937 - DNA, 15 bp, Homo sapiens
aatagttcaaagaat

SEQ ID NO: 334938 - DNA, 15 bp, Homo sapiens
atagttcaaagaatt

SEQ ID NO: 334939 - DNA, 15 bp, Homo sapiens
tagttcaaagaattc

SEQ ID NO: 334940 - DNA, 15 bp, Homo sapiens
agttcaaagaattcc

SEQ ID NO: 334941 - DNA, 15 bp, Homo sapiens
gttcaaagaattccc

SEQ ID NO: 334942 - DNA, 15 bp, Homo sapiens
ttcaaagaattccca

SEQ ID NO: 334943 - DNA, 15 bp, Homo sapiens
tcaaagaattcccaa

SEQ ID NO: 334944 - DNA, 15 bp, Homo sapiens
caaagaattcccaag

SEQ ID NO: 334945 - DNA, 15 bp, Homo sapiens
aaagaattcccaagt

SEQ ID NO: 334946 - DNA, 15 bp, Homo sapiens
aagaattcccaagta

SEQ ID NO: 334947 - DNA, 15 bp, Homo sapiens
agaattcccaagtac

SEQ ID NO: 334948 - DNA, 15 bp, Homo sapiens
gaattcccaagtacc

SEQ ID NO: 334949 - DNA, 15 bp, Homo sapiens
aattcccaagtacct

SEQ ID NO: 334950 - DNA, 15 bp, Homo sapiens
attcccaagtacctt

SEQ ID NO: 334951 - DNA, 15 bp, Homo sapiens
ttcccaagtaccttt

SEQ ID NO: 334952 - DNA, 15 bp, Homo sapiens
tcccaagtacctttc

SEQ ID NO: 334953 - DNA, 15 bp, Homo sapiens
cccaagtacctttca

SEQ ID NO: 334954 - DNA, 15 bp, Homo sapiens
ccaagtacctttcac

SEQ ID NO: 334955 - DNA, 15 bp, Homo sapiens
caagtacctttcact

SEQ ID NO: 334956 - DNA, 15 bp, Homo sapiens
aagtacctttcactc

SEQ ID NO: 334957 - DNA, 15 bp, Homo sapiens
agtacctttcactca

SEQ ID NO: 334958 - DNA, 15 bp, Homo sapiens
gtacctttcactcac

SEQ ID NO: 334959 - DNA, 15 bp, Homo sapiens
tacctttcactcaca

SEQ ID NO: 334960 - DNA, 15 bp, Homo sapiens
acctttcactcacat

SEQ ID NO: 334961 - DNA, 15 bp, Homo sapiens
cctttcactcacatt

SEQ ID NO: 334962 - DNA, 15 bp, Homo sapiens
ctttcactcacattt

SEQ ID NO: 334963 - DNA, 15 bp, Homo sapiens
tttcactcacatttc

SEQ ID NO: 334964 - DNA, 15 bp, Homo sapiens
ttcactcacatttcc

SEQ ID NO: 334965 - DNA, 15 bp, Homo sapiens
tcactcacatttcct

SEQ ID NO: 334966 - DNA, 15 bp, Homo sapiens
cactcacatttccta

SEQ ID NO: 334967 - DNA, 15 bp, Homo sapiens
actcacatttcctaa

SEQ ID NO: 334968 - DNA, 15 bp, Homo sapiens
ctcacatttcctaaa

SEQ ID NO: 334969 - DNA, 15 bp, Homo sapiens
tcacatttcctaaat

SEQ ID NO: 334970 - DNA, 15 bp, Homo sapiens
cacatttcctaaatg

SEQ ID NO: 334971 - DNA, 15 bp, Homo sapiens
acatttcctaaatgt

SEQ ID NO: 334972 - DNA, 15 bp, Homo sapiens
catttcctaaatgtt

SEQ ID NO: 334973 - DNA, 15 bp, Homo sapiens
atttcctaaatgtta

SEQ ID NO: 334974 - DNA, 15 bp, Homo sapiens
tttcctaaatgttac

SEQ ID NO: 334975 - DNA, 15 bp, Homo sapiens
ttcctaaatgttacc

SEQ ID NO: 334976 - DNA, 15 bp, Homo sapiens
tcctaaatgttacca

SEQ ID NO: 334977 - DNA, 15 bp, Homo sapiens
cctaaatgttaccag

SEQ ID NO: 334978 - DNA, 15 bp, Homo sapiens
ctaaatgttaccagt

SEQ ID NO: 334979 - DNA, 15 bp, Homo sapiens
taaatgttaccagtt

SEQ ID NO: 334980 - DNA, 15 bp, Homo sapiens
aaatgttaccagttg

SEQ ID NO: 334981 - DNA, 15 bp, Homo sapiens
aatgttaccagttgt

SEQ ID NO: 334982 - DNA, 15 bp, Homo sapiens
atgttaccagttgtc

SEQ ID NO: 334983 - DNA, 15 bp, Homo sapiens
tgttaccagttgtct

SEQ ID NO: 334984 - DNA, 15 bp, Homo sapiens
gttaccagttgtcta

SEQ ID NO: 334985 - DNA, 15 bp, Homo sapiens
ttaccagttgtctat

SEQ ID NO: 334986 - DNA, 15 bp, Homo sapiens
taccagttgtctata

SEQ ID NO: 334987 - DNA, 15 bp, Homo sapiens
accagttgtctatat

SEQ ID NO: 334988 - DNA, 15 bp, Homo sapiens
ccagttgtctatatt

SEQ ID NO: 334989 - DNA, 15 bp, Homo sapiens
cagttgtctatattt

SEQ ID NO: 334990 - DNA, 15 bp, Homo sapiens
agttgtctatatttc

SEQ ID NO: 334991 - DNA, 15 bp, Homo sapiens
gttgtctatatttca

SEQ ID NO: 334992 - DNA, 15 bp, Homo sapiens
ttgtctatatttcat

SEQ ID NO: 334993 - DNA, 15 bp, Homo sapiens
tgtctatatttcatt

SEQ ID NO: 334994 - DNA, 15 bp, Homo sapiens
gtctatatttcattt

SEQ ID NO: 334995 - DNA, 15 bp, Homo sapiens
tctatatttcatttg

SEQ ID NO: 334996 - DNA, 15 bp, Homo sapiens
ctatatttcatttgt

SEQ ID NO: 334997 - DNA, 15 bp, Homo sapiens
tatatttcatttgta

SEQ ID NO: 334998 - DNA, 15 bp, Homo sapiens
atatttcatttgtac

SEQ ID NO: 334999 - DNA, 15 bp, Homo sapiens
tatttcatttgtact

SEQ ID NO: 335000 - DNA, 15 bp, Homo sapiens
atttcatttgtactc

SEQ ID NO: 335001 - DNA, 15 bp, Homo sapiens
tttcatttgtactct

SEQ ID NO: 335002 - DNA, 15 bp, Homo sapiens
ttcatttgtactctc

SEQ ID NO: 335003 - DNA, 15 bp, Homo sapiens
tcatttgtactctct

SEQ ID NO: 335004 - DNA, 15 bp, Homo sapiens
catttgtactctctc

SEQ ID NO: 335005 - DNA, 15 bp, Homo sapiens
atttgtactctctct

SEQ ID NO: 335006 - DNA, 15 bp, Homo sapiens
tttgtactctctctc

SEQ ID NO: 335007 - DNA, 15 bp, Homo sapiens
ttgtactctctctca

SEQ ID NO: 335008 - DNA, 15 bp, Homo sapiens
tgtactctctctcag

SEQ ID NO: 335009 - DNA, 15 bp, Homo sapiens
gtactctctctcagt

SEQ ID NO: 335010 - DNA, 15 bp, Homo sapiens
tactctctctcagtc

SEQ ID NO: 335011 - DNA, 15 bp, Homo sapiens
actctctctcagtct

SEQ ID NO: 335012 - DNA, 15 bp, Homo sapiens
ctctctctcagtctg

SEQ ID NO: 335013 - DNA, 15 bp, Homo sapiens
tctctctcagtctgc

SEQ ID NO: 335014 - DNA, 15 bp, Homo sapiens
ctctctcagtctgcc

SEQ ID NO: 335015 - DNA, 15 bp, Homo sapiens
tctctcagtctgcct

SEQ ID NO: 335016 - DNA, 15 bp, Homo sapiens
ctctcagtctgccta

SEQ ID NO: 335017 - DNA, 15 bp, Homo sapiens
tctcagtctgcctaa

SEQ ID NO: 335018 - DNA, 15 bp, Homo sapiens
ctcagtctgcctaaa

SEQ ID NO: 335019 - DNA, 15 bp, Homo sapiens
tcagtctgcctaaaa

SEQ ID NO: 335020 - DNA, 15 bp, Homo sapiens
cagtctgcctaaaat

SEQ ID NO: 335021 - DNA, 15 bp, Homo sapiens
agtctgcctaaaata

SEQ ID NO: 335022 - DNA, 15 bp, Homo sapiens
gtctgcctaaaatat

SEQ ID NO: 335023 - DNA, 15 bp, Homo sapiens
tctgcctaaaatatt

SEQ ID NO: 335024 - DNA, 15 bp, Homo sapiens
ctgcctaaaatattt

SEQ ID NO: 335025 - DNA, 15 bp, Homo sapiens
tgcctaaaatattta

SEQ ID NO: 335026 - DNA, 15 bp, Homo sapiens
gcctaaaatatttag

SEQ ID NO: 335027 - DNA, 15 bp, Homo sapiens
cctaaaatatttagt

SEQ ID NO: 335028 - DNA, 15 bp, Homo sapiens
ctaaaatatttagtg

SEQ ID NO: 335029 - DNA, 15 bp, Homo sapiens
taaaatatttagtgt

SEQ ID NO: 335030 - DNA, 15 bp, Homo sapiens
aaaatatttagtgtg

SEQ ID NO: 335031 - DNA, 15 bp, Homo sapiens
aaatatttagtgtgt

SEQ ID NO: 335032 - DNA, 15 bp, Homo sapiens
aatatttagtgtgta

SEQ ID NO: 335033 - DNA, 15 bp, Homo sapiens
atatttagtgtgtat

SEQ ID NO: 335034 - DNA, 15 bp, Homo sapiens
tatttagtgtgtatt

SEQ ID NO: 335035 - DNA, 15 bp, Homo sapiens
atttagtgtgtattt

SEQ ID NO: 335036 - DNA, 15 bp, Homo sapiens
tttagtgtgtatttt

SEQ ID NO: 335037 - DNA, 15 bp, Homo sapiens
ttagtgtgtattttc

SEQ ID NO: 335038 - DNA, 15 bp, Homo sapiens
tagtgtgtattttct

SEQ ID NO: 335039 - DNA, 15 bp, Homo sapiens
agtgtgtattttcta

SEQ ID NO: 335040 - DNA, 15 bp, Homo sapiens
gtgtgtattttctaa

SEQ ID NO: 335041 - DNA, 15 bp, Homo sapiens
tgtgtattttctaac

SEQ ID NO: 335042 - DNA, 15 bp, Homo sapiens
gtgtattttctaacg

SEQ ID NO: 335043 - DNA, 15 bp, Homo sapiens
tgtattttctaacgc

SEQ ID NO: 335044 - DNA, 15 bp, Homo sapiens
gtattttctaacgcc

SEQ ID NO: 335045 - DNA, 15 bp, Homo sapiens
tattttctaacgcca

SEQ ID NO: 335046 - DNA, 15 bp, Homo sapiens
attttctaacgccat

SEQ ID NO: 335047 - DNA, 15 bp, Homo sapiens
ttttctaacgccatg

SEQ ID NO: 335048 - DNA, 15 bp, Homo sapiens
tttctaacgccatgg

SEQ ID NO: 335049 - DNA, 15 bp, Homo sapiens
ttctaacgccatggc

SEQ ID NO: 335050 - DNA, 15 bp, Homo sapiens
tctaacgccatggca

SEQ ID NO: 335051 - DNA, 15 bp, Homo sapiens
ctaacgccatggcat

SEQ ID NO: 335052 - DNA, 15 bp, Homo sapiens
taacgccatggcatt

SEQ ID NO: 335053 - DNA, 15 bp, Homo sapiens
aacgccatggcattc

SEQ ID NO: 335054 - DNA, 15 bp, Homo sapiens
acgccatggcattct

SEQ ID NO: 335055 - DNA, 15 bp, Homo sapiens
cgccatggcattctc

SEQ ID NO: 335056 - DNA, 15 bp, Homo sapiens
gccatggcattctcc

SEQ ID NO: 335057 - DNA, 15 bp, Homo sapiens
ccatggcattctcct

SEQ ID NO: 335058 - DNA, 15 bp, Homo sapiens
catggcattctccta

SEQ ID NO: 335059 - DNA, 15 bp, Homo sapiens
atggcattctcctaa

SEQ ID NO: 335060 - DNA, 15 bp, Homo sapiens
tggcattctcctaaa

SEQ ID NO: 335061 - DNA, 15 bp, Homo sapiens
ggcattctcctaaaa

SEQ ID NO: 335062 - DNA, 15 bp, Homo sapiens
gcattctcctaaaaa

SEQ ID NO: 335063 - DNA, 15 bp, Homo sapiens
cattctcctaaaaac

SEQ ID NO: 335064 - DNA, 15 bp, Homo sapiens
attctcctaaaaaca

SEQ ID NO: 335065 - DNA, 15 bp, Homo sapiens
ttctcctaaaaacaa

SEQ ID NO: 335066 - DNA, 15 bp, Homo sapiens
tctcctaaaaacaag

SEQ ID NO: 335067 - DNA, 15 bp, Homo sapiens
ctcctaaaaacaaga

SEQ ID NO: 335068 - DNA, 15 bp, Homo sapiens
tcctaaaaacaagaa

SEQ ID NO: 335069 - DNA, 15 bp, Homo sapiens
cctaaaaacaagaac

SEQ ID NO: 335070 - DNA, 15 bp, Homo sapiens
ctaaaaacaagaact

SEQ ID NO: 335071 - DNA, 15 bp, Homo sapiens
taaaaacaagaactc

SEQ ID NO: 335072 - DNA, 15 bp, Homo sapiens
aaaaacaagaactct

SEQ ID NO: 335073 - DNA, 15 bp, Homo sapiens
aaaacaagaactctc

SEQ ID NO: 335074 - DNA, 15 bp, Homo sapiens
aaacaagaactctct

SEQ ID NO: 335075 - DNA, 15 bp, Homo sapiens
aacaagaactctctt

SEQ ID NO: 335076 - DNA, 15 bp, Homo sapiens
acaagaactctctta

SEQ ID NO: 335077 - DNA, 15 bp, Homo sapiens
caagaactctcttat

SEQ ID NO: 335078 - DNA, 15 bp, Homo sapiens
aagaactctcttatg

SEQ ID NO: 335079 - DNA, 15 bp, Homo sapiens
agaactctcttatgt

SEQ ID NO: 335080 - DNA, 15 bp, Homo sapiens
gaactctcttatgta

SEQ ID NO: 335081 - DNA, 15 bp, Homo sapiens
aactctcttatgtaa

SEQ ID NO: 335082 - DNA, 15 bp, Homo sapiens
actctcttatgtaaa

SEQ ID NO: 335083 - DNA, 15 bp, Homo sapiens
ctctcttatgtaaac

SEQ ID NO: 335084 - DNA, 15 bp, Homo sapiens
tctcttatgtaaaca

SEQ ID NO: 335085 - DNA, 15 bp, Homo sapiens
ctcttatgtaaacac

SEQ ID NO: 335086 - DNA, 15 bp, Homo sapiens
tcttatgtaaacaca

SEQ ID NO: 335087 - DNA, 15 bp, Homo sapiens
cttatgtaaacacaa

SEQ ID NO: 335088 - DNA, 15 bp, Homo sapiens
ttatgtaaacacaat

SEQ ID NO: 335089 - DNA, 15 bp, Homo sapiens
tatgtaaacacaata

SEQ ID NO: 335090 - DNA, 15 bp, Homo sapiens
atgtaaacacaatag

SEQ ID NO: 335091 - DNA, 15 bp, Homo sapiens
tgtaaacacaatagc

SEQ ID NO: 335092 - DNA, 15 bp, Homo sapiens
gtaaacacaatagca

SEQ ID NO: 335093 - DNA, 15 bp, Homo sapiens
taaacacaatagcat

SEQ ID NO: 335094 - DNA, 15 bp, Homo sapiens
aaacacaatagcata

SEQ ID NO: 335095 - DNA, 15 bp, Homo sapiens
aacacaatagcatat

SEQ ID NO: 335096 - DNA, 15 bp, Homo sapiens
acacaatagcatatt

SEQ ID NO: 335097 - DNA, 15 bp, Homo sapiens
cacaatagcatattg

SEQ ID NO: 335098 - DNA, 15 bp, Homo sapiens
acaatagcatattgg

SEQ ID NO: 335099 - DNA, 15 bp, Homo sapiens
caatagcatattggt

SEQ ID NO: 335100 - DNA, 15 bp, Homo sapiens
aatagcatattggta

SEQ ID NO: 335101 - DNA, 15 bp, Homo sapiens
atagcatattggtat

SEQ ID NO: 335102 - DNA, 15 bp, Homo sapiens
tagcatattggtata

SEQ ID NO: 335103 - DNA, 15 bp, Homo sapiens
agcatattggtataa

SEQ ID NO: 335104 - DNA, 15 bp, Homo sapiens
gcatattggtataat

SEQ ID NO: 335105 - DNA, 15 bp, Homo sapiens
catattggtataata

SEQ ID NO: 335106 - DNA, 15 bp, Homo sapiens
atattggtataataa

SEQ ID NO: 335107 - DNA, 15 bp, Homo sapiens
tattggtataataat

SEQ ID NO: 335108 - DNA, 15 bp, Homo sapiens
attggtataataata

SEQ ID NO: 335109 - DNA, 15 bp, Homo sapiens
ttggtataataatat

SEQ ID NO: 335110 - DNA, 15 bp, Homo sapiens
tggtataataatatg

SEQ ID NO: 335111 - DNA, 15 bp, Homo sapiens
ggtataataatatga

SEQ ID NO: 335112 - DNA, 15 bp, Homo sapiens
gtataataatatgag

SEQ ID NO: 335113 - DNA, 15 bp, Homo sapiens
tataataatatgaga

SEQ ID NO: 335114 - DNA, 15 bp, Homo sapiens
ataataatatgagat

SEQ ID NO: 335115 - DNA, 15 bp, Homo sapiens
taataatatgagatg

SEQ ID NO: 335116 - DNA, 15 bp, Homo sapiens
aataatatgagatgt

SEQ ID NO: 335117 - DNA, 15 bp, Homo sapiens
ataatatgagatgta

SEQ ID NO: 335118 - DNA, 15 bp, Homo sapiens
taatatgagatgtaa

SEQ ID NO: 335119 - DNA, 15 bp, Homo sapiens
aatatgagatgtaaa

SEQ ID NO: 335120 - DNA, 15 bp, Homo sapiens
atatgagatgtaaaa

SEQ ID NO: 335121 - DNA, 15 bp, Homo sapiens
tatgagatgtaaaat

SEQ ID NO: 335122 - DNA, 15 bp, Homo sapiens
atgagatgtaaaata

SEQ ID NO: 335123 - DNA, 15 bp, Homo sapiens
tgagatgtaaaatat

SEQ ID NO: 335124 - DNA, 15 bp, Homo sapiens
gagatgtaaaatatt

SEQ ID NO: 335125 - DNA, 15 bp, Homo sapiens
agatgtaaaatattg

SEQ ID NO: 335126 - DNA, 15 bp, Homo sapiens
gatgtaaaatattga

SEQ ID NO: 335127 - DNA, 15 bp, Homo sapiens
atgtaaaatattgat

SEQ ID NO: 335128 - DNA, 15 bp, Homo sapiens
tgtaaaatattgata

SEQ ID NO: 335129 - DNA, 15 bp, Homo sapiens
gtaaaatattgatat

SEQ ID NO: 335130 - DNA, 15 bp, Homo sapiens
taaaatattgatatt

SEQ ID NO: 335131 - DNA, 15 bp, Homo sapiens
aaaatattgatattt

SEQ ID NO: 335132 - DNA, 15 bp, Homo sapiens
aaatattgatattta

SEQ ID NO: 335133 - DNA, 15 bp, Homo sapiens
aatattgatatttaa

SEQ ID NO: 335134 - DNA, 15 bp, Homo sapiens
atattgatatttaaa

SEQ ID NO: 335135 - DNA, 15 bp, Homo sapiens
tattgatatttaaaa

SEQ ID NO: 335136 - DNA, 15 bp, Homo sapiens
attgatatttaaaat

SEQ ID NO: 335137 - DNA, 15 bp, Homo sapiens
ttgatatttaaaatg

SEQ ID NO: 335138 - DNA, 15 bp, Homo sapiens
tgatatttaaaatgc

SEQ ID NO: 335139 - DNA, 15 bp, Homo sapiens
gatatttaaaatgcc

SEQ ID NO: 335140 - DNA, 15 bp, Homo sapiens
atatttaaaatgcca

SEQ ID NO: 335141 - DNA, 15 bp, Homo sapiens
tatttaaaatgccaa

SEQ ID NO: 335142 - DNA, 15 bp, Homo sapiens
atttaaaatgccaat

SEQ ID NO: 335143 - DNA, 15 bp, Homo sapiens
tttaaaatgccaatt

SEQ ID NO: 335144 - DNA, 15 bp, Homo sapiens
ttaaaatgccaatta

SEQ ID NO: 335145 - DNA, 15 bp, Homo sapiens
taaaatgccaattat

SEQ ID NO: 335146 - DNA, 15 bp, Homo sapiens
aaaatgccaattatt

SEQ ID NO: 335147 - DNA, 15 bp, Homo sapiens
aaatgccaattattg

SEQ ID NO: 335148 - DNA, 15 bp, Homo sapiens
aatgccaattattga

SEQ ID NO: 335149 - DNA, 15 bp, Homo sapiens
atgccaattattgat

SEQ ID NO: 335150 - DNA, 15 bp, Homo sapiens
tgccaattattgatt

SEQ ID NO: 335151 - DNA, 15 bp, Homo sapiens
gccaattattgatta

SEQ ID NO: 335152 - DNA, 15 bp, Homo sapiens
ccaattattgattat

SEQ ID NO: 335153 - DNA, 15 bp, Homo sapiens
caattattgattatt

SEQ ID NO: 335154 - DNA, 15 bp, Homo sapiens
aattattgattatta

SEQ ID NO: 335155 - DNA, 15 bp, Homo sapiens
ttattgattattaaa

SEQ ID NO: 335156 - DNA, 15 bp, Homo sapiens
tattgattattaaat

SEQ ID NO: 335157 - DNA, 15 bp, Homo sapiens
attgattattaaata

SEQ ID NO: 335158 - DNA, 15 bp, Homo sapiens
ttgattattaaatat

SEQ ID NO: 335159 - DNA, 15 bp, Homo sapiens
tgattattaaatatg

SEQ ID NO: 335160 - DNA, 15 bp, Homo sapiens
gattattaaatatga

SEQ ID NO: 335161 - DNA, 15 bp, Homo sapiens
tattaaatatgaaaa

SEQ ID NO: 335162 - DNA, 15 bp, Homo sapiens
attaaatatgaaaac

SEQ ID NO: 335163 - DNA, 15 bp, Homo sapiens
ttaaatatgaaaact

SEQ ID NO: 335164 - DNA, 15 bp, Homo sapiens
taaatatgaaaactt

SEQ ID NO: 335165 - DNA, 15 bp, Homo sapiens
aaatatgaaaactta

SEQ ID NO: 335166 - DNA, 15 bp, Homo sapiens
aatatgaaaacttag

SEQ ID NO: 335167 - DNA, 15 bp, Homo sapiens
atatgaaaacttagt

SEQ ID NO: 335168 - DNA, 15 bp, Homo sapiens
tatgaaaacttagta

SEQ ID NO: 335169 - DNA, 15 bp, Homo sapiens
atgaaaacttagtat

SEQ ID NO: 335170 - DNA, 15 bp, Homo sapiens
tgaaaacttagtata

SEQ ID NO: 335171 - DNA, 15 bp, Homo sapiens
gaaaacttagtatat

SEQ ID NO: 335172 - DNA, 15 bp, Homo sapiens
aaaacttagtatata

SEQ ID NO: 335173 - DNA, 15 bp, Homo sapiens
aaacttagtatataa

SEQ ID NO: 335174 - DNA, 15 bp, Homo sapiens
aacttagtatataat

SEQ ID NO: 335175 - DNA, 15 bp, Homo sapiens
acttagtatataatt

SEQ ID NO: 335176 - DNA, 15 bp, Homo sapiens
cttagtatataatta

SEQ ID NO: 335177 - DNA, 15 bp, Homo sapiens
ttagtatataattat

SEQ ID NO: 335178 - DNA, 15 bp, Homo sapiens
tagtatataattatt

SEQ ID NO: 335179 - DNA, 15 bp, Homo sapiens
agtatataattatta

SEQ ID NO: 335180 - DNA, 15 bp, Homo sapiens
gtatataattattaa

SEQ ID NO: 335181 - DNA, 15 bp, Homo sapiens
tatataattattaaa

SEQ ID NO: 335182 - DNA, 15 bp, Homo sapiens
atataattattaaaa

SEQ ID NO: 335183 - DNA, 15 bp, Homo sapiens
tataattattaaaat

SEQ ID NO: 335184 - DNA, 15 bp, Homo sapiens
ataattattaaaatc

SEQ ID NO: 335185 - DNA, 15 bp, Homo sapiens
taattattaaaatca

SEQ ID NO: 335186 - DNA, 15 bp, Homo sapiens
aattattaaaatcaa

SEQ ID NO: 335187 - DNA, 15 bp, Homo sapiens
attattaaaatcaag

SEQ ID NO: 335188 - DNA, 15 bp, Homo sapiens
ttattaaaatcaaga

SEQ ID NO: 335189 - DNA, 15 bp, Homo sapiens
tattaaaatcaagaa

SEQ ID NO: 335190 - DNA, 15 bp, Homo sapiens
attaaaatcaagaaa

SEQ ID NO: 335191 - DNA, 15 bp, Homo sapiens
ttaaaatcaagaaaa

SEQ ID NO: 335192 - DNA, 15 bp, Homo sapiens
taaaatcaagaaaat

SEQ ID NO: 335193 - DNA, 15 bp, Homo sapiens
aaaatcaagaaaata

SEQ ID NO: 335194 - DNA, 15 bp, Homo sapiens
aaatcaagaaaataa

SEQ ID NO: 335195 - DNA, 15 bp, Homo sapiens
aatcaagaaaataac

SEQ ID NO: 335196 - DNA, 15 bp, Homo sapiens
atcaagaaaataaca

SEQ ID NO: 335197 - DNA, 15 bp, Homo sapiens
tcaagaaaataacat

SEQ ID NO: 335198 - DNA, 15 bp, Homo sapiens
caagaaaataacatt

SEQ ID NO: 335199 - DNA, 15 bp, Homo sapiens
aagaaaataacattg

SEQ ID NO: 335200 - DNA, 15 bp, Homo sapiens
agaaaataacattga

SEQ ID NO: 335201 - DNA, 15 bp, Homo sapiens
gaaaataacattgaa

SEQ ID NO: 335202 - DNA, 15 bp, Homo sapiens
aaaataacattgaaa

SEQ ID NO: 335203 - DNA, 15 bp, Homo sapiens
aaataacattgaaat

SEQ ID NO: 335204 - DNA, 15 bp, Homo sapiens
aataacattgaaata

SEQ ID NO: 335205 - DNA, 15 bp, Homo sapiens
ataacattgaaataa

SEQ ID NO: 335206 - DNA, 15 bp, Homo sapiens
taacattgaaataat

SEQ ID NO: 335207 - DNA, 15 bp, Homo sapiens
aacattgaaataata

SEQ ID NO: 335208 - DNA, 15 bp, Homo sapiens
acattgaaataatac

SEQ ID NO: 335209 - DNA, 15 bp, Homo sapiens
cattgaaataataca

SEQ ID NO: 335210 - DNA, 15 bp, Homo sapiens
attgaaataatacaa

SEQ ID NO: 335211 - DNA, 15 bp, Homo sapiens
ttgaaataatacaat

SEQ ID NO: 335212 - DNA, 15 bp, Homo sapiens
tgaaataatacaatt

SEQ ID NO: 335213 - DNA, 15 bp, Homo sapiens
gaaataatacaatta

SEQ ID NO: 335214 - DNA, 15 bp, Homo sapiens
aaataatacaattat

SEQ ID NO: 335215 - DNA, 15 bp, Homo sapiens
aataatacaattatg

SEQ ID NO: 335216 - DNA, 15 bp, Homo sapiens
ataatacaattatgt

SEQ ID NO: 335217 - DNA, 15 bp, Homo sapiens
taatacaattatgta

SEQ ID NO: 335218 - DNA, 15 bp, Homo sapiens
aatacaattatgtaa

SEQ ID NO: 335219 - DNA, 15 bp, Homo sapiens
atacaattatgtaat

SEQ ID NO: 335220 - DNA, 15 bp, Homo sapiens
tacaattatgtaatc

SEQ ID NO: 335221 - DNA, 15 bp, Homo sapiens
acaattatgtaatct

SEQ ID NO: 335222 - DNA, 15 bp, Homo sapiens
caattatgtaatcta

SEQ ID NO: 335223 - DNA, 15 bp, Homo sapiens
aattatgtaatctac

SEQ ID NO: 335224 - DNA, 15 bp, Homo sapiens
attatgtaatctaca

SEQ ID NO: 335225 - DNA, 15 bp, Homo sapiens
ttatgtaatctacag

SEQ ID NO: 335226 - DNA, 15 bp, Homo sapiens
tatgtaatctacaga

SEQ ID NO: 335227 - DNA, 15 bp, Homo sapiens
atgtaatctacagat

SEQ ID NO: 335228 - DNA, 15 bp, Homo sapiens
tgtaatctacagatc

SEQ ID NO: 335229 - DNA, 15 bp, Homo sapiens
gtaatctacagatct

SEQ ID NO: 335230 - DNA, 15 bp, Homo sapiens
taatctacagatctt

SEQ ID NO: 335231 - DNA, 15 bp, Homo sapiens
aatctacagatctta

SEQ ID NO: 335232 - DNA, 15 bp, Homo sapiens
atctacagatcttaa

SEQ ID NO: 335233 - DNA, 15 bp, Homo sapiens
tctacagatcttaag

SEQ ID NO: 335234 - DNA, 15 bp, Homo sapiens
ctacagatcttaaga

SEQ ID NO: 335235 - DNA, 15 bp, Homo sapiens
tacagatcttaagat

SEQ ID NO: 335236 - DNA, 15 bp, Homo sapiens
acagatcttaagatt

SEQ ID NO: 335237 - DNA, 15 bp, Homo sapiens
cagatcttaagattt

SEQ ID NO: 335238 - DNA, 15 bp, Homo sapiens
agatcttaagatttt

SEQ ID NO: 335239 - DNA, 15 bp, Homo sapiens
gatcttaagattttg

SEQ ID NO: 335240 - DNA, 15 bp, Homo sapiens
atcttaagattttgt

SEQ ID NO: 335241 - DNA, 15 bp, Homo sapiens
tcttaagattttgtc

SEQ ID NO: 335242 - DNA, 15 bp, Homo sapiens
cttaagattttgtca

SEQ ID NO: 335243 - DNA, 15 bp, Homo sapiens
ttaagattttgtcag

SEQ ID NO: 335244 - DNA, 15 bp, Homo sapiens
taagattttgtcagt

SEQ ID NO: 335245 - DNA, 15 bp, Homo sapiens
aagattttgtcagtt

SEQ ID NO: 335246 - DNA, 15 bp, Homo sapiens
agattttgtcagttg

SEQ ID NO: 335247 - DNA, 15 bp, Homo sapiens
gattttgtcagttgt

SEQ ID NO: 335248 - DNA, 15 bp, Homo sapiens
attttgtcagttgtc

SEQ ID NO: 335249 - DNA, 15 bp, Homo sapiens
ttttgtcagttgtcc

SEQ ID NO: 335250 - DNA, 15 bp, Homo sapiens
tttgtcagttgtccc

SEQ ID NO: 335251 - DNA, 15 bp, Homo sapiens
ttgtcagttgtccca

SEQ ID NO: 335252 - DNA, 15 bp, Homo sapiens
tgtcagttgtcccaa

SEQ ID NO: 335253 - DNA, 15 bp, Homo sapiens
gtcagttgtcccaat

SEQ ID NO: 335254 - DNA, 15 bp, Homo sapiens
tcagttgtcccaata

SEQ ID NO: 335255 - DNA, 15 bp, Homo sapiens
cagttgtcccaataa

SEQ ID NO: 335256 - DNA, 15 bp, Homo sapiens
agttgtcccaataat

SEQ ID NO: 335257 - DNA, 15 bp, Homo sapiens
gttgtcccaataata

SEQ ID NO: 335258 - DNA, 15 bp, Homo sapiens
ttgtcccaataatat

SEQ ID NO: 335259 - DNA, 15 bp, Homo sapiens
tgtcccaataatatc

SEQ ID NO: 335260 - DNA, 15 bp, Homo sapiens
gtcccaataatatcc

SEQ ID NO: 335261 - DNA, 15 bp, Homo sapiens
tcccaataatatcct

SEQ ID NO: 335262 - DNA, 15 bp, Homo sapiens
cccaataatatcctt

SEQ ID NO: 335263 - DNA, 15 bp, Homo sapiens
ccaataatatcctta

SEQ ID NO: 335264 - DNA, 15 bp, Homo sapiens
caataatatccttag

SEQ ID NO: 335265 - DNA, 15 bp, Homo sapiens
aataatatccttagt

SEQ ID NO: 335266 - DNA, 15 bp, Homo sapiens
ataatatccttagta

SEQ ID NO: 335267 - DNA, 15 bp, Homo sapiens
taatatccttagtag

SEQ ID NO: 335268 - DNA, 15 bp, Homo sapiens
aatatccttagtagc

SEQ ID NO: 335269 - DNA, 15 bp, Homo sapiens
atatccttagtagca

SEQ ID NO: 335270 - DNA, 15 bp, Homo sapiens
tatccttagtagcaa

SEQ ID NO: 335271 - DNA, 15 bp, Homo sapiens
atccttagtagcaaa

SEQ ID NO: 335272 - DNA, 15 bp, Homo sapiens
tccttagtagcaaaa

SEQ ID NO: 335273 - DNA, 15 bp, Homo sapiens
ccttagtagcaaaag

SEQ ID NO: 335274 - DNA, 15 bp, Homo sapiens
cttagtagcaaaaga

SEQ ID NO: 335275 - DNA, 15 bp, Homo sapiens
ttagtagcaaaagaa

SEQ ID NO: 335276 - DNA, 15 bp, Homo sapiens
tagtagcaaaagaaa

SEQ ID NO: 335277 - DNA, 15 bp, Homo sapiens
agtagcaaaagaaaa

SEQ ID NO: 335278 - DNA, 15 bp, Homo sapiens
gtagcaaaagaaaat

SEQ ID NO: 335279 - DNA, 15 bp, Homo sapiens
tagcaaaagaaaatc

SEQ ID NO: 335280 - DNA, 15 bp, Homo sapiens
agcaaaagaaaatct

SEQ ID NO: 335281 - DNA, 15 bp, Homo sapiens
gcaaaagaaaatctg

SEQ ID NO: 335282 - DNA, 15 bp, Homo sapiens
caaaagaaaatctga

SEQ ID NO: 335283 - DNA, 15 bp, Homo sapiens
aaaagaaaatctgag

SEQ ID NO: 335284 - DNA, 15 bp, Homo sapiens
aaagaaaatctgaga

SEQ ID NO: 335285 - DNA, 15 bp, Homo sapiens
aagaaaatctgagat

SEQ ID NO: 335286 - DNA, 15 bp, Homo sapiens
agaaaatctgagatc

SEQ ID NO: 335287 - DNA, 15 bp, Homo sapiens
gaaaatctgagatca

SEQ ID NO: 335288 - DNA, 15 bp, Homo sapiens
aaaatctgagatcat

SEQ ID NO: 335289 - DNA, 15 bp, Homo sapiens
aaatctgagatcatg

SEQ ID NO: 335290 - DNA, 15 bp, Homo sapiens
aatctgagatcatgc

SEQ ID NO: 335291 - DNA, 15 bp, Homo sapiens
atctgagatcatgca

SEQ ID NO: 335292 - DNA, 15 bp, Homo sapiens
tctgagatcatgcat

SEQ ID NO: 335293 - DNA, 15 bp, Homo sapiens
ctgagatcatgcatt

SEQ ID NO: 335294 - DNA, 15 bp, Homo sapiens
tgagatcatgcatta

SEQ ID NO: 335295 - DNA, 15 bp, Homo sapiens
gagatcatgcattac

SEQ ID NO: 335296 - DNA, 15 bp, Homo sapiens
agatcatgcattaca

SEQ ID NO: 335297 - DNA, 15 bp, Homo sapiens
gatcatgcattacat

SEQ ID NO: 335298 - DNA, 15 bp, Homo sapiens
atcatgcattacatt

SEQ ID NO: 335299 - DNA, 15 bp, Homo sapiens
tcatgcattacattt

SEQ ID NO: 335300 - DNA, 15 bp, Homo sapiens
catgcattacattta

SEQ ID NO: 335301 - DNA, 15 bp, Homo sapiens
atgcattacatttat

SEQ ID NO: 335302 - DNA, 15 bp, Homo sapiens
tgcattacatttatt

SEQ ID NO: 335303 - DNA, 15 bp, Homo sapiens
gcattacatttattt

SEQ ID NO: 335304 - DNA, 15 bp, Homo sapiens
cattacatttatttt

SEQ ID NO: 335305 - DNA, 15 bp, Homo sapiens
attacatttattttt

SEQ ID NO: 335306 - DNA, 15 bp, Homo sapiens
ttacatttatttttc

SEQ ID NO: 335307 - DNA, 15 bp, Homo sapiens
tacatttatttttca

SEQ ID NO: 335308 - DNA, 15 bp, Homo sapiens
acatttatttttcat

SEQ ID NO: 335309 - DNA, 15 bp, Homo sapiens
catttatttttcatg

SEQ ID NO: 335310 - DNA, 15 bp, Homo sapiens
atttatttttcatgt

SEQ ID NO: 335311 - DNA, 15 bp, Homo sapiens
tttatttttcatgtc

SEQ ID NO: 335312 - DNA, 15 bp, Homo sapiens
ttatttttcatgtct

SEQ ID NO: 335313 - DNA, 15 bp, Homo sapiens
tatttttcatgtctc

SEQ ID NO: 335314 - DNA, 15 bp, Homo sapiens
atttttcatgtctct

SEQ ID NO: 335315 - DNA, 15 bp, Homo sapiens
tttttcatgtctctt

SEQ ID NO: 335316 - DNA, 15 bp, Homo sapiens
ttttcatgtctcttt

SEQ ID NO: 335317 - DNA, 15 bp, Homo sapiens
tttcatgtctcttta

SEQ ID NO: 335318 - DNA, 15 bp, Homo sapiens
ttcatgtctctttag

SEQ ID NO: 335319 - DNA, 15 bp, Homo sapiens
tcatgtctctttagt

SEQ ID NO: 335320 - DNA, 15 bp, Homo sapiens
catgtctctttagtc

SEQ ID NO: 335321 - DNA, 15 bp, Homo sapiens
atgtctctttagtcc

SEQ ID NO: 335322 - DNA, 15 bp, Homo sapiens
tgtctctttagtcct

SEQ ID NO: 335323 - DNA, 15 bp, Homo sapiens
gtctctttagtcctc

SEQ ID NO: 335324 - DNA, 15 bp, Homo sapiens
tctctttagtcctct

SEQ ID NO: 335325 - DNA, 15 bp, Homo sapiens
ctctttagtcctctt

SEQ ID NO: 335326 - DNA, 15 bp, Homo sapiens
tctttagtcctcttt

SEQ ID NO: 335327 - DNA, 15 bp, Homo sapiens
ctttagtcctcttta

SEQ ID NO: 335328 - DNA, 15 bp, Homo sapiens
tttagtcctctttaa

SEQ ID NO: 335329 - DNA, 15 bp, Homo sapiens
ttagtcctctttaat

SEQ ID NO: 335330 - DNA, 15 bp, Homo sapiens
tagtcctctttaatc

SEQ ID NO: 335331 - DNA, 15 bp, Homo sapiens
agtcctctttaatct

SEQ ID NO: 335332 - DNA, 15 bp, Homo sapiens
gtcctctttaatctg

SEQ ID NO: 335333 - DNA, 15 bp, Homo sapiens
tcctctttaatctgg

SEQ ID NO: 335334 - DNA, 15 bp, Homo sapiens
cctctttaatctgga

SEQ ID NO: 335335 - DNA, 15 bp, Homo sapiens
ctctttaatctggaa

SEQ ID NO: 335336 - DNA, 15 bp, Homo sapiens
tctttaatctggaag

SEQ ID NO: 335337 - DNA, 15 bp, Homo sapiens
ctttaatctggaagt

SEQ ID NO: 335338 - DNA, 15 bp, Homo sapiens
tttaatctggaagtt

SEQ ID NO: 335339 - DNA, 15 bp, Homo sapiens
ttaatctggaagttt

SEQ ID NO: 335340 - DNA, 15 bp, Homo sapiens
taatctggaagtttt

SEQ ID NO: 335341 - DNA, 15 bp, Homo sapiens
aatctggaagttttt

SEQ ID NO: 335342 - DNA, 15 bp, Homo sapiens
atctggaagtttttg

SEQ ID NO: 335343 - DNA, 15 bp, Homo sapiens
tctggaagtttttga

SEQ ID NO: 335344 - DNA, 15 bp, Homo sapiens
ctggaagtttttgag

SEQ ID NO: 335345 - DNA, 15 bp, Homo sapiens
tggaagtttttgagt

SEQ ID NO: 335346 - DNA, 15 bp, Homo sapiens
ggaagtttttgagtc

SEQ ID NO: 335347 - DNA, 15 bp, Homo sapiens
gaagtttttgagtct

SEQ ID NO: 335348 - DNA, 15 bp, Homo sapiens
aagtttttgagtctt

SEQ ID NO: 335349 - DNA, 15 bp, Homo sapiens
agtttttgagtcttt

SEQ ID NO: 335350 - DNA, 15 bp, Homo sapiens
gtttttgagtctttg

SEQ ID NO: 335351 - DNA, 15 bp, Homo sapiens
tttttgagtctttgt

SEQ ID NO: 335352 - DNA, 15 bp, Homo sapiens
ttttgagtctttgta

SEQ ID NO: 335353 - DNA, 15 bp, Homo sapiens
tttgagtctttgtat

SEQ ID NO: 335354 - DNA, 15 bp, Homo sapiens
ttgagtctttgtatt

SEQ ID NO: 335355 - DNA, 15 bp, Homo sapiens
tgagtctttgtattt

SEQ ID NO: 335356 - DNA, 15 bp, Homo sapiens
gagtctttgtatttc

SEQ ID NO: 335357 - DNA, 15 bp, Homo sapiens
agtctttgtatttca

SEQ ID NO: 335358 - DNA, 15 bp, Homo sapiens
gtctttgtatttcat

SEQ ID NO: 335359 - DNA, 15 bp, Homo sapiens
tctttgtatttcatg

SEQ ID NO: 335360 - DNA, 15 bp, Homo sapiens
ctttgtatttcatga

SEQ ID NO: 335361 - DNA, 15 bp, Homo sapiens
tttgtatttcatgat

SEQ ID NO: 335362 - DNA, 15 bp, Homo sapiens
ttgtatttcatgata

SEQ ID NO: 335363 - DNA, 15 bp, Homo sapiens
tgtatttcatgatat

SEQ ID NO: 335364 - DNA, 15 bp, Homo sapiens
gtatttcatgatatt

SEQ ID NO: 335365 - DNA, 15 bp, Homo sapiens
tatttcatgatattg

SEQ ID NO: 335366 - DNA, 15 bp, Homo sapiens
atttcatgatattga

SEQ ID NO: 335367 - DNA, 15 bp, Homo sapiens
tttcatgatattgat

SEQ ID NO: 335368 - DNA, 15 bp, Homo sapiens
ttcatgatattgata

SEQ ID NO: 335369 - DNA, 15 bp, Homo sapiens
tcatgatattgatat

SEQ ID NO: 335370 - DNA, 15 bp, Homo sapiens
catgatattgatatt

SEQ ID NO: 335371 - DNA, 15 bp, Homo sapiens
atgatattgatattt

SEQ ID NO: 335372 - DNA, 15 bp, Homo sapiens
tgatattgatatttt

SEQ ID NO: 335373 - DNA, 15 bp, Homo sapiens
gatattgatattttt

SEQ ID NO: 335374 - DNA, 15 bp, Homo sapiens
atattgatatttttg

SEQ ID NO: 335375 - DNA, 15 bp, Homo sapiens
tattgatatttttga

SEQ ID NO: 335376 - DNA, 15 bp, Homo sapiens
attgatatttttgaa

SEQ ID NO: 335377 - DNA, 15 bp, Homo sapiens
ttgatatttttgaag

SEQ ID NO: 335378 - DNA, 15 bp, Homo sapiens
tgatatttttgaaga

SEQ ID NO: 335379 - DNA, 15 bp, Homo sapiens
gatatttttgaagag

SEQ ID NO: 335380 - DNA, 15 bp, Homo sapiens
atatttttgaagagt

SEQ ID NO: 335381 - DNA, 15 bp, Homo sapiens
tatttttgaagagtg

SEQ ID NO: 335382 - DNA, 15 bp, Homo sapiens
atttttgaagagtgc

SEQ ID NO: 335383 - DNA, 15 bp, Homo sapiens
tttttgaagagtgct

SEQ ID NO: 335384 - DNA, 15 bp, Homo sapiens
ttttgaagagtgctg

SEQ ID NO: 335385 - DNA, 15 bp, Homo sapiens
tttgaagagtgctgg

SEQ ID NO: 335386 - DNA, 15 bp, Homo sapiens
ttgaagagtgctggc

SEQ ID NO: 335387 - DNA, 15 bp, Homo sapiens
tgaagagtgctggct

SEQ ID NO: 335388 - DNA, 15 bp, Homo sapiens
gaagagtgctggcta

SEQ ID NO: 335389 - DNA, 15 bp, Homo sapiens
aagagtgctggctag

SEQ ID NO: 335390 - DNA, 15 bp, Homo sapiens
agagtgctggctagt

SEQ ID NO: 335391 - DNA, 15 bp, Homo sapiens
gagtgctggctagtt

SEQ ID NO: 335392 - DNA, 15 bp, Homo sapiens
agtgctggctagtta

SEQ ID NO: 335393 - DNA, 15 bp, Homo sapiens
gtgctggctagttat

SEQ ID NO: 335394 - DNA, 15 bp, Homo sapiens
tgctggctagttatt

SEQ ID NO: 335395 - DNA, 15 bp, Homo sapiens
gctggctagttattt

SEQ ID NO: 335396 - DNA, 15 bp, Homo sapiens
ctggctagttatttt

SEQ ID NO: 335397 - DNA, 15 bp, Homo sapiens
tggctagttattttg

SEQ ID NO: 335398 - DNA, 15 bp, Homo sapiens
ggctagttattttgt

SEQ ID NO: 335399 - DNA, 15 bp, Homo sapiens
gctagttattttgta

SEQ ID NO: 335400 - DNA, 15 bp, Homo sapiens
ctagttattttgtag

SEQ ID NO: 335401 - DNA, 15 bp, Homo sapiens
tagttattttgtaga

SEQ ID NO: 335402 - DNA, 15 bp, Homo sapiens
agttattttgtagaa

SEQ ID NO: 335403 - DNA, 15 bp, Homo sapiens
gttattttgtagaat

SEQ ID NO: 335404 - DNA, 15 bp, Homo sapiens
ttattttgtagaatg

SEQ ID NO: 335405 - DNA, 15 bp, Homo sapiens
tattttgtagaatgt

SEQ ID NO: 335406 - DNA, 15 bp, Homo sapiens
attttgtagaatgtc

SEQ ID NO: 335407 - DNA, 15 bp, Homo sapiens
ttttgtagaatgtct

SEQ ID NO: 335408 - DNA, 15 bp, Homo sapiens
tttgtagaatgtctc

SEQ ID NO: 335409 - DNA, 15 bp, Homo sapiens
ttgtagaatgtctct

SEQ ID NO: 335410 - DNA, 15 bp, Homo sapiens
tgtagaatgtctctc

SEQ ID NO: 335411 - DNA, 15 bp, Homo sapiens
gtagaatgtctctct

SEQ ID NO: 335412 - DNA, 15 bp, Homo sapiens
tagaatgtctctctc

SEQ ID NO: 335413 - DNA, 15 bp, Homo sapiens
agaatgtctctctca

SEQ ID NO: 335414 - DNA, 15 bp, Homo sapiens
gaatgtctctctcag

SEQ ID NO: 335415 - DNA, 15 bp, Homo sapiens
aatgtctctctcagt

SEQ ID NO: 335416 - DNA, 15 bp, Homo sapiens
atgtctctctcagtg

SEQ ID NO: 335417 - DNA, 15 bp, Homo sapiens
tgtctctctcagtgg

SEQ ID NO: 335418 - DNA, 15 bp, Homo sapiens
gtctctctcagtggg

SEQ ID NO: 335419 - DNA, 15 bp, Homo sapiens
tctctctcagtgggc

SEQ ID NO: 335420 - DNA, 15 bp, Homo sapiens
ctctctcagtgggct

SEQ ID NO: 335421 - DNA, 15 bp, Homo sapiens
tctctcagtgggctt

SEQ ID NO: 335422 - DNA, 15 bp, Homo sapiens
ctctcagtgggcttg

SEQ ID NO: 335423 - DNA, 15 bp, Homo sapiens
tctcagtgggcttgg

SEQ ID NO: 335424 - DNA, 15 bp, Homo sapiens
ctcagtgggcttggg

SEQ ID NO: 335425 - DNA, 15 bp, Homo sapiens
tcagtgggcttgggc

SEQ ID NO: 335426 - DNA, 15 bp, Homo sapiens
cagtgggcttgggct

SEQ ID NO: 335427 - DNA, 15 bp, Homo sapiens
agtgggcttgggctt

SEQ ID NO: 335428 - DNA, 15 bp, Homo sapiens
gtgggcttgggcttg

SEQ ID NO: 335429 - DNA, 15 bp, Homo sapiens
tgggcttgggcttgg

SEQ ID NO: 335430 - DNA, 15 bp, Homo sapiens
gggcttgggcttggc

SEQ ID NO: 335431 - DNA, 15 bp, Homo sapiens
ggcttgggcttggct

SEQ ID NO: 335432 - DNA, 15 bp, Homo sapiens
gcttgggcttggctg

SEQ ID NO: 335433 - DNA, 15 bp, Homo sapiens
cttgggcttggctga

SEQ ID NO: 335434 - DNA, 15 bp, Homo sapiens
ttgggcttggctgag

SEQ ID NO: 335435 - DNA, 15 bp, Homo sapiens
tgggcttggctgagc

SEQ ID NO: 335436 - DNA, 15 bp, Homo sapiens
gggcttggctgagct

SEQ ID NO: 335437 - DNA, 15 bp, Homo sapiens
ggcttggctgagctt

SEQ ID NO: 335438 - DNA, 15 bp, Homo sapiens
gcttggctgagcttt

SEQ ID NO: 335439 - DNA, 15 bp, Homo sapiens
cttggctgagctttc

SEQ ID NO: 335440 - DNA, 15 bp, Homo sapiens
ttggctgagctttcc

SEQ ID NO: 335441 - DNA, 15 bp, Homo sapiens
tggctgagctttcct

SEQ ID NO: 335442 - DNA, 15 bp, Homo sapiens
ggctgagctttcctt

SEQ ID NO: 335443 - DNA, 15 bp, Homo sapiens
gctgagctttcctta

SEQ ID NO: 335444 - DNA, 15 bp, Homo sapiens
ctgagctttccttat

SEQ ID NO: 335445 - DNA, 15 bp, Homo sapiens
tgagctttccttatg

SEQ ID NO: 335446 - DNA, 15 bp, Homo sapiens
gagctttccttatga

SEQ ID NO: 335447 - DNA, 15 bp, Homo sapiens
agctttccttatgat

SEQ ID NO: 335448 - DNA, 15 bp, Homo sapiens
gctttccttatgatt

SEQ ID NO: 335449 - DNA, 15 bp, Homo sapiens
ctttccttatgatta

SEQ ID NO: 335450 - DNA, 15 bp, Homo sapiens
tttccttatgattaa

SEQ ID NO: 335451 - DNA, 15 bp, Homo sapiens
ttccttatgattaag

SEQ ID NO: 335452 - DNA, 15 bp, Homo sapiens
tccttatgattaagt

SEQ ID NO: 335453 - DNA, 15 bp, Homo sapiens
ccttatgattaagtt

SEQ ID NO: 335454 - DNA, 15 bp, Homo sapiens
cttatgattaagttc

SEQ ID NO: 335455 - DNA, 15 bp, Homo sapiens
ttatgattaagttca

SEQ ID NO: 335456 - DNA, 15 bp, Homo sapiens
tatgattaagttcag

SEQ ID NO: 335457 - DNA, 15 bp, Homo sapiens
atgattaagttcagg

SEQ ID NO: 335458 - DNA, 15 bp, Homo sapiens
tgattaagttcaggt

SEQ ID NO: 335459 - DNA, 15 bp, Homo sapiens
gattaagttcaggtt

SEQ ID NO: 335460 - DNA, 15 bp, Homo sapiens
attaagttcaggttg

SEQ ID NO: 335461 - DNA, 15 bp, Homo sapiens
ttaagttcaggttgt

SEQ ID NO: 335462 - DNA, 15 bp, Homo sapiens
taagttcaggttgtt

SEQ ID NO: 335463 - DNA, 15 bp, Homo sapiens
aagttcaggttgttc

SEQ ID NO: 335464 - DNA, 15 bp, Homo sapiens
agttcaggttgttca

SEQ ID NO: 335465 - DNA, 15 bp, Homo sapiens
gttcaggttgttcac

SEQ ID NO: 335466 - DNA, 15 bp, Homo sapiens
ttcaggttgttcact

SEQ ID NO: 335467 - DNA, 15 bp, Homo sapiens
tcaggttgttcactt

SEQ ID NO: 335468 - DNA, 15 bp, Homo sapiens
caggttgttcacttt

SEQ ID NO: 335469 - DNA, 15 bp, Homo sapiens
aggttgttcactttt

SEQ ID NO: 335470 - DNA, 15 bp, Homo sapiens
ggttgttcacttttg

SEQ ID NO: 335471 - DNA, 15 bp, Homo sapiens
gttgttcacttttgg

SEQ ID NO: 335472 - DNA, 15 bp, Homo sapiens
ttgttcacttttggc

SEQ ID NO: 335473 - DNA, 15 bp, Homo sapiens
tgttcacttttggca

SEQ ID NO: 335474 - DNA, 15 bp, Homo sapiens
gttcacttttggcag

SEQ ID NO: 335475 - DNA, 15 bp, Homo sapiens
ttcacttttggcagg

SEQ ID NO: 335476 - DNA, 15 bp, Homo sapiens
tcacttttggcaggg

SEQ ID NO: 335477 - DNA, 15 bp, Homo sapiens
cacttttggcaggga

SEQ ID NO: 335478 - DNA, 15 bp, Homo sapiens
acttttggcagggac

SEQ ID NO: 335479 - DNA, 15 bp, Homo sapiens
cttttggcagggacg

SEQ ID NO: 335480 - DNA, 15 bp, Homo sapiens
ttttggcagggacgt

SEQ ID NO: 335481 - DNA, 15 bp, Homo sapiens
tttggcagggacgtc

SEQ ID NO: 335482 - DNA, 15 bp, Homo sapiens
ttggcagggacgtca

SEQ ID NO: 335483 - DNA, 15 bp, Homo sapiens
tggcagggacgtcac

SEQ ID NO: 335484 - DNA, 15 bp, Homo sapiens
ggcagggacgtcaca

SEQ ID NO: 335485 - DNA, 15 bp, Homo sapiens
gcagggacgtcacaa

SEQ ID NO: 335486 - DNA, 15 bp, Homo sapiens
cagggacgtcacaaa

SEQ ID NO: 335487 - DNA, 15 bp, Homo sapiens
agggacgtcacaaaa

SEQ ID NO: 335488 - DNA, 15 bp, Homo sapiens
gggacgtcacaaaag

SEQ ID NO: 335489 - DNA, 15 bp, Homo sapiens
ggacgtcacaaaagt

SEQ ID NO: 335490 - DNA, 15 bp, Homo sapiens
gacgtcacaaaagtg

SEQ ID NO: 335491 - DNA, 15 bp, Homo sapiens
acgtcacaaaagtga

SEQ ID NO: 335492 - DNA, 15 bp, Homo sapiens
cgtcacaaaagtgac

SEQ ID NO: 335493 - DNA, 15 bp, Homo sapiens
gtcacaaaagtgacg

SEQ ID NO: 335494 - DNA, 15 bp, Homo sapiens
tcacaaaagtgacgt

SEQ ID NO: 335495 - DNA, 15 bp, Homo sapiens
cacaaaagtgacgtg

SEQ ID NO: 335496 - DNA, 15 bp, Homo sapiens
acaaaagtgacgtga

SEQ ID NO: 335497 - DNA, 15 bp, Homo sapiens
caaaagtgacgtgag

SEQ ID NO: 335498 - DNA, 15 bp, Homo sapiens
aaaagtgacgtgagt

SEQ ID NO: 335499 - DNA, 15 bp, Homo sapiens
aaagtgacgtgagtt

SEQ ID NO: 335500 - DNA, 15 bp, Homo sapiens
aagtgacgtgagttc

SEQ ID NO: 335501 - DNA, 15 bp, Homo sapiens
agtgacgtgagttct

SEQ ID NO: 335502 - DNA, 15 bp, Homo sapiens
gtgacgtgagttctt

SEQ ID NO: 335503 - DNA, 15 bp, Homo sapiens
tgacgtgagttcttc

SEQ ID NO: 335504 - DNA, 15 bp, Homo sapiens
gacgtgagttcttct

SEQ ID NO: 335505 - DNA, 15 bp, Homo sapiens
acgtgagttcttctt

SEQ ID NO: 335506 - DNA, 15 bp, Homo sapiens
cgtgagttcttctta

SEQ ID NO: 335507 - DNA, 15 bp, Homo sapiens
gtgagttcttcttag

SEQ ID NO: 335508 - DNA, 15 bp, Homo sapiens
tgagttcttcttagt

SEQ ID NO: 335509 - DNA, 15 bp, Homo sapiens
gagttcttcttagtg

SEQ ID NO: 335510 - DNA, 15 bp, Homo sapiens
agttcttcttagtgc

SEQ ID NO: 335511 - DNA, 15 bp, Homo sapiens
gttcttcttagtgca

SEQ ID NO: 335512 - DNA, 15 bp, Homo sapiens
ttcttcttagtgcat

SEQ ID NO: 335513 - DNA, 15 bp, Homo sapiens
tcttcttagtgcatc

SEQ ID NO: 335514 - DNA, 15 bp, Homo sapiens
cttcttagtgcatca

SEQ ID NO: 335515 - DNA, 15 bp, Homo sapiens
ttcttagtgcatcat

SEQ ID NO: 335516 - DNA, 15 bp, Homo sapiens
tcttagtgcatcata

SEQ ID NO: 335517 - DNA, 15 bp, Homo sapiens
cttagtgcatcatat

SEQ ID NO: 335518 - DNA, 15 bp, Homo sapiens
ttagtgcatcatatc

SEQ ID NO: 335519 - DNA, 15 bp, Homo sapiens
tagtgcatcatatcg

SEQ ID NO: 335520 - DNA, 15 bp, Homo sapiens
agtgcatcatatcgg

SEQ ID NO: 335521 - DNA, 15 bp, Homo sapiens
gtgcatcatatcggg

SEQ ID NO: 335522 - DNA, 15 bp, Homo sapiens
tgcatcatatcgggg

SEQ ID NO: 335523 - DNA, 15 bp, Homo sapiens
gcatcatatcgggga

SEQ ID NO: 335524 - DNA, 15 bp, Homo sapiens
catcatatcggggat

SEQ ID NO: 335525 - DNA, 15 bp, Homo sapiens
atcatatcggggata

SEQ ID NO: 335526 - DNA, 15 bp, Homo sapiens
tcatatcggggatag

SEQ ID NO: 335527 - DNA, 15 bp, Homo sapiens
catatcggggatagg

SEQ ID NO: 335528 - DNA, 15 bp, Homo sapiens
atatcggggataggt

SEQ ID NO: 335529 - DNA, 15 bp, Homo sapiens
tatcggggataggtg

SEQ ID NO: 335530 - DNA, 15 bp, Homo sapiens
atcggggataggtga

SEQ ID NO: 335531 - DNA, 15 bp, Homo sapiens
tcggggataggtgat

SEQ ID NO: 335532 - DNA, 15 bp, Homo sapiens
cggggataggtgata

SEQ ID NO: 335533 - DNA, 15 bp, Homo sapiens
ggggataggtgatat

SEQ ID NO: 335534 - DNA, 15 bp, Homo sapiens
gggataggtgatatc

SEQ ID NO: 335535 - DNA, 15 bp, Homo sapiens
ggataggtgatatct

SEQ ID NO: 335536 - DNA, 15 bp, Homo sapiens
gataggtgatatctg

SEQ ID NO: 335537 - DNA, 15 bp, Homo sapiens
ataggtgatatctgt

SEQ ID NO: 335538 - DNA, 15 bp, Homo sapiens
taggtgatatctgtt

SEQ ID NO: 335539 - DNA, 15 bp, Homo sapiens
aggtgatatctgttc

SEQ ID NO: 335540 - DNA, 15 bp, Homo sapiens
ggtgatatctgttct

SEQ ID NO: 335541 - DNA, 15 bp, Homo sapiens
gtgatatctgttctt

SEQ ID NO: 335542 - DNA, 15 bp, Homo sapiens
tgatatctgttcttt

SEQ ID NO: 335543 - DNA, 15 bp, Homo sapiens
gatatctgttctttt

SEQ ID NO: 335544 - DNA, 15 bp, Homo sapiens
atatctgttcttttt

SEQ ID NO: 335545 - DNA, 15 bp, Homo sapiens
tatctgttctttttc

SEQ ID NO: 335546 - DNA, 15 bp, Homo sapiens
atctgttctttttct

SEQ ID NO: 335547 - DNA, 15 bp, Homo sapiens
tctgttctttttctg

SEQ ID NO: 335548 - DNA, 15 bp, Homo sapiens
ctgttctttttctgg

SEQ ID NO: 335549 - DNA, 15 bp, Homo sapiens
tgttctttttctggc

SEQ ID NO: 335550 - DNA, 15 bp, Homo sapiens
gttctttttctggca

SEQ ID NO: 335551 - DNA, 15 bp, Homo sapiens
ttctttttctggcag

SEQ ID NO: 335552 - DNA, 15 bp, Homo sapiens
tctttttctggcagt

SEQ ID NO: 335553 - DNA, 15 bp, Homo sapiens
ctttttctggcagtg

SEQ ID NO: 335554 - DNA, 15 bp, Homo sapiens
tttttctggcagtgt

SEQ ID NO: 335555 - DNA, 15 bp, Homo sapiens
ttttctggcagtgtt

SEQ ID NO: 335556 - DNA, 15 bp, Homo sapiens
tttctggcagtgtta

SEQ ID NO: 335557 - DNA, 15 bp, Homo sapiens
ttctggcagtgttaa

SEQ ID NO: 335558 - DNA, 15 bp, Homo sapiens
tctggcagtgttaac

SEQ ID NO: 335559 - DNA, 15 bp, Homo sapiens
ctggcagtgttaact

SEQ ID NO: 335560 - DNA, 15 bp, Homo sapiens
tggcagtgttaactt

SEQ ID NO: 335561 - DNA, 15 bp, Homo sapiens
ggcagtgttaacttt

SEQ ID NO: 335562 - DNA, 15 bp, Homo sapiens
gcagtgttaactttg

SEQ ID NO: 335563 - DNA, 15 bp, Homo sapiens
cagtgttaactttga

SEQ ID NO: 335564 - DNA, 15 bp, Homo sapiens
agtgttaactttgat

SEQ ID NO: 335565 - DNA, 15 bp, Homo sapiens
gtgttaactttgatt

SEQ ID NO: 335566 - DNA, 15 bp, Homo sapiens
tgttaactttgattg

SEQ ID NO: 335567 - DNA, 15 bp, Homo sapiens
gttaactttgattgt

SEQ ID NO: 335568 - DNA, 15 bp, Homo sapiens
ttaactttgattgtt

SEQ ID NO: 335569 - DNA, 15 bp, Homo sapiens
taactttgattgttt

SEQ ID NO: 335570 - DNA, 15 bp, Homo sapiens
aactttgattgtttg

SEQ ID NO: 335571 - DNA, 15 bp, Homo sapiens
actttgattgtttgg

SEQ ID NO: 335572 - DNA, 15 bp, Homo sapiens
ctttgattgtttggc

SEQ ID NO: 335573 - DNA, 15 bp, Homo sapiens
tttgattgtttggct

SEQ ID NO: 335574 - DNA, 15 bp, Homo sapiens
ttgattgtttggcta

SEQ ID NO: 335575 - DNA, 15 bp, Homo sapiens
tgattgtttggctaa

SEQ ID NO: 335576 - DNA, 15 bp, Homo sapiens
gattgtttggctaag

SEQ ID NO: 335577 - DNA, 15 bp, Homo sapiens
attgtttggctaagg

SEQ ID NO: 335578 - DNA, 15 bp, Homo sapiens
ttgtttggctaaggt

SEQ ID NO: 335579 - DNA, 15 bp, Homo sapiens
tgtttggctaaggtg

SEQ ID NO: 335580 - DNA, 15 bp, Homo sapiens
gtttggctaaggtgg

SEQ ID NO: 335581 - DNA, 15 bp, Homo sapiens
tttggctaaggtggt

SEQ ID NO: 335582 - DNA, 15 bp, Homo sapiens
ttggctaaggtggta

SEQ ID NO: 335583 - DNA, 15 bp, Homo sapiens
tggctaaggtggtat

SEQ ID NO: 335584 - DNA, 15 bp, Homo sapiens
ggctaaggtggtatt

SEQ ID NO: 335585 - DNA, 15 bp, Homo sapiens
gctaaggtggtattt

SEQ ID NO: 335586 - DNA, 15 bp, Homo sapiens
ctaaggtggtattta

SEQ ID NO: 335587 - DNA, 15 bp, Homo sapiens
taaggtggtatttac

SEQ ID NO: 335588 - DNA, 15 bp, Homo sapiens
aaggtggtatttacc

SEQ ID NO: 335589 - DNA, 15 bp, Homo sapiens
aggtggtatttacca

SEQ ID NO: 335590 - DNA, 15 bp, Homo sapiens
ggtggtatttaccaa

SEQ ID NO: 335591 - DNA, 15 bp, Homo sapiens
gtggtatttaccaag

SEQ ID NO: 335592 - DNA, 15 bp, Homo sapiens
tggtatttaccaagt

SEQ ID NO: 335593 - DNA, 15 bp, Homo sapiens
ggtatttaccaagtt

SEQ ID NO: 335594 - DNA, 15 bp, Homo sapiens
gtatttaccaagttt

SEQ ID NO: 335595 - DNA, 15 bp, Homo sapiens
tatttaccaagtttc

SEQ ID NO: 335596 - DNA, 15 bp, Homo sapiens
atttaccaagtttct

SEQ ID NO: 335597 - DNA, 15 bp, Homo sapiens
tttaccaagtttctt

SEQ ID NO: 335598 - DNA, 15 bp, Homo sapiens
ttaccaagtttcttc

SEQ ID NO: 335599 - DNA, 15 bp, Homo sapiens
taccaagtttcttcc

SEQ ID NO: 335600 - DNA, 15 bp, Homo sapiens
accaagtttcttccc

SEQ ID NO: 335601 - DNA, 15 bp, Homo sapiens
ccaagtttcttccct

SEQ ID NO: 335602 - DNA, 15 bp, Homo sapiens
caagtttcttccctg

SEQ ID NO: 335603 - DNA, 15 bp, Homo sapiens
aagtttcttccctgt

SEQ ID NO: 335604 - DNA, 15 bp, Homo sapiens
agtttcttccctgta

SEQ ID NO: 335605 - DNA, 15 bp, Homo sapiens
gtttcttccctgtaa

SEQ ID NO: 335606 - DNA, 15 bp, Homo sapiens
tttcttccctgtaaa

SEQ ID NO: 335607 - DNA, 15 bp, Homo sapiens
ttcttccctgtaaat

SEQ ID NO: 335608 - DNA, 15 bp, Homo sapiens
tcttccctgtaaatt

SEQ ID NO: 335609 - DNA, 15 bp, Homo sapiens
cttccctgtaaattg

SEQ ID NO: 335610 - DNA, 15 bp, Homo sapiens
ttccctgtaaattga

SEQ ID NO: 335611 - DNA, 15 bp, Homo sapiens
tccctgtaaattgac

SEQ ID NO: 335612 - DNA, 15 bp, Homo sapiens
ccctgtaaattgact

SEQ ID NO: 335613 - DNA, 15 bp, Homo sapiens
cctgtaaattgacta

SEQ ID NO: 335614 - DNA, 15 bp, Homo sapiens
ctgtaaattgactac

SEQ ID NO: 335615 - DNA, 15 bp, Homo sapiens
tgtaaattgactacc

SEQ ID NO: 335616 - DNA, 15 bp, Homo sapiens
gtaaattgactaccc

SEQ ID NO: 335617 - DNA, 15 bp, Homo sapiens
taaattgactaccct

SEQ ID NO: 335618 - DNA, 15 bp, Homo sapiens
aaattgactaccctt

SEQ ID NO: 335619 - DNA, 15 bp, Homo sapiens
aattgactacccttt

SEQ ID NO: 335620 - DNA, 15 bp, Homo sapiens
attgactaccctttg

SEQ ID NO: 335621 - DNA, 15 bp, Homo sapiens
ttgactaccctttgt

SEQ ID NO: 335622 - DNA, 15 bp, Homo sapiens
tgactaccctttgtt

SEQ ID NO: 335623 - DNA, 15 bp, Homo sapiens
gactaccctttgtta

SEQ ID NO: 335624 - DNA, 15 bp, Homo sapiens
actaccctttgttat

SEQ ID NO: 335625 - DNA, 15 bp, Homo sapiens
ctaccctttgttatt

SEQ ID NO: 335626 - DNA, 15 bp, Homo sapiens
taccctttgttatta

SEQ ID NO: 335627 - DNA, 15 bp, Homo sapiens
accctttgttattaa

SEQ ID NO: 335628 - DNA, 15 bp, Homo sapiens
ccctttgttattaaa

SEQ ID NO: 335629 - DNA, 15 bp, Homo sapiens
cctttgttattaaaa

SEQ ID NO: 335630 - DNA, 15 bp, Homo sapiens
ctttgttattaaaag

SEQ ID NO: 335631 - DNA, 15 bp, Homo sapiens
tttgttattaaaagt

SEQ ID NO: 335632 - DNA, 15 bp, Homo sapiens
ttgttattaaaagta

SEQ ID NO: 335633 - DNA, 15 bp, Homo sapiens
tgttattaaaagtat

SEQ ID NO: 335634 - DNA, 15 bp, Homo sapiens
gttattaaaagtatc

SEQ ID NO: 335635 - DNA, 15 bp, Homo sapiens
ttattaaaagtatcg

SEQ ID NO: 335636 - DNA, 15 bp, Homo sapiens
tattaaaagtatcgg

SEQ ID NO: 335637 - DNA, 15 bp, Homo sapiens
attaaaagtatcggg

SEQ ID NO: 335638 - DNA, 15 bp, Homo sapiens
ttaaaagtatcgggt

SEQ ID NO: 335639 - DNA, 15 bp, Homo sapiens
taaaagtatcgggtg

SEQ ID NO: 335640 - DNA, 15 bp, Homo sapiens
aaaagtatcgggtgg

SEQ ID NO: 335641 - DNA, 15 bp, Homo sapiens
aaagtatcgggtggg

SEQ ID NO: 335642 - DNA, 15 bp, Homo sapiens
aagtatcgggtgggg

SEQ ID NO: 335643 - DNA, 15 bp, Homo sapiens
agtatcgggtgggga

SEQ ID NO: 335644 - DNA, 15 bp, Homo sapiens
gtatcgggtggggat

SEQ ID NO: 335645 - DNA, 15 bp, Homo sapiens
tatcgggtggggata

SEQ ID NO: 335646 - DNA, 15 bp, Homo sapiens
atcgggtggggatat

SEQ ID NO: 335647 - DNA, 15 bp, Homo sapiens
tcgggtggggatata

SEQ ID NO: 335648 - DNA, 15 bp, Homo sapiens
cgggtggggatatac

SEQ ID NO: 335649 - DNA, 15 bp, Homo sapiens
gggtggggatatact

SEQ ID NO: 335650 - DNA, 15 bp, Homo sapiens
ggtggggatatactt

SEQ ID NO: 335651 - DNA, 15 bp, Homo sapiens
gtggggatatacttt

SEQ ID NO: 335652 - DNA, 15 bp, Homo sapiens
tggggatatactttg

SEQ ID NO: 335653 - DNA, 15 bp, Homo sapiens
ggggatatactttga

SEQ ID NO: 335654 - DNA, 15 bp, Homo sapiens
gggatatactttgag

SEQ ID NO: 335655 - DNA, 15 bp, Homo sapiens
ggatatactttgaga

SEQ ID NO: 335656 - DNA, 15 bp, Homo sapiens
gatatactttgagac

SEQ ID NO: 335657 - DNA, 15 bp, Homo sapiens
atatactttgagact

SEQ ID NO: 335658 - DNA, 15 bp, Homo sapiens
tatactttgagactg

SEQ ID NO: 335659 - DNA, 15 bp, Homo sapiens
atactttgagactgt

SEQ ID NO: 335660 - DNA, 15 bp, Homo sapiens
tactttgagactgta

SEQ ID NO: 335661 - DNA, 15 bp, Homo sapiens
actttgagactgtat

SEQ ID NO: 335662 - DNA, 15 bp, Homo sapiens
ctttgagactgtata

SEQ ID NO: 335663 - DNA, 15 bp, Homo sapiens
tttgagactgtataa

SEQ ID NO: 335664 - DNA, 15 bp, Homo sapiens
ttgagactgtataaa

SEQ ID NO: 335665 - DNA, 15 bp, Homo sapiens
tgagactgtataaat

SEQ ID NO: 335666 - DNA, 15 bp, Homo sapiens
gagactgtataaata

SEQ ID NO: 335667 - DNA, 15 bp, Homo sapiens
agactgtataaatat

SEQ ID NO: 335668 - DNA, 15 bp, Homo sapiens
gactgtataaatatt

SEQ ID NO: 335669 - DNA, 15 bp, Homo sapiens
actgtataaatattt

SEQ ID NO: 335670 - DNA, 15 bp, Homo sapiens
ctgtataaatattta

SEQ ID NO: 335671 - DNA, 15 bp, Homo sapiens
tgtataaatatttag

SEQ ID NO: 335672 - DNA, 15 bp, Homo sapiens
gtataaatatttagt

SEQ ID NO: 335673 - DNA, 15 bp, Homo sapiens
tataaatatttagtt

SEQ ID NO: 335674 - DNA, 15 bp, Homo sapiens
ataaatatttagttt

SEQ ID NO: 335675 - DNA, 15 bp, Homo sapiens
taaatatttagtttt

SEQ ID NO: 335676 - DNA, 15 bp, Homo sapiens
aaatatttagttttt

SEQ ID NO: 335677 - DNA, 15 bp, Homo sapiens
aatatttagttttta

SEQ ID NO: 335678 - DNA, 15 bp, Homo sapiens
atatttagtttttat

SEQ ID NO: 335679 - DNA, 15 bp, Homo sapiens
tatttagtttttatc

SEQ ID NO: 335680 - DNA, 15 bp, Homo sapiens
atttagtttttatca

SEQ ID NO: 335681 - DNA, 15 bp, Homo sapiens
tttagtttttatcaa

SEQ ID NO: 335682 - DNA, 15 bp, Homo sapiens
ttagtttttatcaaa

SEQ ID NO: 335683 - DNA, 15 bp, Homo sapiens
tagtttttatcaaac

SEQ ID NO: 335684 - DNA, 15 bp, Homo sapiens
agtttttatcaaact

SEQ ID NO: 335685 - DNA, 15 bp, Homo sapiens
gtttttatcaaactt

SEQ ID NO: 335686 - DNA, 15 bp, Homo sapiens
tttttatcaaacttt

SEQ ID NO: 335687 - DNA, 15 bp, Homo sapiens
ttttatcaaactttt

SEQ ID NO: 335688 - DNA, 15 bp, Homo sapiens
tttatcaaactttta

SEQ ID NO: 335689 - DNA, 15 bp, Homo sapiens
ttatcaaacttttag

SEQ ID NO: 335690 - DNA, 15 bp, Homo sapiens
tatcaaacttttagc

SEQ ID NO: 335691 - DNA, 15 bp, Homo sapiens
atcaaacttttagca

SEQ ID NO: 335692 - DNA, 15 bp, Homo sapiens
tcaaacttttagcac

SEQ ID NO: 335693 - DNA, 15 bp, Homo sapiens
caaacttttagcacc

SEQ ID NO: 335694 - DNA, 15 bp, Homo sapiens
aaacttttagcaccc

SEQ ID NO: 335695 - DNA, 15 bp, Homo sapiens
aacttttagcacccg

SEQ ID NO: 335696 - DNA, 15 bp, Homo sapiens
acttttagcacccgt

SEQ ID NO: 335697 - DNA, 15 bp, Homo sapiens
cttttagcacccgtt

SEQ ID NO: 335698 - DNA, 15 bp, Homo sapiens
ttttagcacccgttc

SEQ ID NO: 335699 - DNA, 15 bp, Homo sapiens
tttagcacccgttca

SEQ ID NO: 335700 - DNA, 15 bp, Homo sapiens
ttagcacccgttcat

SEQ ID NO: 335701 - DNA, 15 bp, Homo sapiens
tagcacccgttcata

SEQ ID NO: 335702 - DNA, 15 bp, Homo sapiens
agcacccgttcataa

SEQ ID NO: 335703 - DNA, 15 bp, Homo sapiens
gcacccgttcataat

SEQ ID NO: 335704 - DNA, 15 bp, Homo sapiens
cacccgttcataatt

SEQ ID NO: 335705 - DNA, 15 bp, Homo sapiens
acccgttcataattt

SEQ ID NO: 335706 - DNA, 15 bp, Homo sapiens
cccgttcataatttt

SEQ ID NO: 335707 - DNA, 15 bp, Homo sapiens
ccgttcataattttt

SEQ ID NO: 335708 - DNA, 15 bp, Homo sapiens
cgttcataatttttg

SEQ ID NO: 335709 - DNA, 15 bp, Homo sapiens
gttcataatttttgc

SEQ ID NO: 335710 - DNA, 15 bp, Homo sapiens
ttcataatttttgcc

SEQ ID NO: 335711 - DNA, 15 bp, Homo sapiens
tcataatttttgcct

SEQ ID NO: 335712 - DNA, 15 bp, Homo sapiens
cataatttttgcctg

SEQ ID NO: 335713 - DNA, 15 bp, Homo sapiens
ataatttttgcctgg

SEQ ID NO: 335714 - DNA, 15 bp, Homo sapiens
taatttttgcctgga

SEQ ID NO: 335715 - DNA, 15 bp, Homo sapiens
aatttttgcctggac

SEQ ID NO: 335716 - DNA, 15 bp, Homo sapiens
atttttgcctggacc

SEQ ID NO: 335717 - DNA, 15 bp, Homo sapiens
tttttgcctggacca

SEQ ID NO: 335718 - DNA, 15 bp, Homo sapiens
ttttgcctggaccag

SEQ ID NO: 335719 - DNA, 15 bp, Homo sapiens
tttgcctggaccagc

SEQ ID NO: 335720 - DNA, 15 bp, Homo sapiens
ttgcctggaccagct

SEQ ID NO: 335721 - DNA, 15 bp, Homo sapiens
tgcctggaccagcta

SEQ ID NO: 335722 - DNA, 15 bp, Homo sapiens
gcctggaccagctat

SEQ ID NO: 335723 - DNA, 15 bp, Homo sapiens
cctggaccagctatt

SEQ ID NO: 335724 - DNA, 15 bp, Homo sapiens
ctggaccagctatta

SEQ ID NO: 335725 - DNA, 15 bp, Homo sapiens
tggaccagctattat

SEQ ID NO: 335726 - DNA, 15 bp, Homo sapiens
ggaccagctattatt

SEQ ID NO: 335727 - DNA, 15 bp, Homo sapiens
gaccagctattatta

SEQ ID NO: 335728 - DNA, 15 bp, Homo sapiens
accagctattattat

SEQ ID NO: 335729 - DNA, 15 bp, Homo sapiens
ccagctattattatg

SEQ ID NO: 335730 - DNA, 15 bp, Homo sapiens
cagctattattatga

SEQ ID NO: 335731 - DNA, 15 bp, Homo sapiens
agctattattatgat

SEQ ID NO: 335732 - DNA, 15 bp, Homo sapiens
gctattattatgatg

SEQ ID NO: 335733 - DNA, 15 bp, Homo sapiens
ctattattatgatgc

SEQ ID NO: 335734 - DNA, 15 bp, Homo sapiens
tattattatgatgct

SEQ ID NO: 335735 - DNA, 15 bp, Homo sapiens
attattatgatgctt

SEQ ID NO: 335736 - DNA, 15 bp, Homo sapiens
ttattatgatgcttg

SEQ ID NO: 335737 - DNA, 15 bp, Homo sapiens
tattatgatgcttga

SEQ ID NO: 335738 - DNA, 15 bp, Homo sapiens
attatgatgcttgat

SEQ ID NO: 335739 - DNA, 15 bp, Homo sapiens
ttatgatgcttgata

SEQ ID NO: 335740 - DNA, 15 bp, Homo sapiens
tatgatgcttgatag

SEQ ID NO: 335741 - DNA, 15 bp, Homo sapiens
atgatgcttgataga

SEQ ID NO: 335742 - DNA, 15 bp, Homo sapiens
tgatgcttgatagat

SEQ ID NO: 335743 - DNA, 15 bp, Homo sapiens
gatgcttgatagata

SEQ ID NO: 335744 - DNA, 15 bp, Homo sapiens
atgcttgatagataa

SEQ ID NO: 335745 - DNA, 15 bp, Homo sapiens
tgcttgatagataat

SEQ ID NO: 335746 - DNA, 15 bp, Homo sapiens
gcttgatagataatg

SEQ ID NO: 335747 - DNA, 15 bp, Homo sapiens
cttgatagataatga

SEQ ID NO: 335748 - DNA, 15 bp, Homo sapiens
ttgatagataatgat

SEQ ID NO: 335749 - DNA, 15 bp, Homo sapiens
tgatagataatgatt

SEQ ID NO: 335750 - DNA, 15 bp, Homo sapiens
gatagataatgattt

SEQ ID NO: 335751 - DNA, 15 bp, Homo sapiens
atagataatgatttt

SEQ ID NO: 335752 - DNA, 15 bp, Homo sapiens
tagataatgattttc

SEQ ID NO: 335753 - DNA, 15 bp, Homo sapiens
agataatgattttct

SEQ ID NO: 335754 - DNA, 15 bp, Homo sapiens
gataatgattttcta

SEQ ID NO: 335755 - DNA, 15 bp, Homo sapiens
ataatgattttctaa

SEQ ID NO: 335756 - DNA, 15 bp, Homo sapiens
taatgattttctaat

SEQ ID NO: 335757 - DNA, 15 bp, Homo sapiens
aatgattttctaatt

SEQ ID NO: 335758 - DNA, 15 bp, Homo sapiens
atgattttctaattt

SEQ ID NO: 335759 - DNA, 15 bp, Homo sapiens
tgattttctaatttc

SEQ ID NO: 335760 - DNA, 15 bp, Homo sapiens
gattttctaatttca

SEQ ID NO: 335761 - DNA, 15 bp, Homo sapiens
attttctaatttcat

SEQ ID NO: 335762 - DNA, 15 bp, Homo sapiens
ttttctaatttcatt

SEQ ID NO: 335763 - DNA, 15 bp, Homo sapiens
tttctaatttcatta

SEQ ID NO: 335764 - DNA, 15 bp, Homo sapiens
ttctaatttcattaa

SEQ ID NO: 335765 - DNA, 15 bp, Homo sapiens
tctaatttcattaat

SEQ ID NO: 335766 - DNA, 15 bp, Homo sapiens
ctaatttcattaatc

SEQ ID NO: 335767 - DNA, 15 bp, Homo sapiens
taatttcattaatcc

SEQ ID NO: 335768 - DNA, 15 bp, Homo sapiens
aatttcattaatcct

SEQ ID NO: 335769 - DNA, 15 bp, Homo sapiens
atttcattaatcctt

SEQ ID NO: 335770 - DNA, 15 bp, Homo sapiens
tttcattaatccttc

SEQ ID NO: 335771 - DNA, 15 bp, Homo sapiens
ttcattaatccttct

SEQ ID NO: 335772 - DNA, 15 bp, Homo sapiens
tcattaatccttcta

SEQ ID NO: 335773 - DNA, 15 bp, Homo sapiens
cattaatccttctac

SEQ ID NO: 335774 - DNA, 15 bp, Homo sapiens
attaatccttctaca

SEQ ID NO: 335775 - DNA, 15 bp, Homo sapiens
ttaatccttctacat

SEQ ID NO: 335776 - DNA, 15 bp, Homo sapiens
taatccttctacatt

SEQ ID NO: 335777 - DNA, 15 bp, Homo sapiens
aatccttctacatta

SEQ ID NO: 335778 - DNA, 15 bp, Homo sapiens
atccttctacattag

SEQ ID NO: 335779 - DNA, 15 bp, Homo sapiens
tccttctacattagt

SEQ ID NO: 335780 - DNA, 15 bp, Homo sapiens
ccttctacattagtt

SEQ ID NO: 335781 - DNA, 15 bp, Homo sapiens
cttctacattagttg

SEQ ID NO: 335782 - DNA, 15 bp, Homo sapiens
ttctacattagttgg

SEQ ID NO: 335783 - DNA, 15 bp, Homo sapiens
tctacattagttggt

SEQ ID NO: 335784 - DNA, 15 bp, Homo sapiens
ctacattagttggtg

SEQ ID NO: 335785 - DNA, 15 bp, Homo sapiens
tacattagttggtgt

SEQ ID NO: 335786 - DNA, 15 bp, Homo sapiens
acattagttggtgtt

SEQ ID NO: 335787 - DNA, 15 bp, Homo sapiens
cattagttggtgttc

SEQ ID NO: 335788 - DNA, 15 bp, Homo sapiens
attagttggtgttct

SEQ ID NO: 335789 - DNA, 15 bp, Homo sapiens
ttagttggtgttcta

SEQ ID NO: 335790 - DNA, 15 bp, Homo sapiens
tagttggtgttctac

SEQ ID NO: 335791 - DNA, 15 bp, Homo sapiens
agttggtgttctact

SEQ ID NO: 335792 - DNA, 15 bp, Homo sapiens
gttggtgttctactt

SEQ ID NO: 335793 - DNA, 15 bp, Homo sapiens
ttggtgttctacttg

SEQ ID NO: 335794 - DNA, 15 bp, Homo sapiens
tggtgttctacttgt

SEQ ID NO: 335795 - DNA, 15 bp, Homo sapiens
ggtgttctacttgta

SEQ ID NO: 335796 - DNA, 15 bp, Homo sapiens
gtgttctacttgtaa

SEQ ID NO: 335797 - DNA, 15 bp, Homo sapiens
tgttctacttgtaaa

SEQ ID NO: 335798 - DNA, 15 bp, Homo sapiens
gttctacttgtaaag

SEQ ID NO: 335799 - DNA, 15 bp, Homo sapiens
ttctacttgtaaaga

SEQ ID NO: 335800 - DNA, 15 bp, Homo sapiens
tctacttgtaaagaa

SEQ ID NO: 335801 - DNA, 15 bp, Homo sapiens
ctacttgtaaagaag

SEQ ID NO: 335802 - DNA, 15 bp, Homo sapiens
tacttgtaaagaaga

SEQ ID NO: 335803 - DNA, 15 bp, Homo sapiens
acttgtaaagaagag

SEQ ID NO: 335804 - DNA, 15 bp, Homo sapiens
cttgtaaagaagagc

SEQ ID NO: 335805 - DNA, 15 bp, Homo sapiens
ttgtaaagaagagct

SEQ ID NO: 335806 - DNA, 15 bp, Homo sapiens
tgtaaagaagagctt

SEQ ID NO: 335807 - DNA, 15 bp, Homo sapiens
gtaaagaagagcttc

SEQ ID NO: 335808 - DNA, 15 bp, Homo sapiens
taaagaagagcttcc

SEQ ID NO: 335809 - DNA, 15 bp, Homo sapiens
aaagaagagcttccc

SEQ ID NO: 335810 - DNA, 15 bp, Homo sapiens
aagaagagcttcccc

SEQ ID NO: 335811 - DNA, 15 bp, Homo sapiens
agaagagcttcccct

SEQ ID NO: 335812 - DNA, 15 bp, Homo sapiens
gaagagcttcccctt

SEQ ID NO: 335813 - DNA, 15 bp, Homo sapiens
aagagcttccccttg

SEQ ID NO: 335814 - DNA, 15 bp, Homo sapiens
agagcttccccttgt

SEQ ID NO: 335815 - DNA, 15 bp, Homo sapiens
gagcttccccttgtt

SEQ ID NO: 335816 - DNA, 15 bp, Homo sapiens
agcttccccttgttt

SEQ ID NO: 335817 - DNA, 15 bp, Homo sapiens
gcttccccttgtttc

SEQ ID NO: 335818 - DNA, 15 bp, Homo sapiens
cttccccttgtttct

SEQ ID NO: 335819 - DNA, 15 bp, Homo sapiens
ttccccttgtttctt

SEQ ID NO: 335820 - DNA, 15 bp, Homo sapiens
tccccttgtttcttg

SEQ ID NO: 335821 - DNA, 15 bp, Homo sapiens
ccccttgtttcttgt

SEQ ID NO: 335822 - DNA, 15 bp, Homo sapiens
cccttgtttcttgtt

SEQ ID NO: 335823 - DNA, 15 bp, Homo sapiens
ccttgtttcttgttt

SEQ ID NO: 335824 - DNA, 15 bp, Homo sapiens
cttgtttcttgtttc

SEQ ID NO: 335825 - DNA, 15 bp, Homo sapiens
ttgtttcttgtttct

SEQ ID NO: 335826 - DNA, 15 bp, Homo sapiens
tgtttcttgtttctc

SEQ ID NO: 335827 - DNA, 15 bp, Homo sapiens
gtttcttgtttctct

SEQ ID NO: 335828 - DNA, 15 bp, Homo sapiens
tttcttgtttctcta

SEQ ID NO: 335829 - DNA, 15 bp, Homo sapiens
ttcttgtttctctat

SEQ ID NO: 335830 - DNA, 15 bp, Homo sapiens
tcttgtttctctatc

SEQ ID NO: 335831 - DNA, 15 bp, Homo sapiens
cttgtttctctatct

SEQ ID NO: 335832 - DNA, 15 bp, Homo sapiens
ttgtttctctatctt

SEQ ID NO: 335833 - DNA, 15 bp, Homo sapiens
tgtttctctatctta

SEQ ID NO: 335834 - DNA, 15 bp, Homo sapiens
gtttctctatcttat

SEQ ID NO: 335835 - DNA, 15 bp, Homo sapiens
tttctctatcttatc

SEQ ID NO: 335836 - DNA, 15 bp, Homo sapiens
ttctctatcttatct

SEQ ID NO: 335837 - DNA, 15 bp, Homo sapiens
tctctatcttatctc

SEQ ID NO: 335838 - DNA, 15 bp, Homo sapiens
ctctatcttatctct

SEQ ID NO: 335839 - DNA, 15 bp, Homo sapiens
tctatcttatctctc

SEQ ID NO: 335840 - DNA, 15 bp, Homo sapiens
ctatcttatctctct

SEQ ID NO: 335841 - DNA, 15 bp, Homo sapiens
tatcttatctctctc

SEQ ID NO: 335842 - DNA, 15 bp, Homo sapiens
atcttatctctctct

SEQ ID NO: 335843 - DNA, 15 bp, Homo sapiens
tcttatctctctctc

SEQ ID NO: 335844 - DNA, 15 bp, Homo sapiens
cttatctctctctcc

SEQ ID NO: 335845 - DNA, 15 bp, Homo sapiens
ttatctctctctcca

SEQ ID NO: 335846 - DNA, 15 bp, Homo sapiens
tatctctctctccat

SEQ ID NO: 335847 - DNA, 15 bp, Homo sapiens
atctctctctccatt

SEQ ID NO: 335848 - DNA, 15 bp, Homo sapiens
tctctctctccattc

SEQ ID NO: 335849 - DNA, 15 bp, Homo sapiens
ctctctctccattca

SEQ ID NO: 335850 - DNA, 15 bp, Homo sapiens
tctctctccattcat

SEQ ID NO: 335851 - DNA, 15 bp, Homo sapiens
ctctctccattcatt

SEQ ID NO: 335852 - DNA, 15 bp, Homo sapiens
tctctccattcattt

SEQ ID NO: 335853 - DNA, 15 bp, Homo sapiens
ctctccattcattta

SEQ ID NO: 335854 - DNA, 15 bp, Homo sapiens
tctccattcatttat

SEQ ID NO: 335855 - DNA, 15 bp, Homo sapiens
ctccattcatttatt

SEQ ID NO: 335856 - DNA, 15 bp, Homo sapiens
tccattcatttattc

SEQ ID NO: 335857 - DNA, 15 bp, Homo sapiens
ccattcatttattca

SEQ ID NO: 335858 - DNA, 15 bp, Homo sapiens
cattcatttattcat

SEQ ID NO: 335859 - DNA, 15 bp, Homo sapiens
attcatttattcatt

SEQ ID NO: 335860 - DNA, 15 bp, Homo sapiens
ttcatttattcattt

SEQ ID NO: 335861 - DNA, 15 bp, Homo sapiens
tcatttattcattta

SEQ ID NO: 335862 - DNA, 15 bp, Homo sapiens
catttattcatttat

SEQ ID NO: 335863 - DNA, 15 bp, Homo sapiens
atttattcatttatg

SEQ ID NO: 335864 - DNA, 15 bp, Homo sapiens
tttattcatttatgt

SEQ ID NO: 335865 - DNA, 15 bp, Homo sapiens
ttattcatttatgta

SEQ ID NO: 335866 - DNA, 15 bp, Homo sapiens
tattcatttatgtat

SEQ ID NO: 335867 - DNA, 15 bp, Homo sapiens
attcatttatgtatc

SEQ ID NO: 335868 - DNA, 15 bp, Homo sapiens
ttcatttatgtatca

SEQ ID NO: 335869 - DNA, 15 bp, Homo sapiens
tcatttatgtatcag

SEQ ID NO: 335870 - DNA, 15 bp, Homo sapiens
catttatgtatcagt

SEQ ID NO: 335871 - DNA, 15 bp, Homo sapiens
atttatgtatcagta

SEQ ID NO: 335872 - DNA, 15 bp, Homo sapiens
tttatgtatcagtat

SEQ ID NO: 335873 - DNA, 15 bp, Homo sapiens
ttatgtatcagtata

SEQ ID NO: 335874 - DNA, 15 bp, Homo sapiens
tatgtatcagtatag

SEQ ID NO: 335875 - DNA, 15 bp, Homo sapiens
atgtatcagtataga

SEQ ID NO: 335876 - DNA, 15 bp, Homo sapiens
tgtatcagtatagat

SEQ ID NO: 335877 - DNA, 15 bp, Homo sapiens
gtatcagtatagatt

SEQ ID NO: 335878 - DNA, 15 bp, Homo sapiens
tatcagtatagattc

SEQ ID NO: 335879 - DNA, 15 bp, Homo sapiens
atcagtatagattca

SEQ ID NO: 335880 - DNA, 15 bp, Homo sapiens
tcagtatagattcat

SEQ ID NO: 335881 - DNA, 15 bp, Homo sapiens
cagtatagattcatg

SEQ ID NO: 335882 - DNA, 15 bp, Homo sapiens
agtatagattcatgg

SEQ ID NO: 335883 - DNA, 15 bp, Homo sapiens
gtatagattcatgga

SEQ ID NO: 335884 - DNA, 15 bp, Homo sapiens
tatagattcatggac

SEQ ID NO: 335885 - DNA, 15 bp, Homo sapiens
atagattcatggaca

SEQ ID NO: 335886 - DNA, 15 bp, Homo sapiens
tagattcatggacat

SEQ ID NO: 335887 - DNA, 15 bp, Homo sapiens
agattcatggacatt

SEQ ID NO: 335888 - DNA, 15 bp, Homo sapiens
gattcatggacattt

SEQ ID NO: 335889 - DNA, 15 bp, Homo sapiens
attcatggacatttg

SEQ ID NO: 335890 - DNA, 15 bp, Homo sapiens
ttcatggacatttgc

SEQ ID NO: 335891 - DNA, 15 bp, Homo sapiens
tcatggacatttgca

SEQ ID NO: 335892 - DNA, 15 bp, Homo sapiens
catggacatttgcat

SEQ ID NO: 335893 - DNA, 15 bp, Homo sapiens
atggacatttgcata

SEQ ID NO: 335894 - DNA, 15 bp, Homo sapiens
tggacatttgcatag

SEQ ID NO: 335895 - DNA, 15 bp, Homo sapiens
ggacatttgcatagg

SEQ ID NO: 335896 - DNA, 15 bp, Homo sapiens
gacatttgcataggt

SEQ ID NO: 335897 - DNA, 15 bp, Homo sapiens
acatttgcataggtt

SEQ ID NO: 335898 - DNA, 15 bp, Homo sapiens
catttgcataggttt

SEQ ID NO: 335899 - DNA, 15 bp, Homo sapiens
atttgcataggttta

SEQ ID NO: 335900 - DNA, 15 bp, Homo sapiens
tttgcataggtttat

SEQ ID NO: 335901 - DNA, 15 bp, Homo sapiens
ttgcataggtttatg

SEQ ID NO: 335902 - DNA, 15 bp, Homo sapiens
tgcataggtttatga

SEQ ID NO: 335903 - DNA, 15 bp, Homo sapiens
gcataggtttatgat

SEQ ID NO: 335904 - DNA, 15 bp, Homo sapiens
cataggtttatgatc

SEQ ID NO: 335905 - DNA, 15 bp, Homo sapiens
ataggtttatgatct

SEQ ID NO: 335906 - DNA, 15 bp, Homo sapiens
taggtttatgatctt

SEQ ID NO: 335907 - DNA, 15 bp, Homo sapiens
aggtttatgatcttt

SEQ ID NO: 335908 - DNA, 15 bp, Homo sapiens
ggtttatgatctttt

SEQ ID NO: 335909 - DNA, 15 bp, Homo sapiens
gtttatgatctttta

SEQ ID NO: 335910 - DNA, 15 bp, Homo sapiens
tttatgatcttttac

SEQ ID NO: 335911 - DNA, 15 bp, Homo sapiens
ttatgatcttttact

SEQ ID NO: 335912 - DNA, 15 bp, Homo sapiens
tatgatcttttacta

SEQ ID NO: 335913 - DNA, 15 bp, Homo sapiens
atgatcttttactag

SEQ ID NO: 335914 - DNA, 15 bp, Homo sapiens
tgatcttttactagt

SEQ ID NO: 335915 - DNA, 15 bp, Homo sapiens
gatcttttactagta

SEQ ID NO: 335916 - DNA, 15 bp, Homo sapiens
atcttttactagtac

SEQ ID NO: 335917 - DNA, 15 bp, Homo sapiens
tcttttactagtact

SEQ ID NO: 335918 - DNA, 15 bp, Homo sapiens
cttttactagtactc

SEQ ID NO: 335919 - DNA, 15 bp, Homo sapiens
ttttactagtactca

SEQ ID NO: 335920 - DNA, 15 bp, Homo sapiens
tttactagtactcat

SEQ ID NO: 335921 - DNA, 15 bp, Homo sapiens
ttactagtactcatt

SEQ ID NO: 335922 - DNA, 15 bp, Homo sapiens
tactagtactcattt

SEQ ID NO: 335923 - DNA, 15 bp, Homo sapiens
actagtactcatttc

SEQ ID NO: 335924 - DNA, 15 bp, Homo sapiens
ctagtactcatttca

SEQ ID NO: 335925 - DNA, 15 bp, Homo sapiens
tagtactcatttcag

SEQ ID NO: 335926 - DNA, 15 bp, Homo sapiens
agtactcatttcagt

SEQ ID NO: 335927 - DNA, 15 bp, Homo sapiens
gtactcatttcagtg

SEQ ID NO: 335928 - DNA, 15 bp, Homo sapiens
tactcatttcagtgt

SEQ ID NO: 335929 - DNA, 15 bp, Homo sapiens
actcatttcagtgtt

SEQ ID NO: 335930 - DNA, 15 bp, Homo sapiens
ctcatttcagtgttc

SEQ ID NO: 335931 - DNA, 15 bp, Homo sapiens
tcatttcagtgttca

SEQ ID NO: 335932 - DNA, 15 bp, Homo sapiens
catttcagtgttcaa

SEQ ID NO: 335933 - DNA, 15 bp, Homo sapiens
atttcagtgttcaag

SEQ ID NO: 335934 - DNA, 15 bp, Homo sapiens
tttcagtgttcaagt

SEQ ID NO: 335935 - DNA, 15 bp, Homo sapiens
ttcagtgttcaagtc

SEQ ID NO: 335936 - DNA, 15 bp, Homo sapiens
tcagtgttcaagtca

SEQ ID NO: 335937 - DNA, 15 bp, Homo sapiens
cagtgttcaagtcat

SEQ ID NO: 335938 - DNA, 15 bp, Homo sapiens
agtgttcaagtcatc

SEQ ID NO: 335939 - DNA, 15 bp, Homo sapiens
gtgttcaagtcatcc

SEQ ID NO: 335940 - DNA, 15 bp, Homo sapiens
tgttcaagtcatcct

SEQ ID NO: 335941 - DNA, 15 bp, Homo sapiens
gttcaagtcatccta

SEQ ID NO: 335942 - DNA, 15 bp, Homo sapiens
ttcaagtcatcctag

SEQ ID NO: 335943 - DNA, 15 bp, Homo sapiens
tcaagtcatcctaga

SEQ ID NO: 335944 - DNA, 15 bp, Homo sapiens
caagtcatcctagat

SEQ ID NO: 335945 - DNA, 15 bp, Homo sapiens
aagtcatcctagatt

SEQ ID NO: 335946 - DNA, 15 bp, Homo sapiens
agtcatcctagattt

SEQ ID NO: 335947 - DNA, 15 bp, Homo sapiens
gtcatcctagatttg

SEQ ID NO: 335948 - DNA, 15 bp, Homo sapiens
tcatcctagatttgg

SEQ ID NO: 335949 - DNA, 15 bp, Homo sapiens
catcctagatttggc

SEQ ID NO: 335950 - DNA, 15 bp, Homo sapiens
atcctagatttggcc

SEQ ID NO: 335951 - DNA, 15 bp, Homo sapiens
tcctagatttggcca

SEQ ID NO: 335952 - DNA, 15 bp, Homo sapiens
cctagatttggccag

SEQ ID NO: 335953 - DNA, 15 bp, Homo sapiens
ctagatttggccagt

SEQ ID NO: 335954 - DNA, 15 bp, Homo sapiens
tagatttggccagtg

SEQ ID NO: 335955 - DNA, 15 bp, Homo sapiens
agatttggccagtgt

SEQ ID NO: 335956 - DNA, 15 bp, Homo sapiens
gatttggccagtgtg

SEQ ID NO: 335957 - DNA, 15 bp, Homo sapiens
atttggccagtgtga

SEQ ID NO: 335958 - DNA, 15 bp, Homo sapiens
tttggccagtgtgag

SEQ ID NO: 335959 - DNA, 15 bp, Homo sapiens
ttggccagtgtgagc

SEQ ID NO: 335960 - DNA, 15 bp, Homo sapiens
tggccagtgtgagcc

SEQ ID NO: 335961 - DNA, 15 bp, Homo sapiens
ggccagtgtgagccc

SEQ ID NO: 335962 - DNA, 15 bp, Homo sapiens
gccagtgtgagcccc

SEQ ID NO: 335963 - DNA, 15 bp, Homo sapiens
ccagtgtgagcccct

SEQ ID NO: 335964 - DNA, 15 bp, Homo sapiens
cagtgtgagcccctt

SEQ ID NO: 335965 - DNA, 15 bp, Homo sapiens
agtgtgagcccctta

SEQ ID NO: 335966 - DNA, 15 bp, Homo sapiens
gtgtgagccccttaa

SEQ ID NO: 335967 - DNA, 15 bp, Homo sapiens
tgtgagccccttaaa

SEQ ID NO: 335968 - DNA, 15 bp, Homo sapiens
gtgagccccttaaat

SEQ ID NO: 335969 - DNA, 15 bp, Homo sapiens
tgagccccttaaatt

SEQ ID NO: 335970 - DNA, 15 bp, Homo sapiens
gagccccttaaattg

SEQ ID NO: 335971 - DNA, 15 bp, Homo sapiens
agccccttaaattgg

SEQ ID NO: 335972 - DNA, 15 bp, Homo sapiens
gccccttaaattggc

SEQ ID NO: 335973 - DNA, 15 bp, Homo sapiens
ccccttaaattggct

SEQ ID NO: 335974 - DNA, 15 bp, Homo sapiens
cccttaaattggctc

SEQ ID NO: 335975 - DNA, 15 bp, Homo sapiens
ccttaaattggctcc

SEQ ID NO: 335976 - DNA, 15 bp, Homo sapiens
cttaaattggctcct

SEQ ID NO: 335977 - DNA, 15 bp, Homo sapiens
ttaaattggctcctg

SEQ ID NO: 335978 - DNA, 15 bp, Homo sapiens
taaattggctcctgt

SEQ ID NO: 335979 - DNA, 15 bp, Homo sapiens
aaattggctcctgtg

SEQ ID NO: 335980 - DNA, 15 bp, Homo sapiens
aattggctcctgtgt

SEQ ID NO: 335981 - DNA, 15 bp, Homo sapiens
attggctcctgtgtc

SEQ ID NO: 335982 - DNA, 15 bp, Homo sapiens
ttggctcctgtgtcc

SEQ ID NO: 335983 - DNA, 15 bp, Homo sapiens
tggctcctgtgtccc

SEQ ID NO: 335984 - DNA, 15 bp, Homo sapiens
ggctcctgtgtccct

SEQ ID NO: 335985 - DNA, 15 bp, Homo sapiens
gctcctgtgtccctt

SEQ ID NO: 335986 - DNA, 15 bp, Homo sapiens
ctcctgtgtccctta

SEQ ID NO: 335987 - DNA, 15 bp, Homo sapiens
tcctgtgtcccttag

SEQ ID NO: 335988 - DNA, 15 bp, Homo sapiens
cctgtgtcccttaga

SEQ ID NO: 335989 - DNA, 15 bp, Homo sapiens
ctgtgtcccttagat

SEQ ID NO: 335990 - DNA, 15 bp, Homo sapiens
tgtgtcccttagata

SEQ ID NO: 335991 - DNA, 15 bp, Homo sapiens
gtgtcccttagatag

SEQ ID NO: 335992 - DNA, 15 bp, Homo sapiens
tgtcccttagataga

SEQ ID NO: 335993 - DNA, 15 bp, Homo sapiens
gtcccttagatagat

SEQ ID NO: 335994 - DNA, 15 bp, Homo sapiens
tcccttagatagatc

SEQ ID NO: 335995 - DNA, 15 bp, Homo sapiens
cccttagatagatct

SEQ ID NO: 335996 - DNA, 15 bp, Homo sapiens
ccttagatagatcta

SEQ ID NO: 335997 - DNA, 15 bp, Homo sapiens
cttagatagatctat

SEQ ID NO: 335998 - DNA, 15 bp, Homo sapiens
ttagatagatctatg

SEQ ID NO: 335999 - DNA, 15 bp, Homo sapiens
tagatagatctatgt

SEQ ID NO: 336000 - DNA, 15 bp, Homo sapiens
agatagatctatgtc

SEQ ID NO: 336001 - DNA, 15 bp, Homo sapiens
gatagatctatgtca

SEQ ID NO: 336002 - DNA, 15 bp, Homo sapiens
atagatctatgtcat

SEQ ID NO: 336003 - DNA, 15 bp, Homo sapiens
tagatctatgtcatt

SEQ ID NO: 336004 - DNA, 15 bp, Homo sapiens
agatctatgtcattc

SEQ ID NO: 336005 - DNA, 15 bp, Homo sapiens
gatctatgtcattct

SEQ ID NO: 336006 - DNA, 15 bp, Homo sapiens
atctatgtcattctt

SEQ ID NO: 336007 - DNA, 15 bp, Homo sapiens
tctatgtcattcttt

SEQ ID NO: 336008 - DNA, 15 bp, Homo sapiens
ctatgtcattctttg

SEQ ID NO: 336009 - DNA, 15 bp, Homo sapiens
tatgtcattctttga

SEQ ID NO: 336010 - DNA, 15 bp, Homo sapiens
atgtcattctttgag

SEQ ID NO: 336011 - DNA, 15 bp, Homo sapiens
tgtcattctttgagc

SEQ ID NO: 336012 - DNA, 15 bp, Homo sapiens
gtcattctttgagca

SEQ ID NO: 336013 - DNA, 15 bp, Homo sapiens
tcattctttgagcac

SEQ ID NO: 336014 - DNA, 15 bp, Homo sapiens
cattctttgagcact

SEQ ID NO: 336015 - DNA, 15 bp, Homo sapiens
attctttgagcactt

SEQ ID NO: 336016 - DNA, 15 bp, Homo sapiens
ttctttgagcacttt

SEQ ID NO: 336017 - DNA, 15 bp, Homo sapiens
tctttgagcactttc

SEQ ID NO: 336018 - DNA, 15 bp, Homo sapiens
ctttgagcactttct

SEQ ID NO: 336019 - DNA, 15 bp, Homo sapiens
tttgagcactttctt

SEQ ID NO: 336020 - DNA, 15 bp, Homo sapiens
ttgagcactttctta

SEQ ID NO: 336021 - DNA, 15 bp, Homo sapiens
tgagcactttcttaa

SEQ ID NO: 336022 - DNA, 15 bp, Homo sapiens
gagcactttcttaaa

SEQ ID NO: 336023 - DNA, 15 bp, Homo sapiens
agcactttcttaaaa

SEQ ID NO: 336024 - DNA, 15 bp, Homo sapiens
gcactttcttaaaac

SEQ ID NO: 336025 - DNA, 15 bp, Homo sapiens
cactttcttaaaaca

SEQ ID NO: 336026 - DNA, 15 bp, Homo sapiens
actttcttaaaacat

SEQ ID NO: 336027 - DNA, 15 bp, Homo sapiens
ctttcttaaaacata

SEQ ID NO: 336028 - DNA, 15 bp, Homo sapiens
tttcttaaaacatat

SEQ ID NO: 336029 - DNA, 15 bp, Homo sapiens
ttcttaaaacatatt

SEQ ID NO: 336030 - DNA, 15 bp, Homo sapiens
tcttaaaacatattt

SEQ ID NO: 336031 - DNA, 15 bp, Homo sapiens
cttaaaacatattta

SEQ ID NO: 336032 - DNA, 15 bp, Homo sapiens
ttaaaacatatttac

SEQ ID NO: 336033 - DNA, 15 bp, Homo sapiens
taaaacatatttact

SEQ ID NO: 336034 - DNA, 15 bp, Homo sapiens
aaaacatatttacta

SEQ ID NO: 336035 - DNA, 15 bp, Homo sapiens
aaacatatttactaa

SEQ ID NO: 336036 - DNA, 15 bp, Homo sapiens
aacatatttactaat

SEQ ID NO: 336037 - DNA, 15 bp, Homo sapiens
acatatttactaatt

SEQ ID NO: 336038 - DNA, 15 bp, Homo sapiens
catatttactaattt

SEQ ID NO: 336039 - DNA, 15 bp, Homo sapiens
atatttactaattta

SEQ ID NO: 336040 - DNA, 15 bp, Homo sapiens
tatttactaatttag

SEQ ID NO: 336041 - DNA, 15 bp, Homo sapiens
atttactaatttaga

SEQ ID NO: 336042 - DNA, 15 bp, Homo sapiens
tttactaatttagaa

SEQ ID NO: 336043 - DNA, 15 bp, Homo sapiens
ttactaatttagaat

SEQ ID NO: 336044 - DNA, 15 bp, Homo sapiens
tactaatttagaata

SEQ ID NO: 336045 - DNA, 15 bp, Homo sapiens
actaatttagaataa

SEQ ID NO: 336046 - DNA, 15 bp, Homo sapiens
ctaatttagaataat

SEQ ID NO: 336047 - DNA, 15 bp, Homo sapiens
taatttagaataata

SEQ ID NO: 336048 - DNA, 15 bp, Homo sapiens
aatttagaataatac

SEQ ID NO: 336049 - DNA, 15 bp, Homo sapiens
atttagaataatact

SEQ ID NO: 336050 - DNA, 15 bp, Homo sapiens
tttagaataatacta

SEQ ID NO: 336051 - DNA, 15 bp, Homo sapiens
ttagaataatactat

SEQ ID NO: 336052 - DNA, 15 bp, Homo sapiens
tagaataatactata

SEQ ID NO: 336053 - DNA, 15 bp, Homo sapiens
agaataatactataa

SEQ ID NO: 336054 - DNA, 15 bp, Homo sapiens
gaataatactataaa

SEQ ID NO: 336055 - DNA, 15 bp, Homo sapiens
aataatactataaaa

SEQ ID NO: 336056 - DNA, 15 bp, Homo sapiens
ataatactataaaat

SEQ ID NO: 336057 - DNA, 15 bp, Homo sapiens
taatactataaaatg

SEQ ID NO: 336058 - DNA, 15 bp, Homo sapiens
aatactataaaatgt

SEQ ID NO: 336059 - DNA, 15 bp, Homo sapiens
atactataaaatgtt

SEQ ID NO: 336060 - DNA, 15 bp, Homo sapiens
tactataaaatgtta

SEQ ID NO: 336061 - DNA, 15 bp, Homo sapiens
actataaaatgttag

SEQ ID NO: 336062 - DNA, 15 bp, Homo sapiens
ctataaaatgttagt

SEQ ID NO: 336063 - DNA, 15 bp, Homo sapiens
tataaaatgttagtt

SEQ ID NO: 336064 - DNA, 15 bp, Homo sapiens
ataaaatgttagttc

SEQ ID NO: 336065 - DNA, 15 bp, Homo sapiens
taaaatgttagttct

SEQ ID NO: 336066 - DNA, 15 bp, Homo sapiens
aaaatgttagttcta

SEQ ID NO: 336067 - DNA, 15 bp, Homo sapiens
aaatgttagttctag

SEQ ID NO: 336068 - DNA, 15 bp, Homo sapiens
aatgttagttctaga

SEQ ID NO: 336069 - DNA, 15 bp, Homo sapiens
atgttagttctagag

SEQ ID NO: 336070 - DNA, 15 bp, Homo sapiens
tgttagttctagagt

SEQ ID NO: 336071 - DNA, 15 bp, Homo sapiens
gttagttctagagta

SEQ ID NO: 336072 - DNA, 15 bp, Homo sapiens
ttagttctagagtat

SEQ ID NO: 336073 - DNA, 15 bp, Homo sapiens
tagttctagagtata

SEQ ID NO: 336074 - DNA, 15 bp, Homo sapiens
agttctagagtataa

SEQ ID NO: 336075 - DNA, 15 bp, Homo sapiens
gttctagagtataat

SEQ ID NO: 336076 - DNA, 15 bp, Homo sapiens
ttctagagtataatc

SEQ ID NO: 336077 - DNA, 15 bp, Homo sapiens
tctagagtataatcg

SEQ ID NO: 336078 - DNA, 15 bp, Homo sapiens
ctagagtataatcgt

SEQ ID NO: 336079 - DNA, 15 bp, Homo sapiens
tagagtataatcgtg

SEQ ID NO: 336080 - DNA, 15 bp, Homo sapiens
agagtataatcgtga

SEQ ID NO: 336081 - DNA, 15 bp, Homo sapiens
gagtataatcgtgat

SEQ ID NO: 336082 - DNA, 15 bp, Homo sapiens
agtataatcgtgatt

SEQ ID NO: 336083 - DNA, 15 bp, Homo sapiens
gtataatcgtgattg

SEQ ID NO: 336084 - DNA, 15 bp, Homo sapiens
tataatcgtgattgc

SEQ ID NO: 336085 - DNA, 15 bp, Homo sapiens
ataatcgtgattgca

SEQ ID NO: 336086 - DNA, 15 bp, Homo sapiens
taatcgtgattgcag

SEQ ID NO: 336087 - DNA, 15 bp, Homo sapiens
aatcgtgattgcagt

SEQ ID NO: 336088 - DNA, 15 bp, Homo sapiens
atcgtgattgcagtc

SEQ ID NO: 336089 - DNA, 15 bp, Homo sapiens
tcgtgattgcagtca

SEQ ID NO: 336090 - DNA, 15 bp, Homo sapiens
cgtgattgcagtcag

SEQ ID NO: 336091 - DNA, 15 bp, Homo sapiens
gtgattgcagtcagg

SEQ ID NO: 336092 - DNA, 15 bp, Homo sapiens
tgattgcagtcagga

SEQ ID NO: 336093 - DNA, 15 bp, Homo sapiens
gattgcagtcaggaa

SEQ ID NO: 336094 - DNA, 15 bp, Homo sapiens
attgcagtcaggaaa

SEQ ID NO: 336095 - DNA, 15 bp, Homo sapiens
ttgcagtcaggaaag

SEQ ID NO: 336096 - DNA, 15 bp, Homo sapiens
tgcagtcaggaaaga

SEQ ID NO: 336097 - DNA, 15 bp, Homo sapiens
gcagtcaggaaagat

SEQ ID NO: 336098 - DNA, 15 bp, Homo sapiens
cagtcaggaaagata

SEQ ID NO: 336099 - DNA, 15 bp, Homo sapiens
agtcaggaaagatac

SEQ ID NO: 336100 - DNA, 15 bp, Homo sapiens
gtcaggaaagatact

SEQ ID NO: 336101 - DNA, 15 bp, Homo sapiens
tcaggaaagatactt

SEQ ID NO: 336102 - DNA, 15 bp, Homo sapiens
caggaaagatacttt

SEQ ID NO: 336103 - DNA, 15 bp, Homo sapiens
aggaaagatacttta

SEQ ID NO: 336104 - DNA, 15 bp, Homo sapiens
ggaaagatactttat

SEQ ID NO: 336105 - DNA, 15 bp, Homo sapiens
gaaagatactttatt

SEQ ID NO: 336106 - DNA, 15 bp, Homo sapiens
aaagatactttattt

SEQ ID NO: 336107 - DNA, 15 bp, Homo sapiens
aagatactttatttt

SEQ ID NO: 336108 - DNA, 15 bp, Homo sapiens
agatactttattttg

SEQ ID NO: 336109 - DNA, 15 bp, Homo sapiens
gatactttattttgt

SEQ ID NO: 336110 - DNA, 15 bp, Homo sapiens
atactttattttgta

SEQ ID NO: 336111 - DNA, 15 bp, Homo sapiens
tactttattttgtag

SEQ ID NO: 336112 - DNA, 15 bp, Homo sapiens
actttattttgtagt

SEQ ID NO: 336113 - DNA, 15 bp, Homo sapiens
ctttattttgtagtc

SEQ ID NO: 336114 - DNA, 15 bp, Homo sapiens
tttattttgtagtca

SEQ ID NO: 336115 - DNA, 15 bp, Homo sapiens
ttattttgtagtcac

SEQ ID NO: 336116 - DNA, 15 bp, Homo sapiens
tattttgtagtcact

SEQ ID NO: 336117 - DNA, 15 bp, Homo sapiens
attttgtagtcactc

SEQ ID NO: 336118 - DNA, 15 bp, Homo sapiens
ttttgtagtcactca

SEQ ID NO: 336119 - DNA, 15 bp, Homo sapiens
tttgtagtcactcaa

SEQ ID NO: 336120 - DNA, 15 bp, Homo sapiens
ttgtagtcactcaaa

SEQ ID NO: 336121 - DNA, 15 bp, Homo sapiens
tgtagtcactcaaaa

SEQ ID NO: 336122 - DNA, 15 bp, Homo sapiens
gtagtcactcaaaag

SEQ ID NO: 336123 - DNA, 15 bp, Homo sapiens
tagtcactcaaaagt

SEQ ID NO: 336124 - DNA, 15 bp, Homo sapiens
agtcactcaaaagtt

SEQ ID NO: 336125 - DNA, 15 bp, Homo sapiens
gtcactcaaaagttt

SEQ ID NO: 336126 - DNA, 15 bp, Homo sapiens
tcactcaaaagtttt

SEQ ID NO: 336127 - DNA, 15 bp, Homo sapiens
cactcaaaagttttt

SEQ ID NO: 336128 - DNA, 15 bp, Homo sapiens
actcaaaagtttttc

SEQ ID NO: 336129 - DNA, 15 bp, Homo sapiens
ctcaaaagtttttcc

SEQ ID NO: 336130 - DNA, 15 bp, Homo sapiens
tcaaaagtttttcct

SEQ ID NO: 336131 - DNA, 15 bp, Homo sapiens
caaaagtttttcctt

SEQ ID NO: 336132 - DNA, 15 bp, Homo sapiens
aaaagtttttccttt

SEQ ID NO: 336133 - DNA, 15 bp, Homo sapiens
aaagtttttcctttc

SEQ ID NO: 336134 - DNA, 15 bp, Homo sapiens
aagtttttcctttct

SEQ ID NO: 336135 - DNA, 15 bp, Homo sapiens
agtttttcctttctc

SEQ ID NO: 336136 - DNA, 15 bp, Homo sapiens
gtttttcctttctca

SEQ ID NO: 336137 - DNA, 15 bp, Homo sapiens
tttttcctttctcat

SEQ ID NO: 336138 - DNA, 15 bp, Homo sapiens
ttttcctttctcatt

SEQ ID NO: 336139 - DNA, 15 bp, Homo sapiens
tttcctttctcattt

SEQ ID NO: 336140 - DNA, 15 bp, Homo sapiens
ttcctttctcatttt

SEQ ID NO: 336141 - DNA, 15 bp, Homo sapiens
tcctttctcattttt

SEQ ID NO: 336142 - DNA, 15 bp, Homo sapiens
cctttctcatttttg

SEQ ID NO: 336143 - DNA, 15 bp, Homo sapiens
ctttctcatttttgt

SEQ ID NO: 336144 - DNA, 15 bp, Homo sapiens
tttctcatttttgta

SEQ ID NO: 336145 - DNA, 15 bp, Homo sapiens
ttctcatttttgtag

SEQ ID NO: 336146 - DNA, 15 bp, Homo sapiens
tctcatttttgtaga

SEQ ID NO: 336147 - DNA, 15 bp, Homo sapiens
ctcatttttgtagaa

SEQ ID NO: 336148 - DNA, 15 bp, Homo sapiens
tcatttttgtagaaa

SEQ ID NO: 336149 - DNA, 15 bp, Homo sapiens
catttttgtagaaaa

SEQ ID NO: 336150 - DNA, 15 bp, Homo sapiens
atttttgtagaaaat

SEQ ID NO: 336151 - DNA, 15 bp, Homo sapiens
tttttgtagaaaata

SEQ ID NO: 336152 - DNA, 15 bp, Homo sapiens
ttttgtagaaaataa

SEQ ID NO: 336153 - DNA, 15 bp, Homo sapiens
tttgtagaaaataaa

SEQ ID NO: 336154 - DNA, 15 bp, Homo sapiens
ttgtagaaaataaaa

SEQ ID NO: 336155 - DNA, 15 bp, Homo sapiens
tgtagaaaataaaat

SEQ ID NO: 336156 - DNA, 15 bp, Homo sapiens
gtagaaaataaaatt

SEQ ID NO: 336157 - DNA, 15 bp, Homo sapiens
tagaaaataaaattt

SEQ ID NO: 336158 - DNA, 15 bp, Homo sapiens
agaaaataaaattta

SEQ ID NO: 336159 - DNA, 15 bp, Homo sapiens
gaaaataaaatttaa

SEQ ID NO: 336160 - DNA, 15 bp, Homo sapiens
aaaataaaatttaat

SEQ ID NO: 336161 - DNA, 15 bp, Homo sapiens
aaataaaatttaatt

SEQ ID NO: 336162 - DNA, 15 bp, Homo sapiens
aataaaatttaattg

SEQ ID NO: 336163 - DNA, 15 bp, Homo sapiens
ataaaatttaattga

SEQ ID NO: 336164 - DNA, 15 bp, Homo sapiens
taaaatttaattgaa

SEQ ID NO: 336165 - DNA, 15 bp, Homo sapiens
aaaatttaattgaaa

SEQ ID NO: 336166 - DNA, 15 bp, Homo sapiens
aaatttaattgaaaa

SEQ ID NO: 336167 - DNA, 15 bp, Homo sapiens
aatttaattgaaaag

SEQ ID NO: 336168 - DNA, 15 bp, Homo sapiens
atttaattgaaaagg

SEQ ID NO: 336169 - DNA, 15 bp, Homo sapiens
tttaattgaaaaggt

SEQ ID NO: 336170 - DNA, 15 bp, Homo sapiens
ttaattgaaaaggtc

SEQ ID NO: 336171 - DNA, 15 bp, Homo sapiens
taattgaaaaggtct

SEQ ID NO: 336172 - DNA, 15 bp, Homo sapiens
aattgaaaaggtctt

SEQ ID NO: 336173 - DNA, 15 bp, Homo sapiens
attgaaaaggtcttt

SEQ ID NO: 336174 - DNA, 15 bp, Homo sapiens
ttgaaaaggtctttg

SEQ ID NO: 336175 - DNA, 15 bp, Homo sapiens
tgaaaaggtctttgt

SEQ ID NO: 336176 - DNA, 15 bp, Homo sapiens
gaaaaggtctttgta

SEQ ID NO: 336177 - DNA, 15 bp, Homo sapiens
aaaaggtctttgtaa

SEQ ID NO: 336178 - DNA, 15 bp, Homo sapiens
aaaggtctttgtaaa

SEQ ID NO: 336179 - DNA, 15 bp, Homo sapiens
aaggtctttgtaaac

SEQ ID NO: 336180 - DNA, 15 bp, Homo sapiens
aggtctttgtaaaca

SEQ ID NO: 336181 - DNA, 15 bp, Homo sapiens
ggtctttgtaaacac

SEQ ID NO: 336182 - DNA, 15 bp, Homo sapiens
gtctttgtaaacaca

SEQ ID NO: 336183 - DNA, 15 bp, Homo sapiens
tctttgtaaacacat

SEQ ID NO: 336184 - DNA, 15 bp, Homo sapiens
ctttgtaaacacata

SEQ ID NO: 336185 - DNA, 15 bp, Homo sapiens
tttgtaaacacatag

SEQ ID NO: 336186 - DNA, 15 bp, Homo sapiens
ttgtaaacacataga

SEQ ID NO: 336187 - DNA, 15 bp, Homo sapiens
tgtaaacacatagag

SEQ ID NO: 336188 - DNA, 15 bp, Homo sapiens
gtaaacacatagagt

SEQ ID NO: 336189 - DNA, 15 bp, Homo sapiens
taaacacatagagtt

SEQ ID NO: 336190 - DNA, 15 bp, Homo sapiens
aaacacatagagtta

SEQ ID NO: 336191 - DNA, 15 bp, Homo sapiens
aacacatagagttaa

SEQ ID NO: 336192 - DNA, 15 bp, Homo sapiens
acacatagagttaaa

SEQ ID NO: 336193 - DNA, 15 bp, Homo sapiens
cacatagagttaaat

SEQ ID NO: 336194 - DNA, 15 bp, Homo sapiens
acatagagttaaata

SEQ ID NO: 336195 - DNA, 15 bp, Homo sapiens
catagagttaaatat

SEQ ID NO: 336196 - DNA, 15 bp, Homo sapiens
atagagttaaatatg

SEQ ID NO: 336197 - DNA, 15 bp, Homo sapiens
tagagttaaatatga

SEQ ID NO: 336198 - DNA, 15 bp, Homo sapiens
agagttaaatatgac

SEQ ID NO: 336199 - DNA, 15 bp, Homo sapiens
gagttaaatatgact

SEQ ID NO: 336200 - DNA, 15 bp, Homo sapiens
agttaaatatgactt

SEQ ID NO: 336201 - DNA, 15 bp, Homo sapiens
gttaaatatgacttt

SEQ ID NO: 336202 - DNA, 15 bp, Homo sapiens
ttaaatatgactttc

SEQ ID NO: 336203 - DNA, 15 bp, Homo sapiens
taaatatgactttct

SEQ ID NO: 336204 - DNA, 15 bp, Homo sapiens
aaatatgactttcta

SEQ ID NO: 336205 - DNA, 15 bp, Homo sapiens
aatatgactttctat

SEQ ID NO: 336206 - DNA, 15 bp, Homo sapiens
atatgactttctatg

SEQ ID NO: 336207 - DNA, 15 bp, Homo sapiens
tatgactttctatga

SEQ ID NO: 336208 - DNA, 15 bp, Homo sapiens
atgactttctatgac

SEQ ID NO: 336209 - DNA, 15 bp, Homo sapiens
tgactttctatgact

SEQ ID NO: 336210 - DNA, 15 bp, Homo sapiens
gactttctatgactg

SEQ ID NO: 336211 - DNA, 15 bp, Homo sapiens
actttctatgactgt

SEQ ID NO: 336212 - DNA, 15 bp, Homo sapiens
ctttctatgactgtg

SEQ ID NO: 336213 - DNA, 15 bp, Homo sapiens
tttctatgactgtga

SEQ ID NO: 336214 - DNA, 15 bp, Homo sapiens
ttctatgactgtgaa

SEQ ID NO: 336215 - DNA, 15 bp, Homo sapiens
tctatgactgtgaaa

SEQ ID NO: 336216 - DNA, 15 bp, Homo sapiens
ctatgactgtgaaag

SEQ ID NO: 336217 - DNA, 15 bp, Homo sapiens
tatgactgtgaaagt

SEQ ID NO: 336218 - DNA, 15 bp, Homo sapiens
atgactgtgaaagtt

SEQ ID NO: 336219 - DNA, 15 bp, Homo sapiens
tgactgtgaaagtta

SEQ ID NO: 336220 - DNA, 15 bp, Homo sapiens
gactgtgaaagttat

SEQ ID NO: 336221 - DNA, 15 bp, Homo sapiens
actgtgaaagttatg

SEQ ID NO: 336222 - DNA, 15 bp, Homo sapiens
ctgtgaaagttatgt

SEQ ID NO: 336223 - DNA, 15 bp, Homo sapiens
tgtgaaagttatgtt

SEQ ID NO: 336224 - DNA, 15 bp, Homo sapiens
gtgaaagttatgttc

SEQ ID NO: 336225 - DNA, 15 bp, Homo sapiens
tgaaagttatgttca

SEQ ID NO: 336226 - DNA, 15 bp, Homo sapiens
gaaagttatgttcat

SEQ ID NO: 336227 - DNA, 15 bp, Homo sapiens
aaagttatgttcatt

SEQ ID NO: 336228 - DNA, 15 bp, Homo sapiens
aagttatgttcattg

SEQ ID NO: 336229 - DNA, 15 bp, Homo sapiens
agttatgttcattgt

SEQ ID NO: 336230 - DNA, 15 bp, Homo sapiens
gttatgttcattgta

SEQ ID NO: 336231 - DNA, 15 bp, Homo sapiens
ttatgttcattgtaa

SEQ ID NO: 336232 - DNA, 15 bp, Homo sapiens
tatgttcattgtaac

SEQ ID NO: 336233 - DNA, 15 bp, Homo sapiens
atgttcattgtaacc

SEQ ID NO: 336234 - DNA, 15 bp, Homo sapiens
tgttcattgtaacca

SEQ ID NO: 336235 - DNA, 15 bp, Homo sapiens
gttcattgtaaccaa

SEQ ID NO: 336236 - DNA, 15 bp, Homo sapiens
ttcattgtaaccaaa

SEQ ID NO: 336237 - DNA, 15 bp, Homo sapiens
tcattgtaaccaaac

SEQ ID NO: 336238 - DNA, 15 bp, Homo sapiens
cattgtaaccaaaca

SEQ ID NO: 336239 - DNA, 15 bp, Homo sapiens
attgtaaccaaacat

SEQ ID NO: 336240 - DNA, 15 bp, Homo sapiens
ttgtaaccaaacata

SEQ ID NO: 336241 - DNA, 15 bp, Homo sapiens
tgtaaccaaacatag

SEQ ID NO: 336242 - DNA, 15 bp, Homo sapiens
gtaaccaaacatagt

SEQ ID NO: 336243 - DNA, 15 bp, Homo sapiens
taaccaaacatagta

SEQ ID NO: 336244 - DNA, 15 bp, Homo sapiens
aaccaaacatagtac

SEQ ID NO: 336245 - DNA, 15 bp, Homo sapiens
accaaacatagtaca

SEQ ID NO: 336246 - DNA, 15 bp, Homo sapiens
ccaaacatagtacaa

SEQ ID NO: 336247 - DNA, 15 bp, Homo sapiens
caaacatagtacaag

SEQ ID NO: 336248 - DNA, 15 bp, Homo sapiens
aaacatagtacaagt

SEQ ID NO: 336249 - DNA, 15 bp, Homo sapiens
aacatagtacaagta

SEQ ID NO: 336250 - DNA, 15 bp, Homo sapiens
acatagtacaagtat

SEQ ID NO: 336251 - DNA, 15 bp, Homo sapiens
catagtacaagtatt

SEQ ID NO: 336252 - DNA, 15 bp, Homo sapiens
atagtacaagtattg

SEQ ID NO: 336253 - DNA, 15 bp, Homo sapiens
tagtacaagtattgc

SEQ ID NO: 336254 - DNA, 15 bp, Homo sapiens
agtacaagtattgct

SEQ ID NO: 336255 - DNA, 15 bp, Homo sapiens
gtacaagtattgctt

SEQ ID NO: 336256 - DNA, 15 bp, Homo sapiens
tacaagtattgctta

SEQ ID NO: 336257 - DNA, 15 bp, Homo sapiens
acaagtattgcttaa

SEQ ID NO: 336258 - DNA, 15 bp, Homo sapiens
caagtattgcttaag

SEQ ID NO: 336259 - DNA, 15 bp, Homo sapiens
aagtattgcttaaga

SEQ ID NO: 336260 - DNA, 15 bp, Homo sapiens
agtattgcttaagat

SEQ ID NO: 336261 - DNA, 15 bp, Homo sapiens
gtattgcttaagata

SEQ ID NO: 336262 - DNA, 15 bp, Homo sapiens
tattgcttaagatat

SEQ ID NO: 336263 - DNA, 15 bp, Homo sapiens
attgcttaagatata

SEQ ID NO: 336264 - DNA, 15 bp, Homo sapiens
ttgcttaagatatag

SEQ ID NO: 336265 - DNA, 15 bp, Homo sapiens
tgcttaagatataga

SEQ ID NO: 336266 - DNA, 15 bp, Homo sapiens
gcttaagatatagaa

SEQ ID NO: 336267 - DNA, 15 bp, Homo sapiens
cttaagatatagaaa

SEQ ID NO: 336268 - DNA, 15 bp, Homo sapiens
ttaagatatagaaaa

SEQ ID NO: 336269 - DNA, 15 bp, Homo sapiens
taagatatagaaaac

SEQ ID NO: 336270 - DNA, 15 bp, Homo sapiens
aagatatagaaaaca

SEQ ID NO: 336271 - DNA, 15 bp, Homo sapiens
agatatagaaaacac

SEQ ID NO: 336272 - DNA, 15 bp, Homo sapiens
gatatagaaaacaca

SEQ ID NO: 336273 - DNA, 15 bp, Homo sapiens
atatagaaaacacag

SEQ ID NO: 336274 - DNA, 15 bp, Homo sapiens
tatagaaaacacagt

SEQ ID NO: 336275 - DNA, 15 bp, Homo sapiens
atagaaaacacagta

SEQ ID NO: 336276 - DNA, 15 bp, Homo sapiens
tagaaaacacagtaa

SEQ ID NO: 336277 - DNA, 15 bp, Homo sapiens
agaaaacacagtaat

SEQ ID NO: 336278 - DNA, 15 bp, Homo sapiens
gaaaacacagtaatg

SEQ ID NO: 336279 - DNA, 15 bp, Homo sapiens
aaaacacagtaatgt

SEQ ID NO: 336280 - DNA, 15 bp, Homo sapiens
aaacacagtaatgta

SEQ ID NO: 336281 - DNA, 15 bp, Homo sapiens
aacacagtaatgtat

SEQ ID NO: 336282 - DNA, 15 bp, Homo sapiens
acacagtaatgtata

SEQ ID NO: 336283 - DNA, 15 bp, Homo sapiens
cacagtaatgtataa

SEQ ID NO: 336284 - DNA, 15 bp, Homo sapiens
acagtaatgtataaa

SEQ ID NO: 336285 - DNA, 15 bp, Homo sapiens
cagtaatgtataaaa

SEQ ID NO: 336286 - DNA, 15 bp, Homo sapiens
agtaatgtataaaag

SEQ ID NO: 336287 - DNA, 15 bp, Homo sapiens
gtaatgtataaaagt

SEQ ID NO: 336288 - DNA, 15 bp, Homo sapiens
taatgtataaaagtg

SEQ ID NO: 336289 - DNA, 15 bp, Homo sapiens
aatgtataaaagtga

SEQ ID NO: 336290 - DNA, 15 bp, Homo sapiens
atgtataaaagtgag

SEQ ID NO: 336291 - DNA, 15 bp, Homo sapiens
tgtataaaagtgagg

SEQ ID NO: 336292 - DNA, 15 bp, Homo sapiens
gtataaaagtgaggt

SEQ ID NO: 336293 - DNA, 15 bp, Homo sapiens
tataaaagtgaggta

SEQ ID NO: 336294 - DNA, 15 bp, Homo sapiens
ataaaagtgaggtaa

SEQ ID NO: 336295 - DNA, 15 bp, Homo sapiens
taaaagtgaggtaaa

SEQ ID NO: 336296 - DNA, 15 bp, Homo sapiens
aaaagtgaggtaaaa

SEQ ID NO: 336297 - DNA, 15 bp, Homo sapiens
aaagtgaggtaaaaa

SEQ ID NO: 336298 - DNA, 15 bp, Homo sapiens
aagtgaggtaaaaat

SEQ ID NO: 336299 - DNA, 15 bp, Homo sapiens
agtgaggtaaaaatc

SEQ ID NO: 336300 - DNA, 15 bp, Homo sapiens
gtgaggtaaaaatca

SEQ ID NO: 336301 - DNA, 15 bp, Homo sapiens
tgaggtaaaaatcac

SEQ ID NO: 336302 - DNA, 15 bp, Homo sapiens
gaggtaaaaatcacc

SEQ ID NO: 336303 - DNA, 15 bp, Homo sapiens
aggtaaaaatcacct

SEQ ID NO: 336304 - DNA, 15 bp, Homo sapiens
ggtaaaaatcacctc

SEQ ID NO: 336305 - DNA, 15 bp, Homo sapiens
gtaaaaatcacctca

SEQ ID NO: 336306 - DNA, 15 bp, Homo sapiens
taaaaatcacctcaa

SEQ ID NO: 336307 - DNA, 15 bp, Homo sapiens
aaaaatcacctcaaa

SEQ ID NO: 336308 - DNA, 15 bp, Homo sapiens
aaaatcacctcaaat

SEQ ID NO: 336309 - DNA, 15 bp, Homo sapiens
aaatcacctcaaatt

SEQ ID NO: 336310 - DNA, 15 bp, Homo sapiens
aatcacctcaaattc

SEQ ID NO: 336311 - DNA, 15 bp, Homo sapiens
atcacctcaaattct

SEQ ID NO: 336312 - DNA, 15 bp, Homo sapiens
tcacctcaaattcta

SEQ ID NO: 336313 - DNA, 15 bp, Homo sapiens
cacctcaaattctag

SEQ ID NO: 336314 - DNA, 15 bp, Homo sapiens
acctcaaattctagt

SEQ ID NO: 336315 - DNA, 15 bp, Homo sapiens
cctcaaattctagtc

SEQ ID NO: 336316 - DNA, 15 bp, Homo sapiens
ctcaaattctagtcc

SEQ ID NO: 336317 - DNA, 15 bp, Homo sapiens
tcaaattctagtccc

SEQ ID NO: 336318 - DNA, 15 bp, Homo sapiens
caaattctagtcccc

SEQ ID NO: 336319 - DNA, 15 bp, Homo sapiens
aaattctagtccccc

SEQ ID NO: 336320 - DNA, 15 bp, Homo sapiens
aattctagtccccca

SEQ ID NO: 336321 - DNA, 15 bp, Homo sapiens
attctagtcccccaa

SEQ ID NO: 336322 - DNA, 15 bp, Homo sapiens
ttctagtcccccaaa

SEQ ID NO: 336323 - DNA, 15 bp, Homo sapiens
tctagtcccccaaaa

SEQ ID NO: 336324 - DNA, 15 bp, Homo sapiens
ctagtcccccaaaat

SEQ ID NO: 336325 - DNA, 15 bp, Homo sapiens
tagtcccccaaaata

SEQ ID NO: 336326 - DNA, 15 bp, Homo sapiens
agtcccccaaaataa

SEQ ID NO: 336327 - DNA, 15 bp, Homo sapiens
gtcccccaaaataat

SEQ ID NO: 336328 - DNA, 15 bp, Homo sapiens
tcccccaaaataatc

SEQ ID NO: 336329 - DNA, 15 bp, Homo sapiens
cccccaaaataatca

SEQ ID NO: 336330 - DNA, 15 bp, Homo sapiens
ccccaaaataatcac

SEQ ID NO: 336331 - DNA, 15 bp, Homo sapiens
cccaaaataatcact

SEQ ID NO: 336332 - DNA, 15 bp, Homo sapiens
ccaaaataatcactg

SEQ ID NO: 336333 - DNA, 15 bp, Homo sapiens
caaaataatcactgt

SEQ ID NO: 336334 - DNA, 15 bp, Homo sapiens
aaaataatcactgtt

SEQ ID NO: 336335 - DNA, 15 bp, Homo sapiens
aaataatcactgtta

SEQ ID NO: 336336 - DNA, 15 bp, Homo sapiens
aataatcactgttaa

SEQ ID NO: 336337 - DNA, 15 bp, Homo sapiens
ataatcactgttaaa

SEQ ID NO: 336338 - DNA, 15 bp, Homo sapiens
taatcactgttaaaa

SEQ ID NO: 336339 - DNA, 15 bp, Homo sapiens
aatcactgttaaaat

SEQ ID NO: 336340 - DNA, 15 bp, Homo sapiens
atcactgttaaaatg

SEQ ID NO: 336341 - DNA, 15 bp, Homo sapiens
tcactgttaaaatgt

SEQ ID NO: 336342 - DNA, 15 bp, Homo sapiens
cactgttaaaatgta

SEQ ID NO: 336343 - DNA, 15 bp, Homo sapiens
actgttaaaatgtat

SEQ ID NO: 336344 - DNA, 15 bp, Homo sapiens
ctgttaaaatgtatt

SEQ ID NO: 336345 - DNA, 15 bp, Homo sapiens
tgttaaaatgtattg

SEQ ID NO: 336346 - DNA, 15 bp, Homo sapiens
gttaaaatgtattgc

SEQ ID NO: 336347 - DNA, 15 bp, Homo sapiens
ttaaaatgtattgct

SEQ ID NO: 336348 - DNA, 15 bp, Homo sapiens
taaaatgtattgctc

SEQ ID NO: 336349 - DNA, 15 bp, Homo sapiens
aaaatgtattgctct

SEQ ID NO: 336350 - DNA, 15 bp, Homo sapiens
aaatgtattgctcta

SEQ ID NO: 336351 - DNA, 15 bp, Homo sapiens
aatgtattgctctag

SEQ ID NO: 336352 - DNA, 15 bp, Homo sapiens
atgtattgctctagt

SEQ ID NO: 336353 - DNA, 15 bp, Homo sapiens
tgtattgctctagtg

SEQ ID NO: 336354 - DNA, 15 bp, Homo sapiens
gtattgctctagtgt

SEQ ID NO: 336355 - DNA, 15 bp, Homo sapiens
tattgctctagtgtc

SEQ ID NO: 336356 - DNA, 15 bp, Homo sapiens
attgctctagtgtct

SEQ ID NO: 336357 - DNA, 15 bp, Homo sapiens
ttgctctagtgtcta

SEQ ID NO: 336358 - DNA, 15 bp, Homo sapiens
tgctctagtgtctac

SEQ ID NO: 336359 - DNA, 15 bp, Homo sapiens
gctctagtgtctaca

SEQ ID NO: 336360 - DNA, 15 bp, Homo sapiens
ctctagtgtctacag

SEQ ID NO: 336361 - DNA, 15 bp, Homo sapiens
tctagtgtctacaga

SEQ ID NO: 336362 - DNA, 15 bp, Homo sapiens
ctagtgtctacagaa

SEQ ID NO: 336363 - DNA, 15 bp, Homo sapiens
tagtgtctacagaaa

SEQ ID NO: 336364 - DNA, 15 bp, Homo sapiens
agtgtctacagaaaa

SEQ ID NO: 336365 - DNA, 15 bp, Homo sapiens
gtctacagaaaaatc

SEQ ID NO: 336366 - DNA, 15 bp, Homo sapiens
tctacagaaaaatct

SEQ ID NO: 336367 - DNA, 15 bp, Homo sapiens
ctacagaaaaatctg

SEQ ID NO: 336368 - DNA, 15 bp, Homo sapiens
tacagaaaaatctga

SEQ ID NO: 336369 - DNA, 15 bp, Homo sapiens
acagaaaaatctgaa

SEQ ID NO: 336370 - DNA, 15 bp, Homo sapiens
cagaaaaatctgaag

SEQ ID NO: 336371 - DNA, 15 bp, Homo sapiens
agaaaaatctgaagt

SEQ ID NO: 336372 - DNA, 15 bp, Homo sapiens
gaaaaatctgaagta

SEQ ID NO: 336373 - DNA, 15 bp, Homo sapiens
aaaaatctgaagtaa

SEQ ID NO: 336374 - DNA, 15 bp, Homo sapiens
aaaatctgaagtaaa

SEQ ID NO: 336375 - DNA, 15 bp, Homo sapiens
aaatctgaagtaaaa

SEQ ID NO: 336376 - DNA, 15 bp, Homo sapiens
aatctgaagtaaaat

SEQ ID NO: 336377 - DNA, 15 bp, Homo sapiens
atctgaagtaaaatg

SEQ ID NO: 336378 - DNA, 15 bp, Homo sapiens
tctgaagtaaaatga

SEQ ID NO: 336379 - DNA, 15 bp, Homo sapiens
ctgaagtaaaatgaa

SEQ ID NO: 336380 - DNA, 15 bp, Homo sapiens
tgaagtaaaatgaat

SEQ ID NO: 336381 - DNA, 15 bp, Homo sapiens
gaagtaaaatgaatg

SEQ ID NO: 336382 - DNA, 15 bp, Homo sapiens
aagtaaaatgaatgc

SEQ ID NO: 336383 - DNA, 15 bp, Homo sapiens
agtaaaatgaatgcc

SEQ ID NO: 336384 - DNA, 15 bp, Homo sapiens
gtaaaatgaatgcca

SEQ ID NO: 336385 - DNA, 15 bp, Homo sapiens
taaaatgaatgccag

SEQ ID NO: 336386 - DNA, 15 bp, Homo sapiens
aaaatgaatgccagt

SEQ ID NO: 336387 - DNA, 15 bp, Homo sapiens
aaatgaatgccagtt

SEQ ID NO: 336388 - DNA, 15 bp, Homo sapiens
aatgaatgccagtta

SEQ ID NO: 336389 - DNA, 15 bp, Homo sapiens
atgaatgccagttac

SEQ ID NO: 336390 - DNA, 15 bp, Homo sapiens
tgaatgccagttacc

SEQ ID NO: 336391 - DNA, 15 bp, Homo sapiens
gaatgccagttacct

SEQ ID NO: 336392 - DNA, 15 bp, Homo sapiens
aatgccagttacctg

SEQ ID NO: 336393 - DNA, 15 bp, Homo sapiens
atgccagttacctga

SEQ ID NO: 336394 - DNA, 15 bp, Homo sapiens
tgccagttacctgat

SEQ ID NO: 336395 - DNA, 15 bp, Homo sapiens
gccagttacctgatc

SEQ ID NO: 336396 - DNA, 15 bp, Homo sapiens
ccagttacctgatcc

SEQ ID NO: 336397 - DNA, 15 bp, Homo sapiens
cagttacctgatcca

SEQ ID NO: 336398 - DNA, 15 bp, Homo sapiens
agttacctgatccat

SEQ ID NO: 336399 - DNA, 15 bp, Homo sapiens
gttacctgatccata

SEQ ID NO: 336400 - DNA, 15 bp, Homo sapiens
ttacctgatccataa

SEQ ID NO: 336401 - DNA, 15 bp, Homo sapiens
tacctgatccataat

SEQ ID NO: 336402 - DNA, 15 bp, Homo sapiens
acctgatccataatg

SEQ ID NO: 336403 - DNA, 15 bp, Homo sapiens
cctgatccataatgg

SEQ ID NO: 336404 - DNA, 15 bp, Homo sapiens
ctgatccataatggt

SEQ ID NO: 336405 - DNA, 15 bp, Homo sapiens
tgatccataatggtt

SEQ ID NO: 336406 - DNA, 15 bp, Homo sapiens
gatccataatggtta

SEQ ID NO: 336407 - DNA, 15 bp, Homo sapiens
atccataatggttaa

SEQ ID NO: 336408 - DNA, 15 bp, Homo sapiens
tccataatggttaat

SEQ ID NO: 336409 - DNA, 15 bp, Homo sapiens
ccataatggttaatt

SEQ ID NO: 336410 - DNA, 15 bp, Homo sapiens
cataatggttaatta

SEQ ID NO: 336411 - DNA, 15 bp, Homo sapiens
ataatggttaattag

SEQ ID NO: 336412 - DNA, 15 bp, Homo sapiens
taatggttaattagt

SEQ ID NO: 336413 - DNA, 15 bp, Homo sapiens
aatggttaattagtg

SEQ ID NO: 336414 - DNA, 15 bp, Homo sapiens
atggttaattagtgc

SEQ ID NO: 336415 - DNA, 15 bp, Homo sapiens
tggttaattagtgca

SEQ ID NO: 336416 - DNA, 15 bp, Homo sapiens
ggttaattagtgcaa

SEQ ID NO: 336417 - DNA, 15 bp, Homo sapiens
gttaattagtgcaat

SEQ ID NO: 336418 - DNA, 15 bp, Homo sapiens
ttaattagtgcaata

SEQ ID NO: 336419 - DNA, 15 bp, Homo sapiens
taattagtgcaatat

SEQ ID NO: 336420 - DNA, 15 bp, Homo sapiens
aattagtgcaatatt

SEQ ID NO: 336421 - DNA, 15 bp, Homo sapiens
attagtgcaatattg

SEQ ID NO: 336422 - DNA, 15 bp, Homo sapiens
ttagtgcaatattgc

SEQ ID NO: 336423 - DNA, 15 bp, Homo sapiens
tagtgcaatattgct

SEQ ID NO: 336424 - DNA, 15 bp, Homo sapiens
agtgcaatattgctt

SEQ ID NO: 336425 - DNA, 15 bp, Homo sapiens
gtgcaatattgcttt

SEQ ID NO: 336426 - DNA, 15 bp, Homo sapiens
tgcaatattgctttt

SEQ ID NO: 336427 - DNA, 15 bp, Homo sapiens
gcaatattgcttttt

SEQ ID NO: 336428 - DNA, 15 bp, Homo sapiens
caatattgctttttc

SEQ ID NO: 336429 - DNA, 15 bp, Homo sapiens
aatattgctttttca

SEQ ID NO: 336430 - DNA, 15 bp, Homo sapiens
atattgctttttcaa

SEQ ID NO: 336431 - DNA, 15 bp, Homo sapiens
tattgctttttcaag

SEQ ID NO: 336432 - DNA, 15 bp, Homo sapiens
attgctttttcaagg

SEQ ID NO: 336433 - DNA, 15 bp, Homo sapiens
ttgctttttcaagga

SEQ ID NO: 336434 - DNA, 15 bp, Homo sapiens
tgctttttcaaggac

SEQ ID NO: 336435 - DNA, 15 bp, Homo sapiens
gctttttcaaggact

SEQ ID NO: 336436 - DNA, 15 bp, Homo sapiens
ctttttcaaggactt

SEQ ID NO: 336437 - DNA, 15 bp, Homo sapiens
tttttcaaggacttc

SEQ ID NO: 336438 - DNA, 15 bp, Homo sapiens
ttttcaaggacttca

SEQ ID NO: 336439 - DNA, 15 bp, Homo sapiens
tttcaaggacttcat

SEQ ID NO: 336440 - DNA, 15 bp, Homo sapiens
ttcaaggacttcatt

SEQ ID NO: 336441 - DNA, 15 bp, Homo sapiens
tcaaggacttcattg

SEQ ID NO: 336442 - DNA, 15 bp, Homo sapiens
caaggacttcattga

SEQ ID NO: 336443 - DNA, 15 bp, Homo sapiens
aaggacttcattgaa

SEQ ID NO: 336444 - DNA, 15 bp, Homo sapiens
aggacttcattgaag

SEQ ID NO: 336445 - DNA, 15 bp, Homo sapiens
ggacttcattgaagt

SEQ ID NO: 336446 - DNA, 15 bp, Homo sapiens
gacttcattgaagta

SEQ ID NO: 336447 - DNA, 15 bp, Homo sapiens
acttcattgaagtaa

SEQ ID NO: 336448 - DNA, 15 bp, Homo sapiens
cttcattgaagtaag

SEQ ID NO: 336449 - DNA, 15 bp, Homo sapiens
ttcattgaagtaagt

SEQ ID NO: 336450 - DNA, 15 bp, Homo sapiens
tcattgaagtaagtt

SEQ ID NO: 336451 - DNA, 15 bp, Homo sapiens
cattgaagtaagttg

SEQ ID NO: 336452 - DNA, 15 bp, Homo sapiens
attgaagtaagttga

SEQ ID NO: 336453 - DNA, 15 bp, Homo sapiens
ttgaagtaagttgaa

SEQ ID NO: 336454 - DNA, 15 bp, Homo sapiens
tgaagtaagttgaag

SEQ ID NO: 336455 - DNA, 15 bp, Homo sapiens
gaagtaagttgaagt

SEQ ID NO: 336456 - DNA, 15 bp, Homo sapiens
aagtaagttgaagta

SEQ ID NO: 336457 - DNA, 15 bp, Homo sapiens
agtaagttgaagtaa

SEQ ID NO: 336458 - DNA, 15 bp, Homo sapiens
gtaagttgaagtaaa

SEQ ID NO: 336459 - DNA, 15 bp, Homo sapiens
taagttgaagtaaat

SEQ ID NO: 336460 - DNA, 15 bp, Homo sapiens
aagttgaagtaaatt

SEQ ID NO: 336461 - DNA, 15 bp, Homo sapiens
agttgaagtaaatta

SEQ ID NO: 336462 - DNA, 15 bp, Homo sapiens
gttgaagtaaattac

SEQ ID NO: 336463 - DNA, 15 bp, Homo sapiens
ttgaagtaaattact

SEQ ID NO: 336464 - DNA, 15 bp, Homo sapiens
tgaagtaaattactg

SEQ ID NO: 336465 - DNA, 15 bp, Homo sapiens
gaagtaaattactga

SEQ ID NO: 336466 - DNA, 15 bp, Homo sapiens
aagtaaattactgaa

SEQ ID NO: 336467 - DNA, 15 bp, Homo sapiens
agtaaattactgaag

SEQ ID NO: 336468 - DNA, 15 bp, Homo sapiens
gtaaattactgaagt

SEQ ID NO: 336469 - DNA, 15 bp, Homo sapiens
taaattactgaagta

SEQ ID NO: 336470 - DNA, 15 bp, Homo sapiens
aaattactgaagtat

SEQ ID NO: 336471 - DNA, 15 bp, Homo sapiens
aattactgaagtatt

SEQ ID NO: 336472 - DNA, 15 bp, Homo sapiens
attactgaagtatta

SEQ ID NO: 336473 - DNA, 15 bp, Homo sapiens
ttactgaagtattag

SEQ ID NO: 336474 - DNA, 15 bp, Homo sapiens
tactgaagtattagt

SEQ ID NO: 336475 - DNA, 15 bp, Homo sapiens
actgaagtattagtt

SEQ ID NO: 336476 - DNA, 15 bp, Homo sapiens
ctgaagtattagtta

SEQ ID NO: 336477 - DNA, 15 bp, Homo sapiens
tgaagtattagttat

SEQ ID NO: 336478 - DNA, 15 bp, Homo sapiens
gaagtattagttatg

SEQ ID NO: 336479 - DNA, 15 bp, Homo sapiens
aagtattagttatgg

SEQ ID NO: 336480 - DNA, 15 bp, Homo sapiens
agtattagttatgga

SEQ ID NO: 336481 - DNA, 15 bp, Homo sapiens
gtattagttatggac

SEQ ID NO: 336482 - DNA, 15 bp, Homo sapiens
tattagttatggaca

SEQ ID NO: 336483 - DNA, 15 bp, Homo sapiens
attagttatggacag

SEQ ID NO: 336484 - DNA, 15 bp, Homo sapiens
ttagttatggacagg

SEQ ID NO: 336485 - DNA, 15 bp, Homo sapiens
tagttatggacaggc

SEQ ID NO: 336486 - DNA, 15 bp, Homo sapiens
agttatggacaggcc

SEQ ID NO: 336487 - DNA, 15 bp, Homo sapiens
gttatggacaggcct

SEQ ID NO: 336488 - DNA, 15 bp, Homo sapiens
ttatggacaggcctg

SEQ ID NO: 336489 - DNA, 15 bp, Homo sapiens
tatggacaggcctgg

SEQ ID NO: 336490 - DNA, 15 bp, Homo sapiens
atggacaggcctggt

SEQ ID NO: 336491 - DNA, 15 bp, Homo sapiens
tggacaggcctggtt

SEQ ID NO: 336492 - DNA, 15 bp, Homo sapiens
ggacaggcctggttt

SEQ ID NO: 336493 - DNA, 15 bp, Homo sapiens
gacaggcctggtttc

SEQ ID NO: 336494 - DNA, 15 bp, Homo sapiens
acaggcctggtttct

SEQ ID NO: 336495 - DNA, 15 bp, Homo sapiens
caggcctggtttctc

SEQ ID NO: 336496 - DNA, 15 bp, Homo sapiens
aggcctggtttctct

SEQ ID NO: 336497 - DNA, 15 bp, Homo sapiens
ggcctggtttctctt

SEQ ID NO: 336498 - DNA, 15 bp, Homo sapiens
gcctggtttctctta

SEQ ID NO: 336499 - DNA, 15 bp, Homo sapiens
cctggtttctcttac

SEQ ID NO: 336500 - DNA, 15 bp, Homo sapiens
ctggtttctcttaca

SEQ ID NO: 336501 - DNA, 15 bp, Homo sapiens
tggtttctcttacat

SEQ ID NO: 336502 - DNA, 15 bp, Homo sapiens
ggtttctcttacata

SEQ ID NO: 336503 - DNA, 15 bp, Homo sapiens
gtttctcttacatag

SEQ ID NO: 336504 - DNA, 15 bp, Homo sapiens
tttctcttacatagg

SEQ ID NO: 336505 - DNA, 15 bp, Homo sapiens
ttctcttacataggt

SEQ ID NO: 336506 - DNA, 15 bp, Homo sapiens
tctcttacataggtg

SEQ ID NO: 336507 - DNA, 15 bp, Homo sapiens
ctcttacataggtga

SEQ ID NO: 336508 - DNA, 15 bp, Homo sapiens
tcttacataggtgaa

SEQ ID NO: 336509 - DNA, 15 bp, Homo sapiens
cttacataggtgaaa

SEQ ID NO: 336510 - DNA, 15 bp, Homo sapiens
ttacataggtgaaag

SEQ ID NO: 336511 - DNA, 15 bp, Homo sapiens
tacataggtgaaaga

SEQ ID NO: 336512 - DNA, 15 bp, Homo sapiens
acataggtgaaagat

SEQ ID NO: 336513 - DNA, 15 bp, Homo sapiens
cataggtgaaagatg

SEQ ID NO: 336514 - DNA, 15 bp, Homo sapiens
ataggtgaaagatgt

SEQ ID NO: 336515 - DNA, 15 bp, Homo sapiens
taggtgaaagatgtc

SEQ ID NO: 336516 - DNA, 15 bp, Homo sapiens
aggtgaaagatgtca

SEQ ID NO: 336517 - DNA, 15 bp, Homo sapiens
ggtgaaagatgtcat

SEQ ID NO: 336518 - DNA, 15 bp, Homo sapiens
gtgaaagatgtcatg

SEQ ID NO: 336519 - DNA, 15 bp, Homo sapiens
tgaaagatgtcatga

SEQ ID NO: 336520 - DNA, 15 bp, Homo sapiens
gaaagatgtcatgaa

SEQ ID NO: 336521 - DNA, 15 bp, Homo sapiens
aaagatgtcatgaag

SEQ ID NO: 336522 - DNA, 15 bp, Homo sapiens
aagatgtcatgaagg

SEQ ID NO: 336523 - DNA, 15 bp, Homo sapiens
agatgtcatgaagga

SEQ ID NO: 336524 - DNA, 15 bp, Homo sapiens
gatgtcatgaaggat

SEQ ID NO: 336525 - DNA, 15 bp, Homo sapiens
atgtcatgaaggatg

SEQ ID NO: 336526 - DNA, 15 bp, Homo sapiens
tgtcatgaaggatgt

SEQ ID NO: 336527 - DNA, 15 bp, Homo sapiens
gtcatgaaggatgtc

SEQ ID NO: 336528 - DNA, 15 bp, Homo sapiens
tcatgaaggatgtca

SEQ ID NO: 336529 - DNA, 15 bp, Homo sapiens
catgaaggatgtcat

SEQ ID NO: 336530 - DNA, 15 bp, Homo sapiens
atgaaggatgtcatg

SEQ ID NO: 336531 - DNA, 15 bp, Homo sapiens
tgaaggatgtcatgt

SEQ ID NO: 336532 - DNA, 15 bp, Homo sapiens
gaaggatgtcatgtc

SEQ ID NO: 336533 - DNA, 15 bp, Homo sapiens
aaggatgtcatgtcg

SEQ ID NO: 336534 - DNA, 15 bp, Homo sapiens
aggatgtcatgtcgg

SEQ ID NO: 336535 - DNA, 15 bp, Homo sapiens
ggatgtcatgtcgga

SEQ ID NO: 336536 - DNA, 15 bp, Homo sapiens
gatgtcatgtcggac

SEQ ID NO: 336537 - DNA, 15 bp, Homo sapiens
atgtcatgtcggacc

SEQ ID NO: 336538 - DNA, 15 bp, Homo sapiens
tgtcatgtcggacct

SEQ ID NO: 336539 - DNA, 15 bp, Homo sapiens
gtcatgtcggacctg

SEQ ID NO: 336540 - DNA, 15 bp, Homo sapiens
tcatgtcggacctgc

SEQ ID NO: 336541 - DNA, 15 bp, Homo sapiens
catgtcggacctgca

SEQ ID NO: 336542 - DNA, 15 bp, Homo sapiens
atgtcggacctgcag

SEQ ID NO: 336543 - DNA, 15 bp, Homo sapiens
tgtcggacctgcagc

SEQ ID NO: 336544 - DNA, 15 bp, Homo sapiens
gtcggacctgcagca

SEQ ID NO: 336545 - DNA, 15 bp, Homo sapiens
tcggacctgcagcag

SEQ ID NO: 336546 - DNA, 15 bp, Homo sapiens
cggacctgcagcaga

SEQ ID NO: 336547 - DNA, 15 bp, Homo sapiens
ggacctgcagcagac

SEQ ID NO: 336548 - DNA, 15 bp, Homo sapiens
gacctgcagcagacg

SEQ ID NO: 336549 - DNA, 15 bp, Homo sapiens
acctgcagcagacga

SEQ ID NO: 336550 - DNA, 15 bp, Homo sapiens
cctgcagcagacgaa

SEQ ID NO: 336551 - DNA, 15 bp, Homo sapiens
ctgcagcagacgaac

SEQ ID NO: 336552 - DNA, 15 bp, Homo sapiens
tgcagcagacgaaca

SEQ ID NO: 336553 - DNA, 15 bp, Homo sapiens
gcagcagacgaacag

SEQ ID NO: 336554 - DNA, 15 bp, Homo sapiens
cagcagacgaacagt

SEQ ID NO: 336555 - DNA, 15 bp, Homo sapiens
agcagacgaacagtg

SEQ ID NO: 336556 - DNA, 15 bp, Homo sapiens
gcagacgaacagtga

SEQ ID NO: 336557 - DNA, 15 bp, Homo sapiens
cagacgaacagtgag

SEQ ID NO: 336558 - DNA, 15 bp, Homo sapiens
agacgaacagtgaga

SEQ ID NO: 336559 - DNA, 15 bp, Homo sapiens
gacgaacagtgagaa

SEQ ID NO: 336560 - DNA, 15 bp, Homo sapiens
acgaacagtgagaag

SEQ ID NO: 336561 - DNA, 15 bp, Homo sapiens
cgaacagtgagaaga

SEQ ID NO: 336562 - DNA, 15 bp, Homo sapiens
gaacagtgagaagat

SEQ ID NO: 336563 - DNA, 15 bp, Homo sapiens
aacagtgagaagatc

SEQ ID NO: 336564 - DNA, 15 bp, Homo sapiens
acagtgagaagatcc

SEQ ID NO: 336565 - DNA, 15 bp, Homo sapiens
cagtgagaagatcct

SEQ ID NO: 336566 - DNA, 15 bp, Homo sapiens
agtgagaagatcctg

SEQ ID NO: 336567 - DNA, 15 bp, Homo sapiens
gtgagaagatcctgc

SEQ ID NO: 336568 - DNA, 15 bp, Homo sapiens
tgagaagatcctgct

SEQ ID NO: 336569 - DNA, 15 bp, Homo sapiens
gagaagatcctgctc

SEQ ID NO: 336570 - DNA, 15 bp, Homo sapiens
agaagatcctgctca

SEQ ID NO: 336571 - DNA, 15 bp, Homo sapiens
gaagatcctgctcag

SEQ ID NO: 336572 - DNA, 15 bp, Homo sapiens
aagatcctgctcagc

SEQ ID NO: 336573 - DNA, 15 bp, Homo sapiens
agatcctgctcagct

SEQ ID NO: 336574 - DNA, 15 bp, Homo sapiens
gatcctgctcagctg

SEQ ID NO: 336575 - DNA, 15 bp, Homo sapiens
atcctgctcagctgg

SEQ ID NO: 336576 - DNA, 15 bp, Homo sapiens
tcctgctcagctggg

SEQ ID NO: 336577 - DNA, 15 bp, Homo sapiens
cctgctcagctgggt

SEQ ID NO: 336578 - DNA, 15 bp, Homo sapiens
ctgctcagctgggtg

SEQ ID NO: 336579 - DNA, 15 bp, Homo sapiens
tgctcagctgggtgc

SEQ ID NO: 336580 - DNA, 15 bp, Homo sapiens
gctcagctgggtgcg

SEQ ID NO: 336581 - DNA, 15 bp, Homo sapiens
ctcagctgggtgcgt

SEQ ID NO: 336582 - DNA, 15 bp, Homo sapiens
tcagctgggtgcgtc

SEQ ID NO: 336583 - DNA, 15 bp, Homo sapiens
cagctgggtgcgtca

SEQ ID NO: 336584 - DNA, 15 bp, Homo sapiens
agctgggtgcgtcag

SEQ ID NO: 336585 - DNA, 15 bp, Homo sapiens
gctgggtgcgtcaga

SEQ ID NO: 336586 - DNA, 15 bp, Homo sapiens
ctgggtgcgtcagac

SEQ ID NO: 336587 - DNA, 15 bp, Homo sapiens
tgggtgcgtcagacc

SEQ ID NO: 336588 - DNA, 15 bp, Homo sapiens
gggtgcgtcagacca

SEQ ID NO: 336589 - DNA, 15 bp, Homo sapiens
ggtgcgtcagaccac

SEQ ID NO: 336590 - DNA, 15 bp, Homo sapiens
gtgcgtcagaccacc

SEQ ID NO: 336591 - DNA, 15 bp, Homo sapiens
tgcgtcagaccacca

SEQ ID NO: 336592 - DNA, 15 bp, Homo sapiens
gcgtcagaccaccag

SEQ ID NO: 336593 - DNA, 15 bp, Homo sapiens
cgtcagaccaccagg

SEQ ID NO: 336594 - DNA, 15 bp, Homo sapiens
gtcagaccaccaggc

SEQ ID NO: 336595 - DNA, 15 bp, Homo sapiens
tcagaccaccaggcc

SEQ ID NO: 336596 - DNA, 15 bp, Homo sapiens
cagaccaccaggccc

SEQ ID NO: 336597 - DNA, 15 bp, Homo sapiens
agaccaccaggccct

SEQ ID NO: 336598 - DNA, 15 bp, Homo sapiens
gaccaccaggcccta

SEQ ID NO: 336599 - DNA, 15 bp, Homo sapiens
accaccaggccctac

SEQ ID NO: 336600 - DNA, 15 bp, Homo sapiens
ccaccaggccctaca

SEQ ID NO: 336601 - DNA, 15 bp, Homo sapiens
caccaggccctacag

SEQ ID NO: 336602 - DNA, 15 bp, Homo sapiens
accaggccctacagc

SEQ ID NO: 336603 - DNA, 15 bp, Homo sapiens
ccaggccctacagcc

SEQ ID NO: 336604 - DNA, 15 bp, Homo sapiens
caggccctacagcca

SEQ ID NO: 336605 - DNA, 15 bp, Homo sapiens
aggccctacagccaa

SEQ ID NO: 336606 - DNA, 15 bp, Homo sapiens
ggccctacagccaag

SEQ ID NO: 336607 - DNA, 15 bp, Homo sapiens
gccctacagccaagt

SEQ ID NO: 336608 - DNA, 15 bp, Homo sapiens
ccctacagccaagtc

SEQ ID NO: 336609 - DNA, 15 bp, Homo sapiens
cctacagccaagtca

SEQ ID NO: 336610 - DNA, 15 bp, Homo sapiens
ctacagccaagtcaa

SEQ ID NO: 336611 - DNA, 15 bp, Homo sapiens
tacagccaagtcaac

SEQ ID NO: 336612 - DNA, 15 bp, Homo sapiens
acagccaagtcaacg

SEQ ID NO: 336613 - DNA, 15 bp, Homo sapiens
cagccaagtcaacgt

SEQ ID NO: 336614 - DNA, 15 bp, Homo sapiens
agccaagtcaacgtc

SEQ ID NO: 336615 - DNA, 15 bp, Homo sapiens
gccaagtcaacgtcc

SEQ ID NO: 336616 - DNA, 15 bp, Homo sapiens
ccaagtcaacgtcct

SEQ ID NO: 336617 - DNA, 15 bp, Homo sapiens
caagtcaacgtcctc

SEQ ID NO: 336618 - DNA, 15 bp, Homo sapiens
aagtcaacgtcctca

SEQ ID NO: 336619 - DNA, 15 bp, Homo sapiens
agtcaacgtcctcaa

SEQ ID NO: 336620 - DNA, 15 bp, Homo sapiens
gtcaacgtcctcaac

SEQ ID NO: 336621 - DNA, 15 bp, Homo sapiens
tcaacgtcctcaact

SEQ ID NO: 336622 - DNA, 15 bp, Homo sapiens
caacgtcctcaactt

SEQ ID NO: 336623 - DNA, 15 bp, Homo sapiens
aacgtcctcaacttc

SEQ ID NO: 336624 - DNA, 15 bp, Homo sapiens
acgtcctcaacttca

SEQ ID NO: 336625 - DNA, 15 bp, Homo sapiens
cgtcctcaacttcac

SEQ ID NO: 336626 - DNA, 15 bp, Homo sapiens
gtcctcaacttcacc

SEQ ID NO: 336627 - DNA, 15 bp, Homo sapiens
tcctcaacttcacca

SEQ ID NO: 336628 - DNA, 15 bp, Homo sapiens
cctcaacttcaccac

SEQ ID NO: 336629 - DNA, 15 bp, Homo sapiens
ctcaacttcaccacc

SEQ ID NO: 336630 - DNA, 15 bp, Homo sapiens
tcaacttcaccacca

SEQ ID NO: 336631 - DNA, 15 bp, Homo sapiens
caacttcaccaccag

SEQ ID NO: 336632 - DNA, 15 bp, Homo sapiens
aacttcaccaccagc

SEQ ID NO: 336633 - DNA, 15 bp, Homo sapiens
acttcaccaccagct

SEQ ID NO: 336634 - DNA, 15 bp, Homo sapiens
cttcaccaccagctg

SEQ ID NO: 336635 - DNA, 15 bp, Homo sapiens
ttcaccaccagctgg

SEQ ID NO: 336636 - DNA, 15 bp, Homo sapiens
tcaccaccagctgga

SEQ ID NO: 336637 - DNA, 15 bp, Homo sapiens
caccaccagctggac

SEQ ID NO: 336638 - DNA, 15 bp, Homo sapiens
accaccagctggaca

SEQ ID NO: 336639 - DNA, 15 bp, Homo sapiens
ccaccagctggacag

SEQ ID NO: 336640 - DNA, 15 bp, Homo sapiens
caccagctggacaga

SEQ ID NO: 336641 - DNA, 15 bp, Homo sapiens
accagctggacagat

SEQ ID NO: 336642 - DNA, 15 bp, Homo sapiens
ccagctggacagatg

SEQ ID NO: 336643 - DNA, 15 bp, Homo sapiens
cagctggacagatgg

SEQ ID NO: 336644 - DNA, 15 bp, Homo sapiens
agctggacagatgga

SEQ ID NO: 336645 - DNA, 15 bp, Homo sapiens
gctggacagatggac

SEQ ID NO: 336646 - DNA, 15 bp, Homo sapiens
ctggacagatggact

SEQ ID NO: 336647 - DNA, 15 bp, Homo sapiens
tggacagatggactc

SEQ ID NO: 336648 - DNA, 15 bp, Homo sapiens
ggacagatggactcg

SEQ ID NO: 336649 - DNA, 15 bp, Homo sapiens
gacagatggactcgc

SEQ ID NO: 336650 - DNA, 15 bp, Homo sapiens
acagatggactcgcc

SEQ ID NO: 336651 - DNA, 15 bp, Homo sapiens
cagatggactcgcct

SEQ ID NO: 336652 - DNA, 15 bp, Homo sapiens
agatggactcgcctt

SEQ ID NO: 336653 - DNA, 15 bp, Homo sapiens
gatggactcgccttt

SEQ ID NO: 336654 - DNA, 15 bp, Homo sapiens
atggactcgccttta

SEQ ID NO: 336655 - DNA, 15 bp, Homo sapiens
tggactcgcctttaa

SEQ ID NO: 336656 - DNA, 15 bp, Homo sapiens
ggactcgcctttaat

SEQ ID NO: 336657 - DNA, 15 bp, Homo sapiens
gactcgcctttaatg

SEQ ID NO: 336658 - DNA, 15 bp, Homo sapiens
actcgcctttaatgc

SEQ ID NO: 336659 - DNA, 15 bp, Homo sapiens
ctcgcctttaatgct

SEQ ID NO: 336660 - DNA, 15 bp, Homo sapiens
tcgcctttaatgctg

SEQ ID NO: 336661 - DNA, 15 bp, Homo sapiens
cgcctttaatgctgt

SEQ ID NO: 336662 - DNA, 15 bp, Homo sapiens
gcctttaatgctgtc

SEQ ID NO: 336663 - DNA, 15 bp, Homo sapiens
cctttaatgctgtcc

SEQ ID NO: 336664 - DNA, 15 bp, Homo sapiens
ctttaatgctgtcct

SEQ ID NO: 336665 - DNA, 15 bp, Homo sapiens
tttaatgctgtcctc

SEQ ID NO: 336666 - DNA, 15 bp, Homo sapiens
ttaatgctgtcctcc

SEQ ID NO: 336667 - DNA, 15 bp, Homo sapiens
taatgctgtcctcca

SEQ ID NO: 336668 - DNA, 15 bp, Homo sapiens
aatgctgtcctccac

SEQ ID NO: 336669 - DNA, 15 bp, Homo sapiens
atgctgtcctccacc

SEQ ID NO: 336670 - DNA, 15 bp, Homo sapiens
tgctgtcctccaccg

SEQ ID NO: 336671 - DNA, 15 bp, Homo sapiens
gctgtcctccaccga

SEQ ID NO: 336672 - DNA, 15 bp, Homo sapiens
ctgtcctccaccgac

SEQ ID NO: 336673 - DNA, 15 bp, Homo sapiens
tgtcctccaccgaca

SEQ ID NO: 336674 - DNA, 15 bp, Homo sapiens
gtcctccaccgacat

SEQ ID NO: 336675 - DNA, 15 bp, Homo sapiens
tcctccaccgacata

SEQ ID NO: 336676 - DNA, 15 bp, Homo sapiens
cctccaccgacataa

SEQ ID NO: 336677 - DNA, 15 bp, Homo sapiens
ctccaccgacataag

SEQ ID NO: 336678 - DNA, 15 bp, Homo sapiens
tccaccgacataagt

SEQ ID NO: 336679 - DNA, 15 bp, Homo sapiens
ccaccgacataagtg

SEQ ID NO: 336680 - DNA, 15 bp, Homo sapiens
caccgacataagtga

SEQ ID NO: 336681 - DNA, 15 bp, Homo sapiens
accgacataagtgag

SEQ ID NO: 336682 - DNA, 15 bp, Homo sapiens
ccgacataagtgaga

SEQ ID NO: 336683 - DNA, 15 bp, Homo sapiens
cgacataagtgagac

SEQ ID NO: 336684 - DNA, 15 bp, Homo sapiens
gacataagtgagaca

SEQ ID NO: 336685 - DNA, 15 bp, Homo sapiens
acataagtgagacat

SEQ ID NO: 336686 - DNA, 15 bp, Homo sapiens
cataagtgagacatt

SEQ ID NO: 336687 - DNA, 15 bp, Homo sapiens
ataagtgagacatta

SEQ ID NO: 336688 - DNA, 15 bp, Homo sapiens
taagtgagacattac

SEQ ID NO: 336689 - DNA, 15 bp, Homo sapiens
aagtgagacattact

SEQ ID NO: 336690 - DNA, 15 bp, Homo sapiens
agtgagacattactc

SEQ ID NO: 336691 - DNA, 15 bp, Homo sapiens
gtgagacattactct

SEQ ID NO: 336692 - DNA, 15 bp, Homo sapiens
tgagacattactcta

SEQ ID NO: 336693 - DNA, 15 bp, Homo sapiens
gagacattactctat

SEQ ID NO: 336694 - DNA, 15 bp, Homo sapiens
agacattactctatc

SEQ ID NO: 336695 - DNA, 15 bp, Homo sapiens
gacattactctatct

SEQ ID NO: 336696 - DNA, 15 bp, Homo sapiens
acattactctatcta

SEQ ID NO: 336697 - DNA, 15 bp, Homo sapiens
cattactctatctag

SEQ ID NO: 336698 - DNA, 15 bp, Homo sapiens
attactctatctaga

SEQ ID NO: 336699 - DNA, 15 bp, Homo sapiens
ttactctatctagaa

SEQ ID NO: 336700 - DNA, 15 bp, Homo sapiens
tactctatctagaag

SEQ ID NO: 336701 - DNA, 15 bp, Homo sapiens
actctatctagaagt

SEQ ID NO: 336702 - DNA, 15 bp, Homo sapiens
ctctatctagaagtg

SEQ ID NO: 336703 - DNA, 15 bp, Homo sapiens
tctatctagaagtgg

SEQ ID NO: 336704 - DNA, 15 bp, Homo sapiens
ctatctagaagtggg

SEQ ID NO: 336705 - DNA, 15 bp, Homo sapiens
tatctagaagtgggc

SEQ ID NO: 336706 - DNA, 15 bp, Homo sapiens
atctagaagtgggct

SEQ ID NO: 336707 - DNA, 15 bp, Homo sapiens
tctagaagtgggctt

SEQ ID NO: 336708 - DNA, 15 bp, Homo sapiens
ctagaagtgggcttt

SEQ ID NO: 336709 - DNA, 15 bp, Homo sapiens
tagaagtgggcttta

SEQ ID NO: 336710 - DNA, 15 bp, Homo sapiens
agaagtgggctttac

SEQ ID NO: 336711 - DNA, 15 bp, Homo sapiens
gaagtgggctttaca

SEQ ID NO: 336712 - DNA, 15 bp, Homo sapiens
aagtgggctttacaa

SEQ ID NO: 336713 - DNA, 15 bp, Homo sapiens
agtgggctttacaaa

SEQ ID NO: 336714 - DNA, 15 bp, Homo sapiens
gtgggctttacaaat

SEQ ID NO: 336715 - DNA, 15 bp, Homo sapiens
tgggctttacaaatt

SEQ ID NO: 336716 - DNA, 15 bp, Homo sapiens
gggctttacaaattc

SEQ ID NO: 336717 - DNA, 15 bp, Homo sapiens
ggctttacaaattca

SEQ ID NO: 336718 - DNA, 15 bp, Homo sapiens
gctttacaaattcat

SEQ ID NO: 336719 - DNA, 15 bp, Homo sapiens
ctttacaaattcatg

SEQ ID NO: 336720 - DNA, 15 bp, Homo sapiens
tttacaaattcatgt

SEQ ID NO: 336721 - DNA, 15 bp, Homo sapiens
ttacaaattcatgtc

SEQ ID NO: 336722 - DNA, 15 bp, Homo sapiens
tacaaattcatgtct

SEQ ID NO: 336723 - DNA, 15 bp, Homo sapiens
acaaattcatgtctc

SEQ ID NO: 336724 - DNA, 15 bp, Homo sapiens
caaattcatgtctcc

SEQ ID NO: 336725 - DNA, 15 bp, Homo sapiens
aaattcatgtctcct

SEQ ID NO: 336726 - DNA, 15 bp, Homo sapiens
aattcatgtctcctc

SEQ ID NO: 336727 - DNA, 15 bp, Homo sapiens
attcatgtctcctct

SEQ ID NO: 336728 - DNA, 15 bp, Homo sapiens
ttcatgtctcctctc

SEQ ID NO: 336729 - DNA, 15 bp, Homo sapiens
tcatgtctcctctct

SEQ ID NO: 336730 - DNA, 15 bp, Homo sapiens
catgtctcctctctg

SEQ ID NO: 336731 - DNA, 15 bp, Homo sapiens
atgtctcctctctgt

SEQ ID NO: 336732 - DNA, 15 bp, Homo sapiens
tgtctcctctctgtc

SEQ ID NO: 336733 - DNA, 15 bp, Homo sapiens
gtctcctctctgtcc

SEQ ID NO: 336734 - DNA, 15 bp, Homo sapiens
tctcctctctgtccc

SEQ ID NO: 336735 - DNA, 15 bp, Homo sapiens
ctcctctctgtccct

SEQ ID NO: 336736 - DNA, 15 bp, Homo sapiens
tcctctctgtccctt

SEQ ID NO: 336737 - DNA, 15 bp, Homo sapiens
cctctctgtcccttt

SEQ ID NO: 336738 - DNA, 15 bp, Homo sapiens
ctctctgtccctttg

SEQ ID NO: 336739 - DNA, 15 bp, Homo sapiens
tctctgtccctttgc

SEQ ID NO: 336740 - DNA, 15 bp, Homo sapiens
ctctgtccctttgct

SEQ ID NO: 336741 - DNA, 15 bp, Homo sapiens
tctgtccctttgctg

SEQ ID NO: 336742 - DNA, 15 bp, Homo sapiens
ctgtccctttgctgc

SEQ ID NO: 336743 - DNA, 15 bp, Homo sapiens
tgtccctttgctgcc

SEQ ID NO: 336744 - DNA, 15 bp, Homo sapiens
gtccctttgctgcca

SEQ ID NO: 336745 - DNA, 15 bp, Homo sapiens
tccctttgctgccac

SEQ ID NO: 336746 - DNA, 15 bp, Homo sapiens
ccctttgctgccacc

SEQ ID NO: 336747 - DNA, 15 bp, Homo sapiens
cctttgctgccacca

SEQ ID NO: 336748 - DNA, 15 bp, Homo sapiens
ctttgctgccaccac

SEQ ID NO: 336749 - DNA, 15 bp, Homo sapiens
tttgctgccaccact

SEQ ID NO: 336750 - DNA, 15 bp, Homo sapiens
ttgctgccaccacta

SEQ ID NO: 336751 - DNA, 15 bp, Homo sapiens
tgctgccaccactac

SEQ ID NO: 336752 - DNA, 15 bp, Homo sapiens
gctgccaccactact

SEQ ID NO: 336753 - DNA, 15 bp, Homo sapiens
ctgccaccactactc

SEQ ID NO: 336754 - DNA, 15 bp, Homo sapiens
tgccaccactactcc

SEQ ID NO: 336755 - DNA, 15 bp, Homo sapiens
gccaccactactccc

SEQ ID NO: 336756 - DNA, 15 bp, Homo sapiens
ccaccactactccct

SEQ ID NO: 336757 - DNA, 15 bp, Homo sapiens
caccactactccctg

SEQ ID NO: 336758 - DNA, 15 bp, Homo sapiens
accactactccctga

SEQ ID NO: 336759 - DNA, 15 bp, Homo sapiens
ccactactccctgaa

SEQ ID NO: 336760 - DNA, 15 bp, Homo sapiens
cactactccctgaag

SEQ ID NO: 336761 - DNA, 15 bp, Homo sapiens
actactccctgaagc

SEQ ID NO: 336762 - DNA, 15 bp, Homo sapiens
ctactccctgaagcc

SEQ ID NO: 336763 - DNA, 15 bp, Homo sapiens
tactccctgaagccc

SEQ ID NO: 336764 - DNA, 15 bp, Homo sapiens
actccctgaagcccc

SEQ ID NO: 336765 - DNA, 15 bp, Homo sapiens
ctccctgaagcccct

SEQ ID NO: 336766 - DNA, 15 bp, Homo sapiens
tccctgaagcccctt

SEQ ID NO: 336767 - DNA, 15 bp, Homo sapiens
ccctgaagccccttc

SEQ ID NO: 336768 - DNA, 15 bp, Homo sapiens
cctgaagccccttct

SEQ ID NO: 336769 - DNA, 15 bp, Homo sapiens
ctgaagccccttctc

SEQ ID NO: 336770 - DNA, 15 bp, Homo sapiens
tgaagccccttctcc

SEQ ID NO: 336771 - DNA, 15 bp, Homo sapiens
gaagccccttctcca

SEQ ID NO: 336772 - DNA, 15 bp, Homo sapiens
aagccccttctccag

SEQ ID NO: 336773 - DNA, 15 bp, Homo sapiens
agccccttctccagt

SEQ ID NO: 336774 - DNA, 15 bp, Homo sapiens
gccccttctccagtg

SEQ ID NO: 336775 - DNA, 15 bp, Homo sapiens
ccccttctccagtgc

SEQ ID NO: 336776 - DNA, 15 bp, Homo sapiens
cccttctccagtgcc

SEQ ID NO: 336777 - DNA, 15 bp, Homo sapiens
ccttctccagtgcca

SEQ ID NO: 336778 - DNA, 15 bp, Homo sapiens
cttctccagtgccac

SEQ ID NO: 336779 - DNA, 15 bp, Homo sapiens
ttctccagtgccact

SEQ ID NO: 336780 - DNA, 15 bp, Homo sapiens
tctccagtgccactg

SEQ ID NO: 336781 - DNA, 15 bp, Homo sapiens
ctccagtgccactgc

SEQ ID NO: 336782 - DNA, 15 bp, Homo sapiens
tccagtgccactgct

SEQ ID NO: 336783 - DNA, 15 bp, Homo sapiens
ccagtgccactgctc

SEQ ID NO: 336784 - DNA, 15 bp, Homo sapiens
cagtgccactgctct

SEQ ID NO: 336785 - DNA, 15 bp, Homo sapiens
agtgccactgctctc

SEQ ID NO: 336786 - DNA, 15 bp, Homo sapiens
gtgccactgctctcc

SEQ ID NO: 336787 - DNA, 15 bp, Homo sapiens
tgccactgctctcct

SEQ ID NO: 336788 - DNA, 15 bp, Homo sapiens
gccactgctctcctt

SEQ ID NO: 336789 - DNA, 15 bp, Homo sapiens
ccactgctctccttt

SEQ ID NO: 336790 - DNA, 15 bp, Homo sapiens
cactgctctcctttc

SEQ ID NO: 336791 - DNA, 15 bp, Homo sapiens
actgctctcctttct

SEQ ID NO: 336792 - DNA, 15 bp, Homo sapiens
ctgctctcctttctg

SEQ ID NO: 336793 - DNA, 15 bp, Homo sapiens
tgctctcctttctgc

SEQ ID NO: 336794 - DNA, 15 bp, Homo sapiens
gctctcctttctgca

SEQ ID NO: 336795 - DNA, 15 bp, Homo sapiens
ctctcctttctgcac

SEQ ID NO: 336796 - DNA, 15 bp, Homo sapiens
tctcctttctgcaca

SEQ ID NO: 336797 - DNA, 15 bp, Homo sapiens
ctcctttctgcacat

SEQ ID NO: 336798 - DNA, 15 bp, Homo sapiens
tcctttctgcacatg

SEQ ID NO: 336799 - DNA, 15 bp, Homo sapiens
cctttctgcacatgt

SEQ ID NO: 336800 - DNA, 15 bp, Homo sapiens
ctttctgcacatgtt

SEQ ID NO: 336801 - DNA, 15 bp, Homo sapiens
tttctgcacatgttc

SEQ ID NO: 336802 - DNA, 15 bp, Homo sapiens
ttctgcacatgttct

SEQ ID NO: 336803 - DNA, 15 bp, Homo sapiens
tctgcacatgttcta

SEQ ID NO: 336804 - DNA, 15 bp, Homo sapiens
ctgcacatgttctac

SEQ ID NO: 336805 - DNA, 15 bp, Homo sapiens
tgcacatgttctacc

SEQ ID NO: 336806 - DNA, 15 bp, Homo sapiens
gcacatgttctacca

SEQ ID NO: 336807 - DNA, 15 bp, Homo sapiens
cacatgttctaccaa

SEQ ID NO: 336808 - DNA, 15 bp, Homo sapiens
acatgttctaccaaa

SEQ ID NO: 336809 - DNA, 15 bp, Homo sapiens
catgttctaccaaaa

SEQ ID NO: 336810 - DNA, 15 bp, Homo sapiens
atgttctaccaaaac

SEQ ID NO: 336811 - DNA, 15 bp, Homo sapiens
tgttctaccaaaacc

SEQ ID NO: 336812 - DNA, 15 bp, Homo sapiens
gttctaccaaaacct

SEQ ID NO: 336813 - DNA, 15 bp, Homo sapiens
ttctaccaaaacctt

SEQ ID NO: 336814 - DNA, 15 bp, Homo sapiens
tctaccaaaacctta

SEQ ID NO: 336815 - DNA, 15 bp, Homo sapiens
ctaccaaaaccttaa

SEQ ID NO: 336816 - DNA, 15 bp, Homo sapiens
taccaaaaccttaag

SEQ ID NO: 336817 - DNA, 15 bp, Homo sapiens
accaaaaccttaaga

SEQ ID NO: 336818 - DNA, 15 bp, Homo sapiens
ccaaaaccttaagaa

SEQ ID NO: 336819 - DNA, 15 bp, Homo sapiens
caaaaccttaagaaa

SEQ ID NO: 336820 - DNA, 15 bp, Homo sapiens
aaaaccttaagaaaa

SEQ ID NO: 336821 - DNA, 15 bp, Homo sapiens
aaaccttaagaaaag

SEQ ID NO: 336822 - DNA, 15 bp, Homo sapiens
aaccttaagaaaaga

SEQ ID NO: 336823 - DNA, 15 bp, Homo sapiens
accttaagaaaagaa

SEQ ID NO: 336824 - DNA, 15 bp, Homo sapiens
ccttaagaaaagaaa

SEQ ID NO: 336825 - DNA, 15 bp, Homo sapiens
cttaagaaaagaaat

SEQ ID NO: 336826 - DNA, 15 bp, Homo sapiens
ttaagaaaagaaata

SEQ ID NO: 336827 - DNA, 15 bp, Homo sapiens
taagaaaagaaatat

SEQ ID NO: 336828 - DNA, 15 bp, Homo sapiens
aagaaaagaaatatc

SEQ ID NO: 336829 - DNA, 15 bp, Homo sapiens
agaaaagaaatatca

SEQ ID NO: 336830 - DNA, 15 bp, Homo sapiens
gaaaagaaatatcat

SEQ ID NO: 336831 - DNA, 15 bp, Homo sapiens
aaaagaaatatcatg

SEQ ID NO: 336832 - DNA, 15 bp, Homo sapiens
aaagaaatatcatgg

SEQ ID NO: 336833 - DNA, 15 bp, Homo sapiens
aagaaatatcatgga

SEQ ID NO: 336834 - DNA, 15 bp, Homo sapiens
agaaatatcatggaa

SEQ ID NO: 336835 - DNA, 15 bp, Homo sapiens
gaaatatcatggaag

SEQ ID NO: 336836 - DNA, 15 bp, Homo sapiens
aaatatcatggaaga

SEQ ID NO: 336837 - DNA, 15 bp, Homo sapiens
aatatcatggaagaa

SEQ ID NO: 336838 - DNA, 15 bp, Homo sapiens
atatcatggaagaaa

SEQ ID NO: 336839 - DNA, 15 bp, Homo sapiens
tatcatggaagaaaa

SEQ ID NO: 336840 - DNA, 15 bp, Homo sapiens
atcatggaagaaaac

SEQ ID NO: 336841 - DNA, 15 bp, Homo sapiens
tcatggaagaaaact

SEQ ID NO: 336842 - DNA, 15 bp, Homo sapiens
catggaagaaaacta

SEQ ID NO: 336843 - DNA, 15 bp, Homo sapiens
atggaagaaaactac

SEQ ID NO: 336844 - DNA, 15 bp, Homo sapiens
tggaagaaaactacc

SEQ ID NO: 336845 - DNA, 15 bp, Homo sapiens
ggaagaaaactaccc

SEQ ID NO: 336846 - DNA, 15 bp, Homo sapiens
gaagaaaactaccca

SEQ ID NO: 336847 - DNA, 15 bp, Homo sapiens
aagaaaactacccat

SEQ ID NO: 336848 - DNA, 15 bp, Homo sapiens
agaaaactacccatc

SEQ ID NO: 336849 - DNA, 15 bp, Homo sapiens
gaaaactacccatca

SEQ ID NO: 336850 - DNA, 15 bp, Homo sapiens
aaaactacccatcag

SEQ ID NO: 336851 - DNA, 15 bp, Homo sapiens
aaactacccatcagg

SEQ ID NO: 336852 - DNA, 15 bp, Homo sapiens
aactacccatcaggt

SEQ ID NO: 336853 - DNA, 15 bp, Homo sapiens
actacccatcaggtt

SEQ ID NO: 336854 - DNA, 15 bp, Homo sapiens
ctacccatcaggttt

SEQ ID NO: 336855 - DNA, 15 bp, Homo sapiens
tacccatcaggtttt

SEQ ID NO: 336856 - DNA, 15 bp, Homo sapiens
acccatcaggttttt

SEQ ID NO: 336857 - DNA, 15 bp, Homo sapiens
cccatcaggttttta

SEQ ID NO: 336858 - DNA, 15 bp, Homo sapiens
ccatcaggtttttat

SEQ ID NO: 336859 - DNA, 15 bp, Homo sapiens
catcaggtttttatt

SEQ ID NO: 336860 - DNA, 15 bp, Homo sapiens
atcaggtttttattt

SEQ ID NO: 336861 - DNA, 15 bp, Homo sapiens
tcaggtttttatttc

SEQ ID NO: 336862 - DNA, 15 bp, Homo sapiens
caggtttttatttcc

SEQ ID NO: 336863 - DNA, 15 bp, Homo sapiens
aggtttttatttcct

SEQ ID NO: 336864 - DNA, 15 bp, Homo sapiens
ggtttttatttcctt

SEQ ID NO: 336865 - DNA, 15 bp, Homo sapiens
gtttttatttcctta

SEQ ID NO: 336866 - DNA, 15 bp, Homo sapiens
tttttatttccttag

SEQ ID NO: 336867 - DNA, 15 bp, Homo sapiens
ttttatttccttagg

SEQ ID NO: 336868 - DNA, 15 bp, Homo sapiens
tttatttccttagga

SEQ ID NO: 336869 - DNA, 15 bp, Homo sapiens
ttatttccttaggac

SEQ ID NO: 336870 - DNA, 15 bp, Homo sapiens
tatttccttaggact

SEQ ID NO: 336871 - DNA, 15 bp, Homo sapiens
atttccttaggactt

SEQ ID NO: 336872 - DNA, 15 bp, Homo sapiens
tttccttaggactta

SEQ ID NO: 336873 - DNA, 15 bp, Homo sapiens
ttccttaggacttaa

SEQ ID NO: 336874 - DNA, 15 bp, Homo sapiens
tccttaggacttaaa

SEQ ID NO: 336875 - DNA, 15 bp, Homo sapiens
ccttaggacttaaat

SEQ ID NO: 336876 - DNA, 15 bp, Homo sapiens
cttaggacttaaatg

SEQ ID NO: 336877 - DNA, 15 bp, Homo sapiens
ttaggacttaaatgc

SEQ ID NO: 336878 - DNA, 15 bp, Homo sapiens
taggacttaaatgct

SEQ ID NO: 336879 - DNA, 15 bp, Homo sapiens
aggacttaaatgctg

SEQ ID NO: 336880 - DNA, 15 bp, Homo sapiens
ggacttaaatgctgc

SEQ ID NO: 336881 - DNA, 15 bp, Homo sapiens
gacttaaatgctgca

SEQ ID NO: 336882 - DNA, 15 bp, Homo sapiens
acttaaatgctgcaa

SEQ ID NO: 336883 - DNA, 15 bp, Homo sapiens
cttaaatgctgcaat

SEQ ID NO: 336884 - DNA, 15 bp, Homo sapiens
ttaaatgctgcaata

SEQ ID NO: 336885 - DNA, 15 bp, Homo sapiens
taaatgctgcaatac

SEQ ID NO: 336886 - DNA, 15 bp, Homo sapiens
aaatgctgcaataca

SEQ ID NO: 336887 - DNA, 15 bp, Homo sapiens
aatgctgcaatacaa

SEQ ID NO: 336888 - DNA, 15 bp, Homo sapiens
atgctgcaatacaag

SEQ ID NO: 336889 - DNA, 15 bp, Homo sapiens
tgctgcaatacaagg

SEQ ID NO: 336890 - DNA, 15 bp, Homo sapiens
gctgcaatacaaggt

SEQ ID NO: 336891 - DNA, 15 bp, Homo sapiens
ctgcaatacaaggtc

SEQ ID NO: 336892 - DNA, 15 bp, Homo sapiens
tgcaatacaaggtcc

SEQ ID NO: 336893 - DNA, 15 bp, Homo sapiens
gcaatacaaggtcca

SEQ ID NO: 336894 - DNA, 15 bp, Homo sapiens
caatacaaggtccat

SEQ ID NO: 336895 - DNA, 15 bp, Homo sapiens
aatacaaggtccata

SEQ ID NO: 336896 - DNA, 15 bp, Homo sapiens
atacaaggtccatag

SEQ ID NO: 336897 - DNA, 15 bp, Homo sapiens
tacaaggtccatagt

SEQ ID NO: 336898 - DNA, 15 bp, Homo sapiens
acaaggtccatagtt

SEQ ID NO: 336899 - DNA, 15 bp, Homo sapiens
caaggtccatagttt

SEQ ID NO: 336900 - DNA, 15 bp, Homo sapiens
aaggtccatagtttc

SEQ ID NO: 336901 - DNA, 15 bp, Homo sapiens
aggtccatagtttct

SEQ ID NO: 336902 - DNA, 15 bp, Homo sapiens
ggtccatagtttctc

SEQ ID NO: 336903 - DNA, 15 bp, Homo sapiens
gtccatagtttctcc

SEQ ID NO: 336904 - DNA, 15 bp, Homo sapiens
tccatagtttctcct

SEQ ID NO: 336905 - DNA, 15 bp, Homo sapiens
ccatagtttctcctg

SEQ ID NO: 336906 - DNA, 15 bp, Homo sapiens
catagtttctcctgc

SEQ ID NO: 336907 - DNA, 15 bp, Homo sapiens
atagtttctcctgca

SEQ ID NO: 336908 - DNA, 15 bp, Homo sapiens
tagtttctcctgcat

SEQ ID NO: 336909 - DNA, 15 bp, Homo sapiens
agtttctcctgcata

SEQ ID NO: 336910 - DNA, 15 bp, Homo sapiens
gtttctcctgcatat

SEQ ID NO: 336911 - DNA, 15 bp, Homo sapiens
tttctcctgcatatt

SEQ ID NO: 336912 - DNA, 15 bp, Homo sapiens
ttctcctgcatattt

SEQ ID NO: 336913 - DNA, 15 bp, Homo sapiens
tctcctgcatattta

SEQ ID NO: 336914 - DNA, 15 bp, Homo sapiens
ctcctgcatatttat

SEQ ID NO: 336915 - DNA, 15 bp, Homo sapiens
tcctgcatatttatg

SEQ ID NO: 336916 - DNA, 15 bp, Homo sapiens
cctgcatatttatga

SEQ ID NO: 336917 - DNA, 15 bp, Homo sapiens
ctgcatatttatgaa

SEQ ID NO: 336918 - DNA, 15 bp, Homo sapiens
tgcatatttatgaat

SEQ ID NO: 336919 - DNA, 15 bp, Homo sapiens
gcatatttatgaatt

SEQ ID NO: 336920 - DNA, 15 bp, Homo sapiens
catatttatgaattt

SEQ ID NO: 336921 - DNA, 15 bp, Homo sapiens
atatttatgaattta

SEQ ID NO: 336922 - DNA, 15 bp, Homo sapiens
tatttatgaatttaa

SEQ ID NO: 336923 - DNA, 15 bp, Homo sapiens
atttatgaatttaaa

SEQ ID NO: 336924 - DNA, 15 bp, Homo sapiens
tttatgaatttaaaa

SEQ ID NO: 336925 - DNA, 15 bp, Homo sapiens
ttatgaatttaaaaa

SEQ ID NO: 336926 - DNA, 15 bp, Homo sapiens
tatgaatttaaaaaa

SEQ ID NO: 336927 - DNA, 15 bp, Homo sapiens
atgaatttaaaaaat

SEQ ID NO: 336928 - DNA, 15 bp, Homo sapiens
tgaatttaaaaaata

SEQ ID NO: 336929 - DNA, 15 bp, Homo sapiens
gaatttaaaaaatat

SEQ ID NO: 336930 - DNA, 15 bp, Homo sapiens
aatttaaaaaatatg

SEQ ID NO: 336931 - DNA, 15 bp, Homo sapiens
taaaaaatatgaaat

SEQ ID NO: 336932 - DNA, 15 bp, Homo sapiens
aaaaaatatgaaata

SEQ ID NO: 336933 - DNA, 15 bp, Homo sapiens
aaaaatatgaaataa

SEQ ID NO: 336934 - DNA, 15 bp, Homo sapiens
aaaatatgaaataat

SEQ ID NO: 336935 - DNA, 15 bp, Homo sapiens
aaatatgaaataatt

SEQ ID NO: 336936 - DNA, 15 bp, Homo sapiens
aatatgaaataattc

SEQ ID NO: 336937 - DNA, 15 bp, Homo sapiens
atatgaaataattca

SEQ ID NO: 336938 - DNA, 15 bp, Homo sapiens
tatgaaataattcac

SEQ ID NO: 336939 - DNA, 15 bp, Homo sapiens
atgaaataattcaca

SEQ ID NO: 336940 - DNA, 15 bp, Homo sapiens
tgaaataattcacaa

SEQ ID NO: 336941 - DNA, 15 bp, Homo sapiens
gaaataattcacaaa

SEQ ID NO: 336942 - DNA, 15 bp, Homo sapiens
aaataattcacaaag

SEQ ID NO: 336943 - DNA, 15 bp, Homo sapiens
aataattcacaaagt

SEQ ID NO: 336944 - DNA, 15 bp, Homo sapiens
ataattcacaaagtt

SEQ ID NO: 336945 - DNA, 15 bp, Homo sapiens
taattcacaaagttc

SEQ ID NO: 336946 - DNA, 15 bp, Homo sapiens
aattcacaaagttca

SEQ ID NO: 336947 - DNA, 15 bp, Homo sapiens
attcacaaagttcaa

SEQ ID NO: 336948 - DNA, 15 bp, Homo sapiens
ttcacaaagttcaac

SEQ ID NO: 336949 - DNA, 15 bp, Homo sapiens
tcacaaagttcaacc

SEQ ID NO: 336950 - DNA, 15 bp, Homo sapiens
cacaaagttcaaccc

SEQ ID NO: 336951 - DNA, 15 bp, Homo sapiens
acaaagttcaacccc

SEQ ID NO: 336952 - DNA, 15 bp, Homo sapiens
caaagttcaacccca

SEQ ID NO: 336953 - DNA, 15 bp, Homo sapiens
aaagttcaaccccac

SEQ ID NO: 336954 - DNA, 15 bp, Homo sapiens
aagttcaaccccact

SEQ ID NO: 336955 - DNA, 15 bp, Homo sapiens
agttcaaccccactc

SEQ ID NO: 336956 - DNA, 15 bp, Homo sapiens
gttcaaccccactca

SEQ ID NO: 336957 - DNA, 15 bp, Homo sapiens
ttcaaccccactcat

SEQ ID NO: 336958 - DNA, 15 bp, Homo sapiens
tcaaccccactcatt

SEQ ID NO: 336959 - DNA, 15 bp, Homo sapiens
caaccccactcattc

SEQ ID NO: 336960 - DNA, 15 bp, Homo sapiens
aaccccactcattca

SEQ ID NO: 336961 - DNA, 15 bp, Homo sapiens
accccactcattcag

SEQ ID NO: 336962 - DNA, 15 bp, Homo sapiens
ccccactcattcagc

SEQ ID NO: 336963 - DNA, 15 bp, Homo sapiens
cccactcattcagca

SEQ ID NO: 336964 - DNA, 15 bp, Homo sapiens
ccactcattcagcac

SEQ ID NO: 336965 - DNA, 15 bp, Homo sapiens
cactcattcagcact

SEQ ID NO: 336966 - DNA, 15 bp, Homo sapiens
actcattcagcacta

SEQ ID NO: 336967 - DNA, 15 bp, Homo sapiens
ctcattcagcactaa

SEQ ID NO: 336968 - DNA, 15 bp, Homo sapiens
tcattcagcactaac

SEQ ID NO: 336969 - DNA, 15 bp, Homo sapiens
cattcagcactaact

SEQ ID NO: 336970 - DNA, 15 bp, Homo sapiens
attcagcactaactg

SEQ ID NO: 336971 - DNA, 15 bp, Homo sapiens
ttcagcactaactga

SEQ ID NO: 336972 - DNA, 15 bp, Homo sapiens
tcagcactaactgat

SEQ ID NO: 336973 - DNA, 15 bp, Homo sapiens
cagcactaactgata

SEQ ID NO: 336974 - DNA, 15 bp, Homo sapiens
agcactaactgataa

SEQ ID NO: 336975 - DNA, 15 bp, Homo sapiens
gcactaactgataat

SEQ ID NO: 336976 - DNA, 15 bp, Homo sapiens
cactaactgataatg

SEQ ID NO: 336977 - DNA, 15 bp, Homo sapiens
actaactgataatgt

SEQ ID NO: 336978 - DNA, 15 bp, Homo sapiens
ctaactgataatgta

SEQ ID NO: 336979 - DNA, 15 bp, Homo sapiens
taactgataatgtat

SEQ ID NO: 336980 - DNA, 15 bp, Homo sapiens
aactgataatgtata

SEQ ID NO: 336981 - DNA, 15 bp, Homo sapiens
actgataatgtatac

SEQ ID NO: 336982 - DNA, 15 bp, Homo sapiens
ctgataatgtataca

SEQ ID NO: 336983 - DNA, 15 bp, Homo sapiens
tgataatgtatacaa

SEQ ID NO: 336984 - DNA, 15 bp, Homo sapiens
gataatgtatacaaa

SEQ ID NO: 336985 - DNA, 15 bp, Homo sapiens
ataatgtatacaaaa

SEQ ID NO: 336986 - DNA, 15 bp, Homo sapiens
taatgtatacaaaaa

SEQ ID NO: 336987 - DNA, 15 bp, Homo sapiens
aatgtatacaaaaaa

SEQ ID NO: 336988 - DNA, 15 bp, Homo sapiens
atgtatacaaaaaat

SEQ ID NO: 336989 - DNA, 15 bp, Homo sapiens
tgtatacaaaaaatt

SEQ ID NO: 336990 - DNA, 15 bp, Homo sapiens
gtatacaaaaaattg

SEQ ID NO: 336991 - DNA, 15 bp, Homo sapiens
tatacaaaaaattgt

SEQ ID NO: 336992 - DNA, 15 bp, Homo sapiens
atacaaaaaattgtg

SEQ ID NO: 336993 - DNA, 15 bp, Homo sapiens
tacaaaaaattgtgt

SEQ ID NO: 336994 - DNA, 15 bp, Homo sapiens
acaaaaaattgtgtt

SEQ ID NO: 336995 - DNA, 15 bp, Homo sapiens
caaaaaattgtgtta

SEQ ID NO: 336996 - DNA, 15 bp, Homo sapiens
aaaaaattgtgttag

SEQ ID NO: 336997 - DNA, 15 bp, Homo sapiens
aaaaattgtgttagc

SEQ ID NO: 336998 - DNA, 15 bp, Homo sapiens
aaaattgtgttagct

SEQ ID NO: 336999 - DNA, 15 bp, Homo sapiens
aaattgtgttagctt

SEQ ID NO: 337000 - DNA, 15 bp, Homo sapiens
aattgtgttagcttt

SEQ ID NO: 337001 - DNA, 15 bp, Homo sapiens
attgtgttagctttt

SEQ ID NO: 337002 - DNA, 15 bp, Homo sapiens
ttgtgttagcttttc

SEQ ID NO: 337003 - DNA, 15 bp, Homo sapiens
tgtgttagcttttct

SEQ ID NO: 337004 - DNA, 15 bp, Homo sapiens
gtgttagcttttctt

SEQ ID NO: 337005 - DNA, 15 bp, Homo sapiens
tgttagcttttcttc

SEQ ID NO: 337006 - DNA, 15 bp, Homo sapiens
gttagcttttcttct

SEQ ID NO: 337007 - DNA, 15 bp, Homo sapiens
ttagcttttcttctc

SEQ ID NO: 337008 - DNA, 15 bp, Homo sapiens
tagcttttcttctca

SEQ ID NO: 337009 - DNA, 15 bp, Homo sapiens
agcttttcttctcaa

SEQ ID NO: 337010 - DNA, 15 bp, Homo sapiens
gcttttcttctcaaa

SEQ ID NO: 337011 - DNA, 15 bp, Homo sapiens
cttttcttctcaaac

SEQ ID NO: 337012 - DNA, 15 bp, Homo sapiens
ttttcttctcaaact

SEQ ID NO: 337013 - DNA, 15 bp, Homo sapiens
tttcttctcaaactg

SEQ ID NO: 337014 - DNA, 15 bp, Homo sapiens
ttcttctcaaactga

SEQ ID NO: 337015 - DNA, 15 bp, Homo sapiens
tcttctcaaactgaa

SEQ ID NO: 337016 - DNA, 15 bp, Homo sapiens
cttctcaaactgaaa

SEQ ID NO: 337017 - DNA, 15 bp, Homo sapiens
ttctcaaactgaaag

SEQ ID NO: 337018 - DNA, 15 bp, Homo sapiens
tctcaaactgaaagt

SEQ ID NO: 337019 - DNA, 15 bp, Homo sapiens
ctcaaactgaaagta

SEQ ID NO: 337020 - DNA, 15 bp, Homo sapiens
tcaaactgaaagtaa

SEQ ID NO: 337021 - DNA, 15 bp, Homo sapiens
caaactgaaagtaaa

SEQ ID NO: 337022 - DNA, 15 bp, Homo sapiens
aaactgaaagtaaaa

SEQ ID NO: 337023 - DNA, 15 bp, Homo sapiens
aactgaaagtaaaac

SEQ ID NO: 337024 - DNA, 15 bp, Homo sapiens
actgaaagtaaaact

SEQ ID NO: 337025 - DNA, 15 bp, Homo sapiens
ctgaaagtaaaactc

SEQ ID NO: 337026 - DNA, 15 bp, Homo sapiens
tgaaagtaaaactct

SEQ ID NO: 337027 - DNA, 15 bp, Homo sapiens
gaaagtaaaactctg

SEQ ID NO: 337028 - DNA, 15 bp, Homo sapiens
aaagtaaaactctgt

SEQ ID NO: 337029 - DNA, 15 bp, Homo sapiens
aagtaaaactctgta

SEQ ID NO: 337030 - DNA, 15 bp, Homo sapiens
agtaaaactctgtaa

SEQ ID NO: 337031 - DNA, 15 bp, Homo sapiens
gtaaaactctgtaaa

SEQ ID NO: 337032 - DNA, 15 bp, Homo sapiens
taaaactctgtaaat

SEQ ID NO: 337033 - DNA, 15 bp, Homo sapiens
aaaactctgtaaatt

SEQ ID NO: 337034 - DNA, 15 bp, Homo sapiens
aaactctgtaaattc

SEQ ID NO: 337035 - DNA, 15 bp, Homo sapiens
aactctgtaaattca

SEQ ID NO: 337036 - DNA, 15 bp, Homo sapiens
actctgtaaattcaa

SEQ ID NO: 337037 - DNA, 15 bp, Homo sapiens
ctctgtaaattcaat

SEQ ID NO: 337038 - DNA, 15 bp, Homo sapiens
tctgtaaattcaatg

SEQ ID NO: 337039 - DNA, 15 bp, Homo sapiens
ctgtaaattcaatgc

SEQ ID NO: 337040 - DNA, 15 bp, Homo sapiens
tgtaaattcaatgca

SEQ ID NO: 337041 - DNA, 15 bp, Homo sapiens
gtaaattcaatgcat

SEQ ID NO: 337042 - DNA, 15 bp, Homo sapiens
taaattcaatgcatt

SEQ ID NO: 337043 - DNA, 15 bp, Homo sapiens
aaattcaatgcattc

SEQ ID NO: 337044 - DNA, 15 bp, Homo sapiens
aattcaatgcattcc

SEQ ID NO: 337045 - DNA, 15 bp, Homo sapiens
attcaatgcattccc

SEQ ID NO: 337046 - DNA, 15 bp, Homo sapiens
ttcaatgcattccca

SEQ ID NO: 337047 - DNA, 15 bp, Homo sapiens
tcaatgcattcccaa

SEQ ID NO: 337048 - DNA, 15 bp, Homo sapiens
caatgcattcccaat

SEQ ID NO: 337049 - DNA, 15 bp, Homo sapiens
aatgcattcccaatt

SEQ ID NO: 337050 - DNA, 15 bp, Homo sapiens
atgcattcccaatta

SEQ ID NO: 337051 - DNA, 15 bp, Homo sapiens
tgcattcccaattaa

SEQ ID NO: 337052 - DNA, 15 bp, Homo sapiens
gcattcccaattaaa

SEQ ID NO: 337053 - DNA, 15 bp, Homo sapiens
cattcccaattaaaa

SEQ ID NO: 337054 - DNA, 15 bp, Homo sapiens
attcccaattaaaaa

SEQ ID NO: 337055 - DNA, 15 bp, Homo sapiens
ttcccaattaaaaat

SEQ ID NO: 337056 - DNA, 15 bp, Homo sapiens
tcccaattaaaaata

SEQ ID NO: 337057 - DNA, 15 bp, Homo sapiens
cccaattaaaaatag

SEQ ID NO: 337058 - DNA, 15 bp, Homo sapiens
ccaattaaaaatagc

SEQ ID NO: 337059 - DNA, 15 bp, Homo sapiens
caattaaaaatagcc

SEQ ID NO: 337060 - DNA, 15 bp, Homo sapiens
aattaaaaatagcca

SEQ ID NO: 337061 - DNA, 15 bp, Homo sapiens
attaaaaatagccaa

SEQ ID NO: 337062 - DNA, 15 bp, Homo sapiens
ttaaaaatagccaaa

SEQ ID NO: 337063 - DNA, 15 bp, Homo sapiens
taaaaatagccaaat

SEQ ID NO: 337064 - DNA, 15 bp, Homo sapiens
aaaaatagccaaatt

SEQ ID NO: 337065 - DNA, 15 bp, Homo sapiens
aaaatagccaaattg

SEQ ID NO: 337066 - DNA, 15 bp, Homo sapiens
aaatagccaaattgt

SEQ ID NO: 337067 - DNA, 15 bp, Homo sapiens
aatagccaaattgtc

SEQ ID NO: 337068 - DNA, 15 bp, Homo sapiens
atagccaaattgtct

SEQ ID NO: 337069 - DNA, 15 bp, Homo sapiens
tagccaaattgtctt

SEQ ID NO: 337070 - DNA, 15 bp, Homo sapiens
agccaaattgtcttt

SEQ ID NO: 337071 - DNA, 15 bp, Homo sapiens
gccaaattgtcttta

SEQ ID NO: 337072 - DNA, 15 bp, Homo sapiens
ccaaattgtctttaa

SEQ ID NO: 337073 - DNA, 15 bp, Homo sapiens
caaattgtctttaat

SEQ ID NO: 337074 - DNA, 15 bp, Homo sapiens
aaattgtctttaatg

SEQ ID NO: 337075 - DNA, 15 bp, Homo sapiens
aattgtctttaatga

SEQ ID NO: 337076 - DNA, 15 bp, Homo sapiens
attgtctttaatgaa

SEQ ID NO: 337077 - DNA, 15 bp, Homo sapiens
ttgtctttaatgaaa

SEQ ID NO: 337078 - DNA, 15 bp, Homo sapiens
tgtctttaatgaaac

SEQ ID NO: 337079 - DNA, 15 bp, Homo sapiens
gtctttaatgaaact

SEQ ID NO: 337080 - DNA, 15 bp, Homo sapiens
tctttaatgaaactt

SEQ ID NO: 337081 - DNA, 15 bp, Homo sapiens
ctttaatgaaacttg

SEQ ID NO: 337082 - DNA, 15 bp, Homo sapiens
tttaatgaaacttgt

SEQ ID NO: 337083 - DNA, 15 bp, Homo sapiens
ttaatgaaacttgtg

SEQ ID NO: 337084 - DNA, 15 bp, Homo sapiens
taatgaaacttgtga

SEQ ID NO: 337085 - DNA, 15 bp, Homo sapiens
aatgaaacttgtgaa

SEQ ID NO: 337086 - DNA, 15 bp, Homo sapiens
atgaaacttgtgaac

SEQ ID NO: 337087 - DNA, 15 bp, Homo sapiens
tgaaacttgtgaaca

SEQ ID NO: 337088 - DNA, 15 bp, Homo sapiens
gaaacttgtgaacag

SEQ ID NO: 337089 - DNA, 15 bp, Homo sapiens
aaacttgtgaacaga

SEQ ID NO: 337090 - DNA, 15 bp, Homo sapiens
aacttgtgaacagat

SEQ ID NO: 337091 - DNA, 15 bp, Homo sapiens
acttgtgaacagatt

SEQ ID NO: 337092 - DNA, 15 bp, Homo sapiens
cttgtgaacagattc

SEQ ID NO: 337093 - DNA, 15 bp, Homo sapiens
ttgtgaacagattct

SEQ ID NO: 337094 - DNA, 15 bp, Homo sapiens
tgtgaacagattcta

SEQ ID NO: 337095 - DNA, 15 bp, Homo sapiens
gtgaacagattctaa

SEQ ID NO: 337096 - DNA, 15 bp, Homo sapiens
tgaacagattctaat

SEQ ID NO: 337097 - DNA, 15 bp, Homo sapiens
gaacagattctaatt

SEQ ID NO: 337098 - DNA, 15 bp, Homo sapiens
aacagattctaatta

SEQ ID NO: 337099 - DNA, 15 bp, Homo sapiens
acagattctaattat

SEQ ID NO: 337100 - DNA, 15 bp, Homo sapiens
cagattctaattata

SEQ ID NO: 337101 - DNA, 15 bp, Homo sapiens
agattctaattatat

SEQ ID NO: 337102 - DNA, 15 bp, Homo sapiens
gattctaattatata

SEQ ID NO: 337103 - DNA, 15 bp, Homo sapiens
attctaattatataa

SEQ ID NO: 337104 - DNA, 15 bp, Homo sapiens
ttctaattatataaa

SEQ ID NO: 337105 - DNA, 15 bp, Homo sapiens
tctaattatataaaa

SEQ ID NO: 337106 - DNA, 15 bp, Homo sapiens
ctaattatataaaag

SEQ ID NO: 337107 - DNA, 15 bp, Homo sapiens
taattatataaaaga

SEQ ID NO: 337108 - DNA, 15 bp, Homo sapiens
aattatataaaagac

SEQ ID NO: 337109 - DNA, 15 bp, Homo sapiens
attatataaaagacg

SEQ ID NO: 337110 - DNA, 15 bp, Homo sapiens
ttatataaaagacga

SEQ ID NO: 337111 - DNA, 15 bp, Homo sapiens
tatataaaagacgag

SEQ ID NO: 337112 - DNA, 15 bp, Homo sapiens
atataaaagacgagg

SEQ ID NO: 337113 - DNA, 15 bp, Homo sapiens
tataaaagacgaggc

SEQ ID NO: 337114 - DNA, 15 bp, Homo sapiens
ataaaagacgaggcc

SEQ ID NO: 337115 - DNA, 15 bp, Homo sapiens
taaaagacgaggccc

SEQ ID NO: 337116 - DNA, 15 bp, Homo sapiens
aaaagacgaggccca

SEQ ID NO: 337117 - DNA, 15 bp, Homo sapiens
aaagacgaggcccaa

SEQ ID NO: 337118 - DNA, 15 bp, Homo sapiens
aagacgaggcccaag

SEQ ID NO: 337119 - DNA, 15 bp, Homo sapiens
agacgaggcccaaga

SEQ ID NO: 337120 - DNA, 15 bp, Homo sapiens
gacgaggcccaagaa

SEQ ID NO: 337121 - DNA, 15 bp, Homo sapiens
acgaggcccaagaat

SEQ ID NO: 337122 - DNA, 15 bp, Homo sapiens
cgaggcccaagaata

SEQ ID NO: 337123 - DNA, 15 bp, Homo sapiens
gaggcccaagaatag

SEQ ID NO: 337124 - DNA, 15 bp, Homo sapiens
aggcccaagaatagc

SEQ ID NO: 337125 - DNA, 15 bp, Homo sapiens
ggcccaagaatagcc

SEQ ID NO: 337126 - DNA, 15 bp, Homo sapiens
gcccaagaatagcca

SEQ ID NO: 337127 - DNA, 15 bp, Homo sapiens
cccaagaatagccag

SEQ ID NO: 337128 - DNA, 15 bp, Homo sapiens
ccaagaatagccagt

SEQ ID NO: 337129 - DNA, 15 bp, Homo sapiens
caagaatagccagta

SEQ ID NO: 337130 - DNA, 15 bp, Homo sapiens
aagaatagccagtag

SEQ ID NO: 337131 - DNA, 15 bp, Homo sapiens
agaatagccagtaga

SEQ ID NO: 337132 - DNA, 15 bp, Homo sapiens
gaatagccagtagac

SEQ ID NO: 337133 - DNA, 15 bp, Homo sapiens
aatagccagtagact

SEQ ID NO: 337134 - DNA, 15 bp, Homo sapiens
atagccagtagactt

SEQ ID NO: 337135 - DNA, 15 bp, Homo sapiens
tagccagtagacttc

SEQ ID NO: 337136 - DNA, 15 bp, Homo sapiens
agccagtagacttct

SEQ ID NO: 337137 - DNA, 15 bp, Homo sapiens
gccagtagacttctg

SEQ ID NO: 337138 - DNA, 15 bp, Homo sapiens
ccagtagacttctga

SEQ ID NO: 337139 - DNA, 15 bp, Homo sapiens
cagtagacttctgag

SEQ ID NO: 337140 - DNA, 15 bp, Homo sapiens
agtagacttctgagg

SEQ ID NO: 337141 - DNA, 15 bp, Homo sapiens
gtagacttctgagga

SEQ ID NO: 337142 - DNA, 15 bp, Homo sapiens
tagacttctgaggaa

SEQ ID NO: 337143 - DNA, 15 bp, Homo sapiens
agacttctgaggaag

SEQ ID NO: 337144 - DNA, 15 bp, Homo sapiens
gacttctgaggaaga

SEQ ID NO: 337145 - DNA, 15 bp, Homo sapiens
acttctgaggaagaa

SEQ ID NO: 337146 - DNA, 15 bp, Homo sapiens
cttctgaggaagaat

SEQ ID NO: 337147 - DNA, 15 bp, Homo sapiens
ttctgaggaagaatc

SEQ ID NO: 337148 - DNA, 15 bp, Homo sapiens
tctgaggaagaatca

SEQ ID NO: 337149 - DNA, 15 bp, Homo sapiens
ctgaggaagaatcag

SEQ ID NO: 337150 - DNA, 15 bp, Homo sapiens
tgaggaagaatcagg

SEQ ID NO: 337151 - DNA, 15 bp, Homo sapiens
gaggaagaatcaggc

SEQ ID NO: 337152 - DNA, 15 bp, Homo sapiens
aggaagaatcaggct

SEQ ID NO: 337153 - DNA, 15 bp, Homo sapiens
ggaagaatcaggctg

SEQ ID NO: 337154 - DNA, 15 bp, Homo sapiens
gaagaatcaggctga

SEQ ID NO: 337155 - DNA, 15 bp, Homo sapiens
aagaatcaggctgaa

SEQ ID NO: 337156 - DNA, 15 bp, Homo sapiens
agaatcaggctgaaa

SEQ ID NO: 337157 - DNA, 15 bp, Homo sapiens
gaatcaggctgaaat

SEQ ID NO: 337158 - DNA, 15 bp, Homo sapiens
aatcaggctgaaata

SEQ ID NO: 337159 - DNA, 15 bp, Homo sapiens
atcaggctgaaatac

SEQ ID NO: 337160 - DNA, 15 bp, Homo sapiens
tcaggctgaaatact

SEQ ID NO: 337161 - DNA, 15 bp, Homo sapiens
caggctgaaatactt

SEQ ID NO: 337162 - DNA, 15 bp, Homo sapiens
aggctgaaatacttt

SEQ ID NO: 337163 - DNA, 15 bp, Homo sapiens
ggctgaaatactttc

SEQ ID NO: 337164 - DNA, 15 bp, Homo sapiens
gctgaaatactttcc

SEQ ID NO: 337165 - DNA, 15 bp, Homo sapiens
ctgaaatactttcca

SEQ ID NO: 337166 - DNA, 15 bp, Homo sapiens
tgaaatactttccaa

SEQ ID NO: 337167 - DNA, 15 bp, Homo sapiens
gaaatactttccaaa

SEQ ID NO: 337168 - DNA, 15 bp, Homo sapiens
aaatactttccaaaa

SEQ ID NO: 337169 - DNA, 15 bp, Homo sapiens
aatactttccaaaaa

SEQ ID NO: 337170 - DNA, 15 bp, Homo sapiens
atactttccaaaaag

SEQ ID NO: 337171 - DNA, 15 bp, Homo sapiens
tactttccaaaaaga

SEQ ID NO: 337172 - DNA, 15 bp, Homo sapiens
actttccaaaaagaa

SEQ ID NO: 337173 - DNA, 15 bp, Homo sapiens
ctttccaaaaagaaa

SEQ ID NO: 337174 - DNA, 15 bp, Homo sapiens
tttccaaaaagaaac

SEQ ID NO: 337175 - DNA, 15 bp, Homo sapiens
ttccaaaaagaaacc

SEQ ID NO: 337176 - DNA, 15 bp, Homo sapiens
tccaaaaagaaacca

SEQ ID NO: 337177 - DNA, 15 bp, Homo sapiens
ccaaaaagaaaccaa

SEQ ID NO: 337178 - DNA, 15 bp, Homo sapiens
caaaaagaaaccaaa

SEQ ID NO: 337179 - DNA, 15 bp, Homo sapiens
aaaaagaaaccaaaa

SEQ ID NO: 337180 - DNA, 15 bp, Homo sapiens
aaaagaaaccaaaac

SEQ ID NO: 337181 - DNA, 15 bp, Homo sapiens
aaagaaaccaaaact

SEQ ID NO: 337182 - DNA, 15 bp, Homo sapiens
aagaaaccaaaacta

SEQ ID NO: 337183 - DNA, 15 bp, Homo sapiens
agaaaccaaaactat

SEQ ID NO: 337184 - DNA, 15 bp, Homo sapiens
gaaaccaaaactatg

SEQ ID NO: 337185 - DNA, 15 bp, Homo sapiens
aaaccaaaactatga

SEQ ID NO: 337186 - DNA, 15 bp, Homo sapiens
aaccaaaactatgaa

SEQ ID NO: 337187 - DNA, 15 bp, Homo sapiens
accaaaactatgaag

SEQ ID NO: 337188 - DNA, 15 bp, Homo sapiens
ccaaaactatgaagc

SEQ ID NO: 337189 - DNA, 15 bp, Homo sapiens
caaaactatgaagct

SEQ ID NO: 337190 - DNA, 15 bp, Homo sapiens
aaaactatgaagcta

SEQ ID NO: 337191 - DNA, 15 bp, Homo sapiens
aaactatgaagctat

SEQ ID NO: 337192 - DNA, 15 bp, Homo sapiens
aactatgaagctata

SEQ ID NO: 337193 - DNA, 15 bp, Homo sapiens
actatgaagctatat

SEQ ID NO: 337194 - DNA, 15 bp, Homo sapiens
ctatgaagctatatt

SEQ ID NO: 337195 - DNA, 15 bp, Homo sapiens
tatgaagctatatta

SEQ ID NO: 337196 - DNA, 15 bp, Homo sapiens
atgaagctatattaa

SEQ ID NO: 337197 - DNA, 15 bp, Homo sapiens
tgaagctatattaat

SEQ ID NO: 337198 - DNA, 15 bp, Homo sapiens
gaagctatattaatt

SEQ ID NO: 337199 - DNA, 15 bp, Homo sapiens
aagctatattaatta

SEQ ID NO: 337200 - DNA, 15 bp, Homo sapiens
agctatattaattaa

SEQ ID NO: 337201 - DNA, 15 bp, Homo sapiens
gctatattaattaag

SEQ ID NO: 337202 - DNA, 15 bp, Homo sapiens
ctatattaattaaga

SEQ ID NO: 337203 - DNA, 15 bp, Homo sapiens
tatattaattaagac

SEQ ID NO: 337204 - DNA, 15 bp, Homo sapiens
atattaattaagact

SEQ ID NO: 337205 - DNA, 15 bp, Homo sapiens
tattaattaagacta

SEQ ID NO: 337206 - DNA, 15 bp, Homo sapiens
attaattaagactat

SEQ ID NO: 337207 - DNA, 15 bp, Homo sapiens
ttaattaagactatg

SEQ ID NO: 337208 - DNA, 15 bp, Homo sapiens
taattaagactatgc

SEQ ID NO: 337209 - DNA, 15 bp, Homo sapiens
aattaagactatgca

SEQ ID NO: 337210 - DNA, 15 bp, Homo sapiens
attaagactatgcag

SEQ ID NO: 337211 - DNA, 15 bp, Homo sapiens
ttaagactatgcagt

SEQ ID NO: 337212 - DNA, 15 bp, Homo sapiens
taagactatgcagta

SEQ ID NO: 337213 - DNA, 15 bp, Homo sapiens
aagactatgcagtac

SEQ ID NO: 337214 - DNA, 15 bp, Homo sapiens
agactatgcagtact

SEQ ID NO: 337215 - DNA, 15 bp, Homo sapiens
gactatgcagtacta

SEQ ID NO: 337216 - DNA, 15 bp, Homo sapiens
actatgcagtactat

SEQ ID NO: 337217 - DNA, 15 bp, Homo sapiens
ctatgcagtactatc

SEQ ID NO: 337218 - DNA, 15 bp, Homo sapiens
tatgcagtactatca

SEQ ID NO: 337219 - DNA, 15 bp, Homo sapiens
atgcagtactatcaa

SEQ ID NO: 337220 - DNA, 15 bp, Homo sapiens
tgcagtactatcaat

SEQ ID NO: 337221 - DNA, 15 bp, Homo sapiens
gcagtactatcaata

SEQ ID NO: 337222 - DNA, 15 bp, Homo sapiens
cagtactatcaatat

SEQ ID NO: 337223 - DNA, 15 bp, Homo sapiens
agtactatcaatata

SEQ ID NO: 337224 - DNA, 15 bp, Homo sapiens
gtactatcaatatac

SEQ ID NO: 337225 - DNA, 15 bp, Homo sapiens
tactatcaatataca

SEQ ID NO: 337226 - DNA, 15 bp, Homo sapiens
actatcaatatacac

SEQ ID NO: 337227 - DNA, 15 bp, Homo sapiens
ctatcaatatacaca

SEQ ID NO: 337228 - DNA, 15 bp, Homo sapiens
tatcaatatacacac

SEQ ID NO: 337229 - DNA, 15 bp, Homo sapiens
atcaatatacacacc

SEQ ID NO: 337230 - DNA, 15 bp, Homo sapiens
tcaatatacacacca

SEQ ID NO: 337231 - DNA, 15 bp, Homo sapiens
caatatacacaccaa

SEQ ID NO: 337232 - DNA, 15 bp, Homo sapiens
aatatacacaccaat

SEQ ID NO: 337233 - DNA, 15 bp, Homo sapiens
atatacacaccaata

SEQ ID NO: 337234 - DNA, 15 bp, Homo sapiens
tatacacaccaatat

SEQ ID NO: 337235 - DNA, 15 bp, Homo sapiens
atacacaccaatata

SEQ ID NO: 337236 - DNA, 15 bp, Homo sapiens
tacacaccaatataa

SEQ ID NO: 337237 - DNA, 15 bp, Homo sapiens
acacaccaatataag

SEQ ID NO: 337238 - DNA, 15 bp, Homo sapiens
cacaccaatataagc

SEQ ID NO: 337239 - DNA, 15 bp, Homo sapiens
acaccaatataagct

SEQ ID NO: 337240 - DNA, 15 bp, Homo sapiens
caccaatataagctg

SEQ ID NO: 337241 - DNA, 15 bp, Homo sapiens
accaatataagctga

SEQ ID NO: 337242 - DNA, 15 bp, Homo sapiens
ccaatataagctgaa

SEQ ID NO: 337243 - DNA, 15 bp, Homo sapiens
caatataagctgaac

SEQ ID NO: 337244 - DNA, 15 bp, Homo sapiens
aatataagctgaacc

SEQ ID NO: 337245 - DNA, 15 bp, Homo sapiens
atataagctgaacca

SEQ ID NO: 337246 - DNA, 15 bp, Homo sapiens
tataagctgaaccat

SEQ ID NO: 337247 - DNA, 15 bp, Homo sapiens
ataagctgaaccata

SEQ ID NO: 337248 - DNA, 15 bp, Homo sapiens
taagctgaaccatat

SEQ ID NO: 337249 - DNA, 15 bp, Homo sapiens
aagctgaaccatatg

SEQ ID NO: 337250 - DNA, 15 bp, Homo sapiens
agctgaaccatatga

SEQ ID NO: 337251 - DNA, 15 bp, Homo sapiens
gctgaaccatatgaa

SEQ ID NO: 337252 - DNA, 15 bp, Homo sapiens
ctgaaccatatgaaa

SEQ ID NO: 337253 - DNA, 15 bp, Homo sapiens
tgaaccatatgaaat

SEQ ID NO: 337254 - DNA, 15 bp, Homo sapiens
gaaccatatgaaatt

SEQ ID NO: 337255 - DNA, 15 bp, Homo sapiens
aaccatatgaaattg

SEQ ID NO: 337256 - DNA, 15 bp, Homo sapiens
accatatgaaattgc

SEQ ID NO: 337257 - DNA, 15 bp, Homo sapiens
ccatatgaaattgcc

SEQ ID NO: 337258 - DNA, 15 bp, Homo sapiens
catatgaaattgccg

SEQ ID NO: 337259 - DNA, 15 bp, Homo sapiens
atatgaaattgccga

SEQ ID NO: 337260 - DNA, 15 bp, Homo sapiens
tatgaaattgccgac

SEQ ID NO: 337261 - DNA, 15 bp, Homo sapiens
atgaaattgccgaca

SEQ ID NO: 337262 - DNA, 15 bp, Homo sapiens
tgaaattgccgacat

SEQ ID NO: 337263 - DNA, 15 bp, Homo sapiens
gaaattgccgacatg

SEQ ID NO: 337264 - DNA, 15 bp, Homo sapiens
aaattgccgacatgt

SEQ ID NO: 337265 - DNA, 15 bp, Homo sapiens
aattgccgacatgtg

SEQ ID NO: 337266 - DNA, 15 bp, Homo sapiens
attgccgacatgtga

SEQ ID NO: 337267 - DNA, 15 bp, Homo sapiens
ttgccgacatgtgag

SEQ ID NO: 337268 - DNA, 15 bp, Homo sapiens
tgccgacatgtgagt

SEQ ID NO: 337269 - DNA, 15 bp, Homo sapiens
gccgacatgtgagtg

SEQ ID NO: 337270 - DNA, 15 bp, Homo sapiens
ccgacatgtgagtgt

SEQ ID NO: 337271 - DNA, 15 bp, Homo sapiens
cgacatgtgagtgtt

SEQ ID NO: 337272 - DNA, 15 bp, Homo sapiens
gacatgtgagtgttt

SEQ ID NO: 337273 - DNA, 15 bp, Homo sapiens
acatgtgagtgtttt

SEQ ID NO: 337274 - DNA, 15 bp, Homo sapiens
catgtgagtgttttt

SEQ ID NO: 337275 - DNA, 15 bp, Homo sapiens
atgtgagtgtttttg

SEQ ID NO: 337276 - DNA, 15 bp, Homo sapiens
tgtgagtgtttttgc

SEQ ID NO: 337277 - DNA, 15 bp, Homo sapiens
gtgagtgtttttgct

SEQ ID NO: 337278 - DNA, 15 bp, Homo sapiens
tgagtgtttttgcta

SEQ ID NO: 337279 - DNA, 15 bp, Homo sapiens
gagtgtttttgctat

SEQ ID NO: 337280 - DNA, 15 bp, Homo sapiens
agtgtttttgctata

SEQ ID NO: 337281 - DNA, 15 bp, Homo sapiens
gtgtttttgctatat

SEQ ID NO: 337282 - DNA, 15 bp, Homo sapiens
tgtttttgctatata

SEQ ID NO: 337283 - DNA, 15 bp, Homo sapiens
gtttttgctatataa

SEQ ID NO: 337284 - DNA, 15 bp, Homo sapiens
tttttgctatataag

SEQ ID NO: 337285 - DNA, 15 bp, Homo sapiens
ttttgctatataaga

SEQ ID NO: 337286 - DNA, 15 bp, Homo sapiens
tttgctatataagaa

SEQ ID NO: 337287 - DNA, 15 bp, Homo sapiens
ttgctatataagaat

SEQ ID NO: 337288 - DNA, 15 bp, Homo sapiens
tgctatataagaatg

SEQ ID NO: 337289 - DNA, 15 bp, Homo sapiens
gctatataagaatgg

SEQ ID NO: 337290 - DNA, 15 bp, Homo sapiens
ctatataagaatggt

SEQ ID NO: 337291 - DNA, 15 bp, Homo sapiens
tatataagaatggtg

SEQ ID NO: 337292 - DNA, 15 bp, Homo sapiens
atataagaatggtgt

SEQ ID NO: 337293 - DNA, 15 bp, Homo sapiens
tataagaatggtgtt

SEQ ID NO: 337294 - DNA, 15 bp, Homo sapiens
ataagaatggtgttt

SEQ ID NO: 337295 - DNA, 15 bp, Homo sapiens
taagaatggtgtttt

SEQ ID NO: 337296 - DNA, 15 bp, Homo sapiens
aagaatggtgttttc

SEQ ID NO: 337297 - DNA, 15 bp, Homo sapiens
agaatggtgttttca

SEQ ID NO: 337298 - DNA, 15 bp, Homo sapiens
gaatggtgttttcat

SEQ ID NO: 337299 - DNA, 15 bp, Homo sapiens
aatggtgttttcata

SEQ ID NO: 337300 - DNA, 15 bp, Homo sapiens
atggtgttttcatat

SEQ ID NO: 337301 - DNA, 15 bp, Homo sapiens
tggtgttttcatatg

SEQ ID NO: 337302 - DNA, 15 bp, Homo sapiens
ggtgttttcatatgg

SEQ ID NO: 337303 - DNA, 15 bp, Homo sapiens
gtgttttcatatggt

SEQ ID NO: 337304 - DNA, 15 bp, Homo sapiens
tgttttcatatggtt

SEQ ID NO: 337305 - DNA, 15 bp, Homo sapiens
gttttcatatggttc

SEQ ID NO: 337306 - DNA, 15 bp, Homo sapiens
ttttcatatggttca

SEQ ID NO: 337307 - DNA, 15 bp, Homo sapiens
tttcatatggttcaa

SEQ ID NO: 337308 - DNA, 15 bp, Homo sapiens
ttcatatggttcaac

SEQ ID NO: 337309 - DNA, 15 bp, Homo sapiens
tcatatggttcaacc

SEQ ID NO: 337310 - DNA, 15 bp, Homo sapiens
catatggttcaacct

SEQ ID NO: 337311 - DNA, 15 bp, Homo sapiens
atatggttcaaccta

SEQ ID NO: 337312 - DNA, 15 bp, Homo sapiens
tatggttcaacctaa

SEQ ID NO: 337313 - DNA, 15 bp, Homo sapiens
atggttcaacctaat

SEQ ID NO: 337314 - DNA, 15 bp, Homo sapiens
tggttcaacctaata

SEQ ID NO: 337315 - DNA, 15 bp, Homo sapiens
ggttcaacctaataa

SEQ ID NO: 337316 - DNA, 15 bp, Homo sapiens
gttcaacctaataaa

SEQ ID NO: 337317 - DNA, 15 bp, Homo sapiens
ttcaacctaataaaa

SEQ ID NO: 337318 - DNA, 15 bp, Homo sapiens
tcaacctaataaaat

SEQ ID NO: 337319 - DNA, 15 bp, Homo sapiens
caacctaataaaatt

SEQ ID NO: 337320 - DNA, 15 bp, Homo sapiens
aacctaataaaatta

SEQ ID NO: 337321 - DNA, 15 bp, Homo sapiens
acctaataaaattaa

SEQ ID NO: 337322 - DNA, 15 bp, Homo sapiens
cctaataaaattaag

SEQ ID NO: 337323 - DNA, 15 bp, Homo sapiens
ctaataaaattaaga

SEQ ID NO: 337324 - DNA, 15 bp, Homo sapiens
taataaaattaagaa

SEQ ID NO: 337325 - DNA, 15 bp, Homo sapiens
aataaaattaagaac

SEQ ID NO: 337326 - DNA, 15 bp, Homo sapiens
ataaaattaagaact

SEQ ID NO: 337327 - DNA, 15 bp, Homo sapiens
taaaattaagaactc

SEQ ID NO: 337328 - DNA, 15 bp, Homo sapiens
aaaattaagaactca

SEQ ID NO: 337329 - DNA, 15 bp, Homo sapiens
aaattaagaactcag

SEQ ID NO: 337330 - DNA, 15 bp, Homo sapiens
aattaagaactcaga

SEQ ID NO: 337331 - DNA, 15 bp, Homo sapiens
attaagaactcagaa

SEQ ID NO: 337332 - DNA, 15 bp, Homo sapiens
ttaagaactcagaaa

SEQ ID NO: 337333 - DNA, 15 bp, Homo sapiens
taagaactcagaaat

SEQ ID NO: 337334 - DNA, 15 bp, Homo sapiens
aagaactcagaaatt

SEQ ID NO: 337335 - DNA, 15 bp, Homo sapiens
agaactcagaaattg

SEQ ID NO: 337336 - DNA, 15 bp, Homo sapiens
gaactcagaaattgc

SEQ ID NO: 337337 - DNA, 15 bp, Homo sapiens
aactcagaaattgct

SEQ ID NO: 337338 - DNA, 15 bp, Homo sapiens
actcagaaattgctc

SEQ ID NO: 337339 - DNA, 15 bp, Homo sapiens
ctcagaaattgctcc

SEQ ID NO: 337340 - DNA, 15 bp, Homo sapiens
tcagaaattgctcca

SEQ ID NO: 337341 - DNA, 15 bp, Homo sapiens
cagaaattgctccat

SEQ ID NO: 337342 - DNA, 15 bp, Homo sapiens
agaaattgctccatt

SEQ ID NO: 337343 - DNA, 15 bp, Homo sapiens
gaaattgctccatta

SEQ ID NO: 337344 - DNA, 15 bp, Homo sapiens
aaattgctccattac

SEQ ID NO: 337345 - DNA, 15 bp, Homo sapiens
aattgctccattaca

SEQ ID NO: 337346 - DNA, 15 bp, Homo sapiens
attgctccattacac

SEQ ID NO: 337347 - DNA, 15 bp, Homo sapiens
ttgctccattacaca

SEQ ID NO: 337348 - DNA, 15 bp, Homo sapiens
tgctccattacacag

SEQ ID NO: 337349 - DNA, 15 bp, Homo sapiens
gctccattacacagg

SEQ ID NO: 337350 - DNA, 15 bp, Homo sapiens
ctccattacacagga

SEQ ID NO: 337351 - DNA, 15 bp, Homo sapiens
tccattacacaggaa

SEQ ID NO: 337352 - DNA, 15 bp, Homo sapiens
ccattacacaggaaa

SEQ ID NO: 337353 - DNA, 15 bp, Homo sapiens
cattacacaggaaaa

SEQ ID NO: 337354 - DNA, 15 bp, Homo sapiens
attacacaggaaaat

SEQ ID NO: 337355 - DNA, 15 bp, Homo sapiens
ttacacaggaaaatc

SEQ ID NO: 337356 - DNA, 15 bp, Homo sapiens
tacacaggaaaatct

SEQ ID NO: 337357 - DNA, 15 bp, Homo sapiens
acacaggaaaatctg

SEQ ID NO: 337358 - DNA, 15 bp, Homo sapiens
cacaggaaaatctga

SEQ ID NO: 337359 - DNA, 15 bp, Homo sapiens
acaggaaaatctgat

SEQ ID NO: 337360 - DNA, 15 bp, Homo sapiens
caggaaaatctgata

SEQ ID NO: 337361 - DNA, 15 bp, Homo sapiens
aggaaaatctgatat

SEQ ID NO: 337362 - DNA, 15 bp, Homo sapiens
ggaaaatctgatata

SEQ ID NO: 337363 - DNA, 15 bp, Homo sapiens
gaaaatctgatatac

SEQ ID NO: 337364 - DNA, 15 bp, Homo sapiens
aaaatctgatatacg

SEQ ID NO: 337365 - DNA, 15 bp, Homo sapiens
aaatctgatatacgc

SEQ ID NO: 337366 - DNA, 15 bp, Homo sapiens
aatctgatatacgct

SEQ ID NO: 337367 - DNA, 15 bp, Homo sapiens
atctgatatacgctt

SEQ ID NO: 337368 - DNA, 15 bp, Homo sapiens
tctgatatacgcttg

SEQ ID NO: 337369 - DNA, 15 bp, Homo sapiens
ctgatatacgcttga

SEQ ID NO: 337370 - DNA, 15 bp, Homo sapiens
tgatatacgcttgag

SEQ ID NO: 337371 - DNA, 15 bp, Homo sapiens
gatatacgcttgagc

SEQ ID NO: 337372 - DNA, 15 bp, Homo sapiens
atatacgcttgagct

SEQ ID NO: 337373 - DNA, 15 bp, Homo sapiens
tatacgcttgagctg

SEQ ID NO: 337374 - DNA, 15 bp, Homo sapiens
atacgcttgagctga

SEQ ID NO: 337375 - DNA, 15 bp, Homo sapiens
tacgcttgagctgac

SEQ ID NO: 337376 - DNA, 15 bp, Homo sapiens
acgcttgagctgaca

SEQ ID NO: 337377 - DNA, 15 bp, Homo sapiens
cgcttgagctgacat

SEQ ID NO: 337378 - DNA, 15 bp, Homo sapiens
gcttgagctgacatt

SEQ ID NO: 337379 - DNA, 15 bp, Homo sapiens
cttgagctgacattg

SEQ ID NO: 337380 - DNA, 15 bp, Homo sapiens
ttgagctgacattgc

SEQ ID NO: 337381 - DNA, 15 bp, Homo sapiens
tgagctgacattgca

SEQ ID NO: 337382 - DNA, 15 bp, Homo sapiens
gagctgacattgcag

SEQ ID NO: 337383 - DNA, 15 bp, Homo sapiens
agctgacattgcaga

SEQ ID NO: 337384 - DNA, 15 bp, Homo sapiens
gctgacattgcagat

SEQ ID NO: 337385 - DNA, 15 bp, Homo sapiens
ctgacattgcagatt

SEQ ID NO: 337386 - DNA, 15 bp, Homo sapiens
tgacattgcagatta

SEQ ID NO: 337387 - DNA, 15 bp, Homo sapiens
gacattgcagattaa

SEQ ID NO: 337388 - DNA, 15 bp, Homo sapiens
acattgcagattaat

SEQ ID NO: 337389 - DNA, 15 bp, Homo sapiens
cattgcagattaata

SEQ ID NO: 337390 - DNA, 15 bp, Homo sapiens
attgcagattaatag

SEQ ID NO: 337391 - DNA, 15 bp, Homo sapiens
ttgcagattaataga

SEQ ID NO: 337392 - DNA, 15 bp, Homo sapiens
tgcagattaatagat

SEQ ID NO: 337393 - DNA, 15 bp, Homo sapiens
gcagattaatagatg

SEQ ID NO: 337394 - DNA, 15 bp, Homo sapiens
cagattaatagatga

SEQ ID NO: 337395 - DNA, 15 bp, Homo sapiens
agattaatagatgat

SEQ ID NO: 337396 - DNA, 15 bp, Homo sapiens
gattaatagatgatt

SEQ ID NO: 337397 - DNA, 15 bp, Homo sapiens
attaatagatgattt

SEQ ID NO: 337398 - DNA, 15 bp, Homo sapiens
ttaatagatgatttg

SEQ ID NO: 337399 - DNA, 15 bp, Homo sapiens
taatagatgatttgg

SEQ ID NO: 337400 - DNA, 15 bp, Homo sapiens
aatagatgatttgga

SEQ ID NO: 337401 - DNA, 15 bp, Homo sapiens
atagatgatttggac

SEQ ID NO: 337402 - DNA, 15 bp, Homo sapiens
tagatgatttggaca

SEQ ID NO: 337403 - DNA, 15 bp, Homo sapiens
agatgatttggacaa

SEQ ID NO: 337404 - DNA, 15 bp, Homo sapiens
gatgatttggacaat

SEQ ID NO: 337405 - DNA, 15 bp, Homo sapiens
atgatttggacaatt

SEQ ID NO: 337406 - DNA, 15 bp, Homo sapiens
tgatttggacaattg

SEQ ID NO: 337407 - DNA, 15 bp, Homo sapiens
gatttggacaattga

SEQ ID NO: 337408 - DNA, 15 bp, Homo sapiens
atttggacaattgat

SEQ ID NO: 337409 - DNA, 15 bp, Homo sapiens
tttggacaattgatt

SEQ ID NO: 337410 - DNA, 15 bp, Homo sapiens
ttggacaattgatta

SEQ ID NO: 337411 - DNA, 15 bp, Homo sapiens
tggacaattgattac

SEQ ID NO: 337412 - DNA, 15 bp, Homo sapiens
ggacaattgattacc

SEQ ID NO: 337413 - DNA, 15 bp, Homo sapiens
gacaattgattaccc

SEQ ID NO: 337414 - DNA, 15 bp, Homo sapiens
acaattgattaccca

SEQ ID NO: 337415 - DNA, 15 bp, Homo sapiens
caattgattacccat

SEQ ID NO: 337416 - DNA, 15 bp, Homo sapiens
aattgattacccata

SEQ ID NO: 337417 - DNA, 15 bp, Homo sapiens
attgattacccatat

SEQ ID NO: 337418 - DNA, 15 bp, Homo sapiens
ttgattacccatata

SEQ ID NO: 337419 - DNA, 15 bp, Homo sapiens
tgattacccatatat

SEQ ID NO: 337420 - DNA, 15 bp, Homo sapiens
gattacccatatata

SEQ ID NO: 337421 - DNA, 15 bp, Homo sapiens
attacccatatataa

SEQ ID NO: 337422 - DNA, 15 bp, Homo sapiens
ttacccatatataaa

SEQ ID NO: 337423 - DNA, 15 bp, Homo sapiens
tacccatatataaat

SEQ ID NO: 337424 - DNA, 15 bp, Homo sapiens
acccatatataaata

SEQ ID NO: 337425 - DNA, 15 bp, Homo sapiens
cccatatataaataa

SEQ ID NO: 337426 - DNA, 15 bp, Homo sapiens
ccatatataaataaa

SEQ ID NO: 337427 - DNA, 15 bp, Homo sapiens
catatataaataaat

SEQ ID NO: 337428 - DNA, 15 bp, Homo sapiens
atatataaataaatg

SEQ ID NO: 337429 - DNA, 15 bp, Homo sapiens
tatataaataaatgt

SEQ ID NO: 337430 - DNA, 15 bp, Homo sapiens
atataaataaatgta

SEQ ID NO: 337431 - DNA, 15 bp, Homo sapiens
tataaataaatgtat

SEQ ID NO: 337432 - DNA, 15 bp, Homo sapiens
ataaataaatgtatt

SEQ ID NO: 337433 - DNA, 15 bp, Homo sapiens
taaataaatgtattg

SEQ ID NO: 337434 - DNA, 15 bp, Homo sapiens
aaataaatgtattgg

SEQ ID NO: 337435 - DNA, 15 bp, Homo sapiens
aataaatgtattgga

SEQ ID NO: 337436 - DNA, 15 bp, Homo sapiens
ataaatgtattggat

SEQ ID NO: 337437 - DNA, 15 bp, Homo sapiens
taaatgtattggatc

SEQ ID NO: 337438 - DNA, 15 bp, Homo sapiens
aaatgtattggatct

SEQ ID NO: 337439 - DNA, 15 bp, Homo sapiens
aatgtattggatctt

SEQ ID NO: 337440 - DNA, 15 bp, Homo sapiens
atgtattggatcttt

SEQ ID NO: 337441 - DNA, 15 bp, Homo sapiens
tgtattggatcttta

SEQ ID NO: 337442 - DNA, 15 bp, Homo sapiens
gtattggatctttac

SEQ ID NO: 337443 - DNA, 15 bp, Homo sapiens
tattggatctttact

SEQ ID NO: 337444 - DNA, 15 bp, Homo sapiens
attggatctttactt

SEQ ID NO: 337445 - DNA, 15 bp, Homo sapiens
ttggatctttacttc

SEQ ID NO: 337446 - DNA, 15 bp, Homo sapiens
tggatctttacttca

SEQ ID NO: 337447 - DNA, 15 bp, Homo sapiens
ggatctttacttcac

SEQ ID NO: 337448 - DNA, 15 bp, Homo sapiens
gatctttacttcacc

SEQ ID NO: 337449 - DNA, 15 bp, Homo sapiens
atctttacttcacca

SEQ ID NO: 337450 - DNA, 15 bp, Homo sapiens
tctttacttcaccac

SEQ ID NO: 337451 - DNA, 15 bp, Homo sapiens
ctttacttcaccaca

SEQ ID NO: 337452 - DNA, 15 bp, Homo sapiens
tttacttcaccacac

SEQ ID NO: 337453 - DNA, 15 bp, Homo sapiens
ttacttcaccacact

SEQ ID NO: 337454 - DNA, 15 bp, Homo sapiens
tacttcaccacacta

SEQ ID NO: 337455 - DNA, 15 bp, Homo sapiens
acttcaccacactaa

SEQ ID NO: 337456 - DNA, 15 bp, Homo sapiens
cttcaccacactaaa

SEQ ID NO: 337457 - DNA, 15 bp, Homo sapiens
ttcaccacactaaaa

SEQ ID NO: 337458 - DNA, 15 bp, Homo sapiens
tcaccacactaaaaa

SEQ ID NO: 337459 - DNA, 15 bp, Homo sapiens
caccacactaaaaaa

SEQ ID NO: 337460 - DNA, 15 bp, Homo sapiens
accacactaaaaaaa

SEQ ID NO: 337461 - DNA, 15 bp, Homo sapiens
ccacactaaaaaaaa

SEQ ID NO: 337462 - DNA, 15 bp, Homo sapiens
cacactaaaaaaaaa

SEQ ID NO: 337463 - DNA, 15 bp, Homo sapiens
acactaaaaaaaaaa

SEQ ID NO: 337464 - DNA, 15 bp, Homo sapiens
cactaaaaaaaaaat

SEQ ID NO: 337465 - DNA, 15 bp, Homo sapiens
actaaaaaaaaaata

SEQ ID NO: 337466 - DNA, 15 bp, Homo sapiens
ctaaaaaaaaaataa

SEQ ID NO: 337467 - DNA, 15 bp, Homo sapiens
taaaaaaaaaataat

SEQ ID NO: 337468 - DNA, 15 bp, Homo sapiens
aaaaaaaaaataata

SEQ ID NO: 337469 - DNA, 15 bp, Homo sapiens
aaaaaaataataatt

SEQ ID NO: 337470 - DNA, 15 bp, Homo sapiens
aaaaaataataattt

SEQ ID NO: 337471 - DNA, 15 bp, Homo sapiens
aaaaataataatttc

SEQ ID NO: 337472 - DNA, 15 bp, Homo sapiens
aaaataataatttct

SEQ ID NO: 337473 - DNA, 15 bp, Homo sapiens
aaataataatttcta

SEQ ID NO: 337474 - DNA, 15 bp, Homo sapiens
aataataatttctac

SEQ ID NO: 337475 - DNA, 15 bp, Homo sapiens
ataataatttctaca

SEQ ID NO: 337476 - DNA, 15 bp, Homo sapiens
taataatttctacat

SEQ ID NO: 337477 - DNA, 15 bp, Homo sapiens
aataatttctacatg

SEQ ID NO: 337478 - DNA, 15 bp, Homo sapiens
ataatttctacatgg

SEQ ID NO: 337479 - DNA, 15 bp, Homo sapiens
taatttctacatgga

SEQ ID NO: 337480 - DNA, 15 bp, Homo sapiens
aatttctacatggat

SEQ ID NO: 337481 - DNA, 15 bp, Homo sapiens
atttctacatggatc

SEQ ID NO: 337482 - DNA, 15 bp, Homo sapiens
tttctacatggatca

SEQ ID NO: 337483 - DNA, 15 bp, Homo sapiens
ttctacatggatcag

SEQ ID NO: 337484 - DNA, 15 bp, Homo sapiens
tctacatggatcagg

SEQ ID NO: 337485 - DNA, 15 bp, Homo sapiens
ctacatggatcaggg

SEQ ID NO: 337486 - DNA, 15 bp, Homo sapiens
tacatggatcaggga

SEQ ID NO: 337487 - DNA, 15 bp, Homo sapiens
acatggatcagggat

SEQ ID NO: 337488 - DNA, 15 bp, Homo sapiens
catggatcagggatt

SEQ ID NO: 337489 - DNA, 15 bp, Homo sapiens
atggatcagggattt

SEQ ID NO: 337490 - DNA, 15 bp, Homo sapiens
tggatcagggattta

SEQ ID NO: 337491 - DNA, 15 bp, Homo sapiens
ggatcagggatttaa

SEQ ID NO: 337492 - DNA, 15 bp, Homo sapiens
gatcagggatttaaa

SEQ ID NO: 337493 - DNA, 15 bp, Homo sapiens
atcagggatttaaat

SEQ ID NO: 337494 - DNA, 15 bp, Homo sapiens
tcagggatttaaatg

SEQ ID NO: 337495 - DNA, 15 bp, Homo sapiens
cagggatttaaatgc

SEQ ID NO: 337496 - DNA, 15 bp, Homo sapiens
agggatttaaatgcc

SEQ ID NO: 337497 - DNA, 15 bp, Homo sapiens
gggatttaaatgcca

SEQ ID NO: 337498 - DNA, 15 bp, Homo sapiens
ggatttaaatgccaa

SEQ ID NO: 337499 - DNA, 15 bp, Homo sapiens
gatttaaatgccaaa

SEQ ID NO: 337500 - DNA, 15 bp, Homo sapiens
atttaaatgccaaag

SEQ ID NO: 337501 - DNA, 15 bp, Homo sapiens
tttaaatgccaaagg

SEQ ID NO: 337502 - DNA, 15 bp, Homo sapiens
ttaaatgccaaaggc

SEQ ID NO: 337503 - DNA, 15 bp, Homo sapiens
taaatgccaaaggca

SEQ ID NO: 337504 - DNA, 15 bp, Homo sapiens
aaatgccaaaggcaa

SEQ ID NO: 337505 - DNA, 15 bp, Homo sapiens
aatgccaaaggcaaa

SEQ ID NO: 337506 - DNA, 15 bp, Homo sapiens
atgccaaaggcaaaa

SEQ ID NO: 337507 - DNA, 15 bp, Homo sapiens
tgccaaaggcaaaat

SEQ ID NO: 337508 - DNA, 15 bp, Homo sapiens
gccaaaggcaaaatt

SEQ ID NO: 337509 - DNA, 15 bp, Homo sapiens
ccaaaggcaaaattt

SEQ ID NO: 337510 - DNA, 15 bp, Homo sapiens
caaaggcaaaatttg

SEQ ID NO: 337511 - DNA, 15 bp, Homo sapiens
aaaggcaaaatttgt

SEQ ID NO: 337512 - DNA, 15 bp, Homo sapiens
aaggcaaaatttgtt

SEQ ID NO: 337513 - DNA, 15 bp, Homo sapiens
aggcaaaatttgtta

SEQ ID NO: 337514 - DNA, 15 bp, Homo sapiens
ggcaaaatttgttat

SEQ ID NO: 337515 - DNA, 15 bp, Homo sapiens
gcaaaatttgttata

SEQ ID NO: 337516 - DNA, 15 bp, Homo sapiens
caaaatttgttatat

SEQ ID NO: 337517 - DNA, 15 bp, Homo sapiens
aaaatttgttatatt

SEQ ID NO: 337518 - DNA, 15 bp, Homo sapiens
aaatttgttatattt

SEQ ID NO: 337519 - DNA, 15 bp, Homo sapiens
aatttgttatatttt

SEQ ID NO: 337520 - DNA, 15 bp, Homo sapiens
atttgttatatttta

SEQ ID NO: 337521 - DNA, 15 bp, Homo sapiens
tttgttatattttat

SEQ ID NO: 337522 - DNA, 15 bp, Homo sapiens
ttgttatattttatt

SEQ ID NO: 337523 - DNA, 15 bp, Homo sapiens
tgttatattttattg

SEQ ID NO: 337524 - DNA, 15 bp, Homo sapiens
gttatattttattgt

SEQ ID NO: 337525 - DNA, 15 bp, Homo sapiens
ttatattttattgtt

SEQ ID NO: 337526 - DNA, 15 bp, Homo sapiens
tatattttattgttg

SEQ ID NO: 337527 - DNA, 15 bp, Homo sapiens
atattttattgttgt

SEQ ID NO: 337528 - DNA, 15 bp, Homo sapiens
tattttattgttgta

SEQ ID NO: 337529 - DNA, 15 bp, Homo sapiens
attttattgttgtaa

SEQ ID NO: 337530 - DNA, 15 bp, Homo sapiens
ttttattgttgtaaa

SEQ ID NO: 337531 - DNA, 15 bp, Homo sapiens
tttattgttgtaaat

SEQ ID NO: 337532 - DNA, 15 bp, Homo sapiens
ttattgttgtaaatg

SEQ ID NO: 337533 - DNA, 15 bp, Homo sapiens
tattgttgtaaatga

SEQ ID NO: 337534 - DNA, 15 bp, Homo sapiens
attgttgtaaatgat

SEQ ID NO: 337535 - DNA, 15 bp, Homo sapiens
ttgttgtaaatgatt

SEQ ID NO: 337536 - DNA, 15 bp, Homo sapiens
tgttgtaaatgatta

SEQ ID NO: 337537 - DNA, 15 bp, Homo sapiens
gttgtaaatgattac

SEQ ID NO: 337538 - DNA, 15 bp, Homo sapiens
ttgtaaatgattact

SEQ ID NO: 337539 - DNA, 15 bp, Homo sapiens
tgtaaatgattactt

SEQ ID NO: 337540 - DNA, 15 bp, Homo sapiens
gtaaatgattacttt

SEQ ID NO: 337541 - DNA, 15 bp, Homo sapiens
taaatgattactttt

SEQ ID NO: 337542 - DNA, 15 bp, Homo sapiens
aaatgattacttttc

SEQ ID NO: 337543 - DNA, 15 bp, Homo sapiens
aatgattacttttct

SEQ ID NO: 337544 - DNA, 15 bp, Homo sapiens
atgattacttttctc

SEQ ID NO: 337545 - DNA, 15 bp, Homo sapiens
tgattacttttctca

SEQ ID NO: 337546 - DNA, 15 bp, Homo sapiens
gattacttttctcaa

SEQ ID NO: 337547 - DNA, 15 bp, Homo sapiens
attacttttctcaaa

SEQ ID NO: 337548 - DNA, 15 bp, Homo sapiens
ttacttttctcaaat

SEQ ID NO: 337549 - DNA, 15 bp, Homo sapiens
tacttttctcaaatt

SEQ ID NO: 337550 - DNA, 15 bp, Homo sapiens
acttttctcaaattt

SEQ ID NO: 337551 - DNA, 15 bp, Homo sapiens
cttttctcaaatttc

SEQ ID NO: 337552 - DNA, 15 bp, Homo sapiens
ttttctcaaatttca

SEQ ID NO: 337553 - DNA, 15 bp, Homo sapiens
tttctcaaatttcac

SEQ ID NO: 337554 - DNA, 15 bp, Homo sapiens
ttctcaaatttcact

SEQ ID NO: 337555 - DNA, 15 bp, Homo sapiens
tctcaaatttcactt

SEQ ID NO: 337556 - DNA, 15 bp, Homo sapiens
ctcaaatttcacttc

SEQ ID NO: 337557 - DNA, 15 bp, Homo sapiens
tcaaatttcacttcc

SEQ ID NO: 337558 - DNA, 15 bp, Homo sapiens
caaatttcacttcct

SEQ ID NO: 337559 - DNA, 15 bp, Homo sapiens
aaatttcacttcctc

SEQ ID NO: 337560 - DNA, 15 bp, Homo sapiens
aatttcacttcctct

SEQ ID NO: 337561 - DNA, 15 bp, Homo sapiens
atttcacttcctcta

SEQ ID NO: 337562 - DNA, 15 bp, Homo sapiens
tttcacttcctctat

SEQ ID NO: 337563 - DNA, 15 bp, Homo sapiens
ttcacttcctctatg

SEQ ID NO: 337564 - DNA, 15 bp, Homo sapiens
tcacttcctctatgt

SEQ ID NO: 337565 - DNA, 15 bp, Homo sapiens
cacttcctctatgtt

SEQ ID NO: 337566 - DNA, 15 bp, Homo sapiens
acttcctctatgttt

SEQ ID NO: 337567 - DNA, 15 bp, Homo sapiens
cttcctctatgtttt

SEQ ID NO: 337568 - DNA, 15 bp, Homo sapiens
ttcctctatgttttt

SEQ ID NO: 337569 - DNA, 15 bp, Homo sapiens
tcctctatgtttttt

SEQ ID NO: 337570 - DNA, 15 bp, Homo sapiens
cctctatgttttttt

SEQ ID NO: 337571 - DNA, 15 bp, Homo sapiens
ctctatgtttttttg

SEQ ID NO: 337572 - DNA, 15 bp, Homo sapiens
tctatgtttttttgc

SEQ ID NO: 337573 - DNA, 15 bp, Homo sapiens
ctatgtttttttgct

SEQ ID NO: 337574 - DNA, 15 bp, Homo sapiens
tatgtttttttgctg

SEQ ID NO: 337575 - DNA, 15 bp, Homo sapiens
atgtttttttgctgg

SEQ ID NO: 337576 - DNA, 15 bp, Homo sapiens
tgtttttttgctggt

SEQ ID NO: 337577 - DNA, 15 bp, Homo sapiens
gtttttttgctggta

SEQ ID NO: 337578 - DNA, 15 bp, Homo sapiens
tttttttgctggtat

SEQ ID NO: 337579 - DNA, 15 bp, Homo sapiens
ttttttgctggtata

SEQ ID NO: 337580 - DNA, 15 bp, Homo sapiens
tttttgctggtatat

SEQ ID NO: 337581 - DNA, 15 bp, Homo sapiens
ttttgctggtatata

SEQ ID NO: 337582 - DNA, 15 bp, Homo sapiens
tttgctggtatataa

SEQ ID NO: 337583 - DNA, 15 bp, Homo sapiens
ttgctggtatataaa

SEQ ID NO: 337584 - DNA, 15 bp, Homo sapiens
tgctggtatataaaa

SEQ ID NO: 337585 - DNA, 15 bp, Homo sapiens
gctggtatataaaag

SEQ ID NO: 337586 - DNA, 15 bp, Homo sapiens
ctggtatataaaagt

SEQ ID NO: 337587 - DNA, 15 bp, Homo sapiens
tggtatataaaagtg

SEQ ID NO: 337588 - DNA, 15 bp, Homo sapiens
ggtatataaaagtgc

SEQ ID NO: 337589 - DNA, 15 bp, Homo sapiens
gtatataaaagtgca

SEQ ID NO: 337590 - DNA, 15 bp, Homo sapiens
tatataaaagtgcaa

SEQ ID NO: 337591 - DNA, 15 bp, Homo sapiens
atataaaagtgcaat

SEQ ID NO: 337592 - DNA, 15 bp, Homo sapiens
tataaaagtgcaata

SEQ ID NO: 337593 - DNA, 15 bp, Homo sapiens
ataaaagtgcaatag

SEQ ID NO: 337594 - DNA, 15 bp, Homo sapiens
taaaagtgcaataga

SEQ ID NO: 337595 - DNA, 15 bp, Homo sapiens
aaaagtgcaatagac

SEQ ID NO: 337596 - DNA, 15 bp, Homo sapiens
aaagtgcaatagact

SEQ ID NO: 337597 - DNA, 15 bp, Homo sapiens
aagtgcaatagactt

SEQ ID NO: 337598 - DNA, 15 bp, Homo sapiens
agtgcaatagacttt

SEQ ID NO: 337599 - DNA, 15 bp, Homo sapiens
gtgcaatagactttt

SEQ ID NO: 337600 - DNA, 15 bp, Homo sapiens
tgcaatagacttttc

SEQ ID NO: 337601 - DNA, 15 bp, Homo sapiens
gcaatagacttttct

SEQ ID NO: 337602 - DNA, 15 bp, Homo sapiens
caatagacttttcta

SEQ ID NO: 337603 - DNA, 15 bp, Homo sapiens
aatagacttttctac

SEQ ID NO: 337604 - DNA, 15 bp, Homo sapiens
atagacttttctacg

SEQ ID NO: 337605 - DNA, 15 bp, Homo sapiens
tagacttttctacgt

SEQ ID NO: 337606 - DNA, 15 bp, Homo sapiens
agacttttctacgtc

SEQ ID NO: 337607 - DNA, 15 bp, Homo sapiens
gacttttctacgtct

SEQ ID NO: 337608 - DNA, 15 bp, Homo sapiens
acttttctacgtctt

SEQ ID NO: 337609 - DNA, 15 bp, Homo sapiens
cttttctacgtctta

SEQ ID NO: 337610 - DNA, 15 bp, Homo sapiens
ttttctacgtcttat

SEQ ID NO: 337611 - DNA, 15 bp, Homo sapiens
tttctacgtcttata

SEQ ID NO: 337612 - DNA, 15 bp, Homo sapiens
ttctacgtcttatat

SEQ ID NO: 337613 - DNA, 15 bp, Homo sapiens
tctacgtcttatatc

SEQ ID NO: 337614 - DNA, 15 bp, Homo sapiens
ctacgtcttatatct

SEQ ID NO: 337615 - DNA, 15 bp, Homo sapiens
tacgtcttatatctg

SEQ ID NO: 337616 - DNA, 15 bp, Homo sapiens
acgtcttatatctgg

SEQ ID NO: 337617 - DNA, 15 bp, Homo sapiens
cgtcttatatctgga

SEQ ID NO: 337618 - DNA, 15 bp, Homo sapiens
gtcttatatctggaa

SEQ ID NO: 337619 - DNA, 15 bp, Homo sapiens
tcttatatctggaaa

SEQ ID NO: 337620 - DNA, 15 bp, Homo sapiens
cttatatctggaaac

SEQ ID NO: 337621 - DNA, 15 bp, Homo sapiens
ttatatctggaaact

SEQ ID NO: 337622 - DNA, 15 bp, Homo sapiens
tatatctggaaactt

SEQ ID NO: 337623 - DNA, 15 bp, Homo sapiens
atatctggaaactta

SEQ ID NO: 337624 - DNA, 15 bp, Homo sapiens
tatctggaaacttaa

SEQ ID NO: 337625 - DNA, 15 bp, Homo sapiens
atctggaaacttaat

SEQ ID NO: 337626 - DNA, 15 bp, Homo sapiens
tctggaaacttaatc

SEQ ID NO: 337627 - DNA, 15 bp, Homo sapiens
ctggaaacttaatca

SEQ ID NO: 337628 - DNA, 15 bp, Homo sapiens
tggaaacttaatcag

SEQ ID NO: 337629 - DNA, 15 bp, Homo sapiens
ggaaacttaatcagt

SEQ ID NO: 337630 - DNA, 15 bp, Homo sapiens
gaaacttaatcagtt

SEQ ID NO: 337631 - DNA, 15 bp, Homo sapiens
aaacttaatcagttc

SEQ ID NO: 337632 - DNA, 15 bp, Homo sapiens
aacttaatcagttct

SEQ ID NO: 337633 - DNA, 15 bp, Homo sapiens
acttaatcagttctt

SEQ ID NO: 337634 - DNA, 15 bp, Homo sapiens
cttaatcagttctta

SEQ ID NO: 337635 - DNA, 15 bp, Homo sapiens
ttaatcagttcttac

SEQ ID NO: 337636 - DNA, 15 bp, Homo sapiens
taatcagttcttaca

SEQ ID NO: 337637 - DNA, 15 bp, Homo sapiens
aatcagttcttacaa

SEQ ID NO: 337638 - DNA, 15 bp, Homo sapiens
atcagttcttacaaa

SEQ ID NO: 337639 - DNA, 15 bp, Homo sapiens
tcagttcttacaaat

SEQ ID NO: 337640 - DNA, 15 bp, Homo sapiens
cagttcttacaaatt

SEQ ID NO: 337641 - DNA, 15 bp, Homo sapiens
agttcttacaaattt

SEQ ID NO: 337642 - DNA, 15 bp, Homo sapiens
gttcttacaaatttt

SEQ ID NO: 337643 - DNA, 15 bp, Homo sapiens
ttcttacaaatttta

SEQ ID NO: 337644 - DNA, 15 bp, Homo sapiens
tcttacaaattttag

SEQ ID NO: 337645 - DNA, 15 bp, Homo sapiens
cttacaaattttagt

SEQ ID NO: 337646 - DNA, 15 bp, Homo sapiens
ttacaaattttagta

SEQ ID NO: 337647 - DNA, 15 bp, Homo sapiens
tacaaattttagtaa

SEQ ID NO: 337648 - DNA, 15 bp, Homo sapiens
acaaattttagtaag

SEQ ID NO: 337649 - DNA, 15 bp, Homo sapiens
caaattttagtaagt

SEQ ID NO: 337650 - DNA, 15 bp, Homo sapiens
aaattttagtaagtt

SEQ ID NO: 337651 - DNA, 15 bp, Homo sapiens
aattttagtaagttt

SEQ ID NO: 337652 - DNA, 15 bp, Homo sapiens
attttagtaagtttg

SEQ ID NO: 337653 - DNA, 15 bp, Homo sapiens
ttttagtaagtttgt

SEQ ID NO: 337654 - DNA, 15 bp, Homo sapiens
tttagtaagtttgtc

SEQ ID NO: 337655 - DNA, 15 bp, Homo sapiens
ttagtaagtttgtct

SEQ ID NO: 337656 - DNA, 15 bp, Homo sapiens
tagtaagtttgtctc

SEQ ID NO: 337657 - DNA, 15 bp, Homo sapiens
agtaagtttgtctct

SEQ ID NO: 337658 - DNA, 15 bp, Homo sapiens
gtaagtttgtctcta

SEQ ID NO: 337659 - DNA, 15 bp, Homo sapiens
taagtttgtctctag

SEQ ID NO: 337660 - DNA, 15 bp, Homo sapiens
aagtttgtctctaga

SEQ ID NO: 337661 - DNA, 15 bp, Homo sapiens
agtttgtctctagat

SEQ ID NO: 337662 - DNA, 15 bp, Homo sapiens
gtttgtctctagatt

SEQ ID NO: 337663 - DNA, 15 bp, Homo sapiens
tttgtctctagattg

SEQ ID NO: 337664 - DNA, 15 bp, Homo sapiens
ttgtctctagattgt

SEQ ID NO: 337665 - DNA, 15 bp, Homo sapiens
tgtctctagattgta

SEQ ID NO: 337666 - DNA, 15 bp, Homo sapiens
gtctctagattgtag

SEQ ID NO: 337667 - DNA, 15 bp, Homo sapiens
tctctagattgtagg

SEQ ID NO: 337668 - DNA, 15 bp, Homo sapiens
ctctagattgtaggt

SEQ ID NO: 337669 - DNA, 15 bp, Homo sapiens
tctagattgtaggtt

SEQ ID NO: 337670 - DNA, 15 bp, Homo sapiens
ctagattgtaggttt

SEQ ID NO: 337671 - DNA, 15 bp, Homo sapiens
tagattgtaggtttc

SEQ ID NO: 337672 - DNA, 15 bp, Homo sapiens
agattgtaggtttct

SEQ ID NO: 337673 - DNA, 15 bp, Homo sapiens
attgtaggtttcttg

SEQ ID NO: 337674 - DNA, 15 bp, Homo sapiens
ttgtaggtttcttgg

SEQ ID NO: 337675 - DNA, 15 bp, Homo sapiens
tgtaggtttcttgga

SEQ ID NO: 337676 - DNA, 15 bp, Homo sapiens
gtaggtttcttggag

SEQ ID NO: 337677 - DNA, 15 bp, Homo sapiens
taggtttcttggagg

SEQ ID NO: 337678 - DNA, 15 bp, Homo sapiens
aggtttcttggagga

SEQ ID NO: 337679 - DNA, 15 bp, Homo sapiens
ggtttcttggaggag

SEQ ID NO: 337680 - DNA, 15 bp, Homo sapiens
gtttcttggaggagg

SEQ ID NO: 337681 - DNA, 15 bp, Homo sapiens
tttcttggaggagga

SEQ ID NO: 337682 - DNA, 15 bp, Homo sapiens
ttcttggaggaggag

SEQ ID NO: 337683 - DNA, 15 bp, Homo sapiens
tcttggaggaggagg

SEQ ID NO: 337684 - DNA, 15 bp, Homo sapiens
cttggaggaggaggg

SEQ ID NO: 337685 - DNA, 15 bp, Homo sapiens
ttggaggaggaggga

SEQ ID NO: 337686 - DNA, 15 bp, Homo sapiens
tggaggaggagggat

SEQ ID NO: 337687 - DNA, 15 bp, Homo sapiens
ggaggaggagggatt

SEQ ID NO: 337688 - DNA, 15 bp, Homo sapiens
gaggaggagggatta

SEQ ID NO: 337689 - DNA, 15 bp, Homo sapiens
aggaggagggattag

SEQ ID NO: 337690 - DNA, 15 bp, Homo sapiens
ggaggagggattaga

SEQ ID NO: 337691 - DNA, 15 bp, Homo sapiens
gaggagggattagaa

SEQ ID NO: 337692 - DNA, 15 bp, Homo sapiens
aggagggattagaat

SEQ ID NO: 337693 - DNA, 15 bp, Homo sapiens
ggagggattagaatg

SEQ ID NO: 337694 - DNA, 15 bp, Homo sapiens
gagggattagaatgt

SEQ ID NO: 337695 - DNA, 15 bp, Homo sapiens
agggattagaatgtc

SEQ ID NO: 337696 - DNA, 15 bp, Homo sapiens
gggattagaatgtcc

SEQ ID NO: 337697 - DNA, 15 bp, Homo sapiens
ggattagaatgtcct

SEQ ID NO: 337698 - DNA, 15 bp, Homo sapiens
gattagaatgtccta

SEQ ID NO: 337699 - DNA, 15 bp, Homo sapiens
attagaatgtcctag

SEQ ID NO: 337700 - DNA, 15 bp, Homo sapiens
ttagaatgtcctaga

SEQ ID NO: 337701 - DNA, 15 bp, Homo sapiens
tagaatgtcctagaa

SEQ ID NO: 337702 - DNA, 15 bp, Homo sapiens
agaatgtcctagaat

SEQ ID NO: 337703 - DNA, 15 bp, Homo sapiens
gaatgtcctagaatt

SEQ ID NO: 337704 - DNA, 15 bp, Homo sapiens
aatgtcctagaatta

SEQ ID NO: 337705 - DNA, 15 bp, Homo sapiens
atgtcctagaattat

SEQ ID NO: 337706 - DNA, 15 bp, Homo sapiens
tgtcctagaattatg

SEQ ID NO: 337707 - DNA, 15 bp, Homo sapiens
gtcctagaattatga

SEQ ID NO: 337708 - DNA, 15 bp, Homo sapiens
tcctagaattatgat

SEQ ID NO: 337709 - DNA, 15 bp, Homo sapiens
cctagaattatgatc

SEQ ID NO: 337710 - DNA, 15 bp, Homo sapiens
ctagaattatgatcc

SEQ ID NO: 337711 - DNA, 15 bp, Homo sapiens
tagaattatgatcct

SEQ ID NO: 337712 - DNA, 15 bp, Homo sapiens
agaattatgatcctt

SEQ ID NO: 337713 - DNA, 15 bp, Homo sapiens
gaattatgatccttt

SEQ ID NO: 337714 - DNA, 15 bp, Homo sapiens
aattatgatcctttt

SEQ ID NO: 337715 - DNA, 15 bp, Homo sapiens
attatgatcctttta

SEQ ID NO: 337716 - DNA, 15 bp, Homo sapiens
ttatgatccttttat

SEQ ID NO: 337717 - DNA, 15 bp, Homo sapiens
tatgatccttttatt

SEQ ID NO: 337718 - DNA, 15 bp, Homo sapiens
atgatccttttattt

SEQ ID NO: 337719 - DNA, 15 bp, Homo sapiens
tgatccttttatttc

SEQ ID NO: 337720 - DNA, 15 bp, Homo sapiens
gatccttttatttct

SEQ ID NO: 337721 - DNA, 15 bp, Homo sapiens
atccttttatttctt

SEQ ID NO: 337722 - DNA, 15 bp, Homo sapiens
tccttttatttcttc

SEQ ID NO: 337723 - DNA, 15 bp, Homo sapiens
ccttttatttcttct

SEQ ID NO: 337724 - DNA, 15 bp, Homo sapiens
cttttatttcttctg

SEQ ID NO: 337725 - DNA, 15 bp, Homo sapiens
ttttatttcttctgt

SEQ ID NO: 337726 - DNA, 15 bp, Homo sapiens
tttatttcttctgtt

SEQ ID NO: 337727 - DNA, 15 bp, Homo sapiens
ttatttcttctgttt

SEQ ID NO: 337728 - DNA, 15 bp, Homo sapiens
tatttcttctgtttt

SEQ ID NO: 337729 - DNA, 15 bp, Homo sapiens
atttcttctgttttc

SEQ ID NO: 337730 - DNA, 15 bp, Homo sapiens
tttcttctgttttct

SEQ ID NO: 337731 - DNA, 15 bp, Homo sapiens
ttcttctgttttctt

SEQ ID NO: 337732 - DNA, 15 bp, Homo sapiens
tcttctgttttcttt

SEQ ID NO: 337733 - DNA, 15 bp, Homo sapiens
cttctgttttctttt

SEQ ID NO: 337734 - DNA, 15 bp, Homo sapiens
ttctgttttcttttt

SEQ ID NO: 337735 - DNA, 15 bp, Homo sapiens
tctgttttctttttt

SEQ ID NO: 337736 - DNA, 15 bp, Homo sapiens
ctgttttcttttttg

SEQ ID NO: 337737 - DNA, 15 bp, Homo sapiens
tgttttcttttttgt

SEQ ID NO: 337738 - DNA, 15 bp, Homo sapiens
gttttcttttttgtt

SEQ ID NO: 337739 - DNA, 15 bp, Homo sapiens
ttttcttttttgttc

SEQ ID NO: 337740 - DNA, 15 bp, Homo sapiens
tttcttttttgttct

SEQ ID NO: 337741 - DNA, 15 bp, Homo sapiens
ttcttttttgttctc

SEQ ID NO: 337742 - DNA, 15 bp, Homo sapiens
tcttttttgttctct

SEQ ID NO: 337743 - DNA, 15 bp, Homo sapiens
cttttttgttctcta

SEQ ID NO: 337744 - DNA, 15 bp, Homo sapiens
ttttttgttctctat

SEQ ID NO: 337745 - DNA, 15 bp, Homo sapiens
tttttgttctctatt

SEQ ID NO: 337746 - DNA, 15 bp, Homo sapiens
ttttgttctctattg

SEQ ID NO: 337747 - DNA, 15 bp, Homo sapiens
tttgttctctattgt

SEQ ID NO: 337748 - DNA, 15 bp, Homo sapiens
ttgttctctattgtg

SEQ ID NO: 337749 - DNA, 15 bp, Homo sapiens
tgttctctattgtgc

SEQ ID NO: 337750 - DNA, 15 bp, Homo sapiens
gttctctattgtgcc

SEQ ID NO: 337751 - DNA, 15 bp, Homo sapiens
ttctctattgtgcct

SEQ ID NO: 337752 - DNA, 15 bp, Homo sapiens
tctctattgtgcctt

SEQ ID NO: 337753 - DNA, 15 bp, Homo sapiens
ctctattgtgccttg

SEQ ID NO: 337754 - DNA, 15 bp, Homo sapiens
tctattgtgccttgt

SEQ ID NO: 337755 - DNA, 15 bp, Homo sapiens
ctattgtgccttgtc

SEQ ID NO: 337756 - DNA, 15 bp, Homo sapiens
tattgtgccttgtcc

SEQ ID NO: 337757 - DNA, 15 bp, Homo sapiens
attgtgccttgtcct

SEQ ID NO: 337758 - DNA, 15 bp, Homo sapiens
ttgtgccttgtcctt

SEQ ID NO: 337759 - DNA, 15 bp, Homo sapiens
tgtgccttgtccttc

SEQ ID NO: 337760 - DNA, 15 bp, Homo sapiens
gtgccttgtccttca

SEQ ID NO: 337761 - DNA, 15 bp, Homo sapiens
tgccttgtccttcaa

SEQ ID NO: 337762 - DNA, 15 bp, Homo sapiens
gccttgtccttcaat

SEQ ID NO: 337763 - DNA, 15 bp, Homo sapiens
ccttgtccttcaatg

SEQ ID NO: 337764 - DNA, 15 bp, Homo sapiens
cttgtccttcaatgc

SEQ ID NO: 337765 - DNA, 15 bp, Homo sapiens
ttgtccttcaatgca

SEQ ID NO: 337766 - DNA, 15 bp, Homo sapiens
tgtccttcaatgcaa

SEQ ID NO: 337767 - DNA, 15 bp, Homo sapiens
gtccttcaatgcaat

SEQ ID NO: 337768 - DNA, 15 bp, Homo sapiens
tccttcaatgcaatg

SEQ ID NO: 337769 - DNA, 15 bp, Homo sapiens
ccttcaatgcaatgt

SEQ ID NO: 337770 - DNA, 15 bp, Homo sapiens
cttcaatgcaatgtt

SEQ ID NO: 337771 - DNA, 15 bp, Homo sapiens
ttcaatgcaatgttg

SEQ ID NO: 337772 - DNA, 15 bp, Homo sapiens
tcaatgcaatgttga

SEQ ID NO: 337773 - DNA, 15 bp, Homo sapiens
caatgcaatgttgat

SEQ ID NO: 337774 - DNA, 15 bp, Homo sapiens
aatgcaatgttgatt

SEQ ID NO: 337775 - DNA, 15 bp, Homo sapiens
atgcaatgttgattt

SEQ ID NO: 337776 - DNA, 15 bp, Homo sapiens
tgcaatgttgatttg

SEQ ID NO: 337777 - DNA, 15 bp, Homo sapiens
gcaatgttgatttga

SEQ ID NO: 337778 - DNA, 15 bp, Homo sapiens
caatgttgatttgaa

SEQ ID NO: 337779 - DNA, 15 bp, Homo sapiens
aatgttgatttgaat

SEQ ID NO: 337780 - DNA, 15 bp, Homo sapiens
atgttgatttgaatt

SEQ ID NO: 337781 - DNA, 15 bp, Homo sapiens
tgttgatttgaattg

SEQ ID NO: 337782 - DNA, 15 bp, Homo sapiens
gttgatttgaattgg

SEQ ID NO: 337783 - DNA, 15 bp, Homo sapiens
ttgatttgaattggt

SEQ ID NO: 337784 - DNA, 15 bp, Homo sapiens
tgatttgaattggtg

SEQ ID NO: 337785 - DNA, 15 bp, Homo sapiens
gatttgaattggtga

SEQ ID NO: 337786 - DNA, 15 bp, Homo sapiens
atttgaattggtgat

SEQ ID NO: 337787 - DNA, 15 bp, Homo sapiens
tttgaattggtgata

SEQ ID NO: 337788 - DNA, 15 bp, Homo sapiens
ttgaattggtgatag

SEQ ID NO: 337789 - DNA, 15 bp, Homo sapiens
tgaattggtgatagt

SEQ ID NO: 337790 - DNA, 15 bp, Homo sapiens
gaattggtgatagtg

SEQ ID NO: 337791 - DNA, 15 bp, Homo sapiens
aattggtgatagtgg

SEQ ID NO: 337792 - DNA, 15 bp, Homo sapiens
attggtgatagtggg

SEQ ID NO: 337793 - DNA, 15 bp, Homo sapiens
ttggtgatagtgggc

SEQ ID NO: 337794 - DNA, 15 bp, Homo sapiens
tggtgatagtgggca

SEQ ID NO: 337795 - DNA, 15 bp, Homo sapiens
ggtgatagtgggcag

SEQ ID NO: 337796 - DNA, 15 bp, Homo sapiens
gtgatagtgggcaga

SEQ ID NO: 337797 - DNA, 15 bp, Homo sapiens
tgatagtgggcagaa

SEQ ID NO: 337798 - DNA, 15 bp, Homo sapiens
gatagtgggcagaat

SEQ ID NO: 337799 - DNA, 15 bp, Homo sapiens
atagtgggcagaatt

SEQ ID NO: 337800 - DNA, 15 bp, Homo sapiens
tagtgggcagaattt

SEQ ID NO: 337801 - DNA, 15 bp, Homo sapiens
agtgggcagaatttt

SEQ ID NO: 337802 - DNA, 15 bp, Homo sapiens
gtgggcagaattttt

SEQ ID NO: 337803 - DNA, 15 bp, Homo sapiens
tgggcagaatttttg

SEQ ID NO: 337804 - DNA, 15 bp, Homo sapiens
gggcagaatttttgt

SEQ ID NO: 337805 - DNA, 15 bp, Homo sapiens
ggcagaatttttgtt

SEQ ID NO: 337806 - DNA, 15 bp, Homo sapiens
gcagaatttttgttg

SEQ ID NO: 337807 - DNA, 15 bp, Homo sapiens
cagaatttttgttgt

SEQ ID NO: 337808 - DNA, 15 bp, Homo sapiens
agaatttttgttgtt

SEQ ID NO: 337809 - DNA, 15 bp, Homo sapiens
gaatttttgttgttg

SEQ ID NO: 337810 - DNA, 15 bp, Homo sapiens
aatttttgttgttga

SEQ ID NO: 337811 - DNA, 15 bp, Homo sapiens
atttttgttgttgat

SEQ ID NO: 337812 - DNA, 15 bp, Homo sapiens
tttttgttgttgata

SEQ ID NO: 337813 - DNA, 15 bp, Homo sapiens
ttttgttgttgataa

SEQ ID NO: 337814 - DNA, 15 bp, Homo sapiens
tttgttgttgataat

SEQ ID NO: 337815 - DNA, 15 bp, Homo sapiens
ttgttgttgataata

SEQ ID NO: 337816 - DNA, 15 bp, Homo sapiens
tgttgttgataataa

SEQ ID NO: 337817 - DNA, 15 bp, Homo sapiens
gttgttgataataaa

SEQ ID NO: 337818 - DNA, 15 bp, Homo sapiens
ttgttgataataaaa

SEQ ID NO: 337819 - DNA, 15 bp, Homo sapiens
tgttgataataaaag

SEQ ID NO: 337820 - DNA, 15 bp, Homo sapiens
gttgataataaaagg

SEQ ID NO: 337821 - DNA, 15 bp, Homo sapiens
ttgataataaaagga

SEQ ID NO: 337822 - DNA, 15 bp, Homo sapiens
tgataataaaaggag

SEQ ID NO: 337823 - DNA, 15 bp, Homo sapiens
gataataaaaggagt

SEQ ID NO: 337824 - DNA, 15 bp, Homo sapiens
ataataaaaggagtg

SEQ ID NO: 337825 - DNA, 15 bp, Homo sapiens
taataaaaggagtgc

SEQ ID NO: 337826 - DNA, 15 bp, Homo sapiens
aataaaaggagtgct

SEQ ID NO: 337827 - DNA, 15 bp, Homo sapiens
ataaaaggagtgctt

SEQ ID NO: 337828 - DNA, 15 bp, Homo sapiens
taaaaggagtgcttt

SEQ ID NO: 337829 - DNA, 15 bp, Homo sapiens
aaaaggagtgctttt

SEQ ID NO: 337830 - DNA, 15 bp, Homo sapiens
aaaggagtgctttta

SEQ ID NO: 337831 - DNA, 15 bp, Homo sapiens
aaggagtgcttttag

SEQ ID NO: 337832 - DNA, 15 bp, Homo sapiens
aggagtgcttttagt

SEQ ID NO: 337833 - DNA, 15 bp, Homo sapiens
ggagtgcttttagtg

SEQ ID NO: 337834 - DNA, 15 bp, Homo sapiens
gagtgcttttagtgt

SEQ ID NO: 337835 - DNA, 15 bp, Homo sapiens
agtgcttttagtgtt

SEQ ID NO: 337836 - DNA, 15 bp, Homo sapiens
gtgcttttagtgttt

SEQ ID NO: 337837 - DNA, 15 bp, Homo sapiens
tgcttttagtgtttt

SEQ ID NO: 337838 - DNA, 15 bp, Homo sapiens
gcttttagtgtttta

SEQ ID NO: 337839 - DNA, 15 bp, Homo sapiens
cttttagtgttttac

SEQ ID NO: 337840 - DNA, 15 bp, Homo sapiens
ttttagtgttttacc

SEQ ID NO: 337841 - DNA, 15 bp, Homo sapiens
tttagtgttttacca

SEQ ID NO: 337842 - DNA, 15 bp, Homo sapiens
ttagtgttttaccat

SEQ ID NO: 337843 - DNA, 15 bp, Homo sapiens
tagtgttttaccata

SEQ ID NO: 337844 - DNA, 15 bp, Homo sapiens
agtgttttaccataa

SEQ ID NO: 337845 - DNA, 15 bp, Homo sapiens
gtgttttaccataag

SEQ ID NO: 337846 - DNA, 15 bp, Homo sapiens
tgttttaccataaga

SEQ ID NO: 337847 - DNA, 15 bp, Homo sapiens
gttttaccataagaa

SEQ ID NO: 337848 - DNA, 15 bp, Homo sapiens
ttttaccataagaat

SEQ ID NO: 337849 - DNA, 15 bp, Homo sapiens
tttaccataagaatg

SEQ ID NO: 337850 - DNA, 15 bp, Homo sapiens
ttaccataagaatga

SEQ ID NO: 337851 - DNA, 15 bp, Homo sapiens
taccataagaatgat

SEQ ID NO: 337852 - DNA, 15 bp, Homo sapiens
accataagaatgata

SEQ ID NO: 337853 - DNA, 15 bp, Homo sapiens
ccataagaatgatag

SEQ ID NO: 337854 - DNA, 15 bp, Homo sapiens
cataagaatgatagt

SEQ ID NO: 337855 - DNA, 15 bp, Homo sapiens
ataagaatgatagtt

SEQ ID NO: 337856 - DNA, 15 bp, Homo sapiens
taagaatgatagttt

SEQ ID NO: 337857 - DNA, 15 bp, Homo sapiens
aagaatgatagtttt

SEQ ID NO: 337858 - DNA, 15 bp, Homo sapiens
agaatgatagttttt

SEQ ID NO: 337859 - DNA, 15 bp, Homo sapiens
gaatgatagtttttg

SEQ ID NO: 337860 - DNA, 15 bp, Homo sapiens
aatgatagtttttgt

SEQ ID NO: 337861 - DNA, 15 bp, Homo sapiens
atgatagtttttgta

SEQ ID NO: 337862 - DNA, 15 bp, Homo sapiens
tgatagtttttgtag

SEQ ID NO: 337863 - DNA, 15 bp, Homo sapiens
gatagtttttgtagc

SEQ ID NO: 337864 - DNA, 15 bp, Homo sapiens
atagtttttgtagct

SEQ ID NO: 337865 - DNA, 15 bp, Homo sapiens
tagtttttgtagctt

SEQ ID NO: 337866 - DNA, 15 bp, Homo sapiens
agtttttgtagcttt

SEQ ID NO: 337867 - DNA, 15 bp, Homo sapiens
gtttttgtagctttt

SEQ ID NO: 337868 - DNA, 15 bp, Homo sapiens
tttttgtagcttttt

SEQ ID NO: 337869 - DNA, 15 bp, Homo sapiens
ttttgtagctttttt

SEQ ID NO: 337870 - DNA, 15 bp, Homo sapiens
tttgtagcttttttg

SEQ ID NO: 337871 - DNA, 15 bp, Homo sapiens
ttgtagcttttttgg

SEQ ID NO: 337872 - DNA, 15 bp, Homo sapiens
tgtagcttttttggt

SEQ ID NO: 337873 - DNA, 15 bp, Homo sapiens
gtagcttttttggta

SEQ ID NO: 337874 - DNA, 15 bp, Homo sapiens
tagcttttttggtac

SEQ ID NO: 337875 - DNA, 15 bp, Homo sapiens
agcttttttggtaca

SEQ ID NO: 337876 - DNA, 15 bp, Homo sapiens
gcttttttggtacac

SEQ ID NO: 337877 - DNA, 15 bp, Homo sapiens
cttttttggtacact

SEQ ID NO: 337878 - DNA, 15 bp, Homo sapiens
ttttttggtacactt

SEQ ID NO: 337879 - DNA, 15 bp, Homo sapiens
tttttggtacacttt

SEQ ID NO: 337880 - DNA, 15 bp, Homo sapiens
ttttggtacactttt

SEQ ID NO: 337881 - DNA, 15 bp, Homo sapiens
tttggtacacttttt

SEQ ID NO: 337882 - DNA, 15 bp, Homo sapiens
ttggtacacttttta

SEQ ID NO: 337883 - DNA, 15 bp, Homo sapiens
tggtacactttttat

SEQ ID NO: 337884 - DNA, 15 bp, Homo sapiens
ggtacactttttatg

SEQ ID NO: 337885 - DNA, 15 bp, Homo sapiens
gtacactttttatga

SEQ ID NO: 337886 - DNA, 15 bp, Homo sapiens
tacactttttatgag

SEQ ID NO: 337887 - DNA, 15 bp, Homo sapiens
acactttttatgagg

SEQ ID NO: 337888 - DNA, 15 bp, Homo sapiens
cactttttatgaggt

SEQ ID NO: 337889 - DNA, 15 bp, Homo sapiens
actttttatgaggtt

SEQ ID NO: 337890 - DNA, 15 bp, Homo sapiens
ctttttatgaggtta

SEQ ID NO: 337891 - DNA, 15 bp, Homo sapiens
tttttatgaggttaa

SEQ ID NO: 337892 - DNA, 15 bp, Homo sapiens
ttttatgaggttaaa

SEQ ID NO: 337893 - DNA, 15 bp, Homo sapiens
tttatgaggttaaag

SEQ ID NO: 337894 - DNA, 15 bp, Homo sapiens
ttatgaggttaaagg

SEQ ID NO: 337895 - DNA, 15 bp, Homo sapiens
tatgaggttaaagga

SEQ ID NO: 337896 - DNA, 15 bp, Homo sapiens
atgaggttaaaggag

SEQ ID NO: 337897 - DNA, 15 bp, Homo sapiens
tgaggttaaaggagg

SEQ ID NO: 337898 - DNA, 15 bp, Homo sapiens
gaggttaaaggaggt

SEQ ID NO: 337899 - DNA, 15 bp, Homo sapiens
aggttaaaggaggtt

SEQ ID NO: 337900 - DNA, 15 bp, Homo sapiens
ggttaaaggaggttg

SEQ ID NO: 337901 - DNA, 15 bp, Homo sapiens
gttaaaggaggttgc

SEQ ID NO: 337902 - DNA, 15 bp, Homo sapiens
ttaaaggaggttgcc

SEQ ID NO: 337903 - DNA, 15 bp, Homo sapiens
taaaggaggttgccc

SEQ ID NO: 337904 - DNA, 15 bp, Homo sapiens
aaaggaggttgccct

SEQ ID NO: 337905 - DNA, 15 bp, Homo sapiens
aaggaggttgcccta

SEQ ID NO: 337906 - DNA, 15 bp, Homo sapiens
aggaggttgccctag

SEQ ID NO: 337907 - DNA, 15 bp, Homo sapiens
ggaggttgccctagg

SEQ ID NO: 337908 - DNA, 15 bp, Homo sapiens
gaggttgccctaggt

SEQ ID NO: 337909 - DNA, 15 bp, Homo sapiens
aggttgccctaggtt

SEQ ID NO: 337910 - DNA, 15 bp, Homo sapiens
ggttgccctaggttt

SEQ ID NO: 337911 - DNA, 15 bp, Homo sapiens
gttgccctaggtttt

SEQ ID NO: 337912 - DNA, 15 bp, Homo sapiens
ttgccctaggttttt

SEQ ID NO: 337913 - DNA, 15 bp, Homo sapiens
tgccctaggttttta

SEQ ID NO: 337914 - DNA, 15 bp, Homo sapiens
gccctaggtttttag

SEQ ID NO: 337915 - DNA, 15 bp, Homo sapiens
ccctaggtttttagt

SEQ ID NO: 337916 - DNA, 15 bp, Homo sapiens
cctaggtttttagtt

SEQ ID NO: 337917 - DNA, 15 bp, Homo sapiens
ctaggtttttagttg

SEQ ID NO: 337918 - DNA, 15 bp, Homo sapiens
taggtttttagttgg

SEQ ID NO: 337919 - DNA, 15 bp, Homo sapiens
aggtttttagttggt

SEQ ID NO: 337920 - DNA, 15 bp, Homo sapiens
ggtttttagttggtt

SEQ ID NO: 337921 - DNA, 15 bp, Homo sapiens
gtttttagttggtta

SEQ ID NO: 337922 - DNA, 15 bp, Homo sapiens
tttttagttggttaa

SEQ ID NO: 337923 - DNA, 15 bp, Homo sapiens
ttttagttggttaag

SEQ ID NO: 337924 - DNA, 15 bp, Homo sapiens
tttagttggttaagg

SEQ ID NO: 337925 - DNA, 15 bp, Homo sapiens
ttagttggttaaggg

SEQ ID NO: 337926 - DNA, 15 bp, Homo sapiens
tagttggttaaggga

SEQ ID NO: 337927 - DNA, 15 bp, Homo sapiens
agttggttaagggat

SEQ ID NO: 337928 - DNA, 15 bp, Homo sapiens
gttggttaagggatt

SEQ ID NO: 337929 - DNA, 15 bp, Homo sapiens
ttggttaagggattt

SEQ ID NO: 337930 - DNA, 15 bp, Homo sapiens
tggttaagggatttt

SEQ ID NO: 337931 - DNA, 15 bp, Homo sapiens
ggttaagggatttta

SEQ ID NO: 337932 - DNA, 15 bp, Homo sapiens
gttaagggattttat

SEQ ID NO: 337933 - DNA, 15 bp, Homo sapiens
ttaagggattttatc

SEQ ID NO: 337934 - DNA, 15 bp, Homo sapiens
taagggattttatca

SEQ ID NO: 337935 - DNA, 15 bp, Homo sapiens
aagggattttatcaa

SEQ ID NO: 337936 - DNA, 15 bp, Homo sapiens
agggattttatcaag

SEQ ID NO: 337937 - DNA, 15 bp, Homo sapiens
gggattttatcaaga

SEQ ID NO: 337938 - DNA, 15 bp, Homo sapiens
ggattttatcaagaa

SEQ ID NO: 337939 - DNA, 15 bp, Homo sapiens
gattttatcaagaaa

SEQ ID NO: 337940 - DNA, 15 bp, Homo sapiens
attttatcaagaaac

SEQ ID NO: 337941 - DNA, 15 bp, Homo sapiens
ttttatcaagaaact

SEQ ID NO: 337942 - DNA, 15 bp, Homo sapiens
tttatcaagaaactg

SEQ ID NO: 337943 - DNA, 15 bp, Homo sapiens
ttatcaagaaactgt

SEQ ID NO: 337944 - DNA, 15 bp, Homo sapiens
tatcaagaaactgta

SEQ ID NO: 337945 - DNA, 15 bp, Homo sapiens
atcaagaaactgtag

SEQ ID NO: 337946 - DNA, 15 bp, Homo sapiens
tcaagaaactgtaga

SEQ ID NO: 337947 - DNA, 15 bp, Homo sapiens
caagaaactgtagaa

SEQ ID NO: 337948 - DNA, 15 bp, Homo sapiens
aagaaactgtagaat

SEQ ID NO: 337949 - DNA, 15 bp, Homo sapiens
agaaactgtagaatt

SEQ ID NO: 337950 - DNA, 15 bp, Homo sapiens
gaaactgtagaattt

SEQ ID NO: 337951 - DNA, 15 bp, Homo sapiens
aaactgtagaatttt

SEQ ID NO: 337952 - DNA, 15 bp, Homo sapiens
aactgtagaatttta

SEQ ID NO: 337953 - DNA, 15 bp, Homo sapiens
actgtagaattttag

SEQ ID NO: 337954 - DNA, 15 bp, Homo sapiens
ctgtagaattttagc

SEQ ID NO: 337955 - DNA, 15 bp, Homo sapiens
tgtagaattttagcc

SEQ ID NO: 337956 - DNA, 15 bp, Homo sapiens
gtagaattttagcca

SEQ ID NO: 337957 - DNA, 15 bp, Homo sapiens
tagaattttagccaa

SEQ ID NO: 337958 - DNA, 15 bp, Homo sapiens
agaattttagccaat

SEQ ID NO: 337959 - DNA, 15 bp, Homo sapiens
gaattttagccaata

SEQ ID NO: 337960 - DNA, 15 bp, Homo sapiens
aattttagccaatat

SEQ ID NO: 337961 - DNA, 15 bp, Homo sapiens
attttagccaatata

SEQ ID NO: 337962 - DNA, 15 bp, Homo sapiens
ttttagccaatatac

SEQ ID NO: 337963 - DNA, 15 bp, Homo sapiens
tttagccaatatacc

SEQ ID NO: 337964 - DNA, 15 bp, Homo sapiens
ttagccaatatacca

SEQ ID NO: 337965 - DNA, 15 bp, Homo sapiens
tagccaatataccat

SEQ ID NO: 337966 - DNA, 15 bp, Homo sapiens
agccaatataccatt

SEQ ID NO: 337967 - DNA, 15 bp, Homo sapiens
gccaatataccattc

SEQ ID NO: 337968 - DNA, 15 bp, Homo sapiens
ccaatataccattcc

SEQ ID NO: 337969 - DNA, 15 bp, Homo sapiens
caatataccattcca

SEQ ID NO: 337970 - DNA, 15 bp, Homo sapiens
aatataccattccat

SEQ ID NO: 337971 - DNA, 15 bp, Homo sapiens
atataccattccatt

SEQ ID NO: 337972 - DNA, 15 bp, Homo sapiens
tataccattccattt

SEQ ID NO: 337973 - DNA, 15 bp, Homo sapiens
ataccattccattta

SEQ ID NO: 337974 - DNA, 15 bp, Homo sapiens
taccattccatttat

SEQ ID NO: 337975 - DNA, 15 bp, Homo sapiens
accattccatttatt

SEQ ID NO: 337976 - DNA, 15 bp, Homo sapiens
ccattccatttatta

SEQ ID NO: 337977 - DNA, 15 bp, Homo sapiens
cattccatttattaa

SEQ ID NO: 337978 - DNA, 15 bp, Homo sapiens
attccatttattaat

SEQ ID NO: 337979 - DNA, 15 bp, Homo sapiens
ttccatttattaatt

SEQ ID NO: 337980 - DNA, 15 bp, Homo sapiens
tccatttattaatta

SEQ ID NO: 337981 - DNA, 15 bp, Homo sapiens
ccatttattaattaa

SEQ ID NO: 337982 - DNA, 15 bp, Homo sapiens
catttattaattaat

SEQ ID NO: 337983 - DNA, 15 bp, Homo sapiens
atttattaattaatt

SEQ ID NO: 337984 - DNA, 15 bp, Homo sapiens
tttattaattaattg

SEQ ID NO: 337985 - DNA, 15 bp, Homo sapiens
ttattaattaattga

SEQ ID NO: 337986 - DNA, 15 bp, Homo sapiens
tattaattaattgat

SEQ ID NO: 337987 - DNA, 15 bp, Homo sapiens
attaattaattgatt

SEQ ID NO: 337988 - DNA, 15 bp, Homo sapiens
ttaattaattgattc

SEQ ID NO: 337989 - DNA, 15 bp, Homo sapiens
taattaattgattca

SEQ ID NO: 337990 - DNA, 15 bp, Homo sapiens
aattaattgattcaa

SEQ ID NO: 337991 - DNA, 15 bp, Homo sapiens
attaattgattcaac

SEQ ID NO: 337992 - DNA, 15 bp, Homo sapiens
ttaattgattcaaca

SEQ ID NO: 337993 - DNA, 15 bp, Homo sapiens
taattgattcaacaa

SEQ ID NO: 337994 - DNA, 15 bp, Homo sapiens
aattgattcaacaaa

SEQ ID NO: 337995 - DNA, 15 bp, Homo sapiens
attgattcaacaaat

SEQ ID NO: 337996 - DNA, 15 bp, Homo sapiens
ttgattcaacaaata

SEQ ID NO: 337997 - DNA, 15 bp, Homo sapiens
tgattcaacaaatac

SEQ ID NO: 337998 - DNA, 15 bp, Homo sapiens
gattcaacaaatacg

SEQ ID NO: 337999 - DNA, 15 bp, Homo sapiens
attcaacaaatacgt

SEQ ID NO: 338000 - DNA, 15 bp, Homo sapiens
ttcaacaaatacgtg

SEQ ID NO: 338001 - DNA, 15 bp, Homo sapiens
tcaacaaatacgtgt

SEQ ID NO: 338002 - DNA, 15 bp, Homo sapiens
caacaaatacgtgtg

SEQ ID NO: 338003 - DNA, 15 bp, Homo sapiens
aacaaatacgtgtgg

SEQ ID NO: 338004 - DNA, 15 bp, Homo sapiens
acaaatacgtgtggg

SEQ ID NO: 338005 - DNA, 15 bp, Homo sapiens
caaatacgtgtgggg

SEQ ID NO: 338006 - DNA, 15 bp, Homo sapiens
aaatacgtgtggggt

SEQ ID NO: 338007 - DNA, 15 bp, Homo sapiens
aatacgtgtggggtg

SEQ ID NO: 338008 - DNA, 15 bp, Homo sapiens
atacgtgtggggtgc

SEQ ID NO: 338009 - DNA, 15 bp, Homo sapiens
tacgtgtggggtgcc

SEQ ID NO: 338010 - DNA, 15 bp, Homo sapiens
acgtgtggggtgcct

SEQ ID NO: 338011 - DNA, 15 bp, Homo sapiens
cgtgtggggtgcctt

SEQ ID NO: 338012 - DNA, 15 bp, Homo sapiens
gtgtggggtgccttt

SEQ ID NO: 338013 - DNA, 15 bp, Homo sapiens
tgtggggtgcctttt

SEQ ID NO: 338014 - DNA, 15 bp, Homo sapiens
gtggggtgcctttta

SEQ ID NO: 338015 - DNA, 15 bp, Homo sapiens
tggggtgccttttat

SEQ ID NO: 338016 - DNA, 15 bp, Homo sapiens
ggggtgccttttatg

SEQ ID NO: 338017 - DNA, 15 bp, Homo sapiens
gggtgccttttatgt

SEQ ID NO: 338018 - DNA, 15 bp, Homo sapiens
ggtgccttttatgtg

SEQ ID NO: 338019 - DNA, 15 bp, Homo sapiens
gtgccttttatgtgc

SEQ ID NO: 338020 - DNA, 15 bp, Homo sapiens
tgccttttatgtgct

SEQ ID NO: 338021 - DNA, 15 bp, Homo sapiens
gccttttatgtgcta

SEQ ID NO: 338022 - DNA, 15 bp, Homo sapiens
ccttttatgtgctag

SEQ ID NO: 338023 - DNA, 15 bp, Homo sapiens
cttttatgtgctaga

SEQ ID NO: 338024 - DNA, 15 bp, Homo sapiens
ttttatgtgctagac

SEQ ID NO: 338025 - DNA, 15 bp, Homo sapiens
tttatgtgctagaca

SEQ ID NO: 338026 - DNA, 15 bp, Homo sapiens
ttatgtgctagacac

SEQ ID NO: 338027 - DNA, 15 bp, Homo sapiens
tatgtgctagacaca

SEQ ID NO: 338028 - DNA, 15 bp, Homo sapiens
atgtgctagacacag

SEQ ID NO: 338029 - DNA, 15 bp, Homo sapiens
tgtgctagacacagg

SEQ ID NO: 338030 - DNA, 15 bp, Homo sapiens
gtgctagacacaggg

SEQ ID NO: 338031 - DNA, 15 bp, Homo sapiens
tgctagacacagggt

SEQ ID NO: 338032 - DNA, 15 bp, Homo sapiens
gctagacacagggta

SEQ ID NO: 338033 - DNA, 15 bp, Homo sapiens
ctagacacagggtat

SEQ ID NO: 338034 - DNA, 15 bp, Homo sapiens
tagacacagggtata

SEQ ID NO: 338035 - DNA, 15 bp, Homo sapiens
agacacagggtatac

SEQ ID NO: 338036 - DNA, 15 bp, Homo sapiens
gacacagggtataca

SEQ ID NO: 338037 - DNA, 15 bp, Homo sapiens
acacagggtatacag

SEQ ID NO: 338038 - DNA, 15 bp, Homo sapiens
cacagggtatacagc

SEQ ID NO: 338039 - DNA, 15 bp, Homo sapiens
acagggtatacagca

SEQ ID NO: 338040 - DNA, 15 bp, Homo sapiens
cagggtatacagcag

SEQ ID NO: 338041 - DNA, 15 bp, Homo sapiens
agggtatacagcaga

SEQ ID NO: 338042 - DNA, 15 bp, Homo sapiens
gggtatacagcagag

SEQ ID NO: 338043 - DNA, 15 bp, Homo sapiens
ggtatacagcagaga

SEQ ID NO: 338044 - DNA, 15 bp, Homo sapiens
gtatacagcagagaa

SEQ ID NO: 338045 - DNA, 15 bp, Homo sapiens
tatacagcagagaac

SEQ ID NO: 338046 - DNA, 15 bp, Homo sapiens
atacagcagagaaca

SEQ ID NO: 338047 - DNA, 15 bp, Homo sapiens
tacagcagagaacaa

SEQ ID NO: 338048 - DNA, 15 bp, Homo sapiens
acagcagagaacaaa

SEQ ID NO: 338049 - DNA, 15 bp, Homo sapiens
cagcagagaacaaaa

SEQ ID NO: 338050 - DNA, 15 bp, Homo sapiens
agcagagaacaaaac

SEQ ID NO: 338051 - DNA, 15 bp, Homo sapiens
gcagagaacaaaaca

SEQ ID NO: 338052 - DNA, 15 bp, Homo sapiens
cagagaacaaaacag

SEQ ID NO: 338053 - DNA, 15 bp, Homo sapiens
agagaacaaaacagg

SEQ ID NO: 338054 - DNA, 15 bp, Homo sapiens
gagaacaaaacaggc

SEQ ID NO: 338055 - DNA, 15 bp, Homo sapiens
agaacaaaacaggca

SEQ ID NO: 338056 - DNA, 15 bp, Homo sapiens
gaacaaaacaggcaa

SEQ ID NO: 338057 - DNA, 15 bp, Homo sapiens
aacaaaacaggcaaa

SEQ ID NO: 338058 - DNA, 15 bp, Homo sapiens
acaaaacaggcaaaa

SEQ ID NO: 338059 - DNA, 15 bp, Homo sapiens
caaaacaggcaaaaa

SEQ ID NO: 338060 - DNA, 15 bp, Homo sapiens
aaaacaggcaaaaat

SEQ ID NO: 338061 - DNA, 15 bp, Homo sapiens
aaacaggcaaaaatc

SEQ ID NO: 338062 - DNA, 15 bp, Homo sapiens
aacaggcaaaaatct

SEQ ID NO: 338063 - DNA, 15 bp, Homo sapiens
acaggcaaaaatctt

SEQ ID NO: 338064 - DNA, 15 bp, Homo sapiens
caggcaaaaatctta

SEQ ID NO: 338065 - DNA, 15 bp, Homo sapiens
aggcaaaaatcttag

SEQ ID NO: 338066 - DNA, 15 bp, Homo sapiens
ggcaaaaatcttagt

SEQ ID NO: 338067 - DNA, 15 bp, Homo sapiens
gcaaaaatcttagtt

SEQ ID NO: 338068 - DNA, 15 bp, Homo sapiens
caaaaatcttagttc

SEQ ID NO: 338069 - DNA, 15 bp, Homo sapiens
aaaaatcttagttct

SEQ ID NO: 338070 - DNA, 15 bp, Homo sapiens
aaaatcttagttctc

SEQ ID NO: 338071 - DNA, 15 bp, Homo sapiens
aaatcttagttctcg

SEQ ID NO: 338072 - DNA, 15 bp, Homo sapiens
aatcttagttctcgt

SEQ ID NO: 338073 - DNA, 15 bp, Homo sapiens
atcttagttctcgtg

SEQ ID NO: 338074 - DNA, 15 bp, Homo sapiens
tcttagttctcgtgg

SEQ ID NO: 338075 - DNA, 15 bp, Homo sapiens
cttagttctcgtgga

SEQ ID NO: 338076 - DNA, 15 bp, Homo sapiens
ttagttctcgtggag

SEQ ID NO: 338077 - DNA, 15 bp, Homo sapiens
tagttctcgtggagc

SEQ ID NO: 338078 - DNA, 15 bp, Homo sapiens
agttctcgtggagct

SEQ ID NO: 338079 - DNA, 15 bp, Homo sapiens
gttctcgtggagctt

SEQ ID NO: 338080 - DNA, 15 bp, Homo sapiens
ttctcgtggagctta

SEQ ID NO: 338081 - DNA, 15 bp, Homo sapiens
tctcgtggagcttat

SEQ ID NO: 338082 - DNA, 15 bp, Homo sapiens
ctcgtggagcttatg

SEQ ID NO: 338083 - DNA, 15 bp, Homo sapiens
tcgtggagcttatgt

SEQ ID NO: 338084 - DNA, 15 bp, Homo sapiens
cgtggagcttatgtt

SEQ ID NO: 338085 - DNA, 15 bp, Homo sapiens
gtggagcttatgttc

SEQ ID NO: 338086 - DNA, 15 bp, Homo sapiens
tggagcttatgttcc

SEQ ID NO: 338087 - DNA, 15 bp, Homo sapiens
ggagcttatgttcca

SEQ ID NO: 338088 - DNA, 15 bp, Homo sapiens
gagcttatgttccaa

SEQ ID NO: 338089 - DNA, 15 bp, Homo sapiens
agcttatgttccaac

SEQ ID NO: 338090 - DNA, 15 bp, Homo sapiens
gcttatgttccaaca

SEQ ID NO: 338091 - DNA, 15 bp, Homo sapiens
cttatgttccaacag

SEQ ID NO: 338092 - DNA, 15 bp, Homo sapiens
ttatgttccaacaga

SEQ ID NO: 338093 - DNA, 15 bp, Homo sapiens
tatgttccaacagag

SEQ ID NO: 338094 - DNA, 15 bp, Homo sapiens
atgttccaacagagg

SEQ ID NO: 338095 - DNA, 15 bp, Homo sapiens
tgttccaacagaggg

SEQ ID NO: 338096 - DNA, 15 bp, Homo sapiens
gttccaacagaggga

SEQ ID NO: 338097 - DNA, 15 bp, Homo sapiens
ttccaacagagggag

SEQ ID NO: 338098 - DNA, 15 bp, Homo sapiens
tccaacagagggaga

SEQ ID NO: 338099 - DNA, 15 bp, Homo sapiens
ccaacagagggagac

SEQ ID NO: 338100 - DNA, 15 bp, Homo sapiens
caacagagggagaca

SEQ ID NO: 338101 - DNA, 15 bp, Homo sapiens
aacagagggagacaa

SEQ ID NO: 338102 - DNA, 15 bp, Homo sapiens
acagagggagacaag

SEQ ID NO: 338103 - DNA, 15 bp, Homo sapiens
cagagggagacaaga

SEQ ID NO: 338104 - DNA, 15 bp, Homo sapiens
agagggagacaagac

SEQ ID NO: 338105 - DNA, 15 bp, Homo sapiens
gagggagacaagaca

SEQ ID NO: 338106 - DNA, 15 bp, Homo sapiens
agggagacaagacaa

SEQ ID NO: 338107 - DNA, 15 bp, Homo sapiens
gggagacaagacaat

SEQ ID NO: 338108 - DNA, 15 bp, Homo sapiens
ggagacaagacaata

SEQ ID NO: 338109 - DNA, 15 bp, Homo sapiens
gagacaagacaataa

SEQ ID NO: 338110 - DNA, 15 bp, Homo sapiens
agacaagacaataat

SEQ ID NO: 338111 - DNA, 15 bp, Homo sapiens
gacaagacaataata

SEQ ID NO: 338112 - DNA, 15 bp, Homo sapiens
acaagacaataataa

SEQ ID NO: 338113 - DNA, 15 bp, Homo sapiens
caagacaataataaa

SEQ ID NO: 338114 - DNA, 15 bp, Homo sapiens
aagacaataataaag

SEQ ID NO: 338115 - DNA, 15 bp, Homo sapiens
agacaataataaagt

SEQ ID NO: 338116 - DNA, 15 bp, Homo sapiens
gacaataataaagtt

SEQ ID NO: 338117 - DNA, 15 bp, Homo sapiens
acaataataaagttg

SEQ ID NO: 338118 - DNA, 15 bp, Homo sapiens
caataataaagttgt

SEQ ID NO: 338119 - DNA, 15 bp, Homo sapiens
aataataaagttgtg

SEQ ID NO: 338120 - DNA, 15 bp, Homo sapiens
ataataaagttgtgt

SEQ ID NO: 338121 - DNA, 15 bp, Homo sapiens
taataaagttgtgta

SEQ ID NO: 338122 - DNA, 15 bp, Homo sapiens
aataaagttgtgtag

SEQ ID NO: 338123 - DNA, 15 bp, Homo sapiens
ataaagttgtgtagt

SEQ ID NO: 338124 - DNA, 15 bp, Homo sapiens
taaagttgtgtagta

SEQ ID NO: 338125 - DNA, 15 bp, Homo sapiens
aaagttgtgtagtat

SEQ ID NO: 338126 - DNA, 15 bp, Homo sapiens
aagttgtgtagtata

SEQ ID NO: 338127 - DNA, 15 bp, Homo sapiens
agttgtgtagtatat

SEQ ID NO: 338128 - DNA, 15 bp, Homo sapiens
gttgtgtagtatata

SEQ ID NO: 338129 - DNA, 15 bp, Homo sapiens
ttgtgtagtatatag

SEQ ID NO: 338130 - DNA, 15 bp, Homo sapiens
tgtgtagtatataga

SEQ ID NO: 338131 - DNA, 15 bp, Homo sapiens
gtgtagtatatagaa

SEQ ID NO: 338132 - DNA, 15 bp, Homo sapiens
tgtagtatatagaaa

SEQ ID NO: 338133 - DNA, 15 bp, Homo sapiens
gtagtatatagaaat

SEQ ID NO: 338134 - DNA, 15 bp, Homo sapiens
tagtatatagaaatg

SEQ ID NO: 338135 - DNA, 15 bp, Homo sapiens
agtatatagaaatgt

SEQ ID NO: 338136 - DNA, 15 bp, Homo sapiens
gtatatagaaatgta

SEQ ID NO: 338137 - DNA, 15 bp, Homo sapiens
tatatagaaatgtac

SEQ ID NO: 338138 - DNA, 15 bp, Homo sapiens
atatagaaatgtaca

SEQ ID NO: 338139 - DNA, 15 bp, Homo sapiens
tatagaaatgtacac

SEQ ID NO: 338140 - DNA, 15 bp, Homo sapiens
atagaaatgtacaca

SEQ ID NO: 338141 - DNA, 15 bp, Homo sapiens
tagaaatgtacacac

SEQ ID NO: 338142 - DNA, 15 bp, Homo sapiens
agaaatgtacacaca

SEQ ID NO: 338143 - DNA, 15 bp, Homo sapiens
gaaatgtacacacac

SEQ ID NO: 338144 - DNA, 15 bp, Homo sapiens
aaatgtacacacact

SEQ ID NO: 338145 - DNA, 15 bp, Homo sapiens
aatgtacacacactg

SEQ ID NO: 338146 - DNA, 15 bp, Homo sapiens
atgtacacacactga

SEQ ID NO: 338147 - DNA, 15 bp, Homo sapiens
tgtacacacactgaa

SEQ ID NO: 338148 - DNA, 15 bp, Homo sapiens
gtacacacactgaag

SEQ ID NO: 338149 - DNA, 15 bp, Homo sapiens
tacacacactgaagg

SEQ ID NO: 338150 - DNA, 15 bp, Homo sapiens
acacacactgaagga

SEQ ID NO: 338151 - DNA, 15 bp, Homo sapiens
cacacactgaaggaa

SEQ ID NO: 338152 - DNA, 15 bp, Homo sapiens
acacactgaaggaaa

SEQ ID NO: 338153 - DNA, 15 bp, Homo sapiens
cacactgaaggaaaa

SEQ ID NO: 338154 - DNA, 15 bp, Homo sapiens
acactgaaggaaaat

SEQ ID NO: 338155 - DNA, 15 bp, Homo sapiens
cactgaaggaaaata

SEQ ID NO: 338156 - DNA, 15 bp, Homo sapiens
actgaaggaaaatac

SEQ ID NO: 338157 - DNA, 15 bp, Homo sapiens
ctgaaggaaaataca

SEQ ID NO: 338158 - DNA, 15 bp, Homo sapiens
tgaaggaaaatacat

SEQ ID NO: 338159 - DNA, 15 bp, Homo sapiens
gaaggaaaatacatc

SEQ ID NO: 338160 - DNA, 15 bp, Homo sapiens
aaggaaaatacatca

SEQ ID NO: 338161 - DNA, 15 bp, Homo sapiens
aggaaaatacatcag

SEQ ID NO: 338162 - DNA, 15 bp, Homo sapiens
ggaaaatacatcaga

SEQ ID NO: 338163 - DNA, 15 bp, Homo sapiens
gaaaatacatcagac

SEQ ID NO: 338164 - DNA, 15 bp, Homo sapiens
aaaatacatcagaca

SEQ ID NO: 338165 - DNA, 15 bp, Homo sapiens
aaatacatcagacaa

SEQ ID NO: 338166 - DNA, 15 bp, Homo sapiens
aatacatcagacaag

SEQ ID NO: 338167 - DNA, 15 bp, Homo sapiens
atacatcagacaaga

SEQ ID NO: 338168 - DNA, 15 bp, Homo sapiens
tacatcagacaagag

SEQ ID NO: 338169 - DNA, 15 bp, Homo sapiens
acatcagacaagagc

SEQ ID NO: 338170 - DNA, 15 bp, Homo sapiens
catcagacaagagca

SEQ ID NO: 338171 - DNA, 15 bp, Homo sapiens
atcagacaagagcag

SEQ ID NO: 338172 - DNA, 15 bp, Homo sapiens
tcagacaagagcaga

SEQ ID NO: 338173 - DNA, 15 bp, Homo sapiens
cagacaagagcagag

SEQ ID NO: 338174 - DNA, 15 bp, Homo sapiens
agacaagagcagagg

SEQ ID NO: 338175 - DNA, 15 bp, Homo sapiens
gacaagagcagagga

SEQ ID NO: 338176 - DNA, 15 bp, Homo sapiens
acaagagcagaggag

SEQ ID NO: 338177 - DNA, 15 bp, Homo sapiens
caagagcagaggagg

SEQ ID NO: 338178 - DNA, 15 bp, Homo sapiens
aagagcagaggaggc

SEQ ID NO: 338179 - DNA, 15 bp, Homo sapiens
agagcagaggaggca

SEQ ID NO: 338180 - DNA, 15 bp, Homo sapiens
gagcagaggaggcac

SEQ ID NO: 338181 - DNA, 15 bp, Homo sapiens
agcagaggaggcact

SEQ ID NO: 338182 - DNA, 15 bp, Homo sapiens
gcagaggaggcactt

SEQ ID NO: 338183 - DNA, 15 bp, Homo sapiens
cagaggaggcacttg

SEQ ID NO: 338184 - DNA, 15 bp, Homo sapiens
agaggaggcacttgg

SEQ ID NO: 338185 - DNA, 15 bp, Homo sapiens
gaggaggcacttggc

SEQ ID NO: 338186 - DNA, 15 bp, Homo sapiens
aggaggcacttggca

SEQ ID NO: 338187 - DNA, 15 bp, Homo sapiens
ggaggcacttggcat

SEQ ID NO: 338188 - DNA, 15 bp, Homo sapiens
gaggcacttggcatc

SEQ ID NO: 338189 - DNA, 15 bp, Homo sapiens
aggcacttggcatcg

SEQ ID NO: 338190 - DNA, 15 bp, Homo sapiens
ggcacttggcatcgg

SEQ ID NO: 338191 - DNA, 15 bp, Homo sapiens
gcacttggcatcgga

SEQ ID NO: 338192 - DNA, 15 bp, Homo sapiens
cacttggcatcggag

SEQ ID NO: 338193 - DNA, 15 bp, Homo sapiens
acttggcatcggaga

SEQ ID NO: 338194 - DNA, 15 bp, Homo sapiens
cttggcatcggagag

SEQ ID NO: 338195 - DNA, 15 bp, Homo sapiens
ttggcatcggagagg

SEQ ID NO: 338196 - DNA, 15 bp, Homo sapiens
tggcatcggagaggg

SEQ ID NO: 338197 - DNA, 15 bp, Homo sapiens
ggcatcggagagggc

SEQ ID NO: 338198 - DNA, 15 bp, Homo sapiens
gcatcggagagggca

SEQ ID NO: 338199 - DNA, 15 bp, Homo sapiens
catcggagagggcag

SEQ ID NO: 338200 - DNA, 15 bp, Homo sapiens
atcggagagggcagt

SEQ ID NO: 338201 - DNA, 15 bp, Homo sapiens
tcggagagggcagtg

SEQ ID NO: 338202 - DNA, 15 bp, Homo sapiens
cggagagggcagtgg

SEQ ID NO: 338203 - DNA, 15 bp, Homo sapiens
ggagagggcagtggc

SEQ ID NO: 338204 - DNA, 15 bp, Homo sapiens
gagagggcagtggct

SEQ ID NO: 338205 - DNA, 15 bp, Homo sapiens
agagggcagtggctg

SEQ ID NO: 338206 - DNA, 15 bp, Homo sapiens
gagggcagtggctgc

SEQ ID NO: 338207 - DNA, 15 bp, Homo sapiens
agggcagtggctgca

SEQ ID NO: 338208 - DNA, 15 bp, Homo sapiens
gggcagtggctgcag

SEQ ID NO: 338209 - DNA, 15 bp, Homo sapiens
ggcagtggctgcagt

SEQ ID NO: 338210 - DNA, 15 bp, Homo sapiens
gcagtggctgcagtg

SEQ ID NO: 338211 - DNA, 15 bp, Homo sapiens
cagtggctgcagtga

SEQ ID NO: 338212 - DNA, 15 bp, Homo sapiens
agtggctgcagtgac

SEQ ID NO: 338213 - DNA, 15 bp, Homo sapiens
gtggctgcagtgacc

SEQ ID NO: 338214 - DNA, 15 bp, Homo sapiens
tggctgcagtgacct

SEQ ID NO: 338215 - DNA, 15 bp, Homo sapiens
ggctgcagtgacctg

SEQ ID NO: 338216 - DNA, 15 bp, Homo sapiens
gctgcagtgacctga

SEQ ID NO: 338217 - DNA, 15 bp, Homo sapiens
ctgcagtgacctgag

SEQ ID NO: 338218 - DNA, 15 bp, Homo sapiens
tgcagtgacctgagt

SEQ ID NO: 338219 - DNA, 15 bp, Homo sapiens
gcagtgacctgagtg

SEQ ID NO: 338220 - DNA, 15 bp, Homo sapiens
cagtgacctgagtgg

SEQ ID NO: 338221 - DNA, 15 bp, Homo sapiens
agtgacctgagtggg

SEQ ID NO: 338222 - DNA, 15 bp, Homo sapiens
gtgacctgagtgggg

SEQ ID NO: 338223 - DNA, 15 bp, Homo sapiens
tgacctgagtggggg

SEQ ID NO: 338224 - DNA, 15 bp, Homo sapiens
gacctgagtgggggg

SEQ ID NO: 338225 - DNA, 15 bp, Homo sapiens
acctgagtgggggga

SEQ ID NO: 338226 - DNA, 15 bp, Homo sapiens
cctgagtggggggag

SEQ ID NO: 338227 - DNA, 15 bp, Homo sapiens
ctgagtggggggagt

SEQ ID NO: 338228 - DNA, 15 bp, Homo sapiens
tgagtggggggagta

SEQ ID NO: 338229 - DNA, 15 bp, Homo sapiens
gagtggggggagtaa

SEQ ID NO: 338230 - DNA, 15 bp, Homo sapiens
agtggggggagtaat

SEQ ID NO: 338231 - DNA, 15 bp, Homo sapiens
gtggggggagtaatg

SEQ ID NO: 338232 - DNA, 15 bp, Homo sapiens
tggggggagtaatgg

SEQ ID NO: 338233 - DNA, 15 bp, Homo sapiens
ggggggagtaatggg

SEQ ID NO: 338234 - DNA, 15 bp, Homo sapiens
gggggagtaatggga

SEQ ID NO: 338235 - DNA, 15 bp, Homo sapiens
ggggagtaatgggag

SEQ ID NO: 338236 - DNA, 15 bp, Homo sapiens
gggagtaatgggaga

SEQ ID NO: 338237 - DNA, 15 bp, Homo sapiens
ggagtaatgggagat

SEQ ID NO: 338238 - DNA, 15 bp, Homo sapiens
gagtaatgggagatg

SEQ ID NO: 338239 - DNA, 15 bp, Homo sapiens
agtaatgggagatga

SEQ ID NO: 338240 - DNA, 15 bp, Homo sapiens
gtaatgggagatgaa

SEQ ID NO: 338241 - DNA, 15 bp, Homo sapiens
taatgggagatgaat

SEQ ID NO: 338242 - DNA, 15 bp, Homo sapiens
aatgggagatgaatt

SEQ ID NO: 338243 - DNA, 15 bp, Homo sapiens
atgggagatgaattc

SEQ ID NO: 338244 - DNA, 15 bp, Homo sapiens
tgggagatgaattca

SEQ ID NO: 338245 - DNA, 15 bp, Homo sapiens
gggagatgaattcag

SEQ ID NO: 338246 - DNA, 15 bp, Homo sapiens
ggagatgaattcagg

SEQ ID NO: 338247 - DNA, 15 bp, Homo sapiens
gagatgaattcaggg

SEQ ID NO: 338248 - DNA, 15 bp, Homo sapiens
agatgaattcaggga

SEQ ID NO: 338249 - DNA, 15 bp, Homo sapiens
gatgaattcagggag

SEQ ID NO: 338250 - DNA, 15 bp, Homo sapiens
atgaattcagggagg

SEQ ID NO: 338251 - DNA, 15 bp, Homo sapiens
tgaattcagggaggg

SEQ ID NO: 338252 - DNA, 15 bp, Homo sapiens
gaattcagggaggga

SEQ ID NO: 338253 - DNA, 15 bp, Homo sapiens
aattcagggagggaa

SEQ ID NO: 338254 - DNA, 15 bp, Homo sapiens
attcagggagggaag

SEQ ID NO: 338255 - DNA, 15 bp, Homo sapiens
ttcagggagggaagt

SEQ ID NO: 338256 - DNA, 15 bp, Homo sapiens
tcagggagggaagtg

SEQ ID NO: 338257 - DNA, 15 bp, Homo sapiens
cagggagggaagtgg

SEQ ID NO: 338258 - DNA, 15 bp, Homo sapiens
agggagggaagtggg

SEQ ID NO: 338259 - DNA, 15 bp, Homo sapiens
gggagggaagtgggg

SEQ ID NO: 338260 - DNA, 15 bp, Homo sapiens
ggagggaagtggggg

SEQ ID NO: 338261 - DNA, 15 bp, Homo sapiens
gagggaagtggggga

SEQ ID NO: 338262 - DNA, 15 bp, Homo sapiens
agggaagtgggggaa

SEQ ID NO: 338263 - DNA, 15 bp, Homo sapiens
gggaagtgggggaag

SEQ ID NO: 338264 - DNA, 15 bp, Homo sapiens
ggaagtgggggaagt

SEQ ID NO: 338265 - DNA, 15 bp, Homo sapiens
gaagtgggggaagtg

SEQ ID NO: 338266 - DNA, 15 bp, Homo sapiens
aagtgggggaagtgc

SEQ ID NO: 338267 - DNA, 15 bp, Homo sapiens
agtgggggaagtgca

SEQ ID NO: 338268 - DNA, 15 bp, Homo sapiens
gtgggggaagtgcat

SEQ ID NO: 338269 - DNA, 15 bp, Homo sapiens
tgggggaagtgcatc

SEQ ID NO: 338270 - DNA, 15 bp, Homo sapiens
gggggaagtgcatcc

SEQ ID NO: 338271 - DNA, 15 bp, Homo sapiens
ggggaagtgcatccc

SEQ ID NO: 338272 - DNA, 15 bp, Homo sapiens
gggaagtgcatccca

SEQ ID NO: 338273 - DNA, 15 bp, Homo sapiens
ggaagtgcatcccag

SEQ ID NO: 338274 - DNA, 15 bp, Homo sapiens
gaagtgcatcccaga

SEQ ID NO: 338275 - DNA, 15 bp, Homo sapiens
aagtgcatcccagaa

SEQ ID NO: 338276 - DNA, 15 bp, Homo sapiens
agtgcatcccagaag

SEQ ID NO: 338277 - DNA, 15 bp, Homo sapiens
gtgcatcccagaagg

SEQ ID NO: 338278 - DNA, 15 bp, Homo sapiens
tgcatcccagaaggt

SEQ ID NO: 338279 - DNA, 15 bp, Homo sapiens
gcatcccagaaggtg

SEQ ID NO: 338280 - DNA, 15 bp, Homo sapiens
catcccagaaggtgg

SEQ ID NO: 338281 - DNA, 15 bp, Homo sapiens
atcccagaaggtggg

SEQ ID NO: 338282 - DNA, 15 bp, Homo sapiens
tcccagaaggtgggt

SEQ ID NO: 338283 - DNA, 15 bp, Homo sapiens
cccagaaggtgggtg

SEQ ID NO: 338284 - DNA, 15 bp, Homo sapiens
ccagaaggtgggtgg

SEQ ID NO: 338285 - DNA, 15 bp, Homo sapiens
cagaaggtgggtggg

SEQ ID NO: 338286 - DNA, 15 bp, Homo sapiens
agaaggtgggtgggt

SEQ ID NO: 338287 - DNA, 15 bp, Homo sapiens
gaaggtgggtgggtc

SEQ ID NO: 338288 - DNA, 15 bp, Homo sapiens
aaggtgggtgggtct

SEQ ID NO: 338289 - DNA, 15 bp, Homo sapiens
aggtgggtgggtcta

SEQ ID NO: 338290 - DNA, 15 bp, Homo sapiens
ggtgggtgggtctaa

SEQ ID NO: 338291 - DNA, 15 bp, Homo sapiens
gtgggtgggtctaac

SEQ ID NO: 338292 - DNA, 15 bp, Homo sapiens
tgggtgggtctaaca

SEQ ID NO: 338293 - DNA, 15 bp, Homo sapiens
gggtgggtctaacat

SEQ ID NO: 338294 - DNA, 15 bp, Homo sapiens
ggtgggtctaacatg

SEQ ID NO: 338295 - DNA, 15 bp, Homo sapiens
gtgggtctaacatgc

SEQ ID NO: 338296 - DNA, 15 bp, Homo sapiens
tgggtctaacatgca

SEQ ID NO: 338297 - DNA, 15 bp, Homo sapiens
gggtctaacatgcaa

SEQ ID NO: 338298 - DNA, 15 bp, Homo sapiens
ggtctaacatgcaag

SEQ ID NO: 338299 - DNA, 15 bp, Homo sapiens
gtctaacatgcaaga

SEQ ID NO: 338300 - DNA, 15 bp, Homo sapiens
tctaacatgcaagaa

SEQ ID NO: 338301 - DNA, 15 bp, Homo sapiens
ctaacatgcaagaac

SEQ ID NO: 338302 - DNA, 15 bp, Homo sapiens
taacatgcaagaaca

SEQ ID NO: 338303 - DNA, 15 bp, Homo sapiens
aacatgcaagaacag

SEQ ID NO: 338304 - DNA, 15 bp, Homo sapiens
acatgcaagaacaga

SEQ ID NO: 338305 - DNA, 15 bp, Homo sapiens
catgcaagaacagac

SEQ ID NO: 338306 - DNA, 15 bp, Homo sapiens
atgcaagaacagaca

SEQ ID NO: 338307 - DNA, 15 bp, Homo sapiens
tgcaagaacagacac

SEQ ID NO: 338308 - DNA, 15 bp, Homo sapiens
gcaagaacagacaca

SEQ ID NO: 338309 - DNA, 15 bp, Homo sapiens
caagaacagacacag

SEQ ID NO: 338310 - DNA, 15 bp, Homo sapiens
aagaacagacacaga

SEQ ID NO: 338311 - DNA, 15 bp, Homo sapiens
agaacagacacagaa

SEQ ID NO: 338312 - DNA, 15 bp, Homo sapiens
gaacagacacagaat

SEQ ID NO: 338313 - DNA, 15 bp, Homo sapiens
aacagacacagaata

SEQ ID NO: 338314 - DNA, 15 bp, Homo sapiens
acagacacagaataa

SEQ ID NO: 338315 - DNA, 15 bp, Homo sapiens
cagacacagaataaa

SEQ ID NO: 338316 - DNA, 15 bp, Homo sapiens
agacacagaataaag

SEQ ID NO: 338317 - DNA, 15 bp, Homo sapiens
gacacagaataaaga

SEQ ID NO: 338318 - DNA, 15 bp, Homo sapiens
acacagaataaagaa

SEQ ID NO: 338319 - DNA, 15 bp, Homo sapiens
cacagaataaagaaa

SEQ ID NO: 338320 - DNA, 15 bp, Homo sapiens
acagaataaagaaaa

SEQ ID NO: 338321 - DNA, 15 bp, Homo sapiens
cagaataaagaaaat

SEQ ID NO: 338322 - DNA, 15 bp, Homo sapiens
agaataaagaaaatg

SEQ ID NO: 338323 - DNA, 15 bp, Homo sapiens
gaataaagaaaatga

SEQ ID NO: 338324 - DNA, 15 bp, Homo sapiens
aataaagaaaatgat

SEQ ID NO: 338325 - DNA, 15 bp, Homo sapiens
ataaagaaaatgatt

SEQ ID NO: 338326 - DNA, 15 bp, Homo sapiens
taaagaaaatgatta

SEQ ID NO: 338327 - DNA, 15 bp, Homo sapiens
aaagaaaatgattaa

SEQ ID NO: 338328 - DNA, 15 bp, Homo sapiens
aagaaaatgattaac

SEQ ID NO: 338329 - DNA, 15 bp, Homo sapiens
agaaaatgattaact

SEQ ID NO: 338330 - DNA, 15 bp, Homo sapiens
gaaaatgattaactt

SEQ ID NO: 338331 - DNA, 15 bp, Homo sapiens
aaaatgattaacttt

SEQ ID NO: 338332 - DNA, 15 bp, Homo sapiens
aaatgattaactttt

SEQ ID NO: 338333 - DNA, 15 bp, Homo sapiens
aatgattaacttttg

SEQ ID NO: 338334 - DNA, 15 bp, Homo sapiens
atgattaacttttgg

SEQ ID NO: 338335 - DNA, 15 bp, Homo sapiens
tgattaacttttgga

SEQ ID NO: 338336 - DNA, 15 bp, Homo sapiens
gattaacttttggat

SEQ ID NO: 338337 - DNA, 15 bp, Homo sapiens
attaacttttggata

SEQ ID NO: 338338 - DNA, 15 bp, Homo sapiens
ttaacttttggataa

SEQ ID NO: 338339 - DNA, 15 bp, Homo sapiens
taacttttggataag

SEQ ID NO: 338340 - DNA, 15 bp, Homo sapiens
aacttttggataagt

SEQ ID NO: 338341 - DNA, 15 bp, Homo sapiens
acttttggataagtc

SEQ ID NO: 338342 - DNA, 15 bp, Homo sapiens
cttttggataagtca

SEQ ID NO: 338343 - DNA, 15 bp, Homo sapiens
ttttggataagtcaa

SEQ ID NO: 338344 - DNA, 15 bp, Homo sapiens
tttggataagtcaaa

SEQ ID NO: 338345 - DNA, 15 bp, Homo sapiens
ttggataagtcaaag

SEQ ID NO: 338346 - DNA, 15 bp, Homo sapiens
tggataagtcaaagc

SEQ ID NO: 338347 - DNA, 15 bp, Homo sapiens
ggataagtcaaagca

SEQ ID NO: 338348 - DNA, 15 bp, Homo sapiens
gataagtcaaagcaa

SEQ ID NO: 338349 - DNA, 15 bp, Homo sapiens
ataagtcaaagcaac

SEQ ID NO: 338350 - DNA, 15 bp, Homo sapiens
taagtcaaagcaaca

SEQ ID NO: 338351 - DNA, 15 bp, Homo sapiens
aagtcaaagcaacaa

SEQ ID NO: 338352 - DNA, 15 bp, Homo sapiens
agtcaaagcaacaat

SEQ ID NO: 338353 - DNA, 15 bp, Homo sapiens
gtcaaagcaacaata

SEQ ID NO: 338354 - DNA, 15 bp, Homo sapiens
tcaaagcaacaataa

SEQ ID NO: 338355 - DNA, 15 bp, Homo sapiens
caaagcaacaataat

SEQ ID NO: 338356 - DNA, 15 bp, Homo sapiens
aaagcaacaataatg

SEQ ID NO: 338357 - DNA, 15 bp, Homo sapiens
aagcaacaataatgt

SEQ ID NO: 338358 - DNA, 15 bp, Homo sapiens
agcaacaataatgtc

SEQ ID NO: 338359 - DNA, 15 bp, Homo sapiens
gcaacaataatgtcc

SEQ ID NO: 338360 - DNA, 15 bp, Homo sapiens
caacaataatgtcca

SEQ ID NO: 338361 - DNA, 15 bp, Homo sapiens
aacaataatgtccaa

SEQ ID NO: 338362 - DNA, 15 bp, Homo sapiens
acaataatgtccaat

SEQ ID NO: 338363 - DNA, 15 bp, Homo sapiens
caataatgtccaatt

SEQ ID NO: 338364 - DNA, 15 bp, Homo sapiens
aataatgtccaattt

SEQ ID NO: 338365 - DNA, 15 bp, Homo sapiens
ataatgtccaatttg

SEQ ID NO: 338366 - DNA, 15 bp, Homo sapiens
taatgtccaatttgt

SEQ ID NO: 338367 - DNA, 15 bp, Homo sapiens
aatgtccaatttgtg

SEQ ID NO: 338368 - DNA, 15 bp, Homo sapiens
atgtccaatttgtga

SEQ ID NO: 338369 - DNA, 15 bp, Homo sapiens
tgtccaatttgtgag

SEQ ID NO: 338370 - DNA, 15 bp, Homo sapiens
gtccaatttgtgaga

SEQ ID NO: 338371 - DNA, 15 bp, Homo sapiens
tccaatttgtgagat

SEQ ID NO: 338372 - DNA, 15 bp, Homo sapiens
ccaatttgtgagatt

SEQ ID NO: 338373 - DNA, 15 bp, Homo sapiens
caatttgtgagatta

SEQ ID NO: 338374 - DNA, 15 bp, Homo sapiens
aatttgtgagattaa

SEQ ID NO: 338375 - DNA, 15 bp, Homo sapiens
atttgtgagattaaa

SEQ ID NO: 338376 - DNA, 15 bp, Homo sapiens
tttgtgagattaaaa

SEQ ID NO: 338377 - DNA, 15 bp, Homo sapiens
ttgtgagattaaaag

SEQ ID NO: 338378 - DNA, 15 bp, Homo sapiens
tgtgagattaaaaga

SEQ ID NO: 338379 - DNA, 15 bp, Homo sapiens
gtgagattaaaagaa

SEQ ID NO: 338380 - DNA, 15 bp, Homo sapiens
tgagattaaaagaaa

SEQ ID NO: 338381 - DNA, 15 bp, Homo sapiens
gagattaaaagaaaa

SEQ ID NO: 338382 - DNA, 15 bp, Homo sapiens
agattaaaagaaaat

SEQ ID NO: 338383 - DNA, 15 bp, Homo sapiens
gattaaaagaaaatc

SEQ ID NO: 338384 - DNA, 15 bp, Homo sapiens
attaaaagaaaatca

SEQ ID NO: 338385 - DNA, 15 bp, Homo sapiens
ttaaaagaaaatcaa

SEQ ID NO: 338386 - DNA, 15 bp, Homo sapiens
taaaagaaaatcaag

SEQ ID NO: 338387 - DNA, 15 bp, Homo sapiens
aaaagaaaatcaaga

SEQ ID NO: 338388 - DNA, 15 bp, Homo sapiens
aaagaaaatcaagat

SEQ ID NO: 338389 - DNA, 15 bp, Homo sapiens
aagaaaatcaagata

SEQ ID NO: 338390 - DNA, 15 bp, Homo sapiens
agaaaatcaagatag

SEQ ID NO: 338391 - DNA, 15 bp, Homo sapiens
gaaaatcaagataga

SEQ ID NO: 338392 - DNA, 15 bp, Homo sapiens
aaaatcaagatagaa

SEQ ID NO: 338393 - DNA, 15 bp, Homo sapiens
aaatcaagatagaaa

SEQ ID NO: 338394 - DNA, 15 bp, Homo sapiens
aatcaagatagaaat

SEQ ID NO: 338395 - DNA, 15 bp, Homo sapiens
atcaagatagaaatg

SEQ ID NO: 338396 - DNA, 15 bp, Homo sapiens
tcaagatagaaatga

SEQ ID NO: 338397 - DNA, 15 bp, Homo sapiens
caagatagaaatgaa

SEQ ID NO: 338398 - DNA, 15 bp, Homo sapiens
aagatagaaatgaaa

SEQ ID NO: 338399 - DNA, 15 bp, Homo sapiens
agatagaaatgaaat

SEQ ID NO: 338400 - DNA, 15 bp, Homo sapiens
gatagaaatgaaata

SEQ ID NO: 338401 - DNA, 15 bp, Homo sapiens
atagaaatgaaatac

SEQ ID NO: 338402 - DNA, 15 bp, Homo sapiens
tagaaatgaaataca

SEQ ID NO: 338403 - DNA, 15 bp, Homo sapiens
agaaatgaaatacag

SEQ ID NO: 338404 - DNA, 15 bp, Homo sapiens
gaaatgaaatacagt

SEQ ID NO: 338405 - DNA, 15 bp, Homo sapiens
aaatgaaatacagtc

SEQ ID NO: 338406 - DNA, 15 bp, Homo sapiens
aatgaaatacagtcc

SEQ ID NO: 338407 - DNA, 15 bp, Homo sapiens
atgaaatacagtcct

SEQ ID NO: 338408 - DNA, 15 bp, Homo sapiens
tgaaatacagtccta

SEQ ID NO: 338409 - DNA, 15 bp, Homo sapiens
gaaatacagtcctag

SEQ ID NO: 338410 - DNA, 15 bp, Homo sapiens
aaatacagtcctaga

SEQ ID NO: 338411 - DNA, 15 bp, Homo sapiens
aatacagtcctagac

SEQ ID NO: 338412 - DNA, 15 bp, Homo sapiens
atacagtcctagaca

SEQ ID NO: 338413 - DNA, 15 bp, Homo sapiens
tacagtcctagacaa

SEQ ID NO: 338414 - DNA, 15 bp, Homo sapiens
acagtcctagacaat

SEQ ID NO: 338415 - DNA, 15 bp, Homo sapiens
cagtcctagacaata

SEQ ID NO: 338416 - DNA, 15 bp, Homo sapiens
agtcctagacaatat

SEQ ID NO: 338417 - DNA, 15 bp, Homo sapiens
gtcctagacaatata

SEQ ID NO: 338418 - DNA, 15 bp, Homo sapiens
tcctagacaatatag

SEQ ID NO: 338419 - DNA, 15 bp, Homo sapiens
cctagacaatatagt

SEQ ID NO: 338420 - DNA, 15 bp, Homo sapiens
ctagacaatatagta

SEQ ID NO: 338421 - DNA, 15 bp, Homo sapiens
tagacaatatagtag

SEQ ID NO: 338422 - DNA, 15 bp, Homo sapiens
agacaatatagtagt

SEQ ID NO: 338423 - DNA, 15 bp, Homo sapiens
gacaatatagtagta

SEQ ID NO: 338424 - DNA, 15 bp, Homo sapiens
acaatatagtagtag

SEQ ID NO: 338425 - DNA, 15 bp, Homo sapiens
caatatagtagtagc

SEQ ID NO: 338426 - DNA, 15 bp, Homo sapiens
aatatagtagtagca

SEQ ID NO: 338427 - DNA, 15 bp, Homo sapiens
atatagtagtagcat

SEQ ID NO: 338428 - DNA, 15 bp, Homo sapiens
tatagtagtagcatg

SEQ ID NO: 338429 - DNA, 15 bp, Homo sapiens
atagtagtagcatgg

SEQ ID NO: 338430 - DNA, 15 bp, Homo sapiens
tagtagtagcatgga

SEQ ID NO: 338431 - DNA, 15 bp, Homo sapiens
agtagtagcatggaa

SEQ ID NO: 338432 - DNA, 15 bp, Homo sapiens
gtagtagcatggaag

SEQ ID NO: 338433 - DNA, 15 bp, Homo sapiens
tagtagcatggaagc

SEQ ID NO: 338434 - DNA, 15 bp, Homo sapiens
agtagcatggaagca

SEQ ID NO: 338435 - DNA, 15 bp, Homo sapiens
gtagcatggaagcag

SEQ ID NO: 338436 - DNA, 15 bp, Homo sapiens
tagcatggaagcagg

SEQ ID NO: 338437 - DNA, 15 bp, Homo sapiens
agcatggaagcaggg

SEQ ID NO: 338438 - DNA, 15 bp, Homo sapiens
gcatggaagcagggg

SEQ ID NO: 338439 - DNA, 15 bp, Homo sapiens
catggaagcagggga

SEQ ID NO: 338440 - DNA, 15 bp, Homo sapiens
atggaagcaggggat

SEQ ID NO: 338441 - DNA, 15 bp, Homo sapiens
tggaagcaggggatt

SEQ ID NO: 338442 - DNA, 15 bp, Homo sapiens
ggaagcaggggattg

SEQ ID NO: 338443 - DNA, 15 bp, Homo sapiens
gaagcaggggattgg

SEQ ID NO: 338444 - DNA, 15 bp, Homo sapiens
aagcaggggattgga

SEQ ID NO: 338445 - DNA, 15 bp, Homo sapiens
agcaggggattggag

SEQ ID NO: 338446 - DNA, 15 bp, Homo sapiens
gcaggggattggagg

SEQ ID NO: 338447 - DNA, 15 bp, Homo sapiens
caggggattggaggg

SEQ ID NO: 338448 - DNA, 15 bp, Homo sapiens
aggggattggaggga

SEQ ID NO: 338449 - DNA, 15 bp, Homo sapiens
ggggattggagggaa

SEQ ID NO: 338450 - DNA, 15 bp, Homo sapiens
gggattggagggaaa

SEQ ID NO: 338451 - DNA, 15 bp, Homo sapiens
ggattggagggaaac

SEQ ID NO: 338452 - DNA, 15 bp, Homo sapiens
gattggagggaaact

SEQ ID NO: 338453 - DNA, 15 bp, Homo sapiens
attggagggaaactc

SEQ ID NO: 338454 - DNA, 15 bp, Homo sapiens
ttggagggaaactct

SEQ ID NO: 338455 - DNA, 15 bp, Homo sapiens
tggagggaaactctt

SEQ ID NO: 338456 - DNA, 15 bp, Homo sapiens
ggagggaaactcttc

SEQ ID NO: 338457 - DNA, 15 bp, Homo sapiens
gagggaaactcttcc

SEQ ID NO: 338458 - DNA, 15 bp, Homo sapiens
agggaaactcttcca

SEQ ID NO: 338459 - DNA, 15 bp, Homo sapiens
gggaaactcttccaa

SEQ ID NO: 338460 - DNA, 15 bp, Homo sapiens
ggaaactcttccaag

SEQ ID NO: 338461 - DNA, 15 bp, Homo sapiens
gaaactcttccaagg

SEQ ID NO: 338462 - DNA, 15 bp, Homo sapiens
aaactcttccaaggc

SEQ ID NO: 338463 - DNA, 15 bp, Homo sapiens
aactcttccaaggct

SEQ ID NO: 338464 - DNA, 15 bp, Homo sapiens
actcttccaaggctt

SEQ ID NO: 338465 - DNA, 15 bp, Homo sapiens
ctcttccaaggcttt

SEQ ID NO: 338466 - DNA, 15 bp, Homo sapiens
tcttccaaggctttt

SEQ ID NO: 338467 - DNA, 15 bp, Homo sapiens
cttccaaggcttttg

SEQ ID NO: 338468 - DNA, 15 bp, Homo sapiens
ttccaaggcttttgt

SEQ ID NO: 338469 - DNA, 15 bp, Homo sapiens
tccaaggcttttgtt

SEQ ID NO: 338470 - DNA, 15 bp, Homo sapiens
ccaaggcttttgttt

SEQ ID NO: 338471 - DNA, 15 bp, Homo sapiens
caaggcttttgtttt

SEQ ID NO: 338472 - DNA, 15 bp, Homo sapiens
aaggcttttgtttta

SEQ ID NO: 338473 - DNA, 15 bp, Homo sapiens
aggcttttgttttag

SEQ ID NO: 338474 - DNA, 15 bp, Homo sapiens
ggcttttgttttagg

SEQ ID NO: 338475 - DNA, 15 bp, Homo sapiens
gcttttgttttagga

SEQ ID NO: 338476 - DNA, 15 bp, Homo sapiens
cttttgttttaggaa

SEQ ID NO: 338477 - DNA, 15 bp, Homo sapiens
ttttgttttaggaat

SEQ ID NO: 338478 - DNA, 15 bp, Homo sapiens
tttgttttaggaata

SEQ ID NO: 338479 - DNA, 15 bp, Homo sapiens
ttgttttaggaatat

SEQ ID NO: 338480 - DNA, 15 bp, Homo sapiens
tgttttaggaatatc

SEQ ID NO: 338481 - DNA, 15 bp, Homo sapiens
gttttaggaatatcc

SEQ ID NO: 338482 - DNA, 15 bp, Homo sapiens
ttttaggaatatcct

SEQ ID NO: 338483 - DNA, 15 bp, Homo sapiens
tttaggaatatcctg

SEQ ID NO: 338484 - DNA, 15 bp, Homo sapiens
ttaggaatatcctga

SEQ ID NO: 338485 - DNA, 15 bp, Homo sapiens
taggaatatcctgag

SEQ ID NO: 338486 - DNA, 15 bp, Homo sapiens
aggaatatcctgaga

SEQ ID NO: 338487 - DNA, 15 bp, Homo sapiens
ggaatatcctgagaa

SEQ ID NO: 338488 - DNA, 15 bp, Homo sapiens
gaatatcctgagaac

SEQ ID NO: 338489 - DNA, 15 bp, Homo sapiens
aatatcctgagaaca

SEQ ID NO: 338490 - DNA, 15 bp, Homo sapiens
atatcctgagaacag

SEQ ID NO: 338491 - DNA, 15 bp, Homo sapiens
tatcctgagaacaga

SEQ ID NO: 338492 - DNA, 15 bp, Homo sapiens
atcctgagaacagat

SEQ ID NO: 338493 - DNA, 15 bp, Homo sapiens
tcctgagaacagatt

SEQ ID NO: 338494 - DNA, 15 bp, Homo sapiens
cctgagaacagatta

SEQ ID NO: 338495 - DNA, 15 bp, Homo sapiens
ctgagaacagattag

SEQ ID NO: 338496 - DNA, 15 bp, Homo sapiens
tgagaacagattaga

SEQ ID NO: 338497 - DNA, 15 bp, Homo sapiens
gagaacagattagag

SEQ ID NO: 338498 - DNA, 15 bp, Homo sapiens
agaacagattagagc

SEQ ID NO: 338499 - DNA, 15 bp, Homo sapiens
gaacagattagagct

SEQ ID NO: 338500 - DNA, 15 bp, Homo sapiens
aacagattagagcta

SEQ ID NO: 338501 - DNA, 15 bp, Homo sapiens
acagattagagctag

SEQ ID NO: 338502 - DNA, 15 bp, Homo sapiens
cagattagagctaga

SEQ ID NO: 338503 - DNA, 15 bp, Homo sapiens
agattagagctagat

SEQ ID NO: 338504 - DNA, 15 bp, Homo sapiens
gattagagctagatt

SEQ ID NO: 338505 - DNA, 15 bp, Homo sapiens
attagagctagattt

SEQ ID NO: 338506 - DNA, 15 bp, Homo sapiens
ttagagctagatttt

SEQ ID NO: 338507 - DNA, 15 bp, Homo sapiens
tagagctagattttg

SEQ ID NO: 338508 - DNA, 15 bp, Homo sapiens
agagctagattttgt

SEQ ID NO: 338509 - DNA, 15 bp, Homo sapiens
gagctagattttgtg

SEQ ID NO: 338510 - DNA, 15 bp, Homo sapiens
agctagattttgtgt

SEQ ID NO: 338511 - DNA, 15 bp, Homo sapiens
gctagattttgtgtt

SEQ ID NO: 338512 - DNA, 15 bp, Homo sapiens
ctagattttgtgttc

SEQ ID NO: 338513 - DNA, 15 bp, Homo sapiens
tagattttgtgttct

SEQ ID NO: 338514 - DNA, 15 bp, Homo sapiens
agattttgtgttctg

SEQ ID NO: 338515 - DNA, 15 bp, Homo sapiens
gattttgtgttctgc

SEQ ID NO: 338516 - DNA, 15 bp, Homo sapiens
attttgtgttctgct

SEQ ID NO: 338517 - DNA, 15 bp, Homo sapiens
ttttgtgttctgcta

SEQ ID NO: 338518 - DNA, 15 bp, Homo sapiens
tttgtgttctgctaa

SEQ ID NO: 338519 - DNA, 15 bp, Homo sapiens
ttgtgttctgctaat

SEQ ID NO: 338520 - DNA, 15 bp, Homo sapiens
tgtgttctgctaatc

SEQ ID NO: 338521 - DNA, 15 bp, Homo sapiens
gtgttctgctaatct

SEQ ID NO: 338522 - DNA, 15 bp, Homo sapiens
tgttctgctaatctt

SEQ ID NO: 338523 - DNA, 15 bp, Homo sapiens
gttctgctaatcttg

SEQ ID NO: 338524 - DNA, 15 bp, Homo sapiens
ttctgctaatcttga

SEQ ID NO: 338525 - DNA, 15 bp, Homo sapiens
tctgctaatcttgat

SEQ ID NO: 338526 - DNA, 15 bp, Homo sapiens
ctgctaatcttgatc

SEQ ID NO: 338527 - DNA, 15 bp, Homo sapiens
tgctaatcttgatct

SEQ ID NO: 338528 - DNA, 15 bp, Homo sapiens
gctaatcttgatctt

SEQ ID NO: 338529 - DNA, 15 bp, Homo sapiens
ctaatcttgatcttt

SEQ ID NO: 338530 - DNA, 15 bp, Homo sapiens
taatcttgatctttt

SEQ ID NO: 338531 - DNA, 15 bp, Homo sapiens
aatcttgatctttta

SEQ ID NO: 338532 - DNA, 15 bp, Homo sapiens
atcttgatcttttaa

SEQ ID NO: 338533 - DNA, 15 bp, Homo sapiens
tcttgatcttttaat

SEQ ID NO: 338534 - DNA, 15 bp, Homo sapiens
cttgatcttttaatt

SEQ ID NO: 338535 - DNA, 15 bp, Homo sapiens
ttgatcttttaattg

SEQ ID NO: 338536 - DNA, 15 bp, Homo sapiens
tgatcttttaattga

SEQ ID NO: 338537 - DNA, 15 bp, Homo sapiens
gatcttttaattgaa

SEQ ID NO: 338538 - DNA, 15 bp, Homo sapiens
atcttttaattgaag

SEQ ID NO: 338539 - DNA, 15 bp, Homo sapiens
tcttttaattgaaga

SEQ ID NO: 338540 - DNA, 15 bp, Homo sapiens
cttttaattgaagaa

SEQ ID NO: 338541 - DNA, 15 bp, Homo sapiens
ttttaattgaagaat

SEQ ID NO: 338542 - DNA, 15 bp, Homo sapiens
tttaattgaagaatt

SEQ ID NO: 338543 - DNA, 15 bp, Homo sapiens
ttaattgaagaattt

SEQ ID NO: 338544 - DNA, 15 bp, Homo sapiens
taattgaagaattta

SEQ ID NO: 338545 - DNA, 15 bp, Homo sapiens
aattgaagaatttag

SEQ ID NO: 338546 - DNA, 15 bp, Homo sapiens
attgaagaatttagt

SEQ ID NO: 338547 - DNA, 15 bp, Homo sapiens
ttgaagaatttagtc

SEQ ID NO: 338548 - DNA, 15 bp, Homo sapiens
tgaagaatttagtcc

SEQ ID NO: 338549 - DNA, 15 bp, Homo sapiens
gaagaatttagtcca

SEQ ID NO: 338550 - DNA, 15 bp, Homo sapiens
aagaatttagtccat

SEQ ID NO: 338551 - DNA, 15 bp, Homo sapiens
agaatttagtccatt

SEQ ID NO: 338552 - DNA, 15 bp, Homo sapiens
gaatttagtccatta

SEQ ID NO: 338553 - DNA, 15 bp, Homo sapiens
aatttagtccattaa

SEQ ID NO: 338554 - DNA, 15 bp, Homo sapiens
atttagtccattaac

SEQ ID NO: 338555 - DNA, 15 bp, Homo sapiens
tttagtccattaaca

SEQ ID NO: 338556 - DNA, 15 bp, Homo sapiens
ttagtccattaacat

SEQ ID NO: 338557 - DNA, 15 bp, Homo sapiens
tagtccattaacatt

SEQ ID NO: 338558 - DNA, 15 bp, Homo sapiens
agtccattaacattg

SEQ ID NO: 338559 - DNA, 15 bp, Homo sapiens
gtccattaacattga

SEQ ID NO: 338560 - DNA, 15 bp, Homo sapiens
tccattaacattgat

SEQ ID NO: 338561 - DNA, 15 bp, Homo sapiens
ccattaacattgatt

SEQ ID NO: 338562 - DNA, 15 bp, Homo sapiens
cattaacattgatta

SEQ ID NO: 338563 - DNA, 15 bp, Homo sapiens
attaacattgattat

SEQ ID NO: 338564 - DNA, 15 bp, Homo sapiens
ttaacattgattatg

SEQ ID NO: 338565 - DNA, 15 bp, Homo sapiens
taacattgattatga

SEQ ID NO: 338566 - DNA, 15 bp, Homo sapiens
aacattgattatgat

SEQ ID NO: 338567 - DNA, 15 bp, Homo sapiens
acattgattatgatt

SEQ ID NO: 338568 - DNA, 15 bp, Homo sapiens
cattgattatgatta

SEQ ID NO: 338569 - DNA, 15 bp, Homo sapiens
attgattatgattat

SEQ ID NO: 338570 - DNA, 15 bp, Homo sapiens
ttgattatgattatt

SEQ ID NO: 338571 - DNA, 15 bp, Homo sapiens
tgattatgattattt

SEQ ID NO: 338572 - DNA, 15 bp, Homo sapiens
gattatgattattta

SEQ ID NO: 338573 - DNA, 15 bp, Homo sapiens
attatgattatttat

SEQ ID NO: 338574 - DNA, 15 bp, Homo sapiens
ttatgattatttata

SEQ ID NO: 338575 - DNA, 15 bp, Homo sapiens
tatgattatttatat

SEQ ID NO: 338576 - DNA, 15 bp, Homo sapiens
atgattatttatata

SEQ ID NO: 338577 - DNA, 15 bp, Homo sapiens
tgattatttatatat

SEQ ID NO: 338578 - DNA, 15 bp, Homo sapiens
gattatttatatatt

SEQ ID NO: 338579 - DNA, 15 bp, Homo sapiens
ttatttatatattta

SEQ ID NO: 338580 - DNA, 15 bp, Homo sapiens
tatttatatatttag

SEQ ID NO: 338581 - DNA, 15 bp, Homo sapiens
atttatatatttagg

SEQ ID NO: 338582 - DNA, 15 bp, Homo sapiens
tttatatatttaggt

SEQ ID NO: 338583 - DNA, 15 bp, Homo sapiens
ttatatatttaggtt

SEQ ID NO: 338584 - DNA, 15 bp, Homo sapiens
tatatatttaggttc

SEQ ID NO: 338585 - DNA, 15 bp, Homo sapiens
atatatttaggttca

SEQ ID NO: 338586 - DNA, 15 bp, Homo sapiens
tatatttaggttcat

SEQ ID NO: 338587 - DNA, 15 bp, Homo sapiens
atatttaggttcatt

SEQ ID NO: 338588 - DNA, 15 bp, Homo sapiens
tatttaggttcattt

SEQ ID NO: 338589 - DNA, 15 bp, Homo sapiens
atttaggttcatttt

SEQ ID NO: 338590 - DNA, 15 bp, Homo sapiens
tttaggttcattttt

SEQ ID NO: 338591 - DNA, 15 bp, Homo sapiens
ttaggttcattttta

SEQ ID NO: 338592 - DNA, 15 bp, Homo sapiens
taggttcatttttac

SEQ ID NO: 338593 - DNA, 15 bp, Homo sapiens
aggttcatttttacc

SEQ ID NO: 338594 - DNA, 15 bp, Homo sapiens
ggttcatttttaccg

SEQ ID NO: 338595 - DNA, 15 bp, Homo sapiens
gttcatttttaccgc

SEQ ID NO: 338596 - DNA, 15 bp, Homo sapiens
ttcatttttaccgca

SEQ ID NO: 338597 - DNA, 15 bp, Homo sapiens
tcatttttaccgcat

SEQ ID NO: 338598 - DNA, 15 bp, Homo sapiens
catttttaccgcata

SEQ ID NO: 338599 - DNA, 15 bp, Homo sapiens
atttttaccgcatag

SEQ ID NO: 338600 - DNA, 15 bp, Homo sapiens
tttttaccgcatagt

SEQ ID NO: 338601 - DNA, 15 bp, Homo sapiens
ttttaccgcatagtg

SEQ ID NO: 338602 - DNA, 15 bp, Homo sapiens
tttaccgcatagtgt

SEQ ID NO: 338603 - DNA, 15 bp, Homo sapiens
ttaccgcatagtgtg

SEQ ID NO: 338604 - DNA, 15 bp, Homo sapiens
taccgcatagtgtga

SEQ ID NO: 338605 - DNA, 15 bp, Homo sapiens
accgcatagtgtgag

SEQ ID NO: 338606 - DNA, 15 bp, Homo sapiens
ccgcatagtgtgagc

SEQ ID NO: 338607 - DNA, 15 bp, Homo sapiens
cgcatagtgtgagct

SEQ ID NO: 338608 - DNA, 15 bp, Homo sapiens
gcatagtgtgagctg

SEQ ID NO: 338609 - DNA, 15 bp, Homo sapiens
catagtgtgagctgc

SEQ ID NO: 338610 - DNA, 15 bp, Homo sapiens
atagtgtgagctgct

SEQ ID NO: 338611 - DNA, 15 bp, Homo sapiens
tagtgtgagctgctc

SEQ ID NO: 338612 - DNA, 15 bp, Homo sapiens
agtgtgagctgctca

SEQ ID NO: 338613 - DNA, 15 bp, Homo sapiens
gtgtgagctgctcat

SEQ ID NO: 338614 - DNA, 15 bp, Homo sapiens
tgtgagctgctcatt

SEQ ID NO: 338615 - DNA, 15 bp, Homo sapiens
gtgagctgctcattt

SEQ ID NO: 338616 - DNA, 15 bp, Homo sapiens
tgagctgctcatttt

SEQ ID NO: 338617 - DNA, 15 bp, Homo sapiens
gagctgctcattttt

SEQ ID NO: 338618 - DNA, 15 bp, Homo sapiens
agctgctcatttttc

SEQ ID NO: 338619 - DNA, 15 bp, Homo sapiens
gctgctcatttttct

SEQ ID NO: 338620 - DNA, 15 bp, Homo sapiens
ctgctcatttttctt

SEQ ID NO: 338621 - DNA, 15 bp, Homo sapiens
tgctcatttttctta

SEQ ID NO: 338622 - DNA, 15 bp, Homo sapiens
gctcatttttcttat

SEQ ID NO: 338623 - DNA, 15 bp, Homo sapiens
ctcatttttcttatt

SEQ ID NO: 338624 - DNA, 15 bp, Homo sapiens
tcatttttcttattt

SEQ ID NO: 338625 - DNA, 15 bp, Homo sapiens
catttttcttatttt

SEQ ID NO: 338626 - DNA, 15 bp, Homo sapiens
atttttcttattttt

SEQ ID NO: 338627 - DNA, 15 bp, Homo sapiens
ttttcttattttttc

SEQ ID NO: 338628 - DNA, 15 bp, Homo sapiens
tttcttattttttct

SEQ ID NO: 338629 - DNA, 15 bp, Homo sapiens
ttcttattttttctg

SEQ ID NO: 338630 - DNA, 15 bp, Homo sapiens
tcttattttttctgt

SEQ ID NO: 338631 - DNA, 15 bp, Homo sapiens
cttattttttctgtg

SEQ ID NO: 338632 - DNA, 15 bp, Homo sapiens
ttattttttctgtgg

SEQ ID NO: 338633 - DNA, 15 bp, Homo sapiens
tattttttctgtggt

SEQ ID NO: 338634 - DNA, 15 bp, Homo sapiens
attttttctgtggtt

SEQ ID NO: 338635 - DNA, 15 bp, Homo sapiens
ttttttctgtggttt

SEQ ID NO: 338636 - DNA, 15 bp, Homo sapiens
tttttctgtggtttt

SEQ ID NO: 338637 - DNA, 15 bp, Homo sapiens
ttttctgtggttttt

SEQ ID NO: 338638 - DNA, 15 bp, Homo sapiens
tttctgtggtttttt

SEQ ID NO: 338639 - DNA, 15 bp, Homo sapiens
ttctgtggttttttt

SEQ ID NO: 338640 - DNA, 15 bp, Homo sapiens
tctgtggtttttttt

SEQ ID NO: 338641 - DNA, 15 bp, Homo sapiens
ctgtggttttttttt

SEQ ID NO: 338642 - DNA, 15 bp, Homo sapiens
tgtggtttttttttt

SEQ ID NO: 338643 - DNA, 15 bp, Homo sapiens
gtggttttttttttt

SEQ ID NO: 338644 - DNA, 15 bp, Homo sapiens
tggtttttttttttt

SEQ ID NO: 338645 - DNA, 15 bp, Homo sapiens
ggttttttttttttt

SEQ ID NO: 338646 - DNA, 15 bp, Homo sapiens
tttttttttactttc

SEQ ID NO: 338647 - DNA, 15 bp, Homo sapiens
ttttttttactttct

SEQ ID NO: 338648 - DNA, 15 bp, Homo sapiens
tttttttactttctt

SEQ ID NO: 338649 - DNA, 15 bp, Homo sapiens
ttttttactttctta

SEQ ID NO: 338650 - DNA, 15 bp, Homo sapiens
tttttactttcttat

SEQ ID NO: 338651 - DNA, 15 bp, Homo sapiens
ttttactttcttatc

SEQ ID NO: 338652 - DNA, 15 bp, Homo sapiens
tttactttcttatct

SEQ ID NO: 338653 - DNA, 15 bp, Homo sapiens
ttactttcttatctc

SEQ ID NO: 338654 - DNA, 15 bp, Homo sapiens
tactttcttatctct

SEQ ID NO: 338655 - DNA, 15 bp, Homo sapiens
actttcttatctctt

SEQ ID NO: 338656 - DNA, 15 bp, Homo sapiens
ctttcttatctcttt

SEQ ID NO: 338657 - DNA, 15 bp, Homo sapiens
tttcttatctctttt

SEQ ID NO: 338658 - DNA, 15 bp, Homo sapiens
ttcttatctcttttt

SEQ ID NO: 338659 - DNA, 15 bp, Homo sapiens
tcttatctctttttg

SEQ ID NO: 338660 - DNA, 15 bp, Homo sapiens
cttatctctttttgt

SEQ ID NO: 338661 - DNA, 15 bp, Homo sapiens
ttatctctttttgta

SEQ ID NO: 338662 - DNA, 15 bp, Homo sapiens
tatctctttttgtat

SEQ ID NO: 338663 - DNA, 15 bp, Homo sapiens
atctctttttgtatc

SEQ ID NO: 338664 - DNA, 15 bp, Homo sapiens
tctctttttgtatcg

SEQ ID NO: 338665 - DNA, 15 bp, Homo sapiens
ctctttttgtatcgg

SEQ ID NO: 338666 - DNA, 15 bp, Homo sapiens
tctttttgtatcggt

SEQ ID NO: 338667 - DNA, 15 bp, Homo sapiens
ctttttgtatcggta

SEQ ID NO: 338668 - DNA, 15 bp, Homo sapiens
tttttgtatcggtag

SEQ ID NO: 338669 - DNA, 15 bp, Homo sapiens
ttttgtatcggtagg

SEQ ID NO: 338670 - DNA, 15 bp, Homo sapiens
tttgtatcggtaggt

SEQ ID NO: 338671 - DNA, 15 bp, Homo sapiens
ttgtatcggtaggtt

SEQ ID NO: 338672 - DNA, 15 bp, Homo sapiens
tgtatcggtaggttt

SEQ ID NO: 338673 - DNA, 15 bp, Homo sapiens
gtatcggtaggtttc

SEQ ID NO: 338674 - DNA, 15 bp, Homo sapiens
tatcggtaggtttcc

SEQ ID NO: 338675 - DNA, 15 bp, Homo sapiens
atcggtaggtttccc

SEQ ID NO: 338676 - DNA, 15 bp, Homo sapiens
tcggtaggtttccct

SEQ ID NO: 338677 - DNA, 15 bp, Homo sapiens
cggtaggtttccctt

SEQ ID NO: 338678 - DNA, 15 bp, Homo sapiens
ggtaggtttcccttt

SEQ ID NO: 338679 - DNA, 15 bp, Homo sapiens
gtaggtttcccttta

SEQ ID NO: 338680 - DNA, 15 bp, Homo sapiens
taggtttccctttac

SEQ ID NO: 338681 - DNA, 15 bp, Homo sapiens
aggtttccctttacc

SEQ ID NO: 338682 - DNA, 15 bp, Homo sapiens
ggtttccctttaccc

SEQ ID NO: 338683 - DNA, 15 bp, Homo sapiens
gtttccctttacccc

SEQ ID NO: 338684 - DNA, 15 bp, Homo sapiens
tttccctttaccccc

SEQ ID NO: 338685 - DNA, 15 bp, Homo sapiens
ttccctttaccccct

SEQ ID NO: 338686 - DNA, 15 bp, Homo sapiens
tccctttaccccctt

SEQ ID NO: 338687 - DNA, 15 bp, Homo sapiens
ccctttacccccttt

SEQ ID NO: 338688 - DNA, 15 bp, Homo sapiens
cctttaccccctttt

SEQ ID NO: 338689 - DNA, 15 bp, Homo sapiens
ctttacccccttttc

SEQ ID NO: 338690 - DNA, 15 bp, Homo sapiens
tttacccccttttct

SEQ ID NO: 338691 - DNA, 15 bp, Homo sapiens
ttacccccttttctt

SEQ ID NO: 338692 - DNA, 15 bp, Homo sapiens
tacccccttttcttc

SEQ ID NO: 338693 - DNA, 15 bp, Homo sapiens
acccccttttcttct

SEQ ID NO: 338694 - DNA, 15 bp, Homo sapiens
cccccttttcttctt

SEQ ID NO: 338695 - DNA, 15 bp, Homo sapiens
ccccttttcttcttc

SEQ ID NO: 338696 - DNA, 15 bp, Homo sapiens
cccttttcttcttct

SEQ ID NO: 338697 - DNA, 15 bp, Homo sapiens
ccttttcttcttcta

SEQ ID NO: 338698 - DNA, 15 bp, Homo sapiens
cttttcttcttctac

SEQ ID NO: 338699 - DNA, 15 bp, Homo sapiens
ttttcttcttctact

SEQ ID NO: 338700 - DNA, 15 bp, Homo sapiens
tttcttcttctactc

SEQ ID NO: 338701 - DNA, 15 bp, Homo sapiens
ttcttcttctactct

SEQ ID NO: 338702 - DNA, 15 bp, Homo sapiens
tcttcttctactctt

SEQ ID NO: 338703 - DNA, 15 bp, Homo sapiens
cttcttctactcttt

SEQ ID NO: 338704 - DNA, 15 bp, Homo sapiens
ttcttctactctttg

SEQ ID NO: 338705 - DNA, 15 bp, Homo sapiens
tcttctactctttgg

SEQ ID NO: 338706 - DNA, 15 bp, Homo sapiens
cttctactctttggg

SEQ ID NO: 338707 - DNA, 15 bp, Homo sapiens
ttctactctttggga

SEQ ID NO: 338708 - DNA, 15 bp, Homo sapiens
tctactctttgggaa

SEQ ID NO: 338709 - DNA, 15 bp, Homo sapiens
ctactctttgggaaa

SEQ ID NO: 338710 - DNA, 15 bp, Homo sapiens
tactctttgggaaac

SEQ ID NO: 338711 - DNA, 15 bp, Homo sapiens
actctttgggaaaca

SEQ ID NO: 338712 - DNA, 15 bp, Homo sapiens
ctctttgggaaacat

SEQ ID NO: 338713 - DNA, 15 bp, Homo sapiens
tctttgggaaacatt

SEQ ID NO: 338714 - DNA, 15 bp, Homo sapiens
ctttgggaaacatta

SEQ ID NO: 338715 - DNA, 15 bp, Homo sapiens
tttgggaaacattat

SEQ ID NO: 338716 - DNA, 15 bp, Homo sapiens
ttgggaaacattata

SEQ ID NO: 338717 - DNA, 15 bp, Homo sapiens
tgggaaacattatat

SEQ ID NO: 338718 - DNA, 15 bp, Homo sapiens
gggaaacattatata

SEQ ID NO: 338719 - DNA, 15 bp, Homo sapiens
ggaaacattatatac

SEQ ID NO: 338720 - DNA, 15 bp, Homo sapiens
gaaacattatatact

SEQ ID NO: 338721 - DNA, 15 bp, Homo sapiens
aaacattatatacta

SEQ ID NO: 338722 - DNA, 15 bp, Homo sapiens
aacattatatactac

SEQ ID NO: 338723 - DNA, 15 bp, Homo sapiens
acattatatactact

SEQ ID NO: 338724 - DNA, 15 bp, Homo sapiens
cattatatactactt

SEQ ID NO: 338725 - DNA, 15 bp, Homo sapiens
attatatactacttc

SEQ ID NO: 338726 - DNA, 15 bp, Homo sapiens
ttatatactacttct

SEQ ID NO: 338727 - DNA, 15 bp, Homo sapiens
tatatactacttcta

SEQ ID NO: 338728 - DNA, 15 bp, Homo sapiens
atatactacttctag

SEQ ID NO: 338729 - DNA, 15 bp, Homo sapiens
tatactacttctagt

SEQ ID NO: 338730 - DNA, 15 bp, Homo sapiens
atactacttctagtc

SEQ ID NO: 338731 - DNA, 15 bp, Homo sapiens
tactacttctagtct

SEQ ID NO: 338732 - DNA, 15 bp, Homo sapiens
actacttctagtctt

SEQ ID NO: 338733 - DNA, 15 bp, Homo sapiens
ctacttctagtctta

SEQ ID NO: 338734 - DNA, 15 bp, Homo sapiens
tacttctagtcttaa

SEQ ID NO: 338735 - DNA, 15 bp, Homo sapiens
acttctagtcttaat

SEQ ID NO: 338736 - DNA, 15 bp, Homo sapiens
cttctagtcttaatg

SEQ ID NO: 338737 - DNA, 15 bp, Homo sapiens
ttctagtcttaatgg

SEQ ID NO: 338738 - DNA, 15 bp, Homo sapiens
tctagtcttaatggt

SEQ ID NO: 338739 - DNA, 15 bp, Homo sapiens
ctagtcttaatggtt

SEQ ID NO: 338740 - DNA, 15 bp, Homo sapiens
tagtcttaatggtta

SEQ ID NO: 338741 - DNA, 15 bp, Homo sapiens
agtcttaatggttac

SEQ ID NO: 338742 - DNA, 15 bp, Homo sapiens
gtcttaatggttacc

SEQ ID NO: 338743 - DNA, 15 bp, Homo sapiens
tcttaatggttacca

SEQ ID NO: 338744 - DNA, 15 bp, Homo sapiens
cttaatggttaccac

SEQ ID NO: 338745 - DNA, 15 bp, Homo sapiens
ttaatggttaccaca

SEQ ID NO: 338746 - DNA, 15 bp, Homo sapiens
taatggttaccacag

SEQ ID NO: 338747 - DNA, 15 bp, Homo sapiens
aatggttaccacaga

SEQ ID NO: 338748 - DNA, 15 bp, Homo sapiens
atggttaccacagaa

SEQ ID NO: 338749 - DNA, 15 bp, Homo sapiens
tggttaccacagaaa

SEQ ID NO: 338750 - DNA, 15 bp, Homo sapiens
ggttaccacagaaaa

SEQ ID NO: 338751 - DNA, 15 bp, Homo sapiens
gttaccacagaaaat

SEQ ID NO: 338752 - DNA, 15 bp, Homo sapiens
ttaccacagaaaata

SEQ ID NO: 338753 - DNA, 15 bp, Homo sapiens
taccacagaaaatag

SEQ ID NO: 338754 - DNA, 15 bp, Homo sapiens
accacagaaaatagc

SEQ ID NO: 338755 - DNA, 15 bp, Homo sapiens
ccacagaaaatagca

SEQ ID NO: 338756 - DNA, 15 bp, Homo sapiens
cacagaaaatagcag

SEQ ID NO: 338757 - DNA, 15 bp, Homo sapiens
acagaaaatagcagt

SEQ ID NO: 338758 - DNA, 15 bp, Homo sapiens
cagaaaatagcagtc

SEQ ID NO: 338759 - DNA, 15 bp, Homo sapiens
agaaaatagcagtcc

SEQ ID NO: 338760 - DNA, 15 bp, Homo sapiens
gaaaatagcagtcct

SEQ ID NO: 338761 - DNA, 15 bp, Homo sapiens
aaaatagcagtccta

SEQ ID NO: 338762 - DNA, 15 bp, Homo sapiens
aaatagcagtcctat

SEQ ID NO: 338763 - DNA, 15 bp, Homo sapiens
aatagcagtcctatt

SEQ ID NO: 338764 - DNA, 15 bp, Homo sapiens
atagcagtcctattt

SEQ ID NO: 338765 - DNA, 15 bp, Homo sapiens
tagcagtcctattta

SEQ ID NO: 338766 - DNA, 15 bp, Homo sapiens
agcagtcctatttag

SEQ ID NO: 338767 - DNA, 15 bp, Homo sapiens
gcagtcctatttagc

SEQ ID NO: 338768 - DNA, 15 bp, Homo sapiens
cagtcctatttagct

SEQ ID NO: 338769 - DNA, 15 bp, Homo sapiens
agtcctatttagcta

SEQ ID NO: 338770 - DNA, 15 bp, Homo sapiens
gtcctatttagctaa

SEQ ID NO: 338771 - DNA, 15 bp, Homo sapiens
tcctatttagctaat

SEQ ID NO: 338772 - DNA, 15 bp, Homo sapiens
cctatttagctaata

SEQ ID NO: 338773 - DNA, 15 bp, Homo sapiens
ctatttagctaatac

SEQ ID NO: 338774 - DNA, 15 bp, Homo sapiens
tatttagctaataca

SEQ ID NO: 338775 - DNA, 15 bp, Homo sapiens
atttagctaatacaa

SEQ ID NO: 338776 - DNA, 15 bp, Homo sapiens
tttagctaatacaag

SEQ ID NO: 338777 - DNA, 15 bp, Homo sapiens
ttagctaatacaaga

SEQ ID NO: 338778 - DNA, 15 bp, Homo sapiens
tagctaatacaagac

SEQ ID NO: 338779 - DNA, 15 bp, Homo sapiens
agctaatacaagacc

SEQ ID NO: 338780 - DNA, 15 bp, Homo sapiens
gctaatacaagaccc

SEQ ID NO: 338781 - DNA, 15 bp, Homo sapiens
ctaatacaagaccct

SEQ ID NO: 338782 - DNA, 15 bp, Homo sapiens
taatacaagaccctt

SEQ ID NO: 338783 - DNA, 15 bp, Homo sapiens
aatacaagacccttg

SEQ ID NO: 338784 - DNA, 15 bp, Homo sapiens
atacaagacccttgg

SEQ ID NO: 338785 - DNA, 15 bp, Homo sapiens
tacaagacccttgga

SEQ ID NO: 338786 - DNA, 15 bp, Homo sapiens
acaagacccttggaa

SEQ ID NO: 338787 - DNA, 15 bp, Homo sapiens
caagacccttggaaa

SEQ ID NO: 338788 - DNA, 15 bp, Homo sapiens
aagacccttggaaag

SEQ ID NO: 338789 - DNA, 15 bp, Homo sapiens
agacccttggaaagt

SEQ ID NO: 338790 - DNA, 15 bp, Homo sapiens
gacccttggaaagta

SEQ ID NO: 338791 - DNA, 15 bp, Homo sapiens
acccttggaaagtat

SEQ ID NO: 338792 - DNA, 15 bp, Homo sapiens
cccttggaaagtatt

SEQ ID NO: 338793 - DNA, 15 bp, Homo sapiens
ccttggaaagtatta

SEQ ID NO: 338794 - DNA, 15 bp, Homo sapiens
cttggaaagtattat

SEQ ID NO: 338795 - DNA, 15 bp, Homo sapiens
ttggaaagtattatc

SEQ ID NO: 338796 - DNA, 15 bp, Homo sapiens
tggaaagtattatct

SEQ ID NO: 338797 - DNA, 15 bp, Homo sapiens
ggaaagtattatctg

SEQ ID NO: 338798 - DNA, 15 bp, Homo sapiens
gaaagtattatctgt

SEQ ID NO: 338799 - DNA, 15 bp, Homo sapiens
aaagtattatctgtt

SEQ ID NO: 338800 - DNA, 15 bp, Homo sapiens
aagtattatctgtta

SEQ ID NO: 338801 - DNA, 15 bp, Homo sapiens
agtattatctgttat

SEQ ID NO: 338802 - DNA, 15 bp, Homo sapiens
gtattatctgttatt

SEQ ID NO: 338803 - DNA, 15 bp, Homo sapiens
tattatctgttattt

SEQ ID NO: 338804 - DNA, 15 bp, Homo sapiens
attatctgttatttt

SEQ ID NO: 338805 - DNA, 15 bp, Homo sapiens
ttatctgttattttc

SEQ ID NO: 338806 - DNA, 15 bp, Homo sapiens
tatctgttattttca

SEQ ID NO: 338807 - DNA, 15 bp, Homo sapiens
atctgttattttcat

SEQ ID NO: 338808 - DNA, 15 bp, Homo sapiens
tctgttattttcata

SEQ ID NO: 338809 - DNA, 15 bp, Homo sapiens
ctgttattttcatat

SEQ ID NO: 338810 - DNA, 15 bp, Homo sapiens
tgttattttcatatt

SEQ ID NO: 338811 - DNA, 15 bp, Homo sapiens
gttattttcatattt

SEQ ID NO: 338812 - DNA, 15 bp, Homo sapiens
ttattttcatatttg

SEQ ID NO: 338813 - DNA, 15 bp, Homo sapiens
tattttcatatttgt

SEQ ID NO: 338814 - DNA, 15 bp, Homo sapiens
attttcatatttgtg

SEQ ID NO: 338815 - DNA, 15 bp, Homo sapiens
ttttcatatttgtga

SEQ ID NO: 338816 - DNA, 15 bp, Homo sapiens
tttcatatttgtgaa

SEQ ID NO: 338817 - DNA, 15 bp, Homo sapiens
ttcatatttgtgaat

SEQ ID NO: 338818 - DNA, 15 bp, Homo sapiens
tcatatttgtgaatt

SEQ ID NO: 338819 - DNA, 15 bp, Homo sapiens
catatttgtgaatta

SEQ ID NO: 338820 - DNA, 15 bp, Homo sapiens
atatttgtgaattaa

SEQ ID NO: 338821 - DNA, 15 bp, Homo sapiens
tatttgtgaattaat

SEQ ID NO: 338822 - DNA, 15 bp, Homo sapiens
atttgtgaattaatt

SEQ ID NO: 338823 - DNA, 15 bp, Homo sapiens
tttgtgaattaattt

SEQ ID NO: 338824 - DNA, 15 bp, Homo sapiens
ttgtgaattaatttc

SEQ ID NO: 338825 - DNA, 15 bp, Homo sapiens
tgtgaattaatttca

SEQ ID NO: 338826 - DNA, 15 bp, Homo sapiens
gtgaattaatttcaa

SEQ ID NO: 338827 - DNA, 15 bp, Homo sapiens
tgaattaatttcaag

SEQ ID NO: 338828 - DNA, 15 bp, Homo sapiens
gaattaatttcaagt

SEQ ID NO: 338829 - DNA, 15 bp, Homo sapiens
aattaatttcaagta

SEQ ID NO: 338830 - DNA, 15 bp, Homo sapiens
attaatttcaagtat

SEQ ID NO: 338831 - DNA, 15 bp, Homo sapiens
ttaatttcaagtatg

SEQ ID NO: 338832 - DNA, 15 bp, Homo sapiens
taatttcaagtatgt

SEQ ID NO: 338833 - DNA, 15 bp, Homo sapiens
aatttcaagtatgta

SEQ ID NO: 338834 - DNA, 15 bp, Homo sapiens
atttcaagtatgtat

SEQ ID NO: 338835 - DNA, 15 bp, Homo sapiens
tttcaagtatgtatt

SEQ ID NO: 338836 - DNA, 15 bp, Homo sapiens
ttcaagtatgtattt

SEQ ID NO: 338837 - DNA, 15 bp, Homo sapiens
tcaagtatgtatttg

SEQ ID NO: 338838 - DNA, 15 bp, Homo sapiens
caagtatgtatttga

SEQ ID NO: 338839 - DNA, 15 bp, Homo sapiens
aagtatgtatttgac

SEQ ID NO: 338840 - DNA, 15 bp, Homo sapiens
agtatgtatttgaca

SEQ ID NO: 338841 - DNA, 15 bp, Homo sapiens
gtatgtatttgacaa

SEQ ID NO: 338842 - DNA, 15 bp, Homo sapiens
tatgtatttgacaag

SEQ ID NO: 338843 - DNA, 15 bp, Homo sapiens
atgtatttgacaagc

SEQ ID NO: 338844 - DNA, 15 bp, Homo sapiens
tgtatttgacaagcc

SEQ ID NO: 338845 - DNA, 15 bp, Homo sapiens
gtatttgacaagcct

SEQ ID NO: 338846 - DNA, 15 bp, Homo sapiens
tatttgacaagcctt

SEQ ID NO: 338847 - DNA, 15 bp, Homo sapiens
atttgacaagccttt

SEQ ID NO: 338848 - DNA, 15 bp, Homo sapiens
tttgacaagcctttg

SEQ ID NO: 338849 - DNA, 15 bp, Homo sapiens
ttgacaagcctttgg

SEQ ID NO: 338850 - DNA, 15 bp, Homo sapiens
tgacaagcctttggg

SEQ ID NO: 338851 - DNA, 15 bp, Homo sapiens
gacaagcctttggga

SEQ ID NO: 338852 - DNA, 15 bp, Homo sapiens
acaagcctttgggat

SEQ ID NO: 338853 - DNA, 15 bp, Homo sapiens
caagcctttgggata

SEQ ID NO: 338854 - DNA, 15 bp, Homo sapiens
aagcctttgggatat

SEQ ID NO: 338855 - DNA, 15 bp, Homo sapiens
agcctttgggatata

SEQ ID NO: 338856 - DNA, 15 bp, Homo sapiens
gcctttgggatataa

SEQ ID NO: 338857 - DNA, 15 bp, Homo sapiens
cctttgggatataaa

SEQ ID NO: 338858 - DNA, 15 bp, Homo sapiens
ctttgggatataaaa

SEQ ID NO: 338859 - DNA, 15 bp, Homo sapiens
tttgggatataaaaa

SEQ ID NO: 338860 - DNA, 15 bp, Homo sapiens
ttgggatataaaaat

SEQ ID NO: 338861 - DNA, 15 bp, Homo sapiens
tgggatataaaaata

SEQ ID NO: 338862 - DNA, 15 bp, Homo sapiens
gggatataaaaataa

SEQ ID NO: 338863 - DNA, 15 bp, Homo sapiens
ggatataaaaataaa

SEQ ID NO: 338864 - DNA, 15 bp, Homo sapiens
gatataaaaataaac

SEQ ID NO: 338865 - DNA, 15 bp, Homo sapiens
atataaaaataaact

SEQ ID NO: 338866 - DNA, 15 bp, Homo sapiens
tataaaaataaactc

SEQ ID NO: 338867 - DNA, 15 bp, Homo sapiens
ataaaaataaactca

SEQ ID NO: 338868 - DNA, 15 bp, Homo sapiens
taaaaataaactcaa

SEQ ID NO: 338869 - DNA, 15 bp, Homo sapiens
aaataaactcaaaaa

SEQ ID NO: 338870 - DNA, 15 bp, Homo sapiens
aataaactcaaaaaa

SEQ ID NO: 338871 - DNA, 15 bp, Homo sapiens
ataaactcaaaaaaa

SEQ ID NO: 338872 - DNA, 15 bp, Homo sapiens
taaactcaaaaaaac

SEQ ID NO: 338873 - DNA, 15 bp, Homo sapiens
aaactcaaaaaaacc

SEQ ID NO: 338874 - DNA, 15 bp, Homo sapiens
aactcaaaaaaacct

SEQ ID NO: 338875 - DNA, 15 bp, Homo sapiens
actcaaaaaaacctc

SEQ ID NO: 338876 - DNA, 15 bp, Homo sapiens
ctcaaaaaaacctca

SEQ ID NO: 338877 - DNA, 15 bp, Homo sapiens
tcaaaaaaacctcac

SEQ ID NO: 338878 - DNA, 15 bp, Homo sapiens
caaaaaaacctcaca

SEQ ID NO: 338879 - DNA, 15 bp, Homo sapiens
aaaaaaacctcacaa

SEQ ID NO: 338880 - DNA, 15 bp, Homo sapiens
aaaaaacctcacaaa

SEQ ID NO: 338881 - DNA, 15 bp, Homo sapiens
aaaaacctcacaaat

SEQ ID NO: 338882 - DNA, 15 bp, Homo sapiens
aaaacctcacaaata

SEQ ID NO: 338883 - DNA, 15 bp, Homo sapiens
aaacctcacaaataa

SEQ ID NO: 338884 - DNA, 15 bp, Homo sapiens
aacctcacaaataaa

SEQ ID NO: 338885 - DNA, 15 bp, Homo sapiens
acctcacaaataaaa

SEQ ID NO: 338886 - DNA, 15 bp, Homo sapiens
cctcacaaataaaaa

SEQ ID NO: 338887 - DNA, 15 bp, Homo sapiens
ctcacaaataaaaat

SEQ ID NO: 338888 - DNA, 15 bp, Homo sapiens
tcacaaataaaaata

SEQ ID NO: 338889 - DNA, 15 bp, Homo sapiens
cacaaataaaaataa

SEQ ID NO: 338890 - DNA, 15 bp, Homo sapiens
acaaataaaaataat

SEQ ID NO: 338891 - DNA, 15 bp, Homo sapiens
caaataaaaataatc

SEQ ID NO: 338892 - DNA, 15 bp, Homo sapiens
aaataaaaataatct

SEQ ID NO: 338893 - DNA, 15 bp, Homo sapiens
aataaaaataatcta

SEQ ID NO: 338894 - DNA, 15 bp, Homo sapiens
ataaaaataatctaa

SEQ ID NO: 338895 - DNA, 15 bp, Homo sapiens
taaaaataatctaaa

SEQ ID NO: 338896 - DNA, 15 bp, Homo sapiens
aaaaataatctaaaa

SEQ ID NO: 338897 - DNA, 15 bp, Homo sapiens
aaaataatctaaaac

SEQ ID NO: 338898 - DNA, 15 bp, Homo sapiens
aaataatctaaaact

SEQ ID NO: 338899 - DNA, 15 bp, Homo sapiens
aataatctaaaacta

SEQ ID NO: 338900 - DNA, 15 bp, Homo sapiens
ataatctaaaactaa

SEQ ID NO: 338901 - DNA, 15 bp, Homo sapiens
taatctaaaactaaa

SEQ ID NO: 338902 - DNA, 15 bp, Homo sapiens
aatctaaaactaaaa

SEQ ID NO: 338903 - DNA, 15 bp, Homo sapiens
atctaaaactaaaat

SEQ ID NO: 338904 - DNA, 15 bp, Homo sapiens
tctaaaactaaaatg

SEQ ID NO: 338905 - DNA, 15 bp, Homo sapiens
ctaaaactaaaatgt

SEQ ID NO: 338906 - DNA, 15 bp, Homo sapiens
taaaactaaaatgta

SEQ ID NO: 338907 - DNA, 15 bp, Homo sapiens
aaaactaaaatgtat

SEQ ID NO: 338908 - DNA, 15 bp, Homo sapiens
aaactaaaatgtatt

SEQ ID NO: 338909 - DNA, 15 bp, Homo sapiens
aactaaaatgtatta

SEQ ID NO: 338910 - DNA, 15 bp, Homo sapiens
actaaaatgtattag

SEQ ID NO: 338911 - DNA, 15 bp, Homo sapiens
ctaaaatgtattaga

SEQ ID NO: 338912 - DNA, 15 bp, Homo sapiens
taaaatgtattagat

SEQ ID NO: 338913 - DNA, 15 bp, Homo sapiens
aaaatgtattagatt

SEQ ID NO: 338914 - DNA, 15 bp, Homo sapiens
aaatgtattagatta

SEQ ID NO: 338915 - DNA, 15 bp, Homo sapiens
aatgtattagattat

SEQ ID NO: 338916 - DNA, 15 bp, Homo sapiens
atgtattagattata

SEQ ID NO: 338917 - DNA, 15 bp, Homo sapiens
tgtattagattataa

SEQ ID NO: 338918 - DNA, 15 bp, Homo sapiens
gtattagattataac

SEQ ID NO: 338919 - DNA, 15 bp, Homo sapiens
tattagattataaca

SEQ ID NO: 338920 - DNA, 15 bp, Homo sapiens
attagattataacaa

SEQ ID NO: 338921 - DNA, 15 bp, Homo sapiens
ttagattataacaat

SEQ ID NO: 338922 - DNA, 15 bp, Homo sapiens
tagattataacaatg

SEQ ID NO: 338923 - DNA, 15 bp, Homo sapiens
agattataacaatgc

SEQ ID NO: 338924 - DNA, 15 bp, Homo sapiens
gattataacaatgcc

SEQ ID NO: 338925 - DNA, 15 bp, Homo sapiens
attataacaatgcct

SEQ ID NO: 338926 - DNA, 15 bp, Homo sapiens
ttataacaatgccta

SEQ ID NO: 338927 - DNA, 15 bp, Homo sapiens
tataacaatgcctac

SEQ ID NO: 338928 - DNA, 15 bp, Homo sapiens
ataacaatgcctact

SEQ ID NO: 338929 - DNA, 15 bp, Homo sapiens
taacaatgcctactt

SEQ ID NO: 338930 - DNA, 15 bp, Homo sapiens
aacaatgcctacttt

SEQ ID NO: 338931 - DNA, 15 bp, Homo sapiens
acaatgcctactttg

SEQ ID NO: 338932 - DNA, 15 bp, Homo sapiens
caatgcctactttgt

SEQ ID NO: 338933 - DNA, 15 bp, Homo sapiens
aatgcctactttgtt

SEQ ID NO: 338934 - DNA, 15 bp, Homo sapiens
atgcctactttgttt

SEQ ID NO: 338935 - DNA, 15 bp, Homo sapiens
tgcctactttgtttc

SEQ ID NO: 338936 - DNA, 15 bp, Homo sapiens
gcctactttgtttcc

SEQ ID NO: 338937 - DNA, 15 bp, Homo sapiens
cctactttgtttcca

SEQ ID NO: 338938 - DNA, 15 bp, Homo sapiens
ctactttgtttccac

SEQ ID NO: 338939 - DNA, 15 bp, Homo sapiens
tactttgtttccaca

SEQ ID NO: 338940 - DNA, 15 bp, Homo sapiens
actttgtttccacat

SEQ ID NO: 338941 - DNA, 15 bp, Homo sapiens
ctttgtttccacata

SEQ ID NO: 338942 - DNA, 15 bp, Homo sapiens
tttgtttccacatat

SEQ ID NO: 338943 - DNA, 15 bp, Homo sapiens
ttgtttccacatatt

SEQ ID NO: 338944 - DNA, 15 bp, Homo sapiens
tgtttccacatattt

SEQ ID NO: 338945 - DNA, 15 bp, Homo sapiens
gtttccacatatttc

SEQ ID NO: 338946 - DNA, 15 bp, Homo sapiens
tttccacatatttca

SEQ ID NO: 338947 - DNA, 15 bp, Homo sapiens
ttccacatatttcat

SEQ ID NO: 338948 - DNA, 15 bp, Homo sapiens
tccacatatttcatc

SEQ ID NO: 338949 - DNA, 15 bp, Homo sapiens
ccacatatttcatct

SEQ ID NO: 338950 - DNA, 15 bp, Homo sapiens
cacatatttcatctt

SEQ ID NO: 338951 - DNA, 15 bp, Homo sapiens
acatatttcatcttc

SEQ ID NO: 338952 - DNA, 15 bp, Homo sapiens
catatttcatcttca

SEQ ID NO: 338953 - DNA, 15 bp, Homo sapiens
atatttcatcttcat

SEQ ID NO: 338954 - DNA, 15 bp, Homo sapiens
tatttcatcttcatt

SEQ ID NO: 338955 - DNA, 15 bp, Homo sapiens
atttcatcttcattg

SEQ ID NO: 338956 - DNA, 15 bp, Homo sapiens
tttcatcttcattgc

SEQ ID NO: 338957 - DNA, 15 bp, Homo sapiens
ttcatcttcattgca

SEQ ID NO: 338958 - DNA, 15 bp, Homo sapiens
tcatcttcattgcat

SEQ ID NO: 338959 - DNA, 15 bp, Homo sapiens
catcttcattgcatt

SEQ ID NO: 338960 - DNA, 15 bp, Homo sapiens
atcttcattgcattt

SEQ ID NO: 338961 - DNA, 15 bp, Homo sapiens
tcttcattgcatttt

SEQ ID NO: 338962 - DNA, 15 bp, Homo sapiens
cttcattgcatttta

SEQ ID NO: 338963 - DNA, 15 bp, Homo sapiens
ttcattgcattttat

SEQ ID NO: 338964 - DNA, 15 bp, Homo sapiens
tcattgcattttatt

SEQ ID NO: 338965 - DNA, 15 bp, Homo sapiens
cattgcattttattt

SEQ ID NO: 338966 - DNA, 15 bp, Homo sapiens
attgcattttatttg

SEQ ID NO: 338967 - DNA, 15 bp, Homo sapiens
ttgcattttatttgc

SEQ ID NO: 338968 - DNA, 15 bp, Homo sapiens
tgcattttatttgca

SEQ ID NO: 338969 - DNA, 15 bp, Homo sapiens
gcattttatttgcat

SEQ ID NO: 338970 - DNA, 15 bp, Homo sapiens
cattttatttgcatg

SEQ ID NO: 338971 - DNA, 15 bp, Homo sapiens
attttatttgcatgg

SEQ ID NO: 338972 - DNA, 15 bp, Homo sapiens
ttttatttgcatggt

SEQ ID NO: 338973 - DNA, 15 bp, Homo sapiens
tttatttgcatggtt

SEQ ID NO: 338974 - DNA, 15 bp, Homo sapiens
ttatttgcatggttt

SEQ ID NO: 338975 - DNA, 15 bp, Homo sapiens
tatttgcatggtttt

SEQ ID NO: 338976 - DNA, 15 bp, Homo sapiens
atttgcatggttttc

SEQ ID NO: 338977 - DNA, 15 bp, Homo sapiens
tttgcatggttttca

SEQ ID NO: 338978 - DNA, 15 bp, Homo sapiens
ttgcatggttttcag

SEQ ID NO: 338979 - DNA, 15 bp, Homo sapiens
tgcatggttttcaga

SEQ ID NO: 338980 - DNA, 15 bp, Homo sapiens
gcatggttttcagac

SEQ ID NO: 338981 - DNA, 15 bp, Homo sapiens
catggttttcagacc

SEQ ID NO: 338982 - DNA, 15 bp, Homo sapiens
atggttttcagacct

SEQ ID NO: 338983 - DNA, 15 bp, Homo sapiens
tggttttcagacctg

SEQ ID NO: 338984 - DNA, 15 bp, Homo sapiens
ggttttcagacctga

SEQ ID NO: 338985 - DNA, 15 bp, Homo sapiens
gttttcagacctgat

SEQ ID NO: 338986 - DNA, 15 bp, Homo sapiens
ttttcagacctgatc

SEQ ID NO: 338987 - DNA, 15 bp, Homo sapiens
tttcagacctgatct

SEQ ID NO: 338988 - DNA, 15 bp, Homo sapiens
ttcagacctgatctc

SEQ ID NO: 338989 - DNA, 15 bp, Homo sapiens
tcagacctgatctct

SEQ ID NO: 338990 - DNA, 15 bp, Homo sapiens
cagacctgatctctt

SEQ ID NO: 338991 - DNA, 15 bp, Homo sapiens
agacctgatctcttc

SEQ ID NO: 338992 - DNA, 15 bp, Homo sapiens
gacctgatctcttca

SEQ ID NO: 338993 - DNA, 15 bp, Homo sapiens
acctgatctcttcag

SEQ ID NO: 338994 - DNA, 15 bp, Homo sapiens
cctgatctcttcagc

SEQ ID NO: 338995 - DNA, 15 bp, Homo sapiens
ctgatctcttcagct

SEQ ID NO: 338996 - DNA, 15 bp, Homo sapiens
tgatctcttcagctg

SEQ ID NO: 338997 - DNA, 15 bp, Homo sapiens
gatctcttcagctgg

SEQ ID NO: 338998 - DNA, 15 bp, Homo sapiens
atctcttcagctggg

SEQ ID NO: 338999 - DNA, 15 bp, Homo sapiens
tctcttcagctggga

SEQ ID NO: 339000 - DNA, 15 bp, Homo sapiens
ctcttcagctgggat

SEQ ID NO: 339001 - DNA, 15 bp, Homo sapiens
tcttcagctgggata

SEQ ID NO: 339002 - DNA, 15 bp, Homo sapiens
cttcagctgggataa

SEQ ID NO: 339003 - DNA, 15 bp, Homo sapiens
ttcagctgggataaa

SEQ ID NO: 339004 - DNA, 15 bp, Homo sapiens
tcagctgggataaag

SEQ ID NO: 339005 - DNA, 15 bp, Homo sapiens
agatcttatttgttg

SEQ ID NO: 339006 - DNA, 15 bp, Homo sapiens
gatcttatttgttgt

SEQ ID NO: 339007 - DNA, 15 bp, Homo sapiens
atcttatttgttgtt

SEQ ID NO: 339008 - DNA, 15 bp, Homo sapiens
tcttatttgttgttt

SEQ ID NO: 339009 - DNA, 15 bp, Homo sapiens
cttatttgttgtttt

SEQ ID NO: 339010 - DNA, 15 bp, Homo sapiens
ttatttgttgttttg

SEQ ID NO: 339011 - DNA, 15 bp, Homo sapiens
tatttgttgttttgg

SEQ ID NO: 339012 - DNA, 15 bp, Homo sapiens
atttgttgttttgga

SEQ ID NO: 339013 - DNA, 15 bp, Homo sapiens
tttgttgttttggat

SEQ ID NO: 339014 - DNA, 15 bp, Homo sapiens
ttgttgttttggata

SEQ ID NO: 339015 - DNA, 15 bp, Homo sapiens
tgttgttttggatag

SEQ ID NO: 339016 - DNA, 15 bp, Homo sapiens
gttgttttggataga

SEQ ID NO: 339017 - DNA, 15 bp, Homo sapiens
ttgttttggatagaa

SEQ ID NO: 339018 - DNA, 15 bp, Homo sapiens
tgttttggatagaaa

SEQ ID NO: 339019 - DNA, 15 bp, Homo sapiens
gttttggatagaaaa

SEQ ID NO: 339020 - DNA, 15 bp, Homo sapiens
ttttggatagaaaat

SEQ ID NO: 339021 - DNA, 15 bp, Homo sapiens
tttggatagaaaata

SEQ ID NO: 339022 - DNA, 15 bp, Homo sapiens
ttggatagaaaataa

SEQ ID NO: 339023 - DNA, 15 bp, Homo sapiens
tggatagaaaataat

SEQ ID NO: 339024 - DNA, 15 bp, Homo sapiens
ggatagaaaataata

SEQ ID NO: 339025 - DNA, 15 bp, Homo sapiens
gatagaaaataatat

SEQ ID NO: 339026 - DNA, 15 bp, Homo sapiens
atagaaaataatata

SEQ ID NO: 339027 - DNA, 15 bp, Homo sapiens
tagaaaataatataa

SEQ ID NO: 339028 - DNA, 15 bp, Homo sapiens
agaaaataatataag

SEQ ID NO: 339029 - DNA, 15 bp, Homo sapiens
gaaaataatataagt

SEQ ID NO: 339030 - DNA, 15 bp, Homo sapiens
aaaataatataagtg

SEQ ID NO: 339031 - DNA, 15 bp, Homo sapiens
aaataatataagtgg

SEQ ID NO: 339032 - DNA, 15 bp, Homo sapiens
aataatataagtggt

SEQ ID NO: 339033 - DNA, 15 bp, Homo sapiens
ataatataagtggta

SEQ ID NO: 339034 - DNA, 15 bp, Homo sapiens
taatataagtggtaa

SEQ ID NO: 339035 - DNA, 15 bp, Homo sapiens
aatataagtggtaat

SEQ ID NO: 339036 - DNA, 15 bp, Homo sapiens
atataagtggtaata

SEQ ID NO: 339037 - DNA, 15 bp, Homo sapiens
tataagtggtaatat

SEQ ID NO: 339038 - DNA, 15 bp, Homo sapiens
ataagtggtaatatc

SEQ ID NO: 339039 - DNA, 15 bp, Homo sapiens
taagtggtaatatct

SEQ ID NO: 339040 - DNA, 15 bp, Homo sapiens
aagtggtaatatctc

SEQ ID NO: 339041 - DNA, 15 bp, Homo sapiens
agtggtaatatctct

SEQ ID NO: 339042 - DNA, 15 bp, Homo sapiens
gtggtaatatctctt

SEQ ID NO: 339043 - DNA, 15 bp, Homo sapiens
tggtaatatctctta

SEQ ID NO: 339044 - DNA, 15 bp, Homo sapiens
ggtaatatctcttaa

SEQ ID NO: 339045 - DNA, 15 bp, Homo sapiens
gtaatatctcttaaa

SEQ ID NO: 339046 - DNA, 15 bp, Homo sapiens
taatatctcttaaac

SEQ ID NO: 339047 - DNA, 15 bp, Homo sapiens
aatatctcttaaaca

SEQ ID NO: 339048 - DNA, 15 bp, Homo sapiens
atatctcttaaacag

SEQ ID NO: 339049 - DNA, 15 bp, Homo sapiens
tatctcttaaacagt

SEQ ID NO: 339050 - DNA, 15 bp, Homo sapiens
atctcttaaacagtt

SEQ ID NO: 339051 - DNA, 15 bp, Homo sapiens
tctcttaaacagttc

SEQ ID NO: 339052 - DNA, 15 bp, Homo sapiens
ctcttaaacagttcc

SEQ ID NO: 339053 - DNA, 15 bp, Homo sapiens
tcttaaacagttcct

SEQ ID NO: 339054 - DNA, 15 bp, Homo sapiens
cttaaacagttcctc

SEQ ID NO: 339055 - DNA, 15 bp, Homo sapiens
ttaaacagttcctct

SEQ ID NO: 339056 - DNA, 15 bp, Homo sapiens
taaacagttcctctt

SEQ ID NO: 339057 - DNA, 15 bp, Homo sapiens
aaacagttcctcttg

SEQ ID NO: 339058 - DNA, 15 bp, Homo sapiens
aacagttcctcttgg

SEQ ID NO: 339059 - DNA, 15 bp, Homo sapiens
acagttcctcttggg

SEQ ID NO: 339060 - DNA, 15 bp, Homo sapiens
cagttcctcttgggt

SEQ ID NO: 339061 - DNA, 15 bp, Homo sapiens
agttcctcttgggtg

SEQ ID NO: 339062 - DNA, 15 bp, Homo sapiens
gttcctcttgggtga

SEQ ID NO: 339063 - DNA, 15 bp, Homo sapiens
ttcctcttgggtgag

SEQ ID NO: 339064 - DNA, 15 bp, Homo sapiens
tcctcttgggtgagt

SEQ ID NO: 339065 - DNA, 15 bp, Homo sapiens
cctcttgggtgagta

SEQ ID NO: 339066 - DNA, 15 bp, Homo sapiens
ctcttgggtgagtat

SEQ ID NO: 339067 - DNA, 15 bp, Homo sapiens
tcttgggtgagtatg

SEQ ID NO: 339068 - DNA, 15 bp, Homo sapiens
cttgggtgagtatgg

SEQ ID NO: 339069 - DNA, 15 bp, Homo sapiens
ttgggtgagtatggt

SEQ ID NO: 339070 - DNA, 15 bp, Homo sapiens
tgggtgagtatggta

SEQ ID NO: 339071 - DNA, 15 bp, Homo sapiens
gggtgagtatggtat

SEQ ID NO: 339072 - DNA, 15 bp, Homo sapiens
ggtgagtatggtatt

SEQ ID NO: 339073 - DNA, 15 bp, Homo sapiens
gtgagtatggtattt

SEQ ID NO: 339074 - DNA, 15 bp, Homo sapiens
tgagtatggtatttt

SEQ ID NO: 339075 - DNA, 15 bp, Homo sapiens
gagtatggtatttta

SEQ ID NO: 339076 - DNA, 15 bp, Homo sapiens
agtatggtattttat

SEQ ID NO: 339077 - DNA, 15 bp, Homo sapiens
gtatggtattttatt

SEQ ID NO: 339078 - DNA, 15 bp, Homo sapiens
tatggtattttattt

SEQ ID NO: 339079 - DNA, 15 bp, Homo sapiens
atggtattttatttt

SEQ ID NO: 339080 - DNA, 15 bp, Homo sapiens
tggtattttatttta

SEQ ID NO: 339081 - DNA, 15 bp, Homo sapiens
ggtattttattttat

SEQ ID NO: 339082 - DNA, 15 bp, Homo sapiens
gtattttattttata

SEQ ID NO: 339083 - DNA, 15 bp, Homo sapiens
tattttattttatat

SEQ ID NO: 339084 - DNA, 15 bp, Homo sapiens
attttattttatata

SEQ ID NO: 339085 - DNA, 15 bp, Homo sapiens
ttttattttatatat

SEQ ID NO: 339086 - DNA, 15 bp, Homo sapiens
tttattttatatata

SEQ ID NO: 339087 - DNA, 15 bp, Homo sapiens
ttattttatatatat

SEQ ID NO: 339088 - DNA, 15 bp, Homo sapiens
tattttatatatata

SEQ ID NO: 339089 - DNA, 15 bp, Homo sapiens
attttatatatatat

SEQ ID NO: 339090 - DNA, 15 bp, Homo sapiens
ttttatatatatatt

SEQ ID NO: 339091 - DNA, 15 bp, Homo sapiens
tttatatatatattt

SEQ ID NO: 339092 - DNA, 15 bp, Homo sapiens
ttatatatatattta

SEQ ID NO: 339093 - DNA, 15 bp, Homo sapiens
tatatatatatttat

SEQ ID NO: 339094 - DNA, 15 bp, Homo sapiens
atatatatatttata

SEQ ID NO: 339095 - DNA, 15 bp, Homo sapiens
tatatttatatatat

SEQ ID NO: 339096 - DNA, 15 bp, Homo sapiens
atatttatatatata

SEQ ID NO: 339097 - DNA, 15 bp, Homo sapiens
tatttatatatataa

SEQ ID NO: 339098 - DNA, 15 bp, Homo sapiens
atttatatatataat

SEQ ID NO: 339099 - DNA, 15 bp, Homo sapiens
tttatatatataata

SEQ ID NO: 339100 - DNA, 15 bp, Homo sapiens
ttatatatataataa

SEQ ID NO: 339101 - DNA, 15 bp, Homo sapiens
tatatatataataaa

SEQ ID NO: 339102 - DNA, 15 bp, Homo sapiens
atatatataataaat

SEQ ID NO: 339103 - DNA, 15 bp, Homo sapiens
tatatataataaata

SEQ ID NO: 339104 - DNA, 15 bp, Homo sapiens
atatataataaataa

SEQ ID NO: 339105 - DNA, 15 bp, Homo sapiens
tatataataaataaa

SEQ ID NO: 339106 - DNA, 15 bp, Homo sapiens
atataataaataaat

SEQ ID NO: 339107 - DNA, 15 bp, Homo sapiens
tataataaataaata

SEQ ID NO: 339108 - DNA, 15 bp, Homo sapiens
ataataaataaatat

SEQ ID NO: 339109 - DNA, 15 bp, Homo sapiens
taataaataaatata

SEQ ID NO: 339110 - DNA, 15 bp, Homo sapiens
ataaataaatatata

SEQ ID NO: 339111 - DNA, 15 bp, Homo sapiens
taaataaatatatat

SEQ ID NO: 339112 - DNA, 15 bp, Homo sapiens
aaataaatatatatt

SEQ ID NO: 339113 - DNA, 15 bp, Homo sapiens
aataaatatatattt

SEQ ID NO: 339114 - DNA, 15 bp, Homo sapiens
aaatatatatttata

SEQ ID NO: 339115 - DNA, 15 bp, Homo sapiens
aatatatatttatat

SEQ ID NO: 339116 - DNA, 15 bp, Homo sapiens
tataaatatatataa

SEQ ID NO: 339117 - DNA, 15 bp, Homo sapiens
ataaatatatataaa

SEQ ID NO: 339118 - DNA, 15 bp, Homo sapiens
taaatatatataaat

SEQ ID NO: 339119 - DNA, 15 bp, Homo sapiens
aaatatatataaata

SEQ ID NO: 339120 - DNA, 15 bp, Homo sapiens
aatatatataaataa

SEQ ID NO: 339121 - DNA, 15 bp, Homo sapiens
atatatataaataaa

SEQ ID NO: 339122 - DNA, 15 bp, Homo sapiens
tatatataaataaaa

SEQ ID NO: 339123 - DNA, 15 bp, Homo sapiens
atatataaataaaaa

SEQ ID NO: 339124 - DNA, 15 bp, Homo sapiens
tatataaataaaaat

SEQ ID NO: 339125 - DNA, 15 bp, Homo sapiens
atataaataaaaata

SEQ ID NO: 339126 - DNA, 15 bp, Homo sapiens
tataaataaaaataa

SEQ ID NO: 339127 - DNA, 15 bp, Homo sapiens
ataaataaaaataaa

SEQ ID NO: 339128 - DNA, 15 bp, Homo sapiens
taaataaaaataaat

SEQ ID NO: 339129 - DNA, 15 bp, Homo sapiens
aaataaaaataaata

SEQ ID NO: 339130 - DNA, 15 bp, Homo sapiens
aataaaaataaatat

SEQ ID NO: 339131 - DNA, 15 bp, Homo sapiens
ataaaaataaatata

SEQ ID NO: 339132 - DNA, 15 bp, Homo sapiens
taaaaataaatatat

SEQ ID NO: 339133 - DNA, 15 bp, Homo sapiens
aaaaataaatatata

SEQ ID NO: 339134 - DNA, 15 bp, Homo sapiens
aaaataaatatatat

SEQ ID NO: 339135 - DNA, 15 bp, Homo sapiens
ataaatatatatttt

SEQ ID NO: 339136 - DNA, 15 bp, Homo sapiens
taaatatatatttta

SEQ ID NO: 339137 - DNA, 15 bp, Homo sapiens
aaatatatattttat

SEQ ID NO: 339138 - DNA, 15 bp, Homo sapiens
aatatatattttatt

SEQ ID NO: 339139 - DNA, 15 bp, Homo sapiens
atatatattttattt

SEQ ID NO: 339140 - DNA, 15 bp, Homo sapiens
tatatattttatttt

SEQ ID NO: 339141 - DNA, 15 bp, Homo sapiens
atatattttatttta

SEQ ID NO: 339142 - DNA, 15 bp, Homo sapiens
tatattttattttat

SEQ ID NO: 339143 - DNA, 15 bp, Homo sapiens
atattttattttata

SEQ ID NO: 339144 - DNA, 15 bp, Homo sapiens
ttattttatatataa

SEQ ID NO: 339145 - DNA, 15 bp, Homo sapiens
tattttatatataaa

SEQ ID NO: 339146 - DNA, 15 bp, Homo sapiens
attttatatataaat

SEQ ID NO: 339147 - DNA, 15 bp, Homo sapiens
ttttatatataaata

SEQ ID NO: 339148 - DNA, 15 bp, Homo sapiens
tttatatataaataa

SEQ ID NO: 339149 - DNA, 15 bp, Homo sapiens
ttatatataaataaa

SEQ ID NO: 339150 - DNA, 15 bp, Homo sapiens
atatataaataaaat

SEQ ID NO: 339151 - DNA, 15 bp, Homo sapiens
tatataaataaaata

SEQ ID NO: 339152 - DNA, 15 bp, Homo sapiens
atataaataaaatat

SEQ ID NO: 339153 - DNA, 15 bp, Homo sapiens
tataaataaaatata

SEQ ID NO: 339154 - DNA, 15 bp, Homo sapiens
ataaataaaatatat

SEQ ID NO: 339155 - DNA, 15 bp, Homo sapiens
taaataaaatatata

SEQ ID NO: 339156 - DNA, 15 bp, Homo sapiens
aaataaaatatataa

SEQ ID NO: 339157 - DNA, 15 bp, Homo sapiens
aataaaatatataaa

SEQ ID NO: 339158 - DNA, 15 bp, Homo sapiens
aaaatatataaataa

SEQ ID NO: 339159 - DNA, 15 bp, Homo sapiens
aaatatataaataaa

SEQ ID NO: 339160 - DNA, 15 bp, Homo sapiens
aatatataaataaat

SEQ ID NO: 339161 - DNA, 15 bp, Homo sapiens
atatataaataaata

SEQ ID NO: 339162 - DNA, 15 bp, Homo sapiens
tatataaataaatat

SEQ ID NO: 339163 - DNA, 15 bp, Homo sapiens
atataaataaatata

SEQ ID NO: 339164 - DNA, 15 bp, Homo sapiens
tataaataaatatat

SEQ ID NO: 339165 - DNA, 15 bp, Homo sapiens
aaataaatatatata

SEQ ID NO: 339166 - DNA, 15 bp, Homo sapiens
aataaatatatataa

SEQ ID NO: 339167 - DNA, 15 bp, Homo sapiens
aaaatatataaatat

SEQ ID NO: 339168 - DNA, 15 bp, Homo sapiens
aaatatataaatatt

SEQ ID NO: 339169 - DNA, 15 bp, Homo sapiens
aatatataaatattt

SEQ ID NO: 339170 - DNA, 15 bp, Homo sapiens
atatataaatatttt

SEQ ID NO: 339171 - DNA, 15 bp, Homo sapiens
tatataaatattttt

SEQ ID NO: 339172 - DNA, 15 bp, Homo sapiens
atataaatattttta

SEQ ID NO: 339173 - DNA, 15 bp, Homo sapiens
tataaatatttttat

SEQ ID NO: 339174 - DNA, 15 bp, Homo sapiens
ataaatatttttata

SEQ ID NO: 339175 - DNA, 15 bp, Homo sapiens
taaatatttttatat

SEQ ID NO: 339176 - DNA, 15 bp, Homo sapiens
aaatatttttatata

SEQ ID NO: 339177 - DNA, 15 bp, Homo sapiens
aatatttttatatat

SEQ ID NO: 339178 - DNA, 15 bp, Homo sapiens
atatttttatatata

SEQ ID NO: 339179 - DNA, 15 bp, Homo sapiens
tatttttatatataa

SEQ ID NO: 339180 - DNA, 15 bp, Homo sapiens
atttttatatataat

SEQ ID NO: 339181 - DNA, 15 bp, Homo sapiens
tttttatatataatc

SEQ ID NO: 339182 - DNA, 15 bp, Homo sapiens
ttttatatataatct

SEQ ID NO: 339183 - DNA, 15 bp, Homo sapiens
tttatatataatcta

SEQ ID NO: 339184 - DNA, 15 bp, Homo sapiens
ttatatataatctat

SEQ ID NO: 339185 - DNA, 15 bp, Homo sapiens
tatatataatctatt

SEQ ID NO: 339186 - DNA, 15 bp, Homo sapiens
atatataatctattt

SEQ ID NO: 339187 - DNA, 15 bp, Homo sapiens
tatataatctattta

SEQ ID NO: 339188 - DNA, 15 bp, Homo sapiens
atataatctatttat

SEQ ID NO: 339189 - DNA, 15 bp, Homo sapiens
tataatctatttata

SEQ ID NO: 339190 - DNA, 15 bp, Homo sapiens
ataatctatttatat

SEQ ID NO: 339191 - DNA, 15 bp, Homo sapiens
taatctatttatata

SEQ ID NO: 339192 - DNA, 15 bp, Homo sapiens
aatctatttatatat

SEQ ID NO: 339193 - DNA, 15 bp, Homo sapiens
atctatttatatatt

SEQ ID NO: 339194 - DNA, 15 bp, Homo sapiens
tctatttatatatta

SEQ ID NO: 339195 - DNA, 15 bp, Homo sapiens
ctatttatatattat

SEQ ID NO: 339196 - DNA, 15 bp, Homo sapiens
tatttatatattata

SEQ ID NO: 339197 - DNA, 15 bp, Homo sapiens
atttatatattatat

SEQ ID NO: 339198 - DNA, 15 bp, Homo sapiens
tttatatattatata

SEQ ID NO: 339199 - DNA, 15 bp, Homo sapiens
ttatatattatatat

SEQ ID NO: 339200 - DNA, 15 bp, Homo sapiens
tatatattatatatg

SEQ ID NO: 339201 - DNA, 15 bp, Homo sapiens
atatattatatatgt

SEQ ID NO: 339202 - DNA, 15 bp, Homo sapiens
tatattatatatgta

SEQ ID NO: 339203 - DNA, 15 bp, Homo sapiens
atattatatatgtat

SEQ ID NO: 339204 - DNA, 15 bp, Homo sapiens
tattatatatgtata

SEQ ID NO: 339205 - DNA, 15 bp, Homo sapiens
attatatatgtatat

SEQ ID NO: 339206 - DNA, 15 bp, Homo sapiens
ttatatatgtatatg

SEQ ID NO: 339207 - DNA, 15 bp, Homo sapiens
tatatatgtatatgt

SEQ ID NO: 339208 - DNA, 15 bp, Homo sapiens
atatatgtatatgta

SEQ ID NO: 339209 - DNA, 15 bp, Homo sapiens
tatatgtatatgtat

SEQ ID NO: 339210 - DNA, 15 bp, Homo sapiens
atatgtatatgtata

SEQ ID NO: 339211 - DNA, 15 bp, Homo sapiens
tatgtatatgtatat

SEQ ID NO: 339212 - DNA, 15 bp, Homo sapiens
atgtatatgtatatg

SEQ ID NO: 339213 - DNA, 15 bp, Homo sapiens
tgtatatgtatatgt

SEQ ID NO: 339214 - DNA, 15 bp, Homo sapiens
gtatatgtatatgtg

SEQ ID NO: 339215 - DNA, 15 bp, Homo sapiens
tatatgtatatgtgt

SEQ ID NO: 339216 - DNA, 15 bp, Homo sapiens
atatgtatatgtgtg

SEQ ID NO: 339217 - DNA, 15 bp, Homo sapiens
tatgtatatgtgtgt

SEQ ID NO: 339218 - DNA, 15 bp, Homo sapiens
atgtatatgtgtgtg

SEQ ID NO: 339219 - DNA, 15 bp, Homo sapiens
gtatatgtgtgtgta

SEQ ID NO: 339220 - DNA, 15 bp, Homo sapiens
tatatgtgtgtgtat

SEQ ID NO: 339221 - DNA, 15 bp, Homo sapiens
atatatatatattta

SEQ ID NO: 339222 - DNA, 15 bp, Homo sapiens
tatatatatttataa

SEQ ID NO: 339223 - DNA, 15 bp, Homo sapiens
tatatatttataatt

SEQ ID NO: 339224 - DNA, 15 bp, Homo sapiens
atatatttataattt

SEQ ID NO: 339225 - DNA, 15 bp, Homo sapiens
tatatttataatttt

SEQ ID NO: 339226 - DNA, 15 bp, Homo sapiens
atatttataattttt

SEQ ID NO: 339227 - DNA, 15 bp, Homo sapiens
tatttataatttttt

SEQ ID NO: 339228 - DNA, 15 bp, Homo sapiens
atttataattttttt

SEQ ID NO: 339229 - DNA, 15 bp, Homo sapiens
tttataatttttttt

SEQ ID NO: 339230 - DNA, 15 bp, Homo sapiens
ttataattttttttt

SEQ ID NO: 339231 - DNA, 15 bp, Homo sapiens
tataatttttttttt

SEQ ID NO: 339232 - DNA, 15 bp, Homo sapiens
ataattttttttttt

SEQ ID NO: 339233 - DNA, 15 bp, Homo sapiens
attttttttttttta

SEQ ID NO: 339234 - DNA, 15 bp, Homo sapiens
tttttttttttaaca

SEQ ID NO: 339235 - DNA, 15 bp, Homo sapiens
ttttttttttaacag

SEQ ID NO: 339236 - DNA, 15 bp, Homo sapiens
tttttttttaacaga

SEQ ID NO: 339237 - DNA, 15 bp, Homo sapiens
ttttttttaacagag

SEQ ID NO: 339238 - DNA, 15 bp, Homo sapiens
tttttttaacagagt

SEQ ID NO: 339239 - DNA, 15 bp, Homo sapiens
ttttttaacagagtc

SEQ ID NO: 339240 - DNA, 15 bp, Homo sapiens
tttttaacagagtct

SEQ ID NO: 339241 - DNA, 15 bp, Homo sapiens
ttttaacagagtctt

SEQ ID NO: 339242 - DNA, 15 bp, Homo sapiens
tttaacagagtctta

SEQ ID NO: 339243 - DNA, 15 bp, Homo sapiens
ttaacagagtcttac

SEQ ID NO: 339244 - DNA, 15 bp, Homo sapiens
taacagagtcttact

SEQ ID NO: 339245 - DNA, 15 bp, Homo sapiens
aacagagtcttactc

SEQ ID NO: 339246 - DNA, 15 bp, Homo sapiens
acagagtcttactct

SEQ ID NO: 339247 - DNA, 15 bp, Homo sapiens
cagagtcttactctg

SEQ ID NO: 339248 - DNA, 15 bp, Homo sapiens
agagtcttactctgt

SEQ ID NO: 339249 - DNA, 15 bp, Homo sapiens
gtggcacaatcttgg

SEQ ID NO: 339250 - DNA, 15 bp, Homo sapiens
tggcacaatcttggc

SEQ ID NO: 339251 - DNA, 15 bp, Homo sapiens
ggcacaatcttggct

SEQ ID NO: 339252 - DNA, 15 bp, Homo sapiens
gcacaatcttggctc

SEQ ID NO: 339253 - DNA, 15 bp, Homo sapiens
cacaatcttggctca

SEQ ID NO: 339254 - DNA, 15 bp, Homo sapiens
acaatcttggctcac

SEQ ID NO: 339255 - DNA, 15 bp, Homo sapiens
tggctcactgcaact

SEQ ID NO: 339256 - DNA, 15 bp, Homo sapiens
gcaacttctacctcc

SEQ ID NO: 339257 - DNA, 15 bp, Homo sapiens
caacttctacctcct

SEQ ID NO: 339258 - DNA, 15 bp, Homo sapiens
aacttctacctcctg

SEQ ID NO: 339259 - DNA, 15 bp, Homo sapiens
acttctacctcctgg

SEQ ID NO: 339260 - DNA, 15 bp, Homo sapiens
cttctacctcctggc

SEQ ID NO: 339261 - DNA, 15 bp, Homo sapiens
ttctacctcctggct

SEQ ID NO: 339262 - DNA, 15 bp, Homo sapiens
tctacctcctggctt

SEQ ID NO: 339263 - DNA, 15 bp, Homo sapiens
ctacctcctggcttc

SEQ ID NO: 339264 - DNA, 15 bp, Homo sapiens
tacctcctggcttca

SEQ ID NO: 339265 - DNA, 15 bp, Homo sapiens
acctcctggcttcaa

SEQ ID NO: 339266 - DNA, 15 bp, Homo sapiens
cctcctggcttcaag

SEQ ID NO: 339267 - DNA, 15 bp, Homo sapiens
ctcctggcttcaagt

SEQ ID NO: 339268 - DNA, 15 bp, Homo sapiens
tcctggcttcaagtg

SEQ ID NO: 339269 - DNA, 15 bp, Homo sapiens
cctggcttcaagtga

SEQ ID NO: 339270 - DNA, 15 bp, Homo sapiens
ctggcttcaagtgat

SEQ ID NO: 339271 - DNA, 15 bp, Homo sapiens
tggcttcaagtgatt

SEQ ID NO: 339272 - DNA, 15 bp, Homo sapiens
ggcttcaagtgattc

SEQ ID NO: 339273 - DNA, 15 bp, Homo sapiens
gcttcaagtgattct

SEQ ID NO: 339274 - DNA, 15 bp, Homo sapiens
cttcaagtgattctc

SEQ ID NO: 339275 - DNA, 15 bp, Homo sapiens
agtgattctcctgca

SEQ ID NO: 339276 - DNA, 15 bp, Homo sapiens
gtgattctcctgcat

SEQ ID NO: 339277 - DNA, 15 bp, Homo sapiens
tgattctcctgcatc

SEQ ID NO: 339278 - DNA, 15 bp, Homo sapiens
gattctcctgcatca

SEQ ID NO: 339279 - DNA, 15 bp, Homo sapiens
attctcctgcatcag

SEQ ID NO: 339280 - DNA, 15 bp, Homo sapiens
ttctcctgcatcagc

SEQ ID NO: 339281 - DNA, 15 bp, Homo sapiens
tctcctgcatcagcc

SEQ ID NO: 339282 - DNA, 15 bp, Homo sapiens
ctcctgcatcagcct

SEQ ID NO: 339283 - DNA, 15 bp, Homo sapiens
tcctgcatcagcctc

SEQ ID NO: 339284 - DNA, 15 bp, Homo sapiens
cctgcatcagcctcc

SEQ ID NO: 339285 - DNA, 15 bp, Homo sapiens
ctgcatcagcctccc

SEQ ID NO: 339286 - DNA, 15 bp, Homo sapiens
tgcatcagcctccca

SEQ ID NO: 339287 - DNA, 15 bp, Homo sapiens
gcatcagcctcccaa

SEQ ID NO: 339288 - DNA, 15 bp, Homo sapiens
catcagcctcccaag

SEQ ID NO: 339289 - DNA, 15 bp, Homo sapiens
atcagcctcccaagt

SEQ ID NO: 339290 - DNA, 15 bp, Homo sapiens
aagtagctgggactg

SEQ ID NO: 339291 - DNA, 15 bp, Homo sapiens
tagctgggactgcaa

SEQ ID NO: 339292 - DNA, 15 bp, Homo sapiens
agctgggactgcaaa

SEQ ID NO: 339293 - DNA, 15 bp, Homo sapiens
gctgggactgcaaac

SEQ ID NO: 339294 - DNA, 15 bp, Homo sapiens
ctgggactgcaaaca

SEQ ID NO: 339295 - DNA, 15 bp, Homo sapiens
tgggactgcaaacat

SEQ ID NO: 339296 - DNA, 15 bp, Homo sapiens
gggactgcaaacatg

SEQ ID NO: 339297 - DNA, 15 bp, Homo sapiens
ggactgcaaacatgt

SEQ ID NO: 339298 - DNA, 15 bp, Homo sapiens
gactgcaaacatgtg

SEQ ID NO: 339299 - DNA, 15 bp, Homo sapiens
actgcaaacatgtgc

SEQ ID NO: 339300 - DNA, 15 bp, Homo sapiens
ctgcaaacatgtgcc

SEQ ID NO: 339301 - DNA, 15 bp, Homo sapiens
tgcaaacatgtgcca

SEQ ID NO: 339302 - DNA, 15 bp, Homo sapiens
gcaaacatgtgccac

SEQ ID NO: 339303 - DNA, 15 bp, Homo sapiens
caaacatgtgccacc

SEQ ID NO: 339304 - DNA, 15 bp, Homo sapiens
aaacatgtgccacca

SEQ ID NO: 339305 - DNA, 15 bp, Homo sapiens
aacatgtgccaccac

SEQ ID NO: 339306 - DNA, 15 bp, Homo sapiens
acatgtgccaccacg

SEQ ID NO: 339307 - DNA, 15 bp, Homo sapiens
ggctaattttttgtg

SEQ ID NO: 339308 - DNA, 15 bp, Homo sapiens
gctaattttttgtgt

SEQ ID NO: 339309 - DNA, 15 bp, Homo sapiens
ctaattttttgtgtt

SEQ ID NO: 339310 - DNA, 15 bp, Homo sapiens
taattttttgtgttt

SEQ ID NO: 339311 - DNA, 15 bp, Homo sapiens
aattttttgtgtttt

SEQ ID NO: 339312 - DNA, 15 bp, Homo sapiens
attttttgtgttttt

SEQ ID NO: 339313 - DNA, 15 bp, Homo sapiens
ttttttgtgttttta

SEQ ID NO: 339314 - DNA, 15 bp, Homo sapiens
tttttgtgtttttag

SEQ ID NO: 339315 - DNA, 15 bp, Homo sapiens
ttttgtgtttttagt

SEQ ID NO: 339316 - DNA, 15 bp, Homo sapiens
tttgtgtttttagtt

SEQ ID NO: 339317 - DNA, 15 bp, Homo sapiens
ttgtgtttttagtta

SEQ ID NO: 339318 - DNA, 15 bp, Homo sapiens
tgtgtttttagttag

SEQ ID NO: 339319 - DNA, 15 bp, Homo sapiens
gtgtttttagttaga

SEQ ID NO: 339320 - DNA, 15 bp, Homo sapiens
tgtttttagttagag

SEQ ID NO: 339321 - DNA, 15 bp, Homo sapiens
gtttttagttagaga

SEQ ID NO: 339322 - DNA, 15 bp, Homo sapiens
tttttagttagagac

SEQ ID NO: 339323 - DNA, 15 bp, Homo sapiens
ttttagttagagacg

SEQ ID NO: 339324 - DNA, 15 bp, Homo sapiens
tttagttagagacgg

SEQ ID NO: 339325 - DNA, 15 bp, Homo sapiens
ttagttagagacggg

SEQ ID NO: 339326 - DNA, 15 bp, Homo sapiens
tagttagagacgggg

SEQ ID NO: 339327 - DNA, 15 bp, Homo sapiens
agttagagacggggt

SEQ ID NO: 339328 - DNA, 15 bp, Homo sapiens
gttagagacggggtt

SEQ ID NO: 339329 - DNA, 15 bp, Homo sapiens
ttagagacggggttt

SEQ ID NO: 339330 - DNA, 15 bp, Homo sapiens
gacggggtttcacct

SEQ ID NO: 339331 - DNA, 15 bp, Homo sapiens
acggggtttcacctt

SEQ ID NO: 339332 - DNA, 15 bp, Homo sapiens
cggggtttcaccttg

SEQ ID NO: 339333 - DNA, 15 bp, Homo sapiens
ggggtttcaccttgt

SEQ ID NO: 339334 - DNA, 15 bp, Homo sapiens
gggtttcaccttgtt

SEQ ID NO: 339335 - DNA, 15 bp, Homo sapiens
ggtttcaccttgttg

SEQ ID NO: 339336 - DNA, 15 bp, Homo sapiens
gtttcaccttgttgt

SEQ ID NO: 339337 - DNA, 15 bp, Homo sapiens
tttcaccttgttgtc

SEQ ID NO: 339338 - DNA, 15 bp, Homo sapiens
ttcaccttgttgtcc

SEQ ID NO: 339339 - DNA, 15 bp, Homo sapiens
tcaccttgttgtcca

SEQ ID NO: 339340 - DNA, 15 bp, Homo sapiens
caccttgttgtccag

SEQ ID NO: 339341 - DNA, 15 bp, Homo sapiens
accttgttgtccagg

SEQ ID NO: 339342 - DNA, 15 bp, Homo sapiens
ccttgttgtccaggc

SEQ ID NO: 339343 - DNA, 15 bp, Homo sapiens
cttgttgtccaggct

SEQ ID NO: 339344 - DNA, 15 bp, Homo sapiens
gttgtccaggctggt

SEQ ID NO: 339345 - DNA, 15 bp, Homo sapiens
ttgtccaggctggtc

SEQ ID NO: 339346 - DNA, 15 bp, Homo sapiens
tgtccaggctggtct

SEQ ID NO: 339347 - DNA, 15 bp, Homo sapiens
gtccaggctggtctt

SEQ ID NO: 339348 - DNA, 15 bp, Homo sapiens
tccaggctggtcttg

SEQ ID NO: 339349 - DNA, 15 bp, Homo sapiens
tgaactcctggccta

SEQ ID NO: 339350 - DNA, 15 bp, Homo sapiens
gaactcctggcctag

SEQ ID NO: 339351 - DNA, 15 bp, Homo sapiens
aactcctggcctagg

SEQ ID NO: 339352 - DNA, 15 bp, Homo sapiens
actcctggcctaggt

SEQ ID NO: 339353 - DNA, 15 bp, Homo sapiens
ctcctggcctaggtg

SEQ ID NO: 339354 - DNA, 15 bp, Homo sapiens
tcctggcctaggtga

SEQ ID NO: 339355 - DNA, 15 bp, Homo sapiens
cctggcctaggtgat

SEQ ID NO: 339356 - DNA, 15 bp, Homo sapiens
ctggcctaggtgatc

SEQ ID NO: 339357 - DNA, 15 bp, Homo sapiens
tggcctaggtgatcc

SEQ ID NO: 339358 - DNA, 15 bp, Homo sapiens
ggcctaggtgatcca

SEQ ID NO: 339359 - DNA, 15 bp, Homo sapiens
gcctaggtgatccac

SEQ ID NO: 339360 - DNA, 15 bp, Homo sapiens
cctaggtgatccacc

SEQ ID NO: 339361 - DNA, 15 bp, Homo sapiens
ctaggtgatccacct

SEQ ID NO: 339362 - DNA, 15 bp, Homo sapiens
taggtgatccacctg

SEQ ID NO: 339363 - DNA, 15 bp, Homo sapiens
aggtgatccacctgc

SEQ ID NO: 339364 - DNA, 15 bp, Homo sapiens
ggtgatccacctgcc

SEQ ID NO: 339365 - DNA, 15 bp, Homo sapiens
ctcagcctcccaaaa

SEQ ID NO: 339366 - DNA, 15 bp, Homo sapiens
tcagcctcccaaaat

SEQ ID NO: 339367 - DNA, 15 bp, Homo sapiens
cagcctcccaaaatg

SEQ ID NO: 339368 - DNA, 15 bp, Homo sapiens
agcctcccaaaatgc

SEQ ID NO: 339369 - DNA, 15 bp, Homo sapiens
aaatgctgggattat

SEQ ID NO: 339370 - DNA, 15 bp, Homo sapiens
aatgctgggattata

SEQ ID NO: 339371 - DNA, 15 bp, Homo sapiens
atgctgggattatag

SEQ ID NO: 339372 - DNA, 15 bp, Homo sapiens
ggtgtgagccaccac

SEQ ID NO: 339373 - DNA, 15 bp, Homo sapiens
gtgtgagccaccaca

SEQ ID NO: 339374 - DNA, 15 bp, Homo sapiens
caccacacccagcct

SEQ ID NO: 339375 - DNA, 15 bp, Homo sapiens
accacacccagcctt

SEQ ID NO: 339376 - DNA, 15 bp, Homo sapiens
ccacacccagccttt

SEQ ID NO: 339377 - DNA, 15 bp, Homo sapiens
cacacccagcctttt

SEQ ID NO: 339378 - DNA, 15 bp, Homo sapiens
acacccagcctttta

SEQ ID NO: 339379 - DNA, 15 bp, Homo sapiens
cacccagccttttat

SEQ ID NO: 339380 - DNA, 15 bp, Homo sapiens
acccagccttttatt

SEQ ID NO: 339381 - DNA, 15 bp, Homo sapiens
cccagccttttattt

SEQ ID NO: 339382 - DNA, 15 bp, Homo sapiens
ccagccttttatttt

SEQ ID NO: 339383 - DNA, 15 bp, Homo sapiens
cagccttttatttta

SEQ ID NO: 339384 - DNA, 15 bp, Homo sapiens
agccttttattttat

SEQ ID NO: 339385 - DNA, 15 bp, Homo sapiens
gccttttattttatt

SEQ ID NO: 339386 - DNA, 15 bp, Homo sapiens
ccttttattttattt

SEQ ID NO: 339387 - DNA, 15 bp, Homo sapiens
cttttattttattta

SEQ ID NO: 339388 - DNA, 15 bp, Homo sapiens
ttttattttatttat

SEQ ID NO: 339389 - DNA, 15 bp, Homo sapiens
tttattttatttatt

SEQ ID NO: 339390 - DNA, 15 bp, Homo sapiens
ttattttatttattt

SEQ ID NO: 339391 - DNA, 15 bp, Homo sapiens
tattttatttattta

SEQ ID NO: 339392 - DNA, 15 bp, Homo sapiens
attttatttatttag

SEQ ID NO: 339393 - DNA, 15 bp, Homo sapiens
ttttatttatttaga

SEQ ID NO: 339394 - DNA, 15 bp, Homo sapiens
tttatttatttagaa

SEQ ID NO: 339395 - DNA, 15 bp, Homo sapiens
ttatttatttagaat

SEQ ID NO: 339396 - DNA, 15 bp, Homo sapiens
tatttatttagaatt

SEQ ID NO: 339397 - DNA, 15 bp, Homo sapiens
atttatttagaattc

SEQ ID NO: 339398 - DNA, 15 bp, Homo sapiens
tttatttagaattcc

SEQ ID NO: 339399 - DNA, 15 bp, Homo sapiens
ttatttagaattcca

SEQ ID NO: 339400 - DNA, 15 bp, Homo sapiens
tatttagaattccat

SEQ ID NO: 339401 - DNA, 15 bp, Homo sapiens
atttagaattccatg

SEQ ID NO: 339402 - DNA, 15 bp, Homo sapiens
tttagaattccatgt

SEQ ID NO: 339403 - DNA, 15 bp, Homo sapiens
ttagaattccatgtt

SEQ ID NO: 339404 - DNA, 15 bp, Homo sapiens
tagaattccatgttc

SEQ ID NO: 339405 - DNA, 15 bp, Homo sapiens
agaattccatgttca

SEQ ID NO: 339406 - DNA, 15 bp, Homo sapiens
gaattccatgttcat

SEQ ID NO: 339407 - DNA, 15 bp, Homo sapiens
aattccatgttcatg

SEQ ID NO: 339408 - DNA, 15 bp, Homo sapiens
attccatgttcatga

SEQ ID NO: 339409 - DNA, 15 bp, Homo sapiens
ttccatgttcatgat

SEQ ID NO: 339410 - DNA, 15 bp, Homo sapiens
tccatgttcatgatc

SEQ ID NO: 339411 - DNA, 15 bp, Homo sapiens
ccatgttcatgatct

SEQ ID NO: 339412 - DNA, 15 bp, Homo sapiens
catgttcatgatcta

SEQ ID NO: 339413 - DNA, 15 bp, Homo sapiens
atgttcatgatctat

SEQ ID NO: 339414 - DNA, 15 bp, Homo sapiens
tgttcatgatctatg

SEQ ID NO: 339415 - DNA, 15 bp, Homo sapiens
gttcatgatctatga

SEQ ID NO: 339416 - DNA, 15 bp, Homo sapiens
ttcatgatctatgag

SEQ ID NO: 339417 - DNA, 15 bp, Homo sapiens
tcatgatctatgagt

SEQ ID NO: 339418 - DNA, 15 bp, Homo sapiens
catgatctatgagta

SEQ ID NO: 339419 - DNA, 15 bp, Homo sapiens
atgatctatgagtag

SEQ ID NO: 339420 - DNA, 15 bp, Homo sapiens
tgatctatgagtagc

SEQ ID NO: 339421 - DNA, 15 bp, Homo sapiens
gatctatgagtagca

SEQ ID NO: 339422 - DNA, 15 bp, Homo sapiens
atctatgagtagcat

SEQ ID NO: 339423 - DNA, 15 bp, Homo sapiens
tctatgagtagcata

SEQ ID NO: 339424 - DNA, 15 bp, Homo sapiens
ctatgagtagcatag

SEQ ID NO: 339425 - DNA, 15 bp, Homo sapiens
tatgagtagcatagt

SEQ ID NO: 339426 - DNA, 15 bp, Homo sapiens
atgagtagcatagtc

SEQ ID NO: 339427 - DNA, 15 bp, Homo sapiens
tgagtagcatagtca

SEQ ID NO: 339428 - DNA, 15 bp, Homo sapiens
gagtagcatagtcag

SEQ ID NO: 339429 - DNA, 15 bp, Homo sapiens
agtagcatagtcagc

SEQ ID NO: 339430 - DNA, 15 bp, Homo sapiens
gtagcatagtcagca

SEQ ID NO: 339431 - DNA, 15 bp, Homo sapiens
tagcatagtcagcat

SEQ ID NO: 339432 - DNA, 15 bp, Homo sapiens
agcatagtcagcatt

SEQ ID NO: 339433 - DNA, 15 bp, Homo sapiens
gcatagtcagcattt

SEQ ID NO: 339434 - DNA, 15 bp, Homo sapiens
catagtcagcattta

SEQ ID NO: 339435 - DNA, 15 bp, Homo sapiens
atagtcagcatttac

SEQ ID NO: 339436 - DNA, 15 bp, Homo sapiens
tagtcagcatttact

SEQ ID NO: 339437 - DNA, 15 bp, Homo sapiens
agtcagcatttactt

SEQ ID NO: 339438 - DNA, 15 bp, Homo sapiens
gtcagcatttacttt

SEQ ID NO: 339439 - DNA, 15 bp, Homo sapiens
tcagcatttacttta

SEQ ID NO: 339440 - DNA, 15 bp, Homo sapiens
cagcatttactttaa

SEQ ID NO: 339441 - DNA, 15 bp, Homo sapiens
agcatttactttaaa

SEQ ID NO: 339442 - DNA, 15 bp, Homo sapiens
gcatttactttaaaa

SEQ ID NO: 339443 - DNA, 15 bp, Homo sapiens
catttactttaaaat

SEQ ID NO: 339444 - DNA, 15 bp, Homo sapiens
tttactttaaaatag

SEQ ID NO: 339445 - DNA, 15 bp, Homo sapiens
ttactttaaaatagc

SEQ ID NO: 339446 - DNA, 15 bp, Homo sapiens
tactttaaaatagct

SEQ ID NO: 339447 - DNA, 15 bp, Homo sapiens
actttaaaatagctg

SEQ ID NO: 339448 - DNA, 15 bp, Homo sapiens
ctttaaaatagctgg

SEQ ID NO: 339449 - DNA, 15 bp, Homo sapiens
tttaaaatagctggt

SEQ ID NO: 339450 - DNA, 15 bp, Homo sapiens
ttaaaatagctggta

SEQ ID NO: 339451 - DNA, 15 bp, Homo sapiens
taaaatagctggtat

SEQ ID NO: 339452 - DNA, 15 bp, Homo sapiens
aaaatagctggtatt

SEQ ID NO: 339453 - DNA, 15 bp, Homo sapiens
aaatagctggtatta

SEQ ID NO: 339454 - DNA, 15 bp, Homo sapiens
aatagctggtattat

SEQ ID NO: 339455 - DNA, 15 bp, Homo sapiens
atagctggtattatc

SEQ ID NO: 339456 - DNA, 15 bp, Homo sapiens
tagctggtattatca

SEQ ID NO: 339457 - DNA, 15 bp, Homo sapiens
agctggtattatcag

SEQ ID NO: 339458 - DNA, 15 bp, Homo sapiens
gctggtattatcaga

SEQ ID NO: 339459 - DNA, 15 bp, Homo sapiens
ctggtattatcagat

SEQ ID NO: 339460 - DNA, 15 bp, Homo sapiens
tggtattatcagatg

SEQ ID NO: 339461 - DNA, 15 bp, Homo sapiens
ggtattatcagatgc

SEQ ID NO: 339462 - DNA, 15 bp, Homo sapiens
gtattatcagatgca

SEQ ID NO: 339463 - DNA, 15 bp, Homo sapiens
tattatcagatgcat

SEQ ID NO: 339464 - DNA, 15 bp, Homo sapiens
attatcagatgcatc

SEQ ID NO: 339465 - DNA, 15 bp, Homo sapiens
ttatcagatgcatca

SEQ ID NO: 339466 - DNA, 15 bp, Homo sapiens
tatcagatgcatcat

SEQ ID NO: 339467 - DNA, 15 bp, Homo sapiens
atcagatgcatcatt

SEQ ID NO: 339468 - DNA, 15 bp, Homo sapiens
tcagatgcatcattg

SEQ ID NO: 339469 - DNA, 15 bp, Homo sapiens
cagatgcatcattgc

SEQ ID NO: 339470 - DNA, 15 bp, Homo sapiens
agatgcatcattgct

SEQ ID NO: 339471 - DNA, 15 bp, Homo sapiens
gatgcatcattgctt

SEQ ID NO: 339472 - DNA, 15 bp, Homo sapiens
atgcatcattgcttg

SEQ ID NO: 339473 - DNA, 15 bp, Homo sapiens
tgcatcattgcttgc

SEQ ID NO: 339474 - DNA, 15 bp, Homo sapiens
gcatcattgcttgct

SEQ ID NO: 339475 - DNA, 15 bp, Homo sapiens
catcattgcttgctt

SEQ ID NO: 339476 - DNA, 15 bp, Homo sapiens
atcattgcttgcttt

SEQ ID NO: 339477 - DNA, 15 bp, Homo sapiens
tcattgcttgctttg

SEQ ID NO: 339478 - DNA, 15 bp, Homo sapiens
cattgcttgctttga

SEQ ID NO: 339479 - DNA, 15 bp, Homo sapiens
attgcttgctttgag

SEQ ID NO: 339480 - DNA, 15 bp, Homo sapiens
ttgcttgctttgagc

SEQ ID NO: 339481 - DNA, 15 bp, Homo sapiens
tgcttgctttgagct

SEQ ID NO: 339482 - DNA, 15 bp, Homo sapiens
gcttgctttgagcta

SEQ ID NO: 339483 - DNA, 15 bp, Homo sapiens
cttgctttgagctat

SEQ ID NO: 339484 - DNA, 15 bp, Homo sapiens
ttgctttgagctatt

SEQ ID NO: 339485 - DNA, 15 bp, Homo sapiens
tgctttgagctattt

SEQ ID NO: 339486 - DNA, 15 bp, Homo sapiens
gctttgagctatttc

SEQ ID NO: 339487 - DNA, 15 bp, Homo sapiens
ctttgagctatttct

SEQ ID NO: 339488 - DNA, 15 bp, Homo sapiens
tttgagctatttctc

SEQ ID NO: 339489 - DNA, 15 bp, Homo sapiens
ttgagctatttctct

SEQ ID NO: 339490 - DNA, 15 bp, Homo sapiens
tgagctatttctctt

SEQ ID NO: 339491 - DNA, 15 bp, Homo sapiens
gagctatttctcttt

SEQ ID NO: 339492 - DNA, 15 bp, Homo sapiens
agctatttctctttt

SEQ ID NO: 339493 - DNA, 15 bp, Homo sapiens
gctatttctctttta

SEQ ID NO: 339494 - DNA, 15 bp, Homo sapiens
ctatttctcttttaa

SEQ ID NO: 339495 - DNA, 15 bp, Homo sapiens
tatttctcttttaac

SEQ ID NO: 339496 - DNA, 15 bp, Homo sapiens
atttctcttttaact

SEQ ID NO: 339497 - DNA, 15 bp, Homo sapiens
tttctcttttaactt

SEQ ID NO: 339498 - DNA, 15 bp, Homo sapiens
ttctcttttaactta

SEQ ID NO: 339499 - DNA, 15 bp, Homo sapiens
tctcttttaacttat

SEQ ID NO: 339500 - DNA, 15 bp, Homo sapiens
ctcttttaacttatg

SEQ ID NO: 339501 - DNA, 15 bp, Homo sapiens
tcttttaacttatgg

SEQ ID NO: 339502 - DNA, 15 bp, Homo sapiens
cttttaacttatggc

SEQ ID NO: 339503 - DNA, 15 bp, Homo sapiens
ttttaacttatggca

SEQ ID NO: 339504 - DNA, 15 bp, Homo sapiens
tttaacttatggcag

SEQ ID NO: 339505 - DNA, 15 bp, Homo sapiens
ttaacttatggcagg

SEQ ID NO: 339506 - DNA, 15 bp, Homo sapiens
taacttatggcaggt

SEQ ID NO: 339507 - DNA, 15 bp, Homo sapiens
aacttatggcaggtg

SEQ ID NO: 339508 - DNA, 15 bp, Homo sapiens
acttatggcaggtgt

SEQ ID NO: 339509 - DNA, 15 bp, Homo sapiens
cttatggcaggtgtt

SEQ ID NO: 339510 - DNA, 15 bp, Homo sapiens
ttatggcaggtgttt

SEQ ID NO: 339511 - DNA, 15 bp, Homo sapiens
tatggcaggtgttta

SEQ ID NO: 339512 - DNA, 15 bp, Homo sapiens
atggcaggtgtttat

SEQ ID NO: 339513 - DNA, 15 bp, Homo sapiens
tggcaggtgtttatt

SEQ ID NO: 339514 - DNA, 15 bp, Homo sapiens
ggcaggtgtttattc

SEQ ID NO: 339515 - DNA, 15 bp, Homo sapiens
gcaggtgtttattcc

SEQ ID NO: 339516 - DNA, 15 bp, Homo sapiens
caggtgtttattcct

SEQ ID NO: 339517 - DNA, 15 bp, Homo sapiens
aggtgtttattccta

SEQ ID NO: 339518 - DNA, 15 bp, Homo sapiens
ggtgtttattcctat

SEQ ID NO: 339519 - DNA, 15 bp, Homo sapiens
gtgtttattcctatt

SEQ ID NO: 339520 - DNA, 15 bp, Homo sapiens
tgtttattcctattt

SEQ ID NO: 339521 - DNA, 15 bp, Homo sapiens
gtttattcctatttt

SEQ ID NO: 339522 - DNA, 15 bp, Homo sapiens
tttattcctattttc

SEQ ID NO: 339523 - DNA, 15 bp, Homo sapiens
ttattcctattttca

SEQ ID NO: 339524 - DNA, 15 bp, Homo sapiens
tattcctattttcag

SEQ ID NO: 339525 - DNA, 15 bp, Homo sapiens
attcctattttcaga

SEQ ID NO: 339526 - DNA, 15 bp, Homo sapiens
ttcctattttcagag

SEQ ID NO: 339527 - DNA, 15 bp, Homo sapiens
tcctattttcagaga

SEQ ID NO: 339528 - DNA, 15 bp, Homo sapiens
cctattttcagagat

SEQ ID NO: 339529 - DNA, 15 bp, Homo sapiens
ctattttcagagatt

SEQ ID NO: 339530 - DNA, 15 bp, Homo sapiens
tattttcagagatta

SEQ ID NO: 339531 - DNA, 15 bp, Homo sapiens
attttcagagattaa

SEQ ID NO: 339532 - DNA, 15 bp, Homo sapiens
ttttcagagattaaa

SEQ ID NO: 339533 - DNA, 15 bp, Homo sapiens
tttcagagattaaaa

SEQ ID NO: 339534 - DNA, 15 bp, Homo sapiens
ttcagagattaaaaa

SEQ ID NO: 339535 - DNA, 15 bp, Homo sapiens
tcagagattaaaaaa

SEQ ID NO: 339536 - DNA, 15 bp, Homo sapiens
cagagattaaaaaat

SEQ ID NO: 339537 - DNA, 15 bp, Homo sapiens
agagattaaaaaatg

SEQ ID NO: 339538 - DNA, 15 bp, Homo sapiens
gagattaaaaaatgt

SEQ ID NO: 339539 - DNA, 15 bp, Homo sapiens
agattaaaaaatgtg

SEQ ID NO: 339540 - DNA, 15 bp, Homo sapiens
gattaaaaaatgtgg

SEQ ID NO: 339541 - DNA, 15 bp, Homo sapiens
attaaaaaatgtggt

SEQ ID NO: 339542 - DNA, 15 bp, Homo sapiens
ttaaaaaatgtggtc

SEQ ID NO: 339543 - DNA, 15 bp, Homo sapiens
taaaaaatgtggtca

SEQ ID NO: 339544 - DNA, 15 bp, Homo sapiens
aaaaaatgtggtcaa

SEQ ID NO: 339545 - DNA, 15 bp, Homo sapiens
aaaaatgtggtcaat

SEQ ID NO: 339546 - DNA, 15 bp, Homo sapiens
aaaatgtggtcaatg

SEQ ID NO: 339547 - DNA, 15 bp, Homo sapiens
aaatgtggtcaatgt

SEQ ID NO: 339548 - DNA, 15 bp, Homo sapiens
aatgtggtcaatgtc

SEQ ID NO: 339549 - DNA, 15 bp, Homo sapiens
atgtggtcaatgtct

SEQ ID NO: 339550 - DNA, 15 bp, Homo sapiens
tgtggtcaatgtcta

SEQ ID NO: 339551 - DNA, 15 bp, Homo sapiens
gtggtcaatgtctat

SEQ ID NO: 339552 - DNA, 15 bp, Homo sapiens
tggtcaatgtctatt

SEQ ID NO: 339553 - DNA, 15 bp, Homo sapiens
ggtcaatgtctattt

SEQ ID NO: 339554 - DNA, 15 bp, Homo sapiens
gtcaatgtctatttt

SEQ ID NO: 339555 - DNA, 15 bp, Homo sapiens
tcaatgtctatttta

SEQ ID NO: 339556 - DNA, 15 bp, Homo sapiens
caatgtctattttat

SEQ ID NO: 339557 - DNA, 15 bp, Homo sapiens
aatgtctattttatt

SEQ ID NO: 339558 - DNA, 15 bp, Homo sapiens
atgtctattttattt

SEQ ID NO: 339559 - DNA, 15 bp, Homo sapiens
tgtctattttatttg

SEQ ID NO: 339560 - DNA, 15 bp, Homo sapiens
gtctattttatttgc

SEQ ID NO: 339561 - DNA, 15 bp, Homo sapiens
tctattttatttgcg

SEQ ID NO: 339562 - DNA, 15 bp, Homo sapiens
ctattttatttgcgc

SEQ ID NO: 339563 - DNA, 15 bp, Homo sapiens
tattttatttgcgct

SEQ ID NO: 339564 - DNA, 15 bp, Homo sapiens
attttatttgcgctc

SEQ ID NO: 339565 - DNA, 15 bp, Homo sapiens
ttttatttgcgctct

SEQ ID NO: 339566 - DNA, 15 bp, Homo sapiens
tttatttgcgctcta

SEQ ID NO: 339567 - DNA, 15 bp, Homo sapiens
ttatttgcgctctac

SEQ ID NO: 339568 - DNA, 15 bp, Homo sapiens
tatttgcgctctact

SEQ ID NO: 339569 - DNA, 15 bp, Homo sapiens
atttgcgctctacta

SEQ ID NO: 339570 - DNA, 15 bp, Homo sapiens
tttgcgctctactag

SEQ ID NO: 339571 - DNA, 15 bp, Homo sapiens
ttgcgctctactagg

SEQ ID NO: 339572 - DNA, 15 bp, Homo sapiens
tgcgctctactaggc

SEQ ID NO: 339573 - DNA, 15 bp, Homo sapiens
gcgctctactaggct

SEQ ID NO: 339574 - DNA, 15 bp, Homo sapiens
cgctctactaggcta

SEQ ID NO: 339575 - DNA, 15 bp, Homo sapiens
gctctactaggctac

SEQ ID NO: 339576 - DNA, 15 bp, Homo sapiens
ctctactaggctacc

SEQ ID NO: 339577 - DNA, 15 bp, Homo sapiens
tctactaggctacct

SEQ ID NO: 339578 - DNA, 15 bp, Homo sapiens
ctactaggctacctt

SEQ ID NO: 339579 - DNA, 15 bp, Homo sapiens
tactaggctaccttt

SEQ ID NO: 339580 - DNA, 15 bp, Homo sapiens
actaggctacctttt

SEQ ID NO: 339581 - DNA, 15 bp, Homo sapiens
ctaggctaccttttt

SEQ ID NO: 339582 - DNA, 15 bp, Homo sapiens
taggctacctttttc

SEQ ID NO: 339583 - DNA, 15 bp, Homo sapiens
aggctacctttttct

SEQ ID NO: 339584 - DNA, 15 bp, Homo sapiens
ggctacctttttctg

SEQ ID NO: 339585 - DNA, 15 bp, Homo sapiens
gctacctttttctgc

SEQ ID NO: 339586 - DNA, 15 bp, Homo sapiens
ctacctttttctgca

SEQ ID NO: 339587 - DNA, 15 bp, Homo sapiens
tacctttttctgcat

SEQ ID NO: 339588 - DNA, 15 bp, Homo sapiens
acctttttctgcatc

SEQ ID NO: 339589 - DNA, 15 bp, Homo sapiens
cctttttctgcatca

SEQ ID NO: 339590 - DNA, 15 bp, Homo sapiens
ctttttctgcatcac

SEQ ID NO: 339591 - DNA, 15 bp, Homo sapiens
tttttctgcatcact

SEQ ID NO: 339592 - DNA, 15 bp, Homo sapiens
ttttctgcatcactg

SEQ ID NO: 339593 - DNA, 15 bp, Homo sapiens
tttctgcatcactga

SEQ ID NO: 339594 - DNA, 15 bp, Homo sapiens
ttctgcatcactgac

SEQ ID NO: 339595 - DNA, 15 bp, Homo sapiens
tctgcatcactgaca

SEQ ID NO: 339596 - DNA, 15 bp, Homo sapiens
ctgcatcactgacat

SEQ ID NO: 339597 - DNA, 15 bp, Homo sapiens
tgcatcactgacatt

SEQ ID NO: 339598 - DNA, 15 bp, Homo sapiens
gcatcactgacattt

SEQ ID NO: 339599 - DNA, 15 bp, Homo sapiens
catcactgacattta

SEQ ID NO: 339600 - DNA, 15 bp, Homo sapiens
atcactgacatttag

SEQ ID NO: 339601 - DNA, 15 bp, Homo sapiens
tcactgacatttagg

SEQ ID NO: 339602 - DNA, 15 bp, Homo sapiens
cactgacatttaggt

SEQ ID NO: 339603 - DNA, 15 bp, Homo sapiens
actgacatttaggtt

SEQ ID NO: 339604 - DNA, 15 bp, Homo sapiens
ctgacatttaggtta

SEQ ID NO: 339605 - DNA, 15 bp, Homo sapiens
tgacatttaggttag

SEQ ID NO: 339606 - DNA, 15 bp, Homo sapiens
gacatttaggttagg

SEQ ID NO: 339607 - DNA, 15 bp, Homo sapiens
acatttaggttaggc

SEQ ID NO: 339608 - DNA, 15 bp, Homo sapiens
catttaggttaggca

SEQ ID NO: 339609 - DNA, 15 bp, Homo sapiens
atttaggttaggcat

SEQ ID NO: 339610 - DNA, 15 bp, Homo sapiens
tttaggttaggcatt

SEQ ID NO: 339611 - DNA, 15 bp, Homo sapiens
ttaggttaggcatta

SEQ ID NO: 339612 - DNA, 15 bp, Homo sapiens
taggttaggcattag

SEQ ID NO: 339613 - DNA, 15 bp, Homo sapiens
aggttaggcattagc

SEQ ID NO: 339614 - DNA, 15 bp, Homo sapiens
ggttaggcattagca

SEQ ID NO: 339615 - DNA, 15 bp, Homo sapiens
gttaggcattagcaa

SEQ ID NO: 339616 - DNA, 15 bp, Homo sapiens
ttaggcattagcaat

SEQ ID NO: 339617 - DNA, 15 bp, Homo sapiens
taggcattagcaatt

SEQ ID NO: 339618 - DNA, 15 bp, Homo sapiens
aggcattagcaattt

SEQ ID NO: 339619 - DNA, 15 bp, Homo sapiens
ggcattagcaatttg

SEQ ID NO: 339620 - DNA, 15 bp, Homo sapiens
gcattagcaatttgt

SEQ ID NO: 339621 - DNA, 15 bp, Homo sapiens
cattagcaatttgtt

SEQ ID NO: 339622 - DNA, 15 bp, Homo sapiens
attagcaatttgttc

SEQ ID NO: 339623 - DNA, 15 bp, Homo sapiens
ttagcaatttgttca

SEQ ID NO: 339624 - DNA, 15 bp, Homo sapiens
tagcaatttgttcag

SEQ ID NO: 339625 - DNA, 15 bp, Homo sapiens
agcaatttgttcagt

SEQ ID NO: 339626 - DNA, 15 bp, Homo sapiens
gcaatttgttcagtc

SEQ ID NO: 339627 - DNA, 15 bp, Homo sapiens
caatttgttcagtct

SEQ ID NO: 339628 - DNA, 15 bp, Homo sapiens
aatttgttcagtctt

SEQ ID NO: 339629 - DNA, 15 bp, Homo sapiens
atttgttcagtcttc

SEQ ID NO: 339630 - DNA, 15 bp, Homo sapiens
tttgttcagtcttcc

SEQ ID NO: 339631 - DNA, 15 bp, Homo sapiens
ttgttcagtcttcct

SEQ ID NO: 339632 - DNA, 15 bp, Homo sapiens
tgttcagtcttcctt

SEQ ID NO: 339633 - DNA, 15 bp, Homo sapiens
gttcagtcttccttt

SEQ ID NO: 339634 - DNA, 15 bp, Homo sapiens
ttcagtcttcctttt

SEQ ID NO: 339635 - DNA, 15 bp, Homo sapiens
tcagtcttccttttt

SEQ ID NO: 339636 - DNA, 15 bp, Homo sapiens
cagtcttcctttttt

SEQ ID NO: 339637 - DNA, 15 bp, Homo sapiens
agtcttccttttttt

SEQ ID NO: 339638 - DNA, 15 bp, Homo sapiens
gtcttcctttttttt

SEQ ID NO: 339639 - DNA, 15 bp, Homo sapiens
tcttccttttttttt

SEQ ID NO: 339640 - DNA, 15 bp, Homo sapiens
cttcctttttttttt

SEQ ID NO: 339641 - DNA, 15 bp, Homo sapiens
ccttttttttttttg

SEQ ID NO: 339642 - DNA, 15 bp, Homo sapiens
cttttttttttttgc

SEQ ID NO: 339643 - DNA, 15 bp, Homo sapiens
tttttttttttgcac

SEQ ID NO: 339644 - DNA, 15 bp, Homo sapiens
ttttttttttgcact

SEQ ID NO: 339645 - DNA, 15 bp, Homo sapiens
tttttttttgcactg

SEQ ID NO: 339646 - DNA, 15 bp, Homo sapiens
ttttttttgcactga

SEQ ID NO: 339647 - DNA, 15 bp, Homo sapiens
tttttttgcactgag

SEQ ID NO: 339648 - DNA, 15 bp, Homo sapiens
ttttttgcactgagt

SEQ ID NO: 339649 - DNA, 15 bp, Homo sapiens
tttttgcactgagta

SEQ ID NO: 339650 - DNA, 15 bp, Homo sapiens
ttttgcactgagtag

SEQ ID NO: 339651 - DNA, 15 bp, Homo sapiens
tttgcactgagtagc

SEQ ID NO: 339652 - DNA, 15 bp, Homo sapiens
ttgcactgagtagct

SEQ ID NO: 339653 - DNA, 15 bp, Homo sapiens
tgcactgagtagctc

SEQ ID NO: 339654 - DNA, 15 bp, Homo sapiens
gcactgagtagctca

SEQ ID NO: 339655 - DNA, 15 bp, Homo sapiens
cactgagtagctcac

SEQ ID NO: 339656 - DNA, 15 bp, Homo sapiens
actgagtagctcaca

SEQ ID NO: 339657 - DNA, 15 bp, Homo sapiens
ctgagtagctcacaa

SEQ ID NO: 339658 - DNA, 15 bp, Homo sapiens
tgagtagctcacaaa

SEQ ID NO: 339659 - DNA, 15 bp, Homo sapiens
gagtagctcacaaat

SEQ ID NO: 339660 - DNA, 15 bp, Homo sapiens
agtagctcacaaatt

SEQ ID NO: 339661 - DNA, 15 bp, Homo sapiens
gtagctcacaaatta

SEQ ID NO: 339662 - DNA, 15 bp, Homo sapiens
tagctcacaaattat

SEQ ID NO: 339663 - DNA, 15 bp, Homo sapiens
agctcacaaattata

SEQ ID NO: 339664 - DNA, 15 bp, Homo sapiens
gctcacaaattataa

SEQ ID NO: 339665 - DNA, 15 bp, Homo sapiens
ctcacaaattataac

SEQ ID NO: 339666 - DNA, 15 bp, Homo sapiens
tcacaaattataaca

SEQ ID NO: 339667 - DNA, 15 bp, Homo sapiens
cacaaattataacaa

SEQ ID NO: 339668 - DNA, 15 bp, Homo sapiens
acaaattataacaat

SEQ ID NO: 339669 - DNA, 15 bp, Homo sapiens
caaattataacaatg

SEQ ID NO: 339670 - DNA, 15 bp, Homo sapiens
aaattataacaatgt

SEQ ID NO: 339671 - DNA, 15 bp, Homo sapiens
aattataacaatgtc

SEQ ID NO: 339672 - DNA, 15 bp, Homo sapiens
attataacaatgtcc

SEQ ID NO: 339673 - DNA, 15 bp, Homo sapiens
ttataacaatgtccc

SEQ ID NO: 339674 - DNA, 15 bp, Homo sapiens
tataacaatgtccct

SEQ ID NO: 339675 - DNA, 15 bp, Homo sapiens
ataacaatgtccctt

SEQ ID NO: 339676 - DNA, 15 bp, Homo sapiens
taacaatgtcccttt

SEQ ID NO: 339677 - DNA, 15 bp, Homo sapiens
aacaatgtccctttc

SEQ ID NO: 339678 - DNA, 15 bp, Homo sapiens
acaatgtccctttct

SEQ ID NO: 339679 - DNA, 15 bp, Homo sapiens
caatgtccctttcta

SEQ ID NO: 339680 - DNA, 15 bp, Homo sapiens
aatgtccctttctag

SEQ ID NO: 339681 - DNA, 15 bp, Homo sapiens
atgtccctttctagg

SEQ ID NO: 339682 - DNA, 15 bp, Homo sapiens
tgtccctttctaggc

SEQ ID NO: 339683 - DNA, 15 bp, Homo sapiens
gtccctttctaggct

SEQ ID NO: 339684 - DNA, 15 bp, Homo sapiens
tccctttctaggctt

SEQ ID NO: 339685 - DNA, 15 bp, Homo sapiens
ccctttctaggcttt

SEQ ID NO: 339686 - DNA, 15 bp, Homo sapiens
cctttctaggctttt

SEQ ID NO: 339687 - DNA, 15 bp, Homo sapiens
ctttctaggctttta

SEQ ID NO: 339688 - DNA, 15 bp, Homo sapiens
tttctaggcttttat

SEQ ID NO: 339689 - DNA, 15 bp, Homo sapiens
ttctaggcttttatg

SEQ ID NO: 339690 - DNA, 15 bp, Homo sapiens
tctaggcttttatga

SEQ ID NO: 339691 - DNA, 15 bp, Homo sapiens
ctaggcttttatgat

SEQ ID NO: 339692 - DNA, 15 bp, Homo sapiens
taggcttttatgatg

SEQ ID NO: 339693 - DNA, 15 bp, Homo sapiens
aggcttttatgatgg

SEQ ID NO: 339694 - DNA, 15 bp, Homo sapiens
ggcttttatgatgga

SEQ ID NO: 339695 - DNA, 15 bp, Homo sapiens
gcttttatgatggaa

SEQ ID NO: 339696 - DNA, 15 bp, Homo sapiens
cttttatgatggaac

SEQ ID NO: 339697 - DNA, 15 bp, Homo sapiens
ttttatgatggaact

SEQ ID NO: 339698 - DNA, 15 bp, Homo sapiens
tttatgatggaactg

SEQ ID NO: 339699 - DNA, 15 bp, Homo sapiens
ttatgatggaactga

SEQ ID NO: 339700 - DNA, 15 bp, Homo sapiens
tatgatggaactgac

SEQ ID NO: 339701 - DNA, 15 bp, Homo sapiens
atgatggaactgact

SEQ ID NO: 339702 - DNA, 15 bp, Homo sapiens
tgatggaactgactg

SEQ ID NO: 339703 - DNA, 15 bp, Homo sapiens
gatggaactgactgc

SEQ ID NO: 339704 - DNA, 15 bp, Homo sapiens
atggaactgactgca

SEQ ID NO: 339705 - DNA, 15 bp, Homo sapiens
tggaactgactgcac

SEQ ID NO: 339706 - DNA, 15 bp, Homo sapiens
ggaactgactgcaca

SEQ ID NO: 339707 - DNA, 15 bp, Homo sapiens
gaactgactgcacac

SEQ ID NO: 339708 - DNA, 15 bp, Homo sapiens
aactgactgcacacc

SEQ ID NO: 339709 - DNA, 15 bp, Homo sapiens
actgactgcacacca

SEQ ID NO: 339710 - DNA, 15 bp, Homo sapiens
ctgactgcacaccag

SEQ ID NO: 339711 - DNA, 15 bp, Homo sapiens
tgactgcacaccaga

SEQ ID NO: 339712 - DNA, 15 bp, Homo sapiens
gactgcacaccagag

SEQ ID NO: 339713 - DNA, 15 bp, Homo sapiens
actgcacaccagagc

SEQ ID NO: 339714 - DNA, 15 bp, Homo sapiens
ctgcacaccagagca

SEQ ID NO: 339715 - DNA, 15 bp, Homo sapiens
tgcacaccagagcag

SEQ ID NO: 339716 - DNA, 15 bp, Homo sapiens
gcacaccagagcagt

SEQ ID NO: 339717 - DNA, 15 bp, Homo sapiens
cacaccagagcagtg

SEQ ID NO: 339718 - DNA, 15 bp, Homo sapiens
acaccagagcagtgt

SEQ ID NO: 339719 - DNA, 15 bp, Homo sapiens
caccagagcagtgtg

SEQ ID NO: 339720 - DNA, 15 bp, Homo sapiens
accagagcagtgtgg

SEQ ID NO: 339721 - DNA, 15 bp, Homo sapiens
ccagagcagtgtggg

SEQ ID NO: 339722 - DNA, 15 bp, Homo sapiens
cagagcagtgtgggc

SEQ ID NO: 339723 - DNA, 15 bp, Homo sapiens
agagcagtgtgggca

SEQ ID NO: 339724 - DNA, 15 bp, Homo sapiens
gagcagtgtgggcag

SEQ ID NO: 339725 - DNA, 15 bp, Homo sapiens
agcagtgtgggcagc

SEQ ID NO: 339726 - DNA, 15 bp, Homo sapiens
gcagtgtgggcagcg

SEQ ID NO: 339727 - DNA, 15 bp, Homo sapiens
cagtgtgggcagcgt

SEQ ID NO: 339728 - DNA, 15 bp, Homo sapiens
agtgtgggcagcgtc

SEQ ID NO: 339729 - DNA, 15 bp, Homo sapiens
gtgtgggcagcgtcc

SEQ ID NO: 339730 - DNA, 15 bp, Homo sapiens
tgtgggcagcgtcct

SEQ ID NO: 339731 - DNA, 15 bp, Homo sapiens
gtgggcagcgtcctg

SEQ ID NO: 339732 - DNA, 15 bp, Homo sapiens
tgggcagcgtcctgc

SEQ ID NO: 339733 - DNA, 15 bp, Homo sapiens
gggcagcgtcctgca

SEQ ID NO: 339734 - DNA, 15 bp, Homo sapiens
ggcagcgtcctgcag

SEQ ID NO: 339735 - DNA, 15 bp, Homo sapiens
gcagcgtcctgcagg

SEQ ID NO: 339736 - DNA, 15 bp, Homo sapiens
cagcgtcctgcaggc

SEQ ID NO: 339737 - DNA, 15 bp, Homo sapiens
agcgtcctgcaggca

SEQ ID NO: 339738 - DNA, 15 bp, Homo sapiens
gcgtcctgcaggcag

SEQ ID NO: 339739 - DNA, 15 bp, Homo sapiens
cgtcctgcaggcagg

SEQ ID NO: 339740 - DNA, 15 bp, Homo sapiens
gtcctgcaggcaggc

SEQ ID NO: 339741 - DNA, 15 bp, Homo sapiens
tcctgcaggcaggca

SEQ ID NO: 339742 - DNA, 15 bp, Homo sapiens
cctgcaggcaggcaa

SEQ ID NO: 339743 - DNA, 15 bp, Homo sapiens
ctgcaggcaggcaac

SEQ ID NO: 339744 - DNA, 15 bp, Homo sapiens
tgcaggcaggcaacc

SEQ ID NO: 339745 - DNA, 15 bp, Homo sapiens
gcaggcaggcaacca

SEQ ID NO: 339746 - DNA, 15 bp, Homo sapiens
caggcaggcaaccaa

SEQ ID NO: 339747 - DNA, 15 bp, Homo sapiens
aggcaggcaaccaac

SEQ ID NO: 339748 - DNA, 15 bp, Homo sapiens
ggcaggcaaccaact

SEQ ID NO: 339749 - DNA, 15 bp, Homo sapiens
gcaggcaaccaactg

SEQ ID NO: 339750 - DNA, 15 bp, Homo sapiens
caggcaaccaactga

SEQ ID NO: 339751 - DNA, 15 bp, Homo sapiens
aggcaaccaactgat

SEQ ID NO: 339752 - DNA, 15 bp, Homo sapiens
ggcaaccaactgata

SEQ ID NO: 339753 - DNA, 15 bp, Homo sapiens
gcaaccaactgataa

SEQ ID NO: 339754 - DNA, 15 bp, Homo sapiens
caaccaactgataac

SEQ ID NO: 339755 - DNA, 15 bp, Homo sapiens
aaccaactgataaca

SEQ ID NO: 339756 - DNA, 15 bp, Homo sapiens
accaactgataacac

SEQ ID NO: 339757 - DNA, 15 bp, Homo sapiens
ccaactgataacaca

SEQ ID NO: 339758 - DNA, 15 bp, Homo sapiens
caactgataacacaa

SEQ ID NO: 339759 - DNA, 15 bp, Homo sapiens
aactgataacacaag

SEQ ID NO: 339760 - DNA, 15 bp, Homo sapiens
actgataacacaagg

SEQ ID NO: 339761 - DNA, 15 bp, Homo sapiens
ctgataacacaagga

SEQ ID NO: 339762 - DNA, 15 bp, Homo sapiens
tgataacacaaggaa

SEQ ID NO: 339763 - DNA, 15 bp, Homo sapiens
gataacacaaggaac

SEQ ID NO: 339764 - DNA, 15 bp, Homo sapiens
ataacacaaggaact

SEQ ID NO: 339765 - DNA, 15 bp, Homo sapiens
taacacaaggaactc

SEQ ID NO: 339766 - DNA, 15 bp, Homo sapiens
aacacaaggaactct

SEQ ID NO: 339767 - DNA, 15 bp, Homo sapiens
acacaaggaactctg

SEQ ID NO: 339768 - DNA, 15 bp, Homo sapiens
cacaaggaactctgt

SEQ ID NO: 339769 - DNA, 15 bp, Homo sapiens
acaaggaactctgtc

SEQ ID NO: 339770 - DNA, 15 bp, Homo sapiens
caaggaactctgtca

SEQ ID NO: 339771 - DNA, 15 bp, Homo sapiens
aaggaactctgtcag

SEQ ID NO: 339772 - DNA, 15 bp, Homo sapiens
aggaactctgtcaga

SEQ ID NO: 339773 - DNA, 15 bp, Homo sapiens
ggaactctgtcagac

SEQ ID NO: 339774 - DNA, 15 bp, Homo sapiens
gaactctgtcagacg

SEQ ID NO: 339775 - DNA, 15 bp, Homo sapiens
aactctgtcagacga

SEQ ID NO: 339776 - DNA, 15 bp, Homo sapiens
actctgtcagacgaa

SEQ ID NO: 339777 - DNA, 15 bp, Homo sapiens
ctctgtcagacgaag

SEQ ID NO: 339778 - DNA, 15 bp, Homo sapiens
tctgtcagacgaaga

SEQ ID NO: 339779 - DNA, 15 bp, Homo sapiens
ctgtcagacgaagaa

SEQ ID NO: 339780 - DNA, 15 bp, Homo sapiens
tgtcagacgaagaag

SEQ ID NO: 339781 - DNA, 15 bp, Homo sapiens
gtcagacgaagaaga

SEQ ID NO: 339782 - DNA, 15 bp, Homo sapiens
tcagacgaagaagaa

SEQ ID NO: 339783 - DNA, 15 bp, Homo sapiens
cagacgaagaagaat

SEQ ID NO: 339784 - DNA, 15 bp, Homo sapiens
agacgaagaagaatt

SEQ ID NO: 339785 - DNA, 15 bp, Homo sapiens
gacgaagaagaattt

SEQ ID NO: 339786 - DNA, 15 bp, Homo sapiens
acgaagaagaatttg

SEQ ID NO: 339787 - DNA, 15 bp, Homo sapiens
cgaagaagaatttga

SEQ ID NO: 339788 - DNA, 15 bp, Homo sapiens
gaagaagaatttgag

SEQ ID NO: 339789 - DNA, 15 bp, Homo sapiens
aagaagaatttgaga

SEQ ID NO: 339790 - DNA, 15 bp, Homo sapiens
agaagaatttgagat

SEQ ID NO: 339791 - DNA, 15 bp, Homo sapiens
gaagaatttgagatt

SEQ ID NO: 339792 - DNA, 15 bp, Homo sapiens
aagaatttgagattc

SEQ ID NO: 339793 - DNA, 15 bp, Homo sapiens
agaatttgagattca

SEQ ID NO: 339794 - DNA, 15 bp, Homo sapiens
gaatttgagattcag

SEQ ID NO: 339795 - DNA, 15 bp, Homo sapiens
aatttgagattcagg

SEQ ID NO: 339796 - DNA, 15 bp, Homo sapiens
atttgagattcagga

SEQ ID NO: 339797 - DNA, 15 bp, Homo sapiens
tttgagattcaggaa

SEQ ID NO: 339798 - DNA, 15 bp, Homo sapiens
ttgagattcaggaac

SEQ ID NO: 339799 - DNA, 15 bp, Homo sapiens
tgagattcaggaaca

SEQ ID NO: 339800 - DNA, 15 bp, Homo sapiens
gagattcaggaacag

SEQ ID NO: 339801 - DNA, 15 bp, Homo sapiens
agattcaggaacaga

SEQ ID NO: 339802 - DNA, 15 bp, Homo sapiens
gattcaggaacagat

SEQ ID NO: 339803 - DNA, 15 bp, Homo sapiens
attcaggaacagatg

SEQ ID NO: 339804 - DNA, 15 bp, Homo sapiens
ttcaggaacagatga

SEQ ID NO: 339805 - DNA, 15 bp, Homo sapiens
tcaggaacagatgac

SEQ ID NO: 339806 - DNA, 15 bp, Homo sapiens
caggaacagatgacc

SEQ ID NO: 339807 - DNA, 15 bp, Homo sapiens
aggaacagatgaccc

SEQ ID NO: 339808 - DNA, 15 bp, Homo sapiens
ggaacagatgaccct

SEQ ID NO: 339809 - DNA, 15 bp, Homo sapiens
gaacagatgaccctg

SEQ ID NO: 339810 - DNA, 15 bp, Homo sapiens
aacagatgaccctgc

SEQ ID NO: 339811 - DNA, 15 bp, Homo sapiens
acagatgaccctgct

SEQ ID NO: 339812 - DNA, 15 bp, Homo sapiens
cagatgaccctgctg

SEQ ID NO: 339813 - DNA, 15 bp, Homo sapiens
agatgaccctgctga

SEQ ID NO: 339814 - DNA, 15 bp, Homo sapiens
gatgaccctgctgaa

SEQ ID NO: 339815 - DNA, 15 bp, Homo sapiens
atgaccctgctgaat

SEQ ID NO: 339816 - DNA, 15 bp, Homo sapiens
tgaccctgctgaatg

SEQ ID NO: 339817 - DNA, 15 bp, Homo sapiens
gaccctgctgaatgc

SEQ ID NO: 339818 - DNA, 15 bp, Homo sapiens
accctgctgaatgct

SEQ ID NO: 339819 - DNA, 15 bp, Homo sapiens
ccctgctgaatgcta

SEQ ID NO: 339820 - DNA, 15 bp, Homo sapiens
cctgctgaatgctag

SEQ ID NO: 339821 - DNA, 15 bp, Homo sapiens
ctgctgaatgctaga

SEQ ID NO: 339822 - DNA, 15 bp, Homo sapiens
tgctgaatgctagat

SEQ ID NO: 339823 - DNA, 15 bp, Homo sapiens
gctgaatgctagatg

SEQ ID NO: 339824 - DNA, 15 bp, Homo sapiens
ctgaatgctagatgg

SEQ ID NO: 339825 - DNA, 15 bp, Homo sapiens
tgaatgctagatggg

SEQ ID NO: 339826 - DNA, 15 bp, Homo sapiens
gaatgctagatggga

SEQ ID NO: 339827 - DNA, 15 bp, Homo sapiens
aatgctagatgggag

SEQ ID NO: 339828 - DNA, 15 bp, Homo sapiens
atgctagatgggagg

SEQ ID NO: 339829 - DNA, 15 bp, Homo sapiens
tgctagatgggaggc

SEQ ID NO: 339830 - DNA, 15 bp, Homo sapiens
gctagatgggaggct

SEQ ID NO: 339831 - DNA, 15 bp, Homo sapiens
ctagatgggaggctc

SEQ ID NO: 339832 - DNA, 15 bp, Homo sapiens
tagatgggaggctct

SEQ ID NO: 339833 - DNA, 15 bp, Homo sapiens
agatgggaggctctt

SEQ ID NO: 339834 - DNA, 15 bp, Homo sapiens
gatgggaggctctta

SEQ ID NO: 339835 - DNA, 15 bp, Homo sapiens
atgggaggctcttag

SEQ ID NO: 339836 - DNA, 15 bp, Homo sapiens
tgggaggctcttagg

SEQ ID NO: 339837 - DNA, 15 bp, Homo sapiens
gggaggctcttaggg

SEQ ID NO: 339838 - DNA, 15 bp, Homo sapiens
ggaggctcttagggt

SEQ ID NO: 339839 - DNA, 15 bp, Homo sapiens
gaggctcttagggtg

SEQ ID NO: 339840 - DNA, 15 bp, Homo sapiens
aggctcttagggtgg

SEQ ID NO: 339841 - DNA, 15 bp, Homo sapiens
ggctcttagggtgga

SEQ ID NO: 339842 - DNA, 15 bp, Homo sapiens
gctcttagggtggag

SEQ ID NO: 339843 - DNA, 15 bp, Homo sapiens
ctcttagggtggaga

SEQ ID NO: 339844 - DNA, 15 bp, Homo sapiens
tcttagggtggagag

SEQ ID NO: 339845 - DNA, 15 bp, Homo sapiens
cttagggtggagagt

SEQ ID NO: 339846 - DNA, 15 bp, Homo sapiens
ttagggtggagagta

SEQ ID NO: 339847 - DNA, 15 bp, Homo sapiens
tagggtggagagtat

SEQ ID NO: 339848 - DNA, 15 bp, Homo sapiens
agggtggagagtatg

SEQ ID NO: 339849 - DNA, 15 bp, Homo sapiens
gggtggagagtatgg

SEQ ID NO: 339850 - DNA, 15 bp, Homo sapiens
ggtggagagtatgga

SEQ ID NO: 339851 - DNA, 15 bp, Homo sapiens
gtggagagtatggac

SEQ ID NO: 339852 - DNA, 15 bp, Homo sapiens
tggagagtatggaca

SEQ ID NO: 339853 - DNA, 15 bp, Homo sapiens
ggagagtatggacag

SEQ ID NO: 339854 - DNA, 15 bp, Homo sapiens
gagagtatggacaga

SEQ ID NO: 339855 - DNA, 15 bp, Homo sapiens
agagtatggacagac

SEQ ID NO: 339856 - DNA, 15 bp, Homo sapiens
gagtatggacagaca

SEQ ID NO: 339857 - DNA, 15 bp, Homo sapiens
agtatggacagacag

SEQ ID NO: 339858 - DNA, 15 bp, Homo sapiens
gtatggacagacagt

SEQ ID NO: 339859 - DNA, 15 bp, Homo sapiens
tatggacagacagtc

SEQ ID NO: 339860 - DNA, 15 bp, Homo sapiens
atggacagacagtcc

SEQ ID NO: 339861 - DNA, 15 bp, Homo sapiens
tggacagacagtccc

SEQ ID NO: 339862 - DNA, 15 bp, Homo sapiens
ggacagacagtcccg

SEQ ID NO: 339863 - DNA, 15 bp, Homo sapiens
gacagacagtcccgg

SEQ ID NO: 339864 - DNA, 15 bp, Homo sapiens
acagacagtcccggt

SEQ ID NO: 339865 - DNA, 15 bp, Homo sapiens
cagacagtcccggtg

SEQ ID NO: 339866 - DNA, 15 bp, Homo sapiens
agacagtcccggtga

SEQ ID NO: 339867 - DNA, 15 bp, Homo sapiens
gacagtcccggtgag

SEQ ID NO: 339868 - DNA, 15 bp, Homo sapiens
acagtcccggtgagt

SEQ ID NO: 339869 - DNA, 15 bp, Homo sapiens
cagtcccggtgagtg

SEQ ID NO: 339870 - DNA, 15 bp, Homo sapiens
agtcccggtgagtgg

SEQ ID NO: 339871 - DNA, 15 bp, Homo sapiens
gtcccggtgagtgga

SEQ ID NO: 339872 - DNA, 15 bp, Homo sapiens
tcccggtgagtggaa

SEQ ID NO: 339873 - DNA, 15 bp, Homo sapiens
cccggtgagtggaaa

SEQ ID NO: 339874 - DNA, 15 bp, Homo sapiens
ccggtgagtggaaag

SEQ ID NO: 339875 - DNA, 15 bp, Homo sapiens
cggtgagtggaaagc

SEQ ID NO: 339876 - DNA, 15 bp, Homo sapiens
ggtgagtggaaagcc

SEQ ID NO: 339877 - DNA, 15 bp, Homo sapiens
gtgagtggaaagcca

SEQ ID NO: 339878 - DNA, 15 bp, Homo sapiens
tgagtggaaagccaa

SEQ ID NO: 339879 - DNA, 15 bp, Homo sapiens
gagtggaaagccaag

SEQ ID NO: 339880 - DNA, 15 bp, Homo sapiens
agtggaaagccaaga

SEQ ID NO: 339881 - DNA, 15 bp, Homo sapiens
gtggaaagccaagaa

SEQ ID NO: 339882 - DNA, 15 bp, Homo sapiens
tggaaagccaagaaa

SEQ ID NO: 339883 - DNA, 15 bp, Homo sapiens
ggaaagccaagaaat

SEQ ID NO: 339884 - DNA, 15 bp, Homo sapiens
gaaagccaagaaatg

SEQ ID NO: 339885 - DNA, 15 bp, Homo sapiens
aaagccaagaaatgc

SEQ ID NO: 339886 - DNA, 15 bp, Homo sapiens
aagccaagaaatgca

SEQ ID NO: 339887 - DNA, 15 bp, Homo sapiens
agccaagaaatgcac

SEQ ID NO: 339888 - DNA, 15 bp, Homo sapiens
gccaagaaatgcact

SEQ ID NO: 339889 - DNA, 15 bp, Homo sapiens
ccaagaaatgcactt

SEQ ID NO: 339890 - DNA, 15 bp, Homo sapiens
caagaaatgcactta

SEQ ID NO: 339891 - DNA, 15 bp, Homo sapiens
aagaaatgcacttaa

SEQ ID NO: 339892 - DNA, 15 bp, Homo sapiens
agaaatgcacttaat

SEQ ID NO: 339893 - DNA, 15 bp, Homo sapiens
gaaatgcacttaatt

SEQ ID NO: 339894 - DNA, 15 bp, Homo sapiens
aaatgcacttaattc

SEQ ID NO: 339895 - DNA, 15 bp, Homo sapiens
aatgcacttaattcc

SEQ ID NO: 339896 - DNA, 15 bp, Homo sapiens
atgcacttaattcca

SEQ ID NO: 339897 - DNA, 15 bp, Homo sapiens
tgcacttaattccac

SEQ ID NO: 339898 - DNA, 15 bp, Homo sapiens
gcacttaattccaca

SEQ ID NO: 339899 - DNA, 15 bp, Homo sapiens
cacttaattccacag

SEQ ID NO: 339900 - DNA, 15 bp, Homo sapiens
acttaattccacagg

SEQ ID NO: 339901 - DNA, 15 bp, Homo sapiens
cttaattccacaggc

SEQ ID NO: 339902 - DNA, 15 bp, Homo sapiens
ttaattccacaggct

SEQ ID NO: 339903 - DNA, 15 bp, Homo sapiens
taattccacaggctg

SEQ ID NO: 339904 - DNA, 15 bp, Homo sapiens
aattccacaggctgc

SEQ ID NO: 339905 - DNA, 15 bp, Homo sapiens
attccacaggctgct

SEQ ID NO: 339906 - DNA, 15 bp, Homo sapiens
ttccacaggctgctt

SEQ ID NO: 339907 - DNA, 15 bp, Homo sapiens
tccacaggctgcttt

SEQ ID NO: 339908 - DNA, 15 bp, Homo sapiens
ccacaggctgctttg

SEQ ID NO: 339909 - DNA, 15 bp, Homo sapiens
cacaggctgctttgc

SEQ ID NO: 339910 - DNA, 15 bp, Homo sapiens
acaggctgctttgca

SEQ ID NO: 339911 - DNA, 15 bp, Homo sapiens
caggctgctttgcac

SEQ ID NO: 339912 - DNA, 15 bp, Homo sapiens
aggctgctttgcaca

SEQ ID NO: 339913 - DNA, 15 bp, Homo sapiens
ggctgctttgcacag

SEQ ID NO: 339914 - DNA, 15 bp, Homo sapiens
gctgctttgcacagt

SEQ ID NO: 339915 - DNA, 15 bp, Homo sapiens
ctgctttgcacagtt

SEQ ID NO: 339916 - DNA, 15 bp, Homo sapiens
tgctttgcacagttg

SEQ ID NO: 339917 - DNA, 15 bp, Homo sapiens
gctttgcacagttga

SEQ ID NO: 339918 - DNA, 15 bp, Homo sapiens
ctttgcacagttgag

SEQ ID NO: 339919 - DNA, 15 bp, Homo sapiens
tttgcacagttgagc

SEQ ID NO: 339920 - DNA, 15 bp, Homo sapiens
ttgcacagttgagct

SEQ ID NO: 339921 - DNA, 15 bp, Homo sapiens
tgcacagttgagctc

SEQ ID NO: 339922 - DNA, 15 bp, Homo sapiens
gcacagttgagctct

SEQ ID NO: 339923 - DNA, 15 bp, Homo sapiens
cacagttgagctcta

SEQ ID NO: 339924 - DNA, 15 bp, Homo sapiens
acagttgagctctag

SEQ ID NO: 339925 - DNA, 15 bp, Homo sapiens
cagttgagctctagt

SEQ ID NO: 339926 - DNA, 15 bp, Homo sapiens
agttgagctctagta

SEQ ID NO: 339927 - DNA, 15 bp, Homo sapiens
gttgagctctagtag

SEQ ID NO: 339928 - DNA, 15 bp, Homo sapiens
ttgagctctagtaga

SEQ ID NO: 339929 - DNA, 15 bp, Homo sapiens
tgagctctagtagat

SEQ ID NO: 339930 - DNA, 15 bp, Homo sapiens
gagctctagtagatg

SEQ ID NO: 339931 - DNA, 15 bp, Homo sapiens
agctctagtagatgt

SEQ ID NO: 339932 - DNA, 15 bp, Homo sapiens
gctctagtagatgtc

SEQ ID NO: 339933 - DNA, 15 bp, Homo sapiens
ctctagtagatgtct

SEQ ID NO: 339934 - DNA, 15 bp, Homo sapiens
tctagtagatgtctg

SEQ ID NO: 339935 - DNA, 15 bp, Homo sapiens
ctagtagatgtctgc

SEQ ID NO: 339936 - DNA, 15 bp, Homo sapiens
tagtagatgtctgca

SEQ ID NO: 339937 - DNA, 15 bp, Homo sapiens
agtagatgtctgcat

SEQ ID NO: 339938 - DNA, 15 bp, Homo sapiens
gtagatgtctgcatg

SEQ ID NO: 339939 - DNA, 15 bp, Homo sapiens
tagatgtctgcatgt

SEQ ID NO: 339940 - DNA, 15 bp, Homo sapiens
agatgtctgcatgtc

SEQ ID NO: 339941 - DNA, 15 bp, Homo sapiens
gatgtctgcatgtct

SEQ ID NO: 339942 - DNA, 15 bp, Homo sapiens
atgtctgcatgtctg

SEQ ID NO: 339943 - DNA, 15 bp, Homo sapiens
tgtctgcatgtctgt

SEQ ID NO: 339944 - DNA, 15 bp, Homo sapiens
gtctgcatgtctgtg

SEQ ID NO: 339945 - DNA, 15 bp, Homo sapiens
tctgcatgtctgtga

SEQ ID NO: 339946 - DNA, 15 bp, Homo sapiens
ctgcatgtctgtgaa

SEQ ID NO: 339947 - DNA, 15 bp, Homo sapiens
tgcatgtctgtgaaa

SEQ ID NO: 339948 - DNA, 15 bp, Homo sapiens
gcatgtctgtgaaag

SEQ ID NO: 339949 - DNA, 15 bp, Homo sapiens
catgtctgtgaaagc

SEQ ID NO: 339950 - DNA, 15 bp, Homo sapiens
atgtctgtgaaagcg

SEQ ID NO: 339951 - DNA, 15 bp, Homo sapiens
tgtctgtgaaagcga

SEQ ID NO: 339952 - DNA, 15 bp, Homo sapiens
gtctgtgaaagcgag

SEQ ID NO: 339953 - DNA, 15 bp, Homo sapiens
tctgtgaaagcgaga

SEQ ID NO: 339954 - DNA, 15 bp, Homo sapiens
ctgtgaaagcgagat

SEQ ID NO: 339955 - DNA, 15 bp, Homo sapiens
tgtgaaagcgagatg

SEQ ID NO: 339956 - DNA, 15 bp, Homo sapiens
gtgaaagcgagatga

SEQ ID NO: 339957 - DNA, 15 bp, Homo sapiens
tgaaagcgagatgat

SEQ ID NO: 339958 - DNA, 15 bp, Homo sapiens
gaaagcgagatgatt

SEQ ID NO: 339959 - DNA, 15 bp, Homo sapiens
aaagcgagatgatta

SEQ ID NO: 339960 - DNA, 15 bp, Homo sapiens
aagcgagatgattac

SEQ ID NO: 339961 - DNA, 15 bp, Homo sapiens
agcgagatgattaca

SEQ ID NO: 339962 - DNA, 15 bp, Homo sapiens
gcgagatgattacag

SEQ ID NO: 339963 - DNA, 15 bp, Homo sapiens
cgagatgattacaga

SEQ ID NO: 339964 - DNA, 15 bp, Homo sapiens
gagatgattacagaa

SEQ ID NO: 339965 - DNA, 15 bp, Homo sapiens
agatgattacagaac

SEQ ID NO: 339966 - DNA, 15 bp, Homo sapiens
gatgattacagaact

SEQ ID NO: 339967 - DNA, 15 bp, Homo sapiens
atgattacagaactt

SEQ ID NO: 339968 - DNA, 15 bp, Homo sapiens
tgattacagaacttg

SEQ ID NO: 339969 - DNA, 15 bp, Homo sapiens
gattacagaacttgc

SEQ ID NO: 339970 - DNA, 15 bp, Homo sapiens
attacagaacttgcc

SEQ ID NO: 339971 - DNA, 15 bp, Homo sapiens
ttacagaacttgcct

SEQ ID NO: 339972 - DNA, 15 bp, Homo sapiens
tacagaacttgcctt

SEQ ID NO: 339973 - DNA, 15 bp, Homo sapiens
acagaacttgccttg

SEQ ID NO: 339974 - DNA, 15 bp, Homo sapiens
cagaacttgccttgg

SEQ ID NO: 339975 - DNA, 15 bp, Homo sapiens
agaacttgccttgga

SEQ ID NO: 339976 - DNA, 15 bp, Homo sapiens
gaacttgccttggaa

SEQ ID NO: 339977 - DNA, 15 bp, Homo sapiens
aacttgccttggaaa

SEQ ID NO: 339978 - DNA, 15 bp, Homo sapiens
acttgccttggaaaa

SEQ ID NO: 339979 - DNA, 15 bp, Homo sapiens
cttgccttggaaaag

SEQ ID NO: 339980 - DNA, 15 bp, Homo sapiens
ttgccttggaaaagt

SEQ ID NO: 339981 - DNA, 15 bp, Homo sapiens
tgccttggaaaagta

SEQ ID NO: 339982 - DNA, 15 bp, Homo sapiens
gccttggaaaagtaa

SEQ ID NO: 339983 - DNA, 15 bp, Homo sapiens
ccttggaaaagtaag

SEQ ID NO: 339984 - DNA, 15 bp, Homo sapiens
cttggaaaagtaaga

SEQ ID NO: 339985 - DNA, 15 bp, Homo sapiens
ttggaaaagtaagac

SEQ ID NO: 339986 - DNA, 15 bp, Homo sapiens
tggaaaagtaagact

SEQ ID NO: 339987 - DNA, 15 bp, Homo sapiens
ggaaaagtaagactc

SEQ ID NO: 339988 - DNA, 15 bp, Homo sapiens
gaaaagtaagactct

SEQ ID NO: 339989 - DNA, 15 bp, Homo sapiens
aaaagtaagactctt

SEQ ID NO: 339990 - DNA, 15 bp, Homo sapiens
aaagtaagactcttt

SEQ ID NO: 339991 - DNA, 15 bp, Homo sapiens
aagtaagactctttt

SEQ ID NO: 339992 - DNA, 15 bp, Homo sapiens
agtaagactcttttc

SEQ ID NO: 339993 - DNA, 15 bp, Homo sapiens
gtaagactcttttct

SEQ ID NO: 339994 - DNA, 15 bp, Homo sapiens
taagactcttttcta

SEQ ID NO: 339995 - DNA, 15 bp, Homo sapiens
aagactcttttctac

SEQ ID NO: 339996 - DNA, 15 bp, Homo sapiens
agactcttttctacg

SEQ ID NO: 339997 - DNA, 15 bp, Homo sapiens
gactcttttctacgg

SEQ ID NO: 339998 - DNA, 15 bp, Homo sapiens
actcttttctacggg

SEQ ID NO: 339999 - DNA, 15 bp, Homo sapiens
ctcttttctacgggt

SEQ ID NO: 340000 - DNA, 15 bp, Homo sapiens
tcttttctacgggta

SEQ ID NO: 340001 - DNA, 15 bp, Homo sapiens
cttttctacgggtaa

SEQ ID NO: 340002 - DNA, 15 bp, Homo sapiens
ttttctacgggtaat

SEQ ID NO: 340003 - DNA, 15 bp, Homo sapiens
tttctacgggtaata

SEQ ID NO: 340004 - DNA, 15 bp, Homo sapiens
ttctacgggtaatat

SEQ ID NO: 340005 - DNA, 15 bp, Homo sapiens
tctacgggtaatatt

SEQ ID NO: 340006 - DNA, 15 bp, Homo sapiens
ctacgggtaatattg

SEQ ID NO: 340007 - DNA, 15 bp, Homo sapiens
tacgggtaatattgc

SEQ ID NO: 340008 - DNA, 15 bp, Homo sapiens
acgggtaatattgct

SEQ ID NO: 340009 - DNA, 15 bp, Homo sapiens
cgggtaatattgctg

SEQ ID NO: 340010 - DNA, 15 bp, Homo sapiens
gggtaatattgctgg

SEQ ID NO: 340011 - DNA, 15 bp, Homo sapiens
ggtaatattgctgga

SEQ ID NO: 340012 - DNA, 15 bp, Homo sapiens
gtaatattgctggaa

SEQ ID NO: 340013 - DNA, 15 bp, Homo sapiens
taatattgctggaat

SEQ ID NO: 340014 - DNA, 15 bp, Homo sapiens
aatattgctggaatt

SEQ ID NO: 340015 - DNA, 15 bp, Homo sapiens
atattgctggaattc

SEQ ID NO: 340016 - DNA, 15 bp, Homo sapiens
tattgctggaattct

SEQ ID NO: 340017 - DNA, 15 bp, Homo sapiens
attgctggaattctg

SEQ ID NO: 340018 - DNA, 15 bp, Homo sapiens
ttgctggaattctgc

SEQ ID NO: 340019 - DNA, 15 bp, Homo sapiens
tgctggaattctgca

SEQ ID NO: 340020 - DNA, 15 bp, Homo sapiens
gctggaattctgcat

SEQ ID NO: 340021 - DNA, 15 bp, Homo sapiens
ctggaattctgcatg

SEQ ID NO: 340022 - DNA, 15 bp, Homo sapiens
tggaattctgcatga

SEQ ID NO: 340023 - DNA, 15 bp, Homo sapiens
ggaattctgcatgat

SEQ ID NO: 340024 - DNA, 15 bp, Homo sapiens
gaattctgcatgatc

SEQ ID NO: 340025 - DNA, 15 bp, Homo sapiens
aattctgcatgatct

SEQ ID NO: 340026 - DNA, 15 bp, Homo sapiens
attctgcatgatctt

SEQ ID NO: 340027 - DNA, 15 bp, Homo sapiens
ttctgcatgatcttt

SEQ ID NO: 340028 - DNA, 15 bp, Homo sapiens
tctgcatgatctttg

SEQ ID NO: 340029 - DNA, 15 bp, Homo sapiens
ctgcatgatctttgt

SEQ ID NO: 340030 - DNA, 15 bp, Homo sapiens
tgcatgatctttgtt

SEQ ID NO: 340031 - DNA, 15 bp, Homo sapiens
gcatgatctttgttt

SEQ ID NO: 340032 - DNA, 15 bp, Homo sapiens
catgatctttgtttc

SEQ ID NO: 340033 - DNA, 15 bp, Homo sapiens
atgatctttgtttcc

SEQ ID NO: 340034 - DNA, 15 bp, Homo sapiens
tgatctttgtttccc

SEQ ID NO: 340035 - DNA, 15 bp, Homo sapiens
gatctttgtttcccc

SEQ ID NO: 340036 - DNA, 15 bp, Homo sapiens
atctttgtttcccct

SEQ ID NO: 340037 - DNA, 15 bp, Homo sapiens
tctttgtttcccctt

SEQ ID NO: 340038 - DNA, 15 bp, Homo sapiens
ctttgtttccccttt

SEQ ID NO: 340039 - DNA, 15 bp, Homo sapiens
tttgtttcccctttg

SEQ ID NO: 340040 - DNA, 15 bp, Homo sapiens
ttgtttcccctttga

SEQ ID NO: 340041 - DNA, 15 bp, Homo sapiens
tgtttcccctttgat

SEQ ID NO: 340042 - DNA, 15 bp, Homo sapiens
gtttcccctttgatg

SEQ ID NO: 340043 - DNA, 15 bp, Homo sapiens
tttcccctttgatgt

SEQ ID NO: 340044 - DNA, 15 bp, Homo sapiens
ttcccctttgatgtg

SEQ ID NO: 340045 - DNA, 15 bp, Homo sapiens
tcccctttgatgtgt

SEQ ID NO: 340046 - DNA, 15 bp, Homo sapiens
cccctttgatgtgtt

SEQ ID NO: 340047 - DNA, 15 bp, Homo sapiens
ccctttgatgtgtta

SEQ ID NO: 340048 - DNA, 15 bp, Homo sapiens
cctttgatgtgttag

SEQ ID NO: 340049 - DNA, 15 bp, Homo sapiens
ctttgatgtgttagc

SEQ ID NO: 340050 - DNA, 15 bp, Homo sapiens
tttgatgtgttagcc

SEQ ID NO: 340051 - DNA, 15 bp, Homo sapiens
ttgatgtgttagcca

SEQ ID NO: 340052 - DNA, 15 bp, Homo sapiens
tgatgtgttagccac

SEQ ID NO: 340053 - DNA, 15 bp, Homo sapiens
gatgtgttagccaca

SEQ ID NO: 340054 - DNA, 15 bp, Homo sapiens
atgtgttagccacac

SEQ ID NO: 340055 - DNA, 15 bp, Homo sapiens
tgtgttagccacacc

SEQ ID NO: 340056 - DNA, 15 bp, Homo sapiens
gtgttagccacacca

SEQ ID NO: 340057 - DNA, 15 bp, Homo sapiens
tgttagccacaccaa

SEQ ID NO: 340058 - DNA, 15 bp, Homo sapiens
gttagccacaccaaa

SEQ ID NO: 340059 - DNA, 15 bp, Homo sapiens
ttagccacaccaaaa

SEQ ID NO: 340060 - DNA, 15 bp, Homo sapiens
tagccacaccaaaag

SEQ ID NO: 340061 - DNA, 15 bp, Homo sapiens
agccacaccaaaaga

SEQ ID NO: 340062 - DNA, 15 bp, Homo sapiens
gccacaccaaaagat

SEQ ID NO: 340063 - DNA, 15 bp, Homo sapiens
ccacaccaaaagata

SEQ ID NO: 340064 - DNA, 15 bp, Homo sapiens
cacaccaaaagataa

SEQ ID NO: 340065 - DNA, 15 bp, Homo sapiens
acaccaaaagataaa

SEQ ID NO: 340066 - DNA, 15 bp, Homo sapiens
caccaaaagataaaa

SEQ ID NO: 340067 - DNA, 15 bp, Homo sapiens
accaaaagataaaag

SEQ ID NO: 340068 - DNA, 15 bp, Homo sapiens
ccaaaagataaaagt

SEQ ID NO: 340069 - DNA, 15 bp, Homo sapiens
caaaagataaaagtt

SEQ ID NO: 340070 - DNA, 15 bp, Homo sapiens
aaaagataaaagttg

SEQ ID NO: 340071 - DNA, 15 bp, Homo sapiens
aaagataaaagttgg

SEQ ID NO: 340072 - DNA, 15 bp, Homo sapiens
aagataaaagttgga

SEQ ID NO: 340073 - DNA, 15 bp, Homo sapiens
agataaaagttggaa

SEQ ID NO: 340074 - DNA, 15 bp, Homo sapiens
gataaaagttggaat

SEQ ID NO: 340075 - DNA, 15 bp, Homo sapiens
ataaaagttggaata

SEQ ID NO: 340076 - DNA, 15 bp, Homo sapiens
taaaagttggaatac

SEQ ID NO: 340077 - DNA, 15 bp, Homo sapiens
aaaagttggaataca

SEQ ID NO: 340078 - DNA, 15 bp, Homo sapiens
aaagttggaatacag

SEQ ID NO: 340079 - DNA, 15 bp, Homo sapiens
aagttggaatacaga

SEQ ID NO: 340080 - DNA, 15 bp, Homo sapiens
agttggaatacagaa

SEQ ID NO: 340081 - DNA, 15 bp, Homo sapiens
gttggaatacagaat

SEQ ID NO: 340082 - DNA, 15 bp, Homo sapiens
ttggaatacagaatt

SEQ ID NO: 340083 - DNA, 15 bp, Homo sapiens
tggaatacagaattt

SEQ ID NO: 340084 - DNA, 15 bp, Homo sapiens
ggaatacagaattta

SEQ ID NO: 340085 - DNA, 15 bp, Homo sapiens
gaatacagaatttaa

SEQ ID NO: 340086 - DNA, 15 bp, Homo sapiens
aatacagaatttaac

SEQ ID NO: 340087 - DNA, 15 bp, Homo sapiens
atacagaatttaaca

SEQ ID NO: 340088 - DNA, 15 bp, Homo sapiens
tacagaatttaacaa

SEQ ID NO: 340089 - DNA, 15 bp, Homo sapiens
acagaatttaacaaa

SEQ ID NO: 340090 - DNA, 15 bp, Homo sapiens
cagaatttaacaaaa

SEQ ID NO: 340091 - DNA, 15 bp, Homo sapiens
agaatttaacaaaaa

SEQ ID NO: 340092 - DNA, 15 bp, Homo sapiens
gaatttaacaaaaag

SEQ ID NO: 340093 - DNA, 15 bp, Homo sapiens
aatttaacaaaaagg

SEQ ID NO: 340094 - DNA, 15 bp, Homo sapiens
atttaacaaaaagga

SEQ ID NO: 340095 - DNA, 15 bp, Homo sapiens
tttaacaaaaaggaa

SEQ ID NO: 340096 - DNA, 15 bp, Homo sapiens
ttaacaaaaaggaaa

SEQ ID NO: 340097 - DNA, 15 bp, Homo sapiens
taacaaaaaggaaaa

SEQ ID NO: 340098 - DNA, 15 bp, Homo sapiens
aacaaaaaggaaaaa

SEQ ID NO: 340099 - DNA, 15 bp, Homo sapiens
acaaaaaggaaaaag

SEQ ID NO: 340100 - DNA, 15 bp, Homo sapiens
caaaaaggaaaaaga

SEQ ID NO: 340101 - DNA, 15 bp, Homo sapiens
aaaaaggaaaaagag

SEQ ID NO: 340102 - DNA, 15 bp, Homo sapiens
aaaaggaaaaagagg

SEQ ID NO: 340103 - DNA, 15 bp, Homo sapiens
aaaggaaaaagagga

SEQ ID NO: 340104 - DNA, 15 bp, Homo sapiens
aaggaaaaagaggat

SEQ ID NO: 340105 - DNA, 15 bp, Homo sapiens
aggaaaaagaggata

SEQ ID NO: 340106 - DNA, 15 bp, Homo sapiens
ggaaaaagaggatag

SEQ ID NO: 340107 - DNA, 15 bp, Homo sapiens
gaaaaagaggatagg

SEQ ID NO: 340108 - DNA, 15 bp, Homo sapiens
aaaaagaggataggc

SEQ ID NO: 340109 - DNA, 15 bp, Homo sapiens
aaaagaggataggca

SEQ ID NO: 340110 - DNA, 15 bp, Homo sapiens
aaagaggataggcat

SEQ ID NO: 340111 - DNA, 15 bp, Homo sapiens
aagaggataggcatg

SEQ ID NO: 340112 - DNA, 15 bp, Homo sapiens
agaggataggcatgg

SEQ ID NO: 340113 - DNA, 15 bp, Homo sapiens
gaggataggcatggt

SEQ ID NO: 340114 - DNA, 15 bp, Homo sapiens
aggataggcatggtg

SEQ ID NO: 340115 - DNA, 15 bp, Homo sapiens
ggataggcatggtgg

SEQ ID NO: 340116 - DNA, 15 bp, Homo sapiens
gataggcatggtggc

SEQ ID NO: 340117 - DNA, 15 bp, Homo sapiens
ataggcatggtggct

SEQ ID NO: 340118 - DNA, 15 bp, Homo sapiens
taggcatggtggctc

SEQ ID NO: 340119 - DNA, 15 bp, Homo sapiens
taatcccagcacttg

SEQ ID NO: 340120 - DNA, 15 bp, Homo sapiens
aatcccagcacttgg

SEQ ID NO: 340121 - DNA, 15 bp, Homo sapiens
atcccagcacttggg

SEQ ID NO: 340122 - DNA, 15 bp, Homo sapiens
tcccagcacttggga

SEQ ID NO: 340123 - DNA, 15 bp, Homo sapiens
cccagcacttgggag

SEQ ID NO: 340124 - DNA, 15 bp, Homo sapiens
ccagcacttgggagg

SEQ ID NO: 340125 - DNA, 15 bp, Homo sapiens
cagcacttgggaggc

SEQ ID NO: 340126 - DNA, 15 bp, Homo sapiens
agcacttgggaggcc

SEQ ID NO: 340127 - DNA, 15 bp, Homo sapiens
gcacttgggaggcca

SEQ ID NO: 340128 - DNA, 15 bp, Homo sapiens
acttgggaggccaac

SEQ ID NO: 340129 - DNA, 15 bp, Homo sapiens
cttgggaggccaacg

SEQ ID NO: 340130 - DNA, 15 bp, Homo sapiens
ttgggaggccaacgc

SEQ ID NO: 340131 - DNA, 15 bp, Homo sapiens
tgggaggccaacgcg

SEQ ID NO: 340132 - DNA, 15 bp, Homo sapiens
gggaggccaacgcgg

SEQ ID NO: 340133 - DNA, 15 bp, Homo sapiens
ggaggccaacgcgga

SEQ ID NO: 340134 - DNA, 15 bp, Homo sapiens
gaggccaacgcggat

SEQ ID NO: 340135 - DNA, 15 bp, Homo sapiens
aggccaacgcggatg

SEQ ID NO: 340136 - DNA, 15 bp, Homo sapiens
ggccaacgcggatgg

SEQ ID NO: 340137 - DNA, 15 bp, Homo sapiens
gccaacgcggatgga

SEQ ID NO: 340138 - DNA, 15 bp, Homo sapiens
ccaacgcggatggat

SEQ ID NO: 340139 - DNA, 15 bp, Homo sapiens
caacgcggatggatc

SEQ ID NO: 340140 - DNA, 15 bp, Homo sapiens
aacgcggatggatca

SEQ ID NO: 340141 - DNA, 15 bp, Homo sapiens
acgcggatggatcac

SEQ ID NO: 340142 - DNA, 15 bp, Homo sapiens
cgcggatggatcact

SEQ ID NO: 340143 - DNA, 15 bp, Homo sapiens
gcggatggatcactt

SEQ ID NO: 340144 - DNA, 15 bp, Homo sapiens
cggatggatcacttg

SEQ ID NO: 340145 - DNA, 15 bp, Homo sapiens
ggatggatcacttga

SEQ ID NO: 340146 - DNA, 15 bp, Homo sapiens
gatggatcacttgag

SEQ ID NO: 340147 - DNA, 15 bp, Homo sapiens
atggatcacttgagg

SEQ ID NO: 340148 - DNA, 15 bp, Homo sapiens
gccaggagtttgaga

SEQ ID NO: 340149 - DNA, 15 bp, Homo sapiens
agaccagcctgggcg

SEQ ID NO: 340150 - DNA, 15 bp, Homo sapiens
gaccagcctgggcga

SEQ ID NO: 340151 - DNA, 15 bp, Homo sapiens
accagcctgggcgac

SEQ ID NO: 340152 - DNA, 15 bp, Homo sapiens
agcctgggcgacatg

SEQ ID NO: 340153 - DNA, 15 bp, Homo sapiens
gcctgggcgacatgg

SEQ ID NO: 340154 - DNA, 15 bp, Homo sapiens
cctgggcgacatggc

SEQ ID NO: 340155 - DNA, 15 bp, Homo sapiens
ctgggcgacatggcg

SEQ ID NO: 340156 - DNA, 15 bp, Homo sapiens
tgggcgacatggcga

SEQ ID NO: 340157 - DNA, 15 bp, Homo sapiens
gggcgacatggcgaa

SEQ ID NO: 340158 - DNA, 15 bp, Homo sapiens
ggcgacatggcgaaa

SEQ ID NO: 340159 - DNA, 15 bp, Homo sapiens
gcgacatggcgaaac

SEQ ID NO: 340160 - DNA, 15 bp, Homo sapiens
cgacatggcgaaact

SEQ ID NO: 340161 - DNA, 15 bp, Homo sapiens
gacatggcgaaactc

SEQ ID NO: 340162 - DNA, 15 bp, Homo sapiens
acatggcgaaactcc

SEQ ID NO: 340163 - DNA, 15 bp, Homo sapiens
catggcgaaactccg

SEQ ID NO: 340164 - DNA, 15 bp, Homo sapiens
atggcgaaactccgt

SEQ ID NO: 340165 - DNA, 15 bp, Homo sapiens
tggcgaaactccgtc

SEQ ID NO: 340166 - DNA, 15 bp, Homo sapiens
cgaaactccgtctct

SEQ ID NO: 340167 - DNA, 15 bp, Homo sapiens
gaaactccgtctcta

SEQ ID NO: 340168 - DNA, 15 bp, Homo sapiens
aaactccgtctctac

SEQ ID NO: 340169 - DNA, 15 bp, Homo sapiens
aactccgtctctact

SEQ ID NO: 340170 - DNA, 15 bp, Homo sapiens
actccgtctctacta

SEQ ID NO: 340171 - DNA, 15 bp, Homo sapiens
ctccgtctctactaa

SEQ ID NO: 340172 - DNA, 15 bp, Homo sapiens
tccgtctctactaaa

SEQ ID NO: 340173 - DNA, 15 bp, Homo sapiens
gctgggcatggtggg

SEQ ID NO: 340174 - DNA, 15 bp, Homo sapiens
ctgggcatggtgggc

SEQ ID NO: 340175 - DNA, 15 bp, Homo sapiens
tgggcatggtgggcc

SEQ ID NO: 340176 - DNA, 15 bp, Homo sapiens
gggcatggtgggcca

SEQ ID NO: 340177 - DNA, 15 bp, Homo sapiens
ggcatggtgggccat

SEQ ID NO: 340178 - DNA, 15 bp, Homo sapiens
gcatggtgggccatg

SEQ ID NO: 340179 - DNA, 15 bp, Homo sapiens
catggtgggccatgc

SEQ ID NO: 340180 - DNA, 15 bp, Homo sapiens
atggtgggccatgcc

SEQ ID NO: 340181 - DNA, 15 bp, Homo sapiens
tggtgggccatgcct

SEQ ID NO: 340182 - DNA, 15 bp, Homo sapiens
ggtgggccatgcctg

SEQ ID NO: 340183 - DNA, 15 bp, Homo sapiens
gtgggccatgcctgt

SEQ ID NO: 340184 - DNA, 15 bp, Homo sapiens
tgggccatgcctgta

SEQ ID NO: 340185 - DNA, 15 bp, Homo sapiens
gggccatgcctgtaa

SEQ ID NO: 340186 - DNA, 15 bp, Homo sapiens
ggccatgcctgtaat

SEQ ID NO: 340187 - DNA, 15 bp, Homo sapiens
gccatgcctgtaatc

SEQ ID NO: 340188 - DNA, 15 bp, Homo sapiens
catgcctgtaatcct

SEQ ID NO: 340189 - DNA, 15 bp, Homo sapiens
atgcctgtaatccta

SEQ ID NO: 340190 - DNA, 15 bp, Homo sapiens
tgcctgtaatcctag

SEQ ID NO: 340191 - DNA, 15 bp, Homo sapiens
cctgtaatcctagct

SEQ ID NO: 340192 - DNA, 15 bp, Homo sapiens
ctgtaatcctagcta

SEQ ID NO: 340193 - DNA, 15 bp, Homo sapiens
tgtaatcctagctac

SEQ ID NO: 340194 - DNA, 15 bp, Homo sapiens
gtaatcctagctact

SEQ ID NO: 340195 - DNA, 15 bp, Homo sapiens
ttgggaggttgaggt

SEQ ID NO: 340196 - DNA, 15 bp, Homo sapiens
tgggaggttgaggta

SEQ ID NO: 340197 - DNA, 15 bp, Homo sapiens
gggaggttgaggtat

SEQ ID NO: 340198 - DNA, 15 bp, Homo sapiens
ggaggttgaggtatg

SEQ ID NO: 340199 - DNA, 15 bp, Homo sapiens
gaggttgaggtatga

SEQ ID NO: 340200 - DNA, 15 bp, Homo sapiens
aggttgaggtatgag

SEQ ID NO: 340201 - DNA, 15 bp, Homo sapiens
ggttgaggtatgagg

SEQ ID NO: 340202 - DNA, 15 bp, Homo sapiens
gttgaggtatgagga

SEQ ID NO: 340203 - DNA, 15 bp, Homo sapiens
ttgaggtatgaggat

SEQ ID NO: 340204 - DNA, 15 bp, Homo sapiens
tgaggtatgaggatc

SEQ ID NO: 340205 - DNA, 15 bp, Homo sapiens
gaggtatgaggatcg

SEQ ID NO: 340206 - DNA, 15 bp, Homo sapiens
aggtatgaggatcgc

SEQ ID NO: 340207 - DNA, 15 bp, Homo sapiens
ggtatgaggatcgct

SEQ ID NO: 340208 - DNA, 15 bp, Homo sapiens
gtatgaggatcgctt

SEQ ID NO: 340209 - DNA, 15 bp, Homo sapiens
tatgaggatcgcttg

SEQ ID NO: 340210 - DNA, 15 bp, Homo sapiens
atgaggatcgcttga

SEQ ID NO: 340211 - DNA, 15 bp, Homo sapiens
tgaggatcgcttgaa

SEQ ID NO: 340212 - DNA, 15 bp, Homo sapiens
gaggatcgcttgaac

SEQ ID NO: 340213 - DNA, 15 bp, Homo sapiens
aggatcgcttgaact

SEQ ID NO: 340214 - DNA, 15 bp, Homo sapiens
ggatcgcttgaactc

SEQ ID NO: 340215 - DNA, 15 bp, Homo sapiens
gatcgcttgaactca

SEQ ID NO: 340216 - DNA, 15 bp, Homo sapiens
atcgcttgaactcag

SEQ ID NO: 340217 - DNA, 15 bp, Homo sapiens
tcgcttgaactcagg

SEQ ID NO: 340218 - DNA, 15 bp, Homo sapiens
cgcttgaactcagga

SEQ ID NO: 340219 - DNA, 15 bp, Homo sapiens
cttgaactcaggaga

SEQ ID NO: 340220 - DNA, 15 bp, Homo sapiens
ttgaactcaggagac

SEQ ID NO: 340221 - DNA, 15 bp, Homo sapiens
tgaactcaggagaca

SEQ ID NO: 340222 - DNA, 15 bp, Homo sapiens
gaactcaggagacag

SEQ ID NO: 340223 - DNA, 15 bp, Homo sapiens
aactcaggagacaga

SEQ ID NO: 340224 - DNA, 15 bp, Homo sapiens
actcaggagacagag

SEQ ID NO: 340225 - DNA, 15 bp, Homo sapiens
ctcaggagacagaga

SEQ ID NO: 340226 - DNA, 15 bp, Homo sapiens
tcaggagacagagat

SEQ ID NO: 340227 - DNA, 15 bp, Homo sapiens
caggagacagagatt

SEQ ID NO: 340228 - DNA, 15 bp, Homo sapiens
aggagacagagattg

SEQ ID NO: 340229 - DNA, 15 bp, Homo sapiens
ggagacagagattgc

SEQ ID NO: 340230 - DNA, 15 bp, Homo sapiens
gagacagagattgca

SEQ ID NO: 340231 - DNA, 15 bp, Homo sapiens
agacagagattgcag

SEQ ID NO: 340232 - DNA, 15 bp, Homo sapiens
gacagagattgcagt

SEQ ID NO: 340233 - DNA, 15 bp, Homo sapiens
acagagattgcagtg

SEQ ID NO: 340234 - DNA, 15 bp, Homo sapiens
agattgcagtgagct

SEQ ID NO: 340235 - DNA, 15 bp, Homo sapiens
gattgcagtgagctg

SEQ ID NO: 340236 - DNA, 15 bp, Homo sapiens
attgcagtgagctga

SEQ ID NO: 340237 - DNA, 15 bp, Homo sapiens
agtgagctgagattc

SEQ ID NO: 340238 - DNA, 15 bp, Homo sapiens
gtgagctgagattca

SEQ ID NO: 340239 - DNA, 15 bp, Homo sapiens
tgagctgagattcag

SEQ ID NO: 340240 - DNA, 15 bp, Homo sapiens
gagctgagattcagc

SEQ ID NO: 340241 - DNA, 15 bp, Homo sapiens
agctgagattcagcc

SEQ ID NO: 340242 - DNA, 15 bp, Homo sapiens
gctgagattcagcca

SEQ ID NO: 340243 - DNA, 15 bp, Homo sapiens
ctgagattcagccac

SEQ ID NO: 340244 - DNA, 15 bp, Homo sapiens
tgagattcagccact

SEQ ID NO: 340245 - DNA, 15 bp, Homo sapiens
gagattcagccactg

SEQ ID NO: 340246 - DNA, 15 bp, Homo sapiens
agattcagccactgc

SEQ ID NO: 340247 - DNA, 15 bp, Homo sapiens
gattcagccactgca

SEQ ID NO: 340248 - DNA, 15 bp, Homo sapiens
attcagccactgcac

SEQ ID NO: 340249 - DNA, 15 bp, Homo sapiens
ttcagccactgcact

SEQ ID NO: 340250 - DNA, 15 bp, Homo sapiens
tcagccactgcactc

SEQ ID NO: 340251 - DNA, 15 bp, Homo sapiens
cagccactgcactcc

SEQ ID NO: 340252 - DNA, 15 bp, Homo sapiens
agccactgcactcca

SEQ ID NO: 340253 - DNA, 15 bp, Homo sapiens
ctgggtaacaaagtg

SEQ ID NO: 340254 - DNA, 15 bp, Homo sapiens
tgggtaacaaagtga

SEQ ID NO: 340255 - DNA, 15 bp, Homo sapiens
gggtaacaaagtgag

SEQ ID NO: 340256 - DNA, 15 bp, Homo sapiens
ggtaacaaagtgaga

SEQ ID NO: 340257 - DNA, 15 bp, Homo sapiens
gtaacaaagtgagac

SEQ ID NO: 340258 - DNA, 15 bp, Homo sapiens
taacaaagtgagact

SEQ ID NO: 340259 - DNA, 15 bp, Homo sapiens
aacaaagtgagactg

SEQ ID NO: 340260 - DNA, 15 bp, Homo sapiens
acaaagtgagactgt

SEQ ID NO: 340261 - DNA, 15 bp, Homo sapiens
caaagtgagactgtc

SEQ ID NO: 340262 - DNA, 15 bp, Homo sapiens
aaagtgagactgtct

SEQ ID NO: 340263 - DNA, 15 bp, Homo sapiens
aagtgagactgtctc

SEQ ID NO: 340264 - DNA, 15 bp, Homo sapiens
agtgagactgtctcc

SEQ ID NO: 340265 - DNA, 15 bp, Homo sapiens
gtgagactgtctcca

SEQ ID NO: 340266 - DNA, 15 bp, Homo sapiens
tgagactgtctccaa

SEQ ID NO: 340267 - DNA, 15 bp, Homo sapiens
gagactgtctccaaa

SEQ ID NO: 340268 - DNA, 15 bp, Homo sapiens
agactgtctccaaaa

SEQ ID NO: 340269 - DNA, 15 bp, Homo sapiens
gactgtctccaaaaa

SEQ ID NO: 340270 - DNA, 15 bp, Homo sapiens
actgtctccaaaaaa

SEQ ID NO: 340271 - DNA, 15 bp, Homo sapiens
ctgtctccaaaaaaa

SEQ ID NO: 340272 - DNA, 15 bp, Homo sapiens
tgtctccaaaaaaag

SEQ ID NO: 340273 - DNA, 15 bp, Homo sapiens
gtctccaaaaaaagg

SEQ ID NO: 340274 - DNA, 15 bp, Homo sapiens
tctccaaaaaaagga

SEQ ID NO: 340275 - DNA, 15 bp, Homo sapiens
ctccaaaaaaaggaa

SEQ ID NO: 340276 - DNA, 15 bp, Homo sapiens
tccaaaaaaaggaaa

SEQ ID NO: 340277 - DNA, 15 bp, Homo sapiens
ccaaaaaaaggaaaa

SEQ ID NO: 340278 - DNA, 15 bp, Homo sapiens
caaaaaaaggaaaag

SEQ ID NO: 340279 - DNA, 15 bp, Homo sapiens
aaaaaaaggaaaaga

SEQ ID NO: 340280 - DNA, 15 bp, Homo sapiens
aaaaaaggaaaagac

SEQ ID NO: 340281 - DNA, 15 bp, Homo sapiens
aaaaaggaaaagaca

SEQ ID NO: 340282 - DNA, 15 bp, Homo sapiens
aaaaggaaaagacat

SEQ ID NO: 340283 - DNA, 15 bp, Homo sapiens
aaaggaaaagacatt

SEQ ID NO: 340284 - DNA, 15 bp, Homo sapiens
aaggaaaagacattt

SEQ ID NO: 340285 - DNA, 15 bp, Homo sapiens
aggaaaagacatttc

SEQ ID NO: 340286 - DNA, 15 bp, Homo sapiens
ggaaaagacatttca

SEQ ID NO: 340287 - DNA, 15 bp, Homo sapiens
gaaaagacatttcat

SEQ ID NO: 340288 - DNA, 15 bp, Homo sapiens
aaaagacatttcata

SEQ ID NO: 340289 - DNA, 15 bp, Homo sapiens
aaagacatttcatag

SEQ ID NO: 340290 - DNA, 15 bp, Homo sapiens
aagacatttcatagg

SEQ ID NO: 340291 - DNA, 15 bp, Homo sapiens
agacatttcataggg

SEQ ID NO: 340292 - DNA, 15 bp, Homo sapiens
gacatttcatagggg

SEQ ID NO: 340293 - DNA, 15 bp, Homo sapiens
acatttcataggggc

SEQ ID NO: 340294 - DNA, 15 bp, Homo sapiens
catttcataggggca

SEQ ID NO: 340295 - DNA, 15 bp, Homo sapiens
atttcataggggcag

SEQ ID NO: 340296 - DNA, 15 bp, Homo sapiens
tttcataggggcagt

SEQ ID NO: 340297 - DNA, 15 bp, Homo sapiens
ttcataggggcagtt

SEQ ID NO: 340298 - DNA, 15 bp, Homo sapiens
tcataggggcagtta

SEQ ID NO: 340299 - DNA, 15 bp, Homo sapiens
cataggggcagttac

SEQ ID NO: 340300 - DNA, 15 bp, Homo sapiens
ataggggcagttact

SEQ ID NO: 340301 - DNA, 15 bp, Homo sapiens
taggggcagttactt

SEQ ID NO: 340302 - DNA, 15 bp, Homo sapiens
aggggcagttactta

SEQ ID NO: 340303 - DNA, 15 bp, Homo sapiens
ggggcagttacttat

SEQ ID NO: 340304 - DNA, 15 bp, Homo sapiens
gggcagttacttatt

SEQ ID NO: 340305 - DNA, 15 bp, Homo sapiens
ggcagttacttattt

SEQ ID NO: 340306 - DNA, 15 bp, Homo sapiens
gcagttacttatttg

SEQ ID NO: 340307 - DNA, 15 bp, Homo sapiens
cagttacttatttgc

SEQ ID NO: 340308 - DNA, 15 bp, Homo sapiens
agttacttatttgca

SEQ ID NO: 340309 - DNA, 15 bp, Homo sapiens
gttacttatttgcaa

SEQ ID NO: 340310 - DNA, 15 bp, Homo sapiens
ttacttatttgcaat

SEQ ID NO: 340311 - DNA, 15 bp, Homo sapiens
tacttatttgcaatg

SEQ ID NO: 340312 - DNA, 15 bp, Homo sapiens
acttatttgcaatgt

SEQ ID NO: 340313 - DNA, 15 bp, Homo sapiens
cttatttgcaatgtt

SEQ ID NO: 340314 - DNA, 15 bp, Homo sapiens
ttatttgcaatgtta

SEQ ID NO: 340315 - DNA, 15 bp, Homo sapiens
tatttgcaatgttaa

SEQ ID NO: 340316 - DNA, 15 bp, Homo sapiens
atttgcaatgttaag

SEQ ID NO: 340317 - DNA, 15 bp, Homo sapiens
tttgcaatgttaaga

SEQ ID NO: 340318 - DNA, 15 bp, Homo sapiens
ttgcaatgttaagat

SEQ ID NO: 340319 - DNA, 15 bp, Homo sapiens
tgcaatgttaagatt

SEQ ID NO: 340320 - DNA, 15 bp, Homo sapiens
gcaatgttaagatta

SEQ ID NO: 340321 - DNA, 15 bp, Homo sapiens
caatgttaagattag

SEQ ID NO: 340322 - DNA, 15 bp, Homo sapiens
aatgttaagattagc

SEQ ID NO: 340323 - DNA, 15 bp, Homo sapiens
atgttaagattagct

SEQ ID NO: 340324 - DNA, 15 bp, Homo sapiens
tgttaagattagcta

SEQ ID NO: 340325 - DNA, 15 bp, Homo sapiens
gttaagattagctaa

SEQ ID NO: 340326 - DNA, 15 bp, Homo sapiens
ttaagattagctaaa

SEQ ID NO: 340327 - DNA, 15 bp, Homo sapiens
taagattagctaaac

SEQ ID NO: 340328 - DNA, 15 bp, Homo sapiens
aagattagctaaaca

SEQ ID NO: 340329 - DNA, 15 bp, Homo sapiens
agattagctaaacat

SEQ ID NO: 340330 - DNA, 15 bp, Homo sapiens
gattagctaaacatt

SEQ ID NO: 340331 - DNA, 15 bp, Homo sapiens
attagctaaacatta

SEQ ID NO: 340332 - DNA, 15 bp, Homo sapiens
ttagctaaacattaa

SEQ ID NO: 340333 - DNA, 15 bp, Homo sapiens
tagctaaacattaac

SEQ ID NO: 340334 - DNA, 15 bp, Homo sapiens
agctaaacattaact

SEQ ID NO: 340335 - DNA, 15 bp, Homo sapiens
gctaaacattaactt

SEQ ID NO: 340336 - DNA, 15 bp, Homo sapiens
ctaaacattaacttg

SEQ ID NO: 340337 - DNA, 15 bp, Homo sapiens
taaacattaacttgg

SEQ ID NO: 340338 - DNA, 15 bp, Homo sapiens
aaacattaacttggt

SEQ ID NO: 340339 - DNA, 15 bp, Homo sapiens
aacattaacttggtg

SEQ ID NO: 340340 - DNA, 15 bp, Homo sapiens
acattaacttggtgt

SEQ ID NO: 340341 - DNA, 15 bp, Homo sapiens
cattaacttggtgtg

SEQ ID NO: 340342 - DNA, 15 bp, Homo sapiens
attaacttggtgtga

SEQ ID NO: 340343 - DNA, 15 bp, Homo sapiens
ttaacttggtgtgaa

SEQ ID NO: 340344 - DNA, 15 bp, Homo sapiens
taacttggtgtgaag

SEQ ID NO: 340345 - DNA, 15 bp, Homo sapiens
aacttggtgtgaaga

SEQ ID NO: 340346 - DNA, 15 bp, Homo sapiens
acttggtgtgaagac

SEQ ID NO: 340347 - DNA, 15 bp, Homo sapiens
cttggtgtgaagaca

SEQ ID NO: 340348 - DNA, 15 bp, Homo sapiens
ttggtgtgaagacag

SEQ ID NO: 340349 - DNA, 15 bp, Homo sapiens
tggtgtgaagacagg

SEQ ID NO: 340350 - DNA, 15 bp, Homo sapiens
ggtgtgaagacagga

SEQ ID NO: 340351 - DNA, 15 bp, Homo sapiens
gtgtgaagacaggac

SEQ ID NO: 340352 - DNA, 15 bp, Homo sapiens
tgtgaagacaggact

SEQ ID NO: 340353 - DNA, 15 bp, Homo sapiens
gtgaagacaggacta

SEQ ID NO: 340354 - DNA, 15 bp, Homo sapiens
tgaagacaggactat

SEQ ID NO: 340355 - DNA, 15 bp, Homo sapiens
gaagacaggactatg

SEQ ID NO: 340356 - DNA, 15 bp, Homo sapiens
aagacaggactatgg

SEQ ID NO: 340357 - DNA, 15 bp, Homo sapiens
agacaggactatgga

SEQ ID NO: 340358 - DNA, 15 bp, Homo sapiens
gacaggactatggag

SEQ ID NO: 340359 - DNA, 15 bp, Homo sapiens
acaggactatggagt

SEQ ID NO: 340360 - DNA, 15 bp, Homo sapiens
caggactatggagta

SEQ ID NO: 340361 - DNA, 15 bp, Homo sapiens
aggactatggagtat

SEQ ID NO: 340362 - DNA, 15 bp, Homo sapiens
ggactatggagtatt

SEQ ID NO: 340363 - DNA, 15 bp, Homo sapiens
gactatggagtattg

SEQ ID NO: 340364 - DNA, 15 bp, Homo sapiens
actatggagtattga

SEQ ID NO: 340365 - DNA, 15 bp, Homo sapiens
ctatggagtattgat

SEQ ID NO: 340366 - DNA, 15 bp, Homo sapiens
tatggagtattgatc

SEQ ID NO: 340367 - DNA, 15 bp, Homo sapiens
atggagtattgatct

SEQ ID NO: 340368 - DNA, 15 bp, Homo sapiens
tggagtattgatcta

SEQ ID NO: 340369 - DNA, 15 bp, Homo sapiens
ggagtattgatctac

SEQ ID NO: 340370 - DNA, 15 bp, Homo sapiens
gagtattgatctact

SEQ ID NO: 340371 - DNA, 15 bp, Homo sapiens
agtattgatctactt

SEQ ID NO: 340372 - DNA, 15 bp, Homo sapiens
gtattgatctacttt

SEQ ID NO: 340373 - DNA, 15 bp, Homo sapiens
tattgatctactttt

SEQ ID NO: 340374 - DNA, 15 bp, Homo sapiens
attgatctacttttc

SEQ ID NO: 340375 - DNA, 15 bp, Homo sapiens
ttgatctacttttcc

SEQ ID NO: 340376 - DNA, 15 bp, Homo sapiens
tgatctacttttcca

SEQ ID NO: 340377 - DNA, 15 bp, Homo sapiens
gatctacttttccat

SEQ ID NO: 340378 - DNA, 15 bp, Homo sapiens
atctacttttccatt

SEQ ID NO: 340379 - DNA, 15 bp, Homo sapiens
tctacttttccattt

SEQ ID NO: 340380 - DNA, 15 bp, Homo sapiens
ctacttttccatttt

SEQ ID NO: 340381 - DNA, 15 bp, Homo sapiens
tacttttccattttg

SEQ ID NO: 340382 - DNA, 15 bp, Homo sapiens
acttttccattttgt

SEQ ID NO: 340383 - DNA, 15 bp, Homo sapiens
cttttccattttgtg

SEQ ID NO: 340384 - DNA, 15 bp, Homo sapiens
ttttccattttgtga

SEQ ID NO: 340385 - DNA, 15 bp, Homo sapiens
tttccattttgtgac

SEQ ID NO: 340386 - DNA, 15 bp, Homo sapiens
ttccattttgtgact

SEQ ID NO: 340387 - DNA, 15 bp, Homo sapiens
tccattttgtgactt

SEQ ID NO: 340388 - DNA, 15 bp, Homo sapiens
ccattttgtgacttt

SEQ ID NO: 340389 - DNA, 15 bp, Homo sapiens
cattttgtgactttt

SEQ ID NO: 340390 - DNA, 15 bp, Homo sapiens
attttgtgactttta

SEQ ID NO: 340391 - DNA, 15 bp, Homo sapiens
ttttgtgacttttat

SEQ ID NO: 340392 - DNA, 15 bp, Homo sapiens
tttgtgacttttatt

SEQ ID NO: 340393 - DNA, 15 bp, Homo sapiens
ttgtgacttttattt

SEQ ID NO: 340394 - DNA, 15 bp, Homo sapiens
tgtgacttttatttt

SEQ ID NO: 340395 - DNA, 15 bp, Homo sapiens
gtgacttttatttta

SEQ ID NO: 340396 - DNA, 15 bp, Homo sapiens
tgacttttattttaa

SEQ ID NO: 340397 - DNA, 15 bp, Homo sapiens
gacttttattttaaa

SEQ ID NO: 340398 - DNA, 15 bp, Homo sapiens
acttttattttaaag

SEQ ID NO: 340399 - DNA, 15 bp, Homo sapiens
cttttattttaaagc

SEQ ID NO: 340400 - DNA, 15 bp, Homo sapiens
ttttattttaaagct

SEQ ID NO: 340401 - DNA, 15 bp, Homo sapiens
tttattttaaagctt

SEQ ID NO: 340402 - DNA, 15 bp, Homo sapiens
ttattttaaagcttt

SEQ ID NO: 340403 - DNA, 15 bp, Homo sapiens
tattttaaagctttc

SEQ ID NO: 340404 - DNA, 15 bp, Homo sapiens
attttaaagctttct

SEQ ID NO: 340405 - DNA, 15 bp, Homo sapiens
ttttaaagctttctc

SEQ ID NO: 340406 - DNA, 15 bp, Homo sapiens
tttaaagctttctca

SEQ ID NO: 340407 - DNA, 15 bp, Homo sapiens
ttaaagctttctcat

SEQ ID NO: 340408 - DNA, 15 bp, Homo sapiens
taaagctttctcatg

SEQ ID NO: 340409 - DNA, 15 bp, Homo sapiens
aaagctttctcatgg

SEQ ID NO: 340410 - DNA, 15 bp, Homo sapiens
aagctttctcatggt

SEQ ID NO: 340411 - DNA, 15 bp, Homo sapiens
agctttctcatggtt

SEQ ID NO: 340412 - DNA, 15 bp, Homo sapiens
gctttctcatggttt

SEQ ID NO: 340413 - DNA, 15 bp, Homo sapiens
ctttctcatggttta

SEQ ID NO: 340414 - DNA, 15 bp, Homo sapiens
tttctcatggtttat

SEQ ID NO: 340415 - DNA, 15 bp, Homo sapiens
ttctcatggtttatt

SEQ ID NO: 340416 - DNA, 15 bp, Homo sapiens
tctcatggtttattt

SEQ ID NO: 340417 - DNA, 15 bp, Homo sapiens
ctcatggtttatttt

SEQ ID NO: 340418 - DNA, 15 bp, Homo sapiens
tcatggtttatttta

SEQ ID NO: 340419 - DNA, 15 bp, Homo sapiens
catggtttattttat

SEQ ID NO: 340420 - DNA, 15 bp, Homo sapiens
atggtttattttatt

SEQ ID NO: 340421 - DNA, 15 bp, Homo sapiens
tggtttattttattt

SEQ ID NO: 340422 - DNA, 15 bp, Homo sapiens
ggtttattttatttc

SEQ ID NO: 340423 - DNA, 15 bp, Homo sapiens
gtttattttatttca

SEQ ID NO: 340424 - DNA, 15 bp, Homo sapiens
tttattttatttcat

SEQ ID NO: 340425 - DNA, 15 bp, Homo sapiens
ttattttatttcatg

SEQ ID NO: 340426 - DNA, 15 bp, Homo sapiens
tattttatttcatgt

SEQ ID NO: 340427 - DNA, 15 bp, Homo sapiens
attttatttcatgta

SEQ ID NO: 340428 - DNA, 15 bp, Homo sapiens
ttttatttcatgtat

SEQ ID NO: 340429 - DNA, 15 bp, Homo sapiens
tttatttcatgtatt

SEQ ID NO: 340430 - DNA, 15 bp, Homo sapiens
ttatttcatgtattg

SEQ ID NO: 340431 - DNA, 15 bp, Homo sapiens
tatttcatgtattgt

SEQ ID NO: 340432 - DNA, 15 bp, Homo sapiens
atttcatgtattgtg

SEQ ID NO: 340433 - DNA, 15 bp, Homo sapiens
tttcatgtattgtgt

SEQ ID NO: 340434 - DNA, 15 bp, Homo sapiens
ttcatgtattgtgtc

SEQ ID NO: 340435 - DNA, 15 bp, Homo sapiens
tcatgtattgtgtct

SEQ ID NO: 340436 - DNA, 15 bp, Homo sapiens
catgtattgtgtctt

SEQ ID NO: 340437 - DNA, 15 bp, Homo sapiens
atgtattgtgtctta

SEQ ID NO: 340438 - DNA, 15 bp, Homo sapiens
tgtattgtgtcttaa

SEQ ID NO: 340439 - DNA, 15 bp, Homo sapiens
gtattgtgtcttaag

SEQ ID NO: 340440 - DNA, 15 bp, Homo sapiens
tattgtgtcttaagg

SEQ ID NO: 340441 - DNA, 15 bp, Homo sapiens
attgtgtcttaagga

SEQ ID NO: 340442 - DNA, 15 bp, Homo sapiens
ttgtgtcttaaggag

SEQ ID NO: 340443 - DNA, 15 bp, Homo sapiens
tgtgtcttaaggagc

SEQ ID NO: 340444 - DNA, 15 bp, Homo sapiens
gtgtcttaaggagca

SEQ ID NO: 340445 - DNA, 15 bp, Homo sapiens
tgtcttaaggagcaa

SEQ ID NO: 340446 - DNA, 15 bp, Homo sapiens
gtcttaaggagcaaa

SEQ ID NO: 340447 - DNA, 15 bp, Homo sapiens
tcttaaggagcaaac

SEQ ID NO: 340448 - DNA, 15 bp, Homo sapiens
cttaaggagcaaact

SEQ ID NO: 340449 - DNA, 15 bp, Homo sapiens
ttaaggagcaaactg

SEQ ID NO: 340450 - DNA, 15 bp, Homo sapiens
taaggagcaaactgc

SEQ ID NO: 340451 - DNA, 15 bp, Homo sapiens
aaggagcaaactgca

SEQ ID NO: 340452 - DNA, 15 bp, Homo sapiens
aggagcaaactgcat

SEQ ID NO: 340453 - DNA, 15 bp, Homo sapiens
ggagcaaactgcatt

SEQ ID NO: 340454 - DNA, 15 bp, Homo sapiens
gagcaaactgcattc

SEQ ID NO: 340455 - DNA, 15 bp, Homo sapiens
agcaaactgcattca

SEQ ID NO: 340456 - DNA, 15 bp, Homo sapiens
gcaaactgcattcat

SEQ ID NO: 340457 - DNA, 15 bp, Homo sapiens
caaactgcattcatt

SEQ ID NO: 340458 - DNA, 15 bp, Homo sapiens
aaactgcattcattg

SEQ ID NO: 340459 - DNA, 15 bp, Homo sapiens
aactgcattcattgc

SEQ ID NO: 340460 - DNA, 15 bp, Homo sapiens
actgcattcattgcc

SEQ ID NO: 340461 - DNA, 15 bp, Homo sapiens
ctgcattcattgcca

SEQ ID NO: 340462 - DNA, 15 bp, Homo sapiens
tgcattcattgccac

SEQ ID NO: 340463 - DNA, 15 bp, Homo sapiens
gcattcattgccact

SEQ ID NO: 340464 - DNA, 15 bp, Homo sapiens
cattcattgccactt

SEQ ID NO: 340465 - DNA, 15 bp, Homo sapiens
attcattgccacttc

SEQ ID NO: 340466 - DNA, 15 bp, Homo sapiens
ttcattgccacttcc

SEQ ID NO: 340467 - DNA, 15 bp, Homo sapiens
cattgccacttccac

SEQ ID NO: 340468 - DNA, 15 bp, Homo sapiens
attgccacttccacc

SEQ ID NO: 340469 - DNA, 15 bp, Homo sapiens
ttgccacttccacct

SEQ ID NO: 340470 - DNA, 15 bp, Homo sapiens
tgccacttccaccta

SEQ ID NO: 340471 - DNA, 15 bp, Homo sapiens
gccacttccacctat

SEQ ID NO: 340472 - DNA, 15 bp, Homo sapiens
ccacttccacctatt

SEQ ID NO: 340473 - DNA, 15 bp, Homo sapiens
cacttccacctattt

SEQ ID NO: 340474 - DNA, 15 bp, Homo sapiens
acttccacctattta

SEQ ID NO: 340475 - DNA, 15 bp, Homo sapiens
cttccacctatttaa

SEQ ID NO: 340476 - DNA, 15 bp, Homo sapiens
ttccacctatttaat

SEQ ID NO: 340477 - DNA, 15 bp, Homo sapiens
tccacctatttaata

SEQ ID NO: 340478 - DNA, 15 bp, Homo sapiens
ccacctatttaataa

SEQ ID NO: 340479 - DNA, 15 bp, Homo sapiens
cacctatttaataag

SEQ ID NO: 340480 - DNA, 15 bp, Homo sapiens
acctatttaataagc

SEQ ID NO: 340481 - DNA, 15 bp, Homo sapiens
cctatttaataagca

SEQ ID NO: 340482 - DNA, 15 bp, Homo sapiens
ctatttaataagcag

SEQ ID NO: 340483 - DNA, 15 bp, Homo sapiens
tatttaataagcagg

SEQ ID NO: 340484 - DNA, 15 bp, Homo sapiens
atttaataagcagga

SEQ ID NO: 340485 - DNA, 15 bp, Homo sapiens
tttaataagcaggaa

SEQ ID NO: 340486 - DNA, 15 bp, Homo sapiens
ttaataagcaggaat

SEQ ID NO: 340487 - DNA, 15 bp, Homo sapiens
taataagcaggaatt

SEQ ID NO: 340488 - DNA, 15 bp, Homo sapiens
aataagcaggaattc

SEQ ID NO: 340489 - DNA, 15 bp, Homo sapiens
ataagcaggaattcc

SEQ ID NO: 340490 - DNA, 15 bp, Homo sapiens
taagcaggaattcct

SEQ ID NO: 340491 - DNA, 15 bp, Homo sapiens
aagcaggaattcctg

SEQ ID NO: 340492 - DNA, 15 bp, Homo sapiens
agcaggaattcctga

SEQ ID NO: 340493 - DNA, 15 bp, Homo sapiens
gcaggaattcctgat

SEQ ID NO: 340494 - DNA, 15 bp, Homo sapiens
caggaattcctgatt

SEQ ID NO: 340495 - DNA, 15 bp, Homo sapiens
aggaattcctgattg

SEQ ID NO: 340496 - DNA, 15 bp, Homo sapiens
ggaattcctgattga

SEQ ID NO: 340497 - DNA, 15 bp, Homo sapiens
gaattcctgattgaa

SEQ ID NO: 340498 - DNA, 15 bp, Homo sapiens
aattcctgattgaag

SEQ ID NO: 340499 - DNA, 15 bp, Homo sapiens
attcctgattgaaga

SEQ ID NO: 340500 - DNA, 15 bp, Homo sapiens
ttcctgattgaagaa

SEQ ID NO: 340501 - DNA, 15 bp, Homo sapiens
tcctgattgaagaaa

SEQ ID NO: 340502 - DNA, 15 bp, Homo sapiens
cctgattgaagaaac

SEQ ID NO: 340503 - DNA, 15 bp, Homo sapiens
ctgattgaagaaaca

SEQ ID NO: 340504 - DNA, 15 bp, Homo sapiens
tgattgaagaaacaa

SEQ ID NO: 340505 - DNA, 15 bp, Homo sapiens
gattgaagaaacaat

SEQ ID NO: 340506 - DNA, 15 bp, Homo sapiens
attgaagaaacaatg

SEQ ID NO: 340507 - DNA, 15 bp, Homo sapiens
ttgaagaaacaatga

SEQ ID NO: 340508 - DNA, 15 bp, Homo sapiens
tgaagaaacaatgat

SEQ ID NO: 340509 - DNA, 15 bp, Homo sapiens
gaagaaacaatgatt

SEQ ID NO: 340510 - DNA, 15 bp, Homo sapiens
aagaaacaatgattc

SEQ ID NO: 340511 - DNA, 15 bp, Homo sapiens
agaaacaatgattct

SEQ ID NO: 340512 - DNA, 15 bp, Homo sapiens
gaaacaatgattctg

SEQ ID NO: 340513 - DNA, 15 bp, Homo sapiens
aaacaatgattctga

SEQ ID NO: 340514 - DNA, 15 bp, Homo sapiens
aacaatgattctgat

SEQ ID NO: 340515 - DNA, 15 bp, Homo sapiens
acaatgattctgata

SEQ ID NO: 340516 - DNA, 15 bp, Homo sapiens
caatgattctgatat

SEQ ID NO: 340517 - DNA, 15 bp, Homo sapiens
aatgattctgatatg

SEQ ID NO: 340518 - DNA, 15 bp, Homo sapiens
atgattctgatatga

SEQ ID NO: 340519 - DNA, 15 bp, Homo sapiens
tgattctgatatgaa

SEQ ID NO: 340520 - DNA, 15 bp, Homo sapiens
gattctgatatgaat

SEQ ID NO: 340521 - DNA, 15 bp, Homo sapiens
attctgatatgaata

SEQ ID NO: 340522 - DNA, 15 bp, Homo sapiens
ttctgatatgaatac

SEQ ID NO: 340523 - DNA, 15 bp, Homo sapiens
tctgatatgaataca

SEQ ID NO: 340524 - DNA, 15 bp, Homo sapiens
ctgatatgaatacag

SEQ ID NO: 340525 - DNA, 15 bp, Homo sapiens
tgatatgaatacagg

SEQ ID NO: 340526 - DNA, 15 bp, Homo sapiens
gatatgaatacaggg

SEQ ID NO: 340527 - DNA, 15 bp, Homo sapiens
atatgaatacagggt

SEQ ID NO: 340528 - DNA, 15 bp, Homo sapiens
tatgaatacagggtg

SEQ ID NO: 340529 - DNA, 15 bp, Homo sapiens
atgaatacagggtgc

SEQ ID NO: 340530 - DNA, 15 bp, Homo sapiens
tgaatacagggtgct

SEQ ID NO: 340531 - DNA, 15 bp, Homo sapiens
gaatacagggtgctg

SEQ ID NO: 340532 - DNA, 15 bp, Homo sapiens
aatacagggtgctgc

SEQ ID NO: 340533 - DNA, 15 bp, Homo sapiens
atacagggtgctgct

SEQ ID NO: 340534 - DNA, 15 bp, Homo sapiens
tacagggtgctgctt

SEQ ID NO: 340535 - DNA, 15 bp, Homo sapiens
acagggtgctgcttt

SEQ ID NO: 340536 - DNA, 15 bp, Homo sapiens
cagggtgctgctttt

SEQ ID NO: 340537 - DNA, 15 bp, Homo sapiens
agggtgctgcttttt

SEQ ID NO: 340538 - DNA, 15 bp, Homo sapiens
gggtgctgctttttg

SEQ ID NO: 340539 - DNA, 15 bp, Homo sapiens
ggtgctgctttttgc

SEQ ID NO: 340540 - DNA, 15 bp, Homo sapiens
gtgctgctttttgca

SEQ ID NO: 340541 - DNA, 15 bp, Homo sapiens
tgctgctttttgcat

SEQ ID NO: 340542 - DNA, 15 bp, Homo sapiens
gctgctttttgcatt

SEQ ID NO: 340543 - DNA, 15 bp, Homo sapiens
ctgctttttgcattc

SEQ ID NO: 340544 - DNA, 15 bp, Homo sapiens
tgctttttgcattct

SEQ ID NO: 340545 - DNA, 15 bp, Homo sapiens
gctttttgcattctt

SEQ ID NO: 340546 - DNA, 15 bp, Homo sapiens
ctttttgcattcttt

SEQ ID NO: 340547 - DNA, 15 bp, Homo sapiens
tttttgcattctttg

SEQ ID NO: 340548 - DNA, 15 bp, Homo sapiens
ttttgcattctttgt

SEQ ID NO: 340549 - DNA, 15 bp, Homo sapiens
tttgcattctttgtc

SEQ ID NO: 340550 - DNA, 15 bp, Homo sapiens
ttgcattctttgtct

SEQ ID NO: 340551 - DNA, 15 bp, Homo sapiens
tgcattctttgtctg

SEQ ID NO: 340552 - DNA, 15 bp, Homo sapiens
gcattctttgtctgc

SEQ ID NO: 340553 - DNA, 15 bp, Homo sapiens
cattctttgtctgca

SEQ ID NO: 340554 - DNA, 15 bp, Homo sapiens
attctttgtctgcat

SEQ ID NO: 340555 - DNA, 15 bp, Homo sapiens
ttctttgtctgcatt

SEQ ID NO: 340556 - DNA, 15 bp, Homo sapiens
tctttgtctgcattt

SEQ ID NO: 340557 - DNA, 15 bp, Homo sapiens
ctttgtctgcattta

SEQ ID NO: 340558 - DNA, 15 bp, Homo sapiens
tttgtctgcatttaa

SEQ ID NO: 340559 - DNA, 15 bp, Homo sapiens
ttgtctgcatttaat

SEQ ID NO: 340560 - DNA, 15 bp, Homo sapiens
tgtctgcatttaatg

SEQ ID NO: 340561 - DNA, 15 bp, Homo sapiens
gtctgcatttaatga

SEQ ID NO: 340562 - DNA, 15 bp, Homo sapiens
tctgcatttaatgaa

SEQ ID NO: 340563 - DNA, 15 bp, Homo sapiens
ctgcatttaatgaac

SEQ ID NO: 340564 - DNA, 15 bp, Homo sapiens
tgcatttaatgaact

SEQ ID NO: 340565 - DNA, 15 bp, Homo sapiens
gcatttaatgaactc

SEQ ID NO: 340566 - DNA, 15 bp, Homo sapiens
catttaatgaactcc

SEQ ID NO: 340567 - DNA, 15 bp, Homo sapiens
atttaatgaactcca

SEQ ID NO: 340568 - DNA, 15 bp, Homo sapiens
tttaatgaactccat

SEQ ID NO: 340569 - DNA, 15 bp, Homo sapiens
ttaatgaactccatt

SEQ ID NO: 340570 - DNA, 15 bp, Homo sapiens
taatgaactccattt

SEQ ID NO: 340571 - DNA, 15 bp, Homo sapiens
aatgaactccattta

SEQ ID NO: 340572 - DNA, 15 bp, Homo sapiens
atgaactccatttag

SEQ ID NO: 340573 - DNA, 15 bp, Homo sapiens
tgaactccatttagg

SEQ ID NO: 340574 - DNA, 15 bp, Homo sapiens
gaactccatttagga

SEQ ID NO: 340575 - DNA, 15 bp, Homo sapiens
aactccatttaggac

SEQ ID NO: 340576 - DNA, 15 bp, Homo sapiens
actccatttaggaca

SEQ ID NO: 340577 - DNA, 15 bp, Homo sapiens
ctccatttaggacaa

SEQ ID NO: 340578 - DNA, 15 bp, Homo sapiens
tccatttaggacaaa

SEQ ID NO: 340579 - DNA, 15 bp, Homo sapiens
ccatttaggacaaaa

SEQ ID NO: 340580 - DNA, 15 bp, Homo sapiens
catttaggacaaaat

SEQ ID NO: 340581 - DNA, 15 bp, Homo sapiens
atttaggacaaaata

SEQ ID NO: 340582 - DNA, 15 bp, Homo sapiens
tttaggacaaaataa

SEQ ID NO: 340583 - DNA, 15 bp, Homo sapiens
ttaggacaaaataaa

SEQ ID NO: 340584 - DNA, 15 bp, Homo sapiens
taggacaaaataaaa

SEQ ID NO: 340585 - DNA, 15 bp, Homo sapiens
aggacaaaataaaag

SEQ ID NO: 340586 - DNA, 15 bp, Homo sapiens
ggacaaaataaaagt

SEQ ID NO: 340587 - DNA, 15 bp, Homo sapiens
gacaaaataaaagtt

SEQ ID NO: 340588 - DNA, 15 bp, Homo sapiens
acaaaataaaagttt

SEQ ID NO: 340589 - DNA, 15 bp, Homo sapiens
caaaataaaagttta

SEQ ID NO: 340590 - DNA, 15 bp, Homo sapiens
aaaataaaagtttac

SEQ ID NO: 340591 - DNA, 15 bp, Homo sapiens
aaataaaagtttact

SEQ ID NO: 340592 - DNA, 15 bp, Homo sapiens
aataaaagtttactt

SEQ ID NO: 340593 - DNA, 15 bp, Homo sapiens
ataaaagtttacttt

SEQ ID NO: 340594 - DNA, 15 bp, Homo sapiens
taaaagtttactttc

SEQ ID NO: 340595 - DNA, 15 bp, Homo sapiens
aaaagtttactttcc

SEQ ID NO: 340596 - DNA, 15 bp, Homo sapiens
aaagtttactttcct

SEQ ID NO: 340597 - DNA, 15 bp, Homo sapiens
aagtttactttcctg

SEQ ID NO: 340598 - DNA, 15 bp, Homo sapiens
agtttactttcctgg

SEQ ID NO: 340599 - DNA, 15 bp, Homo sapiens
gtttactttcctggc

SEQ ID NO: 340600 - DNA, 15 bp, Homo sapiens
tttactttcctggct

SEQ ID NO: 340601 - DNA, 15 bp, Homo sapiens
ttactttcctggctt

SEQ ID NO: 340602 - DNA, 15 bp, Homo sapiens
tactttcctggcttc

SEQ ID NO: 340603 - DNA, 15 bp, Homo sapiens
actttcctggcttct

SEQ ID NO: 340604 - DNA, 15 bp, Homo sapiens
ctttcctggcttcta

SEQ ID NO: 340605 - DNA, 15 bp, Homo sapiens
tttcctggcttctat

SEQ ID NO: 340606 - DNA, 15 bp, Homo sapiens
ttcctggcttctata

SEQ ID NO: 340607 - DNA, 15 bp, Homo sapiens
tcctggcttctatat

SEQ ID NO: 340608 - DNA, 15 bp, Homo sapiens
cctggcttctatatt

SEQ ID NO: 340609 - DNA, 15 bp, Homo sapiens
ctggcttctatattt

SEQ ID NO: 340610 - DNA, 15 bp, Homo sapiens
tggcttctatattta

SEQ ID NO: 340611 - DNA, 15 bp, Homo sapiens
ggcttctatatttaa

SEQ ID NO: 340612 - DNA, 15 bp, Homo sapiens
gcttctatatttaaa

SEQ ID NO: 340613 - DNA, 15 bp, Homo sapiens
cttctatatttaaag

SEQ ID NO: 340614 - DNA, 15 bp, Homo sapiens
ttctatatttaaaga

SEQ ID NO: 340615 - DNA, 15 bp, Homo sapiens
tctatatttaaagac

SEQ ID NO: 340616 - DNA, 15 bp, Homo sapiens
ctatatttaaagact

SEQ ID NO: 340617 - DNA, 15 bp, Homo sapiens
tatatttaaagacta

SEQ ID NO: 340618 - DNA, 15 bp, Homo sapiens
atatttaaagactaa

SEQ ID NO: 340619 - DNA, 15 bp, Homo sapiens
tatttaaagactaaa

SEQ ID NO: 340620 - DNA, 15 bp, Homo sapiens
atttaaagactaaat

SEQ ID NO: 340621 - DNA, 15 bp, Homo sapiens
tttaaagactaaatg

SEQ ID NO: 340622 - DNA, 15 bp, Homo sapiens
ttaaagactaaatgc

SEQ ID NO: 340623 - DNA, 15 bp, Homo sapiens
taaagactaaatgct

SEQ ID NO: 340624 - DNA, 15 bp, Homo sapiens
aaagactaaatgcta

SEQ ID NO: 340625 - DNA, 15 bp, Homo sapiens
aagactaaatgctac

SEQ ID NO: 340626 - DNA, 15 bp, Homo sapiens
agactaaatgctacc

SEQ ID NO: 340627 - DNA, 15 bp, Homo sapiens
gactaaatgctacct

SEQ ID NO: 340628 - DNA, 15 bp, Homo sapiens
actaaatgctacctt

SEQ ID NO: 340629 - DNA, 15 bp, Homo sapiens
ctaaatgctaccttg

SEQ ID NO: 340630 - DNA, 15 bp, Homo sapiens
taaatgctaccttga

SEQ ID NO: 340631 - DNA, 15 bp, Homo sapiens
aaatgctaccttgaa

SEQ ID NO: 340632 - DNA, 15 bp, Homo sapiens
aatgctaccttgaat

SEQ ID NO: 340633 - DNA, 15 bp, Homo sapiens
atgctaccttgaatg

SEQ ID NO: 340634 - DNA, 15 bp, Homo sapiens
tgctaccttgaatgt

SEQ ID NO: 340635 - DNA, 15 bp, Homo sapiens
gctaccttgaatgtt

SEQ ID NO: 340636 - DNA, 15 bp, Homo sapiens
ctaccttgaatgttt

SEQ ID NO: 340637 - DNA, 15 bp, Homo sapiens
taccttgaatgttta

SEQ ID NO: 340638 - DNA, 15 bp, Homo sapiens
accttgaatgtttag

SEQ ID NO: 340639 - DNA, 15 bp, Homo sapiens
ccttgaatgtttaga

SEQ ID NO: 340640 - DNA, 15 bp, Homo sapiens
cttgaatgtttagac

SEQ ID NO: 340641 - DNA, 15 bp, Homo sapiens
ttgaatgtttagaca

SEQ ID NO: 340642 - DNA, 15 bp, Homo sapiens
tgaatgtttagacaa

SEQ ID NO: 340643 - DNA, 15 bp, Homo sapiens
gaatgtttagacaag

SEQ ID NO: 340644 - DNA, 15 bp, Homo sapiens
aatgtttagacaagg

SEQ ID NO: 340645 - DNA, 15 bp, Homo sapiens
atgtttagacaaggg

SEQ ID NO: 340646 - DNA, 15 bp, Homo sapiens
tgtttagacaagggt

SEQ ID NO: 340647 - DNA, 15 bp, Homo sapiens
gtttagacaagggtg

SEQ ID NO: 340648 - DNA, 15 bp, Homo sapiens
tttagacaagggtgt

SEQ ID NO: 340649 - DNA, 15 bp, Homo sapiens
ttagacaagggtgtc

SEQ ID NO: 340650 - DNA, 15 bp, Homo sapiens
tagacaagggtgtct

SEQ ID NO: 340651 - DNA, 15 bp, Homo sapiens
agacaagggtgtctt

SEQ ID NO: 340652 - DNA, 15 bp, Homo sapiens
gacaagggtgtcttc

SEQ ID NO: 340653 - DNA, 15 bp, Homo sapiens
acaagggtgtcttcc

SEQ ID NO: 340654 - DNA, 15 bp, Homo sapiens
caagggtgtcttccc

SEQ ID NO: 340655 - DNA, 15 bp, Homo sapiens
aagggtgtcttccct

SEQ ID NO: 340656 - DNA, 15 bp, Homo sapiens
agggtgtcttccctt

SEQ ID NO: 340657 - DNA, 15 bp, Homo sapiens
gggtgtcttcccttg

SEQ ID NO: 340658 - DNA, 15 bp, Homo sapiens
ggtgtcttcccttgc

SEQ ID NO: 340659 - DNA, 15 bp, Homo sapiens
gtgtcttcccttgcc

SEQ ID NO: 340660 - DNA, 15 bp, Homo sapiens
tgtcttcccttgccc

SEQ ID NO: 340661 - DNA, 15 bp, Homo sapiens
gtcttcccttgccct

SEQ ID NO: 340662 - DNA, 15 bp, Homo sapiens
tcttcccttgccctg

SEQ ID NO: 340663 - DNA, 15 bp, Homo sapiens
cttcccttgccctgt

SEQ ID NO: 340664 - DNA, 15 bp, Homo sapiens
ttcccttgccctgta

SEQ ID NO: 340665 - DNA, 15 bp, Homo sapiens
tcccttgccctgtat

SEQ ID NO: 340666 - DNA, 15 bp, Homo sapiens
cccttgccctgtatc

SEQ ID NO: 340667 - DNA, 15 bp, Homo sapiens
ccttgccctgtatct

SEQ ID NO: 340668 - DNA, 15 bp, Homo sapiens
cttgccctgtatctc

SEQ ID NO: 340669 - DNA, 15 bp, Homo sapiens
ttgccctgtatctcc

SEQ ID NO: 340670 - DNA, 15 bp, Homo sapiens
tgccctgtatctccg

SEQ ID NO: 340671 - DNA, 15 bp, Homo sapiens
gccctgtatctccgg

SEQ ID NO: 340672 - DNA, 15 bp, Homo sapiens
ccctgtatctccggt

SEQ ID NO: 340673 - DNA, 15 bp, Homo sapiens
cctgtatctccggtg

SEQ ID NO: 340674 - DNA, 15 bp, Homo sapiens
ctgtatctccggtgc

SEQ ID NO: 340675 - DNA, 15 bp, Homo sapiens
tgtatctccggtgcc

SEQ ID NO: 340676 - DNA, 15 bp, Homo sapiens
gtatctccggtgccc

SEQ ID NO: 340677 - DNA, 15 bp, Homo sapiens
tatctccggtgccca

SEQ ID NO: 340678 - DNA, 15 bp, Homo sapiens
atctccggtgcccag

SEQ ID NO: 340679 - DNA, 15 bp, Homo sapiens
tctccggtgcccaga

SEQ ID NO: 340680 - DNA, 15 bp, Homo sapiens
ctccggtgcccagaa

SEQ ID NO: 340681 - DNA, 15 bp, Homo sapiens
tccggtgcccagaat

SEQ ID NO: 340682 - DNA, 15 bp, Homo sapiens
ccggtgcccagaatg

SEQ ID NO: 340683 - DNA, 15 bp, Homo sapiens
cggtgcccagaatgt

SEQ ID NO: 340684 - DNA, 15 bp, Homo sapiens
ggtgcccagaatgta

SEQ ID NO: 340685 - DNA, 15 bp, Homo sapiens
gtgcccagaatgtat

SEQ ID NO: 340686 - DNA, 15 bp, Homo sapiens
tgcccagaatgtata

SEQ ID NO: 340687 - DNA, 15 bp, Homo sapiens
gcccagaatgtatat
